United States Patent 11,293,017 (OLIGONUCLEOTIDE PROBES AND USES THEREOF) - sequence listing, part 3

SEQ ID NO: 47541 - DNA, 35 bp, Artificial Sequence
  Synthetic oligonucleotide
gagcgaacacgtccagccactcgcctaggtttcat

SEQ ID NO: 47542 - DNA, 35 bp, Artificial Sequence
  Synthetic oligonucleotide
gactctgtacagcggaacaccggctaatttcacct

SEQ ID NO: 47543 - DNA, 35 bp, Artificial Sequence
  Synthetic oligonucleotide
gttaaggctggcctcccattgctgttttttttgct

SEQ ID NO: 47544 - DNA, 35 bp, Artificial Sequence
  Synthetic oligonucleotide
aattggtggggggggatactttgacaaggcaaggt

SEQ ID NO: 47545 - DNA, 35 bp, Artificial Sequence
  Synthetic oligonucleotide
agacgccgagtcgcaccccacccattaactgttgt

SEQ ID NO: 47546 - DNA, 35 bp, Artificial Sequence
  Synthetic oligonucleotide
accgccatgccctacctcactatcataaactgaaa

SEQ ID NO: 47547 - DNA, 36 bp, Artificial Sequence
  Synthetic oligonucleotide
gccaaacaatgcgtaacgccacctcgccaatccaca

SEQ ID NO: 47548 - DNA, 34 bp, Artificial Sequence
  Synthetic oligonucleotide
agccggtactcgccagtatacttcccacgcccca

SEQ ID NO: 47549 - DNA, 36 bp, Artificial Sequence
  Synthetic oligonucleotide
tcacccattctcccctgattataggtgctttcccca

SEQ ID NO: 47550 - DNA, 36 bp, Artificial Sequence
  Synthetic oligonucleotide
accgcacctcacgcaatagtatcatcttgcaaggca

SEQ ID NO: 47551 - DNA, 36 bp, Artificial Sequence
  Synthetic oligonucleotide
gcacacaatcgatccgaagccacctccagccgatca

SEQ ID NO: 47552 - DNA, 36 bp, Artificial Sequence
  Synthetic oligonucleotide
ttctccccctgccattgagacgctccaaagagctca

SEQ ID NO: 47553 - DNA, 36 bp, Artificial Sequence
  Synthetic oligonucleotide
gtgcctggcgtattgacttcatctactgacctttca

SEQ ID NO: 47554 - DNA, 36 bp, Artificial Sequence
  Synthetic oligonucleotide
gatgagcaaggggtataactggttgcgggataaaga

SEQ ID NO: 47555 - DNA, 36 bp, Artificial Sequence
  Synthetic oligonucleotide
agttgactcacaaggcgatccgaactgccgacccga

SEQ ID NO: 47556 - DNA, 37 bp, Artificial Sequence
  Synthetic oligonucleotide
gcccctgtcccatcttcgagcgttcatagagactcga

SEQ ID NO: 47557 - DNA, 36 bp, Artificial Sequence
  Synthetic oligonucleotide
tattgctcctcctcgaccgttaatacaagccttcga

SEQ ID NO: 47558 - DNA, 37 bp, Artificial Sequence
  Synthetic oligonucleotide
atgagatgggacgtggacttaggggcgtggtgaagga

SEQ ID NO: 47559 - DNA, 36 bp, Artificial Sequence
  Synthetic oligonucleotide
tgcaaagggggattagatgggaggatcaaagacgga

SEQ ID NO: 47560 - DNA, 37 bp, Artificial Sequence
  Synthetic oligonucleotide
gctcgcatcatcaaaccgcgtatcgcctacttacgga

SEQ ID NO: 47561 - DNA, 37 bp, Artificial Sequence
  Synthetic oligonucleotide
aggggagggagggggggcgatggagagcgtgagatga

SEQ ID NO: 47562 - DNA, 38 bp, Artificial Sequence
  Synthetic oligonucleotide
tacgccggtactatattagttatgccccctcttactga

SEQ ID NO: 47563 - DNA, 38 bp, Artificial Sequence
  Synthetic oligonucleotide
aacaccgatctgtccatgcccgacaccataacacctga

SEQ ID NO: 47564 - DNA, 37 bp, Artificial Sequence
  Synthetic oligonucleotide
tgtggcctcgcatcatagttcctggtttgcccgctga

SEQ ID NO: 47565 - DNA, 38 bp, Artificial Sequence
  Synthetic oligonucleotide
gaccacgctcctatcaccccagtgctgccgctccgtga

SEQ ID NO: 47566 - DNA, 38 bp, Artificial Sequence
  Synthetic oligonucleotide
aacgttgcccagccgataacactctttccctcgcgtga

SEQ ID NO: 47567 - DNA, 38 bp, Artificial Sequence
  Synthetic oligonucleotide
gagagcaaaagaacggttgtgagattggtggtgtgtga

SEQ ID NO: 47568 - DNA, 38 bp, Artificial Sequence
  Synthetic oligonucleotide
tagtccatctccaactgccgtggctggcccacacttga

SEQ ID NO: 47569 - DNA, 35 bp, Artificial Sequence
  Synthetic oligonucleotide
tcgccgaacagttcgctcctcaccttcgcacaata

SEQ ID NO: 47570 - DNA, 36 bp, Artificial Sequence
  Synthetic oligonucleotide
tgacgacccagtacatttctgggctgtgcttaccta

SEQ ID NO: 47571 - DNA, 36 bp, Artificial Sequence
  Synthetic oligonucleotide
acctccgaacacaagggtcactgccgcccaacgcta

SEQ ID NO: 47572 - DNA, 36 bp, Artificial Sequence
  Synthetic oligonucleotide
acgaaccccgcgaagtgaatcacaactcgtccctta

SEQ ID NO: 47573 - DNA, 35 bp, Artificial Sequence
  Synthetic oligonucleotide
gaccagccgctgctctactggcacgtacaccacac

SEQ ID NO: 47574 - DNA, 35 bp, Artificial Sequence
  Synthetic oligonucleotide
gccacccacatgatcttgattcgttcacacaccac

SEQ ID NO: 47575 - DNA, 35 bp, Artificial Sequence
  Synthetic oligonucleotide
gtcgccattaccatcgcgatcttggaatcttatcc

SEQ ID NO: 47576 - DNA, 35 bp, Artificial Sequence
  Synthetic oligonucleotide
ttgttcaccactgagtacgggcccccgcccaatgc

SEQ ID NO: 47577 - DNA, 34 bp, Artificial Sequence
  Synthetic oligonucleotide
gtcgattgttgtctgtcgcccattgtccttgttc

SEQ ID NO: 47578 - DNA, 35 bp, Artificial Sequence
  Synthetic oligonucleotide
tctgtggaagtagcgaagggctcaggggggacggg

SEQ ID NO: 47579 - DNA, 35 bp, Artificial Sequence
  Synthetic oligonucleotide
atgaccgggggaaatggtgagtaagctgacgtgtg

SEQ ID NO: 47580 - DNA, 35 bp, Artificial Sequence
  Synthetic oligonucleotide
gggtaaggggtagggtataggtgagaggggggaat

SEQ ID NO: 47581 - DNA, 35 bp, Artificial Sequence
  Synthetic oligonucleotide
gcaccttccttacagacatacgttgtgccatccat

SEQ ID NO: 47582 - DNA, 35 bp, Artificial Sequence
  Synthetic oligonucleotide
ggtacgacacccccgctttcgtccatcagttccct

SEQ ID NO: 47583 - DNA, 35 bp, Artificial Sequence
  Synthetic oligonucleotide
ttagactcgaagcttcacgcgccccacttgattct

SEQ ID NO: 47584 - DNA, 35 bp, Artificial Sequence
  Synthetic oligonucleotide
gcgatgtacggggagaagggaacagtatatagggt

SEQ ID NO: 47585 - DNA, 35 bp, Artificial Sequence
  Synthetic oligonucleotide
tacgtgcacatcacggcacttccgctcccccctca

SEQ ID NO: 47586 - DNA, 36 bp, Artificial Sequence
  Synthetic oligonucleotide
aattgcatcagctgttagcgtctgtcacttctctca

SEQ ID NO: 47587 - DNA, 36 bp, Artificial Sequence
  Synthetic oligonucleotide
atttgcgtacggctagtcctaacacatctcgtctca

SEQ ID NO: 47588 - DNA, 36 bp, Artificial Sequence
  Synthetic oligonucleotide
tagactgtcgcgcacacgggcctcatcatacgttca

SEQ ID NO: 47589 - DNA, 37 bp, Artificial Sequence
  Synthetic oligonucleotide
aacaaacggtgggaatgaggaggggcacgaaaaacga

SEQ ID NO: 47590 - DNA, 37 bp, Artificial Sequence
  Synthetic oligonucleotide
acaccatccccgcggtccctgagctccctcaaagcga

SEQ ID NO: 47591 - DNA, 37 bp, Artificial Sequence
  Synthetic oligonucleotide
tagccatcgcggtaatcctcgctgcactgccattcga

SEQ ID NO: 47592 - DNA, 37 bp, Artificial Sequence
  Synthetic oligonucleotide
ttgttacgtacaaccttgttttgctgcctactttcga

SEQ ID NO: 47593 - DNA, 36 bp, Artificial Sequence
  Synthetic oligonucleotide
tgtgacatatcgctccgttagccctgccctactgga

SEQ ID NO: 47594 - DNA, 37 bp, Artificial Sequence
  Synthetic oligonucleotide
tccccttccctgcactcagctggtcatggaccctgga

SEQ ID NO: 47595 - DNA, 37 bp, Artificial Sequence
  Synthetic oligonucleotide
ttgagcaaggctcaactccccggctctacttcctgga

SEQ ID NO: 47596 - DNA, 37 bp, Artificial Sequence
  Synthetic oligonucleotide
ttgccaagccccgaccacgtatttgccatggattgga

SEQ ID NO: 47597 - DNA, 37 bp, Artificial Sequence
  Synthetic oligonucleotide
tgcgtgtgtcattacttttgctgcctgttgccttgga

SEQ ID NO: 47598 - DNA, 38 bp, Artificial Sequence
  Synthetic oligonucleotide
gtgacaagcgaggtacgcgggagggacacgaaaaatga

SEQ ID NO: 47599 - DNA, 38 bp, Artificial Sequence
  Synthetic oligonucleotide
aagtcacgctccccaccgatatggccattacgcactga

SEQ ID NO: 47600 - DNA, 38 bp, Artificial Sequence
  Synthetic oligonucleotide
aacagagcaccatacgcgtcacccccccctgggcctga

SEQ ID NO: 47601 - DNA, 38 bp, Artificial Sequence
  Synthetic oligonucleotide
tcataggtggggagcctgggaggggacatggacgctga

SEQ ID NO: 47602 - DNA, 38 bp, Artificial Sequence
  Synthetic oligonucleotide
atccagccgcctgctaattacgccacgccacgatctga

SEQ ID NO: 47603 - DNA, 37 bp, Artificial Sequence
  Synthetic oligonucleotide
gcaccccgctgccctatccgcgtggacggtcttctga

SEQ ID NO: 47604 - DNA, 35 bp, Artificial Sequence
  Synthetic oligonucleotide
accacttctttcctcgctactgctccatccggtga

SEQ ID NO: 47605 - DNA, 36 bp, Artificial Sequence
  Synthetic oligonucleotide
atcgcgcggggagccagggtggagtagggatggtga

SEQ ID NO: 47606 - DNA, 37 bp, Artificial Sequence
  Synthetic oligonucleotide
gatccccaccccgacttgcagcccgattactttgtga

SEQ ID NO: 47607 - DNA, 37 bp, Artificial Sequence
  Synthetic oligonucleotide
tcagacttgtccgatcagcatcgttcctaccaattga

SEQ ID NO: 47608 - DNA, 38 bp, Artificial Sequence
  Synthetic oligonucleotide
accaacgccttcgcaccatctttcgggacctccattga

SEQ ID NO: 47609 - DNA, 37 bp, Artificial Sequence
  Synthetic oligonucleotide
tcccttcgcaaatggttacgttgctgttttttcttga

SEQ ID NO: 47610 - DNA, 36 bp, Artificial Sequence
  Synthetic oligonucleotide
ttccgcccacccccacgaaatatagggtttcgttga

SEQ ID NO: 47611 - DNA, 38 bp, Artificial Sequence
  Synthetic oligonucleotide
agatgcctcccggttttcgccgactcacttcactttga

SEQ ID NO: 47612 - DNA, 38 bp, Artificial Sequence
  Synthetic oligonucleotide
tacaccgctacaatagtatccgttcatcccatgtttga

SEQ ID NO: 47613 - DNA, 35 bp, Artificial Sequence
  Synthetic oligonucleotide
actctacgcaagccgggcctgttcaccactcatac

SEQ ID NO: 47614 - DNA, 35 bp, Artificial Sequence
  Synthetic oligonucleotide
acatttgctcttgcgcacccgtccatcgttccacc

SEQ ID NO: 47615 - DNA, 35 bp, Artificial Sequence
  Synthetic oligonucleotide
gccttggggcgccccattcccagccggtaccttgc

SEQ ID NO: 47616 - DNA, 35 bp, Artificial Sequence
  Synthetic oligonucleotide
agcccatgcagtcgacgacagcccttgcctcttgc

SEQ ID NO: 47617 - DNA, 35 bp, Artificial Sequence
  Synthetic oligonucleotide
ttcgaactcccgtccttcgttttgagccccacatg

SEQ ID NO: 47618 - DNA, 35 bp, Artificial Sequence
  Synthetic oligonucleotide
accacccgggaatccgatctagaaacttgactctg

SEQ ID NO: 47619 - DNA, 35 bp, Artificial Sequence
  Synthetic oligonucleotide
atggagcgggacggggatgaggggccgcagagttg

SEQ ID NO: 47620 - DNA, 35 bp, Artificial Sequence
  Synthetic oligonucleotide
aaccctcatgccactagtctcctcgaagccacaat

SEQ ID NO: 47621 - DNA, 35 bp, Artificial Sequence
  Synthetic oligonucleotide
tccagcacactgactctctacacttccgggttcat

SEQ ID NO: 47622 - DNA, 35 bp, Artificial Sequence
  Synthetic oligonucleotide
acgatccatccagccccttattaaagttcaaccgt

SEQ ID NO: 47623 - DNA, 35 bp, Artificial Sequence
  Synthetic oligonucleotide
gcttgtccagagactctttgccacacatccactgt

SEQ ID NO: 47624 - DNA, 35 bp, Artificial Sequence
  Synthetic oligonucleotide
gctaccttgtcagttcacctccacacttcacgctt

SEQ ID NO: 47625 - DNA, 36 bp, Artificial Sequence
  Synthetic oligonucleotide
gagagagtcgccacaggatgaaggaatttgggaaaa

SEQ ID NO: 47626 - DNA, 36 bp, Artificial Sequence
  Synthetic oligonucleotide
accacacttagctgatgatcactgcatttacatcaa

SEQ ID NO: 47627 - DNA, 36 bp, Artificial Sequence
  Synthetic oligonucleotide
aactcccaaccaccatgagcctacgtaagtgcggaa

SEQ ID NO: 47628 - DNA, 36 bp, Artificial Sequence
  Synthetic oligonucleotide
tcactggtagcctgcctctttaccccataggacaca

SEQ ID NO: 47629 - DNA, 36 bp, Artificial Sequence
  Synthetic oligonucleotide
agccacaagtgcgtctttcgtccttcctcgcataga

SEQ ID NO: 47630 - DNA, 37 bp, Artificial Sequence
  Synthetic oligonucleotide
tgtggccatcaaacaacgttagctcccttcgccccga

SEQ ID NO: 47631 - DNA, 37 bp, Artificial Sequence
  Synthetic oligonucleotide
tcaagcacatactgtcaggctaatggggaagggagga

SEQ ID NO: 47632 - DNA, 35 bp, Artificial Sequence
  Synthetic oligonucleotide
agaagggggggaaaggggacaaatagatccgtgga

SEQ ID NO: 47633 - DNA, 37 bp, Artificial Sequence
  Synthetic oligonucleotide
gctgcgaggggagggctaaaaggcgtggcggtaatga

SEQ ID NO: 47634 - DNA, 38 bp, Artificial Sequence
  Synthetic oligonucleotide
actaacgccatgggttcatgtaccttccccaacgatga

SEQ ID NO: 47635 - DNA, 38 bp, Artificial Sequence
  Synthetic oligonucleotide
tgagatgagggtgagagttgcgagtagagacggactga

SEQ ID NO: 47636 - DNA, 37 bp, Artificial Sequence
  Synthetic oligonucleotide
gtactcgtccaattgccacggcctactgatcatctga

SEQ ID NO: 47637 - DNA, 35 bp, Artificial Sequence
  Synthetic oligonucleotide
tcgaagagggggtaaggaatgggttcagggtgtga

SEQ ID NO: 47638 - DNA, 37 bp, Artificial Sequence
  Synthetic oligonucleotide
gatgaaaggtagacgaggttaaatggaggtgggttga

SEQ ID NO: 47639 - DNA, 38 bp, Artificial Sequence
  Synthetic oligonucleotide
tcagcgtgcgctacctggttccaacactacacctttga

SEQ ID NO: 47640 - DNA, 38 bp, Artificial Sequence
  Synthetic oligonucleotide
ttctgtgcccgcgtgcctactacacccctgctctttga

SEQ ID NO: 47641 - DNA, 35 bp, Artificial Sequence
  Synthetic oligonucleotide
tacaacaactccccgtgaacacgctcgcgagcata

SEQ ID NO: 47642 - DNA, 36 bp, Artificial Sequence
  Synthetic oligonucleotide
gtcgtagcctaactgggtcctcatttttcactcata

SEQ ID NO: 47643 - DNA, 36 bp, Artificial Sequence
  Synthetic oligonucleotide
aatcgcaccgccttgccctctactcccgcgcttcta

SEQ ID NO: 47644 - DNA, 36 bp, Artificial Sequence
  Synthetic oligonucleotide
gacccacgaccgcccgtgatccgttctacgtactta

SEQ ID NO: 47645 - DNA, 35 bp, Artificial Sequence
  Synthetic oligonucleotide
ggacggtcgtatcggtcgtccgctactctaaatac

SEQ ID NO: 47646 - DNA, 35 bp, Artificial Sequence
  Synthetic oligonucleotide
gaagccaactgcagtcacctgattttacgccatac

SEQ ID NO: 47647 - DNA, 35 bp, Artificial Sequence
  Synthetic oligonucleotide
tccatgcaggcctcttctcgctatcttgtttgtag

SEQ ID NO: 47648 - DNA, 35 bp, Artificial Sequence
  Synthetic oligonucleotide
ggaatgccttcatcgcacgtatagctcaccatccg

SEQ ID NO: 47649 - DNA, 35 bp, Artificial Sequence
  Synthetic oligonucleotide
tagcagtgggggggggagcgggtggagtggcatcg

SEQ ID NO: 47650 - DNA, 35 bp, Artificial Sequence
  Synthetic oligonucleotide
actgcgacctcgctctaacttgcttcactcgctcg

SEQ ID NO: 47651 - DNA, 35 bp, Artificial Sequence
  Synthetic oligonucleotide
gggaacattgtattaggggtgggtagggatagagg

SEQ ID NO: 47652 - DNA, 35 bp, Artificial Sequence
  Synthetic oligonucleotide
tgtttcaccccgcctttaagcctcccataagtatg

SEQ ID NO: 47653 - DNA, 35 bp, Artificial Sequence
  Synthetic oligonucleotide
gccacacacttgtcattaagccttccatttaacct

SEQ ID NO: 47654 - DNA, 35 bp, Artificial Sequence
  Synthetic oligonucleotide
gctgccaatggccctagaacctacacacgtttgct

SEQ ID NO: 47655 - DNA, 35 bp, Artificial Sequence
  Synthetic oligonucleotide
tccgttgttcgccgctgtagtctccagccgatctt

SEQ ID NO: 47656 - DNA, 35 bp, Artificial Sequence
  Synthetic oligonucleotide
accccactcagcgcagcatattgctagacttcgtt

SEQ ID NO: 47657 - DNA, 35 bp, Artificial Sequence
  Synthetic oligonucleotide
aatgtggagcagggatgggaacgggcgcaaacgaa

SEQ ID NO: 47658 - DNA, 36 bp, Artificial Sequence
  Synthetic oligonucleotide
tctgccctggtcccgttcctcaccagtgccaatcca

SEQ ID NO: 47659 - DNA, 36 bp, Artificial Sequence
  Synthetic oligonucleotide
tccgctgcttatgcgatttacgtcgaaccttctcca

SEQ ID NO: 47660 - DNA, 35 bp, Artificial Sequence
  Synthetic oligonucleotide
ggatcgaagcggtcgcctcattacctgaccaagca

SEQ ID NO: 47661 - DNA, 36 bp, Artificial Sequence
  Synthetic oligonucleotide
atgacacactctcttaacctgcttttaacgtgccga

SEQ ID NO: 47662 - DNA, 37 bp, Artificial Sequence
  Synthetic oligonucleotide
atacgcctctgcatcccctttactacatgtagtccga

SEQ ID NO: 47663 - DNA, 36 bp, Artificial Sequence
  Synthetic oligonucleotide
aaacaaccggcgtaggggaagcaaatgtctgctcga

SEQ ID NO: 47664 - DNA, 37 bp, Artificial Sequence
  Synthetic oligonucleotide
gactgcatgacaatcggttacctgctcttctctagga

SEQ ID NO: 47665 - DNA, 36 bp, Artificial Sequence
  Synthetic oligonucleotide
aacattggaccgggggcaaggtgaaaggataacgga

SEQ ID NO: 47666 - DNA, 37 bp, Artificial Sequence
  Synthetic oligonucleotide
atgtctccccgggccctcacattgcttatccttcgga

SEQ ID NO: 47667 - DNA, 37 bp, Artificial Sequence
  Synthetic oligonucleotide
acacgacaagcgatgggggaggtaaaggagggtggga

SEQ ID NO: 47668 - DNA, 38 bp, Artificial Sequence
  Synthetic oligonucleotide
gtagtgtacgctgcaccctagccctccgccctacctga

SEQ ID NO: 47669 - DNA, 38 bp, Artificial Sequence
  Synthetic oligonucleotide
tcatgacccagcgcccctcccggtggcctaccgcctga

SEQ ID NO: 47670 - DNA, 37 bp, Artificial Sequence
  Synthetic oligonucleotide
gtgacctcctgacggtttcaacacattacagtcctga

SEQ ID NO: 47671 - DNA, 38 bp, Artificial Sequence
  Synthetic oligonucleotide
tgtacccactcgcgcctcgaaacgtttcatcccgctga

SEQ ID NO: 47672 - DNA, 38 bp, Artificial Sequence
  Synthetic oligonucleotide
gcaatacggtggaggaaataagtcatgaagcgaagtga

SEQ ID NO: 47673 - DNA, 38 bp, Artificial Sequence
  Synthetic oligonucleotide
acccgcaaccaccatgtccccgtaaaaactgtaagtga

SEQ ID NO: 47674 - DNA, 38 bp, Artificial Sequence
  Synthetic oligonucleotide
acctgctcaccgtgctccactcgtactcaatcatgtga

SEQ ID NO: 47675 - DNA, 37 bp, Artificial Sequence
  Synthetic oligonucleotide
gacgtgcgccctagaaaccttgccctactttatgtga

SEQ ID NO: 47676 - DNA, 38 bp, Artificial Sequence
  Synthetic oligonucleotide
gtgaaccgctatcgtgcggacgccctcatcccccttga

SEQ ID NO: 47677 - DNA, 38 bp, Artificial Sequence
  Synthetic oligonucleotide
acctccactatacggtatgcccgtgcctgcttttttga

SEQ ID NO: 47678 - DNA, 36 bp, Artificial Sequence
  Synthetic oligonucleotide
tcactgctttaggcgttctactctcctgtctctcta

SEQ ID NO: 47679 - DNA, 35 bp, Artificial Sequence
  Synthetic oligonucleotide
tcgattccctatcgatcagtctctcgtgcctctta

SEQ ID NO: 47680 - DNA, 35 bp, Artificial Sequence
  Synthetic oligonucleotide
agtgctccaccctacgctgtgaggtgcagtgggac

SEQ ID NO: 47681 - DNA, 35 bp, Artificial Sequence
  Synthetic oligonucleotide
gttccctctacgagttgacctacagtgactcaacc

SEQ ID NO: 47682 - DNA, 35 bp, Artificial Sequence
  Synthetic oligonucleotide
ttgtaggcccaaatcgctcctccatcgcaacatgc

SEQ ID NO: 47683 - DNA, 35 bp, Artificial Sequence
  Synthetic oligonucleotide
acccccctttcgccgcttcacctgcccggacgtgc

SEQ ID NO: 47684 - DNA, 35 bp, Artificial Sequence
  Synthetic oligonucleotide
atgtcttcactctctcatgtccaccgaacccttgc

SEQ ID NO: 47685 - DNA, 35 bp, Artificial Sequence
  Synthetic oligonucleotide
cgaccaccctgttaggttaggctccacctcaactc

SEQ ID NO: 47686 - DNA, 35 bp, Artificial Sequence
  Synthetic oligonucleotide
aacgaagggaaaccgaggtgagggtggccgagtag

SEQ ID NO: 47687 - DNA, 35 bp, Artificial Sequence
  Synthetic oligonucleotide
tcacccgcctcagctttcggcgtactggtcgaacg

SEQ ID NO: 47688 - DNA, 35 bp, Artificial Sequence
  Synthetic oligonucleotide
gatacccgatgtaatcggtagaatggggggggacg

SEQ ID NO: 47689 - DNA, 35 bp, Artificial Sequence
  Synthetic oligonucleotide
gatcgcctcatccccactacccacaaagtagcgcg

SEQ ID NO: 47690 - DNA, 35 bp, Artificial Sequence
  Synthetic oligonucleotide
ggatgtctcgagtgggtgtgcaggtgggtagtgtg

SEQ ID NO: 47691 - DNA, 35 bp, Artificial Sequence
  Synthetic oligonucleotide
aatacctgccccccatcgtttaagattctagttat

SEQ ID NO: 47692 - DNA, 35 bp, Artificial Sequence
  Synthetic oligonucleotide
gaaccgatcccgccaccggcattcccatgccgcct

SEQ ID NO: 47693 - DNA, 35 bp, Artificial Sequence
  Synthetic oligonucleotide
acgtgagccatctgcaaccgacccccgcccgttct

SEQ ID NO: 47694 - DNA, 35 bp, Artificial Sequence
  Synthetic oligonucleotide
acttacaccctctcgccttgggccacgaagtcctt

SEQ ID NO: 47695 - DNA, 35 bp, Artificial Sequence
  Synthetic oligonucleotide
gcggagctcaagccagcgtacatatttccctcgtt

SEQ ID NO: 47696 - DNA, 35 bp, Artificial Sequence
  Synthetic oligonucleotide
gcgtgaggtgagtgggggggcactatttgtgggtt

SEQ ID NO: 47697 - DNA, 36 bp, Artificial Sequence
  Synthetic oligonucleotide
acagtacgccaggaatggaaatttggtggatgaaaa

SEQ ID NO: 47698 - DNA, 36 bp, Artificial Sequence
  Synthetic oligonucleotide
ttgaggggaggatgggagggattagcatagtttaaa

SEQ ID NO: 47699 - DNA, 36 bp, Artificial Sequence
  Synthetic oligonucleotide
gacgaacgtactcgcaggtgctcatggggtcgcgaa

SEQ ID NO: 47700 - DNA, 36 bp, Artificial Sequence
  Synthetic oligonucleotide
atggacactccgccaacaccatccgagtagcagaca

SEQ ID NO: 47701 - DNA, 36 bp, Artificial Sequence
  Synthetic oligonucleotide
tgtcccacgcttccatatcagccacgtcccatggca

SEQ ID NO: 47702 - DNA, 37 bp, Artificial Sequence
  Synthetic oligonucleotide
gttgcatggcgcctctttcctcacccccacggtgcga

SEQ ID NO: 47703 - DNA, 35 bp, Artificial Sequence
  Synthetic oligonucleotide
agtgatagggaacggacagtggggggtggtgcgga

SEQ ID NO: 47704 - DNA, 37 bp, Artificial Sequence
  Synthetic oligonucleotide
tataagcactcgtggcacaggaaaaaggggggaggga

SEQ ID NO: 47705 - DNA, 35 bp, Artificial Sequence
  Synthetic oligonucleotide
gtgggggcggtgggctgatagtggggcaatatgga

SEQ ID NO: 47706 - DNA, 37 bp, Artificial Sequence
  Synthetic oligonucleotide
gcatccactcgctttgccaactgtttgaccctatgga

SEQ ID NO: 47707 - DNA, 37 bp, Artificial Sequence
  Synthetic oligonucleotide
tttctccgccccgatttcacttgcccccgagcctgga

SEQ ID NO: 47708 - DNA, 37 bp, Artificial Sequence
  Synthetic oligonucleotide
atccgagatacaggagaggtagatagggcgggaatga

SEQ ID NO: 47709 - DNA, 38 bp, Artificial Sequence
  Synthetic oligonucleotide
acacacatccgagcatacctgggaacaaagtcaactga

SEQ ID NO: 47710 - DNA, 38 bp, Artificial Sequence
  Synthetic oligonucleotide
tagcccccgggtacgcgtcctgttccatctgtacctga

SEQ ID NO: 47711 - DNA, 37 bp, Artificial Sequence
  Synthetic oligonucleotide
ttgcacaccccgttgaactcccccagcccgccggtga

SEQ ID NO: 47712 - DNA, 37 bp, Artificial Sequence
  Synthetic oligonucleotide
ttgtacccttcccggtgacctataggagttccattga

SEQ ID NO: 47713 - DNA, 37 bp, Artificial Sequence
  Synthetic oligonucleotide
ggatgtgctgactggggggatatgtggtggcggttga

SEQ ID NO: 47714 - DNA, 38 bp, Artificial Sequence
  Synthetic oligonucleotide
gtccgtgcagttgcgtggctgccccatacaccatttga

SEQ ID NO: 47715 - DNA, 38 bp, Artificial Sequence
  Synthetic oligonucleotide
atccactgtcacttggcgacccactcacatagttttga

SEQ ID NO: 47716 - DNA, 35 bp, Artificial Sequence
  Synthetic oligonucleotide
accatacgccgtcagctccgcagtgcgcactacta

SEQ ID NO: 47717 - DNA, 36 bp, Artificial Sequence
  Synthetic oligonucleotide
gctcccgcatgactcactcccgtgcttagttcccta

SEQ ID NO: 47718 - DNA, 35 bp, Artificial Sequence
  Synthetic oligonucleotide
tcccaaccaacgccctgaccgctagagtattgcta

SEQ ID NO: 47719 - DNA, 35 bp, Artificial Sequence
  Synthetic oligonucleotide
gtcaacaccgcactctcgcgtgtcccactgaggac

SEQ ID NO: 47720 - DNA, 35 bp, Artificial Sequence
  Synthetic oligonucleotide
aaaggagggagaactatggcaggatcaagggggac

SEQ ID NO: 47721 - DNA, 35 bp, Artificial Sequence
  Synthetic oligonucleotide
tcacgtgctcctcttctacaaaacacagcatatac

SEQ ID NO: 47722 - DNA, 35 bp, Artificial Sequence
  Synthetic oligonucleotide
gcgccgatgtggcattatctctcttgcattctccc

SEQ ID NO: 47723 - DNA, 35 bp, Artificial Sequence
  Synthetic oligonucleotide
aactgcatatcggtcttcccatcgcctcttcacgc

SEQ ID NO: 47724 - DNA, 35 bp, Artificial Sequence
  Synthetic oligonucleotide
atcgctacgccaccaatctggagcaataacaccgc

SEQ ID NO: 47725 - DNA, 35 bp, Artificial Sequence
  Synthetic oligonucleotide
acaccccgctccgtcccgcacctcagttattttgc

SEQ ID NO: 47726 - DNA, 35 bp, Artificial Sequence
  Synthetic oligonucleotide
acacacctttgaatgtactgctgaatatccaaatc

SEQ ID NO: 47727 - DNA, 35 bp, Artificial Sequence
  Synthetic oligonucleotide
acttcggtcccaccatgagtcctttgcacgttatc

SEQ ID NO: 47728 - DNA, 35 bp, Artificial Sequence
  Synthetic oligonucleotide
tttcgccggtgatggcgaaatatctcatatccctc

SEQ ID NO: 47729 - DNA, 35 bp, Artificial Sequence
  Synthetic oligonucleotide
ggttcgcgcacaatcctaggtggccgattaccttc

SEQ ID NO: 47730 - DNA, 35 bp, Artificial Sequence
  Synthetic oligonucleotide
tacagtgcctgcatacccaatgcctgccctagttc

SEQ ID NO: 47731 - DNA, 35 bp, Artificial Sequence
  Synthetic oligonucleotide
acctacaaaatcccagtgcgcgagcaaccgtcgcg

SEQ ID NO: 47732 - DNA, 35 bp, Artificial Sequence
  Synthetic oligonucleotide
gggaagggtgggtgggtagtcgccagattaagtcg

SEQ ID NO: 47733 - DNA, 35 bp, Artificial Sequence
  Synthetic oligonucleotide
gaagcccatgcacgtcgcccccagcccctttagat

SEQ ID NO: 47734 - DNA, 35 bp, Artificial Sequence
  Synthetic oligonucleotide
gactcccaaattgctggcctcccgtttcgccctat

SEQ ID NO: 47735 - DNA, 35 bp, Artificial Sequence
  Synthetic oligonucleotide
tcacggcctgaacttttacccagggctcctttcct

SEQ ID NO: 47736 - DNA, 35 bp, Artificial Sequence
  Synthetic oligonucleotide
gacctagcgtgcgactcgtcctcatcggtacatct

SEQ ID NO: 47737 - DNA, 35 bp, Artificial Sequence
  Synthetic oligonucleotide
tcccaatgccccaattctgctatgaccttttctct

SEQ ID NO: 47738 - DNA, 35 bp, Artificial Sequence
  Synthetic oligonucleotide
aaagtgggaggcggaaggtggatctgcgtggggtt

SEQ ID NO: 47739 - DNA, 35 bp, Artificial Sequence
  Synthetic oligonucleotide
accatcggaggccctggcaccggtacaattatttt

SEQ ID NO: 47740 - DNA, 35 bp, Artificial Sequence
  Synthetic oligonucleotide
taactcgctccgcctccgcagtacttcccgccaaa

SEQ ID NO: 47741 - DNA, 36 bp, Artificial Sequence
  Synthetic oligonucleotide
gatgcaatcccaactgttctgctatggtttaaccaa

SEQ ID NO: 47742 - DNA, 36 bp, Artificial Sequence
  Synthetic oligonucleotide
gatctaccgtaacgacgaccgttctgaccatttcaa

SEQ ID NO: 47743 - DNA, 35 bp, Artificial Sequence
  Synthetic oligonucleotide
gatgcatgatcctgcggggaaaactatctctggaa

SEQ ID NO: 47744 - DNA, 36 bp, Artificial Sequence
  Synthetic oligonucleotide
tcataccgccccagtatgacaccttttttttgaaca

SEQ ID NO: 47745 - DNA, 35 bp, Artificial Sequence
  Synthetic oligonucleotide
tgtaaagtcccaagccccaatgccaaacctgccca

SEQ ID NO: 47746 - DNA, 36 bp, Artificial Sequence
  Synthetic oligonucleotide
taggagccgtcgctctctcttatgaaccctctatca

SEQ ID NO: 47747 - DNA, 36 bp, Artificial Sequence
  Synthetic oligonucleotide
ggactgctcaagctagcggggggcggggaggggtca

SEQ ID NO: 47748 - DNA, 35 bp, Artificial Sequence
  Synthetic oligonucleotide
acgcaccgccctctccccgtattctcctgatccga

SEQ ID NO: 47749 - DNA, 37 bp, Artificial Sequence
  Synthetic oligonucleotide
gaccccttccgtccgccaacgcctgtagcataatcga

SEQ ID NO: 47750 - DNA, 37 bp, Artificial Sequence
  Synthetic oligonucleotide
gcctcaacccgcagcctgacttacacggacactcgga

SEQ ID NO: 47751 - DNA, 37 bp, Artificial Sequence
  Synthetic oligonucleotide
ttgcggagcggaagaaatagggggagttcgatgggga

SEQ ID NO: 47752 - DNA, 37 bp, Artificial Sequence
  Synthetic oligonucleotide
gccagcccgttgactcgtccatactatgcaccactga

SEQ ID NO: 47753 - DNA, 38 bp, Artificial Sequence
  Synthetic oligonucleotide
tcactcggcacccacgtgccaccaccattttgacctga

SEQ ID NO: 47754 - DNA, 38 bp, Artificial Sequence
  Synthetic oligonucleotide
atcaacaacctcgccgtgataaccctccgattcgctga

SEQ ID NO: 47755 - DNA, 38 bp, Artificial Sequence
  Synthetic oligonucleotide
gcacgtcgccgatcagttcgcttcttcttgaccattga

SEQ ID NO: 47756 - DNA, 38 bp, Artificial Sequence
  Synthetic oligonucleotide
tcttccccgccagtcttttactgtcttctccctattga

SEQ ID NO: 47757 - DNA, 36 bp, Artificial Sequence
  Synthetic oligonucleotide
acacgtacgtagttgattattttccgcccttgttga

SEQ ID NO: 47758 - DNA, 37 bp, Artificial Sequence
  Synthetic oligonucleotide
aaagggaggaacatgggcagggaagaaataaatttga

SEQ ID NO: 47759 - DNA, 37 bp, Artificial Sequence
  Synthetic oligonucleotide
tcacggtcgtaattgttaatccttactctctctttga

SEQ ID NO: 47760 - DNA, 36 bp, Artificial Sequence
  Synthetic oligonucleotide
tacgctcccaactcgcttattgtttattcccgtata

SEQ ID NO: 47761 - DNA, 36 bp, Artificial Sequence
  Synthetic oligonucleotide
gatgccccgacacgcacacttcgcaacactcgtata

SEQ ID NO: 47762 - DNA, 36 bp, Artificial Sequence
  Synthetic oligonucleotide
gttcatgcctgcttgcattcgcggtcgcccctccta

SEQ ID NO: 47763 - DNA, 36 bp, Artificial Sequence
  Synthetic oligonucleotide
aaccagcccaatactacctcgctctgttgcggtcta

SEQ ID NO: 47764 - DNA, 36 bp, Artificial Sequence
  Synthetic oligonucleotide
gctcacagccacaaacacccgatacccgcccatgta

SEQ ID NO: 47765 - DNA, 36 bp, Artificial Sequence
  Synthetic oligonucleotide
gtcgcccaatcagccgcaagaccgcctcctccctta

SEQ ID NO: 47766 - DNA, 36 bp, Artificial Sequence
  Synthetic oligonucleotide
gttacgtagcttccctgcgtaccgttgcctgcttta

SEQ ID NO: 47767 - DNA, 36 bp, Artificial Sequence
  Synthetic oligonucleotide
aaccccaccacaagcaacatttgaacccggagttta

SEQ ID NO: 47768 - DNA, 35 bp, Artificial Sequence
  Synthetic oligonucleotide
actccgccgctcaatcagttctcaggccgctacac

SEQ ID NO: 47769 - DNA, 36 bp, Artificial Sequence
  Synthetic oligonucleotide
tcatacgtcacattaacaccgcttgcgctcgctgac

SEQ ID NO: 47770 - DNA, 35 bp, Artificial Sequence
  Synthetic oligonucleotide
gatgcgacgtactgcctctctgagatcttgcatac

SEQ ID NO: 47771 - DNA, 35 bp, Artificial Sequence
  Synthetic oligonucleotide
tataggagcacggggggagcgaaagtggcggttac

SEQ ID NO: 47772 - DNA, 35 bp, Artificial Sequence
  Synthetic oligonucleotide
gcagggccattgactacgccgctgttggtcctccc

SEQ ID NO: 47773 - DNA, 35 bp, Artificial Sequence
  Synthetic oligonucleotide
gcaccacatcaaggtgccttagttttggtcctagc

SEQ ID NO: 47774 - DNA, 35 bp, Artificial Sequence
  Synthetic oligonucleotide
gtggcgaattccgcctgcttatttattccaactgc

SEQ ID NO: 47775 - DNA, 35 bp, Artificial Sequence
  Synthetic oligonucleotide
tgcatccccaaatgccgccgcaaaacttgcgtatc

SEQ ID NO: 47776 - DNA, 35 bp, Artificial Sequence
  Synthetic oligonucleotide
atgcatcccactcgcgattagttacgctcctactc

SEQ ID NO: 47777 - DNA, 35 bp, Artificial Sequence
  Synthetic oligonucleotide
acacccgcataataccactatggcttaagagagcg

SEQ ID NO: 47778 - DNA, 35 bp, Artificial Sequence
  Synthetic oligonucleotide
ttgagtggacggcgtggggagaagatgagataagg

SEQ ID NO: 47779 - DNA, 35 bp, Artificial Sequence
  Synthetic oligonucleotide
gagggggtgcacgttcacggaacacaggatagagg

SEQ ID NO: 47780 - DNA, 35 bp, Artificial Sequence
  Synthetic oligonucleotide
tggtgtgtaggggaattaagcggggtgtggggtgg

SEQ ID NO: 47781 - DNA, 35 bp, Artificial Sequence
  Synthetic oligonucleotide
agtatgcacgcaattacactcacgccaccacgatg

SEQ ID NO: 47782 - DNA, 35 bp, Artificial Sequence
  Synthetic oligonucleotide
gagagcaggctgctgccgagcccatacgttccttg

SEQ ID NO: 47783 - DNA, 35 bp, Artificial Sequence
  Synthetic oligonucleotide
tcccgcactactctcgtgttcaacggtctttcaat

SEQ ID NO: 47784 - DNA, 35 bp, Artificial Sequence
  Synthetic oligonucleotide
gcgcatccttggtactgctgcgccgccacgcacct

SEQ ID NO: 47785 - DNA, 35 bp, Artificial Sequence
  Synthetic oligonucleotide
gatgtgataggccttacgtcatttacgctcctcct

SEQ ID NO: 47786 - DNA, 35 bp, Artificial Sequence
  Synthetic oligonucleotide
gcagaccattctcgacctttattcgactcagtcct

SEQ ID NO: 47787 - DNA, 35 bp, Artificial Sequence
  Synthetic oligonucleotide
gcctcgtgttgggtggtacgtccctgctcttcgct

SEQ ID NO: 47788 - DNA, 36 bp, Artificial Sequence
  Synthetic oligonucleotide
tccacccgaccaactgatgatccatctaagactgct

SEQ ID NO: 47789 - DNA, 35 bp, Artificial Sequence
  Synthetic oligonucleotide
acacgctaccgacttgtcgtaactcgactatctct

SEQ ID NO: 47790 - DNA, 35 bp, Artificial Sequence
  Synthetic oligonucleotide
gtgagggttttgagcgaggggggacggggcacggt

SEQ ID NO: 47791 - DNA, 35 bp, Artificial Sequence
  Synthetic oligonucleotide
tcttcaccacaggactctcaatctgtgaccgaatt

SEQ ID NO: 47792 - DNA, 35 bp, Artificial Sequence
  Synthetic oligonucleotide
gaaggtggaagggggaagggtaatgagcctgggtt

SEQ ID NO: 47793 - DNA, 35 bp, Artificial Sequence
  Synthetic oligonucleotide
ttgacacttcctcgtttgtcccggataactgcttt

SEQ ID NO: 47794 - DNA, 36 bp, Artificial Sequence
  Synthetic oligonucleotide
aaacgacgacggtcggaggagaggtactgggaggaa

SEQ ID NO: 47795 - DNA, 36 bp, Artificial Sequence
  Synthetic oligonucleotide
acacccggcaatttttaacatcattgagctcgctaa

SEQ ID NO: 47796 - DNA, 35 bp, Artificial Sequence
  Synthetic oligonucleotide
gtcgtgcatgtaactgttccatccggcccttctaa

SEQ ID NO: 47797 - DNA, 35 bp, Artificial Sequence
  Synthetic oligonucleotide
tgaccccttgtccaccccctagcgtacgaggcaca

SEQ ID NO: 47798 - DNA, 35 bp, Artificial Sequence
  Synthetic oligonucleotide
tccctcccacgttattcgatcccaaacggacacca

SEQ ID NO: 47799 - DNA, 35 bp, Artificial Sequence
  Synthetic oligonucleotide
tagcatccaccctgtgctcttgtaccttgctccca

SEQ ID NO: 47800 - DNA, 36 bp, Artificial Sequence
  Synthetic oligonucleotide
gcaactgtctgcttagtacgccacacccagactcca

SEQ ID NO: 47801 - DNA, 35 bp, Artificial Sequence
  Synthetic oligonucleotide
ttcccacccccacttttaggccctcaatatgcgca

SEQ ID NO: 47802 - DNA, 35 bp, Artificial Sequence
  Synthetic oligonucleotide
acatgaagccctgacccatagtctatgaaacctca

SEQ ID NO: 47803 - DNA, 36 bp, Artificial Sequence
  Synthetic oligonucleotide
agtcaatccgttccgttcgtccgccacttccggtca

SEQ ID NO: 47804 - DNA, 36 bp, Artificial Sequence
  Synthetic oligonucleotide
gtgtgggggcgggggaagggtcggggagcatgaaga

SEQ ID NO: 47805 - DNA, 35 bp, Artificial Sequence
  Synthetic oligonucleotide
tccatctttcagcaattccatcagtcatgtttaga

SEQ ID NO: 47806 - DNA, 37 bp, Artificial Sequence
  Synthetic oligonucleotide
tacacccatggaatccattatgcagtcatacaaacga

SEQ ID NO: 47807 - DNA, 37 bp, Artificial Sequence
  Synthetic oligonucleotide
ggaaactgaccccgcccatcccatcgtccccggacga

SEQ ID NO: 47808 - DNA, 37 bp, Artificial Sequence
  Synthetic oligonucleotide
gagtaggaatggtgtcaaggggctgggtgggtgtcga

SEQ ID NO: 47809 - DNA, 34 bp, Artificial Sequence
  Synthetic oligonucleotide
accccctcgcacattgggtatggccccttttcga

SEQ ID NO: 47810 - DNA, 37 bp, Artificial Sequence
  Synthetic oligonucleotide
atcgaccgcagggtaatactaggtggaagcaaaagga

SEQ ID NO: 47811 - DNA, 37 bp, Artificial Sequence
  Synthetic oligonucleotide
acgtgtcgcacgcacgatgcattttcaactttccgga

SEQ ID NO: 47812 - DNA, 37 bp, Artificial Sequence
  Synthetic oligonucleotide
gttgcaccatccacactccatagtcttcccaccggga

SEQ ID NO: 47813 - DNA, 36 bp, Artificial Sequence
  Synthetic oligonucleotide
aatgaaggcgagggacggtttttggctggctgggga

SEQ ID NO: 47814 - DNA, 37 bp, Artificial Sequence
  Synthetic oligonucleotide
aattgccacgccaccggttgattagctctccctggga

SEQ ID NO: 47815 - DNA, 38 bp, Artificial Sequence
  Synthetic oligonucleotide
ggatgaaggggccggattgggcgggtgggtgcaaatga

SEQ ID NO: 47816 - DNA, 38 bp, Artificial Sequence
  Synthetic oligonucleotide
tgaccccttagtgctcatacaactcgttcactgactga

SEQ ID NO: 47817 - DNA, 38 bp, Artificial Sequence
  Synthetic oligonucleotide
tccctcggcgattcgatgcagccaccaccaccttctga

SEQ ID NO: 47818 - DNA, 38 bp, Artificial Sequence
  Synthetic oligonucleotide
gagacaccgggataggttggtaaaatatgggggggtga

SEQ ID NO: 47819 - DNA, 38 bp, Artificial Sequence
  Synthetic oligonucleotide
aacacactagcttgctcgggatctgtaccttgccttga

SEQ ID NO: 47820 - DNA, 36 bp, Artificial Sequence
  Synthetic oligonucleotide
agaccccgtgccgccgaattcctcccttagggttga

SEQ ID NO: 47821 - DNA, 36 bp, Artificial Sequence
  Synthetic oligonucleotide
tgtgcaacctctcatgctacgtgtccggtatctcta

SEQ ID NO: 47822 - DNA, 35 bp, Artificial Sequence
  Synthetic oligonucleotide
acctacgcatgtgatgctctttctcgtccctccac

SEQ ID NO: 47823 - DNA, 35 bp, Artificial Sequence
  Synthetic oligonucleotide
tttgcactttccgcctcgcgtaccaatcgcctgac

SEQ ID NO: 47824 - DNA, 35 bp, Artificial Sequence
  Synthetic oligonucleotide
tgtgctgcacggtcgccattctcgtcctgctttac

SEQ ID NO: 47825 - DNA, 35 bp, Artificial Sequence
  Synthetic oligonucleotide
gacgaaacacgcgactatgttgcggcatccccacc

SEQ ID NO: 47826 - DNA, 34 bp, Artificial Sequence
  Synthetic oligonucleotide
aaatccagccattgttttgtcgctatgtgctgcc

SEQ ID NO: 47827 - DNA, 35 bp, Artificial Sequence
  Synthetic oligonucleotide
gacggaaggctcagaaggccgcttttatttcctcc

SEQ ID NO: 47828 - DNA, 35 bp, Artificial Sequence
  Synthetic oligonucleotide
ccgacccctcagccaatccgcttcatcgcccctgc

SEQ ID NO: 47829 - DNA, 35 bp, Artificial Sequence
  Synthetic oligonucleotide
aacctgacttcccgataggcgacggcctacattgc

SEQ ID NO: 47830 - DNA, 35 bp, Artificial Sequence
  Synthetic oligonucleotide
aacccgcccgttccatccgcaggttgaccattctc

SEQ ID NO: 47831 - DNA, 35 bp, Artificial Sequence
  Synthetic oligonucleotide
tcctacgcaagcctcgagagccgctgttccgattc

SEQ ID NO: 47832 - DNA, 35 bp, Artificial Sequence
  Synthetic oligonucleotide
gggtcctgccagtttagtcccgcgccctttgcttc

SEQ ID NO: 47833 - DNA, 35 bp, Artificial Sequence
  Synthetic oligonucleotide
tcgatatccggcggcccactgttttcggtctcttc

SEQ ID NO: 47834 - DNA, 35 bp, Artificial Sequence
  Synthetic oligonucleotide
attgccaatctaccgcctgaagcatatcccctttc

SEQ ID NO: 47835 - DNA, 35 bp, Artificial Sequence
  Synthetic oligonucleotide
gccgcccactcgccaccatatatccaccgcataag

SEQ ID NO: 47836 - DNA, 35 bp, Artificial Sequence
  Synthetic oligonucleotide
gcactccctccatttgctgccgctgtcttttatag

SEQ ID NO: 47837 - DNA, 35 bp, Artificial Sequence
  Synthetic oligonucleotide
tacatgtaacacatgccctctggtcgctacccacg

SEQ ID NO: 47838 - DNA, 35 bp, Artificial Sequence
  Synthetic oligonucleotide
gacacggtgggaacagtaacagggacaatataatg

SEQ ID NO: 47839 - DNA, 35 bp, Artificial Sequence
  Synthetic oligonucleotide
gtggaatgcctatccatcctcctgtatcgctcctg

SEQ ID NO: 47840 - DNA, 35 bp, Artificial Sequence
  Synthetic oligonucleotide
tccgccttacgcctcagggcgcagttttatcacct

SEQ ID NO: 47841 - DNA, 34 bp, Artificial Sequence
  Synthetic oligonucleotide
atgccctgccccttccctccttgtttaccctggt

SEQ ID NO: 47842 - DNA, 35 bp, Artificial Sequence
  Synthetic oligonucleotide
gaaataggcggaggggaaagagggagttggcaatt

SEQ ID NO: 47843 - DNA, 35 bp, Artificial Sequence
  Synthetic oligonucleotide
tgtccactgtccaccgagggttgtttcttttggtt

SEQ ID NO: 47844 - DNA, 36 bp, Artificial Sequence
  Synthetic oligonucleotide
agtaagggtcggcaagcacaagggaaaggagtaaaa

SEQ ID NO: 47845 - DNA, 36 bp, Artificial Sequence
  Synthetic oligonucleotide
gaaaggcggattggagaatggggcaaatggtgtgaa

SEQ ID NO: 47846 - DNA, 36 bp, Artificial Sequence
  Synthetic oligonucleotide
acagaccttggcccgccttgcctaaactgctgttaa

SEQ ID NO: 47847 - DNA, 36 bp, Artificial Sequence
  Synthetic oligonucleotide
agtccaacaatagggaaagggcccacccggaaaaca

SEQ ID NO: 47848 - DNA, 36 bp, Artificial Sequence
  Synthetic oligonucleotide
agccgaacaccgctcgcaatgtaatgcctgataaca

SEQ ID NO: 47849 - DNA, 35 bp, Artificial Sequence
  Synthetic oligonucleotide
tagggtggaccggtaggagggggtggggaagtcca

SEQ ID NO: 47850 - DNA, 36 bp, Artificial Sequence
  Synthetic oligonucleotide
gtcgaaacgtgggggggaaaactgatgacatgttca

SEQ ID NO: 47851 - DNA, 35 bp, Artificial Sequence
  Synthetic oligonucleotide
ttgtcgggcacggttagcagcctgttttggtttca

SEQ ID NO: 47852 - DNA, 37 bp, Artificial Sequence
  Synthetic oligonucleotide
aattccgggaaggtgggaggagtagaagtcgggcaga

SEQ ID NO: 47853 - DNA, 37 bp, Artificial Sequence
  Synthetic oligonucleotide
gtgcggaggacgaaccatacgaaatggtcatgaagga

SEQ ID NO: 47854 - DNA, 37 bp, Artificial Sequence
  Synthetic oligonucleotide
gatgggcaagaaaagaaatggggataacagtaacgga

SEQ ID NO: 47855 - DNA, 37 bp, Artificial Sequence
  Synthetic oligonucleotide
agatgcgtggcacaagcgggaacggtggctgaaggga

SEQ ID NO: 47856 - DNA, 38 bp, Artificial Sequence
  Synthetic oligonucleotide
accaaatgcgcgacaggtccgcctcgagttccccatga

SEQ ID NO: 47857 - DNA, 37 bp, Artificial Sequence
  Synthetic oligonucleotide
gtccagactcgcccaatctatgcaccgctgactatga

SEQ ID NO: 47858 - DNA, 35 bp, Artificial Sequence
  Synthetic oligonucleotide
gcttcactcccatgtgcgcctccctacatctatga

SEQ ID NO: 47859 - DNA, 37 bp, Artificial Sequence
  Synthetic oligonucleotide
aatgtcgggggaagggactttaggataccgacactga

SEQ ID NO: 47860 - DNA, 38 bp, Artificial Sequence
  Synthetic oligonucleotide
aatgtgaaggtggggtggtgtggagaggtggctactga

SEQ ID NO: 47861 - DNA, 38 bp, Artificial Sequence
  Synthetic oligonucleotide
accaagagggggtgtgattggtagagggtgaacgctga

SEQ ID NO: 47862 - DNA, 38 bp, Artificial Sequence
  Synthetic oligonucleotide
gaggccgttaggccgctttaaccacctggctttgctga

SEQ ID NO: 47863 - DNA, 37 bp, Artificial Sequence
  Synthetic oligonucleotide
accacgaacgacctctatccgctgtgcctacttctga

SEQ ID NO: 47864 - DNA, 38 bp, Artificial Sequence
  Synthetic oligonucleotide
ttagtgccccgcattgcatacactctcctggtacgtga

SEQ ID NO: 47865 - DNA, 38 bp, Artificial Sequence
  Synthetic oligonucleotide
tttcgcataagggtggagcggggagggccttgtggtga

SEQ ID NO: 47866 - DNA, 37 bp, Artificial Sequence
  Synthetic oligonucleotide
tgtacacctgccagattcccttcccgtggtcatgtga

SEQ ID NO: 47867 - DNA, 37 bp, Artificial Sequence
  Synthetic oligonucleotide
acacgagtcagctccgacacatgtactttctccttga

SEQ ID NO: 47868 - DNA, 38 bp, Artificial Sequence
  Synthetic oligonucleotide
aatccaccctcgacactccaggcaaagccccagcttga

SEQ ID NO: 47869 - DNA, 38 bp, Artificial Sequence
  Synthetic oligonucleotide
gttcgcccccaccctgtccaccaaccctaagcctttga

SEQ ID NO: 47870 - DNA, 36 bp, Artificial Sequence
  Synthetic oligonucleotide
gaagtcgcgcacctgggattcatggctctctaaata

SEQ ID NO: 47871 - DNA, 36 bp, Artificial Sequence
  Synthetic oligonucleotide
gtcacaggccgacactgcttcaacctctaggtcata

SEQ ID NO: 47872 - DNA, 35 bp, Artificial Sequence
  Synthetic oligonucleotide
agacccaaccatggcaaagacagcccgcccctgta

SEQ ID NO: 47873 - DNA, 37 bp, Artificial Sequence
  Synthetic oligonucleotide
tccatcgccactttgctgattaactttttgctgtgta

SEQ ID NO: 47874 - DNA, 36 bp, Artificial Sequence
  Synthetic oligonucleotide
cctgagctcgcactcctggtttggttccgcatctta

SEQ ID NO: 47875 - DNA, 35 bp, Artificial Sequence
  Synthetic oligonucleotide
gcttcatcccgagccgttcgtgagccattgttcac

SEQ ID NO: 47876 - DNA, 36 bp, Artificial Sequence
  Synthetic oligonucleotide
gccaagtcctcatatgttccggcacatcatacgacc

SEQ ID NO: 47877 - DNA, 35 bp, Artificial Sequence
  Synthetic oligonucleotide
tgtcaaaagcctctatcctgtaccaacgttttggc

SEQ ID NO: 47878 - DNA, 35 bp, Artificial Sequence
  Synthetic oligonucleotide
acccccaaagtgcccgcgattagcctccggagttc

SEQ ID NO: 47879 - DNA, 35 bp, Artificial Sequence
  Synthetic oligonucleotide
tcttccgctcccctcgctcctatcagccaatttag

SEQ ID NO: 47880 - DNA, 35 bp, Artificial Sequence
  Synthetic oligonucleotide
gcgcacacatcctctcgtcacggacatcatgaacg

SEQ ID NO: 47881 - DNA, 35 bp, Artificial Sequence
  Synthetic oligonucleotide
gccacacctcactggaaccgaccctcctttgtacg

SEQ ID NO: 47882 - DNA, 35 bp, Artificial Sequence
  Synthetic oligonucleotide
acaaacgcacacaagcaaccgccctacagtacagg

SEQ ID NO: 47883 - DNA, 35 bp, Artificial Sequence
  Synthetic oligonucleotide
gggtgggccatcgtttggggcatggattgtggggg

SEQ ID NO: 47884 - DNA, 35 bp, Artificial Sequence
  Synthetic oligonucleotide
tcaaccggagccgcctcctgaatacctaacttctg

SEQ ID NO: 47885 - DNA, 35 bp, Artificial Sequence
  Synthetic oligonucleotide
gtcaccccgccgatcttaccacgttccaaggattg

SEQ ID NO: 47886 - DNA, 35 bp, Artificial Sequence
  Synthetic oligonucleotide
tctgtcccccatgttcggagcttttgcctcaccat

SEQ ID NO: 47887 - DNA, 35 bp, Artificial Sequence
  Synthetic oligonucleotide
accccacactttttgtcatggattgcctgtttttt

SEQ ID NO: 47888 - DNA, 36 bp, Artificial Sequence
  Synthetic oligonucleotide
atccccaaacgcaccggcacctttatttttgaccaa

SEQ ID NO: 47889 - DNA, 36 bp, Artificial Sequence
  Synthetic oligonucleotide
gtctccacggacccccctatatcacgtgccccccaa

SEQ ID NO: 47890 - DNA, 35 bp, Artificial Sequence
  Synthetic oligonucleotide
gatccggtatacccgccccacgttccttcttgtaa

SEQ ID NO: 47891 - DNA, 35 bp, Artificial Sequence
  Synthetic oligonucleotide
ggtctcacacccctcccgcccggtaccagcagaca

SEQ ID NO: 47892 - DNA, 36 bp, Artificial Sequence
  Synthetic oligonucleotide
agcaaccgtatttgtccctacgtgcacccccataca

SEQ ID NO: 47893 - DNA, 36 bp, Artificial Sequence
  Synthetic oligonucleotide
atccgaacgtaggtggtcagaataggtgagggtaca

SEQ ID NO: 47894 - DNA, 35 bp, Artificial Sequence
  Synthetic oligonucleotide
tcttgctacacaacatgcaccctcgggccccccca

SEQ ID NO: 47895 - DNA, 36 bp, Artificial Sequence
  Synthetic oligonucleotide
tgatagccctagtcctgcttgcttccgatccagcca

SEQ ID NO: 47896 - DNA, 35 bp, Artificial Sequence
  Synthetic oligonucleotide
ttacaacgccttgcatgtcccttttgaactcatca

SEQ ID NO: 47897 - DNA, 36 bp, Artificial Sequence
  Synthetic oligonucleotide
gccgcccgggcacacgagaaaaagttaaacccctca

SEQ ID NO: 47898 - DNA, 36 bp, Artificial Sequence
  Synthetic oligonucleotide
ttgcccggtatcagcgtatcgtgccgtcccaattca

SEQ ID NO: 47899 - DNA, 37 bp, Artificial Sequence
  Synthetic oligonucleotide
actagcccacgccaattccccatccactcactcgaga

SEQ ID NO: 47900 - DNA, 37 bp, Artificial Sequence
  Synthetic oligonucleotide
gaaaccgtacaggggacgggatcaagggtggtgacga

SEQ ID NO: 47901 - DNA, 35 bp, Artificial Sequence
  Synthetic oligonucleotide
tccgctgcatacgttcactgctccttattgccgga

SEQ ID NO: 47902 - DNA, 37 bp, Artificial Sequence
  Synthetic oligonucleotide
gacgggtgggaaggtgaaagcgtggttagacagcgga

SEQ ID NO: 47903 - DNA, 37 bp, Artificial Sequence
  Synthetic oligonucleotide
ggaggagtgggatggcacaagggggagaggaggggga

SEQ ID NO: 47904 - DNA, 38 bp, Artificial Sequence
  Synthetic oligonucleotide
aaagtaggaacgggtggtagtccaaagggggcaaatga

SEQ ID NO: 47905 - DNA, 37 bp, Artificial Sequence
  Synthetic oligonucleotide
ggagtaggtaccgggaggtgggcgggggagacaatga

SEQ ID NO: 47906 - DNA, 38 bp, Artificial Sequence
  Synthetic oligonucleotide
gtcgaaggcgtgaagggggaaagtcgacgagatgatga

SEQ ID NO: 47907 - DNA, 37 bp, Artificial Sequence
  Synthetic oligonucleotide
acgctccaccattcgcgcttttggtcatggaatatga

SEQ ID NO: 47908 - DNA, 38 bp, Artificial Sequence
  Synthetic oligonucleotide
agtacatcatcgcgtccagctctgtccttcctctatga

SEQ ID NO: 47909 - DNA, 38 bp, Artificial Sequence
  Synthetic oligonucleotide
tgtagggtacagcaggaaaaaaaaaatgggggtagtga

SEQ ID NO: 47910 - DNA, 37 bp, Artificial Sequence
  Synthetic oligonucleotide
ttgcctgccacttcactcatccttcgatcgttcgtga

SEQ ID NO: 47911 - DNA, 38 bp, Artificial Sequence
  Synthetic oligonucleotide
aagcaccttcaccagtaaccaactcgcacttttcgtga

SEQ ID NO: 47912 - DNA, 38 bp, Artificial Sequence
  Synthetic oligonucleotide
ggggaagagggcgggaggtgatgcgaattgtgatgtga

SEQ ID NO: 47913 - DNA, 36 bp, Artificial Sequence
  Synthetic oligonucleotide
gtacgccgggggtactggggcccagggagggattga

SEQ ID NO: 47914 - DNA, 38 bp, Artificial Sequence
  Synthetic oligonucleotide
aacgctacgcctgccgcatacacgataacctctattga

SEQ ID NO: 47915 - DNA, 37 bp, Artificial Sequence
  Synthetic oligonucleotide
acatccaattccgccggtccaactttcgactgcttga

SEQ ID NO: 47916 - DNA, 38 bp, Artificial Sequence
  Synthetic oligonucleotide
tacgatgatgtagattgggcatggagggagcggtttga

SEQ ID NO: 47917 - DNA, 38 bp, Artificial Sequence
  Synthetic oligonucleotide
tcacaccggctgtccactacacatacacgttattttga

SEQ ID NO: 47918 - DNA, 35 bp, Artificial Sequence
  Synthetic oligonucleotide
tccgctttcccgggccatgctgtctcctctttata

SEQ ID NO: 47919 - DNA, 36 bp, Artificial Sequence
  Synthetic oligonucleotide
gccggggtcgttccgctccatctcatcgcaccacta

SEQ ID NO: 47920 - DNA, 36 bp, Artificial Sequence
  Synthetic oligonucleotide
tttcgtgcaccatcatttgaatcgcctgacccccta

SEQ ID NO: 47921 - DNA, 36 bp, Artificial Sequence
  Synthetic oligonucleotide
tgcgtgagtcattttccatcttatgtccgctgccta

SEQ ID NO: 47922 - DNA, 36 bp, Artificial Sequence
  Synthetic oligonucleotide
atgcctttcaaccgccacgtccccggcctttttgta

SEQ ID NO: 47923 - DNA, 36 bp, Artificial Sequence
  Synthetic oligonucleotide
gtgtccgccctttgtccattggtagcttgcgaatta

SEQ ID NO: 47924 - DNA, 36 bp, Artificial Sequence
  Synthetic oligonucleotide
aacgccaccggctcttttccacgcctgacttcatta

SEQ ID NO: 47925 - DNA, 36 bp, Artificial Sequence
  Synthetic oligonucleotide
gctgcacttgacgcatgtagcactcgtcttccttta

SEQ ID NO: 47926 - DNA, 35 bp, Artificial Sequence
  Synthetic oligonucleotide
tgcaccacccctgtgcgcgttgacatcctgtttta

SEQ ID NO: 47927 - DNA, 35 bp, Artificial Sequence
  Synthetic oligonucleotide
tctggcccggctccacatccctggtacgtgcaaac

SEQ ID NO: 47928 - DNA, 35 bp, Artificial Sequence
  Synthetic oligonucleotide
gccacctcctgacttagtggctaccctgtgttcac

SEQ ID NO: 47929 - DNA, 35 bp, Artificial Sequence
  Synthetic oligonucleotide
gctatgccccagtggttgtcaacatagcgctcccc

SEQ ID NO: 47930 - DNA, 35 bp, Artificial Sequence
  Synthetic oligonucleotide
gaaccccgtcgaaacgctctccttaggacccggcc

SEQ ID NO: 47931 - DNA, 35 bp, Artificial Sequence
  Synthetic oligonucleotide
atgcacgcctctccactatgagcattggtccgttc

SEQ ID NO: 47932 - DNA, 35 bp, Artificial Sequence
  Synthetic oligonucleotide
atccactgcaggtgagcgcatatgacgctcctttc

SEQ ID NO: 47933 - DNA, 35 bp, Artificial Sequence
  Synthetic oligonucleotide
gtgggagaagaaggagacggtaggagacaagggag

SEQ ID NO: 47934 - DNA, 35 bp, Artificial Sequence
  Synthetic oligonucleotide
ttacaccgtgcagaccccttgtattacgctccccg

SEQ ID NO: 47935 - DNA, 35 bp, Artificial Sequence
  Synthetic oligonucleotide
tccttcacccccgccttgttgagcccctcctctcg

SEQ ID NO: 47936 - DNA, 35 bp, Artificial Sequence
  Synthetic oligonucleotide
atgatgcaggccgggaggagggctgtatattgggg

SEQ ID NO: 47937 - DNA, 34 bp, Artificial Sequence
  Synthetic oligonucleotide
agcccataacgcccacacacattgattctgtgtg

SEQ ID NO: 47938 - DNA, 35 bp, Artificial Sequence
  Synthetic oligonucleotide
actccacccgctcaccttcgggacttatttgcttg

SEQ ID NO: 47939 - DNA, 35 bp, Artificial Sequence
  Synthetic oligonucleotide
tgtatgccacaacaacgtctaaattagtccgtact

SEQ ID NO: 47940 - DNA, 35 bp, Artificial Sequence
  Synthetic oligonucleotide
acacgtggtgttactcaatgtcgccatctctccaa

SEQ ID NO: 47941 - DNA, 35 bp, Artificial Sequence
  Synthetic oligonucleotide
tacgcccagacccccgttgtaacagggtctaaaca

SEQ ID NO: 47942 - DNA, 35 bp, Artificial Sequence
  Synthetic oligonucleotide
atcccgagtgcccggatactcctgccattgccaca

SEQ ID NO: 47943 - DNA, 35 bp, Artificial Sequence
  Synthetic oligonucleotide
accaccctcaattgtcctttactctattgcaccca

SEQ ID NO: 47944 - DNA, 36 bp, Artificial Sequence
  Synthetic oligonucleotide
tgatccgccccccttgatctataacgataactggca

SEQ ID NO: 47945 - DNA, 36 bp, Artificial Sequence
  Synthetic oligonucleotide
ttcagaacggccatgcatcacaagctgccactttca

SEQ ID NO: 47946 - DNA, 35 bp, Artificial Sequence
  Synthetic oligonucleotide
ccccatgcacccacctgggtaatcctgttctttca

SEQ ID NO: 47947 - DNA, 36 bp, Artificial Sequence
  Synthetic oligonucleotide
attagggaggcggagaaacgggggattggggcgaga

SEQ ID NO: 47948 - DNA, 37 bp, Artificial Sequence
  Synthetic oligonucleotide
acaagcaagggcgggaccgggcatgaggtacagtaga

SEQ ID NO: 47949 - DNA, 37 bp, Artificial Sequence
  Synthetic oligonucleotide
accgacaccagacaccccgaatgctccgtagaaccga

SEQ ID NO: 47950 - DNA, 37 bp, Artificial Sequence
  Synthetic oligonucleotide
gtcccgcaggtctacgcccacacctatcccgctccga

SEQ ID NO: 47951 - DNA, 37 bp, Artificial Sequence
  Synthetic oligonucleotide
aaacgctgcattcccccctcgtctagcaaccaggcga

SEQ ID NO: 47952 - DNA, 37 bp, Artificial Sequence
  Synthetic oligonucleotide
ggacgcacccgacctcacgcccccctaccagttgcga

SEQ ID NO: 47953 - DNA, 37 bp, Artificial Sequence
  Synthetic oligonucleotide
gataccttcggctgatgaggggggctgggaggaggga

SEQ ID NO: 47954 - DNA, 37 bp, Artificial Sequence
  Synthetic oligonucleotide
aaaagcaaggacagggaagggggctggcggtatggga

SEQ ID NO: 47955 - DNA, 36 bp, Artificial Sequence
  Synthetic oligonucleotide
gccatcctcattcccctttagggctgtccgccatga

SEQ ID NO: 47956 - DNA, 38 bp, Artificial Sequence
  Synthetic oligonucleotide
ttactcactcctggcgacgccatcagtacttcgactga

SEQ ID NO: 47957 - DNA, 37 bp, Artificial Sequence
  Synthetic oligonucleotide
tcatcccgggtcctggcaccccgaccaccgcccctga

SEQ ID NO: 47958 - DNA, 38 bp, Artificial Sequence
  Synthetic oligonucleotide
ttgcatggagccgcccgacaccgttttttatgccctga

SEQ ID NO: 47959 - DNA, 37 bp, Artificial Sequence
  Synthetic oligonucleotide
aatcgcccattgcatccctatgcgaacttcctcctga

SEQ ID NO: 47960 - DNA, 37 bp, Artificial Sequence
  Synthetic oligonucleotide
ttgaagagcaatcgtgtgtggcgggtgtgagggctga

SEQ ID NO: 47961 - DNA, 38 bp, Artificial Sequence
  Synthetic oligonucleotide
gacaccccggttattgcccctcacctggcgccccgtga

SEQ ID NO: 47962 - DNA, 38 bp, Artificial Sequence
  Synthetic oligonucleotide
gtgctggggcgggttataggggtgggaccgtgcggtga

SEQ ID NO: 47963 - DNA, 35 bp, Artificial Sequence
  Synthetic oligonucleotide
ataacgacgcccccacgcgcgttaatgaaccttga

SEQ ID NO: 47964 - DNA, 35 bp, Artificial Sequence
  Synthetic oligonucleotide
agcgaagcggcgttctgcatcacggctcctcccta

SEQ ID NO: 47965 - DNA, 35 bp, Artificial Sequence
  Synthetic oligonucleotide
acgtaccacacaaacgaccgaggcggacacctcta

SEQ ID NO: 47966 - DNA, 36 bp, Artificial Sequence
  Synthetic oligonucleotide
ggtcacaacgctgctccatccggtttctgtaacgta

SEQ ID NO: 47967 - DNA, 35 bp, Artificial Sequence
  Synthetic oligonucleotide
tccgcctcacccaaattcctgtaggctaagacgta

SEQ ID NO: 47968 - DNA, 36 bp, Artificial Sequence
  Synthetic oligonucleotide
gagagggggtgggtggggatcgagatggaaagggta

SEQ ID NO: 47969 - DNA, 35 bp, Artificial Sequence
  Synthetic oligonucleotide
tcccaacctcaccgtgccctcattgtaccgaagcc

SEQ ID NO: 47970 - DNA, 35 bp, Artificial Sequence
  Synthetic oligonucleotide
gccggtaccgacacccgaattgcctgtccgtaagc

SEQ ID NO: 47971 - DNA, 35 bp, Artificial Sequence
  Synthetic oligonucleotide
ggtgtccgaggaaactaatgagggaagtgtggggc

SEQ ID NO: 47972 - DNA, 35 bp, Artificial Sequence
  Synthetic oligonucleotide
taaacatcacggaccacggtggcaactctactatc

SEQ ID NO: 47973 - DNA, 35 bp, Artificial Sequence
  Synthetic oligonucleotide
acagtaacctccggagtccgcccaccacgtttttc

SEQ ID NO: 47974 - DNA, 35 bp, Artificial Sequence
  Synthetic oligonucleotide
gcgatatctcccccgtgcaaataaccacaccgaag

SEQ ID NO: 47975 - DNA, 35 bp, Artificial Sequence
  Synthetic oligonucleotide
gccggcccatattaggctgcccccacttgctaacg

SEQ ID NO: 47976 - DNA, 35 bp, Artificial Sequence
  Synthetic oligonucleotide
ggacctagcagggtctccgagcccccccatttctg

SEQ ID NO: 47977 - DNA, 35 bp, Artificial Sequence
  Synthetic oligonucleotide
tttcccatcgctgattatattttgccctcaccgtg

SEQ ID NO: 47978 - DNA, 35 bp, Artificial Sequence
  Synthetic oligonucleotide
gaacacctgcctcgcttccaattccggattgatat

SEQ ID NO: 47979 - DNA, 35 bp, Artificial Sequence
  Synthetic oligonucleotide
gggtctcaccgccgtacgctcctttcttcgtgact

SEQ ID NO: 47980 - DNA, 35 bp, Artificial Sequence
  Synthetic oligonucleotide
tccacggggacatctctttgcagtctactatgcct

SEQ ID NO: 47981 - DNA, 35 bp, Artificial Sequence
  Synthetic oligonucleotide
acaacgtacagaagcagttattctccgtcttttct

SEQ ID NO: 47982 - DNA, 35 bp, Artificial Sequence
  Synthetic oligonucleotide
gaaaaggaggaggggtacacaaaaaatgaatgcgt

SEQ ID NO: 47983 - DNA, 35 bp, Artificial Sequence
  Synthetic oligonucleotide
gccgaacgctattcactgagagtcccttacttatt

SEQ ID NO: 47984 - DNA, 36 bp, Artificial Sequence
  Synthetic oligonucleotide
tatgcccgttccctcgcattctctcgaccctgtaaa

SEQ ID NO: 47985 - DNA, 36 bp, Artificial Sequence
  Synthetic oligonucleotide
acactgctccaccttaaggcattcaccactgtttaa

SEQ ID NO: 47986 - DNA, 36 bp, Artificial Sequence
  Synthetic oligonucleotide
ccacacaccgatgcaactgctcgcacccacccaaca

SEQ ID NO: 47987 - DNA, 36 bp, Artificial Sequence
  Synthetic oligonucleotide
acatggtcacgcccgccaacattccccgtccttaca

SEQ ID NO: 47988 - DNA, 36 bp, Artificial Sequence
  Synthetic oligonucleotide
aagcgagccgtccaggccgtggcccatctccgctca

SEQ ID NO: 47989 - DNA, 37 bp, Artificial Sequence
  Synthetic oligonucleotide
acgtgttcctgccacactgcctgttattgtaccacga

SEQ ID NO: 47990 - DNA, 37 bp, Artificial Sequence
  Synthetic oligonucleotide
agcccaacgccgcctgccccatataaccatccttcga

SEQ ID NO: 47991 - DNA, 37 bp, Artificial Sequence
  Synthetic oligonucleotide
tcgtgcctagacgtttgcacatctccatttctttcga

SEQ ID NO: 47992 - DNA, 36 bp, Artificial Sequence
  Synthetic oligonucleotide
ggacaacgccctgtaaacacacactcccggaccgga

SEQ ID NO: 47993 - DNA, 37 bp, Artificial Sequence
  Synthetic oligonucleotide
accctgtgccctatcgatgacgaccctgatttaatga

SEQ ID NO: 47994 - DNA, 36 bp, Artificial Sequence
  Synthetic oligonucleotide
cacaccgctaacaacagccctgacccctgcccctga

SEQ ID NO: 47995 - DNA, 38 bp, Artificial Sequence
  Synthetic oligonucleotide
tgtcagtccccacacccggctacgatctcaggccctga

SEQ ID NO: 47996 - DNA, 36 bp, Artificial Sequence
  Synthetic oligonucleotide
ttcaccgatcctgtggctactctctttttggcctga

SEQ ID NO: 47997 - DNA, 38 bp, Artificial Sequence
  Synthetic oligonucleotide
acctgccatgatgccccacacctctaccccgtggctga

SEQ ID NO: 47998 - DNA, 38 bp, Artificial Sequence
  Synthetic oligonucleotide
atgaagggtggtgggtgagcttaagcggttgaaggtga

SEQ ID NO: 47999 - DNA, 37 bp, Artificial Sequence
  Synthetic oligonucleotide
gcccctcccgtgtgattttgttgcgcgtcgcccttga

SEQ ID NO: 48000 - DNA, 37 bp, Artificial Sequence
  Synthetic oligonucleotide
tcgtggtgccgtctgctcatccctacacttgcgttga

SEQ ID NO: 48001 - DNA, 35 bp, Artificial Sequence
  Synthetic oligonucleotide
tcacagacgcgctatggccctaacctggaatttga

SEQ ID NO: 48002 - DNA, 38 bp, Artificial Sequence
  Synthetic oligonucleotide
acctcaaccgtggatcggcctcgccccgttacctttga

SEQ ID NO: 48003 - DNA, 38 bp, Artificial Sequence
  Synthetic oligonucleotide
gcgtagagccaccgttgcaccaccgttgaaatttttga

SEQ ID NO: 48004 - DNA, 36 bp, Artificial Sequence
  Synthetic oligonucleotide
acctcttccgcctatcgtgtctattctctccgcgta

SEQ ID NO: 48005 - DNA, 36 bp, Artificial Sequence
  Synthetic oligonucleotide
tcagaaggacgggggaagtcacgagggatttgcgta

SEQ ID NO: 48006 - DNA, 35 bp, Artificial Sequence
  Synthetic oligonucleotide
tactgcatctttgcatctcctcgaacacagtctta

SEQ ID NO: 48007 - DNA, 36 bp, Artificial Sequence
  Synthetic oligonucleotide
gaactgggaccatctggattatgcctctccccttta

SEQ ID NO: 48008 - DNA, 35 bp, Artificial Sequence
  Synthetic oligonucleotide
ggaaaagcccgaggcaacaaaaagccggatcacac

SEQ ID NO: 48009 - DNA, 35 bp, Artificial Sequence
  Synthetic oligonucleotide
gtctcttgcctcacataatccaacacgcccgggac

SEQ ID NO: 48010 - DNA, 35 bp, Artificial Sequence
  Synthetic oligonucleotide
gcgcacaccgtactcatttttgcgattaacaatac

SEQ ID NO: 48011 - DNA, 35 bp, Artificial Sequence
  Synthetic oligonucleotide
atgcgttgagcgctagcacatctttcacatgctac

SEQ ID NO: 48012 - DNA, 35 bp, Artificial Sequence
  Synthetic oligonucleotide
tcaacgtatccgcttgtgaccagtgaggatacacc

SEQ ID NO: 48013 - DNA, 35 bp, Artificial Sequence
  Synthetic oligonucleotide
tgaatgcacaaccacacgactgagctggtgttacc

SEQ ID NO: 48014 - DNA, 36 bp, Artificial Sequence
  Synthetic oligonucleotide
gcacgcggtccctggtcttactgattgccgctcccc

SEQ ID NO: 48015 - DNA, 35 bp, Artificial Sequence
  Synthetic oligonucleotide
gaccgacatgtgaggcctcacaaacccctccgccc

SEQ ID NO: 48016 - DNA, 35 bp, Artificial Sequence
  Synthetic oligonucleotide
tgcaaaccctgctccccatgcccataacttacgcc

SEQ ID NO: 48017 - DNA, 35 bp, Artificial Sequence
  Synthetic oligonucleotide
agaccttcccccgggttattactctttgtctcgcc

SEQ ID NO: 48018 - DNA, 35 bp, Artificial Sequence
  Synthetic oligonucleotide
atacacagtggagcggaattcggggagagggcggc

SEQ ID NO: 48019 - DNA, 35 bp, Artificial Sequence
  Synthetic oligonucleotide
tgtgccacagaccgcttttggtctgaacctcctgc

SEQ ID NO: 48020 - DNA, 35 bp, Artificial Sequence
  Synthetic oligonucleotide
attggcccgccctgcgtatggtaatttccccgtgc

SEQ ID NO: 48021 - DNA, 35 bp, Artificial Sequence
  Synthetic oligonucleotide
gccactcaccgcaacccgacacatcccgtgacctc

SEQ ID NO: 48022 - DNA, 35 bp, Artificial Sequence
  Synthetic oligonucleotide
aaagcacagaccagagggacgttactgtggcattc

SEQ ID NO: 48023 - DNA, 35 bp, Artificial Sequence
  Synthetic oligonucleotide
tcgagcgcccgccacgacccccgactttaagcaag

SEQ ID NO: 48024 - DNA, 35 bp, Artificial Sequence
  Synthetic oligonucleotide
gagcggagcaggaggaaggaatggaaaataaatgg

SEQ ID NO: 48025 - DNA, 35 bp, Artificial Sequence
  Synthetic oligonucleotide
taccacgacactctgccatcccgcgaacgtccaat

SEQ ID NO: 48026 - DNA, 35 bp, Artificial Sequence
  Synthetic oligonucleotide
gttgtgctcgctacgtcctccccccgacattttgt

SEQ ID NO: 48027 - DNA, 35 bp, Artificial Sequence
  Synthetic oligonucleotide
accatgcgcacatctttgagtggccatcacaaatt

SEQ ID NO: 48028 - DNA, 35 bp, Artificial Sequence
  Synthetic oligonucleotide
tgactcaccatgtttacgtcgcaaatttcttccaa

SEQ ID NO: 48029 - DNA, 36 bp, Artificial Sequence
  Synthetic oligonucleotide
tcacgccgaaagccacgtaacccctgccgggatcaa

SEQ ID NO: 48030 - DNA, 36 bp, Artificial Sequence
  Synthetic oligonucleotide
gacgtgcaatgagcgaatgcctgccaactttccaca

SEQ ID NO: 48031 - DNA, 36 bp, Artificial Sequence
  Synthetic oligonucleotide
gccaactcgagttgatgccacttaggccgaccccca

SEQ ID NO: 48032 - DNA, 36 bp, Artificial Sequence
  Synthetic oligonucleotide
tcgacgggcggtatcatgttccttttaggtcctcca

SEQ ID NO: 48033 - DNA, 35 bp, Artificial Sequence
  Synthetic oligonucleotide
aacatccgcaacactcgatatcctcactgatggca

SEQ ID NO: 48034 - DNA, 35 bp, Artificial Sequence
  Synthetic oligonucleotide
tgcacgctgtcccgccggtcggagtcatcttctca

SEQ ID NO: 48035 - DNA, 37 bp, Artificial Sequence
  Synthetic oligonucleotide
acgcgacctcaaatctgctttactccgtacgtgtaga

SEQ ID NO: 48036 - DNA, 37 bp, Artificial Sequence
  Synthetic oligonucleotide
gcccactggcccatgtataccttttctatcataccga

SEQ ID NO: 48037 - DNA, 37 bp, Artificial Sequence
  Synthetic oligonucleotide
atgccaaccgccaaagtgcccgccttcccgtcgagga

SEQ ID NO: 48038 - DNA, 37 bp, Artificial Sequence
  Synthetic oligonucleotide
gtcgcaaggaaagcgggggggaaaactgtgggtggga

SEQ ID NO: 48039 - DNA, 37 bp, Artificial Sequence
  Synthetic oligonucleotide
accctggtgtagaggtgaacgtggggatggattggga

SEQ ID NO: 48040 - DNA, 38 bp, Artificial Sequence
  Synthetic oligonucleotide
atggtctgttgtcccctatgtcccgtcccacctgctga

SEQ ID NO: 48041 - DNA, 37 bp, Artificial Sequence
  Synthetic oligonucleotide
tgcatgccaatgcgcttcgcctccagcaaccatctga

SEQ ID NO: 48042 - DNA, 38 bp, Artificial Sequence
  Synthetic oligonucleotide
cactctgcccagctttcctgttcctactcatttggtga

SEQ ID NO: 48043 - DNA, 38 bp, Artificial Sequence
  Synthetic oligonucleotide
gcgcgcccctcgtctccgctattatggcttcacattga

SEQ ID NO: 48044 - DNA, 35 bp, Artificial Sequence
  Synthetic oligonucleotide
agctctcacgtcagccaccgccccccaatacttga

SEQ ID NO: 48045 - DNA, 36 bp, Artificial Sequence
  Synthetic oligonucleotide
ttgacatcctgctctatgtcccttgcaactgcttga

SEQ ID NO: 48046 - DNA, 36 bp, Artificial Sequence
  Synthetic oligonucleotide
acacacgatcataacgcgaccttcgaacactctata

SEQ ID NO: 48047 - DNA, 36 bp, Artificial Sequence
  Synthetic oligonucleotide
ttagcaccttcctagcctatcccttctaagtgccta

SEQ ID NO: 48048 - DNA, 36 bp, Artificial Sequence
  Synthetic oligonucleotide
tgcccaggctttctccgtgcggtcctcacagttcta

SEQ ID NO: 48049 - DNA, 36 bp, Artificial Sequence
  Synthetic oligonucleotide
ggaatgcgactactcgtgcctgctcactcccccgta

SEQ ID NO: 48050 - DNA, 35 bp, Artificial Sequence
  Synthetic oligonucleotide
acaccgtacggcgaagcatcgagctccctgtcgta

SEQ ID NO: 48051 - DNA, 36 bp, Artificial Sequence
  Synthetic oligonucleotide
tccacgccccgttgtcctatctgcattcgtacctta

SEQ ID NO: 48052 - DNA, 35 bp, Artificial Sequence
  Synthetic oligonucleotide
ttcggtcccgcgatatctgctctacaccttcgtta

SEQ ID NO: 48053 - DNA, 35 bp, Artificial Sequence
  Synthetic oligonucleotide
gtcctgcccccaccgtcgcaatggtgaacgctaac

SEQ ID NO: 48054 - DNA, 35 bp, Artificial Sequence
  Synthetic oligonucleotide
gacacaactctgaaacgtgcatctcccactggtgc

SEQ ID NO: 48055 - DNA, 35 bp, Artificial Sequence
  Synthetic oligonucleotide
gcctggaacatcgcgattaaagcacgaaatgcatc

SEQ ID NO: 48056 - DNA, 35 bp, Artificial Sequence
  Synthetic oligonucleotide
gacaacccgatctggtctaggtatcacttttattc

SEQ ID NO: 48057 - DNA, 35 bp, Artificial Sequence
  Synthetic oligonucleotide
gaggctccccacaacatgctctgtaactgtcttcg

SEQ ID NO: 48058 - DNA, 35 bp, Artificial Sequence
  Synthetic oligonucleotide
tcccaagccacagagcctggtgagggagggagggg

SEQ ID NO: 48059 - DNA, 35 bp, Artificial Sequence
  Synthetic oligonucleotide
acccgccacattgttatgggttttttgcattatat

SEQ ID NO: 48060 - DNA, 35 bp, Artificial Sequence
  Synthetic oligonucleotide
ggtgggttacactggcccttttgacgcatacgact

SEQ ID NO: 48061 - DNA, 35 bp, Artificial Sequence
  Synthetic oligonucleotide
tgccgggctaccaggttcgctcatattcttgccct

SEQ ID NO: 48062 - DNA, 35 bp, Artificial Sequence
  Synthetic oligonucleotide
aatccccctccattcaagtagaccacgtttcgcct

SEQ ID NO: 48063 - DNA, 35 bp, Artificial Sequence
  Synthetic oligonucleotide
gtgcaatgggcgtgttgacgcgcaaccttttttct

SEQ ID NO: 48064 - DNA, 35 bp, Artificial Sequence
  Synthetic oligonucleotide
tgattacgtcgctcatgagcctgctgcactcactt

SEQ ID NO: 48065 - DNA, 35 bp, Artificial Sequence
  Synthetic oligonucleotide
ttcaagccacctcctgggagttgaactttaccttt

SEQ ID NO: 48066 - DNA, 35 bp, Artificial Sequence
  Synthetic oligonucleotide
acacccgtgcgtcgccgaccctgcatacacaacaa

SEQ ID NO: 48067 - DNA, 36 bp, Artificial Sequence
  Synthetic oligonucleotide
gcaccaccaccgcgaaacttgcctcatcgtcccgaa

SEQ ID NO: 48068 - DNA, 35 bp, Artificial Sequence
  Synthetic oligonucleotide
acgcccatttcgccactcttcccttgttcccgtaa

SEQ ID NO: 48069 - DNA, 36 bp, Artificial Sequence
  Synthetic oligonucleotide
gccttacctacgttcccatttgtctgcagtacacca

SEQ ID NO: 48070 - DNA, 35 bp, Artificial Sequence
  Synthetic oligonucleotide
acatggcgagggggggaacgcggatagcagtatca

SEQ ID NO: 48071 - DNA, 35 bp, Artificial Sequence
  Synthetic oligonucleotide
gtgtcttccgtaattgcaataccactgcccactca

SEQ ID NO: 48072 - DNA, 36 bp, Artificial Sequence
  Synthetic oligonucleotide
ttgatgtccggcctccctgtgttcatgtgggtctca

SEQ ID NO: 48073 - DNA, 37 bp, Artificial Sequence
  Synthetic oligonucleotide
ggaaacgcatgggggggccgggtagtaatcggggaga

SEQ ID NO: 48074 - DNA, 37 bp, Artificial Sequence
  Synthetic oligonucleotide
agaaaaggggggctgggaacgtgaccggtgggttaga

SEQ ID NO: 48075 - DNA, 36 bp, Artificial Sequence
  Synthetic oligonucleotide
tacgcttccatccaacaccggactttactttcgcga

SEQ ID NO: 48076 - DNA, 37 bp, Artificial Sequence
  Synthetic oligonucleotide
gtacagtgggcaaattgggaggatgggagttttagga

SEQ ID NO: 48077 - DNA, 37 bp, Artificial Sequence
  Synthetic oligonucleotide
acacctgtacccagccaacagtctacaaggttgtgga

SEQ ID NO: 48078 - DNA, 37 bp, Artificial Sequence
  Synthetic oligonucleotide
tgaccacccttgccatgacagcttcgtcgtaccatga

SEQ ID NO: 48079 - DNA, 38 bp, Artificial Sequence
  Synthetic oligonucleotide
accaccaacgtcgtctcgctcctagtcttatcccatga

SEQ ID NO: 48080 - DNA, 38 bp, Artificial Sequence
  Synthetic oligonucleotide
tgcccccgccagtggcattactcctgttcacattatga

SEQ ID NO: 48081 - DNA, 36 bp, Artificial Sequence
  Synthetic oligonucleotide
gtcacccaggcggcccaacacattaacgttcactga

SEQ ID NO: 48082 - DNA, 38 bp, Artificial Sequence
  Synthetic oligonucleotide
aaggtcactgaggggggaggtgagggagcatggactga

SEQ ID NO: 48083 - DNA, 38 bp, Artificial Sequence
  Synthetic oligonucleotide
tgatccacgttccatctctttcattacgacttacctga

SEQ ID NO: 48084 - DNA, 38 bp, Artificial Sequence
  Synthetic oligonucleotide
tatccgcactgatccgctctcttttctgacgtccctga

SEQ ID NO: 48085 - DNA, 37 bp, Artificial Sequence
  Synthetic oligonucleotide
gatgctggtccacattctcctctccgacccctcctga

SEQ ID NO: 48086 - DNA, 38 bp, Artificial Sequence
  Synthetic oligonucleotide
gacagtcgcacagtgcaaaatgggggctggttgagtga

SEQ ID NO: 48087 - DNA, 37 bp, Artificial Sequence
  Synthetic oligonucleotide
actgccgagggaaacacatagtggggggaacacgtga

SEQ ID NO: 48088 - DNA, 36 bp, Artificial Sequence
  Synthetic oligonucleotide
acccgtgccgaacaatctgatcccagacccggaata

SEQ ID NO: 48089 - DNA, 36 bp, Artificial Sequence
  Synthetic oligonucleotide
gccgccatcccagtcatcctctatcttggtagcata

SEQ ID NO: 48090 - DNA, 36 bp, Artificial Sequence
  Synthetic oligonucleotide
aaccgaggtgggtgggcctggagggagacacagata

SEQ ID NO: 48091 - DNA, 35 bp, Artificial Sequence
  Synthetic oligonucleotide
aagacctggcccgtgaaccttcctcctgtcgtata

SEQ ID NO: 48092 - DNA, 35 bp, Artificial Sequence
  Synthetic oligonucleotide
ggtcaacccctcagctctttctttattgcacgtta

SEQ ID NO: 48093 - DNA, 36 bp, Artificial Sequence
  Synthetic oligonucleotide
tgctcgcattttcgcatgacgacctgccacctttta

SEQ ID NO: 48094 - DNA, 36 bp, Artificial Sequence
  Synthetic oligonucleotide
ttcgccactcccccgaattaagcacgcccgaaagac

SEQ ID NO: 48095 - DNA, 35 bp, Artificial Sequence
  Synthetic oligonucleotide
gaaccgcacataaccacaaggtgtatccccacacc

SEQ ID NO: 48096 - DNA, 35 bp, Artificial Sequence
  Synthetic oligonucleotide
tgtacgtcctcggctagttgttgtacccttccacc

SEQ ID NO: 48097 - DNA, 35 bp, Artificial Sequence
  Synthetic oligonucleotide
gacaaccgttcacaacaattcatgggttggcaccc

SEQ ID NO: 48098 - DNA, 35 bp, Artificial Sequence
  Synthetic oligonucleotide
gcagatgttccggttccgccataccagtctccccc

SEQ ID NO: 48099 - DNA, 35 bp, Artificial Sequence
  Synthetic oligonucleotide
atcacatatccgccctgttgaccggatctcttccc

SEQ ID NO: 48100 - DNA, 35 bp, Artificial Sequence
  Synthetic oligonucleotide
gatacccattaggtcacagtgccttgagccccgcc

SEQ ID NO: 48101 - DNA, 35 bp, Artificial Sequence
  Synthetic oligonucleotide
tcgggtacctcgcccccttctaaggaccatatgcc

SEQ ID NO: 48102 - DNA, 35 bp, Artificial Sequence
  Synthetic oligonucleotide
tcccggggcagggtagcaggcctcctatttccatc

SEQ ID NO: 48103 - DNA, 35 bp, Artificial Sequence
  Synthetic oligonucleotide
taatcgcgagtctaatcggtctcactccccctctc

SEQ ID NO: 48104 - DNA, 35 bp, Artificial Sequence
  Synthetic oligonucleotide
tctaccaccctttctttatccagtccccggactgg

SEQ ID NO: 48105 - DNA, 35 bp, Artificial Sequence
  Synthetic oligonucleotide
gacatttccctgtcgccatgcaccacgcttacaat

SEQ ID NO: 48106 - DNA, 35 bp, Artificial Sequence
  Synthetic oligonucleotide
gttgtccacgatcacgtaatcgggacttcttacat

SEQ ID NO: 48107 - DNA, 35 bp, Artificial Sequence
  Synthetic oligonucleotide
gtgcacacggacctcaagatcatcactccattcct

SEQ ID NO: 48108 - DNA, 35 bp, Artificial Sequence
  Synthetic oligonucleotide
gacatgtgtcacccgttcgcttatcttacagtgct

SEQ ID NO: 48109 - DNA, 35 bp, Artificial Sequence
  Synthetic oligonucleotide
tccatcccgactcgataaatttcttctagcctggt

SEQ ID NO: 48110 - DNA, 35 bp, Artificial Sequence
  Synthetic oligonucleotide
gcactctgacgcaaatccgtactccccggccatgt

SEQ ID NO: 48111 - DNA, 35 bp, Artificial Sequence
  Synthetic oligonucleotide
acgaagccccgtttcccgtcccgttagtattcttt

SEQ ID NO: 48112 - DNA, 36 bp, Artificial Sequence
  Synthetic oligonucleotide
atctggcgcagctcgagtctcccgcctcacaccaaa

SEQ ID NO: 48113 - DNA, 35 bp, Artificial Sequence
  Synthetic oligonucleotide
gcgttccctcctcacagcccgtgtgtctgcttcaa

SEQ ID NO: 48114 - DNA, 35 bp, Artificial Sequence
  Synthetic oligonucleotide
aagagccacaagcgagttcaccccggggcttacca

SEQ ID NO: 48115 - DNA, 35 bp, Artificial Sequence
  Synthetic oligonucleotide
tgccaaacagccatctattgttctccggtttacca

SEQ ID NO: 48116 - DNA, 36 bp, Artificial Sequence
  Synthetic oligonucleotide
tccaccctccgtcagaaagtggtcccgccgtgtgca

SEQ ID NO: 48117 - DNA, 36 bp, Artificial Sequence
  Synthetic oligonucleotide
agaccctccttccacgttgagtttattaaccttgca

SEQ ID NO: 48118 - DNA, 37 bp, Artificial Sequence
  Synthetic oligonucleotide
tagcgccactggctattatcaccttcctctcgacaga

SEQ ID NO: 48119 - DNA, 37 bp, Artificial Sequence
  Synthetic oligonucleotide
gcgtgcacttatacatgtctccgtattctgcccccga

SEQ ID NO: 48120 - DNA, 37 bp, Artificial Sequence
  Synthetic oligonucleotide
gcacgaccgtgactcaccacacgcttccaccagccga

SEQ ID NO: 48121 - DNA, 37 bp, Artificial Sequence
  Synthetic oligonucleotide
atgtgggggtacgggtgagtggaaatgcagagcgcga

SEQ ID NO: 48122 - DNA, 36 bp, Artificial Sequence
  Synthetic oligonucleotide
gatgagcaaggggatcggaggtgctgggagggtcga

SEQ ID NO: 48123 - DNA, 37 bp, Artificial Sequence
  Synthetic oligonucleotide
acgcgtgcaaccctgcgcgcgaggagcccactttcga

SEQ ID NO: 48124 - DNA, 37 bp, Artificial Sequence
  Synthetic oligonucleotide
gcgctgtgtgcgccctcatgttcccctatacgcagga

SEQ ID NO: 48125 - DNA, 37 bp, Artificial Sequence
  Synthetic oligonucleotide
gtcccgccaactgtctatacctttttcgcacatagga

SEQ ID NO: 48126 - DNA, 37 bp, Artificial Sequence
  Synthetic oligonucleotide
acccaaccgaggaaaccgagggggactgtccttagga

SEQ ID NO: 48127 - DNA, 37 bp, Artificial Sequence
  Synthetic oligonucleotide
ggtacagggagtagggaacgagggggaaagagacgga

SEQ ID NO: 48128 - DNA, 38 bp, Artificial Sequence
  Synthetic oligonucleotide
gaacaggggaatgcactgtatggtgggggacgtgatga

SEQ ID NO: 48129 - DNA, 37 bp, Artificial Sequence
  Synthetic oligonucleotide
gcaatagtcacgcgttcttctcccgttgctttactga

SEQ ID NO: 48130 - DNA, 38 bp, Artificial Sequence
  Synthetic oligonucleotide
gcaaagtccgtcgattacacctcgcgcgtccaccctga

SEQ ID NO: 48131 - DNA, 37 bp, Artificial Sequence
  Synthetic oligonucleotide
tcactgacgccccttgtatcctcatctgaaagcctga

SEQ ID NO: 48132 - DNA, 38 bp, Artificial Sequence
  Synthetic oligonucleotide
tgtgccagcccgactagatatcacccgttgcactctga

SEQ ID NO: 48133 - DNA, 38 bp, Artificial Sequence
  Synthetic oligonucleotide
tccctacgtcctccctatttgagctcaccttattctga

SEQ ID NO: 48134 - DNA, 37 bp, Artificial Sequence
  Synthetic oligonucleotide
atgtgtaggtaggctgaggaactgaggggggaattga

SEQ ID NO: 48135 - DNA, 37 bp, Artificial Sequence
  Synthetic oligonucleotide
tccgtaggaggcatagttccgtatcacgctaccttga

SEQ ID NO: 48136 - DNA, 38 bp, Artificial Sequence
  Synthetic oligonucleotide
gtagggcggggcgggggggcgagccatggtttggttga

SEQ ID NO: 48137 - DNA, 35 bp, Artificial Sequence
  Synthetic oligonucleotide
tcctcgtggacggcccaccatcttacgtatttata

SEQ ID NO: 48138 - DNA, 35 bp, Artificial Sequence
  Synthetic oligonucleotide
tatggcgcccccaagcttttctgctagactggaac

SEQ ID NO: 48139 - DNA, 35 bp, Artificial Sequence
  Synthetic oligonucleotide
tcgcaaacgcctgtacctcagctcacacttcccac

SEQ ID NO: 48140 - DNA, 35 bp, Artificial Sequence
  Synthetic oligonucleotide
tggtgacctcactccgtaccaaccgggaaacaacc

SEQ ID NO: 48141 - DNA, 35 bp, Artificial Sequence
  Synthetic oligonucleotide
gccattgtccctttgttgcctgcctcgggataccc

SEQ ID NO: 48142 - DNA, 35 bp, Artificial Sequence
  Synthetic oligonucleotide
taccaaatgctctgcctcgttttgctctcacccgc

SEQ ID NO: 48143 - DNA, 35 bp, Artificial Sequence
  Synthetic oligonucleotide
atctcaccgacgggatcctgacattcgaggccgtc

SEQ ID NO: 48144 - DNA, 35 bp, Artificial Sequence
  Synthetic oligonucleotide
gcccactcgtctcgcgcactgattttttgcccagg

SEQ ID NO: 48145 - DNA, 35 bp, Artificial Sequence
  Synthetic oligonucleotide
tgtttccatatagccggaccctccttccttgcagg

SEQ ID NO: 48146 - DNA, 35 bp, Artificial Sequence
  Synthetic oligonucleotide
atcccagttcctcccccgagaaaggtgcctttatg

SEQ ID NO: 48147 - DNA, 35 bp, Artificial Sequence
  Synthetic oligonucleotide
gagtccacccgcaaacttcgccgagcaagcccctg

SEQ ID NO: 48148 - DNA, 35 bp, Artificial Sequence
  Synthetic oligonucleotide
ttgaacccgatcaggctcggtcccgctgacccaat

SEQ ID NO: 48149 - DNA, 35 bp, Artificial Sequence
  Synthetic oligonucleotide
ggtgctggtacctgtccacgaagtgctttttctat

SEQ ID NO: 48150 - DNA, 34 bp, Artificial Sequence
  Synthetic oligonucleotide
gtcgctcttaccctcacacccttgggcccttcgt

SEQ ID NO: 48151 - DNA, 35 bp, Artificial Sequence
  Synthetic oligonucleotide
aactagggcgagcattgcgcacatcatacaccatt

SEQ ID NO: 48152 - DNA, 35 bp, Artificial Sequence
  Synthetic oligonucleotide
gaacatacgccggttacgccccttagaactatatt

SEQ ID NO: 48153 - DNA, 35 bp, Artificial Sequence
  Synthetic oligonucleotide
gccctacagtgctggtgctcttctgtaaatctatt

SEQ ID NO: 48154 - DNA, 35 bp, Artificial Sequence
  Synthetic oligonucleotide
acaccagctacattgttctgccgattatctgtttt

SEQ ID NO: 48155 - DNA, 35 bp, Artificial Sequence
  Synthetic oligonucleotide
tcgcctcctctggtttacccgccgcctatcttaaa

SEQ ID NO: 48156 - DNA, 35 bp, Artificial Sequence
  Synthetic oligonucleotide
tccacccctcgtgccgctcatccaattctgtacaa

SEQ ID NO: 48157 - DNA, 35 bp, Artificial Sequence
  Synthetic oligonucleotide
tgacgggcgtgtcctggtcatcatctgcccttcaa

SEQ ID NO: 48158 - DNA, 36 bp, Artificial Sequence
  Synthetic oligonucleotide
ggtacggaggagaagcctgaggggagttgacgggaa

SEQ ID NO: 48159 - DNA, 35 bp, Artificial Sequence
  Synthetic oligonucleotide
atcagttgccctccctcatgtttcttccatcctaa

SEQ ID NO: 48160 - DNA, 36 bp, Artificial Sequence
  Synthetic oligonucleotide
tctgatgcctcctcttcacagtttgcccttctgaca

SEQ ID NO: 48161 - DNA, 35 bp, Artificial Sequence
  Synthetic oligonucleotide
actgaagactacctcctgcctgttttgtttgtaca

SEQ ID NO: 48162 - DNA, 36 bp, Artificial Sequence
  Synthetic oligonucleotide
tgagccccgtttgcagcgcctgcccacggccctcca

SEQ ID NO: 48163 - DNA, 36 bp, Artificial Sequence
  Synthetic oligonucleotide
gcaactcccccagcaagccaatgggaaatgcttcca

SEQ ID NO: 48164 - DNA, 36 bp, Artificial Sequence
  Synthetic oligonucleotide
aatggtgcaagtggggaaatcatagaggcttgcgca

SEQ ID NO: 48165 - DNA, 36 bp, Artificial Sequence
  Synthetic oligonucleotide
tttacaccctcaacgtgcatggtcgtatctcgatca

SEQ ID NO: 48166 - DNA, 37 bp, Artificial Sequence
  Synthetic oligonucleotide
accacctgcccagtctcctaacgcgctttatgtgcga

SEQ ID NO: 48167 - DNA, 36 bp, Artificial Sequence
  Synthetic oligonucleotide
accaccagtcgcttgttatacctctcctggattcga

SEQ ID NO: 48168 - DNA, 37 bp, Artificial Sequence
  Synthetic oligonucleotide
gaaaacgtcgggcgggtgcggtgggatactttacgga

SEQ ID NO: 48169 - DNA, 37 bp, Artificial Sequence
  Synthetic oligonucleotide
aaagacaacgcgaagacggtcgtctgaggggaaggga

SEQ ID NO: 48170 - DNA, 37 bp, Artificial Sequence
  Synthetic oligonucleotide
gcccgccgtaggagagggtggggttatgtttccggga

SEQ ID NO: 48171 - DNA, 37 bp, Artificial Sequence
  Synthetic oligonucleotide
aaagaagcaaggtgcgcaagggctcaggagggcggga

SEQ ID NO: 48172 - DNA, 35 bp, Artificial Sequence
  Synthetic oligonucleotide
gaccccccaccaaaattgatacgatactacctgga

SEQ ID NO: 48173 - DNA, 37 bp, Artificial Sequence
  Synthetic oligonucleotide
gttggaacgagggaggtaggtatggagtcaggttgga

SEQ ID NO: 48174 - DNA, 38 bp, Artificial Sequence
  Synthetic oligonucleotide
tccctcgccacatactccgcgaatattgccctacgtga

SEQ ID NO: 48175 - DNA, 38 bp, Artificial Sequence
  Synthetic oligonucleotide
accccgtacagacccacccgtaacgtcccgtgccgtga

SEQ ID NO: 48176 - DNA, 38 bp, Artificial Sequence
  Synthetic oligonucleotide
gagtcacaatgcgccagtgacgcaccatctttcattga

SEQ ID NO: 48177 - DNA, 38 bp, Artificial Sequence
  Synthetic oligonucleotide
tcagtcaagcaactatggctattacagcagttcgttga

SEQ ID NO: 48178 - DNA, 36 bp, Artificial Sequence
  Synthetic oligonucleotide
accaccaaaccctggttccccgtgacgacgaaagta

SEQ ID NO: 48179 - DNA, 36 bp, Artificial Sequence
  Synthetic oligonucleotide
atgccgggtggtcgcccgaaaagattattcctcgta

SEQ ID NO: 48180 - DNA, 36 bp, Artificial Sequence
  Synthetic oligonucleotide
acgacgtctgcgcccccctcttatcgcgatgcatta

SEQ ID NO: 48181 - DNA, 36 bp, Artificial Sequence
  Synthetic oligonucleotide
tgcgacacaccacagtcagccctttaccaccggtta

SEQ ID NO: 48182 - DNA, 35 bp, Artificial Sequence
  Synthetic oligonucleotide
tgaaccaaggagggcggacgggaggggtgagcgac

SEQ ID NO: 48183 - DNA, 35 bp, Artificial Sequence
  Synthetic oligonucleotide
agctcacccgccgactaggcccccagtacccctac

SEQ ID NO: 48184 - DNA, 35 bp, Artificial Sequence
  Synthetic oligonucleotide
tgctcggacgcaaatgcgctgaaaatcaacatacc

SEQ ID NO: 48185 - DNA, 35 bp, Artificial Sequence
  Synthetic oligonucleotide
taccatcggcctctaatggctccggtccttatgcc

SEQ ID NO: 48186 - DNA, 35 bp, Artificial Sequence
  Synthetic oligonucleotide
atccgcagaggcctaccggtccttctttccactgc

SEQ ID NO: 48187 - DNA, 35 bp, Artificial Sequence
  Synthetic oligonucleotide
gacgacgttcggagtcatggacactcaggagttgc

SEQ ID NO: 48188 - DNA, 35 bp, Artificial Sequence
  Synthetic oligonucleotide
atccacctgatcgaccgcactctgcactctgcctc

SEQ ID NO: 48189 - DNA, 35 bp, Artificial Sequence
  Synthetic oligonucleotide
attgcatgacgcccattatcgacccatattcattc

SEQ ID NO: 48190 - DNA, 36 bp, Artificial Sequence
  Synthetic oligonucleotide
tagggaacgggaaggaattgcgccgggtgaggttag

SEQ ID NO: 48191 - DNA, 35 bp, Artificial Sequence
  Synthetic oligonucleotide
gctaagtcggggctggggtggtggggttcgttccg

SEQ ID NO: 48192 - DNA, 35 bp, Artificial Sequence
  Synthetic oligonucleotide
gggtgacggaggatagataagggggaggtcgaagg

SEQ ID NO: 48193 - DNA, 35 bp, Artificial Sequence
  Synthetic oligonucleotide
gcggagggagggagggttagaatcgatctgtgatg

SEQ ID NO: 48194 - DNA, 35 bp, Artificial Sequence
  Synthetic oligonucleotide
acattggtcgcgcccctgcaatttgaacctgactg

SEQ ID NO: 48195 - DNA, 35 bp, Artificial Sequence
  Synthetic oligonucleotide
gcagagcctcctgcgcattttcccgagattgtctg

SEQ ID NO: 48196 - DNA, 35 bp, Artificial Sequence
  Synthetic oligonucleotide
tcctccccttctatgcgccctctatctcacgattg

SEQ ID NO: 48197 - DNA, 35 bp, Artificial Sequence
  Synthetic oligonucleotide
ttctgcagccacagcccctgcagtgccaccctgct

SEQ ID NO: 48198 - DNA, 35 bp, Artificial Sequence
  Synthetic oligonucleotide
ttcacgcaggttccgtagtttctcttctaccttct

SEQ ID NO: 48199 - DNA, 35 bp, Artificial Sequence
  Synthetic oligonucleotide
gcccgcaactttgctggtgccaccatatctctatt

SEQ ID NO: 48200 - DNA, 34 bp, Artificial Sequence
  Synthetic oligonucleotide
gcgagccagtcaaatccctgctgctttacaccaa

SEQ ID NO: 48201 - DNA, 35 bp, Artificial Sequence
  Synthetic oligonucleotide
atacacctgccacgggaacatggcccactgccgaa

SEQ ID NO: 48202 - DNA, 36 bp, Artificial Sequence
  Synthetic oligonucleotide
aacgccgtacatttatcgggcactcacactgaaaca

SEQ ID NO: 48203 - DNA, 35 bp, Artificial Sequence
  Synthetic oligonucleotide
gacgcctccccgagccagccgaccgccgtttcaca

SEQ ID NO: 48204 - DNA, 35 bp, Artificial Sequence
  Synthetic oligonucleotide
gaacacgctacgaactacctttttctaacagacca

SEQ ID NO: 48205 - DNA, 35 bp, Artificial Sequence
  Synthetic oligonucleotide
gcactcaagtgataccacgttctctcattgcccca

SEQ ID NO: 48206 - DNA, 35 bp, Artificial Sequence
  Synthetic oligonucleotide
tgtcttccccaagctccaacaactggtccacgcca

SEQ ID NO: 48207 - DNA, 36 bp, Artificial Sequence
  Synthetic oligonucleotide
gactgcccgtcgaactaaatcccgctgtgcacctca

SEQ ID NO: 48208 - DNA, 36 bp, Artificial Sequence
  Synthetic oligonucleotide
acatcgccggcttttgttgctgtcccttggtcgtca

SEQ ID NO: 48209 - DNA, 37 bp, Artificial Sequence
  Synthetic oligonucleotide
ggaaggggtatggcgcgtgggcagggaacgacggaga

SEQ ID NO: 48210 - DNA, 37 bp, Artificial Sequence
  Synthetic oligonucleotide
tcatggcctctgctccctgtcgcgacttcctgctaga

SEQ ID NO: 48211 - DNA, 36 bp, Artificial Sequence
  Synthetic oligonucleotide
gtcacccctgatgctgactaattgttttaccgccga

SEQ ID NO: 48212 - DNA, 37 bp, Artificial Sequence
  Synthetic oligonucleotide
gcacagtaggaaatgtgtcctcgttttaccctgccga

SEQ ID NO: 48213 - DNA, 37 bp, Artificial Sequence
  Synthetic oligonucleotide
gatccctgtgcacgatacgccccaccttaccacgcga

SEQ ID NO: 48214 - DNA, 37 bp, Artificial Sequence
  Synthetic oligonucleotide
tgacaagaagcacggactggaggatggtagagggcga

SEQ ID NO: 48215 - DNA, 36 bp, Artificial Sequence
  Synthetic oligonucleotide
tgacatcgcttgtaatccaccccgcccgcctatcga

SEQ ID NO: 48216 - DNA, 37 bp, Artificial Sequence
  Synthetic oligonucleotide
atgggataggcacaaggagtcggggcaggtgggcgga

SEQ ID NO: 48217 - DNA, 37 bp, Artificial Sequence
  Synthetic oligonucleotide
accggagccaaggcatacgtggagggggaggatcgga

SEQ ID NO: 48218 - DNA, 36 bp, Artificial Sequence
  Synthetic oligonucleotide
agaccagggacggggtggttcatgattgtgggggga

SEQ ID NO: 48219 - DNA, 37 bp, Artificial Sequence
  Synthetic oligonucleotide
acacccccaatacttgtgcatctggacgaagcctgga

SEQ ID NO: 48220 - DNA, 37 bp, Artificial Sequence
  Synthetic oligonucleotide
ggtcggcccctcatccaatccacgctggcacacatga

SEQ ID NO: 48221 - DNA, 38 bp, Artificial Sequence
  Synthetic oligonucleotide
gagtgagaggtgagagacgtgtgtatgggtgaagatga

SEQ ID NO: 48222 - DNA, 38 bp, Artificial Sequence
  Synthetic oligonucleotide
tttgtcaccggtcgccgtagtcctctctgccctactga

SEQ ID NO: 48223 - DNA, 38 bp, Artificial Sequence
  Synthetic oligonucleotide
atggacacgcctatgctctcacaagctctgcaacctga

SEQ ID NO: 48224 - DNA, 38 bp, Artificial Sequence
  Synthetic oligonucleotide
tagagagcgagtgtcgcgttttccactgccttccctga

SEQ ID NO: 48225 - DNA, 38 bp, Artificial Sequence
  Synthetic oligonucleotide
gcatcggggagataaaacagggctctgacagtgagtga

SEQ ID NO: 48226 - DNA, 37 bp, Artificial Sequence
  Synthetic oligonucleotide
gctggacacgtttgccccctatgtgtctgttttgtga

SEQ ID NO: 48227 - DNA, 38 bp, Artificial Sequence
  Synthetic oligonucleotide
gaaggggccgaccgggaggggggacgacttaggtttga

SEQ ID NO: 48228 - DNA, 36 bp, Artificial Sequence
  Synthetic oligonucleotide
aactagcccccctgcgccccgatatgccccgccata

SEQ ID NO: 48229 - DNA, 36 bp, Artificial Sequence
  Synthetic oligonucleotide
tacttagcatcccatgcccctcgcctcgcaccccta

SEQ ID NO: 48230 - DNA, 35 bp, Artificial Sequence
  Synthetic oligonucleotide
gaggggagatcgaatcttggggggttgggacagta

SEQ ID NO: 48231 - DNA, 36 bp, Artificial Sequence
  Synthetic oligonucleotide
tagagccggtgcgttgtgggagagggagggcgagta

SEQ ID NO: 48232 - DNA, 36 bp, Artificial Sequence
  Synthetic oligonucleotide
tgtgtgcaaccgattcgtgatctctcctcgttgtta

SEQ ID NO: 48233 - DNA, 35 bp, Artificial Sequence
  Synthetic oligonucleotide
tacaccgattcgcgctcatgtctattttgctctac

SEQ ID NO: 48234 - DNA, 35 bp, Artificial Sequence
  Synthetic oligonucleotide
tctacgccacctaggcctttgagattacaagttac

SEQ ID NO: 48235 - DNA, 35 bp, Artificial Sequence
  Synthetic oligonucleotide
actgatgacgcccgtcgcctaactagagttgcacc

SEQ ID NO: 48236 - DNA, 35 bp, Artificial Sequence
  Synthetic oligonucleotide
ttctaccctgaatgatatgggctctggaaataccc

SEQ ID NO: 48237 - DNA, 35 bp, Artificial Sequence
  Synthetic oligonucleotide
acccgcgtgactcaccttgtacttaaatttcatcc

SEQ ID NO: 48238 - DNA, 35 bp, Artificial Sequence
  Synthetic oligonucleotide
tagaccatactatgcttcatatcgcgggccgatcc

SEQ ID NO: 48239 - DNA, 35 bp, Artificial Sequence
  Synthetic oligonucleotide
agccatggctgccattttgaagttatcgtctatcc

SEQ ID NO: 48240 - DNA, 35 bp, Artificial Sequence
  Synthetic oligonucleotide
gcattctacaattggcctcactcgaaccacctcgc

SEQ ID NO: 48241 - DNA, 35 bp, Artificial Sequence
  Synthetic oligonucleotide
tgttccatcgcagtgtctacctaacgtgatttgtc

SEQ ID NO: 48242 - DNA, 35 bp, Artificial Sequence
  Synthetic oligonucleotide
tctcccccgcaacctatgagcaataactatgtccg

SEQ ID NO: 48243 - DNA, 35 bp, Artificial Sequence
  Synthetic oligonucleotide
gccaaatagggagggtgggtacgcagttgaagctg

SEQ ID NO: 48244 - DNA, 35 bp, Artificial Sequence
  Synthetic oligonucleotide
tcatcgtgagggagctcgcgtttgccatctgtaat

SEQ ID NO: 48245 - DNA, 35 bp, Artificial Sequence
  Synthetic oligonucleotide
cacgcaatacagcggatcctgctacctctgctgat

SEQ ID NO: 48246 - DNA, 35 bp, Artificial Sequence
  Synthetic oligonucleotide
gtacgacctgctcgccattgcctgggatatcctat

SEQ ID NO: 48247 - DNA, 35 bp, Artificial Sequence
  Synthetic oligonucleotide
tgacgaccctcgtttaatggtgattctcttatgct

SEQ ID NO: 48248 - DNA, 35 bp, Artificial Sequence
  Synthetic oligonucleotide
agcgattaacgctaccctttctctgtacgccatct

SEQ ID NO: 48249 - DNA, 35 bp, Artificial Sequence
  Synthetic oligonucleotide
tatactctgtcccgttgctaactcgtgcctcatct

SEQ ID NO: 48250 - DNA, 35 bp, Artificial Sequence
  Synthetic oligonucleotide
gaccgagtaggtctgtctggcaacatatttgctct

SEQ ID NO: 48251 - DNA, 35 bp, Artificial Sequence
  Synthetic oligonucleotide
aggacagtccattgcgtaccgtcgtcttcacttct

SEQ ID NO: 48252 - DNA, 35 bp, Artificial Sequence
  Synthetic oligonucleotide
tgtgtgcccctttgtccggtttctttgctctaagt

SEQ ID NO: 48253 - DNA, 35 bp, Artificial Sequence
  Synthetic oligonucleotide
tggaccgttccacatccctgcgccaacccatacgt

SEQ ID NO: 48254 - DNA, 35 bp, Artificial Sequence
  Synthetic oligonucleotide
gtacacgcaggctcctgactggaacccccaacctt

SEQ ID NO: 48255 - DNA, 35 bp, Artificial Sequence
  Synthetic oligonucleotide
tgtgaacccgcattttacatcatagttgaccgctt

SEQ ID NO: 48256 - DNA, 35 bp, Artificial Sequence
  Synthetic oligonucleotide
gcggactacggcatcgacctgcctcacaacacttt

SEQ ID NO: 48257 - DNA, 35 bp, Artificial Sequence
  Synthetic oligonucleotide
acctgcagggccattacaaacttgtcaccttccaa

SEQ ID NO: 48258 - DNA, 36 bp, Artificial Sequence
  Synthetic oligonucleotide
tcgaacttaccactgtcctgctacactcctctagaa

SEQ ID NO: 48259 - DNA, 35 bp, Artificial Sequence
  Synthetic oligonucleotide
atgcctcactcctctgcaatgtgcaatccaacgaa

SEQ ID NO: 48260 - DNA, 36 bp, Artificial Sequence
  Synthetic oligonucleotide
tcgaccgtgctttcccgaacgaatatcccgcccgaa

SEQ ID NO: 48261 - DNA, 36 bp, Artificial Sequence
  Synthetic oligonucleotide
gtgcgacgcaacttacacagcaactcggactccgaa

SEQ ID NO: 48262 - DNA, 35 bp, Artificial Sequence
  Synthetic oligonucleotide
tacacgtcgaaatctactcgtattgcctgtcggaa

SEQ ID NO: 48263 - DNA, 36 bp, Artificial Sequence
  Synthetic oligonucleotide
gagtggcctcgggtaggagggtacgggaaaatcaca

SEQ ID NO: 48264 - DNA, 36 bp, Artificial Sequence
  Synthetic oligonucleotide
ccccgtcccagttcccgtatctcccagccctgtcca

SEQ ID NO: 48265 - DNA, 36 bp, Artificial Sequence
  Synthetic oligonucleotide
tgtacgtcgccggcaaggataaccgtcactcccgca

SEQ ID NO: 48266 - DNA, 36 bp, Artificial Sequence
  Synthetic oligonucleotide
tacccgttgctggtcggccagtactcgcctcactca

SEQ ID NO: 48267 - DNA, 37 bp, Artificial Sequence
  Synthetic oligonucleotide
atcatccgctacgacgcaccgccatgccgacttaaga

SEQ ID NO: 48268 - DNA, 36 bp, Artificial Sequence
  Synthetic oligonucleotide
gattgcaaggccgggtatggaatagggtaaggacga

SEQ ID NO: 48269 - DNA, 37 bp, Artificial Sequence
  Synthetic oligonucleotide
agatcacagaacgggcctaagggctgtggtggtacga

SEQ ID NO: 48270 - DNA, 37 bp, Artificial Sequence
  Synthetic oligonucleotide
atcgcgcgcgcacattttaaagctctacattccccga

SEQ ID NO: 48271 - DNA, 37 bp, Artificial Sequence
  Synthetic oligonucleotide
atccaccacctttcaaagttagacgcgttgttgccga

SEQ ID NO: 48272 - DNA, 37 bp, Artificial Sequence
  Synthetic oligonucleotide
agtcaacccaccttatacggtcctacacctggtccga

SEQ ID NO: 48273 - DNA, 37 bp, Artificial Sequence
  Synthetic oligonucleotide
gccgggctggatcagtgaggggtacgttacgggggga

SEQ ID NO: 48274 - DNA, 37 bp, Artificial Sequence
  Synthetic oligonucleotide
tctgtcgcttcccacatgtactatcgcactctatgga

SEQ ID NO: 48275 - DNA, 38 bp, Artificial Sequence
  Synthetic oligonucleotide
gcacaacgcacggtctacgtgtctcacctttagcatga

SEQ ID NO: 48276 - DNA, 37 bp, Artificial Sequence
  Synthetic oligonucleotide
accccgacacaaggcccacattcgatgccatgcatga

SEQ ID NO: 48277 - DNA, 38 bp, Artificial Sequence
  Synthetic oligonucleotide
gccgagcacggataaacttaggaagaggacacgtatga

SEQ ID NO: 48278 - DNA, 38 bp, Artificial Sequence
  Synthetic oligonucleotide
aacataagttgaggggttggagaggcctgggtgactga

SEQ ID NO: 48279 - DNA, 37 bp, Artificial Sequence
  Synthetic oligonucleotide
tcactgctcgaccgtccgcaacagcttctaaccctga

SEQ ID NO: 48280 - DNA, 38 bp, Artificial Sequence
  Synthetic oligonucleotide
tgagcgacaaggggaggaagaggtggattaaaacgtga

SEQ ID NO: 48281 - DNA, 38 bp, Artificial Sequence
  Synthetic oligonucleotide
agagacatgggaaagagaaggagggtaagagcaggtga

SEQ ID NO: 48282 - DNA, 38 bp, Artificial Sequence
  Synthetic oligonucleotide
ttggcccccggaattccctgccacactccttatggtga

SEQ ID NO: 48283 - DNA, 38 bp, Artificial Sequence
  Synthetic oligonucleotide
gcaatgtgatggggagtgaagaaggagggggtatgtga

SEQ ID NO: 48284 - DNA, 38 bp, Artificial Sequence
  Synthetic oligonucleotide
gttgcaaccacaatcccgggtcttgaaacacaacttga

SEQ ID NO: 48285 - DNA, 38 bp, Artificial Sequence
  Synthetic oligonucleotide
gtcccgcacccttgttgcgcgtaaggattacgccttga

SEQ ID NO: 48286 - DNA, 38 bp, Artificial Sequence
  Synthetic oligonucleotide
acccaccctccggcccacgttctctcacagccagttga

SEQ ID NO: 48287 - DNA, 37 bp, Artificial Sequence
  Synthetic oligonucleotide
tccgcagggccgccctggaatcgccggaacaatttga

SEQ ID NO: 48288 - DNA, 38 bp, Artificial Sequence
  Synthetic oligonucleotide
gaagagtgcccaatgtcgtgggggggaaagaactttga

SEQ ID NO: 48289 - DNA, 35 bp, Artificial Sequence
  Synthetic oligonucleotide
tagaccattcgaccaccgaactcgtgaccttggta

SEQ ID NO: 48290 - DNA, 35 bp, Artificial Sequence
  Synthetic oligonucleotide
actagcggtaacgcctcgattatcctgtccacaac

SEQ ID NO: 48291 - DNA, 35 bp, Artificial Sequence
  Synthetic oligonucleotide
acccacctctgacctgtttaattcttctgtctcac

SEQ ID NO: 48292 - DNA, 35 bp, Artificial Sequence
  Synthetic oligonucleotide
gatctgccccatatcaattacgacacaagtagtac

SEQ ID NO: 48293 - DNA, 35 bp, Artificial Sequence
  Synthetic oligonucleotide
gtgaccatccctccgtcaaatactcggagctttac

SEQ ID NO: 48294 - DNA, 35 bp, Artificial Sequence
  Synthetic oligonucleotide
ggaacgccccggctacgcattaccactatactccc

SEQ ID NO: 48295 - DNA, 35 bp, Artificial Sequence
  Synthetic oligonucleotide
tgtgttgccctccgcctcgtgtaagtggttccgcc

SEQ ID NO: 48296 - DNA, 35 bp, Artificial Sequence
  Synthetic oligonucleotide
tcactccgcattcctgctgtccgctatccacttcc

SEQ ID NO: 48297 - DNA, 35 bp, Artificial Sequence
  Synthetic oligonucleotide
gtggcggtgatactgcaattctgttagatctttcc

SEQ ID NO: 48298 - DNA, 35 bp, Artificial Sequence
  Synthetic oligonucleotide
gatgcgaatcgcctgcatatatatgttcaccacgc

SEQ ID NO: 48299 - DNA, 35 bp, Artificial Sequence
  Synthetic oligonucleotide
tccaacggccttagcacgcgtgactttcctgtcgc

SEQ ID NO: 48300 - DNA, 35 bp, Artificial Sequence
  Synthetic oligonucleotide
cactctcgtgggtatcactttgtaggttctcagtc

SEQ ID NO: 48301 - DNA, 35 bp, Artificial Sequence
  Synthetic oligonucleotide
gcccatctgggcatcccccccgcgcattaaatgtc

SEQ ID NO: 48302 - DNA, 35 bp, Artificial Sequence
  Synthetic oligonucleotide
atgagagggtggtgaggtgtagtcaggggagagcg

SEQ ID NO: 48303 - DNA, 35 bp, Artificial Sequence
  Synthetic oligonucleotide
gcggacattcaccggttagcaacaccactctcgcg

SEQ ID NO: 48304 - DNA, 35 bp, Artificial Sequence
  Synthetic oligonucleotide
tccgcgcagggttgtctggccactaaattgtccct

SEQ ID NO: 48305 - DNA, 35 bp, Artificial Sequence
  Synthetic oligonucleotide
atttacgaccacccgcacaccaataactacacgct

SEQ ID NO: 48306 - DNA, 35 bp, Artificial Sequence
  Synthetic oligonucleotide
accttggtccgagcactggacacctttaccgctct

SEQ ID NO: 48307 - DNA, 35 bp, Artificial Sequence
  Synthetic oligonucleotide
gtcacctgctgaactatgacaactcgtggatttct

SEQ ID NO: 48308 - DNA, 35 bp, Artificial Sequence
  Synthetic oligonucleotide
gtccgcacaagtgcgttggctctttacttttctgt

SEQ ID NO: 48309 - DNA, 32 bp, Artificial Sequence
  Synthetic oligonucleotide
tcctaccgcacaccccaactgcctatcgcatt

SEQ ID NO: 48310 - DNA, 35 bp, Artificial Sequence
  Synthetic oligonucleotide
tcatcgtcggaggagtgtcggctgtttttatcctt

SEQ ID NO: 48311 - DNA, 35 bp, Artificial Sequence
  Synthetic oligonucleotide
gttgtcacgcattcgcatcctgtttaatatttctt

SEQ ID NO: 48312 - DNA, 36 bp, Artificial Sequence
  Synthetic oligonucleotide
tatgacagctgcccccccctctagactcgcctcaaa

SEQ ID NO: 48313 - DNA, 35 bp, Artificial Sequence
  Synthetic oligonucleotide
aactgccactcccactatctcacagcaggtaccaa

SEQ ID NO: 48314 - DNA, 36 bp, Artificial Sequence
  Synthetic oligonucleotide
gtggaggtgggctggtgcgcacaaaggaggttcgaa

SEQ ID NO: 48315 - DNA, 37 bp, Artificial Sequence
  Synthetic oligonucleotide
gaggactgaaaggcagacgggaggatagggccgggaa

SEQ ID NO: 48316 - DNA, 35 bp, Artificial Sequence
  Synthetic oligonucleotide
gggagggataggggcgttgagcgggaacatcttaa

SEQ ID NO: 48317 - DNA, 35 bp, Artificial Sequence
  Synthetic oligonucleotide
tctaccctgccccaaggatgcgccctgtgcgcaca

SEQ ID NO: 48318 - DNA, 35 bp, Artificial Sequence
  Synthetic oligonucleotide
gcactagctacaccgacacctcacaaacctgcaca

SEQ ID NO: 48319 - DNA, 36 bp, Artificial Sequence
  Synthetic oligonucleotide
ctggcaccattgaccatagttttccgttgcattcca

SEQ ID NO: 48320 - DNA, 35 bp, Artificial Sequence
  Synthetic oligonucleotide
gattcaccataggcgagaacatgcctctttttcca

SEQ ID NO: 48321 - DNA, 35 bp, Artificial Sequence
  Synthetic oligonucleotide
gacccgcaccgttaaccgcattcgaccaattggca

SEQ ID NO: 48322 - DNA, 35 bp, Artificial Sequence
  Synthetic oligonucleotide
agcccctgacacaacaacgtttcacgtactgacga

SEQ ID NO: 48323 - DNA, 36 bp, Artificial Sequence
  Synthetic oligonucleotide
gtacgcagtgagcgcaagggggagagggggatagga

SEQ ID NO: 48324 - DNA, 37 bp, Artificial Sequence
  Synthetic oligonucleotide
ttaaacaccgggccacacacattaacgtccactagga

SEQ ID NO: 48325 - DNA, 37 bp, Artificial Sequence
  Synthetic oligonucleotide
ccatcggtcttctctcacccgaactcgcccttctgga

SEQ ID NO: 48326 - DNA, 36 bp, Artificial Sequence
  Synthetic oligonucleotide
gaatccaccctccttgagacacaactacgttctgga

SEQ ID NO: 48327 - DNA, 38 bp, Artificial Sequence
  Synthetic oligonucleotide
tactcgcctctgcaccctaccggcggtcattataatga

SEQ ID NO: 48328 - DNA, 38 bp, Artificial Sequence
  Synthetic oligonucleotide
aaccacccggtaacacgttatgaccaccattaccatga

SEQ ID NO: 48329 - DNA, 38 bp, Artificial Sequence
  Synthetic oligonucleotide
gcctgcataggttggaaagggctgggatggaaggatga

SEQ ID NO: 48330 - DNA, 38 bp, Artificial Sequence
  Synthetic oligonucleotide
gacagggcgagagagaaggtggggcagggttgctatga

SEQ ID NO: 48331 - DNA, 37 bp, Artificial Sequence
  Synthetic oligonucleotide
gatagataggagagggatacaggagacgcgtttatga

SEQ ID NO: 48332 - DNA, 38 bp, Artificial Sequence
  Synthetic oligonucleotide
gttagcccccgtgcccgttaaggctttgaaccacctga

SEQ ID NO: 48333 - DNA, 37 bp, Artificial Sequence
  Synthetic oligonucleotide
gatgggagggagtaagcgcgggtggcagagagagtga

SEQ ID NO: 48334 - DNA, 38 bp, Artificial Sequence
  Synthetic oligonucleotide
actcattccaccgtgctcgattcgtaacgtctccgtga

SEQ ID NO: 48335 - DNA, 38 bp, Artificial Sequence
  Synthetic oligonucleotide
gtcgagcatagaaagcttgcgatctaacacctccttga

SEQ ID NO: 48336 - DNA, 36 bp, Artificial Sequence
  Synthetic oligonucleotide
gtcccgacgtctgtcttccttcgggctttgattcta

SEQ ID NO: 48337 - DNA, 36 bp, Artificial Sequence
  Synthetic oligonucleotide
tgaccccccctgtattcggtagtgttgacgtcctta

SEQ ID NO: 48338 - DNA, 35 bp, Artificial Sequence
  Synthetic oligonucleotide
gcccccaggaaacggcctgtactttccgtgcaccc

SEQ ID NO: 48339 - DNA, 35 bp, Artificial Sequence
  Synthetic oligonucleotide
tcctaagcgttgtcccattctgtcatcctccggcc

SEQ ID NO: 48340 - DNA, 35 bp, Artificial Sequence
  Synthetic oligonucleotide
gcccgctatcactccgctccacgttgacgaattcc

SEQ ID NO: 48341 - DNA, 35 bp, Artificial Sequence
  Synthetic oligonucleotide
gtgccccatctggaagtgctaacggatcacctcgc

SEQ ID NO: 48342 - DNA, 35 bp, Artificial Sequence
  Synthetic oligonucleotide
aacattgtccaatgtttgccattcctcattacctc

SEQ ID NO: 48343 - DNA, 35 bp, Artificial Sequence
  Synthetic oligonucleotide
agcctatgcccggtctcgcgttggccctattaccg

SEQ ID NO: 48344 - DNA, 35 bp, Artificial Sequence
  Synthetic oligonucleotide
agtctgtccgcgcatcgttaccttctgcctatttg

SEQ ID NO: 48345 - DNA, 35 bp, Artificial Sequence
  Synthetic oligonucleotide
attgaacccagacgtgagtcctccctttcgatcat

SEQ ID NO: 48346 - DNA, 35 bp, Artificial Sequence
  Synthetic oligonucleotide
aacacatagccacctgctactcctaagaacgggat

SEQ ID NO: 48347 - DNA, 35 bp, Artificial Sequence
  Synthetic oligonucleotide
tccccgcctaaaccacaactgcctgtccgcgaact

SEQ ID NO: 48348 - DNA, 35 bp, Artificial Sequence
  Synthetic oligonucleotide
gcgatgcctaagctccaggaggtagctttctctct

SEQ ID NO: 48349 - DNA, 35 bp, Artificial Sequence
  Synthetic oligonucleotide
gcgccactctatactcccctccgcgacatggacgt

SEQ ID NO: 48350 - DNA, 35 bp, Artificial Sequence
  Synthetic oligonucleotide
acctccgcatatcagcgtattacttccactgttgt

SEQ ID NO: 48351 - DNA, 35 bp, Artificial Sequence
  Synthetic oligonucleotide
aatatcgcacgccctccagcatcgagtacgtcctt

SEQ ID NO: 48352 - DNA, 36 bp, Artificial Sequence
  Synthetic oligonucleotide
tcacaccccggcggtgcatacagtcttgctgccgtt

SEQ ID NO: 48353 - DNA, 35 bp, Artificial Sequence
  Synthetic oligonucleotide
tgttgtcctcaaggcgttgtttcgtttcccggttt

SEQ ID NO: 48354 - DNA, 36 bp, Artificial Sequence
  Synthetic oligonucleotide
gaaagagagggggggtagtcgtaagcccaggtgaaa

SEQ ID NO: 48355 - DNA, 36 bp, Artificial Sequence
  Synthetic oligonucleotide
gccgaaaaggaaagagcagagatggtcgggaggcaa

SEQ ID NO: 48356 - DNA, 36 bp, Artificial Sequence
  Synthetic oligonucleotide
gagatgcctacacgcccggatcgggatccgccctaa

SEQ ID NO: 48357 - DNA, 35 bp, Artificial Sequence
  Synthetic oligonucleotide
ggtggggtggtggttgttggtgcgtgatgaacaca

SEQ ID NO: 48358 - DNA, 36 bp, Artificial Sequence
  Synthetic oligonucleotide
aactcgccattcccttgtcacgtgtgaatcttcaca

SEQ ID NO: 48359 - DNA, 35 bp, Artificial Sequence
  Synthetic oligonucleotide
tacgttatcacgtgcagccgacgcacttcttgcca

SEQ ID NO: 48360 - DNA, 35 bp, Artificial Sequence
  Synthetic oligonucleotide
ttgtgtagcaacgccagcccgagccatccttgtca

SEQ ID NO: 48361 - DNA, 36 bp, Artificial Sequence
  Synthetic oligonucleotide
ggacaaggggtagccgagtggtggggggcctaacga

SEQ ID NO: 48362 - DNA, 37 bp, Artificial Sequence
  Synthetic oligonucleotide
attcgcgcactggtgcgaaaacgtgctgaccctacga

SEQ ID NO: 48363 - DNA, 35 bp, Artificial Sequence
  Synthetic oligonucleotide
actggcccgacacatccatagtattaccgccccga

SEQ ID NO: 48364 - DNA, 37 bp, Artificial Sequence
  Synthetic oligonucleotide
atccatccgcactgcacttatagtcatgtatccccga

SEQ ID NO: 48365 - DNA, 37 bp, Artificial Sequence
  Synthetic oligonucleotide
agggccaccttcgggctcgggccatccttctcttcga

SEQ ID NO: 48366 - DNA, 37 bp, Artificial Sequence
  Synthetic oligonucleotide
attacatcctcactcttcatcgcaccatccggaagga

SEQ ID NO: 48367 - DNA, 37 bp, Artificial Sequence
  Synthetic oligonucleotide
gtgggggaggtggttgtaatgaacctagaggggagga

SEQ ID NO: 48368 - DNA, 37 bp, Artificial Sequence
  Synthetic oligonucleotide
gaacagcactaggactcggagtaggggagggtgcgga

SEQ ID NO: 48369 - DNA, 37 bp, Artificial Sequence
  Synthetic oligonucleotide
agcacccggtcacttcgtgtgccccaacctcctcgga

SEQ ID NO: 48370 - DNA, 37 bp, Artificial Sequence
  Synthetic oligonucleotide
gagtggtgtaggtacgggaatgcgcgagctgatggga

SEQ ID NO: 48371 - DNA, 37 bp, Artificial Sequence
  Synthetic oligonucleotide
ggatggaaggaaggggttgaagccgcagggattggga

SEQ ID NO: 48372 - DNA, 38 bp, Artificial Sequence
  Synthetic oligonucleotide
gatacgcgggggggagaacaactgggatctgggtctga

SEQ ID NO: 48373 - DNA, 38 bp, Artificial Sequence
  Synthetic oligonucleotide
agtcacatccggtccatttcgttcgtcaccaaaagtga

SEQ ID NO: 48374 - DNA, 37 bp, Artificial Sequence
  Synthetic oligonucleotide
aacccccgatcaccaatcccgaagcacgttcacgtga

SEQ ID NO: 48375 - DNA, 37 bp, Artificial Sequence
  Synthetic oligonucleotide
gtgagcgccgtatcgccgccattatttactaccgtga

SEQ ID NO: 48376 - DNA, 38 bp, Artificial Sequence
  Synthetic oligonucleotide
gtggtcgtaggggccggggtggagctagaagagggtga

SEQ ID NO: 48377 - DNA, 38 bp, Artificial Sequence
  Synthetic oligonucleotide
taccgagcggggtagtccagtagagaaggtatgtgtga

SEQ ID NO: 48378 - DNA, 38 bp, Artificial Sequence
  Synthetic oligonucleotide
gagcgagacagggggatgtcgggcaaaaaaggtgttga

SEQ ID NO: 48379 - DNA, 37 bp, Artificial Sequence
  Synthetic oligonucleotide
tcgtaccttccatgtgcctcggctttcttctctttga

SEQ ID NO: 48380 - DNA, 36 bp, Artificial Sequence
  Synthetic oligonucleotide
aatgccacgctcgatttgctcacgctgcgtactcta

SEQ ID NO: 48381 - DNA, 36 bp, Artificial Sequence
  Synthetic oligonucleotide
gatcaccacgccgagtcaattccggagtgcccttta

SEQ ID NO: 48382 - DNA, 36 bp, Artificial Sequence
  Synthetic oligonucleotide
acccaaggcccggaccacaactttaacgtacgttta

SEQ ID NO: 48383 - DNA, 35 bp, Artificial Sequence
  Synthetic oligonucleotide
taacgcgagcttagatccgtgctttcatccctgcc

SEQ ID NO: 48384 - DNA, 35 bp, Artificial Sequence
  Synthetic oligonucleotide
gcacgcctatattacccgccaggcagaccaaatcc

SEQ ID NO: 48385 - DNA, 35 bp, Artificial Sequence
  Synthetic oligonucleotide
acgtatacgccacggtactcgcatgctgccttcgc

SEQ ID NO: 48386 - DNA, 35 bp, Artificial Sequence
  Synthetic oligonucleotide
tgtctgcataagctcttgagccacctcgcccctgc

SEQ ID NO: 48387 - DNA, 35 bp, Artificial Sequence
  Synthetic oligonucleotide
ttcacacacgcacttacacaaggtacaaatttgag

SEQ ID NO: 48388 - DNA, 35 bp, Artificial Sequence
  Synthetic oligonucleotide
tgagctcacaacgcccatctctgcgagtatttacg

SEQ ID NO: 48389 - DNA, 35 bp, Artificial Sequence
  Synthetic oligonucleotide
tcgaggaggatcggaaaggagtaaagaataggtgg

SEQ ID NO: 48390 - DNA, 34 bp, Artificial Sequence
  Synthetic oligonucleotide
gacgcatccgtgtctcatttgtctttatcgtatg

SEQ ID NO: 48391 - DNA, 35 bp, Artificial Sequence
  Synthetic oligonucleotide
gtgtagtgccacatttattaattctgtctcacctg

SEQ ID NO: 48392 - DNA, 35 bp, Artificial Sequence
  Synthetic oligonucleotide
tgagtaggggagtgcggattgcaggtcgcctggtg

SEQ ID NO: 48393 - DNA, 35 bp, Artificial Sequence
  Synthetic oligonucleotide
ttgtgcacgcgtatgatctctgcttcatcaatttg

SEQ ID NO: 48394 - DNA, 35 bp, Artificial Sequence
  Synthetic oligonucleotide
acactctgacctcgcatccacaaatctgccgcgct

SEQ ID NO: 48395 - DNA, 35 bp, Artificial Sequence
  Synthetic oligonucleotide
gtcacgcagaacggcgccattgcaacattatccgt

SEQ ID NO: 48396 - DNA, 35 bp, Artificial Sequence
  Synthetic oligonucleotide
agcagagctcggcccggctattaacatgttcctgt

SEQ ID NO: 48397 - DNA, 35 bp, Artificial Sequence
  Synthetic oligonucleotide
tatcagatggtcccttgtccgtcctaagcactatt

SEQ ID NO: 48398 - DNA, 36 bp, Artificial Sequence
  Synthetic oligonucleotide
ggtgggacacgccacgtctcagactccctccttaaa

SEQ ID NO: 48399 - DNA, 36 bp, Artificial Sequence
  Synthetic oligonucleotide
gtcacgtgccataacggcgaataaagcccgaaccaa

SEQ ID NO: 48400 - DNA, 36 bp, Artificial Sequence
  Synthetic oligonucleotide
tcgagcgaattgctgccaaatagtctttcctcccaa

SEQ ID NO: 48401 - DNA, 35 bp, Artificial Sequence
  Synthetic oligonucleotide
ttcgaaccatcacaggtccaatctttccgtcgcaa

SEQ ID NO: 48402 - DNA, 36 bp, Artificial Sequence
  Synthetic oligonucleotide
ggtacaaacaccgctgcgatacgcacaaacgcccca

SEQ ID NO: 48403 - DNA, 36 bp, Artificial Sequence
  Synthetic oligonucleotide
tcgtatctacctcagccgtccaacagaattgcccca

SEQ ID NO: 48404 - DNA, 35 bp, Artificial Sequence
  Synthetic oligonucleotide
tatgattgacccatgcctatccgacttcactgcca

SEQ ID NO: 48405 - DNA, 36 bp, Artificial Sequence
  Synthetic oligonucleotide
taccgtggcccatcacgttttatcaatcacacatca

SEQ ID NO: 48406 - DNA, 36 bp, Artificial Sequence
  Synthetic oligonucleotide
ttgtgaactccgccatgaatgaacgacgcggtttca

SEQ ID NO: 48407 - DNA, 36 bp, Artificial Sequence
  Synthetic oligonucleotide
gccaactacaccacatcctctacagctctcctaaga

SEQ ID NO: 48408 - DNA, 36 bp, Artificial Sequence
  Synthetic oligonucleotide
atcgttcctccgcccccgccctggcacagccccaga

SEQ ID NO: 48409 - DNA, 37 bp, Artificial Sequence
  Synthetic oligonucleotide
atcgatacgcccaccatggcatactataatctttaga

SEQ ID NO: 48410 - DNA, 37 bp, Artificial Sequence
  Synthetic oligonucleotide
aactgaaccacccacgccatagtgtgctaaagcacga

SEQ ID NO: 48411 - DNA, 37 bp, Artificial Sequence
  Synthetic oligonucleotide
tagcgccgcaataggtcaaacacactcaaatcaccga

SEQ ID NO: 48412 - DNA, 37 bp, Artificial Sequence
  Synthetic oligonucleotide
accgtctaaaccccgccccacatgctgttgacccgga

SEQ ID NO: 48413 - DNA, 37 bp, Artificial Sequence
  Synthetic oligonucleotide
gattcgggggggaagtggaatggaacctatgtgcgga

SEQ ID NO: 48414 - DNA, 37 bp, Artificial Sequence
  Synthetic oligonucleotide
agcacgctttgccacatacatcctgttccgtagggga

SEQ ID NO: 48415 - DNA, 36 bp, Artificial Sequence
  Synthetic oligonucleotide
attgcctgcacgcaattatcccacccaactcgtgga

SEQ ID NO: 48416 - DNA, 36 bp, Artificial Sequence
  Synthetic oligonucleotide
gccacagtcattttccctcgtgcgccgtccctatga

SEQ ID NO: 48417 - DNA, 36 bp, Artificial Sequence
  Synthetic oligonucleotide
tccagcctttctatgtatactgcccaactccactga

SEQ ID NO: 48418 - DNA, 38 bp, Artificial Sequence
  Synthetic oligonucleotide
ttgcgaacgaaggacggacgtggtgagggtacggctga

SEQ ID NO: 48419 - DNA, 37 bp, Artificial Sequence
  Synthetic oligonucleotide
tcacagaaggccgagatggttgggttgatggggctga

SEQ ID NO: 48420 - DNA, 38 bp, Artificial Sequence
  Synthetic oligonucleotide
gaaacgcgggtgtggggtgcaagggttgagcgttctga

SEQ ID NO: 48421 - DNA, 38 bp, Artificial Sequence
  Synthetic oligonucleotide
tcaacctgcgatcagttccttgccaatttttgacgtga

SEQ ID NO: 48422 - DNA, 38 bp, Artificial Sequence
  Synthetic oligonucleotide
atggcccacgcctttacgcctctactctcggtccgtga

SEQ ID NO: 48423 - DNA, 37 bp, Artificial Sequence
  Synthetic oligonucleotide
aattgaatgcccgatctgccccggcgcacgcccttga

SEQ ID NO: 48424 - DNA, 37 bp, Artificial Sequence
  Synthetic oligonucleotide
atccgacacacttgtcgaccacatttgacccatttga

SEQ ID NO: 48425 - DNA, 36 bp, Artificial Sequence
  Synthetic oligonucleotide
tgtcatccgcaatcgttttccacgccgcaatcaata

SEQ ID NO: 48426 - DNA, 35 bp, Artificial Sequence
  Synthetic oligonucleotide
ttaccgctgggcccgtagttcttcctgtagcccta

SEQ ID NO: 48427 - DNA, 36 bp, Artificial Sequence
  Synthetic oligonucleotide
taccttccccacctcaccgcagctctagcgatccta

SEQ ID NO: 48428 - DNA, 37 bp, Artificial Sequence
  Synthetic oligonucleotide
atcgcaccgctagtgatccatgcatttccacactgta

SEQ ID NO: 48429 - DNA, 36 bp, Artificial Sequence
  Synthetic oligonucleotide
gcactcgttgcccctcttaggaacgttctctttgta

SEQ ID NO: 48430 - DNA, 36 bp, Artificial Sequence
  Synthetic oligonucleotide
gtatcaccgccgtttctaccctggttctccggatta

SEQ ID NO: 48431 - DNA, 36 bp, Artificial Sequence
  Synthetic oligonucleotide
tcaacagcccacgccctgaattgacttccttgctta

SEQ ID NO: 48432 - DNA, 35 bp, Artificial Sequence
  Synthetic oligonucleotide
tcgacctatcgctatcacggaatggcctcttctac

SEQ ID NO: 48433 - DNA, 35 bp, Artificial Sequence
  Synthetic oligonucleotide
gctctcatccagatgtgatctctgtcgtgccgtcc

SEQ ID NO: 48434 - DNA, 35 bp, Artificial Sequence
  Synthetic oligonucleotide
tatgacgatcagccggggcgtcccatcctcattcc

SEQ ID NO: 48435 - DNA, 35 bp, Artificial Sequence
  Synthetic oligonucleotide
atgagggtagcaacaggctagactccattaccatc

SEQ ID NO: 48436 - DNA, 35 bp, Artificial Sequence
  Synthetic oligonucleotide
gtggagggcaaggaaggtccaaggtgttgctgatc

SEQ ID NO: 48437 - DNA, 35 bp, Artificial Sequence
  Synthetic oligonucleotide
accgagctatcactgccgaaccgccttgaaatttc

SEQ ID NO: 48438 - DNA, 35 bp, Artificial Sequence
  Synthetic oligonucleotide
gaaacgtactgtccacgttgagacaaggagggacg

SEQ ID NO: 48439 - DNA, 35 bp, Artificial Sequence
  Synthetic oligonucleotide
gagatgccggccgttgctttacttatgatcctacg

SEQ ID NO: 48440 - DNA, 35 bp, Artificial Sequence
  Synthetic oligonucleotide
gggtcacggaaaatctgcggatcgggggaggttgg

SEQ ID NO: 48441 - DNA, 35 bp, Artificial Sequence
  Synthetic oligonucleotide
gacccgccgtatcattccattgtgcccaactcgat

SEQ ID NO: 48442 - DNA, 35 bp, Artificial Sequence
  Synthetic oligonucleotide
acctgccgggggtacgagcagaacaaacggagggt

SEQ ID NO: 48443 - DNA, 35 bp, Artificial Sequence
  Synthetic oligonucleotide
gaccaacttacatcgagtgtgatctgcctaaaatt

SEQ ID NO: 48444 - DNA, 35 bp, Artificial Sequence
  Synthetic oligonucleotide
accccgactgcccatcaaccgttcgactcgaactt

SEQ ID NO: 48445 - DNA, 36 bp, Artificial Sequence
  Synthetic oligonucleotide
tccgcacgagagagagctattgggcggtcgggagaa

SEQ ID NO: 48446 - DNA, 36 bp, Artificial Sequence
  Synthetic oligonucleotide
gatggaagaactggagagagggaagatagggcttaa

SEQ ID NO: 48447 - DNA, 36 bp, Artificial Sequence
  Synthetic oligonucleotide
gagacgccgtcgtcgaatccgattgtctcccccaca

SEQ ID NO: 48448 - DNA, 36 bp, Artificial Sequence
  Synthetic oligonucleotide
tcacaactctagagttagccaatgcttccctgcaca

SEQ ID NO: 48449 - DNA, 36 bp, Artificial Sequence
  Synthetic oligonucleotide
tccgatcgcatcatagttctcggtccccactagaca

SEQ ID NO: 48450 - DNA, 36 bp, Artificial Sequence
  Synthetic oligonucleotide
tcattcccgcctcgtgcaaaccaacagctatcgaca

SEQ ID NO: 48451 - DNA, 36 bp, Artificial Sequence
  Synthetic oligonucleotide
gctggaccggttgaactgataacgtctttcgctaca

SEQ ID NO: 48452 - DNA, 37 bp, Artificial Sequence
  Synthetic oligonucleotide
taacgcaccaggagtcatagaggggttgcggtagaga

SEQ ID NO: 48453 - DNA, 36 bp, Artificial Sequence
  Synthetic oligonucleotide
gatcacatcctcgtctgcccctgcctaactttacga

SEQ ID NO: 48454 - DNA, 37 bp, Artificial Sequence
  Synthetic oligonucleotide
gcgggccacacatctccctcagtaccagacgagccga

SEQ ID NO: 48455 - DNA, 37 bp, Artificial Sequence
  Synthetic oligonucleotide
tccatttaccccatgtgtcaccggcctccctaatcga

SEQ ID NO: 48456 - DNA, 36 bp, Artificial Sequence
  Synthetic oligonucleotide
caaccctcgccgttgttgggataaactcctcatcga

SEQ ID NO: 48457 - DNA, 37 bp, Artificial Sequence
  Synthetic oligonucleotide
taggagtgggatggagtggctgaatgagcagatggga

SEQ ID NO: 48458 - DNA, 38 bp, Artificial Sequence
  Synthetic oligonucleotide
aacgccctccctcagtttttttactccatggtcgctga

SEQ ID NO: 48459 - DNA, 37 bp, Artificial Sequence
  Synthetic oligonucleotide
tacacgcaaaaagtagcagaaaagtggaatagggtga

SEQ ID NO: 48460 - DNA, 38 bp, Artificial Sequence
  Synthetic oligonucleotide
tgtagcacggaatggcatatccctcactctgaccttga

SEQ ID NO: 48461 - DNA, 35 bp, Artificial Sequence
  Synthetic oligonucleotide
gtccatcatctggtgattcctaatccgtaggccta

SEQ ID NO: 48462 - DNA, 35 bp, Artificial Sequence
  Synthetic oligonucleotide
attcgccccttccgaaagcgcacgcctatccgcta

SEQ ID NO: 48463 - DNA, 35 bp, Artificial Sequence
  Synthetic oligonucleotide
acctcgatgccttcacatctccgcgaacgctggta

SEQ ID NO: 48464 - DNA, 36 bp, Artificial Sequence
  Synthetic oligonucleotide
tcaaccccgccctaccttaacatgatcgctgtggta

SEQ ID NO: 48465 - DNA, 35 bp, Artificial Sequence
  Synthetic oligonucleotide
tctccccgccccataccgaataactacacttatta

SEQ ID NO: 48466 - DNA, 36 bp, Artificial Sequence
  Synthetic oligonucleotide
gtcccatcggtgtgacgcggactgcaccattcgtta

SEQ ID NO: 48467 - DNA, 35 bp, Artificial Sequence
  Synthetic oligonucleotide
gcacgtttagctggcatagcaatccctctaccgac

SEQ ID NO: 48468 - DNA, 34 bp, Artificial Sequence
  Synthetic oligonucleotide
agccgggaaacactccacctacatgctgccaccc

SEQ ID NO: 48469 - DNA, 35 bp, Artificial Sequence
  Synthetic oligonucleotide
gttgcgctgtatccttcctccctaaggccgcaccc

SEQ ID NO: 48470 - DNA, 35 bp, Artificial Sequence
  Synthetic oligonucleotide
aatggacgattccatcctgaatgcccctctggtcc

SEQ ID NO: 48471 - DNA, 35 bp, Artificial Sequence
  Synthetic oligonucleotide
tgggggggcggctcctgcatcaacatacctgtctc

SEQ ID NO: 48472 - DNA, 35 bp, Artificial Sequence
  Synthetic oligonucleotide
tcttcgcattcctctcgctatgtccgggtttcacg

SEQ ID NO: 48473 - DNA, 35 bp, Artificial Sequence
  Synthetic oligonucleotide
gcatctgccactaactggtctggcctaaaaaaccg

SEQ ID NO: 48474 - DNA, 35 bp, Artificial Sequence
  Synthetic oligonucleotide
gtcgcaactaccccgccgcccttggccacagtgcg

SEQ ID NO: 48475 - DNA, 35 bp, Artificial Sequence
  Synthetic oligonucleotide
aatgcatcatcccaaaacgtcctcgtgctgttagg

SEQ ID NO: 48476 - DNA, 34 bp, Artificial Sequence
  Synthetic oligonucleotide
ttatgcaggagggggggggtagtccgaaatgatg

SEQ ID NO: 48477 - DNA, 35 bp, Artificial Sequence
  Synthetic oligonucleotide
tgacacgttcgagttccgtccttattggctctact

SEQ ID NO: 48478 - DNA, 35 bp, Artificial Sequence
  Synthetic oligonucleotide
ggaatccccttcccggtctagcctctcatttccct

SEQ ID NO: 48479 - DNA, 35 bp, Artificial Sequence
  Synthetic oligonucleotide
ccacgccacccacctagagcaccaccggtcgtgct

SEQ ID NO: 48480 - DNA, 35 bp, Artificial Sequence
  Synthetic oligonucleotide
acctgactcacatggcgaataccgcaccaccgagt

SEQ ID NO: 48481 - DNA, 35 bp, Artificial Sequence
  Synthetic oligonucleotide
gtcgaaaggcgacatgtcttcagacccacctcatt

SEQ ID NO: 48482 - DNA, 36 bp, Artificial Sequence
  Synthetic oligonucleotide
agtacatacgggcgctggcatccggaacttctcaaa

SEQ ID NO: 48483 - DNA, 36 bp, Artificial Sequence
  Synthetic oligonucleotide
gatcgaactgcgcctggtcctccgccgtgtacacaa

SEQ ID NO: 48484 - DNA, 36 bp, Artificial Sequence
  Synthetic oligonucleotide
gaccgcgtgacagtgagaacgggaagggggtgctaa

SEQ ID NO: 48485 - DNA, 36 bp, Artificial Sequence
  Synthetic oligonucleotide
tccgaggcgaacgtacatgagctcgaacctgcaaca

SEQ ID NO: 48486 - DNA, 36 bp, Artificial Sequence
  Synthetic oligonucleotide
gacacctccattaaggccccgcgagcactaactaca

SEQ ID NO: 48487 - DNA, 36 bp, Artificial Sequence
  Synthetic oligonucleotide
tagaccgctctcgttttctcgggccctagtactaca

SEQ ID NO: 48488 - DNA, 36 bp, Artificial Sequence
  Synthetic oligonucleotide
tttgaccaaggccagtgcaccaccttctggccccca

SEQ ID NO: 48489 - DNA, 36 bp, Artificial Sequence
  Synthetic oligonucleotide
acccatcgtggcccacgatcgccctgaactatgcca

SEQ ID NO: 48490 - DNA, 35 bp, Artificial Sequence
  Synthetic oligonucleotide
ttggaccccctgataggctccttgcgcaatacgca

SEQ ID NO: 48491 - DNA, 36 bp, Artificial Sequence
  Synthetic oligonucleotide
tcttgtaccatcaccccgtattgtgtatgtgtatca

SEQ ID NO: 48492 - DNA, 36 bp, Artificial Sequence
  Synthetic oligonucleotide
ttcagaccggtcaatttcacaactgctcctttgtca

SEQ ID NO: 48493 - DNA, 37 bp, Artificial Sequence
  Synthetic oligonucleotide
gagaggggacgatggggggcgacgaccgaggtgcaga

SEQ ID NO: 48494 - DNA, 37 bp, Artificial Sequence
  Synthetic oligonucleotide
atggccggtgggatggaaaggtggcgctaaagtcaga

SEQ ID NO: 48495 - DNA, 37 bp, Artificial Sequence
  Synthetic oligonucleotide
taccccgaaaacaggtattaatgcctgccccttacga

SEQ ID NO: 48496 - DNA, 37 bp, Artificial Sequence
  Synthetic oligonucleotide
actcaaccccctccacgcagacaagcctcagcaccga

SEQ ID NO: 48497 - DNA, 37 bp, Artificial Sequence
  Synthetic oligonucleotide
gtaggtggagcagtagaggatgacgtagtgtaggcga

SEQ ID NO: 48498 - DNA, 37 bp, Artificial Sequence
  Synthetic oligonucleotide
tagtgagggtggaggtcaggtcgtgaggcaacgtcga

SEQ ID NO: 48499 - DNA, 37 bp, Artificial Sequence
  Synthetic oligonucleotide
atgaggggcaacaagtggggtcaacaattgggtggga

SEQ ID NO: 48500 - DNA, 37 bp, Artificial Sequence
  Synthetic oligonucleotide
aagggggacagtagctgacgggtgaggattggtggga

SEQ ID NO: 48501 - DNA, 37 bp, Artificial Sequence
  Synthetic oligonucleotide
agacgggggaaagcaagagcagaaggtggggactgga

SEQ ID NO: 48502 - DNA, 37 bp, Artificial Sequence
  Synthetic oligonucleotide
tctaggacggtggtgagaatcaaggtggaggcgtgga

SEQ ID NO: 48503 - DNA, 36 bp, Artificial Sequence
  Synthetic oligonucleotide
atttgcccgctcgtttacgcctcaatccctgcatga

SEQ ID NO: 48504 - DNA, 38 bp, Artificial Sequence
  Synthetic oligonucleotide
gaaacggcacgaaaatgtgggttgctggggggggatga

SEQ ID NO: 48505 - DNA, 37 bp, Artificial Sequence
  Synthetic oligonucleotide
ttggatcgcaggttagtcctagctcctcatcacctga

SEQ ID NO: 48506 - DNA, 38 bp, Artificial Sequence
  Synthetic oligonucleotide
aagccccacctgaggcaaacccacgtacatccagctga

SEQ ID NO: 48507 - DNA, 38 bp, Artificial Sequence
  Synthetic oligonucleotide
gcatccagcctgcgtattacgccttttcatccggctga

SEQ ID NO: 48508 - DNA, 38 bp, Artificial Sequence
  Synthetic oligonucleotide
gccatgactcccgattttgctctagtaccgccatgtga

SEQ ID NO: 48509 - DNA, 38 bp, Artificial Sequence
  Synthetic oligonucleotide
acgagcggggcgggcgggtgcgggttaaaggcaattga

SEQ ID NO: 48510 - DNA, 38 bp, Artificial Sequence
  Synthetic oligonucleotide
atcccctcgacacacagactaacgcttccgcgtattga

SEQ ID NO: 48511 - DNA, 38 bp, Artificial Sequence
  Synthetic oligonucleotide
ttcccacaagcaccccaccgcccccggccttacgttga

SEQ ID NO: 48512 - DNA, 38 bp, Artificial Sequence
  Synthetic oligonucleotide
atctgcggccgcattatcgggatccactgcttctttga

SEQ ID NO: 48513 - DNA, 35 bp, Artificial Sequence
  Synthetic oligonucleotide
gcaccgactgccagccccacctcactttttcaata

SEQ ID NO: 48514 - DNA, 36 bp, Artificial Sequence
  Synthetic oligonucleotide
gtgtcacgatgttactttctgcaccactacctacta

SEQ ID NO: 48515 - DNA, 36 bp, Artificial Sequence
  Synthetic oligonucleotide
aatgcgaaggacggggtggggcttattgtgcgtcta

SEQ ID NO: 48516 - DNA, 36 bp, Artificial Sequence
  Synthetic oligonucleotide
gcacctacagacctggttctccgccggttacttcta

SEQ ID NO: 48517 - DNA, 35 bp, Artificial Sequence
  Synthetic oligonucleotide
gattcccaccactgcatatatgggggtttacctta

SEQ ID NO: 48518 - DNA, 36 bp, Artificial Sequence
  Synthetic oligonucleotide
tccgaatgtccactatctgtctttaaccctgcctta

SEQ ID NO: 48519 - DNA, 36 bp, Artificial Sequence
  Synthetic oligonucleotide
atcgatgcgcagcatacttcatactgaacgacttta

SEQ ID NO: 48520 - DNA, 35 bp, Artificial Sequence
  Synthetic oligonucleotide
gtacatccggtgcctagttgtcctgtgccttatac

SEQ ID NO: 48521 - DNA, 35 bp, Artificial Sequence
  Synthetic oligonucleotide
ttataatgaccggacgcactcgtatccgccctacc

SEQ ID NO: 48522 - DNA, 35 bp, Artificial Sequence
  Synthetic oligonucleotide
gtaacacccgcatgtagggtaattctattacgccc

SEQ ID NO: 48523 - DNA, 35 bp, Artificial Sequence
  Synthetic oligonucleotide
tacgaatcccagtcccctgggtaagactcctgccc

SEQ ID NO: 48524 - DNA, 35 bp, Artificial Sequence
  Synthetic oligonucleotide
tagcctccgcgatgcccgtgtgcgcaaactatccc

SEQ ID NO: 48525 - DNA, 35 bp, Artificial Sequence
  Synthetic oligonucleotide
ttgcccagtgttttcatattatcagtaccatctcc

SEQ ID NO: 48526 - DNA, 35 bp, Artificial Sequence
  Synthetic oligonucleotide
acatctgaggctactggtagtgcccctttttgtcc

SEQ ID NO: 48527 - DNA, 34 bp, Artificial Sequence
  Synthetic oligonucleotide
gcggacactgcctcttgtctcccatatccatagc

SEQ ID NO: 48528 - DNA, 36 bp, Artificial Sequence
  Synthetic oligonucleotide
tccatgttccttatttgcttttgaccgcttgtatgc

SEQ ID NO: 48529 - DNA, 35 bp, Artificial Sequence
  Synthetic oligonucleotide
gatttcgcctcactgagctgcccccacccctgtgc

SEQ ID NO: 48530 - DNA, 35 bp, Artificial Sequence
  Synthetic oligonucleotide
gatctacgccgacggccacaggtcatgttcccgtc

SEQ ID NO: 48531 - DNA, 35 bp, Artificial Sequence
  Synthetic oligonucleotide
ggaccaccttccactgtcttccatgctcgacattc

SEQ ID NO: 48532 - DNA, 34 bp, Artificial Sequence
  Synthetic oligonucleotide
atcgtgctcgtaagtgcgtcaccacctgttattc

SEQ ID NO: 48533 - DNA, 35 bp, Artificial Sequence
  Synthetic oligonucleotide
gatgtcgtctttcttcctatcctgcccggtgatcg

SEQ ID NO: 48534 - DNA, 36 bp, Artificial Sequence
  Synthetic oligonucleotide
accaagtgggtgggggggggaagggtagtagatagg

SEQ ID NO: 48535 - DNA, 35 bp, Artificial Sequence
  Synthetic oligonucleotide
gagatgggagtatgttgcgggagttacaggtcaat

SEQ ID NO: 48536 - DNA, 35 bp, Artificial Sequence
  Synthetic oligonucleotide
gacgcccacatcctgtgctcctctggtaggcttat

SEQ ID NO: 48537 - DNA, 35 bp, Artificial Sequence
  Synthetic oligonucleotide
tctacgctccgacaataccgggtcgtctactttat

SEQ ID NO: 48538 - DNA, 35 bp, Artificial Sequence
  Synthetic oligonucleotide
gtgcgcgcagacagccgcatcctctcgtaactact

SEQ ID NO: 48539 - DNA, 35 bp, Artificial Sequence
  Synthetic oligonucleotide
tcccacattgctatgtttagcgttccgcactgcct

SEQ ID NO: 48540 - DNA, 36 bp, Artificial Sequence
  Synthetic oligonucleotide
gggaaggggagggcggggtgcaaacgagggagttct

SEQ ID NO: 48541 - DNA, 35 bp, Artificial Sequence
  Synthetic oligonucleotide
ttagacccgggggagaacgcaggaggaggtgtggt

SEQ ID NO: 48542 - DNA, 35 bp, Artificial Sequence
  Synthetic oligonucleotide
tcacatgccccctagagccgagaaaaacgtgagtt

SEQ ID NO: 48543 - DNA, 35 bp, Artificial Sequence
  Synthetic oligonucleotide
gagaaggatgagcgcataatggcgcggaaagggtt

SEQ ID NO: 48544 - DNA, 35 bp, Artificial Sequence
  Synthetic oligonucleotide
aaccgccaatgcccatgccctccttaaggtccttt

SEQ ID NO: 48545 - DNA, 35 bp, Artificial Sequence
  Synthetic oligonucleotide
aaacacacctgccaacgaccccgaggaccagaaaa

SEQ ID NO: 48546 - DNA, 35 bp, Artificial Sequence
  Synthetic oligonucleotide
tatgtatagggcgaagggaagtgggtgggatgaaa

SEQ ID NO: 48547 - DNA, 36 bp, Artificial Sequence
  Synthetic oligonucleotide
gacacacagcagggggaagttacagattaggtgcaa

SEQ ID NO: 48548 - DNA, 36 bp, Artificial Sequence
  Synthetic oligonucleotide
tgcgtactgccagcacttctctgtccacctttttaa

SEQ ID NO: 48549 - DNA, 36 bp, Artificial Sequence
  Synthetic oligonucleotide
atccagacccagggcgcactttcatcaaccaggaca

SEQ ID NO: 48550 - DNA, 35 bp, Artificial Sequence
  Synthetic oligonucleotide
accactggtgcgggaggggcgggacattcggtaca

SEQ ID NO: 48551 - DNA, 35 bp, Artificial Sequence
  Synthetic oligonucleotide
gtcgtacgcccttcttactcgtcaagcttggacca

SEQ ID NO: 48552 - DNA, 36 bp, Artificial Sequence
  Synthetic oligonucleotide
agccatcgttcactggtccctccccgttggagccca

SEQ ID NO: 48553 - DNA, 36 bp, Artificial Sequence
  Synthetic oligonucleotide
gagccgttcgtcctctgtctccttgattatagccca

SEQ ID NO: 48554 - DNA, 36 bp, Artificial Sequence
  Synthetic oligonucleotide
gagacgagggcgaaaagcgagaaatgggttgggtca

SEQ ID NO: 48555 - DNA, 36 bp, Artificial Sequence
  Synthetic oligonucleotide
tcccgacggcacgttccacgtacaccttgttcttca

SEQ ID NO: 48556 - DNA, 33 bp, Artificial Sequence
  Synthetic oligonucleotide
acctttgcgcattcaactaaacgaccaccacga

SEQ ID NO: 48557 - DNA, 36 bp, Artificial Sequence
  Synthetic oligonucleotide
aacccattgtcctctatttggccactcgttgtacga

SEQ ID NO: 48558 - DNA, 37 bp, Artificial Sequence
  Synthetic oligonucleotide
gacgcgattagcaggaaaattggatctgggtgtagga

SEQ ID NO: 48559 - DNA, 36 bp, Artificial Sequence
  Synthetic oligonucleotide
agacaagtgcagaatccctccatcatgtttcccgga

SEQ ID NO: 48560 - DNA, 37 bp, Artificial Sequence
  Synthetic oligonucleotide
gacgatgctgtactctcttgtgaagctgaaacctgga

SEQ ID NO: 48561 - DNA, 38 bp, Artificial Sequence
  Synthetic oligonucleotide
gacacctcaaccacagctctgctacatgttccgcatga

SEQ ID NO: 48562 - DNA, 38 bp, Artificial Sequence
  Synthetic oligonucleotide
gaaccccccgacctcggtttgctcgtatcactgcatga

SEQ ID NO: 48563 - DNA, 38 bp, Artificial Sequence
  Synthetic oligonucleotide
tcagcaggcctccctccggctacgagccccccccgtga

SEQ ID NO: 48564 - DNA, 38 bp, Artificial Sequence
  Synthetic oligonucleotide
tgctgtgagcgtgctcattggtcctcgtgcttccttga

SEQ ID NO: 48565 - DNA, 36 bp, Artificial Sequence
  Synthetic oligonucleotide
atccgcagggacccatacctgagtgagtccatacta

SEQ ID NO: 48566 - DNA, 36 bp, Artificial Sequence
  Synthetic oligonucleotide
taacgcgggggaagggacttcaaggaaaattgggta

SEQ ID NO: 48567 - DNA, 36 bp, Artificial Sequence
  Synthetic oligonucleotide
tcgtagtgcacccgcactctctcgtttgcctgctta

SEQ ID NO: 48568 - DNA, 35 bp, Artificial Sequence
  Synthetic oligonucleotide
aacaccaaagaggcatcgttgtagtcaccgtaaac

SEQ ID NO: 48569 - DNA, 35 bp, Artificial Sequence
  Synthetic oligonucleotide
tacccccgcagccggcaacgaaccgcaacacttac

SEQ ID NO: 48570 - DNA, 35 bp, Artificial Sequence
  Synthetic oligonucleotide
tgccttggcccgactaggccttgttatcatcctcc

SEQ ID NO: 48571 - DNA, 35 bp, Artificial Sequence
  Synthetic oligonucleotide
gtacgtcccgctttgagctcgttgctcatttaatc

SEQ ID NO: 48572 - DNA, 35 bp, Artificial Sequence
  Synthetic oligonucleotide
gacccggtctacactaccgcctctttgggaaactc

SEQ ID NO: 48573 - DNA, 35 bp, Artificial Sequence
  Synthetic oligonucleotide
gttactggcatcatattgcgctatattccccactc

SEQ ID NO: 48574 - DNA, 35 bp, Artificial Sequence
  Synthetic oligonucleotide
aagacagcccccaaactccatgatcggttcacctc

SEQ ID NO: 48575 - DNA, 34 bp, Artificial Sequence
  Synthetic oligonucleotide
gaatcacccgtgctgaatccctccttgctctgtc

SEQ ID NO: 48576 - DNA, 35 bp, Artificial Sequence
  Synthetic oligonucleotide
acgcaccttgccccgtgtactcattacttaccgag

SEQ ID NO: 48577 - DNA, 35 bp, Artificial Sequence
  Synthetic oligonucleotide
taccgcagacaactaagggggtggtggggtgatag

SEQ ID NO: 48578 - DNA, 35 bp, Artificial Sequence
  Synthetic oligonucleotide
aactcgcggtccgttcttcaattccttttggctcg

SEQ ID NO: 48579 - DNA, 35 bp, Artificial Sequence
  Synthetic oligonucleotide
gacatggaggagaggcggtacttgcgggagttatg

SEQ ID NO: 48580 - DNA, 34 bp, Artificial Sequence
  Synthetic oligonucleotide
attgcgatctccgcgcaccggaaccacctttcat

SEQ ID NO: 48581 - DNA, 35 bp, Artificial Sequence
  Synthetic oligonucleotide
acagttcggctcaccaccagtccatgcctgcctat

SEQ ID NO: 48582 - DNA, 35 bp, Artificial Sequence
  Synthetic oligonucleotide
tgcctatgccgtgcattggtcttgtgacaccttat

SEQ ID NO: 48583 - DNA, 35 bp, Artificial Sequence
  Synthetic oligonucleotide
aacgcccgacccgaggaccctcttgattagcccgt

SEQ ID NO: 48584 - DNA, 35 bp, Artificial Sequence
  Synthetic oligonucleotide
gtgtcacctactggcccggcctcttggtccccgtt

SEQ ID NO: 48585 - DNA, 36 bp, Artificial Sequence
  Synthetic oligonucleotide
gtttgcctccatcgttttccgtttgaaaaatcaaca

SEQ ID NO: 48586 - DNA, 36 bp, Artificial Sequence
  Synthetic oligonucleotide
ggggggcaaggagggacggataaggagggcgatcca

SEQ ID NO: 48587 - DNA, 36 bp, Artificial Sequence
  Synthetic oligonucleotide
tccgcctgttccttcgtgcctcaggagccacccgca

SEQ ID NO: 48588 - DNA, 35 bp, Artificial Sequence
  Synthetic oligonucleotide
agaagccacacgagcacataggaaggaacacggca

SEQ ID NO: 48589 - DNA, 35 bp, Artificial Sequence
  Synthetic oligonucleotide
tactcagtacgtcgcccttccttgccacactttca

SEQ ID NO: 48590 - DNA, 37 bp, Artificial Sequence
  Synthetic oligonucleotide
gtgggcgcatttgcccattttcactgtcctaaggaga

SEQ ID NO: 48591 - DNA, 37 bp, Artificial Sequence
  Synthetic oligonucleotide
tgacacccctagccagcaaaaaccctcgacttcacga

SEQ ID NO: 48592 - DNA, 37 bp, Artificial Sequence
  Synthetic oligonucleotide
gaccccctccgccgagtactgccatccggtagtagga

SEQ ID NO: 48593 - DNA, 37 bp, Artificial Sequence
  Synthetic oligonucleotide
atgatcctccgactatcttgattccccttaccaggga

SEQ ID NO: 48594 - DNA, 35 bp, Artificial Sequence
  Synthetic oligonucleotide
gcggtgggggagaactgggaggcgtcgggtcggga

SEQ ID NO: 48595 - DNA, 38 bp, Artificial Sequence
  Synthetic oligonucleotide
gcaacgaaggggctatggggaggggtataacatgggga

SEQ ID NO: 48596 - DNA, 35 bp, Artificial Sequence
  Synthetic oligonucleotide
aacgaggggaaccggatgactagggagaacatgga

SEQ ID NO: 48597 - DNA, 37 bp, Artificial Sequence
  Synthetic oligonucleotide
aaccaccagtgaggaggggtgttacaaggggtgtgga

SEQ ID NO: 48598 - DNA, 37 bp, Artificial Sequence
  Synthetic oligonucleotide
gtcaccttgccttacgtgccgattacccactgtatga

SEQ ID NO: 48599 - DNA, 38 bp, Artificial Sequence
  Synthetic oligonucleotide
gaccccagctccagtgcacctgcccgatacttgactga

SEQ ID NO: 48600 - DNA, 38 bp, Artificial Sequence
  Synthetic oligonucleotide
tcaccgccctgaagcaaactgaccactggctgccctga

SEQ ID NO: 48601 - DNA, 38 bp, Artificial Sequence
  Synthetic oligonucleotide
gcccactcccgcccagagcccggcgttgacgggcctga

SEQ ID NO: 48602 - DNA, 38 bp, Artificial Sequence
  Synthetic oligonucleotide
tcacgctcagtgtcctactggatgcccctcaattctga

SEQ ID NO: 48603 - DNA, 38 bp, Artificial Sequence
  Synthetic oligonucleotide
gtccaactcgagcttcgatcgagacaagtctgccgtga

SEQ ID NO: 48604 - DNA, 38 bp, Artificial Sequence
  Synthetic oligonucleotide
aaacaacgacggggaaactcggtagaaaacgggggtga

SEQ ID NO: 48605 - DNA, 38 bp, Artificial Sequence
  Synthetic oligonucleotide
gtaatgggtgggaaatggggggcacgggcacagattga

SEQ ID NO: 48606 - DNA, 37 bp, Artificial Sequence
  Synthetic oligonucleotide
gcggacgtagtatattgcgctgcccccttgcccttga

SEQ ID NO: 48607 - DNA, 38 bp, Artificial Sequence
  Synthetic oligonucleotide
tgtactgcttacactgtggggaagggtggtggagttga

SEQ ID NO: 48608 - DNA, 37 bp, Artificial Sequence
  Synthetic oligonucleotide
agtgaccgtcacttatagccggccgccaccattttga

SEQ ID NO: 48609 - DNA, 35 bp, Artificial Sequence
  Synthetic oligonucleotide
tcctccggggtaacccttgtactctagcaacctta

SEQ ID NO: 48610 - DNA, 36 bp, Artificial Sequence
  Synthetic oligonucleotide
tccgaggggcaactctacatgacaccatctacctta

SEQ ID NO: 48611 - DNA, 36 bp, Artificial Sequence
  Synthetic oligonucleotide
ggagcccctcgattttcactagttgttccgtcgtta

SEQ ID NO: 48612 - DNA, 35 bp, Artificial Sequence
  Synthetic oligonucleotide
tcctatcgcctctacgcattctctgtccggaacac

SEQ ID NO: 48613 - DNA, 35 bp, Artificial Sequence
  Synthetic oligonucleotide
gcatccgtaagcttccatcctcccggtaacagcac

SEQ ID NO: 48614 - DNA, 35 bp, Artificial Sequence
  Synthetic oligonucleotide
gatgcgacactcccccgcatcatcgccatcttcac

SEQ ID NO: 48615 - DNA, 35 bp, Artificial Sequence
  Synthetic oligonucleotide
tcatccaggttaccctttgttatgcccgcctgtac

SEQ ID NO: 48616 - DNA, 35 bp, Artificial Sequence
  Synthetic oligonucleotide
acgtggaccgtacacccttcggctatactaacacc

SEQ ID NO: 48617 - DNA, 35 bp, Artificial Sequence
  Synthetic oligonucleotide
tcgaaacaggcgcccgttcgattaattcacccgcc

SEQ ID NO: 48618 - DNA, 35 bp, Artificial Sequence
  Synthetic oligonucleotide
cacggtccgagctacatcccgtacctacgtatcgc

SEQ ID NO: 48619 - DNA, 35 bp, Artificial Sequence
  Synthetic oligonucleotide
acccagggggtggtgcaaggatggggcgttctgag

SEQ ID NO: 48620 - DNA, 35 bp, Artificial Sequence
  Synthetic oligonucleotide
aacctcgccataatccagctccattcctcgtaccg

SEQ ID NO: 48621 - DNA, 35 bp, Artificial Sequence
  Synthetic oligonucleotide
tccccccactaacggaaatctgacacaggttcatg

SEQ ID NO: 48622 - DNA, 35 bp, Artificial Sequence
  Synthetic oligonucleotide
cacggaccaccccctcatgaccatatgttaggcat

SEQ ID NO: 48623 - DNA, 35 bp, Artificial Sequence
  Synthetic oligonucleotide
acgtcgacatgcccccctctgaggatcgaaccact

SEQ ID NO: 48624 - DNA, 35 bp, Artificial Sequence
  Synthetic oligonucleotide
gattcgcaatgctgccgcctagtgcactacccact

SEQ ID NO: 48625 - DNA, 35 bp, Artificial Sequence
  Synthetic oligonucleotide
tttcgcggatcgcttatcgtcctatctatcccact

SEQ ID NO: 48626 - DNA, 35 bp, Artificial Sequence
  Synthetic oligonucleotide
tatggcgcacgaccaccgtcctaaattgcgcgact

SEQ ID NO: 48627 - DNA, 35 bp, Artificial Sequence
  Synthetic oligonucleotide
tgagcgttatcgcggtctgacatacacctgcccct

SEQ ID NO: 48628 - DNA, 35 bp, Artificial Sequence
  Synthetic oligonucleotide
gataagcgctaacgttgccggctgaaatgctccct

SEQ ID NO: 48629 - DNA, 36 bp, Artificial Sequence
  Synthetic oligonucleotide
ggtcccccgcagaggatacactgctcatccataaaa

SEQ ID NO: 48630 - DNA, 36 bp, Artificial Sequence
  Synthetic oligonucleotide
ttccgctctacccccctgtccgttccccgcatggaa

SEQ ID NO: 48631 - DNA, 35 bp, Artificial Sequence
  Synthetic oligonucleotide
tctaacgagccacattttcgaacgcagactagaca

SEQ ID NO: 48632 - DNA, 36 bp, Artificial Sequence
  Synthetic oligonucleotide
acaatacccggttcaggccgctcgctcatcccacca

SEQ ID NO: 48633 - DNA, 34 bp, Artificial Sequence
  Synthetic oligonucleotide
gcccaccgcgaggtccgtcgctacacaccaatca

SEQ ID NO: 48634 - DNA, 36 bp, Artificial Sequence
  Synthetic oligonucleotide
tgtggtccggttctatcgccactcccccacgaatca

SEQ ID NO: 48635 - DNA, 36 bp, Artificial Sequence
  Synthetic oligonucleotide
gacccgtgatatccattgccatttagcctagtctca

SEQ ID NO: 48636 - DNA, 36 bp, Artificial Sequence
  Synthetic oligonucleotide
tacgcggcattaaagggggggtggtgagcgagtaga

SEQ ID NO: 48637 - DNA, 37 bp, Artificial Sequence
  Synthetic oligonucleotide
tcgtgggaaaggttcctggtgggagggggggcgagga

SEQ ID NO: 48638 - DNA, 37 bp, Artificial Sequence
  Synthetic oligonucleotide
gaatggcgcggggacaacgggttacgggcctggagga

SEQ ID NO: 48639 - DNA, 37 bp, Artificial Sequence
  Synthetic oligonucleotide
atgaggggcggagcaggaggggtggaataccagcgga

SEQ ID NO: 48640 - DNA, 37 bp, Artificial Sequence
  Synthetic oligonucleotide
aagctcaagagacggaggaggcgggaacaatcaggga

SEQ ID NO: 48641 - DNA, 37 bp, Artificial Sequence
  Synthetic oligonucleotide
gacggagtggtgacggggggtttacatgcaggatgga

SEQ ID NO: 48642 - DNA, 36 bp, Artificial Sequence
  Synthetic oligonucleotide
ggagggcataaaaggggcggtggtcgggtgagtgga

SEQ ID NO: 48643 - DNA, 37 bp, Artificial Sequence
  Synthetic oligonucleotide
taagccgtggcagtagggggactaaaatgccggtgga

SEQ ID NO: 48644 - DNA, 37 bp, Artificial Sequence
  Synthetic oligonucleotide
ttgcacgaggggaagatacggaggaaaaattagatga

SEQ ID NO: 48645 - DNA, 38 bp, Artificial Sequence
  Synthetic oligonucleotide
gttcgacaacaggtatacaggtgagggggtgtggatga

SEQ ID NO: 48646 - DNA, 38 bp, Artificial Sequence
  Synthetic oligonucleotide
tcatgcccacgaacgggcactttcaacatttttcctga

SEQ ID NO: 48647 - DNA, 38 bp, Artificial Sequence
  Synthetic oligonucleotide
tcctcagctgcagatcccattcctcgacttacggctga

SEQ ID NO: 48648 - DNA, 38 bp, Artificial Sequence
  Synthetic oligonucleotide
gtacagtcagccaccgacagcctttgcttctcctctga

SEQ ID NO: 48649 - DNA, 38 bp, Artificial Sequence
  Synthetic oligonucleotide
tgtcccccccttgttgtgatcctattcacggtcagtga

SEQ ID NO: 48650 - DNA, 38 bp, Artificial Sequence
  Synthetic oligonucleotide
tacgccacgaaacttaaatcaagccccgccacacgtga

SEQ ID NO: 48651 - DNA, 38 bp, Artificial Sequence
  Synthetic oligonucleotide
gcgcaagggcacggtggttccgggaggatatggggtga

SEQ ID NO: 48652 - DNA, 38 bp, Artificial Sequence
  Synthetic oligonucleotide
gtagtgccggccttgaatccaatgttagcctcctgtga

SEQ ID NO: 48653 - DNA, 38 bp, Artificial Sequence
  Synthetic oligonucleotide
acagcgcgattccacgcgtttgctcctctcatgcttga

SEQ ID NO: 48654 - DNA, 38 bp, Artificial Sequence
  Synthetic oligonucleotide
atggaggtgcaaggtggaagctggggggagttggttga

SEQ ID NO: 48655 - DNA, 37 bp, Artificial Sequence
  Synthetic oligonucleotide
gtctggacacaacacatccgcgaataggcccctttga

SEQ ID NO: 48656 - DNA, 36 bp, Artificial Sequence
  Synthetic oligonucleotide
taacgcgagggaggatctgtgggtaacggtttggta

SEQ ID NO: 48657 - DNA, 35 bp, Artificial Sequence
  Synthetic oligonucleotide
gacacccccaccaagaaagcgcggtcccgatccac

SEQ ID NO: 48658 - DNA, 35 bp, Artificial Sequence
  Synthetic oligonucleotide
atcccatccgcctcccgattgcgggacgcttgcac

SEQ ID NO: 48659 - DNA, 35 bp, Artificial Sequence
  Synthetic oligonucleotide
agttcactgcgagcttgtaatggccgctacctcac

SEQ ID NO: 48660 - DNA, 35 bp, Artificial Sequence
  Synthetic oligonucleotide
acctgtcaccatctcggtgaagtttacttgctcac

SEQ ID NO: 48661 - DNA, 35 bp, Artificial Sequence
  Synthetic oligonucleotide
accaccgatatctgcacgggacttgtcacttatac

SEQ ID NO: 48662 - DNA, 35 bp, Artificial Sequence
  Synthetic oligonucleotide
tagtcaccggaatcttttcaatgcagtttttgccc

SEQ ID NO: 48663 - DNA, 35 bp, Artificial Sequence
  Synthetic oligonucleotide
agcccagccaacccgtgctgttatttcaaccggcc

SEQ ID NO: 48664 - DNA, 35 bp, Artificial Sequence
  Synthetic oligonucleotide
gatggagggctcaatagtgtagggggggctgggcc

SEQ ID NO: 48665 - DNA, 35 bp, Artificial Sequence
  Synthetic oligonucleotide
gttccaaccacagttctcatttaacgcgtttgtcc

SEQ ID NO: 48666 - DNA, 35 bp, Artificial Sequence
  Synthetic oligonucleotide
tgtccttgcgctagctgttttttcctgctttggtc

SEQ ID NO: 48667 - DNA, 35 bp, Artificial Sequence
  Synthetic oligonucleotide
gagaggggccgggcgcattacggggtgggggcttc

SEQ ID NO: 48668 - DNA, 35 bp, Artificial Sequence
  Synthetic oligonucleotide
gactcgccacagatgctttcaatttgctgacgccg

SEQ ID NO: 48669 - DNA, 35 bp, Artificial Sequence
  Synthetic oligonucleotide
tccgggcgcgcaaactccggcacttcactcattcg

SEQ ID NO: 48670 - DNA, 35 bp, Artificial Sequence
  Synthetic oligonucleotide
gaagccggtccatcacgtcccctgcttttggaatg

SEQ ID NO: 48671 - DNA, 35 bp, Artificial Sequence
  Synthetic oligonucleotide
gttgtacccgcgaggtactccctctttacatcact

SEQ ID NO: 48672 - DNA, 35 bp, Artificial Sequence
  Synthetic oligonucleotide
ttcgcgccaccccctacggacgccattacgtccct

SEQ ID NO: 48673 - DNA, 35 bp, Artificial Sequence
  Synthetic oligonucleotide
cctcacctcctgtcacgttgtctcccgttaggcct

SEQ ID NO: 48674 - DNA, 35 bp, Artificial Sequence
  Synthetic oligonucleotide
gcaaccttaccctgtgcagggctctccccatgttt

SEQ ID NO: 48675 - DNA, 34 bp, Artificial Sequence
  Synthetic oligonucleotide
atccgccgtacttatcctgaccatcatgcaagaa

SEQ ID NO: 48676 - DNA, 35 bp, Artificial Sequence
  Synthetic oligonucleotide
atgccacccaggttagtctcagtaccgtacgtaca

SEQ ID NO: 48677 - DNA, 36 bp, Artificial Sequence
  Synthetic oligonucleotide
gctcaccaccgggtcctcgttaatatgttccatcca

SEQ ID NO: 48678 - DNA, 37 bp, Artificial Sequence
  Synthetic oligonucleotide
tatggacgtggaagggggttggcgggtggatagcaga

SEQ ID NO: 48679 - DNA, 37 bp, Artificial Sequence
  Synthetic oligonucleotide
accaccccaacctgccttgttcaaagtttcgtctaga

SEQ ID NO: 48680 - DNA, 37 bp, Artificial Sequence
  Synthetic oligonucleotide
actccactccccccgtctccgtctgccgggtgcacga

SEQ ID NO: 48681 - DNA, 37 bp, Artificial Sequence
  Synthetic oligonucleotide
taacagcctccccttaccagcggccctcgtcccccga

SEQ ID NO: 48682 - DNA, 37 bp, Artificial Sequence
  Synthetic oligonucleotide
ggattgtcagtagaacgaagggtgggtttcggaggga

SEQ ID NO: 48683 - DNA, 36 bp, Artificial Sequence
  Synthetic oligonucleotide
gccaggaacagcctacgaatcggaatggggagggga

SEQ ID NO: 48684 - DNA, 37 bp, Artificial Sequence
  Synthetic oligonucleotide
gaaagcaaggtggatatagggagggatgtggtgggga

SEQ ID NO: 48685 - DNA, 38 bp, Artificial Sequence
  Synthetic oligonucleotide
ttgtcccgcagtagagctgccaattcttaccgccctga

SEQ ID NO: 48686 - DNA, 38 bp, Artificial Sequence
  Synthetic oligonucleotide
gctagtcgtgggcgggagggtatagggatatgcgctga

SEQ ID NO: 48687 - DNA, 38 bp, Artificial Sequence
  Synthetic oligonucleotide
tagccccgcccataatcgttaaacatgtatctacgtga

SEQ ID NO: 48688 - DNA, 37 bp, Artificial Sequence
  Synthetic oligonucleotide
taatcccgccactctgcttcataaacgtacgccgtga

SEQ ID NO: 48689 - DNA, 37 bp, Artificial Sequence
  Synthetic oligonucleotide
tcactgcagaggacctgtgccggataggggggggtga

SEQ ID NO: 48690 - DNA, 37 bp, Artificial Sequence
  Synthetic oligonucleotide
tcctccgttcgacgaataacgttctctgttcacttga

SEQ ID NO: 48691 - DNA, 37 bp, Artificial Sequence
  Synthetic oligonucleotide
tcgccatggcgcacctctcgatacgttccttcgttga

SEQ ID NO: 48692 - DNA, 36 bp, Artificial Sequence
  Synthetic oligonucleotide
ggtgaggaggtagacgggggcgtgagagggcgagta

SEQ ID NO: 48693 - DNA, 35 bp, Artificial Sequence
  Synthetic oligonucleotide
tccgcccttcatagattcatccactccttcacgta

SEQ ID NO: 48694 - DNA, 36 bp, Artificial Sequence
  Synthetic oligonucleotide
acacacgctttcccggcgtggctgttccccacctta

SEQ ID NO: 48695 - DNA, 35 bp, Artificial Sequence
  Synthetic oligonucleotide
tgcccccaccttgtgtcttccacgcccagtccaac

SEQ ID NO: 48696 - DNA, 35 bp, Artificial Sequence
  Synthetic oligonucleotide
gcccattgcacctcagtgattcttacggttaacac

SEQ ID NO: 48697 - DNA, 35 bp, Artificial Sequence
  Synthetic oligonucleotide
aacgcacggggggttggcgtggttgattgcgttac

SEQ ID NO: 48698 - DNA, 35 bp, Artificial Sequence
  Synthetic oligonucleotide
gtgcctcttttcccatggtggctggatcttccccc

SEQ ID NO: 48699 - DNA, 35 bp, Artificial Sequence
  Synthetic oligonucleotide
gaacactggtgagtggcgtttttcttttcctgccc

SEQ ID NO: 48700 - DNA, 35 bp, Artificial Sequence
  Synthetic oligonucleotide
gttgtagtcgtgaactcccgtcgcacgtacctccc

SEQ ID NO: 48701 - DNA, 34 bp, Artificial Sequence
  Synthetic oligonucleotide
tccaaggttgcagccgtaaccatgaaatcctccc

SEQ ID NO: 48702 - DNA, 35 bp, Artificial Sequence
  Synthetic oligonucleotide
atggaccgcactatctgtcgctcatggtattccgc

SEQ ID NO: 48703 - DNA, 35 bp, Artificial Sequence
  Synthetic oligonucleotide
tccattgaagtctgtcctccgacgccggtcctctc

SEQ ID NO: 48704 - DNA, 35 bp, Artificial Sequence
  Synthetic oligonucleotide
atgcgcacatattgttttgtacattcattcttctc

SEQ ID NO: 48705 - DNA, 35 bp, Artificial Sequence
  Synthetic oligonucleotide
gtagacacccacatgagactctgtggtcatacttc

SEQ ID NO: 48706 - DNA, 35 bp, Artificial Sequence
  Synthetic oligonucleotide
tgccacaacgcagccccccccgaagtgttactttc

SEQ ID NO: 48707 - DNA, 35 bp, Artificial Sequence
  Synthetic oligonucleotide
tagcccctcaggtctgtctatttattatctcctag

SEQ ID NO: 48708 - DNA, 35 bp, Artificial Sequence
  Synthetic oligonucleotide
tctgccatccacctgtacctgagcctttcttagcg

SEQ ID NO: 48709 - DNA, 35 bp, Artificial Sequence
  Synthetic oligonucleotide
taaccggggcgttctctgagttctctatttatgcg

SEQ ID NO: 48710 - DNA, 35 bp, Artificial Sequence
  Synthetic oligonucleotide
ggtgaggggatgctgagaggggataatgaagctcg

SEQ ID NO: 48711 - DNA, 35 bp, Artificial Sequence
  Synthetic oligonucleotide
gttgggaaggttggggcagtagcacttatgatagg

SEQ ID NO: 48712 - DNA, 35 bp, Artificial Sequence
  Synthetic oligonucleotide
tgactgattagggtaggaaggggaagatatctcgg

SEQ ID NO: 48713 - DNA, 35 bp, Artificial Sequence
  Synthetic oligonucleotide
gatcgcggtccgtcctcctcaagcgcgtgttcctg

SEQ ID NO: 48714 - DNA, 35 bp, Artificial Sequence
  Synthetic oligonucleotide
gatgcgctttatctgccgtatgcacaaacctcgat

SEQ ID NO: 48715 - DNA, 35 bp, Artificial Sequence
  Synthetic oligonucleotide
ttgatctggcccgtgaggcacacactacctttact

SEQ ID NO: 48716 - DNA, 35 bp, Artificial Sequence
  Synthetic oligonucleotide
tcagaaccgcaacgataggcgccgctgtaccacct

SEQ ID NO: 48717 - DNA, 35 bp, Artificial Sequence
  Synthetic oligonucleotide
ttcgacccgttcgtaccaattatctatgttgacct

SEQ ID NO: 48718 - DNA, 35 bp, Artificial Sequence
  Synthetic oligonucleotide
agcccacgctgccctatggcttactacgagtgcct

SEQ ID NO: 48719 - DNA, 35 bp, Artificial Sequence
  Synthetic oligonucleotide
atactgcaacaggtccggtcctcccaagggtttgt

SEQ ID NO: 48720 - DNA, 36 bp, Artificial Sequence
  Synthetic oligonucleotide
agtgcggatcggaccacaagctggagggagggcaaa

SEQ ID NO: 48721 - DNA, 36 bp, Artificial Sequence
  Synthetic oligonucleotide
tagggtggtggagtaaagcgtggaaacgggtcgaca

SEQ ID NO: 48722 - DNA, 35 bp, Artificial Sequence
  Synthetic oligonucleotide
acgcccatttcgaccattgcgtcgccaccacgcca

SEQ ID NO: 48723 - DNA, 35 bp, Artificial Sequence
  Synthetic oligonucleotide
aatttaggcccgcacagctctttgcctgctttcca

SEQ ID NO: 48724 - DNA, 36 bp, Artificial Sequence
  Synthetic oligonucleotide
gtcgggaggggggggagaacgcggtgtgaggctgca

SEQ ID NO: 48725 - DNA, 37 bp, Artificial Sequence
  Synthetic oligonucleotide
atgggtcactgccacttctgcctccgaactccctaga

SEQ ID NO: 48726 - DNA, 36 bp, Artificial Sequence
  Synthetic oligonucleotide
ttacctcccaacgcgcctatgctacgcctccgacga

SEQ ID NO: 48727 - DNA, 36 bp, Artificial Sequence
  Synthetic oligonucleotide
acctacgcatccacgaatggcaaccaatgacctcga

SEQ ID NO: 48728 - DNA, 36 bp, Artificial Sequence
  Synthetic oligonucleotide
gcacacagaggagcgctaaaagtagacgcgcgagga

SEQ ID NO: 48729 - DNA, 36 bp, Artificial Sequence
  Synthetic oligonucleotide
ttagctaccctctgccctttcctccttcgcgtagga

SEQ ID NO: 48730 - DNA, 37 bp, Artificial Sequence
  Synthetic oligonucleotide
gcaccttccgagtgcccggcctgttgtcctacacgga

SEQ ID NO: 48731 - DNA, 37 bp, Artificial Sequence
  Synthetic oligonucleotide
aacaggcggggtaggaatctcacgatttacggtggga

SEQ ID NO: 48732 - DNA, 37 bp, Artificial Sequence
  Synthetic oligonucleotide
taagaccgcgcaccacactcttgcttagacacctgga

SEQ ID NO: 48733 - DNA, 37 bp, Artificial Sequence
  Synthetic oligonucleotide
tagagggtggagaaaatggtcagggggggaacttgga

SEQ ID NO: 48734 - DNA, 35 bp, Artificial Sequence
  Synthetic oligonucleotide
gaggggagtgtggcggggtgggcatatgccaatga

SEQ ID NO: 48735 - DNA, 37 bp, Artificial Sequence
  Synthetic oligonucleotide
atcctgccattgccagccttccaatgctcccttatga

SEQ ID NO: 48736 - DNA, 36 bp, Artificial Sequence
  Synthetic oligonucleotide
taccccttcgagtgcattccttagtggccatcctga

SEQ ID NO: 48737 - DNA, 37 bp, Artificial Sequence
  Synthetic oligonucleotide
acaaacacctggcatgtgatgctattccggaatctga

SEQ ID NO: 48738 - DNA, 38 bp, Artificial Sequence
  Synthetic oligonucleotide
gtgaaccagtaggagagaaaacggatgacaggtagtga

SEQ ID NO: 48739 - DNA, 38 bp, Artificial Sequence
  Synthetic oligonucleotide
acgtcgcaacatccgccctgcctcacgaactgatgtga

SEQ ID NO: 48740 - DNA, 37 bp, Artificial Sequence
  Synthetic oligonucleotide
tgacccgacggggtcaacccattcctatgagctttga

SEQ ID NO: 48741 - DNA, 38 bp, Artificial Sequence
  Synthetic oligonucleotide
acatcccatctgcccggttattcgttgctttgctttga

SEQ ID NO: 48742 - DNA, 36 bp, Artificial Sequence
  Synthetic oligonucleotide
gactctccattgtgagtcctttcactgtccaccata

SEQ ID NO: 48743 - DNA, 36 bp, Artificial Sequence
  Synthetic oligonucleotide
gccatcctgcagtctagtgtcccccctcaacccata

SEQ ID NO: 48744 - DNA, 36 bp, Artificial Sequence
  Synthetic oligonucleotide
gagtgaagcaccctgatcttgctccaattgcccata

SEQ ID NO: 48745 - DNA, 36 bp, Artificial Sequence
  Synthetic oligonucleotide
gaggggggcacggtcggggcacgggagtcaagcata

SEQ ID NO: 48746 - DNA, 36 bp, Artificial Sequence
  Synthetic oligonucleotide
gccaaagccgacgcccctcgaagccataggccacta

SEQ ID NO: 48747 - DNA, 35 bp, Artificial Sequence
  Synthetic oligonucleotide
gagagagggttcgctgtcctggtttttgcttccta

SEQ ID NO: 48748 - DNA, 36 bp, Artificial Sequence
  Synthetic oligonucleotide
acactgacgatctggaatcgtcgctactggttccta

SEQ ID NO: 48749 - DNA, 35 bp, Artificial Sequence
  Synthetic oligonucleotide
gaccatggcgtttgacacccgaatctgcttagcta

SEQ ID NO: 48750 - DNA, 36 bp, Artificial Sequence
  Synthetic oligonucleotide
ttgcgacggggaggggtatggctaaaggggggctta

SEQ ID NO: 48751 - DNA, 35 bp, Artificial Sequence
  Synthetic oligonucleotide
gaacaccgtgctcatgcctgctcatgtggctccac

SEQ ID NO: 48752 - DNA, 35 bp, Artificial Sequence
  Synthetic oligonucleotide
accttgcacggagcggttgcagtaatccattccac

SEQ ID NO: 48753 - DNA, 35 bp, Artificial Sequence
  Synthetic oligonucleotide
aacacatgaccgtatgcgcctcacggcatttgcac

SEQ ID NO: 48754 - DNA, 35 bp, Artificial Sequence
  Synthetic oligonucleotide
aactctccgccccagcatgctgaactttgagtgcc

SEQ ID NO: 48755 - DNA, 35 bp, Artificial Sequence
  Synthetic oligonucleotide
gtccgtaggttttcaatgcccctttacctgttgcc

SEQ ID NO: 48756 - DNA, 35 bp, Artificial Sequence
  Synthetic oligonucleotide
gtcctatcccgccggtccgatccggaaattaccgc

SEQ ID NO: 48757 - DNA, 35 bp, Artificial Sequence
  Synthetic oligonucleotide
atgttcaccttcatttgctgctgttttcgatcggc

SEQ ID NO: 48758 - DNA, 34 bp, Artificial Sequence
  Synthetic oligonucleotide
aaaggcacccacaacctgcaacccatgaaccgag

SEQ ID NO: 48759 - DNA, 35 bp, Artificial Sequence
  Synthetic oligonucleotide
gtgacgatccacgtccatccccgcgcctgtagccg

SEQ ID NO: 48760 - DNA, 35 bp, Artificial Sequence
  Synthetic oligonucleotide
gtatcgagcgggaaaggagggtgtggctggctagg

SEQ ID NO: 48761 - DNA, 34 bp, Artificial Sequence
  Synthetic oligonucleotide
aaacgcaacggaaggatctccgcgtaccctcttg

SEQ ID NO: 48762 - DNA, 35 bp, Artificial Sequence
  Synthetic oligonucleotide
taccggcaccaccctgttattttgctacctctcat

SEQ ID NO: 48763 - DNA, 35 bp, Artificial Sequence
  Synthetic oligonucleotide
ggatgcccagttcgtctctcccaacttattttgat

SEQ ID NO: 48764 - DNA, 35 bp, Artificial Sequence
  Synthetic oligonucleotide
tccgtcgaccctattccatgcagtcttttgaaact

SEQ ID NO: 48765 - DNA, 35 bp, Artificial Sequence
  Synthetic oligonucleotide
tcatcgcgtgcgtacgcctagtcgacattctctct

SEQ ID NO: 48766 - DNA, 35 bp, Artificial Sequence
  Synthetic oligonucleotide
gcaacgcaaacccttttttttttgactgtccgtct

SEQ ID NO: 48767 - DNA, 35 bp, Artificial Sequence
  Synthetic oligonucleotide
gatgtctggcggcaagggggttgggagtgagaagt

SEQ ID NO: 48768 - DNA, 35 bp, Artificial Sequence
  Synthetic oligonucleotide
gggtcctccgcctttcattgctcattgctccctgt

SEQ ID NO: 48769 - DNA, 35 bp, Artificial Sequence
  Synthetic oligonucleotide
aactaacatacgcagagtatgtaccacatttcgtt

SEQ ID NO: 48770 - DNA, 35 bp, Artificial Sequence
  Synthetic oligonucleotide
tcagaccagaagagcggagtgggaagtcttaggtt

SEQ ID NO: 48771 - DNA, 35 bp, Artificial Sequence
  Synthetic oligonucleotide
gtggaccgccgtacggaagtaccattagtgaattt

SEQ ID NO: 48772 - DNA, 35 bp, Artificial Sequence
  Synthetic oligonucleotide
tattcgttccgtcctccaccgtacccatgccagaa

SEQ ID NO: 48773 - DNA, 36 bp, Artificial Sequence
  Synthetic oligonucleotide
gtccctcgacacttcctctgtcctgttctatgagaa

SEQ ID NO: 48774 - DNA, 35 bp, Artificial Sequence
  Synthetic oligonucleotide
acaaatggggggcacaggcgggcttatcgggggaa

SEQ ID NO: 48775 - DNA, 36 bp, Artificial Sequence
  Synthetic oligonucleotide
acatcataccacacatgaccacttccccggactgaa

SEQ ID NO: 48776 - DNA, 35 bp, Artificial Sequence
  Synthetic oligonucleotide
tcacggttcctccccccttaatagcacagctaaca

SEQ ID NO: 48777 - DNA, 36 bp, Artificial Sequence
  Synthetic oligonucleotide
gactgggggggggtccggagggaagcaacgtggaca

SEQ ID NO: 48778 - DNA, 36 bp, Artificial Sequence
  Synthetic oligonucleotide
aactacagacgaaccccacgttatcgaacacatgca

SEQ ID NO: 48779 - DNA, 36 bp, Artificial Sequence
  Synthetic oligonucleotide
gcccctgtgtccctctcctatcgcctgaggccatca

SEQ ID NO: 48780 - DNA, 36 bp, Artificial Sequence
  Synthetic oligonucleotide
acccccggacgggattccggcaattatcgcccctca

SEQ ID NO: 48781 - DNA, 36 bp, Artificial Sequence
  Synthetic oligonucleotide
actcccgcaaccggtccggaccaaatatcccgttca

SEQ ID NO: 48782 - DNA, 37 bp, Artificial Sequence
  Synthetic oligonucleotide
aacttcaatcgtcactgcctttcgtccatccaccaga

SEQ ID NO: 48783 - DNA, 37 bp, Artificial Sequence
  Synthetic oligonucleotide
atggtgggaaagggcaggtgaaccgcacgggaagaga

SEQ ID NO: 48784 - DNA, 37 bp, Artificial Sequence
  Synthetic oligonucleotide
tgaaagtgcagggaaataacaagtagggcgacggaga

SEQ ID NO: 48785 - DNA, 37 bp, Artificial Sequence
  Synthetic oligonucleotide
gttgcgcatccctcgttcatcggctatttttacacga

SEQ ID NO: 48786 - DNA, 37 bp, Artificial Sequence
  Synthetic oligonucleotide
gtcctcgccttcccctgggtcattctcttggttacga

SEQ ID NO: 48787 - DNA, 36 bp, Artificial Sequence
  Synthetic oligonucleotide
atgcataccccgacgttaatctccacaaccttagga

SEQ ID NO: 48788 - DNA, 37 bp, Artificial Sequence
  Synthetic oligonucleotide
tgcgaaggaggggtgaaaattcgggtgggaacgcgga

SEQ ID NO: 48789 - DNA, 38 bp, Artificial Sequence
  Synthetic oligonucleotide
atgtagcgtggtgggggcaaggaaataagacatgatga

SEQ ID NO: 48790 - DNA, 38 bp, Artificial Sequence
  Synthetic oligonucleotide
atccgcccgtcttgattccgccaacatgccttctctga

SEQ ID NO: 48791 - DNA, 37 bp, Artificial Sequence
  Synthetic oligonucleotide
ggaccgcagtaggtcgccgcataaccccacatagtga

SEQ ID NO: 48792 - DNA, 37 bp, Artificial Sequence
  Synthetic oligonucleotide
tatgccgatgtgtgccccccttgtgttgtattcgtga

SEQ ID NO: 48793 - DNA, 37 bp, Artificial Sequence
  Synthetic oligonucleotide
aacacgcacactggaccaactagtcacggttatgtga

SEQ ID NO: 48794 - DNA, 37 bp, Artificial Sequence
  Synthetic oligonucleotide
gcatgcaccacgcgctgttcgtagcctcctaaattga

SEQ ID NO: 48795 - DNA, 38 bp, Artificial Sequence
  Synthetic oligonucleotide
agtgggcggtcccatccattttttatgtcgttccttga

SEQ ID NO: 48796 - DNA, 37 bp, Artificial Sequence
  Synthetic oligonucleotide
gtcaagcatcccccaccgcatttcagattcacgttga

SEQ ID NO: 48797 - DNA, 36 bp, Artificial Sequence
  Synthetic oligonucleotide
gtactcaccgccactcccccatattccattggtcta

SEQ ID NO: 48798 - DNA, 36 bp, Artificial Sequence
  Synthetic oligonucleotide
actccccaccatggtatcttcccacccacgcattta

SEQ ID NO: 48799 - DNA, 35 bp, Artificial Sequence
  Synthetic oligonucleotide
gttcacgaacggtttggtatatccccctcccttac

SEQ ID NO: 48800 - DNA, 33 bp, Artificial Sequence
  Synthetic oligonucleotide
gactgccagtccacgtctcggaaatgcgatccc

SEQ ID NO: 48801 - DNA, 35 bp, Artificial Sequence
  Synthetic oligonucleotide
tcaccgcccactccgattttattgtagcgaccgcc

SEQ ID NO: 48802 - DNA, 35 bp, Artificial Sequence
  Synthetic oligonucleotide
acctaccctctggagctcgcaaagcccaagtttcc

SEQ ID NO: 48803 - DNA, 35 bp, Artificial Sequence
  Synthetic oligonucleotide
accaaatcactgggccgcctaccgccaggactagc

SEQ ID NO: 48804 - DNA, 35 bp, Artificial Sequence
  Synthetic oligonucleotide
gggacctgccactcgcagtttgatccggcccacgc

SEQ ID NO: 48805 - DNA, 35 bp, Artificial Sequence
  Synthetic oligonucleotide
atcgctctaccataccagaagtcacagcctaccgc

SEQ ID NO: 48806 - DNA, 35 bp, Artificial Sequence
  Synthetic oligonucleotide
tcgaccgcccatggcactattttacacgtttctgc

SEQ ID NO: 48807 - DNA, 35 bp, Artificial Sequence
  Synthetic oligonucleotide
ttccgctcagtccgccgtaggttccctcaacactc

SEQ ID NO: 48808 - DNA, 35 bp, Artificial Sequence
  Synthetic oligonucleotide
tcccaaccgttaccctatcgctttaacgtattctc

SEQ ID NO: 48809 - DNA, 35 bp, Artificial Sequence
  Synthetic oligonucleotide
tcccagtgttcgatccagttggttccccgcttgtc

SEQ ID NO: 48810 - DNA, 35 bp, Artificial Sequence
  Synthetic oligonucleotide
gcaatagggaagggagtgcggaacaagaggctcag

SEQ ID NO: 48811 - DNA, 35 bp, Artificial Sequence
  Synthetic oligonucleotide
ggtgggatggagagttgagggcacgtggaggcgag

SEQ ID NO: 48812 - DNA, 35 bp, Artificial Sequence
  Synthetic oligonucleotide
gctgggataggcgcaaacttgggctcgggagggag

SEQ ID NO: 48813 - DNA, 35 bp, Artificial Sequence
  Synthetic oligonucleotide
tcagcattgctctggcgtgacagatttctcccccg

SEQ ID NO: 48814 - DNA, 35 bp, Artificial Sequence
  Synthetic oligonucleotide
gtggagcacgcagttcgagaattgtaggtggaggg

SEQ ID NO: 48815 - DNA, 35 bp, Artificial Sequence
  Synthetic oligonucleotide
gtcacgcctcattgtctccttatggcatgaatcat

SEQ ID NO: 48816 - DNA, 35 bp, Artificial Sequence
  Synthetic oligonucleotide
acccctagcatccgcgcttttgccaacctaaaact

SEQ ID NO: 48817 - DNA, 36 bp, Artificial Sequence
  Synthetic oligonucleotide
tcacgcaagtatcagtgcgctccccctcatgctcaa

SEQ ID NO: 48818 - DNA, 36 bp, Artificial Sequence
  Synthetic oligonucleotide
attggcccgcgcgcaatcgcctcctcgcttcctgaa

SEQ ID NO: 48819 - DNA, 36 bp, Artificial Sequence
  Synthetic oligonucleotide
gtgggacccctcaccaccacctaagttcgccttgaa

SEQ ID NO: 48820 - DNA, 35 bp, Artificial Sequence
  Synthetic oligonucleotide
cacaacggcccgggtacgtttgcctcttttctaca

SEQ ID NO: 48821 - DNA, 36 bp, Artificial Sequence
  Synthetic oligonucleotide
gccaccacacgatttggcccgtctcctttcctccca

SEQ ID NO: 48822 - DNA, 36 bp, Artificial Sequence
  Synthetic oligonucleotide
tccattctctcgcactgccccggcatcgttcctcca

SEQ ID NO: 48823 - DNA, 36 bp, Artificial Sequence
  Synthetic oligonucleotide
gcgcatcatctgctgcgacccgtaccttctatgtca

SEQ ID NO: 48824 - DNA, 37 bp, Artificial Sequence
  Synthetic oligonucleotide
gactccgacctcagcccccctcatcccaagagcaaga

SEQ ID NO: 48825 - DNA, 37 bp, Artificial Sequence
  Synthetic oligonucleotide
agtactggtcagaagagaggggggcaaggttagaaga

SEQ ID NO: 48826 - DNA, 37 bp, Artificial Sequence
  Synthetic oligonucleotide
tcgcaacggagccaccacccagccttccccagacaga

SEQ ID NO: 48827 - DNA, 37 bp, Artificial Sequence
  Synthetic oligonucleotide
gacgatggaccgtgaataacggggggggtaggcgaga

SEQ ID NO: 48828 - DNA, 37 bp, Artificial Sequence
  Synthetic oligonucleotide
agtcacgacatgcggaatccactcccactcccgtaga

SEQ ID NO: 48829 - DNA, 37 bp, Artificial Sequence
  Synthetic oligonucleotide
gtaccgcctaacgccatctcgattcgccgtccgacga

SEQ ID NO: 48830 - DNA, 37 bp, Artificial Sequence
  Synthetic oligonucleotide
gcgcaccctgccatcccaccacgtcccgggaacgcga

SEQ ID NO: 48831 - DNA, 37 bp, Artificial Sequence
  Synthetic oligonucleotide
agaacgtgggtgcgtggggatcatggggtgcgtgcga

SEQ ID NO: 48832 - DNA, 37 bp, Artificial Sequence
  Synthetic oligonucleotide
taccggtggcagaactggagggggggcttaggtgcga

SEQ ID NO: 48833 - DNA, 37 bp, Artificial Sequence
  Synthetic oligonucleotide
aaccgtcctgcatcccgttgcaaccccgccctttcga

SEQ ID NO: 48834 - DNA, 37 bp, Artificial Sequence
  Synthetic oligonucleotide
gagggcggaacggtggaggtcggggctcattacagga

SEQ ID NO: 48835 - DNA, 37 bp, Artificial Sequence
  Synthetic oligonucleotide
atcaagcgggggggaaggaagccatggatgctacgga

SEQ ID NO: 48836 - DNA, 36 bp, Artificial Sequence
  Synthetic oligonucleotide
ggatgaagccgggggtgcagggatcgaggtatcgga

SEQ ID NO: 48837 - DNA, 37 bp, Artificial Sequence
  Synthetic oligonucleotide
gtcagacactttaacatggagaagggtgagggcggga

SEQ ID NO: 48838 - DNA, 37 bp, Artificial Sequence
  Synthetic oligonucleotide
tccccacaccgacaaacggcgtaacaccgttgcatga

SEQ ID NO: 48839 - DNA, 38 bp, Artificial Sequence
  Synthetic oligonucleotide
gaagggaagtggtgcgggtggtaagggctcgaagatga

SEQ ID NO: 48840 - DNA, 38 bp, Artificial Sequence
  Synthetic oligonucleotide
gagtggatggtgcaaatactagtgctaggcattgatga

SEQ ID NO: 48841 - DNA, 37 bp, Artificial Sequence
  Synthetic oligonucleotide
cgcaccctagcgccgacatgttttggccccatactga

SEQ ID NO: 48842 - DNA, 38 bp, Artificial Sequence
  Synthetic oligonucleotide
gtttaagtgggatgagggtgaatggaacaaggtgctga

SEQ ID NO: 48843 - DNA, 37 bp, Artificial Sequence
  Synthetic oligonucleotide
tatgccagaccaccagttccacttatgcccctcgtga

SEQ ID NO: 48844 - DNA, 38 bp, Artificial Sequence
  Synthetic oligonucleotide
acccacccccgcacccaggagaccgaccgtgtctgtga

SEQ ID NO: 48845 - DNA, 38 bp, Artificial Sequence
  Synthetic oligonucleotide
gacacggagtgtgcgcgtcttctaattcagggttgtga

SEQ ID NO: 48846 - DNA, 38 bp, Artificial Sequence
  Synthetic oligonucleotide
gtactcgcctctaactatacggcaccacctgcccttga

SEQ ID NO: 48847 - DNA, 37 bp, Artificial Sequence
  Synthetic oligonucleotide
tatggacgccccaccttgggctttgaaattatcttga

SEQ ID NO: 48848 - DNA, 38 bp, Artificial Sequence
  Synthetic oligonucleotide
gttacccccttgctgtagtgctcatcggtttttcttga

SEQ ID NO: 48849 - DNA, 35 bp, Artificial Sequence
  Synthetic oligonucleotide
gccgggcacgccgcatcgtccattccatcatagta

SEQ ID NO: 48850 - DNA, 36 bp, Artificial Sequence
  Synthetic oligonucleotide
aaggattgcccaccctgttttccttcgtgctttgta

SEQ ID NO: 48851 - DNA, 32 bp, Artificial Sequence
  Synthetic oligonucleotide
ttgccttcctggcccatcaacgatttttctta

SEQ ID NO: 48852 - DNA, 35 bp, Artificial Sequence
  Synthetic oligonucleotide
aagggcaccccacgcttatgcttcaacaatgccac

SEQ ID NO: 48853 - DNA, 36 bp, Artificial Sequence
  Synthetic oligonucleotide
acacgccccctgtccaacctcagactgttgaacgac

SEQ ID NO: 48854 - DNA, 35 bp, Artificial Sequence
  Synthetic oligonucleotide
gtaatgaagtgggaaatgggggcaaaatcgaggac

SEQ ID NO: 48855 - DNA, 35 bp, Artificial Sequence
  Synthetic oligonucleotide
ccactgtgtagactttactgcacgctccacctgac

SEQ ID NO: 48856 - DNA, 35 bp, Artificial Sequence
  Synthetic oligonucleotide
gaccattatccgtcgacttctccgtacccggtacc

SEQ ID NO: 48857 - DNA, 35 bp, Artificial Sequence
  Synthetic oligonucleotide
tgactgttcgtctgggcctgtcatccacccccccc

SEQ ID NO: 48858 - DNA, 35 bp, Artificial Sequence
  Synthetic oligonucleotide
gcccggacacgcccgcttggctccgtcgcttcccc

SEQ ID NO: 48859 - DNA, 35 bp, Artificial Sequence
  Synthetic oligonucleotide
gtctgtgcccaacccaacctaacgggtaatgtccc

SEQ ID NO: 48860 - DNA, 35 bp, Artificial Sequence
  Synthetic oligonucleotide
tacacatccatgcccgggaaactactgtagacagc

SEQ ID NO: 48861 - DNA, 35 bp, Artificial Sequence
  Synthetic oligonucleotide
tgacattggtacagcgcactttttcagactacagc

SEQ ID NO: 48862 - DNA, 35 bp, Artificial Sequence
  Synthetic oligonucleotide
tgcccctgctgaagtacacccggttcgttgctcgc

SEQ ID NO: 48863 - DNA, 35 bp, Artificial Sequence
  Synthetic oligonucleotide
atcgctgtacgttcacctcccctaggatccggggc

SEQ ID NO: 48864 - DNA, 35 bp, Artificial Sequence
  Synthetic oligonucleotide
ggtcgcactgaacctcgcgcctccgccgtccgctc

SEQ ID NO: 48865 - DNA, 35 bp, Artificial Sequence
  Synthetic oligonucleotide
ggattaccatcgcactcacacatggtacctttgtc

SEQ ID NO: 48866 - DNA, 35 bp, Artificial Sequence
  Synthetic oligonucleotide
acagcacaacatcggcccacgctggaattcctacg

SEQ ID NO: 48867 - DNA, 35 bp, Artificial Sequence
  Synthetic oligonucleotide
aatggagggaacggcctgacgagacaagtaccggg

SEQ ID NO: 48868 - DNA, 35 bp, Artificial Sequence
  Synthetic oligonucleotide
acacaacaacgccgaacgttccttctcatcagggg

SEQ ID NO: 48869 - DNA, 35 bp, Artificial Sequence
  Synthetic oligonucleotide
accaacattacctggtcccttctccaaccaccatg

SEQ ID NO: 48870 - DNA, 35 bp, Artificial Sequence
  Synthetic oligonucleotide
agtagacccccccgaaattcgcttctgcatacttg

SEQ ID NO: 48871 - DNA, 35 bp, Artificial Sequence
  Synthetic oligonucleotide
gactaacagtatcacctttgccgctgataagctct

SEQ ID NO: 48872 - DNA, 35 bp, Artificial Sequence
  Synthetic oligonucleotide
taaccacctcctgtgaacgattgactttattgggt

SEQ ID NO: 48873 - DNA, 35 bp, Artificial Sequence
  Synthetic oligonucleotide
gtccaactcctatcaacgtgtgccagcactcgctt

SEQ ID NO: 48874 - DNA, 35 bp, Artificial Sequence
  Synthetic oligonucleotide
tctaaccaccacagaaatctggatccaggccccaa

SEQ ID NO: 48875 - DNA, 36 bp, Artificial Sequence
  Synthetic oligonucleotide
actatctcgcatgacgggtccacactctcctccgaa

SEQ ID NO: 48876 - DNA, 35 bp, Artificial Sequence
  Synthetic oligonucleotide
cagtacggactaagggaggaagggagggcttggaa

SEQ ID NO: 48877 - DNA, 36 bp, Artificial Sequence
  Synthetic oligonucleotide
tccaggtcagatcttcgtggtcccttcctctgctaa

SEQ ID NO: 48878 - DNA, 35 bp, Artificial Sequence
  Synthetic oligonucleotide
gcaatcgcccacacttctcctcccctaggctctaa

SEQ ID NO: 48879 - DNA, 36 bp, Artificial Sequence
  Synthetic oligonucleotide
tgacactcctcccgtaccgttcgagggtttctttaa

SEQ ID NO: 48880 - DNA, 36 bp, Artificial Sequence
  Synthetic oligonucleotide
agcctgtgcacgccgtcctggccccaatgttgccca

SEQ ID NO: 48881 - DNA, 36 bp, Artificial Sequence
  Synthetic oligonucleotide
gccatctgcgccccatcacagacaccctgaaggcca

SEQ ID NO: 48882 - DNA, 36 bp, Artificial Sequence
  Synthetic oligonucleotide
tagacggccactaggggaccccacacaacagctgca

SEQ ID NO: 48883 - DNA, 35 bp, Artificial Sequence
  Synthetic oligonucleotide
gaagctggctgtaacggcattcactatcctcatca

SEQ ID NO: 48884 - DNA, 36 bp, Artificial Sequence
  Synthetic oligonucleotide
tcctggtccgtattaccgctgtccacgcactcttca

SEQ ID NO: 48885 - DNA, 37 bp, Artificial Sequence
  Synthetic oligonucleotide
tgactgcaatcaatatcctcgcggcgcccccttgcga

SEQ ID NO: 48886 - DNA, 37 bp, Artificial Sequence
  Synthetic oligonucleotide
aaacgcgcacgtgctccctcattccaatgggcctcga

SEQ ID NO: 48887 - DNA, 37 bp, Artificial Sequence
  Synthetic oligonucleotide
aaccttgccctcgttgttaccgcataatatacttcga

SEQ ID NO: 48888 - DNA, 35 bp, Artificial Sequence
  Synthetic oligonucleotide
tcacattgccatcccacctcgggagttcctttgga

SEQ ID NO: 48889 - DNA, 37 bp, Artificial Sequence
  Synthetic oligonucleotide
actccatcccgtcataggcttacatcgttcgtcctga

SEQ ID NO: 48890 - DNA, 38 bp, Artificial Sequence
  Synthetic oligonucleotide
aagacggggagaaaacggtgggtatagccaggcagtga

SEQ ID NO: 48891 - DNA, 38 bp, Artificial Sequence
  Synthetic oligonucleotide
tgaggccgtagagtgtacgccccctattaccctcgtga

SEQ ID NO: 48892 - DNA, 37 bp, Artificial Sequence
  Synthetic oligonucleotide
ttgagctctacccaatggggtccaccatctctcgtga

SEQ ID NO: 48893 - DNA, 38 bp, Artificial Sequence
  Synthetic oligonucleotide
accccgacccatttttgtacccttcacgtgtgtcgtga

SEQ ID NO: 48894 - DNA, 38 bp, Artificial Sequence
  Synthetic oligonucleotide
acgttgtgctacacgtgttgtttttctctttctggtga

SEQ ID NO: 48895 - DNA, 37 bp, Artificial Sequence
  Synthetic oligonucleotide
acacgagagctgccgccccccacacacatccaattga

SEQ ID NO: 48896 - DNA, 38 bp, Artificial Sequence
  Synthetic oligonucleotide
gacgtgcaccgtagcgttacacatctccagcacattga

SEQ ID NO: 48897 - DNA, 37 bp, Artificial Sequence
  Synthetic oligonucleotide
ttacgcgccccctcacccaccattgtgatccgattga

SEQ ID NO: 48898 - DNA, 38 bp, Artificial Sequence
  Synthetic oligonucleotide
ttacagggagggaggggacagtgggtgtacctgattga

SEQ ID NO: 48899 - DNA, 36 bp, Artificial Sequence
  Synthetic oligonucleotide
ttaggccacaaaccggtccatcgtagtactctccta

SEQ ID NO: 48900 - DNA, 36 bp, Artificial Sequence
  Synthetic oligonucleotide
accttccctgctcctacgtcgtcgaacgcaattcta

SEQ ID NO: 48901 - DNA, 35 bp, Artificial Sequence
  Synthetic oligonucleotide
gttcactgcaccctcaggcgagcccattcccttta

SEQ ID NO: 48902 - DNA, 35 bp, Artificial Sequence
  Synthetic oligonucleotide
tatgccaccggagcctgacggtcgcgccaaccacc

SEQ ID NO: 48903 - DNA, 35 bp, Artificial Sequence
  Synthetic oligonucleotide
gctggtgctgtcggaggaccggggaaagggggtgg

SEQ ID NO: 48904 - DNA, 35 bp, Artificial Sequence
  Synthetic oligonucleotide
atcgcgggctaagtcgagggggaatatggggaaat

SEQ ID NO: 48905 - DNA, 35 bp, Artificial Sequence
  Synthetic oligonucleotide
cctcgccgttcgcacatacctcggtttaccgcaat

SEQ ID NO: 48906 - DNA, 35 bp, Artificial Sequence
  Synthetic oligonucleotide
cctactgacaatatttcacaggcttctctcgcact

SEQ ID NO: 48907 - DNA, 35 bp, Artificial Sequence
  Synthetic oligonucleotide
aagcaacgtgctatcgtttcccgctgctaggccct

SEQ ID NO: 48908 - DNA, 35 bp, Artificial Sequence
  Synthetic oligonucleotide
tccacccgctggtcattagcaattttttcttagct

SEQ ID NO: 48909 - DNA, 35 bp, Artificial Sequence
  Synthetic oligonucleotide
gctccgaccaattttaacgccaagtacacccacgt

SEQ ID NO: 48910 - DNA, 33 bp, Artificial Sequence
  Synthetic oligonucleotide
actgtggctcactacatcccaaaatctggcgtt

SEQ ID NO: 48911 - DNA, 35 bp, Artificial Sequence
  Synthetic oligonucleotide
aaacaccgctcacatatagttttctgtcacatgtt

SEQ ID NO: 48912 - DNA, 35 bp, Artificial Sequence
  Synthetic oligonucleotide
agtccccagttccgacttaccttccatgctgtttt

SEQ ID NO: 48913 - DNA, 36 bp, Artificial Sequence
  Synthetic oligonucleotide
gtcaccccatggttccattatcaacccggtcctcaa

SEQ ID NO: 48914 - DNA, 36 bp, Artificial Sequence
  Synthetic oligonucleotide
aaagggacgggggaataacaagtagatggagaagaa

SEQ ID NO: 48915 - DNA, 35 bp, Artificial Sequence
  Synthetic oligonucleotide
gacgctacacctcgagcgctctactacgcctggaa

SEQ ID NO: 48916 - DNA, 36 bp, Artificial Sequence
  Synthetic oligonucleotide
ttgccctgccaacccttgcccaatttaatgggctaa

SEQ ID NO: 48917 - DNA, 37 bp, Artificial Sequence
  Synthetic oligonucleotide
gccaagctatatcttcgcatccatctgccattggtaa

SEQ ID NO: 48918 - DNA, 36 bp, Artificial Sequence
  Synthetic oligonucleotide
gacacacttgcatttcgtttctaaagttaggttaca

SEQ ID NO: 48919 - DNA, 36 bp, Artificial Sequence
  Synthetic oligonucleotide
acatccatccgcttcgagggttacaattccaaacca

SEQ ID NO: 48920 - DNA, 35 bp, Artificial Sequence
  Synthetic oligonucleotide
gcctcaaccgctctcactcggtttaaggccatcca

SEQ ID NO: 48921 - DNA, 34 bp, Artificial Sequence
  Synthetic oligonucleotide
gactccgctctgacgtttgcccctctcactggca

SEQ ID NO: 48922 - DNA, 36 bp, Artificial Sequence
  Synthetic oligonucleotide
tgctctgtgtactgatcccgcccaccacatcgctca

SEQ ID NO: 48923 - DNA, 37 bp, Artificial Sequence
  Synthetic oligonucleotide
tgttgccgtcgaaaccgattctctgcctgggccacga

SEQ ID NO: 48924 - DNA, 37 bp, Artificial Sequence
  Synthetic oligonucleotide
gacgatcactacctccctcagtgtcagccatttacga

SEQ ID NO: 48925 - DNA, 37 bp, Artificial Sequence
  Synthetic oligonucleotide
gaactgcctcaatgtttcctacttgtactaccaccga

SEQ ID NO: 48926 - DNA, 36 bp, Artificial Sequence
  Synthetic oligonucleotide
tacaacgtaggacacccgcttcttatgcatccccga

SEQ ID NO: 48927 - DNA, 37 bp, Artificial Sequence
  Synthetic oligonucleotide
tccacctggctgaccttgcgtcctggcagtctttcga

SEQ ID NO: 48928 - DNA, 36 bp, Artificial Sequence
  Synthetic oligonucleotide
tgaaggacaatggaggaaacgggacgcggctcagga

SEQ ID NO: 48929 - DNA, 35 bp, Artificial Sequence
  Synthetic oligonucleotide
gtgattatgaggggggggagaggcgggcccgggga

SEQ ID NO: 48930 - DNA, 36 bp, Artificial Sequence
  Synthetic oligonucleotide
actgagggcgatggatttgtggtacaaatgggtgga

SEQ ID NO: 48931 - DNA, 38 bp, Artificial Sequence
  Synthetic oligonucleotide
tgagaagccctggctgccgtgccatcttgccctcctga

SEQ ID NO: 48932 - DNA, 38 bp, Artificial Sequence
  Synthetic oligonucleotide
ttgagcgcaaggattaagaaggctcaggttaggggtga

SEQ ID NO: 48933 - DNA, 38 bp, Artificial Sequence
  Synthetic oligonucleotide
gactcgcacggcatactcacgtagtccaccaattttga

SEQ ID NO: 48934 - DNA, 36 bp, Artificial Sequence
  Synthetic oligonucleotide
ttcgcacccctcatcctcgcacgctggtccatcata

SEQ ID NO: 48935 - DNA, 35 bp, Artificial Sequence
  Synthetic oligonucleotide
gatcactccgcaaggatgaagtcatccacactata

SEQ ID NO: 48936 - DNA, 36 bp, Artificial Sequence
  Synthetic oligonucleotide
gtgggcaccatagagctcacgcctgtccttcctcta

SEQ ID NO: 48937 - DNA, 35 bp, Artificial Sequence
  Synthetic oligonucleotide
gccgccccgacgatatcgtcctcccttatgtctta

SEQ ID NO: 48938 - DNA, 35 bp, Artificial Sequence
  Synthetic oligonucleotide
gtcgccggccttaagactatatctgcccccacgac

SEQ ID NO: 48939 - DNA, 35 bp, Artificial Sequence
  Synthetic oligonucleotide
agctcaccgacgacgtccggtccctgtttccgtac

SEQ ID NO: 48940 - DNA, 35 bp, Artificial Sequence
  Synthetic oligonucleotide
gctcagctctccgagtgatcgattccgctcccacc

SEQ ID NO: 48941 - DNA, 35 bp, Artificial Sequence
  Synthetic oligonucleotide
gatcgagaccctgatacaaagctgttttctctgcc

SEQ ID NO: 48942 - DNA, 35 bp, Artificial Sequence
  Synthetic oligonucleotide
tgttcccgcctactccactccgtcaaagcctcggc

SEQ ID NO: 48943 - DNA, 35 bp, Artificial Sequence
  Synthetic oligonucleotide
atgcatcgccccccaatgcctgttgaatgcgtggc

SEQ ID NO: 48944 - DNA, 35 bp, Artificial Sequence
  Synthetic oligonucleotide
acgtattagccactctgcgtttgtttgcgcctctc

SEQ ID NO: 48945 - DNA, 35 bp, Artificial Sequence
  Synthetic oligonucleotide
gtgcacagggctatcccgacgtcgatccatctgtc

SEQ ID NO: 48946 - DNA, 35 bp, Artificial Sequence
  Synthetic oligonucleotide
gtacttcccgaacgtatctgtaccccttgaacttc

SEQ ID NO: 48947 - DNA, 35 bp, Artificial Sequence
  Synthetic oligonucleotide
gaggccgcccggctctaacaacctgcccttcccag

SEQ ID NO: 48948 - DNA, 35 bp, Artificial Sequence
  Synthetic oligonucleotide
agcaacataccagccgacctgtcttatccccatag

SEQ ID NO: 48949 - DNA, 35 bp, Artificial Sequence
  Synthetic oligonucleotide
actgatctcttccgctggcatggccatttctcacg

SEQ ID NO: 48950 - DNA, 35 bp, Artificial Sequence
  Synthetic oligonucleotide
ttcagtgtcgcaggggaatcaatgatgggggggct

SEQ ID NO: 48951 - DNA, 35 bp, Artificial Sequence
  Synthetic oligonucleotide
tgtcacgctccctgcaccttggtaccacgccaatt

SEQ ID NO: 48952 - DNA, 35 bp, Artificial Sequence
  Synthetic oligonucleotide
acgccgggaggttctggtagtctcggtcctttctt

SEQ ID NO: 48953 - DNA, 35 bp, Artificial Sequence
  Synthetic oligonucleotide
acaaggcccacccacagacacggaaaatgtgcgtt

SEQ ID NO: 48954 - DNA, 35 bp, Artificial Sequence
  Synthetic oligonucleotide
tccccacggtcgtgggttaacccgttcacactgtt

SEQ ID NO: 48955 - DNA, 35 bp, Artificial Sequence
  Synthetic oligonucleotide
tcgcccccgaagtatgctcgcccgcatccgcattt

SEQ ID NO: 48956 - DNA, 35 bp, Artificial Sequence
  Synthetic oligonucleotide
gtcatctgcattccaagttcttagcctgactcttt

SEQ ID NO: 48957 - DNA, 35 bp, Artificial Sequence
  Synthetic oligonucleotide
ggggagtacgctgttcgttccatccattcttgttt

SEQ ID NO: 48958 - DNA, 36 bp, Artificial Sequence
  Synthetic oligonucleotide
atacgcacaccagtccctgacccgcttcgcctacaa

SEQ ID NO: 48959 - DNA, 36 bp, Artificial Sequence
  Synthetic oligonucleotide
tatttgcccagggccattcttgagtgctccacccaa

SEQ ID NO: 48960 - DNA, 36 bp, Artificial Sequence
  Synthetic oligonucleotide
ttcgcgcatgcccagcgcctcttaacattccgagaa

SEQ ID NO: 48961 - DNA, 35 bp, Artificial Sequence
  Synthetic oligonucleotide
ttgacgtggcaaggttcgtcccacctatctgttaa

SEQ ID NO: 48962 - DNA, 35 bp, Artificial Sequence
  Synthetic oligonucleotide
acctaccacgctgactgtcagctgcgcaagcccca

SEQ ID NO: 48963 - DNA, 36 bp, Artificial Sequence
  Synthetic oligonucleotide
tcagcactcggtatcttaccctggaactttgcatca

SEQ ID NO: 48964 - DNA, 36 bp, Artificial Sequence
  Synthetic oligonucleotide
tgatcatggacaatattggaggtgagtacgggcaga

SEQ ID NO: 48965 - DNA, 36 bp, Artificial Sequence
  Synthetic oligonucleotide
tgtggcatcacccgcactataactgcacactcgaga

SEQ ID NO: 48966 - DNA, 37 bp, Artificial Sequence
  Synthetic oligonucleotide
ggtcacgggtagggaggttctgggggtggaccggaga

SEQ ID NO: 48967 - DNA, 37 bp, Artificial Sequence
  Synthetic oligonucleotide
gctgcccccatcgaagtctttccaccgtttatgccga

SEQ ID NO: 48968 - DNA, 37 bp, Artificial Sequence
  Synthetic oligonucleotide
agggtgttcaggaagggatggaatgggaatgtaagga

SEQ ID NO: 48969 - DNA, 37 bp, Artificial Sequence
  Synthetic oligonucleotide
ggggtgtggagggagttagggtaagataagacgagga

SEQ ID NO: 48970 - DNA, 37 bp, Artificial Sequence
  Synthetic oligonucleotide
gccgtggtgtggaagaaagggtggtgacatcggagga

SEQ ID NO: 48971 - DNA, 37 bp, Artificial Sequence
  Synthetic oligonucleotide
aaccgccccccgcccttcgcgacgccaatcgcacgga

SEQ ID NO: 48972 - DNA, 37 bp, Artificial Sequence
  Synthetic oligonucleotide
atgttccacccctcacatgatgcactcccgtgtggga

SEQ ID NO: 48973 - DNA, 37 bp, Artificial Sequence
  Synthetic oligonucleotide
gccggaatcatcggtctcttaggcccccacccctgga

SEQ ID NO: 48974 - DNA, 38 bp, Artificial Sequence
  Synthetic oligonucleotide
atcttcgtacgccacacatatccacgccatccacatga

SEQ ID NO: 48975 - DNA, 38 bp, Artificial Sequence
  Synthetic oligonucleotide
attcgccccgtcgggtttcatctctcactcctgcatga

SEQ ID NO: 48976 - DNA, 38 bp, Artificial Sequence
  Synthetic oligonucleotide
tcagtcaccgacatgatcatctcgcatttccctgctga

SEQ ID NO: 48977 - DNA, 38 bp, Artificial Sequence
  Synthetic oligonucleotide
tcatcgcggggtaaaataggtgagggtgtgatttgtga

SEQ ID NO: 48978 - DNA, 35 bp, Artificial Sequence
  Synthetic oligonucleotide
gtgcccactcggctttatagggtaccttatctcta

SEQ ID NO: 48979 - DNA, 37 bp, Artificial Sequence
  Synthetic oligonucleotide
gtgcatcactgatgcacgcctacgtactccctcggta

SEQ ID NO: 48980 - DNA, 35 bp, Artificial Sequence
  Synthetic oligonucleotide
attgcacggacacatggtttttcgtcttatcttta

SEQ ID NO: 48981 - DNA, 35 bp, Artificial Sequence
  Synthetic oligonucleotide
tatgatgacgccttgaatgtcgctacctataacac

SEQ ID NO: 48982 - DNA, 35 bp, Artificial Sequence
  Synthetic oligonucleotide
tacgacagtagggcacgagccgtcgtaacattcac

SEQ ID NO: 48983 - DNA, 35 bp, Artificial Sequence
  Synthetic oligonucleotide
taagtgagtggggtagggaggggttgcctatgggc

SEQ ID NO: 48984 - DNA, 35 bp, Artificial Sequence
  Synthetic oligonucleotide
tgcctgcaccccattgtacgcgccgatttcacatc

SEQ ID NO: 48985 - DNA, 35 bp, Artificial Sequence
  Synthetic oligonucleotide
ttgcgtagtatgcgctctcctactgcctcgtactc

SEQ ID NO: 48986 - DNA, 35 bp, Artificial Sequence
  Synthetic oligonucleotide
gtgacattgcgtatgtcgtagcggtcttacccctc

SEQ ID NO: 48987 - DNA, 35 bp, Artificial Sequence
  Synthetic oligonucleotide
tcacggtcgtctctcattgggcatccccgaccgtc

SEQ ID NO: 48988 - DNA, 35 bp, Artificial Sequence
  Synthetic oligonucleotide
atccacctatgcacatgcgtatatatcatgctgtc

SEQ ID NO: 48989 - DNA, 35 bp, Artificial Sequence
  Synthetic oligonucleotide
gcctttccccgcgctatctttttgtcgtaaatttc

SEQ ID NO: 48990 - DNA, 35 bp, Artificial Sequence
  Synthetic oligonucleotide
atattgcaaggagcgataggggagggggaggaagg

SEQ ID NO: 48991 - DNA, 35 bp, Artificial Sequence
  Synthetic oligonucleotide
gttctgcaactgatctttcctccgctcttcatagg

SEQ ID NO: 48992 - DNA, 35 bp, Artificial Sequence
  Synthetic oligonucleotide
aagcaggatggaaagggcgtggggagcggaatggg

SEQ ID NO: 48993 - DNA, 35 bp, Artificial Sequence
  Synthetic oligonucleotide
aaagccaagctcccaatagcgctcaccaacctctg

SEQ ID NO: 48994 - DNA, 35 bp, Artificial Sequence
  Synthetic oligonucleotide
gaacgtacgccacgacctccttttggctgttctat

SEQ ID NO: 48995 - DNA, 35 bp, Artificial Sequence
  Synthetic oligonucleotide
atgtccatcaacagcttaagcgacgcgcaaaacct

SEQ ID NO: 48996 - DNA, 35 bp, Artificial Sequence
  Synthetic oligonucleotide
tgagccggcctcacagcttctcagatacctcgcct

SEQ ID NO: 48997 - DNA, 36 bp, Artificial Sequence
  Synthetic oligonucleotide
atcactctcatcgaggcaatcaacaccagtactaaa

SEQ ID NO: 48998 - DNA, 36 bp, Artificial Sequence
  Synthetic oligonucleotide
tataacgaaaaccgagtgggaagggaagcagggcaa

SEQ ID NO: 48999 - DNA, 36 bp, Artificial Sequence
  Synthetic oligonucleotide
atgtggcaaccctctccatgtatccttcgacccgaa

SEQ ID NO: 49000 - DNA, 35 bp, Artificial Sequence
  Synthetic oligonucleotide
ttgtacccgcagctgttcgcctgtacttactctaa

SEQ ID NO: 49001 - DNA, 36 bp, Artificial Sequence
  Synthetic oligonucleotide
gtacacctgttcagaaaactatcagctctttgccca

SEQ ID NO: 49002 - DNA, 36 bp, Artificial Sequence
  Synthetic oligonucleotide
agacaacacagccggacaacggctcacctactgcca

SEQ ID NO: 49003 - DNA, 36 bp, Artificial Sequence
  Synthetic oligonucleotide
tccgttgtcgcacacctctatggagttcctagtcca

SEQ ID NO: 49004 - DNA, 36 bp, Artificial Sequence
  Synthetic oligonucleotide
gtcgggccgccgcttctcttcagccaatcatgtcca

SEQ ID NO: 49005 - DNA, 37 bp, Artificial Sequence
  Synthetic oligonucleotide
ttggcacacgagagtgactcttcccatttcctgcaga

SEQ ID NO: 49006 - DNA, 36 bp, Artificial Sequence
  Synthetic oligonucleotide
tcaacccaccgtggaccgcgggagccactccaacga

SEQ ID NO: 49007 - DNA, 35 bp, Artificial Sequence
  Synthetic oligonucleotide
atgacccaacacaccaccaggcccggacaatccga

SEQ ID NO: 49008 - DNA, 35 bp, Artificial Sequence
  Synthetic oligonucleotide
gggggggtgcggaacatggatagaggtgaagagga

SEQ ID NO: 49009 - DNA, 36 bp, Artificial Sequence
  Synthetic oligonucleotide
aggggcatggacggggactaaggggctctgtaggga

SEQ ID NO: 49010 - DNA, 36 bp, Artificial Sequence
  Synthetic oligonucleotide
gaagccaacggatggaagacgcgaaaggagggggga

SEQ ID NO: 49011 - DNA, 37 bp, Artificial Sequence
  Synthetic oligonucleotide
gttgagcaacggtttcatctccccccgcgctttggga

SEQ ID NO: 49012 - DNA, 37 bp, Artificial Sequence
  Synthetic oligonucleotide
gctgagcggctgttagcaatgggagggggggcgtgga

SEQ ID NO: 49013 - DNA, 36 bp, Artificial Sequence
  Synthetic oligonucleotide
taaagggacaagaggataggataggaggggggatga

SEQ ID NO: 49014 - DNA, 38 bp, Artificial Sequence
  Synthetic oligonucleotide
gccaaagtgaggtgaagtatgtggtggacgaaagctga

SEQ ID NO: 49015 - DNA, 38 bp, Artificial Sequence
  Synthetic oligonucleotide
ttgcacgtacgctagcttttttggattctcaccgctga

SEQ ID NO: 49016 - DNA, 37 bp, Artificial Sequence
  Synthetic oligonucleotide
acaccccgctggccccctaatttcacctttgcggtga

SEQ ID NO: 49017 - DNA, 38 bp, Artificial Sequence
  Synthetic oligonucleotide
tagccagctacacgccttcgcgactcctcctcctgtga

SEQ ID NO: 49018 - DNA, 38 bp, Artificial Sequence
  Synthetic oligonucleotide
ttcgccccagaccattccacaacctttagtttctgtga

SEQ ID NO: 49019 - DNA, 38 bp, Artificial Sequence
  Synthetic oligonucleotide
gcccacgattatgccacatcagtgcacccttgaattga

SEQ ID NO: 49020 - DNA, 37 bp, Artificial Sequence
  Synthetic oligonucleotide
aacagtgtacatcttggctgccgattccccccattga

SEQ ID NO: 49021 - DNA, 38 bp, Artificial Sequence
  Synthetic oligonucleotide
acacgtgtggaagatgggcgatgaagggcttagattga

SEQ ID NO: 49022 - DNA, 37 bp, Artificial Sequence
  Synthetic oligonucleotide
gatggcctcactgccgttctttgtctcgacactttga

SEQ ID NO: 49023 - DNA, 36 bp, Artificial Sequence
  Synthetic oligonucleotide
ttgcaggccatcataatgaacgcctatatttgcata

SEQ ID NO: 49024 - DNA, 36 bp, Artificial Sequence
  Synthetic oligonucleotide
tgcaatggaggtggaggtgtgccatagtcggtccta

SEQ ID NO: 49025 - DNA, 36 bp, Artificial Sequence
  Synthetic oligonucleotide
atgccacccaccaagaactgactacagtagactcta

SEQ ID NO: 49026 - DNA, 36 bp, Artificial Sequence
  Synthetic oligonucleotide
gaaccgcccatcacgtccgagtcaacctccagtcta

SEQ ID NO: 49027 - DNA, 35 bp, Artificial Sequence
  Synthetic oligonucleotide
tacgaggcccaaaactgcctactcacgtgcctaac

SEQ ID NO: 49028 - DNA, 35 bp, Artificial Sequence
  Synthetic oligonucleotide
tagcggtgcgggtgtgctgatgcgcttagatccac

SEQ ID NO: 49029 - DNA, 35 bp, Artificial Sequence
  Synthetic oligonucleotide
gccctcacatagtacggcgacaactccctatcatc

SEQ ID NO: 49030 - DNA, 35 bp, Artificial Sequence
  Synthetic oligonucleotide
agccacgaccttagtgtatccctcacattcccctc

SEQ ID NO: 49031 - DNA, 35 bp, Artificial Sequence
  Synthetic oligonucleotide
gtacgccatccagcgggcgggacaccctgtatctc

SEQ ID NO: 49032 - DNA, 35 bp, Artificial Sequence
  Synthetic oligonucleotide
gattgctccctggcctatcttatggtgacaaagtc

SEQ ID NO: 49033 - DNA, 35 bp, Artificial Sequence
  Synthetic oligonucleotide
gccaacatagctgaggcacgtacgccccatcacag

SEQ ID NO: 49034 - DNA, 35 bp, Artificial Sequence
  Synthetic oligonucleotide
gtgtagcatggaagcgggctaaagcggatggatgg

SEQ ID NO: 49035 - DNA, 35 bp, Artificial Sequence
  Synthetic oligonucleotide
gttcgccccatcgctctttaggcaatccaatcatg

SEQ ID NO: 49036 - DNA, 35 bp, Artificial Sequence
  Synthetic oligonucleotide
gaagaacggtaaaggaagggagggtgtgtaatatg

SEQ ID NO: 49037 - DNA, 35 bp, Artificial Sequence
  Synthetic oligonucleotide
atgcatacgatctgcttacctcatctcctacttat

SEQ ID NO: 49038 - DNA, 35 bp, Artificial Sequence
  Synthetic oligonucleotide
tcgatcgttcctgtacaccacttccacgcgcccct

SEQ ID NO: 49039 - DNA, 35 bp, Artificial Sequence
  Synthetic oligonucleotide
gaacaggagatgtccgactttccgctccatccgct

SEQ ID NO: 49040 - DNA, 35 bp, Artificial Sequence
  Synthetic oligonucleotide
gaagcgacactagcgcaatcccaccctatggttct

SEQ ID NO: 49041 - DNA, 35 bp, Artificial Sequence
  Synthetic oligonucleotide
atccccgtcccgcccttttctcgttaccgctcatt

SEQ ID NO: 49042 - DNA, 35 bp, Artificial Sequence
  Synthetic oligonucleotide
gatctacatccaggagcacaacaacatcagttctt

SEQ ID NO: 49043 - DNA, 35 bp, Artificial Sequence
  Synthetic oligonucleotide
tttgcaaccgacagccgatagttaggggggtagtt

SEQ ID NO: 49044 - DNA, 35 bp, Artificial Sequence
  Synthetic oligonucleotide
tagagtaggccgggtacgtggaggtatgggaaaaa

SEQ ID NO: 49045 - DNA, 36 bp, Artificial Sequence
  Synthetic oligonucleotide
tagccctgcgcatcaagccacactgtaacatgccaa

SEQ ID NO: 49046 - DNA, 38 bp, Artificial Sequence
  Synthetic oligonucleotide
gccccacgtactatgtcgccactaatgatccgctcgaa

SEQ ID NO: 49047 - DNA, 36 bp, Artificial Sequence
  Synthetic oligonucleotide
ttgcggtcatggcgggtgggccggggctggctggaa

SEQ ID NO: 49048 - DNA, 36 bp, Artificial Sequence
  Synthetic oligonucleotide
tcagtacatgctgcccgtccacatcaggttgccaca

SEQ ID NO: 49049 - DNA, 35 bp, Artificial Sequence
  Synthetic oligonucleotide
gaccctcgccgggagagtaaccggcccaccttaca

SEQ ID NO: 49050 - DNA, 35 bp, Artificial Sequence
  Synthetic oligonucleotide
gtacacccgcacgaggaatacttcgaggaaacgca

SEQ ID NO: 49051 - DNA, 35 bp, Artificial Sequence
  Synthetic oligonucleotide
acttgaccccgtctcttgcacctaggctcggtgca

SEQ ID NO: 49052 - DNA, 37 bp, Artificial Sequence
  Synthetic oligonucleotide
gtacgcctagtgcacaacagctttcctcatttgacga

SEQ ID NO: 49053 - DNA, 37 bp, Artificial Sequence
  Synthetic oligonucleotide
gctgacgtgaaatggacgggaaggggggagagtacga

SEQ ID NO: 49054 - DNA, 37 bp, Artificial Sequence
  Synthetic oligonucleotide
tgtgcggtcccatggttgcccgtccttgccctgtcga

SEQ ID NO: 49055 - DNA, 37 bp, Artificial Sequence
  Synthetic oligonucleotide
tccatgcaccgttcgctaatgttcgtttgtttgtcga

SEQ ID NO: 49056 - DNA, 36 bp, Artificial Sequence
  Synthetic oligonucleotide
gaaacgtaggaggagcatgaaggggccagaatagga

SEQ ID NO: 49057 - DNA, 37 bp, Artificial Sequence
  Synthetic oligonucleotide
tccagggtaagtgaaaggtaaggggtgggttagggga

SEQ ID NO: 49058 - DNA, 37 bp, Artificial Sequence
  Synthetic oligonucleotide
gatggacaaggtaaatgagagcggtgtagagggggga

SEQ ID NO: 49059 - DNA, 37 bp, Artificial Sequence
  Synthetic oligonucleotide
gtctcgcagaacggtgatgggcgggagaaggggggga

SEQ ID NO: 49060 - DNA, 38 bp, Artificial Sequence
  Synthetic oligonucleotide
tctccccgtcgccttttgcgtatggctcgcccccatga

SEQ ID NO: 49061 - DNA, 38 bp, Artificial Sequence
  Synthetic oligonucleotide
gctgaagctgcctgctcacccgtggcctacctccatga

SEQ ID NO: 49062 - DNA, 38 bp, Artificial Sequence
  Synthetic oligonucleotide
gcctgagccagaaacgacatattgaatcctgctcctga

SEQ ID NO: 49063 - DNA, 37 bp, Artificial Sequence
  Synthetic oligonucleotide
actccccgtgccctttgcattattctgatacccgtga

SEQ ID NO: 49064 - DNA, 38 bp, Artificial Sequence
  Synthetic oligonucleotide
tgtggcggtcctcgttttgtcgcacatcttctccgtga

SEQ ID NO: 49065 - DNA, 38 bp, Artificial Sequence
  Synthetic oligonucleotide
accggagggcgaaggaaagagaatgacagcttgattga

SEQ ID NO: 49066 - DNA, 38 bp, Artificial Sequence
  Synthetic oligonucleotide
acggtctggccccgcccttgaatttgactctgttttga

SEQ ID NO: 49067 - DNA, 35 bp, Artificial Sequence
  Synthetic oligonucleotide
tctgaagacgcagccgggatccaactatgcaccta

SEQ ID NO: 49068 - DNA, 36 bp, Artificial Sequence
  Synthetic oligonucleotide
gtgcgccacactgtcgtcgtttgctacccttcccta

SEQ ID NO: 49069 - DNA, 35 bp, Artificial Sequence
  Synthetic oligonucleotide
gacaccgcctctattcgcagaccctagaagtctta

SEQ ID NO: 49070 - DNA, 36 bp, Artificial Sequence
  Synthetic oligonucleotide
ttccaaccaggacctgaatttgaccgttccaagtta

SEQ ID NO: 49071 - DNA, 36 bp, Artificial Sequence
  Synthetic oligonucleotide
tcagtactcgccactgccgtgacattcgttaattta

SEQ ID NO: 49072 - DNA, 35 bp, Artificial Sequence
  Synthetic oligonucleotide
tctcattgcactcgggctctggattccgcccacac

SEQ ID NO: 49073 - DNA, 35 bp, Artificial Sequence
  Synthetic oligonucleotide
tgctaccacccgcgtttgaccctagcaatttaacc

SEQ ID NO: 49074 - DNA, 35 bp, Artificial Sequence
  Synthetic oligonucleotide
agtggaagctggacgttcgttatcttttcaccccc

SEQ ID NO: 49075 - DNA, 35 bp, Artificial Sequence
  Synthetic oligonucleotide
gtcgcctggaccgttgagtcatcgccgtcccgccc

SEQ ID NO: 49076 - DNA, 35 bp, Artificial Sequence
  Synthetic oligonucleotide
gatagcctttgatccgaacgttcacgaacctgccc

SEQ ID NO: 49077 - DNA, 35 bp, Artificial Sequence
  Synthetic oligonucleotide
cccatcaccagtcgatagtccctccactcggtccc

SEQ ID NO: 49078 - DNA, 35 bp, Artificial Sequence
  Synthetic oligonucleotide
gaggccctcattctcccttcatggcagttctcgcc

SEQ ID NO: 49079 - DNA, 35 bp, Artificial Sequence
  Synthetic oligonucleotide
aaagtgcccgctgttagctacccataatcccttcc

SEQ ID NO: 49080 - DNA, 35 bp, Artificial Sequence
  Synthetic oligonucleotide
atccactgtcaatcatacaccatcgctttagttcc

SEQ ID NO: 49081 - DNA, 35 bp, Artificial Sequence
  Synthetic oligonucleotide
aagtaccacctttgccgcggcaccttttttctcgc

SEQ ID NO: 49082 - DNA, 35 bp, Artificial Sequence
  Synthetic oligonucleotide
tatgcctccacactgacggggccgtctcaaggatc

SEQ ID NO: 49083 - DNA, 35 bp, Artificial Sequence
  Synthetic oligonucleotide
taactcctccctggtgcgatggtagtaccaaactc

SEQ ID NO: 49084 - DNA, 35 bp, Artificial Sequence
  Synthetic oligonucleotide
gatgacagtcacaaatggacgacggaagaacacag

SEQ ID NO: 49085 - DNA, 35 bp, Artificial Sequence
  Synthetic oligonucleotide
ggaaccacggaccccctactctgcctcttttgcag

SEQ ID NO: 49086 - DNA, 35 bp, Artificial Sequence
  Synthetic oligonucleotide
accaagagcatgtccggcccgccctctcactagcg

SEQ ID NO: 49087 - DNA, 32 bp, Artificial Sequence
  Synthetic oligonucleotide
tgattcagtcctttgcttcgtgccccacctcg

SEQ ID NO: 49088 - DNA, 35 bp, Artificial Sequence
  Synthetic oligonucleotide
ccacactcagccgccccgcaagtacttttatttcg

SEQ ID NO: 49089 - DNA, 36 bp, Artificial Sequence
  Synthetic oligonucleotide
ggaaggggacccggggcgaaggggaaaggttgcagg

SEQ ID NO: 49090 - DNA, 35 bp, Artificial Sequence
  Synthetic oligonucleotide
tccatcactgtcacgtcccctgtcctgtacgtagg

SEQ ID NO: 49091 - DNA, 35 bp, Artificial Sequence
  Synthetic oligonucleotide
aagctcactcgccggcctcctctaacatgcatctg

SEQ ID NO: 49092 - DNA, 35 bp, Artificial Sequence
  Synthetic oligonucleotide
gtagggcgactagtaggagttgaggggtggcaaat

SEQ ID NO: 49093 - DNA, 35 bp, Artificial Sequence
  Synthetic oligonucleotide
acagcttgcaccatggcacaccctagggaaaatct

SEQ ID NO: 49094 - DNA, 35 bp, Artificial Sequence
  Synthetic oligonucleotide
gtccccgcccgcgctgtatatagtcctgttgcctt

SEQ ID NO: 49095 - DNA, 35 bp, Artificial Sequence
  Synthetic oligonucleotide
aagcccgcgccgtccgcccgctgaatgtttcgctt

SEQ ID NO: 49096 - DNA, 35 bp, Artificial Sequence
  Synthetic oligonucleotide
tcaaccgggcgccagcgcgcgtggccctccatctt

SEQ ID NO: 49097 - DNA, 36 bp, Artificial Sequence
  Synthetic oligonucleotide
gcaaagtgaggttggggatcaaacgagggctagtaa

SEQ ID NO: 49098 - DNA, 36 bp, Artificial Sequence
  Synthetic oligonucleotide
tcgtcactcctggccgggctcccttatctagtaaca

SEQ ID NO: 49099 - DNA, 36 bp, Artificial Sequence
  Synthetic oligonucleotide
gccatccccagcgctgtataggcatatcctttacca

SEQ ID NO: 49100 - DNA, 35 bp, Artificial Sequence
  Synthetic oligonucleotide
atggcaccacctcttcctacaagccttctgtgcca

SEQ ID NO: 49101 - DNA, 36 bp, Artificial Sequence
  Synthetic oligonucleotide
gttgcaaccatggtggccctccgtactcatatatca

SEQ ID NO: 49102 - DNA, 35 bp, Artificial Sequence
  Synthetic oligonucleotide
gatggagccctctccctgaaatatgttgcatctca

SEQ ID NO: 49103 - DNA, 37 bp, Artificial Sequence
  Synthetic oligonucleotide
atggtaggatgaagggcaaattagcatgggaggaaga

SEQ ID NO: 49104 - DNA, 37 bp, Artificial Sequence
  Synthetic oligonucleotide
tgagtccggaaaagagagatgacgaagggacggcaga

SEQ ID NO: 49105 - DNA, 37 bp, Artificial Sequence
  Synthetic oligonucleotide
tcttatgtcagcccatcgcactccactcgtttcacga

SEQ ID NO: 49106 - DNA, 37 bp, Artificial Sequence
  Synthetic oligonucleotide
gttcccacccgttttcgcccagctcctacagctacga

SEQ ID NO: 49107 - DNA, 37 bp, Artificial Sequence
  Synthetic oligonucleotide
gcacgcgcactcagtcccttcgatcccatcttaccga

SEQ ID NO: 49108 - DNA, 37 bp, Artificial Sequence
  Synthetic oligonucleotide
ttgttctcccgctcacgttccgcccatgcccgcgcga

SEQ ID NO: 49109 - DNA, 35 bp, Artificial Sequence
  Synthetic oligonucleotide
aagccgctgacccttctcatatgacaccaatgcga

SEQ ID NO: 49110 - DNA, 37 bp, Artificial Sequence
  Synthetic oligonucleotide
tggacccaccttgttcggacactctcccctgttgcga

SEQ ID NO: 49111 - DNA, 37 bp, Artificial Sequence
  Synthetic oligonucleotide
gtctggcggctgctgtcaatcatcctgccttcctcga

SEQ ID NO: 49112 - DNA, 37 bp, Artificial Sequence
  Synthetic oligonucleotide
gcgatgctttggggaagggggcaaaaaggataaagga

SEQ ID NO: 49113 - DNA, 37 bp, Artificial Sequence
  Synthetic oligonucleotide
gtaagggaagtggtagtagggatgtggttgggcagga

SEQ ID NO: 49114 - DNA, 36 bp, Artificial Sequence
  Synthetic oligonucleotide
ttggtcgcaaggcgagagaagggaggacaaaacgga

SEQ ID NO: 49115 - DNA, 37 bp, Artificial Sequence
  Synthetic oligonucleotide
tcatgtgggtgggatggggattcccttgggatccgga

SEQ ID NO: 49116 - DNA, 37 bp, Artificial Sequence
  Synthetic oligonucleotide
atcatcaagcgaagaataacaggcaagtggggaggga

SEQ ID NO: 49117 - DNA, 37 bp, Artificial Sequence
  Synthetic oligonucleotide
gtcatcacgttgtcttatgcgcgccctttctacctga

SEQ ID NO: 49118 - DNA, 37 bp, Artificial Sequence
  Synthetic oligonucleotide
atggccctgagctgcgtagttcatcatctttatctga

SEQ ID NO: 49119 - DNA, 37 bp, Artificial Sequence
  Synthetic oligonucleotide
acccacgcaacacggtaggattcccgtttctttctga

SEQ ID NO: 49120 - DNA, 38 bp, Artificial Sequence
  Synthetic oligonucleotide
agtgggggaggtggggacagagaggcatcacagggtga

SEQ ID NO: 49121 - DNA, 38 bp, Artificial Sequence
  Synthetic oligonucleotide
atcgcgcccccccccagctcagctaatggacttggtga

SEQ ID NO: 49122 - DNA, 36 bp, Artificial Sequence
  Synthetic oligonucleotide
gtggccacaaccggtccaatccgaggttcctaccta

SEQ ID NO: 49123 - DNA, 36 bp, Artificial Sequence
  Synthetic oligonucleotide
tgttgagaggtggagtatgataggggtgggtttcta

SEQ ID NO: 49124 - DNA, 35 bp, Artificial Sequence
  Synthetic oligonucleotide
gaggaatggatgcaaccaggagtggtactggggta

SEQ ID NO: 49125 - DNA, 36 bp, Artificial Sequence
  Synthetic oligonucleotide
tagacgggccaatttaatatgtacttttcctgctta

SEQ ID NO: 49126 - DNA, 33 bp, Artificial Sequence
  Synthetic oligonucleotide
gtacacgccacaggctcgtgccctcactatcac

SEQ ID NO: 49127 - DNA, 35 bp, Artificial Sequence
  Synthetic oligonucleotide
taccatcgacgcttgattcctctgtgagttattac

SEQ ID NO: 49128 - DNA, 35 bp, Artificial Sequence
  Synthetic oligonucleotide
tactgccccactgaccgccttgtactataccgacc

SEQ ID NO: 49129 - DNA, 35 bp, Artificial Sequence
  Synthetic oligonucleotide
tgaccacttttcgcaacgccatcttccatcgccgc

SEQ ID NO: 49130 - DNA, 35 bp, Artificial Sequence
  Synthetic oligonucleotide
ttgaaacggctggctagtagtcttcacctccctgc

SEQ ID NO: 49131 - DNA, 35 bp, Artificial Sequence
  Synthetic oligonucleotide
ttccgagccatttcacggtggtatcacctgtcctc

SEQ ID NO: 49132 - DNA, 35 bp, Artificial Sequence
  Synthetic oligonucleotide
gccgctcaccggatcgggatccctcactgttcctc

SEQ ID NO: 49133 - DNA, 35 bp, Artificial Sequence
  Synthetic oligonucleotide
gcacccatcggctcataactggtccttgtacctag

SEQ ID NO: 49134 - DNA, 35 bp, Artificial Sequence
  Synthetic oligonucleotide
gcctctccaccctagcctatcattctcgttgggcg

SEQ ID NO: 49135 - DNA, 35 bp, Artificial Sequence
  Synthetic oligonucleotide
ttgtgcctaatcgccccccctggaccgagttttcg

SEQ ID NO: 49136 - DNA, 35 bp, Artificial Sequence
  Synthetic oligonucleotide
tgcaagcacacttcctgctgcttattttctccagg

SEQ ID NO: 49137 - DNA, 35 bp, Artificial Sequence
  Synthetic oligonucleotide
gctgcgtgctcagcccggtcaccacttttcttatg

SEQ ID NO: 49138 - DNA, 35 bp, Artificial Sequence
  Synthetic oligonucleotide
tggacctctctcccgcttaccttgctgacaagctg

SEQ ID NO: 49139 - DNA, 35 bp, Artificial Sequence
  Synthetic oligonucleotide
tacaccctcgcacacgtctcagacccaatcgtttg

SEQ ID NO: 49140 - DNA, 35 bp, Artificial Sequence
  Synthetic oligonucleotide
tgatccgccaccacgcaggccacccgttgcaccat

SEQ ID NO: 49141 - DNA, 35 bp, Artificial Sequence
  Synthetic oligonucleotide
cccaccctgcctcctctatacaaggcgaacacgct

SEQ ID NO: 49142 - DNA, 35 bp, Artificial Sequence
  Synthetic oligonucleotide
acacccgcttgccctatgaaccgtccactccttgt

SEQ ID NO: 49143 - DNA, 35 bp, Artificial Sequence
  Synthetic oligonucleotide
tccaccgccccctagcctttaaagggctaggcctt

SEQ ID NO: 49144 - DNA, 36 bp, Artificial Sequence
  Synthetic oligonucleotide
gcccccgcagccagcactgacccggttctgctccaa

SEQ ID NO: 49145 - DNA, 36 bp, Artificial Sequence
  Synthetic oligonucleotide
gacctgcctcctaaaatttgcgtcatgcgacctcaa

SEQ ID NO: 49146 - DNA, 36 bp, Artificial Sequence
  Synthetic oligonucleotide
gacggaaaaggtattgggaggaatggtgaaggcgaa

SEQ ID NO: 49147 - DNA, 36 bp, Artificial Sequence
  Synthetic oligonucleotide
gaggtgcaacacaaggcctaacatgatcgccaggaa

SEQ ID NO: 49148 - DNA, 36 bp, Artificial Sequence
  Synthetic oligonucleotide
ttgtccgcgcataattccctcccccccatgcttgaa

SEQ ID NO: 49149 - DNA, 35 bp, Artificial Sequence
  Synthetic oligonucleotide
tgaccaacctcggcaatctgcacttaccatttgaa

SEQ ID NO: 49150 - DNA, 36 bp, Artificial Sequence
  Synthetic oligonucleotide
gaacacacgccccggcgtaccttcgagtgaatacca

SEQ ID NO: 49151 - DNA, 35 bp, Artificial Sequence
  Synthetic oligonucleotide
acccactcgtgattagctgggttccgttcgatcca

SEQ ID NO: 49152 - DNA, 35 bp, Artificial Sequence
  Synthetic oligonucleotide
tctagacagagcaaactatacaccgcgatcctcca

SEQ ID NO: 49153 - DNA, 36 bp, Artificial Sequence
  Synthetic oligonucleotide
gttagccacgggcgggaaaagaagaaggagagatca

SEQ ID NO: 49154 - DNA, 36 bp, Artificial Sequence
  Synthetic oligonucleotide
gattaccgcatctggctcataaccagcacacgctca

SEQ ID NO: 49155 - DNA, 35 bp, Artificial Sequence
  Synthetic oligonucleotide
ttccaacgaccgtttggccaccgaactcgatctca

SEQ ID NO: 49156 - DNA, 37 bp, Artificial Sequence
  Synthetic oligonucleotide
actcccccctcacccgggtcatggactgcattaaaga

SEQ ID NO: 49157 - DNA, 37 bp, Artificial Sequence
  Synthetic oligonucleotide
gcctccctctgtcgcgtagctatcccggtcaccaaga

SEQ ID NO: 49158 - DNA, 37 bp, Artificial Sequence
  Synthetic oligonucleotide
tggggtaggtgggggtagtgggttagcgggttcaaga

SEQ ID NO: 49159 - DNA, 37 bp, Artificial Sequence
  Synthetic oligonucleotide
gaaggggccagggggaggggtggatttctaatataga

SEQ ID NO: 49160 - DNA, 37 bp, Artificial Sequence
  Synthetic oligonucleotide
gagaagagcggaggaaagaatgtggggaatgcaagga

SEQ ID NO: 49161 - DNA, 37 bp, Artificial Sequence
  Synthetic oligonucleotide
agcctcgggagaagggggggggttaggactaaaggga

SEQ ID NO: 49162 - DNA, 37 bp, Artificial Sequence
  Synthetic oligonucleotide
tttgggggggtgaaggtattgggggaattgcgaggga

SEQ ID NO: 49163 - DNA, 37 bp, Artificial Sequence
  Synthetic oligonucleotide
ttgaacacatctcatttggaaatgaaccttctctgga

SEQ ID NO: 49164 - DNA, 35 bp, Artificial Sequence
  Synthetic oligonucleotide
gtcaccctttaggacgttttgaccctgttccctga

SEQ ID NO: 49165 - DNA, 38 bp, Artificial Sequence
  Synthetic oligonucleotide
atcgccgcgtgcgccgggctaatccacacatcctctga

SEQ ID NO: 49166 - DNA, 38 bp, Artificial Sequence
  Synthetic oligonucleotide
atgccatccaccaggcagtttgatgcgtccccgcgtga

SEQ ID NO: 49167 - DNA, 37 bp, Artificial Sequence
  Synthetic oligonucleotide
gcaccacgccacagacaaaccggacatgactacttga

SEQ ID NO: 49168 - DNA, 38 bp, Artificial Sequence
  Synthetic oligonucleotide
tgtatcctcgagtgcgccggagtcacacgtacccttga

SEQ ID NO: 49169 - DNA, 37 bp, Artificial Sequence
  Synthetic oligonucleotide
tgatgcacagtatacaccgcgcccgatcccgccttga

SEQ ID NO: 49170 - DNA, 36 bp, Artificial Sequence
  Synthetic oligonucleotide
tccaggtccgagctctcttagtactccactgcttga

SEQ ID NO: 49171 - DNA, 36 bp, Artificial Sequence
  Synthetic oligonucleotide
gcacattcagccagctatatcctatccacatgttga

SEQ ID NO: 49172 - DNA, 37 bp, Artificial Sequence
  Synthetic oligonucleotide
ttgacaatccgcactcgcgcactccgacccgatttga

SEQ ID NO: 49173 - DNA, 38 bp, Artificial Sequence
  Synthetic oligonucleotide
tgcccatgcgtgcttgtatttttaccatccctatttga

SEQ ID NO: 49174 - DNA, 35 bp, Artificial Sequence
  Synthetic oligonucleotide
gcccatgagcatttctcctttcgtcgagacaggta

SEQ ID NO: 49175 - DNA, 36 bp, Artificial Sequence
  Synthetic oligonucleotide
tacaaagtgtgggaaaggtcggaggaaaggaagtta

SEQ ID NO: 49176 - DNA, 35 bp, Artificial Sequence
  Synthetic oligonucleotide
tccgaacgctagtgcatccggcacttatactttta

SEQ ID NO: 49177 - DNA, 35 bp, Artificial Sequence
  Synthetic oligonucleotide
tgctgaacaggcagggggggggaacgggctatcac

SEQ ID NO: 49178 - DNA, 35 bp, Artificial Sequence
  Synthetic oligonucleotide
actccacaccgacgcctatgtccccttttaggtcc

SEQ ID NO: 49179 - DNA, 35 bp, Artificial Sequence
  Synthetic oligonucleotide
gacatccctatccctgtaaagtacgtgcccggtcc

SEQ ID NO: 49180 - DNA, 35 bp, Artificial Sequence
  Synthetic oligonucleotide
tgctagggagggtggggaggtcacaaggatggcgc

SEQ ID NO: 49181 - DNA, 35 bp, Artificial Sequence
  Synthetic oligonucleotide
agtccggttgtccctccagtttggccacgaatatc

SEQ ID NO: 49182 - DNA, 35 bp, Artificial Sequence
  Synthetic oligonucleotide
taaagtcacatgccccccgtgtaggtcgtgctctc

SEQ ID NO: 49183 - DNA, 35 bp, Artificial Sequence
  Synthetic oligonucleotide
tcgcaacggagggtcaacctgcatgccatccattc

SEQ ID NO: 49184 - DNA, 35 bp, Artificial Sequence
  Synthetic oligonucleotide
gctccacccatgagcattgcgtcaaatcacgcaag

SEQ ID NO: 49185 - DNA, 35 bp, Artificial Sequence
  Synthetic oligonucleotide
ttgccctaactggttccgcgcagtcaccttttccg

SEQ ID NO: 49186 - DNA, 35 bp, Artificial Sequence
  Synthetic oligonucleotide
tagccactggcgggagtgtgggtgtgaattttggg

SEQ ID NO: 49187 - DNA, 35 bp, Artificial Sequence
  Synthetic oligonucleotide
gacctgctcaagactggagggagggttgggcattg

SEQ ID NO: 49188 - DNA, 37 bp, Artificial Sequence
  Synthetic oligonucleotide
gttatagcctcgcccctccgcatctgtgttgcatttg

SEQ ID NO: 49189 - DNA, 35 bp, Artificial Sequence
  Synthetic oligonucleotide
atcatcacgccctctcagacatacgcacacgacat

SEQ ID NO: 49190 - DNA, 35 bp, Artificial Sequence
  Synthetic oligonucleotide
agaccatctgggccccctacgactttcctcacgat

SEQ ID NO: 49191 - DNA, 35 bp, Artificial Sequence
  Synthetic oligonucleotide
acacttacgccgcatctccacatagcagatggtct

SEQ ID NO: 49192 - DNA, 35 bp, Artificial Sequence
  Synthetic oligonucleotide
gcttattccgcccacactgcatgtctttgacctgt

SEQ ID NO: 49193 - DNA, 35 bp, Artificial Sequence
  Synthetic oligonucleotide
atctcgtcgcttccaggcctatcacactgtcgtgt

SEQ ID NO: 49194 - DNA, 35 bp, Artificial Sequence
  Synthetic oligonucleotide
accagcacatttcggtaccactgcgctgcctagtt

SEQ ID NO: 49195 - DNA, 35 bp, Artificial Sequence
  Synthetic oligonucleotide
tacgttcctcgtggctttagttgttctgtccggtt

SEQ ID NO: 49196 - DNA, 35 bp, Artificial Sequence
  Synthetic oligonucleotide
acacaccatgcacacgggtctcgcaagtgtgattt

SEQ ID NO: 49197 - DNA, 36 bp, Artificial Sequence
  Synthetic oligonucleotide
agaccacccccctccgctaggcctgccgtaggtaca

SEQ ID NO: 49198 - DNA, 35 bp, Artificial Sequence
  Synthetic oligonucleotide
gctccctcgcccttgtaactcgagttaccattaca

SEQ ID NO: 49199 - DNA, 36 bp, Artificial Sequence
  Synthetic oligonucleotide
ttatgccagagcactgtcatacacaccttgctacca

SEQ ID NO: 49200 - DNA, 36 bp, Artificial Sequence
  Synthetic oligonucleotide
accgaagccacgggattaccgttcacgacatacgca

SEQ ID NO: 49201 - DNA, 36 bp, Artificial Sequence
  Synthetic oligonucleotide
gtcactcgcgatatagtctaaaccccatgctgttca

SEQ ID NO: 49202 - DNA, 36 bp, Artificial Sequence
  Synthetic oligonucleotide
atggcctcacgggtactatctcgtctttcggtttca

SEQ ID NO: 49203 - DNA, 37 bp, Artificial Sequence
  Synthetic oligonucleotide
aataggtcagaaaagggggggaaccagggagggaaga

SEQ ID NO: 49204 - DNA, 37 bp, Artificial Sequence
  Synthetic oligonucleotide
gaagaggtagagatgagaaggcaaggggtaacacaga

SEQ ID NO: 49205 - DNA, 37 bp, Artificial Sequence
  Synthetic oligonucleotide
gcattcccgccacatcaggtcgcacatcaaccataga

SEQ ID NO: 49206 - DNA, 34 bp, Artificial Sequence
  Synthetic oligonucleotide
aatacgtcccaactctattgtcccatcttctaga

SEQ ID NO: 49207 - DNA, 37 bp, Artificial Sequence
  Synthetic oligonucleotide
gccgatccagccttggactcgaataatcacccaccga

SEQ ID NO: 49208 - DNA, 36 bp, Artificial Sequence
  Synthetic oligonucleotide
atggaggaggggtgtgggttggtactacaggtgcga

SEQ ID NO: 49209 - DNA, 35 bp, Artificial Sequence
  Synthetic oligonucleotide
atcccccaacgctctgttcctgacgaggtaacgga

SEQ ID NO: 49210 - DNA, 37 bp, Artificial Sequence
  Synthetic oligonucleotide
acgggaaccggagggaaaagggcgtagggtatgggga

SEQ ID NO: 49211 - DNA, 38 bp, Artificial Sequence
  Synthetic oligonucleotide
tactcgccccctgattaatctgtaacgcaccaacatga

SEQ ID NO: 49212 - DNA, 38 bp, Artificial Sequence
  Synthetic oligonucleotide
tgaaccccagaacacaccgtccatccctcccgccatga

SEQ ID NO: 49213 - DNA, 37 bp, Artificial Sequence
  Synthetic oligonucleotide
gagctgccacgcgccttcactaccttcccggcactga

SEQ ID NO: 49214 - DNA, 37 bp, Artificial Sequence
  Synthetic oligonucleotide
gcccgctcctgtttccctatacctgcttgaggcctga

SEQ ID NO: 49215 - DNA, 38 bp, Artificial Sequence
  Synthetic oligonucleotide
gaactgcctacctatgtttttgcttttcgccttgctga

SEQ ID NO: 49216 - DNA, 38 bp, Artificial Sequence
  Synthetic oligonucleotide
gtggaggaagccggttgggaggggtcggtagctcgtga

SEQ ID NO: 49217 - DNA, 38 bp, Artificial Sequence
  Synthetic oligonucleotide
accactgccccatagttggccgccactttatatggtga

SEQ ID NO: 49218 - DNA, 38 bp, Artificial Sequence
  Synthetic oligonucleotide
gcacaggtagagtcgaggaggggaaggaatgcaattga

SEQ ID NO: 49219 - DNA, 38 bp, Artificial Sequence
  Synthetic oligonucleotide
gacggtgcgggccgggtgggaagtatccttcgaattga

SEQ ID NO: 49220 - DNA, 38 bp, Artificial Sequence
  Synthetic oligonucleotide
tagcgcagggtacccatccattttcgatcgctccttga

SEQ ID NO: 49221 - DNA, 38 bp, Artificial Sequence
  Synthetic oligonucleotide
gcgctggccaggtccgtttcccgctcaaatgtccttga

SEQ ID NO: 49222 - DNA, 37 bp, Artificial Sequence
  Synthetic oligonucleotide
gagcacgccgcccctgcgcttccacctgacaggttga

SEQ ID NO: 49223 - DNA, 37 bp, Artificial Sequence
  Synthetic oligonucleotide
acacccaaaactgtcctacttgtattcctgcctttga

SEQ ID NO: 49224 - DNA, 36 bp, Artificial Sequence
  Synthetic oligonucleotide
ggaatcagtaggcggagtggggggagcaggctgata

SEQ ID NO: 49225 - DNA, 36 bp, Artificial Sequence
  Synthetic oligonucleotide
tattcgccggtccttggccctacctacgcatgacta

SEQ ID NO: 49226 - DNA, 36 bp, Artificial Sequence
  Synthetic oligonucleotide
gccgtctgaccgcatcttatctgagccttctgccta

SEQ ID NO: 49227 - DNA, 35 bp, Artificial Sequence
  Synthetic oligonucleotide
tctacccgtcgtatccgtttacacccgatcttcta

SEQ ID NO: 49228 - DNA, 36 bp, Artificial Sequence
  Synthetic oligonucleotide
actttgcaccccctccctaggcccctagcttgggta

SEQ ID NO: 49229 - DNA, 36 bp, Artificial Sequence
  Synthetic oligonucleotide
agtactgcggacggtcagaaaactaatgcactgtta

SEQ ID NO: 49230 - DNA, 35 bp, Artificial Sequence
  Synthetic oligonucleotide
gcacttcctggggacaccatcttttgcactccaac

SEQ ID NO: 49231 - DNA, 35 bp, Artificial Sequence
  Synthetic oligonucleotide
ttacgatccttggtccgccacccatccggcgccac

SEQ ID NO: 49232 - DNA, 35 bp, Artificial Sequence
  Synthetic oligonucleotide
gcacagtacacttctgcccagcattttccccggac

SEQ ID NO: 49233 - DNA, 35 bp, Artificial Sequence
  Synthetic oligonucleotide
gtctacggcactccgctacttggagtcttttctac

SEQ ID NO: 49234 - DNA, 35 bp, Artificial Sequence
  Synthetic oligonucleotide
gtacgtcccgtccccagaccctttaaagttgaacc

SEQ ID NO: 49235 - DNA, 35 bp, Artificial Sequence
  Synthetic oligonucleotide
gccaatgtagttgcgttcttccatcccaccgcgcc

SEQ ID NO: 49236 - DNA, 35 bp, Artificial Sequence
  Synthetic oligonucleotide
gagaacctccgaaacttatgtcgctaccctcccgc

SEQ ID NO: 49237 - DNA, 35 bp, Artificial Sequence
  Synthetic oligonucleotide
ttgggggaacgagcagggggggtgagtgagttggc

SEQ ID NO: 49238 - DNA, 35 bp, Artificial Sequence
  Synthetic oligonucleotide
tcccactcctcagtggcttgatcgggtgcaccatc

SEQ ID NO: 49239 - DNA, 35 bp, Artificial Sequence
  Synthetic oligonucleotide
accacgacccggtatacacacgcgttcagctcctc

SEQ ID NO: 49240 - DNA, 35 bp, Artificial Sequence
  Synthetic oligonucleotide
gcaaacccgccggcatcggctgttctctctatgtc

SEQ ID NO: 49241 - DNA, 35 bp, Artificial Sequence
  Synthetic oligonucleotide
gtaccacctgccactgtcttccatgctcgacattc

SEQ ID NO: 49242 - DNA, 35 bp, Artificial Sequence
  Synthetic oligonucleotide
gaaccagcttctcgcccgacctccacctaggtttc

SEQ ID NO: 49243 - DNA, 35 bp, Artificial Sequence
  Synthetic oligonucleotide
agcgggctcccgatggcctcttaccctgtcccaag

SEQ ID NO: 49244 - DNA, 35 bp, Artificial Sequence
  Synthetic oligonucleotide
gagtggtggaggggtggactgcaacgagttaggag

SEQ ID NO: 49245 - DNA, 35 bp, Artificial Sequence
  Synthetic oligonucleotide
aggagggcagggggtaacgggtaggatgtccggag

SEQ ID NO: 49246 - DNA, 35 bp, Artificial Sequence
  Synthetic oligonucleotide
ttcatgtccacatttagtctgttctactttgtacg

SEQ ID NO: 49247 - DNA, 35 bp, Artificial Sequence
  Synthetic oligonucleotide
tcccgctatcgatcacgtctacgcacttaggtccg

SEQ ID NO: 49248 - DNA, 35 bp, Artificial Sequence
  Synthetic oligonucleotide
gtgacacaccggcaacggggcctgaagaaaggggg

SEQ ID NO: 49249 - DNA, 35 bp, Artificial Sequence
  Synthetic oligonucleotide
tggacacccagtccaccctcctccgctggcttcat

SEQ ID NO: 49250 - DNA, 35 bp, Artificial Sequence
  Synthetic oligonucleotide
ggggccactgtctctgctttctatctgcctttgat

SEQ ID NO: 49251 - DNA, 35 bp, Artificial Sequence
  Synthetic oligonucleotide
atcgtcgccgaacctctttgcgttgaataactcct

SEQ ID NO: 49252 - DNA, 35 bp, Artificial Sequence
  Synthetic oligonucleotide
tgtaccgctgcacagtcttcaacgtcaaacccggt

SEQ ID NO: 49253 - DNA, 35 bp, Artificial Sequence
  Synthetic oligonucleotide
ttgtcgtcgcttagcaccccacatgccaatctgtt

SEQ ID NO: 49254 - DNA, 36 bp, Artificial Sequence
  Synthetic oligonucleotide
gaagtgcacgcaccgtgacccacatccgttactgaa

SEQ ID NO: 49255 - DNA, 35 bp, Artificial Sequence
  Synthetic oligonucleotide
accactgcccacgcccggtctacgcccgctaccca

SEQ ID NO: 49256 - DNA, 36 bp, Artificial Sequence
  Synthetic oligonucleotide
gagtgcacttaacgctccacatgattctgttttcca

SEQ ID NO: 49257 - DNA, 36 bp, Artificial Sequence
  Synthetic oligonucleotide
gacctaccgcctgtgagttatctgtacgttttctca

SEQ ID NO: 49258 - DNA, 36 bp, Artificial Sequence
  Synthetic oligonucleotide
aaccaagcttgtgtgaggggtggaggcggggggtca

SEQ ID NO: 49259 - DNA, 36 bp, Artificial Sequence
  Synthetic oligonucleotide
gtcaggaggccgggaaactatggcgacagagcgcga

SEQ ID NO: 49260 - DNA, 37 bp, Artificial Sequence
  Synthetic oligonucleotide
atttccgctacattactgagtcctcgtctctcctcga

SEQ ID NO: 49261 - DNA, 36 bp, Artificial Sequence
  Synthetic oligonucleotide
gaggtagaagaagtgaacgtggatgagcgggaggga

SEQ ID NO: 49262 - DNA, 37 bp, Artificial Sequence
  Synthetic oligonucleotide
gctgagaagccggggggtggttgattgtggtgaggga

SEQ ID NO: 49263 - DNA, 35 bp, Artificial Sequence
  Synthetic oligonucleotide
tagcacggcaatgggatccggtgtggtggaatgga

SEQ ID NO: 49264 - DNA, 37 bp, Artificial Sequence
  Synthetic oligonucleotide
acgcaggggcgggaaggagaacttgggacgtagtgga

SEQ ID NO: 49265 - DNA, 38 bp, Artificial Sequence
  Synthetic oligonucleotide
gccaacccatgcctgtaagcctttcctccaagtaatga

SEQ ID NO: 49266 - DNA, 37 bp, Artificial Sequence
  Synthetic oligonucleotide
atgtagcagcctcgcggaactgatctacctcccctga

SEQ ID NO: 49267 - DNA, 36 bp, Artificial Sequence
  Synthetic oligonucleotide
tacgcggactccccacaatggcttgaagcttcctga

SEQ ID NO: 49268 - DNA, 36 bp, Artificial Sequence
  Synthetic oligonucleotide
acccgatctaaccctgtgcataccgtgatttcctga

SEQ ID NO: 49269 - DNA, 38 bp, Artificial Sequence
  Synthetic oligonucleotide
gcagtaccgcctactcgtgaaccgaccacatccgctga

SEQ ID NO: 49270 - DNA, 38 bp, Artificial Sequence
  Synthetic oligonucleotide
tgcgaaccaccgcagcttccgtaatagcttactgctga

SEQ ID NO: 49271 - DNA, 38 bp, Artificial Sequence
  Synthetic oligonucleotide
atccgtctgtcccgctgccgttttttggatccctctga

SEQ ID NO: 49272 - DNA, 38 bp, Artificial Sequence
  Synthetic oligonucleotide
tagacaaggccgaaaaggtgctaaacgggaatgagtga

SEQ ID NO: 49273 - DNA, 38 bp, Artificial Sequence
  Synthetic oligonucleotide
tcagtggggctgggagggttttgggcaatgccacgtga

SEQ ID NO: 49274 - DNA, 37 bp, Artificial Sequence
  Synthetic oligonucleotide
gatgagtcgggcgtaaaggggtgggcccacggggtga

SEQ ID NO: 49275 - DNA, 38 bp, Artificial Sequence
  Synthetic oligonucleotide
tttgggaagggtacggacggacataaacgggatggtga

SEQ ID NO: 49276 - DNA, 38 bp, Artificial Sequence
  Synthetic oligonucleotide
acccactcgggccttcccgctctctgagtcacctgtga

SEQ ID NO: 49277 - DNA, 38 bp, Artificial Sequence
  Synthetic oligonucleotide
gaggcccttgcccacgtacggtactatgtgccctgtga

SEQ ID NO: 49278 - DNA, 38 bp, Artificial Sequence
  Synthetic oligonucleotide
actgaacgggaatgcgatgggttggggccgggctgtga

SEQ ID NO: 49279 - DNA, 38 bp, Artificial Sequence
  Synthetic oligonucleotide
tcatgatggggaggagggtgggttgcagattgcattga

SEQ ID NO: 49280 - DNA, 38 bp, Artificial Sequence
  Synthetic oligonucleotide
aacacaagtggggggtggaaggctgtgattggccttga

SEQ ID NO: 49281 - DNA, 35 bp, Artificial Sequence
  Synthetic oligonucleotide
tagtcaggggaacggaagcagtctggtggaagcac

SEQ ID NO: 49282 - DNA, 35 bp, Artificial Sequence
  Synthetic oligonucleotide
tgacgacacctaccttctccatggttcccctgcac

SEQ ID NO: 49283 - DNA, 35 bp, Artificial Sequence
  Synthetic oligonucleotide
gatgccacagacctgggaatgctgtacttggtcac

SEQ ID NO: 49284 - DNA, 34 bp, Artificial Sequence
  Synthetic oligonucleotide
gccaactcaatagcgcaattatcgaacggattcc

SEQ ID NO: 49285 - DNA, 35 bp, Artificial Sequence
  Synthetic oligonucleotide
tgccacccggtccagttatctaatcctcttcgcgc

SEQ ID NO: 49286 - DNA, 35 bp, Artificial Sequence
  Synthetic oligonucleotide
tcgtacccgtgagttcttcccccttgcaatatggc

SEQ ID NO: 49287 - DNA, 35 bp, Artificial Sequence
  Synthetic oligonucleotide
tgccttacgccgcaacgatacactgacacatttgc

SEQ ID NO: 49288 - DNA, 35 bp, Artificial Sequence
  Synthetic oligonucleotide
aattgagctcgcgaaatgccactgaaaccttcctc

SEQ ID NO: 49289 - DNA, 35 bp, Artificial Sequence
  Synthetic oligonucleotide
gcaatccctggtgcaagcgagcccttgcctggttc

SEQ ID NO: 49290 - DNA, 35 bp, Artificial Sequence
  Synthetic oligonucleotide
tcgaaggagtggtggagtgggggttaacaagcaag

SEQ ID NO: 49291 - DNA, 35 bp, Artificial Sequence
  Synthetic oligonucleotide
gcaatcctcacataacgttccgccctatctacgag

SEQ ID NO: 49292 - DNA, 35 bp, Artificial Sequence
  Synthetic oligonucleotide
acactgtcgcatgaccgcccaacgttactttatag

SEQ ID NO: 49293 - DNA, 35 bp, Artificial Sequence
  Synthetic oligonucleotide
tagaccgccctaaatctggggtaacccttcgcccg

SEQ ID NO: 49294 - DNA, 35 bp, Artificial Sequence
  Synthetic oligonucleotide
gttgaactcgacgtggcttttctgtatgcatttcg

SEQ ID NO: 49295 - DNA, 35 bp, Artificial Sequence
  Synthetic oligonucleotide
acccgagtctcctcttattgacgccccctctgtgg

SEQ ID NO: 49296 - DNA, 35 bp, Artificial Sequence
  Synthetic oligonucleotide
acaacacccgcagtagctttagcgagcacgccgtg

SEQ ID NO: 49297 - DNA, 35 bp, Artificial Sequence
  Synthetic oligonucleotide
ttgcacacgaggcgcgtaatccctacttgtatcat

SEQ ID NO: 49298 - DNA, 35 bp, Artificial Sequence
  Synthetic oligonucleotide
tgacccttcacagtataccgttcggcttactctat

SEQ ID NO: 49299 - DNA, 35 bp, Artificial Sequence
  Synthetic oligonucleotide
acgatacctttccgccagttacgtggtaacactct

SEQ ID NO: 49300 - DNA, 35 bp, Artificial Sequence
  Synthetic oligonucleotide
tatcctacgtccggcttattgttactcttcaccgt

SEQ ID NO: 49301 - DNA, 34 bp, Artificial Sequence
  Synthetic oligonucleotide
atgccctgcccctgacctccttgtttaccctggt

SEQ ID NO: 49302 - DNA, 35 bp, Artificial Sequence
  Synthetic oligonucleotide
atagggagaaggggcggtaagtgcaggggaatttt

SEQ ID NO: 49303 - DNA, 35 bp, Artificial Sequence
  Synthetic oligonucleotide
gagcgataaggggaaagggtagaacatatgggcaa

SEQ ID NO: 49304 - DNA, 36 bp, Artificial Sequence
  Synthetic oligonucleotide
gatgcacctccacctgctcccctaaccgtccggtaa

SEQ ID NO: 49305 - DNA, 36 bp, Artificial Sequence
  Synthetic oligonucleotide
ttaccatcgccgggcgatagttaactgttacatcca

SEQ ID NO: 49306 - DNA, 37 bp, Artificial Sequence
  Synthetic oligonucleotide
tgccaccctctatacgtcattccggtacgggcaacga

SEQ ID NO: 49307 - DNA, 37 bp, Artificial Sequence
  Synthetic oligonucleotide
tccgcttgtccaatttcgctcccactccgatgaccga

SEQ ID NO: 49308 - DNA, 37 bp, Artificial Sequence
  Synthetic oligonucleotide
attgcccccacgttggtcccgctcgctcctacagcga

SEQ ID NO: 49309 - DNA, 36 bp, Artificial Sequence
  Synthetic oligonucleotide
gaccagggggagccagtgggggagcagttcacgcga

SEQ ID NO: 49310 - DNA, 37 bp, Artificial Sequence
  Synthetic oligonucleotide
acgcctcgcatccaccccattgggtaccgcctctcga

SEQ ID NO: 49311 - DNA, 37 bp, Artificial Sequence
  Synthetic oligonucleotide
agatggacggaaaggactaaaataggacgacggagga

SEQ ID NO: 49312 - DNA, 37 bp, Artificial Sequence
  Synthetic oligonucleotide
gagtggaagcgggagtcgggggaaggttcgcggagga

SEQ ID NO: 49313 - DNA, 37 bp, Artificial Sequence
  Synthetic oligonucleotide
agacgggagggaaacgaattgttcggtggaaagggga

SEQ ID NO: 49314 - DNA, 35 bp, Artificial Sequence
  Synthetic oligonucleotide
ttgaccccgcacgctgtccccccacgctcggtgga

SEQ ID NO: 49315 - DNA, 37 bp, Artificial Sequence
  Synthetic oligonucleotide
gtgggtgggaacggggatgtgtgagggtgttacatga

SEQ ID NO: 49316 - DNA, 38 bp, Artificial Sequence
  Synthetic oligonucleotide
ttcggtccccccacgtacgccattgcgctaccgcatga

SEQ ID NO: 49317 - DNA, 38 bp, Artificial Sequence
  Synthetic oligonucleotide
tgaagagcaccagcgcacgattgcccctctccgcatga

SEQ ID NO: 49318 - DNA, 37 bp, Artificial Sequence
  Synthetic oligonucleotide
tacacctgcctaagtctgcatttcgtcccccctatga

SEQ ID NO: 49319 - DNA, 37 bp, Artificial Sequence
  Synthetic oligonucleotide
aacctacggtcctgttccaaagccgctcatcacctga

SEQ ID NO: 49320 - DNA, 37 bp, Artificial Sequence
  Synthetic oligonucleotide
gaccgtcggaacgttcatccaggcccctgcactctga

SEQ ID NO: 49321 - DNA, 37 bp, Artificial Sequence
  Synthetic oligonucleotide
aagggatgcgatgaggggaacgaaagggcgattgtga

SEQ ID NO: 49322 - DNA, 38 bp, Artificial Sequence
  Synthetic oligonucleotide
gcctgcacgtacgcctcgcaagtcaatttgacacttga

SEQ ID NO: 49323 - DNA, 38 bp, Artificial Sequence
  Synthetic oligonucleotide
gcccgacgcgttcattagttcctggcctacccctttga

SEQ ID NO: 49324 - DNA, 38 bp, Artificial Sequence
  Synthetic oligonucleotide
acctccacccagaaccgagcgacgtaacccccctttga

SEQ ID NO: 49325 - DNA, 38 bp, Artificial Sequence
  Synthetic oligonucleotide
tgtctacgccggtcggcccagcccacttctcattttga

SEQ ID NO: 49326 - DNA, 36 bp, Artificial Sequence
  Synthetic oligonucleotide
tttccacgcactattccccttagagcgatagcaata

SEQ ID NO: 49327 - DNA, 36 bp, Artificial Sequence
  Synthetic oligonucleotide
ttcactggtgcccccccggccctccgccctatcata

SEQ ID NO: 49328 - DNA, 35 bp, Artificial Sequence
  Synthetic oligonucleotide
gtacaccatcactccctacggtaaccgtataacta

SEQ ID NO: 49329 - DNA, 35 bp, Artificial Sequence
  Synthetic oligonucleotide
gcaggctcacttactgccatctatactcctgtcta

SEQ ID NO: 49330 - DNA, 35 bp, Artificial Sequence
  Synthetic oligonucleotide
aaaggggggaacggtagataggcgcaagggctaac

SEQ ID NO: 49331 - DNA, 35 bp, Artificial Sequence
  Synthetic oligonucleotide
gcgcgagcaacgtcgtaccaccctgcccttctaac

SEQ ID NO: 49332 - DNA, 35 bp, Artificial Sequence
  Synthetic oligonucleotide
tcattgccctcttacgagttggtgccctcccacac

SEQ ID NO: 49333 - DNA, 35 bp, Artificial Sequence
  Synthetic oligonucleotide
gtgatgcgcaccgccctcgaaccttcctggtagac

SEQ ID NO: 49334 - DNA, 35 bp, Artificial Sequence
  Synthetic oligonucleotide
atagcgacactgccaaccgtcttgatatatccccc

SEQ ID NO: 49335 - DNA, 35 bp, Artificial Sequence
  Synthetic oligonucleotide
gcatgcacgttgcagggcccacatccgacccctcc

SEQ ID NO: 49336 - DNA, 35 bp, Artificial Sequence
  Synthetic oligonucleotide
gccgttccgccatatgccccaatcgtaagttccgc

SEQ ID NO: 49337 - DNA, 35 bp, Artificial Sequence
  Synthetic oligonucleotide
aacgacctagcaaaaccactgcatacgtgcctcgc

SEQ ID NO: 49338 - DNA, 35 bp, Artificial Sequence
  Synthetic oligonucleotide
tcactcgccgccgtgctccccaaccggtactaatc

SEQ ID NO: 49339 - DNA, 35 bp, Artificial Sequence
  Synthetic oligonucleotide
tacacacctctgttggtgattgctctaccggtctc

SEQ ID NO: 49340 - DNA, 35 bp, Artificial Sequence
  Synthetic oligonucleotide
aacctcaacctcccgcttcgtctttcagcgctaag

SEQ ID NO: 49341 - DNA, 35 bp, Artificial Sequence
  Synthetic oligonucleotide
tgccgactcgccttggccttacatttacacaatcg

SEQ ID NO: 49342 - DNA, 35 bp, Artificial Sequence
  Synthetic oligonucleotide
ttgcccgcccgtgcagggattcataccaccaaaat

SEQ ID NO: 49343 - DNA, 35 bp, Artificial Sequence
  Synthetic oligonucleotide
tgagacggccgccttgcatatgccactaccttgat

SEQ ID NO: 49344 - DNA, 35 bp, Artificial Sequence
  Synthetic oligonucleotide
attgacacaccggcatatgctccatcgcgtcctat

SEQ ID NO: 49345 - DNA, 35 bp, Artificial Sequence
  Synthetic oligonucleotide
gactccctccggactttgtgagaaatgcccctact

SEQ ID NO: 49346 - DNA, 35 bp, Artificial Sequence
  Synthetic oligonucleotide
ttcgccacgccagcgagcctcctcgagcttatcct

SEQ ID NO: 49347 - DNA, 35 bp, Artificial Sequence
  Synthetic oligonucleotide
atgggtcatggccaggctgcaccctattgaactct

SEQ ID NO: 49348 - DNA, 35 bp, Artificial Sequence
  Synthetic oligonucleotide
ccactcctggtcccctcacaaccgatctttacggt

SEQ ID NO: 49349 - DNA, 36 bp, Artificial Sequence
  Synthetic oligonucleotide
ggacctcgtccacaaaaaacaggcacatgtaacaaa

SEQ ID NO: 49350 - DNA, 36 bp, Artificial Sequence
  Synthetic oligonucleotide
atgaggataaacggggataggctggttacagggaaa

SEQ ID NO: 49351 - DNA, 35 bp, Artificial Sequence
  Synthetic oligonucleotide
tctatcactggccacactagaacgtttgtctcgaa

SEQ ID NO: 49352 - DNA, 36 bp, Artificial Sequence
  Synthetic oligonucleotide
tcaggggcacgcgaaccgggaacaaatggctgggaa

SEQ ID NO: 49353 - DNA, 36 bp, Artificial Sequence
  Synthetic oligonucleotide
acacgcgccacgtctgctctaatagtcttgtccaca

SEQ ID NO: 49354 - DNA, 36 bp, Artificial Sequence
  Synthetic oligonucleotide
tcacatgcgggtacttggctcttattgagtttcaca

SEQ ID NO: 49355 - DNA, 36 bp, Artificial Sequence
  Synthetic oligonucleotide
atgcgatatgcagtcccttcaccgcctcgcccccca

SEQ ID NO: 49356 - DNA, 36 bp, Artificial Sequence
  Synthetic oligonucleotide
gacatattcacgtacgtcgttcccactccgcggcca

SEQ ID NO: 49357 - DNA, 36 bp, Artificial Sequence
  Synthetic oligonucleotide
ttcgcacccccggctgatgcccatttcgtacttgca

SEQ ID NO: 49358 - DNA, 37 bp, Artificial Sequence
  Synthetic oligonucleotide
taacaccgctccccttcctttcttgcatgggcaccga

SEQ ID NO: 49359 - DNA, 35 bp, Artificial Sequence
  Synthetic oligonucleotide
tacacttcccatccagggccacaagagcctcccga

SEQ ID NO: 49360 - DNA, 36 bp, Artificial Sequence
  Synthetic oligonucleotide
atgacagggggatggggcggagagaccaggagccga

SEQ ID NO: 49361 - DNA, 37 bp, Artificial Sequence
  Synthetic oligonucleotide
tcaccgcacctgcacattccgaattctgggttatcga

SEQ ID NO: 49362 - DNA, 35 bp, Artificial Sequence
  Synthetic oligonucleotide
ttgggggggccggagggctgggcttacgtacggga

SEQ ID NO: 49363 - DNA, 37 bp, Artificial Sequence
  Synthetic oligonucleotide
acctcgaggctgggtaggttaagggattggggtggga

SEQ ID NO: 49364 - DNA, 37 bp, Artificial Sequence
  Synthetic oligonucleotide
gaccgtgctgccctccacttggggtctctatacatga

SEQ ID NO: 49365 - DNA, 38 bp, Artificial Sequence
  Synthetic oligonucleotide
gtcgcacgctactatgtaccctccccactaccgcatga

SEQ ID NO: 49366 - DNA, 38 bp, Artificial Sequence
  Synthetic oligonucleotide
gtggaaggaggaagggattgagggctgtggtgagatga

SEQ ID NO: 49367 - DNA, 38 bp, Artificial Sequence
  Synthetic oligonucleotide
gtgcgcccacatatctgtcccgctacaccaaattatga

SEQ ID NO: 49368 - DNA, 37 bp, Artificial Sequence
  Synthetic oligonucleotide
tacgactccctaccctcatcttttagagtgtccctga

SEQ ID NO: 49369 - DNA, 37 bp, Artificial Sequence
  Synthetic oligonucleotide
tgcacatccttttcgactcgtactgttgcctcgctga

SEQ ID NO: 49370 - DNA, 38 bp, Artificial Sequence
  Synthetic oligonucleotide
ttgccatgccaccgtgcggcttacaacatatttcgtga

SEQ ID NO: 49371 - DNA, 38 bp, Artificial Sequence
  Synthetic oligonucleotide
tcagctcgccctcgcccggtccccataaacttctgtga

SEQ ID NO: 49372 - DNA, 38 bp, Artificial Sequence
  Synthetic oligonucleotide
aagtgaagagggaaggcggttggataaactgggtgtga

SEQ ID NO: 49373 - DNA, 37 bp, Artificial Sequence
  Synthetic oligonucleotide
tcgcgcccccaccgtctcattcgcggatctattttga

SEQ ID NO: 49374 - DNA, 35 bp, Artificial Sequence
  Synthetic oligonucleotide
tagccacgagggctccggtccacacgaacaatcta

SEQ ID NO: 49375 - DNA, 35 bp, Artificial Sequence
  Synthetic oligonucleotide
atcaagggcaagggaatgagacaaatgtgagagta

SEQ ID NO: 49376 - DNA, 36 bp, Artificial Sequence
  Synthetic oligonucleotide
agaaccgaccactgcttttttttcaacggactagta

SEQ ID NO: 49377 - DNA, 36 bp, Artificial Sequence
  Synthetic oligonucleotide
gtctccgtcccgctacatacatgcactgcatattta

SEQ ID NO: 49378 - DNA, 35 bp, Artificial Sequence
  Synthetic oligonucleotide
actgtccccggctcctgtgtcggttcctaacccac

SEQ ID NO: 49379 - DNA, 35 bp, Artificial Sequence
  Synthetic oligonucleotide
tggatcgtttctgcgcatccatcacctgttcctac

SEQ ID NO: 49380 - DNA, 35 bp, Artificial Sequence
  Synthetic oligonucleotide
tgctacgccccgaagacccgctgaccttcgtaacc

SEQ ID NO: 49381 - DNA, 35 bp, Artificial Sequence
  Synthetic oligonucleotide
attgggccagccaccggaatgcgaactttgtcacc

SEQ ID NO: 49382 - DNA, 35 bp, Artificial Sequence
  Synthetic oligonucleotide
actcacctcggaatcgctcaactaaaactggcccc

SEQ ID NO: 49383 - DNA, 35 bp, Artificial Sequence
  Synthetic oligonucleotide
gaatgcgctcaccaaatgtaccaaattcaccgccc

SEQ ID NO: 49384 - DNA, 35 bp, Artificial Sequence
  Synthetic oligonucleotide
tgatcccgcaaacctctgtcaagccaccgcatccc

SEQ ID NO: 49385 - DNA, 35 bp, Artificial Sequence
  Synthetic oligonucleotide
gacactgtcgcttccgccctcctacagggtcacgc

SEQ ID NO: 49386 - DNA, 35 bp, Artificial Sequence
  Synthetic oligonucleotide
acgatcaccggttccctgatcacgagcttacctgc

SEQ ID NO: 49387 - DNA, 35 bp, Artificial Sequence
  Synthetic oligonucleotide
tccatctcacgtgcctatctactggctcttcactc

SEQ ID NO: 49388 - DNA, 34 bp, Artificial Sequence
  Synthetic oligonucleotide
agcctgacaccactttgtacttaccggaagcctc

SEQ ID NO: 49389 - DNA, 35 bp, Artificial Sequence
  Synthetic oligonucleotide
tacgattgcgtctctaagcgtccctaccacccgtc

SEQ ID NO: 49390 - DNA, 35 bp, Artificial Sequence
  Synthetic oligonucleotide
actccctacgcgctgaagatcactcctctactacg

SEQ ID NO: 49391 - DNA, 35 bp, Artificial Sequence
  Synthetic oligonucleotide
gaccacgagtgcccctcctccgcttacgtcactcg

SEQ ID NO: 49392 - DNA, 35 bp, Artificial Sequence
  Synthetic oligonucleotide
gcgctctagcctattcccacttctgcacatactgg

SEQ ID NO: 49393 - DNA, 35 bp, Artificial Sequence
  Synthetic oligonucleotide
tgttgcatacggttgctcccctccccccttcgcat

SEQ ID NO: 49394 - DNA, 35 bp, Artificial Sequence
  Synthetic oligonucleotide
ttccacgcacgattggggcaatcgggaactcgcct

SEQ ID NO: 49395 - DNA, 35 bp, Artificial Sequence
  Synthetic oligonucleotide
aacgactgataccacaccttcgcctcctcctgggt

SEQ ID NO: 49396 - DNA, 35 bp, Artificial Sequence
  Synthetic oligonucleotide
attgccgtgtctcgacgcccttatgattattttgt

SEQ ID NO: 49397 - DNA, 35 bp, Artificial Sequence
  Synthetic oligonucleotide
ggatgcaatgtcatttctttttttttaggcccttt

SEQ ID NO: 49398 - DNA, 35 bp, Artificial Sequence
  Synthetic oligonucleotide
actcgcacccacgcaaaacttcgggacggtaaaca

SEQ ID NO: 49399 - DNA, 36 bp, Artificial Sequence
  Synthetic oligonucleotide
acctggagcgcctcttgtctcccccaaaacgccaca

SEQ ID NO: 49400 - DNA, 35 bp, Artificial Sequence
  Synthetic oligonucleotide
gcgccaacagcctcgaccgccatcccgccaggaca

SEQ ID NO: 49401 - DNA, 36 bp, Artificial Sequence
  Synthetic oligonucleotide
gaccgatcccccagcaacatgcaactacacgctaca

SEQ ID NO: 49402 - DNA, 36 bp, Artificial Sequence
  Synthetic oligonucleotide
gcatccatgcccaagctcaaccccggccgcacacca

SEQ ID NO: 49403 - DNA, 36 bp, Artificial Sequence
  Synthetic oligonucleotide
gctacgtacctgttgattcggcgtgaacttggccca

SEQ ID NO: 49404 - DNA, 36 bp, Artificial Sequence
  Synthetic oligonucleotide
gctacacccaatttactgtgtccctacgtactccca

SEQ ID NO: 49405 - DNA, 36 bp, Artificial Sequence
  Synthetic oligonucleotide
gctgagcaagcaggggggatcataaagctagggcca

SEQ ID NO: 49406 - DNA, 36 bp, Artificial Sequence
  Synthetic oligonucleotide
gcagggccgcatctttagtacttttcctgttgggca

SEQ ID NO: 49407 - DNA, 36 bp, Artificial Sequence
  Synthetic oligonucleotide
gatgggccctctgttctctgctgtgcagtataatca

SEQ ID NO: 49408 - DNA, 35 bp, Artificial Sequence
  Synthetic oligonucleotide
tgaggaacgactcacttggtcccaacgctgtttca

SEQ ID NO: 49409 - DNA, 35 bp, Artificial Sequence
  Synthetic oligonucleotide
taccgatccgtgttcccgtgctcctgttttccaga

SEQ ID NO: 49410 - DNA, 37 bp, Artificial Sequence
  Synthetic oligonucleotide
gtccactccgaaccctgttaattctagtccgaagaga

SEQ ID NO: 49411 - DNA, 37 bp, Artificial Sequence
  Synthetic oligonucleotide
gaacaggtcgatgcgccatacactaaactccacacga

SEQ ID NO: 49412 - DNA, 37 bp, Artificial Sequence
  Synthetic oligonucleotide
gtccggggcggtgggttacgtgaaagtgggcaaagga

SEQ ID NO: 49413 - DNA, 37 bp, Artificial Sequence
  Synthetic oligonucleotide
gggatcagctcaattggctttacctccaccactcgga

SEQ ID NO: 49414 - DNA, 37 bp, Artificial Sequence
  Synthetic oligonucleotide
ctcgaaccgggaggggtttttggggttgtcccgggga

SEQ ID NO: 49415 - DNA, 37 bp, Artificial Sequence
  Synthetic oligonucleotide
accacaaaccgctattcctgaaggacctcatgctgga

SEQ ID NO: 49416 - DNA, 37 bp, Artificial Sequence
  Synthetic oligonucleotide
gaactgctcctatccggctcatacatctcgttctgga

SEQ ID NO: 49417 - DNA, 38 bp, Artificial Sequence
  Synthetic oligonucleotide
tgtgactgcaacgggtctctgtgaacatccctccctga

SEQ ID NO: 49418 - DNA, 38 bp, Artificial Sequence
  Synthetic oligonucleotide
acatgatctgccgttccaatcccgcttcaccgccgtga

SEQ ID NO: 49419 - DNA, 37 bp, Artificial Sequence
  Synthetic oligonucleotide
aaagtggcacaatggttaacgggtgttgtgggggtga

SEQ ID NO: 49420 - DNA, 38 bp, Artificial Sequence
  Synthetic oligonucleotide
gggaccacgctgaaggttgcaagggagaaggaatgtga

SEQ ID NO: 49421 - DNA, 36 bp, Artificial Sequence
  Synthetic oligonucleotide
aaatggcctccgtacagaccattgctcctcacttga

SEQ ID NO: 49422 - DNA, 38 bp, Artificial Sequence
  Synthetic oligonucleotide
aaccccgcatacccctccccagtctggaatatccttga

SEQ ID NO: 49423 - DNA, 37 bp, Artificial Sequence
  Synthetic oligonucleotide
atggaggctcaaaggagaggggactggaattggttga

SEQ ID NO: 49424 - DNA, 36 bp, Artificial Sequence
  Synthetic oligonucleotide
gctccggagccattccagccccctatgcacgcacta

SEQ ID NO: 49425 - DNA, 35 bp, Artificial Sequence
  Synthetic oligonucleotide
gctccgccccaccggtccaatgcttctccaattta

SEQ ID NO: 49426 - DNA, 36 bp, Artificial Sequence
  Synthetic oligonucleotide
gtagcccgatcactctcgtagattacaccaatttta

SEQ ID NO: 49427 - DNA, 35 bp, Artificial Sequence
  Synthetic oligonucleotide
gacaacgctcgcctccatggaaccacacgctacac

SEQ ID NO: 49428 - DNA, 35 bp, Artificial Sequence
  Synthetic oligonucleotide
gccaccagacccgcaggttaggcacccccttgcac

SEQ ID NO: 49429 - DNA, 35 bp, Artificial Sequence
  Synthetic oligonucleotide
gtggaatgaccggcagtgtttctcttgcacatcac

SEQ ID NO: 49430 - DNA, 36 bp, Artificial Sequence
  Synthetic oligonucleotide
tgtggcaatgcgcctcgccccacatcttcgtatcac

SEQ ID NO: 49431 - DNA, 35 bp, Artificial Sequence
  Synthetic oligonucleotide
aagtcctagcccggctgttcctacctagcggtgcc

SEQ ID NO: 49432 - DNA, 35 bp, Artificial Sequence
  Synthetic oligonucleotide
tccacataacccgcatgaccggagcacttttatcc

SEQ ID NO: 49433 - DNA, 35 bp, Artificial Sequence
  Synthetic oligonucleotide
gggaacatcatcatgcccctgctcatataccctgc

SEQ ID NO: 49434 - DNA, 35 bp, Artificial Sequence
  Synthetic oligonucleotide
aagcatcatccaaatgacgccccctatttcattgc

SEQ ID NO: 49435 - DNA, 35 bp, Artificial Sequence
  Synthetic oligonucleotide
tgactcaccgggtgaaggctgtcgcatatctcatc

SEQ ID NO: 49436 - DNA, 35 bp, Artificial Sequence
  Synthetic oligonucleotide
gcccgttacacacgagtagcttatatccgttcctc

SEQ ID NO: 49437 - DNA, 35 bp, Artificial Sequence
  Synthetic oligonucleotide
gcagtgctatacccctgtctgccttgatctctgtc

SEQ ID NO: 49438 - DNA, 35 bp, Artificial Sequence
  Synthetic oligonucleotide
tgtcacctgtacgcccctgttctgcccctcgcaat

SEQ ID NO: 49439 - DNA, 35 bp, Artificial Sequence
  Synthetic oligonucleotide
atgcgcctgtcccttccgcccggtacggttttcat

SEQ ID NO: 49440 - DNA, 35 bp, Artificial Sequence
  Synthetic oligonucleotide
tgatgtacgggcatcattcactctatgacttcact

SEQ ID NO: 49441 - DNA, 35 bp, Artificial Sequence
  Synthetic oligonucleotide
tacgcctgtcccgcctggaggttttccaaccgact

SEQ ID NO: 49442 - DNA, 35 bp, Artificial Sequence
  Synthetic oligonucleotide
gatggagtgcgggtagatgacagggaactggagct

SEQ ID NO: 49443 - DNA, 35 bp, Artificial Sequence
  Synthetic oligonucleotide
gacacaacgcattttttagcaacctatggatctgt

SEQ ID NO: 49444 - DNA, 35 bp, Artificial Sequence
  Synthetic oligonucleotide
ttagactcagccggcaacgaacgctacacataatt

SEQ ID NO: 49445 - DNA, 35 bp, Artificial Sequence
  Synthetic oligonucleotide
acagtcggcgcatactatccacacttctccgggtt

SEQ ID NO: 49446 - DNA, 35 bp, Artificial Sequence
  Synthetic oligonucleotide
gttgacctgcggtaccaagactcaattatgccttt

SEQ ID NO: 49447 - DNA, 35 bp, Artificial Sequence
  Synthetic oligonucleotide
gttcccttccaatatcctgcatcattgcactgttt

SEQ ID NO: 49448 - DNA, 35 bp, Artificial Sequence
  Synthetic oligonucleotide
tctagcggagagtctcttaccgatcgctcactttt

SEQ ID NO: 49449 - DNA, 35 bp, Artificial Sequence
  Synthetic oligonucleotide
gttgagtagcagatcagcattagggctcggaaaaa

SEQ ID NO: 49450 - DNA, 36 bp, Artificial Sequence
  Synthetic oligonucleotide
attgaccgagggggggctaaattagggaacaatgaa

SEQ ID NO: 49451 - DNA, 35 bp, Artificial Sequence
  Synthetic oligonucleotide
tatgtgccacgctgtcctgagctggcctttcctaa

SEQ ID NO: 49452 - DNA, 36 bp, Artificial Sequence
  Synthetic oligonucleotide
taactgccacccgtttaccgcacgatccactcagca

SEQ ID NO: 49453 - DNA, 36 bp, Artificial Sequence
  Synthetic oligonucleotide
tacccacactcaaccaggctgccatacaatcattca

SEQ ID NO: 49454 - DNA, 36 bp, Artificial Sequence
  Synthetic oligonucleotide
gttcatcccactcacccagctgtcccacggatttca

SEQ ID NO: 49455 - DNA, 37 bp, Artificial Sequence
  Synthetic oligonucleotide
tgtcgagaggggtgggttatattggtaatggcgaaga

SEQ ID NO: 49456 - DNA, 37 bp, Artificial Sequence
  Synthetic oligonucleotide
ttcagccgggaaaatgagggacggggaaactctaaga

SEQ ID NO: 49457 - DNA, 37 bp, Artificial Sequence
  Synthetic oligonucleotide
gagccagtaccactgttcttgacgcccaactcatcga

SEQ ID NO: 49458 - DNA, 37 bp, Artificial Sequence
  Synthetic oligonucleotide
atggaagaggacggaaagggtgatgcgttaaggggga

SEQ ID NO: 49459 - DNA, 36 bp, Artificial Sequence
  Synthetic oligonucleotide
atacatcacaccctttgtctaccaggcttccttgga

SEQ ID NO: 49460 - DNA, 37 bp, Artificial Sequence
  Synthetic oligonucleotide
ggcctgggcccacccaggtatgaccatcaacacatga

SEQ ID NO: 49461 - DNA, 38 bp, Artificial Sequence
  Synthetic oligonucleotide
acgaacgcaagggaacgggaggagcacgcatatgatga

SEQ ID NO: 49462 - DNA, 38 bp, Artificial Sequence
  Synthetic oligonucleotide
actgcaccgcccgctctgccctcacatcaatagtatga

SEQ ID NO: 49463 - DNA, 38 bp, Artificial Sequence
  Synthetic oligonucleotide
gcattccaccgcaccacgtgcaacatgtcattaactga

SEQ ID NO: 49464 - DNA, 38 bp, Artificial Sequence
  Synthetic oligonucleotide
actagccgcctcgcaccccaacgtggcaccctacctga

SEQ ID NO: 49465 - DNA, 38 bp, Artificial Sequence
  Synthetic oligonucleotide
gagtgacagcatatgcagccgttcttttccacctctga

SEQ ID NO: 49466 - DNA, 38 bp, Artificial Sequence
  Synthetic oligonucleotide
gcccgccgctgacgtctaactctggttcgaattagtga

SEQ ID NO: 49467 - DNA, 37 bp, Artificial Sequence
  Synthetic oligonucleotide
gtctgtcccaccgcccacttcgaccattctcttgtga

SEQ ID NO: 49468 - DNA, 38 bp, Artificial Sequence
  Synthetic oligonucleotide
gtgtgcacctccttgtacttttgacgtaccgtccttga

SEQ ID NO: 49469 - DNA, 37 bp, Artificial Sequence
  Synthetic oligonucleotide
gacgatcccgactgcactgcacgccgctccttcttga

SEQ ID NO: 49470 - DNA, 38 bp, Artificial Sequence
  Synthetic oligonucleotide
gatccggccacactctctgcattggaattcaaatttga

SEQ ID NO: 49471 - DNA, 36 bp, Artificial Sequence
  Synthetic oligonucleotide
gcaagggacgccgggagataggtggggcaggggata

SEQ ID NO: 49472 - DNA, 35 bp, Artificial Sequence
  Synthetic oligonucleotide
gtgcgtcacccgcgcgttcaagttcgttgtcacta

SEQ ID NO: 49473 - DNA, 36 bp, Artificial Sequence
  Synthetic oligonucleotide
ttcgcaacatacatacgctcatcacacgggtgacta

SEQ ID NO: 49474 - DNA, 36 bp, Artificial Sequence
  Synthetic oligonucleotide
aatgcattccgcccgcttggatgatcgattctgcta

SEQ ID NO: 49475 - DNA, 36 bp, Artificial Sequence
  Synthetic oligonucleotide
tgttcttccgcgcactgttccggtctttctttatta

SEQ ID NO: 49476 - DNA, 35 bp, Artificial Sequence
  Synthetic oligonucleotide
tactgccccactgaccgcctggtactataccgaac

SEQ ID NO: 49477 - DNA, 35 bp, Artificial Sequence
  Synthetic oligonucleotide
ttatacagggctcaatgaacgatcgcgctctccac

SEQ ID NO: 49478 - DNA, 35 bp, Artificial Sequence
  Synthetic oligonucleotide
gaccacccggtttctgagcctactcttttactcac

SEQ ID NO: 49479 - DNA, 35 bp, Artificial Sequence
  Synthetic oligonucleotide
tccccccccagctgttcgggcagaacctgcaggac

SEQ ID NO: 49480 - DNA, 35 bp, Artificial Sequence
  Synthetic oligonucleotide
gacgaggccggcacccggtaacctctctgcaaccc

SEQ ID NO: 49481 - DNA, 35 bp, Artificial Sequence
  Synthetic oligonucleotide
tctagccgttctaggccacagggcaatcccacccc

SEQ ID NO: 49482 - DNA, 35 bp, Artificial Sequence
  Synthetic oligonucleotide
actacgcacccggacaccattacctcagacggagc

SEQ ID NO: 49483 - DNA, 35 bp, Artificial Sequence
  Synthetic oligonucleotide
atacttcacattcgctgcaccatccgagcgttcgc

SEQ ID NO: 49484 - DNA, 35 bp, Artificial Sequence
  Synthetic oligonucleotide
atggaacgcgcgtagcttattactactgttgcatc

SEQ ID NO: 49485 - DNA, 35 bp, Artificial Sequence
  Synthetic oligonucleotide
aatgcgagtcgccatagaaccgcacgtacgctctc

SEQ ID NO: 49486 - DNA, 35 bp, Artificial Sequence
  Synthetic oligonucleotide
tcgtcctccctgttgcgtgtgagcctcacctcgtc

SEQ ID NO: 49487 - DNA, 35 bp, Artificial Sequence
  Synthetic oligonucleotide
tatagtgatcagggcaaaatggagcggggtgggag

SEQ ID NO: 49488 - DNA, 35 bp, Artificial Sequence
  Synthetic oligonucleotide
tacgcaccgtagcgctccaccttcccccgacgacg

SEQ ID NO: 49489 - DNA, 35 bp, Artificial Sequence
  Synthetic oligonucleotide
tagatcccttgtgctctgccgcccagtttctctcg

SEQ ID NO: 49490 - DNA, 35 bp, Artificial Sequence
  Synthetic oligonucleotide
ggtaacaatcggattgatcatcaaggggtaggggg

SEQ ID NO: 49491 - DNA, 35 bp, Artificial Sequence
  Synthetic oligonucleotide
gtagtggggaaggctgcaggagcaaggattctggg

SEQ ID NO: 49492 - DNA, 35 bp, Artificial Sequence
  Synthetic oligonucleotide
tacgactgcccgtatcgtttgaacttccgaacttg

SEQ ID NO: 49493 - DNA, 35 bp, Artificial Sequence
  Synthetic oligonucleotide
gaccatgtacgaactactcgtgaaagttttgcact

SEQ ID NO: 49494 - DNA, 35 bp, Artificial Sequence
  Synthetic oligonucleotide
ttgcagccgcattattgcttgttatccctcgtact

SEQ ID NO: 49495 - DNA, 35 bp, Artificial Sequence
  Synthetic oligonucleotide
accatcccgacaaggagtggaatagcctctaccct

SEQ ID NO: 49496 - DNA, 35 bp, Artificial Sequence
  Synthetic oligonucleotide
tctgcggaaaccacaccacatacagcaagccgcct

SEQ ID NO: 49497 - DNA, 35 bp, Artificial Sequence
  Synthetic oligonucleotide
gccatagctctgcggccgtaaagcgccctcgtcct

SEQ ID NO: 49498 - DNA, 35 bp, Artificial Sequence
  Synthetic oligonucleotide
actgcctcgaacgctttttaagtaccaaaccctct

SEQ ID NO: 49499 - DNA, 35 bp, Artificial Sequence
  Synthetic oligonucleotide
gtgaggcaccccggacctttacttctggctcttct

SEQ ID NO: 49500 - DNA, 35 bp, Artificial Sequence
  Synthetic oligonucleotide
tgctacgctgaagggcacgttcccccatatctatt

SEQ ID NO: 49501 - DNA, 36 bp, Artificial Sequence
  Synthetic oligonucleotide
gaactgcaggtaggggagagcaccgggcggaaaaaa

SEQ ID NO: 49502 - DNA, 36 bp, Artificial Sequence
  Synthetic oligonucleotide
tgtaccatcgacgcgtctctttcgggcaacttgaaa

SEQ ID NO: 49503 - DNA, 36 bp, Artificial Sequence
  Synthetic oligonucleotide
actccgcgccttcactgcttctctgatctcacggaa

SEQ ID NO: 49504 - DNA, 35 bp, Artificial Sequence
  Synthetic oligonucleotide
gcacggtgattcctacgttcgagcgcactccacca

SEQ ID NO: 49505 - DNA, 36 bp, Artificial Sequence
  Synthetic oligonucleotide
agacgacgcggatccaatggatctttcttgtcacca

SEQ ID NO: 49506 - DNA, 35 bp, Artificial Sequence
  Synthetic oligonucleotide
accccgaagctacgatctgcattgccgccgtacca

SEQ ID NO: 49507 - DNA, 36 bp, Artificial Sequence
  Synthetic oligonucleotide
tccctaccacagttggtcacaataggggggtaccca

SEQ ID NO: 49508 - DNA, 36 bp, Artificial Sequence
  Synthetic oligonucleotide
acctttctgccacactgtcatccatatcttcaggca

SEQ ID NO: 49509 - DNA, 36 bp, Artificial Sequence
  Synthetic oligonucleotide
gatgcgcgtaacaggaatacggggggcatgaagtca

SEQ ID NO: 49510 - DNA, 35 bp, Artificial Sequence
  Synthetic oligonucleotide
acatgggtgggggggtaccttggctatccgggtca

SEQ ID NO: 49511 - DNA, 36 bp, Artificial Sequence
  Synthetic oligonucleotide
gcccgatctgcatccttatttgttcaccgtgtgtca

SEQ ID NO: 49512 - DNA, 36 bp, Artificial Sequence
  Synthetic oligonucleotide
gttgcacatcagcgcctgtgattttcatatctttca

SEQ ID NO: 49513 - DNA, 37 bp, Artificial Sequence
  Synthetic oligonucleotide
gatggaggaagggtgggaaggatgtttcttgtttaga

SEQ ID NO: 49514 - DNA, 36 bp, Artificial Sequence
  Synthetic oligonucleotide
cagcctatccgcccgcaatacactttagttggacga

SEQ ID NO: 49515 - DNA, 37 bp, Artificial Sequence
  Synthetic oligonucleotide
gatcaccaattgttacgaatacggcctttatttccga

SEQ ID NO: 49516 - DNA, 37 bp, Artificial Sequence
  Synthetic oligonucleotide
tgtgccacctcttatctataaacacaccttccgagga

SEQ ID NO: 49517 - DNA, 36 bp, Artificial Sequence
  Synthetic oligonucleotide
gaaacgaacgattcgttctagagggaacatggagga

SEQ ID NO: 49518 - DNA, 36 bp, Artificial Sequence
  Synthetic oligonucleotide
tcagaccaggtactaccgaatacccctccccacgga

SEQ ID NO: 49519 - DNA, 37 bp, Artificial Sequence
  Synthetic oligonucleotide
accgcctggaacgtaacattgccgcaacactcccgga

SEQ ID NO: 49520 - DNA, 37 bp, Artificial Sequence
  Synthetic oligonucleotide
taggtaacgggggaaaatagggggcaaattcaaggga

SEQ ID NO: 49521 - DNA, 37 bp, Artificial Sequence
  Synthetic oligonucleotide
gtttaagggtgagcggtgggaggaattgggctttgga

SEQ ID NO: 49522 - DNA, 36 bp, Artificial Sequence
  Synthetic oligonucleotide
tgtccccacaccatggattaattttggctcccatga

SEQ ID NO: 49523 - DNA, 37 bp, Artificial Sequence
  Synthetic oligonucleotide
gcaccttactcccctccggacgccccacaggctatga

SEQ ID NO: 49524 - DNA, 38 bp, Artificial Sequence
  Synthetic oligonucleotide
agtacgagctctccatcactgactctgaaacagtatga

SEQ ID NO: 49525 - DNA, 38 bp, Artificial Sequence
  Synthetic oligonucleotide
ttggggcgcggccaggccgactcacctttcctacctga

SEQ ID NO: 49526 - DNA, 38 bp, Artificial Sequence
  Synthetic oligonucleotide
tacggtcgccgcacaatgttgggccatccccccgctga

SEQ ID NO: 49527 - DNA, 38 bp, Artificial Sequence
  Synthetic oligonucleotide
ggactcccgccgaccaccaacttctaccgcctcggtga

SEQ ID NO: 49528 - DNA, 38 bp, Artificial Sequence
  Synthetic oligonucleotide
aacaccagtctagacgatgcaatctcgtccacacttga

SEQ ID NO: 49529 - DNA, 38 bp, Artificial Sequence
  Synthetic oligonucleotide
atccacctgagacctataggtcccgcgcatttctttga

SEQ ID NO: 49530 - DNA, 36 bp, Artificial Sequence
  Synthetic oligonucleotide
agcggtcagtcaccgcgctgtcccataatgtcccta

SEQ ID NO: 49531 - DNA, 36 bp, Artificial Sequence
  Synthetic oligonucleotide
tccacatctgaatccgcttccgtccttcaatagcta

SEQ ID NO: 49532 - DNA, 36 bp, Artificial Sequence
  Synthetic oligonucleotide
tgttgcaccatctgacgcgccaatcgacctactcta

SEQ ID NO: 49533 - DNA, 36 bp, Artificial Sequence
  Synthetic oligonucleotide
tgtatcaaccttcacacgtcacataacaccgctgta

SEQ ID NO: 49534 - DNA, 36 bp, Artificial Sequence
  Synthetic oligonucleotide
tttgacgcatggtgacgaacgtcacgtactacctta

SEQ ID NO: 49535 - DNA, 35 bp, Artificial Sequence
  Synthetic oligonucleotide
gcttcgcacctgagaagccttccccccttgcctta

SEQ ID NO: 49536 - DNA, 35 bp, Artificial Sequence
  Synthetic oligonucleotide
gacgatctgctttcccacggtttccttcatgctta

SEQ ID NO: 49537 - DNA, 35 bp, Artificial Sequence
  Synthetic oligonucleotide
tatgacaactggcagttaaaatccgtcgcactaac

SEQ ID NO: 49538 - DNA, 35 bp, Artificial Sequence
  Synthetic oligonucleotide
ggaggtcgcgccctgcctcgattactagtcaccac

SEQ ID NO: 49539 - DNA, 35 bp, Artificial Sequence
  Synthetic oligonucleotide
atcaacctgtcgcgtatcaaaacacactgttccac

SEQ ID NO: 49540 - DNA, 35 bp, Artificial Sequence
  Synthetic oligonucleotide
aacgcgcgcggcctcacattccctcgtccttctac

SEQ ID NO: 49541 - DNA, 36 bp, Artificial Sequence
  Synthetic oligonucleotide
ggtgaaccaccccccgtcatgtcctgacccttcacc

SEQ ID NO: 49542 - DNA, 35 bp, Artificial Sequence
  Synthetic oligonucleotide
gtgcccatatcctgccaagctctttttcgtcttgc

SEQ ID NO: 49543 - DNA, 35 bp, Artificial Sequence
  Synthetic oligonucleotide
gctgctttcacggtcgtcgatcgcttttgcacctc

SEQ ID NO: 49544 - DNA, 35 bp, Artificial Sequence
  Synthetic oligonucleotide
tactatctcgtacctccgccgtccacttacggttc

SEQ ID NO: 49545 - DNA, 35 bp, Artificial Sequence
  Synthetic oligonucleotide
atctcacaggagcaccagcgagtactacatctttc

SEQ ID NO: 49546 - DNA, 35 bp, Artificial Sequence
  Synthetic oligonucleotide
tccactaccgaagtctgtttttttcaccctccgag

SEQ ID NO: 49547 - DNA, 35 bp, Artificial Sequence
  Synthetic oligonucleotide
actggggacaagtacgtgctgcatttggtcgaccg

SEQ ID NO: 49548 - DNA, 35 bp, Artificial Sequence
  Synthetic oligonucleotide
aggtgacctatgttgcatccctccgtgtcttcccg

SEQ ID NO: 49549 - DNA, 35 bp, Artificial Sequence
  Synthetic oligonucleotide
aaccggtgtcacctttgccttcactacccctggcg

SEQ ID NO: 49550 - DNA, 35 bp, Artificial Sequence
  Synthetic oligonucleotide
tggggtatgcgggggtggaaggaatgctgcagagg

SEQ ID NO: 49551 - DNA, 35 bp, Artificial Sequence
  Synthetic oligonucleotide
tgagtcgtcaggataaacaaagtggggaggtgggg

SEQ ID NO: 49552 - DNA, 35 bp, Artificial Sequence
  Synthetic oligonucleotide
aacgcgacaatcgtcaccttccgctatacaaatgg

SEQ ID NO: 49553 - DNA, 35 bp, Artificial Sequence
  Synthetic oligonucleotide
tcctaccatccgctcaccatccgacactgttcgtg

SEQ ID NO: 49554 - DNA, 35 bp, Artificial Sequence
  Synthetic oligonucleotide
aacgatgtgtaattacgcgcccccgcttgctccat

SEQ ID NO: 49555 - DNA, 35 bp, Artificial Sequence
  Synthetic oligonucleotide
tgctacccgcccctcgctccgttgtttaataatct

SEQ ID NO: 49556 - DNA, 36 bp, Artificial Sequence
  Synthetic oligonucleotide
actccctcgttgaataatacattgctggccttcgaa

SEQ ID NO: 49557 - DNA, 35 bp, Artificial Sequence
  Synthetic oligonucleotide
atagcgcccccacctttgggctaccaatacaccca

SEQ ID NO: 49558 - DNA, 36 bp, Artificial Sequence
  Synthetic oligonucleotide
atgcgtgcaatggctctatctgtcgtcccagcatca

SEQ ID NO: 49559 - DNA, 36 bp, Artificial Sequence
  Synthetic oligonucleotide
atcgcctaccttccttcggttagatacgttctctca

SEQ ID NO: 49560 - DNA, 37 bp, Artificial Sequence
  Synthetic oligonucleotide
tatgcggagcggtgtatgcagtgggagcatgggcaga

SEQ ID NO: 49561 - DNA, 37 bp, Artificial Sequence
  Synthetic oligonucleotide
tagtgtggaggggccgggagtcggtaagggacagaga

SEQ ID NO: 49562 - DNA, 37 bp, Artificial Sequence
  Synthetic oligonucleotide
agcctcgctcggcttgcacgtgtctctctctctccga

SEQ ID NO: 49563 - DNA, 36 bp, Artificial Sequence
  Synthetic oligonucleotide
gttgggagtgaaagaacgggtggtcgagcattagga

SEQ ID NO: 49564 - DNA, 37 bp, Artificial Sequence
  Synthetic oligonucleotide
tgtacggtggaaacgcgagtaagcaagggcaacggga

SEQ ID NO: 49565 - DNA, 37 bp, Artificial Sequence
  Synthetic oligonucleotide
aacaaggggtgactgaggttgtggaagcgggctggga

SEQ ID NO: 49566 - DNA, 37 bp, Artificial Sequence
  Synthetic oligonucleotide
accgagggtgtcgctattcttttatcgtgctctggga

SEQ ID NO: 49567 - DNA, 38 bp, Artificial Sequence
  Synthetic oligonucleotide
tcatacgaggaggagggggtacgatagaatgctaatga

SEQ ID NO: 49568 - DNA, 38 bp, Artificial Sequence
  Synthetic oligonucleotide
ggaccacattccctgccacgttcattgaccagccatga

SEQ ID NO: 49569 - DNA, 37 bp, Artificial Sequence
  Synthetic oligonucleotide
agaacccagctgcaccctggaaatcctcggaccctga

SEQ ID NO: 49570 - DNA, 38 bp, Artificial Sequence
  Synthetic oligonucleotide
tcagacggtgtccctgcgcaaaggagcctcccccctga

SEQ ID NO: 49571 - DNA, 38 bp, Artificial Sequence
  Synthetic oligonucleotide
gtcgaggtctgtgcgttcatatgcgccttccctcctga

SEQ ID NO: 49572 - DNA, 38 bp, Artificial Sequence
  Synthetic oligonucleotide
gatggagtagtcggcgggagcttgggagacgtgagtga

SEQ ID NO: 49573 - DNA, 38 bp, Artificial Sequence
  Synthetic oligonucleotide
tagtcgtcggtcgcccgttcaccaccccgctttagtga

SEQ ID NO: 49574 - DNA, 38 bp, Artificial Sequence
  Synthetic oligonucleotide
actgttggtaggggggtagaggctgagtggtagggtga

SEQ ID NO: 49575 - DNA, 38 bp, Artificial Sequence
  Synthetic oligonucleotide
tcacaccatagccatgcgcgacagagacccatttgtga

SEQ ID NO: 49576 - DNA, 37 bp, Artificial Sequence
  Synthetic oligonucleotide
gcgacccggtccaacaatgtctgttcctcctccttga

SEQ ID NO: 49577 - DNA, 37 bp, Artificial Sequence
  Synthetic oligonucleotide
acagccacctacgtcttcaccgccaagtcccctttga

SEQ ID NO: 49578 - DNA, 38 bp, Artificial Sequence
  Synthetic oligonucleotide
gctgggaggtgggagggatccgggccttgtgattttga

SEQ ID NO: 49579 - DNA, 36 bp, Artificial Sequence
  Synthetic oligonucleotide
atgcaggaagggggaggaggggtagcatatggtata

SEQ ID NO: 49580 - DNA, 37 bp, Artificial Sequence
  Synthetic oligonucleotide
gacgggccacccccgccatgattccttttttcgacta

SEQ ID NO: 49581 - DNA, 36 bp, Artificial Sequence
  Synthetic oligonucleotide
gcacgtcctccggtttctttcttacacttcacgcta

SEQ ID NO: 49582 - DNA, 36 bp, Artificial Sequence
  Synthetic oligonucleotide
tccaccttcgacgctattcttgcggtttgtccatta

SEQ ID NO: 49583 - DNA, 35 bp, Artificial Sequence
  Synthetic oligonucleotide
tcgccttcgcgcttcacttctctcgtactgcctta

SEQ ID NO: 49584 - DNA, 35 bp, Artificial Sequence
  Synthetic oligonucleotide
gtggagggcgggggttggcccagtgagcacgctta

SEQ ID NO: 49585 - DNA, 35 bp, Artificial Sequence
  Synthetic oligonucleotide
agcacctgtgtcctggcacattgcgctgcctttac

SEQ ID NO: 49586 - DNA, 35 bp, Artificial Sequence
  Synthetic oligonucleotide
tcgctccttcacacggaccgcaccacattgtgacc

SEQ ID NO: 49587 - DNA, 35 bp, Artificial Sequence
  Synthetic oligonucleotide
ggcctcaccgtgccgtacaacatactcccgtgccc

SEQ ID NO: 49588 - DNA, 35 bp, Artificial Sequence
  Synthetic oligonucleotide
atatccgccccaccgggcatctggtcctgtatccc

SEQ ID NO: 49589 - DNA, 35 bp, Artificial Sequence
  Synthetic oligonucleotide
gtaggcactgaaacctatccaccccgacccgctcc

SEQ ID NO: 49590 - DNA, 35 bp, Artificial Sequence
  Synthetic oligonucleotide
gagcgggcttccgtcccattgcacctcctttcagc

SEQ ID NO: 49591 - DNA, 35 bp, Artificial Sequence
  Synthetic oligonucleotide
tctccgccgaacgaaatatttgatgcaccccgcgc

SEQ ID NO: 49592 - DNA, 35 bp, Artificial Sequence
  Synthetic oligonucleotide
gcgcctacccacctgtctttaaaacggcgaatatc

SEQ ID NO: 49593 - DNA, 35 bp, Artificial Sequence
  Synthetic oligonucleotide
gagaggtccacccctggcatcaaggactacttgtc

SEQ ID NO: 49594 - DNA, 34 bp, Artificial Sequence
  Synthetic oligonucleotide
acctaccctcgccccatgctatgagccccacgag

SEQ ID NO: 49595 - DNA, 35 bp, Artificial Sequence
  Synthetic oligonucleotide
tgctgcccccccaagcataccaacaggaccctgag

SEQ ID NO: 49596 - DNA, 35 bp, Artificial Sequence
  Synthetic oligonucleotide
gatcgccgactttgtaaatccacctatttttcgcg

SEQ ID NO: 49597 - DNA, 35 bp, Artificial Sequence
  Synthetic oligonucleotide
taagccctcaggcctgcattctgccgctatcttcg

SEQ ID NO: 49598 - DNA, 34 bp, Artificial Sequence
  Synthetic oligonucleotide
agctggcaaaggaacgggggtcgacgagagaggg

SEQ ID NO: 49599 - DNA, 35 bp, Artificial Sequence
  Synthetic oligonucleotide
ttgagtgcgggagaggaaggggggagtcttatctg

SEQ ID NO: 49600 - DNA, 35 bp, Artificial Sequence
  Synthetic oligonucleotide
ttgaccatagccacagagttatttcacctctcttg

SEQ ID NO: 49601 - DNA, 35 bp, Artificial Sequence
  Synthetic oligonucleotide
atcgggagtcgccgacacacatcctatcactctat

SEQ ID NO: 49602 - DNA, 35 bp, Artificial Sequence
  Synthetic oligonucleotide
acatcccagatcacactattaggatcattccaact

SEQ ID NO: 49603 - DNA, 35 bp, Artificial Sequence
  Synthetic oligonucleotide
acatcatgtcgttgctagcccaatgcacgtcgact

SEQ ID NO: 49604 - DNA, 35 bp, Artificial Sequence
  Synthetic oligonucleotide
tacgacgagacgcgtgccgttagctggtgaagtct

SEQ ID NO: 49605 - DNA, 35 bp, Artificial Sequence
  Synthetic oligonucleotide
gtcagaccggaatgctagtgcaggtgggagggagt

SEQ ID NO: 49606 - DNA, 35 bp, Artificial Sequence
  Synthetic oligonucleotide
ggacaaggggagaggaggatgagatggtgagtggt

SEQ ID NO: 49607 - DNA, 35 bp, Artificial Sequence
  Synthetic oligonucleotide
tccacgctcagccattaatgttcaatagctgcctt

SEQ ID NO: 49608 - DNA, 36 bp, Artificial Sequence
  Synthetic oligonucleotide
gaggacattcctcctttcattctagtgcaccttctt

SEQ ID NO: 49609 - DNA, 35 bp, Artificial Sequence
  Synthetic oligonucleotide
gcgctagcttctgggcgtcctgcctctcctcattt

SEQ ID NO: 49610 - DNA, 35 bp, Artificial Sequence
  Synthetic oligonucleotide
agaatgtatcatcgcccgccgcttcatctgccttt

SEQ ID NO: 49611 - DNA, 35 bp, Artificial Sequence
  Synthetic oligonucleotide
gatacgcacatctactggagttattgccattgttt

SEQ ID NO: 49612 - DNA, 35 bp, Artificial Sequence
  Synthetic oligonucleotide
tcatacaagctcacgatccgctcatgaacccaaaa

SEQ ID NO: 49613 - DNA, 36 bp, Artificial Sequence
  Synthetic oligonucleotide
gatgaacacataggcgggaaagagtgagggggaaaa

SEQ ID NO: 49614 - DNA, 36 bp, Artificial Sequence
  Synthetic oligonucleotide
ttcgaggccatatggtcgcctgctcacctctctcaa

SEQ ID NO: 49615 - DNA, 36 bp, Artificial Sequence
  Synthetic oligonucleotide
gaatcgcgctgcacgttttcgatcctccatctcgaa

SEQ ID NO: 49616 - DNA, 36 bp, Artificial Sequence
  Synthetic oligonucleotide
gtgggattagggctcggtggagtaggggcgcgtgaa

SEQ ID NO: 49617 - DNA, 36 bp, Artificial Sequence
  Synthetic oligonucleotide
attcgccctcggctgcctttaaacacgttcgttgaa

SEQ ID NO: 49618 - DNA, 35 bp, Artificial Sequence
  Synthetic oligonucleotide
acctacgtcccaatctgcgaactgacctataccca

SEQ ID NO: 49619 - DNA, 35 bp, Artificial Sequence
  Synthetic oligonucleotide
agacggtcgtggcggggagagagggaagacacgca

SEQ ID NO: 49620 - DNA, 36 bp, Artificial Sequence
  Synthetic oligonucleotide
atcatcccgcaattccaggacctgttgtcatttgca

SEQ ID NO: 49621 - DNA, 35 bp, Artificial Sequence
  Synthetic oligonucleotide
ttctcaacccgatgcgttgcaccgagccatcctca

SEQ ID NO: 49622 - DNA, 36 bp, Artificial Sequence
  Synthetic oligonucleotide
cccatccacctacctgtgcgcaaaggtacactctca

SEQ ID NO: 49623 - DNA, 37 bp, Artificial Sequence
  Synthetic oligonucleotide
gcaagggaaagagagcatagaggcggttagaagcaga

SEQ ID NO: 49624 - DNA, 37 bp, Artificial Sequence
  Synthetic oligonucleotide
attcacgtccacattgcacacggcctaggttcaacga

SEQ ID NO: 49625 - DNA, 37 bp, Artificial Sequence
  Synthetic oligonucleotide
taaacccacacgcctgtattctggtaatcgaccccga

SEQ ID NO: 49626 - DNA, 37 bp, Artificial Sequence
  Synthetic oligonucleotide
tagatggagaagctggggatcgggtggggggcgccga

SEQ ID NO: 49627 - DNA, 37 bp, Artificial Sequence
  Synthetic oligonucleotide
tgtgcccccttacgcaatgaatgcaagctctctccga

SEQ ID NO: 49628 - DNA, 37 bp, Artificial Sequence
  Synthetic oligonucleotide
gtgggaacgaggagcagcaaggaaaaacggacgcgga

SEQ ID NO: 49629 - DNA, 37 bp, Artificial Sequence
  Synthetic oligonucleotide
gtcacaggagtctgttccggaaaaggggacgggcgga

SEQ ID NO: 49630 - DNA, 37 bp, Artificial Sequence
  Synthetic oligonucleotide
tagctgtaaggctgcggtggcgtggggggcgggggga

SEQ ID NO: 49631 - DNA, 37 bp, Artificial Sequence
  Synthetic oligonucleotide
atagagggctcagtggggttttggggtcttgtgggga

SEQ ID NO: 49632 - DNA, 37 bp, Artificial Sequence
  Synthetic oligonucleotide
gatgcggtaagcggggacggagggcggtagtgatgga

SEQ ID NO: 49633 - DNA, 37 bp, Artificial Sequence
  Synthetic oligonucleotide
gacccctgagctgagcgaagaccactcgcccaaatga

SEQ ID NO: 49634 - DNA, 37 bp, Artificial Sequence
  Synthetic oligonucleotide
tcctcctgtccagctgtcttatcaccatttctcatga

SEQ ID NO: 49635 - DNA, 38 bp, Artificial Sequence
  Synthetic oligonucleotide
atccggcccagccaaatatcatagccccagcaccctga

SEQ ID NO: 49636 - DNA, 38 bp, Artificial Sequence
  Synthetic oligonucleotide
acccgaccagcccacttggatctctggtactgccctga

SEQ ID NO: 49637 - DNA, 38 bp, Artificial Sequence
  Synthetic oligonucleotide
ttgacacgccctcactctatgttgacaataattcctga

SEQ ID NO: 49638 - DNA, 38 bp, Artificial Sequence
  Synthetic oligonucleotide
acacgaactcttctgaccgcttatacacgtcttcctga

SEQ ID NO: 49639 - DNA, 38 bp, Artificial Sequence
  Synthetic oligonucleotide
tccgtggacgcctgccattaatcgctcctctttagtga

SEQ ID NO: 49640 - DNA, 38 bp, Artificial Sequence
  Synthetic oligonucleotide
ggtgcgtcgccatctgcctatcctcccattcctggtga

SEQ ID NO: 49641 - DNA, 37 bp, Artificial Sequence
  Synthetic oligonucleotide
acccaccccccaaatgcccgtgttgtcgctcccttga

SEQ ID NO: 49642 - DNA, 37 bp, Artificial Sequence
  Synthetic oligonucleotide
aactaccgcagttttgcatcacgcttggccttcttga

SEQ ID NO: 49643 - DNA, 38 bp, Artificial Sequence
  Synthetic oligonucleotide
gggagagagcgatgtagggtgctgggtggtggggttga

SEQ ID NO: 49644 - DNA, 38 bp, Artificial Sequence
  Synthetic oligonucleotide
tctgtgcaggcccgccgtttgcccctattagtgtttga

SEQ ID NO: 49645 - DNA, 36 bp, Artificial Sequence
  Synthetic oligonucleotide
gtcggttgcctccctgcttaacttcgctcgctgcta

SEQ ID NO: 49646 - DNA, 36 bp, Artificial Sequence
  Synthetic oligonucleotide
atcgctcctcctatcttttttcgatggtaccttgta

SEQ ID NO: 49647 - DNA, 36 bp, Artificial Sequence
  Synthetic oligonucleotide
gtccactgaacggacttggcaccccccagcccctta

SEQ ID NO: 49648 - DNA, 35 bp, Artificial Sequence
  Synthetic oligonucleotide
aaacggggtaggaaagtaggggggtctgggcgtta

SEQ ID NO: 49649 - DNA, 35 bp, Artificial Sequence
  Synthetic oligonucleotide
aacccgctgcccaaaatcgtccgacaaacaacaac

SEQ ID NO: 49650 - DNA, 35 bp, Artificial Sequence
  Synthetic oligonucleotide
atgtacacacacggaatgagtcacctgcgtcccgc

SEQ ID NO: 49651 - DNA, 32 bp, Artificial Sequence
  Synthetic oligonucleotide
aatcaccccacctgtcctcgagagcctcatgc

SEQ ID NO: 49652 - DNA, 35 bp, Artificial Sequence
  Synthetic oligonucleotide
caccgacatacccaccaacttaataccgtagctgc

SEQ ID NO: 49653 - DNA, 35 bp, Artificial Sequence
  Synthetic oligonucleotide
atcttacacgccatacaatgcagtttgtcccactc

SEQ ID NO: 49654 - DNA, 35 bp, Artificial Sequence
  Synthetic oligonucleotide
tctgggtgcctgattccatttctgcggttattctc

SEQ ID NO: 49655 - DNA, 35 bp, Artificial Sequence
  Synthetic oligonucleotide
gactccctctatcatttcgcacggttcaacccgag

SEQ ID NO: 49656 - DNA, 35 bp, Artificial Sequence
  Synthetic oligonucleotide
atgcccgtcacaccctggcaggtaacaggaatccg

SEQ ID NO: 49657 - DNA, 36 bp, Artificial Sequence
  Synthetic oligonucleotide
gcacacctgcgcccggtgataatttgtgttcactcg

SEQ ID NO: 49658 - DNA, 35 bp, Artificial Sequence
  Synthetic oligonucleotide
tgcgagaggtgggtgaatatagttgagggggggtg

SEQ ID NO: 49659 - DNA, 35 bp, Artificial Sequence
  Synthetic oligonucleotide
tcccccgtgcccgccccactctaaacgcttgtgtg

SEQ ID NO: 49660 - DNA, 35 bp, Artificial Sequence
  Synthetic oligonucleotide
ggaactgcctgccgcttaacacggggttcacatct

SEQ ID NO: 49661 - DNA, 35 bp, Artificial Sequence
  Synthetic oligonucleotide
gaccttcgtaactggtctcatctcacgattcatct

SEQ ID NO: 49662 - DNA, 35 bp, Artificial Sequence
  Synthetic oligonucleotide
tacaactcccgcctcccctggcgctatccacatgt

SEQ ID NO: 49663 - DNA, 35 bp, Artificial Sequence
  Synthetic oligonucleotide
taacccaaacacagaacgtgcttgcgctcacactt

SEQ ID NO: 49664 - DNA, 35 bp, Artificial Sequence
  Synthetic oligonucleotide
tgccgccatactataatgtctcaaccattcctgtt

SEQ ID NO: 49665 - DNA, 36 bp, Artificial Sequence
  Synthetic oligonucleotide
tgcggtgtaccgggagggaggacggggagatgcaaa

SEQ ID NO: 49666 - DNA, 35 bp, Artificial Sequence
  Synthetic oligonucleotide
acccgccccccttgccatctgaccagaagagtaaa

SEQ ID NO: 49667 - DNA, 36 bp, Artificial Sequence
  Synthetic oligonucleotide
aacgttgtaccgcctccctccgtgcttttagtgcaa

SEQ ID NO: 49668 - DNA, 35 bp, Artificial Sequence
  Synthetic oligonucleotide
acccatgtggaaagggtgtgggtgagagggacgaa

SEQ ID NO: 49669 - DNA, 36 bp, Artificial Sequence
  Synthetic oligonucleotide
ctaccagccatccttgcttcgtctctcatcacggaa

SEQ ID NO: 49670 - DNA, 34 bp, Artificial Sequence
  Synthetic oligonucleotide
tcctcacgaatttgcctttttacgggccaccaca

SEQ ID NO: 49671 - DNA, 36 bp, Artificial Sequence
  Synthetic oligonucleotide
gtcgactgccctggagtattacttggcccacccaca

SEQ ID NO: 49672 - DNA, 35 bp, Artificial Sequence
  Synthetic oligonucleotide
ttcgcattacgcctcatactgcttgttcgattaca

SEQ ID NO: 49673 - DNA, 36 bp, Artificial Sequence
  Synthetic oligonucleotide
tagtctgaccgtccctagcgcaggccgcaaatccca

SEQ ID NO: 49674 - DNA, 36 bp, Artificial Sequence
  Synthetic oligonucleotide
ttcgcacagtcagttgcttgtcgccgttttcatcca

SEQ ID NO: 49675 - DNA, 36 bp, Artificial Sequence
  Synthetic oligonucleotide
tcccctgtccccgcgatataaccccacgccgtcgca

SEQ ID NO: 49676 - DNA, 36 bp, Artificial Sequence
  Synthetic oligonucleotide
acgcatgcaattcgctcctaatgtcaccgtgctgca

SEQ ID NO: 49677 - DNA, 36 bp, Artificial Sequence
  Synthetic oligonucleotide
gccgacgagacagtctcaactcacctctacgcctca

SEQ ID NO: 49678 - DNA, 37 bp, Artificial Sequence
  Synthetic oligonucleotide
gtgagccggttacggttggttgggggcagaatgaaga

SEQ ID NO: 49679 - DNA, 36 bp, Artificial Sequence
  Synthetic oligonucleotide
gccatgaggaaagggaggaaggattatagcctacga

SEQ ID NO: 49680 - DNA, 37 bp, Artificial Sequence
  Synthetic oligonucleotide
accgctagtcgcgaccgccctcccactgtacaaccga

SEQ ID NO: 49681 - DNA, 37 bp, Artificial Sequence
  Synthetic oligonucleotide
tgtgttgggtgggtgggatccaggaggggatgtcgga

SEQ ID NO: 49682 - DNA, 35 bp, Artificial Sequence
  Synthetic oligonucleotide
tgtcctagcaacactcacactcaagataaccggga

SEQ ID NO: 49683 - DNA, 37 bp, Artificial Sequence
  Synthetic oligonucleotide
gggggggagttgagacctagaggacgggtatggggga

SEQ ID NO: 49684 - DNA, 37 bp, Artificial Sequence
  Synthetic oligonucleotide
actgccaccaattgttctgccattaactccacgtgga

SEQ ID NO: 49685 - DNA, 38 bp, Artificial Sequence
  Synthetic oligonucleotide
tcgcatcttccgaggacatctacctcccactgccatga

SEQ ID NO: 49686 - DNA, 38 bp, Artificial Sequence
  Synthetic oligonucleotide
tgacatatgtacgtgaaagggggctggggtggtgatga

SEQ ID NO: 49687 - DNA, 38 bp, Artificial Sequence
  Synthetic oligonucleotide
gcaacccgcgctgtgcttcgtgctacacccccatatga

SEQ ID NO: 49688 - DNA, 38 bp, Artificial Sequence
  Synthetic oligonucleotide
gttacgtgctgcagatgtaatcagggactaaggactga

SEQ ID NO: 49689 - DNA, 37 bp, Artificial Sequence
  Synthetic oligonucleotide
tacgccctccatcaagctggctgcctcgagctcctga

SEQ ID NO: 49690 - DNA, 38 bp, Artificial Sequence
  Synthetic oligonucleotide
gtcacgccgcctcttggtgacctccttcctaccagtga

SEQ ID NO: 49691 - DNA, 38 bp, Artificial Sequence
  Synthetic oligonucleotide
tacgcacgcgcctgcccctacaatctgtgcttccgtga

SEQ ID NO: 49692 - DNA, 37 bp, Artificial Sequence
  Synthetic oligonucleotide
taggtccgctgcaaggtgtgggctgggtgggaattga

SEQ ID NO: 49693 - DNA, 38 bp, Artificial Sequence
  Synthetic oligonucleotide
ttgtccgccgatccactctttttacacgccaccgttga

SEQ ID NO: 49694 - DNA, 38 bp, Artificial Sequence
  Synthetic oligonucleotide
gcacgcgctcgtacacatccacaaggccacccctttga

SEQ ID NO: 49695 - DNA, 36 bp, Artificial Sequence
  Synthetic oligonucleotide
gccaaccacgataactaacagagccctagcaacata

SEQ ID NO: 49696 - DNA, 36 bp, Artificial Sequence
  Synthetic oligonucleotide
gaacccccaccctgaacgatctggaccattgcggta

SEQ ID NO: 49697 - DNA, 36 bp, Artificial Sequence
  Synthetic oligonucleotide
acaagttagggggccggcgaaggataggtcggggta

SEQ ID NO: 49698 - DNA, 35 bp, Artificial Sequence
  Synthetic oligonucleotide
gtggcttactcctgcacatgaccgctttgtactta

SEQ ID NO: 49699 - DNA, 35 bp, Artificial Sequence
  Synthetic oligonucleotide
atgcacctccaagcaaccccttgacgttcgcaaac

SEQ ID NO: 49700 - DNA, 35 bp, Artificial Sequence
  Synthetic oligonucleotide
atgacaagagcccaccgtcctagttgccccatgac

SEQ ID NO: 49701 - DNA, 35 bp, Artificial Sequence
  Synthetic oligonucleotide
tccctgcctgccgcccttctgggtacatcctcacc

SEQ ID NO: 49702 - DNA, 35 bp, Artificial Sequence
  Synthetic oligonucleotide
gaggccccgatcctggaccctacgttttattcacc

SEQ ID NO: 49703 - DNA, 35 bp, Artificial Sequence
  Synthetic oligonucleotide
agctgaccacagctccgtagtaacattgctacccc

SEQ ID NO: 49704 - DNA, 35 bp, Artificial Sequence
  Synthetic oligonucleotide
atgctcctgtatcctatgccgagcgacccgccccc

SEQ ID NO: 49705 - DNA, 35 bp, Artificial Sequence
  Synthetic oligonucleotide
gaagacaccacttacgaatgccgacccttattagc

SEQ ID NO: 49706 - DNA, 35 bp, Artificial Sequence
  Synthetic oligonucleotide
tccaccatcctcgctgacgccgcttattgccccgc

SEQ ID NO: 49707 - DNA, 35 bp, Artificial Sequence
  Synthetic oligonucleotide
tcactgccttacttcgaaccgtactcgatgacatc

SEQ ID NO: 49708 - DNA, 35 bp, Artificial Sequence
  Synthetic oligonucleotide
ttgtgcgagcacaattgactcacgcaaacaacttc

SEQ ID NO: 49709 - DNA, 35 bp, Artificial Sequence
  Synthetic oligonucleotide
gaacccagcgtgcccaccaggttcccttcgagttc

SEQ ID NO: 49710 - DNA, 35 bp, Artificial Sequence
  Synthetic oligonucleotide
ggacacatggccagttccttgtatgttacccgttc

SEQ ID NO: 49711 - DNA, 35 bp, Artificial Sequence
  Synthetic oligonucleotide
gggggtagtgggaatgcgggcggagagggtgccag

SEQ ID NO: 49712 - DNA, 35 bp, Artificial Sequence
  Synthetic oligonucleotide
aacatgatgcacctagcctctacgacaatgagacg

SEQ ID NO: 49713 - DNA, 35 bp, Artificial Sequence
  Synthetic oligonucleotide
ttcaaatagagggagaataggcgtgaagggaactg

SEQ ID NO: 49714 - DNA, 35 bp, Artificial Sequence
  Synthetic oligonucleotide
ataccgcccaataacatatgcatacccagcccgtg

SEQ ID NO: 49715 - DNA, 35 bp, Artificial Sequence
  Synthetic oligonucleotide
aaacgcatgaaacgggcacataagggggcaaaaat

SEQ ID NO: 49716 - DNA, 36 bp, Artificial Sequence
  Synthetic oligonucleotide
acccttcaggcctgtcgcttctggttcggtacctat

SEQ ID NO: 49717 - DNA, 35 bp, Artificial Sequence
  Synthetic oligonucleotide
gacatgtgccatcagcgatgccatgtctcactact

SEQ ID NO: 49718 - DNA, 35 bp, Artificial Sequence
  Synthetic oligonucleotide
aatgacacacgtgtggtcgatcgaacgaaatacct

SEQ ID NO: 49719 - DNA, 35 bp, Artificial Sequence
  Synthetic oligonucleotide
gctgcccacttgcggcgcacccgtttcccctgtct

SEQ ID NO: 49720 - DNA, 35 bp, Artificial Sequence
  Synthetic oligonucleotide
aatcaccgctagcagcacccaaggcttacatcctt

SEQ ID NO: 49721 - DNA, 35 bp, Artificial Sequence
  Synthetic oligonucleotide
acccgcttaaggctcctggcaccactctcgcggtt

SEQ ID NO: 49722 - DNA, 34 bp, Artificial Sequence
  Synthetic oligonucleotide
ggggaaagttggggaaggtagtcgggggccggaa

SEQ ID NO: 49723 - DNA, 36 bp, Artificial Sequence
  Synthetic oligonucleotide
gagggggtgagtggaattaggaatcatgcgaattaa

SEQ ID NO: 49724 - DNA, 36 bp, Artificial Sequence
  Synthetic oligonucleotide
tgtactccccgcacaccataccgggccattggttaa

SEQ ID NO: 49725 - DNA, 35 bp, Artificial Sequence
  Synthetic oligonucleotide
acacaaccgcaatatatgacctggcttaactttaa

SEQ ID NO: 49726 - DNA, 35 bp, Artificial Sequence
  Synthetic oligonucleotide
gtggtgggggggtagtggtacgttgggtagagcca

SEQ ID NO: 49727 - DNA, 36 bp, Artificial Sequence
  Synthetic oligonucleotide
agatccagcgcacatttcggccttctttgtaaagca

SEQ ID NO: 49728 - DNA, 36 bp, Artificial Sequence
  Synthetic oligonucleotide
tccaggagcggtcactacctgtcatcttgcgtctca

SEQ ID NO: 49729 - DNA, 35 bp, Artificial Sequence
  Synthetic oligonucleotide
tcgactccgcgttcctcgtctgtcttgaaccttca

SEQ ID NO: 49730 - DNA, 36 bp, Artificial Sequence
  Synthetic oligonucleotide
gccacagaaggttagggggtaagaaagggctacaga

SEQ ID NO: 49731 - DNA, 37 bp, Artificial Sequence
  Synthetic oligonucleotide
tagccggagaatgtggaaggggcatgtaggaatgaga

SEQ ID NO: 49732 - DNA, 35 bp, Artificial Sequence
  Synthetic oligonucleotide
aacccgtactgtactccaatcatatcgctacacga

SEQ ID NO: 49733 - DNA, 37 bp, Artificial Sequence
  Synthetic oligonucleotide
tccgccgtactcgtagcattttgttcgactctcccga

SEQ ID NO: 49734 - DNA, 37 bp, Artificial Sequence
  Synthetic oligonucleotide
gaaggagagtgaggtgcgggggcagaacaacgaagga

SEQ ID NO: 49735 - DNA, 36 bp, Artificial Sequence
  Synthetic oligonucleotide
taggagggggcggctgacggggaggtgggaatcgga

SEQ ID NO: 49736 - DNA, 35 bp, Artificial Sequence
  Synthetic oligonucleotide
tagagccacgaaaaggtcgacaaggttaaacggga

SEQ ID NO: 49737 - DNA, 37 bp, Artificial Sequence
  Synthetic oligonucleotide
gagaccgactacagagatagggcagagaacagtggga

SEQ ID NO: 49738 - DNA, 37 bp, Artificial Sequence
  Synthetic oligonucleotide
gatactttcgcgcacccgccctccttcgtacttggga

SEQ ID NO: 49739 - DNA, 37 bp, Artificial Sequence
  Synthetic oligonucleotide
gttaactaccgcctcgatcatgtcgaactcctctgga

SEQ ID NO: 49740 - DNA, 37 bp, Artificial Sequence
  Synthetic oligonucleotide
aatatatgcagccgccacgccagttctccgcccctga

SEQ ID NO: 49741 - DNA, 38 bp, Artificial Sequence
  Synthetic oligonucleotide
taacctcccacgccggcttgtactttgcccgtgcctga

SEQ ID NO: 49742 - DNA, 38 bp, Artificial Sequence
  Synthetic oligonucleotide
gcaggggtggaagggggtgtcgttatgtagggctctga

SEQ ID NO: 49743 - DNA, 38 bp, Artificial Sequence
  Synthetic oligonucleotide
gagacacaaagggtggtgggatgagttagtcagagtga

SEQ ID NO: 49744 - DNA, 38 bp, Artificial Sequence
  Synthetic oligonucleotide
tcgaaccggctatcattactatttgcttacacgtgtga

SEQ ID NO: 49745 - DNA, 38 bp, Artificial Sequence
  Synthetic oligonucleotide
gtgggaggggtggcagtcggtcgaagtcaaggcattga

SEQ ID NO: 49746 - DNA, 38 bp, Artificial Sequence
  Synthetic oligonucleotide
accaacgtgaggcctccccatcgaacaatctaggttga

SEQ ID NO: 49747 - DNA, 37 bp, Artificial Sequence
  Synthetic oligonucleotide
ttccggacacgcctcatctctgattttgatctgttga

SEQ ID NO: 49748 - DNA, 38 bp, Artificial Sequence
  Synthetic oligonucleotide
gtggaggaagggtgaggacaatgaggcagatcatttga

SEQ ID NO: 49749 - DNA, 38 bp, Artificial Sequence
  Synthetic oligonucleotide
taccaacgccgtctttcccgtgccaacacccgatttga

SEQ ID NO: 49750 - DNA, 36 bp, Artificial Sequence
  Synthetic oligonucleotide
tgtcgagggggcggaaacaagggaaatgttgaagta

SEQ ID NO: 49751 - DNA, 35 bp, Artificial Sequence
  Synthetic oligonucleotide
acacgcttatctgtgtttcctgctgtttcgtgaac

SEQ ID NO: 49752 - DNA, 35 bp, Artificial Sequence
  Synthetic oligonucleotide
actgaccccttattggcctgtcccctttcgtccac

SEQ ID NO: 49753 - DNA, 35 bp, Artificial Sequence
  Synthetic oligonucleotide
gtcaacaacacactacgcctagtaggcagtttcac

SEQ ID NO: 49754 - DNA, 35 bp, Artificial Sequence
  Synthetic oligonucleotide
gcaccaccgcattagttcccacgggagcatgggac

SEQ ID NO: 49755 - DNA, 35 bp, Artificial Sequence
  Synthetic oligonucleotide
gtccgaaggtcgctttacttttagacgcaacttcc

SEQ ID NO: 49756 - DNA, 35 bp, Artificial Sequence
  Synthetic oligonucleotide
tgaggcacccagtcaaaacgcaccgccgaaatcgc

SEQ ID NO: 49757 - DNA, 35 bp, Artificial Sequence
  Synthetic oligonucleotide
atccacatctccaggggttcgttcactcccggtgc

SEQ ID NO: 49758 - DNA, 35 bp, Artificial Sequence
  Synthetic oligonucleotide
acttacgtctcagtcctttatcattccggccattc

SEQ ID NO: 49759 - DNA, 35 bp, Artificial Sequence
  Synthetic oligonucleotide
agcggggccaaatggggcgatggaagagggttaag

SEQ ID NO: 49760 - DNA, 35 bp, Artificial Sequence
  Synthetic oligonucleotide
gataacgatcgactagctttaactgcataatccat

SEQ ID NO: 49761 - DNA, 35 bp, Artificial Sequence
  Synthetic oligonucleotide
gctgtcatacgccggcttgcttaaccgacaacgat

SEQ ID NO: 49762 - DNA, 35 bp, Artificial Sequence
  Synthetic oligonucleotide
tcccatggccgccctcacgtggcccccttccgact

SEQ ID NO: 49763 - DNA, 35 bp, Artificial Sequence
  Synthetic oligonucleotide
atcgaagccacgcacgtagatctaccggtttacct

SEQ ID NO: 49764 - DNA, 35 bp, Artificial Sequence
  Synthetic oligonucleotide
acaaccaaggctctgaacacgaccgtccctgtcct

SEQ ID NO: 49765 - DNA, 35 bp, Artificial Sequence
  Synthetic oligonucleotide
aactgcggggagtaatcgtggaaaaaataaggcgt

SEQ ID NO: 49766 - DNA, 36 bp, Artificial Sequence
  Synthetic oligonucleotide
tctctagccacaccgtgcccattaaactgttacaaa

SEQ ID NO: 49767 - DNA, 36 bp, Artificial Sequence
  Synthetic oligonucleotide
agcccatcacaagcagagttagtcctgatcctccaa

SEQ ID NO: 49768 - DNA, 36 bp, Artificial Sequence
  Synthetic oligonucleotide
aaacacaacggtggccttgtccgaaccactctcgaa

SEQ ID NO: 49769 - DNA, 36 bp, Artificial Sequence
  Synthetic oligonucleotide
gtgcgccttcgcggattgcgtccgtcccttaccaca

SEQ ID NO: 49770 - DNA, 36 bp, Artificial Sequence
  Synthetic oligonucleotide
gagcgcctcacaggcccccgttcctccctgtccaca

SEQ ID NO: 49771 - DNA, 36 bp, Artificial Sequence
  Synthetic oligonucleotide
tcaacaccgggccacccttcgcaattgatgcagcca

SEQ ID NO: 49772 - DNA, 36 bp, Artificial Sequence
  Synthetic oligonucleotide
agacacgctagaggtcaccagcccacacaacccgca

SEQ ID NO: 49773 - DNA, 36 bp, Artificial Sequence
  Synthetic oligonucleotide
ccacgtccaccttgggcttcactcgactcgctttca

SEQ ID NO: 49774 - DNA, 37 bp, Artificial Sequence
  Synthetic oligonucleotide
ttcaatccacatctgcttcccattttgcctgtcgaga

SEQ ID NO: 49775 - DNA, 36 bp, Artificial Sequence
  Synthetic oligonucleotide
aacgacggaagagagaaggtgcctgtactaatgaga

SEQ ID NO: 49776 - DNA, 37 bp, Artificial Sequence
  Synthetic oligonucleotide
ggtaggtgtgcggaaagtggcggaaaaggagctgaga

SEQ ID NO: 49777 - DNA, 37 bp, Artificial Sequence
  Synthetic oligonucleotide
gaaacgccatcactaccaggactgacttgtctgacga

SEQ ID NO: 49778 - DNA, 37 bp, Artificial Sequence
  Synthetic oligonucleotide
acacatttaaccaccatgcgtacagagatgccgccga

SEQ ID NO: 49779 - DNA, 37 bp, Artificial Sequence
  Synthetic oligonucleotide
tcaccgtaacccccagcgtgctgctaaggacggagga

SEQ ID NO: 49780 - DNA, 37 bp, Artificial Sequence
  Synthetic oligonucleotide
gatggtaggttgggtatgggacgcaatggggacggga

SEQ ID NO: 49781 - DNA, 36 bp, Artificial Sequence
  Synthetic oligonucleotide
tacaaggggtcagggtggttaggtgtggggtgggga

SEQ ID NO: 49782 - DNA, 37 bp, Artificial Sequence
  Synthetic oligonucleotide
tcccttcgccgtttgtactttccgccaactcgctgga

SEQ ID NO: 49783 - DNA, 37 bp, Artificial Sequence
  Synthetic oligonucleotide
gcatctccgcctggacctccatcgatgccataaatga

SEQ ID NO: 49784 - DNA, 37 bp, Artificial Sequence
  Synthetic oligonucleotide
tccccaccacgtctaggcccttcgtcgtcaattatga

SEQ ID NO: 49785 - DNA, 38 bp, Artificial Sequence
  Synthetic oligonucleotide
acgctcccgtgccgtaccttaacatcctgctttactga

SEQ ID NO: 49786 - DNA, 38 bp, Artificial Sequence
  Synthetic oligonucleotide
tgtgcctacacatccgctggcctttttatcccatctga

SEQ ID NO: 49787 - DNA, 38 bp, Artificial Sequence
  Synthetic oligonucleotide
gtggggttggagggaagagggttagagatgttgggtga

SEQ ID NO: 49788 - DNA, 37 bp, Artificial Sequence
  Synthetic oligonucleotide
aactcccccgctattatcgagcccctagaggacttga

SEQ ID NO: 49789 - DNA, 35 bp, Artificial Sequence
  Synthetic oligonucleotide
tttgtcccccagcagccaagttccgctctggttga

SEQ ID NO: 49790 - DNA, 35 bp, Artificial Sequence
  Synthetic oligonucleotide
acatgccccctctctcatttaatgatggtacccta

SEQ ID NO: 49791 - DNA, 36 bp, Artificial Sequence
  Synthetic oligonucleotide
tactaccccggacttcctagttcacgagcactccta

SEQ ID NO: 49792 - DNA, 35 bp, Artificial Sequence
  Synthetic oligonucleotide
actgcgttgggggcggggcggattagcggggtcta

SEQ ID NO: 49793 - DNA, 35 bp, Artificial Sequence
  Synthetic oligonucleotide
tatcgtagggcaagatctttggcgcttcaccctta

SEQ ID NO: 49794 - DNA, 35 bp, Artificial Sequence
  Synthetic oligonucleotide
tttgctagccgcttaaatggcccacttcgtaccac

SEQ ID NO: 49795 - DNA, 34 bp, Artificial Sequence
  Synthetic oligonucleotide
tatgccacacaccccgactcacgttacgagcacc

SEQ ID NO: 49796 - DNA, 35 bp, Artificial Sequence
  Synthetic oligonucleotide
cagcggtacgaccccgcgtccctagatgtttcccc

SEQ ID NO: 49797 - DNA, 35 bp, Artificial Sequence
  Synthetic oligonucleotide
agtaaccctccccgtgtaattgtttagtaatctgc

SEQ ID NO: 49798 - DNA, 35 bp, Artificial Sequence
  Synthetic oligonucleotide
acccctggcacgtcaaacttattccacttcatatc

SEQ ID NO: 49799 - DNA, 35 bp, Artificial Sequence
  Synthetic oligonucleotide
tgaggatgctgctgaggcctccccataccaccctc

SEQ ID NO: 49800 - DNA, 35 bp, Artificial Sequence
  Synthetic oligonucleotide
acgtgtctgtcctgcatggctctcaacacctcttc

SEQ ID NO: 49801 - DNA, 35 bp, Artificial Sequence
  Synthetic oligonucleotide
aaaaatgaggtagggggggtaaatgagtgtggtgg

SEQ ID NO: 49802 - DNA, 35 bp, Artificial Sequence
  Synthetic oligonucleotide
ggagaaaggggatagagggggattcgcggagttgg

SEQ ID NO: 49803 - DNA, 35 bp, Artificial Sequence
  Synthetic oligonucleotide
gacttggtaaaaggtggtaggggagttaggggatg

SEQ ID NO: 49804 - DNA, 35 bp, Artificial Sequence
  Synthetic oligonucleotide
gtcaacaggagaaacgagggagtcaatggagcgtg

SEQ ID NO: 49805 - DNA, 35 bp, Artificial Sequence
  Synthetic oligonucleotide
tcacgtggccacaaccaaacggtcttgcctggaat

SEQ ID NO: 49806 - DNA, 35 bp, Artificial Sequence
  Synthetic oligonucleotide
gtgagtaccagcgatccttacgccgattccctcat

SEQ ID NO: 49807 - DNA, 35 bp, Artificial Sequence
  Synthetic oligonucleotide
tgcgatcagaacacacctgccctgtctatatctat

SEQ ID NO: 49808 - DNA, 35 bp, Artificial Sequence
  Synthetic oligonucleotide
atcccctcggcctacatcacctcctggttttctat

SEQ ID NO: 49809 - DNA, 35 bp, Artificial Sequence
  Synthetic oligonucleotide
tctgactgttgcccccggagccattatgactcact

SEQ ID NO: 49810 - DNA, 35 bp, Artificial Sequence
  Synthetic oligonucleotide
aaccaacgccttaacttgcatcgtatgcgctacct

SEQ ID NO: 49811 - DNA, 35 bp, Artificial Sequence
  Synthetic oligonucleotide
ttgtctcgcaaaattgccctcccacggtccaccct

SEQ ID NO: 49812 - DNA, 35 bp, Artificial Sequence
  Synthetic oligonucleotide
tcccgagcagggttcggaaccttcctgtcgaccct

SEQ ID NO: 49813 - DNA, 35 bp, Artificial Sequence
  Synthetic oligonucleotide
tgtgctatacggacgtacactggcactttgggtct

SEQ ID NO: 49814 - DNA, 35 bp, Artificial Sequence
  Synthetic oligonucleotide
aacagcacgtacctgtcccatgcccatgattgagt

SEQ ID NO: 49815 - DNA, 35 bp, Artificial Sequence
  Synthetic oligonucleotide
gtgggagggcccaaagatatcacgatacgcacctt

SEQ ID NO: 49816 - DNA, 35 bp, Artificial Sequence
  Synthetic oligonucleotide
tgcgaacgctgggatgtctgcgcaccgtttttgtt

SEQ ID NO: 49817 - DNA, 35 bp, Artificial Sequence
  Synthetic oligonucleotide
gctcccacccccagggccacgtcgctcccagattt

SEQ ID NO: 49818 - DNA, 35 bp, Artificial Sequence
  Synthetic oligonucleotide
ggacaggggggtaaaggctagggggaacgacgaaa

SEQ ID NO: 49819 - DNA, 36 bp, Artificial Sequence
  Synthetic oligonucleotide
tttcgctcaagtcattgccccacacgcccagttgaa

SEQ ID NO: 49820 - DNA, 36 bp, Artificial Sequence
  Synthetic oligonucleotide
gtccgtagccccataatgtccgttgcgccttaataa

SEQ ID NO: 49821 - DNA, 36 bp, Artificial Sequence
  Synthetic oligonucleotide
tcttagcgccctacgtcttactctccctcgtgctaa

SEQ ID NO: 49822 - DNA, 35 bp, Artificial Sequence
  Synthetic oligonucleotide
gatacagccaaccaacttcgggctattactacaca

SEQ ID NO: 49823 - DNA, 35 bp, Artificial Sequence
  Synthetic oligonucleotide
acacaccgggggtcgggactgcacgttgcaccaca

SEQ ID NO: 49824 - DNA, 36 bp, Artificial Sequence
  Synthetic oligonucleotide
gctcgtatggctggttcccctttcccaatttgcaca

SEQ ID NO: 49825 - DNA, 36 bp, Artificial Sequence
  Synthetic oligonucleotide
ggccatagcccgcccctataccatacatgccgccca

SEQ ID NO: 49826 - DNA, 35 bp, Artificial Sequence
  Synthetic oligonucleotide
gcgcccccccggccgtcaaaaagcctaaccagcca

SEQ ID NO: 49827 - DNA, 36 bp, Artificial Sequence
  Synthetic oligonucleotide
gtcgcacccattctgttggctcgaacttggctatca

SEQ ID NO: 49828 - DNA, 37 bp, Artificial Sequence
  Synthetic oligonucleotide
tgagcgtgttcgccgctcacgcctgttcttaccaaga

SEQ ID NO: 49829 - DNA, 37 bp, Artificial Sequence
  Synthetic oligonucleotide
tctttcccactgctgccacaagttctatcgatatcga

SEQ ID NO: 49830 - DNA, 37 bp, Artificial Sequence
  Synthetic oligonucleotide
tcgctggaggcgggtgagagggatatctcggggggga

SEQ ID NO: 49831 - DNA, 37 bp, Artificial Sequence
  Synthetic oligonucleotide
gttgggtggaagggggtaagagccggtaatatgggga

SEQ ID NO: 49832 - DNA, 36 bp, Artificial Sequence
  Synthetic oligonucleotide
aaacccacctcggtcagtccctctatcgacgctgga

SEQ ID NO: 49833 - DNA, 37 bp, Artificial Sequence
  Synthetic oligonucleotide
tcatgatgcctgcccaccactataacacttcgttgga

SEQ ID NO: 49834 - DNA, 36 bp, Artificial Sequence
  Synthetic oligonucleotide
gacacaccattttgaaccgagccttcaccgaaatga

SEQ ID NO: 49835 - DNA, 38 bp, Artificial Sequence
  Synthetic oligonucleotide
gaggtgacaaaggggggatacggatggatcgggaatga

SEQ ID NO: 49836 - DNA, 38 bp, Artificial Sequence
  Synthetic oligonucleotide
gaatcatcagtacacactacacacaggaagggacatga

SEQ ID NO: 49837 - DNA, 38 bp, Artificial Sequence
  Synthetic oligonucleotide
tccggaacctcggcatttttctgcgacccatttcatga

SEQ ID NO: 49838 - DNA, 37 bp, Artificial Sequence
  Synthetic oligonucleotide
tccccacccgttaaacctttgttggtccctgtactga

SEQ ID NO: 49839 - DNA, 37 bp, Artificial Sequence
  Synthetic oligonucleotide
ttcacgatcggtctacactttcggactatctccctga

SEQ ID NO: 49840 - DNA, 38 bp, Artificial Sequence
  Synthetic oligonucleotide
gagccataactagtggcgtgcctgttccttttccctga

SEQ ID NO: 49841 - DNA, 38 bp, Artificial Sequence
  Synthetic oligonucleotide
tgatcaccacccgggagtaattgattaccagttcctga

SEQ ID NO: 49842 - DNA, 37 bp, Artificial Sequence
  Synthetic oligonucleotide
tagaccgccccgcacccaagatccgacttggatctga

SEQ ID NO: 49843 - DNA, 38 bp, Artificial Sequence
  Synthetic oligonucleotide
gactcgtagggggcggtaacggcgggtgggtggagtga

SEQ ID NO: 49844 - DNA, 36 bp, Artificial Sequence
  Synthetic oligonucleotide
tgttccacgcttacaccatctgccaggtatctgtga

SEQ ID NO: 49845 - DNA, 37 bp, Artificial Sequence
  Synthetic oligonucleotide
actaccaacacgatcctcctgcatcagcgctgattga

SEQ ID NO: 49846 - DNA, 37 bp, Artificial Sequence
  Synthetic oligonucleotide
tacgcactgctcactattttggccccgcacgtattga

SEQ ID NO: 49847 - DNA, 38 bp, Artificial Sequence
  Synthetic oligonucleotide
gatgggcgcagaacgtggggaggaggatggtaatttga

SEQ ID NO: 49848 - DNA, 35 bp, Artificial Sequence
  Synthetic oligonucleotide
gcccgcctgatcacctgccctttgacgtcagtata

SEQ ID NO: 49849 - DNA, 36 bp, Artificial Sequence
  Synthetic oligonucleotide
aacgctgttcacgcactcatccccgtccaagcccta

SEQ ID NO: 49850 - DNA, 36 bp, Artificial Sequence
  Synthetic oligonucleotide
tcatgacttgtacccagtgctaattaacgctcccta

SEQ ID NO: 49851 - DNA, 36 bp, Artificial Sequence
  Synthetic oligonucleotide
gttgccaccatggtggaccacgcctcactcttctta

SEQ ID NO: 49852 - DNA, 36 bp, Artificial Sequence
  Synthetic oligonucleotide
gtggggtggggagcaaagcagaggcggccggggtta

SEQ ID NO: 49853 - DNA, 36 bp, Artificial Sequence
  Synthetic oligonucleotide
tacgcccttttcaacatttgctgatcgtaacattta

SEQ ID NO: 49854 - DNA, 36 bp, Artificial Sequence
  Synthetic oligonucleotide
aactgcacccctgacccctttggttgagcgccttta

SEQ ID NO: 49855 - DNA, 31 bp, Artificial Sequence
  Synthetic oligonucleotide
atcgaccgtgcgcagtcccactacccgcgac

SEQ ID NO: 49856 - DNA, 35 bp, Artificial Sequence
  Synthetic oligonucleotide
cacctttctgcgcacataatcttatgtacgtctac

SEQ ID NO: 49857 - DNA, 35 bp, Artificial Sequence
  Synthetic oligonucleotide
accgaccccgtatctgactttcctagtcagttgcc

SEQ ID NO: 49858 - DNA, 35 bp, Artificial Sequence
  Synthetic oligonucleotide
gtgaagtacgcgtatcgtctaccctgcttatgtcc

SEQ ID NO: 49859 - DNA, 35 bp, Artificial Sequence
  Synthetic oligonucleotide
tgtcaccctacccgtcaccactcaggcgatgcggc

SEQ ID NO: 49860 - DNA, 35 bp, Artificial Sequence
  Synthetic oligonucleotide
ttagttccaccgcattgcatccgagatgcctttgc

SEQ ID NO: 49861 - DNA, 35 bp, Artificial Sequence
  Synthetic oligonucleotide
accttgccaccatccgcatctagcacgcagcaatc

SEQ ID NO: 49862 - DNA, 35 bp, Artificial Sequence
  Synthetic oligonucleotide
atgccataccatcaagggaggtgttccgtcccttc

SEQ ID NO: 49863 - DNA, 35 bp, Artificial Sequence
  Synthetic oligonucleotide
tgtgaacggggaggtggagcttaggtcgcccggag

SEQ ID NO: 49864 - DNA, 35 bp, Artificial Sequence
  Synthetic oligonucleotide
tccccattgtccaatggatgatgatcattcccccg

SEQ ID NO: 49865 - DNA, 35 bp, Artificial Sequence
  Synthetic oligonucleotide
gccgggtagaggagggtggaggagtgtgtaggccg

SEQ ID NO: 49866 - DNA, 35 bp, Artificial Sequence
  Synthetic oligonucleotide
agctgtgtggggtggggggttgcatgaaggggagg

SEQ ID NO: 49867 - DNA, 35 bp, Artificial Sequence
  Synthetic oligonucleotide
taaaaccgccacgcccgactcgccttagtatgttg

SEQ ID NO: 49868 - DNA, 35 bp, Artificial Sequence
  Synthetic oligonucleotide
acctcgcctgtagtagtaccgttactatcctccct

SEQ ID NO: 49869 - DNA, 35 bp, Artificial Sequence
  Synthetic oligonucleotide
agatacgcccgcccttcgcttgtgcgcttctcgct

SEQ ID NO: 49870 - DNA, 35 bp, Artificial Sequence
  Synthetic oligonucleotide
gcacccgcggcgcacaggctttacttctttcctct

SEQ ID NO: 49871 - DNA, 35 bp, Artificial Sequence
  Synthetic oligonucleotide
gaggagtgaggggagtctgtgcgtagcctagcggt

SEQ ID NO: 49872 - DNA, 35 bp, Artificial Sequence
  Synthetic oligonucleotide
agcacagcagatcttgtccctgtccgatccaaatt

SEQ ID NO: 49873 - DNA, 35 bp, Artificial Sequence
  Synthetic oligonucleotide
gacaagtgatccgtcgtcccacatgccaaaagtaa

SEQ ID NO: 49874 - DNA, 36 bp, Artificial Sequence
  Synthetic oligonucleotide
gccaactccatgcttttgctagggctacctcgttaa

SEQ ID NO: 49875 - DNA, 36 bp, Artificial Sequence
  Synthetic oligonucleotide
aactggaggcgactcatgcaccctcactaggctaca

SEQ ID NO: 49876 - DNA, 35 bp, Artificial Sequence
  Synthetic oligonucleotide
tgaatggcactcaggatttgcaagcctcccgccca

SEQ ID NO: 49877 - DNA, 35 bp, Artificial Sequence
  Synthetic oligonucleotide
acgaggccattgcggggactacttacatccttcca

SEQ ID NO: 49878 - DNA, 36 bp, Artificial Sequence
  Synthetic oligonucleotide
tatcctcgtccccttgccggttgtcgaaacttctca

SEQ ID NO: 49879 - DNA, 37 bp, Artificial Sequence
  Synthetic oligonucleotide
aaaacgaagaggggccggggacggtctccgggaaaga

SEQ ID NO: 49880 - DNA, 37 bp, Artificial Sequence
  Synthetic oligonucleotide
cactgcgccttcacctcccgtacgtatctgtgtcaga

SEQ ID NO: 49881 - DNA, 36 bp, Artificial Sequence
  Synthetic oligonucleotide
acaggtacgcacgactttcatccgaggcccctacga

SEQ ID NO: 49882 - DNA, 37 bp, Artificial Sequence
  Synthetic oligonucleotide
gcgcgatcagtctcaggtactatcatctctgctccga

SEQ ID NO: 49883 - DNA, 36 bp, Artificial Sequence
  Synthetic oligonucleotide
gactactcccagggccgttatgttcaccctactcga

SEQ ID NO: 49884 - DNA, 37 bp, Artificial Sequence
  Synthetic oligonucleotide
gagatcaccccgctttcctacgctggtccttggggga

SEQ ID NO: 49885 - DNA, 35 bp, Artificial Sequence
  Synthetic oligonucleotide
acgactcctcttctgccattgatcataccactgga

SEQ ID NO: 49886 - DNA, 37 bp, Artificial Sequence
  Synthetic oligonucleotide
tcccagaaatggtcgtcccctagtgcctccccctgga

SEQ ID NO: 49887 - DNA, 37 bp, Artificial Sequence
  Synthetic oligonucleotide
acgaagggcggggaggcgagggtactgcgtatgtgga

SEQ ID NO: 49888 - DNA, 38 bp, Artificial Sequence
  Synthetic oligonucleotide
atcgccatacggagccgaccgccaagcacccctcatga

SEQ ID NO: 49889 - DNA, 37 bp, Artificial Sequence
  Synthetic oligonucleotide
gagttgggtggagaaacgtgcgtgagtggctgtatga

SEQ ID NO: 49890 - DNA, 38 bp, Artificial Sequence
  Synthetic oligonucleotide
gtgtgtgactcagggggggaacgggtggggaatactga

SEQ ID NO: 49891 - DNA, 38 bp, Artificial Sequence
  Synthetic oligonucleotide
ggaaccccccatcatctgttctgtcattcttctagtga

SEQ ID NO: 49892 - DNA, 38 bp, Artificial Sequence
  Synthetic oligonucleotide
gatcaagctgagggggtgggtcatggggtcggtcgtga

SEQ ID NO: 49893 - DNA, 37 bp, Artificial Sequence
  Synthetic oligonucleotide
gcggactgctaggcagggagcactgggctggaggtga

SEQ ID NO: 49894 - DNA, 37 bp, Artificial Sequence
  Synthetic oligonucleotide
agacggagccggggggtatgggaaaaaagcgagttga

SEQ ID NO: 49895 - DNA, 38 bp, Artificial Sequence
  Synthetic oligonucleotide
gtcagagctcactttgggccattgctttcgctctttga

SEQ ID NO: 49896 - DNA, 36 bp, Artificial Sequence
  Synthetic oligonucleotide
tctctcatcctcccaatgcaacagacctgaactcta

SEQ ID NO: 49897 - DNA, 36 bp, Artificial Sequence
  Synthetic oligonucleotide
cgcgttagcccgcaatttataggctactcattttta

SEQ ID NO: 49898 - DNA, 35 bp, Artificial Sequence
  Synthetic oligonucleotide
gtggacgtactgcaacatagggattgctgctcaac

SEQ ID NO: 49899 - DNA, 35 bp, Artificial Sequence
  Synthetic oligonucleotide
tcagcacagctctctactctttatgggccaagccc

SEQ ID NO: 49900 - DNA, 35 bp, Artificial Sequence
  Synthetic oligonucleotide
accatttggtgagtatgcgctctcgcctgctgccc

SEQ ID NO: 49901 - DNA, 35 bp, Artificial Sequence
  Synthetic oligonucleotide
atgaggcggtgggtgaagggtggggttggttgtcc

SEQ ID NO: 49902 - DNA, 34 bp, Artificial Sequence
  Synthetic oligonucleotide
tacccctacctccggaagcgctaagcgcaatcgc

SEQ ID NO: 49903 - DNA, 35 bp, Artificial Sequence
  Synthetic oligonucleotide
gtgcagacggtcctttgcccctcgcgctttgctgc

SEQ ID NO: 49904 - DNA, 35 bp, Artificial Sequence
  Synthetic oligonucleotide
acgacccgttctgctcattacgtcgaagacgcctc

SEQ ID NO: 49905 - DNA, 35 bp, Artificial Sequence
  Synthetic oligonucleotide
attcgccaccgatgcgcctcaactctcagaccgtc

SEQ ID NO: 49906 - DNA, 35 bp, Artificial Sequence
  Synthetic oligonucleotide
tacgtagtagcccccgttcccacgctctgacacag

SEQ ID NO: 49907 - DNA, 35 bp, Artificial Sequence
  Synthetic oligonucleotide
accactactggcgtgctgaacaaaccctcgtcccg

SEQ ID NO: 49908 - DNA, 35 bp, Artificial Sequence
  Synthetic oligonucleotide
ttgtccgcccttctcaatgctctaatgatttgccg

SEQ ID NO: 49909 - DNA, 35 bp, Artificial Sequence
  Synthetic oligonucleotide
gtgggtggggtaggtctgggcacgtccatattggg

SEQ ID NO: 49910 - DNA, 35 bp, Artificial Sequence
  Synthetic oligonucleotide
acagggtgggtttgagagaatgggtcagtcggatg

SEQ ID NO: 49911 - DNA, 35 bp, Artificial Sequence
  Synthetic oligonucleotide
taagggttggggcgaaggattaatcaggtggggtg

SEQ ID NO: 49912 - DNA, 35 bp, Artificial Sequence
  Synthetic oligonucleotide
aagctgaagcgccctgacaactgcatatcccccat

SEQ ID NO: 49913 - DNA, 35 bp, Artificial Sequence
  Synthetic oligonucleotide
gcacgccacgtacatcaccaccaagtacccgttat

SEQ ID NO: 49914 - DNA, 35 bp, Artificial Sequence
  Synthetic oligonucleotide
ttaccgcggctcttcggaacgcatttccacccatt

SEQ ID NO: 49915 - DNA, 36 bp, Artificial Sequence
  Synthetic oligonucleotide
gagggacactgagagcacaggaaatggggagtgaaa

SEQ ID NO: 49916 - DNA, 36 bp, Artificial Sequence
  Synthetic oligonucleotide
acgtgtcgccaacccgggccgccgtaactcccccaa

SEQ ID NO: 49917 - DNA, 35 bp, Artificial Sequence
  Synthetic oligonucleotide
aactatcccaccagacgccggtacagccgagccaa

SEQ ID NO: 49918 - DNA, 36 bp, Artificial Sequence
  Synthetic oligonucleotide
agaccctcacagtcattaagtcccatatgtcacgaa

SEQ ID NO: 49919 - DNA, 35 bp, Artificial Sequence
  Synthetic oligonucleotide
gtgacagactcagcgcgtcctgcgccactcccgaa

SEQ ID NO: 49920 - DNA, 36 bp, Artificial Sequence
  Synthetic oligonucleotide
gatgggaagtgcaatgggcatcaccgagcgggggaa

SEQ ID NO: 49921 - DNA, 36 bp, Artificial Sequence
  Synthetic oligonucleotide
ttgtctcgccatctgctaaccggttcggtaatcaca

SEQ ID NO: 49922 - DNA, 36 bp, Artificial Sequence
  Synthetic oligonucleotide
gcaaggccttccatagcaattgtcatgttcctgcca

SEQ ID NO: 49923 - DNA, 36 bp, Artificial Sequence
  Synthetic oligonucleotide
tgcattccggccaacaccgtaccgcgacccagtcca

SEQ ID NO: 49924 - DNA, 35 bp, Artificial Sequence
  Synthetic oligonucleotide
gatcccatcactacgaccaataccatgtgctcgca

SEQ ID NO: 49925 - DNA, 36 bp, Artificial Sequence
  Synthetic oligonucleotide
ttcgacatctcgcacctcgccatggcgttcccctca

SEQ ID NO: 49926 - DNA, 37 bp, Artificial Sequence
  Synthetic oligonucleotide
gggaaaccgggcggatgacagttgggggtgcgggaga

SEQ ID NO: 49927 - DNA, 37 bp, Artificial Sequence
  Synthetic oligonucleotide
ataccgcgatgccatcaatcctgtccacatccataga

SEQ ID NO: 49928 - DNA, 37 bp, Artificial Sequence
  Synthetic oligonucleotide
taccaacgcactccggtaggtcctcacacagtcacga

SEQ ID NO: 49929 - DNA, 37 bp, Artificial Sequence
  Synthetic oligonucleotide
tagacggagtgggagggtaggagatagaacagtcgga

SEQ ID NO: 49930 - DNA, 37 bp, Artificial Sequence
  Synthetic oligonucleotide
gaccatgggagattgggaattaggtgctgtaatggga

SEQ ID NO: 49931 - DNA, 35 bp, Artificial Sequence
  Synthetic oligonucleotide
ttcccagccgtacccgcagcttcaacagccgatga

SEQ ID NO: 49932 - DNA, 38 bp, Artificial Sequence
  Synthetic oligonucleotide
gatgtcggggggagggtgggagcggccgtctgctatga

SEQ ID NO: 49933 - DNA, 36 bp, Artificial Sequence
  Synthetic oligonucleotide
gcatatactcgttcgccagctccctcttacgcctga

SEQ ID NO: 49934 - DNA, 38 bp, Artificial Sequence
  Synthetic oligonucleotide
tcatacccctccgtccgtcacttgaggcactttcctga

SEQ ID NO: 49935 - DNA, 38 bp, Artificial Sequence
  Synthetic oligonucleotide
atgcggatcggggtctgacgggcgaatggtggcggtga

SEQ ID NO: 49936 - DNA, 37 bp, Artificial Sequence
  Synthetic oligonucleotide
gtgggtgggaagatacgaatgggggagagcagtgtga

SEQ ID NO: 49937 - DNA, 37 bp, Artificial Sequence
  Synthetic oligonucleotide
aaccgatggaggggagggagagaagtagtggtgttga

SEQ ID NO: 49938 - DNA, 37 bp, Artificial Sequence
  Synthetic oligonucleotide
gatgccaccgttgctttgggcgatccgcattatttga

SEQ ID NO: 49939 - DNA, 38 bp, Artificial Sequence
  Synthetic oligonucleotide
ttagcgcgtacttccggttatactcgtgccccctttga

SEQ ID NO: 49940 - DNA, 38 bp, Artificial Sequence
  Synthetic oligonucleotide
atgccacgtcgcctgcctccctggttcacactctttga

SEQ ID NO: 49941 - DNA, 37 bp, Artificial Sequence
  Synthetic oligonucleotide
actacgaacgcaggtccccaattgtctgtttctttga

SEQ ID NO: 49942 - DNA, 36 bp, Artificial Sequence
  Synthetic oligonucleotide
gacatcccgccccggggtggcctgtacctattttga

SEQ ID NO: 49943 - DNA, 35 bp, Artificial Sequence
  Synthetic oligonucleotide
accaggctatgtttttgctcgcccacctcaccata

SEQ ID NO: 49944 - DNA, 35 bp, Artificial Sequence
  Synthetic oligonucleotide
atgtcatcgctatcgttacttatcaccaattccta

SEQ ID NO: 49945 - DNA, 36 bp, Artificial Sequence
  Synthetic oligonucleotide
gaccattactgctgccctccgtgacaaatctgtcta

SEQ ID NO: 49946 - DNA, 35 bp, Artificial Sequence
  Synthetic oligonucleotide
gtacgcgctcgaaacccatccaccaaaccgcctta

SEQ ID NO: 49947 - DNA, 35 bp, Artificial Sequence
  Synthetic oligonucleotide
agtgatgtccattgccccttgttttgaccccgtta

SEQ ID NO: 49948 - DNA, 35 bp, Artificial Sequence
  Synthetic oligonucleotide
tacgacctccattcacgtatgcctgctagaccgac

SEQ ID NO: 49949 - DNA, 35 bp, Artificial Sequence
  Synthetic oligonucleotide
tgcatctctactgcttatccgagtttgtccgttac

SEQ ID NO: 49950 - DNA, 35 bp, Artificial Sequence
  Synthetic oligonucleotide
gaaccgttccacgttcgccttcactgcctacgacc

SEQ ID NO: 49951 - DNA, 35 bp, Artificial Sequence
  Synthetic oligonucleotide
gcgccgacgtacatcacctcgttctaactcatacc

SEQ ID NO: 49952 - DNA, 35 bp, Artificial Sequence
  Synthetic oligonucleotide
ttagcgggagatcatcgaatgcacgcgacccctcc

SEQ ID NO: 49953 - DNA, 35 bp, Artificial Sequence
  Synthetic oligonucleotide
tcgcatccacatcttgggtaatgctgttgctctcc

SEQ ID NO: 49954 - DNA, 35 bp, Artificial Sequence
  Synthetic oligonucleotide
gctgtcaccgccatacacacgacttactttcgcgc

SEQ ID NO: 49955 - DNA, 35 bp, Artificial Sequence
  Synthetic oligonucleotide
ggggtccgacccgttttctcctccatctctggtgc

SEQ ID NO: 49956 - DNA, 35 bp, Artificial Sequence
  Synthetic oligonucleotide
ctgggttgatatctattcctgccacgcctcgcatc

SEQ ID NO: 49957 - DNA, 35 bp, Artificial Sequence
  Synthetic oligonucleotide
gtcccaatagccccgcttgagttgtttgactactc

SEQ ID NO: 49958 - DNA, 35 bp, Artificial Sequence
  Synthetic oligonucleotide
acatcgcgcgcattataagctcccacaagccgctc

SEQ ID NO: 49959 - DNA, 35 bp, Artificial Sequence
  Synthetic oligonucleotide
gcccggtacgatcaccccctggcgcgagcaatctc

SEQ ID NO: 49960 - DNA, 35 bp, Artificial Sequence
  Synthetic oligonucleotide
acacgcgtaaacccgctggttccccatctggattc

SEQ ID NO: 49961 - DNA, 35 bp, Artificial Sequence
  Synthetic oligonucleotide
gattgcagaatgtggcggacgggggaggattgcag

SEQ ID NO: 49962 - DNA, 35 bp, Artificial Sequence
  Synthetic oligonucleotide
gaaaccccacagtttctacgctcctactctccacg

SEQ ID NO: 49963 - DNA, 35 bp, Artificial Sequence
  Synthetic oligonucleotide
acagggcccgtatcccgccgttcgtatcttaaccg

SEQ ID NO: 49964 - DNA, 35 bp, Artificial Sequence
  Synthetic oligonucleotide
tgctccgtagaaccgttgtccccacttcactctgg

SEQ ID NO: 49965 - DNA, 35 bp, Artificial Sequence
  Synthetic oligonucleotide
tgtgcggggtgacagtgcatgttggaggatagtgg

SEQ ID NO: 49966 - DNA, 35 bp, Artificial Sequence
  Synthetic oligonucleotide
gattaacccgcgcccgcaccattttttacctcatg

SEQ ID NO: 49967 - DNA, 35 bp, Artificial Sequence
  Synthetic oligonucleotide
acccgacttacctcaaccaccacaatccagctttg

SEQ ID NO: 49968 - DNA, 35 bp, Artificial Sequence
  Synthetic oligonucleotide
tcgcgacgtgcccagtaaatttgaccccacaccat

SEQ ID NO: 49969 - DNA, 35 bp, Artificial Sequence
  Synthetic oligonucleotide
tctatcgctggccgatacctgaaactgcacaccat

SEQ ID NO: 49970 - DNA, 35 bp, Artificial Sequence
  Synthetic oligonucleotide
ttaagccgggctcccacccagacgctgtcctttat

SEQ ID NO: 49971 - DNA, 35 bp, Artificial Sequence
  Synthetic oligonucleotide
tcacattctcttcgctctcgtgctccggcgcacct

SEQ ID NO: 49972 - DNA, 35 bp, Artificial Sequence
  Synthetic oligonucleotide
gtccgccaactagtcttatatacaccttcagctct

SEQ ID NO: 49973 - DNA, 35 bp, Artificial Sequence
  Synthetic oligonucleotide
tgtacttgctccatcccccccgacccgctaggggt

SEQ ID NO: 49974 - DNA, 35 bp, Artificial Sequence
  Synthetic oligonucleotide
tcacctccgtctgacccctcctcagccgccctggt

SEQ ID NO: 49975 - DNA, 35 bp, Artificial Sequence
  Synthetic oligonucleotide
attcgacgggggtagtggaatattggggtagcatt

SEQ ID NO: 49976 - DNA, 35 bp, Artificial Sequence
  Synthetic oligonucleotide
acgcaagcctgtaacgcccaatcccagcttgcatt

SEQ ID NO: 49977 - DNA, 35 bp, Artificial Sequence
  Synthetic oligonucleotide
gtctccaactgcaactgcgctcctttggctctaaa

SEQ ID NO: 49978 - DNA, 35 bp, Artificial Sequence
  Synthetic oligonucleotide
tgacgccacattggctttcccgatgcacttgccaa

SEQ ID NO: 49979 - DNA, 36 bp, Artificial Sequence
  Synthetic oligonucleotide
tgcgcctagcgctattgtctacacaccaaccctcaa

SEQ ID NO: 49980 - DNA, 36 bp, Artificial Sequence
  Synthetic oligonucleotide
gctcaatctgcgttccatctcagccacgacaacgaa

SEQ ID NO: 49981 - DNA, 36 bp, Artificial Sequence
  Synthetic oligonucleotide
gggacgcgggcaacgaagaaggggagggtgtaggaa

SEQ ID NO: 49982 - DNA, 35 bp, Artificial Sequence
  Synthetic oligonucleotide
tcgacgccggggactgcgcttctcttcgttcttaa

SEQ ID NO: 49983 - DNA, 35 bp, Artificial Sequence
  Synthetic oligonucleotide
tccagtccacgctttcaaccatatataactggaca

SEQ ID NO: 49984 - DNA, 35 bp, Artificial Sequence
  Synthetic oligonucleotide
gagttccccctacgagtgataccactgaccctaca

SEQ ID NO: 49985 - DNA, 36 bp, Artificial Sequence
  Synthetic oligonucleotide
gaaagggtcaaggaggggcaggctggttggggtaca

SEQ ID NO: 49986 - DNA, 36 bp, Artificial Sequence
  Synthetic oligonucleotide
gtcaacctctaaccaaccgccgctggcccgcaccca

SEQ ID NO: 49987 - DNA, 36 bp, Artificial Sequence
  Synthetic oligonucleotide
aacccagcacatattctattgaaagcaacctcccca

SEQ ID NO: 49988 - DNA, 36 bp, Artificial Sequence
  Synthetic oligonucleotide
ttccccagcgtgtcctcagctttctctcacctgtca

SEQ ID NO: 49989 - DNA, 37 bp, Artificial Sequence
  Synthetic oligonucleotide
tcggatgtcattgcctgtcacccgtgtctttattaga

SEQ ID NO: 49990 - DNA, 37 bp, Artificial Sequence
  Synthetic oligonucleotide
tcactgcgcgacctaggtgcgccatctgatttcccga

SEQ ID NO: 49991 - DNA, 37 bp, Artificial Sequence
  Synthetic oligonucleotide
gacgggaggagatatagactagaagtcaagaggggga

SEQ ID NO: 49992 - DNA, 37 bp, Artificial Sequence
  Synthetic oligonucleotide
acgttcctaacgtgctcctcatgttcctccgcctgga

SEQ ID NO: 49993 - DNA, 37 bp, Artificial Sequence
  Synthetic oligonucleotide
ggagacaaccgtagccgggaggggatggacaaaatga

SEQ ID NO: 49994 - DNA, 38 bp, Artificial Sequence
  Synthetic oligonucleotide
ggagatggccgtcacctgctactgccacatacttatga

SEQ ID NO: 49995 - DNA, 38 bp, Artificial Sequence
  Synthetic oligonucleotide
ggatcgccatccatgttcttccgtctctatgcttatga

SEQ ID NO: 49996 - DNA, 38 bp, Artificial Sequence
  Synthetic oligonucleotide
tatgaccccactgctgtgcaacgccctagtggccctga

SEQ ID NO: 49997 - DNA, 37 bp, Artificial Sequence
  Synthetic oligonucleotide
actcaacgctggactcgaattcatcttttgccgctga

SEQ ID NO: 49998 - DNA, 38 bp, Artificial Sequence
  Synthetic oligonucleotide
gcgtaacccggtacgccgtgcccgaccctctatgctga

SEQ ID NO: 49999 - DNA, 35 bp, Artificial Sequence
  Synthetic oligonucleotide
tcaaacccggttcgatcgcccggcaccatactata

SEQ ID NO: 50000 - DNA, 35 bp, Artificial Sequence
  Synthetic oligonucleotide
tatgacgagaggtgtgggtaactgttgaggcgcta

SEQ ID NO: 50001 - DNA, 36 bp, Artificial Sequence
  Synthetic oligonucleotide
gtctctccagtccaggccatgccctctgctttgcta

SEQ ID NO: 50002 - DNA, 35 bp, Artificial Sequence
  Synthetic oligonucleotide
gacccagtggacggtacctgccttgctttccttta

SEQ ID NO: 50003 - DNA, 35 bp, Artificial Sequence
  Synthetic oligonucleotide
ttgtggtcacgatggaacctctacgcgtctcccac

SEQ ID NO: 50004 - DNA, 35 bp, Artificial Sequence
  Synthetic oligonucleotide
tccgcgatccattggctcgtaatcggtgattctac

SEQ ID NO: 50005 - DNA, 35 bp, Artificial Sequence
  Synthetic oligonucleotide
tcgacggaaccagtagtgcccgtattttcgcttac

SEQ ID NO: 50006 - DNA, 35 bp, Artificial Sequence
  Synthetic oligonucleotide
aatgttccccaagcagtttgcccgccttctcttac

SEQ ID NO: 50007 - DNA, 35 bp, Artificial Sequence
  Synthetic oligonucleotide
tcaccctccctgggttactgcaccgcaggtaagcc

SEQ ID NO: 50008 - DNA, 35 bp, Artificial Sequence
  Synthetic oligonucleotide
aagtgcgtacattcaccttgctccactacttccgc

SEQ ID NO: 50009 - DNA, 35 bp, Artificial Sequence
  Synthetic oligonucleotide
atttgctcaactctgccgggctgtatctttcaatc

SEQ ID NO: 50010 - DNA, 35 bp, Artificial Sequence
  Synthetic oligonucleotide
ggcccatggtcagtctcgtcttatcctctccggtc

SEQ ID NO: 50011 - DNA, 35 bp, Artificial Sequence
  Synthetic oligonucleotide
tgtgcgcttatcgctggcgggccccaaattcattc

SEQ ID NO: 50012 - DNA, 35 bp, Artificial Sequence
  Synthetic oligonucleotide
gatgcacagcttgaaaagaactctcgcaccatacg

SEQ ID NO: 50013 - DNA, 35 bp, Artificial Sequence
  Synthetic oligonucleotide
gacatccctgactaccctactgcctgccatattcg

SEQ ID NO: 50014 - DNA, 35 bp, Artificial Sequence
  Synthetic oligonucleotide
tatcaccggcgaatagctattccgtagccatctgg

SEQ ID NO: 50015 - DNA, 35 bp, Artificial Sequence
  Synthetic oligonucleotide
gaacaactgagtgccccaaccccgctaaatgcgtg

SEQ ID NO: 50016 - DNA, 35 bp, Artificial Sequence
  Synthetic oligonucleotide
gcattcccccatgatccctaactgccctacggttg

SEQ ID NO: 50017 - DNA, 35 bp, Artificial Sequence
  Synthetic oligonucleotide
agcacatcgcgggtcgacccttttctacaattttg

SEQ ID NO: 50018 - DNA, 35 bp, Artificial Sequence
  Synthetic oligonucleotide
aagctcgcctccccccgctcgatccaaacagccat

SEQ ID NO: 50019 - DNA, 35 bp, Artificial Sequence
  Synthetic oligonucleotide
ttcgtaggacctccccgcttttatcagccccttat

SEQ ID NO: 50020 - DNA, 35 bp, Artificial Sequence
  Synthetic oligonucleotide
gtaagcccctatgcctaccaacctatacataccct

SEQ ID NO: 50021 - DNA, 35 bp, Artificial Sequence
  Synthetic oligonucleotide
tgtgtaccaacgacacgttgcctgtactcagccct

SEQ ID NO: 50022 - DNA, 35 bp, Artificial Sequence
  Synthetic oligonucleotide
aacgccttagccgttgggggggtcatggggtgggt

SEQ ID NO: 50023 - DNA, 35 bp, Artificial Sequence
  Synthetic oligonucleotide
gaccgcgtgcgacgctctgccctttctttattggt

SEQ ID NO: 50024 - DNA, 35 bp, Artificial Sequence
  Synthetic oligonucleotide
tacaatacactcttggaccacagcacaccccgtgt

SEQ ID NO: 50025 - DNA, 35 bp, Artificial Sequence
  Synthetic oligonucleotide
acgatgggtttgtcctggcacctcctgctgtactt

SEQ ID NO: 50026 - DNA, 35 bp, Artificial Sequence
  Synthetic oligonucleotide
tcctgtgcaatctcgcttgctggacccccttcttt

SEQ ID NO: 50027 - DNA, 36 bp, Artificial Sequence
  Synthetic oligonucleotide
tagcatgcccccgagcccctcatatccgacctgaaa

SEQ ID NO: 50028 - DNA, 36 bp, Artificial Sequence
  Synthetic oligonucleotide
agcaccccaccacgggaaggtgccctgatctctaaa

SEQ ID NO: 50029 - DNA, 36 bp, Artificial Sequence
  Synthetic oligonucleotide
gcgccgatctagtggcgccaatacccaccctttaaa

SEQ ID NO: 50030 - DNA, 35 bp, Artificial Sequence
  Synthetic oligonucleotide
tgaaacgcccatgcctctcgtcgacgcactttcaa

SEQ ID NO: 50031 - DNA, 36 bp, Artificial Sequence
  Synthetic oligonucleotide
tgaacccgtcctgtagcttcccacgactcgactgaa

SEQ ID NO: 50032 - DNA, 36 bp, Artificial Sequence
  Synthetic oligonucleotide
tgcacccactgaacgctaccgcctatcttgacataa

SEQ ID NO: 50033 - DNA, 36 bp, Artificial Sequence
  Synthetic oligonucleotide
aagggcgggcgatttgaagtttggtgggtgggttaa

SEQ ID NO: 50034 - DNA, 36 bp, Artificial Sequence
  Synthetic oligonucleotide
agtgagagggcatagtcgggccaacacacggtaaca

SEQ ID NO: 50035 - DNA, 35 bp, Artificial Sequence
  Synthetic oligonucleotide
tccgtccccatccagactctgaatccatttttaca

SEQ ID NO: 50036 - DNA, 36 bp, Artificial Sequence
  Synthetic oligonucleotide
tatcaacagaaaaccaaatgcagtgggggagtacca

SEQ ID NO: 50037 - DNA, 36 bp, Artificial Sequence
  Synthetic oligonucleotide
gcacatccgaccccgaaggcactcgtacttggccca

SEQ ID NO: 50038 - DNA, 35 bp, Artificial Sequence
  Synthetic oligonucleotide
accaccataaccggacatcgagcaaatagcgagca

SEQ ID NO: 50039 - DNA, 35 bp, Artificial Sequence
  Synthetic oligonucleotide
actcgcgcactcgattatattcttctccactatca

SEQ ID NO: 50040 - DNA, 37 bp, Artificial Sequence
  Synthetic oligonucleotide
tggatcccccgttcgctaccattcgcccagcctacga

SEQ ID NO: 50041 - DNA, 37 bp, Artificial Sequence
  Synthetic oligonucleotide
gcgctagtgcgctgtctcgaatgatctccctacccga

SEQ ID NO: 50042 - DNA, 35 bp, Artificial Sequence
  Synthetic oligonucleotide
taggtctgcggccaaacgtaccatccacttcccga

SEQ ID NO: 50043 - DNA, 37 bp, Artificial Sequence
  Synthetic oligonucleotide
gtcattcacgcctctgttaactactgttctcatccga

SEQ ID NO: 50044 - DNA, 37 bp, Artificial Sequence
  Synthetic oligonucleotide
tcgttccccgtcgtccccaaccctgtgcgttatccga

SEQ ID NO: 50045 - DNA, 37 bp, Artificial Sequence
  Synthetic oligonucleotide
gaccgaaacctaaggtaaaggggatagagggaaagga

SEQ ID NO: 50046 - DNA, 37 bp, Artificial Sequence
  Synthetic oligonucleotide
agggtggcgacggcatggggaggttcggaataaagga

SEQ ID NO: 50047 - DNA, 37 bp, Artificial Sequence
  Synthetic oligonucleotide
agattgaagggtaaaggtacgggaaagggaaagggga

SEQ ID NO: 50048 - DNA, 36 bp, Artificial Sequence
  Synthetic oligonucleotide
gtgaggaggctatgggggtaccagtaatgaggggga

SEQ ID NO: 50049 - DNA, 37 bp, Artificial Sequence
  Synthetic oligonucleotide
gtagggccacggtaggtaagaaggataatcatgggga

SEQ ID NO: 50050 - DNA, 37 bp, Artificial Sequence
  Synthetic oligonucleotide
gatggtgggagggtaggtttggggaagacgattggga

SEQ ID NO: 50051 - DNA, 36 bp, Artificial Sequence
  Synthetic oligonucleotide
accgagcgtcctcatcacctcacgaagccaacctga

SEQ ID NO: 50052 - DNA, 38 bp, Artificial Sequence
  Synthetic oligonucleotide
gattggccccgctaattggttttatcttgattccctga

SEQ ID NO: 50053 - DNA, 37 bp, Artificial Sequence
  Synthetic oligonucleotide
gcccgaccctgacgccgctcttacgacaattgcctga

SEQ ID NO: 50054 - DNA, 38 bp, Artificial Sequence
  Synthetic oligonucleotide
gacacgcagcacccatcgacttttgccaacttgcctga

SEQ ID NO: 50055 - DNA, 38 bp, Artificial Sequence
  Synthetic oligonucleotide
gagccgcaacattattgctatagcctactaccatctga

SEQ ID NO: 50056 - DNA, 37 bp, Artificial Sequence
  Synthetic oligonucleotide
tcacacgatgcaatcgtgccctaactatcttctgtga

SEQ ID NO: 50057 - DNA, 37 bp, Artificial Sequence
  Synthetic oligonucleotide
gttgacagctggccctttggcgaactctcctctttga

SEQ ID NO: 50058 - DNA, 35 bp, Artificial Sequence
  Synthetic oligonucleotide
acacgaccgtcggtcgattagggatttgaccccta

SEQ ID NO: 50059 - DNA, 36 bp, Artificial Sequence
  Synthetic oligonucleotide
acctccggaccctgtacagtccctaggatttatcta

SEQ ID NO: 50060 - DNA, 35 bp, Artificial Sequence
  Synthetic oligonucleotide
gaggccgattgcgctgggaagcctgtcatgtcccc

SEQ ID NO: 50061 - DNA, 35 bp, Artificial Sequence
  Synthetic oligonucleotide
tgcctccccgggctggaatgtaaccgatggtgccc

SEQ ID NO: 50062 - DNA, 35 bp, Artificial Sequence
  Synthetic oligonucleotide
gaccctgagtgaagttacaatgcatgtttgtctcc

SEQ ID NO: 50063 - DNA, 35 bp, Artificial Sequence
  Synthetic oligonucleotide
tacacgctcatcgccggtcgtcctcctcctcgcgc

SEQ ID NO: 50064 - DNA, 35 bp, Artificial Sequence
  Synthetic oligonucleotide
atcaccatacgttagcgactgacttattcctgcgc

SEQ ID NO: 50065 - DNA, 35 bp, Artificial Sequence
  Synthetic oligonucleotide
ttcaaccaagtaccgttgggatctgctcaccattc

SEQ ID NO: 50066 - DNA, 35 bp, Artificial Sequence
  Synthetic oligonucleotide
tgactgcccatgttattgcttttgtgcttccgttc

SEQ ID NO: 50067 - DNA, 35 bp, Artificial Sequence
  Synthetic oligonucleotide
gtgaacagcataggtgcagggaaataggtagtagg

SEQ ID NO: 50068 - DNA, 35 bp, Artificial Sequence
  Synthetic oligonucleotide
gacgctggccggtcacgatctttctttcctatcgg

SEQ ID NO: 50069 - DNA, 35 bp, Artificial Sequence
  Synthetic oligonucleotide
accgaagtactgtgagaatgggagatgaggtggtg

SEQ ID NO: 50070 - DNA, 35 bp, Artificial Sequence
  Synthetic oligonucleotide
gtcaccgtagaaactcgcttaggtctccagtaaat

SEQ ID NO: 50071 - DNA, 35 bp, Artificial Sequence
  Synthetic oligonucleotide
tccgacggacgcaccatccagtaccgctctccgat

SEQ ID NO: 50072 - DNA, 35 bp, Artificial Sequence
  Synthetic oligonucleotide
gagaaaagtgatcacggtgttggaaggggagggat

SEQ ID NO: 50073 - DNA, 35 bp, Artificial Sequence
  Synthetic oligonucleotide
gatatgtgggggtggtgggctttacgagtgtgtgt

SEQ ID NO: 50074 - DNA, 35 bp, Artificial Sequence
  Synthetic oligonucleotide
actcactacttggcccttgagctaacacggacttt

SEQ ID NO: 50075 - DNA, 35 bp, Artificial Sequence
  Synthetic oligonucleotide
accctcgcccctagtggacgctctctcaatgcaaa

SEQ ID NO: 50076 - DNA, 36 bp, Artificial Sequence
  Synthetic oligonucleotide
gcagaatagttgcggagggaaggggcacagggagaa

SEQ ID NO: 50077 - DNA, 36 bp, Artificial Sequence
  Synthetic oligonucleotide
tatcgcgaacttgcccgccggaggcttgttgcccca

SEQ ID NO: 50078 - DNA, 37 bp, Artificial Sequence
  Synthetic oligonucleotide
tctcacgcaccgtgcatctccagcttccatgggaaga

SEQ ID NO: 50079 - DNA, 37 bp, Artificial Sequence
  Synthetic oligonucleotide
taagtgtgtggtggtaaacggcggaagggctcatgga

SEQ ID NO: 50080 - DNA, 36 bp, Artificial Sequence
  Synthetic oligonucleotide
gagagagagaaggtgggtatgtaggtgggtggatga

SEQ ID NO: 50081 - DNA, 38 bp, Artificial Sequence
  Synthetic oligonucleotide
tgttacccctgagagttcgccatcgagtctccccctga

SEQ ID NO: 50082 - DNA, 37 bp, Artificial Sequence
  Synthetic oligonucleotide
actcgccttagacgcttggaatcattccccgccctga

SEQ ID NO: 50083 - DNA, 37 bp, Artificial Sequence
  Synthetic oligonucleotide
tcgaccgatatgcggggttctttctttctcttgctga

SEQ ID NO: 50084 - DNA, 37 bp, Artificial Sequence
  Synthetic oligonucleotide
ggactgaaaccggacggaacaaagggattgggagtga

SEQ ID NO: 50085 - DNA, 38 bp, Artificial Sequence
  Synthetic oligonucleotide
agctcgcgtgccccgccgcccagacccgccatccgtga

SEQ ID NO: 50086 - DNA, 38 bp, Artificial Sequence
  Synthetic oligonucleotide
tgcaccaacgaacccccaccacgagtcttgtctcgtga

SEQ ID NO: 50087 - DNA, 38 bp, Artificial Sequence
  Synthetic oligonucleotide
gctggggagctcatgggatttgggggaaaggtaggtga

SEQ ID NO: 50088 - DNA, 38 bp, Artificial Sequence
  Synthetic oligonucleotide
tgcccaacgctcaaccccccgtcgagacaggatggtga

SEQ ID NO: 50089 - DNA, 38 bp, Artificial Sequence
  Synthetic oligonucleotide
gccaacggtcaagtctctgcgggtcccttcttttgtga

SEQ ID NO: 50090 - DNA, 38 bp, Artificial Sequence
  Synthetic oligonucleotide
atccaccacaccgagggcgtaatgaaaacagcccttga

SEQ ID NO: 50091 - DNA, 38 bp, Artificial Sequence
  Synthetic oligonucleotide
gtgagaggggagacagggagatgcatgggatgggttga

SEQ ID NO: 50092 - DNA, 38 bp, Artificial Sequence
  Synthetic oligonucleotide
tccccgcccccgttgcttcttggtcgatttttggttga

SEQ ID NO: 50093 - DNA, 35 bp, Artificial Sequence
  Synthetic oligonucleotide
gcgacattcccacccacccatgttctcagtaccta

SEQ ID NO: 50094 - DNA, 36 bp, Artificial Sequence
  Synthetic oligonucleotide
accaacctgagggccatccattatgacaaggtgcta

SEQ ID NO: 50095 - DNA, 35 bp, Artificial Sequence
  Synthetic oligonucleotide
tttaccatccacgcgtataatcaacactatgtcta

SEQ ID NO: 50096 - DNA, 36 bp, Artificial Sequence
  Synthetic oligonucleotide
aaggcctgacagctactctatgccgcctacttctta

SEQ ID NO: 50097 - DNA, 35 bp, Artificial Sequence
  Synthetic oligonucleotide
gatgccacgaatatgcccggccttcctgtagtaac

SEQ ID NO: 50098 - DNA, 35 bp, Artificial Sequence
  Synthetic oligonucleotide
gcccgcgtgaaccattgttcacagaccgcctacac

SEQ ID NO: 50099 - DNA, 35 bp, Artificial Sequence
  Synthetic oligonucleotide
tgtcccttccccgaatatgcggtttcgcgactcac

SEQ ID NO: 50100 - DNA, 35 bp, Artificial Sequence
  Synthetic oligonucleotide
tcacgctcccgtcgctcttccgtatttgcctgtac

SEQ ID NO: 50101 - DNA, 35 bp, Artificial Sequence
  Synthetic oligonucleotide
tccgtctggcatttacctgttcaccatgcacaacc

SEQ ID NO: 50102 - DNA, 35 bp, Artificial Sequence
  Synthetic oligonucleotide
taactgtgtcgcccaggctgagaattcataacacc

SEQ ID NO: 50103 - DNA, 34 bp, Artificial Sequence
  Synthetic oligonucleotide
ataaccgccccccaggtacgctatggaatccgcc

SEQ ID NO: 50104 - DNA, 35 bp, Artificial Sequence
  Synthetic oligonucleotide
taggagcgtactcatcaccccctcgcgatacatcc

SEQ ID NO: 50105 - DNA, 35 bp, Artificial Sequence
  Synthetic oligonucleotide
ggactactcacggtcgccccttcatttccacgtcc

SEQ ID NO: 50106 - DNA, 35 bp, Artificial Sequence
  Synthetic oligonucleotide
acaccagcgagtctgccataacccagtcccgccgc

SEQ ID NO: 50107 - DNA, 35 bp, Artificial Sequence
  Synthetic oligonucleotide
gattccctcggaccgtgttgcatgcacgttttcgc

SEQ ID NO: 50108 - DNA, 35 bp, Artificial Sequence
  Synthetic oligonucleotide
gaagacactcgcgggcagtaatacgatctatcctc

SEQ ID NO: 50109 - DNA, 35 bp, Artificial Sequence
  Synthetic oligonucleotide
tagaccccaggaggtaggtggagtggggctagctc

SEQ ID NO: 50110 - DNA, 35 bp, Artificial Sequence
  Synthetic oligonucleotide
ggacaactgatcaccacatgtactccccgtccgtc

SEQ ID NO: 50111 - DNA, 35 bp, Artificial Sequence
  Synthetic oligonucleotide
tggacactatcatcccggtcatcgctttacccacg

SEQ ID NO: 50112 - DNA, 35 bp, Artificial Sequence
  Synthetic oligonucleotide
acccgacaagcttacccggtaagtccgccacttcg

SEQ ID NO: 50113 - DNA, 35 bp, Artificial Sequence
  Synthetic oligonucleotide
gcacgctccaactagccagcttaccctctcctctg

SEQ ID NO: 50114 - DNA, 35 bp, Artificial Sequence
  Synthetic oligonucleotide
gacgaagtagacgatcagcgggcagacacaaccat

SEQ ID NO: 50115 - DNA, 35 bp, Artificial Sequence
  Synthetic oligonucleotide
gtttccaaacccggcaactccccgattcgtactat

SEQ ID NO: 50116 - DNA, 35 bp, Artificial Sequence
  Synthetic oligonucleotide
aaaaacccgcaacaggtccgtccgaactaccgcct

SEQ ID NO: 50117 - DNA, 35 bp, Artificial Sequence
  Synthetic oligonucleotide
aacagacgcttaccggttaatatggccaatccgct

SEQ ID NO: 50118 - DNA, 35 bp, Artificial Sequence
  Synthetic oligonucleotide
tcatgccctacgcccactccatcgagcgcccctct

SEQ ID NO: 50119 - DNA, 35 bp, Artificial Sequence
  Synthetic oligonucleotide
tgacacgcactgtccataacctctcccgttctggt

SEQ ID NO: 50120 - DNA, 35 bp, Artificial Sequence
  Synthetic oligonucleotide
tccgcccaccccttgactcctggttcttcagggtt

SEQ ID NO: 50121 - DNA, 36 bp, Artificial Sequence
  Synthetic oligonucleotide
tcacggtccatgataacgcccccttcctcaacgcaa

SEQ ID NO: 50122 - DNA, 36 bp, Artificial Sequence
  Synthetic oligonucleotide
gcaccctgtttgtcgtggactaacggcctatcctaa

SEQ ID NO: 50123 - DNA, 36 bp, Artificial Sequence
  Synthetic oligonucleotide
gccgcccatcccattccatttaggctcgacctctaa

SEQ ID NO: 50124 - DNA, 35 bp, Artificial Sequence
  Synthetic oligonucleotide
tgcatctggttctgcctccaccatcgatacacaca

SEQ ID NO: 50125 - DNA, 36 bp, Artificial Sequence
  Synthetic oligonucleotide
acgccaacccacaagtcatcacaccaagcgctagca

SEQ ID NO: 50126 - DNA, 35 bp, Artificial Sequence
  Synthetic oligonucleotide
tcctcttccgataggtttcgattccctgattttca

SEQ ID NO: 50127 - DNA, 37 bp, Artificial Sequence
  Synthetic oligonucleotide
ttccacatcaccaataaagccgacttccgtaccaaga

SEQ ID NO: 50128 - DNA, 37 bp, Artificial Sequence
  Synthetic oligonucleotide
gtctacgcctgtcaactcgccgctcttattcagccga

SEQ ID NO: 50129 - DNA, 35 bp, Artificial Sequence
  Synthetic oligonucleotide
gctgactcccactacctgtaagaacgacttcgcga

SEQ ID NO: 50130 - DNA, 37 bp, Artificial Sequence
  Synthetic oligonucleotide
gcgccggccgcacggctagcatctcccctttattcga

SEQ ID NO: 50131 - DNA, 37 bp, Artificial Sequence
  Synthetic oligonucleotide
aggggagcatcgctcgggaggggcgtaagtagaggga

SEQ ID NO: 50132 - DNA, 37 bp, Artificial Sequence
  Synthetic oligonucleotide
acctcgatctcctgcctaaataagtgtgcgccctgga

SEQ ID NO: 50133 - DNA, 38 bp, Artificial Sequence
  Synthetic oligonucleotide
aacggtccgccctacttgcgttaaatctcatgccgtga

SEQ ID NO: 50134 - DNA, 38 bp, Artificial Sequence
  Synthetic oligonucleotide
tatagcgacagggcggtaggagggcggtgtatgggtga

SEQ ID NO: 50135 - DNA, 37 bp, Artificial Sequence
  Synthetic oligonucleotide
acgagtcggcactcctcgaatacaggttctctattga

SEQ ID NO: 50136 - DNA, 38 bp, Artificial Sequence
  Synthetic oligonucleotide
gatccgacgacggtagtacaaactctgttccttcttga

SEQ ID NO: 50137 - DNA, 37 bp, Artificial Sequence
  Synthetic oligonucleotide
gaccatcccagtcactttcctgtaactgtacatttga

SEQ ID NO: 50138 - DNA, 36 bp, Artificial Sequence
  Synthetic oligonucleotide
tgcaggggagaaaaggcaaggtaggtgtttggtata

SEQ ID NO: 50139 - DNA, 36 bp, Artificial Sequence
  Synthetic oligonucleotide
tacgcatctccatactccgtagtctacccacaccta

SEQ ID NO: 50140 - DNA, 36 bp, Artificial Sequence
  Synthetic oligonucleotide
acccgcctccctgacaccacctttgctctcgcccta

SEQ ID NO: 50141 - DNA, 35 bp, Artificial Sequence
  Synthetic oligonucleotide
ggacgtaaggtccaccgttgttcactcttctccta

SEQ ID NO: 50142 - DNA, 37 bp, Artificial Sequence
  Synthetic oligonucleotide
atgcacccttgcctatgcccccacacttggacaggta

SEQ ID NO: 50143 - DNA, 36 bp, Artificial Sequence
  Synthetic oligonucleotide
gaacgccgtgctgtactgtgcctttacctctttgta

SEQ ID NO: 50144 - DNA, 36 bp, Artificial Sequence
  Synthetic oligonucleotide
tactgagggaggggcggaaacggacggtcactatta

SEQ ID NO: 50145 - DNA, 35 bp, Artificial Sequence
  Synthetic oligonucleotide
tcacagtggcgccccttgtccgaagtctgctatta

SEQ ID NO: 50146 - DNA, 35 bp, Artificial Sequence
  Synthetic oligonucleotide
acacatgcagagtccgtccctttacgccatcttta

SEQ ID NO: 50147 - DNA, 35 bp, Artificial Sequence
  Synthetic oligonucleotide
gagatcccaaaacctctatgtgcaaacccccacac

SEQ ID NO: 50148 - DNA, 35 bp, Artificial Sequence
  Synthetic oligonucleotide
gcgggaccagctgacttcgttccgacccctacacc

SEQ ID NO: 50149 - DNA, 35 bp, Artificial Sequence
  Synthetic oligonucleotide
tacgaaggcccgtactacggtctccactctatacc

SEQ ID NO: 50150 - DNA, 35 bp, Artificial Sequence
  Synthetic oligonucleotide
tgcattaaatgtgttccctgtcctcgctgcatccc

SEQ ID NO: 50151 - DNA, 35 bp, Artificial Sequence
  Synthetic oligonucleotide
atcctaccacatgaagacttacttcgagtcaagcc

SEQ ID NO: 50152 - DNA, 35 bp, Artificial Sequence
  Synthetic oligonucleotide
aaccagtcgcgatcctttgctctattagtttggcc

SEQ ID NO: 50153 - DNA, 35 bp, Artificial Sequence
  Synthetic oligonucleotide
tcacttagcgcggagccgactctcaaatcccatcc

SEQ ID NO: 50154 - DNA, 35 bp, Artificial Sequence
  Synthetic oligonucleotide
ttccccccgcccatcctggtgtcttcaaacgctcc

SEQ ID NO: 50155 - DNA, 35 bp, Artificial Sequence
  Synthetic oligonucleotide
accacaacacacctggtggctgcataacaaaacgc

SEQ ID NO: 50156 - DNA, 35 bp, Artificial Sequence
  Synthetic oligonucleotide
gcaacgcccccactcctgcctctgtacttgtgcgc

SEQ ID NO: 50157 - DNA, 35 bp, Artificial Sequence
  Synthetic oligonucleotide
gcccatctgcctgttctgtccatccaatcctctgc

SEQ ID NO: 50158 - DNA, 35 bp, Artificial Sequence
  Synthetic oligonucleotide
tagtgccgactggggaacgttcatcccacaccctc

SEQ ID NO: 50159 - DNA, 35 bp, Artificial Sequence
  Synthetic oligonucleotide
tacgccgtgagtcatccgctgcagttctgcttgtc

SEQ ID NO: 50160 - DNA, 35 bp, Artificial Sequence
  Synthetic oligonucleotide
acgccctacacataccctcgagaagccggcttccg

SEQ ID NO: 50161 - DNA, 35 bp, Artificial Sequence
  Synthetic oligonucleotide
tagagggggagtgggatgggaagctatgttacatg

SEQ ID NO: 50162 - DNA, 35 bp, Artificial Sequence
  Synthetic oligonucleotide
attgcctgccccatttaccctgagatcctcccctg

SEQ ID NO: 50163 - DNA, 35 bp, Artificial Sequence
  Synthetic oligonucleotide
acgccgccttgcccaataccgtaactcgcctattg

SEQ ID NO: 50164 - DNA, 35 bp, Artificial Sequence
  Synthetic oligonucleotide
tactgcctcccgccttcctgcgatataatatcgat

SEQ ID NO: 50165 - DNA, 35 bp, Artificial Sequence
  Synthetic oligonucleotide
aacgtaccccatcccgtggcacttgctcgcactat

SEQ ID NO: 50166 - DNA, 35 bp, Artificial Sequence
  Synthetic oligonucleotide
gactaacaacgtggtttacgcaacattctttccct

SEQ ID NO: 50167 - DNA, 35 bp, Artificial Sequence
  Synthetic oligonucleotide
tccgccgctgtccatcgcggacgcctggccattct

SEQ ID NO: 50168 - DNA, 35 bp, Artificial Sequence
  Synthetic oligonucleotide
atcctagcgaagacgggcatgaaccgtatgttggt

SEQ ID NO: 50169 - DNA, 35 bp, Artificial Sequence
  Synthetic oligonucleotide
atcgcccccattgtgccgctactgtatgtacgatt

SEQ ID NO: 50170 - DNA, 35 bp, Artificial Sequence
  Synthetic oligonucleotide
tatgcaacgcgctcaaaactcgggcctgttccttt

SEQ ID NO: 50171 - DNA, 35 bp, Artificial Sequence
  Synthetic oligonucleotide
gtgacgccactggctttgaaactagtccttccaaa

SEQ ID NO: 50172 - DNA, 36 bp, Artificial Sequence
  Synthetic oligonucleotide
gcccatcggtccccccctccgtagagtactggtaaa

SEQ ID NO: 50173 - DNA, 36 bp, Artificial Sequence
  Synthetic oligonucleotide
acagtccgccactttagctggtaccgctttgccgaa

SEQ ID NO: 50174 - DNA, 37 bp, Artificial Sequence
  Synthetic oligonucleotide
ttaacacggggaaggaggtgactagcggagctgggaa

SEQ ID NO: 50175 - DNA, 35 bp, Artificial Sequence
  Synthetic oligonucleotide
tcaccatgcacagtaccgttgtagctggcttacca

SEQ ID NO: 50176 - DNA, 36 bp, Artificial Sequence
  Synthetic oligonucleotide
aacctccacgcgaataattgcgcttacctcgaccca

SEQ ID NO: 50177 - DNA, 35 bp, Artificial Sequence
  Synthetic oligonucleotide
agtactacactcaacgggtatccacatcatttgca

SEQ ID NO: 50178 - DNA, 36 bp, Artificial Sequence
  Synthetic oligonucleotide
acacccctcgtgtgtgtctacgcgccctgaaactca

SEQ ID NO: 50179 - DNA, 36 bp, Artificial Sequence
  Synthetic oligonucleotide
gctcactagcactgaccctccatccgaaagtcctca

SEQ ID NO: 50180 - DNA, 36 bp, Artificial Sequence
  Synthetic oligonucleotide
aagtgcagactcggccttacacttgctctccgttca

SEQ ID NO: 50181 - DNA, 37 bp, Artificial Sequence
  Synthetic oligonucleotide
agtgtgggggttaggtaggtcggggtaggggaccaga

SEQ ID NO: 50182 - DNA, 37 bp, Artificial Sequence
  Synthetic oligonucleotide
gacaggtggagggagtacaaagtaggaaaacgaacga

SEQ ID NO: 50183 - DNA, 37 bp, Artificial Sequence
  Synthetic oligonucleotide
gtggggagtggtgagggatatgaatggattggcacga

SEQ ID NO: 50184 - DNA, 37 bp, Artificial Sequence
  Synthetic oligonucleotide
acgcacgtacaagcgggttggtagggggggcgggcga

SEQ ID NO: 50185 - DNA, 36 bp, Artificial Sequence
  Synthetic oligonucleotide
gaggtgggaaaggcggagcggcacagtgacaatgga

SEQ ID NO: 50186 - DNA, 38 bp, Artificial Sequence
  Synthetic oligonucleotide
tcgcggatagcacgggggggggagaaccgaaagaatga

SEQ ID NO: 50187 - DNA, 37 bp, Artificial Sequence
  Synthetic oligonucleotide
gacgagtaggagaatggaacaacaggtggtacgatga

SEQ ID NO: 50188 - DNA, 37 bp, Artificial Sequence
  Synthetic oligonucleotide
tattgctcaggacgggagcgggtgggcccagggatga

SEQ ID NO: 50189 - DNA, 37 bp, Artificial Sequence
  Synthetic oligonucleotide
tccgacggggtagcatcctcccatcccgccaccctga

SEQ ID NO: 50190 - DNA, 37 bp, Artificial Sequence
  Synthetic oligonucleotide
gtccttgcacgtcagcatccccaattgtgccccctga

SEQ ID NO: 50191 - DNA, 38 bp, Artificial Sequence
  Synthetic oligonucleotide
tccgacgctctatttgcgttacacttgtctcatcctga

SEQ ID NO: 50192 - DNA, 37 bp, Artificial Sequence
  Synthetic oligonucleotide
taatctcacgctgcttagcgccgtccaattcctctga

SEQ ID NO: 50193 - DNA, 37 bp, Artificial Sequence
  Synthetic oligonucleotide
gacgctacgagggggggtggagttcagacaagagtga

SEQ ID NO: 50194 - DNA, 38 bp, Artificial Sequence
  Synthetic oligonucleotide
ttggtggggcggtacggcgggatcgggaaaaaacgtga

SEQ ID NO: 50195 - DNA, 38 bp, Artificial Sequence
  Synthetic oligonucleotide
ggagggggggaaattcggaaacggccacagtcccgtga

SEQ ID NO: 50196 - DNA, 38 bp, Artificial Sequence
  Synthetic oligonucleotide
tttcagccccagtgctcctttatgtcgtggtggtgtga

SEQ ID NO: 50197 - DNA, 38 bp, Artificial Sequence
  Synthetic oligonucleotide
gacgctaccactgcgaacatcacatacgaaattcttga

SEQ ID NO: 50198 - DNA, 35 bp, Artificial Sequence
  Synthetic oligonucleotide
ggacacctttgttgctatcctactccgactctata

SEQ ID NO: 50199 - DNA, 35 bp, Artificial Sequence
  Synthetic oligonucleotide
gacaagtgtctcacgtttgattcctgtcgttccta

SEQ ID NO: 50200 - DNA, 36 bp, Artificial Sequence
  Synthetic oligonucleotide
ggtgggagtgccaaaaataggaataggatgaaagta

SEQ ID NO: 50201 - DNA, 36 bp, Artificial Sequence
  Synthetic oligonucleotide
aactccaactacctgcatagcgaccaccgttccgta

SEQ ID NO: 50202 - DNA, 36 bp, Artificial Sequence
  Synthetic oligonucleotide
gatatgcatggcgctcttgcccctttgtacgtggta

SEQ ID NO: 50203 - DNA, 35 bp, Artificial Sequence
  Synthetic oligonucleotide
tttgacacccatgaatggtctatgtccactttgta

SEQ ID NO: 50204 - DNA, 35 bp, Artificial Sequence
  Synthetic oligonucleotide
taaagaaaagaggggtggtgcggtacgaaacatta

SEQ ID NO: 50205 - DNA, 36 bp, Artificial Sequence
  Synthetic oligonucleotide
gacacagcgcactttgattcgaaaacaccgggctta

SEQ ID NO: 50206 - DNA, 35 bp, Artificial Sequence
  Synthetic oligonucleotide
gcaccgctctgatatcacagcgccttgtcccttta

SEQ ID NO: 50207 - DNA, 36 bp, Artificial Sequence
  Synthetic oligonucleotide
tccacccgtcacatagctgccaatgtcctgccttta

SEQ ID NO: 50208 - DNA, 35 bp, Artificial Sequence
  Synthetic oligonucleotide
tcaccccatctacttctctagcgccgttgcccaac

SEQ ID NO: 50209 - DNA, 35 bp, Artificial Sequence
  Synthetic oligonucleotide
gagttgggaggagtatgcgggtgggacgaggacac

SEQ ID NO: 50210 - DNA, 35 bp, Artificial Sequence
  Synthetic oligonucleotide
tacaccactgtccgtctccccttccaagcccggac

SEQ ID NO: 50211 - DNA, 35 bp, Artificial Sequence
  Synthetic oligonucleotide
gcctgagcacgtccgttcgtctccttgcttgtgac

SEQ ID NO: 50212 - DNA, 35 bp, Artificial Sequence
  Synthetic oligonucleotide
gatggctcacgtgacggtagtcgccttctcgtacc

SEQ ID NO: 50213 - DNA, 35 bp, Artificial Sequence
  Synthetic oligonucleotide
tagcacccatgcaccttacatcatagggtttcgcc

SEQ ID NO: 50214 - DNA, 35 bp, Artificial Sequence
  Synthetic oligonucleotide
gcacagccctgccggccacttttatactttcctcc

SEQ ID NO: 50215 - DNA, 35 bp, Artificial Sequence
  Synthetic oligonucleotide
ggaccatccaagcagcatcaaagagcccactaggc

SEQ ID NO: 50216 - DNA, 35 bp, Artificial Sequence
  Synthetic oligonucleotide
gcacgttaggcagaccctctcgtacattgcgttgc

SEQ ID NO: 50217 - DNA, 35 bp, Artificial Sequence
  Synthetic oligonucleotide
tacgatcgtcacagatgctcaagctctatcatatc

SEQ ID NO: 50218 - DNA, 35 bp, Artificial Sequence
  Synthetic oligonucleotide
tgttaaccggtatagcccagcactcctgcctcctc

SEQ ID NO: 50219 - DNA, 35 bp, Artificial Sequence
  Synthetic oligonucleotide
ttgttgcgatcgcagctcccgtgccctcgcagctc

SEQ ID NO: 50220 - DNA, 35 bp, Artificial Sequence
  Synthetic oligonucleotide
gcccactgcaggacctgtatttgacaatcgctctc

SEQ ID NO: 50221 - DNA, 35 bp, Artificial Sequence
  Synthetic oligonucleotide
attgcgtatctccctgtcgaattgaaaccgctttc

SEQ ID NO: 50222 - DNA, 35 bp, Artificial Sequence
  Synthetic oligonucleotide
tcctcgtctgcccaggtaagttaacctctcatcag

SEQ ID NO: 50223 - DNA, 35 bp, Artificial Sequence
  Synthetic oligonucleotide
tccgtgtcctatccgtatcgtccatcctgtaccgg

SEQ ID NO: 50224 - DNA, 35 bp, Artificial Sequence
  Synthetic oligonucleotide
tcaacaccccggacggttctatagccctgcaatgg

SEQ ID NO: 50225 - DNA, 35 bp, Artificial Sequence
  Synthetic oligonucleotide
tagtagccgcttgattgattccctcatgtttttgg

SEQ ID NO: 50226 - DNA, 35 bp, Artificial Sequence
  Synthetic oligonucleotide
gatgtcaagctacccggacgggctgcaccctctat

SEQ ID NO: 50227 - DNA, 35 bp, Artificial Sequence
  Synthetic oligonucleotide
gacacagctgtctctaactttcaggcccgctgcct

SEQ ID NO: 50228 - DNA, 27 bp, Artificial Sequence
  Synthetic oligonucleotide
cccatgtccctgcaaacactccccgct

SEQ ID NO: 50229 - DNA, 35 bp, Artificial Sequence
  Synthetic oligonucleotide
atctcgctcacctttcctcgtacccgtgcttggct

SEQ ID NO: 50230 - DNA, 35 bp, Artificial Sequence
  Synthetic oligonucleotide
gccaacccaacgatcgtatccctacctcgcaccgt

SEQ ID NO: 50231 - DNA, 35 bp, Artificial Sequence
  Synthetic oligonucleotide
ggacactggggggaggggcctgaactcgaccatgt

SEQ ID NO: 50232 - DNA, 35 bp, Artificial Sequence
  Synthetic oligonucleotide
gtttgcaccggggctgatccccgctttcttcatgt

SEQ ID NO: 50233 - DNA, 35 bp, Artificial Sequence
  Synthetic oligonucleotide
atgaatgtcgcacgtgaaccctcgttacccctcaa

SEQ ID NO: 50234 - DNA, 35 bp, Artificial Sequence
  Synthetic oligonucleotide
gaagtcgatgactaactgcccccgttccttcaaca

SEQ ID NO: 50235 - DNA, 36 bp, Artificial Sequence
  Synthetic oligonucleotide
gacgaggcgctgtgttgtacttccacccgggccaca

SEQ ID NO: 50236 - DNA, 36 bp, Artificial Sequence
  Synthetic oligonucleotide
gtacgcttgccccgttttgcacggatcgacatccca

SEQ ID NO: 50237 - DNA, 35 bp, Artificial Sequence
  Synthetic oligonucleotide
tataccgctcgttccaccgcttctgtcatagtcca

SEQ ID NO: 50238 - DNA, 36 bp, Artificial Sequence
  Synthetic oligonucleotide
tcactccatccaggtcgagagcgcgctctccttgca

SEQ ID NO: 50239 - DNA, 35 bp, Artificial Sequence
  Synthetic oligonucleotide
ggagacgcatatggaattcactcctaccaccccga

SEQ ID NO: 50240 - DNA, 37 bp, Artificial Sequence
  Synthetic oligonucleotide
accctacacgcagagccttctcgtcccttaacttcga

SEQ ID NO: 50241 - DNA, 37 bp, Artificial Sequence
  Synthetic oligonucleotide
gactctaccccactcgtctcacagggacacttaagga

SEQ ID NO: 50242 - DNA, 37 bp, Artificial Sequence
  Synthetic oligonucleotide
gaccccacgcaccttgtcggagagaacattgcacgga

SEQ ID NO: 50243 - DNA, 37 bp, Artificial Sequence
  Synthetic oligonucleotide
tagaggtctgggacataggggaggctcgaatggggga

SEQ ID NO: 50244 - DNA, 36 bp, Artificial Sequence
  Synthetic oligonucleotide
tcacgtaaaagggaaggtatgggatgaggggtggga

SEQ ID NO: 50245 - DNA, 38 bp, Artificial Sequence
  Synthetic oligonucleotide
gtgcaagcacacttctctatcactgtgactacacctga

SEQ ID NO: 50246 - DNA, 37 bp, Artificial Sequence
  Synthetic oligonucleotide
ttcgtcgcgccgaatcgttgcctatcctcccgcctga

SEQ ID NO: 50247 - DNA, 37 bp, Artificial Sequence
  Synthetic oligonucleotide
gtgtgctcccccatcgcgaagcagcccatactcctga

SEQ ID NO: 50248 - DNA, 38 bp, Artificial Sequence
  Synthetic oligonucleotide
ggtcaacaagtcgcctatcgatcacgccatctttctga

SEQ ID NO: 50249 - DNA, 37 bp, Artificial Sequence
  Synthetic oligonucleotide
tcagtccgtgttcgatcataagccttttccaccgtga

SEQ ID NO: 50250 - DNA, 38 bp, Artificial Sequence
  Synthetic oligonucleotide
tgactgcactgcgcacacaacttggctccatcccgtga

SEQ ID NO: 50251 - DNA, 38 bp, Artificial Sequence
  Synthetic oligonucleotide
tgctgccatccccgaactcttctcgcgcctatccgtga

SEQ ID NO: 50252 - DNA, 38 bp, Artificial Sequence
  Synthetic oligonucleotide
gttgccgccactgtaaccataaattgatgccctcgtga

SEQ ID NO: 50253 - DNA, 38 bp, Artificial Sequence
  Synthetic oligonucleotide
tattggagcaaggcttgggtcggggggggcaagggtga

SEQ ID NO: 50254 - DNA, 37 bp, Artificial Sequence
  Synthetic oligonucleotide
attgccgagccgacctttgttaaatcgcccttattga

SEQ ID NO: 50255 - DNA, 37 bp, Artificial Sequence
  Synthetic oligonucleotide
tcccctccacccgaactatgacgacgcccgcacttga

SEQ ID NO: 50256 - DNA, 37 bp, Artificial Sequence
  Synthetic oligonucleotide
gaaacacctggcattattacaacgacgcttcgtttga

SEQ ID NO: 50257 - DNA, 35 bp, Artificial Sequence
  Synthetic oligonucleotide
acccctgatcgttcatccattcgtactgttgcata

SEQ ID NO: 50258 - DNA, 36 bp, Artificial Sequence
  Synthetic oligonucleotide
gtaaggggaagctgtaggtagggattgggtgggata

SEQ ID NO: 50259 - DNA, 36 bp, Artificial Sequence
  Synthetic oligonucleotide
acgccgtgcaagactggtaattagcccccccgtcta

SEQ ID NO: 50260 - DNA, 35 bp, Artificial Sequence
  Synthetic oligonucleotide
tctgcgattcgacgcgcactctatcgctttcttta

SEQ ID NO: 50261 - DNA, 35 bp, Artificial Sequence
  Synthetic oligonucleotide
tcagtgtaccaggagggctcatctctgctttttta

SEQ ID NO: 50262 - DNA, 35 bp, Artificial Sequence
  Synthetic oligonucleotide
gaaccacggcatcatatagaccagaagttctccac

SEQ ID NO: 50263 - DNA, 35 bp, Artificial Sequence
  Synthetic oligonucleotide
tgaaacatcataaggcattcggtcgcactatttac

SEQ ID NO: 50264 - DNA, 35 bp, Artificial Sequence
  Synthetic oligonucleotide
ttgttcaacaaacgtcggtgcgatcgatatttggc

SEQ ID NO: 50265 - DNA, 35 bp, Artificial Sequence
  Synthetic oligonucleotide
gcacatgccagatatggctcagccaacactcaatc

SEQ ID NO: 50266 - DNA, 36 bp, Artificial Sequence
  Synthetic oligonucleotide
tgatcgtccacagctcccgggaatatgcgcgccctc

SEQ ID NO: 50267 - DNA, 35 bp, Artificial Sequence
  Synthetic oligonucleotide
ttggtccaacgacttttcgcgtgttcttatctctc

SEQ ID NO: 50268 - DNA, 35 bp, Artificial Sequence
  Synthetic oligonucleotide
tagacccccactgtgcctgtcaagtacctgcttgg

SEQ ID NO: 50269 - DNA, 35 bp, Artificial Sequence
  Synthetic oligonucleotide
tcaaccatgcccatcttacgacccaacgacacatg

SEQ ID NO: 50270 - DNA, 35 bp, Artificial Sequence
  Synthetic oligonucleotide
tagagagcaagcctataagtgaaagaaagggggtg

SEQ ID NO: 50271 - DNA, 35 bp, Artificial Sequence
  Synthetic oligonucleotide
atgctgctcgcgccctgccgttacttttacctaat

SEQ ID NO: 50272 - DNA, 35 bp, Artificial Sequence
  Synthetic oligonucleotide
ttagcgcgtgcgtacctgcgtacttccgtttctat

SEQ ID NO: 50273 - DNA, 35 bp, Artificial Sequence
  Synthetic oligonucleotide
taccgtgtgggtaggaaggcaaggatgggagttat

SEQ ID NO: 50274 - DNA, 35 bp, Artificial Sequence
  Synthetic oligonucleotide
gcttgccctatccctctctacatgtccgcttgact

SEQ ID NO: 50275 - DNA, 35 bp, Artificial Sequence
  Synthetic oligonucleotide
tagatcggcgattacttcctgcttactatgcacct

SEQ ID NO: 50276 - DNA, 35 bp, Artificial Sequence
  Synthetic oligonucleotide
atgaagcgctagcgaatagtttgcttctcttatct

SEQ ID NO: 50277 - DNA, 35 bp, Artificial Sequence
  Synthetic oligonucleotide
tacgcgtactatcgtgatctttcaatcctcatggt

SEQ ID NO: 50278 - DNA, 35 bp, Artificial Sequence
  Synthetic oligonucleotide
tgctcggagcaacgccactagacgcgaacaccttt

SEQ ID NO: 50279 - DNA, 35 bp, Artificial Sequence
  Synthetic oligonucleotide
agagacaggggttggggagggggtaactagaataa

SEQ ID NO: 50280 - DNA, 35 bp, Artificial Sequence
  Synthetic oligonucleotide
acaaactacacttgagcagcctctttatctccgca

SEQ ID NO: 50281 - DNA, 36 bp, Artificial Sequence
  Synthetic oligonucleotide
gccgaacttccttgcgcccggtcctggcctacatca

SEQ ID NO: 50282 - DNA, 35 bp, Artificial Sequence
  Synthetic oligonucleotide
gtgcatatcagcccactctagtcccgcccgtttca

SEQ ID NO: 50283 - DNA, 36 bp, Artificial Sequence
  Synthetic oligonucleotide
gatgggactcgggtacggggtagggaacaaacaaga

SEQ ID NO: 50284 - DNA, 37 bp, Artificial Sequence
  Synthetic oligonucleotide
gtgggtgggcaggtgtatgaggaagattaaaaggaga

SEQ ID NO: 50285 - DNA, 37 bp, Artificial Sequence
  Synthetic oligonucleotide
tcacctactcctccacttcctgtaacatggtagacga

SEQ ID NO: 50286 - DNA, 37 bp, Artificial Sequence
  Synthetic oligonucleotide
gagccacgcattcggctcttagctgccagtcctccga

SEQ ID NO: 50287 - DNA, 37 bp, Artificial Sequence
  Synthetic oligonucleotide
tgacggcggtcaaccgtttgcctgattacttttccga

SEQ ID NO: 50288 - DNA, 37 bp, Artificial Sequence
  Synthetic oligonucleotide
ggaacgtgtttagtgggagggagtggcatgtgaggga

SEQ ID NO: 50289 - DNA, 36 bp, Artificial Sequence
  Synthetic oligonucleotide
gcgctagcatcgcagacttttctattttcactggga

SEQ ID NO: 50290 - DNA, 38 bp, Artificial Sequence
  Synthetic oligonucleotide
ggtccccacaaccgcgaatacttgagtcacccacatga

SEQ ID NO: 50291 - DNA, 38 bp, Artificial Sequence
  Synthetic oligonucleotide
ggacccccgcctgatggatgccctgaccatgcccctga

SEQ ID NO: 50292 - DNA, 38 bp, Artificial Sequence
  Synthetic oligonucleotide
agacctgccataactgtctcatagcaagccttccctga

SEQ ID NO: 50293 - DNA, 38 bp, Artificial Sequence
  Synthetic oligonucleotide
gtgtagcgcgttgtcgttgtcctttggccccttcctga

SEQ ID NO: 50294 - DNA, 36 bp, Artificial Sequence
  Synthetic oligonucleotide
gggtgagaagtggtaggagctggtgggggcgagtga

SEQ ID NO: 50295 - DNA, 37 bp, Artificial Sequence
  Synthetic oligonucleotide
gtttggcgtgccacattccgacctctacccaccgtga

SEQ ID NO: 50296 - DNA, 38 bp, Artificial Sequence
  Synthetic oligonucleotide
acgcgagatcccggggtggtctaattctgtgggggtga

SEQ ID NO: 50297 - DNA, 38 bp, Artificial Sequence
  Synthetic oligonucleotide
gctgatggtagaggcataatggaaaggcgtggtggtga

SEQ ID NO: 50298 - DNA, 37 bp, Artificial Sequence
  Synthetic oligonucleotide
tgggaggggggagcaaggtgggtaagcgcgaatgtga

SEQ ID NO: 50299 - DNA, 36 bp, Artificial Sequence
  Synthetic oligonucleotide
ttggccgggctggacattcccactccttcgctacta

SEQ ID NO: 50300 - DNA, 35 bp, Artificial Sequence
  Synthetic oligonucleotide
ggaaccactcctccgaaaatctgtccgtaagccta

SEQ ID NO: 50301 - DNA, 36 bp, Artificial Sequence
  Synthetic oligonucleotide
tcagatgggtgccctcgagtcctattcccgcttgta

SEQ ID NO: 50302 - DNA, 36 bp, Artificial Sequence
  Synthetic oligonucleotide
tacacctgccctgggcagtcatttttccccccctta

SEQ ID NO: 50303 - DNA, 35 bp, Artificial Sequence
  Synthetic oligonucleotide
gttaccacctgagcttgatttccccgattacggac

SEQ ID NO: 50304 - DNA, 35 bp, Artificial Sequence
  Synthetic oligonucleotide
ttaccaccacctattcatattttgggcttggatac

SEQ ID NO: 50305 - DNA, 35 bp, Artificial Sequence
  Synthetic oligonucleotide
taggtatcatcctcgcttttgccgtgagcccctac

SEQ ID NO: 50306 - DNA, 35 bp, Artificial Sequence
  Synthetic oligonucleotide
gcacgggcacgaagctcctaggtctctggtatacc

SEQ ID NO: 50307 - DNA, 35 bp, Artificial Sequence
  Synthetic oligonucleotide
gtttcagcccaactctcaatcggcaccagtttacc

SEQ ID NO: 50308 - DNA, 35 bp, Artificial Sequence
  Synthetic oligonucleotide
gttgctacattcttcacgtgctattcgccctctgc

SEQ ID NO: 50309 - DNA, 35 bp, Artificial Sequence
  Synthetic oligonucleotide
tttggaaggctgaggggggggatagagtttattgc

SEQ ID NO: 50310 - DNA, 35 bp, Artificial Sequence
  Synthetic oligonucleotide
tctgcactctcctcgctgaccgtcctgccctttgc

SEQ ID NO: 50311 - DNA, 35 bp, Artificial Sequence
  Synthetic oligonucleotide
tcaggacgggtctccggcaaccgacacctctaatc

SEQ ID NO: 50312 - DNA, 35 bp, Artificial Sequence
  Synthetic oligonucleotide
gtgcgcaaggccatcatttacacccctctcattag

SEQ ID NO: 50313 - DNA, 35 bp, Artificial Sequence
  Synthetic oligonucleotide
tgcagaatgggctgggattgggatgggtatttacg

SEQ ID NO: 50314 - DNA, 35 bp, Artificial Sequence
  Synthetic oligonucleotide
tagtgctgctgtacctaattcaaatgtccatttcg

SEQ ID NO: 50315 - DNA, 35 bp, Artificial Sequence
  Synthetic oligonucleotide
tcccagggggagtcctatcacacgctctatcactg

SEQ ID NO: 50316 - DNA, 35 bp, Artificial Sequence
  Synthetic oligonucleotide
gtccccccgttcgctgggcgttatgacaccatact

SEQ ID NO: 50317 - DNA, 35 bp, Artificial Sequence
  Synthetic oligonucleotide
agcatccgacctttttgtccctcactcaccctcgt

SEQ ID NO: 50318 - DNA, 35 bp, Artificial Sequence
  Synthetic oligonucleotide
atgctcgggtccggagccatctaaacatccttctt

SEQ ID NO: 50319 - DNA, 35 bp, Artificial Sequence
  Synthetic oligonucleotide
tgccgagcaatcgctccatcgcttcaagcgcattt

SEQ ID NO: 50320 - DNA, 36 bp, Artificial Sequence
  Synthetic oligonucleotide
acaaccgggggtatgtggaggctgaagcatgggtaa

SEQ ID NO: 50321 - DNA, 36 bp, Artificial Sequence
  Synthetic oligonucleotide
tagtatgcattccgcgtcgtttcgcccacctacaca

SEQ ID NO: 50322 - DNA, 35 bp, Artificial Sequence
  Synthetic oligonucleotide
aagacgacgctcaccttagtgccctcctccgccca

SEQ ID NO: 50323 - DNA, 35 bp, Artificial Sequence
  Synthetic oligonucleotide
gattgtgatgccggcaaaaggggtaggcgtgcgca

SEQ ID NO: 50324 - DNA, 36 bp, Artificial Sequence
  Synthetic oligonucleotide
gtgatcccgccggtcatgttcatcaaaattccatca

SEQ ID NO: 50325 - DNA, 37 bp, Artificial Sequence
  Synthetic oligonucleotide
gtgagaggaggagaggggaggggggtaggcttcgaga

SEQ ID NO: 50326 - DNA, 37 bp, Artificial Sequence
  Synthetic oligonucleotide
agccaagcccaacgcccgaactagcgaaacaatacga

SEQ ID NO: 50327 - DNA, 36 bp, Artificial Sequence
  Synthetic oligonucleotide
atccactactacccccgctgcctcaacctgctacga

SEQ ID NO: 50328 - DNA, 37 bp, Artificial Sequence
  Synthetic oligonucleotide
atgttccaccaccacgacaatatatgcgttcgcagga

SEQ ID NO: 50329 - DNA, 38 bp, Artificial Sequence
  Synthetic oligonucleotide
gacgccccgactgctgcacgacttagaccttgcgctga

SEQ ID NO: 50330 - DNA, 38 bp, Artificial Sequence
  Synthetic oligonucleotide
gcggggagctacggggaggcggagaagcggagatctga

SEQ ID NO: 50331 - DNA, 37 bp, Artificial Sequence
  Synthetic oligonucleotide
atgtacctacaccgcgcatcaccatctcgttacgtga

SEQ ID NO: 50332 - DNA, 37 bp, Artificial Sequence
  Synthetic oligonucleotide
gaggtcggggtgagggggaaggggatagggaaggtga

SEQ ID NO: 50333 - DNA, 38 bp, Artificial Sequence
  Synthetic oligonucleotide
ggtgtcgaggtgattagggtgggaaaaggaatgtgtga

SEQ ID NO: 50334 - DNA, 38 bp, Artificial Sequence
  Synthetic oligonucleotide
ttgccccgtgagccttcttcccttcaacgtcccgttga

SEQ ID NO: 50335 - DNA, 37 bp, Artificial Sequence
  Synthetic oligonucleotide
accacactcctattgccatttaacgggtcacggttga

SEQ ID NO: 50336 - DNA, 37 bp, Artificial Sequence
  Synthetic oligonucleotide
gagccaccccgtgaggcctcggatcccttccatttga

SEQ ID NO: 50337 - DNA, 38 bp, Artificial Sequence
  Synthetic oligonucleotide
gtcacggccgtaccttgtccttttgatgtcctctttga

SEQ ID NO: 50338 - DNA, 38 bp, Artificial Sequence
  Synthetic oligonucleotide
taacagcctcaaagccttcctttctcccgcccgtttga

SEQ ID NO: 50339 - DNA, 36 bp, Artificial Sequence
  Synthetic oligonucleotide
atgccgatcgccgttatgcaatttagccccccaata

SEQ ID NO: 50340 - DNA, 36 bp, Artificial Sequence
  Synthetic oligonucleotide
gacctgagggacggggtagagggaggagtctgcata

SEQ ID NO: 50341 - DNA, 37 bp, Artificial Sequence
  Synthetic oligonucleotide
accctgtgaccgttgctggggtcaaacttcccgtata

SEQ ID NO: 50342 - DNA, 36 bp, Artificial Sequence
  Synthetic oligonucleotide
tccacaacaccctctacggaggtaacacacaagcta

SEQ ID NO: 50343 - DNA, 35 bp, Artificial Sequence
  Synthetic oligonucleotide
gccccgctcctataccgcattgccggtttgcccac

SEQ ID NO: 50344 - DNA, 35 bp, Artificial Sequence
  Synthetic oligonucleotide
gataacatcccgcctgcttaactgccgcttagccc

SEQ ID NO: 50345 - DNA, 35 bp, Artificial Sequence
  Synthetic oligonucleotide
gtgatgccgctgcaagttctatcctgacggtgtcc

SEQ ID NO: 50346 - DNA, 35 bp, Artificial Sequence
  Synthetic oligonucleotide
tcgaacacttggaccggacgcacgtaacgccttcc

SEQ ID NO: 50347 - DNA, 36 bp, Artificial Sequence
  Synthetic oligonucleotide
tccacgccacggaactacgctctcaggatctctggc

SEQ ID NO: 50348 - DNA, 35 bp, Artificial Sequence
  Synthetic oligonucleotide
tgtatgacaatggatttaggtacccatctccctgc

SEQ ID NO: 50349 - DNA, 35 bp, Artificial Sequence
  Synthetic oligonucleotide
gactgagacgtaaatctgtcgcatcccttccttcg

SEQ ID NO: 50350 - DNA, 35 bp, Artificial Sequence
  Synthetic oligonucleotide
tccgatgagggcccccacagttctgagcacaacat

SEQ ID NO: 50351 - DNA, 35 bp, Artificial Sequence
  Synthetic oligonucleotide
actccctgtgccgagtgacaatggcactgttacat

SEQ ID NO: 50352 - DNA, 35 bp, Artificial Sequence
  Synthetic oligonucleotide
atcgaccatcgcgcatatctcattgtgtccgccat

SEQ ID NO: 50353 - DNA, 35 bp, Artificial Sequence
  Synthetic oligonucleotide
gcataccttccaccatccagcctttgagttttcat

SEQ ID NO: 50354 - DNA, 35 bp, Artificial Sequence
  Synthetic oligonucleotide
acccatcgctacctccacgccaaaaacgggacact

SEQ ID NO: 50355 - DNA, 35 bp, Artificial Sequence
  Synthetic oligonucleotide
atcttcgggtagctggtccttaccccctgtgccct

SEQ ID NO: 50356 - DNA, 35 bp, Artificial Sequence
  Synthetic oligonucleotide
gacacacatgggcattggcattcctagtaggtcct

SEQ ID NO: 50357 - DNA, 35 bp, Artificial Sequence
  Synthetic oligonucleotide
ttaggccgtggttctacaatccgcttgggccatct

SEQ ID NO: 50358 - DNA, 35 bp, Artificial Sequence
  Synthetic oligonucleotide
gtggggatccagcgcaacaacaacactactacggt

SEQ ID NO: 50359 - DNA, 35 bp, Artificial Sequence
  Synthetic oligonucleotide
attttagccgtctagttccaccccccctaggctgt

SEQ ID NO: 50360 - DNA, 35 bp, Artificial Sequence
  Synthetic oligonucleotide
gagtcaggcggtctaggctcttctccgggtctctt

SEQ ID NO: 50361 - DNA, 36 bp, Artificial Sequence
  Synthetic oligonucleotide
tccgtacctcccatgacaatacctcctgttgacaaa

SEQ ID NO: 50362 - DNA, 36 bp, Artificial Sequence
  Synthetic oligonucleotide
agtggcgctgccctatacgcgcttcttcaccccaaa

SEQ ID NO: 50363 - DNA, 36 bp, Artificial Sequence
  Synthetic oligonucleotide
gacgattcggtaagacgttcacttcggtcccatcaa

SEQ ID NO: 50364 - DNA, 35 bp, Artificial Sequence
  Synthetic oligonucleotide
atcaccaccgacctcaccaatacttagtttcggaa

SEQ ID NO: 50365 - DNA, 36 bp, Artificial Sequence
  Synthetic oligonucleotide
agcgccgccgcctgcaacatgttttcccgttttaca

SEQ ID NO: 50366 - DNA, 35 bp, Artificial Sequence
  Synthetic oligonucleotide
acactcggacacagttttggtcacccgtctcacca

SEQ ID NO: 50367 - DNA, 36 bp, Artificial Sequence
  Synthetic oligonucleotide
cacacctcgtgtcgttgaatcctgccgttgttccca

SEQ ID NO: 50368 - DNA, 36 bp, Artificial Sequence
  Synthetic oligonucleotide
aacccattcccgcagtactttcccatgcatgtggca

SEQ ID NO: 50369 - DNA, 36 bp, Artificial Sequence
  Synthetic oligonucleotide
tgacaactggcattctcgcgcgttactatctgtgca

SEQ ID NO: 50370 - DNA, 36 bp, Artificial Sequence
  Synthetic oligonucleotide
tgcgtgcccctcttttgcaaccgggccttattatca

SEQ ID NO: 50371 - DNA, 36 bp, Artificial Sequence
  Synthetic oligonucleotide
acactgactgcccgtcataatcaaagtcctggttca

SEQ ID NO: 50372 - DNA, 37 bp, Artificial Sequence
  Synthetic oligonucleotide
ttgggccagaaggcgagggaggggaaatttagtcaga

SEQ ID NO: 50373 - DNA, 36 bp, Artificial Sequence
  Synthetic oligonucleotide
tcccacccctgaatatgtctttacctcccactagga

SEQ ID NO: 50374 - DNA, 37 bp, Artificial Sequence
  Synthetic oligonucleotide
gaataggggacattaaggggcgggcacaggtggggga

SEQ ID NO: 50375 - DNA, 37 bp, Artificial Sequence
  Synthetic oligonucleotide
ggagcaacagatctttcattcacgatccccccttgga

SEQ ID NO: 50376 - DNA, 36 bp, Artificial Sequence
  Synthetic oligonucleotide
tccctgacaccacgcggctcactgcaatactttgga

SEQ ID NO: 50377 - DNA, 35 bp, Artificial Sequence
  Synthetic oligonucleotide
atccccgccctgtcgcctcgcttggtcccaaatga

SEQ ID NO: 50378 - DNA, 38 bp, Artificial Sequence
  Synthetic oligonucleotide
ttacgacaagcggtgtggtggtgagtgtgtgtggatga

SEQ ID NO: 50379 - DNA, 38 bp, Artificial Sequence
  Synthetic oligonucleotide
aactacctcacgaaaacaccgagcctggctcaacctga

SEQ ID NO: 50380 - DNA, 38 bp, Artificial Sequence
  Synthetic oligonucleotide
attgaccgcattcacgtcccgtttttgttatgccctga

SEQ ID NO: 50381 - DNA, 38 bp, Artificial Sequence
  Synthetic oligonucleotide
tacgaccacactacgactcgttgccgacttcctcctga

SEQ ID NO: 50382 - DNA, 37 bp, Artificial Sequence
  Synthetic oligonucleotide
atcctcgacaggctgtcttgactcctcctatttctga

SEQ ID NO: 50383 - DNA, 38 bp, Artificial Sequence
  Synthetic oligonucleotide
tgtcagatccacttttcttctgctctgcactgccgtga

SEQ ID NO: 50384 - DNA, 37 bp, Artificial Sequence
  Synthetic oligonucleotide
gaaacagagacgggttcaaggagaggaatacaggtga

SEQ ID NO: 50385 - DNA, 37 bp, Artificial Sequence
  Synthetic oligonucleotide
gctgactgagaggacgaaagaatggatgatggtgtga

SEQ ID NO: 50386 - DNA, 38 bp, Artificial Sequence
  Synthetic oligonucleotide
aggacgtacacggctttactgggccactcttaacttga

SEQ ID NO: 50387 - DNA, 38 bp, Artificial Sequence
  Synthetic oligonucleotide
cataggagctcaccttcctgaaaagatcctcgtcttga

SEQ ID NO: 50388 - DNA, 37 bp, Artificial Sequence
  Synthetic oligonucleotide
gtccccccaacgtgcttaaatctcacactcaggttga

SEQ ID NO: 50389 - DNA, 37 bp, Artificial Sequence
  Synthetic oligonucleotide
ccaacgccccctcgatcttcttagccactacctttga

SEQ ID NO: 50390 - DNA, 36 bp, Artificial Sequence
  Synthetic oligonucleotide
taccacgccgaccgtgcgtgatgactcgttgaaata

SEQ ID NO: 50391 - DNA, 36 bp, Artificial Sequence
  Synthetic oligonucleotide
gcctcttgtcctcaccgttcgtcgcgttcgccgcta

SEQ ID NO: 50392 - DNA, 35 bp, Artificial Sequence
  Synthetic oligonucleotide
gtcacacgatcaatgccgcagccagcttatttcta

SEQ ID NO: 50393 - DNA, 36 bp, Artificial Sequence
  Synthetic oligonucleotide
acaggaacgacgccttgacggaaggaggagggagta

SEQ ID NO: 50394 - DNA, 36 bp, Artificial Sequence
  Synthetic oligonucleotide
gtggtggtcggagattggttggaaggtgcttgggta

SEQ ID NO: 50395 - DNA, 36 bp, Artificial Sequence
  Synthetic oligonucleotide
ggaacagctgccacacatcttcccgacccggtggta

SEQ ID NO: 50396 - DNA, 36 bp, Artificial Sequence
  Synthetic oligonucleotide
gtcgccgccacatacattcagcgctcgcggatctta

SEQ ID NO: 50397 - DNA, 38 bp, Artificial Sequence
  Synthetic oligonucleotide
cctgccgcacgcaacacctatggcctgtttcaccttta

SEQ ID NO: 50398 - DNA, 35 bp, Artificial Sequence
  Synthetic oligonucleotide
gaccgacctgatactcccttaccgacacagcagac

SEQ ID NO: 50399 - DNA, 35 bp, Artificial Sequence
  Synthetic oligonucleotide
atgttcgcagccctcggatgcccatccgcaacacc

SEQ ID NO: 50400 - DNA, 35 bp, Artificial Sequence
  Synthetic oligonucleotide
gcaatccgccgagccgatatatgatgccgctcacc

SEQ ID NO: 50401 - DNA, 35 bp, Artificial Sequence
  Synthetic oligonucleotide
gaataacccgtggatctgtgctgccttgaccgccc

SEQ ID NO: 50402 - DNA, 35 bp, Artificial Sequence
  Synthetic oligonucleotide
aggggcccgtaacatcctcccaccccaaacatgcc

SEQ ID NO: 50403 - DNA, 35 bp, Artificial Sequence
  Synthetic oligonucleotide
tcttggacatcccggcctccgactttgctttttcc

SEQ ID NO: 50404 - DNA, 35 bp, Artificial Sequence
  Synthetic oligonucleotide
aagatcggcgggttaccccattacgccctcactgc

SEQ ID NO: 50405 - DNA, 35 bp, Artificial Sequence
  Synthetic oligonucleotide
ttctccacctcattggcacaaaccatacctcttgc

SEQ ID NO: 50406 - DNA, 35 bp, Artificial Sequence
  Synthetic oligonucleotide
aacttggcccggtctcctcttaggctttcgtactc

SEQ ID NO: 50407 - DNA, 35 bp, Artificial Sequence
  Synthetic oligonucleotide
tcatcctttgccgtgtaatggctcttatctgtttc

SEQ ID NO: 50408 - DNA, 35 bp, Artificial Sequence
  Synthetic oligonucleotide
acgtgcacaacggaaaaaagccgggggtgggggag

SEQ ID NO: 50409 - DNA, 35 bp, Artificial Sequence
  Synthetic oligonucleotide
aatgggcacgctgggtttagttggggttgggggag

SEQ ID NO: 50410 - DNA, 35 bp, Artificial Sequence
  Synthetic oligonucleotide
acacttcatccccattgttattagcaacccctgcg

SEQ ID NO: 50411 - DNA, 35 bp, Artificial Sequence
  Synthetic oligonucleotide
gcctgttgacgcgtctgttgatcctctcctttggg

SEQ ID NO: 50412 - DNA, 35 bp, Artificial Sequence
  Synthetic oligonucleotide
gccaaagcataatgggcgagatggtacactattgg

SEQ ID NO: 50413 - DNA, 35 bp, Artificial Sequence
  Synthetic oligonucleotide
ggtcaatcgggaatgcgtcctttctatacctctat

SEQ ID NO: 50414 - DNA, 35 bp, Artificial Sequence
  Synthetic oligonucleotide
accgcgtcggcctccacaagttctaccgtttaact

SEQ ID NO: 50415 - DNA, 35 bp, Artificial Sequence
  Synthetic oligonucleotide
gaaacgaccgcccgaagctatacctgaatttacct

SEQ ID NO: 50416 - DNA, 35 bp, Artificial Sequence
  Synthetic oligonucleotide
cccacccacctctgctactattgcccacacaagct

SEQ ID NO: 50417 - DNA, 35 bp, Artificial Sequence
  Synthetic oligonucleotide
acatccccgaggctgacttacgaagttcacgtgct

SEQ ID NO: 50418 - DNA, 35 bp, Artificial Sequence
  Synthetic oligonucleotide
accgatgtatgggctggaacgacgctcccttctct

SEQ ID NO: 50419 - DNA, 35 bp, Artificial Sequence
  Synthetic oligonucleotide
ttgtcacatcaattacaccgccgttcgtctcgtct

SEQ ID NO: 50420 - DNA, 35 bp, Artificial Sequence
  Synthetic oligonucleotide
tccccatgccgcctgcgtttttccttgactggcgt

SEQ ID NO: 50421 - DNA, 35 bp, Artificial Sequence
  Synthetic oligonucleotide
atcccatccggcatcttctgtatactatacgtggt

SEQ ID NO: 50422 - DNA, 35 bp, Artificial Sequence
  Synthetic oligonucleotide
agggccccaacacccatggttcagagctaccaatt

SEQ ID NO: 50423 - DNA, 35 bp, Artificial Sequence
  Synthetic oligonucleotide
acatgtcgcatgcaattctccgcggttcacacatt

SEQ ID NO: 50424 - DNA, 35 bp, Artificial Sequence
  Synthetic oligonucleotide
gaccgccatcaggttacttgccgactctcccacaa

SEQ ID NO: 50425 - DNA, 36 bp, Artificial Sequence
  Synthetic oligonucleotide
gaagagggagttgaagtttggtaggaaagtacagaa

SEQ ID NO: 50426 - DNA, 36 bp, Artificial Sequence
  Synthetic oligonucleotide
ttgtctagcccaccctcctcccggaagcaccacgaa

SEQ ID NO: 50427 - DNA, 36 bp, Artificial Sequence
  Synthetic oligonucleotide
gcgggaagggggcatagtaaccgggcagaacgtgaa

SEQ ID NO: 50428 - DNA, 36 bp, Artificial Sequence
  Synthetic oligonucleotide
tagaatggaatgatggggtggcgaggcgagcactaa

SEQ ID NO: 50429 - DNA, 36 bp, Artificial Sequence
  Synthetic oligonucleotide
atgacccgcaatgttttgcttggcatttgactaaca

SEQ ID NO: 50430 - DNA, 36 bp, Artificial Sequence
  Synthetic oligonucleotide
ggagacggagtgtaggtggattggacttaacggaca

SEQ ID NO: 50431 - DNA, 36 bp, Artificial Sequence
  Synthetic oligonucleotide
tacgccccctaccacctgccgtgagttagctgtcca

SEQ ID NO: 50432 - DNA, 35 bp, Artificial Sequence
  Synthetic oligonucleotide
actgtcaaaaacgggcgggcggggtctgggtagca

SEQ ID NO: 50433 - DNA, 36 bp, Artificial Sequence
  Synthetic oligonucleotide
tcccactccgcatttcaagataccactatcctggca

SEQ ID NO: 50434 - DNA, 36 bp, Artificial Sequence
  Synthetic oligonucleotide
tgccacactcgacactgttctcgccccgccactgca

SEQ ID NO: 50435 - DNA, 36 bp, Artificial Sequence
  Synthetic oligonucleotide
tccacaactggacataatgccatgggcgaccctgca

SEQ ID NO: 50436 - DNA, 35 bp, Artificial Sequence
  Synthetic oligonucleotide
ttcctggcggcacttcgcctatacacttctctgca

SEQ ID NO: 50437 - DNA, 35 bp, Artificial Sequence
  Synthetic oligonucleotide
ggtggctagggggatagcggggtagaggggggtca

SEQ ID NO: 50438 - DNA, 37 bp, Artificial Sequence
  Synthetic oligonucleotide
tgacagatagagacagagaaacaggaggagtggaaga

SEQ ID NO: 50439 - DNA, 37 bp, Artificial Sequence
  Synthetic oligonucleotide
tacggtcggggagttggagtgggggggaaatccgaga

SEQ ID NO: 50440 - DNA, 36 bp, Artificial Sequence
  Synthetic oligonucleotide
acccatctctcgaccgacgtgcatttttgtcgccga

SEQ ID NO: 50441 - DNA, 37 bp, Artificial Sequence
  Synthetic oligonucleotide
gtgtctgggggtgaagagtaggagcaggggatcagga

SEQ ID NO: 50442 - DNA, 36 bp, Artificial Sequence
  Synthetic oligonucleotide
gacagaacggggggggggcggactgatgccagagga

SEQ ID NO: 50443 - DNA, 38 bp, Artificial Sequence
  Synthetic oligonucleotide
tagtcgggcgggcggggaacatataaaacagtaaggga

SEQ ID NO: 50444 - DNA, 37 bp, Artificial Sequence
  Synthetic oligonucleotide
tggtaacgcgctggtgggagggtgaggaatcgaggga

SEQ ID NO: 50445 - DNA, 37 bp, Artificial Sequence
  Synthetic oligonucleotide
atacatcaggtcgggtgggcatgggtgggacaatgga

SEQ ID NO: 50446 - DNA, 38 bp, Artificial Sequence
  Synthetic oligonucleotide
tacacccacttggcaatacgacggttcatcatacatga

SEQ ID NO: 50447 - DNA, 37 bp, Artificial Sequence
  Synthetic oligonucleotide
tcacgcgcccgctgcttacaccctctcgcaggactga

SEQ ID NO: 50448 - DNA, 38 bp, Artificial Sequence
  Synthetic oligonucleotide
accgccataacgtaattgaacacacggccactctctga

SEQ ID NO: 50449 - DNA, 37 bp, Artificial Sequence
  Synthetic oligonucleotide
gacctaccactgtccaattccgacgactgtctcgtga

SEQ ID NO: 50450 - DNA, 38 bp, Artificial Sequence
  Synthetic oligonucleotide
aaagtcgagggaacaaggggaatagggaaactcggtga

SEQ ID NO: 50451 - DNA, 38 bp, Artificial Sequence
  Synthetic oligonucleotide
agtaccacccatgccgtagcgagtctagggcaacttga

SEQ ID NO: 50452 - DNA, 38 bp, Artificial Sequence
  Synthetic oligonucleotide
gacccacatgaatgcccagacgtcctttattcacttga

SEQ ID NO: 50453 - DNA, 37 bp, Artificial Sequence
  Synthetic oligonucleotide
gcgatcgcccctatgaaccttatacttacctagttga

SEQ ID NO: 50454 - DNA, 38 bp, Artificial Sequence
  Synthetic oligonucleotide
gggtgacctccacgcgctaaggcttcactctattttga

SEQ ID NO: 50455 - DNA, 36 bp, Artificial Sequence
  Synthetic oligonucleotide
aacgcccttccccgattatccaagtcactattgcta

SEQ ID NO: 50456 - DNA, 36 bp, Artificial Sequence
  Synthetic oligonucleotide
tcatacaacccgaacaggggaccatgtgccttgcta

SEQ ID NO: 50457 - DNA, 36 bp, Artificial Sequence
  Synthetic oligonucleotide
agacaccactgattaccctttaccaagctggctcta

SEQ ID NO: 50458 - DNA, 35 bp, Artificial Sequence
  Synthetic oligonucleotide
tccgcgtaccgcccttcagaccctattcatccgac

SEQ ID NO: 50459 - DNA, 35 bp, Artificial Sequence
  Synthetic oligonucleotide
agactcccatgccgagcacaagttttcccagttac

SEQ ID NO: 50460 - DNA, 35 bp, Artificial Sequence
  Synthetic oligonucleotide
tacgcccactcatctggattgacctcgctactacc

SEQ ID NO: 50461 - DNA, 35 bp, Artificial Sequence
  Synthetic oligonucleotide
gatggcccttcgcccttgggtctttcgcatacccc

SEQ ID NO: 50462 - DNA, 35 bp, Artificial Sequence
  Synthetic oligonucleotide
gcttgaccagcagtgcccgcctgcacgaaattgcc

SEQ ID NO: 50463 - DNA, 35 bp, Artificial Sequence
  Synthetic oligonucleotide
gcctccgaacgttaacgtcaatcttgtcacattcc

SEQ ID NO: 50464 - DNA, 35 bp, Artificial Sequence
  Synthetic oligonucleotide
ccccatccgcctttccgacaccaaggccccttcgc

SEQ ID NO: 50465 - DNA, 36 bp, Artificial Sequence
  Synthetic oligonucleotide
gcccatgcctcgtgctcgcttcaggcccccgacttc

SEQ ID NO: 50466 - DNA, 35 bp, Artificial Sequence
  Synthetic oligonucleotide
ttcaccccgccgggtgttcctgagtgatcttaaag

SEQ ID NO: 50467 - DNA, 35 bp, Artificial Sequence
  Synthetic oligonucleotide
acgggacgggagagcacctagggggatggggaaat

SEQ ID NO: 50468 - DNA, 35 bp, Artificial Sequence
  Synthetic oligonucleotide
gacagtgctccaaatcgctcgatcgatgctcacct

SEQ ID NO: 50469 - DNA, 35 bp, Artificial Sequence
  Synthetic oligonucleotide
gactggagggcaggtagtataggggggattcatct

SEQ ID NO: 50470 - DNA, 35 bp, Artificial Sequence
  Synthetic oligonucleotide
tagagccccctccgttccgcaaaggtcactgaatt

SEQ ID NO: 50471 - DNA, 35 bp, Artificial Sequence
  Synthetic oligonucleotide
tgcagatgccacaaccgcctcgctcatgatctctt

SEQ ID NO: 50472 - DNA, 35 bp, Artificial Sequence
  Synthetic oligonucleotide
tcttgcaatgaccgtaaacgcccctgtacctcgtt

SEQ ID NO: 50473 - DNA, 35 bp, Artificial Sequence
  Synthetic oligonucleotide
tccagggcgtcaggctcatgtagttcgccattgtt

SEQ ID NO: 50474 - DNA, 35 bp, Artificial Sequence
  Synthetic oligonucleotide
aaccccacgctgatgcccatgcctctcagctaaaa

SEQ ID NO: 50475 - DNA, 36 bp, Artificial Sequence
  Synthetic oligonucleotide
gtcacgcgacccctggctcttcgttaccgctggaca

SEQ ID NO: 50476 - DNA, 36 bp, Artificial Sequence
  Synthetic oligonucleotide
ttgcaccaatgcactccctggccgacctgtcctaca

SEQ ID NO: 50477 - DNA, 35 bp, Artificial Sequence
  Synthetic oligonucleotide
accacgccgcaagatcgatatgccatttttctaca

SEQ ID NO: 50478 - DNA, 35 bp, Artificial Sequence
  Synthetic oligonucleotide
aaaccctcccccaggtctcgataaatcgagcttca

SEQ ID NO: 50479 - DNA, 37 bp, Artificial Sequence
  Synthetic oligonucleotide
tcccctgcatctgtccgagccgcgctacctctctaga

SEQ ID NO: 50480 - DNA, 37 bp, Artificial Sequence
  Synthetic oligonucleotide
gtttgcgctaaggaagggaaaaaggggataaggacga

SEQ ID NO: 50481 - DNA, 36 bp, Artificial Sequence
  Synthetic oligonucleotide
ttcaccatccatttgtacccctccccttctgggcga

SEQ ID NO: 50482 - DNA, 37 bp, Artificial Sequence
  Synthetic oligonucleotide
tccgcaccttattgcacttttctacgacgcacttcga

SEQ ID NO: 50483 - DNA, 37 bp, Artificial Sequence
  Synthetic oligonucleotide
gttgcgagatagaggacgaggggaaacggaaaaagga

SEQ ID NO: 50484 - DNA, 36 bp, Artificial Sequence
  Synthetic oligonucleotide
gagatgggagtagaataagtggtgcatgggaaagga

SEQ ID NO: 50485 - DNA, 37 bp, Artificial Sequence
  Synthetic oligonucleotide
tgactgtccgccccctgattatggtgttcgttccgga

SEQ ID NO: 50486 - DNA, 36 bp, Artificial Sequence
  Synthetic oligonucleotide
accgacggtgttgtacaatgttggggaatttgggga

SEQ ID NO: 50487 - DNA, 38 bp, Artificial Sequence
  Synthetic oligonucleotide
tccgagtgccactttgttcatggtgcccgaccaaatga

SEQ ID NO: 50488 - DNA, 38 bp, Artificial Sequence
  Synthetic oligonucleotide
tcccccacctactagtcgttgtcatacacacggactga

SEQ ID NO: 50489 - DNA, 38 bp, Artificial Sequence
  Synthetic oligonucleotide
ggacagaggagagggcaataggggtgggcaatcgctga

SEQ ID NO: 50490 - DNA, 38 bp, Artificial Sequence
  Synthetic oligonucleotide
gaacctctcacacacgaccactatgccagtcttattga

SEQ ID NO: 50491 - DNA, 38 bp, Artificial Sequence
  Synthetic oligonucleotide
tgcacgaacgcgaattttctcatccagtcatgacttga

SEQ ID NO: 50492 - DNA, 37 bp, Artificial Sequence
  Synthetic oligonucleotide
ttgaccactcgacctccccccgcagtacgcaggttga

SEQ ID NO: 50493 - DNA, 38 bp, Artificial Sequence
  Synthetic oligonucleotide
aagaccagagaaacaggaggtgggaaggagagggttga

SEQ ID NO: 50494 - DNA, 38 bp, Artificial Sequence
  Synthetic oligonucleotide
gcaggcgaggtggaggggggggaacagcagcatgttga

SEQ ID NO: 50495 - DNA, 36 bp, Artificial Sequence
  Synthetic oligonucleotide
tcgcgactcgggcgggtagggctacaaaggggttta

SEQ ID NO: 50496 - DNA, 35 bp, Artificial Sequence
  Synthetic oligonucleotide
gtgcactcgaacagcctccccgacccgccgtttta

SEQ ID NO: 50497 - DNA, 35 bp, Artificial Sequence
  Synthetic oligonucleotide
gaatccacacgccatgtgcagtttatgtactccac

SEQ ID NO: 50498 - DNA, 35 bp, Artificial Sequence
  Synthetic oligonucleotide
gcgccttccaccaagtgtccttggcataatattac

SEQ ID NO: 50499 - DNA, 35 bp, Artificial Sequence
  Synthetic oligonucleotide
gcacatgagatcttcatattttcgttgcttgcccc

SEQ ID NO: 50500 - DNA, 35 bp, Artificial Sequence
  Synthetic oligonucleotide
gtgaactaccaccatccgtaatcttaggcccatcc

SEQ ID NO: 50501 - DNA, 35 bp, Artificial Sequence
  Synthetic oligonucleotide
cacatccctagctttgcagcatattaactgcctcc

SEQ ID NO: 50502 - DNA, 34 bp, Artificial Sequence
  Synthetic oligonucleotide
ttgaccgtacgaggagccccaattagtttgttcc

SEQ ID NO: 50503 - DNA, 35 bp, Artificial Sequence
  Synthetic oligonucleotide
tgcaatacctcaggcctacctgcctaaaggacctc

SEQ ID NO: 50504 - DNA, 35 bp, Artificial Sequence
  Synthetic oligonucleotide
tctcgtagcctcacaccgttcctttcgtccagctc

SEQ ID NO: 50505 - DNA, 35 bp, Artificial Sequence
  Synthetic oligonucleotide
tctcccgccacctcaccttcactttacagatagtc

SEQ ID NO: 50506 - DNA, 35 bp, Artificial Sequence
  Synthetic oligonucleotide
gccgtacgtcctccccgatatccaattggtccttc

SEQ ID NO: 50507 - DNA, 35 bp, Artificial Sequence
  Synthetic oligonucleotide
agatgtgcaacgcattgtcctccttcaactcttag

SEQ ID NO: 50508 - DNA, 35 bp, Artificial Sequence
  Synthetic oligonucleotide
taaccgtccaccaacgctctcttaccgtttacccg

SEQ ID NO: 50509 - DNA, 35 bp, Artificial Sequence
  Synthetic oligonucleotide
acgctaccctcctaatccggtgtcctcatactgcg

SEQ ID NO: 50510 - DNA, 35 bp, Artificial Sequence
  Synthetic oligonucleotide
tgcgttaccccgccactccgatcactccatagcgg

SEQ ID NO: 50511 - DNA, 35 bp, Artificial Sequence
  Synthetic oligonucleotide
accccgtttcatcaactgtcttcgcttttctaatg

SEQ ID NO: 50512 - DNA, 36 bp, Artificial Sequence
  Synthetic oligonucleotide
ttgaaccctcatgacgcctctcgcttttttcagatg

SEQ ID NO: 50513 - DNA, 35 bp, Artificial Sequence
  Synthetic oligonucleotide
gatgcgtggcccccggtttcctctagcttaagctg

SEQ ID NO: 50514 - DNA, 35 bp, Artificial Sequence
  Synthetic oligonucleotide
tgacactacttataaccacctgaacactttcgctg

SEQ ID NO: 50515 - DNA, 35 bp, Artificial Sequence
  Synthetic oligonucleotide
acaaccgggctctacacatgtcacccactttcgat

SEQ ID NO: 50516 - DNA, 35 bp, Artificial Sequence
  Synthetic oligonucleotide
tcacgggtgtctggcgctcgaccccttatctgcct

SEQ ID NO: 50517 - DNA, 35 bp, Artificial Sequence
  Synthetic oligonucleotide
gtgcgccttacatattctattgcgcgtttttgcct

SEQ ID NO: 50518 - DNA, 35 bp, Artificial Sequence
  Synthetic oligonucleotide
tcctggtgtcagctactcttcgtactctgcccgct

SEQ ID NO: 50519 - DNA, 35 bp, Artificial Sequence
  Synthetic oligonucleotide
tcaccgccgcagacccgttttcgcattgtactgct

SEQ ID NO: 50520 - DNA, 35 bp, Artificial Sequence
  Synthetic oligonucleotide
ataccactgatgtgtccggcccatccaataacttt

SEQ ID NO: 50521 - DNA, 35 bp, Artificial Sequence
  Synthetic oligonucleotide
tgtgccgaacatctcaaggagctcctacactccaa

SEQ ID NO: 50522 - DNA, 36 bp, Artificial Sequence
  Synthetic oligonucleotide
tcaaccgctcccttccctctaactaagaccacgtaa

SEQ ID NO: 50523 - DNA, 36 bp, Artificial Sequence
  Synthetic oligonucleotide
tgaccaggggtgtgtcggagggtgggggcctgaaca

SEQ ID NO: 50524 - DNA, 36 bp, Artificial Sequence
  Synthetic oligonucleotide
actaccactgccctacgcctgcactaggcaatcaca

SEQ ID NO: 50525 - DNA, 36 bp, Artificial Sequence
  Synthetic oligonucleotide
tcactacccgccccagaatttctttcgcttaggcca

SEQ ID NO: 50526 - DNA, 35 bp, Artificial Sequence
  Synthetic oligonucleotide
aattagcccacactcctgaacgttcgcctgatcca

SEQ ID NO: 50527 - DNA, 35 bp, Artificial Sequence
  Synthetic oligonucleotide
gcatagcgtgctcatcctctgtgctgtaaccttca

SEQ ID NO: 50528 - DNA, 37 bp, Artificial Sequence
  Synthetic oligonucleotide
gatcatggggatgcagtgacgggagtacgagggtaga

SEQ ID NO: 50529 - DNA, 37 bp, Artificial Sequence
  Synthetic oligonucleotide
gagtgatggtactagatggatggaaggggagtgtaga

SEQ ID NO: 50530 - DNA, 37 bp, Artificial Sequence
  Synthetic oligonucleotide
agtcgggggggcatttttgggctgggagtcaacccga

SEQ ID NO: 50531 - DNA, 37 bp, Artificial Sequence
  Synthetic oligonucleotide
gcaagggggggggcaaggagcaattgcaggtgatcga

SEQ ID NO: 50532 - DNA, 37 bp, Artificial Sequence
  Synthetic oligonucleotide
gtgcaggtaggtaagatagggcaggcaggcggaagga

SEQ ID NO: 50533 - DNA, 37 bp, Artificial Sequence
  Synthetic oligonucleotide
agattcgaaggggggcggcctgagacggacaaacgga

SEQ ID NO: 50534 - DNA, 36 bp, Artificial Sequence
  Synthetic oligonucleotide
gagagaggggcaatttgcacaaggatgggcggggga

SEQ ID NO: 50535 - DNA, 37 bp, Artificial Sequence
  Synthetic oligonucleotide
gataggcgccacagccgatatatttctcctcttggga

SEQ ID NO: 50536 - DNA, 38 bp, Artificial Sequence
  Synthetic oligonucleotide
tcatcaccgagagcaggtgctaactgcacaataactga

SEQ ID NO: 50537 - DNA, 37 bp, Artificial Sequence
  Synthetic oligonucleotide
ggtggaggaggcgaagtgggtgcagacggacgactga

SEQ ID NO: 50538 - DNA, 38 bp, Artificial Sequence
  Synthetic oligonucleotide
ggacaatctcagaccatatcccggcactaccctactga

SEQ ID NO: 50539 - DNA, 38 bp, Artificial Sequence
  Synthetic oligonucleotide
ggtccaccacagacgattatgcggccacccacatctga

SEQ ID NO: 50540 - DNA, 38 bp, Artificial Sequence
  Synthetic oligonucleotide
atcccagtccaccatgatcagctgcaacacacacgtga

SEQ ID NO: 50541 - DNA, 38 bp, Artificial Sequence
  Synthetic oligonucleotide
tggtccgatgtgcagggctggggtagggcggggggtga

SEQ ID NO: 50542 - DNA, 38 bp, Artificial Sequence
  Synthetic oligonucleotide
gacaccctatccgctcaggactgcaatatctcttgtga

SEQ ID NO: 50543 - DNA, 38 bp, Artificial Sequence
  Synthetic oligonucleotide
atcgcccctcaattcgctgagctagtatctatcattga

SEQ ID NO: 50544 - DNA, 37 bp, Artificial Sequence
  Synthetic oligonucleotide
gctcatagctgctctctattcctccccccgtggttga

SEQ ID NO: 50545 - DNA, 36 bp, Artificial Sequence
  Synthetic oligonucleotide
ttgcccctcccttccgtagagccactatatttgata

SEQ ID NO: 50546 - DNA, 35 bp, Artificial Sequence
  Synthetic oligonucleotide
gccctccttacgtgttttacatttccattctgtta

SEQ ID NO: 50547 - DNA, 35 bp, Artificial Sequence
  Synthetic oligonucleotide
gccttcgaactcatctgcttttcatccgcgcacac

SEQ ID NO: 50548 - DNA, 35 bp, Artificial Sequence
  Synthetic oligonucleotide
gtctccctcacgttcctcgcgaactgcgccctgac

SEQ ID NO: 50549 - DNA, 35 bp, Artificial Sequence
  Synthetic oligonucleotide
tacgctgtgccccccgcgggcttacatccatttac

SEQ ID NO: 50550 - DNA, 35 bp, Artificial Sequence
  Synthetic oligonucleotide
tcaattggtgtcagtgctctctcttcgttcacacc

SEQ ID NO: 50551 - DNA, 35 bp, Artificial Sequence
  Synthetic oligonucleotide
taacccgaggttcccccttacggcacaccctgccc

SEQ ID NO: 50552 - DNA, 35 bp, Artificial Sequence
  Synthetic oligonucleotide
tcgaccccgtgcacggatcgacccccttatgtccc

SEQ ID NO: 50553 - DNA, 35 bp, Artificial Sequence
  Synthetic oligonucleotide
gactgcagtaagtacacccttgtcaaccgcaagcc

SEQ ID NO: 50554 - DNA, 35 bp, Artificial Sequence
  Synthetic oligonucleotide
ggccacatatcatggttcactagcttcccatcgcc

SEQ ID NO: 50555 - DNA, 35 bp, Artificial Sequence
  Synthetic oligonucleotide
acacactcccttgtccgccttttagtgcatgatcc

SEQ ID NO: 50556 - DNA, 35 bp, Artificial Sequence
  Synthetic oligonucleotide
gcctcgcccctcccgttaaattcagccggccgtcc

SEQ ID NO: 50557 - DNA, 35 bp, Artificial Sequence
  Synthetic oligonucleotide
tttcggtagcccgacacctggtactattacgcctc

SEQ ID NO: 50558 - DNA, 35 bp, Artificial Sequence
  Synthetic oligonucleotide
tcgccctcatttttgccgagaacgctatctcattc

SEQ ID NO: 50559 - DNA, 35 bp, Artificial Sequence
  Synthetic oligonucleotide
ataccttcaccggccccgttaatccgtctccttgg

SEQ ID NO: 50560 - DNA, 35 bp, Artificial Sequence
  Synthetic oligonucleotide
tagtgcgcttgcaaccccgctcctcgaattgcctg

SEQ ID NO: 50561 - DNA, 35 bp, Artificial Sequence
  Synthetic oligonucleotide
gcgaaacaagccagatgaaaggaaattatggggtg

SEQ ID NO: 50562 - DNA, 35 bp, Artificial Sequence
  Synthetic oligonucleotide
gctcatcaatgcctttctaccccgctgggtaccat

SEQ ID NO: 50563 - DNA, 35 bp, Artificial Sequence
  Synthetic oligonucleotide
gaaacgcgcgtttctcctgtgctctccaactccct

SEQ ID NO: 50564 - DNA, 35 bp, Artificial Sequence
  Synthetic oligonucleotide
gcaatacgaaggctattagcatgcttccccaatct

SEQ ID NO: 50565 - DNA, 35 bp, Artificial Sequence
  Synthetic oligonucleotide
gaaggcaaagggtgttagggtgggctgatagtggt

SEQ ID NO: 50566 - DNA, 36 bp, Artificial Sequence
  Synthetic oligonucleotide
gtcaccctgattttcaactgcccctagccggaacaa

SEQ ID NO: 50567 - DNA, 36 bp, Artificial Sequence
  Synthetic oligonucleotide
gccagggtctctgaacacggaatcatcactgcacaa

SEQ ID NO: 50568 - DNA, 36 bp, Artificial Sequence
  Synthetic oligonucleotide
gccgaaccggcatgagggcgactactatgacagtaa

SEQ ID NO: 50569 - DNA, 36 bp, Artificial Sequence
  Synthetic oligonucleotide
ttggtccgctccctcgccttcagtagccaatgaaca

SEQ ID NO: 50570 - DNA, 36 bp, Artificial Sequence
  Synthetic oligonucleotide
taccagaacgttcgcgaagttacttgtttcaaccca

SEQ ID NO: 50571 - DNA, 35 bp, Artificial Sequence
  Synthetic oligonucleotide
tcctacactcgaacatgtcgaccccttagtatcca

SEQ ID NO: 50572 - DNA, 36 bp, Artificial Sequence
  Synthetic oligonucleotide
tcacccactcgccatgctaggtgactttccattgca

SEQ ID NO: 50573 - DNA, 36 bp, Artificial Sequence
  Synthetic oligonucleotide
tggggcactccgtcccgcggattttcttgttttgca

SEQ ID NO: 50574 - DNA, 36 bp, Artificial Sequence
  Synthetic oligonucleotide
tccagacaatctggggactattctacttgcttttca

SEQ ID NO: 50575 - DNA, 37 bp, Artificial Sequence
  Synthetic oligonucleotide
gaatgggtcggagggggtgcgggggaagtcaaggaga

SEQ ID NO: 50576 - DNA, 35 bp, Artificial Sequence
  Synthetic oligonucleotide
accccatgacccaagcatcttttctcgtcgataga

SEQ ID NO: 50577 - DNA, 37 bp, Artificial Sequence
  Synthetic oligonucleotide
tacacaccacaccgccaacctctagtctagcgcgcga

SEQ ID NO: 50578 - DNA, 37 bp, Artificial Sequence
  Synthetic oligonucleotide
aactcccaaatgctagacctacgcgtcatgtcccgga

SEQ ID NO: 50579 - DNA, 37 bp, Artificial Sequence
  Synthetic oligonucleotide
tcactccccgccactctactggggcactccccaggga

SEQ ID NO: 50580 - DNA, 37 bp, Artificial Sequence
  Synthetic oligonucleotide
aagggggtgtggtgggctgattattggagggacggga

SEQ ID NO: 50581 - DNA, 37 bp, Artificial Sequence
  Synthetic oligonucleotide
gtcaacgagatgagtggtgctggtgtaggcgagggga

SEQ ID NO: 50582 - DNA, 37 bp, Artificial Sequence
  Synthetic oligonucleotide
ggataggaggaaaaatgagggtagacgagatagggga

SEQ ID NO: 50583 - DNA, 36 bp, Artificial Sequence
  Synthetic oligonucleotide
gcgataggggctggaagtaccagcatgaggggggga

SEQ ID NO: 50584 - DNA, 36 bp, Artificial Sequence
  Synthetic oligonucleotide
agtgaaagagggcaggatatcagttggtggggggga

SEQ ID NO: 50585 - DNA, 37 bp, Artificial Sequence
  Synthetic oligonucleotide
acaacgaaaaggggctgggaaacgcgggacgtgggga

SEQ ID NO: 50586 - DNA, 37 bp, Artificial Sequence
  Synthetic oligonucleotide
ttctagggggagggggacgagaatactgggattggga

SEQ ID NO: 50587 - DNA, 38 bp, Artificial Sequence
  Synthetic oligonucleotide
tcgatgcacctcctgcctttacaatctacaatctatga

SEQ ID NO: 50588 - DNA, 38 bp, Artificial Sequence
  Synthetic oligonucleotide
gatgactccgttccagtttcgtacatccggtttcctga

SEQ ID NO: 50589 - DNA, 38 bp, Artificial Sequence
  Synthetic oligonucleotide
tccgacccccccgacaagcttgctcgtacactatgtga

SEQ ID NO: 50590 - DNA, 38 bp, Artificial Sequence
  Synthetic oligonucleotide
ttccctcgcctagcattggcatccacggtcacttgtga

SEQ ID NO: 50591 - DNA, 38 bp, Artificial Sequence
  Synthetic oligonucleotide
gagacagagtgccggagggaagaagtaaggaatattga

SEQ ID NO: 50592 - DNA, 34 bp, Artificial Sequence
  Synthetic oligonucleotide
gacctcacgcttctaccgcatttgatcttcttga

SEQ ID NO: 50593 - DNA, 38 bp, Artificial Sequence
  Synthetic oligonucleotide
atccaggccccgatcgtagtttatcgcgcttgctttga

SEQ ID NO: 50594 - DNA, 36 bp, Artificial Sequence
  Synthetic oligonucleotide
gagccgcactcacccggggtaccgttttccgccata

SEQ ID NO: 50595 - DNA, 35 bp, Artificial Sequence
  Synthetic oligonucleotide
ttcacttctggtcccacacggttactcctcctgta

SEQ ID NO: 50596 - DNA, 36 bp, Artificial Sequence
  Synthetic oligonucleotide
gtgagagctctctcctgttcacttttgcctgtttta

SEQ ID NO: 50597 - DNA, 35 bp, Artificial Sequence
  Synthetic oligonucleotide
aaaccggacgttcctgctcacgctatacctagtac

SEQ ID NO: 50598 - DNA, 35 bp, Artificial Sequence
  Synthetic oligonucleotide
agacgaccctaagacagtctcccactccgtcgtac

SEQ ID NO: 50599 - DNA, 36 bp, Artificial Sequence
  Synthetic oligonucleotide
gacgctcactagcacagtctgaccctgccggaaccc

SEQ ID NO: 50600 - DNA, 35 bp, Artificial Sequence
  Synthetic oligonucleotide
tggtccgtacgcccaaaacttctagcgagccctgc

SEQ ID NO: 50601 - DNA, 35 bp, Artificial Sequence
  Synthetic oligonucleotide
gagggtgaccgaagatcccgctatttctgccctgc

SEQ ID NO: 50602 - DNA, 35 bp, Artificial Sequence
  Synthetic oligonucleotide
tcccagtcctcattcgcatccgctagggttcgtgc

SEQ ID NO: 50603 - DNA, 35 bp, Artificial Sequence
  Synthetic oligonucleotide
tgaaatcacgctgcccttagtgcctcggaacaatc

SEQ ID NO: 50604 - DNA, 35 bp, Artificial Sequence
  Synthetic oligonucleotide
tcagccctctcacttttggttttgtatgtcttatc

SEQ ID NO: 50605 - DNA, 35 bp, Artificial Sequence
  Synthetic oligonucleotide
ggagcaaacgtgccgaccagcggtgccttcctctc

SEQ ID NO: 50606 - DNA, 34 bp, Artificial Sequence
  Synthetic oligonucleotide
tacggtatcaaccgtacaatttacgcccctggtc

SEQ ID NO: 50607 - DNA, 35 bp, Artificial Sequence
  Synthetic oligonucleotide
agctggtcaatccctccggcttcccgatccgcacg

SEQ ID NO: 50608 - DNA, 34 bp, Artificial Sequence
  Synthetic oligonucleotide
acctaccctcgccccattctatgagccccacgcg

SEQ ID NO: 50609 - DNA, 35 bp, Artificial Sequence
  Synthetic oligonucleotide
gatgatagggtagtcttggggtggtgtgggaatgg

SEQ ID NO: 50610 - DNA, 35 bp, Artificial Sequence
  Synthetic oligonucleotide
gtccaggaaggaggttgccgattgaggggcggatg

SEQ ID NO: 50611 - DNA, 35 bp, Artificial Sequence
  Synthetic oligonucleotide
agctaacgcacctaatcctgtaccgcccctaattg

SEQ ID NO: 50612 - DNA, 35 bp, Artificial Sequence
  Synthetic oligonucleotide
tcctgcaacacccatccatggtatctcagtctttg

SEQ ID NO: 50613 - DNA, 35 bp, Artificial Sequence
  Synthetic oligonucleotide
aaccgtgcggaaatgtatgcccacctcaccgtttg

SEQ ID NO: 50614 - DNA, 35 bp, Artificial Sequence
  Synthetic oligonucleotide
gcactccactgcctgaccttcaagcgccgcataat

SEQ ID NO: 50615 - DNA, 35 bp, Artificial Sequence
  Synthetic oligonucleotide
taggccggctcgttaccctctttacgcaagcttct

SEQ ID NO: 50616 - DNA, 35 bp, Artificial Sequence
  Synthetic oligonucleotide
acgatggagcgtacacctccaccatgatgcaactt

SEQ ID NO: 50617 - DNA, 35 bp, Artificial Sequence
  Synthetic oligonucleotide
gcggagcggaaaaggcggttggtgaagggatggtt

SEQ ID NO: 50618 - DNA, 36 bp, Artificial Sequence
  Synthetic oligonucleotide
accgacacgacccacttgatccgctcgggctttaaa

SEQ ID NO: 50619 - DNA, 36 bp, Artificial Sequence
  Synthetic oligonucleotide
gcatggttcgcgccggcgccatcaacactccccaca

SEQ ID NO: 50620 - DNA, 35 bp, Artificial Sequence
  Synthetic oligonucleotide
gctcgcagtagccccaagtccagcaactcatgcca

SEQ ID NO: 50621 - DNA, 35 bp, Artificial Sequence
  Synthetic oligonucleotide
tcttggctacattccctctatctttgtgctgttca

SEQ ID NO: 50622 - DNA, 36 bp, Artificial Sequence
  Synthetic oligonucleotide
gaacaggggggcgatgggtggggctggggtgacaga

SEQ ID NO: 50623 - DNA, 37 bp, Artificial Sequence
  Synthetic oligonucleotide
tggggggtagcgggtagggacaggaatgcatagtaga

SEQ ID NO: 50624 - DNA, 37 bp, Artificial Sequence
  Synthetic oligonucleotide
taagccccacacgaatttctgtacaaccgcatcacga

SEQ ID NO: 50625 - DNA, 35 bp, Artificial Sequence
  Synthetic oligonucleotide
agtcacgtaccttttcacacactccactgctccga

SEQ ID NO: 50626 - DNA, 37 bp, Artificial Sequence
  Synthetic oligonucleotide
aacaacgcaagcaagaagggccgggggtaaatggcga

SEQ ID NO: 50627 - DNA, 37 bp, Artificial Sequence
  Synthetic oligonucleotide
atcccctaccacaacacgtcgcgcgcctcgattgcga

SEQ ID NO: 50628 - DNA, 37 bp, Artificial Sequence
  Synthetic oligonucleotide
ggtgcatgttccgcgctatcctccatctctagatcga

SEQ ID NO: 50629 - DNA, 37 bp, Artificial Sequence
  Synthetic oligonucleotide
gaagctccacatctctgctcactggtccatttgtcga

SEQ ID NO: 50630 - DNA, 36 bp, Artificial Sequence
  Synthetic oligonucleotide
tgcgacgactggggaggtgatgggagtgggaacgga

SEQ ID NO: 50631 - DNA, 37 bp, Artificial Sequence
  Synthetic oligonucleotide
agcactaccccatccatctgaggtctttacttaggga

SEQ ID NO: 50632 - DNA, 37 bp, Artificial Sequence
  Synthetic oligonucleotide
aacgtcaccaccgatctttgccactactctgatggga

SEQ ID NO: 50633 - DNA, 36 bp, Artificial Sequence
  Synthetic oligonucleotide
gaggagacaaggaggcaaagatggcaggaattggga

SEQ ID NO: 50634 - DNA, 37 bp, Artificial Sequence
  Synthetic oligonucleotide
gttctacccctcacatgtctgactatccagggatgga

SEQ ID NO: 50635 - DNA, 38 bp, Artificial Sequence
  Synthetic oligonucleotide
gggaccagagtgcggactgcagggaggctcggggatga

SEQ ID NO: 50636 - DNA, 38 bp, Artificial Sequence
  Synthetic oligonucleotide
gcgcacacccgcagcaccgtaatcacacaaggcactga

SEQ ID NO: 50637 - DNA, 38 bp, Artificial Sequence
  Synthetic oligonucleotide
ggacaaaccgcatccctttatcgaacaacagcccctga

SEQ ID NO: 50638 - DNA, 37 bp, Artificial Sequence
  Synthetic oligonucleotide
gcatccacaacgtattcttttctcccccccaggctga

SEQ ID NO: 50639 - DNA, 37 bp, Artificial Sequence
  Synthetic oligonucleotide
gttgctgtaccggagaggacagagaaaggtacagtga

SEQ ID NO: 50640 - DNA, 36 bp, Artificial Sequence
  Synthetic oligonucleotide
atacgacagcccccccgctgatatccgttaacgtga

SEQ ID NO: 50641 - DNA, 35 bp, Artificial Sequence
  Synthetic oligonucleotide
taactcccccatccccgccgcatcgaccccggtga

SEQ ID NO: 50642 - DNA, 38 bp, Artificial Sequence
  Synthetic oligonucleotide
taagccacgtggcttctggtttctaacgtacaaattga

SEQ ID NO: 50643 - DNA, 38 bp, Artificial Sequence
  Synthetic oligonucleotide
gctccgctagacgcgcatctttcaccgatcaccattga

SEQ ID NO: 50644 - DNA, 38 bp, Artificial Sequence
  Synthetic oligonucleotide
gatcaccagccatccgatagtttttgccttctcattga

SEQ ID NO: 50645 - DNA, 38 bp, Artificial Sequence
  Synthetic oligonucleotide
attgcaaagctcgcggtacctgcctcgttcttcattga

SEQ ID NO: 50646 - DNA, 38 bp, Artificial Sequence
  Synthetic oligonucleotide
tcagacgctagtctggttcattgtctgtcgcgctttga

SEQ ID NO: 50647 - DNA, 37 bp, Artificial Sequence
  Synthetic oligonucleotide
tctgtgggagtggcgggagggggattaattcttttga

SEQ ID NO: 50648 - DNA, 35 bp, Artificial Sequence
  Synthetic oligonucleotide
tgccccctctggctcgttccgggtatctacctata

SEQ ID NO: 50649 - DNA, 36 bp, Artificial Sequence
  Synthetic oligonucleotide
tgcggaccaccttttactgagtcagccctttgctta

SEQ ID NO: 50650 - DNA, 35 bp, Artificial Sequence
  Synthetic oligonucleotide
acacgaccggggggtttgtcttgctccggttctta

SEQ ID NO: 50651 - DNA, 35 bp, Artificial Sequence
  Synthetic oligonucleotide
tagttcaatccgcacgctgcttgtcaggtactgac

SEQ ID NO: 50652 - DNA, 35 bp, Artificial Sequence
  Synthetic oligonucleotide
agccacttctctggagcgaactaccaaggcacacc

SEQ ID NO: 50653 - DNA, 35 bp, Artificial Sequence
  Synthetic oligonucleotide
ttcaacgacattgattttctgttaccgcctctacc

SEQ ID NO: 50654 - DNA, 35 bp, Artificial Sequence
  Synthetic oligonucleotide
tcccgaacgatcttgtactgtgacccaccgtctcc

SEQ ID NO: 50655 - DNA, 35 bp, Artificial Sequence
  Synthetic oligonucleotide
acacaagtgctcgcgccaatgctcggtctccttcc

SEQ ID NO: 50656 - DNA, 35 bp, Artificial Sequence
  Synthetic oligonucleotide
gtggacaccagggcgcctaggggagggagggaggc

SEQ ID NO: 50657 - DNA, 35 bp, Artificial Sequence
  Synthetic oligonucleotide
gagtgagctgatgttcctccgtttgccgtgtcatc

SEQ ID NO: 50658 - DNA, 35 bp, Artificial Sequence
  Synthetic oligonucleotide
gtccaaaccgagggctacgcgaggggtcacttctc

SEQ ID NO: 50659 - DNA, 35 bp, Artificial Sequence
  Synthetic oligonucleotide
tcacaccccccctcctgtcaatgaatgatcatgag

SEQ ID NO: 50660 - DNA, 35 bp, Artificial Sequence
  Synthetic oligonucleotide
tcccggacgcccgttgtaacaaccacccttccccg

SEQ ID NO: 50661 - DNA, 35 bp, Artificial Sequence
  Synthetic oligonucleotide
gactccgggagggtgtcggggatcgattttgcggg

SEQ ID NO: 50662 - DNA, 35 bp, Artificial Sequence
  Synthetic oligonucleotide
gaatgaggctaggaatgtggggtctttgtgtgggg

SEQ ID NO: 50663 - DNA, 35 bp, Artificial Sequence
  Synthetic oligonucleotide
tccgacttaagccaccgccccccaaagtgcatctg

SEQ ID NO: 50664 - DNA, 35 bp, Artificial Sequence
  Synthetic oligonucleotide
aatgtggtcgcaggtaccagtgggtggtggggttg

SEQ ID NO: 50665 - DNA, 35 bp, Artificial Sequence
  Synthetic oligonucleotide
tcgcgggtaaactgcgccgtcctggtccaccaact

SEQ ID NO: 50666 - DNA, 35 bp, Artificial Sequence
  Synthetic oligonucleotide
gccacacgatgcttttttcgaacttgctccaccct

SEQ ID NO: 50667 - DNA, 35 bp, Artificial Sequence
  Synthetic oligonucleotide
gacaagcattataaccgcagccgctcagcccgcct

SEQ ID NO: 50668 - DNA, 35 bp, Artificial Sequence
  Synthetic oligonucleotide
acccgccgttgtgctctattttctctggtgtgcct

SEQ ID NO: 50669 - DNA, 35 bp, Artificial Sequence
  Synthetic oligonucleotide
gcgagcacctcgcctgtccctcttccatctctggt

SEQ ID NO: 50670 - DNA, 35 bp, Artificial Sequence
  Synthetic oligonucleotide
gtgtgcgcctgaacacccttgcatttgtccttggt

SEQ ID NO: 50671 - DNA, 35 bp, Artificial Sequence
  Synthetic oligonucleotide
aacccccaatgtcttgcctacgtacgtacccttgt

SEQ ID NO: 50672 - DNA, 35 bp, Artificial Sequence
  Synthetic oligonucleotide
gaagccgctccccagactcccgggctgtttacttt

SEQ ID NO: 50673 - DNA, 36 bp, Artificial Sequence
  Synthetic oligonucleotide
tgaccacggtcaggattcgctcttggtcactggtaa

SEQ ID NO: 50674 - DNA, 36 bp, Artificial Sequence
  Synthetic oligonucleotide
gttgccgggatcattcgcatacactaacctctgaca

SEQ ID NO: 50675 - DNA, 35 bp, Artificial Sequence
  Synthetic oligonucleotide
attacatcacagccaccttgcccgcccgcccacca

SEQ ID NO: 50676 - DNA, 36 bp, Artificial Sequence
  Synthetic oligonucleotide
atatccagaccggagcgaccacccacgcgcatccca

SEQ ID NO: 50677 - DNA, 35 bp, Artificial Sequence
  Synthetic oligonucleotide
ttggttaaggctcctgcgtcccctcctgtctgcca

SEQ ID NO: 50678 - DNA, 36 bp, Artificial Sequence
  Synthetic oligonucleotide
gtaacaaccgaaggagcctgccacatacgactatca

SEQ ID NO: 50679 - DNA, 36 bp, Artificial Sequence
  Synthetic oligonucleotide
attcaaccccgggatgtttaaccccacaacttgtca

SEQ ID NO: 50680 - DNA, 37 bp, Artificial Sequence
  Synthetic oligonucleotide
gttgacgccaaaacttttgacacctcttatgccaaga

SEQ ID NO: 50681 - DNA, 37 bp, Artificial Sequence
  Synthetic oligonucleotide
accaacggaaggcaggaaagtgaggctagtagtgaga

SEQ ID NO: 50682 - DNA, 37 bp, Artificial Sequence
  Synthetic oligonucleotide
ggaagactgccgcccctgtactgcgtaaacataacga

SEQ ID NO: 50683 - DNA, 37 bp, Artificial Sequence
  Synthetic oligonucleotide
ttgcccgcccgcacacgtagccgaccttttgccccga

SEQ ID NO: 50684 - DNA, 37 bp, Artificial Sequence
  Synthetic oligonucleotide
gacccaccccattcatgtcctgacctggtgtccccga

SEQ ID NO: 50685 - DNA, 37 bp, Artificial Sequence
  Synthetic oligonucleotide
tctggacagatgcaggagggagtgggcgagggtagga

SEQ ID NO: 50686 - DNA, 37 bp, Artificial Sequence
  Synthetic oligonucleotide
gagatgaagcaggggaggcggtggtcactagggggga

SEQ ID NO: 50687 - DNA, 37 bp, Artificial Sequence
  Synthetic oligonucleotide
ttgaatcacggtcgggagtggggtgcggatggctgga

SEQ ID NO: 50688 - DNA, 38 bp, Artificial Sequence
  Synthetic oligonucleotide
gagatccatcccttagcaccttcattgacagttagtga

SEQ ID NO: 50689 - DNA, 36 bp, Artificial Sequence
  Synthetic oligonucleotide
atcgaccccacgttactgtagcccgccatttcgtga

SEQ ID NO: 50690 - DNA, 38 bp, Artificial Sequence
  Synthetic oligonucleotide
gctgaactgcctatctgtatcccggtcccttagcttga

SEQ ID NO: 50691 - DNA, 38 bp, Artificial Sequence
  Synthetic oligonucleotide
aatgcccgcagaatgcttctgtacgttttccatcttga

SEQ ID NO: 50692 - DNA, 38 bp, Artificial Sequence
  Synthetic oligonucleotide
gtggtcgcctcctactgcaccctgtttcctcctgttga

SEQ ID NO: 50693 - DNA, 35 bp, Artificial Sequence
  Synthetic oligonucleotide
gtacctgcgcgccccaggtaggcccttccctttga

SEQ ID NO: 50694 - DNA, 36 bp, Artificial Sequence
  Synthetic oligonucleotide
gctgtcatcattcaccgcgtccttgcgtccgcacta

SEQ ID NO: 50695 - DNA, 35 bp, Artificial Sequence
  Synthetic oligonucleotide
gcacacccattcctccttgtcacctcaggagtcta

SEQ ID NO: 50696 - DNA, 35 bp, Artificial Sequence
  Synthetic oligonucleotide
gcaaattgccggtccgtcccaccgcacgtaacgta

SEQ ID NO: 50697 - DNA, 36 bp, Artificial Sequence
  Synthetic oligonucleotide
gttgacgcctgctatgccaatttactctagttatta

SEQ ID NO: 50698 - DNA, 35 bp, Artificial Sequence
  Synthetic oligonucleotide
aaaaagggaggaagaagcacgataggccaacacac

SEQ ID NO: 50699 - DNA, 35 bp, Artificial Sequence
  Synthetic oligonucleotide
gcccctccctcatgtctacgccccggtacctacac

SEQ ID NO: 50700 - DNA, 35 bp, Artificial Sequence
  Synthetic oligonucleotide
aatacgaccgagccgtatctatgcgaggcctcacc

SEQ ID NO: 50701 - DNA, 35 bp, Artificial Sequence
  Synthetic oligonucleotide
tgtcctagctcggcacgttacttcggctcaacccc

SEQ ID NO: 50702 - DNA, 35 bp, Artificial Sequence
  Synthetic oligonucleotide
tgagacgccgcacgctcgcctggcccttccctgcc

SEQ ID NO: 50703 - DNA, 35 bp, Artificial Sequence
  Synthetic oligonucleotide
acgccctgtccccagacctgtaccttgagtactcc

SEQ ID NO: 50704 - DNA, 35 bp, Artificial Sequence
  Synthetic oligonucleotide
tgggcattcgttccactccccagccgcacccccgc

SEQ ID NO: 50705 - DNA, 35 bp, Artificial Sequence
  Synthetic oligonucleotide
gcctgagcaactaacctctcctacagtctggccgc

SEQ ID NO: 50706 - DNA, 35 bp, Artificial Sequence
  Synthetic oligonucleotide
aacaatgacatggtggtgggagggatgggtgcatc

SEQ ID NO: 50707 - DNA, 35 bp, Artificial Sequence
  Synthetic oligonucleotide
tgctccctacgtaggtcttggaaccttatttactc

SEQ ID NO: 50708 - DNA, 35 bp, Artificial Sequence
  Synthetic oligonucleotide
tacaagccccgaactgcgcagtcccgtattctctc

SEQ ID NO: 50709 - DNA, 35 bp, Artificial Sequence
  Synthetic oligonucleotide
ctcactcagccacggtgtctttccatttccatgtc

SEQ ID NO: 50710 - DNA, 35 bp, Artificial Sequence
  Synthetic oligonucleotide
acgtgcgctgcctgaccgatataccactctttgtc

SEQ ID NO: 50711 - DNA, 35 bp, Artificial Sequence
  Synthetic oligonucleotide
acacgagcggttttccatccattccttagctgttc

SEQ ID NO: 50712 - DNA, 35 bp, Artificial Sequence
  Synthetic oligonucleotide
attgcctgcctactgtgcagtaacttttcatcacg

SEQ ID NO: 50713 - DNA, 35 bp, Artificial Sequence
  Synthetic oligonucleotide
taacctccccaaatagcgccgcaatcaagcgatcg

SEQ ID NO: 50714 - DNA, 35 bp, Artificial Sequence
  Synthetic oligonucleotide
aaggggggggccagggtgaaaggatagttggacgg

SEQ ID NO: 50715 - DNA, 35 bp, Artificial Sequence
  Synthetic oligonucleotide
gtaccaccatcgggcacagtcctcatctgttaatg

SEQ ID NO: 50716 - DNA, 35 bp, Artificial Sequence
  Synthetic oligonucleotide
tgaccagaggaaggacatgggaccaagaacggatg

SEQ ID NO: 50717 - DNA, 35 bp, Artificial Sequence
  Synthetic oligonucleotide
gcatcgtaagccctgtattacatcgtgttgtcctg

SEQ ID NO: 50718 - DNA, 35 bp, Artificial Sequence
  Synthetic oligonucleotide
ttaggtcgctgttaaggccccgactattttgccat

SEQ ID NO: 50719 - DNA, 35 bp, Artificial Sequence
  Synthetic oligonucleotide
gcccatagcccatacgtcgatcctatatcgtccat

SEQ ID NO: 50720 - DNA, 35 bp, Artificial Sequence
  Synthetic oligonucleotide
acctgcctcccccactcataccagccggatttgat

SEQ ID NO: 50721 - DNA, 35 bp, Artificial Sequence
  Synthetic oligonucleotide
tatggacacacacggatcatagcctgggtaggact

SEQ ID NO: 50722 - DNA, 35 bp, Artificial Sequence
  Synthetic oligonucleotide
gttaactgccttgcttgccccctccaagctcctct

SEQ ID NO: 50723 - DNA, 35 bp, Artificial Sequence
  Synthetic oligonucleotide
aaaccactcattggtgcttaaacttttccattggt

SEQ ID NO: 50724 - DNA, 35 bp, Artificial Sequence
  Synthetic oligonucleotide
gaccaggtagcatggctttgcaggggggcacaatt

SEQ ID NO: 50725 - DNA, 35 bp, Artificial Sequence
  Synthetic oligonucleotide
gaatgaccaccaccagctcgctgctataggtactt

SEQ ID NO: 50726 - DNA, 35 bp, Artificial Sequence
  Synthetic oligonucleotide
gacagggtcagcttgccgtctgccgttacctgctt

SEQ ID NO: 50727 - DNA, 36 bp, Artificial Sequence
  Synthetic oligonucleotide
gatgtcgccggagtatggcctacgctttccgctaaa

SEQ ID NO: 50728 - DNA, 35 bp, Artificial Sequence
  Synthetic oligonucleotide
ttcaccacaaaccgtagtacgaggtaacttccgaa

SEQ ID NO: 50729 - DNA, 36 bp, Artificial Sequence
  Synthetic oligonucleotide
acgcgggttggtacgatagggcaggagcacgcggaa

SEQ ID NO: 50730 - DNA, 35 bp, Artificial Sequence
  Synthetic oligonucleotide
tgcccggagccatccgccctcagttcgcactggaa

SEQ ID NO: 50731 - DNA, 35 bp, Artificial Sequence
  Synthetic oligonucleotide
gctgcccagccgctcgctgacagttaaccacctaa

SEQ ID NO: 50732 - DNA, 36 bp, Artificial Sequence
  Synthetic oligonucleotide
acgacaagtcgaacgcaccggtgcctccccctgaca

SEQ ID NO: 50733 - DNA, 35 bp, Artificial Sequence
  Synthetic oligonucleotide
gtagggaacagcaactttcgccgtccacctctaca

SEQ ID NO: 50734 - DNA, 36 bp, Artificial Sequence
  Synthetic oligonucleotide
gtgcacgtacctttgcccaacctgactgcaggacca

SEQ ID NO: 50735 - DNA, 36 bp, Artificial Sequence
  Synthetic oligonucleotide
tgctagccgcactgtcgccttttatcgggaaacgca

SEQ ID NO: 50736 - DNA, 36 bp, Artificial Sequence
  Synthetic oligonucleotide
gtcgcctcggtaccgaacacactatcattgtaatca

SEQ ID NO: 50737 - DNA, 36 bp, Artificial Sequence
  Synthetic oligonucleotide
atcaggcgcagccggtttcattgtttgtctcattca

SEQ ID NO: 50738 - DNA, 35 bp, Artificial Sequence
  Synthetic oligonucleotide
tcgccgcacatcatgttcaggctggcctcctttca

SEQ ID NO: 50739 - DNA, 37 bp, Artificial Sequence
  Synthetic oligonucleotide
ggacgcaatgagaaggaattgggtataggggttaaga

SEQ ID NO: 50740 - DNA, 37 bp, Artificial Sequence
  Synthetic oligonucleotide
gtgcctccaatctgcatctgttcacgtttatttcaga

SEQ ID NO: 50741 - DNA, 35 bp, Artificial Sequence
  Synthetic oligonucleotide
gaaagcatgcgcagttccccggccttacttatcga

SEQ ID NO: 50742 - DNA, 37 bp, Artificial Sequence
  Synthetic oligonucleotide
acaaaaggggacgtgggggacgatggcaagatgagga

SEQ ID NO: 50743 - DNA, 37 bp, Artificial Sequence
  Synthetic oligonucleotide
gccgtgccaaagactcaagaaaggggggccgatagga

SEQ ID NO: 50744 - DNA, 36 bp, Artificial Sequence
  Synthetic oligonucleotide
tcacaccgcaattcatacattacctccgatcccgga

SEQ ID NO: 50745 - DNA, 35 bp, Artificial Sequence
  Synthetic oligonucleotide
atgacatgggggagaggaactgatatttacaggga

SEQ ID NO: 50746 - DNA, 36 bp, Artificial Sequence
  Synthetic oligonucleotide
aacacaaatcaacgaccgggaaagaacgggcaggga

SEQ ID NO: 50747 - DNA, 36 bp, Artificial Sequence
  Synthetic oligonucleotide
atgagccgggaagggctaccacgagccgggggggga

SEQ ID NO: 50748 - DNA, 35 bp, Artificial Sequence
  Synthetic oligonucleotide
agtgaggctcattcccccagctttcacctcatgga

SEQ ID NO: 50749 - DNA, 36 bp, Artificial Sequence
  Synthetic oligonucleotide
gcacggtctcactaccctttcctgcggtttcactga

SEQ ID NO: 50750 - DNA, 36 bp, Artificial Sequence
  Synthetic oligonucleotide
actccatcgaccagtcttactatccgcctattctga

SEQ ID NO: 50751 - DNA, 38 bp, Artificial Sequence
  Synthetic oligonucleotide
tacccaggtccgccctcgaaacctcctccttcggttga

SEQ ID NO: 50752 - DNA, 35 bp, Artificial Sequence
  Synthetic oligonucleotide
ttcacattctgctgcactaattgtcctccttgcta

SEQ ID NO: 50753 - DNA, 36 bp, Artificial Sequence
  Synthetic oligonucleotide
tccagcccctcacactatcggttcattagcattcta

SEQ ID NO: 50754 - DNA, 36 bp, Artificial Sequence
  Synthetic oligonucleotide
gagagagaaggtagtgtgtaggggaattatgtcgta

SEQ ID NO: 50755 - DNA, 36 bp, Artificial Sequence
  Synthetic oligonucleotide
ggtcacccacatggaattgaccctatttttgttgta

SEQ ID NO: 50756 - DNA, 36 bp, Artificial Sequence
  Synthetic oligonucleotide
tccccccggagggcagtatcactacgccaggccacc

SEQ ID NO: 50757 - DNA, 35 bp, Artificial Sequence
  Synthetic oligonucleotide
ggagccggatcctcgtccttctcttcagtttcacc

SEQ ID NO: 50758 - DNA, 35 bp, Artificial Sequence
  Synthetic oligonucleotide
tgtgaggcgcctagcgactttcaccccggttcccc

SEQ ID NO: 50759 - DNA, 35 bp, Artificial Sequence
  Synthetic oligonucleotide
tgtcccctcccatgataccaataaacactttgccc

SEQ ID NO: 50760 - DNA, 35 bp, Artificial Sequence
  Synthetic oligonucleotide
ggtcctccacagctgttcccctccctgaacatgcc

SEQ ID NO: 50761 - DNA, 34 bp, Artificial Sequence
  Synthetic oligonucleotide
tacactacactcgttaccgtgcttggtaaatctc

SEQ ID NO: 50762 - DNA, 35 bp, Artificial Sequence
  Synthetic oligonucleotide
tgcagaactgactaacttactacacacaccaacag

SEQ ID NO: 50763 - DNA, 35 bp, Artificial Sequence
  Synthetic oligonucleotide
ttcaccgcgccaagctattactccctgtccactag

SEQ ID NO: 50764 - DNA, 35 bp, Artificial Sequence
  Synthetic oligonucleotide
gccctgactgttccgtgtttgtagtccattcttcg

SEQ ID NO: 50765 - DNA, 35 bp, Artificial Sequence
  Synthetic oligonucleotide
gactgctccctccttaagtgttttttcgttttgat

SEQ ID NO: 50766 - DNA, 35 bp, Artificial Sequence
  Synthetic oligonucleotide
aactccctcggtcaaaatgcgtaacagcgctaact

SEQ ID NO: 50767 - DNA, 35 bp, Artificial Sequence
  Synthetic oligonucleotide
gacgaccgtaagtcatacagcaccacgatcccact

SEQ ID NO: 50768 - DNA, 35 bp, Artificial Sequence
  Synthetic oligonucleotide
gtatagctctccccccccacgcctgtacagtatct

SEQ ID NO: 50769 - DNA, 35 bp, Artificial Sequence
  Synthetic oligonucleotide
agcaagggtgattgggtagtctagtaggggggagt

SEQ ID NO: 50770 - DNA, 35 bp, Artificial Sequence
  Synthetic oligonucleotide
aatcaatgacctccgaccgtacgccacagccgtgt

SEQ ID NO: 50771 - DNA, 35 bp, Artificial Sequence
  Synthetic oligonucleotide
tttgccgccttattatgatccttacacgcgctctt

SEQ ID NO: 50772 - DNA, 35 bp, Artificial Sequence
  Synthetic oligonucleotide
tccgactacccaatgacttatgcttgccggaattt

SEQ ID NO: 50773 - DNA, 35 bp, Artificial Sequence
  Synthetic oligonucleotide
tttacccctctgctatgagttacgcattaatcttt

SEQ ID NO: 50774 - DNA, 34 bp, Artificial Sequence
  Synthetic oligonucleotide
acaagccgacctctcgccgcctgtctttgagttt

SEQ ID NO: 50775 - DNA, 35 bp, Artificial Sequence
  Synthetic oligonucleotide
taccacgcttgattaatgcccgttccaattagttt

SEQ ID NO: 50776 - DNA, 36 bp, Artificial Sequence
  Synthetic oligonucleotide
gtaggaaagggaaaggggttagcgcaacaaaaaaaa

SEQ ID NO: 50777 - DNA, 36 bp, Artificial Sequence
  Synthetic oligonucleotide
tgacgctctccattgctaggtatcccatcgttgaaa

SEQ ID NO: 50778 - DNA, 35 bp, Artificial Sequence
  Synthetic oligonucleotide
tcaccccgcatattcaacggcgctgcctatggcca

SEQ ID NO: 50779 - DNA, 36 bp, Artificial Sequence
  Synthetic oligonucleotide
tcccggtcctgttgtctcattccctctttactggca

SEQ ID NO: 50780 - DNA, 36 bp, Artificial Sequence
  Synthetic oligonucleotide
ggacggctagtaggcccctgtcgtccccttccatca

SEQ ID NO: 50781 - DNA, 36 bp, Artificial Sequence
  Synthetic oligonucleotide
gtaacccgccactgcgccttccatgtcgtccttaga

SEQ ID NO: 50782 - DNA, 36 bp, Artificial Sequence
  Synthetic oligonucleotide
tctgagacaggcacgccaatcgtcacacctctacga

SEQ ID NO: 50783 - DNA, 37 bp, Artificial Sequence
  Synthetic oligonucleotide
gacggatggacggtggaacaagggagaagaaagccga

SEQ ID NO: 50784 - DNA, 37 bp, Artificial Sequence
  Synthetic oligonucleotide
tgagctgtagacctgctttcccattcccacgcgccga

SEQ ID NO: 50785 - DNA, 37 bp, Artificial Sequence
  Synthetic oligonucleotide
gctccatcagcacctcattcccgcccaccattagcga

SEQ ID NO: 50786 - DNA, 37 bp, Artificial Sequence
  Synthetic oligonucleotide
tcgatcccagcctcgcagcgggcatccctttcttcga

SEQ ID NO: 50787 - DNA, 37 bp, Artificial Sequence
  Synthetic oligonucleotide
ggaagaaaaagtgggggaaggagtgggagcagccgga

SEQ ID NO: 50788 - DNA, 37 bp, Artificial Sequence
  Synthetic oligonucleotide
gcgctactgcagtgtactggggtgggtggtgtgcgga

SEQ ID NO: 50789 - DNA, 37 bp, Artificial Sequence
  Synthetic oligonucleotide
attatgtagggtaggtgcgataggggatgggcgggga

SEQ ID NO: 50790 - DNA, 37 bp, Artificial Sequence
  Synthetic oligonucleotide
gagaagggaaggggggaagagaaggaggcattatgga

SEQ ID NO: 50791 - DNA, 37 bp, Artificial Sequence
  Synthetic oligonucleotide
gatcggtgcacacggccagtcacttcccctttctgga

SEQ ID NO: 50792 - DNA, 37 bp, Artificial Sequence
  Synthetic oligonucleotide
gatgcccttttcgaagctgaccctgtagccctgtgga

SEQ ID NO: 50793 - DNA, 38 bp, Artificial Sequence
  Synthetic oligonucleotide
gcacaccaccacactagcactgcccggaacggaactga

SEQ ID NO: 50794 - DNA, 37 bp, Artificial Sequence
  Synthetic oligonucleotide
tatcccgcccccgaagtatttaggggatataccctga

SEQ ID NO: 50795 - DNA, 38 bp, Artificial Sequence
  Synthetic oligonucleotide
agtaaacgcacactgttgcgatgccacttgtcccctga

SEQ ID NO: 50796 - DNA, 38 bp, Artificial Sequence
  Synthetic oligonucleotide
aactgagccagttcctgcacttggactaatttccctga

SEQ ID NO: 50797 - DNA, 36 bp, Artificial Sequence
  Synthetic oligonucleotide
aacgcgtccacaaggatccgcgcacacccctgctga

SEQ ID NO: 50798 - DNA, 38 bp, Artificial Sequence
  Synthetic oligonucleotide
tccgccaccgtcttcccgttgcattcgatccgtagtga

SEQ ID NO: 50799 - DNA, 37 bp, Artificial Sequence
  Synthetic oligonucleotide
gaaatgcgaagggaggctagggagggcgcagaggtga

SEQ ID NO: 50800 - DNA, 36 bp, Artificial Sequence
  Synthetic oligonucleotide
ttggcatgttctccgcccgtgcctctagccttgtga

SEQ ID NO: 50801 - DNA, 38 bp, Artificial Sequence
  Synthetic oligonucleotide
tgttacgctcccgctggaattccggtacctcaccttga

SEQ ID NO: 50802 - DNA, 37 bp, Artificial Sequence
  Synthetic oligonucleotide
tccacaccgatcagactgacacatcttatagtcttga

SEQ ID NO: 50803 - DNA, 37 bp, Artificial Sequence
  Synthetic oligonucleotide
ttcgtgtcaacgtaccacatccgatctcgctttttga

SEQ ID NO: 50804 - DNA, 36 bp, Artificial Sequence
  Synthetic oligonucleotide
acctgggcgccccttatacggtccatcaatccaata

SEQ ID NO: 50805 - DNA, 35 bp, Artificial Sequence
  Synthetic oligonucleotide
gtgcaaccgaggcttggtccacgcgccctctcata

SEQ ID NO: 50806 - DNA, 36 bp, Artificial Sequence
  Synthetic oligonucleotide
gattgatccgtccatgcgtatgccttcgccaatcta

SEQ ID NO: 50807 - DNA, 35 bp, Artificial Sequence
  Synthetic oligonucleotide
aaggggtcgacctgccgcgtgtcacctgaccctac

SEQ ID NO: 50808 - DNA, 35 bp, Artificial Sequence
  Synthetic oligonucleotide
gcaagcgcttgaccccaccaggccctttggttacc

SEQ ID NO: 50809 - DNA, 35 bp, Artificial Sequence
  Synthetic oligonucleotide
ttcgccggcaccccacaccctgtaagagtgccccc

SEQ ID NO: 50810 - DNA, 35 bp, Artificial Sequence
  Synthetic oligonucleotide
ggagccgcaccccgatacttcttttgttgatgccc

SEQ ID NO: 50811 - DNA, 35 bp, Artificial Sequence
  Synthetic oligonucleotide
aagacggccttttctatgtcgcgtgaccttatccc

SEQ ID NO: 50812 - DNA, 35 bp, Artificial Sequence
  Synthetic oligonucleotide
acatactgccgtcgcatctttctggccttgcgcgc

SEQ ID NO: 50813 - DNA, 35 bp, Artificial Sequence
  Synthetic oligonucleotide
gccaagtgcgccattgaagttctacgacccctcgc

SEQ ID NO: 50814 - DNA, 35 bp, Artificial Sequence
  Synthetic oligonucleotide
gacaagtcttcttccgtcactctcgtcccgttctc

SEQ ID NO: 50815 - DNA, 35 bp, Artificial Sequence
  Synthetic oligonucleotide
gtgtacagcgctcaccgacttcagccatattcgtc

SEQ ID NO: 50816 - DNA, 35 bp, Artificial Sequence
  Synthetic oligonucleotide
tccacctgtattcctgttcgggatttattcctgtc

SEQ ID NO: 50817 - DNA, 35 bp, Artificial Sequence
  Synthetic oligonucleotide
ttaaaccgccaagtagtggccttcgaaaccccttc

SEQ ID NO: 50818 - DNA, 35 bp, Artificial Sequence
  Synthetic oligonucleotide
atcacccccccctggaggtcacgattactggaacg

SEQ ID NO: 50819 - DNA, 35 bp, Artificial Sequence
  Synthetic oligonucleotide
tttactggccgcctatgaatcccccgtcctgcacg

SEQ ID NO: 50820 - DNA, 35 bp, Artificial Sequence
  Synthetic oligonucleotide
tacctgtccgtgcaatttctggaacttcccctacg

SEQ ID NO: 50821 - DNA, 35 bp, Artificial Sequence
  Synthetic oligonucleotide
tgtttcagccactggtccctgacctccctcattcg

SEQ ID NO: 50822 - DNA, 35 bp, Artificial Sequence
  Synthetic oligonucleotide
gaggaagactaccatctgctcctcgtattcattcg

SEQ ID NO: 50823 - DNA, 35 bp, Artificial Sequence
  Synthetic oligonucleotide
tcacactcacagtgatctagtattggttttccagg

SEQ ID NO: 50824 - DNA, 35 bp, Artificial Sequence
  Synthetic oligonucleotide
aacacgccggctaaagagatgagggcgggggtatg

SEQ ID NO: 50825 - DNA, 35 bp, Artificial Sequence
  Synthetic oligonucleotide
gtaacgtgaatggtttatgggggatggttggggtg

SEQ ID NO: 50826 - DNA, 35 bp, Artificial Sequence
  Synthetic oligonucleotide
gacctcgctttgccttatcgtgaatcctgctacat

SEQ ID NO: 50827 - DNA, 35 bp, Artificial Sequence
  Synthetic oligonucleotide
acgagggaatgggggggaaaggaataactatggat

SEQ ID NO: 50828 - DNA, 35 bp, Artificial Sequence
  Synthetic oligonucleotide
gtggcactggtcccatccccgtttgtttcattact

SEQ ID NO: 50829 - DNA, 35 bp, Artificial Sequence
  Synthetic oligonucleotide
gccatcaacggttgccggtcccgcccccgtgtcct

SEQ ID NO: 50830 - DNA, 35 bp, Artificial Sequence
  Synthetic oligonucleotide
acagtgtcgcagccacctgatggtccttatcctct

SEQ ID NO: 50831 - DNA, 35 bp, Artificial Sequence
  Synthetic oligonucleotide
gacacgaagggtcgggagatgatacaacgggtagt

SEQ ID NO: 50832 - DNA, 35 bp, Artificial Sequence
  Synthetic oligonucleotide
gcacggggtccctcactctgtttcgttccattttt

SEQ ID NO: 50833 - DNA, 35 bp, Artificial Sequence
  Synthetic oligonucleotide
atgccgaccatcgtactctaccaggacttctaaaa

SEQ ID NO: 50834 - DNA, 35 bp, Artificial Sequence
  Synthetic oligonucleotide
agcaaaacagggaaggctataagtgagaggagaaa

SEQ ID NO: 50835 - DNA, 35 bp, Artificial Sequence
  Synthetic oligonucleotide
gtgggatcgggcagggaggggtattgagctcgaaa

SEQ ID NO: 50836 - DNA, 36 bp, Artificial Sequence
  Synthetic oligonucleotide
gcgcaagccagcgaactccccaacagacgcgctaaa

SEQ ID NO: 50837 - DNA, 35 bp, Artificial Sequence
  Synthetic oligonucleotide
attgccaagcggctggtctcttttttgcggctgaa

SEQ ID NO: 50838 - DNA, 35 bp, Artificial Sequence
  Synthetic oligonucleotide
gttccgaccccctgttcagccctgtcactagtgaa

SEQ ID NO: 50839 - DNA, 36 bp, Artificial Sequence
  Synthetic oligonucleotide
tcgaacgtacatagcgggggggcacacggttttgaa

SEQ ID NO: 50840 - DNA, 36 bp, Artificial Sequence
  Synthetic oligonucleotide
acgacctacaacatgtgattggccgcctttatacca

SEQ ID NO: 50841 - DNA, 36 bp, Artificial Sequence
  Synthetic oligonucleotide
gctgttccgccacatttacgaccggagagtgcccca

SEQ ID NO: 50842 - DNA, 36 bp, Artificial Sequence
  Synthetic oligonucleotide
tcatcatcgttggtccataccaccgcatcctagcca

SEQ ID NO: 50843 - DNA, 36 bp, Artificial Sequence
  Synthetic oligonucleotide
tccgcgtcgcaattcgtttattcactcgttgtcgca

SEQ ID NO: 50844 - DNA, 35 bp, Artificial Sequence
  Synthetic oligonucleotide
agcacaccgagtcgttaccgggcccaagtactgca

SEQ ID NO: 50845 - DNA, 37 bp, Artificial Sequence
  Synthetic oligonucleotide
gtgcaagctacagccatgacctcctgcccgcactaga

SEQ ID NO: 50846 - DNA, 37 bp, Artificial Sequence
  Synthetic oligonucleotide
actcccctcatccgacggtcgtaatttagcaaaacga

SEQ ID NO: 50847 - DNA, 37 bp, Artificial Sequence
  Synthetic oligonucleotide
attccgtgcgcctgcctccatacccctcggcttccga

SEQ ID NO: 50848 - DNA, 37 bp, Artificial Sequence
  Synthetic oligonucleotide
taatgggctggtgttaaaggaatggaggggaaacgga

SEQ ID NO: 50849 - DNA, 37 bp, Artificial Sequence
  Synthetic oligonucleotide
atcacgaggagacatagggggggaaggagtagaggga

SEQ ID NO: 50850 - DNA, 36 bp, Artificial Sequence
  Synthetic oligonucleotide
tgaaccaggttgtcgctctgccccaccatacatgga

SEQ ID NO: 50851 - DNA, 37 bp, Artificial Sequence
  Synthetic oligonucleotide
tccatcaacacttgtttgtcatctaccccccattgga

SEQ ID NO: 50852 - DNA, 38 bp, Artificial Sequence
  Synthetic oligonucleotide
tccacccccgtggagaggacaccccccccttggcatga

SEQ ID NO: 50853 - DNA, 38 bp, Artificial Sequence
  Synthetic oligonucleotide
tgtacgacacaggcaccccacccgaccacaagtcatga

SEQ ID NO: 50854 - DNA, 37 bp, Artificial Sequence
  Synthetic oligonucleotide
taccgaccagttctgctttctttcacaggaggtatga

SEQ ID NO: 50855 - DNA, 37 bp, Artificial Sequence
  Synthetic oligonucleotide
ttgtaccaccgctggacccattgacgaccttacctga

SEQ ID NO: 50856 - DNA, 38 bp, Artificial Sequence
  Synthetic oligonucleotide
ttgacgccacagttgcacactaacggctcactgcctga

SEQ ID NO: 50857 - DNA, 38 bp, Artificial Sequence
  Synthetic oligonucleotide
accagccattgcgtcgctctcgtctctccagatcctga

SEQ ID NO: 50858 - DNA, 37 bp, Artificial Sequence
  Synthetic oligonucleotide
acaccattcgtcccacgcaccggcctgcacaacgtga

SEQ ID NO: 50859 - DNA, 38 bp, Artificial Sequence
  Synthetic oligonucleotide
gttcccacccggcaaacacttataatgccctaacgtga

SEQ ID NO: 50860 - DNA, 38 bp, Artificial Sequence
  Synthetic oligonucleotide
actccgccctccttctaggcttttcacccgacgtgtga

SEQ ID NO: 50861 - DNA, 38 bp, Artificial Sequence
  Synthetic oligonucleotide
ttcgctgaccgtactgctaggcttctttcatacattga

SEQ ID NO: 50862 - DNA, 38 bp, Artificial Sequence
  Synthetic oligonucleotide
tccttagcagcacgaaactactgcgcgtaccatcttga

SEQ ID NO: 50863 - DNA, 38 bp, Artificial Sequence
  Synthetic oligonucleotide
gagcgacaccgtcactccgtcctctatgctcttgttga

SEQ ID NO: 50864 - DNA, 38 bp, Artificial Sequence
  Synthetic oligonucleotide
gctctccagagcgcgttatcagcctcgcaactttttga

SEQ ID NO: 50865 - DNA, 36 bp, Artificial Sequence
  Synthetic oligonucleotide
gtcacatccacgaatgctgtctctctacttaatcta

SEQ ID NO: 50866 - DNA, 35 bp, Artificial Sequence
  Synthetic oligonucleotide
acaccatcaacgtaggggaaatgaagtgatggaac

SEQ ID NO: 50867 - DNA, 35 bp, Artificial Sequence
  Synthetic oligonucleotide
aacacttggccgtcagtccgtcatctatcatacac

SEQ ID NO: 50868 - DNA, 35 bp, Artificial Sequence
  Synthetic oligonucleotide
taccggatgctcaccaacctgtgtcccccacaccc

SEQ ID NO: 50869 - DNA, 35 bp, Artificial Sequence
  Synthetic oligonucleotide
gttcacgaacgcttgcaaccgagttagtcccgccc

SEQ ID NO: 50870 - DNA, 35 bp, Artificial Sequence
  Synthetic oligonucleotide
aacatccgcgatcctcgtccactcaaaggctgccc

SEQ ID NO: 50871 - DNA, 34 bp, Artificial Sequence
  Synthetic oligonucleotide
gccctacccattgggatttggattattttgttgc

SEQ ID NO: 50872 - DNA, 35 bp, Artificial Sequence
  Synthetic oligonucleotide
tgccgactgggccctatctgagtcgtcctcttatc

SEQ ID NO: 50873 - DNA, 35 bp, Artificial Sequence
  Synthetic oligonucleotide
gtatctccgtccgccgttgcatagtgcgtcgtctc

SEQ ID NO: 50874 - DNA, 35 bp, Artificial Sequence
  Synthetic oligonucleotide
tcatcgtaacattcctcgtgacccgcacacaatcg

SEQ ID NO: 50875 - DNA, 35 bp, Artificial Sequence
  Synthetic oligonucleotide
gaataacgcgccctactgagcttctcaccccttcg

SEQ ID NO: 50876 - DNA, 35 bp, Artificial Sequence
  Synthetic oligonucleotide
gcgtaggtcatcacacagaaaagaaggggttgggg

SEQ ID NO: 50877 - DNA, 35 bp, Artificial Sequence
  Synthetic oligonucleotide
gttgtctcccagcctgtgtgattgtaacgttcctg

SEQ ID NO: 50878 - DNA, 35 bp, Artificial Sequence
  Synthetic oligonucleotide
ttgtggaacaggaaggtggaacatatgggcttcat

SEQ ID NO: 50879 - DNA, 35 bp, Artificial Sequence
  Synthetic oligonucleotide
attgagtcccccctgcctgcgctcattacttatat

SEQ ID NO: 50880 - DNA, 35 bp, Artificial Sequence
  Synthetic oligonucleotide
tcacgcctcgatagagtatcacctcccgtgccact

SEQ ID NO: 50881 - DNA, 35 bp, Artificial Sequence
  Synthetic oligonucleotide
acagagcaggggccggtcattaatttctgtcctgt

SEQ ID NO: 50882 - DNA, 35 bp, Artificial Sequence
  Synthetic oligonucleotide
tgatcgacctcattattctaccgggcagactcctt

SEQ ID NO: 50883 - DNA, 35 bp, Artificial Sequence
  Synthetic oligonucleotide
gaacgtgcgggaagggaatagggcttaaaccagtt

SEQ ID NO: 50884 - DNA, 35 bp, Artificial Sequence
  Synthetic oligonucleotide
ttactcctcagccgaagcggccctgcctcattttt

SEQ ID NO: 50885 - DNA, 35 bp, Artificial Sequence
  Synthetic oligonucleotide
gtcatacactcaccactctgtctagtgataaacaa

SEQ ID NO: 50886 - DNA, 35 bp, Artificial Sequence
  Synthetic oligonucleotide
tatcacctctccgcctccgtaggtttcaggatgaa

SEQ ID NO: 50887 - DNA, 35 bp, Artificial Sequence
  Synthetic oligonucleotide
tccgcccccctaaacttctctacgacatgtctgaa

SEQ ID NO: 50888 - DNA, 36 bp, Artificial Sequence
  Synthetic oligonucleotide
gtcacccccgattgcttccctgacctcgtccactaa

SEQ ID NO: 50889 - DNA, 35 bp, Artificial Sequence
  Synthetic oligonucleotide
tgcgagccgctacattgggatctttcttttactaa

SEQ ID NO: 50890 - DNA, 35 bp, Artificial Sequence
  Synthetic oligonucleotide
acacgcctccaaattcatgctgtgccttccattaa

SEQ ID NO: 50891 - DNA, 36 bp, Artificial Sequence
  Synthetic oligonucleotide
tcacatccgcgtcatccatgctattcactcttttaa

SEQ ID NO: 50892 - DNA, 36 bp, Artificial Sequence
  Synthetic oligonucleotide
tgtgacagctgaatggtcctcgtccacactaacaca

SEQ ID NO: 50893 - DNA, 36 bp, Artificial Sequence
  Synthetic oligonucleotide
aaatccaccctcgatgttctcgaacggcaaggccca

SEQ ID NO: 50894 - DNA, 37 bp, Artificial Sequence
  Synthetic oligonucleotide
taccacctcactgcccgtagtagtcaggcccgaacga

SEQ ID NO: 50895 - DNA, 37 bp, Artificial Sequence
  Synthetic oligonucleotide
gacaagctgcctatcggttcaacctctatcatttcga

SEQ ID NO: 50896 - DNA, 37 bp, Artificial Sequence
  Synthetic oligonucleotide
gatgtggagcgacggcgtgggggagcgatatcaagga

SEQ ID NO: 50897 - DNA, 37 bp, Artificial Sequence
  Synthetic oligonucleotide
acctcccaaccgattaagtcgacgtacgtcgcacgga

SEQ ID NO: 50898 - DNA, 37 bp, Artificial Sequence
  Synthetic oligonucleotide
gacacgctgcgaaatacgtcaaacctgcttccccgga

SEQ ID NO: 50899 - DNA, 37 bp, Artificial Sequence
  Synthetic oligonucleotide
aagaaggcggtagcaaggcggggccactttgggggga

SEQ ID NO: 50900 - DNA, 37 bp, Artificial Sequence
  Synthetic oligonucleotide
tcaattgtgggaagggggtggacgtggtggggttgga

SEQ ID NO: 50901 - DNA, 38 bp, Artificial Sequence
  Synthetic oligonucleotide
ggtgggggaaaggtgagggagcgggagagtggacatga

SEQ ID NO: 50902 - DNA, 38 bp, Artificial Sequence
  Synthetic oligonucleotide
gccaacgcagtacgcctatttaccaaccttccgactga

SEQ ID NO: 50903 - DNA, 38 bp, Artificial Sequence
  Synthetic oligonucleotide
tgcccaccagtgcctatgacaacgagtgccccccctga

SEQ ID NO: 50904 - DNA, 38 bp, Artificial Sequence
  Synthetic oligonucleotide
tatcggccaccccgtagctcaattcccattcatgctga

SEQ ID NO: 50905 - DNA, 38 bp, Artificial Sequence
  Synthetic oligonucleotide
ttgtgaccacagggcatcagcgaccagcccccccgtga

SEQ ID NO: 50906 - DNA, 37 bp, Artificial Sequence
  Synthetic oligonucleotide
acgtcacgcccgcctctgttacaattgttcttcgtga

SEQ ID NO: 50907 - DNA, 37 bp, Artificial Sequence
  Synthetic oligonucleotide
aattcgccgatcgcagcctccgccttctgtaccttga

SEQ ID NO: 50908 - DNA, 37 bp, Artificial Sequence
  Synthetic oligonucleotide
acgcctccccgcctaggttttatccgttgcatcttga

SEQ ID NO: 50909 - DNA, 38 bp, Artificial Sequence
  Synthetic oligonucleotide
gcatcgcatcctgccgtggggcttctgaattcctttga

SEQ ID NO: 50910 - DNA, 36 bp, Artificial Sequence
  Synthetic oligonucleotide
tgaacatcgagcgtgccttggtctcagtcaaaccta

SEQ ID NO: 50911 - DNA, 35 bp, Artificial Sequence
  Synthetic oligonucleotide
gactgttactgcccatttttcgcccggcctttgta

SEQ ID NO: 50912 - DNA, 36 bp, Artificial Sequence
  Synthetic oligonucleotide
acactcacctggggttcgaccgcattttgcccgtta

SEQ ID NO: 50913 - DNA, 35 bp, Artificial Sequence
  Synthetic oligonucleotide
tgcgtaacgtaggcgtgccactttctctccactac

SEQ ID NO: 50914 - DNA, 35 bp, Artificial Sequence
  Synthetic oligonucleotide
acgagccagagcttttatcgtagtcccggtcaacc

SEQ ID NO: 50915 - DNA, 35 bp, Artificial Sequence
  Synthetic oligonucleotide
gctgccgagagtcttaaactgaatccagccccacc

SEQ ID NO: 50916 - DNA, 35 bp, Artificial Sequence
  Synthetic oligonucleotide
ttacgcctattgtacccgacacacgctggtctgcc

SEQ ID NO: 50917 - DNA, 35 bp, Artificial Sequence
  Synthetic oligonucleotide
ggattcagcccgcccattagtcgcacattttaagc

SEQ ID NO: 50918 - DNA, 35 bp, Artificial Sequence
  Synthetic oligonucleotide
gctgcctgttcttagaccaactgcccgaccccagc

SEQ ID NO: 50919 - DNA, 35 bp, Artificial Sequence
  Synthetic oligonucleotide
atcacacgaggcaagacagaccattcttttccatc

SEQ ID NO: 50920 - DNA, 35 bp, Artificial Sequence
  Synthetic oligonucleotide
acgcccagcactcatctcttagcgattatccgctc

SEQ ID NO: 50921 - DNA, 35 bp, Artificial Sequence
  Synthetic oligonucleotide
tgtgcacacgtaatcgattagcggtccacctcgtc

SEQ ID NO: 50922 - DNA, 35 bp, Artificial Sequence
  Synthetic oligonucleotide
cataccacgacacgcgccatccatccccatatgtc

SEQ ID NO: 50923 - DNA, 35 bp, Artificial Sequence
  Synthetic oligonucleotide
tgaaaccgcacatccatgcgtacttcaccttgttc

SEQ ID NO: 50924 - DNA, 35 bp, Artificial Sequence
  Synthetic oligonucleotide
acgcgtctctcccgctcacccattcccccggctag

SEQ ID NO: 50925 - DNA, 35 bp, Artificial Sequence
  Synthetic oligonucleotide
agcgactgaaaaaggcaacaaggtggaagggtgcg

SEQ ID NO: 50926 - DNA, 35 bp, Artificial Sequence
  Synthetic oligonucleotide
tatggggggtaaaggtgcaggaaaggaggcgtagg

SEQ ID NO: 50927 - DNA, 35 bp, Artificial Sequence
  Synthetic oligonucleotide
tattggacgctgagcgggggggaaggaggtggttg

SEQ ID NO: 50928 - DNA, 35 bp, Artificial Sequence
  Synthetic oligonucleotide
ggatcgccggacccaggttacgttactttttgttg

SEQ ID NO: 50929 - DNA, 35 bp, Artificial Sequence
  Synthetic oligonucleotide
gctacattccgatctaccccaggacatcagggcct

SEQ ID NO: 50930 - DNA, 35 bp, Artificial Sequence
  Synthetic oligonucleotide
tcgtacacactgtagtaatactgccacttcttgtt

SEQ ID NO: 50931 - DNA, 35 bp, Artificial Sequence
  Synthetic oligonucleotide
aggaggggaccgcataggaagagggcggggcaaaa

SEQ ID NO: 50932 - DNA, 36 bp, Artificial Sequence
  Synthetic oligonucleotide
aacgatgccgccccattatgcacccatggtcgaaaa

SEQ ID NO: 50933 - DNA, 36 bp, Artificial Sequence
  Synthetic oligonucleotide
gcgatgccggcactacgcattactagcttttgacaa

SEQ ID NO: 50934 - DNA, 35 bp, Artificial Sequence
  Synthetic oligonucleotide
gcccacatactcgacgtcgtaccccttcggcgcaa

SEQ ID NO: 50935 - DNA, 36 bp, Artificial Sequence
  Synthetic oligonucleotide
accaaccgatcagcaccaccacacacatcccttcaa

SEQ ID NO: 50936 - DNA, 35 bp, Artificial Sequence
  Synthetic oligonucleotide
aacttcgtccgtccagccttcgtacgccaccctaa

SEQ ID NO: 50937 - DNA, 35 bp, Artificial Sequence
  Synthetic oligonucleotide
atgggtgaataaagtggggaaggtcgggggggtaa

SEQ ID NO: 50938 - DNA, 35 bp, Artificial Sequence
  Synthetic oligonucleotide
gcaacacgcaattcacccttcagcacgcgcgtaca

SEQ ID NO: 50939 - DNA, 36 bp, Artificial Sequence
  Synthetic oligonucleotide
accgaactgtcgcatccgttacgccacctcgatcca

SEQ ID NO: 50940 - DNA, 36 bp, Artificial Sequence
  Synthetic oligonucleotide
gccgtcccgccgcagaattgaacgcgctccagtcca

SEQ ID NO: 50941 - DNA, 35 bp, Artificial Sequence
  Synthetic oligonucleotide
tcccccgcgaccgccctcggtcccaacgacccgca

SEQ ID NO: 50942 - DNA, 37 bp, Artificial Sequence
  Synthetic oligonucleotide
gctcaacacatctgatctcaatttacactgcacgcga

SEQ ID NO: 50943 - DNA, 37 bp, Artificial Sequence
  Synthetic oligonucleotide
tgcttcggcctaccctatccgcccttgtcccgtgcga

SEQ ID NO: 50944 - DNA, 35 bp, Artificial Sequence
  Synthetic oligonucleotide
atgaacaaccatggcctattttctgacgcattcga

SEQ ID NO: 50945 - DNA, 37 bp, Artificial Sequence
  Synthetic oligonucleotide
aagcaaacggtcacggactccttcgccaccatttcga

SEQ ID NO: 50946 - DNA, 37 bp, Artificial Sequence
  Synthetic oligonucleotide
gtgtaggggggcaaggttgttgcagcccgggtgggga

SEQ ID NO: 50947 - DNA, 37 bp, Artificial Sequence
  Synthetic oligonucleotide
gcctccccgccctaaaatatcggtacgcccactggga

SEQ ID NO: 50948 - DNA, 37 bp, Artificial Sequence
  Synthetic oligonucleotide
gccaggagtaacgggaaaaggagaaagggataatgga

SEQ ID NO: 50949 - DNA, 36 bp, Artificial Sequence
  Synthetic oligonucleotide
acaaatgcaaggagttcggcgctgttgcctattgga

SEQ ID NO: 50950 - DNA, 38 bp, Artificial Sequence
  Synthetic oligonucleotide
taatgcgggggtgggcgtggatcgggcgggcattatga

SEQ ID NO: 50951 - DNA, 37 bp, Artificial Sequence
  Synthetic oligonucleotide
aatgctcaccactgccactgaccgcccgccccactga

SEQ ID NO: 50952 - DNA, 38 bp, Artificial Sequence
  Synthetic oligonucleotide
gacgaggagaaaaatgggaagaggtgggtagctactga

SEQ ID NO: 50953 - DNA, 37 bp, Artificial Sequence
  Synthetic oligonucleotide
gtgttacatcctttgggtccgccggtcattttactga

SEQ ID NO: 50954 - DNA, 38 bp, Artificial Sequence
  Synthetic oligonucleotide
acccaacggtatgatgcttgaacgaaatacacctctga

SEQ ID NO: 50955 - DNA, 38 bp, Artificial Sequence
  Synthetic oligonucleotide
tcagagtagcagtagtgcgcgagggggagatggtctga

SEQ ID NO: 50956 - DNA, 38 bp, Artificial Sequence
  Synthetic oligonucleotide
tcacaggactgggaatgtgagcagggctgggaacgtga

SEQ ID NO: 50957 - DNA, 37 bp, Artificial Sequence
  Synthetic oligonucleotide
aaacgaaggatccgtggagggggattgcggggggtga

SEQ ID NO: 50958 - DNA, 37 bp, Artificial Sequence
  Synthetic oligonucleotide
acccaccccccaactgccagtgttgtcgctcccttga

SEQ ID NO: 50959 - DNA, 36 bp, Artificial Sequence
  Synthetic oligonucleotide
gcgcattccaccatgcctggttaacctaacaagata

SEQ ID NO: 50960 - DNA, 36 bp, Artificial Sequence
  Synthetic oligonucleotide
tcccgaactgggcttcctgacttattatatagctta

SEQ ID NO: 50961 - DNA, 35 bp, Artificial Sequence
  Synthetic oligonucleotide
tgacacacggaacacttgggttagcccccctctta

SEQ ID NO: 50962 - DNA, 35 bp, Artificial Sequence
  Synthetic oligonucleotide
aacacttccatcgcgacacggacatgacgcatcac

SEQ ID NO: 50963 - DNA, 35 bp, Artificial Sequence
  Synthetic oligonucleotide
tccacacgcacactgtcatatgtccaccattggac

SEQ ID NO: 50964 - DNA, 35 bp, Artificial Sequence
  Synthetic oligonucleotide
gcacagcacattcatcgccttctgcttacagaacc

SEQ ID NO: 50965 - DNA, 35 bp, Artificial Sequence
  Synthetic oligonucleotide
aaagccacctgaaaggttagcccctctgacgcacc

SEQ ID NO: 50966 - DNA, 35 bp, Artificial Sequence
  Synthetic oligonucleotide
ttacagcgcgcatcatctccgttagatcaactccc

SEQ ID NO: 50967 - DNA, 35 bp, Artificial Sequence
  Synthetic oligonucleotide
accgtgccgacactacccctgatcccgcctgtatc

SEQ ID NO: 50968 - DNA, 35 bp, Artificial Sequence
  Synthetic oligonucleotide
ttgacgcaggctttcccgtgttgggctagcccctc

SEQ ID NO: 50969 - DNA, 35 bp, Artificial Sequence
  Synthetic oligonucleotide
atccgctcctggtgcgtcccgtccgttcgactctc

SEQ ID NO: 50970 - DNA, 35 bp, Artificial Sequence
  Synthetic oligonucleotide
gttcactgggaatgtcttacgtgacttatcctctc

SEQ ID NO: 50971 - DNA, 35 bp, Artificial Sequence
  Synthetic oligonucleotide
acatcgacgctgtctctcctcttgcagtcaaggtc

SEQ ID NO: 50972 - DNA, 35 bp, Artificial Sequence
  Synthetic oligonucleotide
gccccactaccttgagccctatcatgatatagttc

SEQ ID NO: 50973 - DNA, 35 bp, Artificial Sequence
  Synthetic oligonucleotide
acgctcaccgagaacggttctcttgctcttcgccg

SEQ ID NO: 50974 - DNA, 35 bp, Artificial Sequence
  Synthetic oligonucleotide
atccgatcgaccattaccctccacttgcaccctcg

SEQ ID NO: 50975 - DNA, 35 bp, Artificial Sequence
  Synthetic oligonucleotide
gtttcggtcccattctacactgtccagcattttcg

SEQ ID NO: 50976 - DNA, 35 bp, Artificial Sequence
  Synthetic oligonucleotide
atctcccgacaaccacactgatacgccaatcacgg

SEQ ID NO: 50977 - DNA, 35 bp, Artificial Sequence
  Synthetic oligonucleotide
gggatcacctcacctaaacttatagtgcccacgtg

SEQ ID NO: 50978 - DNA, 35 bp, Artificial Sequence
  Synthetic oligonucleotide
agagtggaggttcggggggtaagcaatggcacttg

SEQ ID NO: 50979 - DNA, 35 bp, Artificial Sequence
  Synthetic oligonucleotide
aaccactactggcacctatgagcattctcggaaat

SEQ ID NO: 50980 - DNA, 35 bp, Artificial Sequence
  Synthetic oligonucleotide
tctccaccaagtttatcgctgagggtgacactcct

SEQ ID NO: 50981 - DNA, 35 bp, Artificial Sequence
  Synthetic oligonucleotide
aacagcatggagggaggaatgcaatacaaatccgt

SEQ ID NO: 50982 - DNA, 35 bp, Artificial Sequence
  Synthetic oligonucleotide
ggattcgcttggcaaccacgtcggccccgtttcgt

SEQ ID NO: 50983 - DNA, 35 bp, Artificial Sequence
  Synthetic oligonucleotide
tagtgagtgccaagggtgtacttagggggtatggt

SEQ ID NO: 50984 - DNA, 34 bp, Artificial Sequence
  Synthetic oligonucleotide
tctatccgcaccggcaaccttacacctttcattt

SEQ ID NO: 50985 - DNA, 35 bp, Artificial Sequence
  Synthetic oligonucleotide
atcccggtggctaccgtcttctgtccgtttcgttt

SEQ ID NO: 50986 - DNA, 35 bp, Artificial Sequence
  Synthetic oligonucleotide
tggacatgacatctaacgtttgaattttcgctttt

SEQ ID NO: 50987 - DNA, 36 bp, Artificial Sequence
  Synthetic oligonucleotide
gcaggctgggggggcgtagggtacagggcggaaaaa

SEQ ID NO: 50988 - DNA, 35 bp, Artificial Sequence
  Synthetic oligonucleotide
tccatgccccattttctgtatcaccttggttcaaa

SEQ ID NO: 50989 - DNA, 36 bp, Artificial Sequence
  Synthetic oligonucleotide
gagcacccactgtccttagcccgacaacatagccaa

SEQ ID NO: 50990 - DNA, 35 bp, Artificial Sequence
  Synthetic oligonucleotide
gacatccacttgccaggatgactgaactcatccaa

SEQ ID NO: 50991 - DNA, 36 bp, Artificial Sequence
  Synthetic oligonucleotide
tctcctgcctctaccaaagggttctgcacaccaaca

SEQ ID NO: 50992 - DNA, 36 bp, Artificial Sequence
  Synthetic oligonucleotide
acctctgcctcacaccaaaacgcccctgccttaaca

SEQ ID NO: 50993 - DNA, 36 bp, Artificial Sequence
  Synthetic oligonucleotide
tcatcatctacacatgccctaactgcctccgggaca

SEQ ID NO: 50994 - DNA, 36 bp, Artificial Sequence
  Synthetic oligonucleotide
tcaccctccctcatcacgcgcttttagatagctaca

SEQ ID NO: 50995 - DNA, 36 bp, Artificial Sequence
  Synthetic oligonucleotide
tgaccgctgttcacccaggggtcatcccttacccca

SEQ ID NO: 50996 - DNA, 36 bp, Artificial Sequence
  Synthetic oligonucleotide
gactacggggtgaggcggggtaaattcaatggtcca

SEQ ID NO: 50997 - DNA, 35 bp, Artificial Sequence
  Synthetic oligonucleotide
agcccgcccctctttaccagcatacacatcgcgca

SEQ ID NO: 50998 - DNA, 35 bp, Artificial Sequence
  Synthetic oligonucleotide
gtggtgaaggaaaagggagtcgtggataagcggca

SEQ ID NO: 50999 - DNA, 36 bp, Artificial Sequence
  Synthetic oligonucleotide
gagcacagcgaatgcgactctgcccccgattgctca

SEQ ID NO: 51000 - DNA, 36 bp, Artificial Sequence
  Synthetic oligonucleotide
gccgtacccctaacgatgcctcaggttctgctctca

SEQ ID NO: 51001 - DNA, 36 bp, Artificial Sequence
  Synthetic oligonucleotide
gacgcaggtccgtactccgccttctgtctctcaaga

SEQ ID NO: 51002 - DNA, 37 bp, Artificial Sequence
  Synthetic oligonucleotide
ttacagccgccgacctgctctacgatgacccctgaga

SEQ ID NO: 51003 - DNA, 37 bp, Artificial Sequence
  Synthetic oligonucleotide
gatccccagctggttgcttattcgcctccttgataga

SEQ ID NO: 51004 - DNA, 37 bp, Artificial Sequence
  Synthetic oligonucleotide
gctaaggaacaggaaaagggatgaaacggggcgtaga

SEQ ID NO: 51005 - DNA, 37 bp, Artificial Sequence
  Synthetic oligonucleotide
gaagcacgggaatggaaggggtagcaatgtggttaga

SEQ ID NO: 51006 - DNA, 36 bp, Artificial Sequence
  Synthetic oligonucleotide
agtcccatccccacgctaagccgtatctaacgccga

SEQ ID NO: 51007 - DNA, 37 bp, Artificial Sequence
  Synthetic oligonucleotide
gtgcatcctgctctccaatgtcatctctggtaatcga

SEQ ID NO: 51008 - DNA, 37 bp, Artificial Sequence
  Synthetic oligonucleotide
gaggacgacaggagctttttgtacacacacttttcga

SEQ ID NO: 51009 - DNA, 37 bp, Artificial Sequence
  Synthetic oligonucleotide
gaatgccaaatagtaactgggcgggaaggagaaagga

SEQ ID NO: 51010 - DNA, 37 bp, Artificial Sequence
  Synthetic oligonucleotide
gacacaacagagaggactgactgcacgagatcacgga

SEQ ID NO: 51011 - DNA, 37 bp, Artificial Sequence
  Synthetic oligonucleotide
actccaacccggaacactccatacgtcctttatcgga

SEQ ID NO: 51012 - DNA, 36 bp, Artificial Sequence
  Synthetic oligonucleotide
gtctcatcgccctaatctgcatcatttcaacaggga

SEQ ID NO: 51013 - DNA, 37 bp, Artificial Sequence
  Synthetic oligonucleotide
gacgagggaaattgtagggtaggtactactagtggga

SEQ ID NO: 51014 - DNA, 37 bp, Artificial Sequence
  Synthetic oligonucleotide
gcccgagggaagaataaatctgaaggtggacgtggga

SEQ ID NO: 51015 - DNA, 36 bp, Artificial Sequence
  Synthetic oligonucleotide
acacctccatgtcatcgtacgtcctttgaacctgga

SEQ ID NO: 51016 - DNA, 35 bp, Artificial Sequence
  Synthetic oligonucleotide
aactgcctcacctccgagtttccatagggcctgga

SEQ ID NO: 51017 - DNA, 36 bp, Artificial Sequence
  Synthetic oligonucleotide
acgcacacccatcctaataaccgtctctacattgga

SEQ ID NO: 51018 - DNA, 38 bp, Artificial Sequence
  Synthetic oligonucleotide
agcatccctccttgttaaacgttgccatctagccatga

SEQ ID NO: 51019 - DNA, 38 bp, Artificial Sequence
  Synthetic oligonucleotide
tgttgccgacgggctccatcatccgtgttacctcatga

SEQ ID NO: 51020 - DNA, 38 bp, Artificial Sequence
  Synthetic oligonucleotide
gaagggaaggaaagttgagtggaagcggaatcttatga

SEQ ID NO: 51021 - DNA, 37 bp, Artificial Sequence
  Synthetic oligonucleotide
ttgacaccactcccggctcgttcccacgcatccctga

SEQ ID NO: 51022 - DNA, 38 bp, Artificial Sequence
  Synthetic oligonucleotide
agaacaccacacatcgaccacagcctttcttgtgctga

SEQ ID NO: 51023 - DNA, 38 bp, Artificial Sequence
  Synthetic oligonucleotide
tggggcgccaggaaggagggcctaaaggaaaaaggtga

SEQ ID NO: 51024 - DNA, 38 bp, Artificial Sequence
  Synthetic oligonucleotide
aatgcgcagggaggtcatggggtgcattctgggggtga

SEQ ID NO: 51025 - DNA, 38 bp, Artificial Sequence
  Synthetic oligonucleotide
gtcacgctggctcactttctccggcactccctgggtga

SEQ ID NO: 51026 - DNA, 38 bp, Artificial Sequence
  Synthetic oligonucleotide
tcactgtcacgacctgccgttaacattacacctattga

SEQ ID NO: 51027 - DNA, 37 bp, Artificial Sequence
  Synthetic oligonucleotide
tattcgcccgccctcaatgcatagggttcacggttga

SEQ ID NO: 51028 - DNA, 36 bp, Artificial Sequence
  Synthetic oligonucleotide
atcaacgcacccggctacggtaactcctgcttttga

SEQ ID NO: 51029 - DNA, 36 bp, Artificial Sequence
  Synthetic oligonucleotide
ggtccaccgtcacggctacacagacccacaccgata

SEQ ID NO: 51030 - DNA, 36 bp, Artificial Sequence
  Synthetic oligonucleotide
atgcccgcctcttcatcgcgtgattgaactatacta

SEQ ID NO: 51031 - DNA, 36 bp, Artificial Sequence
  Synthetic oligonucleotide
gcccaaacaaatcgcgctactagccagttacgccta

SEQ ID NO: 51032 - DNA, 35 bp, Artificial Sequence
  Synthetic oligonucleotide
gtgcctctcgtatgtcaccgtgcctatcgtttcta

SEQ ID NO: 51033 - DNA, 36 bp, Artificial Sequence
  Synthetic oligonucleotide
acgtgggggggtaggacgaccggggaaggtgaagta

SEQ ID NO: 51034 - DNA, 35 bp, Artificial Sequence
  Synthetic oligonucleotide
agcgatgacagacctgatcctcctccctggctcac

SEQ ID NO: 51035 - DNA, 35 bp, Artificial Sequence
  Synthetic oligonucleotide
tcaggaatggtgcatggagcatttggaagtggggc

SEQ ID NO: 51036 - DNA, 35 bp, Artificial Sequence
  Synthetic oligonucleotide
attacgctgctagacgtatgttctgcatccccctc

SEQ ID NO: 51037 - DNA, 35 bp, Artificial Sequence
  Synthetic oligonucleotide
atccgctgtccacggtcacttatcagggtccattc

SEQ ID NO: 51038 - DNA, 35 bp, Artificial Sequence
  Synthetic oligonucleotide
tttaggtcgcgtcctaactcccgccttgcctattc

SEQ ID NO: 51039 - DNA, 35 bp, Artificial Sequence
  Synthetic oligonucleotide
aaacaccggtaaccacccgactctatgctactgcg

SEQ ID NO: 51040 - DNA, 35 bp, Artificial Sequence
  Synthetic oligonucleotide
ttatgcaggaggggggggggtagtccgaaatgatg

SEQ ID NO: 51041 - DNA, 35 bp, Artificial Sequence
  Synthetic oligonucleotide
tccactcatctgaggcttctacatcactttttatg

SEQ ID NO: 51042 - DNA, 35 bp, Artificial Sequence
  Synthetic oligonucleotide
gccccccgttccagcgatgaaccttggcctgtaat

SEQ ID NO: 51043 - DNA, 35 bp, Artificial Sequence
  Synthetic oligonucleotide
gcaccaccatacgctgcctcactctcgtatgccat

SEQ ID NO: 51044 - DNA, 35 bp, Artificial Sequence
  Synthetic oligonucleotide
gctaccctgcgcaagctccatcttcaccgcttact

SEQ ID NO: 51045 - DNA, 35 bp, Artificial Sequence
  Synthetic oligonucleotide
tgccgtggtgtgcaatccccgaccttctccgttct

SEQ ID NO: 51046 - DNA, 35 bp, Artificial Sequence
  Synthetic oligonucleotide
tctgcggagcacaaattgcttttccacctcgaatt

SEQ ID NO: 51047 - DNA, 35 bp, Artificial Sequence
  Synthetic oligonucleotide
atgtgactcctccgcgtatgcctttttaggtgatt

SEQ ID NO: 51048 - DNA, 35 bp, Artificial Sequence
  Synthetic oligonucleotide
gctgtgtccccgttttgcaatacagcctagccttt

SEQ ID NO: 51049 - DNA, 36 bp, Artificial Sequence
  Synthetic oligonucleotide
acgggatggggggggattgtggcgggcaaaaagaaa

SEQ ID NO: 51050 - DNA, 35 bp, Artificial Sequence
  Synthetic oligonucleotide
atgaccttgctggccgaatgcctactgactcccaa

SEQ ID NO: 51051 - DNA, 36 bp, Artificial Sequence
  Synthetic oligonucleotide
cctaacgggtgggggggaggtacatgctcaagggaa

SEQ ID NO: 51052 - DNA, 36 bp, Artificial Sequence
  Synthetic oligonucleotide
gccaccgcccctttttatcgatgagatcggttaaca

SEQ ID NO: 51053 - DNA, 36 bp, Artificial Sequence
  Synthetic oligonucleotide
actggccttgcgcatacgtctccggcgcacatcaca

SEQ ID NO: 51054 - DNA, 36 bp, Artificial Sequence
  Synthetic oligonucleotide
gtggattgggggggaacgatgaaataggcacagaca

SEQ ID NO: 51055 - DNA, 36 bp, Artificial Sequence
  Synthetic oligonucleotide
tgctttcaccacagtcttgttctaattccccgtaca

SEQ ID NO: 51056 - DNA, 36 bp, Artificial Sequence
  Synthetic oligonucleotide
actctccggtaccgctccattaatccccacgtgcca

SEQ ID NO: 51057 - DNA, 36 bp, Artificial Sequence
  Synthetic oligonucleotide
gaccatggactgcagtttaattcgttccggcttcca

SEQ ID NO: 51058 - DNA, 36 bp, Artificial Sequence
  Synthetic oligonucleotide
agcctgcccagggtcttcatggaattgctcctctca

SEQ ID NO: 51059 - DNA, 36 bp, Artificial Sequence
  Synthetic oligonucleotide
gtgcagtgtgtcctgttatccgccccatctgattca

SEQ ID NO: 51060 - DNA, 36 bp, Artificial Sequence
  Synthetic oligonucleotide
gactatcgggtgttctggtccttgtcccttgtttca

SEQ ID NO: 51061 - DNA, 37 bp, Artificial Sequence
  Synthetic oligonucleotide
atcggacgtgggaacgggggagtacggatgaagtaga

SEQ ID NO: 51062 - DNA, 37 bp, Artificial Sequence
  Synthetic oligonucleotide
ttgctccccccgcttattattgtagtcgagttcacga

SEQ ID NO: 51063 - DNA, 37 bp, Artificial Sequence
  Synthetic oligonucleotide
atgacaccccccacctacgccctacgacaggggacga

SEQ ID NO: 51064 - DNA, 37 bp, Artificial Sequence
  Synthetic oligonucleotide
gtgaaaagtggggtcttaaggggtgtgctgatgggga

SEQ ID NO: 51065 - DNA, 35 bp, Artificial Sequence
  Synthetic oligonucleotide
gacgacctacggaatggggcaggaatgaggtggga

SEQ ID NO: 51066 - DNA, 38 bp, Artificial Sequence
  Synthetic oligonucleotide
tgcccacgacagcacactaaattcacgccagcctatga

SEQ ID NO: 51067 - DNA, 38 bp, Artificial Sequence
  Synthetic oligonucleotide
tttacatctcccgctgcctgaaactgatagtcgtatga

SEQ ID NO: 51068 - DNA, 38 bp, Artificial Sequence
  Synthetic oligonucleotide
tacatcgtcctgcgcaaccacgcccagtccggaactga

SEQ ID NO: 51069 - DNA, 38 bp, Artificial Sequence
  Synthetic oligonucleotide
gccgtcagtcgcatctgtacttccccgtctttgcctga

SEQ ID NO: 51070 - DNA, 38 bp, Artificial Sequence
  Synthetic oligonucleotide
tgacattcctattggtgttagttaccctgccctcctga

SEQ ID NO: 51071 - DNA, 37 bp, Artificial Sequence
  Synthetic oligonucleotide
gatgacgccggtcacttgttttcatgaacttcgctga

SEQ ID NO: 51072 - DNA, 38 bp, Artificial Sequence
  Synthetic oligonucleotide
atgacgaagagggtcaggggccagggcacagagggtga

SEQ ID NO: 51073 - DNA, 37 bp, Artificial Sequence
  Synthetic oligonucleotide
taccccaacccgcacttctgtcacacaaacggggtga

SEQ ID NO: 51074 - DNA, 37 bp, Artificial Sequence
  Synthetic oligonucleotide
gccacagaactttggcttactctcgcacacttggtga

SEQ ID NO: 51075 - DNA, 38 bp, Artificial Sequence
  Synthetic oligonucleotide
agccagggagtggttggcgtagaggggggggagtgtga

SEQ ID NO: 51076 - DNA, 38 bp, Artificial Sequence
  Synthetic oligonucleotide
gccacaggcacggtgggaaactgtgaacgggaacttga

SEQ ID NO: 51077 - DNA, 38 bp, Artificial Sequence
  Synthetic oligonucleotide
tacctagcgtccccagctccaatgccactgactcttga

SEQ ID NO: 51078 - DNA, 38 bp, Artificial Sequence
  Synthetic oligonucleotide
tcaacccctgtccgagttactcccgggttcacctttga

SEQ ID NO: 51079 - DNA, 35 bp, Artificial Sequence
  Synthetic oligonucleotide
gactgagtgtgagggatcggggcaggttggttata

SEQ ID NO: 51080 - DNA, 36 bp, Artificial Sequence
  Synthetic oligonucleotide
gccacctgtcctcggtgtccatgctactgattccta

SEQ ID NO: 51081 - DNA, 35 bp, Artificial Sequence
  Synthetic oligonucleotide
gcaccttgacgctccacctagatcgtggttctcta

SEQ ID NO: 51082 - DNA, 36 bp, Artificial Sequence
  Synthetic oligonucleotide
agcacatcaaggtgaagtgcctcccccacattatta

SEQ ID NO: 51083 - DNA, 35 bp, Artificial Sequence
  Synthetic oligonucleotide
atcgccacttgcgaaccgtaccattggctccgtta

SEQ ID NO: 51084 - DNA, 35 bp, Artificial Sequence
  Synthetic oligonucleotide
agctgtgcggcacacattgcgcattctccttgtac

SEQ ID NO: 51085 - DNA, 35 bp, Artificial Sequence
  Synthetic oligonucleotide
acgacctgtatcctaggtctcattgtaatggttcc

SEQ ID NO: 51086 - DNA, 35 bp, Artificial Sequence
  Synthetic oligonucleotide
gacatacacctcccgggtccttctgagaccatcgc

SEQ ID NO: 51087 - DNA, 35 bp, Artificial Sequence
  Synthetic oligonucleotide
tcacgacaacaccggtatacatgctttacgtcatc

SEQ ID NO: 51088 - DNA, 35 bp, Artificial Sequence
  Synthetic oligonucleotide
acagccgggccggcgctccgtcctttcctattctc

SEQ ID NO: 51089 - DNA, 35 bp, Artificial Sequence
  Synthetic oligonucleotide
tcaacgtgcctgcactccgctctctatcgcactcg

SEQ ID NO: 51090 - DNA, 35 bp, Artificial Sequence
  Synthetic oligonucleotide
taccattgcccctacctctcgactgggtcgaacgg

SEQ ID NO: 51091 - DNA, 35 bp, Artificial Sequence
  Synthetic oligonucleotide
tgcgaggggggcaagggagggtgtcccacggaggg

SEQ ID NO: 51092 - DNA, 35 bp, Artificial Sequence
  Synthetic oligonucleotide
gctagcgcaggataagggcggggttggtggttggg

SEQ ID NO: 51093 - DNA, 35 bp, Artificial Sequence
  Synthetic oligonucleotide
gtccgggcgggggatgggctaaaatgtttggaatg

SEQ ID NO: 51094 - DNA, 35 bp, Artificial Sequence
  Synthetic oligonucleotide
tagaccagcaaaattaccggagtagtaggggagtg

SEQ ID NO: 51095 - DNA, 35 bp, Artificial Sequence
  Synthetic oligonucleotide
gtccaagggggggtgtagtgcatttttgggaggtg

SEQ ID NO: 51096 - DNA, 35 bp, Artificial Sequence
  Synthetic oligonucleotide
tttaacccccctgcgctcccatagggatcacaact

SEQ ID NO: 51097 - DNA, 35 bp, Artificial Sequence
  Synthetic oligonucleotide
tcatccctattcgcgcaggattctgcttcattact

SEQ ID NO: 51098 - DNA, 35 bp, Artificial Sequence
  Synthetic oligonucleotide
aatgtcatccggccatacacaacaacgcacaagct

SEQ ID NO: 51099 - DNA, 35 bp, Artificial Sequence
  Synthetic oligonucleotide
gagccccaatcactgtccgcccgcatggtattgct

SEQ ID NO: 51100 - DNA, 35 bp, Artificial Sequence
  Synthetic oligonucleotide
gctgatcgatcccgtgctttccctgtactcatcgt

SEQ ID NO: 51101 - DNA, 35 bp, Artificial Sequence
  Synthetic oligonucleotide
aactctgccatttccgcggtgcttacctcacaatt

SEQ ID NO: 51102 - DNA, 35 bp, Artificial Sequence
  Synthetic oligonucleotide
gacgaaaggggaaggaagttggagcgaaattgatt

SEQ ID NO: 51103 - DNA, 35 bp, Artificial Sequence
  Synthetic oligonucleotide
agaccctccatcttgtttcacctgcgccgcaggtt

SEQ ID NO: 51104 - DNA, 31 bp, Artificial Sequence
  Synthetic oligonucleotide
ttccctccccggtccgccggttctcatccca

SEQ ID NO: 51105 - DNA, 36 bp, Artificial Sequence
  Synthetic oligonucleotide
aaggagagggaatctaggctgacgaactggcgggca

SEQ ID NO: 51106 - DNA, 35 bp, Artificial Sequence
  Synthetic oligonucleotide
gccggtgtcccgacctcatccgaactgttgttgca

SEQ ID NO: 51107 - DNA, 35 bp, Artificial Sequence
  Synthetic oligonucleotide
gaggggcggggcgcaaagccaggaggaaccgatca

SEQ ID NO: 51108 - DNA, 36 bp, Artificial Sequence
  Synthetic oligonucleotide
atcgggtcacatctgttatcggtattgtcttcctca

SEQ ID NO: 51109 - DNA, 36 bp, Artificial Sequence
  Synthetic oligonucleotide
gtttccccagcccagcgcatcaatccaccctggtca

SEQ ID NO: 51110 - DNA, 37 bp, Artificial Sequence
  Synthetic oligonucleotide
accgaggaggccaccacccgcacacgtaccatccaga

SEQ ID NO: 51111 - DNA, 36 bp, Artificial Sequence
  Synthetic oligonucleotide
aacttcaccctccaggttccgccctcccttcggaga

SEQ ID NO: 51112 - DNA, 37 bp, Artificial Sequence
  Synthetic oligonucleotide
gatgggaacgattgaaggttagaggtgggagggtaga

SEQ ID NO: 51113 - DNA, 37 bp, Artificial Sequence
  Synthetic oligonucleotide
tccaccgcattcgccgaacgtctcactaggaccacga

SEQ ID NO: 51114 - DNA, 37 bp, Artificial Sequence
  Synthetic oligonucleotide
gtggggtaggggtgggacaccgaggtgccataaagga

SEQ ID NO: 51115 - DNA, 37 bp, Artificial Sequence
  Synthetic oligonucleotide
ggacgactcaggtcgggtgggggcacgggggcgggga

SEQ ID NO: 51116 - DNA, 35 bp, Artificial Sequence
  Synthetic oligonucleotide
tcaatcaccgatacaacctgaagaaatggactgga

SEQ ID NO: 51117 - DNA, 37 bp, Artificial Sequence
  Synthetic oligonucleotide
tgcagacatcgaccttcatctccactccgcccctgga

SEQ ID NO: 51118 - DNA, 35 bp, Artificial Sequence
  Synthetic oligonucleotide
tcgatgcagttgaagagggagggatgggtggtgga

SEQ ID NO: 51119 - DNA, 38 bp, Artificial Sequence
  Synthetic oligonucleotide
gccgtatacgcaagcagccgaccacccgcgattcctga

SEQ ID NO: 51120 - DNA, 38 bp, Artificial Sequence
  Synthetic oligonucleotide
tcaatctccgcccagttcgttcgctgggtagttcctga

SEQ ID NO: 51121 - DNA, 38 bp, Artificial Sequence
  Synthetic oligonucleotide
taactcctcgattgcgttacctgtcccatcctcgctga

SEQ ID NO: 51122 - DNA, 38 bp, Artificial Sequence
  Synthetic oligonucleotide
acgacgtgggacggggggggatgggggatacgctctga

SEQ ID NO: 51123 - DNA, 37 bp, Artificial Sequence
  Synthetic oligonucleotide
gctgtgggcacgtacgactataacgcccataccgtga

SEQ ID NO: 51124 - DNA, 38 bp, Artificial Sequence
  Synthetic oligonucleotide
tctaggggcatggttgagcggagggtgggacggggtga

SEQ ID NO: 51125 - DNA, 37 bp, Artificial Sequence
  Synthetic oligonucleotide
tgcagtgcaggggcggggggcgtcggacctaaattga

SEQ ID NO: 51126 - DNA, 35 bp, Artificial Sequence
  Synthetic oligonucleotide
gacaacattcttctggtccccagccaccctccata

SEQ ID NO: 51127 - DNA, 36 bp, Artificial Sequence
  Synthetic oligonucleotide
gatggctccccaggttcctcatgtagaccacccgta

SEQ ID NO: 51128 - DNA, 35 bp, Artificial Sequence
  Synthetic oligonucleotide
gtgctgcgaaggtttagcctgtttccttttatacc

SEQ ID NO: 51129 - DNA, 35 bp, Artificial Sequence
  Synthetic oligonucleotide
gcaggcacacatgtcgacgaggtcgtccgcccccc

SEQ ID NO: 51130 - DNA, 35 bp, Artificial Sequence
  Synthetic oligonucleotide
aacctcagctagccgtcactccgccccgcagtccc

SEQ ID NO: 51131 - DNA, 35 bp, Artificial Sequence
  Synthetic oligonucleotide
aatccctctgcattactttacaagggactagatcc

SEQ ID NO: 51132 - DNA, 35 bp, Artificial Sequence
  Synthetic oligonucleotide
actccatgcacgggtcttcgagttcgccttggtcc

SEQ ID NO: 51133 - DNA, 35 bp, Artificial Sequence
  Synthetic oligonucleotide
gatcaagcacttaagtgtccctccgctcttgcagc

SEQ ID NO: 51134 - DNA, 35 bp, Artificial Sequence
  Synthetic oligonucleotide
ttgcgcatggtgccgacctgcattacacttctagc

SEQ ID NO: 51135 - DNA, 35 bp, Artificial Sequence
  Synthetic oligonucleotide
gcaccatctcaggtttcttcaatatcttgccccgc

SEQ ID NO: 51136 - DNA, 35 bp, Artificial Sequence
  Synthetic oligonucleotide
aagcgacccgtctctgtcgcgctcccgtactctgc

SEQ ID NO: 51137 - DNA, 35 bp, Artificial Sequence
  Synthetic oligonucleotide
tatgcgccagagccctgcaagctccgttttcactc

SEQ ID NO: 51138 - DNA, 35 bp, Artificial Sequence
  Synthetic oligonucleotide
tacctccatcaatctcagagcctggcattctatcg

SEQ ID NO: 51139 - DNA, 35 bp, Artificial Sequence
  Synthetic oligonucleotide
acataccacccgccacgatgatgtgtggtcacatg

SEQ ID NO: 51140 - DNA, 35 bp, Artificial Sequence
  Synthetic oligonucleotide
gggaggacgcagcagtgattgcggtttgtgtagtg

SEQ ID NO: 51141 - DNA, 35 bp, Artificial Sequence
  Synthetic oligonucleotide
tgccaagtacattcccttgccactgacctcaggat

SEQ ID NO: 51142 - DNA, 35 bp, Artificial Sequence
  Synthetic oligonucleotide
aaccgcacaaatctcgcacctgacccataatgact

SEQ ID NO: 51143 - DNA, 35 bp, Artificial Sequence
  Synthetic oligonucleotide
ttacctacgatccggcatccaaccattgtctacct

SEQ ID NO: 51144 - DNA, 35 bp, Artificial Sequence
  Synthetic oligonucleotide
gcgctccaggggccccccacgttttttcgttctgt

SEQ ID NO: 51145 - DNA, 35 bp, Artificial Sequence
  Synthetic oligonucleotide
tcatccttggccttggaacactggtcgtgaccatt

SEQ ID NO: 51146 - DNA, 35 bp, Artificial Sequence
  Synthetic oligonucleotide
gaacccgggttcggcggttcttgtcacatcccctt

SEQ ID NO: 51147 - DNA, 35 bp, Artificial Sequence
  Synthetic oligonucleotide
gagtgcagtacactcccctactatcgtccaccgtt

SEQ ID NO: 51148 - DNA, 36 bp, Artificial Sequence
  Synthetic oligonucleotide
gacttcccatcctctgtttctgtgtcttctggcaaa

SEQ ID NO: 51149 - DNA, 36 bp, Artificial Sequence
  Synthetic oligonucleotide
gttaccgctatcacctatgatttgggctttttcgaa

SEQ ID NO: 51150 - DNA, 36 bp, Artificial Sequence
  Synthetic oligonucleotide
agtaacgctgaacaagcggaggaggaactgaaggaa

SEQ ID NO: 51151 - DNA, 36 bp, Artificial Sequence
  Synthetic oligonucleotide
acaggaggtcccatgccccgtatcatcgcttttgaa

SEQ ID NO: 51152 - DNA, 37 bp, Artificial Sequence
  Synthetic oligonucleotide
gctgagcgagtacggtaaggctaggtatggaggccga

SEQ ID NO: 51153 - DNA, 37 bp, Artificial Sequence
  Synthetic oligonucleotide
aaacgcaggagacaggtgggtggggtcgaagggccga

SEQ ID NO: 51154 - DNA, 37 bp, Artificial Sequence
  Synthetic oligonucleotide
tcagcgcactggttaactcagcgtgtcacaccctcga

SEQ ID NO: 51155 - DNA, 36 bp, Artificial Sequence
  Synthetic oligonucleotide
atgcgcataaccccctcccggactccgactgctcga

SEQ ID NO: 51156 - DNA, 37 bp, Artificial Sequence
  Synthetic oligonucleotide
acctcgccgcctagttatagcttgtctctcccttgga

SEQ ID NO: 51157 - DNA, 38 bp, Artificial Sequence
  Synthetic oligonucleotide
gcccacgttggttcctgaccgtgctccagttttaatga

SEQ ID NO: 51158 - DNA, 37 bp, Artificial Sequence
  Synthetic oligonucleotide
gtggtggctggcggggcatgtgtttggagggggctga

SEQ ID NO: 51159 - DNA, 38 bp, Artificial Sequence
  Synthetic oligonucleotide
tcttacgtcagaatcctctgtgcactcccttgttctga

SEQ ID NO: 51160 - DNA, 38 bp, Artificial Sequence
  Synthetic oligonucleotide
ggtggaaggtggtggtgagtgggggtcggtaacagtga

SEQ ID NO: 51161 - DNA, 36 bp, Artificial Sequence
  Synthetic oligonucleotide
actgcccgtaactaaccccctcgtccgtcgtattga

SEQ ID NO: 51162 - DNA, 38 bp, Artificial Sequence
  Synthetic oligonucleotide
acacctaggaacacacgtggatccgctcacccccttga

SEQ ID NO: 51163 - DNA, 38 bp, Artificial Sequence
  Synthetic oligonucleotide
tactactgccgattgcatatgtttgggcccctccttga

SEQ ID NO: 51164 - DNA, 38 bp, Artificial Sequence
  Synthetic oligonucleotide
gactgccgcccggaatactggctcgtgatacttcttga

SEQ ID NO: 51165 - DNA, 37 bp, Artificial Sequence
  Synthetic oligonucleotide
atggacgggacaaaaagagagggaggagctaagttga

SEQ ID NO: 51166 - DNA, 38 bp, Artificial Sequence
  Synthetic oligonucleotide
tacatccagccatcagaccccctatctaacttggttga

SEQ ID NO: 51167 - DNA, 38 bp, Artificial Sequence
  Synthetic oligonucleotide
agcgaggaccagtggagagctggtgtgagcaatgttga

SEQ ID NO: 51168 - DNA, 38 bp, Artificial Sequence
  Synthetic oligonucleotide
gacccccttctagttgccactaatgacctgtatgttga

SEQ ID NO: 51169 - DNA, 38 bp, Artificial Sequence
  Synthetic oligonucleotide
atattcctcgccatgcccagtcacccgtccatctttga

SEQ ID NO: 51170 - DNA, 38 bp, Artificial Sequence
  Synthetic oligonucleotide
tctgccctcgcccccttgattgtcctctgaacgtttga

SEQ ID NO: 51171 - DNA, 36 bp, Artificial Sequence
  Synthetic oligonucleotide
atctctcgcccgcaccattcgtagcgtttctgacta

SEQ ID NO: 51172 - DNA, 36 bp, Artificial Sequence
  Synthetic oligonucleotide
gacaaatacagctggtcccgccgcccatcgctctta

SEQ ID NO: 51173 - DNA, 35 bp, Artificial Sequence
  Synthetic oligonucleotide
atgtccaccctcattgtacaaaaagttctctgtta

SEQ ID NO: 51174 - DNA, 36 bp, Artificial Sequence
  Synthetic oligonucleotide
actagggtggtggcgggaagggaggctggcttgtta

SEQ ID NO: 51175 - DNA, 35 bp, Artificial Sequence
  Synthetic oligonucleotide
tcatagccctgcccggagtgccccggtgatccgcc

SEQ ID NO: 51176 - DNA, 35 bp, Artificial Sequence
  Synthetic oligonucleotide
gtgtccggagttcgaccgtgccccctctgtccgcc

SEQ ID NO: 51177 - DNA, 35 bp, Artificial Sequence
  Synthetic oligonucleotide
tcatcgcgcgagcataacgcataggttctccgtcc

SEQ ID NO: 51178 - DNA, 35 bp, Artificial Sequence
  Synthetic oligonucleotide
atcgcccaaaaggagctatacttacacaatcatgc

SEQ ID NO: 51179 - DNA, 35 bp, Artificial Sequence
  Synthetic oligonucleotide
aactcgttcgcagtcctgttctccttgcttgatgc

SEQ ID NO: 51180 - DNA, 35 bp, Artificial Sequence
  Synthetic oligonucleotide
gtgatcgccgttcggtgccaactatttcccgtatc

SEQ ID NO: 51181 - DNA, 35 bp, Artificial Sequence
  Synthetic oligonucleotide
acgccggaccttcgcaatcgtctttcaccgcagtc

SEQ ID NO: 51182 - DNA, 35 bp, Artificial Sequence
  Synthetic oligonucleotide
gtcacgtattcagtcgctctggagtccttgccttc

SEQ ID NO: 51183 - DNA, 35 bp, Artificial Sequence
  Synthetic oligonucleotide
agctgacccgctcttatcggtaacaccatctcttc

SEQ ID NO: 51184 - DNA, 35 bp, Artificial Sequence
  Synthetic oligonucleotide
gcgccgagaccgtccacacttgtatgtccctaccg

SEQ ID NO: 51185 - DNA, 35 bp, Artificial Sequence
  Synthetic oligonucleotide
attgagcctccacttttgcttctggaacatgtccg

SEQ ID NO: 51186 - DNA, 35 bp, Artificial Sequence
  Synthetic oligonucleotide
tacgagcctgcacaatccaccactttacgctttcg

SEQ ID NO: 51187 - DNA, 35 bp, Artificial Sequence
  Synthetic oligonucleotide
ttacactcctgcgaccggcctcacacaatcatcgg

SEQ ID NO: 51188 - DNA, 35 bp, Artificial Sequence
  Synthetic oligonucleotide
atctccactgtactttgcggaccgatcgctacctg

SEQ ID NO: 51189 - DNA, 35 bp, Artificial Sequence
  Synthetic oligonucleotide
gattcgcacgtctactcacttaacacgcataacct

SEQ ID NO: 51190 - DNA, 35 bp, Artificial Sequence
  Synthetic oligonucleotide
atttggcctgggccactctctatcctagccacgct

SEQ ID NO: 51191 - DNA, 32 bp, Artificial Sequence
  Synthetic oligonucleotide
ttgtgcagaaacaacaattcacatgtttcgct

SEQ ID NO: 51192 - DNA, 35 bp, Artificial Sequence
  Synthetic oligonucleotide
tattacagccgacgctctcttcttctggggcctct

SEQ ID NO: 51193 - DNA, 35 bp, Artificial Sequence
  Synthetic oligonucleotide
tctgtgtccgggacacgcgatcctttttactctct

SEQ ID NO: 51194 - DNA, 35 bp, Artificial Sequence
  Synthetic oligonucleotide
tacggaccctgctctgtggcatccaattaacgtct

SEQ ID NO: 51195 - DNA, 35 bp, Artificial Sequence
  Synthetic oligonucleotide
tatgcctccccccctttctcggatcgcgtcgttct

SEQ ID NO: 51196 - DNA, 35 bp, Artificial Sequence
  Synthetic oligonucleotide
tcccctgtcccggtttctcgacatcacactacgtt

SEQ ID NO: 51197 - DNA, 36 bp, Artificial Sequence
  Synthetic oligonucleotide
gtacgcgcactggacttggctctatcatacttgcaa

SEQ ID NO: 51198 - DNA, 36 bp, Artificial Sequence
  Synthetic oligonucleotide
ttagggatgggaggaggggtatccgcggagttcgaa

SEQ ID NO: 51199 - DNA, 36 bp, Artificial Sequence
  Synthetic oligonucleotide
gtcacgacgcacttgccaattatacctgtaggacca

SEQ ID NO: 51200 - DNA, 36 bp, Artificial Sequence
  Synthetic oligonucleotide
gttccagccgcattattgtttcccgcatgtagctca

SEQ ID NO: 51201 - DNA, 37 bp, Artificial Sequence
  Synthetic oligonucleotide
tatgccgcaaatcaaccgcttgcctcctctcatgaga

SEQ ID NO: 51202 - DNA, 37 bp, Artificial Sequence
  Synthetic oligonucleotide
acctcatacatctggctgttcacaaccagtccaacga

SEQ ID NO: 51203 - DNA, 37 bp, Artificial Sequence
  Synthetic oligonucleotide
agtgagggaactgggtgggcgtatcgagtcgagggga

SEQ ID NO: 51204 - DNA, 37 bp, Artificial Sequence
  Synthetic oligonucleotide
atcgttcggggtgagctctagggcgggatggcgggga

SEQ ID NO: 51205 - DNA, 37 bp, Artificial Sequence
  Synthetic oligonucleotide
gatgtctgaggaagggggattgagggagaaacgtgga

SEQ ID NO: 51206 - DNA, 38 bp, Artificial Sequence
  Synthetic oligonucleotide
tcctgccaataacccgcccaatgtcccttacgacatga

SEQ ID NO: 51207 - DNA, 37 bp, Artificial Sequence
  Synthetic oligonucleotide
agtccaccatccatggagatattatcaccctgcctga

SEQ ID NO: 51208 - DNA, 37 bp, Artificial Sequence
  Synthetic oligonucleotide
ttccccctgcagacgtgacttagttcactcacgctga

SEQ ID NO: 51209 - DNA, 38 bp, Artificial Sequence
  Synthetic oligonucleotide
atacgcaggctcgccgtcccctctcatttccgcgctga

SEQ ID NO: 51210 - DNA, 38 bp, Artificial Sequence
  Synthetic oligonucleotide
aaagggatgaacaggcgtgggaactgggagtgggctga

SEQ ID NO: 51211 - DNA, 38 bp, Artificial Sequence
  Synthetic oligonucleotide
gactcctggcacgatcgctactccaggtccaattctga

SEQ ID NO: 51212 - DNA, 38 bp, Artificial Sequence
  Synthetic oligonucleotide
tcacccactttgtctacctaggccctgtcataacgtga

SEQ ID NO: 51213 - DNA, 38 bp, Artificial Sequence
  Synthetic oligonucleotide
gtcgaaggcacgtacatcctcgagtctttatctggtga

SEQ ID NO: 51214 - DNA, 37 bp, Artificial Sequence
  Synthetic oligonucleotide
atagagctcggagacgggaggggaaggggatggttga

SEQ ID NO: 51215 - DNA, 35 bp, Artificial Sequence
  Synthetic oligonucleotide
gctatctcacgactctctgcaatacgaatgtccta

SEQ ID NO: 51216 - DNA, 35 bp, Artificial Sequence
  Synthetic oligonucleotide
taaggggtggggtagggcgtagcgtgggccagtta

SEQ ID NO: 51217 - DNA, 35 bp, Artificial Sequence
  Synthetic oligonucleotide
tatcgggccggcctactccccccgccggtaaaccc

SEQ ID NO: 51218 - DNA, 35 bp, Artificial Sequence
  Synthetic oligonucleotide
gtcgttgccacttcgtatttaacatgaaaaacccc

SEQ ID NO: 51219 - DNA, 35 bp, Artificial Sequence
  Synthetic oligonucleotide
gttagtgtgtcctccgttttgatccaccttggccc

SEQ ID NO: 51220 - DNA, 35 bp, Artificial Sequence
  Synthetic oligonucleotide
ggtctggccctgccttgttgccctcaacagttccc

SEQ ID NO: 51221 - DNA, 35 bp, Artificial Sequence
  Synthetic oligonucleotide
tacctgagcacgtgaacccgaatcctccttccgcc

SEQ ID NO: 51222 - DNA, 35 bp, Artificial Sequence
  Synthetic oligonucleotide
gtgtagcccatggccttcatagctactcccgctcc

SEQ ID NO: 51223 - DNA, 35 bp, Artificial Sequence
  Synthetic oligonucleotide
gctgcgcctaaccaattatgcaaccacgcccctgc

SEQ ID NO: 51224 - DNA, 35 bp, Artificial Sequence
  Synthetic oligonucleotide
gccacctcctccgattataagtctccattagctgc

SEQ ID NO: 51225 - DNA, 35 bp, Artificial Sequence
  Synthetic oligonucleotide
gacacggtagaggggggtaggatctgagtatttgc

SEQ ID NO: 51226 - DNA, 35 bp, Artificial Sequence
  Synthetic oligonucleotide
agtcacccaaatccgtccagtggcttgttgtcctc

SEQ ID NO: 51227 - DNA, 35 bp, Artificial Sequence
  Synthetic oligonucleotide
gaatggacttgagagggacgtacgggggagtggag

SEQ ID NO: 51228 - DNA, 35 bp, Artificial Sequence
  Synthetic oligonucleotide
gtccgcctcgacctattatgggcatcttatcatcg

SEQ ID NO: 51229 - DNA, 35 bp, Artificial Sequence
  Synthetic oligonucleotide
gatacccttgcccacagacccgccttcgtgctcgg

SEQ ID NO: 51230 - DNA, 35 bp, Artificial Sequence
  Synthetic oligonucleotide
gatggcccacccccgtcgcttctttagatatcatg

SEQ ID NO: 51231 - DNA, 35 bp, Artificial Sequence
  Synthetic oligonucleotide
tcctcctcacgcacgccgttcgttacacagtcgtg

SEQ ID NO: 51232 - DNA, 35 bp, Artificial Sequence
  Synthetic oligonucleotide
gtcaatcgaaactgccgagccaccgcacactgaat

SEQ ID NO: 51233 - DNA, 35 bp, Artificial Sequence
  Synthetic oligonucleotide
acctcactgcccccccttttgtacaaaggctagat

SEQ ID NO: 51234 - DNA, 35 bp, Artificial Sequence
  Synthetic oligonucleotide
gtacacttcgcccaacacatatcttttgtctgtat

SEQ ID NO: 51235 - DNA, 35 bp, Artificial Sequence
  Synthetic oligonucleotide
atggtcacgttgctctcacgttttcggcctcacct

SEQ ID NO: 51236 - DNA, 35 bp, Artificial Sequence
  Synthetic oligonucleotide
gcgagaggtccccacaatgctaaaccacaatgcct

SEQ ID NO: 51237 - DNA, 35 bp, Artificial Sequence
  Synthetic oligonucleotide
gtggctcggtaccctgcatcttcgttttattacgt

SEQ ID NO: 51238 - DNA, 35 bp, Artificial Sequence
  Synthetic oligonucleotide
gtaccttcagggacaccccgctttgttctacctgt

SEQ ID NO: 51239 - DNA, 35 bp, Artificial Sequence
  Synthetic oligonucleotide
aactcaccccctgttctcttaacgagcatcttgtt

SEQ ID NO: 51240 - DNA, 35 bp, Artificial Sequence
  Synthetic oligonucleotide
acttcccgagcctgccttatctcagtcgccataca

SEQ ID NO: 51241 - DNA, 35 bp, Artificial Sequence
  Synthetic oligonucleotide
tcgagttaacgcctgtggccctactaccacctcca

SEQ ID NO: 51242 - DNA, 36 bp, Artificial Sequence
  Synthetic oligonucleotide
acacgcccccgcagcgatacatctattagttgagca

SEQ ID NO: 51243 - DNA, 36 bp, Artificial Sequence
  Synthetic oligonucleotide
ttcgaactcagccatcatccggtgccttctcgttca

SEQ ID NO: 51244 - DNA, 37 bp, Artificial Sequence
  Synthetic oligonucleotide
tagttcggagctgggtgagaggggggaaaggaataga

SEQ ID NO: 51245 - DNA, 35 bp, Artificial Sequence
  Synthetic oligonucleotide
gagcatcacggcgacacgaccctacaccacataga

SEQ ID NO: 51246 - DNA, 36 bp, Artificial Sequence
  Synthetic oligonucleotide
gaaccaacatcacgcgtgggcctcatactttttaga

SEQ ID NO: 51247 - DNA, 37 bp, Artificial Sequence
  Synthetic oligonucleotide
atgatcgccccctcactctggtcgggtagtctaccga

SEQ ID NO: 51248 - DNA, 36 bp, Artificial Sequence
  Synthetic oligonucleotide
tcccaccccccgctacggggactaccgatcactcga

SEQ ID NO: 51249 - DNA, 37 bp, Artificial Sequence
  Synthetic oligonucleotide
acctgcgacaagtagcactcaatgccccgcccctgga

SEQ ID NO: 51250 - DNA, 37 bp, Artificial Sequence
  Synthetic oligonucleotide
taagctcgaggaggcgggtggagggcgaggcgaatga

SEQ ID NO: 51251 - DNA, 38 bp, Artificial Sequence
  Synthetic oligonucleotide
gccagactactgctaccgtgcctccaacttggctatga

SEQ ID NO: 51252 - DNA, 38 bp, Artificial Sequence
  Synthetic oligonucleotide
tgcccctcaaaatcagcccagcacccatcacatcgtga

SEQ ID NO: 51253 - DNA, 38 bp, Artificial Sequence
  Synthetic oligonucleotide
tcgagggtggagggttgtagggggtatggagagtgtga

SEQ ID NO: 51254 - DNA, 38 bp, Artificial Sequence
  Synthetic oligonucleotide
tagacctaccctctgactacagtattgttcacacttga

SEQ ID NO: 51255 - DNA, 35 bp, Artificial Sequence
  Synthetic oligonucleotide
atgcgtgaggtacggaagggagtggacttttgata

SEQ ID NO: 51256 - DNA, 35 bp, Artificial Sequence
  Synthetic oligonucleotide
atgcaacagtacttatcctggttactctcatccta

SEQ ID NO: 51257 - DNA, 35 bp, Artificial Sequence
  Synthetic oligonucleotide
tcacccgcgtgcggtttttcaatcggacccatcta

SEQ ID NO: 51258 - DNA, 36 bp, Artificial Sequence
  Synthetic oligonucleotide
tccaacttagaatgccttccccccgattatgtcgta

SEQ ID NO: 51259 - DNA, 36 bp, Artificial Sequence
  Synthetic oligonucleotide
gaggtgtccgtgccatcttcctataacgcgccctta

SEQ ID NO: 51260 - DNA, 35 bp, Artificial Sequence
  Synthetic oligonucleotide
tccctgtgccaccttatgtactgtacctgccctta

SEQ ID NO: 51261 - DNA, 36 bp, Artificial Sequence
  Synthetic oligonucleotide
gtaccatcactgattaactgacttcgtatgaagtta

SEQ ID NO: 51262 - DNA, 35 bp, Artificial Sequence
  Synthetic oligonucleotide
tagtggtgcctcgggggcataactacctaccctac

SEQ ID NO: 51263 - DNA, 33 bp, Artificial Sequence
  Synthetic oligonucleotide
gtaacatccgatcgcagtatgcatgctggaacc

SEQ ID NO: 51264 - DNA, 35 bp, Artificial Sequence
  Synthetic oligonucleotide
ttggccccgccttagtcactgtctccgtgtcggcc

SEQ ID NO: 51265 - DNA, 35 bp, Artificial Sequence
  Synthetic oligonucleotide
gtacctcatattaacgccttcgagccagccctgcc

SEQ ID NO: 51266 - DNA, 35 bp, Artificial Sequence
  Synthetic oligonucleotide
aacaacgatccgcagactataaacagtttccatcc

SEQ ID NO: 51267 - DNA, 35 bp, Artificial Sequence
  Synthetic oligonucleotide
tcagccttacttgtgcccgttccaccgcctgctcc

SEQ ID NO: 51268 - DNA, 35 bp, Artificial Sequence
  Synthetic oligonucleotide
tgtgccctccagcttactccccccgtcatctacgc

SEQ ID NO: 51269 - DNA, 35 bp, Artificial Sequence
  Synthetic oligonucleotide
tcccgacatgtgttctgtcctctctgtttcaggtc

SEQ ID NO: 51270 - DNA, 35 bp, Artificial Sequence
  Synthetic oligonucleotide
actgttatcatgtggagtgtccatccatctgcttc

SEQ ID NO: 51271 - DNA, 35 bp, Artificial Sequence
  Synthetic oligonucleotide
gactcatcccactcctgcctttctgggcctacgag

SEQ ID NO: 51272 - DNA, 35 bp, Artificial Sequence
  Synthetic oligonucleotide
ttcatcgcttaaccgttcccatacaggcctcctag

SEQ ID NO: 51273 - DNA, 35 bp, Artificial Sequence
  Synthetic oligonucleotide
agcccatctcgtataaattttccgtgtacctctcg

SEQ ID NO: 51274 - DNA, 35 bp, Artificial Sequence
  Synthetic oligonucleotide
tgctacacacgtcgtcgcataatgtactccccggg

SEQ ID NO: 51275 - DNA, 35 bp, Artificial Sequence
  Synthetic oligonucleotide
aacgtgagctctactgacctgaccgttccatcaat

SEQ ID NO: 51276 - DNA, 34 bp, Artificial Sequence
  Synthetic oligonucleotide
gaggccatccccgactcccgccttaaactcacat

SEQ ID NO: 51277 - DNA, 35 bp, Artificial Sequence
  Synthetic oligonucleotide
gatgagggttggttttgaggaggggacaaatacat

SEQ ID NO: 51278 - DNA, 35 bp, Artificial Sequence
  Synthetic oligonucleotide
agtctgtatcgcctcctctggctaaggtcctccct

SEQ ID NO: 51279 - DNA, 35 bp, Artificial Sequence
  Synthetic oligonucleotide
ggggactggctccctgggatctaattcgaacctct

SEQ ID NO: 51280 - DNA, 35 bp, Artificial Sequence
  Synthetic oligonucleotide
tctcctcacccaccaggaacagcgtaaccatctct

SEQ ID NO: 51281 - DNA, 35 bp, Artificial Sequence
  Synthetic oligonucleotide
atgctacagctggttatcgttggccttgaatttgt

SEQ ID NO: 51282 - DNA, 35 bp, Artificial Sequence
  Synthetic oligonucleotide
acctgcttctgtctcctggcacgctgttctcgctt

SEQ ID NO: 51283 - DNA, 35 bp, Artificial Sequence
  Synthetic oligonucleotide
gcaaccgggccgaaattgctcgctgtacacctctt

SEQ ID NO: 51284 - DNA, 35 bp, Artificial Sequence
  Synthetic oligonucleotide
tgtaggacacgtggtttccggtggggtggtttctt

SEQ ID NO: 51285 - DNA, 35 bp, Artificial Sequence
  Synthetic oligonucleotide
gtagcaagatgtcccttcattggcgccattaattt

SEQ ID NO: 51286 - DNA, 35 bp, Artificial Sequence
  Synthetic oligonucleotide
gacgcgccaccgttcccttgcctctggctgttttt

SEQ ID NO: 51287 - DNA, 36 bp, Artificial Sequence
  Synthetic oligonucleotide
gaagataacaccgcagcaagtaccgttcctgtccaa

SEQ ID NO: 51288 - DNA, 36 bp, Artificial Sequence
  Synthetic oligonucleotide
tgccacgcaccaacgccataagcctagcattagcaa

SEQ ID NO: 51289 - DNA, 36 bp, Artificial Sequence
  Synthetic oligonucleotide
tgaggacgccgggtatggggaaaggcaaaaaccgaa

SEQ ID NO: 51290 - DNA, 36 bp, Artificial Sequence
  Synthetic oligonucleotide
gtgcccctgcgcctttcccaacggaccatcgaaaca

SEQ ID NO: 51291 - DNA, 36 bp, Artificial Sequence
  Synthetic oligonucleotide
taccggtcggtgcgcattgcccccgattacccccca

SEQ ID NO: 51292 - DNA, 36 bp, Artificial Sequence
  Synthetic oligonucleotide
aacgcatcaacccgccacagacacgaacgtatccca

SEQ ID NO: 51293 - DNA, 35 bp, Artificial Sequence
  Synthetic oligonucleotide
tgccgccccttgctcgtacacctagctttgagcca

SEQ ID NO: 51294 - DNA, 37 bp, Artificial Sequence
  Synthetic oligonucleotide
gctatctgacctccactgctactttaccaagggacga

SEQ ID NO: 51295 - DNA, 37 bp, Artificial Sequence
  Synthetic oligonucleotide
ggcctacgctgcctcgtctccctgcctgccaaaccga

SEQ ID NO: 51296 - DNA, 37 bp, Artificial Sequence
  Synthetic oligonucleotide
gtcccgaacccctttatcgtacccctgccgactccga

SEQ ID NO: 51297 - DNA, 37 bp, Artificial Sequence
  Synthetic oligonucleotide
gaccatgctcggacgttccgtttaattccatccgcga

SEQ ID NO: 51298 - DNA, 37 bp, Artificial Sequence
  Synthetic oligonucleotide
atgatctgtactgcaggggcgggagggcggtgggcga

SEQ ID NO: 51299 - DNA, 36 bp, Artificial Sequence
  Synthetic oligonucleotide
gcaacaccgcctggaaccgttttgaatactctgcga

SEQ ID NO: 51300 - DNA, 36 bp, Artificial Sequence
  Synthetic oligonucleotide
gcgcctttgcgccaccaacacttgtgatcttctcga

SEQ ID NO: 51301 - DNA, 37 bp, Artificial Sequence
  Synthetic oligonucleotide
tccccagtccagcatccgtcatttgactatcctggga

SEQ ID NO: 51302 - DNA, 36 bp, Artificial Sequence
  Synthetic oligonucleotide
acagcccccgccgcgtgttggtagagcgtggtggga

SEQ ID NO: 51303 - DNA, 37 bp, Artificial Sequence
  Synthetic oligonucleotide
gcgcgaggtgggcgcgggaagggtagaccttggtgga

SEQ ID NO: 51304 - DNA, 38 bp, Artificial Sequence
  Synthetic oligonucleotide
tttgttcacgccgtttgtgcctctcttcactgccatga

SEQ ID NO: 51305 - DNA, 38 bp, Artificial Sequence
  Synthetic oligonucleotide
gggaccggagtgggggcccggagaggaggggaggatga

SEQ ID NO: 51306 - DNA, 36 bp, Artificial Sequence
  Synthetic oligonucleotide
gacacatcagatcgaggtgggttggtttattgatga

SEQ ID NO: 51307 - DNA, 37 bp, Artificial Sequence
  Synthetic oligonucleotide
tgcccatttgacccttaagttgtcctccgtaccctga

SEQ ID NO: 51308 - DNA, 38 bp, Artificial Sequence
  Synthetic oligonucleotide
catagtaggcacccttcctgcactcaatcttcgcctga

SEQ ID NO: 51309 - DNA, 36 bp, Artificial Sequence
  Synthetic oligonucleotide
accccctcatcactgccggcgctgatgctctcctga

SEQ ID NO: 51310 - DNA, 38 bp, Artificial Sequence
  Synthetic oligonucleotide
gtgagggaggtagagaggaacggagctgtacctcgtga

SEQ ID NO: 51311 - DNA, 38 bp, Artificial Sequence
  Synthetic oligonucleotide
acaacaaggatcacttgttgtacggagatggcttgtga

SEQ ID NO: 51312 - DNA, 37 bp, Artificial Sequence
  Synthetic oligonucleotide
atgacaccctagcgggcataccttaactctgacttga

SEQ ID NO: 51313 - DNA, 36 bp, Artificial Sequence
  Synthetic oligonucleotide
actaccacgcctggaagcacatcgctgccacatata

SEQ ID NO: 51314 - DNA, 36 bp, Artificial Sequence
  Synthetic oligonucleotide
gtgggaccggtgaacggaaattgtggggcgggtata

SEQ ID NO: 51315 - DNA, 36 bp, Artificial Sequence
  Synthetic oligonucleotide
tcgaacatccgggtaatctgttctttttggtcacta

SEQ ID NO: 51316 - DNA, 36 bp, Artificial Sequence
  Synthetic oligonucleotide
gcctccgtgcacctttgttagatcatacctgcatta

SEQ ID NO: 51317 - DNA, 35 bp, Artificial Sequence
  Synthetic oligonucleotide
tcaaacgcgatccccccttttgtcctacaggttgc

SEQ ID NO: 51318 - DNA, 35 bp, Artificial Sequence
  Synthetic oligonucleotide
tacccctgatcctgagtctaacaagccacgcgatc

SEQ ID NO: 51319 - DNA, 35 bp, Artificial Sequence
  Synthetic oligonucleotide
gtcgcgaaaccgccggtaagaaccttttgtccttc

SEQ ID NO: 51320 - DNA, 35 bp, Artificial Sequence
  Synthetic oligonucleotide
tgacggaggatcgaccctgtcaccatacttctttc

SEQ ID NO: 51321 - DNA, 36 bp, Artificial Sequence
  Synthetic oligonucleotide
aggggtggatagtgcaggaccgggaaggggtgacag

SEQ ID NO: 51322 - DNA, 35 bp, Artificial Sequence
  Synthetic oligonucleotide
ttagacgtcaaggcaagcaaactcactaactcccg

SEQ ID NO: 51323 - DNA, 35 bp, Artificial Sequence
  Synthetic oligonucleotide
gccattgccgtcctcctacctgaccctttcgttcg

SEQ ID NO: 51324 - DNA, 35 bp, Artificial Sequence
  Synthetic oligonucleotide
gaggaacgtcgggcggggcaaactctggatagggg

SEQ ID NO: 51325 - DNA, 35 bp, Artificial Sequence
  Synthetic oligonucleotide
gaacccaagccattctgcacccccccgtgaatggg

SEQ ID NO: 51326 - DNA, 35 bp, Artificial Sequence
  Synthetic oligonucleotide
gacaccagacataggcacgggcacaaaccaccatg

SEQ ID NO: 51327 - DNA, 35 bp, Artificial Sequence
  Synthetic oligonucleotide
acttgcgtgacagctccatctttccactgcacctg

SEQ ID NO: 51328 - DNA, 35 bp, Artificial Sequence
  Synthetic oligonucleotide
tcgcacctccaccttgttcgcgttaccgttgtcat

SEQ ID NO: 51329 - DNA, 35 bp, Artificial Sequence
  Synthetic oligonucleotide
aatagcacaccatggccaccaaaggatcccgttat

SEQ ID NO: 51330 - DNA, 35 bp, Artificial Sequence
  Synthetic oligonucleotide
gagacaccggaggagaacggggatttaaccaaact

SEQ ID NO: 51331 - DNA, 35 bp, Artificial Sequence
  Synthetic oligonucleotide
gtacctccttccccgcccgtatccgtttgggcgct

SEQ ID NO: 51332 - DNA, 35 bp, Artificial Sequence
  Synthetic oligonucleotide
gagcgaaggggtgactacaatggggggagctcggt

SEQ ID NO: 51333 - DNA, 35 bp, Artificial Sequence
  Synthetic oligonucleotide
atcatcaccatcctgctcacctagttacacctggt

SEQ ID NO: 51334 - DNA, 36 bp, Artificial Sequence
  Synthetic oligonucleotide
tctacgtgcgatcgcttctttagcaacacccgtggt

SEQ ID NO: 51335 - DNA, 35 bp, Artificial Sequence
  Synthetic oligonucleotide
gccgtgcacccaactgcctctttactagttgtgtt

SEQ ID NO: 51336 - DNA, 35 bp, Artificial Sequence
  Synthetic oligonucleotide
tccattcgtccttttgctacggccggagttttgtt

SEQ ID NO: 51337 - DNA, 37 bp, Artificial Sequence
  Synthetic oligonucleotide
tcacctgacgcagccgggaacctacttttatgcgaaa

SEQ ID NO: 51338 - DNA, 36 bp, Artificial Sequence
  Synthetic oligonucleotide
gatgggtgcggggcacggttgattgcaggaggcaca

SEQ ID NO: 51339 - DNA, 36 bp, Artificial Sequence
  Synthetic oligonucleotide
tgccccgtcccgacatctttacgtgccgttatgaca

SEQ ID NO: 51340 - DNA, 36 bp, Artificial Sequence
  Synthetic oligonucleotide
ttccctgcactcaacattgttggtcccattattgca

SEQ ID NO: 51341 - DNA, 37 bp, Artificial Sequence
  Synthetic oligonucleotide
gtgggtgggtcgggggtctcgttgtggaaggacaaga

SEQ ID NO: 51342 - DNA, 37 bp, Artificial Sequence
  Synthetic oligonucleotide
gaagggtagggcatggagggactgttataggggaaga

SEQ ID NO: 51343 - DNA, 37 bp, Artificial Sequence
  Synthetic oligonucleotide
tccctgcgccaatcgttcatcgccacctccccggaga

SEQ ID NO: 51344 - DNA, 37 bp, Artificial Sequence
  Synthetic oligonucleotide
gtctgttcaggtagcttactctttccacttctgccga

SEQ ID NO: 51345 - DNA, 37 bp, Artificial Sequence
  Synthetic oligonucleotide
agacccgtcctcgcgccgctgccctgtacgcctccga

SEQ ID NO: 51346 - DNA, 37 bp, Artificial Sequence
  Synthetic oligonucleotide
agtcggaggctgggtagaagcgggggaggcaaatcga

SEQ ID NO: 51347 - DNA, 35 bp, Artificial Sequence
  Synthetic oligonucleotide
aacgcgagtaagatggagcagaaggtggaaatcga

SEQ ID NO: 51348 - DNA, 37 bp, Artificial Sequence
  Synthetic oligonucleotide
tcacgcccatcatctcacctgcgacctgccaattcga

SEQ ID NO: 51349 - DNA, 38 bp, Artificial Sequence
  Synthetic oligonucleotide
gtggctgctctgccggctctcttcctcgtgtcattcga

SEQ ID NO: 51350 - DNA, 36 bp, Artificial Sequence
  Synthetic oligonucleotide
tcacacatcatattgccctcgtcgccggtctcggga

SEQ ID NO: 51351 - DNA, 36 bp, Artificial Sequence
  Synthetic oligonucleotide
tacaacccctcgccaaatgtttacgcactctctgga

SEQ ID NO: 51352 - DNA, 37 bp, Artificial Sequence
  Synthetic oligonucleotide
gagaagccacatccctcgtccagctcgggcctttgga

SEQ ID NO: 51353 - DNA, 36 bp, Artificial Sequence
  Synthetic oligonucleotide
tccgaacatgccgagttaacgcctgctctcccatga

SEQ ID NO: 51354 - DNA, 38 bp, Artificial Sequence
  Synthetic oligonucleotide
atccacgcacgcacaatttagcaacggtggaccgatga

SEQ ID NO: 51355 - DNA, 37 bp, Artificial Sequence
  Synthetic oligonucleotide
tagttccgcccgcccgtacgtcgttagtcaacactga

SEQ ID NO: 51356 - DNA, 38 bp, Artificial Sequence
  Synthetic oligonucleotide
attcatgcctcaccgccctgtcacagtttgcccgctga

SEQ ID NO: 51357 - DNA, 38 bp, Artificial Sequence
  Synthetic oligonucleotide
gccaactccatctgccgtggcgactcgcttaacggtga

SEQ ID NO: 51358 - DNA, 36 bp, Artificial Sequence
  Synthetic oligonucleotide
gatccacgaccatggtctaacatttcgctaatgtga

SEQ ID NO: 51359 - DNA, 38 bp, Artificial Sequence
  Synthetic oligonucleotide
gcccaccgagcatactcgccttgtcatcccaccattga

SEQ ID NO: 51360 - DNA, 37 bp, Artificial Sequence
  Synthetic oligonucleotide
tagcaatcgaaccctcttcgctgtatggcccccttga

SEQ ID NO: 51361 - DNA, 36 bp, Artificial Sequence
  Synthetic oligonucleotide
gaagggggggagggttccgatagcctggggggttga

SEQ ID NO: 51362 - DNA, 35 bp, Artificial Sequence
  Synthetic oligonucleotide
taacaaccccactttagcggtctagacgccgcata

SEQ ID NO: 51363 - DNA, 35 bp, Artificial Sequence
  Synthetic oligonucleotide
aaacccgtgccctctcgcatgcatttcctatacac

SEQ ID NO: 51364 - DNA, 35 bp, Artificial Sequence
  Synthetic oligonucleotide
gcccaccgtctttgtccccgctccgccaacgcgac

SEQ ID NO: 51365 - DNA, 35 bp, Artificial Sequence
  Synthetic oligonucleotide
gccaaaacgtggccaattcataccctccgcctgac

SEQ ID NO: 51366 - DNA, 35 bp, Artificial Sequence
  Synthetic oligonucleotide
tgttgaccctaccgctgatgtctcacgttcattac

SEQ ID NO: 51367 - DNA, 35 bp, Artificial Sequence
  Synthetic oligonucleotide
atatggccagtgcagttcctcgcttatgcccttac

SEQ ID NO: 51368 - DNA, 35 bp, Artificial Sequence
  Synthetic oligonucleotide
gacccatcgaaaaacgagtgcatctccacctgacc

SEQ ID NO: 51369 - DNA, 35 bp, Artificial Sequence
  Synthetic oligonucleotide
tcacccaacggagcgctatctctctactcatgtcc

SEQ ID NO: 51370 - DNA, 35 bp, Artificial Sequence
  Synthetic oligonucleotide
aacgtacttacaatggctgtaacccaactctgtcc

SEQ ID NO: 51371 - DNA, 35 bp, Artificial Sequence
  Synthetic oligonucleotide
caacccctctcactatccgcctcctttgtgtgcgc

SEQ ID NO: 51372 - DNA, 35 bp, Artificial Sequence
  Synthetic oligonucleotide
tccagcatgttgggccctttttacgccgtgcctgc

SEQ ID NO: 51373 - DNA, 35 bp, Artificial Sequence
  Synthetic oligonucleotide
gacaaaccgcctcaatcgttcctcgaagatatctc

SEQ ID NO: 51374 - DNA, 35 bp, Artificial Sequence
  Synthetic oligonucleotide
atggcgcagccgtaccttatatggttttccccgtc

SEQ ID NO: 51375 - DNA, 34 bp, Artificial Sequence
  Synthetic oligonucleotide
tctgtagtccgtcctcccggtcctactctgcttc

SEQ ID NO: 51376 - DNA, 35 bp, Artificial Sequence
  Synthetic oligonucleotide
aattgtccccccagttatggtccttcgttactttc

SEQ ID NO: 51377 - DNA, 35 bp, Artificial Sequence
  Synthetic oligonucleotide
tcacgcacgacccacatatgtaaaatccttgtttg

SEQ ID NO: 51378 - DNA, 35 bp, Artificial Sequence
  Synthetic oligonucleotide
gtccatgccattctatattggtccgcacccttgat

SEQ ID NO: 51379 - DNA, 35 bp, Artificial Sequence
  Synthetic oligonucleotide
tccatccccgccgtcgttttggacgtcttctgcct

SEQ ID NO: 51380 - DNA, 35 bp, Artificial Sequence
  Synthetic oligonucleotide
acccctgcccctatggactttctgaacctgtgcgt

SEQ ID NO: 51381 - DNA, 35 bp, Artificial Sequence
  Synthetic oligonucleotide
aagtgtggagaaggttacggtgcacaaaggaaggt

SEQ ID NO: 51382 - DNA, 35 bp, Artificial Sequence
  Synthetic oligonucleotide
ttaggacgcgtttggacctctttctcgcttgttgt

SEQ ID NO: 51383 - DNA, 35 bp, Artificial Sequence
  Synthetic oligonucleotide
aacctgtcgcgcgtagccaccttgggaccgccctt

SEQ ID NO: 51384 - DNA, 35 bp, Artificial Sequence
  Synthetic oligonucleotide
gacttatacgtatcgcctaccgactggtcatcctt

SEQ ID NO: 51385 - DNA, 35 bp, Artificial Sequence
  Synthetic oligonucleotide
aagcctagcgctacccttcacactgacggcccttt

SEQ ID NO: 51386 - DNA, 36 bp, Artificial Sequence
  Synthetic oligonucleotide
atgcgccatggccttatgcataactgaaactcccaa

SEQ ID NO: 51387 - DNA, 36 bp, Artificial Sequence
  Synthetic oligonucleotide
gcagaacaaccgattgacccgaccccccactcccaa

SEQ ID NO: 51388 - DNA, 36 bp, Artificial Sequence
  Synthetic oligonucleotide
acctgacgaaccccgcgtagcccctaggcccccgaa

SEQ ID NO: 51389 - DNA, 35 bp, Artificial Sequence
  Synthetic oligonucleotide
aacgcgtttccccaccccccccgcacgccgatgaa

SEQ ID NO: 51390 - DNA, 36 bp, Artificial Sequence
  Synthetic oligonucleotide
tacgcccatgaacgtatgtcttctgatccaccctaa

SEQ ID NO: 51391 - DNA, 36 bp, Artificial Sequence
  Synthetic oligonucleotide
ggagaggtaaggggaagaggcttgcggaatcagtaa

SEQ ID NO: 51392 - DNA, 35 bp, Artificial Sequence
  Synthetic oligonucleotide
aggccctcgcgacaacacacacaaactgcaccaca

SEQ ID NO: 51393 - DNA, 35 bp, Artificial Sequence
  Synthetic oligonucleotide
tccgcatgacatgtattgatcactcgtttgttcca

SEQ ID NO: 51394 - DNA, 36 bp, Artificial Sequence
  Synthetic oligonucleotide
tagacctccctattgaacctgtcccagagatgggca

SEQ ID NO: 51395 - DNA, 36 bp, Artificial Sequence
  Synthetic oligonucleotide
gcaggccaacttggcatttagcaacttaaccattca

SEQ ID NO: 51396 - DNA, 36 bp, Artificial Sequence
  Synthetic oligonucleotide
actcgcgtgtcccttcgcccttcttgtcatttttca

SEQ ID NO: 51397 - DNA, 37 bp, Artificial Sequence
  Synthetic oligonucleotide
gccgtacccgtcgcacgcccctgcctaacattggaga

SEQ ID NO: 51398 - DNA, 35 bp, Artificial Sequence
  Synthetic oligonucleotide
gttctggcaccccagctccatttctgcatcctaga

SEQ ID NO: 51399 - DNA, 36 bp, Artificial Sequence
  Synthetic oligonucleotide
accgggagggaaatagcacctgggtgggaaccacga

SEQ ID NO: 51400 - DNA, 36 bp, Artificial Sequence
  Synthetic oligonucleotide
tatgtaccaccgacaaccgatctacgcattctccga

SEQ ID NO: 51401 - DNA, 37 bp, Artificial Sequence
  Synthetic oligonucleotide
tgatgtgcacgttcccccttttggccttatcacgcga

SEQ ID NO: 51402 - DNA, 37 bp, Artificial Sequence
  Synthetic oligonucleotide
ggacaccgaccaacttcggccttgcaccccgtttcga

SEQ ID NO: 51403 - DNA, 37 bp, Artificial Sequence
  Synthetic oligonucleotide
gctgacctcatagttttatgccttcactcctcacgga

SEQ ID NO: 51404 - DNA, 37 bp, Artificial Sequence
  Synthetic oligonucleotide
tgatagggagggggaagattgtcagatcgcctaggga

SEQ ID NO: 51405 - DNA, 37 bp, Artificial Sequence
  Synthetic oligonucleotide
gcccagggtgcggattcggaggggatactggcttgga

SEQ ID NO: 51406 - DNA, 37 bp, Artificial Sequence
  Synthetic oligonucleotide
agtcgaagacggagcggactaagccagtttgacatga

SEQ ID NO: 51407 - DNA, 38 bp, Artificial Sequence
  Synthetic oligonucleotide
ggtgagggaagaaaataggtcgagggacggcgtgatga

SEQ ID NO: 51408 - DNA, 37 bp, Artificial Sequence
  Synthetic oligonucleotide
agcaccaatacaccgaaccccccgtccgcttgactga

SEQ ID NO: 51409 - DNA, 38 bp, Artificial Sequence
  Synthetic oligonucleotide
tgccgccccggtggtcccaaacatcctcccatctctga

SEQ ID NO: 51410 - DNA, 38 bp, Artificial Sequence
  Synthetic oligonucleotide
tgtacgcattgctatttgcgcctctctgccctacgtga

SEQ ID NO: 51411 - DNA, 38 bp, Artificial Sequence
  Synthetic oligonucleotide
gagatggacagtgatgataaagtagagagatggggtga

SEQ ID NO: 51412 - DNA, 37 bp, Artificial Sequence
  Synthetic oligonucleotide
gagcaccctcactgacctatgaccgataaacatgtga

SEQ ID NO: 51413 - DNA, 38 bp, Artificial Sequence
  Synthetic oligonucleotide
ggagggcgggtgggacttttgatgtctgcaaaaattga

SEQ ID NO: 51414 - DNA, 37 bp, Artificial Sequence
  Synthetic oligonucleotide
tcatggaggtgggaggcggggggtcaaaggctattga

SEQ ID NO: 51415 - DNA, 36 bp, Artificial Sequence
  Synthetic oligonucleotide
tccctgccctcgcctttcgcaattaaacgctgttga

SEQ ID NO: 51416 - DNA, 38 bp, Artificial Sequence
  Synthetic oligonucleotide
acgccacccggcgtctgctttacgaccaccgctgttga

SEQ ID NO: 51417 - DNA, 38 bp, Artificial Sequence
  Synthetic oligonucleotide
gtccacactcaaatctctgtctcttgcatcatctttga

SEQ ID NO: 51418 - DNA, 36 bp, Artificial Sequence
  Synthetic oligonucleotide
aagagagggagctggccggagggtgtcgggggatta

SEQ ID NO: 51419 - DNA, 36 bp, Artificial Sequence
  Synthetic oligonucleotide
tggtcaaggggagagtagggaacggtggacgggtta

SEQ ID NO: 51420 - DNA, 35 bp, Artificial Sequence
  Synthetic oligonucleotide
taggtggagagattgggcgggggtaggcgttgaac

SEQ ID NO: 51421 - DNA, 35 bp, Artificial Sequence
  Synthetic oligonucleotide
gtgcagacttcccccctcaccgtattgcccggcac

SEQ ID NO: 51422 - DNA, 34 bp, Artificial Sequence
  Synthetic oligonucleotide
agccatcgtcgggaaacacacatctccggccgac

SEQ ID NO: 51423 - DNA, 35 bp, Artificial Sequence
  Synthetic oligonucleotide
ccaaatccgccacacgatagcttccgcactgaccc

SEQ ID NO: 51424 - DNA, 35 bp, Artificial Sequence
  Synthetic oligonucleotide
gatagtcgtaccgtagggtagacccactaaacccc

SEQ ID NO: 51425 - DNA, 35 bp, Artificial Sequence
  Synthetic oligonucleotide
gagactacgcacacctaatacgacgcccaggatcc

SEQ ID NO: 51426 - DNA, 35 bp, Artificial Sequence
  Synthetic oligonucleotide
tgcgacctctacactccctacactagtgaggatcc

SEQ ID NO: 51427 - DNA, 35 bp, Artificial Sequence
  Synthetic oligonucleotide
tatgatccgaggcggaggttactttccgctactcc

SEQ ID NO: 51428 - DNA, 35 bp, Artificial Sequence
  Synthetic oligonucleotide
atcgtgatgccccctcttcacacaccacccgtggc

SEQ ID NO: 51429 - DNA, 35 bp, Artificial Sequence
  Synthetic oligonucleotide
attgtagccaggtggggggtagtgagggcggacag

SEQ ID NO: 51430 - DNA, 35 bp, Artificial Sequence
  Synthetic oligonucleotide
gaaggaagcgcggccctcttttcctttcctgtacg

SEQ ID NO: 51431 - DNA, 35 bp, Artificial Sequence
  Synthetic oligonucleotide
gcgatggagagggtcaatgaagggggggactgtcg

SEQ ID NO: 51432 - DNA, 35 bp, Artificial Sequence
  Synthetic oligonucleotide
tcccccacgtctgtccacttgccactgttagttcg

SEQ ID NO: 51433 - DNA, 35 bp, Artificial Sequence
  Synthetic oligonucleotide
gagtgtggaagggggggcaaggaagcatgagaagg

SEQ ID NO: 51434 - DNA, 35 bp, Artificial Sequence
  Synthetic oligonucleotide
atatcgcccatttgccgtggacttatctcccgatg

SEQ ID NO: 51435 - DNA, 35 bp, Artificial Sequence
  Synthetic oligonucleotide
ttaccaagcgccctgtaccctattcaccaagcaat

SEQ ID NO: 51436 - DNA, 34 bp, Artificial Sequence
  Synthetic oligonucleotide
tacatcccatgatgcattggcccagtccaataat

SEQ ID NO: 51437 - DNA, 35 bp, Artificial Sequence
  Synthetic oligonucleotide
gttcccgccccgcccggatcgcattgtgcgataat

SEQ ID NO: 51438 - DNA, 34 bp, Artificial Sequence
  Synthetic oligonucleotide
ggagctcgccgtgcgactatcatggaatcctcat

SEQ ID NO: 51439 - DNA, 35 bp, Artificial Sequence
  Synthetic oligonucleotide
gttgcaatgacaggccatcgcgcggaacaactact

SEQ ID NO: 51440 - DNA, 35 bp, Artificial Sequence
  Synthetic oligonucleotide
acccatcaactcgcacacgagttaacgatttacct

SEQ ID NO: 51441 - DNA, 35 bp, Artificial Sequence
  Synthetic oligonucleotide
gttatcgccgctctcaagcgtgtctttgtttacct

SEQ ID NO: 51442 - DNA, 35 bp, Artificial Sequence
  Synthetic oligonucleotide
taccgaggcccaatatacataacgcacttgaatct

SEQ ID NO: 51443 - DNA, 34 bp, Artificial Sequence
  Synthetic oligonucleotide
attgcgggccgaggaactgattagtttggtttct

SEQ ID NO: 51444 - DNA, 36 bp, Artificial Sequence
  Synthetic oligonucleotide
atgattgggtggggagggttagtcaggtaggctgaa

SEQ ID NO: 51445 - DNA, 36 bp, Artificial Sequence
  Synthetic oligonucleotide
gtcgaggggaaaggagggctccaagagctcatataa

SEQ ID NO: 51446 - DNA, 36 bp, Artificial Sequence
  Synthetic oligonucleotide
gagaggggagtgttgaaagggtgcggtgatgactaa

SEQ ID NO: 51447 - DNA, 36 bp, Artificial Sequence
  Synthetic oligonucleotide
gcacgcaccctactcctctgtgattctaaccgctaa

SEQ ID NO: 51448 - DNA, 35 bp, Artificial Sequence
  Synthetic oligonucleotide
gcgatacgcacttttaaattaggggaaaccacaca

SEQ ID NO: 51449 - DNA, 36 bp, Artificial Sequence
  Synthetic oligonucleotide
accagtagtcgctgttccccttactgttcgtgccca

SEQ ID NO: 51450 - DNA, 36 bp, Artificial Sequence
  Synthetic oligonucleotide
ttgagctctacagccacttttggacccagctactca

SEQ ID NO: 51451 - DNA, 35 bp, Artificial Sequence
  Synthetic oligonucleotide
tggttgtcttgcccgttgaacccttcgccacttca

SEQ ID NO: 51452 - DNA, 36 bp, Artificial Sequence
  Synthetic oligonucleotide
gttccaacacgtcgggcgcgattagctactgctaga

SEQ ID NO: 51453 - DNA, 37 bp, Artificial Sequence
  Synthetic oligonucleotide
cactatctgccacgggatcagcagctgatcacaacga

SEQ ID NO: 51454 - DNA, 37 bp, Artificial Sequence
  Synthetic oligonucleotide
gccagaccattcgatgtctactgtatcctttctccga

SEQ ID NO: 51455 - DNA, 36 bp, Artificial Sequence
  Synthetic oligonucleotide
ttcacatcgcacaatctgatttcgaacctttgtcga

SEQ ID NO: 51456 - DNA, 37 bp, Artificial Sequence
  Synthetic oligonucleotide
ttgacgcgtgggaactggcggggtgggactgaacgga

SEQ ID NO: 51457 - DNA, 37 bp, Artificial Sequence
  Synthetic oligonucleotide
gtactgccggcgggaaggtgggagtcgggcactcgga

SEQ ID NO: 51458 - DNA, 37 bp, Artificial Sequence
  Synthetic oligonucleotide
gcataccctgcccacaagccccccccgacgtagtgga

SEQ ID NO: 51459 - DNA, 38 bp, Artificial Sequence
  Synthetic oligonucleotide
tgtcgacgggggaaaagcattgacacaggggtgaatga

SEQ ID NO: 51460 - DNA, 38 bp, Artificial Sequence
  Synthetic oligonucleotide
gttctgccccggtaactacaacatgccatcttctatga

SEQ ID NO: 51461 - DNA, 36 bp, Artificial Sequence
  Synthetic oligonucleotide
aacgcccgcgcatctagtacacctactccgaactga

SEQ ID NO: 51462 - DNA, 37 bp, Artificial Sequence
  Synthetic oligonucleotide
agacaagcgcgacttttcggatccgatccccacgtga

SEQ ID NO: 51463 - DNA, 38 bp, Artificial Sequence
  Synthetic oligonucleotide
tcctgaccccctggcaagagactcctacgaacaattga

SEQ ID NO: 51464 - DNA, 37 bp, Artificial Sequence
  Synthetic oligonucleotide
gcaactgccatccggattcaagcatctccttcattga

SEQ ID NO: 51465 - DNA, 37 bp, Artificial Sequence
  Synthetic oligonucleotide
tgtcaaccctaccttgccaatcactggaccagcttga

SEQ ID NO: 51466 - DNA, 38 bp, Artificial Sequence
  Synthetic oligonucleotide
ttccctccgccagccccctccatattggtccgctttga

SEQ ID NO: 51467 - DNA, 38 bp, Artificial Sequence
  Synthetic oligonucleotide
actgacaagccatcacccacgttagtatagctctttga

SEQ ID NO: 51468 - DNA, 35 bp, Artificial Sequence
  Synthetic oligonucleotide
gccagtgcccgcaattggtcgttgaatggcttcta

SEQ ID NO: 51469 - DNA, 35 bp, Artificial Sequence
  Synthetic oligonucleotide
gatcacgttctctccaggcgactgccgaatacgta

SEQ ID NO: 51470 - DNA, 36 bp, Artificial Sequence
  Synthetic oligonucleotide
tcacagtcatcgaattcgtgatcttcttgttgctta

SEQ ID NO: 51471 - DNA, 36 bp, Artificial Sequence
  Synthetic oligonucleotide
gacgaagcgccaacaccactcattcggatagcttta

SEQ ID NO: 51472 - DNA, 35 bp, Artificial Sequence
  Synthetic oligonucleotide
gaacgcgaagagggcatgcatcccgccccaaaacc

SEQ ID NO: 51473 - DNA, 35 bp, Artificial Sequence
  Synthetic oligonucleotide
gtccattccctcatattcgttgtccagctagtccc

SEQ ID NO: 51474 - DNA, 35 bp, Artificial Sequence
  Synthetic oligonucleotide
tgctcccaccaggaatcgctaggttatttctcagc

SEQ ID NO: 51475 - DNA, 34 bp, Artificial Sequence
  Synthetic oligonucleotide
tgcgttgtccctgttcgcgctatatcagcatatc

SEQ ID NO: 51476 - DNA, 35 bp, Artificial Sequence
  Synthetic oligonucleotide
gacacccggctaacacgttgaacgtttggcaactc

SEQ ID NO: 51477 - DNA, 35 bp, Artificial Sequence
  Synthetic oligonucleotide
tccatcatacttctatccacgcgttatcgacgtag

SEQ ID NO: 51478 - DNA, 35 bp, Artificial Sequence
  Synthetic oligonucleotide
gaatgggcacaaaaggcggataaagaggaggggcg

SEQ ID NO: 51479 - DNA, 35 bp, Artificial Sequence
  Synthetic oligonucleotide
aagtgcgcccggaaaataaggcataagcaatgggg

SEQ ID NO: 51480 - DNA, 35 bp, Artificial Sequence
  Synthetic oligonucleotide
gcgaccccctccgatgcgaggccggcatcacaact

SEQ ID NO: 51481 - DNA, 35 bp, Artificial Sequence
  Synthetic oligonucleotide
gctcgctccgaagcaagaccgcccatattttccct

SEQ ID NO: 51482 - DNA, 35 bp, Artificial Sequence
  Synthetic oligonucleotide
gccgacccgcattaataactctgatacttagcgct

SEQ ID NO: 51483 - DNA, 35 bp, Artificial Sequence
  Synthetic oligonucleotide
tagaatgccagccgcgcgcacatctcccctaacaa

SEQ ID NO: 51484 - DNA, 36 bp, Artificial Sequence
  Synthetic oligonucleotide
agaatgatgtcacgggggtcaaggggagtgggagaa

SEQ ID NO: 51485 - DNA, 36 bp, Artificial Sequence
  Synthetic oligonucleotide
aaacgaacagcaccgtctcgcctacctctctctgaa

SEQ ID NO: 51486 - DNA, 36 bp, Artificial Sequence
  Synthetic oligonucleotide
gacctactcccgcaacctactcgttcatgctgataa

SEQ ID NO: 51487 - DNA, 35 bp, Artificial Sequence
  Synthetic oligonucleotide
gattcacatccggtcatttcgctacttagggctaa

SEQ ID NO: 51488 - DNA, 35 bp, Artificial Sequence
  Synthetic oligonucleotide
acgcacaccatattgcggtcttctttgttctgtaa

SEQ ID NO: 51489 - DNA, 36 bp, Artificial Sequence
  Synthetic oligonucleotide
aagatcagctggcaagaggggtcgggaggataagca

SEQ ID NO: 51490 - DNA, 35 bp, Artificial Sequence
  Synthetic oligonucleotide
acacgggggtggagggtattgcaacgctgggctca

SEQ ID NO: 51491 - DNA, 37 bp, Artificial Sequence
  Synthetic oligonucleotide
ggagggatgatcgggcgcatgggcaagggaggaaaga

SEQ ID NO: 51492 - DNA, 37 bp, Artificial Sequence
  Synthetic oligonucleotide
gcccggtccaagtgggcgtcccccgttctttccacga

SEQ ID NO: 51493 - DNA, 37 bp, Artificial Sequence
  Synthetic oligonucleotide
gaagtgagagaggcggggcggtgggtggaatgtacga

SEQ ID NO: 51494 - DNA, 37 bp, Artificial Sequence
  Synthetic oligonucleotide
gcccctgggcatggggtacgggaaggtgaacggggga

SEQ ID NO: 51495 - DNA, 36 bp, Artificial Sequence
  Synthetic oligonucleotide
atgcggactcaggttaaggtagggggaagggtggga

SEQ ID NO: 51496 - DNA, 36 bp, Artificial Sequence
  Synthetic oligonucleotide
agccacccgtctacgtctccctgcttgttcgctgga

SEQ ID NO: 51497 - DNA, 38 bp, Artificial Sequence
  Synthetic oligonucleotide
gacgccaccactccgaagtaaaccgatccccgatatga

SEQ ID NO: 51498 - DNA, 38 bp, Artificial Sequence
  Synthetic oligonucleotide
gtgactatccggctccgtcccctgccctcgaaagctga

SEQ ID NO: 51499 - DNA, 38 bp, Artificial Sequence
  Synthetic oligonucleotide
gagggcgtgaggctcaaagggaacgggcggatgcgtga

SEQ ID NO: 51500 - DNA, 38 bp, Artificial Sequence
  Synthetic oligonucleotide
ttgagcacatttgaccatactcagccttctcatcgtga

SEQ ID NO: 51501 - DNA, 38 bp, Artificial Sequence
  Synthetic oligonucleotide
gtaggagaggatggtgtgtgacggacgaggagaggtga

SEQ ID NO: 51502 - DNA, 38 bp, Artificial Sequence
  Synthetic oligonucleotide
tgcaaccacatctgcttcggcgtcccagtactccttga

SEQ ID NO: 51503 - DNA, 36 bp, Artificial Sequence
  Synthetic oligonucleotide
tccgctaccctcacgctacccccatgggacagcata

SEQ ID NO: 51504 - DNA, 36 bp, Artificial Sequence
  Synthetic oligonucleotide
gtgaccgtcctcaatgagatttgctccgtccgtcta

SEQ ID NO: 51505 - DNA, 36 bp, Artificial Sequence
  Synthetic oligonucleotide
ggtgcacccccttccgagtactctttcttggttcta

SEQ ID NO: 51506 - DNA, 35 bp, Artificial Sequence
  Synthetic oligonucleotide
ttacgtcccgcctccgcacaactgacgttcacgta

SEQ ID NO: 51507 - DNA, 35 bp, Artificial Sequence
  Synthetic oligonucleotide
ttcggatgcggagtgagcagggggatggttgtgta

SEQ ID NO: 51508 - DNA, 36 bp, Artificial Sequence
  Synthetic oligonucleotide
taacctcgccatccagcttttcaaagtaccacctta

SEQ ID NO: 51509 - DNA, 36 bp, Artificial Sequence
  Synthetic oligonucleotide
taccggaccctgtagcatgcgcactttatcttctta

SEQ ID NO: 51510 - DNA, 35 bp, Artificial Sequence
  Synthetic oligonucleotide
agtgccaccgcctcattgaaaccgtttatttttta

SEQ ID NO: 51511 - DNA, 35 bp, Artificial Sequence
  Synthetic oligonucleotide
tccccgccactacagccccggacttccacgtcaac

SEQ ID NO: 51512 - DNA, 35 bp, Artificial Sequence
  Synthetic oligonucleotide
acgcccgcctcgcttgtctctgctcatcttggaac

SEQ ID NO: 51513 - DNA, 35 bp, Artificial Sequence
  Synthetic oligonucleotide
aactaccctccgctagatctacactgggcattcac

SEQ ID NO: 51514 - DNA, 35 bp, Artificial Sequence
  Synthetic oligonucleotide
tccgcgcaagcctttgcccttgaccactgctatac

SEQ ID NO: 51515 - DNA, 35 bp, Artificial Sequence
  Synthetic oligonucleotide
aagtggccccatgagcctccatgttctaccattac

SEQ ID NO: 51516 - DNA, 35 bp, Artificial Sequence
  Synthetic oligonucleotide
gtcacaacgtacgaatccttgacgcgccgtatacc

SEQ ID NO: 51517 - DNA, 35 bp, Artificial Sequence
  Synthetic oligonucleotide
atgacctcaataccagggcacgcaacatctttacc

SEQ ID NO: 51518 - DNA, 35 bp, Artificial Sequence
  Synthetic oligonucleotide
ttggaggctcaggtaacgttttgatcttggttgcc

SEQ ID NO: 51519 - DNA, 35 bp, Artificial Sequence
  Synthetic oligonucleotide
acctgtgttcctccccgatgcgtgttatctggtcc

SEQ ID NO: 51520 - DNA, 34 bp, Artificial Sequence
  Synthetic oligonucleotide
gaacccgccgaagcgtaacgccaacccacttagc

SEQ ID NO: 51521 - DNA, 35 bp, Artificial Sequence
  Synthetic oligonucleotide
tcacgcaggcccgcagcccccggtcacgctgactc

SEQ ID NO: 51522 - DNA, 35 bp, Artificial Sequence
  Synthetic oligonucleotide
gccaacattccatcaggccatagagaacacgcctc

SEQ ID NO: 51523 - DNA, 35 bp, Artificial Sequence
  Synthetic oligonucleotide
tagtggccgagttcgctgttccctaatgcctcctc

SEQ ID NO: 51524 - DNA, 35 bp, Artificial Sequence
  Synthetic oligonucleotide
tcatgctcggctctcacttcttccccacgtatttc

SEQ ID NO: 51525 - DNA, 35 bp, Artificial Sequence
  Synthetic oligonucleotide
accaggcccccctaccattgcccgagcctacaccg

SEQ ID NO: 51526 - DNA, 35 bp, Artificial Sequence
  Synthetic oligonucleotide
gggaagggaaggaggcagtaaggcttgagcgggcg

SEQ ID NO: 51527 - DNA, 35 bp, Artificial Sequence
  Synthetic oligonucleotide
tctcaccgccaccgttatgacctgtagccacatcg

SEQ ID NO: 51528 - DNA, 35 bp, Artificial Sequence
  Synthetic oligonucleotide
gacaccgggggaatagtatgtgctgatggggaatg

SEQ ID NO: 51529 - DNA, 35 bp, Artificial Sequence
  Synthetic oligonucleotide
tctaggatgcggtggaaaggaaggaagataggatg

SEQ ID NO: 51530 - DNA, 35 bp, Artificial Sequence
  Synthetic oligonucleotide
tcaagagggaaggggctgagtcgttaggaaaattg

SEQ ID NO: 51531 - DNA, 35 bp, Artificial Sequence
  Synthetic oligonucleotide
tctacccttgattgatattcacgctgtacccaact

SEQ ID NO: 51532 - DNA, 35 bp, Artificial Sequence
  Synthetic oligonucleotide
tacgttcgcccttctctcggcttcaatccgagcct

SEQ ID NO: 51533 - DNA, 35 bp, Artificial Sequence
  Synthetic oligonucleotide
gggaacgataccggtggcattggcactcgacctct

SEQ ID NO: 51534 - DNA, 35 bp, Artificial Sequence
  Synthetic oligonucleotide
tagtcactcaccgtcttccagcctcgttataactt

SEQ ID NO: 51535 - DNA, 35 bp, Artificial Sequence
  Synthetic oligonucleotide
tacatgcgtaccggacacgttcagaaccccccctt

SEQ ID NO: 51536 - DNA, 35 bp, Artificial Sequence
  Synthetic oligonucleotide
gaaccccccgataacgtccttatttacgtttctaa

SEQ ID NO: 51537 - DNA, 36 bp, Artificial Sequence
  Synthetic oligonucleotide
atcacgtcatactatccaccgacttgaccgccgtaa

SEQ ID NO: 51538 - DNA, 35 bp, Artificial Sequence
  Synthetic oligonucleotide
gtgccgagctttgaactctttaccgtactgcttaa

SEQ ID NO: 51539 - DNA, 35 bp, Artificial Sequence
  Synthetic oligonucleotide
acttaccgttccaccacgtgacaatctttagcaca

SEQ ID NO: 51540 - DNA, 36 bp, Artificial Sequence
  Synthetic oligonucleotide
gttgtgaacatgcgttttggcccaccctccttgaca

SEQ ID NO: 51541 - DNA, 36 bp, Artificial Sequence
  Synthetic oligonucleotide
tgacctaggtcctcccccacaaacacatggtttaca

SEQ ID NO: 51542 - DNA, 36 bp, Artificial Sequence
  Synthetic oligonucleotide
atgggtgtgtgagttgggtgagcgtgggaggaaaga

SEQ ID NO: 51543 - DNA, 37 bp, Artificial Sequence
  Synthetic oligonucleotide
tggttgcctcacctctgctctcaatccctgttacaga

SEQ ID NO: 51544 - DNA, 36 bp, Artificial Sequence
  Synthetic oligonucleotide
gacgaaattgcagcgcgcctcccatctttgatccga

SEQ ID NO: 51545 - DNA, 36 bp, Artificial Sequence
  Synthetic oligonucleotide
gtacgcgctacaactggttttctgctgagccctcga

SEQ ID NO: 51546 - DNA, 34 bp, Artificial Sequence
  Synthetic oligonucleotide
acccgcctcatccactgcataatacatgcctcga

SEQ ID NO: 51547 - DNA, 37 bp, Artificial Sequence
  Synthetic oligonucleotide
tcacatcataaccgttctccaaccagacagatctcga

SEQ ID NO: 51548 - DNA, 37 bp, Artificial Sequence
  Synthetic oligonucleotide
agcgcatgaaggaccggtggagagaggctggagagga

SEQ ID NO: 51549 - DNA, 37 bp, Artificial Sequence
  Synthetic oligonucleotide
tccacgtcgaaacttcccctcatccgcctggattgga

SEQ ID NO: 51550 - DNA, 38 bp, Artificial Sequence
  Synthetic oligonucleotide
tcaccatcactgcatatatttattccatcatgtaatga

SEQ ID NO: 51551 - DNA, 38 bp, Artificial Sequence
  Synthetic oligonucleotide
gcccacccagaggatgtccccactcccagccgcactga

SEQ ID NO: 51552 - DNA, 37 bp, Artificial Sequence
  Synthetic oligonucleotide
gagtaggagtgggcgggggcataggggtggtcactga

SEQ ID NO: 51553 - DNA, 38 bp, Artificial Sequence
  Synthetic oligonucleotide
gactgggtgcggtgggtttgtgccactgtcgggactga

SEQ ID NO: 51554 - DNA, 36 bp, Artificial Sequence
  Synthetic oligonucleotide
tccgactccaggctttaatgcgctacacactactga

SEQ ID NO: 51555 - DNA, 38 bp, Artificial Sequence
  Synthetic oligonucleotide
atcggcataactccagccgtgatcttttaccaccctga

SEQ ID NO: 51556 - DNA, 38 bp, Artificial Sequence
  Synthetic oligonucleotide
gcatagccgtcgctccagggttcgcatctttcttctga

SEQ ID NO: 51557 - DNA, 38 bp, Artificial Sequence
  Synthetic oligonucleotide
aagctagggagggggcgggaggatacaggacgaagtga

SEQ ID NO: 51558 - DNA, 37 bp, Artificial Sequence
  Synthetic oligonucleotide
tcccgtcgccattaactttgtacctcttataccgtga

SEQ ID NO: 51559 - DNA, 35 bp, Artificial Sequence
  Synthetic oligonucleotide
tgccaactgaccctgagttcaacctacgtatgtga

SEQ ID NO: 51560 - DNA, 38 bp, Artificial Sequence
  Synthetic oligonucleotide
gatccagcctaccctgtgtggtttgcctgctgttgtga

SEQ ID NO: 51561 - DNA, 37 bp, Artificial Sequence
  Synthetic oligonucleotide
tatcccagctcgcagccaccctaccacgttcacttga

SEQ ID NO: 51562 - DNA, 37 bp, Artificial Sequence
  Synthetic oligonucleotide
gccccgccctgaatacaccgaccgctgaaaagcttga

SEQ ID NO: 51563 - DNA, 37 bp, Artificial Sequence
  Synthetic oligonucleotide
gtaacccgcacagaacttgtccatcttttcttgttga

SEQ ID NO: 51564 - DNA, 35 bp, Artificial Sequence
  Synthetic oligonucleotide
actcccagccatccgcgctctgacgtttcctgata

SEQ ID NO: 51565 - DNA, 36 bp, Artificial Sequence
  Synthetic oligonucleotide
atcgcgagcaccccttccgaatatttgggttatcta

SEQ ID NO: 51566 - DNA, 36 bp, Artificial Sequence
  Synthetic oligonucleotide
acgtccggcccatcccttttcccatgtagacatgta

SEQ ID NO: 51567 - DNA, 35 bp, Artificial Sequence
  Synthetic oligonucleotide
atccactcaccgccgcctatttcgtggttggaaac

SEQ ID NO: 51568 - DNA, 35 bp, Artificial Sequence
  Synthetic oligonucleotide
gtaccccaagttgataggcctattgtacattccac

SEQ ID NO: 51569 - DNA, 35 bp, Artificial Sequence
  Synthetic oligonucleotide
gcgcagttcggctgccccttcttgtaccgtttgac

SEQ ID NO: 51570 - DNA, 36 bp, Artificial Sequence
  Synthetic oligonucleotide
acagagtaggccttcagctccttgtccaccgtaacc

SEQ ID NO: 51571 - DNA, 35 bp, Artificial Sequence
  Synthetic oligonucleotide
gaaactacacgtagtccatctaatgcgcatgcccc

SEQ ID NO: 51572 - DNA, 35 bp, Artificial Sequence
  Synthetic oligonucleotide
tatgccattgaatttgtcccgtcccagcctatgcc

SEQ ID NO: 51573 - DNA, 35 bp, Artificial Sequence
  Synthetic oligonucleotide
aagtccgccctcgaacctttctcaatcgtatttcc

SEQ ID NO: 51574 - DNA, 35 bp, Artificial Sequence
  Synthetic oligonucleotide
atagagggaagtacagggaagaggatccagcaagc

SEQ ID NO: 51575 - DNA, 36 bp, Artificial Sequence
  Synthetic oligonucleotide
gccaccccttgctcggactattcgcggggaccacgc

SEQ ID NO: 51576 - DNA, 35 bp, Artificial Sequence
  Synthetic oligonucleotide
atgcaccacctttgcgatttccttgccacaccggc

SEQ ID NO: 51577 - DNA, 35 bp, Artificial Sequence
  Synthetic oligonucleotide
aagtcacaacaactccgtcccatgggccttgcatc

SEQ ID NO: 51578 - DNA, 35 bp, Artificial Sequence
  Synthetic oligonucleotide
gccatgccctcctcttcctcgttcgacttgttttc

SEQ ID NO: 51579 - DNA, 35 bp, Artificial Sequence
  Synthetic oligonucleotide
tagacccgggaggggggacttgagggagtaggtag

SEQ ID NO: 51580 - DNA, 35 bp, Artificial Sequence
  Synthetic oligonucleotide
agttcatccccggcctgagtgcccctctatgcccg

SEQ ID NO: 51581 - DNA, 35 bp, Artificial Sequence
  Synthetic oligonucleotide
attcgtccgaccatgttgtctggctacctcttctg

SEQ ID NO: 51582 - DNA, 35 bp, Artificial Sequence
  Synthetic oligonucleotide
tgtctacacacgcacgcggacttctgctctactat

SEQ ID NO: 51583 - DNA, 35 bp, Artificial Sequence
  Synthetic oligonucleotide
actgctcaattcccggttcacaactgttactttgt

SEQ ID NO: 51584 - DNA, 35 bp, Artificial Sequence
  Synthetic oligonucleotide
aagacaaacatggggcggggtaaaggcgatagctt

SEQ ID NO: 51585 - DNA, 35 bp, Artificial Sequence
  Synthetic oligonucleotide
tacagtgcaaccacgcagaccatacttccttgctt

SEQ ID NO: 51586 - DNA, 35 bp, Artificial Sequence
  Synthetic oligonucleotide
acgaccatatacgcgagctgtcctcttcagttctt

SEQ ID NO: 51587 - DNA, 35 bp, Artificial Sequence
  Synthetic oligonucleotide
gatgcccgcccgaatgctagagtcttcctcatgtt

SEQ ID NO: 51588 - DNA, 35 bp, Artificial Sequence
  Synthetic oligonucleotide
tcctacttgccctggactggatgcctgaagttttt

SEQ ID NO: 51589 - DNA, 36 bp, Artificial Sequence
  Synthetic oligonucleotide
ttgacatctctgttccacttgagcccaggcttccaa

SEQ ID NO: 51590 - DNA, 35 bp, Artificial Sequence
  Synthetic oligonucleotide
ttcggtatacctccaccagcctcctgtaacatcaa

SEQ ID NO: 51591 - DNA, 36 bp, Artificial Sequence
  Synthetic oligonucleotide
tagctcgttgcgccgcccagtcttgtcaccttcgaa

SEQ ID NO: 51592 - DNA, 36 bp, Artificial Sequence
  Synthetic oligonucleotide
aagactgagggagataggagcgagtggaacggggaa

SEQ ID NO: 51593 - DNA, 36 bp, Artificial Sequence
  Synthetic oligonucleotide
taccgaacgccaatggcaccttttcgcctgtgctaa

SEQ ID NO: 51594 - DNA, 36 bp, Artificial Sequence
  Synthetic oligonucleotide
accatcccgactcttgtcgtttttcctaggttccca

SEQ ID NO: 51595 - DNA, 36 bp, Artificial Sequence
  Synthetic oligonucleotide
acctgtcgcaagccgtgctctcctaaaggcatgcca

SEQ ID NO: 51596 - DNA, 35 bp, Artificial Sequence
  Synthetic oligonucleotide
tcgctacgttttgtctatgtcttccacccgcggca

SEQ ID NO: 51597 - DNA, 36 bp, Artificial Sequence
  Synthetic oligonucleotide
gcatcctaaggcgcggtccctgaccccatttctgca

SEQ ID NO: 51598 - DNA, 35 bp, Artificial Sequence
  Synthetic oligonucleotide
aaccgcattccctttagctttgtatccctcgctca

SEQ ID NO: 51599 - DNA, 36 bp, Artificial Sequence
  Synthetic oligonucleotide
gacacgacctgccactgcaagtaacctcattattca

SEQ ID NO: 51600 - DNA, 36 bp, Artificial Sequence
  Synthetic oligonucleotide
aatgctgcctccattcccgggacctgcacagtttca

SEQ ID NO: 51601 - DNA, 37 bp, Artificial Sequence
  Synthetic oligonucleotide
atccgctcgcctcctatctgactccataatatgcaga

SEQ ID NO: 51602 - DNA, 36 bp, Artificial Sequence
  Synthetic oligonucleotide
gagacgggggtagggggtcctaggaggtaactgaga

SEQ ID NO: 51603 - DNA, 37 bp, Artificial Sequence
  Synthetic oligonucleotide
agaagacgctcactgcccacccagcccactccgccga

SEQ ID NO: 51604 - DNA, 37 bp, Artificial Sequence
  Synthetic oligonucleotide
tcctcaacactcccatttatctgacgaatgccttcga

SEQ ID NO: 51605 - DNA, 37 bp, Artificial Sequence
  Synthetic oligonucleotide
gcatccgcagtctttcgctctgtccaactgtttagga

SEQ ID NO: 51606 - DNA, 37 bp, Artificial Sequence
  Synthetic oligonucleotide
gttggtgaggggtgggcggggctgatctgaccatgga

SEQ ID NO: 51607 - DNA, 38 bp, Artificial Sequence
  Synthetic oligonucleotide
tagcactccaggccacttcgtgctgactactctcatga

SEQ ID NO: 51608 - DNA, 38 bp, Artificial Sequence
  Synthetic oligonucleotide
ttggaagagcgggactgggtgggatgccatgttgctga

SEQ ID NO: 51609 - DNA, 38 bp, Artificial Sequence
  Synthetic oligonucleotide
accggactgcctccctggtgcctcccctgtctaggtga

SEQ ID NO: 51610 - DNA, 35 bp, Artificial Sequence
  Synthetic oligonucleotide
gccccgcccacttcgaaactctggctttttggtga

SEQ ID NO: 51611 - DNA, 38 bp, Artificial Sequence
  Synthetic oligonucleotide
gggggaggtgagccatatgagatggtggtaggatgtga

SEQ ID NO: 51612 - DNA, 37 bp, Artificial Sequence
  Synthetic oligonucleotide
ggtactgccccttcccccaattatggtccatgcttga

SEQ ID NO: 51613 - DNA, 38 bp, Artificial Sequence
  Synthetic oligonucleotide
tccaccttctggtaatgcatatacactctacatgttga

SEQ ID NO: 51614 - DNA, 35 bp, Artificial Sequence
  Synthetic oligonucleotide
tcacatctattggaccactgtttttctcctgttga

SEQ ID NO: 51615 - DNA, 38 bp, Artificial Sequence
  Synthetic oligonucleotide
gccaagacgggcacgggcgtgtttgttacgggtgttga

SEQ ID NO: 51616 - DNA, 38 bp, Artificial Sequence
  Synthetic oligonucleotide
ttcgaaccgtcaagtctcctgtttccctccttgtttga

SEQ ID NO: 51617 - DNA, 35 bp, Artificial Sequence
  Synthetic oligonucleotide
gctccgcctcacatcagtgcctctttgattactta

SEQ ID NO: 51618 - DNA, 36 bp, Artificial Sequence
  Synthetic oligonucleotide
gggggtggtggggtaagggggtttaaatacacgtta

SEQ ID NO: 51619 - DNA, 35 bp, Artificial Sequence
  Synthetic oligonucleotide
gaccattgcggcgctcctcccatataaccccgaac

SEQ ID NO: 51620 - DNA, 35 bp, Artificial Sequence
  Synthetic oligonucleotide
tcgagtacgccgtgctcctaggcacattcccacac

SEQ ID NO: 51621 - DNA, 35 bp, Artificial Sequence
  Synthetic oligonucleotide
gccgcctcaccatatgcttgcggttaaacccccac

SEQ ID NO: 51622 - DNA, 36 bp, Artificial Sequence
  Synthetic oligonucleotide
tcaaacaacgggcccatgtctgtcttcatccgccac

SEQ ID NO: 51623 - DNA, 35 bp, Artificial Sequence
  Synthetic oligonucleotide
gcatcactcgggtttttcttaatgctttgccttac

SEQ ID NO: 51624 - DNA, 35 bp, Artificial Sequence
  Synthetic oligonucleotide
gctaacccgctagacctgccttgagtgtccccccc

SEQ ID NO: 51625 - DNA, 35 bp, Artificial Sequence
  Synthetic oligonucleotide
acacaaactggctttatgtatccatggccaatccc

SEQ ID NO: 51626 - DNA, 35 bp, Artificial Sequence
  Synthetic oligonucleotide
atgtcagggcatatcttcgtcacgcataacctccc

SEQ ID NO: 51627 - DNA, 35 bp, Artificial Sequence
  Synthetic oligonucleotide
tacacctgctcacacgcgtgctactcaatccatcc

SEQ ID NO: 51628 - DNA, 35 bp, Artificial Sequence
  Synthetic oligonucleotide
actctctcggtctgtattggtctgtcccgctttcc

SEQ ID NO: 51629 - DNA, 35 bp, Artificial Sequence
  Synthetic oligonucleotide
gcgcctacctacatcgcaatttctaccgcatctgc

SEQ ID NO: 51630 - DNA, 35 bp, Artificial Sequence
  Synthetic oligonucleotide
tgatgaccaacttaacacgacgcttatcgtcgctc

SEQ ID NO: 51631 - DNA, 35 bp, Artificial Sequence
  Synthetic oligonucleotide
gaacctccaacacttaagcgacccacttcagggtc

SEQ ID NO: 51632 - DNA, 35 bp, Artificial Sequence
  Synthetic oligonucleotide
tgagactccgcacgctcgcctggcccttccctgtc

SEQ ID NO: 51633 - DNA, 35 bp, Artificial Sequence
  Synthetic oligonucleotide
atccaccgagactgcttgctgcgtaacctcgattc

SEQ ID NO: 51634 - DNA, 35 bp, Artificial Sequence
  Synthetic oligonucleotide
tcactcacgaagccatgatacgcttcgaaccgttc

SEQ ID NO: 51635 - DNA, 35 bp, Artificial Sequence
  Synthetic oligonucleotide
gtgaccacggtatgtaccgaaccttctcctagacg

SEQ ID NO: 51636 - DNA, 35 bp, Artificial Sequence
  Synthetic oligonucleotide
gcgctgcacggactaagtctgattgcacctgttcg

SEQ ID NO: 51637 - DNA, 35 bp, Artificial Sequence
  Synthetic oligonucleotide
tgatgacgaagtaagggtgggtaatcgaataaagg

SEQ ID NO: 51638 - DNA, 35 bp, Artificial Sequence
  Synthetic oligonucleotide
tgtcatcccaaagcaccgcccccattatcatgcgg

SEQ ID NO: 51639 - DNA, 35 bp, Artificial Sequence
  Synthetic oligonucleotide
atctactcccctacgtccgagcgcgcaatatactg

SEQ ID NO: 51640 - DNA, 34 bp, Artificial Sequence
  Synthetic oligonucleotide
atgccacccttagttcgcgccacccataactaat

SEQ ID NO: 51641 - DNA, 35 bp, Artificial Sequence
  Synthetic oligonucleotide
accccagcccatcgcaagcttacccggctgaccat

SEQ ID NO: 51642 - DNA, 35 bp, Artificial Sequence
  Synthetic oligonucleotide
accgcatgccctagctacctacatttacataggat

SEQ ID NO: 51643 - DNA, 35 bp, Artificial Sequence
  Synthetic oligonucleotide
acatgcggttgccatgtcatcactcccgcgattat

SEQ ID NO: 51644 - DNA, 35 bp, Artificial Sequence
  Synthetic oligonucleotide
atatcccgatgtacctccgcaaggtcctcgcacct

SEQ ID NO: 51645 - DNA, 35 bp, Artificial Sequence
  Synthetic oligonucleotide
ccacgccacccacctcgagcaccaccgttcgtgct

SEQ ID NO: 51646 - DNA, 35 bp, Artificial Sequence
  Synthetic oligonucleotide
gaccccggttggtatttttccctcttggtccttct

SEQ ID NO: 51647 - DNA, 33 bp, Artificial Sequence
  Synthetic oligonucleotide
tctgcatctctcttcgtcccccgataacgcctt

SEQ ID NO: 51648 - DNA, 36 bp, Artificial Sequence
  Synthetic oligonucleotide
ggggggggtggaaacgatttcaaggagggtagcaaa

SEQ ID NO: 51649 - DNA, 36 bp, Artificial Sequence
  Synthetic oligonucleotide
gatcggtgagagggcctgggtagggtacgggagtaa

SEQ ID NO: 51650 - DNA, 36 bp, Artificial Sequence
  Synthetic oligonucleotide
gcactccgcaccgtttagggcctcgacccacccaca

SEQ ID NO: 51651 - DNA, 36 bp, Artificial Sequence
  Synthetic oligonucleotide
ttgcgccctacgaatcccagcagttccatatgccca

SEQ ID NO: 51652 - DNA, 35 bp, Artificial Sequence
  Synthetic oligonucleotide
agccgcaccgcaaatttcatactaattctgtgcca

SEQ ID NO: 51653 - DNA, 35 bp, Artificial Sequence
  Synthetic oligonucleotide
taagtaccccgcccgcttacatgtcgtgaatggca

SEQ ID NO: 51654 - DNA, 35 bp, Artificial Sequence
  Synthetic oligonucleotide
gtacagtgtcccgccgcctgtgactacgtttttca

SEQ ID NO: 51655 - DNA, 37 bp, Artificial Sequence
  Synthetic oligonucleotide
gtaggagggtgatgcggggccggagtgttggcggaga

SEQ ID NO: 51656 - DNA, 37 bp, Artificial Sequence
  Synthetic oligonucleotide
tgcgaacccagtgtagggataagtggggtggtaacga

SEQ ID NO: 51657 - DNA, 36 bp, Artificial Sequence
  Synthetic oligonucleotide
tatacccccacagtacgtcgcctttccgctcatcga

SEQ ID NO: 51658 - DNA, 35 bp, Artificial Sequence
  Synthetic oligonucleotide
gttcacagcaccattcattccgcttttgccaggga

SEQ ID NO: 51659 - DNA, 37 bp, Artificial Sequence
  Synthetic oligonucleotide
aacgacagggccgggcagtcatggtggggccggggga

SEQ ID NO: 51660 - DNA, 37 bp, Artificial Sequence
  Synthetic oligonucleotide
aagtgcgggtcggccctttttcctctccacgctggga

SEQ ID NO: 51661 - DNA, 35 bp, Artificial Sequence
  Synthetic oligonucleotide
acgaacgtacggcacttcatgaacttttcggtgga

SEQ ID NO: 51662 - DNA, 35 bp, Artificial Sequence
  Synthetic oligonucleotide
atcacgacatcagtcttgctgctactcttacctga

SEQ ID NO: 51663 - DNA, 38 bp, Artificial Sequence
  Synthetic oligonucleotide
tgtgagacgtgggatggaggatggtatgttcaaagtga

SEQ ID NO: 51664 - DNA, 38 bp, Artificial Sequence
  Synthetic oligonucleotide
ttggtgggcactatggctcaactgcttttttcccgtga

SEQ ID NO: 51665 - DNA, 37 bp, Artificial Sequence
  Synthetic oligonucleotide
gatgggaggcacatggcgagggggtcgggaagcgtga

SEQ ID NO: 51666 - DNA, 37 bp, Artificial Sequence
  Synthetic oligonucleotide
tcccaccttgccgatggaccacttctacacagcgtga

SEQ ID NO: 51667 - DNA, 38 bp, Artificial Sequence
  Synthetic oligonucleotide
aacccccccacacagatgttacctacggagcatggtga

SEQ ID NO: 51668 - DNA, 37 bp, Artificial Sequence
  Synthetic oligonucleotide
gaacaccactgagtacgcaccatctgattccccttga

SEQ ID NO: 51669 - DNA, 38 bp, Artificial Sequence
  Synthetic oligonucleotide
ggagggaggggaaagggaggccttggtgaaaaggttga

SEQ ID NO: 51670 - DNA, 38 bp, Artificial Sequence
  Synthetic oligonucleotide
tacatgttcgtgctgccgtcaatcattcccgcctttga

SEQ ID NO: 51671 - DNA, 36 bp, Artificial Sequence
  Synthetic oligonucleotide
atcaccctcccacagccgtgggcttaatacctcata

SEQ ID NO: 51672 - DNA, 36 bp, Artificial Sequence
  Synthetic oligonucleotide
agacgggaaaatggaggacgggaacaagggggtata

SEQ ID NO: 51673 - DNA, 36 bp, Artificial Sequence
  Synthetic oligonucleotide
tatcgatgcagccccctcaggtcctcaaaccgcgta

SEQ ID NO: 51674 - DNA, 36 bp, Artificial Sequence
  Synthetic oligonucleotide
ttcgccaatcgttactatttcagccttctctgctta

SEQ ID NO: 51675 - DNA, 36 bp, Artificial Sequence
  Synthetic oligonucleotide
tatgcaccgtatttgttcgcgtggccaattccttta

SEQ ID NO: 51676 - DNA, 35 bp, Artificial Sequence
  Synthetic oligonucleotide
gccgcgcggaccgctgagctcatccctgtctctac

SEQ ID NO: 51677 - DNA, 35 bp, Artificial Sequence
  Synthetic oligonucleotide
tgccctcgtagccattcaagttcttgtttgccgcc

SEQ ID NO: 51678 - DNA, 35 bp, Artificial Sequence
  Synthetic oligonucleotide
aagtaacatcccataaccgttccaggtactagtcc

SEQ ID NO: 51679 - DNA, 35 bp, Artificial Sequence
  Synthetic oligonucleotide
ttttacgcggccacgattagctcatatctacttcc

SEQ ID NO: 51680 - DNA, 35 bp, Artificial Sequence
  Synthetic oligonucleotide
gtgtcaagcccccttggcatgctctgactctcatc

SEQ ID NO: 51681 - DNA, 35 bp, Artificial Sequence
  Synthetic oligonucleotide
gccggcttggccgcacaatcctcgtacttccgctc

SEQ ID NO: 51682 - DNA, 35 bp, Artificial Sequence
  Synthetic oligonucleotide
ggtgcaccctgtccgcaagctctatcactgctctc

SEQ ID NO: 51683 - DNA, 35 bp, Artificial Sequence
  Synthetic oligonucleotide
ggaatcgtatgattcggcttcttatcctgtctctc

SEQ ID NO: 51684 - DNA, 35 bp, Artificial Sequence
  Synthetic oligonucleotide
tagaaggccaggcatcagctcccctgtactctttc

SEQ ID NO: 51685 - DNA, 35 bp, Artificial Sequence
  Synthetic oligonucleotide
gccaccttgcaacttcactctggcttggttctttc

SEQ ID NO: 51686 - DNA, 35 bp, Artificial Sequence
  Synthetic oligonucleotide
ttgcccggctggtcaaagcatcacgaatcccaccg

SEQ ID NO: 51687 - DNA, 35 bp, Artificial Sequence
  Synthetic oligonucleotide
aagtcgtagtgacggggggaagcaagaaaaggggg

SEQ ID NO: 51688 - DNA, 35 bp, Artificial Sequence
  Synthetic oligonucleotide
ggtaaagtcacgcgttccttaactactccatcctg

SEQ ID NO: 51689 - DNA, 35 bp, Artificial Sequence
  Synthetic oligonucleotide
aggtgggaacggcgctgggggggcgggaggtacat

SEQ ID NO: 51690 - DNA, 34 bp, Artificial Sequence
  Synthetic oligonucleotide
tgcctcgcctgtccccacttgcttgtttttggat

SEQ ID NO: 51691 - DNA, 35 bp, Artificial Sequence
  Synthetic oligonucleotide
tttgcgcctcccataaacggattcagaaatggcct

SEQ ID NO: 51692 - DNA, 35 bp, Artificial Sequence
  Synthetic oligonucleotide
gctcccatcatggcaacggaaccaccaccacggct

SEQ ID NO: 51693 - DNA, 35 bp, Artificial Sequence
  Synthetic oligonucleotide
atctcatctgacgtacttgcactgggccgactctt

SEQ ID NO: 51694 - DNA, 35 bp, Artificial Sequence
  Synthetic oligonucleotide
acgaccatcccccctcagtctccatggcctggttt

SEQ ID NO: 51695 - DNA, 35 bp, Artificial Sequence
  Synthetic oligonucleotide
acgatgtgtgccccatctgttctggtctattgttt

SEQ ID NO: 51696 - DNA, 36 bp, Artificial Sequence
  Synthetic oligonucleotide
gttcacccctctatacttccagcacactggttaaaa

SEQ ID NO: 51697 - DNA, 36 bp, Artificial Sequence
  Synthetic oligonucleotide
gactcgagccccatagactgaacctggccaatcaaa

SEQ ID NO: 51698 - DNA, 35 bp, Artificial Sequence
  Synthetic oligonucleotide
atggacaagccgaaaagaatgccgcactacctaaa

SEQ ID NO: 51699 - DNA, 35 bp, Artificial Sequence
  Synthetic oligonucleotide
tccacccgactgcttcgtgcaacgaccaagttaaa

SEQ ID NO: 51700 - DNA, 36 bp, Artificial Sequence
  Synthetic oligonucleotide
acctgagccccggctcgaccacagttacctgtccaa

SEQ ID NO: 51701 - DNA, 36 bp, Artificial Sequence
  Synthetic oligonucleotide
atcgacacgcagcgcgtcgaaacgggttttcatcaa

SEQ ID NO: 51702 - DNA, 36 bp, Artificial Sequence
  Synthetic oligonucleotide
agaggggggctggcaggaggtgcgtgaggatcgaca

SEQ ID NO: 51703 - DNA, 36 bp, Artificial Sequence
  Synthetic oligonucleotide
gagtgcgacacaatctgggctcctactacataacca

SEQ ID NO: 51704 - DNA, 36 bp, Artificial Sequence
  Synthetic oligonucleotide
tcccaatatccgctgcgtacttcttccggttggcca

SEQ ID NO: 51705 - DNA, 36 bp, Artificial Sequence
  Synthetic oligonucleotide
gaccagtctgctggtaggtgcgtacctcttcttcca

SEQ ID NO: 51706 - DNA, 36 bp, Artificial Sequence
  Synthetic oligonucleotide
aggtggatcacacctgggccgcctccctatctctca

SEQ ID NO: 51707 - DNA, 36 bp, Artificial Sequence
  Synthetic oligonucleotide
tcacgtccgctcaccgcccgaactaactttgcttca

SEQ ID NO: 51708 - DNA, 37 bp, Artificial Sequence
  Synthetic oligonucleotide
gccttgggggagatggcatatgggggagtgaggcaga

SEQ ID NO: 51709 - DNA, 37 bp, Artificial Sequence
  Synthetic oligonucleotide
tcctggacactgtgggcgccctatcttcatactgaga

SEQ ID NO: 51710 - DNA, 37 bp, Artificial Sequence
  Synthetic oligonucleotide
aatccccctgcctacgtggataccatacggtacacga

SEQ ID NO: 51711 - DNA, 36 bp, Artificial Sequence
  Synthetic oligonucleotide
gaccacccccctttgttcaagcgcgtcactacgcga

SEQ ID NO: 51712 - DNA, 37 bp, Artificial Sequence
  Synthetic oligonucleotide
gaagtccgtcggcatccttgtccagtggccccttcga

SEQ ID NO: 51713 - DNA, 37 bp, Artificial Sequence
  Synthetic oligonucleotide
tacccgctccaccaacggaatttgaggcagacaggga

SEQ ID NO: 51714 - DNA, 36 bp, Artificial Sequence
  Synthetic oligonucleotide
tcccaaccctccgctccattggactgttctactgga

SEQ ID NO: 51715 - DNA, 37 bp, Artificial Sequence
  Synthetic oligonucleotide
acattacgcagcctatgtcaccgccccgtttttatga

SEQ ID NO: 51716 - DNA, 38 bp, Artificial Sequence
  Synthetic oligonucleotide
agacaagtgaggggagcaacattaggggccgacactga

SEQ ID NO: 51717 - DNA, 36 bp, Artificial Sequence
  Synthetic oligonucleotide
gctgacatacctcaggcggaccgttcgaccctctga

SEQ ID NO: 51718 - DNA, 38 bp, Artificial Sequence
  Synthetic oligonucleotide
tctcctgcatacatatccctgcctacgtgacgacgtga

SEQ ID NO: 51719 - DNA, 38 bp, Artificial Sequence
  Synthetic oligonucleotide
aagtaccgcgttactcccccggccctccacattcgtga

SEQ ID NO: 51720 - DNA, 37 bp, Artificial Sequence
  Synthetic oligonucleotide
gctggaggggctgaagagagtgggtgttggctggtga

SEQ ID NO: 51721 - DNA, 38 bp, Artificial Sequence
  Synthetic oligonucleotide
agaacaccccttctcatcgcattgatcggacctattga

SEQ ID NO: 51722 - DNA, 38 bp, Artificial Sequence
  Synthetic oligonucleotide
gttggcgatctcttgttcttgcccggtcccattgttga

SEQ ID NO: 51723 - DNA, 36 bp, Artificial Sequence
  Synthetic oligonucleotide
tcaacaggcggttatgccttcgataaacacaacata

SEQ ID NO: 51724 - DNA, 35 bp, Artificial Sequence
  Synthetic oligonucleotide
caatccccccttcgccgatgctttctgctgacata

SEQ ID NO: 51725 - DNA, 36 bp, Artificial Sequence
  Synthetic oligonucleotide
aagatcagcgctgcacaccccgcacagtacgccata

SEQ ID NO: 51726 - DNA, 35 bp, Artificial Sequence
  Synthetic oligonucleotide
accccattagttcaacgcacgcatgtacctcccta

SEQ ID NO: 51727 - DNA, 36 bp, Artificial Sequence
  Synthetic oligonucleotide
tgcaggcaccctcccatattgatgcacaaactgcta

SEQ ID NO: 51728 - DNA, 36 bp, Artificial Sequence
  Synthetic oligonucleotide
gttcaccctctcgttgtatcactttattcagtgcta

SEQ ID NO: 51729 - DNA, 36 bp, Artificial Sequence
  Synthetic oligonucleotide
tcaccactgccagtatctattgccgtttcgcaatta

SEQ ID NO: 51730 - DNA, 35 bp, Artificial Sequence
  Synthetic oligonucleotide
tcagtcccccaccggacatactaaagcccatctta

SEQ ID NO: 51731 - DNA, 36 bp, Artificial Sequence
  Synthetic oligonucleotide
tagacagtgcccgagtcgttatcctccgtttcttta

SEQ ID NO: 51732 - DNA, 35 bp, Artificial Sequence
  Synthetic oligonucleotide
accgccggtcgaaaaccttcgatccaccttggaac

SEQ ID NO: 51733 - DNA, 35 bp, Artificial Sequence
  Synthetic oligonucleotide
aatggtcaccgctcgcatatcgattacgcagctac

SEQ ID NO: 51734 - DNA, 35 bp, Artificial Sequence
  Synthetic oligonucleotide
aaatggcccacccgaacaggaacagggtcaccacc

SEQ ID NO: 51735 - DNA, 35 bp, Artificial Sequence
  Synthetic oligonucleotide
ttgcgcggattgaatcgattcccctggcccatccc

SEQ ID NO: 51736 - DNA, 35 bp, Artificial Sequence
  Synthetic oligonucleotide
gtcactgtttgtaaacgctctggcctcccgctccc

SEQ ID NO: 51737 - DNA, 35 bp, Artificial Sequence
  Synthetic oligonucleotide
tattccgcctcgactaaacttcctccccacaagcc

SEQ ID NO: 51738 - DNA, 35 bp, Artificial Sequence
  Synthetic oligonucleotide
gtttatctgccccctcgcctactccaggaccagcc

SEQ ID NO: 51739 - DNA, 35 bp, Artificial Sequence
  Synthetic oligonucleotide
aacgcgtggccccgctggtaccagccaagcactcc

SEQ ID NO: 51740 - DNA, 35 bp, Artificial Sequence
  Synthetic oligonucleotide
tagaactccgattcccccatcgtaccctgccttgc

SEQ ID NO: 51741 - DNA, 35 bp, Artificial Sequence
  Synthetic oligonucleotide
gctgggtactagttatggcgccctgcactttttgc

SEQ ID NO: 51742 - DNA, 35 bp, Artificial Sequence
  Synthetic oligonucleotide
aactaacctcacattctgtcccagggtcgcacatc

SEQ ID NO: 51743 - DNA, 35 bp, Artificial Sequence
  Synthetic oligonucleotide
tttaccctggctggtccgtcgccccatatactatc

SEQ ID NO: 51744 - DNA, 35 bp, Artificial Sequence
  Synthetic oligonucleotide
gtgttgccgtgggaactaggaaaggggggggtatc

SEQ ID NO: 51745 - DNA, 35 bp, Artificial Sequence
  Synthetic oligonucleotide
acaggcccctccacgtccaacgtggcccgttactc

SEQ ID NO: 51746 - DNA, 35 bp, Artificial Sequence
  Synthetic oligonucleotide
tcggacatcaccactccgatgcaagccatcccctc

SEQ ID NO: 51747 - DNA, 35 bp, Artificial Sequence
  Synthetic oligonucleotide
aagtcccgtgcaccaccctctagccattgacagtc

SEQ ID NO: 51748 - DNA, 35 bp, Artificial Sequence
  Synthetic oligonucleotide
tctccatgcacaaatggagtttctgtgaaattttc

SEQ ID NO: 51749 - DNA, 35 bp, Artificial Sequence
  Synthetic oligonucleotide
tatgacagcagcagacgtcttggtcccgtgttccg

SEQ ID NO: 51750 - DNA, 35 bp, Artificial Sequence
  Synthetic oligonucleotide
gatgcacgacagaccaccggtacgcacacactgcg

SEQ ID NO: 51751 - DNA, 35 bp, Artificial Sequence
  Synthetic oligonucleotide
gcctgtgctggcttttgaaatgtatggttcccggg

SEQ ID NO: 51752 - DNA, 35 bp, Artificial Sequence
  Synthetic oligonucleotide
gagtgagggcatgttgtgggacgggggagtcacat

SEQ ID NO: 51753 - DNA, 35 bp, Artificial Sequence
  Synthetic oligonucleotide
gtgtacgcaacgatgttcaccacctacaaatacat

SEQ ID NO: 51754 - DNA, 35 bp, Artificial Sequence
  Synthetic oligonucleotide
agaccccgagcagaacccctgactcagacctccat

SEQ ID NO: 51755 - DNA, 35 bp, Artificial Sequence
  Synthetic oligonucleotide
gcctcccttacagcatctatagcgcacgtatctat

SEQ ID NO: 51756 - DNA, 35 bp, Artificial Sequence
  Synthetic oligonucleotide
aatggtgcgctttcgcccctattcgatctgtctat

SEQ ID NO: 51757 - DNA, 35 bp, Artificial Sequence
  Synthetic oligonucleotide
acgcgactgccctccccgtgatctggtgtcccact

SEQ ID NO: 51758 - DNA, 35 bp, Artificial Sequence
  Synthetic oligonucleotide
ttcgcagaacacaaggagaggtgggtcaaggagct

SEQ ID NO: 51759 - DNA, 35 bp, Artificial Sequence
  Synthetic oligonucleotide
gcttgccgaccggaaggctaaatccatctttttct

SEQ ID NO: 51760 - DNA, 35 bp, Artificial Sequence
  Synthetic oligonucleotide
gtgaccgctcctacttgttcactggatccttaggt

SEQ ID NO: 51761 - DNA, 35 bp, Artificial Sequence
  Synthetic oligonucleotide
ttacggaccgagtgtcttctccctcctccttttgt

SEQ ID NO: 51762 - DNA, 35 bp, Artificial Sequence
  Synthetic oligonucleotide
tcatcacatccggcatttatgcattctacgaattt

SEQ ID NO: 51763 - DNA, 36 bp, Artificial Sequence
  Synthetic oligonucleotide
gagtggacgatccgctaagtccgctgttaatcccca

SEQ ID NO: 51764 - DNA, 36 bp, Artificial Sequence
  Synthetic oligonucleotide
aaccacttgtgtgcgcctcaggtaaaattgtgtcca

SEQ ID NO: 51765 - DNA, 36 bp, Artificial Sequence
  Synthetic oligonucleotide
gacctcccgctaagtgcaatgtctccttcagttgca

SEQ ID NO: 51766 - DNA, 35 bp, Artificial Sequence
  Synthetic oligonucleotide
tggagcacacatcgctagcaatgccgtttttatca

SEQ ID NO: 51767 - DNA, 36 bp, Artificial Sequence
  Synthetic oligonucleotide
tacgccttctcccttgtctttcgggtacgcgattca

SEQ ID NO: 51768 - DNA, 36 bp, Artificial Sequence
  Synthetic oligonucleotide
ccaacgtgcccaatttatactcgttacatcctttca

SEQ ID NO: 51769 - DNA, 37 bp, Artificial Sequence
  Synthetic oligonucleotide
atgcaaaacgtgggtggggaagcttgggtcaagcaga

SEQ ID NO: 51770 - DNA, 37 bp, Artificial Sequence
  Synthetic oligonucleotide
gcattacaacaccatggttcgacgcacatccaaacga

SEQ ID NO: 51771 - DNA, 37 bp, Artificial Sequence
  Synthetic oligonucleotide
ggtgccacaaggataaacggacaaggaggtgaggcga

SEQ ID NO: 51772 - DNA, 36 bp, Artificial Sequence
  Synthetic oligonucleotide
gtcacgtcgggcgttctctacgtttcatcacctcga

SEQ ID NO: 51773 - DNA, 37 bp, Artificial Sequence
  Synthetic oligonucleotide
gccgaacgagggggtagaggattagaggggcagtcga

SEQ ID NO: 51774 - DNA, 37 bp, Artificial Sequence
  Synthetic oligonucleotide
gcgaccacaagatctctttgcaacattgcctcttcga

SEQ ID NO: 51775 - DNA, 36 bp, Artificial Sequence
  Synthetic oligonucleotide
taccgtgtgagtggttttctcgttgttggggtggga

SEQ ID NO: 51776 - DNA, 37 bp, Artificial Sequence
  Synthetic oligonucleotide
gtgcgctatctgaactccccacgacctttagcctgga

SEQ ID NO: 51777 - DNA, 38 bp, Artificial Sequence
  Synthetic oligonucleotide
tccgcccgccctcttacgcaacatagcatatgccatga

SEQ ID NO: 51778 - DNA, 38 bp, Artificial Sequence
  Synthetic oligonucleotide
agacgtcaccgcttgatctcccattgtccttcgactga

SEQ ID NO: 51779 - DNA, 38 bp, Artificial Sequence
  Synthetic oligonucleotide
gaatatccacgtggccatgcagtgccaaccaaacctga

SEQ ID NO: 51780 - DNA, 37 bp, Artificial Sequence
  Synthetic oligonucleotide
gcgcacatcgcgcaacctgtaacgttcgaccacctga

SEQ ID NO: 51781 - DNA, 36 bp, Artificial Sequence
  Synthetic oligonucleotide
tccgatgccgcaacgcccctggtaaatccctcctga

SEQ ID NO: 51782 - DNA, 36 bp, Artificial Sequence
  Synthetic oligonucleotide
tgccgctctctcgagcccgatggtccttcttcctga

SEQ ID NO: 51783 - DNA, 38 bp, Artificial Sequence
  Synthetic oligonucleotide
aatgcgagacgggcgggagtggtcgtgacctggggtga

SEQ ID NO: 51784 - DNA, 38 bp, Artificial Sequence
  Synthetic oligonucleotide
ggtggaaataggccgggagtaaagtaagggttgggtga

SEQ ID NO: 51785 - DNA, 38 bp, Artificial Sequence
  Synthetic oligonucleotide
aactgcccccatctggtctgcacacagcccgactgtga

SEQ ID NO: 51786 - DNA, 38 bp, Artificial Sequence
  Synthetic oligonucleotide
tcacagccgcattcgtttttcaatgcccagtttcttga

SEQ ID NO: 51787 - DNA, 38 bp, Artificial Sequence
  Synthetic oligonucleotide
tcccacactatccatcagtgcacgtacccgttgtttga

SEQ ID NO: 51788 - DNA, 36 bp, Artificial Sequence
  Synthetic oligonucleotide
acctcacctctcgaccaggcttggcttgaaggacta

SEQ ID NO: 51789 - DNA, 35 bp, Artificial Sequence
  Synthetic oligonucleotide
gtggtacgccaagtagatcacccacccacatgtta

SEQ ID NO: 51790 - DNA, 35 bp, Artificial Sequence
  Synthetic oligonucleotide
tacgtacgccccccgattgcccactatccacttta

SEQ ID NO: 51791 - DNA, 36 bp, Artificial Sequence
  Synthetic oligonucleotide
tgctacgaaacctggtaaacgccccacattatttta

SEQ ID NO: 51792 - DNA, 35 bp, Artificial Sequence
  Synthetic oligonucleotide
gcacccaccagtagttcatgtttactcgtctcgac

SEQ ID NO: 51793 - DNA, 35 bp, Artificial Sequence
  Synthetic oligonucleotide
tgcccaccttatagttcaacggttccacgggttcc

SEQ ID NO: 51794 - DNA, 35 bp, Artificial Sequence
  Synthetic oligonucleotide
gggtcctccacctccgtttgatctgcattggttcc

SEQ ID NO: 51795 - DNA, 35 bp, Artificial Sequence
  Synthetic oligonucleotide
gccccgcacgaacccccttagggcaacgccaaagc

SEQ ID NO: 51796 - DNA, 35 bp, Artificial Sequence
  Synthetic oligonucleotide
gttcagccactacttacccttaacgctatgcaggc

SEQ ID NO: 51797 - DNA, 35 bp, Artificial Sequence
  Synthetic oligonucleotide
ttcgtacgtcccctgtctttcaacgttcagccggc

SEQ ID NO: 51798 - DNA, 34 bp, Artificial Sequence
  Synthetic oligonucleotide
agaacagcccgactttaaggtcactcctctcatc

SEQ ID NO: 51799 - DNA, 35 bp, Artificial Sequence
  Synthetic oligonucleotide
gcactaggccggcgttctccttcatctaccttttc

SEQ ID NO: 51800 - DNA, 35 bp, Artificial Sequence
  Synthetic oligonucleotide
aacctgccctcagcgctctctagctcgatttgtcg

SEQ ID NO: 51801 - DNA, 35 bp, Artificial Sequence
  Synthetic oligonucleotide
gcgtagctggaacgagggcgtggggggcttggggg

SEQ ID NO: 51802 - DNA, 36 bp, Artificial Sequence
  Synthetic oligonucleotide
gagtgtaccacgtaggcaccgggcggtgagggtggg

SEQ ID NO: 51803 - DNA, 35 bp, Artificial Sequence
  Synthetic oligonucleotide
acgtggtcacgcgcacctctgtttcccgtcctttg

SEQ ID NO: 51804 - DNA, 35 bp, Artificial Sequence
  Synthetic oligonucleotide
gaatacccacggagtttcgaccattttggccctat

SEQ ID NO: 51805 - DNA, 35 bp, Artificial Sequence
  Synthetic oligonucleotide
ggacaacccctaatagccagttccaccgacccact

SEQ ID NO: 51806 - DNA, 35 bp, Artificial Sequence
  Synthetic oligonucleotide
gtgcggacccatcctctcatgtagtgcgtttcact

SEQ ID NO: 51807 - DNA, 35 bp, Artificial Sequence
  Synthetic oligonucleotide
tcctgcactacaatcctcggaccgctatccgccct

SEQ ID NO: 51808 - DNA, 35 bp, Artificial Sequence
  Synthetic oligonucleotide
ttcatcgtaccagggccggggccagtctttcctct

SEQ ID NO: 51809 - DNA, 35 bp, Artificial Sequence
  Synthetic oligonucleotide
gcatctccaccctgccgtgaggttatactatctct

SEQ ID NO: 51810 - DNA, 35 bp, Artificial Sequence
  Synthetic oligonucleotide
aaatgcacaacgccagtctccagttatcctagtct

SEQ ID NO: 51811 - DNA, 35 bp, Artificial Sequence
  Synthetic oligonucleotide
gttcgccttatatttgcgattgttaccctctgtct

SEQ ID NO: 51812 - DNA, 35 bp, Artificial Sequence
  Synthetic oligonucleotide
taaagcgaccatctcacccagcattcacgatttct

SEQ ID NO: 51813 - DNA, 35 bp, Artificial Sequence
  Synthetic oligonucleotide
gtcacgttcggcctacccatgattatattgtccgt

SEQ ID NO: 51814 - DNA, 35 bp, Artificial Sequence
  Synthetic oligonucleotide
acgcacgacactcattaatttgccgtcctacaatt

SEQ ID NO: 51815 - DNA, 35 bp, Artificial Sequence
  Synthetic oligonucleotide
tgttcgtgttccgcccaatttttcttgctcacctt

SEQ ID NO: 51816 - DNA, 35 bp, Artificial Sequence
  Synthetic oligonucleotide
aaggacagtactctccatgttccttgctcgctctt

SEQ ID NO: 51817 - DNA, 36 bp, Artificial Sequence
  Synthetic oligonucleotide
gttacagccgcacactttctaaaccggtgaactcaa

SEQ ID NO: 51818 - DNA, 36 bp, Artificial Sequence
  Synthetic oligonucleotide
ttccagcacgcctacacgctatttcgcacacctcaa

SEQ ID NO: 51819 - DNA, 35 bp, Artificial Sequence
  Synthetic oligonucleotide
gtggcctgtgcgctttggctaatggtcttcttcaa

SEQ ID NO: 51820 - DNA, 36 bp, Artificial Sequence
  Synthetic oligonucleotide
gtccgcgccacatattacctttgccgcttccacgaa

SEQ ID NO: 51821 - DNA, 35 bp, Artificial Sequence
  Synthetic oligonucleotide
accctaccgtatcaccgacttatcttgtttgggaa

SEQ ID NO: 51822 - DNA, 36 bp, Artificial Sequence
  Synthetic oligonucleotide
tacaccagaagttggacggggggagagacggctgaa

SEQ ID NO: 51823 - DNA, 36 bp, Artificial Sequence
  Synthetic oligonucleotide
accgacacccatatggcatccttaaaacggaattaa

SEQ ID NO: 51824 - DNA, 35 bp, Artificial Sequence
  Synthetic oligonucleotide
atgcccaaagctgagaacactacgcactgtgtaca

SEQ ID NO: 51825 - DNA, 36 bp, Artificial Sequence
  Synthetic oligonucleotide
cgcccaaacggattattagctataggccacaatcca

SEQ ID NO: 51826 - DNA, 35 bp, Artificial Sequence
  Synthetic oligonucleotide
gtactgccaaaagaccgtcctaccttccccgagca

SEQ ID NO: 51827 - DNA, 36 bp, Artificial Sequence
  Synthetic oligonucleotide
gcacagccgctaatactgaatgcaatcgttctcgca

SEQ ID NO: 51828 - DNA, 36 bp, Artificial Sequence
  Synthetic oligonucleotide
gacggtaggggggggcattaatattgcgctagtgca

SEQ ID NO: 51829 - DNA, 35 bp, Artificial Sequence
  Synthetic oligonucleotide
acgccgttaagcctttcacaccgtactgccttgca

SEQ ID NO: 51830 - DNA, 36 bp, Artificial Sequence
  Synthetic oligonucleotide
tgattcaccgcaaatctgttctagttagggccctca

SEQ ID NO: 51831 - DNA, 36 bp, Artificial Sequence
  Synthetic oligonucleotide
tcctaacgtgacgattatcctgccttctgttgctca

SEQ ID NO: 51832 - DNA, 37 bp, Artificial Sequence
  Synthetic oligonucleotide
gagacaacgctgcttctccgacgacttatgacaaaga

SEQ ID NO: 51833 - DNA, 37 bp, Artificial Sequence
  Synthetic oligonucleotide
gcgacgagcacgggaatgtgggtgtttcgttgtaaga

SEQ ID NO: 51834 - DNA, 36 bp, Artificial Sequence
  Synthetic oligonucleotide
acaagggttaggagggggcaaagaatacggtcgaga

SEQ ID NO: 51835 - DNA, 36 bp, Artificial Sequence
  Synthetic oligonucleotide
acacagaaccaaccccagaagccctgcctccaacga

SEQ ID NO: 51836 - DNA, 37 bp, Artificial Sequence
  Synthetic oligonucleotide
gaatcgcactgtcgcccccgatcaacccgttttacga

SEQ ID NO: 51837 - DNA, 37 bp, Artificial Sequence
  Synthetic oligonucleotide
actttgctcggatacgcgtctgccttcgcccccccga

SEQ ID NO: 51838 - DNA, 37 bp, Artificial Sequence
  Synthetic oligonucleotide
acacctccgccatcgttcaaactactggtttatccga

SEQ ID NO: 51839 - DNA, 37 bp, Artificial Sequence
  Synthetic oligonucleotide
atggagccttacgatgccgctctccaccgtgtctgga

SEQ ID NO: 51840 - DNA, 38 bp, Artificial Sequence
  Synthetic oligonucleotide
ggacccgaccagtgccgtccgcgccaccatttcaatga

SEQ ID NO: 51841 - DNA, 38 bp, Artificial Sequence
  Synthetic oligonucleotide
actacctgcctcttgtggcaaccggtattcctccatga

SEQ ID NO: 51842 - DNA, 38 bp, Artificial Sequence
  Synthetic oligonucleotide
atttagcagtcgaagggtgggggctcgggagagtatga

SEQ ID NO: 51843 - DNA, 38 bp, Artificial Sequence
  Synthetic oligonucleotide
tagtcccgaccctatgctttgctgagtcactttcctga

SEQ ID NO: 51844 - DNA, 38 bp, Artificial Sequence
  Synthetic oligonucleotide
gttgttacgatgtgccattagccctccctctacgctga

SEQ ID NO: 51845 - DNA, 37 bp, Artificial Sequence
  Synthetic oligonucleotide
gtgagctcgatgtcattctcccctgggccgtggctga

SEQ ID NO: 51846 - DNA, 37 bp, Artificial Sequence
  Synthetic oligonucleotide
gttccaactgcctccctctctcacgtccccatgctga

SEQ ID NO: 51847 - DNA, 38 bp, Artificial Sequence
  Synthetic oligonucleotide
gtcctgatgcccgatcgttttaactactacacttctga

SEQ ID NO: 51848 - DNA, 38 bp, Artificial Sequence
  Synthetic oligonucleotide
tgacaactgttcttctggcccctctagtccgtgagtga

SEQ ID NO: 51849 - DNA, 38 bp, Artificial Sequence
  Synthetic oligonucleotide
gagtgggaggactgggaggtaggagtacaggactgtga

SEQ ID NO: 51850 - DNA, 38 bp, Artificial Sequence
  Synthetic oligonucleotide
gtggcgaaagagccgtacttcccatttcccttttgtga

SEQ ID NO: 51851 - DNA, 38 bp, Artificial Sequence
  Synthetic oligonucleotide
gacaacaatagatgggggtaggcaggagaaggcattga

SEQ ID NO: 51852 - DNA, 38 bp, Artificial Sequence
  Synthetic oligonucleotide
tccgcaactagagtgttcatgtgccgcccccgctttga

SEQ ID NO: 51853 - DNA, 37 bp, Artificial Sequence
  Synthetic oligonucleotide
tccgacacccttattgcacgaaccgttcgatctttga

SEQ ID NO: 51854 - DNA, 36 bp, Artificial Sequence
  Synthetic oligonucleotide
tagttaccccacccagcctcgacgactctcccgata

SEQ ID NO: 51855 - DNA, 36 bp, Artificial Sequence
  Synthetic oligonucleotide
aacgccacacctccattgcatccccgcccgttacta

SEQ ID NO: 51856 - DNA, 35 bp, Artificial Sequence
  Synthetic oligonucleotide
aacgccgtgcccatacgcttccggtgcccattcta

SEQ ID NO: 51857 - DNA, 35 bp, Artificial Sequence
  Synthetic oligonucleotide
gtcgacttttagcgcgtacttccatacattttcta

SEQ ID NO: 51858 - DNA, 36 bp, Artificial Sequence
  Synthetic oligonucleotide
gaccccccctgggcggtaactattcctgtcctcgta

SEQ ID NO: 51859 - DNA, 35 bp, Artificial Sequence
  Synthetic oligonucleotide
gcatggggggtggcttggaggtcgacagtgtatta

SEQ ID NO: 51860 - DNA, 35 bp, Artificial Sequence
  Synthetic oligonucleotide
gcagtcactaggtgacgtcagcctctaactctcgc

SEQ ID NO: 51861 - DNA, 35 bp, Artificial Sequence
  Synthetic oligonucleotide
tagccggggatctatctgtcccacgtaaccccctc

SEQ ID NO: 51862 - DNA, 35 bp, Artificial Sequence
  Synthetic oligonucleotide
atatggtccctccgcaccttcctgctgtttacgtc

SEQ ID NO: 51863 - DNA, 35 bp, Artificial Sequence
  Synthetic oligonucleotide
gccgaggtaggtggcgggggtcttggaaggtggag

SEQ ID NO: 51864 - DNA, 35 bp, Artificial Sequence
  Synthetic oligonucleotide
tcccgcccctcatctccgacaatatgccaggtgag

SEQ ID NO: 51865 - DNA, 35 bp, Artificial Sequence
  Synthetic oligonucleotide
actcacgattgcgcctccatggctgttctctaccg

SEQ ID NO: 51866 - DNA, 35 bp, Artificial Sequence
  Synthetic oligonucleotide
accactcctgggctcaataacggcgttcgaggccg

SEQ ID NO: 51867 - DNA, 35 bp, Artificial Sequence
  Synthetic oligonucleotide
ccagggaccatcaacagcgtactgcgaggatctcg

SEQ ID NO: 51868 - DNA, 35 bp, Artificial Sequence
  Synthetic oligonucleotide
ttgacacatgccgaccccaacgtaaagaatccatg

SEQ ID NO: 51869 - DNA, 35 bp, Artificial Sequence
  Synthetic oligonucleotide
gcctagcaaaggggggcaagaatcgagttcacctg

SEQ ID NO: 51870 - DNA, 35 bp, Artificial Sequence
  Synthetic oligonucleotide
gcgatggccgtgtgctggtggtgcggggaatgctg

SEQ ID NO: 51871 - DNA, 35 bp, Artificial Sequence
  Synthetic oligonucleotide
agcctccccaattggtcctgggttctctctttgat

SEQ ID NO: 51872 - DNA, 35 bp, Artificial Sequence
  Synthetic oligonucleotide
tcacatactaccttctccgttctgcaatacggact

SEQ ID NO: 51873 - DNA, 35 bp, Artificial Sequence
  Synthetic oligonucleotide
tagccccgtatccacaccttcgatcaggacctact

SEQ ID NO: 51874 - DNA, 35 bp, Artificial Sequence
  Synthetic oligonucleotide
gtccgttccggcgagcttcccgcttccactcgcct

SEQ ID NO: 51875 - DNA, 35 bp, Artificial Sequence
  Synthetic oligonucleotide
taccccgacgcgtctagtgttgccaccccgcatct

SEQ ID NO: 51876 - DNA, 35 bp, Artificial Sequence
  Synthetic oligonucleotide
gagcggagctccgcgtggtgcagtcgattcgctct

SEQ ID NO: 51877 - DNA, 35 bp, Artificial Sequence
  Synthetic oligonucleotide
tgcatacaacactacaccctcaaccaggcactggt

SEQ ID NO: 51878 - DNA, 35 bp, Artificial Sequence
  Synthetic oligonucleotide
ggatcaaccccctgtcaccctgattaatgatggtt

SEQ ID NO: 51879 - DNA, 36 bp, Artificial Sequence
  Synthetic oligonucleotide
tgcggaaaccttgctgcctaaccacgtatcccaaaa

SEQ ID NO: 51880 - DNA, 36 bp, Artificial Sequence
  Synthetic oligonucleotide
attgggcggggggggcgggtttagaacgggtgccaa

SEQ ID NO: 51881 - DNA, 36 bp, Artificial Sequence
  Synthetic oligonucleotide
gattgggccgatatctgcactttgcgcctgttccaa

SEQ ID NO: 51882 - DNA, 36 bp, Artificial Sequence
  Synthetic oligonucleotide
tttgcccatattgcgcactacctcctgggtaccaca

SEQ ID NO: 51883 - DNA, 35 bp, Artificial Sequence
  Synthetic oligonucleotide
gagtaaccctcacaaatcttatccagaatgagaca

SEQ ID NO: 51884 - DNA, 36 bp, Artificial Sequence
  Synthetic oligonucleotide
accaccacagcgaaaacgcactccacagatacacca

SEQ ID NO: 51885 - DNA, 35 bp, Artificial Sequence
  Synthetic oligonucleotide
gtgtaccgaacgcgcgcgcacttagggcccttcca

SEQ ID NO: 51886 - DNA, 35 bp, Artificial Sequence
  Synthetic oligonucleotide
gcatgtccagccacttaggttttatctttcactca

SEQ ID NO: 51887 - DNA, 36 bp, Artificial Sequence
  Synthetic oligonucleotide
ttggccactctcgtcacctatcacactctttggtca

SEQ ID NO: 51888 - DNA, 36 bp, Artificial Sequence
  Synthetic oligonucleotide
gtcgtctccctccgtgattgcgctggcaccccttca

SEQ ID NO: 51889 - DNA, 36 bp, Artificial Sequence
  Synthetic oligonucleotide
tgcgtctggtcccgttggtctcttggcgcactttca

SEQ ID NO: 51890 - DNA, 37 bp, Artificial Sequence
  Synthetic oligonucleotide
gagtactagcgggattgggaatagggttagggagaga

SEQ ID NO: 51891 - DNA, 37 bp, Artificial Sequence
  Synthetic oligonucleotide
gttgggctctgctcttacgttagtccttcctgtacga

SEQ ID NO: 51892 - DNA, 37 bp, Artificial Sequence
  Synthetic oligonucleotide
acgaggtcagatctcaacctcttggccctcccgccga

SEQ ID NO: 51893 - DNA, 37 bp, Artificial Sequence
  Synthetic oligonucleotide
gccacccttcccgacaagcttagtgcttctgattcga

SEQ ID NO: 51894 - DNA, 38 bp, Artificial Sequence
  Synthetic oligonucleotide
ttggcccccgtttctctgcttgttacgtccgtttatga

SEQ ID NO: 51895 - DNA, 37 bp, Artificial Sequence
  Synthetic oligonucleotide
gacaggaggggaggggaggagaccacactctgactga

SEQ ID NO: 51896 - DNA, 38 bp, Artificial Sequence
  Synthetic oligonucleotide
ttacgcctcgtgcccgtccttccttttttgcaacctga

SEQ ID NO: 51897 - DNA, 37 bp, Artificial Sequence
  Synthetic oligonucleotide
gacctcccactgagacctggaccctagatgcacctga

SEQ ID NO: 51898 - DNA, 38 bp, Artificial Sequence
  Synthetic oligonucleotide
atctgcgtcattcatgccaagttctgctgtgaccctga

SEQ ID NO: 51899 - DNA, 34 bp, Artificial Sequence
  Synthetic oligonucleotide
acttacatcgtagtctgaattgcctccatcctga

SEQ ID NO: 51900 - DNA, 38 bp, Artificial Sequence
  Synthetic oligonucleotide
tctggacacaccgctcgaacacccgtctcattaagtga

SEQ ID NO: 51901 - DNA, 38 bp, Artificial Sequence
  Synthetic oligonucleotide
agtggacagtaggggcatgggtggaaggttttcagtga

SEQ ID NO: 51902 - DNA, 38 bp, Artificial Sequence
  Synthetic oligonucleotide
agggacaacggaaagggaggagcaaagttggcgagtga

SEQ ID NO: 51903 - DNA, 38 bp, Artificial Sequence
  Synthetic oligonucleotide
tacgacgccatgtcgctcacaagacacccgattcttga

SEQ ID NO: 51904 - DNA, 37 bp, Artificial Sequence
  Synthetic oligonucleotide
atcacggcccctgttcgaatttgcctgaccttcttga

SEQ ID NO: 51905 - DNA, 38 bp, Artificial Sequence
  Synthetic oligonucleotide
gtctgacgcgcagttagttattactcccctcaatttga

SEQ ID NO: 51906 - DNA, 38 bp, Artificial Sequence
  Synthetic oligonucleotide
atacgcaagcctcctgcacgttaccgtcctccctttga

SEQ ID NO: 51907 - DNA, 38 bp, Artificial Sequence
  Synthetic oligonucleotide
gcatgcaccacccttgatacactctatctgctgtttga

SEQ ID NO: 51908 - DNA, 35 bp, Artificial Sequence
  Synthetic oligonucleotide
gaagtgtggatgagcgcaaggggggtgagtgcata

SEQ ID NO: 51909 - DNA, 36 bp, Artificial Sequence
  Synthetic oligonucleotide
acttctgctgcttccattcggctgtcgctcctacta

SEQ ID NO: 51910 - DNA, 36 bp, Artificial Sequence
  Synthetic oligonucleotide
tgtatgtcatcggcgcagtcccccgctcttcacgta

SEQ ID NO: 51911 - DNA, 35 bp, Artificial Sequence
  Synthetic oligonucleotide
tttgaccatcgggcggcatggctctcttcacacac

SEQ ID NO: 51912 - DNA, 35 bp, Artificial Sequence
  Synthetic oligonucleotide
gggatcaagcccccggccgtccacaaactatacac

SEQ ID NO: 51913 - DNA, 35 bp, Artificial Sequence
  Synthetic oligonucleotide
tcagtgccttgggttcatagccactccgtcgtacc

SEQ ID NO: 51914 - DNA, 35 bp, Artificial Sequence
  Synthetic oligonucleotide
taccccagagtgaacggtcggccattcttgttctc

SEQ ID NO: 51915 - DNA, 35 bp, Artificial Sequence
  Synthetic oligonucleotide
tcatcggtgacgtccgttcttgtctttcgcctgcg

SEQ ID NO: 51916 - DNA, 35 bp, Artificial Sequence
  Synthetic oligonucleotide
tgccgctgcccatttctactaatacctcggcttcg

SEQ ID NO: 51917 - DNA, 35 bp, Artificial Sequence
  Synthetic oligonucleotide
ggtgcaccggacaagtcccccaaatccccatgtgg

SEQ ID NO: 51918 - DNA, 36 bp, Artificial Sequence
  Synthetic oligonucleotide
accggacccttttgtaccagcattgcctccctactg

SEQ ID NO: 51919 - DNA, 35 bp, Artificial Sequence
  Synthetic oligonucleotide
ataccgacgcgcacctgaacgtaccgtcctgccat

SEQ ID NO: 51920 - DNA, 35 bp, Artificial Sequence
  Synthetic oligonucleotide
tgtgacttctgacacgcatttgccttggtctacct

SEQ ID NO: 51921 - DNA, 35 bp, Artificial Sequence
  Synthetic oligonucleotide
tagcctcccgtcaaagcaccgcttattctgtacct

SEQ ID NO: 51922 - DNA, 35 bp, Artificial Sequence
  Synthetic oligonucleotide
tgctcggagccactactagctgtcttttagttcct

SEQ ID NO: 51923 - DNA, 35 bp, Artificial Sequence
  Synthetic oligonucleotide
tcctcccgcgtggcccccgtgcgcaccttagtgct

SEQ ID NO: 51924 - DNA, 35 bp, Artificial Sequence
  Synthetic oligonucleotide
tatgtgatgggtgagagggttgggacggcatttgt

SEQ ID NO: 51925 - DNA, 30 bp, Artificial Sequence
  Synthetic oligonucleotide
gatgtgcgcactattctgaggtttgctatt

SEQ ID NO: 51926 - DNA, 35 bp, Artificial Sequence
  Synthetic oligonucleotide
gattccacggcatagttaacagctttcaccttctt

SEQ ID NO: 51927 - DNA, 35 bp, Artificial Sequence
  Synthetic oligonucleotide
tacacgtggagtacctacttgcagacgctaccttt

SEQ ID NO: 51928 - DNA, 36 bp, Artificial Sequence
  Synthetic oligonucleotide
attgtcgccctgagcccttagtccctacataacgaa

SEQ ID NO: 51929 - DNA, 36 bp, Artificial Sequence
  Synthetic oligonucleotide
gcaacggactcgccttcgacactcgttatccacaca

SEQ ID NO: 51930 - DNA, 36 bp, Artificial Sequence
  Synthetic oligonucleotide
gttcaatccttagctgtatcctcggctctggcccca

SEQ ID NO: 51931 - DNA, 36 bp, Artificial Sequence
  Synthetic oligonucleotide
gtagactccccatccttatcccacgggactttccca

SEQ ID NO: 51932 - DNA, 36 bp, Artificial Sequence
  Synthetic oligonucleotide
ggccacgcacgttgtcgcgcgtgtactccatctcca

SEQ ID NO: 51933 - DNA, 35 bp, Artificial Sequence
  Synthetic oligonucleotide
tagtccgccccgtcacacaagtgcctatacgtcca

SEQ ID NO: 51934 - DNA, 35 bp, Artificial Sequence
  Synthetic oligonucleotide
gtctcgcctaaccgctgccaacgaccttttaagca

SEQ ID NO: 51935 - DNA, 36 bp, Artificial Sequence
  Synthetic oligonucleotide
gtggcgaaggcactccagcccaggatcccacctgca

SEQ ID NO: 51936 - DNA, 36 bp, Artificial Sequence
  Synthetic oligonucleotide
tcacgccgaccttacacatgaccagatgtgccatca

SEQ ID NO: 51937 - DNA, 37 bp, Artificial Sequence
  Synthetic oligonucleotide
ataaactgggtgaggtgagggtgggggaagtaagcga

SEQ ID NO: 51938 - DNA, 37 bp, Artificial Sequence
  Synthetic oligonucleotide
tcacatgtggacggtgatgggggggccgtagagtcga

SEQ ID NO: 51939 - DNA, 37 bp, Artificial Sequence
  Synthetic oligonucleotide
gcgaactgggtggacgggaggcatgccgggaatagga

SEQ ID NO: 51940 - DNA, 37 bp, Artificial Sequence
  Synthetic oligonucleotide
gttcgaacaccatctctgtcgcgtgactcttttagga

SEQ ID NO: 51941 - DNA, 37 bp, Artificial Sequence
  Synthetic oligonucleotide
tgccattcccactgggccttttaagtatagttccgga

SEQ ID NO: 51942 - DNA, 36 bp, Artificial Sequence
  Synthetic oligonucleotide
gatagtgtagacttgagaggagggaggaccgaggga

SEQ ID NO: 51943 - DNA, 37 bp, Artificial Sequence
  Synthetic oligonucleotide
tgatgggaggggcagaaacaaggcaggtggctgggga

SEQ ID NO: 51944 - DNA, 37 bp, Artificial Sequence
  Synthetic oligonucleotide
gaagtccgatcggaggaggaataggacagggctggga

SEQ ID NO: 51945 - DNA, 37 bp, Artificial Sequence
  Synthetic oligonucleotide
tgtaaggtgggatggggttacggttcttgggtgtgga

SEQ ID NO: 51946 - DNA, 38 bp, Artificial Sequence
  Synthetic oligonucleotide
gagtacatggcagatagagagagcgagcgggcgaatga

SEQ ID NO: 51947 - DNA, 38 bp, Artificial Sequence
  Synthetic oligonucleotide
acccacgtctagcaggccagtttcttccatcaccatga

SEQ ID NO: 51948 - DNA, 38 bp, Artificial Sequence
  Synthetic oligonucleotide
actccactgggccactcaatagacacactcgccactga

SEQ ID NO: 51949 - DNA, 38 bp, Artificial Sequence
  Synthetic oligonucleotide
gctaacggtctatgtagttcgccgatttccgcccctga

SEQ ID NO: 51950 - DNA, 38 bp, Artificial Sequence
  Synthetic oligonucleotide
gacgcccaccctcgtatctttataggcattcatcctga

SEQ ID NO: 51951 - DNA, 38 bp, Artificial Sequence
  Synthetic oligonucleotide
actgctccacagcagtcccaggtgccatccacaattga

SEQ ID NO: 51952 - DNA, 38 bp, Artificial Sequence
  Synthetic oligonucleotide
gacaccacattttcccaacggttcgccgtcattcttga

SEQ ID NO: 51953 - DNA, 36 bp, Artificial Sequence
  Synthetic oligonucleotide
atcgcacctgcaactttcccactttgtgcacgaata

SEQ ID NO: 51954 - DNA, 35 bp, Artificial Sequence
  Synthetic oligonucleotide
ttgtggtcctccactgcctcgctccacggttccta

SEQ ID NO: 51955 - DNA, 35 bp, Artificial Sequence
  Synthetic oligonucleotide
tcccgctggttcgacggttcaggcctaattctcta

SEQ ID NO: 51956 - DNA, 36 bp, Artificial Sequence
  Synthetic oligonucleotide
tctgccaactgcatgattccttatcaatttctggta

SEQ ID NO: 51957 - DNA, 35 bp, Artificial Sequence
  Synthetic oligonucleotide
tcatgctggagaatctgactttcgctgcttttaac

SEQ ID NO: 51958 - DNA, 35 bp, Artificial Sequence
  Synthetic oligonucleotide
aacctggcctacacaatgaagttaaatcagccgcc

SEQ ID NO: 51959 - DNA, 35 bp, Artificial Sequence
  Synthetic oligonucleotide
gccccatagggcttctgtatattagcttcgccgcc

SEQ ID NO: 51960 - DNA, 35 bp, Artificial Sequence
  Synthetic oligonucleotide
acctctgcacacctcactggattggcaggaagtcc

SEQ ID NO: 51961 - DNA, 35 bp, Artificial Sequence
  Synthetic oligonucleotide
acaccgaaagcccctgatactcatgccgatggtcc

SEQ ID NO: 51962 - DNA, 35 bp, Artificial Sequence
  Synthetic oligonucleotide
attcagccgtacccctaaacaacggtcatggttcc

SEQ ID NO: 51963 - DNA, 35 bp, Artificial Sequence
  Synthetic oligonucleotide
gacgatagtgcgactggcgtcccttccctggtttc

SEQ ID NO: 51964 - DNA, 35 bp, Artificial Sequence
  Synthetic oligonucleotide
tcatattcgcacttcactctgccgccccacgcacg

SEQ ID NO: 51965 - DNA, 35 bp, Artificial Sequence
  Synthetic oligonucleotide
ttccgggtcggctctatccgaattgtccatccctg

SEQ ID NO: 51966 - DNA, 35 bp, Artificial Sequence
  Synthetic oligonucleotide
atccacacatataacggagcacctcccttgtagtg

SEQ ID NO: 51967 - DNA, 35 bp, Artificial Sequence
  Synthetic oligonucleotide
acccgtagtcgccctcggggaacactctgcttact

SEQ ID NO: 51968 - DNA, 35 bp, Artificial Sequence
  Synthetic oligonucleotide
tcagtacccccactcactcgttgatcttagtctct

SEQ ID NO: 51969 - DNA, 35 bp, Artificial Sequence
  Synthetic oligonucleotide
gtagcccggctacactcccgctctttgacctacgt

SEQ ID NO: 51970 - DNA, 35 bp, Artificial Sequence
  Synthetic oligonucleotide
gatgacggggtagagatttgggctggaaaagcggt

SEQ ID NO: 51971 - DNA, 35 bp, Artificial Sequence
  Synthetic oligonucleotide
gacgcaggtttttggcgttcctaaccacttcttgt

SEQ ID NO: 51972 - DNA, 35 bp, Artificial Sequence
  Synthetic oligonucleotide
gtatggtgagggggggaatggcggagtaggtgatt

SEQ ID NO: 51973 - DNA, 35 bp, Artificial Sequence
  Synthetic oligonucleotide
gaggtcaccgggtttatcctatatatgttgtcctt

SEQ ID NO: 51974 - DNA, 35 bp, Artificial Sequence
  Synthetic oligonucleotide
gctagcaacgcccctccggctacatacaccacgtt

SEQ ID NO: 51975 - DNA, 35 bp, Artificial Sequence
  Synthetic oligonucleotide
tcgtgttccagcctagtttcgccgtcgcacccgtt

SEQ ID NO: 51976 - DNA, 35 bp, Artificial Sequence
  Synthetic oligonucleotide
actgtcaaccgccgattccgacaccgtgcctcttt

SEQ ID NO: 51977 - DNA, 36 bp, Artificial Sequence
  Synthetic oligonucleotide
tgctcccacaccttccgcaccgctgctcttcgacaa

SEQ ID NO: 51978 - DNA, 35 bp, Artificial Sequence
  Synthetic oligonucleotide
gagggcgggaggtgttggggttagagtctggggaa

SEQ ID NO: 51979 - DNA, 36 bp, Artificial Sequence
  Synthetic oligonucleotide
gaatgcagtcaactcttcactggggactgcccataa

SEQ ID NO: 51980 - DNA, 35 bp, Artificial Sequence
  Synthetic oligonucleotide
atgccccatgaggcatccaattccctcattatcca

SEQ ID NO: 51981 - DNA, 36 bp, Artificial Sequence
  Synthetic oligonucleotide
ttgtgtaagcggataccctgcgaccttttgccatca

SEQ ID NO: 51982 - DNA, 36 bp, Artificial Sequence
  Synthetic oligonucleotide
gaaacgatggagaggggtaatagcgtgcaacagtca

SEQ ID NO: 51983 - DNA, 36 bp, Artificial Sequence
  Synthetic oligonucleotide
gaaaaaagggtgagtggtgaatcagaggaagagtca

SEQ ID NO: 51984 - DNA, 35 bp, Artificial Sequence
  Synthetic oligonucleotide
aaacatagactcgccgccagcacgcacgccattca

SEQ ID NO: 51985 - DNA, 35 bp, Artificial Sequence
  Synthetic oligonucleotide
tcatgcctcagtcccggcatttatgttccatcaga

SEQ ID NO: 51986 - DNA, 37 bp, Artificial Sequence
  Synthetic oligonucleotide
ttccacacactattggaggactataacctgtcctaga

SEQ ID NO: 51987 - DNA, 37 bp, Artificial Sequence
  Synthetic oligonucleotide
gcacatcaagccgctgacacttaactggccttaccga

SEQ ID NO: 51988 - DNA, 37 bp, Artificial Sequence
  Synthetic oligonucleotide
atgacactcaggggggtgacggaatgtaggggtgcga

SEQ ID NO: 51989 - DNA, 37 bp, Artificial Sequence
  Synthetic oligonucleotide
gaatggcatcatctgctctctggtaatttcgaatcga

SEQ ID NO: 51990 - DNA, 35 bp, Artificial Sequence
  Synthetic oligonucleotide
ggggcacagaagaggggcgggcgatgaccccggga

SEQ ID NO: 51991 - DNA, 37 bp, Artificial Sequence
  Synthetic oligonucleotide
acctcctcgccactatacataatcctgagcctcggga

SEQ ID NO: 51992 - DNA, 37 bp, Artificial Sequence
  Synthetic oligonucleotide
ttgtgagtgggaagggcctggtgaggggaaacgggga

SEQ ID NO: 51993 - DNA, 37 bp, Artificial Sequence
  Synthetic oligonucleotide
gtagaacgcctcgaactgttctttgccacatcctgga

SEQ ID NO: 51994 - DNA, 37 bp, Artificial Sequence
  Synthetic oligonucleotide
tcacaccttgttggctgacactgcactactttttgga

SEQ ID NO: 51995 - DNA, 38 bp, Artificial Sequence
  Synthetic oligonucleotide
aagggaaagaacgtgggaggtggttggcaagtgaatga

SEQ ID NO: 51996 - DNA, 38 bp, Artificial Sequence
  Synthetic oligonucleotide
tcctgctcccctgctgcgaactaagcctctttgactga

SEQ ID NO: 51997 - DNA, 38 bp, Artificial Sequence
  Synthetic oligonucleotide
atccccgccaacccatcctcagtggagtcgattcctga

SEQ ID NO: 51998 - DNA, 38 bp, Artificial Sequence
  Synthetic oligonucleotide
tgtgaatggctcccgacgtaatttccttcacttcctga

SEQ ID NO: 51999 - DNA, 38 bp, Artificial Sequence
  Synthetic oligonucleotide
gcaccacctcctatgcgacctccaacgcttcgcgctga

SEQ ID NO: 52000 - DNA, 38 bp, Artificial Sequence
  Synthetic oligonucleotide
tgacgcacgagcggtaggcgtcaacgtttttagcgtga

SEQ ID NO: 52001 - DNA, 36 bp, Artificial Sequence
  Synthetic oligonucleotide
tcactggaaccggggtacggcgcctccttcccttga

SEQ ID NO: 52002 - DNA, 37 bp, Artificial Sequence
  Synthetic oligonucleotide
tgtccctcagcctgtcaggaccaacccctattcttga

SEQ ID NO: 52003 - DNA, 36 bp, Artificial Sequence
  Synthetic oligonucleotide
actcacccacacgtaggcgtaatttcaagacgcata

SEQ ID NO: 52004 - DNA, 35 bp, Artificial Sequence
  Synthetic oligonucleotide
gcacatacccggttggactcgcttacactttccta

SEQ ID NO: 52005 - DNA, 35 bp, Artificial Sequence
  Synthetic oligonucleotide
acacccagagttcgttgactgcctttcatcccgta

SEQ ID NO: 52006 - DNA, 36 bp, Artificial Sequence
  Synthetic oligonucleotide
ggtacaccacacaccgaccgagattagcgcatcgta

SEQ ID NO: 52007 - DNA, 36 bp, Artificial Sequence
  Synthetic oligonucleotide
acctccaccgaaccccaatttatagaagactattta

SEQ ID NO: 52008 - DNA, 35 bp, Artificial Sequence
  Synthetic oligonucleotide
gtcacctcggggtgattcccttttacacatgtaac

SEQ ID NO: 52009 - DNA, 35 bp, Artificial Sequence
  Synthetic oligonucleotide
gatgcgcgagtctcttgggccgtgccacctttcac

SEQ ID NO: 52010 - DNA, 35 bp, Artificial Sequence
  Synthetic oligonucleotide
aaatgcattcgcgcagagaacacacaccaccatac

SEQ ID NO: 52011 - DNA, 35 bp, Artificial Sequence
  Synthetic oligonucleotide
taggtcacagcatcccatctcctaactagtcgtac

SEQ ID NO: 52012 - DNA, 35 bp, Artificial Sequence
  Synthetic oligonucleotide
actccagtcccatgatttgagttatctgcctaccc

SEQ ID NO: 52013 - DNA, 35 bp, Artificial Sequence
  Synthetic oligonucleotide
gcattccgagcaaccctttttattctgaggccctc

SEQ ID NO: 52014 - DNA, 35 bp, Artificial Sequence
  Synthetic oligonucleotide
tccttacgccaggatggttcctttacgcgattctc

SEQ ID NO: 52015 - DNA, 35 bp, Artificial Sequence
  Synthetic oligonucleotide
tatccaccgagatcccgttcggaacgagtttcttc

SEQ ID NO: 52016 - DNA, 35 bp, Artificial Sequence
  Synthetic oligonucleotide
actcgcatcaatagcgctacaaattccttctgttc

SEQ ID NO: 52017 - DNA, 35 bp, Artificial Sequence
  Synthetic oligonucleotide
aacgccgcctctttccgatctacctttgggtcatg

SEQ ID NO: 52018 - DNA, 35 bp, Artificial Sequence
  Synthetic oligonucleotide
tctgcacagggttccgatccctccctaaccgcctg

SEQ ID NO: 52019 - DNA, 35 bp, Artificial Sequence
  Synthetic oligonucleotide
gatcatgccatggtgaccttgtgatcctttttact

SEQ ID NO: 52020 - DNA, 35 bp, Artificial Sequence
  Synthetic oligonucleotide
ggtctaaccagaaatgatgcgctgcctccccccct

SEQ ID NO: 52021 - DNA, 35 bp, Artificial Sequence
  Synthetic oligonucleotide
ttctacagcactcgtctcccttctcagtctcgcct

SEQ ID NO: 52022 - DNA, 35 bp, Artificial Sequence
  Synthetic oligonucleotide
tttccacgtaggtgccccgctcaacccctcacagt

SEQ ID NO: 52023 - DNA, 35 bp, Artificial Sequence
  Synthetic oligonucleotide
gacgcgacacactagatcatcaaatagccgaccgt

SEQ ID NO: 52024 - DNA, 35 bp, Artificial Sequence
  Synthetic oligonucleotide
tcaacccgccgccctgtgatcaccgttcgtaatgt

SEQ ID NO: 52025 - DNA, 35 bp, Artificial Sequence
  Synthetic oligonucleotide
acatcagtgcagttgatatttttgttgggtgctgt

SEQ ID NO: 52026 - DNA, 35 bp, Artificial Sequence
  Synthetic oligonucleotide
ggaaagcccaccaatttcgcgcctccgtccacctt

SEQ ID NO: 52027 - DNA, 35 bp, Artificial Sequence
  Synthetic oligonucleotide
accgctggccccaaccaattctagccttgaacttt

SEQ ID NO: 52028 - DNA, 34 bp, Artificial Sequence
  Synthetic oligonucleotide
ttctcgaacgcctgcgaacttcgacatttgtttt

SEQ ID NO: 52029 - DNA, 36 bp, Artificial Sequence
  Synthetic oligonucleotide
gcagagggtactagggctgaccacgagggaggggaa

SEQ ID NO: 52030 - DNA, 36 bp, Artificial Sequence
  Synthetic oligonucleotide
gcctgagtcgaccttgtttgtcccgcgactccgcca

SEQ ID NO: 52031 - DNA, 36 bp, Artificial Sequence
  Synthetic oligonucleotide
aactacgcccagacaatgccctgtctcctgcctgca

SEQ ID NO: 52032 - DNA, 35 bp, Artificial Sequence
  Synthetic oligonucleotide
acacccctctggtgactcccatactctcggggtca

SEQ ID NO: 52033 - DNA, 36 bp, Artificial Sequence
  Synthetic oligonucleotide
tcctcctcccacgggtaagtgcacatcattcataga

SEQ ID NO: 52034 - DNA, 37 bp, Artificial Sequence
  Synthetic oligonucleotide
ggttcatcaccctttgcgcattacagtcgtaactaga

SEQ ID NO: 52035 - DNA, 36 bp, Artificial Sequence
  Synthetic oligonucleotide
taccgaccagccatccgcttgcttcctctgtaccga

SEQ ID NO: 52036 - DNA, 36 bp, Artificial Sequence
  Synthetic oligonucleotide
tccctgccgaggattctttgttcttcccctctgcga

SEQ ID NO: 52037 - DNA, 37 bp, Artificial Sequence
  Synthetic oligonucleotide
gatgcgctgtgccgtcttttcaatcgcaccacctgga

SEQ ID NO: 52038 - DNA, 38 bp, Artificial Sequence
  Synthetic oligonucleotide
tagggggtgtgggggaccgagcgaaacggtgcgaatga

SEQ ID NO: 52039 - DNA, 38 bp, Artificial Sequence
  Synthetic oligonucleotide
atcacccacccgtactcgatagaaccgtaaggacatga

SEQ ID NO: 52040 - DNA, 37 bp, Artificial Sequence
  Synthetic oligonucleotide
ttagcgactgcctccacctcctgtttcacatcactga

SEQ ID NO: 52041 - DNA, 37 bp, Artificial Sequence
  Synthetic oligonucleotide
atcgcccctgacaaccctgccaacccccgtgccctga

SEQ ID NO: 52042 - DNA, 38 bp, Artificial Sequence
  Synthetic oligonucleotide
ttgacaggctggccacccgccgaatccaacacatgtga

SEQ ID NO: 52043 - DNA, 38 bp, Artificial Sequence
  Synthetic oligonucleotide
gaatggacaaaggaatgagtgctaggcaacgggtgtga

SEQ ID NO: 52044 - DNA, 38 bp, Artificial Sequence
  Synthetic oligonucleotide
tgacggcccgccatcgctctcgttagtcattccgttga

SEQ ID NO: 52045 - DNA, 38 bp, Artificial Sequence
  Synthetic oligonucleotide
gacaacagtaagggaaaggggactcggtgggaggttga

SEQ ID NO: 52046 - DNA, 37 bp, Artificial Sequence
  Synthetic oligonucleotide
tgtgacgacggaggaagcattggggaagggatgttga

SEQ ID NO: 52047 - DNA, 38 bp, Artificial Sequence
  Synthetic oligonucleotide
acctgcctccccctattggaacggacaaagcctgttga

SEQ ID NO: 52048 - DNA, 36 bp, Artificial Sequence
  Synthetic oligonucleotide
aacccgccacccagccagggggatggtacttctata

SEQ ID NO: 52049 - DNA, 36 bp, Artificial Sequence
  Synthetic oligonucleotide
ttacgcagtgtaacgttccgctatgggctctcccta

SEQ ID NO: 52050 - DNA, 36 bp, Artificial Sequence
  Synthetic oligonucleotide
gctttgttccccccccaccgtgccaggtgagctcta

SEQ ID NO: 52051 - DNA, 35 bp, Artificial Sequence
  Synthetic oligonucleotide
gttccgatctccagcgcaccaatggcttacgctta

SEQ ID NO: 52052 - DNA, 35 bp, Artificial Sequence
  Synthetic oligonucleotide
agatgccctgactcacaagatcgcaccttctgcac

SEQ ID NO: 52053 - DNA, 35 bp, Artificial Sequence
  Synthetic oligonucleotide
ggatataatccacgcacgcccttcatgccactcac

SEQ ID NO: 52054 - DNA, 35 bp, Artificial Sequence
  Synthetic oligonucleotide
tgcgcccatacctgaatctgctccaggctcgcgac

SEQ ID NO: 52055 - DNA, 35 bp, Artificial Sequence
  Synthetic oligonucleotide
acgcccattgcaaaatggctttaaaacacttcacc

SEQ ID NO: 52056 - DNA, 35 bp, Artificial Sequence
  Synthetic oligonucleotide
tcggaatgcgcaagcgaaaccgaagcccacacccc

SEQ ID NO: 52057 - DNA, 35 bp, Artificial Sequence
  Synthetic oligonucleotide
ttcgccatctacttctcctaagcgattcgtgatcc

SEQ ID NO: 52058 - DNA, 35 bp, Artificial Sequence
  Synthetic oligonucleotide
gacgttcctgcgctcccgctacgagctacatctcc

SEQ ID NO: 52059 - DNA, 35 bp, Artificial Sequence
  Synthetic oligonucleotide
tctaacctcagtcacaccggtctgccattcaaagc

SEQ ID NO: 52060 - DNA, 35 bp, Artificial Sequence
  Synthetic oligonucleotide
gctgtgctcctcctgatgaaaaacttcaacgccgc

SEQ ID NO: 52061 - DNA, 35 bp, Artificial Sequence
  Synthetic oligonucleotide
accatgcgtcaccatctgcccttgaccgttcgtgc

SEQ ID NO: 52062 - DNA, 35 bp, Artificial Sequence
  Synthetic oligonucleotide
gatcgcacgcatccatcatatgatatctatttgtc

SEQ ID NO: 52063 - DNA, 35 bp, Artificial Sequence
  Synthetic oligonucleotide
gttccgtcccacttctttaagcaccaacatcgttc

SEQ ID NO: 52064 - DNA, 35 bp, Artificial Sequence
  Synthetic oligonucleotide
gcctccaaagcccttgatcctcgtgccctgggttc

SEQ ID NO: 52065 - DNA, 35 bp, Artificial Sequence
  Synthetic oligonucleotide
gcacgtctccgtggcaattctcacttccttaaacg

SEQ ID NO: 52066 - DNA, 35 bp, Artificial Sequence
  Synthetic oligonucleotide
gcgaacgtactggcgaggaggtcaaaggagcaccg

SEQ ID NO: 52067 - DNA, 35 bp, Artificial Sequence
  Synthetic oligonucleotide
tgaaagtagggtgaatcgtggtacaagggggtgcg

SEQ ID NO: 52068 - DNA, 35 bp, Artificial Sequence
  Synthetic oligonucleotide
tttacatcccgccctcacttgtgtgcaactgcagg

SEQ ID NO: 52069 - DNA, 35 bp, Artificial Sequence
  Synthetic oligonucleotide
gtcacccgaatcagatataccaccacggaaacctg

SEQ ID NO: 52070 - DNA, 35 bp, Artificial Sequence
  Synthetic oligonucleotide
ggaccgtcgtcacccattggtctactcactcgttg

SEQ ID NO: 52071 - DNA, 35 bp, Artificial Sequence
  Synthetic oligonucleotide
agattggtaggggagtccgggggcgggggacgaat

SEQ ID NO: 52072 - DNA, 35 bp, Artificial Sequence
  Synthetic oligonucleotide
tttgtagcccccacgaccaccacaaagtagtgact

SEQ ID NO: 52073 - DNA, 35 bp, Artificial Sequence
  Synthetic oligonucleotide
tcccgcgaccgttctctaacgctcacataaattct

SEQ ID NO: 52074 - DNA, 35 bp, Artificial Sequence
  Synthetic oligonucleotide
attcgggaaaggatgaaaggcatgagtatgtaggt

SEQ ID NO: 52075 - DNA, 35 bp, Artificial Sequence
  Synthetic oligonucleotide
ccagacacggacgaggcttccgtcatttattgctt

SEQ ID NO: 52076 - DNA, 36 bp, Artificial Sequence
  Synthetic oligonucleotide
accgcggttcgctcgcatgtccccggttatttccaa

SEQ ID NO: 52077 - DNA, 35 bp, Artificial Sequence
  Synthetic oligonucleotide
acgtgagaagcagggggggcgttgaaagatgggaa

SEQ ID NO: 52078 - DNA, 36 bp, Artificial Sequence
  Synthetic oligonucleotide
gatcaaacctactttcaccgcagactgttcgcaaca

SEQ ID NO: 52079 - DNA, 36 bp, Artificial Sequence
  Synthetic oligonucleotide
tgggagggagggctaacgggattggggggccgaaca

SEQ ID NO: 52080 - DNA, 36 bp, Artificial Sequence
  Synthetic oligonucleotide
tgtgcatgacccattccgccccgtacttgtgcgaca

SEQ ID NO: 52081 - DNA, 36 bp, Artificial Sequence
  Synthetic oligonucleotide
aaggtttgcatccaattgccatcacatcaccctgca

SEQ ID NO: 52082 - DNA, 36 bp, Artificial Sequence
  Synthetic oligonucleotide
gatgggctccactcctctcccctgttctccgctgca

SEQ ID NO: 52083 - DNA, 38 bp, Artificial Sequence
  Synthetic oligonucleotide
cctgccgcacgcaacacctatggcctgtttcaccttca

SEQ ID NO: 52084 - DNA, 37 bp, Artificial Sequence
  Synthetic oligonucleotide
gtggtggggtggtgactgtaagggtgaaaggttgaga

SEQ ID NO: 52085 - DNA, 37 bp, Artificial Sequence
  Synthetic oligonucleotide
tgtccctgcctccaccgtattagcagaagacgaccga

SEQ ID NO: 52086 - DNA, 37 bp, Artificial Sequence
  Synthetic oligonucleotide
acgatgcgcaccgtccttcccaactgctgaccctcga

SEQ ID NO: 52087 - DNA, 36 bp, Artificial Sequence
  Synthetic oligonucleotide
atcacctgccatccataactaaacatccgatgtcga

SEQ ID NO: 52088 - DNA, 35 bp, Artificial Sequence
  Synthetic oligonucleotide
tcttccacaccacccgcgtgactgacctcctcgga

SEQ ID NO: 52089 - DNA, 37 bp, Artificial Sequence
  Synthetic oligonucleotide
tgaagaagggttatggtaaatgtaggggagggaggga

SEQ ID NO: 52090 - DNA, 35 bp, Artificial Sequence
  Synthetic oligonucleotide
gtgtcccgcatttatcatccccccgctgtctggga

SEQ ID NO: 52091 - DNA, 38 bp, Artificial Sequence
  Synthetic oligonucleotide
agcatcactgccccaccgtttcgcacacggtcaactga

SEQ ID NO: 52092 - DNA, 38 bp, Artificial Sequence
  Synthetic oligonucleotide
acccaccatatcatgtcactagaccgcgcataccctga

SEQ ID NO: 52093 - DNA, 37 bp, Artificial Sequence
  Synthetic oligonucleotide
tgttgccccgcttgcctgactatctaatggagcctga

SEQ ID NO: 52094 - DNA, 38 bp, Artificial Sequence
  Synthetic oligonucleotide
atcgcgtatgccttgccttccctcacttgtattgctga

SEQ ID NO: 52095 - DNA, 38 bp, Artificial Sequence
  Synthetic oligonucleotide
agcacgctccgatcctcttctacttcaacgctctctga

SEQ ID NO: 52096 - DNA, 38 bp, Artificial Sequence
  Synthetic oligonucleotide
tacacccctttccaccgtgcggtccacaggcttattga

SEQ ID NO: 52097 - DNA, 37 bp, Artificial Sequence
  Synthetic oligonucleotide
aacgacctgggaacacggagaaaaaggatcgacttga

SEQ ID NO: 52098 - DNA, 38 bp, Artificial Sequence
  Synthetic oligonucleotide
gacccgtggcgcaccctcatcacagagctttagcttga

SEQ ID NO: 52099 - DNA, 38 bp, Artificial Sequence
  Synthetic oligonucleotide
agtgagcgcccggacgtaaaactacccaaccctcttga

SEQ ID NO: 52100 - DNA, 35 bp, Artificial Sequence
  Synthetic oligonucleotide
gtctaccactcacccccgctgtgctgtgaatcata

SEQ ID NO: 52101 - DNA, 35 bp, Artificial Sequence
  Synthetic oligonucleotide
gtcaaatccgcccgctagaaatcacctacgctata

SEQ ID NO: 52102 - DNA, 36 bp, Artificial Sequence
  Synthetic oligonucleotide
gcccttgccatccgtgagctggtacatgcgaactta

SEQ ID NO: 52103 - DNA, 35 bp, Artificial Sequence
  Synthetic oligonucleotide
atggtgggccgggaaggcggtcaacggaaaggtta

SEQ ID NO: 52104 - DNA, 36 bp, Artificial Sequence
  Synthetic oligonucleotide
tcccaatcctgcactgtttggttgacacatatgtta

SEQ ID NO: 52105 - DNA, 35 bp, Artificial Sequence
  Synthetic oligonucleotide
tcgaccccccgttcccgattgcatggcctgttaac

SEQ ID NO: 52106 - DNA, 35 bp, Artificial Sequence
  Synthetic oligonucleotide
ttccgtgttgacgtccacaaggctttactctttac

SEQ ID NO: 52107 - DNA, 35 bp, Artificial Sequence
  Synthetic oligonucleotide
gacaacttcgacagtcattcgttttttacctcgcc

SEQ ID NO: 52108 - DNA, 35 bp, Artificial Sequence
  Synthetic oligonucleotide
atcaacccgatccaggcgagacctactccacttgc

SEQ ID NO: 52109 - DNA, 35 bp, Artificial Sequence
  Synthetic oligonucleotide
tgttgtccgcacgtagcgggtccgaccctctaatc

SEQ ID NO: 52110 - DNA, 35 bp, Artificial Sequence
  Synthetic oligonucleotide
tgactcacagatgggaggggtggattggggcggtc

SEQ ID NO: 52111 - DNA, 35 bp, Artificial Sequence
  Synthetic oligonucleotide
aaactcgcttactgactaagtcatcaccaaaattc

SEQ ID NO: 52112 - DNA, 35 bp, Artificial Sequence
  Synthetic oligonucleotide
tacttccggcaatgaggtagcgctccccctttagg

SEQ ID NO: 52113 - DNA, 35 bp, Artificial Sequence
  Synthetic oligonucleotide
acgatacaccccggacaatttagaaactcctactg

SEQ ID NO: 52114 - DNA, 35 bp, Artificial Sequence
  Synthetic oligonucleotide
atcgaaccgttcttcactctgctctcagctaattg

SEQ ID NO: 52115 - DNA, 35 bp, Artificial Sequence
  Synthetic oligonucleotide
ttattaccgcaagggtgtcttgctcatccattcat

SEQ ID NO: 52116 - DNA, 35 bp, Artificial Sequence
  Synthetic oligonucleotide
actgcgtacacctcccgtttcccctgctcgccact

SEQ ID NO: 52117 - DNA, 35 bp, Artificial Sequence
  Synthetic oligonucleotide
agccccccgagcgctaggcgacctcacattgcact

SEQ ID NO: 52118 - DNA, 35 bp, Artificial Sequence
  Synthetic oligonucleotide
tgctcgtcttgtatttcttgtgtccgtcgccgcct

SEQ ID NO: 52119 - DNA, 35 bp, Artificial Sequence
  Synthetic oligonucleotide
gcacgtcccattgcaatattgtcgctgcgacatct

SEQ ID NO: 52120 - DNA, 35 bp, Artificial Sequence
  Synthetic oligonucleotide
gttgccaagagctgcactcaatcgatagcatactt

SEQ ID NO: 52121 - DNA, 36 bp, Artificial Sequence
  Synthetic oligonucleotide
gcaccacaacacggagtcaattccagcccagttgaa

SEQ ID NO: 52122 - DNA, 36 bp, Artificial Sequence
  Synthetic oligonucleotide
gcaaggtggagggggaaggaacgattttccgtataa

SEQ ID NO: 52123 - DNA, 36 bp, Artificial Sequence
  Synthetic oligonucleotide
gagggggggataattcgggttgagaccagggaaaca

SEQ ID NO: 52124 - DNA, 36 bp, Artificial Sequence
  Synthetic oligonucleotide
tcgtaccccatacgcctcatgcttagtgaaacgaca

SEQ ID NO: 52125 - DNA, 36 bp, Artificial Sequence
  Synthetic oligonucleotide
taccgctcggtagggcatggtccctccttcaaacca

SEQ ID NO: 52126 - DNA, 36 bp, Artificial Sequence
  Synthetic oligonucleotide
tgcctggcgcactgtctgccgtttgcactatgccca

SEQ ID NO: 52127 - DNA, 36 bp, Artificial Sequence
  Synthetic oligonucleotide
actccctcgcgcacacgatttacgcgttacatcgca

SEQ ID NO: 52128 - DNA, 36 bp, Artificial Sequence
  Synthetic oligonucleotide
ttacaaccaccacatatacagtagcccgaggcatca

SEQ ID NO: 52129 - DNA, 36 bp, Artificial Sequence
  Synthetic oligonucleotide
agactacatccccatgtgaatccaaggccacattca

SEQ ID NO: 52130 - DNA, 37 bp, Artificial Sequence
  Synthetic oligonucleotide
gtcacacagacaacgccccgtccgccacaggtgccga

SEQ ID NO: 52131 - DNA, 37 bp, Artificial Sequence
  Synthetic oligonucleotide
actccaaaccgtcgacagtgttccctcttagtatcga

SEQ ID NO: 52132 - DNA, 37 bp, Artificial Sequence
  Synthetic oligonucleotide
acagtgtgtacccggaccatccgccagaatccctcga

SEQ ID NO: 52133 - DNA, 37 bp, Artificial Sequence
  Synthetic oligonucleotide
tgaccagctaggtcaacgcagctcttttctacttcga

SEQ ID NO: 52134 - DNA, 37 bp, Artificial Sequence
  Synthetic oligonucleotide
agtgccttcgcccgcgcagaccgattcctacgttcga

SEQ ID NO: 52135 - DNA, 36 bp, Artificial Sequence
  Synthetic oligonucleotide
tctggcgcaaattttcccgcccctccgtcacgcgga

SEQ ID NO: 52136 - DNA, 37 bp, Artificial Sequence
  Synthetic oligonucleotide
gtgggttaggggtgacggttggtgttgggggaaggga

SEQ ID NO: 52137 - DNA, 37 bp, Artificial Sequence
  Synthetic oligonucleotide
gtcacaggcctattatccttccatccccgacgaggga

SEQ ID NO: 52138 - DNA, 37 bp, Artificial Sequence
  Synthetic oligonucleotide
tactgacaggtaggtaagtgcgtgatgcacgggggga

SEQ ID NO: 52139 - DNA, 37 bp, Artificial Sequence
  Synthetic oligonucleotide
agttgaacagggggactaagggatgtaaggcgtggga

SEQ ID NO: 52140 - DNA, 37 bp, Artificial Sequence
  Synthetic oligonucleotide
aacgggtggcacaagaaggggagctatgtgaggtgga

SEQ ID NO: 52141 - DNA, 38 bp, Artificial Sequence
  Synthetic oligonucleotide
gctggtggcacgtacgcctttcgacctcattagaatga

SEQ ID NO: 52142 - DNA, 37 bp, Artificial Sequence
  Synthetic oligonucleotide
gcgatccggtatggggggtaggaggggctttgaatga

SEQ ID NO: 52143 - DNA, 37 bp, Artificial Sequence
  Synthetic oligonucleotide
gtgccacgcacgcaaccgcgactcatattcatcatga

SEQ ID NO: 52144 - DNA, 38 bp, Artificial Sequence
  Synthetic oligonucleotide
gaacgtagaggcacagtagcacaatgggacggggatga

SEQ ID NO: 52145 - DNA, 37 bp, Artificial Sequence
  Synthetic oligonucleotide
accctgtcccagaccatttgcctgtcagttatcctga

SEQ ID NO: 52146 - DNA, 37 bp, Artificial Sequence
  Synthetic oligonucleotide
tcagtcatctccgcatccctgcttcgacgacctctga

SEQ ID NO: 52147 - DNA, 37 bp, Artificial Sequence
  Synthetic oligonucleotide
aaccacatcaccgcctgtaatctggtaacatacgtga

SEQ ID NO: 52148 - DNA, 38 bp, Artificial Sequence
  Synthetic oligonucleotide
gaaacgtgagcccttggaggcgagcaacccttccgtga

SEQ ID NO: 52149 - DNA, 37 bp, Artificial Sequence
  Synthetic oligonucleotide
gctccactccaactacactgtccacccataaaggtga

SEQ ID NO: 52150 - DNA, 38 bp, Artificial Sequence
  Synthetic oligonucleotide
atcacatccctacgtaaaagcccgcgacccgaccttga

SEQ ID NO: 52151 - DNA, 37 bp, Artificial Sequence
  Synthetic oligonucleotide
gaatgcctgtgtccagatccccatcgtttctgtttga

SEQ ID NO: 52152 - DNA, 35 bp, Artificial Sequence
  Synthetic oligonucleotide
attgccgaccgctgttaaacgcgatgaatcaccta

SEQ ID NO: 52153 - DNA, 35 bp, Artificial Sequence
  Synthetic oligonucleotide
atggcccccggcgctacgttcccttgttataccta

SEQ ID NO: 52154 - DNA, 35 bp, Artificial Sequence
  Synthetic oligonucleotide
aacctccacgcagacccggccggcctcctttgcta

SEQ ID NO: 52155 - DNA, 35 bp, Artificial Sequence
  Synthetic oligonucleotide
ttccgtaccggcccactccctcttcatcgattgta

SEQ ID NO: 52156 - DNA, 35 bp, Artificial Sequence
  Synthetic oligonucleotide
gcacaaccccgccacacggaaccccgccacgcaac

SEQ ID NO: 52157 - DNA, 35 bp, Artificial Sequence
  Synthetic oligonucleotide
gtgtcccccgcatggcaactttcattgttagccac

SEQ ID NO: 52158 - DNA, 35 bp, Artificial Sequence
  Synthetic oligonucleotide
tccataaggcccctccacatacgtctctttacgac

SEQ ID NO: 52159 - DNA, 35 bp, Artificial Sequence
  Synthetic oligonucleotide
tgcggttgtacacatcttgtaaggcctccacctac

SEQ ID NO: 52160 - DNA, 35 bp, Artificial Sequence
  Synthetic oligonucleotide
agcgttcggtcatcattgtttcccgcccgtattac

SEQ ID NO: 52161 - DNA, 35 bp, Artificial Sequence
  Synthetic oligonucleotide
agcccgaggtccctgcgaactatttctattccacc

SEQ ID NO: 52162 - DNA, 35 bp, Artificial Sequence
  Synthetic oligonucleotide
attgttcccagcggacgcgcccacattttagcccc

SEQ ID NO: 52163 - DNA, 35 bp, Artificial Sequence
  Synthetic oligonucleotide
tgcctcgcttcaggcatacccatgtttctcccgcc

SEQ ID NO: 52164 - DNA, 35 bp, Artificial Sequence
  Synthetic oligonucleotide
gttatcaacacgtttgctggttggaccccctcccg

SEQ ID NO: 52165 - DNA, 34 bp, Artificial Sequence
  Synthetic oligonucleotide
gttacatgccagaataccctaaacttcattttcg

SEQ ID NO: 52166 - DNA, 35 bp, Artificial Sequence
  Synthetic oligonucleotide
aaagaacatgcaacggtgggtatcaacgggggggg

SEQ ID NO: 52167 - DNA, 35 bp, Artificial Sequence
  Synthetic oligonucleotide
tgacacgtgcgagctcaaacgaatcccggtaacat

SEQ ID NO: 52168 - DNA, 35 bp, Artificial Sequence
  Synthetic oligonucleotide
cacgacgctcctgatacagccgcccaacatgccat

SEQ ID NO: 52169 - DNA, 35 bp, Artificial Sequence
  Synthetic oligonucleotide
atcatgtctcggtgctttactccacgtttgtccct

SEQ ID NO: 52170 - DNA, 35 bp, Artificial Sequence
  Synthetic oligonucleotide
gtcatcccttagcccgcatgctgccaaatacatct

SEQ ID NO: 52171 - DNA, 35 bp, Artificial Sequence
  Synthetic oligonucleotide
gtcccgtagccccactttagtttgcgacattatct

SEQ ID NO: 52172 - DNA, 35 bp, Artificial Sequence
  Synthetic oligonucleotide
ttgacttgcctttgcccccctacggacgagcttgt

SEQ ID NO: 52173 - DNA, 35 bp, Artificial Sequence
  Synthetic oligonucleotide
gccctggagttctgcgctggcccgtaccatccctt

SEQ ID NO: 52174 - DNA, 36 bp, Artificial Sequence
  Synthetic oligonucleotide
gagaccaccgttcaacaccacgtaacccaaacacaa

SEQ ID NO: 52175 - DNA, 36 bp, Artificial Sequence
  Synthetic oligonucleotide
ggaacatgcggcacccgccccaaccccgcttcgcaa

SEQ ID NO: 52176 - DNA, 36 bp, Artificial Sequence
  Synthetic oligonucleotide
tgaccctgccattcatgcgtgaagccctcaaatcaa

SEQ ID NO: 52177 - DNA, 35 bp, Artificial Sequence
  Synthetic oligonucleotide
tacccgcccctccatcgcacactcctgtttacgaa

SEQ ID NO: 52178 - DNA, 35 bp, Artificial Sequence
  Synthetic oligonucleotide
gtgtggagaagggaggtgtgaggtgcagacgtgaa

SEQ ID NO: 52179 - DNA, 36 bp, Artificial Sequence
  Synthetic oligonucleotide
accccttgcatcattgcgtcgcaactccaggacgca

SEQ ID NO: 52180 - DNA, 35 bp, Artificial Sequence
  Synthetic oligonucleotide
aacgacggctcaccttatgggccatacacctgtca

SEQ ID NO: 52181 - DNA, 36 bp, Artificial Sequence
  Synthetic oligonucleotide
gatcgaaggggtggtaaaacaggcggaggacagaga

SEQ ID NO: 52182 - DNA, 37 bp, Artificial Sequence
  Synthetic oligonucleotide
gtgtcacgtacacatctaggttggggtggcttttaga

SEQ ID NO: 52183 - DNA, 37 bp, Artificial Sequence
  Synthetic oligonucleotide
tgcctcccacactttctgacgccctaggtcctgccga

SEQ ID NO: 52184 - DNA, 35 bp, Artificial Sequence
  Synthetic oligonucleotide
acgaatacctccacctcacgttttcccgtgatcga

SEQ ID NO: 52185 - DNA, 37 bp, Artificial Sequence
  Synthetic oligonucleotide
aacgccgtgtcagcttcggaacaaccacctatctcga

SEQ ID NO: 52186 - DNA, 37 bp, Artificial Sequence
  Synthetic oligonucleotide
tcccccgactcacccccgtccgtcacctgacggagga

SEQ ID NO: 52187 - DNA, 37 bp, Artificial Sequence
  Synthetic oligonucleotide
cgaggctctctcagtgggtgggacgggactgggggga

SEQ ID NO: 52188 - DNA, 38 bp, Artificial Sequence
  Synthetic oligonucleotide
atgactccgtatgcacaaaactaacgctccctcttgga

SEQ ID NO: 52189 - DNA, 38 bp, Artificial Sequence
  Synthetic oligonucleotide
tgtcccccacgtgcgcgcatccatctcttcccccatga

SEQ ID NO: 52190 - DNA, 37 bp, Artificial Sequence
  Synthetic oligonucleotide
acctgacaaacgggctactaacacctctgttccatga

SEQ ID NO: 52191 - DNA, 38 bp, Artificial Sequence
  Synthetic oligonucleotide
tatcccatccctgtcacatcttatgcgcctccgcatga

SEQ ID NO: 52192 - DNA, 36 bp, Artificial Sequence
  Synthetic oligonucleotide
gactggtcttctcccgcaccgttggtcccacactga

SEQ ID NO: 52193 - DNA, 37 bp, Artificial Sequence
  Synthetic oligonucleotide
accaccggcaagtcctcttccgtcgctttaatcctga

SEQ ID NO: 52194 - DNA, 37 bp, Artificial Sequence
  Synthetic oligonucleotide
tgccacccccgctactgtcccaccaggcactccgtga

SEQ ID NO: 52195 - DNA, 37 bp, Artificial Sequence
  Synthetic oligonucleotide
gcccatctctccctcttgtttaatcactcgcatgtga

SEQ ID NO: 52196 - DNA, 36 bp, Artificial Sequence
  Synthetic oligonucleotide
tacacagcactgctgagctttctgcatgccatttga

SEQ ID NO: 52197 - DNA, 38 bp, Artificial Sequence
  Synthetic oligonucleotide
accaccgcctgcacaccaagtagtgctcgcaattttga

SEQ ID NO: 52198 - DNA, 35 bp, Artificial Sequence
  Synthetic oligonucleotide
attgcgccaatctccgacgtgctttaccatgaata

SEQ ID NO: 52199 - DNA, 35 bp, Artificial Sequence
  Synthetic oligonucleotide
atgtgggagagtccatccccgctcaccccgttata

SEQ ID NO: 52200 - DNA, 36 bp, Artificial Sequence
  Synthetic oligonucleotide
accattcaccccgttccgcagcttggcgttaaccta

SEQ ID NO: 52201 - DNA, 35 bp, Artificial Sequence
  Synthetic oligonucleotide
gcaaaacgggggggaagcacggtgtaaggagtcta

SEQ ID NO: 52202 - DNA, 35 bp, Artificial Sequence
  Synthetic oligonucleotide
tgaatgtgcctccgccgactcacctgttctgagta

SEQ ID NO: 52203 - DNA, 36 bp, Artificial Sequence
  Synthetic oligonucleotide
gtggtggggggggcgggaattcctcagtataattta

SEQ ID NO: 52204 - DNA, 35 bp, Artificial Sequence
  Synthetic oligonucleotide
acgacttcacttccatgagtccctacacactttta

SEQ ID NO: 52205 - DNA, 35 bp, Artificial Sequence
  Synthetic oligonucleotide
taggctcaacgtccatcccattttcctgtttcaac

SEQ ID NO: 52206 - DNA, 35 bp, Artificial Sequence
  Synthetic oligonucleotide
tcaggttcgtctagcaacccttcttcatggcccac

SEQ ID NO: 52207 - DNA, 35 bp, Artificial Sequence
  Synthetic oligonucleotide
tcgcgcacatgaactgctctacacggtttggccac

SEQ ID NO: 52208 - DNA, 35 bp, Artificial Sequence
  Synthetic oligonucleotide
gtgggaccagggaggacggggggtcaaacagagac

SEQ ID NO: 52209 - DNA, 35 bp, Artificial Sequence
  Synthetic oligonucleotide
tacgtcccgatcgtagctggcccatgaacttcgac

SEQ ID NO: 52210 - DNA, 35 bp, Artificial Sequence
  Synthetic oligonucleotide
ggggaccgcgagcgcatttctatctcataaccccc

SEQ ID NO: 52211 - DNA, 35 bp, Artificial Sequence
  Synthetic oligonucleotide
ggatacgcaaccggtccacattcctatgcacacgc

SEQ ID NO: 52212 - DNA, 36 bp, Artificial Sequence
  Synthetic oligonucleotide
caagccgtgcaccagtgccccgttccatcgccattc

SEQ ID NO: 52213 - DNA, 35 bp, Artificial Sequence
  Synthetic oligonucleotide
tccaccaccatcacgttgcgcgagtatcttcacgg

SEQ ID NO: 52214 - DNA, 35 bp, Artificial Sequence
  Synthetic oligonucleotide
taccacggctacacgcatgaaacttcgctatcggg

SEQ ID NO: 52215 - DNA, 35 bp, Artificial Sequence
  Synthetic oligonucleotide
tcgaagggggggaacgttgcgctttaattcagggg

SEQ ID NO: 52216 - DNA, 35 bp, Artificial Sequence
  Synthetic oligonucleotide
actcgcactgtgctgtcatttcccatgaaccattg

SEQ ID NO: 52217 - DNA, 35 bp, Artificial Sequence
  Synthetic oligonucleotide
accgaaccgcttgactcttagaaatgacggacttg

SEQ ID NO: 52218 - DNA, 35 bp, Artificial Sequence
  Synthetic oligonucleotide
gtaacaccgtaggccaacgacgcatacacccgtat

SEQ ID NO: 52219 - DNA, 35 bp, Artificial Sequence
  Synthetic oligonucleotide
gaatgccctggtgcaatcgtgtcctggtttcaact

SEQ ID NO: 52220 - DNA, 35 bp, Artificial Sequence
  Synthetic oligonucleotide
tcaaaaactcgaccttcgtgattacgtgttccact

SEQ ID NO: 52221 - DNA, 36 bp, Artificial Sequence
  Synthetic oligonucleotide
gccgcccacccagttacaacctgagagcatctctaa

SEQ ID NO: 52222 - DNA, 36 bp, Artificial Sequence
  Synthetic oligonucleotide
accacgggcgaatcggggctttccaaacgaactaca

SEQ ID NO: 52223 - DNA, 35 bp, Artificial Sequence
  Synthetic oligonucleotide
gggaccggttaaaaggggaggtagtgggagttaca

SEQ ID NO: 52224 - DNA, 36 bp, Artificial Sequence
  Synthetic oligonucleotide
atggccaagacctgtttttgtccccgtttgctggca

SEQ ID NO: 52225 - DNA, 35 bp, Artificial Sequence
  Synthetic oligonucleotide
acgcaatcctccgacgtccaacccttcttttggca

SEQ ID NO: 52226 - DNA, 36 bp, Artificial Sequence
  Synthetic oligonucleotide
taccacacgttgttctttatgcccgtctattctgca

SEQ ID NO: 52227 - DNA, 36 bp, Artificial Sequence
  Synthetic oligonucleotide
tccgctcacacacagacctcctttcggctgtcctca

SEQ ID NO: 52228 - DNA, 35 bp, Artificial Sequence
  Synthetic oligonucleotide
gtagccttgtttgcgctccctataaatcactctca

SEQ ID NO: 52229 - DNA, 37 bp, Artificial Sequence
  Synthetic oligonucleotide
gactggaggagggtggtaaggatgaacgctttggaga

SEQ ID NO: 52230 - DNA, 37 bp, Artificial Sequence
  Synthetic oligonucleotide
tgacctacaccggcactggcctgattctcgatctcga

SEQ ID NO: 52231 - DNA, 37 bp, Artificial Sequence
  Synthetic oligonucleotide
gcacctcccagtaatagtccaagcatctccatgtcga

SEQ ID NO: 52232 - DNA, 37 bp, Artificial Sequence
  Synthetic oligonucleotide
tgcccccaccccaatggctatacaattttctttcgga

SEQ ID NO: 52233 - DNA, 37 bp, Artificial Sequence
  Synthetic oligonucleotide
gaaagggcgtattggaatcagggtggtgcttagggga

SEQ ID NO: 52234 - DNA, 37 bp, Artificial Sequence
  Synthetic oligonucleotide
tagtagtggggcggagggcctgtgcaaaaaaatggga

SEQ ID NO: 52235 - DNA, 37 bp, Artificial Sequence
  Synthetic oligonucleotide
acgaccatccatgttgggatgcacctgacttcttgga

SEQ ID NO: 52236 - DNA, 37 bp, Artificial Sequence
  Synthetic oligonucleotide
aatggaacatgggagcctgggtggcggagagtttgga

SEQ ID NO: 52237 - DNA, 38 bp, Artificial Sequence
  Synthetic oligonucleotide
tgccatccacatcatttataaccacgaagtccgtatga

SEQ ID NO: 52238 - DNA, 38 bp, Artificial Sequence
  Synthetic oligonucleotide
gcaccaggagggggggacaaaagttctgtgcaaactga

SEQ ID NO: 52239 - DNA, 37 bp, Artificial Sequence
  Synthetic oligonucleotide
tcgcaatacacacagggcacgtacactacccctctga

SEQ ID NO: 52240 - DNA, 38 bp, Artificial Sequence
  Synthetic oligonucleotide
accacactccgttctatatggcccgttttacgttctga

SEQ ID NO: 52241 - DNA, 38 bp, Artificial Sequence
  Synthetic oligonucleotide
gaccggaacgtggtggtaagaaccagtatggggggtga

SEQ ID NO: 52242 - DNA, 38 bp, Artificial Sequence
  Synthetic oligonucleotide
tattgccaccagctggtttggcgtatacacctcattga

SEQ ID NO: 52243 - DNA, 37 bp, Artificial Sequence
  Synthetic oligonucleotide
taatccggcatgcccattactttttcgtgctacttga

SEQ ID NO: 52244 - DNA, 38 bp, Artificial Sequence
  Synthetic oligonucleotide
aagacacctccgttgccgaatggtgcaaccgactttga

SEQ ID NO: 52245 - DNA, 36 bp, Artificial Sequence
  Synthetic oligonucleotide
gttggtgcactgagggcaaagggcggtcgggggata

SEQ ID NO: 52246 - DNA, 36 bp, Artificial Sequence
  Synthetic oligonucleotide
gccacccctcctgtttctacttgtacccggatgcta

SEQ ID NO: 52247 - DNA, 36 bp, Artificial Sequence
  Synthetic oligonucleotide
gccgatgcatccatactaaaccacagccacggtcta

SEQ ID NO: 52248 - DNA, 35 bp, Artificial Sequence
  Synthetic oligonucleotide
gtgcataggctgtcactccaacgcgcacactaaac

SEQ ID NO: 52249 - DNA, 35 bp, Artificial Sequence
  Synthetic oligonucleotide
acacccagcaggagcttcaagccctatagccgaac

SEQ ID NO: 52250 - DNA, 35 bp, Artificial Sequence
  Synthetic oligonucleotide
ttgtctgccacgaatcatctttttgctcctgtaac

SEQ ID NO: 52251 - DNA, 35 bp, Artificial Sequence
  Synthetic oligonucleotide
ttgaaaacccacatcggtaagtactgctttttcac

SEQ ID NO: 52252 - DNA, 35 bp, Artificial Sequence
  Synthetic oligonucleotide
gtaacactgcactccgttgatcacgaacattcgac

SEQ ID NO: 52253 - DNA, 34 bp, Artificial Sequence
  Synthetic oligonucleotide
tccactatccagatctctgctccatgccctgtac

SEQ ID NO: 52254 - DNA, 35 bp, Artificial Sequence
  Synthetic oligonucleotide
tgacaccctgtttgctcagttacgttcccgcttac

SEQ ID NO: 52255 - DNA, 35 bp, Artificial Sequence
  Synthetic oligonucleotide
agccgcctgacctgctattacttttcttacgctgc

SEQ ID NO: 52256 - DNA, 35 bp, Artificial Sequence
  Synthetic oligonucleotide
agcccccgctgctgtagacgtcttgtctggaaatc

SEQ ID NO: 52257 - DNA, 35 bp, Artificial Sequence
  Synthetic oligonucleotide
tcgatccaacttgccgagctcaacagacaactctc

SEQ ID NO: 52258 - DNA, 35 bp, Artificial Sequence
  Synthetic oligonucleotide
gtgccatcgccataagcatcaactctttccgggtc

SEQ ID NO: 52259 - DNA, 35 bp, Artificial Sequence
  Synthetic oligonucleotide
attgcggtcactcttggtcttgtcctggttatgtc

SEQ ID NO: 52260 - DNA, 35 bp, Artificial Sequence
  Synthetic oligonucleotide
tcacagggtcaacacccgttgccatcactaagttc

SEQ ID NO: 52261 - DNA, 35 bp, Artificial Sequence
  Synthetic oligonucleotide
tagtcaacgccgccggcaaccgaaactgggaatcg

SEQ ID NO: 52262 - DNA, 35 bp, Artificial Sequence
  Synthetic oligonucleotide
cacaaacccaccttgctatttatttccgcctttgg

SEQ ID NO: 52263 - DNA, 35 bp, Artificial Sequence
  Synthetic oligonucleotide
ttcgcccctaacggcaggtcgctctcaggcaccat

SEQ ID NO: 52264 - DNA, 35 bp, Artificial Sequence
  Synthetic oligonucleotide
ttcccatccgtgtcgcacccacgctctattgtcct

SEQ ID NO: 52265 - DNA, 35 bp, Artificial Sequence
  Synthetic oligonucleotide
atggggcgtgaggctggggaggcgggttacgtcgt

SEQ ID NO: 52266 - DNA, 35 bp, Artificial Sequence
  Synthetic oligonucleotide
gcacacctgttcctctctgtctagtccgcaagtgt

SEQ ID NO: 52267 - DNA, 35 bp, Artificial Sequence
  Synthetic oligonucleotide
gacttgccttaagattctgtgcttagtgtttcgtt

SEQ ID NO: 52268 - DNA, 36 bp, Artificial Sequence
  Synthetic oligonucleotide
acagccacctacaggtcacgcgtacgtcacacccaa

SEQ ID NO: 52269 - DNA, 36 bp, Artificial Sequence
  Synthetic oligonucleotide
taagaccccctggcgctaccaccgtaactaccggaa

SEQ ID NO: 52270 - DNA, 36 bp, Artificial Sequence
  Synthetic oligonucleotide
tttgccacttcctgttgatattgctgaatgccttaa

SEQ ID NO: 52271 - DNA, 35 bp, Artificial Sequence
  Synthetic oligonucleotide
acgcttccgacggcactgaacgcctttgcacacca

SEQ ID NO: 52272 - DNA, 36 bp, Artificial Sequence
  Synthetic oligonucleotide
atgtccccgccacgcacctactggccggttcgacca

SEQ ID NO: 52273 - DNA, 35 bp, Artificial Sequence
  Synthetic oligonucleotide
gagacaccacccccccgtctatggtgaagccccca

SEQ ID NO: 52274 - DNA, 36 bp, Artificial Sequence
  Synthetic oligonucleotide
gtgacacggatgggtttggagtggaagggaaacgca

SEQ ID NO: 52275 - DNA, 37 bp, Artificial Sequence
  Synthetic oligonucleotide
acgcactctccctaccgcagcccccttatccgtaaga

SEQ ID NO: 52276 - DNA, 36 bp, Artificial Sequence
  Synthetic oligonucleotide
atgtttgcccgatcgaattcctgtcaccattacaga

SEQ ID NO: 52277 - DNA, 35 bp, Artificial Sequence
  Synthetic oligonucleotide
atccatctcggcttatctcttaagacctccttaga

SEQ ID NO: 52278 - DNA, 37 bp, Artificial Sequence
  Synthetic oligonucleotide
agctacaagcccacgcccataactacacatacaccga

SEQ ID NO: 52279 - DNA, 33 bp, Artificial Sequence
  Synthetic oligonucleotide
gtaccgcataccgaacatctatcttgctcccga

SEQ ID NO: 52280 - DNA, 37 bp, Artificial Sequence
  Synthetic oligonucleotide
gcttgccgtgcgccaccatttacagtacgtttcccga

SEQ ID NO: 52281 - DNA, 37 bp, Artificial Sequence
  Synthetic oligonucleotide
tatgggacggaaaagtttggcggagagtggggaagga

SEQ ID NO: 52282 - DNA, 35 bp, Artificial Sequence
  Synthetic oligonucleotide
gggacggaggggacacaagaggtgggtagacagga

SEQ ID NO: 52283 - DNA, 37 bp, Artificial Sequence
  Synthetic oligonucleotide
aagaactggggacgaggggcttaaggggcaccgcgga

SEQ ID NO: 52284 - DNA, 37 bp, Artificial Sequence
  Synthetic oligonucleotide
gtactagggggggaagggcctgcggtcatggggggga

SEQ ID NO: 52285 - DNA, 37 bp, Artificial Sequence
  Synthetic oligonucleotide
gagcggggtccagggcgactcaggggatgaagtggga

SEQ ID NO: 52286 - DNA, 37 bp, Artificial Sequence
  Synthetic oligonucleotide
tctgcgacccagctatctatgggatcttcattctgga

SEQ ID NO: 52287 - DNA, 38 bp, Artificial Sequence
  Synthetic oligonucleotide
gtcacgtgggcgggtgggtcagcacgggattcacatga

SEQ ID NO: 52288 - DNA, 38 bp, Artificial Sequence
  Synthetic oligonucleotide
taccggtggtaggtagagggataaagggggtctcatga

SEQ ID NO: 52289 - DNA, 36 bp, Artificial Sequence
  Synthetic oligonucleotide
gctgtagcaggtgctggctttgtcatcagtttatga

SEQ ID NO: 52290 - DNA, 37 bp, Artificial Sequence
  Synthetic oligonucleotide
gacacgccgcaaggtgtgagaggggtcagggtactga

SEQ ID NO: 52291 - DNA, 38 bp, Artificial Sequence
  Synthetic oligonucleotide
gtggaccgggcggaatgcgggctggggggataaagtga

SEQ ID NO: 52292 - DNA, 35 bp, Artificial Sequence
  Synthetic oligonucleotide
acacgtcacctagttatctgttgtgcccttcgtga

SEQ ID NO: 52293 - DNA, 37 bp, Artificial Sequence
  Synthetic oligonucleotide
gtttgctcagccctattctgctttatctgccgtgtga

SEQ ID NO: 52294 - DNA, 38 bp, Artificial Sequence
  Synthetic oligonucleotide
ttagccggtggacttgagttggagggtaggcggtgtga

SEQ ID NO: 52295 - DNA, 38 bp, Artificial Sequence
  Synthetic oligonucleotide
gcccgttcgcaactggcccagaacacgccacattttga

SEQ ID NO: 52296 - DNA, 35 bp, Artificial Sequence
  Synthetic oligonucleotide
gccccccgggtcttgcttgaacgccatttaaacta

SEQ ID NO: 52297 - DNA, 36 bp, Artificial Sequence
  Synthetic oligonucleotide
gttagccggaccgtgcgccttaccagtggcctccta

SEQ ID NO: 52298 - DNA, 36 bp, Artificial Sequence
  Synthetic oligonucleotide
tgcccccccctggtcaagcctggtaccctaaagcta

SEQ ID NO: 52299 - DNA, 36 bp, Artificial Sequence
  Synthetic oligonucleotide
ttgtgaacgcgaggttatgggaatggggaggggcta

SEQ ID NO: 52300 - DNA, 36 bp, Artificial Sequence
  Synthetic oligonucleotide
gtacatgccgcgcgttcgaccgcttcttgcctctta

SEQ ID NO: 52301 - DNA, 35 bp, Artificial Sequence
  Synthetic oligonucleotide
tcatccacacctttacatccgtgtgagagaagtta

SEQ ID NO: 52302 - DNA, 35 bp, Artificial Sequence
  Synthetic oligonucleotide
gccgatcgccacggtagcgaccctcgaacatacac

SEQ ID NO: 52303 - DNA, 35 bp, Artificial Sequence
  Synthetic oligonucleotide
gactccgaccagatataaccgcggcctaaaactac

SEQ ID NO: 52304 - DNA, 35 bp, Artificial Sequence
  Synthetic oligonucleotide
tactccaacgtgctcaagcctgggatactccctac

SEQ ID NO: 52305 - DNA, 35 bp, Artificial Sequence
  Synthetic oligonucleotide
ttatcccacgtgtggttacccgacccaatatgacc

SEQ ID NO: 52306 - DNA, 35 bp, Artificial Sequence
  Synthetic oligonucleotide
tgcacgacgcccgccggatcccattttcacgatcc

SEQ ID NO: 52307 - DNA, 35 bp, Artificial Sequence
  Synthetic oligonucleotide
tcctgtctctagtccccgagcccgttcttatccgc

SEQ ID NO: 52308 - DNA, 35 bp, Artificial Sequence
  Synthetic oligonucleotide
tgcctggtacataaggcacctactcagtctccctc

SEQ ID NO: 52309 - DNA, 35 bp, Artificial Sequence
  Synthetic oligonucleotide
accgtgctaggtgacttccagtgcttatattcctc

SEQ ID NO: 52310 - DNA, 35 bp, Artificial Sequence
  Synthetic oligonucleotide
tcccgccgctcacagctcctcccgacctccctgtc

SEQ ID NO: 52311 - DNA, 35 bp, Artificial Sequence
  Synthetic oligonucleotide
tcccgccgccccatcatccagcctgtcgaatgccg

SEQ ID NO: 52312 - DNA, 35 bp, Artificial Sequence
  Synthetic oligonucleotide
tctgtggagagggctgcgggtaaggggcacaatgg

SEQ ID NO: 52313 - DNA, 35 bp, Artificial Sequence
  Synthetic oligonucleotide
tagtcaagcggaccgtatggttgtagtgggtggtg

SEQ ID NO: 52314 - DNA, 33 bp, Artificial Sequence
  Synthetic oligonucleotide
acgattagcgctactccttctaggcttccgaat

SEQ ID NO: 52315 - DNA, 35 bp, Artificial Sequence
  Synthetic oligonucleotide
atactggaagcccttacgccggttgattaccccct

SEQ ID NO: 52316 - DNA, 35 bp, Artificial Sequence
  Synthetic oligonucleotide
gggtgcatcagtcaattcttgcgcactacatccct

SEQ ID NO: 52317 - DNA, 35 bp, Artificial Sequence
  Synthetic oligonucleotide
taacgcttgcttacatatgcccttttgcctcatct

SEQ ID NO: 52318 - DNA, 35 bp, Artificial Sequence
  Synthetic oligonucleotide
ttcgccaaccgggcatctccgcacttctcacctgt

SEQ ID NO: 52319 - DNA, 36 bp, Artificial Sequence
  Synthetic oligonucleotide
atccgcctacagccgcatacaccagacgctgacaaa

SEQ ID NO: 52320 - DNA, 35 bp, Artificial Sequence
  Synthetic oligonucleotide
agccacctctctttccggcctgctcgcatcgcgaa

SEQ ID NO: 52321 - DNA, 36 bp, Artificial Sequence
  Synthetic oligonucleotide
gtgagtcgtagtctgggtggggagctcaaagaaaca

SEQ ID NO: 52322 - DNA, 36 bp, Artificial Sequence
  Synthetic oligonucleotide
tcttcctctgccacccatcgcatagtgccgctaaca

SEQ ID NO: 52323 - DNA, 36 bp, Artificial Sequence
  Synthetic oligonucleotide
gacttgaccatccgagccagacccgctatcctggca

SEQ ID NO: 52324 - DNA, 35 bp, Artificial Sequence
  Synthetic oligonucleotide
gtccacctcgagccacaattaccaccttagtggca

SEQ ID NO: 52325 - DNA, 36 bp, Artificial Sequence
  Synthetic oligonucleotide
ttgcccttccccagcgtgagagctacacttcatgca

SEQ ID NO: 52326 - DNA, 35 bp, Artificial Sequence
  Synthetic oligonucleotide
gtactacctgttctgttatacaccgccaacaatca

SEQ ID NO: 52327 - DNA, 37 bp, Artificial Sequence
  Synthetic oligonucleotide
tccaccccagcttatcccgttgtcaccaggccaacga

SEQ ID NO: 52328 - DNA, 37 bp, Artificial Sequence
  Synthetic oligonucleotide
gacgaaggtaggaaaagtgttagttgggcatgtacga

SEQ ID NO: 52329 - DNA, 37 bp, Artificial Sequence
  Synthetic oligonucleotide
gagcacgggtcacggtctccgatttcacacaccccga

SEQ ID NO: 52330 - DNA, 37 bp, Artificial Sequence
  Synthetic oligonucleotide
ttacgggtgcggagggggggttacttctgaagcgcga

SEQ ID NO: 52331 - DNA, 37 bp, Artificial Sequence
  Synthetic oligonucleotide
gaaatgggggcggttaaaataggggaggatggccgga

SEQ ID NO: 52332 - DNA, 38 bp, Artificial Sequence
  Synthetic oligonucleotide
tgaccccacgacgtgttaaccacgtctagtatcactga

SEQ ID NO: 52333 - DNA, 38 bp, Artificial Sequence
  Synthetic oligonucleotide
gcaaccgtagccgccactcgctgcctgtcttcacctga

SEQ ID NO: 52334 - DNA, 38 bp, Artificial Sequence
  Synthetic oligonucleotide
accacttgtacacacctgggctccatcttgtaccctga

SEQ ID NO: 52335 - DNA, 37 bp, Artificial Sequence
  Synthetic oligonucleotide
atcccgtgaacttgcgcagacctctcccccctgctga

SEQ ID NO: 52336 - DNA, 38 bp, Artificial Sequence
  Synthetic oligonucleotide
gtttgatcgcgcctgttgggccttgtaactctctctga

SEQ ID NO: 52337 - DNA, 38 bp, Artificial Sequence
  Synthetic oligonucleotide
aagacaccgtgaagcctactatcgtccctaaccgttga

SEQ ID NO: 52338 - DNA, 38 bp, Artificial Sequence
  Synthetic oligonucleotide
agactccgccgacgattcccctctctcactcgtgttga

SEQ ID NO: 52339 - DNA, 38 bp, Artificial Sequence
  Synthetic oligonucleotide
acgcccttacctgagtcgtaacacacactctaatttga

SEQ ID NO: 52340 - DNA, 37 bp, Artificial Sequence
  Synthetic oligonucleotide
ttgaccccacgcgcactgctattcagtcacgttttga

SEQ ID NO: 52341 - DNA, 36 bp, Artificial Sequence
  Synthetic oligonucleotide
gtgatcccccgtaagtcctgtacccatatagttcta

SEQ ID NO: 52342 - DNA, 35 bp, Artificial Sequence
  Synthetic oligonucleotide
tagccaacctcacacagacggaacgccccaccccc

SEQ ID NO: 52343 - DNA, 35 bp, Artificial Sequence
  Synthetic oligonucleotide
ttcggatcaatcgacatagttcccagttttctgcc

SEQ ID NO: 52344 - DNA, 35 bp, Artificial Sequence
  Synthetic oligonucleotide
tcaacgtcacagcacttaccgatttactggtttcc

SEQ ID NO: 52345 - DNA, 35 bp, Artificial Sequence
  Synthetic oligonucleotide
acccattaaacgccagcgtatcccttccttcgcgc

SEQ ID NO: 52346 - DNA, 35 bp, Artificial Sequence
  Synthetic oligonucleotide
gctcaactctctgtcgacccaattgtcccttgtgc

SEQ ID NO: 52347 - DNA, 35 bp, Artificial Sequence
  Synthetic oligonucleotide
tcgttccacccatcgacgcttgacgtaacgccatc

SEQ ID NO: 52348 - DNA, 35 bp, Artificial Sequence
  Synthetic oligonucleotide
aactgaccttggcagcttttacattgcattgcctc

SEQ ID NO: 52349 - DNA, 35 bp, Artificial Sequence
  Synthetic oligonucleotide
acctggtagtcggtaacatccaccccgctcatacg

SEQ ID NO: 52350 - DNA, 35 bp, Artificial Sequence
  Synthetic oligonucleotide
tcccacgcctccgttcgttatgtctcgtggacggg

SEQ ID NO: 52351 - DNA, 35 bp, Artificial Sequence
  Synthetic oligonucleotide
tagaccacgaactctatatccgccctgaactatgg

SEQ ID NO: 52352 - DNA, 35 bp, Artificial Sequence
  Synthetic oligonucleotide
tgatgacgatagtcgcaccagtgataccttgcctg

SEQ ID NO: 52353 - DNA, 35 bp, Artificial Sequence
  Synthetic oligonucleotide
gaagaaaggggtgcactgtgggaagatagaaagtg

SEQ ID NO: 52354 - DNA, 35 bp, Artificial Sequence
  Synthetic oligonucleotide
tgccccccactgaacctccccacattgcacgagtg

SEQ ID NO: 52355 - DNA, 35 bp, Artificial Sequence
  Synthetic oligonucleotide
gggtcagaagtgctgggtgtgtagtagggggagtg

SEQ ID NO: 52356 - DNA, 35 bp, Artificial Sequence
  Synthetic oligonucleotide
acgccggcccttcccacaccgttcacggcctggct

SEQ ID NO: 52357 - DNA, 35 bp, Artificial Sequence
  Synthetic oligonucleotide
acaaactctgcctgctggacctaagggtcatctct

SEQ ID NO: 52358 - DNA, 35 bp, Artificial Sequence
  Synthetic oligonucleotide
attggtgcgttgccactaccctgtcattctgttct

SEQ ID NO: 52359 - DNA, 35 bp, Artificial Sequence
  Synthetic oligonucleotide
gtgcaacgtccagtagctttcgtgctgtaatcttt

SEQ ID NO: 52360 - DNA, 35 bp, Artificial Sequence
  Synthetic oligonucleotide
aacaacggatcattgggggttagccggggttgttt

SEQ ID NO: 52361 - DNA, 36 bp, Artificial Sequence
  Synthetic oligonucleotide
tttggcctcctccttgcatcgttacttgcacctgaa

SEQ ID NO: 52362 - DNA, 36 bp, Artificial Sequence
  Synthetic oligonucleotide
agtaacccgcgggcacacttctcagcctatgctaca

SEQ ID NO: 52363 - DNA, 36 bp, Artificial Sequence
  Synthetic oligonucleotide
atgagatgggggcatgggtattgaaaaatgagtaca

SEQ ID NO: 52364 - DNA, 36 bp, Artificial Sequence
  Synthetic oligonucleotide
ggttgccgccaaccgtcttattaaaaccttgttaca

SEQ ID NO: 52365 - DNA, 36 bp, Artificial Sequence
  Synthetic oligonucleotide
ttcatggcccgtacgcctatgttcttgccgaaacca

SEQ ID NO: 52366 - DNA, 36 bp, Artificial Sequence
  Synthetic oligonucleotide
tgacatctaacccacccactgcggcctgtaacccca

SEQ ID NO: 52367 - DNA, 36 bp, Artificial Sequence
  Synthetic oligonucleotide
agtgatcggctcaagttctgtgacactgctccccca

SEQ ID NO: 52368 - DNA, 35 bp, Artificial Sequence
  Synthetic oligonucleotide
gcgcaaccatgttgattgcctgtaccagtgagcca

SEQ ID NO: 52369 - DNA, 35 bp, Artificial Sequence
  Synthetic oligonucleotide
ccccatgcccttttctccgtaccgccactgttcca

SEQ ID NO: 52370 - DNA, 35 bp, Artificial Sequence
  Synthetic oligonucleotide
gaccccgcgggtttctcctatacaacaatttctca

SEQ ID NO: 52371 - DNA, 37 bp, Artificial Sequence
  Synthetic oligonucleotide
acccacttccgccatcactgtttcgtgattaacaaga

SEQ ID NO: 52372 - DNA, 37 bp, Artificial Sequence
  Synthetic oligonucleotide
gctgatgcaacgacccgggccagccccgtacctacga

SEQ ID NO: 52373 - DNA, 35 bp, Artificial Sequence
  Synthetic oligonucleotide
gccacccggagcacaaaacgccatgacccgatcga

SEQ ID NO: 52374 - DNA, 35 bp, Artificial Sequence
  Synthetic oligonucleotide
gactatgggtgcggaggggggggtctccggaagga

SEQ ID NO: 52375 - DNA, 37 bp, Artificial Sequence
  Synthetic oligonucleotide
gtaccggcgacaacctgtactatcccgtcctgaatga

SEQ ID NO: 52376 - DNA, 36 bp, Artificial Sequence
  Synthetic oligonucleotide
tgtagttccccgcctgtaccttccgtgctgacatga

SEQ ID NO: 52377 - DNA, 38 bp, Artificial Sequence
  Synthetic oligonucleotide
gcgaaaaggcggtggggccttagtaggaaagggagtga

SEQ ID NO: 52378 - DNA, 38 bp, Artificial Sequence
  Synthetic oligonucleotide
ggtccagcacgatagggaaggaggaacggaatacgtga

SEQ ID NO: 52379 - DNA, 38 bp, Artificial Sequence
  Synthetic oligonucleotide
accgcccacctaagttttaacatgaccgtgctcattga

SEQ ID NO: 52380 - DNA, 38 bp, Artificial Sequence
  Synthetic oligonucleotide
tgcggaacatccgtctctcctctttttatggcacttga

SEQ ID NO: 52381 - DNA, 36 bp, Artificial Sequence
  Synthetic oligonucleotide
tctctacacacgcgtgtcgacactatccatcctcta

SEQ ID NO: 52382 - DNA, 35 bp, Artificial Sequence
  Synthetic oligonucleotide
actaccgcaccttgtcttttgcagtacacaattta

SEQ ID NO: 52383 - DNA, 35 bp, Artificial Sequence
  Synthetic oligonucleotide
tacacttatggcaatcagctctaccggtctcacac

SEQ ID NO: 52384 - DNA, 35 bp, Artificial Sequence
  Synthetic oligonucleotide
gacccgtggccgttatgcaatcttctctggtccac

SEQ ID NO: 52385 - DNA, 35 bp, Artificial Sequence
  Synthetic oligonucleotide
acaccccactccaaaccagtcccggtcggcgggac

SEQ ID NO: 52386 - DNA, 35 bp, Artificial Sequence
  Synthetic oligonucleotide
attgggccattgcaaacttccattaatcgcctgac

SEQ ID NO: 52387 - DNA, 35 bp, Artificial Sequence
  Synthetic oligonucleotide
atgccggccgttttttcgagggcgcttatcaaccc

SEQ ID NO: 52388 - DNA, 35 bp, Artificial Sequence
  Synthetic oligonucleotide
ttaccctggtgcgccttcttggaccaccgtgcccc

SEQ ID NO: 52389 - DNA, 35 bp, Artificial Sequence
  Synthetic oligonucleotide
aacacatcgttggcctcccgcggtaaataactccc

SEQ ID NO: 52390 - DNA, 35 bp, Artificial Sequence
  Synthetic oligonucleotide
acgactccaccactctacacgtttttatcgaggcc

SEQ ID NO: 52391 - DNA, 35 bp, Artificial Sequence
  Synthetic oligonucleotide
tgctatttcgcacagaaaggccacttcccactctc

SEQ ID NO: 52392 - DNA, 35 bp, Artificial Sequence
  Synthetic oligonucleotide
agcctgggacctgaccccgcctcgtttactgcttc

SEQ ID NO: 52393 - DNA, 35 bp, Artificial Sequence
  Synthetic oligonucleotide
atgtttgccgaactgtctctgtatcccacgccagg

SEQ ID NO: 52394 - DNA, 35 bp, Artificial Sequence
  Synthetic oligonucleotide
ggagcgcgacaattgctccctacacccgccatgat

SEQ ID NO: 52395 - DNA, 35 bp, Artificial Sequence
  Synthetic oligonucleotide
tcctcaccggctccagcagctcgttcccctaatat

SEQ ID NO: 52396 - DNA, 35 bp, Artificial Sequence
  Synthetic oligonucleotide
atgtcgcctactcgtcgtagagccacctcttcgct

SEQ ID NO: 52397 - DNA, 35 bp, Artificial Sequence
  Synthetic oligonucleotide
gacaagaccgttgtggaggaggtgtcggtggaagt

SEQ ID NO: 52398 - DNA, 35 bp, Artificial Sequence
  Synthetic oligonucleotide
tcccgcccacagtccgccaagcaaagagctccagt

SEQ ID NO: 52399 - DNA, 35 bp, Artificial Sequence
  Synthetic oligonucleotide
atccacatagcacgcgggaggatagactgcggagt

SEQ ID NO: 52400 - DNA, 35 bp, Artificial Sequence
  Synthetic oligonucleotide
gaccgcccaacgcctgagcagtcgcgaaaaactgt

SEQ ID NO: 52401 - DNA, 35 bp, Artificial Sequence
  Synthetic oligonucleotide
tattgttgcaggccccagttagtctacactcctgt

SEQ ID NO: 52402 - DNA, 35 bp, Artificial Sequence
  Synthetic oligonucleotide
aagcgcaaactccgtatagccacatgcgctccctt

SEQ ID NO: 52403 - DNA, 35 bp, Artificial Sequence
  Synthetic oligonucleotide
gataacgagaaggacgtgggggtgcggtggttctt

SEQ ID NO: 52404 - DNA, 35 bp, Artificial Sequence
  Synthetic oligonucleotide
gtccaaacgcgggtgccaatacaatccgaactgtt

SEQ ID NO: 52405 - DNA, 35 bp, Artificial Sequence
  Synthetic oligonucleotide
gcctcgtcgtctgcgcggccaaactcacggtcttt

SEQ ID NO: 52406 - DNA, 36 bp, Artificial Sequence
  Synthetic oligonucleotide
gttggtcgcagattctctccgtaaccgttatcgcaa

SEQ ID NO: 52407 - DNA, 36 bp, Artificial Sequence
  Synthetic oligonucleotide
tgttgccatccatgttacgaagtctctatctctgaa

SEQ ID NO: 52408 - DNA, 36 bp, Artificial Sequence
  Synthetic oligonucleotide
catacaccatcgtgagacgtatggaactaaggaaca

SEQ ID NO: 52409 - DNA, 36 bp, Artificial Sequence
  Synthetic oligonucleotide
gaacaccggctaatagagatgaaacttgtcccccca

SEQ ID NO: 52410 - DNA, 36 bp, Artificial Sequence
  Synthetic oligonucleotide
tatcgcacccttacattgatatcgaaacattggcca

SEQ ID NO: 52411 - DNA, 35 bp, Artificial Sequence
  Synthetic oligonucleotide
tgtcgtcgcactctgtacccgcctctttctacgca

SEQ ID NO: 52412 - DNA, 36 bp, Artificial Sequence
  Synthetic oligonucleotide
gatacgttcatcccggcctaagactctccccttgca

SEQ ID NO: 52413 - DNA, 36 bp, Artificial Sequence
  Synthetic oligonucleotide
gtccaaccactttggtaaaaggaaccttataaatca

SEQ ID NO: 52414 - DNA, 36 bp, Artificial Sequence
  Synthetic oligonucleotide
ggaacacctcgggctagacagcacaccccctcctca

SEQ ID NO: 52415 - DNA, 35 bp, Artificial Sequence
  Synthetic oligonucleotide
gtgtcaggcactgacgtctcgtttttaccatttca

SEQ ID NO: 52416 - DNA, 37 bp, Artificial Sequence
  Synthetic oligonucleotide
gagatcatcctctttgtaccctgcctttttctaacga

SEQ ID NO: 52417 - DNA, 37 bp, Artificial Sequence
  Synthetic oligonucleotide
gctcccgcccatccagctcactgtctctcacacacga

SEQ ID NO: 52418 - DNA, 37 bp, Artificial Sequence
  Synthetic oligonucleotide
accgaggaggccatagttgcataggcaacggtgacga

SEQ ID NO: 52419 - DNA, 35 bp, Artificial Sequence
  Synthetic oligonucleotide
gcactgcattgattagaacgccttcacacatacga

SEQ ID NO: 52420 - DNA, 37 bp, Artificial Sequence
  Synthetic oligonucleotide
tagtgcgcaacccccaacttaccaccttgccgttcga

SEQ ID NO: 52421 - DNA, 37 bp, Artificial Sequence
  Synthetic oligonucleotide
accacccactgcaggttttcccgaactgcttaacgga

SEQ ID NO: 52422 - DNA, 37 bp, Artificial Sequence
  Synthetic oligonucleotide
gtagtgtgggaacaagagcggaacggacaagagcgga

SEQ ID NO: 52423 - DNA, 38 bp, Artificial Sequence
  Synthetic oligonucleotide
actgatgcgacttttgcccccattcgtccatcacatga

SEQ ID NO: 52424 - DNA, 37 bp, Artificial Sequence
  Synthetic oligonucleotide
tgcggaatcgcttgtcgactttgccacctgcccctga

SEQ ID NO: 52425 - DNA, 35 bp, Artificial Sequence
  Synthetic oligonucleotide
gtaacacccacgcgcgaaccccatcgtgatgctga

SEQ ID NO: 52426 - DNA, 38 bp, Artificial Sequence
  Synthetic oligonucleotide
gagaggatggggcgtggaagcaggcgcacattctctga

SEQ ID NO: 52427 - DNA, 38 bp, Artificial Sequence
  Synthetic oligonucleotide
tgcctgggaggggtaaagggagggatttctaggagtga

SEQ ID NO: 52428 - DNA, 38 bp, Artificial Sequence
  Synthetic oligonucleotide
gagacaatggcgaggaggttgcgggtacgaatgggtga

SEQ ID NO: 52429 - DNA, 37 bp, Artificial Sequence
  Synthetic oligonucleotide
gaggggaaatgggtggtgtcaaacggtaaggatgtga

SEQ ID NO: 52430 - DNA, 36 bp, Artificial Sequence
  Synthetic oligonucleotide
gttgaccgacacttggcgtgaatgtcccttgcaata

SEQ ID NO: 52431 - DNA, 35 bp, Artificial Sequence
  Synthetic oligonucleotide
accctcctgagtttttagcccgtgcttgtcgccta

SEQ ID NO: 52432 - DNA, 36 bp, Artificial Sequence
  Synthetic oligonucleotide
gacaaccttcgacacgaacaatattgcctgatgcta

SEQ ID NO: 52433 - DNA, 35 bp, Artificial Sequence
  Synthetic oligonucleotide
tccccccccggtctcacaggagttcctatcttcta

SEQ ID NO: 52434 - DNA, 35 bp, Artificial Sequence
  Synthetic oligonucleotide
aaccccgaccccttcactgtcgctggcccccccac

SEQ ID NO: 52435 - DNA, 35 bp, Artificial Sequence
  Synthetic oligonucleotide
gtcgacgcagactttgcattcggcgccctccccac

SEQ ID NO: 52436 - DNA, 35 bp, Artificial Sequence
  Synthetic oligonucleotide
tgatccccaggtcgttctactttctaggttcccac

SEQ ID NO: 52437 - DNA, 35 bp, Artificial Sequence
  Synthetic oligonucleotide
tacgccctccccgacagaagccgctctatattgac

SEQ ID NO: 52438 - DNA, 35 bp, Artificial Sequence
  Synthetic oligonucleotide
gttcaactctacttccgctctccaccgttgtggcc

SEQ ID NO: 52439 - DNA, 35 bp, Artificial Sequence
  Synthetic oligonucleotide
gaagcggtttctctgctcctttccgacgtcactgc

SEQ ID NO: 52440 - DNA, 35 bp, Artificial Sequence
  Synthetic oligonucleotide
tgctcatccgttgaggtgtccctccccgtaccttc

SEQ ID NO: 52441 - DNA, 35 bp, Artificial Sequence
  Synthetic oligonucleotide
tgaatcaattggccctgttcatgcctggatgcttc

SEQ ID NO: 52442 - DNA, 35 bp, Artificial Sequence
  Synthetic oligonucleotide
tctgactgtgccaccttctccataggcaattcttc

SEQ ID NO: 52443 - DNA, 33 bp, Artificial Sequence
  Synthetic oligonucleotide
tcgactcagccccatctctagtccattgctttc

SEQ ID NO: 52444 - DNA, 35 bp, Artificial Sequence
  Synthetic oligonucleotide
gaacctcctttgcatcctgccgtcgatctcgtttc

SEQ ID NO: 52445 - DNA, 35 bp, Artificial Sequence
  Synthetic oligonucleotide
tctgccctccgacacgctcaccctcgcatggaacg

SEQ ID NO: 52446 - DNA, 35 bp, Artificial Sequence
  Synthetic oligonucleotide
atcgaccaaagtaagggaagagagaggtgaatgcg

SEQ ID NO: 52447 - DNA, 35 bp, Artificial Sequence
  Synthetic oligonucleotide
gtagtgccggaggatcttcaggaaaaactttgagg

SEQ ID NO: 52448 - DNA, 35 bp, Artificial Sequence
  Synthetic oligonucleotide
gccccacaaattgcgaactctgcttcatgctgctg

SEQ ID NO: 52449 - DNA, 35 bp, Artificial Sequence
  Synthetic oligonucleotide
aaaccgcaacacctccatcaatttcggagccagtg

SEQ ID NO: 52450 - DNA, 35 bp, Artificial Sequence
  Synthetic oligonucleotide
gcgagcctcggccatcatagtacctctcctctcat

SEQ ID NO: 52451 - DNA, 34 bp, Artificial Sequence
  Synthetic oligonucleotide
gaataaaggggggcatggccatgggggtgcgact

SEQ ID NO: 52452 - DNA, 35 bp, Artificial Sequence
  Synthetic oligonucleotide
tcagacccctgtgacccttcggaagtttgttccct

SEQ ID NO: 52453 - DNA, 35 bp, Artificial Sequence
  Synthetic oligonucleotide
gtggacccgccagctaaattttctttcgattgcct

SEQ ID NO: 52454 - DNA, 35 bp, Artificial Sequence
  Synthetic oligonucleotide
gccccgcgatgcctacgtctcggttccagaatcct

SEQ ID NO: 52455 - DNA, 35 bp, Artificial Sequence
  Synthetic oligonucleotide
gttacccagtccctccgaccacaggccctaaggct

SEQ ID NO: 52456 - DNA, 35 bp, Artificial Sequence
  Synthetic oligonucleotide
accgcccttcctaaattttcgggactacttgatct

SEQ ID NO: 52457 - DNA, 35 bp, Artificial Sequence
  Synthetic oligonucleotide
tcacgacaccgcattattctgcctgcctgtcctct

SEQ ID NO: 52458 - DNA, 35 bp, Artificial Sequence
  Synthetic oligonucleotide
gaccatgcacacaaaattctcgtctatttgaccgt

SEQ ID NO: 52459 - DNA, 35 bp, Artificial Sequence
  Synthetic oligonucleotide
tcagggctgtggccgatctttaccctcccaccggt

SEQ ID NO: 52460 - DNA, 35 bp, Artificial Sequence
  Synthetic oligonucleotide
aatgacgccctggatggccgtttgttactaatttt

SEQ ID NO: 52461 - DNA, 36 bp, Artificial Sequence
  Synthetic oligonucleotide
tcccccgccccattggccattagtagtatttaccaa

SEQ ID NO: 52462 - DNA, 35 bp, Artificial Sequence
  Synthetic oligonucleotide
aaccacccgttcttgcctttccagtgctcgtcgaa

SEQ ID NO: 52463 - DNA, 36 bp, Artificial Sequence
  Synthetic oligonucleotide
gttcacccccagctgctgacctaccgtgctacgtaa

SEQ ID NO: 52464 - DNA, 36 bp, Artificial Sequence
  Synthetic oligonucleotide
gactgccactagccgcccagttcgcttccgcccaca

SEQ ID NO: 52465 - DNA, 36 bp, Artificial Sequence
  Synthetic oligonucleotide
gtgaacgcctcctgcttgccattgaagatcacacca

SEQ ID NO: 52466 - DNA, 36 bp, Artificial Sequence
  Synthetic oligonucleotide
accgcacatggttcttcactgcgcatagacgcacca

SEQ ID NO: 52467 - DNA, 36 bp, Artificial Sequence
  Synthetic oligonucleotide
tcacatggcgataaaataacatccttgtcactgcca

SEQ ID NO: 52468 - DNA, 36 bp, Artificial Sequence
  Synthetic oligonucleotide
agcagttgtcccgtcctgttactccctgcatactca

SEQ ID NO: 52469 - DNA, 36 bp, Artificial Sequence
  Synthetic oligonucleotide
accatcgaatcttgaggtaccgtttcaaccccttca

SEQ ID NO: 52470 - DNA, 37 bp, Artificial Sequence
  Synthetic oligonucleotide
ggagggccgaggatgatcaaccgtcatttgttaaaga

SEQ ID NO: 52471 - DNA, 37 bp, Artificial Sequence
  Synthetic oligonucleotide
tccgaccaggcctcactcttggaactgagcagtgaga

SEQ ID NO: 52472 - DNA, 36 bp, Artificial Sequence
  Synthetic oligonucleotide
tgcaccctctcaaacgcttcatgcaccgtgcatcga

SEQ ID NO: 52473 - DNA, 37 bp, Artificial Sequence
  Synthetic oligonucleotide
tatccctccgctcaattgtccatcagggtttgctcga

SEQ ID NO: 52474 - DNA, 36 bp, Artificial Sequence
  Synthetic oligonucleotide
tccggttgaggattgggtggtaaggcggggggagga

SEQ ID NO: 52475 - DNA, 35 bp, Artificial Sequence
  Synthetic oligonucleotide
gcgacgagagggtgcgagggtgcaagaaatgagga

SEQ ID NO: 52476 - DNA, 37 bp, Artificial Sequence
  Synthetic oligonucleotide
ggtggggaatgagaggatcgcgggcgggttctgggga

SEQ ID NO: 52477 - DNA, 37 bp, Artificial Sequence
  Synthetic oligonucleotide
acgtgtgggggacttgactgtacaggaaggggtggga

SEQ ID NO: 52478 - DNA, 37 bp, Artificial Sequence
  Synthetic oligonucleotide
ttaggacgcggggggaagactgggggtgcggaatgga

SEQ ID NO: 52479 - DNA, 37 bp, Artificial Sequence
  Synthetic oligonucleotide
tgctacgaacttcctcgctttccccgggtcctctgga

SEQ ID NO: 52480 - DNA, 35 bp, Artificial Sequence
  Synthetic oligonucleotide
tccaccggtcacttgtaaggtttctcttcgcatga

SEQ ID NO: 52481 - DNA, 38 bp, Artificial Sequence
  Synthetic oligonucleotide
gaacgcgtacccgatagataatgcccgcccccaactga

SEQ ID NO: 52482 - DNA, 37 bp, Artificial Sequence
  Synthetic oligonucleotide
gtagctgcctgccttctatttgatcagctctccctga

SEQ ID NO: 52483 - DNA, 38 bp, Artificial Sequence
  Synthetic oligonucleotide
gccgctcctccaggatcttacgtgcttgcaccctctga

SEQ ID NO: 52484 - DNA, 38 bp, Artificial Sequence
  Synthetic oligonucleotide
gacgaggattaggggctaagggaaaaggcgtggagtga

SEQ ID NO: 52485 - DNA, 38 bp, Artificial Sequence
  Synthetic oligonucleotide
ttacaaggcagacgagggtaggggtggggggtctgtga

SEQ ID NO: 52486 - DNA, 37 bp, Artificial Sequence
  Synthetic oligonucleotide
atatcgcgcgcccatagcttatttccagttcgattga

SEQ ID NO: 52487 - DNA, 37 bp, Artificial Sequence
  Synthetic oligonucleotide
aacgccacacctcttaatgtgcgcgaaaaccccttga

SEQ ID NO: 52488 - DNA, 38 bp, Artificial Sequence
  Synthetic oligonucleotide
tttgctgcaaacgctccacttgcccgagttcctgttga

SEQ ID NO: 52489 - DNA, 36 bp, Artificial Sequence
  Synthetic oligonucleotide
aaactgcccgacgccatatcaagcgccatgtcctta

SEQ ID NO: 52490 - DNA, 36 bp, Artificial Sequence
  Synthetic oligonucleotide
tcacaccttgtctgtttcctcggggctacaatttta

SEQ ID NO: 52491 - DNA, 35 bp, Artificial Sequence
  Synthetic oligonucleotide
aagcacgtccaacggccaaagctaggcccaaaacc

SEQ ID NO: 52492 - DNA, 35 bp, Artificial Sequence
  Synthetic oligonucleotide
tcaccggcatacgcgaacacttgtaggcatccacc

SEQ ID NO: 52493 - DNA, 35 bp, Artificial Sequence
  Synthetic oligonucleotide
tcagccttacttgttcccgttccaccgcctgcgcc

SEQ ID NO: 52494 - DNA, 35 bp, Artificial Sequence
  Synthetic oligonucleotide
aggtgccgcaaactctcgtggttcttacattatgc

SEQ ID NO: 52495 - DNA, 35 bp, Artificial Sequence
  Synthetic oligonucleotide
gccgacatccatgcctggtcgacattctgcattgc

SEQ ID NO: 52496 - DNA, 35 bp, Artificial Sequence
  Synthetic oligonucleotide
acccactctaatcaatcatgaccgatcttgcaatc

SEQ ID NO: 52497 - DNA, 35 bp, Artificial Sequence
  Synthetic oligonucleotide
gttacgttccaccatgtcaccctatttgcaaagtc

SEQ ID NO: 52498 - DNA, 35 bp, Artificial Sequence
  Synthetic oligonucleotide
attcgctaagccgtcgacccactcttgcctggccg

SEQ ID NO: 52499 - DNA, 35 bp, Artificial Sequence
  Synthetic oligonucleotide
tcaccccccgtctccttccacctttttgtttgccg

SEQ ID NO: 52500 - DNA, 35 bp, Artificial Sequence
  Synthetic oligonucleotide
aggtcgggtgggacggggtgggccttgaatatagg

SEQ ID NO: 52501 - DNA, 35 bp, Artificial Sequence
  Synthetic oligonucleotide
aacatggggcggcggactggtggggaaaggggttg

SEQ ID NO: 52502 - DNA, 35 bp, Artificial Sequence
  Synthetic oligonucleotide
gagcatactgatctgacgctttaacttttttgcct

SEQ ID NO: 52503 - DNA, 34 bp, Artificial Sequence
  Synthetic oligonucleotide
acatgggacccacctgctgcgtcgccccccagct

SEQ ID NO: 52504 - DNA, 35 bp, Artificial Sequence
  Synthetic oligonucleotide
ggtgggtgccgggctgcacaaaaacgtagccttct

SEQ ID NO: 52505 - DNA, 35 bp, Artificial Sequence
  Synthetic oligonucleotide
gtccgtcaacatcgtaccatctgcacacgaccggt

SEQ ID NO: 52506 - DNA, 35 bp, Artificial Sequence
  Synthetic oligonucleotide
acatccctgcccttccgctgagcactgtttcctgt

SEQ ID NO: 52507 - DNA, 35 bp, Artificial Sequence
  Synthetic oligonucleotide
tgactacttcaatcagcgtttactacatcctgcaa

SEQ ID NO: 52508 - DNA, 36 bp, Artificial Sequence
  Synthetic oligonucleotide
gactcccccggccagaactacgcctcatcggactaa

SEQ ID NO: 52509 - DNA, 36 bp, Artificial Sequence
  Synthetic oligonucleotide
gaacacctcgttgcggtcacacggtcgcctcccaca

SEQ ID NO: 52510 - DNA, 35 bp, Artificial Sequence
  Synthetic oligonucleotide
tgcaccgggtgccgtcttcccaatttattcccaca

SEQ ID NO: 52511 - DNA, 36 bp, Artificial Sequence
  Synthetic oligonucleotide
tttactgtggcccaccccgcccggcctgcttaacca

SEQ ID NO: 52512 - DNA, 36 bp, Artificial Sequence
  Synthetic oligonucleotide
tcaggttggagtgccgcgcatatcgaccattttcca

SEQ ID NO: 52513 - DNA, 36 bp, Artificial Sequence
  Synthetic oligonucleotide
agcctccccttcactatagacgtagcgccccctgca

SEQ ID NO: 52514 - DNA, 36 bp, Artificial Sequence
  Synthetic oligonucleotide
ttgacgccgaatgcgctcgctgggactttagctgca

SEQ ID NO: 52515 - DNA, 36 bp, Artificial Sequence
  Synthetic oligonucleotide
gatgctcgctggagcttaccgacccactttaccaga

SEQ ID NO: 52516 - DNA, 37 bp, Artificial Sequence
  Synthetic oligonucleotide
gccatcgctccaaccgcacggctccacttatccgaga

SEQ ID NO: 52517 - DNA, 37 bp, Artificial Sequence
  Synthetic oligonucleotide
aactgaggaggatgtggcgcgggtggggtggaggaga

SEQ ID NO: 52518 - DNA, 37 bp, Artificial Sequence
  Synthetic oligonucleotide
gcccatgccctagccctcccctttcattccaggacga

SEQ ID NO: 52519 - DNA, 36 bp, Artificial Sequence
  Synthetic oligonucleotide
gtcaacgcttagtacatcctccgcgacactcatcga

SEQ ID NO: 52520 - DNA, 36 bp, Artificial Sequence
  Synthetic oligonucleotide
gaacacgtacttcgcccttggatggttaccccagga

SEQ ID NO: 52521 - DNA, 36 bp, Artificial Sequence
  Synthetic oligonucleotide
tagggctcgggggccgggtagagcagggaaatagga

SEQ ID NO: 52522 - DNA, 37 bp, Artificial Sequence
  Synthetic oligonucleotide
taccccgcatccgcgcacccagtccgtcgcccaggga

SEQ ID NO: 52523 - DNA, 37 bp, Artificial Sequence
  Synthetic oligonucleotide
gcacgccaccatcccattcatcgcaccttatccggga

SEQ ID NO: 52524 - DNA, 37 bp, Artificial Sequence
  Synthetic oligonucleotide
acaccacctgttacttctgacgtcattatgctcggga

SEQ ID NO: 52525 - DNA, 37 bp, Artificial Sequence
  Synthetic oligonucleotide
aggaggggctagactggggacggaggggagcagtgga

SEQ ID NO: 52526 - DNA, 37 bp, Artificial Sequence
  Synthetic oligonucleotide
gtccgtgggggggttggtggggtgagtgagatgtgga

SEQ ID NO: 52527 - DNA, 37 bp, Artificial Sequence
  Synthetic oligonucleotide
tgcggtaccacactccggtcccggttactctcttgga

SEQ ID NO: 52528 - DNA, 37 bp, Artificial Sequence
  Synthetic oligonucleotide
tcatccctccgagtatatgcgtacctccagcctatga

SEQ ID NO: 52529 - DNA, 38 bp, Artificial Sequence
  Synthetic oligonucleotide
acatactgcgcaccaacccaggcgtaaaaccgtactga

SEQ ID NO: 52530 - DNA, 38 bp, Artificial Sequence
  Synthetic oligonucleotide
tctgacctgggtagaacgaaagaatagggaaggggtga

SEQ ID NO: 52531 - DNA, 37 bp, Artificial Sequence
  Synthetic oligonucleotide
tagacaactcaaccagcccgcgatagccctcacttga

SEQ ID NO: 52532 - DNA, 38 bp, Artificial Sequence
  Synthetic oligonucleotide
gacactcgtgcctgtttcctctctgcactctaatttga

SEQ ID NO: 52533 - DNA, 35 bp, Artificial Sequence
  Synthetic oligonucleotide
gaaccacccccacgccaaaaggttagcttagcata

SEQ ID NO: 52534 - DNA, 36 bp, Artificial Sequence
  Synthetic oligonucleotide
acctgcacccaaacgccatgccactactgccttata

SEQ ID NO: 52535 - DNA, 36 bp, Artificial Sequence
  Synthetic oligonucleotide
gactcccacggtcaatgggctcactgtcactgctta

SEQ ID NO: 52536 - DNA, 35 bp, Artificial Sequence
  Synthetic oligonucleotide
agatcccccggcgaactgcaactctcttctgctta

SEQ ID NO: 52537 - DNA, 35 bp, Artificial Sequence
  Synthetic oligonucleotide
tcttcccagccactcgcttgcacgaaacttgtaac

SEQ ID NO: 52538 - DNA, 35 bp, Artificial Sequence
  Synthetic oligonucleotide
tccctagtccggtctctgtacgacgcgcgcaccac

SEQ ID NO: 52539 - DNA, 35 bp, Artificial Sequence
  Synthetic oligonucleotide
gcgatcatccccgcataaactagagtgcgcctcac

SEQ ID NO: 52540 - DNA, 35 bp, Artificial Sequence
  Synthetic oligonucleotide
agtccccctgctattccgcacacagcccggttcac

SEQ ID NO: 52541 - DNA, 35 bp, Artificial Sequence
  Synthetic oligonucleotide
tacctcgctcccgtgcccagttcccatgactatac

SEQ ID NO: 52542 - DNA, 35 bp, Artificial Sequence
  Synthetic oligonucleotide
gatactctcaaggtacatggccaccaatgctttac

SEQ ID NO: 52543 - DNA, 35 bp, Artificial Sequence
  Synthetic oligonucleotide
tgctcctcatgttaacgaaccttttgccttctacc

SEQ ID NO: 52544 - DNA, 35 bp, Artificial Sequence
  Synthetic oligonucleotide
tgatcgctctttcgtcgaacgactgcatctacccc

SEQ ID NO: 52545 - DNA, 35 bp, Artificial Sequence
  Synthetic oligonucleotide
aacccgccgtgagcctcttatggctaatgttagcc

SEQ ID NO: 52546 - DNA, 35 bp, Artificial Sequence
  Synthetic oligonucleotide
tccccacttgattagcattgcattagtatttccgc

SEQ ID NO: 52547 - DNA, 35 bp, Artificial Sequence
  Synthetic oligonucleotide
gacacttggcaagcgggtgcctatctcttctcgtc

SEQ ID NO: 52548 - DNA, 35 bp, Artificial Sequence
  Synthetic oligonucleotide
ttcggttccctcggtggacattttgctttcccttc

SEQ ID NO: 52549 - DNA, 35 bp, Artificial Sequence
  Synthetic oligonucleotide
tcgccaaactgttcgccttgctctgcccatactag

SEQ ID NO: 52550 - DNA, 35 bp, Artificial Sequence
  Synthetic oligonucleotide
gagaccggttgtgccccacgcgcctcctccaattg

SEQ ID NO: 52551 - DNA, 35 bp, Artificial Sequence
  Synthetic oligonucleotide
tacgatcgagggggagttatggtgggccttttttg

SEQ ID NO: 52552 - DNA, 35 bp, Artificial Sequence
  Synthetic oligonucleotide
tgtttagaccctgccccccgccattcacatgtaat

SEQ ID NO: 52553 - DNA, 35 bp, Artificial Sequence
  Synthetic oligonucleotide
gtctacacgacattccgaccaggatacccacccat

SEQ ID NO: 52554 - DNA, 35 bp, Artificial Sequence
  Synthetic oligonucleotide
acacgccactttttctaaggcggtatatttcctat

SEQ ID NO: 52555 - DNA, 35 bp, Artificial Sequence
  Synthetic oligonucleotide
gatcccctctgctccgacgctggacgttgggcact

SEQ ID NO: 52556 - DNA, 35 bp, Artificial Sequence
  Synthetic oligonucleotide
aactaacgggcgaccatgttttgcattttttccct

SEQ ID NO: 52557 - DNA, 35 bp, Artificial Sequence
  Synthetic oligonucleotide
aactccgccaaggtttacgcatgaccactcttcct

SEQ ID NO: 52558 - DNA, 35 bp, Artificial Sequence
  Synthetic oligonucleotide
atcccccaggacacctgttacacatgacatgtagt

SEQ ID NO: 52559 - DNA, 35 bp, Artificial Sequence
  Synthetic oligonucleotide
tgtgaaaccgtgggagtgcgctaatcccaggtatt

SEQ ID NO: 52560 - DNA, 35 bp, Artificial Sequence
  Synthetic oligonucleotide
tcctttcgccaacaccctgcatttcccaagacctt

SEQ ID NO: 52561 - DNA, 35 bp, Artificial Sequence
  Synthetic oligonucleotide
acacgtaccccagccctcgcatgcctaggggcctt

SEQ ID NO: 52562 - DNA, 34 bp, Artificial Sequence
  Synthetic oligonucleotide
tcaggcggatgtgtatgtcgttcccgtgtctgtt

SEQ ID NO: 52563 - DNA, 35 bp, Artificial Sequence
  Synthetic oligonucleotide
ggtgtaccgccagtctgcactcaacgctccgattt

SEQ ID NO: 52564 - DNA, 35 bp, Artificial Sequence
  Synthetic oligonucleotide
tctgccttcggttccgtgcaatccgcgcttgcttt

SEQ ID NO: 52565 - DNA, 36 bp, Artificial Sequence
  Synthetic oligonucleotide
tccgaagcgcctgttatcccgcgcaccacttgtaaa

SEQ ID NO: 52566 - DNA, 36 bp, Artificial Sequence
  Synthetic oligonucleotide
gccctggccctgatactctttgatgtccacccgtaa

SEQ ID NO: 52567 - DNA, 36 bp, Artificial Sequence
  Synthetic oligonucleotide
accgccatgctttcctcggagaaacctgacccccca

SEQ ID NO: 52568 - DNA, 36 bp, Artificial Sequence
  Synthetic oligonucleotide
aatgactgagctgtgccagtcttgagccttctccca

SEQ ID NO: 52569 - DNA, 35 bp, Artificial Sequence
  Synthetic oligonucleotide
gacaaccatgattactcttaacctcccaggtcgca

SEQ ID NO: 52570 - DNA, 36 bp, Artificial Sequence
  Synthetic oligonucleotide
gctttgtccgtccgtcctttcgttagcgttgttgca

SEQ ID NO: 52571 - DNA, 36 bp, Artificial Sequence
  Synthetic oligonucleotide
gaccatgcccaactgtccgcatactgactcgcctca

SEQ ID NO: 52572 - DNA, 36 bp, Artificial Sequence
  Synthetic oligonucleotide
gttactgccacgccgtattttgtctccttgttctca

SEQ ID NO: 52573 - DNA, 36 bp, Artificial Sequence
  Synthetic oligonucleotide
gtaggtccgaggagggggtaaattaagggaaggtca

SEQ ID NO: 52574 - DNA, 35 bp, Artificial Sequence
  Synthetic oligonucleotide
tcgtgctccctatgccgtggtttacacctacttca

SEQ ID NO: 52575 - DNA, 37 bp, Artificial Sequence
  Synthetic oligonucleotide
tgtatgcggatgggttgggctgctagggtgggacaga

SEQ ID NO: 52576 - DNA, 37 bp, Artificial Sequence
  Synthetic oligonucleotide
tgcactgtctgcaggttccaatgtttcgccccctaga

SEQ ID NO: 52577 - DNA, 36 bp, Artificial Sequence
  Synthetic oligonucleotide
gaagtggacacggtgatccgagggggaggtggtaga

SEQ ID NO: 52578 - DNA, 37 bp, Artificial Sequence
  Synthetic oligonucleotide
atgacaccatgggccactttacatttcaacctgtaga

SEQ ID NO: 52579 - DNA, 37 bp, Artificial Sequence
  Synthetic oligonucleotide
tcgccaatacgtaatacctgggcgctcccccccacga

SEQ ID NO: 52580 - DNA, 35 bp, Artificial Sequence
  Synthetic oligonucleotide
atgaccgtaggtcgttgcccccggtatttaaccga

SEQ ID NO: 52581 - DNA, 37 bp, Artificial Sequence
  Synthetic oligonucleotide
gcaaccgacagagattatcgcactcacgaaaccccga

SEQ ID NO: 52582 - DNA, 37 bp, Artificial Sequence
  Synthetic oligonucleotide
taccgaacaagtcccatctgtagcgcacccctgccga

SEQ ID NO: 52583 - DNA, 37 bp, Artificial Sequence
  Synthetic oligonucleotide
ggataccagcccagcacccgcattgcaactctgccga

SEQ ID NO: 52584 - DNA, 37 bp, Artificial Sequence
  Synthetic oligonucleotide
tcacagcctgtgctcagcaatcgccgcccctattcga

SEQ ID NO: 52585 - DNA, 38 bp, Artificial Sequence
  Synthetic oligonucleotide
gcaaaagtggggtagggaaatccgggggggagtaagga

SEQ ID NO: 52586 - DNA, 38 bp, Artificial Sequence
  Synthetic oligonucleotide
gtagcccggactatgcctgaaataccagcaccacatga

SEQ ID NO: 52587 - DNA, 37 bp, Artificial Sequence
  Synthetic oligonucleotide
agtgggaggtgtcaaacgggagaatgggcggggatga

SEQ ID NO: 52588 - DNA, 38 bp, Artificial Sequence
  Synthetic oligonucleotide
gttgcggatcactgacccccctattgcgtgcccactga

SEQ ID NO: 52589 - DNA, 38 bp, Artificial Sequence
  Synthetic oligonucleotide
gcaacacggactgcctaccgcagacgcagaccacctga

SEQ ID NO: 52590 - DNA, 38 bp, Artificial Sequence
  Synthetic oligonucleotide
acctattgcgcgaggtgcggcgcgacccttttccctga

SEQ ID NO: 52591 - DNA, 38 bp, Artificial Sequence
  Synthetic oligonucleotide
gcgatgttggggaaggggcgtgatggaactgtggctga

SEQ ID NO: 52592 - DNA, 37 bp, Artificial Sequence
  Synthetic oligonucleotide
gcaacaacatttgccatcactaccctgcttccggtga

SEQ ID NO: 52593 - DNA, 38 bp, Artificial Sequence
  Synthetic oligonucleotide
gcagtaggggacaagtaaggacttaaggaggattgtga

SEQ ID NO: 52594 - DNA, 38 bp, Artificial Sequence
  Synthetic oligonucleotide
tatgcgccacatactttgcttaggccacttgtgattga

SEQ ID NO: 52595 - DNA, 38 bp, Artificial Sequence
  Synthetic oligonucleotide
ttgcccgccctgttttgtcacgttaaccgttctattga

SEQ ID NO: 52596 - DNA, 38 bp, Artificial Sequence
  Synthetic oligonucleotide
gaactacacccaccgacaatttgcttcagtccggttga

SEQ ID NO: 52597 - DNA, 38 bp, Artificial Sequence
  Synthetic oligonucleotide
ttgcggagagaattggggttcacgggaaggcgggttga

SEQ ID NO: 52598 - DNA, 36 bp, Artificial Sequence
  Synthetic oligonucleotide
tatcacactcccaatgcacccttaagtcatctttga

SEQ ID NO: 52599 - DNA, 38 bp, Artificial Sequence
  Synthetic oligonucleotide
gatcccggcctccactgataaggtcctccctcttttga

SEQ ID NO: 52600 - DNA, 35 bp, Artificial Sequence
  Synthetic oligonucleotide
tcagagcaagcttgccatcgaataactttttgcta

SEQ ID NO: 52601 - DNA, 36 bp, Artificial Sequence
  Synthetic oligonucleotide
gagccaacgttcgtattttcgtacacccaccctcta

SEQ ID NO: 52602 - DNA, 35 bp, Artificial Sequence
  Synthetic oligonucleotide
gctagtgtagagggggcttagggcgcggtgaagta

SEQ ID NO: 52603 - DNA, 35 bp, Artificial Sequence
  Synthetic oligonucleotide
atgtccagaaactgcccgttcgacgcttcaacgta

SEQ ID NO: 52604 - DNA, 35 bp, Artificial Sequence
  Synthetic oligonucleotide
aaagtggatgggaacgggaaaaacatttgcaggta

SEQ ID NO: 52605 - DNA, 35 bp, Artificial Sequence
  Synthetic oligonucleotide
tcgttccgcctccatcaacgcaactccttcgggta

SEQ ID NO: 52606 - DNA, 36 bp, Artificial Sequence
  Synthetic oligonucleotide
cacgtgtcacgtccacccctccgcctgttttactta

SEQ ID NO: 52607 - DNA, 36 bp, Artificial Sequence
  Synthetic oligonucleotide
tcataacgcacgagggaatcgaggagttgacagtta

SEQ ID NO: 52608 - DNA, 36 bp, Artificial Sequence
  Synthetic oligonucleotide
tagcacactttccagtttctgctccaccgtacgtta

SEQ ID NO: 52609 - DNA, 35 bp, Artificial Sequence
  Synthetic oligonucleotide
gtgcttacagccacacgagattctgcctgtctaac

SEQ ID NO: 52610 - DNA, 35 bp, Artificial Sequence
  Synthetic oligonucleotide
gcacatgctctataccacttggttcgttcctgacc

SEQ ID NO: 52611 - DNA, 35 bp, Artificial Sequence
  Synthetic oligonucleotide
gcacccgggaaggcatcctggcgctctcacatacc

SEQ ID NO: 52612 - DNA, 35 bp, Artificial Sequence
  Synthetic oligonucleotide
tgccgcgagtgatattttctcgcgcccccacaccc

SEQ ID NO: 52613 - DNA, 35 bp, Artificial Sequence
  Synthetic oligonucleotide
gtaatccatcatccgaattgcagtatcgccacccc

SEQ ID NO: 52614 - DNA, 35 bp, Artificial Sequence
  Synthetic oligonucleotide
gttgccctagccccctgcttgatttctacatatcc

SEQ ID NO: 52615 - DNA, 35 bp, Artificial Sequence
  Synthetic oligonucleotide
tacttccccatggcccgctaattccgacgtccagc

SEQ ID NO: 52616 - DNA, 35 bp, Artificial Sequence
  Synthetic oligonucleotide
tccacctggtacgccaccctattggcctttatatc

SEQ ID NO: 52617 - DNA, 35 bp, Artificial Sequence
  Synthetic oligonucleotide
gcgtgtagtcgcccggcgttttttaagcctatctc

SEQ ID NO: 52618 - DNA, 35 bp, Artificial Sequence
  Synthetic oligonucleotide
ggacaccgggaaccaactcgcaccccttaactgtc

SEQ ID NO: 52619 - DNA, 35 bp, Artificial Sequence
  Synthetic oligonucleotide
aactacgcacggacgctaaaaagagcgtgtgcttc

SEQ ID NO: 52620 - DNA, 34 bp, Artificial Sequence
  Synthetic oligonucleotide
acaggacatcaccacctccgcatgcgccgagtcg

SEQ ID NO: 52621 - DNA, 35 bp, Artificial Sequence
  Synthetic oligonucleotide
tggaacctacactcccaacgttgcaaccttatagg

SEQ ID NO: 52622 - DNA, 35 bp, Artificial Sequence
  Synthetic oligonucleotide
tagccatgcgctcttaccggttttcttctctcatg

SEQ ID NO: 52623 - DNA, 36 bp, Artificial Sequence
  Synthetic oligonucleotide
atgccctgcctgacttcacggaacgatcatttcatg

SEQ ID NO: 52624 - DNA, 35 bp, Artificial Sequence
  Synthetic oligonucleotide
gagcgcactatcttatgtcctgtcccccgttggtg

SEQ ID NO: 52625 - DNA, 35 bp, Artificial Sequence
  Synthetic oligonucleotide
gcgatacgcctcggtttttttagcctcacgccaat

SEQ ID NO: 52626 - DNA, 35 bp, Artificial Sequence
  Synthetic oligonucleotide
aaccgcattgtagtaccgtgcaacctcttggccct

SEQ ID NO: 52627 - DNA, 35 bp, Artificial Sequence
  Synthetic oligonucleotide
agtcgtcccgccggtaattttccttcatagtggct

SEQ ID NO: 52628 - DNA, 35 bp, Artificial Sequence
  Synthetic oligonucleotide
tgaatcgttagcacccacagcgcggccctttcctt

SEQ ID NO: 52629 - DNA, 35 bp, Artificial Sequence
  Synthetic oligonucleotide
taccatgctgtattcacctttcttgcataccgaaa

SEQ ID NO: 52630 - DNA, 36 bp, Artificial Sequence
  Synthetic oligonucleotide
gattagtgggagggggtggtgctacgatcgaggaaa

SEQ ID NO: 52631 - DNA, 35 bp, Artificial Sequence
  Synthetic oligonucleotide
actgggggggagcgtaggcaggactgaaaggtaaa

SEQ ID NO: 52632 - DNA, 35 bp, Artificial Sequence
  Synthetic oligonucleotide
aagcgttgcgccttagtctatctgttcctcaccaa

SEQ ID NO: 52633 - DNA, 35 bp, Artificial Sequence
  Synthetic oligonucleotide
tcagcccgcccgacacgccaggtagaggacccgaa

SEQ ID NO: 52634 - DNA, 36 bp, Artificial Sequence
  Synthetic oligonucleotide
gcgttgaccgtctggtacaactgtcatgtcccccca

SEQ ID NO: 52635 - DNA, 36 bp, Artificial Sequence
  Synthetic oligonucleotide
gtacccatcgcccaacaccaaacaattgcgggagca

SEQ ID NO: 52636 - DNA, 35 bp, Artificial Sequence
  Synthetic oligonucleotide
accgtcaaccggccagtccccagtccttcatgtca

SEQ ID NO: 52637 - DNA, 35 bp, Artificial Sequence
  Synthetic oligonucleotide
tacgagcaaagggggcacaaaggcaggaactgtca

SEQ ID NO: 52638 - DNA, 37 bp, Artificial Sequence
  Synthetic oligonucleotide
gacgggggaaatagtaggtaaaatgagggtgtgaaga

SEQ ID NO: 52639 - DNA, 37 bp, Artificial Sequence
  Synthetic oligonucleotide
gcctccgacagaaaaatttccgccaactcgttcccga

SEQ ID NO: 52640 - DNA, 37 bp, Artificial Sequence
  Synthetic oligonucleotide
acacgcctccctcactaaatggactatgggattccga

SEQ ID NO: 52641 - DNA, 38 bp, Artificial Sequence
  Synthetic oligonucleotide
gaccccccgccccaagcattgttacgtctggagaatga

SEQ ID NO: 52642 - DNA, 38 bp, Artificial Sequence
  Synthetic oligonucleotide
accgggccagtctgttcctatgattcttttccccatga

SEQ ID NO: 52643 - DNA, 37 bp, Artificial Sequence
  Synthetic oligonucleotide
tgcactgcactactataccgcgtatgcttacacctga

SEQ ID NO: 52644 - DNA, 38 bp, Artificial Sequence
  Synthetic oligonucleotide
gcgctcttcgtagctgattaccgttccatccgatctga

SEQ ID NO: 52645 - DNA, 38 bp, Artificial Sequence
  Synthetic oligonucleotide
tgctgagcctcgctgtagccccttacatttaaccgtga

SEQ ID NO: 52646 - DNA, 38 bp, Artificial Sequence
  Synthetic oligonucleotide
agcagaccggccgcctgtgctacctttctttaccttga

SEQ ID NO: 52647 - DNA, 38 bp, Artificial Sequence
  Synthetic oligonucleotide
aaccccaacattcgagtgtacactgttcatcgatttga

SEQ ID NO: 52648 - DNA, 38 bp, Artificial Sequence
  Synthetic oligonucleotide
gatacgcctcatcttccgacctaacagactacgtttga

SEQ ID NO: 52649 - DNA, 35 bp, Artificial Sequence
  Synthetic oligonucleotide
aaacagggaaaggtgggcagggaagtcgcgtcata

SEQ ID NO: 52650 - DNA, 36 bp, Artificial Sequence
  Synthetic oligonucleotide
atctcacagtgttagatcttcacgccgtaacaccta

SEQ ID NO: 52651 - DNA, 35 bp, Artificial Sequence
  Synthetic oligonucleotide
actcgcccccctcttatagttattcttactgagta

SEQ ID NO: 52652 - DNA, 36 bp, Artificial Sequence
  Synthetic oligonucleotide
actccgcgcatgcgagtgcttcctctctgctccgta

SEQ ID NO: 52653 - DNA, 36 bp, Artificial Sequence
  Synthetic oligonucleotide
agccaccacttggaaagtgtccctactttggcctta

SEQ ID NO: 52654 - DNA, 36 bp, Artificial Sequence
  Synthetic oligonucleotide
taccagacgacaccacatatttggccatggctctta

SEQ ID NO: 52655 - DNA, 36 bp, Artificial Sequence
  Synthetic oligonucleotide
acgcccatgcccgtcgttcaaagctggtcaccgtta

SEQ ID NO: 52656 - DNA, 35 bp, Artificial Sequence
  Synthetic oligonucleotide
gccatgacccggtctaattaattagagcccccaac

SEQ ID NO: 52657 - DNA, 35 bp, Artificial Sequence
  Synthetic oligonucleotide
aagaacgtaggggcaggtgaggtcagtgatgggac

SEQ ID NO: 52658 - DNA, 35 bp, Artificial Sequence
  Synthetic oligonucleotide
tgcaggctccactcaggactaacgcgcctatctac

SEQ ID NO: 52659 - DNA, 35 bp, Artificial Sequence
  Synthetic oligonucleotide
gtcccgtgaggttctcccacgtccactgtttcacc

SEQ ID NO: 52660 - DNA, 35 bp, Artificial Sequence
  Synthetic oligonucleotide
agttgctcaggccaccctgtttcacctcgtcaccc

SEQ ID NO: 52661 - DNA, 35 bp, Artificial Sequence
  Synthetic oligonucleotide
gtgaccaacgacgcttggctgcgaccatactgccc

SEQ ID NO: 52662 - DNA, 35 bp, Artificial Sequence
  Synthetic oligonucleotide
gcgcaaccgtgattgccctgaattttactgtcgcc

SEQ ID NO: 52663 - DNA, 35 bp, Artificial Sequence
  Synthetic oligonucleotide
gctatcagcccccatgactctgctgcaacccgtcc

SEQ ID NO: 52664 - DNA, 35 bp, Artificial Sequence
  Synthetic oligonucleotide
gaggtccggttcgcgcatcggtacctttgtaactc

SEQ ID NO: 52665 - DNA, 35 bp, Artificial Sequence
  Synthetic oligonucleotide
acgcgaggcccgagtgtataccgtttgcatatgtc

SEQ ID NO: 52666 - DNA, 35 bp, Artificial Sequence
  Synthetic oligonucleotide
tcaaggcatggaccgctactgcaacctcaccttcg

SEQ ID NO: 52667 - DNA, 35 bp, Artificial Sequence
  Synthetic oligonucleotide
gtggtgggatggaaagtgggaggcgacgacatgtg

SEQ ID NO: 52668 - DNA, 35 bp, Artificial Sequence
  Synthetic oligonucleotide
gacgttgccaggttcccctgattgttccgttccat

SEQ ID NO: 52669 - DNA, 35 bp, Artificial Sequence
  Synthetic oligonucleotide
gacaactcaacggacctggctcccgtgttttacct

SEQ ID NO: 52670 - DNA, 35 bp, Artificial Sequence
  Synthetic oligonucleotide
acagcacgtgcttaaattgtccgccccagtgcagt

SEQ ID NO: 52671 - DNA, 35 bp, Artificial Sequence
  Synthetic oligonucleotide
tgacttgctagggtacgttcactgcctccacctgt

SEQ ID NO: 52672 - DNA, 35 bp, Artificial Sequence
  Synthetic oligonucleotide
gagagggtggacacggacatgcgggggggggtctt

SEQ ID NO: 52673 - DNA, 35 bp, Artificial Sequence
  Synthetic oligonucleotide
gacgacgatgcggtgccgcactctcagcccttaaa

SEQ ID NO: 52674 - DNA, 36 bp, Artificial Sequence
  Synthetic oligonucleotide
atggcggagcgattcggccggcgcaccacctctcaa

SEQ ID NO: 52675 - DNA, 36 bp, Artificial Sequence
  Synthetic oligonucleotide
aacgaagggagggtgggtgcgatacggagctcataa

SEQ ID NO: 52676 - DNA, 36 bp, Artificial Sequence
  Synthetic oligonucleotide
ggtacaacgctgcgttgttaactgcccttgtactaa

SEQ ID NO: 52677 - DNA, 36 bp, Artificial Sequence
  Synthetic oligonucleotide
taagggcccagcgcaactctatcttagctcatacca

SEQ ID NO: 52678 - DNA, 36 bp, Artificial Sequence
  Synthetic oligonucleotide
tctatgcgatgctggcttaggctcctcttcctccca

SEQ ID NO: 52679 - DNA, 36 bp, Artificial Sequence
  Synthetic oligonucleotide
tgcccattccaccacattaagtaacctgctatgcca

SEQ ID NO: 52680 - DNA, 36 bp, Artificial Sequence
  Synthetic oligonucleotide
tatgtgcgcctcatccccccatgttgcccctaggca

SEQ ID NO: 52681 - DNA, 36 bp, Artificial Sequence
  Synthetic oligonucleotide
atcgacacgcaacatccacctggatcaacgcatgca

SEQ ID NO: 52682 - DNA, 35 bp, Artificial Sequence
  Synthetic oligonucleotide
gggaacgtcactcgaccggcttcgcaccaactgca

SEQ ID NO: 52683 - DNA, 36 bp, Artificial Sequence
  Synthetic oligonucleotide
gttgctgcactggcccgagtagcttattatccatca

SEQ ID NO: 52684 - DNA, 36 bp, Artificial Sequence
  Synthetic oligonucleotide
gtgcccgtactgaaaacttctccacgcctgtactca

SEQ ID NO: 52685 - DNA, 37 bp, Artificial Sequence
  Synthetic oligonucleotide
tctgcctggactattgcccacccgtgagtcttcacga

SEQ ID NO: 52686 - DNA, 37 bp, Artificial Sequence
  Synthetic oligonucleotide
gtacgagcccgcccacctccgtccaatgcccatacga

SEQ ID NO: 52687 - DNA, 36 bp, Artificial Sequence
  Synthetic oligonucleotide
gcccaaggtcccgttaggattctcccattttgccga

SEQ ID NO: 52688 - DNA, 36 bp, Artificial Sequence
  Synthetic oligonucleotide
gtgccgcccccccctgctttgcctgtcactttgcga

SEQ ID NO: 52689 - DNA, 36 bp, Artificial Sequence
  Synthetic oligonucleotide
aacccgcgttccccgtatgcgtttgctattcttcga

SEQ ID NO: 52690 - DNA, 37 bp, Artificial Sequence
  Synthetic oligonucleotide
gacgaagagtggataggccggtgaggggtaaatagga

SEQ ID NO: 52691 - DNA, 37 bp, Artificial Sequence
  Synthetic oligonucleotide
tcccccccacgaaacagctccagatccccccgatgga

SEQ ID NO: 52692 - DNA, 36 bp, Artificial Sequence
  Synthetic oligonucleotide
gaggagagggtggagggagacttacttcaggctgga

SEQ ID NO: 52693 - DNA, 38 bp, Artificial Sequence
  Synthetic oligonucleotide
tgcccaatccgcctcggaagtgtacccaccccaactga

SEQ ID NO: 52694 - DNA, 38 bp, Artificial Sequence
  Synthetic oligonucleotide
taacacgtcttaccctatagctctgactcgccccctga

SEQ ID NO: 52695 - DNA, 38 bp, Artificial Sequence
  Synthetic oligonucleotide
attcgccatccttccgtgtaaagcccgctctcccctga

SEQ ID NO: 52696 - DNA, 38 bp, Artificial Sequence
  Synthetic oligonucleotide
tcaacctgacttgtgcttactgtttatcctccgtctga

SEQ ID NO: 52697 - DNA, 37 bp, Artificial Sequence
  Synthetic oligonucleotide
gcgcacggtcgtgggcggaaggggttgagggtagtga

SEQ ID NO: 52698 - DNA, 38 bp, Artificial Sequence
  Synthetic oligonucleotide
gtcgcctcctaggctgtacactaacatcaaccccgtga

SEQ ID NO: 52699 - DNA, 38 bp, Artificial Sequence
  Synthetic oligonucleotide
agagtgaaggacggagaggctgggtttggtggaggtga

SEQ ID NO: 52700 - DNA, 37 bp, Artificial Sequence
  Synthetic oligonucleotide
tccggacggaaggtaggggctcgggtaaggacggtga

SEQ ID NO: 52701 - DNA, 37 bp, Artificial Sequence
  Synthetic oligonucleotide
atgcgatggtaagtaggacgagtgggggcgcgggtga

SEQ ID NO: 52702 - DNA, 38 bp, Artificial Sequence
  Synthetic oligonucleotide
tccaaccgttccagacgtctatcttgccggcacattga

SEQ ID NO: 52703 - DNA, 38 bp, Artificial Sequence
  Synthetic oligonucleotide
gcgtaagcacgcggggtctttggggatcgagtgattga

SEQ ID NO: 52704 - DNA, 36 bp, Artificial Sequence
  Synthetic oligonucleotide
tttcagctcaggcgaaccgttggcctctatccttga

SEQ ID NO: 52705 - DNA, 35 bp, Artificial Sequence
  Synthetic oligonucleotide
atcggatctcagctcgaatctccatccttcgttga

SEQ ID NO: 52706 - DNA, 36 bp, Artificial Sequence
  Synthetic oligonucleotide
gggtacctctgacgcgctacgccttttcccccgata

SEQ ID NO: 52707 - DNA, 36 bp, Artificial Sequence
  Synthetic oligonucleotide
gaacacaccacgcttcaagtcccattattgtaccta

SEQ ID NO: 52708 - DNA, 35 bp, Artificial Sequence
  Synthetic oligonucleotide
gacccgcgatcgaattcgtccaatgcactcacgta

SEQ ID NO: 52709 - DNA, 36 bp, Artificial Sequence
  Synthetic oligonucleotide
tcgcgtcgcactcaccatgcatgttgcccagcctta

SEQ ID NO: 52710 - DNA, 35 bp, Artificial Sequence
  Synthetic oligonucleotide
acactatggccccactcttgagctagctccccaac

SEQ ID NO: 52711 - DNA, 35 bp, Artificial Sequence
  Synthetic oligonucleotide
gacgtggcaagtcaacgcttgaaataatcacccac

SEQ ID NO: 52712 - DNA, 35 bp, Artificial Sequence
  Synthetic oligonucleotide
gcccacctttgatcgcgaatggctacagcgagcac

SEQ ID NO: 52713 - DNA, 35 bp, Artificial Sequence
  Synthetic oligonucleotide
acagcaaacatccacgagtctctcacacgcttgac

SEQ ID NO: 52714 - DNA, 35 bp, Artificial Sequence
  Synthetic oligonucleotide
accgacatggcatacctagacccacgccgtgaacc

SEQ ID NO: 52715 - DNA, 35 bp, Artificial Sequence
  Synthetic oligonucleotide
tgtgcactgcactccgcatcacgcactaactgacc

SEQ ID NO: 52716 - DNA, 35 bp, Artificial Sequence
  Synthetic oligonucleotide
gctgtagtcggtcgtctccgaaatccgcgcatacc

SEQ ID NO: 52717 - DNA, 35 bp, Artificial Sequence
  Synthetic oligonucleotide
atcatcaggaccggatatatgccacctcacccgcc

SEQ ID NO: 52718 - DNA, 35 bp, Artificial Sequence
  Synthetic oligonucleotide
ggatctggtacagcctttattgtccttggtcgtcc

SEQ ID NO: 52719 - DNA, 33 bp, Artificial Sequence
  Synthetic oligonucleotide
gaggtagtcagcgctcacctttcttccccttcc

SEQ ID NO: 52720 - DNA, 35 bp, Artificial Sequence
  Synthetic oligonucleotide
gtcatcaagccggtccacgcatccacttactgcgc

SEQ ID NO: 52721 - DNA, 35 bp, Artificial Sequence
  Synthetic oligonucleotide
tgatcgtttttgctcttgtcttcccgttgccctgc

SEQ ID NO: 52722 - DNA, 35 bp, Artificial Sequence
  Synthetic oligonucleotide
gatccagaagcaacttgaaaacaccacggtacctc

SEQ ID NO: 52723 - DNA, 35 bp, Artificial Sequence
  Synthetic oligonucleotide
agcgcccatcagtaaatactatcctcccgaccacg

SEQ ID NO: 52724 - DNA, 35 bp, Artificial Sequence
  Synthetic oligonucleotide
aaagaacccggcggttcgtcgtcacccactccacg

SEQ ID NO: 52725 - DNA, 35 bp, Artificial Sequence
  Synthetic oligonucleotide
ggccaacaccgcggccgttcctcgtttcctctccg

SEQ ID NO: 52726 - DNA, 35 bp, Artificial Sequence
  Synthetic oligonucleotide
tagacggcgccacgccaagacctatcactacagcg

SEQ ID NO: 52727 - DNA, 35 bp, Artificial Sequence
  Synthetic oligonucleotide
agagaaagagtggagggtgatgagcgacgggggcg

SEQ ID NO: 52728 - DNA, 35 bp, Artificial Sequence
  Synthetic oligonucleotide
tcaccacccgccaggagaaggaaaaacgaaattcg

SEQ ID NO: 52729 - DNA, 35 bp, Artificial Sequence
  Synthetic oligonucleotide
gtatggagagagaggagggttcgttcgggacaggg

SEQ ID NO: 52730 - DNA, 35 bp, Artificial Sequence
  Synthetic oligonucleotide
atgaccctggctgaggggcatactaaaataccaat

SEQ ID NO: 52731 - DNA, 35 bp, Artificial Sequence
  Synthetic oligonucleotide
ttagaggctaccatatcccttctgccacaatgaat

SEQ ID NO: 52732 - DNA, 35 bp, Artificial Sequence
  Synthetic oligonucleotide
acgccccatgcattttgttagttcccccaacatat

SEQ ID NO: 52733 - DNA, 35 bp, Artificial Sequence
  Synthetic oligonucleotide
tgcacctatccgccggatcgtaccttaaattattt

SEQ ID NO: 52734 - DNA, 36 bp, Artificial Sequence
  Synthetic oligonucleotide
atccgtccctagacgtcgcacatatccacagtgaaa

SEQ ID NO: 52735 - DNA, 35 bp, Artificial Sequence
  Synthetic oligonucleotide
atgcgaaccgcaatacgcctacatagtacgctgaa

SEQ ID NO: 52736 - DNA, 35 bp, Artificial Sequence
  Synthetic oligonucleotide
ttcggacgggagggaaaatagcgggagaggactaa

SEQ ID NO: 52737 - DNA, 36 bp, Artificial Sequence
  Synthetic oligonucleotide
taatcgcaccactatgcaagcacaggcctaagacca

SEQ ID NO: 52738 - DNA, 36 bp, Artificial Sequence
  Synthetic oligonucleotide
atgtcccgctatccaacctgtcccagataatgacca

SEQ ID NO: 52739 - DNA, 36 bp, Artificial Sequence
  Synthetic oligonucleotide
ttgctggtggcaaccactccccgtccttcgctcgca

SEQ ID NO: 52740 - DNA, 36 bp, Artificial Sequence
  Synthetic oligonucleotide
ttgcaccaacgcgttccttccttttgctgactggca

SEQ ID NO: 52741 - DNA, 36 bp, Artificial Sequence
  Synthetic oligonucleotide
tcgagccattttcgattcgcatccacctgggtctca

SEQ ID NO: 52742 - DNA, 36 bp, Artificial Sequence
  Synthetic oligonucleotide
atacatggtcgacgtcctcagttgcactgtctttca

SEQ ID NO: 52743 - DNA, 37 bp, Artificial Sequence
  Synthetic oligonucleotide
gagggggtgtacatacgggtgggggaggttcgcacga

SEQ ID NO: 52744 - DNA, 37 bp, Artificial Sequence
  Synthetic oligonucleotide
ggtaagcgtcccctacggccttctctcgtgtaaccga

SEQ ID NO: 52745 - DNA, 37 bp, Artificial Sequence
  Synthetic oligonucleotide
aaacactgtcattgtcccacgcactgtacctgtccga

SEQ ID NO: 52746 - DNA, 37 bp, Artificial Sequence
  Synthetic oligonucleotide
tcctcacaccggattcatggctatttcgctctcgcga

SEQ ID NO: 52747 - DNA, 35 bp, Artificial Sequence
  Synthetic oligonucleotide
atgctctctccacctcgcacgactccgcccatcga

SEQ ID NO: 52748 - DNA, 37 bp, Artificial Sequence
  Synthetic oligonucleotide
gaataccccctctgcgataggaggccctcaatttcga

SEQ ID NO: 52749 - DNA, 37 bp, Artificial Sequence
  Synthetic oligonucleotide
tgccacccaccccgatatttccgagtagttcacagga

SEQ ID NO: 52750 - DNA, 37 bp, Artificial Sequence
  Synthetic oligonucleotide
aaccaaccctgaaaccagtgccccatgcctcttagga

SEQ ID NO: 52751 - DNA, 37 bp, Artificial Sequence
  Synthetic oligonucleotide
gaaagggaaagcaaaataacgataggagtgtccggga

SEQ ID NO: 52752 - DNA, 37 bp, Artificial Sequence
  Synthetic oligonucleotide
actggggcccggggttgaggcggagggtattggggga

SEQ ID NO: 52753 - DNA, 37 bp, Artificial Sequence
  Synthetic oligonucleotide
gtgggaacatgtaaagggatgttggtgggcatgggga

SEQ ID NO: 52754 - DNA, 37 bp, Artificial Sequence
  Synthetic oligonucleotide
atcatgaggggatggaaaaaagggcatagtttgggga

SEQ ID NO: 52755 - DNA, 36 bp, Artificial Sequence
  Synthetic oligonucleotide
gatcacagtcacagcctcgtttaaatagccactgga

SEQ ID NO: 52756 - DNA, 35 bp, Artificial Sequence
  Synthetic oligonucleotide
ttacgcgtgctagcacattctatttgatctctgga

SEQ ID NO: 52757 - DNA, 36 bp, Artificial Sequence
  Synthetic oligonucleotide
gttcacatctaaccgtaatgctacctccgctttgga

SEQ ID NO: 52758 - DNA, 38 bp, Artificial Sequence
  Synthetic oligonucleotide
tagcgaggccgatgggggtgcttgttgggggaagatga

SEQ ID NO: 52759 - DNA, 38 bp, Artificial Sequence
  Synthetic oligonucleotide
acatggcacgaaccttagcataaagcgcgcctcactga

SEQ ID NO: 52760 - DNA, 38 bp, Artificial Sequence
  Synthetic oligonucleotide
acacctcgcctcctcacagtctgtggtttatgacctga

SEQ ID NO: 52761 - DNA, 37 bp, Artificial Sequence
  Synthetic oligonucleotide
gcaaccacactcgcgcctcgccccaaatacgccgtga

SEQ ID NO: 52762 - DNA, 36 bp, Artificial Sequence
  Synthetic oligonucleotide
acaatgagggtagacgggaggggagggtaagtgtga

SEQ ID NO: 52763 - DNA, 38 bp, Artificial Sequence
  Synthetic oligonucleotide
gtaacaacacaagcactcgccactcccacacggtttga

SEQ ID NO: 52764 - DNA, 35 bp, Artificial Sequence
  Synthetic oligonucleotide
gaacgggcggacgggagggaaggtgctttagaata

SEQ ID NO: 52765 - DNA, 36 bp, Artificial Sequence
  Synthetic oligonucleotide
tgcaatcaccatgaccaagaccacgcaacgaatcta

SEQ ID NO: 52766 - DNA, 36 bp, Artificial Sequence
  Synthetic oligonucleotide
tgcgactgctcgccgtccaattctaccccgctctta

SEQ ID NO: 52767 - DNA, 35 bp, Artificial Sequence
  Synthetic oligonucleotide
gcaggggaaggaaacgtaattactagatgggccac

SEQ ID NO: 52768 - DNA, 35 bp, Artificial Sequence
  Synthetic oligonucleotide
acccagtcccagctctgtcacatccctacaattac

SEQ ID NO: 52769 - DNA, 35 bp, Artificial Sequence
  Synthetic oligonucleotide
gaccgccaacgtgccgcacacatgtcccatcttac

SEQ ID NO: 52770 - DNA, 35 bp, Artificial Sequence
  Synthetic oligonucleotide
tacccctcaacatctggtaatcaaaacgactcacc

SEQ ID NO: 52771 - DNA, 35 bp, Artificial Sequence
  Synthetic oligonucleotide
tgacactccccgtacctgcctctttgtttgctgcc

SEQ ID NO: 52772 - DNA, 35 bp, Artificial Sequence
  Synthetic oligonucleotide
acaacgagagctttccctggtccgaggcctcttgc

SEQ ID NO: 52773 - DNA, 35 bp, Artificial Sequence
  Synthetic oligonucleotide
agttcgagtcggagcattatgtcgtcctctccgtc

SEQ ID NO: 52774 - DNA, 35 bp, Artificial Sequence
  Synthetic oligonucleotide
tcatctggacccgctgtcgtacccttttacttgtc

SEQ ID NO: 52775 - DNA, 35 bp, Artificial Sequence
  Synthetic oligonucleotide
ttgactgctgctcgtccttcttggcggactttttc

SEQ ID NO: 52776 - DNA, 35 bp, Artificial Sequence
  Synthetic oligonucleotide
tgccacattcctcaatcacatatagcctttatacg

SEQ ID NO: 52777 - DNA, 35 bp, Artificial Sequence
  Synthetic oligonucleotide
tcaacctctgcatctcttaagtttgtcccttggcg

SEQ ID NO: 52778 - DNA, 35 bp, Artificial Sequence
  Synthetic oligonucleotide
tgttcatgttgggcccgcgtgtcatcttccctgcg

SEQ ID NO: 52779 - DNA, 35 bp, Artificial Sequence
  Synthetic oligonucleotide
acagcgagtatgctatccagcacaccatccactcg

SEQ ID NO: 52780 - DNA, 35 bp, Artificial Sequence
  Synthetic oligonucleotide
tcataggcgcaatcttccgaaaccactaacactgg

SEQ ID NO: 52781 - DNA, 35 bp, Artificial Sequence
  Synthetic oligonucleotide
acccaccgtactaaggcttgattagttgccactgg

SEQ ID NO: 52782 - DNA, 35 bp, Artificial Sequence
  Synthetic oligonucleotide
gcccaacgcctctaaatttgtcgaccacgtggact

SEQ ID NO: 52783 - DNA, 35 bp, Artificial Sequence
  Synthetic oligonucleotide
tgtccacaccagtccgcactcattacagagcgtct

SEQ ID NO: 52784 - DNA, 35 bp, Artificial Sequence
  Synthetic oligonucleotide
gcccagccctcgtcaattacccgtcacgctctcgt

SEQ ID NO: 52785 - DNA, 35 bp, Artificial Sequence
  Synthetic oligonucleotide
gttgcactgactcaattggccaacttgtcccttgt

SEQ ID NO: 52786 - DNA, 35 bp, Artificial Sequence
  Synthetic oligonucleotide
gcacttctttccgctccggttgtaccatcgatatt

SEQ ID NO: 52787 - DNA, 35 bp, Artificial Sequence
  Synthetic oligonucleotide
taccgggcctccgcacatcccatagatcctgcctt

SEQ ID NO: 52788 - DNA, 36 bp, Artificial Sequence
  Synthetic oligonucleotide
actacacgacacaccctgcggccatgcacatcgcaa

SEQ ID NO: 52789 - DNA, 36 bp, Artificial Sequence
  Synthetic oligonucleotide
tttcacatcagacttccatctgttcccctagcctaa

SEQ ID NO: 52790 - DNA, 36 bp, Artificial Sequence
  Synthetic oligonucleotide
gccggtcacccctcacccaactcccctcaaggctaa

SEQ ID NO: 52791 - DNA, 35 bp, Artificial Sequence
  Synthetic oligonucleotide
gtgccgcctttaccgctagctgcccacggatctaa

SEQ ID NO: 52792 - DNA, 35 bp, Artificial Sequence
  Synthetic oligonucleotide
tcattccacccctttcgtatatcgtgcgctgcaca

SEQ ID NO: 52793 - DNA, 36 bp, Artificial Sequence
  Synthetic oligonucleotide
tccggagcctctgccgattacccttgacgatttaca

SEQ ID NO: 52794 - DNA, 36 bp, Artificial Sequence
  Synthetic oligonucleotide
atcccccccgttaaatgattacctcgaacgcctgca

SEQ ID NO: 52795 - DNA, 37 bp, Artificial Sequence
  Synthetic oligonucleotide
tttagccccacgtggtatcgccgctccccatattaga

SEQ ID NO: 52796 - DNA, 37 bp, Artificial Sequence
  Synthetic oligonucleotide
accgaggtgcaccgcgcccttagccccccattaacga

SEQ ID NO: 52797 - DNA, 37 bp, Artificial Sequence
  Synthetic oligonucleotide
acacatcgctgcagcattaagtcccatgcgaacacga

SEQ ID NO: 52798 - DNA, 36 bp, Artificial Sequence
  Synthetic oligonucleotide
agccccgcaagcagacccacccggtgtcctcccgga

SEQ ID NO: 52799 - DNA, 37 bp, Artificial Sequence
  Synthetic oligonucleotide
aacccccgttagactggtgggggggtggagtgaggga

SEQ ID NO: 52800 - DNA, 37 bp, Artificial Sequence
  Synthetic oligonucleotide
ggacgcccctaccatgaccttagctttcgtccctgga

SEQ ID NO: 52801 - DNA, 37 bp, Artificial Sequence
  Synthetic oligonucleotide
tacctacgtcaccttatttcatccggtcttttctgga

SEQ ID NO: 52802 - DNA, 37 bp, Artificial Sequence
  Synthetic oligonucleotide
gcgaggagccccagtccctagaacacactactcatga

SEQ ID NO: 52803 - DNA, 38 bp, Artificial Sequence
  Synthetic oligonucleotide
agacaacgtggagaggggggtgttgaatcatgggatga

SEQ ID NO: 52804 - DNA, 38 bp, Artificial Sequence
  Synthetic oligonucleotide
gggacacccacgggagggatagggctgatttgaactga

SEQ ID NO: 52805 - DNA, 38 bp, Artificial Sequence
  Synthetic oligonucleotide
aatccaccccacctgtctttagcattatctggcactga

SEQ ID NO: 52806 - DNA, 38 bp, Artificial Sequence
  Synthetic oligonucleotide
tccagccttcgccaacatgtgcctcccagccggactga

SEQ ID NO: 52807 - DNA, 37 bp, Artificial Sequence
  Synthetic oligonucleotide
atcgctccggtcgcccacatagttgatttctccctga

SEQ ID NO: 52808 - DNA, 37 bp, Artificial Sequence
  Synthetic oligonucleotide
aatggcacggccctcttttacctgcctgatctcgtga

SEQ ID NO: 52809 - DNA, 37 bp, Artificial Sequence
  Synthetic oligonucleotide
ggacgaacgggggaatgggcctacggagggccggtga

SEQ ID NO: 52810 - DNA, 38 bp, Artificial Sequence
  Synthetic oligonucleotide
acctcacagcgagcctttctgtttaccgcacccattga

SEQ ID NO: 52811 - DNA, 35 bp, Artificial Sequence
  Synthetic oligonucleotide
tcaggggccccgcgtggggagggaacttgaccata

SEQ ID NO: 52812 - DNA, 36 bp, Artificial Sequence
  Synthetic oligonucleotide
acgactccccccctcgtgcaaggctttgtcgcacta

SEQ ID NO: 52813 - DNA, 36 bp, Artificial Sequence
  Synthetic oligonucleotide
tacctctgccccacttactagttctccatgttacta

SEQ ID NO: 52814 - DNA, 36 bp, Artificial Sequence
  Synthetic oligonucleotide
gtgccgtcactttcgacctacttctacacaccggta

SEQ ID NO: 52815 - DNA, 35 bp, Artificial Sequence
  Synthetic oligonucleotide
gccaggttgggtcacctcgttctgtacttccctta

SEQ ID NO: 52816 - DNA, 35 bp, Artificial Sequence
  Synthetic oligonucleotide
gaagctcgcagaagtcccttatacacgtccaacac

SEQ ID NO: 52817 - DNA, 35 bp, Artificial Sequence
  Synthetic oligonucleotide
ttgggacgataacggggaagggagatactgaagac

SEQ ID NO: 52818 - DNA, 35 bp, Artificial Sequence
  Synthetic oligonucleotide
tgcctacgccatattacgtcccctcgacgcgaacc

SEQ ID NO: 52819 - DNA, 35 bp, Artificial Sequence
  Synthetic oligonucleotide
gattcccaccgtaatatccctgagctttctgaccc

SEQ ID NO: 52820 - DNA, 35 bp, Artificial Sequence
  Synthetic oligonucleotide
ttctgacgcggtgtcaattcactctttccactccc

SEQ ID NO: 52821 - DNA, 35 bp, Artificial Sequence
  Synthetic oligonucleotide
gcacgcctgccagtggctacgcatgtcccgattcc

SEQ ID NO: 52822 - DNA, 35 bp, Artificial Sequence
  Synthetic oligonucleotide
tccgatgacaccgtgaaaagttttttgctgatcgc

SEQ ID NO: 52823 - DNA, 35 bp, Artificial Sequence
  Synthetic oligonucleotide
actgtcttcacctgcctaacggtggcccttccatc

SEQ ID NO: 52824 - DNA, 35 bp, Artificial Sequence
  Synthetic oligonucleotide
aagtcaatctccagcggttaactttcgcctctatc

SEQ ID NO: 52825 - DNA, 35 bp, Artificial Sequence
  Synthetic oligonucleotide
ttacactgaccgcacttgaaccttatagaagcttc

SEQ ID NO: 52826 - DNA, 35 bp, Artificial Sequence
  Synthetic oligonucleotide
gcaatcatcaacctgtctttcccgtccacacgttc

SEQ ID NO: 52827 - DNA, 35 bp, Artificial Sequence
  Synthetic oligonucleotide
ggtgttccccgattcttgttcgtgttcatgctttc

SEQ ID NO: 52828 - DNA, 35 bp, Artificial Sequence
  Synthetic oligonucleotide
acatccgatcagaccgcctacgtgcttttcctacg

SEQ ID NO: 52829 - DNA, 35 bp, Artificial Sequence
  Synthetic oligonucleotide
aaccgcaatcacacccgggtcgccttcaactagcg

SEQ ID NO: 52830 - DNA, 35 bp, Artificial Sequence
  Synthetic oligonucleotide
atcttccacacctggctcccctgacgcccgacggg

SEQ ID NO: 52831 - DNA, 35 bp, Artificial Sequence
  Synthetic oligonucleotide
tgctcgaaaatagggaataggcatgggtggagggg

SEQ ID NO: 52832 - DNA, 34 bp, Artificial Sequence
  Synthetic oligonucleotide
tgtctggggcgatagtctcggctgtagggggggg

SEQ ID NO: 52833 - DNA, 35 bp, Artificial Sequence
  Synthetic oligonucleotide
gcaatcgcacatcccacactttagtcatcgaatgg

SEQ ID NO: 52834 - DNA, 35 bp, Artificial Sequence
  Synthetic oligonucleotide
accactgactcggaaacctcatacttgcgccctgg

SEQ ID NO: 52835 - DNA, 35 bp, Artificial Sequence
  Synthetic oligonucleotide
taagcccttcttcacctgaatcctgccgtatcctg

SEQ ID NO: 52836 - DNA, 35 bp, Artificial Sequence
  Synthetic oligonucleotide
taccttcacccgcttggaaactgccgacagttttg

SEQ ID NO: 52837 - DNA, 35 bp, Artificial Sequence
  Synthetic oligonucleotide
atgcgagccccatcatactctgtttttccttgaat

SEQ ID NO: 52838 - DNA, 35 bp, Artificial Sequence
  Synthetic oligonucleotide
gatgggggggcacactggaagctcttaatcaccat

SEQ ID NO: 52839 - DNA, 35 bp, Artificial Sequence
  Synthetic oligonucleotide
gtgacttcacatctgcacctttatgaccttggcat

SEQ ID NO: 52840 - DNA, 35 bp, Artificial Sequence
  Synthetic oligonucleotide
ttatccaccacccgaatagtccctgagccagcgat

SEQ ID NO: 52841 - DNA, 35 bp, Artificial Sequence
  Synthetic oligonucleotide
acggtcgagctcagcttctcatcatgccacgaact

SEQ ID NO: 52842 - DNA, 35 bp, Artificial Sequence
  Synthetic oligonucleotide
tccgaactctgctttgcctactaggcttacaacct

SEQ ID NO: 52843 - DNA, 35 bp, Artificial Sequence
  Synthetic oligonucleotide
gattggcgtaccggtcactggatctcctctacgct

SEQ ID NO: 52844 - DNA, 35 bp, Artificial Sequence
  Synthetic oligonucleotide
gctagcctcactcatttttagcaacaatctcacgt

SEQ ID NO: 52845 - DNA, 35 bp, Artificial Sequence
  Synthetic oligonucleotide
gatgtgcgatcgtagaacttggtggtggggttggt

SEQ ID NO: 52846 - DNA, 35 bp, Artificial Sequence
  Synthetic oligonucleotide
acaacccacctcggtatgattcccccggatttatt

SEQ ID NO: 52847 - DNA, 35 bp, Artificial Sequence
  Synthetic oligonucleotide
gcgcctccacatccctgcgtctcaagtctttggtt

SEQ ID NO: 52848 - DNA, 35 bp, Artificial Sequence
  Synthetic oligonucleotide
tgcgaaccgcaactatagctcgttttcatactgtt

SEQ ID NO: 52849 - DNA, 35 bp, Artificial Sequence
  Synthetic oligonucleotide
gccacatacggtgcctatcactgattcgacccaca

SEQ ID NO: 52850 - DNA, 36 bp, Artificial Sequence
  Synthetic oligonucleotide
ttcacggtcgcttattttggttcctacgttccagca

SEQ ID NO: 52851 - DNA, 36 bp, Artificial Sequence
  Synthetic oligonucleotide
tttcagagggagcagtgaaagggtcgggggggagca

SEQ ID NO: 52852 - DNA, 36 bp, Artificial Sequence
  Synthetic oligonucleotide
gaactggtaggcggaaaagaccaggggggaggctca

SEQ ID NO: 52853 - DNA, 35 bp, Artificial Sequence
  Synthetic oligonucleotide
tcatcgcagaccccaatcacctagtgtcggtctca

SEQ ID NO: 52854 - DNA, 36 bp, Artificial Sequence
  Synthetic oligonucleotide
tccgatccaggagcgcatactttcctctgaccttca

SEQ ID NO: 52855 - DNA, 37 bp, Artificial Sequence
  Synthetic oligonucleotide
gttcccagcgctcaatgcccgcgagcccctctcaaga

SEQ ID NO: 52856 - DNA, 37 bp, Artificial Sequence
  Synthetic oligonucleotide
gagagagggcgtagggtagcaaactgaaattgtaaga

SEQ ID NO: 52857 - DNA, 35 bp, Artificial Sequence
  Synthetic oligonucleotide
tcgaaggcctcaccccccggaccgacctacccaga

SEQ ID NO: 52858 - DNA, 37 bp, Artificial Sequence
  Synthetic oligonucleotide
ttcaggccgagacttggggggggtggtgcaattcaga

SEQ ID NO: 52859 - DNA, 37 bp, Artificial Sequence
  Synthetic oligonucleotide
tccgtgtgtgcgccccatgattgttgtcggcttgaga

SEQ ID NO: 52860 - DNA, 37 bp, Artificial Sequence
  Synthetic oligonucleotide
gccagttggcggagagggaaagctggtgagatcacga

SEQ ID NO: 52861 - DNA, 37 bp, Artificial Sequence
  Synthetic oligonucleotide
gaccaccgatcctcactgttgcactttcttgacccga

SEQ ID NO: 52862 - DNA, 37 bp, Artificial Sequence
  Synthetic oligonucleotide
tgagacacgcataggtggaaaggggtgtgtctcgcga

SEQ ID NO: 52863 - DNA, 37 bp, Artificial Sequence
  Synthetic oligonucleotide
tcgccaacgaacccccctcgctgtcacacgtgccgga

SEQ ID NO: 52864 - DNA, 35 bp, Artificial Sequence
  Synthetic oligonucleotide
agtgtgactgcgacacgtgtcaagggtggatggga

SEQ ID NO: 52865 - DNA, 37 bp, Artificial Sequence
  Synthetic oligonucleotide
aatgaaagtctggagggggataatgctcggactggga

SEQ ID NO: 52866 - DNA, 38 bp, Artificial Sequence
  Synthetic oligonucleotide
ggtgggcaaatgtaacagcaccttctcccttcacatga

SEQ ID NO: 52867 - DNA, 38 bp, Artificial Sequence
  Synthetic oligonucleotide
atgtcctgcaacactgaaagaaacaccccctccgatga

SEQ ID NO: 52868 - DNA, 38 bp, Artificial Sequence
  Synthetic oligonucleotide
atgccactgatcctcactatacgccccccctgttatga

SEQ ID NO: 52869 - DNA, 38 bp, Artificial Sequence
  Synthetic oligonucleotide
gatccgcgactcgcaacccttagcgaccacatgcctga

SEQ ID NO: 52870 - DNA, 36 bp, Artificial Sequence
  Synthetic oligonucleotide
gaggaccaggtggagtgggaggattgcggtcagtga

SEQ ID NO: 52871 - DNA, 37 bp, Artificial Sequence
  Synthetic oligonucleotide
atgggacaaagggggtggatgctgttatgtaaggtga

SEQ ID NO: 52872 - DNA, 38 bp, Artificial Sequence
  Synthetic oligonucleotide
gttcgagtagcggggggggagtgggcatgttacggtga

SEQ ID NO: 52873 - DNA, 38 bp, Artificial Sequence
  Synthetic oligonucleotide
ggtgagttgcgggtggtggtgggtgaacttgggattga

SEQ ID NO: 52874 - DNA, 37 bp, Artificial Sequence
  Synthetic oligonucleotide
aatgtgaccgctgacttaagcgcatgccccatattga

SEQ ID NO: 52875 - DNA, 38 bp, Artificial Sequence
  Synthetic oligonucleotide
tcacctttcggctctattatgcatcacctcactgttga

SEQ ID NO: 52876 - DNA, 36 bp, Artificial Sequence
  Synthetic oligonucleotide
tcaaacagatgtacctcactgttgcgctgaacccta

SEQ ID NO: 52877 - DNA, 36 bp, Artificial Sequence
  Synthetic oligonucleotide
agaacacggggggtgtgggaattcgggtctgtgcta

SEQ ID NO: 52878 - DNA, 35 bp, Artificial Sequence
  Synthetic oligonucleotide
gacagtgcgtgccaatgacgtggtggggggatgta

SEQ ID NO: 52879 - DNA, 36 bp, Artificial Sequence
  Synthetic oligonucleotide
tcacactatcatcaatgttaacctactgcctatgta

SEQ ID NO: 52880 - DNA, 36 bp, Artificial Sequence
  Synthetic oligonucleotide
tacacatggctgtgttgtcttgcgggtcacctatta

SEQ ID NO: 52881 - DNA, 35 bp, Artificial Sequence
  Synthetic oligonucleotide
gcgctactgacacgagtttcaacatgcatggcccc

SEQ ID NO: 52882 - DNA, 35 bp, Artificial Sequence
  Synthetic oligonucleotide
gacccttcaaccttcaccggcggaactagctcgcc

SEQ ID NO: 52883 - DNA, 35 bp, Artificial Sequence
  Synthetic oligonucleotide
tcacagcctatgtccatccgtacaccttactggcc

SEQ ID NO: 52884 - DNA, 34 bp, Artificial Sequence
  Synthetic oligonucleotide
gatcaagcagttttcactcactcccttagttagc

SEQ ID NO: 52885 - DNA, 35 bp, Artificial Sequence
  Synthetic oligonucleotide
tacgcccctgggcgttgtatctaggacctatccgc

SEQ ID NO: 52886 - DNA, 35 bp, Artificial Sequence
  Synthetic oligonucleotide
ttggtgctccatcacgactgaaccttcctgtaatc

SEQ ID NO: 52887 - DNA, 35 bp, Artificial Sequence
  Synthetic oligonucleotide
aacacgcctgtcctaacgtagccttaacggcattc

SEQ ID NO: 52888 - DNA, 35 bp, Artificial Sequence
  Synthetic oligonucleotide
tagatcccatcatggaaccgggacaccacttattc

SEQ ID NO: 52889 - DNA, 35 bp, Artificial Sequence
  Synthetic oligonucleotide
ttcgccatgccattcgccgcgagtcgcctctgttc

SEQ ID NO: 52890 - DNA, 35 bp, Artificial Sequence
  Synthetic oligonucleotide
tccatgccagggcatctaactctggcggtaatttc

SEQ ID NO: 52891 - DNA, 35 bp, Artificial Sequence
  Synthetic oligonucleotide
atgcgcagtcaacgctcgtctctaacctacctacg

SEQ ID NO: 52892 - DNA, 35 bp, Artificial Sequence
  Synthetic oligonucleotide
tcagttccgtacagtcacccattatcaatccttcg

SEQ ID NO: 52893 - DNA, 35 bp, Artificial Sequence
  Synthetic oligonucleotide
gacccccctgaaacgacgtgacttacgatcgacat

SEQ ID NO: 52894 - DNA, 35 bp, Artificial Sequence
  Synthetic oligonucleotide
gcagtccacttcccggctttttcgtggtctcccat

SEQ ID NO: 52895 - DNA, 35 bp, Artificial Sequence
  Synthetic oligonucleotide
gcctcacacgttaggtcaaacctagccttttccat

SEQ ID NO: 52896 - DNA, 35 bp, Artificial Sequence
  Synthetic oligonucleotide
aggaggaaggacggccaggtggtggaggaagaact

SEQ ID NO: 52897 - DNA, 35 bp, Artificial Sequence
  Synthetic oligonucleotide
gtgcactctcacgattctcaatctaacggcttact

SEQ ID NO: 52898 - DNA, 35 bp, Artificial Sequence
  Synthetic oligonucleotide
tgtgatccgcccgtataccacgttagttaatgcct

SEQ ID NO: 52899 - DNA, 36 bp, Artificial Sequence
  Synthetic oligonucleotide
ttgctacccctcaaatgcgacgcccctgactcaagt

SEQ ID NO: 52900 - DNA, 35 bp, Artificial Sequence
  Synthetic oligonucleotide
tacgctcgtgcacttttacggactttcaccggttt

SEQ ID NO: 52901 - DNA, 32 bp, Artificial Sequence
  Synthetic oligonucleotide
gccctggcgccttttacacctcgcggtatttt

SEQ ID NO: 52902 - DNA, 36 bp, Artificial Sequence
  Synthetic oligonucleotide
tacgggaggcgattacacgggaggagtgggggcaaa

SEQ ID NO: 52903 - DNA, 35 bp, Artificial Sequence
  Synthetic oligonucleotide
tgcccccctgcaatggccatggacggatttcacaa

SEQ ID NO: 52904 - DNA, 36 bp, Artificial Sequence
  Synthetic oligonucleotide
actgccccgtgcccgaagaccctcccgtatcgaaca

SEQ ID NO: 52905 - DNA, 36 bp, Artificial Sequence
  Synthetic oligonucleotide
gaggagggcgaggtgagtggtggtcttcgtgggaca

SEQ ID NO: 52906 - DNA, 36 bp, Artificial Sequence
  Synthetic oligonucleotide
gcttcagagccccgcgtcacttacaccctggcacca

SEQ ID NO: 52907 - DNA, 36 bp, Artificial Sequence
  Synthetic oligonucleotide
gagtaggagggccgagaagttggcagcctgagacca

SEQ ID NO: 52908 - DNA, 36 bp, Artificial Sequence
  Synthetic oligonucleotide
gcccccttcaccggtttactaactcgtagctaccca

SEQ ID NO: 52909 - DNA, 36 bp, Artificial Sequence
  Synthetic oligonucleotide
gcacaatcgacccagaacccatccctgaactgccca

SEQ ID NO: 52910 - DNA, 36 bp, Artificial Sequence
  Synthetic oligonucleotide
agcctgtccggaggatgcctgccccattgtgcgcca

SEQ ID NO: 52911 - DNA, 35 bp, Artificial Sequence
  Synthetic oligonucleotide
gacgttctccgcccacttttttgtggctttggcca

SEQ ID NO: 52912 - DNA, 35 bp, Artificial Sequence
  Synthetic oligonucleotide
gcgctgggccgttattgctcctctctctcgcagca

SEQ ID NO: 52913 - DNA, 35 bp, Artificial Sequence
  Synthetic oligonucleotide
tggtggaggggaggtgggggtaggacaccgggtca

SEQ ID NO: 52914 - DNA, 37 bp, Artificial Sequence
  Synthetic oligonucleotide
tgtggagggaagtggtgacattaggttggggcagaga

SEQ ID NO: 52915 - DNA, 37 bp, Artificial Sequence
  Synthetic oligonucleotide
gccgcccacatacgcaccgagcctagactgtccgaga

SEQ ID NO: 52916 - DNA, 37 bp, Artificial Sequence
  Synthetic oligonucleotide
tcaggacgagagaaaattgagatggggatgacgtaga

SEQ ID NO: 52917 - DNA, 36 bp, Artificial Sequence
  Synthetic oligonucleotide
gcttccacccccagtactccatgatagcctacacga

SEQ ID NO: 52918 - DNA, 37 bp, Artificial Sequence
  Synthetic oligonucleotide
gcgatgaagaagagaaacggggggatagaggatacga

SEQ ID NO: 52919 - DNA, 37 bp, Artificial Sequence
  Synthetic oligonucleotide
gatgccaccacctctaacctttattcgccgcccgcga

SEQ ID NO: 52920 - DNA, 37 bp, Artificial Sequence
  Synthetic oligonucleotide
gctgcaatcgcttggcctccctttaattgctgttcga

SEQ ID NO: 52921 - DNA, 37 bp, Artificial Sequence
  Synthetic oligonucleotide
gcgggggggaatggatggatggtaagtcaaacgagga

SEQ ID NO: 52922 - DNA, 37 bp, Artificial Sequence
  Synthetic oligonucleotide
acagaacggtggggtaaggactatgccggggggagga

SEQ ID NO: 52923 - DNA, 36 bp, Artificial Sequence
  Synthetic oligonucleotide
tcccccatcgcatactgttaggtagtgcctcccgga

SEQ ID NO: 52924 - DNA, 37 bp, Artificial Sequence
  Synthetic oligonucleotide
gctagggggggaataggtaaggaaaatcgcctcggga

SEQ ID NO: 52925 - DNA, 37 bp, Artificial Sequence
  Synthetic oligonucleotide
atgccaagtggcgtgggaaaacaatattagctgggga

SEQ ID NO: 52926 - DNA, 38 bp, Artificial Sequence
  Synthetic oligonucleotide
acatgttggagaggggggtatcgaagagaggactggga

SEQ ID NO: 52927 - DNA, 37 bp, Artificial Sequence
  Synthetic oligonucleotide
agacacttgcgtctggaagggggatgatagggtggga

SEQ ID NO: 52928 - DNA, 37 bp, Artificial Sequence
  Synthetic oligonucleotide
tagcgggtgggaagtaattcatgtggggaggtttgga

SEQ ID NO: 52929 - DNA, 37 bp, Artificial Sequence
  Synthetic oligonucleotide
tgacaccccattcgtctcactagtcttgaccaaatga

SEQ ID NO: 52930 - DNA, 38 bp, Artificial Sequence
  Synthetic oligonucleotide
atgacggacgtcagagggacggtgggaagggaagatga

SEQ ID NO: 52931 - DNA, 38 bp, Artificial Sequence
  Synthetic oligonucleotide
actaccacctttgtcctcatcttacagttatgagatga

SEQ ID NO: 52932 - DNA, 37 bp, Artificial Sequence
  Synthetic oligonucleotide
gttcgctgcatattctacatcctgtggtccaccctga

SEQ ID NO: 52933 - DNA, 38 bp, Artificial Sequence
  Synthetic oligonucleotide
aacgtcccaacttgccagcttatccctgactgccctga

SEQ ID NO: 52934 - DNA, 37 bp, Artificial Sequence
  Synthetic oligonucleotide
gtcaagcctcatcccatttgccccaggctgcttgtga

SEQ ID NO: 52935 - DNA, 36 bp, Artificial Sequence
  Synthetic oligonucleotide
tccccgcggacctcaacctcccacctatggggcata

SEQ ID NO: 52936 - DNA, 35 bp, Artificial Sequence
  Synthetic oligonucleotide
tcgcgagcccagtctctaacaaccccccacggata

SEQ ID NO: 52937 - DNA, 36 bp, Artificial Sequence
  Synthetic oligonucleotide
acacccgcccgaaccacaaagtatgtgcgttgccta

SEQ ID NO: 52938 - DNA, 36 bp, Artificial Sequence
  Synthetic oligonucleotide
gacacaggccccggtaccctattagatcctctgcta

SEQ ID NO: 52939 - DNA, 36 bp, Artificial Sequence
  Synthetic oligonucleotide
ggagggtgcaagatctagggggttgagtgagcggta

SEQ ID NO: 52940 - DNA, 35 bp, Artificial Sequence
  Synthetic oligonucleotide
tagccaacctcacacagacggaactccccacccac

SEQ ID NO: 52941 - DNA, 35 bp, Artificial Sequence
  Synthetic oligonucleotide
atcacaggcttcacaccgaatcgttggccccggac

SEQ ID NO: 52942 - DNA, 35 bp, Artificial Sequence
  Synthetic oligonucleotide
tagagcgtagcccagcctccgaccatcctggcacc

SEQ ID NO: 52943 - DNA, 35 bp, Artificial Sequence
  Synthetic oligonucleotide
tcaatcactcccggaatcgcccatcaagtggtgcc

SEQ ID NO: 52944 - DNA, 34 bp, Artificial Sequence
  Synthetic oligonucleotide
gcccaccgcgatgtccgtcgctacacaccaatcc

SEQ ID NO: 52945 - DNA, 35 bp, Artificial Sequence
  Synthetic oligonucleotide
taacacagtagtgtccccaggtaccattacgttcc

SEQ ID NO: 52946 - DNA, 35 bp, Artificial Sequence
  Synthetic oligonucleotide
agctccccaccgaattccgttccgagagttgttcc

SEQ ID NO: 52947 - DNA, 35 bp, Artificial Sequence
  Synthetic oligonucleotide
accccacctcacagtgatctgtctacgcttctcgc

SEQ ID NO: 52948 - DNA, 33 bp, Artificial Sequence
  Synthetic oligonucleotide
tgctgggggaacgagggtggactggctaggctc

SEQ ID NO: 52949 - DNA, 35 bp, Artificial Sequence
  Synthetic oligonucleotide
gtgtcagccaccctgttgtacgttgccccttgctc

SEQ ID NO: 52950 - DNA, 35 bp, Artificial Sequence
  Synthetic oligonucleotide
tctgtgacatggcggcggagggtatggagtggcag

SEQ ID NO: 52951 - DNA, 35 bp, Artificial Sequence
  Synthetic oligonucleotide
tacgtacatactcggtggctactaaatctcctcag

SEQ ID NO: 52952 - DNA, 35 bp, Artificial Sequence
  Synthetic oligonucleotide
gcccttctacacgttaatggcattgtccacccccg

SEQ ID NO: 52953 - DNA, 35 bp, Artificial Sequence
  Synthetic oligonucleotide
tacccggttgcacaatctcgccgctattactctcg

SEQ ID NO: 52954 - DNA, 35 bp, Artificial Sequence
  Synthetic oligonucleotide
gactacccagatacggcccattccacttcactagg

SEQ ID NO: 52955 - DNA, 35 bp, Artificial Sequence
  Synthetic oligonucleotide
taccctcagggcgttggttggttcgtctttccctg

SEQ ID NO: 52956 - DNA, 35 bp, Artificial Sequence
  Synthetic oligonucleotide
tcatcgcaggtccttatattttttgctttggtctg

SEQ ID NO: 52957 - DNA, 35 bp, Artificial Sequence
  Synthetic oligonucleotide
gtccctcgagacgcaagtgcattaatcgttcccat

SEQ ID NO: 52958 - DNA, 35 bp, Artificial Sequence
  Synthetic oligonucleotide
ggactgtcggctggcactgcccggagctcctccct

SEQ ID NO: 52959 - DNA, 35 bp, Artificial Sequence
  Synthetic oligonucleotide
acatccgtccaaatccgtaattgaattaccgtgct

SEQ ID NO: 52960 - DNA, 35 bp, Artificial Sequence
  Synthetic oligonucleotide
tagggaggggttggtacgaaggacgggtggaaggt

SEQ ID NO: 52961 - DNA, 35 bp, Artificial Sequence
  Synthetic oligonucleotide
tgaaccggggggagatggacagttgcggtcggggt

SEQ ID NO: 52962 - DNA, 35 bp, Artificial Sequence
  Synthetic oligonucleotide
gcccaaaggtacctgagtttcttttccatccgtgt

SEQ ID NO: 52963 - DNA, 36 bp, Artificial Sequence
  Synthetic oligonucleotide
gacctcatccgcacctcgaataagaccatggcactt

SEQ ID NO: 52964 - DNA, 35 bp, Artificial Sequence
  Synthetic oligonucleotide
tagtcgcacacacatcctcctttgcctggttcctt

SEQ ID NO: 52965 - DNA, 35 bp, Artificial Sequence
  Synthetic oligonucleotide
ttcgggccaggcgatctctgcgtcttccggtgctt

SEQ ID NO: 52966 - DNA, 35 bp, Artificial Sequence
  Synthetic oligonucleotide
gtacgagccagactccgcgtgcgatttcttctctt

SEQ ID NO: 52967 - DNA, 36 bp, Artificial Sequence
  Synthetic oligonucleotide
gcatgggagggggtagggtgactatcggcaagaaaa

SEQ ID NO: 52968 - DNA, 35 bp, Artificial Sequence
  Synthetic oligonucleotide
ttggtgagaggagggaaccggggcataaggtaaaa

SEQ ID NO: 52969 - DNA, 35 bp, Artificial Sequence
  Synthetic oligonucleotide
agaggtgggggttctggaggggtagtgtggtaaaa

SEQ ID NO: 52970 - DNA, 35 bp, Artificial Sequence
  Synthetic oligonucleotide
tctttactcgccgatcctggccactccgaccataa

SEQ ID NO: 52971 - DNA, 36 bp, Artificial Sequence
  Synthetic oligonucleotide
gcacaccatcgcgcttgtaagcacggttacttaaca

SEQ ID NO: 52972 - DNA, 36 bp, Artificial Sequence
  Synthetic oligonucleotide
aatgccaccgcagcagaatcattcgggtgacgcgca

SEQ ID NO: 52973 - DNA, 36 bp, Artificial Sequence
  Synthetic oligonucleotide
gtgcacattgccctcattccacggaaacagtcttca

SEQ ID NO: 52974 - DNA, 35 bp, Artificial Sequence
  Synthetic oligonucleotide
gaccatttcgcaagcctgggtaacggcctctttca

SEQ ID NO: 52975 - DNA, 37 bp, Artificial Sequence
  Synthetic oligonucleotide
acccgatccgccacccaggccactccgaaacaagaga

SEQ ID NO: 52976 - DNA, 37 bp, Artificial Sequence
  Synthetic oligonucleotide
ttcagacagcctccccccctgtcttctccggacgaga

SEQ ID NO: 52977 - DNA, 37 bp, Artificial Sequence
  Synthetic oligonucleotide
tggggggagcgtgagccaggggcaggtgggcgggaga

SEQ ID NO: 52978 - DNA, 37 bp, Artificial Sequence
  Synthetic oligonucleotide
gaacttgccgccccagttacatctccgccattgacga

SEQ ID NO: 52979 - DNA, 36 bp, Artificial Sequence
  Synthetic oligonucleotide
aagcgggaagaagagactaagggaatgtgttgacga

SEQ ID NO: 52980 - DNA, 37 bp, Artificial Sequence
  Synthetic oligonucleotide
gaggaacagccccccgccgtccacaccgacctccgga

SEQ ID NO: 52981 - DNA, 35 bp, Artificial Sequence
  Synthetic oligonucleotide
gtgcaaagcacggggggttcacgggggtttaggga

SEQ ID NO: 52982 - DNA, 35 bp, Artificial Sequence
  Synthetic oligonucleotide
gcaaaatggggtgatggaatgcctagaggtatgga

SEQ ID NO: 52983 - DNA, 37 bp, Artificial Sequence
  Synthetic oligonucleotide
gatacccttcgctgcctatcccaggcttctgactgga

SEQ ID NO: 52984 - DNA, 37 bp, Artificial Sequence
  Synthetic oligonucleotide
tcagctcgacgcatttagtgctgtttgaactcctgga

SEQ ID NO: 52985 - DNA, 38 bp, Artificial Sequence
  Synthetic oligonucleotide
gtccaagcatgatctacttaactactgcccttacatga

SEQ ID NO: 52986 - DNA, 36 bp, Artificial Sequence
  Synthetic oligonucleotide
acacctggcctgttactcgccatacgtaccctatga

SEQ ID NO: 52987 - DNA, 38 bp, Artificial Sequence
  Synthetic oligonucleotide
tggttcgctcgttttttatcccccttgcctgcctatga

SEQ ID NO: 52988 - DNA, 38 bp, Artificial Sequence
  Synthetic oligonucleotide
atcacacctgcgatgtgtatcaatgctttatccagtga

SEQ ID NO: 52989 - DNA, 37 bp, Artificial Sequence
  Synthetic oligonucleotide
tacctgctgtgcctctccgtctttcctcatttggtga

SEQ ID NO: 52990 - DNA, 37 bp, Artificial Sequence
  Synthetic oligonucleotide
ttgagaaggccgaggaggacagtggggtcgcatgtga

SEQ ID NO: 52991 - DNA, 38 bp, Artificial Sequence
  Synthetic oligonucleotide
actccgccacacccagtcactgtacgagtttgttgtga

SEQ ID NO: 52992 - DNA, 36 bp, Artificial Sequence
  Synthetic oligonucleotide
gacgcacaggcccgtgctttagtctcctatacttga

SEQ ID NO: 52993 - DNA, 36 bp, Artificial Sequence
  Synthetic oligonucleotide
acagtgtcacaaaacttaaaccacctgcatttcgta

SEQ ID NO: 52994 - DNA, 36 bp, Artificial Sequence
  Synthetic oligonucleotide
tgtctctcaccataccatgtgcttccggtctcacac

SEQ ID NO: 52995 - DNA, 35 bp, Artificial Sequence
  Synthetic oligonucleotide
gtcgatccctctcccggctctgctattctcgagac

SEQ ID NO: 52996 - DNA, 35 bp, Artificial Sequence
  Synthetic oligonucleotide
gtactctcggctcgcctgtgcctccaacgtccacc

SEQ ID NO: 52997 - DNA, 35 bp, Artificial Sequence
  Synthetic oligonucleotide
tcaccaagcctgtaatctgccttcacttcggaccc

SEQ ID NO: 52998 - DNA, 35 bp, Artificial Sequence
  Synthetic oligonucleotide
gggagacctccaacgccctcgagtctgccgatccc

SEQ ID NO: 52999 - DNA, 35 bp, Artificial Sequence
  Synthetic oligonucleotide
tatacccccacgttgctggtgccccccacgcggcc

SEQ ID NO: 53000 - DNA, 35 bp, Artificial Sequence
  Synthetic oligonucleotide
ttgccctatgattttcccgagttctgcgctactcc

SEQ ID NO: 53001 - DNA, 35 bp, Artificial Sequence
  Synthetic oligonucleotide
atacgcccgctgcgagggtctatatcgtctttagc

SEQ ID NO: 53002 - DNA, 35 bp, Artificial Sequence
  Synthetic oligonucleotide
gcaagccttactcctgcgatacaagttcaagccgc

SEQ ID NO: 53003 - DNA, 35 bp, Artificial Sequence
  Synthetic oligonucleotide
aacacccattgcccagggatcattcttggccctgc

SEQ ID NO: 53004 - DNA, 35 bp, Artificial Sequence
  Synthetic oligonucleotide
ttgacccagtaggacgcgtgcaatctgcctacatc

SEQ ID NO: 53005 - DNA, 35 bp, Artificial Sequence
  Synthetic oligonucleotide
tcctgctctgccggcaatcgaacaccttgcacttc

SEQ ID NO: 53006 - DNA, 35 bp, Artificial Sequence
  Synthetic oligonucleotide
tgtaagaccctagctccacctaggctactcacttc

SEQ ID NO: 53007 - DNA, 35 bp, Artificial Sequence
  Synthetic oligonucleotide
gactacgttgcaggtggacattgggggaggtcgag

SEQ ID NO: 53008 - DNA, 35 bp, Artificial Sequence
  Synthetic oligonucleotide
gaacagccagcaatgggcatgggaggtggttgacg

SEQ ID NO: 53009 - DNA, 35 bp, Artificial Sequence
  Synthetic oligonucleotide
tatgctccgccaccgtcctcgttccagtattttcg

SEQ ID NO: 53010 - DNA, 35 bp, Artificial Sequence
  Synthetic oligonucleotide
aagccgaagtccgtaccagaccgggggggagaggg

SEQ ID NO: 53011 - DNA, 35 bp, Artificial Sequence
  Synthetic oligonucleotide
gtaagggaagggggaaaatttgggaatctcatggg

SEQ ID NO: 53012 - DNA, 35 bp, Artificial Sequence
  Synthetic oligonucleotide
tctgaaatgagtggaatgggactgggtaagggatg

SEQ ID NO: 53013 - DNA, 35 bp, Artificial Sequence
  Synthetic oligonucleotide
gaccgcaagggagggcaaggtggcgaaggaaactg

SEQ ID NO: 53014 - DNA, 35 bp, Artificial Sequence
  Synthetic oligonucleotide
acgtcatggcacttatgtccggccctcactgtaat

SEQ ID NO: 53015 - DNA, 35 bp, Artificial Sequence
  Synthetic oligonucleotide
tccgcgccggcacccactcatctctccatcggcct

SEQ ID NO: 53016 - DNA, 35 bp, Artificial Sequence
  Synthetic oligonucleotide
tcacccgcgacgggttcctcctttcggatttcgct

SEQ ID NO: 53017 - DNA, 35 bp, Artificial Sequence
  Synthetic oligonucleotide
gacacccgccgtgttcctttatggtgatcccttct

SEQ ID NO: 53018 - DNA, 35 bp, Artificial Sequence
  Synthetic oligonucleotide
gtagaccatccacatgcctgagccatttaagtagt

SEQ ID NO: 53019 - DNA, 35 bp, Artificial Sequence
  Synthetic oligonucleotide
gtcacatcacacaacacgagtctggtcaacaaggt

SEQ ID NO: 53020 - DNA, 35 bp, Artificial Sequence
  Synthetic oligonucleotide
agaacggagagaaaataatgggcgataggaagggt

SEQ ID NO: 53021 - DNA, 35 bp, Artificial Sequence
  Synthetic oligonucleotide
acacgaactgcctccatcgtgctccgttatcgatt

SEQ ID NO: 53022 - DNA, 35 bp, Artificial Sequence
  Synthetic oligonucleotide
gcgatgataggatgtcagcgccgccaccctccctt

SEQ ID NO: 53023 - DNA, 35 bp, Artificial Sequence
  Synthetic oligonucleotide
accaacgttgtctcgtttgtccttgcacctccttt

SEQ ID NO: 53024 - DNA, 35 bp, Artificial Sequence
  Synthetic oligonucleotide
atcgtgaacagcccatgattatgcgctcctgtttt

SEQ ID NO: 53025 - DNA, 35 bp, Artificial Sequence
  Synthetic oligonucleotide
acacccgcagccaatacaagcaacggcattccaaa

SEQ ID NO: 53026 - DNA, 36 bp, Artificial Sequence
  Synthetic oligonucleotide
taacccgcattcgttggccattatgaccccttgaaa

SEQ ID NO: 53027 - DNA, 36 bp, Artificial Sequence
  Synthetic oligonucleotide
aatatgccgcctaacaaaccgacgtccttgccacaa

SEQ ID NO: 53028 - DNA, 36 bp, Artificial Sequence
  Synthetic oligonucleotide
tctcacgctctcatccatgcgctgttaacaatcgaa

SEQ ID NO: 53029 - DNA, 36 bp, Artificial Sequence
  Synthetic oligonucleotide
atgagactgggcgtggagggcaagcttgtcggggaa

SEQ ID NO: 53030 - DNA, 36 bp, Artificial Sequence
  Synthetic oligonucleotide
gcataaggcgccgccgtagctgaccccacacctgaa

SEQ ID NO: 53031 - DNA, 36 bp, Artificial Sequence
  Synthetic oligonucleotide
gttcgcccccgtttactcttcctctagtgccaaaca

SEQ ID NO: 53032 - DNA, 35 bp, Artificial Sequence
  Synthetic oligonucleotide
taaggggaaggggggtgcaggagtagtgattgaca

SEQ ID NO: 53033 - DNA, 36 bp, Artificial Sequence
  Synthetic oligonucleotide
aacagtccgcccaggccggcaatccatcgaactaca

SEQ ID NO: 53034 - DNA, 36 bp, Artificial Sequence
  Synthetic oligonucleotide
tgcacacgagaaccatttaaagctgccctatgtaca

SEQ ID NO: 53035 - DNA, 36 bp, Artificial Sequence
  Synthetic oligonucleotide
tcctgccataccgagaagttaatcatcgccatcgca

SEQ ID NO: 53036 - DNA, 36 bp, Artificial Sequence
  Synthetic oligonucleotide
gtctccggcctatgtctaggcactcctattccttca

SEQ ID NO: 53037 - DNA, 37 bp, Artificial Sequence
  Synthetic oligonucleotide
gggactgcccgccggctaactactacacacatctaga

SEQ ID NO: 53038 - DNA, 35 bp, Artificial Sequence
  Synthetic oligonucleotide
acaaccccatgactgccacatatagcaaacgacga

SEQ ID NO: 53039 - DNA, 37 bp, Artificial Sequence
  Synthetic oligonucleotide
acgccatgtcactctcaaacgcccttcgtcataccga

SEQ ID NO: 53040 - DNA, 37 bp, Artificial Sequence
  Synthetic oligonucleotide
gcgatggtggctcactctacacgctacagttccccga

SEQ ID NO: 53041 - DNA, 37 bp, Artificial Sequence
  Synthetic oligonucleotide
ggaaccgtagcactggggtatgggatggctaggagga

SEQ ID NO: 53042 - DNA, 37 bp, Artificial Sequence
  Synthetic oligonucleotide
ggaagagacacgaagatggagtgtggcatgttgagga

SEQ ID NO: 53043 - DNA, 37 bp, Artificial Sequence
  Synthetic oligonucleotide
tacacacccctccgttcccaggacaaggattctggga

SEQ ID NO: 53044 - DNA, 35 bp, Artificial Sequence
  Synthetic oligonucleotide
tagcccaatagcgcctagcccatcaccatcatgga

SEQ ID NO: 53045 - DNA, 35 bp, Artificial Sequence
  Synthetic oligonucleotide
gtgacacccctctcatccctggcgtgcccactgga

SEQ ID NO: 53046 - DNA, 37 bp, Artificial Sequence
  Synthetic oligonucleotide
tcaaccctcttgtacggtttcacatcttccatctgga

SEQ ID NO: 53047 - DNA, 36 bp, Artificial Sequence
  Synthetic oligonucleotide
agcacacatcgcgcgcccgcctaaattgtctctgga

SEQ ID NO: 53048 - DNA, 37 bp, Artificial Sequence
  Synthetic oligonucleotide
tccctcggccccggttgtgtttttatttttttttgga

SEQ ID NO: 53049 - DNA, 37 bp, Artificial Sequence
  Synthetic oligonucleotide
acgactggcaatgctaggggggaggtaggggggatga

SEQ ID NO: 53050 - DNA, 38 bp, Artificial Sequence
  Synthetic oligonucleotide
accacctcaatcgcgtcatcgttatcccggcatgatga

SEQ ID NO: 53051 - DNA, 38 bp, Artificial Sequence
  Synthetic oligonucleotide
ttacacgcgaatgatattgccgggtaccaacaaactga

SEQ ID NO: 53052 - DNA, 38 bp, Artificial Sequence
  Synthetic oligonucleotide
aaccccgaccggaccgaacctgtttttagtacacctga

SEQ ID NO: 53053 - DNA, 38 bp, Artificial Sequence
  Synthetic oligonucleotide
tgcccgcagtatctctcgttctcgccgcttgtacctga

SEQ ID NO: 53054 - DNA, 38 bp, Artificial Sequence
  Synthetic oligonucleotide
tccatgcaacacatcgcagccgagtcctccgcccctga

SEQ ID NO: 53055 - DNA, 36 bp, Artificial Sequence
  Synthetic oligonucleotide
acttacccccccttgatacgctcacccgccgcctga

SEQ ID NO: 53056 - DNA, 38 bp, Artificial Sequence
  Synthetic oligonucleotide
tccacccgatgtccatctgtactagcttccggtcctga

SEQ ID NO: 53057 - DNA, 38 bp, Artificial Sequence
  Synthetic oligonucleotide
gcacgctccatatgtttttcttctcctggcgttgctga

SEQ ID NO: 53058 - DNA, 38 bp, Artificial Sequence
  Synthetic oligonucleotide
acgatgcaaggagaagggaaatgctgtaggggatctga

SEQ ID NO: 53059 - DNA, 37 bp, Artificial Sequence
  Synthetic oligonucleotide
tacacgcatcggcccgctatgctcccctttttcgtga

SEQ ID NO: 53060 - DNA, 35 bp, Artificial Sequence
  Synthetic oligonucleotide
ttgggacggacaaaatacggaaactgaagcggtga

SEQ ID NO: 53061 - DNA, 38 bp, Artificial Sequence
  Synthetic oligonucleotide
atcccgacgcgttgcctctaccttgttccatctggtga

SEQ ID NO: 53062 - DNA, 38 bp, Artificial Sequence
  Synthetic oligonucleotide
tgtgtaggggtaggcgggcgtgaggacggagggtgtga

SEQ ID NO: 53063 - DNA, 35 bp, Artificial Sequence
  Synthetic oligonucleotide
aaatgatggagcaaggtgggggaactggggtgtga

SEQ ID NO: 53064 - DNA, 36 bp, Artificial Sequence
  Synthetic oligonucleotide
ataccatcccacgcacatcgggacaatctgttgtga

SEQ ID NO: 53065 - DNA, 38 bp, Artificial Sequence
  Synthetic oligonucleotide
ttgtccctcaccccctctgtgaacgtgaccacaattga

SEQ ID NO: 53066 - DNA, 38 bp, Artificial Sequence
  Synthetic oligonucleotide
tcgtatcagccacctatgcttagcgcgatattacttga

SEQ ID NO: 53067 - DNA, 38 bp, Artificial Sequence
  Synthetic oligonucleotide
agaccaggccgccgacgcgtactaatcaaacgctttga

SEQ ID NO: 53068 - DNA, 36 bp, Artificial Sequence
  Synthetic oligonucleotide
tcgaacgtgggagggaattctagcttgttcgacata

SEQ ID NO: 53069 - DNA, 36 bp, Artificial Sequence
  Synthetic oligonucleotide
ttgactcaccacaccagcccagtaggcatatttcta

SEQ ID NO: 53070 - DNA, 36 bp, Artificial Sequence
  Synthetic oligonucleotide
ttagcctaaccagtcgtcccatctaccaagcaagta

SEQ ID NO: 53071 - DNA, 35 bp, Artificial Sequence
  Synthetic oligonucleotide
ggacagccccttatctcgtgccttccactaacgta

SEQ ID NO: 53072 - DNA, 36 bp, Artificial Sequence
  Synthetic oligonucleotide
gaagggcaagggggagagaccattaggggtcccgta

SEQ ID NO: 53073 - DNA, 36 bp, Artificial Sequence
  Synthetic oligonucleotide
gagaggtggggtacgacaaggaaaagggtaatggta

SEQ ID NO: 53074 - DNA, 36 bp, Artificial Sequence
  Synthetic oligonucleotide
acatgccactttcactgcccgcggttccttcgctta

SEQ ID NO: 53075 - DNA, 36 bp, Artificial Sequence
  Synthetic oligonucleotide
tgatgccattcgttcacggtctcttctcagtgctta

SEQ ID NO: 53076 - DNA, 35 bp, Artificial Sequence
  Synthetic oligonucleotide
taacccgtagagggtccacccaaacacctatcaac

SEQ ID NO: 53077 - DNA, 35 bp, Artificial Sequence
  Synthetic oligonucleotide
gaaacgcgatgtacggacgtctgcctcccctccac

SEQ ID NO: 53078 - DNA, 35 bp, Artificial Sequence
  Synthetic oligonucleotide
gatagtccctgttccgccgttcttcttgctgctac

SEQ ID NO: 53079 - DNA, 35 bp, Artificial Sequence
  Synthetic oligonucleotide
aatccccagtcggctatgcatccctcgattcaacc

SEQ ID NO: 53080 - DNA, 35 bp, Artificial Sequence
  Synthetic oligonucleotide
tcctcggagtgctgctgtaacccgctctatgcacc

SEQ ID NO: 53081 - DNA, 35 bp, Artificial Sequence
  Synthetic oligonucleotide
tgaatcataccgcctgacaagcgatgcttcttacc

SEQ ID NO: 53082 - DNA, 35 bp, Artificial Sequence
  Synthetic oligonucleotide
attagcgctgtggtcatttacgtacatctcccgcc

SEQ ID NO: 53083 - DNA, 35 bp, Artificial Sequence
  Synthetic oligonucleotide
gtgtcctcctctccggctcatagaacagcttaggc

SEQ ID NO: 53084 - DNA, 35 bp, Artificial Sequence
  Synthetic oligonucleotide
tccggacctgcctgcactctcctgccattatcatc

SEQ ID NO: 53085 - DNA, 35 bp, Artificial Sequence
  Synthetic oligonucleotide
tcagttaaacagcctccgagcctatgcaatccctc

SEQ ID NO: 53086 - DNA, 35 bp, Artificial Sequence
  Synthetic oligonucleotide
taaacgtcacagcttccctcccccgcccgaagacg

SEQ ID NO: 53087 - DNA, 35 bp, Artificial Sequence
  Synthetic oligonucleotide
acgcccgaggcccacgcgtgttgaactttatctcg

SEQ ID NO: 53088 - DNA, 35 bp, Artificial Sequence
  Synthetic oligonucleotide
tattgcgggagctggagagaagcaggggggtgggg

SEQ ID NO: 53089 - DNA, 35 bp, Artificial Sequence
  Synthetic oligonucleotide
gtcacggggccaagtatttcgtacactcttacatg

SEQ ID NO: 53090 - DNA, 35 bp, Artificial Sequence
  Synthetic oligonucleotide
tatcccactctactccatgcacacatcccgcggtg

SEQ ID NO: 53091 - DNA, 35 bp, Artificial Sequence
  Synthetic oligonucleotide
acatggggaactcagggcgtggggaatgatgattg

SEQ ID NO: 53092 - DNA, 35 bp, Artificial Sequence
  Synthetic oligonucleotide
tcctgcccggggcctcctggaataccagccatttg

SEQ ID NO: 53093 - DNA, 35 bp, Artificial Sequence
  Synthetic oligonucleotide
tgtacgtacttcccgccccagaacccgagcggtct

SEQ ID NO: 53094 - DNA, 35 bp, Artificial Sequence
  Synthetic oligonucleotide
aacccggccgcagccaatgctcccccatgctctgt

SEQ ID NO: 53095 - DNA, 35 bp, Artificial Sequence
  Synthetic oligonucleotide
gatctgaccgccaatgtactgtacacacctgtatt

SEQ ID NO: 53096 - DNA, 35 bp, Artificial Sequence
  Synthetic oligonucleotide
gtctcccgccttctagtgcaatgcccccaatagtt

SEQ ID NO: 53097 - DNA, 36 bp, Artificial Sequence
  Synthetic oligonucleotide
tccgccacacctacgttgataaacatagcaagccaa

SEQ ID NO: 53098 - DNA, 36 bp, Artificial Sequence
  Synthetic oligonucleotide
gtagtgaagaagtggtgatgggggttgtcggaagaa

SEQ ID NO: 53099 - DNA, 36 bp, Artificial Sequence
  Synthetic oligonucleotide
gtcgccgcttttaccgacgccgtgatcccattcgaa

SEQ ID NO: 53100 - DNA, 36 bp, Artificial Sequence
  Synthetic oligonucleotide
acctggcgcgacccgtcctcacacctcgtagtccca

SEQ ID NO: 53101 - DNA, 35 bp, Artificial Sequence
  Synthetic oligonucleotide
taacacatggcccataatgttgctaactatctcca

SEQ ID NO: 53102 - DNA, 36 bp, Artificial Sequence
  Synthetic oligonucleotide
gtgcactcactgcaagcaccataatttcgatgtcca

SEQ ID NO: 53103 - DNA, 37 bp, Artificial Sequence
  Synthetic oligonucleotide
gtttgggttggaataggggtaatgggagggtaacaga

SEQ ID NO: 53104 - DNA, 37 bp, Artificial Sequence
  Synthetic oligonucleotide
gtacaggaggggagtgaaaggggtgtaatggagtaga

SEQ ID NO: 53105 - DNA, 37 bp, Artificial Sequence
  Synthetic oligonucleotide
agttgcgccctgttctccaccacgatccctgtttaga

SEQ ID NO: 53106 - DNA, 37 bp, Artificial Sequence
  Synthetic oligonucleotide
gagggaacggagcggtggtggaggaaaaaatttacga

SEQ ID NO: 53107 - DNA, 37 bp, Artificial Sequence
  Synthetic oligonucleotide
ttcaccgttcctgcttttctctgtccttaggggtcga

SEQ ID NO: 53108 - DNA, 37 bp, Artificial Sequence
  Synthetic oligonucleotide
gaggaccacccctgagtatactccaccgattcttcga

SEQ ID NO: 53109 - DNA, 37 bp, Artificial Sequence
  Synthetic oligonucleotide
aaacactagcggggataggattggggcaaaggaagga

SEQ ID NO: 53110 - DNA, 37 bp, Artificial Sequence
  Synthetic oligonucleotide
gttggagggtatgcgggggggttgaaagtagagggga

SEQ ID NO: 53111 - DNA, 37 bp, Artificial Sequence
  Synthetic oligonucleotide
tgattgccacagaccgtgtggtggaaaaaatggggga

SEQ ID NO: 53112 - DNA, 37 bp, Artificial Sequence
  Synthetic oligonucleotide
gtcagaggaggggtcaagtggatggggtgatgctgga

SEQ ID NO: 53113 - DNA, 38 bp, Artificial Sequence
  Synthetic oligonucleotide
gtcccaacacgtcttaagttctttgtccccccgaatga

SEQ ID NO: 53114 - DNA, 38 bp, Artificial Sequence
  Synthetic oligonucleotide
tagacgggggtgaggagggggccgctattacgagatga

SEQ ID NO: 53115 - DNA, 38 bp, Artificial Sequence
  Synthetic oligonucleotide
atcagggtggacaaaggctgggggggattgggagatga

SEQ ID NO: 53116 - DNA, 38 bp, Artificial Sequence
  Synthetic oligonucleotide
gcaggggtaatcgtagtgtaggggtggggcttatatga

SEQ ID NO: 53117 - DNA, 38 bp, Artificial Sequence
  Synthetic oligonucleotide
gtggtcgaggtcgtaccattgtcgccgttctttcctga

SEQ ID NO: 53118 - DNA, 38 bp, Artificial Sequence
  Synthetic oligonucleotide
tctgtcacggtcacatctcgctacataattcccgctga

SEQ ID NO: 53119 - DNA, 38 bp, Artificial Sequence
  Synthetic oligonucleotide
tgcccccaccatcgtatcccaaacacgctagaatctga

SEQ ID NO: 53120 - DNA, 37 bp, Artificial Sequence
  Synthetic oligonucleotide
tgcgctcgccccgggcccgactaaccttcccccttga

SEQ ID NO: 53121 - DNA, 38 bp, Artificial Sequence
  Synthetic oligonucleotide
atgcaacattccgctacacctgttcgttccaggcttga

SEQ ID NO: 53122 - DNA, 38 bp, Artificial Sequence
  Synthetic oligonucleotide
gaagggccagagtacgacgcgataggggcataatttga

SEQ ID NO: 53123 - DNA, 38 bp, Artificial Sequence
  Synthetic oligonucleotide
tccacctggagtggtgtttacgctcattctacctttga

SEQ ID NO: 53124 - DNA, 36 bp, Artificial Sequence
  Synthetic oligonucleotide
tactcaggcgtgcaagggtggaggggggggctttga

SEQ ID NO: 53125 - DNA, 38 bp, Artificial Sequence
  Synthetic oligonucleotide
gcctcgcatgaggccgggccacctacctttctctttga

SEQ ID NO: 53126 - DNA, 35 bp, Artificial Sequence
  Synthetic oligonucleotide
gcatccatccgccgtggctttgcgatgtaacaata

SEQ ID NO: 53127 - DNA, 36 bp, Artificial Sequence
  Synthetic oligonucleotide
tgagacgggaaggatgaagcccagcagtatcggata

SEQ ID NO: 53128 - DNA, 36 bp, Artificial Sequence
  Synthetic oligonucleotide
ggaacaccttgctcggataacccttactctgtgata

SEQ ID NO: 53129 - DNA, 35 bp, Artificial Sequence
  Synthetic oligonucleotide
actgcaaccgttgcatgccttcgacgttcagccta

SEQ ID NO: 53130 - DNA, 36 bp, Artificial Sequence
  Synthetic oligonucleotide
gacgcatgacgcccatactccgctacccctattcta

SEQ ID NO: 53131 - DNA, 36 bp, Artificial Sequence
  Synthetic oligonucleotide
aattcaccacctgtccgcccaccgtgctgcctggta

SEQ ID NO: 53132 - DNA, 36 bp, Artificial Sequence
  Synthetic oligonucleotide
tcagaaacgacacagtcgcccttggcccatctctta

SEQ ID NO: 53133 - DNA, 35 bp, Artificial Sequence
  Synthetic oligonucleotide
tcaccccgccacttggggacttccagtctttcaac

SEQ ID NO: 53134 - DNA, 35 bp, Artificial Sequence
  Synthetic oligonucleotide
gagattcgcttgggacgtgcgccttgcctccatac

SEQ ID NO: 53135 - DNA, 35 bp, Artificial Sequence
  Synthetic oligonucleotide
agcgatcaatcattgtccctccgttattgcacccc

SEQ ID NO: 53136 - DNA, 35 bp, Artificial Sequence
  Synthetic oligonucleotide
gagatccacaacttacatgtcttacgggttccgcc

SEQ ID NO: 53137 - DNA, 35 bp, Artificial Sequence
  Synthetic oligonucleotide
gtagcacggttggcccctggatgaacttccgctcc

SEQ ID NO: 53138 - DNA, 35 bp, Artificial Sequence
  Synthetic oligonucleotide
atcccggtgccgactcttacgatagcacgggttcc

SEQ ID NO: 53139 - DNA, 35 bp, Artificial Sequence
  Synthetic oligonucleotide
tctccgaccataccaacgctaccggtgctccatgc

SEQ ID NO: 53140 - DNA, 35 bp, Artificial Sequence
  Synthetic oligonucleotide
agcacttgcccgatagttatttgcttgttttctgc

SEQ ID NO: 53141 - DNA, 35 bp, Artificial Sequence
  Synthetic oligonucleotide
tctgacccacgccctgggcctaggtactaaaactc

SEQ ID NO: 53142 - DNA, 35 bp, Artificial Sequence
  Synthetic oligonucleotide
aacgtaggccgcatttccctttacgctacttcgtc

SEQ ID NO: 53143 - DNA, 35 bp, Artificial Sequence
  Synthetic oligonucleotide
atcacatcgatcttacccgtccgtcttccttggtc

SEQ ID NO: 53144 - DNA, 35 bp, Artificial Sequence
  Synthetic oligonucleotide
tcacgatgcacgtcagtcatctgaacgtaaatgtc

SEQ ID NO: 53145 - DNA, 35 bp, Artificial Sequence
  Synthetic oligonucleotide
gtctgccatagcctgtcaggtttccattttctgtc

SEQ ID NO: 53146 - DNA, 35 bp, Artificial Sequence
  Synthetic oligonucleotide
gccccatatccacactattgcgtctgtttacgttc

SEQ ID NO: 53147 - DNA, 35 bp, Artificial Sequence
  Synthetic oligonucleotide
gcaaagcttacggtcgcacgtttttccatcttccg

SEQ ID NO: 53148 - DNA, 35 bp, Artificial Sequence
  Synthetic oligonucleotide
aaacccctcgcctcccacactccatacggctgtgg

SEQ ID NO: 53149 - DNA, 35 bp, Artificial Sequence
  Synthetic oligonucleotide
ttagtacctgcctcgcccctcgtagctcaataaat

SEQ ID NO: 53150 - DNA, 35 bp, Artificial Sequence
  Synthetic oligonucleotide
tgagccctacgcggagttccttttccttcatgaat

SEQ ID NO: 53151 - DNA, 35 bp, Artificial Sequence
  Synthetic oligonucleotide
ttcccccctgcctcatgaccgcacacctccagact

SEQ ID NO: 53152 - DNA, 35 bp, Artificial Sequence
  Synthetic oligonucleotide
attgccaggtaggcaaatgcggaacctactatcct

SEQ ID NO: 53153 - DNA, 35 bp, Artificial Sequence
  Synthetic oligonucleotide
gacacgcaaccttccgcccactaagcatatccgct

SEQ ID NO: 53154 - DNA, 35 bp, Artificial Sequence
  Synthetic oligonucleotide
ccccccaggaggctgtaggctcttcgttttttggt

SEQ ID NO: 53155 - DNA, 35 bp, Artificial Sequence
  Synthetic oligonucleotide
acccccctctcgaggcccaccactttggatggctt

SEQ ID NO: 53156 - DNA, 36 bp, Artificial Sequence
  Synthetic oligonucleotide
tcatggacaaggaggtatgcacaggctaaaacggaa

SEQ ID NO: 53157 - DNA, 36 bp, Artificial Sequence
  Synthetic oligonucleotide
aatccgcgccgcccgattatcattgtcgcttaaaca

SEQ ID NO: 53158 - DNA, 36 bp, Artificial Sequence
  Synthetic oligonucleotide
tgcctgtcggttctctctggtcataccttacacaca

SEQ ID NO: 53159 - DNA, 36 bp, Artificial Sequence
  Synthetic oligonucleotide
gtctatcatcgctgaaacactcgccactacctcaca

SEQ ID NO: 53160 - DNA, 36 bp, Artificial Sequence
  Synthetic oligonucleotide
tccttcgcggtaaatctgctttttaactgcttcaca

SEQ ID NO: 53161 - DNA, 36 bp, Artificial Sequence
  Synthetic oligonucleotide
atgtccatgggggctcaggagcggggcatggggaca

SEQ ID NO: 53162 - DNA, 35 bp, Artificial Sequence
  Synthetic oligonucleotide
aatgagggtgaacgggaattacgaggtacactaca

SEQ ID NO: 53163 - DNA, 36 bp, Artificial Sequence
  Synthetic oligonucleotide
atgatcgcgcatcaatattcttggtactggcaccca

SEQ ID NO: 53164 - DNA, 36 bp, Artificial Sequence
  Synthetic oligonucleotide
acttgacgcttggctcccaattcagtggtggcccca

SEQ ID NO: 53165 - DNA, 36 bp, Artificial Sequence
  Synthetic oligonucleotide
ttgaggacaaggaagccagggaagcaggtgaggcca

SEQ ID NO: 53166 - DNA, 36 bp, Artificial Sequence
  Synthetic oligonucleotide
tgtctagtggcaaccaccatccccgcctccctgtca

SEQ ID NO: 53167 - DNA, 37 bp, Artificial Sequence
  Synthetic oligonucleotide
tcccccatcaaccgtcttatccttgactgtctccaga

SEQ ID NO: 53168 - DNA, 37 bp, Artificial Sequence
  Synthetic oligonucleotide
gcactccaacccaccttccgctgccgactctggtaga

SEQ ID NO: 53169 - DNA, 37 bp, Artificial Sequence
  Synthetic oligonucleotide
cacccacaccaccaactgcatccgtagtcggtaacga

SEQ ID NO: 53170 - DNA, 37 bp, Artificial Sequence
  Synthetic oligonucleotide
acaccgatcggtgggtctggtctaagaccctgtacga

SEQ ID NO: 53171 - DNA, 37 bp, Artificial Sequence
  Synthetic oligonucleotide
tgccccactgcaggccgttcaccaatcctgacaccga

SEQ ID NO: 53172 - DNA, 34 bp, Artificial Sequence
  Synthetic oligonucleotide
aggcctgcacacacaccgccaccattgcactcga

SEQ ID NO: 53173 - DNA, 37 bp, Artificial Sequence
  Synthetic oligonucleotide
accacagggttttccatggcatgcctcgacctctcga

SEQ ID NO: 53174 - DNA, 36 bp, Artificial Sequence
  Synthetic oligonucleotide
caaacaggcggcccattcctatcgaccggtattcga

SEQ ID NO: 53175 - DNA, 37 bp, Artificial Sequence
  Synthetic oligonucleotide
aagcaggaggaggttggggggggcattactaggagga

SEQ ID NO: 53176 - DNA, 38 bp, Artificial Sequence
  Synthetic oligonucleotide
gatccataccgcctctatctgagctctatctgccatga

SEQ ID NO: 53177 - DNA, 37 bp, Artificial Sequence
  Synthetic oligonucleotide
tcccgagaccgctctctaatgaacacactcttactga

SEQ ID NO: 53178 - DNA, 38 bp, Artificial Sequence
  Synthetic oligonucleotide
ttcacaacctggccatggaactgtcagttctaagctga

SEQ ID NO: 53179 - DNA, 38 bp, Artificial Sequence
  Synthetic oligonucleotide
gccacccctgttcggaacaagcagtttagtcccgctga

SEQ ID NO: 53180 - DNA, 38 bp, Artificial Sequence
  Synthetic oligonucleotide
gcgatcgcctcagcacaagcgcccttacatcatggtga

SEQ ID NO: 53181 - DNA, 38 bp, Artificial Sequence
  Synthetic oligonucleotide
gagtacagtcgcaccatcttgattattgccgacgttga

SEQ ID NO: 53182 - DNA, 35 bp, Artificial Sequence
  Synthetic oligonucleotide
atcacggactgcatcgcgacaaaccaggtgcacta

SEQ ID NO: 53183 - DNA, 36 bp, Artificial Sequence
  Synthetic oligonucleotide
ggatcccagaccattaattccagcctgtctccgcta

SEQ ID NO: 53184 - DNA, 35 bp, Artificial Sequence
  Synthetic oligonucleotide
tcacatctgccatcggctccttcctaaggttgcta

SEQ ID NO: 53185 - DNA, 35 bp, Artificial Sequence
  Synthetic oligonucleotide
aaacccgcaacggaccctcggtacactggtatccc

SEQ ID NO: 53186 - DNA, 35 bp, Artificial Sequence
  Synthetic oligonucleotide
gcgacgctacctctagtctccgaggcacattggcc

SEQ ID NO: 53187 - DNA, 35 bp, Artificial Sequence
  Synthetic oligonucleotide
tacccgcaaacttgtccatacacgcataacccagc

SEQ ID NO: 53188 - DNA, 35 bp, Artificial Sequence
  Synthetic oligonucleotide
gcttactaccagtactacttgactagcgatacctc

SEQ ID NO: 53189 - DNA, 35 bp, Artificial Sequence
  Synthetic oligonucleotide
agacggacgaccatccagcctcgaatataccggtc

SEQ ID NO: 53190 - DNA, 35 bp, Artificial Sequence
  Synthetic oligonucleotide
gctcccgcaggggagtggaaagtagggggtcacag

SEQ ID NO: 53191 - DNA, 35 bp, Artificial Sequence
  Synthetic oligonucleotide
atcgtgcctacattccgccttgcttcgcattaacg

SEQ ID NO: 53192 - DNA, 35 bp, Artificial Sequence
  Synthetic oligonucleotide
cttcggtggtcgcaatataccttccccattttagg

SEQ ID NO: 53193 - DNA, 35 bp, Artificial Sequence
  Synthetic oligonucleotide
ggaggggcgaggacgaggggatcggagttagtcgg

SEQ ID NO: 53194 - DNA, 36 bp, Artificial Sequence
  Synthetic oligonucleotide
gacgattcagggtaatgggttggtggggtctgtggg

SEQ ID NO: 53195 - DNA, 35 bp, Artificial Sequence
  Synthetic oligonucleotide
agtgacgtacgcaccggggcgaataggggttaaat

SEQ ID NO: 53196 - DNA, 34 bp, Artificial Sequence
  Synthetic oligonucleotide
gcacgggtgggtagggagggaatccggacaggat

SEQ ID NO: 53197 - DNA, 35 bp, Artificial Sequence
  Synthetic oligonucleotide
tccaccagccgtcatacccggagccatcttcctat

SEQ ID NO: 53198 - DNA, 34 bp, Artificial Sequence
  Synthetic oligonucleotide
agtttggcaacctaccctctcttcaccgcggtat

SEQ ID NO: 53199 - DNA, 35 bp, Artificial Sequence
  Synthetic oligonucleotide
tctccactacgccgatcccttgtatgcaagctgct

SEQ ID NO: 53200 - DNA, 35 bp, Artificial Sequence
  Synthetic oligonucleotide
tcctccgaccggctagattatcgatgcacccttct

SEQ ID NO: 53201 - DNA, 35 bp, Artificial Sequence
  Synthetic oligonucleotide
atcatggacatatgccgtacatcgtcctcatttct

SEQ ID NO: 53202 - DNA, 35 bp, Artificial Sequence
  Synthetic oligonucleotide
tcgccgccacacactcctcgccatatgaaatcagt

SEQ ID NO: 53203 - DNA, 35 bp, Artificial Sequence
  Synthetic oligonucleotide
gacgcatgtcccgggcaacggaagctgcctcttgt

SEQ ID NO: 53204 - DNA, 35 bp, Artificial Sequence
  Synthetic oligonucleotide
gtccatcatttgtttttgctcccccggtactcgtt

SEQ ID NO: 53205 - DNA, 35 bp, Artificial Sequence
  Synthetic oligonucleotide
tgccccttcttggacacgttatttcacttcctgtt

SEQ ID NO: 53206 - DNA, 35 bp, Artificial Sequence
  Synthetic oligonucleotide
acttcatagcccgatcgaatcttagcacctgtttt

SEQ ID NO: 53207 - DNA, 36 bp, Artificial Sequence
  Synthetic oligonucleotide
gacccgcgcgctatcactacacctggcctagctaaa

SEQ ID NO: 53208 - DNA, 36 bp, Artificial Sequence
  Synthetic oligonucleotide
tatgcacgctttccgcaccctcttcgaaccatctaa

SEQ ID NO: 53209 - DNA, 36 bp, Artificial Sequence
  Synthetic oligonucleotide
aagccatctgcgatttgaccaagcccgcccctttaa

SEQ ID NO: 53210 - DNA, 35 bp, Artificial Sequence
  Synthetic oligonucleotide
gtggaccacttgataccatgcgccgttcgttccca

SEQ ID NO: 53211 - DNA, 36 bp, Artificial Sequence
  Synthetic oligonucleotide
acttccacccctagctactacggtaatacgtggcca

SEQ ID NO: 53212 - DNA, 35 bp, Artificial Sequence
  Synthetic oligonucleotide
gtctctatcagcgttcgtccacttacacacatcca

SEQ ID NO: 53213 - DNA, 36 bp, Artificial Sequence
  Synthetic oligonucleotide
tgtgccaccgagtatgcatcctatgttcgcactcca

SEQ ID NO: 53214 - DNA, 36 bp, Artificial Sequence
  Synthetic oligonucleotide
tcaacgcacggctctgctcattgtcacaggatcgca

SEQ ID NO: 53215 - DNA, 36 bp, Artificial Sequence
  Synthetic oligonucleotide
gtcgtgaagggcagcggtgtgggggggggataggca

SEQ ID NO: 53216 - DNA, 37 bp, Artificial Sequence
  Synthetic oligonucleotide
gtgatgcctaattgcctgctgttccactctcgactca

SEQ ID NO: 53217 - DNA, 36 bp, Artificial Sequence
  Synthetic oligonucleotide
gcagacctcgtaccaacccctccgcagggctcctca

SEQ ID NO: 53218 - DNA, 37 bp, Artificial Sequence
  Synthetic oligonucleotide
aataccccccgcatatcccgcctcctgtcgtactaga

SEQ ID NO: 53219 - DNA, 37 bp, Artificial Sequence
  Synthetic oligonucleotide
atcgcgccccgattcgccctcttcatttggcctacga

SEQ ID NO: 53220 - DNA, 35 bp, Artificial Sequence
  Synthetic oligonucleotide
taaccaccggagcgggggggggagggtcatggcga

SEQ ID NO: 53221 - DNA, 37 bp, Artificial Sequence
  Synthetic oligonucleotide
tcaggggaaatggggtgcatggaatggggggttagga

SEQ ID NO: 53222 - DNA, 35 bp, Artificial Sequence
  Synthetic oligonucleotide
aagaaaacgggaggatgaatggagggtagtcggga

SEQ ID NO: 53223 - DNA, 37 bp, Artificial Sequence
  Synthetic oligonucleotide
tctcatgggtgagcgaacgggggaaacggatggggga

SEQ ID NO: 53224 - DNA, 37 bp, Artificial Sequence
  Synthetic oligonucleotide
accgagaggttgacgtgagttggggaggaaaatggga

SEQ ID NO: 53225 - DNA, 38 bp, Artificial Sequence
  Synthetic oligonucleotide
ggagagagtaccggtagggaggcaagggatagcaatga

SEQ ID NO: 53226 - DNA, 38 bp, Artificial Sequence
  Synthetic oligonucleotide
gatggagctgtatgcgcattcgttcttgtctttcatga

SEQ ID NO: 53227 - DNA, 38 bp, Artificial Sequence
  Synthetic oligonucleotide
gacctaccctggttcctcccatcgcaatactttgctga

SEQ ID NO: 53228 - DNA, 38 bp, Artificial Sequence
  Synthetic oligonucleotide
gttgcatcatactgatttcgctctatcccgcccggtga

SEQ ID NO: 53229 - DNA, 37 bp, Artificial Sequence
  Synthetic oligonucleotide
accaatttccgccggcactccgccatacagtccttga

SEQ ID NO: 53230 - DNA, 35 bp, Artificial Sequence
  Synthetic oligonucleotide
aatgcgccgctttgccccatccgtagttcatttga

SEQ ID NO: 53231 - DNA, 36 bp, Artificial Sequence
  Synthetic oligonucleotide
gtacaggcccgataatcgcttcgttttgccatctta

SEQ ID NO: 53232 - DNA, 36 bp, Artificial Sequence
  Synthetic oligonucleotide
ttacggcacacccgacacacgccaactcgcccgtta

SEQ ID NO: 53233 - DNA, 36 bp, Artificial Sequence
  Synthetic oligonucleotide
gacgtgcaggtgaaccgctgccttgtccacttttta

SEQ ID NO: 53234 - DNA, 34 bp, Artificial Sequence
  Synthetic oligonucleotide
ttcgatagcatgtgcgctgacgcccccttttgac

SEQ ID NO: 53235 - DNA, 35 bp, Artificial Sequence
  Synthetic oligonucleotide
gttacccgggtacaatcatatctgaagcctatacc

SEQ ID NO: 53236 - DNA, 35 bp, Artificial Sequence
  Synthetic oligonucleotide
acaaacggtactccccctcaaatctggcgtgggcc

SEQ ID NO: 53237 - DNA, 35 bp, Artificial Sequence
  Synthetic oligonucleotide
gtgagccttggatcgcgcccatagttgcaccacgc

SEQ ID NO: 53238 - DNA, 35 bp, Artificial Sequence
  Synthetic oligonucleotide
accacttggaccgcctcgctactgttgccatatgc

SEQ ID NO: 53239 - DNA, 35 bp, Artificial Sequence
  Synthetic oligonucleotide
gagacctacttcgcgctgccgctcccgctgctatc

SEQ ID NO: 53240 - DNA, 35 bp, Artificial Sequence
  Synthetic oligonucleotide
aaagggcaccccctccgataagatcggtctgcctc

SEQ ID NO: 53241 - DNA, 35 bp, Artificial Sequence
  Synthetic oligonucleotide
gtccccccatcctaggtgttatgattttcttattc

SEQ ID NO: 53242 - DNA, 35 bp, Artificial Sequence
  Synthetic oligonucleotide
gaaagcgacgtctcccgtcatcacgttggtcgttc

SEQ ID NO: 53243 - DNA, 35 bp, Artificial Sequence
  Synthetic oligonucleotide
aagtgccccgacgtctcgcgcccgtgctgcccccg

SEQ ID NO: 53244 - DNA, 34 bp, Artificial Sequence
  Synthetic oligonucleotide
acaatcaccgttaccctgattaacatcagccccg

SEQ ID NO: 53245 - DNA, 35 bp, Artificial Sequence
  Synthetic oligonucleotide
tagcacctgcgattgcacgttcaacttactcctgg

SEQ ID NO: 53246 - DNA, 35 bp, Artificial Sequence
  Synthetic oligonucleotide
tatgggtcgtagatgggcttgggggggcggggtgg

SEQ ID NO: 53247 - DNA, 35 bp, Artificial Sequence
  Synthetic oligonucleotide
tccccacctcacgtctcggctacctagatatacct

SEQ ID NO: 53248 - DNA, 35 bp, Artificial Sequence
  Synthetic oligonucleotide
atgtgccagcctatttgattttacagccctctcct

SEQ ID NO: 53249 - DNA, 35 bp, Artificial Sequence
  Synthetic oligonucleotide
gcacgtgacatgggaaggtggtaaatgccgtagct

SEQ ID NO: 53250 - DNA, 35 bp, Artificial Sequence
  Synthetic oligonucleotide
gggttccgcccgcgtacttgctcctgacgccaatt

SEQ ID NO: 53251 - DNA, 35 bp, Artificial Sequence
  Synthetic oligonucleotide
gttgacgctatccgggtagggtactggtcattctt

SEQ ID NO: 53252 - DNA, 35 bp, Artificial Sequence
  Synthetic oligonucleotide
agcaacgggccgggggggaattcattcagggaaaa

SEQ ID NO: 53253 - DNA, 36 bp, Artificial Sequence
  Synthetic oligonucleotide
gacaccagacaagccctgtaggtgcgtacctcccaa

SEQ ID NO: 53254 - DNA, 36 bp, Artificial Sequence
  Synthetic oligonucleotide
acagctggagagaggggggcctgagggctgagcgaa

SEQ ID NO: 53255 - DNA, 35 bp, Artificial Sequence
  Synthetic oligonucleotide
gccaccttgaactgtaccttcacttggcacattaa

SEQ ID NO: 53256 - DNA, 36 bp, Artificial Sequence
  Synthetic oligonucleotide
agtccgctgccccaattagcccgggctctctaaaca

SEQ ID NO: 53257 - DNA, 36 bp, Artificial Sequence
  Synthetic oligonucleotide
tgactccatgttctcgatgcctcctcttccgcacca

SEQ ID NO: 53258 - DNA, 36 bp, Artificial Sequence
  Synthetic oligonucleotide
gataagccgtcagtcaaccataccatacctccccca

SEQ ID NO: 53259 - DNA, 36 bp, Artificial Sequence
  Synthetic oligonucleotide
agttaaggcccctcccacgctatcgagtcgtaatca

SEQ ID NO: 53260 - DNA, 35 bp, Artificial Sequence
  Synthetic oligonucleotide
gcgggcgcacaccacatgtccggttctttccttca

SEQ ID NO: 53261 - DNA, 36 bp, Artificial Sequence
  Synthetic oligonucleotide
gctgccactatatctttttacttggactatcgacga

SEQ ID NO: 53262 - DNA, 37 bp, Artificial Sequence
  Synthetic oligonucleotide
gactctgccccactccagaacgcctttagtatgacga

SEQ ID NO: 53263 - DNA, 37 bp, Artificial Sequence
  Synthetic oligonucleotide
tctgtcaacccatagagccacccatcccatcctgcga

SEQ ID NO: 53264 - DNA, 36 bp, Artificial Sequence
  Synthetic oligonucleotide
gactgccatgaaaggagcaccgtcatggggggagga

SEQ ID NO: 53265 - DNA, 37 bp, Artificial Sequence
  Synthetic oligonucleotide
gggaaggtgggaagtggaggaaggttgggtcggcgga

SEQ ID NO: 53266 - DNA, 37 bp, Artificial Sequence
  Synthetic oligonucleotide
acgccaaccatcctcgctgtttttcccctacatcgga

SEQ ID NO: 53267 - DNA, 37 bp, Artificial Sequence
  Synthetic oligonucleotide
tgacgacatcattgtcgtccttcttaacttcctcgga

SEQ ID NO: 53268 - DNA, 36 bp, Artificial Sequence
  Synthetic oligonucleotide
gaaagggcgagatgcgaggggcgggagatacgggga

SEQ ID NO: 53269 - DNA, 37 bp, Artificial Sequence
  Synthetic oligonucleotide
tcagacggtgctataagagtaaaggagaggccatgga

SEQ ID NO: 53270 - DNA, 36 bp, Artificial Sequence
  Synthetic oligonucleotide
tccacctctttgtctccgcaccctagctgggctgga

SEQ ID NO: 53271 - DNA, 35 bp, Artificial Sequence
  Synthetic oligonucleotide
acccctaccacggtccccttcttcagcttagtgga

SEQ ID NO: 53272 - DNA, 37 bp, Artificial Sequence
  Synthetic oligonucleotide
atgcgtgcaacgcatagtggacggtatgaaacgtgga

SEQ ID NO: 53273 - DNA, 37 bp, Artificial Sequence
  Synthetic oligonucleotide
tgtgggcccctacgaacccgcgcccagttctcttgga

SEQ ID NO: 53274 - DNA, 38 bp, Artificial Sequence
  Synthetic oligonucleotide
ttatcccccatgctgtgctttaatccatgttcgtatga

SEQ ID NO: 53275 - DNA, 38 bp, Artificial Sequence
  Synthetic oligonucleotide
acaccgccccttgttgtaaccgcccgagtttctactga

SEQ ID NO: 53276 - DNA, 38 bp, Artificial Sequence
  Synthetic oligonucleotide
gcgggaggctcgggtagagcaaatgggggagtaggtga

SEQ ID NO: 53277 - DNA, 38 bp, Artificial Sequence
  Synthetic oligonucleotide
tagcacccgcacaagagttgaggaacgcaaggtggtga

SEQ ID NO: 53278 - DNA, 38 bp, Artificial Sequence
  Synthetic oligonucleotide
tcaggtccagcccgtactttcgccggcatccaacttga

SEQ ID NO: 53279 - DNA, 37 bp, Artificial Sequence
  Synthetic oligonucleotide
tcacgtcgtcactatcaggcgcctttctccatcttga

SEQ ID NO: 53280 - DNA, 35 bp, Artificial Sequence
  Synthetic oligonucleotide
gacgggtaggaggttgaggtgcggcgggcatttga

SEQ ID NO: 53281 - DNA, 38 bp, Artificial Sequence
  Synthetic oligonucleotide
tgtcccaagggccggttgatccacctccactcatttga

SEQ ID NO: 53282 - DNA, 38 bp, Artificial Sequence
  Synthetic oligonucleotide
atccatcccctctgaaggaaacgagccgttccttttga

SEQ ID NO: 53283 - DNA, 38 bp, Artificial Sequence
  Synthetic oligonucleotide
acaatgacgggttgctgaagggaagggagggtttttga

SEQ ID NO: 53284 - DNA, 36 bp, Artificial Sequence
  Synthetic oligonucleotide
tcaggtcgaatgtgacaagtctccccggcctctcta

SEQ ID NO: 53285 - DNA, 36 bp, Artificial Sequence
  Synthetic oligonucleotide
taaacgggtaggggcaaaggcaaggagttgaaagta

SEQ ID NO: 53286 - DNA, 35 bp, Artificial Sequence
  Synthetic oligonucleotide
tgttgggtacctctcgtttcatgacctggcactta

SEQ ID NO: 53287 - DNA, 35 bp, Artificial Sequence
  Synthetic oligonucleotide
acccgcgcaactcgactaaggtcgacccgctaaac

SEQ ID NO: 53288 - DNA, 35 bp, Artificial Sequence
  Synthetic oligonucleotide
gcccttgcccggcattctaggtagttccaatgcac

SEQ ID NO: 53289 - DNA, 35 bp, Artificial Sequence
  Synthetic oligonucleotide
ttctccgccgctactatgaagacccccaaccgccc

SEQ ID NO: 53290 - DNA, 35 bp, Artificial Sequence
  Synthetic oligonucleotide
tgttgagtccacagcttagcgttttcttcatggcc

SEQ ID NO: 53291 - DNA, 35 bp, Artificial Sequence
  Synthetic oligonucleotide
atgcacaacgggtaaagaggggggaagggaggatc

SEQ ID NO: 53292 - DNA, 35 bp, Artificial Sequence
  Synthetic oligonucleotide
tacacatgggtagacaaccccatttcgatacactc

SEQ ID NO: 53293 - DNA, 35 bp, Artificial Sequence
  Synthetic oligonucleotide
gcgaacgcttgtgcaaatctgtttattgctgcctc

SEQ ID NO: 53294 - DNA, 35 bp, Artificial Sequence
  Synthetic oligonucleotide
tgccccccagtactttgcggtcgcctattatcgcg

SEQ ID NO: 53295 - DNA, 35 bp, Artificial Sequence
  Synthetic oligonucleotide
tctgtctactcgttcgcgtcccaagcaccacctcg

SEQ ID NO: 53296 - DNA, 35 bp, Artificial Sequence
  Synthetic oligonucleotide
aatggaggtggatgcactgggggcgggcggtaggg

SEQ ID NO: 53297 - DNA, 35 bp, Artificial Sequence
  Synthetic oligonucleotide
gataacaccgtactggttgtttgcctctttatttg

SEQ ID NO: 53298 - DNA, 35 bp, Artificial Sequence
  Synthetic oligonucleotide
aacgcgtaactgtcttttgcgccatgtccattaat

SEQ ID NO: 53299 - DNA, 35 bp, Artificial Sequence
  Synthetic oligonucleotide
tccacccctgaccttccatgcttttgggcatagat

SEQ ID NO: 53300 - DNA, 35 bp, Artificial Sequence
  Synthetic oligonucleotide
atcaccactgattccctaaggtttctcaggccact

SEQ ID NO: 53301 - DNA, 35 bp, Artificial Sequence
  Synthetic oligonucleotide
tccacccggcagacaatcgtactcctggctaagct

SEQ ID NO: 53302 - DNA, 35 bp, Artificial Sequence
  Synthetic oligonucleotide
gcaacgctcgcattcttactgtggctcgaaattgt

SEQ ID NO: 53303 - DNA, 35 bp, Artificial Sequence
  Synthetic oligonucleotide
ttggggagggctgtgaggaggggcttgcgtttatt

SEQ ID NO: 53304 - DNA, 35 bp, Artificial Sequence
  Synthetic oligonucleotide
gtgacacatatgcacggcccatagcgacgcacctt

SEQ ID NO: 53305 - DNA, 35 bp, Artificial Sequence
  Synthetic oligonucleotide
gttgggcctaaatcgtgcacaatcaaacctccctt

SEQ ID NO: 53306 - DNA, 35 bp, Artificial Sequence
  Synthetic oligonucleotide
atagcaccagccgtagttaaatcggggcttctctt

SEQ ID NO: 53307 - DNA, 35 bp, Artificial Sequence
  Synthetic oligonucleotide
gccacagcccgttcgcgtatagcacccatcttctt

SEQ ID NO: 53308 - DNA, 35 bp, Artificial Sequence
  Synthetic oligonucleotide
tcgcctgcctctgttccctgcttttgggtcgcttt

SEQ ID NO: 53309 - DNA, 35 bp, Artificial Sequence
  Synthetic oligonucleotide
tgcgacgctcgctcctatgcccaccgactctgttt

SEQ ID NO: 53310 - DNA, 36 bp, Artificial Sequence
  Synthetic oligonucleotide
gaagaccgcactcacttttcaagtgatactcccaca

SEQ ID NO: 53311 - DNA, 35 bp, Artificial Sequence
  Synthetic oligonucleotide
agtacgcctgcacagcgatctcttgccaactgaca

SEQ ID NO: 53312 - DNA, 35 bp, Artificial Sequence
  Synthetic oligonucleotide
tagccatccacgtaaccccgatttgcccgcgccca

SEQ ID NO: 53313 - DNA, 36 bp, Artificial Sequence
  Synthetic oligonucleotide
tgaccaaccattgcatccagtttccgggtaccagca

SEQ ID NO: 53314 - DNA, 36 bp, Artificial Sequence
  Synthetic oligonucleotide
acaaccgccatgtcaccgcggatttccgatcactca

SEQ ID NO: 53315 - DNA, 36 bp, Artificial Sequence
  Synthetic oligonucleotide
attccaccagtgcgctatgacgccccgagttattca

SEQ ID NO: 53316 - DNA, 37 bp, Artificial Sequence
  Synthetic oligonucleotide
acgcttcacatcaagttcttgcattttccgacaccga

SEQ ID NO: 53317 - DNA, 36 bp, Artificial Sequence
  Synthetic oligonucleotide
acagttcgtcatataaccacctccgatgctcctcga

SEQ ID NO: 53318 - DNA, 37 bp, Artificial Sequence
  Synthetic oligonucleotide
gttccgcctgcgttttcagtaccgcctcttctctcga

SEQ ID NO: 53319 - DNA, 37 bp, Artificial Sequence
  Synthetic oligonucleotide
gaagatatgggtggtggtgcctgcaggggggtaagga

SEQ ID NO: 53320 - DNA, 37 bp, Artificial Sequence
  Synthetic oligonucleotide
gtgacgtactgctgaagatcgactgggttcagtagga

SEQ ID NO: 53321 - DNA, 37 bp, Artificial Sequence
  Synthetic oligonucleotide
atagggtggtgaaacgggggggtatagtggctacgga

SEQ ID NO: 53322 - DNA, 37 bp, Artificial Sequence
  Synthetic oligonucleotide
acgcaaagtgcctagcgagataaggggaggataggga

SEQ ID NO: 53323 - DNA, 35 bp, Artificial Sequence
  Synthetic oligonucleotide
agagaaatgcaagggaaaaaacggtgatgggtgga

SEQ ID NO: 53324 - DNA, 38 bp, Artificial Sequence
  Synthetic oligonucleotide
tagcgaaccgcgcgtttcgtacaccactatgcacctga

SEQ ID NO: 53325 - DNA, 37 bp, Artificial Sequence
  Synthetic oligonucleotide
tacgtggcaggtcacgtctgtcttatccgtttcctga

SEQ ID NO: 53326 - DNA, 38 bp, Artificial Sequence
  Synthetic oligonucleotide
gtgcacacgttcagtgcccgccgaattactcccgctga

SEQ ID NO: 53327 - DNA, 37 bp, Artificial Sequence
  Synthetic oligonucleotide
gcacacacagcgccgtaattcccctctcaaatgctga

SEQ ID NO: 53328 - DNA, 37 bp, Artificial Sequence
  Synthetic oligonucleotide
tcgtccctccctatcacctcgcccttcgacagggtga

SEQ ID NO: 53329 - DNA, 38 bp, Artificial Sequence
  Synthetic oligonucleotide
atgcgcgcacgtctatcactcccctacatctggcttga

SEQ ID NO: 53330 - DNA, 38 bp, Artificial Sequence
  Synthetic oligonucleotide
actcagccgtaaccacctgccgatgtctccctttttga

SEQ ID NO: 53331 - DNA, 36 bp, Artificial Sequence
  Synthetic oligonucleotide
gcctgggtgggaggggctcggtggagactattcgta

SEQ ID NO: 53332 - DNA, 36 bp, Artificial Sequence
  Synthetic oligonucleotide
gaacactctctgactcagccatacatgaccccggta

SEQ ID NO: 53333 - DNA, 35 bp, Artificial Sequence
  Synthetic oligonucleotide
gccatggtgatctgggctaagactgctgccctccc

SEQ ID NO: 53334 - DNA, 35 bp, Artificial Sequence
  Synthetic oligonucleotide
acaacatgaggcgtctgacccctcgccaatcttcc

SEQ ID NO: 53335 - DNA, 35 bp, Artificial Sequence
  Synthetic oligonucleotide
ttgataccatgtccgagtcttatacccccctccgc

SEQ ID NO: 53336 - DNA, 35 bp, Artificial Sequence
  Synthetic oligonucleotide
gtcggtctgcaacgttgccctccctccgaccgcgc

SEQ ID NO: 53337 - DNA, 35 bp, Artificial Sequence
  Synthetic oligonucleotide
gactacggtacagcactactcccttggtggccatc

SEQ ID NO: 53338 - DNA, 35 bp, Artificial Sequence
  Synthetic oligonucleotide
agaccgttctccgtgcccccaacgaatgtcatgtc

SEQ ID NO: 53339 - DNA, 35 bp, Artificial Sequence
  Synthetic oligonucleotide
gaccctacaatcagccgcttacacgtcctcctgtc

SEQ ID NO: 53340 - DNA, 35 bp, Artificial Sequence
  Synthetic oligonucleotide
gccacggtcgagttacgccttctgccacttctgtc

SEQ ID NO: 53341 - DNA, 35 bp, Artificial Sequence
  Synthetic oligonucleotide
tctgaccaccgcatcataatttcaagcacacagct

SEQ ID NO: 53342 - DNA, 35 bp, Artificial Sequence
  Synthetic oligonucleotide
gttgtccgtggcgccgtaaaactagtgctcgctct

SEQ ID NO: 53343 - DNA, 35 bp, Artificial Sequence
  Synthetic oligonucleotide
ccacccctttgggccctcatgtcttgtcttgcttt

SEQ ID NO: 53344 - DNA, 35 bp, Artificial Sequence
  Synthetic oligonucleotide
acctgctgttgcttcttgctccgttttgctctttt

SEQ ID NO: 53345 - DNA, 36 bp, Artificial Sequence
  Synthetic oligonucleotide
agatggaggcctgaggggggcggaaaaaacagcaaa

SEQ ID NO: 53346 - DNA, 35 bp, Artificial Sequence
  Synthetic oligonucleotide
atgtacgatcgcgccccatgcccctgtggtattaa

SEQ ID NO: 53347 - DNA, 35 bp, Artificial Sequence
  Synthetic oligonucleotide
gacgcacgaagtactccccggctttctgtcgacca

SEQ ID NO: 53348 - DNA, 35 bp, Artificial Sequence
  Synthetic oligonucleotide
gtcgccgtagtattctatagtaaccccctcctgca

SEQ ID NO: 53349 - DNA, 35 bp, Artificial Sequence
  Synthetic oligonucleotide
gatggtcgcgagactacaagggagggtaggggaga

SEQ ID NO: 53350 - DNA, 37 bp, Artificial Sequence
  Synthetic oligonucleotide
gtgacatgaggggaccaggggacggactggatggaga

SEQ ID NO: 53351 - DNA, 37 bp, Artificial Sequence
  Synthetic oligonucleotide
gttggggaggtggccatggggcgaatgcaggcttaga

SEQ ID NO: 53352 - DNA, 37 bp, Artificial Sequence
  Synthetic oligonucleotide
tatgactgggcgaggtgtggtgggagctcagcgccga

SEQ ID NO: 53353 - DNA, 37 bp, Artificial Sequence
  Synthetic oligonucleotide
gaagacgagttgcacttgcgcgttgccctccatccga

SEQ ID NO: 53354 - DNA, 37 bp, Artificial Sequence
  Synthetic oligonucleotide
tgtgaggtagaacaagtgatagataatacagacagga

SEQ ID NO: 53355 - DNA, 36 bp, Artificial Sequence
  Synthetic oligonucleotide
taccacccgctagtatagttatcgaatattatggga

SEQ ID NO: 53356 - DNA, 36 bp, Artificial Sequence
  Synthetic oligonucleotide
gaacctcctggaccagccttcgcgctacttacctga

SEQ ID NO: 53357 - DNA, 36 bp, Artificial Sequence
  Synthetic oligonucleotide
tgtgaaacgtcgacatttgccggctctttcccctga

SEQ ID NO: 53358 - DNA, 38 bp, Artificial Sequence
  Synthetic oligonucleotide
tccagcattaaggccaggaagagagaggttatgggtga

SEQ ID NO: 53359 - DNA, 38 bp, Artificial Sequence
  Synthetic oligonucleotide
tgccattctctcagccttggtgtcttctcttcccttga

SEQ ID NO: 53360 - DNA, 36 bp, Artificial Sequence
  Synthetic oligonucleotide
gcactgtgcccgctctggcgtcgaatacattcgcta

SEQ ID NO: 53361 - DNA, 35 bp, Artificial Sequence
  Synthetic oligonucleotide
actaaacagcggtccttctcccctgccttaacgta

SEQ ID NO: 53362 - DNA, 35 bp, Artificial Sequence
  Synthetic oligonucleotide
acccgactcccgtctccaccaaaatatggcccaac

SEQ ID NO: 53363 - DNA, 35 bp, Artificial Sequence
  Synthetic oligonucleotide
tcgaagacttcccctgatctgcccgaactgcgcac

SEQ ID NO: 53364 - DNA, 35 bp, Artificial Sequence
  Synthetic oligonucleotide
acccttcactgcgaatctgtagatccggccttcac

SEQ ID NO: 53365 - DNA, 35 bp, Artificial Sequence
  Synthetic oligonucleotide
acggaggaacggggaatctagggaagggaatagac

SEQ ID NO: 53366 - DNA, 35 bp, Artificial Sequence
  Synthetic oligonucleotide
tcccggctccccctacatgccacctggatagaacc

SEQ ID NO: 53367 - DNA, 35 bp, Artificial Sequence
  Synthetic oligonucleotide
ttgacccctgaaccatcacgagggctcgacctccc

SEQ ID NO: 53368 - DNA, 35 bp, Artificial Sequence
  Synthetic oligonucleotide
tgcatcttcgaggaccgcactaagacccttttccc

SEQ ID NO: 53369 - DNA, 35 bp, Artificial Sequence
  Synthetic oligonucleotide
gtcccgatccgcatgtacgtccccacttcacaggc

SEQ ID NO: 53370 - DNA, 35 bp, Artificial Sequence
  Synthetic oligonucleotide
acgaattggtcgtgggaaatgggagggtgcggggc

SEQ ID NO: 53371 - DNA, 35 bp, Artificial Sequence
  Synthetic oligonucleotide
tccgtgcaatcgcctaccttctcatcaagcttggc

SEQ ID NO: 53372 - DNA, 35 bp, Artificial Sequence
  Synthetic oligonucleotide
tgcgagtcgggacgggcgcgagaactgtcacaatc

SEQ ID NO: 53373 - DNA, 35 bp, Artificial Sequence
  Synthetic oligonucleotide
caccgaagcccctgcactcaaccaggtctcccatc

SEQ ID NO: 53374 - DNA, 35 bp, Artificial Sequence
  Synthetic oligonucleotide
tagacggtgccaatcactgcgcctgcgagtacctc

SEQ ID NO: 53375 - DNA, 35 bp, Artificial Sequence
  Synthetic oligonucleotide
tttgggtagctcgccgctgcccctgaaacatttag

SEQ ID NO: 53376 - DNA, 35 bp, Artificial Sequence
  Synthetic oligonucleotide
tcacgtcccttgaccatacttcatgacatccctcg

SEQ ID NO: 53377 - DNA, 35 bp, Artificial Sequence
  Synthetic oligonucleotide
tcacacccatggatgttttttgtcttttcagtagg

SEQ ID NO: 53378 - DNA, 35 bp, Artificial Sequence
  Synthetic oligonucleotide
ttccactacctcgataatagccacgttcgccttgg

SEQ ID NO: 53379 - DNA, 35 bp, Artificial Sequence
  Synthetic oligonucleotide
tttcggggtccgaacaccaagtattatgtctcctg

SEQ ID NO: 53380 - DNA, 35 bp, Artificial Sequence
  Synthetic oligonucleotide
atcaacctggtggttatctctctgctcttcgtttg

SEQ ID NO: 53381 - DNA, 35 bp, Artificial Sequence
  Synthetic oligonucleotide
gacgttgcccggttcccctgattgttcctttccat

SEQ ID NO: 53382 - DNA, 35 bp, Artificial Sequence
  Synthetic oligonucleotide
tcgaggtaccatctgcgtgcacatccttcacgcct

SEQ ID NO: 53383 - DNA, 35 bp, Artificial Sequence
  Synthetic oligonucleotide
gtctgccccgactctaattccgacgagatcctgct

SEQ ID NO: 53384 - DNA, 35 bp, Artificial Sequence
  Synthetic oligonucleotide
tatcccgcacctgtgatgccatattacccgcatct

SEQ ID NO: 53385 - DNA, 35 bp, Artificial Sequence
  Synthetic oligonucleotide
agaatgccctgttctcatcgaccgctgctagttct

SEQ ID NO: 53386 - DNA, 35 bp, Artificial Sequence
  Synthetic oligonucleotide
agtaactgcgaatcgagccggccccatccctctgt

SEQ ID NO: 53387 - DNA, 35 bp, Artificial Sequence
  Synthetic oligonucleotide
tagttcgtcgtccttgtactgcctgtgtcggcctt

SEQ ID NO: 53388 - DNA, 35 bp, Artificial Sequence
  Synthetic oligonucleotide
tagtatcatcgctgccctgtacggggttttgcctt

SEQ ID NO: 53389 - DNA, 35 bp, Artificial Sequence
  Synthetic oligonucleotide
ggaggggttggtgggcggggttaacgtaccttttt

SEQ ID NO: 53390 - DNA, 35 bp, Artificial Sequence
  Synthetic oligonucleotide
gagatggacgcacgattatctggccctttctgaaa

SEQ ID NO: 53391 - DNA, 36 bp, Artificial Sequence
  Synthetic oligonucleotide
tcagccgagatgtttcgatggaactctccctcccca

SEQ ID NO: 53392 - DNA, 36 bp, Artificial Sequence
  Synthetic oligonucleotide
gatttcagccgcccaggttccatagttaaactgcca

SEQ ID NO: 53393 - DNA, 35 bp, Artificial Sequence
  Synthetic oligonucleotide
acacgacgaacccacttcgcacaggtcttgttcca

SEQ ID NO: 53394 - DNA, 35 bp, Artificial Sequence
  Synthetic oligonucleotide
tcacgtatagcgcagtcctgaatccaccgtccgca

SEQ ID NO: 53395 - DNA, 36 bp, Artificial Sequence
  Synthetic oligonucleotide
tatcccatcatcggggaactacaacggtgtcctgca

SEQ ID NO: 53396 - DNA, 37 bp, Artificial Sequence
  Synthetic oligonucleotide
actccccccacatgtcatctcctaccagtatagaaga

SEQ ID NO: 53397 - DNA, 37 bp, Artificial Sequence
  Synthetic oligonucleotide
tatcccaacgcgcacaccatgccacccatctgagaga

SEQ ID NO: 53398 - DNA, 35 bp, Artificial Sequence
  Synthetic oligonucleotide
acccctgaaccaaaggatccctgcctccctggaga

SEQ ID NO: 53399 - DNA, 37 bp, Artificial Sequence
  Synthetic oligonucleotide
acccactaccagcccccgtcaatcctagtctctgaga

SEQ ID NO: 53400 - DNA, 36 bp, Artificial Sequence
  Synthetic oligonucleotide
ttcgccccccatgttacgcgccgaagcggtttccga

SEQ ID NO: 53401 - DNA, 36 bp, Artificial Sequence
  Synthetic oligonucleotide
tagcctaacgggagagagttgtgggtggttgtagga

SEQ ID NO: 53402 - DNA, 35 bp, Artificial Sequence
  Synthetic oligonucleotide
atgacaccacagtcgaactatcgaggatcccggga

SEQ ID NO: 53403 - DNA, 36 bp, Artificial Sequence
  Synthetic oligonucleotide
tcaaccatgtgggatcaggaaaataaaggggcggga

SEQ ID NO: 53404 - DNA, 36 bp, Artificial Sequence
  Synthetic oligonucleotide
tcgccccaatgccttcatcccacccatactctggga

SEQ ID NO: 53405 - DNA, 37 bp, Artificial Sequence
  Synthetic oligonucleotide
acacaccttcccctaacacaaggatcaggcatttgga

SEQ ID NO: 53406 - DNA, 38 bp, Artificial Sequence
  Synthetic oligonucleotide
tccacacagcccccctcctaccataacggccttcatga

SEQ ID NO: 53407 - DNA, 36 bp, Artificial Sequence
  Synthetic oligonucleotide
gagccatgccaactacgatattctgccccgcgatga

SEQ ID NO: 53408 - DNA, 37 bp, Artificial Sequence
  Synthetic oligonucleotide
tcacgcaatgtgaacaaagagagtaggggggggatga

SEQ ID NO: 53409 - DNA, 38 bp, Artificial Sequence
  Synthetic oligonucleotide
cccatcatccgcatctgcccagccggccccactactga

SEQ ID NO: 53410 - DNA, 38 bp, Artificial Sequence
  Synthetic oligonucleotide
gtgtgtgccgcccgacatttcgcatttttagcccctga

SEQ ID NO: 53411 - DNA, 38 bp, Artificial Sequence
  Synthetic oligonucleotide
taggtggcaatccccattccatgtctattctggcctga

SEQ ID NO: 53412 - DNA, 38 bp, Artificial Sequence
  Synthetic oligonucleotide
gtaccaaccatagttctcgctgtcacatccttgcctga

SEQ ID NO: 53413 - DNA, 37 bp, Artificial Sequence
  Synthetic oligonucleotide
ttgccatactgccctttgtctctgctacttaacgtga

SEQ ID NO: 53414 - DNA, 37 bp, Artificial Sequence
  Synthetic oligonucleotide
tccgcccaccgatagacgacttccttatgtcccgtga

SEQ ID NO: 53415 - DNA, 37 bp, Artificial Sequence
  Synthetic oligonucleotide
gccgccagccccccccatcataaacctgcctcattga

SEQ ID NO: 53416 - DNA, 37 bp, Artificial Sequence
  Synthetic oligonucleotide
acctgagccctcggtctcaacacctcaagggacttga

SEQ ID NO: 53417 - DNA, 37 bp, Artificial Sequence
  Synthetic oligonucleotide
tcctgtgcggtcatccagcggacgccccttatcttga

SEQ ID NO: 53418 - DNA, 36 bp, Artificial Sequence
  Synthetic oligonucleotide
tgaacactgctccatattttgctcctgcctcctata

SEQ ID NO: 53419 - DNA, 35 bp, Artificial Sequence
  Synthetic oligonucleotide
gaccagaaccggtgctacttgactactgtcaccta

SEQ ID NO: 53420 - DNA, 35 bp, Artificial Sequence
  Synthetic oligonucleotide
agggaaaggggtgggtgggtcactgcgcagtcgta

SEQ ID NO: 53421 - DNA, 36 bp, Artificial Sequence
  Synthetic oligonucleotide
gaagcgcgaagagcggttcggatgggggtcggggta

SEQ ID NO: 53422 - DNA, 35 bp, Artificial Sequence
  Synthetic oligonucleotide
ggaccaagccccgttattctacgctttacacaaac

SEQ ID NO: 53423 - DNA, 35 bp, Artificial Sequence
  Synthetic oligonucleotide
tatacacggcgcccccgcaaattacactcgaacac

SEQ ID NO: 53424 - DNA, 35 bp, Artificial Sequence
  Synthetic oligonucleotide
accacccgcaacatggttgaagtgggataattcac

SEQ ID NO: 53425 - DNA, 35 bp, Artificial Sequence
  Synthetic oligonucleotide
atggtccgtacccgcttatcgcatacccagcctac

SEQ ID NO: 53426 - DNA, 35 bp, Artificial Sequence
  Synthetic oligonucleotide
ggagtgccaatcctctgctccgccggttacccacc

SEQ ID NO: 53427 - DNA, 35 bp, Artificial Sequence
  Synthetic oligonucleotide
tgatcgcatcctcatgttagcttggctcctggtcc

SEQ ID NO: 53428 - DNA, 35 bp, Artificial Sequence
  Synthetic oligonucleotide
gcccggcgccccttccgaactttacctgcttgtcc

SEQ ID NO: 53429 - DNA, 35 bp, Artificial Sequence
  Synthetic oligonucleotide
tcatccccgaccacaggaatagacagttgaaactc

SEQ ID NO: 53430 - DNA, 35 bp, Artificial Sequence
  Synthetic oligonucleotide
gtagacgtcactactataacttctccctgtcactc

SEQ ID NO: 53431 - DNA, 35 bp, Artificial Sequence
  Synthetic oligonucleotide
ggacacccaccgaggaaaccgcttcctttcctgtc

SEQ ID NO: 53432 - DNA, 35 bp, Artificial Sequence
  Synthetic oligonucleotide
gtgcgcatcactctcaatgcgatcccatgatcttc

SEQ ID NO: 53433 - DNA, 35 bp, Artificial Sequence
  Synthetic oligonucleotide
tgactctcatccccgtgccaactgtcactagtacg

SEQ ID NO: 53434 - DNA, 35 bp, Artificial Sequence
  Synthetic oligonucleotide
acacccatccctcacctggggctaatcgactaccg

SEQ ID NO: 53435 - DNA, 35 bp, Artificial Sequence
  Synthetic oligonucleotide
gcactccacttcacagtgacccacttcaccttgcg

SEQ ID NO: 53436 - DNA, 35 bp, Artificial Sequence
  Synthetic oligonucleotide
ttacggggcggggctagagggacggacgtaggggg

SEQ ID NO: 53437 - DNA, 35 bp, Artificial Sequence
  Synthetic oligonucleotide
gcgcaccttctgtgaccatgccagccccctcacat

SEQ ID NO: 53438 - DNA, 35 bp, Artificial Sequence
  Synthetic oligonucleotide
ggatccgccaccacgcaggccaccagttgcaccat

SEQ ID NO: 53439 - DNA, 35 bp, Artificial Sequence
  Synthetic oligonucleotide
gtgttgggtcgtctcactgttaggtcttgtctcat

SEQ ID NO: 53440 - DNA, 35 bp, Artificial Sequence
  Synthetic oligonucleotide
atcccagccgcacattaaacgttggctttcacgat

SEQ ID NO: 53441 - DNA, 35 bp, Artificial Sequence
  Synthetic oligonucleotide
tcagttgccgcccatcgactcgtgtacattattat

SEQ ID NO: 53442 - DNA, 35 bp, Artificial Sequence
  Synthetic oligonucleotide
acctctgcgtatcggtcctactcacgcgcaccgct

SEQ ID NO: 53443 - DNA, 35 bp, Artificial Sequence
  Synthetic oligonucleotide
gacaagagggcgtggagtatagcgtgtgagaggct

SEQ ID NO: 53444 - DNA, 35 bp, Artificial Sequence
  Synthetic oligonucleotide
tcactggtcagtgcttcacattcctgctccctgct

SEQ ID NO: 53445 - DNA, 35 bp, Artificial Sequence
  Synthetic oligonucleotide
cgaacacgggtcttgctggtttagctggatccctt

SEQ ID NO: 53446 - DNA, 35 bp, Artificial Sequence
  Synthetic oligonucleotide
gcagtgaaccctgcctaccacacatccctcttgtt

SEQ ID NO: 53447 - DNA, 35 bp, Artificial Sequence
  Synthetic oligonucleotide
ttgttcaccgctatattcctcgggcctagtgtttt

SEQ ID NO: 53448 - DNA, 36 bp, Artificial Sequence
  Synthetic oligonucleotide
tcgacctcttagtaacctgtttttgaccccgtgaaa

SEQ ID NO: 53449 - DNA, 36 bp, Artificial Sequence
  Synthetic oligonucleotide
ttcgagcaagccttagggttgccgagaacttcccaa

SEQ ID NO: 53450 - DNA, 36 bp, Artificial Sequence
  Synthetic oligonucleotide
acacacagggggaaggtacgagaggagagagtgcaa

SEQ ID NO: 53451 - DNA, 36 bp, Artificial Sequence
  Synthetic oligonucleotide
accttcccccgcgcggaattttctctctatcgggaa

SEQ ID NO: 53452 - DNA, 35 bp, Artificial Sequence
  Synthetic oligonucleotide
tccactccattggattctaatgctttcttcatgaa

SEQ ID NO: 53453 - DNA, 36 bp, Artificial Sequence
  Synthetic oligonucleotide
agtgggaaggggtaacgggagtagagcggggcaaca

SEQ ID NO: 53454 - DNA, 36 bp, Artificial Sequence
  Synthetic oligonucleotide
gccactacgcagggactccaccgggttgttaccaca

SEQ ID NO: 53455 - DNA, 35 bp, Artificial Sequence
  Synthetic oligonucleotide
acaagggttaggcggggaaaaagggtgatgccaca

SEQ ID NO: 53456 - DNA, 36 bp, Artificial Sequence
  Synthetic oligonucleotide
gaccaagttggatcgggggaaattcggagatgcaca

SEQ ID NO: 53457 - DNA, 36 bp, Artificial Sequence
  Synthetic oligonucleotide
agcagtcctgtcctatcggttctatcctctgtcaca

SEQ ID NO: 53458 - DNA, 36 bp, Artificial Sequence
  Synthetic oligonucleotide
aagccggtcaatttttgcacgtttttccccattaca

SEQ ID NO: 53459 - DNA, 36 bp, Artificial Sequence
  Synthetic oligonucleotide
ataacctggacgccagtgcccttaggatccctccca

SEQ ID NO: 53460 - DNA, 36 bp, Artificial Sequence
  Synthetic oligonucleotide
acccaaaggggagtcgggaaactggccaggcaagca

SEQ ID NO: 53461 - DNA, 35 bp, Artificial Sequence
  Synthetic oligonucleotide
tcatcgtatcgctgccacttacccctgagctagca

SEQ ID NO: 53462 - DNA, 36 bp, Artificial Sequence
  Synthetic oligonucleotide
gatccgcgtgagggagagtaagatgaaaggaaggca

SEQ ID NO: 53463 - DNA, 35 bp, Artificial Sequence
  Synthetic oligonucleotide
tacctcatcatttgccttacttacgcagacgggca

SEQ ID NO: 53464 - DNA, 36 bp, Artificial Sequence
  Synthetic oligonucleotide
aattgcgatctaccgtggtgcgaaagccacttctca

SEQ ID NO: 53465 - DNA, 37 bp, Artificial Sequence
  Synthetic oligonucleotide
acaccacctgatagaacggtccccttacagttgtaga

SEQ ID NO: 53466 - DNA, 37 bp, Artificial Sequence
  Synthetic oligonucleotide
gtttggccaccacttccacttttcatctgagagacga

SEQ ID NO: 53467 - DNA, 37 bp, Artificial Sequence
  Synthetic oligonucleotide
tgtccagcacagttggtacttttttgccttgatcgga

SEQ ID NO: 53468 - DNA, 36 bp, Artificial Sequence
  Synthetic oligonucleotide
tagagacgagatggtgggatcaagtgatggctcgga

SEQ ID NO: 53469 - DNA, 37 bp, Artificial Sequence
  Synthetic oligonucleotide
attgacaccggccatgaatctccccgctcgtttcgga

SEQ ID NO: 53470 - DNA, 37 bp, Artificial Sequence
  Synthetic oligonucleotide
gacccatcgaactcgcactgactctccgcccgtggga

SEQ ID NO: 53471 - DNA, 37 bp, Artificial Sequence
  Synthetic oligonucleotide
gtcacctccactcgctacatccgtttcacgttcatga

SEQ ID NO: 53472 - DNA, 36 bp, Artificial Sequence
  Synthetic oligonucleotide
aaccacaccgacaaacataccttagtggaagtatga

SEQ ID NO: 53473 - DNA, 38 bp, Artificial Sequence
  Synthetic oligonucleotide
acaaacacccagctccctgtgccccacgtttcacctga

SEQ ID NO: 53474 - DNA, 38 bp, Artificial Sequence
  Synthetic oligonucleotide
tcagcacaccactaaccggcccacacgcgacactctga

SEQ ID NO: 53475 - DNA, 38 bp, Artificial Sequence
  Synthetic oligonucleotide
agcccactgcgaacagcactccttcctttcgactctga

SEQ ID NO: 53476 - DNA, 38 bp, Artificial Sequence
  Synthetic oligonucleotide
acgtggcatggagggagaaattggggtgtgcggtgtga

SEQ ID NO: 53477 - DNA, 38 bp, Artificial Sequence
  Synthetic oligonucleotide
aacacgtcccaggtctcaggtaaacgcccttctattga

SEQ ID NO: 53478 - DNA, 37 bp, Artificial Sequence
  Synthetic oligonucleotide
tgccccgcttgatctccattctagctctgttctttga

SEQ ID NO: 53479 - DNA, 36 bp, Artificial Sequence
  Synthetic oligonucleotide
atcgccgtatcagcatattcgtcccactcacgcgta

SEQ ID NO: 53480 - DNA, 36 bp, Artificial Sequence
  Synthetic oligonucleotide
ggtgtgcgaccatgactgcattacccccccatgtta

SEQ ID NO: 53481 - DNA, 35 bp, Artificial Sequence
  Synthetic oligonucleotide
gatggcacagctcatctcgaatcatcttcatcaac

SEQ ID NO: 53482 - DNA, 35 bp, Artificial Sequence
  Synthetic oligonucleotide
tctcaatggcccacttgtccctgtcatttatgtac

SEQ ID NO: 53483 - DNA, 35 bp, Artificial Sequence
  Synthetic oligonucleotide
cctacaggcccttgacgcgcccgggactttcaacc

SEQ ID NO: 53484 - DNA, 35 bp, Artificial Sequence
  Synthetic oligonucleotide
ggacatgcttcgatgatgcagatccaccctttctc

SEQ ID NO: 53485 - DNA, 35 bp, Artificial Sequence
  Synthetic oligonucleotide
gtcacgacatttcctacgctcccaggtattgtgtc

SEQ ID NO: 53486 - DNA, 35 bp, Artificial Sequence
  Synthetic oligonucleotide
ggggctacctccattcgattagcactactcacttc

SEQ ID NO: 53487 - DNA, 35 bp, Artificial Sequence
  Synthetic oligonucleotide
ttgcggccatctcctactgcgataggctcaccttc

SEQ ID NO: 53488 - DNA, 35 bp, Artificial Sequence
  Synthetic oligonucleotide
actagtggcgaggcatcacccagtgcacattcccg

SEQ ID NO: 53489 - DNA, 35 bp, Artificial Sequence
  Synthetic oligonucleotide
actcatgctgtgggccattacaagttctcctgtcg

SEQ ID NO: 53490 - DNA, 35 bp, Artificial Sequence
  Synthetic oligonucleotide
attggggtgcactaagggcggggcgccagaaaggg

SEQ ID NO: 53491 - DNA, 35 bp, Artificial Sequence
  Synthetic oligonucleotide
accccagtacaccgagttgccgaaccctccacggg

SEQ ID NO: 53492 - DNA, 35 bp, Artificial Sequence
  Synthetic oligonucleotide
atcagcccacgtatggtcccggataaggttttggg

SEQ ID NO: 53493 - DNA, 35 bp, Artificial Sequence
  Synthetic oligonucleotide
tctcaactcaccgaccttctgtgccacatggcttg

SEQ ID NO: 53494 - DNA, 35 bp, Artificial Sequence
  Synthetic oligonucleotide
tccccttatcgagatgtcctgctattaccacgaat

SEQ ID NO: 53495 - DNA, 35 bp, Artificial Sequence
  Synthetic oligonucleotide
gcccgaccatccatcccaagttttttgccctgact

SEQ ID NO: 53496 - DNA, 35 bp, Artificial Sequence
  Synthetic oligonucleotide
aaagggcgacatttgctctctggccgcttgctact

SEQ ID NO: 53497 - DNA, 35 bp, Artificial Sequence
  Synthetic oligonucleotide
tagctacacctgccctcttccactttgcacgacct

SEQ ID NO: 53498 - DNA, 35 bp, Artificial Sequence
  Synthetic oligonucleotide
aatccgggggggtgggagatccgggagtctggtct

SEQ ID NO: 53499 - DNA, 35 bp, Artificial Sequence
  Synthetic oligonucleotide
acgcgatgccgatgcccgcaccgccatttgattct

SEQ ID NO: 53500 - DNA, 35 bp, Artificial Sequence
  Synthetic oligonucleotide
ttcatgtcagcactccctatcccgaattgctctgt

SEQ ID NO: 53501 - DNA, 35 bp, Artificial Sequence
  Synthetic oligonucleotide
ggggaggagcgggtacgagagggggtagtttctgt

SEQ ID NO: 53502 - DNA, 35 bp, Artificial Sequence
  Synthetic oligonucleotide
gagcagtgccccctcccacacaccacggaactatt

SEQ ID NO: 53503 - DNA, 35 bp, Artificial Sequence
  Synthetic oligonucleotide
tgtactccatgtggcaaaacaggtccctcgccctt

SEQ ID NO: 53504 - DNA, 35 bp, Artificial Sequence
  Synthetic oligonucleotide
accctctatcaatgccagctcgacctccttccgtt

SEQ ID NO: 53505 - DNA, 35 bp, Artificial Sequence
  Synthetic oligonucleotide
tgacggagggtacggaccgtaatgggaggggtgtt

SEQ ID NO: 53506 - DNA, 35 bp, Artificial Sequence
  Synthetic oligonucleotide
gtgcgacaggcacctaaccgatgtccctgcgcttt

SEQ ID NO: 53507 - DNA, 35 bp, Artificial Sequence
  Synthetic oligonucleotide
gttaatgcccctcttgttactatccatcagccaaa

SEQ ID NO: 53508 - DNA, 35 bp, Artificial Sequence
  Synthetic oligonucleotide
acctacatcaacgggtccccggcctcgctgcccaa

SEQ ID NO: 53509 - DNA, 36 bp, Artificial Sequence
  Synthetic oligonucleotide
gatccgtagggagcgtactcgcagggccacagctaa

SEQ ID NO: 53510 - DNA, 36 bp, Artificial Sequence
  Synthetic oligonucleotide
agccccgaccacgtgcctctagctatacacttcaca

SEQ ID NO: 53511 - DNA, 36 bp, Artificial Sequence
  Synthetic oligonucleotide
tctctgccctgtacacgcttagcgcacattcgccca

SEQ ID NO: 53512 - DNA, 35 bp, Artificial Sequence
  Synthetic oligonucleotide
tgacgcaccagcatcccgccatgcgatctgtgcca

SEQ ID NO: 53513 - DNA, 35 bp, Artificial Sequence
  Synthetic oligonucleotide
ttcccctccctacccagtttagtgtctgcattgca

SEQ ID NO: 53514 - DNA, 36 bp, Artificial Sequence
  Synthetic oligonucleotide
acacgttgtgcggtacttcatcactgtgccacctca

SEQ ID NO: 53515 - DNA, 36 bp, Artificial Sequence
  Synthetic oligonucleotide
gagcgctacctccgtgaagccacgttttctctgtca

SEQ ID NO: 53516 - DNA, 37 bp, Artificial Sequence
  Synthetic oligonucleotide
aactgcccccccttattgctcctcccgtgctaggaga

SEQ ID NO: 53517 - DNA, 36 bp, Artificial Sequence
  Synthetic oligonucleotide
gattaacgctgaagagagggcgggagacgggaacga

SEQ ID NO: 53518 - DNA, 37 bp, Artificial Sequence
  Synthetic oligonucleotide
ttacccgcctcacacatggcgtcatggaatcccacga

SEQ ID NO: 53519 - DNA, 37 bp, Artificial Sequence
  Synthetic oligonucleotide
gacgcatctatctagttcttgtcgatcatctccccga

SEQ ID NO: 53520 - DNA, 37 bp, Artificial Sequence
  Synthetic oligonucleotide
tgtcaccgctcgttcatggatcggcaccacttcccga

SEQ ID NO: 53521 - DNA, 36 bp, Artificial Sequence
  Synthetic oligonucleotide
tcctagctccctcagcagcttgctccgactttccga

SEQ ID NO: 53522 - DNA, 37 bp, Artificial Sequence
  Synthetic oligonucleotide
gatgggaaggcggtgggcaaatgacggagttggtgga

SEQ ID NO: 53523 - DNA, 38 bp, Artificial Sequence
  Synthetic oligonucleotide
acctgcacccctgttatgtctctagctacctcgaatga

SEQ ID NO: 53524 - DNA, 38 bp, Artificial Sequence
  Synthetic oligonucleotide
gccctatccgcacgtatcccgtgaacatactaccatga

SEQ ID NO: 53525 - DNA, 38 bp, Artificial Sequence
  Synthetic oligonucleotide
ttcaccgcctaatgagcacctgggtgctctccacctga

SEQ ID NO: 53526 - DNA, 38 bp, Artificial Sequence
  Synthetic oligonucleotide
gtgcctctaatctacgtgctatcacctgttctcgctga

SEQ ID NO: 53527 - DNA, 38 bp, Artificial Sequence
  Synthetic oligonucleotide
gctgaccaccgccgaccatgttagattaccaccagtga

SEQ ID NO: 53528 - DNA, 38 bp, Artificial Sequence
  Synthetic oligonucleotide
gagtggtggggggtactataggcataagaatggagtga

SEQ ID NO: 53529 - DNA, 37 bp, Artificial Sequence
  Synthetic oligonucleotide
tacgcggaacgtgtggggggtggaagattcctagtga

SEQ ID NO: 53530 - DNA, 38 bp, Artificial Sequence
  Synthetic oligonucleotide
tctcccacctcatgaaaaccgcacgatatccgacgtga

SEQ ID NO: 53531 - DNA, 38 bp, Artificial Sequence
  Synthetic oligonucleotide
tatggaccgacggcacgaagggaaaaatttggaattga

SEQ ID NO: 53532 - DNA, 38 bp, Artificial Sequence
  Synthetic oligonucleotide
taaccacgccgcagctgtgccactttcggccaacttga

SEQ ID NO: 53533 - DNA, 38 bp, Artificial Sequence
  Synthetic oligonucleotide
gaccagtggacgggtggagattggtagtcagacgttga

SEQ ID NO: 53534 - DNA, 38 bp, Artificial Sequence
  Synthetic oligonucleotide
gttgggggggggttaggagcaggaaatggggtgtttga

SEQ ID NO: 53535 - DNA, 35 bp, Artificial Sequence
  Synthetic oligonucleotide
gacgcccactagccctgtttgcccatggagtaata

SEQ ID NO: 53536 - DNA, 34 bp, Artificial Sequence
  Synthetic oligonucleotide
atgtctcgcacctatgcttatccaaacctaatta

SEQ ID NO: 53537 - DNA, 35 bp, Artificial Sequence
  Synthetic oligonucleotide
gagagtctccgcccatccgcaaagtacgactatta

SEQ ID NO: 53538 - DNA, 36 bp, Artificial Sequence
  Synthetic oligonucleotide
ggacaggtggtggggtaaaaatgatcgggatactta

SEQ ID NO: 53539 - DNA, 36 bp, Artificial Sequence
  Synthetic oligonucleotide
tcagacaactcaccctgggctttttgaatatcgtta

SEQ ID NO: 53540 - DNA, 35 bp, Artificial Sequence
  Synthetic oligonucleotide
ggggcttccgaactgcgagcctggcccccctacac

SEQ ID NO: 53541 - DNA, 35 bp, Artificial Sequence
  Synthetic oligonucleotide
atattgtcacatcgatatccgtcccgttctttcac

SEQ ID NO: 53542 - DNA, 35 bp, Artificial Sequence
  Synthetic oligonucleotide
acgctcacccgactccttgtcatccgttgcctacc

SEQ ID NO: 53543 - DNA, 35 bp, Artificial Sequence
  Synthetic oligonucleotide
gcacggcctcctgccacaccccaccgatgattacc

SEQ ID NO: 53544 - DNA, 35 bp, Artificial Sequence
  Synthetic oligonucleotide
gaacccccgatacgccttaagtccattggcgtccc

SEQ ID NO: 53545 - DNA, 35 bp, Artificial Sequence
  Synthetic oligonucleotide
ttcccgactaagccgttctccccgttattccatcc

SEQ ID NO: 53546 - DNA, 35 bp, Artificial Sequence
  Synthetic oligonucleotide
gctccagcgtactgtcgacttccgttgtgccttcc

SEQ ID NO: 53547 - DNA, 35 bp, Artificial Sequence
  Synthetic oligonucleotide
acccacgtagtccttatattcccgattcgcaacgc

SEQ ID NO: 53548 - DNA, 35 bp, Artificial Sequence
  Synthetic oligonucleotide
acaaccgctacacagctgcgcaacacacatctcgc

SEQ ID NO: 53549 - DNA, 35 bp, Artificial Sequence
  Synthetic oligonucleotide
aaacacaagccaatccacttgtgatcaactacatc

SEQ ID NO: 53550 - DNA, 35 bp, Artificial Sequence
  Synthetic oligonucleotide
gcatgacgagcttactgaagtgctcttgttacatc

SEQ ID NO: 53551 - DNA, 35 bp, Artificial Sequence
  Synthetic oligonucleotide
gagggcacacctgtaatatagccgctcgcgatctc

SEQ ID NO: 53552 - DNA, 35 bp, Artificial Sequence
  Synthetic oligonucleotide
gatcatccacttagttgcgtaaccccttaccagtc

SEQ ID NO: 53553 - DNA, 35 bp, Artificial Sequence
  Synthetic oligonucleotide
gcgcggactctcggtgaacactctcctctgttacg

SEQ ID NO: 53554 - DNA, 35 bp, Artificial Sequence
  Synthetic oligonucleotide
gagaaggggcggcgggagaaggatggcgtagggcg

SEQ ID NO: 53555 - DNA, 35 bp, Artificial Sequence
  Synthetic oligonucleotide
tcatctggctcggtacgtagcgccgcccccccgtg

SEQ ID NO: 53556 - DNA, 35 bp, Artificial Sequence
  Synthetic oligonucleotide
atgcatggggccgctcacctctcgccatctaattg

SEQ ID NO: 53557 - DNA, 35 bp, Artificial Sequence
  Synthetic oligonucleotide
caagaggtggaagggggggaatacgggaagaaaat

SEQ ID NO: 53558 - DNA, 35 bp, Artificial Sequence
  Synthetic oligonucleotide
gacacccgcagtgttcctttatggtgatccctgct

SEQ ID NO: 53559 - DNA, 35 bp, Artificial Sequence
  Synthetic oligonucleotide
actgttcacgctcatctttggcaaatgctatctct

SEQ ID NO: 53560 - DNA, 35 bp, Artificial Sequence
  Synthetic oligonucleotide
gtgcaagtccctgcttctccgttttcttcattcgt

SEQ ID NO: 53561 - DNA, 35 bp, Artificial Sequence
  Synthetic oligonucleotide
gcccaaaggcctctttgagaattatacccccttgt

SEQ ID NO: 53562 - DNA, 35 bp, Artificial Sequence
  Synthetic oligonucleotide
acacatccgtatgtcaaatccttcacactctcatt

SEQ ID NO: 53563 - DNA, 35 bp, Artificial Sequence
  Synthetic oligonucleotide
tgttgtctgaccatcctgccatcagttcccgactt

SEQ ID NO: 53564 - DNA, 35 bp, Artificial Sequence
  Synthetic oligonucleotide
ttgtagtgcccaatctggcctttgccttgcctctt

SEQ ID NO: 53565 - DNA, 35 bp, Artificial Sequence
  Synthetic oligonucleotide
acatcatgcccaatgagcactttacacaacgtgtt

SEQ ID NO: 53566 - DNA, 35 bp, Artificial Sequence
  Synthetic oligonucleotide
tccgtggtctacgggccgtccgttttttcgctttt

SEQ ID NO: 53567 - DNA, 35 bp, Artificial Sequence
  Synthetic oligonucleotide
gatcacacgtacacagctgggtaattcccattttt

SEQ ID NO: 53568 - DNA, 36 bp, Artificial Sequence
  Synthetic oligonucleotide
taccgctcttgcaaccatccagctgcccctgggaaa

SEQ ID NO: 53569 - DNA, 36 bp, Artificial Sequence
  Synthetic oligonucleotide
ttgaccccgcttagacccccggtggatctcaataaa

SEQ ID NO: 53570 - DNA, 35 bp, Artificial Sequence
  Synthetic oligonucleotide
tgaacctctcgcgtagctcttacaacccgccacaa

SEQ ID NO: 53571 - DNA, 36 bp, Artificial Sequence
  Synthetic oligonucleotide
tacctcatccgtgctattgtctctagtagttgctaa

SEQ ID NO: 53572 - DNA, 35 bp, Artificial Sequence
  Synthetic oligonucleotide
ttgagccatgagctggccttctaaaatgactctaa

SEQ ID NO: 53573 - DNA, 36 bp, Artificial Sequence
  Synthetic oligonucleotide
tactgtcccgcgccttctcacggccccttctgcaca

SEQ ID NO: 53574 - DNA, 36 bp, Artificial Sequence
  Synthetic oligonucleotide
aacacacccactctattgcgacgcagtcacctgaca

SEQ ID NO: 53575 - DNA, 35 bp, Artificial Sequence
  Synthetic oligonucleotide
tgtctcctggggtttcgcaccctgcccacttgcca

SEQ ID NO: 53576 - DNA, 36 bp, Artificial Sequence
  Synthetic oligonucleotide
tcctgctccaattgttattttatcggctcacgagca

SEQ ID NO: 53577 - DNA, 36 bp, Artificial Sequence
  Synthetic oligonucleotide
tcaacattccgcagtgcgccaatgtttctttcatca

SEQ ID NO: 53578 - DNA, 36 bp, Artificial Sequence
  Synthetic oligonucleotide
cccccatcacctccgatatgcatcgcaacttgttca

SEQ ID NO: 53579 - DNA, 37 bp, Artificial Sequence
  Synthetic oligonucleotide
ttgctcctgcctggctacccctccatctgagacgaga

SEQ ID NO: 53580 - DNA, 37 bp, Artificial Sequence
  Synthetic oligonucleotide
tcagcatcactcggaaggggtcggggtggggcggaga

SEQ ID NO: 53581 - DNA, 37 bp, Artificial Sequence
  Synthetic oligonucleotide
tacacccgatattgacccgccccaagaacaggttaga

SEQ ID NO: 53582 - DNA, 37 bp, Artificial Sequence
  Synthetic oligonucleotide
ttaggtacaaggtggtccggtgggatggtgggagcga

SEQ ID NO: 53583 - DNA, 37 bp, Artificial Sequence
  Synthetic oligonucleotide
ggagcgacacgaagggggcggaagggttttcaggcga

SEQ ID NO: 53584 - DNA, 36 bp, Artificial Sequence
  Synthetic oligonucleotide
gacataggcaacgcgcgatacacacttttttctcga

SEQ ID NO: 53585 - DNA, 37 bp, Artificial Sequence
  Synthetic oligonucleotide
gccaacggtccggtgccctactgtcacccccgccgga

SEQ ID NO: 53586 - DNA, 37 bp, Artificial Sequence
  Synthetic oligonucleotide
accatccgttggcacctgccgactatccgattccgga

SEQ ID NO: 53587 - DNA, 37 bp, Artificial Sequence
  Synthetic oligonucleotide
gacaccatcacgtttcagtcggagacctctttccgga

SEQ ID NO: 53588 - DNA, 37 bp, Artificial Sequence
  Synthetic oligonucleotide
gagcggtgcggggggagagggagataaggggcgggga

SEQ ID NO: 53589 - DNA, 37 bp, Artificial Sequence
  Synthetic oligonucleotide
acagaggcggggaaaggcaacgctcaatggtggggga

SEQ ID NO: 53590 - DNA, 38 bp, Artificial Sequence
  Synthetic oligonucleotide
accgaacgccgaccccgccctccccgttcttctgatga

SEQ ID NO: 53591 - DNA, 38 bp, Artificial Sequence
  Synthetic oligonucleotide
aacagcccaattgtccccatatcgtgtcctaactctga

SEQ ID NO: 53592 - DNA, 38 bp, Artificial Sequence
  Synthetic oligonucleotide
acggaaaagggcatgtaggagtaggaggagggacgtga

SEQ ID NO: 53593 - DNA, 38 bp, Artificial Sequence
  Synthetic oligonucleotide
aacacctgggtgattgtactcgcttcagctctacgtga

SEQ ID NO: 53594 - DNA, 38 bp, Artificial Sequence
  Synthetic oligonucleotide
gtaagtcggaggggattcggaggcggttggtagggtga

SEQ ID NO: 53595 - DNA, 38 bp, Artificial Sequence
  Synthetic oligonucleotide
gacgagagcgttccgaaatcaggaagtaagtggggtga

SEQ ID NO: 53596 - DNA, 38 bp, Artificial Sequence
  Synthetic oligonucleotide
atctgacgcactggacacaggaagggcacaggcattga

SEQ ID NO: 53597 - DNA, 37 bp, Artificial Sequence
  Synthetic oligonucleotide
gcccgacgcccctcttaccgtctatacgtacagttga

SEQ ID NO: 53598 - DNA, 36 bp, Artificial Sequence
  Synthetic oligonucleotide
tccccgtctccatccgtatcatcatccaattgggta

SEQ ID NO: 53599 - DNA, 35 bp, Artificial Sequence
  Synthetic oligonucleotide
tcagacatcctgaggcaacttagcacacaaactac

SEQ ID NO: 53600 - DNA, 35 bp, Artificial Sequence
  Synthetic oligonucleotide
acaccaccctggatccaaaataaaggcaaacctac

SEQ ID NO: 53601 - DNA, 35 bp, Artificial Sequence
  Synthetic oligonucleotide
tccccccctgtcctctttatgggcgcttgctttac

SEQ ID NO: 53602 - DNA, 35 bp, Artificial Sequence
  Synthetic oligonucleotide
tagacatcccatgccgtctggtcttaggcctcacc

SEQ ID NO: 53603 - DNA, 35 bp, Artificial Sequence
  Synthetic oligonucleotide
cacaccatcacattctcttgaaattgcgttttgcc

SEQ ID NO: 53604 - DNA, 35 bp, Artificial Sequence
  Synthetic oligonucleotide
atacggccccatgttcccctagtggcccaggatcc

SEQ ID NO: 53605 - DNA, 35 bp, Artificial Sequence
  Synthetic oligonucleotide
gtacggtgaagcccacccgtgtcaactcaatctcc

SEQ ID NO: 53606 - DNA, 35 bp, Artificial Sequence
  Synthetic oligonucleotide
tgtcttcgcagccgggttgaacctacgcccaccgc

SEQ ID NO: 53607 - DNA, 35 bp, Artificial Sequence
  Synthetic oligonucleotide
acgcgaaattaggagggggcggtaaataaggaatc

SEQ ID NO: 53608 - DNA, 35 bp, Artificial Sequence
  Synthetic oligonucleotide
atcaccctgctccatgcgactatcgtaactgtatc

SEQ ID NO: 53609 - DNA, 35 bp, Artificial Sequence
  Synthetic oligonucleotide
tagattcctgtgacgttagccccagtctttgcttc

SEQ ID NO: 53610 - DNA, 35 bp, Artificial Sequence
  Synthetic oligonucleotide
gattcgggagtgggaagggtggaggtgttttagcg

SEQ ID NO: 53611 - DNA, 35 bp, Artificial Sequence
  Synthetic oligonucleotide
attcactgctgtctccatggctttcgccccttcgg

SEQ ID NO: 53612 - DNA, 35 bp, Artificial Sequence
  Synthetic oligonucleotide
atgctggcaatccctgcattcttagtggttctctg

SEQ ID NO: 53613 - DNA, 35 bp, Artificial Sequence
  Synthetic oligonucleotide
tgactctgcaaaacactgacagccaacatgtggtg

SEQ ID NO: 53614 - DNA, 35 bp, Artificial Sequence
  Synthetic oligonucleotide
gttacggtactgtacttgcgatccatggccctgct

SEQ ID NO: 53615 - DNA, 35 bp, Artificial Sequence
  Synthetic oligonucleotide
gcattccattgactctttacgctccagtactccgt

SEQ ID NO: 53616 - DNA, 35 bp, Artificial Sequence
  Synthetic oligonucleotide
tgccatgatccatgtttacttcctagctttttcgt

SEQ ID NO: 53617 - DNA, 35 bp, Artificial Sequence
  Synthetic oligonucleotide
acagcgaacaccctcgtcttctcttctgctcctgt

SEQ ID NO: 53618 - DNA, 35 bp, Artificial Sequence
  Synthetic oligonucleotide
gggggcggaagggattcgaaggtggaggttgggtt

SEQ ID NO: 53619 - DNA, 35 bp, Artificial Sequence
  Synthetic oligonucleotide
atcgcatccccgccctaatacgttccatttggaaa

SEQ ID NO: 53620 - DNA, 36 bp, Artificial Sequence
  Synthetic oligonucleotide
tattgcgcccgctggtcctactaatgcctctcccaa

SEQ ID NO: 53621 - DNA, 36 bp, Artificial Sequence
  Synthetic oligonucleotide
gtgcgcccctcttagcccgtgttactgcgcattcaa

SEQ ID NO: 53622 - DNA, 35 bp, Artificial Sequence
  Synthetic oligonucleotide
gtggtcgacactaatgcagcgattaaggaacggaa

SEQ ID NO: 53623 - DNA, 36 bp, Artificial Sequence
  Synthetic oligonucleotide
atgggtgcactatcggggttaggggctggggttaca

SEQ ID NO: 53624 - DNA, 35 bp, Artificial Sequence
  Synthetic oligonucleotide
atctagctcgccaaagttcctgcccgacaaaacca

SEQ ID NO: 53625 - DNA, 36 bp, Artificial Sequence
  Synthetic oligonucleotide
tgcgaccctgcctctcaaattggaccataaaaccca

SEQ ID NO: 53626 - DNA, 36 bp, Artificial Sequence
  Synthetic oligonucleotide
ggacctgccatcttgcggtacgacccaaaaccccca

SEQ ID NO: 53627 - DNA, 36 bp, Artificial Sequence
  Synthetic oligonucleotide
tcactccccatttggtccggctggggggtatcccca

SEQ ID NO: 53628 - DNA, 36 bp, Artificial Sequence
  Synthetic oligonucleotide
tgacgcctatgctagaccgatcgcgtgctctcccca

SEQ ID NO: 53629 - DNA, 36 bp, Artificial Sequence
  Synthetic oligonucleotide
gccaccctcaagctagcaagctgcagaactcacgca

SEQ ID NO: 53630 - DNA, 36 bp, Artificial Sequence
  Synthetic oligonucleotide
atcaccacgcctgattaaattcacaccgattacgca

SEQ ID NO: 53631 - DNA, 37 bp, Artificial Sequence
  Synthetic oligonucleotide
gttgccacaggaacgcaggaatggacggacaacgaga

SEQ ID NO: 53632 - DNA, 36 bp, Artificial Sequence
  Synthetic oligonucleotide
gccgtacagccgcgacaccctccccgcccaaaccga

SEQ ID NO: 53633 - DNA, 37 bp, Artificial Sequence
  Synthetic oligonucleotide
gtgaaactgggagggggctgagaggggtcacggccga

SEQ ID NO: 53634 - DNA, 36 bp, Artificial Sequence
  Synthetic oligonucleotide
gcaaggtgcgatagcaagagatcaagaagatggcga

SEQ ID NO: 53635 - DNA, 35 bp, Artificial Sequence
  Synthetic oligonucleotide
ggaaaggtcggaaaacgaaatggttaggggcggga

SEQ ID NO: 53636 - DNA, 38 bp, Artificial Sequence
  Synthetic oligonucleotide
ttggacacgccgaacgagccgagctctccttcctatga

SEQ ID NO: 53637 - DNA, 37 bp, Artificial Sequence
  Synthetic oligonucleotide
gtgaatcccctaatgcttttgttgcctgcctttatga

SEQ ID NO: 53638 - DNA, 37 bp, Artificial Sequence
  Synthetic oligonucleotide
tgattggcggacccggggcaaaaaggggtggcactga

SEQ ID NO: 53639 - DNA, 38 bp, Artificial Sequence
  Synthetic oligonucleotide
tatccgtagatggccagcactcccttctccgtacctga

SEQ ID NO: 53640 - DNA, 36 bp, Artificial Sequence
  Synthetic oligonucleotide
tgcgtgggcctcttcttccgtggtcttccttgctga

SEQ ID NO: 53641 - DNA, 38 bp, Artificial Sequence
  Synthetic oligonucleotide
acacccgctcctcttgctctttcgacgtagatttctga

SEQ ID NO: 53642 - DNA, 37 bp, Artificial Sequence
  Synthetic oligonucleotide
gcctggcaccaattgatccggattcccctcatcgtga

SEQ ID NO: 53643 - DNA, 38 bp, Artificial Sequence
  Synthetic oligonucleotide
ggatccgccgcccccctagttactgaaaatgctcgtga

SEQ ID NO: 53644 - DNA, 38 bp, Artificial Sequence
  Synthetic oligonucleotide
acccgcctaccgcatgcattcaacgtcctctcttgtga

SEQ ID NO: 53645 - DNA, 38 bp, Artificial Sequence
  Synthetic oligonucleotide
ggatccgtagtatcgttctgctacccttccctttgtga

SEQ ID NO: 53646 - DNA, 38 bp, Artificial Sequence
  Synthetic oligonucleotide
tctgtcatcacacgcctcctgattacacacctgattga

SEQ ID NO: 53647 - DNA, 37 bp, Artificial Sequence
  Synthetic oligonucleotide
agcggggggcctcgacctgttttcccttataacttga

SEQ ID NO: 53648 - DNA, 38 bp, Artificial Sequence
  Synthetic oligonucleotide
gcccccacgacctggtccagtcaagaactccggcttga

SEQ ID NO: 53649 - DNA, 38 bp, Artificial Sequence
  Synthetic oligonucleotide
ggatagcggggggtacgcaggtggaacgggatggttga

SEQ ID NO: 53650 - DNA, 36 bp, Artificial Sequence
  Synthetic oligonucleotide
acaaccatacttgactcctgctttgccccgtgttga

SEQ ID NO: 53651 - DNA, 36 bp, Artificial Sequence
  Synthetic oligonucleotide
atttccggcctctccggcaccgttcctcgctaccta

SEQ ID NO: 53652 - DNA, 36 bp, Artificial Sequence
  Synthetic oligonucleotide
atcaccatcccgtacaagcagaatcaactcccccta

SEQ ID NO: 53653 - DNA, 35 bp, Artificial Sequence
  Synthetic oligonucleotide
tgtccaaaccaccgactggcatgagcacgatgcta

SEQ ID NO: 53654 - DNA, 35 bp, Artificial Sequence
  Synthetic oligonucleotide
tgcctgtgcacttctgctcactctttgtgacatta

SEQ ID NO: 53655 - DNA, 36 bp, Artificial Sequence
  Synthetic oligonucleotide
gcaagacacggcacgttttttcttcacataccctta

SEQ ID NO: 53656 - DNA, 35 bp, Artificial Sequence
  Synthetic oligonucleotide
tccaccgacgtggtcagtccgcttcctacccgtac

SEQ ID NO: 53657 - DNA, 35 bp, Artificial Sequence
  Synthetic oligonucleotide
acgcgggaaggggggagtcaacagggcatgggacc

SEQ ID NO: 53658 - DNA, 35 bp, Artificial Sequence
  Synthetic oligonucleotide
ttacaacccgttcagacgactctaggtgtcccccc

SEQ ID NO: 53659 - DNA, 35 bp, Artificial Sequence
  Synthetic oligonucleotide
tacttgccacgaactgcttatatcgcctaagcccc

SEQ ID NO: 53660 - DNA, 35 bp, Artificial Sequence
  Synthetic oligonucleotide
attcccgctgacatccttttaatatggccactggc

SEQ ID NO: 53661 - DNA, 35 bp, Artificial Sequence
  Synthetic oligonucleotide
gtgtctacccccatttgtcatgtccgcagccttgc

SEQ ID NO: 53662 - DNA, 35 bp, Artificial Sequence
  Synthetic oligonucleotide
gtccaacctgcttgcaccatcgctgcttaatttgc

SEQ ID NO: 53663 - DNA, 35 bp, Artificial Sequence
  Synthetic oligonucleotide
ttgttcggcatcactagtttggcatttatctcctc

SEQ ID NO: 53664 - DNA, 35 bp, Artificial Sequence
  Synthetic oligonucleotide
tccacgccgccgctcgtcataatcataaggcgttc

SEQ ID NO: 53665 - DNA, 35 bp, Artificial Sequence
  Synthetic oligonucleotide
ttgctgccaaaccttggtacgcgtgtactccttag

SEQ ID NO: 53666 - DNA, 35 bp, Artificial Sequence
  Synthetic oligonucleotide
acgcgttgcaccctagtccactccacttctatccg

SEQ ID NO: 53667 - DNA, 35 bp, Artificial Sequence
  Synthetic oligonucleotide
gtcgagccaactcttctgctacaatggttccatcg

SEQ ID NO: 53668 - DNA, 35 bp, Artificial Sequence
  Synthetic oligonucleotide
ggtgaacaaatctgatgggtagccgcacctcatcg

SEQ ID NO: 53669 - DNA, 35 bp, Artificial Sequence
  Synthetic oligonucleotide
ggcatgaccgatccatcttcaccgccactcactcg

SEQ ID NO: 53670 - DNA, 35 bp, Artificial Sequence
  Synthetic oligonucleotide
aacacggcccacaggttcgctaccttcctttaggg

SEQ ID NO: 53671 - DNA, 35 bp, Artificial Sequence
  Synthetic oligonucleotide
taccgcgcctgagcgggtctgaatttggtgccctg

SEQ ID NO: 53672 - DNA, 35 bp, Artificial Sequence
  Synthetic oligonucleotide
agagggatgacggtttagcgccctactttctccat

SEQ ID NO: 53673 - DNA, 35 bp, Artificial Sequence
  Synthetic oligonucleotide
tgccaccagcttggttgtgctccttctcggtccat

SEQ ID NO: 53674 - DNA, 35 bp, Artificial Sequence
  Synthetic oligonucleotide
tagtaaccctgtatctgtactcccaagccacttgt

SEQ ID NO: 53675 - DNA, 35 bp, Artificial Sequence
  Synthetic oligonucleotide
agagccgcacgcccagtcttcggctttcacacctt

SEQ ID NO: 53676 - DNA, 35 bp, Artificial Sequence
  Synthetic oligonucleotide
ttgtcgtccgtccctccgcattcgttcgcctgttt

SEQ ID NO: 53677 - DNA, 36 bp, Artificial Sequence
  Synthetic oligonucleotide
tccacacccacagcccgtcgaagcatccaaattcaa

SEQ ID NO: 53678 - DNA, 35 bp, Artificial Sequence
  Synthetic oligonucleotide
tgcagagctcacgtacttcatatggccctgttcaa

SEQ ID NO: 53679 - DNA, 35 bp, Artificial Sequence
  Synthetic oligonucleotide
atgtcactcacttgtatgcgccacactatctcgaa

SEQ ID NO: 53680 - DNA, 36 bp, Artificial Sequence
  Synthetic oligonucleotide
gctgccacaccagtttgggaaaccaccagcctcaca

SEQ ID NO: 53681 - DNA, 36 bp, Artificial Sequence
  Synthetic oligonucleotide
agaccatcagcattaggtttcatcatgttgtttcca

SEQ ID NO: 53682 - DNA, 35 bp, Artificial Sequence
  Synthetic oligonucleotide
gacccgccggagccgactatacctacgcccatgca

SEQ ID NO: 53683 - DNA, 35 bp, Artificial Sequence
  Synthetic oligonucleotide
accgcaagccccgactcctcaatagcaatttgtca

SEQ ID NO: 53684 - DNA, 35 bp, Artificial Sequence
  Synthetic oligonucleotide
gtgcatagtcgaaaccttccccggtccatttttca

SEQ ID NO: 53685 - DNA, 37 bp, Artificial Sequence
  Synthetic oligonucleotide
ttgtgagggtggctgagggacggagagtttatgcaga

SEQ ID NO: 53686 - DNA, 37 bp, Artificial Sequence
  Synthetic oligonucleotide
ttacccggccggtatgttcggcactctcctgctacga

SEQ ID NO: 53687 - DNA, 37 bp, Artificial Sequence
  Synthetic oligonucleotide
tcaatcgcggctatattcatcccactcatcgttacga

SEQ ID NO: 53688 - DNA, 37 bp, Artificial Sequence
  Synthetic oligonucleotide
gccaaccactcctagccttcgggtacgtaagtatcga

SEQ ID NO: 53689 - DNA, 37 bp, Artificial Sequence
  Synthetic oligonucleotide
gcaaaagggcgtggagttggggcaacggggagacgga

SEQ ID NO: 53690 - DNA, 37 bp, Artificial Sequence
  Synthetic oligonucleotide
gatcacaatcgcagctgattatttttctcgtttcgga

SEQ ID NO: 53691 - DNA, 37 bp, Artificial Sequence
  Synthetic oligonucleotide
taacccccgtaacactggcgccacatctctctaggga

SEQ ID NO: 53692 - DNA, 37 bp, Artificial Sequence
  Synthetic oligonucleotide
agccagtcaggaccggtgatgggttgggcgaaatgga

SEQ ID NO: 53693 - DNA, 35 bp, Artificial Sequence
  Synthetic oligonucleotide
taccctctggaccacgagatagccatcatactgga

SEQ ID NO: 53694 - DNA, 38 bp, Artificial Sequence
  Synthetic oligonucleotide
tccgccctctcactacaggtcagcctctcgggacatga

SEQ ID NO: 53695 - DNA, 38 bp, Artificial Sequence
  Synthetic oligonucleotide
aactcgctcacctctctcgtacgcacgaccctcgatga

SEQ ID NO: 53696 - DNA, 37 bp, Artificial Sequence
  Synthetic oligonucleotide
atgctgggtaaaggggagaaggtatggtggatgatga

SEQ ID NO: 53697 - DNA, 37 bp, Artificial Sequence
  Synthetic oligonucleotide
gccgctactagcctctggccgaaccacactcaactga

SEQ ID NO: 53698 - DNA, 38 bp, Artificial Sequence
  Synthetic oligonucleotide
tgacggtggagaggtctttgcccgcacgtttgtactga

SEQ ID NO: 53699 - DNA, 37 bp, Artificial Sequence
  Synthetic oligonucleotide
tccggacggccactcaaaatgaaacttccagccctga

SEQ ID NO: 53700 - DNA, 38 bp, Artificial Sequence
  Synthetic oligonucleotide
gacatccggctcatcatctctgaccgcctagtccctga

SEQ ID NO: 53701 - DNA, 37 bp, Artificial Sequence
  Synthetic oligonucleotide
gattcgtgggagggatatacgggcgggccaaagctga

SEQ ID NO: 53702 - DNA, 38 bp, Artificial Sequence
  Synthetic oligonucleotide
agtgtcgcagacaataccgtactttggccaacctgtga

SEQ ID NO: 53703 - DNA, 38 bp, Artificial Sequence
  Synthetic oligonucleotide
actggtgggggtcaagtagtatgcacgggtgggtgtga

SEQ ID NO: 53704 - DNA, 38 bp, Artificial Sequence
  Synthetic oligonucleotide
tccacggacgcaatcctcgcacactccaggcccattga

SEQ ID NO: 53705 - DNA, 38 bp, Artificial Sequence
  Synthetic oligonucleotide
ttcaactgccgttcagcccctccacctggtctcattga

SEQ ID NO: 53706 - DNA, 38 bp, Artificial Sequence
  Synthetic oligonucleotide
gcgagccaacctcgcgactggccttttactcgccttga

SEQ ID NO: 53707 - DNA, 38 bp, Artificial Sequence
  Synthetic oligonucleotide
gttaaggcgctccttcatgcatctccatccgcttttga

SEQ ID NO: 53708 - DNA, 36 bp, Artificial Sequence
  Synthetic oligonucleotide
accgagtgtccagcacctcgttttccaccggtacta

SEQ ID NO: 53709 - DNA, 36 bp, Artificial Sequence
  Synthetic oligonucleotide
attgcccttcgaatgcgacaaagctagctccatcta

SEQ ID NO: 53710 - DNA, 35 bp, Artificial Sequence
  Synthetic oligonucleotide
tatggtgcacctgagttcttggctccatgtttcta

SEQ ID NO: 53711 - DNA, 35 bp, Artificial Sequence
  Synthetic oligonucleotide
tgcaccatgaagggggaaaacagcagagcaacgta

SEQ ID NO: 53712 - DNA, 35 bp, Artificial Sequence
  Synthetic oligonucleotide
tccacctgcctcacccggacacatactctcccgta

SEQ ID NO: 53713 - DNA, 36 bp, Artificial Sequence
  Synthetic oligonucleotide
gtcccccatgttcaaccctgcctgagacgacgggta

SEQ ID NO: 53714 - DNA, 35 bp, Artificial Sequence
  Synthetic oligonucleotide
agcagtagcttacgttggccctgaatcccccgcac

SEQ ID NO: 53715 - DNA, 35 bp, Artificial Sequence
  Synthetic oligonucleotide
acttctagccacaccattgttacgtcactgccgac

SEQ ID NO: 53716 - DNA, 35 bp, Artificial Sequence
  Synthetic oligonucleotide
atctacgtggcgcaaacctaggcacggcccttacc

SEQ ID NO: 53717 - DNA, 35 bp, Artificial Sequence
  Synthetic oligonucleotide
gactgtcttaccgttttggctctgttggctttacc

SEQ ID NO: 53718 - DNA, 35 bp, Artificial Sequence
  Synthetic oligonucleotide
tggtcactctactatgttttcgtgtggctccaccc

SEQ ID NO: 53719 - DNA, 35 bp, Artificial Sequence
  Synthetic oligonucleotide
aaccgccccggtaggcgggacccaccttcatttgc

SEQ ID NO: 53720 - DNA, 35 bp, Artificial Sequence
  Synthetic oligonucleotide
aaaggcaaccctcattcgtagtcgatcgctgcctc

SEQ ID NO: 53721 - DNA, 35 bp, Artificial Sequence
  Synthetic oligonucleotide
ggatccggaggtatcctgcttttcccatctgcttc

SEQ ID NO: 53722 - DNA, 35 bp, Artificial Sequence
  Synthetic oligonucleotide
atgcacccttacattatcttaccgacactgcagag

SEQ ID NO: 53723 - DNA, 35 bp, Artificial Sequence
  Synthetic oligonucleotide
aaccccgtcgcattcccaaactgtcgatcttgtcg

SEQ ID NO: 53724 - DNA, 35 bp, Artificial Sequence
  Synthetic oligonucleotide
aagggggtcccaagaaagaggcggtgacgggatgg

SEQ ID NO: 53725 - DNA, 35 bp, Artificial Sequence
  Synthetic oligonucleotide
tactgccgcaattctggttgccctcgtaattacat

SEQ ID NO: 53726 - DNA, 35 bp, Artificial Sequence
  Synthetic oligonucleotide
gtgtggaggagggttgaggtggcgaggacaacgat

SEQ ID NO: 53727 - DNA, 35 bp, Artificial Sequence
  Synthetic oligonucleotide
tgttgccccccgagtctggctctgtcgcaaacact

SEQ ID NO: 53728 - DNA, 35 bp, Artificial Sequence
  Synthetic oligonucleotide
atctcgtcgtcgcgtttagaaaacatctcctcgct

SEQ ID NO: 53729 - DNA, 35 bp, Artificial Sequence
  Synthetic oligonucleotide
agatcaggtcaattgtctcatcgtagtccatccgt

SEQ ID NO: 53730 - DNA, 35 bp, Artificial Sequence
  Synthetic oligonucleotide
gagcacgaaactcacgccacctgaatctttcgatt

SEQ ID NO: 53731 - DNA, 35 bp, Artificial Sequence
  Synthetic oligonucleotide
aacaacgtccgcctttggaattctggtactctgtt

SEQ ID NO: 53732 - DNA, 35 bp, Artificial Sequence
  Synthetic oligonucleotide
tgctcaccccatacgtcgatcgcgattgttcattt

SEQ ID NO: 53733 - DNA, 35 bp, Artificial Sequence
  Synthetic oligonucleotide
tgccagtaccatctcagacctctaccaagctgttt

SEQ ID NO: 53734 - DNA, 36 bp, Artificial Sequence
  Synthetic oligonucleotide
ggtggtgaggggcaggtaactcagaacgacacgaaa

SEQ ID NO: 53735 - DNA, 35 bp, Artificial Sequence
  Synthetic oligonucleotide
acaccccttcccgcgacgacgaggcttccaagcaa

SEQ ID NO: 53736 - DNA, 36 bp, Artificial Sequence
  Synthetic oligonucleotide
gtcgaactgatgaacgtgggctaggggggcacataa

SEQ ID NO: 53737 - DNA, 36 bp, Artificial Sequence
  Synthetic oligonucleotide
ggaccatctaccatattcccgtgtgactacctaaca

SEQ ID NO: 53738 - DNA, 36 bp, Artificial Sequence
  Synthetic oligonucleotide
tccacacgccggctcctgttctgtaattcatataca

SEQ ID NO: 53739 - DNA, 36 bp, Artificial Sequence
  Synthetic oligonucleotide
tctctcactaccgacccgagctgcctaatcgaccca

SEQ ID NO: 53740 - DNA, 36 bp, Artificial Sequence
  Synthetic oligonucleotide
accaacacgccactccacttgacggtaattgagcca

SEQ ID NO: 53741 - DNA, 36 bp, Artificial Sequence
  Synthetic oligonucleotide
gcccatctggagccccttgaaccacccgcaatgcca

SEQ ID NO: 53742 - DNA, 35 bp, Artificial Sequence
  Synthetic oligonucleotide
agttccgcacaacacccagccgcacctggcctgca

SEQ ID NO: 53743 - DNA, 36 bp, Artificial Sequence
  Synthetic oligonucleotide
gccgattcccccacggactgagtcatcacatcatca

SEQ ID NO: 53744 - DNA, 35 bp, Artificial Sequence
  Synthetic oligonucleotide
gccgattcgcaacaggaacctgcacccatcactca

SEQ ID NO: 53745 - DNA, 34 bp, Artificial Sequence
  Synthetic oligonucleotide
gacgcagtgctccgttcgatcacggcttatctca

SEQ ID NO: 53746 - DNA, 35 bp, Artificial Sequence
  Synthetic oligonucleotide
gatgagagtaggaaaggagggttgggactaggtca

SEQ ID NO: 53747 - DNA, 37 bp, Artificial Sequence
  Synthetic oligonucleotide
tagaggtgaagatcggtctatggtgggcgggtggaga

SEQ ID NO: 53748 - DNA, 36 bp, Artificial Sequence
  Synthetic oligonucleotide
tcccaacccagttcagcacctggaaccccctaacga

SEQ ID NO: 53749 - DNA, 36 bp, Artificial Sequence
  Synthetic oligonucleotide
tctgccctgacctctctcctacaccctgtgtgacga

SEQ ID NO: 53750 - DNA, 37 bp, Artificial Sequence
  Synthetic oligonucleotide
acatcattggtaggaggggggtgggtggaacggccga

SEQ ID NO: 53751 - DNA, 37 bp, Artificial Sequence
  Synthetic oligonucleotide
gtagggtgaaaagggtggagagatcggcgggtggcga

SEQ ID NO: 53752 - DNA, 37 bp, Artificial Sequence
  Synthetic oligonucleotide
acacggtagtgacaataagggaggaacaaggcatcga

SEQ ID NO: 53753 - DNA, 37 bp, Artificial Sequence
  Synthetic oligonucleotide
gaaccgttgggggtaaagggatgggagtaaccaagga

SEQ ID NO: 53754 - DNA, 37 bp, Artificial Sequence
  Synthetic oligonucleotide
gaccgcccagttcgtcgcactcttcaccggttccgga

SEQ ID NO: 53755 - DNA, 37 bp, Artificial Sequence
  Synthetic oligonucleotide
gccattgacagtcgagacttgggggtgatgaggggga

SEQ ID NO: 53756 - DNA, 37 bp, Artificial Sequence
  Synthetic oligonucleotide
gaggaacgtaccggcggcatgagggggctacggggga

SEQ ID NO: 53757 - DNA, 37 bp, Artificial Sequence
  Synthetic oligonucleotide
ggtacaccccagaagcctcatattgctccccattgga

SEQ ID NO: 53758 - DNA, 38 bp, Artificial Sequence
  Synthetic oligonucleotide
tctcaacccgatgaagatcgggacacctgactaaatga

SEQ ID NO: 53759 - DNA, 38 bp, Artificial Sequence
  Synthetic oligonucleotide
atactgcgcaacccaagatcaccacgcctgtacaatga

SEQ ID NO: 53760 - DNA, 38 bp, Artificial Sequence
  Synthetic oligonucleotide
tccagccactagctcaaaatttgccacactctgcatga

SEQ ID NO: 53761 - DNA, 38 bp, Artificial Sequence
  Synthetic oligonucleotide
gtgacaccgtacagaacaaagggatggggtgcggatga

SEQ ID NO: 53762 - DNA, 36 bp, Artificial Sequence
  Synthetic oligonucleotide
tccaacgaactcgccactcttatcacgcaggtatga

SEQ ID NO: 53763 - DNA, 35 bp, Artificial Sequence
  Synthetic oligonucleotide
gtaccttgcaccagctccatgtttcatccacctga

SEQ ID NO: 53764 - DNA, 38 bp, Artificial Sequence
  Synthetic oligonucleotide
gaaccagctccccccacttaccctcgagtagaccctga

SEQ ID NO: 53765 - DNA, 38 bp, Artificial Sequence
  Synthetic oligonucleotide
acacgttcgtcccgtctgtcggctctactccttcctga

SEQ ID NO: 53766 - DNA, 37 bp, Artificial Sequence
  Synthetic oligonucleotide
gacttcaccgctccccaccttgacgcacatttcctga

SEQ ID NO: 53767 - DNA, 38 bp, Artificial Sequence
  Synthetic oligonucleotide
gccccgccctcctaccgttcttgctctaccggttctga

SEQ ID NO: 53768 - DNA, 37 bp, Artificial Sequence
  Synthetic oligonucleotide
gataccacgtactcaaatacgctctgagccatcttga

SEQ ID NO: 53769 - DNA, 37 bp, Artificial Sequence
  Synthetic oligonucleotide
tccatcacccgaccttttcgtagttctgcctgtttga

SEQ ID NO: 53770 - DNA, 36 bp, Artificial Sequence
  Synthetic oligonucleotide
acccacacagccccagtcgcattatcacggtctata

SEQ ID NO: 53771 - DNA, 36 bp, Artificial Sequence
  Synthetic oligonucleotide
acccaacacccgcctgagagcctcttcactggtata

SEQ ID NO: 53772 - DNA, 36 bp, Artificial Sequence
  Synthetic oligonucleotide
acaaacatgactcctctgcaatatgcacgccccgta

SEQ ID NO: 53773 - DNA, 36 bp, Artificial Sequence
  Synthetic oligonucleotide
gaatctggggaggacggaaaaaatactgtagtcgta

SEQ ID NO: 53774 - DNA, 35 bp, Artificial Sequence
  Synthetic oligonucleotide
tgcagaacgagaggggaaaggcaaaaacaggggta

SEQ ID NO: 53775 - DNA, 35 bp, Artificial Sequence
  Synthetic oligonucleotide
accctgtccccaacccatgcgactcgttgctctta

SEQ ID NO: 53776 - DNA, 36 bp, Artificial Sequence
  Synthetic oligonucleotide
atgttcagccttggtcgtaccgaataccccacttta

SEQ ID NO: 53777 - DNA, 36 bp, Artificial Sequence
  Synthetic oligonucleotide
acccagacctcctacacacgattcctcctgggttta

SEQ ID NO: 53778 - DNA, 35 bp, Artificial Sequence
  Synthetic oligonucleotide
cggacagcattcgggtagccctgtgctgttaacac

SEQ ID NO: 53779 - DNA, 35 bp, Artificial Sequence
  Synthetic oligonucleotide
aacacatgcccggatccgcctattacaacgtttac

SEQ ID NO: 53780 - DNA, 35 bp, Artificial Sequence
  Synthetic oligonucleotide
tttgtccaccccgcctatgtgccgttgccgctgcc

SEQ ID NO: 53781 - DNA, 35 bp, Artificial Sequence
  Synthetic oligonucleotide
atggttcacgtccggtcagtctagtcgtcgcatcc

SEQ ID NO: 53782 - DNA, 35 bp, Artificial Sequence
  Synthetic oligonucleotide
tgaacgtagggtcgaaccgccgtctacgtacttcc

SEQ ID NO: 53783 - DNA, 35 bp, Artificial Sequence
  Synthetic oligonucleotide
tacgccaaatagttgtgctcagccacgttcccagc

SEQ ID NO: 53784 - DNA, 35 bp, Artificial Sequence
  Synthetic oligonucleotide
tcactccctatgctttcacgccacatacggcttgc

SEQ ID NO: 53785 - DNA, 35 bp, Artificial Sequence
  Synthetic oligonucleotide
gacgcctcccaagcctcgagggttacgggtaaatc

SEQ ID NO: 53786 - DNA, 35 bp, Artificial Sequence
  Synthetic oligonucleotide
gccacgcacctcaacccgacacatcccgtgacctc

SEQ ID NO: 53787 - DNA, 35 bp, Artificial Sequence
  Synthetic oligonucleotide
aactccgtcacatacgccctgtaatccctgccttc

SEQ ID NO: 53788 - DNA, 35 bp, Artificial Sequence
  Synthetic oligonucleotide
ggggcatgggggcaggcaggaggggggatcgtagg

SEQ ID NO: 53789 - DNA, 34 bp, Artificial Sequence
  Synthetic oligonucleotide
atctgcgtaccaaaaccatgatatgccccccaat

SEQ ID NO: 53790 - DNA, 35 bp, Artificial Sequence
  Synthetic oligonucleotide
acccaatccaacccgtcatgtcttccatgtgcact

SEQ ID NO: 53791 - DNA, 35 bp, Artificial Sequence
  Synthetic oligonucleotide
gtacgttccatgcgcctttccaaccacggcctcct

SEQ ID NO: 53792 - DNA, 35 bp, Artificial Sequence
  Synthetic oligonucleotide
tgaattacactgcccctcatgatattgcgtgctct

SEQ ID NO: 53793 - DNA, 35 bp, Artificial Sequence
  Synthetic oligonucleotide
gtgaagagcgaggtagggaagcagcaatgacgttt

SEQ ID NO: 53794 - DNA, 36 bp, Artificial Sequence
  Synthetic oligonucleotide
attacccccccagcaccatttcccgagttggggaaa

SEQ ID NO: 53795 - DNA, 36 bp, Artificial Sequence
  Synthetic oligonucleotide
tgccaatgccgacctttaagctcctttacctagcaa

SEQ ID NO: 53796 - DNA, 36 bp, Artificial Sequence
  Synthetic oligonucleotide
tactactgcaggcgaagacggggaaatgggtttcaa

SEQ ID NO: 53797 - DNA, 35 bp, Artificial Sequence
  Synthetic oligonucleotide
accccgccctgcactgactacctcagtaaattgaa

SEQ ID NO: 53798 - DNA, 36 bp, Artificial Sequence
  Synthetic oligonucleotide
aacacacgccgcctaccttatctaccctattggtaa

SEQ ID NO: 53799 - DNA, 37 bp, Artificial Sequence
  Synthetic oligonucleotide
gacaccctccatggccccgattcgcgttctttcccca

SEQ ID NO: 53800 - DNA, 36 bp, Artificial Sequence
  Synthetic oligonucleotide
tgcaccccagtactgcccaggatcctttctccgcca

SEQ ID NO: 53801 - DNA, 37 bp, Artificial Sequence
  Synthetic oligonucleotide
gtgccccaccccgcctggaacctcatttcttcccaga

SEQ ID NO: 53802 - DNA, 37 bp, Artificial Sequence
  Synthetic oligonucleotide
atcacctccatcaggcagtccaatgctattggaacga

SEQ ID NO: 53803 - DNA, 37 bp, Artificial Sequence
  Synthetic oligonucleotide
gtgctagttgggaaagggaagggcaacaggggcacga

SEQ ID NO: 53804 - DNA, 37 bp, Artificial Sequence
  Synthetic oligonucleotide
agagtgtaggctgaggttgggaagcaagggtggacga

SEQ ID NO: 53805 - DNA, 37 bp, Artificial Sequence
  Synthetic oligonucleotide
tgacaccgaagtgctttgccacctagttccctcccga

SEQ ID NO: 53806 - DNA, 36 bp, Artificial Sequence
  Synthetic oligonucleotide
ttcgctccgtacctcacggccttttcccgtttccga

SEQ ID NO: 53807 - DNA, 37 bp, Artificial Sequence
  Synthetic oligonucleotide
ttgcatggtagagtcgctccatctctcgccttatcga

SEQ ID NO: 53808 - DNA, 36 bp, Artificial Sequence
  Synthetic oligonucleotide
tcagggtgggagtgggggagaacgcgcgcatttcga

SEQ ID NO: 53809 - DNA, 37 bp, Artificial Sequence
  Synthetic oligonucleotide
aacccgatgacgttgtctgccccgcccacttgaagga

SEQ ID NO: 53810 - DNA, 37 bp, Artificial Sequence
  Synthetic oligonucleotide
gctcatcggggacagtgttccgggcgggggaagggga

SEQ ID NO: 53811 - DNA, 37 bp, Artificial Sequence
  Synthetic oligonucleotide
accacatggctgaacgcccttccttctcaatttggga

SEQ ID NO: 53812 - DNA, 36 bp, Artificial Sequence
  Synthetic oligonucleotide
agatccaggaacgggtacagcggggagggcggtgga

SEQ ID NO: 53813 - DNA, 36 bp, Artificial Sequence
  Synthetic oligonucleotide
agagcgccgcaagagttctcggagggggggggatga

SEQ ID NO: 53814 - DNA, 38 bp, Artificial Sequence
  Synthetic oligonucleotide
acgtacgcacccgtccgtttccttgttcgttggtatga

SEQ ID NO: 53815 - DNA, 37 bp, Artificial Sequence
  Synthetic oligonucleotide
tgcgccaaccattattggtgctgactttgaaccctga

SEQ ID NO: 53816 - DNA, 38 bp, Artificial Sequence
  Synthetic oligonucleotide
aacaacaaggttggcgccactcatctacctctcgctga

SEQ ID NO: 53817 - DNA, 38 bp, Artificial Sequence
  Synthetic oligonucleotide
tcgcgaacctcctctgacacctgatccctctgttctga

SEQ ID NO: 53818 - DNA, 38 bp, Artificial Sequence
  Synthetic oligonucleotide
tccggagcccgcctttgttttttaaccctaatacgtga

SEQ ID NO: 53819 - DNA, 38 bp, Artificial Sequence
  Synthetic oligonucleotide
tgacccgacacttctcctctgagcctctttgtacgtga

SEQ ID NO: 53820 - DNA, 38 bp, Artificial Sequence
  Synthetic oligonucleotide
ttgaggggccttaagcgcaggcagtgggggggcggtga

SEQ ID NO: 53821 - DNA, 38 bp, Artificial Sequence
  Synthetic oligonucleotide
tcagtcgcggcaccaccccgctgctttagacctgttga

SEQ ID NO: 53822 - DNA, 37 bp, Artificial Sequence
  Synthetic oligonucleotide
acgactccgcactcatgtcgcatcatcccgtttttga

SEQ ID NO: 53823 - DNA, 36 bp, Artificial Sequence
  Synthetic oligonucleotide
tccactccttactcgtaagtccatgttcacgcccta

SEQ ID NO: 53824 - DNA, 36 bp, Artificial Sequence
  Synthetic oligonucleotide
gaagcaaggcggaaccatggctaggggagtggccta

SEQ ID NO: 53825 - DNA, 35 bp, Artificial Sequence
  Synthetic oligonucleotide
gccgccccccacgccattatcgatcgacgcaagta

SEQ ID NO: 53826 - DNA, 35 bp, Artificial Sequence
  Synthetic oligonucleotide
gcacaaaccgaacccaattgagtagaccgccccac

SEQ ID NO: 53827 - DNA, 36 bp, Artificial Sequence
  Synthetic oligonucleotide
acgtgagcgtggcgtctgtgatttcccgtccccacc

SEQ ID NO: 53828 - DNA, 35 bp, Artificial Sequence
  Synthetic oligonucleotide
agccacaatgtacgctgtcggctccatatcccgcc

SEQ ID NO: 53829 - DNA, 35 bp, Artificial Sequence
  Synthetic oligonucleotide
gaacccctactggaacggtcggtcctctacctggc

SEQ ID NO: 53830 - DNA, 35 bp, Artificial Sequence
  Synthetic oligonucleotide
gtaacacacccggaccaccacgttgcatgactttc

SEQ ID NO: 53831 - DNA, 35 bp, Artificial Sequence
  Synthetic oligonucleotide
ttggccccccacccaaccgttgcattcattagcag

SEQ ID NO: 53832 - DNA, 35 bp, Artificial Sequence
  Synthetic oligonucleotide
aacatcgccgaccccctaccagccttcctatgggg

SEQ ID NO: 53833 - DNA, 35 bp, Artificial Sequence
  Synthetic oligonucleotide
gccgagagtgttcaatcgtacccttagtctttctg

SEQ ID NO: 53834 - DNA, 35 bp, Artificial Sequence
  Synthetic oligonucleotide
gatcaacagggggggtgccttactgggtgtgaact

SEQ ID NO: 53835 - DNA, 35 bp, Artificial Sequence
  Synthetic oligonucleotide
ccctcctccgtgcaaaccctagtcatagcttgtct

SEQ ID NO: 53836 - DNA, 35 bp, Artificial Sequence
  Synthetic oligonucleotide
atctcgccattcgcattggttagtcttgcccttct

SEQ ID NO: 53837 - DNA, 35 bp, Artificial Sequence
  Synthetic oligonucleotide
gcccacctcttttctgtttcaccaagccgaacagt

SEQ ID NO: 53838 - DNA, 35 bp, Artificial Sequence
  Synthetic oligonucleotide
ggacatacaccgacaagaggcgacatttggaaggt

SEQ ID NO: 53839 - DNA, 36 bp, Artificial Sequence
  Synthetic oligonucleotide
tatccccggttccctctgcgcgaaagcaatgccctt

SEQ ID NO: 53840 - DNA, 35 bp, Artificial Sequence
  Synthetic oligonucleotide
gtgccgcctcgtagctgccatagtgtttccatctt

SEQ ID NO: 53841 - DNA, 35 bp, Artificial Sequence
  Synthetic oligonucleotide
gcaggacacggctcgttggggaggaggcggggaaa

SEQ ID NO: 53842 - DNA, 35 bp, Artificial Sequence
  Synthetic oligonucleotide
tataccactcaggtcgcgatccttggccaactaaa

SEQ ID NO: 53843 - DNA, 36 bp, Artificial Sequence
  Synthetic oligonucleotide
tgacgcccgcccaattgcactaacagatttccccaa

SEQ ID NO: 53844 - DNA, 36 bp, Artificial Sequence
  Synthetic oligonucleotide
tcccgttcccccaccgatatcacagtcactgcctaa

SEQ ID NO: 53845 - DNA, 36 bp, Artificial Sequence
  Synthetic oligonucleotide
tcttcacggcctggtccttccgcagcctgctcttaa

SEQ ID NO: 53846 - DNA, 36 bp, Artificial Sequence
  Synthetic oligonucleotide
gccgaacgcctggctggctcttcgatactttcttaa

SEQ ID NO: 53847 - DNA, 35 bp, Artificial Sequence
  Synthetic oligonucleotide
gatctccacacttgtattctcgttactcaaggaca

SEQ ID NO: 53848 - DNA, 35 bp, Artificial Sequence
  Synthetic oligonucleotide
gtacactgccacttgtatgttagtgctgttaacca

SEQ ID NO: 53849 - DNA, 36 bp, Artificial Sequence
  Synthetic oligonucleotide
gccgtacaacagcagtaataccgactcccctatcca

SEQ ID NO: 53850 - DNA, 35 bp, Artificial Sequence
  Synthetic oligonucleotide
tctccagccccgcagtaagggtcattttcacctca

SEQ ID NO: 53851 - DNA, 36 bp, Artificial Sequence
  Synthetic oligonucleotide
taccacgcgtcaattctaaaaccccgcacacgctca

SEQ ID NO: 53852 - DNA, 36 bp, Artificial Sequence
  Synthetic oligonucleotide
gagtacacgaacggacacagggaaggcggtaggtca

SEQ ID NO: 53853 - DNA, 37 bp, Artificial Sequence
  Synthetic oligonucleotide
gaaccgtgagggaaatatggctgggggcggatttaga

SEQ ID NO: 53854 - DNA, 37 bp, Artificial Sequence
  Synthetic oligonucleotide
gccctgctccacaccgtacgcttattgtttcacgcga

SEQ ID NO: 53855 - DNA, 36 bp, Artificial Sequence
  Synthetic oligonucleotide
gttgggcgaagtggaggagggacccgggggcatcga

SEQ ID NO: 53856 - DNA, 37 bp, Artificial Sequence
  Synthetic oligonucleotide
gccacctacgctgaacgaacttgactatttatcagga

SEQ ID NO: 53857 - DNA, 37 bp, Artificial Sequence
  Synthetic oligonucleotide
gactaggcgaactcttgcgacaagctgatgggccgga

SEQ ID NO: 53858 - DNA, 37 bp, Artificial Sequence
  Synthetic oligonucleotide
atgaccccagctgctctcttccttttccattcgggga

SEQ ID NO: 53859 - DNA, 37 bp, Artificial Sequence
  Synthetic oligonucleotide
tgtgaagggggggccgagagtgttaaggcatgtggga

SEQ ID NO: 53860 - DNA, 37 bp, Artificial Sequence
  Synthetic oligonucleotide
tgacaatcgaacgccgttagcgaaactatccactgga

SEQ ID NO: 53861 - DNA, 37 bp, Artificial Sequence
  Synthetic oligonucleotide
ttccacccgaggtgttatcagctcttcaatccctgga

SEQ ID NO: 53862 - DNA, 38 bp, Artificial Sequence
  Synthetic oligonucleotide
gatcagtgcgcacatggagtagggggcgttggggatga

SEQ ID NO: 53863 - DNA, 38 bp, Artificial Sequence
  Synthetic oligonucleotide
gggacacgagatggtccttaaggggtgaagggttatga

SEQ ID NO: 53864 - DNA, 38 bp, Artificial Sequence
  Synthetic oligonucleotide
gcaaggagagaggccgaggtgtggcagctagaaactga

SEQ ID NO: 53865 - DNA, 38 bp, Artificial Sequence
  Synthetic oligonucleotide
tgcattgcactctaactgaggctttctttgacccctga

SEQ ID NO: 53866 - DNA, 37 bp, Artificial Sequence
  Synthetic oligonucleotide
atacaactgacctgttttgcttagaaatgccccctga

SEQ ID NO: 53867 - DNA, 37 bp, Artificial Sequence
  Synthetic oligonucleotide
gggagtgggggggtgctggttggggaggcacacgtga

SEQ ID NO: 53868 - DNA, 38 bp, Artificial Sequence
  Synthetic oligonucleotide
gcgagtgagctcgcaagaaatgaaagtagggcccgtga

SEQ ID NO: 53869 - DNA, 38 bp, Artificial Sequence
  Synthetic oligonucleotide
tccggtatccctctgctgtaccctcgattctgccgtga

SEQ ID NO: 53870 - DNA, 36 bp, Artificial Sequence
  Synthetic oligonucleotide
aatccctgggccctcatgctggtagctactccgtga

SEQ ID NO: 53871 - DNA, 38 bp, Artificial Sequence
  Synthetic oligonucleotide
atgggagggtgcggaatgaggcggggtatccctcgtga

SEQ ID NO: 53872 - DNA, 38 bp, Artificial Sequence
  Synthetic oligonucleotide
tccagtcgaaccggcactataggttgtagcaccggtga

SEQ ID NO: 53873 - DNA, 38 bp, Artificial Sequence
  Synthetic oligonucleotide
tccacccccagctatgtatccaactgacttgccggtga

SEQ ID NO: 53874 - DNA, 38 bp, Artificial Sequence
  Synthetic oligonucleotide
gccattgccggcgccttcttgcccgttttttcttttga

SEQ ID NO: 53875 - DNA, 38 bp, Artificial Sequence
  Synthetic oligonucleotide
acgcacagcctccctcgatacataattacgctttttga

SEQ ID NO: 53876 - DNA, 35 bp, Artificial Sequence
  Synthetic oligonucleotide
tgcgtgactgccactggacttgactcctcctgcta

SEQ ID NO: 53877 - DNA, 36 bp, Artificial Sequence
  Synthetic oligonucleotide
tctacgccacttcgcctacgtttcaggatcttgcta

SEQ ID NO: 53878 - DNA, 36 bp, Artificial Sequence
  Synthetic oligonucleotide
aacacaattccggtcctgttgggatgccaactcgta

SEQ ID NO: 53879 - DNA, 35 bp, Artificial Sequence
  Synthetic oligonucleotide
gaacatcccactgtgccccgctccacgctccgaac

SEQ ID NO: 53880 - DNA, 35 bp, Artificial Sequence
  Synthetic oligonucleotide
tctattgccgcattcgtaagacattacatcccccc

SEQ ID NO: 53881 - DNA, 35 bp, Artificial Sequence
  Synthetic oligonucleotide
tgatgcaccgctgccccccaacgtgtgtccctgcc

SEQ ID NO: 53882 - DNA, 35 bp, Artificial Sequence
  Synthetic oligonucleotide
ggtgtgcttggaccatcaccgcctctgtttctgcc

SEQ ID NO: 53883 - DNA, 35 bp, Artificial Sequence
  Synthetic oligonucleotide
gctgcctgggccctacgacgccttgatcgttcatc

SEQ ID NO: 53884 - DNA, 35 bp, Artificial Sequence
  Synthetic oligonucleotide
gtcggttgcgtgccggccgtaccacctcgattttc

SEQ ID NO: 53885 - DNA, 35 bp, Artificial Sequence
  Synthetic oligonucleotide
gttaccacccatgtatttcccgtgtattaccttcg

SEQ ID NO: 53886 - DNA, 35 bp, Artificial Sequence
  Synthetic oligonucleotide
gcacgcgaaagggggcaaatgggcggttgcgaggg

SEQ ID NO: 53887 - DNA, 35 bp, Artificial Sequence
  Synthetic oligonucleotide
atcatccacatcagttcgatccgattacatatttg

SEQ ID NO: 53888 - DNA, 35 bp, Artificial Sequence
  Synthetic oligonucleotide
tacgtgccacagcgttccgcatcacccatcaacat

SEQ ID NO: 53889 - DNA, 35 bp, Artificial Sequence
  Synthetic oligonucleotide
tacacgggacgggaacaagggttggaggaatctat

SEQ ID NO: 53890 - DNA, 35 bp, Artificial Sequence
  Synthetic oligonucleotide
actcccaacccacctcggtggctacaccttttact

SEQ ID NO: 53891 - DNA, 35 bp, Artificial Sequence
  Synthetic oligonucleotide
acatcaccgcaggggaaacccgtacgcttcaacct

SEQ ID NO: 53892 - DNA, 35 bp, Artificial Sequence
  Synthetic oligonucleotide
tgagatccgacaaaccataccgtgataacgctcct

SEQ ID NO: 53893 - DNA, 36 bp, Artificial Sequence
  Synthetic oligonucleotide
tcctcaccgctcctcagttctaggcctcaccccgct

SEQ ID NO: 53894 - DNA, 35 bp, Artificial Sequence
  Synthetic oligonucleotide
gatgcgccgggacttccactctcaggttagcactt

SEQ ID NO: 53895 - DNA, 35 bp, Artificial Sequence
  Synthetic oligonucleotide
actcgcgcaccaaattaggtccatagtctgtcctt

SEQ ID NO: 53896 - DNA, 35 bp, Artificial Sequence
  Synthetic oligonucleotide
gtacacttgcaccccccagtggatatgccacggtt

SEQ ID NO: 53897 - DNA, 36 bp, Artificial Sequence
  Synthetic oligonucleotide
atcacgtaccctgcctccgctaagaaggctttccaa

SEQ ID NO: 53898 - DNA, 36 bp, Artificial Sequence
  Synthetic oligonucleotide
ggaacaggtcgagctatatcctcccgtgcctatcaa

SEQ ID NO: 53899 - DNA, 36 bp, Artificial Sequence
  Synthetic oligonucleotide
tcagtccagtccgcctcaagcccgcacttctgggaa

SEQ ID NO: 53900 - DNA, 35 bp, Artificial Sequence
  Synthetic oligonucleotide
acccgccttcagtacgcttccactgcggcctctaa

SEQ ID NO: 53901 - DNA, 36 bp, Artificial Sequence
  Synthetic oligonucleotide
gatgcgtacgccatatcgtatgtcaatagctctaca

SEQ ID NO: 53902 - DNA, 35 bp, Artificial Sequence
  Synthetic oligonucleotide
acccggccagactactgcatgccaagcaaactcca

SEQ ID NO: 53903 - DNA, 36 bp, Artificial Sequence
  Synthetic oligonucleotide
tgtgccctgcatgccctcccagcacacacgcgcgca

SEQ ID NO: 53904 - DNA, 35 bp, Artificial Sequence
  Synthetic oligonucleotide
gccgaggtaccgctgcttcttctttttgtccctca

SEQ ID NO: 53905 - DNA, 36 bp, Artificial Sequence
  Synthetic oligonucleotide
atcatccgccaccgacccatggtcccctgactttca

SEQ ID NO: 53906 - DNA, 37 bp, Artificial Sequence
  Synthetic oligonucleotide
tagacaccggtcccgttgcataaagcacccttgaaga

SEQ ID NO: 53907 - DNA, 37 bp, Artificial Sequence
  Synthetic oligonucleotide
agagaaaacataagggtcgtgggggaagcaggagaga

SEQ ID NO: 53908 - DNA, 37 bp, Artificial Sequence
  Synthetic oligonucleotide
gacatcccgccaatctacatgtcgtactacactgaga

SEQ ID NO: 53909 - DNA, 37 bp, Artificial Sequence
  Synthetic oligonucleotide
gtaccatcagtctatactcgcgccttttgtccctaga

SEQ ID NO: 53910 - DNA, 36 bp, Artificial Sequence
  Synthetic oligonucleotide
tcaacttgcatctgcgcaccacgatcccatcaacga

SEQ ID NO: 53911 - DNA, 37 bp, Artificial Sequence
  Synthetic oligonucleotide
tacggggtcacagccgtgcatccctgaatcaccccga

SEQ ID NO: 53912 - DNA, 37 bp, Artificial Sequence
  Synthetic oligonucleotide
atacagcgcgtatttactcctttagccatgctcccga

SEQ ID NO: 53913 - DNA, 37 bp, Artificial Sequence
  Synthetic oligonucleotide
tccaatcgcatagttgcgtgcaaaaactacttcccga

SEQ ID NO: 53914 - DNA, 35 bp, Artificial Sequence
  Synthetic oligonucleotide
tccactcataggttctccacgctgtttaatgccga

SEQ ID NO: 53915 - DNA, 37 bp, Artificial Sequence
  Synthetic oligonucleotide
atcaccacagtacacccataaatagttgggcctccga

SEQ ID NO: 53916 - DNA, 36 bp, Artificial Sequence
  Synthetic oligonucleotide
ggaccatgcgcgcccttaatggacctacccactcga

SEQ ID NO: 53917 - DNA, 37 bp, Artificial Sequence
  Synthetic oligonucleotide
ttgcatccccggcatctcgcgttaatgattccttcga

SEQ ID NO: 53918 - DNA, 36 bp, Artificial Sequence
  Synthetic oligonucleotide
gcgagcgatggggcgagcaccgacgtgaggaaagga

SEQ ID NO: 53919 - DNA, 37 bp, Artificial Sequence
  Synthetic oligonucleotide
tcatcgccctcaatctatccgcaacgactcataggga

SEQ ID NO: 53920 - DNA, 37 bp, Artificial Sequence
  Synthetic oligonucleotide
tgagaggagagaaatggtggaggattccggcatggga

SEQ ID NO: 53921 - DNA, 37 bp, Artificial Sequence
  Synthetic oligonucleotide
tccccccaccggcatcaacagtctcctcaccgtggga

SEQ ID NO: 53922 - DNA, 37 bp, Artificial Sequence
  Synthetic oligonucleotide
atgggccaattcgcagggcgggacaatggtcttggga

SEQ ID NO: 53923 - DNA, 37 bp, Artificial Sequence
  Synthetic oligonucleotide
gagggggcggaggcatgacaaagaggtcgaggatgga

SEQ ID NO: 53924 - DNA, 37 bp, Artificial Sequence
  Synthetic oligonucleotide
tgtatggagagggacgggtaaccagagggggagtgga

SEQ ID NO: 53925 - DNA, 37 bp, Artificial Sequence
  Synthetic oligonucleotide
tccgaccaccggttcacattttttactttacattgga

SEQ ID NO: 53926 - DNA, 37 bp, Artificial Sequence
  Synthetic oligonucleotide
gaccggaggtcagggctcaatatggttttgggttgga

SEQ ID NO: 53927 - DNA, 38 bp, Artificial Sequence
  Synthetic oligonucleotide
tcacggccatctggaaatccagccctcctgtcgaatga

SEQ ID NO: 53928 - DNA, 37 bp, Artificial Sequence
  Synthetic oligonucleotide
acaccctgcaactgtacttgcccgctgatattcatga

SEQ ID NO: 53929 - DNA, 38 bp, Artificial Sequence
  Synthetic oligonucleotide
tcgtggtttcgcccgcctttcttcatcggatccgatga

SEQ ID NO: 53930 - DNA, 38 bp, Artificial Sequence
  Synthetic oligonucleotide
gttcaccccgaatgccatgagcactgaaaacatactga

SEQ ID NO: 53931 - DNA, 37 bp, Artificial Sequence
  Synthetic oligonucleotide
tgttgccatccctcaccccacataagtcctgtactga

SEQ ID NO: 53932 - DNA, 37 bp, Artificial Sequence
  Synthetic oligonucleotide
gcccacactgccggcctttcactatacttcacgctga

SEQ ID NO: 53933 - DNA, 38 bp, Artificial Sequence
  Synthetic oligonucleotide
tgcatccccaccgtggccccaatacgatttgtccgtga

SEQ ID NO: 53934 - DNA, 38 bp, Artificial Sequence
  Synthetic oligonucleotide
tgcgggggggggcgaagatgatgcaggggctatcgtga

SEQ ID NO: 53935 - DNA, 37 bp, Artificial Sequence
  Synthetic oligonucleotide
gagtgcaattacgtgtccccgccgccctgtaccttga

SEQ ID NO: 53936 - DNA, 38 bp, Artificial Sequence
  Synthetic oligonucleotide
gtcatggcccttcattgcccacgttactatctcgttga

SEQ ID NO: 53937 - DNA, 38 bp, Artificial Sequence
  Synthetic oligonucleotide
tgcgaaggttacacggataggagggggattgcctttga

SEQ ID NO: 53938 - DNA, 37 bp, Artificial Sequence
  Synthetic oligonucleotide
gtctaccatcgctcactgcgcctcatattccgtttga

SEQ ID NO: 53939 - DNA, 36 bp, Artificial Sequence
  Synthetic oligonucleotide
tctgcgcccccgccctatcatatgttgacgtccata

SEQ ID NO: 53940 - DNA, 36 bp, Artificial Sequence
  Synthetic oligonucleotide
gaattcgcctccgacctattaccgacagaacatcta

SEQ ID NO: 53941 - DNA, 36 bp, Artificial Sequence
  Synthetic oligonucleotide
ggtgggggcaagtagggggccaattccaggggtgta

SEQ ID NO: 53942 - DNA, 35 bp, Artificial Sequence
  Synthetic oligonucleotide
tcattcactaccagccctgtttgcaaaggctgaac

SEQ ID NO: 53943 - DNA, 35 bp, Artificial Sequence
  Synthetic oligonucleotide
taggagtagtgggaaaatagtgggaaaatggggac

SEQ ID NO: 53944 - DNA, 35 bp, Artificial Sequence
  Synthetic oligonucleotide
accggtccgtacaccccgtccacattatctggacc

SEQ ID NO: 53945 - DNA, 35 bp, Artificial Sequence
  Synthetic oligonucleotide
aatcaccccacccgctccgtaaggagatactgacc

SEQ ID NO: 53946 - DNA, 35 bp, Artificial Sequence
  Synthetic oligonucleotide
tatggccccgctgactcaaaacgagcgccatcccc

SEQ ID NO: 53947 - DNA, 35 bp, Artificial Sequence
  Synthetic oligonucleotide
tccgcgatactatcgttaccttagcccgggggccc

SEQ ID NO: 53948 - DNA, 35 bp, Artificial Sequence
  Synthetic oligonucleotide
acaaacctgataatgctcgctgggcatgccactcc

SEQ ID NO: 53949 - DNA, 35 bp, Artificial Sequence
  Synthetic oligonucleotide
gtaccccagggccttgatctaccaagttggcctcc

SEQ ID NO: 53950 - DNA, 35 bp, Artificial Sequence
  Synthetic oligonucleotide
gtcgtccttgctctcagtccctctcgtattcgtcc

SEQ ID NO: 53951 - DNA, 35 bp, Artificial Sequence
  Synthetic oligonucleotide
tgcatacggtccgtaatacacttcacttcgtttcc

SEQ ID NO: 53952 - DNA, 35 bp, Artificial Sequence
  Synthetic oligonucleotide
tcacacgttgtccttcctatcgatccctcatgagc

SEQ ID NO: 53953 - DNA, 35 bp, Artificial Sequence
  Synthetic oligonucleotide
gcgctccgtcccggctactgggcctcgattcacgc

SEQ ID NO: 53954 - DNA, 35 bp, Artificial Sequence
  Synthetic oligonucleotide
gtcgcctgtccgccgttgcactgtcaacctcccgc

SEQ ID NO: 53955 - DNA, 35 bp, Artificial Sequence
  Synthetic oligonucleotide
gccacaccgagagctgagcactgggtagttatcgc

SEQ ID NO: 53956 - DNA, 35 bp, Artificial Sequence
  Synthetic oligonucleotide
gtcgtaacatcggagcaccccatttcttgctctgc

SEQ ID NO: 53957 - DNA, 35 bp, Artificial Sequence
  Synthetic oligonucleotide
tagcacataattgatccctggccctggtgcttatc

SEQ ID NO: 53958 - DNA, 36 bp, Artificial Sequence
  Synthetic oligonucleotide
tcactccgccggccacacgactccgccttcgccttc

SEQ ID NO: 53959 - DNA, 35 bp, Artificial Sequence
  Synthetic oligonucleotide
ttcgccaaggcaatctcgcttaccggtttcatttc

SEQ ID NO: 53960 - DNA, 35 bp, Artificial Sequence
  Synthetic oligonucleotide
tgtcctcccaccgatggtttcctctcgccagcaag

SEQ ID NO: 53961 - DNA, 35 bp, Artificial Sequence
  Synthetic oligonucleotide
ggtgggagcacggctgatacgggataggaaaggag

SEQ ID NO: 53962 - DNA, 35 bp, Artificial Sequence
  Synthetic oligonucleotide
tccgaggtaggtggcggggggcttggaaggtggag

SEQ ID NO: 53963 - DNA, 35 bp, Artificial Sequence
  Synthetic oligonucleotide
ttcgatgcccgcctcatgacgccgccaggagcacg

SEQ ID NO: 53964 - DNA, 35 bp, Artificial Sequence
  Synthetic oligonucleotide
ggggcaccatccacttctgacttctgtcgcaaccg

SEQ ID NO: 53965 - DNA, 35 bp, Artificial Sequence
  Synthetic oligonucleotide
tctactcccatcagacctatcgactatcgacaccg

SEQ ID NO: 53966 - DNA, 35 bp, Artificial Sequence
  Synthetic oligonucleotide
tctagactgctccctcacatgaaatatactctccg

SEQ ID NO: 53967 - DNA, 35 bp, Artificial Sequence
  Synthetic oligonucleotide
actatgccccccagagccacccgccgtgcttagcg

SEQ ID NO: 53968 - DNA, 35 bp, Artificial Sequence
  Synthetic oligonucleotide
gtgcccgtcaatcatcgtcgttcgttgttacctcg

SEQ ID NO: 53969 - DNA, 35 bp, Artificial Sequence
  Synthetic oligonucleotide
gggataggtgcgttggggcacaggggggtcgaggg

SEQ ID NO: 53970 - DNA, 35 bp, Artificial Sequence
  Synthetic oligonucleotide
tattccctttcgccgcatcccgctccgtcgcctgg

SEQ ID NO: 53971 - DNA, 36 bp, Artificial Sequence
  Synthetic oligonucleotide
ttacccgaaatgtgctgccgcctctgtccacccaat

SEQ ID NO: 53972 - DNA, 35 bp, Artificial Sequence
  Synthetic oligonucleotide
ggagaaatggcgggggaacagggaaatcaaggtat

SEQ ID NO: 53973 - DNA, 35 bp, Artificial Sequence
  Synthetic oligonucleotide
atcgccacaatgtatatcaccattgtatcgaccct

SEQ ID NO: 53974 - DNA, 35 bp, Artificial Sequence
  Synthetic oligonucleotide
attgcaggacaagagcctcccctgctccacttcct

SEQ ID NO: 53975 - DNA, 35 bp, Artificial Sequence
  Synthetic oligonucleotide
tacgcacctcacacccccactgttccatcttcgct

SEQ ID NO: 53976 - DNA, 35 bp, Artificial Sequence
  Synthetic oligonucleotide
atctctggcagatcactttaccccgttcgttctct

SEQ ID NO: 53977 - DNA, 35 bp, Artificial Sequence
  Synthetic oligonucleotide
tcaaccgcaatgcgctgggcctgtaggaaaggtgt

SEQ ID NO: 53978 - DNA, 35 bp, Artificial Sequence
  Synthetic oligonucleotide
gcaccaagccgagttgggaatggactggctggtgt

SEQ ID NO: 53979 - DNA, 35 bp, Artificial Sequence
  Synthetic oligonucleotide
gactcgccttatctccatgtgagcccgtgtcctaa

SEQ ID NO: 53980 - DNA, 36 bp, Artificial Sequence
  Synthetic oligonucleotide
aactcacgcagcccccgttatgttcgcgcccgaaca

SEQ ID NO: 53981 - DNA, 35 bp, Artificial Sequence
  Synthetic oligonucleotide
gtgagtatgccccctagtcctgccttccattagca

SEQ ID NO: 53982 - DNA, 35 bp, Artificial Sequence
  Synthetic oligonucleotide
ggatctgcgcagggcatacctcacccagttccgca

SEQ ID NO: 53983 - DNA, 35 bp, Artificial Sequence
  Synthetic oligonucleotide
gtcaaccctctgctcggtactgttcccttgtcgca

SEQ ID NO: 53984 - DNA, 37 bp, Artificial Sequence
  Synthetic oligonucleotide
tcgtatggggtgaaggagaaaaaagggtggggagaga

SEQ ID NO: 53985 - DNA, 37 bp, Artificial Sequence
  Synthetic oligonucleotide
tcgacacgtttgcatacccactacctgcctcgtacga

SEQ ID NO: 53986 - DNA, 37 bp, Artificial Sequence
  Synthetic oligonucleotide
ttgcgggtgggggtagagtgttggggtgggggtacga

SEQ ID NO: 53987 - DNA, 37 bp, Artificial Sequence
  Synthetic oligonucleotide
agtcaccggccgcaacaaccgactctttcctgtacga

SEQ ID NO: 53988 - DNA, 37 bp, Artificial Sequence
  Synthetic oligonucleotide
tatcgtgcagtccccctttcctgcagaatctttccga

SEQ ID NO: 53989 - DNA, 37 bp, Artificial Sequence
  Synthetic oligonucleotide
gacgcgaagcaaacgggccctggcaatatacactcga

SEQ ID NO: 53990 - DNA, 37 bp, Artificial Sequence
  Synthetic oligonucleotide
gcccccctgcgcaaactggcttcgaattcttcctcga

SEQ ID NO: 53991 - DNA, 37 bp, Artificial Sequence
  Synthetic oligonucleotide
agcgatcctgggtcatcccccctcgtaaaaccttcga

SEQ ID NO: 53992 - DNA, 37 bp, Artificial Sequence
  Synthetic oligonucleotide
gaagcgacagggcgagaagcaaggtggtagtagcgga

SEQ ID NO: 53993 - DNA, 37 bp, Artificial Sequence
  Synthetic oligonucleotide
ggtcgaggcggggtggctggcgtggtggcgacgggga

SEQ ID NO: 53994 - DNA, 35 bp, Artificial Sequence
  Synthetic oligonucleotide
tagcgaaaggaaaggagcttaggaaggcggaatga

SEQ ID NO: 53995 - DNA, 38 bp, Artificial Sequence
  Synthetic oligonucleotide
tactccccggtgggaacgacttcctctttaatgcatga

SEQ ID NO: 53996 - DNA, 38 bp, Artificial Sequence
  Synthetic oligonucleotide
gtatgcaccagtagatgatagtgtggtgcactttatga

SEQ ID NO: 53997 - DNA, 37 bp, Artificial Sequence
  Synthetic oligonucleotide
gtccgacgccctacgactccgtgccttaagaccctga

SEQ ID NO: 53998 - DNA, 37 bp, Artificial Sequence
  Synthetic oligonucleotide
gactcccacagggctataccggtcaacgtgccgctga

SEQ ID NO: 53999 - DNA, 38 bp, Artificial Sequence
  Synthetic oligonucleotide
tactgaactcatatcccgtgccaccccagtccctctga

SEQ ID NO: 54000 - DNA, 36 bp, Artificial Sequence
  Synthetic oligonucleotide
tactggtcgcatggctttttccacttcttattctga

SEQ ID NO: 54001 - DNA, 37 bp, Artificial Sequence
  Synthetic oligonucleotide
tccttcacacctatgtctcggaacgtatccgttctga

SEQ ID NO: 54002 - DNA, 38 bp, Artificial Sequence
  Synthetic oligonucleotide
gtcaacgcacaggaggtcctcatactttttttccgtga

SEQ ID NO: 54003 - DNA, 38 bp, Artificial Sequence
  Synthetic oligonucleotide
tgggaggaacggggtagggtagctgatgcgcggggtga

SEQ ID NO: 54004 - DNA, 37 bp, Artificial Sequence
  Synthetic oligonucleotide
gacaaggtggggggggttcgaagacgtaagtaattga

SEQ ID NO: 54005 - DNA, 37 bp, Artificial Sequence
  Synthetic oligonucleotide
tctgccgtcacaccaggcttcacccacctgctattga

SEQ ID NO: 54006 - DNA, 38 bp, Artificial Sequence
  Synthetic oligonucleotide
aaaacaggcgcggacttctgcattctctgactacttga

SEQ ID NO: 54007 - DNA, 38 bp, Artificial Sequence
  Synthetic oligonucleotide
agtttgccacacctcagcgccctccccctatcgcttga

SEQ ID NO: 54008 - DNA, 38 bp, Artificial Sequence
  Synthetic oligonucleotide
tcagcggaggtcagggatgagggatagggaggagttga

SEQ ID NO: 54009 - DNA, 37 bp, Artificial Sequence
  Synthetic oligonucleotide
ggaaggggggcgtggaccagggcataggcggggttga

SEQ ID NO: 54010 - DNA, 38 bp, Artificial Sequence
  Synthetic oligonucleotide
atgccacgtcgcctgcctccctgtttcacacgctttga

SEQ ID NO: 54011 - DNA, 37 bp, Artificial Sequence
  Synthetic oligonucleotide
tgctcacagcggtttatggtttctttgtttagtttga

SEQ ID NO: 54012 - DNA, 38 bp, Artificial Sequence
  Synthetic oligonucleotide
tgtttccctcgacatagctgccttgtactgccttttga

SEQ ID NO: 54013 - DNA, 36 bp, Artificial Sequence
  Synthetic oligonucleotide
tgcccaccctctactcttctaagatttcagttgata

SEQ ID NO: 54014 - DNA, 36 bp, Artificial Sequence
  Synthetic oligonucleotide
gccctgtcaactcatagtactctcgtgtccttctta

SEQ ID NO: 54015 - DNA, 35 bp, Artificial Sequence
  Synthetic oligonucleotide
gtacgaactgcggaggagggacggaccgggggtta

SEQ ID NO: 54016 - DNA, 35 bp, Artificial Sequence
  Synthetic oligonucleotide
gatgtgtaggggggagggatagggcaactgtgtta

SEQ ID NO: 54017 - DNA, 35 bp, Artificial Sequence
  Synthetic oligonucleotide
acctgagggctgtaggcaaaaaggggtagttacac

SEQ ID NO: 54018 - DNA, 35 bp, Artificial Sequence
  Synthetic oligonucleotide
gattatcccgctctctgcctgttgctttatgccac

SEQ ID NO: 54019 - DNA, 35 bp, Artificial Sequence
  Synthetic oligonucleotide
tggacactcccccataggtccaagggccgttgcac

SEQ ID NO: 54020 - DNA, 35 bp, Artificial Sequence
  Synthetic oligonucleotide
gccatcaaaccggcctgaggacgcccatcgcgccc

SEQ ID NO: 54021 - DNA, 35 bp, Artificial Sequence
  Synthetic oligonucleotide
acccacctggcttcccaacggcattgacaactccc

SEQ ID NO: 54022 - DNA, 35 bp, Artificial Sequence
  Synthetic oligonucleotide
tgtgcatagcatcatgtgcgctactatcactttcc

SEQ ID NO: 54023 - DNA, 35 bp, Artificial Sequence
  Synthetic oligonucleotide
tacacttcctctccagcacgctaccctgggaacgc

SEQ ID NO: 54024 - DNA, 35 bp, Artificial Sequence
  Synthetic oligonucleotide
attccccactacagccatcgacaaatgcgccatgc

SEQ ID NO: 54025 - DNA, 35 bp, Artificial Sequence
  Synthetic oligonucleotide
tacgagcgacgtcaccgagggccaaactacccatc

SEQ ID NO: 54026 - DNA, 35 bp, Artificial Sequence
  Synthetic oligonucleotide
ttgcggacgccgttgacctacaatcctttctatag

SEQ ID NO: 54027 - DNA, 35 bp, Artificial Sequence
  Synthetic oligonucleotide
agtatgcccgcccccatcaccctaagcccagaatg

SEQ ID NO: 54028 - DNA, 35 bp, Artificial Sequence
  Synthetic oligonucleotide
gccacatgaggggttggatataggggggagtcgtg

SEQ ID NO: 54029 - DNA, 35 bp, Artificial Sequence
  Synthetic oligonucleotide
taatcgcagcactacacatgctctgggtcttcttg

SEQ ID NO: 54030 - DNA, 35 bp, Artificial Sequence
  Synthetic oligonucleotide
tagacagatacgagaggggggaggtattaggccat

SEQ ID NO: 54031 - DNA, 35 bp, Artificial Sequence
  Synthetic oligonucleotide
tttgacacctcacttgggatacctgccacgatcat

SEQ ID NO: 54032 - DNA, 35 bp, Artificial Sequence
  Synthetic oligonucleotide
acagatgaagggaaagggtgagttctggggagtat

SEQ ID NO: 54033 - DNA, 35 bp, Artificial Sequence
  Synthetic oligonucleotide
ggttgccagcccggccgcactattgtcttctacgt

SEQ ID NO: 54034 - DNA, 35 bp, Artificial Sequence
  Synthetic oligonucleotide
atcacatcgaggggcgtcgaaccacagtcgttttt

SEQ ID NO: 54035 - DNA, 36 bp, Artificial Sequence
  Synthetic oligonucleotide
gatgtgtgccccgggccgtccacccatgatccctaa

SEQ ID NO: 54036 - DNA, 35 bp, Artificial Sequence
  Synthetic oligonucleotide
tgcgggggagaaacaatgggtgcgggggaaggtaa

SEQ ID NO: 54037 - DNA, 36 bp, Artificial Sequence
  Synthetic oligonucleotide
acatcacccccaacgttacatatttagtgtccttaa

SEQ ID NO: 54038 - DNA, 36 bp, Artificial Sequence
  Synthetic oligonucleotide
tactaccacactgtcctagtaaacagttgccaaaca

SEQ ID NO: 54039 - DNA, 35 bp, Artificial Sequence
  Synthetic oligonucleotide
acacgttagccttcccgcgattcctgctgcttaca

SEQ ID NO: 54040 - DNA, 35 bp, Artificial Sequence
  Synthetic oligonucleotide
tatacatcccgaccacagcagtacaaggagttaca

SEQ ID NO: 54041 - DNA, 36 bp, Artificial Sequence
  Synthetic oligonucleotide
gttctgcccataatactatctagcactggtccacca

SEQ ID NO: 54042 - DNA, 36 bp, Artificial Sequence
  Synthetic oligonucleotide
accccaatagagtcggtgccccgttgatcccgccca

SEQ ID NO: 54043 - DNA, 36 bp, Artificial Sequence
  Synthetic oligonucleotide
agcccacacgaatgcctggccctgaaatatcatgca

SEQ ID NO: 54044 - DNA, 36 bp, Artificial Sequence
  Synthetic oligonucleotide
tgtcctgtcgcaccttggttagcccccggtaattca

SEQ ID NO: 54045 - DNA, 35 bp, Artificial Sequence
  Synthetic oligonucleotide
gacccctcaacgccgagtccacacaacggacttca

SEQ ID NO: 54046 - DNA, 36 bp, Artificial Sequence
  Synthetic oligonucleotide
aacgaagtggaaggtgagtgagaaaaggcggtgaga

SEQ ID NO: 54047 - DNA, 37 bp, Artificial Sequence
  Synthetic oligonucleotide
acaggtcgggtgcctactgtgaaccctcttgcctaga

SEQ ID NO: 54048 - DNA, 36 bp, Artificial Sequence
  Synthetic oligonucleotide
ttacatcctcctcaaacttgagcgaccacctaccga

SEQ ID NO: 54049 - DNA, 36 bp, Artificial Sequence
  Synthetic oligonucleotide
ttggaccccgattagaatagtttcactcccttccga

SEQ ID NO: 54050 - DNA, 37 bp, Artificial Sequence
  Synthetic oligonucleotide
acattgcgtcaaccggaaaaccagcactacccttcga

SEQ ID NO: 54051 - DNA, 37 bp, Artificial Sequence
  Synthetic oligonucleotide
gaaggggtggagggagagtgtaatggaggctggcgga

SEQ ID NO: 54052 - DNA, 37 bp, Artificial Sequence
  Synthetic oligonucleotide
atgtgagagatgaggtgggaggttaagcaagagggga

SEQ ID NO: 54053 - DNA, 37 bp, Artificial Sequence
  Synthetic oligonucleotide
taggggacgagtagactgggggggccgagtccgggga

SEQ ID NO: 54054 - DNA, 37 bp, Artificial Sequence
  Synthetic oligonucleotide
ggtgggagccgaaacgagggcacgcactgaaggggga

SEQ ID NO: 54055 - DNA, 37 bp, Artificial Sequence
  Synthetic oligonucleotide
gagggtggagggaaggtgtaagtcgttgatcggtgga

SEQ ID NO: 54056 - DNA, 38 bp, Artificial Sequence
  Synthetic oligonucleotide
taatcagttggggaaggaggcaaaggagcagagaatga

SEQ ID NO: 54057 - DNA, 38 bp, Artificial Sequence
  Synthetic oligonucleotide
tcaggcatggaagtggaaggggaagggttagtgaatga

SEQ ID NO: 54058 - DNA, 37 bp, Artificial Sequence
  Synthetic oligonucleotide
gaggggggtgtgagatacgggggatttcgtgggatga

SEQ ID NO: 54059 - DNA, 37 bp, Artificial Sequence
  Synthetic oligonucleotide
atctcgcacccgcgcccccacccaactgcataactga

SEQ ID NO: 54060 - DNA, 38 bp, Artificial Sequence
  Synthetic oligonucleotide
agggcgtggcggggcgggcgggcgaagaagtccactga

SEQ ID NO: 54061 - DNA, 38 bp, Artificial Sequence
  Synthetic oligonucleotide
gagctgatccactgcagggacaacccaccacaacctga

SEQ ID NO: 54062 - DNA, 38 bp, Artificial Sequence
  Synthetic oligonucleotide
acttgctcgccgttgcatggcaacccaaaccttcctga

SEQ ID NO: 54063 - DNA, 37 bp, Artificial Sequence
  Synthetic oligonucleotide
aacgcccccctctgccctttgttcagtcagtatctga

SEQ ID NO: 54064 - DNA, 38 bp, Artificial Sequence
  Synthetic oligonucleotide
actccgctccctggcctcccgacgcagtttccctctga

SEQ ID NO: 54065 - DNA, 38 bp, Artificial Sequence
  Synthetic oligonucleotide
ttgtgcaataggggaagcacaggaggaggggtgagtga

SEQ ID NO: 54066 - DNA, 38 bp, Artificial Sequence
  Synthetic oligonucleotide
tttgcacgctgcaccacatctccacagatcctacgtga

SEQ ID NO: 54067 - DNA, 37 bp, Artificial Sequence
  Synthetic oligonucleotide
taacatcgcatctcgccgtactctatactttgggtga

SEQ ID NO: 54068 - DNA, 38 bp, Artificial Sequence
  Synthetic oligonucleotide
gactgacctcggtggtgcgaagcggaggaaaatggtga

SEQ ID NO: 54069 - DNA, 37 bp, Artificial Sequence
  Synthetic oligonucleotide
gcaaaggccccattctgctattgaactcttgttgtga

SEQ ID NO: 54070 - DNA, 35 bp, Artificial Sequence
  Synthetic oligonucleotide
gacctggtaaaccacagctgaggcgcccccactta

SEQ ID NO: 54071 - DNA, 36 bp, Artificial Sequence
  Synthetic oligonucleotide
acagggcaattaggtgggggagggtcgcagatctta

SEQ ID NO: 54072 - DNA, 36 bp, Artificial Sequence
  Synthetic oligonucleotide
agctacaccaccgttactaaacgccgtatttcttta

SEQ ID NO: 54073 - DNA, 35 bp, Artificial Sequence
  Synthetic oligonucleotide
gaagaaagctgttgggggggcatgaacgagcgaac

SEQ ID NO: 54074 - DNA, 35 bp, Artificial Sequence
  Synthetic oligonucleotide
agtccagaacatagcctgccccagcccaagccacc

SEQ ID NO: 54075 - DNA, 35 bp, Artificial Sequence
  Synthetic oligonucleotide
gtgggcacactcaaattcgatagatctttgctccc

SEQ ID NO: 54076 - DNA, 35 bp, Artificial Sequence
  Synthetic oligonucleotide
tgcaaaccctgatccccacgcccataacttacgcc

SEQ ID NO: 54077 - DNA, 35 bp, Artificial Sequence
  Synthetic oligonucleotide
taccggcgcccatttcccttttccaagcgatctcc

SEQ ID NO: 54078 - DNA, 35 bp, Artificial Sequence
  Synthetic oligonucleotide
acgactcagtcctaggtcggatcccgcaacttctc

SEQ ID NO: 54079 - DNA, 35 bp, Artificial Sequence
  Synthetic oligonucleotide
tgaataacagcgctgaaacccttcttttaccgttc

SEQ ID NO: 54080 - DNA, 35 bp, Artificial Sequence
  Synthetic oligonucleotide
gtgaccgcacttcaagctctgttgttccaatgttc

SEQ ID NO: 54081 - DNA, 35 bp, Artificial Sequence
  Synthetic oligonucleotide
tacatgcctcgcacgtaacgtttgaattgcctaat

SEQ ID NO: 54082 - DNA, 35 bp, Artificial Sequence
  Synthetic oligonucleotide
tgtgctcgtcgccccgatatgctcccattttctat

SEQ ID NO: 54083 - DNA, 35 bp, Artificial Sequence
  Synthetic oligonucleotide
atgacttccatcccacatgcatccgtagcttaact

SEQ ID NO: 54084 - DNA, 35 bp, Artificial Sequence
  Synthetic oligonucleotide
gccaatcactgtacgcaacatgttccgcagaccct

SEQ ID NO: 54085 - DNA, 35 bp, Artificial Sequence
  Synthetic oligonucleotide
gatcatgccactcaatatattgcttatcgattcct

SEQ ID NO: 54086 - DNA, 35 bp, Artificial Sequence
  Synthetic oligonucleotide
accacagcgttggtcctgcatataacccgccctct

SEQ ID NO: 54087 - DNA, 35 bp, Artificial Sequence
  Synthetic oligonucleotide
gaggagtgcgtggggacaaaagaaggacaagtagt

SEQ ID NO: 54088 - DNA, 35 bp, Artificial Sequence
  Synthetic oligonucleotide
gagatgatgggcggaagggcttgttcgacaacggt

SEQ ID NO: 54089 - DNA, 35 bp, Artificial Sequence
  Synthetic oligonucleotide
gattgcccggcctggtttcctgggacttttccatt

SEQ ID NO: 54090 - DNA, 35 bp, Artificial Sequence
  Synthetic oligonucleotide
agttcgccatctagcgccctccgacgacacctatt

SEQ ID NO: 54091 - DNA, 35 bp, Artificial Sequence
  Synthetic oligonucleotide
accactcatacgtggtaacgtacgtaatcgatctt

SEQ ID NO: 54092 - DNA, 35 bp, Artificial Sequence
  Synthetic oligonucleotide
atcacgccaatctacgctcctacagtcccgcattt

SEQ ID NO: 54093 - DNA, 35 bp, Artificial Sequence
  Synthetic oligonucleotide
tgtcgtaatctcgactgctttatgtttccgccttt

SEQ ID NO: 54094 - DNA, 36 bp, Artificial Sequence
  Synthetic oligonucleotide
acccatcaccgtttgacctgttttgactctgccaaa

SEQ ID NO: 54095 - DNA, 34 bp, Artificial Sequence
  Synthetic oligonucleotide
gaccgtagtaaatccgccgaccgtactgtctcaa

SEQ ID NO: 54096 - DNA, 36 bp, Artificial Sequence
  Synthetic oligonucleotide
aatgacctcatcgtcacaacctgtcgctcgctttaa

SEQ ID NO: 54097 - DNA, 36 bp, Artificial Sequence
  Synthetic oligonucleotide
tactcgcacactatcgcccggcgtaagcacgccaca

SEQ ID NO: 54098 - DNA, 36 bp, Artificial Sequence
  Synthetic oligonucleotide
tatctcacctaactgccgcctatggacacaatcaca

SEQ ID NO: 54099 - DNA, 36 bp, Artificial Sequence
  Synthetic oligonucleotide
gattcgcccacacactcttatcaacacgtttcacca

SEQ ID NO: 54100 - DNA, 36 bp, Artificial Sequence
  Synthetic oligonucleotide
gaagaagggtcgggggaaggtctcgtaaataaggca

SEQ ID NO: 54101 - DNA, 35 bp, Artificial Sequence
  Synthetic oligonucleotide
accccgtacacggactcggactccgctctgaatca

SEQ ID NO: 54102 - DNA, 37 bp, Artificial Sequence
  Synthetic oligonucleotide
ggaggggggaggaatttcagaaaagccggatttcaga

SEQ ID NO: 54103 - DNA, 37 bp, Artificial Sequence
  Synthetic oligonucleotide
gcatgcacgctccccgtcttttctggcgttcttgaga

SEQ ID NO: 54104 - DNA, 37 bp, Artificial Sequence
  Synthetic oligonucleotide
acatgcacagtcaccatcccaactaactctctgtaga

SEQ ID NO: 54105 - DNA, 36 bp, Artificial Sequence
  Synthetic oligonucleotide
gaccctcgatactccctcggcttttacccgagccga

SEQ ID NO: 54106 - DNA, 37 bp, Artificial Sequence
  Synthetic oligonucleotide
tccgaatcgcggaacgaacttatatgcctgccgccga

SEQ ID NO: 54107 - DNA, 37 bp, Artificial Sequence
  Synthetic oligonucleotide
gtgccgggatgggagatccgggcgggtgggaaatcga

SEQ ID NO: 54108 - DNA, 37 bp, Artificial Sequence
  Synthetic oligonucleotide
ggaacagtccgcaattccgccactctctttcactcga

SEQ ID NO: 54109 - DNA, 37 bp, Artificial Sequence
  Synthetic oligonucleotide
gcatcacaccatgtcgtcacaccgacctcacgcagga

SEQ ID NO: 54110 - DNA, 36 bp, Artificial Sequence
  Synthetic oligonucleotide
acagggtgcatgaggggaaaaaacagtgggggcgga

SEQ ID NO: 54111 - DNA, 37 bp, Artificial Sequence
  Synthetic oligonucleotide
ttgtgcccctgttctattatctcaagacacgtaggga

SEQ ID NO: 54112 - DNA, 37 bp, Artificial Sequence
  Synthetic oligonucleotide
gatgccttcgcaggttatgcctcacccccactcggga

SEQ ID NO: 54113 - DNA, 37 bp, Artificial Sequence
  Synthetic oligonucleotide
aaacccccgcttgagctattgcttcgtacatctggga

SEQ ID NO: 54114 - DNA, 36 bp, Artificial Sequence
  Synthetic oligonucleotide
agacgtgctcaccccctgcccccactttctctggga

SEQ ID NO: 54115 - DNA, 37 bp, Artificial Sequence
  Synthetic oligonucleotide
tcaggacagcggaatgaggcatagggggatgaaatga

SEQ ID NO: 54116 - DNA, 38 bp, Artificial Sequence
  Synthetic oligonucleotide
gtgcgacgaggaaaatggagggaggattggcgtgatga

SEQ ID NO: 54117 - DNA, 37 bp, Artificial Sequence
  Synthetic oligonucleotide
cccaaccgcccaaccgcgaaactgaccctcgatatga

SEQ ID NO: 54118 - DNA, 38 bp, Artificial Sequence
  Synthetic oligonucleotide
gtccaccctcacaatttggatctggtccatccgtatga

SEQ ID NO: 54119 - DNA, 38 bp, Artificial Sequence
  Synthetic oligonucleotide
aacctggtaggcaaggtggttaggaatgacggaactga

SEQ ID NO: 54120 - DNA, 38 bp, Artificial Sequence
  Synthetic oligonucleotide
aacgacagggcgtacctgcccgtccttaaccttactga

SEQ ID NO: 54121 - DNA, 38 bp, Artificial Sequence
  Synthetic oligonucleotide
tcatcacttaagctgagctccatggccctagaccctga

SEQ ID NO: 54122 - DNA, 37 bp, Artificial Sequence
  Synthetic oligonucleotide
taccacgcaggcggtatttgcatcattctggccctga

SEQ ID NO: 54123 - DNA, 37 bp, Artificial Sequence
  Synthetic oligonucleotide
accgcagtcacggaacaccacctctcttatgcgctga

SEQ ID NO: 54124 - DNA, 37 bp, Artificial Sequence
  Synthetic oligonucleotide
acattccatcatccccgctcagcgtatactgcgctga

SEQ ID NO: 54125 - DNA, 38 bp, Artificial Sequence
  Synthetic oligonucleotide
gcatctgccctatacaccaacgccggacccatggctga

SEQ ID NO: 54126 - DNA, 38 bp, Artificial Sequence
  Synthetic oligonucleotide
ttagtccggccctcacacgacagatccgccctgagtga

SEQ ID NO: 54127 - DNA, 38 bp, Artificial Sequence
  Synthetic oligonucleotide
gacaccctgcaaattgctcccatattaaactgtcgtga

SEQ ID NO: 54128 - DNA, 38 bp, Artificial Sequence
  Synthetic oligonucleotide
aaggagtggggggtaaattagagacgggggcgtggtga

SEQ ID NO: 54129 - DNA, 38 bp, Artificial Sequence
  Synthetic oligonucleotide
gagaggccaccgatccatccaaatagtaacgcacttga

SEQ ID NO: 54130 - DNA, 38 bp, Artificial Sequence
  Synthetic oligonucleotide
aaccgacaacctccctacctgaattcgacgtattttga

SEQ ID NO: 54131 - DNA, 36 bp, Artificial Sequence
  Synthetic oligonucleotide
atgtgtgtccgccacccacgcctgcatattcaacta

SEQ ID NO: 54132 - DNA, 36 bp, Artificial Sequence
  Synthetic oligonucleotide
taacgtgcccctgttcctttagcgtgatccaggcta

SEQ ID NO: 54133 - DNA, 36 bp, Artificial Sequence
  Synthetic oligonucleotide
tcaggtgtacgggggtggattggtttgacttggcta

SEQ ID NO: 54134 - DNA, 35 bp, Artificial Sequence
  Synthetic oligonucleotide
gccctaatccgccgccctcaatatatcttatgcta

SEQ ID NO: 54135 - DNA, 36 bp, Artificial Sequence
  Synthetic oligonucleotide
actagggagcctaccgccgttctgccgccgttgcta

SEQ ID NO: 54136 - DNA, 36 bp, Artificial Sequence
  Synthetic oligonucleotide
tgtcaccagggggcgagaatagatggaacgtgtgta

SEQ ID NO: 54137 - DNA, 35 bp, Artificial Sequence
  Synthetic oligonucleotide
gaacgacttccagccctatcatggttcaggtaaac

SEQ ID NO: 54138 - DNA, 35 bp, Artificial Sequence
  Synthetic oligonucleotide
acgacccctcacctggtatcaacgccctaaccacc

SEQ ID NO: 54139 - DNA, 35 bp, Artificial Sequence
  Synthetic oligonucleotide
ggtcacttacgatctattgcgatattctgcccacc

SEQ ID NO: 54140 - DNA, 35 bp, Artificial Sequence
  Synthetic oligonucleotide
gcaccgtaagcgtgcacacctctgctaccaaaccc

SEQ ID NO: 54141 - DNA, 35 bp, Artificial Sequence
  Synthetic oligonucleotide
actaccctgacctatggtgttccagccctgccccc

SEQ ID NO: 54142 - DNA, 35 bp, Artificial Sequence
  Synthetic oligonucleotide
gaaacgccctaagtatatcgtcgtcgtccactgcc

SEQ ID NO: 54143 - DNA, 35 bp, Artificial Sequence
  Synthetic oligonucleotide
tcctcgtgaactctgctgttacatccttgcgtgcc

SEQ ID NO: 54144 - DNA, 35 bp, Artificial Sequence
  Synthetic oligonucleotide
tcaaggctcagtctcgtcccctttactgtcactcc

SEQ ID NO: 54145 - DNA, 35 bp, Artificial Sequence
  Synthetic oligonucleotide
tgacgcccctgtgccatccatttccggcgtgttcc

SEQ ID NO: 54146 - DNA, 35 bp, Artificial Sequence
  Synthetic oligonucleotide
atagcgccacccagcgttacctcggttctccaagc

SEQ ID NO: 54147 - DNA, 35 bp, Artificial Sequence
  Synthetic oligonucleotide
taaccagtggcgtgcaagtggcatccagctttatc

SEQ ID NO: 54148 - DNA, 35 bp, Artificial Sequence
  Synthetic oligonucleotide
tcagtgggtctcctctagtacgggcacgaatcctc

SEQ ID NO: 54149 - DNA, 35 bp, Artificial Sequence
  Synthetic oligonucleotide
gaaagcgaagggagggggagaaacgacagacgctc

SEQ ID NO: 54150 - DNA, 33 bp, Artificial Sequence
  Synthetic oligonucleotide
tcatcctacagccagggcctgcccaagctattc

SEQ ID NO: 54151 - DNA, 35 bp, Artificial Sequence
  Synthetic oligonucleotide
atctgggggcgcaacactccgattcatgccgcttc

SEQ ID NO: 54152 - DNA, 35 bp, Artificial Sequence
  Synthetic oligonucleotide
gttgaggctccagcgttccgaacccgctcctgttc

SEQ ID NO: 54153 - DNA, 35 bp, Artificial Sequence
  Synthetic oligonucleotide
acttatccagccactattattgccagtagccaccg

SEQ ID NO: 54154 - DNA, 35 bp, Artificial Sequence
  Synthetic oligonucleotide
tgacccccgtcgttcaaccctgttcatgcatgccg

SEQ ID NO: 54155 - DNA, 35 bp, Artificial Sequence
  Synthetic oligonucleotide
tttgatcgtacaactcgtgaatcatgcccctctcg

SEQ ID NO: 54156 - DNA, 35 bp, Artificial Sequence
  Synthetic oligonucleotide
ttagccaatgccgcacgcaaggtacaatctattcg

SEQ ID NO: 54157 - DNA, 35 bp, Artificial Sequence
  Synthetic oligonucleotide
accaggtgggtggggggggaagggtagtagatagg

SEQ ID NO: 54158 - DNA, 35 bp, Artificial Sequence
  Synthetic oligonucleotide
tcgcacgtgcctaaaggttgaaaaaactactcctg

SEQ ID NO: 54159 - DNA, 35 bp, Artificial Sequence
  Synthetic oligonucleotide
gtccccgccgttatacactctgtcctttgccggtg

SEQ ID NO: 54160 - DNA, 35 bp, Artificial Sequence
  Synthetic oligonucleotide
tccaaacgctacactgcaggacctgtccacttttg

SEQ ID NO: 54161 - DNA, 35 bp, Artificial Sequence
  Synthetic oligonucleotide
ttcgttccctagcgtatcgcccgctgatcatcgct

SEQ ID NO: 54162 - DNA, 35 bp, Artificial Sequence
  Synthetic oligonucleotide
ttcgaaggacgcgcaccccttccatgtaaccttct

SEQ ID NO: 54163 - DNA, 35 bp, Artificial Sequence
  Synthetic oligonucleotide
tgcgcatgttgctgtgtactttgccttctctgtgt

SEQ ID NO: 54164 - DNA, 35 bp, Artificial Sequence
  Synthetic oligonucleotide
aacaccagcctcttcacttatctttccgggccctt

SEQ ID NO: 54165 - DNA, 35 bp, Artificial Sequence
  Synthetic oligonucleotide
accacatcatcgagtgatctttgtcccgggctctt

SEQ ID NO: 54166 - DNA, 35 bp, Artificial Sequence
  Synthetic oligonucleotide
tgttgaccaccctgcatgcgtgtgcctctactgtt

SEQ ID NO: 54167 - DNA, 35 bp, Artificial Sequence
  Synthetic oligonucleotide
accaacatgggtggggtatggccgatctttgcttt

SEQ ID NO: 54168 - DNA, 36 bp, Artificial Sequence
  Synthetic oligonucleotide
gccatcctcgctcatgtcctactttgttcgtcccaa

SEQ ID NO: 54169 - DNA, 36 bp, Artificial Sequence
  Synthetic oligonucleotide
ttccatccgccgcatacgttgatccgcaatcttcaa

SEQ ID NO: 54170 - DNA, 36 bp, Artificial Sequence
  Synthetic oligonucleotide
ggacgccgcgcgggtcacttgatcaactaccacaca

SEQ ID NO: 54171 - DNA, 36 bp, Artificial Sequence
  Synthetic oligonucleotide
taggccggccatcacccgtgggatccgccttgtaca

SEQ ID NO: 54172 - DNA, 35 bp, Artificial Sequence
  Synthetic oligonucleotide
ataacccaagcggccaacaccatcagtccattaca

SEQ ID NO: 54173 - DNA, 36 bp, Artificial Sequence
  Synthetic oligonucleotide
tactggtctgccacaccgtattgtcactgcatgcca

SEQ ID NO: 54174 - DNA, 36 bp, Artificial Sequence
  Synthetic oligonucleotide
aatactcacagggacaagtcaggcagggaaggggca

SEQ ID NO: 54175 - DNA, 36 bp, Artificial Sequence
  Synthetic oligonucleotide
aatggcgctgttccgcatcaactgacgattacctca

SEQ ID NO: 54176 - DNA, 37 bp, Artificial Sequence
  Synthetic oligonucleotide
atcaccacacgcttaaaacgacctcccctacgcaaga

SEQ ID NO: 54177 - DNA, 37 bp, Artificial Sequence
  Synthetic oligonucleotide
tgtcgatgtacgccgccttaactccctgctgtaacga

SEQ ID NO: 54178 - DNA, 37 bp, Artificial Sequence
  Synthetic oligonucleotide
gtcgcccttggtgttacgatccgcccccgttccacga

SEQ ID NO: 54179 - DNA, 37 bp, Artificial Sequence
  Synthetic oligonucleotide
tatcccgacaccacttgcgagccgtaacttaacccga

SEQ ID NO: 54180 - DNA, 37 bp, Artificial Sequence
  Synthetic oligonucleotide
atccgcacggggctggaatacactctccaactatcga

SEQ ID NO: 54181 - DNA, 37 bp, Artificial Sequence
  Synthetic oligonucleotide
ctcaccacctggccacttcttccggtttaataccgga

SEQ ID NO: 54182 - DNA, 37 bp, Artificial Sequence
  Synthetic oligonucleotide
gatcaatccccacactgctgttagccaatatacatga

SEQ ID NO: 54183 - DNA, 38 bp, Artificial Sequence
  Synthetic oligonucleotide
tgtactggaagtggtaggtatacgatgggggcggatga

SEQ ID NO: 54184 - DNA, 38 bp, Artificial Sequence
  Synthetic oligonucleotide
atggaggggaaaaccgttaggggaagaggaaaatatga

SEQ ID NO: 54185 - DNA, 38 bp, Artificial Sequence
  Synthetic oligonucleotide
gagtactgctgaagagggatggtacgcgtatcctatga

SEQ ID NO: 54186 - DNA, 38 bp, Artificial Sequence
  Synthetic oligonucleotide
agcccgccaccccgaacgtagagcgctatacctgctga

SEQ ID NO: 54187 - DNA, 38 bp, Artificial Sequence
  Synthetic oligonucleotide
aaccacgccgccaacacacctgggctcactctttctga

SEQ ID NO: 54188 - DNA, 38 bp, Artificial Sequence
  Synthetic oligonucleotide
tggatccgcactgtttaactagcgcccatcatccgtga

SEQ ID NO: 54189 - DNA, 36 bp, Artificial Sequence
  Synthetic oligonucleotide
tgctcctccctttccgtcgctctacttgccaggtga

SEQ ID NO: 54190 - DNA, 38 bp, Artificial Sequence
  Synthetic oligonucleotide
tactgccggaggggggtatcagactgggaaagcggtga

SEQ ID NO: 54191 - DNA, 38 bp, Artificial Sequence
  Synthetic oligonucleotide
accaccgccttaacccgaactccgatgcccactggtga

SEQ ID NO: 54192 - DNA, 38 bp, Artificial Sequence
  Synthetic oligonucleotide
acgggggaggcaaattagaggaacgtaaaggggtgtga

SEQ ID NO: 54193 - DNA, 38 bp, Artificial Sequence
  Synthetic oligonucleotide
gtagcacccgcgcaacttggctctatctcagttattga

SEQ ID NO: 54194 - DNA, 38 bp, Artificial Sequence
  Synthetic oligonucleotide
acacctccgacgcgcgtccactttgtccattcacttga

SEQ ID NO: 54195 - DNA, 36 bp, Artificial Sequence
  Synthetic oligonucleotide
gcccattgactatatcccctgttatgaaccatttga

SEQ ID NO: 54196 - DNA, 36 bp, Artificial Sequence
  Synthetic oligonucleotide
ttacgccgaccgtcacattgattgctacttcctata

SEQ ID NO: 54197 - DNA, 36 bp, Artificial Sequence
  Synthetic oligonucleotide
gactgccccatcgtggctccttccgtctttacgcta

SEQ ID NO: 54198 - DNA, 36 bp, Artificial Sequence
  Synthetic oligonucleotide
gctcggctactcgcaccaccatgatatccggcgcta

SEQ ID NO: 54199 - DNA, 35 bp, Artificial Sequence
  Synthetic oligonucleotide
ggatgcacccagcacaaagactcaccgcaactcta

SEQ ID NO: 54200 - DNA, 35 bp, Artificial Sequence
  Synthetic oligonucleotide
gcacccggccctcgtccccctccgcttcccctcta

SEQ ID NO: 54201 - DNA, 35 bp, Artificial Sequence
  Synthetic oligonucleotide
atacacagaaaggagggacgagggacaaaagtgta

SEQ ID NO: 54202 - DNA, 36 bp, Artificial Sequence
  Synthetic oligonucleotide
tagaatcacagctgtacctttgttttcctgccatta

SEQ ID NO: 54203 - DNA, 36 bp, Artificial Sequence
  Synthetic oligonucleotide
gaccatacgccaccgaccgttgactccctgtcctta

SEQ ID NO: 54204 - DNA, 37 bp, Artificial Sequence
  Synthetic oligonucleotide
tccatcgcgcccatgacggacatcgttccccatttta

SEQ ID NO: 54205 - DNA, 35 bp, Artificial Sequence
  Synthetic oligonucleotide
atccttacgtccacagtttcttccgctgtctcaac

SEQ ID NO: 54206 - DNA, 35 bp, Artificial Sequence
  Synthetic oligonucleotide
gataggcccgctatagcatttccttgggtcaccac

SEQ ID NO: 54207 - DNA, 35 bp, Artificial Sequence
  Synthetic oligonucleotide
ttattggatgtgtcggcgtgccacctgtcttccac

SEQ ID NO: 54208 - DNA, 35 bp, Artificial Sequence
  Synthetic oligonucleotide
ttgcgacgccttgaacggtttatttgctacctcac

SEQ ID NO: 54209 - DNA, 35 bp, Artificial Sequence
  Synthetic oligonucleotide
ttcgagccgtccagcgttcacctctcacctttcac

SEQ ID NO: 54210 - DNA, 35 bp, Artificial Sequence
  Synthetic oligonucleotide
tgcctcgtcgtactcatctgttgacggcccactcc

SEQ ID NO: 54211 - DNA, 35 bp, Artificial Sequence
  Synthetic oligonucleotide
aattcacgtgcgctcacaccccccttcgccggtcc

SEQ ID NO: 54212 - DNA, 35 bp, Artificial Sequence
  Synthetic oligonucleotide
atgccccttgatcctcataagaacttgatccgggc

SEQ ID NO: 54213 - DNA, 35 bp, Artificial Sequence
  Synthetic oligonucleotide
gatcgccacttcggccttttcggggtcccccgatc

SEQ ID NO: 54214 - DNA, 35 bp, Artificial Sequence
  Synthetic oligonucleotide
gtctggtggaagagggaacgggggagccacgagag

SEQ ID NO: 54215 - DNA, 35 bp, Artificial Sequence
  Synthetic oligonucleotide
ttacgaggggaggggcggagacgatccacttatag

SEQ ID NO: 54216 - DNA, 35 bp, Artificial Sequence
  Synthetic oligonucleotide
tgtgcagggaacacagacgtagggggggtgggtcg

SEQ ID NO: 54217 - DNA, 34 bp, Artificial Sequence
  Synthetic oligonucleotide
gattgaagaactggtggggacggaggacatgtcg

SEQ ID NO: 54218 - DNA, 35 bp, Artificial Sequence
  Synthetic oligonucleotide
ggccacaatcccatccgcgcctttcgttacctagg

SEQ ID NO: 54219 - DNA, 35 bp, Artificial Sequence
  Synthetic oligonucleotide
ttgccgagccctcccctgctttaagcacgcccttg

SEQ ID NO: 54220 - DNA, 35 bp, Artificial Sequence
  Synthetic oligonucleotide
catggatcgcgccactcctcacggtctgttatgat

SEQ ID NO: 54221 - DNA, 35 bp, Artificial Sequence
  Synthetic oligonucleotide
actagagcctccgcctatatctgaaactcagtact

SEQ ID NO: 54222 - DNA, 35 bp, Artificial Sequence
  Synthetic oligonucleotide
gttgaacttccgtgtacagtttactttttttgcct

SEQ ID NO: 54223 - DNA, 35 bp, Artificial Sequence
  Synthetic oligonucleotide
gtccacagtgggacggttgcaattactgctcattt

SEQ ID NO: 54224 - DNA, 35 bp, Artificial Sequence
  Synthetic oligonucleotide
tcgtgaggcgggcggaaggggcggccgaggaggaa

SEQ ID NO: 54225 - DNA, 35 bp, Artificial Sequence
  Synthetic oligonucleotide
tatcgcacgcacctttctcccgagccccccgggaa

SEQ ID NO: 54226 - DNA, 36 bp, Artificial Sequence
  Synthetic oligonucleotide
atcgccaaccacgggctttgttggcccacatactaa

SEQ ID NO: 54227 - DNA, 36 bp, Artificial Sequence
  Synthetic oligonucleotide
gattcatcctgaggtcgtaagcgagcccttacaaca

SEQ ID NO: 54228 - DNA, 36 bp, Artificial Sequence
  Synthetic oligonucleotide
gctacgcacacttgttaaacttccggggaatgcaca

SEQ ID NO: 54229 - DNA, 35 bp, Artificial Sequence
  Synthetic oligonucleotide
taactgacccgcaccgatgacgtgtcgtgtgccca

SEQ ID NO: 54230 - DNA, 36 bp, Artificial Sequence
  Synthetic oligonucleotide
tagtgtgcaaacgagttattgcccaatgcttctcca

SEQ ID NO: 54231 - DNA, 35 bp, Artificial Sequence
  Synthetic oligonucleotide
gccttatcgccccttctctcgtactatagtgcgca

SEQ ID NO: 54232 - DNA, 36 bp, Artificial Sequence
  Synthetic oligonucleotide
gaagcagctccattgcccccggccgctccccatgca

SEQ ID NO: 54233 - DNA, 35 bp, Artificial Sequence
  Synthetic oligonucleotide
gagcggtcacttcattcatagcgtttccaagttca

SEQ ID NO: 54234 - DNA, 36 bp, Artificial Sequence
  Synthetic oligonucleotide
gtttacgtctgtttcctgcctattacacctgtttca

SEQ ID NO: 54235 - DNA, 36 bp, Artificial Sequence
  Synthetic oligonucleotide
gtctactcgccacccctcttgctaggcagtccaaga

SEQ ID NO: 54236 - DNA, 37 bp, Artificial Sequence
  Synthetic oligonucleotide
tacgcacttccagcagctgatgtattctctgcccaga

SEQ ID NO: 54237 - DNA, 37 bp, Artificial Sequence
  Synthetic oligonucleotide
ttacgcgaagcagacgtggggggtggtaaagtgcaga

SEQ ID NO: 54238 - DNA, 37 bp, Artificial Sequence
  Synthetic oligonucleotide
tatgcataccctcaccacaagttcgccttttagccga

SEQ ID NO: 54239 - DNA, 37 bp, Artificial Sequence
  Synthetic oligonucleotide
acaccctcgtagttcccgaattcgaacccctttccga

SEQ ID NO: 54240 - DNA, 37 bp, Artificial Sequence
  Synthetic oligonucleotide
aaagagtgaggcggggagggaggtatgtggttcagga

SEQ ID NO: 54241 - DNA, 37 bp, Artificial Sequence
  Synthetic oligonucleotide
gcccatcactggtactcacccaccaacaggctacgga

SEQ ID NO: 54242 - DNA, 37 bp, Artificial Sequence
  Synthetic oligonucleotide
agtgagggggacatggaaaaaatggaacccgcatgga

SEQ ID NO: 54243 - DNA, 37 bp, Artificial Sequence
  Synthetic oligonucleotide
aacgacgggggggcattcgggtaggtgtgcaagtgga

SEQ ID NO: 54244 - DNA, 37 bp, Artificial Sequence
  Synthetic oligonucleotide
acgaatcccgtgctactcgccgacactccgcattgga

SEQ ID NO: 54245 - DNA, 38 bp, Artificial Sequence
  Synthetic oligonucleotide
gttaacgccggttccatatgagcggccctttcccatga

SEQ ID NO: 54246 - DNA, 38 bp, Artificial Sequence
  Synthetic oligonucleotide
attctcccgctgttttccggatcctgtacactgcatga

SEQ ID NO: 54247 - DNA, 38 bp, Artificial Sequence
  Synthetic oligonucleotide
ggacctagcgcccctcatgctcacacaccgtcgtatga

SEQ ID NO: 54248 - DNA, 38 bp, Artificial Sequence
  Synthetic oligonucleotide
gtcccgccccattaccgatggttccctgtcacacctga

SEQ ID NO: 54249 - DNA, 38 bp, Artificial Sequence
  Synthetic oligonucleotide
atctgcccccgagaatgccattgcccttcagcccttga

SEQ ID NO: 54250 - DNA, 38 bp, Artificial Sequence
  Synthetic oligonucleotide
ttactgcccgcttgtgggctattcacctccccttttga

SEQ ID NO: 54251 - DNA, 36 bp, Artificial Sequence
  Synthetic oligonucleotide
gtgaaggaaaggtgaagccacacgatgaaaggaata

SEQ ID NO: 54252 - DNA, 35 bp, Artificial Sequence
  Synthetic oligonucleotide
gaggttctccgccacgtttcttatttcactgcata

SEQ ID NO: 54253 - DNA, 35 bp, Artificial Sequence
  Synthetic oligonucleotide
gtggacaatcaagcgagggcaaggtgacgtggata

SEQ ID NO: 54254 - DNA, 35 bp, Artificial Sequence
  Synthetic oligonucleotide
actcggtgggtcccatcgatttcccgcctctcgta

SEQ ID NO: 54255 - DNA, 36 bp, Artificial Sequence
  Synthetic oligonucleotide
tcaccgaaccaaactctgcttatgaaccactcggta

SEQ ID NO: 54256 - DNA, 35 bp, Artificial Sequence
  Synthetic oligonucleotide
tccactctgccgcgccgccggactcaaccacagac

SEQ ID NO: 54257 - DNA, 35 bp, Artificial Sequence
  Synthetic oligonucleotide
gttcaggcttcaccgatcctcacgttccctacacc

SEQ ID NO: 54258 - DNA, 35 bp, Artificial Sequence
  Synthetic oligonucleotide
gcacctgcacctcgcttaagtgcaaattagccacc

SEQ ID NO: 54259 - DNA, 35 bp, Artificial Sequence
  Synthetic oligonucleotide
acgactgacattcgcgctttaagtttctacgcacc

SEQ ID NO: 54260 - DNA, 35 bp, Artificial Sequence
  Synthetic oligonucleotide
gcgccccatcactactcgcagacaccaatatccgc

SEQ ID NO: 54261 - DNA, 35 bp, Artificial Sequence
  Synthetic oligonucleotide
tgacatccatcttcatgttactctctatgctaggc

SEQ ID NO: 54262 - DNA, 35 bp, Artificial Sequence
  Synthetic oligonucleotide
aagaacagtcccgcttctcatcgcggctctcctgc

SEQ ID NO: 54263 - DNA, 35 bp, Artificial Sequence
  Synthetic oligonucleotide
tgctaaggtcgttctttcatcctcccttcccgctc

SEQ ID NO: 54264 - DNA, 35 bp, Artificial Sequence
  Synthetic oligonucleotide
ttgtcgcctgatcttttggtgggccctcctgtctc

SEQ ID NO: 54265 - DNA, 36 bp, Artificial Sequence
  Synthetic oligonucleotide
tgcacccgcgatctacttggttggtcatctgttctc

SEQ ID NO: 54266 - DNA, 35 bp, Artificial Sequence
  Synthetic oligonucleotide
agcgaggtcgcgttacttttgtccacactccggtc

SEQ ID NO: 54267 - DNA, 35 bp, Artificial Sequence
  Synthetic oligonucleotide
acctagtacgactgttgttagtgccccgtaatgtc

SEQ ID NO: 54268 - DNA, 35 bp, Artificial Sequence
  Synthetic oligonucleotide
tagctcgccccatgcgccccccactttatgtcttc

SEQ ID NO: 54269 - DNA, 35 bp, Artificial Sequence
  Synthetic oligonucleotide
tccgtatacgtactaatgtgccacctaatgcgttc

SEQ ID NO: 54270 - DNA, 35 bp, Artificial Sequence
  Synthetic oligonucleotide
gatcacacacacccttatgctggcggaatgccaag

SEQ ID NO: 54271 - DNA, 35 bp, Artificial Sequence
  Synthetic oligonucleotide
ttcgcactacaccaccgtccttttcaatgatcaag

SEQ ID NO: 54272 - DNA, 35 bp, Artificial Sequence
  Synthetic oligonucleotide
tagtactgcaccgcttatataacagctcggttgag

SEQ ID NO: 54273 - DNA, 35 bp, Artificial Sequence
  Synthetic oligonucleotide
tacgtgccatcctgcccccggcgaaaacttgaccg

SEQ ID NO: 54274 - DNA, 35 bp, Artificial Sequence
  Synthetic oligonucleotide
tcacccacatatgcaatggcgcctagtacgtcccg

SEQ ID NO: 54275 - DNA, 35 bp, Artificial Sequence
  Synthetic oligonucleotide
tgccccgcgcgtttctaacaccttcgactactgtg

SEQ ID NO: 54276 - DNA, 35 bp, Artificial Sequence
  Synthetic oligonucleotide
accatcgttcgtgcatgccctcctatgcatcccat

SEQ ID NO: 54277 - DNA, 35 bp, Artificial Sequence
  Synthetic oligonucleotide
ttcagctccccatagttacgacaaacgtctcccat

SEQ ID NO: 54278 - DNA, 35 bp, Artificial Sequence
  Synthetic oligonucleotide
aagccaatcctcggtcccgtatcccgccactgcat

SEQ ID NO: 54279 - DNA, 35 bp, Artificial Sequence
  Synthetic oligonucleotide
accatcggccaaacaacgcatactcccgcacggat

SEQ ID NO: 54280 - DNA, 35 bp, Artificial Sequence
  Synthetic oligonucleotide
ggtgcattgcccttcgaagccaacatattccctat

SEQ ID NO: 54281 - DNA, 35 bp, Artificial Sequence
  Synthetic oligonucleotide
tccacgtgtcaaagctagcatgattcgaccctact

SEQ ID NO: 54282 - DNA, 35 bp, Artificial Sequence
  Synthetic oligonucleotide
gcctaggccaaacctggaacgcaccctcgaacgct

SEQ ID NO: 54283 - DNA, 35 bp, Artificial Sequence
  Synthetic oligonucleotide
tcatacgccgccgtaacgactataacgctccctct

SEQ ID NO: 54284 - DNA, 35 bp, Artificial Sequence
  Synthetic oligonucleotide
gtaccggacggaggtagcgttcgatttccatctct

SEQ ID NO: 54285 - DNA, 35 bp, Artificial Sequence
  Synthetic oligonucleotide
aaactactccgccgtttgctttagaatcatttcgt

SEQ ID NO: 54286 - DNA, 35 bp, Artificial Sequence
  Synthetic oligonucleotide
acgcaggcctttcctgtgtcctaccaatctttctt

SEQ ID NO: 54287 - DNA, 36 bp, Artificial Sequence
  Synthetic oligonucleotide
ttgctggtacagcgcaaatccgtcctgcttttacaa

SEQ ID NO: 54288 - DNA, 36 bp, Artificial Sequence
  Synthetic oligonucleotide
tagacccccacaagccagcgtgactaggtaccccaa

SEQ ID NO: 54289 - DNA, 35 bp, Artificial Sequence
  Synthetic oligonucleotide
gaggggtgtgagggctatgggtgggaatgcgcgaa

SEQ ID NO: 54290 - DNA, 35 bp, Artificial Sequence
  Synthetic oligonucleotide
ctagcgcccaaaccagatacgcgtttatgctcgaa

SEQ ID NO: 54291 - DNA, 36 bp, Artificial Sequence
  Synthetic oligonucleotide
aatggcccgacctgaccccctgcttgcatgtaccca

SEQ ID NO: 54292 - DNA, 35 bp, Artificial Sequence
  Synthetic oligonucleotide
gctgcattacgcaaactagcatccctccacgagca

SEQ ID NO: 54293 - DNA, 36 bp, Artificial Sequence
  Synthetic oligonucleotide
tgcatgcctaggtcgccctccggttctttgctcgca

SEQ ID NO: 54294 - DNA, 36 bp, Artificial Sequence
  Synthetic oligonucleotide
gcatccactcgcctctcatactgtgccaaacaatca

SEQ ID NO: 54295 - DNA, 36 bp, Artificial Sequence
  Synthetic oligonucleotide
gacgtagtcgccatacgaaagatctggcactcttca

SEQ ID NO: 54296 - DNA, 37 bp, Artificial Sequence
  Synthetic oligonucleotide
atgggaggggattggctgcgagggacttaagtggaga

SEQ ID NO: 54297 - DNA, 37 bp, Artificial Sequence
  Synthetic oligonucleotide
tcactcccgaattggtcgcttatagtaccgcctgaga

SEQ ID NO: 54298 - DNA, 37 bp, Artificial Sequence
  Synthetic oligonucleotide
tcgtgagggagggagaaatggggcgcgaggttgacga

SEQ ID NO: 54299 - DNA, 37 bp, Artificial Sequence
  Synthetic oligonucleotide
gtgcctcatgtcggattctttacacctccttctgcga

SEQ ID NO: 54300 - DNA, 36 bp, Artificial Sequence
  Synthetic oligonucleotide
tctacgccctctccttccgagctcttctagcgagga

SEQ ID NO: 54301 - DNA, 37 bp, Artificial Sequence
  Synthetic oligonucleotide
aacaccctcctcgatggtccgatcctatacccccgga

SEQ ID NO: 54302 - DNA, 37 bp, Artificial Sequence
  Synthetic oligonucleotide
tcacgtggccagatccgccatcccttgcactctcgga

SEQ ID NO: 54303 - DNA, 37 bp, Artificial Sequence
  Synthetic oligonucleotide
gataggtgaggattacagcataaagtgggcgaaggga

SEQ ID NO: 54304 - DNA, 37 bp, Artificial Sequence
  Synthetic oligonucleotide
gagcgggctgcaggcgtttgttatgggggggtatgga

SEQ ID NO: 54305 - DNA, 38 bp, Artificial Sequence
  Synthetic oligonucleotide
gcacagtgccaacttgcttacgccctttcgttccatga

SEQ ID NO: 54306 - DNA, 38 bp, Artificial Sequence
  Synthetic oligonucleotide
actcacaaaccgtcagccctttttattctctgtcatga

SEQ ID NO: 54307 - DNA, 38 bp, Artificial Sequence
  Synthetic oligonucleotide
agaacacccccacacttggctcgccgtcacgcccctga

SEQ ID NO: 54308 - DNA, 38 bp, Artificial Sequence
  Synthetic oligonucleotide
tcccatccttgacgtgggttaatcctcaccttgcctga

SEQ ID NO: 54309 - DNA, 38 bp, Artificial Sequence
  Synthetic oligonucleotide
ctcaccacacatctggacctggccatccactcctctga

SEQ ID NO: 54310 - DNA, 36 bp, Artificial Sequence
  Synthetic oligonucleotide
tcacgcaattgcaataacggatttcctgatttctga

SEQ ID NO: 54311 - DNA, 37 bp, Artificial Sequence
  Synthetic oligonucleotide
tcctatgcaccccgtggtcctccgcttcctgccgtga

SEQ ID NO: 54312 - DNA, 37 bp, Artificial Sequence
  Synthetic oligonucleotide
taagcgctaaaacggtgggtttgtggtaggggggtga

SEQ ID NO: 54313 - DNA, 38 bp, Artificial Sequence
  Synthetic oligonucleotide
tgacgtgcgcacactggtgtaactcctcctccctttga

SEQ ID NO: 54314 - DNA, 38 bp, Artificial Sequence
  Synthetic oligonucleotide
gtggctgagctcctgccattttcttgtccttgttttga

SEQ ID NO: 54315 - DNA, 36 bp, Artificial Sequence
  Synthetic oligonucleotide
ttcgcccgttggttcatcgtactcgtcttggtcata

SEQ ID NO: 54316 - DNA, 36 bp, Artificial Sequence
  Synthetic oligonucleotide
atcgcgacctcaatcgttctcccttgtattgccgta

SEQ ID NO: 54317 - DNA, 35 bp, Artificial Sequence
  Synthetic oligonucleotide
actgaggaaaaaacgcaagaggactgcgcggtgta

SEQ ID NO: 54318 - DNA, 36 bp, Artificial Sequence
  Synthetic oligonucleotide
ggaggtcaaaccctgtccttgggagcaccactctta

SEQ ID NO: 54319 - DNA, 36 bp, Artificial Sequence
  Synthetic oligonucleotide
gtcgcctgcagccgccacaccacataacgttcttta

SEQ ID NO: 54320 - DNA, 35 bp, Artificial Sequence
  Synthetic oligonucleotide
tgtagcccagcatactctgtttcacactgtcccac

SEQ ID NO: 54321 - DNA, 34 bp, Artificial Sequence
  Synthetic oligonucleotide
tcaaccgtcattcctctgcaccaaactatctacc

SEQ ID NO: 54322 - DNA, 35 bp, Artificial Sequence
  Synthetic oligonucleotide
acacacatcttcacctggcgacgcataatggagcc

SEQ ID NO: 54323 - DNA, 35 bp, Artificial Sequence
  Synthetic oligonucleotide
aaccccctgcagaacgctaccctcataggatctcc

SEQ ID NO: 54324 - DNA, 35 bp, Artificial Sequence
  Synthetic oligonucleotide
tcggtcccgcaacccttatgtcaacctccgagtcc

SEQ ID NO: 54325 - DNA, 35 bp, Artificial Sequence
  Synthetic oligonucleotide
ttgtggggcgggtgaactgggaaggtgaagaaggc

SEQ ID NO: 54326 - DNA, 35 bp, Artificial Sequence
  Synthetic oligonucleotide
agtacacagcctacacgttagcgtgcgcacctatc

SEQ ID NO: 54327 - DNA, 35 bp, Artificial Sequence
  Synthetic oligonucleotide
gtgccggggcccgcggtgcctaacaaagcccactc

SEQ ID NO: 54328 - DNA, 35 bp, Artificial Sequence
  Synthetic oligonucleotide
tcgatgcgtagccatttgcatctgaaatacgtctc

SEQ ID NO: 54329 - DNA, 35 bp, Artificial Sequence
  Synthetic oligonucleotide
gtaacaccctgcaattttgtcagaccgaatccgtc

SEQ ID NO: 54330 - DNA, 35 bp, Artificial Sequence
  Synthetic oligonucleotide
ttctaccccgtccacgttgaaagcattcttggttc

SEQ ID NO: 54331 - DNA, 35 bp, Artificial Sequence
  Synthetic oligonucleotide
gactacccgaacgatctataaatgtactcgccccg

SEQ ID NO: 54332 - DNA, 35 bp, Artificial Sequence
  Synthetic oligonucleotide
attcgccccttgcttccgccgccgcaggcttcccg

SEQ ID NO: 54333 - DNA, 35 bp, Artificial Sequence
  Synthetic oligonucleotide
cacgcgccatgtccaccccatcccgttcgcatgcg

SEQ ID NO: 54334 - DNA, 35 bp, Artificial Sequence
  Synthetic oligonucleotide
agtgaacggtgtcaaggaaaagttcgatggtgggg

SEQ ID NO: 54335 - DNA, 34 bp, Artificial Sequence
  Synthetic oligonucleotide
gtgagacgaaatcattgatggagcttgtggtggg

SEQ ID NO: 54336 - DNA, 35 bp, Artificial Sequence
  Synthetic oligonucleotide
gtttaatactcccacctgcgcctagggctgcactg

SEQ ID NO: 54337 - DNA, 36 bp, Artificial Sequence
  Synthetic oligonucleotide
aactcggcaatggataatcaaccgttctgccccctg

SEQ ID NO: 54338 - DNA, 35 bp, Artificial Sequence
  Synthetic oligonucleotide
gtaacacaatgggaccggggcctactccttacttg

SEQ ID NO: 54339 - DNA, 35 bp, Artificial Sequence
  Synthetic oligonucleotide
atcacatgacctacctgagttgcaagatcctccat

SEQ ID NO: 54340 - DNA, 35 bp, Artificial Sequence
  Synthetic oligonucleotide
gctgatccatgccaccacagggccgcttgccacct

SEQ ID NO: 54341 - DNA, 35 bp, Artificial Sequence
  Synthetic oligonucleotide
gattcacgctagaatccctccgagacgcataccct

SEQ ID NO: 54342 - DNA, 35 bp, Artificial Sequence
  Synthetic oligonucleotide
gtcgcctgctatcgttactgcgtaatcttcattct

SEQ ID NO: 54343 - DNA, 35 bp, Artificial Sequence
  Synthetic oligonucleotide
tggtgcagccccgatactgaattgcctctcttcgt

SEQ ID NO: 54344 - DNA, 35 bp, Artificial Sequence
  Synthetic oligonucleotide
acacaggatcatagaagggggaggttgcaagtggt

SEQ ID NO: 54345 - DNA, 36 bp, Artificial Sequence
  Synthetic oligonucleotide
ggaccatcccgttactgtctatagtaacgcccctaa

SEQ ID NO: 54346 - DNA, 36 bp, Artificial Sequence
  Synthetic oligonucleotide
ttacgaccggtcttcctgctttcgtggttccattaa

SEQ ID NO: 54347 - DNA, 36 bp, Artificial Sequence
  Synthetic oligonucleotide
gatcgcccctggaatgcaacatgacggagcctaaca

SEQ ID NO: 54348 - DNA, 36 bp, Artificial Sequence
  Synthetic oligonucleotide
gtgttcatcacccacgtatacagtgcaccttttcca

SEQ ID NO: 54349 - DNA, 36 bp, Artificial Sequence
  Synthetic oligonucleotide
gtcactggtgccgcacctttatcgaccgaacattca

SEQ ID NO: 54350 - DNA, 36 bp, Artificial Sequence
  Synthetic oligonucleotide
tcagggcggagggaccaaatatagcggggatattca

SEQ ID NO: 54351 - DNA, 34 bp, Artificial Sequence
  Synthetic oligonucleotide
tccaggcgggggtaatggggaaagggtgttgaga

SEQ ID NO: 54352 - DNA, 37 bp, Artificial Sequence
  Synthetic oligonucleotide
atatcccaagccccgctgacttcctgacatacgtaga

SEQ ID NO: 54353 - DNA, 37 bp, Artificial Sequence
  Synthetic oligonucleotide
gtcccgctaccgaccaccgacccacacagacatacga

SEQ ID NO: 54354 - DNA, 37 bp, Artificial Sequence
  Synthetic oligonucleotide
tacgtagccggagggaagagagggggatatcttacga

SEQ ID NO: 54355 - DNA, 36 bp, Artificial Sequence
  Synthetic oligonucleotide
atacacgcgcacataatttaacccatgtctacccga

SEQ ID NO: 54356 - DNA, 37 bp, Artificial Sequence
  Synthetic oligonucleotide
tgcgatacgtatgacgcacctcccagcccagccccga

SEQ ID NO: 54357 - DNA, 37 bp, Artificial Sequence
  Synthetic oligonucleotide
accctaccccaacgtggcattaacagaaataatccga

SEQ ID NO: 54358 - DNA, 37 bp, Artificial Sequence
  Synthetic oligonucleotide
tcgtgccttgctgaaactgcctttttgacccagggga

SEQ ID NO: 54359 - DNA, 38 bp, Artificial Sequence
  Synthetic oligonucleotide
acccacacccgcttggttctcattattgccaggaatga

SEQ ID NO: 54360 - DNA, 38 bp, Artificial Sequence
  Synthetic oligonucleotide
acctacactccgacgcaccgacacgagggtgcccatga

SEQ ID NO: 54361 - DNA, 38 bp, Artificial Sequence
  Synthetic oligonucleotide
gtacaagaagggggtattcatagagcgggaaggactga

SEQ ID NO: 54362 - DNA, 38 bp, Artificial Sequence
  Synthetic oligonucleotide
tcccactccgacccgaccatgaaaaggttaagacctga

SEQ ID NO: 54363 - DNA, 38 bp, Artificial Sequence
  Synthetic oligonucleotide
ggggggccgcatatatgccaattgatccctctacctga

SEQ ID NO: 54364 - DNA, 33 bp, Artificial Sequence
  Synthetic oligonucleotide
tacactggggcctactcatctcttgaactctga

SEQ ID NO: 54365 - DNA, 38 bp, Artificial Sequence
  Synthetic oligonucleotide
cacatccgaatggatggtctttcgacgaacagccgtga

SEQ ID NO: 54366 - DNA, 38 bp, Artificial Sequence
  Synthetic oligonucleotide
gtgagacgctagcaaccgggcgggcatgggtagggtga

SEQ ID NO: 54367 - DNA, 37 bp, Artificial Sequence
  Synthetic oligonucleotide
tgggagggggtgatcatcggggaacggaggggggtga

SEQ ID NO: 54368 - DNA, 38 bp, Artificial Sequence
  Synthetic oligonucleotide
gcatgacagttaggtcggggggaggagggaaactgtga

SEQ ID NO: 54369 - DNA, 38 bp, Artificial Sequence
  Synthetic oligonucleotide
gccgcattccgaccattcggcttcagtcctgcctgtga

SEQ ID NO: 54370 - DNA, 38 bp, Artificial Sequence
  Synthetic oligonucleotide
acgagcgactgcaggcccggcacacacaacatacttga

SEQ ID NO: 54371 - DNA, 37 bp, Artificial Sequence
  Synthetic oligonucleotide
acccaccccccaactgcccttgttgtcgctcccttga

SEQ ID NO: 54372 - DNA, 38 bp, Artificial Sequence
  Synthetic oligonucleotide
gatcctcgcccggttaatgccaactccgtcgtccttga

SEQ ID NO: 54373 - DNA, 37 bp, Artificial Sequence
  Synthetic oligonucleotide
agatccaccgctcccctgcttactaagaactgcttga

SEQ ID NO: 54374 - DNA, 36 bp, Artificial Sequence
  Synthetic oligonucleotide
tcccgtccgagcgctgaatgggggggggttgcttga

SEQ ID NO: 54375 - DNA, 38 bp, Artificial Sequence
  Synthetic oligonucleotide
gatacgcaaagcgaaggggggtttccaataggggttga

SEQ ID NO: 54376 - DNA, 38 bp, Artificial Sequence
  Synthetic oligonucleotide
ttgacgcagggacttcgggtcgtcttgcatccttttga

SEQ ID NO: 54377 - DNA, 36 bp, Artificial Sequence
  Synthetic oligonucleotide
gacaccactcattagcgacctccacatccgctcata

SEQ ID NO: 54378 - DNA, 36 bp, Artificial Sequence
  Synthetic oligonucleotide
acacctcctcacagtttttgccggcgttttctccta

SEQ ID NO: 54379 - DNA, 36 bp, Artificial Sequence
  Synthetic oligonucleotide
tgatacggccgcagagtccttattctatctttccta

SEQ ID NO: 54380 - DNA, 36 bp, Artificial Sequence
  Synthetic oligonucleotide
gtgctcctacactggatttgggcatttccatccgta

SEQ ID NO: 54381 - DNA, 35 bp, Artificial Sequence
  Synthetic oligonucleotide
gcccgaaacctactgagcctttggaccgctttacc

SEQ ID NO: 54382 - DNA, 35 bp, Artificial Sequence
  Synthetic oligonucleotide
atcccactccgagtcttttcggtccggttacgccc

SEQ ID NO: 54383 - DNA, 35 bp, Artificial Sequence
  Synthetic oligonucleotide
ggatcagtggcctcaaagccgtctatactcatgcc

SEQ ID NO: 54384 - DNA, 35 bp, Artificial Sequence
  Synthetic oligonucleotide
tcacgaagtatccctttcttgtggcctcgccctcc

SEQ ID NO: 54385 - DNA, 35 bp, Artificial Sequence
  Synthetic oligonucleotide
tactcctcagccaccgtagggggacattcctctcc

SEQ ID NO: 54386 - DNA, 35 bp, Artificial Sequence
  Synthetic oligonucleotide
atcaaactctcgactgggacgccgcactacttagc

SEQ ID NO: 54387 - DNA, 35 bp, Artificial Sequence
  Synthetic oligonucleotide
accgcatggggctaaggggatatagtgggtgtggc

SEQ ID NO: 54388 - DNA, 35 bp, Artificial Sequence
  Synthetic oligonucleotide
ggatgcgtcacatctgatcgcttcccgtctacatc

SEQ ID NO: 54389 - DNA, 35 bp, Artificial Sequence
  Synthetic oligonucleotide
gactgcccgctcattgaaccaaggccccgtgcatc

SEQ ID NO: 54390 - DNA, 35 bp, Artificial Sequence
  Synthetic oligonucleotide
acttcggagcagaccaaggccctccatccccgatc

SEQ ID NO: 54391 - DNA, 35 bp, Artificial Sequence
  Synthetic oligonucleotide
ttggtccgatggcgtgttcttactgttttttcttg

SEQ ID NO: 54392 - DNA, 35 bp, Artificial Sequence
  Synthetic oligonucleotide
tgaataccgtcgttttaatcctcgtcctggtacat

SEQ ID NO: 54393 - DNA, 35 bp, Artificial Sequence
  Synthetic oligonucleotide
gctataccacccccccgtaatatccgcccatcgat

SEQ ID NO: 54394 - DNA, 35 bp, Artificial Sequence
  Synthetic oligonucleotide
gttcgcgatcggtccggctcaccacatatacctat

SEQ ID NO: 54395 - DNA, 35 bp, Artificial Sequence
  Synthetic oligonucleotide
gcacccggtagggtgttttccaggaacactaccct

SEQ ID NO: 54396 - DNA, 35 bp, Artificial Sequence
  Synthetic oligonucleotide
aatgcgcgaccaacgctttacaggtaattctccct

SEQ ID NO: 54397 - DNA, 35 bp, Artificial Sequence
  Synthetic oligonucleotide
atgatgcagcgcgttctcactttctcctggttcct

SEQ ID NO: 54398 - DNA, 35 bp, Artificial Sequence
  Synthetic oligonucleotide
tgcaaccccggtcctttagatttccaatcactgct

SEQ ID NO: 54399 - DNA, 35 bp, Artificial Sequence
  Synthetic oligonucleotide
gtgatgaccggtacttgatcgtacgctctttctct

SEQ ID NO: 54400 - DNA, 35 bp, Artificial Sequence
  Synthetic oligonucleotide
accagctgaccccccccccactgtcagaatcccgt

SEQ ID NO: 54401 - DNA, 35 bp, Artificial Sequence
  Synthetic oligonucleotide
tgtcatcccatcgactatctcaaggtgcagccaaa

SEQ ID NO: 54402 - DNA, 36 bp, Artificial Sequence
  Synthetic oligonucleotide
agacagtgcaaacgtcaccttctactccagccccaa

SEQ ID NO: 54403 - DNA, 36 bp, Artificial Sequence
  Synthetic oligonucleotide
acaaagtagagcgtaatggggagggaggtacgagaa

SEQ ID NO: 54404 - DNA, 36 bp, Artificial Sequence
  Synthetic oligonucleotide
acagggtcgaaagagggaggatcaggggctaacgaa

SEQ ID NO: 54405 - DNA, 36 bp, Artificial Sequence
  Synthetic oligonucleotide
gccttcctcaagcctgtttgggccgcttgtttcgaa

SEQ ID NO: 54406 - DNA, 35 bp, Artificial Sequence
  Synthetic oligonucleotide
gttccacagcctgggtccgcccgaatcattcgaca

SEQ ID NO: 54407 - DNA, 36 bp, Artificial Sequence
  Synthetic oligonucleotide
tccgcccatgtttttgctgacctgtatcactggcca

SEQ ID NO: 54408 - DNA, 36 bp, Artificial Sequence
  Synthetic oligonucleotide
tacgtccgcactcacacacgtattttcttagttcca

SEQ ID NO: 54409 - DNA, 35 bp, Artificial Sequence
  Synthetic oligonucleotide
agtgcctccccgtttattccaccaatgcggtctca

SEQ ID NO: 54410 - DNA, 35 bp, Artificial Sequence
  Synthetic oligonucleotide
attgtatgccccctcgcctagatcacatgccttca

SEQ ID NO: 54411 - DNA, 35 bp, Artificial Sequence
  Synthetic oligonucleotide
gtctcccccggttatgtatccgtttgtgtggttca

SEQ ID NO: 54412 - DNA, 37 bp, Artificial Sequence
  Synthetic oligonucleotide
gtcccagcctgtgcttagcccttctagttattcaaga

SEQ ID NO: 54413 - DNA, 36 bp, Artificial Sequence
  Synthetic oligonucleotide
atcatatcctcatccgccacatgccacttgcgccga

SEQ ID NO: 54414 - DNA, 35 bp, Artificial Sequence
  Synthetic oligonucleotide
atgcccacatcagggcaacgctgttctgctctcga

SEQ ID NO: 54415 - DNA, 37 bp, Artificial Sequence
  Synthetic oligonucleotide
acctggccccgtaatggcttaacccctgttgtctcga

SEQ ID NO: 54416 - DNA, 35 bp, Artificial Sequence
  Synthetic oligonucleotide
ttgtcacctgttaccgcacgcatccccgttttcga

SEQ ID NO: 54417 - DNA, 37 bp, Artificial Sequence
  Synthetic oligonucleotide
ggtgttggccaatgctacgtcgctctccccttacgga

SEQ ID NO: 54418 - DNA, 36 bp, Artificial Sequence
  Synthetic oligonucleotide
tctggtaccgggagggctaatacgacagggaaggga

SEQ ID NO: 54419 - DNA, 37 bp, Artificial Sequence
  Synthetic oligonucleotide
tccaaggcaaaggacgggtggagttaggtttgtggga

SEQ ID NO: 54420 - DNA, 36 bp, Artificial Sequence
  Synthetic oligonucleotide
gaaaaggtagggggtgggacgatcggttggtgtgga

SEQ ID NO: 54421 - DNA, 37 bp, Artificial Sequence
  Synthetic oligonucleotide
tgcccctcctgcctatctaatctgccaaccccaatga

SEQ ID NO: 54422 - DNA, 37 bp, Artificial Sequence
  Synthetic oligonucleotide
gatgcacaggaagtgtatgtgtgggatcccacgatga

SEQ ID NO: 54423 - DNA, 38 bp, Artificial Sequence
  Synthetic oligonucleotide
atcgataggggggctgggaaaagatggagttgggatga

SEQ ID NO: 54424 - DNA, 38 bp, Artificial Sequence
  Synthetic oligonucleotide
tggagggggggtggtgactcacggaaatagtggtatga

SEQ ID NO: 54425 - DNA, 37 bp, Artificial Sequence
  Synthetic oligonucleotide
gccatgccagattccaattttgccgcatttaccctga

SEQ ID NO: 54426 - DNA, 38 bp, Artificial Sequence
  Synthetic oligonucleotide
acgaaaaagagtgatggtgaggggaagtgcggtggtga

SEQ ID NO: 54427 - DNA, 38 bp, Artificial Sequence
  Synthetic oligonucleotide
gtgtccgtcactcacgcctatccccatcctgcgattga

SEQ ID NO: 54428 - DNA, 37 bp, Artificial Sequence
  Synthetic oligonucleotide
tacgacgcctcctccaatgcgacggaagacctcttga

SEQ ID NO: 54429 - DNA, 37 bp, Artificial Sequence
  Synthetic oligonucleotide
tcatcgcctcgtgctgcgtatttattcctctgtttga

SEQ ID NO: 54430 - DNA, 38 bp, Artificial Sequence
  Synthetic oligonucleotide
gagacagttctccctgacaccgaccatcactcttttga

SEQ ID NO: 54431 - DNA, 36 bp, Artificial Sequence
  Synthetic oligonucleotide
actccacctcataatgtcacttccaccatacgaata

SEQ ID NO: 54432 - DNA, 35 bp, Artificial Sequence
  Synthetic oligonucleotide
gatatccacactcgctccgcagaacaaacactata

SEQ ID NO: 54433 - DNA, 36 bp, Artificial Sequence
  Synthetic oligonucleotide
tccctccggcataatccacagcccttcttgcatcta

SEQ ID NO: 54434 - DNA, 35 bp, Artificial Sequence
  Synthetic oligonucleotide
gtacctccgtccatcttgcgctcttgtaacctcta

SEQ ID NO: 54435 - DNA, 36 bp, Artificial Sequence
  Synthetic oligonucleotide
atgatgcgctcgatctctcagatgcctgccgctcta

SEQ ID NO: 54436 - DNA, 36 bp, Artificial Sequence
  Synthetic oligonucleotide
tctcccccgtcgccccatcttcatcctacatcggta

SEQ ID NO: 54437 - DNA, 36 bp, Artificial Sequence
  Synthetic oligonucleotide
ggatccccgccccgctatgtctaattggtcgcatta

SEQ ID NO: 54438 - DNA, 36 bp, Artificial Sequence
  Synthetic oligonucleotide
ggaacgccttatctcttacccgggtccgtcctctta

SEQ ID NO: 54439 - DNA, 36 bp, Artificial Sequence
  Synthetic oligonucleotide
gctgcctgaccgctggtacttagctccgttcgttta

SEQ ID NO: 54440 - DNA, 35 bp, Artificial Sequence
  Synthetic oligonucleotide
gctgtcagtcccacattgggctatgtctgttcccc

SEQ ID NO: 54441 - DNA, 35 bp, Artificial Sequence
  Synthetic oligonucleotide
aacacgctgcactacccgtcctgtatacatggccc

SEQ ID NO: 54442 - DNA, 35 bp, Artificial Sequence
  Synthetic oligonucleotide
ggagagatgaccccggaagctgctatccttatccc

SEQ ID NO: 54443 - DNA, 35 bp, Artificial Sequence
  Synthetic oligonucleotide
gcaccgcggagatggcctcgctggaccgcccatcc

SEQ ID NO: 54444 - DNA, 35 bp, Artificial Sequence
  Synthetic oligonucleotide
agtgtccgggcaggaggagtaggggataagctatc

SEQ ID NO: 54445 - DNA, 35 bp, Artificial Sequence
  Synthetic oligonucleotide
gcacgctccgaattacccacccgataaacatgctc

SEQ ID NO: 54446 - DNA, 35 bp, Artificial Sequence
  Synthetic oligonucleotide
atcggtgcacacatgtccccagatcttaagccgtc

SEQ ID NO: 54447 - DNA, 35 bp, Artificial Sequence
  Synthetic oligonucleotide
aatcgcaccacccgcacatttctattacctagcag

SEQ ID NO: 54448 - DNA, 35 bp, Artificial Sequence
  Synthetic oligonucleotide
attcatgcgtgggaggtttggagggcgaagggcag

SEQ ID NO: 54449 - DNA, 35 bp, Artificial Sequence
  Synthetic oligonucleotide
gtctgcacatccggttgccctcatgaccattatag

SEQ ID NO: 54450 - DNA, 35 bp, Artificial Sequence
  Synthetic oligonucleotide
agatcatgcttaccactgccgcaaccacgctttag

SEQ ID NO: 54451 - DNA, 35 bp, Artificial Sequence
  Synthetic oligonucleotide
atcacaatcacatgagctagctgtttctgagaacg

SEQ ID NO: 54452 - DNA, 35 bp, Artificial Sequence
  Synthetic oligonucleotide
gctgggctcacacgtctttaccgctcctacccagg

SEQ ID NO: 54453 - DNA, 35 bp, Artificial Sequence
  Synthetic oligonucleotide
gtcacactttgtgccctccctacatcccggcttgg

SEQ ID NO: 54454 - DNA, 35 bp, Artificial Sequence
  Synthetic oligonucleotide
ggaagacgcgtgggtgcactattttggggagttgg

SEQ ID NO: 54455 - DNA, 35 bp, Artificial Sequence
  Synthetic oligonucleotide
tcctcccacccctgtatcttgctacctttagcttg

SEQ ID NO: 54456 - DNA, 35 bp, Artificial Sequence
  Synthetic oligonucleotide
atccgaaccgctgacaatctcaaatggctttacat

SEQ ID NO: 54457 - DNA, 35 bp, Artificial Sequence
  Synthetic oligonucleotide
tctatacccacgcgctatgtcgccctcgtgtccat

SEQ ID NO: 54458 - DNA, 35 bp, Artificial Sequence
  Synthetic oligonucleotide
gtgaccacatgaatctgtaggtgttcatatctact

SEQ ID NO: 54459 - DNA, 35 bp, Artificial Sequence
  Synthetic oligonucleotide
ttcaccgattcgtgtgatgccacattatcgctcct

SEQ ID NO: 54460 - DNA, 35 bp, Artificial Sequence
  Synthetic oligonucleotide
tgtcctcgaagcgcttttccccgaaccgttttcct

SEQ ID NO: 54461 - DNA, 35 bp, Artificial Sequence
  Synthetic oligonucleotide
tccatgttatattggaacgtgccatcctattctgt

SEQ ID NO: 54462 - DNA, 35 bp, Artificial Sequence
  Synthetic oligonucleotide
agatggacgccctcacaaccaaatctgccaaattt

SEQ ID NO: 54463 - DNA, 36 bp, Artificial Sequence
  Synthetic oligonucleotide
tctacgcatcctccggttcaaccctgcttacgaaaa

SEQ ID NO: 54464 - DNA, 35 bp, Artificial Sequence
  Synthetic oligonucleotide
agttacacgcagtatttcctgcctagccccttcaa

SEQ ID NO: 54465 - DNA, 35 bp, Artificial Sequence
  Synthetic oligonucleotide
gctgttaacactccactcacgtactccgtggcaca

SEQ ID NO: 54466 - DNA, 36 bp, Artificial Sequence
  Synthetic oligonucleotide
tcgcaaccaagctgatatcgaagcctctactaacca

SEQ ID NO: 54467 - DNA, 36 bp, Artificial Sequence
  Synthetic oligonucleotide
gccaactcccggccggcccaaaacgaaacacaccca

SEQ ID NO: 54468 - DNA, 36 bp, Artificial Sequence
  Synthetic oligonucleotide
tgtcccgcaacagagcttcagcgaaggctccctcca

SEQ ID NO: 54469 - DNA, 36 bp, Artificial Sequence
  Synthetic oligonucleotide
gttggcggcccactctaccaccacggtttgcctcca

SEQ ID NO: 54470 - DNA, 36 bp, Artificial Sequence
  Synthetic oligonucleotide
gcccgcaactctcgcgctgctgccattagttctcca

SEQ ID NO: 54471 - DNA, 36 bp, Artificial Sequence
  Synthetic oligonucleotide
tagacaaccgctgtagtgcgttctactgacaacgca

SEQ ID NO: 54472 - DNA, 35 bp, Artificial Sequence
  Synthetic oligonucleotide
ggcccacatcctaccgcgtaagtcctaccctggca

SEQ ID NO: 54473 - DNA, 36 bp, Artificial Sequence
  Synthetic oligonucleotide
atcgatcggcgtgcacgaccttggaccatccttgca

SEQ ID NO: 54474 - DNA, 35 bp, Artificial Sequence
  Synthetic oligonucleotide
gctgggtaaacagtaaagggagggtgtaaaggtca

SEQ ID NO: 54475 - DNA, 35 bp, Artificial Sequence
  Synthetic oligonucleotide
tgccaccgacctaatttccacccaacccacacaga

SEQ ID NO: 54476 - DNA, 36 bp, Artificial Sequence
  Synthetic oligonucleotide
gctcagtggggggggttgcacacgcaagaggaacga

SEQ ID NO: 54477 - DNA, 37 bp, Artificial Sequence
  Synthetic oligonucleotide
gaacccaccgcctgcacatgagctacttcaccgacga

SEQ ID NO: 54478 - DNA, 35 bp, Artificial Sequence
  Synthetic oligonucleotide
tcatggcaaagggacatagggggagtagtggacga

SEQ ID NO: 54479 - DNA, 37 bp, Artificial Sequence
  Synthetic oligonucleotide
tgcacgttcgccctcatattaggtagcccctactcga

SEQ ID NO: 54480 - DNA, 37 bp, Artificial Sequence
  Synthetic oligonucleotide
gtccgagccatggatacacttctgcctgctccctcga

SEQ ID NO: 54481 - DNA, 37 bp, Artificial Sequence
  Synthetic oligonucleotide
gtgctcttccgttgacccatcccttgtcctagtagga

SEQ ID NO: 54482 - DNA, 36 bp, Artificial Sequence
  Synthetic oligonucleotide
atccacccggacatccccttggttccaacggtagga

SEQ ID NO: 54483 - DNA, 37 bp, Artificial Sequence
  Synthetic oligonucleotide
acatcatccacccggcctgctatgtacagttttggga

SEQ ID NO: 54484 - DNA, 35 bp, Artificial Sequence
  Synthetic oligonucleotide
ttgtccccccatgtttgcggtgagccgttcttgga

SEQ ID NO: 54485 - DNA, 36 bp, Artificial Sequence
  Synthetic oligonucleotide
gtcatccgacccccccgcccctgtctcaggtttgga

SEQ ID NO: 54486 - DNA, 38 bp, Artificial Sequence
  Synthetic oligonucleotide
ggtatcgtgttacgaggaatgggaggggagggggatga

SEQ ID NO: 54487 - DNA, 38 bp, Artificial Sequence
  Synthetic oligonucleotide
gcccccacccgcacgatgtagcgaattaatatcactga

SEQ ID NO: 54488 - DNA, 38 bp, Artificial Sequence
  Synthetic oligonucleotide
gacatctgaccgtgcttgaacccctggaatcaccctga

SEQ ID NO: 54489 - DNA, 38 bp, Artificial Sequence
  Synthetic oligonucleotide
ggtacaacgcaccctcaggcccccccgactcgatctga

SEQ ID NO: 54490 - DNA, 38 bp, Artificial Sequence
  Synthetic oligonucleotide
tcccggagcgtacggcctgctcctgttattacctctga

SEQ ID NO: 54491 - DNA, 37 bp, Artificial Sequence
  Synthetic oligonucleotide
gtggtgcctacggttgtacccttttcagaccctctga

SEQ ID NO: 54492 - DNA, 37 bp, Artificial Sequence
  Synthetic oligonucleotide
tgcgggtcgtcgtagcttccctttttccatggtctga

SEQ ID NO: 54493 - DNA, 38 bp, Artificial Sequence
  Synthetic oligonucleotide
gtgtacgtgcacgggaggtaagaaggaacggcgggtga

SEQ ID NO: 54494 - DNA, 38 bp, Artificial Sequence
  Synthetic oligonucleotide
attacgatgggcagggagggagtagtggggcgatgtga

SEQ ID NO: 54495 - DNA, 37 bp, Artificial Sequence
  Synthetic oligonucleotide
actcaacccggcccgccattacagtcgcacaccttga

SEQ ID NO: 54496 - DNA, 38 bp, Artificial Sequence
  Synthetic oligonucleotide
tatttcgctcggatgtgtcctggttttttcccccttga

SEQ ID NO: 54497 - DNA, 38 bp, Artificial Sequence
  Synthetic oligonucleotide
gactgaggggggtggtgttcggcaccgcacggggttga

SEQ ID NO: 54498 - DNA, 38 bp, Artificial Sequence
  Synthetic oligonucleotide
tcacgcccccctgtcgcttcgcgtatggctcactttga

SEQ ID NO: 54499 - DNA, 38 bp, Artificial Sequence
  Synthetic oligonucleotide
gacgagcgctcatggtaacgccccaccaattcctttga

SEQ ID NO: 54500 - DNA, 37 bp, Artificial Sequence
  Synthetic oligonucleotide
atgacacactgaggacagggggacgcgagcagtttga

SEQ ID NO: 54501 - DNA, 35 bp, Artificial Sequence
  Synthetic oligonucleotide
agttaatccggcacacgtacctgactgctgcccta

SEQ ID NO: 54502 - DNA, 36 bp, Artificial Sequence
  Synthetic oligonucleotide
aacatacatccggacagattccgcaaactagctcta

SEQ ID NO: 54503 - DNA, 36 bp, Artificial Sequence
  Synthetic oligonucleotide
gctacatctgagttctcttgcgatcacgcctttcta

SEQ ID NO: 54504 - DNA, 36 bp, Artificial Sequence
  Synthetic oligonucleotide
agccatcctctccacgcgattctgggctcgaacgta

SEQ ID NO: 54505 - DNA, 36 bp, Artificial Sequence
  Synthetic oligonucleotide
atcagtgcaacaccccgttgcgaaggaccttgctta

SEQ ID NO: 54506 - DNA, 36 bp, Artificial Sequence
  Synthetic oligonucleotide
gggacgcccctgcgatttattccgtgtacaccgtta

SEQ ID NO: 54507 - DNA, 35 bp, Artificial Sequence
  Synthetic oligonucleotide
acgagggaaagagacggtgaaaaggcgggaggaac

SEQ ID NO: 54508 - DNA, 35 bp, Artificial Sequence
  Synthetic oligonucleotide
gcatcctcctggtttcagaatcatgttttcaccac

SEQ ID NO: 54509 - DNA, 35 bp, Artificial Sequence
  Synthetic oligonucleotide
acgccccaccgacgagccactgaatctgtcatgac

SEQ ID NO: 54510 - DNA, 35 bp, Artificial Sequence
  Synthetic oligonucleotide
tgacgcgggggccggagcagaatgacgagtttgac

SEQ ID NO: 54511 - DNA, 35 bp, Artificial Sequence
  Synthetic oligonucleotide
ccatcccgtttagcgtagccggtatcgctatctac

SEQ ID NO: 54512 - DNA, 35 bp, Artificial Sequence
  Synthetic oligonucleotide
tctcgacagatgttcactcgctgatctccatttac

SEQ ID NO: 54513 - DNA, 35 bp, Artificial Sequence
  Synthetic oligonucleotide
accatcaccctgtaagacatcaagaccatctttac

SEQ ID NO: 54514 - DNA, 35 bp, Artificial Sequence
  Synthetic oligonucleotide
ttgaacatgtaacctgcatattaatgaaccacacc

SEQ ID NO: 54515 - DNA, 35 bp, Artificial Sequence
  Synthetic oligonucleotide
tccaaacgaccagcttatccgtgaggccaaatacc

SEQ ID NO: 54516 - DNA, 35 bp, Artificial Sequence
  Synthetic oligonucleotide
tcgctaccctacgccactaggaccgatacgttacc

SEQ ID NO: 54517 - DNA, 35 bp, Artificial Sequence
  Synthetic oligonucleotide
gtccactggaggcaccttacgtatctccgaatccc

SEQ ID NO: 54518 - DNA, 35 bp, Artificial Sequence
  Synthetic oligonucleotide
gtcaatgccctttatgagttaacctgcgtgatccc

SEQ ID NO: 54519 - DNA, 35 bp, Artificial Sequence
  Synthetic oligonucleotide
gaagctgtctcaaactccaaaccaggctacgttcc

SEQ ID NO: 54520 - DNA, 35 bp, Artificial Sequence
  Synthetic oligonucleotide
atcacacccccttgcattggttcccgttgaatggc

SEQ ID NO: 54521 - DNA, 35 bp, Artificial Sequence
  Synthetic oligonucleotide
gttcaacaacatttgcgtattgctttactcctggc

SEQ ID NO: 54522 - DNA, 35 bp, Artificial Sequence
  Synthetic oligonucleotide
tgagccaagctgcccttcgatccctgttttactgc

SEQ ID NO: 54523 - DNA, 36 bp, Artificial Sequence
  Synthetic oligonucleotide
gcatgcgccgtagccattctgttttagccaatgttc

SEQ ID NO: 54524 - DNA, 35 bp, Artificial Sequence
  Synthetic oligonucleotide
gctgcacgacttgcttgcagtaacgaatctacccg

SEQ ID NO: 54525 - DNA, 35 bp, Artificial Sequence
  Synthetic oligonucleotide
tgcacatctccttctcgcacttgtttttcgccagg

SEQ ID NO: 54526 - DNA, 34 bp, Artificial Sequence
  Synthetic oligonucleotide
acgcccccatgtcgtcgcaccaactgctttaaat

SEQ ID NO: 54527 - DNA, 35 bp, Artificial Sequence
  Synthetic oligonucleotide
tagccgtatgccacacccacgtttatgcccgacat

SEQ ID NO: 54528 - DNA, 35 bp, Artificial Sequence
  Synthetic oligonucleotide
agcccccagccaattatttactccgttgtcgttat

SEQ ID NO: 54529 - DNA, 35 bp, Artificial Sequence
  Synthetic oligonucleotide
tactgcctccaatccgtgccgtgcacactctgcct

SEQ ID NO: 54530 - DNA, 35 bp, Artificial Sequence
  Synthetic oligonucleotide
agtaccggtcctacacgttggtcgacacacctcct

SEQ ID NO: 54531 - DNA, 35 bp, Artificial Sequence
  Synthetic oligonucleotide
gaaaccgcagtgggaattggttgtcattttaccgt

SEQ ID NO: 54532 - DNA, 35 bp, Artificial Sequence
  Synthetic oligonucleotide
gatagacgtccaggtgtgtctccctttctccccgt

SEQ ID NO: 54533 - DNA, 35 bp, Artificial Sequence
  Synthetic oligonucleotide
atgactcacgaaatgtactccacctccaagcaggt

SEQ ID NO: 54534 - DNA, 35 bp, Artificial Sequence
  Synthetic oligonucleotide
ggacggtgaaaatgggctcaggtgatctctggtgt

SEQ ID NO: 54535 - DNA, 35 bp, Artificial Sequence
  Synthetic oligonucleotide
gccccacatccactgatgccggccactaaatttgt

SEQ ID NO: 54536 - DNA, 35 bp, Artificial Sequence
  Synthetic oligonucleotide
tcagcggtcaagcattcattcttcgccctctcatt

SEQ ID NO: 54537 - DNA, 35 bp, Artificial Sequence
  Synthetic oligonucleotide
gttgcgctccgttccatcttaggcttgtttctctt

SEQ ID NO: 54538 - DNA, 36 bp, Artificial Sequence
  Synthetic oligonucleotide
gtccccactccctgttaaagcatgttgcgccgaaaa

SEQ ID NO: 54539 - DNA, 35 bp, Artificial Sequence
  Synthetic oligonucleotide
tatgcgcgaagtctctaaagggagggaagatcaaa

SEQ ID NO: 54540 - DNA, 35 bp, Artificial Sequence
  Synthetic oligonucleotide
gtcgagagggagggacgtcacagcagtacattaaa

SEQ ID NO: 54541 - DNA, 35 bp, Artificial Sequence
  Synthetic oligonucleotide
ctcggtccccgaggcgtgcaaacccaaaattgcaa

SEQ ID NO: 54542 - DNA, 35 bp, Artificial Sequence
  Synthetic oligonucleotide
atctcaccgctccttgaaactaaaggcctggataa

SEQ ID NO: 54543 - DNA, 36 bp, Artificial Sequence
  Synthetic oligonucleotide
tagtccacaactcattcgcatcacgagcatacgtaa

SEQ ID NO: 54544 - DNA, 36 bp, Artificial Sequence
  Synthetic oligonucleotide
tcacacgcacagctaaatgccgtagttccgtccaca

SEQ ID NO: 54545 - DNA, 37 bp, Artificial Sequence
  Synthetic oligonucleotide
gacgcccgttcccggttcgttgttcctataacataca

SEQ ID NO: 54546 - DNA, 35 bp, Artificial Sequence
  Synthetic oligonucleotide
agtacagagggcaccgcgcataccctgattatcca

SEQ ID NO: 54547 - DNA, 36 bp, Artificial Sequence
  Synthetic oligonucleotide
ataccccgatccctccgttaacatagcctcttggca

SEQ ID NO: 54548 - DNA, 36 bp, Artificial Sequence
  Synthetic oligonucleotide
gtctggtgcactactccattatacccacagcctgca

SEQ ID NO: 54549 - DNA, 37 bp, Artificial Sequence
  Synthetic oligonucleotide
gttgacctacggccacaagtgactaaacttgacctca

SEQ ID NO: 54550 - DNA, 35 bp, Artificial Sequence
  Synthetic oligonucleotide
gtgcccccgcgttcttttgttctcccatgtattca

SEQ ID NO: 54551 - DNA, 37 bp, Artificial Sequence
  Synthetic oligonucleotide
tctgcctcattttaatccctccctgccctgccagaga

SEQ ID NO: 54552 - DNA, 37 bp, Artificial Sequence
  Synthetic oligonucleotide
gatgggcacatgaggtggtttatggttcatggataga

SEQ ID NO: 54553 - DNA, 37 bp, Artificial Sequence
  Synthetic oligonucleotide
tgcatcgtactgctcctgcatccctccccagtttaga

SEQ ID NO: 54554 - DNA, 37 bp, Artificial Sequence
  Synthetic oligonucleotide
accggaacccgctccttgcaaccgatacatttgacga

SEQ ID NO: 54555 - DNA, 37 bp, Artificial Sequence
  Synthetic oligonucleotide
gtagcatagggtgtcgctccccccgtacttctaccga

SEQ ID NO: 54556 - DNA, 36 bp, Artificial Sequence
  Synthetic oligonucleotide
tcaggtcgcgagttcgttcttttacttgttccccga

SEQ ID NO: 54557 - DNA, 35 bp, Artificial Sequence
  Synthetic oligonucleotide
gtacgccatctttccacccgtttcaataccgccga

SEQ ID NO: 54558 - DNA, 37 bp, Artificial Sequence
  Synthetic oligonucleotide
tccgaactgccccggtatttgcgtcaccaccatccga

SEQ ID NO: 54559 - DNA, 37 bp, Artificial Sequence
  Synthetic oligonucleotide
aatgagagtggagggcctgggtagcgacgatcatcga

SEQ ID NO: 54560 - DNA, 37 bp, Artificial Sequence
  Synthetic oligonucleotide
gaagccccggccgctccctccctttgtttgttctcga

SEQ ID NO: 54561 - DNA, 37 bp, Artificial Sequence
  Synthetic oligonucleotide
gtgctccaaccgagctgtattttacctaccaccagga

SEQ ID NO: 54562 - DNA, 36 bp, Artificial Sequence
  Synthetic oligonucleotide
tgtgccgtgcagttcgcctttgtccactctgccgga

SEQ ID NO: 54563 - DNA, 37 bp, Artificial Sequence
  Synthetic oligonucleotide
gtggggatgggacaattaggagggtgagaaatgcgga

SEQ ID NO: 54564 - DNA, 37 bp, Artificial Sequence
  Synthetic oligonucleotide
tgccgacccccacctgagcccaattcaccgactcgga

SEQ ID NO: 54565 - DNA, 37 bp, Artificial Sequence
  Synthetic oligonucleotide
gacgcatgtcgaagaggggaatacggtaaatattgga

SEQ ID NO: 54566 - DNA, 38 bp, Artificial Sequence
  Synthetic oligonucleotide
tactccctggtgttgcaccgaagaccttccgcccatga

SEQ ID NO: 54567 - DNA, 37 bp, Artificial Sequence
  Synthetic oligonucleotide
ccggagccggccacgtatgactctaattactccatga

SEQ ID NO: 54568 - DNA, 38 bp, Artificial Sequence
  Synthetic oligonucleotide
accgctgcacaatgagtacattccgcatccaccactga

SEQ ID NO: 54569 - DNA, 37 bp, Artificial Sequence
  Synthetic oligonucleotide
acaccaactcatatggcctccgtatcaccttcactga

SEQ ID NO: 54570 - DNA, 38 bp, Artificial Sequence
  Synthetic oligonucleotide
gcacaggtcaccacctactccgtatgctaacggactga

SEQ ID NO: 54571 - DNA, 38 bp, Artificial Sequence
  Synthetic oligonucleotide
acctcgactgaccacttgcatccgtaggtcttacctga

SEQ ID NO: 54572 - DNA, 38 bp, Artificial Sequence
  Synthetic oligonucleotide
tatttccccgctgaactgtatgccgattttgcccgtga

SEQ ID NO: 54573 - DNA, 36 bp, Artificial Sequence
  Synthetic oligonucleotide
attggcctgcccctatgctacgcgatacaaccttga

SEQ ID NO: 54574 - DNA, 38 bp, Artificial Sequence
  Synthetic oligonucleotide
gttgcacgccgtggtgttcgtcgttccactcattttga

SEQ ID NO: 54575 - DNA, 35 bp, Artificial Sequence
  Synthetic oligonucleotide
aatacggatcacgcgctcacacccactcctggcta

SEQ ID NO: 54576 - DNA, 35 bp, Artificial Sequence
  Synthetic oligonucleotide
ggaaaggccgagggatacgacgggggatagtgcta

SEQ ID NO: 54577 - DNA, 36 bp, Artificial Sequence
  Synthetic oligonucleotide
atatgcaccctcggaccattccttgtctgtattcta

SEQ ID NO: 54578 - DNA, 36 bp, Artificial Sequence
  Synthetic oligonucleotide
agacaacgggggccaggtaaggcgggttaaaaggta

SEQ ID NO: 54579 - DNA, 35 bp, Artificial Sequence
  Synthetic oligonucleotide
tctcagaggcaggaaagggtttgaggtaaggggta

SEQ ID NO: 54580 - DNA, 35 bp, Artificial Sequence
  Synthetic oligonucleotide
gccattcctgcctatccctgtgcttgtaagcccac

SEQ ID NO: 54581 - DNA, 35 bp, Artificial Sequence
  Synthetic oligonucleotide
gcacaatcttgctccatccacgacgtgtcctggac

SEQ ID NO: 54582 - DNA, 35 bp, Artificial Sequence
  Synthetic oligonucleotide
aagtccctctggcatagacccccctgggcacaccc

SEQ ID NO: 54583 - DNA, 35 bp, Artificial Sequence
  Synthetic oligonucleotide
cacaggccacctgaccatttgcccgccgccaggcc

SEQ ID NO: 54584 - DNA, 35 bp, Artificial Sequence
  Synthetic oligonucleotide
tcccgccgccctggcaagttagaattccctgctgc

SEQ ID NO: 54585 - DNA, 35 bp, Artificial Sequence
  Synthetic oligonucleotide
gtcacacctacgaccgttcctaccattaggcaatc

SEQ ID NO: 54586 - DNA, 35 bp, Artificial Sequence
  Synthetic oligonucleotide
atggtgcacgatcggtggtttcaagtcgcgccatc

SEQ ID NO: 54587 - DNA, 35 bp, Artificial Sequence
  Synthetic oligonucleotide
gtagacagtcaggatccccggaccgccgcatactc

SEQ ID NO: 54588 - DNA, 35 bp, Artificial Sequence
  Synthetic oligonucleotide
gacacttcgacttgggccgttgaatggcacctttc

SEQ ID NO: 54589 - DNA, 35 bp, Artificial Sequence
  Synthetic oligonucleotide
aatgtggccccgccgtactgtacctcacaacttag

SEQ ID NO: 54590 - DNA, 35 bp, Artificial Sequence
  Synthetic oligonucleotide
gtcatgtgtcattcggaccccacgaaccactcccg

SEQ ID NO: 54591 - DNA, 35 bp, Artificial Sequence
  Synthetic oligonucleotide
tgatcactgccttattgaatgcccttgctcacgcg

SEQ ID NO: 54592 - DNA, 35 bp, Artificial Sequence
  Synthetic oligonucleotide
agcacaagcacacctcaagttccgcaatgtttgcg

SEQ ID NO: 54593 - DNA, 35 bp, Artificial Sequence
  Synthetic oligonucleotide
tcaagaatggggtgtggaagaccatggatgaaggg

SEQ ID NO: 54594 - DNA, 35 bp, Artificial Sequence
  Synthetic oligonucleotide
tgagctgagtagcggaattaggtagagtaggaggg

SEQ ID NO: 54595 - DNA, 36 bp, Artificial Sequence
  Synthetic oligonucleotide
gcctccttccaccgttcttgcaagcagcaccctggg

SEQ ID NO: 54596 - DNA, 35 bp, Artificial Sequence
  Synthetic oligonucleotide
gcgacggtagaagcgggctggggtacggggaattg

SEQ ID NO: 54597 - DNA, 35 bp, Artificial Sequence
  Synthetic oligonucleotide
gacccctcacatcgttcacatccgaccgttaccat

SEQ ID NO: 54598 - DNA, 35 bp, Artificial Sequence
  Synthetic oligonucleotide
aacgcctaaccccaggcctcacgccgctgtttcat

SEQ ID NO: 54599 - DNA, 35 bp, Artificial Sequence
  Synthetic oligonucleotide
tccaggtgaggtgataggccttctttttgcaacct

SEQ ID NO: 54600 - DNA, 35 bp, Artificial Sequence
  Synthetic oligonucleotide
tttgtccaactgacaccttgtaagccaatttacct

SEQ ID NO: 54601 - DNA, 35 bp, Artificial Sequence
  Synthetic oligonucleotide
gtactggcgggagatctatacgggcgggtacgggt

SEQ ID NO: 54602 - DNA, 35 bp, Artificial Sequence
  Synthetic oligonucleotide
gattacgccaaggattacgggggggcatggggtgt

SEQ ID NO: 54603 - DNA, 35 bp, Artificial Sequence
  Synthetic oligonucleotide
tcctgtaatatcacatccgtttgcagacaggtctt

SEQ ID NO: 54604 - DNA, 35 bp, Artificial Sequence
  Synthetic oligonucleotide
gtggaccggcgactatcctgttaattttccttttt

SEQ ID NO: 54605 - DNA, 35 bp, Artificial Sequence
  Synthetic oligonucleotide
tcgagcgacaaggaaaagcgggaggggagcacgaa

SEQ ID NO: 54606 - DNA, 35 bp, Artificial Sequence
  Synthetic oligonucleotide
gccacggggcgagggtggaatgggcctctgtttaa

SEQ ID NO: 54607 - DNA, 36 bp, Artificial Sequence
  Synthetic oligonucleotide
tatcactctctgctctagtcctgcgggacatccaca

SEQ ID NO: 54608 - DNA, 36 bp, Artificial Sequence
  Synthetic oligonucleotide
ttgtcctgacgccctattcttgtatatctgatcaca

SEQ ID NO: 54609 - DNA, 36 bp, Artificial Sequence
  Synthetic oligonucleotide
gtgcactcagagcgaaaaaatcaacatccgcaacca

SEQ ID NO: 54610 - DNA, 36 bp, Artificial Sequence
  Synthetic oligonucleotide
gacgagaaccccgtcccattcagtatagcttttcca

SEQ ID NO: 54611 - DNA, 36 bp, Artificial Sequence
  Synthetic oligonucleotide
gtccaacttcctgccactgccacgtgcaatgaggca

SEQ ID NO: 54612 - DNA, 35 bp, Artificial Sequence
  Synthetic oligonucleotide
tgtgccctctaccacgttattcgtcccttgtctca

SEQ ID NO: 54613 - DNA, 37 bp, Artificial Sequence
  Synthetic oligonucleotide
gcactgtgctctggccctcgtgtacttctctcccaga

SEQ ID NO: 54614 - DNA, 37 bp, Artificial Sequence
  Synthetic oligonucleotide
tgaagccactgggctcaccgcctcctcgttatcgaga

SEQ ID NO: 54615 - DNA, 36 bp, Artificial Sequence
  Synthetic oligonucleotide
tccacctccccgggttcgcccgcagcctttgaacga

SEQ ID NO: 54616 - DNA, 37 bp, Artificial Sequence
  Synthetic oligonucleotide
ggaacgacagtggagggctggtgaagaataaggacga

SEQ ID NO: 54617 - DNA, 37 bp, Artificial Sequence
  Synthetic oligonucleotide
tatccgacccgcctttcttgttcctcgaagtctccga

SEQ ID NO: 54618 - DNA, 37 bp, Artificial Sequence
  Synthetic oligonucleotide
gtccgcgccccgtccctattctcgcccaccggtccga

SEQ ID NO: 54619 - DNA, 36 bp, Artificial Sequence
  Synthetic oligonucleotide
tgagaggaatgacctgaaggaaggagattggggcga

SEQ ID NO: 54620 - DNA, 37 bp, Artificial Sequence
  Synthetic oligonucleotide
gactgctgaaaggaggtcaggggatcgtgggggcgga

SEQ ID NO: 54621 - DNA, 37 bp, Artificial Sequence
  Synthetic oligonucleotide
ggagggttgaggacgcgggaaacggagtgaggaggga

SEQ ID NO: 54622 - DNA, 37 bp, Artificial Sequence
  Synthetic oligonucleotide
attagggcggggggggctagccgcgtgtgaaagggga

SEQ ID NO: 54623 - DNA, 37 bp, Artificial Sequence
  Synthetic oligonucleotide
accacacgcgcgttcaggggggcctaccgggagggga

SEQ ID NO: 54624 - DNA, 37 bp, Artificial Sequence
  Synthetic oligonucleotide
tagtgcttgacactggcctggcctcccctcctctgga

SEQ ID NO: 54625 - DNA, 37 bp, Artificial Sequence
  Synthetic oligonucleotide
tgaaggcggaaagggtgtggggtgttgcttaattgga

SEQ ID NO: 54626 - DNA, 37 bp, Artificial Sequence
  Synthetic oligonucleotide
gcaaccactccacagtagcaaagcctgatcgccatga

SEQ ID NO: 54627 - DNA, 37 bp, Artificial Sequence
  Synthetic oligonucleotide
cacgtcgaagatctccccctcgcgcccggcctcctga

SEQ ID NO: 54628 - DNA, 38 bp, Artificial Sequence
  Synthetic oligonucleotide
atctgcccgaccacggtgttagcctcctgctttcctga

SEQ ID NO: 54629 - DNA, 38 bp, Artificial Sequence
  Synthetic oligonucleotide
gccgtcgccccgcccactgctaaactactcttggctga

SEQ ID NO: 54630 - DNA, 37 bp, Artificial Sequence
  Synthetic oligonucleotide
aactccggcgcaagcagtggctccctactccccgtga

SEQ ID NO: 54631 - DNA, 38 bp, Artificial Sequence
  Synthetic oligonucleotide
gtgagcaccactacggttgtttgttgacccgcccgtga

SEQ ID NO: 54632 - DNA, 36 bp, Artificial Sequence
  Synthetic oligonucleotide
tctatcttcgaggtttaacacgcccatcccctgtga

SEQ ID NO: 54633 - DNA, 37 bp, Artificial Sequence
  Synthetic oligonucleotide
acgcgacccaactggctttcccgtgacagtattgtga

SEQ ID NO: 54634 - DNA, 38 bp, Artificial Sequence
  Synthetic oligonucleotide
gagtgttgagggaggtggaggggaatagggcgacttga

SEQ ID NO: 54635 - DNA, 38 bp, Artificial Sequence
  Synthetic oligonucleotide
tcccacatctcattgccgcttctcttgctgacccttga

SEQ ID NO: 54636 - DNA, 38 bp, Artificial Sequence
  Synthetic oligonucleotide
gtggacgaaggcagacgagggtgaggaaggtttgttga

SEQ ID NO: 54637 - DNA, 36 bp, Artificial Sequence
  Synthetic oligonucleotide
accacagggatgggtcgggatcgggaactcggaata

SEQ ID NO: 54638 - DNA, 35 bp, Artificial Sequence
  Synthetic oligonucleotide
tctcggttggcaacacatcttgagccactattcac

SEQ ID NO: 54639 - DNA, 35 bp, Artificial Sequence
  Synthetic oligonucleotide
gttgtaacttggcgtatgtaccacggcttctctcc

SEQ ID NO: 54640 - DNA, 34 bp, Artificial Sequence
  Synthetic oligonucleotide
ttattcctgcccaattgtcgggtcctcttcacgc

SEQ ID NO: 54641 - DNA, 35 bp, Artificial Sequence
  Synthetic oligonucleotide
tctctgctaaaccattgctttcacccacttcctgc

SEQ ID NO: 54642 - DNA, 35 bp, Artificial Sequence
  Synthetic oligonucleotide
gagccattgcagcgaacgtacttcacggatacatc

SEQ ID NO: 54643 - DNA, 34 bp, Artificial Sequence
  Synthetic oligonucleotide
tgggctatccacatgtctttactctctcctcctc

SEQ ID NO: 54644 - DNA, 35 bp, Artificial Sequence
  Synthetic oligonucleotide
gttgcagggtgatgggtatgggggttggggaggcg

SEQ ID NO: 54645 - DNA, 35 bp, Artificial Sequence
  Synthetic oligonucleotide
tccaccccacttaagatcgtcgtacctacatgcgg

SEQ ID NO: 54646 - DNA, 35 bp, Artificial Sequence
  Synthetic oligonucleotide
acgagtgccgaacgccacctaccctctgaatctgg

SEQ ID NO: 54647 - DNA, 35 bp, Artificial Sequence
  Synthetic oligonucleotide
acactcgctaggagggcccataaatcaccaacatg

SEQ ID NO: 54648 - DNA, 35 bp, Artificial Sequence
  Synthetic oligonucleotide
accgtacctagcagagtactgccttgcctccccat

SEQ ID NO: 54649 - DNA, 35 bp, Artificial Sequence
  Synthetic oligonucleotide
tgataccccctcattctgcacgttagtactgcgat

SEQ ID NO: 54650 - DNA, 35 bp, Artificial Sequence
  Synthetic oligonucleotide
ggagttcgttctgccgggtttcgtgccccccctat

SEQ ID NO: 54651 - DNA, 35 bp, Artificial Sequence
  Synthetic oligonucleotide
gatgtacctaggggccgccaaatgcccgtctgcct

SEQ ID NO: 54652 - DNA, 35 bp, Artificial Sequence
  Synthetic oligonucleotide
gctgatcacgtcccccgctccggtttacgtccgct

SEQ ID NO: 54653 - DNA, 35 bp, Artificial Sequence
  Synthetic oligonucleotide
taaaccgccgacgttttccttgttacaatccgatt

SEQ ID NO: 54654 - DNA, 35 bp, Artificial Sequence
  Synthetic oligonucleotide
acccattcggatcccttgacatttgcgatgttctt

SEQ ID NO: 54655 - DNA, 35 bp, Artificial Sequence
  Synthetic oligonucleotide
tcatgtcgaggcacgcacctaccgcgttcgttaaa

SEQ ID NO: 54656 - DNA, 30 bp, Artificial Sequence
  Synthetic oligonucleotide
tctaccccgcatgaagtagtcacctctcaa

SEQ ID NO: 54657 - DNA, 36 bp, Artificial Sequence
  Synthetic oligonucleotide
gtgggacgaggtaatgaaggggagaattttggggca

SEQ ID NO: 54658 - DNA, 36 bp, Artificial Sequence
  Synthetic oligonucleotide
tccgccggcccccagttttgcctgactaggactgca

SEQ ID NO: 54659 - DNA, 36 bp, Artificial Sequence
  Synthetic oligonucleotide
tgatgtgaggccattatcgttgttcgtccttgttca

SEQ ID NO: 54660 - DNA, 37 bp, Artificial Sequence
  Synthetic oligonucleotide
gtaacttgcggcaagacaatggagggggcaaggtaga

SEQ ID NO: 54661 - DNA, 36 bp, Artificial Sequence
  Synthetic oligonucleotide
tcctcattccaccttgggtgttgtcgtccttcacga

SEQ ID NO: 54662 - DNA, 36 bp, Artificial Sequence
  Synthetic oligonucleotide
tgaccctacgttgttgtcttcattctgcctgtacga

SEQ ID NO: 54663 - DNA, 37 bp, Artificial Sequence
  Synthetic oligonucleotide
tgacctcctgtcaggttcgccacgttttgtttttcga

SEQ ID NO: 54664 - DNA, 35 bp, Artificial Sequence
  Synthetic oligonucleotide
tgagccgtacgctacaatctcccatcgcccgagga

SEQ ID NO: 54665 - DNA, 37 bp, Artificial Sequence
  Synthetic oligonucleotide
taatgcggggggggttggcgttggaaaacggggcgga

SEQ ID NO: 54666 - DNA, 37 bp, Artificial Sequence
  Synthetic oligonucleotide
tgccagtacgccaagcccaccactagccatctcggga

SEQ ID NO: 54667 - DNA, 37 bp, Artificial Sequence
  Synthetic oligonucleotide
gtgatgagcaggattgggggatggtgcagttttggga

SEQ ID NO: 54668 - DNA, 37 bp, Artificial Sequence
  Synthetic oligonucleotide
atcccggcccgtctctttacgccactactttcatgga

SEQ ID NO: 54669 - DNA, 38 bp, Artificial Sequence
  Synthetic oligonucleotide
tcacgctcagaccgcgtccgtcttcttacccgtcatga

SEQ ID NO: 54670 - DNA, 38 bp, Artificial Sequence
  Synthetic oligonucleotide
gccgcaccacgaattccgcattttacccgtattactga

SEQ ID NO: 54671 - DNA, 37 bp, Artificial Sequence
  Synthetic oligonucleotide
gagcgtacataccatccgcgatcaccaccccgcctga

SEQ ID NO: 54672 - DNA, 38 bp, Artificial Sequence
  Synthetic oligonucleotide
atcagcacctcaggatcaccttacacactcaaagctga

SEQ ID NO: 54673 - DNA, 38 bp, Artificial Sequence
  Synthetic oligonucleotide
gcctccgtgcgccgtcatctcgtctcctctccatctga

SEQ ID NO: 54674 - DNA, 38 bp, Artificial Sequence
  Synthetic oligonucleotide
tagaaccaggaggaaacggatgacagggcgtgtggtga

SEQ ID NO: 54675 - DNA, 38 bp, Artificial Sequence
  Synthetic oligonucleotide
ggaaccgcccggtatccccctcctttcccgtcatgtga

SEQ ID NO: 54676 - DNA, 38 bp, Artificial Sequence
  Synthetic oligonucleotide
atcgtcccaccgcacgcaaaacaaccgatcccttgtga

SEQ ID NO: 54677 - DNA, 38 bp, Artificial Sequence
  Synthetic oligonucleotide
aagccgcaccgctccgctactatttgattgccacttga

SEQ ID NO: 54678 - DNA, 38 bp, Artificial Sequence
  Synthetic oligonucleotide
tattacgaccggctagttcgctgcccccaattgcttga

SEQ ID NO: 54679 - DNA, 38 bp, Artificial Sequence
  Synthetic oligonucleotide
atcgggcggccaaccgtatcgtatcccatccatcttga

SEQ ID NO: 54680 - DNA, 38 bp, Artificial Sequence
  Synthetic oligonucleotide
gtgaggatcaggagaaatggggaaaagtgtgaagttga

SEQ ID NO: 54681 - DNA, 36 bp, Artificial Sequence
  Synthetic oligonucleotide
tccaacctgccacctccgcgttataaagtcttcata

SEQ ID NO: 54682 - DNA, 35 bp, Artificial Sequence
  Synthetic oligonucleotide
gtccacccggttgggtgttgccaaccatcctccta

SEQ ID NO: 54683 - DNA, 36 bp, Artificial Sequence
  Synthetic oligonucleotide
atcccctccattgcccatcatgacgccgtcagagta

SEQ ID NO: 54684 - DNA, 35 bp, Artificial Sequence
  Synthetic oligonucleotide
gacaccccctctggcacttctaggacctgcaacac

SEQ ID NO: 54685 - DNA, 35 bp, Artificial Sequence
  Synthetic oligonucleotide
taagggtaaaggggcagtgagagtaggacgaggac

SEQ ID NO: 54686 - DNA, 35 bp, Artificial Sequence
  Synthetic oligonucleotide
gaacaacgacggcatgctcgaccgcccccacgtac

SEQ ID NO: 54687 - DNA, 35 bp, Artificial Sequence
  Synthetic oligonucleotide
gactgtggcctgctcgtgaaacacatctgccttac

SEQ ID NO: 54688 - DNA, 35 bp, Artificial Sequence
  Synthetic oligonucleotide
ggaccgtttccccacactcatctacgtcgcacacc

SEQ ID NO: 54689 - DNA, 35 bp, Artificial Sequence
  Synthetic oligonucleotide
gcccttgaatcctcgtgcacagaagttgcacttcc

SEQ ID NO: 54690 - DNA, 35 bp, Artificial Sequence
  Synthetic oligonucleotide
aacccaggccgcgcgtcacgcatctatggctcatc

SEQ ID NO: 54691 - DNA, 35 bp, Artificial Sequence
  Synthetic oligonucleotide
tactggctcatccgtcgccacatcgacgacctctc

SEQ ID NO: 54692 - DNA, 35 bp, Artificial Sequence
  Synthetic oligonucleotide
tctcctggccatataattcttcgagtctgcctgtc

SEQ ID NO: 54693 - DNA, 35 bp, Artificial Sequence
  Synthetic oligonucleotide
ggagagggagcgggcgaacgggacacaggtctttc

SEQ ID NO: 54694 - DNA, 35 bp, Artificial Sequence
  Synthetic oligonucleotide
aaagcaatccgccgcaatccagcaactcgttcccg

SEQ ID NO: 54695 - DNA, 35 bp, Artificial Sequence
  Synthetic oligonucleotide
agggatgcattaaagggcgggaagtggagggaagg

SEQ ID NO: 54696 - DNA, 35 bp, Artificial Sequence
  Synthetic oligonucleotide
agccgggaggggctacagaacttgggattggatgg

SEQ ID NO: 54697 - DNA, 35 bp, Artificial Sequence
  Synthetic oligonucleotide
accttggcccccgacgaacttgcgcaacaaacctg

SEQ ID NO: 54698 - DNA, 34 bp, Artificial Sequence
  Synthetic oligonucleotide
ttgcggaatacgcaagcacacctaaatcactctg

SEQ ID NO: 54699 - DNA, 35 bp, Artificial Sequence
  Synthetic oligonucleotide
gacgcaaacgtgccacacgggaggccatgcccact

SEQ ID NO: 54700 - DNA, 35 bp, Artificial Sequence
  Synthetic oligonucleotide
ttctggtccaaccaccttcgtctcacggcgttact

SEQ ID NO: 54701 - DNA, 35 bp, Artificial Sequence
  Synthetic oligonucleotide
gatgctgactcccgcgccgtcgatacaccgcccct

SEQ ID NO: 54702 - DNA, 35 bp, Artificial Sequence
  Synthetic oligonucleotide
tggacacctctgtgcgctctcatttagaattgtct

SEQ ID NO: 54703 - DNA, 35 bp, Artificial Sequence
  Synthetic oligonucleotide
actgtcacggcactcctcccactccaggtcacggt

SEQ ID NO: 54704 - DNA, 35 bp, Artificial Sequence
  Synthetic oligonucleotide
tcgctgcatgcccctggtaagctcactcgcccggt

SEQ ID NO: 54705 - DNA, 35 bp, Artificial Sequence
  Synthetic oligonucleotide
tcttctcgcacctgtagttccattgtttcctgggt

SEQ ID NO: 54706 - DNA, 36 bp, Artificial Sequence
  Synthetic oligonucleotide
gacatgtggttccatccatcctgcccttgagaacaa

SEQ ID NO: 54707 - DNA, 35 bp, Artificial Sequence
  Synthetic oligonucleotide
gtgacctaacggagttgcctactttttctgtggaa

SEQ ID NO: 54708 - DNA, 36 bp, Artificial Sequence
  Synthetic oligonucleotide
ttctgcccaaccgtagttttgtcgacactgccttaa

SEQ ID NO: 54709 - DNA, 36 bp, Artificial Sequence
  Synthetic oligonucleotide
tcactgtcgtgatcgactatccggtccaccttcaca

SEQ ID NO: 54710 - DNA, 36 bp, Artificial Sequence
  Synthetic oligonucleotide
ttacatcagccattgagctcccccgacggtcctcca

SEQ ID NO: 54711 - DNA, 35 bp, Artificial Sequence
  Synthetic oligonucleotide
tgtgccttctcatgcttgactcccccgatatcgca

SEQ ID NO: 54712 - DNA, 35 bp, Artificial Sequence
  Synthetic oligonucleotide
tcatcgtgcaccggtcgcaggtgcgcttgatctca

SEQ ID NO: 54713 - DNA, 36 bp, Artificial Sequence
  Synthetic oligonucleotide
gtgtgtgtgaagtccggggaggcgggtatgggcaga

SEQ ID NO: 54714 - DNA, 35 bp, Artificial Sequence
  Synthetic oligonucleotide
gtccccgcttgccctctaccggtttgaaattacga

SEQ ID NO: 54715 - DNA, 37 bp, Artificial Sequence
  Synthetic oligonucleotide
gccaccacctgaacagcccccaccagggctcgaccga

SEQ ID NO: 54716 - DNA, 37 bp, Artificial Sequence
  Synthetic oligonucleotide
gaccacctccgattgttctcatactgccagtacccga

SEQ ID NO: 54717 - DNA, 37 bp, Artificial Sequence
  Synthetic oligonucleotide
gctccatcgcatgattcctttggtgacctcccgtcga

SEQ ID NO: 54718 - DNA, 37 bp, Artificial Sequence
  Synthetic oligonucleotide
agggagacacgatgggatggggcaaattacaatagga

SEQ ID NO: 54719 - DNA, 37 bp, Artificial Sequence
  Synthetic oligonucleotide
tcatcgtccaccgtcatattctcgtccttatcccgga

SEQ ID NO: 54720 - DNA, 37 bp, Artificial Sequence
  Synthetic oligonucleotide
gtgaagctgcactctttgcgcacccccctaacatgga

SEQ ID NO: 54721 - DNA, 38 bp, Artificial Sequence
  Synthetic oligonucleotide
tcacgcccaggccttgccaacgccggacatcccaatga

SEQ ID NO: 54722 - DNA, 38 bp, Artificial Sequence
  Synthetic oligonucleotide
gacacgttctaccgacaccgttcctccacgactcatga

SEQ ID NO: 54723 - DNA, 38 bp, Artificial Sequence
  Synthetic oligonucleotide
aggtggggagggtggaggacagattttggaggggatga

SEQ ID NO: 54724 - DNA, 38 bp, Artificial Sequence
  Synthetic oligonucleotide
acctacggcggctttacatcgcccctctcaccacgtga

SEQ ID NO: 54725 - DNA, 37 bp, Artificial Sequence
  Synthetic oligonucleotide
gccacggcacccttactccccccgagccaattggtga

SEQ ID NO: 54726 - DNA, 38 bp, Artificial Sequence
  Synthetic oligonucleotide
tcctccccctgctcagccttgcgcctcaagtcatgtga

SEQ ID NO: 54727 - DNA, 37 bp, Artificial Sequence
  Synthetic oligonucleotide
tccctgacctgtctgaattttgatcgttagcccttga

SEQ ID NO: 54728 - DNA, 37 bp, Artificial Sequence
  Synthetic oligonucleotide
agtgaacggctcaccattgaaatctaccctgccttga

SEQ ID NO: 54729 - DNA, 38 bp, Artificial Sequence
  Synthetic oligonucleotide
gtgacgagggcggagggtggcttagggggtcgctttga

SEQ ID NO: 54730 - DNA, 38 bp, Artificial Sequence
  Synthetic oligonucleotide
gtgctggaacgcacgatttagctctactccacgtttga

SEQ ID NO: 54731 - DNA, 38 bp, Artificial Sequence
  Synthetic oligonucleotide
acgaggggggaccgagaggacaagaatagatgttttga

SEQ ID NO: 54732 - DNA, 36 bp, Artificial Sequence
  Synthetic oligonucleotide
gaacactgctgcctccagctcttttgccctccggta

SEQ ID NO: 54733 - DNA, 35 bp, Artificial Sequence
  Synthetic oligonucleotide
ggaaaacaaggtggtggtacgacgggggaaacaac

SEQ ID NO: 54734 - DNA, 35 bp, Artificial Sequence
  Synthetic oligonucleotide
gactcacaggatacacagtccctaccccgcaaacc

SEQ ID NO: 54735 - DNA, 35 bp, Artificial Sequence
  Synthetic oligonucleotide
tctgcacccactatctcgtcatacatccatcgccc

SEQ ID NO: 54736 - DNA, 35 bp, Artificial Sequence
  Synthetic oligonucleotide
agaccagtagtcccgcactttgttccgttgcatcc

SEQ ID NO: 54737 - DNA, 35 bp, Artificial Sequence
  Synthetic oligonucleotide
tgatccccgaagcgttgacattcttgaaagcctcc

SEQ ID NO: 54738 - DNA, 35 bp, Artificial Sequence
  Synthetic oligonucleotide
agccccaactgcagttatatggtcgctgaccttcc

SEQ ID NO: 54739 - DNA, 35 bp, Artificial Sequence
  Synthetic oligonucleotide
gcctcgtgaactctgctgttacatccttgcgttcc

SEQ ID NO: 54740 - DNA, 35 bp, Artificial Sequence
  Synthetic oligonucleotide
aactaccaacagcaggacgcgccccgcctagcctc

SEQ ID NO: 54741 - DNA, 35 bp, Artificial Sequence
  Synthetic oligonucleotide
tgaccacctgccactgtcttccatgctcgacattc

SEQ ID NO: 54742 - DNA, 35 bp, Artificial Sequence
  Synthetic oligonucleotide
ggtgtctccatcggcacacccgccttcttaccttc

SEQ ID NO: 54743 - DNA, 35 bp, Artificial Sequence
  Synthetic oligonucleotide
ttcatccacgactaggtactacccgcctgcccttc

SEQ ID NO: 54744 - DNA, 35 bp, Artificial Sequence
  Synthetic oligonucleotide
tttaccgtccacgtatccccttaggtttatgcttc

SEQ ID NO: 54745 - DNA, 35 bp, Artificial Sequence
  Synthetic oligonucleotide
tgtccctagcctggtgcgcaactactctggtacat

SEQ ID NO: 54746 - DNA, 35 bp, Artificial Sequence
  Synthetic oligonucleotide
gatggggtgtggtcggtaggttggttggtacggat

SEQ ID NO: 54747 - DNA, 35 bp, Artificial Sequence
  Synthetic oligonucleotide
gacgaaggtcgagaaggagtagtggcaacgatgat

SEQ ID NO: 54748 - DNA, 35 bp, Artificial Sequence
  Synthetic oligonucleotide
gactccgacggcccggttccagccagtaggtctat

SEQ ID NO: 54749 - DNA, 35 bp, Artificial Sequence
  Synthetic oligonucleotide
tcagatccgggggaggctctatttgggggaaaact

SEQ ID NO: 54750 - DNA, 35 bp, Artificial Sequence
  Synthetic oligonucleotide
tttctcgccgtcacgtgtccgctacaaccacctct

SEQ ID NO: 54751 - DNA, 35 bp, Artificial Sequence
  Synthetic oligonucleotide
gattccagaccccaatacgtgcttatttttccgtt

SEQ ID NO: 54752 - DNA, 36 bp, Artificial Sequence
  Synthetic oligonucleotide
acgcgaaactgccccgggtaaagccctcttccaaaa

SEQ ID NO: 54753 - DNA, 35 bp, Artificial Sequence
  Synthetic oligonucleotide
ttcgatgcactacttccatcttataagcctacaaa

SEQ ID NO: 54754 - DNA, 35 bp, Artificial Sequence
  Synthetic oligonucleotide
ttcgtgcacatcttcccagcatttaggcacttaaa

SEQ ID NO: 54755 - DNA, 35 bp, Artificial Sequence
  Synthetic oligonucleotide
tcgatccggccacgtactcgcattgaccccctgaa

SEQ ID NO: 54756 - DNA, 36 bp, Artificial Sequence
  Synthetic oligonucleotide
aaacaaccaacaagtgctgttaaaaatggtggtgaa

SEQ ID NO: 54757 - DNA, 36 bp, Artificial Sequence
  Synthetic oligonucleotide
atgccgtgccgccctgtcttcgcctttccagttgaa

SEQ ID NO: 54758 - DNA, 36 bp, Artificial Sequence
  Synthetic oligonucleotide
gccgacctcggtatgttttcgtttccgccatgttaa

SEQ ID NO: 54759 - DNA, 36 bp, Artificial Sequence
  Synthetic oligonucleotide
atccccaccggacggtgaggggaactcatactcaca

SEQ ID NO: 54760 - DNA, 36 bp, Artificial Sequence
  Synthetic oligonucleotide
tcagtaagcaacctgacgaatacgcgtttttcccca

SEQ ID NO: 54761 - DNA, 36 bp, Artificial Sequence
  Synthetic oligonucleotide
gatacaccatcggatacaccgatcatccggactcca

SEQ ID NO: 54762 - DNA, 36 bp, Artificial Sequence
  Synthetic oligonucleotide
acgccgtaaacttcgccttgcctgctatcttgcgca

SEQ ID NO: 54763 - DNA, 36 bp, Artificial Sequence
  Synthetic oligonucleotide
tccgcgatccccccccacgtggccgttcatcctgca

SEQ ID NO: 54764 - DNA, 36 bp, Artificial Sequence
  Synthetic oligonucleotide
ttggaacgcgaaccgaaacgtacttcagctttatca

SEQ ID NO: 54765 - DNA, 36 bp, Artificial Sequence
  Synthetic oligonucleotide
tggagaggtgatcgaaaagggtgggtggagggttca

SEQ ID NO: 54766 - DNA, 36 bp, Artificial Sequence
  Synthetic oligonucleotide
ttccccgcacaccactttgcataacactacaggaga

SEQ ID NO: 54767 - DNA, 37 bp, Artificial Sequence
  Synthetic oligonucleotide
atcgtatccgatgcatgccctccgtccttcgctccga

SEQ ID NO: 54768 - DNA, 37 bp, Artificial Sequence
  Synthetic oligonucleotide
tcagcccctcaaacccaatcgccgaacagaccaagga

SEQ ID NO: 54769 - DNA, 38 bp, Artificial Sequence
  Synthetic oligonucleotide
gatgcaggtgtagtggattgcgggctgtggggagagga

SEQ ID NO: 54770 - DNA, 37 bp, Artificial Sequence
  Synthetic oligonucleotide
gcagttgagggacgggattgaccggggtaagtgagga

SEQ ID NO: 54771 - DNA, 37 bp, Artificial Sequence
  Synthetic oligonucleotide
tatgaggggacaggaacgggtggtgaacgggagcgga

SEQ ID NO: 54772 - DNA, 37 bp, Artificial Sequence
  Synthetic oligonucleotide
agtccccgaccgctcgcaaaacccgcccccgcaggga

SEQ ID NO: 54773 - DNA, 37 bp, Artificial Sequence
  Synthetic oligonucleotide
gagacaagagggctagctaggtttatggatgatggga

SEQ ID NO: 54774 - DNA, 37 bp, Artificial Sequence
  Synthetic oligonucleotide
gtgggtgttgggggaaggaagaaggtgacgtatggga

SEQ ID NO: 54775 - DNA, 35 bp, Artificial Sequence
  Synthetic oligonucleotide
gtagggaatatgggggtgggaggcgctagctggga

SEQ ID NO: 54776 - DNA, 37 bp, Artificial Sequence
  Synthetic oligonucleotide
actcacggagtgagtggcatgagatcggtgagaatga

SEQ ID NO: 54777 - DNA, 38 bp, Artificial Sequence
  Synthetic oligonucleotide
accgccccgtactactgtctgccgctctgttttcatga

SEQ ID NO: 54778 - DNA, 37 bp, Artificial Sequence
  Synthetic oligonucleotide
actaggccccccagtgatccctgccgtaggttactga

SEQ ID NO: 54779 - DNA, 38 bp, Artificial Sequence
  Synthetic oligonucleotide
tcgaccacctctggtagcttttacttaggacccgctga

SEQ ID NO: 54780 - DNA, 37 bp, Artificial Sequence
  Synthetic oligonucleotide
tacagcacactttgacgctatcttacactttcgctga

SEQ ID NO: 54781 - DNA, 38 bp, Artificial Sequence
  Synthetic oligonucleotide
gacaagtgaagggtaaattatgattgcgggtatgctga

SEQ ID NO: 54782 - DNA, 38 bp, Artificial Sequence
  Synthetic oligonucleotide
agctcacaccggcgccggttatatcaccccattgctga

SEQ ID NO: 54783 - DNA, 36 bp, Artificial Sequence
  Synthetic oligonucleotide
acgagggacgggggggctgattctggagggtcgtga

SEQ ID NO: 54784 - DNA, 38 bp, Artificial Sequence
  Synthetic oligonucleotide
tgtgcacgcctccttcgttattaattgtacgcctgtga

SEQ ID NO: 54785 - DNA, 38 bp, Artificial Sequence
  Synthetic oligonucleotide
tcacaccaacacgctgtcccccgcctccgttgaattga

SEQ ID NO: 54786 - DNA, 37 bp, Artificial Sequence
  Synthetic oligonucleotide
gaccattccccgtggcgaacaaggacctttttcttga

SEQ ID NO: 54787 - DNA, 37 bp, Artificial Sequence
  Synthetic oligonucleotide
tagcctcccaccccatctgcaataaaaaatcggttga

SEQ ID NO: 54788 - DNA, 38 bp, Artificial Sequence
  Synthetic oligonucleotide
gacgacggtgtaggaaaataagggtaactaggatttga

SEQ ID NO: 54789 - DNA, 36 bp, Artificial Sequence
  Synthetic oligonucleotide
gacctggttgttggtctaactctggccccctccata

SEQ ID NO: 54790 - DNA, 36 bp, Artificial Sequence
  Synthetic oligonucleotide
atcgaactgcatcccctactcgtatacagtctacta

SEQ ID NO: 54791 - DNA, 35 bp, Artificial Sequence
  Synthetic oligonucleotide
gatcacaatcggacgaaatatgaaccatttcgtta

SEQ ID NO: 54792 - DNA, 35 bp, Artificial Sequence
  Synthetic oligonucleotide
tcgatcccgcctacattgtcccacgccacgtaaac

SEQ ID NO: 54793 - DNA, 35 bp, Artificial Sequence
  Synthetic oligonucleotide
gtgacttgaaccgcagcgcgtttaccactccccac

SEQ ID NO: 54794 - DNA, 35 bp, Artificial Sequence
  Synthetic oligonucleotide
gatctcacacacggtttcttaacaccagtgtccac

SEQ ID NO: 54795 - DNA, 35 bp, Artificial Sequence
  Synthetic oligonucleotide
gcccctacactcccgtagattatgtctctcggtac

SEQ ID NO: 54796 - DNA, 35 bp, Artificial Sequence
  Synthetic oligonucleotide
gtgcccttgcccctctttgttgggttggcccgccc

SEQ ID NO: 54797 - DNA, 35 bp, Artificial Sequence
  Synthetic oligonucleotide
tcagtgggtaagcacatttccctcccatttcttcc

SEQ ID NO: 54798 - DNA, 35 bp, Artificial Sequence
  Synthetic oligonucleotide
actccatcaagacgttccggagtatacgcttccgc

SEQ ID NO: 54799 - DNA, 35 bp, Artificial Sequence
  Synthetic oligonucleotide
tgctccgcttactctgtctcccatccatcattgtc

SEQ ID NO: 54800 - DNA, 35 bp, Artificial Sequence
  Synthetic oligonucleotide
tcaccatacttcctgtccgaattggtggtactttc

SEQ ID NO: 54801 - DNA, 35 bp, Artificial Sequence
  Synthetic oligonucleotide
tcgctacaacatcagctctacttgtacgaattttc

SEQ ID NO: 54802 - DNA, 35 bp, Artificial Sequence
  Synthetic oligonucleotide
gtggccatctgattctttgccgtcatttttacacg

SEQ ID NO: 54803 - DNA, 35 bp, Artificial Sequence
  Synthetic oligonucleotide
gtcgtacctgcaggcttatcaattcccgctaatgg

SEQ ID NO: 54804 - DNA, 35 bp, Artificial Sequence
  Synthetic oligonucleotide
tacaccttaatttcttgccccatgagccgctactg

SEQ ID NO: 54805 - DNA, 35 bp, Artificial Sequence
  Synthetic oligonucleotide
gagccctctcccataactgacggtccttttccctg

SEQ ID NO: 54806 - DNA, 35 bp, Artificial Sequence
  Synthetic oligonucleotide
actcgacgtccaaccagaactcgcgctttggacct

SEQ ID NO: 54807 - DNA, 35 bp, Artificial Sequence
  Synthetic oligonucleotide
gttatatccgatctgtcgcccgaattgcattctct

SEQ ID NO: 54808 - DNA, 35 bp, Artificial Sequence
  Synthetic oligonucleotide
actgacatgccgatccatattcataccgattgtct

SEQ ID NO: 54809 - DNA, 35 bp, Artificial Sequence
  Synthetic oligonucleotide
gtgacccccctatgttttccacgttctggtcgtgt

SEQ ID NO: 54810 - DNA, 35 bp, Artificial Sequence
  Synthetic oligonucleotide
tcctccacatccgagaggattccactatccctgtt

SEQ ID NO: 54811 - DNA, 35 bp, Artificial Sequence
  Synthetic oligonucleotide
ggactacacagacgcttaattttctacggttcttt

SEQ ID NO: 54812 - DNA, 35 bp, Artificial Sequence
  Synthetic oligonucleotide
gaacgcccgctcaccgcgcaaatgttctccttttt

SEQ ID NO: 54813 - DNA, 36 bp, Artificial Sequence
  Synthetic oligonucleotide
gtcaccccaactcagccgaaacgtcttctcacgaaa

SEQ ID NO: 54814 - DNA, 36 bp, Artificial Sequence
  Synthetic oligonucleotide
tgtccggtctcaactttgctgattactcgtgccaca

SEQ ID NO: 54815 - DNA, 36 bp, Artificial Sequence
  Synthetic oligonucleotide
gcctgcggatctgaacgcactccatacacgcttaca

SEQ ID NO: 54816 - DNA, 36 bp, Artificial Sequence
  Synthetic oligonucleotide
gccccaaatatggaacgcccctggccccacagccca

SEQ ID NO: 54817 - DNA, 35 bp, Artificial Sequence
  Synthetic oligonucleotide
gtctaacctccacacagttctccggtatgatccca

SEQ ID NO: 54818 - DNA, 36 bp, Artificial Sequence
  Synthetic oligonucleotide
tgcaacaacatgaaataatgcgcttcttcgacctca

SEQ ID NO: 54819 - DNA, 36 bp, Artificial Sequence
  Synthetic oligonucleotide
gaaagaggggacaaggtgcggaaagtgaacgggtca

SEQ ID NO: 54820 - DNA, 37 bp, Artificial Sequence
  Synthetic oligonucleotide
actccccgccaatacagtctacatcctggcacccaga

SEQ ID NO: 54821 - DNA, 37 bp, Artificial Sequence
  Synthetic oligonucleotide
ataccacccctgtcatatggtcaaccacctcatcaga

SEQ ID NO: 54822 - DNA, 37 bp, Artificial Sequence
  Synthetic oligonucleotide
gaggtgggaggggtctgggagtagacggataagtaga

SEQ ID NO: 54823 - DNA, 37 bp, Artificial Sequence
  Synthetic oligonucleotide
atcgactgggtcctctctgtagcaccaaaccccacga

SEQ ID NO: 54824 - DNA, 37 bp, Artificial Sequence
  Synthetic oligonucleotide
agctagccccagccccggaccggaacccgctccacga

SEQ ID NO: 54825 - DNA, 36 bp, Artificial Sequence
  Synthetic oligonucleotide
tcatcccctttgcctaccgtctatacagcagatcga

SEQ ID NO: 54826 - DNA, 37 bp, Artificial Sequence
  Synthetic oligonucleotide
gtagccggaacatccagtatctaccactgtacctcga

SEQ ID NO: 54827 - DNA, 37 bp, Artificial Sequence
  Synthetic oligonucleotide
aagctgaaaggtggtaggtggtgtggtgcccgtcgga

SEQ ID NO: 54828 - DNA, 37 bp, Artificial Sequence
  Synthetic oligonucleotide
tatgtgcagacatcaacggggtggtggggggacggga

SEQ ID NO: 54829 - DNA, 37 bp, Artificial Sequence
  Synthetic oligonucleotide
gggggcgagcgaggggtatagggctgctaggtgggga

SEQ ID NO: 54830 - DNA, 37 bp, Artificial Sequence
  Synthetic oligonucleotide
gacacccgtgaagcaccacgccgtacccctcttggga

SEQ ID NO: 54831 - DNA, 35 bp, Artificial Sequence
  Synthetic oligonucleotide
agatatgggagggtgggaggagtacagaacctgga

SEQ ID NO: 54832 - DNA, 37 bp, Artificial Sequence
  Synthetic oligonucleotide
gacaccccctgttttcctatgatcccgtagttgtgga

SEQ ID NO: 54833 - DNA, 38 bp, Artificial Sequence
  Synthetic oligonucleotide
atcaaagacgagggtggatggaagctggtaaagaatga

SEQ ID NO: 54834 - DNA, 38 bp, Artificial Sequence
  Synthetic oligonucleotide
tccaacaaacaactggggcaatggagggggtaaactga

SEQ ID NO: 54835 - DNA, 38 bp, Artificial Sequence
  Synthetic oligonucleotide
acgcatctgtccttgtcctgtccttgctcagttactga

SEQ ID NO: 54836 - DNA, 37 bp, Artificial Sequence
  Synthetic oligonucleotide
tcacacctccatgacctttgagaatacctggccctga

SEQ ID NO: 54837 - DNA, 37 bp, Artificial Sequence
  Synthetic oligonucleotide
ttccacccctcgcatgtccgtgaggtatcctgcctga

SEQ ID NO: 54838 - DNA, 37 bp, Artificial Sequence
  Synthetic oligonucleotide
attgtagccgcacattcgaccagatcctgtttgctga

SEQ ID NO: 54839 - DNA, 38 bp, Artificial Sequence
  Synthetic oligonucleotide
gtcatgacacatgatcgtaaatcccgattgccttctga

SEQ ID NO: 54840 - DNA, 38 bp, Artificial Sequence
  Synthetic oligonucleotide
gccacgcatcctcctccccgccgaagctccctcagtga

SEQ ID NO: 54841 - DNA, 36 bp, Artificial Sequence
  Synthetic oligonucleotide
accacgactcgcccgtgctgaaccgcccccaatcta

SEQ ID NO: 54842 - DNA, 36 bp, Artificial Sequence
  Synthetic oligonucleotide
atttccacccctccgcgccgactacgcgggtctgta

SEQ ID NO: 54843 - DNA, 35 bp, Artificial Sequence
  Synthetic oligonucleotide
acatggaccgccgccgacacgctccaccaagatta

SEQ ID NO: 54844 - DNA, 36 bp, Artificial Sequence
  Synthetic oligonucleotide
tacgccccctggtaccgacggagactccagccctta

SEQ ID NO: 54845 - DNA, 36 bp, Artificial Sequence
  Synthetic oligonucleotide
gcatatcgttggtcaatgccttggccccccgcctta

SEQ ID NO: 54846 - DNA, 35 bp, Artificial Sequence
  Synthetic oligonucleotide
ggtacatcggccctcctgcctttccgccacgctta

SEQ ID NO: 54847 - DNA, 35 bp, Artificial Sequence
  Synthetic oligonucleotide
gaacgaagcacgcaattaactctccgggggctcac

SEQ ID NO: 54848 - DNA, 35 bp, Artificial Sequence
  Synthetic oligonucleotide
tcacactcgtcgccgcgactcttcttgggtgcccc

SEQ ID NO: 54849 - DNA, 35 bp, Artificial Sequence
  Synthetic oligonucleotide
tcaactaaccgattccttagccgtcttgggtcccc

SEQ ID NO: 54850 - DNA, 35 bp, Artificial Sequence
  Synthetic oligonucleotide
atgaccgatcggaaccaacctactcttgcccgccc

SEQ ID NO: 54851 - DNA, 35 bp, Artificial Sequence
  Synthetic oligonucleotide
aaggggtcatgacgttctttgcctatccgtgttcc

SEQ ID NO: 54852 - DNA, 35 bp, Artificial Sequence
  Synthetic oligonucleotide
acttacctagcctggtgcccgtttaacctacgcgc

SEQ ID NO: 54853 - DNA, 35 bp, Artificial Sequence
  Synthetic oligonucleotide
actgacaagaccatctattctgcgacccgactcgc

SEQ ID NO: 54854 - DNA, 35 bp, Artificial Sequence
  Synthetic oligonucleotide
gccaccggcacgtacattaccaccgcaccttaatc

SEQ ID NO: 54855 - DNA, 35 bp, Artificial Sequence
  Synthetic oligonucleotide
ttgcgggcgacatcactttgctcagctatcacctc

SEQ ID NO: 54856 - DNA, 35 bp, Artificial Sequence
  Synthetic oligonucleotide
tacgcttccgccgacgttacacccttctgaaccag

SEQ ID NO: 54857 - DNA, 35 bp, Artificial Sequence
  Synthetic oligonucleotide
gaccacgcacatctcacactttactcagaaaatag

SEQ ID NO: 54858 - DNA, 35 bp, Artificial Sequence
  Synthetic oligonucleotide
gcccagagctagtatagtaccccaccgatccctag

SEQ ID NO: 54859 - DNA, 35 bp, Artificial Sequence
  Synthetic oligonucleotide
actccattcagttagttcccccacgctacttttcg

SEQ ID NO: 54860 - DNA, 35 bp, Artificial Sequence
  Synthetic oligonucleotide
gaaggagctaagagagaacttaaggagggtggagg

SEQ ID NO: 54861 - DNA, 35 bp, Artificial Sequence
  Synthetic oligonucleotide
ggaccggtaagttgaaatttgggggaatgaaaggg

SEQ ID NO: 54862 - DNA, 35 bp, Artificial Sequence
  Synthetic oligonucleotide
aaggcctttcgccgcatatcttcacactctgcctg

SEQ ID NO: 54863 - DNA, 35 bp, Artificial Sequence
  Synthetic oligonucleotide
atgattcctcccagttacccacggtacacagcttg

SEQ ID NO: 54864 - DNA, 35 bp, Artificial Sequence
  Synthetic oligonucleotide
tgcttatcgagcaccgttaactctgccacaccaat

SEQ ID NO: 54865 - DNA, 35 bp, Artificial Sequence
  Synthetic oligonucleotide
gaccccccggagtgagctcgctggatctttaacat

SEQ ID NO: 54866 - DNA, 35 bp, Artificial Sequence
  Synthetic oligonucleotide
gaccaatcgtttcgaggtgacgcaccatccagcct

SEQ ID NO: 54867 - DNA, 35 bp, Artificial Sequence
  Synthetic oligonucleotide
gaatggctatgcccatcactttttacctctcatgt

SEQ ID NO: 54868 - DNA, 35 bp, Artificial Sequence
  Synthetic oligonucleotide
ggagcaaccagcccctcgttttggtctgccacatt

SEQ ID NO: 54869 - DNA, 35 bp, Artificial Sequence
  Synthetic oligonucleotide
aactgatccctgataacaggatgcccctttccttt

SEQ ID NO: 54870 - DNA, 36 bp, Artificial Sequence
  Synthetic oligonucleotide
ttcgccatgcccaatactggacgatgcctccaaaaa

SEQ ID NO: 54871 - DNA, 35 bp, Artificial Sequence
  Synthetic oligonucleotide
gagccaccacccccccgtctatggtgaagccccaa

SEQ ID NO: 54872 - DNA, 36 bp, Artificial Sequence
  Synthetic oligonucleotide
ttcattgcgcaccgacctaaagcacacctcccagaa

SEQ ID NO: 54873 - DNA, 36 bp, Artificial Sequence
  Synthetic oligonucleotide
ttggagcggtagcctgtccattgctccattaaaaca

SEQ ID NO: 54874 - DNA, 36 bp, Artificial Sequence
  Synthetic oligonucleotide
agccgtacgccacatcaaaacggatcttatcacaca

SEQ ID NO: 54875 - DNA, 36 bp, Artificial Sequence
  Synthetic oligonucleotide
gagcacaaatcgaactgctcgcgttaactacctaca

SEQ ID NO: 54876 - DNA, 35 bp, Artificial Sequence
  Synthetic oligonucleotide
accactgcccacgccctgtcgacgcccgctaccca

SEQ ID NO: 54877 - DNA, 36 bp, Artificial Sequence
  Synthetic oligonucleotide
atgtaccccgcccaaacggctatccaatgaggccca

SEQ ID NO: 54878 - DNA, 36 bp, Artificial Sequence
  Synthetic oligonucleotide
agtgccacgctagctgtcccatatcaatctttttca

SEQ ID NO: 54879 - DNA, 36 bp, Artificial Sequence
  Synthetic oligonucleotide
ttagagagcgtgaggaaggtaggtggcacggcgaga

SEQ ID NO: 54880 - DNA, 35 bp, Artificial Sequence
  Synthetic oligonucleotide
acgacctcatcgaaaggttgtccacttcatctaga

SEQ ID NO: 54881 - DNA, 35 bp, Artificial Sequence
  Synthetic oligonucleotide
tgatcaccgtcacatctgcacacgatatccgtaga

SEQ ID NO: 54882 - DNA, 37 bp, Artificial Sequence
  Synthetic oligonucleotide
gatgggggggggcgacgggcatgtacgatgtggtaga

SEQ ID NO: 54883 - DNA, 37 bp, Artificial Sequence
  Synthetic oligonucleotide
ggatgacagtgaggtattggtagtgaagaaggagcga

SEQ ID NO: 54884 - DNA, 37 bp, Artificial Sequence
  Synthetic oligonucleotide
acagacacatcgctagatggagaaagggaaacgtcga

SEQ ID NO: 54885 - DNA, 36 bp, Artificial Sequence
  Synthetic oligonucleotide
gggacaacgatgggggggcggtatggatagggtcga

SEQ ID NO: 54886 - DNA, 37 bp, Artificial Sequence
  Synthetic oligonucleotide
gtgacccctgaccatttacgtatatagtggctacgga

SEQ ID NO: 54887 - DNA, 37 bp, Artificial Sequence
  Synthetic oligonucleotide
tgcataagcggcgggaacaagatagaaagggggcgga

SEQ ID NO: 54888 - DNA, 37 bp, Artificial Sequence
  Synthetic oligonucleotide
ggtccccacacatctaacgctcagccgcttgctcgga

SEQ ID NO: 54889 - DNA, 37 bp, Artificial Sequence
  Synthetic oligonucleotide
tgtacatccttccgtaactcgccacccgtttgtcgga

SEQ ID NO: 54890 - DNA, 36 bp, Artificial Sequence
  Synthetic oligonucleotide
tatacgggatgggagcggaatggagggcggtaggga

SEQ ID NO: 54891 - DNA, 38 bp, Artificial Sequence
  Synthetic oligonucleotide
tgtgccacgagtcgtgggggggtggagttatgaaatga

SEQ ID NO: 54892 - DNA, 38 bp, Artificial Sequence
  Synthetic oligonucleotide
ttagacgcatatgcctctatgtacattacttcccatga

SEQ ID NO: 54893 - DNA, 37 bp, Artificial Sequence
  Synthetic oligonucleotide
ttccgcctccgcaattcatttagacatatatcgatga

SEQ ID NO: 54894 - DNA, 38 bp, Artificial Sequence
  Synthetic oligonucleotide
ttcgaatacgtgcggggggtgggcggttaattgtatga

SEQ ID NO: 54895 - DNA, 38 bp, Artificial Sequence
  Synthetic oligonucleotide
ttcaccttgcagcatacctacccgcctccgtcgactga

SEQ ID NO: 54896 - DNA, 37 bp, Artificial Sequence
  Synthetic oligonucleotide
ttgcacttcctcgcatctccggttggccttgccctga

SEQ ID NO: 54897 - DNA, 38 bp, Artificial Sequence
  Synthetic oligonucleotide
gattcgccccctatagttacgccatggtagatccctga

SEQ ID NO: 54898 - DNA, 38 bp, Artificial Sequence
  Synthetic oligonucleotide
atgacagatcggtctagccccacgcctaccaagcctga

SEQ ID NO: 54899 - DNA, 38 bp, Artificial Sequence
  Synthetic oligonucleotide
agcacccgtatctcactcaaccaagctctgcctcctga

SEQ ID NO: 54900 - DNA, 37 bp, Artificial Sequence
  Synthetic oligonucleotide
accccatcgctcaccatccatcgcgacgtttgagtga

SEQ ID NO: 54901 - DNA, 38 bp, Artificial Sequence
  Synthetic oligonucleotide
gcgagcccgcacttccatccacacttcgcagtacgtga

SEQ ID NO: 54902 - DNA, 34 bp, Artificial Sequence
  Synthetic oligonucleotide
gcaaacgtacaagtgtctttttttttttcggtga

SEQ ID NO: 54903 - DNA, 36 bp, Artificial Sequence
  Synthetic oligonucleotide
tctgtcgctccacgttacatgccttgatcgaattga

SEQ ID NO: 54904 - DNA, 38 bp, Artificial Sequence
  Synthetic oligonucleotide
ccactcctcactggttccatatgcctattccacattga

SEQ ID NO: 54905 - DNA, 37 bp, Artificial Sequence
  Synthetic oligonucleotide
gtccacctcggtcaacggttcgagtgccctccattga

SEQ ID NO: 54906 - DNA, 38 bp, Artificial Sequence
  Synthetic oligonucleotide
tcatacaggctggcccaccgttcgtatctgccccttga

SEQ ID NO: 54907 - DNA, 34 bp, Artificial Sequence
  Synthetic oligonucleotide
ttgccctccagctgctttttcgctattacgttga

SEQ ID NO: 54908 - DNA, 38 bp, Artificial Sequence
  Synthetic oligonucleotide
accgccgggacgcgggggggaatgggtttgtcctttga

SEQ ID NO: 54909 - DNA, 38 bp, Artificial Sequence
  Synthetic oligonucleotide
acgtacacagtagggagcatgtggtcgggggattttga

SEQ ID NO: 54910 - DNA, 38 bp, Artificial Sequence
  Synthetic oligonucleotide
gatgacgtacgtgcatatctttatgcgccctgttttga

SEQ ID NO: 54911 - DNA, 34 bp, Artificial Sequence
  Synthetic oligonucleotide
tccactccaggcctcatagcttggtcccacaata

SEQ ID NO: 54912 - DNA, 36 bp, Artificial Sequence
  Synthetic oligonucleotide
tgaaacatcacggaaaacggggggtgaggattgata

SEQ ID NO: 54913 - DNA, 35 bp, Artificial Sequence
  Synthetic oligonucleotide
ttggcccactatgagtcgcccatcactttccacta

SEQ ID NO: 54914 - DNA, 36 bp, Artificial Sequence
  Synthetic oligonucleotide
tcgacaagtgtccttttctgccatgtccgcacctta

SEQ ID NO: 54915 - DNA, 36 bp, Artificial Sequence
  Synthetic oligonucleotide
ataaagaggtggtggtgggcaggcgggcgggggtta

SEQ ID NO: 54916 - DNA, 35 bp, Artificial Sequence
  Synthetic oligonucleotide
agagaggacgtcgcggaccctctgactgcctacac

SEQ ID NO: 54917 - DNA, 35 bp, Artificial Sequence
  Synthetic oligonucleotide
tgtccccccactgccgcctcttacacctgtggtac

SEQ ID NO: 54918 - DNA, 35 bp, Artificial Sequence
  Synthetic oligonucleotide
aattgcccaatgagcttttccacctcacaccatcc

SEQ ID NO: 54919 - DNA, 35 bp, Artificial Sequence
  Synthetic oligonucleotide
gggagagctctgaagcccggtcgcgcccttattcc

SEQ ID NO: 54920 - DNA, 35 bp, Artificial Sequence
  Synthetic oligonucleotide
tatgctcacacacacccataaaagcgactcgttcc

SEQ ID NO: 54921 - DNA, 35 bp, Artificial Sequence
  Synthetic oligonucleotide
tagcgagtgcgcgcggaaagggaaggggtttaagc

SEQ ID NO: 54922 - DNA, 35 bp, Artificial Sequence
  Synthetic oligonucleotide
gaacgcgcgtcaccgcttgctgctcccatatactc

SEQ ID NO: 54923 - DNA, 35 bp, Artificial Sequence
  Synthetic oligonucleotide
gccagggagcaccttaaaaggtaacggggaaagcg

SEQ ID NO: 54924 - DNA, 35 bp, Artificial Sequence
  Synthetic oligonucleotide
tcaacgacgcccacctgctctcccctcaccatcgg

SEQ ID NO: 54925 - DNA, 35 bp, Artificial Sequence
  Synthetic oligonucleotide
gtgacccctctaacatcgtgttcatcgtgcccgtg

SEQ ID NO: 54926 - DNA, 35 bp, Artificial Sequence
  Synthetic oligonucleotide
agcacccgcctagtccccaatgtacctgtgggcat

SEQ ID NO: 54927 - DNA, 35 bp, Artificial Sequence
  Synthetic oligonucleotide
acgtggtgggagccaccatatgctacacatttact

SEQ ID NO: 54928 - DNA, 35 bp, Artificial Sequence
  Synthetic oligonucleotide
atcgactgacctcttactgcgctgttggggcttct

SEQ ID NO: 54929 - DNA, 35 bp, Artificial Sequence
  Synthetic oligonucleotide
gcaagccagctaactcagcgcgttctgttcctcgt

SEQ ID NO: 54930 - DNA, 35 bp, Artificial Sequence
  Synthetic oligonucleotide
gtcacgtgatcagggttttcaattgccttgtttgt

SEQ ID NO: 54931 - DNA, 35 bp, Artificial Sequence
  Synthetic oligonucleotide
gtgcatgggccctcttcacgtgcattgccctcatt

SEQ ID NO: 54932 - DNA, 35 bp, Artificial Sequence
  Synthetic oligonucleotide
agacccctatcacggacggacttgaactgctattt

SEQ ID NO: 54933 - DNA, 35 bp, Artificial Sequence
  Synthetic oligonucleotide
gccactcatacattctttccagcgtgcgtaacttt

SEQ ID NO: 54934 - DNA, 35 bp, Artificial Sequence
  Synthetic oligonucleotide
gtctcactagtcccccgccagcccacggcgccttt

SEQ ID NO: 54935 - DNA, 35 bp, Artificial Sequence
  Synthetic oligonucleotide
aaccatccctgtacgtcgcgggccgtccttcgttt

SEQ ID NO: 54936 - DNA, 36 bp, Artificial Sequence
  Synthetic oligonucleotide
agtctacctctttgcactctcttcgcgtatgcgcaa

SEQ ID NO: 54937 - DNA, 36 bp, Artificial Sequence
  Synthetic oligonucleotide
acaccgacaccattccattggcacaagttctttcaa

SEQ ID NO: 54938 - DNA, 36 bp, Artificial Sequence
  Synthetic oligonucleotide
gcaccgcactactgcttgatcaactcctcgctcgaa

SEQ ID NO: 54939 - DNA, 35 bp, Artificial Sequence
  Synthetic oligonucleotide
agacacctgcacaaattctgagctttcgcctataa

SEQ ID NO: 54940 - DNA, 36 bp, Artificial Sequence
  Synthetic oligonucleotide
ttgagcgcagtaatatcgcgcgcctctcatgactaa

SEQ ID NO: 54941 - DNA, 35 bp, Artificial Sequence
  Synthetic oligonucleotide
gacgctacgctgcccgccctcgaattgtacggtaa

SEQ ID NO: 54942 - DNA, 33 bp, Artificial Sequence
  Synthetic oligonucleotide
tgtcccctctcacgtcatctctagcggtcaaca

SEQ ID NO: 54943 - DNA, 35 bp, Artificial Sequence
  Synthetic oligonucleotide
atacgcctagatctcttgaactgcttgcccgaaca

SEQ ID NO: 54944 - DNA, 35 bp, Artificial Sequence
  Synthetic oligonucleotide
atacctccgatgctgcagtttcataccacacagca

SEQ ID NO: 54945 - DNA, 35 bp, Artificial Sequence
  Synthetic oligonucleotide
gacaaaccatatcgtagccgacccaacttcccgca

SEQ ID NO: 54946 - DNA, 36 bp, Artificial Sequence
  Synthetic oligonucleotide
tccatgaagggcgggaagttgggtaggcgggaggca

SEQ ID NO: 54947 - DNA, 36 bp, Artificial Sequence
  Synthetic oligonucleotide
gcgggggacaggcgcgtgccaggccagggtgatgca

SEQ ID NO: 54948 - DNA, 36 bp, Artificial Sequence
  Synthetic oligonucleotide
gtttcgccaggaaaacctccgccctttcgctctgca

SEQ ID NO: 54949 - DNA, 36 bp, Artificial Sequence
  Synthetic oligonucleotide
acccgccaaactctatcctgtaccgagggggcctca

SEQ ID NO: 54950 - DNA, 36 bp, Artificial Sequence
  Synthetic oligonucleotide
accagacggcgtcctacttttttagaatcctgctca

SEQ ID NO: 54951 - DNA, 37 bp, Artificial Sequence
  Synthetic oligonucleotide
gcgaggggttgcgggactaggaaagtaagggacgaga

SEQ ID NO: 54952 - DNA, 36 bp, Artificial Sequence
  Synthetic oligonucleotide
tagcataccgctcacacaatactagcctctcttaga

SEQ ID NO: 54953 - DNA, 37 bp, Artificial Sequence
  Synthetic oligonucleotide
gatgcgggcctaccctgccctggtatacaaccaccga

SEQ ID NO: 54954 - DNA, 36 bp, Artificial Sequence
  Synthetic oligonucleotide
acccgggcaggacattcttcagcgccatttcatcga

SEQ ID NO: 54955 - DNA, 37 bp, Artificial Sequence
  Synthetic oligonucleotide
ggaaagccaagggtaaggtcgcgcgcaggaggaagga

SEQ ID NO: 54956 - DNA, 37 bp, Artificial Sequence
  Synthetic oligonucleotide
gctcccgcagagcatgacgcactcgccttactacgga

SEQ ID NO: 54957 - DNA, 37 bp, Artificial Sequence
  Synthetic oligonucleotide
gagaacgtcggcgaaaacgatccttgcctaccccgga

SEQ ID NO: 54958 - DNA, 37 bp, Artificial Sequence
  Synthetic oligonucleotide
actcaatgcatctcgtcttagcctcctcccatccgga

SEQ ID NO: 54959 - DNA, 36 bp, Artificial Sequence
  Synthetic oligonucleotide
taaacgggaagcaaagtaagggattgaaagcgcgga

SEQ ID NO: 54960 - DNA, 37 bp, Artificial Sequence
  Synthetic oligonucleotide
taacacccccgctcatgtaaggtttcatcaactcgga

SEQ ID NO: 54961 - DNA, 36 bp, Artificial Sequence
  Synthetic oligonucleotide
gctgggccttgggcacttgttctctccattcctgga

SEQ ID NO: 54962 - DNA, 38 bp, Artificial Sequence
  Synthetic oligonucleotide
tccatgccgcggatacgcatctcgattcacttcactga

SEQ ID NO: 54963 - DNA, 38 bp, Artificial Sequence
  Synthetic oligonucleotide
gcatcccgacgcacctgtattcaatttagaaacgctga

SEQ ID NO: 54964 - DNA, 38 bp, Artificial Sequence
  Synthetic oligonucleotide
gaacctgcgtcccatctcgttggttaatgcccttctga

SEQ ID NO: 54965 - DNA, 38 bp, Artificial Sequence
  Synthetic oligonucleotide
tacagcctctgcccaccgcccgccctagttagcagtga

SEQ ID NO: 54966 - DNA, 38 bp, Artificial Sequence
  Synthetic oligonucleotide
gacaccgaaaggtgatttggcgaaacctatctctgtga

SEQ ID NO: 54967 - DNA, 38 bp, Artificial Sequence
  Synthetic oligonucleotide
tccgccgacacagcctgccattggtaccagttctgtga

SEQ ID NO: 54968 - DNA, 38 bp, Artificial Sequence
  Synthetic oligonucleotide
tttgactacgctgtatgtacctcgcccacgcatattga

SEQ ID NO: 54969 - DNA, 38 bp, Artificial Sequence
  Synthetic oligonucleotide
agcggaaaaggcgcactgaaggggaaggaagggcttga

SEQ ID NO: 54970 - DNA, 36 bp, Artificial Sequence
  Synthetic oligonucleotide
ggtgcactccgacttatgacgctcactgttgcttga

SEQ ID NO: 54971 - DNA, 38 bp, Artificial Sequence
  Synthetic oligonucleotide
gaagccgcgactatagcttcaccagcctttcgttttga

SEQ ID NO: 54972 - DNA, 35 bp, Artificial Sequence
  Synthetic oligonucleotide
acatgcaaagcggaccacacactatacttcctata

SEQ ID NO: 54973 - DNA, 35 bp, Artificial Sequence
  Synthetic oligonucleotide
aacacaaacgactcacatgcaccgcttatccgcta

SEQ ID NO: 54974 - DNA, 36 bp, Artificial Sequence
  Synthetic oligonucleotide
gactgtcggcgcactgtaaccttgaattgctttcta

SEQ ID NO: 54975 - DNA, 36 bp, Artificial Sequence
  Synthetic oligonucleotide
tactcgccccggccagtcttaccaagctcgccttta

SEQ ID NO: 54976 - DNA, 35 bp, Artificial Sequence
  Synthetic oligonucleotide
ttagccctgtccatcaaccgttgtcccgagttcac

SEQ ID NO: 54977 - DNA, 35 bp, Artificial Sequence
  Synthetic oligonucleotide
ttgtcttaccacaggttcatatcccgaccacctac

SEQ ID NO: 54978 - DNA, 35 bp, Artificial Sequence
  Synthetic oligonucleotide
tccgcgccttacctgccaatcgccctaactccgcc

SEQ ID NO: 54979 - DNA, 35 bp, Artificial Sequence
  Synthetic oligonucleotide
aactgacgccataatgctcctggacgttgcgggcc

SEQ ID NO: 54980 - DNA, 35 bp, Artificial Sequence
  Synthetic oligonucleotide
gccaacgaactgtcctccgctctaagggtcctgcc

SEQ ID NO: 54981 - DNA, 35 bp, Artificial Sequence
  Synthetic oligonucleotide
gtgcacagtgagcgactgctcaaaggaccacatcc

SEQ ID NO: 54982 - DNA, 35 bp, Artificial Sequence
  Synthetic oligonucleotide
acgaacaacgcagaagtccatggtgcgtcttttcc

SEQ ID NO: 54983 - DNA, 35 bp, Artificial Sequence
  Synthetic oligonucleotide
tgcgccgacccactacattaacttacagcatcagc

SEQ ID NO: 54984 - DNA, 35 bp, Artificial Sequence
  Synthetic oligonucleotide
gaggactgtccacacatagcaccgcactagttatc

SEQ ID NO: 54985 - DNA, 35 bp, Artificial Sequence
  Synthetic oligonucleotide
aaactccgcccgcatcgcctgttattctctggttc

SEQ ID NO: 54986 - DNA, 36 bp, Artificial Sequence
  Synthetic oligonucleotide
tcgcacgccggggggggcaaaacaaaagatcagaag

SEQ ID NO: 54987 - DNA, 35 bp, Artificial Sequence
  Synthetic oligonucleotide
tcccatgctggccacattgtgtctattctcactgg

SEQ ID NO: 54988 - DNA, 35 bp, Artificial Sequence
  Synthetic oligonucleotide
ttccacgttcacttatgggccttttgctgttctgg

SEQ ID NO: 54989 - DNA, 35 bp, Artificial Sequence
  Synthetic oligonucleotide
ggtcaacgggggggagagaaaccgtattggctgtg

SEQ ID NO: 54990 - DNA, 35 bp, Artificial Sequence
  Synthetic oligonucleotide
attcgacggaacagggaagacaggagagagggcat

SEQ ID NO: 54991 - DNA, 35 bp, Artificial Sequence
  Synthetic oligonucleotide
tgcccatactgcccttccagctgcgccacgcgtat

SEQ ID NO: 54992 - DNA, 35 bp, Artificial Sequence
  Synthetic oligonucleotide
atctgccacaattgcagtctccaggcctaacaact

SEQ ID NO: 54993 - DNA, 35 bp, Artificial Sequence
  Synthetic oligonucleotide
gacgacggctaagtttcaaatgcctccttgtccct

SEQ ID NO: 54994 - DNA, 35 bp, Artificial Sequence
  Synthetic oligonucleotide
gacccgtaggtgccatcttttctcgctttctttct

SEQ ID NO: 54995 - DNA, 35 bp, Artificial Sequence
  Synthetic oligonucleotide
gatgagccgatgaggtctatgcttcctctcctggt

SEQ ID NO: 54996 - DNA, 35 bp, Artificial Sequence
  Synthetic oligonucleotide
tcttaccgtggcctcgcacgtgtaaccatttactt

SEQ ID NO: 54997 - DNA, 35 bp, Artificial Sequence
  Synthetic oligonucleotide
tcagccaactgcccccttacgatgcacgccgcctt

SEQ ID NO: 54998 - DNA, 35 bp, Artificial Sequence
  Synthetic oligonucleotide
gacttccactgcctatttgtgggaacgtatccttt

SEQ ID NO: 54999 - DNA, 34 bp, Artificial Sequence
  Synthetic oligonucleotide
gaactgccgggcctggaatgtggcatgttttttt

SEQ ID NO: 55000 - DNA, 34 bp, Artificial Sequence
  Synthetic oligonucleotide
tatatcccctgctgtcgtaactcctccctttaaa

SEQ ID NO: 55001 - DNA, 35 bp, Artificial Sequence
  Synthetic oligonucleotide
tacctaacctcgcgccacatacaacacgttgagaa

SEQ ID NO: 55002 - DNA, 36 bp, Artificial Sequence
  Synthetic oligonucleotide
gtctggagtcagtaaaaaagaggtaggagtggcgaa

SEQ ID NO: 55003 - DNA, 35 bp, Artificial Sequence
  Synthetic oligonucleotide
tacacgtgactccctcgaacgtgcctactgtttaa

SEQ ID NO: 55004 - DNA, 35 bp, Artificial Sequence
  Synthetic oligonucleotide
tccgtcgggacgattctcggggtccgtacctccca

SEQ ID NO: 55005 - DNA, 36 bp, Artificial Sequence
  Synthetic oligonucleotide
gcttcgccccaactgggtatgcccccgtactaagca

SEQ ID NO: 55006 - DNA, 37 bp, Artificial Sequence
  Synthetic oligonucleotide
gtggagtgctccggaagaagaatgagggcacgcaaga

SEQ ID NO: 55007 - DNA, 37 bp, Artificial Sequence
  Synthetic oligonucleotide
aggtcaccacccccccggccctcgctgttcgcacaga

SEQ ID NO: 55008 - DNA, 37 bp, Artificial Sequence
  Synthetic oligonucleotide
ggagggcgcaggggatagagcgggggtgaacaataga

SEQ ID NO: 55009 - DNA, 37 bp, Artificial Sequence
  Synthetic oligonucleotide
gagcaccgcgctcgccacgcaccactccaaagctaga

SEQ ID NO: 55010 - DNA, 37 bp, Artificial Sequence
  Synthetic oligonucleotide
tgaggccacactcaacgtaacgcccacccgactacga

SEQ ID NO: 55011 - DNA, 36 bp, Artificial Sequence
  Synthetic oligonucleotide
acgtgagcagtaactattgccaatccccctgtgcga

SEQ ID NO: 55012 - DNA, 37 bp, Artificial Sequence
  Synthetic oligonucleotide
acgacggagaactagtgggaatggggggcgttcagga

SEQ ID NO: 55013 - DNA, 37 bp, Artificial Sequence
  Synthetic oligonucleotide
tcataccgctcaccataggcctgaccccgttcgagga

SEQ ID NO: 55014 - DNA, 37 bp, Artificial Sequence
  Synthetic oligonucleotide
gtagtggggtgggggtagaagccaaagtaagtgagga

SEQ ID NO: 55015 - DNA, 37 bp, Artificial Sequence
  Synthetic oligonucleotide
tagggcacggtgggggaagtgggtattggaaatcgga

SEQ ID NO: 55016 - DNA, 37 bp, Artificial Sequence
  Synthetic oligonucleotide
taccagatccaaggtcatcacacaacctccacaggga

SEQ ID NO: 55017 - DNA, 37 bp, Artificial Sequence
  Synthetic oligonucleotide
gaatgcagctgggcgaagcggggaactcggggaggga

SEQ ID NO: 55018 - DNA, 37 bp, Artificial Sequence
  Synthetic oligonucleotide
tatcccgaatacgtgatctgatccaccacccactgga

SEQ ID NO: 55019 - DNA, 37 bp, Artificial Sequence
  Synthetic oligonucleotide
atgcaccccccgaacagtctgactccccctacttgga

SEQ ID NO: 55020 - DNA, 38 bp, Artificial Sequence
  Synthetic oligonucleotide
gatcgagggggtgagggtgggactgggttgtatcatga

SEQ ID NO: 55021 - DNA, 38 bp, Artificial Sequence
  Synthetic oligonucleotide
gggagtggaggtaaagcgctaaggaacggaggagatga

SEQ ID NO: 55022 - DNA, 38 bp, Artificial Sequence
  Synthetic oligonucleotide
atcacggggtgacatagggttgtaaggggtacggatga

SEQ ID NO: 55023 - DNA, 37 bp, Artificial Sequence
  Synthetic oligonucleotide
tcctcgcagatcacacactccaggtattgccctatga

SEQ ID NO: 55024 - DNA, 38 bp, Artificial Sequence
  Synthetic oligonucleotide
gaggaagatcacggggtgggatagggagaggtgtatga

SEQ ID NO: 55025 - DNA, 34 bp, Artificial Sequence
  Synthetic oligonucleotide
tctgacgcatggccgatttatccccctattatga

SEQ ID NO: 55026 - DNA, 38 bp, Artificial Sequence
  Synthetic oligonucleotide
gctagcatcgggagggggggagggctcggtcaagctga

SEQ ID NO: 55027 - DNA, 38 bp, Artificial Sequence
  Synthetic oligonucleotide
ggaaggggtggaaggctggatcggggacgctgttctga

SEQ ID NO: 55028 - DNA, 38 bp, Artificial Sequence
  Synthetic oligonucleotide
tcccagcccggcccagtttgagggaagggggaaagtga

SEQ ID NO: 55029 - DNA, 38 bp, Artificial Sequence
  Synthetic oligonucleotide
tcgatcgccgtgcctctgccgtttcctaccctccgtga

SEQ ID NO: 55030 - DNA, 38 bp, Artificial Sequence
  Synthetic oligonucleotide
atagtgcggtacaacagggtaacagggatgaagggtga

SEQ ID NO: 55031 - DNA, 37 bp, Artificial Sequence
  Synthetic oligonucleotide
ggacgccccaccaggtcccgctttccattagacttga

SEQ ID NO: 55032 - DNA, 38 bp, Artificial Sequence
  Synthetic oligonucleotide
gatcccacgttccaccgagacagtttctgtcatgttga

SEQ ID NO: 55033 - DNA, 38 bp, Artificial Sequence
  Synthetic oligonucleotide
gtaccacgcatgtaccgccactggtgccctatgtttga

SEQ ID NO: 55034 - DNA, 35 bp, Artificial Sequence
  Synthetic oligonucleotide
gtgggccaacatgtgcggctctcaacctgtccata

SEQ ID NO: 55035 - DNA, 36 bp, Artificial Sequence
  Synthetic oligonucleotide
acaacccgcgcgcaggtgcaatgggcttattctgta

SEQ ID NO: 55036 - DNA, 35 bp, Artificial Sequence
  Synthetic oligonucleotide
gatcacccccattcgaaataccgtacgctcgtgta

SEQ ID NO: 55037 - DNA, 36 bp, Artificial Sequence
  Synthetic oligonucleotide
tccaacccctgcgcatttcccaacgcctatgactta

SEQ ID NO: 55038 - DNA, 35 bp, Artificial Sequence
  Synthetic oligonucleotide
tccaatggtactacatgtaacgccttctgccaaac

SEQ ID NO: 55039 - DNA, 35 bp, Artificial Sequence
  Synthetic oligonucleotide
gtcgcctcaactgacctgcgcccccgcgaccatac

SEQ ID NO: 55040 - DNA, 35 bp, Artificial Sequence
  Synthetic oligonucleotide
tgaccgcggaccgaggcccgccctaaacacccgcc

SEQ ID NO: 55041 - DNA, 35 bp, Artificial Sequence
  Synthetic oligonucleotide
tctgagcgtttggcacgtaccctcatttatccatc

SEQ ID NO: 55042 - DNA, 35 bp, Artificial Sequence
  Synthetic oligonucleotide
accctcacccttgtaaatgttctaggccctgggtc

SEQ ID NO: 55043 - DNA, 35 bp, Artificial Sequence
  Synthetic oligonucleotide
gccttattgcccctgtcatcgaaacgccacctgag

SEQ ID NO: 55044 - DNA, 35 bp, Artificial Sequence
  Synthetic oligonucleotide
atggacaggttccatccaatagtactcgcctaccg

SEQ ID NO: 55045 - DNA, 35 bp, Artificial Sequence
  Synthetic oligonucleotide
attatgaaaggccggggcggaggtgggtcggggtg

SEQ ID NO: 55046 - DNA, 35 bp, Artificial Sequence
  Synthetic oligonucleotide
taggctgcactaccctgcgctaatacacacctttg

SEQ ID NO: 55047 - DNA, 35 bp, Artificial Sequence
  Synthetic oligonucleotide
tccgcatgacccaccctctgcttattccgggaaat

SEQ ID NO: 55048 - DNA, 35 bp, Artificial Sequence
  Synthetic oligonucleotide
gaccgacaaagctgttatcccccgagcccaatgat

SEQ ID NO: 55049 - DNA, 35 bp, Artificial Sequence
  Synthetic oligonucleotide
ttaccgctgagcatatcgccattcttaccttcact

SEQ ID NO: 55050 - DNA, 35 bp, Artificial Sequence
  Synthetic oligonucleotide
aactatgcgtgcgacccgttaccacacgaatccct

SEQ ID NO: 55051 - DNA, 35 bp, Artificial Sequence
  Synthetic oligonucleotide
tcgtacgccataaacttaggcgctcatgttactct

SEQ ID NO: 55052 - DNA, 35 bp, Artificial Sequence
  Synthetic oligonucleotide
acatccagtggccatttagtgctcgtgcgcctagt

SEQ ID NO: 55053 - DNA, 35 bp, Artificial Sequence
  Synthetic oligonucleotide
tacgtggctggggtggggtggttcggggatagcgt

SEQ ID NO: 55054 - DNA, 35 bp, Artificial Sequence
  Synthetic oligonucleotide
tgacatcatcaaccagttgcctgcttctgttcctt

SEQ ID NO: 55055 - DNA, 35 bp, Artificial Sequence
  Synthetic oligonucleotide
gacgacctcaggaaatctcttgtcccggaaccttt

SEQ ID NO: 55056 - DNA, 36 bp, Artificial Sequence
  Synthetic oligonucleotide
agcggactgtcgccccctccgtaaaacgcctaccaa

SEQ ID NO: 55057 - DNA, 36 bp, Artificial Sequence
  Synthetic oligonucleotide
gtgcacaggtcaacacgccgcaaaactcgacgagaa

SEQ ID NO: 55058 - DNA, 37 bp, Artificial Sequence
  Synthetic oligonucleotide
tgaaaacggaagcagaaaggggctcgcagggatagaa

SEQ ID NO: 55059 - DNA, 36 bp, Artificial Sequence
  Synthetic oligonucleotide
gtgtgagacggcgataactggagatgatgctgcgaa

SEQ ID NO: 55060 - DNA, 36 bp, Artificial Sequence
  Synthetic oligonucleotide
atcgacccggtcgatccagggtacttctattcaaca

SEQ ID NO: 55061 - DNA, 36 bp, Artificial Sequence
  Synthetic oligonucleotide
gtggggataacgtcgccgggcagggtagggatcaca

SEQ ID NO: 55062 - DNA, 35 bp, Artificial Sequence
  Synthetic oligonucleotide
gccgaacctgtttgctatcgctacttagatctaca

SEQ ID NO: 55063 - DNA, 36 bp, Artificial Sequence
  Synthetic oligonucleotide
ggacgcattgctaccctccgcgccggccgttaccca

SEQ ID NO: 55064 - DNA, 36 bp, Artificial Sequence
  Synthetic oligonucleotide
tccactggcggtactatctgccaacaacctgtccca

SEQ ID NO: 55065 - DNA, 36 bp, Artificial Sequence
  Synthetic oligonucleotide
actcttcgcacgcctctctcatatccgtctatagca

SEQ ID NO: 55066 - DNA, 36 bp, Artificial Sequence
  Synthetic oligonucleotide
gctacgaagacgtaaatccctctgtttgccctgtca

SEQ ID NO: 55067 - DNA, 36 bp, Artificial Sequence
  Synthetic oligonucleotide
gagccctacgaacgcaagtgctgatcattcctttca

SEQ ID NO: 55068 - DNA, 36 bp, Artificial Sequence
  Synthetic oligonucleotide
attaccgcctcactcctgactgaacgacagctgaga

SEQ ID NO: 55069 - DNA, 36 bp, Artificial Sequence
  Synthetic oligonucleotide
gtccagtagttcggccgtcgtacatcccaccctaga

SEQ ID NO: 55070 - DNA, 37 bp, Artificial Sequence
  Synthetic oligonucleotide
tttgccgacgctgctattgccccaaatgatccgtaga

SEQ ID NO: 55071 - DNA, 37 bp, Artificial Sequence
  Synthetic oligonucleotide
gagtacgcgatagccacccgattccacctcaggccga

SEQ ID NO: 55072 - DNA, 36 bp, Artificial Sequence
  Synthetic oligonucleotide
gccacatcacccgggctcccttatatcttgtgccga

SEQ ID NO: 55073 - DNA, 37 bp, Artificial Sequence
  Synthetic oligonucleotide
ggtctacacgcagccatccttaaatgtcacgcctcga

SEQ ID NO: 55074 - DNA, 36 bp, Artificial Sequence
  Synthetic oligonucleotide
actgagcacgtatgtgatggggaaagggatggtcga

SEQ ID NO: 55075 - DNA, 36 bp, Artificial Sequence
  Synthetic oligonucleotide
acattacccgtgccccggccccacttctttgccgga

SEQ ID NO: 55076 - DNA, 36 bp, Artificial Sequence
  Synthetic oligonucleotide
ggttgtaggtgagttgaaggggcgtaaggggaggga

SEQ ID NO: 55077 - DNA, 37 bp, Artificial Sequence
  Synthetic oligonucleotide
gtgccaagggccgctctttctcagtactgtcgcatga

SEQ ID NO: 55078 - DNA, 37 bp, Artificial Sequence
  Synthetic oligonucleotide
atgtcagacgtgctgcaggttattagcatcttgatga

SEQ ID NO: 55079 - DNA, 38 bp, Artificial Sequence
  Synthetic oligonucleotide
taagccgtagcacctttacgtttagccacacactatga

SEQ ID NO: 55080 - DNA, 37 bp, Artificial Sequence
  Synthetic oligonucleotide
accgacgcttagcactaataacactccacccctctga

SEQ ID NO: 55081 - DNA, 38 bp, Artificial Sequence
  Synthetic oligonucleotide
gcactgcccgtccctttagtctttatttcaatctctga

SEQ ID NO: 55082 - DNA, 38 bp, Artificial Sequence
  Synthetic oligonucleotide
tgcacaccgatgtgcccgctacccttggcctcaagtga

SEQ ID NO: 55083 - DNA, 37 bp, Artificial Sequence
  Synthetic oligonucleotide
tacacacaaccacactatgagacaactgtcgaagtga

SEQ ID NO: 55084 - DNA, 38 bp, Artificial Sequence
  Synthetic oligonucleotide
gaacgtcacacataatccaatctccagccccactgtga

SEQ ID NO: 55085 - DNA, 37 bp, Artificial Sequence
  Synthetic oligonucleotide
gccgtactccggcagaattccttaaccacccgtgtga

SEQ ID NO: 55086 - DNA, 38 bp, Artificial Sequence
  Synthetic oligonucleotide
gacccaccccactcttgtgcacctactcctggccttga

SEQ ID NO: 55087 - DNA, 37 bp, Artificial Sequence
  Synthetic oligonucleotide
tctccgcctcctgccacagtcgtgcatgattgcttga

SEQ ID NO: 55088 - DNA, 36 bp, Artificial Sequence
  Synthetic oligonucleotide
gagccggtttcaggcgcgctttattgacctgccata

SEQ ID NO: 55089 - DNA, 35 bp, Artificial Sequence
  Synthetic oligonucleotide
tacacccgatcgatatgcccttccgatgattgata

SEQ ID NO: 55090 - DNA, 36 bp, Artificial Sequence
  Synthetic oligonucleotide
gcagttcgaacggcgccctgtccatctaaccttata

SEQ ID NO: 55091 - DNA, 36 bp, Artificial Sequence
  Synthetic oligonucleotide
tacgcgtgcactcataaattgccactggacaatcta

SEQ ID NO: 55092 - DNA, 35 bp, Artificial Sequence
  Synthetic oligonucleotide
agccggatccagacgtcaccgccagcccatatcta

SEQ ID NO: 55093 - DNA, 36 bp, Artificial Sequence
  Synthetic oligonucleotide
tgtcaacacccacgtagagctgcccttctcttttta

SEQ ID NO: 55094 - DNA, 35 bp, Artificial Sequence
  Synthetic oligonucleotide
tagcgccagtgcaaatcttttgtcacacacctaac

SEQ ID NO: 55095 - DNA, 35 bp, Artificial Sequence
  Synthetic oligonucleotide
gccgtgagtggaaccgtccccgtcctcagtgcacc

SEQ ID NO: 55096 - DNA, 35 bp, Artificial Sequence
  Synthetic oligonucleotide
gtcgcgttgcatctttgaattgccgtgggccaccc

SEQ ID NO: 55097 - DNA, 35 bp, Artificial Sequence
  Synthetic oligonucleotide
tgagctcagaccgtttgccttgcaatatcctcccc

SEQ ID NO: 55098 - DNA, 35 bp, Artificial Sequence
  Synthetic oligonucleotide
ttgccactcaagctatcctcctctgacaccgtgcc

SEQ ID NO: 55099 - DNA, 35 bp, Artificial Sequence
  Synthetic oligonucleotide
ggacatagctaccaccgtccttaccgaaccactcc

SEQ ID NO: 55100 - DNA, 35 bp, Artificial Sequence
  Synthetic oligonucleotide
accgttcacccccaatggaattcgcaccactgagc

SEQ ID NO: 55101 - DNA, 35 bp, Artificial Sequence
  Synthetic oligonucleotide
tactggccacctcttgtctagctccatgaactcgc

SEQ ID NO: 55102 - DNA, 35 bp, Artificial Sequence
  Synthetic oligonucleotide
tgctgtgtcgtgccctcctgccgtcattcctatgc

SEQ ID NO: 55103 - DNA, 35 bp, Artificial Sequence
  Synthetic oligonucleotide
tatcacccccgcctactcagccacggttctaaatc

SEQ ID NO: 55104 - DNA, 35 bp, Artificial Sequence
  Synthetic oligonucleotide
gacccctctgacttgccctggaaggatgccatatc

SEQ ID NO: 55105 - DNA, 35 bp, Artificial Sequence
  Synthetic oligonucleotide
ttagtgcggtgcggcctgctcgtgcaacccacctc

SEQ ID NO: 55106 - DNA, 35 bp, Artificial Sequence
  Synthetic oligonucleotide
gaaaacaccccgccggtggcccacgtattagcctc

SEQ ID NO: 55107 - DNA, 35 bp, Artificial Sequence
  Synthetic oligonucleotide
atgatggtgttcgacctgtacgaccctgctgtttc

SEQ ID NO: 55108 - DNA, 35 bp, Artificial Sequence
  Synthetic oligonucleotide
tacgcaccgtcgcgctccaccttcccccgactacg

SEQ ID NO: 55109 - DNA, 35 bp, Artificial Sequence
  Synthetic oligonucleotide
actttcactccctgtgtgcgattttccccttatcg

SEQ ID NO: 55110 - DNA, 35 bp, Artificial Sequence
  Synthetic oligonucleotide
ggactaagggaggtggggtggtgcggagcttttcg

SEQ ID NO: 55111 - DNA, 32 bp, Artificial Sequence
  Synthetic oligonucleotide
tcgtcggacgtcgcctttcttcgctccatctg

SEQ ID NO: 55112 - DNA, 35 bp, Artificial Sequence
  Synthetic oligonucleotide
gaccaggctacatgcataaaccctacttgaccgtg

SEQ ID NO: 55113 - DNA, 35 bp, Artificial Sequence
  Synthetic oligonucleotide
tctccgccaactctatttacgtcatccgacacact

SEQ ID NO: 55114 - DNA, 35 bp, Artificial Sequence
  Synthetic oligonucleotide
tactcacttgcaggtccgcaagtgaaccctttcct

SEQ ID NO: 55115 - DNA, 35 bp, Artificial Sequence
  Synthetic oligonucleotide
gttaccagctccgcgctcgttctacactctcctct

SEQ ID NO: 55116 - DNA, 35 bp, Artificial Sequence
  Synthetic oligonucleotide
tttggcgccggcacccgctacccgttgtctctggt

SEQ ID NO: 55117 - DNA, 35 bp, Artificial Sequence
  Synthetic oligonucleotide
atcctcaaccgttacgcccttagtatggcaacatt

SEQ ID NO: 55118 - DNA, 35 bp, Artificial Sequence
  Synthetic oligonucleotide
gatgagagctggtcgtccgccttctcttgcacatt

SEQ ID NO: 55119 - DNA, 35 bp, Artificial Sequence
  Synthetic oligonucleotide
taacccaaacctcccgaccggcggtcatgctcctt

SEQ ID NO: 55120 - DNA, 35 bp, Artificial Sequence
  Synthetic oligonucleotide
ttccgacctcttggcttgtaacttgtgaactggtt

SEQ ID NO: 55121 - DNA, 35 bp, Artificial Sequence
  Synthetic oligonucleotide
gcgtcacccgctccgactcctcacacctacgtgtt

SEQ ID NO: 55122 - DNA, 35 bp, Artificial Sequence
  Synthetic oligonucleotide
acgtatcctcgggcctggccaagctaccgatcttt

SEQ ID NO: 55123 - DNA, 36 bp, Artificial Sequence
  Synthetic oligonucleotide
tcaggtgctactgcagggagcggggggagtggcaaa

SEQ ID NO: 55124 - DNA, 36 bp, Artificial Sequence
  Synthetic oligonucleotide
aacaccgtgtgcgtggcgtacctggcctttgttcaa

SEQ ID NO: 55125 - DNA, 36 bp, Artificial Sequence
  Synthetic oligonucleotide
ggaagaggggcaggagaggcacagtagggataggaa

SEQ ID NO: 55126 - DNA, 36 bp, Artificial Sequence
  Synthetic oligonucleotide
gtgcgacgaggacgctcattatacccattccccaca

SEQ ID NO: 55127 - DNA, 36 bp, Artificial Sequence
  Synthetic oligonucleotide
gacgatgccgtgattttcttcggcccagttccacca

SEQ ID NO: 55128 - DNA, 35 bp, Artificial Sequence
  Synthetic oligonucleotide
ttgacacctctccccgtgccgcgcgggtatcccca

SEQ ID NO: 55129 - DNA, 36 bp, Artificial Sequence
  Synthetic oligonucleotide
gcagagctcacctactgctttgaacccctaaggcca

SEQ ID NO: 55130 - DNA, 36 bp, Artificial Sequence
  Synthetic oligonucleotide
gtctgccgccgcctgttccaacgcctatgatctcca

SEQ ID NO: 55131 - DNA, 36 bp, Artificial Sequence
  Synthetic oligonucleotide
accctgcctggccaagttcccttcttctcaggatca

SEQ ID NO: 55132 - DNA, 37 bp, Artificial Sequence
  Synthetic oligonucleotide
gcgcctccgcagagttaacaaacttccccaacccaga

SEQ ID NO: 55133 - DNA, 37 bp, Artificial Sequence
  Synthetic oligonucleotide
gtgacaccgcaagccgagcaattctccaggtactaga

SEQ ID NO: 55134 - DNA, 37 bp, Artificial Sequence
  Synthetic oligonucleotide
acagacactctcgattggttccctcgtactctctcga

SEQ ID NO: 55135 - DNA, 35 bp, Artificial Sequence
  Synthetic oligonucleotide
gaatgcgcaaatcttctccatctactgctggtcga

SEQ ID NO: 55136 - DNA, 37 bp, Artificial Sequence
  Synthetic oligonucleotide
attgaccccccacctgcatgtccatatcaagatagga

SEQ ID NO: 55137 - DNA, 37 bp, Artificial Sequence
  Synthetic oligonucleotide
gttccgccacagtggtttccttattctattcctggga

SEQ ID NO: 55138 - DNA, 37 bp, Artificial Sequence
  Synthetic oligonucleotide
acccacggcgccttgtttctgtgcccgatcgcatgga

SEQ ID NO: 55139 - DNA, 37 bp, Artificial Sequence
  Synthetic oligonucleotide
ttatcgccccctagtgcctacgtcttcctaccttgga

SEQ ID NO: 55140 - DNA, 38 bp, Artificial Sequence
  Synthetic oligonucleotide
acccagcacacgttctgccattctcttatagtcgatga

SEQ ID NO: 55141 - DNA, 38 bp, Artificial Sequence
  Synthetic oligonucleotide
taccccacctggtcgctgtatcgctatttcacctatga

SEQ ID NO: 55142 - DNA, 37 bp, Artificial Sequence
  Synthetic oligonucleotide
ggaatgaaagccggaggggataaggggcatggactga

SEQ ID NO: 55143 - DNA, 36 bp, Artificial Sequence
  Synthetic oligonucleotide
atcttgccactgaccgcagactctacaccgacctga

SEQ ID NO: 55144 - DNA, 36 bp, Artificial Sequence
  Synthetic oligonucleotide
gagcgaccccgccaacgactcatccgtaccccctga

SEQ ID NO: 55145 - DNA, 37 bp, Artificial Sequence
  Synthetic oligonucleotide
gtccgggcgcgcgctttacgtaacatcccatccctga

SEQ ID NO: 55146 - DNA, 38 bp, Artificial Sequence
  Synthetic oligonucleotide
ggagcgatctgtcgcaatcactcacctccctggcctga

SEQ ID NO: 55147 - DNA, 35 bp, Artificial Sequence
  Synthetic oligonucleotide
gaatggacggggcggggaggaaatggcccaagtga

SEQ ID NO: 55148 - DNA, 38 bp, Artificial Sequence
  Synthetic oligonucleotide
tccaacggtccggtccgtacgttctacctatcctgtga

SEQ ID NO: 55149 - DNA, 38 bp, Artificial Sequence
  Synthetic oligonucleotide
tctggcctgttccatcagtgcgtcttttggtcagttga

SEQ ID NO: 55150 - DNA, 35 bp, Artificial Sequence
  Synthetic oligonucleotide
tgaacacgcacaccttatcatttcaacagtcacta

SEQ ID NO: 55151 - DNA, 35 bp, Artificial Sequence
  Synthetic oligonucleotide
tacgccactgccagtggacagactgcaatcttcta

SEQ ID NO: 55152 - DNA, 35 bp, Artificial Sequence
  Synthetic oligonucleotide
ttgtatcccttccctcgatctctcaaaaggaccac

SEQ ID NO: 55153 - DNA, 35 bp, Artificial Sequence
  Synthetic oligonucleotide
aacatctctgaggacgataccatgctgcctattac

SEQ ID NO: 55154 - DNA, 35 bp, Artificial Sequence
  Synthetic oligonucleotide
gtgtcacggccacaactcgaattacccgccccgcc

SEQ ID NO: 55155 - DNA, 35 bp, Artificial Sequence
  Synthetic oligonucleotide
attgtcgcctactttcgtggccatcctggtattcc

SEQ ID NO: 55156 - DNA, 34 bp, Artificial Sequence
  Synthetic oligonucleotide
tccaacgtggtagaattgctcctccctttaacgc

SEQ ID NO: 55157 - DNA, 35 bp, Artificial Sequence
  Synthetic oligonucleotide
tcctctcgcccagtcttcatgtcatctcaaccggc

SEQ ID NO: 55158 - DNA, 35 bp, Artificial Sequence
  Synthetic oligonucleotide
aacacgagtgctacggttttctctatttttcctgc

SEQ ID NO: 55159 - DNA, 35 bp, Artificial Sequence
  Synthetic oligonucleotide
gctatctgccggtccaatacacctcttgtcacatc

SEQ ID NO: 55160 - DNA, 35 bp, Artificial Sequence
  Synthetic oligonucleotide
aaccactgatcaattgccgaatactcgcgaagctc

SEQ ID NO: 55161 - DNA, 35 bp, Artificial Sequence
  Synthetic oligonucleotide
tcacattcctcccgagcgttcggccaccccaggtc

SEQ ID NO: 55162 - DNA, 35 bp, Artificial Sequence
  Synthetic oligonucleotide
ggggaggcgttgctgtcatctattcccatcttgtc

SEQ ID NO: 55163 - DNA, 35 bp, Artificial Sequence
  Synthetic oligonucleotide
gcagatcaacggtggtggaggtaggggggaacaag

SEQ ID NO: 55164 - DNA, 35 bp, Artificial Sequence
  Synthetic oligonucleotide
gagtgactgtaggtggtgtcagtgaagggaggaag

SEQ ID NO: 55165 - DNA, 35 bp, Artificial Sequence
  Synthetic oligonucleotide
ccagtgctgggccctccctcaggtctctaccaacg

SEQ ID NO: 55166 - DNA, 35 bp, Artificial Sequence
  Synthetic oligonucleotide
gacccctacatcccgcaccccaccgctattatgcg

SEQ ID NO: 55167 - DNA, 35 bp, Artificial Sequence
  Synthetic oligonucleotide
gaacgtccccgttgcacgattcctaattactgtcg

SEQ ID NO: 55168 - DNA, 36 bp, Artificial Sequence
  Synthetic oligonucleotide
gcaggattaaggcggggaactaggacggtcggtggg

SEQ ID NO: 55169 - DNA, 35 bp, Artificial Sequence
  Synthetic oligonucleotide
acgctcttccatagtttgcgtatctcttctccctg

SEQ ID NO: 55170 - DNA, 35 bp, Artificial Sequence
  Synthetic oligonucleotide
tgccagaatcgtccggcgctgcatattctacccct

SEQ ID NO: 55171 - DNA, 35 bp, Artificial Sequence
  Synthetic oligonucleotide
tccaagcgtgcgatacccttttgctcacaccgcgt

SEQ ID NO: 55172 - DNA, 35 bp, Artificial Sequence
  Synthetic oligonucleotide
gcaccccacgctcgaacaacctgcccgcctccggt

SEQ ID NO: 55173 - DNA, 35 bp, Artificial Sequence
  Synthetic oligonucleotide
gcccgatcgcgccaagagctacacaacccttgctt

SEQ ID NO: 55174 - DNA, 36 bp, Artificial Sequence
  Synthetic oligonucleotide
atcaccatccacgcaccgcaattgacattcttaaaa

SEQ ID NO: 55175 - DNA, 36 bp, Artificial Sequence
  Synthetic oligonucleotide
gctctccgtagctgcatcttcccttaaaccccggaa

SEQ ID NO: 55176 - DNA, 36 bp, Artificial Sequence
  Synthetic oligonucleotide
gacccctaacaacttgtttctcgtacatagagaaca

SEQ ID NO: 55177 - DNA, 35 bp, Artificial Sequence
  Synthetic oligonucleotide
gatcccacgcaccagctaggtgcacttcgcgaaca

SEQ ID NO: 55178 - DNA, 36 bp, Artificial Sequence
  Synthetic oligonucleotide
acatgagcacagggaccgtacaaatcagagggaaca

SEQ ID NO: 55179 - DNA, 34 bp, Artificial Sequence
  Synthetic oligonucleotide
gccacctgagatctttaatagggccacctgaaca

SEQ ID NO: 55180 - DNA, 36 bp, Artificial Sequence
  Synthetic oligonucleotide
gctgcaagccccaatagacatatttacctggctaca

SEQ ID NO: 55181 - DNA, 35 bp, Artificial Sequence
  Synthetic oligonucleotide
agggccacctatgccggggtttctctatctcacca

SEQ ID NO: 55182 - DNA, 36 bp, Artificial Sequence
  Synthetic oligonucleotide
gaaaacactccacggtgccccgtactgtacagtcca

SEQ ID NO: 55183 - DNA, 36 bp, Artificial Sequence
  Synthetic oligonucleotide
tcctaactgactgccactattttccgcccaagggca

SEQ ID NO: 55184 - DNA, 36 bp, Artificial Sequence
  Synthetic oligonucleotide
acgttctacgcctccctcgctaatgcatagtttgca

SEQ ID NO: 55185 - DNA, 36 bp, Artificial Sequence
  Synthetic oligonucleotide
actaccttgaacctcggtggactaacaatcacttca

SEQ ID NO: 55186 - DNA, 37 bp, Artificial Sequence
  Synthetic oligonucleotide
aaggggtgaagggtgggactatgagttctggggcaga

SEQ ID NO: 55187 - DNA, 37 bp, Artificial Sequence
  Synthetic oligonucleotide
tgcaccagcccctgccgtttcagatccttattgcaga

SEQ ID NO: 55188 - DNA, 37 bp, Artificial Sequence
  Synthetic oligonucleotide
ggagcccgcctgaccttcgatttggcattttccacga

SEQ ID NO: 55189 - DNA, 35 bp, Artificial Sequence
  Synthetic oligonucleotide
acacccgaccgagtggccttagttcactacctcga

SEQ ID NO: 55190 - DNA, 37 bp, Artificial Sequence
  Synthetic oligonucleotide
tctgccctacgtgtgcgcgcaaggacgtactgcagga

SEQ ID NO: 55191 - DNA, 36 bp, Artificial Sequence
  Synthetic oligonucleotide
gaacgaaggaagtgggcggaagaggagtgatgggga

SEQ ID NO: 55192 - DNA, 36 bp, Artificial Sequence
  Synthetic oligonucleotide
tgcaccaccacccattaacgcagcttattcctggga

SEQ ID NO: 55193 - DNA, 38 bp, Artificial Sequence
  Synthetic oligonucleotide
ggaccagcctcccccatgcccattgttgcgcatactga

SEQ ID NO: 55194 - DNA, 38 bp, Artificial Sequence
  Synthetic oligonucleotide
actgcccttcttccacttgtactaactgaccttcctga

SEQ ID NO: 55195 - DNA, 37 bp, Artificial Sequence
  Synthetic oligonucleotide
aagtcgcccacctgttcgtgttttcacatccctctga

SEQ ID NO: 55196 - DNA, 37 bp, Artificial Sequence
  Synthetic oligonucleotide
taccagtccgttgtccacggtctccatccatctctga

SEQ ID NO: 55197 - DNA, 38 bp, Artificial Sequence
  Synthetic oligonucleotide
aaacgccacactggccctcccagatcactgaacggtga

SEQ ID NO: 55198 - DNA, 38 bp, Artificial Sequence
  Synthetic oligonucleotide
atgctgacccacacgctcccgtaagccctcctttgtga

SEQ ID NO: 55199 - DNA, 38 bp, Artificial Sequence
  Synthetic oligonucleotide
acgagaggaggaaaaaagtggtggtaaggatctattga

SEQ ID NO: 55200 - DNA, 35 bp, Artificial Sequence
  Synthetic oligonucleotide
tttatcccgccgccacagtaatatcctcaacttga

SEQ ID NO: 55201 - DNA, 38 bp, Artificial Sequence
  Synthetic oligonucleotide
tttgcttactccagcccatcgaacatagccaaccttga

SEQ ID NO: 55202 - DNA, 38 bp, Artificial Sequence
  Synthetic oligonucleotide
ttgaacccgacggaaattgtcgctagtgccctccttga

SEQ ID NO: 55203 - DNA, 38 bp, Artificial Sequence
  Synthetic oligonucleotide
tactgccacctactttgccctagattctgcatgcttga

SEQ ID NO: 55204 - DNA, 37 bp, Artificial Sequence
  Synthetic oligonucleotide
ttaatgccccgcccgactgtgactattacctcgttga

SEQ ID NO: 55205 - DNA, 37 bp, Artificial Sequence
  Synthetic oligonucleotide
agtgaccctctatcacgtaagacatcctgcaacccta

SEQ ID NO: 55206 - DNA, 35 bp, Artificial Sequence
  Synthetic oligonucleotide
atggctaccgcaactccatcacctgacctgtgcta

SEQ ID NO: 55207 - DNA, 36 bp, Artificial Sequence
  Synthetic oligonucleotide
tcataccacacccgggtacgaagtatcccgcatgta

SEQ ID NO: 55208 - DNA, 35 bp, Artificial Sequence
  Synthetic oligonucleotide
tactcactgtcacaccacgtcctgacaggttatta

SEQ ID NO: 55209 - DNA, 35 bp, Artificial Sequence
  Synthetic oligonucleotide
tcaatggtggggccgttgccaatttagtgatgcac

SEQ ID NO: 55210 - DNA, 35 bp, Artificial Sequence
  Synthetic oligonucleotide
tgccaacatctactaggtgcagcgccctcctcgac

SEQ ID NO: 55211 - DNA, 35 bp, Artificial Sequence
  Synthetic oligonucleotide
tgcggcctcacaccagccaagcgcctttcgtcgac

SEQ ID NO: 55212 - DNA, 35 bp, Artificial Sequence
  Synthetic oligonucleotide
tgtcaacaaaggatggaaaccgcattcccctgtac

SEQ ID NO: 55213 - DNA, 35 bp, Artificial Sequence
  Synthetic oligonucleotide
gcgctgctcatcaccgccaagatgctccacgttcc

SEQ ID NO: 55214 - DNA, 35 bp, Artificial Sequence
  Synthetic oligonucleotide
tgaactatcaggcaagactccctcattctttgcgc

SEQ ID NO: 55215 - DNA, 35 bp, Artificial Sequence
  Synthetic oligonucleotide
ttatcgtgcggtgcccatttcgattagttcctcgc

SEQ ID NO: 55216 - DNA, 35 bp, Artificial Sequence
  Synthetic oligonucleotide
gtgtgaacaggggcagtgcaggcaggtagggttgc

SEQ ID NO: 55217 - DNA, 35 bp, Artificial Sequence
  Synthetic oligonucleotide
ggaacgaggggtggactacaatggcggccgcgatc

SEQ ID NO: 55218 - DNA, 35 bp, Artificial Sequence
  Synthetic oligonucleotide
atccccccatgagcccacctcgtctgcgctagttc

SEQ ID NO: 55219 - DNA, 35 bp, Artificial Sequence
  Synthetic oligonucleotide
attagctactgtcaccacgcatggaccatactttc

SEQ ID NO: 55220 - DNA, 35 bp, Artificial Sequence
  Synthetic oligonucleotide
aacaaccgaccacattgaccattagggagcccacg

SEQ ID NO: 55221 - DNA, 35 bp, Artificial Sequence
  Synthetic oligonucleotide
gcacaggagggacccactaccaccgctgcccatcg

SEQ ID NO: 55222 - DNA, 35 bp, Artificial Sequence
  Synthetic oligonucleotide
gccccgttgactaactcgcttaactgacactatcg

SEQ ID NO: 55223 - DNA, 35 bp, Artificial Sequence
  Synthetic oligonucleotide
atgccaagccacgatactgtccggttttaattgtg

SEQ ID NO: 55224 - DNA, 35 bp, Artificial Sequence
  Synthetic oligonucleotide
gtagtccaccccattctgcggacagctttctccat

SEQ ID NO: 55225 - DNA, 35 bp, Artificial Sequence
  Synthetic oligonucleotide
aacctgacgcggcctatttcaccacggcaactcct

SEQ ID NO: 55226 - DNA, 35 bp, Artificial Sequence
  Synthetic oligonucleotide
gggatcgccctcttcgtactgtgcacgtcttttct

SEQ ID NO: 55227 - DNA, 35 bp, Artificial Sequence
  Synthetic oligonucleotide
tcatcctgagcgtcccttgtgcttctcgatcgcgt

SEQ ID NO: 55228 - DNA, 35 bp, Artificial Sequence
  Synthetic oligonucleotide
tactcacttcgccaccaggtttcaactctcaggtt

SEQ ID NO: 55229 - DNA, 35 bp, Artificial Sequence
  Synthetic oligonucleotide
tctaaataccaccccacgcgcaatcgtgtgctgtt

SEQ ID NO: 55230 - DNA, 35 bp, Artificial Sequence
  Synthetic oligonucleotide
tcgctacggtcgcattggtaggccctttttcgttt

SEQ ID NO: 55231 - DNA, 35 bp, Artificial Sequence
  Synthetic oligonucleotide
gactgacccacgtctgtcatatctgtggccatttt

SEQ ID NO: 55232 - DNA, 35 bp, Artificial Sequence
  Synthetic oligonucleotide
aattaggtcgcgtatccttctgtcccgtcgctttt

SEQ ID NO: 55233 - DNA, 36 bp, Artificial Sequence
  Synthetic oligonucleotide
atcgacgacgacagctcgcgcgcccctcctctgcaa

SEQ ID NO: 55234 - DNA, 36 bp, Artificial Sequence
  Synthetic oligonucleotide
tccctgtctcacgctaagaattttccgccctccgaa

SEQ ID NO: 55235 - DNA, 36 bp, Artificial Sequence
  Synthetic oligonucleotide
tctccggaaggcagtatcgtaccacccctcccctaa

SEQ ID NO: 55236 - DNA, 36 bp, Artificial Sequence
  Synthetic oligonucleotide
gacgcaaatatcagtgtgttccccacacctgcccca

SEQ ID NO: 55237 - DNA, 36 bp, Artificial Sequence
  Synthetic oligonucleotide
agcacgtagtgccaagttctttagcgcgttctccca

SEQ ID NO: 55238 - DNA, 35 bp, Artificial Sequence
  Synthetic oligonucleotide
gctgaagggaggtgtgggggctgtattctaacgca

SEQ ID NO: 55239 - DNA, 36 bp, Artificial Sequence
  Synthetic oligonucleotide
gtggggaaaatacaggtatcggtggggcagtgggca

SEQ ID NO: 55240 - DNA, 35 bp, Artificial Sequence
  Synthetic oligonucleotide
tcacccatcacgccgagacaagtggaacaatatca

SEQ ID NO: 55241 - DNA, 37 bp, Artificial Sequence
  Synthetic oligonucleotide
taccatgcgctggtacgcccacaccacatttactaga

SEQ ID NO: 55242 - DNA, 37 bp, Artificial Sequence
  Synthetic oligonucleotide
tagagagcaacaggggaccgaatggaagaaggctaga

SEQ ID NO: 55243 - DNA, 36 bp, Artificial Sequence
  Synthetic oligonucleotide
acttgacctcgtctgctctaccgccaactctaccga

SEQ ID NO: 55244 - DNA, 37 bp, Artificial Sequence
  Synthetic oligonucleotide
aatgccccgcacgccagcctagcctcatggatcccga

SEQ ID NO: 55245 - DNA, 37 bp, Artificial Sequence
  Synthetic oligonucleotide
accgcagggaacctctcttcctctgtccatgagccga

SEQ ID NO: 55246 - DNA, 37 bp, Artificial Sequence
  Synthetic oligonucleotide
actcatccgaccagtaggtctttcttgtacccgccga

SEQ ID NO: 55247 - DNA, 36 bp, Artificial Sequence
  Synthetic oligonucleotide
gacccgtgccctactcgaccctcgacccttttccga

SEQ ID NO: 55248 - DNA, 37 bp, Artificial Sequence
  Synthetic oligonucleotide
gagctgaggccggtggtcgggaataaatggctggcga

SEQ ID NO: 55249 - DNA, 36 bp, Artificial Sequence
  Synthetic oligonucleotide
agcatccctgacttccgtacccccggtaactctcga

SEQ ID NO: 55250 - DNA, 37 bp, Artificial Sequence
  Synthetic oligonucleotide
gataggcaaaggatgtgaaagaaggaagttcagagga

SEQ ID NO: 55251 - DNA, 37 bp, Artificial Sequence
  Synthetic oligonucleotide
ttggcacccccggaggcctcgtcaatcacttctcgga

SEQ ID NO: 55252 - DNA, 37 bp, Artificial Sequence
  Synthetic oligonucleotide
ttgtgtgtcaggggcggaatggagggatggataggga

SEQ ID NO: 55253 - DNA, 37 bp, Artificial Sequence
  Synthetic oligonucleotide
atccgttccctgttctgccgttagtactccctcggga

SEQ ID NO: 55254 - DNA, 37 bp, Artificial Sequence
  Synthetic oligonucleotide
taatacgcggaggggtgccttggtagcacagggggga

SEQ ID NO: 55255 - DNA, 36 bp, Artificial Sequence
  Synthetic oligonucleotide
tccatgtgacctgttcacacccccgtgttctgggga

SEQ ID NO: 55256 - DNA, 37 bp, Artificial Sequence
  Synthetic oligonucleotide
ttgtgcgcgaaggctggtgcggggggtacgagatgga

SEQ ID NO: 55257 - DNA, 36 bp, Artificial Sequence
  Synthetic oligonucleotide
acgcactacgctctcgcttcctccagctaccctgga

SEQ ID NO: 55258 - DNA, 38 bp, Artificial Sequence
  Synthetic oligonucleotide
acgtctgtgcccgttcgtacctccttttcaatgcatga

SEQ ID NO: 55259 - DNA, 38 bp, Artificial Sequence
  Synthetic oligonucleotide
gcctacgttgaattcttgtaacgtccgtcccctcctga

SEQ ID NO: 55260 - DNA, 38 bp, Artificial Sequence
  Synthetic oligonucleotide
tccacgacccattgattcgtccgccccccccttcctga

SEQ ID NO: 55261 - DNA, 37 bp, Artificial Sequence
  Synthetic oligonucleotide
atgattgccggccatgtttctcttccataccatctga

SEQ ID NO: 55262 - DNA, 36 bp, Artificial Sequence
  Synthetic oligonucleotide
ggacatcctgggccccctacgccattccgtctctga

SEQ ID NO: 55263 - DNA, 35 bp, Artificial Sequence
  Synthetic oligonucleotide
gagcccctccacaggtaaacgaccgagagtcgtga

SEQ ID NO: 55264 - DNA, 38 bp, Artificial Sequence
  Synthetic oligonucleotide
taccgcacaacgtggcctgccttcccccttctgtgtga

SEQ ID NO: 55265 - DNA, 38 bp, Artificial Sequence
  Synthetic oligonucleotide
gccgcctgcaccatcccctctcatgtattagtttgtga

SEQ ID NO: 55266 - DNA, 38 bp, Artificial Sequence
  Synthetic oligonucleotide
tcgttacggccaatagcggtaccgatcctcctccttga

SEQ ID NO: 55267 - DNA, 38 bp, Artificial Sequence
  Synthetic oligonucleotide
tatcctgtgcgattggagcaccccaaattcctccttga

SEQ ID NO: 55268 - DNA, 37 bp, Artificial Sequence
  Synthetic oligonucleotide
gacataaccgcactgcccccctccagacttcgcttga

SEQ ID NO: 55269 - DNA, 37 bp, Artificial Sequence
  Synthetic oligonucleotide
gacgacaaggtgagcaaaaagggtatgaagcggttga

SEQ ID NO: 55270 - DNA, 37 bp, Artificial Sequence
  Synthetic oligonucleotide
gaagaccacagcacgcagcttatggtcacttttttga

SEQ ID NO: 55271 - DNA, 36 bp, Artificial Sequence
  Synthetic oligonucleotide
agtacaccctagagagccgatgatctggcgcaccta

SEQ ID NO: 55272 - DNA, 36 bp, Artificial Sequence
  Synthetic oligonucleotide
gcgcacccggcaaaccgcaacccgtcccaaagccta

SEQ ID NO: 55273 - DNA, 36 bp, Artificial Sequence
  Synthetic oligonucleotide
gtgtcttcgccggttcataacctcaacaccttgcta

SEQ ID NO: 55274 - DNA, 35 bp, Artificial Sequence
  Synthetic oligonucleotide
tcagcacgtacatcagctccataaacactctggta

SEQ ID NO: 55275 - DNA, 36 bp, Artificial Sequence
  Synthetic oligonucleotide
tgcgcgaagcaccactggccgcttttgttactgtta

SEQ ID NO: 55276 - DNA, 35 bp, Artificial Sequence
  Synthetic oligonucleotide
tccacacctatgtgaggatcacaattatccccgac

SEQ ID NO: 55277 - DNA, 35 bp, Artificial Sequence
  Synthetic oligonucleotide
acgtttcactgcctatgtaccgcccttttcgcgac

SEQ ID NO: 55278 - DNA, 35 bp, Artificial Sequence
  Synthetic oligonucleotide
atccttgaagtccccgatcactgctcgttcctgac

SEQ ID NO: 55279 - DNA, 35 bp, Artificial Sequence
  Synthetic oligonucleotide
tcgattcgaacttaactctgcctgagggcatgtac

SEQ ID NO: 55280 - DNA, 35 bp, Artificial Sequence
  Synthetic oligonucleotide
gctccgtgctgaacctgttaccctccgccatgtcc

SEQ ID NO: 55281 - DNA, 35 bp, Artificial Sequence
  Synthetic oligonucleotide
gccccccggcacctctcatccaggacactccttcc

SEQ ID NO: 55282 - DNA, 35 bp, Artificial Sequence
  Synthetic oligonucleotide
agcatgatgcctcattttctgttctagttagttcc

SEQ ID NO: 55283 - DNA, 35 bp, Artificial Sequence
  Synthetic oligonucleotide
acacgctggtcgggaaaacgttaaacgctaggagc

SEQ ID NO: 55284 - DNA, 35 bp, Artificial Sequence
  Synthetic oligonucleotide
aaatacggcccctggactatcaacgtaacctccgc

SEQ ID NO: 55285 - DNA, 35 bp, Artificial Sequence
  Synthetic oligonucleotide
tcttatccgccacacatctcatcacgcaacccggc

SEQ ID NO: 55286 - DNA, 35 bp, Artificial Sequence
  Synthetic oligonucleotide
gctaattccaagcccacatggatcacccatcctgc

SEQ ID NO: 55287 - DNA, 35 bp, Artificial Sequence
  Synthetic oligonucleotide
cgccttaccatacttccctgatctgataaaacgtc

SEQ ID NO: 55288 - DNA, 35 bp, Artificial Sequence
  Synthetic oligonucleotide
ttttgatccgcctcactattctagcgacgtaggtc

SEQ ID NO: 55289 - DNA, 35 bp, Artificial Sequence
  Synthetic oligonucleotide
gactccgatctcgctggctcttgtactagtttgtc

SEQ ID NO: 55290 - DNA, 36 bp, Artificial Sequence
  Synthetic oligonucleotide
aactgaagggggggagagacaatggcgacagaattc

SEQ ID NO: 55291 - DNA, 35 bp, Artificial Sequence
  Synthetic oligonucleotide
tagtcaccgccttgtccccatgccttgtctaattc

SEQ ID NO: 55292 - DNA, 35 bp, Artificial Sequence
  Synthetic oligonucleotide
gctcgcggtcctgctctccaccattcggggatttc

SEQ ID NO: 55293 - DNA, 35 bp, Artificial Sequence
  Synthetic oligonucleotide
tctaggccgtttccggtgtcttccctcgttatttc

SEQ ID NO: 55294 - DNA, 35 bp, Artificial Sequence
  Synthetic oligonucleotide
accctgtccttgttgcttactaacggaccactttc

SEQ ID NO: 55295 - DNA, 35 bp, Artificial Sequence
  Synthetic oligonucleotide
acgcacgaaggggggtctaaacaaggcgagaacag

SEQ ID NO: 55296 - DNA, 35 bp, Artificial Sequence
  Synthetic oligonucleotide
gtaaacccctcacctcctgccacgcgtagatcgcg

SEQ ID NO: 55297 - DNA, 35 bp, Artificial Sequence
  Synthetic oligonucleotide
gaacgcatcccaatactcgtcgatgattcccatcg

SEQ ID NO: 55298 - DNA, 35 bp, Artificial Sequence
  Synthetic oligonucleotide
tgatacgcaattcgagtccactgttctttctttcg

SEQ ID NO: 55299 - DNA, 35 bp, Artificial Sequence
  Synthetic oligonucleotide
gtgtaggtcccgaattagtactgcccgagcctatg

SEQ ID NO: 55300 - DNA, 35 bp, Artificial Sequence
  Synthetic oligonucleotide
ggagtggaatcacggaggttttgagaggggggttg

SEQ ID NO: 55301 - DNA, 36 bp, Artificial Sequence
  Synthetic oligonucleotide
gttgctactgcccgtagtccttcataagcttcgcct

SEQ ID NO: 55302 - DNA, 35 bp, Artificial Sequence
  Synthetic oligonucleotide
acctcaacctgtaggatgtcacccctcatcgcctt

SEQ ID NO: 55303 - DNA, 35 bp, Artificial Sequence
  Synthetic oligonucleotide
ttccaggtcaggcgcccaaggctcattacttcctt

SEQ ID NO: 55304 - DNA, 35 bp, Artificial Sequence
  Synthetic oligonucleotide
atgtatccaccatgagcttagctgcatacgatttt

SEQ ID NO: 55305 - DNA, 36 bp, Artificial Sequence
  Synthetic oligonucleotide
tccttgccactattccgggtccttactgatcacaaa

SEQ ID NO: 55306 - DNA, 36 bp, Artificial Sequence
  Synthetic oligonucleotide
tccagagatcaggaccgtgcatccctcctacccaaa

SEQ ID NO: 55307 - DNA, 36 bp, Artificial Sequence
  Synthetic oligonucleotide
ttgtcaccccacccccggtaccccccgctggggaaa

SEQ ID NO: 55308 - DNA, 36 bp, Artificial Sequence
  Synthetic oligonucleotide
aacacgtacagggaggggccaacaaggatgactaaa

SEQ ID NO: 55309 - DNA, 36 bp, Artificial Sequence
  Synthetic oligonucleotide
tccacccctcacatcgtctcagcacaccccccagaa

SEQ ID NO: 55310 - DNA, 36 bp, Artificial Sequence
  Synthetic oligonucleotide
tccggctcacctcacgcccccgtccgcgccctcgaa

SEQ ID NO: 55311 - DNA, 36 bp, Artificial Sequence
  Synthetic oligonucleotide
gtacgccgtccccaccgccactatgcatattgtgaa

SEQ ID NO: 55312 - DNA, 35 bp, Artificial Sequence
  Synthetic oligonucleotide
ggacaacctgggtcgtggttcacacgtaaaattaa

SEQ ID NO: 55313 - DNA, 36 bp, Artificial Sequence
  Synthetic oligonucleotide
tcagtaccggcctcttctctcgcttgctggtgaaca

SEQ ID NO: 55314 - DNA, 36 bp, Artificial Sequence
  Synthetic oligonucleotide
tccagcacgggtttcttctgctcagacttttctaca

SEQ ID NO: 55315 - DNA, 35 bp, Artificial Sequence
  Synthetic oligonucleotide
gtcatcgatcgcgagttctcccttatcccgccgca

SEQ ID NO: 55316 - DNA, 36 bp, Artificial Sequence
  Synthetic oligonucleotide
gtgcgctggtccacaacaaccgttttagtcgcctca

SEQ ID NO: 55317 - DNA, 37 bp, Artificial Sequence
  Synthetic oligonucleotide
aagcccgggcgggagttaacgagaagggggggaaaga

SEQ ID NO: 55318 - DNA, 37 bp, Artificial Sequence
  Synthetic oligonucleotide
aaatcgagaggagaggaccagcagggaagggtggaga

SEQ ID NO: 55319 - DNA, 37 bp, Artificial Sequence
  Synthetic oligonucleotide
gccacccttcggagttatcgcgattcaccgcccccga

SEQ ID NO: 55320 - DNA, 37 bp, Artificial Sequence
  Synthetic oligonucleotide
tatcacccccaacctacctagcattcaagagacgcga

SEQ ID NO: 55321 - DNA, 37 bp, Artificial Sequence
  Synthetic oligonucleotide
atcgacgcagggaaaatgaactgaaagattgtggcga

SEQ ID NO: 55322 - DNA, 37 bp, Artificial Sequence
  Synthetic oligonucleotide
gaggcaaatacggataggggaagggggcatttacgga

SEQ ID NO: 55323 - DNA, 37 bp, Artificial Sequence
  Synthetic oligonucleotide
gtgaaggcgtgcgagtcagggcaagtggtagtgggga

SEQ ID NO: 55324 - DNA, 37 bp, Artificial Sequence
  Synthetic oligonucleotide
gcgactaacccaatgatcctgcacctcaacccctgga

SEQ ID NO: 55325 - DNA, 37 bp, Artificial Sequence
  Synthetic oligonucleotide
agaatgagaagggcaattggtggagaagcgggttgga

SEQ ID NO: 55326 - DNA, 38 bp, Artificial Sequence
  Synthetic oligonucleotide
taccaatccccagtgatgcaaggtgttccgcccaatga

SEQ ID NO: 55327 - DNA, 38 bp, Artificial Sequence
  Synthetic oligonucleotide
gaggtagctcgggaatggagcggggattggaggaatga

SEQ ID NO: 55328 - DNA, 37 bp, Artificial Sequence
  Synthetic oligonucleotide
acccacccatctgacatagtgacgcgttggttactga

SEQ ID NO: 55329 - DNA, 38 bp, Artificial Sequence
  Synthetic oligonucleotide
cccgccgtcaccccctacccgcacgcataaggacctga

SEQ ID NO: 55330 - DNA, 38 bp, Artificial Sequence
  Synthetic oligonucleotide
tgtacagcctcatctgccaccttactacctaggtctga

SEQ ID NO: 55331 - DNA, 37 bp, Artificial Sequence
  Synthetic oligonucleotide
ttgtcccctcgacttgatctgtgtcatctatcattga

SEQ ID NO: 55332 - DNA, 38 bp, Artificial Sequence
  Synthetic oligonucleotide
gtggaaggggcacgggagagacggtccgcgtggattga

SEQ ID NO: 55333 - DNA, 37 bp, Artificial Sequence
  Synthetic oligonucleotide
acgcgaccatcacggctgtaccctttcacatgattga

SEQ ID NO: 55334 - DNA, 37 bp, Artificial Sequence
  Synthetic oligonucleotide
ttcccattggccacatagtagtctactgcccccttga

SEQ ID NO: 55335 - DNA, 35 bp, Artificial Sequence
  Synthetic oligonucleotide
tcatccgtcaacaggtcatgttatctcccgcgcta

SEQ ID NO: 55336 - DNA, 36 bp, Artificial Sequence
  Synthetic oligonucleotide
acgaccctcgaggcaagacaaaccccgtccctagta

SEQ ID NO: 55337 - DNA, 36 bp, Artificial Sequence
  Synthetic oligonucleotide
tcaccatgtcactgtacatgggtctgtcacaacgta

SEQ ID NO: 55338 - DNA, 35 bp, Artificial Sequence
  Synthetic oligonucleotide
atgagtgcccttcattctatcgcgacctcctcgta

SEQ ID NO: 55339 - DNA, 35 bp, Artificial Sequence
  Synthetic oligonucleotide
gagtctccacctgctgtagttactctctgaaaaac

SEQ ID NO: 55340 - DNA, 35 bp, Artificial Sequence
  Synthetic oligonucleotide
ggaggaacggaaccaacctgtaactctgtgaaccc

SEQ ID NO: 55341 - DNA, 35 bp, Artificial Sequence
  Synthetic oligonucleotide
aactcgttctatcaccggacccgtacttgacaccc

SEQ ID NO: 55342 - DNA, 35 bp, Artificial Sequence
  Synthetic oligonucleotide
aaccacattcgatcaacgtatccgaactccctccc

SEQ ID NO: 55343 - DNA, 35 bp, Artificial Sequence
  Synthetic oligonucleotide
gatcggcggtactccgagccctcacacacactgcc

SEQ ID NO: 55344 - DNA, 35 bp, Artificial Sequence
  Synthetic oligonucleotide
acatcatcttcttcctctaggccggggccaattcc

SEQ ID NO: 55345 - DNA, 35 bp, Artificial Sequence
  Synthetic oligonucleotide
gcgtactccgttctacccgtatcacccctcccagc

SEQ ID NO: 55346 - DNA, 35 bp, Artificial Sequence
  Synthetic oligonucleotide
ggaccaacgctctgcatcctctgccctgtaattgc

SEQ ID NO: 55347 - DNA, 35 bp, Artificial Sequence
  Synthetic oligonucleotide
tgcccgaactcgaccaagaggcttccctcacaccg

SEQ ID NO: 55348 - DNA, 35 bp, Artificial Sequence
  Synthetic oligonucleotide
gatcatggggttaaggcaaagggagagctcagccg

SEQ ID NO: 55349 - DNA, 35 bp, Artificial Sequence
  Synthetic oligonucleotide
tcagacctccactgttctttacactcccgacatcg

SEQ ID NO: 55350 - DNA, 35 bp, Artificial Sequence
  Synthetic oligonucleotide
gcgtggacagggataacaaaagggggcggtcaggg

SEQ ID NO: 55351 - DNA, 35 bp, Artificial Sequence
  Synthetic oligonucleotide
gtcttacactcgcccccagcatggctgaaccaatg

SEQ ID NO: 55352 - DNA, 35 bp, Artificial Sequence
  Synthetic oligonucleotide
accacatgtcctgtcactccttctctccagcactg

SEQ ID NO: 55353 - DNA, 35 bp, Artificial Sequence
  Synthetic oligonucleotide
ggttgtctctcagatcaccaacccatccttccctg

SEQ ID NO: 55354 - DNA, 35 bp, Artificial Sequence
  Synthetic oligonucleotide
gccgcttacgaacccggtccatccaattgagcctg

SEQ ID NO: 55355 - DNA, 35 bp, Artificial Sequence
  Synthetic oligonucleotide
gtgcctagcgcagccactccctcctaaccaccttg

SEQ ID NO: 55356 - DNA, 35 bp, Artificial Sequence
  Synthetic oligonucleotide
tttgctgagccacgaccgatcactccggccttaat

SEQ ID NO: 55357 - DNA, 35 bp, Artificial Sequence
  Synthetic oligonucleotide
gtccgtctgatttccggcctttactatcgcccact

SEQ ID NO: 55358 - DNA, 35 bp, Artificial Sequence
  Synthetic oligonucleotide
taagccaggcccgccgtttgttcgccatccttact

SEQ ID NO: 55359 - DNA, 35 bp, Artificial Sequence
  Synthetic oligonucleotide
gccgtctacgcttccgtccgtacgattgcctctct

SEQ ID NO: 55360 - DNA, 34 bp, Artificial Sequence
  Synthetic oligonucleotide
taggtcaggcgggggccaaatctgcattctttct

SEQ ID NO: 55361 - DNA, 35 bp, Artificial Sequence
  Synthetic oligonucleotide
ttgacttcacttccgatccgttccttctacacagt

SEQ ID NO: 55362 - DNA, 35 bp, Artificial Sequence
  Synthetic oligonucleotide
gaaggaagcaacacaacacactacccttgccgatt

SEQ ID NO: 55363 - DNA, 35 bp, Artificial Sequence
  Synthetic oligonucleotide
tcaccaccgcaaaccccggaactgtaatttacctt

SEQ ID NO: 55364 - DNA, 35 bp, Artificial Sequence
  Synthetic oligonucleotide
ggtcccccctggttgcttggggtttcttttacctt

SEQ ID NO: 55365 - DNA, 35 bp, Artificial Sequence
  Synthetic oligonucleotide
tgtggccgaataaccagcagcgatccctactgctt

SEQ ID NO: 55366 - DNA, 36 bp, Artificial Sequence
  Synthetic oligonucleotide
tcagccaagtgcggggcctcatcacactaatacgtt

SEQ ID NO: 55367 - DNA, 35 bp, Artificial Sequence
  Synthetic oligonucleotide
gttcggccctgatcacctgacggttgttttttgtt

SEQ ID NO: 55368 - DNA, 35 bp, Artificial Sequence
  Synthetic oligonucleotide
tagtactccgtagcgcgatccgtcccattggccaa

SEQ ID NO: 55369 - DNA, 35 bp, Artificial Sequence
  Synthetic oligonucleotide
gataaccgccatacctcgaactagagcccgtggaa

SEQ ID NO: 55370 - DNA, 36 bp, Artificial Sequence
  Synthetic oligonucleotide
gacaggtcgactctccacctgagccctgccgacaca

SEQ ID NO: 55371 - DNA, 35 bp, Artificial Sequence
  Synthetic oligonucleotide
atcctcacccgacatattaacacggttaacggaca

SEQ ID NO: 55372 - DNA, 36 bp, Artificial Sequence
  Synthetic oligonucleotide
taggtgccgccaactgtcttgcctttttcctgccca

SEQ ID NO: 55373 - DNA, 36 bp, Artificial Sequence
  Synthetic oligonucleotide
gcacatctgccgttgcgaaaccttgcctttcatcca

SEQ ID NO: 55374 - DNA, 36 bp, Artificial Sequence
  Synthetic oligonucleotide
gtcaccaaagtgccacctagtagtccatccatggca

SEQ ID NO: 55375 - DNA, 35 bp, Artificial Sequence
  Synthetic oligonucleotide
tcaccatgggcgatggtgtgataaatgttgcctca

SEQ ID NO: 55376 - DNA, 35 bp, Artificial Sequence
  Synthetic oligonucleotide
acgccatcgcatcctaaatacggccctgctcttca

SEQ ID NO: 55377 - DNA, 35 bp, Artificial Sequence
  Synthetic oligonucleotide
gaagagtaggacggggattcagggttgagaggaga

SEQ ID NO: 55378 - DNA, 37 bp, Artificial Sequence
  Synthetic oligonucleotide
gtgcaagtgtatgggcggtggacggggggagatgaga

SEQ ID NO: 55379 - DNA, 37 bp, Artificial Sequence
  Synthetic oligonucleotide
aagcccgccccataagtccatatctcccggccgtaga

SEQ ID NO: 55380 - DNA, 37 bp, Artificial Sequence
  Synthetic oligonucleotide
tcaagcgccacttcttagggcaccatccagctcccga

SEQ ID NO: 55381 - DNA, 37 bp, Artificial Sequence
  Synthetic oligonucleotide
tgggggggaaggagggtatcggaggcgataagcgcga

SEQ ID NO: 55382 - DNA, 37 bp, Artificial Sequence
  Synthetic oligonucleotide
gaacaaccctctccggtgcctgagttaaccacttcga

SEQ ID NO: 55383 - DNA, 36 bp, Artificial Sequence
  Synthetic oligonucleotide
tgcgaccgctgtttttccaatgtttttcatcttcga

SEQ ID NO: 55384 - DNA, 37 bp, Artificial Sequence
  Synthetic oligonucleotide
tagtactcacggcacaacacacctactttcagcagga

SEQ ID NO: 55385 - DNA, 36 bp, Artificial Sequence
  Synthetic oligonucleotide
taaaatgccgccacatcttcccagccccgttccgga

SEQ ID NO: 55386 - DNA, 36 bp, Artificial Sequence
  Synthetic oligonucleotide
aggggtaaccggagggaggggttcgtacttggggga

SEQ ID NO: 55387 - DNA, 37 bp, Artificial Sequence
  Synthetic oligonucleotide
ttggaacggggaatggtgcaccgggggacctagtgga

SEQ ID NO: 55388 - DNA, 38 bp, Artificial Sequence
  Synthetic oligonucleotide
atttgccggaccgtgggtttgccactctcaccacatga

SEQ ID NO: 55389 - DNA, 37 bp, Artificial Sequence
  Synthetic oligonucleotide
taccatgggtaaggggtgaaatgtggagggtaactga

SEQ ID NO: 55390 - DNA, 38 bp, Artificial Sequence
  Synthetic oligonucleotide
taccggaacgtcttacacacaacgcccactgagcctga

SEQ ID NO: 55391 - DNA, 37 bp, Artificial Sequence
  Synthetic oligonucleotide
gcccacgaatgcccttgaccccagctcgaacagctga

SEQ ID NO: 55392 - DNA, 37 bp, Artificial Sequence
  Synthetic oligonucleotide
agcacttgcgccgttacctcccccttaccatctctga

SEQ ID NO: 55393 - DNA, 38 bp, Artificial Sequence
  Synthetic oligonucleotide
tcactgtcacgacccttcagatctgctccatctggtga

SEQ ID NO: 55394 - DNA, 38 bp, Artificial Sequence
  Synthetic oligonucleotide
gacatcctggagaaaagcggtaggttggggcttggtga

SEQ ID NO: 55395 - DNA, 38 bp, Artificial Sequence
  Synthetic oligonucleotide
agctcgacgagcccggtaatctcctcccttcgttgtga

SEQ ID NO: 55396 - DNA, 38 bp, Artificial Sequence
  Synthetic oligonucleotide
gccttcccacctggctgactaatgactctgcatattga

SEQ ID NO: 55397 - DNA, 38 bp, Artificial Sequence
  Synthetic oligonucleotide
tctgctcacgacacctgcccatttaggcgtcatgttga

SEQ ID NO: 55398 - DNA, 34 bp, Artificial Sequence
  Synthetic oligonucleotide
tacatcgaagatgacactcctgcccccgactata

SEQ ID NO: 55399 - DNA, 36 bp, Artificial Sequence
  Synthetic oligonucleotide
gtcgcatcccctcttatcgctcgagtttgatcacta

SEQ ID NO: 55400 - DNA, 36 bp, Artificial Sequence
  Synthetic oligonucleotide
gaccatcccccacgcgtactttcccttctaaaggta

SEQ ID NO: 55401 - DNA, 36 bp, Artificial Sequence
  Synthetic oligonucleotide
atggacactggggctgtgtccgctcctgttgcatta

SEQ ID NO: 55402 - DNA, 36 bp, Artificial Sequence
  Synthetic oligonucleotide
acgtgatccccgcctcgtctaagttcctctcattta

SEQ ID NO: 55403 - DNA, 35 bp, Artificial Sequence
  Synthetic oligonucleotide
agaacccccacatcgctaggaatcacctcggtaac

SEQ ID NO: 55404 - DNA, 35 bp, Artificial Sequence
  Synthetic oligonucleotide
gcataacacatctcattcagcggggacacttttac

SEQ ID NO: 55405 - DNA, 35 bp, Artificial Sequence
  Synthetic oligonucleotide
tgcactccgctccgtctaccacccgaaacaccacc

SEQ ID NO: 55406 - DNA, 35 bp, Artificial Sequence
  Synthetic oligonucleotide
atccgcatactctggtaggtccgactctctcgccc

SEQ ID NO: 55407 - DNA, 35 bp, Artificial Sequence
  Synthetic oligonucleotide
gaccctcgcgccgaattaattttttgttccgtccc

SEQ ID NO: 55408 - DNA, 35 bp, Artificial Sequence
  Synthetic oligonucleotide
tatgttatgacctgtggtgatttggtccgtttccc

SEQ ID NO: 55409 - DNA, 35 bp, Artificial Sequence
  Synthetic oligonucleotide
gacccgtcccccaattgggcacaactggcaaagcc

SEQ ID NO: 55410 - DNA, 35 bp, Artificial Sequence
  Synthetic oligonucleotide
gggcacatccatcactgtacctgtagcaacctagc

SEQ ID NO: 55411 - DNA, 35 bp, Artificial Sequence
  Synthetic oligonucleotide
acacctgggccaacactgactttctcttgtcctgc

SEQ ID NO: 55412 - DNA, 35 bp, Artificial Sequence
  Synthetic oligonucleotide
acagctggccaacagccctttatacctcctcaatc

SEQ ID NO: 55413 - DNA, 35 bp, Artificial Sequence
  Synthetic oligonucleotide
gtcccgcctccacatagtccctggtccatcaagtc

SEQ ID NO: 55414 - DNA, 35 bp, Artificial Sequence
  Synthetic oligonucleotide
gactgactcccgtccacgccaccttctctgcagtc

SEQ ID NO: 55415 - DNA, 35 bp, Artificial Sequence
  Synthetic oligonucleotide
tgtaccgcagacacccttctgttttggacctgttc

SEQ ID NO: 55416 - DNA, 35 bp, Artificial Sequence
  Synthetic oligonucleotide
gagacggcactggagccacgtacaattgccttttc

SEQ ID NO: 55417 - DNA, 35 bp, Artificial Sequence
  Synthetic oligonucleotide
tcatgagcgcccagccacttccatccgtacgggag

SEQ ID NO: 55418 - DNA, 35 bp, Artificial Sequence
  Synthetic oligonucleotide
aacaagtttgtgggaatgggaaggctgggagttcg

SEQ ID NO: 55419 - DNA, 35 bp, Artificial Sequence
  Synthetic oligonucleotide
ttgatccgaagcctgtctctatcccaaacgtttcg

SEQ ID NO: 55420 - DNA, 35 bp, Artificial Sequence
  Synthetic oligonucleotide
gtccgacacgggtgggggggccctatgtgtcaggg

SEQ ID NO: 55421 - DNA, 35 bp, Artificial Sequence
  Synthetic oligonucleotide
gctcggagaaagggagaggggctgcatgtagaggg

SEQ ID NO: 55422 - DNA, 35 bp, Artificial Sequence
  Synthetic oligonucleotide
acatcccgacataagccctagttagagctgaatgg

SEQ ID NO: 55423 - DNA, 35 bp, Artificial Sequence
  Synthetic oligonucleotide
gtgcgtgtcccttgcacaatctccgctctccctgg

SEQ ID NO: 55424 - DNA, 35 bp, Artificial Sequence
  Synthetic oligonucleotide
acttgatccagcatgggcggagtgggggggtgtgg

SEQ ID NO: 55425 - DNA, 35 bp, Artificial Sequence
  Synthetic oligonucleotide
acttaccacctcgggattcacgccctaatgcgctg

SEQ ID NO: 55426 - DNA, 35 bp, Artificial Sequence
  Synthetic oligonucleotide
tcaatgctggtctcgaccgcccctccacctccttg

SEQ ID NO: 55427 - DNA, 35 bp, Artificial Sequence
  Synthetic oligonucleotide
tcaacgcgatccggcttgtcgtttccatcctcttg

SEQ ID NO: 55428 - DNA, 35 bp, Artificial Sequence
  Synthetic oligonucleotide
acagacacccctgacacaccggatttagcacccat

SEQ ID NO: 55429 - DNA, 35 bp, Artificial Sequence
  Synthetic oligonucleotide
atgaagtggtgagtagggagcaggatgcacgccat

SEQ ID NO: 55430 - DNA, 35 bp, Artificial Sequence
  Synthetic oligonucleotide
atcaatgcaggtcttcagtatcctcctgttctcat

SEQ ID NO: 55431 - DNA, 35 bp, Artificial Sequence
  Synthetic oligonucleotide
gtcaaggtactgctttgcacccctgtttcaaatat

SEQ ID NO: 55432 - DNA, 35 bp, Artificial Sequence
  Synthetic oligonucleotide
gcaagtaggtgagggacgggtgggtgccagcaact

SEQ ID NO: 55433 - DNA, 35 bp, Artificial Sequence
  Synthetic oligonucleotide
aaacactctacaccgaccggctggcttaacttcct

SEQ ID NO: 55434 - DNA, 35 bp, Artificial Sequence
  Synthetic oligonucleotide
acatccctcaggccgtaccacattgctacccatct

SEQ ID NO: 55435 - DNA, 35 bp, Artificial Sequence
  Synthetic oligonucleotide
ttgttccatctaccagcctcatccgcattgcaggt

SEQ ID NO: 55436 - DNA, 35 bp, Artificial Sequence
  Synthetic oligonucleotide
gaatacaggggcaatggaagggtcttcgggggggt

SEQ ID NO: 55437 - DNA, 35 bp, Artificial Sequence
  Synthetic oligonucleotide
actcctccgtctgccgggctgccacaaaaccaatt

SEQ ID NO: 55438 - DNA, 35 bp, Artificial Sequence
  Synthetic oligonucleotide
tcggagtgccttctcacgtcattctgttacccctt

SEQ ID NO: 55439 - DNA, 35 bp, Artificial Sequence
  Synthetic oligonucleotide
tcataccgaacgcaagtacggtggtattatctctt

SEQ ID NO: 55440 - DNA, 35 bp, Artificial Sequence
  Synthetic oligonucleotide
ggatcgatagtagggtaggtggtgcaggtgaagaa

SEQ ID NO: 55441 - DNA, 36 bp, Artificial Sequence
  Synthetic oligonucleotide
tgctactccacctggtcagtatcagggtactcccca

SEQ ID NO: 55442 - DNA, 36 bp, Artificial Sequence
  Synthetic oligonucleotide
cgtggtcggactacgcctgcgtctacattgcgccca

SEQ ID NO: 55443 - DNA, 35 bp, Artificial Sequence
  Synthetic oligonucleotide
tctacgcctccgttcttgatctataggatctgcca

SEQ ID NO: 55444 - DNA, 36 bp, Artificial Sequence
  Synthetic oligonucleotide
taaggccgcagtagctcgcacactaccacaccagca

SEQ ID NO: 55445 - DNA, 36 bp, Artificial Sequence
  Synthetic oligonucleotide
gaagtggagatgaaggtgtaagcagtagggagggca

SEQ ID NO: 55446 - DNA, 36 bp, Artificial Sequence
  Synthetic oligonucleotide
tagacgagaatgctgggaggaggttcgtggagggca

SEQ ID NO: 55447 - DNA, 36 bp, Artificial Sequence
  Synthetic oligonucleotide
tggtgtacgtccctggcctatttgtctctcctatca

SEQ ID NO: 55448 - DNA, 35 bp, Artificial Sequence
  Synthetic oligonucleotide
atcgccggagtcccgaatccttgcacgctacctca

SEQ ID NO: 55449 - DNA, 37 bp, Artificial Sequence
  Synthetic oligonucleotide
tgctccgtcacaaaacggcctcgttgactccctcaga

SEQ ID NO: 55450 - DNA, 38 bp, Artificial Sequence
  Synthetic oligonucleotide
attgcggagggaggagtctgtgtggggtcatacaacga

SEQ ID NO: 55451 - DNA, 37 bp, Artificial Sequence
  Synthetic oligonucleotide
tacgcaacggacactccgagaatgcttctaacgccga

SEQ ID NO: 55452 - DNA, 35 bp, Artificial Sequence
  Synthetic oligonucleotide
acgctacccatattgccgcgtgctaaacactccga

SEQ ID NO: 55453 - DNA, 37 bp, Artificial Sequence
  Synthetic oligonucleotide
gacaaaacgcattgccaaccacgggacctacttccga

SEQ ID NO: 55454 - DNA, 37 bp, Artificial Sequence
  Synthetic oligonucleotide
agcacaccgccccacatgcccaaaaaccagcactcga

SEQ ID NO: 55455 - DNA, 37 bp, Artificial Sequence
  Synthetic oligonucleotide
gaagcagagagggtatttgaaagtaagtgcaggagga

SEQ ID NO: 55456 - DNA, 37 bp, Artificial Sequence
  Synthetic oligonucleotide
gaccattgctcaaaagttcccaattctcgttcccgga

SEQ ID NO: 55457 - DNA, 37 bp, Artificial Sequence
  Synthetic oligonucleotide
tgtgagggaagtagaaaggattaggttagagtaggga

SEQ ID NO: 55458 - DNA, 36 bp, Artificial Sequence
  Synthetic oligonucleotide
gtataactgggaggcttgagggtgacggggtatgga

SEQ ID NO: 55459 - DNA, 36 bp, Artificial Sequence
  Synthetic oligonucleotide
tcttatcgcacgagcacatttgccttcatgcctgga

SEQ ID NO: 55460 - DNA, 35 bp, Artificial Sequence
  Synthetic oligonucleotide
gtgaatggggtggggtactagagcgggcggaatga

SEQ ID NO: 55461 - DNA, 36 bp, Artificial Sequence
  Synthetic oligonucleotide
atgaggaagggtgagaggaggagaagtgaagactga

SEQ ID NO: 55462 - DNA, 37 bp, Artificial Sequence
  Synthetic oligonucleotide
gagacccggagcctcatccaactactgccacccctga

SEQ ID NO: 55463 - DNA, 38 bp, Artificial Sequence
  Synthetic oligonucleotide
accacaggtccgtcttcatttcacgtcatcacatctga

SEQ ID NO: 55464 - DNA, 37 bp, Artificial Sequence
  Synthetic oligonucleotide
gcactccccacccgtgtagcggttccgttatttctga

SEQ ID NO: 55465 - DNA, 38 bp, Artificial Sequence
  Synthetic oligonucleotide
ggacgacgccgggtttctcccatatgtgcccctcgtga

SEQ ID NO: 55466 - DNA, 37 bp, Artificial Sequence
  Synthetic oligonucleotide
tcccatacctccatttgtatcggcctgaatactttga

SEQ ID NO: 55467 - DNA, 36 bp, Artificial Sequence
  Synthetic oligonucleotide
tctgcgctagttacctgtcttttggcccatgtttga

SEQ ID NO: 55468 - DNA, 38 bp, Artificial Sequence
  Synthetic oligonucleotide
ttgagtggggggaggatctatagggggcaagattttga

SEQ ID NO: 55469 - DNA, 36 bp, Artificial Sequence
  Synthetic oligonucleotide
tgcaagagggggggctaattacaggacaacaggcta

SEQ ID NO: 55470 - DNA, 36 bp, Artificial Sequence
  Synthetic oligonucleotide
accgcagtggagagagtagggtggttcggggaggta

SEQ ID NO: 55471 - DNA, 36 bp, Artificial Sequence
  Synthetic oligonucleotide
tgacgaggcggtcctgtccaccattgcatttaatta

SEQ ID NO: 55472 - DNA, 35 bp, Artificial Sequence
  Synthetic oligonucleotide
ggagcctctaggagcacaaattcccaagccaacac

SEQ ID NO: 55473 - DNA, 35 bp, Artificial Sequence
  Synthetic oligonucleotide
taaccacccgccgcggagcccagggtagataacac

SEQ ID NO: 55474 - DNA, 35 bp, Artificial Sequence
  Synthetic oligonucleotide
agctccgtgctcgaccaaggccccgccctccaccc

SEQ ID NO: 55475 - DNA, 35 bp, Artificial Sequence
  Synthetic oligonucleotide
gctccaacaaagactcctgcgatacgctgcaacgc

SEQ ID NO: 55476 - DNA, 35 bp, Artificial Sequence
  Synthetic oligonucleotide
gccacgcacacaggttaacccgtcaattaacacgc

SEQ ID NO: 55477 - DNA, 35 bp, Artificial Sequence
  Synthetic oligonucleotide
tagaccccttgatccgccattaccatgttgctggc

SEQ ID NO: 55478 - DNA, 35 bp, Artificial Sequence
  Synthetic oligonucleotide
agctacaccaggccctcgcaccttccccctgtatc

SEQ ID NO: 55479 - DNA, 35 bp, Artificial Sequence
  Synthetic oligonucleotide
atctcgcatgctgaccacatcttgaactgcggctc

SEQ ID NO: 55480 - DNA, 35 bp, Artificial Sequence
  Synthetic oligonucleotide
gctcccagtgcggaaagccaaaaacgatccttgtc

SEQ ID NO: 55481 - DNA, 35 bp, Artificial Sequence
  Synthetic oligonucleotide
actccgccacttatacgactcggtacctctcacag

SEQ ID NO: 55482 - DNA, 35 bp, Artificial Sequence
  Synthetic oligonucleotide
actacgcctcactcttaatgacggcccgtccaccg

SEQ ID NO: 55483 - DNA, 35 bp, Artificial Sequence
  Synthetic oligonucleotide
tgggttccacctgacaccctctaagagctctcccg

SEQ ID NO: 55484 - DNA, 35 bp, Artificial Sequence
  Synthetic oligonucleotide
aatgcccgtccacgcggccctaacttgactcactg

SEQ ID NO: 55485 - DNA, 35 bp, Artificial Sequence
  Synthetic oligonucleotide
gtggcctccagagcaaccctcctctcccgactctg

SEQ ID NO: 55486 - DNA, 35 bp, Artificial Sequence
  Synthetic oligonucleotide
gactatacggggctagccacaggatgaccaaccat

SEQ ID NO: 55487 - DNA, 35 bp, Artificial Sequence
  Synthetic oligonucleotide
tcaaatgcagctatcgcctgcccagcactgaccat

SEQ ID NO: 55488 - DNA, 35 bp, Artificial Sequence
  Synthetic oligonucleotide
aacactccgtatcaggcgtttctatctagccaact

SEQ ID NO: 55489 - DNA, 35 bp, Artificial Sequence
  Synthetic oligonucleotide
tgagctccccaattaaccagtcaaggtcaaaccct

SEQ ID NO: 55490 - DNA, 35 bp, Artificial Sequence
  Synthetic oligonucleotide
gcatagcaacacgcatagtcgcagctctgctccct

SEQ ID NO: 55491 - DNA, 35 bp, Artificial Sequence
  Synthetic oligonucleotide
acctcgcactgacatttattcacaactcacgctct

SEQ ID NO: 55492 - DNA, 35 bp, Artificial Sequence
  Synthetic oligonucleotide
acctcctgcctttctatgcctccccaaggaggtct

SEQ ID NO: 55493 - DNA, 35 bp, Artificial Sequence
  Synthetic oligonucleotide
tcccccgaggccctatcccgtaaactttttgcgtt

SEQ ID NO: 55494 - DNA, 35 bp, Artificial Sequence
  Synthetic oligonucleotide
ttggctaagccgacctgtagtccactccttcgttt

SEQ ID NO: 55495 - DNA, 35 bp, Artificial Sequence
  Synthetic oligonucleotide
tccacccgccctccacatcaaagtgcctagtgaaa

SEQ ID NO: 55496 - DNA, 36 bp, Artificial Sequence
  Synthetic oligonucleotide
taaggtgagcccagctaactccccattgctttacaa

SEQ ID NO: 55497 - DNA, 36 bp, Artificial Sequence
  Synthetic oligonucleotide
gcgtgtgaggttgggaggggtaaccaagtggaagaa

SEQ ID NO: 55498 - DNA, 35 bp, Artificial Sequence
  Synthetic oligonucleotide
tgcacaccacctgccgccgtaccatattttcggaa

SEQ ID NO: 55499 - DNA, 35 bp, Artificial Sequence
  Synthetic oligonucleotide
tttgacatctgtggctgtacctgtctttcgcttca

SEQ ID NO: 55500 - DNA, 36 bp, Artificial Sequence
  Synthetic oligonucleotide
gaacaacccacacccactctaaacggtccaccaaga

SEQ ID NO: 55501 - DNA, 37 bp, Artificial Sequence
  Synthetic oligonucleotide
aacgaggaggtctggcaaagaggaagagatggcgaga

SEQ ID NO: 55502 - DNA, 37 bp, Artificial Sequence
  Synthetic oligonucleotide
acgtactcctccctgaggtatccaggaacattaccga

SEQ ID NO: 55503 - DNA, 35 bp, Artificial Sequence
  Synthetic oligonucleotide
agacctcacactagggcccaacaatccgccacgga

SEQ ID NO: 55504 - DNA, 37 bp, Artificial Sequence
  Synthetic oligonucleotide
tcaactgccggctaatgccactcccctacgacccgga

SEQ ID NO: 55505 - DNA, 37 bp, Artificial Sequence
  Synthetic oligonucleotide
gagtgatagaaaaggagtgatagatcagagggaggga

SEQ ID NO: 55506 - DNA, 37 bp, Artificial Sequence
  Synthetic oligonucleotide
accccgatcctgacctgctcgagagctgaacacatga

SEQ ID NO: 55507 - DNA, 38 bp, Artificial Sequence
  Synthetic oligonucleotide
tccagttaccacatacgtgtccgtgccggtttccatga

SEQ ID NO: 55508 - DNA, 37 bp, Artificial Sequence
  Synthetic oligonucleotide
tcgaccccccactcatcgaaagtcccactcatcatga

SEQ ID NO: 55509 - DNA, 37 bp, Artificial Sequence
  Synthetic oligonucleotide
gcccttaccgcaccttcatatacgactgttcatatga

SEQ ID NO: 55510 - DNA, 38 bp, Artificial Sequence
  Synthetic oligonucleotide
acacccaccggcgaggaaagaagagcgtgtgagtatga

SEQ ID NO: 55511 - DNA, 37 bp, Artificial Sequence
  Synthetic oligonucleotide
ttggcaaccccgcggggtacttgaatttcctagctga

SEQ ID NO: 55512 - DNA, 37 bp, Artificial Sequence
  Synthetic oligonucleotide
accaattcgacgccgttgtacttcctaccatccgtga

SEQ ID NO: 55513 - DNA, 38 bp, Artificial Sequence
  Synthetic oligonucleotide
gtatgcgaaaaggggggcgggcgatgaaacataggtga

SEQ ID NO: 55514 - DNA, 38 bp, Artificial Sequence
  Synthetic oligonucleotide
aaccggtgggtagagcgctgtaggaggatggagtgtga

SEQ ID NO: 55515 - DNA, 38 bp, Artificial Sequence
  Synthetic oligonucleotide
tcaatccgtcgcaaattgaaccccgcgtggacccttga

SEQ ID NO: 55516 - DNA, 38 bp, Artificial Sequence
  Synthetic oligonucleotide
tcacgaggcgataacgccggtctactattttgccttga

SEQ ID NO: 55517 - DNA, 35 bp, Artificial Sequence
  Synthetic oligonucleotide
aacccgtaaccggccctgggattccatgccccata

SEQ ID NO: 55518 - DNA, 36 bp, Artificial Sequence
  Synthetic oligonucleotide
tcaccacaattacacctaacgcccggtattgctata

SEQ ID NO: 55519 - DNA, 36 bp, Artificial Sequence
  Synthetic oligonucleotide
acacctcgcacgatggactcatattgcccctcctta

SEQ ID NO: 55520 - DNA, 36 bp, Artificial Sequence
  Synthetic oligonucleotide
gaagccgtcgaacttccctgaatggccgcccgctta

SEQ ID NO: 55521 - DNA, 36 bp, Artificial Sequence
  Synthetic oligonucleotide
gcacatcgcaggttctaactattctaccgcttgtta

SEQ ID NO: 55522 - DNA, 35 bp, Artificial Sequence
  Synthetic oligonucleotide
atctccacgcctaacgtttacaccatatattgcac

SEQ ID NO: 55523 - DNA, 35 bp, Artificial Sequence
  Synthetic oligonucleotide
gccacccgtgccgccggtaagccactttctcatac

SEQ ID NO: 55524 - DNA, 35 bp, Artificial Sequence
  Synthetic oligonucleotide
agctgctgtaggtcgctgcctgtaatcccacaccc

SEQ ID NO: 55525 - DNA, 35 bp, Artificial Sequence
  Synthetic oligonucleotide
tctggggcccgccttaaggttgatctcgcttgtcc

SEQ ID NO: 55526 - DNA, 35 bp, Artificial Sequence
  Synthetic oligonucleotide
tctgggctgggtaggccttcatgtacgctttgtcc

SEQ ID NO: 55527 - DNA, 35 bp, Artificial Sequence
  Synthetic oligonucleotide
accctccgtgttggcggtaccggtcccactattcc

SEQ ID NO: 55528 - DNA, 35 bp, Artificial Sequence
  Synthetic oligonucleotide
acaagcggggggagcgattttgggagcgggatcgc

SEQ ID NO: 55529 - DNA, 35 bp, Artificial Sequence
  Synthetic oligonucleotide
atgtagcgccgtttgctttacgtcgatcatctctc

SEQ ID NO: 55530 - DNA, 35 bp, Artificial Sequence
  Synthetic oligonucleotide
tcaatggaggtggaggggcggttagggtggatcag

SEQ ID NO: 55531 - DNA, 35 bp, Artificial Sequence
  Synthetic oligonucleotide
gaccaagctcccacacgccatctatccaggatccg

SEQ ID NO: 55532 - DNA, 35 bp, Artificial Sequence
  Synthetic oligonucleotide
tccgcgtggcatcgaacccccacacttgtccactg

SEQ ID NO: 55533 - DNA, 35 bp, Artificial Sequence
  Synthetic oligonucleotide
aacgccatgcaccgccgctctcttccctgaacgtg

SEQ ID NO: 55534 - DNA, 35 bp, Artificial Sequence
  Synthetic oligonucleotide
atgcacaactcacgttacattcccgtttggctaat

SEQ ID NO: 55535 - DNA, 35 bp, Artificial Sequence
  Synthetic oligonucleotide
atgcaaccgtgcagtcatacacattgttgcccact

SEQ ID NO: 55536 - DNA, 35 bp, Artificial Sequence
  Synthetic oligonucleotide
actacagtgacccgtccctgccgcgacgccacgct

SEQ ID NO: 55537 - DNA, 35 bp, Artificial Sequence
  Synthetic oligonucleotide
gtgaggatgggaagggagtgctggtacatcgcggt

SEQ ID NO: 55538 - DNA, 35 bp, Artificial Sequence
  Synthetic oligonucleotide
tccacgtggctgccgcaatagatccctctaacgtt

SEQ ID NO: 55539 - DNA, 35 bp, Artificial Sequence
  Synthetic oligonucleotide
accacatccgacggccattggaaaaaatggtggtt

SEQ ID NO: 55540 - DNA, 36 bp, Artificial Sequence
  Synthetic oligonucleotide
tgctcccctatatcgttgacgcaaagccgtttccaa

SEQ ID NO: 55541 - DNA, 35 bp, Artificial Sequence
  Synthetic oligonucleotide
atgcgcacactgccacgctatcaataaacctgcaa

SEQ ID NO: 55542 - DNA, 36 bp, Artificial Sequence
  Synthetic oligonucleotide
acgtatgggttggcacgaggactggagcagggagaa

SEQ ID NO: 55543 - DNA, 36 bp, Artificial Sequence
  Synthetic oligonucleotide
tatgatcgccgccgcttacgcaacccgtttaacgaa

SEQ ID NO: 55544 - DNA, 35 bp, Artificial Sequence
  Synthetic oligonucleotide
actcatccgccacccgctcaggccccgcactcgaa

SEQ ID NO: 55545 - DNA, 36 bp, Artificial Sequence
  Synthetic oligonucleotide
tcgaacatacagccacatttggcaccactttaggaa

SEQ ID NO: 55546 - DNA, 34 bp, Artificial Sequence
  Synthetic oligonucleotide
tagtacaccgcccagctatattgcttttacggaa

SEQ ID NO: 55547 - DNA, 35 bp, Artificial Sequence
  Synthetic oligonucleotide
tcaggtccctggttctaccgctcacactttcgtaa

SEQ ID NO: 55548 - DNA, 36 bp, Artificial Sequence
  Synthetic oligonucleotide
ttgtccgaccccgcttttctgagacagcacagttaa

SEQ ID NO: 55549 - DNA, 36 bp, Artificial Sequence
  Synthetic oligonucleotide
gatccacgcgttggggacacacacagccgcacgaca

SEQ ID NO: 55550 - DNA, 36 bp, Artificial Sequence
  Synthetic oligonucleotide
gaagcgcctccatctgcctacgactgatcagctaca

SEQ ID NO: 55551 - DNA, 36 bp, Artificial Sequence
  Synthetic oligonucleotide
tgttgtacggctgttccattggcctgatgcccccca

SEQ ID NO: 55552 - DNA, 36 bp, Artificial Sequence
  Synthetic oligonucleotide
aaccatgtcatgcctgtcccaaagtctctggcccca

SEQ ID NO: 55553 - DNA, 36 bp, Artificial Sequence
  Synthetic oligonucleotide
tgtactcttgcttgccatatggactttatccctcca

SEQ ID NO: 55554 - DNA, 35 bp, Artificial Sequence
  Synthetic oligonucleotide
actattgccgctacaaacgttctgactccagtcca

SEQ ID NO: 55555 - DNA, 36 bp, Artificial Sequence
  Synthetic oligonucleotide
acgacccgaccaatagttgcatactatcggcttcca

SEQ ID NO: 55556 - DNA, 36 bp, Artificial Sequence
  Synthetic oligonucleotide
tccaacaccaaccatcaaactgtggcgctcaacgca

SEQ ID NO: 55557 - DNA, 36 bp, Artificial Sequence
  Synthetic oligonucleotide
gagctaggcacatctctctacatctggtgccatgca

SEQ ID NO: 55558 - DNA, 37 bp, Artificial Sequence
  Synthetic oligonucleotide
agtggccaaggggggcgagaagggggtatgcaggtca

SEQ ID NO: 55559 - DNA, 37 bp, Artificial Sequence
  Synthetic oligonucleotide
gacgcccctgcccacttcttcaaggtcccagtataga

SEQ ID NO: 55560 - DNA, 37 bp, Artificial Sequence
  Synthetic oligonucleotide
ttagccgcaagagggaaggtcttgcaaaaagtgtaga

SEQ ID NO: 55561 - DNA, 36 bp, Artificial Sequence
  Synthetic oligonucleotide
aatccgcacccatggaccacgttcacactaacccga

SEQ ID NO: 55562 - DNA, 35 bp, Artificial Sequence
  Synthetic oligonucleotide
ttgggagggtgaggaaaggtatcaatatccggcga

SEQ ID NO: 55563 - DNA, 37 bp, Artificial Sequence
  Synthetic oligonucleotide
gctgggtgggaatggggaaaaaagtgaactgcatcga

SEQ ID NO: 55564 - DNA, 37 bp, Artificial Sequence
  Synthetic oligonucleotide
tcacggagtcagagacacgcctgccgctttccctcga

SEQ ID NO: 55565 - DNA, 37 bp, Artificial Sequence
  Synthetic oligonucleotide
gtccagggggccagattcggagagggataggatcgga

SEQ ID NO: 55566 - DNA, 37 bp, Artificial Sequence
  Synthetic oligonucleotide
gtcataaggggtgaaatgagggccagggggcaaggga

SEQ ID NO: 55567 - DNA, 37 bp, Artificial Sequence
  Synthetic oligonucleotide
gcacgagggagcgcaggggcgggaaagggctgaggga

SEQ ID NO: 55568 - DNA, 37 bp, Artificial Sequence
  Synthetic oligonucleotide
agagagtggctacgggttggttagggtgggaacggga

SEQ ID NO: 55569 - DNA, 36 bp, Artificial Sequence
  Synthetic oligonucleotide
gcagtgtatggaggggaggaagttggacgcactgga

SEQ ID NO: 55570 - DNA, 38 bp, Artificial Sequence
  Synthetic oligonucleotide
atggcactgcaatgccatactaaatgatatcttaatga

SEQ ID NO: 55571 - DNA, 38 bp, Artificial Sequence
  Synthetic oligonucleotide
atggaaccccccactcccccaatgagatgtcaatatga

SEQ ID NO: 55572 - DNA, 36 bp, Artificial Sequence
  Synthetic oligonucleotide
tacaacaacagcctgtggcttgcaacccccctatga

SEQ ID NO: 55573 - DNA, 38 bp, Artificial Sequence
  Synthetic oligonucleotide
gacatggcaacaggcacggacaaaagcaagttctatga

SEQ ID NO: 55574 - DNA, 36 bp, Artificial Sequence
  Synthetic oligonucleotide
gccggacctcacaagtgccttatatcacgctactga

SEQ ID NO: 55575 - DNA, 37 bp, Artificial Sequence
  Synthetic oligonucleotide
tcgcaacaccccacagtgattaggcacatactcctga

SEQ ID NO: 55576 - DNA, 38 bp, Artificial Sequence
  Synthetic oligonucleotide
gctcgcaccactatctgcttcaagccactgtgtcctga

SEQ ID NO: 55577 - DNA, 38 bp, Artificial Sequence
  Synthetic oligonucleotide
atgcgtggggggggaatggatggaagcgcccctagtga

SEQ ID NO: 55578 - DNA, 37 bp, Artificial Sequence
  Synthetic oligonucleotide
gcgaactctatctcacgttccctcacgcatggcgtga

SEQ ID NO: 55579 - DNA, 36 bp, Artificial Sequence
  Synthetic oligonucleotide
tagacaaggtacggggaacgtgggcatatggggtga

SEQ ID NO: 55580 - DNA, 38 bp, Artificial Sequence
  Synthetic oligonucleotide
ttgaggcaaccgctcctgccctgaattacgccctgtga

SEQ ID NO: 55581 - DNA, 37 bp, Artificial Sequence
  Synthetic oligonucleotide
ttgcccctcgccgtaacttttgagttcaacccattga

SEQ ID NO: 55582 - DNA, 38 bp, Artificial Sequence
  Synthetic oligonucleotide
gtccgacggacgcacttcctgtctacgttacctattga

SEQ ID NO: 55583 - DNA, 38 bp, Artificial Sequence
  Synthetic oligonucleotide
acgaagggggacggcccaatggagaaaggggaggttga

SEQ ID NO: 55584 - DNA, 36 bp, Artificial Sequence
  Synthetic oligonucleotide
acgaccaacgtagttcgtaattcttgtttcacctta

SEQ ID NO: 55585 - DNA, 36 bp, Artificial Sequence
  Synthetic oligonucleotide
tagcgaggcttgtccaccgcctacctgccccgttta

SEQ ID NO: 55586 - DNA, 36 bp, Artificial Sequence
  Synthetic oligonucleotide
ataggaggaggtcgaggggggtggatctcactttta

SEQ ID NO: 55587 - DNA, 34 bp, Artificial Sequence
  Synthetic oligonucleotide
gcttgcaccccgtctccctctgcctatggccaac

SEQ ID NO: 55588 - DNA, 35 bp, Artificial Sequence
  Synthetic oligonucleotide
gccttctccgccaccggtttaacccccgtcaacac

SEQ ID NO: 55589 - DNA, 35 bp, Artificial Sequence
  Synthetic oligonucleotide
agcctgtcaccacaggcgcatagcactcgccccac

SEQ ID NO: 55590 - DNA, 35 bp, Artificial Sequence
  Synthetic oligonucleotide
accccactgaattgttttgttgctcgcttattcac

SEQ ID NO: 55591 - DNA, 35 bp, Artificial Sequence
  Synthetic oligonucleotide
acaccgatcgcgcactttgatcttcctatgcaacc

SEQ ID NO: 55592 - DNA, 35 bp, Artificial Sequence
  Synthetic oligonucleotide
agcgcaccttcttgctacagccgacgcctacgacc

SEQ ID NO: 55593 - DNA, 35 bp, Artificial Sequence
  Synthetic oligonucleotide
ttgcaccgcacatgctcaatattttgagatccccc

SEQ ID NO: 55594 - DNA, 35 bp, Artificial Sequence
  Synthetic oligonucleotide
tcttgtaccgaaaggtttgcctcctggtcattgcc

SEQ ID NO: 55595 - DNA, 35 bp, Artificial Sequence
  Synthetic oligonucleotide
aacatcgaatatgttcgcgagcatagcataacatc

SEQ ID NO: 55596 - DNA, 35 bp, Artificial Sequence
  Synthetic oligonucleotide
tgtgccgggcgcgattgacccgccttattgctatc

SEQ ID NO: 55597 - DNA, 35 bp, Artificial Sequence
  Synthetic oligonucleotide
gcccatgtatcctgaccacagcgcccccttctctc

SEQ ID NO: 55598 - DNA, 35 bp, Artificial Sequence
  Synthetic oligonucleotide
actaacacccacggccggagtaacattaaagcttc

SEQ ID NO: 55599 - DNA, 35 bp, Artificial Sequence
  Synthetic oligonucleotide
ttgtccttgcccttacgaccgtctaaaccgggttc

SEQ ID NO: 55600 - DNA, 35 bp, Artificial Sequence
  Synthetic oligonucleotide
tatagtaggagggaaggtatggccggggggtggcg

SEQ ID NO: 55601 - DNA, 35 bp, Artificial Sequence
  Synthetic oligonucleotide
attaacgcagaatgttctcaagtttgtccctctcg

SEQ ID NO: 55602 - DNA, 35 bp, Artificial Sequence
  Synthetic oligonucleotide
tgccccgttaatcgcttttttagttccgttgttgg

SEQ ID NO: 55603 - DNA, 35 bp, Artificial Sequence
  Synthetic oligonucleotide
taccactgcgtgacgaccacttagcgactatcctg

SEQ ID NO: 55604 - DNA, 35 bp, Artificial Sequence
  Synthetic oligonucleotide
ttagtgcggcgattactttttcttcccggtatctg

SEQ ID NO: 55605 - DNA, 35 bp, Artificial Sequence
  Synthetic oligonucleotide
ggagtgggaaagagcttggaaagacggtacggttg

SEQ ID NO: 55606 - DNA, 35 bp, Artificial Sequence
  Synthetic oligonucleotide
cccgacctcagtaccattgcccgcgtgctccagct

SEQ ID NO: 55607 - DNA, 35 bp, Artificial Sequence
  Synthetic oligonucleotide
tgctgccaccagtttcatgtttttgtaggcccagt

SEQ ID NO: 55608 - DNA, 35 bp, Artificial Sequence
  Synthetic oligonucleotide
tttgcactcgcagaatttatcacttgcctcttagt

SEQ ID NO: 55609 - DNA, 35 bp, Artificial Sequence
  Synthetic oligonucleotide
tccacacgccgagctctagaagaggtacgtatggt

SEQ ID NO: 55610 - DNA, 35 bp, Artificial Sequence
  Synthetic oligonucleotide
tgctgcctacggactcccatccttttacattcgtt

SEQ ID NO: 55611 - DNA, 35 bp, Artificial Sequence
  Synthetic oligonucleotide
gtccccgcctccctctgccgttacacttctttgtt

SEQ ID NO: 55612 - DNA, 35 bp, Artificial Sequence
  Synthetic oligonucleotide
tcctcccgtgctcaacccgcaagctttccggcttt

SEQ ID NO: 55613 - DNA, 36 bp, Artificial Sequence
  Synthetic oligonucleotide
actcgccggttatctatcagcccccttgctcttgaa

SEQ ID NO: 55614 - DNA, 36 bp, Artificial Sequence
  Synthetic oligonucleotide
tgctccggccacataaactaccatgtcggtaactaa

SEQ ID NO: 55615 - DNA, 35 bp, Artificial Sequence
  Synthetic oligonucleotide
cttccctccggcatcgtgtcctacgccgcgaaaca

SEQ ID NO: 55616 - DNA, 36 bp, Artificial Sequence
  Synthetic oligonucleotide
ttaggctaccacacctggaattcatctgccagacca

SEQ ID NO: 55617 - DNA, 36 bp, Artificial Sequence
  Synthetic oligonucleotide
tgtgatgttccgttctctattggtccatatttgcca

SEQ ID NO: 55618 - DNA, 35 bp, Artificial Sequence
  Synthetic oligonucleotide
ttggtaccacaaatcccagcggtaccttcccctca

SEQ ID NO: 55619 - DNA, 36 bp, Artificial Sequence
  Synthetic oligonucleotide
gtagccccgaaccactgaccttgcaagtccagctca

SEQ ID NO: 55620 - DNA, 36 bp, Artificial Sequence
  Synthetic oligonucleotide
attgccccctccgttgtgacaccactgctactctca

SEQ ID NO: 55621 - DNA, 35 bp, Artificial Sequence
  Synthetic oligonucleotide
acttgccccccataagcactcacctgtgttcgtca

SEQ ID NO: 55622 - DNA, 35 bp, Artificial Sequence
  Synthetic oligonucleotide
aacccatggcagcattttcatctacgatcctttca

SEQ ID NO: 55623 - DNA, 37 bp, Artificial Sequence
  Synthetic oligonucleotide
atcaatcgacacgggtagggggagagcggtgaaaaga

SEQ ID NO: 55624 - DNA, 36 bp, Artificial Sequence
  Synthetic oligonucleotide
gttgaaacccacccttccctaggagtctgctcaaga

SEQ ID NO: 55625 - DNA, 37 bp, Artificial Sequence
  Synthetic oligonucleotide
tgtgcatactctccccgccctccgtcgacccgaacga

SEQ ID NO: 55626 - DNA, 37 bp, Artificial Sequence
  Synthetic oligonucleotide
gacacagaatcaggaaaaattgatgggggtgggacga

SEQ ID NO: 55627 - DNA, 37 bp, Artificial Sequence
  Synthetic oligonucleotide
tgccgatgcattagcgtctatactacggccccctcga

SEQ ID NO: 55628 - DNA, 36 bp, Artificial Sequence
  Synthetic oligonucleotide
tgcacacgcagactcagtacctctcattaatctcga

SEQ ID NO: 55629 - DNA, 37 bp, Artificial Sequence
  Synthetic oligonucleotide
ttgctcggtcccggtgttgcgctttcccctgtttcga

SEQ ID NO: 55630 - DNA, 37 bp, Artificial Sequence
  Synthetic oligonucleotide
gtgaaggttacaaaaaagggtggagcggatacaggga

SEQ ID NO: 55631 - DNA, 35 bp, Artificial Sequence
  Synthetic oligonucleotide
ttcaccgacgcctcttggtgtaatccgttcttgga

SEQ ID NO: 55632 - DNA, 36 bp, Artificial Sequence
  Synthetic oligonucleotide
acttgccccctatcaccgttcgctccggtctttgga

SEQ ID NO: 55633 - DNA, 38 bp, Artificial Sequence
  Synthetic oligonucleotide
agcgccattacatccctgtggtttagccccttacatga

SEQ ID NO: 55634 - DNA, 38 bp, Artificial Sequence
  Synthetic oligonucleotide
ggtacatcacacgtgccctctcccgtcgaacttcatga

SEQ ID NO: 55635 - DNA, 38 bp, Artificial Sequence
  Synthetic oligonucleotide
tgaagtgagcaggaatgggtgcggggtagcagaactga

SEQ ID NO: 55636 - DNA, 38 bp, Artificial Sequence
  Synthetic oligonucleotide
agacacccacctgctactcagtatccacatgaacctga

SEQ ID NO: 55637 - DNA, 37 bp, Artificial Sequence
  Synthetic oligonucleotide
aacactgtcccgcaggcctaccccatacacacgctga

SEQ ID NO: 55638 - DNA, 38 bp, Artificial Sequence
  Synthetic oligonucleotide
gtgtgtggtgagtgtggtgggggggtgggaaacagtga

SEQ ID NO: 55639 - DNA, 38 bp, Artificial Sequence
  Synthetic oligonucleotide
tgtgccagaaacggcgatgcatgtaggagggggagtga

SEQ ID NO: 55640 - DNA, 38 bp, Artificial Sequence
  Synthetic oligonucleotide
agcccagcctacacatagcccctcataccatttcgtga

SEQ ID NO: 55641 - DNA, 38 bp, Artificial Sequence
  Synthetic oligonucleotide
ggtccccctccgttttaattaatgcccagccacggtga

SEQ ID NO: 55642 - DNA, 37 bp, Artificial Sequence
  Synthetic oligonucleotide
tacaccgtggtgtaacgcaggaactcaataagggtga

SEQ ID NO: 55643 - DNA, 37 bp, Artificial Sequence
  Synthetic oligonucleotide
acatctccgcaatgtatcttcgctttccctggggtga

SEQ ID NO: 55644 - DNA, 38 bp, Artificial Sequence
  Synthetic oligonucleotide
ataccagcagtccggtatcctcgccccatattgcttga

SEQ ID NO: 55645 - DNA, 37 bp, Artificial Sequence
  Synthetic oligonucleotide
agcgcgcgctgcccgtccgaatctttctgccagttga

SEQ ID NO: 55646 - DNA, 37 bp, Artificial Sequence
  Synthetic oligonucleotide
ggagtggagcgactggagaaggttgggcattggttga

SEQ ID NO: 55647 - DNA, 36 bp, Artificial Sequence
  Synthetic oligonucleotide
tcaccagcgcgttgtgaagtatctcagcgaacccta

SEQ ID NO: 55648 - DNA, 36 bp, Artificial Sequence
  Synthetic oligonucleotide
attgatgcccccattggccgtatctcactacgccta

SEQ ID NO: 55649 - DNA, 35 bp, Artificial Sequence
  Synthetic oligonucleotide
actgcgcaagtttacaacggcctattaccatccta

SEQ ID NO: 55650 - DNA, 35 bp, Artificial Sequence
  Synthetic oligonucleotide
gcccttcccgccgggccgcattttattttatccta

SEQ ID NO: 55651 - DNA, 35 bp, Artificial Sequence
  Synthetic oligonucleotide
ttccgcccggtgctcatgatcgggctcgctcttac

SEQ ID NO: 55652 - DNA, 35 bp, Artificial Sequence
  Synthetic oligonucleotide
tacacgaccaagttcgaggaagcttctccttcccc

SEQ ID NO: 55653 - DNA, 35 bp, Artificial Sequence
  Synthetic oligonucleotide
tatccacatcttgttaacgtctcggccgccccgcc

SEQ ID NO: 55654 - DNA, 35 bp, Artificial Sequence
  Synthetic oligonucleotide
agcgatcgaccaaggaccccaaccctggcttcgcc

SEQ ID NO: 55655 - DNA, 35 bp, Artificial Sequence
  Synthetic oligonucleotide
accaaccctaacagttatgttcttccctgatgtcc

SEQ ID NO: 55656 - DNA, 35 bp, Artificial Sequence
  Synthetic oligonucleotide
acccgtatgcgcaggtcctagtgccgaagccttcc

SEQ ID NO: 55657 - DNA, 35 bp, Artificial Sequence
  Synthetic oligonucleotide
gatggggggagagtgctgggtagggtttgaagagc

SEQ ID NO: 55658 - DNA, 35 bp, Artificial Sequence
  Synthetic oligonucleotide
attcctagctcggcatacgctgctacccctcacgc

SEQ ID NO: 55659 - DNA, 35 bp, Artificial Sequence
  Synthetic oligonucleotide
gtcgccctcaaaacacctgggacacagccacccgc

SEQ ID NO: 55660 - DNA, 35 bp, Artificial Sequence
  Synthetic oligonucleotide
tgacccggtgcgtgcccactttgatttctgcatgc

SEQ ID NO: 55661 - DNA, 35 bp, Artificial Sequence
  Synthetic oligonucleotide
tcatctccacaggcatagcttaccgatcctcttgc

SEQ ID NO: 55662 - DNA, 35 bp, Artificial Sequence
  Synthetic oligonucleotide
gacagccccctttccactgagtggatcccaccatc

SEQ ID NO: 55663 - DNA, 35 bp, Artificial Sequence
  Synthetic oligonucleotide
gtttgcccgccaaacggagcagctatcgctccatc

SEQ ID NO: 55664 - DNA, 35 bp, Artificial Sequence
  Synthetic oligonucleotide
gccacgcaccgcaacccgacacatcccttgacctc

SEQ ID NO: 55665 - DNA, 35 bp, Artificial Sequence
  Synthetic oligonucleotide
ttgtcataccgactgccattccacccgtgtgcctc

SEQ ID NO: 55666 - DNA, 35 bp, Artificial Sequence
  Synthetic oligonucleotide
agtgttctgcctggcccgttacttggacactcctc

SEQ ID NO: 55667 - DNA, 35 bp, Artificial Sequence
  Synthetic oligonucleotide
gaacattgccatcgcgggatcgtggctttcatctc

SEQ ID NO: 55668 - DNA, 35 bp, Artificial Sequence
  Synthetic oligonucleotide
taggtaggacgacagcggccttactatccactctc

SEQ ID NO: 55669 - DNA, 35 bp, Artificial Sequence
  Synthetic oligonucleotide
tgaagccatcgaaatgtccttagctcatccgggtc

SEQ ID NO: 55670 - DNA, 35 bp, Artificial Sequence
  Synthetic oligonucleotide
gtctctcgcctggaactgcacctgtcacctctaag

SEQ ID NO: 55671 - DNA, 31 bp, Artificial Sequence
  Synthetic oligonucleotide
tcacgtcgcataccgctccgagtgcccctcg

SEQ ID NO: 55672 - DNA, 35 bp, Artificial Sequence
  Synthetic oligonucleotide
ggaaaccgcactgactttatggttcactctattcg

SEQ ID NO: 55673 - DNA, 35 bp, Artificial Sequence
  Synthetic oligonucleotide
taccaggtgggtgtaggttggtgtgatatatcatg

SEQ ID NO: 55674 - DNA, 35 bp, Artificial Sequence
  Synthetic oligonucleotide
gtgcacgcagttcaaacgtttggcatcccaggaat

SEQ ID NO: 55675 - DNA, 35 bp, Artificial Sequence
  Synthetic oligonucleotide
ttcgagcacgagcctgagcactggctgtttcctat

SEQ ID NO: 55676 - DNA, 35 bp, Artificial Sequence
  Synthetic oligonucleotide
tcgtccagtcgctcccccctgccatcgcagatcct

SEQ ID NO: 55677 - DNA, 35 bp, Artificial Sequence
  Synthetic oligonucleotide
gctgtgtgcccggcccacgcgttattaacggtcct

SEQ ID NO: 55678 - DNA, 35 bp, Artificial Sequence
  Synthetic oligonucleotide
gcctgaccgaccaaagtatgacctcattatgcgct

SEQ ID NO: 55679 - DNA, 35 bp, Artificial Sequence
  Synthetic oligonucleotide
ggtggactgttggactagggcgggagggagtggct

SEQ ID NO: 55680 - DNA, 35 bp, Artificial Sequence
  Synthetic oligonucleotide
gaaccacagcagaactgactacttgactctcgtct

SEQ ID NO: 55681 - DNA, 35 bp, Artificial Sequence
  Synthetic oligonucleotide
gcccgtgtcggcgagtgctacgtaccacatattct

SEQ ID NO: 55682 - DNA, 35 bp, Artificial Sequence
  Synthetic oligonucleotide
gtggaacacaggaaagaggaaggacggtccatggt

SEQ ID NO: 55683 - DNA, 35 bp, Artificial Sequence
  Synthetic oligonucleotide
gcctgtacctctcaccctgattctttgggctcatt

SEQ ID NO: 55684 - DNA, 35 bp, Artificial Sequence
  Synthetic oligonucleotide
ttggtgcgcatcatcaattaccagaccgctgcctt

SEQ ID NO: 55685 - DNA, 35 bp, Artificial Sequence
  Synthetic oligonucleotide
gaaacatcgagccgacgcccttcttcactaatgtt

SEQ ID NO: 55686 - DNA, 35 bp, Artificial Sequence
  Synthetic oligonucleotide
gcaccctgtccctaatcatgcgatacgcgcgcttt

SEQ ID NO: 55687 - DNA, 36 bp, Artificial Sequence
  Synthetic oligonucleotide
ggtacatgccacccgccacttaggttcccacttaaa

SEQ ID NO: 55688 - DNA, 35 bp, Artificial Sequence
  Synthetic oligonucleotide
gacagggtagggcacggcgggatactggtgttaaa

SEQ ID NO: 55689 - DNA, 36 bp, Artificial Sequence
  Synthetic oligonucleotide
gtgcgaggtggccgccccttattgctcttaccccaa

SEQ ID NO: 55690 - DNA, 36 bp, Artificial Sequence
  Synthetic oligonucleotide
tttcggactgctcacaaacccttccttgcgtggcaa

SEQ ID NO: 55691 - DNA, 36 bp, Artificial Sequence
  Synthetic oligonucleotide
gctacgtccttgcccccatcttgcccactactgcaa

SEQ ID NO: 55692 - DNA, 36 bp, Artificial Sequence
  Synthetic oligonucleotide
gtgttaccaccgccaccgtacgacattcccttctaa

SEQ ID NO: 55693 - DNA, 35 bp, Artificial Sequence
  Synthetic oligonucleotide
taacctccgtccgcattcgtgttcccacgccttaa

SEQ ID NO: 55694 - DNA, 36 bp, Artificial Sequence
  Synthetic oligonucleotide
ttacctgcccacgatttgtactcgtaccacgcacca

SEQ ID NO: 55695 - DNA, 35 bp, Artificial Sequence
  Synthetic oligonucleotide
acactccgcatatactgccgggccactaaatgcca

SEQ ID NO: 55696 - DNA, 35 bp, Artificial Sequence
  Synthetic oligonucleotide
gtgagcgcagaccaagtgttgcattccatctttca

SEQ ID NO: 55697 - DNA, 36 bp, Artificial Sequence
  Synthetic oligonucleotide
gacaagcccctacctcactcatatggacgatgaaga

SEQ ID NO: 55698 - DNA, 37 bp, Artificial Sequence
  Synthetic oligonucleotide
tacagagggggggggatggggaatgggttaatgtaga

SEQ ID NO: 55699 - DNA, 37 bp, Artificial Sequence
  Synthetic oligonucleotide
ttaccctccagccggttcatccatggccgttgcccga

SEQ ID NO: 55700 - DNA, 37 bp, Artificial Sequence
  Synthetic oligonucleotide
acccaggccgcagagcccttcccgatgaccagtgcga

SEQ ID NO: 55701 - DNA, 38 bp, Artificial Sequence
  Synthetic oligonucleotide
tcaattcacgccttatctggtcacgaccaccggatcga

SEQ ID NO: 55702 - DNA, 36 bp, Artificial Sequence
  Synthetic oligonucleotide
gcacactgctcggggtatgggggtgggaaatctcga

SEQ ID NO: 55703 - DNA, 36 bp, Artificial Sequence
  Synthetic oligonucleotide
actctactggctccattgccctctatgtccccagga

SEQ ID NO: 55704 - DNA, 37 bp, Artificial Sequence
  Synthetic oligonucleotide
acgaggagaaaagagtgggggatggaatgtatgggga

SEQ ID NO: 55705 - DNA, 38 bp, Artificial Sequence
  Synthetic oligonucleotide
gttgacacgggcggctcaggtgggtcgggtgggaatga

SEQ ID NO: 55706 - DNA, 38 bp, Artificial Sequence
  Synthetic oligonucleotide
acatgtcgccggccgtcaaatcaatctgttttccatga

SEQ ID NO: 55707 - DNA, 38 bp, Artificial Sequence
  Synthetic oligonucleotide
tgagtcgcacttagtacagtgtctccacttccacctga

SEQ ID NO: 55708 - DNA, 38 bp, Artificial Sequence
  Synthetic oligonucleotide
gccatctacactgccgtccttgctcacgcgaaagctga

SEQ ID NO: 55709 - DNA, 38 bp, Artificial Sequence
  Synthetic oligonucleotide
tcacaaacagtccctgcaaatgcacctgctccatctga

SEQ ID NO: 55710 - DNA, 38 bp, Artificial Sequence
  Synthetic oligonucleotide
gcgtggcacaggaggggagaaatgagtttaatgtctga

SEQ ID NO: 55711 - DNA, 37 bp, Artificial Sequence
  Synthetic oligonucleotide
gacaacggtccccctctgtagctctggctatttctga

SEQ ID NO: 55712 - DNA, 38 bp, Artificial Sequence
  Synthetic oligonucleotide
atacgggcgtggggcatgttgggagggcctaagggtga

SEQ ID NO: 55713 - DNA, 38 bp, Artificial Sequence
  Synthetic oligonucleotide
gacacaccatgcccctcagttttccgaacacaatgtga

SEQ ID NO: 55714 - DNA, 37 bp, Artificial Sequence
  Synthetic oligonucleotide
ggtgaacggaagacgggggacgggggttagtgtgtga

SEQ ID NO: 55715 - DNA, 38 bp, Artificial Sequence
  Synthetic oligonucleotide
ttcatgtgcctgatagctaatccttccgcctcttgtga

SEQ ID NO: 55716 - DNA, 38 bp, Artificial Sequence
  Synthetic oligonucleotide
acacgacatcttcaccaggcgcaaccaaccgacattga

SEQ ID NO: 55717 - DNA, 38 bp, Artificial Sequence
  Synthetic oligonucleotide
gacggtccagctccgtctcatttcctggcctagattga

SEQ ID NO: 55718 - DNA, 38 bp, Artificial Sequence
  Synthetic oligonucleotide
acagacacacacacctcactcgtcaagtcaagagttga

SEQ ID NO: 55719 - DNA, 35 bp, Artificial Sequence
  Synthetic oligonucleotide
gacacggccctgaacacgagcatgaaaatggttga

SEQ ID NO: 55720 - DNA, 36 bp, Artificial Sequence
  Synthetic oligonucleotide
gagtttatgtcgaatggggggaagggggcggtgata

SEQ ID NO: 55721 - DNA, 36 bp, Artificial Sequence
  Synthetic oligonucleotide
gtcccgccagctatccatctccgtgtcgtttttata

SEQ ID NO: 55722 - DNA, 36 bp, Artificial Sequence
  Synthetic oligonucleotide
ggccccattctacccgccctgatcgttaccccagta

SEQ ID NO: 55723 - DNA, 36 bp, Artificial Sequence
  Synthetic oligonucleotide
gcgagaatggaagaagggaataactgatgtgtggta

SEQ ID NO: 55724 - DNA, 35 bp, Artificial Sequence
  Synthetic oligonucleotide
ttgaactggcctattgttgtcttcctacgcagaac

SEQ ID NO: 55725 - DNA, 35 bp, Artificial Sequence
  Synthetic oligonucleotide
acccgtagggactcccgaactttacgataccgaac

SEQ ID NO: 55726 - DNA, 35 bp, Artificial Sequence
  Synthetic oligonucleotide
atagccccgccggtgaaagcactcactccctgtac

SEQ ID NO: 55727 - DNA, 35 bp, Artificial Sequence
  Synthetic oligonucleotide
atctctgcttacccgcacaggattctccacctgcc

SEQ ID NO: 55728 - DNA, 35 bp, Artificial Sequence
  Synthetic oligonucleotide
tagtcgcatccgccctggatgtatcgcctgcattc

SEQ ID NO: 55729 - DNA, 35 bp, Artificial Sequence
  Synthetic oligonucleotide
gtttgcaccagcgtgttaatgacccttcctccacg

SEQ ID NO: 55730 - DNA, 35 bp, Artificial Sequence
  Synthetic oligonucleotide
ttgtgaagggtggtggcggaaggagcattaaaccg

SEQ ID NO: 55731 - DNA, 35 bp, Artificial Sequence
  Synthetic oligonucleotide
gtgactcactgtatctctccctcgctatcttgcgg

SEQ ID NO: 55732 - DNA, 35 bp, Artificial Sequence
  Synthetic oligonucleotide
tccgtacatcatctccgtcaactgcatacatctgg

SEQ ID NO: 55733 - DNA, 35 bp, Artificial Sequence
  Synthetic oligonucleotide
tgggtagtctcgctttatttgattccctgtacctg

SEQ ID NO: 55734 - DNA, 35 bp, Artificial Sequence
  Synthetic oligonucleotide
gttgcggggaagggaattgccaagttgaagagttg

SEQ ID NO: 55735 - DNA, 35 bp, Artificial Sequence
  Synthetic oligonucleotide
aatctccgcatctgtttccaccaagccatacgttg

SEQ ID NO: 55736 - DNA, 35 bp, Artificial Sequence
  Synthetic oligonucleotide
gagtagcacacgcgctttcctatgttccccccaat

SEQ ID NO: 55737 - DNA, 35 bp, Artificial Sequence
  Synthetic oligonucleotide
aaattgcctccgccttagtgctcctgtcaccttat

SEQ ID NO: 55738 - DNA, 35 bp, Artificial Sequence
  Synthetic oligonucleotide
gacttagccgctccactcgcgttccaactggccct

SEQ ID NO: 55739 - DNA, 35 bp, Artificial Sequence
  Synthetic oligonucleotide
tcctgcgaactgcgagtgccacataatacttctct

SEQ ID NO: 55740 - DNA, 35 bp, Artificial Sequence
  Synthetic oligonucleotide
gcactgtcacggttctcgtacctcatactttcggt

SEQ ID NO: 55741 - DNA, 35 bp, Artificial Sequence
  Synthetic oligonucleotide
tgctcagtcttccccgttcattcccgctgcacatt

SEQ ID NO: 55742 - DNA, 35 bp, Artificial Sequence
  Synthetic oligonucleotide
tgaacgtgcgctaatttcggactgacttgcacctt

SEQ ID NO: 55743 - DNA, 35 bp, Artificial Sequence
  Synthetic oligonucleotide
gacccttgcgaacgctagagcaggcctgacccctt

SEQ ID NO: 55744 - DNA, 35 bp, Artificial Sequence
  Synthetic oligonucleotide
tacctcacgctatcgtgagcttcacccggttcctt

SEQ ID NO: 55745 - DNA, 35 bp, Artificial Sequence
  Synthetic oligonucleotide
tccggggttagccctgtacttcgatcctgtccttt

SEQ ID NO: 55746 - DNA, 36 bp, Artificial Sequence
  Synthetic oligonucleotide
gcatcaaccccgctggcattttgtcgactaattcaa

SEQ ID NO: 55747 - DNA, 36 bp, Artificial Sequence
  Synthetic oligonucleotide
agaggggggggcagaaaagaaaggggagggagcgaa

SEQ ID NO: 55748 - DNA, 36 bp, Artificial Sequence
  Synthetic oligonucleotide
tggaccccctaccaatcatgtacatctgtctggtaa

SEQ ID NO: 55749 - DNA, 35 bp, Artificial Sequence
  Synthetic oligonucleotide
gtggggtggtgtgggtcgaattgggggttggttaa

SEQ ID NO: 55750 - DNA, 35 bp, Artificial Sequence
  Synthetic oligonucleotide
gcgcccactccaaccagcgaacttgaactgtcaca

SEQ ID NO: 55751 - DNA, 36 bp, Artificial Sequence
  Synthetic oligonucleotide
attgaagcccctccggtgtggcaccgattacctaca

SEQ ID NO: 55752 - DNA, 36 bp, Artificial Sequence
  Synthetic oligonucleotide
taacacgttgcggcccagcttaacactttttctaca

SEQ ID NO: 55753 - DNA, 36 bp, Artificial Sequence
  Synthetic oligonucleotide
tctgccctggagggaaacgacaccttcatgtttaca

SEQ ID NO: 55754 - DNA, 36 bp, Artificial Sequence
  Synthetic oligonucleotide
agcaccactgggcaggtaagggctcgggattgacca

SEQ ID NO: 55755 - DNA, 35 bp, Artificial Sequence
  Synthetic oligonucleotide
agttaccatccgtccatactgcctagcagcagcca

SEQ ID NO: 55756 - DNA, 35 bp, Artificial Sequence
  Synthetic oligonucleotide
atgccgccgtcctgagccactcttgcgatccgcca

SEQ ID NO: 55757 - DNA, 36 bp, Artificial Sequence
  Synthetic oligonucleotide
acccacctcctagataccgatggtcgtacctcgcca

SEQ ID NO: 55758 - DNA, 35 bp, Artificial Sequence
  Synthetic oligonucleotide
tgtctcacacacgccataagcttctatcccttgca

SEQ ID NO: 55759 - DNA, 36 bp, Artificial Sequence
  Synthetic oligonucleotide
aagtcgccaatcaccttaagcccgtatcacttgtca

SEQ ID NO: 55760 - DNA, 36 bp, Artificial Sequence
  Synthetic oligonucleotide
ggtggtgcgtgttgccggccagattcttttccttca

SEQ ID NO: 55761 - DNA, 36 bp, Artificial Sequence
  Synthetic oligonucleotide
tcccacccaagcttttgcagctgctatgcctgttca

SEQ ID NO: 55762 - DNA, 37 bp, Artificial Sequence
  Synthetic oligonucleotide
agtctgcatcccgggcgctctcctctcagtaccaaga

SEQ ID NO: 55763 - DNA, 36 bp, Artificial Sequence
  Synthetic oligonucleotide
tgtacgttccacggctccctaactgaccagtcaaga

SEQ ID NO: 55764 - DNA, 37 bp, Artificial Sequence
  Synthetic oligonucleotide
gatcacgccaccatatcgcccaccgcaatcttcaaga

SEQ ID NO: 55765 - DNA, 37 bp, Artificial Sequence
  Synthetic oligonucleotide
aacgaagtgagagaggataaagggtacttacatgaga

SEQ ID NO: 55766 - DNA, 37 bp, Artificial Sequence
  Synthetic oligonucleotide
gatagagggatgggagtgcggagaagcgagcgctaga

SEQ ID NO: 55767 - DNA, 37 bp, Artificial Sequence
  Synthetic oligonucleotide
gcccatcaacaccgaatctgggtcgctccacccacga

SEQ ID NO: 55768 - DNA, 37 bp, Artificial Sequence
  Synthetic oligonucleotide
gccgactccctctcgatcttttggtagcccgtgccga

SEQ ID NO: 55769 - DNA, 35 bp, Artificial Sequence
  Synthetic oligonucleotide
gttgcccgcgccggctcttccactcactccagcga

SEQ ID NO: 55770 - DNA, 37 bp, Artificial Sequence
  Synthetic oligonucleotide
agaccccgggtctgaattctggccttctcattctcga

SEQ ID NO: 55771 - DNA, 37 bp, Artificial Sequence
  Synthetic oligonucleotide
cacacaccaacacaaggtattttccagagatgtagga

SEQ ID NO: 55772 - DNA, 37 bp, Artificial Sequence
  Synthetic oligonucleotide
ggacgaaggtgggagcgtggggtgggggtctacggga

SEQ ID NO: 55773 - DNA, 37 bp, Artificial Sequence
  Synthetic oligonucleotide
gtccgggccaggactaggtggggtgtgaggacgggga

SEQ ID NO: 55774 - DNA, 37 bp, Artificial Sequence
  Synthetic oligonucleotide
gcggagaagtaaatggggaattagcagggggtgggga

SEQ ID NO: 55775 - DNA, 37 bp, Artificial Sequence
  Synthetic oligonucleotide
acagattgggcacacatgagggggggggtccctggga

SEQ ID NO: 55776 - DNA, 37 bp, Artificial Sequence
  Synthetic oligonucleotide
tcaggggggagcaaggagagggactaatgaatctgga

SEQ ID NO: 55777 - DNA, 35 bp, Artificial Sequence
  Synthetic oligonucleotide
gtgcaaagggagtgagcgcggggatatcatttgga

SEQ ID NO: 55778 - DNA, 38 bp, Artificial Sequence
  Synthetic oligonucleotide
tagcagggcaccggctcactttgactacagcaccctga

SEQ ID NO: 55779 - DNA, 38 bp, Artificial Sequence
  Synthetic oligonucleotide
tacgagccacctgctgtaagcttcagccttttgcctga

SEQ ID NO: 55780 - DNA, 38 bp, Artificial Sequence
  Synthetic oligonucleotide
acccaccgcagttgaacgaacagtaaagcgagttctga

SEQ ID NO: 55781 - DNA, 38 bp, Artificial Sequence
  Synthetic oligonucleotide
tgcaccgaaacttccgtccttggaacatcaggttctga

SEQ ID NO: 55782 - DNA, 38 bp, Artificial Sequence
  Synthetic oligonucleotide
agataggggggtgacggggcagaccatgcacttagtga

SEQ ID NO: 55783 - DNA, 37 bp, Artificial Sequence
  Synthetic oligonucleotide
aatgcagactccgcctcccttgtcctgccccttgtga

SEQ ID NO: 55784 - DNA, 38 bp, Artificial Sequence
  Synthetic oligonucleotide
tccctcgatagtcgttacacctgaccctgcttttgtga

SEQ ID NO: 55785 - DNA, 38 bp, Artificial Sequence
  Synthetic oligonucleotide
gggcctccaccgtgtgcccacaccatccctttttgtga

SEQ ID NO: 55786 - DNA, 38 bp, Artificial Sequence
  Synthetic oligonucleotide
tcactggagggagagtgcgtggtaggaaatgggattga

SEQ ID NO: 55787 - DNA, 38 bp, Artificial Sequence
  Synthetic oligonucleotide
gacccggcctctgttcctggtacccagtttccacttga

SEQ ID NO: 55788 - DNA, 38 bp, Artificial Sequence
  Synthetic oligonucleotide
acttacctgcttcggccatgcgtgcctgcaacccttga

SEQ ID NO: 55789 - DNA, 38 bp, Artificial Sequence
  Synthetic oligonucleotide
gattcctcccgatcgatgatacactcacgccatcttga

SEQ ID NO: 55790 - DNA, 38 bp, Artificial Sequence
  Synthetic oligonucleotide
acacgttccatcgccgtcgcgctcctcccgttagttga

SEQ ID NO: 55791 - DNA, 37 bp, Artificial Sequence
  Synthetic oligonucleotide
gagaacgggctgacacggcgggaggggcgggatttga

SEQ ID NO: 55792 - DNA, 38 bp, Artificial Sequence
  Synthetic oligonucleotide
atccacgcacctgagtctctcgccgggtcatcctttga

SEQ ID NO: 55793 - DNA, 35 bp, Artificial Sequence
  Synthetic oligonucleotide
ttgcacagcctacccaatttgcttgtagttgcata

SEQ ID NO: 55794 - DNA, 36 bp, Artificial Sequence
  Synthetic oligonucleotide
gctctgccccggaacgtctccgtttgcgattcccta

SEQ ID NO: 55795 - DNA, 36 bp, Artificial Sequence
  Synthetic oligonucleotide
ggaatgaacagggtggatttttggtgggtgcaatta

SEQ ID NO: 55796 - DNA, 35 bp, Artificial Sequence
  Synthetic oligonucleotide
tccgggcccccaccggggatagacctcctccctta

SEQ ID NO: 55797 - DNA, 36 bp, Artificial Sequence
  Synthetic oligonucleotide
gtacgccgcatttagtgtcaattccatccctcctta

SEQ ID NO: 55798 - DNA, 36 bp, Artificial Sequence
  Synthetic oligonucleotide
gcatcacttcctgcttatcctagggttcggtcttta

SEQ ID NO: 55799 - DNA, 35 bp, Artificial Sequence
  Synthetic oligonucleotide
tacgttacagctctgccactccatactattcttta

SEQ ID NO: 55800 - DNA, 35 bp, Artificial Sequence
  Synthetic oligonucleotide
tgacgaacctggatgtaagccgcccttttgccaac

SEQ ID NO: 55801 - DNA, 35 bp, Artificial Sequence
  Synthetic oligonucleotide
tgatgcgtgggccatcgttggtttcgttttcttac

SEQ ID NO: 55802 - DNA, 35 bp, Artificial Sequence
  Synthetic oligonucleotide
ttgttgtcccaacggtcatacaacacctcacaacc

SEQ ID NO: 55803 - DNA, 35 bp, Artificial Sequence
  Synthetic oligonucleotide
tacatcggcctttctccatggtgctgtcgaacacc

SEQ ID NO: 55804 - DNA, 35 bp, Artificial Sequence
  Synthetic oligonucleotide
gaccagcgcattgtttatgtcttggttatcccccc

SEQ ID NO: 55805 - DNA, 35 bp, Artificial Sequence
  Synthetic oligonucleotide
tgcctcaaatctccgtgtcgcatggttaccttccc

SEQ ID NO: 55806 - DNA, 35 bp, Artificial Sequence
  Synthetic oligonucleotide
ttatgcagaacaacgaatagcgcctgacaccatcc

SEQ ID NO: 55807 - DNA, 35 bp, Artificial Sequence
  Synthetic oligonucleotide
agtgtgcaccccctgacagcagtgaccgcccctcc

SEQ ID NO: 55808 - DNA, 35 bp, Artificial Sequence
  Synthetic oligonucleotide
acacctaatcctgctgatcaccttggcccgggtcc

SEQ ID NO: 55809 - DNA, 35 bp, Artificial Sequence
  Synthetic oligonucleotide
gtgatgccccctcactcgaattttaaaagccttcc

SEQ ID NO: 55810 - DNA, 35 bp, Artificial Sequence
  Synthetic oligonucleotide
tgtattccccgcacgttctgccagcgcatgtccgc

SEQ ID NO: 55811 - DNA, 35 bp, Artificial Sequence
  Synthetic oligonucleotide
agacgcgaaactccacctcagatgtacccttccgc

SEQ ID NO: 55812 - DNA, 35 bp, Artificial Sequence
  Synthetic oligonucleotide
tacaactcgtccgtctgcatttcgccttctgcggc

SEQ ID NO: 55813 - DNA, 35 bp, Artificial Sequence
  Synthetic oligonucleotide
tcccgcgggttatctctgcctccggcctattgctc

SEQ ID NO: 55814 - DNA, 35 bp, Artificial Sequence
  Synthetic oligonucleotide
gtccacccgtcttatagaccttgactagttttctc

SEQ ID NO: 55815 - DNA, 35 bp, Artificial Sequence
  Synthetic oligonucleotide
tcggatcccgcattgttacctccgtattactggtc

SEQ ID NO: 55816 - DNA, 35 bp, Artificial Sequence
  Synthetic oligonucleotide
tgagtagggagataaggatatatgaggggtacgag

SEQ ID NO: 55817 - DNA, 35 bp, Artificial Sequence
  Synthetic oligonucleotide
gttctcccgccgtacccctatctggatgactaacg

SEQ ID NO: 55818 - DNA, 35 bp, Artificial Sequence
  Synthetic oligonucleotide
gactcccactgaacgttccacgcgcccctgcctcg

SEQ ID NO: 55819 - DNA, 35 bp, Artificial Sequence
  Synthetic oligonucleotide
accaagtggggggggggggaagggtagtagatagg

SEQ ID NO: 55820 - DNA, 34 bp, Artificial Sequence
  Synthetic oligonucleotide
atgctgtgcgccgggcttgaccaccaatccccat

SEQ ID NO: 55821 - DNA, 35 bp, Artificial Sequence
  Synthetic oligonucleotide
gccatcccgcaccagtccacatagatcccgtagat

SEQ ID NO: 55822 - DNA, 35 bp, Artificial Sequence
  Synthetic oligonucleotide
acccccacttcccattgctagcgcgatgaggttat

SEQ ID NO: 55823 - DNA, 35 bp, Artificial Sequence
  Synthetic oligonucleotide
tcataccctctgctgcacatttaacagccgggact

SEQ ID NO: 55824 - DNA, 35 bp, Artificial Sequence
  Synthetic oligonucleotide
tatatccctccgcggatctaagacccttagtacct

SEQ ID NO: 55825 - DNA, 35 bp, Artificial Sequence
  Synthetic oligonucleotide
actccggaacccgctgggataaacacccacttgct

SEQ ID NO: 55826 - DNA, 35 bp, Artificial Sequence
  Synthetic oligonucleotide
gcctcacctagtacactgagcacgaacaagcctct

SEQ ID NO: 55827 - DNA, 35 bp, Artificial Sequence
  Synthetic oligonucleotide
attcaagcgcctatcatctggtctcaactggtttt

SEQ ID NO: 55828 - DNA, 36 bp, Artificial Sequence
  Synthetic oligonucleotide
gcaggccaccatctgttttcgccagctcaacctcaa

SEQ ID NO: 55829 - DNA, 35 bp, Artificial Sequence
  Synthetic oligonucleotide
tgatgacatcctccgtttctatctgggcattcaca

SEQ ID NO: 55830 - DNA, 35 bp, Artificial Sequence
  Synthetic oligonucleotide
gacgaacaggcagtacgtactgtcaaacgccgcca

SEQ ID NO: 55831 - DNA, 35 bp, Artificial Sequence
  Synthetic oligonucleotide
ttgagacagcacctttcgatacatcctctgtgcca

SEQ ID NO: 55832 - DNA, 36 bp, Artificial Sequence
  Synthetic oligonucleotide
aacgcccctcgagtattgcagccccgaaacattcca

SEQ ID NO: 55833 - DNA, 36 bp, Artificial Sequence
  Synthetic oligonucleotide
gtgccgggggctatgggttcaaagcgggaggaaaga

SEQ ID NO: 55834 - DNA, 37 bp, Artificial Sequence
  Synthetic oligonucleotide
atacctgtccacgccacttgatactcgtctatgacga

SEQ ID NO: 55835 - DNA, 36 bp, Artificial Sequence
  Synthetic oligonucleotide
tatagcccattgcgctgaccgaacatcaaaatacga

SEQ ID NO: 55836 - DNA, 37 bp, Artificial Sequence
  Synthetic oligonucleotide
atgacctgcgcccctgccatggccattaacatgccga

SEQ ID NO: 55837 - DNA, 37 bp, Artificial Sequence
  Synthetic oligonucleotide
agggaacccgtgcaattgtcttcgccctacccatcga

SEQ ID NO: 55838 - DNA, 37 bp, Artificial Sequence
  Synthetic oligonucleotide
tacgaagcttggcgagttgctgctctttccctatcga

SEQ ID NO: 55839 - DNA, 35 bp, Artificial Sequence
  Synthetic oligonucleotide
tttgccagccgattcaactctgcgttatccctcga

SEQ ID NO: 55840 - DNA, 36 bp, Artificial Sequence
  Synthetic oligonucleotide
tcagtctcgactttttccatgcccagccctcgcgga

SEQ ID NO: 55841 - DNA, 37 bp, Artificial Sequence
  Synthetic oligonucleotide
gaccaatgcgggtggcgcaaaggggccttggtaggga

SEQ ID NO: 55842 - DNA, 37 bp, Artificial Sequence
  Synthetic oligonucleotide
gatgagaggtgggcaggggcgtcccgggtcaggggga

SEQ ID NO: 55843 - DNA, 37 bp, Artificial Sequence
  Synthetic oligonucleotide
taaacggggaaaaggactggtgggggcggtcatggga

SEQ ID NO: 55844 - DNA, 38 bp, Artificial Sequence
  Synthetic oligonucleotide
gggatagaggtggacgggtcgcggactgggagaaatga

SEQ ID NO: 55845 - DNA, 37 bp, Artificial Sequence
  Synthetic oligonucleotide
gaatgcgggaatgaggaaggtgatgtgatgtctatga

SEQ ID NO: 55846 - DNA, 38 bp, Artificial Sequence
  Synthetic oligonucleotide
tagggcgactcctgcccgtccgagcccacatcacctga

SEQ ID NO: 55847 - DNA, 38 bp, Artificial Sequence
  Synthetic oligonucleotide
gcatgccttcatcctggtcctcatatgtacactgctga

SEQ ID NO: 55848 - DNA, 38 bp, Artificial Sequence
  Synthetic oligonucleotide
gtgacccctcgagctccttccctgtgaaacatttctga

SEQ ID NO: 55849 - DNA, 38 bp, Artificial Sequence
  Synthetic oligonucleotide
agtgggatggttggtggggtcggaacgggagctagtga

SEQ ID NO: 55850 - DNA, 38 bp, Artificial Sequence
  Synthetic oligonucleotide
aagccaaaaaaggcggaaaatggggggaacggaggtga

SEQ ID NO: 55851 - DNA, 38 bp, Artificial Sequence
  Synthetic oligonucleotide
ataccacgaccatgtttctccgttaacctaccctgtga

SEQ ID NO: 55852 - DNA, 38 bp, Artificial Sequence
  Synthetic oligonucleotide
tttcaaagtcgggaaggaggaaagggcggagggtgtga

SEQ ID NO: 55853 - DNA, 37 bp, Artificial Sequence
  Synthetic oligonucleotide
acctccgtatgcagttgctatctcatcctttgcttga

SEQ ID NO: 55854 - DNA, 38 bp, Artificial Sequence
  Synthetic oligonucleotide
gacaagtcttacccgtccctccgccgacccccgtttga

SEQ ID NO: 55855 - DNA, 36 bp, Artificial Sequence
  Synthetic oligonucleotide
agtacaaccacaaatggcacattggaacccgatcta

SEQ ID NO: 55856 - DNA, 36 bp, Artificial Sequence
  Synthetic oligonucleotide
acgtattagggaggtggggtatggggaggtatggta

SEQ ID NO: 55857 - DNA, 36 bp, Artificial Sequence
  Synthetic oligonucleotide
aacactagcagcacctaaacgttccagcgccctgta

SEQ ID NO: 55858 - DNA, 36 bp, Artificial Sequence
  Synthetic oligonucleotide
gaccgcccctctttgaagtacatcctgggcccgtta

SEQ ID NO: 55859 - DNA, 35 bp, Artificial Sequence
  Synthetic oligonucleotide
atacacaaaccatgcgctgctgatccatcacgcac

SEQ ID NO: 55860 - DNA, 35 bp, Artificial Sequence
  Synthetic oligonucleotide
caacactgctcctctaccccgtacagacacgaacc

SEQ ID NO: 55861 - DNA, 35 bp, Artificial Sequence
  Synthetic oligonucleotide
tgacgcaacaccttaaactcgtgcggttaggaacc

SEQ ID NO: 55862 - DNA, 35 bp, Artificial Sequence
  Synthetic oligonucleotide
agcaacgtacattcgtcactttcgtcgggtaatcc

SEQ ID NO: 55863 - DNA, 35 bp, Artificial Sequence
  Synthetic oligonucleotide
tccccagcgagcacacatacatcgcaaactgctcc

SEQ ID NO: 55864 - DNA, 35 bp, Artificial Sequence
  Synthetic oligonucleotide
ttcacccacggtccgcggttttaaaacctttgtcc

SEQ ID NO: 55865 - DNA, 35 bp, Artificial Sequence
  Synthetic oligonucleotide
agtgacgacccccacgtaggaccaatgactgtcgc

SEQ ID NO: 55866 - DNA, 35 bp, Artificial Sequence
  Synthetic oligonucleotide
gccggtgcatgtagtagttgttttttctttcctgc

SEQ ID NO: 55867 - DNA, 35 bp, Artificial Sequence
  Synthetic oligonucleotide
tctgttgacacatctgaattactacccaatgcctc

SEQ ID NO: 55868 - DNA, 35 bp, Artificial Sequence
  Synthetic oligonucleotide
gtgtgcccccgggcgttggctcccctaatgctctc

SEQ ID NO: 55869 - DNA, 35 bp, Artificial Sequence
  Synthetic oligonucleotide
tccacggctctcctgattcctttattttgtaattc

SEQ ID NO: 55870 - DNA, 35 bp, Artificial Sequence
  Synthetic oligonucleotide
tcaacacagactctgtcgttggcaaattcccattc

SEQ ID NO: 55871 - DNA, 35 bp, Artificial Sequence
  Synthetic oligonucleotide
gaacaggctaagccttcttgcacacccgccaatcg

SEQ ID NO: 55872 - DNA, 35 bp, Artificial Sequence
  Synthetic oligonucleotide
actagacgccaccgttctttatgaacacacctctg

SEQ ID NO: 55873 - DNA, 35 bp, Artificial Sequence
  Synthetic oligonucleotide
ttcgactgtcctgcccaagttcgccttttccggtg

SEQ ID NO: 55874 - DNA, 35 bp, Artificial Sequence
  Synthetic oligonucleotide
ttgacggtcaccctgtcttcccgtacttctttttg

SEQ ID NO: 55875 - DNA, 35 bp, Artificial Sequence
  Synthetic oligonucleotide
gcccacccgcacgacccgccgagtagcaccttgct

SEQ ID NO: 55876 - DNA, 35 bp, Artificial Sequence
  Synthetic oligonucleotide
gtgccatccacgcaacgagacacgcttatcgatct

SEQ ID NO: 55877 - DNA, 35 bp, Artificial Sequence
  Synthetic oligonucleotide
gttgttacctcctgttcccctcgtacggacccagt

SEQ ID NO: 55878 - DNA, 35 bp, Artificial Sequence
  Synthetic oligonucleotide
agcacgcgctgtcccactgggtctctctgctcggt

SEQ ID NO: 55879 - DNA, 35 bp, Artificial Sequence
  Synthetic oligonucleotide
taccaccgcctttgactagttttgaggatcctctt

SEQ ID NO: 55880 - DNA, 35 bp, Artificial Sequence
  Synthetic oligonucleotide
tgagccgtgcgttaattctgtcgccttttcttctt

SEQ ID NO: 55881 - DNA, 35 bp, Artificial Sequence
  Synthetic oligonucleotide
agaactggcagttgcatcacccacgtccttccaaa

SEQ ID NO: 55882 - DNA, 36 bp, Artificial Sequence
  Synthetic oligonucleotide
tgatctgccactgacgacctctcattatctttcgaa

SEQ ID NO: 55883 - DNA, 36 bp, Artificial Sequence
  Synthetic oligonucleotide
tgtcacccagccataccccaccactaaccttagtaa

SEQ ID NO: 55884 - DNA, 36 bp, Artificial Sequence
  Synthetic oligonucleotide
gccacccgacgggatccgctccattgactgaagaca

SEQ ID NO: 55885 - DNA, 35 bp, Artificial Sequence
  Synthetic oligonucleotide
gcactaggtgctggcctcgtagcatatacccacca

SEQ ID NO: 55886 - DNA, 36 bp, Artificial Sequence
  Synthetic oligonucleotide
gccctagatggtcaggatcaccccgcatcttctcca

SEQ ID NO: 55887 - DNA, 36 bp, Artificial Sequence
  Synthetic oligonucleotide
tcaccacctttccggatccggacgcgacgctcctca

SEQ ID NO: 55888 - DNA, 36 bp, Artificial Sequence
  Synthetic oligonucleotide
gcacgcgcgcgggcaaaaccgcataacattctgtca

SEQ ID NO: 55889 - DNA, 36 bp, Artificial Sequence
  Synthetic oligonucleotide
agaagcactcggacgagcttattcctctcaccttca

SEQ ID NO: 55890 - DNA, 36 bp, Artificial Sequence
  Synthetic oligonucleotide
gagaagggattcgtacctgggaatcgggaagggaga

SEQ ID NO: 55891 - DNA, 36 bp, Artificial Sequence
  Synthetic oligonucleotide
agtaccccagccggctcccgcaaagtcaacactaga

SEQ ID NO: 55892 - DNA, 37 bp, Artificial Sequence
  Synthetic oligonucleotide
gcaatatatcgataggggaaagggaagggaggctaga

SEQ ID NO: 55893 - DNA, 37 bp, Artificial Sequence
  Synthetic oligonucleotide
tcgatgggtgggttggggtacctggggatactttaga

SEQ ID NO: 55894 - DNA, 37 bp, Artificial Sequence
  Synthetic oligonucleotide
attcgaaccccgcagtcgtttattcactgtctcacga

SEQ ID NO: 55895 - DNA, 37 bp, Artificial Sequence
  Synthetic oligonucleotide
gtgtaaacgcccgaaattccgactgaacccgctccga

SEQ ID NO: 55896 - DNA, 37 bp, Artificial Sequence
  Synthetic oligonucleotide
atcgccgagttgcgataagcgtccacccctccatcga

SEQ ID NO: 55897 - DNA, 37 bp, Artificial Sequence
  Synthetic oligonucleotide
gacgtgcacagataaggaatgaatggggcaagcagga

SEQ ID NO: 55898 - DNA, 37 bp, Artificial Sequence
  Synthetic oligonucleotide
agcccctgaatcctaaactgccgtgtccgcccctgga

SEQ ID NO: 55899 - DNA, 36 bp, Artificial Sequence
  Synthetic oligonucleotide
tgcatcaccccctacattctcgtttttcgtcttgga

SEQ ID NO: 55900 - DNA, 37 bp, Artificial Sequence
  Synthetic oligonucleotide
gtcgagagggtagggatgaaactaggaagctggatga

SEQ ID NO: 55901 - DNA, 37 bp, Artificial Sequence
  Synthetic oligonucleotide
tcacgtcacggtctgcacatgcaccctcacctgatga

SEQ ID NO: 55902 - DNA, 37 bp, Artificial Sequence
  Synthetic oligonucleotide
gatacacactcacacgcacgtgctttaacaacactga

SEQ ID NO: 55903 - DNA, 38 bp, Artificial Sequence
  Synthetic oligonucleotide
tctccaaccgaccactttgctcgaagcttcatacctga

SEQ ID NO: 55904 - DNA, 38 bp, Artificial Sequence
  Synthetic oligonucleotide
gatgcagctacataggccatcctgcatctccaccctga

SEQ ID NO: 55905 - DNA, 35 bp, Artificial Sequence
  Synthetic oligonucleotide
aactgcggccaacaccacccccacacataccctga

SEQ ID NO: 55906 - DNA, 37 bp, Artificial Sequence
  Synthetic oligonucleotide
tttgacctccgtaccgtgcgtggaaattcctatctga

SEQ ID NO: 55907 - DNA, 38 bp, Artificial Sequence
  Synthetic oligonucleotide
gcgctagcctgttcgttcatcacattgcttctttctga

SEQ ID NO: 55908 - DNA, 38 bp, Artificial Sequence
  Synthetic oligonucleotide
gactacgctggtctcctactatctatcacccatcgtga

SEQ ID NO: 55909 - DNA, 37 bp, Artificial Sequence
  Synthetic oligonucleotide
gacacgtggggaaggatgaagtcattagaagatgtga

SEQ ID NO: 55910 - DNA, 37 bp, Artificial Sequence
  Synthetic oligonucleotide
tcaacacgcacacctcctccgtttaataatccgttga

SEQ ID NO: 55911 - DNA, 37 bp, Artificial Sequence
  Synthetic oligonucleotide
ttcaccgccgcggacaattaggcctccccatttttga

SEQ ID NO: 55912 - DNA, 36 bp, Artificial Sequence
  Synthetic oligonucleotide
tcacaattgtcacatcacgcttatatggcgcccata

SEQ ID NO: 55913 - DNA, 36 bp, Artificial Sequence
  Synthetic oligonucleotide
ttgcgtggcatgggaaaggaggagggaggggttata

SEQ ID NO: 55914 - DNA, 35 bp, Artificial Sequence
  Synthetic oligonucleotide
tcattccattgcacacgatcctagttgacccgcta

SEQ ID NO: 55915 - DNA, 36 bp, Artificial Sequence
  Synthetic oligonucleotide
gccgtctcaggccgcttctaggcacgcattcccgta

SEQ ID NO: 55916 - DNA, 35 bp, Artificial Sequence
  Synthetic oligonucleotide
ttagccatcggccacttctattgaccctttcaaac

SEQ ID NO: 55917 - DNA, 36 bp, Artificial Sequence
  Synthetic oligonucleotide
acccatcccccctctttgtgctgtgctctcgcgaac

SEQ ID NO: 55918 - DNA, 35 bp, Artificial Sequence
  Synthetic oligonucleotide
tctcgctcctatcgtccttccttgacccgattcac

SEQ ID NO: 55919 - DNA, 35 bp, Artificial Sequence
  Synthetic oligonucleotide
gtgagcggaaccggccggaacccttactgatctac

SEQ ID NO: 55920 - DNA, 35 bp, Artificial Sequence
  Synthetic oligonucleotide
tctgtcactccgattcctgtgcgcattagatttac

SEQ ID NO: 55921 - DNA, 35 bp, Artificial Sequence
  Synthetic oligonucleotide
atcagagtccctcgcagcttatatgtccggccgcc

SEQ ID NO: 55922 - DNA, 35 bp, Artificial Sequence
  Synthetic oligonucleotide
ttccccgcacccgttgctatctggttaattgttcc

SEQ ID NO: 55923 - DNA, 35 bp, Artificial Sequence
  Synthetic oligonucleotide
tgccgccgatatggctctagaacccattcccaatc

SEQ ID NO: 55924 - DNA, 35 bp, Artificial Sequence
  Synthetic oligonucleotide
gatctcgccttttacgtcttcgagcctacccagtc

SEQ ID NO: 55925 - DNA, 35 bp, Artificial Sequence
  Synthetic oligonucleotide
gaagtcgagaggaatggagttgcaacaagtgtagg

SEQ ID NO: 55926 - DNA, 35 bp, Artificial Sequence
  Synthetic oligonucleotide
tcaaccagggaaaggtgtaactggtggggcggatg

SEQ ID NO: 55927 - DNA, 35 bp, Artificial Sequence
  Synthetic oligonucleotide
ttgaacagggaggcaacgcactgagggaatggatg

SEQ ID NO: 55928 - DNA, 34 bp, Artificial Sequence
  Synthetic oligonucleotide
gtaccgcacggctcttcggcgacactataaccat

SEQ ID NO: 55929 - DNA, 35 bp, Artificial Sequence
  Synthetic oligonucleotide
gtcgtgtgcactgtcaccgaacgcacttccctcat

SEQ ID NO: 55930 - DNA, 35 bp, Artificial Sequence
  Synthetic oligonucleotide
ttactgtcgccccttgagcttatgcagtcctttat

SEQ ID NO: 55931 - DNA, 35 bp, Artificial Sequence
  Synthetic oligonucleotide
atcgccacccattgtctcgacctcaagcacccagt

SEQ ID NO: 55932 - DNA, 35 bp, Artificial Sequence
  Synthetic oligonucleotide
gctccacccatctcagccgttccttggtcaagtgt

SEQ ID NO: 55933 - DNA, 35 bp, Artificial Sequence
  Synthetic oligonucleotide
gtaactcccgcttgactcgacccgtcatgaccatt

SEQ ID NO: 55934 - DNA, 35 bp, Artificial Sequence
  Synthetic oligonucleotide
atccccaacaggtgctaaccgcttgcaataatatt

SEQ ID NO: 55935 - DNA, 36 bp, Artificial Sequence
  Synthetic oligonucleotide
tgccatcacgttgcttccccgctcatgtttacacaa

SEQ ID NO: 55936 - DNA, 36 bp, Artificial Sequence
  Synthetic oligonucleotide
accatcacgccattatatatactctcgtgtgaccaa

SEQ ID NO: 55937 - DNA, 36 bp, Artificial Sequence
  Synthetic oligonucleotide
tcaacgaagagaaccaacggggagagatggtagcaa

SEQ ID NO: 55938 - DNA, 36 bp, Artificial Sequence
  Synthetic oligonucleotide
tgacgcacccgtcccctccattggtttcttagtgaa

SEQ ID NO: 55939 - DNA, 36 bp, Artificial Sequence
  Synthetic oligonucleotide
acccgtagtaccccccgtctacttccattggagaca

SEQ ID NO: 55940 - DNA, 35 bp, Artificial Sequence
  Synthetic oligonucleotide
atcccacccttgcttggtctcgtgccgtgtacgca

SEQ ID NO: 55941 - DNA, 36 bp, Artificial Sequence
  Synthetic oligonucleotide
gggaaaggtgcaaaaggaaggaagcatgtggaggca

SEQ ID NO: 55942 - DNA, 36 bp, Artificial Sequence
  Synthetic oligonucleotide
gaacagacacacgaagtgatatccactggtgcatca

SEQ ID NO: 55943 - DNA, 36 bp, Artificial Sequence
  Synthetic oligonucleotide
agctgatgcagtgctctagcaacccgtgttctctca

SEQ ID NO: 55944 - DNA, 37 bp, Artificial Sequence
  Synthetic oligonucleotide
ggatgcagcctctcagcccgttctccctgctccaaga

SEQ ID NO: 55945 - DNA, 36 bp, Artificial Sequence
  Synthetic oligonucleotide
agctcacctcggacgcccctaaaactgtcaaacaga

SEQ ID NO: 55946 - DNA, 37 bp, Artificial Sequence
  Synthetic oligonucleotide
ctgacaacgccatttggcaacgcccatccgccccaga

SEQ ID NO: 55947 - DNA, 37 bp, Artificial Sequence
  Synthetic oligonucleotide
tctcacgaccaacacatgtcctttgccctgatccaga

SEQ ID NO: 55948 - DNA, 37 bp, Artificial Sequence
  Synthetic oligonucleotide
ggatggaggcgaagtgggtagtattgtggctgggaga

SEQ ID NO: 55949 - DNA, 36 bp, Artificial Sequence
  Synthetic oligonucleotide
ggaggtgttggggaaagaatggggactgtggtgcga

SEQ ID NO: 55950 - DNA, 37 bp, Artificial Sequence
  Synthetic oligonucleotide
tgtctcctcattgcatccaccgtcgcggaactctcga

SEQ ID NO: 55951 - DNA, 35 bp, Artificial Sequence
  Synthetic oligonucleotide
gtgaccccgcgagagtcgcgttacttctttttcga

SEQ ID NO: 55952 - DNA, 37 bp, Artificial Sequence
  Synthetic oligonucleotide
gagcccagggaaagaagagcatagggaaaaagcggga

SEQ ID NO: 55953 - DNA, 37 bp, Artificial Sequence
  Synthetic oligonucleotide
ggtactggataggggtggggctatggaacacaatgga

SEQ ID NO: 55954 - DNA, 37 bp, Artificial Sequence
  Synthetic oligonucleotide
gtttgcactgcccattatgtctccgtatttgcctgga

SEQ ID NO: 55955 - DNA, 38 bp, Artificial Sequence
  Synthetic oligonucleotide
aatggtggggggggatgggcaggacgcgtcaataatga

SEQ ID NO: 55956 - DNA, 37 bp, Artificial Sequence
  Synthetic oligonucleotide
tactgcaacttacgcctgctcactgtaccgaccatga

SEQ ID NO: 55957 - DNA, 37 bp, Artificial Sequence
  Synthetic oligonucleotide
gagggaaggagcatgaataggggggtcgtgcggatga

SEQ ID NO: 55958 - DNA, 38 bp, Artificial Sequence
  Synthetic oligonucleotide
gacgaagtcaggggatcgattcctggtagacagtatga

SEQ ID NO: 55959 - DNA, 38 bp, Artificial Sequence
  Synthetic oligonucleotide
atcgcctcctcgccctccttcgctcctgggcattatga

SEQ ID NO: 55960 - DNA, 38 bp, Artificial Sequence
  Synthetic oligonucleotide
atcatacgtgcgggggggagggttaagagagggactga

SEQ ID NO: 55961 - DNA, 38 bp, Artificial Sequence
  Synthetic oligonucleotide
accacaccatggggtgtttggccaccctttcatactga

SEQ ID NO: 55962 - DNA, 38 bp, Artificial Sequence
  Synthetic oligonucleotide
gcacagacaaaatcgtgctacccgtcctggccacctga

SEQ ID NO: 55963 - DNA, 37 bp, Artificial Sequence
  Synthetic oligonucleotide
gcatgctgcccacgcgatcagacctttttcacgctga

SEQ ID NO: 55964 - DNA, 38 bp, Artificial Sequence
  Synthetic oligonucleotide
gaggggcaaacgacatggggggtggcatgggacgctga

SEQ ID NO: 55965 - DNA, 38 bp, Artificial Sequence
  Synthetic oligonucleotide
gcccaccattcctggttcaggttgccaacctttgctga

SEQ ID NO: 55966 - DNA, 38 bp, Artificial Sequence
  Synthetic oligonucleotide
tccaacctacatagccgttaatatccgttcctccgtga

SEQ ID NO: 55967 - DNA, 38 bp, Artificial Sequence
  Synthetic oligonucleotide
ttccgtcctcatctcgctgctgaatcctcctgtcgtga

SEQ ID NO: 55968 - DNA, 38 bp, Artificial Sequence
  Synthetic oligonucleotide
atcgttgcgggggaaggtagcaaggcgcggaagggtga

SEQ ID NO: 55969 - DNA, 37 bp, Artificial Sequence
  Synthetic oligonucleotide
gcgcaaggtgggaaggggggctcgagtggatctgtga

SEQ ID NO: 55970 - DNA, 37 bp, Artificial Sequence
  Synthetic oligonucleotide
ttcccccgccgtcatccgtctatcgacgcgcaattga

SEQ ID NO: 55971 - DNA, 38 bp, Artificial Sequence
  Synthetic oligonucleotide
ttacgcccccacttgcatcggcctgtccgtaaacttga

SEQ ID NO: 55972 - DNA, 38 bp, Artificial Sequence
  Synthetic oligonucleotide
gcttgctcaggtgggcgttatttcgtttcctcacttga

SEQ ID NO: 55973 - DNA, 37 bp, Artificial Sequence
  Synthetic oligonucleotide
tagtcgcccggtccctcccattgtacacccaccttga

SEQ ID NO: 55974 - DNA, 37 bp, Artificial Sequence
  Synthetic oligonucleotide
ggatcaagggaggcatggggaacgaaaatgaagttga

SEQ ID NO: 55975 - DNA, 38 bp, Artificial Sequence
  Synthetic oligonucleotide
agcctaccacgcattgtagttgcgatcctattttttga

SEQ ID NO: 55976 - DNA, 35 bp, Artificial Sequence
  Synthetic oligonucleotide
gatgactccgcacaaactgatagaccgtcctccta

SEQ ID NO: 55977 - DNA, 36 bp, Artificial Sequence
  Synthetic oligonucleotide
attggccaccctcgaatgcgcttccaacccatctta

SEQ ID NO: 55978 - DNA, 35 bp, Artificial Sequence
  Synthetic oligonucleotide
aactacccattaggcatcaatactgcatctcgtta

SEQ ID NO: 55979 - DNA, 35 bp, Artificial Sequence
  Synthetic oligonucleotide
attcgaccgccacacattttcccacatagctgtac

SEQ ID NO: 55980 - DNA, 35 bp, Artificial Sequence
  Synthetic oligonucleotide
acccgctgcctgtgcccgtagtgcgctacaattac

SEQ ID NO: 55981 - DNA, 35 bp, Artificial Sequence
  Synthetic oligonucleotide
gtccaccaatctcaaacttgtttaagggtagaacc

SEQ ID NO: 55982 - DNA, 35 bp, Artificial Sequence
  Synthetic oligonucleotide
gaacggagcggacaagcagtactaactatcgcccc

SEQ ID NO: 55983 - DNA, 35 bp, Artificial Sequence
  Synthetic oligonucleotide
gtgaccagaacttctcgtcttacccgttacttgcc

SEQ ID NO: 55984 - DNA, 35 bp, Artificial Sequence
  Synthetic oligonucleotide
gtgaaaccgatgttgcgtacattttttggcgttcc

SEQ ID NO: 55985 - DNA, 35 bp, Artificial Sequence
  Synthetic oligonucleotide
gacccctgtactgcatctcgattctcgcgcaaatc

SEQ ID NO: 55986 - DNA, 35 bp, Artificial Sequence
  Synthetic oligonucleotide
tctccgcccttcatggtttttctgcggctcccctc

SEQ ID NO: 55987 - DNA, 35 bp, Artificial Sequence
  Synthetic oligonucleotide
gctggcacatcccaggtactatttcgctgggcctc

SEQ ID NO: 55988 - DNA, 35 bp, Artificial Sequence
  Synthetic oligonucleotide
agtacggggcctagtccggtcctcacaacgctctc

SEQ ID NO: 55989 - DNA, 35 bp, Artificial Sequence
  Synthetic oligonucleotide
gtgtgtggtagcctctgtcgcttgtactcgtggtc

SEQ ID NO: 55990 - DNA, 35 bp, Artificial Sequence
  Synthetic oligonucleotide
acgtggctacgcatggtcttctcgacccgtacttc

SEQ ID NO: 55991 - DNA, 35 bp, Artificial Sequence
  Synthetic oligonucleotide
gcaaggagacactagctatgtaactgttccctttc

SEQ ID NO: 55992 - DNA, 35 bp, Artificial Sequence
  Synthetic oligonucleotide
gtcacgcactacgcgaacaaattacctcccgatag

SEQ ID NO: 55993 - DNA, 35 bp, Artificial Sequence
  Synthetic oligonucleotide
gtagtgagggagcatagggagcgggcattcacacg

SEQ ID NO: 55994 - DNA, 35 bp, Artificial Sequence
  Synthetic oligonucleotide
acgcgtcctaccattatttgcctccatctggtccg

SEQ ID NO: 55995 - DNA, 35 bp, Artificial Sequence
  Synthetic oligonucleotide
tcacgcgtattggtcgtcgccgccttttttaatcg

SEQ ID NO: 55996 - DNA, 35 bp, Artificial Sequence
  Synthetic oligonucleotide
acacgcggtctaaattcactgcacgatgtttctcg

SEQ ID NO: 55997 - DNA, 35 bp, Artificial Sequence
  Synthetic oligonucleotide
gtgtgagcagaggagaagtaaggcgtaggattcgg

SEQ ID NO: 55998 - DNA, 35 bp, Artificial Sequence
  Synthetic oligonucleotide
gcactcctaatccccatgaccgatcgccgttccat

SEQ ID NO: 55999 - DNA, 35 bp, Artificial Sequence
  Synthetic oligonucleotide
gtaagtcgccccccgcctatggttactttatcgat

SEQ ID NO: 56000 - DNA, 35 bp, Artificial Sequence
  Synthetic oligonucleotide
gactgacccatttgtgacgaacccttccttaaact

SEQ ID NO: 56001 - DNA, 35 bp, Artificial Sequence
  Synthetic oligonucleotide
taactggcccgcgtacgcatagccaagtcacacct

SEQ ID NO: 56002 - DNA, 35 bp, Artificial Sequence
  Synthetic oligonucleotide
gggagtgggggaaaggggcggacaatatggaggct

SEQ ID NO: 56003 - DNA, 35 bp, Artificial Sequence
  Synthetic oligonucleotide
tgtgaccgcttaccgtaaattttgtgccttcatct

SEQ ID NO: 56004 - DNA, 35 bp, Artificial Sequence
  Synthetic oligonucleotide
aacgaacgtgggtgtggggggtttctcgttagtct

SEQ ID NO: 56005 - DNA, 35 bp, Artificial Sequence
  Synthetic oligonucleotide
tacgcaaggtggtggagttaggtgttttgcccagt

SEQ ID NO: 56006 - DNA, 35 bp, Artificial Sequence
  Synthetic oligonucleotide
tgcccacattccccaccacactctggtcgcaacgt

SEQ ID NO: 56007 - DNA, 35 bp, Artificial Sequence
  Synthetic oligonucleotide
attgcacttcgcgtcccacagctttttttcaacgt

SEQ ID NO: 56008 - DNA, 35 bp, Artificial Sequence
  Synthetic oligonucleotide
tccactgcctcatccagctgcctcacgaatttcgt

SEQ ID NO: 56009 - DNA, 35 bp, Artificial Sequence
  Synthetic oligonucleotide
ggaggggtatgagtggaggtatagaaggggttggt

SEQ ID NO: 56010 - DNA, 35 bp, Artificial Sequence
  Synthetic oligonucleotide
gctgaccaacgcttgctgacaattcttgacaaatt

SEQ ID NO: 56011 - DNA, 35 bp, Artificial Sequence
  Synthetic oligonucleotide
tcgtccgataagattcgtcacaccgacctcgcttt

SEQ ID NO: 56012 - DNA, 35 bp, Artificial Sequence
  Synthetic oligonucleotide
ttcgtcccgccgggaatcttatcgctggttatttt

SEQ ID NO: 56013 - DNA, 35 bp, Artificial Sequence
  Synthetic oligonucleotide
gagctgccggctcgactgacctgccgattccccaa

SEQ ID NO: 56014 - DNA, 36 bp, Artificial Sequence
  Synthetic oligonucleotide
gttaagagggcgagggggaagtccaagatagggcaa

SEQ ID NO: 56015 - DNA, 36 bp, Artificial Sequence
  Synthetic oligonucleotide
accagcaacatcctgttgttcgatcatctctccgaa

SEQ ID NO: 56016 - DNA, 36 bp, Artificial Sequence
  Synthetic oligonucleotide
tctacgccctcgcactacatcttccagttttggtaa

SEQ ID NO: 56017 - DNA, 36 bp, Artificial Sequence
  Synthetic oligonucleotide
tgccacgtgcacctctgcttgggaccaggtccttaa

SEQ ID NO: 56018 - DNA, 35 bp, Artificial Sequence
  Synthetic oligonucleotide
gctccggagctgcttctgcgttcctgtcctacaca

SEQ ID NO: 56019 - DNA, 36 bp, Artificial Sequence
  Synthetic oligonucleotide
gggccacctggtctttacttgtccttcgattccaca

SEQ ID NO: 56020 - DNA, 36 bp, Artificial Sequence
  Synthetic oligonucleotide
tagacacccatcaatgccgatcgcgaactcttccca

SEQ ID NO: 56021 - DNA, 35 bp, Artificial Sequence
  Synthetic oligonucleotide
acatcctcactcaatcgcataccaggcactaggca

SEQ ID NO: 56022 - DNA, 36 bp, Artificial Sequence
  Synthetic oligonucleotide
ggaaccggcgcaggtcactgtcccgcttgactctca

SEQ ID NO: 56023 - DNA, 37 bp, Artificial Sequence
  Synthetic oligonucleotide
tatccacctcaacatattgaccctacagtagaaacga

SEQ ID NO: 56024 - DNA, 35 bp, Artificial Sequence
  Synthetic oligonucleotide
gccacaccaatacagtagaccctggtatacaccga

SEQ ID NO: 56025 - DNA, 37 bp, Artificial Sequence
  Synthetic oligonucleotide
aagtcactcccacctccgcacaacgggctccacccga

SEQ ID NO: 56026 - DNA, 35 bp, Artificial Sequence
  Synthetic oligonucleotide
tattggggccccgttctcagcttgtctcttcccga

SEQ ID NO: 56027 - DNA, 37 bp, Artificial Sequence
  Synthetic oligonucleotide
ttgccaaggtcaatgtcacctatgcccgctcatccga

SEQ ID NO: 56028 - DNA, 37 bp, Artificial Sequence
  Synthetic oligonucleotide
aaaccacatcacaactgttacctgcaccagttctcga

SEQ ID NO: 56029 - DNA, 37 bp, Artificial Sequence
  Synthetic oligonucleotide
tgcaaaaagggctgaaagggaggagacggccagtcga

SEQ ID NO: 56030 - DNA, 37 bp, Artificial Sequence
  Synthetic oligonucleotide
ggagtggaggtaaaactaggcagggtggtaacgtcga

SEQ ID NO: 56031 - DNA, 37 bp, Artificial Sequence
  Synthetic oligonucleotide
aactcgacgggatgggtgagggtgatgccgttaggga

SEQ ID NO: 56032 - DNA, 36 bp, Artificial Sequence
  Synthetic oligonucleotide
acctcccccatccggatatgccggactctccttgga

SEQ ID NO: 56033 - DNA, 37 bp, Artificial Sequence
  Synthetic oligonucleotide
gtgtaggggcgcagtcggttggtaagagggtgttgga

SEQ ID NO: 56034 - DNA, 37 bp, Artificial Sequence
  Synthetic oligonucleotide
tagggtgcagcagggcaaaggcggggaagtggaatga

SEQ ID NO: 56035 - DNA, 36 bp, Artificial Sequence
  Synthetic oligonucleotide
ggacacgctatcctactgcctccaatctatgaatga

SEQ ID NO: 56036 - DNA, 38 bp, Artificial Sequence
  Synthetic oligonucleotide
gacaagcttagtgttgagggggtgctggggcaggatga

SEQ ID NO: 56037 - DNA, 38 bp, Artificial Sequence
  Synthetic oligonucleotide
gtcccctcccgactgtccgcactcccttcatatgatga

SEQ ID NO: 56038 - DNA, 38 bp, Artificial Sequence
  Synthetic oligonucleotide
gcgctaccccatttgcttgttaccccacccgccactga

SEQ ID NO: 56039 - DNA, 37 bp, Artificial Sequence
  Synthetic oligonucleotide
tgccaccgccccaacttctgaagctaggcatccctga

SEQ ID NO: 56040 - DNA, 38 bp, Artificial Sequence
  Synthetic oligonucleotide
tgcacatgccatgacttcccctggttcctcgtacgtga

SEQ ID NO: 56041 - DNA, 37 bp, Artificial Sequence
  Synthetic oligonucleotide
tgagctcaagactatcccccccactccgctctcgtga

SEQ ID NO: 56042 - DNA, 37 bp, Artificial Sequence
  Synthetic oligonucleotide
aaggagggcagggttgatcaaaagcttgagtgggtga

SEQ ID NO: 56043 - DNA, 38 bp, Artificial Sequence
  Synthetic oligonucleotide
gatcgtcgaagtggatctagtggggggcggggtggtga

SEQ ID NO: 56044 - DNA, 38 bp, Artificial Sequence
  Synthetic oligonucleotide
aacaccatctgtcgtgtacgcttcattcggtttggtga

SEQ ID NO: 56045 - DNA, 36 bp, Artificial Sequence
  Synthetic oligonucleotide
gctagcacggagcactcaagggtgggtgggggcata

SEQ ID NO: 56046 - DNA, 36 bp, Artificial Sequence
  Synthetic oligonucleotide
tgagtcaggtgagggggttggcaatagtaggtcata

SEQ ID NO: 56047 - DNA, 35 bp, Artificial Sequence
  Synthetic oligonucleotide
atccccttgcctactccaatagtgaattgttacta

SEQ ID NO: 56048 - DNA, 37 bp, Artificial Sequence
  Synthetic oligonucleotide
tcccacctccgctgtcgtaccgctggcctttactcta

SEQ ID NO: 56049 - DNA, 35 bp, Artificial Sequence
  Synthetic oligonucleotide
agcatccctgacatatccaatccacttgctcacac

SEQ ID NO: 56050 - DNA, 35 bp, Artificial Sequence
  Synthetic oligonucleotide
tcgaaccgtatacatgcaattgacactctcccgac

SEQ ID NO: 56051 - DNA, 35 bp, Artificial Sequence
  Synthetic oligonucleotide
acgattcccgtgccgaatcacattcagccatttac

SEQ ID NO: 56052 - DNA, 35 bp, Artificial Sequence
  Synthetic oligonucleotide
gtcatccacttggtgaatatcgcttgtctcggacc

SEQ ID NO: 56053 - DNA, 35 bp, Artificial Sequence
  Synthetic oligonucleotide
gtcaggtcccgctatctctagggaatgtcaccccc

SEQ ID NO: 56054 - DNA, 35 bp, Artificial Sequence
  Synthetic oligonucleotide
tctcagctgccaatcccggcccaccggcctccccc

SEQ ID NO: 56055 - DNA, 35 bp, Artificial Sequence
  Synthetic oligonucleotide
tccatgcacaggccaacttcttaatgctttatcgc

SEQ ID NO: 56056 - DNA, 35 bp, Artificial Sequence
  Synthetic oligonucleotide
gaagaggggaggtacacggaaggagaaatcagtgc

SEQ ID NO: 56057 - DNA, 35 bp, Artificial Sequence
  Synthetic oligonucleotide
tcctgtacgacgcacgaactacatccacaaggtgc

SEQ ID NO: 56058 - DNA, 35 bp, Artificial Sequence
  Synthetic oligonucleotide
tacgtcggtatcccctccaacctttctggaacctc

SEQ ID NO: 56059 - DNA, 35 bp, Artificial Sequence
  Synthetic oligonucleotide
aatgtgtccgcctgttacatccccgttcacgcctc

SEQ ID NO: 56060 - DNA, 35 bp, Artificial Sequence
  Synthetic oligonucleotide
attccccgctatcctagttatagcgccgcttcctc

SEQ ID NO: 56061 - DNA, 35 bp, Artificial Sequence
  Synthetic oligonucleotide
tgtccacaccgccgctccggatctgccttaatctc

SEQ ID NO: 56062 - DNA, 35 bp, Artificial Sequence
  Synthetic oligonucleotide
gtgggtgggatgggaggtgtcatgggttttgtctc

SEQ ID NO: 56063 - DNA, 35 bp, Artificial Sequence
  Synthetic oligonucleotide
gtacgtatgaaccggcacggaccgacctttgcttc

SEQ ID NO: 56064 - DNA, 35 bp, Artificial Sequence
  Synthetic oligonucleotide
acgaccggcaaactcagctactagccttgcctttc

SEQ ID NO: 56065 - DNA, 35 bp, Artificial Sequence
  Synthetic oligonucleotide
aaccaacacccgttcacattccccacgcacccgcg

SEQ ID NO: 56066 - DNA, 35 bp, Artificial Sequence
  Synthetic oligonucleotide
tcgggcctcacactcatcgaacatcaaattcactg

SEQ ID NO: 56067 - DNA, 35 bp, Artificial Sequence
  Synthetic oligonucleotide
aacgcaggattgaatcggtgatggggtagatgctg

SEQ ID NO: 56068 - DNA, 35 bp, Artificial Sequence
  Synthetic oligonucleotide
gacaggggtagggcatcctggaaggggagatcgtg

SEQ ID NO: 56069 - DNA, 35 bp, Artificial Sequence
  Synthetic oligonucleotide
gtgccccatagttgtgatcacttaacatgtcccat

SEQ ID NO: 56070 - DNA, 35 bp, Artificial Sequence
  Synthetic oligonucleotide
tccgaccgtacgtcagcctcgaactactaactgat

SEQ ID NO: 56071 - DNA, 35 bp, Artificial Sequence
  Synthetic oligonucleotide
tacctgcacacaacactatggtgcgtttacctctt

SEQ ID NO: 56072 - DNA, 35 bp, Artificial Sequence
  Synthetic oligonucleotide
tcatggggggtcgccactggtacccaggaacattt

SEQ ID NO: 56073 - DNA, 35 bp, Artificial Sequence
  Synthetic oligonucleotide
atcgcgaccgcagggctcctctgcttcatcgcttt

SEQ ID NO: 56074 - DNA, 35 bp, Artificial Sequence
  Synthetic oligonucleotide
tgcaaacggggagtcgctgataggcacggtgcaaa

SEQ ID NO: 56075 - DNA, 35 bp, Artificial Sequence
  Synthetic oligonucleotide
gccacgtcaacctattcatcgtggccccgatccaa

SEQ ID NO: 56076 - DNA, 36 bp, Artificial Sequence
  Synthetic oligonucleotide
gtggggagagaagcgtgaaggacgagtaagggagaa

SEQ ID NO: 56077 - DNA, 36 bp, Artificial Sequence
  Synthetic oligonucleotide
agctcccaaccgatctgcctctttacggtcccttaa

SEQ ID NO: 56078 - DNA, 35 bp, Artificial Sequence
  Synthetic oligonucleotide
gagctcccgctttgccatcaggcacatctccttaa

SEQ ID NO: 56079 - DNA, 36 bp, Artificial Sequence
  Synthetic oligonucleotide
accaccatctcgaagtctggccagggtgcctgttaa

SEQ ID NO: 56080 - DNA, 36 bp, Artificial Sequence
  Synthetic oligonucleotide
actccaccagactccggctacacttgaaacatcaca

SEQ ID NO: 56081 - DNA, 36 bp, Artificial Sequence
  Synthetic oligonucleotide
accccctagcctcagggcccattttgaattcttaca

SEQ ID NO: 56082 - DNA, 35 bp, Artificial Sequence
  Synthetic oligonucleotide
acttgcctcctacgacacaccttgcgattgatcca

SEQ ID NO: 56083 - DNA, 35 bp, Artificial Sequence
  Synthetic oligonucleotide
tccacctgcctcacccggacacatactcgcccgca

SEQ ID NO: 56084 - DNA, 36 bp, Artificial Sequence
  Synthetic oligonucleotide
gatgacgcctcgcctcgctagcatttggacccaaga

SEQ ID NO: 56085 - DNA, 37 bp, Artificial Sequence
  Synthetic oligonucleotide
gtgtgttctccttgcatcaccgtcctttacaccacga

SEQ ID NO: 56086 - DNA, 37 bp, Artificial Sequence
  Synthetic oligonucleotide
ggaggaggaggaaacgacggaaaacggttcagagcga

SEQ ID NO: 56087 - DNA, 36 bp, Artificial Sequence
  Synthetic oligonucleotide
tccccattcatcatttcctgtgcctttgtccctcga

SEQ ID NO: 56088 - DNA, 37 bp, Artificial Sequence
  Synthetic oligonucleotide
gccagggagggggaggatggggcgcgtaattcctcga

SEQ ID NO: 56089 - DNA, 37 bp, Artificial Sequence
  Synthetic oligonucleotide
tgtatgtcgtctctacactccccgggtttttcctcga

SEQ ID NO: 56090 - DNA, 37 bp, Artificial Sequence
  Synthetic oligonucleotide
gcatagtgggaggtggagcaaaatgcggcttcaggga

SEQ ID NO: 56091 - DNA, 36 bp, Artificial Sequence
  Synthetic oligonucleotide
gcgaacgcaccgcgggggaatcaaattagtgtggga

SEQ ID NO: 56092 - DNA, 37 bp, Artificial Sequence
  Synthetic oligonucleotide
acatccacccgaacaggttataccgacaagccttgga

SEQ ID NO: 56093 - DNA, 37 bp, Artificial Sequence
  Synthetic oligonucleotide
gacatagcggttgcgggatccgggggcgggatttgga

SEQ ID NO: 56094 - DNA, 38 bp, Artificial Sequence
  Synthetic oligonucleotide
atcaaccccctgtccgtggcaccacccgactcaaatga

SEQ ID NO: 56095 - DNA, 38 bp, Artificial Sequence
  Synthetic oligonucleotide
gatcgcctccaactggactcctcactgactgataatga

SEQ ID NO: 56096 - DNA, 38 bp, Artificial Sequence
  Synthetic oligonucleotide
tgctacacgccacatttcttaatttgaaacttccatga

SEQ ID NO: 56097 - DNA, 37 bp, Artificial Sequence
  Synthetic oligonucleotide
ttccacaacctcgctccctgttcccgtcccagcctga

SEQ ID NO: 56098 - DNA, 38 bp, Artificial Sequence
  Synthetic oligonucleotide
tctcgcctgattttggatgtgccgctggccatgcctga

SEQ ID NO: 56099 - DNA, 38 bp, Artificial Sequence
  Synthetic oligonucleotide
tagtacgttccccctgtgcagcatccagcatcatctga

SEQ ID NO: 56100 - DNA, 38 bp, Artificial Sequence
  Synthetic oligonucleotide
gatgtctgtcacccctctttgttaagcaccgtacgtga

SEQ ID NO: 56101 - DNA, 37 bp, Artificial Sequence
  Synthetic oligonucleotide
gcacgaaagtgggaaatggagatgggttgcaaggtga

SEQ ID NO: 56102 - DNA, 38 bp, Artificial Sequence
  Synthetic oligonucleotide
ataatgggtgaggacggaagagaacgaggggatggtga

SEQ ID NO: 56103 - DNA, 37 bp, Artificial Sequence
  Synthetic oligonucleotide
gtgtccgggtcctcccgacgctcttatgccaccttga

SEQ ID NO: 56104 - DNA, 38 bp, Artificial Sequence
  Synthetic oligonucleotide
accgtctggccggatacatctccctcgcacagccttga

SEQ ID NO: 56105 - DNA, 38 bp, Artificial Sequence
  Synthetic oligonucleotide
acgcatgagtgggggaatagagtaagaaaaagtgttga

SEQ ID NO: 56106 - DNA, 37 bp, Artificial Sequence
  Synthetic oligonucleotide
gagacgctgccttggttctgacctatccgatctttga

SEQ ID NO: 56107 - DNA, 38 bp, Artificial Sequence
  Synthetic oligonucleotide
gccaccatgggcgaataaacatgccacccctcttttga

SEQ ID NO: 56108 - DNA, 35 bp, Artificial Sequence
  Synthetic oligonucleotide
gacactcacgtgggttctgctccgtatccatccta

SEQ ID NO: 56109 - DNA, 36 bp, Artificial Sequence
  Synthetic oligonucleotide
tatgcattccctcgcagcatgcgatcactactgcta

SEQ ID NO: 56110 - DNA, 36 bp, Artificial Sequence
  Synthetic oligonucleotide
acaacctgcgtgcactactcgtctatctggttatta

SEQ ID NO: 56111 - DNA, 36 bp, Artificial Sequence
  Synthetic oligonucleotide
tgccctgtgacaccggttctcttgtgttccccctta

SEQ ID NO: 56112 - DNA, 35 bp, Artificial Sequence
  Synthetic oligonucleotide
ggcgacgcaatctacgtgcttgtccctgtccaaac

SEQ ID NO: 56113 - DNA, 35 bp, Artificial Sequence
  Synthetic oligonucleotide
ccctatcgcaccaccgcattgtacgcactggccac

SEQ ID NO: 56114 - DNA, 35 bp, Artificial Sequence
  Synthetic oligonucleotide
gtgacaccccgccgtcaaggccaatccatcaatac

SEQ ID NO: 56115 - DNA, 35 bp, Artificial Sequence
  Synthetic oligonucleotide
ttgatttgccccggaggttatggcccacctacacc

SEQ ID NO: 56116 - DNA, 35 bp, Artificial Sequence
  Synthetic oligonucleotide
agaccgcctgaagtaaaaatattcgcgcaccaccc

SEQ ID NO: 56117 - DNA, 35 bp, Artificial Sequence
  Synthetic oligonucleotide
aaagcccagtcccacctataaagtccgcgtcgccc

SEQ ID NO: 56118 - DNA, 35 bp, Artificial Sequence
  Synthetic oligonucleotide
ggagacgcctttgaccaaacaaccacctttacgcc

SEQ ID NO: 56119 - DNA, 35 bp, Artificial Sequence
  Synthetic oligonucleotide
ttggtcggtccaatattttcacttgcacaggctcc

SEQ ID NO: 56120 - DNA, 35 bp, Artificial Sequence
  Synthetic oligonucleotide
agtcttggcgtactagcgcgaatcctgttccttcc

SEQ ID NO: 56121 - DNA, 35 bp, Artificial Sequence
  Synthetic oligonucleotide
acaaggtggagcaatcgtcgacccccgccctttcc

SEQ ID NO: 56122 - DNA, 35 bp, Artificial Sequence
  Synthetic oligonucleotide
tcgcttcccctatacgtggcctctcctgctggtgc

SEQ ID NO: 56123 - DNA, 35 bp, Artificial Sequence
  Synthetic oligonucleotide
gtcacggaggcatatacttgctgggccgtttcttc

SEQ ID NO: 56124 - DNA, 36 bp, Artificial Sequence
  Synthetic oligonucleotide
acgtaacccagccgccacaaggcttcataccaaacg

SEQ ID NO: 56125 - DNA, 35 bp, Artificial Sequence
  Synthetic oligonucleotide
gaccgacgcatattgataacgcgcccagagccctg

SEQ ID NO: 56126 - DNA, 35 bp, Artificial Sequence
  Synthetic oligonucleotide
tcagccgcgctgcaccccgacctttatccctattg

SEQ ID NO: 56127 - DNA, 35 bp, Artificial Sequence
  Synthetic oligonucleotide
ttgactcctcctcccgttggaaagacgaccttgat

SEQ ID NO: 56128 - DNA, 35 bp, Artificial Sequence
  Synthetic oligonucleotide
acgacccacacccttttctccattttgttgcgact

SEQ ID NO: 56129 - DNA, 35 bp, Artificial Sequence
  Synthetic oligonucleotide
tccgctgatacattctttgacgccttctcacgcct

SEQ ID NO: 56130 - DNA, 35 bp, Artificial Sequence
  Synthetic oligonucleotide
agtaacatcctcatggcaccgtcacctgctacgct

SEQ ID NO: 56131 - DNA, 33 bp, Artificial Sequence
  Synthetic oligonucleotide
ccacccaccggttttactgcgcgctccgccgct

SEQ ID NO: 56132 - DNA, 35 bp, Artificial Sequence
  Synthetic oligonucleotide
taccaccactgcagggcaaaggctcttccagctct

SEQ ID NO: 56133 - DNA, 35 bp, Artificial Sequence
  Synthetic oligonucleotide
tcccgatggtcacttgtctactaattccattgtct

SEQ ID NO: 56134 - DNA, 35 bp, Artificial Sequence
  Synthetic oligonucleotide
atccggggggaggtaggggtggagcgtaacacggt

SEQ ID NO: 56135 - DNA, 34 bp, Artificial Sequence
  Synthetic oligonucleotide
ggacgtcgccgaactctctcaaattactctctgt

SEQ ID NO: 56136 - DNA, 35 bp, Artificial Sequence
  Synthetic oligonucleotide
ttaccaccccgggccggagcctctcggacacactt

SEQ ID NO: 56137 - DNA, 36 bp, Artificial Sequence
  Synthetic oligonucleotide
acgcgtaagccccctcagacgcatgcttggtcactt

SEQ ID NO: 56138 - DNA, 35 bp, Artificial Sequence
  Synthetic oligonucleotide
ttttgcccccatgtgtcgccgcgccgtcttcacaa

SEQ ID NO: 56139 - DNA, 36 bp, Artificial Sequence
  Synthetic oligonucleotide
gatcacattacccgctacgccagcaacattgctgaa

SEQ ID NO: 56140 - DNA, 35 bp, Artificial Sequence
  Synthetic oligonucleotide
gaagggggttgtgggacggtgcgtaatggggtgaa

SEQ ID NO: 56141 - DNA, 35 bp, Artificial Sequence
  Synthetic oligonucleotide
gcccgcacaccgaatgacgcgttatgacgctcgca

SEQ ID NO: 56142 - DNA, 35 bp, Artificial Sequence
  Synthetic oligonucleotide
aactgtcccccagcccactccagacgaactcgaga

SEQ ID NO: 56143 - DNA, 37 bp, Artificial Sequence
  Synthetic oligonucleotide
acgaacactctgccggaattaccccagctcggaccga

SEQ ID NO: 56144 - DNA, 37 bp, Artificial Sequence
  Synthetic oligonucleotide
tgccgcagcctgacgatcctgcactacgttttcccga

SEQ ID NO: 56145 - DNA, 36 bp, Artificial Sequence
  Synthetic oligonucleotide
ttcaccgataccacatagctctacccagacgcgcga

SEQ ID NO: 56146 - DNA, 37 bp, Artificial Sequence
  Synthetic oligonucleotide
gcaaccgctgtgctctcccaagatctagctatttcga

SEQ ID NO: 56147 - DNA, 36 bp, Artificial Sequence
  Synthetic oligonucleotide
tcgccaaccacaacaaccccgtcgcctatgcgagga

SEQ ID NO: 56148 - DNA, 37 bp, Artificial Sequence
  Synthetic oligonucleotide
tcacatgtccctcctacgagtaccacaccgccacgga

SEQ ID NO: 56149 - DNA, 36 bp, Artificial Sequence
  Synthetic oligonucleotide
gtacaccaccctttgcctaacttccgtcgttttgga

SEQ ID NO: 56150 - DNA, 37 bp, Artificial Sequence
  Synthetic oligonucleotide
tagcctcagggcggacgggggtgtaggtggtgaatga

SEQ ID NO: 56151 - DNA, 38 bp, Artificial Sequence
  Synthetic oligonucleotide
tgctacgcttttgcccactctcgtccgccatctaatga

SEQ ID NO: 56152 - DNA, 37 bp, Artificial Sequence
  Synthetic oligonucleotide
gcagggccgggcccatccgggagggtagaacacatga

SEQ ID NO: 56153 - DNA, 38 bp, Artificial Sequence
  Synthetic oligonucleotide
ttaccctcccccccagcttcagcggaatcctgccatga

SEQ ID NO: 56154 - DNA, 36 bp, Artificial Sequence
  Synthetic oligonucleotide
accaccacgttggtttcacgtttatcctcaatatga

SEQ ID NO: 56155 - DNA, 38 bp, Artificial Sequence
  Synthetic oligonucleotide
atagcgacacaatcgcttctaatacacctagtacctga

SEQ ID NO: 56156 - DNA, 38 bp, Artificial Sequence
  Synthetic oligonucleotide
tctccgctcaaccgctctgcgataatcaacgcccctga

SEQ ID NO: 56157 - DNA, 38 bp, Artificial Sequence
  Synthetic oligonucleotide
atgcaatccatacctaataccccgcgcgttcctgctga

SEQ ID NO: 56158 - DNA, 38 bp, Artificial Sequence
  Synthetic oligonucleotide
aacgaaccctcgtacgtcccccttacagtccttgctga

SEQ ID NO: 56159 - DNA, 38 bp, Artificial Sequence
  Synthetic oligonucleotide
tagaaagcggagcgcgataaggaatgggcggggggtga

SEQ ID NO: 56160 - DNA, 38 bp, Artificial Sequence
  Synthetic oligonucleotide
gcatacgagaggaagcattggaagggtgcatgttgtga

SEQ ID NO: 56161 - DNA, 38 bp, Artificial Sequence
  Synthetic oligonucleotide
gatgcccgacgcatggatccatacccctaacagcttga

SEQ ID NO: 56162 - DNA, 38 bp, Artificial Sequence
  Synthetic oligonucleotide
gaggggcggaccctgttttgtttgcctggccatcttga

SEQ ID NO: 56163 - DNA, 35 bp, Artificial Sequence
  Synthetic oligonucleotide
taacgcccctccggtttcatgttattcctgttata

SEQ ID NO: 56164 - DNA, 36 bp, Artificial Sequence
  Synthetic oligonucleotide
tcccaggacattgtctgccttcgcggctttcgccta

SEQ ID NO: 56165 - DNA, 35 bp, Artificial Sequence
  Synthetic oligonucleotide
aagcaccgtatcaccttcaatgctggtctcgtcta

SEQ ID NO: 56166 - DNA, 35 bp, Artificial Sequence
  Synthetic oligonucleotide
gatgtcccccacttacgctctagttgtacggttac

SEQ ID NO: 56167 - DNA, 35 bp, Artificial Sequence
  Synthetic oligonucleotide
acacaagccccctttaaggcggtcgaaccttgacc

SEQ ID NO: 56168 - DNA, 35 bp, Artificial Sequence
  Synthetic oligonucleotide
gtccgtatgcacatacatggcttcctcccgtaccc

SEQ ID NO: 56169 - DNA, 35 bp, Artificial Sequence
  Synthetic oligonucleotide
gtggactcgctttgtttgctgactcctgacgtccc

SEQ ID NO: 56170 - DNA, 35 bp, Artificial Sequence
  Synthetic oligonucleotide
tctaccattccctaacgtatctccggacagtccgc

SEQ ID NO: 56171 - DNA, 35 bp, Artificial Sequence
  Synthetic oligonucleotide
acgctgaatccctgtacctgcatataaaattcatc

SEQ ID NO: 56172 - DNA, 35 bp, Artificial Sequence
  Synthetic oligonucleotide
acctccccttgcgcatccgtcaataccgattcatc

SEQ ID NO: 56173 - DNA, 35 bp, Artificial Sequence
  Synthetic oligonucleotide
acaaccgcgcttttcggcttccgtgcttgtcactc

SEQ ID NO: 56174 - DNA, 35 bp, Artificial Sequence
  Synthetic oligonucleotide
gaacaagacgtacccattggcaccttgcaactctc

SEQ ID NO: 56175 - DNA, 35 bp, Artificial Sequence
  Synthetic oligonucleotide
agcttggtcgcatgggatctgccgcacccaccttc

SEQ ID NO: 56176 - DNA, 35 bp, Artificial Sequence
  Synthetic oligonucleotide
ttcccgtaaggcctaagtatatttccatcgttcgg

SEQ ID NO: 56177 - DNA, 35 bp, Artificial Sequence
  Synthetic oligonucleotide
gtgagcggaaatggcatgtcattggatagttgggg

SEQ ID NO: 56178 - DNA, 35 bp, Artificial Sequence
  Synthetic oligonucleotide
gcaccacgtgtgttcccattcttcttgctgtgtgg

SEQ ID NO: 56179 - DNA, 35 bp, Artificial Sequence
  Synthetic oligonucleotide
tattggccccaaattgtgtttatttattctccctg

SEQ ID NO: 56180 - DNA, 35 bp, Artificial Sequence
  Synthetic oligonucleotide
acccaagaactccttatcccctgtttagtgcctat

SEQ ID NO: 56181 - DNA, 35 bp, Artificial Sequence
  Synthetic oligonucleotide
ttgcatgcgaatcaaattcattgcgggccacacct

SEQ ID NO: 56182 - DNA, 35 bp, Artificial Sequence
  Synthetic oligonucleotide
tccgacgaagcgccaaataaaccctactcgaccct

SEQ ID NO: 56183 - DNA, 35 bp, Artificial Sequence
  Synthetic oligonucleotide
atttgcgcgcatttttaacagttcttccccagtct

SEQ ID NO: 56184 - DNA, 35 bp, Artificial Sequence
  Synthetic oligonucleotide
atttcgccgccgtttcccacgtaagcatccattct

SEQ ID NO: 56185 - DNA, 35 bp, Artificial Sequence
  Synthetic oligonucleotide
taagtggtgtgtgctagtggaatgaagtcagccgt

SEQ ID NO: 56186 - DNA, 35 bp, Artificial Sequence
  Synthetic oligonucleotide
tccccgggcgcacctgtcatccacgctggacggtt

SEQ ID NO: 56187 - DNA, 36 bp, Artificial Sequence
  Synthetic oligonucleotide
tacaaaaaggtaaggtggaacaaagccgggcgaaaa

SEQ ID NO: 56188 - DNA, 36 bp, Artificial Sequence
  Synthetic oligonucleotide
ggagcaggctgagggtgggagtgtaagggcgggcaa

SEQ ID NO: 56189 - DNA, 36 bp, Artificial Sequence
  Synthetic oligonucleotide
aaataaggctaacggataggaaggaagtgggggcaa

SEQ ID NO: 56190 - DNA, 36 bp, Artificial Sequence
  Synthetic oligonucleotide
acgaggggtacgcacggagcttaatgagggtggcaa

SEQ ID NO: 56191 - DNA, 35 bp, Artificial Sequence
  Synthetic oligonucleotide
tgcccccgattgcaagaccaccccactacccagaa

SEQ ID NO: 56192 - DNA, 36 bp, Artificial Sequence
  Synthetic oligonucleotide
ggtgcggaggaggagtcatgcattatgtgggtggaa

SEQ ID NO: 56193 - DNA, 36 bp, Artificial Sequence
  Synthetic oligonucleotide
tcgaacccgtgactcatcgccgtctaagctctctaa

SEQ ID NO: 56194 - DNA, 35 bp, Artificial Sequence
  Synthetic oligonucleotide
actcgcgggctatgtcatcacgcgcccttgtaaca

SEQ ID NO: 56195 - DNA, 35 bp, Artificial Sequence
  Synthetic oligonucleotide
agcaccgactcaattttgccttttttaccgagaca

SEQ ID NO: 56196 - DNA, 35 bp, Artificial Sequence
  Synthetic oligonucleotide
tacccccgcaggattgccttcgatactacactaca

SEQ ID NO: 56197 - DNA, 35 bp, Artificial Sequence
  Synthetic oligonucleotide
gtcacgacaagtcttgcagcaccacgaacaatcca

SEQ ID NO: 56198 - DNA, 36 bp, Artificial Sequence
  Synthetic oligonucleotide
gccactgaccggtttttagggcttcatcgctccgca

SEQ ID NO: 56199 - DNA, 37 bp, Artificial Sequence
  Synthetic oligonucleotide
aggaattgcagggggggaatggcggaggggattgaga

SEQ ID NO: 56200 - DNA, 35 bp, Artificial Sequence
  Synthetic oligonucleotide
aatagagcagggagtggggtcgtcagaagacacga

SEQ ID NO: 56201 - DNA, 37 bp, Artificial Sequence
  Synthetic oligonucleotide
gcgaccgaaacacctgtcgccctcctatcctatccga

SEQ ID NO: 56202 - DNA, 37 bp, Artificial Sequence
  Synthetic oligonucleotide
gtgccacgctccactgtaaaacgcctgtatgcgagga

SEQ ID NO: 56203 - DNA, 37 bp, Artificial Sequence
  Synthetic oligonucleotide
atgttccgcccacctgctgtcttttgatgtcttggga

SEQ ID NO: 56204 - DNA, 37 bp, Artificial Sequence
  Synthetic oligonucleotide
gatgccgctgcccaggttataccacgccccgaaatga

SEQ ID NO: 56205 - DNA, 38 bp, Artificial Sequence
  Synthetic oligonucleotide
gtcagagccactggctgaacatctggaccctatcatga

SEQ ID NO: 56206 - DNA, 38 bp, Artificial Sequence
  Synthetic oligonucleotide
gacacgaagacggctagtcccacaccttgttccactga

SEQ ID NO: 56207 - DNA, 38 bp, Artificial Sequence
  Synthetic oligonucleotide
acccgaggactccgaagcctctcttccgacttccctga

SEQ ID NO: 56208 - DNA, 38 bp, Artificial Sequence
  Synthetic oligonucleotide
tgagaccattgtgcgtcggttaacacaccccatgctga

SEQ ID NO: 56209 - DNA, 38 bp, Artificial Sequence
  Synthetic oligonucleotide
ttgtagctggccaatcgattcaaccaactcatctctga

SEQ ID NO: 56210 - DNA, 38 bp, Artificial Sequence
  Synthetic oligonucleotide
ggaacgtacagctagtagaggaggcggggagtgtctga

SEQ ID NO: 56211 - DNA, 38 bp, Artificial Sequence
  Synthetic oligonucleotide
gtctcctcagtcgcacaacgtttctgccaggctgttga

SEQ ID NO: 56212 - DNA, 36 bp, Artificial Sequence
  Synthetic oligonucleotide
aattgccgccgtcccgctctttccttccagagcata

SEQ ID NO: 56213 - DNA, 36 bp, Artificial Sequence
  Synthetic oligonucleotide
ctcgcagttatctcgtgtcctgccctgtactgcata

SEQ ID NO: 56214 - DNA, 36 bp, Artificial Sequence
  Synthetic oligonucleotide
gtcccatccacagtcctggtttccaacattgtacta

SEQ ID NO: 56215 - DNA, 36 bp, Artificial Sequence
  Synthetic oligonucleotide
tccgtggtagcgtttagcatgcacactccgcaccta

SEQ ID NO: 56216 - DNA, 36 bp, Artificial Sequence
  Synthetic oligonucleotide
gtttggcgctgttttccatcgagcacacctgaccta

SEQ ID NO: 56217 - DNA, 36 bp, Artificial Sequence
  Synthetic oligonucleotide
atgagtggcgagtgaggtaagatcaggagaagggta

SEQ ID NO: 56218 - DNA, 35 bp, Artificial Sequence
  Synthetic oligonucleotide
tcactggggtgatttgagtgcatcttggcattgta

SEQ ID NO: 56219 - DNA, 36 bp, Artificial Sequence
  Synthetic oligonucleotide
gcggactcgtgtgtccgtttctcttcctgttgctta

SEQ ID NO: 56220 - DNA, 36 bp, Artificial Sequence
  Synthetic oligonucleotide
gacgtaacgacgtctttgtagtatcatctcccgtta

SEQ ID NO: 56221 - DNA, 36 bp, Artificial Sequence
  Synthetic oligonucleotide
tcacgctacctggcaccatggcatcgatcttcgtta

SEQ ID NO: 56222 - DNA, 36 bp, Artificial Sequence
  Synthetic oligonucleotide
cacaccaccgcctggcagggcattccgctccattta

SEQ ID NO: 56223 - DNA, 35 bp, Artificial Sequence
  Synthetic oligonucleotide
tactctccacgtacggaactttgtgacacacttta

SEQ ID NO: 56224 - DNA, 35 bp, Artificial Sequence
  Synthetic oligonucleotide
acattcctccctctatctaggtgccggagtagcac

SEQ ID NO: 56225 - DNA, 35 bp, Artificial Sequence
  Synthetic oligonucleotide
gctgctgagcaagcacgtctccggttacatcctac

SEQ ID NO: 56226 - DNA, 35 bp, Artificial Sequence
  Synthetic oligonucleotide
agtgccaagcaactgtctccccatcgccctgaccc

SEQ ID NO: 56227 - DNA, 35 bp, Artificial Sequence
  Synthetic oligonucleotide
gcctcaggccgttttgctccatccgcaggctcccc

SEQ ID NO: 56228 - DNA, 35 bp, Artificial Sequence
  Synthetic oligonucleotide
actcgaaccccgtaccacaacccaggttgcaccgc

SEQ ID NO: 56229 - DNA, 35 bp, Artificial Sequence
  Synthetic oligonucleotide
accggttgctcatagtctccccagcccaccaatgc

SEQ ID NO: 56230 - DNA, 35 bp, Artificial Sequence
  Synthetic oligonucleotide
acccataccgtcatacttctttacctggtttatgc

SEQ ID NO: 56231 - DNA, 35 bp, Artificial Sequence
  Synthetic oligonucleotide
atcgcactccgccctctacttcctgatggataatc

SEQ ID NO: 56232 - DNA, 35 bp, Artificial Sequence
  Synthetic oligonucleotide
tttcgaacacttggctgttgcctcaaccgcacctc

SEQ ID NO: 56233 - DNA, 35 bp, Artificial Sequence
  Synthetic oligonucleotide
gctcggtcgctgggtttggttataaccctcccctc

SEQ ID NO: 56234 - DNA, 35 bp, Artificial Sequence
  Synthetic oligonucleotide
gcagtccgcacgtcacgcgctctatcgttcaattc

SEQ ID NO: 56235 - DNA, 36 bp, Artificial Sequence
  Synthetic oligonucleotide
tgagcatcgcattccgtgccggttgttgcttttttc

SEQ ID NO: 56236 - DNA, 35 bp, Artificial Sequence
  Synthetic oligonucleotide
ttccgggaaactgctccatacgacgtacctccacg

SEQ ID NO: 56237 - DNA, 35 bp, Artificial Sequence
  Synthetic oligonucleotide
gcctcacacagccttcccaccccgcgcccttgacg

SEQ ID NO: 56238 - DNA, 35 bp, Artificial Sequence
  Synthetic oligonucleotide
gccgggggatagaagggcggattaggggttacgcg

SEQ ID NO: 56239 - DNA, 35 bp, Artificial Sequence
  Synthetic oligonucleotide
gacgagcgatacgctctcacaagtttccttcctcg

SEQ ID NO: 56240 - DNA, 35 bp, Artificial Sequence
  Synthetic oligonucleotide
atgtgaggaaaaagggaaagcgggacgcgcgacgg

SEQ ID NO: 56241 - DNA, 35 bp, Artificial Sequence
  Synthetic oligonucleotide
tgggcctctgcacacaccacttcgctctttttctg

SEQ ID NO: 56242 - DNA, 35 bp, Artificial Sequence
  Synthetic oligonucleotide
gagtataacgagggtgtcggaggggcaacaaggtg

SEQ ID NO: 56243 - DNA, 35 bp, Artificial Sequence
  Synthetic oligonucleotide
ttcatccatcgccatgcttcacgcgatcataccct

SEQ ID NO: 56244 - DNA, 35 bp, Artificial Sequence
  Synthetic oligonucleotide
gtacagtcccgctagtagcctgggcgactccccct

SEQ ID NO: 56245 - DNA, 35 bp, Artificial Sequence
  Synthetic oligonucleotide
gtgtgagcgtacattgtcagttgcaccggccctct

SEQ ID NO: 56246 - DNA, 35 bp, Artificial Sequence
  Synthetic oligonucleotide
gataagcaccggaagtaagtggagtttattgcggt

SEQ ID NO: 56247 - DNA, 36 bp, Artificial Sequence
  Synthetic oligonucleotide
gccaagtcctcccctggaagctgcaagttactacaa

SEQ ID NO: 56248 - DNA, 35 bp, Artificial Sequence
  Synthetic oligonucleotide
tgctcacccgtacgcattgccctcaaactgccgaa

SEQ ID NO: 56249 - DNA, 36 bp, Artificial Sequence
  Synthetic oligonucleotide
actgaccctgagcctggcgcacttaaccgttaggaa

SEQ ID NO: 56250 - DNA, 36 bp, Artificial Sequence
  Synthetic oligonucleotide
gaggggggggccaaaacgggcattagttatcagtaa

SEQ ID NO: 56251 - DNA, 36 bp, Artificial Sequence
  Synthetic oligonucleotide
tactgcccaacctaggcccttgtcggttaccctaca

SEQ ID NO: 56252 - DNA, 36 bp, Artificial Sequence
  Synthetic oligonucleotide
tcaaaccctgccgacgcacggtcttttcagtttaca

SEQ ID NO: 56253 - DNA, 35 bp, Artificial Sequence
  Synthetic oligonucleotide
gaatccggcgcatacttactctgctagagctacca

SEQ ID NO: 56254 - DNA, 36 bp, Artificial Sequence
  Synthetic oligonucleotide
aacctatgttgcccgcggtcttggtcgctatcccca

SEQ ID NO: 56255 - DNA, 35 bp, Artificial Sequence
  Synthetic oligonucleotide
atcacgcaccgtgctgcaggtctttttcatagcca

SEQ ID NO: 56256 - DNA, 36 bp, Artificial Sequence
  Synthetic oligonucleotide
aagtcctcaacaccaactcataagggtcactctcca

SEQ ID NO: 56257 - DNA, 36 bp, Artificial Sequence
  Synthetic oligonucleotide
gtgcggagggggaagatcgacggggtgagaggtcca

SEQ ID NO: 56258 - DNA, 36 bp, Artificial Sequence
  Synthetic oligonucleotide
gacaacctcgagacacataatccgatcacccttcca

SEQ ID NO: 56259 - DNA, 36 bp, Artificial Sequence
  Synthetic oligonucleotide
accccacagccctcttccgctacttgatcgcctgca

SEQ ID NO: 56260 - DNA, 36 bp, Artificial Sequence
  Synthetic oligonucleotide
tcataaacctaccacgcttccccgcagacaggtgca

SEQ ID NO: 56261 - DNA, 36 bp, Artificial Sequence
  Synthetic oligonucleotide
taccccccgtcgtcgtcgtccagggaagtcacctca

SEQ ID NO: 56262 - DNA, 34 bp, Artificial Sequence
  Synthetic oligonucleotide
gatcagcatcgcgtgatcactattttcttccaga

SEQ ID NO: 56263 - DNA, 37 bp, Artificial Sequence
  Synthetic oligonucleotide
gaacccacatgtatagtcccgccctcttctacttaga

SEQ ID NO: 56264 - DNA, 36 bp, Artificial Sequence
  Synthetic oligonucleotide
cggacacgtactttcctttcatgggcgaccgcgcga

SEQ ID NO: 56265 - DNA, 35 bp, Artificial Sequence
  Synthetic oligonucleotide
tgcaatgggcgggggggtctaacagtcgagggcga

SEQ ID NO: 56266 - DNA, 37 bp, Artificial Sequence
  Synthetic oligonucleotide
acatcgcgccaggttcaccgtaccattttgtttgcga

SEQ ID NO: 56267 - DNA, 37 bp, Artificial Sequence
  Synthetic oligonucleotide
tgacgtgaccccagtaatttttcgacctgacgatcga

SEQ ID NO: 56268 - DNA, 36 bp, Artificial Sequence
  Synthetic oligonucleotide
tgagcatgggtgaattaaatgaggggcggagaggga

SEQ ID NO: 56269 - DNA, 37 bp, Artificial Sequence
  Synthetic oligonucleotide
gcaacaaagactagcgggtaagtggtggaacggggga

SEQ ID NO: 56270 - DNA, 36 bp, Artificial Sequence
  Synthetic oligonucleotide
atggaggagaggatcttgcgaaggctaaggggggga

SEQ ID NO: 56271 - DNA, 37 bp, Artificial Sequence
  Synthetic oligonucleotide
acgcacgatgtgtcgtgggtggtaagggctggtggga

SEQ ID NO: 56272 - DNA, 35 bp, Artificial Sequence
  Synthetic oligonucleotide
gacgccacatcagaaacttatgatcccctactgga

SEQ ID NO: 56273 - DNA, 37 bp, Artificial Sequence
  Synthetic oligonucleotide
gacctgtgttggccgtcacataaaccctgctgctgga

SEQ ID NO: 56274 - DNA, 37 bp, Artificial Sequence
  Synthetic oligonucleotide
gtatgtaacgcagaagtggggttgtgtgggtagtgga

SEQ ID NO: 56275 - DNA, 36 bp, Artificial Sequence
  Synthetic oligonucleotide
tgagtgcgtgacaattatggggaatgaacgggtgga

SEQ ID NO: 56276 - DNA, 37 bp, Artificial Sequence
  Synthetic oligonucleotide
atcgacccccaacgctgtgggcacctattcccttgga

SEQ ID NO: 56277 - DNA, 38 bp, Artificial Sequence
  Synthetic oligonucleotide
gtctcagcgcaacactctttcctgccccatctgactga

SEQ ID NO: 56278 - DNA, 37 bp, Artificial Sequence
  Synthetic oligonucleotide
gacaacagcgggttatttcctgagtcgccactcctga

SEQ ID NO: 56279 - DNA, 37 bp, Artificial Sequence
  Synthetic oligonucleotide
agacgaaggagcaggagcggaatacgaggggatctga

SEQ ID NO: 56280 - DNA, 38 bp, Artificial Sequence
  Synthetic oligonucleotide
tgcgggggtgggcgaagatgatgcaggggcgatcgtga

SEQ ID NO: 56281 - DNA, 38 bp, Artificial Sequence
  Synthetic oligonucleotide
acaggcccagtcatgtacatcccatctgcacacgttga

SEQ ID NO: 56282 - DNA, 38 bp, Artificial Sequence
  Synthetic oligonucleotide
gcattgcctactgcccttttccttgtcttgtcttttga

SEQ ID NO: 56283 - DNA, 38 bp, Artificial Sequence
  Synthetic oligonucleotide
gtgatcacctcacgcgctaaaaaggtcctggtttttga

SEQ ID NO: 56284 - DNA, 37 bp, Artificial Sequence
  Synthetic oligonucleotide
atccactccctgggggggcctttcaactgaacaccta

SEQ ID NO: 56285 - DNA, 36 bp, Artificial Sequence
  Synthetic oligonucleotide
tccacccagccattaactagtattggatctctgcta

SEQ ID NO: 56286 - DNA, 35 bp, Artificial Sequence
  Synthetic oligonucleotide
tccacgctcaattagccgcctccctatcttgagta

SEQ ID NO: 56287 - DNA, 35 bp, Artificial Sequence
  Synthetic oligonucleotide
taccactctgagctccgccgtcgcccgctgggaac

SEQ ID NO: 56288 - DNA, 35 bp, Artificial Sequence
  Synthetic oligonucleotide
taacgaccaacaggagtgaaatctgttcctgtaac

SEQ ID NO: 56289 - DNA, 35 bp, Artificial Sequence
  Synthetic oligonucleotide
actaagggccccgtgccctacacctttgatgacac

SEQ ID NO: 56290 - DNA, 35 bp, Artificial Sequence
  Synthetic oligonucleotide
gtcatccgagggttgacctccaccttttctgacac

SEQ ID NO: 56291 - DNA, 35 bp, Artificial Sequence
  Synthetic oligonucleotide
taggccagccttaacaccgttcgacccatctatac

SEQ ID NO: 56292 - DNA, 35 bp, Artificial Sequence
  Synthetic oligonucleotide
gtcaccatatccgtcatcgcttcggcccgggatcc

SEQ ID NO: 56293 - DNA, 35 bp, Artificial Sequence
  Synthetic oligonucleotide
tcccgccaccgctttggcttggacctacatggagc

SEQ ID NO: 56294 - DNA, 35 bp, Artificial Sequence
  Synthetic oligonucleotide
aactccatcgtatggctgggttacgctgttctatc

SEQ ID NO: 56295 - DNA, 35 bp, Artificial Sequence
  Synthetic oligonucleotide
tcccgccgccttgtttttttggtccgtcttcactc

SEQ ID NO: 56296 - DNA, 35 bp, Artificial Sequence
  Synthetic oligonucleotide
acttcaccccctgctgcgatacttgaagctagctc

SEQ ID NO: 56297 - DNA, 35 bp, Artificial Sequence
  Synthetic oligonucleotide
gtcacctaccgggtggaggtggggagggtaatttc

SEQ ID NO: 56298 - DNA, 35 bp, Artificial Sequence
  Synthetic oligonucleotide
accaccgtcgctctgcctcccaccctccttgtgag

SEQ ID NO: 56299 - DNA, 35 bp, Artificial Sequence
  Synthetic oligonucleotide
gcgaggtggggtccaaacgaaggggggattaatag

SEQ ID NO: 56300 - DNA, 35 bp, Artificial Sequence
  Synthetic oligonucleotide
ataccctacgattttgttcccctgcctatacgagg

SEQ ID NO: 56301 - DNA, 35 bp, Artificial Sequence
  Synthetic oligonucleotide
ttaccacacacctatgccgcactcataaccggagg

SEQ ID NO: 56302 - DNA, 35 bp, Artificial Sequence
  Synthetic oligonucleotide
gaccgcaaattccaccgcatcgtctcgacatccgg

SEQ ID NO: 56303 - DNA, 35 bp, Artificial Sequence
  Synthetic oligonucleotide
tgctgcccctacgaatttaatggaacactattggg

SEQ ID NO: 56304 - DNA, 35 bp, Artificial Sequence
  Synthetic oligonucleotide
gccaacgcgagctcccccgcatttcaataacctgg

SEQ ID NO: 56305 - DNA, 35 bp, Artificial Sequence
  Synthetic oligonucleotide
acccacacacttgcttgatgagcacgtcatacgtg

SEQ ID NO: 56306 - DNA, 35 bp, Artificial Sequence
  Synthetic oligonucleotide
gaggggggtgccgagatggaagaccgggcggggtg

SEQ ID NO: 56307 - DNA, 35 bp, Artificial Sequence
  Synthetic oligonucleotide
tgcaatgcatgacgaccttattacaccaaacattg

SEQ ID NO: 56308 - DNA, 35 bp, Artificial Sequence
  Synthetic oligonucleotide
gcgacccggcacctgactagttctatggcttccat

SEQ ID NO: 56309 - DNA, 35 bp, Artificial Sequence
  Synthetic oligonucleotide
tgtgacggcaacgtatctgcctttcaatcctaact

SEQ ID NO: 56310 - DNA, 35 bp, Artificial Sequence
  Synthetic oligonucleotide
gtagtgagatgtagtggtgtgagtgggaaggccgt

SEQ ID NO: 56311 - DNA, 36 bp, Artificial Sequence
  Synthetic oligonucleotide
gacgttaggggccggggaaaggggtaattgacgcgt

SEQ ID NO: 56312 - DNA, 36 bp, Artificial Sequence
  Synthetic oligonucleotide
tcacccatcgccctacgtaagagttctgcacaagaa

SEQ ID NO: 56313 - DNA, 36 bp, Artificial Sequence
  Synthetic oligonucleotide
gacccgcatgctaacagttgccttctccaacccgaa

SEQ ID NO: 56314 - DNA, 36 bp, Artificial Sequence
  Synthetic oligonucleotide
gccatccaccctgctgccccctgatcggggtattaa

SEQ ID NO: 56315 - DNA, 36 bp, Artificial Sequence
  Synthetic oligonucleotide
acaacgcgtatggtttcgtgcgcgcctttcccttaa

SEQ ID NO: 56316 - DNA, 35 bp, Artificial Sequence
  Synthetic oligonucleotide
gcctcatctctcccgactgagtcccttgatctaca

SEQ ID NO: 56317 - DNA, 36 bp, Artificial Sequence
  Synthetic oligonucleotide
tattcgcgccaatgagtcatgcactaactctcccca

SEQ ID NO: 56318 - DNA, 35 bp, Artificial Sequence
  Synthetic oligonucleotide
ttcccaaaggccagcactggaccccctcttcgcca

SEQ ID NO: 56319 - DNA, 36 bp, Artificial Sequence
  Synthetic oligonucleotide
accctaggaaggatggagagtgggggcggttaggca

SEQ ID NO: 56320 - DNA, 37 bp, Artificial Sequence
  Synthetic oligonucleotide
tgaaccacctctgtcggtattggtgcctgacccacga

SEQ ID NO: 56321 - DNA, 35 bp, Artificial Sequence
  Synthetic oligonucleotide
attctgtcccatccacccgacgtcgccgcagccga

SEQ ID NO: 56322 - DNA, 37 bp, Artificial Sequence
  Synthetic oligonucleotide
acggggaggtttcggcaaagggagtgagttggaagga

SEQ ID NO: 56323 - DNA, 35 bp, Artificial Sequence
  Synthetic oligonucleotide
gccactcgctcacaatccacgcattctatccagga

SEQ ID NO: 56324 - DNA, 37 bp, Artificial Sequence
  Synthetic oligonucleotide
ttgtgctaccctgtttccgccatgtcttgctgtagga

SEQ ID NO: 56325 - DNA, 36 bp, Artificial Sequence
  Synthetic oligonucleotide
gaggtcgagagaggtgtggggcatgtaaaggaggga

SEQ ID NO: 56326 - DNA, 37 bp, Artificial Sequence
  Synthetic oligonucleotide
atctgcaggttgggagggattgcaggacttgggggga

SEQ ID NO: 56327 - DNA, 36 bp, Artificial Sequence
  Synthetic oligonucleotide
tgcacagttgtggggtggaaaaaaagtggtggtgga

SEQ ID NO: 56328 - DNA, 38 bp, Artificial Sequence
  Synthetic oligonucleotide
gaagtgggtagggggggctgggcccttgtcgaacatga

SEQ ID NO: 56329 - DNA, 38 bp, Artificial Sequence
  Synthetic oligonucleotide
gagactgggcgggcgggggccatgagggagggagatga

SEQ ID NO: 56330 - DNA, 37 bp, Artificial Sequence
  Synthetic oligonucleotide
acatcctatcccgtagccccgagtgcatacgacctga

SEQ ID NO: 56331 - DNA, 37 bp, Artificial Sequence
  Synthetic oligonucleotide
tgttggtcagtccgactattgcgtgatccccctctga

SEQ ID NO: 56332 - DNA, 38 bp, Artificial Sequence
  Synthetic oligonucleotide
ggtggtgccccggtttttactctacatgcccctcgtga

SEQ ID NO: 56333 - DNA, 37 bp, Artificial Sequence
  Synthetic oligonucleotide
gcctccacttagaaagtgctacacgtatgaccattga

SEQ ID NO: 56334 - DNA, 38 bp, Artificial Sequence
  Synthetic oligonucleotide
tgccagatatctcacatgcggctctgtaacctccttga

SEQ ID NO: 56335 - DNA, 38 bp, Artificial Sequence
  Synthetic oligonucleotide
gtctcgcactctccgttcaccatcgatccgtatcttga

SEQ ID NO: 56336 - DNA, 38 bp, Artificial Sequence
  Synthetic oligonucleotide
gacaccgcggcctgctatctgggtctcagcccctttga

SEQ ID NO: 56337 - DNA, 38 bp, Artificial Sequence
  Synthetic oligonucleotide
acgtgtcagagagtggggggtttacagggtgggtttga

SEQ ID NO: 56338 - DNA, 36 bp, Artificial Sequence
  Synthetic oligonucleotide
atccttgtccgttgttccgtgcgcatttaccgtata

SEQ ID NO: 56339 - DNA, 35 bp, Artificial Sequence
  Synthetic oligonucleotide
gtgcaccctcatacacacacccttactgttgtcta

SEQ ID NO: 56340 - DNA, 35 bp, Artificial Sequence
  Synthetic oligonucleotide
tactactggcaaagggatcgcgcccctcacccaac

SEQ ID NO: 56341 - DNA, 35 bp, Artificial Sequence
  Synthetic oligonucleotide
gacaacaacaggctcatgcatgcgttactccgaac

SEQ ID NO: 56342 - DNA, 35 bp, Artificial Sequence
  Synthetic oligonucleotide
aacctactgccggttaggtacaacacggatttcac

SEQ ID NO: 56343 - DNA, 35 bp, Artificial Sequence
  Synthetic oligonucleotide
ggagcatcatccgccccactgctaggccggccacc

SEQ ID NO: 56344 - DNA, 35 bp, Artificial Sequence
  Synthetic oligonucleotide
gcccgcagtagtcgcacccccctgcctgacagacc

SEQ ID NO: 56345 - DNA, 35 bp, Artificial Sequence
  Synthetic oligonucleotide
tgataagcaggttaatttgctgctcccctttggcc

SEQ ID NO: 56346 - DNA, 35 bp, Artificial Sequence
  Synthetic oligonucleotide
gccccagccgtgcattggcatttaattcctgctgc

SEQ ID NO: 56347 - DNA, 35 bp, Artificial Sequence
  Synthetic oligonucleotide
gccaccaccggattatttgataacctgccactctc

SEQ ID NO: 56348 - DNA, 35 bp, Artificial Sequence
  Synthetic oligonucleotide
gagggctgaccctggcacctgggttatcttttctc

SEQ ID NO: 56349 - DNA, 35 bp, Artificial Sequence
  Synthetic oligonucleotide
tatcccacaccattttcccttatgtcacgcctgtc

SEQ ID NO: 56350 - DNA, 35 bp, Artificial Sequence
  Synthetic oligonucleotide
gctaccaacgacccggtcattggttcatccccttc

SEQ ID NO: 56351 - DNA, 35 bp, Artificial Sequence
  Synthetic oligonucleotide
attaccccggcctgccatctgctctgcctatatag

SEQ ID NO: 56352 - DNA, 35 bp, Artificial Sequence
  Synthetic oligonucleotide
gttgacaatctttcgcccgcctttagaacgcactg

SEQ ID NO: 56353 - DNA, 35 bp, Artificial Sequence
  Synthetic oligonucleotide
gaagacccgccacttatatcatgccctcgaaattg

SEQ ID NO: 56354 - DNA, 35 bp, Artificial Sequence
  Synthetic oligonucleotide
gtggtgctcccaatccgtcttggcctaaccgcaat

SEQ ID NO: 56355 - DNA, 35 bp, Artificial Sequence
  Synthetic oligonucleotide
ataggcctcccttaaccagccgctcgtcctgcaat

SEQ ID NO: 56356 - DNA, 35 bp, Artificial Sequence
  Synthetic oligonucleotide
gcctccaaccggcgtggttccggttgctataccat

SEQ ID NO: 56357 - DNA, 35 bp, Artificial Sequence
  Synthetic oligonucleotide
gattcatccgctgaggctattcatacgcatattat

SEQ ID NO: 56358 - DNA, 35 bp, Artificial Sequence
  Synthetic oligonucleotide
tgccctacacggtaggtatcccctattctcgaact

SEQ ID NO: 56359 - DNA, 35 bp, Artificial Sequence
  Synthetic oligonucleotide
actacggtcggatttccagctgctctccactgact

SEQ ID NO: 56360 - DNA, 35 bp, Artificial Sequence
  Synthetic oligonucleotide
tgcaagtcatacccgcttttcgtgccacggctcct

SEQ ID NO: 56361 - DNA, 35 bp, Artificial Sequence
  Synthetic oligonucleotide
agtcgaccaccgggtgcacttaaactgttcttggt

SEQ ID NO: 56362 - DNA, 35 bp, Artificial Sequence
  Synthetic oligonucleotide
gcctgatggccactggtttaacaagcccacacatt

SEQ ID NO: 56363 - DNA, 35 bp, Artificial Sequence
  Synthetic oligonucleotide
tcttgctacggaccgcacaagctatatctgctctt

SEQ ID NO: 56364 - DNA, 36 bp, Artificial Sequence
  Synthetic oligonucleotide
gggacggtaacacaggaaaagggatggagcgtaaaa

SEQ ID NO: 56365 - DNA, 35 bp, Artificial Sequence
  Synthetic oligonucleotide
gctgcaaagcttccggccactttttgaatcctgaa

SEQ ID NO: 56366 - DNA, 35 bp, Artificial Sequence
  Synthetic oligonucleotide
taagcctgggaaagtggaaatgggggacataaaca

SEQ ID NO: 56367 - DNA, 35 bp, Artificial Sequence
  Synthetic oligonucleotide
aacgagcactgtagtatttctttctgcctctcaca

SEQ ID NO: 56368 - DNA, 36 bp, Artificial Sequence
  Synthetic oligonucleotide
gggagacacgaaagggaaggaaggcaacaattggca

SEQ ID NO: 56369 - DNA, 36 bp, Artificial Sequence
  Synthetic oligonucleotide
agtgctccccggtcgtgatccatcctcgttaatgca

SEQ ID NO: 56370 - DNA, 35 bp, Artificial Sequence
  Synthetic oligonucleotide
ttgccagcaccatccatcactgatcgccacctgca

SEQ ID NO: 56371 - DNA, 36 bp, Artificial Sequence
  Synthetic oligonucleotide
tcacgttgggctccacgttaccggtccatttcatca

SEQ ID NO: 56372 - DNA, 35 bp, Artificial Sequence
  Synthetic oligonucleotide
tgaacaactcgcaggcattccatctccagaactca

SEQ ID NO: 56373 - DNA, 35 bp, Artificial Sequence
  Synthetic oligonucleotide
acgctctactcgcattgtttgtattttcgctctca

SEQ ID NO: 56374 - DNA, 37 bp, Artificial Sequence
  Synthetic oligonucleotide
tgtagtgccggaaggtaggagtggaagtgtgcggaga

SEQ ID NO: 56375 - DNA, 36 bp, Artificial Sequence
  Synthetic oligonucleotide
gaggaaccgactagagttccttccctctcatctaga

SEQ ID NO: 56376 - DNA, 37 bp, Artificial Sequence
  Synthetic oligonucleotide
gaaaaaacggggaaaggagggaagtaccgccgaacga

SEQ ID NO: 56377 - DNA, 37 bp, Artificial Sequence
  Synthetic oligonucleotide
ggtggagaagggtcaggagcaggccggtgttagacga

SEQ ID NO: 56378 - DNA, 37 bp, Artificial Sequence
  Synthetic oligonucleotide
gagtgcgggtctattcgtcacccggttacatccccga

SEQ ID NO: 56379 - DNA, 35 bp, Artificial Sequence
  Synthetic oligonucleotide
gtcaagcgcgcgtaattctcaacgaccttccccga

SEQ ID NO: 56380 - DNA, 37 bp, Artificial Sequence
  Synthetic oligonucleotide
tgcccattgcacccgcagttttgaccggtactcccga

SEQ ID NO: 56381 - DNA, 37 bp, Artificial Sequence
  Synthetic oligonucleotide
aatgcgcgcagactattgggtccctgagccccgccga

SEQ ID NO: 56382 - DNA, 37 bp, Artificial Sequence
  Synthetic oligonucleotide
tgctgccgcactccacatacttagcaacctcttgcga

SEQ ID NO: 56383 - DNA, 35 bp, Artificial Sequence
  Synthetic oligonucleotide
tactccgtccatcgcttcaccatattcctcatcga

SEQ ID NO: 56384 - DNA, 35 bp, Artificial Sequence
  Synthetic oligonucleotide
gaaaggagcagacacagggcaaatgggtgcttcga

SEQ ID NO: 56385 - DNA, 37 bp, Artificial Sequence
  Synthetic oligonucleotide
taatagagggctgggagtggtagggtgggcatgagga

SEQ ID NO: 56386 - DNA, 35 bp, Artificial Sequence
  Synthetic oligonucleotide
gcatccacttcgcactaccgcagaacagccctgga

SEQ ID NO: 56387 - DNA, 37 bp, Artificial Sequence
  Synthetic oligonucleotide
ggtgagtgcggtgggcaacttggggaaaagatctgga

SEQ ID NO: 56388 - DNA, 37 bp, Artificial Sequence
  Synthetic oligonucleotide
actcgtacccccatccgacgctaggacttgacttgga

SEQ ID NO: 56389 - DNA, 38 bp, Artificial Sequence
  Synthetic oligonucleotide
gagaacaacggaggagtagatatttaggtgggcgatga

SEQ ID NO: 56390 - DNA, 38 bp, Artificial Sequence
  Synthetic oligonucleotide
tgatccaccggcatgataattggttggtttctccctga

SEQ ID NO: 56391 - DNA, 38 bp, Artificial Sequence
  Synthetic oligonucleotide
gatgcctccgtacatccggctagcgatctctgtcctga

SEQ ID NO: 56392 - DNA, 38 bp, Artificial Sequence
  Synthetic oligonucleotide
atccgtcggtgatgcaccggaactcttgtccttcctga

SEQ ID NO: 56393 - DNA, 38 bp, Artificial Sequence
  Synthetic oligonucleotide
acgaccaccagttaatcattcgtctttttcgttcctga

SEQ ID NO: 56394 - DNA, 38 bp, Artificial Sequence
  Synthetic oligonucleotide
tacgacctcagctgtcgccccgtacgtctcctatctga

SEQ ID NO: 56395 - DNA, 38 bp, Artificial Sequence
  Synthetic oligonucleotide
atcgcaaccacatgcgatttcacacatataaatggtga

SEQ ID NO: 56396 - DNA, 36 bp, Artificial Sequence
  Synthetic oligonucleotide
ggggaagtggagagaaatgagatagggtaggattga

SEQ ID NO: 56397 - DNA, 35 bp, Artificial Sequence
  Synthetic oligonucleotide
gatacaggggggggatgacttacatagggccgata

SEQ ID NO: 56398 - DNA, 36 bp, Artificial Sequence
  Synthetic oligonucleotide
tggaccccttgccactgggagagctatatccacgta

SEQ ID NO: 56399 - DNA, 36 bp, Artificial Sequence
  Synthetic oligonucleotide
tgcatcccgcactggaactgggtcacgtttttcgta

SEQ ID NO: 56400 - DNA, 36 bp, Artificial Sequence
  Synthetic oligonucleotide
ttacagagctgcgtgcggcctcaacaaccatctgta

SEQ ID NO: 56401 - DNA, 36 bp, Artificial Sequence
  Synthetic oligonucleotide
gacgccatccctgccttgagttgttgtcctgggtta

SEQ ID NO: 56402 - DNA, 35 bp, Artificial Sequence
  Synthetic oligonucleotide
gcccgcacttatcgaacacaacggtacttgacgac

SEQ ID NO: 56403 - DNA, 35 bp, Artificial Sequence
  Synthetic oligonucleotide
gtgcccaaccgtgattgctttctgcttagttttac

SEQ ID NO: 56404 - DNA, 35 bp, Artificial Sequence
  Synthetic oligonucleotide
gattgctgccgcggtcggcggtccttcttcaaccc

SEQ ID NO: 56405 - DNA, 35 bp, Artificial Sequence
  Synthetic oligonucleotide
tgagcacatgtatttaacggtagttcggtccaccc

SEQ ID NO: 56406 - DNA, 35 bp, Artificial Sequence
  Synthetic oligonucleotide
gtccattctcggagtgatctttatgcgcctacccc

SEQ ID NO: 56407 - DNA, 35 bp, Artificial Sequence
  Synthetic oligonucleotide
gtcaaccatgtaatcagccatgtgatccatggccc

SEQ ID NO: 56408 - DNA, 35 bp, Artificial Sequence
  Synthetic oligonucleotide
gtacaggcggttcactctttatccttcggctcgcc

SEQ ID NO: 56409 - DNA, 35 bp, Artificial Sequence
  Synthetic oligonucleotide
tgtacgtgttggattacactccgcctgaccatgcc

SEQ ID NO: 56410 - DNA, 35 bp, Artificial Sequence
  Synthetic oligonucleotide
gtacgcttgcaagtaccagtatcaaccacctgtcc

SEQ ID NO: 56411 - DNA, 35 bp, Artificial Sequence
  Synthetic oligonucleotide
gaagggatggatatggatgttgcgggtggaaaagc

SEQ ID NO: 56412 - DNA, 35 bp, Artificial Sequence
  Synthetic oligonucleotide
gatgggccggcacttctccaactaaatcgctccgc

SEQ ID NO: 56413 - DNA, 35 bp, Artificial Sequence
  Synthetic oligonucleotide
gtgcacatcgctgcaccataagcctggtaactggc

SEQ ID NO: 56414 - DNA, 35 bp, Artificial Sequence
  Synthetic oligonucleotide
acgaacctggacctatgggcctctatgccttaatc

SEQ ID NO: 56415 - DNA, 35 bp, Artificial Sequence
  Synthetic oligonucleotide
atcccgcgagtgctgatttggtactttgctttctc

SEQ ID NO: 56416 - DNA, 35 bp, Artificial Sequence
  Synthetic oligonucleotide
ttcgttcgcggttttgatgcccctcctcgtttctc

SEQ ID NO: 56417 - DNA, 35 bp, Artificial Sequence
  Synthetic oligonucleotide
gtcgcccgacgccggtctggttcgttaaaccgttc

SEQ ID NO: 56418 - DNA, 35 bp, Artificial Sequence
  Synthetic oligonucleotide
ttccgtatcgtacggtgctactagcccatctgttc

SEQ ID NO: 56419 - DNA, 35 bp, Artificial Sequence
  Synthetic oligonucleotide
tgaactacatgctgaaggggagaggtgacggggcg

SEQ ID NO: 56420 - DNA, 35 bp, Artificial Sequence
  Synthetic oligonucleotide
tgctccgggtggtggtagtagggtagttagttagg

SEQ ID NO: 56421 - DNA, 35 bp, Artificial Sequence
  Synthetic oligonucleotide
gaaacgaagggggatcttagcggggtcgttaacgg

SEQ ID NO: 56422 - DNA, 36 bp, Artificial Sequence
  Synthetic oligonucleotide
aagaaaggccacagggggaagaagaattgaacacgg

SEQ ID NO: 56423 - DNA, 35 bp, Artificial Sequence
  Synthetic oligonucleotide
tagtcaacccccgttgccttcccctattactctgg

SEQ ID NO: 56424 - DNA, 35 bp, Artificial Sequence
  Synthetic oligonucleotide
gtgcgaggctattgctaagcatctgccacccacct

SEQ ID NO: 56425 - DNA, 35 bp, Artificial Sequence
  Synthetic oligonucleotide
gcccaccttcgcgaatttttatttcccctccgtct

SEQ ID NO: 56426 - DNA, 35 bp, Artificial Sequence
  Synthetic oligonucleotide
tgtcgctacccagtcccatcacggcacttaacaaa

SEQ ID NO: 56427 - DNA, 35 bp, Artificial Sequence
  Synthetic oligonucleotide
agtaccaaacactgtgcatatgcatttgcactaaa

SEQ ID NO: 56428 - DNA, 35 bp, Artificial Sequence
  Synthetic oligonucleotide
gactcttctatgcctgttcccgtacgctgattaca

SEQ ID NO: 56429 - DNA, 35 bp, Artificial Sequence
  Synthetic oligonucleotide
ggaccgtatgctctcgtaattcctgccgacaacca

SEQ ID NO: 56430 - DNA, 35 bp, Artificial Sequence
  Synthetic oligonucleotide
tcccctgcctctgggcaccgcgtcactgtctgcca

SEQ ID NO: 56431 - DNA, 36 bp, Artificial Sequence
  Synthetic oligonucleotide
tgcaaaaatatagggtgagggacgagggggggcgca

SEQ ID NO: 56432 - DNA, 35 bp, Artificial Sequence
  Synthetic oligonucleotide
gagacccccagttcaaaacgctattcgacactgca

SEQ ID NO: 56433 - DNA, 36 bp, Artificial Sequence
  Synthetic oligonucleotide
gactgcggcctaccaggtttcattcgctcacttgca

SEQ ID NO: 56434 - DNA, 36 bp, Artificial Sequence
  Synthetic oligonucleotide
gatggcgccttcaccttgccgcgggcccttcttgca

SEQ ID NO: 56435 - DNA, 36 bp, Artificial Sequence
  Synthetic oligonucleotide
gtccaagtcggatgaatagtccccttttaaccctca

SEQ ID NO: 56436 - DNA, 35 bp, Artificial Sequence
  Synthetic oligonucleotide
gaaatagggcaagcagtagtggcggcaaaatgtca

SEQ ID NO: 56437 - DNA, 36 bp, Artificial Sequence
  Synthetic oligonucleotide
gtgaaacgttcaactgcccgatcgcatctgctttca

SEQ ID NO: 56438 - DNA, 36 bp, Artificial Sequence
  Synthetic oligonucleotide
gtgtttagcccaccctgctattgattccgagtttca

SEQ ID NO: 56439 - DNA, 37 bp, Artificial Sequence
  Synthetic oligonucleotide
gcgaagccgactggggtaagcgggttcgcactcgaga

SEQ ID NO: 56440 - DNA, 37 bp, Artificial Sequence
  Synthetic oligonucleotide
atgcgccacaacgagcccgccgagcttaccactacga

SEQ ID NO: 56441 - DNA, 37 bp, Artificial Sequence
  Synthetic oligonucleotide
gacatctctcacttttgttccgggaccattatcccga

SEQ ID NO: 56442 - DNA, 37 bp, Artificial Sequence
  Synthetic oligonucleotide
accccccacatctgcgcgtgccagcgatatatcgcga

SEQ ID NO: 56443 - DNA, 36 bp, Artificial Sequence
  Synthetic oligonucleotide
gatcacctgccattatttcaagcttacgtacgggga

SEQ ID NO: 56444 - DNA, 35 bp, Artificial Sequence
  Synthetic oligonucleotide
gacgtcgagccacctatcctaacttgcagccatga

SEQ ID NO: 56445 - DNA, 37 bp, Artificial Sequence
  Synthetic oligonucleotide
acccgatcgaggggacggcttacaacaccatccatga

SEQ ID NO: 56446 - DNA, 38 bp, Artificial Sequence
  Synthetic oligonucleotide
atgcgaggagagatctctatttgttgcccccctcatga

SEQ ID NO: 56447 - DNA, 38 bp, Artificial Sequence
  Synthetic oligonucleotide
ttaagcccacatgagccctcttgccacgcacttgatga

SEQ ID NO: 56448 - DNA, 38 bp, Artificial Sequence
  Synthetic oligonucleotide
acccaaaccaccatcacagactggcactttcgttatga

SEQ ID NO: 56449 - DNA, 38 bp, Artificial Sequence
  Synthetic oligonucleotide
gacacaacacatagctgacacccgggcactgcccttga

SEQ ID NO: 56450 - DNA, 36 bp, Artificial Sequence
  Synthetic oligonucleotide
gacgcatcgacatgtcgcctaccgattacgccttga

SEQ ID NO: 56451 - DNA, 38 bp, Artificial Sequence
  Synthetic oligonucleotide
acagcatccccgtggtctttaatcattccccgccttga

SEQ ID NO: 56452 - DNA, 36 bp, Artificial Sequence
  Synthetic oligonucleotide
aggtatgccgccagccgtttccaccatttccgttga

SEQ ID NO: 56453 - DNA, 38 bp, Artificial Sequence
  Synthetic oligonucleotide
acttcctgcggatccgtcgtactatgtgcgcattttga

SEQ ID NO: 56454 - DNA, 36 bp, Artificial Sequence
  Synthetic oligonucleotide
ttaccgccatccatgcacctaccgacgaacatggta

SEQ ID NO: 56455 - DNA, 35 bp, Artificial Sequence
  Synthetic oligonucleotide
gatgccactgaatggtccctgcctgcaccatggta

SEQ ID NO: 56456 - DNA, 36 bp, Artificial Sequence
  Synthetic oligonucleotide
gacttgcccaacgtagaagctggccctcccgactta

SEQ ID NO: 56457 - DNA, 35 bp, Artificial Sequence
  Synthetic oligonucleotide
gcacgtgctctgcccaaggtcgcccaattatttta

SEQ ID NO: 56458 - DNA, 35 bp, Artificial Sequence
  Synthetic oligonucleotide
tgaagggtgccgagggcccataatactaatcctac

SEQ ID NO: 56459 - DNA, 35 bp, Artificial Sequence
  Synthetic oligonucleotide
tgacgtaacaccaaataaatgcacaccagcctgcc

SEQ ID NO: 56460 - DNA, 35 bp, Artificial Sequence
  Synthetic oligonucleotide
ttcgacgcgtgcaccttgcgttacttcctgcatcc

SEQ ID NO: 56461 - DNA, 35 bp, Artificial Sequence
  Synthetic oligonucleotide
aacatcccgggtaatttacgctaggacccagttcc

SEQ ID NO: 56462 - DNA, 35 bp, Artificial Sequence
  Synthetic oligonucleotide
gatacatacccctgaccgtttaacccacgcgttcc

SEQ ID NO: 56463 - DNA, 35 bp, Artificial Sequence
  Synthetic oligonucleotide
gatgcaggagtctttagggctaggatttcttcggc

SEQ ID NO: 56464 - DNA, 35 bp, Artificial Sequence
  Synthetic oligonucleotide
ttctccctcacacgcggatcagctctccaaggctc

SEQ ID NO: 56465 - DNA, 35 bp, Artificial Sequence
  Synthetic oligonucleotide
acatacaacgccttataccattccaccgtagagtc

SEQ ID NO: 56466 - DNA, 35 bp, Artificial Sequence
  Synthetic oligonucleotide
gccgacgcactatcgctctcaattatctgggggtc

SEQ ID NO: 56467 - DNA, 35 bp, Artificial Sequence
  Synthetic oligonucleotide
tcctcactgacgttcgtgctcgtttcacacctaag

SEQ ID NO: 56468 - DNA, 35 bp, Artificial Sequence
  Synthetic oligonucleotide
ttgagctggtcgccgtgatgacatctttctctccg

SEQ ID NO: 56469 - DNA, 35 bp, Artificial Sequence
  Synthetic oligonucleotide
tgttggttggcaagaggtggggtggggtacatggg

SEQ ID NO: 56470 - DNA, 35 bp, Artificial Sequence
  Synthetic oligonucleotide
atccgcgaagggtcaacaagggagaacgtgtgaat

SEQ ID NO: 56471 - DNA, 35 bp, Artificial Sequence
  Synthetic oligonucleotide
agccccagtagccttctgccgctctaggcctccat

SEQ ID NO: 56472 - DNA, 35 bp, Artificial Sequence
  Synthetic oligonucleotide
ggttaccccagccttctaaagtgcccatgttcgat

SEQ ID NO: 56473 - DNA, 35 bp, Artificial Sequence
  Synthetic oligonucleotide
tccaccatatctccgtgctgccattcaccgcctat

SEQ ID NO: 56474 - DNA, 35 bp, Artificial Sequence
  Synthetic oligonucleotide
tccttacccaagtagcactccgtccacgtactcct

SEQ ID NO: 56475 - DNA, 35 bp, Artificial Sequence
  Synthetic oligonucleotide
gcacgccccttgctctgtattcgtgtgcgttctct

SEQ ID NO: 56476 - DNA, 35 bp, Artificial Sequence
  Synthetic oligonucleotide
gggttgtggtggggcggtgggtccagcaggtatgt

SEQ ID NO: 56477 - DNA, 35 bp, Artificial Sequence
  Synthetic oligonucleotide
gatgggcagtccacccccatgttagtacgaatgtt

SEQ ID NO: 56478 - DNA, 35 bp, Artificial Sequence
  Synthetic oligonucleotide
gtcctcactgccacaataacaatatgttaatacaa

SEQ ID NO: 56479 - DNA, 35 bp, Artificial Sequence
  Synthetic oligonucleotide
tccataggtgagcacgtctgccccctgccatgcaa

SEQ ID NO: 56480 - DNA, 36 bp, Artificial Sequence
  Synthetic oligonucleotide
acctcccgaatgttgacccgtccgaccctctttgaa

SEQ ID NO: 56481 - DNA, 36 bp, Artificial Sequence
  Synthetic oligonucleotide
ggccgaatcatggcccgtttcgtagtttagccaaca

SEQ ID NO: 56482 - DNA, 35 bp, Artificial Sequence
  Synthetic oligonucleotide
gtgggcgcctctagagcgcatgaccccttaacaca

SEQ ID NO: 56483 - DNA, 36 bp, Artificial Sequence
  Synthetic oligonucleotide
attcgacccacaccgcgtggctactagcagtagaca

SEQ ID NO: 56484 - DNA, 36 bp, Artificial Sequence
  Synthetic oligonucleotide
atatgctggagccacttgctattgatccgttaccca

SEQ ID NO: 56485 - DNA, 36 bp, Artificial Sequence
  Synthetic oligonucleotide
atcctgcacagtggcttgacattctccctcggccca

SEQ ID NO: 56486 - DNA, 35 bp, Artificial Sequence
  Synthetic oligonucleotide
atcgccaggcatctaattcaggcttgcaccatcca

SEQ ID NO: 56487 - DNA, 36 bp, Artificial Sequence
  Synthetic oligonucleotide
ttctgcaccctgtctcccccgattaagcgccgtcca

SEQ ID NO: 56488 - DNA, 36 bp, Artificial Sequence
  Synthetic oligonucleotide
agctgcccccactactctcgtgccccgcttggtcca

SEQ ID NO: 56489 - DNA, 36 bp, Artificial Sequence
  Synthetic oligonucleotide
acacggagccccgcgagcatccctattcgtagtgca

SEQ ID NO: 56490 - DNA, 35 bp, Artificial Sequence
  Synthetic oligonucleotide
agaaaggccgaggaggagcaggccgtgggtgttca

SEQ ID NO: 56491 - DNA, 37 bp, Artificial Sequence
  Synthetic oligonucleotide
gagcaccgaagcgttcggaaaaagggcgggaataaga

SEQ ID NO: 56492 - DNA, 37 bp, Artificial Sequence
  Synthetic oligonucleotide
aacgctgcaggcaaatcgaaaaggaatgaatgataga

SEQ ID NO: 56493 - DNA, 36 bp, Artificial Sequence
  Synthetic oligonucleotide
gccaacaacgttccacggcgtattactctgccacga

SEQ ID NO: 56494 - DNA, 35 bp, Artificial Sequence
  Synthetic oligonucleotide
gcaccctcgcacgtctggctgccctgactaaccga

SEQ ID NO: 56495 - DNA, 36 bp, Artificial Sequence
  Synthetic oligonucleotide
acgcgcacctaaactgagggtttacatcctttccga

SEQ ID NO: 56496 - DNA, 37 bp, Artificial Sequence
  Synthetic oligonucleotide
gtacggtggtcacgattttggttttctttctccgcga

SEQ ID NO: 56497 - DNA, 37 bp, Artificial Sequence
  Synthetic oligonucleotide
atggagttgggggggcgtacggttgggcatggtagga

SEQ ID NO: 56498 - DNA, 37 bp, Artificial Sequence
  Synthetic oligonucleotide
agaggaccggcggctataaaaagtacggaggggcgga

SEQ ID NO: 56499 - DNA, 38 bp, Artificial Sequence
  Synthetic oligonucleotide
tccactacgcccagttctgttctcatcagccgtgatga

SEQ ID NO: 56500 - DNA, 38 bp, Artificial Sequence
  Synthetic oligonucleotide
tgagagccgcccccccacgatgcttgcatttcgactga

SEQ ID NO: 56501 - DNA, 38 bp, Artificial Sequence
  Synthetic oligonucleotide
tacgaggtacggaagtaggtataggtagagcggactga

SEQ ID NO: 56502 - DNA, 38 bp, Artificial Sequence
  Synthetic oligonucleotide
gacgtgggtgcgaggatgacggagggagggcgacctga

SEQ ID NO: 56503 - DNA, 36 bp, Artificial Sequence
  Synthetic oligonucleotide
gacagtgcgttatatcctccacctgattttacctga

SEQ ID NO: 56504 - DNA, 38 bp, Artificial Sequence
  Synthetic oligonucleotide
gtctctaacgcattcctggtatccgtgcccactcctga

SEQ ID NO: 56505 - DNA, 38 bp, Artificial Sequence
  Synthetic oligonucleotide
aatcgccccgccgcgatctgttaccgtcgtatctctga

SEQ ID NO: 56506 - DNA, 36 bp, Artificial Sequence
  Synthetic oligonucleotide
tccacccatcattttcggataccgtatctaccgtga

SEQ ID NO: 56507 - DNA, 37 bp, Artificial Sequence
  Synthetic oligonucleotide
tacgcccgctcgctctcctttccgacgctctgtgtga

SEQ ID NO: 56508 - DNA, 37 bp, Artificial Sequence
  Synthetic oligonucleotide
gtagcacgtagtcctggattaggtggtggggttgtga

SEQ ID NO: 56509 - DNA, 36 bp, Artificial Sequence
  Synthetic oligonucleotide
aggtttacacacatggccaccccagaacctgcttga

SEQ ID NO: 56510 - DNA, 36 bp, Artificial Sequence
  Synthetic oligonucleotide
gagccaccatcatgagtacttcattttcattgttga

SEQ ID NO: 56511 - DNA, 37 bp, Artificial Sequence
  Synthetic oligonucleotide
gttgcccttgctgttgtaccagttctgttagctttga

SEQ ID NO: 56512 - DNA, 35 bp, Artificial Sequence
  Synthetic oligonucleotide
gtgtccggtcctccaggccccatctccctcatata

SEQ ID NO: 56513 - DNA, 35 bp, Artificial Sequence
  Synthetic oligonucleotide
tcaagccacagcatccaacattcagcccttaacta

SEQ ID NO: 56514 - DNA, 35 bp, Artificial Sequence
  Synthetic oligonucleotide
ttgactgcctggctgctctttaacgtacaatacta

SEQ ID NO: 56515 - DNA, 36 bp, Artificial Sequence
  Synthetic oligonucleotide
gtgagcatagcgctgggctcctagttaacacaccta

SEQ ID NO: 56516 - DNA, 35 bp, Artificial Sequence
  Synthetic oligonucleotide
ggtccgttcccctgtcctgacatccgccgaatgta

SEQ ID NO: 56517 - DNA, 36 bp, Artificial Sequence
  Synthetic oligonucleotide
gggacatgtcattgcggttatctcttaccatcctta

SEQ ID NO: 56518 - DNA, 36 bp, Artificial Sequence
  Synthetic oligonucleotide
tgcttcgcagccaccgcccccaaagtgccacggtta

SEQ ID NO: 56519 - DNA, 35 bp, Artificial Sequence
  Synthetic oligonucleotide
tagctgtctatctgctgccaaactccgccacgaac

SEQ ID NO: 56520 - DNA, 35 bp, Artificial Sequence
  Synthetic oligonucleotide
tgctgtgcatacttctagcgcgtggccttactaac

SEQ ID NO: 56521 - DNA, 35 bp, Artificial Sequence
  Synthetic oligonucleotide
gagtgcgaaactgttgaaaccggcgggaagggcac

SEQ ID NO: 56522 - DNA, 34 bp, Artificial Sequence
  Synthetic oligonucleotide
ggaccaactctcggacactattggtgcctccgac

SEQ ID NO: 56523 - DNA, 35 bp, Artificial Sequence
  Synthetic oligonucleotide
tgttacgctctgtcttcgggccatgtacacacacc

SEQ ID NO: 56524 - DNA, 35 bp, Artificial Sequence
  Synthetic oligonucleotide
ggtcgtggtgacccgttaattccagcacctttgcc

SEQ ID NO: 56525 - DNA, 35 bp, Artificial Sequence
  Synthetic oligonucleotide
gacccaccgctccatctgatctcgtcgccgaaagc

SEQ ID NO: 56526 - DNA, 36 bp, Artificial Sequence
  Synthetic oligonucleotide
gtgggtgggtgaccgttggaacgatcgggctgggtc

SEQ ID NO: 56527 - DNA, 35 bp, Artificial Sequence
  Synthetic oligonucleotide
tgaggagcggaccatccttctcgcggcaattcttc

SEQ ID NO: 56528 - DNA, 35 bp, Artificial Sequence
  Synthetic oligonucleotide
cccgaacgttagccctctctgccgtgtaccacccg

SEQ ID NO: 56529 - DNA, 35 bp, Artificial Sequence
  Synthetic oligonucleotide
attgggacagcaagggagggtgtttcaataacggg

SEQ ID NO: 56530 - DNA, 35 bp, Artificial Sequence
  Synthetic oligonucleotide
ttggagaagtgggtgtcgattatcgggagagtgtg

SEQ ID NO: 56531 - DNA, 35 bp, Artificial Sequence
  Synthetic oligonucleotide
agcaccaagcacgtatgttcctaattgtttgtttg

SEQ ID NO: 56532 - DNA, 35 bp, Artificial Sequence
  Synthetic oligonucleotide
tgaagccgcccccagttcagcatcctcaaccaaat

SEQ ID NO: 56533 - DNA, 35 bp, Artificial Sequence
  Synthetic oligonucleotide
gtccgcaacgaaaatctccagttatcgcgcctaat

SEQ ID NO: 56534 - DNA, 35 bp, Artificial Sequence
  Synthetic oligonucleotide
tcctagcagcctgtgcgtcatggccttttctacat

SEQ ID NO: 56535 - DNA, 35 bp, Artificial Sequence
  Synthetic oligonucleotide
tccgaggttacctctcccacgcgtcactgctctat

SEQ ID NO: 56536 - DNA, 35 bp, Artificial Sequence
  Synthetic oligonucleotide
gactcatcgggtcaataacgcgatctctgaaccct

SEQ ID NO: 56537 - DNA, 36 bp, Artificial Sequence
  Synthetic oligonucleotide
ggagccgtgcggtaggggagggtgaaaaggcttcct

SEQ ID NO: 56538 - DNA, 35 bp, Artificial Sequence
  Synthetic oligonucleotide
gttagccgcatgtgccaacctgctctgtccgttct

SEQ ID NO: 56539 - DNA, 35 bp, Artificial Sequence
  Synthetic oligonucleotide
ttttacgccggactctccttcagacacatttctgt

SEQ ID NO: 56540 - DNA, 35 bp, Artificial Sequence
  Synthetic oligonucleotide
gagggactacaaccctgcgagccttctgttctatt

SEQ ID NO: 56541 - DNA, 36 bp, Artificial Sequence
  Synthetic oligonucleotide
taccgccccattatccgtgctgcccttttgggtaaa

SEQ ID NO: 56542 - DNA, 36 bp, Artificial Sequence
  Synthetic oligonucleotide
taagcccgaattgccccttgctgtcccgttcgttaa

SEQ ID NO: 56543 - DNA, 36 bp, Artificial Sequence
  Synthetic oligonucleotide
accaaggagtacgccggcgcgagaccaccatttcca

SEQ ID NO: 56544 - DNA, 35 bp, Artificial Sequence
  Synthetic oligonucleotide
acgccgacaaattctccaaacacggttcgtttcca

SEQ ID NO: 56545 - DNA, 36 bp, Artificial Sequence
  Synthetic oligonucleotide
atgcataggacgggtaggtgaggaggagaacacgca

SEQ ID NO: 56546 - DNA, 35 bp, Artificial Sequence
  Synthetic oligonucleotide
acgctacactcctgcccagatcttagccatacgca

SEQ ID NO: 56547 - DNA, 36 bp, Artificial Sequence
  Synthetic oligonucleotide
gtgcaatccgccttgcaatgcatgcaatctcactca

SEQ ID NO: 56548 - DNA, 36 bp, Artificial Sequence
  Synthetic oligonucleotide
tcacatgtcactcgcgctcttttgcgtacacattca

SEQ ID NO: 56549 - DNA, 37 bp, Artificial Sequence
  Synthetic oligonucleotide
tctgcctcccaaattagccatccatcgctgcagacga

SEQ ID NO: 56550 - DNA, 37 bp, Artificial Sequence
  Synthetic oligonucleotide
gattgtccacccaccatgattggtaccttcttgacga

SEQ ID NO: 56551 - DNA, 37 bp, Artificial Sequence
  Synthetic oligonucleotide
actcccggcgctcccgactccaacatctacccgagga

SEQ ID NO: 56552 - DNA, 36 bp, Artificial Sequence
  Synthetic oligonucleotide
tcaagtggaccatggtaaagggattggctggatgga

SEQ ID NO: 56553 - DNA, 38 bp, Artificial Sequence
  Synthetic oligonucleotide
aactccacgacggcttcccccgaagcgctcccacctga

SEQ ID NO: 56554 - DNA, 38 bp, Artificial Sequence
  Synthetic oligonucleotide
cactcttccgccactgctgctaatcttgctccacctga

SEQ ID NO: 56555 - DNA, 38 bp, Artificial Sequence
  Synthetic oligonucleotide
aatgtgtaggcctctcagtaccttctcgttcttcctga

SEQ ID NO: 56556 - DNA, 37 bp, Artificial Sequence
  Synthetic oligonucleotide
ggatcaccctcccaggtttgacatgactcgttcctga

SEQ ID NO: 56557 - DNA, 37 bp, Artificial Sequence
  Synthetic oligonucleotide
tagttcaccatcccctgtgagtctgtcctgttgctga

SEQ ID NO: 56558 - DNA, 38 bp, Artificial Sequence
  Synthetic oligonucleotide
gtagaacgggtagttgggcagcaagagaaaggaattga

SEQ ID NO: 56559 - DNA, 37 bp, Artificial Sequence
  Synthetic oligonucleotide
gcctcgccacagatgactttcctgttgctcctattga

SEQ ID NO: 56560 - DNA, 38 bp, Artificial Sequence
  Synthetic oligonucleotide
tctgctcggcccttgtacgccatctgcctatactttga

SEQ ID NO: 56561 - DNA, 38 bp, Artificial Sequence
  Synthetic oligonucleotide
tgaacctcttgtgatcgtgccctggtggttatctttga

SEQ ID NO: 56562 - DNA, 36 bp, Artificial Sequence
  Synthetic oligonucleotide
aacgccacacctccattgcatcccctcccggtacta

SEQ ID NO: 56563 - DNA, 35 bp, Artificial Sequence
  Synthetic oligonucleotide
gctcaaccgcagaggccgtccgcttacggttccta

SEQ ID NO: 56564 - DNA, 36 bp, Artificial Sequence
  Synthetic oligonucleotide
acgtggctgtcggtattaacttctccttgcttcgta

SEQ ID NO: 56565 - DNA, 36 bp, Artificial Sequence
  Synthetic oligonucleotide
aatgccccaggcacatctagtatgaaaacacaatta

SEQ ID NO: 56566 - DNA, 36 bp, Artificial Sequence
  Synthetic oligonucleotide
gatacaacccggatcagtatcacagagccagtgtta

SEQ ID NO: 56567 - DNA, 35 bp, Artificial Sequence
  Synthetic oligonucleotide
gaggcaagctccgcctcgtctccctgctacattta

SEQ ID NO: 56568 - DNA, 36 bp, Artificial Sequence
  Synthetic oligonucleotide
ttgacagccccgagcaagctctgccccgatcattta

SEQ ID NO: 56569 - DNA, 35 bp, Artificial Sequence
  Synthetic oligonucleotide
tcttcgcctcaattttggcaatcacatgatcacac

SEQ ID NO: 56570 - DNA, 35 bp, Artificial Sequence
  Synthetic oligonucleotide
acgcctccgacattggtcggtcatagggcctccac

SEQ ID NO: 56571 - DNA, 35 bp, Artificial Sequence
  Synthetic oligonucleotide
tcacaggcccctatcgcgcatctttatcacgtcac

SEQ ID NO: 56572 - DNA, 35 bp, Artificial Sequence
  Synthetic oligonucleotide
actcccaccctgttctagttctagttgctctggac

SEQ ID NO: 56573 - DNA, 35 bp, Artificial Sequence
  Synthetic oligonucleotide
gttgctcaaaaccactgcatcccggactttgttac

SEQ ID NO: 56574 - DNA, 35 bp, Artificial Sequence
  Synthetic oligonucleotide
agccacctcttgtaaactcataacctgactgaacc

SEQ ID NO: 56575 - DNA, 35 bp, Artificial Sequence
  Synthetic oligonucleotide
gccgtacgctactttttatttccgaccgtattccc

SEQ ID NO: 56576 - DNA, 35 bp, Artificial Sequence
  Synthetic oligonucleotide
atcaccacgggtcaatcaaagcacaaccttattcc

SEQ ID NO: 56577 - DNA, 35 bp, Artificial Sequence
  Synthetic oligonucleotide
attgcccctcacctaccatgtattcatgcccccgc

SEQ ID NO: 56578 - DNA, 35 bp, Artificial Sequence
  Synthetic oligonucleotide
gacccgcatcgtctcttttccccagccgctatggc

SEQ ID NO: 56579 - DNA, 35 bp, Artificial Sequence
  Synthetic oligonucleotide
ttgtagcccgcctaccccccgccacagattcatgc

SEQ ID NO: 56580 - DNA, 36 bp, Artificial Sequence
  Synthetic oligonucleotide
attgtcctgcccaccgtgagtaaattgcatctgtgc

SEQ ID NO: 56581 - DNA, 35 bp, Artificial Sequence
  Synthetic oligonucleotide
tcccgcgaacgcagtgccctagcccgacgtaaatc

SEQ ID NO: 56582 - DNA, 35 bp, Artificial Sequence
  Synthetic oligonucleotide
atcacacatgcgggatgcaacgcgcttaccatatc

SEQ ID NO: 56583 - DNA, 35 bp, Artificial Sequence
  Synthetic oligonucleotide
tcatcgcccacatgaaataacgaaatgcctgattc

SEQ ID NO: 56584 - DNA, 35 bp, Artificial Sequence
  Synthetic oligonucleotide
acaaccaacgacgcgcacggtttttgaactgcaag

SEQ ID NO: 56585 - DNA, 35 bp, Artificial Sequence
  Synthetic oligonucleotide
agttccccacccgtccgattgaaacctcccgttag

SEQ ID NO: 56586 - DNA, 35 bp, Artificial Sequence
  Synthetic oligonucleotide
gacgttccccgggttcaccacgcattgctgtgacg

SEQ ID NO: 56587 - DNA, 35 bp, Artificial Sequence
  Synthetic oligonucleotide
acagccccagtccccccggtcccgagtaacccccg

SEQ ID NO: 56588 - DNA, 36 bp, Artificial Sequence
  Synthetic oligonucleotide
agaaggccggggggagggctaggaggaagccggccg

SEQ ID NO: 56589 - DNA, 35 bp, Artificial Sequence
  Synthetic oligonucleotide
agaaaagtaggtagcgaaatagaagggagggaagg

SEQ ID NO: 56590 - DNA, 35 bp, Artificial Sequence
  Synthetic oligonucleotide
acacaacatccgggccccgactgacagggcacaat

SEQ ID NO: 56591 - DNA, 35 bp, Artificial Sequence
  Synthetic oligonucleotide
agatggagtggggtggggggttttgtatgtgcaat

SEQ ID NO: 56592 - DNA, 35 bp, Artificial Sequence
  Synthetic oligonucleotide
aacctcgcccgtcttgacacccatatagcctacat

SEQ ID NO: 56593 - DNA, 35 bp, Artificial Sequence
  Synthetic oligonucleotide
aataccgcccctgaccacaacacgccgtgttatat

SEQ ID NO: 56594 - DNA, 35 bp, Artificial Sequence
  Synthetic oligonucleotide
tgctaccaccagagtttctactttccgaaccgtat

SEQ ID NO: 56595 - DNA, 35 bp, Artificial Sequence
  Synthetic oligonucleotide
atcggtccactgttagcccactttcctcctggtat

SEQ ID NO: 56596 - DNA, 35 bp, Artificial Sequence
  Synthetic oligonucleotide
ggaagggtaggaggatcgcgtggacactggggact

SEQ ID NO: 56597 - DNA, 35 bp, Artificial Sequence
  Synthetic oligonucleotide
tccgacgatgtaacgtgaactgtttgtcgcttcct

SEQ ID NO: 56598 - DNA, 35 bp, Artificial Sequence
  Synthetic oligonucleotide
aacaagggagtagggggtatatttgtggtatggct

SEQ ID NO: 56599 - DNA, 35 bp, Artificial Sequence
  Synthetic oligonucleotide
atgtcaccgaggcccagaccgcaccacgcttaatt

SEQ ID NO: 56600 - DNA, 35 bp, Artificial Sequence
  Synthetic oligonucleotide
gcctcccgccttacgggtatgatgcctcttatctt

SEQ ID NO: 56601 - DNA, 35 bp, Artificial Sequence
  Synthetic oligonucleotide
atatccacctcacgcggtgttattacctacggttt

SEQ ID NO: 56602 - DNA, 36 bp, Artificial Sequence
  Synthetic oligonucleotide
gggtagagaatagggggggagtcgatcagggttgaa

SEQ ID NO: 56603 - DNA, 36 bp, Artificial Sequence
  Synthetic oligonucleotide
aagccggagagggcggttaaggaaaacgtcagaaca

SEQ ID NO: 56604 - DNA, 35 bp, Artificial Sequence
  Synthetic oligonucleotide
agcaggagtcgctgcctgttgcttccgcccctcca

SEQ ID NO: 56605 - DNA, 36 bp, Artificial Sequence
  Synthetic oligonucleotide
aaaaggtacagcgcatttggtcgtctgcttcctcca

SEQ ID NO: 56606 - DNA, 36 bp, Artificial Sequence
  Synthetic oligonucleotide
cctcgctgaccccccgttgttttatttcctgttcca

SEQ ID NO: 56607 - DNA, 36 bp, Artificial Sequence
  Synthetic oligonucleotide
gacacccaactgcctcgcacgagcgcaaacttcgca

SEQ ID NO: 56608 - DNA, 35 bp, Artificial Sequence
  Synthetic oligonucleotide
acccatccagatatgtcctatggcctcattattca

SEQ ID NO: 56609 - DNA, 35 bp, Artificial Sequence
  Synthetic oligonucleotide
ggagccactaccacagtaatctatactacacttca

SEQ ID NO: 56610 - DNA, 38 bp, Artificial Sequence
  Synthetic oligonucleotide
atgcatgctgctgctgtctatcttattctcgctcaaga

SEQ ID NO: 56611 - DNA, 36 bp, Artificial Sequence
  Synthetic oligonucleotide
acaccgatcaggttgctcccgtgcccactcttaaga

SEQ ID NO: 56612 - DNA, 33 bp, Artificial Sequence
  Synthetic oligonucleotide
gttcaggatccggcctgttgcccccccgcccga

SEQ ID NO: 56613 - DNA, 37 bp, Artificial Sequence
  Synthetic oligonucleotide
tatccctccgtcgtatctcagccaagcacgactccga

SEQ ID NO: 56614 - DNA, 37 bp, Artificial Sequence
  Synthetic oligonucleotide
actcacgtcgtctgtatccttggtctttgctctccga

SEQ ID NO: 56615 - DNA, 37 bp, Artificial Sequence
  Synthetic oligonucleotide
attaccgatctgttgagtttggccaccatctctccga

SEQ ID NO: 56616 - DNA, 37 bp, Artificial Sequence
  Synthetic oligonucleotide
tactcacatcaccttctcgcaactgcgtttgtatcga

SEQ ID NO: 56617 - DNA, 37 bp, Artificial Sequence
  Synthetic oligonucleotide
gtccatctttgcatgcctaccgtacgcttattatcga

SEQ ID NO: 56618 - DNA, 37 bp, Artificial Sequence
  Synthetic oligonucleotide
ggtgtgtcgagcggtgcggcttggtggagtggaggga

SEQ ID NO: 56619 - DNA, 37 bp, Artificial Sequence
  Synthetic oligonucleotide
accagtggtggggtcgtaactcatggagggaactgga

SEQ ID NO: 56620 - DNA, 36 bp, Artificial Sequence
  Synthetic oligonucleotide
aacagccgtagaattgatctacccatcacacctgga

SEQ ID NO: 56621 - DNA, 36 bp, Artificial Sequence
  Synthetic oligonucleotide
tgaggggaaggtttggggaataggccacgccctgga

SEQ ID NO: 56622 - DNA, 37 bp, Artificial Sequence
  Synthetic oligonucleotide
gcccgacctagttccgggcattatcacctctcctgga

SEQ ID NO: 56623 - DNA, 37 bp, Artificial Sequence
  Synthetic oligonucleotide
tttcatgcacgcgtacctactacatctgccgattgga

SEQ ID NO: 56624 - DNA, 37 bp, Artificial Sequence
  Synthetic oligonucleotide
gttggcgcttccaatcttgcatagctctcaccactga

SEQ ID NO: 56625 - DNA, 38 bp, Artificial Sequence
  Synthetic oligonucleotide
agtacgcatggccctcgcggagtatcgccttcccctga

SEQ ID NO: 56626 - DNA, 36 bp, Artificial Sequence
  Synthetic oligonucleotide
tacaagcacccgccacttcctacttcgacctcctga

SEQ ID NO: 56627 - DNA, 38 bp, Artificial Sequence
  Synthetic oligonucleotide
gcccacccatggactagatttacgatcccctttagtga

SEQ ID NO: 56628 - DNA, 38 bp, Artificial Sequence
  Synthetic oligonucleotide
tagggcgaggggggacggatgatgacgggagagggtga

SEQ ID NO: 56629 - DNA, 38 bp, Artificial Sequence
  Synthetic oligonucleotide
tcaagtaccaaccgaccattcctgcctgtcacgtgtga

SEQ ID NO: 56630 - DNA, 38 bp, Artificial Sequence
  Synthetic oligonucleotide
tctcgccatccgccacccgttttcgatcgcttgtgtga

SEQ ID NO: 56631 - DNA, 37 bp, Artificial Sequence
  Synthetic oligonucleotide
taacccacgtgcggttgcttcgtacaccaaaccttga

SEQ ID NO: 56632 - DNA, 38 bp, Artificial Sequence
  Synthetic oligonucleotide
gcctgccactgttctcgcccacccgaggtctccgttga

SEQ ID NO: 56633 - DNA, 38 bp, Artificial Sequence
  Synthetic oligonucleotide
ctgacgatccatatctgttttgactctgcatactttga

SEQ ID NO: 56634 - DNA, 38 bp, Artificial Sequence
  Synthetic oligonucleotide
gactcatgccccatatacgattaagcttgctattttga

SEQ ID NO: 56635 - DNA, 36 bp, Artificial Sequence
  Synthetic oligonucleotide
tttgaaccccgcacattcgagacaacgccctgccta

SEQ ID NO: 56636 - DNA, 36 bp, Artificial Sequence
  Synthetic oligonucleotide
gactacaggcctaagacacgttcaacacccttccta

SEQ ID NO: 56637 - DNA, 35 bp, Artificial Sequence
  Synthetic oligonucleotide
acagggcgggatagggagcggacgtggaagaggta

SEQ ID NO: 56638 - DNA, 35 bp, Artificial Sequence
  Synthetic oligonucleotide
tgtgcaagccattccggtccaatagctgggcgcac

SEQ ID NO: 56639 - DNA, 35 bp, Artificial Sequence
  Synthetic oligonucleotide
acgagtagggaggtagcgggggggcgtgcggtcac

SEQ ID NO: 56640 - DNA, 35 bp, Artificial Sequence
  Synthetic oligonucleotide
atctcagaagatcgaacacgcacgaaacgccttac

SEQ ID NO: 56641 - DNA, 35 bp, Artificial Sequence
  Synthetic oligonucleotide
gactcctcccaggggtgagccactggaacttttac

SEQ ID NO: 56642 - DNA, 35 bp, Artificial Sequence
  Synthetic oligonucleotide
cgcgaaccgtcagccgcctgcttagtgtcttttac

SEQ ID NO: 56643 - DNA, 35 bp, Artificial Sequence
  Synthetic oligonucleotide
agatgcgccgctcggtcccagtttgcatgtccacc

SEQ ID NO: 56644 - DNA, 35 bp, Artificial Sequence
  Synthetic oligonucleotide
acccactcgtgccattccatcctgcaggtgatagc

SEQ ID NO: 56645 - DNA, 35 bp, Artificial Sequence
  Synthetic oligonucleotide
tgccatctgctgccccaacgcggtcgcccattagc

SEQ ID NO: 56646 - DNA, 35 bp, Artificial Sequence
  Synthetic oligonucleotide
tagacaccaatatctgcaaactgactcattgtatc

SEQ ID NO: 56647 - DNA, 35 bp, Artificial Sequence
  Synthetic oligonucleotide
atgtcaacccacggactgtccttgatcccctactc

SEQ ID NO: 56648 - DNA, 35 bp, Artificial Sequence
  Synthetic oligonucleotide
aacctggaggcacgtgcatggcgctttcccagttc

SEQ ID NO: 56649 - DNA, 35 bp, Artificial Sequence
  Synthetic oligonucleotide
gccaatcgcgaaacactcacaccctttgatgcaag

SEQ ID NO: 56650 - DNA, 35 bp, Artificial Sequence
  Synthetic oligonucleotide
agcccatcaccgcggtcctcaagtcgatcccttag

SEQ ID NO: 56651 - DNA, 35 bp, Artificial Sequence
  Synthetic oligonucleotide
gtagcacaaagttgcccgccccggctgtccattcg

SEQ ID NO: 56652 - DNA, 35 bp, Artificial Sequence
  Synthetic oligonucleotide
aaagagagcgaggaggggagcgggagggtgcgggg

SEQ ID NO: 56653 - DNA, 35 bp, Artificial Sequence
  Synthetic oligonucleotide
gacatactctccgattcgaaatgcgatccctctgg

SEQ ID NO: 56654 - DNA, 35 bp, Artificial Sequence
  Synthetic oligonucleotide
gtagtgccccgcagcacccttaacgttcacatctg

SEQ ID NO: 56655 - DNA, 35 bp, Artificial Sequence
  Synthetic oligonucleotide
agttcgacccgatgccacctgtcccttcgcttgat

SEQ ID NO: 56656 - DNA, 35 bp, Artificial Sequence
  Synthetic oligonucleotide
gtgtacacgcattgaggttgtcaccatcttttcct

SEQ ID NO: 56657 - DNA, 35 bp, Artificial Sequence
  Synthetic oligonucleotide
gaacccacgtgaggtcttctcagttcaacacatct

SEQ ID NO: 56658 - DNA, 35 bp, Artificial Sequence
  Synthetic oligonucleotide
tcccctcggtgctggaacgtttcatcgctacctct

SEQ ID NO: 56659 - DNA, 35 bp, Artificial Sequence
  Synthetic oligonucleotide
ccacgtgcatcctgacgctctatttgcattattct

SEQ ID NO: 56660 - DNA, 35 bp, Artificial Sequence
  Synthetic oligonucleotide
aagtagagcgcctcagctactctcatgtaccttct

SEQ ID NO: 56661 - DNA, 35 bp, Artificial Sequence
  Synthetic oligonucleotide
gaggtagtactgcctgccctgacttcgatctttct

SEQ ID NO: 56662 - DNA, 35 bp, Artificial Sequence
  Synthetic oligonucleotide
tgtgccgaagatccccgcaatgcttgtccgccagt

SEQ ID NO: 56663 - DNA, 35 bp, Artificial Sequence
  Synthetic oligonucleotide
aacatgagcacacgacttcgttaaacgtactactt

SEQ ID NO: 56664 - DNA, 35 bp, Artificial Sequence
  Synthetic oligonucleotide
gctcttgccggagcgttggtcgtttctgtcctgtt

SEQ ID NO: 56665 - DNA, 35 bp, Artificial Sequence
  Synthetic oligonucleotide
ttctggcccgggcggccgcattccttacccgcaaa

SEQ ID NO: 56666 - DNA, 36 bp, Artificial Sequence
  Synthetic oligonucleotide
atcgcgcctcccttaactgatttgactcgccgcaaa

SEQ ID NO: 56667 - DNA, 36 bp, Artificial Sequence
  Synthetic oligonucleotide
gagcgcagtcaaataaagggggcacgtgcggtcaaa

SEQ ID NO: 56668 - DNA, 36 bp, Artificial Sequence
  Synthetic oligonucleotide
acgaccggatcggtagggagtaagcgggggtgtcaa

SEQ ID NO: 56669 - DNA, 36 bp, Artificial Sequence
  Synthetic oligonucleotide
gtccagccacaaccgactgtttcacgcgcctttcaa

SEQ ID NO: 56670 - DNA, 35 bp, Artificial Sequence
  Synthetic oligonucleotide
gacgggtgggttgggggcgtggtagagcttcagaa

SEQ ID NO: 56671 - DNA, 36 bp, Artificial Sequence
  Synthetic oligonucleotide
gaggaggaggacccgacggggagttagtgagagtaa

SEQ ID NO: 56672 - DNA, 36 bp, Artificial Sequence
  Synthetic oligonucleotide
gccacgtgagagttgatctgaccaaccacagcttaa

SEQ ID NO: 56673 - DNA, 36 bp, Artificial Sequence
  Synthetic oligonucleotide
tacccacccgtccgctttacccccccggccagttaa

SEQ ID NO: 56674 - DNA, 36 bp, Artificial Sequence
  Synthetic oligonucleotide
tgcactgatccgcgaggtactactcaccagaacaca

SEQ ID NO: 56675 - DNA, 35 bp, Artificial Sequence
  Synthetic oligonucleotide
ggaccgcaatttgagttccgccccacaccaccaca

SEQ ID NO: 56676 - DNA, 36 bp, Artificial Sequence
  Synthetic oligonucleotide
tcacgcttgcccaccggataactttcttactgccca

SEQ ID NO: 56677 - DNA, 36 bp, Artificial Sequence
  Synthetic oligonucleotide
gaagaacgtcatgcagtgcttccattctggcctcca

SEQ ID NO: 56678 - DNA, 36 bp, Artificial Sequence
  Synthetic oligonucleotide
tagtttccgtaccaggccgctctccgcctcgttcca

SEQ ID NO: 56679 - DNA, 36 bp, Artificial Sequence
  Synthetic oligonucleotide
gcgccgttcaacgcgattcggtacccaaattttcca

SEQ ID NO: 56680 - DNA, 36 bp, Artificial Sequence
  Synthetic oligonucleotide
actccctaatcgcatctggattatagccagtatgca

SEQ ID NO: 56681 - DNA, 36 bp, Artificial Sequence
  Synthetic oligonucleotide
gacccccttgtcgtcgtccactcggagcgatgctca

SEQ ID NO: 56682 - DNA, 35 bp, Artificial Sequence
  Synthetic oligonucleotide
acatcttcccgacgcccctgaacgtatggtgctca

SEQ ID NO: 56683 - DNA, 35 bp, Artificial Sequence
  Synthetic oligonucleotide
acggaacaccaccatttgcctacctttatcggtca

SEQ ID NO: 56684 - DNA, 35 bp, Artificial Sequence
  Synthetic oligonucleotide
tcactaagtcccagcgatatcgccttgatctttca

SEQ ID NO: 56685 - DNA, 36 bp, Artificial Sequence
  Synthetic oligonucleotide
tgtaccatcttcaccccgtcagttggtgatttttca

SEQ ID NO: 56686 - DNA, 36 bp, Artificial Sequence
  Synthetic oligonucleotide
gaagctgtccctgcctctgaattcgcccctctcaga

SEQ ID NO: 56687 - DNA, 37 bp, Artificial Sequence
  Synthetic oligonucleotide
ttcggcccattccgccacatcttgctcgtcgccgaga

SEQ ID NO: 56688 - DNA, 36 bp, Artificial Sequence
  Synthetic oligonucleotide
tggactcctacttgcgggcaacacatcattacacga

SEQ ID NO: 56689 - DNA, 37 bp, Artificial Sequence
  Synthetic oligonucleotide
tccacagaccacatcccacccaccaaacattcgacga

SEQ ID NO: 56690 - DNA, 37 bp, Artificial Sequence
  Synthetic oligonucleotide
accccaaccccgtgcacgtttaaatgctaatccccga

SEQ ID NO: 56691 - DNA, 37 bp, Artificial Sequence
  Synthetic oligonucleotide
gtctgccccaaaatggtttgcacgtgtcactgcccga

SEQ ID NO: 56692 - DNA, 37 bp, Artificial Sequence
  Synthetic oligonucleotide
gaggtagtggggggagcgaaatctggacacggatcga

SEQ ID NO: 56693 - DNA, 37 bp, Artificial Sequence
  Synthetic oligonucleotide
tacaacctcacgaggctttcgtgacctcccactagga

SEQ ID NO: 56694 - DNA, 37 bp, Artificial Sequence
  Synthetic oligonucleotide
gcaatccgggctgggagggcatgggtgttacctagga

SEQ ID NO: 56695 - DNA, 37 bp, Artificial Sequence
  Synthetic oligonucleotide
acccggttcagggtacggtaggggcgttactcgggga

SEQ ID NO: 56696 - DNA, 37 bp, Artificial Sequence
  Synthetic oligonucleotide
acgaaccaaccgacgctttctattggacgtggaatga

SEQ ID NO: 56697 - DNA, 38 bp, Artificial Sequence
  Synthetic oligonucleotide
tcccagctcacccccgtgttcatgctgatgcttactga

SEQ ID NO: 56698 - DNA, 38 bp, Artificial Sequence
  Synthetic oligonucleotide
attgcccaggtccacgcgtctgcttgcgccgttcctga

SEQ ID NO: 56699 - DNA, 35 bp, Artificial Sequence
  Synthetic oligonucleotide
gtatcgccgccgcatattgaagtccaccgcgctga

SEQ ID NO: 56700 - DNA, 38 bp, Artificial Sequence
  Synthetic oligonucleotide
gttggaggagagggagtgggcggatcaagaacacgtga

SEQ ID NO: 56701 - DNA, 38 bp, Artificial Sequence
  Synthetic oligonucleotide
tgatccgttgttatgtcgcgcccctccacgcctggtga

SEQ ID NO: 56702 - DNA, 38 bp, Artificial Sequence
  Synthetic oligonucleotide
acgacccgataggctggttctcgacttctctggattga

SEQ ID NO: 56703 - DNA, 38 bp, Artificial Sequence
  Synthetic oligonucleotide
ttcaatccaacctcacttgccactagttgcaggcttga

SEQ ID NO: 56704 - DNA, 36 bp, Artificial Sequence
  Synthetic oligonucleotide
gcctaccacactcacgcccaaagttgacctcgttga

SEQ ID NO: 56705 - DNA, 36 bp, Artificial Sequence
  Synthetic oligonucleotide
tgtgtcgcatcgactcgtccgcccacataatccata

SEQ ID NO: 56706 - DNA, 36 bp, Artificial Sequence
  Synthetic oligonucleotide
tcaagacagcattacctggtatcatttctctgccta

SEQ ID NO: 56707 - DNA, 35 bp, Artificial Sequence
  Synthetic oligonucleotide
aaacagcctgtgatcgttccgcttatgccaccaac

SEQ ID NO: 56708 - DNA, 35 bp, Artificial Sequence
  Synthetic oligonucleotide
acgtagtataaatgcgcatgacctcacgctactac

SEQ ID NO: 56709 - DNA, 35 bp, Artificial Sequence
  Synthetic oligonucleotide
aactcgagcaactccagatccctgcctctttgtac

SEQ ID NO: 56710 - DNA, 35 bp, Artificial Sequence
  Synthetic oligonucleotide
tacccgcaaagcttggagccatttgatagcgcacc

SEQ ID NO: 56711 - DNA, 35 bp, Artificial Sequence
  Synthetic oligonucleotide
ggttacggccctttaagctccgtcctgccttcacc

SEQ ID NO: 56712 - DNA, 34 bp, Artificial Sequence
  Synthetic oligonucleotide
ttcacccagcaaggtatcaccaaggcctccgacc

SEQ ID NO: 56713 - DNA, 35 bp, Artificial Sequence
  Synthetic oligonucleotide
gagccttatccatcgagttttgacgcctttcgccc

SEQ ID NO: 56714 - DNA, 35 bp, Artificial Sequence
  Synthetic oligonucleotide
atgctcccatctatactgctcgtttcaaccgttcc

SEQ ID NO: 56715 - DNA, 36 bp, Artificial Sequence
  Synthetic oligonucleotide
gttcggacagcacctcctgtagtccccccgctaagc

SEQ ID NO: 56716 - DNA, 34 bp, Artificial Sequence
  Synthetic oligonucleotide
accaaaatgcctctctatgaccccccagacgctc

SEQ ID NO: 56717 - DNA, 35 bp, Artificial Sequence
  Synthetic oligonucleotide
gttgtagggccgatcttaccctccctctgtttgtc

SEQ ID NO: 56718 - DNA, 35 bp, Artificial Sequence
  Synthetic oligonucleotide
gttcagtgactctactctccgctccttcgcgcccg

SEQ ID NO: 56719 - DNA, 35 bp, Artificial Sequence
  Synthetic oligonucleotide
ttgccctgacgcccattgacgaagcgagaaatgcg

SEQ ID NO: 56720 - DNA, 35 bp, Artificial Sequence
  Synthetic oligonucleotide
gtgctagccgttgtcgtctcacctttgtctcgtgg

SEQ ID NO: 56721 - DNA, 35 bp, Artificial Sequence
  Synthetic oligonucleotide
gcccccctcatgctcggccggttctaggatgcctg

SEQ ID NO: 56722 - DNA, 35 bp, Artificial Sequence
  Synthetic oligonucleotide
tccacacttcacagtatagtcgtaacctgattctg

SEQ ID NO: 56723 - DNA, 35 bp, Artificial Sequence
  Synthetic oligonucleotide
tctgggtgcctctgcctaccttcttcaccaaggat

SEQ ID NO: 56724 - DNA, 35 bp, Artificial Sequence
  Synthetic oligonucleotide
ggagttaggcaatgagggtcgagggggggatggat

SEQ ID NO: 56725 - DNA, 35 bp, Artificial Sequence
  Synthetic oligonucleotide
gaaccggcacattttcatcacatccacaaacgtat

SEQ ID NO: 56726 - DNA, 35 bp, Artificial Sequence
  Synthetic oligonucleotide
gtccactcgaccttctattcatgatagccagtact

SEQ ID NO: 56727 - DNA, 35 bp, Artificial Sequence
  Synthetic oligonucleotide
tgatggtcaccttctatgaacgctctagccaccct

SEQ ID NO: 56728 - DNA, 35 bp, Artificial Sequence
  Synthetic oligonucleotide
gaccctgtcggtaggtctattcttgctcaaattct

SEQ ID NO: 56729 - DNA, 35 bp, Artificial Sequence
  Synthetic oligonucleotide
tgtagcccctactggttgcacgcctatagctgatt

SEQ ID NO: 56730 - DNA, 36 bp, Artificial Sequence
  Synthetic oligonucleotide
tcaaccctcggtatctgttagtgtccctttctgttt

SEQ ID NO: 56731 - DNA, 35 bp, Artificial Sequence
  Synthetic oligonucleotide
cactcaatgctggcattgctgttccaccttttttt

SEQ ID NO: 56732 - DNA, 37 bp, Artificial Sequence
  Synthetic oligonucleotide
tgattgtttcgcctcgatcgcgtacgcacttaccaaa

SEQ ID NO: 56733 - DNA, 36 bp, Artificial Sequence
  Synthetic oligonucleotide
tcaacggggggtaggaaggagagacatggggcgtaa

SEQ ID NO: 56734 - DNA, 36 bp, Artificial Sequence
  Synthetic oligonucleotide
tcctcctcggcatgtcgtacacaagcttcgaattaa

SEQ ID NO: 56735 - DNA, 36 bp, Artificial Sequence
  Synthetic oligonucleotide
acgtacccttcccgtactatttatagctgtttttaa

SEQ ID NO: 56736 - DNA, 36 bp, Artificial Sequence
  Synthetic oligonucleotide
tatttccaggcgcacgaatcctgttctcatcacaca

SEQ ID NO: 56737 - DNA, 35 bp, Artificial Sequence
  Synthetic oligonucleotide
atggaaccacaaccggttgaaatactctgtgcaca

SEQ ID NO: 56738 - DNA, 35 bp, Artificial Sequence
  Synthetic oligonucleotide
atgccgcgctcctacctagtacgcctgcggataca

SEQ ID NO: 56739 - DNA, 35 bp, Artificial Sequence
  Synthetic oligonucleotide
tagacctacccgaccagtctactgagggctttaca

SEQ ID NO: 56740 - DNA, 36 bp, Artificial Sequence
  Synthetic oligonucleotide
ggacacccaaaaggcctaacacttgacgcaacacca

SEQ ID NO: 56741 - DNA, 36 bp, Artificial Sequence
  Synthetic oligonucleotide
taccacgatcaacggaagctctcaaacgccgcccca

SEQ ID NO: 56742 - DNA, 35 bp, Artificial Sequence
  Synthetic oligonucleotide
accattcatggccaacttacccgcgcggtatccca

SEQ ID NO: 56743 - DNA, 35 bp, Artificial Sequence
  Synthetic oligonucleotide
aatcacccgacgcaagacccccgttccttcgtgca

SEQ ID NO: 56744 - DNA, 36 bp, Artificial Sequence
  Synthetic oligonucleotide
aactcgacatgttaacacattcacccccgacttgca

SEQ ID NO: 56745 - DNA, 37 bp, Artificial Sequence
  Synthetic oligonucleotide
atgtgcaccgccctatgtcactagtgctcccaccaga

SEQ ID NO: 56746 - DNA, 35 bp, Artificial Sequence
  Synthetic oligonucleotide
aaggaaggtcggggctagaacattgaaaaggcaga

SEQ ID NO: 56747 - DNA, 37 bp, Artificial Sequence
  Synthetic oligonucleotide
gaaaaagtggaccagtggggtacggggaaaggagaga

SEQ ID NO: 56748 - DNA, 37 bp, Artificial Sequence
  Synthetic oligonucleotide
tcacacgcagactgaacttccgctgactgacaggaga

SEQ ID NO: 56749 - DNA, 37 bp, Artificial Sequence
  Synthetic oligonucleotide
gccatccgtcactttcatactttggcatagactacga

SEQ ID NO: 56750 - DNA, 37 bp, Artificial Sequence
  Synthetic oligonucleotide
gacacctcctctcacattcacacgcggagccaaccga

SEQ ID NO: 56751 - DNA, 37 bp, Artificial Sequence
  Synthetic oligonucleotide
atggaggcacgttcaagggggagggcacatcaaagga

SEQ ID NO: 56752 - DNA, 35 bp, Artificial Sequence
  Synthetic oligonucleotide
taccgtgaccgctcgcctttcccgctgactgagga

SEQ ID NO: 56753 - DNA, 37 bp, Artificial Sequence
  Synthetic oligonucleotide
gaatcacgcaggaccaccatgaacaaccccctgagga

SEQ ID NO: 56754 - DNA, 38 bp, Artificial Sequence
  Synthetic oligonucleotide
tgaatccctccattgatcaagaccctcgtacaaaatga

SEQ ID NO: 56755 - DNA, 37 bp, Artificial Sequence
  Synthetic oligonucleotide
gtgcgaggccgtgggtgctagagggggcagggaatga

SEQ ID NO: 56756 - DNA, 38 bp, Artificial Sequence
  Synthetic oligonucleotide
acgcgctctgttgatacgcaattcccgcccactcatga

SEQ ID NO: 56757 - DNA, 38 bp, Artificial Sequence
  Synthetic oligonucleotide
taccccaccatttcgacgtcatgtacctgccatactga

SEQ ID NO: 56758 - DNA, 38 bp, Artificial Sequence
  Synthetic oligonucleotide
ttcgacgcccagcacctgattgggccttgtaaccctga

SEQ ID NO: 56759 - DNA, 38 bp, Artificial Sequence
  Synthetic oligonucleotide
gagtcacgcgagctattgttgtcgccgcccgttcctga

SEQ ID NO: 56760 - DNA, 36 bp, Artificial Sequence
  Synthetic oligonucleotide
tcagaacgccagtcctaatcatctaccatcatctga

SEQ ID NO: 56761 - DNA, 38 bp, Artificial Sequence
  Synthetic oligonucleotide
tcagacggggtgaggctaggttttttcgttaggggtga

SEQ ID NO: 56762 - DNA, 35 bp, Artificial Sequence
  Synthetic oligonucleotide
acgcgtgatcacgcacaaccctgtttaccccttga

SEQ ID NO: 56763 - DNA, 38 bp, Artificial Sequence
  Synthetic oligonucleotide
acgatgaaactggccacacaacaatgagcactccttga

SEQ ID NO: 56764 - DNA, 38 bp, Artificial Sequence
  Synthetic oligonucleotide
agttcggtcacttgcctcctctgccaagtctctcttga

SEQ ID NO: 56765 - DNA, 38 bp, Artificial Sequence
  Synthetic oligonucleotide
gacgacgaagggtggcgtaagaagccaatggtggttga

SEQ ID NO: 56766 - DNA, 35 bp, Artificial Sequence
  Synthetic oligonucleotide
actaactcctgccttccacgtctttctggtacata

SEQ ID NO: 56767 - DNA, 36 bp, Artificial Sequence
  Synthetic oligonucleotide
tctattgtgcccgcccgctgcctgtttgaaatgata

SEQ ID NO: 56768 - DNA, 36 bp, Artificial Sequence
  Synthetic oligonucleotide
gtacacgcacttctgtcacgcccgagtatcgcccta

SEQ ID NO: 56769 - DNA, 36 bp, Artificial Sequence
  Synthetic oligonucleotide
gcagactggggtcggtgcacaataaaggggatggta

SEQ ID NO: 56770 - DNA, 36 bp, Artificial Sequence
  Synthetic oligonucleotide
gtcccgcctacagatcagggcccacactactcatta

SEQ ID NO: 56771 - DNA, 35 bp, Artificial Sequence
  Synthetic oligonucleotide
ggacgactgatgttgccattatccactcgccgccc

SEQ ID NO: 56772 - DNA, 35 bp, Artificial Sequence
  Synthetic oligonucleotide
taggacgcatggcttctgttcagctctgctacgcc

SEQ ID NO: 56773 - DNA, 35 bp, Artificial Sequence
  Synthetic oligonucleotide
gcattccccgtagtacgagcacgaagctccccgcc

SEQ ID NO: 56774 - DNA, 35 bp, Artificial Sequence
  Synthetic oligonucleotide
aacccgcttgtacgtaacgcctgccacagacttcc

SEQ ID NO: 56775 - DNA, 35 bp, Artificial Sequence
  Synthetic oligonucleotide
acacctgagccggagtggatcttctgaattgcggc

SEQ ID NO: 56776 - DNA, 35 bp, Artificial Sequence
  Synthetic oligonucleotide
gttcccagcccccactctgcgttcttgatctcatc

SEQ ID NO: 56777 - DNA, 35 bp, Artificial Sequence
  Synthetic oligonucleotide
gtcttgactgtcccctgctcgaggagaactttatc

SEQ ID NO: 56778 - DNA, 35 bp, Artificial Sequence
  Synthetic oligonucleotide
aacacacctacaccctcggctaggcaggcccgctc

SEQ ID NO: 56779 - DNA, 35 bp, Artificial Sequence
  Synthetic oligonucleotide
gtttggtcggcccactaggaccaaggccacttctc

SEQ ID NO: 56780 - DNA, 35 bp, Artificial Sequence
  Synthetic oligonucleotide
atgccgcgactagtccctgcctaaaacctcaattc

SEQ ID NO: 56781 - DNA, 35 bp, Artificial Sequence
  Synthetic oligonucleotide
taccgccgggggtggcacgcgaatttcttggtttc

SEQ ID NO: 56782 - DNA, 35 bp, Artificial Sequence
  Synthetic oligonucleotide
gtgtgtggaaagggggatgacatggttaagggcag

SEQ ID NO: 56783 - DNA, 35 bp, Artificial Sequence
  Synthetic oligonucleotide
acctggagccgtaataggagggatataatggttgg

SEQ ID NO: 56784 - DNA, 35 bp, Artificial Sequence
  Synthetic oligonucleotide
gaccccgctcgcgagtcctacccgcagtttccctg

SEQ ID NO: 56785 - DNA, 35 bp, Artificial Sequence
  Synthetic oligonucleotide
tccacgcgggaggagctactatacatacgggtttg

SEQ ID NO: 56786 - DNA, 35 bp, Artificial Sequence
  Synthetic oligonucleotide
gatcctacaccggtacatagtacggctacccttat

SEQ ID NO: 56787 - DNA, 35 bp, Artificial Sequence
  Synthetic oligonucleotide
ttcacctacggacacgattcgattaaccattcact

SEQ ID NO: 56788 - DNA, 35 bp, Artificial Sequence
  Synthetic oligonucleotide
gtgcacgcctggttaatatactggttcatattcct

SEQ ID NO: 56789 - DNA, 35 bp, Artificial Sequence
  Synthetic oligonucleotide
gcacgcaattaacccagtagcaattgcttttctct

SEQ ID NO: 56790 - DNA, 35 bp, Artificial Sequence
  Synthetic oligonucleotide
gtgggagaggggacgtggacctgatagctgttggt

SEQ ID NO: 56791 - DNA, 35 bp, Artificial Sequence
  Synthetic oligonucleotide
tttgatcccgctgtttgacttttggaacgaattgt

SEQ ID NO: 56792 - DNA, 35 bp, Artificial Sequence
  Synthetic oligonucleotide
tgtatggtcgcaccctcaaccccctttctgtttgt

SEQ ID NO: 56793 - DNA, 35 bp, Artificial Sequence
  Synthetic oligonucleotide
acccaatgtgtcccatctcgtccgggcttgacctt

SEQ ID NO: 56794 - DNA, 35 bp, Artificial Sequence
  Synthetic oligonucleotide
tcccatccctactctagatagtgtaccgcctggtt

SEQ ID NO: 56795 - DNA, 35 bp, Artificial Sequence
  Synthetic oligonucleotide
gtaaaccaccattatctgcgtagacgctggccttt

SEQ ID NO: 56796 - DNA, 35 bp, Artificial Sequence
  Synthetic oligonucleotide
tgaaacccgctccctgtcctacactgtccatcaaa

SEQ ID NO: 56797 - DNA, 36 bp, Artificial Sequence
  Synthetic oligonucleotide
tcatcgctatctgacctggcttgttcagttgttaaa

SEQ ID NO: 56798 - DNA, 36 bp, Artificial Sequence
  Synthetic oligonucleotide
gacgtgtatgtagggatggggttgtagaaagagtaa

SEQ ID NO: 56799 - DNA, 36 bp, Artificial Sequence
  Synthetic oligonucleotide
gtgtagagagtgggttgaagggaagacagaacgaca

SEQ ID NO: 56800 - DNA, 36 bp, Artificial Sequence
  Synthetic oligonucleotide
gtccacctttacgctattcgcgacctggtcactaca

SEQ ID NO: 56801 - DNA, 35 bp, Artificial Sequence
  Synthetic oligonucleotide
atgcacgacatctcattgttttcctcgcaccacca

SEQ ID NO: 56802 - DNA, 36 bp, Artificial Sequence
  Synthetic oligonucleotide
gttacaccatccccagttcctcagtctcggttacca

SEQ ID NO: 56803 - DNA, 35 bp, Artificial Sequence
  Synthetic oligonucleotide
gttggggaatggcgggttgagagcaggggttagca

SEQ ID NO: 56804 - DNA, 37 bp, Artificial Sequence
  Synthetic oligonucleotide
gcctccccgtactgctgggcctacgcttcataataga

SEQ ID NO: 56805 - DNA, 35 bp, Artificial Sequence
  Synthetic oligonucleotide
tgacctacccggagatactaacccttgccttacga

SEQ ID NO: 56806 - DNA, 37 bp, Artificial Sequence
  Synthetic oligonucleotide
tgtcccccactacatctacaccctgtaccatttcgga

SEQ ID NO: 56807 - DNA, 38 bp, Artificial Sequence
  Synthetic oligonucleotide
taggcgaagcccccccctgaaccgtgacttgaacatga

SEQ ID NO: 56808 - DNA, 38 bp, Artificial Sequence
  Synthetic oligonucleotide
ggagggcggggatacgtggggggctggcggtaacatga

SEQ ID NO: 56809 - DNA, 38 bp, Artificial Sequence
  Synthetic oligonucleotide
atgggtgggtcggagggagtatgaggttcgactgatga

SEQ ID NO: 56810 - DNA, 38 bp, Artificial Sequence
  Synthetic oligonucleotide
agtccacacgcctcggtatttacatacaccctcactga

SEQ ID NO: 56811 - DNA, 37 bp, Artificial Sequence
  Synthetic oligonucleotide
atcgccctccctgagtttagtactatttcaaacctga

SEQ ID NO: 56812 - DNA, 38 bp, Artificial Sequence
  Synthetic oligonucleotide
taccacttcccctgcgcataccggatcccgctatctga

SEQ ID NO: 56813 - DNA, 36 bp, Artificial Sequence
  Synthetic oligonucleotide
accctgcctcacaccattatcgacgcccggctctga

SEQ ID NO: 56814 - DNA, 37 bp, Artificial Sequence
  Synthetic oligonucleotide
gaggggaagtaagtaaaggggtttgggaggcaattga

SEQ ID NO: 56815 - DNA, 38 bp, Artificial Sequence
  Synthetic oligonucleotide
tatgcgtgacgggtgggttctaaacgggaaagggttga

SEQ ID NO: 56816 - DNA, 38 bp, Artificial Sequence
  Synthetic oligonucleotide
gacgagtggggagacggataaggagggtgcagggttga

SEQ ID NO: 56817 - DNA, 38 bp, Artificial Sequence
  Synthetic oligonucleotide
acaactcacacgtccccccgggtatgggccccatttga

SEQ ID NO: 56818 - DNA, 38 bp, Artificial Sequence
  Synthetic oligonucleotide
tccccagcatcgccgcgctgctttgcttatctctttga

SEQ ID NO: 56819 - DNA, 38 bp, Artificial Sequence
  Synthetic oligonucleotide
gcgaatgcgcctgcacttacttattattacctgtttga

SEQ ID NO: 56820 - DNA, 36 bp, Artificial Sequence
  Synthetic oligonucleotide
gccacttccctctctgacgagttgctgtgccccata

SEQ ID NO: 56821 - DNA, 36 bp, Artificial Sequence
  Synthetic oligonucleotide
tgagacttaaatggctactcgcaggaccccctccta

SEQ ID NO: 56822 - DNA, 36 bp, Artificial Sequence
  Synthetic oligonucleotide
gtagtataggggagggaatgggaggtacagtatcta

SEQ ID NO: 56823 - DNA, 36 bp, Artificial Sequence
  Synthetic oligonucleotide
aatacggtgcaggccttcccaccatgcctccttgta

SEQ ID NO: 56824 - DNA, 36 bp, Artificial Sequence
  Synthetic oligonucleotide
aagctgcaagcccagagtcccaccttatcgaattta

SEQ ID NO: 56825 - DNA, 36 bp, Artificial Sequence
  Synthetic oligonucleotide
tctgatcccgtccatttaggatctcgacctgtttta

SEQ ID NO: 56826 - DNA, 35 bp, Artificial Sequence
  Synthetic oligonucleotide
ttcctctgccgtatcgtcggtcacataggcttaac

SEQ ID NO: 56827 - DNA, 35 bp, Artificial Sequence
  Synthetic oligonucleotide
gtacccccccaggccaataataactgcgatgtgac

SEQ ID NO: 56828 - DNA, 35 bp, Artificial Sequence
  Synthetic oligonucleotide
tcaaacatgcgcccatcccggtctagacccctacc

SEQ ID NO: 56829 - DNA, 35 bp, Artificial Sequence
  Synthetic oligonucleotide
ggacacgccgagttttcctctggttcattaaaccc

SEQ ID NO: 56830 - DNA, 35 bp, Artificial Sequence
  Synthetic oligonucleotide
gtggggcgattgcactacagtcaccctgttacccc

SEQ ID NO: 56831 - DNA, 35 bp, Artificial Sequence
  Synthetic oligonucleotide
tcagccttacttgtgccctttccaccgcctgcgcc

SEQ ID NO: 56832 - DNA, 35 bp, Artificial Sequence
  Synthetic oligonucleotide
taaggggtgacaagacgatggggaaagggggaagc

SEQ ID NO: 56833 - DNA, 35 bp, Artificial Sequence
  Synthetic oligonucleotide
tagcgccgctcgctacacaacctcaaaccgctgtc

SEQ ID NO: 56834 - DNA, 35 bp, Artificial Sequence
  Synthetic oligonucleotide
gtaacgccccctttcgcctctgattcgaagataag

SEQ ID NO: 56835 - DNA, 35 bp, Artificial Sequence
  Synthetic oligonucleotide
tacccacggacctccactcacctggagatgagacg

SEQ ID NO: 56836 - DNA, 35 bp, Artificial Sequence
  Synthetic oligonucleotide
gccagaccggaatgtgcaaaccccctttcttttcg

SEQ ID NO: 56837 - DNA, 35 bp, Artificial Sequence
  Synthetic oligonucleotide
tccgtgacagcgtgggagggaggtacggggcgtgg

SEQ ID NO: 56838 - DNA, 35 bp, Artificial Sequence
  Synthetic oligonucleotide
gcacgacatcagatataaaggtatggaaggacatg

SEQ ID NO: 56839 - DNA, 35 bp, Artificial Sequence
  Synthetic oligonucleotide
tacagatctgctcctacccttgctcctgtagtaat

SEQ ID NO: 56840 - DNA, 34 bp, Artificial Sequence
  Synthetic oligonucleotide
tgtacataggggcggggcatggcgggggggatat

SEQ ID NO: 56841 - DNA, 35 bp, Artificial Sequence
  Synthetic oligonucleotide
tcaggaactcgccaggtggtctcctgtcctatcct

SEQ ID NO: 56842 - DNA, 35 bp, Artificial Sequence
  Synthetic oligonucleotide
gctggccccgtcttacccgtcagatagaccttgct

SEQ ID NO: 56843 - DNA, 35 bp, Artificial Sequence
  Synthetic oligonucleotide
gaagtgtgggagggtgcaaggccgcggcgagcagt

SEQ ID NO: 56844 - DNA, 35 bp, Artificial Sequence
  Synthetic oligonucleotide
gccactttccaacgggtactaaatcaattgtgctt

SEQ ID NO: 56845 - DNA, 36 bp, Artificial Sequence
  Synthetic oligonucleotide
tcacgcgcgggtattgagcggagggaaaagtacaaa

SEQ ID NO: 56846 - DNA, 36 bp, Artificial Sequence
  Synthetic oligonucleotide
agtggccagcactagtaccgtccccttccctggaaa

SEQ ID NO: 56847 - DNA, 36 bp, Artificial Sequence
  Synthetic oligonucleotide
acaatgagggtgtgtgtggaaggccggaagcaacaa

SEQ ID NO: 56848 - DNA, 36 bp, Artificial Sequence
  Synthetic oligonucleotide
tgacactgcaagcctgtgttcttcactgatccacca

SEQ ID NO: 56849 - DNA, 36 bp, Artificial Sequence
  Synthetic oligonucleotide
acacatccccagctggtacatacctaccctcaccca

SEQ ID NO: 56850 - DNA, 36 bp, Artificial Sequence
  Synthetic oligonucleotide
tgtctaacaccatgcagctactaagaactctcctca

SEQ ID NO: 56851 - DNA, 36 bp, Artificial Sequence
  Synthetic oligonucleotide
ttaccgctggacccgagatatcgttcaccctgttca

SEQ ID NO: 56852 - DNA, 37 bp, Artificial Sequence
  Synthetic oligonucleotide
accgcaccaagcatcctgaactctgccccatcaaaga

SEQ ID NO: 56853 - DNA, 36 bp, Artificial Sequence
  Synthetic oligonucleotide
tacgtcgcactcacttttcacgctgtcgaatcacga

SEQ ID NO: 56854 - DNA, 37 bp, Artificial Sequence
  Synthetic oligonucleotide
ggagagacgaaggtaaataggaggagcgggcatacga

SEQ ID NO: 56855 - DNA, 37 bp, Artificial Sequence
  Synthetic oligonucleotide
tcacgcctgccccgctacgtactctctagacccccga

SEQ ID NO: 56856 - DNA, 37 bp, Artificial Sequence
  Synthetic oligonucleotide
tagctcgctaacgcccgcccactgatctactcatcga

SEQ ID NO: 56857 - DNA, 37 bp, Artificial Sequence
  Synthetic oligonucleotide
atcgcccccattttcgtgactactgtgcccaagtcga

SEQ ID NO: 56858 - DNA, 37 bp, Artificial Sequence
  Synthetic oligonucleotide
tgttcatcatccggtctttagtcgcggttcatttcga

SEQ ID NO: 56859 - DNA, 36 bp, Artificial Sequence
  Synthetic oligonucleotide
gagtgaccatagggtgttcggaaaagaagggcagga

SEQ ID NO: 56860 - DNA, 38 bp, Artificial Sequence
  Synthetic oligonucleotide
gcaaccacgtgcctgcttctcgctatacccgataatga

SEQ ID NO: 56861 - DNA, 38 bp, Artificial Sequence
  Synthetic oligonucleotide
acgaagcacaatcgcgcacccgaatcagactccgctga

SEQ ID NO: 56862 - DNA, 38 bp, Artificial Sequence
  Synthetic oligonucleotide
ttagtggccaggtgggatggaggtggaatgaatggtga

SEQ ID NO: 56863 - DNA, 38 bp, Artificial Sequence
  Synthetic oligonucleotide
gagatgccactagctttgtcctctcgcacattcattga

SEQ ID NO: 56864 - DNA, 38 bp, Artificial Sequence
  Synthetic oligonucleotide
acacgcctcacgcttgctacctttcatccggttcttga

SEQ ID NO: 56865 - DNA, 38 bp, Artificial Sequence
  Synthetic oligonucleotide
aacgtcaatgggaagggagcgtgtagtgggatggttga

SEQ ID NO: 56866 - DNA, 38 bp, Artificial Sequence
  Synthetic oligonucleotide
acgcggggggtggcgccgtggcttggggaggggtttga

SEQ ID NO: 56867 - DNA, 38 bp, Artificial Sequence
  Synthetic oligonucleotide
tagcactccgtctctgccaccgactattaagcttttga

SEQ ID NO: 56868 - DNA, 34 bp, Artificial Sequence
  Synthetic oligonucleotide
acccccgcgaaaccaggaaagaccgctgtcgcta

SEQ ID NO: 56869 - DNA, 36 bp, Artificial Sequence
  Synthetic oligonucleotide
gactgcagtggagcggaatgcaggccgttagggcta

SEQ ID NO: 56870 - DNA, 35 bp, Artificial Sequence
  Synthetic oligonucleotide
gactccccacaaacgcacattccgcctgtgccgta

SEQ ID NO: 56871 - DNA, 36 bp, Artificial Sequence
  Synthetic oligonucleotide
ggggcggaaagggggtgaccggggtgtggttgggta

SEQ ID NO: 56872 - DNA, 35 bp, Artificial Sequence
  Synthetic oligonucleotide
gagactcacccgctttggtccttggaatttcatta

SEQ ID NO: 56873 - DNA, 36 bp, Artificial Sequence
  Synthetic oligonucleotide
tactgcctatctgggccatccgattactgattctta

SEQ ID NO: 56874 - DNA, 36 bp, Artificial Sequence
  Synthetic oligonucleotide
ttctgcccattgacgctactacaatttcccatgtta

SEQ ID NO: 56875 - DNA, 34 bp, Artificial Sequence
  Synthetic oligonucleotide
gtgacctcgaaccccgggaattcaactggtgaac

SEQ ID NO: 56876 - DNA, 35 bp, Artificial Sequence
  Synthetic oligonucleotide
accggcacccctctagcgcatactacgactaccac

SEQ ID NO: 56877 - DNA, 35 bp, Artificial Sequence
  Synthetic oligonucleotide
gttccccgttaccaatatgtgacgctcattcgtac

SEQ ID NO: 56878 - DNA, 35 bp, Artificial Sequence
  Synthetic oligonucleotide
gcccatctagttacacagtctgtttacactgaacc

SEQ ID NO: 56879 - DNA, 35 bp, Artificial Sequence
  Synthetic oligonucleotide
attcccacacagttctgttcgcactatggtgcacc

SEQ ID NO: 56880 - DNA, 35 bp, Artificial Sequence
  Synthetic oligonucleotide
atgcgcgtctcgtcgagtttccacctgcctgcgcc

SEQ ID NO: 56881 - DNA, 35 bp, Artificial Sequence
  Synthetic oligonucleotide
taccatccagagcatatcgtctcaacacttcggcc

SEQ ID NO: 56882 - DNA, 35 bp, Artificial Sequence
  Synthetic oligonucleotide
tcacaccgtatgacttttaacctctgctggcctcc

SEQ ID NO: 56883 - DNA, 35 bp, Artificial Sequence
  Synthetic oligonucleotide
tgaatcctcacttgcaggccctcgtccacttccgc

SEQ ID NO: 56884 - DNA, 35 bp, Artificial Sequence
  Synthetic oligonucleotide
attgacttggcggcctgggaacgctaccttctctc

SEQ ID NO: 56885 - DNA, 35 bp, Artificial Sequence
  Synthetic oligonucleotide
tgcccttctggcagtttgcactgacgatgcccttc

SEQ ID NO: 56886 - DNA, 35 bp, Artificial Sequence
  Synthetic oligonucleotide
gaattatgaacgtggaatagagtaagggatgggag

SEQ ID NO: 56887 - DNA, 35 bp, Artificial Sequence
  Synthetic oligonucleotide
agaatgggaggcggagaggcaggcttcgtgaatag

SEQ ID NO: 56888 - DNA, 35 bp, Artificial Sequence
  Synthetic oligonucleotide
acacgccgcaggtaaccctaactgttgcaacaacg

SEQ ID NO: 56889 - DNA, 35 bp, Artificial Sequence
  Synthetic oligonucleotide
gatacaggccgacggggagaagtaggggttcaagg

SEQ ID NO: 56890 - DNA, 35 bp, Artificial Sequence
  Synthetic oligonucleotide
tcttcccgtccgttgttcgaccgtccacatccatg

SEQ ID NO: 56891 - DNA, 35 bp, Artificial Sequence
  Synthetic oligonucleotide
tcccgatcccgcgaacttattatgtactaaacctg

SEQ ID NO: 56892 - DNA, 35 bp, Artificial Sequence
  Synthetic oligonucleotide
tagaagtgcaattgcgcacataaccgtattacctg

SEQ ID NO: 56893 - DNA, 35 bp, Artificial Sequence
  Synthetic oligonucleotide
tgacgacccagcgattaaccctagtatttactcct

SEQ ID NO: 56894 - DNA, 35 bp, Artificial Sequence
  Synthetic oligonucleotide
tgtgtggtctcggcctgtactcatctaaccacgct

SEQ ID NO: 56895 - DNA, 35 bp, Artificial Sequence
  Synthetic oligonucleotide
agcaacagcagttgctaatgggggatcatttctct

SEQ ID NO: 56896 - DNA, 35 bp, Artificial Sequence
  Synthetic oligonucleotide
atggccccgctgcccccgggatatttttcctgtgt

SEQ ID NO: 56897 - DNA, 35 bp, Artificial Sequence
  Synthetic oligonucleotide
tctatcgggtagcagggggtttagcaatgggggtt

SEQ ID NO: 56898 - DNA, 35 bp, Artificial Sequence
  Synthetic oligonucleotide
tcagccgatcgtgccgtccgctccgttgcgccttt

SEQ ID NO: 56899 - DNA, 35 bp, Artificial Sequence
  Synthetic oligonucleotide
tcacgcacggattatgactcactaactgggcccaa

SEQ ID NO: 56900 - DNA, 35 bp, Artificial Sequence
  Synthetic oligonucleotide
ttggaaccatttccgatggttcatgtaccttttaa

SEQ ID NO: 56901 - DNA, 35 bp, Artificial Sequence
  Synthetic oligonucleotide
acttgcccgcatctgctctcggtccgaattggaca

SEQ ID NO: 56902 - DNA, 36 bp, Artificial Sequence
  Synthetic oligonucleotide
gacaatgcagtcgattgaaggcagtaggagtatcca

SEQ ID NO: 56903 - DNA, 32 bp, Artificial Sequence
  Synthetic oligonucleotide
gccgaggcgcttgacttttaaacgtatttcca

SEQ ID NO: 56904 - DNA, 35 bp, Artificial Sequence
  Synthetic oligonucleotide
aatgcccccttatgttccatggctatgcacctgca

SEQ ID NO: 56905 - DNA, 35 bp, Artificial Sequence
  Synthetic oligonucleotide
tcgcgcatcacatcaccatccacatccacggtgca

SEQ ID NO: 56906 - DNA, 36 bp, Artificial Sequence
  Synthetic oligonucleotide
agctcgcacccgttgtggtttcaccgcttacactca

SEQ ID NO: 56907 - DNA, 37 bp, Artificial Sequence
  Synthetic oligonucleotide
gataggaacttgggaacggagacagtaaagaatcaga

SEQ ID NO: 56908 - DNA, 37 bp, Artificial Sequence
  Synthetic oligonucleotide
tgaccccaatcaagctcctgccctcctgcctaggaga

SEQ ID NO: 56909 - DNA, 37 bp, Artificial Sequence
  Synthetic oligonucleotide
tcaccccatacatgtgacgtgcagtgcaccttaacga

SEQ ID NO: 56910 - DNA, 36 bp, Artificial Sequence
  Synthetic oligonucleotide
gtgactgacgctcccaactataccaccacagaccga

SEQ ID NO: 56911 - DNA, 37 bp, Artificial Sequence
  Synthetic oligonucleotide
gccgcgaagcccatccgctgactcgaaactgccccga

SEQ ID NO: 56912 - DNA, 37 bp, Artificial Sequence
  Synthetic oligonucleotide
ttgcgctcagttcgcggctccatcttacgcgtagcga

SEQ ID NO: 56913 - DNA, 37 bp, Artificial Sequence
  Synthetic oligonucleotide
accccgtcgtcacactccatctgaattcttgcttcga

SEQ ID NO: 56914 - DNA, 37 bp, Artificial Sequence
  Synthetic oligonucleotide
gcctacagcacgcacggaacgcccacaggatccagga

SEQ ID NO: 56915 - DNA, 35 bp, Artificial Sequence
  Synthetic oligonucleotide
acatgaaccaaggggacggaaggaagaagcatgga

SEQ ID NO: 56916 - DNA, 37 bp, Artificial Sequence
  Synthetic oligonucleotide
gaacctccgccttccacagtgactctgctttactgga

SEQ ID NO: 56917 - DNA, 36 bp, Artificial Sequence
  Synthetic oligonucleotide
agcactccttcgttttcagcttccctcgcacctgga

SEQ ID NO: 56918 - DNA, 36 bp, Artificial Sequence
  Synthetic oligonucleotide
ggacgtaggggcaaaggcggcgaaagtgggcttgga

SEQ ID NO: 56919 - DNA, 38 bp, Artificial Sequence
  Synthetic oligonucleotide
aaccccgactaccaccagccaactgcattgatccatga

SEQ ID NO: 56920 - DNA, 38 bp, Artificial Sequence
  Synthetic oligonucleotide
tgtccatgtacatgtgcgtctgttctttttctttatga

SEQ ID NO: 56921 - DNA, 37 bp, Artificial Sequence
  Synthetic oligonucleotide
attgaggcgctgtccttggttttcttccggtttatga

SEQ ID NO: 56922 - DNA, 38 bp, Artificial Sequence
  Synthetic oligonucleotide
gagctacacccatgccgttcactaagctcaccaactga

SEQ ID NO: 56923 - DNA, 38 bp, Artificial Sequence
  Synthetic oligonucleotide
tacatgtccagttctcggcctcagttgtccccccctga

SEQ ID NO: 56924 - DNA, 37 bp, Artificial Sequence
  Synthetic oligonucleotide
atcatacgcgtcctctgacttctctgccctgccctga

SEQ ID NO: 56925 - DNA, 38 bp, Artificial Sequence
  Synthetic oligonucleotide
gtacgcaatcggtttctgttttcaggcgtacttcctga

SEQ ID NO: 56926 - DNA, 38 bp, Artificial Sequence
  Synthetic oligonucleotide
aactgcaggaaaatagcgggagggagtacgttgtctga

SEQ ID NO: 56927 - DNA, 38 bp, Artificial Sequence
  Synthetic oligonucleotide
tgcccaccaaattctgcattgctacccatcaaccgtga

SEQ ID NO: 56928 - DNA, 37 bp, Artificial Sequence
  Synthetic oligonucleotide
ggaggtctgctccgtgccccccagatcacctccttga

SEQ ID NO: 56929 - DNA, 38 bp, Artificial Sequence
  Synthetic oligonucleotide
tcctcgcggccccatgaaacgctccactgacagcttga

SEQ ID NO: 56930 - DNA, 38 bp, Artificial Sequence
  Synthetic oligonucleotide
tatgccccgagtcctcccctgaactaatgtcggcttga

SEQ ID NO: 56931 - DNA, 38 bp, Artificial Sequence
  Synthetic oligonucleotide
tgtgcggagcgaaagaacacacggaacagggaagttga

SEQ ID NO: 56932 - DNA, 38 bp, Artificial Sequence
  Synthetic oligonucleotide
atgatgggtggtgggaaagcaggtggtgggtcatttga

SEQ ID NO: 56933 - DNA, 38 bp, Artificial Sequence
  Synthetic oligonucleotide
gcgtacagggggaggaaatccgaggggcatatttttga

SEQ ID NO: 56934 - DNA, 36 bp, Artificial Sequence
  Synthetic oligonucleotide
aacccccgccttggcaacgtgctccgaagccgacta

SEQ ID NO: 56935 - DNA, 36 bp, Artificial Sequence
  Synthetic oligonucleotide
cacacaccgcctttactatccccttccatgaggcta

SEQ ID NO: 56936 - DNA, 36 bp, Artificial Sequence
  Synthetic oligonucleotide
ttgtgcctaccttacatcgttgttgcttacccatta

SEQ ID NO: 56937 - DNA, 36 bp, Artificial Sequence
  Synthetic oligonucleotide
tgcaccccatccgcttctcagttatatacggcctta

SEQ ID NO: 56938 - DNA, 35 bp, Artificial Sequence
  Synthetic oligonucleotide
ttcgctagcactacattcgtccgaagcttacccac

SEQ ID NO: 56939 - DNA, 35 bp, Artificial Sequence
  Synthetic oligonucleotide
gacgaacgccaccaaacaatctccgccccctctac

SEQ ID NO: 56940 - DNA, 35 bp, Artificial Sequence
  Synthetic oligonucleotide
tcacactcatcgcgcccacgcatgaatcgtaatcc

SEQ ID NO: 56941 - DNA, 35 bp, Artificial Sequence
  Synthetic oligonucleotide
taccgcgattagtttgcattgtctcttcccactcc

SEQ ID NO: 56942 - DNA, 35 bp, Artificial Sequence
  Synthetic oligonucleotide
tccacacctacgcactgttcaccgatacacgttcc

SEQ ID NO: 56943 - DNA, 35 bp, Artificial Sequence
  Synthetic oligonucleotide
agtaacacatcgtgttggttcctctcatcttccgc

SEQ ID NO: 56944 - DNA, 35 bp, Artificial Sequence
  Synthetic oligonucleotide
ttcacccgaacatctccagtctggccttgaattgc

SEQ ID NO: 56945 - DNA, 35 bp, Artificial Sequence
  Synthetic oligonucleotide
tcgaggggctcttagtcgcagcctattccttcatc

SEQ ID NO: 56946 - DNA, 35 bp, Artificial Sequence
  Synthetic oligonucleotide
gccgttgtaaacggtgtggggccctttgcattatc

SEQ ID NO: 56947 - DNA, 35 bp, Artificial Sequence
  Synthetic oligonucleotide
tcgttacgatagtcgcgccttaggaaccttttctc

SEQ ID NO: 56948 - DNA, 34 bp, Artificial Sequence
  Synthetic oligonucleotide
acacctaccgtgcctttgatatgcactcttgttc

SEQ ID NO: 56949 - DNA, 35 bp, Artificial Sequence
  Synthetic oligonucleotide
gccacctggatcgtttttgtcaatcgcatatttag

SEQ ID NO: 56950 - DNA, 34 bp, Artificial Sequence
  Synthetic oligonucleotide
ggagccaatccacttacgacatgtttctttttcg

SEQ ID NO: 56951 - DNA, 35 bp, Artificial Sequence
  Synthetic oligonucleotide
agcgtgtctggcgagagggagggtagagggaacgg

SEQ ID NO: 56952 - DNA, 35 bp, Artificial Sequence
  Synthetic oligonucleotide
agtacgtgctaactccactttcaccgccctttggg

SEQ ID NO: 56953 - DNA, 35 bp, Artificial Sequence
  Synthetic oligonucleotide
gaaacggacggggggtttgctgacgcaaagatctg

SEQ ID NO: 56954 - DNA, 35 bp, Artificial Sequence
  Synthetic oligonucleotide
gtgcccacttagtgtgactcatctcccttgttttg

SEQ ID NO: 56955 - DNA, 35 bp, Artificial Sequence
  Synthetic oligonucleotide
gatgacctgcctcagctgcaggacgttcgatctat

SEQ ID NO: 56956 - DNA, 35 bp, Artificial Sequence
  Synthetic oligonucleotide
gaaggtggggtggtgcaagcaagtggtctctaact

SEQ ID NO: 56957 - DNA, 35 bp, Artificial Sequence
  Synthetic oligonucleotide
atcacctctcctactgttacggatcttggaccagt

SEQ ID NO: 56958 - DNA, 35 bp, Artificial Sequence
  Synthetic oligonucleotide
aacgggcgacgcaccgttcttgaatactcttgagt

SEQ ID NO: 56959 - DNA, 35 bp, Artificial Sequence
  Synthetic oligonucleotide
tcacccactgcacgaccgtaggcacatcgaaacgt

SEQ ID NO: 56960 - DNA, 35 bp, Artificial Sequence
  Synthetic oligonucleotide
ccacacgtcgactgcctcccaatccgcttttcgtt

SEQ ID NO: 56961 - DNA, 35 bp, Artificial Sequence
  Synthetic oligonucleotide
atgatccgcaactttactatccgcgcgatcccttt

SEQ ID NO: 56962 - DNA, 36 bp, Artificial Sequence
  Synthetic oligonucleotide
gataactctgttgtctactactcactaccatgtaaa

SEQ ID NO: 56963 - DNA, 35 bp, Artificial Sequence
  Synthetic oligonucleotide
taaacgagcccccccgcgcgcaccgacgagcccaa

SEQ ID NO: 56964 - DNA, 35 bp, Artificial Sequence
  Synthetic oligonucleotide
atagaggaggagtggatggtagtgctgtgggccaa

SEQ ID NO: 56965 - DNA, 36 bp, Artificial Sequence
  Synthetic oligonucleotide
gcacacctacgctctttgccaggttcctctgttcaa

SEQ ID NO: 56966 - DNA, 36 bp, Artificial Sequence
  Synthetic oligonucleotide
ttatccacgccaccacgaagggtcctgaaatttcaa

SEQ ID NO: 56967 - DNA, 36 bp, Artificial Sequence
  Synthetic oligonucleotide
gtgagggacgtcggtcgcgaacacaccttacccgaa

SEQ ID NO: 56968 - DNA, 36 bp, Artificial Sequence
  Synthetic oligonucleotide
tctaaggtgaggggtggaaggtatggttggtaggaa

SEQ ID NO: 56969 - DNA, 35 bp, Artificial Sequence
  Synthetic oligonucleotide
gcgaagggggaaggatcggggagacgagccgataa

SEQ ID NO: 56970 - DNA, 35 bp, Artificial Sequence
  Synthetic oligonucleotide
agcggacggtctcatctttgtctcccgtggcctaa

SEQ ID NO: 56971 - DNA, 36 bp, Artificial Sequence
  Synthetic oligonucleotide
agatgatggccgcagactggctcggaaacccgctaa

SEQ ID NO: 56972 - DNA, 36 bp, Artificial Sequence
  Synthetic oligonucleotide
aggacgactgagcgcttgttcccactatccttccca

SEQ ID NO: 56973 - DNA, 36 bp, Artificial Sequence
  Synthetic oligonucleotide
tgagaccacctttctctgcgataatcaggacaagca

SEQ ID NO: 56974 - DNA, 36 bp, Artificial Sequence
  Synthetic oligonucleotide
tgagcgcgtggtctctggtcttgcccttcttcatca

SEQ ID NO: 56975 - DNA, 36 bp, Artificial Sequence
  Synthetic oligonucleotide
ccacctccgcccgtgcgcctaacttgagtactatca

SEQ ID NO: 56976 - DNA, 35 bp, Artificial Sequence
  Synthetic oligonucleotide
gacttcccgcacaacacgtagatccgtgcctctca

SEQ ID NO: 56977 - DNA, 35 bp, Artificial Sequence
  Synthetic oligonucleotide
actcatgcatcgcccactcccactcattacggtca

SEQ ID NO: 56978 - DNA, 37 bp, Artificial Sequence
  Synthetic oligonucleotide
aacccaccatgtcgcattttacagccgttaccacaga

SEQ ID NO: 56979 - DNA, 37 bp, Artificial Sequence
  Synthetic oligonucleotide
gcgaaccctgccatttagcccgccgattccacccaga

SEQ ID NO: 56980 - DNA, 36 bp, Artificial Sequence
  Synthetic oligonucleotide
gaccccgccgtgaacccatatacaccatgctggaga

SEQ ID NO: 56981 - DNA, 37 bp, Artificial Sequence
  Synthetic oligonucleotide
tcgacgctgagctgagcgaaacaaacgaccctcacga

SEQ ID NO: 56982 - DNA, 36 bp, Artificial Sequence
  Synthetic oligonucleotide
actgccacacggacgtaacgggtccacaaacaccga

SEQ ID NO: 56983 - DNA, 36 bp, Artificial Sequence
  Synthetic oligonucleotide
tacgttgccccgagactcattatatccgttgttcga

SEQ ID NO: 56984 - DNA, 37 bp, Artificial Sequence
  Synthetic oligonucleotide
atgagtgctgcagatttcttaggaggatgggggagga

SEQ ID NO: 56985 - DNA, 37 bp, Artificial Sequence
  Synthetic oligonucleotide
tgaccctccatatcaaaaggatacacgcaacccggga

SEQ ID NO: 56986 - DNA, 35 bp, Artificial Sequence
  Synthetic oligonucleotide
gacctgtcagtggctggtgaacatgggtgggtgga

SEQ ID NO: 56987 - DNA, 37 bp, Artificial Sequence
  Synthetic oligonucleotide
gggacggggcctcctcgtgtaccgcctccctccatga

SEQ ID NO: 56988 - DNA, 38 bp, Artificial Sequence
  Synthetic oligonucleotide
agacacaccatccgatcaccccgcttcgcacttcatga

SEQ ID NO: 56989 - DNA, 38 bp, Artificial Sequence
  Synthetic oligonucleotide
tgaggacggtcgggctggggaaatatgaatggggatga

SEQ ID NO: 56990 - DNA, 37 bp, Artificial Sequence
  Synthetic oligonucleotide
gatgcaggtggggggcttgggtccggttcggtgatga

SEQ ID NO: 56991 - DNA, 38 bp, Artificial Sequence
  Synthetic oligonucleotide
accatccgtcccgcttccgcgccgccaatttttgatga

SEQ ID NO: 56992 - DNA, 38 bp, Artificial Sequence
  Synthetic oligonucleotide
taccgctttccggtcgtaagatcagctctccatcctga

SEQ ID NO: 56993 - DNA, 38 bp, Artificial Sequence
  Synthetic oligonucleotide
gagagtggaagggccggcggaggtagggaaaaatctga

SEQ ID NO: 56994 - DNA, 38 bp, Artificial Sequence
  Synthetic oligonucleotide
gaagagggggagtaggtatggagagtcaggtcgagtga

SEQ ID NO: 56995 - DNA, 37 bp, Artificial Sequence
  Synthetic oligonucleotide
gatcaacctactgcctctccggagccaagctacgtga

SEQ ID NO: 56996 - DNA, 38 bp, Artificial Sequence
  Synthetic oligonucleotide
tcagacagaaggagatgatagtgatgcccgggctgtga

SEQ ID NO: 56997 - DNA, 36 bp, Artificial Sequence
  Synthetic oligonucleotide
tggccatacgccaccatccgcctctgctctcattga

SEQ ID NO: 56998 - DNA, 36 bp, Artificial Sequence
  Synthetic oligonucleotide
atgccctgttactctcccgataagcttactacttga

SEQ ID NO: 56999 - DNA, 38 bp, Artificial Sequence
  Synthetic oligonucleotide
tccgcaaggggcctgcctactctaaccataccatttga

SEQ ID NO: 57000 - DNA, 35 bp, Artificial Sequence
  Synthetic oligonucleotide
aaccaggacgggacgccggtcatggaatcaatata

SEQ ID NO: 57001 - DNA, 35 bp, Artificial Sequence
  Synthetic oligonucleotide
atcgacgtggtcagctggcacacgcctccctccta

SEQ ID NO: 57002 - DNA, 35 bp, Artificial Sequence
  Synthetic oligonucleotide
tttgtcgcatcaaacagttcactcaccttaccgta

SEQ ID NO: 57003 - DNA, 35 bp, Artificial Sequence
  Synthetic oligonucleotide
gcatcgcttcgtccctttatcacatttccctgtta

SEQ ID NO: 57004 - DNA, 35 bp, Artificial Sequence
  Synthetic oligonucleotide
atacccacgcatttagttgccttacaacagctaac

SEQ ID NO: 57005 - DNA, 35 bp, Artificial Sequence
  Synthetic oligonucleotide
gccgacacggcccatctagtctcagtcttggccac

SEQ ID NO: 57006 - DNA, 35 bp, Artificial Sequence
  Synthetic oligonucleotide
tgaagcgcgctctccacactgtatagcatgccacc

SEQ ID NO: 57007 - DNA, 35 bp, Artificial Sequence
  Synthetic oligonucleotide
tgtcctgagtcttacgtctatcccggccctccacc

SEQ ID NO: 57008 - DNA, 35 bp, Artificial Sequence
  Synthetic oligonucleotide
gatgtatgcctcttggcaccctgctgttaatcacc

SEQ ID NO: 57009 - DNA, 35 bp, Artificial Sequence
  Synthetic oligonucleotide
gtgcactacactatttgattcccttacgcgttccc

SEQ ID NO: 57010 - DNA, 35 bp, Artificial Sequence
  Synthetic oligonucleotide
ccgtgcccccgcgctccacccactccgtcgtacgc

SEQ ID NO: 57011 - DNA, 35 bp, Artificial Sequence
  Synthetic oligonucleotide
accatgaggcaccatctgcccttgaccgttcgtgc

SEQ ID NO: 57012 - DNA, 27 bp, Artificial Sequence
  Synthetic oligonucleotide
gatggcttgtacccctacgattttctc

SEQ ID NO: 57013 - DNA, 35 bp, Artificial Sequence
  Synthetic oligonucleotide
tctagcgggaggagggggaagattcgctgggagtc

SEQ ID NO: 57014 - DNA, 35 bp, Artificial Sequence
  Synthetic oligonucleotide
tggggagagggggcggttgaggataggcaggggag

SEQ ID NO: 57015 - DNA, 35 bp, Artificial Sequence
  Synthetic oligonucleotide
gatgtcgtcctggaactcccgtcatgcattccacg

SEQ ID NO: 57016 - DNA, 35 bp, Artificial Sequence
  Synthetic oligonucleotide
tacatgctggggggaggaacgagattaagataggg

SEQ ID NO: 57017 - DNA, 35 bp, Artificial Sequence
  Synthetic oligonucleotide
gatccatcctcacatagtaactatccagcagtggg

SEQ ID NO: 57018 - DNA, 35 bp, Artificial Sequence
  Synthetic oligonucleotide
gagtaggtcgatacggtggactgtaggcattggtg

SEQ ID NO: 57019 - DNA, 35 bp, Artificial Sequence
  Synthetic oligonucleotide
gcatgcccgctcacgtcgtcactcgtagttcaaat

SEQ ID NO: 57020 - DNA, 35 bp, Artificial Sequence
  Synthetic oligonucleotide
acacccaccttaccttattggcagtagatcaccct

SEQ ID NO: 57021 - DNA, 35 bp, Artificial Sequence
  Synthetic oligonucleotide
gctaccacccgtccgcacattctgccacgcctcct

SEQ ID NO: 57022 - DNA, 35 bp, Artificial Sequence
  Synthetic oligonucleotide
acacaagcccaaaccaagacccgcgtcaccacgct

SEQ ID NO: 57023 - DNA, 35 bp, Artificial Sequence
  Synthetic oligonucleotide
tcacccaatcgccgtgattcgtccaacatctggct

SEQ ID NO: 57024 - DNA, 35 bp, Artificial Sequence
  Synthetic oligonucleotide
tgttcaaatacgacccccagtccctgcccggtgct

SEQ ID NO: 57025 - DNA, 35 bp, Artificial Sequence
  Synthetic oligonucleotide
gacgaccgtactagacctttccgtgcgatccctct

SEQ ID NO: 57026 - DNA, 35 bp, Artificial Sequence
  Synthetic oligonucleotide
gatagatccacgctgccgtaccctgcacattgtct

SEQ ID NO: 57027 - DNA, 35 bp, Artificial Sequence
  Synthetic oligonucleotide
gtcatgtaccggtgagatcaccctccactcattgt

SEQ ID NO: 57028 - DNA, 35 bp, Artificial Sequence
  Synthetic oligonucleotide
tgccactcctatctgttcccgtgcccattttggtt

SEQ ID NO: 57029 - DNA, 36 bp, Artificial Sequence
  Synthetic oligonucleotide
tctgagatcgcgcaaacctctgtggctcacctccaa

SEQ ID NO: 57030 - DNA, 35 bp, Artificial Sequence
  Synthetic oligonucleotide
tccgacggcccggcccctccacggtctcgcttgaa

SEQ ID NO: 57031 - DNA, 36 bp, Artificial Sequence
  Synthetic oligonucleotide
gaagccactgtggcggcaggagaggaccatgaaaca

SEQ ID NO: 57032 - DNA, 36 bp, Artificial Sequence
  Synthetic oligonucleotide
tatcatgaacggctgtgtttcttggcgctttatcca

SEQ ID NO: 57033 - DNA, 36 bp, Artificial Sequence
  Synthetic oligonucleotide
acaaagccaagggctgtacgtagggaatggaaggca

SEQ ID NO: 57034 - DNA, 36 bp, Artificial Sequence
  Synthetic oligonucleotide
gacaaccctaggccgagctatacagctctttactca

SEQ ID NO: 57035 - DNA, 37 bp, Artificial Sequence
  Synthetic oligonucleotide
gtaggccccttcccccattttttggacccgcccaaga

SEQ ID NO: 57036 - DNA, 37 bp, Artificial Sequence
  Synthetic oligonucleotide
gacgggctaggtcggcaaaggcgggttaacggggaga

SEQ ID NO: 57037 - DNA, 37 bp, Artificial Sequence
  Synthetic oligonucleotide
aactacacaatccgatgactaatttcacactgtacga

SEQ ID NO: 57038 - DNA, 36 bp, Artificial Sequence
  Synthetic oligonucleotide
actccctctgcattccaaatatagcgttcgttacga

SEQ ID NO: 57039 - DNA, 37 bp, Artificial Sequence
  Synthetic oligonucleotide
ttactcagagccaaactattactgccacctgccccga

SEQ ID NO: 57040 - DNA, 36 bp, Artificial Sequence
  Synthetic oligonucleotide
ttgtaatctgtccgcgcgcctcatcgtcctgttcga

SEQ ID NO: 57041 - DNA, 36 bp, Artificial Sequence
  Synthetic oligonucleotide
ggaacatagagtgggatttagcgggtgacgggcgga

SEQ ID NO: 57042 - DNA, 36 bp, Artificial Sequence
  Synthetic oligonucleotide
gcatatgtgggaatagggatctggaatggggaggga

SEQ ID NO: 57043 - DNA, 37 bp, Artificial Sequence
  Synthetic oligonucleotide
taaacaacacgcgtgcggagcgaggggcaggggggga

SEQ ID NO: 57044 - DNA, 37 bp, Artificial Sequence
  Synthetic oligonucleotide
acgattctcacgcaacattgtcatctgctaccttgga

SEQ ID NO: 57045 - DNA, 38 bp, Artificial Sequence
  Synthetic oligonucleotide
tacttcctcctccgacttgggtttgggtccctcaatga

SEQ ID NO: 57046 - DNA, 38 bp, Artificial Sequence
  Synthetic oligonucleotide
actacacgtcgctgctattatttcatcgaccaacatga

SEQ ID NO: 57047 - DNA, 38 bp, Artificial Sequence
  Synthetic oligonucleotide
tgatacggcgcctcgtgctttttcgcctcgttttatga

SEQ ID NO: 57048 - DNA, 38 bp, Artificial Sequence
  Synthetic oligonucleotide
ggatgaccgttcacgaccctgacaataccactcactga

SEQ ID NO: 57049 - DNA, 38 bp, Artificial Sequence
  Synthetic oligonucleotide
ttaaccggcctacgtatttggcgccttccctggactga

SEQ ID NO: 57050 - DNA, 38 bp, Artificial Sequence
  Synthetic oligonucleotide
tattcggaccagccgcaccacccaaactcagcacctga

SEQ ID NO: 57051 - DNA, 38 bp, Artificial Sequence
  Synthetic oligonucleotide
aatcgacaggctcagactaccttcgatccgctacctga

SEQ ID NO: 57052 - DNA, 37 bp, Artificial Sequence
  Synthetic oligonucleotide
tccagtcatcctttcaagcggtttaaaaccatcctga

SEQ ID NO: 57053 - DNA, 38 bp, Artificial Sequence
  Synthetic oligonucleotide
gtctaaaccggccagagttcccctcccgtccttcctga

SEQ ID NO: 57054 - DNA, 38 bp, Artificial Sequence
  Synthetic oligonucleotide
gagtgctgcatcggtgtacaccaatgatttgactctga

SEQ ID NO: 57055 - DNA, 38 bp, Artificial Sequence
  Synthetic oligonucleotide
gtgggaggtggagatagatgggacggggagtcaagtga

SEQ ID NO: 57056 - DNA, 36 bp, Artificial Sequence
  Synthetic oligonucleotide
gtgctcgcgatgattcccctacttccacaccggtga

SEQ ID NO: 57057 - DNA, 38 bp, Artificial Sequence
  Synthetic oligonucleotide
gcgtacaccgccccccgctgatgattcgtgatcattga

SEQ ID NO: 57058 - DNA, 38 bp, Artificial Sequence
  Synthetic oligonucleotide
ttcgaagaccgcattggcgccatcatcccatctcttga

SEQ ID NO: 57059 - DNA, 37 bp, Artificial Sequence
  Synthetic oligonucleotide
atggtccctgccccaccacttactgagatgtcgttga

SEQ ID NO: 57060 - DNA, 38 bp, Artificial Sequence
  Synthetic oligonucleotide
tgcaccatcgcctattccctgttcgtgaacaatgttga

SEQ ID NO: 57061 - DNA, 38 bp, Artificial Sequence
  Synthetic oligonucleotide
tccaacgacgtgggggagcagacttaacggagatttga

SEQ ID NO: 57062 - DNA, 38 bp, Artificial Sequence
  Synthetic oligonucleotide
tgtgcatagttggggggtgggcggcataggcactttga

SEQ ID NO: 57063 - DNA, 36 bp, Artificial Sequence
  Synthetic oligonucleotide
gtcaacttggcataccaactccgccgcaccgcccta

SEQ ID NO: 57064 - DNA, 36 bp, Artificial Sequence
  Synthetic oligonucleotide
gtgccccgccgcttgggtctgaagcctactttccta

SEQ ID NO: 57065 - DNA, 36 bp, Artificial Sequence
  Synthetic oligonucleotide
gcccacacctcgatgaccaacaaggcccgttatcta

SEQ ID NO: 57066 - DNA, 36 bp, Artificial Sequence
  Synthetic oligonucleotide
aaaccgaacgaggagcgagccttatgcgacgaagta

SEQ ID NO: 57067 - DNA, 36 bp, Artificial Sequence
  Synthetic oligonucleotide
gccatcctgctcatgacatctgactctgactaagta

SEQ ID NO: 57068 - DNA, 36 bp, Artificial Sequence
  Synthetic oligonucleotide
tacagtaggtgtggggtggttgggttctggacctta

SEQ ID NO: 57069 - DNA, 35 bp, Artificial Sequence
  Synthetic oligonucleotide
cccaccttcacgtacgtactcgcgttgccataaac

SEQ ID NO: 57070 - DNA, 35 bp, Artificial Sequence
  Synthetic oligonucleotide
gacgacggtggagaggagggcaaagtgtgcaacac

SEQ ID NO: 57071 - DNA, 35 bp, Artificial Sequence
  Synthetic oligonucleotide
tccacatctcacccaagcttctatgcttatagcac

SEQ ID NO: 57072 - DNA, 35 bp, Artificial Sequence
  Synthetic oligonucleotide
tagataacgcggtggtcgtagtacaccattctgcc

SEQ ID NO: 57073 - DNA, 35 bp, Artificial Sequence
  Synthetic oligonucleotide
tactaacaccggtgttgcatgttgacacaggtcgc

SEQ ID NO: 57074 - DNA, 35 bp, Artificial Sequence
  Synthetic oligonucleotide
gccaagtggaaggggggccagcgcggcggaggggc

SEQ ID NO: 57075 - DNA, 35 bp, Artificial Sequence
  Synthetic oligonucleotide
ggcctgactcctgcaatctgccatccagggcactc

SEQ ID NO: 57076 - DNA, 35 bp, Artificial Sequence
  Synthetic oligonucleotide
acaccagcatgtccatctctcgttgctacgttgtc

SEQ ID NO: 57077 - DNA, 35 bp, Artificial Sequence
  Synthetic oligonucleotide
gatagctgggagggggggatcttgtgactacacag

SEQ ID NO: 57078 - DNA, 35 bp, Artificial Sequence
  Synthetic oligonucleotide
acgcgctccctttacgtactttaccgttccacacg

SEQ ID NO: 57079 - DNA, 35 bp, Artificial Sequence
  Synthetic oligonucleotide
ttagctgaatccaacgcacctgaactgtatccccg

SEQ ID NO: 57080 - DNA, 35 bp, Artificial Sequence
  Synthetic oligonucleotide
gccccggaacccgccctaccttgtgagaatcagcg

SEQ ID NO: 57081 - DNA, 35 bp, Artificial Sequence
  Synthetic oligonucleotide
taccgaccggattgctacaaaccgcatgactttcg

SEQ ID NO: 57082 - DNA, 35 bp, Artificial Sequence
  Synthetic oligonucleotide
atgcccgaatctaaagcgtatttgcacacctttcg

SEQ ID NO: 57083 - DNA, 35 bp, Artificial Sequence
  Synthetic oligonucleotide
tagaggagtggtcgggatgaattgggggtgcacgg

SEQ ID NO: 57084 - DNA, 35 bp, Artificial Sequence
  Synthetic oligonucleotide
ggaccacaatccacttaacacttttgcacagcctg

SEQ ID NO: 57085 - DNA, 35 bp, Artificial Sequence
  Synthetic oligonucleotide
agacgccggacacattcccgtttctccgtattctg

SEQ ID NO: 57086 - DNA, 35 bp, Artificial Sequence
  Synthetic oligonucleotide
attccctgcccagccgagcaacagtcccggccttg

SEQ ID NO: 57087 - DNA, 35 bp, Artificial Sequence
  Synthetic oligonucleotide
tcaagtgctagttcattcctactccctccggtttg

SEQ ID NO: 57088 - DNA, 35 bp, Artificial Sequence
  Synthetic oligonucleotide
tgcaagctacattcacctagcacgggctgttacat

SEQ ID NO: 57089 - DNA, 35 bp, Artificial Sequence
  Synthetic oligonucleotide
ttgcgttagcccttccattcgtacttcgctgtgat

SEQ ID NO: 57090 - DNA, 35 bp, Artificial Sequence
  Synthetic oligonucleotide
tgacgccagcccgcatgtcgttccatcgtaggtat

SEQ ID NO: 57091 - DNA, 35 bp, Artificial Sequence
  Synthetic oligonucleotide
tcgtcctgaccccggaatgtccctcgccgcccact

SEQ ID NO: 57092 - DNA, 35 bp, Artificial Sequence
  Synthetic oligonucleotide
acagctgcccacatccttccgagtctcccgttcct

SEQ ID NO: 57093 - DNA, 35 bp, Artificial Sequence
  Synthetic oligonucleotide
gtacgagtgtgattgggagtaagcgagggggcagt

SEQ ID NO: 57094 - DNA, 35 bp, Artificial Sequence
  Synthetic oligonucleotide
gataacgaaggggagaaatgacgggaccttggggt

SEQ ID NO: 57095 - DNA, 36 bp, Artificial Sequence
  Synthetic oligonucleotide
gacctcgccgagcgaacttctaagaccgcctgacaa

SEQ ID NO: 57096 - DNA, 35 bp, Artificial Sequence
  Synthetic oligonucleotide
gagcccacgtgcgcacacatttccctccggaccaa

SEQ ID NO: 57097 - DNA, 36 bp, Artificial Sequence
  Synthetic oligonucleotide
gtacgaaggggcgggtgcgggtagagcaaacaggaa

SEQ ID NO: 57098 - DNA, 36 bp, Artificial Sequence
  Synthetic oligonucleotide
gaggacggtggcaggacgatttaaacgggttgggaa

SEQ ID NO: 57099 - DNA, 35 bp, Artificial Sequence
  Synthetic oligonucleotide
ttcgaccacaacctacttgctacctcctgtgaaca

SEQ ID NO: 57100 - DNA, 35 bp, Artificial Sequence
  Synthetic oligonucleotide
acgagcactcgctcggctaactttttatttcacca

SEQ ID NO: 57101 - DNA, 35 bp, Artificial Sequence
  Synthetic oligonucleotide
gagcgacgcctgtcccacgcgccgttaattcccca

SEQ ID NO: 57102 - DNA, 36 bp, Artificial Sequence
  Synthetic oligonucleotide
ggatggaggagagggattgagggagaaagtgcgcca

SEQ ID NO: 57103 - DNA, 36 bp, Artificial Sequence
  Synthetic oligonucleotide
atcgcgttaacgaggccgaccatcacctttacagca

SEQ ID NO: 57104 - DNA, 36 bp, Artificial Sequence
  Synthetic oligonucleotide
ttcgcgcacttctgtctgtactatccgcgaacgtca

SEQ ID NO: 57105 - DNA, 37 bp, Artificial Sequence
  Synthetic oligonucleotide
gtggaggatatgcagggggtagaatacggccgaaaga

SEQ ID NO: 57106 - DNA, 36 bp, Artificial Sequence
  Synthetic oligonucleotide
gacccccatcacctaagacagtgctaaccccgtaga

SEQ ID NO: 57107 - DNA, 37 bp, Artificial Sequence
  Synthetic oligonucleotide
tactgtagaccagccgcgctccccgccccccatccga

SEQ ID NO: 57108 - DNA, 37 bp, Artificial Sequence
  Synthetic oligonucleotide
gggagggtacatggggcttagggtagtgctaacgcga

SEQ ID NO: 57109 - DNA, 37 bp, Artificial Sequence
  Synthetic oligonucleotide
atggggggtacatgtggcaagtaaggaggattgtgga

SEQ ID NO: 57110 - DNA, 38 bp, Artificial Sequence
  Synthetic oligonucleotide
actaccacgcgcacagaatcctgttttgcggatcatga

SEQ ID NO: 57111 - DNA, 38 bp, Artificial Sequence
  Synthetic oligonucleotide
gtggttacaggctggagatgatgtggcaggtgagatga

SEQ ID NO: 57112 - DNA, 38 bp, Artificial Sequence
  Synthetic oligonucleotide
tgcaccccgccgaacatcttgcatacgatgaaaactga

SEQ ID NO: 57113 - DNA, 37 bp, Artificial Sequence
  Synthetic oligonucleotide
gacaacgggttgcacgggtaggggttgggaagactga

SEQ ID NO: 57114 - DNA, 37 bp, Artificial Sequence
  Synthetic oligonucleotide
ttgtgcgccctcactcgacgttcccaagttgtactga

SEQ ID NO: 57115 - DNA, 37 bp, Artificial Sequence
  Synthetic oligonucleotide
tcagccccgctaaggtcttactgatatgctcgcctga

SEQ ID NO: 57116 - DNA, 38 bp, Artificial Sequence
  Synthetic oligonucleotide
gtgtgctcctccgttcattgggccacagaacttcctga

SEQ ID NO: 57117 - DNA, 38 bp, Artificial Sequence
  Synthetic oligonucleotide
gacccccgtgcagaaaagcaccttgcgccccccggtga

SEQ ID NO: 57118 - DNA, 38 bp, Artificial Sequence
  Synthetic oligonucleotide
cacccacctccactgatcgccacccagtcttcctgtga

SEQ ID NO: 57119 - DNA, 37 bp, Artificial Sequence
  Synthetic oligonucleotide
tcaaccatccctttgctggcccttttgatccgtgtga

SEQ ID NO: 57120 - DNA, 37 bp, Artificial Sequence
  Synthetic oligonucleotide
gcaacaaccaccgcgggtaactcactcctccaattga

SEQ ID NO: 57121 - DNA, 38 bp, Artificial Sequence
  Synthetic oligonucleotide
tcgaagtcgacctctctgcatgaagtttttgccattga

SEQ ID NO: 57122 - DNA, 38 bp, Artificial Sequence
  Synthetic oligonucleotide
acgctggctcctggtctctgggtcattttctctcttga

SEQ ID NO: 57123 - DNA, 37 bp, Artificial Sequence
  Synthetic oligonucleotide
tccctcttcgctgccgtgattttacccacctttttga

SEQ ID NO: 57124 - DNA, 36 bp, Artificial Sequence
  Synthetic oligonucleotide
tcatcggtactttggcaaccgccctataccttacta

SEQ ID NO: 57125 - DNA, 36 bp, Artificial Sequence
  Synthetic oligonucleotide
gtgaaaccgtcgacactacactacactgtttcccta

SEQ ID NO: 57126 - DNA, 35 bp, Artificial Sequence
  Synthetic oligonucleotide
ggtactccaccccacatcttcaggtagacacttta

SEQ ID NO: 57127 - DNA, 36 bp, Artificial Sequence
  Synthetic oligonucleotide
tttagcgccgacgacccctccatccttttgtgttta

SEQ ID NO: 57128 - DNA, 35 bp, Artificial Sequence
  Synthetic oligonucleotide
gaagccaccatgctgacgtactctccggatctgac

SEQ ID NO: 57129 - DNA, 35 bp, Artificial Sequence
  Synthetic oligonucleotide
ttgtgacccgccgttgactcggacgcatttattac

SEQ ID NO: 57130 - DNA, 35 bp, Artificial Sequence
  Synthetic oligonucleotide
gaatgagcgagttctcacgccgcccgtccaccacc

SEQ ID NO: 57131 - DNA, 35 bp, Artificial Sequence
  Synthetic oligonucleotide
tgcctgcacaagtttgtcagctgccgccattcacc

SEQ ID NO: 57132 - DNA, 35 bp, Artificial Sequence
  Synthetic oligonucleotide
aagcacaatggcgtattctccaagtcgcgaaaccc

SEQ ID NO: 57133 - DNA, 35 bp, Artificial Sequence
  Synthetic oligonucleotide
tactgtcgcaaattgtctcatccacccgcgagccc

SEQ ID NO: 57134 - DNA, 35 bp, Artificial Sequence
  Synthetic oligonucleotide
tcatatagtgcaagcaccgaatcagccaacctgcc

SEQ ID NO: 57135 - DNA, 35 bp, Artificial Sequence
  Synthetic oligonucleotide
aatgccaatctcccggtgtgtcttttacacactcc

SEQ ID NO: 57136 - DNA, 35 bp, Artificial Sequence
  Synthetic oligonucleotide
gcgcgccaaatctcagtcttggtatcctctgctcc

SEQ ID NO: 57137 - DNA, 35 bp, Artificial Sequence
  Synthetic oligonucleotide
gccagccgagtttaccttctgctgttccctggtcc

SEQ ID NO: 57138 - DNA, 35 bp, Artificial Sequence
  Synthetic oligonucleotide
ttttagcacccgccgtgacatcccacattccttcc

SEQ ID NO: 57139 - DNA, 35 bp, Artificial Sequence
  Synthetic oligonucleotide
ttcatggcccacgtcccatttgcacaaatccaagc

SEQ ID NO: 57140 - DNA, 35 bp, Artificial Sequence
  Synthetic oligonucleotide
ggaccacacctcccaaaccaagaataggccctagc

SEQ ID NO: 57141 - DNA, 35 bp, Artificial Sequence
  Synthetic oligonucleotide
accacccaatgagccgtattttcgtaaggatgtgc

SEQ ID NO: 57142 - DNA, 35 bp, Artificial Sequence
  Synthetic oligonucleotide
gtatgcaccgctagtttggcatagctcactccttc

SEQ ID NO: 57143 - DNA, 35 bp, Artificial Sequence
  Synthetic oligonucleotide
gcgtacatgtccgcttgtagcgaatcacgcttttc

SEQ ID NO: 57144 - DNA, 35 bp, Artificial Sequence
  Synthetic oligonucleotide
gcaccaatgggggaaatggggacaagactgtgtag

SEQ ID NO: 57145 - DNA, 35 bp, Artificial Sequence
  Synthetic oligonucleotide
tattcctgcctccctattgagtgctgctgttgacg

SEQ ID NO: 57146 - DNA, 35 bp, Artificial Sequence
  Synthetic oligonucleotide
aaaggtggcggtgggaggaaggtggcatggtagcg

SEQ ID NO: 57147 - DNA, 35 bp, Artificial Sequence
  Synthetic oligonucleotide
gtgtgcgcgggtgtatatgcgggagggggttagcg

SEQ ID NO: 57148 - DNA, 35 bp, Artificial Sequence
  Synthetic oligonucleotide
catgtagctactctccccactttactgcgcacctg

SEQ ID NO: 57149 - DNA, 35 bp, Artificial Sequence
  Synthetic oligonucleotide
ttcatgcctcccatatttgtacgcatcccttgctg

SEQ ID NO: 57150 - DNA, 35 bp, Artificial Sequence
  Synthetic oligonucleotide
gagtgaggggagggtcgagtggtcggtgaaaaact

SEQ ID NO: 57151 - DNA, 35 bp, Artificial Sequence
  Synthetic oligonucleotide
gcgatacgcctcggtttttttagcctcactccact

SEQ ID NO: 57152 - DNA, 35 bp, Artificial Sequence
  Synthetic oligonucleotide
tacaagtcaggacaattccatctgctcagtcacct

SEQ ID NO: 57153 - DNA, 35 bp, Artificial Sequence
  Synthetic oligonucleotide
attacatctgcctacatggggtctacgttagacct

SEQ ID NO: 57154 - DNA, 35 bp, Artificial Sequence
  Synthetic oligonucleotide
ttaccccccctctttgatgcataggaccgacgcct

SEQ ID NO: 57155 - DNA, 35 bp, Artificial Sequence
  Synthetic oligonucleotide
taagcttgccccgctctgttgctctcctgcctcct

SEQ ID NO: 57156 - DNA, 36 bp, Artificial Sequence
  Synthetic oligonucleotide
tacgcccagcccaaccctttacttgacgagttacgt

SEQ ID NO: 57157 - DNA, 35 bp, Artificial Sequence
  Synthetic oligonucleotide
tgagctccatcctgcggtgttggattctcttctgt

SEQ ID NO: 57158 - DNA, 35 bp, Artificial Sequence
  Synthetic oligonucleotide
atcctatcgccatcccgagattacaccagtgtatt

SEQ ID NO: 57159 - DNA, 35 bp, Artificial Sequence
  Synthetic oligonucleotide
gcaacctctgttatggccacaggccagtttccttt

SEQ ID NO: 57160 - DNA, 35 bp, Artificial Sequence
  Synthetic oligonucleotide
actagttctcagctgccgggcttacctagttcttt

SEQ ID NO: 57161 - DNA, 35 bp, Artificial Sequence
  Synthetic oligonucleotide
gtgattgaacccctgtaactgtttaggctcatttt

SEQ ID NO: 57162 - DNA, 35 bp, Artificial Sequence
  Synthetic oligonucleotide
gcattcagacgagcctcaggtcgtcatgttttttt

SEQ ID NO: 57163 - DNA, 36 bp, Artificial Sequence
  Synthetic oligonucleotide
gtgttaggaggggtaggactatgagcacagaagaca

SEQ ID NO: 57164 - DNA, 36 bp, Artificial Sequence
  Synthetic oligonucleotide
ggacacatccacgttgtcttcgtattttggtgccca

SEQ ID NO: 57165 - DNA, 36 bp, Artificial Sequence
  Synthetic oligonucleotide
ttagatcccagggcacgtattttccgccgttttcca

SEQ ID NO: 57166 - DNA, 35 bp, Artificial Sequence
  Synthetic oligonucleotide
tacctgtgatccatacgtctctaacttctgtctca

SEQ ID NO: 57167 - DNA, 36 bp, Artificial Sequence
  Synthetic oligonucleotide
gcatttgctgccacatgtcagaacccccttcagtca

SEQ ID NO: 57168 - DNA, 37 bp, Artificial Sequence
  Synthetic oligonucleotide
tgtgacagaaggcggagggggtgcgaggtacagaaga

SEQ ID NO: 57169 - DNA, 37 bp, Artificial Sequence
  Synthetic oligonucleotide
gcgtgggtaggggtagggtgatcatgggggcgtaaga

SEQ ID NO: 57170 - DNA, 37 bp, Artificial Sequence
  Synthetic oligonucleotide
tccgctacgggacatcagccgccgcttctatttacga

SEQ ID NO: 57171 - DNA, 37 bp, Artificial Sequence
  Synthetic oligonucleotide
ttcgaccctagccctcgaaggcaaacgcctttaccga

SEQ ID NO: 57172 - DNA, 37 bp, Artificial Sequence
  Synthetic oligonucleotide
tcactccgatcccgggtgtcatttctcgcctacccga

SEQ ID NO: 57173 - DNA, 37 bp, Artificial Sequence
  Synthetic oligonucleotide
tgcgctgaccacctatttccttcggccccatgcccga

SEQ ID NO: 57174 - DNA, 37 bp, Artificial Sequence
  Synthetic oligonucleotide
acgaccccacagctatgaccaattcatcttcatccga

SEQ ID NO: 57175 - DNA, 37 bp, Artificial Sequence
  Synthetic oligonucleotide
atgcaacggtgcccctctccccctgtgttccccgcga

SEQ ID NO: 57176 - DNA, 35 bp, Artificial Sequence
  Synthetic oligonucleotide
accatgcgatacgcgctctatcttactcactcgga

SEQ ID NO: 57177 - DNA, 36 bp, Artificial Sequence
  Synthetic oligonucleotide
atgtaagggggaaggggaagtttagtgatggtggga

SEQ ID NO: 57178 - DNA, 37 bp, Artificial Sequence
  Synthetic oligonucleotide
gagggtggcgaacgtacgagagcggcggtgggttgga

SEQ ID NO: 57179 - DNA, 38 bp, Artificial Sequence
  Synthetic oligonucleotide
aagacggtacgatcgcgttagggagggggggaagatga

SEQ ID NO: 57180 - DNA, 36 bp, Artificial Sequence
  Synthetic oligonucleotide
gcactcccaggagtgtacgtcacaaagaaaggatga

SEQ ID NO: 57181 - DNA, 37 bp, Artificial Sequence
  Synthetic oligonucleotide
acgatctacccgcccacatgcgcctttctgcaactga

SEQ ID NO: 57182 - DNA, 38 bp, Artificial Sequence
  Synthetic oligonucleotide
gtgcgttccgaaagctcacacaacattgccgtacctga

SEQ ID NO: 57183 - DNA, 38 bp, Artificial Sequence
  Synthetic oligonucleotide
tccccccgactcacactgcgaactcttgcttactctga

SEQ ID NO: 57184 - DNA, 37 bp, Artificial Sequence
  Synthetic oligonucleotide
gtgtcccctgcctttccgtgtgtcacaacctacgtga

SEQ ID NO: 57185 - DNA, 38 bp, Artificial Sequence
  Synthetic oligonucleotide
gtcgggcgatcacacttgcacccgtacacgccacttga

SEQ ID NO: 57186 - DNA, 36 bp, Artificial Sequence
  Synthetic oligonucleotide
gacgccccctcaattcggttttggcatttgacttga

SEQ ID NO: 57187 - DNA, 37 bp, Artificial Sequence
  Synthetic oligonucleotide
tgctcccccccgaattgtgtaatgcacatgtgcttga

SEQ ID NO: 57188 - DNA, 36 bp, Artificial Sequence
  Synthetic oligonucleotide
acagtcaatttgcatcatcacacccgtcccatttga

SEQ ID NO: 57189 - DNA, 38 bp, Artificial Sequence
  Synthetic oligonucleotide
attctgccccattgccctttcagacgccttgcttttga

SEQ ID NO: 57190 - DNA, 36 bp, Artificial Sequence
  Synthetic oligonucleotide
ggacatccccctaatgggccttctattcgacaacta

SEQ ID NO: 57191 - DNA, 36 bp, Artificial Sequence
  Synthetic oligonucleotide
aagccatctggttcgttttgccgttctttcaatcta

SEQ ID NO: 57192 - DNA, 36 bp, Artificial Sequence
  Synthetic oligonucleotide
atgtccgctcttcgtttgttcgttcccccctcatta

SEQ ID NO: 57193 - DNA, 35 bp, Artificial Sequence
  Synthetic oligonucleotide
tagtcgcgtagaacaccactgttgaccacccttta

SEQ ID NO: 57194 - DNA, 35 bp, Artificial Sequence
  Synthetic oligonucleotide
actccccaaccgttggcacgttgataacctgtcac

SEQ ID NO: 57195 - DNA, 35 bp, Artificial Sequence
  Synthetic oligonucleotide
gcatcacccccttcggatactcatgactttcagac

SEQ ID NO: 57196 - DNA, 35 bp, Artificial Sequence
  Synthetic oligonucleotide
taagtgcccttacagtcgtttacctcgtttcctac

SEQ ID NO: 57197 - DNA, 35 bp, Artificial Sequence
  Synthetic oligonucleotide
tcacctcgtgccgacttgctccgttaacaagtacc

SEQ ID NO: 57198 - DNA, 35 bp, Artificial Sequence
  Synthetic oligonucleotide
gggtcgtagcttgcccccggccacccctcaaagcc

SEQ ID NO: 57199 - DNA, 35 bp, Artificial Sequence
  Synthetic oligonucleotide
actgcacaaattacaccacaccgccgaccacagcc

SEQ ID NO: 57200 - DNA, 35 bp, Artificial Sequence
  Synthetic oligonucleotide
aaaatgctgcactcgccattgacgcttacccatgc

SEQ ID NO: 57201 - DNA, 35 bp, Artificial Sequence
  Synthetic oligonucleotide
tcgcgccctaattgatccatccagtagatcctatc

SEQ ID NO: 57202 - DNA, 35 bp, Artificial Sequence
  Synthetic oligonucleotide
tctgcgcctgcatcattactctactgaattgcttc

SEQ ID NO: 57203 - DNA, 35 bp, Artificial Sequence
  Synthetic oligonucleotide
gggacgattagtagcccctcccccatgtgcctttc

SEQ ID NO: 57204 - DNA, 35 bp, Artificial Sequence
  Synthetic oligonucleotide
gcaatgtggaggacaagagtcaggggtacgaaaag

SEQ ID NO: 57205 - DNA, 35 bp, Artificial Sequence
  Synthetic oligonucleotide
gagtgaggtgagtgctacaaaaagagtcgttgacg

SEQ ID NO: 57206 - DNA, 35 bp, Artificial Sequence
  Synthetic oligonucleotide
aaccagacgcgctcacccgctcacttgaactgccg

SEQ ID NO: 57207 - DNA, 35 bp, Artificial Sequence
  Synthetic oligonucleotide
gagctgggggcgggcctaaagggtaaaggcggggg

SEQ ID NO: 57208 - DNA, 35 bp, Artificial Sequence
  Synthetic oligonucleotide
catgacgggggaagaacggaggacattggggtggg

SEQ ID NO: 57209 - DNA, 35 bp, Artificial Sequence
  Synthetic oligonucleotide
ataccaccttcacgggttgaaactctataccatat

SEQ ID NO: 57210 - DNA, 35 bp, Artificial Sequence
  Synthetic oligonucleotide
acacgccggcctctcccaagcttcatatttatgct

SEQ ID NO: 57211 - DNA, 35 bp, Artificial Sequence
  Synthetic oligonucleotide
gacgggcctcccgcatttttgacgccatttactct

SEQ ID NO: 57212 - DNA, 35 bp, Artificial Sequence
  Synthetic oligonucleotide
aaagttgagggaggggggactacatgagagcgatt

SEQ ID NO: 57213 - DNA, 35 bp, Artificial Sequence
  Synthetic oligonucleotide
gcttccacacatctgtcatgcatacgctgtgccaa

SEQ ID NO: 57214 - DNA, 36 bp, Artificial Sequence
  Synthetic oligonucleotide
tagcccccctgctagttatcaccttgccttgtgcaa

SEQ ID NO: 57215 - DNA, 36 bp, Artificial Sequence
  Synthetic oligonucleotide
gcacggtagtgctgattttaaatttttcttttgcaa

SEQ ID NO: 57216 - DNA, 36 bp, Artificial Sequence
  Synthetic oligonucleotide
gaacaacccacaagggaacagtaagggactattgaa

SEQ ID NO: 57217 - DNA, 36 bp, Artificial Sequence
  Synthetic oligonucleotide
gatacacgtgcttcgaccgcttcaccgactcaataa

SEQ ID NO: 57218 - DNA, 36 bp, Artificial Sequence
  Synthetic oligonucleotide
ggtttccacgccaatagcctatccccttgccactaa

SEQ ID NO: 57219 - DNA, 36 bp, Artificial Sequence
  Synthetic oligonucleotide
aagaggcggaatggtggctggtagcggggcggctaa

SEQ ID NO: 57220 - DNA, 34 bp, Artificial Sequence
  Synthetic oligonucleotide
aacaaggtggagggcctgttgagagatgcaaaca

SEQ ID NO: 57221 - DNA, 36 bp, Artificial Sequence
  Synthetic oligonucleotide
ttcagtcagtcgccaccttcgccaggtttcaccaca

SEQ ID NO: 57222 - DNA, 35 bp, Artificial Sequence
  Synthetic oligonucleotide
gtcctccaccacttttaaagcgacgcgcatataca

SEQ ID NO: 57223 - DNA, 35 bp, Artificial Sequence
  Synthetic oligonucleotide
tccaccatagtatgtcttgtaacttccagaatgca

SEQ ID NO: 57224 - DNA, 35 bp, Artificial Sequence
  Synthetic oligonucleotide
tctcaggctccattcgtgggcgtcttacccctgca

SEQ ID NO: 57225 - DNA, 36 bp, Artificial Sequence
  Synthetic oligonucleotide
gctatgcgtccaatctgcccacccaggcgccaatca

SEQ ID NO: 57226 - DNA, 37 bp, Artificial Sequence
  Synthetic oligonucleotide
gagagccacgtgggggtggcaaagtgccggtaaaaga

SEQ ID NO: 57227 - DNA, 36 bp, Artificial Sequence
  Synthetic oligonucleotide
gcatggtagatggcctctcacgttcctgtccacaga

SEQ ID NO: 57228 - DNA, 37 bp, Artificial Sequence
  Synthetic oligonucleotide
agacacccctggccccgtttttaatcctccccagaga

SEQ ID NO: 57229 - DNA, 36 bp, Artificial Sequence
  Synthetic oligonucleotide
atgtcaccgctagtcttactcatctccccataacga

SEQ ID NO: 57230 - DNA, 37 bp, Artificial Sequence
  Synthetic oligonucleotide
acccagattctcacccactgtttttcgtgccatccga

SEQ ID NO: 57231 - DNA, 36 bp, Artificial Sequence
  Synthetic oligonucleotide
tccaccgaggtcaagtgattctagctccacctgcga

SEQ ID NO: 57232 - DNA, 37 bp, Artificial Sequence
  Synthetic oligonucleotide
acaagctcgctgccggtctcgtttcgtatcacttcga

SEQ ID NO: 57233 - DNA, 37 bp, Artificial Sequence
  Synthetic oligonucleotide
gggtaacagtcccatgcatattggctcctcctttcga

SEQ ID NO: 57234 - DNA, 37 bp, Artificial Sequence
  Synthetic oligonucleotide
tagtacgaggctgttgaggtaggagggaagagaggga

SEQ ID NO: 57235 - DNA, 37 bp, Artificial Sequence
  Synthetic oligonucleotide
tttgcaccatccacacgccatagtcttcccaccggga

SEQ ID NO: 57236 - DNA, 37 bp, Artificial Sequence
  Synthetic oligonucleotide
agatggggctgcacgggggattgattaggtgggggga

SEQ ID NO: 57237 - DNA, 37 bp, Artificial Sequence
  Synthetic oligonucleotide
acacaccgctcgtacttgcattgggcgaccttaatga

SEQ ID NO: 57238 - DNA, 38 bp, Artificial Sequence
  Synthetic oligonucleotide
gtggtgtcgccgaccgttgatcatcctcttgcctgtga

SEQ ID NO: 57239 - DNA, 38 bp, Artificial Sequence
  Synthetic oligonucleotide
gttaaccaccttacgaactgccacctggaactgtgtga

SEQ ID NO: 57240 - DNA, 37 bp, Artificial Sequence
  Synthetic oligonucleotide
tagaccgtagaaaggccgctcacccctccgcaattga

SEQ ID NO: 57241 - DNA, 37 bp, Artificial Sequence
  Synthetic oligonucleotide
ggacgctcgggccacctgccttgccacacactattga

SEQ ID NO: 57242 - DNA, 37 bp, Artificial Sequence
  Synthetic oligonucleotide
tagtccgacccgcctgaagctcgagctaaaaccttga

SEQ ID NO: 57243 - DNA, 38 bp, Artificial Sequence
  Synthetic oligonucleotide
ggtacgtctcgtctgcttccgttttattcgcctcttga

SEQ ID NO: 57244 - DNA, 38 bp, Artificial Sequence
  Synthetic oligonucleotide
gtccctgacgcccctgagcactacagtcccgcggttga

SEQ ID NO: 57245 - DNA, 37 bp, Artificial Sequence
  Synthetic oligonucleotide
gacgacaaagcgcaagggagggggtcggacgggttga

SEQ ID NO: 57246 - DNA, 38 bp, Artificial Sequence
  Synthetic oligonucleotide
tgctacgtcaaatccctcgcagaacacattccctttga

SEQ ID NO: 57247 - DNA, 38 bp, Artificial Sequence
  Synthetic oligonucleotide
tgtacatgcgatcccgcgcatatcgactactgctttga

SEQ ID NO: 57248 - DNA, 36 bp, Artificial Sequence
  Synthetic oligonucleotide
accccccacctgccgcgtcattctgcaagctacata

SEQ ID NO: 57249 - DNA, 36 bp, Artificial Sequence
  Synthetic oligonucleotide
atgcccgtacccttcggtattatatggctttaccta

SEQ ID NO: 57250 - DNA, 36 bp, Artificial Sequence
  Synthetic oligonucleotide
aaccccacccttgtgatacacatgtcattatatcta

SEQ ID NO: 57251 - DNA, 36 bp, Artificial Sequence
  Synthetic oligonucleotide
tgcgactgctcgccgtccaatgctacccctctctta

SEQ ID NO: 57252 - DNA, 36 bp, Artificial Sequence
  Synthetic oligonucleotide
tactacaacatgccctcaacgtactggtcccgttta

SEQ ID NO: 57253 - DNA, 35 bp, Artificial Sequence
  Synthetic oligonucleotide
actgcagacccgcgaaagcctattgtcgacaaaac

SEQ ID NO: 57254 - DNA, 35 bp, Artificial Sequence
  Synthetic oligonucleotide
gacccatggctcatgcccaccgttttagcccggac

SEQ ID NO: 57255 - DNA, 35 bp, Artificial Sequence
  Synthetic oligonucleotide
ttgctccccgtcaccacaaacggcctgtcatatac

SEQ ID NO: 57256 - DNA, 35 bp, Artificial Sequence
  Synthetic oligonucleotide
gaaacgaccctagtaacatgtcgcctttacagtac

SEQ ID NO: 57257 - DNA, 35 bp, Artificial Sequence
  Synthetic oligonucleotide
gcccactgaaaacgccgcgcttctgcacacaaccc

SEQ ID NO: 57258 - DNA, 35 bp, Artificial Sequence
  Synthetic oligonucleotide
ttgacgccccttccgcacctgagatgcaacccgcc

SEQ ID NO: 57259 - DNA, 35 bp, Artificial Sequence
  Synthetic oligonucleotide
agtgtgcaccccctgaccgcagttaccgcccctcc

SEQ ID NO: 57260 - DNA, 35 bp, Artificial Sequence
  Synthetic oligonucleotide
gccaccgattatacgccattgacggcgctgtttcc

SEQ ID NO: 57261 - DNA, 35 bp, Artificial Sequence
  Synthetic oligonucleotide
attttacctgccagttgacctttccagccctgagc

SEQ ID NO: 57262 - DNA, 35 bp, Artificial Sequence
  Synthetic oligonucleotide
gttacgtccaaccaggttctattcgacgtgttagc

SEQ ID NO: 57263 - DNA, 35 bp, Artificial Sequence
  Synthetic oligonucleotide
acgctacttcgccctctcgttaccgttactgtggc

SEQ ID NO: 57264 - DNA, 35 bp, Artificial Sequence
  Synthetic oligonucleotide
gcgaccactcatcttagtttcccgttattttatgc

SEQ ID NO: 57265 - DNA, 35 bp, Artificial Sequence
  Synthetic oligonucleotide
actccccgaggaccgctggaatatcacacgcctgc

SEQ ID NO: 57266 - DNA, 35 bp, Artificial Sequence
  Synthetic oligonucleotide
tgtaccttgcctcggtttcacgtactctactctgc

SEQ ID NO: 57267 - DNA, 35 bp, Artificial Sequence
  Synthetic oligonucleotide
accccgctgtacaccaccaagtcttttgcgtgatc

SEQ ID NO: 57268 - DNA, 35 bp, Artificial Sequence
  Synthetic oligonucleotide
tttcgcccactcgactcctctaccccgggtgattc

SEQ ID NO: 57269 - DNA, 35 bp, Artificial Sequence
  Synthetic oligonucleotide
gacctccttccactgtcacttttcccgccatagag

SEQ ID NO: 57270 - DNA, 35 bp, Artificial Sequence
  Synthetic oligonucleotide
accacccctgtcctaccataacgccgcccactgag

SEQ ID NO: 57271 - DNA, 35 bp, Artificial Sequence
  Synthetic oligonucleotide
gaaccgcctctccggacgttaaactgctttgtccg

SEQ ID NO: 57272 - DNA, 35 bp, Artificial Sequence
  Synthetic oligonucleotide
aacatatccgaggccttccgtcacttccccgaggg

SEQ ID NO: 57273 - DNA, 35 bp, Artificial Sequence
  Synthetic oligonucleotide
gcaacctgttcaacttgtccttccagcttgttcct

SEQ ID NO: 57274 - DNA, 35 bp, Artificial Sequence
  Synthetic oligonucleotide
gacgccactctggacccatagacgggtcgtttgct

SEQ ID NO: 57275 - DNA, 35 bp, Artificial Sequence
  Synthetic oligonucleotide
ttcaacgatcacaaccccgtgtggccatttttgct

SEQ ID NO: 57276 - DNA, 35 bp, Artificial Sequence
  Synthetic oligonucleotide
tctccaccccctccttggttactgtaacggtatct

SEQ ID NO: 57277 - DNA, 35 bp, Artificial Sequence
  Synthetic oligonucleotide
agttcggccctccaggtcgcaaggttcaatcctct

SEQ ID NO: 57278 - DNA, 35 bp, Artificial Sequence
  Synthetic oligonucleotide
gacccgtaacgacttccagaacattgcaactttct

SEQ ID NO: 57279 - DNA, 35 bp, Artificial Sequence
  Synthetic oligonucleotide
attccgtgctcaaggacggaccctaaatgtttctt

SEQ ID NO: 57280 - DNA, 35 bp, Artificial Sequence
  Synthetic oligonucleotide
tctcagccgctagaccctttgcatttccggttgtt

SEQ ID NO: 57281 - DNA, 36 bp, Artificial Sequence
  Synthetic oligonucleotide
acagacgcccccgttcctcaccctccaatggatttt

SEQ ID NO: 57282 - DNA, 35 bp, Artificial Sequence
  Synthetic oligonucleotide
atgcctcaccgcactccttttgaggagaatctttt

SEQ ID NO: 57283 - DNA, 35 bp, Artificial Sequence
  Synthetic oligonucleotide
gctggggggaaatcgaatgggggcaccgagaaaaa

SEQ ID NO: 57284 - DNA, 36 bp, Artificial Sequence
  Synthetic oligonucleotide
tcacagcgctcccaggctgcacgatctcgctccaaa

SEQ ID NO: 57285 - DNA, 36 bp, Artificial Sequence
  Synthetic oligonucleotide
atggtccaattcccgtgtgctccgatcctgctcaaa

SEQ ID NO: 57286 - DNA, 36 bp, Artificial Sequence
  Synthetic oligonucleotide
ttcagccacctgcaggtccccatgcgcgtcctgaaa

SEQ ID NO: 57287 - DNA, 35 bp, Artificial Sequence
  Synthetic oligonucleotide
tacctgcctctgaactttacacattcttgccccaa

SEQ ID NO: 57288 - DNA, 36 bp, Artificial Sequence
  Synthetic oligonucleotide
gtattgcgcgtacacaatttaagctttcatttccaa

SEQ ID NO: 57289 - DNA, 36 bp, Artificial Sequence
  Synthetic oligonucleotide
attgccacctctgcaatcgataccgaaaattttcaa

SEQ ID NO: 57290 - DNA, 36 bp, Artificial Sequence
  Synthetic oligonucleotide
tgaggggcacctactcgtttaattcctgtcgcctaa

SEQ ID NO: 57291 - DNA, 36 bp, Artificial Sequence
  Synthetic oligonucleotide
tacacccgtggatatttcttcactctctgtaggtaa

SEQ ID NO: 57292 - DNA, 36 bp, Artificial Sequence
  Synthetic oligonucleotide
tgcctccactaagacacgcgacacccatgcacttaa

SEQ ID NO: 57293 - DNA, 36 bp, Artificial Sequence
  Synthetic oligonucleotide
tagtgtcgggtggactgcggggtggttgggttaaca

SEQ ID NO: 57294 - DNA, 36 bp, Artificial Sequence
  Synthetic oligonucleotide
agcgatagccaagtccaagcaaagggaacgcacaca

SEQ ID NO: 57295 - DNA, 36 bp, Artificial Sequence
  Synthetic oligonucleotide
acattcactccacaagacgcaccaggcctgaatcca

SEQ ID NO: 57296 - DNA, 36 bp, Artificial Sequence
  Synthetic oligonucleotide
gactcgattgtgctgtttcttccccccgtacttcca

SEQ ID NO: 57297 - DNA, 35 bp, Artificial Sequence
  Synthetic oligonucleotide
tgagcgaactctcgcaaacggcccagcacatagca

SEQ ID NO: 57298 - DNA, 36 bp, Artificial Sequence
  Synthetic oligonucleotide
atccggagcgacagtacatgtcttttccgttctgca

SEQ ID NO: 57299 - DNA, 36 bp, Artificial Sequence
  Synthetic oligonucleotide
gacatcatgtgaagtaccggggttatctaggggtca

SEQ ID NO: 57300 - DNA, 37 bp, Artificial Sequence
  Synthetic oligonucleotide
acgaccacccctccgactgcatcgaactgggacgaga

SEQ ID NO: 57301 - DNA, 37 bp, Artificial Sequence
  Synthetic oligonucleotide
gcactctccccttgcctgttctatctcgcatcataga

SEQ ID NO: 57302 - DNA, 37 bp, Artificial Sequence
  Synthetic oligonucleotide
acgccttgcctctgccctcgcgcccggtttccaccga

SEQ ID NO: 57303 - DNA, 37 bp, Artificial Sequence
  Synthetic oligonucleotide
gctactgcccctgttttgaaacatcttctagtgccga

SEQ ID NO: 57304 - DNA, 37 bp, Artificial Sequence
  Synthetic oligonucleotide
gcacgtgggcgccacactttccatgacatacttccga

SEQ ID NO: 57305 - DNA, 37 bp, Artificial Sequence
  Synthetic oligonucleotide
gtacgccgtcgcctgggcctctgttctgcttgctcga

SEQ ID NO: 57306 - DNA, 35 bp, Artificial Sequence
  Synthetic oligonucleotide
gcctacggcatcaccatttctcagcgctccttcga

SEQ ID NO: 57307 - DNA, 37 bp, Artificial Sequence
  Synthetic oligonucleotide
agagaccaccgcattcccgtccaacatccgtgttcga

SEQ ID NO: 57308 - DNA, 37 bp, Artificial Sequence
  Synthetic oligonucleotide
gatcatgggcagagactagggtcaatgaggcggggga

SEQ ID NO: 57309 - DNA, 37 bp, Artificial Sequence
  Synthetic oligonucleotide
ttcccacccgcaagtcgaataccacctgttccatgga

SEQ ID NO: 57310 - DNA, 37 bp, Artificial Sequence
  Synthetic oligonucleotide
agcacacccgatctcctgcgccaacatatgcattgga

SEQ ID NO: 57311 - DNA, 37 bp, Artificial Sequence
  Synthetic oligonucleotide
agtacgccgcaaccctggccccattaccttcattgga

SEQ ID NO: 57312 - DNA, 35 bp, Artificial Sequence
  Synthetic oligonucleotide
gcaggatgggggtgcgctgtagggaacgataatga

SEQ ID NO: 57313 - DNA, 38 bp, Artificial Sequence
  Synthetic oligonucleotide
gccaggtctgatgttctttcggttaaccttctccatga

SEQ ID NO: 57314 - DNA, 38 bp, Artificial Sequence
  Synthetic oligonucleotide
tacactcgcagtccattaacatgaacccacaggcatga

SEQ ID NO: 57315 - DNA, 38 bp, Artificial Sequence
  Synthetic oligonucleotide
gaagtaggacggcatcgggtaaagtaaaacggcgctga

SEQ ID NO: 57316 - DNA, 38 bp, Artificial Sequence
  Synthetic oligonucleotide
atacccgcacgccgcgaattcgtcttctccaaatctga

SEQ ID NO: 57317 - DNA, 38 bp, Artificial Sequence
  Synthetic oligonucleotide
gtcaggtccacgacaatttgatcttcccgcctctgtga

SEQ ID NO: 57318 - DNA, 38 bp, Artificial Sequence
  Synthetic oligonucleotide
atgcccaacgccctttccagcatgcgggatccacttga

SEQ ID NO: 57319 - DNA, 38 bp, Artificial Sequence
  Synthetic oligonucleotide
aaaggtggtaagcgatggacgaggaggagggagcttga

SEQ ID NO: 57320 - DNA, 35 bp, Artificial Sequence
  Synthetic oligonucleotide
acaggtccgccgatgctgacctggtctcctcccta

SEQ ID NO: 57321 - DNA, 37 bp, Artificial Sequence
  Synthetic oligonucleotide
gttcaacgtgtggctcctatttgaccactgctctcta

SEQ ID NO: 57322 - DNA, 36 bp, Artificial Sequence
  Synthetic oligonucleotide
acctaaacgcacccagcctcgacccatacctaagta

SEQ ID NO: 57323 - DNA, 36 bp, Artificial Sequence
  Synthetic oligonucleotide
gatgctgccacaatgtagtgcaggccacacgcatta

SEQ ID NO: 57324 - DNA, 35 bp, Artificial Sequence
  Synthetic oligonucleotide
aagttagcccgcggtaacatcccagatccatcaac

SEQ ID NO: 57325 - DNA, 35 bp, Artificial Sequence
  Synthetic oligonucleotide
tccgcaagcagcataggcttttcgcctattcaacc

SEQ ID NO: 57326 - DNA, 35 bp, Artificial Sequence
  Synthetic oligonucleotide
ggacctcccacacgcaatggtattaccgtgtaccc

SEQ ID NO: 57327 - DNA, 35 bp, Artificial Sequence
  Synthetic oligonucleotide
ttacctccgcttttgttatagtggcaacgcttccc

SEQ ID NO: 57328 - DNA, 35 bp, Artificial Sequence
  Synthetic oligonucleotide
tagccccctcgtccttccgcgtatcccttctgtcc

SEQ ID NO: 57329 - DNA, 35 bp, Artificial Sequence
  Synthetic oligonucleotide
gtttgcctaccttgcgccaatgacgactcgtacgc

SEQ ID NO: 57330 - DNA, 35 bp, Artificial Sequence
  Synthetic oligonucleotide
tgtacttcaaccacagattctcatccactgcatgc

SEQ ID NO: 57331 - DNA, 35 bp, Artificial Sequence
  Synthetic oligonucleotide
tttgtcatgtttcgcccgcatagttacactgtttc

SEQ ID NO: 57332 - DNA, 35 bp, Artificial Sequence
  Synthetic oligonucleotide
tctacgtcccaccacgctcatatgcgtttgcatag

SEQ ID NO: 57333 - DNA, 35 bp, Artificial Sequence
  Synthetic oligonucleotide
tgcacatcacatactggaacacagcccattgttag

SEQ ID NO: 57334 - DNA, 35 bp, Artificial Sequence
  Synthetic oligonucleotide
tatgacggggagtgtaagggatcaactgtactacg

SEQ ID NO: 57335 - DNA, 35 bp, Artificial Sequence
  Synthetic oligonucleotide
acaaagtctcctcccacacctacccacgagctacg

SEQ ID NO: 57336 - DNA, 35 bp, Artificial Sequence
  Synthetic oligonucleotide
ttgctactgctctgcccagagtatcctccacctcg

SEQ ID NO: 57337 - DNA, 35 bp, Artificial Sequence
  Synthetic oligonucleotide
tcccgtagctcaaggcttatcacccggtttgctcg

SEQ ID NO: 57338 - DNA, 35 bp, Artificial Sequence
  Synthetic oligonucleotide
gcctaccgctgatggaccattgcaggatcaccgtg

SEQ ID NO: 57339 - DNA, 35 bp, Artificial Sequence
  Synthetic oligonucleotide
tgacggtagggctgttgagcggattaagggggttg

SEQ ID NO: 57340 - DNA, 35 bp, Artificial Sequence
  Synthetic oligonucleotide
tgaaccacaagaagagtgatagtacgatgctgcat

SEQ ID NO: 57341 - DNA, 35 bp, Artificial Sequence
  Synthetic oligonucleotide
ttctcctgcgcgctgcccccgtccaggctgctcct

SEQ ID NO: 57342 - DNA, 35 bp, Artificial Sequence
  Synthetic oligonucleotide
ggaggaaccgtacctctcgcgccgcccacgctcgt

SEQ ID NO: 57343 - DNA, 35 bp, Artificial Sequence
  Synthetic oligonucleotide
gaaccagcggggcatagctatcatctcacaacggt

SEQ ID NO: 57344 - DNA, 35 bp, Artificial Sequence
  Synthetic oligonucleotide
tgcgtaacatgcgtatgtcggagggcagggtgggt

SEQ ID NO: 57345 - DNA, 34 bp, Artificial Sequence
  Synthetic oligonucleotide
gaaaccgtgccactttatccgctgatcttactgt

SEQ ID NO: 57346 - DNA, 35 bp, Artificial Sequence
  Synthetic oligonucleotide
ttagagcgcacggattgatccggccactttccctt

SEQ ID NO: 57347 - DNA, 35 bp, Artificial Sequence
  Synthetic oligonucleotide
agtgcgtgctttaatggtactccacaccctgtctt

SEQ ID NO: 57348 - DNA, 35 bp, Artificial Sequence
  Synthetic oligonucleotide
gtatgcgggcactcgctgtccagcccattaacgtt

SEQ ID NO: 57349 - DNA, 35 bp, Artificial Sequence
  Synthetic oligonucleotide
aaagaggccacgggcacggtccccacactgcattt

SEQ ID NO: 57350 - DNA, 35 bp, Artificial Sequence
  Synthetic oligonucleotide
gaccggagggacggtatgcttatcatttaaatttt

SEQ ID NO: 57351 - DNA, 35 bp, Artificial Sequence
  Synthetic oligonucleotide
tgacgcatgactccccagcttcaatatgcattttt

SEQ ID NO: 57352 - DNA, 35 bp, Artificial Sequence
  Synthetic oligonucleotide
tccccactatccgattctatgaccgagcaacgaaa

SEQ ID NO: 57353 - DNA, 36 bp, Artificial Sequence
  Synthetic oligonucleotide
ccaccgtccgcagtgcgtattcggcacaagaggaaa

SEQ ID NO: 57354 - DNA, 36 bp, Artificial Sequence
  Synthetic oligonucleotide
gtccgctcccacgagcttcacctactttcacaagaa

SEQ ID NO: 57355 - DNA, 36 bp, Artificial Sequence
  Synthetic oligonucleotide
tacacgctccaaatgccggactatcctctcgttgaa

SEQ ID NO: 57356 - DNA, 36 bp, Artificial Sequence
  Synthetic oligonucleotide
tatcgcccccgaaacgtcgtagcccctgacgcctaa

SEQ ID NO: 57357 - DNA, 35 bp, Artificial Sequence
  Synthetic oligonucleotide
tattggaccgtggtccaataggccccattctcaca

SEQ ID NO: 57358 - DNA, 36 bp, Artificial Sequence
  Synthetic oligonucleotide
tacctgggttgctggcgtcgtaccaccgatttcaca

SEQ ID NO: 57359 - DNA, 35 bp, Artificial Sequence
  Synthetic oligonucleotide
aaccttcactcatgggttgtctgtccacttataca

SEQ ID NO: 57360 - DNA, 36 bp, Artificial Sequence
  Synthetic oligonucleotide
gttgccgaacatggcggtctccttctctactgacca

SEQ ID NO: 57361 - DNA, 36 bp, Artificial Sequence
  Synthetic oligonucleotide
gtgccgcctaatggttttatgttaccccaaccccca

SEQ ID NO: 57362 - DNA, 36 bp, Artificial Sequence
  Synthetic oligonucleotide
tgtggcgacccgacggtcctaggagtgccttcccca

SEQ ID NO: 57363 - DNA, 36 bp, Artificial Sequence
  Synthetic oligonucleotide
accgactcctcgcacccttgaatgatggaatgtcca

SEQ ID NO: 57364 - DNA, 36 bp, Artificial Sequence
  Synthetic oligonucleotide
agcccaagctcctccaattgtccttctgacccagca

SEQ ID NO: 57365 - DNA, 36 bp, Artificial Sequence
  Synthetic oligonucleotide
ataccccgtcctgtgtactcactggccccattctca

SEQ ID NO: 57366 - DNA, 36 bp, Artificial Sequence
  Synthetic oligonucleotide
acacaacctcggctatctcgaccctagccctagaga

SEQ ID NO: 57367 - DNA, 37 bp, Artificial Sequence
  Synthetic oligonucleotide
tttgcaccccagctttgatctaccgtacattcataga

SEQ ID NO: 57368 - DNA, 37 bp, Artificial Sequence
  Synthetic oligonucleotide
cccctccacccccaatgtagtcatggtacgacgccga

SEQ ID NO: 57369 - DNA, 37 bp, Artificial Sequence
  Synthetic oligonucleotide
tgacccacacgcttcgcaacgagcatcctttatccga

SEQ ID NO: 57370 - DNA, 37 bp, Artificial Sequence
  Synthetic oligonucleotide
ggaacaatgtagggagggtgggcgtggagtgaatcga

SEQ ID NO: 57371 - DNA, 36 bp, Artificial Sequence
  Synthetic oligonucleotide
tcactcgcatcccccccaaagaacgtgatcgttcga

SEQ ID NO: 57372 - DNA, 37 bp, Artificial Sequence
  Synthetic oligonucleotide
tctgccacctacttgtctctatagttctccctttcga

SEQ ID NO: 57373 - DNA, 37 bp, Artificial Sequence
  Synthetic oligonucleotide
acatgagtgcgatggggggagatagagaggcaaagga

SEQ ID NO: 57374 - DNA, 37 bp, Artificial Sequence
  Synthetic oligonucleotide
aggagtcggggggggaggagcgctgtgagcgggagga

SEQ ID NO: 57375 - DNA, 37 bp, Artificial Sequence
  Synthetic oligonucleotide
tccgacgcaaaatttgcccttcttcccgggttaggga

SEQ ID NO: 57376 - DNA, 37 bp, Artificial Sequence
  Synthetic oligonucleotide
gtccggagattggaggaactgaggctcacggtgggga

SEQ ID NO: 57377 - DNA, 38 bp, Artificial Sequence
  Synthetic oligonucleotide
gcacatcgcccggccttaatattgacagtttcgcatga

SEQ ID NO: 57378 - DNA, 38 bp, Artificial Sequence
  Synthetic oligonucleotide
acctcgaacctcactggaacctacatgcatcccactga

SEQ ID NO: 57379 - DNA, 38 bp, Artificial Sequence
  Synthetic oligonucleotide
aaccccccttggcaccccgagtacattgtcctgactga

SEQ ID NO: 57380 - DNA, 38 bp, Artificial Sequence
  Synthetic oligonucleotide
gcccagccgcccctttccttaggactgacttcccctga

SEQ ID NO: 57381 - DNA, 38 bp, Artificial Sequence
  Synthetic oligonucleotide
tctgacgatcgatatgccccgttgtttcttccatctga

SEQ ID NO: 57382 - DNA, 37 bp, Artificial Sequence
  Synthetic oligonucleotide
atctgacgccggccttctattcgtagccactgagtga

SEQ ID NO: 57383 - DNA, 38 bp, Artificial Sequence
  Synthetic oligonucleotide
gccggttcgcccgaaccgaaaatgagaggatatggtga

SEQ ID NO: 57384 - DNA, 38 bp, Artificial Sequence
  Synthetic oligonucleotide
tgtgacatcggagggcatttaccagggagggtatgtga

SEQ ID NO: 57385 - DNA, 38 bp, Artificial Sequence
  Synthetic oligonucleotide
aagtgcgcacgaagatgatccacaccctttccccttga

SEQ ID NO: 57386 - DNA, 38 bp, Artificial Sequence
  Synthetic oligonucleotide
atggtccagggcccggtgtggtggtatggggaatttga

SEQ ID NO: 57387 - DNA, 38 bp, Artificial Sequence
  Synthetic oligonucleotide
gacagaccaaagaatgagaaagggaatactggctttga

SEQ ID NO: 57388 - DNA, 36 bp, Artificial Sequence
  Synthetic oligonucleotide
actcccgcacttgcagtgtttttgcttttgctccta

SEQ ID NO: 57389 - DNA, 36 bp, Artificial Sequence
  Synthetic oligonucleotide
ttctcgccacctattttttgttaacggcccactcta

SEQ ID NO: 57390 - DNA, 36 bp, Artificial Sequence
  Synthetic oligonucleotide
tctgacgcctccgaacgggtcttgttccacggatta

SEQ ID NO: 57391 - DNA, 36 bp, Artificial Sequence
  Synthetic oligonucleotide
tcccgcctccctcaattttattcggagccgtagtta

SEQ ID NO: 57392 - DNA, 35 bp, Artificial Sequence
  Synthetic oligonucleotide
attctccatctcgcttcataactcgttatgctgac

SEQ ID NO: 57393 - DNA, 35 bp, Artificial Sequence
  Synthetic oligonucleotide
tccacacctacgcactgtgcaccgatacacgttac

SEQ ID NO: 57394 - DNA, 35 bp, Artificial Sequence
  Synthetic oligonucleotide
agttggcacagtggtttaccacatctctcgaaacc

SEQ ID NO: 57395 - DNA, 35 bp, Artificial Sequence
  Synthetic oligonucleotide
gtcccccgatcactattacttcttccaaactgccc

SEQ ID NO: 57396 - DNA, 35 bp, Artificial Sequence
  Synthetic oligonucleotide
agcgtcgtagccccagatctagccctgctcctccc

SEQ ID NO: 57397 - DNA, 35 bp, Artificial Sequence
  Synthetic oligonucleotide
tcaccttgctcatccagtcaacattatcataggcc

SEQ ID NO: 57398 - DNA, 35 bp, Artificial Sequence
  Synthetic oligonucleotide
tgctcatcagacagtggctacttcccctcatttcc

SEQ ID NO: 57399 - DNA, 35 bp, Artificial Sequence
  Synthetic oligonucleotide
tcaccacgccaactctccatttcccagaaacgagc

SEQ ID NO: 57400 - DNA, 35 bp, Artificial Sequence
  Synthetic oligonucleotide
tcaccggctcaaaatgggggtggaggttgaaacgc

SEQ ID NO: 57401 - DNA, 34 bp, Artificial Sequence
  Synthetic oligonucleotide
atgcctctgtgctgtcgtcaacactcagccccgc

SEQ ID NO: 57402 - DNA, 35 bp, Artificial Sequence
  Synthetic oligonucleotide
acacgggacccatctatgctaatgatttacatcgc

SEQ ID NO: 57403 - DNA, 35 bp, Artificial Sequence
  Synthetic oligonucleotide
taggtgaaccaaggtatgtggtggaatgggatggc

SEQ ID NO: 57404 - DNA, 35 bp, Artificial Sequence
  Synthetic oligonucleotide
acacctgtgccaacactgactttcgcttgtcctgc

SEQ ID NO: 57405 - DNA, 35 bp, Artificial Sequence
  Synthetic oligonucleotide
tagcctcatatccgatccgcgtgctgccgataatc

SEQ ID NO: 57406 - DNA, 35 bp, Artificial Sequence
  Synthetic oligonucleotide
tcgataccttccgggtaaaccgcctttccgtactc

SEQ ID NO: 57407 - DNA, 35 bp, Artificial Sequence
  Synthetic oligonucleotide
gcgaaggtacgcagatgtctttacttaatttggtc

SEQ ID NO: 57408 - DNA, 35 bp, Artificial Sequence
  Synthetic oligonucleotide
gcgctgcctacgcccaccatagtctcgtttatgtc

SEQ ID NO: 57409 - DNA, 35 bp, Artificial Sequence
  Synthetic oligonucleotide
gacacgtcgtcttgtcccgcgaaggtcccccgttc

SEQ ID NO: 57410 - DNA, 35 bp, Artificial Sequence
  Synthetic oligonucleotide
tcccacggacggcacattgcagccccttcccgttc

SEQ ID NO: 57411 - DNA, 35 bp, Artificial Sequence
  Synthetic oligonucleotide
ggataaggggaagggatgcggggataagtttggcg

SEQ ID NO: 57412 - DNA, 35 bp, Artificial Sequence
  Synthetic oligonucleotide
ttgcccgaactattgaggtcgttccatctgccagg

SEQ ID NO: 57413 - DNA, 35 bp, Artificial Sequence
  Synthetic oligonucleotide
ggacacaggacttagggggaaagtgggcttatagg

SEQ ID NO: 57414 - DNA, 35 bp, Artificial Sequence
  Synthetic oligonucleotide
aatgccatcccttccaactcatgggccttgttgtg

SEQ ID NO: 57415 - DNA, 35 bp, Artificial Sequence
  Synthetic oligonucleotide
gtaccgtgaccgtcgtcgtcttcatcccgggtttg

SEQ ID NO: 57416 - DNA, 35 bp, Artificial Sequence
  Synthetic oligonucleotide
atgcgtaaccatccagcatagtactttgcatccat

SEQ ID NO: 57417 - DNA, 35 bp, Artificial Sequence
  Synthetic oligonucleotide
gccctacccccccgcggtactagcatattgatgct

SEQ ID NO: 57418 - DNA, 35 bp, Artificial Sequence
  Synthetic oligonucleotide
atgcgcatgtcgcgcagccctaggacctgttgtct

SEQ ID NO: 57419 - DNA, 35 bp, Artificial Sequence
  Synthetic oligonucleotide
ttaggatgccctccataggtatcatatgcccttct

SEQ ID NO: 57420 - DNA, 35 bp, Artificial Sequence
  Synthetic oligonucleotide
gtgatgccgtagagcgtggagggaagatcgggagt

SEQ ID NO: 57421 - DNA, 35 bp, Artificial Sequence
  Synthetic oligonucleotide
acactccccaacactgttcgccatacgagggattt

SEQ ID NO: 57422 - DNA, 35 bp, Artificial Sequence
  Synthetic oligonucleotide
ggggtagagggccaattcgggaagggctaggtttt

SEQ ID NO: 57423 - DNA, 35 bp, Artificial Sequence
  Synthetic oligonucleotide
tctatcgcctccaggtcacggcctgtaatccaaaa

SEQ ID NO: 57424 - DNA, 36 bp, Artificial Sequence
  Synthetic oligonucleotide
gccacgcactcgttacccgcccgtgcattgtgcaaa

SEQ ID NO: 57425 - DNA, 36 bp, Artificial Sequence
  Synthetic oligonucleotide
gctgagagtgaaaatgggaggggagtagaggcacaa

SEQ ID NO: 57426 - DNA, 36 bp, Artificial Sequence
  Synthetic oligonucleotide
gtgcgagcatcatttcttcggtctctgttcacccaa

SEQ ID NO: 57427 - DNA, 36 bp, Artificial Sequence
  Synthetic oligonucleotide
gacaaccgtattttgtcttgtagtcttacactccaa

SEQ ID NO: 57428 - DNA, 36 bp, Artificial Sequence
  Synthetic oligonucleotide
agcgcgccgccggaccaggcgtttctccttgctcaa

SEQ ID NO: 57429 - DNA, 36 bp, Artificial Sequence
  Synthetic oligonucleotide
tagggcacctaacagtcgcgacacgccccccacgaa

SEQ ID NO: 57430 - DNA, 36 bp, Artificial Sequence
  Synthetic oligonucleotide
gcatgagaagtcggggggagtttagagaaggagaca

SEQ ID NO: 57431 - DNA, 36 bp, Artificial Sequence
  Synthetic oligonucleotide
aaccatgctcacatggcacttgtactagctcgtaca

SEQ ID NO: 57432 - DNA, 36 bp, Artificial Sequence
  Synthetic oligonucleotide
aaaccgacaccatgaatccgataagcaccatgcgca

SEQ ID NO: 57433 - DNA, 35 bp, Artificial Sequence
  Synthetic oligonucleotide
atccccgcccctaagtaactgccccttgattatca

SEQ ID NO: 57434 - DNA, 36 bp, Artificial Sequence
  Synthetic oligonucleotide
ccacaccccggcctgtcttttgcgacctatgtctca

SEQ ID NO: 57435 - DNA, 35 bp, Artificial Sequence
  Synthetic oligonucleotide
tgttggggccttggacgcaatatgtaccctcttca

SEQ ID NO: 57436 - DNA, 37 bp, Artificial Sequence
  Synthetic oligonucleotide
gtccccgcacgagaccccacctgatccactcacaaga

SEQ ID NO: 57437 - DNA, 37 bp, Artificial Sequence
  Synthetic oligonucleotide
gaagggaacgcaaaagcgaggacatgaggggtagaga

SEQ ID NO: 57438 - DNA, 37 bp, Artificial Sequence
  Synthetic oligonucleotide
gacatagcaggagctggttggggggcaggttaggaga

SEQ ID NO: 57439 - DNA, 36 bp, Artificial Sequence
  Synthetic oligonucleotide
gtgagataggaaggaaggggctagtcggcacataga

SEQ ID NO: 57440 - DNA, 37 bp, Artificial Sequence
  Synthetic oligonucleotide
tccgagcgccctcgacgcttcctaatagaactgtaga

SEQ ID NO: 57441 - DNA, 35 bp, Artificial Sequence
  Synthetic oligonucleotide
tccactccacctgagtccattgtttggttatccga

SEQ ID NO: 57442 - DNA, 37 bp, Artificial Sequence
  Synthetic oligonucleotide
aagcgatgcacggcgtcagtctcgcaccatcctccga

SEQ ID NO: 57443 - DNA, 37 bp, Artificial Sequence
  Synthetic oligonucleotide
tgtagagccgcatagtgaagggcggtgattggggcga

SEQ ID NO: 57444 - DNA, 37 bp, Artificial Sequence
  Synthetic oligonucleotide
gacaccaagttgccggttacgcaagcctctccttcga

SEQ ID NO: 57445 - DNA, 37 bp, Artificial Sequence
  Synthetic oligonucleotide
acgacgccccttactgtacgagtcatcccggtttcga

SEQ ID NO: 57446 - DNA, 37 bp, Artificial Sequence
  Synthetic oligonucleotide
ttgtatgcaacgccatgacaccccatgcccttttcga

SEQ ID NO: 57447 - DNA, 35 bp, Artificial Sequence
  Synthetic oligonucleotide
tatgaaaggggggtgggctagaatgagcacgagga

SEQ ID NO: 57448 - DNA, 37 bp, Artificial Sequence
  Synthetic oligonucleotide
gccccctcccagtctccgttatttggcccttaccgga

SEQ ID NO: 57449 - DNA, 37 bp, Artificial Sequence
  Synthetic oligonucleotide
tgaaccacatcccgctgtcttcacattgtacctggga

SEQ ID NO: 57450 - DNA, 37 bp, Artificial Sequence
  Synthetic oligonucleotide
tccgtggagcatacatggcactaccttccaccctgga

SEQ ID NO: 57451 - DNA, 37 bp, Artificial Sequence
  Synthetic oligonucleotide
aaccctgccggacttagaacactcgcgcccctctgga

SEQ ID NO: 57452 - DNA, 35 bp, Artificial Sequence
  Synthetic oligonucleotide
gagtctaggagcgagggcgtgaggccgggagtgga

SEQ ID NO: 57453 - DNA, 37 bp, Artificial Sequence
  Synthetic oligonucleotide
accatgtgcacaatcttttcgtactctctcttttgga

SEQ ID NO: 57454 - DNA, 38 bp, Artificial Sequence
  Synthetic oligonucleotide
gacatgagggggatgggcaagggttcccaggggaatga

SEQ ID NO: 57455 - DNA, 38 bp, Artificial Sequence
  Synthetic oligonucleotide
gggggccggtgccaaggaaagggagttaggggcgatga

SEQ ID NO: 57456 - DNA, 38 bp, Artificial Sequence
  Synthetic oligonucleotide
gtcaccctcgcccatcaagtaccttttggtttccctga

SEQ ID NO: 57457 - DNA, 37 bp, Artificial Sequence
  Synthetic oligonucleotide
gccccacctacgcccaaccgtctgccgccatcgctga

SEQ ID NO: 57458 - DNA, 38 bp, Artificial Sequence
  Synthetic oligonucleotide
aaacccccctcacaatggcgacggtcaaacccggctga

SEQ ID NO: 57459 - DNA, 38 bp, Artificial Sequence
  Synthetic oligonucleotide
gacaaccgcacagggtgggtatcaattggggaaagtga

SEQ ID NO: 57460 - DNA, 37 bp, Artificial Sequence
  Synthetic oligonucleotide
gaagggggggagactgagcggccgcagaacacagtga

SEQ ID NO: 57461 - DNA, 37 bp, Artificial Sequence
  Synthetic oligonucleotide
acctatcgggagggggtaaatggggtatggaacgtga

SEQ ID NO: 57462 - DNA, 36 bp, Artificial Sequence
  Synthetic oligonucleotide
gttgacgcccccggttgcacaccgccacgggattga

SEQ ID NO: 57463 - DNA, 38 bp, Artificial Sequence
  Synthetic oligonucleotide
tcaccgcgctacctctctgttttggcactacttattga

SEQ ID NO: 57464 - DNA, 37 bp, Artificial Sequence
  Synthetic oligonucleotide
tgccacatacaccatttttgaggctgtctgtacttga

SEQ ID NO: 57465 - DNA, 38 bp, Artificial Sequence
  Synthetic oligonucleotide
ttccccgtcgacaccgctaagcttcccggcccccttga

SEQ ID NO: 57466 - DNA, 37 bp, Artificial Sequence
  Synthetic oligonucleotide
gcccccccttgccgacagggctcccgtacctagttga

SEQ ID NO: 57467 - DNA, 37 bp, Artificial Sequence
  Synthetic oligonucleotide
gacactccgtgaagcggtttatggccaccccctttga

SEQ ID NO: 57468 - DNA, 35 bp, Artificial Sequence
  Synthetic oligonucleotide
agcatggtgcaaatggcagccacaccccatacgac

SEQ ID NO: 57469 - DNA, 35 bp, Artificial Sequence
  Synthetic oligonucleotide
tgcagggagactcactgccctctaatcccacggac

SEQ ID NO: 57470 - DNA, 35 bp, Artificial Sequence
  Synthetic oligonucleotide
attgaaacccctcagcacgctgtttgggacctgac

SEQ ID NO: 57471 - DNA, 35 bp, Artificial Sequence
  Synthetic oligonucleotide
aacccgccctagcacctccaggaaatagttcatac

SEQ ID NO: 57472 - DNA, 35 bp, Artificial Sequence
  Synthetic oligonucleotide
acataacgtccgtttagtccttggcccccggtacc

SEQ ID NO: 57473 - DNA, 35 bp, Artificial Sequence
  Synthetic oligonucleotide
aagtcccgtgcacatacctcctgcggatgcttacc

SEQ ID NO: 57474 - DNA, 35 bp, Artificial Sequence
  Synthetic oligonucleotide
gcatgcaaacgccttccggacgtacgaccccatgc

SEQ ID NO: 57475 - DNA, 35 bp, Artificial Sequence
  Synthetic oligonucleotide
gatgcaacgctatttggaagcacgttccttaactc

SEQ ID NO: 57476 - DNA, 35 bp, Artificial Sequence
  Synthetic oligonucleotide
aagaccctgccctttgcatggagccctactgtctc

SEQ ID NO: 57477 - DNA, 35 bp, Artificial Sequence
  Synthetic oligonucleotide
tgcaccgccacccaacgaagtactcccgccgatag

SEQ ID NO: 57478 - DNA, 35 bp, Artificial Sequence
  Synthetic oligonucleotide
taggagggtaggttggttctatttccggttggtcg

SEQ ID NO: 57479 - DNA, 35 bp, Artificial Sequence
  Synthetic oligonucleotide
attggcatcaataacaactcactgacttcatccgg

SEQ ID NO: 57480 - DNA, 35 bp, Artificial Sequence
  Synthetic oligonucleotide
acagacccgaatcagtctgtctacccgtcctccgg

SEQ ID NO: 57481 - DNA, 35 bp, Artificial Sequence
  Synthetic oligonucleotide
agtgggggcaccaaggaggagtcacacggattggg

SEQ ID NO: 57482 - DNA, 35 bp, Artificial Sequence
  Synthetic oligonucleotide
tacacagccaccacgactgtccgaaaccttgtctg

SEQ ID NO: 57483 - DNA, 35 bp, Artificial Sequence
  Synthetic oligonucleotide
gccgcgctccgttaccgttaacgctcgccctcttg

SEQ ID NO: 57484 - DNA, 35 bp, Artificial Sequence
  Synthetic oligonucleotide
tcaaccccgtccattcacacttatgaagttccaat

SEQ ID NO: 57485 - DNA, 35 bp, Artificial Sequence
  Synthetic oligonucleotide
actggtgcccgccccgttgctttgaacaaccgcat

SEQ ID NO: 57486 - DNA, 35 bp, Artificial Sequence
  Synthetic oligonucleotide
ttgtcctgaccgcctcacacattcggggttcatat

SEQ ID NO: 57487 - DNA, 35 bp, Artificial Sequence
  Synthetic oligonucleotide
tatccagcgcagttcaaattgcggggtgtccttat

SEQ ID NO: 57488 - DNA, 35 bp, Artificial Sequence
  Synthetic oligonucleotide
gcgatccaatactacgcctgaacccccgccgttat

SEQ ID NO: 57489 - DNA, 35 bp, Artificial Sequence
  Synthetic oligonucleotide
gtcaaaccaaaggcggtacagaacacatacaaact

SEQ ID NO: 57490 - DNA, 35 bp, Artificial Sequence
  Synthetic oligonucleotide
gaccgctcgcgacaattgcaccctttactaccact

SEQ ID NO: 57491 - DNA, 35 bp, Artificial Sequence
  Synthetic oligonucleotide
gaacaacctgccaacaggtgagtgaattaacacct

SEQ ID NO: 57492 - DNA, 35 bp, Artificial Sequence
  Synthetic oligonucleotide
aatatccgacggaactggtaaccacctcccacgct

SEQ ID NO: 57493 - DNA, 35 bp, Artificial Sequence
  Synthetic oligonucleotide
gtccgctgctgacacattaaggccccatcaccagt

SEQ ID NO: 57494 - DNA, 35 bp, Artificial Sequence
  Synthetic oligonucleotide
gtccctcaccacgcactgcccaggaaatgatcatt

SEQ ID NO: 57495 - DNA, 35 bp, Artificial Sequence
  Synthetic oligonucleotide
atacattcgccgttagtctcttttcgcagtacctt

SEQ ID NO: 57496 - DNA, 35 bp, Artificial Sequence
  Synthetic oligonucleotide
gcactcccatcacgagtcatgcctgagtgtccctt

SEQ ID NO: 57497 - DNA, 35 bp, Artificial Sequence
  Synthetic oligonucleotide
gagacctcagactggttgtttcggtttctattctt

SEQ ID NO: 57498 - DNA, 35 bp, Artificial Sequence
  Synthetic oligonucleotide
gttgagcatacgttgtctggggccccggttttgtt

SEQ ID NO: 57499 - DNA, 35 bp, Artificial Sequence
  Synthetic oligonucleotide
gcgcacacttcgcactgttgcaacttacgatattt

SEQ ID NO: 57500 - DNA, 35 bp, Artificial Sequence
  Synthetic oligonucleotide
aattgccatgccactttttcaatcttagacctttt

SEQ ID NO: 57501 - DNA, 36 bp, Artificial Sequence
  Synthetic oligonucleotide
ggggttgttcggggcggagaatacgagggggtgaaa

SEQ ID NO: 57502 - DNA, 36 bp, Artificial Sequence
  Synthetic oligonucleotide
gtccgacccgttctcccgcttttccaccaacaggaa

SEQ ID NO: 57503 - DNA, 36 bp, Artificial Sequence
  Synthetic oligonucleotide
cccccggccacagcctttaacacgtgcccctttaca

SEQ ID NO: 57504 - DNA, 36 bp, Artificial Sequence
  Synthetic oligonucleotide
tacctcccgtccggagcttagagtgcaccgccgcca

SEQ ID NO: 57505 - DNA, 35 bp, Artificial Sequence
  Synthetic oligonucleotide
atcgcaggtaccgataccgacaactcactccatca

SEQ ID NO: 57506 - DNA, 34 bp, Artificial Sequence
  Synthetic oligonucleotide
tcgcgcctagcattttacgaacctcgcacattca

SEQ ID NO: 57507 - DNA, 37 bp, Artificial Sequence
  Synthetic oligonucleotide
gcctcaacccccgtcgctcattcttactacagtggga

SEQ ID NO: 57508 - DNA, 37 bp, Artificial Sequence
  Synthetic oligonucleotide
atgccctccaagctccacctggaccaccactttggga

SEQ ID NO: 57509 - DNA, 34 bp, Artificial Sequence
  Synthetic oligonucleotide
atgacatcatctggttctcccttcgtgacatgga

SEQ ID NO: 57510 - DNA, 37 bp, Artificial Sequence
  Synthetic oligonucleotide
taggccacgccactccaggacctttctttccactgga

SEQ ID NO: 57511 - DNA, 37 bp, Artificial Sequence
  Synthetic oligonucleotide
tccaaccagacgccgcttcttatcctcccacggtgga

SEQ ID NO: 57512 - DNA, 37 bp, Artificial Sequence
  Synthetic oligonucleotide
cacggggtgtggggaattggataggagggcatgtgga

SEQ ID NO: 57513 - DNA, 37 bp, Artificial Sequence
  Synthetic oligonucleotide
aaacaggcggggggcggcgggaatcattcagtgtgga

SEQ ID NO: 57514 - DNA, 38 bp, Artificial Sequence
  Synthetic oligonucleotide
tccacaggtcaatcgcgcttccccctttggtttaatga

SEQ ID NO: 57515 - DNA, 38 bp, Artificial Sequence
  Synthetic oligonucleotide
tacatgcctcaagtgaccttccctggccccttccatga

SEQ ID NO: 57516 - DNA, 38 bp, Artificial Sequence
  Synthetic oligonucleotide
tcattcagccggcacaatcaacacctcggtaaaactga

SEQ ID NO: 57517 - DNA, 38 bp, Artificial Sequence
  Synthetic oligonucleotide
taccgcttgtacctcgttgcccttttgacatttactga

SEQ ID NO: 57518 - DNA, 38 bp, Artificial Sequence
  Synthetic oligonucleotide
gcatcctcactatctcgtaactactctctgtttactga

SEQ ID NO: 57519 - DNA, 38 bp, Artificial Sequence
  Synthetic oligonucleotide
aaccgaagaagcaaaggggaagaggcgaggcaacctga

SEQ ID NO: 57520 - DNA, 38 bp, Artificial Sequence
  Synthetic oligonucleotide
gactgccacaataagctgctcgatcgcatattccctga

SEQ ID NO: 57521 - DNA, 31 bp, Artificial Sequence
  Synthetic oligonucleotide
accatttggcttcgaaccatcgccttcctga

SEQ ID NO: 57522 - DNA, 38 bp, Artificial Sequence
  Synthetic oligonucleotide
ttgcgcctcaagtctaaaatgcatgctcctggttctga

SEQ ID NO: 57523 - DNA, 38 bp, Artificial Sequence
  Synthetic oligonucleotide
ttggtagccgaaatctgccgtacctcttagcactgtga

SEQ ID NO: 57524 - DNA, 37 bp, Artificial Sequence
  Synthetic oligonucleotide
ggggggataggtggatatcgggaaggggactaattga

SEQ ID NO: 57525 - DNA, 38 bp, Artificial Sequence
  Synthetic oligonucleotide
gatcctccaacactgtgtgttgaatcgtttattcttga

SEQ ID NO: 57526 - DNA, 36 bp, Artificial Sequence
  Synthetic oligonucleotide
accatcgccccgttccaagtcaagttaacatgttga

SEQ ID NO: 57527 - DNA, 38 bp, Artificial Sequence
  Synthetic oligonucleotide
gagtcagcccccatccattgtttcctttagcatgttga

SEQ ID NO: 57528 - DNA, 36 bp, Artificial Sequence
  Synthetic oligonucleotide
gccttgccaatgtcacatgcccgcctagttttacta

SEQ ID NO: 57529 - DNA, 36 bp, Artificial Sequence
  Synthetic oligonucleotide
accgaaccactgaggttaatccacttaaagtaccta

SEQ ID NO: 57530 - DNA, 35 bp, Artificial Sequence
  Synthetic oligonucleotide
agcctccgaaccgcctcgatttcgacacgtggcta

SEQ ID NO: 57531 - DNA, 35 bp, Artificial Sequence
  Synthetic oligonucleotide
gacgggccagccagcggagtaggggggttggagta

SEQ ID NO: 57532 - DNA, 36 bp, Artificial Sequence
  Synthetic oligonucleotide
tgtggggggaggaagggtaaatgctatggcagtgta

SEQ ID NO: 57533 - DNA, 36 bp, Artificial Sequence
  Synthetic oligonucleotide
tctacagcccacccgtatggtctccatgcatcttta

SEQ ID NO: 57534 - DNA, 35 bp, Artificial Sequence
  Synthetic oligonucleotide
tgagatcgggcaacatttgacctggcccctaatac

SEQ ID NO: 57535 - DNA, 35 bp, Artificial Sequence
  Synthetic oligonucleotide
tctacgccgacggaaacttgatcgccatcacttac

SEQ ID NO: 57536 - DNA, 35 bp, Artificial Sequence
  Synthetic oligonucleotide
gcctgctgccattatgtagcagccttactacgacc

SEQ ID NO: 57537 - DNA, 35 bp, Artificial Sequence
  Synthetic oligonucleotide
tacgttaccccactggtatagggcgtttatcgacc

SEQ ID NO: 57538 - DNA, 35 bp, Artificial Sequence
  Synthetic oligonucleotide
gctgcatcctttcgacgctgttgcggttggcgccc

SEQ ID NO: 57539 - DNA, 35 bp, Artificial Sequence
  Synthetic oligonucleotide
tgacgagtaggcaacctgcccggtcttacctgccc

SEQ ID NO: 57540 - DNA, 35 bp, Artificial Sequence
  Synthetic oligonucleotide
tggaaaccgaggcatccctactggcgatcattccc

SEQ ID NO: 57541 - DNA, 35 bp, Artificial Sequence
  Synthetic oligonucleotide
tggtgccacccgtacttgcaggcctcggcatctcc

SEQ ID NO: 57542 - DNA, 35 bp, Artificial Sequence
  Synthetic oligonucleotide
atgccacttcccttgtacgccaatgccttacttcc

SEQ ID NO: 57543 - DNA, 35 bp, Artificial Sequence
  Synthetic oligonucleotide
atgcccctgttacgacgcccacgcgcatatgcatc

SEQ ID NO: 57544 - DNA, 35 bp, Artificial Sequence
  Synthetic oligonucleotide
ttcatacaccatttgctgtgtcactccaccatatc

SEQ ID NO: 57545 - DNA, 34 bp, Artificial Sequence
  Synthetic oligonucleotide
ggaccgagggctgttcgtcctcacccgccgcctc

SEQ ID NO: 57546 - DNA, 35 bp, Artificial Sequence
  Synthetic oligonucleotide
gctcctagcaccgttctgcccgtaacctcgcgctc

SEQ ID NO: 57547 - DNA, 35 bp, Artificial Sequence
  Synthetic oligonucleotide
tgtacctccatatgcgcttcctacctggttttctc

SEQ ID NO: 57548 - DNA, 35 bp, Artificial Sequence
  Synthetic oligonucleotide
atcgcgaatccgctttgtttgtcctgggtacctag

SEQ ID NO: 57549 - DNA, 35 bp, Artificial Sequence
  Synthetic oligonucleotide
cacccctggccctctctgaacatgaacctgccacg

SEQ ID NO: 57550 - DNA, 35 bp, Artificial Sequence
  Synthetic oligonucleotide
gccgagcccatctacaagtctaagcaccactgccg

SEQ ID NO: 57551 - DNA, 35 bp, Artificial Sequence
  Synthetic oligonucleotide
gaagaaaggggaaagtgacgggatgcggtgctgcg

SEQ ID NO: 57552 - DNA, 35 bp, Artificial Sequence
  Synthetic oligonucleotide
agtcactggtggagggtgaagtagtcgcggtgagg

SEQ ID NO: 57553 - DNA, 35 bp, Artificial Sequence
  Synthetic oligonucleotide
tggatagggtagggagcaaacttttcgggtgacgg

SEQ ID NO: 57554 - DNA, 35 bp, Artificial Sequence
  Synthetic oligonucleotide
taggggattgaaaaaatgaaatagggtgacggggg

SEQ ID NO: 57555 - DNA, 35 bp, Artificial Sequence
  Synthetic oligonucleotide
actgtatctccgactctctaactacacgccgatgg

SEQ ID NO: 57556 - DNA, 35 bp, Artificial Sequence
  Synthetic oligonucleotide
gtagcgtagggggggaagtacaatgatagggatgg

SEQ ID NO: 57557 - DNA, 35 bp, Artificial Sequence
  Synthetic oligonucleotide
agaatccgctgcatacccaaccttgcccgccctgg

SEQ ID NO: 57558 - DNA, 35 bp, Artificial Sequence
  Synthetic oligonucleotide
gctgtccccacgcgctttcctatctgaagacaatg

SEQ ID NO: 57559 - DNA, 35 bp, Artificial Sequence
  Synthetic oligonucleotide
ggacggggtacgaacgaggggttgggtagtggatg

SEQ ID NO: 57560 - DNA, 35 bp, Artificial Sequence
  Synthetic oligonucleotide
gcatcatcatacctttcccgtgcgagctcatcgtg

SEQ ID NO: 57561 - DNA, 35 bp, Artificial Sequence
  Synthetic oligonucleotide
gacattgcccactcgcacgactgccgaacaagcat

SEQ ID NO: 57562 - DNA, 35 bp, Artificial Sequence
  Synthetic oligonucleotide
tgatccttcaccggccagcaacatccttacgtcat

SEQ ID NO: 57563 - DNA, 35 bp, Artificial Sequence
  Synthetic oligonucleotide
tccaggacgccgcttacatctcacgtgttgttcat

SEQ ID NO: 57564 - DNA, 35 bp, Artificial Sequence
  Synthetic oligonucleotide
agacaccccacgctacattctaacgaacgaaatat

SEQ ID NO: 57565 - DNA, 34 bp, Artificial Sequence
  Synthetic oligonucleotide
gccagggcctatagatccccaatgctgcttttat

SEQ ID NO: 57566 - DNA, 35 bp, Artificial Sequence
  Synthetic oligonucleotide
atggccctttgctgcttactaactggacgatcact

SEQ ID NO: 57567 - DNA, 35 bp, Artificial Sequence
  Synthetic oligonucleotide
tagtggtggtcgcatctcctttagtcaactagcct

SEQ ID NO: 57568 - DNA, 35 bp, Artificial Sequence
  Synthetic oligonucleotide
tttgaccaccaatatgatgctcgcaccctcacgct

SEQ ID NO: 57569 - DNA, 35 bp, Artificial Sequence
  Synthetic oligonucleotide
aatggaggggaatagttaaacagaacggggcatct

SEQ ID NO: 57570 - DNA, 35 bp, Artificial Sequence
  Synthetic oligonucleotide
aattggccaggcgcacgaatctaaacccatcctct

SEQ ID NO: 57571 - DNA, 35 bp, Artificial Sequence
  Synthetic oligonucleotide
gtagggccaatcgactccacaacaccagacccctt

SEQ ID NO: 57572 - DNA, 35 bp, Artificial Sequence
  Synthetic oligonucleotide
gcccaagcctcggccccagtagtacgcaggctctt

SEQ ID NO: 57573 - DNA, 35 bp, Artificial Sequence
  Synthetic oligonucleotide
ttcttgcaccacctacagccgcctttttatgtctt

SEQ ID NO: 57574 - DNA, 35 bp, Artificial Sequence
  Synthetic oligonucleotide
gactagccccagccccacgttgacgttcgacagtt

SEQ ID NO: 57575 - DNA, 35 bp, Artificial Sequence
  Synthetic oligonucleotide
tgcacacttatatgcatcgtttcaataactggttt

SEQ ID NO: 57576 - DNA, 35 bp, Artificial Sequence
  Synthetic oligonucleotide
aagtctcgccggacgggctaagcactcctctgttt

SEQ ID NO: 57577 - DNA, 35 bp, Artificial Sequence
  Synthetic oligonucleotide
tccccaatctacagcttcgttctttgccttccaaa

SEQ ID NO: 57578 - DNA, 36 bp, Artificial Sequence
  Synthetic oligonucleotide
ggggacctgcccctgacttgtccgtaatatcaagaa

SEQ ID NO: 57579 - DNA, 36 bp, Artificial Sequence
  Synthetic oligonucleotide
gatccgcctcaactcgctctactttgacgcctggaa

SEQ ID NO: 57580 - DNA, 36 bp, Artificial Sequence
  Synthetic oligonucleotide
gtgccgagacacctcactgtagccgcctgttccaca

SEQ ID NO: 57581 - DNA, 35 bp, Artificial Sequence
  Synthetic oligonucleotide
gccactgacgttggaatttcctggcgcatttgaca

SEQ ID NO: 57582 - DNA, 36 bp, Artificial Sequence
  Synthetic oligonucleotide
gtcacaacacggctcggagcttcaccaataccacca

SEQ ID NO: 57583 - DNA, 36 bp, Artificial Sequence
  Synthetic oligonucleotide
gctggtcctggatcgattcttgttctgtcattacca

SEQ ID NO: 57584 - DNA, 36 bp, Artificial Sequence
  Synthetic oligonucleotide
gatcccgtgaagcgtataactttctgcatatgtcca

SEQ ID NO: 57585 - DNA, 35 bp, Artificial Sequence
  Synthetic oligonucleotide
gcatccccgcacgccagccttttcacggcatggca

SEQ ID NO: 57586 - DNA, 36 bp, Artificial Sequence
  Synthetic oligonucleotide
gatatgagggggtagggaaaggaagttagacgtaga

SEQ ID NO: 57587 - DNA, 37 bp, Artificial Sequence
  Synthetic oligonucleotide
gacgggtgtgaagaggagggggagcatatcaggacga

SEQ ID NO: 57588 - DNA, 37 bp, Artificial Sequence
  Synthetic oligonucleotide
aacgcgcacgggcacactcctctatccaccggaccga

SEQ ID NO: 57589 - DNA, 36 bp, Artificial Sequence
  Synthetic oligonucleotide
tgatggacgaatgacaaggtgggatgaagtgagcga

SEQ ID NO: 57590 - DNA, 36 bp, Artificial Sequence
  Synthetic oligonucleotide
tccaccgactgggctgaccctacttttttattgcga

SEQ ID NO: 57591 - DNA, 38 bp, Artificial Sequence
  Synthetic oligonucleotide
tccgcgccccgcctaccaagataccaccgcagactcga

SEQ ID NO: 57592 - DNA, 37 bp, Artificial Sequence
  Synthetic oligonucleotide
tgaccggatccaacacttagtaccatttacctttcga

SEQ ID NO: 57593 - DNA, 36 bp, Artificial Sequence
  Synthetic oligonucleotide
gagctgaaggggtggaactttggacgaaagggagga

SEQ ID NO: 57594 - DNA, 37 bp, Artificial Sequence
  Synthetic oligonucleotide
aagtgcactccgcaatattcctagtttctccaccgga

SEQ ID NO: 57595 - DNA, 37 bp, Artificial Sequence
  Synthetic oligonucleotide
aggacaagtgcaggtggtggcggaagtggggggcgga

SEQ ID NO: 57596 - DNA, 37 bp, Artificial Sequence
  Synthetic oligonucleotide
aaaccgctggcccccccgagcgcccctccacctcgga

SEQ ID NO: 57597 - DNA, 37 bp, Artificial Sequence
  Synthetic oligonucleotide
aatgacaccattgctgctttcttaccgcccataggga

SEQ ID NO: 57598 - DNA, 37 bp, Artificial Sequence
  Synthetic oligonucleotide
atgcacacgtactgctattgttactcgctattatgga

SEQ ID NO: 57599 - DNA, 37 bp, Artificial Sequence
  Synthetic oligonucleotide
tacgtctgcccgttccacttttgtgtcctgctcatga

SEQ ID NO: 57600 - DNA, 38 bp, Artificial Sequence
  Synthetic oligonucleotide
taggggggatcggagcagggaaagacctgtcgggatga

SEQ ID NO: 57601 - DNA, 37 bp, Artificial Sequence
  Synthetic oligonucleotide
aacgcatcaccgacgaccctgtcatatccatcactga

SEQ ID NO: 57602 - DNA, 38 bp, Artificial Sequence
  Synthetic oligonucleotide
gcgtacatctcagcccctctcacatgggtgacccctga

SEQ ID NO: 57603 - DNA, 38 bp, Artificial Sequence
  Synthetic oligonucleotide
gatagcaaggtaaggtggaggaaaaacacggcatctga

SEQ ID NO: 57604 - DNA, 37 bp, Artificial Sequence
  Synthetic oligonucleotide
acaggtggaggagttaggccgggtagtaggtgagtga

SEQ ID NO: 57605 - DNA, 37 bp, Artificial Sequence
  Synthetic oligonucleotide
ttgaagtggggagtggcgggcgggcgaagtacggtga

SEQ ID NO: 57606 - DNA, 38 bp, Artificial Sequence
  Synthetic oligonucleotide
aacttcccccatcgcccccctgtgtgtaaggaacttga

SEQ ID NO: 57607 - DNA, 37 bp, Artificial Sequence
  Synthetic oligonucleotide
aacagtcgcacaaagttactagttttcaccaccttga

SEQ ID NO: 57608 - DNA, 38 bp, Artificial Sequence
  Synthetic oligonucleotide
agcaccgcgagacataggacgttggggggggagcttga

SEQ ID NO: 57609 - DNA, 38 bp, Artificial Sequence
  Synthetic oligonucleotide
ggtgccactgtgatctaactacgctgcctatctcttga

SEQ ID NO: 57610 - DNA, 38 bp, Artificial Sequence
  Synthetic oligonucleotide
acccgccggtcgccacggatggcttattacgtgtttga

SEQ ID NO: 57611 - DNA, 36 bp, Artificial Sequence
  Synthetic oligonucleotide
acaaagcccgaaggagcgagtaaaggctaaggaata

SEQ ID NO: 57612 - DNA, 35 bp, Artificial Sequence
  Synthetic oligonucleotide
tgaacacaccccggaagccatcgggtcccacacta

SEQ ID NO: 57613 - DNA, 35 bp, Artificial Sequence
  Synthetic oligonucleotide
gtctaccgcaccagccgttttgccctggtttagta

SEQ ID NO: 57614 - DNA, 35 bp, Artificial Sequence
  Synthetic oligonucleotide
atggggcgaatcggcactgcgcataactccttgta

SEQ ID NO: 57615 - DNA, 36 bp, Artificial Sequence
  Synthetic oligonucleotide
gccgccgaagccctcccagttctgaccagtgcgtta

SEQ ID NO: 57616 - DNA, 35 bp, Artificial Sequence
  Synthetic oligonucleotide
taagtgagcgggcacactgcacctcgacgaacaac

SEQ ID NO: 57617 - DNA, 35 bp, Artificial Sequence
  Synthetic oligonucleotide
atgccccgccaccactttctgtcctacggttccac

SEQ ID NO: 57618 - DNA, 35 bp, Artificial Sequence
  Synthetic oligonucleotide
aggagcacccctaggcttccaccatttcgactcac

SEQ ID NO: 57619 - DNA, 35 bp, Artificial Sequence
  Synthetic oligonucleotide
gtctaacttgcagtcgctcttgctcaccgccatac

SEQ ID NO: 57620 - DNA, 35 bp, Artificial Sequence
  Synthetic oligonucleotide
tcagtgtataccgctggccttaaatatcgagttcc

SEQ ID NO: 57621 - DNA, 35 bp, Artificial Sequence
  Synthetic oligonucleotide
gtttagggccccccttgctccgatcccccgtgagc

SEQ ID NO: 57622 - DNA, 35 bp, Artificial Sequence
  Synthetic oligonucleotide
ccatggccacattcaaatagcattcgatccgccgc

SEQ ID NO: 57623 - DNA, 35 bp, Artificial Sequence
  Synthetic oligonucleotide
tacgcccctgctcctttaggttaactacgaacggc

SEQ ID NO: 57624 - DNA, 36 bp, Artificial Sequence
  Synthetic oligonucleotide
tcactccgcaggccacacgactccgccttcgcctgc

SEQ ID NO: 57625 - DNA, 35 bp, Artificial Sequence
  Synthetic oligonucleotide
acgcccatttcaaaatggctttaaaacacttcatc

SEQ ID NO: 57626 - DNA, 35 bp, Artificial Sequence
  Synthetic oligonucleotide
gtcacgcatgtctgttaggctcgcatttctgcctc

SEQ ID NO: 57627 - DNA, 35 bp, Artificial Sequence
  Synthetic oligonucleotide
ttccaccgacccgagtaagtaaaccgctcacgctc

SEQ ID NO: 57628 - DNA, 35 bp, Artificial Sequence
  Synthetic oligonucleotide
ttcagtctcaaccttacgcagcaccccttatcgtc

SEQ ID NO: 57629 - DNA, 35 bp, Artificial Sequence
  Synthetic oligonucleotide
gcctgtcacccggggctattgcacagcctctcttc

SEQ ID NO: 57630 - DNA, 35 bp, Artificial Sequence
  Synthetic oligonucleotide
atccgcaatggtggccacgcgcaccctgttatttc

SEQ ID NO: 57631 - DNA, 35 bp, Artificial Sequence
  Synthetic oligonucleotide
gaatcgcggagcactggtgggacgggcaaagcaag

SEQ ID NO: 57632 - DNA, 35 bp, Artificial Sequence
  Synthetic oligonucleotide
acacctaccgcaccgtacgaactgccactgcgaag

SEQ ID NO: 57633 - DNA, 35 bp, Artificial Sequence
  Synthetic oligonucleotide
gacaccgggagagtgaaggtcgcgcgtaggttaag

SEQ ID NO: 57634 - DNA, 35 bp, Artificial Sequence
  Synthetic oligonucleotide
gcaggggtaatggaagtaaaatgggtgtactgtag

SEQ ID NO: 57635 - DNA, 35 bp, Artificial Sequence
  Synthetic oligonucleotide
tcaggggagggaagggaaataacgtttaactgccg

SEQ ID NO: 57636 - DNA, 35 bp, Artificial Sequence
  Synthetic oligonucleotide
agtacgtctgtcggtcctctatcatctatctcgcg

SEQ ID NO: 57637 - DNA, 36 bp, Artificial Sequence
  Synthetic oligonucleotide
gtgcaaagaggccgagggggcatgcagggaggacgg

SEQ ID NO: 57638 - DNA, 35 bp, Artificial Sequence
  Synthetic oligonucleotide
attgccgtgatgcaccgtcgaacatctcttttttg

SEQ ID NO: 57639 - DNA, 35 bp, Artificial Sequence
  Synthetic oligonucleotide
tgatgtgtggtactatcttatgcgccgccggaact

SEQ ID NO: 57640 - DNA, 35 bp, Artificial Sequence
  Synthetic oligonucleotide
tcaaccgccttgtgccaccatgcacattaatgact

SEQ ID NO: 57641 - DNA, 35 bp, Artificial Sequence
  Synthetic oligonucleotide
ccaccagccccccggacgcccagtctttatgccct

SEQ ID NO: 57642 - DNA, 35 bp, Artificial Sequence
  Synthetic oligonucleotide
ttcactgccctgcctctagaccgccaattcactct

SEQ ID NO: 57643 - DNA, 35 bp, Artificial Sequence
  Synthetic oligonucleotide
tatgacagctgatatagctcggcaccatccctctt

SEQ ID NO: 57644 - DNA, 35 bp, Artificial Sequence
  Synthetic oligonucleotide
atgatccatcacccgtgattagtggacatttagtt

SEQ ID NO: 57645 - DNA, 36 bp, Artificial Sequence
  Synthetic oligonucleotide
gtgccgcccactcgattatccttttctgtcttgcaa

SEQ ID NO: 57646 - DNA, 36 bp, Artificial Sequence
  Synthetic oligonucleotide
tagccgtatgcgcaccatcattttagacgtacttaa

SEQ ID NO: 57647 - DNA, 36 bp, Artificial Sequence
  Synthetic oligonucleotide
gttcaacgattgaccctgtaatactccgtcctaaca

SEQ ID NO: 57648 - DNA, 36 bp, Artificial Sequence
  Synthetic oligonucleotide
tcgattccactactccatgctcttgcgccgcacaca

SEQ ID NO: 57649 - DNA, 36 bp, Artificial Sequence
  Synthetic oligonucleotide
ggtgaattcctgcctgtagtgctcccgacccctaca

SEQ ID NO: 57650 - DNA, 37 bp, Artificial Sequence
  Synthetic oligonucleotide
gtccagggcgaccggaggagggaggcgtacattgaga

SEQ ID NO: 57651 - DNA, 37 bp, Artificial Sequence
  Synthetic oligonucleotide
tccactcacatacaatctgccttcgccctgtcaacga

SEQ ID NO: 57652 - DNA, 36 bp, Artificial Sequence
  Synthetic oligonucleotide
accggaggtcacagaaatgtgtctcgttccccccga

SEQ ID NO: 57653 - DNA, 37 bp, Artificial Sequence
  Synthetic oligonucleotide
gacgcgtaactactgtctcgcctacctggtcccccga

SEQ ID NO: 57654 - DNA, 37 bp, Artificial Sequence
  Synthetic oligonucleotide
tagagctcgaaaggggtggctggattaggaaggagga

SEQ ID NO: 57655 - DNA, 37 bp, Artificial Sequence
  Synthetic oligonucleotide
acaaccggcctcacccccacggttcaacctggaatga

SEQ ID NO: 57656 - DNA, 37 bp, Artificial Sequence
  Synthetic oligonucleotide
ggacaaccactcagcatcccccctgtgaccaccatga

SEQ ID NO: 57657 - DNA, 38 bp, Artificial Sequence
  Synthetic oligonucleotide
acaaccgaacactgcttactgaagtcaggcactcatga

SEQ ID NO: 57658 - DNA, 37 bp, Artificial Sequence
  Synthetic oligonucleotide
gcccaccaccaagtcgtctacaatctccggaacctga

SEQ ID NO: 57659 - DNA, 38 bp, Artificial Sequence
  Synthetic oligonucleotide
acatgtggctcacctatgaggcttaacgtacaccctga

SEQ ID NO: 57660 - DNA, 38 bp, Artificial Sequence
  Synthetic oligonucleotide
gcgaacgtgagatcatcccaccatctcttctgccctga

SEQ ID NO: 57661 - DNA, 38 bp, Artificial Sequence
  Synthetic oligonucleotide
tctcatctccagtatgcattgagcacatctcaggctga

SEQ ID NO: 57662 - DNA, 35 bp, Artificial Sequence
  Synthetic oligonucleotide
tacgatcggaactacacacgctgcccctttgctga

SEQ ID NO: 57663 - DNA, 38 bp, Artificial Sequence
  Synthetic oligonucleotide
ggaccacactatttgattcaccaagcctctgcccttga

SEQ ID NO: 57664 - DNA, 38 bp, Artificial Sequence
  Synthetic oligonucleotide
tgcacccagccacatacatctcaacctgcgggtgttga

SEQ ID NO: 57665 - DNA, 38 bp, Artificial Sequence
  Synthetic oligonucleotide
ggtaaccggagaaggttaggaacgtgtagggagtttga

SEQ ID NO: 57666 - DNA, 38 bp, Artificial Sequence
  Synthetic oligonucleotide
gccggacggtgctccttgtactgcgctatccattttga

SEQ ID NO: 57667 - DNA, 36 bp, Artificial Sequence
  Synthetic oligonucleotide
atctcatgccctctgtctatctatattcacgcaata

SEQ ID NO: 57668 - DNA, 36 bp, Artificial Sequence
  Synthetic oligonucleotide
gagcactcgcaagggggtccacctgtcctcaccata

SEQ ID NO: 57669 - DNA, 36 bp, Artificial Sequence
  Synthetic oligonucleotide
gcgccaccttaacaatactgcacacctactttagta

SEQ ID NO: 57670 - DNA, 35 bp, Artificial Sequence
  Synthetic oligonucleotide
atgtatccccccgccatatattaacgtatcatgta

SEQ ID NO: 57671 - DNA, 36 bp, Artificial Sequence
  Synthetic oligonucleotide
gctcagatcgatgtcgcatgttctctcgccgcctta

SEQ ID NO: 57672 - DNA, 35 bp, Artificial Sequence
  Synthetic oligonucleotide
tcgtaacctctgtctgtcgtagctcacccgcacac

SEQ ID NO: 57673 - DNA, 35 bp, Artificial Sequence
  Synthetic oligonucleotide
tcccccggaaatattcggatatctgaacccttgac

SEQ ID NO: 57674 - DNA, 35 bp, Artificial Sequence
  Synthetic oligonucleotide
ttaacccgcggggaccgcttaacaccctggttgac

SEQ ID NO: 57675 - DNA, 35 bp, Artificial Sequence
  Synthetic oligonucleotide
tgccctcgaacacgatatgcgtgacactatccccc

SEQ ID NO: 57676 - DNA, 35 bp, Artificial Sequence
  Synthetic oligonucleotide
atgtaggccctaatctgccgcctcgtatccctccc

SEQ ID NO: 57677 - DNA, 35 bp, Artificial Sequence
  Synthetic oligonucleotide
gatcgggctcaatgtgtcccagttttttcatggcc

SEQ ID NO: 57678 - DNA, 35 bp, Artificial Sequence
  Synthetic oligonucleotide
aaacacaggcgcggttcgcagctccatcattggcc

SEQ ID NO: 57679 - DNA, 35 bp, Artificial Sequence
  Synthetic oligonucleotide
gaacacaatcagaccgccccgtaaactcctgtgcc

SEQ ID NO: 57680 - DNA, 35 bp, Artificial Sequence
  Synthetic oligonucleotide
tgcttaccgatcgtcacacttcacggctcgactcc

SEQ ID NO: 57681 - DNA, 35 bp, Artificial Sequence
  Synthetic oligonucleotide
tttgcaagccaatatacgcttcgggaatggcctcc

SEQ ID NO: 57682 - DNA, 35 bp, Artificial Sequence
  Synthetic oligonucleotide
gatcgctaccaggtcttccccgagctttaacccgc

SEQ ID NO: 57683 - DNA, 35 bp, Artificial Sequence
  Synthetic oligonucleotide
tgcggtgctgcgccactttctggaatcccaacggc

SEQ ID NO: 57684 - DNA, 35 bp, Artificial Sequence
  Synthetic oligonucleotide
gtggtcacggtgggcagtagaggggagtgacaatc

SEQ ID NO: 57685 - DNA, 35 bp, Artificial Sequence
  Synthetic oligonucleotide
gcccccttaagttccgttcccttgtttgccagatc

SEQ ID NO: 57686 - DNA, 35 bp, Artificial Sequence
  Synthetic oligonucleotide
gcaaaccgccgcatacatggcgcgatacatatctc

SEQ ID NO: 57687 - DNA, 35 bp, Artificial Sequence
  Synthetic oligonucleotide
agaacacactccatttggacaccttactggttctc

SEQ ID NO: 57688 - DNA, 35 bp, Artificial Sequence
  Synthetic oligonucleotide
tgtcaggcccgtgaaatacaaatagtcctaacgtc

SEQ ID NO: 57689 - DNA, 35 bp, Artificial Sequence
  Synthetic oligonucleotide
cctgcccctgccgtgttgtttactcaccgcctttc

SEQ ID NO: 57690 - DNA, 35 bp, Artificial Sequence
  Synthetic oligonucleotide
tgaaaaagcgggggacgggacaggtacggctctag

SEQ ID NO: 57691 - DNA, 35 bp, Artificial Sequence
  Synthetic oligonucleotide
gcactctgaagagatgactcccacacactctagcg

SEQ ID NO: 57692 - DNA, 35 bp, Artificial Sequence
  Synthetic oligonucleotide
gcctcccaccgccgttttacttactgctatcttgg

SEQ ID NO: 57693 - DNA, 35 bp, Artificial Sequence
  Synthetic oligonucleotide
gagaccactacctttatcgcgcactgatctttaat

SEQ ID NO: 57694 - DNA, 35 bp, Artificial Sequence
  Synthetic oligonucleotide
gattgacggggtggattaaaaactgggtggaagat

SEQ ID NO: 57695 - DNA, 35 bp, Artificial Sequence
  Synthetic oligonucleotide
ttttaccgcccaaggtactacttcctccatcttat

SEQ ID NO: 57696 - DNA, 35 bp, Artificial Sequence
  Synthetic oligonucleotide
tgagcacccgcggcgttcctacaatgaaactaact

SEQ ID NO: 57697 - DNA, 35 bp, Artificial Sequence
  Synthetic oligonucleotide
gacgggtagggctgggacgggtgagtgtaggatct

SEQ ID NO: 57698 - DNA, 35 bp, Artificial Sequence
  Synthetic oligonucleotide
gtgagcaatgcgaccgcacaagcctgcaaccctct

SEQ ID NO: 57699 - DNA, 35 bp, Artificial Sequence
  Synthetic oligonucleotide
tctcgtcagtatcgcgagttctggccccttcctct

SEQ ID NO: 57700 - DNA, 35 bp, Artificial Sequence
  Synthetic oligonucleotide
ttgacccccttgtttggccgcgtggccgccctttt

SEQ ID NO: 57701 - DNA, 35 bp, Artificial Sequence
  Synthetic oligonucleotide
acacataccgttcgggacacccccccgctgcccaa

SEQ ID NO: 57702 - DNA, 36 bp, Artificial Sequence
  Synthetic oligonucleotide
gttgcgaaaccgagacgacggggcttaggtggggaa

SEQ ID NO: 57703 - DNA, 36 bp, Artificial Sequence
  Synthetic oligonucleotide
gatgaaccgtgaaaacattatttagactgggatgaa

SEQ ID NO: 57704 - DNA, 35 bp, Artificial Sequence
  Synthetic oligonucleotide
tctggaccctgccctagttctttgaccgagtctaa

SEQ ID NO: 57705 - DNA, 36 bp, Artificial Sequence
  Synthetic oligonucleotide
gttactgccacgccgtattttgtctccttggtctaa

SEQ ID NO: 57706 - DNA, 36 bp, Artificial Sequence
  Synthetic oligonucleotide
acccaccttgctcgaagcacattgtgcttcttaaca

SEQ ID NO: 57707 - DNA, 36 bp, Artificial Sequence
  Synthetic oligonucleotide
actggccaggacgggaggaataggttccaggagaca

SEQ ID NO: 57708 - DNA, 35 bp, Artificial Sequence
  Synthetic oligonucleotide
gagatgcgtaacctagcctgttctccacttcgaca

SEQ ID NO: 57709 - DNA, 35 bp, Artificial Sequence
  Synthetic oligonucleotide
tgtgggggaagaatggctagggaaaaaggagacca

SEQ ID NO: 57710 - DNA, 36 bp, Artificial Sequence
  Synthetic oligonucleotide
tccaaagggccacgcatacagagtccactcacccca

SEQ ID NO: 57711 - DNA, 36 bp, Artificial Sequence
  Synthetic oligonucleotide
ttaaccccttcatccccgctacggtctgcttgcgca

SEQ ID NO: 57712 - DNA, 35 bp, Artificial Sequence
  Synthetic oligonucleotide
ggggaagaaaggggaaggggcataagagtgcaaga

SEQ ID NO: 57713 - DNA, 37 bp, Artificial Sequence
  Synthetic oligonucleotide
ttttgcctcccctctgtttggaacctcaccccagaga

SEQ ID NO: 57714 - DNA, 37 bp, Artificial Sequence
  Synthetic oligonucleotide
acgtgtgtgacgcacgtgggggagggaaagaaggaga

SEQ ID NO: 57715 - DNA, 37 bp, Artificial Sequence
  Synthetic oligonucleotide
gggaaggaaggtggtactggtcatagggagcttgaga

SEQ ID NO: 57716 - DNA, 37 bp, Artificial Sequence
  Synthetic oligonucleotide
tatggggaaggggcctggaggggattttgactaacga

SEQ ID NO: 57717 - DNA, 37 bp, Artificial Sequence
  Synthetic oligonucleotide
gtgccgtagctgtcgccacgtacaaacctaaccacga

SEQ ID NO: 57718 - DNA, 37 bp, Artificial Sequence
  Synthetic oligonucleotide
tgttgcacctctgggggtctcctatcgcctctgccga

SEQ ID NO: 57719 - DNA, 37 bp, Artificial Sequence
  Synthetic oligonucleotide
aatagcccggggactggaggagtggggtggggatcga

SEQ ID NO: 57720 - DNA, 37 bp, Artificial Sequence
  Synthetic oligonucleotide
ttgcgtcacaccaccctgcgttcgccatctaattcga

SEQ ID NO: 57721 - DNA, 37 bp, Artificial Sequence
  Synthetic oligonucleotide
atgccaatccgctctcgactttatcatggacccagga

SEQ ID NO: 57722 - DNA, 37 bp, Artificial Sequence
  Synthetic oligonucleotide
tgggatgaaatgggtttggaaggaatagcggagagga

SEQ ID NO: 57723 - DNA, 37 bp, Artificial Sequence
  Synthetic oligonucleotide
tgtattgcacctctccgtcttctttcctgtccaggga

SEQ ID NO: 57724 - DNA, 37 bp, Artificial Sequence
  Synthetic oligonucleotide
gacacaccgcagttctccctcctttacgctcagggga

SEQ ID NO: 57725 - DNA, 37 bp, Artificial Sequence
  Synthetic oligonucleotide
gaactagcaagaataggggaacggtgctaatggggga

SEQ ID NO: 57726 - DNA, 38 bp, Artificial Sequence
  Synthetic oligonucleotide
gagcaagattacagggaaggtcagagggcgcgcgatga

SEQ ID NO: 57727 - DNA, 37 bp, Artificial Sequence
  Synthetic oligonucleotide
tgaccaaacaggaggaatggaaaggtactagtgatga

SEQ ID NO: 57728 - DNA, 38 bp, Artificial Sequence
  Synthetic oligonucleotide
taccacgcccatgagttctcgacgttgctaatgtatga

SEQ ID NO: 57729 - DNA, 38 bp, Artificial Sequence
  Synthetic oligonucleotide
agatgcgttgcctgtcccgtttcctttcaatgtgctga

SEQ ID NO: 57730 - DNA, 37 bp, Artificial Sequence
  Synthetic oligonucleotide
ggtccacacctctgcctttagtaataaactttgctga

SEQ ID NO: 57731 - DNA, 38 bp, Artificial Sequence
  Synthetic oligonucleotide
gacgctacgagagtgcgccgtcccaccctccgccgtga

SEQ ID NO: 57732 - DNA, 38 bp, Artificial Sequence
  Synthetic oligonucleotide
gaagagacgggaactgggtggttacataaggggggtga

SEQ ID NO: 57733 - DNA, 38 bp, Artificial Sequence
  Synthetic oligonucleotide
catgccgcacgcaacacctatggcctgtttcaccttga

SEQ ID NO: 57734 - DNA, 38 bp, Artificial Sequence
  Synthetic oligonucleotide
tacgacgacgtagggcctggcttttgacaacacgttga

SEQ ID NO: 57735 - DNA, 38 bp, Artificial Sequence
  Synthetic oligonucleotide
tacgcttgtaatgaagtcgttgccgccaccacctttga

SEQ ID NO: 57736 - DNA, 38 bp, Artificial Sequence
  Synthetic oligonucleotide
ggacggagagggatgtgggagggaatgcttgtctttga

SEQ ID NO: 57737 - DNA, 37 bp, Artificial Sequence
  Synthetic oligonucleotide
acagaacccattctgcactccccgaactccgttttga

SEQ ID NO: 57738 - DNA, 36 bp, Artificial Sequence
  Synthetic oligonucleotide
aaagggtgggaagaaggataagtgggctggatcata

SEQ ID NO: 57739 - DNA, 36 bp, Artificial Sequence
  Synthetic oligonucleotide
ggtcgttgggaggcgaaggggcaggaggagatgata

SEQ ID NO: 57740 - DNA, 36 bp, Artificial Sequence
  Synthetic oligonucleotide
ttgagctgacctgggtactatcttggccattgagta

SEQ ID NO: 57741 - DNA, 35 bp, Artificial Sequence
  Synthetic oligonucleotide
acacagtaccacaggttgctatcgctcaacctgta

SEQ ID NO: 57742 - DNA, 35 bp, Artificial Sequence
  Synthetic oligonucleotide
gtagtcgcacattgttcacttgacctctacactta

SEQ ID NO: 57743 - DNA, 36 bp, Artificial Sequence
  Synthetic oligonucleotide
agtgcctgatcgatctcccgtgctctcgcttgctta

SEQ ID NO: 57744 - DNA, 36 bp, Artificial Sequence
  Synthetic oligonucleotide
tagacctagggccgcccgttgaatgcttctcgttta

SEQ ID NO: 57745 - DNA, 35 bp, Artificial Sequence
  Synthetic oligonucleotide
gagcccgttccaagcctccgtcgctttcatagcac

SEQ ID NO: 57746 - DNA, 35 bp, Artificial Sequence
  Synthetic oligonucleotide
gtcgaaccccacctcgtacaagcgcccgactttac

SEQ ID NO: 57747 - DNA, 35 bp, Artificial Sequence
  Synthetic oligonucleotide
acacgccacaacggcccaaaaattcatgacttccc

SEQ ID NO: 57748 - DNA, 35 bp, Artificial Sequence
  Synthetic oligonucleotide
accctaacaggaggttcgcgttgcctgcttattcc

SEQ ID NO: 57749 - DNA, 35 bp, Artificial Sequence
  Synthetic oligonucleotide
tcgacgacagtgcagttttccatgttgctttcagc

SEQ ID NO: 57750 - DNA, 35 bp, Artificial Sequence
  Synthetic oligonucleotide
ttcccaacacactttgccacgggcgttgacactgc

SEQ ID NO: 57751 - DNA, 35 bp, Artificial Sequence
  Synthetic oligonucleotide
gtattgcccgtcctcccaaactcggctcacttatc

SEQ ID NO: 57752 - DNA, 35 bp, Artificial Sequence
  Synthetic oligonucleotide
ttgcgaaagcatggaggaatcccccctctcttgtc

SEQ ID NO: 57753 - DNA, 35 bp, Artificial Sequence
  Synthetic oligonucleotide
gattatcgatgcagggaggccgccccttcttgttc

SEQ ID NO: 57754 - DNA, 35 bp, Artificial Sequence
  Synthetic oligonucleotide
acagacattgcaaacgccaccagctctactactcg

SEQ ID NO: 57755 - DNA, 35 bp, Artificial Sequence
  Synthetic oligonucleotide
tccactcgattcatatgtgaactcccttcttcgtg

SEQ ID NO: 57756 - DNA, 35 bp, Artificial Sequence
  Synthetic oligonucleotide
tagagtgtgggagtcgggagggggatcgcgcgttg

SEQ ID NO: 57757 - DNA, 35 bp, Artificial Sequence
  Synthetic oligonucleotide
tccaacgtagcagcataagccctctctcaccgcat

SEQ ID NO: 57758 - DNA, 35 bp, Artificial Sequence
  Synthetic oligonucleotide
aacatcgcacccgctcgactgactaaaccacacct

SEQ ID NO: 57759 - DNA, 35 bp, Artificial Sequence
  Synthetic oligonucleotide
acacgcctggcccctgttttttaaatagagcacct

SEQ ID NO: 57760 - DNA, 35 bp, Artificial Sequence
  Synthetic oligonucleotide
gatgctgcaccatccctcttatgattgctgttgct

SEQ ID NO: 57761 - DNA, 35 bp, Artificial Sequence
  Synthetic oligonucleotide
gcgcactgccctattagaccaaccttgcctttgct

SEQ ID NO: 57762 - DNA, 35 bp, Artificial Sequence
  Synthetic oligonucleotide
accactcgggtaatgttaccacgctcgttctatct

SEQ ID NO: 57763 - DNA, 35 bp, Artificial Sequence
  Synthetic oligonucleotide
gaagccgagcatgccctgccctggttttatgtagt

SEQ ID NO: 57764 - DNA, 35 bp, Artificial Sequence
  Synthetic oligonucleotide
gtgaaccaggcagaagaaaactagggcggcatggt

SEQ ID NO: 57765 - DNA, 35 bp, Artificial Sequence
  Synthetic oligonucleotide
agttgccctcttacgaagtgcttctccctttcatt

SEQ ID NO: 57766 - DNA, 35 bp, Artificial Sequence
  Synthetic oligonucleotide
gccaggccacactcgtgtcaatctcctcagacgtt

SEQ ID NO: 57767 - DNA, 36 bp, Artificial Sequence
  Synthetic oligonucleotide
ggagcacgggggggttgccagggcgagggagagcaa

SEQ ID NO: 57768 - DNA, 36 bp, Artificial Sequence
  Synthetic oligonucleotide
agcgccgtaggagagggagcattgggatttacggaa

SEQ ID NO: 57769 - DNA, 35 bp, Artificial Sequence
  Synthetic oligonucleotide
gttgagggtgagggtgcgagcatggggttgggtaa

SEQ ID NO: 57770 - DNA, 36 bp, Artificial Sequence
  Synthetic oligonucleotide
acccctcagctgcgcctcatccgcctgttgaacaca

SEQ ID NO: 57771 - DNA, 36 bp, Artificial Sequence
  Synthetic oligonucleotide
actgacgcaagaactatctatcaggaacatagcaca

SEQ ID NO: 57772 - DNA, 36 bp, Artificial Sequence
  Synthetic oligonucleotide
tcatacggccaaatgcctccgcgcttctctaaccca

SEQ ID NO: 57773 - DNA, 36 bp, Artificial Sequence
  Synthetic oligonucleotide
gcgaatcacttccgccacatgtatatcacatggcca

SEQ ID NO: 57774 - DNA, 36 bp, Artificial Sequence
  Synthetic oligonucleotide
gactgcctgggaacctgtccgtaacttagcattcca

SEQ ID NO: 57775 - DNA, 35 bp, Artificial Sequence
  Synthetic oligonucleotide
acaacactgagtgaattgtcacccgtccccacgca

SEQ ID NO: 57776 - DNA, 35 bp, Artificial Sequence
  Synthetic oligonucleotide
aaacaggcggggagatcaccgaagggggggcatca

SEQ ID NO: 57777 - DNA, 36 bp, Artificial Sequence
  Synthetic oligonucleotide
attgaccagggcccccgcctccattggcctcactca

SEQ ID NO: 57778 - DNA, 36 bp, Artificial Sequence
  Synthetic oligonucleotide
gtgcggctcaatgaacgtccttgttgcgctacctca

SEQ ID NO: 57779 - DNA, 36 bp, Artificial Sequence
  Synthetic oligonucleotide
gcgatgggggggaggatacgattaggcgtggtgtca

SEQ ID NO: 57780 - DNA, 38 bp, Artificial Sequence
  Synthetic oligonucleotide
gagacgctagggtgggtcggaatacggcgaaaaacaga

SEQ ID NO: 57781 - DNA, 37 bp, Artificial Sequence
  Synthetic oligonucleotide
gatgggacatgggcatgaagggcgggtattctgcaga

SEQ ID NO: 57782 - DNA, 36 bp, Artificial Sequence
  Synthetic oligonucleotide
atcaccgacccgctgatccatttaccctgccggaga

SEQ ID NO: 57783 - DNA, 37 bp, Artificial Sequence
  Synthetic oligonucleotide
gaccccctcgtaagttcggctctttatctcttgacga

SEQ ID NO: 57784 - DNA, 36 bp, Artificial Sequence
  Synthetic oligonucleotide
gaagaaaggaaaagattggtgaaggtgaaaatacga

SEQ ID NO: 57785 - DNA, 36 bp, Artificial Sequence
  Synthetic oligonucleotide
atagcccccggctctccgtcttctccacatgggcga

SEQ ID NO: 57786 - DNA, 37 bp, Artificial Sequence
  Synthetic oligonucleotide
atccaccggtccacaccctaaagccgcagactggcga

SEQ ID NO: 57787 - DNA, 37 bp, Artificial Sequence
  Synthetic oligonucleotide
gacgcaggagcatccccccggtcccataacccctcga

SEQ ID NO: 57788 - DNA, 37 bp, Artificial Sequence
  Synthetic oligonucleotide
tacgtcgctgcgtgcgctgtctacccacttctttcga

SEQ ID NO: 57789 - DNA, 37 bp, Artificial Sequence
  Synthetic oligonucleotide
gaaaccagctggatagacggagaaggacaagagagga

SEQ ID NO: 57790 - DNA, 37 bp, Artificial Sequence
  Synthetic oligonucleotide
gtgttggaagttgattgacggaaggcggagtaatgga

SEQ ID NO: 57791 - DNA, 37 bp, Artificial Sequence
  Synthetic oligonucleotide
agcccaacaggtacgactcgactcatagattgctgga

SEQ ID NO: 57792 - DNA, 37 bp, Artificial Sequence
  Synthetic oligonucleotide
tgagggttagagtagcacgtggtagggggaggttgga

SEQ ID NO: 57793 - DNA, 38 bp, Artificial Sequence
  Synthetic oligonucleotide
aagagggaaactaccaggcagtcgggacaagttaatga

SEQ ID NO: 57794 - DNA, 38 bp, Artificial Sequence
  Synthetic oligonucleotide
tgcactcagggatcaatggggagggcgggagaaactga

SEQ ID NO: 57795 - DNA, 36 bp, Artificial Sequence
  Synthetic oligonucleotide
accatggaaggggtggcaataaaagatttagactga

SEQ ID NO: 57796 - DNA, 37 bp, Artificial Sequence
  Synthetic oligonucleotide
accccgtcccacaaccattagcgtcatcattggctga

SEQ ID NO: 57797 - DNA, 37 bp, Artificial Sequence
  Synthetic oligonucleotide
taaggagtgggcacagggagggggtcacaagtagtga

SEQ ID NO: 57798 - DNA, 38 bp, Artificial Sequence
  Synthetic oligonucleotide
tgctacttcctcgttcgtttgaccattctcagtcttga

SEQ ID NO: 57799 - DNA, 38 bp, Artificial Sequence
  Synthetic oligonucleotide
gtcacacgttacatacctcatcacgtgtctccctttga

SEQ ID NO: 57800 - DNA, 35 bp, Artificial Sequence
  Synthetic oligonucleotide
aaaccccagccccgccccatgtctttgtaccacta

SEQ ID NO: 57801 - DNA, 36 bp, Artificial Sequence
  Synthetic oligonucleotide
agcaccactctaacctggcgaggactgccaatccta

SEQ ID NO: 57802 - DNA, 35 bp, Artificial Sequence
  Synthetic oligonucleotide
gtggtgcgcaacatattacactctcccacggtcta

SEQ ID NO: 57803 - DNA, 35 bp, Artificial Sequence
  Synthetic oligonucleotide
gtcgcagacgccttgctgctacccctctcctcgta

SEQ ID NO: 57804 - DNA, 35 bp, Artificial Sequence
  Synthetic oligonucleotide
gaatgcacacaactgttaaagggggggatcgctta

SEQ ID NO: 57805 - DNA, 36 bp, Artificial Sequence
  Synthetic oligonucleotide
aactcccttcgatcgagtaagtggtcgccgatctta

SEQ ID NO: 57806 - DNA, 35 bp, Artificial Sequence
  Synthetic oligonucleotide
gcaagctcaccgtcccccgcttggttcatagttta

SEQ ID NO: 57807 - DNA, 35 bp, Artificial Sequence
  Synthetic oligonucleotide
gacgtggggaggcgaacgggaatacgggtatgcac

SEQ ID NO: 57808 - DNA, 35 bp, Artificial Sequence
  Synthetic oligonucleotide
gtccttacatgctgccccaacctcgtgatgctccc

SEQ ID NO: 57809 - DNA, 35 bp, Artificial Sequence
  Synthetic oligonucleotide
gcgtgcctggccagcccaactatgaagttcttgcc

SEQ ID NO: 57810 - DNA, 35 bp, Artificial Sequence
  Synthetic oligonucleotide
tgccccgcacccgttgctatcttgttaattgttcc

SEQ ID NO: 57811 - DNA, 35 bp, Artificial Sequence
  Synthetic oligonucleotide
tacgatcttgaacggatagttccgggtccttttcc

SEQ ID NO: 57812 - DNA, 35 bp, Artificial Sequence
  Synthetic oligonucleotide
gctcacacaccgagttaagttgttcttcgtcttgc

SEQ ID NO: 57813 - DNA, 35 bp, Artificial Sequence
  Synthetic oligonucleotide
ttcaggtacccaccgcattggaacggccttttatc

SEQ ID NO: 57814 - DNA, 35 bp, Artificial Sequence
  Synthetic oligonucleotide
tccactttcccatgcccttgctacagccacgactc

SEQ ID NO: 57815 - DNA, 35 bp, Artificial Sequence
  Synthetic oligonucleotide
gaaccccgtcccgcaaagggtagcctatgcacctc

SEQ ID NO: 57816 - DNA, 35 bp, Artificial Sequence
  Synthetic oligonucleotide
gcaacacaaggggtgggaaataattgggcgtaacg

SEQ ID NO: 57817 - DNA, 35 bp, Artificial Sequence
  Synthetic oligonucleotide
tccgcaaatgtccgtagctcactgtatctcacccg

SEQ ID NO: 57818 - DNA, 35 bp, Artificial Sequence
  Synthetic oligonucleotide
gagtggagctcagcatggggatggcaggtgattcg

SEQ ID NO: 57819 - DNA, 35 bp, Artificial Sequence
  Synthetic oligonucleotide
atgaaagggccaaaagaataagcaaccgtcccagg

SEQ ID NO: 57820 - DNA, 35 bp, Artificial Sequence
  Synthetic oligonucleotide
ggggtgggggatagggatcaagggactagatcatg

SEQ ID NO: 57821 - DNA, 35 bp, Artificial Sequence
  Synthetic oligonucleotide
tcatacgcgcacaagctacccgacgcttaacactg

SEQ ID NO: 57822 - DNA, 35 bp, Artificial Sequence
  Synthetic oligonucleotide
gaaaaggaaggggaaagttcgtatgacgtagggtg

SEQ ID NO: 57823 - DNA, 35 bp, Artificial Sequence
  Synthetic oligonucleotide
gaaccgtagctaagtcccacccccgtcactatgtg

SEQ ID NO: 57824 - DNA, 35 bp, Artificial Sequence
  Synthetic oligonucleotide
ttgcaccagttatcgggctatgttatctctttttg

SEQ ID NO: 57825 - DNA, 35 bp, Artificial Sequence
  Synthetic oligonucleotide
accctcgtgcaacatgtgcgctttataattaccat

SEQ ID NO: 57826 - DNA, 35 bp, Artificial Sequence
  Synthetic oligonucleotide
agggggcaacccgcgctggtccgatcccgctccat

SEQ ID NO: 57827 - DNA, 35 bp, Artificial Sequence
  Synthetic oligonucleotide
gaacgtaccatgtgatgtttcgccacgccccacct

SEQ ID NO: 57828 - DNA, 35 bp, Artificial Sequence
  Synthetic oligonucleotide
ttcgatgtgctcacccaccatggcccacgatcgct

SEQ ID NO: 57829 - DNA, 35 bp, Artificial Sequence
  Synthetic oligonucleotide
attcgacgaacatcagcctacaacagctcttacgt

SEQ ID NO: 57830 - DNA, 35 bp, Artificial Sequence
  Synthetic oligonucleotide
tccattggttgcaaccacctaccgtacttaacggt

SEQ ID NO: 57831 - DNA, 35 bp, Artificial Sequence
  Synthetic oligonucleotide
gccagacacatctcttccctcagctaagacgctgt

SEQ ID NO: 57832 - DNA, 35 bp, Artificial Sequence
  Synthetic oligonucleotide
gtggtcctcggcctgaacatggtccttctatactt

SEQ ID NO: 57833 - DNA, 35 bp, Artificial Sequence
  Synthetic oligonucleotide
tgcgggtcgcgattagcgaatgtacctccccgctt

SEQ ID NO: 57834 - DNA, 35 bp, Artificial Sequence
  Synthetic oligonucleotide
gctcctccacatgactacaatggaacgtgcctgtt

SEQ ID NO: 57835 - DNA, 35 bp, Artificial Sequence
  Synthetic oligonucleotide
gtctcctcctggtatgaggctctcgcaccactttt

SEQ ID NO: 57836 - DNA, 36 bp, Artificial Sequence
  Synthetic oligonucleotide
accacgcaacgcaactttctctagtgtactcgtaaa

SEQ ID NO: 57837 - DNA, 35 bp, Artificial Sequence
  Synthetic oligonucleotide
accgtcccccgtacgtaggtactagatacccccaa

SEQ ID NO: 57838 - DNA, 36 bp, Artificial Sequence
  Synthetic oligonucleotide
atgtccgaccccgtgaacttggctctgagactccaa

SEQ ID NO: 57839 - DNA, 36 bp, Artificial Sequence
  Synthetic oligonucleotide
gttcgccgagtgcacttttcgcctttgcctaagcaa

SEQ ID NO: 57840 - DNA, 35 bp, Artificial Sequence
  Synthetic oligonucleotide
ttgttgtgcctacttcgtttcctcggggtgaccca

SEQ ID NO: 57841 - DNA, 36 bp, Artificial Sequence
  Synthetic oligonucleotide
agaacaacatgtgcttagcctgccactatataccca

SEQ ID NO: 57842 - DNA, 35 bp, Artificial Sequence
  Synthetic oligonucleotide
tcgcgttacttcccgtgcttactgtcccctgtcca

SEQ ID NO: 57843 - DNA, 37 bp, Artificial Sequence
  Synthetic oligonucleotide
tctgtcgccaccggtttacccttctcacgcctgcaga

SEQ ID NO: 57844 - DNA, 37 bp, Artificial Sequence
  Synthetic oligonucleotide
atacaaaaacaagggagagtaacgggggttggtgaga

SEQ ID NO: 57845 - DNA, 37 bp, Artificial Sequence
  Synthetic oligonucleotide
aacaccaccacccagagtgtcgaccacgtcgttgaga

SEQ ID NO: 57846 - DNA, 37 bp, Artificial Sequence
  Synthetic oligonucleotide
acgaaagggcgcaaaggatatggggctgcattatgga

SEQ ID NO: 57847 - DNA, 36 bp, Artificial Sequence
  Synthetic oligonucleotide
acgtgcccgcgccagtatatcctttccgtttcctga

SEQ ID NO: 57848 - DNA, 38 bp, Artificial Sequence
  Synthetic oligonucleotide
tcgtcgaggaaggagcgaggggaaagggagtgtagtga

SEQ ID NO: 57849 - DNA, 38 bp, Artificial Sequence
  Synthetic oligonucleotide
atcctcatccagtaagtcgtacccaccatccgacgtga

SEQ ID NO: 57850 - DNA, 38 bp, Artificial Sequence
  Synthetic oligonucleotide
aactcgctcaggcgcacttgcccatcccatgaccgtga

SEQ ID NO: 57851 - DNA, 36 bp, Artificial Sequence
  Synthetic oligonucleotide
aaccctgaatgcccttgtcggcacacacctccgtga

SEQ ID NO: 57852 - DNA, 38 bp, Artificial Sequence
  Synthetic oligonucleotide
ttggggtagcaggagggtcgggatcgggttggttgtga

SEQ ID NO: 57853 - DNA, 37 bp, Artificial Sequence
  Synthetic oligonucleotide
tcgtgtcgtcacttgaccctgttcgcgcaacccttga

SEQ ID NO: 57854 - DNA, 38 bp, Artificial Sequence
  Synthetic oligonucleotide
gcacacaacctgcctaagtacacctagtatgctcttga

SEQ ID NO: 57855 - DNA, 35 bp, Artificial Sequence
  Synthetic oligonucleotide
tgggccctcggctccccaccttctaagccttcata

SEQ ID NO: 57856 - DNA, 36 bp, Artificial Sequence
  Synthetic oligonucleotide
tgaccggctgggatgggggaaaaactggggtggata

SEQ ID NO: 57857 - DNA, 36 bp, Artificial Sequence
  Synthetic oligonucleotide
acaccccttgcaccggtcccacaaaacggtcaccta

SEQ ID NO: 57858 - DNA, 35 bp, Artificial Sequence
  Synthetic oligonucleotide
gtagccgagtcactaatgctggttcctctgcccta

SEQ ID NO: 57859 - DNA, 36 bp, Artificial Sequence
  Synthetic oligonucleotide
ttcgaattgtcgcctcctgtaccactcatacgccta

SEQ ID NO: 57860 - DNA, 37 bp, Artificial Sequence
  Synthetic oligonucleotide
acaatgcgcgtacctaaccggtccttttcttgccgta

SEQ ID NO: 57861 - DNA, 35 bp, Artificial Sequence
  Synthetic oligonucleotide
tcactcacggcgcccttaccaagcccccatgggta

SEQ ID NO: 57862 - DNA, 36 bp, Artificial Sequence
  Synthetic oligonucleotide
gatgtggcgattcgagggtgtgaaggggggattgta

SEQ ID NO: 57863 - DNA, 35 bp, Artificial Sequence
  Synthetic oligonucleotide
gcgatactccttcccgatcgatgaccataggccac

SEQ ID NO: 57864 - DNA, 35 bp, Artificial Sequence
  Synthetic oligonucleotide
atccaagctcgccctcccgtttgttcatgtcgcac

SEQ ID NO: 57865 - DNA, 35 bp, Artificial Sequence
  Synthetic oligonucleotide
gccacatacattgccgcaactagcgctacatatac

SEQ ID NO: 57866 - DNA, 35 bp, Artificial Sequence
  Synthetic oligonucleotide
gttctaggggggaaaggggtggcaagtgtgggacc

SEQ ID NO: 57867 - DNA, 35 bp, Artificial Sequence
  Synthetic oligonucleotide
tgtcctgccccaatgagctcttcgccctggatacc

SEQ ID NO: 57868 - DNA, 35 bp, Artificial Sequence
  Synthetic oligonucleotide
aaaacgatagtgtcgtacgcaaccttcctgcaccc

SEQ ID NO: 57869 - DNA, 35 bp, Artificial Sequence
  Synthetic oligonucleotide
gagcgcgaacctcaatctattgaaggccacccccc

SEQ ID NO: 57870 - DNA, 35 bp, Artificial Sequence
  Synthetic oligonucleotide
gaaccttcacacttagcacccttcccgcatgcccc

SEQ ID NO: 57871 - DNA, 35 bp, Artificial Sequence
  Synthetic oligonucleotide
gcgtacacaatggctagtttctcccggcgaattcc

SEQ ID NO: 57872 - DNA, 35 bp, Artificial Sequence
  Synthetic oligonucleotide
atacttcatgtccgcccatttcgctctgtacctgc

SEQ ID NO: 57873 - DNA, 35 bp, Artificial Sequence
  Synthetic oligonucleotide
agggccaaccttcgcccctgacgctttataacatc

SEQ ID NO: 57874 - DNA, 35 bp, Artificial Sequence
  Synthetic oligonucleotide
gtcgcctcaccggcttaaacggtggtctctacatc

SEQ ID NO: 57875 - DNA, 35 bp, Artificial Sequence
  Synthetic oligonucleotide
accccccccaaccgatttgcctgcagccataacag

SEQ ID NO: 57876 - DNA, 35 bp, Artificial Sequence
  Synthetic oligonucleotide
tgccgcgtaaacacaccgtattccaactgtcctcg

SEQ ID NO: 57877 - DNA, 35 bp, Artificial Sequence
  Synthetic oligonucleotide
agttgcgggaggcggggctaatcatggaagggtcg

SEQ ID NO: 57878 - DNA, 35 bp, Artificial Sequence
  Synthetic oligonucleotide
gagcggagagcgagcgggacaacgatgaacagaat

SEQ ID NO: 57879 - DNA, 35 bp, Artificial Sequence
  Synthetic oligonucleotide
tagcacatccccgtaggcctcccccgatccaagat

SEQ ID NO: 57880 - DNA, 35 bp, Artificial Sequence
  Synthetic oligonucleotide
acccgcatccctggactaaaaagccgtattaacct

SEQ ID NO: 57881 - DNA, 35 bp, Artificial Sequence
  Synthetic oligonucleotide
tgcacctttcatcagcgggatccaccttcgccgct

SEQ ID NO: 57882 - DNA, 35 bp, Artificial Sequence
  Synthetic oligonucleotide
ttggtcggagctgatctttcacgtggtttctatct

SEQ ID NO: 57883 - DNA, 35 bp, Artificial Sequence
  Synthetic oligonucleotide
gttagcagtcaagtcaacgcctactcattatctct

SEQ ID NO: 57884 - DNA, 35 bp, Artificial Sequence
  Synthetic oligonucleotide
atggggtgcctgctgtactattccctcccaactgt

SEQ ID NO: 57885 - DNA, 35 bp, Artificial Sequence
  Synthetic oligonucleotide
gtcccctctgcgaaccccggcttcacgacactctt

SEQ ID NO: 57886 - DNA, 35 bp, Artificial Sequence
  Synthetic oligonucleotide
aggccaccaccgccctctcatggttattcttcgtt

SEQ ID NO: 57887 - DNA, 36 bp, Artificial Sequence
  Synthetic oligonucleotide
accaacctcacggacctgtcgcgttttttaatcaaa

SEQ ID NO: 57888 - DNA, 36 bp, Artificial Sequence
  Synthetic oligonucleotide
tcattccaccctcccaggattgtctaggagttcaaa

SEQ ID NO: 57889 - DNA, 36 bp, Artificial Sequence
  Synthetic oligonucleotide
aagtggatgggtacaacggttggggaaatgagagaa

SEQ ID NO: 57890 - DNA, 36 bp, Artificial Sequence
  Synthetic oligonucleotide
gatgggaacagcaggagaggggagatggttctagaa

SEQ ID NO: 57891 - DNA, 36 bp, Artificial Sequence
  Synthetic oligonucleotide
atggaaaaagggaacatgcgcggagacaagatgtaa

SEQ ID NO: 57892 - DNA, 36 bp, Artificial Sequence
  Synthetic oligonucleotide
gactgctcctcgggctctatgccgaatccttgaaca

SEQ ID NO: 57893 - DNA, 36 bp, Artificial Sequence
  Synthetic oligonucleotide
accctatccccgtgctgagcaacggttagtttacca

SEQ ID NO: 57894 - DNA, 35 bp, Artificial Sequence
  Synthetic oligonucleotide
gacgcagacgaaccccgactcgaacgtacaagcca

SEQ ID NO: 57895 - DNA, 35 bp, Artificial Sequence
  Synthetic oligonucleotide
gcgaaacactcgcaaaatgtacatccaaatctcca

SEQ ID NO: 57896 - DNA, 36 bp, Artificial Sequence
  Synthetic oligonucleotide
ttgatcgatagatcatttgcttggacacttgttcca

SEQ ID NO: 57897 - DNA, 35 bp, Artificial Sequence
  Synthetic oligonucleotide
acatctgctaccatatcactacggagctttctgca

SEQ ID NO: 57898 - DNA, 35 bp, Artificial Sequence
  Synthetic oligonucleotide
gacgcctgttcatcggtgcaacacacaagccatca

SEQ ID NO: 57899 - DNA, 35 bp, Artificial Sequence
  Synthetic oligonucleotide
tagccattctctcacgcccagcctccgaagcctca

SEQ ID NO: 57900 - DNA, 36 bp, Artificial Sequence
  Synthetic oligonucleotide
tgccaaccctcattaatggatcttctgttcgtctca

SEQ ID NO: 57901 - DNA, 37 bp, Artificial Sequence
  Synthetic oligonucleotide
tcacctctgtcacgttcgcatcaactacgttcaccga

SEQ ID NO: 57902 - DNA, 37 bp, Artificial Sequence
  Synthetic oligonucleotide
gccacccattcctgacccttggtatacttccctccga

SEQ ID NO: 57903 - DNA, 37 bp, Artificial Sequence
  Synthetic oligonucleotide
tctgcacccatcacttgcttactgacacccgatagga

SEQ ID NO: 57904 - DNA, 38 bp, Artificial Sequence
  Synthetic oligonucleotide
tgactggtgcaagggtgggaaaaaattccggaaaatga

SEQ ID NO: 57905 - DNA, 38 bp, Artificial Sequence
  Synthetic oligonucleotide
ggagaggatcgggggaaaaggggtgcctcgggatatga

SEQ ID NO: 57906 - DNA, 38 bp, Artificial Sequence
  Synthetic oligonucleotide
gtcgtagagcccggtatttctttggttcctgttactga

SEQ ID NO: 57907 - DNA, 38 bp, Artificial Sequence
  Synthetic oligonucleotide
gtggcgccctgacgcgcgaatagcctaccttgccctga

SEQ ID NO: 57908 - DNA, 36 bp, Artificial Sequence
  Synthetic oligonucleotide
tactgactgcgtgcctatgcgttcttttttgcctga

SEQ ID NO: 57909 - DNA, 38 bp, Artificial Sequence
  Synthetic oligonucleotide
gcccacgcctaaccatgaactttgctcagtaaagctga

SEQ ID NO: 57910 - DNA, 38 bp, Artificial Sequence
  Synthetic oligonucleotide
gacggtctggtaggaagagaggggtgacggagggctga

SEQ ID NO: 57911 - DNA, 37 bp, Artificial Sequence
  Synthetic oligonucleotide
gcacacccgtgtgtgcgtgttagaaggtactggctga

SEQ ID NO: 57912 - DNA, 38 bp, Artificial Sequence
  Synthetic oligonucleotide
acacgagaggggcggacgactggaacggggggctctga

SEQ ID NO: 57913 - DNA, 38 bp, Artificial Sequence
  Synthetic oligonucleotide
tcacccgatccctgactattaaagtcctcacggagtga

SEQ ID NO: 57914 - DNA, 38 bp, Artificial Sequence
  Synthetic oligonucleotide
tgtaccgtacccacatttgtctgcatctatgaccgtga

SEQ ID NO: 57915 - DNA, 38 bp, Artificial Sequence
  Synthetic oligonucleotide
tcacacacaacttttcatcaacacgtacctgcccgtga

SEQ ID NO: 57916 - DNA, 38 bp, Artificial Sequence
  Synthetic oligonucleotide
tgataccgcatcacccttgacacagttctatcatgtga

SEQ ID NO: 57917 - DNA, 38 bp, Artificial Sequence
  Synthetic oligonucleotide
tgccacttagctatcttctaacccagactttgcattga

SEQ ID NO: 57918 - DNA, 37 bp, Artificial Sequence
  Synthetic oligonucleotide
gacctagctacccgacccccgtcagaagccatcttga

SEQ ID NO: 57919 - DNA, 38 bp, Artificial Sequence
  Synthetic oligonucleotide
gacccgccacaattattatgctctccttcgagggttga

SEQ ID NO: 57920 - DNA, 36 bp, Artificial Sequence
  Synthetic oligonucleotide
tggtaccatccttgttttcgccactgttaaccgata

SEQ ID NO: 57921 - DNA, 36 bp, Artificial Sequence
  Synthetic oligonucleotide
gccggtcctccacctagtacacgcccagctacacta

SEQ ID NO: 57922 - DNA, 36 bp, Artificial Sequence
  Synthetic oligonucleotide
gatgcctggtcgtttaacgctttgttccggttacta

SEQ ID NO: 57923 - DNA, 34 bp, Artificial Sequence
  Synthetic oligonucleotide
gttcccccgcattaaactgcctcataagccggta

SEQ ID NO: 57924 - DNA, 35 bp, Artificial Sequence
  Synthetic oligonucleotide
tgtcccgaccgccctccttaacgatgttagtctta

SEQ ID NO: 57925 - DNA, 35 bp, Artificial Sequence
  Synthetic oligonucleotide
gcgctgtagcgggtctatttgtctgtctctcacac

SEQ ID NO: 57926 - DNA, 35 bp, Artificial Sequence
  Synthetic oligonucleotide
tcttagtcatctccgacacaacacacgttcctgac

SEQ ID NO: 57927 - DNA, 35 bp, Artificial Sequence
  Synthetic oligonucleotide
gtgagcgccatttgcccccctgaaccgtgtactac

SEQ ID NO: 57928 - DNA, 35 bp, Artificial Sequence
  Synthetic oligonucleotide
gagcctctcactaggcctcaccgacatgaccgccc

SEQ ID NO: 57929 - DNA, 35 bp, Artificial Sequence
  Synthetic oligonucleotide
atcattgcacacccctgtgacgaatagtctccgcc

SEQ ID NO: 57930 - DNA, 35 bp, Artificial Sequence
  Synthetic oligonucleotide
tgtacacaccacctaaagtcacctggccatcatgc

SEQ ID NO: 57931 - DNA, 35 bp, Artificial Sequence
  Synthetic oligonucleotide
aacccccgtagccctccgatcggtcttttcgctgc

SEQ ID NO: 57932 - DNA, 35 bp, Artificial Sequence
  Synthetic oligonucleotide
gttagcgcacgagcactcattttgtcatcctcatc

SEQ ID NO: 57933 - DNA, 35 bp, Artificial Sequence
  Synthetic oligonucleotide
acattcagctgcatgtactcctatcgccgtacctc

SEQ ID NO: 57934 - DNA, 35 bp, Artificial Sequence
  Synthetic oligonucleotide
gaacaacgtggacgctgggctcggtctttcttctc

SEQ ID NO: 57935 - DNA, 35 bp, Artificial Sequence
  Synthetic oligonucleotide
ttgctgtgcacgctggcgctaaaatacctgctttc

SEQ ID NO: 57936 - DNA, 35 bp, Artificial Sequence
  Synthetic oligonucleotide
gtataagcagatggtggtggagggttagtggtcag

SEQ ID NO: 57937 - DNA, 35 bp, Artificial Sequence
  Synthetic oligonucleotide
gaccaccggttaccctgtacactgtcccaccatcg

SEQ ID NO: 57938 - DNA, 35 bp, Artificial Sequence
  Synthetic oligonucleotide
tctacccgtccggccagtattagtttccgtggtgg

SEQ ID NO: 57939 - DNA, 35 bp, Artificial Sequence
  Synthetic oligonucleotide
acactccggcaccggtgttataactctccctactg

SEQ ID NO: 57940 - DNA, 35 bp, Artificial Sequence
  Synthetic oligonucleotide
tcccttcccaagatgaggattacccacccttactg

SEQ ID NO: 57941 - DNA, 35 bp, Artificial Sequence
  Synthetic oligonucleotide
atggactgtgccaccctacacgacggtcttatctg

SEQ ID NO: 57942 - DNA, 35 bp, Artificial Sequence
  Synthetic oligonucleotide
accgatccgggtggaagtagatgggcgggtaagtg

SEQ ID NO: 57943 - DNA, 35 bp, Artificial Sequence
  Synthetic oligonucleotide
gtgatgtgaaggtggaaaagcacaagtgaggcaat

SEQ ID NO: 57944 - DNA, 35 bp, Artificial Sequence
  Synthetic oligonucleotide
atgctgccatgtaggcaccgtaccctcctgcgaat

SEQ ID NO: 57945 - DNA, 35 bp, Artificial Sequence
  Synthetic oligonucleotide
atccccggccaatgtgcacccgctatccaccccat

SEQ ID NO: 57946 - DNA, 35 bp, Artificial Sequence
  Synthetic oligonucleotide
gaaagccgtgctttcacctctttagacccgcttat

SEQ ID NO: 57947 - DNA, 34 bp, Artificial Sequence
  Synthetic oligonucleotide
gcccaccctaatcttcaaccgtgctacttgccct

SEQ ID NO: 57948 - DNA, 35 bp, Artificial Sequence
  Synthetic oligonucleotide
tgtccaccctacggcaaccagcgaattccgttcct

SEQ ID NO: 57949 - DNA, 35 bp, Artificial Sequence
  Synthetic oligonucleotide
attgcagtcaccctagacccaacgcctcttttgct

SEQ ID NO: 57950 - DNA, 35 bp, Artificial Sequence
  Synthetic oligonucleotide
tgtcccctggtcgagcggttttcgattctctgtct

SEQ ID NO: 57951 - DNA, 35 bp, Artificial Sequence
  Synthetic oligonucleotide
ttgccataattgccccaagtcaccgtccgttccgt

SEQ ID NO: 57952 - DNA, 35 bp, Artificial Sequence
  Synthetic oligonucleotide
tgagacaccacccattcgttctctctgtacactgt

SEQ ID NO: 57953 - DNA, 35 bp, Artificial Sequence
  Synthetic oligonucleotide
tagctcgaagtaggcgacggaagggggggtgctgt

SEQ ID NO: 57954 - DNA, 35 bp, Artificial Sequence
  Synthetic oligonucleotide
gacatgcgtccccgcgagcgtacccgttattcatt

SEQ ID NO: 57955 - DNA, 35 bp, Artificial Sequence
  Synthetic oligonucleotide
ttccctcgccccggttttcgcaatcatcaggtttt

SEQ ID NO: 57956 - DNA, 36 bp, Artificial Sequence
  Synthetic oligonucleotide
acgacgagggttaaaaaggggcgataaaggaaacaa

SEQ ID NO: 57957 - DNA, 36 bp, Artificial Sequence
  Synthetic oligonucleotide
gattcaccgctacctctaggagccagccccgacgaa

SEQ ID NO: 57958 - DNA, 36 bp, Artificial Sequence
  Synthetic oligonucleotide
tttgatgaagggcgggaaggagcagttgcgagggaa

SEQ ID NO: 57959 - DNA, 35 bp, Artificial Sequence
  Synthetic oligonucleotide
gagggggggtggaggacttgtaagtgatatatgaa

SEQ ID NO: 57960 - DNA, 35 bp, Artificial Sequence
  Synthetic oligonucleotide
gtactgcaagctttatctgccgtttttcctctgaa

SEQ ID NO: 57961 - DNA, 36 bp, Artificial Sequence
  Synthetic oligonucleotide
aacaggtgtactgcctcctgctttgagccctgtgaa

SEQ ID NO: 57962 - DNA, 36 bp, Artificial Sequence
  Synthetic oligonucleotide
acgacgtgtaagtacaccttcacctccctaacgtaa

SEQ ID NO: 57963 - DNA, 36 bp, Artificial Sequence
  Synthetic oligonucleotide
gtggaactgcccctggatcggccccgctatccaaca

SEQ ID NO: 57964 - DNA, 36 bp, Artificial Sequence
  Synthetic oligonucleotide
gatacaagctggtcacatcgcctgcaaaaccacaca

SEQ ID NO: 57965 - DNA, 36 bp, Artificial Sequence
  Synthetic oligonucleotide
tttggcctcctcgacccctgtagtagtcaccacgca

SEQ ID NO: 57966 - DNA, 36 bp, Artificial Sequence
  Synthetic oligonucleotide
atgtctgcatcccggccgttttatgctccttttgca

SEQ ID NO: 57967 - DNA, 37 bp, Artificial Sequence
  Synthetic oligonucleotide
tcccaacgagcaggccggacctacaaatactgcgaga

SEQ ID NO: 57968 - DNA, 37 bp, Artificial Sequence
  Synthetic oligonucleotide
cttcaccgctcagtctttagcattctgaaccaggaga

SEQ ID NO: 57969 - DNA, 36 bp, Artificial Sequence
  Synthetic oligonucleotide
gagctgaggtaaggggagtggaatttataacggaga

SEQ ID NO: 57970 - DNA, 37 bp, Artificial Sequence
  Synthetic oligonucleotide
agtggcaagggaggaggggcggctatacgcgcggaga

SEQ ID NO: 57971 - DNA, 37 bp, Artificial Sequence
  Synthetic oligonucleotide
gatgcgaggcattggcgcttattctcctttttcacga

SEQ ID NO: 57972 - DNA, 37 bp, Artificial Sequence
  Synthetic oligonucleotide
gcattcagtcacactatcccctcacgttcgttgccga

SEQ ID NO: 57973 - DNA, 36 bp, Artificial Sequence
  Synthetic oligonucleotide
accaccacccgtgacacaaccctgacggatttccga

SEQ ID NO: 57974 - DNA, 37 bp, Artificial Sequence
  Synthetic oligonucleotide
tacacaccgctttttgacgccacgatcgttggatcga

SEQ ID NO: 57975 - DNA, 37 bp, Artificial Sequence
  Synthetic oligonucleotide
tacctgggccctcaccaactagtgcatgtttcctcga

SEQ ID NO: 57976 - DNA, 37 bp, Artificial Sequence
  Synthetic oligonucleotide
gtgcgtgcacaccccctgttgtgactaatcatctcga

SEQ ID NO: 57977 - DNA, 37 bp, Artificial Sequence
  Synthetic oligonucleotide
ggttgggaccggagtggttgcagggggaggtcgagga

SEQ ID NO: 57978 - DNA, 36 bp, Artificial Sequence
  Synthetic oligonucleotide
aaggggggtggagtagggtgggtcgaatacaccgga

SEQ ID NO: 57979 - DNA, 37 bp, Artificial Sequence
  Synthetic oligonucleotide
gccggggtagaggtaggcacgttgagagcgtaaggga

SEQ ID NO: 57980 - DNA, 37 bp, Artificial Sequence
  Synthetic oligonucleotide
gaactgctccaggaatttaggcatagtgggggaggga

SEQ ID NO: 57981 - DNA, 36 bp, Artificial Sequence
  Synthetic oligonucleotide
tccgacctccattgctagacacgccccctgtgtgga

SEQ ID NO: 57982 - DNA, 38 bp, Artificial Sequence
  Synthetic oligonucleotide
tagtacgccccgagtgggatggagcgtttgtggaatga

SEQ ID NO: 57983 - DNA, 38 bp, Artificial Sequence
  Synthetic oligonucleotide
agctggagggggagaaaaatagaccaggcgtaaactga

SEQ ID NO: 57984 - DNA, 37 bp, Artificial Sequence
  Synthetic oligonucleotide
gattcgcctcgcgtgggaaacttgaacgcctcactga

SEQ ID NO: 57985 - DNA, 38 bp, Artificial Sequence
  Synthetic oligonucleotide
atgccaccccgtaagcaattcagcggtctttgacctga

SEQ ID NO: 57986 - DNA, 38 bp, Artificial Sequence
  Synthetic oligonucleotide
gcgacgtactaccagttgcgccaaattccttctcctga

SEQ ID NO: 57987 - DNA, 38 bp, Artificial Sequence
  Synthetic oligonucleotide
atctacgcccaacccgtttcgattcgtacttatgctga

SEQ ID NO: 57988 - DNA, 35 bp, Artificial Sequence
  Synthetic oligonucleotide
gcatgatcccattacaccttcttggccactgctga

SEQ ID NO: 57989 - DNA, 38 bp, Artificial Sequence
  Synthetic oligonucleotide
gttaccccgtcccatttaccatgtctgatatcatctga

SEQ ID NO: 57990 - DNA, 38 bp, Artificial Sequence
  Synthetic oligonucleotide
atcataccccagacggtacacattacattgttctctga

SEQ ID NO: 57991 - DNA, 37 bp, Artificial Sequence
  Synthetic oligonucleotide
gaccgtacaagcgtcccgcgtggcctgctttttctga

SEQ ID NO: 57992 - DNA, 38 bp, Artificial Sequence
  Synthetic oligonucleotide
gtgcaaaagtggaagacggggatggagtttaactgtga

SEQ ID NO: 57993 - DNA, 37 bp, Artificial Sequence
  Synthetic oligonucleotide
accctatccgacattcccgttcatgaacctgctgtga

SEQ ID NO: 57994 - DNA, 38 bp, Artificial Sequence
  Synthetic oligonucleotide
acgaccagaccggccctctatgtgcgccatccttgtga

SEQ ID NO: 57995 - DNA, 37 bp, Artificial Sequence
  Synthetic oligonucleotide
tcacacgggtggaaggagagtggacagaagaagttga

SEQ ID NO: 57996 - DNA, 36 bp, Artificial Sequence
  Synthetic oligonucleotide
ttcatccctgggcctactcctagtcggtctctttga

SEQ ID NO: 57997 - DNA, 37 bp, Artificial Sequence
  Synthetic oligonucleotide
gcgcagtcacaacatcgttggttccatcctcttttga

SEQ ID NO: 57998 - DNA, 36 bp, Artificial Sequence
  Synthetic oligonucleotide
tgtaaaaccgcagacatcgaaattgttgccccgata

SEQ ID NO: 57999 - DNA, 35 bp, Artificial Sequence
  Synthetic oligonucleotide
atcgccgctcgaaagccccaccatcgaacacacta

SEQ ID NO: 58000 - DNA, 35 bp, Artificial Sequence
  Synthetic oligonucleotide
acccaaacaaccatgttgatctatattgacgccta

SEQ ID NO: 58001 - DNA, 36 bp, Artificial Sequence
  Synthetic oligonucleotide
tgagagctgtcagtttccccgaggctccaccttcta

SEQ ID NO: 58002 - DNA, 35 bp, Artificial Sequence
  Synthetic oligonucleotide
gcatccaaccgcacatattattcactttgcccgta

SEQ ID NO: 58003 - DNA, 36 bp, Artificial Sequence
  Synthetic oligonucleotide
aacatcaaaacaaagggcggggggaatatgcagtta

SEQ ID NO: 58004 - DNA, 35 bp, Artificial Sequence
  Synthetic oligonucleotide
atcgcgccaagcttgtgcccctcgcgccccattta

SEQ ID NO: 58005 - DNA, 35 bp, Artificial Sequence
  Synthetic oligonucleotide
acgcactgtccttcaacaaatttggggtctgcaac

SEQ ID NO: 58006 - DNA, 35 bp, Artificial Sequence
  Synthetic oligonucleotide
gtccctcttcactgctactactgggtagcaataac

SEQ ID NO: 58007 - DNA, 35 bp, Artificial Sequence
  Synthetic oligonucleotide
agtggggtgcccactgacgctatcctcaagtacac

SEQ ID NO: 58008 - DNA, 35 bp, Artificial Sequence
  Synthetic oligonucleotide
tgactctgtaacggcattccaggtcagccacccac

SEQ ID NO: 58009 - DNA, 35 bp, Artificial Sequence
  Synthetic oligonucleotide
gttcgcgcgtttgtcctcgctgcctcctacccgac

SEQ ID NO: 58010 - DNA, 35 bp, Artificial Sequence
  Synthetic oligonucleotide
acctctccgaaccaggtgagtttgtcactttaacc

SEQ ID NO: 58011 - DNA, 35 bp, Artificial Sequence
  Synthetic oligonucleotide
gcagatacggtccccactgtcgccggctctacgcc

SEQ ID NO: 58012 - DNA, 35 bp, Artificial Sequence
  Synthetic oligonucleotide
acccctgccccctgatcagcacctcttcactgtcc

SEQ ID NO: 58013 - DNA, 35 bp, Artificial Sequence
  Synthetic oligonucleotide
tcttgaccacacgagcaatttgagctgacgcgagc

SEQ ID NO: 58014 - DNA, 35 bp, Artificial Sequence
  Synthetic oligonucleotide
tgggacccctgcatcgtatcccgcacccaccatgc

SEQ ID NO: 58015 - DNA, 35 bp, Artificial Sequence
  Synthetic oligonucleotide
gacaccgagggggggaaacggtaagaacagtctgc

SEQ ID NO: 58016 - DNA, 35 bp, Artificial Sequence
  Synthetic oligonucleotide
acacccgcaggcccatcaatctagagtcctccttc

SEQ ID NO: 58017 - DNA, 35 bp, Artificial Sequence
  Synthetic oligonucleotide
gcgctatgaggtcagtttcgcctaccacccccaag

SEQ ID NO: 58018 - DNA, 35 bp, Artificial Sequence
  Synthetic oligonucleotide
tgaaaatggcggaggttatggttgggcaggaccag

SEQ ID NO: 58019 - DNA, 35 bp, Artificial Sequence
  Synthetic oligonucleotide
gataacaatgaggcgggagggcttgggctcttcag

SEQ ID NO: 58020 - DNA, 35 bp, Artificial Sequence
  Synthetic oligonucleotide
gtgagggtgtagggaaattgactatggtagaggcg

SEQ ID NO: 58021 - DNA, 35 bp, Artificial Sequence
  Synthetic oligonucleotide
gccaggacggaacgggtggtctgagtatggaatgg

SEQ ID NO: 58022 - DNA, 35 bp, Artificial Sequence
  Synthetic oligonucleotide
gactatcccggtcaatccgcctgagcatccactgg

SEQ ID NO: 58023 - DNA, 35 bp, Artificial Sequence
  Synthetic oligonucleotide
gaacacgaatcgatgggtttggtccactctttctg

SEQ ID NO: 58024 - DNA, 35 bp, Artificial Sequence
  Synthetic oligonucleotide
attttgcacctccgcttatcatcacgcattttcat

SEQ ID NO: 58025 - DNA, 35 bp, Artificial Sequence
  Synthetic oligonucleotide
gaacacagtggggtcaaggatagggagtagcggat

SEQ ID NO: 58026 - DNA, 35 bp, Artificial Sequence
  Synthetic oligonucleotide
aactgaaacactccaacctcatgctgaacgggcct

SEQ ID NO: 58027 - DNA, 35 bp, Artificial Sequence
  Synthetic oligonucleotide
aaatcgcccctatacctcaggatcgctcccacgct

SEQ ID NO: 58028 - DNA, 35 bp, Artificial Sequence
  Synthetic oligonucleotide
atcaccaaccggccaggctctgcgtctcccgctct

SEQ ID NO: 58029 - DNA, 35 bp, Artificial Sequence
  Synthetic oligonucleotide
gccatcccacacgcctattctgttagctgttctct

SEQ ID NO: 58030 - DNA, 35 bp, Artificial Sequence
  Synthetic oligonucleotide
gtcgaactggcgccgagtgccaccactgccacggt

SEQ ID NO: 58031 - DNA, 35 bp, Artificial Sequence
  Synthetic oligonucleotide
aacaggtcgggcccgattatcgccttgactgcatt

SEQ ID NO: 58032 - DNA, 35 bp, Artificial Sequence
  Synthetic oligonucleotide
atgcacattaactgccgtgggtctggcgccttatt

SEQ ID NO: 58033 - DNA, 35 bp, Artificial Sequence
  Synthetic oligonucleotide
tatttgacgtagtgcgtctcgaccctccgattctt

SEQ ID NO: 58034 - DNA, 36 bp, Artificial Sequence
  Synthetic oligonucleotide
ggatcaactggaccgaatcaacatagcctgagccaa

SEQ ID NO: 58035 - DNA, 36 bp, Artificial Sequence
  Synthetic oligonucleotide
gaaatgataagcagggagggaagggcacggtttgaa

SEQ ID NO: 58036 - DNA, 35 bp, Artificial Sequence
  Synthetic oligonucleotide
gtcagagctggcctcttgttaccgaaccgttcaca

SEQ ID NO: 58037 - DNA, 36 bp, Artificial Sequence
  Synthetic oligonucleotide
gacgcttccgagcactcgtcctcactcctcattaca

SEQ ID NO: 58038 - DNA, 35 bp, Artificial Sequence
  Synthetic oligonucleotide
tgcactgtgttacgttttcacccaggctgccccca

SEQ ID NO: 58039 - DNA, 35 bp, Artificial Sequence
  Synthetic oligonucleotide
gttgccagagctgcacaacggaacacatatcccca

SEQ ID NO: 58040 - DNA, 36 bp, Artificial Sequence
  Synthetic oligonucleotide
gccacacccctcaaagctcacgtccgcatctcccca

SEQ ID NO: 58041 - DNA, 36 bp, Artificial Sequence
  Synthetic oligonucleotide
accaccactcgtacacaaacagggctgcattcgcca

SEQ ID NO: 58042 - DNA, 36 bp, Artificial Sequence
  Synthetic oligonucleotide
gtggtcgcccagactttattacgctccctacggcca

SEQ ID NO: 58043 - DNA, 36 bp, Artificial Sequence
  Synthetic oligonucleotide
gtggtggggcgcatatctgttccccgactccatcca

SEQ ID NO: 58044 - DNA, 36 bp, Artificial Sequence
  Synthetic oligonucleotide
ggtcaatcaacatccgggcctcgccgaacgcctgca

SEQ ID NO: 58045 - DNA, 36 bp, Artificial Sequence
  Synthetic oligonucleotide
ttcgctcccacacgtgtttttgtaggtcttcgtgca

SEQ ID NO: 58046 - DNA, 36 bp, Artificial Sequence
  Synthetic oligonucleotide
gatacgtcaagggccatcctgcctattctctttgca

SEQ ID NO: 58047 - DNA, 37 bp, Artificial Sequence
  Synthetic oligonucleotide
gtggtacaggtagggtgcgggtgtaggcaggtcgaga

SEQ ID NO: 58048 - DNA, 37 bp, Artificial Sequence
  Synthetic oligonucleotide
atcgcgacctggtcgccgttcctcgcattccactaga

SEQ ID NO: 58049 - DNA, 36 bp, Artificial Sequence
  Synthetic oligonucleotide
actgcacggctactttcgtttgttcgttcctctaga

SEQ ID NO: 58050 - DNA, 37 bp, Artificial Sequence
  Synthetic oligonucleotide
ttcgagcctcagggtcgcctcctcgtctttcttacga

SEQ ID NO: 58051 - DNA, 37 bp, Artificial Sequence
  Synthetic oligonucleotide
ttactaccatccataaggacaggtcgcacagtaccga

SEQ ID NO: 58052 - DNA, 37 bp, Artificial Sequence
  Synthetic oligonucleotide
accgtaggccccagacaccttaagcatctctcgccga

SEQ ID NO: 58053 - DNA, 37 bp, Artificial Sequence
  Synthetic oligonucleotide
tacacgtcccctcgctcttgcttcccgctcctgccga

SEQ ID NO: 58054 - DNA, 37 bp, Artificial Sequence
  Synthetic oligonucleotide
taagagtgcggtaagtggaggagagggacgggttcga

SEQ ID NO: 58055 - DNA, 37 bp, Artificial Sequence
  Synthetic oligonucleotide
ttctgtagccgctattcgcatctgactgccctttcga

SEQ ID NO: 58056 - DNA, 37 bp, Artificial Sequence
  Synthetic oligonucleotide
tccgaacggctctccatctatcagatccatcctagga

SEQ ID NO: 58057 - DNA, 37 bp, Artificial Sequence
  Synthetic oligonucleotide
agttacgggggatcggataggggaagtcaaggacgga

SEQ ID NO: 58058 - DNA, 37 bp, Artificial Sequence
  Synthetic oligonucleotide
gacacaacctgccaacattcaggaacaggactccgga

SEQ ID NO: 58059 - DNA, 37 bp, Artificial Sequence
  Synthetic oligonucleotide
gaaggtcgtgagtccggtgagttgagggggggaggga

SEQ ID NO: 58060 - DNA, 37 bp, Artificial Sequence
  Synthetic oligonucleotide
tgcgagccgacactttgcctcactacctttgaaatga

SEQ ID NO: 58061 - DNA, 38 bp, Artificial Sequence
  Synthetic oligonucleotide
tcctaggcctcagctgcttttgttgtctcccagtctga

SEQ ID NO: 58062 - DNA, 37 bp, Artificial Sequence
  Synthetic oligonucleotide
gtctaactggcaatggaaggggggctaggaggcgtga

SEQ ID NO: 58063 - DNA, 38 bp, Artificial Sequence
  Synthetic oligonucleotide
tatgtgtgccgttatgagggacgaactgggtggggtga

SEQ ID NO: 58064 - DNA, 38 bp, Artificial Sequence
  Synthetic oligonucleotide
gatgaccagggggggttaatttgggaccgttggggtga

SEQ ID NO: 58065 - DNA, 37 bp, Artificial Sequence
  Synthetic oligonucleotide
ggtaaccaagggaggtagtgggaaacacaatatgtga

SEQ ID NO: 58066 - DNA, 38 bp, Artificial Sequence
  Synthetic oligonucleotide
tctagcccacaactgtctccggaagtcacatattgtga

SEQ ID NO: 58067 - DNA, 37 bp, Artificial Sequence
  Synthetic oligonucleotide
gacatgcgtgaaactgctatgacccgccccttattga

SEQ ID NO: 58068 - DNA, 38 bp, Artificial Sequence
  Synthetic oligonucleotide
agcgacatgtcgggttgtcctctccactatctccttga

SEQ ID NO: 58069 - DNA, 38 bp, Artificial Sequence
  Synthetic oligonucleotide
acgtcgtgtccgaccaagtaacacccacacgactttga

SEQ ID NO: 58070 - DNA, 35 bp, Artificial Sequence
  Synthetic oligonucleotide
ttgcgagtgacagcacgcctctacatttctccata

SEQ ID NO: 58071 - DNA, 35 bp, Artificial Sequence
  Synthetic oligonucleotide
gaatcggtgcaatccgtctatcaccgcgctttata

SEQ ID NO: 58072 - DNA, 36 bp, Artificial Sequence
  Synthetic oligonucleotide
gcaggcctcatcctcagtttcatcccagtctgggta

SEQ ID NO: 58073 - DNA, 36 bp, Artificial Sequence
  Synthetic oligonucleotide
gtcatagcctagataaagctcacctgctatgttgta

SEQ ID NO: 58074 - DNA, 36 bp, Artificial Sequence
  Synthetic oligonucleotide
ctttccggtcggtgttttctgctatcgacctcttta

SEQ ID NO: 58075 - DNA, 35 bp, Artificial Sequence
  Synthetic oligonucleotide
gtgtggggtgctgggggaagggtagttagaaggac

SEQ ID NO: 58076 - DNA, 35 bp, Artificial Sequence
  Synthetic oligonucleotide
atgagccccatgtccacctcctcaactagggtacc

SEQ ID NO: 58077 - DNA, 35 bp, Artificial Sequence
  Synthetic oligonucleotide
aaaccaatgcctcggggacgcaccattgcccgccc

SEQ ID NO: 58078 - DNA, 35 bp, Artificial Sequence
  Synthetic oligonucleotide
actcgagacgtatgctagccggctcccacgctccc

SEQ ID NO: 58079 - DNA, 35 bp, Artificial Sequence
  Synthetic oligonucleotide
ggtctaccgccgacccatgactatgcaattcgatc

SEQ ID NO: 58080 - DNA, 35 bp, Artificial Sequence
  Synthetic oligonucleotide
tgcaattccagcaaccccgctcgagcgctgctatc

SEQ ID NO: 58081 - DNA, 35 bp, Artificial Sequence
  Synthetic oligonucleotide
tacatcgatagatgccctcgttcgatcgttctatc

SEQ ID NO: 58082 - DNA, 35 bp, Artificial Sequence
  Synthetic oligonucleotide
atactccacatcggcttaacacacggccccaggag

SEQ ID NO: 58083 - DNA, 35 bp, Artificial Sequence
  Synthetic oligonucleotide
gccgaccatgattttctcgtttccctgtcttgtag

SEQ ID NO: 58084 - DNA, 35 bp, Artificial Sequence
  Synthetic oligonucleotide
gttgggaacgggttagaactagggagtctgtgcgg

SEQ ID NO: 58085 - DNA, 35 bp, Artificial Sequence
  Synthetic oligonucleotide
gccaactcgaacactgccctctatgtgcgcacggg

SEQ ID NO: 58086 - DNA, 35 bp, Artificial Sequence
  Synthetic oligonucleotide
tacgggaggtctagtgttgcggaggggggttatgg

SEQ ID NO: 58087 - DNA, 35 bp, Artificial Sequence
  Synthetic oligonucleotide
actatcagtccgtaccgctaaatcgccgctctctg

SEQ ID NO: 58088 - DNA, 35 bp, Artificial Sequence
  Synthetic oligonucleotide
gacacaccttagatatcgagcccccctccagcgtg

SEQ ID NO: 58089 - DNA, 35 bp, Artificial Sequence
  Synthetic oligonucleotide
tgcgaagcgagggaggggtttcgaatttgggggtg

SEQ ID NO: 58090 - DNA, 35 bp, Artificial Sequence
  Synthetic oligonucleotide
gcttgccaaacgagttctgcgcgcatccacccaat

SEQ ID NO: 58091 - DNA, 35 bp, Artificial Sequence
  Synthetic oligonucleotide
agatcgcccacagacgtaaatctgcgttcgcccat

SEQ ID NO: 58092 - DNA, 35 bp, Artificial Sequence
  Synthetic oligonucleotide
gtggaggtacggtggaatctaatcaaagtaagcat

SEQ ID NO: 58093 - DNA, 35 bp, Artificial Sequence
  Synthetic oligonucleotide
tcatcgtgccctgacccgtccgctttaggtaatat

SEQ ID NO: 58094 - DNA, 35 bp, Artificial Sequence
  Synthetic oligonucleotide
gtgactccagctcgtgtttaccccgctgttcaact

SEQ ID NO: 58095 - DNA, 35 bp, Artificial Sequence
  Synthetic oligonucleotide
atcgacccgatcctggatgactccttccgtgtcct

SEQ ID NO: 58096 - DNA, 36 bp, Artificial Sequence
  Synthetic oligonucleotide
tgtgaaacggtcaactgggggatggagacaaggggt

SEQ ID NO: 58097 - DNA, 35 bp, Artificial Sequence
  Synthetic oligonucleotide
aatgcccggagcaggggggatacacaagtgcgatt

SEQ ID NO: 58098 - DNA, 35 bp, Artificial Sequence
  Synthetic oligonucleotide
gcgaactacttagcaacgtggccctatcctccctt

SEQ ID NO: 58099 - DNA, 35 bp, Artificial Sequence
  Synthetic oligonucleotide
tcacaaacacaaatggtctggttgcctaactgctt

SEQ ID NO: 58100 - DNA, 36 bp, Artificial Sequence
  Synthetic oligonucleotide
tcgcaacagctcagctagcgcctccttcttacaaaa

SEQ ID NO: 58101 - DNA, 36 bp, Artificial Sequence
  Synthetic oligonucleotide
tgataccgtcacgtgatctcctcgggccatcaacaa

SEQ ID NO: 58102 - DNA, 36 bp, Artificial Sequence
  Synthetic oligonucleotide
ataaaccagcacacacctgcataggacaacccacaa

SEQ ID NO: 58103 - DNA, 36 bp, Artificial Sequence
  Synthetic oligonucleotide
accagccctccggtcaccatcgaggttctgctacaa

SEQ ID NO: 58104 - DNA, 36 bp, Artificial Sequence
  Synthetic oligonucleotide
tgtgagagagggatccggtgatggagtgttggcgaa

SEQ ID NO: 58105 - DNA, 36 bp, Artificial Sequence
  Synthetic oligonucleotide
tctagcggcacgacttgcctttctgctctgcactaa

SEQ ID NO: 58106 - DNA, 36 bp, Artificial Sequence
  Synthetic oligonucleotide
tccgagagcggctatattcctttactatcctgcaca

SEQ ID NO: 58107 - DNA, 36 bp, Artificial Sequence
  Synthetic oligonucleotide
gatggcccaccgcggttctcctcgctctactagaca

SEQ ID NO: 58108 - DNA, 36 bp, Artificial Sequence
  Synthetic oligonucleotide
ttagttgaccgtccgctgttgcaactgcccttacca

SEQ ID NO: 58109 - DNA, 36 bp, Artificial Sequence
  Synthetic oligonucleotide
gccccgaccattttatgtttttgaccaatctcggca

SEQ ID NO: 58110 - DNA, 35 bp, Artificial Sequence
  Synthetic oligonucleotide
tgcaaacccaaccactcgccgatcctagccgctca

SEQ ID NO: 58111 - DNA, 36 bp, Artificial Sequence
  Synthetic oligonucleotide
agaccacggtcccagctcttatccagcattcaaaga

SEQ ID NO: 58112 - DNA, 37 bp, Artificial Sequence
  Synthetic oligonucleotide
accccgtccggacccacccgtcttctcctcccacaga

SEQ ID NO: 58113 - DNA, 37 bp, Artificial Sequence
  Synthetic oligonucleotide
atttgcgcccaatctttgcacactcctgaataccaga

SEQ ID NO: 58114 - DNA, 37 bp, Artificial Sequence
  Synthetic oligonucleotide
gaaggtggagctggaaacaagtcggccgttgaagaga

SEQ ID NO: 58115 - DNA, 36 bp, Artificial Sequence
  Synthetic oligonucleotide
ggactggtccacattctctcatttgtctgccttaga

SEQ ID NO: 58116 - DNA, 37 bp, Artificial Sequence
  Synthetic oligonucleotide
accgctcactggctcactggatctacgcacccgacga

SEQ ID NO: 58117 - DNA, 37 bp, Artificial Sequence
  Synthetic oligonucleotide
tctgcattccatggtccacacaatcctacgcttacga

SEQ ID NO: 58118 - DNA, 37 bp, Artificial Sequence
  Synthetic oligonucleotide
tgtactcgctcgcctgtagcctactgaattccaccga

SEQ ID NO: 58119 - DNA, 36 bp, Artificial Sequence
  Synthetic oligonucleotide
gcggacacgcccatgcccccaacctctgctcaagga

SEQ ID NO: 58120 - DNA, 37 bp, Artificial Sequence
  Synthetic oligonucleotide
tgttcgacccccgccctgtcttcatctgccttacgga

SEQ ID NO: 58121 - DNA, 37 bp, Artificial Sequence
  Synthetic oligonucleotide
ttcctgacaccccaggcccagtccctctacactcgga

SEQ ID NO: 58122 - DNA, 37 bp, Artificial Sequence
  Synthetic oligonucleotide
aagactaggacatgggctgttgaaaggcgggatggga

SEQ ID NO: 58123 - DNA, 37 bp, Artificial Sequence
  Synthetic oligonucleotide
gtcaccgcactaattgctcaccaacgagacttctgga

SEQ ID NO: 58124 - DNA, 37 bp, Artificial Sequence
  Synthetic oligonucleotide
gctcactcccctggggttcaaacaccgctcttaatga

SEQ ID NO: 58125 - DNA, 37 bp, Artificial Sequence
  Synthetic oligonucleotide
agccgcaatgtgctctgctcacaccaccctgacatga

SEQ ID NO: 58126 - DNA, 38 bp, Artificial Sequence
  Synthetic oligonucleotide
gcgcacccctgtttcctgcccgcttaccaatcggatga

SEQ ID NO: 58127 - DNA, 38 bp, Artificial Sequence
  Synthetic oligonucleotide
gtccgccgggggtaaagggggaaatgaggcaaatatga

SEQ ID NO: 58128 - DNA, 37 bp, Artificial Sequence
  Synthetic oligonucleotide
aacaagagacgggatagggatgacgagtgggaactga

SEQ ID NO: 58129 - DNA, 38 bp, Artificial Sequence
  Synthetic oligonucleotide
taccctccctccagattctgtggggccttgatcactga

SEQ ID NO: 58130 - DNA, 37 bp, Artificial Sequence
  Synthetic oligonucleotide
tccgttgcccggggctttatttcacctgcttgcctga

SEQ ID NO: 58131 - DNA, 36 bp, Artificial Sequence
  Synthetic oligonucleotide
aaccgcaaagcgcaatcgtccttctcggccagctga

SEQ ID NO: 58132 - DNA, 38 bp, Artificial Sequence
  Synthetic oligonucleotide
gtcacctgatcgccgcatgcccccatacatagtgctga

SEQ ID NO: 58133 - DNA, 38 bp, Artificial Sequence
  Synthetic oligonucleotide
gaacaaaaacggggtggatggggaaagcgtatgtctga

SEQ ID NO: 58134 - DNA, 37 bp, Artificial Sequence
  Synthetic oligonucleotide
gagggagaagtgtgggttggggtcatgtgacaggtga

SEQ ID NO: 58135 - DNA, 37 bp, Artificial Sequence
  Synthetic oligonucleotide
acccccctaactgctagcttttccagtgctacggtga

SEQ ID NO: 58136 - DNA, 38 bp, Artificial Sequence
  Synthetic oligonucleotide
tcaccgccgccccctactaccccgcatctcgcgggtga

SEQ ID NO: 58137 - DNA, 37 bp, Artificial Sequence
  Synthetic oligonucleotide
gaaacagaggtgaacagtatcaggacggagggggtga

SEQ ID NO: 58138 - DNA, 38 bp, Artificial Sequence
  Synthetic oligonucleotide
gttgggggcagggagaacggacctaggggttggggtga

SEQ ID NO: 58139 - DNA, 38 bp, Artificial Sequence
  Synthetic oligonucleotide
gtactgcctagttcacctcacgcaccattatgctgtga

SEQ ID NO: 58140 - DNA, 38 bp, Artificial Sequence
  Synthetic oligonucleotide
tcaccgcctcaccaagcctctcagttccagcagtgtga

SEQ ID NO: 58141 - DNA, 37 bp, Artificial Sequence
  Synthetic oligonucleotide
gcctaaaccaacggttgtattctgtccctctaattga

SEQ ID NO: 58142 - DNA, 37 bp, Artificial Sequence
  Synthetic oligonucleotide
agaccctccaaagggtgatcaaccccgaactcattga

SEQ ID NO: 58143 - DNA, 38 bp, Artificial Sequence
  Synthetic oligonucleotide
aagacaagtgtgcgtgttcgtaccccctgttaacttga

SEQ ID NO: 58144 - DNA, 38 bp, Artificial Sequence
  Synthetic oligonucleotide
actccatccctatggagttcctagcccaccacccttga

SEQ ID NO: 58145 - DNA, 38 bp, Artificial Sequence
  Synthetic oligonucleotide
gcgagagagtagggtgaatgcggggggttggtagttga

SEQ ID NO: 58146 - DNA, 38 bp, Artificial Sequence
  Synthetic oligonucleotide
atcttccgtggagtgtcagccgcccccttgcccgttga

SEQ ID NO: 58147 - DNA, 38 bp, Artificial Sequence
  Synthetic oligonucleotide
tgtgccactccctgcctctccttggtacctaaggttga

SEQ ID NO: 58148 - DNA, 37 bp, Artificial Sequence
  Synthetic oligonucleotide
ttgcatgactcatggatgttatccctcctcgctttga

SEQ ID NO: 58149 - DNA, 36 bp, Artificial Sequence
  Synthetic oligonucleotide
atgtccgtctttcgtcctgatcttgccacctctcta

SEQ ID NO: 58150 - DNA, 35 bp, Artificial Sequence
  Synthetic oligonucleotide
gactttggccgcccaacccccgtacctccccagta

SEQ ID NO: 58151 - DNA, 36 bp, Artificial Sequence
  Synthetic oligonucleotide
tccgcctggtcgacgttcctacccccgaaatcgtta

SEQ ID NO: 58152 - DNA, 35 bp, Artificial Sequence
  Synthetic oligonucleotide
aagtagctcagtggctcctactcgctcccccttta

SEQ ID NO: 58153 - DNA, 35 bp, Artificial Sequence
  Synthetic oligonucleotide
gaccaccgggaccgatccaaccttggataaccaac

SEQ ID NO: 58154 - DNA, 35 bp, Artificial Sequence
  Synthetic oligonucleotide
acgacccctcacctggtagcaacgccctaaccaac

SEQ ID NO: 58155 - DNA, 35 bp, Artificial Sequence
  Synthetic oligonucleotide
gggagcactcggagcgctacaacaccacccatacc

SEQ ID NO: 58156 - DNA, 35 bp, Artificial Sequence
  Synthetic oligonucleotide
tacgtaatgacctcctgcgtcggcttccatcaccc

SEQ ID NO: 58157 - DNA, 35 bp, Artificial Sequence
  Synthetic oligonucleotide
ttggatgaacggggaacggcaaaggggctagcgcc

SEQ ID NO: 58158 - DNA, 35 bp, Artificial Sequence
  Synthetic oligonucleotide
atctcaacccgactatcactttaggcatcttaggc

SEQ ID NO: 58159 - DNA, 35 bp, Artificial Sequence
  Synthetic oligonucleotide
taacctccgaactaggcccacaatcatgctcatgc

SEQ ID NO: 58160 - DNA, 35 bp, Artificial Sequence
  Synthetic oligonucleotide
gtgcggtcactcgacgattattagccatctactgc

SEQ ID NO: 58161 - DNA, 35 bp, Artificial Sequence
  Synthetic oligonucleotide
acctcgcggatctccgccaacgacctttagcctgc

SEQ ID NO: 58162 - DNA, 35 bp, Artificial Sequence
  Synthetic oligonucleotide
acccactcctagcttctatcgcaatggcatgttgc

SEQ ID NO: 58163 - DNA, 35 bp, Artificial Sequence
  Synthetic oligonucleotide
gacatcctgccacgctgtaataccctatggaggtc

SEQ ID NO: 58164 - DNA, 35 bp, Artificial Sequence
  Synthetic oligonucleotide
gctgcaatggccggggttgagactggtggggtgag

SEQ ID NO: 58165 - DNA, 35 bp, Artificial Sequence
  Synthetic oligonucleotide
agtcacagtccgtaggtaccggcaatacatccacg

SEQ ID NO: 58166 - DNA, 35 bp, Artificial Sequence
  Synthetic oligonucleotide
acaagagccgcttctttaaccgccctactccgccg

SEQ ID NO: 58167 - DNA, 35 bp, Artificial Sequence
  Synthetic oligonucleotide
taactaacgctccttcgcacaactgctgccatccg

SEQ ID NO: 58168 - DNA, 35 bp, Artificial Sequence
  Synthetic oligonucleotide
actggggggatgttaagatgagcggatgggggagg

SEQ ID NO: 58169 - DNA, 36 bp, Artificial Sequence
  Synthetic oligonucleotide
tcctggaaggggggttgcggttacatcacggcgggg

SEQ ID NO: 58170 - DNA, 38 bp, Artificial Sequence
  Synthetic oligonucleotide
tcaccactcctagacgcgtatttcctcaccctcactgg

SEQ ID NO: 58171 - DNA, 38 bp, Artificial Sequence
  Synthetic oligonucleotide
gccgtgagagggaggtgcacgggtcgccggaaaattgg

SEQ ID NO: 58172 - DNA, 35 bp, Artificial Sequence
  Synthetic oligonucleotide
gtgcacagcaatccggcggaagtctcccaccttgg

SEQ ID NO: 58173 - DNA, 35 bp, Artificial Sequence
  Synthetic oligonucleotide
gagcctactccttccccataagcactgtgccttgg

SEQ ID NO: 58174 - DNA, 35 bp, Artificial Sequence
  Synthetic oligonucleotide
tcatagcagtgggggtggggggacactggcgaatg

SEQ ID NO: 58175 - DNA, 35 bp, Artificial Sequence
  Synthetic oligonucleotide
tgtcccctgtttcccgcgcacatcctacggtgatg

SEQ ID NO: 58176 - DNA, 35 bp, Artificial Sequence
  Synthetic oligonucleotide
tcgaaaccataggtccaatagagtgccccccactg

SEQ ID NO: 58177 - DNA, 35 bp, Artificial Sequence
  Synthetic oligonucleotide
aaggggacgagttggtgcaggggccggggtaattg

SEQ ID NO: 58178 - DNA, 35 bp, Artificial Sequence
  Synthetic oligonucleotide
atctcgacagctggttttctttcctaggttgtttg

SEQ ID NO: 58179 - DNA, 36 bp, Artificial Sequence
  Synthetic oligonucleotide
ttctgcccatcggtgaccgcacccacacgactctat

SEQ ID NO: 58180 - DNA, 35 bp, Artificial Sequence
  Synthetic oligonucleotide
tagagcacttgggaacttcggacactctttctact

SEQ ID NO: 58181 - DNA, 35 bp, Artificial Sequence
  Synthetic oligonucleotide
agacgtcacatgctcccatgcgctgaaatccccct

SEQ ID NO: 58182 - DNA, 34 bp, Artificial Sequence
  Synthetic oligonucleotide
ttgcctattcccgttcgtgttccgatcgtttcct

SEQ ID NO: 58183 - DNA, 35 bp, Artificial Sequence
  Synthetic oligonucleotide
gacaccctcgtcgcctgcatccggttaacttctct

SEQ ID NO: 58184 - DNA, 35 bp, Artificial Sequence
  Synthetic oligonucleotide
cccatgaccacatcattcgctccgctccctaatgt

SEQ ID NO: 58185 - DNA, 35 bp, Artificial Sequence
  Synthetic oligonucleotide
tgctacactgggccgcttgtcctcctttcataatt

SEQ ID NO: 58186 - DNA, 35 bp, Artificial Sequence
  Synthetic oligonucleotide
ttctaccgctcctgggaccctctagttgcttgttt

SEQ ID NO: 58187 - DNA, 35 bp, Artificial Sequence
  Synthetic oligonucleotide
tacccctgccctacattgagtcaatacgttatttt

SEQ ID NO: 58188 - DNA, 36 bp, Artificial Sequence
  Synthetic oligonucleotide
gtcgcgcccattatgccttttcgctggctgccaaaa

SEQ ID NO: 58189 - DNA, 35 bp, Artificial Sequence
  Synthetic oligonucleotide
gtccacactccgactcccggttttgccctttaaaa

SEQ ID NO: 58190 - DNA, 36 bp, Artificial Sequence
  Synthetic oligonucleotide
acgacatgtccgccataccaagcacgcaggtagaaa

SEQ ID NO: 58191 - DNA, 36 bp, Artificial Sequence
  Synthetic oligonucleotide
tccacctcagtccccgcttcgcatgaagttcaccaa

SEQ ID NO: 58192 - DNA, 36 bp, Artificial Sequence
  Synthetic oligonucleotide
acttagcgccactgcccacaccttagcgcccatcaa

SEQ ID NO: 58193 - DNA, 36 bp, Artificial Sequence
  Synthetic oligonucleotide
taaccaccccactttgtacaattccgggtccaaaca

SEQ ID NO: 58194 - DNA, 36 bp, Artificial Sequence
  Synthetic oligonucleotide
gcgcccgagcgcatacggggccctctcacaccccca

SEQ ID NO: 58195 - DNA, 35 bp, Artificial Sequence
  Synthetic oligonucleotide
tgctaacaccatcacccccgactcttgtctgccca

SEQ ID NO: 58196 - DNA, 36 bp, Artificial Sequence
  Synthetic oligonucleotide
agggccatcccatcgttccgtgacccgtcttaatca

SEQ ID NO: 58197 - DNA, 35 bp, Artificial Sequence
  Synthetic oligonucleotide
cccataccctcaatgttgccgccgcattcccatca

SEQ ID NO: 58198 - DNA, 35 bp, Artificial Sequence
  Synthetic oligonucleotide
tgaaagacggttcacattcatcgccccgctcatca

SEQ ID NO: 58199 - DNA, 37 bp, Artificial Sequence
  Synthetic oligonucleotide
aatgacggctaggagtggggaatgacgggtggcgaga

SEQ ID NO: 58200 - DNA, 36 bp, Artificial Sequence
  Synthetic oligonucleotide
tcgcccttgtgcctcttaaactgctgactctcacga

SEQ ID NO: 58201 - DNA, 37 bp, Artificial Sequence
  Synthetic oligonucleotide
tcccgacgaacaatgttgaaccctctgttatctacga

SEQ ID NO: 58202 - DNA, 35 bp, Artificial Sequence
  Synthetic oligonucleotide
gcacagaacatcccgtgactcatccgttcttacga

SEQ ID NO: 58203 - DNA, 37 bp, Artificial Sequence
  Synthetic oligonucleotide
gttagggaggggacgaactatgggatgtgggaaccga

SEQ ID NO: 58204 - DNA, 37 bp, Artificial Sequence
  Synthetic oligonucleotide
tgtgccctctccttcaaatatgttctgtacgatccga

SEQ ID NO: 58205 - DNA, 37 bp, Artificial Sequence
  Synthetic oligonucleotide
gccgtactcgccatccactttgcattcgtctatgcga

SEQ ID NO: 58206 - DNA, 37 bp, Artificial Sequence
  Synthetic oligonucleotide
tcagccctgcgtcatacccgccactgcccgcctgcga

SEQ ID NO: 58207 - DNA, 36 bp, Artificial Sequence
  Synthetic oligonucleotide
actgaccgcgcccaacgccatcccacgagatttcga

SEQ ID NO: 58208 - DNA, 37 bp, Artificial Sequence
  Synthetic oligonucleotide
agtggagggccggggcggattactggattttcaagga

SEQ ID NO: 58209 - DNA, 37 bp, Artificial Sequence
  Synthetic oligonucleotide
ttgccctcgacgtcacttaagcctttgcccacgcgga

SEQ ID NO: 58210 - DNA, 37 bp, Artificial Sequence
  Synthetic oligonucleotide
gatcaaggccgggaaggcggataaaggtatgttggga

SEQ ID NO: 58211 - DNA, 36 bp, Artificial Sequence
  Synthetic oligonucleotide
gatggggggaggggatatggtaaaatgcttgatgga

SEQ ID NO: 58212 - DNA, 38 bp, Artificial Sequence
  Synthetic oligonucleotide
acattcacgtcaacatttatttgccttcaccacctgga

SEQ ID NO: 58213 - DNA, 37 bp, Artificial Sequence
  Synthetic oligonucleotide
aagccatccggccaattccctgattctctgctctgga

SEQ ID NO: 58214 - DNA, 37 bp, Artificial Sequence
  Synthetic oligonucleotide
taacctgccccccctcctcatcagccaagtcgcatga

SEQ ID NO: 58215 - DNA, 38 bp, Artificial Sequence
  Synthetic oligonucleotide
tccttgcagctgtgaccgggccctctatcttcgcatga

SEQ ID NO: 58216 - DNA, 38 bp, Artificial Sequence
  Synthetic oligonucleotide
gtgcctcagtcaattgccgatttcctacctgttcatga

SEQ ID NO: 58217 - DNA, 38 bp, Artificial Sequence
  Synthetic oligonucleotide
tccccatccccctgcctgagggcataaggttactatga

SEQ ID NO: 58218 - DNA, 36 bp, Artificial Sequence
  Synthetic oligonucleotide
actgtcccccttccagcgatctaagggcacccctga

SEQ ID NO: 58219 - DNA, 37 bp, Artificial Sequence
  Synthetic oligonucleotide
caccccccttgcctcaacttgtctatcactagcctga

SEQ ID NO: 58220 - DNA, 38 bp, Artificial Sequence
  Synthetic oligonucleotide
acacgtccatagcttcaagatacgttttcctcgcctga

SEQ ID NO: 58221 - DNA, 37 bp, Artificial Sequence
  Synthetic oligonucleotide
atccatccgggagtggggggaagatgcgaatggctga

SEQ ID NO: 58222 - DNA, 38 bp, Artificial Sequence
  Synthetic oligonucleotide
ttgcatagacacacgaccattcgattccagcctgctga

SEQ ID NO: 58223 - DNA, 38 bp, Artificial Sequence
  Synthetic oligonucleotide
ttggcactcactcccgccgcaaagaacgtactccgtga

SEQ ID NO: 58224 - DNA, 35 bp, Artificial Sequence
  Synthetic oligonucleotide
ggaaaggcccgcccacgccgctaaatcccgcttga

SEQ ID NO: 58225 - DNA, 38 bp, Artificial Sequence
  Synthetic oligonucleotide
gccgccaccgtttgcacatcttcgccgctttttgttga

SEQ ID NO: 58226 - DNA, 36 bp, Artificial Sequence
  Synthetic oligonucleotide
acgccggagaggtccgtcgcttctttcacctttcta

SEQ ID NO: 58227 - DNA, 35 bp, Artificial Sequence
  Synthetic oligonucleotide
gacaccccaatccggagtaactaacttaagtatac

SEQ ID NO: 58228 - DNA, 35 bp, Artificial Sequence
  Synthetic oligonucleotide
agaacaccgacaccgtgaggaccgcccgctctacc

SEQ ID NO: 58229 - DNA, 35 bp, Artificial Sequence
  Synthetic oligonucleotide
gcaacgcaaaaaatcgcacgtaccttcgcgttacc

SEQ ID NO: 58230 - DNA, 35 bp, Artificial Sequence
  Synthetic oligonucleotide
cattcacacccccggcgcatgcagtagccaacccc

SEQ ID NO: 58231 - DNA, 35 bp, Artificial Sequence
  Synthetic oligonucleotide
gccaatccatcctagtcggttaacgcttactgccc

SEQ ID NO: 58232 - DNA, 35 bp, Artificial Sequence
  Synthetic oligonucleotide
attcacatgatttttacccgggtccattcgctccc

SEQ ID NO: 58233 - DNA, 35 bp, Artificial Sequence
  Synthetic oligonucleotide
agacgaccgtcgcaggcctgcattcacctcgtgcc

SEQ ID NO: 58234 - DNA, 35 bp, Artificial Sequence
  Synthetic oligonucleotide
tcatccgtcccatcacacatatacttcgaattgcc

SEQ ID NO: 58235 - DNA, 35 bp, Artificial Sequence
  Synthetic oligonucleotide
aacaacgtgtcatccacgcccccacacaggttgcc

SEQ ID NO: 58236 - DNA, 35 bp, Artificial Sequence
  Synthetic oligonucleotide
catgacgggcggttccttctgccgagcaccactcc

SEQ ID NO: 58237 - DNA, 35 bp, Artificial Sequence
  Synthetic oligonucleotide
tccacgacgcccgttatgggttagtatatatctcc

SEQ ID NO: 58238 - DNA, 35 bp, Artificial Sequence
  Synthetic oligonucleotide
tagctcgggctcccgaacaggacacactgctttcc

SEQ ID NO: 58239 - DNA, 35 bp, Artificial Sequence
  Synthetic oligonucleotide
gagcaagctggttagtcgtcacttcacgcctccgc

SEQ ID NO: 58240 - DNA, 35 bp, Artificial Sequence
  Synthetic oligonucleotide
gaaccaccttatctcagttcctaggaacattctgc

SEQ ID NO: 58241 - DNA, 35 bp, Artificial Sequence
  Synthetic oligonucleotide
cacgaccccgtcccattgagtccttcaccacaatc

SEQ ID NO: 58242 - DNA, 35 bp, Artificial Sequence
  Synthetic oligonucleotide
gacactcagcagtttagcacacgcgcttcgcactc

SEQ ID NO: 58243 - DNA, 35 bp, Artificial Sequence
  Synthetic oligonucleotide
agcataccataccgcactatcgtttaagacgcctc

SEQ ID NO: 58244 - DNA, 35 bp, Artificial Sequence
  Synthetic oligonucleotide
taaacgtccggccgcactgttttcggaacatcctc

SEQ ID NO: 58245 - DNA, 35 bp, Artificial Sequence
  Synthetic oligonucleotide
atttcctgcctccgcgcccgagcactcgtactctc

SEQ ID NO: 58246 - DNA, 35 bp, Artificial Sequence
  Synthetic oligonucleotide
attgccacgtaccaccgaattatacgccacacgtc

SEQ ID NO: 58247 - DNA, 35 bp, Artificial Sequence
  Synthetic oligonucleotide
gtgggagtgcaaagggttatccagggctgggtgag

SEQ ID NO: 58248 - DNA, 35 bp, Artificial Sequence
  Synthetic oligonucleotide
aaattaacacatagcccgcccaccatggtcatccg

SEQ ID NO: 58249 - DNA, 35 bp, Artificial Sequence
  Synthetic oligonucleotide
ttagtcacaacgcactcacccgaacgcttgatctg

SEQ ID NO: 58250 - DNA, 35 bp, Artificial Sequence
  Synthetic oligonucleotide
gcggaaaccgccaaatactagcttatcactctctg

SEQ ID NO: 58251 - DNA, 35 bp, Artificial Sequence
  Synthetic oligonucleotide
ttgaccctgtttgactgtctttttggcctatattg

SEQ ID NO: 58252 - DNA, 35 bp, Artificial Sequence
  Synthetic oligonucleotide
gacagagccccacaatggtcacccgaaaatgtttg

SEQ ID NO: 58253 - DNA, 33 bp, Artificial Sequence
  Synthetic oligonucleotide
acgataccgcaatctttctcacgcgctttgtct

SEQ ID NO: 58254 - DNA, 34 bp, Artificial Sequence
  Synthetic oligonucleotide
taccaccccctctgacgtttactggcttgcttct

SEQ ID NO: 58255 - DNA, 35 bp, Artificial Sequence
  Synthetic oligonucleotide
tgtggagcgtgcctcgctgttttttcgttaatctt

SEQ ID NO: 58256 - DNA, 35 bp, Artificial Sequence
  Synthetic oligonucleotide
gactgagcgcctgctctgtttccaggttccctttt

SEQ ID NO: 58257 - DNA, 37 bp, Artificial Sequence
  Synthetic oligonucleotide
tccgacattgttcgcttggtgagtcgcctaactccaa

SEQ ID NO: 58258 - DNA, 36 bp, Artificial Sequence
  Synthetic oligonucleotide
tttggtcatgcacaccatcctgttactgcacgtgaa

SEQ ID NO: 58259 - DNA, 36 bp, Artificial Sequence
  Synthetic oligonucleotide
gacagaggggggatacagggataattagggggtgaa

SEQ ID NO: 58260 - DNA, 36 bp, Artificial Sequence
  Synthetic oligonucleotide
acatggcgggtgcacgctgccctatagcaaccttaa

SEQ ID NO: 58261 - DNA, 35 bp, Artificial Sequence
  Synthetic oligonucleotide
atgcctgggccgcttgggatcccgatcaattttaa

SEQ ID NO: 58262 - DNA, 35 bp, Artificial Sequence
  Synthetic oligonucleotide
atgcatgcttgtccgccaacccgtctaactgcaca

SEQ ID NO: 58263 - DNA, 36 bp, Artificial Sequence
  Synthetic oligonucleotide
acccctccgtccctgcttgttgtagtgctttcgcca

SEQ ID NO: 58264 - DNA, 36 bp, Artificial Sequence
  Synthetic oligonucleotide
ataccggcgtcgcaacacctccgttctccatgtgca

SEQ ID NO: 58265 - DNA, 36 bp, Artificial Sequence
  Synthetic oligonucleotide
gtcgagtctcttaagcggggaggtagggggggatca

SEQ ID NO: 58266 - DNA, 35 bp, Artificial Sequence
  Synthetic oligonucleotide
tctactctaccggcccctgcgatcggttttcttca

SEQ ID NO: 58267 - DNA, 35 bp, Artificial Sequence
  Synthetic oligonucleotide
gtgcccacgcgtcaccgactacatcctcatacaga

SEQ ID NO: 58268 - DNA, 37 bp, Artificial Sequence
  Synthetic oligonucleotide
actaacgtcatatacgcatacaccaccccctcagaga

SEQ ID NO: 58269 - DNA, 37 bp, Artificial Sequence
  Synthetic oligonucleotide
gaagagggaaggatcggtcaggacgtgtaagatgaga

SEQ ID NO: 58270 - DNA, 37 bp, Artificial Sequence
  Synthetic oligonucleotide
tcatcctactaacttctgcgaccagcaggtcccccga

SEQ ID NO: 58271 - DNA, 36 bp, Artificial Sequence
  Synthetic oligonucleotide
gcgaccaaggtgggtggtgaggtgggggggggccga

SEQ ID NO: 58272 - DNA, 37 bp, Artificial Sequence
  Synthetic oligonucleotide
atgcatgcaaacagcacccagcggaatttctactcga

SEQ ID NO: 58273 - DNA, 37 bp, Artificial Sequence
  Synthetic oligonucleotide
acccaacaccacattcaccgcgattataatgaacgga

SEQ ID NO: 58274 - DNA, 35 bp, Artificial Sequence
  Synthetic oligonucleotide
actcaagccccctgacctgtatttatagttgcgga

SEQ ID NO: 58275 - DNA, 37 bp, Artificial Sequence
  Synthetic oligonucleotide
gtctcgcctcgcccctacgcaccattgatacatcgga

SEQ ID NO: 58276 - DNA, 37 bp, Artificial Sequence
  Synthetic oligonucleotide
gaacaggtggtaagtggtctaggctgaacagtaggga

SEQ ID NO: 58277 - DNA, 37 bp, Artificial Sequence
  Synthetic oligonucleotide
gcatccgtcaaggaagggctggagaggtagacgggga

SEQ ID NO: 58278 - DNA, 35 bp, Artificial Sequence
  Synthetic oligonucleotide
tcacaccacgaggcaggaactctgagaagggtgga

SEQ ID NO: 58279 - DNA, 37 bp, Artificial Sequence
  Synthetic oligonucleotide
gccgtcttcccgcactgctcccttgtttcttcttgga

SEQ ID NO: 58280 - DNA, 37 bp, Artificial Sequence
  Synthetic oligonucleotide
agacccatcctgcatagacctgccctccagagttgga

SEQ ID NO: 58281 - DNA, 37 bp, Artificial Sequence
  Synthetic oligonucleotide
gccacacacagtgaactgcataccctactcatttgga

SEQ ID NO: 58282 - DNA, 36 bp, Artificial Sequence
  Synthetic oligonucleotide
tccgccgatgcgggaccgacctttaactgtgcctga

SEQ ID NO: 58283 - DNA, 37 bp, Artificial Sequence
  Synthetic oligonucleotide
gatgcgggacgggcgtttcggggcgggacgttcctga

SEQ ID NO: 58284 - DNA, 38 bp, Artificial Sequence
  Synthetic oligonucleotide
agttaccccaggctcctccagctgtcctcctccgctga

SEQ ID NO: 58285 - DNA, 36 bp, Artificial Sequence
  Synthetic oligonucleotide
gtgcgcagaacagtgtctgtcccctctgcactctga

SEQ ID NO: 58286 - DNA, 38 bp, Artificial Sequence
  Synthetic oligonucleotide
gattccaatttgtacatggcaccatctgttccctctga

SEQ ID NO: 58287 - DNA, 38 bp, Artificial Sequence
  Synthetic oligonucleotide
gtgggagaggggatgacgagcgggaaaaaacaaagtga

SEQ ID NO: 58288 - DNA, 38 bp, Artificial Sequence
  Synthetic oligonucleotide
accgccactccgacatccagcttccttctcaacagtga

SEQ ID NO: 58289 - DNA, 38 bp, Artificial Sequence
  Synthetic oligonucleotide
ggatgtagggctcgggggggaaacggttgtgggagtga

SEQ ID NO: 58290 - DNA, 38 bp, Artificial Sequence
  Synthetic oligonucleotide
taaggggcaatgaatggaagcgagggaatttggcgtga

SEQ ID NO: 58291 - DNA, 38 bp, Artificial Sequence
  Synthetic oligonucleotide
gagtcagtggggtgacggaggcgggatgcggggggtga

SEQ ID NO: 58292 - DNA, 38 bp, Artificial Sequence
  Synthetic oligonucleotide
gagtacatgcagggtgtagaggatggcgctggacttga

SEQ ID NO: 58293 - DNA, 37 bp, Artificial Sequence
  Synthetic oligonucleotide
gtgcaatgtcccccgttgcgcatattaatttccttga

SEQ ID NO: 58294 - DNA, 37 bp, Artificial Sequence
  Synthetic oligonucleotide
gtggacaaggtgggagatagggatgatgtcatgttga

SEQ ID NO: 58295 - DNA, 37 bp, Artificial Sequence
  Synthetic oligonucleotide
acagccgacgtccagcggttacagtgttgccctttga

SEQ ID NO: 58296 - DNA, 38 bp, Artificial Sequence
  Synthetic oligonucleotide
attgctccccccaattgcttccgacaacatccttttga

SEQ ID NO: 58297 - DNA, 36 bp, Artificial Sequence
  Synthetic oligonucleotide
tactccctctcagttcgctgtaccaccacggttata

SEQ ID NO: 58298 - DNA, 35 bp, Artificial Sequence
  Synthetic oligonucleotide
aatacccaccgctatcgagtgtcccttcctagcta

SEQ ID NO: 58299 - DNA, 36 bp, Artificial Sequence
  Synthetic oligonucleotide
tgtctccaccgcaatataactggacaatgccagtta

SEQ ID NO: 58300 - DNA, 36 bp, Artificial Sequence
  Synthetic oligonucleotide
gccccgacttgcacgcattccctgcctctgtcttta

SEQ ID NO: 58301 - DNA, 35 bp, Artificial Sequence
  Synthetic oligonucleotide
tctgtccctgcaaccaaccgcttgagtctcaatac

SEQ ID NO: 58302 - DNA, 35 bp, Artificial Sequence
  Synthetic oligonucleotide
gcgcacgataatcgctttttctcgacgatcgaacc

SEQ ID NO: 58303 - DNA, 35 bp, Artificial Sequence
  Synthetic oligonucleotide
actagcctactgccgtggaattctgcatatgtccc

SEQ ID NO: 58304 - DNA, 35 bp, Artificial Sequence
  Synthetic oligonucleotide
gtcgccgccagttcgctattacgttgggcgttccc

SEQ ID NO: 58305 - DNA, 35 bp, Artificial Sequence
  Synthetic oligonucleotide
tgcaatcgtacttctcggttccctgctcctgttcc

SEQ ID NO: 58306 - DNA, 35 bp, Artificial Sequence
  Synthetic oligonucleotide
tactcatcagaagagcggtgtgtgggaaagtgtgc

SEQ ID NO: 58307 - DNA, 35 bp, Artificial Sequence
  Synthetic oligonucleotide
aacccacccacaatgctccctcacagggagtttgc

SEQ ID NO: 58308 - DNA, 35 bp, Artificial Sequence
  Synthetic oligonucleotide
tgtgtacgaaagtccgtccgcaccatcgcaaaatc

SEQ ID NO: 58309 - DNA, 35 bp, Artificial Sequence
  Synthetic oligonucleotide
taagatcccccagcctcccggaccgtgtccgtatc

SEQ ID NO: 58310 - DNA, 35 bp, Artificial Sequence
  Synthetic oligonucleotide
ttagaaccatgcgtgcaagtccgttcctccctctc

SEQ ID NO: 58311 - DNA, 35 bp, Artificial Sequence
  Synthetic oligonucleotide
atggcgtgttcatcccccgtggtcgtaccttggtc

SEQ ID NO: 58312 - DNA, 35 bp, Artificial Sequence
  Synthetic oligonucleotide
gactgagaaaggccggattggggacgagactggag

SEQ ID NO: 58313 - DNA, 35 bp, Artificial Sequence
  Synthetic oligonucleotide
tgcctaccacttgtcaatgacccatcgatgtgacg

SEQ ID NO: 58314 - DNA, 35 bp, Artificial Sequence
  Synthetic oligonucleotide
tacgcacctcacaaccccactgttccatcttcgcg

SEQ ID NO: 58315 - DNA, 35 bp, Artificial Sequence
  Synthetic oligonucleotide
gatgcagggaagacaagattttagggcgggccagg

SEQ ID NO: 58316 - DNA, 35 bp, Artificial Sequence
  Synthetic oligonucleotide
gacggatggccaaagcgttacggggaaaaattggg

SEQ ID NO: 58317 - DNA, 35 bp, Artificial Sequence
  Synthetic oligonucleotide
gagggtgttgcaaaagtagggaggctgatgtactg

SEQ ID NO: 58318 - DNA, 35 bp, Artificial Sequence
  Synthetic oligonucleotide
atcgacatcagccaatgtcatcctcctattcgctg

SEQ ID NO: 58319 - DNA, 35 bp, Artificial Sequence
  Synthetic oligonucleotide
tcacctccgtctcatcggactgacacgtgcctttg

SEQ ID NO: 58320 - DNA, 35 bp, Artificial Sequence
  Synthetic oligonucleotide
agatcacactggccttcaggtccaacttccttttg

SEQ ID NO: 58321 - DNA, 35 bp, Artificial Sequence
  Synthetic oligonucleotide
acccgcactcttgtatttgtacttacaccgtccat

SEQ ID NO: 58322 - DNA, 35 bp, Artificial Sequence
  Synthetic oligonucleotide
gaaggcgctctacagccaagcttgcccttcactat

SEQ ID NO: 58323 - DNA, 35 bp, Artificial Sequence
  Synthetic oligonucleotide
gttggagccatcctcgtaacgccctgcacaaaact

SEQ ID NO: 58324 - DNA, 35 bp, Artificial Sequence
  Synthetic oligonucleotide
gaacatcttacacctcgctcgtcaagctcccgcct

SEQ ID NO: 58325 - DNA, 36 bp, Artificial Sequence
  Synthetic oligonucleotide
ttcctcccatggccttttgtggttgtgcgcactcct

SEQ ID NO: 58326 - DNA, 35 bp, Artificial Sequence
  Synthetic oligonucleotide
gagtcccgccttcgagattaccgttaaccccttct

SEQ ID NO: 58327 - DNA, 35 bp, Artificial Sequence
  Synthetic oligonucleotide
tcagggggaggagaagcaggagagacgcacgtagt

SEQ ID NO: 58328 - DNA, 35 bp, Artificial Sequence
  Synthetic oligonucleotide
ggtgtcggtggaggtaatacagggaggcagtgcgt

SEQ ID NO: 58329 - DNA, 35 bp, Artificial Sequence
  Synthetic oligonucleotide
gtcaccaccctggcgtcctagcgacacacaatggt

SEQ ID NO: 58330 - DNA, 35 bp, Artificial Sequence
  Synthetic oligonucleotide
gtgcgccgctaagccttacactgcactgggccatt

SEQ ID NO: 58331 - DNA, 35 bp, Artificial Sequence
  Synthetic oligonucleotide
acacgggaaggtagagatgctggtggtgtgtgatt

SEQ ID NO: 58332 - DNA, 35 bp, Artificial Sequence
  Synthetic oligonucleotide
tctccgcacggtccgtctccatactctacgcgctt

SEQ ID NO: 58333 - DNA, 35 bp, Artificial Sequence
  Synthetic oligonucleotide
gcacaaccgccaggacccataccctcagcgccgtt

SEQ ID NO: 58334 - DNA, 36 bp, Artificial Sequence
  Synthetic oligonucleotide
gacatgtgtaaggtcatacaagcccacgtaccccaa

SEQ ID NO: 58335 - DNA, 36 bp, Artificial Sequence
  Synthetic oligonucleotide
tgtgtgccttaccgcccgaccaacgtgccactagaa

SEQ ID NO: 58336 - DNA, 36 bp, Artificial Sequence
  Synthetic oligonucleotide
gaccgcaacctcgatttaacatcatcacgtatcgaa

SEQ ID NO: 58337 - DNA, 35 bp, Artificial Sequence
  Synthetic oligonucleotide
tacacacacaaattagaatggcctatcctggggaa

SEQ ID NO: 58338 - DNA, 36 bp, Artificial Sequence
  Synthetic oligonucleotide
gatctgcccgtactcgtatctagtcggtccccgtaa

SEQ ID NO: 58339 - DNA, 35 bp, Artificial Sequence
  Synthetic oligonucleotide
gaccccgacttcctagaaaaccagacgcccaaaca

SEQ ID NO: 58340 - DNA, 36 bp, Artificial Sequence
  Synthetic oligonucleotide
gtcacaccgattttagtcagcctcccagccccaaca

SEQ ID NO: 58341 - DNA, 35 bp, Artificial Sequence
  Synthetic oligonucleotide
tatgtagacgttcgctcttatcctccaccgataca

SEQ ID NO: 58342 - DNA, 36 bp, Artificial Sequence
  Synthetic oligonucleotide
acaggccgggcctgtactcttatgtctctccgtaca

SEQ ID NO: 58343 - DNA, 35 bp, Artificial Sequence
  Synthetic oligonucleotide
taacgaggtcacgcactcacaacacacggattaca

SEQ ID NO: 58344 - DNA, 36 bp, Artificial Sequence
  Synthetic oligonucleotide
tttggccagtcaaccctgtctccatgttgcctacca

SEQ ID NO: 58345 - DNA, 35 bp, Artificial Sequence
  Synthetic oligonucleotide
ttgcaatccatatcacacaggactcctctttcgca

SEQ ID NO: 58346 - DNA, 36 bp, Artificial Sequence
  Synthetic oligonucleotide
ttttgcaacggattgtacacgcctcgcctccctgca

SEQ ID NO: 58347 - DNA, 36 bp, Artificial Sequence
  Synthetic oligonucleotide
ttgcacgcaagccgacaaacgtctggccctccatca

SEQ ID NO: 58348 - DNA, 35 bp, Artificial Sequence
  Synthetic oligonucleotide
aatacgcccatccaagcacggcccttgcgccgtca

SEQ ID NO: 58349 - DNA, 36 bp, Artificial Sequence
  Synthetic oligonucleotide
atgggagagagacgcaaagagggagctaggttgtca

SEQ ID NO: 58350 - DNA, 36 bp, Artificial Sequence
  Synthetic oligonucleotide
ttgggggggacattctgggaaagggagagcgggaga

SEQ ID NO: 58351 - DNA, 35 bp, Artificial Sequence
  Synthetic oligonucleotide
actatgcgacgcaagcctcccctgatactcttaga

SEQ ID NO: 58352 - DNA, 37 bp, Artificial Sequence
  Synthetic oligonucleotide
accgcctccctcggggtcattaggcccgggctcacga

SEQ ID NO: 58353 - DNA, 37 bp, Artificial Sequence
  Synthetic oligonucleotide
tgaatcgtgcccagtgcgctttctctcctcctgacga

SEQ ID NO: 58354 - DNA, 37 bp, Artificial Sequence
  Synthetic oligonucleotide
tatacaccgctgattttctaggccattttaccaccga

SEQ ID NO: 58355 - DNA, 37 bp, Artificial Sequence
  Synthetic oligonucleotide
gctcaaagcgcactttccatgcctgcacacttgccga

SEQ ID NO: 58356 - DNA, 37 bp, Artificial Sequence
  Synthetic oligonucleotide
tcactgcagtccttcttcgcctataacactcttccga

SEQ ID NO: 58357 - DNA, 37 bp, Artificial Sequence
  Synthetic oligonucleotide
acacttccacttaccgcctgaacctgtacatgagcga

SEQ ID NO: 58358 - DNA, 35 bp, Artificial Sequence
  Synthetic oligonucleotide
tacgtaccgtagggagtaagggggggggatcgcga

SEQ ID NO: 58359 - DNA, 37 bp, Artificial Sequence
  Synthetic oligonucleotide
tccagtgcgacattgtccacttttctattcgtatcga

SEQ ID NO: 58360 - DNA, 36 bp, Artificial Sequence
  Synthetic oligonucleotide
accgccccgcccgtagactcgtatctgcaaacagga

SEQ ID NO: 58361 - DNA, 37 bp, Artificial Sequence
  Synthetic oligonucleotide
accagtgtaacgaagaaggaggcaaggggtgggagga

SEQ ID NO: 58362 - DNA, 37 bp, Artificial Sequence
  Synthetic oligonucleotide
aactgggttgggtgggctgggtggcgtttgctgcgga

SEQ ID NO: 58363 - DNA, 37 bp, Artificial Sequence
  Synthetic oligonucleotide
gtggtgggggggagctggcacatgcgtgtgggaggga

SEQ ID NO: 58364 - DNA, 35 bp, Artificial Sequence
  Synthetic oligonucleotide
gtggatacgaccacagagatataggaggggatgga

SEQ ID NO: 58365 - DNA, 38 bp, Artificial Sequence
  Synthetic oligonucleotide
tgagtaatacctggcccctaccttgtccaatgacatga

SEQ ID NO: 58366 - DNA, 38 bp, Artificial Sequence
  Synthetic oligonucleotide
tacggtacctgttcctggtctgaactacctctccatga

SEQ ID NO: 58367 - DNA, 37 bp, Artificial Sequence
  Synthetic oligonucleotide
agccccaccgtgtcttgtccatatgttgcactcatga

SEQ ID NO: 58368 - DNA, 38 bp, Artificial Sequence
  Synthetic oligonucleotide
accacaacaccgcccgaatcaactttgcatctgtatga

SEQ ID NO: 58369 - DNA, 38 bp, Artificial Sequence
  Synthetic oligonucleotide
tcgcactgtaagcagtcctcaccctcccctcaaactga

SEQ ID NO: 58370 - DNA, 35 bp, Artificial Sequence
  Synthetic oligonucleotide
tgtgcaacccctgtaataccaacctgggccactga

SEQ ID NO: 58371 - DNA, 38 bp, Artificial Sequence
  Synthetic oligonucleotide
gacctgcccacaccatccgtccacaacgacatctctga

SEQ ID NO: 58372 - DNA, 38 bp, Artificial Sequence
  Synthetic oligonucleotide
gccatcggtatgatgtgtgaggaaggtggggcaagtga

SEQ ID NO: 58373 - DNA, 38 bp, Artificial Sequence
  Synthetic oligonucleotide
tgagagcagtcggcgggaggtaatggatggtgcagtga

SEQ ID NO: 58374 - DNA, 38 bp, Artificial Sequence
  Synthetic oligonucleotide
ggtgatccccgtggttgttgcatcttcatcccccgtga

SEQ ID NO: 58375 - DNA, 37 bp, Artificial Sequence
  Synthetic oligonucleotide
gatggataggtgggaggcgttgaaaagcgctgcgtga

SEQ ID NO: 58376 - DNA, 38 bp, Artificial Sequence
  Synthetic oligonucleotide
tccctacggcgacatcttcccggcctcccctgcggtga

SEQ ID NO: 58377 - DNA, 38 bp, Artificial Sequence
  Synthetic oligonucleotide
atgggggtgacaaaggttgagggatgtggccatggtga

SEQ ID NO: 58378 - DNA, 38 bp, Artificial Sequence
  Synthetic oligonucleotide
gcctgaggcggccttgtcccatcgtatcatcccattga

SEQ ID NO: 58379 - DNA, 37 bp, Artificial Sequence
  Synthetic oligonucleotide
gatctcaatgcctgtgtaccatcccctccctccttga

SEQ ID NO: 58380 - DNA, 37 bp, Artificial Sequence
  Synthetic oligonucleotide
ttccacgaatcggccgtaccctcttgctttcgcttga

SEQ ID NO: 58381 - DNA, 36 bp, Artificial Sequence
  Synthetic oligonucleotide
gctacatcttgaccttcccctatgcagaacttcgta

SEQ ID NO: 58382 - DNA, 36 bp, Artificial Sequence
  Synthetic oligonucleotide
atgcatcctccctgcgccttgcgtcacacaacggta

SEQ ID NO: 58383 - DNA, 35 bp, Artificial Sequence
  Synthetic oligonucleotide
tgacccatcgctgggctctcattcatctacgggta

SEQ ID NO: 58384 - DNA, 35 bp, Artificial Sequence
  Synthetic oligonucleotide
tcccggaacgccagcgcaaacgcccggtcacctta

SEQ ID NO: 58385 - DNA, 36 bp, Artificial Sequence
  Synthetic oligonucleotide
accatatttccccatcctgcgcatcctgacgtctta

SEQ ID NO: 58386 - DNA, 35 bp, Artificial Sequence
  Synthetic oligonucleotide
gcgaaggggccttcagcgggtctacttcctctaac

SEQ ID NO: 58387 - DNA, 34 bp, Artificial Sequence
  Synthetic oligonucleotide
acatgacctcctgatcattgcgagggactccacc

SEQ ID NO: 58388 - DNA, 35 bp, Artificial Sequence
  Synthetic oligonucleotide
tacgcggatgttggtttggtcgccttctcttaccc

SEQ ID NO: 58389 - DNA, 35 bp, Artificial Sequence
  Synthetic oligonucleotide
gcacggtgtggtaatctctatcgcttcggtactcc

SEQ ID NO: 58390 - DNA, 35 bp, Artificial Sequence
  Synthetic oligonucleotide
gctggttggctctgcggttcacttatttccattcc

SEQ ID NO: 58391 - DNA, 35 bp, Artificial Sequence
  Synthetic oligonucleotide
acgacgaagtgggtcgtggccgtcaacttatccgc

SEQ ID NO: 58392 - DNA, 35 bp, Artificial Sequence
  Synthetic oligonucleotide
tgttaccccccaactgagatcgtccagaactaggc

SEQ ID NO: 58393 - DNA, 35 bp, Artificial Sequence
  Synthetic oligonucleotide
tgcgcatcccgaagctggcgcattaaccctccatc

SEQ ID NO: 58394 - DNA, 35 bp, Artificial Sequence
  Synthetic oligonucleotide
taccaccttaatccgacgggcctgctgtcgtactc

SEQ ID NO: 58395 - DNA, 35 bp, Artificial Sequence
  Synthetic oligonucleotide
tccagcgatgccatcgcaacgcctatgaatacctc

SEQ ID NO: 58396 - DNA, 35 bp, Artificial Sequence
  Synthetic oligonucleotide
tcgagaccattcgcttcttgtctgccgataacttc

SEQ ID NO: 58397 - DNA, 35 bp, Artificial Sequence
  Synthetic oligonucleotide
ttgtcctgtcatacttcccaccaattcgcgtccag

SEQ ID NO: 58398 - DNA, 35 bp, Artificial Sequence
  Synthetic oligonucleotide
agctccggccctgttgctgcctcatctgcccatag

SEQ ID NO: 58399 - DNA, 35 bp, Artificial Sequence
  Synthetic oligonucleotide
ggagtggggtaagggtggggttgacgggtgtgccg

SEQ ID NO: 58400 - DNA, 35 bp, Artificial Sequence
  Synthetic oligonucleotide
gagcagaggagggtagggaagtggctatgatgcgg

SEQ ID NO: 58401 - DNA, 35 bp, Artificial Sequence
  Synthetic oligonucleotide
ggatcgaatggggcaaagcggggggccaggcactg

SEQ ID NO: 58402 - DNA, 35 bp, Artificial Sequence
  Synthetic oligonucleotide
ttccccgcctccctctgccgttacacttctttgtg

SEQ ID NO: 58403 - DNA, 35 bp, Artificial Sequence
  Synthetic oligonucleotide
agcgcaggccaaaatccatcgatctacacccgttg

SEQ ID NO: 58404 - DNA, 35 bp, Artificial Sequence
  Synthetic oligonucleotide
agtccctatctagccctaaccactgacagtctttg

SEQ ID NO: 58405 - DNA, 35 bp, Artificial Sequence
  Synthetic oligonucleotide
gtgttaccaccgggagctgcttgttacatcaccat

SEQ ID NO: 58406 - DNA, 35 bp, Artificial Sequence
  Synthetic oligonucleotide
gtgcgaaccgccgcatccgtagctctcctctctat

SEQ ID NO: 58407 - DNA, 35 bp, Artificial Sequence
  Synthetic oligonucleotide
tgacccaccagagctcgtgccataccggaaatact

SEQ ID NO: 58408 - DNA, 35 bp, Artificial Sequence
  Synthetic oligonucleotide
gctgggtggctgaacgtagcggggggaataacggt

SEQ ID NO: 58409 - DNA, 35 bp, Artificial Sequence
  Synthetic oligonucleotide
accacacaatcgtctttggcgcaagccaccgtttt

SEQ ID NO: 58410 - DNA, 36 bp, Artificial Sequence
  Synthetic oligonucleotide
agaacatccccgcagtattcgtttcgcatggaccaa

SEQ ID NO: 58411 - DNA, 35 bp, Artificial Sequence
  Synthetic oligonucleotide
accacccccctcggccgagccctgtcccgaacgaa

SEQ ID NO: 58412 - DNA, 36 bp, Artificial Sequence
  Synthetic oligonucleotide
gagcggcccaccgcactggcctccgaatatttcgaa

SEQ ID NO: 58413 - DNA, 35 bp, Artificial Sequence
  Synthetic oligonucleotide
tcatcccccggtactctcccccgacgcacgaataa

SEQ ID NO: 58414 - DNA, 36 bp, Artificial Sequence
  Synthetic oligonucleotide
atgtccccgtaggtctaccatgttccgaccccctaa

SEQ ID NO: 58415 - DNA, 36 bp, Artificial Sequence
  Synthetic oligonucleotide
tcaaacatgccagaatggccgagctccttaatcaca

SEQ ID NO: 58416 - DNA, 35 bp, Artificial Sequence
  Synthetic oligonucleotide
tctaacggtacgtacaagctgctccctttccacca

SEQ ID NO: 58417 - DNA, 36 bp, Artificial Sequence
  Synthetic oligonucleotide
ttagtaacccctccgaccagtgtaacttgcatccca

SEQ ID NO: 58418 - DNA, 36 bp, Artificial Sequence
  Synthetic oligonucleotide
taactcagccagccggggagcgtactgtcccatcca

SEQ ID NO: 58419 - DNA, 36 bp, Artificial Sequence
  Synthetic oligonucleotide
gacccatctttcgtgtcatccgatcgacaaattcca

SEQ ID NO: 58420 - DNA, 36 bp, Artificial Sequence
  Synthetic oligonucleotide
atcaccaatcgtcgatattttacccgttatcctgca

SEQ ID NO: 58421 - DNA, 36 bp, Artificial Sequence
  Synthetic oligonucleotide
tcagccgttgggatgtgctttttgctctcatattca

SEQ ID NO: 58422 - DNA, 36 bp, Artificial Sequence
  Synthetic oligonucleotide
tgaccggcaaaggaaaaagttggtctgggattgaga

SEQ ID NO: 58423 - DNA, 37 bp, Artificial Sequence
  Synthetic oligonucleotide
accccattcagtgggccagaataccccacccaaccga

SEQ ID NO: 58424 - DNA, 35 bp, Artificial Sequence
  Synthetic oligonucleotide
cccgtgacccgcccacacctgtgttcaccttccga

SEQ ID NO: 58425 - DNA, 36 bp, Artificial Sequence
  Synthetic oligonucleotide
gatgcggccaatatgccgtaccgccccctaaatcga

SEQ ID NO: 58426 - DNA, 37 bp, Artificial Sequence
  Synthetic oligonucleotide
ttgggctcagtaccatatggtgttttctttccttcga

SEQ ID NO: 58427 - DNA, 36 bp, Artificial Sequence
  Synthetic oligonucleotide
tagtgctcgcgcccccttgtaacaccccccgcagga

SEQ ID NO: 58428 - DNA, 37 bp, Artificial Sequence
  Synthetic oligonucleotide
gaagagagagaggatctgaagtacagttggaggagga

SEQ ID NO: 58429 - DNA, 37 bp, Artificial Sequence
  Synthetic oligonucleotide
acacccttcctcctgatcctacgggcctatttgagga

SEQ ID NO: 58430 - DNA, 37 bp, Artificial Sequence
  Synthetic oligonucleotide
tcctttgcctccacctatgtgcgtgcacccttacgga

SEQ ID NO: 58431 - DNA, 36 bp, Artificial Sequence
  Synthetic oligonucleotide
gagaacgagaggggacagggatactaacgcggcgga

SEQ ID NO: 58432 - DNA, 36 bp, Artificial Sequence
  Synthetic oligonucleotide
gcaacgaggtagcaaaacatgtagtgaaaaacggga

SEQ ID NO: 58433 - DNA, 36 bp, Artificial Sequence
  Synthetic oligonucleotide
atatacgatccgttggtgggaaggggtcggggggga

SEQ ID NO: 58434 - DNA, 37 bp, Artificial Sequence
  Synthetic oligonucleotide
gtccgagggaattggggggaggacatcacttggggga

SEQ ID NO: 58435 - DNA, 37 bp, Artificial Sequence
  Synthetic oligonucleotide
aacttacacgccgccccacttgcatagatttgctgga

SEQ ID NO: 58436 - DNA, 37 bp, Artificial Sequence
  Synthetic oligonucleotide
tccgcgggtggattatccgcgttttcacatatctgga

SEQ ID NO: 58437 - DNA, 38 bp, Artificial Sequence
  Synthetic oligonucleotide
atcatccccgccgaccagcatctcaagacgccacatga

SEQ ID NO: 58438 - DNA, 38 bp, Artificial Sequence
  Synthetic oligonucleotide
gggtgggcagtgaagcaaggggggagggagatctatga

SEQ ID NO: 58439 - DNA, 38 bp, Artificial Sequence
  Synthetic oligonucleotide
gcaagtggtgccggggttggaggggagttgaggactga

SEQ ID NO: 58440 - DNA, 36 bp, Artificial Sequence
  Synthetic oligonucleotide
gcaacactagtcgggtcccttctccgtctgtcctga

SEQ ID NO: 58441 - DNA, 38 bp, Artificial Sequence
  Synthetic oligonucleotide
atctgagccgtccgcattattcacgccgaacttcctga

SEQ ID NO: 58442 - DNA, 38 bp, Artificial Sequence
  Synthetic oligonucleotide
gccgcaccaccatttcagggcagtacaacaatggctga

SEQ ID NO: 58443 - DNA, 37 bp, Artificial Sequence
  Synthetic oligonucleotide
agtagttgggggggtcaaagggtgggatggatcgtga

SEQ ID NO: 58444 - DNA, 37 bp, Artificial Sequence
  Synthetic oligonucleotide
gactgtggacatgttattgtaaggttggggggggtga

SEQ ID NO: 58445 - DNA, 38 bp, Artificial Sequence
  Synthetic oligonucleotide
tttctgtccgcccgcgcattcttacacagcctttgtga

SEQ ID NO: 58446 - DNA, 37 bp, Artificial Sequence
  Synthetic oligonucleotide
acctagccttctcctgttcgccctgtcctttttgtga

SEQ ID NO: 58447 - DNA, 38 bp, Artificial Sequence
  Synthetic oligonucleotide
actgccactccccgcgtaaacagcctaattctcattga

SEQ ID NO: 58448 - DNA, 38 bp, Artificial Sequence
  Synthetic oligonucleotide
tcccaccgcctcatttgaaaaacccgtctacttattga

SEQ ID NO: 58449 - DNA, 38 bp, Artificial Sequence
  Synthetic oligonucleotide
gacttccccgtgcacaatcgtcgcattgaatcccttga

SEQ ID NO: 58450 - DNA, 37 bp, Artificial Sequence
  Synthetic oligonucleotide
tgtgatgcctcttcactatcgcctattatagccttga

SEQ ID NO: 58451 - DNA, 38 bp, Artificial Sequence
  Synthetic oligonucleotide
gacgttcgccaaatccaagcccccctgctcctgcttga

SEQ ID NO: 58452 - DNA, 38 bp, Artificial Sequence
  Synthetic oligonucleotide
aaactgctctctgcttacggtattcgttccacctttga

SEQ ID NO: 58453 - DNA, 38 bp, Artificial Sequence
  Synthetic oligonucleotide
tcgttgtgcccatgcaggtcaacctcgaccctctttga

SEQ ID NO: 58454 - DNA, 36 bp, Artificial Sequence
  Synthetic oligonucleotide
ttgaatgaaagtggacggtgggacctagagtgggta

SEQ ID NO: 58455 - DNA, 35 bp, Artificial Sequence
  Synthetic oligonucleotide
gaactacgccccacactgtcgatttcacccttgta

SEQ ID NO: 58456 - DNA, 36 bp, Artificial Sequence
  Synthetic oligonucleotide
gcatactcccccatgtttttttcgagccgactatta

SEQ ID NO: 58457 - DNA, 35 bp, Artificial Sequence
  Synthetic oligonucleotide
ttgatccacttgcagtgagccttttcgttcataac

SEQ ID NO: 58458 - DNA, 35 bp, Artificial Sequence
  Synthetic oligonucleotide
gttgcccgacctacagttgaacgcgacatcttaac

SEQ ID NO: 58459 - DNA, 35 bp, Artificial Sequence
  Synthetic oligonucleotide
gtacaggcaacacctggggaatcctccaccctcac

SEQ ID NO: 58460 - DNA, 35 bp, Artificial Sequence
  Synthetic oligonucleotide
gtggtacactgactttacgaggcctcgttcctcac

SEQ ID NO: 58461 - DNA, 35 bp, Artificial Sequence
  Synthetic oligonucleotide
ttgcatcaaatctgctccggacactccgcattcac

SEQ ID NO: 58462 - DNA, 35 bp, Artificial Sequence
  Synthetic oligonucleotide
tgcccgtcacagtccatgccgtacattacgcaacc

SEQ ID NO: 58463 - DNA, 35 bp, Artificial Sequence
  Synthetic oligonucleotide
ttcggtgcaggaatctgtagcccatctcatcgccc

SEQ ID NO: 58464 - DNA, 35 bp, Artificial Sequence
  Synthetic oligonucleotide
tgcgctcgttttgtgccctgttctgtcatcgtccc

SEQ ID NO: 58465 - DNA, 35 bp, Artificial Sequence
  Synthetic oligonucleotide
gttgcgctcaatctttgctaaatgacccagactcc

SEQ ID NO: 58466 - DNA, 35 bp, Artificial Sequence
  Synthetic oligonucleotide
gtctccctggccaatgtccctctttcgtcgtatgc

SEQ ID NO: 58467 - DNA, 35 bp, Artificial Sequence
  Synthetic oligonucleotide
gtacagagccttccgatacagtctgcagatccttc

SEQ ID NO: 58468 - DNA, 35 bp, Artificial Sequence
  Synthetic oligonucleotide
ccagagccacattctgccagacccctcatacgttc

SEQ ID NO: 58469 - DNA, 35 bp, Artificial Sequence
  Synthetic oligonucleotide
gcacttatctgaccacccatcctgcaactgtaaag

SEQ ID NO: 58470 - DNA, 35 bp, Artificial Sequence
  Synthetic oligonucleotide
gacgccacgtcaacaaagcagcacgcattgatgcg

SEQ ID NO: 58471 - DNA, 35 bp, Artificial Sequence
  Synthetic oligonucleotide
aaacacccccggactatatggtagatttatgttcg

SEQ ID NO: 58472 - DNA, 35 bp, Artificial Sequence
  Synthetic oligonucleotide
ttcggtgtgaacgaagtcgggcgtggggaaggggg

SEQ ID NO: 58473 - DNA, 35 bp, Artificial Sequence
  Synthetic oligonucleotide
aacggtctggtcattctggggttttgggtgggggg

SEQ ID NO: 58474 - DNA, 35 bp, Artificial Sequence
  Synthetic oligonucleotide
gagatgacaagtactgaaggaagtgcgaggacatg

SEQ ID NO: 58475 - DNA, 35 bp, Artificial Sequence
  Synthetic oligonucleotide
atctggccgtcttaagcctgtttttccctacgttg

SEQ ID NO: 58476 - DNA, 35 bp, Artificial Sequence
  Synthetic oligonucleotide
gttcatcctacgcgatttcgcgtgtctgctttact

SEQ ID NO: 58477 - DNA, 35 bp, Artificial Sequence
  Synthetic oligonucleotide
ttgacctccattgacgctaataggtgatatcacct

SEQ ID NO: 58478 - DNA, 35 bp, Artificial Sequence
  Synthetic oligonucleotide
gttcctagccccactccggattttgcatcacgcct

SEQ ID NO: 58479 - DNA, 35 bp, Artificial Sequence
  Synthetic oligonucleotide
tgtcaggtatcccgccgtacagtccaccctctcct

SEQ ID NO: 58480 - DNA, 35 bp, Artificial Sequence
  Synthetic oligonucleotide
tatgactacggctctccgaccatcctttgtctgct

SEQ ID NO: 58481 - DNA, 35 bp, Artificial Sequence
  Synthetic oligonucleotide
tcctgtcttctgcccgtaagtcctgtctgtactct

SEQ ID NO: 58482 - DNA, 35 bp, Artificial Sequence
  Synthetic oligonucleotide
taacaagtataggcatcgcacagtcactggcctct

SEQ ID NO: 58483 - DNA, 35 bp, Artificial Sequence
  Synthetic oligonucleotide
tttcgggcaagggaaaggaggggggagctgggtct

SEQ ID NO: 58484 - DNA, 35 bp, Artificial Sequence
  Synthetic oligonucleotide
ttggacgtctgcgctccacttttacgtcactgtct

SEQ ID NO: 58485 - DNA, 35 bp, Artificial Sequence
  Synthetic oligonucleotide
atagtcactcgagcccttatcgatcttcctccagt

SEQ ID NO: 58486 - DNA, 35 bp, Artificial Sequence
  Synthetic oligonucleotide
tgactctgacaacacatacaccgacactaattcgt

SEQ ID NO: 58487 - DNA, 35 bp, Artificial Sequence
  Synthetic oligonucleotide
gctggccaccggtaggcttctccacccgatatctt

SEQ ID NO: 58488 - DNA, 35 bp, Artificial Sequence
  Synthetic oligonucleotide
gagtcgctgcgatgccgggttcgcccctttccgtt

SEQ ID NO: 58489 - DNA, 35 bp, Artificial Sequence
  Synthetic oligonucleotide
ggatggcgaaggggcactcggagatctgaaactaa

SEQ ID NO: 58490 - DNA, 36 bp, Artificial Sequence
  Synthetic oligonucleotide
gtagcacccctctcggtcttgaaggttgcttattaa

SEQ ID NO: 58491 - DNA, 36 bp, Artificial Sequence
  Synthetic oligonucleotide
gcacctgccccgcccttcgactctcttgttccaaca

SEQ ID NO: 58492 - DNA, 36 bp, Artificial Sequence
  Synthetic oligonucleotide
gaagctgacctggagataggggtgggggattggaca

SEQ ID NO: 58493 - DNA, 36 bp, Artificial Sequence
  Synthetic oligonucleotide
tacgtcagagcaatcgtcccctatttcgcttctaca

SEQ ID NO: 58494 - DNA, 35 bp, Artificial Sequence
  Synthetic oligonucleotide
accgttcaagctcactccttagccttaggttacca

SEQ ID NO: 58495 - DNA, 36 bp, Artificial Sequence
  Synthetic oligonucleotide
gcacgctcggccccctaccgtttgctcatcgctgca

SEQ ID NO: 58496 - DNA, 35 bp, Artificial Sequence
  Synthetic oligonucleotide
gtacgcccataggcggtttcggattatttttctca

SEQ ID NO: 58497 - DNA, 35 bp, Artificial Sequence
  Synthetic oligonucleotide
tttgatgtgcgccatggccctgggttctatcgtca

SEQ ID NO: 58498 - DNA, 37 bp, Artificial Sequence
  Synthetic oligonucleotide
gtagggaggtgggcaacaaggaaattgagaagtgaga

SEQ ID NO: 58499 - DNA, 37 bp, Artificial Sequence
  Synthetic oligonucleotide
gtgcgccttcatgcatcctgtgacgcctatatcacga

SEQ ID NO: 58500 - DNA, 37 bp, Artificial Sequence
  Synthetic oligonucleotide
acaccaaacgatggcatatcgtctccgattttcccga

SEQ ID NO: 58501 - DNA, 37 bp, Artificial Sequence
  Synthetic oligonucleotide
tccaacggatgcactagagatgaacagtggagatcga

SEQ ID NO: 58502 - DNA, 37 bp, Artificial Sequence
  Synthetic oligonucleotide
gactcccccgcagactgacttgttcgacggagctcga

SEQ ID NO: 58503 - DNA, 35 bp, Artificial Sequence
  Synthetic oligonucleotide
atacaccgctgtgggccttctcccgtgagtttcga

SEQ ID NO: 58504 - DNA, 37 bp, Artificial Sequence
  Synthetic oligonucleotide
actgatcgggccggaaaaatgaaacgtgtgggaagga

SEQ ID NO: 58505 - DNA, 37 bp, Artificial Sequence
  Synthetic oligonucleotide
tcagggcggggcgaggtgggaccgttagatggaagga

SEQ ID NO: 58506 - DNA, 36 bp, Artificial Sequence
  Synthetic oligonucleotide
tcacacattgtgcccctcgcctcttgtttcctcgga

SEQ ID NO: 58507 - DNA, 37 bp, Artificial Sequence
  Synthetic oligonucleotide
acccgaaccggccaatatagttggaatatggagggga

SEQ ID NO: 58508 - DNA, 35 bp, Artificial Sequence
  Synthetic oligonucleotide
tgtgtggggtgcgggtgcaggcgacgggggatgga

SEQ ID NO: 58509 - DNA, 38 bp, Artificial Sequence
  Synthetic oligonucleotide
acacattatggttccccctccagtcgtgttatgcatga

SEQ ID NO: 58510 - DNA, 37 bp, Artificial Sequence
  Synthetic oligonucleotide
ttgcgaggttcgtcttttctgcggttccatctcatga

SEQ ID NO: 58511 - DNA, 38 bp, Artificial Sequence
  Synthetic oligonucleotide
aaagaaacgggaggggtattaggcgccatatgggatga

SEQ ID NO: 58512 - DNA, 37 bp, Artificial Sequence
  Synthetic oligonucleotide
aacactgcccaattggcacttattaacaggacactga

SEQ ID NO: 58513 - DNA, 38 bp, Artificial Sequence
  Synthetic oligonucleotide
tatgaccgccttcgtaccacgtatcatcaacctcctga

SEQ ID NO: 58514 - DNA, 38 bp, Artificial Sequence
  Synthetic oligonucleotide
acccgcggcccactctgacacttttgcgttaattctga

SEQ ID NO: 58515 - DNA, 38 bp, Artificial Sequence
  Synthetic oligonucleotide
atactcacccttaagctggccaattcagtccaacgtga

SEQ ID NO: 58516 - DNA, 38 bp, Artificial Sequence
  Synthetic oligonucleotide
gagcggaggtgagggagataaacaagggtaaagcgtga

SEQ ID NO: 58517 - DNA, 38 bp, Artificial Sequence
  Synthetic oligonucleotide
gcgacgctcatcctgatctgattcttttccatttgtga

SEQ ID NO: 58518 - DNA, 38 bp, Artificial Sequence
  Synthetic oligonucleotide
agtcgagccagacctgatctttgccccttcttaattga

SEQ ID NO: 58519 - DNA, 38 bp, Artificial Sequence
  Synthetic oligonucleotide
gccaagcacgaaggcagggaagcatggtcacagcttga

SEQ ID NO: 58520 - DNA, 37 bp, Artificial Sequence
  Synthetic oligonucleotide
tgagcacacgcatcctcttttgggaaccatctgttga

SEQ ID NO: 58521 - DNA, 38 bp, Artificial Sequence
  Synthetic oligonucleotide
tgatactcggactctggtattgtttcacgcccctttga

SEQ ID NO: 58522 - DNA, 35 bp, Artificial Sequence
  Synthetic oligonucleotide
taattgcccgcgccgaatccgcattgcccacacta

SEQ ID NO: 58523 - DNA, 36 bp, Artificial Sequence
  Synthetic oligonucleotide
ttccgaccgacaccaatcccgctgccgctcacccta

SEQ ID NO: 58524 - DNA, 35 bp, Artificial Sequence
  Synthetic oligonucleotide
gactccatctgccaaaggtatctagttcattgcta

SEQ ID NO: 58525 - DNA, 36 bp, Artificial Sequence
  Synthetic oligonucleotide
gttggtccactggcatatccagcttatgcatctcta

SEQ ID NO: 58526 - DNA, 36 bp, Artificial Sequence
  Synthetic oligonucleotide
gccactgtccggcggtcgccacctttcatgcaagta

SEQ ID NO: 58527 - DNA, 35 bp, Artificial Sequence
  Synthetic oligonucleotide
tacagcaccaatcgctccctggcgcctaattcgta

SEQ ID NO: 58528 - DNA, 35 bp, Artificial Sequence
  Synthetic oligonucleotide
tacacaccctgccaaggcatactcacgggcctgta

SEQ ID NO: 58529 - DNA, 35 bp, Artificial Sequence
  Synthetic oligonucleotide
accctgtccccaccccatgagactcgttgctctta

SEQ ID NO: 58530 - DNA, 36 bp, Artificial Sequence
  Synthetic oligonucleotide
gtactcacccgactccacataactgccttcgcttta

SEQ ID NO: 58531 - DNA, 35 bp, Artificial Sequence
  Synthetic oligonucleotide
gaaaccatgcactccgccgtgaggcatttaccaac

SEQ ID NO: 58532 - DNA, 35 bp, Artificial Sequence
  Synthetic oligonucleotide
acacatggtcccggccggagctgaccccatggaac

SEQ ID NO: 58533 - DNA, 35 bp, Artificial Sequence
  Synthetic oligonucleotide
tcccataacaatgctctatacagtcgccgtggtac

SEQ ID NO: 58534 - DNA, 35 bp, Artificial Sequence
  Synthetic oligonucleotide
tatcgagctacgccaacgccactactcgccattac

SEQ ID NO: 58535 - DNA, 35 bp, Artificial Sequence
  Synthetic oligonucleotide
tgccgccccgtcagcaccgccacttgaatacttac

SEQ ID NO: 58536 - DNA, 35 bp, Artificial Sequence
  Synthetic oligonucleotide
ttgaccgaacacaccagtatgcaaccgagcatacc

SEQ ID NO: 58537 - DNA, 34 bp, Artificial Sequence
  Synthetic oligonucleotide
tccaccccaggtccgctgtcttttggctctctgc

SEQ ID NO: 58538 - DNA, 35 bp, Artificial Sequence
  Synthetic oligonucleotide
taccaacgcaccgccgccccatgagctacactatc

SEQ ID NO: 58539 - DNA, 35 bp, Artificial Sequence
  Synthetic oligonucleotide
gtgagtcctccaccgttcagtttcccgctttagtc

SEQ ID NO: 58540 - DNA, 35 bp, Artificial Sequence
  Synthetic oligonucleotide
gagggggtgagggtactcaggcgaaagagtatttc

SEQ ID NO: 58541 - DNA, 35 bp, Artificial Sequence
  Synthetic oligonucleotide
ttgtccgaaggctttccccttttagcgtgccaacg

SEQ ID NO: 58542 - DNA, 35 bp, Artificial Sequence
  Synthetic oligonucleotide
gttacccatcctgaatttattaaaagacccaatcg

SEQ ID NO: 58543 - DNA, 35 bp, Artificial Sequence
  Synthetic oligonucleotide
tcgatggggggggtggagcaggtacgggagttagg

SEQ ID NO: 58544 - DNA, 35 bp, Artificial Sequence
  Synthetic oligonucleotide
taatagggaggaggggcagggggccgagcgagggg

SEQ ID NO: 58545 - DNA, 36 bp, Artificial Sequence
  Synthetic oligonucleotide
taacatcccccttctcgcaggcacatacgatctggg

SEQ ID NO: 58546 - DNA, 35 bp, Artificial Sequence
  Synthetic oligonucleotide
ttgaaggtggaggaggggtaggtgatggaggcttg

SEQ ID NO: 58547 - DNA, 35 bp, Artificial Sequence
  Synthetic oligonucleotide
tgtgttcacgtgaaagtcgccatcgccctctccat

SEQ ID NO: 58548 - DNA, 35 bp, Artificial Sequence
  Synthetic oligonucleotide
tgccaccttgacctatccgcttcccattgttcgat

SEQ ID NO: 58549 - DNA, 35 bp, Artificial Sequence
  Synthetic oligonucleotide
gtcgcttcacctcaacattacagctgctacttcct

SEQ ID NO: 58550 - DNA, 35 bp, Artificial Sequence
  Synthetic oligonucleotide
aaactcccgatccagccaatcacacggtcaccgct

SEQ ID NO: 58551 - DNA, 35 bp, Artificial Sequence
  Synthetic oligonucleotide
tgagtggggggtagggtctgacaatgcctcggagt

SEQ ID NO: 58552 - DNA, 35 bp, Artificial Sequence
  Synthetic oligonucleotide
ttccagggaggtgggatgttgttacctggaaaggt

SEQ ID NO: 58553 - DNA, 35 bp, Artificial Sequence
  Synthetic oligonucleotide
tcacctcaacgttgaactgcgtaggttctccctgt

SEQ ID NO: 58554 - DNA, 35 bp, Artificial Sequence
  Synthetic oligonucleotide
tctcaccaccgacagcgttacttctaacatattgt

SEQ ID NO: 58555 - DNA, 34 bp, Artificial Sequence
  Synthetic oligonucleotide
gaacgcccatccgctcttctcagactgccgttgt

SEQ ID NO: 58556 - DNA, 35 bp, Artificial Sequence
  Synthetic oligonucleotide
atgtgctgaaaaccggactggggccacaaaaaatt

SEQ ID NO: 58557 - DNA, 35 bp, Artificial Sequence
  Synthetic oligonucleotide
tcgatcggtcccgcactcttgtagaccaccgactt

SEQ ID NO: 58558 - DNA, 35 bp, Artificial Sequence
  Synthetic oligonucleotide
ggagccgattacagccgggtctcccagtcttcctt

SEQ ID NO: 58559 - DNA, 35 bp, Artificial Sequence
  Synthetic oligonucleotide
tccacctcggtgatgatccgttcctacttgagctt

SEQ ID NO: 58560 - DNA, 35 bp, Artificial Sequence
  Synthetic oligonucleotide
acaaggtggaggattgggtgaaaagggcggccgtt

SEQ ID NO: 58561 - DNA, 35 bp, Artificial Sequence
  Synthetic oligonucleotide
tcagcccacgtgttttcgtacacactactttgttt

SEQ ID NO: 58562 - DNA, 35 bp, Artificial Sequence
  Synthetic oligonucleotide
accaggagagggagttgggggtgcggtaagtcaaa

SEQ ID NO: 58563 - DNA, 36 bp, Artificial Sequence
  Synthetic oligonucleotide
gagttgaccgtaacgaatctgtctcctgtggcccaa

SEQ ID NO: 58564 - DNA, 36 bp, Artificial Sequence
  Synthetic oligonucleotide
gagtgcccaggcacgattccacgaaactgatagcaa

SEQ ID NO: 58565 - DNA, 35 bp, Artificial Sequence
  Synthetic oligonucleotide
tagagtgccgaacagcaagtaaaggtgagatgcaa

SEQ ID NO: 58566 - DNA, 37 bp, Artificial Sequence
  Synthetic oligonucleotide
gtgtccgttcgcagccagggacgatctcttctctcaa

SEQ ID NO: 58567 - DNA, 35 bp, Artificial Sequence
  Synthetic oligonucleotide
gtccaccctacttctggcgacgacctagtaccgaa

SEQ ID NO: 58568 - DNA, 35 bp, Artificial Sequence
  Synthetic oligonucleotide
tcaggtcgacgatcgctctctgctccactactgaa

SEQ ID NO: 58569 - DNA, 36 bp, Artificial Sequence
  Synthetic oligonucleotide
tccctgccacattctatctatcgagggctgtcctaa

SEQ ID NO: 58570 - DNA, 36 bp, Artificial Sequence
  Synthetic oligonucleotide
gtgtcgccggcactattcctcgtaagcccccataca

SEQ ID NO: 58571 - DNA, 36 bp, Artificial Sequence
  Synthetic oligonucleotide
gcgttcgtccacctgctcccctatcgtatggcccca

SEQ ID NO: 58572 - DNA, 36 bp, Artificial Sequence
  Synthetic oligonucleotide
ttgcgctcggtgttattccttttccgtgttgtgcca

SEQ ID NO: 58573 - DNA, 35 bp, Artificial Sequence
  Synthetic oligonucleotide
tatgacctaggcacacattagcaagtgcacttcca

SEQ ID NO: 58574 - DNA, 35 bp, Artificial Sequence
  Synthetic oligonucleotide
aaccccgaaccgccggtgatactcatctatgagca

SEQ ID NO: 58575 - DNA, 36 bp, Artificial Sequence
  Synthetic oligonucleotide
cctggcactcatgcttactactccctgccttgagca

SEQ ID NO: 58576 - DNA, 36 bp, Artificial Sequence
  Synthetic oligonucleotide
acacttgacgtatggtgccttaggaaacgcgaatca

SEQ ID NO: 58577 - DNA, 35 bp, Artificial Sequence
  Synthetic oligonucleotide
gagtggatgtgtagttgtcctctctttgcccctca

SEQ ID NO: 58578 - DNA, 36 bp, Artificial Sequence
  Synthetic oligonucleotide
gttgggaggggggatcgaggttcgcgctataattca

SEQ ID NO: 58579 - DNA, 37 bp, Artificial Sequence
  Synthetic oligonucleotide
tcagagagaggaggatcgggagcacggaggagtgaga

SEQ ID NO: 58580 - DNA, 36 bp, Artificial Sequence
  Synthetic oligonucleotide
tagtctcgcctgtctcacgtctacctgcttctacga

SEQ ID NO: 58581 - DNA, 37 bp, Artificial Sequence
  Synthetic oligonucleotide
atccagttcggcgccctcaaccccatcaatgtgccga

SEQ ID NO: 58582 - DNA, 37 bp, Artificial Sequence
  Synthetic oligonucleotide
gagaggggatgggaacattgagctgaggcccgggcga

SEQ ID NO: 58583 - DNA, 36 bp, Artificial Sequence
  Synthetic oligonucleotide
gatagattctcgggggggtggggcatgtgggtgcga

SEQ ID NO: 58584 - DNA, 36 bp, Artificial Sequence
  Synthetic oligonucleotide
accacggtctatcctccttgtaccactcgttatcga

SEQ ID NO: 58585 - DNA, 36 bp, Artificial Sequence
  Synthetic oligonucleotide
accgccttaccgctcgccccccaggcatgtactcga

SEQ ID NO: 58586 - DNA, 37 bp, Artificial Sequence
  Synthetic oligonucleotide
gaacgcccatcatctcacctgcgacctgccaattcga

SEQ ID NO: 58587 - DNA, 37 bp, Artificial Sequence
  Synthetic oligonucleotide
atttacacgaaggggggaaagggaaagggcacgcgga

SEQ ID NO: 58588 - DNA, 37 bp, Artificial Sequence
  Synthetic oligonucleotide
taaagcgggggccacgaaggggtgggcggacggcgga

SEQ ID NO: 58589 - DNA, 37 bp, Artificial Sequence
  Synthetic oligonucleotide
tatcgcgcgcactcccccagccaacttctactcggga

SEQ ID NO: 58590 - DNA, 37 bp, Artificial Sequence
  Synthetic oligonucleotide
gacgcgcccggtctcgtgcgtgccttttcttactgga

SEQ ID NO: 58591 - DNA, 37 bp, Artificial Sequence
  Synthetic oligonucleotide
cacgtgcatgaggtgcagatctgggaacgtcgctgga

SEQ ID NO: 58592 - DNA, 37 bp, Artificial Sequence
  Synthetic oligonucleotide
aacacacacaaggataggagggtctgattggagtgga

SEQ ID NO: 58593 - DNA, 37 bp, Artificial Sequence
  Synthetic oligonucleotide
tagtgaggatggcgcacgcggggggaggacatgtgga

SEQ ID NO: 58594 - DNA, 38 bp, Artificial Sequence
  Synthetic oligonucleotide
tccgcaagctcgtaccctagcaagcaccagcacaatga

SEQ ID NO: 58595 - DNA, 38 bp, Artificial Sequence
  Synthetic oligonucleotide
gctacctggcgggtcgggctggggaaggagggggatga

SEQ ID NO: 58596 - DNA, 38 bp, Artificial Sequence
  Synthetic oligonucleotide
gcaccagcctcgtcccagctcccatttttccacgctga

SEQ ID NO: 58597 - DNA, 38 bp, Artificial Sequence
  Synthetic oligonucleotide
gcacccggtggtgcgaattaaaggagggattacgctga

SEQ ID NO: 58598 - DNA, 38 bp, Artificial Sequence
  Synthetic oligonucleotide
actcaaccgcgaaccttggctacaaacctgcactctga

SEQ ID NO: 58599 - DNA, 37 bp, Artificial Sequence
  Synthetic oligonucleotide
gaccgcccaatccaataaaccgcggtaacacccgtga

SEQ ID NO: 58600 - DNA, 38 bp, Artificial Sequence
  Synthetic oligonucleotide
tgcgctgtattcccatccggctttagaccactccttga

SEQ ID NO: 58601 - DNA, 38 bp, Artificial Sequence
  Synthetic oligonucleotide
tccttcccaccgtggcctatttctggagtcaatcttga

SEQ ID NO: 58602 - DNA, 37 bp, Artificial Sequence
  Synthetic oligonucleotide
actcaggacgatatgcactttttggctccaccgttga

SEQ ID NO: 58603 - DNA, 38 bp, Artificial Sequence
  Synthetic oligonucleotide
gagcacgggatctgtcccgttgttgcctaaccctttga

SEQ ID NO: 58604 - DNA, 38 bp, Artificial Sequence
  Synthetic oligonucleotide
tgactcgtatcgagagtcatctgtgtttgtttttttga

SEQ ID NO: 58605 - DNA, 35 bp, Artificial Sequence
  Synthetic oligonucleotide
tttccgagcggtttctctgtttttgccacctgata

SEQ ID NO: 58606 - DNA, 36 bp, Artificial Sequence
  Synthetic oligonucleotide
tgcgaccccaccgcctatctctacctctacggtata

SEQ ID NO: 58607 - DNA, 35 bp, Artificial Sequence
  Synthetic oligonucleotide
tagcccctagccctaacttggattacccgttgcta

SEQ ID NO: 58608 - DNA, 36 bp, Artificial Sequence
  Synthetic oligonucleotide
tggacacctgcccacgggaaccgccctcgaactgta

SEQ ID NO: 58609 - DNA, 36 bp, Artificial Sequence
  Synthetic oligonucleotide
tttgccactcagcgaaccatcaattgacttgcttta

SEQ ID NO: 58610 - DNA, 35 bp, Artificial Sequence
  Synthetic oligonucleotide
gggtcgtactcgcccgcatatttgaaccgctaacc

SEQ ID NO: 58611 - DNA, 35 bp, Artificial Sequence
  Synthetic oligonucleotide
acccgagaagcgtggaggaaaaaggcgcgacgacc

SEQ ID NO: 58612 - DNA, 35 bp, Artificial Sequence
  Synthetic oligonucleotide
agggtagccctcgcctggtcgtcgtctttcttacc

SEQ ID NO: 58613 - DNA, 35 bp, Artificial Sequence
  Synthetic oligonucleotide
atagccaacaacggtcagtgtcctcacgtaccccc

SEQ ID NO: 58614 - DNA, 35 bp, Artificial Sequence
  Synthetic oligonucleotide
tattgcaccaatgatgtttttttggttgctccccc

SEQ ID NO: 58615 - DNA, 35 bp, Artificial Sequence
  Synthetic oligonucleotide
gtcgcccctccccgccactgagctatgtccgctcc

SEQ ID NO: 58616 - DNA, 35 bp, Artificial Sequence
  Synthetic oligonucleotide
tgctaaccggtctccggccatcggtccctgcccgc

SEQ ID NO: 58617 - DNA, 35 bp, Artificial Sequence
  Synthetic oligonucleotide
cacgccgcctattgccggctgagaccatcccgctc

SEQ ID NO: 58618 - DNA, 35 bp, Artificial Sequence
  Synthetic oligonucleotide
gtatcactcgccacagtccgtactcaaatttcttc

SEQ ID NO: 58619 - DNA, 35 bp, Artificial Sequence
  Synthetic oligonucleotide
accaccaccaacacgatcgctcatgatatcacaag

SEQ ID NO: 58620 - DNA, 35 bp, Artificial Sequence
  Synthetic oligonucleotide
ctcatgggaccatactgcactttccacgctccgag

SEQ ID NO: 58621 - DNA, 35 bp, Artificial Sequence
  Synthetic oligonucleotide
tgccaccctgtcgtgtctccggctgctttgtttag

SEQ ID NO: 58622 - DNA, 35 bp, Artificial Sequence
  Synthetic oligonucleotide
gactcctctacgcggttactttcctcttgtttacg

SEQ ID NO: 58623 - DNA, 35 bp, Artificial Sequence
  Synthetic oligonucleotide
atgcactcgcgctcctcttcgaagcgtaccacccg

SEQ ID NO: 58624 - DNA, 34 bp, Artificial Sequence
  Synthetic oligonucleotide
actctcagccttatccaccttcaaaatacgccgg

SEQ ID NO: 58625 - DNA, 35 bp, Artificial Sequence
  Synthetic oligonucleotide
accaacggctaactgaatattccactctcaacggg

SEQ ID NO: 58626 - DNA, 35 bp, Artificial Sequence
  Synthetic oligonucleotide
agtgtcctgctccaattcgtcgttaccattcactg

SEQ ID NO: 58627 - DNA, 35 bp, Artificial Sequence
  Synthetic oligonucleotide
gtttgcctgccgtgtgccgtcgtcacatcaccctg

SEQ ID NO: 58628 - DNA, 35 bp, Artificial Sequence
  Synthetic oligonucleotide
gaatagacgaaagagggtagcgggggactcggttg

SEQ ID NO: 58629 - DNA, 35 bp, Artificial Sequence
  Synthetic oligonucleotide
acgctcatttcaccctgcgcagaacactggctttg

SEQ ID NO: 58630 - DNA, 35 bp, Artificial Sequence
  Synthetic oligonucleotide
gcagagctcccgctatccctgttcgttaagccaat

SEQ ID NO: 58631 - DNA, 35 bp, Artificial Sequence
  Synthetic oligonucleotide
gacaaaccgcatgcccccagctggtcgttccccat

SEQ ID NO: 58632 - DNA, 35 bp, Artificial Sequence
  Synthetic oligonucleotide
agatacccccgtacaagggatcgacctttcttact

SEQ ID NO: 58633 - DNA, 32 bp, Artificial Sequence
  Synthetic oligonucleotide
actgtactagtcgcgcctttgtccctgtccct

SEQ ID NO: 58634 - DNA, 34 bp, Artificial Sequence
  Synthetic oligonucleotide
attgccaatgccgcgccctcaggtcttttatggt

SEQ ID NO: 58635 - DNA, 35 bp, Artificial Sequence
  Synthetic oligonucleotide
tactgcggagaactgcttacagcacccatgcaatt

SEQ ID NO: 58636 - DNA, 35 bp, Artificial Sequence
  Synthetic oligonucleotide
atccgcattccgacacacgttttggctaccgtatt

SEQ ID NO: 58637 - DNA, 35 bp, Artificial Sequence
  Synthetic oligonucleotide
gatatgcctgcagtcgagcccttataacgcccctt

SEQ ID NO: 58638 - DNA, 35 bp, Artificial Sequence
  Synthetic oligonucleotide
acacacattgaggtggtcatcctgttagtcctctt

SEQ ID NO: 58639 - DNA, 35 bp, Artificial Sequence
  Synthetic oligonucleotide
tgtccagctctttcgacttgcatcaccccagcttt

SEQ ID NO: 58640 - DNA, 35 bp, Artificial Sequence
  Synthetic oligonucleotide
ttacggcgccgagcagctacccgcgttctcctttt

SEQ ID NO: 58641 - DNA, 35 bp, Artificial Sequence
  Synthetic oligonucleotide
tagtaactccaccacggctccttattgacctgaaa

SEQ ID NO: 58642 - DNA, 36 bp, Artificial Sequence
  Synthetic oligonucleotide
atagggacggaaagaaataggagagaacgccgccaa

SEQ ID NO: 58643 - DNA, 35 bp, Artificial Sequence
  Synthetic oligonucleotide
tactcctcctggtgacctggctcagttttttgcaa

SEQ ID NO: 58644 - DNA, 36 bp, Artificial Sequence
  Synthetic oligonucleotide
aatgatccagcacatgctaccaggcacatcttaaca

SEQ ID NO: 58645 - DNA, 35 bp, Artificial Sequence
  Synthetic oligonucleotide
ttcgctgttcgggccatcatgttcctcacccacca

SEQ ID NO: 58646 - DNA, 35 bp, Artificial Sequence
  Synthetic oligonucleotide
gtacgcttaccctgcatcacccggtgattctacca

SEQ ID NO: 58647 - DNA, 36 bp, Artificial Sequence
  Synthetic oligonucleotide
aagtcacctcaccttttgctcctgataccggtgcca

SEQ ID NO: 58648 - DNA, 36 bp, Artificial Sequence
  Synthetic oligonucleotide
tgatctaaggggggcgggttacatggtgaggtggca

SEQ ID NO: 58649 - DNA, 36 bp, Artificial Sequence
  Synthetic oligonucleotide
gcagaccctatgtcgtgctttttcacaatcgcctca

SEQ ID NO: 58650 - DNA, 36 bp, Artificial Sequence
  Synthetic oligonucleotide
tgttgatcaggcgctggatggtcccctcttttctca

SEQ ID NO: 58651 - DNA, 37 bp, Artificial Sequence
  Synthetic oligonucleotide
gtcagatcacgtaatgtacctttccctgcccccccga

SEQ ID NO: 58652 - DNA, 35 bp, Artificial Sequence
  Synthetic oligonucleotide
tggtgtcctaccacagccccgcttcgttcccccga

SEQ ID NO: 58653 - DNA, 37 bp, Artificial Sequence
  Synthetic oligonucleotide
agcggaggccctgctagtctaccttacactttttcga

SEQ ID NO: 58654 - DNA, 36 bp, Artificial Sequence
  Synthetic oligonucleotide
gaaggggggacacggtgggctaacagaaagagagga

SEQ ID NO: 58655 - DNA, 36 bp, Artificial Sequence
  Synthetic oligonucleotide
atccacaggaagccgggccaaggagctcaagtagga

SEQ ID NO: 58656 - DNA, 37 bp, Artificial Sequence
  Synthetic oligonucleotide
gcccagcagaccacccttactagcagtctgatacgga

SEQ ID NO: 58657 - DNA, 37 bp, Artificial Sequence
  Synthetic oligonucleotide
atgaccggacgaagcgtgtgccaattactggtgcgga

SEQ ID NO: 58658 - DNA, 35 bp, Artificial Sequence
  Synthetic oligonucleotide
acagtgggtaaaggggaaaagggtcgactaaggga

SEQ ID NO: 58659 - DNA, 36 bp, Artificial Sequence
  Synthetic oligonucleotide
ataagcgtgcacggaaacggtgggggcgggcgggga

SEQ ID NO: 58660 - DNA, 37 bp, Artificial Sequence
  Synthetic oligonucleotide
tgggtacggggaagattcgtgggatgttgggtgggga

SEQ ID NO: 58661 - DNA, 36 bp, Artificial Sequence
  Synthetic oligonucleotide
tagttgcctccaccgctctatgtctacgttaagtga

SEQ ID NO: 58662 - DNA, 37 bp, Artificial Sequence
  Synthetic oligonucleotide
agccgggaagcagaaaaggaaaaacaagtatgagtga

SEQ ID NO: 58663 - DNA, 37 bp, Artificial Sequence
  Synthetic oligonucleotide
tacagggaagcgcgtagcggggggggactgctagtga

SEQ ID NO: 58664 - DNA, 36 bp, Artificial Sequence
  Synthetic oligonucleotide
acttcccctcgctctggccatatcctacgatcgtga

SEQ ID NO: 58665 - DNA, 38 bp, Artificial Sequence
  Synthetic oligonucleotide
tttgtccgaccttgcgatctgtactttgggttctgtga

SEQ ID NO: 58666 - DNA, 38 bp, Artificial Sequence
  Synthetic oligonucleotide
gacgtgtctggcccatatagcctctaactccccattga

SEQ ID NO: 58667 - DNA, 37 bp, Artificial Sequence
  Synthetic oligonucleotide
gaagggaggccggggggggatacgtcatttgacttga

SEQ ID NO: 58668 - DNA, 37 bp, Artificial Sequence
  Synthetic oligonucleotide
gcaccacaaactccaacaatgcattctgtcgccttga

SEQ ID NO: 58669 - DNA, 37 bp, Artificial Sequence
  Synthetic oligonucleotide
tgacacggagggtagtgaaaaggaatgtcacggttga

SEQ ID NO: 58670 - DNA, 38 bp, Artificial Sequence
  Synthetic oligonucleotide
gccagtggctgacttggcacgggtcgccttccttttga

SEQ ID NO: 58671 - DNA, 36 bp, Artificial Sequence
  Synthetic oligonucleotide
gtctgccttagcgctaccctcccacacttccccata

SEQ ID NO: 58672 - DNA, 36 bp, Artificial Sequence
  Synthetic oligonucleotide
gccaacccagccatggcgccaacgacccgaagccta

SEQ ID NO: 58673 - DNA, 36 bp, Artificial Sequence
  Synthetic oligonucleotide
gagacaccaacggcgggggcgggagtacgggaatta

SEQ ID NO: 58674 - DNA, 36 bp, Artificial Sequence
  Synthetic oligonucleotide
acaagaggtaggagagcgatgagaaagcaatagtta

SEQ ID NO: 58675 - DNA, 36 bp, Artificial Sequence
  Synthetic oligonucleotide
aagggccctccacgaccccgtataactttaacgtta

SEQ ID NO: 58676 - DNA, 36 bp, Artificial Sequence
  Synthetic oligonucleotide
tgatatccgcgccctaaatcgtgtccgctctcttta

SEQ ID NO: 58677 - DNA, 35 bp, Artificial Sequence
  Synthetic oligonucleotide
tgcgaagtccgttcaagcgcctcatcatcaccaac

SEQ ID NO: 58678 - DNA, 35 bp, Artificial Sequence
  Synthetic oligonucleotide
gccgtagggcgccctatcgctcagccataactcac

SEQ ID NO: 58679 - DNA, 35 bp, Artificial Sequence
  Synthetic oligonucleotide
tgtcctcgcatcctcctcagcgttctggcataacc

SEQ ID NO: 58680 - DNA, 35 bp, Artificial Sequence
  Synthetic oligonucleotide
tcccctacgttctactacctggccgttacttaccc

SEQ ID NO: 58681 - DNA, 35 bp, Artificial Sequence
  Synthetic oligonucleotide
acctttccccgcccgcgccccgcaatcggacgccc

SEQ ID NO: 58682 - DNA, 35 bp, Artificial Sequence
  Synthetic oligonucleotide
agcacccctcagttgtgttgtccgcgcaacttccc

SEQ ID NO: 58683 - DNA, 35 bp, Artificial Sequence
  Synthetic oligonucleotide
gcgggtcgcatataacatgtcattttcacgcctcc

SEQ ID NO: 58684 - DNA, 35 bp, Artificial Sequence
  Synthetic oligonucleotide
acctaattcggcccctccatggtgtcacccatagc

SEQ ID NO: 58685 - DNA, 35 bp, Artificial Sequence
  Synthetic oligonucleotide
accacattgagcagaggtagataccacttttccgc

SEQ ID NO: 58686 - DNA, 35 bp, Artificial Sequence
  Synthetic oligonucleotide
aactatctcccccggatcatgggaaccatgatgtc

SEQ ID NO: 58687 - DNA, 35 bp, Artificial Sequence
  Synthetic oligonucleotide
gaaaggctccagctcctttgctcactttcaccttc

SEQ ID NO: 58688 - DNA, 35 bp, Artificial Sequence
  Synthetic oligonucleotide
tagactgcgcaatggttcccgatgcgcctcgtttc

SEQ ID NO: 58689 - DNA, 35 bp, Artificial Sequence
  Synthetic oligonucleotide
gcgttacgttctatctgttctaggttcccctcaag

SEQ ID NO: 58690 - DNA, 35 bp, Artificial Sequence
  Synthetic oligonucleotide
gcccagtcgcatggaacgtaatggctcaacatccg

SEQ ID NO: 58691 - DNA, 35 bp, Artificial Sequence
  Synthetic oligonucleotide
tcactggcgcctttgatggctccgtcacattttcg

SEQ ID NO: 58692 - DNA, 35 bp, Artificial Sequence
  Synthetic oligonucleotide
acacccgagctagggtgatattctgtaacattctg

SEQ ID NO: 58693 - DNA, 35 bp, Artificial Sequence
  Synthetic oligonucleotide
gacattgatggcagtcgtttcgtacatttcctcat

SEQ ID NO: 58694 - DNA, 35 bp, Artificial Sequence
  Synthetic oligonucleotide
gacccccacctcagttgcttggccctagcccacct

SEQ ID NO: 58695 - DNA, 35 bp, Artificial Sequence
  Synthetic oligonucleotide
gcgccatggcttggacttgggcatattctttttct

SEQ ID NO: 58696 - DNA, 35 bp, Artificial Sequence
  Synthetic oligonucleotide
tgttgcaccgattgaccgcgccgcttccgtacatt

SEQ ID NO: 58697 - DNA, 35 bp, Artificial Sequence
  Synthetic oligonucleotide
actcgcctgacgaatcggcaccgcgctgtcgcctt

SEQ ID NO: 58698 - DNA, 35 bp, Artificial Sequence
  Synthetic oligonucleotide
ttatcacgcccgggcctatcagctcaaacaagctt

SEQ ID NO: 58699 - DNA, 36 bp, Artificial Sequence
  Synthetic oligonucleotide
gtgaacggaacgggaggcacgactctctctggggaa

SEQ ID NO: 58700 - DNA, 36 bp, Artificial Sequence
  Synthetic oligonucleotide
gccacccctgggtctcgtcgtcagatccccccgtaa

SEQ ID NO: 58701 - DNA, 36 bp, Artificial Sequence
  Synthetic oligonucleotide
agctccgactgactttaactttgcgaaccatcccca

SEQ ID NO: 58702 - DNA, 35 bp, Artificial Sequence
  Synthetic oligonucleotide
acgacgccactaggccgcgagacctcccctaagca

SEQ ID NO: 58703 - DNA, 36 bp, Artificial Sequence
  Synthetic oligonucleotide
ttggacctcccgtcagttgagctttccttacccgca

SEQ ID NO: 58704 - DNA, 36 bp, Artificial Sequence
  Synthetic oligonucleotide
tgtgccctgatgcgtcatttccgttcgctggttgca

SEQ ID NO: 58705 - DNA, 36 bp, Artificial Sequence
  Synthetic oligonucleotide
taaagagtcacccgcgaaacccgttcatgcctctca

SEQ ID NO: 58706 - DNA, 36 bp, Artificial Sequence
  Synthetic oligonucleotide
gagtcgctcacctgcacaagaaatacctccatgtca

SEQ ID NO: 58707 - DNA, 35 bp, Artificial Sequence
  Synthetic oligonucleotide
tgttccctcggtcctccttggtttgtagtgcttca

SEQ ID NO: 58708 - DNA, 35 bp, Artificial Sequence
  Synthetic oligonucleotide
tgcaacctgtacactgtcacgctacctgcttttca

SEQ ID NO: 58709 - DNA, 37 bp, Artificial Sequence
  Synthetic oligonucleotide
gaccgagaaaggtatgggtggtgagacgacagcgaga

SEQ ID NO: 58710 - DNA, 36 bp, Artificial Sequence
  Synthetic oligonucleotide
ttatctgtaccgcgcgcagtccccttcctccgacga

SEQ ID NO: 58711 - DNA, 37 bp, Artificial Sequence
  Synthetic oligonucleotide
gaagagacagggacaggtttgcttagatggggtacga

SEQ ID NO: 58712 - DNA, 36 bp, Artificial Sequence
  Synthetic oligonucleotide
aaccatgccatcgggatagcacctaagacgctccga

SEQ ID NO: 58713 - DNA, 37 bp, Artificial Sequence
  Synthetic oligonucleotide
actacacctgagtgaccctgatcagtcccatgtccga

SEQ ID NO: 58714 - DNA, 37 bp, Artificial Sequence
  Synthetic oligonucleotide
ggggggaggggagaggctggcaggctggcacatcgga

SEQ ID NO: 58715 - DNA, 36 bp, Artificial Sequence
  Synthetic oligonucleotide
gaagacagaacggctggaatggtgtgggtagcggga

SEQ ID NO: 58716 - DNA, 36 bp, Artificial Sequence
  Synthetic oligonucleotide
tcaccgccaaagtagtactccgccactttcttggga

SEQ ID NO: 58717 - DNA, 36 bp, Artificial Sequence
  Synthetic oligonucleotide
acgacgtaccatccgcaacatcgaatcgagcctgga

SEQ ID NO: 58718 - DNA, 37 bp, Artificial Sequence
  Synthetic oligonucleotide
tcacgtagcatgttcactctaccgttttttttctgga

SEQ ID NO: 58719 - DNA, 37 bp, Artificial Sequence
  Synthetic oligonucleotide
gtgagctggcccagggtggagataggtgatgattgga

SEQ ID NO: 58720 - DNA, 37 bp, Artificial Sequence
  Synthetic oligonucleotide
gctgctctagcgtactctccgaccgcctcctcaatga

SEQ ID NO: 58721 - DNA, 38 bp, Artificial Sequence
  Synthetic oligonucleotide
tgatgcccaatcccgtgtaacatctgccgtgtccatga

SEQ ID NO: 58722 - DNA, 38 bp, Artificial Sequence
  Synthetic oligonucleotide
ttgcgagtgaagggaagcgggtagggtgaaattcatga

SEQ ID NO: 58723 - DNA, 38 bp, Artificial Sequence
  Synthetic oligonucleotide
tccaccacaccctttgccgtactattttaggtcgatga

SEQ ID NO: 58724 - DNA, 38 bp, Artificial Sequence
  Synthetic oligonucleotide
ggagcaacctcatcttgtcttatcctatcgttgactga

SEQ ID NO: 58725 - DNA, 38 bp, Artificial Sequence
  Synthetic oligonucleotide
atcatacacccaggatgcttaaagcacctacttactga

SEQ ID NO: 58726 - DNA, 38 bp, Artificial Sequence
  Synthetic oligonucleotide
acaccgcagatgctcgtactctcatttagctttactga

SEQ ID NO: 58727 - DNA, 38 bp, Artificial Sequence
  Synthetic oligonucleotide
gccgtacgccgcattaatataacttgcaccgactctga

SEQ ID NO: 58728 - DNA, 37 bp, Artificial Sequence
  Synthetic oligonucleotide
tcattttgcccgccctctatcatcagagaacacgtga

SEQ ID NO: 58729 - DNA, 38 bp, Artificial Sequence
  Synthetic oligonucleotide
gagcacgccattcctgaaacctcgcctacattccgtga

SEQ ID NO: 58730 - DNA, 37 bp, Artificial Sequence
  Synthetic oligonucleotide
acactgccctaacactagcgtaaccggaccttcgtga

SEQ ID NO: 58731 - DNA, 38 bp, Artificial Sequence
  Synthetic oligonucleotide
atacaacgtccatacagaatagggggccgggggggtga

SEQ ID NO: 58732 - DNA, 36 bp, Artificial Sequence
  Synthetic oligonucleotide
tcatctcgacacctttgcttttgtacctagctgtga

SEQ ID NO: 58733 - DNA, 37 bp, Artificial Sequence
  Synthetic oligonucleotide
tactgggagggaatatgggaaaacggtgaggcattga

SEQ ID NO: 58734 - DNA, 36 bp, Artificial Sequence
  Synthetic oligonucleotide
gccgaaacgtcaactttcttccttcgttcgacttga

SEQ ID NO: 58735 - DNA, 38 bp, Artificial Sequence
  Synthetic oligonucleotide
accgctccattgcttctgcgctcgcttcctgtttttga

SEQ ID NO: 58736 - DNA, 38 bp, Artificial Sequence
  Synthetic oligonucleotide
tcccctcccacacgaagtctataattgaatttttttga

SEQ ID NO: 58737 - DNA, 36 bp, Artificial Sequence
  Synthetic oligonucleotide
tgcttgggaagcatggctcacacaccgatccccata

SEQ ID NO: 58738 - DNA, 36 bp, Artificial Sequence
  Synthetic oligonucleotide
tgaagaaggggcgatggaaggttgggcggctatata

SEQ ID NO: 58739 - DNA, 36 bp, Artificial Sequence
  Synthetic oligonucleotide
gactcgtagccgtgtgctctatacttgcttcctgta

SEQ ID NO: 58740 - DNA, 35 bp, Artificial Sequence
  Synthetic oligonucleotide
tagttgcctgccccccccggctcaattatacgtta

SEQ ID NO: 58741 - DNA, 35 bp, Artificial Sequence
  Synthetic oligonucleotide
gtgcactcgaacagccgcccctacccgccgtttta

SEQ ID NO: 58742 - DNA, 36 bp, Artificial Sequence
  Synthetic oligonucleotide
gccacgtcgctatcggactcctacccatgggaccac

SEQ ID NO: 58743 - DNA, 35 bp, Artificial Sequence
  Synthetic oligonucleotide
gactgcccactggacgcaggcctctacgtgagtac

SEQ ID NO: 58744 - DNA, 35 bp, Artificial Sequence
  Synthetic oligonucleotide
gttgaccccttattgtgatgcgttccgtaggaacc

SEQ ID NO: 58745 - DNA, 35 bp, Artificial Sequence
  Synthetic oligonucleotide
gctatgacccccagccaccttcgacgcccgagtcc

SEQ ID NO: 58746 - DNA, 35 bp, Artificial Sequence
  Synthetic oligonucleotide
tgtttgaaccgtgctcactctgccatcttttgtcc

SEQ ID NO: 58747 - DNA, 35 bp, Artificial Sequence
  Synthetic oligonucleotide
acacggtggagcaatcgtcgaccccagccctttcc

SEQ ID NO: 58748 - DNA, 35 bp, Artificial Sequence
  Synthetic oligonucleotide
gatacgaggccccccctttactacaaacgcgccgc

SEQ ID NO: 58749 - DNA, 35 bp, Artificial Sequence
  Synthetic oligonucleotide
tctgagtgcccaagatcaccaccaacgtacctggc

SEQ ID NO: 58750 - DNA, 35 bp, Artificial Sequence
  Synthetic oligonucleotide
tcatgaatcgacgtcacgcttatttggtgccatgc

SEQ ID NO: 58751 - DNA, 35 bp, Artificial Sequence
  Synthetic oligonucleotide
gttcattccatcgatggtcctatccgtcatgcatc

SEQ ID NO: 58752 - DNA, 35 bp, Artificial Sequence
  Synthetic oligonucleotide
agccctaccgctcccttagagtgatgcatcttctc

SEQ ID NO: 58753 - DNA, 35 bp, Artificial Sequence
  Synthetic oligonucleotide
gtctttccccgtccaaaccgttaggccaccggttc

SEQ ID NO: 58754 - DNA, 35 bp, Artificial Sequence
  Synthetic oligonucleotide
ttgaacacgcactggtatctgaacgatcgacgccg

SEQ ID NO: 58755 - DNA, 35 bp, Artificial Sequence
  Synthetic oligonucleotide
gcatgaatcgtcccctttccaccgcccgtccaagg

SEQ ID NO: 58756 - DNA, 35 bp, Artificial Sequence
  Synthetic oligonucleotide
tagcctcccctgccagattttacgtccccgcgagg

SEQ ID NO: 58757 - DNA, 35 bp, Artificial Sequence
  Synthetic oligonucleotide
tatacggatgatgggcatgtggggatgattgaggg

SEQ ID NO: 58758 - DNA, 35 bp, Artificial Sequence
  Synthetic oligonucleotide
tagacttccacacctatacctgcatgcatccctgg

SEQ ID NO: 58759 - DNA, 35 bp, Artificial Sequence
  Synthetic oligonucleotide
gagcatgtcacgtcaccccattcaaatcatcctgg

SEQ ID NO: 58760 - DNA, 35 bp, Artificial Sequence
  Synthetic oligonucleotide
atcctgacagcgaaattacttgtcactcatgcgtg

SEQ ID NO: 58761 - DNA, 35 bp, Artificial Sequence
  Synthetic oligonucleotide
acctccccaccattcgctctatcgacacgtgattg

SEQ ID NO: 58762 - DNA, 35 bp, Artificial Sequence
  Synthetic oligonucleotide
acctctccccgttcacccgccttggtatttcaact

SEQ ID NO: 58763 - DNA, 35 bp, Artificial Sequence
  Synthetic oligonucleotide
tgaaggcggggaaccaatcgtgggggcggggtgct

SEQ ID NO: 58764 - DNA, 35 bp, Artificial Sequence
  Synthetic oligonucleotide
agggacgtggaggaaagggggtaagtacaacaatt

SEQ ID NO: 58765 - DNA, 35 bp, Artificial Sequence
  Synthetic oligonucleotide
aaccagcgcccaagtgcctacctgcttttgccttt

SEQ ID NO: 58766 - DNA, 36 bp, Artificial Sequence
  Synthetic oligonucleotide
tccccaatgtggcaaatcgcaatttagctgccccaa

SEQ ID NO: 58767 - DNA, 36 bp, Artificial Sequence
  Synthetic oligonucleotide
acctgagcgaggtgacgggtggtggcatggatcgaa

SEQ ID NO: 58768 - DNA, 36 bp, Artificial Sequence
  Synthetic oligonucleotide
gtgcgaccgataggaatgaggggcgcacgtacataa

SEQ ID NO: 58769 - DNA, 36 bp, Artificial Sequence
  Synthetic oligonucleotide
tcacgaacttcgctcatgcctgctgtaacttatcca

SEQ ID NO: 58770 - DNA, 35 bp, Artificial Sequence
  Synthetic oligonucleotide
atggtgaccaagcgttacggcccatctacatgtca

SEQ ID NO: 58771 - DNA, 35 bp, Artificial Sequence
  Synthetic oligonucleotide
ttgtcgacgcacgggcctttttgccgctgccttca

SEQ ID NO: 58772 - DNA, 35 bp, Artificial Sequence
  Synthetic oligonucleotide
tctatgcccgccttacgcaatttactgttatttca

SEQ ID NO: 58773 - DNA, 37 bp, Artificial Sequence
  Synthetic oligonucleotide
ttaggggggggagtgctaggggattagcaggtaaaga

SEQ ID NO: 58774 - DNA, 37 bp, Artificial Sequence
  Synthetic oligonucleotide
ttcaccgagcgaaaggacaatggagagggagggaaga

SEQ ID NO: 58775 - DNA, 37 bp, Artificial Sequence
  Synthetic oligonucleotide
taacacgggtgagtaaggggggaggatatttggacga

SEQ ID NO: 58776 - DNA, 37 bp, Artificial Sequence
  Synthetic oligonucleotide
gacccctgttccacagtgatgaccacattccgcccga

SEQ ID NO: 58777 - DNA, 36 bp, Artificial Sequence
  Synthetic oligonucleotide
accccggtagtgctaccttcgttccgcctctcgcga

SEQ ID NO: 58778 - DNA, 37 bp, Artificial Sequence
  Synthetic oligonucleotide
tcctaccgcacgctgttactccccgcattcccggcga

SEQ ID NO: 58779 - DNA, 37 bp, Artificial Sequence
  Synthetic oligonucleotide
tactcctctgcccctccctcagcccttcagtccagga

SEQ ID NO: 58780 - DNA, 37 bp, Artificial Sequence
  Synthetic oligonucleotide
actctccatgccgctggattttttcgtcccttccgga

SEQ ID NO: 58781 - DNA, 36 bp, Artificial Sequence
  Synthetic oligonucleotide
gtatgaagggcaaagggtggagacgaaggaggcgga

SEQ ID NO: 58782 - DNA, 37 bp, Artificial Sequence
  Synthetic oligonucleotide
gcacgcatgagcatgaatgaaggagggcatgttcgga

SEQ ID NO: 58783 - DNA, 37 bp, Artificial Sequence
  Synthetic oligonucleotide
tgtgaaacggtacatggggaggggtatgcgtaaggga

SEQ ID NO: 58784 - DNA, 37 bp, Artificial Sequence
  Synthetic oligonucleotide
tcagcacaactccggttagctttacgatccctaggga

SEQ ID NO: 58785 - DNA, 37 bp, Artificial Sequence
  Synthetic oligonucleotide
taactgggaggaacgggcggttcggggagagggggga

SEQ ID NO: 58786 - DNA, 36 bp, Artificial Sequence
  Synthetic oligonucleotide
tagggcacttgcgggaacatggagtatcggggggga

SEQ ID NO: 58787 - DNA, 37 bp, Artificial Sequence
  Synthetic oligonucleotide
taagccaaacatgacgggactcgtcgggtggggggga

SEQ ID NO: 58788 - DNA, 37 bp, Artificial Sequence
  Synthetic oligonucleotide
gggacatgacccgttttctcaccgtgccctcttggga

SEQ ID NO: 58789 - DNA, 37 bp, Artificial Sequence
  Synthetic oligonucleotide
gtggcccggccaccaccgcactcgccttcttttggga

SEQ ID NO: 58790 - DNA, 37 bp, Artificial Sequence
  Synthetic oligonucleotide
acacttacccagggcaccttcgaacgtccgtcatgga

SEQ ID NO: 58791 - DNA, 37 bp, Artificial Sequence
  Synthetic oligonucleotide
attggggcaagtcaaccggtgggcagggtggggtgga

SEQ ID NO: 58792 - DNA, 38 bp, Artificial Sequence
  Synthetic oligonucleotide
gggacgtggggggcggtgtggggggcactggttgatga

SEQ ID NO: 58793 - DNA, 38 bp, Artificial Sequence
  Synthetic oligonucleotide
tagaccacctggcccttaatgtctccacgggagactga

SEQ ID NO: 58794 - DNA, 37 bp, Artificial Sequence
  Synthetic oligonucleotide
gattaatccgacacctcccgcaccgttacaagcctga

SEQ ID NO: 58795 - DNA, 38 bp, Artificial Sequence
  Synthetic oligonucleotide
gaatcccccccccgatgcctttttgtagtctatgctga

SEQ ID NO: 58796 - DNA, 38 bp, Artificial Sequence
  Synthetic oligonucleotide
aacgaagctggtgggcgaaaatgaggggtgatgtctga

SEQ ID NO: 58797 - DNA, 38 bp, Artificial Sequence
  Synthetic oligonucleotide
aagtagccctcccatcatcccacctccccgtttggtga

SEQ ID NO: 58798 - DNA, 37 bp, Artificial Sequence
  Synthetic oligonucleotide
gacgcctctccggccctgacatcgccgaacggcttga

SEQ ID NO: 58799 - DNA, 37 bp, Artificial Sequence
  Synthetic oligonucleotide
gatgtggaggaggaatgagtagtgaggagccagttga

SEQ ID NO: 58800 - DNA, 37 bp, Artificial Sequence
  Synthetic oligonucleotide
ggggggggacggggggagagaggggcgacgaggttga

SEQ ID NO: 58801 - DNA, 38 bp, Artificial Sequence
  Synthetic oligonucleotide
ttgtccacgtgcaatccgtccgacttcctctctgttga

SEQ ID NO: 58802 - DNA, 38 bp, Artificial Sequence
  Synthetic oligonucleotide
gccacaccacggcggcctacctatgcgaattctgttga

SEQ ID NO: 58803 - DNA, 36 bp, Artificial Sequence
  Synthetic oligonucleotide
ttgcgccccgccgctaattgctccacttagacgata

SEQ ID NO: 58804 - DNA, 36 bp, Artificial Sequence
  Synthetic oligonucleotide
gcactcacacctttcttttccgggtctcccgtggta

SEQ ID NO: 58805 - DNA, 35 bp, Artificial Sequence
  Synthetic oligonucleotide
tcaccgcactccacactcgggttatcctccgtgta

SEQ ID NO: 58806 - DNA, 35 bp, Artificial Sequence
  Synthetic oligonucleotide
taccttcacccccatgcgatgctctgcattcgaac

SEQ ID NO: 58807 - DNA, 35 bp, Artificial Sequence
  Synthetic oligonucleotide
actgatcgtaatgcctcggttcgcttgaccttcac

SEQ ID NO: 58808 - DNA, 35 bp, Artificial Sequence
  Synthetic oligonucleotide
gtctctacaagggggcaagtggggaaggggtgacc

SEQ ID NO: 58809 - DNA, 35 bp, Artificial Sequence
  Synthetic oligonucleotide
gttcgcctcctttcaaactttggcattggacttcc

SEQ ID NO: 58810 - DNA, 35 bp, Artificial Sequence
  Synthetic oligonucleotide
gttacattcacacctacagacggcaccctatacgc

SEQ ID NO: 58811 - DNA, 35 bp, Artificial Sequence
  Synthetic oligonucleotide
actcgcccagggggccttctgcggttcctacccgc

SEQ ID NO: 58812 - DNA, 35 bp, Artificial Sequence
  Synthetic oligonucleotide
tcacaccgcggaagggacggatcatcccagtttgc

SEQ ID NO: 58813 - DNA, 35 bp, Artificial Sequence
  Synthetic oligonucleotide
agtaccccttccgatcttttgcatctgactagatc

SEQ ID NO: 58814 - DNA, 35 bp, Artificial Sequence
  Synthetic oligonucleotide
actatcacgtccttcgattattggttcgcgccctc

SEQ ID NO: 58815 - DNA, 35 bp, Artificial Sequence
  Synthetic oligonucleotide
tcagtctatcgctgcccttgagattcttcgatctc

SEQ ID NO: 58816 - DNA, 35 bp, Artificial Sequence
  Synthetic oligonucleotide
attagcacccccgccgtggctctagcctcttagtc

SEQ ID NO: 58817 - DNA, 35 bp, Artificial Sequence
  Synthetic oligonucleotide
tttagtgaccatcctcgacatcgccctgtaaattc

SEQ ID NO: 58818 - DNA, 35 bp, Artificial Sequence
  Synthetic oligonucleotide
tcccattttccgtgcgcgctatcgagcctcgcttc

SEQ ID NO: 58819 - DNA, 35 bp, Artificial Sequence
  Synthetic oligonucleotide
tcgtttcgcccccaacccacgtccggcgcactttc

SEQ ID NO: 58820 - DNA, 35 bp, Artificial Sequence
  Synthetic oligonucleotide
tgatcaaacccggtacgtttcaacaacgtcctttc

SEQ ID NO: 58821 - DNA, 35 bp, Artificial Sequence
  Synthetic oligonucleotide
acccgtcaccaccgatccgtggcatgctactccag

SEQ ID NO: 58822 - DNA, 35 bp, Artificial Sequence
  Synthetic oligonucleotide
agaggggaaggtgttatgtatgtattgtggagcag

SEQ ID NO: 58823 - DNA, 35 bp, Artificial Sequence
  Synthetic oligonucleotide
aaccactcgaccccaaatgtacgtttcagacttcg

SEQ ID NO: 58824 - DNA, 35 bp, Artificial Sequence
  Synthetic oligonucleotide
gcgacccctcccacacccgttacatcaactgttcg

SEQ ID NO: 58825 - DNA, 35 bp, Artificial Sequence
  Synthetic oligonucleotide
agaataggggcgggcgatgggggggtagaaagagg

SEQ ID NO: 58826 - DNA, 35 bp, Artificial Sequence
  Synthetic oligonucleotide
gcaaagtcaaatctgcaaagggagggatggtgcgg

SEQ ID NO: 58827 - DNA, 35 bp, Artificial Sequence
  Synthetic oligonucleotide
gctcatgtgggggttggggcttaccaggcagaggg

SEQ ID NO: 58828 - DNA, 35 bp, Artificial Sequence
  Synthetic oligonucleotide
gaccagcattcatgggaggtgtgggtcaaactggg

SEQ ID NO: 58829 - DNA, 35 bp, Artificial Sequence
  Synthetic oligonucleotide
tctccacgaaaggtccctctgcattcccccattgg

SEQ ID NO: 58830 - DNA, 35 bp, Artificial Sequence
  Synthetic oligonucleotide
ggtgatcaccgtcgccctcttctctaatcttgctg

SEQ ID NO: 58831 - DNA, 35 bp, Artificial Sequence
  Synthetic oligonucleotide
tgttccccagatctccacccctcacgctgctggat

SEQ ID NO: 58832 - DNA, 35 bp, Artificial Sequence
  Synthetic oligonucleotide
aagagtggagggtgggtgactgacgagaaggttat

SEQ ID NO: 58833 - DNA, 35 bp, Artificial Sequence
  Synthetic oligonucleotide
tgtctcatccactccttccgtctcgtactcagact

SEQ ID NO: 58834 - DNA, 35 bp, Artificial Sequence
  Synthetic oligonucleotide
gtacacaggtggaataaacggaggatcggcggact

SEQ ID NO: 58835 - DNA, 35 bp, Artificial Sequence
  Synthetic oligonucleotide
tccgcgcctgcacccactcatcgctccatcggcct

SEQ ID NO: 58836 - DNA, 35 bp, Artificial Sequence
  Synthetic oligonucleotide
tcagcaccgagcggaacactacggcctcccacgct

SEQ ID NO: 58837 - DNA, 35 bp, Artificial Sequence
  Synthetic oligonucleotide
attcgcggcccctttatcctgtccgatacccttct

SEQ ID NO: 58838 - DNA, 35 bp, Artificial Sequence
  Synthetic oligonucleotide
acgtgctcgtccaggaaggggagggttgggccggt

SEQ ID NO: 58839 - DNA, 35 bp, Artificial Sequence
  Synthetic oligonucleotide
gtcgtaggaggtattatcgctgcctcaccttttgt

SEQ ID NO: 58840 - DNA, 35 bp, Artificial Sequence
  Synthetic oligonucleotide
tgagcccacagtgttcggtcttttcgcatgaagtt

SEQ ID NO: 58841 - DNA, 35 bp, Artificial Sequence
  Synthetic oligonucleotide
gatcatctgcaaatctgtttcctacaaggtccaaa

SEQ ID NO: 58842 - DNA, 36 bp, Artificial Sequence
  Synthetic oligonucleotide
tagctcaggaaatccaggggggtgtggaataggaaa

SEQ ID NO: 58843 - DNA, 35 bp, Artificial Sequence
  Synthetic oligonucleotide
gtcgtaccatgcgaccagccatcgccatgaaccaa

SEQ ID NO: 58844 - DNA, 36 bp, Artificial Sequence
  Synthetic oligonucleotide
gttcatgaaatgcaagggaaaagggcggatgaccaa

SEQ ID NO: 58845 - DNA, 36 bp, Artificial Sequence
  Synthetic oligonucleotide
acacagccgacgaagtcattgcgcctgcctttccaa

SEQ ID NO: 58846 - DNA, 35 bp, Artificial Sequence
  Synthetic oligonucleotide
tgccatactccatcccacaagcgctggcaccataa

SEQ ID NO: 58847 - DNA, 35 bp, Artificial Sequence
  Synthetic oligonucleotide
gattggcgaaggggagcggtggttgtaggcgataa

SEQ ID NO: 58848 - DNA, 36 bp, Artificial Sequence
  Synthetic oligonucleotide
actcagaacgtctcgctctcgttatcacgcttttaa

SEQ ID NO: 58849 - DNA, 35 bp, Artificial Sequence
  Synthetic oligonucleotide
acgttcctgctccgtgtccccgccaatcttgaaca

SEQ ID NO: 58850 - DNA, 36 bp, Artificial Sequence
  Synthetic oligonucleotide
tcatgtacgccctctgatccccggctctcttgaaca

SEQ ID NO: 58851 - DNA, 36 bp, Artificial Sequence
  Synthetic oligonucleotide
ggccactgtccgacgcttgcatttccctaccacaca

SEQ ID NO: 58852 - DNA, 35 bp, Artificial Sequence
  Synthetic oligonucleotide
cccatgacactccgcctcgcactgtgggaaaccca

SEQ ID NO: 58853 - DNA, 35 bp, Artificial Sequence
  Synthetic oligonucleotide
gtatccatccgtgccaactacctttcctattgcca

SEQ ID NO: 58854 - DNA, 36 bp, Artificial Sequence
  Synthetic oligonucleotide
ttagctgacgcctgccttcaaatctcgtggtctcca

SEQ ID NO: 58855 - DNA, 36 bp, Artificial Sequence
  Synthetic oligonucleotide
gtgggcacaggttcggtaccgcgcttttcccgtcca

SEQ ID NO: 58856 - DNA, 35 bp, Artificial Sequence
  Synthetic oligonucleotide
gcccccattccgctggctttcattcgaagcatgca

SEQ ID NO: 58857 - DNA, 36 bp, Artificial Sequence
  Synthetic oligonucleotide
atcgagacaaggattgatggagcatagactggtgca

SEQ ID NO: 58858 - DNA, 36 bp, Artificial Sequence
  Synthetic oligonucleotide
tccttccaccgtagggcttagtaggcccgttactca

SEQ ID NO: 58859 - DNA, 35 bp, Artificial Sequence
  Synthetic oligonucleotide
gccgatgtgctctaaattttaccccgctgttgtca

SEQ ID NO: 58860 - DNA, 36 bp, Artificial Sequence
  Synthetic oligonucleotide
tcactacggcaattcgctagtacctggtcccattca

SEQ ID NO: 58861 - DNA, 37 bp, Artificial Sequence
  Synthetic oligonucleotide
agttgcaatccgccaccatgtcactttctatggaaga

SEQ ID NO: 58862 - DNA, 37 bp, Artificial Sequence
  Synthetic oligonucleotide
ttgggagagaaggccgagtgtatgacgcggtgggaga

SEQ ID NO: 58863 - DNA, 37 bp, Artificial Sequence
  Synthetic oligonucleotide
tgcccaccctctggtccacgcgaatcctcatgttcga

SEQ ID NO: 58864 - DNA, 37 bp, Artificial Sequence
  Synthetic oligonucleotide
aacacttgtgagtcgaggggaagggagggagtaagga

SEQ ID NO: 58865 - DNA, 37 bp, Artificial Sequence
  Synthetic oligonucleotide
gtcccagggcgggaaggtgcatagctgaggaagagga

SEQ ID NO: 58866 - DNA, 36 bp, Artificial Sequence
  Synthetic oligonucleotide
gtccaacataaactcctccatcacgagacggtagga

SEQ ID NO: 58867 - DNA, 37 bp, Artificial Sequence
  Synthetic oligonucleotide
gaggaggaatagaagaatggattgatagggagccgga

SEQ ID NO: 58868 - DNA, 37 bp, Artificial Sequence
  Synthetic oligonucleotide
ggggcggggattgtctcatgtttggtaaggggaggga

SEQ ID NO: 58869 - DNA, 37 bp, Artificial Sequence
  Synthetic oligonucleotide
agtggtcgggaggtgtagattgcgggggtggatggga

SEQ ID NO: 58870 - DNA, 38 bp, Artificial Sequence
  Synthetic oligonucleotide
ggacacttgactcacctttagacactgccgtttaatga

SEQ ID NO: 58871 - DNA, 38 bp, Artificial Sequence
  Synthetic oligonucleotide
accaccatcacttaaagaggaatgacaatgggtcatga

SEQ ID NO: 58872 - DNA, 38 bp, Artificial Sequence
  Synthetic oligonucleotide
gtggactggtgcccgttgccttaccacgactgtactga

SEQ ID NO: 58873 - DNA, 38 bp, Artificial Sequence
  Synthetic oligonucleotide
ttgggagcgaccagcctagcaaacacttccacacctga

SEQ ID NO: 58874 - DNA, 38 bp, Artificial Sequence
  Synthetic oligonucleotide
acctgagcacaaacgtggcgaacagaacccccacctga

SEQ ID NO: 58875 - DNA, 38 bp, Artificial Sequence
  Synthetic oligonucleotide
gcagggggggggagtggggcacagcacttcggtgctga

SEQ ID NO: 58876 - DNA, 38 bp, Artificial Sequence
  Synthetic oligonucleotide
attttcccccaccgcagtccttaacccagtccctctga

SEQ ID NO: 58877 - DNA, 38 bp, Artificial Sequence
  Synthetic oligonucleotide
agcaccactgttacgctctactggtcctttttctctga

SEQ ID NO: 58878 - DNA, 38 bp, Artificial Sequence
  Synthetic oligonucleotide
aagaaacataggggatgggccaggacacaggtacgtga

SEQ ID NO: 58879 - DNA, 37 bp, Artificial Sequence
  Synthetic oligonucleotide
acacacggtcagtggtcttttccgcccttgatcgtga

SEQ ID NO: 58880 - DNA, 38 bp, Artificial Sequence
  Synthetic oligonucleotide
gacatcatctcgtacttccgcatcgcaccaccctgtga

SEQ ID NO: 58881 - DNA, 37 bp, Artificial Sequence
  Synthetic oligonucleotide
gttcgctaccctgcatccaccgttcacacttcgttga

SEQ ID NO: 58882 - DNA, 35 bp, Artificial Sequence
  Synthetic oligonucleotide
tttcgtagcggcacgcttttttcctggttgatcac

SEQ ID NO: 58883 - DNA, 35 bp, Artificial Sequence
  Synthetic oligonucleotide
gacgagtgtcacgtgccgtacccgcacttctatac

SEQ ID NO: 58884 - DNA, 35 bp, Artificial Sequence
  Synthetic oligonucleotide
tcatccctacatggtccaagatccccaacacctac

SEQ ID NO: 58885 - DNA, 35 bp, Artificial Sequence
  Synthetic oligonucleotide
tgcccctgagacctcgccgaggttcacgatttacc

SEQ ID NO: 58886 - DNA, 35 bp, Artificial Sequence
  Synthetic oligonucleotide
acaccgcgttctcctcttatgaggcatacatgccc

SEQ ID NO: 58887 - DNA, 35 bp, Artificial Sequence
  Synthetic oligonucleotide
atgtagcccgtgacctctcaatgtcctgccaggcc

SEQ ID NO: 58888 - DNA, 35 bp, Artificial Sequence
  Synthetic oligonucleotide
gcgcgacgccccgtatctcgtcgtagcattaatcc

SEQ ID NO: 58889 - DNA, 35 bp, Artificial Sequence
  Synthetic oligonucleotide
gattggcaccactacttctgcgggtgtactcctcc

SEQ ID NO: 58890 - DNA, 35 bp, Artificial Sequence
  Synthetic oligonucleotide
agcgaatcgctcggattcttcgttttatcctgtcc

SEQ ID NO: 58891 - DNA, 34 bp, Artificial Sequence
  Synthetic oligonucleotide
gggtgttgcccatgtctttcacagaactacttcc

SEQ ID NO: 58892 - DNA, 35 bp, Artificial Sequence
  Synthetic oligonucleotide
gggggaggggcgtagtccgaataaggggtgggagc

SEQ ID NO: 58893 - DNA, 35 bp, Artificial Sequence
  Synthetic oligonucleotide
atccactatgacagtctcgttccgaccgactactc

SEQ ID NO: 58894 - DNA, 35 bp, Artificial Sequence
  Synthetic oligonucleotide
gcctatcgtgcctaagtgtataccttcataccttc

SEQ ID NO: 58895 - DNA, 35 bp, Artificial Sequence
  Synthetic oligonucleotide
aacgaccgccactcgaggagaacagtcagcccttc

SEQ ID NO: 58896 - DNA, 35 bp, Artificial Sequence
  Synthetic oligonucleotide
tgataggtcatcgcacattgaatcggttgattttc

SEQ ID NO: 58897 - DNA, 36 bp, Artificial Sequence
  Synthetic oligonucleotide
gttgagctggcggtgtgaagggctgtgaaggaatgg

SEQ ID NO: 58898 - DNA, 35 bp, Artificial Sequence
  Synthetic oligonucleotide
gaccaagctcatcaggggaagaagggggggccatg

SEQ ID NO: 58899 - DNA, 35 bp, Artificial Sequence
  Synthetic oligonucleotide
gacacccacttagacattcgtctcggaacaccttg

SEQ ID NO: 58900 - DNA, 35 bp, Artificial Sequence
  Synthetic oligonucleotide
gagagctgcagacctcgggcctttgacaatcatct

SEQ ID NO: 58901 - DNA, 35 bp, Artificial Sequence
  Synthetic oligonucleotide
tcttcccctggtggcctctatctgccctgttacgt

SEQ ID NO: 58902 - DNA, 35 bp, Artificial Sequence
  Synthetic oligonucleotide
tgatgtgttaacatagtcctagctcccggaaactt

SEQ ID NO: 58903 - DNA, 35 bp, Artificial Sequence
  Synthetic oligonucleotide
ataccacccgtatatcacagacccccggtggcctt

SEQ ID NO: 58904 - DNA, 35 bp, Artificial Sequence
  Synthetic oligonucleotide
tctgtggtggtgggccgccgttctcccgctaattt

SEQ ID NO: 58905 - DNA, 35 bp, Artificial Sequence
  Synthetic oligonucleotide
aacgatgtgtgggggggcgatgggattaggcgttt

SEQ ID NO: 58906 - DNA, 36 bp, Artificial Sequence
  Synthetic oligonucleotide
acatcagtccccatcgtctctcgggacgtctaccaa

SEQ ID NO: 58907 - DNA, 35 bp, Artificial Sequence
  Synthetic oligonucleotide
acacgcaagcgattcctcgggccatgccgccccaa

SEQ ID NO: 58908 - DNA, 35 bp, Artificial Sequence
  Synthetic oligonucleotide
tgttgggggaaaaggtaaggggaaagaccggtgaa

SEQ ID NO: 58909 - DNA, 36 bp, Artificial Sequence
  Synthetic oligonucleotide
gtcgcccccccccagttgtcacagcgattgtgttaa

SEQ ID NO: 58910 - DNA, 36 bp, Artificial Sequence
  Synthetic oligonucleotide
attggtgcgacggcctggaaatcgctcctgtcaaca

SEQ ID NO: 58911 - DNA, 35 bp, Artificial Sequence
  Synthetic oligonucleotide
aaccgacctagctgctccaaggctcccattacaca

SEQ ID NO: 58912 - DNA, 35 bp, Artificial Sequence
  Synthetic oligonucleotide
tgcactccaactgcgcaataagggggagaaagcca

SEQ ID NO: 58913 - DNA, 36 bp, Artificial Sequence
  Synthetic oligonucleotide
atgctccaaactgaaaacacagacaccgctcggcca

SEQ ID NO: 58914 - DNA, 36 bp, Artificial Sequence
  Synthetic oligonucleotide
gataccctgctgccgtacctttgacctcagactcca

SEQ ID NO: 58915 - DNA, 36 bp, Artificial Sequence
  Synthetic oligonucleotide
tccatgcgccctgttttttccatttcgtatcaagca

SEQ ID NO: 58916 - DNA, 36 bp, Artificial Sequence
  Synthetic oligonucleotide
gaccaacactcgcatcagttcatccatgccgacgca

SEQ ID NO: 58917 - DNA, 36 bp, Artificial Sequence
  Synthetic oligonucleotide
gatatctgcgcaaatctcctaagaacctcattcgca

SEQ ID NO: 58918 - DNA, 36 bp, Artificial Sequence
  Synthetic oligonucleotide
tacgacgacctatccccgaaacttgagtttctctca

SEQ ID NO: 58919 - DNA, 36 bp, Artificial Sequence
  Synthetic oligonucleotide
ttcagcgcacgaccacgtccttttgtgctgttctca

SEQ ID NO: 58920 - DNA, 37 bp, Artificial Sequence
  Synthetic oligonucleotide
ttgatccgactccttgcttattacttgtctgactaga

SEQ ID NO: 58921 - DNA, 36 bp, Artificial Sequence
  Synthetic oligonucleotide
aacccttccatcgcacattctggttgacctcttaga

SEQ ID NO: 58922 - DNA, 37 bp, Artificial Sequence
  Synthetic oligonucleotide
gtgacacacggactacgtgtactcggtacaataccga

SEQ ID NO: 58923 - DNA, 37 bp, Artificial Sequence
  Synthetic oligonucleotide
acacctcctcgtaatttgccctctgcttctgagccga

SEQ ID NO: 58924 - DNA, 37 bp, Artificial Sequence
  Synthetic oligonucleotide
gcgagccgaactcagtcagtctattggcccactccga

SEQ ID NO: 58925 - DNA, 37 bp, Artificial Sequence
  Synthetic oligonucleotide
gatgccccctaaccgaacattcgcctgttatgttcga

SEQ ID NO: 58926 - DNA, 37 bp, Artificial Sequence
  Synthetic oligonucleotide
tccaacgagcctcattatctactgctgatctaccgga

SEQ ID NO: 58927 - DNA, 37 bp, Artificial Sequence
  Synthetic oligonucleotide
gacgcaaaagcggcgttttgggagggaaaacgatgga

SEQ ID NO: 58928 - DNA, 35 bp, Artificial Sequence
  Synthetic oligonucleotide
gagtaggatacacaagttggggggaaagtgatgga

SEQ ID NO: 58929 - DNA, 37 bp, Artificial Sequence
  Synthetic oligonucleotide
tccgtgtgtagtgtggcggaaaaaaatgcggtgtgga

SEQ ID NO: 58930 - DNA, 38 bp, Artificial Sequence
  Synthetic oligonucleotide
taatcgcacgggaaagggggatcagggattgaccatga

SEQ ID NO: 58931 - DNA, 37 bp, Artificial Sequence
  Synthetic oligonucleotide
ggggggatagaataggaagggggtgtcgggcggatga

SEQ ID NO: 58932 - DNA, 38 bp, Artificial Sequence
  Synthetic oligonucleotide
aacaacgtgcgatcgcccgcccaccacaccaaatatga

SEQ ID NO: 58933 - DNA, 37 bp, Artificial Sequence
  Synthetic oligonucleotide
gcccaactgtaacatgccttcacctacgggtccgtga

SEQ ID NO: 58934 - DNA, 36 bp, Artificial Sequence
  Synthetic oligonucleotide
ggagaccgccctgcctgaattttgggtctttcgtga

SEQ ID NO: 58935 - DNA, 38 bp, Artificial Sequence
  Synthetic oligonucleotide
ttgcgcgggaaagggggtagtgtttggtgggagtgtga

SEQ ID NO: 58936 - DNA, 38 bp, Artificial Sequence
  Synthetic oligonucleotide
ttggagctgttgtccctggcccctcccatagacattga

SEQ ID NO: 58937 - DNA, 38 bp, Artificial Sequence
  Synthetic oligonucleotide
tgaacgtggtgccctccgaaatgttcggccatacttga

SEQ ID NO: 58938 - DNA, 38 bp, Artificial Sequence
  Synthetic oligonucleotide
acgaaccgccacctctaggaacactcaacataccttga

SEQ ID NO: 58939 - DNA, 37 bp, Artificial Sequence
  Synthetic oligonucleotide
tatacctagccccccagaaggtccttttgcatcttga

SEQ ID NO: 58940 - DNA, 38 bp, Artificial Sequence
  Synthetic oligonucleotide
acttgtgacagcctccaatgtgcctccggcaacgttga

SEQ ID NO: 58941 - DNA, 38 bp, Artificial Sequence
  Synthetic oligonucleotide
tgaagccctccctgcaacgaaatcgtccttcccgttga

SEQ ID NO: 58942 - DNA, 37 bp, Artificial Sequence
  Synthetic oligonucleotide
gatcgccacaaatactactccgtgccaggtgctttga

SEQ ID NO: 58943 - DNA, 38 bp, Artificial Sequence
  Synthetic oligonucleotide
tgtggggcgtagttcttttctctcgttcatgcttttga

SEQ ID NO: 58944 - DNA, 35 bp, Artificial Sequence
  Synthetic oligonucleotide
aagcagtgcgcacattatcccaatctgcctccata

SEQ ID NO: 58945 - DNA, 36 bp, Artificial Sequence
  Synthetic oligonucleotide
tcacacccttactggtacaacatttgaatttccata

SEQ ID NO: 58946 - DNA, 36 bp, Artificial Sequence
  Synthetic oligonucleotide
ttgatgacccgtcctcgtagttttcccgtcccacta

SEQ ID NO: 58947 - DNA, 36 bp, Artificial Sequence
  Synthetic oligonucleotide
aaaaggtaagtggaaggggtgacgggcacagcggta

SEQ ID NO: 58948 - DNA, 36 bp, Artificial Sequence
  Synthetic oligonucleotide
tcttggcaacaactggcttttatctttcactactta

SEQ ID NO: 58949 - DNA, 36 bp, Artificial Sequence
  Synthetic oligonucleotide
taatcgcgcggcggaccccatcacggccctgtttta

SEQ ID NO: 58950 - DNA, 35 bp, Artificial Sequence
  Synthetic oligonucleotide
tccgatcggtctccattcatttttccctgtacgac

SEQ ID NO: 58951 - DNA, 35 bp, Artificial Sequence
  Synthetic oligonucleotide
agcgggtcatcagcacatcaaagcgccccccatac

SEQ ID NO: 58952 - DNA, 35 bp, Artificial Sequence
  Synthetic oligonucleotide
tcacgcctctaatccatttatgcgcaatttatacc

SEQ ID NO: 58953 - DNA, 35 bp, Artificial Sequence
  Synthetic oligonucleotide
gtataccgccccagtgatgggtcgctcacaaaccc

SEQ ID NO: 58954 - DNA, 35 bp, Artificial Sequence
  Synthetic oligonucleotide
actccccgcggagctcgcacccaggattttggccc

SEQ ID NO: 58955 - DNA, 35 bp, Artificial Sequence
  Synthetic oligonucleotide
gtggtcgaacctggtgtgtgttgctcctcctatcc

SEQ ID NO: 58956 - DNA, 35 bp, Artificial Sequence
  Synthetic oligonucleotide
gccgagagttcagttaccctatgaccacccgtcgc

SEQ ID NO: 58957 - DNA, 35 bp, Artificial Sequence
  Synthetic oligonucleotide
gccagttcaggacaccacccatccgacattattgc

SEQ ID NO: 58958 - DNA, 35 bp, Artificial Sequence
  Synthetic oligonucleotide
atcgtctacaggcgactcgtccttctcatttttgc

SEQ ID NO: 58959 - DNA, 35 bp, Artificial Sequence
  Synthetic oligonucleotide
tagtgtctcggcactggtgttttgctttcatcttc

SEQ ID NO: 58960 - DNA, 35 bp, Artificial Sequence
  Synthetic oligonucleotide
gtgacctccgcggatggcttcaggcctgccgtttc

SEQ ID NO: 58961 - DNA, 35 bp, Artificial Sequence
  Synthetic oligonucleotide
acactactggcgcctgttctaacattgcttagccg

SEQ ID NO: 58962 - DNA, 35 bp, Artificial Sequence
  Synthetic oligonucleotide
gttgctcagtcaccctctgcacccccgctaatagg

SEQ ID NO: 58963 - DNA, 36 bp, Artificial Sequence
  Synthetic oligonucleotide
caccaccctgtggcctccaccccccaccccttagtg

SEQ ID NO: 58964 - DNA, 35 bp, Artificial Sequence
  Synthetic oligonucleotide
aataatccgcccacgaaacgtttaattgccaccat

SEQ ID NO: 58965 - DNA, 35 bp, Artificial Sequence
  Synthetic oligonucleotide
acattgacgggagacactaggtaaggggagggtat

SEQ ID NO: 58966 - DNA, 35 bp, Artificial Sequence
  Synthetic oligonucleotide
gtgcacgcatgggggcaaatgcacggagttaaagt

SEQ ID NO: 58967 - DNA, 35 bp, Artificial Sequence
  Synthetic oligonucleotide
gccacgcgctaacttcgccttgtgactgtctgagt

SEQ ID NO: 58968 - DNA, 35 bp, Artificial Sequence
  Synthetic oligonucleotide
gttcccccaacccttctatccgccccctgcgacgt

SEQ ID NO: 58969 - DNA, 35 bp, Artificial Sequence
  Synthetic oligonucleotide
atacccagcggcaccttcttgaaccttagttacgt

SEQ ID NO: 58970 - DNA, 35 bp, Artificial Sequence
  Synthetic oligonucleotide
tcactccgcccggcctccataacgttaccgaaggt

SEQ ID NO: 58971 - DNA, 35 bp, Artificial Sequence
  Synthetic oligonucleotide
atggtacctgcccaaaccgggtatgccccttgatt

SEQ ID NO: 58972 - DNA, 35 bp, Artificial Sequence
  Synthetic oligonucleotide
gttggggtgagtaacgtggtgggggtggacaagtt

SEQ ID NO: 58973 - DNA, 35 bp, Artificial Sequence
  Synthetic oligonucleotide
tgctgtctgacgtttgcggcgctctctcatccgtt

SEQ ID NO: 58974 - DNA, 35 bp, Artificial Sequence
  Synthetic oligonucleotide
tctgcgccatcctcgcgtgcactttttaatgattt

SEQ ID NO: 58975 - DNA, 36 bp, Artificial Sequence
  Synthetic oligonucleotide
aacaaaggcaaacaaccgggagttctagtcatagaa

SEQ ID NO: 58976 - DNA, 35 bp, Artificial Sequence
  Synthetic oligonucleotide
tttatggccccgcagcagccttccgtggcaccgaa

SEQ ID NO: 58977 - DNA, 35 bp, Artificial Sequence
  Synthetic oligonucleotide
tcatttaccatcactgtgcaggcgtgcgcatgaca

SEQ ID NO: 58978 - DNA, 35 bp, Artificial Sequence
  Synthetic oligonucleotide
ttcatcacagctcagaagttcaacgctcattgcca

SEQ ID NO: 58979 - DNA, 36 bp, Artificial Sequence
  Synthetic oligonucleotide
gcccacttgctccctatcgaatgttacccttatgca

SEQ ID NO: 58980 - DNA, 36 bp, Artificial Sequence
  Synthetic oligonucleotide
gcccgattcagacggtacctcgcgcttttcctttca

SEQ ID NO: 58981 - DNA, 37 bp, Artificial Sequence
  Synthetic oligonucleotide
gttgggcccgaccagagaccaacgcgtacaaagaaga

SEQ ID NO: 58982 - DNA, 37 bp, Artificial Sequence
  Synthetic oligonucleotide
ttagtaagtgggggggagggtggtgaccagaagcaga

SEQ ID NO: 58983 - DNA, 37 bp, Artificial Sequence
  Synthetic oligonucleotide
tgtagcacagggggacagggagtcggtgggtacgaga

SEQ ID NO: 58984 - DNA, 37 bp, Artificial Sequence
  Synthetic oligonucleotide
atgttctcgcacgaatctgtcttccccccctccgaga

SEQ ID NO: 58985 - DNA, 37 bp, Artificial Sequence
  Synthetic oligonucleotide
tgtgcaacatgtagggagggcagggagcctagggaga

SEQ ID NO: 58986 - DNA, 35 bp, Artificial Sequence
  Synthetic oligonucleotide
tgtactccctctcctctgctgtacaaactcctaga

SEQ ID NO: 58987 - DNA, 36 bp, Artificial Sequence
  Synthetic oligonucleotide
gcacgaccctcctgcgcgcttaccatggtgcttaga

SEQ ID NO: 58988 - DNA, 37 bp, Artificial Sequence
  Synthetic oligonucleotide
taacgccatccctctagtcacgaaacagtcaaaccga

SEQ ID NO: 58989 - DNA, 37 bp, Artificial Sequence
  Synthetic oligonucleotide
tccgtcccgacctgccgctacaaggaagcaccaccga

SEQ ID NO: 58990 - DNA, 37 bp, Artificial Sequence
  Synthetic oligonucleotide
atggaaacctcgctcgacccgccttacctagtaccga

SEQ ID NO: 58991 - DNA, 37 bp, Artificial Sequence
  Synthetic oligonucleotide
agttcagcctaatcgttcttgcacactactctgccga

SEQ ID NO: 58992 - DNA, 35 bp, Artificial Sequence
  Synthetic oligonucleotide
gattcggtagggtgatttaggggctggaggaggga

SEQ ID NO: 58993 - DNA, 37 bp, Artificial Sequence
  Synthetic oligonucleotide
aacattgcaaggactggagggaagccggggagtggga

SEQ ID NO: 58994 - DNA, 37 bp, Artificial Sequence
  Synthetic oligonucleotide
acctcccagcacctctttgtcatcttgtcccaatgga

SEQ ID NO: 58995 - DNA, 36 bp, Artificial Sequence
  Synthetic oligonucleotide
ggaacagttgactggaggagaaggtggaaggttgga

SEQ ID NO: 58996 - DNA, 37 bp, Artificial Sequence
  Synthetic oligonucleotide
ggggagggtgggtggagcggtaggccttaaatttgga

SEQ ID NO: 58997 - DNA, 38 bp, Artificial Sequence
  Synthetic oligonucleotide
atgatcaccatctggttctctgacagtaccttcaatga

SEQ ID NO: 58998 - DNA, 38 bp, Artificial Sequence
  Synthetic oligonucleotide
gccatatgctagcctgcatcctgaattacctgaactga

SEQ ID NO: 58999 - DNA, 38 bp, Artificial Sequence
  Synthetic oligonucleotide
gacgcctagcagtccgcacatccgtttctttcgactga

SEQ ID NO: 59000 - DNA, 36 bp, Artificial Sequence
  Synthetic oligonucleotide
accccttgtcgttaacgtggctctgtatccccctga

SEQ ID NO: 59001 - DNA, 38 bp, Artificial Sequence
  Synthetic oligonucleotide
gatacatcacgatctggccaaacaccctcctatggtga

SEQ ID NO: 59002 - DNA, 37 bp, Artificial Sequence
  Synthetic oligonucleotide
tgtcccctatccattgtaagctaccattcgcccttga

SEQ ID NO: 59003 - DNA, 38 bp, Artificial Sequence
  Synthetic oligonucleotide
aacgaggcacagggtggggcatggggcggacagcttga

SEQ ID NO: 59004 - DNA, 38 bp, Artificial Sequence
  Synthetic oligonucleotide
gtggaacgacggggatgggggggacaacgtaaggttga

SEQ ID NO: 59005 - DNA, 38 bp, Artificial Sequence
  Synthetic oligonucleotide
gacggtcggaagaaggttctgggaattgggtgggttga

SEQ ID NO: 59006 - DNA, 38 bp, Artificial Sequence
  Synthetic oligonucleotide
ggtagactggtgggtgggggagtgagcggagatgttga

SEQ ID NO: 59007 - DNA, 37 bp, Artificial Sequence
  Synthetic oligonucleotide
ggctgttgccatcgcctttttgttgccctgcttttga

SEQ ID NO: 59008 - DNA, 36 bp, Artificial Sequence
  Synthetic oligonucleotide
tgagccccatgatcaacttaccgaagtacttaccta

SEQ ID NO: 59009 - DNA, 36 bp, Artificial Sequence
  Synthetic oligonucleotide
ttggtgacgtgcccgcgacgttgttacgccctccta

SEQ ID NO: 59010 - DNA, 36 bp, Artificial Sequence
  Synthetic oligonucleotide
gaagacctccgcccgcaattgagccttccaaatcta

SEQ ID NO: 59011 - DNA, 35 bp, Artificial Sequence
  Synthetic oligonucleotide
atacgtcaaagcgccgctatcctgctccccaagta

SEQ ID NO: 59012 - DNA, 36 bp, Artificial Sequence
  Synthetic oligonucleotide
gacccaaagaactcgcccacgttgccaaccctcgta

SEQ ID NO: 59013 - DNA, 35 bp, Artificial Sequence
  Synthetic oligonucleotide
tccgggcactcagcactttgtcgtcctccgtatta

SEQ ID NO: 59014 - DNA, 36 bp, Artificial Sequence
  Synthetic oligonucleotide
gtaccccgttgcatttgctgcccctccctcatctta

SEQ ID NO: 59015 - DNA, 35 bp, Artificial Sequence
  Synthetic oligonucleotide
gggagggtgggctgggggcaatgatgacaacgtta

SEQ ID NO: 59016 - DNA, 35 bp, Artificial Sequence
  Synthetic oligonucleotide
actgtgaaccgttccgcaggctacctaatcgacac

SEQ ID NO: 59017 - DNA, 35 bp, Artificial Sequence
  Synthetic oligonucleotide
atcaccctgtcgttttatgtagccccccaatctac

SEQ ID NO: 59018 - DNA, 35 bp, Artificial Sequence
  Synthetic oligonucleotide
atcgcgtgccggcactattatcatgatctcgttac

SEQ ID NO: 59019 - DNA, 35 bp, Artificial Sequence
  Synthetic oligonucleotide
gacccatctctgttatacagtggttaccgctcacc

SEQ ID NO: 59020 - DNA, 35 bp, Artificial Sequence
  Synthetic oligonucleotide
tacccatgcccccacgttatgcgctttgtcatacc

SEQ ID NO: 59021 - DNA, 35 bp, Artificial Sequence
  Synthetic oligonucleotide
ggtcgccggccatattcttaagcctactccgtccc

SEQ ID NO: 59022 - DNA, 35 bp, Artificial Sequence
  Synthetic oligonucleotide
gatatccgcttgccccctcttgacattgattcgcc

SEQ ID NO: 59023 - DNA, 35 bp, Artificial Sequence
  Synthetic oligonucleotide
acacccaaatcacgttcacatcttaaaagcgtgcc

SEQ ID NO: 59024 - DNA, 33 bp, Artificial Sequence
  Synthetic oligonucleotide
ggaacgctatagaacgctctacccgtcgtatcc

SEQ ID NO: 59025 - DNA, 35 bp, Artificial Sequence
  Synthetic oligonucleotide
gtgatggtaatcgctacacccctactgtaccttcc

SEQ ID NO: 59026 - DNA, 35 bp, Artificial Sequence
  Synthetic oligonucleotide
acctcttaccccggtggtagaccttggactgttcc

SEQ ID NO: 59027 - DNA, 35 bp, Artificial Sequence
  Synthetic oligonucleotide
aaccccagcgtgctgcttttggcttcatttcgcgc

SEQ ID NO: 59028 - DNA, 35 bp, Artificial Sequence
  Synthetic oligonucleotide
agcacgggagacacggtactgaagggggggggcgc

SEQ ID NO: 59029 - DNA, 35 bp, Artificial Sequence
  Synthetic oligonucleotide
atccaccgagttcgctaagaagcctgattcatcgc

SEQ ID NO: 59030 - DNA, 35 bp, Artificial Sequence
  Synthetic oligonucleotide
tatgcccactcctatgagctgcccacttaactttc

SEQ ID NO: 59031 - DNA, 35 bp, Artificial Sequence
  Synthetic oligonucleotide
gcaatcaaatagggtgaggggtgagggaggcgtag

SEQ ID NO: 59032 - DNA, 35 bp, Artificial Sequence
  Synthetic oligonucleotide
aaactgctaggcaacagtccccctgccctcccgcg

SEQ ID NO: 59033 - DNA, 35 bp, Artificial Sequence
  Synthetic oligonucleotide
ggtatcggcggtaagcaaaacgaatgggggtgggg

SEQ ID NO: 59034 - DNA, 35 bp, Artificial Sequence
  Synthetic oligonucleotide
tttgaaagggagtggtggggcatgcattatctatg

SEQ ID NO: 59035 - DNA, 35 bp, Artificial Sequence
  Synthetic oligonucleotide
accgccatagccggtatagggctctgttcccactg

SEQ ID NO: 59036 - DNA, 35 bp, Artificial Sequence
  Synthetic oligonucleotide
aacctaccgatgcacccattcagaacctcgccctg

SEQ ID NO: 59037 - DNA, 35 bp, Artificial Sequence
  Synthetic oligonucleotide
actgagtcaccttccacccgcaaattccccggtat

SEQ ID NO: 59038 - DNA, 35 bp, Artificial Sequence
  Synthetic oligonucleotide
acaccatccgagggccctgcccaatttaatcgact

SEQ ID NO: 59039 - DNA, 35 bp, Artificial Sequence
  Synthetic oligonucleotide
aaccggcccgctgatcttgtcctcccccttagcct

SEQ ID NO: 59040 - DNA, 35 bp, Artificial Sequence
  Synthetic oligonucleotide
tctgagtgccgtctgtttctaatccctctccattt

SEQ ID NO: 59041 - DNA, 35 bp, Artificial Sequence
  Synthetic oligonucleotide
atgatttaccccctgctgaagaatcgccccgattt

SEQ ID NO: 59042 - DNA, 35 bp, Artificial Sequence
  Synthetic oligonucleotide
gcctagtccctctcaccgggtaaaccactaacttt

SEQ ID NO: 59043 - DNA, 35 bp, Artificial Sequence
  Synthetic oligonucleotide
acatgggcacgtttaattgctctgatctcctaaaa

SEQ ID NO: 59044 - DNA, 36 bp, Artificial Sequence
  Synthetic oligonucleotide
aaccgcacaggtactcgccatctgcgatccattaaa

SEQ ID NO: 59045 - DNA, 35 bp, Artificial Sequence
  Synthetic oligonucleotide
acatctcagagagacgatgcccctccctttcccaa

SEQ ID NO: 59046 - DNA, 36 bp, Artificial Sequence
  Synthetic oligonucleotide
tatgctgtcagaatcgccgccctagccaaccgccaa

SEQ ID NO: 59047 - DNA, 36 bp, Artificial Sequence
  Synthetic oligonucleotide
acgtgtgccacctgctttgctatcaattttcagcaa

SEQ ID NO: 59048 - DNA, 36 bp, Artificial Sequence
  Synthetic oligonucleotide
tccgcggagagggcgggaagggggaagggggtggaa

SEQ ID NO: 59049 - DNA, 36 bp, Artificial Sequence
  Synthetic oligonucleotide
agtgtaccgcccatgcactgtacttgtgcaaataca

SEQ ID NO: 59050 - DNA, 36 bp, Artificial Sequence
  Synthetic oligonucleotide
tgttgaccagaccgcaccgttagctccatcaaccca

SEQ ID NO: 59051 - DNA, 36 bp, Artificial Sequence
  Synthetic oligonucleotide
tctcgcgcccttgcccgaatctgacctgtcttccca

SEQ ID NO: 59052 - DNA, 36 bp, Artificial Sequence
  Synthetic oligonucleotide
gcccaacactgacagcatcgtgtctcgatacttgca

SEQ ID NO: 59053 - DNA, 36 bp, Artificial Sequence
  Synthetic oligonucleotide
acatatcctcaggcgggctttggtttggcctgttca

SEQ ID NO: 59054 - DNA, 36 bp, Artificial Sequence
  Synthetic oligonucleotide
agttcgcggctccaactgttctgtacccgtttttca

SEQ ID NO: 59055 - DNA, 37 bp, Artificial Sequence
  Synthetic oligonucleotide
gtgcactgcccggacccaagaactcaccatgcataga

SEQ ID NO: 59056 - DNA, 37 bp, Artificial Sequence
  Synthetic oligonucleotide
gaagggtgggagcaccaggggttgaagtatgggacga

SEQ ID NO: 59057 - DNA, 37 bp, Artificial Sequence
  Synthetic oligonucleotide
tgaggaagcctcttttcgatcctgccactttgtacga

SEQ ID NO: 59058 - DNA, 36 bp, Artificial Sequence
  Synthetic oligonucleotide
gagacacccagcatggacaacattctgatttaccga

SEQ ID NO: 59059 - DNA, 37 bp, Artificial Sequence
  Synthetic oligonucleotide
atcgcaacccgaatgtagaccctacctatccacccga

SEQ ID NO: 59060 - DNA, 37 bp, Artificial Sequence
  Synthetic oligonucleotide
gtctaacgacccatgttcatccagtattattccccga

SEQ ID NO: 59061 - DNA, 37 bp, Artificial Sequence
  Synthetic oligonucleotide
gatcactcctcagaatttcgcgctccggttccgccga

SEQ ID NO: 59062 - DNA, 37 bp, Artificial Sequence
  Synthetic oligonucleotide
agcgagggaagatagataggagtttggggaaggccga

SEQ ID NO: 59063 - DNA, 37 bp, Artificial Sequence
  Synthetic oligonucleotide
tgtcaatcatcccaagggccttacctccgatcctcga

SEQ ID NO: 59064 - DNA, 37 bp, Artificial Sequence
  Synthetic oligonucleotide
ttatgcaccgaaacaccggccaagaaggacgcaagga

SEQ ID NO: 59065 - DNA, 37 bp, Artificial Sequence
  Synthetic oligonucleotide
gacagaggggacatagaggggcagccgcgggaacgga

SEQ ID NO: 59066 - DNA, 37 bp, Artificial Sequence
  Synthetic oligonucleotide
acgtaacgtagcctgtaggtacaccctcctcttcgga

SEQ ID NO: 59067 - DNA, 37 bp, Artificial Sequence
  Synthetic oligonucleotide
acccgcggaaggggatcggttgggactgctaaaggga

SEQ ID NO: 59068 - DNA, 37 bp, Artificial Sequence
  Synthetic oligonucleotide
gacacgcacgggctttccacaaaaaaatcatgaatga

SEQ ID NO: 59069 - DNA, 37 bp, Artificial Sequence
  Synthetic oligonucleotide
atcccggttcaccccctcagtacgcctattcccatga

SEQ ID NO: 59070 - DNA, 38 bp, Artificial Sequence
  Synthetic oligonucleotide
tcctgccctagaacccgtttgtcccatctcggccatga

SEQ ID NO: 59071 - DNA, 38 bp, Artificial Sequence
  Synthetic oligonucleotide
tagtcaggcctatttgcctatctttgcctttcaactga

SEQ ID NO: 59072 - DNA, 38 bp, Artificial Sequence
  Synthetic oligonucleotide
acaccttcaggttcacgcttcaccagttctttgcctga

SEQ ID NO: 59073 - DNA, 37 bp, Artificial Sequence
  Synthetic oligonucleotide
tgccgactcaatatacaaatccacctgttccctctga

SEQ ID NO: 59074 - DNA, 38 bp, Artificial Sequence
  Synthetic oligonucleotide
acacatgcctgtagattattagtgtcacctgcctctga

SEQ ID NO: 59075 - DNA, 38 bp, Artificial Sequence
  Synthetic oligonucleotide
gtggtacgtggtggtagactggaaaggcagaggggtga

SEQ ID NO: 59076 - DNA, 36 bp, Artificial Sequence
  Synthetic oligonucleotide
tagcaacctacaaacctacataacgatcgctggtga

SEQ ID NO: 59077 - DNA, 38 bp, Artificial Sequence
  Synthetic oligonucleotide
acaacgcgacgtgcagcatcctgtgtcccgctctgtga

SEQ ID NO: 59078 - DNA, 38 bp, Artificial Sequence
  Synthetic oligonucleotide
agtcacagggagtaacagggatagggagtgaagtgtga

SEQ ID NO: 59079 - DNA, 38 bp, Artificial Sequence
  Synthetic oligonucleotide
atgactccggctgtcccgtaaaccaaaccgacttgtga

SEQ ID NO: 59080 - DNA, 38 bp, Artificial Sequence
  Synthetic oligonucleotide
atttcgccgcgcattcgccgagcctctcttacccttga

SEQ ID NO: 59081 - DNA, 37 bp, Artificial Sequence
  Synthetic oligonucleotide
tgttcgccgcctttattttcacgccagttttcgttga

SEQ ID NO: 59082 - DNA, 38 bp, Artificial Sequence
  Synthetic oligonucleotide
gccacacagcaccccaatacggaaggccctcaatttga

SEQ ID NO: 59083 - DNA, 38 bp, Artificial Sequence
  Synthetic oligonucleotide
ttggacgagggtccatccccataggctctaccttttga

SEQ ID NO: 59084 - DNA, 35 bp, Artificial Sequence
  Synthetic oligonucleotide
tagacatcccatagtgaaccaccgccaacccacta

SEQ ID NO: 59085 - DNA, 35 bp, Artificial Sequence
  Synthetic oligonucleotide
tgagccccattttgactgccagttcccggatccta

SEQ ID NO: 59086 - DNA, 36 bp, Artificial Sequence
  Synthetic oligonucleotide
atgcattgccatggccccaacgtgatcttatttcta

SEQ ID NO: 59087 - DNA, 36 bp, Artificial Sequence
  Synthetic oligonucleotide
tgtaggcccatctgggggtggaatgggaggggatta

SEQ ID NO: 59088 - DNA, 36 bp, Artificial Sequence
  Synthetic oligonucleotide
acactccacaacatggtgcgtgagcatattatctta

SEQ ID NO: 59089 - DNA, 36 bp, Artificial Sequence
  Synthetic oligonucleotide
tccctccagcgcgcgctacctggtttaaccccttta

SEQ ID NO: 59090 - DNA, 35 bp, Artificial Sequence
  Synthetic oligonucleotide
tccgtgctttaacccgcctcggccccctccttgac

SEQ ID NO: 59091 - DNA, 35 bp, Artificial Sequence
  Synthetic oligonucleotide
aacctccacctccaccaagaccaccttggttgtac

SEQ ID NO: 59092 - DNA, 35 bp, Artificial Sequence
  Synthetic oligonucleotide
aattacagcatccgtagcgcttcccgtaacattac

SEQ ID NO: 59093 - DNA, 35 bp, Artificial Sequence
  Synthetic oligonucleotide
aatagcgcgcgtctcgctactgttctttctacacc

SEQ ID NO: 59094 - DNA, 35 bp, Artificial Sequence
  Synthetic oligonucleotide
ttgccttcgtgacgaacgaaccttcatgctttagc

SEQ ID NO: 59095 - DNA, 35 bp, Artificial Sequence
  Synthetic oligonucleotide
taactaccgactgctgaggtctctattcttcttgc

SEQ ID NO: 59096 - DNA, 35 bp, Artificial Sequence
  Synthetic oligonucleotide
gactcaacatcgtgctcccgctgatcatctgaatc

SEQ ID NO: 59097 - DNA, 35 bp, Artificial Sequence
  Synthetic oligonucleotide
ccaccgtccacccaccgattcggggtcaccgcctc

SEQ ID NO: 59098 - DNA, 35 bp, Artificial Sequence
  Synthetic oligonucleotide
aacatcgcctgccccccgacggtccccttgacgtc

SEQ ID NO: 59099 - DNA, 35 bp, Artificial Sequence
  Synthetic oligonucleotide
gacaagcggtgcaatcggttatgtcttgatctgtc

SEQ ID NO: 59100 - DNA, 35 bp, Artificial Sequence
  Synthetic oligonucleotide
tccgtggccagagcatagcacacaagccctcgttc

SEQ ID NO: 59101 - DNA, 35 bp, Artificial Sequence
  Synthetic oligonucleotide
gtgatgaggttctgactgaggggaggatggtaaag

SEQ ID NO: 59102 - DNA, 35 bp, Artificial Sequence
  Synthetic oligonucleotide
tcacgcatccgtgccctccttatttgtttgtgtag

SEQ ID NO: 59103 - DNA, 35 bp, Artificial Sequence
  Synthetic oligonucleotide
gctccccacgggtaattacagctgagcgccacccg

SEQ ID NO: 59104 - DNA, 35 bp, Artificial Sequence
  Synthetic oligonucleotide
atgtgggacggtaggttggtatccgggtatatatg

SEQ ID NO: 59105 - DNA, 35 bp, Artificial Sequence
  Synthetic oligonucleotide
aaccatgttgatctgaatctcctgctaactatatg

SEQ ID NO: 59106 - DNA, 35 bp, Artificial Sequence
  Synthetic oligonucleotide
taacacgcgtttctgtctcaaggctccatctactg

SEQ ID NO: 59107 - DNA, 35 bp, Artificial Sequence
  Synthetic oligonucleotide
gcaaaccacctttcgcacatgcgcatgcgcccctg

SEQ ID NO: 59108 - DNA, 35 bp, Artificial Sequence
  Synthetic oligonucleotide
ttcgccctgagcgggaacttcctagcatttggcct

SEQ ID NO: 59109 - DNA, 35 bp, Artificial Sequence
  Synthetic oligonucleotide
tcctcacctgggattggcgatggtactcgtctcct

SEQ ID NO: 59110 - DNA, 35 bp, Artificial Sequence
  Synthetic oligonucleotide
tacttccctacaggcagtgtgttcggtttcttcct

SEQ ID NO: 59111 - DNA, 35 bp, Artificial Sequence
  Synthetic oligonucleotide
tgcccgctgagcctcccatgcaataaagggcctct

SEQ ID NO: 59112 - DNA, 35 bp, Artificial Sequence
  Synthetic oligonucleotide
tccataccccgcaactatgtggcatcttgatgtct

SEQ ID NO: 59113 - DNA, 35 bp, Artificial Sequence
  Synthetic oligonucleotide
ttcagccaacccgcctaacaatctgaacctatggt

SEQ ID NO: 59114 - DNA, 35 bp, Artificial Sequence
  Synthetic oligonucleotide
gtgaaggggcaaaggagcacccaaaggagaatatt

SEQ ID NO: 59115 - DNA, 35 bp, Artificial Sequence
  Synthetic oligonucleotide
tccagctagactgctttcgttcggctctatctatt

SEQ ID NO: 59116 - DNA, 35 bp, Artificial Sequence
  Synthetic oligonucleotide
gccatgcaaactgttcactctctggttggaatctt

SEQ ID NO: 59117 - DNA, 35 bp, Artificial Sequence
  Synthetic oligonucleotide
agtcatccggcttggtccgcactccgaattggttt

SEQ ID NO: 59118 - DNA, 35 bp, Artificial Sequence
  Synthetic oligonucleotide
ttcaacgcgcatcatcttcctttgggatccttcaa

SEQ ID NO: 59119 - DNA, 36 bp, Artificial Sequence
  Synthetic oligonucleotide
gatagctactgcatccctgcttcaacggactcctaa

SEQ ID NO: 59120 - DNA, 36 bp, Artificial Sequence
  Synthetic oligonucleotide
gcacgtaccatcagacactgctcaaggtccttcaca

SEQ ID NO: 59121 - DNA, 36 bp, Artificial Sequence
  Synthetic oligonucleotide
acgtgcactacgacatactgtttgcccgtttcgcca

SEQ ID NO: 59122 - DNA, 35 bp, Artificial Sequence
  Synthetic oligonucleotide
gtcgtggacacgtaggccagccactaatacttgca

SEQ ID NO: 59123 - DNA, 36 bp, Artificial Sequence
  Synthetic oligonucleotide
tccgtcattcccgctgataggaccaccctccttgca

SEQ ID NO: 59124 - DNA, 36 bp, Artificial Sequence
  Synthetic oligonucleotide
tccctctaccctgttcgtgatcccgcattggattca

SEQ ID NO: 59125 - DNA, 35 bp, Artificial Sequence
  Synthetic oligonucleotide
gaacagatcacacaaccacgcctactgtagtttca

SEQ ID NO: 59126 - DNA, 37 bp, Artificial Sequence
  Synthetic oligonucleotide
agtaccaccatccacctgccctcgcaagcttaccaga

SEQ ID NO: 59127 - DNA, 36 bp, Artificial Sequence
  Synthetic oligonucleotide
acccccgcatcatttaccttttccgtgccattcaga

SEQ ID NO: 59128 - DNA, 37 bp, Artificial Sequence
  Synthetic oligonucleotide
ctcaacgagtgccatggtatggtatgatcacacacga

SEQ ID NO: 59129 - DNA, 37 bp, Artificial Sequence
  Synthetic oligonucleotide
agttagtgccccgccctttgctcctgcgcttatgcga

SEQ ID NO: 59130 - DNA, 36 bp, Artificial Sequence
  Synthetic oligonucleotide
tctccatctactcgcgcactgacacttcccctgcga

SEQ ID NO: 59131 - DNA, 37 bp, Artificial Sequence
  Synthetic oligonucleotide
accgtgcgcacgcttattccccggtgatcgccttcga

SEQ ID NO: 59132 - DNA, 37 bp, Artificial Sequence
  Synthetic oligonucleotide
tacgaggtaagcaaaggggtggcgttagggcgaggga

SEQ ID NO: 59133 - DNA, 37 bp, Artificial Sequence
  Synthetic oligonucleotide
atccctgctaccatccattactcttgcgccctcggga

SEQ ID NO: 59134 - DNA, 37 bp, Artificial Sequence
  Synthetic oligonucleotide
aagcctatccacccagcacgatcagtacgcccctgga

SEQ ID NO: 59135 - DNA, 35 bp, Artificial Sequence
  Synthetic oligonucleotide
gtctatcctgttgcttattgtgccttttgtctgga

SEQ ID NO: 59136 - DNA, 38 bp, Artificial Sequence
  Synthetic oligonucleotide
ttggttgcaccacccgtaggcccgactccgccacctga

SEQ ID NO: 59137 - DNA, 37 bp, Artificial Sequence
  Synthetic oligonucleotide
ttgatacacatccctgggaaaccagcccattccctga

SEQ ID NO: 59138 - DNA, 38 bp, Artificial Sequence
  Synthetic oligonucleotide
gtgagggcctcaccgagtcacgtccctaatcctcctga

SEQ ID NO: 59139 - DNA, 37 bp, Artificial Sequence
  Synthetic oligonucleotide
acgatctcacgctccctgtcctgtacgtctctagtga

SEQ ID NO: 59140 - DNA, 38 bp, Artificial Sequence
  Synthetic oligonucleotide
tgtggtcgggcggggctgggggggtcgagcgtgggtga

SEQ ID NO: 59141 - DNA, 38 bp, Artificial Sequence
  Synthetic oligonucleotide
gcacgggggaacttggttggtgggaacggggtgggtga

SEQ ID NO: 59142 - DNA, 38 bp, Artificial Sequence
  Synthetic oligonucleotide
ggacggatgcaggccgagggatggggggcggagtgtga

SEQ ID NO: 59143 - DNA, 38 bp, Artificial Sequence
  Synthetic oligonucleotide
ggttgccccctcttccgccgtcgccctttcccgtgtga

SEQ ID NO: 59144 - DNA, 36 bp, Artificial Sequence
  Synthetic oligonucleotide
atcgaccacgggctcttggattgcccactaccttga

SEQ ID NO: 59145 - DNA, 38 bp, Artificial Sequence
  Synthetic oligonucleotide
gcacgccaatcacgcaggacacttcaccgcacccttga

SEQ ID NO: 59146 - DNA, 38 bp, Artificial Sequence
  Synthetic oligonucleotide
ttcacgtatgtcacatatctgccctgtttcctgcttga

SEQ ID NO: 59147 - DNA, 38 bp, Artificial Sequence
  Synthetic oligonucleotide
tagacggtcccagctttgcatctaaattccaccgttga

SEQ ID NO: 59148 - DNA, 38 bp, Artificial Sequence
  Synthetic oligonucleotide
ttgacacgttatggcgcgtcattcactcctcgctttga

SEQ ID NO: 59149 - DNA, 38 bp, Artificial Sequence
  Synthetic oligonucleotide
gtgcacatgccgtgccccgtcctacatccccagtttga

SEQ ID NO: 59150 - DNA, 36 bp, Artificial Sequence
  Synthetic oligonucleotide
gccacattgcattcgcacatcgccgttacctgtcta

SEQ ID NO: 59151 - DNA, 36 bp, Artificial Sequence
  Synthetic oligonucleotide
gtccacgcgctgaataacctccgctggacccttcta

SEQ ID NO: 59152 - DNA, 36 bp, Artificial Sequence
  Synthetic oligonucleotide
tgcctattgccgataccttcaactgactccaacgta

SEQ ID NO: 59153 - DNA, 35 bp, Artificial Sequence
  Synthetic oligonucleotide
acgaaccaattgctacatcttacacgggttcccac

SEQ ID NO: 59154 - DNA, 35 bp, Artificial Sequence
  Synthetic oligonucleotide
tgcacctcttgctatctgcgtcgggccaacgtacc

SEQ ID NO: 59155 - DNA, 35 bp, Artificial Sequence
  Synthetic oligonucleotide
tgggaccccacaaggctatcctttccaggccctcc

SEQ ID NO: 59156 - DNA, 35 bp, Artificial Sequence
  Synthetic oligonucleotide
attacgtggaccatcttgggctggaagcctcctcc

SEQ ID NO: 59157 - DNA, 35 bp, Artificial Sequence
  Synthetic oligonucleotide
gaggacagtcatcatcatggaggtgcgccctttcc

SEQ ID NO: 59158 - DNA, 35 bp, Artificial Sequence
  Synthetic oligonucleotide
gcacctgtcagatcctatgccccaagctacaccgc

SEQ ID NO: 59159 - DNA, 35 bp, Artificial Sequence
  Synthetic oligonucleotide
agccatccgaactaggattccatctcgtaacctgc

SEQ ID NO: 59160 - DNA, 35 bp, Artificial Sequence
  Synthetic oligonucleotide
taccctacggcctacgtctaactccctgcctttgc

SEQ ID NO: 59161 - DNA, 35 bp, Artificial Sequence
  Synthetic oligonucleotide
tcctaagccccgcctgaccatagtgctctcttatc

SEQ ID NO: 59162 - DNA, 35 bp, Artificial Sequence
  Synthetic oligonucleotide
tcgctcgatcgctctattaacccatggcacgattc

SEQ ID NO: 59163 - DNA, 35 bp, Artificial Sequence
  Synthetic oligonucleotide
tatgaccccagaatagtacggtacagcaccccttc

SEQ ID NO: 59164 - DNA, 35 bp, Artificial Sequence
  Synthetic oligonucleotide
gaacccctgtaacactacgcgactaacgttcgttc

SEQ ID NO: 59165 - DNA, 35 bp, Artificial Sequence
  Synthetic oligonucleotide
taggtcgccgtagctagcaacacgggaggggtttc

SEQ ID NO: 59166 - DNA, 35 bp, Artificial Sequence
  Synthetic oligonucleotide
taccgtgggggggaaagggtactctgagagcctag

SEQ ID NO: 59167 - DNA, 35 bp, Artificial Sequence
  Synthetic oligonucleotide
ttgagccccacttcctgtttgacggttgttttccg

SEQ ID NO: 59168 - DNA, 35 bp, Artificial Sequence
  Synthetic oligonucleotide
gatagcagggtggcgagaacgggccgaggtcaagg

SEQ ID NO: 59169 - DNA, 35 bp, Artificial Sequence
  Synthetic oligonucleotide
tgattaccgtctccgccgcccccacgccaacgagg

SEQ ID NO: 59170 - DNA, 34 bp, Artificial Sequence
  Synthetic oligonucleotide
taagatagggccgaagggacgagcgacaaacggg

SEQ ID NO: 59171 - DNA, 35 bp, Artificial Sequence
  Synthetic oligonucleotide
gccaccgtactttctgaactgacatcaccagcttg

SEQ ID NO: 59172 - DNA, 35 bp, Artificial Sequence
  Synthetic oligonucleotide
aacgcgcacacaccacccccacagctaatccgttg

SEQ ID NO: 59173 - DNA, 35 bp, Artificial Sequence
  Synthetic oligonucleotide
tacgatcgtctccggcgcatcataccttcgagaat

SEQ ID NO: 59174 - DNA, 35 bp, Artificial Sequence
  Synthetic oligonucleotide
gtggctcaccccaccacgctttcaccagaggtcat

SEQ ID NO: 59175 - DNA, 35 bp, Artificial Sequence
  Synthetic oligonucleotide
gttgcgatcgccaaggacccatcgtgccccattgt

SEQ ID NO: 59176 - DNA, 35 bp, Artificial Sequence
  Synthetic oligonucleotide
actagcctgatccatgatttcccaccctcaacctt

SEQ ID NO: 59177 - DNA, 35 bp, Artificial Sequence
  Synthetic oligonucleotide
tcagaagtgtacatgtttttcctaccgttgtgctt

SEQ ID NO: 59178 - DNA, 35 bp, Artificial Sequence
  Synthetic oligonucleotide
tgttgtggcctgttgtcttccaagtttgccctgtt

SEQ ID NO: 59179 - DNA, 35 bp, Artificial Sequence
  Synthetic oligonucleotide
gtcgtttgcaccatctaatatgtactatcccgttt

SEQ ID NO: 59180 - DNA, 35 bp, Artificial Sequence
  Synthetic oligonucleotide
acgaccatccccccgcagtctccatggccttgttt

SEQ ID NO: 59181 - DNA, 35 bp, Artificial Sequence
  Synthetic oligonucleotide
tgcctgtcgctagacttcgttgaatgcacaatttt

SEQ ID NO: 59182 - DNA, 35 bp, Artificial Sequence
  Synthetic oligonucleotide
tgccactcctatctcaggccagtcttccgtatttt

SEQ ID NO: 59183 - DNA, 36 bp, Artificial Sequence
  Synthetic oligonucleotide
tgaatggcacaataagcactcatcgcatcttcaaca

SEQ ID NO: 59184 - DNA, 36 bp, Artificial Sequence
  Synthetic oligonucleotide
gaacacgtttcaggccatggccccatccaggcacca

SEQ ID NO: 59185 - DNA, 36 bp, Artificial Sequence
  Synthetic oligonucleotide
agttccacgcccggaactctcgtaatttcaccccca

SEQ ID NO: 59186 - DNA, 35 bp, Artificial Sequence
  Synthetic oligonucleotide
atcagagccaattgtcgattcaacgccacccccca

SEQ ID NO: 59187 - DNA, 36 bp, Artificial Sequence
  Synthetic oligonucleotide
gaccattcactctgtgcctcctatcctgtaggccca

SEQ ID NO: 59188 - DNA, 36 bp, Artificial Sequence
  Synthetic oligonucleotide
tccacctgttcccccgataatagttggtgtactcca

SEQ ID NO: 59189 - DNA, 37 bp, Artificial Sequence
  Synthetic oligonucleotide
gcctgccccgcttaatccccgaactttcttttggaga

SEQ ID NO: 59190 - DNA, 37 bp, Artificial Sequence
  Synthetic oligonucleotide
gaacatagccataagcgccctctccgaatcgatccga

SEQ ID NO: 59191 - DNA, 37 bp, Artificial Sequence
  Synthetic oligonucleotide
attccccgacgctcaattttactgttaggttctccga

SEQ ID NO: 59192 - DNA, 37 bp, Artificial Sequence
  Synthetic oligonucleotide
tacattccaccgccctgtctcgagagattcatgtcga

SEQ ID NO: 59193 - DNA, 36 bp, Artificial Sequence
  Synthetic oligonucleotide
tagcagggaaaacgggtaccctgaggctggggagga

SEQ ID NO: 59194 - DNA, 37 bp, Artificial Sequence
  Synthetic oligonucleotide
acgggggcaacaggagggctggaatggggtcaacgga

SEQ ID NO: 59195 - DNA, 37 bp, Artificial Sequence
  Synthetic oligonucleotide
accaccatcaacggatacctttgtccctgcatacgga

SEQ ID NO: 59196 - DNA, 37 bp, Artificial Sequence
  Synthetic oligonucleotide
gacaccggacacgttggtaagggcgggtggattggga

SEQ ID NO: 59197 - DNA, 37 bp, Artificial Sequence
  Synthetic oligonucleotide
tgtcctacacccatgcggccacccttcattccatgga

SEQ ID NO: 59198 - DNA, 37 bp, Artificial Sequence
  Synthetic oligonucleotide
gagacggaaggaagagagaaagcgatgtcgaattgga

SEQ ID NO: 59199 - DNA, 38 bp, Artificial Sequence
  Synthetic oligonucleotide
gcacggaggggccgtggactagggggggttggaaatga

SEQ ID NO: 59200 - DNA, 38 bp, Artificial Sequence
  Synthetic oligonucleotide
tcagtgaggcgggaggtcagtcgcagtgagaggaatga

SEQ ID NO: 59201 - DNA, 38 bp, Artificial Sequence
  Synthetic oligonucleotide
gtccacgtcacggcctgatctgctaccgcccaccatga

SEQ ID NO: 59202 - DNA, 37 bp, Artificial Sequence
  Synthetic oligonucleotide
tcacctcccaatcacgagtcttgcacgattaccatga

SEQ ID NO: 59203 - DNA, 38 bp, Artificial Sequence
  Synthetic oligonucleotide
acaaagcgagggccagggagggtggacaacagggatga

SEQ ID NO: 59204 - DNA, 38 bp, Artificial Sequence
  Synthetic oligonucleotide
gtgacagggggaatggggccttaggtagcatgggatga

SEQ ID NO: 59205 - DNA, 37 bp, Artificial Sequence
  Synthetic oligonucleotide
accctgagtcggtggcccctcgttctctgtcctatga

SEQ ID NO: 59206 - DNA, 38 bp, Artificial Sequence
  Synthetic oligonucleotide
tgtcgtctcggccgcacttactatgcctcactctatga

SEQ ID NO: 59207 - DNA, 38 bp, Artificial Sequence
  Synthetic oligonucleotide
aacgggcagtgcaaggggataaagggggaggggtatga

SEQ ID NO: 59208 - DNA, 38 bp, Artificial Sequence
  Synthetic oligonucleotide
aacctgtgcccagccacaatatctacatgcacttatga

SEQ ID NO: 59209 - DNA, 38 bp, Artificial Sequence
  Synthetic oligonucleotide
gccccgctccataatgaaatgccgtatcagttcactga

SEQ ID NO: 59210 - DNA, 38 bp, Artificial Sequence
  Synthetic oligonucleotide
ggtgctcgtaccgatcgttcagttcaccttctccctga

SEQ ID NO: 59211 - DNA, 38 bp, Artificial Sequence
  Synthetic oligonucleotide
gatacgcgctccgatcaggtctaattcttcctcgctga

SEQ ID NO: 59212 - DNA, 38 bp, Artificial Sequence
  Synthetic oligonucleotide
gacccagcccctgacccggccgaatgtagctttgctga

SEQ ID NO: 59213 - DNA, 37 bp, Artificial Sequence
  Synthetic oligonucleotide
gtaggaggggagaaagtagcaaaaacaccacccgtga

SEQ ID NO: 59214 - DNA, 38 bp, Artificial Sequence
  Synthetic oligonucleotide
gacccgcgcccccactctcttcgaatactgacacttga

SEQ ID NO: 59215 - DNA, 38 bp, Artificial Sequence
  Synthetic oligonucleotide
tgatccctcggggtttttcacacacctcaattacttga

SEQ ID NO: 59216 - DNA, 38 bp, Artificial Sequence
  Synthetic oligonucleotide
tccatttcaccgcctgcaacggttattaccatccttga

SEQ ID NO: 59217 - DNA, 38 bp, Artificial Sequence
  Synthetic oligonucleotide
tacacttggcgtcctctctcgtgccattttgctgttga

SEQ ID NO: 59218 - DNA, 38 bp, Artificial Sequence
  Synthetic oligonucleotide
gagagacgttattgttctgccgtgcctcctgtttttga

SEQ ID NO: 59219 - DNA, 36 bp, Artificial Sequence
  Synthetic oligonucleotide
tatccatgcacaccccggttgcgaacacatgccata

SEQ ID NO: 59220 - DNA, 35 bp, Artificial Sequence
  Synthetic oligonucleotide
gtaccgacccatacaacaacaagctgacccgcgta

SEQ ID NO: 59221 - DNA, 36 bp, Artificial Sequence
  Synthetic oligonucleotide
tcatctagccaactaccgcagtaggcctctcctgta

SEQ ID NO: 59222 - DNA, 35 bp, Artificial Sequence
  Synthetic oligonucleotide
acatacgatcagactcggatttattacaattctta

SEQ ID NO: 59223 - DNA, 35 bp, Artificial Sequence
  Synthetic oligonucleotide
gcaagctccagtaatgtcaccccgtcctgctttta

SEQ ID NO: 59224 - DNA, 35 bp, Artificial Sequence
  Synthetic oligonucleotide
gtggtccgggtcctcgcaagctcgttacaccacac

SEQ ID NO: 59225 - DNA, 35 bp, Artificial Sequence
  Synthetic oligonucleotide
attgccatacttgcgatggggctcaaatcacccac

SEQ ID NO: 59226 - DNA, 35 bp, Artificial Sequence
  Synthetic oligonucleotide
gacgcaccatcggaactgttttgctgtaatatcac

SEQ ID NO: 59227 - DNA, 35 bp, Artificial Sequence
  Synthetic oligonucleotide
tcaccgggtgtcctctactcacgaccgtctttacc

SEQ ID NO: 59228 - DNA, 35 bp, Artificial Sequence
  Synthetic oligonucleotide
gaccacggatctccccacggtactcagcctacgcc

SEQ ID NO: 59229 - DNA, 35 bp, Artificial Sequence
  Synthetic oligonucleotide
caacccaacctcccataacttgcgaccccagcgcc

SEQ ID NO: 59230 - DNA, 35 bp, Artificial Sequence
  Synthetic oligonucleotide
aactgaacccgcgcctacatctgctctggcatgcc

SEQ ID NO: 59231 - DNA, 35 bp, Artificial Sequence
  Synthetic oligonucleotide
gtgtgcaacgctttacgtcctcgtgtcactgttcc

SEQ ID NO: 59232 - DNA, 35 bp, Artificial Sequence
  Synthetic oligonucleotide
atccgacagtaggcacgcctcctacgcgactttcc

SEQ ID NO: 59233 - DNA, 36 bp, Artificial Sequence
  Synthetic oligonucleotide
tcgcaagggcagacaccagctcatcttcccgctagc

SEQ ID NO: 59234 - DNA, 35 bp, Artificial Sequence
  Synthetic oligonucleotide
tctgaccgctgaacctgggatatcttatattgtgc

SEQ ID NO: 59235 - DNA, 35 bp, Artificial Sequence
  Synthetic oligonucleotide
tacacccaccgaagatccctgtctgtcatgttctc

SEQ ID NO: 59236 - DNA, 35 bp, Artificial Sequence
  Synthetic oligonucleotide
tgaggggggattaggggcggtaaatagggtgcgtc

SEQ ID NO: 59237 - DNA, 35 bp, Artificial Sequence
  Synthetic oligonucleotide
acaattcgagcgcaacgatcccctacactgttttc

SEQ ID NO: 59238 - DNA, 35 bp, Artificial Sequence
  Synthetic oligonucleotide
tgagcggtggatgaaacaggggaacgatggggaag

SEQ ID NO: 59239 - DNA, 36 bp, Artificial Sequence
  Synthetic oligonucleotide
tgttcccagctcctgcaacgccatccaccgcacgag

SEQ ID NO: 59240 - DNA, 35 bp, Artificial Sequence
  Synthetic oligonucleotide
tcactttccccgagtcattaccctgcacgctaacg

SEQ ID NO: 59241 - DNA, 35 bp, Artificial Sequence
  Synthetic oligonucleotide
aactcagctccacatgcatcggtggccctttcgcg

SEQ ID NO: 59242 - DNA, 35 bp, Artificial Sequence
  Synthetic oligonucleotide
tgacactgtcgcgtgaccatcccgtttcgaattcg

SEQ ID NO: 59243 - DNA, 35 bp, Artificial Sequence
  Synthetic oligonucleotide
agttgtgggtgagcaggaggcttttaagtgggagg

SEQ ID NO: 59244 - DNA, 35 bp, Artificial Sequence
  Synthetic oligonucleotide
aacacctagaccttcttccgtacacctcctctgtg

SEQ ID NO: 59245 - DNA, 35 bp, Artificial Sequence
  Synthetic oligonucleotide
accggactttcctacccatcgccccgtgccgccat

SEQ ID NO: 59246 - DNA, 35 bp, Artificial Sequence
  Synthetic oligonucleotide
agtcaggggcaacagcaggcggggtttcaaaatat

SEQ ID NO: 59247 - DNA, 34 bp, Artificial Sequence
  Synthetic oligonucleotide
gttaccacgtcgccgctttggagcaactgctact

SEQ ID NO: 59248 - DNA, 35 bp, Artificial Sequence
  Synthetic oligonucleotide
tgatatcgccgctatactagtaacgtgtcctccct

SEQ ID NO: 59249 - DNA, 35 bp, Artificial Sequence
  Synthetic oligonucleotide
gtacctgaccggcaatagaaaaacgtctccctcct

SEQ ID NO: 59250 - DNA, 35 bp, Artificial Sequence
  Synthetic oligonucleotide
gcacaagcaggggggggtggacgctagacggtgct

SEQ ID NO: 59251 - DNA, 35 bp, Artificial Sequence
  Synthetic oligonucleotide
taccatcgcatataggttagggctccccatggtct

SEQ ID NO: 59252 - DNA, 35 bp, Artificial Sequence
  Synthetic oligonucleotide
tatcgtgtcgcctgccccccgttgtactatcaggt

SEQ ID NO: 59253 - DNA, 35 bp, Artificial Sequence
  Synthetic oligonucleotide
aacctccctctgtgcgacaacagccccaccgcatt

SEQ ID NO: 59254 - DNA, 36 bp, Artificial Sequence
  Synthetic oligonucleotide
atgtaacgagcgaaacggtgctggaacgtggagaaa

SEQ ID NO: 59255 - DNA, 36 bp, Artificial Sequence
  Synthetic oligonucleotide
acctgcgcatcaacacttcctaggctcgaggcccaa

SEQ ID NO: 59256 - DNA, 36 bp, Artificial Sequence
  Synthetic oligonucleotide
gccacctttgccaccaatgcccgtagtgagctggaa

SEQ ID NO: 59257 - DNA, 36 bp, Artificial Sequence
  Synthetic oligonucleotide
accaacggcccttcttcgttaactctggccaggtaa

SEQ ID NO: 59258 - DNA, 35 bp, Artificial Sequence
  Synthetic oligonucleotide
atggttcacttccaccccgtgcttcgaactcttaa

SEQ ID NO: 59259 - DNA, 36 bp, Artificial Sequence
  Synthetic oligonucleotide
atgaccatccctcagagaagctctcaagccgcaaca

SEQ ID NO: 59260 - DNA, 35 bp, Artificial Sequence
  Synthetic oligonucleotide
gtgtgcagcacgctctcatcgcattattcatcaca

SEQ ID NO: 59261 - DNA, 36 bp, Artificial Sequence
  Synthetic oligonucleotide
acacagtacgggggggggattcaaatgattgataca

SEQ ID NO: 59262 - DNA, 36 bp, Artificial Sequence
  Synthetic oligonucleotide
acgctcctcccaccttcgattcgtgcgtgctcccca

SEQ ID NO: 59263 - DNA, 35 bp, Artificial Sequence
  Synthetic oligonucleotide
gcattacgcctcctgcttgtcgagtaagccgccca

SEQ ID NO: 59264 - DNA, 36 bp, Artificial Sequence
  Synthetic oligonucleotide
gcgagcgccggtcagtcaccctcctagcatcctcca

SEQ ID NO: 59265 - DNA, 36 bp, Artificial Sequence
  Synthetic oligonucleotide
tgctcacttgcaaacgtctatcgaagctgatctgca

SEQ ID NO: 59266 - DNA, 36 bp, Artificial Sequence
  Synthetic oligonucleotide
acccgcccattagcagggaacccacaggtactatca

SEQ ID NO: 59267 - DNA, 36 bp, Artificial Sequence
  Synthetic oligonucleotide
agcgagtcaaccatgattcctcagcacttctactca

SEQ ID NO: 59268 - DNA, 37 bp, Artificial Sequence
  Synthetic oligonucleotide
actcctggtctatcattattcgttactggtccgccga

SEQ ID NO: 59269 - DNA, 37 bp, Artificial Sequence
  Synthetic oligonucleotide
atgagcgctcggacaccgcagcaaccacttcctccga

SEQ ID NO: 59270 - DNA, 37 bp, Artificial Sequence
  Synthetic oligonucleotide
actcagacacacctgggtccttacgaccacatatcga

SEQ ID NO: 59271 - DNA, 37 bp, Artificial Sequence
  Synthetic oligonucleotide
gcgctgtagcctgttttatgttctatcttcacctcga

SEQ ID NO: 59272 - DNA, 37 bp, Artificial Sequence
  Synthetic oligonucleotide
atgcctaccgtcattagaacttcgctcactccctcga

SEQ ID NO: 59273 - DNA, 37 bp, Artificial Sequence
  Synthetic oligonucleotide
agcggtgggggaacacgggtaaacaatgaccgctcga

SEQ ID NO: 59274 - DNA, 37 bp, Artificial Sequence
  Synthetic oligonucleotide
gagaagagtttaggaggagtgggggggaaagcaggga

SEQ ID NO: 59275 - DNA, 36 bp, Artificial Sequence
  Synthetic oligonucleotide
tgaacacgcatccagtgacgtaggggttaggctgga

SEQ ID NO: 59276 - DNA, 36 bp, Artificial Sequence
  Synthetic oligonucleotide
agtgacaggggagtgctatatagtaatgggggtgga

SEQ ID NO: 59277 - DNA, 38 bp, Artificial Sequence
  Synthetic oligonucleotide
gacacgtggcggaaaagaatgtggaaggggggccatga

SEQ ID NO: 59278 - DNA, 38 bp, Artificial Sequence
  Synthetic oligonucleotide
gcctctccactcacagtaacttatgcgacttcccctga

SEQ ID NO: 59279 - DNA, 38 bp, Artificial Sequence
  Synthetic oligonucleotide
acatcgtccgtatcctcttttaccgtgccgctgcctga

SEQ ID NO: 59280 - DNA, 38 bp, Artificial Sequence
  Synthetic oligonucleotide
agactatgcgcgacctaagttcctacacctttgcctga

SEQ ID NO: 59281 - DNA, 38 bp, Artificial Sequence
  Synthetic oligonucleotide
tccacctgccggcttggctcgtttttttgagttcctga

SEQ ID NO: 59282 - DNA, 38 bp, Artificial Sequence
  Synthetic oligonucleotide
gaattgctgcgaccgggtcgggcatgggagtggattga

SEQ ID NO: 59283 - DNA, 38 bp, Artificial Sequence
  Synthetic oligonucleotide
tcactacaccgagtgtagttatgggataaccatgttga

SEQ ID NO: 59284 - DNA, 35 bp, Artificial Sequence
  Synthetic oligonucleotide
gatcacgtcctcggcggtcgttacctcatcaccta

SEQ ID NO: 59285 - DNA, 35 bp, Artificial Sequence
  Synthetic oligonucleotide
tgcgaacgggctctgcaaaagaatctgctcctcta

SEQ ID NO: 59286 - DNA, 35 bp, Artificial Sequence
  Synthetic oligonucleotide
atcccatcacgtactcaggcttatacaagcctgta

SEQ ID NO: 59287 - DNA, 36 bp, Artificial Sequence
  Synthetic oligonucleotide
tcccgtaccctacctcacgattcgtgataaagttta

SEQ ID NO: 59288 - DNA, 36 bp, Artificial Sequence
  Synthetic oligonucleotide
gcgacgcgaagcatctgagcaagcatatctctttta

SEQ ID NO: 59289 - DNA, 35 bp, Artificial Sequence
  Synthetic oligonucleotide
atgctccaccggaacgtaggcttttgaagcttaac

SEQ ID NO: 59290 - DNA, 35 bp, Artificial Sequence
  Synthetic oligonucleotide
tctgtacgcaccaatctgtacaaccaccaggccac

SEQ ID NO: 59291 - DNA, 35 bp, Artificial Sequence
  Synthetic oligonucleotide
gaatgcactaccggcccgttcctacgctcaaggac

SEQ ID NO: 59292 - DNA, 35 bp, Artificial Sequence
  Synthetic oligonucleotide
gtgctactgcattacgtttgcctacgggtagttac

SEQ ID NO: 59293 - DNA, 35 bp, Artificial Sequence
  Synthetic oligonucleotide
gcggtccccctttgtgcttcaggttctcaccgccc

SEQ ID NO: 59294 - DNA, 35 bp, Artificial Sequence
  Synthetic oligonucleotide
tgctgtggcctatctgattgaccttccacgcgccc

SEQ ID NO: 59295 - DNA, 35 bp, Artificial Sequence
  Synthetic oligonucleotide
tccacacacccgcacccaatatgtttacgtatctc

SEQ ID NO: 59296 - DNA, 35 bp, Artificial Sequence
  Synthetic oligonucleotide
gctgtgccgtacttccatggatacttggtaatttc

SEQ ID NO: 59297 - DNA, 35 bp, Artificial Sequence
  Synthetic oligonucleotide
tcgtccccacatattgttcggtcctttcgataccg

SEQ ID NO: 59298 - DNA, 35 bp, Artificial Sequence
  Synthetic oligonucleotide
tgccctcccctccccatgtccttacaatgcacccg

SEQ ID NO: 59299 - DNA, 35 bp, Artificial Sequence
  Synthetic oligonucleotide
agccgctcccgcatttgcaccagtctctaacttcg

SEQ ID NO: 59300 - DNA, 35 bp, Artificial Sequence
  Synthetic oligonucleotide
tgtagggggagggtatctggaactgtaatgtaagg

SEQ ID NO: 59301 - DNA, 35 bp, Artificial Sequence
  Synthetic oligonucleotide
ggaacatgagcatgttcctggggggggatgttggg

SEQ ID NO: 59302 - DNA, 35 bp, Artificial Sequence
  Synthetic oligonucleotide
agacctgactgacattccccattacgcctcgctgg

SEQ ID NO: 59303 - DNA, 35 bp, Artificial Sequence
  Synthetic oligonucleotide
aaacacgccacgaactgtcgaacgtaattaacctg

SEQ ID NO: 59304 - DNA, 35 bp, Artificial Sequence
  Synthetic oligonucleotide
tacgagtgccgcccacacacatgtcttagacagtg

SEQ ID NO: 59305 - DNA, 35 bp, Artificial Sequence
  Synthetic oligonucleotide
gtcatccgggctcccccacttcagccattgacaat

SEQ ID NO: 59306 - DNA, 35 bp, Artificial Sequence
  Synthetic oligonucleotide
tgtacgcgcagaggaagggggtggggtgttatcat

SEQ ID NO: 59307 - DNA, 35 bp, Artificial Sequence
  Synthetic oligonucleotide
gacgcctgcagttttttgtcccccctgaaatctat

SEQ ID NO: 59308 - DNA, 35 bp, Artificial Sequence
  Synthetic oligonucleotide
gctcgcacatgcaccgacgctaccatctctcttat

SEQ ID NO: 59309 - DNA, 35 bp, Artificial Sequence
  Synthetic oligonucleotide
aacatgccactgcagcaggacccgatcagttccct

SEQ ID NO: 59310 - DNA, 35 bp, Artificial Sequence
  Synthetic oligonucleotide
tttatgcgcctactcgtagtttccgttcatgtcct

SEQ ID NO: 59311 - DNA, 35 bp, Artificial Sequence
  Synthetic oligonucleotide
atagttgaacggcgccgcttttagtctattcctct

SEQ ID NO: 59312 - DNA, 35 bp, Artificial Sequence
  Synthetic oligonucleotide
atgtctgcggccttcgctgcgtactcttttcacgt

SEQ ID NO: 59313 - DNA, 35 bp, Artificial Sequence
  Synthetic oligonucleotide
gcgcattacagcaacggcccgtctccccattacgt

SEQ ID NO: 59314 - DNA, 35 bp, Artificial Sequence
  Synthetic oligonucleotide
gacccaaacctcagcaagtagcatattagctaatt

SEQ ID NO: 59315 - DNA, 35 bp, Artificial Sequence
  Synthetic oligonucleotide
tgcaccctcttacgttaataacgataccgaccctt

SEQ ID NO: 59316 - DNA, 36 bp, Artificial Sequence
  Synthetic oligonucleotide
tggatagagtgggaccaagtgaagggtgcggtaaaa

SEQ ID NO: 59317 - DNA, 36 bp, Artificial Sequence
  Synthetic oligonucleotide
ttcgcccgcccctgtcacaaaccaattctctgggaa

SEQ ID NO: 59318 - DNA, 36 bp, Artificial Sequence
  Synthetic oligonucleotide
tatgacgccttttgtctgtattctccggccatggaa

SEQ ID NO: 59319 - DNA, 35 bp, Artificial Sequence
  Synthetic oligonucleotide
tgttactcctcattgaacatggcccaattcgaaca

SEQ ID NO: 59320 - DNA, 36 bp, Artificial Sequence
  Synthetic oligonucleotide
tatggccacgctctcgtctatcaagtcctcttaaca

SEQ ID NO: 59321 - DNA, 35 bp, Artificial Sequence
  Synthetic oligonucleotide
tcatgcatactcgatggaactcactcccatgcaca

SEQ ID NO: 59322 - DNA, 35 bp, Artificial Sequence
  Synthetic oligonucleotide
acttgcctagagttcctatttgaaaccactgcaca

SEQ ID NO: 59323 - DNA, 36 bp, Artificial Sequence
  Synthetic oligonucleotide
tacacgtgcatttgccatccggttccacgagctaca

SEQ ID NO: 59324 - DNA, 36 bp, Artificial Sequence
  Synthetic oligonucleotide
agccggatacacccctatgacgcccactgaactcca

SEQ ID NO: 59325 - DNA, 36 bp, Artificial Sequence
  Synthetic oligonucleotide
gccgagaaggtctcggttcgctatctatccttagca

SEQ ID NO: 59326 - DNA, 36 bp, Artificial Sequence
  Synthetic oligonucleotide
gtccaaagtcatcgatgtcagcacaccttaccctca

SEQ ID NO: 59327 - DNA, 37 bp, Artificial Sequence
  Synthetic oligonucleotide
atgtacgatgcatgaggggggtatgggggatcaaaga

SEQ ID NO: 59328 - DNA, 37 bp, Artificial Sequence
  Synthetic oligonucleotide
accactcacttcccggccatacatgacgctttgcaga

SEQ ID NO: 59329 - DNA, 37 bp, Artificial Sequence
  Synthetic oligonucleotide
tgtaaaggagcgcagtacaggaaaggagggggcgaga

SEQ ID NO: 59330 - DNA, 37 bp, Artificial Sequence
  Synthetic oligonucleotide
tgccaaccgtagcctggtcttaatatgtcccgcccga

SEQ ID NO: 59331 - DNA, 37 bp, Artificial Sequence
  Synthetic oligonucleotide
agccctgccctacgatacgctcgatctccctcgccga

SEQ ID NO: 59332 - DNA, 37 bp, Artificial Sequence
  Synthetic oligonucleotide
aggaactgcaaggcggtgtggggatggaagatagcga

SEQ ID NO: 59333 - DNA, 37 bp, Artificial Sequence
  Synthetic oligonucleotide
ttcgacgtcatgacgtgcttcatgtttttgctctcga

SEQ ID NO: 59334 - DNA, 37 bp, Artificial Sequence
  Synthetic oligonucleotide
tcaccccacggtcgctggatatctacatttgattcga

SEQ ID NO: 59335 - DNA, 37 bp, Artificial Sequence
  Synthetic oligonucleotide
aacgcgatgtggcacttccttttttagtgtggttcga

SEQ ID NO: 59336 - DNA, 36 bp, Artificial Sequence
  Synthetic oligonucleotide
gtcatgtcctcatgacctagacacaccctcaccgga

SEQ ID NO: 59337 - DNA, 37 bp, Artificial Sequence
  Synthetic oligonucleotide
gctctgccgccgctctagttctcgctccgtatccgga

SEQ ID NO: 59338 - DNA, 37 bp, Artificial Sequence
  Synthetic oligonucleotide
tgccagggcatccccccgtcacccgttctgcctcgga

SEQ ID NO: 59339 - DNA, 37 bp, Artificial Sequence
  Synthetic oligonucleotide
atgcgcgtggaaggatctcgggggggggaagagggga

SEQ ID NO: 59340 - DNA, 37 bp, Artificial Sequence
  Synthetic oligonucleotide
gtgccaagtgctggatgatctgtgatggatgggggga

SEQ ID NO: 59341 - DNA, 37 bp, Artificial Sequence
  Synthetic oligonucleotide
tcacacggatgagtgtgctgaaataggataatgggga

SEQ ID NO: 59342 - DNA, 35 bp, Artificial Sequence
  Synthetic oligonucleotide
ggtggaggaaggagaaatggacgtggcagtatgga

SEQ ID NO: 59343 - DNA, 37 bp, Artificial Sequence
  Synthetic oligonucleotide
ttagagggacggtggggtgccagtatgaggggctgga

SEQ ID NO: 59344 - DNA, 37 bp, Artificial Sequence
  Synthetic oligonucleotide
ttgccgatcaggcgtggaccaggtaaggggtggtgga

SEQ ID NO: 59345 - DNA, 37 bp, Artificial Sequence
  Synthetic oligonucleotide
ttcacgacgcctgcaaaaagcctacgtcactcttgga

SEQ ID NO: 59346 - DNA, 38 bp, Artificial Sequence
  Synthetic oligonucleotide
tcccacgtagccaaacgtaatgatcttccgccacatga

SEQ ID NO: 59347 - DNA, 37 bp, Artificial Sequence
  Synthetic oligonucleotide
gaccactctccccgaccgtttttgcgaccagcgatga

SEQ ID NO: 59348 - DNA, 37 bp, Artificial Sequence
  Synthetic oligonucleotide
tacgatcgaagggaggcgggatagatacagcgtatga

SEQ ID NO: 59349 - DNA, 38 bp, Artificial Sequence
  Synthetic oligonucleotide
gttcaccaacgcgttcctgcatctatggcctcttatga

SEQ ID NO: 59350 - DNA, 36 bp, Artificial Sequence
  Synthetic oligonucleotide
atgcatctgcatcgcttaaaaacccgtcaacactga

SEQ ID NO: 59351 - DNA, 37 bp, Artificial Sequence
  Synthetic oligonucleotide
tcgctatcgaacgtacttttgcttagattactcctga

SEQ ID NO: 59352 - DNA, 38 bp, Artificial Sequence
  Synthetic oligonucleotide
actcgccacttcaccgattagccattgtccacttctga

SEQ ID NO: 59353 - DNA, 38 bp, Artificial Sequence
  Synthetic oligonucleotide
ttcataggccgccctctgtttttgaccttgagttctga

SEQ ID NO: 59354 - DNA, 37 bp, Artificial Sequence
  Synthetic oligonucleotide
gatgtggcgggtgagtgcgtgtagcataggtacgtga

SEQ ID NO: 59355 - DNA, 38 bp, Artificial Sequence
  Synthetic oligonucleotide
tcatccttacgcacatgccggttttgacgaacacttga

SEQ ID NO: 59356 - DNA, 38 bp, Artificial Sequence
  Synthetic oligonucleotide
acaacgtagatcgcatccgcctccggggaccaccttga

SEQ ID NO: 59357 - DNA, 38 bp, Artificial Sequence
  Synthetic oligonucleotide
gtatgcctgttggtttcttgccacgttttgtaccttga

SEQ ID NO: 59358 - DNA, 37 bp, Artificial Sequence
  Synthetic oligonucleotide
accccgatacagccctccgggaataaccaccccttga

SEQ ID NO: 59359 - DNA, 36 bp, Artificial Sequence
  Synthetic oligonucleotide
atacgcaccaaccactgacctggtcgcctcccttga

SEQ ID NO: 59360 - DNA, 37 bp, Artificial Sequence
  Synthetic oligonucleotide
aagcccacgtccaaacccctcttgcgctaatccttga

SEQ ID NO: 59361 - DNA, 38 bp, Artificial Sequence
  Synthetic oligonucleotide
tttgacacgcttctgtgctgaccttatgccttccttga

SEQ ID NO: 59362 - DNA, 38 bp, Artificial Sequence
  Synthetic oligonucleotide
tctggtcgccgtgccgatctctcgtcaatgaacgttga

SEQ ID NO: 59363 - DNA, 38 bp, Artificial Sequence
  Synthetic oligonucleotide
gtggccacatattggactcttgcctctcaacactttga

SEQ ID NO: 59364 - DNA, 38 bp, Artificial Sequence
  Synthetic oligonucleotide
taaaccctcgccttgttgcgtaacctctcctcctttga

SEQ ID NO: 59365 - DNA, 35 bp, Artificial Sequence
  Synthetic oligonucleotide
gccccacatacccccgccacttctagtgtgaacta

SEQ ID NO: 59366 - DNA, 36 bp, Artificial Sequence
  Synthetic oligonucleotide
tcccggcgctgaactttcctgtaacacctcgcacta

SEQ ID NO: 59367 - DNA, 36 bp, Artificial Sequence
  Synthetic oligonucleotide
aaacgatgcgcgctttcggtctcccacgccattcta

SEQ ID NO: 59368 - DNA, 36 bp, Artificial Sequence
  Synthetic oligonucleotide
gaacacgacaccctgtatcgcaactgcagattctta

SEQ ID NO: 59369 - DNA, 35 bp, Artificial Sequence
  Synthetic oligonucleotide
tacctggacaaggtaggcttttgccacagacttta

SEQ ID NO: 59370 - DNA, 37 bp, Artificial Sequence
  Synthetic oligonucleotide
aacaccgtaacccaccgcattcaagggccccatttta

SEQ ID NO: 59371 - DNA, 35 bp, Artificial Sequence
  Synthetic oligonucleotide
tgcacgccccccctcaccgatggcgttatgcgaac

SEQ ID NO: 59372 - DNA, 35 bp, Artificial Sequence
  Synthetic oligonucleotide
tacaccccattgattccaaatgacactgcccatac

SEQ ID NO: 59373 - DNA, 35 bp, Artificial Sequence
  Synthetic oligonucleotide
tgccatccccgtggaccgaaccgatcgttacctac

SEQ ID NO: 59374 - DNA, 35 bp, Artificial Sequence
  Synthetic oligonucleotide
gcccatcaacgcctggtctaccgtacacaccctac

SEQ ID NO: 59375 - DNA, 34 bp, Artificial Sequence
  Synthetic oligonucleotide
ggcgggtgccgcagtctccctgatatctaccccc

SEQ ID NO: 59376 - DNA, 35 bp, Artificial Sequence
  Synthetic oligonucleotide
tgtcgccgtacgttctgcttaggaattcattgccc

SEQ ID NO: 59377 - DNA, 35 bp, Artificial Sequence
  Synthetic oligonucleotide
caaccgcatgaatgtctgtccgcccaactgctccc

SEQ ID NO: 59378 - DNA, 35 bp, Artificial Sequence
  Synthetic oligonucleotide
gctaactggcttttacttgtgatctcactgctccc

SEQ ID NO: 59379 - DNA, 34 bp, Artificial Sequence
  Synthetic oligonucleotide
tgtcacacctcatcggttccgagcgtacacggcc

SEQ ID NO: 59380 - DNA, 35 bp, Artificial Sequence
  Synthetic oligonucleotide
gtgacggtagatttgctttgttctccctcgcaatc

SEQ ID NO: 59381 - DNA, 35 bp, Artificial Sequence
  Synthetic oligonucleotide
tctgtacccgacccccccctcctctttgtagcatc

SEQ ID NO: 59382 - DNA, 35 bp, Artificial Sequence
  Synthetic oligonucleotide
tgcgcggttcatttaatgcctgctcgtcgccgctc

SEQ ID NO: 59383 - DNA, 35 bp, Artificial Sequence
  Synthetic oligonucleotide
gaatgctaagcaggagggcaggggagcgtctagtc

SEQ ID NO: 59384 - DNA, 35 bp, Artificial Sequence
  Synthetic oligonucleotide
agccatgagcccctccgtaacgttacgccgccaag

SEQ ID NO: 59385 - DNA, 35 bp, Artificial Sequence
  Synthetic oligonucleotide
tcacaccatactcgttatgtcaaccgtctcccacg

SEQ ID NO: 59386 - DNA, 35 bp, Artificial Sequence
  Synthetic oligonucleotide
tacctcgacaccaccgcttatgacgcgtctggacg

SEQ ID NO: 59387 - DNA, 35 bp, Artificial Sequence
  Synthetic oligonucleotide
aaggaccacctcttacaccccccggattgggaccg

SEQ ID NO: 59388 - DNA, 35 bp, Artificial Sequence
  Synthetic oligonucleotide
tgcccacagtccaactgcccgtcaattccggccat

SEQ ID NO: 59389 - DNA, 35 bp, Artificial Sequence
  Synthetic oligonucleotide
tgatgtcagaccgagttcgtactctgacactacct

SEQ ID NO: 59390 - DNA, 35 bp, Artificial Sequence
  Synthetic oligonucleotide
tgatcgacatgcccaatcacgccccgtcgttgcct

SEQ ID NO: 59391 - DNA, 35 bp, Artificial Sequence
  Synthetic oligonucleotide
gaacacccgtagcccaccgatgggctgaccccgct

SEQ ID NO: 59392 - DNA, 35 bp, Artificial Sequence
  Synthetic oligonucleotide
acgcgtgagcgcaatcatttctgcgtaatctatct

SEQ ID NO: 59393 - DNA, 35 bp, Artificial Sequence
  Synthetic oligonucleotide
tacgcaacctcaccagcgcgcggaacgggatctct

SEQ ID NO: 59394 - DNA, 35 bp, Artificial Sequence
  Synthetic oligonucleotide
aaccccaggcggctttccaaacacttctctcgtct

SEQ ID NO: 59395 - DNA, 35 bp, Artificial Sequence
  Synthetic oligonucleotide
gcattgtcactgcggcatccagatcaaccccccgt

SEQ ID NO: 59396 - DNA, 35 bp, Artificial Sequence
  Synthetic oligonucleotide
tacgtgggtcgcacgttcctatccctttatccggt

SEQ ID NO: 59397 - DNA, 35 bp, Artificial Sequence
  Synthetic oligonucleotide
accagtgagcctcacaccggagtactatcaatatt

SEQ ID NO: 59398 - DNA, 35 bp, Artificial Sequence
  Synthetic oligonucleotide
tcactgcctgttctcgctcctacgttgactaggtt

SEQ ID NO: 59399 - DNA, 36 bp, Artificial Sequence
  Synthetic oligonucleotide
gccgggccagcagggaaaagaaagtggtgcggaaaa

SEQ ID NO: 59400 - DNA, 36 bp, Artificial Sequence
  Synthetic oligonucleotide
gtagagtacggggggggaatcagaggacgtgtcaaa

SEQ ID NO: 59401 - DNA, 36 bp, Artificial Sequence
  Synthetic oligonucleotide
taccatccggtcagtcattcacctcaccgtccgaaa

SEQ ID NO: 59402 - DNA, 35 bp, Artificial Sequence
  Synthetic oligonucleotide
atgggtagggacgatggagcaaatggtggggtaaa

SEQ ID NO: 59403 - DNA, 36 bp, Artificial Sequence
  Synthetic oligonucleotide
gtgtcgcatcctgggctctactcatgctttgtgcaa

SEQ ID NO: 59404 - DNA, 36 bp, Artificial Sequence
  Synthetic oligonucleotide
gccataccctgtttgccatcgaatctttatcacgaa

SEQ ID NO: 59405 - DNA, 36 bp, Artificial Sequence
  Synthetic oligonucleotide
gtcggagagaggagcgaatcacactcaggggggaca

SEQ ID NO: 59406 - DNA, 36 bp, Artificial Sequence
  Synthetic oligonucleotide
gactgccataaggcgagtactacaatgctacttaca

SEQ ID NO: 59407 - DNA, 35 bp, Artificial Sequence
  Synthetic oligonucleotide
aacgccaacaaaccggctccatgctccaggtacca

SEQ ID NO: 59408 - DNA, 36 bp, Artificial Sequence
  Synthetic oligonucleotide
acgtgcactgccgaaccttggctcgtcttaagccca

SEQ ID NO: 59409 - DNA, 35 bp, Artificial Sequence
  Synthetic oligonucleotide
tcccaccggacacaaattcaatctcgacccatcca

SEQ ID NO: 59410 - DNA, 35 bp, Artificial Sequence
  Synthetic oligonucleotide
atgtcccaccctcgatgctggttaccattccagca

SEQ ID NO: 59411 - DNA, 35 bp, Artificial Sequence
  Synthetic oligonucleotide
ttgctgtcttggccgcacccaccacccgtatggca

SEQ ID NO: 59412 - DNA, 36 bp, Artificial Sequence
  Synthetic oligonucleotide
ttatacccgactctacaatgattactgtgcctggca

SEQ ID NO: 59413 - DNA, 36 bp, Artificial Sequence
  Synthetic oligonucleotide
tgcacacgccccctgtcgccatccattcactttgca

SEQ ID NO: 59414 - DNA, 37 bp, Artificial Sequence
  Synthetic oligonucleotide
aatgtagcgtagcccatgtcatcctacaccatcaaga

SEQ ID NO: 59415 - DNA, 37 bp, Artificial Sequence
  Synthetic oligonucleotide
tacacatcagacaagactggacactggtactcgcaga

SEQ ID NO: 59416 - DNA, 35 bp, Artificial Sequence
  Synthetic oligonucleotide
gaaagtgggaggggacggcgacaaaacggttgaga

SEQ ID NO: 59417 - DNA, 37 bp, Artificial Sequence
  Synthetic oligonucleotide
aacactgtacccactgacctctgactatccagaacga

SEQ ID NO: 59418 - DNA, 35 bp, Artificial Sequence
  Synthetic oligonucleotide
gcgaagccccatgtccggtagcttcggccccccga

SEQ ID NO: 59419 - DNA, 38 bp, Artificial Sequence
  Synthetic oligonucleotide
actaccgtcgggccggtcccacctattcgttcccccga

SEQ ID NO: 59420 - DNA, 36 bp, Artificial Sequence
  Synthetic oligonucleotide
gatcgaaagggagcatatggggcgggaaggccgcga

SEQ ID NO: 59421 - DNA, 37 bp, Artificial Sequence
  Synthetic oligonucleotide
gacggtgaaagaaaggtatgggaagggtgcgcctcga

SEQ ID NO: 59422 - DNA, 37 bp, Artificial Sequence
  Synthetic oligonucleotide
tctaacccgccgcctcttgagccagcacagtcaagga

SEQ ID NO: 59423 - DNA, 37 bp, Artificial Sequence
  Synthetic oligonucleotide
gatgcagggaatgaggaagacgggtgtggccggagga

SEQ ID NO: 59424 - DNA, 37 bp, Artificial Sequence
  Synthetic oligonucleotide
aaatggggcagaatttggacaggggcgccgggtagga

SEQ ID NO: 59425 - DNA, 37 bp, Artificial Sequence
  Synthetic oligonucleotide
tcgatggacaatttggcacggggacggataacgggga

SEQ ID NO: 59426 - DNA, 36 bp, Artificial Sequence
  Synthetic oligonucleotide
atgtaggaggaatagatggaggtttgtgggatggga

SEQ ID NO: 59427 - DNA, 37 bp, Artificial Sequence
  Synthetic oligonucleotide
gccctccacctgcctatataatgtaaagcaccatgga

SEQ ID NO: 59428 - DNA, 36 bp, Artificial Sequence
  Synthetic oligonucleotide
atccaacgaccctgcttatccagattcactcatgga

SEQ ID NO: 59429 - DNA, 37 bp, Artificial Sequence
  Synthetic oligonucleotide
gcaatggtggggccgtagcggggggcgaggctttgga

SEQ ID NO: 59430 - DNA, 38 bp, Artificial Sequence
  Synthetic oligonucleotide
gtcgcatgcattccaactctcacgtgctacaccaatga

SEQ ID NO: 59431 - DNA, 37 bp, Artificial Sequence
  Synthetic oligonucleotide
gctcccctcttgcgtactgaccccgtcccaaatatga

SEQ ID NO: 59432 - DNA, 38 bp, Artificial Sequence
  Synthetic oligonucleotide
ggttggggacattggcggaaaaacgggaggcattatga

SEQ ID NO: 59433 - DNA, 38 bp, Artificial Sequence
  Synthetic oligonucleotide
gtatcagcccctgctggatgtacgccccttctttatga

SEQ ID NO: 59434 - DNA, 36 bp, Artificial Sequence
  Synthetic oligonucleotide
ttagcaccatcccttacgcggcgttcgtattcctga

SEQ ID NO: 59435 - DNA, 38 bp, Artificial Sequence
  Synthetic oligonucleotide
gtctgccccgctcacgagttaattattaccccctctga

SEQ ID NO: 59436 - DNA, 38 bp, Artificial Sequence
  Synthetic oligonucleotide
gccattgcttcccactgggctttatttgccaattctga

SEQ ID NO: 59437 - DNA, 37 bp, Artificial Sequence
  Synthetic oligonucleotide
atcgacactcttgattttcttgccatcccggacgtga

SEQ ID NO: 59438 - DNA, 38 bp, Artificial Sequence
  Synthetic oligonucleotide
gcgtacgcctatgacccaatcccgcttcgcctacgtga

SEQ ID NO: 59439 - DNA, 38 bp, Artificial Sequence
  Synthetic oligonucleotide
gacgcctcatgtttacgttcacgtcttttttccggtga

SEQ ID NO: 59440 - DNA, 37 bp, Artificial Sequence
  Synthetic oligonucleotide
gcgtgatcggaggaaaggaaagtgtgggcacgggtga

SEQ ID NO: 59441 - DNA, 37 bp, Artificial Sequence
  Synthetic oligonucleotide
tgagttgggtgggaatatgcggaggaatgtaatgtga

SEQ ID NO: 59442 - DNA, 37 bp, Artificial Sequence
  Synthetic oligonucleotide
tgtcacgggagtgagtcgtatgtgtaggttgcattga

SEQ ID NO: 59443 - DNA, 36 bp, Artificial Sequence
  Synthetic oligonucleotide
gtccccccggacggttatatctccatttaatgttga

SEQ ID NO: 59444 - DNA, 38 bp, Artificial Sequence
  Synthetic oligonucleotide
tgtccacatcctttgttttgacatgaagcaccttttga

SEQ ID NO: 59445 - DNA, 36 bp, Artificial Sequence
  Synthetic oligonucleotide
acaccgttaactccgtctatctcctgtttggcaata

SEQ ID NO: 59446 - DNA, 36 bp, Artificial Sequence
  Synthetic oligonucleotide
aagcccgcaggacacgttctacctataccaatacta

SEQ ID NO: 59447 - DNA, 36 bp, Artificial Sequence
  Synthetic oligonucleotide
gttgacgcgctatgagtcctacgcttcatataccta

SEQ ID NO: 59448 - DNA, 35 bp, Artificial Sequence
  Synthetic oligonucleotide
taacacgggcggaatgggggcaataaagaactaac

SEQ ID NO: 59449 - DNA, 35 bp, Artificial Sequence
  Synthetic oligonucleotide
tcaagcacacacgcctcacgccctcgccttgccac

SEQ ID NO: 59450 - DNA, 35 bp, Artificial Sequence
  Synthetic oligonucleotide
aatccacagttcaaatctctcctgctcacgcgacc

SEQ ID NO: 59451 - DNA, 35 bp, Artificial Sequence
  Synthetic oligonucleotide
acccctcatatcttgggcaattagtaacccctacc

SEQ ID NO: 59452 - DNA, 35 bp, Artificial Sequence
  Synthetic oligonucleotide
gcattcgaaacctccccgcgaccgattatttgccc

SEQ ID NO: 59453 - DNA, 35 bp, Artificial Sequence
  Synthetic oligonucleotide
acccatcgaaatgttacgcatcacacttacaagcc

SEQ ID NO: 59454 - DNA, 35 bp, Artificial Sequence
  Synthetic oligonucleotide
agtgcaccccagttttcaacgtgccttgattgtcc

SEQ ID NO: 59455 - DNA, 35 bp, Artificial Sequence
  Synthetic oligonucleotide
acgatactcgaacggtcacctgtacgtcccttggc

SEQ ID NO: 59456 - DNA, 35 bp, Artificial Sequence
  Synthetic oligonucleotide
gtgccctgcacgcattccgtagacccgttcccatc

SEQ ID NO: 59457 - DNA, 35 bp, Artificial Sequence
  Synthetic oligonucleotide
gatgaccccacctggataaggcggcgaacgtactc

SEQ ID NO: 59458 - DNA, 35 bp, Artificial Sequence
  Synthetic oligonucleotide
gcctgtcccactggtggaaacgctttcattccctc

SEQ ID NO: 59459 - DNA, 35 bp, Artificial Sequence
  Synthetic oligonucleotide
agcccgccaaactcgccgtggggctaaaattgctc

SEQ ID NO: 59460 - DNA, 35 bp, Artificial Sequence
  Synthetic oligonucleotide
gagttagcaccccatcgcttttgttagatctggtc

SEQ ID NO: 59461 - DNA, 35 bp, Artificial Sequence
  Synthetic oligonucleotide
gagctgtcctggcctgtaaccaaactttttcttag

SEQ ID NO: 59462 - DNA, 36 bp, Artificial Sequence
  Synthetic oligonucleotide
tcactcgaaagagatcgtcattcctgctctacccgg

SEQ ID NO: 59463 - DNA, 35 bp, Artificial Sequence
  Synthetic oligonucleotide
gattgccatacccagctacccacccgttctctctg

SEQ ID NO: 59464 - DNA, 35 bp, Artificial Sequence
  Synthetic oligonucleotide
tagcccttgccatcctaccgagatcactttcacgt

SEQ ID NO: 59465 - DNA, 35 bp, Artificial Sequence
  Synthetic oligonucleotide
gatcagaaggggtagtgcatgatatatgacaaggt

SEQ ID NO: 59466 - DNA, 35 bp, Artificial Sequence
  Synthetic oligonucleotide
tgctcaatcgccagcaccggtctctcatacatatt

SEQ ID NO: 59467 - DNA, 35 bp, Artificial Sequence
  Synthetic oligonucleotide
gagagttgcctgcgaatcagccgttcccatccttt

SEQ ID NO: 59468 - DNA, 35 bp, Artificial Sequence
  Synthetic oligonucleotide
tattcccgtctggccgcccccccttagtgcgcttt

SEQ ID NO: 59469 - DNA, 35 bp, Artificial Sequence
  Synthetic oligonucleotide
gcacggcctcatttaagtatccccttccactgttt

SEQ ID NO: 59470 - DNA, 36 bp, Artificial Sequence
  Synthetic oligonucleotide
gtccatttccagctcctgcgctccatcgttgcagaa

SEQ ID NO: 59471 - DNA, 36 bp, Artificial Sequence
  Synthetic oligonucleotide
cccactgtagtgactactcgccgtgccccgtttaca

SEQ ID NO: 59472 - DNA, 35 bp, Artificial Sequence
  Synthetic oligonucleotide
gagcgatcaaccggtactaccgctccttactccca

SEQ ID NO: 59473 - DNA, 36 bp, Artificial Sequence
  Synthetic oligonucleotide
gccaaccacgaaatgctttgtcgcagtctcatgcca

SEQ ID NO: 59474 - DNA, 36 bp, Artificial Sequence
  Synthetic oligonucleotide
tagcctccaccgagcgtggttcctcgtgggcctcca

SEQ ID NO: 59475 - DNA, 35 bp, Artificial Sequence
  Synthetic oligonucleotide
acgattcgcccagggcattaagtcctatcattgca

SEQ ID NO: 59476 - DNA, 36 bp, Artificial Sequence
  Synthetic oligonucleotide
ggacaagccgcaaaattcttattggcccatgtatca

SEQ ID NO: 59477 - DNA, 37 bp, Artificial Sequence
  Synthetic oligonucleotide
actctcaagcagtctgacaggtagggggctggaaaga

SEQ ID NO: 59478 - DNA, 37 bp, Artificial Sequence
  Synthetic oligonucleotide
atagtaccgggggagaagggttagtgacttgtgtaga

SEQ ID NO: 59479 - DNA, 36 bp, Artificial Sequence
  Synthetic oligonucleotide
tcatgtgcgctttcctgtctccctgtggcccttaga

SEQ ID NO: 59480 - DNA, 37 bp, Artificial Sequence
  Synthetic oligonucleotide
tcatgctcggttatgtcatccatcctccctcaaacga

SEQ ID NO: 59481 - DNA, 37 bp, Artificial Sequence
  Synthetic oligonucleotide
acgagcccttacacctttcatttttcgtagtccacga

SEQ ID NO: 59482 - DNA, 37 bp, Artificial Sequence
  Synthetic oligonucleotide
ttcggggagccgaaacccgaggaaaggtgaagaccga

SEQ ID NO: 59483 - DNA, 36 bp, Artificial Sequence
  Synthetic oligonucleotide
tgcaccttcgcaatagcaacttcctgccgctaccga

SEQ ID NO: 59484 - DNA, 37 bp, Artificial Sequence
  Synthetic oligonucleotide
accgagtcacctgtacccctccgcgcactagctccga

SEQ ID NO: 59485 - DNA, 37 bp, Artificial Sequence
  Synthetic oligonucleotide
agtgtgggggaaaggttaaaacatacgtgagtcgcga

SEQ ID NO: 59486 - DNA, 36 bp, Artificial Sequence
  Synthetic oligonucleotide
tgatgccactccggatcaccaatgcactgatttcga

SEQ ID NO: 59487 - DNA, 36 bp, Artificial Sequence
  Synthetic oligonucleotide
gatggagagggccggccacagaacagaacataagga

SEQ ID NO: 59488 - DNA, 37 bp, Artificial Sequence
  Synthetic oligonucleotide
gcgagaaggagggaagtcttacgaggagtgtgcggga

SEQ ID NO: 59489 - DNA, 37 bp, Artificial Sequence
  Synthetic oligonucleotide
taagggctggtggaaccttacaaggaaatggagggga

SEQ ID NO: 59490 - DNA, 37 bp, Artificial Sequence
  Synthetic oligonucleotide
atcacctgattgccttctgtcgtttatttgcctggga

SEQ ID NO: 59491 - DNA, 37 bp, Artificial Sequence
  Synthetic oligonucleotide
gggacgaacgtaaacctaacaaggagaggagactgga

SEQ ID NO: 59492 - DNA, 38 bp, Artificial Sequence
  Synthetic oligonucleotide
atgggatggagggaaggtagggaggcggttccccgtga

SEQ ID NO: 59493 - DNA, 36 bp, Artificial Sequence
  Synthetic oligonucleotide
gctacgccaacactcgtacgtatgcttaaccattga

SEQ ID NO: 59494 - DNA, 38 bp, Artificial Sequence
  Synthetic oligonucleotide
gacctgagccagtttgcgtttgggtcctcgtggtttga

SEQ ID NO: 59495 - DNA, 36 bp, Artificial Sequence
  Synthetic oligonucleotide
gcttggaacccgtctcctcgacttttcagttgccta

SEQ ID NO: 59496 - DNA, 35 bp, Artificial Sequence
  Synthetic oligonucleotide
attgtgaaacacctctccgtgcccgttcacgtcta

SEQ ID NO: 59497 - DNA, 36 bp, Artificial Sequence
  Synthetic oligonucleotide
gaaacagcgacagtcaccacccgactagcacaagta

SEQ ID NO: 59498 - DNA, 35 bp, Artificial Sequence
  Synthetic oligonucleotide
tttatgcctcgcccgccacagtccctgcgtagtta

SEQ ID NO: 59499 - DNA, 36 bp, Artificial Sequence
  Synthetic oligonucleotide
gcctgccatagcccttcgacttccttgtttacgtta

SEQ ID NO: 59500 - DNA, 35 bp, Artificial Sequence
  Synthetic oligonucleotide
gaaccaacacacagtgaaacgctaaggaactatac

SEQ ID NO: 59501 - DNA, 35 bp, Artificial Sequence
  Synthetic oligonucleotide
tgcctgtccatttacacatgatcgaagttcccacc

SEQ ID NO: 59502 - DNA, 35 bp, Artificial Sequence
  Synthetic oligonucleotide
gcctggacgcgattatactcgccttagcaccaccc

SEQ ID NO: 59503 - DNA, 35 bp, Artificial Sequence
  Synthetic oligonucleotide
aacgccctgtaagcacctttctgcagacactaccc

SEQ ID NO: 59504 - DNA, 35 bp, Artificial Sequence
  Synthetic oligonucleotide
ggatgccgagcatggcgtaggggactggttagccc

SEQ ID NO: 59505 - DNA, 35 bp, Artificial Sequence
  Synthetic oligonucleotide
gtaatccacaccactcgccgagtgtccgtaatccc

SEQ ID NO: 59506 - DNA, 35 bp, Artificial Sequence
  Synthetic oligonucleotide
actgcagtgcaaccgctgtttcttgtctatgtccc

SEQ ID NO: 59507 - DNA, 35 bp, Artificial Sequence
  Synthetic oligonucleotide
ttgtcatctctgtagtggtttcattcagtcgctcc

SEQ ID NO: 59508 - DNA, 35 bp, Artificial Sequence
  Synthetic oligonucleotide
cccccgccctgtatacccaccgcacctttttacgc

SEQ ID NO: 59509 - DNA, 35 bp, Artificial Sequence
  Synthetic oligonucleotide
gctcctccataccgaagcgttatctaacgcgttgc

SEQ ID NO: 59510 - DNA, 35 bp, Artificial Sequence
  Synthetic oligonucleotide
gtgatccagtgggctccgttgtcaatattcacctc

SEQ ID NO: 59511 - DNA, 35 bp, Artificial Sequence
  Synthetic oligonucleotide
agattgcgtcccagctcatttttaacgattgattc

SEQ ID NO: 59512 - DNA, 35 bp, Artificial Sequence
  Synthetic oligonucleotide
tctaattgccatccgagcagcccccctacatagag

SEQ ID NO: 59513 - DNA, 35 bp, Artificial Sequence
  Synthetic oligonucleotide
gccatggcacccagtacgccttataaacccccacg

SEQ ID NO: 59514 - DNA, 35 bp, Artificial Sequence
  Synthetic oligonucleotide
tttgcactgaccttgctgtggtttcactgtccccg

SEQ ID NO: 59515 - DNA, 35 bp, Artificial Sequence
  Synthetic oligonucleotide
acacaggtcactcaacgtcaacacccacaaagagg

SEQ ID NO: 59516 - DNA, 35 bp, Artificial Sequence
  Synthetic oligonucleotide
gtaggggcgggtagaggcagcaaaaatctgtaggg

SEQ ID NO: 59517 - DNA, 35 bp, Artificial Sequence
  Synthetic oligonucleotide
accaacaaccaggttaatgatcttgcccatttctg

SEQ ID NO: 59518 - DNA, 35 bp, Artificial Sequence
  Synthetic oligonucleotide
acagcctgcagccccacggctctcacgctctcttg

SEQ ID NO: 59519 - DNA, 35 bp, Artificial Sequence
  Synthetic oligonucleotide
acattcccgcccattggacacgaagcctcccacat

SEQ ID NO: 59520 - DNA, 35 bp, Artificial Sequence
  Synthetic oligonucleotide
ttcccgttactggcctccaatgagcctcgattcat

SEQ ID NO: 59521 - DNA, 35 bp, Artificial Sequence
  Synthetic oligonucleotide
gtgcaccaatggctccacaactccccggattgact

SEQ ID NO: 59522 - DNA, 35 bp, Artificial Sequence
  Synthetic oligonucleotide
atcatcctcgcactgagatggtccgtacttgccct

SEQ ID NO: 59523 - DNA, 34 bp, Artificial Sequence
  Synthetic oligonucleotide
tcatcagcgattaaactgcttattcaaccctgct

SEQ ID NO: 59524 - DNA, 35 bp, Artificial Sequence
  Synthetic oligonucleotide
tgctgccaagcaagggaagaatactagggaatagt

SEQ ID NO: 59525 - DNA, 35 bp, Artificial Sequence
  Synthetic oligonucleotide
gcgtaccaccacgcaatctaatgtacgcgatcctt

SEQ ID NO: 59526 - DNA, 35 bp, Artificial Sequence
  Synthetic oligonucleotide
aatccctgcatggcgcacctcgagtgtctctcctt

SEQ ID NO: 59527 - DNA, 35 bp, Artificial Sequence
  Synthetic oligonucleotide
aacagggtggtcggttgaagatgggggttgcgctt

SEQ ID NO: 59528 - DNA, 35 bp, Artificial Sequence
  Synthetic oligonucleotide
ggtgctgatccacccctgcagctttgtttccattt

SEQ ID NO: 59529 - DNA, 35 bp, Artificial Sequence
  Synthetic oligonucleotide
tgtcactgtacaacttgttgactcattccttcttt

SEQ ID NO: 59530 - DNA, 36 bp, Artificial Sequence
  Synthetic oligonucleotide
atcacacccgtatgcgaccgcacgagtcttccccaa

SEQ ID NO: 59531 - DNA, 35 bp, Artificial Sequence
  Synthetic oligonucleotide
tcgctaccacgcgggcaaccaccgacaatacgcaa

SEQ ID NO: 59532 - DNA, 36 bp, Artificial Sequence
  Synthetic oligonucleotide
gtcccgccccagtcgatttctgcgttctgtttgcaa

SEQ ID NO: 59533 - DNA, 36 bp, Artificial Sequence
  Synthetic oligonucleotide
gacacccgaaggtacgcgtaaaagtgcgcgcttcaa

SEQ ID NO: 59534 - DNA, 35 bp, Artificial Sequence
  Synthetic oligonucleotide
tgacggtgggcgcataaagcaaaaggctaaaggaa

SEQ ID NO: 59535 - DNA, 36 bp, Artificial Sequence
  Synthetic oligonucleotide
gacttgccatcacacagcctcactcagtctactgaa

SEQ ID NO: 59536 - DNA, 35 bp, Artificial Sequence
  Synthetic oligonucleotide
agacgtcctccctgggcgatatttcacttctctaa

SEQ ID NO: 59537 - DNA, 35 bp, Artificial Sequence
  Synthetic oligonucleotide
aacacccttctgcttacaggtttcgttcgtcgtaa

SEQ ID NO: 59538 - DNA, 37 bp, Artificial Sequence
  Synthetic oligonucleotide
ttgtggccctacagctccatgcttcttccatgtacca

SEQ ID NO: 59539 - DNA, 36 bp, Artificial Sequence
  Synthetic oligonucleotide
gtcttcggtgcagacgttatctgccgcccctcgcca

SEQ ID NO: 59540 - DNA, 36 bp, Artificial Sequence
  Synthetic oligonucleotide
agtgactgtcatccgatttcgctacgctagcctcca

SEQ ID NO: 59541 - DNA, 36 bp, Artificial Sequence
  Synthetic oligonucleotide
tccatgtgggggaagggaagctgtgtacgttctcca

SEQ ID NO: 59542 - DNA, 36 bp, Artificial Sequence
  Synthetic oligonucleotide
gacagagaggtgacgggcatagcgtgagggaatgca

SEQ ID NO: 59543 - DNA, 36 bp, Artificial Sequence
  Synthetic oligonucleotide
gaccacttgctactcatcctgttggttactgaatca

SEQ ID NO: 59544 - DNA, 34 bp, Artificial Sequence
  Synthetic oligonucleotide
gcatccacattcaccgatcatcacgtagggctca

SEQ ID NO: 59545 - DNA, 36 bp, Artificial Sequence
  Synthetic oligonucleotide
gttcacgcctggcatagtcgcaccgctcttatctca

SEQ ID NO: 59546 - DNA, 37 bp, Artificial Sequence
  Synthetic oligonucleotide
gcaccaccatcaaataagcgttgttagacccatcaga

SEQ ID NO: 59547 - DNA, 37 bp, Artificial Sequence
  Synthetic oligonucleotide
gctgacaactccgaactgtcattatattacctcacga

SEQ ID NO: 59548 - DNA, 37 bp, Artificial Sequence
  Synthetic oligonucleotide
actatcgcctctacgctccttattgtgatgcccccga

SEQ ID NO: 59549 - DNA, 37 bp, Artificial Sequence
  Synthetic oligonucleotide
tgctatgccgcgagcccgtgccaaattccctgcccga

SEQ ID NO: 59550 - DNA, 37 bp, Artificial Sequence
  Synthetic oligonucleotide
gattcacgcgccttacccccccggactcccattccga

SEQ ID NO: 59551 - DNA, 37 bp, Artificial Sequence
  Synthetic oligonucleotide
tgtgaactcaggggatggaaaatgatcgtataggcga

SEQ ID NO: 59552 - DNA, 37 bp, Artificial Sequence
  Synthetic oligonucleotide
atgtaccaacatctgctgataagccctatcgcttcga

SEQ ID NO: 59553 - DNA, 37 bp, Artificial Sequence
  Synthetic oligonucleotide
gtggaggcacacagctacccagacccccgcacgagga

SEQ ID NO: 59554 - DNA, 37 bp, Artificial Sequence
  Synthetic oligonucleotide
gagcgggatgggtgggccgctgaatacgcaaaaggga

SEQ ID NO: 59555 - DNA, 37 bp, Artificial Sequence
  Synthetic oligonucleotide
aataatgaagtaaatggggacgggaaagctgggggga

SEQ ID NO: 59556 - DNA, 37 bp, Artificial Sequence
  Synthetic oligonucleotide
acaataggcgtgctggggacggggcattgatggggga

SEQ ID NO: 59557 - DNA, 37 bp, Artificial Sequence
  Synthetic oligonucleotide
gatcgctaagtgggtgggaaatcatggaagatgggga

SEQ ID NO: 59558 - DNA, 37 bp, Artificial Sequence
  Synthetic oligonucleotide
gggtccgctccgggggtggggttccgaacgttgggga

SEQ ID NO: 59559 - DNA, 37 bp, Artificial Sequence
  Synthetic oligonucleotide
agtggaagggacggggggctgcagttggcatgatgga

SEQ ID NO: 59560 - DNA, 37 bp, Artificial Sequence
  Synthetic oligonucleotide
gagggaggtgggaggcgtggcggagacggtatctgga

SEQ ID NO: 59561 - DNA, 37 bp, Artificial Sequence
  Synthetic oligonucleotide
gtgccgcagacgttagcactccctttttcgtcaatga

SEQ ID NO: 59562 - DNA, 38 bp, Artificial Sequence
  Synthetic oligonucleotide
tccgtacgcttccatcgctaggaaccattcctccatga

SEQ ID NO: 59563 - DNA, 38 bp, Artificial Sequence
  Synthetic oligonucleotide
ttgcctgtgcggtccgcctaatgctacccctctcatga

SEQ ID NO: 59564 - DNA, 38 bp, Artificial Sequence
  Synthetic oligonucleotide
gagcgtgctgcagtattatcacatcctgtcttggatga

SEQ ID NO: 59565 - DNA, 38 bp, Artificial Sequence
  Synthetic oligonucleotide
accgtggacctccttatctgtgctatcgtgatttatga

SEQ ID NO: 59566 - DNA, 38 bp, Artificial Sequence
  Synthetic oligonucleotide
taccacgcctcctttttcgatttgttctgtctcactga

SEQ ID NO: 59567 - DNA, 38 bp, Artificial Sequence
  Synthetic oligonucleotide
ttggacggtcgccccggggccctgttatatcctactga

SEQ ID NO: 59568 - DNA, 38 bp, Artificial Sequence
  Synthetic oligonucleotide
aagcatcatcggcacatcccaacacctgtcagccctga

SEQ ID NO: 59569 - DNA, 38 bp, Artificial Sequence
  Synthetic oligonucleotide
tcaccgtgcatccgccgctgaggctcactcatccctga

SEQ ID NO: 59570 - DNA, 38 bp, Artificial Sequence
  Synthetic oligonucleotide
taaacgccggccatcagcgacttacgtacatctcctga

SEQ ID NO: 59571 - DNA, 38 bp, Artificial Sequence
  Synthetic oligonucleotide
tcaccttccactcagtttatcagcgtcatgtacgctga

SEQ ID NO: 59572 - DNA, 36 bp, Artificial Sequence
  Synthetic oligonucleotide
accgcaagggggggaaaggggaatcttaactgctga

SEQ ID NO: 59573 - DNA, 38 bp, Artificial Sequence
  Synthetic oligonucleotide
gtacgccctcggcttgcgatacgacaccgccctgctga

SEQ ID NO: 59574 - DNA, 38 bp, Artificial Sequence
  Synthetic oligonucleotide
atcgcgaccctatctgccatatgcatttttctttctga

SEQ ID NO: 59575 - DNA, 37 bp, Artificial Sequence
  Synthetic oligonucleotide
gagaatgatcagaaaaaacatggggagtgcggagtga

SEQ ID NO: 59576 - DNA, 37 bp, Artificial Sequence
  Synthetic oligonucleotide
gcctacatcttcaggcacgtaaactgactcgtagtga

SEQ ID NO: 59577 - DNA, 38 bp, Artificial Sequence
  Synthetic oligonucleotide
acgtggggcggcttgagggtgggcggagtgaatggtga

SEQ ID NO: 59578 - DNA, 38 bp, Artificial Sequence
  Synthetic oligonucleotide
acacctcgcatcattctgagcaatccgggttccattga

SEQ ID NO: 59579 - DNA, 37 bp, Artificial Sequence
  Synthetic oligonucleotide
ttgaatgccctctgcccgatgcaattatcatgcttga

SEQ ID NO: 59580 - DNA, 38 bp, Artificial Sequence
  Synthetic oligonucleotide
ttgcctcatgaactagctcctcctcgctcagctgttga

SEQ ID NO: 59581 - DNA, 38 bp, Artificial Sequence
  Synthetic oligonucleotide
gcatcccatcaatataatgcgcattgtttcttctttga

SEQ ID NO: 59582 - DNA, 37 bp, Artificial Sequence
  Synthetic oligonucleotide
accacctcgcccttgtccgccatcatgaaaattttga

SEQ ID NO: 59583 - DNA, 35 bp, Artificial Sequence
  Synthetic oligonucleotide
acccatccctacacgccatgacctcgcgataaata

SEQ ID NO: 59584 - DNA, 36 bp, Artificial Sequence
  Synthetic oligonucleotide
ggtggggcgggcgcgggttcaaggcctgggaacgta

SEQ ID NO: 59585 - DNA, 36 bp, Artificial Sequence
  Synthetic oligonucleotide
tccacatggtagcgcaccccaatcgccagcccatta

SEQ ID NO: 59586 - DNA, 35 bp, Artificial Sequence
  Synthetic oligonucleotide
ttccgaccattcaatcaactttgccataacagtac

SEQ ID NO: 59587 - DNA, 34 bp, Artificial Sequence
  Synthetic oligonucleotide
gcatatcctcacctgcagggactatactgccccc

SEQ ID NO: 59588 - DNA, 35 bp, Artificial Sequence
  Synthetic oligonucleotide
tgcacctcttgccgcccgcttgacatggtaagccc

SEQ ID NO: 59589 - DNA, 35 bp, Artificial Sequence
  Synthetic oligonucleotide
gcacccttggcttcttgtcgctgactaacacgccc

SEQ ID NO: 59590 - DNA, 35 bp, Artificial Sequence
  Synthetic oligonucleotide
tcccacgtcaccggtagatcacgcaaccataggcc

SEQ ID NO: 59591 - DNA, 35 bp, Artificial Sequence
  Synthetic oligonucleotide
tacaccactgtccgtctccccttccaagccctgcc

SEQ ID NO: 59592 - DNA, 35 bp, Artificial Sequence
  Synthetic oligonucleotide
tcgctggttcgtcctctggaccttttcgtaactcc

SEQ ID NO: 59593 - DNA, 35 bp, Artificial Sequence
  Synthetic oligonucleotide
aaatcatgttcaccgtcgcctctgccccgtagtcc

SEQ ID NO: 59594 - DNA, 35 bp, Artificial Sequence
  Synthetic oligonucleotide
acacccgttcagcgtaccaatggaatccaccgtcc

SEQ ID NO: 59595 - DNA, 36 bp, Artificial Sequence
  Synthetic oligonucleotide
acaggagggggattcgtgatgaaaaactgcaaactc

SEQ ID NO: 59596 - DNA, 35 bp, Artificial Sequence
  Synthetic oligonucleotide
agccacccggccccacgcgcacagtcgcagaactc

SEQ ID NO: 59597 - DNA, 35 bp, Artificial Sequence
  Synthetic oligonucleotide
atcaaccattccgccaagcgttgccagttctgctc

SEQ ID NO: 59598 - DNA, 35 bp, Artificial Sequence
  Synthetic oligonucleotide
ttagcccagctggttaattctctttgcctactctc

SEQ ID NO: 59599 - DNA, 35 bp, Artificial Sequence
  Synthetic oligonucleotide
gacgtaacgtcactattgatgtcccccttttcgtc

SEQ ID NO: 59600 - DNA, 35 bp, Artificial Sequence
  Synthetic oligonucleotide
gtcaacgtgcttacctattctttgtgccgtgggtc

SEQ ID NO: 59601 - DNA, 34 bp, Artificial Sequence
  Synthetic oligonucleotide
ttgactgcacctttgcactacgataccacacttc

SEQ ID NO: 59602 - DNA, 35 bp, Artificial Sequence
  Synthetic oligonucleotide
gagtgtcgcaaccacgccctctaagcctccccaag

SEQ ID NO: 59603 - DNA, 35 bp, Artificial Sequence
  Synthetic oligonucleotide
atggggcacgaagaggagaaaccgacggggtgcag

SEQ ID NO: 59604 - DNA, 35 bp, Artificial Sequence
  Synthetic oligonucleotide
aacgcgtgtatcccgttcgcccatcctcccatgag

SEQ ID NO: 59605 - DNA, 35 bp, Artificial Sequence
  Synthetic oligonucleotide
tcatcactgtcccgtaatccgtctgaatttctgag

SEQ ID NO: 59606 - DNA, 35 bp, Artificial Sequence
  Synthetic oligonucleotide
tccccactcagctcgccctgcatcagctgcatgcg

SEQ ID NO: 59607 - DNA, 35 bp, Artificial Sequence
  Synthetic oligonucleotide
aatacccacctaagcgtgcccgtgaccctgcttcg

SEQ ID NO: 59608 - DNA, 35 bp, Artificial Sequence
  Synthetic oligonucleotide
gagtaaagggggaagggggcaatgatctggttagg

SEQ ID NO: 59609 - DNA, 35 bp, Artificial Sequence
  Synthetic oligonucleotide
tagcctaacacctcacactgaggcccgccccccgg

SEQ ID NO: 59610 - DNA, 35 bp, Artificial Sequence
  Synthetic oligonucleotide
gaaatggtaaaggtgggaaaatacgaaagagcggg

SEQ ID NO: 59611 - DNA, 35 bp, Artificial Sequence
  Synthetic oligonucleotide
agtgatgaggagatggacattgcaggggggtgggg

SEQ ID NO: 59612 - DNA, 35 bp, Artificial Sequence
  Synthetic oligonucleotide
acgtattgcccacttcggagaacgcctttcttctg

SEQ ID NO: 59613 - DNA, 35 bp, Artificial Sequence
  Synthetic oligonucleotide
gaatgtctgcaccacaccttttacaaccgagcttg

SEQ ID NO: 59614 - DNA, 35 bp, Artificial Sequence
  Synthetic oligonucleotide
ttcgtcgccagaatacttgctctcttcccatgttg

SEQ ID NO: 59615 - DNA, 35 bp, Artificial Sequence
  Synthetic oligonucleotide
gtgcgaacaacacgattatttgggccacgttgaat

SEQ ID NO: 59616 - DNA, 35 bp, Artificial Sequence
  Synthetic oligonucleotide
acatctgtccggaacgggctacgagcaattcccat

SEQ ID NO: 59617 - DNA, 35 bp, Artificial Sequence
  Synthetic oligonucleotide
gagccaccgctcactttcaccgttccagccacact

SEQ ID NO: 59618 - DNA, 35 bp, Artificial Sequence
  Synthetic oligonucleotide
acgtccacccgccacccccccccgggtatgatact

SEQ ID NO: 59619 - DNA, 35 bp, Artificial Sequence
  Synthetic oligonucleotide
tcacttcccgtttttgatatacgtacacctctcgt

SEQ ID NO: 59620 - DNA, 34 bp, Artificial Sequence
  Synthetic oligonucleotide
gacacgacaaaaattgtgctgtaccaccgaatgt

SEQ ID NO: 59621 - DNA, 35 bp, Artificial Sequence
  Synthetic oligonucleotide
acaatccatgtacactgctgagcgattttgcctgt

SEQ ID NO: 59622 - DNA, 35 bp, Artificial Sequence
  Synthetic oligonucleotide
atgttggtgcgccttccgaattctgcctccccgtt

SEQ ID NO: 59623 - DNA, 35 bp, Artificial Sequence
  Synthetic oligonucleotide
gcccactcgcaattctacatgcatccaccgctgtt

SEQ ID NO: 59624 - DNA, 36 bp, Artificial Sequence
  Synthetic oligonucleotide
gaacaccatccagaacccctttttagtgcggtgaaa

SEQ ID NO: 59625 - DNA, 36 bp, Artificial Sequence
  Synthetic oligonucleotide
gcgactcctccatgtatcgttctccctgtttaacaa

SEQ ID NO: 59626 - DNA, 36 bp, Artificial Sequence
  Synthetic oligonucleotide
aacggtaagaaggggaggcggtaaagagtaagacaa

SEQ ID NO: 59627 - DNA, 35 bp, Artificial Sequence
  Synthetic oligonucleotide
cactatgtccgaagtgcgtaccatgctccatacaa

SEQ ID NO: 59628 - DNA, 36 bp, Artificial Sequence
  Synthetic oligonucleotide
atccccccccgcttcgtttttggatcggcccaaaca

SEQ ID NO: 59629 - DNA, 36 bp, Artificial Sequence
  Synthetic oligonucleotide
gacattcacccgggccttgcaaatgctggttccaca

SEQ ID NO: 59630 - DNA, 36 bp, Artificial Sequence
  Synthetic oligonucleotide
gcaccagggataaggttggaggggacgatacggaca

SEQ ID NO: 59631 - DNA, 36 bp, Artificial Sequence
  Synthetic oligonucleotide
attgtgcaggggatcgggaagcgggggcccgggaca

SEQ ID NO: 59632 - DNA, 36 bp, Artificial Sequence
  Synthetic oligonucleotide
gaacacagcacgcgccttggtccatggttgtcccca

SEQ ID NO: 59633 - DNA, 35 bp, Artificial Sequence
  Synthetic oligonucleotide
ataagccccgcccttgaccgtgttgtcccctgcca

SEQ ID NO: 59634 - DNA, 36 bp, Artificial Sequence
  Synthetic oligonucleotide
tcgttgcctagttcccgttgaccttgtacattgcca

SEQ ID NO: 59635 - DNA, 36 bp, Artificial Sequence
  Synthetic oligonucleotide
acctcggacctggatctggtaaattctacacacgca

SEQ ID NO: 59636 - DNA, 36 bp, Artificial Sequence
  Synthetic oligonucleotide
gaacggggcaatcggttcgtgtatttcctccgctca

SEQ ID NO: 59637 - DNA, 35 bp, Artificial Sequence
  Synthetic oligonucleotide
tttggacagacttgacgttgttggctctctcttca

SEQ ID NO: 59638 - DNA, 37 bp, Artificial Sequence
  Synthetic oligonucleotide
gcaacgtagcagagaaacaagcgtcatggtcacgaga

SEQ ID NO: 59639 - DNA, 37 bp, Artificial Sequence
  Synthetic oligonucleotide
gattgacgggtaaggggggatgggtcgcgaactacga

SEQ ID NO: 59640 - DNA, 37 bp, Artificial Sequence
  Synthetic oligonucleotide
atgattgtgcgcacttgctctttgtttccagtaccga

SEQ ID NO: 59641 - DNA, 36 bp, Artificial Sequence
  Synthetic oligonucleotide
ggtcccttgcacactgcccgtactccgccatcgcga

SEQ ID NO: 59642 - DNA, 37 bp, Artificial Sequence
  Synthetic oligonucleotide
taggtgtgtaaacggcctcctctcttccattgttcga

SEQ ID NO: 59643 - DNA, 37 bp, Artificial Sequence
  Synthetic oligonucleotide
gaccacggaaggtggaggaatgggagcgaaccacgga

SEQ ID NO: 59644 - DNA, 37 bp, Artificial Sequence
  Synthetic oligonucleotide
acacaacagtgtcggtaccagcctttctatatccgga

SEQ ID NO: 59645 - DNA, 37 bp, Artificial Sequence
  Synthetic oligonucleotide
ttcccacatcagctccccctgttccaccaagggcgga

SEQ ID NO: 59646 - DNA, 37 bp, Artificial Sequence
  Synthetic oligonucleotide
gtaagtgggggtggaaggaggggatggtcctccggga

SEQ ID NO: 59647 - DNA, 38 bp, Artificial Sequence
  Synthetic oligonucleotide
accgggcgaaggaggcaaattgaacacgggaaaaatga

SEQ ID NO: 59648 - DNA, 38 bp, Artificial Sequence
  Synthetic oligonucleotide
gagtacggcaaataggactcggcttgacaggataatga

SEQ ID NO: 59649 - DNA, 38 bp, Artificial Sequence
  Synthetic oligonucleotide
gagcaggggaacatgaggggcggacgcacagaatatga

SEQ ID NO: 59650 - DNA, 37 bp, Artificial Sequence
  Synthetic oligonucleotide
gtgatgcgacaccgttttccttgcctcatataactga

SEQ ID NO: 59651 - DNA, 37 bp, Artificial Sequence
  Synthetic oligonucleotide
atgtgcgggtgtattgtaatgtttttttttgccctga

SEQ ID NO: 59652 - DNA, 37 bp, Artificial Sequence
  Synthetic oligonucleotide
tgtgggacgtgtggtgcgtgggttggggggggcctga

SEQ ID NO: 59653 - DNA, 38 bp, Artificial Sequence
  Synthetic oligonucleotide
agtgccatccctcagtgctttcttgggcacaactctga

SEQ ID NO: 59654 - DNA, 37 bp, Artificial Sequence
  Synthetic oligonucleotide
aagtgccgggcatacaatcgttccagctcctacgtga

SEQ ID NO: 59655 - DNA, 38 bp, Artificial Sequence
  Synthetic oligonucleotide
tagctcgcgcatcacgttcccagttcggtccttcgtga

SEQ ID NO: 59656 - DNA, 36 bp, Artificial Sequence
  Synthetic oligonucleotide
gctggtaaacgggtggggtggtatgctgggcggtga

SEQ ID NO: 59657 - DNA, 38 bp, Artificial Sequence
  Synthetic oligonucleotide
tttccaccgccctttacgtctgctccgttgccctgtga

SEQ ID NO: 59658 - DNA, 36 bp, Artificial Sequence
  Synthetic oligonucleotide
gctgccaccgttaggttacgcctgttgctattgtga

SEQ ID NO: 59659 - DNA, 37 bp, Artificial Sequence
  Synthetic oligonucleotide
gtaacaacgcgttggtaacgcgacttcccccttgtga

SEQ ID NO: 59660 - DNA, 38 bp, Artificial Sequence
  Synthetic oligonucleotide
tcactcagctgtaccttacggccgttcttttccattga

SEQ ID NO: 59661 - DNA, 37 bp, Artificial Sequence
  Synthetic oligonucleotide
gctacatagcgctgatatcctcatacttacgccttga

SEQ ID NO: 59662 - DNA, 38 bp, Artificial Sequence
  Synthetic oligonucleotide
ccacgcaagtgccgtttccacctcgttgtcctagttga

SEQ ID NO: 59663 - DNA, 38 bp, Artificial Sequence
  Synthetic oligonucleotide
gacctgcacacctcccactcttcatgaacacgcgttga

SEQ ID NO: 59664 - DNA, 38 bp, Artificial Sequence
  Synthetic oligonucleotide
ttggtgtcctgcctcctaagccccctgtcttcgtttga

SEQ ID NO: 59665 - DNA, 36 bp, Artificial Sequence
  Synthetic oligonucleotide
tgcaaaggcacgacccttttaccaggtttcacgata

SEQ ID NO: 59666 - DNA, 35 bp, Artificial Sequence
  Synthetic oligonucleotide
gccaggccaccgggatttggcgttccatctatata

SEQ ID NO: 59667 - DNA, 36 bp, Artificial Sequence
  Synthetic oligonucleotide
ttgaccatttccgtgcctacactgggacagatacta

SEQ ID NO: 59668 - DNA, 35 bp, Artificial Sequence
  Synthetic oligonucleotide
tatcaggcacgtggaggggcgaaatggcggtggta

SEQ ID NO: 59669 - DNA, 36 bp, Artificial Sequence
  Synthetic oligonucleotide
gctcaccatgcccctgtcagtgctttcccggcctta

SEQ ID NO: 59670 - DNA, 36 bp, Artificial Sequence
  Synthetic oligonucleotide
gtccacctgcataaacctattacgctagttctctta

SEQ ID NO: 59671 - DNA, 35 bp, Artificial Sequence
  Synthetic oligonucleotide
gtggagaaaagccggataagggggagatggataac

SEQ ID NO: 59672 - DNA, 35 bp, Artificial Sequence
  Synthetic oligonucleotide
gccctcaccaccacatcacctgtcgctggacacac

SEQ ID NO: 59673 - DNA, 35 bp, Artificial Sequence
  Synthetic oligonucleotide
atccattcccgacggcgcctcacgacgcaacctac

SEQ ID NO: 59674 - DNA, 35 bp, Artificial Sequence
  Synthetic oligonucleotide
acgcactatccgttaagttcaatgatttttgcccc

SEQ ID NO: 59675 - DNA, 35 bp, Artificial Sequence
  Synthetic oligonucleotide
tcactgcccttgctgtaatattgccacgagggccc

SEQ ID NO: 59676 - DNA, 34 bp, Artificial Sequence
  Synthetic oligonucleotide
tcaaccttcgctcacacatacagtcgccgccgcc

SEQ ID NO: 59677 - DNA, 35 bp, Artificial Sequence
  Synthetic oligonucleotide
gtgtagctcacacccacatttgaaggttcttggcc

SEQ ID NO: 59678 - DNA, 35 bp, Artificial Sequence
  Synthetic oligonucleotide
gcacataagccgcctatagccaacggtcgctacgc

SEQ ID NO: 59679 - DNA, 35 bp, Artificial Sequence
  Synthetic oligonucleotide
ggaagggactacgggttatgggtggaagcgtgtgc

SEQ ID NO: 59680 - DNA, 35 bp, Artificial Sequence
  Synthetic oligonucleotide
tcgcactgcctcgacacgacctggaattttcttgc

SEQ ID NO: 59681 - DNA, 35 bp, Artificial Sequence
  Synthetic oligonucleotide
gacgaaccgcaacccgtagggacccaggtgacctc

SEQ ID NO: 59682 - DNA, 35 bp, Artificial Sequence
  Synthetic oligonucleotide
ttctcgagcgatctccttatatgccagctgccctc

SEQ ID NO: 59683 - DNA, 35 bp, Artificial Sequence
  Synthetic oligonucleotide
gatgagaggcgcctccccttgcaatatgtttcctc

SEQ ID NO: 59684 - DNA, 35 bp, Artificial Sequence
  Synthetic oligonucleotide
gccatgctccacggccctgctcctccgtcgtgctc

SEQ ID NO: 59685 - DNA, 35 bp, Artificial Sequence
  Synthetic oligonucleotide
agctgacgatggcgcatttgctcgatctgattctc

SEQ ID NO: 59686 - DNA, 35 bp, Artificial Sequence
  Synthetic oligonucleotide
tgacccacttgcatctctacgctcgaagcttagtc

SEQ ID NO: 59687 - DNA, 35 bp, Artificial Sequence
  Synthetic oligonucleotide
gatcggaagaacgcgtctaatccaatcttcccttc

SEQ ID NO: 59688 - DNA, 35 bp, Artificial Sequence
  Synthetic oligonucleotide
gaaaccaatcggatgctccgccacggtccgccttc

SEQ ID NO: 59689 - DNA, 34 bp, Artificial Sequence
  Synthetic oligonucleotide
gtgtgatccttacgctatccctccgccggttttc

SEQ ID NO: 59690 - DNA, 35 bp, Artificial Sequence
  Synthetic oligonucleotide
accgtaccaccctagcctaaactttccgctatcag

SEQ ID NO: 59691 - DNA, 35 bp, Artificial Sequence
  Synthetic oligonucleotide
agacaagtgtgaggtaaggaaaggagtggtagtag

SEQ ID NO: 59692 - DNA, 35 bp, Artificial Sequence
  Synthetic oligonucleotide
acgaccaatgttccccttctcttcgttactgagcg

SEQ ID NO: 59693 - DNA, 35 bp, Artificial Sequence
  Synthetic oligonucleotide
gatcgagggcctcccccattccactgcacatatcg

SEQ ID NO: 59694 - DNA, 35 bp, Artificial Sequence
  Synthetic oligonucleotide
atcaccacatctacgttagcgcgccctatcactcg

SEQ ID NO: 59695 - DNA, 35 bp, Artificial Sequence
  Synthetic oligonucleotide
acagggcctccgaaggataacttcgcctactttcg

SEQ ID NO: 59696 - DNA, 35 bp, Artificial Sequence
  Synthetic oligonucleotide
accaccagctccaggcagtcacctttcgcgcccgg

SEQ ID NO: 59697 - DNA, 35 bp, Artificial Sequence
  Synthetic oligonucleotide
gcattcaagcgccgggttcgctccccccacctcgg

SEQ ID NO: 59698 - DNA, 35 bp, Artificial Sequence
  Synthetic oligonucleotide
gtgttagtgggcggtcgttaggaaggggggctggg

SEQ ID NO: 59699 - DNA, 35 bp, Artificial Sequence
  Synthetic oligonucleotide
gagcgcgcagtaacgctcgatccacccatcactgg

SEQ ID NO: 59700 - DNA, 35 bp, Artificial Sequence
  Synthetic oligonucleotide
acatctcccgtgcatctgacagaccctctcggctg

SEQ ID NO: 59701 - DNA, 35 bp, Artificial Sequence
  Synthetic oligonucleotide
taggaacaggtcatacagaggagggctggtgggat

SEQ ID NO: 59702 - DNA, 35 bp, Artificial Sequence
  Synthetic oligonucleotide
ttcgccgccatgtcctatcactggactaccattat

SEQ ID NO: 59703 - DNA, 35 bp, Artificial Sequence
  Synthetic oligonucleotide
tgcacttgtgcgttccatactgctgccccgtaact

SEQ ID NO: 59704 - DNA, 35 bp, Artificial Sequence
  Synthetic oligonucleotide
gtggaaccgcactatattcgttcaaggcctcccct

SEQ ID NO: 59705 - DNA, 35 bp, Artificial Sequence
  Synthetic oligonucleotide
taaaatgggtggttagggggtggaggaggcgtgct

SEQ ID NO: 59706 - DNA, 35 bp, Artificial Sequence
  Synthetic oligonucleotide
taccctggacaccccctgctgcccgcatactctct

SEQ ID NO: 59707 - DNA, 35 bp, Artificial Sequence
  Synthetic oligonucleotide
gtcatactgtcgcctcgaatttgaatcatcgttct

SEQ ID NO: 59708 - DNA, 35 bp, Artificial Sequence
  Synthetic oligonucleotide
ggtaggacgagcggcacataccatccgatttacgt

SEQ ID NO: 59709 - DNA, 35 bp, Artificial Sequence
  Synthetic oligonucleotide
gcactagtcggcctcggaggggttctagggattgt

SEQ ID NO: 59710 - DNA, 35 bp, Artificial Sequence
  Synthetic oligonucleotide
gcccacgccacatttgcgattacactctagccatt

SEQ ID NO: 59711 - DNA, 35 bp, Artificial Sequence
  Synthetic oligonucleotide
tcacgaacacccacacaccccagaatcctcagatt

SEQ ID NO: 59712 - DNA, 35 bp, Artificial Sequence
  Synthetic oligonucleotide
tgttcaccactcggatctccgtctattcgttgctt

SEQ ID NO: 59713 - DNA, 35 bp, Artificial Sequence
  Synthetic oligonucleotide
tgcatgacccatccctaactaggcgtgttcctctt

SEQ ID NO: 59714 - DNA, 36 bp, Artificial Sequence
  Synthetic oligonucleotide
gtgccactgaagcccttttccaggacagtctacaaa

SEQ ID NO: 59715 - DNA, 35 bp, Artificial Sequence
  Synthetic oligonucleotide
tcatcatttctggggacccctactacacgtgcaaa

SEQ ID NO: 59716 - DNA, 36 bp, Artificial Sequence
  Synthetic oligonucleotide
tagactcgtggcctgcacgcttaacctcctttagaa

SEQ ID NO: 59717 - DNA, 36 bp, Artificial Sequence
  Synthetic oligonucleotide
gcggagcatggccctgcatttgaagctcctcccgaa

SEQ ID NO: 59718 - DNA, 35 bp, Artificial Sequence
  Synthetic oligonucleotide
tgacattgccctccgatcgccaagcttcaccggaa

SEQ ID NO: 59719 - DNA, 36 bp, Artificial Sequence
  Synthetic oligonucleotide
gccattcactgccggtgccggaaaacaccccgctaa

SEQ ID NO: 59720 - DNA, 36 bp, Artificial Sequence
  Synthetic oligonucleotide
tctgggagcagcctaaacgggtcacttgcattttaa

SEQ ID NO: 59721 - DNA, 36 bp, Artificial Sequence
  Synthetic oligonucleotide
actctacactccagagggcgacatgcactccacaca

SEQ ID NO: 59722 - DNA, 35 bp, Artificial Sequence
  Synthetic oligonucleotide
gacaacccacatcacttgaccctaagttttgcaca

SEQ ID NO: 59723 - DNA, 36 bp, Artificial Sequence
  Synthetic oligonucleotide
ttaatgacgcaggtgggaggatgggcgggttgtaca

SEQ ID NO: 59724 - DNA, 36 bp, Artificial Sequence
  Synthetic oligonucleotide
gaccccggcccgtatcaccctcagcgtgtccctcca

SEQ ID NO: 59725 - DNA, 35 bp, Artificial Sequence
  Synthetic oligonucleotide
taccagggtcaagagggaggagatgggtaggtcca

SEQ ID NO: 59726 - DNA, 36 bp, Artificial Sequence
  Synthetic oligonucleotide
tcccctacatcaatgacacggtggcaagtacttgca

SEQ ID NO: 59727 - DNA, 36 bp, Artificial Sequence
  Synthetic oligonucleotide
attcctggtcgaaggacctactacataccgttatca

SEQ ID NO: 59728 - DNA, 36 bp, Artificial Sequence
  Synthetic oligonucleotide
agccccaccaatgcgccgaactattgctcggtgtca

SEQ ID NO: 59729 - DNA, 36 bp, Artificial Sequence
  Synthetic oligonucleotide
gccattctgcccgaccacaacgcattgttgatttca

SEQ ID NO: 59730 - DNA, 37 bp, Artificial Sequence
  Synthetic oligonucleotide
aatcctgccgccgaccacaccagcctactgaggaaga

SEQ ID NO: 59731 - DNA, 36 bp, Artificial Sequence
  Synthetic oligonucleotide
tatggtgcacagggataaggaacaagggcggtgaga

SEQ ID NO: 59732 - DNA, 37 bp, Artificial Sequence
  Synthetic oligonucleotide
tctcccatccgacaacccttggcccccccgaggtaga

SEQ ID NO: 59733 - DNA, 37 bp, Artificial Sequence
  Synthetic oligonucleotide
gaacgcacttctcatttttcgacgcctgacataacga

SEQ ID NO: 59734 - DNA, 37 bp, Artificial Sequence
  Synthetic oligonucleotide
gtgaactgcccctcacgctgaccagcccgacccacga

SEQ ID NO: 59735 - DNA, 36 bp, Artificial Sequence
  Synthetic oligonucleotide
tgggccacattgactaacaccaacgcgtttgcccga

SEQ ID NO: 59736 - DNA, 37 bp, Artificial Sequence
  Synthetic oligonucleotide
gtggagggcatggggcaaacacccgtggaacacgcga

SEQ ID NO: 59737 - DNA, 37 bp, Artificial Sequence
  Synthetic oligonucleotide
atagcccacgacgctacttcacgacttgttgtttcga

SEQ ID NO: 59738 - DNA, 37 bp, Artificial Sequence
  Synthetic oligonucleotide
tcccatgtaaagtatgggtggagggagggcccaagga

SEQ ID NO: 59739 - DNA, 37 bp, Artificial Sequence
  Synthetic oligonucleotide
gtggaggaagaggggtgttctaaggcaggctgaagga

SEQ ID NO: 59740 - DNA, 37 bp, Artificial Sequence
  Synthetic oligonucleotide
gcatcgggggggtgtggaactaggaaaggatggagga

SEQ ID NO: 59741 - DNA, 36 bp, Artificial Sequence
  Synthetic oligonucleotide
atcattgagcggggaaaaggagacacggaggacgga

SEQ ID NO: 59742 - DNA, 36 bp, Artificial Sequence
  Synthetic oligonucleotide
gactgccctcattctcacgaccatcaatattgcgga

SEQ ID NO: 59743 - DNA, 37 bp, Artificial Sequence
  Synthetic oligonucleotide
gccaccactggagctagacgcctcatccgttatcgga

SEQ ID NO: 59744 - DNA, 37 bp, Artificial Sequence
  Synthetic oligonucleotide
ggtggagagttgtcgaggggggacaacggtggaggga

SEQ ID NO: 59745 - DNA, 37 bp, Artificial Sequence
  Synthetic oligonucleotide
gatcctcctgctgaacgacgcctccatccctggggga

SEQ ID NO: 59746 - DNA, 37 bp, Artificial Sequence
  Synthetic oligonucleotide
tttgcccgcccatccgtctatcaaatagttatctgga

SEQ ID NO: 59747 - DNA, 37 bp, Artificial Sequence
  Synthetic oligonucleotide
acagaccgtgcaggtctctgtctctgtgctttctgga

SEQ ID NO: 59748 - DNA, 38 bp, Artificial Sequence
  Synthetic oligonucleotide
tcatcaccgcctgcctcctatagcagacactttaatga

SEQ ID NO: 59749 - DNA, 36 bp, Artificial Sequence
  Synthetic oligonucleotide
ggacactgtgggggggccagagaagggcgaccatga

SEQ ID NO: 59750 - DNA, 38 bp, Artificial Sequence
  Synthetic oligonucleotide
tccaccattcacgcgcccttcacgaactttggccatga

SEQ ID NO: 59751 - DNA, 38 bp, Artificial Sequence
  Synthetic oligonucleotide
cccacccccacgcccgcatgcccgaactgtattcatga

SEQ ID NO: 59752 - DNA, 38 bp, Artificial Sequence
  Synthetic oligonucleotide
ggagacactgaaaaaggtgtgaggggcctgggggatga

SEQ ID NO: 59753 - DNA, 37 bp, Artificial Sequence
  Synthetic oligonucleotide
atcgccctcctcttgaacgattcgtttcgaactatga

SEQ ID NO: 59754 - DNA, 38 bp, Artificial Sequence
  Synthetic oligonucleotide
agcgaagctacggcttatttacctctcgtcacgtatga

SEQ ID NO: 59755 - DNA, 38 bp, Artificial Sequence
  Synthetic oligonucleotide
gtgacctcatcttcctgtccgtgaacaaccgatactga

SEQ ID NO: 59756 - DNA, 36 bp, Artificial Sequence
  Synthetic oligonucleotide
gaagcctccgcgcaatctccgaatctgtctcgctga

SEQ ID NO: 59757 - DNA, 38 bp, Artificial Sequence
  Synthetic oligonucleotide
gagcacggtcaatcaggggcagaaggtgaaatacgtga

SEQ ID NO: 59758 - DNA, 38 bp, Artificial Sequence
  Synthetic oligonucleotide
tgaacaagttgggtgggtcgggcgagtccgacgggtga

SEQ ID NO: 59759 - DNA, 38 bp, Artificial Sequence
  Synthetic oligonucleotide
gataccagacagctagggggtgggcgtggtgggtgtga

SEQ ID NO: 59760 - DNA, 38 bp, Artificial Sequence
  Synthetic oligonucleotide
aagagcgacacctgcccaccacgccttgtactttgtga

SEQ ID NO: 59761 - DNA, 38 bp, Artificial Sequence
  Synthetic oligonucleotide
tacacacgccccccaaaacggacactgagccaccttga

SEQ ID NO: 59762 - DNA, 38 bp, Artificial Sequence
  Synthetic oligonucleotide
tccgatccagggctattgaatgaaaaccacacccttga

SEQ ID NO: 59763 - DNA, 38 bp, Artificial Sequence
  Synthetic oligonucleotide
tcagaccatcccgccgctagtccttccaccgaagttga

SEQ ID NO: 59764 - DNA, 37 bp, Artificial Sequence
  Synthetic oligonucleotide
tgacacctcatccggtgcacgaatctttgcctgttga

SEQ ID NO: 59765 - DNA, 38 bp, Artificial Sequence
  Synthetic oligonucleotide
tgcctccacctcgaccattgctttgataccaagtttga

SEQ ID NO: 59766 - DNA, 35 bp, Artificial Sequence
  Synthetic oligonucleotide
gtgtacccgccgccaatataaatctacgaaacata

SEQ ID NO: 59767 - DNA, 36 bp, Artificial Sequence
  Synthetic oligonucleotide
gctcggaccatccttagtgtgttcgctcaccactta

SEQ ID NO: 59768 - DNA, 35 bp, Artificial Sequence
  Synthetic oligonucleotide
gctagggatggcgtgggggagcagaaggttcgtta

SEQ ID NO: 59769 - DNA, 36 bp, Artificial Sequence
  Synthetic oligonucleotide
gccgtcggacaccagcgaggctcattccaccattta

SEQ ID NO: 59770 - DNA, 35 bp, Artificial Sequence
  Synthetic oligonucleotide
taacactcctgatcgaggccccccacgtgatcaac

SEQ ID NO: 59771 - DNA, 35 bp, Artificial Sequence
  Synthetic oligonucleotide
ttcaacctccaatactgttacgccaacacgatcac

SEQ ID NO: 59772 - DNA, 35 bp, Artificial Sequence
  Synthetic oligonucleotide
aatggagggaacgactgggagaagacccgaactac

SEQ ID NO: 59773 - DNA, 35 bp, Artificial Sequence
  Synthetic oligonucleotide
gtctctcctcctaccgaagggtatactgttggtac

SEQ ID NO: 59774 - DNA, 35 bp, Artificial Sequence
  Synthetic oligonucleotide
gtcgtcgcccggtttcaccaactccaccactgacc

SEQ ID NO: 59775 - DNA, 35 bp, Artificial Sequence
  Synthetic oligonucleotide
ggacggttccaatgcctgcgctgagcttgcacccc

SEQ ID NO: 59776 - DNA, 35 bp, Artificial Sequence
  Synthetic oligonucleotide
acactagttgacgcacctctgcgactcatttcccc

SEQ ID NO: 59777 - DNA, 35 bp, Artificial Sequence
  Synthetic oligonucleotide
tctatcatctcgcaaggcctattccccagggctcc

SEQ ID NO: 59778 - DNA, 35 bp, Artificial Sequence
  Synthetic oligonucleotide
atgctgaacgcaattggggtacgatccgcgcttcc

SEQ ID NO: 59779 - DNA, 35 bp, Artificial Sequence
  Synthetic oligonucleotide
atccgccgcttgttttgaaccatttaatccatcgc

SEQ ID NO: 59780 - DNA, 35 bp, Artificial Sequence
  Synthetic oligonucleotide
atccctccgatcaggccatccacagtactcctcgc

SEQ ID NO: 59781 - DNA, 35 bp, Artificial Sequence
  Synthetic oligonucleotide
gccaacggccgccatccgtaacacccgccagaatc

SEQ ID NO: 59782 - DNA, 35 bp, Artificial Sequence
  Synthetic oligonucleotide
gtacacttggcacgaccacacctgcatagcgcatc

SEQ ID NO: 59783 - DNA, 35 bp, Artificial Sequence
  Synthetic oligonucleotide
aactcacactggcggcctacttttatctttaactc

SEQ ID NO: 59784 - DNA, 35 bp, Artificial Sequence
  Synthetic oligonucleotide
aaccgcgtgggctgctcaccacaaaattcgtactc

SEQ ID NO: 59785 - DNA, 35 bp, Artificial Sequence
  Synthetic oligonucleotide
agccgagtgcaaagggggggaggttacgtggggtc

SEQ ID NO: 59786 - DNA, 35 bp, Artificial Sequence
  Synthetic oligonucleotide
gaatacagcgccctaaatgccgaggccctttcttc

SEQ ID NO: 59787 - DNA, 35 bp, Artificial Sequence
  Synthetic oligonucleotide
ccctgctactgctgcccgccgacactacttcgccg

SEQ ID NO: 59788 - DNA, 35 bp, Artificial Sequence
  Synthetic oligonucleotide
atcatctggcacgctagcgttcaccttccgctgcg

SEQ ID NO: 59789 - DNA, 35 bp, Artificial Sequence
  Synthetic oligonucleotide
taagacaaggggtatggcaccgtgatgttaggggg

SEQ ID NO: 59790 - DNA, 35 bp, Artificial Sequence
  Synthetic oligonucleotide
gatacgggtccgaagtgtgggtgggctgacttggg

SEQ ID NO: 59791 - DNA, 35 bp, Artificial Sequence
  Synthetic oligonucleotide
atcgtgaagggggcgggaggaccggatagacctgg

SEQ ID NO: 59792 - DNA, 35 bp, Artificial Sequence
  Synthetic oligonucleotide
gcgaggcaccaacttcgcgaggaattccaccactg

SEQ ID NO: 59793 - DNA, 35 bp, Artificial Sequence
  Synthetic oligonucleotide
ttacataccccaagctgcacttatagatcgccctg

SEQ ID NO: 59794 - DNA, 35 bp, Artificial Sequence
  Synthetic oligonucleotide
gctcgcattgcctctttgttcttttcctgagcctg

SEQ ID NO: 59795 - DNA, 35 bp, Artificial Sequence
  Synthetic oligonucleotide
gatgtccactggttgttcgtccgcccaccgctttg

SEQ ID NO: 59796 - DNA, 35 bp, Artificial Sequence
  Synthetic oligonucleotide
tcacctcgctagctgctccgtcggtctcaccaaat

SEQ ID NO: 59797 - DNA, 35 bp, Artificial Sequence
  Synthetic oligonucleotide
actgtgcccgcataacagctgtccccatacgacat

SEQ ID NO: 59798 - DNA, 35 bp, Artificial Sequence
  Synthetic oligonucleotide
tgacgtctaccgcgtttagcgactttgccttcact

SEQ ID NO: 59799 - DNA, 35 bp, Artificial Sequence
  Synthetic oligonucleotide
acccgagccccacaccttctgtcgacgttcacgct

SEQ ID NO: 59800 - DNA, 35 bp, Artificial Sequence
  Synthetic oligonucleotide
atgcaacaacctgcgtaatcgatacatccaccgct

SEQ ID NO: 59801 - DNA, 35 bp, Artificial Sequence
  Synthetic oligonucleotide
tgtacagacacggcacatcaattctacccgtctct

SEQ ID NO: 59802 - DNA, 35 bp, Artificial Sequence
  Synthetic oligonucleotide
gccacgccggcgggcaatagcacatatatttacgt

SEQ ID NO: 59803 - DNA, 35 bp, Artificial Sequence
  Synthetic oligonucleotide
gagccaccagtcgtccagtactaggtcatacccgt

SEQ ID NO: 59804 - DNA, 35 bp, Artificial Sequence
  Synthetic oligonucleotide
gtcaccctacgcctcagcggacttcttctactcgt

SEQ ID NO: 59805 - DNA, 35 bp, Artificial Sequence
  Synthetic oligonucleotide
gacaaacaccggggggtgctcacatctttcttcgt

SEQ ID NO: 59806 - DNA, 34 bp, Artificial Sequence
  Synthetic oligonucleotide
tccttggcacgctccaaggatccatcacctcatt

SEQ ID NO: 59807 - DNA, 35 bp, Artificial Sequence
  Synthetic oligonucleotide
tgccctctgcacggcctgacacacggggtgtcctt

SEQ ID NO: 59808 - DNA, 35 bp, Artificial Sequence
  Synthetic oligonucleotide
gccgagccaacccattatgtagtgcgtggtcattt

SEQ ID NO: 59809 - DNA, 35 bp, Artificial Sequence
  Synthetic oligonucleotide
tccatccgtgggctttacgcattaagaccaccttt

SEQ ID NO: 59810 - DNA, 35 bp, Artificial Sequence
  Synthetic oligonucleotide
agccccccacggacgcacacgctttgtagcaccaa

SEQ ID NO: 59811 - DNA, 36 bp, Artificial Sequence
  Synthetic oligonucleotide
gatagcaagggtggggccgggtatatacactgggaa

SEQ ID NO: 59812 - DNA, 35 bp, Artificial Sequence
  Synthetic oligonucleotide
gagtctgtaggggttggggtgggacgtggtgtgaa

SEQ ID NO: 59813 - DNA, 35 bp, Artificial Sequence
  Synthetic oligonucleotide
tcagaacgccatacttaccctcgcatggttattaa

SEQ ID NO: 59814 - DNA, 35 bp, Artificial Sequence
  Synthetic oligonucleotide
tatgcatggacactggcttttcggtaccccacaca

SEQ ID NO: 59815 - DNA, 36 bp, Artificial Sequence
  Synthetic oligonucleotide
tcatcgcatgcccttttgttctgacgtacaggcaca

SEQ ID NO: 59816 - DNA, 36 bp, Artificial Sequence
  Synthetic oligonucleotide
ccctgtccgcaatcgcctcctaacactcctgttgca

SEQ ID NO: 59817 - DNA, 36 bp, Artificial Sequence
  Synthetic oligonucleotide
tagttcctacccgatatatgtttacccgccgattca

SEQ ID NO: 59818 - DNA, 36 bp, Artificial Sequence
  Synthetic oligonucleotide
tcgcaacgcaacatctttattaagaattctctttca

SEQ ID NO: 59819 - DNA, 36 bp, Artificial Sequence
  Synthetic oligonucleotide
actcacgttctgtgtctcccccctctgctctcaaga

SEQ ID NO: 59820 - DNA, 37 bp, Artificial Sequence
  Synthetic oligonucleotide
ttacggggaggaaagcggagcgggaacgggtcacaga

SEQ ID NO: 59821 - DNA, 36 bp, Artificial Sequence
  Synthetic oligonucleotide
ggtggtgcgtacggtcatggagggtgctgagggaga

SEQ ID NO: 59822 - DNA, 37 bp, Artificial Sequence
  Synthetic oligonucleotide
tcacagtgcgggaaaagacgaaaggggtggcactaga

SEQ ID NO: 59823 - DNA, 37 bp, Artificial Sequence
  Synthetic oligonucleotide
atcctcctgcccccgggttacacaacagtgaccacga

SEQ ID NO: 59824 - DNA, 36 bp, Artificial Sequence
  Synthetic oligonucleotide
ggatgataggggagggtgggttttagataaagacga

SEQ ID NO: 59825 - DNA, 37 bp, Artificial Sequence
  Synthetic oligonucleotide
gggactgggccgagggaggaaggttacggttagacga

SEQ ID NO: 59826 - DNA, 37 bp, Artificial Sequence
  Synthetic oligonucleotide
gcctcgcagtacgactcactgcctgctcttacaccga

SEQ ID NO: 59827 - DNA, 36 bp, Artificial Sequence
  Synthetic oligonucleotide
acgtggcccccaaaccagtcccctgataaggcccga

SEQ ID NO: 59828 - DNA, 37 bp, Artificial Sequence
  Synthetic oligonucleotide
tactacgcacgcagcatctgtgatcactttcactcga

SEQ ID NO: 59829 - DNA, 37 bp, Artificial Sequence
  Synthetic oligonucleotide
gactccatcggtcgaatctctttcatctgctactcga

SEQ ID NO: 59830 - DNA, 37 bp, Artificial Sequence
  Synthetic oligonucleotide
tatcataacagagtggggtgggatgggcaccaaggga

SEQ ID NO: 59831 - DNA, 36 bp, Artificial Sequence
  Synthetic oligonucleotide
gatgagaaggctgcaaagtctgaaaccaggtgggga

SEQ ID NO: 59832 - DNA, 37 bp, Artificial Sequence
  Synthetic oligonucleotide
aaagacgcgtacccgtggcgggcggggggggctggga

SEQ ID NO: 59833 - DNA, 37 bp, Artificial Sequence
  Synthetic oligonucleotide
gtatagctgacaacggtgggaacgggcgggggtatga

SEQ ID NO: 59834 - DNA, 38 bp, Artificial Sequence
  Synthetic oligonucleotide
tagacagtcaccatcttgtagctccaccgtgccactga

SEQ ID NO: 59835 - DNA, 38 bp, Artificial Sequence
  Synthetic oligonucleotide
ttccaacgccgcaccttcttcgcgatcaggtaacctga

SEQ ID NO: 59836 - DNA, 38 bp, Artificial Sequence
  Synthetic oligonucleotide
aggagacgcacagcctagtcgcacgaccatacacctga

SEQ ID NO: 59837 - DNA, 38 bp, Artificial Sequence
  Synthetic oligonucleotide
gtccacaggcctcctacatgtctaccccacatacctga

SEQ ID NO: 59838 - DNA, 38 bp, Artificial Sequence
  Synthetic oligonucleotide
gtaccatctcgaccattcaacgtctcagcacccgctga

SEQ ID NO: 59839 - DNA, 38 bp, Artificial Sequence
  Synthetic oligonucleotide
gacgatctccgcttaccgtagtgtaccttctctgctga

SEQ ID NO: 59840 - DNA, 36 bp, Artificial Sequence
  Synthetic oligonucleotide
tagccgggggcacgtacgttattagggtgggattga

SEQ ID NO: 59841 - DNA, 38 bp, Artificial Sequence
  Synthetic oligonucleotide
aacctgctactgcttttccgcacacagtcctcgcttga

SEQ ID NO: 59842 - DNA, 38 bp, Artificial Sequence
  Synthetic oligonucleotide
ggtccgggctgcattcgaaacgccactattcctcttga

SEQ ID NO: 59843 - DNA, 38 bp, Artificial Sequence
  Synthetic oligonucleotide
gggaacaactgccctcgttcaaaagtacgatcctttga

SEQ ID NO: 59844 - DNA, 38 bp, Artificial Sequence
  Synthetic oligonucleotide
aatgaagggggagactggaggggtgagtgagtctttga

SEQ ID NO: 59845 - DNA, 36 bp, Artificial Sequence
  Synthetic oligonucleotide
gctgcggggaaaaggcggaggggcgacagggtttga

SEQ ID NO: 59846 - DNA, 38 bp, Artificial Sequence
  Synthetic oligonucleotide
gtgaagcccgcacctttgttttgaaatcctagttttga

SEQ ID NO: 59847 - DNA, 35 bp, Artificial Sequence
  Synthetic oligonucleotide
gcacaggcgtgaacactctgcccccatccacagta

SEQ ID NO: 59848 - DNA, 36 bp, Artificial Sequence
  Synthetic oligonucleotide
acttatcccccgccctatccgaagccgccgacctta

SEQ ID NO: 59849 - DNA, 35 bp, Artificial Sequence
  Synthetic oligonucleotide
accctttccccaccccatgcgactcgttgctctta

SEQ ID NO: 59850 - DNA, 35 bp, Artificial Sequence
  Synthetic oligonucleotide
gttaaccctttgctgtctgtaggccgggctacaac

SEQ ID NO: 59851 - DNA, 35 bp, Artificial Sequence
  Synthetic oligonucleotide
gaccgcatcttgctccatccgtgcgccgtgttcac

SEQ ID NO: 59852 - DNA, 35 bp, Artificial Sequence
  Synthetic oligonucleotide
ttcggacgtccctcctttggcacatgccttacgcc

SEQ ID NO: 59853 - DNA, 35 bp, Artificial Sequence
  Synthetic oligonucleotide
actgatgcaccgttgtttttgaatggctaccttcc

SEQ ID NO: 59854 - DNA, 35 bp, Artificial Sequence
  Synthetic oligonucleotide
gatgcggtgctccgtgatcgtcatttctttccatc

SEQ ID NO: 59855 - DNA, 35 bp, Artificial Sequence
  Synthetic oligonucleotide
gcctggagttcgttctctggtcttgtttcatgctc

SEQ ID NO: 59856 - DNA, 35 bp, Artificial Sequence
  Synthetic oligonucleotide
atactacacctcaggccaaccgaagtcgactattc

SEQ ID NO: 59857 - DNA, 35 bp, Artificial Sequence
  Synthetic oligonucleotide
ttcactgtgaccgtgctcgctccactttgtccttc

SEQ ID NO: 59858 - DNA, 34 bp, Artificial Sequence
  Synthetic oligonucleotide
gagctccacccatatttgttgtcgcgtattgttc

SEQ ID NO: 59859 - DNA, 35 bp, Artificial Sequence
  Synthetic oligonucleotide
aggacgccctcaacccatgcttacacggttttttc

SEQ ID NO: 59860 - DNA, 35 bp, Artificial Sequence
  Synthetic oligonucleotide
aagatgggtgctcaaaagggggtcggcgggacaag

SEQ ID NO: 59861 - DNA, 35 bp, Artificial Sequence
  Synthetic oligonucleotide
aaacaagggggaggttgaggtgagctttatggtag

SEQ ID NO: 59862 - DNA, 35 bp, Artificial Sequence
  Synthetic oligonucleotide
tcccgaccacatcctcgtttcaacgtatgtttacg

SEQ ID NO: 59863 - DNA, 35 bp, Artificial Sequence
  Synthetic oligonucleotide
acatcgtgcgctcagattattctcccgttgccgcg

SEQ ID NO: 59864 - DNA, 35 bp, Artificial Sequence
  Synthetic oligonucleotide
agcgcccgtgctaccggtctgttctcctgttctcg

SEQ ID NO: 59865 - DNA, 35 bp, Artificial Sequence
  Synthetic oligonucleotide
gagaaggggcagtctacgccataaacgggaggggg

SEQ ID NO: 59866 - DNA, 35 bp, Artificial Sequence
  Synthetic oligonucleotide
tgcgaaaaacagggtgagtgaaggtctttggtggg

SEQ ID NO: 59867 - DNA, 35 bp, Artificial Sequence
  Synthetic oligonucleotide
ggaccctcgttgaaaccaccactcgccattttatg

SEQ ID NO: 59868 - DNA, 35 bp, Artificial Sequence
  Synthetic oligonucleotide
gttcgacgaccacaccaccttcaacgatgtacttg

SEQ ID NO: 59869 - DNA, 35 bp, Artificial Sequence
  Synthetic oligonucleotide
gagagacggggcggatttggggaagcacttcgttg

SEQ ID NO: 59870 - DNA, 35 bp, Artificial Sequence
  Synthetic oligonucleotide
taccctccgttgaatctgcacgggactgcttccat

SEQ ID NO: 59871 - DNA, 35 bp, Artificial Sequence
  Synthetic oligonucleotide
gtggcccccgccatcggattcgatcatcactgcct

SEQ ID NO: 59872 - DNA, 35 bp, Artificial Sequence
  Synthetic oligonucleotide
aaccacaatcaccgttctccacgaagaccttacgt

SEQ ID NO: 59873 - DNA, 35 bp, Artificial Sequence
  Synthetic oligonucleotide
tgccccccggcaacctcctagctgctacgcctggt

SEQ ID NO: 59874 - DNA, 35 bp, Artificial Sequence
  Synthetic oligonucleotide
acgatgggaaggggatagaaagagctagtacacaa

SEQ ID NO: 59875 - DNA, 36 bp, Artificial Sequence
  Synthetic oligonucleotide
gccgtgccccccctagaggtatgaccacatatgcaa

SEQ ID NO: 59876 - DNA, 36 bp, Artificial Sequence
  Synthetic oligonucleotide
gccctcgcccgcacgataccctctattagtactaca

SEQ ID NO: 59877 - DNA, 36 bp, Artificial Sequence
  Synthetic oligonucleotide
ggggtccaacacctggcctgcttgagtcctttccca

SEQ ID NO: 59878 - DNA, 35 bp, Artificial Sequence
  Synthetic oligonucleotide
gacggggctaggggaaagattagagggtgggcgca

SEQ ID NO: 59879 - DNA, 35 bp, Artificial Sequence
  Synthetic oligonucleotide
gacccccatccagactccagaaataaagcctcgca

SEQ ID NO: 59880 - DNA, 34 bp, Artificial Sequence
  Synthetic oligonucleotide
atgttctgacacaaatccgttacaggcctcttca

SEQ ID NO: 59881 - DNA, 37 bp, Artificial Sequence
  Synthetic oligonucleotide
attgaccaggagtcgtggggttaggggcctgggcaga

SEQ ID NO: 59882 - DNA, 36 bp, Artificial Sequence
  Synthetic oligonucleotide
cgccacatctgacgtacctgcgtggttactcttaga

SEQ ID NO: 59883 - DNA, 36 bp, Artificial Sequence
  Synthetic oligonucleotide
gttacaagaagggaaggtgcaataggcgagtaacga

SEQ ID NO: 59884 - DNA, 37 bp, Artificial Sequence
  Synthetic oligonucleotide
tcactcgatgtgccatcacatttctccctatctgcga

SEQ ID NO: 59885 - DNA, 37 bp, Artificial Sequence
  Synthetic oligonucleotide
tcgctccctcttcaattgtcactggtcaccccctcga

SEQ ID NO: 59886 - DNA, 38 bp, Artificial Sequence
  Synthetic oligonucleotide
tacgctctggcgtacgttggtagccggatccccctcga

SEQ ID NO: 59887 - DNA, 37 bp, Artificial Sequence
  Synthetic oligonucleotide
tacgggggggtgggtgagacgggcatagattaaagga

SEQ ID NO: 59888 - DNA, 36 bp, Artificial Sequence
  Synthetic oligonucleotide
taacccgccctccgttagagttcgctccgtgaagga

SEQ ID NO: 59889 - DNA, 37 bp, Artificial Sequence
  Synthetic oligonucleotide
ggtggggtaggggtataggtcgggagacccggtagga

SEQ ID NO: 59890 - DNA, 37 bp, Artificial Sequence
  Synthetic oligonucleotide
tgatcaatcgacgagtggacatcggagaggggtggga

SEQ ID NO: 59891 - DNA, 38 bp, Artificial Sequence
  Synthetic oligonucleotide
agagacaagacgctgggacggtggaacaggggaaatga

SEQ ID NO: 59892 - DNA, 38 bp, Artificial Sequence
  Synthetic oligonucleotide
gccccctgcctccccgattcgaagtgctgctatcatga

SEQ ID NO: 59893 - DNA, 37 bp, Artificial Sequence
  Synthetic oligonucleotide
aacaacgggaggggatgagccacaggagaggagatga

SEQ ID NO: 59894 - DNA, 38 bp, Artificial Sequence
  Synthetic oligonucleotide
tgtcattcatcgaacgtccactttgccactccctatga

SEQ ID NO: 59895 - DNA, 38 bp, Artificial Sequence
  Synthetic oligonucleotide
agaaacggggaggaggggggaggctcgtcatcctatga

SEQ ID NO: 59896 - DNA, 38 bp, Artificial Sequence
  Synthetic oligonucleotide
atctcccgcgcacctagcctacaacacctcacccctga

SEQ ID NO: 59897 - DNA, 37 bp, Artificial Sequence
  Synthetic oligonucleotide
tgcccacatctgccgtccctttatttagccactctga

SEQ ID NO: 59898 - DNA, 37 bp, Artificial Sequence
  Synthetic oligonucleotide
ggtggattggggacggggtggtggtacggcccagtga

SEQ ID NO: 59899 - DNA, 37 bp, Artificial Sequence
  Synthetic oligonucleotide
tcaggaaggcgggagtatgaaacgggggtaggagtga

SEQ ID NO: 59900 - DNA, 38 bp, Artificial Sequence
  Synthetic oligonucleotide
acaaccccgcccaacgttgcaggaactcacaaccgtga

SEQ ID NO: 59901 - DNA, 38 bp, Artificial Sequence
  Synthetic oligonucleotide
gatggcccccacctttcgtgacgtgtaactgctcgtga

SEQ ID NO: 59902 - DNA, 37 bp, Artificial Sequence
  Synthetic oligonucleotide
ttgggggaggttagggtagggccgataggtactgtga

SEQ ID NO: 59903 - DNA, 37 bp, Artificial Sequence
  Synthetic oligonucleotide
ttgtcccgccggcccttctcgccgaacttctcattga

SEQ ID NO: 59904 - DNA, 37 bp, Artificial Sequence
  Synthetic oligonucleotide
tgtcaccccatcccttcttgaactgagtatgccttga

SEQ ID NO: 59905 - DNA, 38 bp, Artificial Sequence
  Synthetic oligonucleotide
accattgctcccgtgcgtgttcatgatctcttgcttga

SEQ ID NO: 59906 - DNA, 37 bp, Artificial Sequence
  Synthetic oligonucleotide
ttgtcgttgcgcaatttctgccttccttacatgttga

SEQ ID NO: 59907 - DNA, 38 bp, Artificial Sequence
  Synthetic oligonucleotide
tccatcctgcagagcttgccacgtcgctctccttttga

SEQ ID NO: 59908 - DNA, 36 bp, Artificial Sequence
  Synthetic oligonucleotide
gagcccacagtcttacaacagcccgctaccgacata

SEQ ID NO: 59909 - DNA, 36 bp, Artificial Sequence
  Synthetic oligonucleotide
actgatgcataactggttttgcagcagatgaaacta

SEQ ID NO: 59910 - DNA, 35 bp, Artificial Sequence
  Synthetic oligonucleotide
tccccaccttcattccgaacccacgccgtcgacta

SEQ ID NO: 59911 - DNA, 36 bp, Artificial Sequence
  Synthetic oligonucleotide
taccacgtagcggcgctctagtctcatcgggctcta

SEQ ID NO: 59912 - DNA, 36 bp, Artificial Sequence
  Synthetic oligonucleotide
gacgcctccttcgaacgataagacatcgccacagta

SEQ ID NO: 59913 - DNA, 36 bp, Artificial Sequence
  Synthetic oligonucleotide
ttgagcacagatcttcatcaggctgcattgtacgta

SEQ ID NO: 59914 - DNA, 35 bp, Artificial Sequence
  Synthetic oligonucleotide
tctgttaagtgctgcgtaacttcgcctctttcgta

SEQ ID NO: 59915 - DNA, 36 bp, Artificial Sequence
  Synthetic oligonucleotide
tgatttgtgtaccccgtgcctgccctctttcctgta

SEQ ID NO: 59916 - DNA, 36 bp, Artificial Sequence
  Synthetic oligonucleotide
ggaccctgtagctctgctagctcccgtgcctggtta

SEQ ID NO: 59917 - DNA, 36 bp, Artificial Sequence
  Synthetic oligonucleotide
gtccactgccgattgcaccgcatgacgatctggtta

SEQ ID NO: 59918 - DNA, 36 bp, Artificial Sequence
  Synthetic oligonucleotide
gatgacttctgggcaggattaggggggcattggtta

SEQ ID NO: 59919 - DNA, 35 bp, Artificial Sequence
  Synthetic oligonucleotide
taccccatccgtgccgccgggaatattcatcttta

SEQ ID NO: 59920 - DNA, 35 bp, Artificial Sequence
  Synthetic oligonucleotide
agtcacaccagggacctcggcgagccggaccgaac

SEQ ID NO: 59921 - DNA, 35 bp, Artificial Sequence
  Synthetic oligonucleotide
gcactcacaaagcccgagtctcccatggcttacac

SEQ ID NO: 59922 - DNA, 35 bp, Artificial Sequence
  Synthetic oligonucleotide
gcccttccatctcgcatcgtcttgcgagccatgac

SEQ ID NO: 59923 - DNA, 35 bp, Artificial Sequence
  Synthetic oligonucleotide
agcacgtgcagccacctctcgttggtctccaaacc

SEQ ID NO: 59924 - DNA, 35 bp, Artificial Sequence
  Synthetic oligonucleotide
acgctacccgaactcgggcctgtcctccatgaacc

SEQ ID NO: 59925 - DNA, 35 bp, Artificial Sequence
  Synthetic oligonucleotide
acccctgccccctgatcatcacctcttcacggtcc

SEQ ID NO: 59926 - DNA, 35 bp, Artificial Sequence
  Synthetic oligonucleotide
actgactactgggcctgaattagtttacatatcgc

SEQ ID NO: 59927 - DNA, 35 bp, Artificial Sequence
  Synthetic oligonucleotide
gttgcctgccatgattggtggaatgggaattgggc

SEQ ID NO: 59928 - DNA, 35 bp, Artificial Sequence
  Synthetic oligonucleotide
agttgggccacctgtcgaaccctggtcttaactgc

SEQ ID NO: 59929 - DNA, 35 bp, Artificial Sequence
  Synthetic oligonucleotide
tccaatacgatccccgccgtgtcatgaacacgtgc

SEQ ID NO: 59930 - DNA, 35 bp, Artificial Sequence
  Synthetic oligonucleotide
tagtgggagtagggaagtaacatacggggccaatc

SEQ ID NO: 59931 - DNA, 35 bp, Artificial Sequence
  Synthetic oligonucleotide
atccactccgctacgctagtgcactgacgactttc

SEQ ID NO: 59932 - DNA, 35 bp, Artificial Sequence
  Synthetic oligonucleotide
gcctggggcgtatggttggaagacgatgagggtag

SEQ ID NO: 59933 - DNA, 35 bp, Artificial Sequence
  Synthetic oligonucleotide
gcatctgcctgcatcaggtccttcaatcatgcgcg

SEQ ID NO: 59934 - DNA, 35 bp, Artificial Sequence
  Synthetic oligonucleotide
agctgagagaccgggaggggaataggtcggtcggg

SEQ ID NO: 59935 - DNA, 35 bp, Artificial Sequence
  Synthetic oligonucleotide
atacgtactgctcacttccgtttaacagccacctg

SEQ ID NO: 59936 - DNA, 35 bp, Artificial Sequence
  Synthetic oligonucleotide
atggtggacgcaatgtggttgccactttcttgctg

SEQ ID NO: 59937 - DNA, 34 bp, Artificial Sequence
  Synthetic oligonucleotide
gaaccctgtcgagctgcctaagccaaactgtctg

SEQ ID NO: 59938 - DNA, 35 bp, Artificial Sequence
  Synthetic oligonucleotide
atacaagcccacaccacgcagacagtaacaactat

SEQ ID NO: 59939 - DNA, 35 bp, Artificial Sequence
  Synthetic oligonucleotide
accccatcgagtatgtgcctccacttcaggcccgt

SEQ ID NO: 59940 - DNA, 35 bp, Artificial Sequence
  Synthetic oligonucleotide
atggtacccggttagtatccgtgcttagcacatgt

SEQ ID NO: 59941 - DNA, 35 bp, Artificial Sequence
  Synthetic oligonucleotide
gtgtgccacctctcggtcctgagccttgtccctgt

SEQ ID NO: 59942 - DNA, 35 bp, Artificial Sequence
  Synthetic oligonucleotide
gacaggctccggttaagttttcctactgcttcatt

SEQ ID NO: 59943 - DNA, 35 bp, Artificial Sequence
  Synthetic oligonucleotide
gatcaactgcccccgcgcctgggtttgtctttatt

SEQ ID NO: 59944 - DNA, 36 bp, Artificial Sequence
  Synthetic oligonucleotide
tcagacggaggaaacccgagtcagtttcaagcagaa

SEQ ID NO: 59945 - DNA, 36 bp, Artificial Sequence
  Synthetic oligonucleotide
tagatggagtggcataggaacattaagcgatacgaa

SEQ ID NO: 59946 - DNA, 36 bp, Artificial Sequence
  Synthetic oligonucleotide
gtccagaccccccatattcttatagcgttcaccgaa

SEQ ID NO: 59947 - DNA, 36 bp, Artificial Sequence
  Synthetic oligonucleotide
gtggatgacagagatggggtatgtcaggggtcggaa

SEQ ID NO: 59948 - DNA, 36 bp, Artificial Sequence
  Synthetic oligonucleotide
tcccctgacggatcactactgtccaccgcctcttaa

SEQ ID NO: 59949 - DNA, 36 bp, Artificial Sequence
  Synthetic oligonucleotide
attgatcgcccaattctatttctacctggtaccaca

SEQ ID NO: 59950 - DNA, 35 bp, Artificial Sequence
  Synthetic oligonucleotide
atgcccttctgtgcgtttcattatcctggcttaca

SEQ ID NO: 59951 - DNA, 36 bp, Artificial Sequence
  Synthetic oligonucleotide
gtcccaccacttgcttccaaatcgcgattctgacca

SEQ ID NO: 59952 - DNA, 36 bp, Artificial Sequence
  Synthetic oligonucleotide
aacgccgacgtaatctaaaatgcgcaggctcaccca

SEQ ID NO: 59953 - DNA, 36 bp, Artificial Sequence
  Synthetic oligonucleotide
tcaacgctacagtgtccatcactactatggctccca

SEQ ID NO: 59954 - DNA, 35 bp, Artificial Sequence
  Synthetic oligonucleotide
tcatcagtacggccttttgttcctgcacccctgca

SEQ ID NO: 59955 - DNA, 35 bp, Artificial Sequence
  Synthetic oligonucleotide
tatctgccggaaactggctttccagcatcacctca

SEQ ID NO: 59956 - DNA, 37 bp, Artificial Sequence
  Synthetic oligonucleotide
aaaagggttcaggcggaggggttcggggtgggaaaga

SEQ ID NO: 59957 - DNA, 36 bp, Artificial Sequence
  Synthetic oligonucleotide
tgagcatgcggggctaaggggcgggagggacacaga

SEQ ID NO: 59958 - DNA, 37 bp, Artificial Sequence
  Synthetic oligonucleotide
gaccccccgccgagctgatctggcccgacgccccaga

SEQ ID NO: 59959 - DNA, 37 bp, Artificial Sequence
  Synthetic oligonucleotide
aaaacgggcgggggggtgcgatgttttaacgggcaga

SEQ ID NO: 59960 - DNA, 37 bp, Artificial Sequence
  Synthetic oligonucleotide
gacagggagacgagccaatgatatgagcgataggaga

SEQ ID NO: 59961 - DNA, 37 bp, Artificial Sequence
  Synthetic oligonucleotide
ggtgggggacttgaaggggccggggagcgagtggaga

SEQ ID NO: 59962 - DNA, 37 bp, Artificial Sequence
  Synthetic oligonucleotide
gtctgacacctccgttacgccctgatctctcatgaga

SEQ ID NO: 59963 - DNA, 37 bp, Artificial Sequence
  Synthetic oligonucleotide
gtgtgcgtaccacgcgtgtacactttctctgcctaga

SEQ ID NO: 59964 - DNA, 37 bp, Artificial Sequence
  Synthetic oligonucleotide
tcaacttccgcgttcaccaatagctcaccctcttaga

SEQ ID NO: 59965 - DNA, 37 bp, Artificial Sequence
  Synthetic oligonucleotide
gatagcccattctcccatctacacacgcgtcttacga

SEQ ID NO: 59966 - DNA, 35 bp, Artificial Sequence
  Synthetic oligonucleotide
tcgactgtcacttccgactccgtcatttccaccga

SEQ ID NO: 59967 - DNA, 37 bp, Artificial Sequence
  Synthetic oligonucleotide
atggacaaaccctcacgaaggacgagccacgatccga

SEQ ID NO: 59968 - DNA, 37 bp, Artificial Sequence
  Synthetic oligonucleotide
tgcatccttcatcgactaacgtatcgcgcaccatcga

SEQ ID NO: 59969 - DNA, 37 bp, Artificial Sequence
  Synthetic oligonucleotide
acacactctggagcaaacaacgggcatactggaagga

SEQ ID NO: 59970 - DNA, 37 bp, Artificial Sequence
  Synthetic oligonucleotide
ttcctccacccacaccctagactggccggtcccagga

SEQ ID NO: 59971 - DNA, 37 bp, Artificial Sequence
  Synthetic oligonucleotide
gtgagagggggtggaaacggtacgtgttttatgggga

SEQ ID NO: 59972 - DNA, 37 bp, Artificial Sequence
  Synthetic oligonucleotide
tcaacaccactcttcgggattcccaccactattggga

SEQ ID NO: 59973 - DNA, 38 bp, Artificial Sequence
  Synthetic oligonucleotide
ggagacacaggagacacgggggcgaagtatagtaatga

SEQ ID NO: 59974 - DNA, 38 bp, Artificial Sequence
  Synthetic oligonucleotide
acactcatgggagcaggtggaggagtcgggattaatga

SEQ ID NO: 59975 - DNA, 37 bp, Artificial Sequence
  Synthetic oligonucleotide
ttggggagcagcatcacggaccactgcatttacatga

SEQ ID NO: 59976 - DNA, 37 bp, Artificial Sequence
  Synthetic oligonucleotide
tccggtgccttctccgttttgtaccacacggccatga

SEQ ID NO: 59977 - DNA, 37 bp, Artificial Sequence
  Synthetic oligonucleotide
tccacccactgattatacctaagtcccggtcggatga

SEQ ID NO: 59978 - DNA, 37 bp, Artificial Sequence
  Synthetic oligonucleotide
gtgtccacgcatatttccattgtttcatctcctatga

SEQ ID NO: 59979 - DNA, 38 bp, Artificial Sequence
  Synthetic oligonucleotide
agtccatacgcctctttcggttgtgtcctacacactga

SEQ ID NO: 59980 - DNA, 38 bp, Artificial Sequence
  Synthetic oligonucleotide
tacgccactagtccccatcgcggcgcctacaccactga

SEQ ID NO: 59981 - DNA, 37 bp, Artificial Sequence
  Synthetic oligonucleotide
agcccacatgagtcactcctcctgcccgtttgactga

SEQ ID NO: 59982 - DNA, 38 bp, Artificial Sequence
  Synthetic oligonucleotide
ttgaccgccatcctacaagtactctaagctcgtgctga

SEQ ID NO: 59983 - DNA, 38 bp, Artificial Sequence
  Synthetic oligonucleotide
tagccccgctcctctcgccgaaacgcactcaactctga

SEQ ID NO: 59984 - DNA, 37 bp, Artificial Sequence
  Synthetic oligonucleotide
ttgtcacggtaccctacgtgtatgtttccctctctga

SEQ ID NO: 59985 - DNA, 38 bp, Artificial Sequence
  Synthetic oligonucleotide
tcacgcccattgtccctgcctttgtacaaccttcgtga

SEQ ID NO: 59986 - DNA, 37 bp, Artificial Sequence
  Synthetic oligonucleotide
agtgagggatccaaagacggggtgacgggataggtga

SEQ ID NO: 59987 - DNA, 38 bp, Artificial Sequence
  Synthetic oligonucleotide
agccatgcctcctgccgtccagtccatgatagatgtga

SEQ ID NO: 59988 - DNA, 37 bp, Artificial Sequence
  Synthetic oligonucleotide
atccgctcccgacagcgcaaatcgttaccgtgattga

SEQ ID NO: 59989 - DNA, 38 bp, Artificial Sequence
  Synthetic oligonucleotide
gagatgcggggtggagatcgggaagacagcgcacttga

SEQ ID NO: 59990 - DNA, 38 bp, Artificial Sequence
  Synthetic oligonucleotide
gtgtaccggccctggtcctttagcccccacatggttga

SEQ ID NO: 59991 - DNA, 38 bp, Artificial Sequence
  Synthetic oligonucleotide
gaagggtagggtaggtttgggtgaagattcgggtttga

SEQ ID NO: 59992 - DNA, 38 bp, Artificial Sequence
  Synthetic oligonucleotide
gccacacatcattccaacatgtccgcaacatcttttga

SEQ ID NO: 59993 - DNA, 36 bp, Artificial Sequence
  Synthetic oligonucleotide
tggggcgaccacgagttcctccttattcagcaccta

SEQ ID NO: 59994 - DNA, 36 bp, Artificial Sequence
  Synthetic oligonucleotide
gagtccacacatgacgttaccaacgcagactatcta

SEQ ID NO: 59995 - DNA, 36 bp, Artificial Sequence
  Synthetic oligonucleotide
attgatgcccgcccgcccagcgctcttctttgatta

SEQ ID NO: 59996 - DNA, 35 bp, Artificial Sequence
  Synthetic oligonucleotide
gtctcaaactgccgcccaaccaggagatactacac

SEQ ID NO: 59997 - DNA, 35 bp, Artificial Sequence
  Synthetic oligonucleotide
aaccccaactattgcccagtattcatctgtcgcac

SEQ ID NO: 59998 - DNA, 35 bp, Artificial Sequence
  Synthetic oligonucleotide
agcacgctcgcggtttagtctttcccgattttcac

SEQ ID NO: 59999 - DNA, 35 bp, Artificial Sequence
  Synthetic oligonucleotide
taatgacccacctatctggcccgacgagtacctac

SEQ ID NO: 60000 - DNA, 35 bp, Artificial Sequence
  Synthetic oligonucleotide
acactgactcgtgaggacccactgacattttgacc

SEQ ID NO: 60001 - DNA, 35 bp, Artificial Sequence
  Synthetic oligonucleotide
tatcctgttcgggtcgactaacactgactgccccc

SEQ ID NO: 60002 - DNA, 35 bp, Artificial Sequence
  Synthetic oligonucleotide
tacaacacgccactacgttaaaggaaactcgtccc

SEQ ID NO: 60003 - DNA, 34 bp, Artificial Sequence
  Synthetic oligonucleotide
acaagtccattcgtttctgctgccttcaacacgc

SEQ ID NO: 60004 - DNA, 32 bp, Artificial Sequence
  Synthetic oligonucleotide
tccattccagggatgatcatttctattactgc

SEQ ID NO: 60005 - DNA, 35 bp, Artificial Sequence
  Synthetic oligonucleotide
gctgaatctatgcgtcaatactctcgcctgcctgc

SEQ ID NO: 60006 - DNA, 35 bp, Artificial Sequence
  Synthetic oligonucleotide
tcccgacacccctgttcctacgtacacgtccactc

SEQ ID NO: 60007 - DNA, 35 bp, Artificial Sequence
  Synthetic oligonucleotide
tatcggtggcgccggaaacgacccctcttctctag

SEQ ID NO: 60008 - DNA, 35 bp, Artificial Sequence
  Synthetic oligonucleotide
acatcgaggcaaggttccctctataccacctaccg

SEQ ID NO: 60009 - DNA, 35 bp, Artificial Sequence
  Synthetic oligonucleotide
tagcgacgttgcggatgaggggtagttgggaatgg

SEQ ID NO: 60010 - DNA, 35 bp, Artificial Sequence
  Synthetic oligonucleotide
acccggtgcagtatttgccattgactcaacgagtg

SEQ ID NO: 60011 - DNA, 35 bp, Artificial Sequence
  Synthetic oligonucleotide
gtgtcacctccatgggtcctcactgcgaccgccat

SEQ ID NO: 60012 - DNA, 35 bp, Artificial Sequence
  Synthetic oligonucleotide
tctctcgtgccggagggccggggtccactatccat

SEQ ID NO: 60013 - DNA, 35 bp, Artificial Sequence
  Synthetic oligonucleotide
gcaccacggccgatacctacatctcagtgcaatat

SEQ ID NO: 60014 - DNA, 35 bp, Artificial Sequence
  Synthetic oligonucleotide
taccgcctgggtttactctcctttcactgggttat

SEQ ID NO: 60015 - DNA, 35 bp, Artificial Sequence
  Synthetic oligonucleotide
aaagcacatcaactccgtaatgcgtctaccttgct

SEQ ID NO: 60016 - DNA, 35 bp, Artificial Sequence
  Synthetic oligonucleotide
gaactgcccttaaagacccgcgcacccgatcctct

SEQ ID NO: 60017 - DNA, 35 bp, Artificial Sequence
  Synthetic oligonucleotide
gcccgaattcaaacacgccactactcatgacatgt

SEQ ID NO: 60018 - DNA, 35 bp, Artificial Sequence
  Synthetic oligonucleotide
gtggccggcggcactcgctttccccgtaccgttgt

SEQ ID NO: 60019 - DNA, 35 bp, Artificial Sequence
  Synthetic oligonucleotide
agacgccggtgtcgttcgtctctcgctttctcatt

SEQ ID NO: 60020 - DNA, 34 bp, Artificial Sequence
  Synthetic oligonucleotide
gtccttggcgttgaccgtcccctctttacgcctt

SEQ ID NO: 60021 - DNA, 35 bp, Artificial Sequence
  Synthetic oligonucleotide
gttaaccgcctcttggcctaattcaacatgcattt

SEQ ID NO: 60022 - DNA, 35 bp, Artificial Sequence
  Synthetic oligonucleotide
gcggagtcacgtacggtaggctcagggcacacaaa

SEQ ID NO: 60023 - DNA, 36 bp, Artificial Sequence
  Synthetic oligonucleotide
tccccttgcggagtgccatcgttcccctttcctaaa

SEQ ID NO: 60024 - DNA, 36 bp, Artificial Sequence
  Synthetic oligonucleotide
gagttcgcgaagaaggaaaggggcacgggggaacaa

SEQ ID NO: 60025 - DNA, 36 bp, Artificial Sequence
  Synthetic oligonucleotide
gagactgaccccccctggttacccttccgtatggaa

SEQ ID NO: 60026 - DNA, 36 bp, Artificial Sequence
  Synthetic oligonucleotide
tacccgtccctgggcacttatgacggattttgtgaa

SEQ ID NO: 60027 - DNA, 36 bp, Artificial Sequence
  Synthetic oligonucleotide
tttcgccgtgcaccctgtattcatttgtcctcttaa

SEQ ID NO: 60028 - DNA, 36 bp, Artificial Sequence
  Synthetic oligonucleotide
gtggtcagcatctgccctggtaacctttttgcaaca

SEQ ID NO: 60029 - DNA, 36 bp, Artificial Sequence
  Synthetic oligonucleotide
ttgcacacatgcactccctggccgacctgtcctaca

SEQ ID NO: 60030 - DNA, 36 bp, Artificial Sequence
  Synthetic oligonucleotide
tccactctaccaggatactgccaacgcgtacgccca

SEQ ID NO: 60031 - DNA, 35 bp, Artificial Sequence
  Synthetic oligonucleotide
ttgacgtccttgctgttcgttccacttgggtccca

SEQ ID NO: 60032 - DNA, 36 bp, Artificial Sequence
  Synthetic oligonucleotide
agcacgacacgtctcggatccctgtcttgattgcca

SEQ ID NO: 60033 - DNA, 36 bp, Artificial Sequence
  Synthetic oligonucleotide
atccattctcccatgggcattttatcagacgctgca

SEQ ID NO: 60034 - DNA, 36 bp, Artificial Sequence
  Synthetic oligonucleotide
tgacagaacaatgctgcccaattattgcacccctca

SEQ ID NO: 60035 - DNA, 36 bp, Artificial Sequence
  Synthetic oligonucleotide
accacctgtacaggaagtctcccatgtctagcctca

SEQ ID NO: 60036 - DNA, 36 bp, Artificial Sequence
  Synthetic oligonucleotide
gcaagacgcggcgatattgacatccataccatctca

SEQ ID NO: 60037 - DNA, 36 bp, Artificial Sequence
  Synthetic oligonucleotide
acaaggggggctccggggacgggtgaaaggtcgaga

SEQ ID NO: 60038 - DNA, 37 bp, Artificial Sequence
  Synthetic oligonucleotide
tagagacactgctgggcactggtggacggaagggaga

SEQ ID NO: 60039 - DNA, 35 bp, Artificial Sequence
  Synthetic oligonucleotide
agataggagcataatacgggtgcaggggagggaga

SEQ ID NO: 60040 - DNA, 35 bp, Artificial Sequence
  Synthetic oligonucleotide
gccctcaaacccacctcgcaccctgtcactggaga

SEQ ID NO: 60041 - DNA, 37 bp, Artificial Sequence
  Synthetic oligonucleotide
caccccccctcccctgtgtcgtaacccggtgcaacga

SEQ ID NO: 60042 - DNA, 37 bp, Artificial Sequence
  Synthetic oligonucleotide
agagacacaggtgatgggtcggtcttggtgcagacga

SEQ ID NO: 60043 - DNA, 37 bp, Artificial Sequence
  Synthetic oligonucleotide
tacacctcgccgccaatcgctctatccagccattcga

SEQ ID NO: 60044 - DNA, 37 bp, Artificial Sequence
  Synthetic oligonucleotide
tgcggggcttcggcgagggcggggtggctagggagga

SEQ ID NO: 60045 - DNA, 37 bp, Artificial Sequence
  Synthetic oligonucleotide
gcagcactgttttttcctatttgcatcgccccccgga

SEQ ID NO: 60046 - DNA, 37 bp, Artificial Sequence
  Synthetic oligonucleotide
tcaggtgagggtgggttgatatatctgggcgagggga

SEQ ID NO: 60047 - DNA, 37 bp, Artificial Sequence
  Synthetic oligonucleotide
gctacgcacacccgcgtacatctttcatcatcctgga

SEQ ID NO: 60048 - DNA, 37 bp, Artificial Sequence
  Synthetic oligonucleotide
acgatgaaagtgaggggggggattgtagccttgtgga

SEQ ID NO: 60049 - DNA, 37 bp, Artificial Sequence
  Synthetic oligonucleotide
gacttggggccggagtggtttccgctgcttacttgga

SEQ ID NO: 60050 - DNA, 38 bp, Artificial Sequence
  Synthetic oligonucleotide
agcaagggggaatggggaaatggctggcaaacatatga

SEQ ID NO: 60051 - DNA, 37 bp, Artificial Sequence
  Synthetic oligonucleotide
gcatgaaggggggcaaggatacgtgagcatgatatga

SEQ ID NO: 60052 - DNA, 38 bp, Artificial Sequence
  Synthetic oligonucleotide
gccaggaccagcgcgacgcccatcacgccatcaactga

SEQ ID NO: 60053 - DNA, 38 bp, Artificial Sequence
  Synthetic oligonucleotide
acgatcgctagcagggctaaatattgaactcccactga

SEQ ID NO: 60054 - DNA, 38 bp, Artificial Sequence
  Synthetic oligonucleotide
acacgccctccgtacatggttggattttttgaacctga

SEQ ID NO: 60055 - DNA, 38 bp, Artificial Sequence
  Synthetic oligonucleotide
taccactcccgcgagccgctacgtagcaccaatcgtga

SEQ ID NO: 60056 - DNA, 38 bp, Artificial Sequence
  Synthetic oligonucleotide
gcaaacggtcgctcgggggaagcgcagggcgaaggtga

SEQ ID NO: 60057 - DNA, 38 bp, Artificial Sequence
  Synthetic oligonucleotide
gcgaaggcgaagatgaaacctggcggtgggaatggtga

SEQ ID NO: 60058 - DNA, 38 bp, Artificial Sequence
  Synthetic oligonucleotide
tgcgtgatcagcgcgctgtcccttttgctcttcgttga

SEQ ID NO: 60059 - DNA, 38 bp, Artificial Sequence
  Synthetic oligonucleotide
ctccgccccaccattgccactagcccagtcgttgttga

SEQ ID NO: 60060 - DNA, 38 bp, Artificial Sequence
  Synthetic oligonucleotide
gaaccgtcgcccgccgcatcacattggataggttttga

SEQ ID NO: 60061 - DNA, 36 bp, Artificial Sequence
  Synthetic oligonucleotide
gcccctacttatcacacggactgccatgtccctcta

SEQ ID NO: 60062 - DNA, 35 bp, Artificial Sequence
  Synthetic oligonucleotide
aatccgtactagccttgcacttcgagccattatta

SEQ ID NO: 60063 - DNA, 35 bp, Artificial Sequence
  Synthetic oligonucleotide
tgtgaccccccgcgagtatatactacatgccttta

SEQ ID NO: 60064 - DNA, 35 bp, Artificial Sequence
  Synthetic oligonucleotide
acatgcatgaaggggcgagaggaaatacggggcac

SEQ ID NO: 60065 - DNA, 35 bp, Artificial Sequence
  Synthetic oligonucleotide
acacgccgccgtgctttggactgttgcagccaacc

SEQ ID NO: 60066 - DNA, 35 bp, Artificial Sequence
  Synthetic oligonucleotide
ttgactacagtcagccaattttatccatccccccc

SEQ ID NO: 60067 - DNA, 35 bp, Artificial Sequence
  Synthetic oligonucleotide
gcaccccatgccggccagtagctcttttcagtccc

SEQ ID NO: 60068 - DNA, 35 bp, Artificial Sequence
  Synthetic oligonucleotide
tcagcctcccgcctcgtcactttttccttaggtcc

SEQ ID NO: 60069 - DNA, 35 bp, Artificial Sequence
  Synthetic oligonucleotide
aacatcccccggggttgctgtgattgtcacggtcc

SEQ ID NO: 60070 - DNA, 36 bp, Artificial Sequence
  Synthetic oligonucleotide
ttgtgccccagcttacttgtagtcgttcctcctagc

SEQ ID NO: 60071 - DNA, 35 bp, Artificial Sequence
  Synthetic oligonucleotide
ggatcatgggcgtccacaatccacgttttcgccgc

SEQ ID NO: 60072 - DNA, 35 bp, Artificial Sequence
  Synthetic oligonucleotide
tcctacccattcgttctatcaccgccattatgggc

SEQ ID NO: 60073 - DNA, 35 bp, Artificial Sequence
  Synthetic oligonucleotide
gtccctcatctaaactggctagacaccctccctgc

SEQ ID NO: 60074 - DNA, 35 bp, Artificial Sequence
  Synthetic oligonucleotide
tggatagctcccgaggcctccgtattttcatcatc

SEQ ID NO: 60075 - DNA, 35 bp, Artificial Sequence
  Synthetic oligonucleotide
gatccaagcagggtacgccaagccactgttatatc

SEQ ID NO: 60076 - DNA, 35 bp, Artificial Sequence
  Synthetic oligonucleotide
tccttgctcagtgtccacgtggttcttcgcttctc

SEQ ID NO: 60077 - DNA, 35 bp, Artificial Sequence
  Synthetic oligonucleotide
cattgcacccccgcgcctagactcccctgctattc

SEQ ID NO: 60078 - DNA, 35 bp, Artificial Sequence
  Synthetic oligonucleotide
gaagagcaaacagagaacgtgaacatgggtgcgag

SEQ ID NO: 60079 - DNA, 35 bp, Artificial Sequence
  Synthetic oligonucleotide
atgtcactgcgcagccgatcccaatctacatcacg

SEQ ID NO: 60080 - DNA, 34 bp, Artificial Sequence
  Synthetic oligonucleotide
gggacgtgcttaaggccaatccccgctccacccg

SEQ ID NO: 60081 - DNA, 35 bp, Artificial Sequence
  Synthetic oligonucleotide
gggatgtccttctcctgttcatatcgcctgccccg

SEQ ID NO: 60082 - DNA, 35 bp, Artificial Sequence
  Synthetic oligonucleotide
ttaaccatcgctcgccgtctttttttttattgccg

SEQ ID NO: 60083 - DNA, 35 bp, Artificial Sequence
  Synthetic oligonucleotide
tgtagcccttctccccacacttcagcctcaccgcg

SEQ ID NO: 60084 - DNA, 35 bp, Artificial Sequence
  Synthetic oligonucleotide
tagtcaatcgccgcgctgatcggaaccacccctcg

SEQ ID NO: 60085 - DNA, 35 bp, Artificial Sequence
  Synthetic oligonucleotide
tcacgaggcaccaaacctatcctacgcttaacagg

SEQ ID NO: 60086 - DNA, 35 bp, Artificial Sequence
  Synthetic oligonucleotide
gccactccgcgcacccactgaatcggctatgaggg

SEQ ID NO: 60087 - DNA, 35 bp, Artificial Sequence
  Synthetic oligonucleotide
ttggggagcccctgtaaattggaatgaaaatctgg

SEQ ID NO: 60088 - DNA, 35 bp, Artificial Sequence
  Synthetic oligonucleotide
gaagttggtaggagggcgcgcggggccatgggatg

SEQ ID NO: 60089 - DNA, 35 bp, Artificial Sequence
  Synthetic oligonucleotide
gctattcagcgctcggttgcatcttttattccctg

SEQ ID NO: 60090 - DNA, 35 bp, Artificial Sequence
  Synthetic oligonucleotide
tagatgcactacagctttccgacctctcgatctat

SEQ ID NO: 60091 - DNA, 35 bp, Artificial Sequence
  Synthetic oligonucleotide
agtgacgggggagtagcgttagcaccagattcgct

SEQ ID NO: 60092 - DNA, 35 bp, Artificial Sequence
  Synthetic oligonucleotide
acctacctgccccggcttcggtttattattgttct

SEQ ID NO: 60093 - DNA, 35 bp, Artificial Sequence
  Synthetic oligonucleotide
gaacagcaaagtcaatacataggccgcatgtttct

SEQ ID NO: 60094 - DNA, 35 bp, Artificial Sequence
  Synthetic oligonucleotide
gctatctgacacccaggcgcgtggctccacccggt

SEQ ID NO: 60095 - DNA, 35 bp, Artificial Sequence
  Synthetic oligonucleotide
gcgaaccccccccatcctgccgttagtcggactgt

SEQ ID NO: 60096 - DNA, 35 bp, Artificial Sequence
  Synthetic oligonucleotide
gctcgtacgccgccccgacacattactcttcgtgt

SEQ ID NO: 60097 - DNA, 35 bp, Artificial Sequence
  Synthetic oligonucleotide
ttcggtaaggccccgccatgctttttgaactcatt

SEQ ID NO: 60098 - DNA, 35 bp, Artificial Sequence
  Synthetic oligonucleotide
tcacgccgtaactgtcatccttcgctaaagaagtt

SEQ ID NO: 60099 - DNA, 35 bp, Artificial Sequence
  Synthetic oligonucleotide
tgcactgtcatttggttaaccaacccatccttgtt

SEQ ID NO: 60100 - DNA, 35 bp, Artificial Sequence
  Synthetic oligonucleotide
ggatagggtccggcccccctttgccccttaggttt

SEQ ID NO: 60101 - DNA, 36 bp, Artificial Sequence
  Synthetic oligonucleotide
accgacatgtcttaaatcgtgacctctcgcaacaaa

SEQ ID NO: 60102 - DNA, 36 bp, Artificial Sequence
  Synthetic oligonucleotide
agagtccggtcgcgcgatatggcccccttcgttaaa

SEQ ID NO: 60103 - DNA, 36 bp, Artificial Sequence
  Synthetic oligonucleotide
atcatgacccctcacggtgaaaacactggacacgaa

SEQ ID NO: 60104 - DNA, 36 bp, Artificial Sequence
  Synthetic oligonucleotide
accactgctcctcatatcagcatgctgcttagggaa

SEQ ID NO: 60105 - DNA, 36 bp, Artificial Sequence
  Synthetic oligonucleotide
gcttagggcctcagggcggaattaggggggaagtaa

SEQ ID NO: 60106 - DNA, 36 bp, Artificial Sequence
  Synthetic oligonucleotide
gttggtggacaaggaatgggtgggcgtagtcagtaa

SEQ ID NO: 60107 - DNA, 36 bp, Artificial Sequence
  Synthetic oligonucleotide
aatcagtacgcgtacttgtcccgttggccatcacca

SEQ ID NO: 60108 - DNA, 36 bp, Artificial Sequence
  Synthetic oligonucleotide
atgaccatcgccgaagtccccaaggagttctcccca

SEQ ID NO: 60109 - DNA, 36 bp, Artificial Sequence
  Synthetic oligonucleotide
actgtacgttcctccgtcttattggaaaactgccca

SEQ ID NO: 60110 - DNA, 36 bp, Artificial Sequence
  Synthetic oligonucleotide
tagacccacgtcgtatttccggccaggactcctcca

SEQ ID NO: 60111 - DNA, 36 bp, Artificial Sequence
  Synthetic oligonucleotide
gaacgcgaaggagggatgactgggtagaagtggtca

SEQ ID NO: 60112 - DNA, 37 bp, Artificial Sequence
  Synthetic oligonucleotide
gaacgtgcagtaggtttgggtagtagtggtgggaaga

SEQ ID NO: 60113 - DNA, 37 bp, Artificial Sequence
  Synthetic oligonucleotide
acgtccacacgtcgtacttttgcccactcctgttaga

SEQ ID NO: 60114 - DNA, 35 bp, Artificial Sequence
  Synthetic oligonucleotide
gcctgcataaagccgcatgcactatctccatacga

SEQ ID NO: 60115 - DNA, 35 bp, Artificial Sequence
  Synthetic oligonucleotide
accaccgcggatgcccacacacttgactagtacga

SEQ ID NO: 60116 - DNA, 37 bp, Artificial Sequence
  Synthetic oligonucleotide
tctacgctccgaaatccgttgaaccccatcataccga

SEQ ID NO: 60117 - DNA, 36 bp, Artificial Sequence
  Synthetic oligonucleotide
tcacgatcacagcgtattcctaaacaaatgccccga

SEQ ID NO: 60118 - DNA, 36 bp, Artificial Sequence
  Synthetic oligonucleotide
tacatcccctgaggcctccgtccatgagctcggcga

SEQ ID NO: 60119 - DNA, 37 bp, Artificial Sequence
  Synthetic oligonucleotide
gttgcgttcggccttttatgctgttctgccccctcga

SEQ ID NO: 60120 - DNA, 35 bp, Artificial Sequence
  Synthetic oligonucleotide
aagacggcggagtgacaggatcaaggaaaagagga

SEQ ID NO: 60121 - DNA, 37 bp, Artificial Sequence
  Synthetic oligonucleotide
tccaccgcatttcccggcgtatgatctatcgcccgga

SEQ ID NO: 60122 - DNA, 37 bp, Artificial Sequence
  Synthetic oligonucleotide
gacgtcgggcgggagaagactgactatgggacaggga

SEQ ID NO: 60123 - DNA, 37 bp, Artificial Sequence
  Synthetic oligonucleotide
acattccatcccagagcccaccgtctgtatacttgga

SEQ ID NO: 60124 - DNA, 37 bp, Artificial Sequence
  Synthetic oligonucleotide
ggatagcgccggggctttactaccaacctcttcatga

SEQ ID NO: 60125 - DNA, 38 bp, Artificial Sequence
  Synthetic oligonucleotide
gagacgtggctgggggaatgggaatcgattggtgatga

SEQ ID NO: 60126 - DNA, 35 bp, Artificial Sequence
  Synthetic oligonucleotide
gacgaacgaacagttagagtctgcccttctactga

SEQ ID NO: 60127 - DNA, 38 bp, Artificial Sequence
  Synthetic oligonucleotide
attgtgcagcagtttctcctgcttttatttggacctga

SEQ ID NO: 60128 - DNA, 37 bp, Artificial Sequence
  Synthetic oligonucleotide
ggatgtcctccccggtgattgcttactatccttctga

SEQ ID NO: 60129 - DNA, 38 bp, Artificial Sequence
  Synthetic oligonucleotide
tatcacttcccatgccaacgactccactgttcaagtga

SEQ ID NO: 60130 - DNA, 37 bp, Artificial Sequence
  Synthetic oligonucleotide
aaaccgcccaggaaccccctttggccgtgtgacgtga

SEQ ID NO: 60131 - DNA, 38 bp, Artificial Sequence
  Synthetic oligonucleotide
acaccgcacgcactagtatgatgctctagccaccgtga

SEQ ID NO: 60132 - DNA, 38 bp, Artificial Sequence
  Synthetic oligonucleotide
accgagagggggattgcgggaataacatggggaggtga

SEQ ID NO: 60133 - DNA, 38 bp, Artificial Sequence
  Synthetic oligonucleotide
gaggaagtgtaggaatactgagggagtggaaggggtga

SEQ ID NO: 60134 - DNA, 38 bp, Artificial Sequence
  Synthetic oligonucleotide
atggggcgggcattgcgaagaggtaagggggtgtgtga

SEQ ID NO: 60135 - DNA, 38 bp, Artificial Sequence
  Synthetic oligonucleotide
gacactgctgcgaacttcgccagaccctacaattgtga

SEQ ID NO: 60136 - DNA, 38 bp, Artificial Sequence
  Synthetic oligonucleotide
tcacgagcgcaggtgctgccctttgttgtctcagttga

SEQ ID NO: 60137 - DNA, 36 bp, Artificial Sequence
  Synthetic oligonucleotide
tcatcgtgcccgggggactctttaacgcataccata

SEQ ID NO: 60138 - DNA, 35 bp, Artificial Sequence
  Synthetic oligonucleotide
aattggactgcctctgtttttctgcgcctcccata

SEQ ID NO: 60139 - DNA, 36 bp, Artificial Sequence
  Synthetic oligonucleotide
tgcatccccaccgtaagctgcgatcgaactacgata

SEQ ID NO: 60140 - DNA, 35 bp, Artificial Sequence
  Synthetic oligonucleotide
ttggaaactgggggcgggagagtaggaattggata

SEQ ID NO: 60141 - DNA, 36 bp, Artificial Sequence
  Synthetic oligonucleotide
tatatgcaacatcggctcccactcgacaccaggcta

SEQ ID NO: 60142 - DNA, 35 bp, Artificial Sequence
  Synthetic oligonucleotide
gcataacccgccttttattggtatttgttaccgta

SEQ ID NO: 60143 - DNA, 36 bp, Artificial Sequence
  Synthetic oligonucleotide
gccaaccttcaagcgatgatagccctccttccatta

SEQ ID NO: 60144 - DNA, 36 bp, Artificial Sequence
  Synthetic oligonucleotide
tcaaggcctcaaccacctttgacccgttaacgctta

SEQ ID NO: 60145 - DNA, 35 bp, Artificial Sequence
  Synthetic oligonucleotide
aacttctaggcctcccagtgcgcacaagcccttta

SEQ ID NO: 60146 - DNA, 35 bp, Artificial Sequence
  Synthetic oligonucleotide
atgcgaagctggcctatatattcgtcaaattgcac

SEQ ID NO: 60147 - DNA, 35 bp, Artificial Sequence
  Synthetic oligonucleotide
gataccagcagcccgtgccgtgtcacacctttcac

SEQ ID NO: 60148 - DNA, 35 bp, Artificial Sequence
  Synthetic oligonucleotide
tacccgtgctctgtttcggacgctatctattaacc

SEQ ID NO: 60149 - DNA, 35 bp, Artificial Sequence
  Synthetic oligonucleotide
tttggctaccaccccatatctgcctgtcggatccc

SEQ ID NO: 60150 - DNA, 35 bp, Artificial Sequence
  Synthetic oligonucleotide
gtctccctcacgttcctctcgaactgcgccctgcc

SEQ ID NO: 60151 - DNA, 35 bp, Artificial Sequence
  Synthetic oligonucleotide
tgctcacccgctgctggtccgtcgctccccactcc

SEQ ID NO: 60152 - DNA, 35 bp, Artificial Sequence
  Synthetic oligonucleotide
cccccaccccggcctgttgctggcgtgttccctcc

SEQ ID NO: 60153 - DNA, 35 bp, Artificial Sequence
  Synthetic oligonucleotide
acgtggcaaaacccacgtaactgtaatccacttcc

SEQ ID NO: 60154 - DNA, 35 bp, Artificial Sequence
  Synthetic oligonucleotide
ggtgctcccagcctccctttgttcagtagccccgc

SEQ ID NO: 60155 - DNA, 35 bp, Artificial Sequence
  Synthetic oligonucleotide
atcgaatgaagtggtgggattgtggcagatatggc

SEQ ID NO: 60156 - DNA, 35 bp, Artificial Sequence
  Synthetic oligonucleotide
cacgggccatacgcatgtgtctcatgtacacgtgc

SEQ ID NO: 60157 - DNA, 35 bp, Artificial Sequence
  Synthetic oligonucleotide
gcctccatcgcaaaagtgccacgcatcccgcttgc

SEQ ID NO: 60158 - DNA, 35 bp, Artificial Sequence
  Synthetic oligonucleotide
atcgtgcccatcttagagacctcgtgtttgtttgc

SEQ ID NO: 60159 - DNA, 35 bp, Artificial Sequence
  Synthetic oligonucleotide
gctcaaacgttatccctgccgttccgtcaccattc

SEQ ID NO: 60160 - DNA, 35 bp, Artificial Sequence
  Synthetic oligonucleotide
ggtggtacggggaaggaaataatggttattaaggg

SEQ ID NO: 60161 - DNA, 35 bp, Artificial Sequence
  Synthetic oligonucleotide
actgcggtgaatagggcattttgattgaggtgtgg

SEQ ID NO: 60162 - DNA, 35 bp, Artificial Sequence
  Synthetic oligonucleotide
gcccttcccaagatgagtattacccacccttactg

SEQ ID NO: 60163 - DNA, 35 bp, Artificial Sequence
  Synthetic oligonucleotide
tgagccccccgctcagactatccgctttgttgaat

SEQ ID NO: 60164 - DNA, 35 bp, Artificial Sequence
  Synthetic oligonucleotide
acatcccgctctttcacctcggaagtagagatact

SEQ ID NO: 60165 - DNA, 35 bp, Artificial Sequence
  Synthetic oligonucleotide
acgctgcctccaccagtagttagcttacctgtgct

SEQ ID NO: 60166 - DNA, 35 bp, Artificial Sequence
  Synthetic oligonucleotide
aggaccgacaccaccctccgtaatcgcgattgtct

SEQ ID NO: 60167 - DNA, 35 bp, Artificial Sequence
  Synthetic oligonucleotide
tgagcggcactatcgcacgtgcggatatgctcctt

SEQ ID NO: 60168 - DNA, 35 bp, Artificial Sequence
  Synthetic oligonucleotide
aagacacatccctcgttcctgaattcgctgtattt

SEQ ID NO: 60169 - DNA, 36 bp, Artificial Sequence
  Synthetic oligonucleotide
atccatccgctcgcccgtacaagcacgcacacccaa

SEQ ID NO: 60170 - DNA, 36 bp, Artificial Sequence
  Synthetic oligonucleotide
aagcaacggaaccggcgggtcgaacaaaaatggcaa

SEQ ID NO: 60171 - DNA, 36 bp, Artificial Sequence
  Synthetic oligonucleotide
gtaaccctgggaccatactacgacagtctccgagaa

SEQ ID NO: 60172 - DNA, 35 bp, Artificial Sequence
  Synthetic oligonucleotide
gtgacatcacaccgtctcctcgaaatacgctagaa

SEQ ID NO: 60173 - DNA, 36 bp, Artificial Sequence
  Synthetic oligonucleotide
ggagagcgaggtggtctaagtgggcggaggttggaa

SEQ ID NO: 60174 - DNA, 36 bp, Artificial Sequence
  Synthetic oligonucleotide
tccatcacgccgtatttcgctacatttcattgtcca

SEQ ID NO: 60175 - DNA, 35 bp, Artificial Sequence
  Synthetic oligonucleotide
tgcccgctgctcgcaagctatatctcgttcttcca

SEQ ID NO: 60176 - DNA, 35 bp, Artificial Sequence
  Synthetic oligonucleotide
ttgccacccacctggacgttctagagctggtcgca

SEQ ID NO: 60177 - DNA, 36 bp, Artificial Sequence
  Synthetic oligonucleotide
ttgccacgcttgacgaaccatcttatttcagttgca

SEQ ID NO: 60178 - DNA, 36 bp, Artificial Sequence
  Synthetic oligonucleotide
gttaccatctgcgcgaactgtttttggcctaactca

SEQ ID NO: 60179 - DNA, 36 bp, Artificial Sequence
  Synthetic oligonucleotide
ttggtcaattgccgatttcctgcccggatctactca

SEQ ID NO: 60180 - DNA, 36 bp, Artificial Sequence
  Synthetic oligonucleotide
tcagcatggtcactcgggaaaatcgtagctacctca

SEQ ID NO: 60181 - DNA, 36 bp, Artificial Sequence
  Synthetic oligonucleotide
tcacgtccctgtaacccgttatggcctcttccttca

SEQ ID NO: 60182 - DNA, 35 bp, Artificial Sequence
  Synthetic oligonucleotide
tgtatccacgcccccaagtacaaccgattctttca

SEQ ID NO: 60183 - DNA, 37 bp, Artificial Sequence
  Synthetic oligonucleotide
gtaaggggacacaagcaaagggcaagacggggggaga

SEQ ID NO: 60184 - DNA, 37 bp, Artificial Sequence
  Synthetic oligonucleotide
tagacaacgagaggcgtaaccgtcagcctggttgaga

SEQ ID NO: 60185 - DNA, 37 bp, Artificial Sequence
  Synthetic oligonucleotide
acacgctctacatgccccgacccgcttcgaccaacga

SEQ ID NO: 60186 - DNA, 37 bp, Artificial Sequence
  Synthetic oligonucleotide
tctgcggacgcagaatcgatagcgtaccaacccacga

SEQ ID NO: 60187 - DNA, 36 bp, Artificial Sequence
  Synthetic oligonucleotide
actccgcaccaacactgccccctgagcctgccacga

SEQ ID NO: 60188 - DNA, 37 bp, Artificial Sequence
  Synthetic oligonucleotide
gcgccctcagcctcctctatcccaccgtattttacga

SEQ ID NO: 60189 - DNA, 37 bp, Artificial Sequence
  Synthetic oligonucleotide
tacgttcgacctcggatctacagcctactttacccga

SEQ ID NO: 60190 - DNA, 37 bp, Artificial Sequence
  Synthetic oligonucleotide
gaggggtggagccgaggagataggggggtcgctccga

SEQ ID NO: 60191 - DNA, 35 bp, Artificial Sequence
  Synthetic oligonucleotide
gggtagacaataaagggtaggaacggtgacggcga

SEQ ID NO: 60192 - DNA, 37 bp, Artificial Sequence
  Synthetic oligonucleotide
agagcccagctacttcagccctctccatgcactgcga

SEQ ID NO: 60193 - DNA, 35 bp, Artificial Sequence
  Synthetic oligonucleotide
agttaccccatgcccggaaccccctccaccatcga

SEQ ID NO: 60194 - DNA, 37 bp, Artificial Sequence
  Synthetic oligonucleotide
tcttccgcacgtctcgtctctttccgcccactatcga

SEQ ID NO: 60195 - DNA, 37 bp, Artificial Sequence
  Synthetic oligonucleotide
gccgggagggaaagatgggtggtgagagtttctagga

SEQ ID NO: 60196 - DNA, 36 bp, Artificial Sequence
  Synthetic oligonucleotide
taggaagacctcaactgcttgcatacccaccccgga

SEQ ID NO: 60197 - DNA, 36 bp, Artificial Sequence
  Synthetic oligonucleotide
gcgtaagcatgggcaaggtggggggtcatgtaggga

SEQ ID NO: 60198 - DNA, 37 bp, Artificial Sequence
  Synthetic oligonucleotide
gtgtaggcgaccgtaagagggtgcgggggttggggga

SEQ ID NO: 60199 - DNA, 36 bp, Artificial Sequence
  Synthetic oligonucleotide
ggtgctcgccggagaggaggggatcaaaagatggga

SEQ ID NO: 60200 - DNA, 35 bp, Artificial Sequence
  Synthetic oligonucleotide
agaggggcgaaataattggtgggtgggaagttgga

SEQ ID NO: 60201 - DNA, 36 bp, Artificial Sequence
  Synthetic oligonucleotide
gtcaggtctcaggcccaagccacatcctacccatga

SEQ ID NO: 60202 - DNA, 37 bp, Artificial Sequence
  Synthetic oligonucleotide
tagcacgacaccatttacccaaccaacaccgccatga

SEQ ID NO: 60203 - DNA, 38 bp, Artificial Sequence
  Synthetic oligonucleotide
gagacagaaggggacgtggttggcgggattgacgatga

SEQ ID NO: 60204 - DNA, 38 bp, Artificial Sequence
  Synthetic oligonucleotide
tctccccccacggtatgcattcttcggtcttagactga

SEQ ID NO: 60205 - DNA, 38 bp, Artificial Sequence
  Synthetic oligonucleotide
gtgtcgcggtgtcccatccggttttctgcatttactga

SEQ ID NO: 60206 - DNA, 38 bp, Artificial Sequence
  Synthetic oligonucleotide
tcatgcccgacgcttgacgtatttatgcaccgacctga

SEQ ID NO: 60207 - DNA, 38 bp, Artificial Sequence
  Synthetic oligonucleotide
gccgggaagcaccattgggtgaaactcccactccctga

SEQ ID NO: 60208 - DNA, 38 bp, Artificial Sequence
  Synthetic oligonucleotide
agatcgccgccgtttggatcttgacttctccttcctga

SEQ ID NO: 60209 - DNA, 38 bp, Artificial Sequence
  Synthetic oligonucleotide
tgccgtctcgctcctcttgacccgctagcttttcctga

SEQ ID NO: 60210 - DNA, 37 bp, Artificial Sequence
  Synthetic oligonucleotide
tcgtccatcatgcctcggatccgctactttactctga

SEQ ID NO: 60211 - DNA, 38 bp, Artificial Sequence
  Synthetic oligonucleotide
gtttgcttgcgccccccatgacctgctaccgcctctga

SEQ ID NO: 60212 - DNA, 38 bp, Artificial Sequence
  Synthetic oligonucleotide
gcgacgaaggtggttacgggtgctttaggggcgggtga

SEQ ID NO: 60213 - DNA, 38 bp, Artificial Sequence
  Synthetic oligonucleotide
gccgaggtggaataacggtgaagatgttgaccatgtga

SEQ ID NO: 60214 - DNA, 38 bp, Artificial Sequence
  Synthetic oligonucleotide
gcgtggggcgggagggcgcggggcatgatattatgtga

SEQ ID NO: 60215 - DNA, 38 bp, Artificial Sequence
  Synthetic oligonucleotide
tgatcaccaatgattccggatttcgctccattccttga

SEQ ID NO: 60216 - DNA, 38 bp, Artificial Sequence
  Synthetic oligonucleotide
tgacgtagtgcgcgggtggctttctttgctttccttga

SEQ ID NO: 60217 - DNA, 38 bp, Artificial Sequence
  Synthetic oligonucleotide
tcctgagctcaccaacatcctgtagaacccacgcttga

SEQ ID NO: 60218 - DNA, 36 bp, Artificial Sequence
  Synthetic oligonucleotide
tgaacagctggtctagcacctcttaattcacgttga

SEQ ID NO: 60219 - DNA, 38 bp, Artificial Sequence
  Synthetic oligonucleotide
atcgcccccatcaccgaagaagaggttctatcatttga

SEQ ID NO: 60220 - DNA, 37 bp, Artificial Sequence
  Synthetic oligonucleotide
ggatcagcccccgacgcgcttcccctttttcatttga

SEQ ID NO: 60221 - DNA, 36 bp, Artificial Sequence
  Synthetic oligonucleotide
aaactcggcctcatgcgcctcgcccccgtttaacta

SEQ ID NO: 60222 - DNA, 35 bp, Artificial Sequence
  Synthetic oligonucleotide
gaatgcgcattcacatgagcgtgaaggagggcgta

SEQ ID NO: 60223 - DNA, 36 bp, Artificial Sequence
  Synthetic oligonucleotide
agatggtgtggtggctggggggcttacctgctggta

SEQ ID NO: 60224 - DNA, 36 bp, Artificial Sequence
  Synthetic oligonucleotide
tctgatgacgtggtgtggtgtggatgtgtagtggta

SEQ ID NO: 60225 - DNA, 36 bp, Artificial Sequence
  Synthetic oligonucleotide
tgcgggccatatcgctctagccaactaacctcgtta

SEQ ID NO: 60226 - DNA, 35 bp, Artificial Sequence
  Synthetic oligonucleotide
tccttcgcctccttcctgacatctgctacatgtta

SEQ ID NO: 60227 - DNA, 35 bp, Artificial Sequence
  Synthetic oligonucleotide
atggggcaacggcacgaacccaacgacccttttta

SEQ ID NO: 60228 - DNA, 35 bp, Artificial Sequence
  Synthetic oligonucleotide
gtgttataacaaccgtccacgccgccaccgcttac

SEQ ID NO: 60229 - DNA, 35 bp, Artificial Sequence
  Synthetic oligonucleotide
tacgccttctctacaattgataattgccggccccc

SEQ ID NO: 60230 - DNA, 35 bp, Artificial Sequence
  Synthetic oligonucleotide
gctgcgaacctggtctaacggccgctgctacatcc

SEQ ID NO: 60231 - DNA, 36 bp, Artificial Sequence
  Synthetic oligonucleotide
ggaggggcgggaaggggtatcagctgtgggctttcc

SEQ ID NO: 60232 - DNA, 35 bp, Artificial Sequence
  Synthetic oligonucleotide
aacgcgagtctgtaccattcttatcctttaccttc

SEQ ID NO: 60233 - DNA, 35 bp, Artificial Sequence
  Synthetic oligonucleotide
atctgctccgggctcaccggtcctaatcgtttttc

SEQ ID NO: 60234 - DNA, 35 bp, Artificial Sequence
  Synthetic oligonucleotide
ttggctcccatccctcgtccaggccctgctcctag

SEQ ID NO: 60235 - DNA, 35 bp, Artificial Sequence
  Synthetic oligonucleotide
tccttcgccggaggtaacacgtcccttacctatcg

SEQ ID NO: 60236 - DNA, 35 bp, Artificial Sequence
  Synthetic oligonucleotide
ttccacccacagtatgggattttggtttatcttcg

SEQ ID NO: 60237 - DNA, 35 bp, Artificial Sequence
  Synthetic oligonucleotide
acccgcgaataataggttctgtttgttgtcccttg

SEQ ID NO: 60238 - DNA, 35 bp, Artificial Sequence
  Synthetic oligonucleotide
attcccgaacactccctgtcctgttacagtcttat

SEQ ID NO: 60239 - DNA, 35 bp, Artificial Sequence
  Synthetic oligonucleotide
ttccggggggggacgagatgacattggggtagact

SEQ ID NO: 60240 - DNA, 35 bp, Artificial Sequence
  Synthetic oligonucleotide
tatgatgcacacccggcgtggctggctccaacgct

SEQ ID NO: 60241 - DNA, 35 bp, Artificial Sequence
  Synthetic oligonucleotide
taagaaggctacgacgtactttgtctgaactctct

SEQ ID NO: 60242 - DNA, 35 bp, Artificial Sequence
  Synthetic oligonucleotide
tttcacgcgtctttcatgcctccgtttttgtctct

SEQ ID NO: 60243 - DNA, 35 bp, Artificial Sequence
  Synthetic oligonucleotide
ttccctggtcatgtcctttccactacacctttagt

SEQ ID NO: 60244 - DNA, 35 bp, Artificial Sequence
  Synthetic oligonucleotide
actcacccgtgtgtttagccgtatccttacatcgt

SEQ ID NO: 60245 - DNA, 36 bp, Artificial Sequence
  Synthetic oligonucleotide
tacaatgatggggggtgggtggatgtggtgtcaggt

SEQ ID NO: 60246 - DNA, 35 bp, Artificial Sequence
  Synthetic oligonucleotide
tttcccacacgcactgacatttgagccgctcgggt

SEQ ID NO: 60247 - DNA, 35 bp, Artificial Sequence
  Synthetic oligonucleotide
gacgtaaggagggtgggatcatgatggagcgtgtt

SEQ ID NO: 60248 - DNA, 35 bp, Artificial Sequence
  Synthetic oligonucleotide
gactccctatctagactgccttgaacggctttttt

SEQ ID NO: 60249 - DNA, 36 bp, Artificial Sequence
  Synthetic oligonucleotide
tgtcccccccgatcgacatgagtttcccagataaaa

SEQ ID NO: 60250 - DNA, 36 bp, Artificial Sequence
  Synthetic oligonucleotide
gccatcgcatccgattctaaaggcccttattctcaa

SEQ ID NO: 60251 - DNA, 35 bp, Artificial Sequence
  Synthetic oligonucleotide
gatttcgtgcgctcaacttcgccccacccgccgaa

SEQ ID NO: 60252 - DNA, 36 bp, Artificial Sequence
  Synthetic oligonucleotide
acctgggaccgcgaccccaatcgctctacagtttaa

SEQ ID NO: 60253 - DNA, 36 bp, Artificial Sequence
  Synthetic oligonucleotide
ggcattcacggccccttctacgtcctatataacaca

SEQ ID NO: 60254 - DNA, 35 bp, Artificial Sequence
  Synthetic oligonucleotide
tcaagacgactttgcttgcttcccgcccatccaca

SEQ ID NO: 60255 - DNA, 36 bp, Artificial Sequence
  Synthetic oligonucleotide
aagcaccttccgtacgaccgcaatccaggttcgaca

SEQ ID NO: 60256 - DNA, 35 bp, Artificial Sequence
  Synthetic oligonucleotide
ttcgccccacaaccgtatggttaggattgtcctca

SEQ ID NO: 60257 - DNA, 37 bp, Artificial Sequence
  Synthetic oligonucleotide
acacgtttgggtgataaaggggaatggtgggcaaaga

SEQ ID NO: 60258 - DNA, 37 bp, Artificial Sequence
  Synthetic oligonucleotide
gctgatgttccgctgcatattgcttcccttctagcga

SEQ ID NO: 60259 - DNA, 37 bp, Artificial Sequence
  Synthetic oligonucleotide
gccaacgctaccctatcaacatgtctatttgccagga

SEQ ID NO: 60260 - DNA, 37 bp, Artificial Sequence
  Synthetic oligonucleotide
gccggggtgtggaaatgtcataaatgggagaggagga

SEQ ID NO: 60261 - DNA, 37 bp, Artificial Sequence
  Synthetic oligonucleotide
tccccgctcattgctgatttctgccactcagttagga

SEQ ID NO: 60262 - DNA, 37 bp, Artificial Sequence
  Synthetic oligonucleotide
aaggataaacggggtgaggaagaacgagtgagcggga

SEQ ID NO: 60263 - DNA, 37 bp, Artificial Sequence
  Synthetic oligonucleotide
ttgggaggggctgagggtctactgggaacgatgggga

SEQ ID NO: 60264 - DNA, 36 bp, Artificial Sequence
  Synthetic oligonucleotide
tgaccgccgcagttcgcgcacccaacgtagtaatga

SEQ ID NO: 60265 - DNA, 38 bp, Artificial Sequence
  Synthetic oligonucleotide
gcgataccacgcgccgaaccagttcttttaggccatga

SEQ ID NO: 60266 - DNA, 37 bp, Artificial Sequence
  Synthetic oligonucleotide
gaggggcgggacgcttcggggattaagggagggatga

SEQ ID NO: 60267 - DNA, 38 bp, Artificial Sequence
  Synthetic oligonucleotide
tgccacggacggacggcactatagctcgtaaactatga

SEQ ID NO: 60268 - DNA, 38 bp, Artificial Sequence
  Synthetic oligonucleotide
gccgatctgcctccgaccgctataccgtatgtcactga

SEQ ID NO: 60269 - DNA, 36 bp, Artificial Sequence
  Synthetic oligonucleotide
gcactgcgattagctcgtgttctggaccccccctga

SEQ ID NO: 60270 - DNA, 38 bp, Artificial Sequence
  Synthetic oligonucleotide
gatcctccgagccccacacactgatataagtttcgtga

SEQ ID NO: 60271 - DNA, 38 bp, Artificial Sequence
  Synthetic oligonucleotide
gacactctggtgtcgaaaataacaccccttcactgtga

SEQ ID NO: 60272 - DNA, 38 bp, Artificial Sequence
  Synthetic oligonucleotide
gtcccacacatcccccggccttcggtgacgcatattga

SEQ ID NO: 60273 - DNA, 38 bp, Artificial Sequence
  Synthetic oligonucleotide
tgtgccacgccctgacgtagcggttccttaggccttga

SEQ ID NO: 60274 - DNA, 38 bp, Artificial Sequence
  Synthetic oligonucleotide
ttaggccccactcgttacattcgacaccccctccttga

SEQ ID NO: 60275 - DNA, 36 bp, Artificial Sequence
  Synthetic oligonucleotide
gatgtagaggggtgggaagatggtaatagcttgata

SEQ ID NO: 60276 - DNA, 35 bp, Artificial Sequence
  Synthetic oligonucleotide
atggtcggagtccaggaaggggggtttacaatata

SEQ ID NO: 60277 - DNA, 35 bp, Artificial Sequence
  Synthetic oligonucleotide
gaactcgcgaccatcttcctcttgcgcgtctccta

SEQ ID NO: 60278 - DNA, 35 bp, Artificial Sequence
  Synthetic oligonucleotide
gccatcactcttcccggcgatttcggtgacatcta

SEQ ID NO: 60279 - DNA, 35 bp, Artificial Sequence
  Synthetic oligonucleotide
accgcggaagagtacttgcgcttctccctcccgta

SEQ ID NO: 60280 - DNA, 36 bp, Artificial Sequence
  Synthetic oligonucleotide
tcctctgtacagacgcgcatttgaatccttcgctta

SEQ ID NO: 60281 - DNA, 36 bp, Artificial Sequence
  Synthetic oligonucleotide
aatgcatggtccgccatccatctacccacccattta

SEQ ID NO: 60282 - DNA, 35 bp, Artificial Sequence
  Synthetic oligonucleotide
tataccgccgggtccctctccaactgggccgttta

SEQ ID NO: 60283 - DNA, 35 bp, Artificial Sequence
  Synthetic oligonucleotide
ggtgcgcgccggcactttatcattctggctccaac

SEQ ID NO: 60284 - DNA, 35 bp, Artificial Sequence
  Synthetic oligonucleotide
atcccaccgcatcaccaacgatccgtctatatgac

SEQ ID NO: 60285 - DNA, 35 bp, Artificial Sequence
  Synthetic oligonucleotide
gcacccgcccgagaactccacagttccactgctac

SEQ ID NO: 60286 - DNA, 35 bp, Artificial Sequence
  Synthetic oligonucleotide
ttacctgcaatccgtctgtccctctgtcccattac

SEQ ID NO: 60287 - DNA, 35 bp, Artificial Sequence
  Synthetic oligonucleotide
agtaccggcgcatttacttaatttctatgaccacc

SEQ ID NO: 60288 - DNA, 35 bp, Artificial Sequence
  Synthetic oligonucleotide
ttgcaccctggtgcacaactatatagacattgacc

SEQ ID NO: 60289 - DNA, 35 bp, Artificial Sequence
  Synthetic oligonucleotide
gtccgaatgcctctgacccctcgcaccacatatgc

SEQ ID NO: 60290 - DNA, 35 bp, Artificial Sequence
  Synthetic oligonucleotide
cctcgatgcagtcccgagtcccatccatgtctatc

SEQ ID NO: 60291 - DNA, 35 bp, Artificial Sequence
  Synthetic oligonucleotide
tgctcaacgcaattatcatccattcgattggtctc

SEQ ID NO: 60292 - DNA, 35 bp, Artificial Sequence
  Synthetic oligonucleotide
acaggtccacgcttgccctgtgttgccactgtctc

SEQ ID NO: 60293 - DNA, 35 bp, Artificial Sequence
  Synthetic oligonucleotide
tcacagccgtccgttcatgccaccttcacgttctc

SEQ ID NO: 60294 - DNA, 35 bp, Artificial Sequence
  Synthetic oligonucleotide
gagcggactgcttcgattttcggtcactcctagtc

SEQ ID NO: 60295 - DNA, 35 bp, Artificial Sequence
  Synthetic oligonucleotide
tgtgggacgcataaattttcatggtcttactgttc

SEQ ID NO: 60296 - DNA, 35 bp, Artificial Sequence
  Synthetic oligonucleotide
gacgaggtaggtggcggggggcttggaaggtggag

SEQ ID NO: 60297 - DNA, 35 bp, Artificial Sequence
  Synthetic oligonucleotide
gccctgcgcacatcaactgagaactcgaaaatgag

SEQ ID NO: 60298 - DNA, 35 bp, Artificial Sequence
  Synthetic oligonucleotide
ttgaaccccacctctgtatgagagtgctacctgag

SEQ ID NO: 60299 - DNA, 35 bp, Artificial Sequence
  Synthetic oligonucleotide
atcgcgtggtcgggcagggaggacacacatcaacg

SEQ ID NO: 60300 - DNA, 35 bp, Artificial Sequence
  Synthetic oligonucleotide
taatagggtgcggagtccgggggatagggaatagg

SEQ ID NO: 60301 - DNA, 35 bp, Artificial Sequence
  Synthetic oligonucleotide
atgattgcaccctcagcctcctcacttccacacgg

SEQ ID NO: 60302 - DNA, 35 bp, Artificial Sequence
  Synthetic oligonucleotide
tcatggcgaagaaggaaactgatgtagggtggggg

SEQ ID NO: 60303 - DNA, 35 bp, Artificial Sequence
  Synthetic oligonucleotide
aggggcatggtcagtggaagggcggtagagttggg

SEQ ID NO: 60304 - DNA, 35 bp, Artificial Sequence
  Synthetic oligonucleotide
tttcgtaccacctgcacgttccagacgccgttgtg

SEQ ID NO: 60305 - DNA, 35 bp, Artificial Sequence
  Synthetic oligonucleotide
gagtcccatacgtggcacgtataaagtttctccat

SEQ ID NO: 60306 - DNA, 35 bp, Artificial Sequence
  Synthetic oligonucleotide
tcaacgacattggcacagccccgcctaactatcat

SEQ ID NO: 60307 - DNA, 35 bp, Artificial Sequence
  Synthetic oligonucleotide
acgaacgggggggccttaaatacatggctgggact

SEQ ID NO: 60308 - DNA, 35 bp, Artificial Sequence
  Synthetic oligonucleotide
gctattccaatcttgcatgaactgccgggttacct

SEQ ID NO: 60309 - DNA, 35 bp, Artificial Sequence
  Synthetic oligonucleotide
gcaacacgcgccaccggatttgctctattcagtct

SEQ ID NO: 60310 - DNA, 35 bp, Artificial Sequence
  Synthetic oligonucleotide
atgaggggtggtggctttttccggggctgacacgt

SEQ ID NO: 60311 - DNA, 35 bp, Artificial Sequence
  Synthetic oligonucleotide
ttcgaccatttcctccgcgcattgattacttccgt

SEQ ID NO: 60312 - DNA, 35 bp, Artificial Sequence
  Synthetic oligonucleotide
tatggccctcgaaccaccttttactggaccaatgt

SEQ ID NO: 60313 - DNA, 35 bp, Artificial Sequence
  Synthetic oligonucleotide
gagatgctggtaatcgtgccagaccttgtaccctt

SEQ ID NO: 60314 - DNA, 35 bp, Artificial Sequence
  Synthetic oligonucleotide
cgaggtaggcgtactccccgtcggatatccccctt

SEQ ID NO: 60315 - DNA, 35 bp, Artificial Sequence
  Synthetic oligonucleotide
atccgggcctatcgctgccatcgcctcgcgagttt

SEQ ID NO: 60316 - DNA, 35 bp, Artificial Sequence
  Synthetic oligonucleotide
gtgctacgcagtttccgggttacacgccttttttt

SEQ ID NO: 60317 - DNA, 35 bp, Artificial Sequence
  Synthetic oligonucleotide
gcacgaggaaggagggtagctacacaatgggtcaa

SEQ ID NO: 60318 - DNA, 36 bp, Artificial Sequence
  Synthetic oligonucleotide
tgagggatcgggggggttgaggaggagtagttgtaa

SEQ ID NO: 60319 - DNA, 36 bp, Artificial Sequence
  Synthetic oligonucleotide
tatgaccgcagatgtgctggtcacatatgtcgttaa

SEQ ID NO: 60320 - DNA, 36 bp, Artificial Sequence
  Synthetic oligonucleotide
tccacgccctcatcaaccagggacccggtatgacca

SEQ ID NO: 60321 - DNA, 36 bp, Artificial Sequence
  Synthetic oligonucleotide
gccctcccctcgcggactcaaatgctgaaagcccca

SEQ ID NO: 60322 - DNA, 36 bp, Artificial Sequence
  Synthetic oligonucleotide
aacgaaccaccccactcagtcgcggataatttgcca

SEQ ID NO: 60323 - DNA, 36 bp, Artificial Sequence
  Synthetic oligonucleotide
tattgccaccaccaaactgtgaacaggtcgctagca

SEQ ID NO: 60324 - DNA, 35 bp, Artificial Sequence
  Synthetic oligonucleotide
gttcaagcacgtactaccatcagcattgcttatca

SEQ ID NO: 60325 - DNA, 37 bp, Artificial Sequence
  Synthetic oligonucleotide
accgcacgacggcggtacggggcagtggaactccaga

SEQ ID NO: 60326 - DNA, 37 bp, Artificial Sequence
  Synthetic oligonucleotide
ggccacgggaactgggagcagggggcaaggtacgaga

SEQ ID NO: 60327 - DNA, 37 bp, Artificial Sequence
  Synthetic oligonucleotide
aacaccgaatcactacgtgcggaaggggacagcgaga

SEQ ID NO: 60328 - DNA, 36 bp, Artificial Sequence
  Synthetic oligonucleotide
ttgggtggagttagggatgaggacctgctgggacga

SEQ ID NO: 60329 - DNA, 37 bp, Artificial Sequence
  Synthetic oligonucleotide
atgctgaattgcccacatgccgcttagactcctccga

SEQ ID NO: 60330 - DNA, 37 bp, Artificial Sequence
  Synthetic oligonucleotide
tacggaccgcacactcctgccacaagcacacttccga

SEQ ID NO: 60331 - DNA, 37 bp, Artificial Sequence
  Synthetic oligonucleotide
ttcccacacccgttgtatccgttcgtccatcacgcga

SEQ ID NO: 60332 - DNA, 37 bp, Artificial Sequence
  Synthetic oligonucleotide
ggagagcgacatattgggcaagggttggggcgggcga

SEQ ID NO: 60333 - DNA, 35 bp, Artificial Sequence
  Synthetic oligonucleotide
tcagtctgatgcgtcacgccacactcaccatgcga

SEQ ID NO: 60334 - DNA, 35 bp, Artificial Sequence
  Synthetic oligonucleotide
gttaccagcctcacgtatacgcaattccacatcga

SEQ ID NO: 60335 - DNA, 35 bp, Artificial Sequence
  Synthetic oligonucleotide
accatagccccgccgcatccttacatttttatcga

SEQ ID NO: 60336 - DNA, 37 bp, Artificial Sequence
  Synthetic oligonucleotide
gagtgggagttgagaggtggggaacgcatgagaagga

SEQ ID NO: 60337 - DNA, 37 bp, Artificial Sequence
  Synthetic oligonucleotide
ttgccctctctccatggctcttaatgctaacgcagga

SEQ ID NO: 60338 - DNA, 37 bp, Artificial Sequence
  Synthetic oligonucleotide
taacaccaccgcctctggtcgacattccctgatagga

SEQ ID NO: 60339 - DNA, 37 bp, Artificial Sequence
  Synthetic oligonucleotide
gccatgaggtaagggggagggaccgtttccggacgga

SEQ ID NO: 60340 - DNA, 36 bp, Artificial Sequence
  Synthetic oligonucleotide
agagcggagagcagaataaccatgaatagcggggga

SEQ ID NO: 60341 - DNA, 38 bp, Artificial Sequence
  Synthetic oligonucleotide
accgcagaactcccactgcacgaacggaccatctatga

SEQ ID NO: 60342 - DNA, 38 bp, Artificial Sequence
  Synthetic oligonucleotide
gatagaggaacgcaagcagaaagagacgctcgtactga

SEQ ID NO: 60343 - DNA, 38 bp, Artificial Sequence
  Synthetic oligonucleotide
acacctgagctcggcccccgccccgaatgcttacctga

SEQ ID NO: 60344 - DNA, 38 bp, Artificial Sequence
  Synthetic oligonucleotide
taccgccttaacacatcgctatactgcccaggtcctga

SEQ ID NO: 60345 - DNA, 37 bp, Artificial Sequence
  Synthetic oligonucleotide
gttagagcctgcaacccctcgtcaccttctccgctga

SEQ ID NO: 60346 - DNA, 37 bp, Artificial Sequence
  Synthetic oligonucleotide
gtgaggccggccgctctattcagtgtactcctgctga

SEQ ID NO: 60347 - DNA, 35 bp, Artificial Sequence
  Synthetic oligonucleotide
aaccgcgaacgctggcgatttttgtactcacgtga

SEQ ID NO: 60348 - DNA, 38 bp, Artificial Sequence
  Synthetic oligonucleotide
tctgtactgttgcttcctcgagctcatcgaccccttga

SEQ ID NO: 60349 - DNA, 38 bp, Artificial Sequence
  Synthetic oligonucleotide
acagcccgcttgcttgtagctagtccccgttatcttga

SEQ ID NO: 60350 - DNA, 38 bp, Artificial Sequence
  Synthetic oligonucleotide
gcacaatggagggactaggtagagaggttcgcagttga

SEQ ID NO: 60351 - DNA, 38 bp, Artificial Sequence
  Synthetic oligonucleotide
tctgtgcgccgctttcatctgcattctttgtactttga

SEQ ID NO: 60352 - DNA, 35 bp, Artificial Sequence
  Synthetic oligonucleotide
gtctgcccgctactttgttccgcttttcgaatata

SEQ ID NO: 60353 - DNA, 36 bp, Artificial Sequence
  Synthetic oligonucleotide
gtaccgcccggttttgaccgcccatttcctaatcta

SEQ ID NO: 60354 - DNA, 36 bp, Artificial Sequence
  Synthetic oligonucleotide
gaggggtgggaagggcagtacgagcggtcataatta

SEQ ID NO: 60355 - DNA, 35 bp, Artificial Sequence
  Synthetic oligonucleotide
acactctctcacacgttggatagaccccgcgcaac

SEQ ID NO: 60356 - DNA, 35 bp, Artificial Sequence
  Synthetic oligonucleotide
accacctctgatgccatcgatggtgtggctcatac

SEQ ID NO: 60357 - DNA, 35 bp, Artificial Sequence
  Synthetic oligonucleotide
ccaaaaccagggcccaccacctcgggggagtatac

SEQ ID NO: 60358 - DNA, 35 bp, Artificial Sequence
  Synthetic oligonucleotide
gttacactgccacgggtactgtaagtccccactac

SEQ ID NO: 60359 - DNA, 35 bp, Artificial Sequence
  Synthetic oligonucleotide
ggacccgctctggtgtgaatacacccctgtccccc

SEQ ID NO: 60360 - DNA, 35 bp, Artificial Sequence
  Synthetic oligonucleotide
tcacatcgaaatccatcgccggggaacgaatcccc

SEQ ID NO: 60361 - DNA, 35 bp, Artificial Sequence
  Synthetic oligonucleotide
ggtcccgcatgctgccccccccggcgacagatccc

SEQ ID NO: 60362 - DNA, 35 bp, Artificial Sequence
  Synthetic oligonucleotide
tggtcctccgacccggtaccacgactcctagttcc

SEQ ID NO: 60363 - DNA, 35 bp, Artificial Sequence
  Synthetic oligonucleotide
gtaggacatactgaacgtgatacgcgccctcccgc

SEQ ID NO: 60364 - DNA, 35 bp, Artificial Sequence
  Synthetic oligonucleotide
agcacgacgcatccgttaactggttttttacgctc

SEQ ID NO: 60365 - DNA, 35 bp, Artificial Sequence
  Synthetic oligonucleotide
gatcgtgtagttagggtggtgcgggtggtgttagg

SEQ ID NO: 60366 - DNA, 35 bp, Artificial Sequence
  Synthetic oligonucleotide
gtagacaaggagggggctgagaaatcggatcacgg

SEQ ID NO: 60367 - DNA, 35 bp, Artificial Sequence
  Synthetic oligonucleotide
atgtaactcccgcaggtcccggtccatctctcgtg

SEQ ID NO: 60368 - DNA, 35 bp, Artificial Sequence
  Synthetic oligonucleotide
gtccgccccctgtggtttcccctgcgttggccttg

SEQ ID NO: 60369 - DNA, 35 bp, Artificial Sequence
  Synthetic oligonucleotide
acatcaacctcccgccctgctgcagccgatcgaat

SEQ ID NO: 60370 - DNA, 35 bp, Artificial Sequence
  Synthetic oligonucleotide
actgcccgacccgtggccgccccctcggatcaact

SEQ ID NO: 60371 - DNA, 35 bp, Artificial Sequence
  Synthetic oligonucleotide
gcgcgaaaggatccccaggcgccaccacactccct

SEQ ID NO: 60372 - DNA, 35 bp, Artificial Sequence
  Synthetic oligonucleotide
gcctcagcagatgactcaccaacctgtccagcgct

SEQ ID NO: 60373 - DNA, 35 bp, Artificial Sequence
  Synthetic oligonucleotide
tacatggtcgactcgtggcaggcattcttcactct

SEQ ID NO: 60374 - DNA, 35 bp, Artificial Sequence
  Synthetic oligonucleotide
gcaggacaatatcgtcgcctaaccttgaacattct

SEQ ID NO: 60375 - DNA, 35 bp, Artificial Sequence
  Synthetic oligonucleotide
gttggggagttagggggattggtactatggtaagt

SEQ ID NO: 60376 - DNA, 35 bp, Artificial Sequence
  Synthetic oligonucleotide
acactcagcacatggtgtaggcgctactacccagt

SEQ ID NO: 60377 - DNA, 35 bp, Artificial Sequence
  Synthetic oligonucleotide
agtatgcctcgcatttcctacttgccatccctttt

SEQ ID NO: 60378 - DNA, 36 bp, Artificial Sequence
  Synthetic oligonucleotide
gatcagtcgctgcgggcgagtaggggcagagagaaa

SEQ ID NO: 60379 - DNA, 36 bp, Artificial Sequence
  Synthetic oligonucleotide
tgtgacggctcctcggcccctttcactgtgatccaa

SEQ ID NO: 60380 - DNA, 36 bp, Artificial Sequence
  Synthetic oligonucleotide
gagctcgttcctgcacctcatagccttcccaaagaa

SEQ ID NO: 60381 - DNA, 35 bp, Artificial Sequence
  Synthetic oligonucleotide
acatgtcgcctggttgcgcctcactcctattagaa

SEQ ID NO: 60382 - DNA, 36 bp, Artificial Sequence
  Synthetic oligonucleotide
ttgatgccctccgacgggaccgtccccatttccgaa

SEQ ID NO: 60383 - DNA, 35 bp, Artificial Sequence
  Synthetic oligonucleotide
ttctgcccctgcccggagcgccactgaaactaaca

SEQ ID NO: 60384 - DNA, 35 bp, Artificial Sequence
  Synthetic oligonucleotide
gagtcgctggtcaagggagggtcgggttttgtaca

SEQ ID NO: 60385 - DNA, 36 bp, Artificial Sequence
  Synthetic oligonucleotide
tgccgcccccgaccccttggtgccacgagccttaca

SEQ ID NO: 60386 - DNA, 36 bp, Artificial Sequence
  Synthetic oligonucleotide
gcacgatcgcattatctggctgggcgtcgaccacca

SEQ ID NO: 60387 - DNA, 35 bp, Artificial Sequence
  Synthetic oligonucleotide
accgcccagattcgccccaggatactctaccacca

SEQ ID NO: 60388 - DNA, 36 bp, Artificial Sequence
  Synthetic oligonucleotide
tgcgaggccccattagctataccggaatcccaccca

SEQ ID NO: 60389 - DNA, 36 bp, Artificial Sequence
  Synthetic oligonucleotide
tttgactggcctacacgttcattacagtgtccccca

SEQ ID NO: 60390 - DNA, 36 bp, Artificial Sequence
  Synthetic oligonucleotide
gagagggcatggaagggacaaatggggtgctttaga

SEQ ID NO: 60391 - DNA, 37 bp, Artificial Sequence
  Synthetic oligonucleotide
gcaatgtgccggggtttaggtgatggggttgcaacga

SEQ ID NO: 60392 - DNA, 36 bp, Artificial Sequence
  Synthetic oligonucleotide
gccgggagaagatgtgttggtacgggggatgcacga

SEQ ID NO: 60393 - DNA, 37 bp, Artificial Sequence
  Synthetic oligonucleotide
tgtacccggacgggaataactccttgctccactacga

SEQ ID NO: 60394 - DNA, 37 bp, Artificial Sequence
  Synthetic oligonucleotide
gtcaggagtccgtactcctgctaagaaacctcaccga

SEQ ID NO: 60395 - DNA, 35 bp, Artificial Sequence
  Synthetic oligonucleotide
gacacagtctttcctgccagtacgctgccctccga

SEQ ID NO: 60396 - DNA, 37 bp, Artificial Sequence
  Synthetic oligonucleotide
tagtgcacagctgctctatgccacacactttcaagga

SEQ ID NO: 60397 - DNA, 37 bp, Artificial Sequence
  Synthetic oligonucleotide
gagacacgctcaggaggggcatgcttggaagggagga

SEQ ID NO: 60398 - DNA, 37 bp, Artificial Sequence
  Synthetic oligonucleotide
ttaccaccctgcccgctgtagcagtcaacctggagga

SEQ ID NO: 60399 - DNA, 37 bp, Artificial Sequence
  Synthetic oligonucleotide
gctcggtccatgtcccctctcgcataccatcaccgga

SEQ ID NO: 60400 - DNA, 37 bp, Artificial Sequence
  Synthetic oligonucleotide
gacacaagggtttagcagggcaagaagaaggggcgga

SEQ ID NO: 60401 - DNA, 37 bp, Artificial Sequence
  Synthetic oligonucleotide
tgcccaccctcaagcgctactcgacgtttacatcgga

SEQ ID NO: 60402 - DNA, 37 bp, Artificial Sequence
  Synthetic oligonucleotide
gtcctacgacgcgggattgagggagggttacgaggga

SEQ ID NO: 60403 - DNA, 37 bp, Artificial Sequence
  Synthetic oligonucleotide
tgagggacggggggagaaggatggctagaggccggga

SEQ ID NO: 60404 - DNA, 37 bp, Artificial Sequence
  Synthetic oligonucleotide
ttccactgctcgtttcgcgcgcccgcacccatctgga

SEQ ID NO: 60405 - DNA, 38 bp, Artificial Sequence
  Synthetic oligonucleotide
acacagcctccgagtccgtactccggatttacacctga

SEQ ID NO: 60406 - DNA, 38 bp, Artificial Sequence
  Synthetic oligonucleotide
ggaccacgatccgcacccacgagagcactccagcctga

SEQ ID NO: 60407 - DNA, 38 bp, Artificial Sequence
  Synthetic oligonucleotide
taagtgtgaacgggccgaaaaacggggatggaggctga

SEQ ID NO: 60408 - DNA, 38 bp, Artificial Sequence
  Synthetic oligonucleotide
gtccgcgcaagttagcctcttttcgcctttctcagtga

SEQ ID NO: 60409 - DNA, 38 bp, Artificial Sequence
  Synthetic oligonucleotide
aacgctgccctgccggttggacctcaaaaatctagtga

SEQ ID NO: 60410 - DNA, 38 bp, Artificial Sequence
  Synthetic oligonucleotide
gccactgaggaaggagggaagcggacaataggtagtga

SEQ ID NO: 60411 - DNA, 38 bp, Artificial Sequence
  Synthetic oligonucleotide
tgacctggggtcaaggtgaggggggggccgataggtga

SEQ ID NO: 60412 - DNA, 38 bp, Artificial Sequence
  Synthetic oligonucleotide
tgcgcctgcacagcgtgcttccgataactcccgggtga

SEQ ID NO: 60413 - DNA, 35 bp, Artificial Sequence
  Synthetic oligonucleotide
gctggggtgggaaaacgggtggggtggttctgtga

SEQ ID NO: 60414 - DNA, 37 bp, Artificial Sequence
  Synthetic oligonucleotide
gacagtggtgacactggatggataggggaatgcttga

SEQ ID NO: 60415 - DNA, 38 bp, Artificial Sequence
  Synthetic oligonucleotide
gcagggggtggcatgaatggaacgggaaagggctttga

SEQ ID NO: 60416 - DNA, 36 bp, Artificial Sequence
  Synthetic oligonucleotide
gagggggggaaaaacgtgtcgcttcgcaacaagata

SEQ ID NO: 60417 - DNA, 36 bp, Artificial Sequence
  Synthetic oligonucleotide
gagcctgttcgccctcattttggcactgccccacta

SEQ ID NO: 60418 - DNA, 36 bp, Artificial Sequence
  Synthetic oligonucleotide
acgtcgcacctgtgaccctgttctgtctattcccta

SEQ ID NO: 60419 - DNA, 35 bp, Artificial Sequence
  Synthetic oligonucleotide
tgctcgctaggccagaccctcttattcatctcgta

SEQ ID NO: 60420 - DNA, 36 bp, Artificial Sequence
  Synthetic oligonucleotide
ttccgtccgccgactctcacgtgagatcctccttta

SEQ ID NO: 60421 - DNA, 35 bp, Artificial Sequence
  Synthetic oligonucleotide
tccccccatgacggttgctcttgcgctgtgcacac

SEQ ID NO: 60422 - DNA, 35 bp, Artificial Sequence
  Synthetic oligonucleotide
gacgggtagccccggtcctaacgtaccaaataacc

SEQ ID NO: 60423 - DNA, 35 bp, Artificial Sequence
  Synthetic oligonucleotide
gttctgcccacctcatctgagggaaatacgccacc

SEQ ID NO: 60424 - DNA, 35 bp, Artificial Sequence
  Synthetic oligonucleotide
acaccctcgatcaccttttctttacgctccccgcc

SEQ ID NO: 60425 - DNA, 35 bp, Artificial Sequence
  Synthetic oligonucleotide
acgcaagggaaggctaagcagtataggatggggcc

SEQ ID NO: 60426 - DNA, 35 bp, Artificial Sequence
  Synthetic oligonucleotide
gctggcacacggccttctctgtgtcgttgtcctcc

SEQ ID NO: 60427 - DNA, 35 bp, Artificial Sequence
  Synthetic oligonucleotide
atggtccggcgggtttcctgcggcccctcatctcc

SEQ ID NO: 60428 - DNA, 35 bp, Artificial Sequence
  Synthetic oligonucleotide
gcgcaccttccaattcgccactcagttcgatcggc

SEQ ID NO: 60429 - DNA, 35 bp, Artificial Sequence
  Synthetic oligonucleotide
gagtcagagccttattgctgctcctccccgctggc

SEQ ID NO: 60430 - DNA, 35 bp, Artificial Sequence
  Synthetic oligonucleotide
atgtgatggtggccccttgacctcccgaggcctgc

SEQ ID NO: 60431 - DNA, 35 bp, Artificial Sequence
  Synthetic oligonucleotide
ttctggaccagacgtacttcaccctcatcagcatc

SEQ ID NO: 60432 - DNA, 35 bp, Artificial Sequence
  Synthetic oligonucleotide
tgtcgcccctgtcctttataacccctcctgcgctc

SEQ ID NO: 60433 - DNA, 35 bp, Artificial Sequence
  Synthetic oligonucleotide
gggtgctaacgacggtagcacaatcccgaactctc

SEQ ID NO: 60434 - DNA, 35 bp, Artificial Sequence
  Synthetic oligonucleotide
aatccgaaccaatcgtagtaccatcgatcacattc

SEQ ID NO: 60435 - DNA, 35 bp, Artificial Sequence
  Synthetic oligonucleotide
acagcacctgccccgaatactgagcctcaaatttc

SEQ ID NO: 60436 - DNA, 35 bp, Artificial Sequence
  Synthetic oligonucleotide
gagctcgtcctgcgactcaatgtccacactctttc

SEQ ID NO: 60437 - DNA, 35 bp, Artificial Sequence
  Synthetic oligonucleotide
accctcagccgcctcctgtcccgcacccactcgag

SEQ ID NO: 60438 - DNA, 35 bp, Artificial Sequence
  Synthetic oligonucleotide
gttgcatgtgcactgttccattttctcaatcatag

SEQ ID NO: 60439 - DNA, 35 bp, Artificial Sequence
  Synthetic oligonucleotide
agaggccggggggaaacaggagggagctgggtccg

SEQ ID NO: 60440 - DNA, 35 bp, Artificial Sequence
  Synthetic oligonucleotide
gcggacaccgtagataccccgtctcgccattctcg

SEQ ID NO: 60441 - DNA, 35 bp, Artificial Sequence
  Synthetic oligonucleotide
atggtggccgcacacctacatgaatcactttattg

SEQ ID NO: 60442 - DNA, 35 bp, Artificial Sequence
  Synthetic oligonucleotide
acatagcgctagtgatcgctcaacccaccctgcat

SEQ ID NO: 60443 - DNA, 31 bp, Artificial Sequence
  Synthetic oligonucleotide
ttggaatcccgttaagccactgaatcatcct

SEQ ID NO: 60444 - DNA, 35 bp, Artificial Sequence
  Synthetic oligonucleotide
ttcagatctcaagctttttacaggcactatctcct

SEQ ID NO: 60445 - DNA, 35 bp, Artificial Sequence
  Synthetic oligonucleotide
tcccacccagtcggtactaacgaggtagtccatct

SEQ ID NO: 60446 - DNA, 36 bp, Artificial Sequence
  Synthetic oligonucleotide
acagacccagcctacgatcttatccaccaagttggt

SEQ ID NO: 60447 - DNA, 35 bp, Artificial Sequence
  Synthetic oligonucleotide
ttagtcaccccaattcgatggcactttggccctgt

SEQ ID NO: 60448 - DNA, 35 bp, Artificial Sequence
  Synthetic oligonucleotide
gcccatgtgcgtgtgcctcatcctcgggcaccctt

SEQ ID NO: 60449 - DNA, 35 bp, Artificial Sequence
  Synthetic oligonucleotide
gtctggatccctgccaaaagtgcgcgtggcccctt

SEQ ID NO: 60450 - DNA, 35 bp, Artificial Sequence
  Synthetic oligonucleotide
atcagccatgttgctgatatatgtttactttggtt

SEQ ID NO: 60451 - DNA, 35 bp, Artificial Sequence
  Synthetic oligonucleotide
gtgcatgtggttctcgtgcaacctggcccaaattt

SEQ ID NO: 60452 - DNA, 35 bp, Artificial Sequence
  Synthetic oligonucleotide
tgtgacagccacactacgagcacctgttcacattt

SEQ ID NO: 60453 - DNA, 36 bp, Artificial Sequence
  Synthetic oligonucleotide
tatcagactacaccctgcctagtaaccgagagtgaa

SEQ ID NO: 60454 - DNA, 36 bp, Artificial Sequence
  Synthetic oligonucleotide
tcatacacccgccaacgatctcgtgccagtatttaa

SEQ ID NO: 60455 - DNA, 36 bp, Artificial Sequence
  Synthetic oligonucleotide
aggtccacggcaacccgtgcctaatcacctcacaca

SEQ ID NO: 60456 - DNA, 36 bp, Artificial Sequence
  Synthetic oligonucleotide
gtgccactactctcgctcgttagtgcattacgtaca

SEQ ID NO: 60457 - DNA, 35 bp, Artificial Sequence
  Synthetic oligonucleotide
gcacctggggtactagcccgacccgatctctgcca

SEQ ID NO: 60458 - DNA, 36 bp, Artificial Sequence
  Synthetic oligonucleotide
tgcgcggggctcaccttgatctttaacactaccgca

SEQ ID NO: 60459 - DNA, 35 bp, Artificial Sequence
  Synthetic oligonucleotide
gaacacaccaaggcatccgtagacgccgtttcgca

SEQ ID NO: 60460 - DNA, 36 bp, Artificial Sequence
  Synthetic oligonucleotide
cagccccgacctcagtcccccctatggcaccctgca

SEQ ID NO: 60461 - DNA, 36 bp, Artificial Sequence
  Synthetic oligonucleotide
ggacgctgatgaaggggggatgatgttagggttgca

SEQ ID NO: 60462 - DNA, 36 bp, Artificial Sequence
  Synthetic oligonucleotide
atagctcccgcaggtaccttgttctaacgccactca

SEQ ID NO: 60463 - DNA, 35 bp, Artificial Sequence
  Synthetic oligonucleotide
tattagcgccgtcaacgaattattaaatcctctca

SEQ ID NO: 60464 - DNA, 35 bp, Artificial Sequence
  Synthetic oligonucleotide
acatccaccgccttgagcttatccgccgcctgtca

SEQ ID NO: 60465 - DNA, 37 bp, Artificial Sequence
  Synthetic oligonucleotide
tacatccacgggctccgacactgcatggttcaccaga

SEQ ID NO: 60466 - DNA, 36 bp, Artificial Sequence
  Synthetic oligonucleotide
ggaaaggcgatccacgggacggagaatggtgggaga

SEQ ID NO: 60467 - DNA, 37 bp, Artificial Sequence
  Synthetic oligonucleotide
gcacacgtctttcttgttctacccttcctcttctaga

SEQ ID NO: 60468 - DNA, 37 bp, Artificial Sequence
  Synthetic oligonucleotide
aagccctgccgactccgtattgcctattggttgccga

SEQ ID NO: 60469 - DNA, 37 bp, Artificial Sequence
  Synthetic oligonucleotide
tccatcacagtggcgcgcgcactttacttcactccga

SEQ ID NO: 60470 - DNA, 37 bp, Artificial Sequence
  Synthetic oligonucleotide
tcatgcactgccctccatgtttcttgtaacccggcga

SEQ ID NO: 60471 - DNA, 37 bp, Artificial Sequence
  Synthetic oligonucleotide
gcaccacaactgaacccgtcgcatccctcctcggcga

SEQ ID NO: 60472 - DNA, 37 bp, Artificial Sequence
  Synthetic oligonucleotide
gctcataacccgtcccgcccgaacgcccgctgggcga

SEQ ID NO: 60473 - DNA, 36 bp, Artificial Sequence
  Synthetic oligonucleotide
aagacatgcctccccatccttgttagatacgtgcga

SEQ ID NO: 60474 - DNA, 37 bp, Artificial Sequence
  Synthetic oligonucleotide
atgttgcgagccacttcatccatcgtccttcttgcga

SEQ ID NO: 60475 - DNA, 36 bp, Artificial Sequence
  Synthetic oligonucleotide
tgcacaggttgctggtactcttgccccggttctcga

SEQ ID NO: 60476 - DNA, 37 bp, Artificial Sequence
  Synthetic oligonucleotide
ctttccaccacgtccggcatgcgttatccttagtcga

SEQ ID NO: 60477 - DNA, 37 bp, Artificial Sequence
  Synthetic oligonucleotide
ttgggaagaagcaggaaaaggagcagcgcgaaccgga

SEQ ID NO: 60478 - DNA, 37 bp, Artificial Sequence
  Synthetic oligonucleotide
aaagccgtgggcatgggttggaattgttgggtgggga

SEQ ID NO: 60479 - DNA, 37 bp, Artificial Sequence
  Synthetic oligonucleotide
agcttgcatcacatcccagcgcctactacaccctgga

SEQ ID NO: 60480 - DNA, 38 bp, Artificial Sequence
  Synthetic oligonucleotide
taggtacgggcaagaagaagactttacgggggacatga

SEQ ID NO: 60481 - DNA, 38 bp, Artificial Sequence
  Synthetic oligonucleotide
tcacgttacgctgactgttatccctcgccatgccatga

SEQ ID NO: 60482 - DNA, 38 bp, Artificial Sequence
  Synthetic oligonucleotide
gtagcttcatccgtcgcgtgcctgctgccctttactga

SEQ ID NO: 60483 - DNA, 38 bp, Artificial Sequence
  Synthetic oligonucleotide
tgacactccggcacccctgaatttctgtgtcattctga

SEQ ID NO: 60484 - DNA, 38 bp, Artificial Sequence
  Synthetic oligonucleotide
tcgagtgtgcgtggggagggagtggcggtggggcgtga

SEQ ID NO: 60485 - DNA, 36 bp, Artificial Sequence
  Synthetic oligonucleotide
tcatctacatcctggtggcacatggatatcctgtga

SEQ ID NO: 60486 - DNA, 37 bp, Artificial Sequence
  Synthetic oligonucleotide
gagccaggcttatgtggtgcgtggggggctagtgtga

SEQ ID NO: 60487 - DNA, 37 bp, Artificial Sequence
  Synthetic oligonucleotide
acgacctatagctattgtactctgctcccttttgtga

SEQ ID NO: 60488 - DNA, 38 bp, Artificial Sequence
  Synthetic oligonucleotide
acccgccaccagcctccaccctaaagatgtccaattga

SEQ ID NO: 60489 - DNA, 38 bp, Artificial Sequence
  Synthetic oligonucleotide
attgtggcggggtgtgtgatgaagcggactaggattga

SEQ ID NO: 60490 - DNA, 38 bp, Artificial Sequence
  Synthetic oligonucleotide
gactacatcaccttcacatagggaacaccacgacttga

SEQ ID NO: 60491 - DNA, 38 bp, Artificial Sequence
  Synthetic oligonucleotide
tcccacccggtaccgagtactactaggccacaccttga

SEQ ID NO: 60492 - DNA, 38 bp, Artificial Sequence
  Synthetic oligonucleotide
gcaacgcgagatcattttatgaataccacccaccttga

SEQ ID NO: 60493 - DNA, 37 bp, Artificial Sequence
  Synthetic oligonucleotide
tctgggtcggccagctcttaaaccccgcgatccttga

SEQ ID NO: 60494 - DNA, 37 bp, Artificial Sequence
  Synthetic oligonucleotide
tgccacctcttcaccagcgcgcgtacaaccgagttga

SEQ ID NO: 60495 - DNA, 38 bp, Artificial Sequence
  Synthetic oligonucleotide
tctgtggaggccgtcgggaggggaaatagtgtggttga

SEQ ID NO: 60496 - DNA, 38 bp, Artificial Sequence
  Synthetic oligonucleotide
gacgctccctcccatcgctattggaaagtacgttttga

SEQ ID NO: 60497 - DNA, 36 bp, Artificial Sequence
  Synthetic oligonucleotide
gaggaggaagaaaggacgagcaggttcgagcgcata

SEQ ID NO: 60498 - DNA, 35 bp, Artificial Sequence
  Synthetic oligonucleotide
gtacctcacatccccacgaggttgcagagcaacta

SEQ ID NO: 60499 - DNA, 36 bp, Artificial Sequence
  Synthetic oligonucleotide
atctccccaatgcccccacgatattttgccgtgcta

SEQ ID NO: 60500 - DNA, 36 bp, Artificial Sequence
  Synthetic oligonucleotide
gattaggggcgggaagggtcattaagagggtctgta

SEQ ID NO: 60501 - DNA, 36 bp, Artificial Sequence
  Synthetic oligonucleotide
gacccttcgccacccaccgttcgctgtgcttgttta

SEQ ID NO: 60502 - DNA, 35 bp, Artificial Sequence
  Synthetic oligonucleotide
tgccgaccacggttgatataccttctcgcttcgac

SEQ ID NO: 60503 - DNA, 35 bp, Artificial Sequence
  Synthetic oligonucleotide
tgtactttccaccctgctgtgtcgatcatccggac

SEQ ID NO: 60504 - DNA, 35 bp, Artificial Sequence
  Synthetic oligonucleotide
atcgataggctccggtaccgatcctggccaaaccc

SEQ ID NO: 60505 - DNA, 35 bp, Artificial Sequence
  Synthetic oligonucleotide
ccaccctgcctcctttattgcgtgcacgcgatgcc

SEQ ID NO: 60506 - DNA, 35 bp, Artificial Sequence
  Synthetic oligonucleotide
tgtgcctacacaatcccgtgtgccatccacatagc

SEQ ID NO: 60507 - DNA, 35 bp, Artificial Sequence
  Synthetic oligonucleotide
tccctacgttcctgtcgcttgaatctttccctagc

SEQ ID NO: 60508 - DNA, 35 bp, Artificial Sequence
  Synthetic oligonucleotide
gacatatcactggaccttttaccaccggcgaccgc

SEQ ID NO: 60509 - DNA, 35 bp, Artificial Sequence
  Synthetic oligonucleotide
tgtaatctcggtggccgcccttttttgctgttcgc

SEQ ID NO: 60510 - DNA, 35 bp, Artificial Sequence
  Synthetic oligonucleotide
tgtgatacaccgaagccgccccacgttacccgggc

SEQ ID NO: 60511 - DNA, 35 bp, Artificial Sequence
  Synthetic oligonucleotide
gctcacccgtttctgcatagttgttggtttcatgc

SEQ ID NO: 60512 - DNA, 35 bp, Artificial Sequence
  Synthetic oligonucleotide
taaccggccaacgaggcaattcatggcgtttcctc

SEQ ID NO: 60513 - DNA, 35 bp, Artificial Sequence
  Synthetic oligonucleotide
gcaaaaccgcttgcccaccccataagttattgctc

SEQ ID NO: 60514 - DNA, 35 bp, Artificial Sequence
  Synthetic oligonucleotide
agaccagtattcccggtcgttatactctccgtctc

SEQ ID NO: 60515 - DNA, 35 bp, Artificial Sequence
  Synthetic oligonucleotide
actgatcgcattaccccgagtgagtaccttgtctc

SEQ ID NO: 60516 - DNA, 35 bp, Artificial Sequence
  Synthetic oligonucleotide
aaatgcccgttccctattttggtatccgaccgttc

SEQ ID NO: 60517 - DNA, 35 bp, Artificial Sequence
  Synthetic oligonucleotide
atgtcctagttgcactatgctttaatccccgtttc

SEQ ID NO: 60518 - DNA, 35 bp, Artificial Sequence
  Synthetic oligonucleotide
gatgcggtaaaggttcggtatgggatagagggtag

SEQ ID NO: 60519 - DNA, 35 bp, Artificial Sequence
  Synthetic oligonucleotide
gagagggggcggtaggtgattgacttattcgggcg

SEQ ID NO: 60520 - DNA, 35 bp, Artificial Sequence
  Synthetic oligonucleotide
atcgccactcctgtccctccccttcaaacagaagg

SEQ ID NO: 60521 - DNA, 35 bp, Artificial Sequence
  Synthetic oligonucleotide
agtccgaccgttcacatcatacacatagagcgctg

SEQ ID NO: 60522 - DNA, 35 bp, Artificial Sequence
  Synthetic oligonucleotide
atccgaatccgaacgtaatatccgcaactgtaact

SEQ ID NO: 60523 - DNA, 35 bp, Artificial Sequence
  Synthetic oligonucleotide
gccgccgcgcgcgcgtatgaccccgaccatgcact

SEQ ID NO: 60524 - DNA, 35 bp, Artificial Sequence
  Synthetic oligonucleotide
gtggatagcactctcttccggtccttgctctcact

SEQ ID NO: 60525 - DNA, 35 bp, Artificial Sequence
  Synthetic oligonucleotide
tccacctgccattagcatctctataataaggtact

SEQ ID NO: 60526 - DNA, 35 bp, Artificial Sequence
  Synthetic oligonucleotide
ggatacgtcttcattggttcgccctccactcgcct

SEQ ID NO: 60527 - DNA, 35 bp, Artificial Sequence
  Synthetic oligonucleotide
gtccttgctctgttattatctccgccttgttgcct

SEQ ID NO: 60528 - DNA, 35 bp, Artificial Sequence
  Synthetic oligonucleotide
acagatcccatggcaacttaagcgcaattcctcct

SEQ ID NO: 60529 - DNA, 35 bp, Artificial Sequence
  Synthetic oligonucleotide
gcgatagcaggatacaatcataatcaggtgctgct

SEQ ID NO: 60530 - DNA, 35 bp, Artificial Sequence
  Synthetic oligonucleotide
atgaacccagcacgtcgtaaaacaggaatcgctct

SEQ ID NO: 60531 - DNA, 35 bp, Artificial Sequence
  Synthetic oligonucleotide
ggatacagcagagccttttgtccgcacgcccttct

SEQ ID NO: 60532 - DNA, 35 bp, Artificial Sequence
  Synthetic oligonucleotide
tagagcacggctttacttctgcatgatacatccgt

SEQ ID NO: 60533 - DNA, 35 bp, Artificial Sequence
  Synthetic oligonucleotide
gtgctagctctcaccatcccatcttactctcaggt

SEQ ID NO: 60534 - DNA, 35 bp, Artificial Sequence
  Synthetic oligonucleotide
gcatccattgtctcatccctaagtgccgatcatgt

SEQ ID NO: 60535 - DNA, 35 bp, Artificial Sequence
  Synthetic oligonucleotide
atgcgcgcaccaccactatcgccgctgctgcaatt

SEQ ID NO: 60536 - DNA, 35 bp, Artificial Sequence
  Synthetic oligonucleotide
atgacgagccggtctgaagttactattcatcaatt

SEQ ID NO: 60537 - DNA, 35 bp, Artificial Sequence
  Synthetic oligonucleotide
tgatcccgcctactttctgcaggtttttgcctatt

SEQ ID NO: 60538 - DNA, 35 bp, Artificial Sequence
  Synthetic oligonucleotide
atggggtgtggtggtgttgtagcttgctaaatgtt

SEQ ID NO: 60539 - DNA, 33 bp, Artificial Sequence
  Synthetic oligonucleotide
tcctgccggcactgccccttaaaacgcgacttt

SEQ ID NO: 60540 - DNA, 35 bp, Artificial Sequence
  Synthetic oligonucleotide
tacacttctcgaccgttatatcggctttcattttt

SEQ ID NO: 60541 - DNA, 36 bp, Artificial Sequence
  Synthetic oligonucleotide
atgacgacgccggggtacgaaggattggtgctacaa

SEQ ID NO: 60542 - DNA, 35 bp, Artificial Sequence
  Synthetic oligonucleotide
tgagcgcgctaatggttactttttcccctttcgaa

SEQ ID NO: 60543 - DNA, 35 bp, Artificial Sequence
  Synthetic oligonucleotide
gagacgtgaaacgcggtgaagtaggaaggagggaa

SEQ ID NO: 60544 - DNA, 35 bp, Artificial Sequence
  Synthetic oligonucleotide
accttgccaccagccgatctcgttccgagagcaca

SEQ ID NO: 60545 - DNA, 36 bp, Artificial Sequence
  Synthetic oligonucleotide
gtattgcgggagtatgtctgcctcctgtttgcccca

SEQ ID NO: 60546 - DNA, 36 bp, Artificial Sequence
  Synthetic oligonucleotide
gacaacccgctatccggtatgcacaagccttgctca

SEQ ID NO: 60547 - DNA, 35 bp, Artificial Sequence
  Synthetic oligonucleotide
acctcacggctctcaaaggttctcttgctctttca

SEQ ID NO: 60548 - DNA, 36 bp, Artificial Sequence
  Synthetic oligonucleotide
gtggagcacataggatgacgtgtgtgggggcaaaga

SEQ ID NO: 60549 - DNA, 37 bp, Artificial Sequence
  Synthetic oligonucleotide
actcacctgcgcatgatccttacccaggtctccaaga

SEQ ID NO: 60550 - DNA, 37 bp, Artificial Sequence
  Synthetic oligonucleotide
aaacgggaagtgggtaaggagagatagctggagcaga

SEQ ID NO: 60551 - DNA, 37 bp, Artificial Sequence
  Synthetic oligonucleotide
acactacgcccaccaaatatttccgatccacctcaga

SEQ ID NO: 60552 - DNA, 37 bp, Artificial Sequence
  Synthetic oligonucleotide
agcggatcgctcacataggccatacacaacctctaga

SEQ ID NO: 60553 - DNA, 36 bp, Artificial Sequence
  Synthetic oligonucleotide
acccagcatgctcccaacatttgcaccacacttaga

SEQ ID NO: 60554 - DNA, 37 bp, Artificial Sequence
  Synthetic oligonucleotide
atggatggcgctcgtggcatatgcttccacctcccga

SEQ ID NO: 60555 - DNA, 37 bp, Artificial Sequence
  Synthetic oligonucleotide
aaccccactcccgaacctgaccgcgcgcccaaatcga

SEQ ID NO: 60556 - DNA, 37 bp, Artificial Sequence
  Synthetic oligonucleotide
gacactccgctttcatatacaatgaaccactcttcga

SEQ ID NO: 60557 - DNA, 37 bp, Artificial Sequence
  Synthetic oligonucleotide
gacgctgccgggggacagggggagtagcttagaggga

SEQ ID NO: 60558 - DNA, 37 bp, Artificial Sequence
  Synthetic oligonucleotide
tgtcctgcctccgcttttcgagtttaacctctgggga

SEQ ID NO: 60559 - DNA, 37 bp, Artificial Sequence
  Synthetic oligonucleotide
tgaaatgggcgaggtggagtttagctttggttgggga

SEQ ID NO: 60560 - DNA, 37 bp, Artificial Sequence
  Synthetic oligonucleotide
tccaggcctgatgcgctcgtttcattacccacctgga

SEQ ID NO: 60561 - DNA, 37 bp, Artificial Sequence
  Synthetic oligonucleotide
gagcgggaagcagggcagggaagcaggttgttgtgga

SEQ ID NO: 60562 - DNA, 38 bp, Artificial Sequence
  Synthetic oligonucleotide
tcagtccaggaacgggaagggtgggtcgaaaggaatga

SEQ ID NO: 60563 - DNA, 37 bp, Artificial Sequence
  Synthetic oligonucleotide
tccaggccacctcctcgtttatcctcacgtgatatga

SEQ ID NO: 60564 - DNA, 38 bp, Artificial Sequence
  Synthetic oligonucleotide
tacctcatcacttatccgaatcaagacggttcttatga

SEQ ID NO: 60565 - DNA, 38 bp, Artificial Sequence
  Synthetic oligonucleotide
ttcaccacccgatagcaagtgctagggtctctaactga

SEQ ID NO: 60566 - DNA, 38 bp, Artificial Sequence
  Synthetic oligonucleotide
gctgggtcgtaggagggcacttggactgtgagggctga

SEQ ID NO: 60567 - DNA, 38 bp, Artificial Sequence
  Synthetic oligonucleotide
tctccacttcgtgctgtgtcatcctccgttcgtcgtga

SEQ ID NO: 60568 - DNA, 38 bp, Artificial Sequence
  Synthetic oligonucleotide
tgtcccagcgccggcattacctaaccaccttcctgtga

SEQ ID NO: 60569 - DNA, 37 bp, Artificial Sequence
  Synthetic oligonucleotide
taccacggggagggttgatgaagaaggtaatgtgtga

SEQ ID NO: 60570 - DNA, 38 bp, Artificial Sequence
  Synthetic oligonucleotide
gacacatctccttcctgctcgtgattccatgtttgtga

SEQ ID NO: 60571 - DNA, 37 bp, Artificial Sequence
  Synthetic oligonucleotide
gcgggacgccgcacggacctacctagaaccgcattga

SEQ ID NO: 60572 - DNA, 38 bp, Artificial Sequence
  Synthetic oligonucleotide
tcgcatccgcgacctgatctccacgttacctaccttga

SEQ ID NO: 60573 - DNA, 37 bp, Artificial Sequence
  Synthetic oligonucleotide
tccacacacgctggatctccacaatcactgatcttga

SEQ ID NO: 60574 - DNA, 37 bp, Artificial Sequence
  Synthetic oligonucleotide
gcgaatactgcaatgttcttctaatgcctctctttga

SEQ ID NO: 60575 - DNA, 38 bp, Artificial Sequence
  Synthetic oligonucleotide
tcccttcacactgatctatggtgcggtgaaccttttga

SEQ ID NO: 60576 - DNA, 38 bp, Artificial Sequence
  Synthetic oligonucleotide
gttgacatctatgcgttcctgttctaccttgcttttga

SEQ ID NO: 60577 - DNA, 36 bp, Artificial Sequence
  Synthetic oligonucleotide
gccacgtcgtacggtccctctggcctggattttcta

SEQ ID NO: 60578 - DNA, 36 bp, Artificial Sequence
  Synthetic oligonucleotide
gcaccaaatgcgtgccgacgctgttcgcccacttta

SEQ ID NO: 60579 - DNA, 36 bp, Artificial Sequence
  Synthetic oligonucleotide
tgcggtcctacacgcggggctaatcgattctcttta

SEQ ID NO: 60580 - DNA, 35 bp, Artificial Sequence
  Synthetic oligonucleotide
gcactttcgttccgcaccccacgacacgtgaacac

SEQ ID NO: 60581 - DNA, 35 bp, Artificial Sequence
  Synthetic oligonucleotide
tcataccgcagtgcgaacaaaattggattccccac

SEQ ID NO: 60582 - DNA, 35 bp, Artificial Sequence
  Synthetic oligonucleotide
gtggcctcgccctatgaagttccggatcctcccac

SEQ ID NO: 60583 - DNA, 35 bp, Artificial Sequence
  Synthetic oligonucleotide
tatggtgcaccacctattcctcgcttcacaattac

SEQ ID NO: 60584 - DNA, 35 bp, Artificial Sequence
  Synthetic oligonucleotide
aacaacaacgattgccaccaatcgttctacctacc

SEQ ID NO: 60585 - DNA, 35 bp, Artificial Sequence
  Synthetic oligonucleotide
gcccgcaacgtctccttccctgcagcacagtcccc

SEQ ID NO: 60586 - DNA, 35 bp, Artificial Sequence
  Synthetic oligonucleotide
aaagtcacaacggactgtcccctatacccatgccc

SEQ ID NO: 60587 - DNA, 35 bp, Artificial Sequence
  Synthetic oligonucleotide
tgtcccaaaacccgccccgttgctttatgatagcc

SEQ ID NO: 60588 - DNA, 35 bp, Artificial Sequence
  Synthetic oligonucleotide
tctccatacctacacaagcatgacgcatatggtcc

SEQ ID NO: 60589 - DNA, 35 bp, Artificial Sequence
  Synthetic oligonucleotide
gacggggtaggggtcaaagggcggacgtgtgttgc

SEQ ID NO: 60590 - DNA, 35 bp, Artificial Sequence
  Synthetic oligonucleotide
ccgttccacccgacccgaagcttttaaccacactc

SEQ ID NO: 60591 - DNA, 35 bp, Artificial Sequence
  Synthetic oligonucleotide
attcatccgtgtctgcatcgccctagcattcggtc

SEQ ID NO: 60592 - DNA, 35 bp, Artificial Sequence
  Synthetic oligonucleotide
tcgactcgcgagccgttaagcctagccgctatttc

SEQ ID NO: 60593 - DNA, 35 bp, Artificial Sequence
  Synthetic oligonucleotide
gtcgaggcaggcgattgcggcatttcacacttttc

SEQ ID NO: 60594 - DNA, 34 bp, Artificial Sequence
  Synthetic oligonucleotide
tgtaggagagagacggaggtaggcggggggcaag

SEQ ID NO: 60595 - DNA, 35 bp, Artificial Sequence
  Synthetic oligonucleotide
gtcgccgcctccgatccatcttgtaagatttacag

SEQ ID NO: 60596 - DNA, 35 bp, Artificial Sequence
  Synthetic oligonucleotide
gagcatcctacacgttaactatcacatccagctag

SEQ ID NO: 60597 - DNA, 35 bp, Artificial Sequence
  Synthetic oligonucleotide
acaactcaccgcctgtacacctcttatcagggacg

SEQ ID NO: 60598 - DNA, 35 bp, Artificial Sequence
  Synthetic oligonucleotide
tactaccaacggtgagaggggcaggcttactggcg

SEQ ID NO: 60599 - DNA, 35 bp, Artificial Sequence
  Synthetic oligonucleotide
gcctgaacctgttccaacttcgcgaccgcccgtgg

SEQ ID NO: 60600 - DNA, 35 bp, Artificial Sequence
  Synthetic oligonucleotide
ctgcgtcctagccagtctccgatctccattctatg

SEQ ID NO: 60601 - DNA, 35 bp, Artificial Sequence
  Synthetic oligonucleotide
atggaagtggagtagggaaggaggcattgtttctg

SEQ ID NO: 60602 - DNA, 35 bp, Artificial Sequence
  Synthetic oligonucleotide
gagtgcgctgaaggaagcaactctcgcttgacttg

SEQ ID NO: 60603 - DNA, 35 bp, Artificial Sequence
  Synthetic oligonucleotide
acgctccccctagtggtgtatgatccaccctacat

SEQ ID NO: 60604 - DNA, 35 bp, Artificial Sequence
  Synthetic oligonucleotide
gcattgctttggcactcccgccatcatcgctttat

SEQ ID NO: 60605 - DNA, 35 bp, Artificial Sequence
  Synthetic oligonucleotide
tccagaaggcctcaatacatcccgacgaaccttct

SEQ ID NO: 60606 - DNA, 35 bp, Artificial Sequence
  Synthetic oligonucleotide
gtcatcaggtcttatccccgcccgcatccgcaatt

SEQ ID NO: 60607 - DNA, 35 bp, Artificial Sequence
  Synthetic oligonucleotide
gctcaggacggtctccacaccttcgcccttcgctt

SEQ ID NO: 60608 - DNA, 35 bp, Artificial Sequence
  Synthetic oligonucleotide
tctcccccgggacctagatgtcccctgtgccgttt

SEQ ID NO: 60609 - DNA, 35 bp, Artificial Sequence
  Synthetic oligonucleotide
tcagcagacacgttcgcgttactattctagggttt

SEQ ID NO: 60610 - DNA, 36 bp, Artificial Sequence
  Synthetic oligonucleotide
gctacctgttgacctgcctagttccagttctaccaa

SEQ ID NO: 60611 - DNA, 36 bp, Artificial Sequence
  Synthetic oligonucleotide
atggtcgcaatccatccgggctaattccagttccaa

SEQ ID NO: 60612 - DNA, 35 bp, Artificial Sequence
  Synthetic oligonucleotide
aacgcgcctcgccatgcatctgccacaaggtctaa

SEQ ID NO: 60613 - DNA, 36 bp, Artificial Sequence
  Synthetic oligonucleotide
gtacgtacttccgtcaacttgctccgccgccacaca

SEQ ID NO: 60614 - DNA, 36 bp, Artificial Sequence
  Synthetic oligonucleotide
ccgtggcgggctccggagccacgagactcacttaca

SEQ ID NO: 60615 - DNA, 35 bp, Artificial Sequence
  Synthetic oligonucleotide
atcttaggcgggagcgcggcattcatcctctacca

SEQ ID NO: 60616 - DNA, 36 bp, Artificial Sequence
  Synthetic oligonucleotide
ttttcacagcatactatatgcgtcgtgtcttcccca

SEQ ID NO: 60617 - DNA, 35 bp, Artificial Sequence
  Synthetic oligonucleotide
tgtctcactttatgtcgtccaccagtcttcttcca

SEQ ID NO: 60618 - DNA, 36 bp, Artificial Sequence
  Synthetic oligonucleotide
acacacgccatgcggattcgaactatgcgcgttcca

SEQ ID NO: 60619 - DNA, 36 bp, Artificial Sequence
  Synthetic oligonucleotide
gtcgtacaccgccatccgccgctgcgccttgcagca

SEQ ID NO: 60620 - DNA, 35 bp, Artificial Sequence
  Synthetic oligonucleotide
gtccgttgtggccgttcgttaacctctatcatgca

SEQ ID NO: 60621 - DNA, 36 bp, Artificial Sequence
  Synthetic oligonucleotide
gcgacaccccacaccccaaacggctgatcatttgca

SEQ ID NO: 60622 - DNA, 36 bp, Artificial Sequence
  Synthetic oligonucleotide
atcactcgacgcggatgcgttactgttggtccatca

SEQ ID NO: 60623 - DNA, 36 bp, Artificial Sequence
  Synthetic oligonucleotide
gccacgcagtgtgccgtgccatctttagtactatca

SEQ ID NO: 60624 - DNA, 36 bp, Artificial Sequence
  Synthetic oligonucleotide
gccggagggtgatatatgaatggaagttggtgcaga

SEQ ID NO: 60625 - DNA, 35 bp, Artificial Sequence
  Synthetic oligonucleotide
tatgcactcctcactgacccttatgattgtcacga

SEQ ID NO: 60626 - DNA, 37 bp, Artificial Sequence
  Synthetic oligonucleotide
tcacgtacctcccatggcaacgatacaaccttgacga

SEQ ID NO: 60627 - DNA, 37 bp, Artificial Sequence
  Synthetic oligonucleotide
actccgaccacaccgcttcaaattttaggccttacga

SEQ ID NO: 60628 - DNA, 37 bp, Artificial Sequence
  Synthetic oligonucleotide
tgttgcgcggtttatcggcccgacccattcttaccga

SEQ ID NO: 60629 - DNA, 37 bp, Artificial Sequence
  Synthetic oligonucleotide
attgccggacataggatcctcgccgcataacacccga

SEQ ID NO: 60630 - DNA, 37 bp, Artificial Sequence
  Synthetic oligonucleotide
gccccgaacgagctaccctcccattgtcatgacccga

SEQ ID NO: 60631 - DNA, 37 bp, Artificial Sequence
  Synthetic oligonucleotide
gaatgatggggtgaagagaatgggggacgaacggcga

SEQ ID NO: 60632 - DNA, 33 bp, Artificial Sequence
  Synthetic oligonucleotide
taccacctcatccgacgccttcacaaccatcga

SEQ ID NO: 60633 - DNA, 37 bp, Artificial Sequence
  Synthetic oligonucleotide
gtgcacgcaagcttgcgaacacttcacctgaactcga

SEQ ID NO: 60634 - DNA, 37 bp, Artificial Sequence
  Synthetic oligonucleotide
tcccccacgacgtgaagcacggctctgctccattcga

SEQ ID NO: 60635 - DNA, 37 bp, Artificial Sequence
  Synthetic oligonucleotide
gactcgctgccttccttcttgtctgccgtaaacagga

SEQ ID NO: 60636 - DNA, 36 bp, Artificial Sequence
  Synthetic oligonucleotide
atcaacaccacggggtcaacaggcctaccaccagga

SEQ ID NO: 60637 - DNA, 37 bp, Artificial Sequence
  Synthetic oligonucleotide
actgcccgccaaaactccttcacaccattggcacgga

SEQ ID NO: 60638 - DNA, 36 bp, Artificial Sequence
  Synthetic oligonucleotide
tcatagcaaagggcggaggaaaggtctccaaaggga

SEQ ID NO: 60639 - DNA, 36 bp, Artificial Sequence
  Synthetic oligonucleotide
tcgcacaaccgccgactttactggaccgattaggga

SEQ ID NO: 60640 - DNA, 37 bp, Artificial Sequence
  Synthetic oligonucleotide
ggggcggagcctgactcactcctgtccaaccacatga

SEQ ID NO: 60641 - DNA, 38 bp, Artificial Sequence
  Synthetic oligonucleotide
gagtacgcaggagcggagctggatgccaggatggatga

SEQ ID NO: 60642 - DNA, 38 bp, Artificial Sequence
  Synthetic oligonucleotide
acgtcaccacgcctagtggccatcattaccttcactga

SEQ ID NO: 60643 - DNA, 38 bp, Artificial Sequence
  Synthetic oligonucleotide
ttccgctgggtgaagagtatggggggagggggtactga

SEQ ID NO: 60644 - DNA, 36 bp, Artificial Sequence
  Synthetic oligonucleotide
gcgactgctggcatcttctcatcgtacaccacctga

SEQ ID NO: 60645 - DNA, 38 bp, Artificial Sequence
  Synthetic oligonucleotide
ggacacctgtcactcccgcaccacaagacctccgctga

SEQ ID NO: 60646 - DNA, 38 bp, Artificial Sequence
  Synthetic oligonucleotide
tgagggggagtgtgaagggtgtgggcaggtgaggctga

SEQ ID NO: 60647 - DNA, 38 bp, Artificial Sequence
  Synthetic oligonucleotide
tgcgtatcgcagtcccgtctcatgcaccacagttctga

SEQ ID NO: 60648 - DNA, 38 bp, Artificial Sequence
  Synthetic oligonucleotide
gaaacggacgatttgcagggaggactggagcagggtga

SEQ ID NO: 60649 - DNA, 37 bp, Artificial Sequence
  Synthetic oligonucleotide
gacggtgccccagaaagaccgccttgcccacccttga

SEQ ID NO: 60650 - DNA, 38 bp, Artificial Sequence
  Synthetic oligonucleotide
tgaacatctccgttatgcgataacggctgaccccttga

SEQ ID NO: 60651 - DNA, 38 bp, Artificial Sequence
  Synthetic oligonucleotide
gcatggtcctgacatactattgtgccgctacgccttga

SEQ ID NO: 60652 - DNA, 38 bp, Artificial Sequence
  Synthetic oligonucleotide
gaccgcctacaacggtattttccacacattctccttga

SEQ ID NO: 60653 - DNA, 38 bp, Artificial Sequence
  Synthetic oligonucleotide
tcatcactccttgtccattggaacagaattttccttga

SEQ ID NO: 60654 - DNA, 37 bp, Artificial Sequence
  Synthetic oligonucleotide
acgtcgccacgaagtttacgcttccaacccgctttga

SEQ ID NO: 60655 - DNA, 38 bp, Artificial Sequence
  Synthetic oligonucleotide
gtcccccgcagccaccacacgttaggatttcagtttga

SEQ ID NO: 60656 - DNA, 35 bp, Artificial Sequence
  Synthetic oligonucleotide
gtgacgcaattatcgccctggtctatggacccata

SEQ ID NO: 60657 - DNA, 36 bp, Artificial Sequence
  Synthetic oligonucleotide
ggaacaacctaacacccacacacacagaactgcata

SEQ ID NO: 60658 - DNA, 36 bp, Artificial Sequence
  Synthetic oligonucleotide
taaccgggcggacgggaatggaacaaacatatcgta

SEQ ID NO: 60659 - DNA, 36 bp, Artificial Sequence
  Synthetic oligonucleotide
agctctggcctcacttatttcttcatgactacgtta

SEQ ID NO: 60660 - DNA, 35 bp, Artificial Sequence
  Synthetic oligonucleotide
ttgcaacccatccctctacactgccttacgcgtta

SEQ ID NO: 60661 - DNA, 35 bp, Artificial Sequence
  Synthetic oligonucleotide
aactgactaccgcactataagccaatgaatcccac

SEQ ID NO: 60662 - DNA, 35 bp, Artificial Sequence
  Synthetic oligonucleotide
atctgtcgagtccgaacttacgtgcctaccttcac

SEQ ID NO: 60663 - DNA, 35 bp, Artificial Sequence
  Synthetic oligonucleotide
gaacatgcgctattcatagcacggacccactctac

SEQ ID NO: 60664 - DNA, 35 bp, Artificial Sequence
  Synthetic oligonucleotide
gcccgtcacccggacatccccatacgggctatacc

SEQ ID NO: 60665 - DNA, 35 bp, Artificial Sequence
  Synthetic oligonucleotide
taagtgcacacgttaaacttaatgaatctgatccc

SEQ ID NO: 60666 - DNA, 35 bp, Artificial Sequence
  Synthetic oligonucleotide
gaccaactttgttgtttcttttgccgtgtaccgcc

SEQ ID NO: 60667 - DNA, 35 bp, Artificial Sequence
  Synthetic oligonucleotide
gtaagccccgccaacgtcagtgcctcttctatgcc

SEQ ID NO: 60668 - DNA, 35 bp, Artificial Sequence
  Synthetic oligonucleotide
ttgtagcccgcctaccccccgccaccgattcatcc

SEQ ID NO: 60669 - DNA, 35 bp, Artificial Sequence
  Synthetic oligonucleotide
atcttcgcgccgaagcgtcgttttcaccgtgctcc

SEQ ID NO: 60670 - DNA, 35 bp, Artificial Sequence
  Synthetic oligonucleotide
atctgtggctgctacctccacctaaccactgttcc

SEQ ID NO: 60671 - DNA, 35 bp, Artificial Sequence
  Synthetic oligonucleotide
tggtcactcattccggcctctatgccacagctagc

SEQ ID NO: 60672 - DNA, 35 bp, Artificial Sequence
  Synthetic oligonucleotide
gtgcttctgaggcggccatctctctatcaactatc

SEQ ID NO: 60673 - DNA, 35 bp, Artificial Sequence
  Synthetic oligonucleotide
tcatattgcagacgtgcgcccacgaggtcgaattc

SEQ ID NO: 60674 - DNA, 35 bp, Artificial Sequence
  Synthetic oligonucleotide
acaaagacaggtactggggaggttaggggcaatag

SEQ ID NO: 60675 - DNA, 35 bp, Artificial Sequence
  Synthetic oligonucleotide
gagaaaccgtgagggtaggataggtagggattgcg

SEQ ID NO: 60676 - DNA, 35 bp, Artificial Sequence
  Synthetic oligonucleotide
atccctgacaatcttgctccatcgactctgtaatg

SEQ ID NO: 60677 - DNA, 35 bp, Artificial Sequence
  Synthetic oligonucleotide
acatgccctctgtcgtccgccatttagctgccctg

SEQ ID NO: 60678 - DNA, 35 bp, Artificial Sequence
  Synthetic oligonucleotide
tagccggacgcaatagtccaaggtcacactagctg

SEQ ID NO: 60679 - DNA, 35 bp, Artificial Sequence
  Synthetic oligonucleotide
tccacccattgtatatacccgcgaacgatcgagct

SEQ ID NO: 60680 - DNA, 35 bp, Artificial Sequence
  Synthetic oligonucleotide
cccgaaggacacccgtcgcccaccgaggcccctct

SEQ ID NO: 60681 - DNA, 35 bp, Artificial Sequence
  Synthetic oligonucleotide
gaccccaccggccgatgtattacttctttctgatt

SEQ ID NO: 60682 - DNA, 35 bp, Artificial Sequence
  Synthetic oligonucleotide
tcgtgcaccacctatccgctgttgctaaaacactt

SEQ ID NO: 60683 - DNA, 35 bp, Artificial Sequence
  Synthetic oligonucleotide
taactcaccgctgaggcccacgtgactcccctttt

SEQ ID NO: 60684 - DNA, 36 bp, Artificial Sequence
  Synthetic oligonucleotide
tcatgacctcgcctcgttttctggtttcatactcaa

SEQ ID NO: 60685 - DNA, 36 bp, Artificial Sequence
  Synthetic oligonucleotide
tcatccgtttgttttgccccccgccgaccgtccgaa

SEQ ID NO: 60686 - DNA, 36 bp, Artificial Sequence
  Synthetic oligonucleotide
aacatgcccgtactaacggttggtgccttcccttaa

SEQ ID NO: 60687 - DNA, 35 bp, Artificial Sequence
  Synthetic oligonucleotide
aacacactgcactttcgtcctcgaggagccgacca

SEQ ID NO: 60688 - DNA, 36 bp, Artificial Sequence
  Synthetic oligonucleotide
gttatcaccgcttgccatgcggtcttccagacccca

SEQ ID NO: 60689 - DNA, 35 bp, Artificial Sequence
  Synthetic oligonucleotide
tgccttagcccccaattcatcttgttctgacccca

SEQ ID NO: 60690 - DNA, 36 bp, Artificial Sequence
  Synthetic oligonucleotide
tcaaacgccagacaaaagaaattgaggggaacggca

SEQ ID NO: 60691 - DNA, 36 bp, Artificial Sequence
  Synthetic oligonucleotide
caagccccacagtcggttcctgccttccgccactca

SEQ ID NO: 60692 - DNA, 36 bp, Artificial Sequence
  Synthetic oligonucleotide
atgacgctatagcctagtttaccccagcatgactca

SEQ ID NO: 60693 - DNA, 37 bp, Artificial Sequence
  Synthetic oligonucleotide
tcagaggggacggagtggaaggtgtatagtgggcaga

SEQ ID NO: 60694 - DNA, 37 bp, Artificial Sequence
  Synthetic oligonucleotide
atgatgggagggggaacttggacggacaagggctaga

SEQ ID NO: 60695 - DNA, 37 bp, Artificial Sequence
  Synthetic oligonucleotide
ttgtaacgtcatcttgcaccgtcacagcccaaaccga

SEQ ID NO: 60696 - DNA, 36 bp, Artificial Sequence
  Synthetic oligonucleotide
gcgggaacctcatttctagtgtactgcctcccccga

SEQ ID NO: 60697 - DNA, 37 bp, Artificial Sequence
  Synthetic oligonucleotide
tgcgaccgccataggatctaaccaaactgattgccga

SEQ ID NO: 60698 - DNA, 37 bp, Artificial Sequence
  Synthetic oligonucleotide
agatacgcaccggactaatcgacccgcccaccatcga

SEQ ID NO: 60699 - DNA, 37 bp, Artificial Sequence
  Synthetic oligonucleotide
aacacgaacagagatgaggtggtgagttgacgaagga

SEQ ID NO: 60700 - DNA, 35 bp, Artificial Sequence
  Synthetic oligonucleotide
tatgcggggggcgaatcggatatgcggggaaggga

SEQ ID NO: 60701 - DNA, 36 bp, Artificial Sequence
  Synthetic oligonucleotide
gcaagctatgaaagggatacgggatgaaatgaggga

SEQ ID NO: 60702 - DNA, 37 bp, Artificial Sequence
  Synthetic oligonucleotide
tgagtgtcactttgacaggagaggggaaatggatgga

SEQ ID NO: 60703 - DNA, 37 bp, Artificial Sequence
  Synthetic oligonucleotide
ccaaccccaccgttggaatgtggtatctctcgctgga

SEQ ID NO: 60704 - DNA, 37 bp, Artificial Sequence
  Synthetic oligonucleotide
gatgctgcccccctagtttgaagtctccgtctctgga

SEQ ID NO: 60705 - DNA, 37 bp, Artificial Sequence
  Synthetic oligonucleotide
gttgccacgcctggcactatggcgtcccttttttgga

SEQ ID NO: 60706 - DNA, 37 bp, Artificial Sequence
  Synthetic oligonucleotide
aacatcacgcctcacaacgcacttacccacgaaatga

SEQ ID NO: 60707 - DNA, 37 bp, Artificial Sequence
  Synthetic oligonucleotide
gccccacacgccatcctaatacaaagttcacccatga

SEQ ID NO: 60708 - DNA, 37 bp, Artificial Sequence
  Synthetic oligonucleotide
tgagtgggaggtaggacggagaaacactgtgatatga

SEQ ID NO: 60709 - DNA, 37 bp, Artificial Sequence
  Synthetic oligonucleotide
tgccacgcaacgtacaccgggctcgttggttccctga

SEQ ID NO: 60710 - DNA, 38 bp, Artificial Sequence
  Synthetic oligonucleotide
acacactccgcaggtaccaaaacagtatcaccacgtga

SEQ ID NO: 60711 - DNA, 38 bp, Artificial Sequence
  Synthetic oligonucleotide
gactactttaccgtgtgactctgccttccccaccgtga

SEQ ID NO: 60712 - DNA, 38 bp, Artificial Sequence
  Synthetic oligonucleotide
agcaagtatgctggagggacgggtggtgagcatcgtga

SEQ ID NO: 60713 - DNA, 37 bp, Artificial Sequence
  Synthetic oligonucleotide
acgcgctgcccttggctctatcccctgacgctcgtga

SEQ ID NO: 60714 - DNA, 35 bp, Artificial Sequence
  Synthetic oligonucleotide
accgggtaggagagttaggggcaatgcaggggtga

SEQ ID NO: 60715 - DNA, 38 bp, Artificial Sequence
  Synthetic oligonucleotide
gacatgagcactgaggattaggatgactgggttggtga

SEQ ID NO: 60716 - DNA, 37 bp, Artificial Sequence
  Synthetic oligonucleotide
taacgactggctctgagcttgcatcttacatcattga

SEQ ID NO: 60717 - DNA, 37 bp, Artificial Sequence
  Synthetic oligonucleotide
gtggccgtgaagccgcgacctacaatacaatccttga

SEQ ID NO: 60718 - DNA, 38 bp, Artificial Sequence
  Synthetic oligonucleotide
agacccctcccatgactatcgggccctgcctccgttga

SEQ ID NO: 60719 - DNA, 35 bp, Artificial Sequence
  Synthetic oligonucleotide
tgagtgggccgaagggggttggtcaggggatttga

SEQ ID NO: 60720 - DNA, 38 bp, Artificial Sequence
  Synthetic oligonucleotide
atcgcgtcgcaatgcgtgattgcgtccgccctttttga

SEQ ID NO: 60721 - DNA, 38 bp, Artificial Sequence
  Synthetic oligonucleotide
gcccacctctcaccggagtatacctaggacttttttga

SEQ ID NO: 60722 - DNA, 36 bp, Artificial Sequence
  Synthetic oligonucleotide
atcgtcccaggccacggtccatacatcccaatacta

SEQ ID NO: 60723 - DNA, 35 bp, Artificial Sequence
  Synthetic oligonucleotide
tgggagagtctatgctacttccttgccatccccta

SEQ ID NO: 60724 - DNA, 36 bp, Artificial Sequence
  Synthetic oligonucleotide
tcacctagcctggccaacatctacctcgacgcatta

SEQ ID NO: 60725 - DNA, 36 bp, Artificial Sequence
  Synthetic oligonucleotide
ttcaccccgttcacgccatgtgcttaggtcctgtta

SEQ ID NO: 60726 - DNA, 35 bp, Artificial Sequence
  Synthetic oligonucleotide
tcattggtggtcctggaacgcttatctttgtacac

SEQ ID NO: 60727 - DNA, 35 bp, Artificial Sequence
  Synthetic oligonucleotide
gcatacaccgcaaatggtttgccctttctttggac

SEQ ID NO: 60728 - DNA, 35 bp, Artificial Sequence
  Synthetic oligonucleotide
attgtccgtacccgcttatcgcatacccagcctac

SEQ ID NO: 60729 - DNA, 35 bp, Artificial Sequence
  Synthetic oligonucleotide
tgaccctaaccatacgatcgccctgggttgcttac

SEQ ID NO: 60730 - DNA, 35 bp, Artificial Sequence
  Synthetic oligonucleotide
tgagtcagctcagcggtcaatcctcacgtcgcacc

SEQ ID NO: 60731 - DNA, 35 bp, Artificial Sequence
  Synthetic oligonucleotide
gactcgatatcgccattgcataattggatttgccc

SEQ ID NO: 60732 - DNA, 36 bp, Artificial Sequence
  Synthetic oligonucleotide
gagatccgtgatctgaggacatccctccccttggcc

SEQ ID NO: 60733 - DNA, 35 bp, Artificial Sequence
  Synthetic oligonucleotide
tcaacaaagtgggttggtggtagggtgggtaacgc

SEQ ID NO: 60734 - DNA, 35 bp, Artificial Sequence
  Synthetic oligonucleotide
atcgccagtccatcttcgtgatgactctgttttgc

SEQ ID NO: 60735 - DNA, 35 bp, Artificial Sequence
  Synthetic oligonucleotide
gacgcaacaaaccggaacttggtctaataccgctc

SEQ ID NO: 60736 - DNA, 34 bp, Artificial Sequence
  Synthetic oligonucleotide
acgacgccctaatccgttgaatccctagccagtc

SEQ ID NO: 60737 - DNA, 35 bp, Artificial Sequence
  Synthetic oligonucleotide
gaactggcactctcttgtctaacatgcctcttgtc

SEQ ID NO: 60738 - DNA, 35 bp, Artificial Sequence
  Synthetic oligonucleotide
tgcctacgtgctcattctcagtgtttcccgtattc

SEQ ID NO: 60739 - DNA, 35 bp, Artificial Sequence
  Synthetic oligonucleotide
acctcaactcgtcatcgtaccctgtttacctccag

SEQ ID NO: 60740 - DNA, 35 bp, Artificial Sequence
  Synthetic oligonucleotide
aaccataacgcccgtctattcgactccctaccgag

SEQ ID NO: 60741 - DNA, 35 bp, Artificial Sequence
  Synthetic oligonucleotide
taaccgacaccatccgttttgccaacggtccctag

SEQ ID NO: 60742 - DNA, 35 bp, Artificial Sequence
  Synthetic oligonucleotide
tctacgctgtcattttgcctatcctcgtgcgaccg

SEQ ID NO: 60743 - DNA, 35 bp, Artificial Sequence
  Synthetic oligonucleotide
gacgaaggtgacggattgagaatcttgctagacgg

SEQ ID NO: 60744 - DNA, 35 bp, Artificial Sequence
  Synthetic oligonucleotide
atatctcctgcccccaaaagcctcctttatcgatg

SEQ ID NO: 60745 - DNA, 35 bp, Artificial Sequence
  Synthetic oligonucleotide
tcccaccgttcaattcactaactcataacactctg

SEQ ID NO: 60746 - DNA, 35 bp, Artificial Sequence
  Synthetic oligonucleotide
actccaccctcgacaaccagcaacctgacggttat

SEQ ID NO: 60747 - DNA, 35 bp, Artificial Sequence
  Synthetic oligonucleotide
tccagagcatgctttttaatccttctgtctggtct

SEQ ID NO: 60748 - DNA, 35 bp, Artificial Sequence
  Synthetic oligonucleotide
gaaccgaaccgccacccatgcgacatatggccttt

SEQ ID NO: 60749 - DNA, 35 bp, Artificial Sequence
  Synthetic oligonucleotide
cactccacccttgctgccatgcgaaatatttcttt

SEQ ID NO: 60750 - DNA, 35 bp, Artificial Sequence
  Synthetic oligonucleotide
gttgctggagtatttatcattatggcctggttttt

SEQ ID NO: 60751 - DNA, 35 bp, Artificial Sequence
  Synthetic oligonucleotide
gtgggagggggtgtggaataggggtgcgctggaaa

SEQ ID NO: 60752 - DNA, 35 bp, Artificial Sequence
  Synthetic oligonucleotide
cttcaccgccccatgggtttcgcaaataacataaa

SEQ ID NO: 60753 - DNA, 35 bp, Artificial Sequence
  Synthetic oligonucleotide
tcagagggcgagtcgggggaaacacacggcattaa

SEQ ID NO: 60754 - DNA, 35 bp, Artificial Sequence
  Synthetic oligonucleotide
acattcatccgtccccaagttcgctgtctatcaca

SEQ ID NO: 60755 - DNA, 36 bp, Artificial Sequence
  Synthetic oligonucleotide
aactacatcgctagtgactctctctctctcgtgcca

SEQ ID NO: 60756 - DNA, 37 bp, Artificial Sequence
  Synthetic oligonucleotide
tcccacctccgctgtcgtaccgctggcctttactcca

SEQ ID NO: 60757 - DNA, 36 bp, Artificial Sequence
  Synthetic oligonucleotide
cgatctctgcgtatgtccacttggcgccaaacctca

SEQ ID NO: 60758 - DNA, 36 bp, Artificial Sequence
  Synthetic oligonucleotide
tcacactacgattcttctgatcagcctaggtcctca

SEQ ID NO: 60759 - DNA, 36 bp, Artificial Sequence
  Synthetic oligonucleotide
atgtgcgcgacagttatatcaccctgctggccgtca

SEQ ID NO: 60760 - DNA, 37 bp, Artificial Sequence
  Synthetic oligonucleotide
gcccaccatcatgttacttcgggttcttatatcaaga

SEQ ID NO: 60761 - DNA, 36 bp, Artificial Sequence
  Synthetic oligonucleotide
tgcaaccaatcgcctggtctgccatcaatccaccga

SEQ ID NO: 60762 - DNA, 37 bp, Artificial Sequence
  Synthetic oligonucleotide
tactgcgactagaaatgcattacactccttaccccga

SEQ ID NO: 60763 - DNA, 35 bp, Artificial Sequence
  Synthetic oligonucleotide
ggacgtcctctgtttgttccacctacctatgccga

SEQ ID NO: 60764 - DNA, 37 bp, Artificial Sequence
  Synthetic oligonucleotide
gatgcactgtgcatggtaacctattgcttcgatccga

SEQ ID NO: 60765 - DNA, 35 bp, Artificial Sequence
  Synthetic oligonucleotide
gacccctgccctggacctattatactaatttccga

SEQ ID NO: 60766 - DNA, 37 bp, Artificial Sequence
  Synthetic oligonucleotide
gacgccccagcttgagctcctaacagcatccccgcga

SEQ ID NO: 60767 - DNA, 37 bp, Artificial Sequence
  Synthetic oligonucleotide
acgctctaccaccccggataactcgcccaagttgcga

SEQ ID NO: 60768 - DNA, 37 bp, Artificial Sequence
  Synthetic oligonucleotide
gcatcctccaaatacggtttacatcacgatcccagga

SEQ ID NO: 60769 - DNA, 35 bp, Artificial Sequence
  Synthetic oligonucleotide
acgtaccatcccaccctaaaggttacctcccagga

SEQ ID NO: 60770 - DNA, 36 bp, Artificial Sequence
  Synthetic oligonucleotide
tactgggtgggaaagactaggtggggaaggtcggga

SEQ ID NO: 60771 - DNA, 37 bp, Artificial Sequence
  Synthetic oligonucleotide
acgcggggaggcggatcggacgacggactcgagggga

SEQ ID NO: 60772 - DNA, 37 bp, Artificial Sequence
  Synthetic oligonucleotide
attgtgcgcatatagagctggggagggagacaatgga

SEQ ID NO: 60773 - DNA, 37 bp, Artificial Sequence
  Synthetic oligonucleotide
gctggtggaaggtggagaacataatggcaggagtgga

SEQ ID NO: 60774 - DNA, 37 bp, Artificial Sequence
  Synthetic oligonucleotide
ggtgtgtgacggaacggaaaaatggggctcggaatga

SEQ ID NO: 60775 - DNA, 37 bp, Artificial Sequence
  Synthetic oligonucleotide
tgttcgtctccgtccccaacagcactgacacacatga

SEQ ID NO: 60776 - DNA, 38 bp, Artificial Sequence
  Synthetic oligonucleotide
gagtccagccgcccccttcagttaatgcacgcctatga

SEQ ID NO: 60777 - DNA, 38 bp, Artificial Sequence
  Synthetic oligonucleotide
gaccgccccgctcgcatcgtggcatactactttactga

SEQ ID NO: 60778 - DNA, 38 bp, Artificial Sequence
  Synthetic oligonucleotide
acatctgggaacaatctgtcgaagcacccctttcctga

SEQ ID NO: 60779 - DNA, 38 bp, Artificial Sequence
  Synthetic oligonucleotide
tccgcacccacaatcagcgacaacactacttgagctga

SEQ ID NO: 60780 - DNA, 38 bp, Artificial Sequence
  Synthetic oligonucleotide
gcggaagcaacactgcgcaaaactccatcacattctga

SEQ ID NO: 60781 - DNA, 37 bp, Artificial Sequence
  Synthetic oligonucleotide
gccgataggccgggacttttaggagatggggttctga

SEQ ID NO: 60782 - DNA, 38 bp, Artificial Sequence
  Synthetic oligonucleotide
gacatgctgcaggtttcacgaatggctggacatagtga

SEQ ID NO: 60783 - DNA, 38 bp, Artificial Sequence
  Synthetic oligonucleotide
gatcggagattgcctaacatacctcattgcccccgtga

SEQ ID NO: 60784 - DNA, 37 bp, Artificial Sequence
  Synthetic oligonucleotide
tcgcaacagaagggttgggtggtatgttgcgaggtga

SEQ ID NO: 60785 - DNA, 38 bp, Artificial Sequence
  Synthetic oligonucleotide
atgtgtggtggctggatagtggctggggttacgggtga

SEQ ID NO: 60786 - DNA, 38 bp, Artificial Sequence
  Synthetic oligonucleotide
tgacgatggtgaggggcgtggggaatcattgggggtga

SEQ ID NO: 60787 - DNA, 36 bp, Artificial Sequence
  Synthetic oligonucleotide
ttgcgtgcctgcatcttcctaccccttacggattga

SEQ ID NO: 60788 - DNA, 38 bp, Artificial Sequence
  Synthetic oligonucleotide
ttgcccggtccgcttgccctttatcaccctgtatttga

SEQ ID NO: 60789 - DNA, 38 bp, Artificial Sequence
  Synthetic oligonucleotide
tgctacgtagcaggtggggtgaaagatgttagctttga

SEQ ID NO: 60790 - DNA, 36 bp, Artificial Sequence
  Synthetic oligonucleotide
tttgaccggtcctgtccttagtgaacattgctttga

SEQ ID NO: 60791 - DNA, 36 bp, Artificial Sequence
  Synthetic oligonucleotide
gcaccgcccccctgtacgttagactcaaacgggcta

SEQ ID NO: 60792 - DNA, 36 bp, Artificial Sequence
  Synthetic oligonucleotide
acccccggagttccgagatattaacccctgtatcta

SEQ ID NO: 60793 - DNA, 36 bp, Artificial Sequence
  Synthetic oligonucleotide
tcccaatcgggaacacaccctcaccttggaaaagta

SEQ ID NO: 60794 - DNA, 36 bp, Artificial Sequence
  Synthetic oligonucleotide
tggagggctgaaatcgcaactacttcccctggctta

SEQ ID NO: 60795 - DNA, 36 bp, Artificial Sequence
  Synthetic oligonucleotide
gatgcaatcgcagctactaccataatgatttgctta

SEQ ID NO: 60796 - DNA, 36 bp, Artificial Sequence
  Synthetic oligonucleotide
atcggagctcaatttccctactcgttctatctgcac

SEQ ID NO: 60797 - DNA, 35 bp, Artificial Sequence
  Synthetic oligonucleotide
gagtggtgggtacgtttggaggaggcgaggtttac

SEQ ID NO: 60798 - DNA, 35 bp, Artificial Sequence
  Synthetic oligonucleotide
gccacaaacggtgtagtgtctccgctctcttttac

SEQ ID NO: 60799 - DNA, 35 bp, Artificial Sequence
  Synthetic oligonucleotide
gttagcccactagaattacactggacacagcaacc

SEQ ID NO: 60800 - DNA, 35 bp, Artificial Sequence
  Synthetic oligonucleotide
gacttccgcgttgccacacttcttgcctacgtacc

SEQ ID NO: 60801 - DNA, 35 bp, Artificial Sequence
  Synthetic oligonucleotide
taacgccaatatgttcatttctgcacgcccagtcc

SEQ ID NO: 60802 - DNA, 35 bp, Artificial Sequence
  Synthetic oligonucleotide
atcacctgtctatcatcctaaattaggagcccagc

SEQ ID NO: 60803 - DNA, 35 bp, Artificial Sequence
  Synthetic oligonucleotide
attaggggtggggaaggggctatgagttaatgatc

SEQ ID NO: 60804 - DNA, 35 bp, Artificial Sequence
  Synthetic oligonucleotide
atgaccttcacgaacatgtgacgatccgcttactc

SEQ ID NO: 60805 - DNA, 35 bp, Artificial Sequence
  Synthetic oligonucleotide
accacccgaccattttgtttgttagggcccgcttc

SEQ ID NO: 60806 - DNA, 35 bp, Artificial Sequence
  Synthetic oligonucleotide
gcaagtccagccggttattcgttcgctttcggttc

SEQ ID NO: 60807 - DNA, 35 bp, Artificial Sequence
  Synthetic oligonucleotide
gccaatgccaaatcctacgtgtcccagtctaacag

SEQ ID NO: 60808 - DNA, 36 bp, Artificial Sequence
  Synthetic oligonucleotide
agtgtacgtagggtggtgggatgagcgggataccag

SEQ ID NO: 60809 - DNA, 35 bp, Artificial Sequence
  Synthetic oligonucleotide
aaaccacaccaccctaggcttaaaacaagccctag

SEQ ID NO: 60810 - DNA, 35 bp, Artificial Sequence
  Synthetic oligonucleotide
taagagtggaggtgaagacgctgtgcataggaagg

SEQ ID NO: 60811 - DNA, 35 bp, Artificial Sequence
  Synthetic oligonucleotide
agtatgggaagggcgggcctaagatgggtcaactg

SEQ ID NO: 60812 - DNA, 35 bp, Artificial Sequence
  Synthetic oligonucleotide
gagcgcccctgcccagtatttcgtttgccctactg

SEQ ID NO: 60813 - DNA, 35 bp, Artificial Sequence
  Synthetic oligonucleotide
agccaaacctcatccctgtcgccacagtttagctg

SEQ ID NO: 60814 - DNA, 35 bp, Artificial Sequence
  Synthetic oligonucleotide
tgcaactcatggccggagtcccgattttttttttg

SEQ ID NO: 60815 - DNA, 35 bp, Artificial Sequence
  Synthetic oligonucleotide
attggcacatcgatccatactaaacttcagcaaat

SEQ ID NO: 60816 - DNA, 35 bp, Artificial Sequence
  Synthetic oligonucleotide
taccggcgcatcccgctgccatacacttcgcaact

SEQ ID NO: 60817 - DNA, 35 bp, Artificial Sequence
  Synthetic oligonucleotide
attgcgatcgtcacatcaatctgtccgtcataact

SEQ ID NO: 60818 - DNA, 35 bp, Artificial Sequence
  Synthetic oligonucleotide
tcgacccatgcctccttatgtctgatctctcatct

SEQ ID NO: 60819 - DNA, 35 bp, Artificial Sequence
  Synthetic oligonucleotide
gagcacctccatacatgctgccttcgacaagctct

SEQ ID NO: 60820 - DNA, 35 bp, Artificial Sequence
  Synthetic oligonucleotide
gtttgcacaggcgcggagatcttttgtcaacttct

SEQ ID NO: 60821 - DNA, 35 bp, Artificial Sequence
  Synthetic oligonucleotide
gctattaccgtacaggcggactcattttcacttct

SEQ ID NO: 60822 - DNA, 34 bp, Artificial Sequence
  Synthetic oligonucleotide
tgcaaccctgtttgttactgttccccctgacatt

SEQ ID NO: 60823 - DNA, 35 bp, Artificial Sequence
  Synthetic oligonucleotide
tagtacgctcacgtggcgctcttagctatcaactt

SEQ ID NO: 60824 - DNA, 35 bp, Artificial Sequence
  Synthetic oligonucleotide
tcgcacacacctgatcctacttattagttctactt

SEQ ID NO: 60825 - DNA, 35 bp, Artificial Sequence
  Synthetic oligonucleotide
gcattactgacgccacgcattccggttagaccctt

SEQ ID NO: 60826 - DNA, 35 bp, Artificial Sequence
  Synthetic oligonucleotide
tactacatgggcgtcccacaacacatcaccacttt

SEQ ID NO: 60827 - DNA, 36 bp, Artificial Sequence
  Synthetic oligonucleotide
ttggacattgggttcgggagggtgggcgataaaaaa

SEQ ID NO: 60828 - DNA, 35 bp, Artificial Sequence
  Synthetic oligonucleotide
gggactagtgaacgcgggtgaagggggcttaaaaa

SEQ ID NO: 60829 - DNA, 36 bp, Artificial Sequence
  Synthetic oligonucleotide
ttagtggaggcatggaggcggggaggtagattagaa

SEQ ID NO: 60830 - DNA, 35 bp, Artificial Sequence
  Synthetic oligonucleotide
tcaggcctcctaggtttatctcctctctcttagaa

SEQ ID NO: 60831 - DNA, 36 bp, Artificial Sequence
  Synthetic oligonucleotide
atcgtcgcctgactataccactaatgtacacctgaa

SEQ ID NO: 60832 - DNA, 36 bp, Artificial Sequence
  Synthetic oligonucleotide
ttgaatgtcagcagtaggtcccgtttgcgcttcaca

SEQ ID NO: 60833 - DNA, 35 bp, Artificial Sequence
  Synthetic oligonucleotide
tacgcgaaacttctgcaggttatcctaatgttcca

SEQ ID NO: 60834 - DNA, 36 bp, Artificial Sequence
  Synthetic oligonucleotide
ttgtggcgccccgtttcgcaattcgttttgcctgca

SEQ ID NO: 60835 - DNA, 35 bp, Artificial Sequence
  Synthetic oligonucleotide
ttgtcactaccccgccaaggctcccagttttatca

SEQ ID NO: 60836 - DNA, 35 bp, Artificial Sequence
  Synthetic oligonucleotide
gttcagtcgacccacaccgctcccacccgaactca

SEQ ID NO: 60837 - DNA, 36 bp, Artificial Sequence
  Synthetic oligonucleotide
tatcaccgactcacgcctatatattattgacactca

SEQ ID NO: 60838 - DNA, 35 bp, Artificial Sequence
  Synthetic oligonucleotide
atcaatgaaggcgcggctggggaaaggggagaaga

SEQ ID NO: 60839 - DNA, 36 bp, Artificial Sequence
  Synthetic oligonucleotide
gagtagagaagcgggaaggctacgggtaggagcaga

SEQ ID NO: 60840 - DNA, 37 bp, Artificial Sequence
  Synthetic oligonucleotide
gactgggagataaggcgatagggggcacactgataga

SEQ ID NO: 60841 - DNA, 37 bp, Artificial Sequence
  Synthetic oligonucleotide
gaaacgcccctaaatcaaagtactgcggccccaccga

SEQ ID NO: 60842 - DNA, 37 bp, Artificial Sequence
  Synthetic oligonucleotide
cacggttatcagccctttccacatcccgccctaagga

SEQ ID NO: 60843 - DNA, 36 bp, Artificial Sequence
  Synthetic oligonucleotide
aacgccgcctacggaaaaagtcattaacacaaggga

SEQ ID NO: 60844 - DNA, 36 bp, Artificial Sequence
  Synthetic oligonucleotide
tacatcacctggaccatccttgtcggttaccctgga

SEQ ID NO: 60845 - DNA, 37 bp, Artificial Sequence
  Synthetic oligonucleotide
agcggggtgggcaaactaagggggcggcaggggtgga

SEQ ID NO: 60846 - DNA, 37 bp, Artificial Sequence
  Synthetic oligonucleotide
gacaacgactaccgcgtaccccgccaacatgattgga

SEQ ID NO: 60847 - DNA, 38 bp, Artificial Sequence
  Synthetic oligonucleotide
tgcacccagcgtgctgggaccactcacctttaacatga

SEQ ID NO: 60848 - DNA, 38 bp, Artificial Sequence
  Synthetic oligonucleotide
acctggcaccctaactcggttggcactacatcacatga

SEQ ID NO: 60849 - DNA, 38 bp, Artificial Sequence
  Synthetic oligonucleotide
ggaccgcaacgcccaggaaccaccgacttttgacatga

SEQ ID NO: 60850 - DNA, 38 bp, Artificial Sequence
  Synthetic oligonucleotide
gtggcggacagaactttatgcgccctccgattccatga

SEQ ID NO: 60851 - DNA, 35 bp, Artificial Sequence
  Synthetic oligonucleotide
ggtccccggaaccactgcgatttttatcttcctga

SEQ ID NO: 60852 - DNA, 38 bp, Artificial Sequence
  Synthetic oligonucleotide
gactgtccattgatcctccccttgtcgtacgttcctga

SEQ ID NO: 60853 - DNA, 38 bp, Artificial Sequence
  Synthetic oligonucleotide
atccattgacgcccggaatgtgttttttccgtgtctga

SEQ ID NO: 60854 - DNA, 37 bp, Artificial Sequence
  Synthetic oligonucleotide
tcccgtcactgtattgctgcattttgggtggttctga

SEQ ID NO: 60855 - DNA, 38 bp, Artificial Sequence
  Synthetic oligonucleotide
acgtcccaacccagcaactacgcccgcccagcccgtga

SEQ ID NO: 60856 - DNA, 38 bp, Artificial Sequence
  Synthetic oligonucleotide
acgcaacgcagggtcgttcgcactgccctcttctgtga

SEQ ID NO: 60857 - DNA, 35 bp, Artificial Sequence
  Synthetic oligonucleotide
tcacatccccgtcactctccttatgattattttga

SEQ ID NO: 60858 - DNA, 36 bp, Artificial Sequence
  Synthetic oligonucleotide
gcccatgccgttttttcattcactgtatacgttata

SEQ ID NO: 60859 - DNA, 36 bp, Artificial Sequence
  Synthetic oligonucleotide
acgacccaactctcggacccgcaaaaggctttccta

SEQ ID NO: 60860 - DNA, 35 bp, Artificial Sequence
  Synthetic oligonucleotide
tacagccggtggggagtagggcactattcaatcta

SEQ ID NO: 60861 - DNA, 36 bp, Artificial Sequence
  Synthetic oligonucleotide
gcccgcacccgatcatctcacgcagctccattagta

SEQ ID NO: 60862 - DNA, 36 bp, Artificial Sequence
  Synthetic oligonucleotide
atgtgccttgatgtccttcccctttcccttggcgta

SEQ ID NO: 60863 - DNA, 35 bp, Artificial Sequence
  Synthetic oligonucleotide
tttgtcaccctaggcacgacgtatctctccacaac

SEQ ID NO: 60864 - DNA, 35 bp, Artificial Sequence
  Synthetic oligonucleotide
gatcccgccgctttgaagacacgcctggatcctac

SEQ ID NO: 60865 - DNA, 35 bp, Artificial Sequence
  Synthetic oligonucleotide
gcacagccctccccttatgtcccgacgccgctacc

SEQ ID NO: 60866 - DNA, 35 bp, Artificial Sequence
  Synthetic oligonucleotide
ttgtcgaattcacatccgcccatttgagatttacc

SEQ ID NO: 60867 - DNA, 35 bp, Artificial Sequence
  Synthetic oligonucleotide
tcccataccagcgaagacaccgcccgttaacaccc

SEQ ID NO: 60868 - DNA, 35 bp, Artificial Sequence
  Synthetic oligonucleotide
tgacactacacgacatccctagtcatatggcaccc

SEQ ID NO: 60869 - DNA, 35 bp, Artificial Sequence
  Synthetic oligonucleotide
tgatcctgctatggtacccgtccgccttccgaccc

SEQ ID NO: 60870 - DNA, 35 bp, Artificial Sequence
  Synthetic oligonucleotide
acccgtagcccgatgtgtacagtcccttcgtcccc

SEQ ID NO: 60871 - DNA, 34 bp, Artificial Sequence
  Synthetic oligonucleotide
gccgtcactcgcacacgcctgggtttcctctccc

SEQ ID NO: 60872 - DNA, 35 bp, Artificial Sequence
  Synthetic oligonucleotide
ttaccacgcgcgagtacggtaagcagtatctcgcc

SEQ ID NO: 60873 - DNA, 35 bp, Artificial Sequence
  Synthetic oligonucleotide
tgtggtcacaaatgtacaaggccccacccacatcc

SEQ ID NO: 60874 - DNA, 35 bp, Artificial Sequence
  Synthetic oligonucleotide
acatcgtacagtaccgcacacggttctcctcacgc

SEQ ID NO: 60875 - DNA, 35 bp, Artificial Sequence
  Synthetic oligonucleotide
gtctatcccgtccctagtgctctttgctctgactc

SEQ ID NO: 60876 - DNA, 35 bp, Artificial Sequence
  Synthetic oligonucleotide
tgcccatgtacgttgatcgtacagccttgttactc

SEQ ID NO: 60877 - DNA, 35 bp, Artificial Sequence
  Synthetic oligonucleotide
agtgaactggaacggctgcactccctcctgtcctc

SEQ ID NO: 60878 - DNA, 35 bp, Artificial Sequence
  Synthetic oligonucleotide
tcacatcccgcactcgccttcgctgacgtccggtc

SEQ ID NO: 60879 - DNA, 35 bp, Artificial Sequence
  Synthetic oligonucleotide
atgtcatcgcaagtctcttttttagtccgtgcttc

SEQ ID NO: 60880 - DNA, 35 bp, Artificial Sequence
  Synthetic oligonucleotide
aggggtcgggtcggagtggagcaaatgggagggag

SEQ ID NO: 60881 - DNA, 35 bp, Artificial Sequence
  Synthetic oligonucleotide
acagggtgggaggggccgggtccgcgtcgcagtag

SEQ ID NO: 60882 - DNA, 35 bp, Artificial Sequence
  Synthetic oligonucleotide
agagcggtgacgcagacgcaaccccccctaccctg

SEQ ID NO: 60883 - DNA, 35 bp, Artificial Sequence
  Synthetic oligonucleotide
acgcaactccacgcgttcttgaactacgcccccat

SEQ ID NO: 60884 - DNA, 35 bp, Artificial Sequence
  Synthetic oligonucleotide
gcacgcaccaggcactatttcagcaactctcgtat

SEQ ID NO: 60885 - DNA, 36 bp, Artificial Sequence
  Synthetic oligonucleotide
acccgcctggaacccgggacctattgcaaccaatct

SEQ ID NO: 60886 - DNA, 35 bp, Artificial Sequence
  Synthetic oligonucleotide
tgcaccgcaatagttctctagggagccacctctct

SEQ ID NO: 60887 - DNA, 35 bp, Artificial Sequence
  Synthetic oligonucleotide
gcgctgtaagaatggttgtgtcaccgctctcttct

SEQ ID NO: 60888 - DNA, 35 bp, Artificial Sequence
  Synthetic oligonucleotide
tcacttatcgcggcttctcggcccccatggtttct

SEQ ID NO: 60889 - DNA, 35 bp, Artificial Sequence
  Synthetic oligonucleotide
attggggggtgcgggtgcagttaggaaggaaacgt

SEQ ID NO: 60890 - DNA, 35 bp, Artificial Sequence
  Synthetic oligonucleotide
tacctcacgacatttcgagcccgtacgcccacctt

SEQ ID NO: 60891 - DNA, 35 bp, Artificial Sequence
  Synthetic oligonucleotide
gtaccggaagctggtttctcacgcctgtacatctt

SEQ ID NO: 60892 - DNA, 36 bp, Artificial Sequence
  Synthetic oligonucleotide
aacagttgcagctggtcacgccacacactttacaaa

SEQ ID NO: 60893 - DNA, 36 bp, Artificial Sequence
  Synthetic oligonucleotide
tccgcgcgggtacgggacggggaggggaaagcgaaa

SEQ ID NO: 60894 - DNA, 35 bp, Artificial Sequence
  Synthetic oligonucleotide
ttgtgccacgaccttgttctatctaaattcgggaa

SEQ ID NO: 60895 - DNA, 36 bp, Artificial Sequence
  Synthetic oligonucleotide
gcataaaggggcaaaaggtggggaccagagtagtaa

SEQ ID NO: 60896 - DNA, 36 bp, Artificial Sequence
  Synthetic oligonucleotide
gccctaggcctaatagaaccgtaccctgtgctccca

SEQ ID NO: 60897 - DNA, 36 bp, Artificial Sequence
  Synthetic oligonucleotide
tcacggtccatgataacgcccccttcctcaactcca

SEQ ID NO: 60898 - DNA, 36 bp, Artificial Sequence
  Synthetic oligonucleotide
attgtcctccggcctcatgcttatcaccgagccgca

SEQ ID NO: 60899 - DNA, 35 bp, Artificial Sequence
  Synthetic oligonucleotide
gtccatcacatcgccttgcctttaaaccgcacaga

SEQ ID NO: 60900 - DNA, 35 bp, Artificial Sequence
  Synthetic oligonucleotide
tgagatcccagtccctcccactcacaatgtccaga

SEQ ID NO: 60901 - DNA, 36 bp, Artificial Sequence
  Synthetic oligonucleotide
tatgcctcatagtacgtccctatgttacacccccga

SEQ ID NO: 60902 - DNA, 37 bp, Artificial Sequence
  Synthetic oligonucleotide
tggacctacactgacactgcccgccatacgcttccga

SEQ ID NO: 60903 - DNA, 37 bp, Artificial Sequence
  Synthetic oligonucleotide
aacctgatgcaaggtgccagccatcccgattactcga

SEQ ID NO: 60904 - DNA, 37 bp, Artificial Sequence
  Synthetic oligonucleotide
gtgggacaagggagtgttatatattgggagggctcga

SEQ ID NO: 60905 - DNA, 36 bp, Artificial Sequence
  Synthetic oligonucleotide
actagtgatggaaagaacggtgaggatgcaggagga

SEQ ID NO: 60906 - DNA, 37 bp, Artificial Sequence
  Synthetic oligonucleotide
agatgggacggcgggtgtccaggaatagggggtagga

SEQ ID NO: 60907 - DNA, 35 bp, Artificial Sequence
  Synthetic oligonucleotide
tacatcatgtactgagcaaatgggaggcgaaggga

SEQ ID NO: 60908 - DNA, 37 bp, Artificial Sequence
  Synthetic oligonucleotide
gaagggtacgaaggtgttgttggaatatgtgagggga

SEQ ID NO: 60909 - DNA, 37 bp, Artificial Sequence
  Synthetic oligonucleotide
ttagatagggagggtgcgtttggcctaggtcggggga

SEQ ID NO: 60910 - DNA, 37 bp, Artificial Sequence
  Synthetic oligonucleotide
ataaaggacgcggaggaaataggtatttgggggggga

SEQ ID NO: 60911 - DNA, 35 bp, Artificial Sequence
  Synthetic oligonucleotide
tccgggcctccctcacatccaacgttactagtgga

SEQ ID NO: 60912 - DNA, 37 bp, Artificial Sequence
  Synthetic oligonucleotide
gcaaatgaggtgcgaggggttgattacggtgggtgga

SEQ ID NO: 60913 - DNA, 37 bp, Artificial Sequence
  Synthetic oligonucleotide
agtccagccccatccgcaaaggcctgcctctgaatga

SEQ ID NO: 60914 - DNA, 38 bp, Artificial Sequence
  Synthetic oligonucleotide
tccaagcgagcagtcgaggaaaggcataatgaatatga

SEQ ID NO: 60915 - DNA, 38 bp, Artificial Sequence
  Synthetic oligonucleotide
tatccacgtacgaacgcgatcctagcataacactatga

SEQ ID NO: 60916 - DNA, 38 bp, Artificial Sequence
  Synthetic oligonucleotide
acgactagtcccacctgcccccgaatgatcgttactga

SEQ ID NO: 60917 - DNA, 36 bp, Artificial Sequence
  Synthetic oligonucleotide
tctccacccgccggtcttcgaaagcctgccacctga

SEQ ID NO: 60918 - DNA, 37 bp, Artificial Sequence
  Synthetic oligonucleotide
gtcggggacacgcctacctctgcctataccggcctga

SEQ ID NO: 60919 - DNA, 38 bp, Artificial Sequence
  Synthetic oligonucleotide
gtgtccgctccgtaactgcatgtttcccccatagctga

SEQ ID NO: 60920 - DNA, 37 bp, Artificial Sequence
  Synthetic oligonucleotide
gtcgaatcgccgctggttcagtttctctcctagctga

SEQ ID NO: 60921 - DNA, 37 bp, Artificial Sequence
  Synthetic oligonucleotide
atgacagctgcaactttgaacgtattgcctctcgtga

SEQ ID NO: 60922 - DNA, 37 bp, Artificial Sequence
  Synthetic oligonucleotide
taagggcgaggcgaacgggaggtcaaggcaaaggtga

SEQ ID NO: 60923 - DNA, 38 bp, Artificial Sequence
  Synthetic oligonucleotide
gatggtggggggcggtgaatacgccaattaattggtga

SEQ ID NO: 60924 - DNA, 38 bp, Artificial Sequence
  Synthetic oligonucleotide
gcctgcgagccgttactcctggtcgctcacatctgtga

SEQ ID NO: 60925 - DNA, 38 bp, Artificial Sequence
  Synthetic oligonucleotide
acagatacgcggatcggggtgggaggggaggcgtgtga

SEQ ID NO: 60926 - DNA, 38 bp, Artificial Sequence
  Synthetic oligonucleotide
acattatgcgccccacgttcaccatcagcatgcattga

SEQ ID NO: 60927 - DNA, 36 bp, Artificial Sequence
  Synthetic oligonucleotide
ttgaggtggccaccacgacgatccgacacattaata

SEQ ID NO: 60928 - DNA, 36 bp, Artificial Sequence
  Synthetic oligonucleotide
ttaccaccgtgacgccaatccgctcatgcaagacta

SEQ ID NO: 60929 - DNA, 36 bp, Artificial Sequence
  Synthetic oligonucleotide
taccatcggtcaccgcaattccctgtcaatttgcta

SEQ ID NO: 60930 - DNA, 36 bp, Artificial Sequence
  Synthetic oligonucleotide
acgccgcccccccgcctttcagagttttgttctgta

SEQ ID NO: 60931 - DNA, 35 bp, Artificial Sequence
  Synthetic oligonucleotide
acacatgatctcacaggttttctagccattttcac

SEQ ID NO: 60932 - DNA, 35 bp, Artificial Sequence
  Synthetic oligonucleotide
acaatggtaggagggcaaaaggagcttgggtgtac

SEQ ID NO: 60933 - DNA, 35 bp, Artificial Sequence
  Synthetic oligonucleotide
accaaggggctcataatctatctgcctggtcgacc

SEQ ID NO: 60934 - DNA, 35 bp, Artificial Sequence
  Synthetic oligonucleotide
aacatagcgtgggtgatgcttctcctccccccccc

SEQ ID NO: 60935 - DNA, 35 bp, Artificial Sequence
  Synthetic oligonucleotide
atatgcatccgcgtacccatttcgccttcatcccc

SEQ ID NO: 60936 - DNA, 35 bp, Artificial Sequence
  Synthetic oligonucleotide
agccaaggttggtttcagcgtccgctcccctcccc

SEQ ID NO: 60937 - DNA, 35 bp, Artificial Sequence
  Synthetic oligonucleotide
gccacccgtgccgcctgtaagccactttctcatcc

SEQ ID NO: 60938 - DNA, 35 bp, Artificial Sequence
  Synthetic oligonucleotide
gcattctatcgcccccttgtaaatcccgcctcagc

SEQ ID NO: 60939 - DNA, 35 bp, Artificial Sequence
  Synthetic oligonucleotide
aagaaaaagggacgggtgcgggtggtggcgtgggc

SEQ ID NO: 60940 - DNA, 35 bp, Artificial Sequence
  Synthetic oligonucleotide
gatgggtaaccatgcgatgtgatcaaccttcatgc

SEQ ID NO: 60941 - DNA, 35 bp, Artificial Sequence
  Synthetic oligonucleotide
tcactaccactccgtgtcttccacctctagcactc

SEQ ID NO: 60942 - DNA, 35 bp, Artificial Sequence
  Synthetic oligonucleotide
actccgccacagcctgggacctatgtgcagtcctc

SEQ ID NO: 60943 - DNA, 35 bp, Artificial Sequence
  Synthetic oligonucleotide
tacttacagggaacccacgcattctagactttgtc

SEQ ID NO: 60944 - DNA, 35 bp, Artificial Sequence
  Synthetic oligonucleotide
acctgctagcttatggacgtccctgctttatcttc

SEQ ID NO: 60945 - DNA, 35 bp, Artificial Sequence
  Synthetic oligonucleotide
gagcgctatcaggcgttcgccacatgctcgctttc

SEQ ID NO: 60946 - DNA, 35 bp, Artificial Sequence
  Synthetic oligonucleotide
gcttaagccgactggctctagtccctctccttttc

SEQ ID NO: 60947 - DNA, 35 bp, Artificial Sequence
  Synthetic oligonucleotide
gtggacatgcccagaagaggttggtgtggggtacg

SEQ ID NO: 60948 - DNA, 35 bp, Artificial Sequence
  Synthetic oligonucleotide
acatcagtcggctggaggggtggggtacgtgagcg

SEQ ID NO: 60949 - DNA, 35 bp, Artificial Sequence
  Synthetic oligonucleotide
gttggggggtggtggcacgtggactgaatcctggg

SEQ ID NO: 60950 - DNA, 35 bp, Artificial Sequence
  Synthetic oligonucleotide
gtcgggtgggtgactcggaaagggaaaaacattgg

SEQ ID NO: 60951 - DNA, 35 bp, Artificial Sequence
  Synthetic oligonucleotide
gacgagcccaccgcactttacagccgcacacagtg

SEQ ID NO: 60952 - DNA, 35 bp, Artificial Sequence
  Synthetic oligonucleotide
acgttcctcccttagctattgtttctttcggacat

SEQ ID NO: 60953 - DNA, 35 bp, Artificial Sequence
  Synthetic oligonucleotide
tgttgtctctggtccctgtaaggtagccactccct

SEQ ID NO: 60954 - DNA, 35 bp, Artificial Sequence
  Synthetic oligonucleotide
gcgccaaggtggcccgccccatgaccctcacttct

SEQ ID NO: 60955 - DNA, 35 bp, Artificial Sequence
  Synthetic oligonucleotide
atcatgcccacctctagtcgaacaccgacttcttt

SEQ ID NO: 60956 - DNA, 35 bp, Artificial Sequence
  Synthetic oligonucleotide
tacctctccacctggttagacatttgttctcgttt

SEQ ID NO: 60957 - DNA, 35 bp, Artificial Sequence
  Synthetic oligonucleotide
gttgcgatcggtgccacggcatgatttcgcctttt

SEQ ID NO: 60958 - DNA, 36 bp, Artificial Sequence
  Synthetic oligonucleotide
tagccggcccagcgacacatactctttacatgaaaa

SEQ ID NO: 60959 - DNA, 35 bp, Artificial Sequence
  Synthetic oligonucleotide
acgagagacctccacctgtttgagttggacctcaa

SEQ ID NO: 60960 - DNA, 35 bp, Artificial Sequence
  Synthetic oligonucleotide
gtcacggtcacgccccctcttttccctttagtcaa

SEQ ID NO: 60961 - DNA, 35 bp, Artificial Sequence
  Synthetic oligonucleotide
tagatcccaactccagaccgaactgccagacataa

SEQ ID NO: 60962 - DNA, 35 bp, Artificial Sequence
  Synthetic oligonucleotide
gactgagctcacacaacgtgttccctacgatttaa

SEQ ID NO: 60963 - DNA, 36 bp, Artificial Sequence
  Synthetic oligonucleotide
tagatgcctgacacaaacggttggtgtctcctcaca

SEQ ID NO: 60964 - DNA, 36 bp, Artificial Sequence
  Synthetic oligonucleotide
tcctattcctgccttattcctgcctattagtggaca

SEQ ID NO: 60965 - DNA, 36 bp, Artificial Sequence
  Synthetic oligonucleotide
gtaggacggacggtggtagggggtatgtatcataca

SEQ ID NO: 60966 - DNA, 36 bp, Artificial Sequence
  Synthetic oligonucleotide
acaccgtccataggatcgttggtctcctcattccca

SEQ ID NO: 60967 - DNA, 36 bp, Artificial Sequence
  Synthetic oligonucleotide
gtcccacagccgtacgcagcaaccagtcccgggcca

SEQ ID NO: 60968 - DNA, 35 bp, Artificial Sequence
  Synthetic oligonucleotide
tcaccatacccgcgcctggcacttgtctacacgca

SEQ ID NO: 60969 - DNA, 35 bp, Artificial Sequence
  Synthetic oligonucleotide
gaacttggggaggtggtaggggatcgtaggaatca

SEQ ID NO: 60970 - DNA, 35 bp, Artificial Sequence
  Synthetic oligonucleotide
atctactaccacgaccgacctatccactgcgatca

SEQ ID NO: 60971 - DNA, 32 bp, Artificial Sequence
  Synthetic oligonucleotide
gtttgaagcccgagcgcctgtacctactctca

SEQ ID NO: 60972 - DNA, 37 bp, Artificial Sequence
  Synthetic oligonucleotide
tctcccaaccggacccccttcgatgcttctctgcaga

SEQ ID NO: 60973 - DNA, 37 bp, Artificial Sequence
  Synthetic oligonucleotide
tggaacacgggggggttaggaaggtgcctgggtgaga

SEQ ID NO: 60974 - DNA, 37 bp, Artificial Sequence
  Synthetic oligonucleotide
accaatagcagcccactccgacacaccagtgtaccga

SEQ ID NO: 60975 - DNA, 37 bp, Artificial Sequence
  Synthetic oligonucleotide
gagtcgcccggccctgcaacatgaggtcactaatcga

SEQ ID NO: 60976 - DNA, 37 bp, Artificial Sequence
  Synthetic oligonucleotide
gcaaacccactttgctgggagaactgccgtttttcga

SEQ ID NO: 60977 - DNA, 37 bp, Artificial Sequence
  Synthetic oligonucleotide
tcgataggggcggaacggaaactttgggctacaagga

SEQ ID NO: 60978 - DNA, 35 bp, Artificial Sequence
  Synthetic oligonucleotide
gatgtagcgcactccccacccacagccggatagga

SEQ ID NO: 60979 - DNA, 37 bp, Artificial Sequence
  Synthetic oligonucleotide
gcaaccaccacccgggtcctttctcctactggacgga

SEQ ID NO: 60980 - DNA, 37 bp, Artificial Sequence
  Synthetic oligonucleotide
gtcccatcctgccaaacagaacagtccggacctcgga

SEQ ID NO: 60981 - DNA, 37 bp, Artificial Sequence
  Synthetic oligonucleotide
acgtcacagcagggggttggcatggttggaacgggga

SEQ ID NO: 60982 - DNA, 37 bp, Artificial Sequence
  Synthetic oligonucleotide
tagagtgagggggaactacgaagcatgttgcatggga

SEQ ID NO: 60983 - DNA, 37 bp, Artificial Sequence
  Synthetic oligonucleotide
tgcgcgagggttacagggtagaggggagtagagtgga

SEQ ID NO: 60984 - DNA, 38 bp, Artificial Sequence
  Synthetic oligonucleotide
acacacacacagttcacccacatatgcacaagacatga

SEQ ID NO: 60985 - DNA, 38 bp, Artificial Sequence
  Synthetic oligonucleotide
gacaagcacaggagcagggatagcggcaaagggcatga

SEQ ID NO: 60986 - DNA, 38 bp, Artificial Sequence
  Synthetic oligonucleotide
tacatcatgcccggttgtagtttttggtgccttcatga

SEQ ID NO: 60987 - DNA, 38 bp, Artificial Sequence
  Synthetic oligonucleotide
tgtaccatccctccgcccggttaagcttggttaactga

SEQ ID NO: 60988 - DNA, 38 bp, Artificial Sequence
  Synthetic oligonucleotide
aaccgtgcctgcagtagttcggagaagtcaatacctga

SEQ ID NO: 60989 - DNA, 38 bp, Artificial Sequence
  Synthetic oligonucleotide
gtccactccatcaccacggctccgttcgccaaccgtga

SEQ ID NO: 60990 - DNA, 37 bp, Artificial Sequence
  Synthetic oligonucleotide
tcccgcctctctaccagacctgaatcgacagccgtga

SEQ ID NO: 60991 - DNA, 37 bp, Artificial Sequence
  Synthetic oligonucleotide
agaccctcccccaaaatcgcccaaacacccccggtga

SEQ ID NO: 60992 - DNA, 38 bp, Artificial Sequence
  Synthetic oligonucleotide
tgactgctgtgcatatgttgtccgggggaaattggtga

SEQ ID NO: 60993 - DNA, 38 bp, Artificial Sequence
  Synthetic oligonucleotide
gatgacgaggtggagtaggtgaagtgtaatgtaattga

SEQ ID NO: 60994 - DNA, 37 bp, Artificial Sequence
  Synthetic oligonucleotide
aacgccaagcatatgtaagcggaatagaggggattga

SEQ ID NO: 60995 - DNA, 38 bp, Artificial Sequence
  Synthetic oligonucleotide
aagtggggctagccacgaggatgaatgggggggattga

SEQ ID NO: 60996 - DNA, 36 bp, Artificial Sequence
  Synthetic oligonucleotide
gctgccgtggccactattgctcgctcgaacacttga

SEQ ID NO: 60997 - DNA, 37 bp, Artificial Sequence
  Synthetic oligonucleotide
gtccgacgccggcaccatctacggccctcacacttga

SEQ ID NO: 60998 - DNA, 37 bp, Artificial Sequence
  Synthetic oligonucleotide
acccaccacccaactgcccgtgttgtcgctcccttga

SEQ ID NO: 60999 - DNA, 37 bp, Artificial Sequence
  Synthetic oligonucleotide
cactcctgccatccaccagtcttgacacggtccttga

SEQ ID NO: 61000 - DNA, 37 bp, Artificial Sequence
  Synthetic oligonucleotide
tgaggaatgcagaggattaagggagggtagggcttga

SEQ ID NO: 61001 - DNA, 38 bp, Artificial Sequence
  Synthetic oligonucleotide
aacgatcccgaacaccattgtgctttgcccattcttga

SEQ ID NO: 61002 - DNA, 38 bp, Artificial Sequence
  Synthetic oligonucleotide
gcctccagaggggacgggatagggggtagtggagttga

SEQ ID NO: 61003 - DNA, 37 bp, Artificial Sequence
  Synthetic oligonucleotide
acacaggggaaggtagtctatatgggctttgatttga

SEQ ID NO: 61004 - DNA, 36 bp, Artificial Sequence
  Synthetic oligonucleotide
tagccccgatttccacctcccacctggtacgtgcta

SEQ ID NO: 61005 - DNA, 36 bp, Artificial Sequence
  Synthetic oligonucleotide
atgctcctgcaaagtacgtccgctccatctaacgta

SEQ ID NO: 61006 - DNA, 36 bp, Artificial Sequence
  Synthetic oligonucleotide
gaggggagggcccggtttaaagttaaggggagatta

SEQ ID NO: 61007 - DNA, 36 bp, Artificial Sequence
  Synthetic oligonucleotide
atcagatacgtcggcctttttcatgcagccacctta

SEQ ID NO: 61008 - DNA, 35 bp, Artificial Sequence
  Synthetic oligonucleotide
gtccaaccaaggttggttgtcgattaccgccctta

SEQ ID NO: 61009 - DNA, 36 bp, Artificial Sequence
  Synthetic oligonucleotide
tccccaccattttccaaccgtgatttgacccgctta

SEQ ID NO: 61010 - DNA, 35 bp, Artificial Sequence
  Synthetic oligonucleotide
tacccaggctgacacgcacggtacgcatactgtta

SEQ ID NO: 61011 - DNA, 35 bp, Artificial Sequence
  Synthetic oligonucleotide
tcatatggcacggagaatccattctgccacccacc

SEQ ID NO: 61012 - DNA, 35 bp, Artificial Sequence
  Synthetic oligonucleotide
tccagctgccttgcagaccccccgactgacccacc

SEQ ID NO: 61013 - DNA, 35 bp, Artificial Sequence
  Synthetic oligonucleotide
aatcgagctccgttagcaccaacccctgttttacc

SEQ ID NO: 61014 - DNA, 35 bp, Artificial Sequence
  Synthetic oligonucleotide
tcaaccatcatttccgtatatacgatgttcatccc

SEQ ID NO: 61015 - DNA, 35 bp, Artificial Sequence
  Synthetic oligonucleotide
acatgacgtagggcggtaagggataagaggaggcc

SEQ ID NO: 61016 - DNA, 35 bp, Artificial Sequence
  Synthetic oligonucleotide
gttagcctaaggtcccggatttttccaactagtcc

SEQ ID NO: 61017 - DNA, 35 bp, Artificial Sequence
  Synthetic oligonucleotide
tcccctggtactgacgccggttttgacggttacgc

SEQ ID NO: 61018 - DNA, 35 bp, Artificial Sequence
  Synthetic oligonucleotide
tccgacctagccaaccggcactagtaatccctcgc

SEQ ID NO: 61019 - DNA, 35 bp, Artificial Sequence
  Synthetic oligonucleotide
acatcccgacctagtatccagactgtcttttactc

SEQ ID NO: 61020 - DNA, 35 bp, Artificial Sequence
  Synthetic oligonucleotide
aaccatcacaaccgtggtcattgagccaacagctc

SEQ ID NO: 61021 - DNA, 35 bp, Artificial Sequence
  Synthetic oligonucleotide
tagccgtcgcgggaggggggattgtagtggggctc

SEQ ID NO: 61022 - DNA, 35 bp, Artificial Sequence
  Synthetic oligonucleotide
gctggctggaagcaggagtttagtggggggtggag

SEQ ID NO: 61023 - DNA, 35 bp, Artificial Sequence
  Synthetic oligonucleotide
gcccgccgcctatcgcgctctaaagattattctag

SEQ ID NO: 61024 - DNA, 35 bp, Artificial Sequence
  Synthetic oligonucleotide
agcagacacgcctaccttgggtcattccacctacg

SEQ ID NO: 61025 - DNA, 35 bp, Artificial Sequence
  Synthetic oligonucleotide
ttgggtgcaatgaccacccctgaacacatgactcg

SEQ ID NO: 61026 - DNA, 34 bp, Artificial Sequence
  Synthetic oligonucleotide
atcacatccgaacgctgctttttttggtgctagg

SEQ ID NO: 61027 - DNA, 35 bp, Artificial Sequence
  Synthetic oligonucleotide
gtggacgctcagggctcacaccattacacatactg

SEQ ID NO: 61028 - DNA, 35 bp, Artificial Sequence
  Synthetic oligonucleotide
tctcctgccgtacctgcccatatatccaagtggat

SEQ ID NO: 61029 - DNA, 35 bp, Artificial Sequence
  Synthetic oligonucleotide
agacatcacacctggatacctatgcgctcgctact

SEQ ID NO: 61030 - DNA, 35 bp, Artificial Sequence
  Synthetic oligonucleotide
gttgtcatcaacggtgcgacaatctgctctaacct

SEQ ID NO: 61031 - DNA, 35 bp, Artificial Sequence
  Synthetic oligonucleotide
acaacgccattaaggccggagcctacaggtaacct

SEQ ID NO: 61032 - DNA, 35 bp, Artificial Sequence
  Synthetic oligonucleotide
gtcagtgcgaaagggacgccaggtgggggggaggt

SEQ ID NO: 61033 - DNA, 35 bp, Artificial Sequence
  Synthetic oligonucleotide
ttacgatcgcgcacaccttttctcttttagccggt

SEQ ID NO: 61034 - DNA, 35 bp, Artificial Sequence
  Synthetic oligonucleotide
gtatgcatctcggtttcgacaccctgctaccctgt

SEQ ID NO: 61035 - DNA, 35 bp, Artificial Sequence
  Synthetic oligonucleotide
ttcccactagcggatcagagccgttctacccctgt

SEQ ID NO: 61036 - DNA, 35 bp, Artificial Sequence
  Synthetic oligonucleotide
gttccatctgcacgctgtcgtaccaatcatatctt

SEQ ID NO: 61037 - DNA, 35 bp, Artificial Sequence
  Synthetic oligonucleotide
gaaacgacacctattgccaaggccctctaccggtt

SEQ ID NO: 61038 - DNA, 35 bp, Artificial Sequence
  Synthetic oligonucleotide
gcgctagacaccgccggagcactctcctgaccttt

SEQ ID NO: 61039 - DNA, 35 bp, Artificial Sequence
  Synthetic oligonucleotide
gacgcaccattgcagcgagacctccagctgccttt

SEQ ID NO: 61040 - DNA, 34 bp, Artificial Sequence
  Synthetic oligonucleotide
tcgtcccctgggcctgctcataatacccactttt

SEQ ID NO: 61041 - DNA, 36 bp, Artificial Sequence
  Synthetic oligonucleotide
atggtcgaaagcgtcggacgcacctccattccccaa

SEQ ID NO: 61042 - DNA, 36 bp, Artificial Sequence
  Synthetic oligonucleotide
tcgaatcgtctattgcccactcgtacttctgcccaa

SEQ ID NO: 61043 - DNA, 36 bp, Artificial Sequence
  Synthetic oligonucleotide
ggtcgccggcgccgtattttacgcacacctcgccaa

SEQ ID NO: 61044 - DNA, 36 bp, Artificial Sequence
  Synthetic oligonucleotide
ggtcgaggcgctgttggccctgtgtcccccttgcaa

SEQ ID NO: 61045 - DNA, 36 bp, Artificial Sequence
  Synthetic oligonucleotide
gatgatcagggggcacggaaaagggaagggagggaa

SEQ ID NO: 61046 - DNA, 35 bp, Artificial Sequence
  Synthetic oligonucleotide
gtgagtgggggttatgggtttaaattatgatggaa

SEQ ID NO: 61047 - DNA, 36 bp, Artificial Sequence
  Synthetic oligonucleotide
aacgcctgctggtcaacaacgcttgttgccttctaa

SEQ ID NO: 61048 - DNA, 36 bp, Artificial Sequence
  Synthetic oligonucleotide
aatgcgagggaggagaataccgacgacgaatcaaca

SEQ ID NO: 61049 - DNA, 35 bp, Artificial Sequence
  Synthetic oligonucleotide
acaaccacgtctctccctggcttcccattggcaca

SEQ ID NO: 61050 - DNA, 36 bp, Artificial Sequence
  Synthetic oligonucleotide
tccccgacagcaagctccatgcccttgctcttcaca

SEQ ID NO: 61051 - DNA, 35 bp, Artificial Sequence
  Synthetic oligonucleotide
ttcagaccaggctaggtctcgctttcgcttcccca

SEQ ID NO: 61052 - DNA, 36 bp, Artificial Sequence
  Synthetic oligonucleotide
atcattcccccgtgttcaatctacagtcgatcgcca

SEQ ID NO: 61053 - DNA, 36 bp, Artificial Sequence
  Synthetic oligonucleotide
tctatcatgccttcgttcgcgtggctctccaatcca

SEQ ID NO: 61054 - DNA, 36 bp, Artificial Sequence
  Synthetic oligonucleotide
tgtgtgctatcattgactattgccagtccgtttcca

SEQ ID NO: 61055 - DNA, 36 bp, Artificial Sequence
  Synthetic oligonucleotide
gtgccgttgaccgagttcctggccctccgtctttca

SEQ ID NO: 61056 - DNA, 36 bp, Artificial Sequence
  Synthetic oligonucleotide
gaaccaacgctgtgtcgtcgccccatgttcgccaga

SEQ ID NO: 61057 - DNA, 37 bp, Artificial Sequence
  Synthetic oligonucleotide
gtgtgcgggctgttttcgttcctctttaacccaacga

SEQ ID NO: 61058 - DNA, 37 bp, Artificial Sequence
  Synthetic oligonucleotide
atgtccgtcccagtctcccgccgtcttggttcaccga

SEQ ID NO: 61059 - DNA, 37 bp, Artificial Sequence
  Synthetic oligonucleotide
gagccgtgcatccgtgtaactgccatgcccttaccga

SEQ ID NO: 61060 - DNA, 35 bp, Artificial Sequence
  Synthetic oligonucleotide
gcctggacgcaaacaagagcccttcccccgcccga

SEQ ID NO: 61061 - DNA, 37 bp, Artificial Sequence
  Synthetic oligonucleotide
atgacgcgggcaagatgtaaggggattgtagggagga

SEQ ID NO: 61062 - DNA, 37 bp, Artificial Sequence
  Synthetic oligonucleotide
agccacgcaggagaacttttgagcgaaagcgggagga

SEQ ID NO: 61063 - DNA, 36 bp, Artificial Sequence
  Synthetic oligonucleotide
tccatcacccgcaggccaactgacggtcaatccgga

SEQ ID NO: 61064 - DNA, 37 bp, Artificial Sequence
  Synthetic oligonucleotide
gtcgatgtattggtggaaaagctagagcgagggcgga

SEQ ID NO: 61065 - DNA, 36 bp, Artificial Sequence
  Synthetic oligonucleotide
ggagattagggtgctggctagggctgggggaaggga

SEQ ID NO: 61066 - DNA, 37 bp, Artificial Sequence
  Synthetic oligonucleotide
tatgcacagcagacccgcataccgacaatcataggga

SEQ ID NO: 61067 - DNA, 37 bp, Artificial Sequence
  Synthetic oligonucleotide
gctgtgtgggaaagtgcacagggtaagcaggtaggga

SEQ ID NO: 61068 - DNA, 37 bp, Artificial Sequence
  Synthetic oligonucleotide
ttcgaaggtgtatgtgttggtgggcgtatgtgatgga

SEQ ID NO: 61069 - DNA, 37 bp, Artificial Sequence
  Synthetic oligonucleotide
gcaccatcataccgcccatccaagacgcctcagtgga

SEQ ID NO: 61070 - DNA, 37 bp, Artificial Sequence
  Synthetic oligonucleotide
gagaattgtggcaggtatagggagatgacggggtgga

SEQ ID NO: 61071 - DNA, 38 bp, Artificial Sequence
  Synthetic oligonucleotide
tgtcgcccacaccacgctcgtttcatcttgcaacatga

SEQ ID NO: 61072 - DNA, 38 bp, Artificial Sequence
  Synthetic oligonucleotide
gagtacctcgccgtgagaacacacctaccaacacatga

SEQ ID NO: 61073 - DNA, 38 bp, Artificial Sequence
  Synthetic oligonucleotide
aaggggcacgagtgggtgggcgggaaaaacaaccatga

SEQ ID NO: 61074 - DNA, 38 bp, Artificial Sequence
  Synthetic oligonucleotide
gtcaaggagcgaggggtagacacggggttccaggatga

SEQ ID NO: 61075 - DNA, 37 bp, Artificial Sequence
  Synthetic oligonucleotide
gactactacatgacgagcccataagcacctggtatga

SEQ ID NO: 61076 - DNA, 38 bp, Artificial Sequence
  Synthetic oligonucleotide
tgctcaggccactgtttagcgtccgcgacctctcctga

SEQ ID NO: 61077 - DNA, 37 bp, Artificial Sequence
  Synthetic oligonucleotide
gagccgacatggctatcgcccctctcatcctacgtga

SEQ ID NO: 61078 - DNA, 38 bp, Artificial Sequence
  Synthetic oligonucleotide
tgcaaccactcggtctgaatctggggctcccactgtga

SEQ ID NO: 61079 - DNA, 38 bp, Artificial Sequence
  Synthetic oligonucleotide
tccttcgcaactgttctattaccagacctctgctgtga

SEQ ID NO: 61080 - DNA, 37 bp, Artificial Sequence
  Synthetic oligonucleotide
atccggtgccggccatttctggtttctgatctcttga

SEQ ID NO: 61081 - DNA, 38 bp, Artificial Sequence
  Synthetic oligonucleotide
aatgccatcaccgcaccgtgccctgaatcgattcttga

SEQ ID NO: 61082 - DNA, 38 bp, Artificial Sequence
  Synthetic oligonucleotide
gaggtgcagtaaaacgaaaggctggagggggacgttga

SEQ ID NO: 61083 - DNA, 38 bp, Artificial Sequence
  Synthetic oligonucleotide
gtgcatggggtggatcggggggaactggcacgggttga

SEQ ID NO: 61084 - DNA, 38 bp, Artificial Sequence
  Synthetic oligonucleotide
agacatcaagagacagcataggggtatggggggtttga

SEQ ID NO: 61085 - DNA, 36 bp, Artificial Sequence
  Synthetic oligonucleotide
gtacaccacaaaccggtctccgagtgctccctgata

SEQ ID NO: 61086 - DNA, 35 bp, Artificial Sequence
  Synthetic oligonucleotide
tgaccgtaagacaagccactccactctcccgccta

SEQ ID NO: 61087 - DNA, 36 bp, Artificial Sequence
  Synthetic oligonucleotide
gtgacccgaggcaccataccagacacattctatcta

SEQ ID NO: 61088 - DNA, 36 bp, Artificial Sequence
  Synthetic oligonucleotide
atgagacactgcctgccttcgtaatctgctactcta

SEQ ID NO: 61089 - DNA, 35 bp, Artificial Sequence
  Synthetic oligonucleotide
gtcaacatctacgccgttacaagtgctaacctcta

SEQ ID NO: 61090 - DNA, 34 bp, Artificial Sequence
  Synthetic oligonucleotide
tgtgctgagccaaaattctacccaccgcccagta

SEQ ID NO: 61091 - DNA, 35 bp, Artificial Sequence
  Synthetic oligonucleotide
gtaggactggggccaagtccggtcttcaaaatcac

SEQ ID NO: 61092 - DNA, 35 bp, Artificial Sequence
  Synthetic oligonucleotide
acctcgatcctacagtacctttcctttgtttgtac

SEQ ID NO: 61093 - DNA, 35 bp, Artificial Sequence
  Synthetic oligonucleotide
tacagcgcattagtcaataccgtcatctgttcacc

SEQ ID NO: 61094 - DNA, 35 bp, Artificial Sequence
  Synthetic oligonucleotide
ttcagcgcccgtccaggaacccttgccatatcccc

SEQ ID NO: 61095 - DNA, 35 bp, Artificial Sequence
  Synthetic oligonucleotide
tgaccagcattatacctgatcaccgttgtcttccc

SEQ ID NO: 61096 - DNA, 35 bp, Artificial Sequence
  Synthetic oligonucleotide
gatctaccagcgaggatagtccgctcctccaggcc

SEQ ID NO: 61097 - DNA, 35 bp, Artificial Sequence
  Synthetic oligonucleotide
tccattgctccttcgcgcccctagctcagcgggcc

SEQ ID NO: 61098 - DNA, 35 bp, Artificial Sequence
  Synthetic oligonucleotide
aacctcctgctgagaccaccttgaggaagggtgcc

SEQ ID NO: 61099 - DNA, 35 bp, Artificial Sequence
  Synthetic oligonucleotide
gtcctcttcctaatctcgttcttgcacggcgctcc

SEQ ID NO: 61100 - DNA, 35 bp, Artificial Sequence
  Synthetic oligonucleotide
attgcctcgaccggttactccctactcgtatctcc

SEQ ID NO: 61101 - DNA, 35 bp, Artificial Sequence
  Synthetic oligonucleotide
ggttcacgaccctggaccccctgtgtttcttccgc

SEQ ID NO: 61102 - DNA, 35 bp, Artificial Sequence
  Synthetic oligonucleotide
ttaaaggccaagattgtcgtcccatcctccgcatc

SEQ ID NO: 61103 - DNA, 35 bp, Artificial Sequence
  Synthetic oligonucleotide
tcattatacatttcgcccgttagtggcactcgatc

SEQ ID NO: 61104 - DNA, 35 bp, Artificial Sequence
  Synthetic oligonucleotide
aaaggtaatgggggaaaggtggataataagggccg

SEQ ID NO: 61105 - DNA, 35 bp, Artificial Sequence
  Synthetic oligonucleotide
aagacaacgcaacctctttatctgctcatgctagg

SEQ ID NO: 61106 - DNA, 35 bp, Artificial Sequence
  Synthetic oligonucleotide
acacacgtatgccacaaattgttatctccctcggg

SEQ ID NO: 61107 - DNA, 35 bp, Artificial Sequence
  Synthetic oligonucleotide
gagacactaccgacttaccctaccactggatttat

SEQ ID NO: 61108 - DNA, 35 bp, Artificial Sequence
  Synthetic oligonucleotide
atcgccgtactcacggatgcctatcctagtttact

SEQ ID NO: 61109 - DNA, 35 bp, Artificial Sequence
  Synthetic oligonucleotide
acttggaggcataggaccagccactttttctccct

SEQ ID NO: 61110 - DNA, 35 bp, Artificial Sequence
  Synthetic oligonucleotide
gaccaggacagttcgtttcatcacttgtttaggct

SEQ ID NO: 61111 - DNA, 35 bp, Artificial Sequence
  Synthetic oligonucleotide
taccccccccttgaaggttatagccagatatggct

SEQ ID NO: 61112 - DNA, 35 bp, Artificial Sequence
  Synthetic oligonucleotide
gagtccatccacggtcgtgcgaagtgcggtgctct

SEQ ID NO: 61113 - DNA, 35 bp, Artificial Sequence
  Synthetic oligonucleotide
gtcttgtaccgagcctccacatctgttccttcagt

SEQ ID NO: 61114 - DNA, 35 bp, Artificial Sequence
  Synthetic oligonucleotide
ggtcggaacccaccaaccacacctcgatttctggt

SEQ ID NO: 61115 - DNA, 35 bp, Artificial Sequence
  Synthetic oligonucleotide
atcgacccagttctcaccaatcgagcatttcatgt

SEQ ID NO: 61116 - DNA, 35 bp, Artificial Sequence
  Synthetic oligonucleotide
ggtcaccgcggtatccacgtctttctccgcccctt

SEQ ID NO: 61117 - DNA, 36 bp, Artificial Sequence
  Synthetic oligonucleotide
actcgtgcctaggtaggggcgtaggtgggggaaaaa

SEQ ID NO: 61118 - DNA, 36 bp, Artificial Sequence
  Synthetic oligonucleotide
accacgctctgccgtgtttgtgcttacaattttaaa

SEQ ID NO: 61119 - DNA, 36 bp, Artificial Sequence
  Synthetic oligonucleotide
tctgaccctcttcaacgtgtgccttttttcgaagaa

SEQ ID NO: 61120 - DNA, 36 bp, Artificial Sequence
  Synthetic oligonucleotide
tgtacgccacgactaacacttagacccgcattcgaa

SEQ ID NO: 61121 - DNA, 35 bp, Artificial Sequence
  Synthetic oligonucleotide
gagcacactccccacggtagaaatgcccctttgaa

SEQ ID NO: 61122 - DNA, 36 bp, Artificial Sequence
  Synthetic oligonucleotide
tgtccaatctgaccttttctccacgtacagtgctaa

SEQ ID NO: 61123 - DNA, 35 bp, Artificial Sequence
  Synthetic oligonucleotide
gccctgccgtcatactgtctcgccgatcgctttaa

SEQ ID NO: 61124 - DNA, 35 bp, Artificial Sequence
  Synthetic oligonucleotide
gtcgcctcaccgcaaaacttgccatgccaccacca

SEQ ID NO: 61125 - DNA, 35 bp, Artificial Sequence
  Synthetic oligonucleotide
gcgcacacaccaccgagctgctccatctgccccca

SEQ ID NO: 61126 - DNA, 36 bp, Artificial Sequence
  Synthetic oligonucleotide
tagctcgaaccgcaacaccccccgctgcctgtccca

SEQ ID NO: 61127 - DNA, 36 bp, Artificial Sequence
  Synthetic oligonucleotide
atgaccctcagcacagtggtatggaatccctctcca

SEQ ID NO: 61128 - DNA, 35 bp, Artificial Sequence
  Synthetic oligonucleotide
gtcagacaaggagcaaacagcgggggggggaggca

SEQ ID NO: 61129 - DNA, 35 bp, Artificial Sequence
  Synthetic oligonucleotide
ttagcgccatacaggcgtacccaccccccccggca

SEQ ID NO: 61130 - DNA, 36 bp, Artificial Sequence
  Synthetic oligonucleotide
accgacacatacgcacacactacgtccggtcaatca

SEQ ID NO: 61131 - DNA, 35 bp, Artificial Sequence
  Synthetic oligonucleotide
ccccacatctctccgtacacgacgtactcgactca

SEQ ID NO: 61132 - DNA, 36 bp, Artificial Sequence
  Synthetic oligonucleotide
gggggcgacccgcctcgatctatcatgcccagctca

SEQ ID NO: 61133 - DNA, 36 bp, Artificial Sequence
  Synthetic oligonucleotide
ggaggccggttccctactccgtgtgcacccctctca

SEQ ID NO: 61134 - DNA, 36 bp, Artificial Sequence
  Synthetic oligonucleotide
gtgttacacgccaaccatcaacagactgaacgttca

SEQ ID NO: 61135 - DNA, 37 bp, Artificial Sequence
  Synthetic oligonucleotide
gggagtggaggggtaggtagcatagtgcaagtataga

SEQ ID NO: 61136 - DNA, 37 bp, Artificial Sequence
  Synthetic oligonucleotide
acctggcgccattcacatccatacaccctgcgctaga

SEQ ID NO: 61137 - DNA, 37 bp, Artificial Sequence
  Synthetic oligonucleotide
ttccaccgcgcctcttgtacaagctcctgtaacacga

SEQ ID NO: 61138 - DNA, 36 bp, Artificial Sequence
  Synthetic oligonucleotide
tcccctccttcccgctatccaccgcgacgcttacga

SEQ ID NO: 61139 - DNA, 37 bp, Artificial Sequence
  Synthetic oligonucleotide
tcagccactgtcctgtcccacactcctcgcgcaccga

SEQ ID NO: 61140 - DNA, 36 bp, Artificial Sequence
  Synthetic oligonucleotide
attgtccgaccccctgagtactttatgttgctccga

SEQ ID NO: 61141 - DNA, 37 bp, Artificial Sequence
  Synthetic oligonucleotide
gggtcagggaggagggggaattggaggaatcctgcga

SEQ ID NO: 61142 - DNA, 37 bp, Artificial Sequence
  Synthetic oligonucleotide
aagcgtacgtaaaccgtttgagtcccatgcccctcga

SEQ ID NO: 61143 - DNA, 37 bp, Artificial Sequence
  Synthetic oligonucleotide
taaacaccgcgctaaaggtcttcttgctcactctcga

SEQ ID NO: 61144 - DNA, 37 bp, Artificial Sequence
  Synthetic oligonucleotide
gtggacgccgggtccatctgctctcctgttaacagga

SEQ ID NO: 61145 - DNA, 37 bp, Artificial Sequence
  Synthetic oligonucleotide
gcgcacaccgcgttcccccttgcttaccgtccccgga

SEQ ID NO: 61146 - DNA, 37 bp, Artificial Sequence
  Synthetic oligonucleotide
ataggggatctagggtagggagggacgggtatgcgga

SEQ ID NO: 61147 - DNA, 37 bp, Artificial Sequence
  Synthetic oligonucleotide
gaaagggtggaaacatgagcggggaactgaagtcgga

SEQ ID NO: 61148 - DNA, 36 bp, Artificial Sequence
  Synthetic oligonucleotide
actccatcatccacgggccgcgcaaccaccaaggga

SEQ ID NO: 61149 - DNA, 37 bp, Artificial Sequence
  Synthetic oligonucleotide
acccctgccgtcgtcccaaccgaccctgcccacggga

SEQ ID NO: 61150 - DNA, 37 bp, Artificial Sequence
  Synthetic oligonucleotide
gatggaagggtggcggttggaagaggagatgagggga

SEQ ID NO: 61151 - DNA, 37 bp, Artificial Sequence
  Synthetic oligonucleotide
aagatgacgggagttaaaagggaaaggacagggggga

SEQ ID NO: 61152 - DNA, 37 bp, Artificial Sequence
  Synthetic oligonucleotide
tccctcgctccccacttcaggcgaaaactcgcatgga

SEQ ID NO: 61153 - DNA, 38 bp, Artificial Sequence
  Synthetic oligonucleotide
accgcaaccagcccaggtcccaacgaaaacacctatga

SEQ ID NO: 61154 - DNA, 38 bp, Artificial Sequence
  Synthetic oligonucleotide
tcaacctcatgtacgtccagccattacccaacaactga

SEQ ID NO: 61155 - DNA, 36 bp, Artificial Sequence
  Synthetic oligonucleotide
gtagcaagaactgaatgagggagtgggaatgactga

SEQ ID NO: 61156 - DNA, 37 bp, Artificial Sequence
  Synthetic oligonucleotide
attccccgcgctccatctggtaaatgttcacacctga

SEQ ID NO: 61157 - DNA, 38 bp, Artificial Sequence
  Synthetic oligonucleotide
tgactagctacaccactttgcctagccagtccacctga

SEQ ID NO: 61158 - DNA, 36 bp, Artificial Sequence
  Synthetic oligonucleotide
gtcccgctgagacctctttccaccttcggtacctga

SEQ ID NO: 61159 - DNA, 38 bp, Artificial Sequence
  Synthetic oligonucleotide
tgcacaccccatctaaacgcatcccgctaggcccctga

SEQ ID NO: 61160 - DNA, 38 bp, Artificial Sequence
  Synthetic oligonucleotide
acgcgtggtacttccgcttggtattttgtttgccctga

SEQ ID NO: 61161 - DNA, 38 bp, Artificial Sequence
  Synthetic oligonucleotide
tgccatgctcctcacgcgtacccctcctcacctcctga

SEQ ID NO: 61162 - DNA, 38 bp, Artificial Sequence
  Synthetic oligonucleotide
tcccctgcgcacttgacacgtaccatcaatttatctga

SEQ ID NO: 61163 - DNA, 38 bp, Artificial Sequence
  Synthetic oligonucleotide
ggggaaggtggaaggatagtggcatacagcggtagtga

SEQ ID NO: 61164 - DNA, 38 bp, Artificial Sequence
  Synthetic oligonucleotide
aagtcactggtggaaagtggcggagggcgggtacgtga

SEQ ID NO: 61165 - DNA, 38 bp, Artificial Sequence
  Synthetic oligonucleotide
gttccaacgccgaccgaccctttgcacatgcctcgtga

SEQ ID NO: 61166 - DNA, 38 bp, Artificial Sequence
  Synthetic oligonucleotide
tcatcacgcctgcgaacacctactgcccgttctcgtga

SEQ ID NO: 61167 - DNA, 35 bp, Artificial Sequence
  Synthetic oligonucleotide
gaccagagactgggaattggggactgagggggtga

SEQ ID NO: 61168 - DNA, 38 bp, Artificial Sequence
  Synthetic oligonucleotide
gagtgtgtacgggagtgagtacgggatgggggtggtga

SEQ ID NO: 61169 - DNA, 38 bp, Artificial Sequence
  Synthetic oligonucleotide
gatcccatctgaccgagccctggacccaagccttgtga

SEQ ID NO: 61170 - DNA, 38 bp, Artificial Sequence
  Synthetic oligonucleotide
gtggccacgcctctttatattgtcccgttccgcattga

SEQ ID NO: 61171 - DNA, 38 bp, Artificial Sequence
  Synthetic oligonucleotide
ggtaacaccaaccctaacatgaagcgtgccatccttga

SEQ ID NO: 61172 - DNA, 38 bp, Artificial Sequence
  Synthetic oligonucleotide
aatcaccgccgctgcttcccagatcttccaccgcttga

SEQ ID NO: 61173 - DNA, 38 bp, Artificial Sequence
  Synthetic oligonucleotide
agaggagaacaggcggaggtcttaggagtggcagttga

SEQ ID NO: 61174 - DNA, 35 bp, Artificial Sequence
  Synthetic oligonucleotide
gtcgcagtgagcgacggggggatcgtgggagggta

SEQ ID NO: 61175 - DNA, 35 bp, Artificial Sequence
  Synthetic oligonucleotide
tgcagggcacccatctggcctctgggactactgta

SEQ ID NO: 61176 - DNA, 35 bp, Artificial Sequence
  Synthetic oligonucleotide
tacgcccactcatctggatggacctcgctactaac

SEQ ID NO: 61177 - DNA, 35 bp, Artificial Sequence
  Synthetic oligonucleotide
tctgtactgccggtcaccaaattgctcttctgtac

SEQ ID NO: 61178 - DNA, 35 bp, Artificial Sequence
  Synthetic oligonucleotide
atcgtgtgctgccaactcacccccccggatgaacc

SEQ ID NO: 61179 - DNA, 35 bp, Artificial Sequence
  Synthetic oligonucleotide
acagcacctctgcaaatcatgaccatgctaatacc

SEQ ID NO: 61180 - DNA, 35 bp, Artificial Sequence
  Synthetic oligonucleotide
attacgcaggctccctcttcttttcagcttgaccc

SEQ ID NO: 61181 - DNA, 35 bp, Artificial Sequence
  Synthetic oligonucleotide
gccaatcatctgcctcattctgcgcgacccccgcc

SEQ ID NO: 61182 - DNA, 36 bp, Artificial Sequence
  Synthetic oligonucleotide
tttcgaactcactgcggccatacaacccggatcgcc

SEQ ID NO: 61183 - DNA, 35 bp, Artificial Sequence
  Synthetic oligonucleotide
atgtcaatgcaccaaggctccccaccctgcaatcc

SEQ ID NO: 61184 - DNA, 35 bp, Artificial Sequence
  Synthetic oligonucleotide
caaggccatcctccatccctctatgcaggccatcc

SEQ ID NO: 61185 - DNA, 35 bp, Artificial Sequence
  Synthetic oligonucleotide
tgatgcccctagtgtcccgccatcccattccgtcc

SEQ ID NO: 61186 - DNA, 34 bp, Artificial Sequence
  Synthetic oligonucleotide
tgccgcactggactcatttgctaagttacctggc

SEQ ID NO: 61187 - DNA, 35 bp, Artificial Sequence
  Synthetic oligonucleotide
tatgcctttatgaacgcctctgacctccgccgtgc

SEQ ID NO: 61188 - DNA, 35 bp, Artificial Sequence
  Synthetic oligonucleotide
gccactttcccattcccttgctacagccacgactc

SEQ ID NO: 61189 - DNA, 36 bp, Artificial Sequence
  Synthetic oligonucleotide
accgaggggccctcacttagttgctcggaattactc

SEQ ID NO: 61190 - DNA, 35 bp, Artificial Sequence
  Synthetic oligonucleotide
agcacaatcgtcctttcgacctcattatcatcctc

SEQ ID NO: 61191 - DNA, 35 bp, Artificial Sequence
  Synthetic oligonucleotide
ataccccgccgggccacacaccgaagtccacgctc

SEQ ID NO: 61192 - DNA, 35 bp, Artificial Sequence
  Synthetic oligonucleotide
tccactaccttgtactatgtggttccgctactctc

SEQ ID NO: 61193 - DNA, 35 bp, Artificial Sequence
  Synthetic oligonucleotide
aacacggctcgatccacacccacggattctcgttc

SEQ ID NO: 61194 - DNA, 35 bp, Artificial Sequence
  Synthetic oligonucleotide
ggtccatcaacccatccatacctcgactggagacg

SEQ ID NO: 61195 - DNA, 35 bp, Artificial Sequence
  Synthetic oligonucleotide
gcacagcactcacccctatatttcaaccgactccg

SEQ ID NO: 61196 - DNA, 35 bp, Artificial Sequence
  Synthetic oligonucleotide
tggggggtgaagggaaaggggttatagcatttgtg

SEQ ID NO: 61197 - DNA, 35 bp, Artificial Sequence
  Synthetic oligonucleotide
gcaaggcggatagaggaactgggggagaagggttg

SEQ ID NO: 61198 - DNA, 35 bp, Artificial Sequence
  Synthetic oligonucleotide
tccaccggtcgaccgcgttcaacctcagccacaat

SEQ ID NO: 61199 - DNA, 35 bp, Artificial Sequence
  Synthetic oligonucleotide
acatgccaccgcctattgtagttctgtcctgacat

SEQ ID NO: 61200 - DNA, 35 bp, Artificial Sequence
  Synthetic oligonucleotide
ccatgacgcgtaccaatccctgctttctgtactat

SEQ ID NO: 61201 - DNA, 35 bp, Artificial Sequence
  Synthetic oligonucleotide
acatgagctaccccaatagcgacacctgtacaact

SEQ ID NO: 61202 - DNA, 35 bp, Artificial Sequence
  Synthetic oligonucleotide
aatcaacagagcaaggtcaaagaccgcagttcact

SEQ ID NO: 61203 - DNA, 35 bp, Artificial Sequence
  Synthetic oligonucleotide
aaggacaccacccgctgactttagatgctgtccct

SEQ ID NO: 61204 - DNA, 35 bp, Artificial Sequence
  Synthetic oligonucleotide
ttcactattcacagggccatgcggtggtccatcct

SEQ ID NO: 61205 - DNA, 35 bp, Artificial Sequence
  Synthetic oligonucleotide
acaccagtcttcgtatcgctcgattggcatctcct

SEQ ID NO: 61206 - DNA, 35 bp, Artificial Sequence
  Synthetic oligonucleotide
gatgtctcgcggtcatcgtgcctatcctccattct

SEQ ID NO: 61207 - DNA, 35 bp, Artificial Sequence
  Synthetic oligonucleotide
gagcggacggttgccgcgttttatcagttcccagt

SEQ ID NO: 61208 - DNA, 35 bp, Artificial Sequence
  Synthetic oligonucleotide
actcccgacctcggtgaattgtctgccttggcagt

SEQ ID NO: 61209 - DNA, 35 bp, Artificial Sequence
  Synthetic oligonucleotide
atggggagtggccgctgctggagagggtgtggatt

SEQ ID NO: 61210 - DNA, 35 bp, Artificial Sequence
  Synthetic oligonucleotide
tccggggtagccgccaacgtaagtcgcaccatttt

SEQ ID NO: 61211 - DNA, 35 bp, Artificial Sequence
  Synthetic oligonucleotide
tttggagccgctgcaacctcaccatttggaccaaa

SEQ ID NO: 61212 - DNA, 36 bp, Artificial Sequence
  Synthetic oligonucleotide
gacccgctccctgtccctcacccgcgtttagctgaa

SEQ ID NO: 61213 - DNA, 35 bp, Artificial Sequence
  Synthetic oligonucleotide
acttcctacttgacctgccccgttacgtgtagtaa

SEQ ID NO: 61214 - DNA, 36 bp, Artificial Sequence
  Synthetic oligonucleotide
taagcatcccgcgctaaaggttcccatgtccaacca

SEQ ID NO: 61215 - DNA, 35 bp, Artificial Sequence
  Synthetic oligonucleotide
tcgtacctacatatggcgtccatcacgcgctacca

SEQ ID NO: 61216 - DNA, 35 bp, Artificial Sequence
  Synthetic oligonucleotide
ttgtgctctacactgtcccaatatatgctcgccca

SEQ ID NO: 61217 - DNA, 36 bp, Artificial Sequence
  Synthetic oligonucleotide
atctgacccacccccctcgcgctggttttagggcca

SEQ ID NO: 61218 - DNA, 36 bp, Artificial Sequence
  Synthetic oligonucleotide
gtgacggtcagtcggcctaaaagtttccgcatgcca

SEQ ID NO: 61219 - DNA, 36 bp, Artificial Sequence
  Synthetic oligonucleotide
atgaaggtctggtgtctgtccgtccactcctctcca

SEQ ID NO: 61220 - DNA, 36 bp, Artificial Sequence
  Synthetic oligonucleotide
atgcatgttggggtctcgctctacgccgtccttcca

SEQ ID NO: 61221 - DNA, 35 bp, Artificial Sequence
  Synthetic oligonucleotide
gatcgcattgacgctagtacgccaccttcaacgca

SEQ ID NO: 61222 - DNA, 36 bp, Artificial Sequence
  Synthetic oligonucleotide
gaacaacgggacagtggggagtaggacgggtcggca

SEQ ID NO: 61223 - DNA, 35 bp, Artificial Sequence
  Synthetic oligonucleotide
gtcacccgcccccttaatgctgttttagctttgca

SEQ ID NO: 61224 - DNA, 35 bp, Artificial Sequence
  Synthetic oligonucleotide
acccgcaccccctcgcacccgccgcctttcactca

SEQ ID NO: 61225 - DNA, 36 bp, Artificial Sequence
  Synthetic oligonucleotide
gtgatcatccacacgggaatctagtacggtttttca

SEQ ID NO: 61226 - DNA, 36 bp, Artificial Sequence
  Synthetic oligonucleotide
tccgcagattggccgcgccactgccctctccctaga

SEQ ID NO: 61227 - DNA, 37 bp, Artificial Sequence
  Synthetic oligonucleotide
atctgaacaccgcctggaaccacccgctagggaacga

SEQ ID NO: 61228 - DNA, 37 bp, Artificial Sequence
  Synthetic oligonucleotide
aatcacgctagacccaccatgacaagtccggatacga

SEQ ID NO: 61229 - DNA, 36 bp, Artificial Sequence
  Synthetic oligonucleotide
tgcccctacgtccggccaatgccgaccaccctacga

SEQ ID NO: 61230 - DNA, 37 bp, Artificial Sequence
  Synthetic oligonucleotide
tgcgcaccccattcatcaagacgccgattccctccga

SEQ ID NO: 61231 - DNA, 35 bp, Artificial Sequence
  Synthetic oligonucleotide
acgaatcatagctccgactcgaccatccgctccga

SEQ ID NO: 61232 - DNA, 35 bp, Artificial Sequence
  Synthetic oligonucleotide
ttgaccaacaaaaagaagcgggaatagaggggcga

SEQ ID NO: 61233 - DNA, 37 bp, Artificial Sequence
  Synthetic oligonucleotide
agcaagacgcaaacaatctggggggaggacggggcga

SEQ ID NO: 61234 - DNA, 37 bp, Artificial Sequence
  Synthetic oligonucleotide
agatgtcgtagggggcacagggagtagagtttggcga

SEQ ID NO: 61235 - DNA, 37 bp, Artificial Sequence
  Synthetic oligonucleotide
acccctccataaaccatgtatatagtcaacacatcga

SEQ ID NO: 61236 - DNA, 37 bp, Artificial Sequence
  Synthetic oligonucleotide
ttccatcctcacattatattcagttcgacttgttcga

SEQ ID NO: 61237 - DNA, 37 bp, Artificial Sequence
  Synthetic oligonucleotide
aagacccgcccatttcttgatcccgccctagtacgga

SEQ ID NO: 61238 - DNA, 37 bp, Artificial Sequence
  Synthetic oligonucleotide
gcactttccgtcgtgctttcacctatctcattacgga

SEQ ID NO: 61239 - DNA, 37 bp, Artificial Sequence
  Synthetic oligonucleotide
gtgggggaggatgagggagcgtacgtgaagtaaggga

SEQ ID NO: 61240 - DNA, 37 bp, Artificial Sequence
  Synthetic oligonucleotide
taacgcaggtgagctggaagggtcggcaatgggggga

SEQ ID NO: 61241 - DNA, 37 bp, Artificial Sequence
  Synthetic oligonucleotide
gagatgtctagggtgcgttgagggcaaggggtgggga

SEQ ID NO: 61242 - DNA, 36 bp, Artificial Sequence
  Synthetic oligonucleotide
gggaacacctcttgccatgccgaccttacactggga

SEQ ID NO: 61243 - DNA, 38 bp, Artificial Sequence
  Synthetic oligonucleotide
acactatcgacggtacttgtacgcaccccttgccatga

SEQ ID NO: 61244 - DNA, 38 bp, Artificial Sequence
  Synthetic oligonucleotide
gtcgtagtccgctcattgatcatgcgaggccagcctga

SEQ ID NO: 61245 - DNA, 38 bp, Artificial Sequence
  Synthetic oligonucleotide
accgacccccaggagcttgaataggtcttttatcctga

SEQ ID NO: 61246 - DNA, 37 bp, Artificial Sequence
  Synthetic oligonucleotide
gtgcccactatgccattcttgcttccctgaacgctga

SEQ ID NO: 61247 - DNA, 38 bp, Artificial Sequence
  Synthetic oligonucleotide
gatgcagaccatttcggccgggcgctcttctttgctga

SEQ ID NO: 61248 - DNA, 38 bp, Artificial Sequence
  Synthetic oligonucleotide
agacatcatcgctgaacttggtcctccccttttgctga

SEQ ID NO: 61249 - DNA, 38 bp, Artificial Sequence
  Synthetic oligonucleotide
gcgcacgcacgacgccaattggtggacggcttaagtga

SEQ ID NO: 61250 - DNA, 37 bp, Artificial Sequence
  Synthetic oligonucleotide
agggaatgaagggggaggtagaaaatggcgacagtga

SEQ ID NO: 61251 - DNA, 38 bp, Artificial Sequence
  Synthetic oligonucleotide
ttgaaccgctccaccgaacctgccacagttattagtga

SEQ ID NO: 61252 - DNA, 37 bp, Artificial Sequence
  Synthetic oligonucleotide
tacctgcctcgggctagaatctccctgttacacgtga

SEQ ID NO: 61253 - DNA, 38 bp, Artificial Sequence
  Synthetic oligonucleotide
tgaggcgtgggggtttacggagtgtggggcgggggtga

SEQ ID NO: 61254 - DNA, 38 bp, Artificial Sequence
  Synthetic oligonucleotide
gtctgccctgcaaatctatcggttctgccttaaattga

SEQ ID NO: 61255 - DNA, 37 bp, Artificial Sequence
  Synthetic oligonucleotide
gctgcaccccgcctttaatttatcgccctgctattga

SEQ ID NO: 61256 - DNA, 38 bp, Artificial Sequence
  Synthetic oligonucleotide
acaacgggcaaccttctttccgcctcctgtggccttga

SEQ ID NO: 61257 - DNA, 37 bp, Artificial Sequence
  Synthetic oligonucleotide
gccgttccagcctgacgcatgatctccccacagttga

SEQ ID NO: 61258 - DNA, 38 bp, Artificial Sequence
  Synthetic oligonucleotide
atgatccaccatcagcgctgccttctacatcgtgttga

SEQ ID NO: 61259 - DNA, 38 bp, Artificial Sequence
  Synthetic oligonucleotide
gtcacacagggtgggggggctagacaggaacattttga

SEQ ID NO: 61260 - DNA, 37 bp, Artificial Sequence
  Synthetic oligonucleotide
gacctgtcgtcgtttagcaattcgttccatcttttga

SEQ ID NO: 61261 - DNA, 35 bp, Artificial Sequence
  Synthetic oligonucleotide
actgtcaccgcaaacattggtctcatttccttata

SEQ ID NO: 61262 - DNA, 36 bp, Artificial Sequence
  Synthetic oligonucleotide
ggtcaccgttacgacctttttagcgccttttttcta

SEQ ID NO: 61263 - DNA, 35 bp, Artificial Sequence
  Synthetic oligonucleotide
tatgccggtccaacgtataccccacgccatgctta

SEQ ID NO: 61264 - DNA, 35 bp, Artificial Sequence
  Synthetic oligonucleotide
taccgacaacgcgcagcgatgccatgacctctaac

SEQ ID NO: 61265 - DNA, 35 bp, Artificial Sequence
  Synthetic oligonucleotide
tagcccatcatagagcaccgcaacctttcgatcac

SEQ ID NO: 61266 - DNA, 35 bp, Artificial Sequence
  Synthetic oligonucleotide
gttagaccgccacacattttcccacatagctgtac

SEQ ID NO: 61267 - DNA, 35 bp, Artificial Sequence
  Synthetic oligonucleotide
gtggtggaggaagtgaagaatagaacccagacgcc

SEQ ID NO: 61268 - DNA, 35 bp, Artificial Sequence
  Synthetic oligonucleotide
aacaccggccaccgtagctttcgttttctagcgcc

SEQ ID NO: 61269 - DNA, 35 bp, Artificial Sequence
  Synthetic oligonucleotide
aatgcccaatcaagggcccctcgatgaaattctcc

SEQ ID NO: 61270 - DNA, 35 bp, Artificial Sequence
  Synthetic oligonucleotide
tacgccaatcttcgcatcacctctataaaaggtcc

SEQ ID NO: 61271 - DNA, 36 bp, Artificial Sequence
  Synthetic oligonucleotide
gcaagccatgtccatactcggtcacgataacttcgc

SEQ ID NO: 61272 - DNA, 35 bp, Artificial Sequence
  Synthetic oligonucleotide
tagtccggtaaatgccccatcttgcgcctcctggc

SEQ ID NO: 61273 - DNA, 35 bp, Artificial Sequence
  Synthetic oligonucleotide
gcactgttacatctttgctctttccacgcatactc

SEQ ID NO: 61274 - DNA, 35 bp, Artificial Sequence
  Synthetic oligonucleotide
acgccctgctctgctagagttcatattctcccttc

SEQ ID NO: 61275 - DNA, 35 bp, Artificial Sequence
  Synthetic oligonucleotide
gtgatggatggtagtaggggtatattggtttaaag

SEQ ID NO: 61276 - DNA, 35 bp, Artificial Sequence
  Synthetic oligonucleotide
ttccaataccatcccccacgagtggcctgaccgcg

SEQ ID NO: 61277 - DNA, 34 bp, Artificial Sequence
  Synthetic oligonucleotide
gctccgcgtgaagggagggaaggagcggttgagg

SEQ ID NO: 61278 - DNA, 35 bp, Artificial Sequence
  Synthetic oligonucleotide
gcacaaggccgtcgccgcataacccgactccctgg

SEQ ID NO: 61279 - DNA, 35 bp, Artificial Sequence
  Synthetic oligonucleotide
gataccatcctacggcctatacttcgtgcgccctg

SEQ ID NO: 61280 - DNA, 35 bp, Artificial Sequence
  Synthetic oligonucleotide
atcgaacggaaacaaagtctgaggaggggcaagtg

SEQ ID NO: 61281 - DNA, 35 bp, Artificial Sequence
  Synthetic oligonucleotide
acccgcgatactttcgatttccttgcccgcttttg

SEQ ID NO: 61282 - DNA, 35 bp, Artificial Sequence
  Synthetic oligonucleotide
gctgggggttaaggggtatggcgggatagcgtaat

SEQ ID NO: 61283 - DNA, 35 bp, Artificial Sequence
  Synthetic oligonucleotide
atcaaggcagggtggcctcgaccaaatttgcccat

SEQ ID NO: 61284 - DNA, 35 bp, Artificial Sequence
  Synthetic oligonucleotide
tcacgaggcctcactttccgcgtctcccggcctat

SEQ ID NO: 61285 - DNA, 35 bp, Artificial Sequence
  Synthetic oligonucleotide
gattggtgccagtggttacctggctattcactact

SEQ ID NO: 61286 - DNA, 35 bp, Artificial Sequence
  Synthetic oligonucleotide
acttccaccgggccgaaaactttgaaaactgacct

SEQ ID NO: 61287 - DNA, 35 bp, Artificial Sequence
  Synthetic oligonucleotide
gttccatcttcagcggatttaccatggatctacct

SEQ ID NO: 61288 - DNA, 35 bp, Artificial Sequence
  Synthetic oligonucleotide
ttcaacttcaacccctccgcgtgatctatttggct

SEQ ID NO: 61289 - DNA, 35 bp, Artificial Sequence
  Synthetic oligonucleotide
gatccaaacgccagggcatccagttcacccgcatt

SEQ ID NO: 61290 - DNA, 35 bp, Artificial Sequence
  Synthetic oligonucleotide
gagccatgccaccgatggtttagatttttgccctt

SEQ ID NO: 61291 - DNA, 35 bp, Artificial Sequence
  Synthetic oligonucleotide
gtcccactggctctgttctcatcgctcaaatgctt

SEQ ID NO: 61292 - DNA, 35 bp, Artificial Sequence
  Synthetic oligonucleotide
gcacaacggtgcccctttgataattgtacatgctt

SEQ ID NO: 61293 - DNA, 35 bp, Artificial Sequence
  Synthetic oligonucleotide
actccgactcacacgctccatcggagacgaatgtt

SEQ ID NO: 61294 - DNA, 36 bp, Artificial Sequence
  Synthetic oligonucleotide
tgatcaaccgccaagtttaatgcttacccttcgaaa

SEQ ID NO: 61295 - DNA, 36 bp, Artificial Sequence
  Synthetic oligonucleotide
gacgacggccttccacccatacgctactgtatccaa

SEQ ID NO: 61296 - DNA, 35 bp, Artificial Sequence
  Synthetic oligonucleotide
gagtgggggggcaacgtggaatggcatgcgggcaa

SEQ ID NO: 61297 - DNA, 37 bp, Artificial Sequence
  Synthetic oligonucleotide
gactgccccacgttgctccatcttttatgggacggaa

SEQ ID NO: 61298 - DNA, 36 bp, Artificial Sequence
  Synthetic oligonucleotide
gatccagttcgcccctcccgcctgttcacacgataa

SEQ ID NO: 61299 - DNA, 36 bp, Artificial Sequence
  Synthetic oligonucleotide
ttgacccgggttgtcaattctaaactgctccataca

SEQ ID NO: 61300 - DNA, 36 bp, Artificial Sequence
  Synthetic oligonucleotide
tgcactgatcgtttccatctgcatccagcaattaca

SEQ ID NO: 61301 - DNA, 35 bp, Artificial Sequence
  Synthetic oligonucleotide
taccattctatgcgtcttcgttccccgtaccacca

SEQ ID NO: 61302 - DNA, 35 bp, Artificial Sequence
  Synthetic oligonucleotide
gacatggcggcaatttcgcaacacattctctacca

SEQ ID NO: 61303 - DNA, 36 bp, Artificial Sequence
  Synthetic oligonucleotide
tatccacccggatgtccagcgatccttggctgccca

SEQ ID NO: 61304 - DNA, 36 bp, Artificial Sequence
  Synthetic oligonucleotide
gagtttggggactgaaggtagggctacggggaggca

SEQ ID NO: 61305 - DNA, 35 bp, Artificial Sequence
  Synthetic oligonucleotide
gtagggaggagaaataatggcatggcggaaatgca

SEQ ID NO: 61306 - DNA, 36 bp, Artificial Sequence
  Synthetic oligonucleotide
aagtgcggggaggaggcaggggcggttaacgtaaga

SEQ ID NO: 61307 - DNA, 37 bp, Artificial Sequence
  Synthetic oligonucleotide
atcgggcgggggggatcgggttgtctttgtgtgcaga

SEQ ID NO: 61308 - DNA, 37 bp, Artificial Sequence
  Synthetic oligonucleotide
atcgcggggaaggaacgtgcgcagagctgtagtcaga

SEQ ID NO: 61309 - DNA, 36 bp, Artificial Sequence
  Synthetic oligonucleotide
gtgttgtgtagttggggtgaaaattgttggtagaga

SEQ ID NO: 61310 - DNA, 37 bp, Artificial Sequence
  Synthetic oligonucleotide
gaaatgggtggggtgtagggcaataggcaattagaga

SEQ ID NO: 61311 - DNA, 37 bp, Artificial Sequence
  Synthetic oligonucleotide
gtgacggggggaagggggccgtactggttccccgaga

SEQ ID NO: 61312 - DNA, 37 bp, Artificial Sequence
  Synthetic oligonucleotide
ttgcctgcctcggtctgctcaatctacgcgatcacga

SEQ ID NO: 61313 - DNA, 37 bp, Artificial Sequence
  Synthetic oligonucleotide
tccctactgaccgtacctcatagacagcggatcacga

SEQ ID NO: 61314 - DNA, 36 bp, Artificial Sequence
  Synthetic oligonucleotide
gatagaacgagaggaaagtataggttaaaggtacga

SEQ ID NO: 61315 - DNA, 37 bp, Artificial Sequence
  Synthetic oligonucleotide
tgctgcgtaccaagcaccgatgcaccaccccccccga

SEQ ID NO: 61316 - DNA, 37 bp, Artificial Sequence
  Synthetic oligonucleotide
tagggccaacggtcgccgtgtgaaatcgcccccccga

SEQ ID NO: 61317 - DNA, 37 bp, Artificial Sequence
  Synthetic oligonucleotide
gcaactagtgcacgccacagcgccgttatcaccgcga

SEQ ID NO: 61318 - DNA, 37 bp, Artificial Sequence
  Synthetic oligonucleotide
aacagcaccgattttgcacaatactattcccctgcga

SEQ ID NO: 61319 - DNA, 37 bp, Artificial Sequence
  Synthetic oligonucleotide
tgaatacgcaggcttgacactctccctcctccctcga

SEQ ID NO: 61320 - DNA, 37 bp, Artificial Sequence
  Synthetic oligonucleotide
ggtgaatccatcacatagcctagccactccgtacgga

SEQ ID NO: 61321 - DNA, 37 bp, Artificial Sequence
  Synthetic oligonucleotide
tcgatcaaccctcccttgtacgcttccgttcatcgga

SEQ ID NO: 61322 - DNA, 36 bp, Artificial Sequence
  Synthetic oligonucleotide
acgacttgaggatacaaaatggaggtacatgaggga

SEQ ID NO: 61323 - DNA, 37 bp, Artificial Sequence
  Synthetic oligonucleotide
gaaccagcagtgagcttgatcggggtaacggcgggga

SEQ ID NO: 61324 - DNA, 36 bp, Artificial Sequence
  Synthetic oligonucleotide
gcgtgtatagcgcccccctaatcccacccgcctgga

SEQ ID NO: 61325 - DNA, 37 bp, Artificial Sequence
  Synthetic oligonucleotide
aaccgatgcagacaaagaggcgtaagaagggtgtgga

SEQ ID NO: 61326 - DNA, 37 bp, Artificial Sequence
  Synthetic oligonucleotide
tacaggtcgcacataaacctccatggcagtcattgga

SEQ ID NO: 61327 - DNA, 37 bp, Artificial Sequence
  Synthetic oligonucleotide
atcgttaggggaaaggcaggtaggggtcggctaatga

SEQ ID NO: 61328 - DNA, 38 bp, Artificial Sequence
  Synthetic oligonucleotide
gtgtcggtccgcgttaaagcactccctttcctacatga

SEQ ID NO: 61329 - DNA, 38 bp, Artificial Sequence
  Synthetic oligonucleotide
tgctgaactcatgtcctaatctctcgtccgcaccatga

SEQ ID NO: 61330 - DNA, 38 bp, Artificial Sequence
  Synthetic oligonucleotide
gtacacctccttcaacagatatgacgccgtaatactga

SEQ ID NO: 61331 - DNA, 38 bp, Artificial Sequence
  Synthetic oligonucleotide
tacgatccatcccccttgcgtagctagctttagcctga

SEQ ID NO: 61332 - DNA, 38 bp, Artificial Sequence
  Synthetic oligonucleotide
tacaccccacacgctccttctgcatcaggataagctga

SEQ ID NO: 61333 - DNA, 37 bp, Artificial Sequence
  Synthetic oligonucleotide
accattccgatccgtaatcattatatgttccaggtga

SEQ ID NO: 61334 - DNA, 38 bp, Artificial Sequence
  Synthetic oligonucleotide
gtagtggccaagtgattcatgagcgtggcgggtggtga

SEQ ID NO: 61335 - DNA, 38 bp, Artificial Sequence
  Synthetic oligonucleotide
tcccccgcgactggcaaccccacatccattcgttgtga

SEQ ID NO: 61336 - DNA, 38 bp, Artificial Sequence
  Synthetic oligonucleotide
acgccttcccgcacgccccagccacgagacctgattga

SEQ ID NO: 61337 - DNA, 37 bp, Artificial Sequence
  Synthetic oligonucleotide
tgactggggcagaagcggaaacgcagggggggtttga

SEQ ID NO: 61338 - DNA, 38 bp, Artificial Sequence
  Synthetic oligonucleotide
tccgactccactggtctgactacccccttccattttga

SEQ ID NO: 61339 - DNA, 36 bp, Artificial Sequence
  Synthetic oligonucleotide
tctcgcttgcacaaaccctgcttaatacggaaccta

SEQ ID NO: 61340 - DNA, 36 bp, Artificial Sequence
  Synthetic oligonucleotide
gtgtcgtctcgccgctctatggtctagccccgccta

SEQ ID NO: 61341 - DNA, 36 bp, Artificial Sequence
  Synthetic oligonucleotide
ggtgggaggtaggaaggtggggtacggacgagtcta

SEQ ID NO: 61342 - DNA, 36 bp, Artificial Sequence
  Synthetic oligonucleotide
gacggaacgttgaccgtctcttaatcccgccttcta

SEQ ID NO: 61343 - DNA, 35 bp, Artificial Sequence
  Synthetic oligonucleotide
acgccgcacattgatcttagtccgccgtgccttta

SEQ ID NO: 61344 - DNA, 36 bp, Artificial Sequence
  Synthetic oligonucleotide
tatcctttgcccccatgattactcagtcctggttta

SEQ ID NO: 61345 - DNA, 35 bp, Artificial Sequence
  Synthetic oligonucleotide
tgtccccgagtcccaactcacgagggttctcaaac

SEQ ID NO: 61346 - DNA, 35 bp, Artificial Sequence
  Synthetic oligonucleotide
cattgcccctagttccggtacccgaccaggctcac

SEQ ID NO: 61347 - DNA, 35 bp, Artificial Sequence
  Synthetic oligonucleotide
tccccttcctgctctgaggcacaccgaccatagac

SEQ ID NO: 61348 - DNA, 35 bp, Artificial Sequence
  Synthetic oligonucleotide
acatcatgctgctgcgggttcagtcaaccgtcgac

SEQ ID NO: 61349 - DNA, 36 bp, Artificial Sequence
  Synthetic oligonucleotide
tctcccggagctcccatcttgtctgtcggcacgacc

SEQ ID NO: 61350 - DNA, 35 bp, Artificial Sequence
  Synthetic oligonucleotide
taaaccatccctagaccagggcgttaggtcgtccc

SEQ ID NO: 61351 - DNA, 35 bp, Artificial Sequence
  Synthetic oligonucleotide
acatgttgcgcgtaggccttttgctttaaacccgc

SEQ ID NO: 61352 - DNA, 35 bp, Artificial Sequence
  Synthetic oligonucleotide
ggaccccctgaatttcaaattgattgctgcatggc

SEQ ID NO: 61353 - DNA, 35 bp, Artificial Sequence
  Synthetic oligonucleotide
actaccgtgccataacctcacgatctgattccgtc

SEQ ID NO: 61354 - DNA, 35 bp, Artificial Sequence
  Synthetic oligonucleotide
taccagaagaattggctcgagccgcccccccgttc

SEQ ID NO: 61355 - DNA, 35 bp, Artificial Sequence
  Synthetic oligonucleotide
cacaacgtttgcgccgtccctcccttctgatcacg

SEQ ID NO: 61356 - DNA, 35 bp, Artificial Sequence
  Synthetic oligonucleotide
acaaagtgggtggggggggaagggtagtagatagg

SEQ ID NO: 61357 - DNA, 35 bp, Artificial Sequence
  Synthetic oligonucleotide
gataccacccatcgcacgcagctgcattaacacgg

SEQ ID NO: 61358 - DNA, 35 bp, Artificial Sequence
  Synthetic oligonucleotide
gacaggaggtgcgtactatagttaacgcaataggg

SEQ ID NO: 61359 - DNA, 35 bp, Artificial Sequence
  Synthetic oligonucleotide
gtgcgacggaggagcataggactgaggtgcacggg

SEQ ID NO: 61360 - DNA, 35 bp, Artificial Sequence
  Synthetic oligonucleotide
agtgagggggacgggtcggagtgagcgtattgggg

SEQ ID NO: 61361 - DNA, 35 bp, Artificial Sequence
  Synthetic oligonucleotide
gttaggggaggggtgttcggttagttcggaaatgg

SEQ ID NO: 61362 - DNA, 35 bp, Artificial Sequence
  Synthetic oligonucleotide
tccgccccgtaatattcctcatgatgtctcctctg

SEQ ID NO: 61363 - DNA, 35 bp, Artificial Sequence
  Synthetic oligonucleotide
ctcgacaccttgcccggttttgccacccacttctg

SEQ ID NO: 61364 - DNA, 35 bp, Artificial Sequence
  Synthetic oligonucleotide
acactgagccggcggtctcgtactagctctccaat

SEQ ID NO: 61365 - DNA, 35 bp, Artificial Sequence
  Synthetic oligonucleotide
ttaggatgcgcaacatgtcctatctgtgtcccgat

SEQ ID NO: 61366 - DNA, 35 bp, Artificial Sequence
  Synthetic oligonucleotide
ttggaaccctcttgcctgattcgtcccattatgat

SEQ ID NO: 61367 - DNA, 35 bp, Artificial Sequence
  Synthetic oligonucleotide
actgggcccgtgcgcgcacaaataattctcgccct

SEQ ID NO: 61368 - DNA, 35 bp, Artificial Sequence
  Synthetic oligonucleotide
tcattgttagctccggacgctatatccgctcctct

SEQ ID NO: 61369 - DNA, 35 bp, Artificial Sequence
  Synthetic oligonucleotide
tagatgtgctccattgttgttcccgggtaaattgt

SEQ ID NO: 61370 - DNA, 35 bp, Artificial Sequence
  Synthetic oligonucleotide
ttacacgctcaccccaggttaacctatatcacgtt

SEQ ID NO: 61371 - DNA, 35 bp, Artificial Sequence
  Synthetic oligonucleotide
agggataccgtacgcgcctacttgcccctcacgtt

SEQ ID NO: 61372 - DNA, 35 bp, Artificial Sequence
  Synthetic oligonucleotide
taggacagatgcatgtgtttcgtgcctaccccttt

SEQ ID NO: 61373 - DNA, 35 bp, Artificial Sequence
  Synthetic oligonucleotide
atccaccccagccaatctgcccctgccaccatttt

SEQ ID NO: 61374 - DNA, 36 bp, Artificial Sequence
  Synthetic oligonucleotide
atcaccacatttagtaacagcaccgcttgacccaaa

SEQ ID NO: 61375 - DNA, 36 bp, Artificial Sequence
  Synthetic oligonucleotide
tggacggtccactccgcctataaatgtccctgtaaa

SEQ ID NO: 61376 - DNA, 36 bp, Artificial Sequence
  Synthetic oligonucleotide
taggggacagcttaaagctcaatagggggcggataa

SEQ ID NO: 61377 - DNA, 36 bp, Artificial Sequence
  Synthetic oligonucleotide
tgacgactcattcgtcatttctttcctatccgaaca

SEQ ID NO: 61378 - DNA, 36 bp, Artificial Sequence
  Synthetic oligonucleotide
gcccattgccctgtgctgcctgttgccggaccgaca

SEQ ID NO: 61379 - DNA, 36 bp, Artificial Sequence
  Synthetic oligonucleotide
aactgctcaaccttctgctcgcttatagggacacca

SEQ ID NO: 61380 - DNA, 36 bp, Artificial Sequence
  Synthetic oligonucleotide
gtccgaggaacatcgccccatccccatagaggtcca

SEQ ID NO: 61381 - DNA, 36 bp, Artificial Sequence
  Synthetic oligonucleotide
tgctagccctcgtttcttttggtttgtcacgttcca

SEQ ID NO: 61382 - DNA, 36 bp, Artificial Sequence
  Synthetic oligonucleotide
acgactgccatacactcctctgatacctcacctgca

SEQ ID NO: 61383 - DNA, 36 bp, Artificial Sequence
  Synthetic oligonucleotide
gtgaagggaagaagtgggtgatcgaggaacagtgca

SEQ ID NO: 61384 - DNA, 35 bp, Artificial Sequence
  Synthetic oligonucleotide
gatacctcaagatcgtcgccatcctatctcactca

SEQ ID NO: 61385 - DNA, 36 bp, Artificial Sequence
  Synthetic oligonucleotide
gcatgacctccgtgaagtacggagtggtaactctca

SEQ ID NO: 61386 - DNA, 35 bp, Artificial Sequence
  Synthetic oligonucleotide
tcgcaccgttgttctcccccactgttcgcttctca

SEQ ID NO: 61387 - DNA, 36 bp, Artificial Sequence
  Synthetic oligonucleotide
acgacccaggcccaggacaatagggtggcctcttca

SEQ ID NO: 61388 - DNA, 36 bp, Artificial Sequence
  Synthetic oligonucleotide
gcgctgttcccgtccaccccctcttgttttggaaga

SEQ ID NO: 61389 - DNA, 36 bp, Artificial Sequence
  Synthetic oligonucleotide
tactgaccggctttgctgtttccgtaccatctgaga

SEQ ID NO: 61390 - DNA, 37 bp, Artificial Sequence
  Synthetic oligonucleotide
gagaagaggaataggggggagtgctggggttggacga

SEQ ID NO: 61391 - DNA, 36 bp, Artificial Sequence
  Synthetic oligonucleotide
acacggtccgcccacaatctattcaagcatatccga

SEQ ID NO: 61392 - DNA, 37 bp, Artificial Sequence
  Synthetic oligonucleotide
acgcctcgcaccttccgttccgattctcttgctccga

SEQ ID NO: 61393 - DNA, 37 bp, Artificial Sequence
  Synthetic oligonucleotide
gtcgatccccctcgctcgtgtacataacctcacgcga

SEQ ID NO: 61394 - DNA, 37 bp, Artificial Sequence
  Synthetic oligonucleotide
ggatgacgaggcacagggaatagggaacgaaatagga

SEQ ID NO: 61395 - DNA, 36 bp, Artificial Sequence
  Synthetic oligonucleotide
gacgagtcacgaagtgaggtggggtaagtaacggga

SEQ ID NO: 61396 - DNA, 37 bp, Artificial Sequence
  Synthetic oligonucleotide
atggccatccatacgttcctgaccgattcagccggga

SEQ ID NO: 61397 - DNA, 37 bp, Artificial Sequence
  Synthetic oligonucleotide
agaggggggaaggtctggattgattaggtggtgggga

SEQ ID NO: 61398 - DNA, 37 bp, Artificial Sequence
  Synthetic oligonucleotide
gtcgagggtcagctagacggcgtggggaaaaggtgga

SEQ ID NO: 61399 - DNA, 37 bp, Artificial Sequence
  Synthetic oligonucleotide
acgcattcccacgttgggcgattcctgtaccttatga

SEQ ID NO: 61400 - DNA, 37 bp, Artificial Sequence
  Synthetic oligonucleotide
gagggcccatatgcccttattgactccactgtcctga

SEQ ID NO: 61401 - DNA, 37 bp, Artificial Sequence
  Synthetic oligonucleotide
gagcacgatcggctcccaattgacttaatgtcgctga

SEQ ID NO: 61402 - DNA, 38 bp, Artificial Sequence
  Synthetic oligonucleotide
agtggtgcaggcccatcctcgtctaggaaactccgtga

SEQ ID NO: 61403 - DNA, 38 bp, Artificial Sequence
  Synthetic oligonucleotide
acagacacggactttagggaaggaacggggaagcgtga

SEQ ID NO: 61404 - DNA, 38 bp, Artificial Sequence
  Synthetic oligonucleotide
tgcatctctccacgcgggtaccgtttcgcatttcgtga

SEQ ID NO: 61405 - DNA, 38 bp, Artificial Sequence
  Synthetic oligonucleotide
gagagggcacaatcgacgttgccaggtttctttcgtga

SEQ ID NO: 61406 - DNA, 37 bp, Artificial Sequence
  Synthetic oligonucleotide
tcgaccgactaccttgcttccgcctgtccggatgtga

SEQ ID NO: 61407 - DNA, 38 bp, Artificial Sequence
  Synthetic oligonucleotide
agcgcacagaggggtggtgcgcgtacgtatcggtgtga

SEQ ID NO: 61408 - DNA, 38 bp, Artificial Sequence
  Synthetic oligonucleotide
tacctccgccagggctaacattgcccgcacctttgtga

SEQ ID NO: 61409 - DNA, 38 bp, Artificial Sequence
  Synthetic oligonucleotide
tcactcgctgttgacccgggtttttcaagtttacttga

SEQ ID NO: 61410 - DNA, 38 bp, Artificial Sequence
  Synthetic oligonucleotide
tatcactcagtcagccgctacttcagcgcccaccttga

SEQ ID NO: 61411 - DNA, 36 bp, Artificial Sequence
  Synthetic oligonucleotide
gtgtagccaccatcccgcctttgtcgttattcttga

SEQ ID NO: 61412 - DNA, 38 bp, Artificial Sequence
  Synthetic oligonucleotide
atactcatacgcgcacccgggcccatccattctgttga

SEQ ID NO: 61413 - DNA, 37 bp, Artificial Sequence
  Synthetic oligonucleotide
tccatcctgaccctcgtgccagaattctgctctttga

SEQ ID NO: 61414 - DNA, 36 bp, Artificial Sequence
  Synthetic oligonucleotide
tcccctgtgcccgacgaaggagagttcctattttga

SEQ ID NO: 61415 - DNA, 38 bp, Artificial Sequence
  Synthetic oligonucleotide
gctgagcagggaaactggaggggtgggtgggcttttga

SEQ ID NO: 61416 - DNA, 36 bp, Artificial Sequence
  Synthetic oligonucleotide
acgcgccctcccgactccaccagccaaggctgaata

SEQ ID NO: 61417 - DNA, 36 bp, Artificial Sequence
  Synthetic oligonucleotide
gatagaggggggtaggtggtggatttacaatggata

SEQ ID NO: 61418 - DNA, 36 bp, Artificial Sequence
  Synthetic oligonucleotide
actatgcaggggcacatatctgccgtccccgttgta

SEQ ID NO: 61419 - DNA, 35 bp, Artificial Sequence
  Synthetic oligonucleotide
gagcataccccgcccgcggccactgtaatccttac

SEQ ID NO: 61420 - DNA, 35 bp, Artificial Sequence
  Synthetic oligonucleotide
acccccatctcacatgggcattaaccccgctttac

SEQ ID NO: 61421 - DNA, 35 bp, Artificial Sequence
  Synthetic oligonucleotide
gagcatctctactcacagtgccgactgcccccacc

SEQ ID NO: 61422 - DNA, 35 bp, Artificial Sequence
  Synthetic oligonucleotide
gcacccctctccggtgctattaatccttcttaccc

SEQ ID NO: 61423 - DNA, 35 bp, Artificial Sequence
  Synthetic oligonucleotide
gtctaggtccaaccccccgtcgcagacgtgccccc

SEQ ID NO: 61424 - DNA, 35 bp, Artificial Sequence
  Synthetic oligonucleotide
acaacggctagtagtggcctgcctttgtcttcccc

SEQ ID NO: 61425 - DNA, 35 bp, Artificial Sequence
  Synthetic oligonucleotide
tgtcggtcctagtaccgcctattaccaccatgtcc

SEQ ID NO: 61426 - DNA, 35 bp, Artificial Sequence
  Synthetic oligonucleotide
accgaaacacttgctaggttcatagcctcttgtcc

SEQ ID NO: 61427 - DNA, 35 bp, Artificial Sequence
  Synthetic oligonucleotide
aatcctccgtccagaatacgacgctatttcctcgc

SEQ ID NO: 61428 - DNA, 35 bp, Artificial Sequence
  Synthetic oligonucleotide
acgctggtgcatctcattttccacagcctccctgc

SEQ ID NO: 61429 - DNA, 35 bp, Artificial Sequence
  Synthetic oligonucleotide
gccactttcccatgcccttgctacatccacgactc

SEQ ID NO: 61430 - DNA, 35 bp, Artificial Sequence
  Synthetic oligonucleotide
gtacggatgacgtactccattcgaagtgcaacctc

SEQ ID NO: 61431 - DNA, 35 bp, Artificial Sequence
  Synthetic oligonucleotide
gactccctcaggcgttaatcctgcggcccacgctc

SEQ ID NO: 61432 - DNA, 35 bp, Artificial Sequence
  Synthetic oligonucleotide
cacctacggcccaagctgacctgcctgaacatctc

SEQ ID NO: 61433 - DNA, 35 bp, Artificial Sequence
  Synthetic oligonucleotide
gagagaaccgcctagtcgtggcaacactcgctctc

SEQ ID NO: 61434 - DNA, 35 bp, Artificial Sequence
  Synthetic oligonucleotide
gtcggtgcgcattcgtccccttttcactcagtttc

SEQ ID NO: 61435 - DNA, 35 bp, Artificial Sequence
  Synthetic oligonucleotide
tgatgcctccacccgttgtaggacgcatgagaccg

SEQ ID NO: 61436 - DNA, 35 bp, Artificial Sequence
  Synthetic oligonucleotide
tccacctcttaatcacgcgtttgcaaggtttctcg

SEQ ID NO: 61437 - DNA, 35 bp, Artificial Sequence
  Synthetic oligonucleotide
tgtctacaccattgcactattcgacacagagttcg

SEQ ID NO: 61438 - DNA, 35 bp, Artificial Sequence
  Synthetic oligonucleotide
tcgtcccactcaaaatctctctctgtcctgtttcg

SEQ ID NO: 61439 - DNA, 35 bp, Artificial Sequence
  Synthetic oligonucleotide
tgatcgccccgggtggcaagtggaatgggtgaagg

SEQ ID NO: 61440 - DNA, 35 bp, Artificial Sequence
  Synthetic oligonucleotide
acgcacacaacgtaactgtcactcgtcatcttcgg

SEQ ID NO: 61441 - DNA, 35 bp, Artificial Sequence
  Synthetic oligonucleotide
gatctgcctcccagtttagctctggaacccttatg

SEQ ID NO: 61442 - DNA, 35 bp, Artificial Sequence
  Synthetic oligonucleotide
ttacgcgacgaataacccccttttagcctttcttg

SEQ ID NO: 61443 - DNA, 35 bp, Artificial Sequence
  Synthetic oligonucleotide
ggacctgttgtccgagcctttctatcgctacacat

SEQ ID NO: 61444 - DNA, 35 bp, Artificial Sequence
  Synthetic oligonucleotide
agcactctccatcggtacctcatggcccgctcact

SEQ ID NO: 61445 - DNA, 35 bp, Artificial Sequence
  Synthetic oligonucleotide
agctccgcaacgtcacacactgtttccattcacct

SEQ ID NO: 61446 - DNA, 35 bp, Artificial Sequence
  Synthetic oligonucleotide
gacgcgccctgcaccatgcgaacatgcgcaaccct

SEQ ID NO: 61447 - DNA, 35 bp, Artificial Sequence
  Synthetic oligonucleotide
atgtcctggcccaaacgccacgactttcatcatct

SEQ ID NO: 61448 - DNA, 35 bp, Artificial Sequence
  Synthetic oligonucleotide
cctctacgcccttgtccaacgagtccctgctatct

SEQ ID NO: 61449 - DNA, 35 bp, Artificial Sequence
  Synthetic oligonucleotide
tctacactccggcttcgacgaggagcaaattctct

SEQ ID NO: 61450 - DNA, 35 bp, Artificial Sequence
  Synthetic oligonucleotide
tcaatgaagggttgcaataataggtgggataacgt

SEQ ID NO: 61451 - DNA, 34 bp, Artificial Sequence
  Synthetic oligonucleotide
atgtccccctgttgcccggatcagtacccgcggt

SEQ ID NO: 61452 - DNA, 35 bp, Artificial Sequence
  Synthetic oligonucleotide
gctcatccggcctcatcgtgattctgtcgacctgt

SEQ ID NO: 61453 - DNA, 35 bp, Artificial Sequence
  Synthetic oligonucleotide
gttcccacccactcccctgccgggatgccccgtgt

SEQ ID NO: 61454 - DNA, 35 bp, Artificial Sequence
  Synthetic oligonucleotide
gctaacgtgcagtgggtggggtgcagacgtggttt

SEQ ID NO: 61455 - DNA, 35 bp, Artificial Sequence
  Synthetic oligonucleotide
gatcatcccctggttttgtttcattagcctgtttt

SEQ ID NO: 61456 - DNA, 36 bp, Artificial Sequence
  Synthetic oligonucleotide
tatccgctcccttacgcccgtttggttctctcggaa

SEQ ID NO: 61457 - DNA, 36 bp, Artificial Sequence
  Synthetic oligonucleotide
ttgccggtttctgacccgtaatgtcctggctccaca

SEQ ID NO: 61458 - DNA, 36 bp, Artificial Sequence
  Synthetic oligonucleotide
gcccaagtcctgtctataggccggcgttgctctaca

SEQ ID NO: 61459 - DNA, 36 bp, Artificial Sequence
  Synthetic oligonucleotide
gtcgatccacttaccccccgatgcttaaaacgtaca

SEQ ID NO: 61460 - DNA, 35 bp, Artificial Sequence
  Synthetic oligonucleotide
tctactcctctcatgtaaacttggggtgttcccca

SEQ ID NO: 61461 - DNA, 36 bp, Artificial Sequence
  Synthetic oligonucleotide
cgcaacgaagacgcaatctttgtgattgcaggccca

SEQ ID NO: 61462 - DNA, 36 bp, Artificial Sequence
  Synthetic oligonucleotide
gctctactccgactgttactttgattcaataatcca

SEQ ID NO: 61463 - DNA, 36 bp, Artificial Sequence
  Synthetic oligonucleotide
agcaaccacatggaaaattatccgtaacgccctgca

SEQ ID NO: 61464 - DNA, 35 bp, Artificial Sequence
  Synthetic oligonucleotide
tgcaatgctacgtacgctcataatcctgtatctca

SEQ ID NO: 61465 - DNA, 35 bp, Artificial Sequence
  Synthetic oligonucleotide
aagtcgaagcggttgtttcatctggctttatctca

SEQ ID NO: 61466 - DNA, 36 bp, Artificial Sequence
  Synthetic oligonucleotide
ggaatgccctgtgtacacgcttgcctgtttccttca

SEQ ID NO: 61467 - DNA, 37 bp, Artificial Sequence
  Synthetic oligonucleotide
aaggtgataacggggtggtggaaaaaagtaattaaga

SEQ ID NO: 61468 - DNA, 37 bp, Artificial Sequence
  Synthetic oligonucleotide
gcacgccatactaccacaaacacacgctgttgacaga

SEQ ID NO: 61469 - DNA, 37 bp, Artificial Sequence
  Synthetic oligonucleotide
tccgcctgccatgccctcttcagtctccccttgacga

SEQ ID NO: 61470 - DNA, 35 bp, Artificial Sequence
  Synthetic oligonucleotide
ttgaatgtccagcgtgcactctcctagctcaccga

SEQ ID NO: 61471 - DNA, 37 bp, Artificial Sequence
  Synthetic oligonucleotide
gattgccccttcccggtgatagttcgccttcttccga

SEQ ID NO: 61472 - DNA, 37 bp, Artificial Sequence
  Synthetic oligonucleotide
atcgcccaggaccgttccaaccactttagcttcgcga

SEQ ID NO: 61473 - DNA, 37 bp, Artificial Sequence
  Synthetic oligonucleotide
gaccctgccattcagttccccactcaacaccactcga

SEQ ID NO: 61474 - DNA, 35 bp, Artificial Sequence
  Synthetic oligonucleotide
gttagtggggggaaattgtggaatatgacggagga

SEQ ID NO: 61475 - DNA, 37 bp, Artificial Sequence
  Synthetic oligonucleotide
aatggtcagcaagcgaaataacgtggggaatggggga

SEQ ID NO: 61476 - DNA, 37 bp, Artificial Sequence
  Synthetic oligonucleotide
taaccgcctcgatcttgtctgattcacttcccgtgga

SEQ ID NO: 61477 - DNA, 36 bp, Artificial Sequence
  Synthetic oligonucleotide
ggtgggaaagagggcgggggggacgcacttcgtgga

SEQ ID NO: 61478 - DNA, 38 bp, Artificial Sequence
  Synthetic oligonucleotide
gatccccccgaccccttgcacgaccagtttccccatga

SEQ ID NO: 61479 - DNA, 37 bp, Artificial Sequence
  Synthetic oligonucleotide
agagggtgggagggcttaacatggttagtacgtatga

SEQ ID NO: 61480 - DNA, 37 bp, Artificial Sequence
  Synthetic oligonucleotide
gtgcacctggttacgcccctacttgaccctctactga

SEQ ID NO: 61481 - DNA, 38 bp, Artificial Sequence
  Synthetic oligonucleotide
tcacgggccaagatctacccatcgaccgtatctcctga

SEQ ID NO: 61482 - DNA, 35 bp, Artificial Sequence
  Synthetic oligonucleotide
gttggaagaaggagttatggggctggttttgctga

SEQ ID NO: 61483 - DNA, 37 bp, Artificial Sequence
  Synthetic oligonucleotide
actcgtatatccgcacacccctccgcctacggtctga

SEQ ID NO: 61484 - DNA, 38 bp, Artificial Sequence
  Synthetic oligonucleotide
acgcgtgtcctaccttttgctgcccttgttccttctga

SEQ ID NO: 61485 - DNA, 37 bp, Artificial Sequence
  Synthetic oligonucleotide
gtgtcgcccaaggtaatcaccagttccacccgcttga

SEQ ID NO: 61486 - DNA, 37 bp, Artificial Sequence
  Synthetic oligonucleotide
tccacgcgctgcagaacccccagcttaacactcttga

SEQ ID NO: 61487 - DNA, 38 bp, Artificial Sequence
  Synthetic oligonucleotide
tgcattgcgcacgctttccatctctcgggcccagttga

SEQ ID NO: 61488 - DNA, 38 bp, Artificial Sequence
  Synthetic oligonucleotide
tcgcgggcaggaacgggtggagcttctagggcggttga

SEQ ID NO: 61489 - DNA, 37 bp, Artificial Sequence
  Synthetic oligonucleotide
tatcctaccacctgagggtcatcgtgccccaatttga

SEQ ID NO: 61490 - DNA, 36 bp, Artificial Sequence
  Synthetic oligonucleotide
acgttacactgcctcccctatgcatccgaagggcta

SEQ ID NO: 61491 - DNA, 36 bp, Artificial Sequence
  Synthetic oligonucleotide
gcataccccccgggagcatcttgacggtccttgcta

SEQ ID NO: 61492 - DNA, 36 bp, Artificial Sequence
  Synthetic oligonucleotide
ggactcggtggaaggtcatgggccgggtgtgcagta

SEQ ID NO: 61493 - DNA, 36 bp, Artificial Sequence
  Synthetic oligonucleotide
ttaggaagggcggagtggggaggtgaggcgaaatta

SEQ ID NO: 61494 - DNA, 35 bp, Artificial Sequence
  Synthetic oligonucleotide
gcacgtagtcttagaatcatcggacctacctctta

SEQ ID NO: 61495 - DNA, 36 bp, Artificial Sequence
  Synthetic oligonucleotide
tgaaatatgcggaagggagtggggaggtcttggtta

SEQ ID NO: 61496 - DNA, 36 bp, Artificial Sequence
  Synthetic oligonucleotide
gctcccgtgctcttcgtatctgttgtccgtctttta

SEQ ID NO: 61497 - DNA, 35 bp, Artificial Sequence
  Synthetic oligonucleotide
atcctatgtatgcgcccagtggtcttacttcccac

SEQ ID NO: 61498 - DNA, 35 bp, Artificial Sequence
  Synthetic oligonucleotide
gctggccggaatcagcattataaccctcctgccac

SEQ ID NO: 61499 - DNA, 35 bp, Artificial Sequence
  Synthetic oligonucleotide
gtgcaagctgactttagcaccacacccttggtcac

SEQ ID NO: 61500 - DNA, 35 bp, Artificial Sequence
  Synthetic oligonucleotide
aattgccctttcatccacgcgcccttaggtattac

SEQ ID NO: 61501 - DNA, 35 bp, Artificial Sequence
  Synthetic oligonucleotide
aactgtgcctgacgctggtgctagccacttttacc

SEQ ID NO: 61502 - DNA, 35 bp, Artificial Sequence
  Synthetic oligonucleotide
tacgaacgtgctgcttttgaatccgtaaacgcccc

SEQ ID NO: 61503 - DNA, 35 bp, Artificial Sequence
  Synthetic oligonucleotide
tgtcaatccagtgttcatgaacactgccctgcccc

SEQ ID NO: 61504 - DNA, 35 bp, Artificial Sequence
  Synthetic oligonucleotide
tcagcccaacgggatgcttcgaacgtggtctcccc

SEQ ID NO: 61505 - DNA, 35 bp, Artificial Sequence
  Synthetic oligonucleotide
tgtgctagccaactccgaatcacatgccgaccgcc

SEQ ID NO: 61506 - DNA, 35 bp, Artificial Sequence
  Synthetic oligonucleotide
tccgcatccccgtctctacagtttgacgacttggc

SEQ ID NO: 61507 - DNA, 35 bp, Artificial Sequence
  Synthetic oligonucleotide
atgccatgtcctgctgtcactcctggctttagatc

SEQ ID NO: 61508 - DNA, 35 bp, Artificial Sequence
  Synthetic oligonucleotide
tcgtgctcctagaatttattttcctgtagttcctc

SEQ ID NO: 61509 - DNA, 35 bp, Artificial Sequence
  Synthetic oligonucleotide
atcacgtccatgtctagtagcttgcactaccgctc

SEQ ID NO: 61510 - DNA, 35 bp, Artificial Sequence
  Synthetic oligonucleotide
tctctggcgacaccaccggtccagaatcctagttc

SEQ ID NO: 61511 - DNA, 35 bp, Artificial Sequence
  Synthetic oligonucleotide
acttgcctcaggtccacttacctctgtcatgtttc

SEQ ID NO: 61512 - DNA, 35 bp, Artificial Sequence
  Synthetic oligonucleotide
tacacgccagccacttatttcctgttcccatgcag

SEQ ID NO: 61513 - DNA, 35 bp, Artificial Sequence
  Synthetic oligonucleotide
gttcaagtggatggcccgggcaaatcgaggaggag

SEQ ID NO: 61514 - DNA, 35 bp, Artificial Sequence
  Synthetic oligonucleotide
gacatgtatgtcccatgccccaaacgttaatcccg

SEQ ID NO: 61515 - DNA, 35 bp, Artificial Sequence
  Synthetic oligonucleotide
gcaagtgccccaggcaatgtccattctacagttcg

SEQ ID NO: 61516 - DNA, 35 bp, Artificial Sequence
  Synthetic oligonucleotide
agaccgcctcgatcccgcggcctacaactgacctg

SEQ ID NO: 61517 - DNA, 35 bp, Artificial Sequence
  Synthetic oligonucleotide
gacttcacctgcccggactctgaaaaagaacattg

SEQ ID NO: 61518 - DNA, 35 bp, Artificial Sequence
  Synthetic oligonucleotide
agtacccaccaccctattgattgactaccgatttg

SEQ ID NO: 61519 - DNA, 35 bp, Artificial Sequence
  Synthetic oligonucleotide
ttgcccgggccaggaagtctgccactctctctttg

SEQ ID NO: 61520 - DNA, 35 bp, Artificial Sequence
  Synthetic oligonucleotide
gtgagctcagtagctaacccgtacccgccattttg

SEQ ID NO: 61521 - DNA, 35 bp, Artificial Sequence
  Synthetic oligonucleotide
gtagcacgtacttccgaggatccctcccctttttg

SEQ ID NO: 61522 - DNA, 35 bp, Artificial Sequence
  Synthetic oligonucleotide
gccaaccctcggttttgaatttcacaggatgcact

SEQ ID NO: 61523 - DNA, 35 bp, Artificial Sequence
  Synthetic oligonucleotide
ttgggacgctactttcgcatacgacgctagatcct

SEQ ID NO: 61524 - DNA, 35 bp, Artificial Sequence
  Synthetic oligonucleotide
gtgcgctggggggaaatgaagcacggggaagagct

SEQ ID NO: 61525 - DNA, 35 bp, Artificial Sequence
  Synthetic oligonucleotide
tactgccctgatggcacaagtttaattaattctct

SEQ ID NO: 61526 - DNA, 35 bp, Artificial Sequence
  Synthetic oligonucleotide
gctcccgtgctacaactgtctgtaacttcttaggt

SEQ ID NO: 61527 - DNA, 35 bp, Artificial Sequence
  Synthetic oligonucleotide
gttgttccccaggtatatactgtcagtcatctttt

SEQ ID NO: 61528 - DNA, 35 bp, Artificial Sequence
  Synthetic oligonucleotide
attacatgcccacctgtctaaagtcttatatgaaa

SEQ ID NO: 61529 - DNA, 35 bp, Artificial Sequence
  Synthetic oligonucleotide
taagcaaccatcagggagccgaccccctctttcaa

SEQ ID NO: 61530 - DNA, 34 bp, Artificial Sequence
  Synthetic oligonucleotide
gatgcccctgccctcacatacctacacagctgaa

SEQ ID NO: 61531 - DNA, 35 bp, Artificial Sequence
  Synthetic oligonucleotide
agatgggccggttactgcatgccactctctcataa

SEQ ID NO: 61532 - DNA, 36 bp, Artificial Sequence
  Synthetic oligonucleotide
tacgcggtagcgcatcatgtagcatttcggccaaca

SEQ ID NO: 61533 - DNA, 36 bp, Artificial Sequence
  Synthetic oligonucleotide
gacatgtctcccccagcgccctaagaatcctcaaca

SEQ ID NO: 61534 - DNA, 35 bp, Artificial Sequence
  Synthetic oligonucleotide
acataacccgacgacccttattacagttggacaca

SEQ ID NO: 61535 - DNA, 36 bp, Artificial Sequence
  Synthetic oligonucleotide
gcacccacgtttgcaaggccatcattcactttgaca

SEQ ID NO: 61536 - DNA, 36 bp, Artificial Sequence
  Synthetic oligonucleotide
atgcaaactcgggccttaaggtctgctactatccca

SEQ ID NO: 61537 - DNA, 35 bp, Artificial Sequence
  Synthetic oligonucleotide
ggaccccgccctcaatacaaccgtggtgactgcca

SEQ ID NO: 61538 - DNA, 36 bp, Artificial Sequence
  Synthetic oligonucleotide
ggggatccatgcccgatctgtcttccgtctgctcca

SEQ ID NO: 61539 - DNA, 36 bp, Artificial Sequence
  Synthetic oligonucleotide
ggggaggggcagaacaaaggggtacgtggcggggca

SEQ ID NO: 61540 - DNA, 36 bp, Artificial Sequence
  Synthetic oligonucleotide
tgcccgcacgtacacttagccataaacatgaatgca

SEQ ID NO: 61541 - DNA, 35 bp, Artificial Sequence
  Synthetic oligonucleotide
aactactccgcaggcctccggagtccgtgccatca

SEQ ID NO: 61542 - DNA, 36 bp, Artificial Sequence
  Synthetic oligonucleotide
ttccacccattgacgtgcacctgcaggtcatcatca

SEQ ID NO: 61543 - DNA, 36 bp, Artificial Sequence
  Synthetic oligonucleotide
tgccgcaatacccgtctgttcacgcgttatgtttca

SEQ ID NO: 61544 - DNA, 37 bp, Artificial Sequence
  Synthetic oligonucleotide
gacggacggtcgtagggggtagtgaaccttgacgaga

SEQ ID NO: 61545 - DNA, 36 bp, Artificial Sequence
  Synthetic oligonucleotide
gagcattccgcccacctttctttagcgtactttaga

SEQ ID NO: 61546 - DNA, 37 bp, Artificial Sequence
  Synthetic oligonucleotide
ggacaaccccccctctgattggctaccggcccaacga

SEQ ID NO: 61547 - DNA, 36 bp, Artificial Sequence
  Synthetic oligonucleotide
agacccgctttcccgtttcgcccttccgtattacga

SEQ ID NO: 61548 - DNA, 37 bp, Artificial Sequence
  Synthetic oligonucleotide
acacatggaccatctgtattatcttgtaactccgcga

SEQ ID NO: 61549 - DNA, 37 bp, Artificial Sequence
  Synthetic oligonucleotide
aacaacccagtcatacgtcgctatccacccatggcga

SEQ ID NO: 61550 - DNA, 37 bp, Artificial Sequence
  Synthetic oligonucleotide
gaccagttacggaactatggggaaaagggtgtaggga

SEQ ID NO: 61551 - DNA, 37 bp, Artificial Sequence
  Synthetic oligonucleotide
ggtgtgttcggataacatgggggtggggtgcagggga

SEQ ID NO: 61552 - DNA, 37 bp, Artificial Sequence
  Synthetic oligonucleotide
atgagaccggtcagctcgtaatatcacctccgcatga

SEQ ID NO: 61553 - DNA, 38 bp, Artificial Sequence
  Synthetic oligonucleotide
tcacgcaaaagccctcgcctgcacaataccataactga

SEQ ID NO: 61554 - DNA, 38 bp, Artificial Sequence
  Synthetic oligonucleotide
gtccacgacatccaaatctattgctcagccatccctga

SEQ ID NO: 61555 - DNA, 37 bp, Artificial Sequence
  Synthetic oligonucleotide
gcccctcccgccgccgtcgaagcgtttctacttctga

SEQ ID NO: 61556 - DNA, 38 bp, Artificial Sequence
  Synthetic oligonucleotide
gtgcgtgtatgaaaggggatcaaaaggtggagcggtga

SEQ ID NO: 61557 - DNA, 38 bp, Artificial Sequence
  Synthetic oligonucleotide
ggatgctgtcgggaaaatcggtggttgggcaatggtga

SEQ ID NO: 61558 - DNA, 38 bp, Artificial Sequence
  Synthetic oligonucleotide
gggacgggcaaggtgggggaaagctgtcctgttggtga

SEQ ID NO: 61559 - DNA, 38 bp, Artificial Sequence
  Synthetic oligonucleotide
taccacgtagccagtacgcgttgtgagcttggggttga

SEQ ID NO: 61560 - DNA, 38 bp, Artificial Sequence
  Synthetic oligonucleotide
gagtagtagtagggtagtggataggtgatgctggttga

SEQ ID NO: 61561 - DNA, 38 bp, Artificial Sequence
  Synthetic oligonucleotide
gcgtacacgtccatttcgctcgtattctccccgtttga

SEQ ID NO: 61562 - DNA, 35 bp, Artificial Sequence
  Synthetic oligonucleotide
ttcgcatccggcttagtttcctgatccatttttga

SEQ ID NO: 61563 - DNA, 36 bp, Artificial Sequence
  Synthetic oligonucleotide
tccatgtccctgtgccggcctggcttttggtgccta

SEQ ID NO: 61564 - DNA, 34 bp, Artificial Sequence
  Synthetic oligonucleotide
tatgcttaacgcatgcgtaccccatcctgatcta

SEQ ID NO: 61565 - DNA, 35 bp, Artificial Sequence
  Synthetic oligonucleotide
gaccttccttccaatgtccatggtttctagcatta

SEQ ID NO: 61566 - DNA, 36 bp, Artificial Sequence
  Synthetic oligonucleotide
gcgtgcctcccagcgcggttctctggtcaccactta

SEQ ID NO: 61567 - DNA, 35 bp, Artificial Sequence
  Synthetic oligonucleotide
atgacagccctgccgcgtgggtgcccaattgctta

SEQ ID NO: 61568 - DNA, 35 bp, Artificial Sequence
  Synthetic oligonucleotide
gacgcacccgccttaatgctcgctgcatgtcacac

SEQ ID NO: 61569 - DNA, 35 bp, Artificial Sequence
  Synthetic oligonucleotide
acttgcgcatcgcacgactattcacctgcacgcac

SEQ ID NO: 61570 - DNA, 35 bp, Artificial Sequence
  Synthetic oligonucleotide
tctggcccgatcagactcatcccgaccgtcatgac

SEQ ID NO: 61571 - DNA, 35 bp, Artificial Sequence
  Synthetic oligonucleotide
tcctgctatcggcgtcatattataccacccgtacc

SEQ ID NO: 61572 - DNA, 35 bp, Artificial Sequence
  Synthetic oligonucleotide
tgaaaagcttagttgaacatctcgccccctcagcc

SEQ ID NO: 61573 - DNA, 35 bp, Artificial Sequence
  Synthetic oligonucleotide
gcttgtcaccgtccctgtgatactctgtccgatcc

SEQ ID NO: 61574 - DNA, 35 bp, Artificial Sequence
  Synthetic oligonucleotide
acagaacgtgcttacctcgcctcttagggtcctcc

SEQ ID NO: 61575 - DNA, 35 bp, Artificial Sequence
  Synthetic oligonucleotide
tccagctcaaaagcccaccctttagcccctggggc

SEQ ID NO: 61576 - DNA, 35 bp, Artificial Sequence
  Synthetic oligonucleotide
tttcgcgccctcgacctcatcttaattttggtggc

SEQ ID NO: 61577 - DNA, 35 bp, Artificial Sequence
  Synthetic oligonucleotide
acacggaggctctatactcgaacacaacttccctc

SEQ ID NO: 61578 - DNA, 35 bp, Artificial Sequence
  Synthetic oligonucleotide
tcgttgcccaacccacccctatgttgatagttctc

SEQ ID NO: 61579 - DNA, 35 bp, Artificial Sequence
  Synthetic oligonucleotide
tcactccgttcgaataaccagtcacatctggagtc

SEQ ID NO: 61580 - DNA, 35 bp, Artificial Sequence
  Synthetic oligonucleotide
tccagttgccagttccgctcatccattcatacgtc

SEQ ID NO: 61581 - DNA, 35 bp, Artificial Sequence
  Synthetic oligonucleotide
gccgtaacagtacatccgtttagccactgaatttc

SEQ ID NO: 61582 - DNA, 35 bp, Artificial Sequence
  Synthetic oligonucleotide
attgcccgtcgttcctccgctcactcttcaacaag

SEQ ID NO: 61583 - DNA, 35 bp, Artificial Sequence
  Synthetic oligonucleotide
tgctgactagttagggtccttggttcgcccattag

SEQ ID NO: 61584 - DNA, 35 bp, Artificial Sequence
  Synthetic oligonucleotide
aactgcccgttttcctctgctgccttaatgtaacg

SEQ ID NO: 61585 - DNA, 35 bp, Artificial Sequence
  Synthetic oligonucleotide
gtggagacgggcaggaatacccataacagcaggcg

SEQ ID NO: 61586 - DNA, 35 bp, Artificial Sequence
  Synthetic oligonucleotide
aagaccgccccaagccagctgctaaacgaagggcg

SEQ ID NO: 61587 - DNA, 35 bp, Artificial Sequence
  Synthetic oligonucleotide
tagtacccggagcgccactatatatcaatcttgcg

SEQ ID NO: 61588 - DNA, 35 bp, Artificial Sequence
  Synthetic oligonucleotide
aaacactgctactgtacacaatttccatgccacgg

SEQ ID NO: 61589 - DNA, 35 bp, Artificial Sequence
  Synthetic oligonucleotide
gtaattggggcggagagaagcaggggcgccacggg

SEQ ID NO: 61590 - DNA, 35 bp, Artificial Sequence
  Synthetic oligonucleotide
aacccgctctaccgtgccagaccgccatgccggtg

SEQ ID NO: 61591 - DNA, 35 bp, Artificial Sequence
  Synthetic oligonucleotide
gttgggctccacgactgataactctaccttttttg

SEQ ID NO: 61592 - DNA, 35 bp, Artificial Sequence
  Synthetic oligonucleotide
ggacagcctcaccatgccattcctctgctaactat

SEQ ID NO: 61593 - DNA, 35 bp, Artificial Sequence
  Synthetic oligonucleotide
gccatcctcacatagacctgagttttcactcgtct

SEQ ID NO: 61594 - DNA, 35 bp, Artificial Sequence
  Synthetic oligonucleotide
acgcaactgacccttggttgaaacactaaccttct

SEQ ID NO: 61595 - DNA, 35 bp, Artificial Sequence
  Synthetic oligonucleotide
gctccatcaagccgcatgaaaccattctacggagt

SEQ ID NO: 61596 - DNA, 35 bp, Artificial Sequence
  Synthetic oligonucleotide
gactccccctttcgcgccgctcctcctggtctggt

SEQ ID NO: 61597 - DNA, 35 bp, Artificial Sequence
  Synthetic oligonucleotide
agactgcggattccgcgcctaacccacgcccctgt

SEQ ID NO: 61598 - DNA, 35 bp, Artificial Sequence
  Synthetic oligonucleotide
tgcacgctggtatgtaagggtcctgcttcctcctt

SEQ ID NO: 61599 - DNA, 35 bp, Artificial Sequence
  Synthetic oligonucleotide
atcattcaccgtactagcctcacacacaccgtgtt

SEQ ID NO: 61600 - DNA, 35 bp, Artificial Sequence
  Synthetic oligonucleotide
tgttcgcccccctattagatctgcggactattgtt

SEQ ID NO: 61601 - DNA, 35 bp, Artificial Sequence
  Synthetic oligonucleotide
tgcacctgccgaggggtaaccttatccacgcattt

SEQ ID NO: 61602 - DNA, 35 bp, Artificial Sequence
  Synthetic oligonucleotide
tgacgccggtatcgtattttgccggactccgattt

SEQ ID NO: 61603 - DNA, 35 bp, Artificial Sequence
  Synthetic oligonucleotide
aaggaccccctcagcggatttttttccctgccttt

SEQ ID NO: 61604 - DNA, 36 bp, Artificial Sequence
  Synthetic oligonucleotide
gacccatcttagtacttttgcgatgtattcctaaaa

SEQ ID NO: 61605 - DNA, 36 bp, Artificial Sequence
  Synthetic oligonucleotide
gctcggacctacgtacgctgcacttttctggaacaa

SEQ ID NO: 61606 - DNA, 35 bp, Artificial Sequence
  Synthetic oligonucleotide
gatcatcccccgaggcgtagcttttcgataacgaa

SEQ ID NO: 61607 - DNA, 36 bp, Artificial Sequence
  Synthetic oligonucleotide
ttaccatagacactccctcgcgcactgttgttcgaa

SEQ ID NO: 61608 - DNA, 36 bp, Artificial Sequence
  Synthetic oligonucleotide
tcccatccacctatgtagggacgcacatggaccaca

SEQ ID NO: 61609 - DNA, 36 bp, Artificial Sequence
  Synthetic oligonucleotide
tccccgatcagtccctaatcggccattccatccaca

SEQ ID NO: 61610 - DNA, 35 bp, Artificial Sequence
  Synthetic oligonucleotide
agtaactgcgaatatgctgggggggaaggagggca

SEQ ID NO: 61611 - DNA, 36 bp, Artificial Sequence
  Synthetic oligonucleotide
aattgacacggcacttgttaacattcaactttctca

SEQ ID NO: 61612 - DNA, 37 bp, Artificial Sequence
  Synthetic oligonucleotide
gatgtgacggccctgccacatccatccaccctccaga

SEQ ID NO: 61613 - DNA, 37 bp, Artificial Sequence
  Synthetic oligonucleotide
ttgcacagcgcatccgggcactaaaccacatccgaga

SEQ ID NO: 61614 - DNA, 37 bp, Artificial Sequence
  Synthetic oligonucleotide
taacggaggtgtggggtgtcattggggtgtggtacga

SEQ ID NO: 61615 - DNA, 37 bp, Artificial Sequence
  Synthetic oligonucleotide
aatatcccgccccacattagtttacacgctttaccga

SEQ ID NO: 61616 - DNA, 37 bp, Artificial Sequence
  Synthetic oligonucleotide
tacccccagacccaccattcacacctgtccgactcga

SEQ ID NO: 61617 - DNA, 36 bp, Artificial Sequence
  Synthetic oligonucleotide
gcgacacggccaagcgcgctcacctcaacactagga

SEQ ID NO: 61618 - DNA, 37 bp, Artificial Sequence
  Synthetic oligonucleotide
aagactggggtaatcgggggtgggcagaactagcgga

SEQ ID NO: 61619 - DNA, 37 bp, Artificial Sequence
  Synthetic oligonucleotide
gccaattggtcactttttcatctccgtcccagcggga

SEQ ID NO: 61620 - DNA, 37 bp, Artificial Sequence
  Synthetic oligonucleotide
gtgctgggagcagggacgtaggacgtgccgggcggga

SEQ ID NO: 61621 - DNA, 37 bp, Artificial Sequence
  Synthetic oligonucleotide
ggatcagtgcaactgaattgcttgtgggggaagggga

SEQ ID NO: 61622 - DNA, 37 bp, Artificial Sequence
  Synthetic oligonucleotide
gtaaagtagaggtcaaggggagtaggctggaagggga

SEQ ID NO: 61623 - DNA, 37 bp, Artificial Sequence
  Synthetic oligonucleotide
gtccccctagcaaaacgccgcacctcccattcgggga

SEQ ID NO: 61624 - DNA, 37 bp, Artificial Sequence
  Synthetic oligonucleotide
gaaggtgaggccgtgctttaggggaggatcaggtgga

SEQ ID NO: 61625 - DNA, 37 bp, Artificial Sequence
  Synthetic oligonucleotide
tgcgtgtagttaggggcgtgggggcatatcgggtgga

SEQ ID NO: 61626 - DNA, 37 bp, Artificial Sequence
  Synthetic oligonucleotide
ttcaaggaggaacaggaggtaaaatatgggctgtgga

SEQ ID NO: 61627 - DNA, 37 bp, Artificial Sequence
  Synthetic oligonucleotide
tacaacctgccctatggcgattttctatccttgtgga

SEQ ID NO: 61628 - DNA, 38 bp, Artificial Sequence
  Synthetic oligonucleotide
gctgtccgggagggttaggaggaagtgcgggtaaatga

SEQ ID NO: 61629 - DNA, 38 bp, Artificial Sequence
  Synthetic oligonucleotide
gaggaagggagggacagtgaagttggcgcggtccatga

SEQ ID NO: 61630 - DNA, 38 bp, Artificial Sequence
  Synthetic oligonucleotide
taccgcgccgctccaccaggtcttttgccatactatga

SEQ ID NO: 61631 - DNA, 37 bp, Artificial Sequence
  Synthetic oligonucleotide
gttaacaccagccctgcattgctcagttcccctatga

SEQ ID NO: 61632 - DNA, 38 bp, Artificial Sequence
  Synthetic oligonucleotide
tgcaacagactcttgccacactgatgaccttccactga

SEQ ID NO: 61633 - DNA, 38 bp, Artificial Sequence
  Synthetic oligonucleotide
actctgagccatgccttacgatcactagccttcactga

SEQ ID NO: 61634 - DNA, 36 bp, Artificial Sequence
  Synthetic oligonucleotide
acaccacccctaaccgtggtgcccgttgtaacctga

SEQ ID NO: 61635 - DNA, 38 bp, Artificial Sequence
  Synthetic oligonucleotide
gtctacccgccatacgacccgtgcacaaaacaccctga

SEQ ID NO: 61636 - DNA, 35 bp, Artificial Sequence
  Synthetic oligonucleotide
gcgaccccccttctcttggccgtcacgagtcctga

SEQ ID NO: 61637 - DNA, 37 bp, Artificial Sequence
  Synthetic oligonucleotide
ggacccgccacggcataaaccgcaccttttgagctga

SEQ ID NO: 61638 - DNA, 38 bp, Artificial Sequence
  Synthetic oligonucleotide
gcgccaaacgcccactatcctggacctgctatatctga

SEQ ID NO: 61639 - DNA, 38 bp, Artificial Sequence
  Synthetic oligonucleotide
agccgactcgcagtatctcgcgtctcccatctatctga

SEQ ID NO: 61640 - DNA, 36 bp, Artificial Sequence
  Synthetic oligonucleotide
tacctatcgcacgcatcttcgttgttccctctctga

SEQ ID NO: 61641 - DNA, 38 bp, Artificial Sequence
  Synthetic oligonucleotide
gccacctcccacccactgttaatgtacatagacggtga

SEQ ID NO: 61642 - DNA, 38 bp, Artificial Sequence
  Synthetic oligonucleotide
tagggcaaagggggggataaccttatcacaaggggtga

SEQ ID NO: 61643 - DNA, 38 bp, Artificial Sequence
  Synthetic oligonucleotide
gctcaaccctccgctctgttgcgctgattacacattga

SEQ ID NO: 61644 - DNA, 36 bp, Artificial Sequence
  Synthetic oligonucleotide
tctggacacacaggctattccggctatcatacttga

SEQ ID NO: 61645 - DNA, 36 bp, Artificial Sequence
  Synthetic oligonucleotide
gccgaagccggccccggaccctcccccattacttga

SEQ ID NO: 61646 - DNA, 38 bp, Artificial Sequence
  Synthetic oligonucleotide
gtccattcctatgccataagtacccgttccctcgttga

SEQ ID NO: 61647 - DNA, 37 bp, Artificial Sequence
  Synthetic oligonucleotide
gtggagagccagaataggcggggggttcggattttga

SEQ ID NO: 61648 - DNA, 38 bp, Artificial Sequence
  Synthetic oligonucleotide
gttgactcacattgctcatattttaccgcgccttttga

SEQ ID NO: 61649 - DNA, 36 bp, Artificial Sequence
  Synthetic oligonucleotide
aattcccgcccacgagtacccatcagtgatacaata

SEQ ID NO: 61650 - DNA, 35 bp, Artificial Sequence
  Synthetic oligonucleotide
tataccaacctgcctttagaattagcttatacgta

SEQ ID NO: 61651 - DNA, 35 bp, Artificial Sequence
  Synthetic oligonucleotide
agctgggataacaaaagcaaaaggggtggagtgta

SEQ ID NO: 61652 - DNA, 36 bp, Artificial Sequence
  Synthetic oligonucleotide
tgcctgccacctgtcttaactgctgagcgcacatta

SEQ ID NO: 61653 - DNA, 35 bp, Artificial Sequence
  Synthetic oligonucleotide
tgcaaagcctcttaacctgcccgcctccttgctta

SEQ ID NO: 61654 - DNA, 35 bp, Artificial Sequence
  Synthetic oligonucleotide
acgatggacaccgttggttaattgccctggagtta

SEQ ID NO: 61655 - DNA, 35 bp, Artificial Sequence
  Synthetic oligonucleotide
agcacctgtcactgaatgcccctgtgctaaattac

SEQ ID NO: 61656 - DNA, 35 bp, Artificial Sequence
  Synthetic oligonucleotide
gaccatgtatactcctgcctctgacaccgcacccc

SEQ ID NO: 61657 - DNA, 35 bp, Artificial Sequence
  Synthetic oligonucleotide
gataagccgtgagcccaccgacttaccacttcccc

SEQ ID NO: 61658 - DNA, 35 bp, Artificial Sequence
  Synthetic oligonucleotide
tgggtgcagtacatcgttacccccccttacagtcc

SEQ ID NO: 61659 - DNA, 35 bp, Artificial Sequence
  Synthetic oligonucleotide
tcaccacgagctattttcgcaacctgaggttacgc

SEQ ID NO: 61660 - DNA, 35 bp, Artificial Sequence
  Synthetic oligonucleotide
ttgagccagtgctctgctatacgtcatacctccgc

SEQ ID NO: 61661 - DNA, 35 bp, Artificial Sequence
  Synthetic oligonucleotide
gtgcgagctgcctttagtgattatccaatgcttgc

SEQ ID NO: 61662 - DNA, 35 bp, Artificial Sequence
  Synthetic oligonucleotide
gtacagcccgtctttgtcaacacgcctcctagatc

SEQ ID NO: 61663 - DNA, 35 bp, Artificial Sequence
  Synthetic oligonucleotide
gtgttgactgcggcctgtcggcttctcgcgccctc

SEQ ID NO: 61664 - DNA, 35 bp, Artificial Sequence
  Synthetic oligonucleotide
tgacacctcggctcactctcctggtttaacgtctc

SEQ ID NO: 61665 - DNA, 35 bp, Artificial Sequence
  Synthetic oligonucleotide
tggactccctctcttggtacccttcagcctgagtc

SEQ ID NO: 61666 - DNA, 35 bp, Artificial Sequence
  Synthetic oligonucleotide
atcatcacgataccactctctgccatgttgcggtc

SEQ ID NO: 61667 - DNA, 34 bp, Artificial Sequence
  Synthetic oligonucleotide
gtaggacgcgagacccgccctctcgtacgcattc

SEQ ID NO: 61668 - DNA, 35 bp, Artificial Sequence
  Synthetic oligonucleotide
gcgacaactacgtcacccgcacgcaccgcttattc

SEQ ID NO: 61669 - DNA, 35 bp, Artificial Sequence
  Synthetic oligonucleotide
tgacgtcagaccggttacgcctacgtccctgcttc

SEQ ID NO: 61670 - DNA, 35 bp, Artificial Sequence
  Synthetic oligonucleotide
gggacagtcgctgcgttactcatggtctcacttag

SEQ ID NO: 61671 - DNA, 35 bp, Artificial Sequence
  Synthetic oligonucleotide
gagagcacggcacaggtaatctctcagtaacaacg

SEQ ID NO: 61672 - DNA, 35 bp, Artificial Sequence
  Synthetic oligonucleotide
ggacgggcacaggaagtacgaaacgggggtaccgg

SEQ ID NO: 61673 - DNA, 35 bp, Artificial Sequence
  Synthetic oligonucleotide
gaatgggagaacggaaacaatgcggcccagtatgg

SEQ ID NO: 61674 - DNA, 35 bp, Artificial Sequence
  Synthetic oligonucleotide
tgcggctcgccaccctcaggaccccacactttctg

SEQ ID NO: 61675 - DNA, 37 bp, Artificial Sequence
  Synthetic oligonucleotide
tattgggcgagaagacattgagggatgggatggcgtg

SEQ ID NO: 61676 - DNA, 35 bp, Artificial Sequence
  Synthetic oligonucleotide
actcaccaccatggaaatggatgggactgttcttg

SEQ ID NO: 61677 - DNA, 35 bp, Artificial Sequence
  Synthetic oligonucleotide
tggatccggtccctctgtgcccattatgcctcaat

SEQ ID NO: 61678 - DNA, 35 bp, Artificial Sequence
  Synthetic oligonucleotide
ttaccgcctccagacaggtccaagccacacaacat

SEQ ID NO: 61679 - DNA, 35 bp, Artificial Sequence
  Synthetic oligonucleotide
gtgagacgccatctcccttcctatttgagcctgat

SEQ ID NO: 61680 - DNA, 35 bp, Artificial Sequence
  Synthetic oligonucleotide
accaccttccttcgatgctcaagctgcaccatagt

SEQ ID NO: 61681 - DNA, 35 bp, Artificial Sequence
  Synthetic oligonucleotide
agtgccatcccggagtagtagaatccatcatatgt

SEQ ID NO: 61682 - DNA, 35 bp, Artificial Sequence
  Synthetic oligonucleotide
aggagggggggatgggcactagagttgggagttgt

SEQ ID NO: 61683 - DNA, 35 bp, Artificial Sequence
  Synthetic oligonucleotide
tgttcccgatcccccacacatgtcacttgccaatt

SEQ ID NO: 61684 - DNA, 35 bp, Artificial Sequence
  Synthetic oligonucleotide
ggataaagcgcctgcgagcttctccaacgtgcctt

SEQ ID NO: 61685 - DNA, 35 bp, Artificial Sequence
  Synthetic oligonucleotide
tgatgactccccggactccacggacacctgttttt

SEQ ID NO: 61686 - DNA, 36 bp, Artificial Sequence
  Synthetic oligonucleotide
tcagccgcccgcttttcgacccatttttaacaaaaa

SEQ ID NO: 61687 - DNA, 36 bp, Artificial Sequence
  Synthetic oligonucleotide
gtgaacaccctcgccacgagctctagggcatttaaa

SEQ ID NO: 61688 - DNA, 36 bp, Artificial Sequence
  Synthetic oligonucleotide
tagacagttcgctcattttcgttcctcgctgtacaa

SEQ ID NO: 61689 - DNA, 36 bp, Artificial Sequence
  Synthetic oligonucleotide
tttgctctcaccacatgtatataccccccagcgcaa

SEQ ID NO: 61690 - DNA, 35 bp, Artificial Sequence
  Synthetic oligonucleotide
accgcccagcaggggagaaaccaaagtgggggtaa

SEQ ID NO: 61691 - DNA, 36 bp, Artificial Sequence
  Synthetic oligonucleotide
acctgatgtgctaaattcacccactgcgatgccaca

SEQ ID NO: 61692 - DNA, 36 bp, Artificial Sequence
  Synthetic oligonucleotide
gagggggcagaccgagatagcgggaggcatacacca

SEQ ID NO: 61693 - DNA, 36 bp, Artificial Sequence
  Synthetic oligonucleotide
gacagacgaactgtatttacgtttctttgcttccca

SEQ ID NO: 61694 - DNA, 36 bp, Artificial Sequence
  Synthetic oligonucleotide
taacgcctcagagttcacacgagcccccaacccgca

SEQ ID NO: 61695 - DNA, 36 bp, Artificial Sequence
  Synthetic oligonucleotide
taccttgcattcatccgtgcgctactggtatcctca

SEQ ID NO: 61696 - DNA, 37 bp, Artificial Sequence
  Synthetic oligonucleotide
gtgtaggggaggggttaggggattacggcaatagaga

SEQ ID NO: 61697 - DNA, 36 bp, Artificial Sequence
  Synthetic oligonucleotide
aaccgcaggttgctactgcccttacaaggaccgaga

SEQ ID NO: 61698 - DNA, 37 bp, Artificial Sequence
  Synthetic oligonucleotide
tagcgccccacctatgacttttgtctggcatccacga

SEQ ID NO: 61699 - DNA, 36 bp, Artificial Sequence
  Synthetic oligonucleotide
taatcaccagtcagccgccgcactgacaacatacga

SEQ ID NO: 61700 - DNA, 37 bp, Artificial Sequence
  Synthetic oligonucleotide
gaagcaatgaagggggagggattaagtgaggctacga

SEQ ID NO: 61701 - DNA, 37 bp, Artificial Sequence
  Synthetic oligonucleotide
gcacggggtgtggagggagtaaatgggaagagtccga

SEQ ID NO: 61702 - DNA, 37 bp, Artificial Sequence
  Synthetic oligonucleotide
tactcgacgtccctgggtcttagtttcttcattgcga

SEQ ID NO: 61703 - DNA, 37 bp, Artificial Sequence
  Synthetic oligonucleotide
ttcccacacctcttgtgcaaacgatttgttcttgcga

SEQ ID NO: 61704 - DNA, 37 bp, Artificial Sequence
  Synthetic oligonucleotide
agtcaccccctcgacgagttttagcgtcagccctcga

SEQ ID NO: 61705 - DNA, 37 bp, Artificial Sequence
  Synthetic oligonucleotide
tgctaacgacagttcccctaatgcgccagatcctcga

SEQ ID NO: 61706 - DNA, 37 bp, Artificial Sequence
  Synthetic oligonucleotide
gtgccctccgcccaccatgaagtgacaagtcgacgga

SEQ ID NO: 61707 - DNA, 37 bp, Artificial Sequence
  Synthetic oligonucleotide
ttccacacctgtatcttgcacgtaccacttcttcgga

SEQ ID NO: 61708 - DNA, 35 bp, Artificial Sequence
  Synthetic oligonucleotide
ttaccccatcattggactactctgcccgacaggga

SEQ ID NO: 61709 - DNA, 37 bp, Artificial Sequence
  Synthetic oligonucleotide
tgtgagtcaatgcggaaagcagggggagaacatggga

SEQ ID NO: 61710 - DNA, 37 bp, Artificial Sequence
  Synthetic oligonucleotide
tagacaggtaagcccaggagggggagactggatggga

SEQ ID NO: 61711 - DNA, 37 bp, Artificial Sequence
  Synthetic oligonucleotide
tatcacgggggaagttagggccgggcggggagtggga

SEQ ID NO: 61712 - DNA, 36 bp, Artificial Sequence
  Synthetic oligonucleotide
tgacgcgggtaagggcgggcaggtggacaaggtgga

SEQ ID NO: 61713 - DNA, 36 bp, Artificial Sequence
  Synthetic oligonucleotide
tgtactgcaaccacgatcatcacgcttcctacatga

SEQ ID NO: 61714 - DNA, 38 bp, Artificial Sequence
  Synthetic oligonucleotide
tagtggcccacatctcgttaatcctgggtgacccatga

SEQ ID NO: 61715 - DNA, 38 bp, Artificial Sequence
  Synthetic oligonucleotide
tcgcccgaccgaacgccgattagggaacttccaactga

SEQ ID NO: 61716 - DNA, 38 bp, Artificial Sequence
  Synthetic oligonucleotide
tgatttccgcctcggctgtaagctcatcatccacctga

SEQ ID NO: 61717 - DNA, 38 bp, Artificial Sequence
  Synthetic oligonucleotide
attgcccgtgtttgctcctgcctttgtctaggccctga

SEQ ID NO: 61718 - DNA, 38 bp, Artificial Sequence
  Synthetic oligonucleotide
ttcaccctcatgggtgtctttctgtcccgtaacgctga

SEQ ID NO: 61719 - DNA, 38 bp, Artificial Sequence
  Synthetic oligonucleotide
gacagacaagcctcttcagcatccgtcccccgggctga

SEQ ID NO: 61720 - DNA, 35 bp, Artificial Sequence
  Synthetic oligonucleotide
gtacgccctatcacccgcgtgccccaaaaccgtga

SEQ ID NO: 61721 - DNA, 38 bp, Artificial Sequence
  Synthetic oligonucleotide
acccacgccacacgctgcaagttaagcaatccccgtga

SEQ ID NO: 61722 - DNA, 38 bp, Artificial Sequence
  Synthetic oligonucleotide
tgcggggggggtcgaagatgatgcaggggcgatcgtga

SEQ ID NO: 61723 - DNA, 36 bp, Artificial Sequence
  Synthetic oligonucleotide
gtgtacgccattctttttttggtaccccgaaggtga

SEQ ID NO: 61724 - DNA, 38 bp, Artificial Sequence
  Synthetic oligonucleotide
gcccgcctccattgacttgaaaggcgttttccctgtga

SEQ ID NO: 61725 - DNA, 38 bp, Artificial Sequence
  Synthetic oligonucleotide
gtgcatgagggtgagacggagagggtttgacgcattga

SEQ ID NO: 61726 - DNA, 38 bp, Artificial Sequence
  Synthetic oligonucleotide
tatgccggtcgaagccaatttccagccataccacttga

SEQ ID NO: 61727 - DNA, 38 bp, Artificial Sequence
  Synthetic oligonucleotide
tatcaccggccttacactggaacgtgcttattccttga

SEQ ID NO: 61728 - DNA, 38 bp, Artificial Sequence
  Synthetic oligonucleotide
ttcaggaccagttgcaatcgccatctattctttcttga

SEQ ID NO: 61729 - DNA, 38 bp, Artificial Sequence
  Synthetic oligonucleotide
tacgcaggaggctttgggtatggttagtggtttgttga

SEQ ID NO: 61730 - DNA, 38 bp, Artificial Sequence
  Synthetic oligonucleotide
gagtgtggtggagggatggttttagccggtaattttga

SEQ ID NO: 61731 - DNA, 35 bp, Artificial Sequence
  Synthetic oligonucleotide
aatctccacgccgtcgtttctgttttgcgcgtata

SEQ ID NO: 61732 - DNA, 36 bp, Artificial Sequence
  Synthetic oligonucleotide
gagatgcgcaataacccgttctaaaacaccccacta

SEQ ID NO: 61733 - DNA, 36 bp, Artificial Sequence
  Synthetic oligonucleotide
tacccatgcctttgacctgcactgtcgccctcacta

SEQ ID NO: 61734 - DNA, 36 bp, Artificial Sequence
  Synthetic oligonucleotide
actgcccccctctaccccactgactcgaaggggcta

SEQ ID NO: 61735 - DNA, 36 bp, Artificial Sequence
  Synthetic oligonucleotide
aattgtcggagggaggcaaaggacggaggttgagta

SEQ ID NO: 61736 - DNA, 36 bp, Artificial Sequence
  Synthetic oligonucleotide
tacgcctccgcactgttcctctatttcccccacgta

SEQ ID NO: 61737 - DNA, 36 bp, Artificial Sequence
  Synthetic oligonucleotide
acctgtcccgcactggtcggtaaattctcctccgta

SEQ ID NO: 61738 - DNA, 36 bp, Artificial Sequence
  Synthetic oligonucleotide
gtccggacaggttccttttcatcccttgctgcatta

SEQ ID NO: 61739 - DNA, 36 bp, Artificial Sequence
  Synthetic oligonucleotide
atccagcccccccctcctaggtgtgacctgttctta

SEQ ID NO: 61740 - DNA, 35 bp, Artificial Sequence
  Synthetic oligonucleotide
gacgcagtcgtggtctagcccaatgatctccttta

SEQ ID NO: 61741 - DNA, 35 bp, Artificial Sequence
  Synthetic oligonucleotide
gctgctgcggcctcattagcgtgcacattctccac

SEQ ID NO: 61742 - DNA, 35 bp, Artificial Sequence
  Synthetic oligonucleotide
aactggtacctcattgtgctccgccctcccccgac

SEQ ID NO: 61743 - DNA, 35 bp, Artificial Sequence
  Synthetic oligonucleotide
tcctaccaaccagacattaataggggcccacctac

SEQ ID NO: 61744 - DNA, 35 bp, Artificial Sequence
  Synthetic oligonucleotide
tgcactgcctgatacctcactgccctgacgcgtac

SEQ ID NO: 61745 - DNA, 35 bp, Artificial Sequence
  Synthetic oligonucleotide
ggacagtgctaccagtgctgactcaccaacacacc

SEQ ID NO: 61746 - DNA, 35 bp, Artificial Sequence
  Synthetic oligonucleotide
ttttggtccctcggtcctgggaatcatcacctacc

SEQ ID NO: 61747 - DNA, 35 bp, Artificial Sequence
  Synthetic oligonucleotide
tgcgggtaggctccacccgcgggcccatcattccc

SEQ ID NO: 61748 - DNA, 35 bp, Artificial Sequence
  Synthetic oligonucleotide
tgatacgggtcacggaaatctgcctactcctcgcc

SEQ ID NO: 61749 - DNA, 35 bp, Artificial Sequence
  Synthetic oligonucleotide
gaacctcagtctcagcgcgtaccgaccctgattcc

SEQ ID NO: 61750 - DNA, 35 bp, Artificial Sequence
  Synthetic oligonucleotide
tgcaggacggaagccataccaatcgcagttcttcc

SEQ ID NO: 61751 - DNA, 35 bp, Artificial Sequence
  Synthetic oligonucleotide
gttgagtacactgccgccttagatcagccccgcgc

SEQ ID NO: 61752 - DNA, 35 bp, Artificial Sequence
  Synthetic oligonucleotide
atccacgggccgctcgcccacacttccccgatggc

SEQ ID NO: 61753 - DNA, 35 bp, Artificial Sequence
  Synthetic oligonucleotide
gtgcaccttggcctttgaagactgacctcctctgc

SEQ ID NO: 61754 - DNA, 35 bp, Artificial Sequence
  Synthetic oligonucleotide
gacaatccgcctccttcagatcagatcgtagtatc

SEQ ID NO: 61755 - DNA, 35 bp, Artificial Sequence
  Synthetic oligonucleotide
ttgcattcccgccccacatcatcggttcatttgtc

SEQ ID NO: 61756 - DNA, 35 bp, Artificial Sequence
  Synthetic oligonucleotide
ataccatcatcgtgcgaggacttcttccctttgtc

SEQ ID NO: 61757 - DNA, 35 bp, Artificial Sequence
  Synthetic oligonucleotide
gagggatggaggtccattaagtgggagtgggatag

SEQ ID NO: 61758 - DNA, 35 bp, Artificial Sequence
  Synthetic oligonucleotide
aactgtcacatatgttacaccatccgcacccaacg

SEQ ID NO: 61759 - DNA, 35 bp, Artificial Sequence
  Synthetic oligonucleotide
atactgcgccggctctattcctgtcctactcggcg

SEQ ID NO: 61760 - DNA, 36 bp, Artificial Sequence
  Synthetic oligonucleotide
gaggtttggggcacggaatgggggtatcttgggagg

SEQ ID NO: 61761 - DNA, 35 bp, Artificial Sequence
  Synthetic oligonucleotide
tccaacaactgattggcatctctttccactttcgg

SEQ ID NO: 61762 - DNA, 35 bp, Artificial Sequence
  Synthetic oligonucleotide
agctatcgaaaaggcaagggcgggggagagttggg

SEQ ID NO: 61763 - DNA, 35 bp, Artificial Sequence
  Synthetic oligonucleotide
aacgcatggggaacaatgtcatagagagggtagtg

SEQ ID NO: 61764 - DNA, 35 bp, Artificial Sequence
  Synthetic oligonucleotide
agagagtgacggaggaggtaagttggggaaaggtg

SEQ ID NO: 61765 - DNA, 35 bp, Artificial Sequence
  Synthetic oligonucleotide
gtcaagggtgacgggaaagtacgtgcaggcaaaat

SEQ ID NO: 61766 - DNA, 35 bp, Artificial Sequence
  Synthetic oligonucleotide
gccacatcattcggtgcagcagatagggccctgat

SEQ ID NO: 61767 - DNA, 35 bp, Artificial Sequence
  Synthetic oligonucleotide
atgaacccatctccgctgcaggccctgcttcctat

SEQ ID NO: 61768 - DNA, 35 bp, Artificial Sequence
  Synthetic oligonucleotide
gttctcacctctcgttctgacatcactacgtgcct

SEQ ID NO: 61769 - DNA, 35 bp, Artificial Sequence
  Synthetic oligonucleotide
tccttgcgcctaccgcctcgctgccaacactagct

SEQ ID NO: 61770 - DNA, 35 bp, Artificial Sequence
  Synthetic oligonucleotide
gccaggcgtatccaggtcgcctccatctgttatct

SEQ ID NO: 61771 - DNA, 35 bp, Artificial Sequence
  Synthetic oligonucleotide
taccttccagtcgctttggcccctttcgttagtct

SEQ ID NO: 61772 - DNA, 35 bp, Artificial Sequence
  Synthetic oligonucleotide
aagagggagtggtgggtgatgacgcaaatcatagt

SEQ ID NO: 61773 - DNA, 35 bp, Artificial Sequence
  Synthetic oligonucleotide
tgaggccccccgatcagtattcgcatcactaaatt

SEQ ID NO: 61774 - DNA, 35 bp, Artificial Sequence
  Synthetic oligonucleotide
tacgcggtctacccgtagcaaccaaatcattcgtt

SEQ ID NO: 61775 - DNA, 35 bp, Artificial Sequence
  Synthetic oligonucleotide
gagtgggggagaagtgaggttgcggagcctggttt

SEQ ID NO: 61776 - DNA, 36 bp, Artificial Sequence
  Synthetic oligonucleotide
ttgcgcgcatgccattctatcttagccttagacgaa

SEQ ID NO: 61777 - DNA, 35 bp, Artificial Sequence
  Synthetic oligonucleotide
gctccacctgtccggacatcgctctccgcaccgaa

SEQ ID NO: 61778 - DNA, 36 bp, Artificial Sequence
  Synthetic oligonucleotide
gtcacaggcggtaaggctataaaacggaacggataa

SEQ ID NO: 61779 - DNA, 36 bp, Artificial Sequence
  Synthetic oligonucleotide
aaccgtgggggggagggaacgggaaattcatgcaca

SEQ ID NO: 61780 - DNA, 35 bp, Artificial Sequence
  Synthetic oligonucleotide
atgaggggtggggggaattggagagtctcactaca

SEQ ID NO: 61781 - DNA, 35 bp, Artificial Sequence
  Synthetic oligonucleotide
atacctcccggccttacaccaggctccgcccccca

SEQ ID NO: 61782 - DNA, 36 bp, Artificial Sequence
  Synthetic oligonucleotide
aaccaccggctatgtatctcgtacgctattgtccca

SEQ ID NO: 61783 - DNA, 36 bp, Artificial Sequence
  Synthetic oligonucleotide
aacaaggtcccgggttgagcggaggacgggagtgca

SEQ ID NO: 61784 - DNA, 35 bp, Artificial Sequence
  Synthetic oligonucleotide
ggcatgcatcggaagctgccgcggaaacccagtca

SEQ ID NO: 61785 - DNA, 37 bp, Artificial Sequence
  Synthetic oligonucleotide
gggaaagggcatagacaaaggggagccatcggtaaga

SEQ ID NO: 61786 - DNA, 37 bp, Artificial Sequence
  Synthetic oligonucleotide
aaggtaggagagagccgaggtggggatgtgtcacaga

SEQ ID NO: 61787 - DNA, 37 bp, Artificial Sequence
  Synthetic oligonucleotide
ggagtgcctgccatctaccacacgctacccacagaga

SEQ ID NO: 61788 - DNA, 37 bp, Artificial Sequence
  Synthetic oligonucleotide
taccagggtgtggagggtgggctacgttcagtctaga

SEQ ID NO: 61789 - DNA, 37 bp, Artificial Sequence
  Synthetic oligonucleotide
attgcgggggagatgagaaaggtgaggtgaggaacga

SEQ ID NO: 61790 - DNA, 37 bp, Artificial Sequence
  Synthetic oligonucleotide
agtatcaccctgcacatccacggctacacaaagacga

SEQ ID NO: 61791 - DNA, 37 bp, Artificial Sequence
  Synthetic oligonucleotide
aaccaaacggcgtctggcgttttcctcacttttacga

SEQ ID NO: 61792 - DNA, 37 bp, Artificial Sequence
  Synthetic oligonucleotide
tccaccggggatggctcttgaagtttactaccaccga

SEQ ID NO: 61793 - DNA, 37 bp, Artificial Sequence
  Synthetic oligonucleotide
tgactgcctccgtaacttgggagctctgacctaccga

SEQ ID NO: 61794 - DNA, 37 bp, Artificial Sequence
  Synthetic oligonucleotide
aagatcaccgcccctgcattccatcagcacaccccga

SEQ ID NO: 61795 - DNA, 36 bp, Artificial Sequence
  Synthetic oligonucleotide
accaccaccctggacacaaccctgacggatttccga

SEQ ID NO: 61796 - DNA, 37 bp, Artificial Sequence
  Synthetic oligonucleotide
gcactccacctgcgctagtcgccacaacattcagcga

SEQ ID NO: 61797 - DNA, 37 bp, Artificial Sequence
  Synthetic oligonucleotide
agcttgaccgacgtttaaccagcctttccgttctcga

SEQ ID NO: 61798 - DNA, 37 bp, Artificial Sequence
  Synthetic oligonucleotide
tagactccctatcctgtaaatgttctgtccttgtcga

SEQ ID NO: 61799 - DNA, 37 bp, Artificial Sequence
  Synthetic oligonucleotide
gccctcctctttgcttcacgtacttgccctacacgga

SEQ ID NO: 61800 - DNA, 37 bp, Artificial Sequence
  Synthetic oligonucleotide
gctcatccctcggaattccaccctatgcttagacgga

SEQ ID NO: 61801 - DNA, 37 bp, Artificial Sequence
  Synthetic oligonucleotide
tcccttcgcacccgtagtttgcctcccgatgcccgga

SEQ ID NO: 61802 - DNA, 35 bp, Artificial Sequence
  Synthetic oligonucleotide
tcaagggggggacggacacaggttcacgggaggga

SEQ ID NO: 61803 - DNA, 34 bp, Artificial Sequence
  Synthetic oligonucleotide
gtgctgtgcaaacttaaaaaggtggtggggggga

SEQ ID NO: 61804 - DNA, 37 bp, Artificial Sequence
  Synthetic oligonucleotide
gtcaatgccgctggtgcgagcccgccttgtcctggga

SEQ ID NO: 61805 - DNA, 37 bp, Artificial Sequence
  Synthetic oligonucleotide
tcactccccggttttgcgacgctcctccggccttgga

SEQ ID NO: 61806 - DNA, 38 bp, Artificial Sequence
  Synthetic oligonucleotide
tccccccttctcgtgagccaatgacgccggtaccatga

SEQ ID NO: 61807 - DNA, 37 bp, Artificial Sequence
  Synthetic oligonucleotide
gagcaacaccccttagtgccttgaatcatgtccatga

SEQ ID NO: 61808 - DNA, 37 bp, Artificial Sequence
  Synthetic oligonucleotide
taaagcgtaagctgcggagggtggagtggggggatga

SEQ ID NO: 61809 - DNA, 35 bp, Artificial Sequence
  Synthetic oligonucleotide
aacagcccatgctaaggctttacttccctttatga

SEQ ID NO: 61810 - DNA, 37 bp, Artificial Sequence
  Synthetic oligonucleotide
acgcgcctggtacacgactcatccccccttatactga

SEQ ID NO: 61811 - DNA, 35 bp, Artificial Sequence
  Synthetic oligonucleotide
gtgccgccctttcacgtcctggaccaaacacctga

SEQ ID NO: 61812 - DNA, 38 bp, Artificial Sequence
  Synthetic oligonucleotide
cacagtcaggtatgcggggtgttagttaggcaacgtga

SEQ ID NO: 61813 - DNA, 38 bp, Artificial Sequence
  Synthetic oligonucleotide
gccatgagaaaagttgcgggaaggggtgggctcggtga

SEQ ID NO: 61814 - DNA, 38 bp, Artificial Sequence
  Synthetic oligonucleotide
agcgagccacgtgccgtttactacccatgctcttgtga

SEQ ID NO: 61815 - DNA, 38 bp, Artificial Sequence
  Synthetic oligonucleotide
gacacgggtcagtaattacttgggctccgattttgtga

SEQ ID NO: 61816 - DNA, 38 bp, Artificial Sequence
  Synthetic oligonucleotide
aatacggcgccgctccacctctatcctatcccgattga

SEQ ID NO: 61817 - DNA, 38 bp, Artificial Sequence
  Synthetic oligonucleotide
gccatcgggccgaaatagtccctgcctatactacttga

SEQ ID NO: 61818 - DNA, 38 bp, Artificial Sequence
  Synthetic oligonucleotide
taaatcgcggggtgtggaaaaatgagaggggtgcttga

SEQ ID NO: 61819 - DNA, 38 bp, Artificial Sequence
  Synthetic oligonucleotide
tcgacactgtcttctgcgccacccccaattgttcttga

SEQ ID NO: 61820 - DNA, 36 bp, Artificial Sequence
  Synthetic oligonucleotide
gtctaccacctatgccttaatacagactagttacta

SEQ ID NO: 61821 - DNA, 36 bp, Artificial Sequence
  Synthetic oligonucleotide
tcacatccgacggtgcgtgggcactttccgcgccta

SEQ ID NO: 61822 - DNA, 36 bp, Artificial Sequence
  Synthetic oligonucleotide
tacccccatccctcgcgctgcatgttcttgttccta

SEQ ID NO: 61823 - DNA, 36 bp, Artificial Sequence
  Synthetic oligonucleotide
tacactcctcatctcagtggacctagccacccgcta

SEQ ID NO: 61824 - DNA, 36 bp, Artificial Sequence
  Synthetic oligonucleotide
gccagttaggttgggtcggtgggagggttttaggta

SEQ ID NO: 61825 - DNA, 36 bp, Artificial Sequence
  Synthetic oligonucleotide
agactgcacgggggtgacgtgggtggcctggatgta

SEQ ID NO: 61826 - DNA, 35 bp, Artificial Sequence
  Synthetic oligonucleotide
tgcgctgccacgaagcacatctgcttcgatactta

SEQ ID NO: 61827 - DNA, 35 bp, Artificial Sequence
  Synthetic oligonucleotide
tgtagtgcatccgtagcgtccccacgtttgccaac

SEQ ID NO: 61828 - DNA, 35 bp, Artificial Sequence
  Synthetic oligonucleotide
aagtgagaggatgctaaaatggagggggaggagac

SEQ ID NO: 61829 - DNA, 35 bp, Artificial Sequence
  Synthetic oligonucleotide
aatgaaactgtctgcctacgaccactcctcccgac

SEQ ID NO: 61830 - DNA, 35 bp, Artificial Sequence
  Synthetic oligonucleotide
gactctctcgcaagcttattcgacccatagcctac

SEQ ID NO: 61831 - DNA, 35 bp, Artificial Sequence
  Synthetic oligonucleotide
tgctacccttacgattaaccctgccacgtttgtac

SEQ ID NO: 61832 - DNA, 35 bp, Artificial Sequence
  Synthetic oligonucleotide
acccttcgcaccacttctcttctcggttcagagcc

SEQ ID NO: 61833 - DNA, 35 bp, Artificial Sequence
  Synthetic oligonucleotide
tgtccaccgggtgaggagtccattacatctctgcc

SEQ ID NO: 61834 - DNA, 35 bp, Artificial Sequence
  Synthetic oligonucleotide
tcgccccctcgattaacctggctcgaacaataagc

SEQ ID NO: 61835 - DNA, 35 bp, Artificial Sequence
  Synthetic oligonucleotide
tctcagagcccccacctttttggcacaggaccagc

SEQ ID NO: 61836 - DNA, 35 bp, Artificial Sequence
  Synthetic oligonucleotide
ggaatgccaccatgtgatcctctttccgctgccgc

SEQ ID NO: 61837 - DNA, 35 bp, Artificial Sequence
  Synthetic oligonucleotide
acggtacggtccattccagttttagttcctgctgc

SEQ ID NO: 61838 - DNA, 35 bp, Artificial Sequence
  Synthetic oligonucleotide
atcggtacctcccctgatatctactttttgtcatc

SEQ ID NO: 61839 - DNA, 35 bp, Artificial Sequence
  Synthetic oligonucleotide
gcaacgagagtgtgctaccattcacatcgccggtc

SEQ ID NO: 61840 - DNA, 35 bp, Artificial Sequence
  Synthetic oligonucleotide
tccccccgccggtccgctatattctaccagtccag

SEQ ID NO: 61841 - DNA, 35 bp, Artificial Sequence
  Synthetic oligonucleotide
acggagggccgtagccgttttgttcgcttccaacg

SEQ ID NO: 61842 - DNA, 35 bp, Artificial Sequence
  Synthetic oligonucleotide
gaccatcgctgtccccgtacttagtttctgttgcg

SEQ ID NO: 61843 - DNA, 34 bp, Artificial Sequence
  Synthetic oligonucleotide
tgtacaccacatggaattccgcactgtatcatcg

SEQ ID NO: 61844 - DNA, 35 bp, Artificial Sequence
  Synthetic oligonucleotide
gcgagtgttgcattcccgtttatataccctcatcg

SEQ ID NO: 61845 - DNA, 35 bp, Artificial Sequence
  Synthetic oligonucleotide
atttaccgcgctctatatccgtacacattctatcg

SEQ ID NO: 61846 - DNA, 35 bp, Artificial Sequence
  Synthetic oligonucleotide
tctatgtcctcgccaccgtgtactcttccatctgg

SEQ ID NO: 61847 - DNA, 34 bp, Artificial Sequence
  Synthetic oligonucleotide
gaactcccatccgctcttctcagactgccgttgg

SEQ ID NO: 61848 - DNA, 35 bp, Artificial Sequence
  Synthetic oligonucleotide
gaccaacaatgttggagcagttaagagggaaggtg

SEQ ID NO: 61849 - DNA, 35 bp, Artificial Sequence
  Synthetic oligonucleotide
gatgccaaccgtgactgtgcgataattcattcttg

SEQ ID NO: 61850 - DNA, 35 bp, Artificial Sequence
  Synthetic oligonucleotide
gcctgctaccccccacttcgacagggcccggtgct

SEQ ID NO: 61851 - DNA, 35 bp, Artificial Sequence
  Synthetic oligonucleotide
aactggggggatggatgatagcatgttcatagagt

SEQ ID NO: 61852 - DNA, 35 bp, Artificial Sequence
  Synthetic oligonucleotide
acctgaccagctggtcaacgaacgatcgattaggt

SEQ ID NO: 61853 - DNA, 35 bp, Artificial Sequence
  Synthetic oligonucleotide
atccccggtagaacaccgcacgcccagaccacggt

SEQ ID NO: 61854 - DNA, 35 bp, Artificial Sequence
  Synthetic oligonucleotide
tcgcaccgaacccccgatcccttagctccggttgt

SEQ ID NO: 61855 - DNA, 35 bp, Artificial Sequence
  Synthetic oligonucleotide
gcccgacatctgagtatcgtgtcgagcacctcctt

SEQ ID NO: 61856 - DNA, 35 bp, Artificial Sequence
  Synthetic oligonucleotide
gttgcgctcccacacgtttcccacggcattcggtt

SEQ ID NO: 61857 - DNA, 35 bp, Artificial Sequence
  Synthetic oligonucleotide
ttcgcactgggacgcctctatatagattcatggtt

SEQ ID NO: 61858 - DNA, 35 bp, Artificial Sequence
  Synthetic oligonucleotide
accacgcaagagttggccccacgacttatcccttt

SEQ ID NO: 61859 - DNA, 35 bp, Artificial Sequence
  Synthetic oligonucleotide
taggactgcagtgtggagtgcaaatttcacttttt

SEQ ID NO: 61860 - DNA, 35 bp, Artificial Sequence
  Synthetic oligonucleotide
tgcccatatacccacgtcacccactgagggtccaa

SEQ ID NO: 61861 - DNA, 37 bp, Artificial Sequence
  Synthetic oligonucleotide
gcctcgccaacgaggccatatacctgaccattgtgaa

SEQ ID NO: 61862 - DNA, 36 bp, Artificial Sequence
  Synthetic oligonucleotide
tagcgagctgttcacgcgtgcctccctctttcctaa

SEQ ID NO: 61863 - DNA, 36 bp, Artificial Sequence
  Synthetic oligonucleotide
ggtcggagaaaccgggggagaaagggcagtaagtaa

SEQ ID NO: 61864 - DNA, 35 bp, Artificial Sequence
  Synthetic oligonucleotide
gcactgggtccgtttccatccctctgacccgttaa

SEQ ID NO: 61865 - DNA, 35 bp, Artificial Sequence
  Synthetic oligonucleotide
ttcccaccctgtttctgtactgtctcgcctgaaca

SEQ ID NO: 61866 - DNA, 35 bp, Artificial Sequence
  Synthetic oligonucleotide
tcacacctcgaattatgccagtagcttactataca

SEQ ID NO: 61867 - DNA, 36 bp, Artificial Sequence
  Synthetic oligonucleotide
ggggagggccgtaggggagggaagtacgcaagacca

SEQ ID NO: 61868 - DNA, 36 bp, Artificial Sequence
  Synthetic oligonucleotide
accacgttgcccgggtagcttttaatctttgagcca

SEQ ID NO: 61869 - DNA, 36 bp, Artificial Sequence
  Synthetic oligonucleotide
tatcacctcatagacctcccgcgtgatacctttcca

SEQ ID NO: 61870 - DNA, 36 bp, Artificial Sequence
  Synthetic oligonucleotide
ggatcacctatagtgatccctaccctgttccacgca

SEQ ID NO: 61871 - DNA, 36 bp, Artificial Sequence
  Synthetic oligonucleotide
tcgacctctcgttcgcttcacttctaggactcatca

SEQ ID NO: 61872 - DNA, 36 bp, Artificial Sequence
  Synthetic oligonucleotide
tagacacgtccgcaattggtcccccgcgtaacgtca

SEQ ID NO: 61873 - DNA, 36 bp, Artificial Sequence
  Synthetic oligonucleotide
gcctcgaaacctgctacacccctgtgctatacttca

SEQ ID NO: 61874 - DNA, 36 bp, Artificial Sequence
  Synthetic oligonucleotide
gccttcagcagttacccccggccccatctgtgttca

SEQ ID NO: 61875 - DNA, 37 bp, Artificial Sequence
  Synthetic oligonucleotide
tggaaggaggtgcgggaagaaaggtttgtgggggaga

SEQ ID NO: 61876 - DNA, 36 bp, Artificial Sequence
  Synthetic oligonucleotide
tgggccaagtatggaatgagggaatggagtgggaga

SEQ ID NO: 61877 - DNA, 37 bp, Artificial Sequence
  Synthetic oligonucleotide
gggaccgccagtcgccattcttcccgcaccaacacga

SEQ ID NO: 61878 - DNA, 37 bp, Artificial Sequence
  Synthetic oligonucleotide
ttatgggtggggtgttaatgggcgggagtgctcacga

SEQ ID NO: 61879 - DNA, 37 bp, Artificial Sequence
  Synthetic oligonucleotide
aataggtagggggagaaggtgggatggtcgacgacga

SEQ ID NO: 61880 - DNA, 37 bp, Artificial Sequence
  Synthetic oligonucleotide
gtggttctggcctgccgctgcttttatcctgttccga

SEQ ID NO: 61881 - DNA, 37 bp, Artificial Sequence
  Synthetic oligonucleotide
gcctgccccgccttttgggttagctgtaactttccga

SEQ ID NO: 61882 - DNA, 36 bp, Artificial Sequence
  Synthetic oligonucleotide
gttgacgaggtgatattatcagtgaagagggggcga

SEQ ID NO: 61883 - DNA, 37 bp, Artificial Sequence
  Synthetic oligonucleotide
gatgcgggggtggaagtgagacgttacgggatatcga

SEQ ID NO: 61884 - DNA, 37 bp, Artificial Sequence
  Synthetic oligonucleotide
tgacggtggggggggggctgtaggacgctcgggagga

SEQ ID NO: 61885 - DNA, 36 bp, Artificial Sequence
  Synthetic oligonucleotide
atcatcgcccttgaaatggttcaagctgccctagga

SEQ ID NO: 61886 - DNA, 37 bp, Artificial Sequence
  Synthetic oligonucleotide
gacgaaggtcaagggcagactaagtgccacgtgggga

SEQ ID NO: 61887 - DNA, 38 bp, Artificial Sequence
  Synthetic oligonucleotide
gactgattcggaagagggagacggggggagggcaatga

SEQ ID NO: 61888 - DNA, 37 bp, Artificial Sequence
  Synthetic oligonucleotide
gtcagggaggcgaaggtagggagggaagtgtacatga

SEQ ID NO: 61889 - DNA, 37 bp, Artificial Sequence
  Synthetic oligonucleotide
tctcgacaacggtcgtccctgtcttttgataccatga

SEQ ID NO: 61890 - DNA, 38 bp, Artificial Sequence
  Synthetic oligonucleotide
tccccatttgaactcgcataaaccagtcctcaccctga

SEQ ID NO: 61891 - DNA, 38 bp, Artificial Sequence
  Synthetic oligonucleotide
atcagccccccgcacttgtacgccgctaaggaccctga

SEQ ID NO: 61892 - DNA, 38 bp, Artificial Sequence
  Synthetic oligonucleotide
tccggaggaacgttcagtccctatgtagatttccctga

SEQ ID NO: 61893 - DNA, 38 bp, Artificial Sequence
  Synthetic oligonucleotide
gatccacagagaggagggaagaatgatgtcatgagtga

SEQ ID NO: 61894 - DNA, 38 bp, Artificial Sequence
  Synthetic oligonucleotide
gtaggcacccacccaccagcctctaccgacagctgtga

SEQ ID NO: 61895 - DNA, 37 bp, Artificial Sequence
  Synthetic oligonucleotide
tcacgtcatagtcgggggagggaagcggaaaacttga

SEQ ID NO: 61896 - DNA, 38 bp, Artificial Sequence
  Synthetic oligonucleotide
gaccacgcttcatagtccttttttgcgcctctacttga

SEQ ID NO: 61897 - DNA, 37 bp, Artificial Sequence
  Synthetic oligonucleotide
tccacggtccagggttctaaatttttctgcacgttga

SEQ ID NO: 61898 - DNA, 37 bp, Artificial Sequence
  Synthetic oligonucleotide
ttcgagccccccatggtagcacaccgattttcgttga

SEQ ID NO: 61899 - DNA, 38 bp, Artificial Sequence
  Synthetic oligonucleotide
gcactctgtccgcagttccgccctttatagtttgttga

SEQ ID NO: 61900 - DNA, 36 bp, Artificial Sequence
  Synthetic oligonucleotide
tgtcgccatgcacagtctgggttttccaccgcaata

SEQ ID NO: 61901 - DNA, 36 bp, Artificial Sequence
  Synthetic oligonucleotide
gaccgagggccgactcccttttcgccgttcccgcta

SEQ ID NO: 61902 - DNA, 35 bp, Artificial Sequence
  Synthetic oligonucleotide
aatcgccccccatttcctggtaccgtgtaggaaac

SEQ ID NO: 61903 - DNA, 35 bp, Artificial Sequence
  Synthetic oligonucleotide
tccgtacccctgttcaatctcttcccctgtagaac

SEQ ID NO: 61904 - DNA, 35 bp, Artificial Sequence
  Synthetic oligonucleotide
gaaaagcccccacctagtttatcatgtcgcctaac

SEQ ID NO: 61905 - DNA, 35 bp, Artificial Sequence
  Synthetic oligonucleotide
gttaaatgcggccaccgtacacctgggcaccccac

SEQ ID NO: 61906 - DNA, 35 bp, Artificial Sequence
  Synthetic oligonucleotide
gagaccagcagcccgtgccgtttcacacctttcac

SEQ ID NO: 61907 - DNA, 35 bp, Artificial Sequence
  Synthetic oligonucleotide
tacaatatacgggccatcggcattgcactccctcc

SEQ ID NO: 61908 - DNA, 35 bp, Artificial Sequence
  Synthetic oligonucleotide
tacatctgcactgagggccaagatagtctccctgc

SEQ ID NO: 61909 - DNA, 35 bp, Artificial Sequence
  Synthetic oligonucleotide
acgtacaccccttgccgcctttgattcttgcctgc

SEQ ID NO: 61910 - DNA, 35 bp, Artificial Sequence
  Synthetic oligonucleotide
gaccgggccgctaacgttcttcccccgtgtaactc

SEQ ID NO: 61911 - DNA, 35 bp, Artificial Sequence
  Synthetic oligonucleotide
tccggggcctagcagagtcattaccgttgatcctc

SEQ ID NO: 61912 - DNA, 34 bp, Artificial Sequence
  Synthetic oligonucleotide
gccacacctagggaaactgttgcacactgaagtc

SEQ ID NO: 61913 - DNA, 35 bp, Artificial Sequence
  Synthetic oligonucleotide
gcagacgttcagcggtactgccccactaactggtc

SEQ ID NO: 61914 - DNA, 35 bp, Artificial Sequence
  Synthetic oligonucleotide
tcaccttaattgcctccacatactgctcgataacg

SEQ ID NO: 61915 - DNA, 35 bp, Artificial Sequence
  Synthetic oligonucleotide
gccccaccgcctcagtctgcaatccggtccgtacg

SEQ ID NO: 61916 - DNA, 34 bp, Artificial Sequence
  Synthetic oligonucleotide
acatacaccctcaactcgccggacacacccaccg

SEQ ID NO: 61917 - DNA, 35 bp, Artificial Sequence
  Synthetic oligonucleotide
tgctatcacactcgaggttgttacacatttccctg

SEQ ID NO: 61918 - DNA, 35 bp, Artificial Sequence
  Synthetic oligonucleotide
atcaactgctaccagtcccacctccattgagcgat

SEQ ID NO: 61919 - DNA, 35 bp, Artificial Sequence
  Synthetic oligonucleotide
tggtgcaaaggagtggcgtgggaaatgaagggtat

SEQ ID NO: 61920 - DNA, 35 bp, Artificial Sequence
  Synthetic oligonucleotide
gaccaccctggttcgtgtaccctcttgtgcctact

SEQ ID NO: 61921 - DNA, 35 bp, Artificial Sequence
  Synthetic oligonucleotide
accgcccatcctcccggaatcttgaatccgaccct

SEQ ID NO: 61922 - DNA, 35 bp, Artificial Sequence
  Synthetic oligonucleotide
tgcacacgatctcagcgatcaagctgtatacctct

SEQ ID NO: 61923 - DNA, 35 bp, Artificial Sequence
  Synthetic oligonucleotide
aatctgggggacgcgacatggggtagggagtgggt

SEQ ID NO: 61924 - DNA, 36 bp, Artificial Sequence
  Synthetic oligonucleotide
ttggggccaggaagtcgttcgttccgtggttttatt

SEQ ID NO: 61925 - DNA, 35 bp, Artificial Sequence
  Synthetic oligonucleotide
tacgacacccatgccgtacctttcgaggtatactt

SEQ ID NO: 61926 - DNA, 35 bp, Artificial Sequence
  Synthetic oligonucleotide
gcgccaagccgcttctacagattcgtgcccctctt

SEQ ID NO: 61927 - DNA, 35 bp, Artificial Sequence
  Synthetic oligonucleotide
taggactcgttgcccgttacgttaatctcccagtt

SEQ ID NO: 61928 - DNA, 35 bp, Artificial Sequence
  Synthetic oligonucleotide
atccctgctgcgcaaagccacgcactctgttggtt

SEQ ID NO: 61929 - DNA, 35 bp, Artificial Sequence
  Synthetic oligonucleotide
tgttgccaacaggtgcgtgccccaaccgcaaattt

SEQ ID NO: 61930 - DNA, 35 bp, Artificial Sequence
  Synthetic oligonucleotide
acccgcccacatccctagtagggcgtgactctttt

SEQ ID NO: 61931 - DNA, 36 bp, Artificial Sequence
  Synthetic oligonucleotide
tgaggggctcaggaaaggcatgaatgatggcaaaaa

SEQ ID NO: 61932 - DNA, 36 bp, Artificial Sequence
  Synthetic oligonucleotide
ttgatacgccagccttgtctcttgccttgcccacaa

SEQ ID NO: 61933 - DNA, 35 bp, Artificial Sequence
  Synthetic oligonucleotide
gagaggggacacatgagcttatggcggtgggacaa

SEQ ID NO: 61934 - DNA, 35 bp, Artificial Sequence
  Synthetic oligonucleotide
gtacgatcgggggtaccgctggggtgaggagggaa

SEQ ID NO: 61935 - DNA, 36 bp, Artificial Sequence
  Synthetic oligonucleotide
tttgcaaccccgcctgtccttccgggtgaccatgaa

SEQ ID NO: 61936 - DNA, 36 bp, Artificial Sequence
  Synthetic oligonucleotide
tacactccttctgcagaaactttgagctctctcaca

SEQ ID NO: 61937 - DNA, 36 bp, Artificial Sequence
  Synthetic oligonucleotide
gattcccccgtagttctgtatacgtcttctgataca

SEQ ID NO: 61938 - DNA, 36 bp, Artificial Sequence
  Synthetic oligonucleotide
tcgaccctacccgaatggtgttcgttcacacaacca

SEQ ID NO: 61939 - DNA, 36 bp, Artificial Sequence
  Synthetic oligonucleotide
ggtagggccccttcagcgtaggctcgcatttcacca

SEQ ID NO: 61940 - DNA, 36 bp, Artificial Sequence
  Synthetic oligonucleotide
acacgttctcacccgcgcacgcgatattatgcccca

SEQ ID NO: 61941 - DNA, 35 bp, Artificial Sequence
  Synthetic oligonucleotide
aggagcgaacggggaaggggtaaggttagggtcca

SEQ ID NO: 61942 - DNA, 35 bp, Artificial Sequence
  Synthetic oligonucleotide
ggactgagcattgtccttcaccgtcctaaatatca

SEQ ID NO: 61943 - DNA, 36 bp, Artificial Sequence
  Synthetic oligonucleotide
tgaccggccttcctgcccgctattacggtttactca

SEQ ID NO: 61944 - DNA, 36 bp, Artificial Sequence
  Synthetic oligonucleotide
gaggagctcccgaggtgcgcatgtcaccattcctca

SEQ ID NO: 61945 - DNA, 36 bp, Artificial Sequence
  Synthetic oligonucleotide
aatcccctccctcgcccgccgcccttgagcacgtca

SEQ ID NO: 61946 - DNA, 36 bp, Artificial Sequence
  Synthetic oligonucleotide
gtgctcccctggcgcccttgcatccctggtttttca

SEQ ID NO: 61947 - DNA, 37 bp, Artificial Sequence
  Synthetic oligonucleotide
gcgtgacgtgtaggtagtaagggaatggcgggaaaga

SEQ ID NO: 61948 - DNA, 37 bp, Artificial Sequence
  Synthetic oligonucleotide
tccgacctctgtctgttttcgcttaactgttcaccga

SEQ ID NO: 61949 - DNA, 36 bp, Artificial Sequence
  Synthetic oligonucleotide
gttaataccgcaccgcccgctcccagtcttgaccga

SEQ ID NO: 61950 - DNA, 36 bp, Artificial Sequence
  Synthetic oligonucleotide
tccatcttaaattgcccttcgtgatagttgcctcga

SEQ ID NO: 61951 - DNA, 37 bp, Artificial Sequence
  Synthetic oligonucleotide
gtcacctctacacgtggtaactactcattttctagga

SEQ ID NO: 61952 - DNA, 37 bp, Artificial Sequence
  Synthetic oligonucleotide
gcccagggccctccccaggaccacctaatttcacgga

SEQ ID NO: 61953 - DNA, 35 bp, Artificial Sequence
  Synthetic oligonucleotide
tccagctacgtatccgttcattctcgccactcgga

SEQ ID NO: 61954 - DNA, 37 bp, Artificial Sequence
  Synthetic oligonucleotide
acacacatcacttgcctaatgttctccacgggatgga

SEQ ID NO: 61955 - DNA, 36 bp, Artificial Sequence
  Synthetic oligonucleotide
acccgctgtgatgaagcccatctcgccccataatga

SEQ ID NO: 61956 - DNA, 38 bp, Artificial Sequence
  Synthetic oligonucleotide
gttgagaaggaggagtaggacctgggcgaagaggatga

SEQ ID NO: 61957 - DNA, 38 bp, Artificial Sequence
  Synthetic oligonucleotide
actgacgtagggggtgttgaaggaatcggtagctatga

SEQ ID NO: 61958 - DNA, 38 bp, Artificial Sequence
  Synthetic oligonucleotide
gtttgccccctgcatgttgccgtttctacatcacctga

SEQ ID NO: 61959 - DNA, 38 bp, Artificial Sequence
  Synthetic oligonucleotide
actgagccaccataatgtagatccctgctaatgcctga

SEQ ID NO: 61960 - DNA, 38 bp, Artificial Sequence
  Synthetic oligonucleotide
gacgacggctaccttatgcggtatctaacaccctctga

SEQ ID NO: 61961 - DNA, 37 bp, Artificial Sequence
  Synthetic oligonucleotide
tccacgtgccgacccctcgcgccctagactgtagtga

SEQ ID NO: 61962 - DNA, 38 bp, Artificial Sequence
  Synthetic oligonucleotide
aaacacccatgaactatccgtggtacgtcacttagtga

SEQ ID NO: 61963 - DNA, 38 bp, Artificial Sequence
  Synthetic oligonucleotide
cttggcccgtcccacttcatccgcataccagctcgtga

SEQ ID NO: 61964 - DNA, 38 bp, Artificial Sequence
  Synthetic oligonucleotide
tatggcatcagaacgagcattgggttgtgggggggtga

SEQ ID NO: 61965 - DNA, 36 bp, Artificial Sequence
  Synthetic oligonucleotide
tcacaaggtcaccacgcagctctccctcttttgtga

SEQ ID NO: 61966 - DNA, 37 bp, Artificial Sequence
  Synthetic oligonucleotide
gcccgcccctcaatctagtattgcacttacaccttga

SEQ ID NO: 61967 - DNA, 36 bp, Artificial Sequence
  Synthetic oligonucleotide
acgaacggtggtggaggtgggccgtaccatcgaata

SEQ ID NO: 61968 - DNA, 36 bp, Artificial Sequence
  Synthetic oligonucleotide
accctcgctgcctacacaagcccccaccatgagata

SEQ ID NO: 61969 - DNA, 35 bp, Artificial Sequence
  Synthetic oligonucleotide
atcgaccccatacggcctcctttttgagaattata

SEQ ID NO: 61970 - DNA, 36 bp, Artificial Sequence
  Synthetic oligonucleotide
tctcccagctagacacggcaaccgcttcttcaccta

SEQ ID NO: 61971 - DNA, 36 bp, Artificial Sequence
  Synthetic oligonucleotide
ttccataccccggtgtcgcttgccgctttcctgcta

SEQ ID NO: 61972 - DNA, 35 bp, Artificial Sequence
  Synthetic oligonucleotide
acatgcgaacattgactccaccctaacttcgtgta

SEQ ID NO: 61973 - DNA, 36 bp, Artificial Sequence
  Synthetic oligonucleotide
gcccacccaacgacctcctgtttatgtttaagctta

SEQ ID NO: 61974 - DNA, 36 bp, Artificial Sequence
  Synthetic oligonucleotide
accctgcccgtcccaaatctggtgctaccggtctta

SEQ ID NO: 61975 - DNA, 35 bp, Artificial Sequence
  Synthetic oligonucleotide
gaatcatcagcttcctctcgccacgcatgccagac

SEQ ID NO: 61976 - DNA, 35 bp, Artificial Sequence
  Synthetic oligonucleotide
taccgaaacgttgtgtcctccgccctgccctctac

SEQ ID NO: 61977 - DNA, 35 bp, Artificial Sequence
  Synthetic oligonucleotide
gatccgcactccattatggctgtaactggtgcacc

SEQ ID NO: 61978 - DNA, 35 bp, Artificial Sequence
  Synthetic oligonucleotide
tcccatcccttttgcagttgagaagtctttgcacc

SEQ ID NO: 61979 - DNA, 35 bp, Artificial Sequence
  Synthetic oligonucleotide
tcagcgcggttacgtacgtttttgttctgccaccc

SEQ ID NO: 61980 - DNA, 35 bp, Artificial Sequence
  Synthetic oligonucleotide
tgaacaggccccttatagtaagtaatgtcgcaccc

SEQ ID NO: 61981 - DNA, 35 bp, Artificial Sequence
  Synthetic oligonucleotide
gtgagttagcagccgacgcacatcttttgcctccc

SEQ ID NO: 61982 - DNA, 35 bp, Artificial Sequence
  Synthetic oligonucleotide
tccatagccaggaattcgcccattgatcttctccc

SEQ ID NO: 61983 - DNA, 35 bp, Artificial Sequence
  Synthetic oligonucleotide
ttcgtgttccgtaaacgcctattcaagcgggctcc

SEQ ID NO: 61984 - DNA, 35 bp, Artificial Sequence
  Synthetic oligonucleotide
tccacacctacgcactgtgcacctatacacgttcc

SEQ ID NO: 61985 - DNA, 34 bp, Artificial Sequence
  Synthetic oligonucleotide
gacttgcatccagtgcgccgcctctaaatgtcgc

SEQ ID NO: 61986 - DNA, 35 bp, Artificial Sequence
  Synthetic oligonucleotide
gtctgaccgccgactcattcctatgcgatcctctc

SEQ ID NO: 61987 - DNA, 35 bp, Artificial Sequence
  Synthetic oligonucleotide
ggacctaaacccagttgcattgtgaacacgttctc

SEQ ID NO: 61988 - DNA, 35 bp, Artificial Sequence
  Synthetic oligonucleotide
tcctggggtcccgtcacctgttttggcgttttctc

SEQ ID NO: 61989 - DNA, 35 bp, Artificial Sequence
  Synthetic oligonucleotide
gaccatttccccatctcgctgctatctgcgcggtc

SEQ ID NO: 61990 - DNA, 35 bp, Artificial Sequence
  Synthetic oligonucleotide
gatgtcgccggtccaccctccattcaatgcgattc

SEQ ID NO: 61991 - DNA, 35 bp, Artificial Sequence
  Synthetic oligonucleotide
ccacgtccatagccctgtagtgtcttcctgtcttc

SEQ ID NO: 61992 - DNA, 35 bp, Artificial Sequence
  Synthetic oligonucleotide
tccccggtctcagaaatcagcgcttttgaccgttc

SEQ ID NO: 61993 - DNA, 35 bp, Artificial Sequence
  Synthetic oligonucleotide
actcatgtccgttgctccttctttacgtcctgctg

SEQ ID NO: 61994 - DNA, 35 bp, Artificial Sequence
  Synthetic oligonucleotide
gaaggacggtacggtatagggtagggaatggtaat

SEQ ID NO: 61995 - DNA, 35 bp, Artificial Sequence
  Synthetic oligonucleotide
tgagaggtcgctctttcagcctgcccctcacccct

SEQ ID NO: 61996 - DNA, 35 bp, Artificial Sequence
  Synthetic oligonucleotide
tctgagcgctaacatctacacgctcttttagccct

SEQ ID NO: 61997 - DNA, 35 bp, Artificial Sequence
  Synthetic oligonucleotide
agtaccaacacacggtgaagtgatacctttctcct

SEQ ID NO: 61998 - DNA, 35 bp, Artificial Sequence
  Synthetic oligonucleotide
agtggatgtccactgggccatgattctcaacttct

SEQ ID NO: 61999 - DNA, 35 bp, Artificial Sequence
  Synthetic oligonucleotide
atcacgaacatcccagttataactgcccacttcgt

SEQ ID NO: 62000 - DNA, 35 bp, Artificial Sequence
  Synthetic oligonucleotide
atacccgacaatcaaccgtgcttccaatcactggt

SEQ ID NO: 62001 - DNA, 35 bp, Artificial Sequence
  Synthetic oligonucleotide
gtcctcactccgtattagttactctcttgggcatt

SEQ ID NO: 62002 - DNA, 35 bp, Artificial Sequence
  Synthetic oligonucleotide
gacccggacactttccgagccccgattgaccgatt

SEQ ID NO: 62003 - DNA, 35 bp, Artificial Sequence
  Synthetic oligonucleotide
ttgtgaagcacaccacgagccaatatgccaacctt

SEQ ID NO: 62004 - DNA, 35 bp, Artificial Sequence
  Synthetic oligonucleotide
tcgccccggatcctctcacggcaccctcactgctt

SEQ ID NO: 62005 - DNA, 35 bp, Artificial Sequence
  Synthetic oligonucleotide
ataggtgccgaatgaaatagggtcgggagggggtt

SEQ ID NO: 62006 - DNA, 35 bp, Artificial Sequence
  Synthetic oligonucleotide
gtgatcccttcatccatataatgtgactgcctttt

SEQ ID NO: 62007 - DNA, 35 bp, Artificial Sequence
  Synthetic oligonucleotide
gcattatcgccgcatctcttggctgaaccccccaa

SEQ ID NO: 62008 - DNA, 36 bp, Artificial Sequence
  Synthetic oligonucleotide
taccgcccccccgtctaaatcttgggaaattttcaa

SEQ ID NO: 62009 - DNA, 36 bp, Artificial Sequence
  Synthetic oligonucleotide
atctgctcacggagcctaaaccacctccctttcgaa

SEQ ID NO: 62010 - DNA, 36 bp, Artificial Sequence
  Synthetic oligonucleotide
gcgccggatccggagggagtagtggggtggtatgaa

SEQ ID NO: 62011 - DNA, 36 bp, Artificial Sequence
  Synthetic oligonucleotide
acactacctcccccagcacagtcaaccagtgcttaa

SEQ ID NO: 62012 - DNA, 35 bp, Artificial Sequence
  Synthetic oligonucleotide
ttacgccctaattttgtcgggaacagacctacaca

SEQ ID NO: 62013 - DNA, 36 bp, Artificial Sequence
  Synthetic oligonucleotide
aggatgcgcaagtctcgtctctttggttattacaca

SEQ ID NO: 62014 - DNA, 36 bp, Artificial Sequence
  Synthetic oligonucleotide
gaatctgcgtggtaggggctggcttggtgatggaca

SEQ ID NO: 62015 - DNA, 36 bp, Artificial Sequence
  Synthetic oligonucleotide
actccccacaacgagtcatctaaaagactcatgaca

SEQ ID NO: 62016 - DNA, 35 bp, Artificial Sequence
  Synthetic oligonucleotide
tatctcagccattattctacgccaccttgcgggca

SEQ ID NO: 62017 - DNA, 36 bp, Artificial Sequence
  Synthetic oligonucleotide
taaccacccctatcagataccattacttttgagtca

SEQ ID NO: 62018 - DNA, 37 bp, Artificial Sequence
  Synthetic oligonucleotide
aagtacgcagtcgtcttcgtttttagttgaggtcaga

SEQ ID NO: 62019 - DNA, 37 bp, Artificial Sequence
  Synthetic oligonucleotide
gacgcgcccctgagcatgtaagttgtcacccttacga

SEQ ID NO: 62020 - DNA, 35 bp, Artificial Sequence
  Synthetic oligonucleotide
taccgtactcccttgactcacgtagtccacgccga

SEQ ID NO: 62021 - DNA, 37 bp, Artificial Sequence
  Synthetic oligonucleotide
tttcgctgctgaggccctcacctactcttcctggcga

SEQ ID NO: 62022 - DNA, 37 bp, Artificial Sequence
  Synthetic oligonucleotide
ggtgcatcgcgaaaaaggggggaaatgtggcgaagga

SEQ ID NO: 62023 - DNA, 37 bp, Artificial Sequence
  Synthetic oligonucleotide
agatgcacatcgcgaataatggcacacctctgacgga

SEQ ID NO: 62024 - DNA, 37 bp, Artificial Sequence
  Synthetic oligonucleotide
aggggggtggttcgtggggtaagtgggagggccggga

SEQ ID NO: 62025 - DNA, 37 bp, Artificial Sequence
  Synthetic oligonucleotide
gagtgtgttagtggggttgagggtgggttgctgtgga

SEQ ID NO: 62026 - DNA, 36 bp, Artificial Sequence
  Synthetic oligonucleotide
tcctggccccaatgattcctggccatcaacaaatga

SEQ ID NO: 62027 - DNA, 38 bp, Artificial Sequence
  Synthetic oligonucleotide
gcaccctcacccgtacctatggacccgtgcccccatga

SEQ ID NO: 62028 - DNA, 37 bp, Artificial Sequence
  Synthetic oligonucleotide
ggacaatcacgcactccgtaacacgcctctcctatga

SEQ ID NO: 62029 - DNA, 38 bp, Artificial Sequence
  Synthetic oligonucleotide
acaccccattgggatagcgggaaccgccgctttactga

SEQ ID NO: 62030 - DNA, 38 bp, Artificial Sequence
  Synthetic oligonucleotide
gtcaccgcccgttggctttgctccgactgttcttctga

SEQ ID NO: 62031 - DNA, 37 bp, Artificial Sequence
  Synthetic oligonucleotide
agtgtgacagtgttaaggggagtgcggggaaaagtga

SEQ ID NO: 62032 - DNA, 38 bp, Artificial Sequence
  Synthetic oligonucleotide
taccaaccctctggttacacttgccgtccctccagtga

SEQ ID NO: 62033 - DNA, 37 bp, Artificial Sequence
  Synthetic oligonucleotide
gtgtacagagtggggtaaggaggtggtgggggagtga

SEQ ID NO: 62034 - DNA, 38 bp, Artificial Sequence
  Synthetic oligonucleotide
ttggtggtcggtccgggggtaaggaggaagggtcgtga

SEQ ID NO: 62035 - DNA, 38 bp, Artificial Sequence
  Synthetic oligonucleotide
acagaccagaggacgggtactagatggaatggcggtga

SEQ ID NO: 62036 - DNA, 38 bp, Artificial Sequence
  Synthetic oligonucleotide
tcatcagtagtcccgtagacagcgaggggggagggtga

SEQ ID NO: 62037 - DNA, 38 bp, Artificial Sequence
  Synthetic oligonucleotide
aacaccgcccgaagggaatctaaccgtagtacctgtga

SEQ ID NO: 62038 - DNA, 38 bp, Artificial Sequence
  Synthetic oligonucleotide
gtgggggtccaggaacgggggagacaatgggaaattga

SEQ ID NO: 62039 - DNA, 37 bp, Artificial Sequence
  Synthetic oligonucleotide
aaccataccacaatcgaatcagcgggcacagcattga

SEQ ID NO: 62040 - DNA, 37 bp, Artificial Sequence
  Synthetic oligonucleotide
atagaccgaggccggtcttagtatcactccatattga

SEQ ID NO: 62041 - DNA, 38 bp, Artificial Sequence
  Synthetic oligonucleotide
tgcacggtcagggaagcggtgcacgggttgcatattga

SEQ ID NO: 62042 - DNA, 38 bp, Artificial Sequence
  Synthetic oligonucleotide
gcagggcaggcactcgatgccctacactttcctattga

SEQ ID NO: 62043 - DNA, 37 bp, Artificial Sequence
  Synthetic oligonucleotide
ccgcattccctaacctctatgcttacagtaaccttga

SEQ ID NO: 62044 - DNA, 37 bp, Artificial Sequence
  Synthetic oligonucleotide
acatccgtcgtagtctatctggtaacgctcaccttga

SEQ ID NO: 62045 - DNA, 38 bp, Artificial Sequence
  Synthetic oligonucleotide
agtgtcgcactggctcacatttggcctccatttcttga

SEQ ID NO: 62046 - DNA, 37 bp, Artificial Sequence
  Synthetic oligonucleotide
gtgtcgccgccatatattgttgctgatggctcgttga

SEQ ID NO: 62047 - DNA, 36 bp, Artificial Sequence
  Synthetic oligonucleotide
agtgcaaggggcataccagggtggaggtcgaaaata

SEQ ID NO: 62048 - DNA, 36 bp, Artificial Sequence
  Synthetic oligonucleotide
gtccaagccggcaatctattggcactcggttttcta

SEQ ID NO: 62049 - DNA, 36 bp, Artificial Sequence
  Synthetic oligonucleotide
tcaccctgccatgccaacaggtctatcaaagccgta

SEQ ID NO: 62050 - DNA, 36 bp, Artificial Sequence
  Synthetic oligonucleotide
gctggctgattacctttgtcttagtgtccctccgta

SEQ ID NO: 62051 - DNA, 34 bp, Artificial Sequence
  Synthetic oligonucleotide
gtccccactatggcatggaacatggccaactgta

SEQ ID NO: 62052 - DNA, 35 bp, Artificial Sequence
  Synthetic oligonucleotide
taggcactcacattacgaaatatgcccgttgtcac

SEQ ID NO: 62053 - DNA, 35 bp, Artificial Sequence
  Synthetic oligonucleotide
ccatactctgcctgttccaacatcacgacgttcac

SEQ ID NO: 62054 - DNA, 35 bp, Artificial Sequence
  Synthetic oligonucleotide
gaagccacccctgatcgaagagccctgactttcac

SEQ ID NO: 62055 - DNA, 35 bp, Artificial Sequence
  Synthetic oligonucleotide
gttgcgccgtcttcctacgcgtttccgcctcatac

SEQ ID NO: 62056 - DNA, 35 bp, Artificial Sequence
  Synthetic oligonucleotide
agtacggcacaggtagccttcaacaggcccttccc

SEQ ID NO: 62057 - DNA, 35 bp, Artificial Sequence
  Synthetic oligonucleotide
ttgcgaaccgacggcctgcccttagcttacatgcc

SEQ ID NO: 62058 - DNA, 35 bp, Artificial Sequence
  Synthetic oligonucleotide
aacaaaggcgctgccttggttcgccgtaacttatc

SEQ ID NO: 62059 - DNA, 35 bp, Artificial Sequence
  Synthetic oligonucleotide
atgcggaaggcgaagtccgctcaccccctacattc

SEQ ID NO: 62060 - DNA, 35 bp, Artificial Sequence
  Synthetic oligonucleotide
ggtctacggggagttcgggacgggtggttggaaag

SEQ ID NO: 62061 - DNA, 35 bp, Artificial Sequence
  Synthetic oligonucleotide
aactcgcgcgctgctgttagtactatcctcttccg

SEQ ID NO: 62062 - DNA, 35 bp, Artificial Sequence
  Synthetic oligonucleotide
tgcccaccccatattcataatgctgtgctaaagcg

SEQ ID NO: 62063 - DNA, 35 bp, Artificial Sequence
  Synthetic oligonucleotide
gatcgtgtcggggggattggtcgaaggggagtgcg

SEQ ID NO: 62064 - DNA, 35 bp, Artificial Sequence
  Synthetic oligonucleotide
atcacacacacgggcctattataagcctcatacgg

SEQ ID NO: 62065 - DNA, 35 bp, Artificial Sequence
  Synthetic oligonucleotide
tagatgggacaggacaaggtcggatgagaagtatg

SEQ ID NO: 62066 - DNA, 35 bp, Artificial Sequence
  Synthetic oligonucleotide
attgtccatacctacaatgcacacacttcccgttg

SEQ ID NO: 62067 - DNA, 35 bp, Artificial Sequence
  Synthetic oligonucleotide
tcaaaggtgtcggggtaagggaggataggtgccat

SEQ ID NO: 62068 - DNA, 35 bp, Artificial Sequence
  Synthetic oligonucleotide
gggtgatgggagggcaaaaggtcgtgggggctcat

SEQ ID NO: 62069 - DNA, 35 bp, Artificial Sequence
  Synthetic oligonucleotide
gttaccatctgcgaaccgtatctggcctcttttat

SEQ ID NO: 62070 - DNA, 35 bp, Artificial Sequence
  Synthetic oligonucleotide
gatcgtatgattggcgtgttgttctgctttcccct

SEQ ID NO: 62071 - DNA, 35 bp, Artificial Sequence
  Synthetic oligonucleotide
acccttcccccgttagaatgcaactcgcttacgct

SEQ ID NO: 62072 - DNA, 35 bp, Artificial Sequence
  Synthetic oligonucleotide
taagaactatgcgcacactgtttcctgcactatct

SEQ ID NO: 62073 - DNA, 35 bp, Artificial Sequence
  Synthetic oligonucleotide
atacccgttccagtgccacgctgagtttcctgtgt

SEQ ID NO: 62074 - DNA, 35 bp, Artificial Sequence
  Synthetic oligonucleotide
tccataccgaacgtacaggctcgccgttatcactt

SEQ ID NO: 62075 - DNA, 35 bp, Artificial Sequence
  Synthetic oligonucleotide
ttagcctgccacgagcgttctctaccatttagctt

SEQ ID NO: 62076 - DNA, 35 bp, Artificial Sequence
  Synthetic oligonucleotide
accacgttgctactcctggtttagttttacttttt

SEQ ID NO: 62077 - DNA, 36 bp, Artificial Sequence
  Synthetic oligonucleotide
gctgaaacggcgccaccttcattgcatgcccgtaaa

SEQ ID NO: 62078 - DNA, 35 bp, Artificial Sequence
  Synthetic oligonucleotide
ggaccactcagtggtactcgatcgttacccttcaa

SEQ ID NO: 62079 - DNA, 36 bp, Artificial Sequence
  Synthetic oligonucleotide
tacgcccgtgcgaccctagaccccgccacattggaa

SEQ ID NO: 62080 - DNA, 35 bp, Artificial Sequence
  Synthetic oligonucleotide
tcaggacgatagcttgggcgagggggatcggtgaa

SEQ ID NO: 62081 - DNA, 36 bp, Artificial Sequence
  Synthetic oligonucleotide
gcatagcaccatccatacactgctataatgtcctaa

SEQ ID NO: 62082 - DNA, 36 bp, Artificial Sequence
  Synthetic oligonucleotide
accagctgaacctgtttcaccgcccggagacccaca

SEQ ID NO: 62083 - DNA, 36 bp, Artificial Sequence
  Synthetic oligonucleotide
gtcacccccagccttgctcaccccgcattgcaacca

SEQ ID NO: 62084 - DNA, 35 bp, Artificial Sequence
  Synthetic oligonucleotide
acctccgcccgtaaagcccggggagtagtacacca

SEQ ID NO: 62085 - DNA, 36 bp, Artificial Sequence
  Synthetic oligonucleotide
ggctctaccccgctccatgttctgtacaaactacca

SEQ ID NO: 62086 - DNA, 35 bp, Artificial Sequence
  Synthetic oligonucleotide
acgtgaaccacccacatcggaattcctcttgagca

SEQ ID NO: 62087 - DNA, 36 bp, Artificial Sequence
  Synthetic oligonucleotide
gaactcgcagtacgagccctattgttacctccatca

SEQ ID NO: 62088 - DNA, 36 bp, Artificial Sequence
  Synthetic oligonucleotide
gttggacaccgacagctgacattctgccattgatca

SEQ ID NO: 62089 - DNA, 36 bp, Artificial Sequence
  Synthetic oligonucleotide
ttgaccctcccgtggaatctcgcatacatagcctca

SEQ ID NO: 62090 - DNA, 35 bp, Artificial Sequence
  Synthetic oligonucleotide
attacctcatgatgcggcacctaattcatctctca

SEQ ID NO: 62091 - DNA, 37 bp, Artificial Sequence
  Synthetic oligonucleotide
taacctctcacatcgacggcttgtctacgccccaaga

SEQ ID NO: 62092 - DNA, 37 bp, Artificial Sequence
  Synthetic oligonucleotide
tcacgatgcctgctgaactggcttatgttctccccga

SEQ ID NO: 62093 - DNA, 37 bp, Artificial Sequence
  Synthetic oligonucleotide
gtgcaaccccgacccgccccctatttgataacatcga

SEQ ID NO: 62094 - DNA, 37 bp, Artificial Sequence
  Synthetic oligonucleotide
acccgcgttggcgctaatattaacccttttctttcga

SEQ ID NO: 62095 - DNA, 37 bp, Artificial Sequence
  Synthetic oligonucleotide
tcgcgccccccatttttctaagaccctctcactagga

SEQ ID NO: 62096 - DNA, 36 bp, Artificial Sequence
  Synthetic oligonucleotide
tcatacctccgagtagcaagcttttctgtcaacgga

SEQ ID NO: 62097 - DNA, 36 bp, Artificial Sequence
  Synthetic oligonucleotide
gtggtgatacattgggggcgggatactaagagggga

SEQ ID NO: 62098 - DNA, 37 bp, Artificial Sequence
  Synthetic oligonucleotide
ggatggccgaagatttcgaggggcctgggtggtggga

SEQ ID NO: 62099 - DNA, 37 bp, Artificial Sequence
  Synthetic oligonucleotide
tcgccacctgcagggcaccttcgccatcttcactgga

SEQ ID NO: 62100 - DNA, 37 bp, Artificial Sequence
  Synthetic oligonucleotide
tgtgcaaatctcgtgcgatcccaccccattgtttgga

SEQ ID NO: 62101 - DNA, 38 bp, Artificial Sequence
  Synthetic oligonucleotide
tgcactcctcggccatgttccacagttgtccaccatga

SEQ ID NO: 62102 - DNA, 37 bp, Artificial Sequence
  Synthetic oligonucleotide
acctaaccggccggactgctaagcatccataccatga

SEQ ID NO: 62103 - DNA, 38 bp, Artificial Sequence
  Synthetic oligonucleotide
aaagtcgcagtcggatcagcactcgttcgcccctatga

SEQ ID NO: 62104 - DNA, 37 bp, Artificial Sequence
  Synthetic oligonucleotide
atcgtgtcggcaagacaccacacactctattctatga

SEQ ID NO: 62105 - DNA, 37 bp, Artificial Sequence
  Synthetic oligonucleotide
gtgttgagcacacgtctgttcatcctcacatccctga

SEQ ID NO: 62106 - DNA, 37 bp, Artificial Sequence
  Synthetic oligonucleotide
ttacccgcccacttgaatttttcgttgaagacgctga

SEQ ID NO: 62107 - DNA, 38 bp, Artificial Sequence
  Synthetic oligonucleotide
tacatgtactgcccccccttgcggtctgcaaccgctga

SEQ ID NO: 62108 - DNA, 36 bp, Artificial Sequence
  Synthetic oligonucleotide
acgagcccattatttcttcgacgttttccgccgtga

SEQ ID NO: 62109 - DNA, 38 bp, Artificial Sequence
  Synthetic oligonucleotide
ttcgatcgcgccctgttggtgcctccctgatatcgtga

SEQ ID NO: 62110 - DNA, 38 bp, Artificial Sequence
  Synthetic oligonucleotide
gtactgacgaggagagggatgggatatgtgtgcggtga

SEQ ID NO: 62111 - DNA, 37 bp, Artificial Sequence
  Synthetic oligonucleotide
aaacctgcgcaggctatcgtgtcgcttccccttgtga

SEQ ID NO: 62112 - DNA, 38 bp, Artificial Sequence
  Synthetic oligonucleotide
tagcaccctgaccccccggaaaaaaaatgtagttgtga

SEQ ID NO: 62113 - DNA, 38 bp, Artificial Sequence
  Synthetic oligonucleotide
gatgcacgaactgaagcacggccacgccctttccttga

SEQ ID NO: 62114 - DNA, 38 bp, Artificial Sequence
  Synthetic oligonucleotide
gatcgctgccaccttcgaccccgttctattgggcttga

SEQ ID NO: 62115 - DNA, 38 bp, Artificial Sequence
  Synthetic oligonucleotide
agccgcggaatcgggtgaaatggaacgggaggtgttga

SEQ ID NO: 62116 - DNA, 38 bp, Artificial Sequence
  Synthetic oligonucleotide
gttggtactgcaggagtgacgtagggggtgcgttttga

SEQ ID NO: 62117 - DNA, 36 bp, Artificial Sequence
  Synthetic oligonucleotide
atcgtgaacccaatgcgcaccataactggcccaata

SEQ ID NO: 62118 - DNA, 35 bp, Artificial Sequence
  Synthetic oligonucleotide
gccaagcccctctcctggctttcagggataactta

SEQ ID NO: 62119 - DNA, 36 bp, Artificial Sequence
  Synthetic oligonucleotide
atgcgcgcctgcacttccgtcgaaaaatacgtctta

SEQ ID NO: 62120 - DNA, 36 bp, Artificial Sequence
  Synthetic oligonucleotide
caccacttgtcctcttttgtactcatcgcctgttta

SEQ ID NO: 62121 - DNA, 35 bp, Artificial Sequence
  Synthetic oligonucleotide
gaggacccatctctggatctttaatgaacccttac

SEQ ID NO: 62122 - DNA, 35 bp, Artificial Sequence
  Synthetic oligonucleotide
gaatccactgcccagagttaaaattcctccgtacc

SEQ ID NO: 62123 - DNA, 35 bp, Artificial Sequence
  Synthetic oligonucleotide
attgtgcgtttaggtcctctatcttcgttcacccc

SEQ ID NO: 62124 - DNA, 35 bp, Artificial Sequence
  Synthetic oligonucleotide
aatatcactcgccatccatatcttccatagtagcc

SEQ ID NO: 62125 - DNA, 35 bp, Artificial Sequence
  Synthetic oligonucleotide
gaccccacgggtgttagctcagcagcccagcctcc

SEQ ID NO: 62126 - DNA, 35 bp, Artificial Sequence
  Synthetic oligonucleotide
ttagccccactgtatgagttgtacctatcgcgtcc

SEQ ID NO: 62127 - DNA, 35 bp, Artificial Sequence
  Synthetic oligonucleotide
atactcgtgctgggaacactccttattgcccttgc

SEQ ID NO: 62128 - DNA, 35 bp, Artificial Sequence
  Synthetic oligonucleotide
gcaaccacccagcccttgtcccgactctgatcatc

SEQ ID NO: 62129 - DNA, 35 bp, Artificial Sequence
  Synthetic oligonucleotide
tccagtgtctcttccccaccattccgagcccgatc

SEQ ID NO: 62130 - DNA, 35 bp, Artificial Sequence
  Synthetic oligonucleotide
tcagctactccgaccaccgtatgccactcgcatgg

SEQ ID NO: 62131 - DNA, 35 bp, Artificial Sequence
  Synthetic oligonucleotide
ggtaaggccggatatttttcaccactcaactttgg

SEQ ID NO: 62132 - DNA, 35 bp, Artificial Sequence
  Synthetic oligonucleotide
aacatacctcgatcccaaacgaacaccgcaccatg

SEQ ID NO: 62133 - DNA, 35 bp, Artificial Sequence
  Synthetic oligonucleotide
gttcacacgtatttctgccattcgctttacttttg

SEQ ID NO: 62134 - DNA, 35 bp, Artificial Sequence
  Synthetic oligonucleotide
gacctgagcacttgctacccgctactttcttctat

SEQ ID NO: 62135 - DNA, 35 bp, Artificial Sequence
  Synthetic oligonucleotide
gccatggacgccacaagtcgacctttgatcatact

SEQ ID NO: 62136 - DNA, 35 bp, Artificial Sequence
  Synthetic oligonucleotide
tccgcgccggcacccactcatcgctccatcgtcct

SEQ ID NO: 62137 - DNA, 35 bp, Artificial Sequence
  Synthetic oligonucleotide
tcaagtcccacctgtcatcagcaacgattgcttct

SEQ ID NO: 62138 - DNA, 35 bp, Artificial Sequence
  Synthetic oligonucleotide
gtctccgttccaggcacagtccacccatcctcagt

SEQ ID NO: 62139 - DNA, 35 bp, Artificial Sequence
  Synthetic oligonucleotide
gaagtgagacgagagagatagtgagtgaaggaggt

SEQ ID NO: 62140 - DNA, 35 bp, Artificial Sequence
  Synthetic oligonucleotide
tatgatgcaaatgtcccccgcctcgccatcactgt

SEQ ID NO: 62141 - DNA, 35 bp, Artificial Sequence
  Synthetic oligonucleotide
gaaacaaccccctcacctagcgcaggcatcctctt

SEQ ID NO: 62142 - DNA, 35 bp, Artificial Sequence
  Synthetic oligonucleotide
ggagtgggggatagcaagggtccgggagtgacgtt

SEQ ID NO: 62143 - DNA, 35 bp, Artificial Sequence
  Synthetic oligonucleotide
atcgtatgtctccctgcactctacccccgttggtt

SEQ ID NO: 62144 - DNA, 35 bp, Artificial Sequence
  Synthetic oligonucleotide
atggccctgtagaatgcaggccctatgactccaaa

SEQ ID NO: 62145 - DNA, 36 bp, Artificial Sequence
  Synthetic oligonucleotide
tgaacctagcgcccatcctgatcggccatgttcaaa

SEQ ID NO: 62146 - DNA, 36 bp, Artificial Sequence
  Synthetic oligonucleotide
cctaccgcgcccggtcattctaagttgctcgctaaa

SEQ ID NO: 62147 - DNA, 35 bp, Artificial Sequence
  Synthetic oligonucleotide
tacccacacactacatctcaagcctacgttgccaa

SEQ ID NO: 62148 - DNA, 36 bp, Artificial Sequence
  Synthetic oligonucleotide
tctccatatcgcctagttgcggagccaaaccatcaa

SEQ ID NO: 62149 - DNA, 36 bp, Artificial Sequence
  Synthetic oligonucleotide
ttggtcacagcctacgacccgatcccgttacacgaa

SEQ ID NO: 62150 - DNA, 36 bp, Artificial Sequence
  Synthetic oligonucleotide
gggaactcaaagaggcggaggaaggggagtgcgtaa

SEQ ID NO: 62151 - DNA, 36 bp, Artificial Sequence
  Synthetic oligonucleotide
tctcgagcaaatgcgttactcgcaagacctcccaca

SEQ ID NO: 62152 - DNA, 35 bp, Artificial Sequence
  Synthetic oligonucleotide
taacactcatgatcgtccatcaatgagaaaaacca

SEQ ID NO: 62153 - DNA, 36 bp, Artificial Sequence
  Synthetic oligonucleotide
gtaggcgcacttcatctgattctctggttggcacca

SEQ ID NO: 62154 - DNA, 36 bp, Artificial Sequence
  Synthetic oligonucleotide
taccctgacccgtcctttatgttccgacttgcacca

SEQ ID NO: 62155 - DNA, 36 bp, Artificial Sequence
  Synthetic oligonucleotide
accacattccgaggaaggcatacactctccgtacca

SEQ ID NO: 62156 - DNA, 35 bp, Artificial Sequence
  Synthetic oligonucleotide
aaatcaccctagtcagcgtcaactcgccctccgca

SEQ ID NO: 62157 - DNA, 36 bp, Artificial Sequence
  Synthetic oligonucleotide
gactcgtgcagtattctccgttcctcgttctgcgca

SEQ ID NO: 62158 - DNA, 36 bp, Artificial Sequence
  Synthetic oligonucleotide
tacaggctgggcccccgttacatcaattcaccggca

SEQ ID NO: 62159 - DNA, 35 bp, Artificial Sequence
  Synthetic oligonucleotide
ttacacacagatgtattcccagtccctcgccctca

SEQ ID NO: 62160 - DNA, 35 bp, Artificial Sequence
  Synthetic oligonucleotide
cgcacctgcatacaaccccgcgaattgaggtctca

SEQ ID NO: 62161 - DNA, 37 bp, Artificial Sequence
  Synthetic oligonucleotide
gcatacgccgcgtagggggaggaaggggtgctgaaga

SEQ ID NO: 62162 - DNA, 35 bp, Artificial Sequence
  Synthetic oligonucleotide
atgggaggggaggggatagagaaagataacagaga

SEQ ID NO: 62163 - DNA, 37 bp, Artificial Sequence
  Synthetic oligonucleotide
tacgacatgacagcgggtgtgcccgatctactggaga

SEQ ID NO: 62164 - DNA, 37 bp, Artificial Sequence
  Synthetic oligonucleotide
taggaggaactgatgaacgaagtgtgggggctggaga

SEQ ID NO: 62165 - DNA, 35 bp, Artificial Sequence
  Synthetic oligonucleotide
tctgctcgctccggttcacattcaccactgctaga

SEQ ID NO: 62166 - DNA, 37 bp, Artificial Sequence
  Synthetic oligonucleotide
gccgaaaggcctctgactatcctcacgttcttgtaga

SEQ ID NO: 62167 - DNA, 37 bp, Artificial Sequence
  Synthetic oligonucleotide
agatcgtctgttccgtccctgcgcacccttttttaga

SEQ ID NO: 62168 - DNA, 37 bp, Artificial Sequence
  Synthetic oligonucleotide
accgccctgctgatacagcccgtataccccctaccga

SEQ ID NO: 62169 - DNA, 37 bp, Artificial Sequence
  Synthetic oligonucleotide
gatcgccacacgagtgaatcatatcgcatacccccga

SEQ ID NO: 62170 - DNA, 37 bp, Artificial Sequence
  Synthetic oligonucleotide
gtcatgacgctgccaatgtgcccccgactccgtccga

SEQ ID NO: 62171 - DNA, 37 bp, Artificial Sequence
  Synthetic oligonucleotide
aacaaccacctttattgggatcatcgccacccagcga

SEQ ID NO: 62172 - DNA, 37 bp, Artificial Sequence
  Synthetic oligonucleotide
gacccatcccaggacggcgttatacacataacaagga

SEQ ID NO: 62173 - DNA, 37 bp, Artificial Sequence
  Synthetic oligonucleotide
tctcctcccgccaccccccatcggctcggccgaagga

SEQ ID NO: 62174 - DNA, 37 bp, Artificial Sequence
  Synthetic oligonucleotide
ttggggtaggaagtttgtgtggggactatgggtagga

SEQ ID NO: 62175 - DNA, 36 bp, Artificial Sequence
  Synthetic oligonucleotide
tcacacaggatcgtgcccattattgctttcaccgga

SEQ ID NO: 62176 - DNA, 37 bp, Artificial Sequence
  Synthetic oligonucleotide
ttgaccgtttgcatccgcctgcccattttctcgggga

SEQ ID NO: 62177 - DNA, 37 bp, Artificial Sequence
  Synthetic oligonucleotide
acgacacccgttccggcatccttactttgcacatgga

SEQ ID NO: 62178 - DNA, 37 bp, Artificial Sequence
  Synthetic oligonucleotide
tgtgttcagcctcttccccttgcgtgtactacctgga

SEQ ID NO: 62179 - DNA, 37 bp, Artificial Sequence
  Synthetic oligonucleotide
tcatcacgctcgactaatactgcgctcattttctgga

SEQ ID NO: 62180 - DNA, 38 bp, Artificial Sequence
  Synthetic oligonucleotide
gatgcatgctgtgtactgtaagaaatgggcgagaatga

SEQ ID NO: 62181 - DNA, 38 bp, Artificial Sequence
  Synthetic oligonucleotide
ttgacctacttcctgctctgagatagtcgccaccatga

SEQ ID NO: 62182 - DNA, 38 bp, Artificial Sequence
  Synthetic oligonucleotide
tgagaggcgcgggaaggggagggacagggcccggatga

SEQ ID NO: 62183 - DNA, 37 bp, Artificial Sequence
  Synthetic oligonucleotide
ttcacccaccccgactgcatagtcacagtactgatga

SEQ ID NO: 62184 - DNA, 38 bp, Artificial Sequence
  Synthetic oligonucleotide
atgatgtgcccctccatcctgtgtccacactcacctga

SEQ ID NO: 62185 - DNA, 38 bp, Artificial Sequence
  Synthetic oligonucleotide
gacaaccctgcaacgccaatctatcgaatcatgcctga

SEQ ID NO: 62186 - DNA, 38 bp, Artificial Sequence
  Synthetic oligonucleotide
gctccacgcccattgtaaactgacctatctcgagctga

SEQ ID NO: 62187 - DNA, 38 bp, Artificial Sequence
  Synthetic oligonucleotide
ctccaatcccacctgagcatagccacaactcactctga

SEQ ID NO: 62188 - DNA, 37 bp, Artificial Sequence
  Synthetic oligonucleotide
acccagtgacaccctgatctaggccagccttacgtga

SEQ ID NO: 62189 - DNA, 38 bp, Artificial Sequence
  Synthetic oligonucleotide
acccgccttccgggccccgagactgttccgttgcgtga

SEQ ID NO: 62190 - DNA, 38 bp, Artificial Sequence
  Synthetic oligonucleotide
tttaccgcgctacgtcatgtcccttaaccccgtcgtga

SEQ ID NO: 62191 - DNA, 37 bp, Artificial Sequence
  Synthetic oligonucleotide
tgggtggcggggagaccaaggctgggaggggtggtga

SEQ ID NO: 62192 - DNA, 37 bp, Artificial Sequence
  Synthetic oligonucleotide
gagaggggctagtgggggcttaggtaggctgatgtga

SEQ ID NO: 62193 - DNA, 36 bp, Artificial Sequence
  Synthetic oligonucleotide
gaggtacgctccccctaccacacatccttgcattga

SEQ ID NO: 62194 - DNA, 38 bp, Artificial Sequence
  Synthetic oligonucleotide
gtgcctactatatgcctacgggatctgccccctattga

SEQ ID NO: 62195 - DNA, 36 bp, Artificial Sequence
  Synthetic oligonucleotide
tcgtaccggcccatgcgcggttttcctgtaacttga

SEQ ID NO: 62196 - DNA, 37 bp, Artificial Sequence
  Synthetic oligonucleotide
gccagtacgatctggctccctgttacctatctcttga

SEQ ID NO: 62197 - DNA, 38 bp, Artificial Sequence
  Synthetic oligonucleotide
ttgcgacgctccgttcatgtactacaccccccagttga

SEQ ID NO: 62198 - DNA, 36 bp, Artificial Sequence
  Synthetic oligonucleotide
accgacacgtgtgacccccgtcccctatggagcata

SEQ ID NO: 62199 - DNA, 36 bp, Artificial Sequence
  Synthetic oligonucleotide
ttccacccgcccgtcccgacggtgaacttctcgata

SEQ ID NO: 62200 - DNA, 36 bp, Artificial Sequence
  Synthetic oligonucleotide
tgcctcacctctcaatatcatccctgtgctcaacta

SEQ ID NO: 62201 - DNA, 35 bp, Artificial Sequence
  Synthetic oligonucleotide
acatgcactccaccgcattccccaaaggcagacta

SEQ ID NO: 62202 - DNA, 35 bp, Artificial Sequence
  Synthetic oligonucleotide
tgtctacctccctttgtccgcgaagaaaccgccta

SEQ ID NO: 62203 - DNA, 36 bp, Artificial Sequence
  Synthetic oligonucleotide
taggaaatgtccgttgcttcctagtcacccatccta

SEQ ID NO: 62204 - DNA, 36 bp, Artificial Sequence
  Synthetic oligonucleotide
atgatcatcggccaactatgaattgaactcatccta

SEQ ID NO: 62205 - DNA, 36 bp, Artificial Sequence
  Synthetic oligonucleotide
gaccataccattcgtagtgaccgatccaacttgcta

SEQ ID NO: 62206 - DNA, 35 bp, Artificial Sequence
  Synthetic oligonucleotide
gtcaggctatccggccgttttccgcccccatcgta

SEQ ID NO: 62207 - DNA, 35 bp, Artificial Sequence
  Synthetic oligonucleotide
gatctgttcccgcccaaccacctgtgtgtcattta

SEQ ID NO: 62208 - DNA, 35 bp, Artificial Sequence
  Synthetic oligonucleotide
atctgcccagaaatgctatcctggtctgttaacac

SEQ ID NO: 62209 - DNA, 35 bp, Artificial Sequence
  Synthetic oligonucleotide
taccacgtcgaacgaacacgcgcggttttctacac

SEQ ID NO: 62210 - DNA, 35 bp, Artificial Sequence
  Synthetic oligonucleotide
tctggacaactgagccgccttccagacaaagccac

SEQ ID NO: 62211 - DNA, 35 bp, Artificial Sequence
  Synthetic oligonucleotide
cagatagctccagcgttgcccctcccgttcacgac

SEQ ID NO: 62212 - DNA, 35 bp, Artificial Sequence
  Synthetic oligonucleotide
gcataagcccattccagctcccgcgtacaacaacc

SEQ ID NO: 62213 - DNA, 35 bp, Artificial Sequence
  Synthetic oligonucleotide
ttcgcacgcaatcgccgtcccctcccgaaaccacc

SEQ ID NO: 62214 - DNA, 35 bp, Artificial Sequence
  Synthetic oligonucleotide
tactcgtgaacaaatgccagcggatccttcgtacc

SEQ ID NO: 62215 - DNA, 35 bp, Artificial Sequence
  Synthetic oligonucleotide
acctgctgatgagaaatcgctggtctgcacctccc

SEQ ID NO: 62216 - DNA, 35 bp, Artificial Sequence
  Synthetic oligonucleotide
agccatggcgagtgctcttcgtgaggttccttccc

SEQ ID NO: 62217 - DNA, 35 bp, Artificial Sequence
  Synthetic oligonucleotide
tcttcaaccgctatgcaaccttcatgcatttcgcc

SEQ ID NO: 62218 - DNA, 35 bp, Artificial Sequence
  Synthetic oligonucleotide
gtaacactgacctactacacaccacgctatgggcc

SEQ ID NO: 62219 - DNA, 35 bp, Artificial Sequence
  Synthetic oligonucleotide
tccactttcagagtccgcgcgcccattttcgtgcc

SEQ ID NO: 62220 - DNA, 35 bp, Artificial Sequence
  Synthetic oligonucleotide
gacattcactagaacacggttcccaactggactcc

SEQ ID NO: 62221 - DNA, 35 bp, Artificial Sequence
  Synthetic oligonucleotide
gtggtcacagcttcataccatccctagcccgctgc

SEQ ID NO: 62222 - DNA, 35 bp, Artificial Sequence
  Synthetic oligonucleotide
acccttcatccacactgtatccgtggtacataatc

SEQ ID NO: 62223 - DNA, 35 bp, Artificial Sequence
  Synthetic oligonucleotide
tacacgttatggcccggcgacctctaacatcgatc

SEQ ID NO: 62224 - DNA, 35 bp, Artificial Sequence
  Synthetic oligonucleotide
gccactttcccatgcccttgctacagccactactc

SEQ ID NO: 62225 - DNA, 35 bp, Artificial Sequence
  Synthetic oligonucleotide
acttgcccgcagtcgtaaagtctacgctggaagtc

SEQ ID NO: 62226 - DNA, 36 bp, Artificial Sequence
  Synthetic oligonucleotide
gaccatcaagggcgatcgcacacgagttcactgttc

SEQ ID NO: 62227 - DNA, 35 bp, Artificial Sequence
  Synthetic oligonucleotide
aatgccggcccgtttccgcagtttaactactgttc

SEQ ID NO: 62228 - DNA, 35 bp, Artificial Sequence
  Synthetic oligonucleotide
tagccacgatgattctgaatgcattgacccgtttc

SEQ ID NO: 62229 - DNA, 35 bp, Artificial Sequence
  Synthetic oligonucleotide
gtgacgagtccctaggcactcattcgattcctacg

SEQ ID NO: 62230 - DNA, 35 bp, Artificial Sequence
  Synthetic oligonucleotide
ttggaaagggggaagggggccaggtggtccgtacg

SEQ ID NO: 62231 - DNA, 35 bp, Artificial Sequence
  Synthetic oligonucleotide
accttctccacccgtccctgtccccccagtaggcg

SEQ ID NO: 62232 - DNA, 35 bp, Artificial Sequence
  Synthetic oligonucleotide
attgccctccccattctccgtacgtccaccgctgg

SEQ ID NO: 62233 - DNA, 35 bp, Artificial Sequence
  Synthetic oligonucleotide
atcgcaccgaacctttccacaatgttaaccttgtg

SEQ ID NO: 62234 - DNA, 35 bp, Artificial Sequence
  Synthetic oligonucleotide
taccggtacagaagctgcgggggggggtagtgaat

SEQ ID NO: 62235 - DNA, 35 bp, Artificial Sequence
  Synthetic oligonucleotide
atgatcgtatgttcccaccgttttgtttcgtacat

SEQ ID NO: 62236 - DNA, 35 bp, Artificial Sequence
  Synthetic oligonucleotide
aagctcccagtgcgataccctgcacacacttagct

SEQ ID NO: 62237 - DNA, 35 bp, Artificial Sequence
  Synthetic oligonucleotide
taccgcgcgccattcgggtttccccatgtttctct

SEQ ID NO: 62238 - DNA, 35 bp, Artificial Sequence
  Synthetic oligonucleotide
attcgcattctgctgcgaccgtccacccttcctgt

SEQ ID NO: 62239 - DNA, 35 bp, Artificial Sequence
  Synthetic oligonucleotide
gcatacaccgtccccgtggactcaaggcgcccatt

SEQ ID NO: 62240 - DNA, 35 bp, Artificial Sequence
  Synthetic oligonucleotide
acataccggcggttttgacgcggattatgtccctt

SEQ ID NO: 62241 - DNA, 35 bp, Artificial Sequence
  Synthetic oligonucleotide
actcaccgtcccgagatccacattacagtagcgtt

SEQ ID NO: 62242 - DNA, 36 bp, Artificial Sequence
  Synthetic oligonucleotide
gcacgcatcctcgctgccgcatctggtccaggacaa

SEQ ID NO: 62243 - DNA, 36 bp, Artificial Sequence
  Synthetic oligonucleotide
tccatgcgcggaacaactaatcgtgcgctaccccaa

SEQ ID NO: 62244 - DNA, 36 bp, Artificial Sequence
  Synthetic oligonucleotide
tctccactcagcaagcgtagcattcccttcatcgaa

SEQ ID NO: 62245 - DNA, 36 bp, Artificial Sequence
  Synthetic oligonucleotide
agctgaataccgggaggaggagggggccagggggaa

SEQ ID NO: 62246 - DNA, 36 bp, Artificial Sequence
  Synthetic oligonucleotide
tgtcgacgccgctcacgtatcctgtccactgctgaa

SEQ ID NO: 62247 - DNA, 36 bp, Artificial Sequence
  Synthetic oligonucleotide
ttcatccccgccatgatgagccttagcaagcactaa

SEQ ID NO: 62248 - DNA, 35 bp, Artificial Sequence
  Synthetic oligonucleotide
aagtcagacccgattaccgctatggccaacgcaca

SEQ ID NO: 62249 - DNA, 36 bp, Artificial Sequence
  Synthetic oligonucleotide
accagacctaggaggaggaaataacggtgtatcaca

SEQ ID NO: 62250 - DNA, 35 bp, Artificial Sequence
  Synthetic oligonucleotide
gtcccacgtcagcctcccgcggtgccccaattaca

SEQ ID NO: 62251 - DNA, 36 bp, Artificial Sequence
  Synthetic oligonucleotide
taggaatctacattgtgaaacccatccgcctgccca

SEQ ID NO: 62252 - DNA, 36 bp, Artificial Sequence
  Synthetic oligonucleotide
gcaccactcctggccatggaacggttcacggggcca

SEQ ID NO: 62253 - DNA, 36 bp, Artificial Sequence
  Synthetic oligonucleotide
gtcatgtactgcttgcgctcggcactttttattcca

SEQ ID NO: 62254 - DNA, 36 bp, Artificial Sequence
  Synthetic oligonucleotide
gcttgcttcctcatttcccgaacctcgtcctacgca

SEQ ID NO: 62255 - DNA, 35 bp, Artificial Sequence
  Synthetic oligonucleotide
acttgggtgtggggggaatggacataggagcggca

SEQ ID NO: 62256 - DNA, 36 bp, Artificial Sequence
  Synthetic oligonucleotide
tgcaaaggaacaagcgaataaggaggggttggtgca

SEQ ID NO: 62257 - DNA, 35 bp, Artificial Sequence
  Synthetic oligonucleotide
atcttcccgctacttgtatatgtacacttccctca

SEQ ID NO: 62258 - DNA, 36 bp, Artificial Sequence
  Synthetic oligonucleotide
gtgtaaccgccctcctctacgatagtgcagacaaga

SEQ ID NO: 62259 - DNA, 37 bp, Artificial Sequence
  Synthetic oligonucleotide
tcagacaaccgcccgcgttaccacacagtaccgcaga

SEQ ID NO: 62260 - DNA, 37 bp, Artificial Sequence
  Synthetic oligonucleotide
gttaagagcggtatgggggatagaattggcgtagaga

SEQ ID NO: 62261 - DNA, 37 bp, Artificial Sequence
  Synthetic oligonucleotide
ggaacattgccaccaccctaccctcagcctgggacga

SEQ ID NO: 62262 - DNA, 35 bp, Artificial Sequence
  Synthetic oligonucleotide
tacttagtggagggagggtgtaactggatgtgcga

SEQ ID NO: 62263 - DNA, 35 bp, Artificial Sequence
  Synthetic oligonucleotide
ttagcggggcactcgtacacataatcatcactcga

SEQ ID NO: 62264 - DNA, 37 bp, Artificial Sequence
  Synthetic oligonucleotide
ggagccgacattattccaaacacaactcctgcctcga

SEQ ID NO: 62265 - DNA, 37 bp, Artificial Sequence
  Synthetic oligonucleotide
acatgatctgcagccaccgatcccctcttcctctcga

SEQ ID NO: 62266 - DNA, 37 bp, Artificial Sequence
  Synthetic oligonucleotide
aaataggccagaaggggctcaaaggaggggcacagga

SEQ ID NO: 62267 - DNA, 37 bp, Artificial Sequence
  Synthetic oligonucleotide
ttgccccatgctgttcgcgctggcattcacgcgcgga

SEQ ID NO: 62268 - DNA, 37 bp, Artificial Sequence
  Synthetic oligonucleotide
gctgtgcacctggtgcccttcaatatactcctaggga

SEQ ID NO: 62269 - DNA, 36 bp, Artificial Sequence
  Synthetic oligonucleotide
ggggcaaggtgcgggtactgagggtagcgaggggga

SEQ ID NO: 62270 - DNA, 37 bp, Artificial Sequence
  Synthetic oligonucleotide
ccacgacgggaggctggaggaggagggggtcggggga

SEQ ID NO: 62271 - DNA, 37 bp, Artificial Sequence
  Synthetic oligonucleotide
gacagggttcgggggagtcgggggttcatttgctgga

SEQ ID NO: 62272 - DNA, 38 bp, Artificial Sequence
  Synthetic oligonucleotide
gtgacacgtagagtaagagttgcgacactggcaaatga

SEQ ID NO: 62273 - DNA, 38 bp, Artificial Sequence
  Synthetic oligonucleotide
tcatcgaggaaagggcggaccaagaagcgggataatga

SEQ ID NO: 62274 - DNA, 37 bp, Artificial Sequence
  Synthetic oligonucleotide
aacgaccacagccctgcacatcgcttcgtatacatga

SEQ ID NO: 62275 - DNA, 37 bp, Artificial Sequence
  Synthetic oligonucleotide
gtgccagcccctcacccaggagcgttcctttacatga

SEQ ID NO: 62276 - DNA, 35 bp, Artificial Sequence
  Synthetic oligonucleotide
attcgccgacttagtatccctccacattgccatga

SEQ ID NO: 62277 - DNA, 37 bp, Artificial Sequence
  Synthetic oligonucleotide
atcaccctccccatccacctggttcaagcctgcatga

SEQ ID NO: 62278 - DNA, 37 bp, Artificial Sequence
  Synthetic oligonucleotide
tcccatcaaaccaccgacctgtttctgcttccactga

SEQ ID NO: 62279 - DNA, 38 bp, Artificial Sequence
  Synthetic oligonucleotide
tgccgagcagtgggagggggggtacggaagatgactga

SEQ ID NO: 62280 - DNA, 37 bp, Artificial Sequence
  Synthetic oligonucleotide
tatcccgccctaccacgcttcgcaggacatctactga

SEQ ID NO: 62281 - DNA, 36 bp, Artificial Sequence
  Synthetic oligonucleotide
acagcaaagatgtaccgccgcgcctccttagcctga

SEQ ID NO: 62282 - DNA, 38 bp, Artificial Sequence
  Synthetic oligonucleotide
acgtaacccacctctatatcatatacgacggctcctga

SEQ ID NO: 62283 - DNA, 38 bp, Artificial Sequence
  Synthetic oligonucleotide
tcgaggcgcttgttttgtttttttgcatctcgtcctga

SEQ ID NO: 62284 - DNA, 37 bp, Artificial Sequence
  Synthetic oligonucleotide
ttgcggggtacggggtcattagaggagggggagctga

SEQ ID NO: 62285 - DNA, 38 bp, Artificial Sequence
  Synthetic oligonucleotide
gtgtccacggggaagaagcaaaaaggggattcgagtga

SEQ ID NO: 62286 - DNA, 36 bp, Artificial Sequence
  Synthetic oligonucleotide
acgacaagtaggcggttaaacttggaggctgagtga

SEQ ID NO: 62287 - DNA, 38 bp, Artificial Sequence
  Synthetic oligonucleotide
tgatcgtcgagagcgaacttggattagtgggttggtga

SEQ ID NO: 62288 - DNA, 37 bp, Artificial Sequence
  Synthetic oligonucleotide
gtccacctgcaccatgttggaaaactaccctacttga

SEQ ID NO: 62289 - DNA, 38 bp, Artificial Sequence
  Synthetic oligonucleotide
acataccaacatgtgactcgacgctcttgcttctttga

SEQ ID NO: 62290 - DNA, 38 bp, Artificial Sequence
  Synthetic oligonucleotide
tacactacctcctgtatcatccgtcatgtcttctttga

SEQ ID NO: 62291 - DNA, 36 bp, Artificial Sequence
  Synthetic oligonucleotide
gaagggcgggggagggcgcggaacacgaagaccgta

SEQ ID NO: 62292 - DNA, 36 bp, Artificial Sequence
  Synthetic oligonucleotide
tccgctccccagcgggaacttgtacacatccccgta

SEQ ID NO: 62293 - DNA, 36 bp, Artificial Sequence
  Synthetic oligonucleotide
atgagaacaccgggagataagcccaacccggcggta

SEQ ID NO: 62294 - DNA, 35 bp, Artificial Sequence
  Synthetic oligonucleotide
tccgagccgtacctcaccgtttcattggtctctta

SEQ ID NO: 62295 - DNA, 35 bp, Artificial Sequence
  Synthetic oligonucleotide
accgcccagcaccgcttgctatgccgaactttaac

SEQ ID NO: 62296 - DNA, 35 bp, Artificial Sequence
  Synthetic oligonucleotide
tccacattccgaaacaagcgagttatcacctccac

SEQ ID NO: 62297 - DNA, 35 bp, Artificial Sequence
  Synthetic oligonucleotide
aagccgccacttcggtccctgttacgccgtatcac

SEQ ID NO: 62298 - DNA, 35 bp, Artificial Sequence
  Synthetic oligonucleotide
gttgaccaacatgcatagcacacacgcgggttcac

SEQ ID NO: 62299 - DNA, 35 bp, Artificial Sequence
  Synthetic oligonucleotide
gcaactgttcgttgcgtttgcacttgatcaacacc

SEQ ID NO: 62300 - DNA, 35 bp, Artificial Sequence
  Synthetic oligonucleotide
aactcctgattgaccacccccgctcacaagtgacc

SEQ ID NO: 62301 - DNA, 35 bp, Artificial Sequence
  Synthetic oligonucleotide
atccgtacgctctcatgcagaccgcgtgcctcccc

SEQ ID NO: 62302 - DNA, 35 bp, Artificial Sequence
  Synthetic oligonucleotide
ataccaccgccttgtcactctatattccccggtcc

SEQ ID NO: 62303 - DNA, 35 bp, Artificial Sequence
  Synthetic oligonucleotide
tacactgtgccctaactcgaaaagatagcatacgc

SEQ ID NO: 62304 - DNA, 35 bp, Artificial Sequence
  Synthetic oligonucleotide
ttcccctcgcttcacaattttgggttttcactggc

SEQ ID NO: 62305 - DNA, 35 bp, Artificial Sequence
  Synthetic oligonucleotide
gaccctgccgacctcggcgtgtaggactacccatc

SEQ ID NO: 62306 - DNA, 35 bp, Artificial Sequence
  Synthetic oligonucleotide
gctgtacggatctgcggcaccaccttccactcttc

SEQ ID NO: 62307 - DNA, 35 bp, Artificial Sequence
  Synthetic oligonucleotide
gtgcagaggtttctccttgggccagcaatctcttc

SEQ ID NO: 62308 - DNA, 35 bp, Artificial Sequence
  Synthetic oligonucleotide
tccccggggccccctcctgcttgttcgtgaaccag

SEQ ID NO: 62309 - DNA, 35 bp, Artificial Sequence
  Synthetic oligonucleotide
tcaacgcccgctcgccctccaaacgtccgtctgag

SEQ ID NO: 62310 - DNA, 35 bp, Artificial Sequence
  Synthetic oligonucleotide
gcacacacatagtcctctacagtaccagtctcccg

SEQ ID NO: 62311 - DNA, 35 bp, Artificial Sequence
  Synthetic oligonucleotide
accccgcatgatattagatctgtttcccatcgccg

SEQ ID NO: 62312 - DNA, 36 bp, Artificial Sequence
  Synthetic oligonucleotide
gtgccctcctgcgccctttatgtacaatgaactccg

SEQ ID NO: 62313 - DNA, 35 bp, Artificial Sequence
  Synthetic oligonucleotide
atccccatatgcaatgaattggtccactttcttcg

SEQ ID NO: 62314 - DNA, 35 bp, Artificial Sequence
  Synthetic oligonucleotide
tcatggaccctcaggcggcactaagccatcgcagg

SEQ ID NO: 62315 - DNA, 35 bp, Artificial Sequence
  Synthetic oligonucleotide
gaagaggactggggaaaggatgcctagaaaagggg

SEQ ID NO: 62316 - DNA, 35 bp, Artificial Sequence
  Synthetic oligonucleotide
taggactgcacattatagctctgtttcccgttggg

SEQ ID NO: 62317 - DNA, 36 bp, Artificial Sequence
  Synthetic oligonucleotide
ttgccagaggagtggagtgctggggttggtgtgctg

SEQ ID NO: 62318 - DNA, 36 bp, Artificial Sequence
  Synthetic oligonucleotide
gcgcgcggggggaggggcaaggtagggtcgcgcgtg

SEQ ID NO: 62319 - DNA, 35 bp, Artificial Sequence
  Synthetic oligonucleotide
tctgttcatcgcacccctaatacagagctatcttg

SEQ ID NO: 62320 - DNA, 35 bp, Artificial Sequence
  Synthetic oligonucleotide
tccagacgttcacaacacccgctttgcttccaaat

SEQ ID NO: 62321 - DNA, 35 bp, Artificial Sequence
  Synthetic oligonucleotide
tcagtgctacccatatcaggccgcatgccccgaat

SEQ ID NO: 62322 - DNA, 35 bp, Artificial Sequence
  Synthetic oligonucleotide
tctacgcccttttatatgtccatcctagcctccat

SEQ ID NO: 62323 - DNA, 35 bp, Artificial Sequence
  Synthetic oligonucleotide
atcacacgcaatgtctgagcccctcattccgaact

SEQ ID NO: 62324 - DNA, 35 bp, Artificial Sequence
  Synthetic oligonucleotide
tagtcccttagccccaacaatgccaactgcacact

SEQ ID NO: 62325 - DNA, 35 bp, Artificial Sequence
  Synthetic oligonucleotide
gccaggggtatagttcatgttgattagccttccct

SEQ ID NO: 62326 - DNA, 35 bp, Artificial Sequence
  Synthetic oligonucleotide
tctaccgcctgtgtttgcttatcttgtcaccctgt

SEQ ID NO: 62327 - DNA, 35 bp, Artificial Sequence
  Synthetic oligonucleotide
agcattgcccattttctactcagcttaccgcactt

SEQ ID NO: 62328 - DNA, 35 bp, Artificial Sequence
  Synthetic oligonucleotide
tgacccctggcgcgggatcgatctgcctttccctt

SEQ ID NO: 62329 - DNA, 35 bp, Artificial Sequence
  Synthetic oligonucleotide
tcgtatccaggcgtcgtattaccatctctaccgtt

SEQ ID NO: 62330 - DNA, 35 bp, Artificial Sequence
  Synthetic oligonucleotide
tgtcgctcacagcctggaatgcttgtaccctgttt

SEQ ID NO: 62331 - DNA, 36 bp, Artificial Sequence
  Synthetic oligonucleotide
accagcccttcctacacatctgtcatgttacaacaa

SEQ ID NO: 62332 - DNA, 36 bp, Artificial Sequence
  Synthetic oligonucleotide
gtgaacctttagagcgttaccctgaccggaccccaa

SEQ ID NO: 62333 - DNA, 36 bp, Artificial Sequence
  Synthetic oligonucleotide
acatatgcgcggtacgtctacttatttccaacgcaa

SEQ ID NO: 62334 - DNA, 36 bp, Artificial Sequence
  Synthetic oligonucleotide
ttgacaagcccgacgctcattagggaagtaatgcaa

SEQ ID NO: 62335 - DNA, 36 bp, Artificial Sequence
  Synthetic oligonucleotide
gccgctgtttccgttcccttttatttgtggcactaa

SEQ ID NO: 62336 - DNA, 35 bp, Artificial Sequence
  Synthetic oligonucleotide
aattatgggcgtagtgggcagggggaaggggctaa

SEQ ID NO: 62337 - DNA, 36 bp, Artificial Sequence
  Synthetic oligonucleotide
ttacagggtggacctgggttaggggaatcggggaca

SEQ ID NO: 62338 - DNA, 35 bp, Artificial Sequence
  Synthetic oligonucleotide
tgttcgcctgtcttttcaacgccctgcagaaccca

SEQ ID NO: 62339 - DNA, 36 bp, Artificial Sequence
  Synthetic oligonucleotide
atccactcgtactgggcatttgacatctggagccca

SEQ ID NO: 62340 - DNA, 35 bp, Artificial Sequence
  Synthetic oligonucleotide
tgcgacacccgttccgttccatgttgctatccgca

SEQ ID NO: 62341 - DNA, 36 bp, Artificial Sequence
  Synthetic oligonucleotide
agcgccgcctcgctcctccgccggactaaacgcgca

SEQ ID NO: 62342 - DNA, 35 bp, Artificial Sequence
  Synthetic oligonucleotide
gtacccccccttaacccacttcgtcacgacgcgca

SEQ ID NO: 62343 - DNA, 35 bp, Artificial Sequence
  Synthetic oligonucleotide
tccccccttgcgccttccacttatttgtcattgca

SEQ ID NO: 62344 - DNA, 36 bp, Artificial Sequence
  Synthetic oligonucleotide
tactccctcgattctacagagcgttatacactatca

SEQ ID NO: 62345 - DNA, 35 bp, Artificial Sequence
  Synthetic oligonucleotide
tcctgcggaccaataccccgccacacgctcgctca

SEQ ID NO: 62346 - DNA, 36 bp, Artificial Sequence
  Synthetic oligonucleotide
gaccatcacgaacactcgcgagcctattagttctca

SEQ ID NO: 62347 - DNA, 36 bp, Artificial Sequence
  Synthetic oligonucleotide
tctaccaccgcaacacatctacaaacggatgggtca

SEQ ID NO: 62348 - DNA, 36 bp, Artificial Sequence
  Synthetic oligonucleotide
tcagtctgttagcccactgttgtcacacgcaattca

SEQ ID NO: 62349 - DNA, 36 bp, Artificial Sequence
  Synthetic oligonucleotide
tcataactcccgggcccggctttcctgttacgttca

SEQ ID NO: 62350 - DNA, 35 bp, Artificial Sequence
  Synthetic oligonucleotide
cacatcaccacggagggcttctacgtactatttca

SEQ ID NO: 62351 - DNA, 37 bp, Artificial Sequence
  Synthetic oligonucleotide
taaaagcctcaacttgccgcccctcccatattgacga

SEQ ID NO: 62352 - DNA, 37 bp, Artificial Sequence
  Synthetic oligonucleotide
tatatgggagggctcgcgttacagggggagggtagga

SEQ ID NO: 62353 - DNA, 36 bp, Artificial Sequence
  Synthetic oligonucleotide
gttgcgaatgaaaaaggaggaagggtaatcgacgga

SEQ ID NO: 62354 - DNA, 37 bp, Artificial Sequence
  Synthetic oligonucleotide
tgtgccagcactacctctatatccgtgcgtgacggga

SEQ ID NO: 62355 - DNA, 37 bp, Artificial Sequence
  Synthetic oligonucleotide
gtcgtcgggcattcacggtgtgatgggttggggggga

SEQ ID NO: 62356 - DNA, 36 bp, Artificial Sequence
  Synthetic oligonucleotide
tgcaccccggggagggttacgggttacacattggga

SEQ ID NO: 62357 - DNA, 37 bp, Artificial Sequence
  Synthetic oligonucleotide
tgtagccacatgacaacgccccctctttcggcctgga

SEQ ID NO: 62358 - DNA, 36 bp, Artificial Sequence
  Synthetic oligonucleotide
agtgtgcaaaccggaaggttagaggaatgacgtgga

SEQ ID NO: 62359 - DNA, 37 bp, Artificial Sequence
  Synthetic oligonucleotide
tgtgttacgacccactgcgcaccgtaccgtttttgga

SEQ ID NO: 62360 - DNA, 38 bp, Artificial Sequence
  Synthetic oligonucleotide
aacggacacgagataagggcggggaagaagaccaatga

SEQ ID NO: 62361 - DNA, 37 bp, Artificial Sequence
  Synthetic oligonucleotide
ggtggaaggaggagtaggcgaatcggaaggatcatga

SEQ ID NO: 62362 - DNA, 38 bp, Artificial Sequence
  Synthetic oligonucleotide
gacccatgcgtcgattcctcgcccgtgtccgacgatga

SEQ ID NO: 62363 - DNA, 38 bp, Artificial Sequence
  Synthetic oligonucleotide
tccccgccgcctgaccaccgctacccgctgacctatga

SEQ ID NO: 62364 - DNA, 38 bp, Artificial Sequence
  Synthetic oligonucleotide
agccacccccactccatggtgctagtgcccttgtatga

SEQ ID NO: 62365 - DNA, 38 bp, Artificial Sequence
  Synthetic oligonucleotide
tagggaggggtggacggagggcagagatcgatgactga

SEQ ID NO: 62366 - DNA, 38 bp, Artificial Sequence
  Synthetic oligonucleotide
tctcggtgccccccttcctacgatgtcttcttagctga

SEQ ID NO: 62367 - DNA, 37 bp, Artificial Sequence
  Synthetic oligonucleotide
tgcccctgtccacgctcccactctagtacttttctga

SEQ ID NO: 62368 - DNA, 37 bp, Artificial Sequence
  Synthetic oligonucleotide
ttgggggggagggggaaacatgatcgatagggagtga

SEQ ID NO: 62369 - DNA, 37 bp, Artificial Sequence
  Synthetic oligonucleotide
tgtggtccaactgctatcatcacaattacttaggtga

SEQ ID NO: 62370 - DNA, 37 bp, Artificial Sequence
  Synthetic oligonucleotide
acgactacctatgccgggtgcctactgaaccccttga

SEQ ID NO: 62371 - DNA, 36 bp, Artificial Sequence
  Synthetic oligonucleotide
actcgagggcgggagtgggacggacaagggccttga

SEQ ID NO: 62372 - DNA, 38 bp, Artificial Sequence
  Synthetic oligonucleotide
tcaaacacaagacggtgggacggtgacgaggggcttga

SEQ ID NO: 62373 - DNA, 38 bp, Artificial Sequence
  Synthetic oligonucleotide
taccacccagttttccgtcactcagcaacataagttga

SEQ ID NO: 62374 - DNA, 38 bp, Artificial Sequence
  Synthetic oligonucleotide
gctacagcaggaggatcgcaaattagggtacgggttga

SEQ ID NO: 62375 - DNA, 38 bp, Artificial Sequence
  Synthetic oligonucleotide
attccccgcccagtgctctcctctacgatccgatttga

SEQ ID NO: 62376 - DNA, 36 bp, Artificial Sequence
  Synthetic oligonucleotide
gtcgcccccccagaagttatcttctgcctcagcata

SEQ ID NO: 62377 - DNA, 37 bp, Artificial Sequence
  Synthetic oligonucleotide
gatgcacacggacacgggctgagagtgggtttttcta

SEQ ID NO: 62378 - DNA, 36 bp, Artificial Sequence
  Synthetic oligonucleotide
agtgcgccctctagcatagctagtacacctaattta

SEQ ID NO: 62379 - DNA, 35 bp, Artificial Sequence
  Synthetic oligonucleotide
aggaacgcagttcgcatgatcacaaactcccacac

SEQ ID NO: 62380 - DNA, 35 bp, Artificial Sequence
  Synthetic oligonucleotide
tgcgaggggcgggctgggcagggtgccgcgctgac

SEQ ID NO: 62381 - DNA, 35 bp, Artificial Sequence
  Synthetic oligonucleotide
atgcccttcctgaagttacctcaaccccatgtgac

SEQ ID NO: 62382 - DNA, 35 bp, Artificial Sequence
  Synthetic oligonucleotide
tgatcgtacatcatccctacacccaggtcaaaacc

SEQ ID NO: 62383 - DNA, 35 bp, Artificial Sequence
  Synthetic oligonucleotide
aagcgaaggcgaaaaagtcgacctcccccctggcc

SEQ ID NO: 62384 - DNA, 35 bp, Artificial Sequence
  Synthetic oligonucleotide
tgtgccgctgctcacgtagagtccactttcactcc

SEQ ID NO: 62385 - DNA, 35 bp, Artificial Sequence
  Synthetic oligonucleotide
gcataccggcccacccgtgtccccgcatgcctagc

SEQ ID NO: 62386 - DNA, 35 bp, Artificial Sequence
  Synthetic oligonucleotide
ttctactgccccctggattaaatttagggccatgc

SEQ ID NO: 62387 - DNA, 35 bp, Artificial Sequence
  Synthetic oligonucleotide
acattcaccgctcattccacccacagtacgtattc

SEQ ID NO: 62388 - DNA, 35 bp, Artificial Sequence
  Synthetic oligonucleotide
atagggcacccgcagatcacggttctgtccttttc

SEQ ID NO: 62389 - DNA, 35 bp, Artificial Sequence
  Synthetic oligonucleotide
gcctccatcagtcaaacggttcttcaccatgtacg

SEQ ID NO: 62390 - DNA, 35 bp, Artificial Sequence
  Synthetic oligonucleotide
gccctcacccaccaatatgtaggcgccctgccccg

SEQ ID NO: 62391 - DNA, 35 bp, Artificial Sequence
  Synthetic oligonucleotide
gcaccgagcacatcattattccacagccacagccg

SEQ ID NO: 62392 - DNA, 35 bp, Artificial Sequence
  Synthetic oligonucleotide
actggagagaagtatggcagggggaatcgcgtgcg

SEQ ID NO: 62393 - DNA, 35 bp, Artificial Sequence
  Synthetic oligonucleotide
gagtcacttactgacccgtgttgttcgatttctcg

SEQ ID NO: 62394 - DNA, 35 bp, Artificial Sequence
  Synthetic oligonucleotide
gaaacatacatcgctgaattactcacatctctctg

SEQ ID NO: 62395 - DNA, 35 bp, Artificial Sequence
  Synthetic oligonucleotide
catcccccgtagccccccgcccacaatatctattg

SEQ ID NO: 62396 - DNA, 35 bp, Artificial Sequence
  Synthetic oligonucleotide
actatccaccccggatcctgtgtaagtttcacaat

SEQ ID NO: 62397 - DNA, 35 bp, Artificial Sequence
  Synthetic oligonucleotide
atccgtctgcccattccgagtattacgtaccgtat

SEQ ID NO: 62398 - DNA, 35 bp, Artificial Sequence
  Synthetic oligonucleotide
tgggacccgccaccactccactggaaacaatacct

SEQ ID NO: 62399 - DNA, 35 bp, Artificial Sequence
  Synthetic oligonucleotide
aataaccgatactccagcacacccacgtcgccgct

SEQ ID NO: 62400 - DNA, 35 bp, Artificial Sequence
  Synthetic oligonucleotide
gccaagtcacacattgaatcattgggcgcaaatct

SEQ ID NO: 62401 - DNA, 35 bp, Artificial Sequence
  Synthetic oligonucleotide
tgagtgtccaccagtttcctcatcttccctattct

SEQ ID NO: 62402 - DNA, 35 bp, Artificial Sequence
  Synthetic oligonucleotide
aacgaacgcgaggagggccgtgatggtactgcagt

SEQ ID NO: 62403 - DNA, 35 bp, Artificial Sequence
  Synthetic oligonucleotide
tgattctccgccccctattgcaacccgaccaactt

SEQ ID NO: 62404 - DNA, 35 bp, Artificial Sequence
  Synthetic oligonucleotide
aagccggtgatttgaaacggctgtatcttactctt

SEQ ID NO: 62405 - DNA, 35 bp, Artificial Sequence
  Synthetic oligonucleotide
gcctccaacccctaactgaacacggggcacgattt

SEQ ID NO: 62406 - DNA, 35 bp, Artificial Sequence
  Synthetic oligonucleotide
ttacgcgggtcgggcgatgccgcttttctttcttt

SEQ ID NO: 62407 - DNA, 36 bp, Artificial Sequence
  Synthetic oligonucleotide
ttacatcccttcactatcttgcatttatctgtgcaa

SEQ ID NO: 62408 - DNA, 36 bp, Artificial Sequence
  Synthetic oligonucleotide
tatccagccggcaaagttgttccccgtccctttcaa

SEQ ID NO: 62409 - DNA, 36 bp, Artificial Sequence
  Synthetic oligonucleotide
tgacgaccctgctttcattggtcaagtaaccccgaa

SEQ ID NO: 62410 - DNA, 36 bp, Artificial Sequence
  Synthetic oligonucleotide
tgacactcttgcactggtctagccgatcaattcgaa

SEQ ID NO: 62411 - DNA, 36 bp, Artificial Sequence
  Synthetic oligonucleotide
tgtccaattgcctgtgagcccccttggtcccttgaa

SEQ ID NO: 62412 - DNA, 35 bp, Artificial Sequence
  Synthetic oligonucleotide
aatgccactgcacataaactggttcgccgcttgaa

SEQ ID NO: 62413 - DNA, 36 bp, Artificial Sequence
  Synthetic oligonucleotide
tctaacccccgctgccatctccaccaatgtgactaa

SEQ ID NO: 62414 - DNA, 35 bp, Artificial Sequence
  Synthetic oligonucleotide
agggaccgaactcttatcttgcaggcactgacaca

SEQ ID NO: 62415 - DNA, 36 bp, Artificial Sequence
  Synthetic oligonucleotide
actgtcgacggcacaacgcgaaaccgactacccaca

SEQ ID NO: 62416 - DNA, 35 bp, Artificial Sequence
  Synthetic oligonucleotide
tagagaccacctgcctgaagctcttatcacagaca

SEQ ID NO: 62417 - DNA, 35 bp, Artificial Sequence
  Synthetic oligonucleotide
atctaacccaccagtcgtgctttactgccccgaca

SEQ ID NO: 62418 - DNA, 36 bp, Artificial Sequence
  Synthetic oligonucleotide
attccgcacgactcctttagaatacctgtaaaacca

SEQ ID NO: 62419 - DNA, 36 bp, Artificial Sequence
  Synthetic oligonucleotide
gcacggggacgacgtgcactttacctgtgcctacca

SEQ ID NO: 62420 - DNA, 35 bp, Artificial Sequence
  Synthetic oligonucleotide
accgcacaaacttcctcaacgtcattgttctacca

SEQ ID NO: 62421 - DNA, 36 bp, Artificial Sequence
  Synthetic oligonucleotide
acttagagttcaacgccgaacggtgccaccacccca

SEQ ID NO: 62422 - DNA, 36 bp, Artificial Sequence
  Synthetic oligonucleotide
acaacgtcccgttgtcacaagctaatatacgcccca

SEQ ID NO: 62423 - DNA, 36 bp, Artificial Sequence
  Synthetic oligonucleotide
ttggacgtacccttccaacgcccatgtaactcccca

SEQ ID NO: 62424 - DNA, 35 bp, Artificial Sequence
  Synthetic oligonucleotide
acccacaatcaacgcggtatccacccctgtggcca

SEQ ID NO: 62425 - DNA, 36 bp, Artificial Sequence
  Synthetic oligonucleotide
tcaaagtggggatcttggagagcgaggttgagagca

SEQ ID NO: 62426 - DNA, 36 bp, Artificial Sequence
  Synthetic oligonucleotide
actcttgcccgatccagtgtcattgaattttcgtca

SEQ ID NO: 62427 - DNA, 37 bp, Artificial Sequence
  Synthetic oligonucleotide
tttggagtgcacatttggaaaggaagaagagcgcaga

SEQ ID NO: 62428 - DNA, 37 bp, Artificial Sequence
  Synthetic oligonucleotide
tagcaggggaggaaggcaaatcgcgggaggaggtaga

SEQ ID NO: 62429 - DNA, 37 bp, Artificial Sequence
  Synthetic oligonucleotide
atgaaccaggatagacgtggggtggagggaagaacga

SEQ ID NO: 62430 - DNA, 37 bp, Artificial Sequence
  Synthetic oligonucleotide
agagacaggtgcaggggcctgaagaatgttgaatcga

SEQ ID NO: 62431 - DNA, 36 bp, Artificial Sequence
  Synthetic oligonucleotide
atgggacaccgacctctgtacaaagcatcctctcga

SEQ ID NO: 62432 - DNA, 37 bp, Artificial Sequence
  Synthetic oligonucleotide
gactgggtaaggaccaaaacagggaggtacggttcga

SEQ ID NO: 62433 - DNA, 37 bp, Artificial Sequence
  Synthetic oligonucleotide
gatagtgtggcgtgggaatggagcaggtgagggagga

SEQ ID NO: 62434 - DNA, 36 bp, Artificial Sequence
  Synthetic oligonucleotide
gagggtgatggggaaccgaaagttacgatgggagga

SEQ ID NO: 62435 - DNA, 36 bp, Artificial Sequence
  Synthetic oligonucleotide
agcccgacgcgttacttccaccccactcgccacgga

SEQ ID NO: 62436 - DNA, 37 bp, Artificial Sequence
  Synthetic oligonucleotide
acgatccgtccgctgatctgacccattctttgacgga

SEQ ID NO: 62437 - DNA, 37 bp, Artificial Sequence
  Synthetic oligonucleotide
gcacactcccgacccgaaagttaggtccctattcgga

SEQ ID NO: 62438 - DNA, 36 bp, Artificial Sequence
  Synthetic oligonucleotide
gtgggggaagagtaggtagcggacaccgtctaggga

SEQ ID NO: 62439 - DNA, 37 bp, Artificial Sequence
  Synthetic oligonucleotide
acttaccccgcattgcctggacttagctctcattgga

SEQ ID NO: 62440 - DNA, 38 bp, Artificial Sequence
  Synthetic oligonucleotide
ttccgcagtagagccacgggggaggaagtaggagatga

SEQ ID NO: 62441 - DNA, 38 bp, Artificial Sequence
  Synthetic oligonucleotide
gagtcaaagggggaggacgtgtcgctggatcgtgatga

SEQ ID NO: 62442 - DNA, 38 bp, Artificial Sequence
  Synthetic oligonucleotide
gtaagcacggaccacgggaagacggagaggagatatga

SEQ ID NO: 62443 - DNA, 37 bp, Artificial Sequence
  Synthetic oligonucleotide
gcacccttcgcccctatagaatgctccccccgactga

SEQ ID NO: 62444 - DNA, 37 bp, Artificial Sequence
  Synthetic oligonucleotide
tcttgaccaaatccatgtgcctccgggccgttcctga

SEQ ID NO: 62445 - DNA, 38 bp, Artificial Sequence
  Synthetic oligonucleotide
tatgtgccctccaccttcatgccaccgaacctagctga

SEQ ID NO: 62446 - DNA, 38 bp, Artificial Sequence
  Synthetic oligonucleotide
gaggcttgtaggcacggggaggggggaggatagagtga

SEQ ID NO: 62447 - DNA, 38 bp, Artificial Sequence
  Synthetic oligonucleotide
tccctccgttcaataggttcgctccagcctactcgtga

SEQ ID NO: 62448 - DNA, 38 bp, Artificial Sequence
  Synthetic oligonucleotide
atgtgggacagggctggaatttgagggaatcggggtga

SEQ ID NO: 62449 - DNA, 37 bp, Artificial Sequence
  Synthetic oligonucleotide
taactctccgctgctcccgcccataatcacatggtga

SEQ ID NO: 62450 - DNA, 35 bp, Artificial Sequence
  Synthetic oligonucleotide
gtgatgctgccctatgtcgtacgctactctggtga

SEQ ID NO: 62451 - DNA, 38 bp, Artificial Sequence
  Synthetic oligonucleotide
gacaactcgaaccgcatacgccctgacatcgcttgtga

SEQ ID NO: 62452 - DNA, 38 bp, Artificial Sequence
  Synthetic oligonucleotide
gcaagaccgaagaagaggggatgtggtaaacgttgtga

SEQ ID NO: 62453 - DNA, 38 bp, Artificial Sequence
  Synthetic oligonucleotide
acaccttacctcaccgattgactgtaccgattacttga

SEQ ID NO: 62454 - DNA, 35 bp, Artificial Sequence
  Synthetic oligonucleotide
gcaaagagtagggaaaggaaggcgaatcaataata

SEQ ID NO: 62455 - DNA, 36 bp, Artificial Sequence
  Synthetic oligonucleotide
atgcctgcgtaccggttagctgcgccctccaccata

SEQ ID NO: 62456 - DNA, 36 bp, Artificial Sequence
  Synthetic oligonucleotide
tccctcgtccgtcgaatcgacctctctccagccata

SEQ ID NO: 62457 - DNA, 35 bp, Artificial Sequence
  Synthetic oligonucleotide
gaatagtgggggccggcttgcacaaaagccatata

SEQ ID NO: 62458 - DNA, 35 bp, Artificial Sequence
  Synthetic oligonucleotide
atgaccgcgagcttaccgcttttggacgcccccta

SEQ ID NO: 62459 - DNA, 36 bp, Artificial Sequence
  Synthetic oligonucleotide
gaagtcaccgccttcggttatagctgccgttgccta

SEQ ID NO: 62460 - DNA, 35 bp, Artificial Sequence
  Synthetic oligonucleotide
gtttccgccccatttccgggactactcaccatgta

SEQ ID NO: 62461 - DNA, 36 bp, Artificial Sequence
  Synthetic oligonucleotide
gtgtggcatcgcattctactgttatttcgcctctta

SEQ ID NO: 62462 - DNA, 36 bp, Artificial Sequence
  Synthetic oligonucleotide
gaacggggccactgaaaaagttgtaggggggattta

SEQ ID NO: 62463 - DNA, 35 bp, Artificial Sequence
  Synthetic oligonucleotide
tagccaatctgcggtgcccctacgttatgccttta

SEQ ID NO: 62464 - DNA, 35 bp, Artificial Sequence
  Synthetic oligonucleotide
acactcctgttgcaagaacccgtcttctcgttcac

SEQ ID NO: 62465 - DNA, 35 bp, Artificial Sequence
  Synthetic oligonucleotide
tacgtggcccccgcttgacgtagtgtccgctttac

SEQ ID NO: 62466 - DNA, 35 bp, Artificial Sequence
  Synthetic oligonucleotide
gactcactacgctttagacatgtccttgatttacc

SEQ ID NO: 62467 - DNA, 35 bp, Artificial Sequence
  Synthetic oligonucleotide
tgccctcgctcctccccctcgtcgtgcgtaggccc

SEQ ID NO: 62468 - DNA, 35 bp, Artificial Sequence
  Synthetic oligonucleotide
aattcggcctttcaccgatcgctacgtacgctccc

SEQ ID NO: 62469 - DNA, 35 bp, Artificial Sequence
  Synthetic oligonucleotide
gtgggatgcacccggacccgaacccaatgtagtcc

SEQ ID NO: 62470 - DNA, 35 bp, Artificial Sequence
  Synthetic oligonucleotide
agtaagcataggccagtgtgggggatggaaaaagc

SEQ ID NO: 62471 - DNA, 35 bp, Artificial Sequence
  Synthetic oligonucleotide
gacacaactgtgaatctaggggtatcgcgcttatc

SEQ ID NO: 62472 - DNA, 35 bp, Artificial Sequence
  Synthetic oligonucleotide
gggggtacctgccggccaccattgtaccaattctc

SEQ ID NO: 62473 - DNA, 35 bp, Artificial Sequence
  Synthetic oligonucleotide
acaccccagagtctcttcataatgcaatgccagtc

SEQ ID NO: 62474 - DNA, 35 bp, Artificial Sequence
  Synthetic oligonucleotide
gtgtagccccacaagaatcctatggtactcacttc

SEQ ID NO: 62475 - DNA, 35 bp, Artificial Sequence
  Synthetic oligonucleotide
gagacgattacgccgcccgagcctccagaccgttc

SEQ ID NO: 62476 - DNA, 35 bp, Artificial Sequence
  Synthetic oligonucleotide
gcactctggaccgggtcctatagctccctgaaacg

SEQ ID NO: 62477 - DNA, 35 bp, Artificial Sequence
  Synthetic oligonucleotide
gcacccattcgcgtgagttgtccaatctctgtccg

SEQ ID NO: 62478 - DNA, 35 bp, Artificial Sequence
  Synthetic oligonucleotide
ttgatccacctcagcgctacttagcgggcaacgcg

SEQ ID NO: 62479 - DNA, 35 bp, Artificial Sequence
  Synthetic oligonucleotide
gtccgagaaagagccacagtagttatgggggaagg

SEQ ID NO: 62480 - DNA, 35 bp, Artificial Sequence
  Synthetic oligonucleotide
acaacactgggctgacagcaatatagcggagcagg

SEQ ID NO: 62481 - DNA, 35 bp, Artificial Sequence
  Synthetic oligonucleotide
atccgacccctcaccccggtaagtccgttatacat

SEQ ID NO: 62482 - DNA, 35 bp, Artificial Sequence
  Synthetic oligonucleotide
gactgcagaaccccacctggaaggtctactcccat

SEQ ID NO: 62483 - DNA, 35 bp, Artificial Sequence
  Synthetic oligonucleotide
gacctgtcgtcgcacctttccccacttgttagtat

SEQ ID NO: 62484 - DNA, 35 bp, Artificial Sequence
  Synthetic oligonucleotide
tcataccggcggccaatagtctccagcgccaacct

SEQ ID NO: 62485 - DNA, 35 bp, Artificial Sequence
  Synthetic oligonucleotide
gattctgcgtgcatagaaacaccgtatgtccccct

SEQ ID NO: 62486 - DNA, 33 bp, Artificial Sequence
  Synthetic oligonucleotide
actctagtactatcccccgtgccgtatgcccct

SEQ ID NO: 62487 - DNA, 34 bp, Artificial Sequence
  Synthetic oligonucleotide
aacgcccatgcattacacacctacattttgtggt

SEQ ID NO: 62488 - DNA, 35 bp, Artificial Sequence
  Synthetic oligonucleotide
ccacatcacccccacatcgcaatgaggttcttgtt

SEQ ID NO: 62489 - DNA, 35 bp, Artificial Sequence
  Synthetic oligonucleotide
tgaccctgccaagccctctggcaaccgttcgtttt

SEQ ID NO: 62490 - DNA, 35 bp, Artificial Sequence
  Synthetic oligonucleotide
atcctccccaacgaccatgccagtggctagttttt

SEQ ID NO: 62491 - DNA, 35 bp, Artificial Sequence
  Synthetic oligonucleotide
gcaaccactgataagaaccccccggcatccccaaa

SEQ ID NO: 62492 - DNA, 35 bp, Artificial Sequence
  Synthetic oligonucleotide
tcagacgcccattttcgtcgcaggatcccgccaaa

SEQ ID NO: 62493 - DNA, 36 bp, Artificial Sequence
  Synthetic oligonucleotide
agactgctttgcaggctgcctaaaataccatcacaa

SEQ ID NO: 62494 - DNA, 36 bp, Artificial Sequence
  Synthetic oligonucleotide
gtgatatgcattcaccacatatgtttccctgtccaa

SEQ ID NO: 62495 - DNA, 35 bp, Artificial Sequence
  Synthetic oligonucleotide
gacatgttccgctctgttctcacctggcccttgaa

SEQ ID NO: 62496 - DNA, 36 bp, Artificial Sequence
  Synthetic oligonucleotide
tcctcgcactctcatggcccatcacctggaatgtaa

SEQ ID NO: 62497 - DNA, 36 bp, Artificial Sequence
  Synthetic oligonucleotide
aacacgccagaaacctcttgggagcggctttaaaca

SEQ ID NO: 62498 - DNA, 36 bp, Artificial Sequence
  Synthetic oligonucleotide
taaccgccacctggttagcatttgacttatttaaca

SEQ ID NO: 62499 - DNA, 36 bp, Artificial Sequence
  Synthetic oligonucleotide
aatttgccgcatactaggccgactctcacagacaca

SEQ ID NO: 62500 - DNA, 36 bp, Artificial Sequence
  Synthetic oligonucleotide
accgagcccctttctcacctcgaaacacacagacca

SEQ ID NO: 62501 - DNA, 36 bp, Artificial Sequence
  Synthetic oligonucleotide
tggactacgcgcgtgccttcactgctgtgatcccca

SEQ ID NO: 62502 - DNA, 35 bp, Artificial Sequence
  Synthetic oligonucleotide
ttccaactgcgaacgggcggccttgtttcaatcca

SEQ ID NO: 62503 - DNA, 36 bp, Artificial Sequence
  Synthetic oligonucleotide
gccccatcgcaatctctttaggacaaatagtgagca

SEQ ID NO: 62504 - DNA, 36 bp, Artificial Sequence
  Synthetic oligonucleotide
gggacatccacggtacggtcatcgttctctcacgca

SEQ ID NO: 62505 - DNA, 36 bp, Artificial Sequence
  Synthetic oligonucleotide
ttctggggatgggtagggcaggggacgaatgcggca

SEQ ID NO: 62506 - DNA, 35 bp, Artificial Sequence
  Synthetic oligonucleotide
tgccccagaggttttgacctcgttctgacccatca

SEQ ID NO: 62507 - DNA, 36 bp, Artificial Sequence
  Synthetic oligonucleotide
tatgcgacgatagtaatcaatgtttcgcactcttca

SEQ ID NO: 62508 - DNA, 35 bp, Artificial Sequence
  Synthetic oligonucleotide
tgttctgccaactgttttctcatatctcgtaacga

SEQ ID NO: 62509 - DNA, 36 bp, Artificial Sequence
  Synthetic oligonucleotide
ttgcgcacggtactagcacgctgatcaccaccacga

SEQ ID NO: 62510 - DNA, 37 bp, Artificial Sequence
  Synthetic oligonucleotide
gaaccaaggcaagggatggagcagtatgatcaagcga

SEQ ID NO: 62511 - DNA, 37 bp, Artificial Sequence
  Synthetic oligonucleotide
gttgcactccctggccttttgattttgacctttgcga

SEQ ID NO: 62512 - DNA, 36 bp, Artificial Sequence
  Synthetic oligonucleotide
aagggagtgggtttggggggtggaaaggacaaagga

SEQ ID NO: 62513 - DNA, 37 bp, Artificial Sequence
  Synthetic oligonucleotide
gaaacagggggtagggggggttgtgagctccgccgga

SEQ ID NO: 62514 - DNA, 37 bp, Artificial Sequence
  Synthetic oligonucleotide
tgagatgggtggcctggtggggttggggtgaatcgga

SEQ ID NO: 62515 - DNA, 36 bp, Artificial Sequence
  Synthetic oligonucleotide
tccaccccgatatgcatgctgacacccccagctgga

SEQ ID NO: 62516 - DNA, 37 bp, Artificial Sequence
  Synthetic oligonucleotide
gtccatcaccagttgctgcacaatacacatttctgga

SEQ ID NO: 62517 - DNA, 37 bp, Artificial Sequence
  Synthetic oligonucleotide
acatgcaacaaacacgtactatgggaaagggggtgga

SEQ ID NO: 62518 - DNA, 36 bp, Artificial Sequence
  Synthetic oligonucleotide
atcaacagcaaacacgaaatatggtggcttggtgga

SEQ ID NO: 62519 - DNA, 36 bp, Artificial Sequence
  Synthetic oligonucleotide
tcaccaaacctaactgcatacgccgagacacaatga

SEQ ID NO: 62520 - DNA, 38 bp, Artificial Sequence
  Synthetic oligonucleotide
accgccccggcactcatggcaccgatcgtccccaatga

SEQ ID NO: 62521 - DNA, 38 bp, Artificial Sequence
  Synthetic oligonucleotide
gttgcttccaccgtttacgactcctttactgccaatga

SEQ ID NO: 62522 - DNA, 38 bp, Artificial Sequence
  Synthetic oligonucleotide
atccggtgggtcctccgcgtttcaccactcattcatga

SEQ ID NO: 62523 - DNA, 38 bp, Artificial Sequence
  Synthetic oligonucleotide
gtgcggggcggtcgaggggagagtggagtgcactatga

SEQ ID NO: 62524 - DNA, 37 bp, Artificial Sequence
  Synthetic oligonucleotide
gctgtctcagttagtctacccacacacttccacctga

SEQ ID NO: 62525 - DNA, 37 bp, Artificial Sequence
  Synthetic oligonucleotide
tagaactgcccgcgactcgcctattttttgtacctga

SEQ ID NO: 62526 - DNA, 37 bp, Artificial Sequence
  Synthetic oligonucleotide
taggtcgagagaaactgatagtgggaggggatgctga

SEQ ID NO: 62527 - DNA, 38 bp, Artificial Sequence
  Synthetic oligonucleotide
tagtgccgtccctgctccatcctcgcgaggccttctga

SEQ ID NO: 62528 - DNA, 36 bp, Artificial Sequence
  Synthetic oligonucleotide
agtacacgctgctttacttactcgtcccccaagtga

SEQ ID NO: 62529 - DNA, 38 bp, Artificial Sequence
  Synthetic oligonucleotide
gcatatgcggggcagcaaggggggggctggagcggtga

SEQ ID NO: 62530 - DNA, 37 bp, Artificial Sequence
  Synthetic oligonucleotide
gacggtgggggtatcggataagagcggggtggggtga

SEQ ID NO: 62531 - DNA, 38 bp, Artificial Sequence
  Synthetic oligonucleotide
taccgtctggcccatttttctctagcccaccttggtga

SEQ ID NO: 62532 - DNA, 38 bp, Artificial Sequence
  Synthetic oligonucleotide
tgtccgccctatgccgcttattcgctccgcccatgtga

SEQ ID NO: 62533 - DNA, 38 bp, Artificial Sequence
  Synthetic oligonucleotide
tgattcgcccagttctgcttttctctcacatgatgtga

SEQ ID NO: 62534 - DNA, 38 bp, Artificial Sequence
  Synthetic oligonucleotide
tcttcccgcctcgacccctcgcccctgatgtggattga

SEQ ID NO: 62535 - DNA, 38 bp, Artificial Sequence
  Synthetic oligonucleotide
tgagttcctcccagcttttgactacgtttcatgcttga

SEQ ID NO: 62536 - DNA, 38 bp, Artificial Sequence
  Synthetic oligonucleotide
tcccggtcgcccttctccggatctttcatatacgttga

SEQ ID NO: 62537 - DNA, 38 bp, Artificial Sequence
  Synthetic oligonucleotide
acagaacggatatcatggggctatgggtagtaggttga

SEQ ID NO: 62538 - DNA, 38 bp, Artificial Sequence
  Synthetic oligonucleotide
tcaagtagggagggttgcgagagaggggtgtggtttga

SEQ ID NO: 62539 - DNA, 35 bp, Artificial Sequence
  Synthetic oligonucleotide
tcgatccgctctacgaatcggtacctcttgccata

SEQ ID NO: 62540 - DNA, 35 bp, Artificial Sequence
  Synthetic oligonucleotide
gaaagtcaggtagggcggaggagtacggggtgata

SEQ ID NO: 62541 - DNA, 35 bp, Artificial Sequence
  Synthetic oligonucleotide
aacgcggggccccctcgaccatccgtgtaacacta

SEQ ID NO: 62542 - DNA, 36 bp, Artificial Sequence
  Synthetic oligonucleotide
tcccatcctgcctctccccttgcctggtttgtccta

SEQ ID NO: 62543 - DNA, 35 bp, Artificial Sequence
  Synthetic oligonucleotide
gaccacgccccactggcacaatacacttcaccgta

SEQ ID NO: 62544 - DNA, 36 bp, Artificial Sequence
  Synthetic oligonucleotide
gtcacacgcatcccttttgcacgctttgaaacatta

SEQ ID NO: 62545 - DNA, 35 bp, Artificial Sequence
  Synthetic oligonucleotide
gacttggtcccgaatgcatccgtattgcccactta

SEQ ID NO: 62546 - DNA, 36 bp, Artificial Sequence
  Synthetic oligonucleotide
ttagcggccattcgctttgtcgacgtctatccctta

SEQ ID NO: 62547 - DNA, 36 bp, Artificial Sequence
  Synthetic oligonucleotide
gttgacgaaggcctaaaagaagggggtggacggtta

SEQ ID NO: 62548 - DNA, 36 bp, Artificial Sequence
  Synthetic oligonucleotide
ggtgcgattacccccgctctgagtttgtacgcttta

SEQ ID NO: 62549 - DNA, 35 bp, Artificial Sequence
  Synthetic oligonucleotide
gtcactccatacccgcaatgctaccgccttgggac

SEQ ID NO: 62550 - DNA, 35 bp, Artificial Sequence
  Synthetic oligonucleotide
tatctttacgcccatatcattagccctgttcctac

SEQ ID NO: 62551 - DNA, 35 bp, Artificial Sequence
  Synthetic oligonucleotide
ggatcggacttgttcggctccacacttcttacacc

SEQ ID NO: 62552 - DNA, 35 bp, Artificial Sequence
  Synthetic oligonucleotide
actctcacccgacgccttgtcatccgttgcctacc

SEQ ID NO: 62553 - DNA, 35 bp, Artificial Sequence
  Synthetic oligonucleotide
tgccggggactcccgtacattgggccatttctacc

SEQ ID NO: 62554 - DNA, 35 bp, Artificial Sequence
  Synthetic oligonucleotide
tactaaccaggatgcgcaatttgcacgcgcacgcc

SEQ ID NO: 62555 - DNA, 35 bp, Artificial Sequence
  Synthetic oligonucleotide
acctcgtcgcctggcggttcacttcggtctactcc

SEQ ID NO: 62556 - DNA, 35 bp, Artificial Sequence
  Synthetic oligonucleotide
tgagatccggggcgttggctcttaatcgtttttcc

SEQ ID NO: 62557 - DNA, 35 bp, Artificial Sequence
  Synthetic oligonucleotide
gatgcgcaccaacctgactaacgcccctcaaaagc

SEQ ID NO: 62558 - DNA, 35 bp, Artificial Sequence
  Synthetic oligonucleotide
gcacgcgccgtcctgacgagtcaactccctctagc

SEQ ID NO: 62559 - DNA, 35 bp, Artificial Sequence
  Synthetic oligonucleotide
atattccgacgcctttcctccacactcccgtgcgc

SEQ ID NO: 62560 - DNA, 35 bp, Artificial Sequence
  Synthetic oligonucleotide
agccccctcctaataataccgacccttttaccggc

SEQ ID NO: 62561 - DNA, 35 bp, Artificial Sequence
  Synthetic oligonucleotide
tcccggaccacacagcttgaaatacgattgcatgc

SEQ ID NO: 62562 - DNA, 35 bp, Artificial Sequence
  Synthetic oligonucleotide
agtacgtcatcccgatccacacccagggcccctgc

SEQ ID NO: 62563 - DNA, 35 bp, Artificial Sequence
  Synthetic oligonucleotide
tacagcgacgaacccatcactgcgtcttcgaactc

SEQ ID NO: 62564 - DNA, 35 bp, Artificial Sequence
  Synthetic oligonucleotide
tcacgtcggtcggcgactatgtacaccgttccctc

SEQ ID NO: 62565 - DNA, 35 bp, Artificial Sequence
  Synthetic oligonucleotide
taggtcaccagaactaaaccacacacgaggtcctc

SEQ ID NO: 62566 - DNA, 35 bp, Artificial Sequence
  Synthetic oligonucleotide
atcatccgcaacggaattcacccgccctctacgtc

SEQ ID NO: 62567 - DNA, 35 bp, Artificial Sequence
  Synthetic oligonucleotide
tccagccatgtaacgatctgaaaaatccctgggtc

SEQ ID NO: 62568 - DNA, 35 bp, Artificial Sequence
  Synthetic oligonucleotide
ttacgccacccgcagtagtgggcactgcctctgtc

SEQ ID NO: 62569 - DNA, 35 bp, Artificial Sequence
  Synthetic oligonucleotide
ggggactgcgcacctattcatgctgaacctaattc

SEQ ID NO: 62570 - DNA, 35 bp, Artificial Sequence
  Synthetic oligonucleotide
atcgctcctccaagtaagactcgctgtcctgcttc

SEQ ID NO: 62571 - DNA, 35 bp, Artificial Sequence
  Synthetic oligonucleotide
ggagaagacaagaacgagatggcagtggtggggag

SEQ ID NO: 62572 - DNA, 35 bp, Artificial Sequence
  Synthetic oligonucleotide
tgatacgcaatgcgagtccactgttctttctttag

SEQ ID NO: 62573 - DNA, 35 bp, Artificial Sequence
  Synthetic oligonucleotide
actcgtctggctaacgacgcaccctgttctctccg

SEQ ID NO: 62574 - DNA, 35 bp, Artificial Sequence
  Synthetic oligonucleotide
atggataacgggagggcacggccggggggagagcg

SEQ ID NO: 62575 - DNA, 35 bp, Artificial Sequence
  Synthetic oligonucleotide
actactcagtggttttatccgtccctcaactctcg

SEQ ID NO: 62576 - DNA, 35 bp, Artificial Sequence
  Synthetic oligonucleotide
ttgaccgcgatcgtccgcccccaatccatttacgg

SEQ ID NO: 62577 - DNA, 35 bp, Artificial Sequence
  Synthetic oligonucleotide
tcagtgtggtgagaaagggttacgtgatggaatgg

SEQ ID NO: 62578 - DNA, 35 bp, Artificial Sequence
  Synthetic oligonucleotide
acttcggtgccacacctcatgcccacgacctctgg

SEQ ID NO: 62579 - DNA, 35 bp, Artificial Sequence
  Synthetic oligonucleotide
gactgggaagaacttgggtagaaaatgcggctatg

SEQ ID NO: 62580 - DNA, 35 bp, Artificial Sequence
  Synthetic oligonucleotide
agcaaaggctcatattccgcgtccccgttgaactg

SEQ ID NO: 62581 - DNA, 35 bp, Artificial Sequence
  Synthetic oligonucleotide
caatcatccctggtgtctctcacgtccacgacctg

SEQ ID NO: 62582 - DNA, 35 bp, Artificial Sequence
  Synthetic oligonucleotide
tgcacacacatgacgtccgctggatctgctaacat

SEQ ID NO: 62583 - DNA, 35 bp, Artificial Sequence
  Synthetic oligonucleotide
gcaccaccatacgctgcctcactctcgtattccat

SEQ ID NO: 62584 - DNA, 35 bp, Artificial Sequence
  Synthetic oligonucleotide
acgcttgtcgcttgacgcccgccatgtttacctct

SEQ ID NO: 62585 - DNA, 35 bp, Artificial Sequence
  Synthetic oligonucleotide
actaacgatcacgccttgactatcctacctcccgt

SEQ ID NO: 62586 - DNA, 35 bp, Artificial Sequence
  Synthetic oligonucleotide
accagtactcagcctatatctcctctttgccctgt

SEQ ID NO: 62587 - DNA, 35 bp, Artificial Sequence
  Synthetic oligonucleotide
aatatccatgcgggcaccgtgccgtcccatcgctt

SEQ ID NO: 62588 - DNA, 35 bp, Artificial Sequence
  Synthetic oligonucleotide
tcagttcggtccctcacggtatgcatcttaacgtt

SEQ ID NO: 62589 - DNA, 35 bp, Artificial Sequence
  Synthetic oligonucleotide
tccagtcaggtatttcagctgcctactatctcgtt

SEQ ID NO: 62590 - DNA, 36 bp, Artificial Sequence
  Synthetic oligonucleotide
atgtaaccccagccttatcccgcttatgacgcgaaa

SEQ ID NO: 62591 - DNA, 35 bp, Artificial Sequence
  Synthetic oligonucleotide
aacgagggcccaggcgcttatttttgtaacacgaa

SEQ ID NO: 62592 - DNA, 36 bp, Artificial Sequence
  Synthetic oligonucleotide
tcaccacctggggcacctgcgtttagcctgagctaa

SEQ ID NO: 62593 - DNA, 36 bp, Artificial Sequence
  Synthetic oligonucleotide
gcgactctggacgtcaggcccgccctattgatccca

SEQ ID NO: 62594 - DNA, 36 bp, Artificial Sequence
  Synthetic oligonucleotide
atcacatgattattctgtcctgcccgtttcaccgca

SEQ ID NO: 62595 - DNA, 36 bp, Artificial Sequence
  Synthetic oligonucleotide
gaggccagacgcacgcctttctctttgacgtcctca

SEQ ID NO: 62596 - DNA, 37 bp, Artificial Sequence
  Synthetic oligonucleotide
tgttccttccgtgtccgcccagtgaccctctacaaga

SEQ ID NO: 62597 - DNA, 37 bp, Artificial Sequence
  Synthetic oligonucleotide
tacgccttcgcctccctgtccgagctgattctgcaga

SEQ ID NO: 62598 - DNA, 37 bp, Artificial Sequence
  Synthetic oligonucleotide
gcagtcgcgcgcgggtggagggaatacgatggggaga

SEQ ID NO: 62599 - DNA, 35 bp, Artificial Sequence
  Synthetic oligonucleotide
cactatgcccgaccgatctctcttgcccttcacga

SEQ ID NO: 62600 - DNA, 37 bp, Artificial Sequence
  Synthetic oligonucleotide
ggacggcacctttgtacgtttcaagccctgccaccga

SEQ ID NO: 62601 - DNA, 36 bp, Artificial Sequence
  Synthetic oligonucleotide
agtgaaggggaatgctgtactggtaggaggtgtcga

SEQ ID NO: 62602 - DNA, 37 bp, Artificial Sequence
  Synthetic oligonucleotide
gtacatgcgagggtgaccaaggtttcatgggggagga

SEQ ID NO: 62603 - DNA, 37 bp, Artificial Sequence
  Synthetic oligonucleotide
tacgccacgaggcgccctgtccagttttcatcccgga

SEQ ID NO: 62604 - DNA, 36 bp, Artificial Sequence
  Synthetic oligonucleotide
tctgcctcctggccattacttgcccgattactggga

SEQ ID NO: 62605 - DNA, 35 bp, Artificial Sequence
  Synthetic oligonucleotide
ggggggtgcaggaggtttgggccgtaagggaatga

SEQ ID NO: 62606 - DNA, 37 bp, Artificial Sequence
  Synthetic oligonucleotide
tcctctatcctcgctgttggccatagttgccacatga

SEQ ID NO: 62607 - DNA, 38 bp, Artificial Sequence
  Synthetic oligonucleotide
tacacccccactcggcctttcttgctatcagactatga

SEQ ID NO: 62608 - DNA, 37 bp, Artificial Sequence
  Synthetic oligonucleotide
tccgagcatctcccttctgtacactgcgcctccctga

SEQ ID NO: 62609 - DNA, 38 bp, Artificial Sequence
  Synthetic oligonucleotide
gaagaagcgcgggggtaggtaagagcgtgaccagctga

SEQ ID NO: 62610 - DNA, 36 bp, Artificial Sequence
  Synthetic oligonucleotide
aacccatgcgctgcttcgacccaaaacttccgctga

SEQ ID NO: 62611 - DNA, 38 bp, Artificial Sequence
  Synthetic oligonucleotide
tgctctcatcacccccacggctagtgacttccccgtga

SEQ ID NO: 62612 - DNA, 37 bp, Artificial Sequence
  Synthetic oligonucleotide
ggattcccacatacggtccaacatctatgagtggtga

SEQ ID NO: 62613 - DNA, 38 bp, Artificial Sequence
  Synthetic oligonucleotide
gtggtaccggggtcagtgatagggggtgagtgatgtga

SEQ ID NO: 62614 - DNA, 38 bp, Artificial Sequence
  Synthetic oligonucleotide
tgtgggatggggacggggggataagagtcaggtattga

SEQ ID NO: 62615 - DNA, 35 bp, Artificial Sequence
  Synthetic oligonucleotide
taccccgccatactcgtggcgcaacatgcccttga

SEQ ID NO: 62616 - DNA, 38 bp, Artificial Sequence
  Synthetic oligonucleotide
gaacctgtcccacagttgtacttagtcaagcttgttga

SEQ ID NO: 62617 - DNA, 35 bp, Artificial Sequence
  Synthetic oligonucleotide
tacgttgccccccatgtggcacatggcgcccccta

SEQ ID NO: 62618 - DNA, 35 bp, Artificial Sequence
  Synthetic oligonucleotide
acacttattcccccgaccacgcgacctcgatccta

SEQ ID NO: 62619 - DNA, 35 bp, Artificial Sequence
  Synthetic oligonucleotide
gtgagggaacagggaaagttgtatgtgatacagta

SEQ ID NO: 62620 - DNA, 36 bp, Artificial Sequence
  Synthetic oligonucleotide
aagggatggagcagagggctgaaggacggcctagta

SEQ ID NO: 62621 - DNA, 36 bp, Artificial Sequence
  Synthetic oligonucleotide
atgtaaggcgccgcattcccccgcttccgacctgta

SEQ ID NO: 62622 - DNA, 34 bp, Artificial Sequence
  Synthetic oligonucleotide
gacgacttaggatagtgctttggtcactcctgta

SEQ ID NO: 62623 - DNA, 36 bp, Artificial Sequence
  Synthetic oligonucleotide
ggtgaggtgccagcgtaactttccacgcttttatta

SEQ ID NO: 62624 - DNA, 36 bp, Artificial Sequence
  Synthetic oligonucleotide
gttatcgcttggtgcccctgtttcgtaaatggttta

SEQ ID NO: 62625 - DNA, 37 bp, Artificial Sequence
  Synthetic oligonucleotide
tccatcacccgacctttgcgtagttctgcctgtttta

SEQ ID NO: 62626 - DNA, 35 bp, Artificial Sequence
  Synthetic oligonucleotide
atctcgttcgtcctctagctgcgaatttgccccac

SEQ ID NO: 62627 - DNA, 35 bp, Artificial Sequence
  Synthetic oligonucleotide
gtgcgcacaacttttctacatagtcccttggccac

SEQ ID NO: 62628 - DNA, 35 bp, Artificial Sequence
  Synthetic oligonucleotide
agctgccatatctcgttcggcacacacttcgcgac

SEQ ID NO: 62629 - DNA, 35 bp, Artificial Sequence
  Synthetic oligonucleotide
accctaacactgaattcagggaacgtgaacccgcc

SEQ ID NO: 62630 - DNA, 35 bp, Artificial Sequence
  Synthetic oligonucleotide
gacggactccaggcgctgactatactctttatgcc

SEQ ID NO: 62631 - DNA, 35 bp, Artificial Sequence
  Synthetic oligonucleotide
gactcacgtgagtctagatatatcgcacttgatcc

SEQ ID NO: 62632 - DNA, 35 bp, Artificial Sequence
  Synthetic oligonucleotide
tgtggtggctgcaggttattactaatatcgcctcc

SEQ ID NO: 62633 - DNA, 34 bp, Artificial Sequence
  Synthetic oligonucleotide
acccgtcatataagggcgtctctactgttcctcc

SEQ ID NO: 62634 - DNA, 35 bp, Artificial Sequence
  Synthetic oligonucleotide
tccctaccgtcgatacactccattaatgcatgtcc

SEQ ID NO: 62635 - DNA, 35 bp, Artificial Sequence
  Synthetic oligonucleotide
gatgacccatctcctggatcacgatgacttctagc

SEQ ID NO: 62636 - DNA, 35 bp, Artificial Sequence
  Synthetic oligonucleotide
ttgacatctgccggcattacgagccacttggaggc

SEQ ID NO: 62637 - DNA, 35 bp, Artificial Sequence
  Synthetic oligonucleotide
tcccctccctatgattcgccacagcgatgtcatgc

SEQ ID NO: 62638 - DNA, 35 bp, Artificial Sequence
  Synthetic oligonucleotide
gccatactccttgcttccccgctgcacgtttctgc

SEQ ID NO: 62639 - DNA, 35 bp, Artificial Sequence
  Synthetic oligonucleotide
attactcgcagattagctacgttgttgcacccctc

SEQ ID NO: 62640 - DNA, 35 bp, Artificial Sequence
  Synthetic oligonucleotide
atggtgcataccggtgtttactactcgcgcttctc

SEQ ID NO: 62641 - DNA, 35 bp, Artificial Sequence
  Synthetic oligonucleotide
tcatggcctgcatccattgcattctcctggccttc

SEQ ID NO: 62642 - DNA, 35 bp, Artificial Sequence
  Synthetic oligonucleotide
tccttgcgattcatatcgtcacctcgcgatccttc

SEQ ID NO: 62643 - DNA, 35 bp, Artificial Sequence
  Synthetic oligonucleotide
ttgttccccatgttctggactttactgtttgcttc

SEQ ID NO: 62644 - DNA, 35 bp, Artificial Sequence
  Synthetic oligonucleotide
acaacatgagcagtggggctggaggtgatgcgaag

SEQ ID NO: 62645 - DNA, 35 bp, Artificial Sequence
  Synthetic oligonucleotide
ggacagtgaagaagacggggggagtagtaggaggg

SEQ ID NO: 62646 - DNA, 35 bp, Artificial Sequence
  Synthetic oligonucleotide
gtgtgacgtgtgcacgggttagtaatgggttgtgg

SEQ ID NO: 62647 - DNA, 35 bp, Artificial Sequence
  Synthetic oligonucleotide
accttgcccgcccacccaacgtttatcgccctatg

SEQ ID NO: 62648 - DNA, 36 bp, Artificial Sequence
  Synthetic oligonucleotide
gaaccacatagtctctgtgactcacaccattgcctg

SEQ ID NO: 62649 - DNA, 35 bp, Artificial Sequence
  Synthetic oligonucleotide
actatgtgtcaaacccgctacgtactcacttcctg

SEQ ID NO: 62650 - DNA, 35 bp, Artificial Sequence
  Synthetic oligonucleotide
tgaggaggatgcgtagggtagggcgtatgctgctg

SEQ ID NO: 62651 - DNA, 35 bp, Artificial Sequence
  Synthetic oligonucleotide
tcaggccccttcattatagttgtttgttgaatctg

SEQ ID NO: 62652 - DNA, 35 bp, Artificial Sequence
  Synthetic oligonucleotide
agcgccccacgcccacgacttcgcgagaccgccat

SEQ ID NO: 62653 - DNA, 35 bp, Artificial Sequence
  Synthetic oligonucleotide
gagccaagcccgttacgattcccctggtcctatat

SEQ ID NO: 62654 - DNA, 35 bp, Artificial Sequence
  Synthetic oligonucleotide
ggagtacgctgatccatcctatacgtcgcacaact

SEQ ID NO: 62655 - DNA, 35 bp, Artificial Sequence
  Synthetic oligonucleotide
ggaccgtaccgacccactgcaatcacgaccagact

SEQ ID NO: 62656 - DNA, 35 bp, Artificial Sequence
  Synthetic oligonucleotide
agcaaccgcacgactatcaaaaccgaaccattact

SEQ ID NO: 62657 - DNA, 35 bp, Artificial Sequence
  Synthetic oligonucleotide
actgccattcgtaacaggggtacctgttccttact

SEQ ID NO: 62658 - DNA, 35 bp, Artificial Sequence
  Synthetic oligonucleotide
actcccattccaggtacctctcacatgtttgctct

SEQ ID NO: 62659 - DNA, 35 bp, Artificial Sequence
  Synthetic oligonucleotide
gcgattacagcgcatcctgcgactcttttctcatt

SEQ ID NO: 62660 - DNA, 35 bp, Artificial Sequence
  Synthetic oligonucleotide
aactaatcactgctatttgttgcatacccttggtt

SEQ ID NO: 62661 - DNA, 35 bp, Artificial Sequence
  Synthetic oligonucleotide
gacacctatgggcctctgaattgcccgttccattt

SEQ ID NO: 62662 - DNA, 35 bp, Artificial Sequence
  Synthetic oligonucleotide
tgcttcacaaccagcggtcacctcactattagcaa

SEQ ID NO: 62663 - DNA, 35 bp, Artificial Sequence
  Synthetic oligonucleotide
tgcgatccagccactctaacgttacacagcctcaa

SEQ ID NO: 62664 - DNA, 36 bp, Artificial Sequence
  Synthetic oligonucleotide
ggagccgacccacacacgtatctcacattagtagaa

SEQ ID NO: 62665 - DNA, 36 bp, Artificial Sequence
  Synthetic oligonucleotide
tcaaccatcgctgcctgggcctaacgcaaaaaataa

SEQ ID NO: 62666 - DNA, 36 bp, Artificial Sequence
  Synthetic oligonucleotide
tcccgtgctgattcgggaccctttcttatcccgcca

SEQ ID NO: 62667 - DNA, 36 bp, Artificial Sequence
  Synthetic oligonucleotide
gatcaggccgaccgctccatctgctcgtcttttcca

SEQ ID NO: 62668 - DNA, 35 bp, Artificial Sequence
  Synthetic oligonucleotide
ttctcgggcacccttcttcgcctacccattatgca

SEQ ID NO: 62669 - DNA, 36 bp, Artificial Sequence
  Synthetic oligonucleotide
gtgggtgccgggggtagcagtaaggattggaacaga

SEQ ID NO: 62670 - DNA, 37 bp, Artificial Sequence
  Synthetic oligonucleotide
tgccgtgccctccgtgcgcctatccacattcaccaga

SEQ ID NO: 62671 - DNA, 36 bp, Artificial Sequence
  Synthetic oligonucleotide
gctacgatcgccagtgttgtcccatgcaccttcaga

SEQ ID NO: 62672 - DNA, 37 bp, Artificial Sequence
  Synthetic oligonucleotide
gtgtgcataggcctgatttggtggtggtgtggggaga

SEQ ID NO: 62673 - DNA, 37 bp, Artificial Sequence
  Synthetic oligonucleotide
gagagggagcacaaggaacaggtaaggtatggataga

SEQ ID NO: 62674 - DNA, 37 bp, Artificial Sequence
  Synthetic oligonucleotide
tacaacccgattcatgacatttagctcacatcaacga

SEQ ID NO: 62675 - DNA, 37 bp, Artificial Sequence
  Synthetic oligonucleotide
gatgtagcgtgcttcctaactgccccacgaattacga

SEQ ID NO: 62676 - DNA, 36 bp, Artificial Sequence
  Synthetic oligonucleotide
gacccacaaacggatggccccacgatgaccccccga

SEQ ID NO: 62677 - DNA, 36 bp, Artificial Sequence
  Synthetic oligonucleotide
gcccgccttccaagcaactggcctcccgaattccga

SEQ ID NO: 62678 - DNA, 37 bp, Artificial Sequence
  Synthetic oligonucleotide
tatcggcggaacccgagtttctgtgccatcattccga

SEQ ID NO: 62679 - DNA, 37 bp, Artificial Sequence
  Synthetic oligonucleotide
gcacgtccagctcacaccaccctgctttcgaccagga

SEQ ID NO: 62680 - DNA, 37 bp, Artificial Sequence
  Synthetic oligonucleotide
atgacgcacaggagcatagatttaataggacagagga

SEQ ID NO: 62681 - DNA, 36 bp, Artificial Sequence
  Synthetic oligonucleotide
tccctgcgcaaactctattagccccccttcaccgga

SEQ ID NO: 62682 - DNA, 37 bp, Artificial Sequence
  Synthetic oligonucleotide
tcccgcctgattgcgttatttccttttctctacatga

SEQ ID NO: 62683 - DNA, 38 bp, Artificial Sequence
  Synthetic oligonucleotide
atcaccaccgctgtactctaaaattacgccgatcatga

SEQ ID NO: 62684 - DNA, 38 bp, Artificial Sequence
  Synthetic oligonucleotide
taacgcacggtcaaagcgaaacccgacctttatcatga

SEQ ID NO: 62685 - DNA, 38 bp, Artificial Sequence
  Synthetic oligonucleotide
tatgtgtgcgggcgggcgtacttggaggggagggatga

SEQ ID NO: 62686 - DNA, 37 bp, Artificial Sequence
  Synthetic oligonucleotide
gtcgcacctcctgccccaataggcgccgctactatga

SEQ ID NO: 62687 - DNA, 37 bp, Artificial Sequence
  Synthetic oligonucleotide
actgacacgtggttagcggggtaaaggcggaaactga

SEQ ID NO: 62688 - DNA, 37 bp, Artificial Sequence
  Synthetic oligonucleotide
gcgccccagacgcacgttaaacctatattggaactga

SEQ ID NO: 62689 - DNA, 38 bp, Artificial Sequence
  Synthetic oligonucleotide
gtcacagtccatatccgtgccgtaacttttataactga

SEQ ID NO: 62690 - DNA, 38 bp, Artificial Sequence
  Synthetic oligonucleotide
acaacaatgtgctgaatctgcccgtatcgttcacctga

SEQ ID NO: 62691 - DNA, 38 bp, Artificial Sequence
  Synthetic oligonucleotide
atttcgcgcgcacagttccttaggatgccctcctctga

SEQ ID NO: 62692 - DNA, 38 bp, Artificial Sequence
  Synthetic oligonucleotide
aagacaggggtacacattagtagtgtgaaggcgagtga

SEQ ID NO: 62693 - DNA, 37 bp, Artificial Sequence
  Synthetic oligonucleotide
accactcactctcatgctcttcattacgtgtacgtga

SEQ ID NO: 62694 - DNA, 37 bp, Artificial Sequence
  Synthetic oligonucleotide
gtttgggccagtagaaactaaggagaggagacggtga

SEQ ID NO: 62695 - DNA, 38 bp, Artificial Sequence
  Synthetic oligonucleotide
gctgctcaggacgatctgggaggttgggggaagggtga

SEQ ID NO: 62696 - DNA, 38 bp, Artificial Sequence
  Synthetic oligonucleotide
gagaacgaaaagtgaggcgatgggaaacgtaaatgtga

SEQ ID NO: 62697 - DNA, 38 bp, Artificial Sequence
  Synthetic oligonucleotide
agatcgggcgtgggtggcgctatctttccttgccttga

SEQ ID NO: 62698 - DNA, 38 bp, Artificial Sequence
  Synthetic oligonucleotide
acatatctcgcccctggtctcacagttcaaatcgttga

SEQ ID NO: 62699 - DNA, 38 bp, Artificial Sequence
  Synthetic oligonucleotide
tcacccgatactgttctgtcatcccatctaccatttga

SEQ ID NO: 62700 - DNA, 38 bp, Artificial Sequence
  Synthetic oligonucleotide
taccactcatatgaccagtcacgccgccgtccctttga

SEQ ID NO: 62701 - DNA, 38 bp, Artificial Sequence
  Synthetic oligonucleotide
gtgcccgcccagtgaacccagcccggaacatattttga

SEQ ID NO: 62702 - DNA, 36 bp, Artificial Sequence
  Synthetic oligonucleotide
gccggacggcacttctttgcatcacacctccgtata

SEQ ID NO: 62703 - DNA, 35 bp, Artificial Sequence
  Synthetic oligonucleotide
gagcacacaccaccgagctgctccatctgccccta

SEQ ID NO: 62704 - DNA, 35 bp, Artificial Sequence
  Synthetic oligonucleotide
ggtggagttcctgttctagctgcttcattcgccta

SEQ ID NO: 62705 - DNA, 36 bp, Artificial Sequence
  Synthetic oligonucleotide
attgcccaacgactgttatccagctcgtacttgtta

SEQ ID NO: 62706 - DNA, 35 bp, Artificial Sequence
  Synthetic oligonucleotide
tcaacgcatgcgatataatcgtcccctcgtcgcac

SEQ ID NO: 62707 - DNA, 35 bp, Artificial Sequence
  Synthetic oligonucleotide
tcacgacatcagcttggccgcaattgtgttcctac

SEQ ID NO: 62708 - DNA, 35 bp, Artificial Sequence
  Synthetic oligonucleotide
cctgctccgactgctgccacctatctcgcttgtac

SEQ ID NO: 62709 - DNA, 35 bp, Artificial Sequence
  Synthetic oligonucleotide
caacacccacgaacccggttccgttactgctttac

SEQ ID NO: 62710 - DNA, 35 bp, Artificial Sequence
  Synthetic oligonucleotide
taccaaccgtcgtcacgagtcgtcaatgcaacacc

SEQ ID NO: 62711 - DNA, 33 bp, Artificial Sequence
  Synthetic oligonucleotide
tgcccctaccccttttcattccggtcttgggcc

SEQ ID NO: 62712 - DNA, 35 bp, Artificial Sequence
  Synthetic oligonucleotide
tcacgtgcggccacaactgcgcgttcctatcatcc

SEQ ID NO: 62713 - DNA, 35 bp, Artificial Sequence
  Synthetic oligonucleotide
gacgtgagcgcaggtgcaatcccaatcatccgtcc

SEQ ID NO: 62714 - DNA, 35 bp, Artificial Sequence
  Synthetic oligonucleotide
ttgatacaccgatgtgggtgtttaccgccccctgc

SEQ ID NO: 62715 - DNA, 35 bp, Artificial Sequence
  Synthetic oligonucleotide
ttgataacccggctagcgctaccccatgacgttgc

SEQ ID NO: 62716 - DNA, 35 bp, Artificial Sequence
  Synthetic oligonucleotide
accggtcccatgctgtatcccttcttttacgtatc

SEQ ID NO: 62717 - DNA, 35 bp, Artificial Sequence
  Synthetic oligonucleotide
tccatccccgcacgacgtctttcgttaatcgtatc

SEQ ID NO: 62718 - DNA, 35 bp, Artificial Sequence
  Synthetic oligonucleotide
gcctcccattgtaaatacgaatgcaacggttcctc

SEQ ID NO: 62719 - DNA, 35 bp, Artificial Sequence
  Synthetic oligonucleotide
atacaccgactaccatggcctcgcacttacggctc

SEQ ID NO: 62720 - DNA, 35 bp, Artificial Sequence
  Synthetic oligonucleotide
ggaaccactgtcaacaccgtgaactcacttggctc

SEQ ID NO: 62721 - DNA, 35 bp, Artificial Sequence
  Synthetic oligonucleotide
gttagcatggcggtactaacatcgcttccactttc

SEQ ID NO: 62722 - DNA, 35 bp, Artificial Sequence
  Synthetic oligonucleotide
ggtgcaacctatgtaaagcatcgacctctcttttc

SEQ ID NO: 62723 - DNA, 35 bp, Artificial Sequence
  Synthetic oligonucleotide
accaaccccatctgaatgcaaggcgtttttctacg

SEQ ID NO: 62724 - DNA, 35 bp, Artificial Sequence
  Synthetic oligonucleotide
tacatcctagctctacctatcatcgcgttcccccg

SEQ ID NO: 62725 - DNA, 35 bp, Artificial Sequence
  Synthetic oligonucleotide
atttgtgcagcaataagtgcggggggggaggaggg

SEQ ID NO: 62726 - DNA, 35 bp, Artificial Sequence
  Synthetic oligonucleotide
acaacactcacgtacccctccaacttgctacgggg

SEQ ID NO: 62727 - DNA, 35 bp, Artificial Sequence
  Synthetic oligonucleotide
tctacccacaacggacatggagctgttccctactg

SEQ ID NO: 62728 - DNA, 35 bp, Artificial Sequence
  Synthetic oligonucleotide
ggccatacctgcttgttcatttttcattgcccctg

SEQ ID NO: 62729 - DNA, 35 bp, Artificial Sequence
  Synthetic oligonucleotide
ttgcaagggggcgaaagaacacagttaagttagtg

SEQ ID NO: 62730 - DNA, 35 bp, Artificial Sequence
  Synthetic oligonucleotide
tcctgaacaacgtcttaccctgtttttttcgccat

SEQ ID NO: 62731 - DNA, 35 bp, Artificial Sequence
  Synthetic oligonucleotide
gatggtgcggccctacccttctataacgtgttcat

SEQ ID NO: 62732 - DNA, 34 bp, Artificial Sequence
  Synthetic oligonucleotide
acaagtgcgctatgcgatatccgttctcagccct

SEQ ID NO: 62733 - DNA, 35 bp, Artificial Sequence
  Synthetic oligonucleotide
tacgcgcgggaggtgttccatagtctctgccctct

SEQ ID NO: 62734 - DNA, 35 bp, Artificial Sequence
  Synthetic oligonucleotide
tcaacgacattggcacagccccgcctaactatcgt

SEQ ID NO: 62735 - DNA, 35 bp, Artificial Sequence
  Synthetic oligonucleotide
gtgcacctccggtccgagccatcccacctaactgt

SEQ ID NO: 62736 - DNA, 35 bp, Artificial Sequence
  Synthetic oligonucleotide
gacccagaccgacatccattacccgcttcttctgt

SEQ ID NO: 62737 - DNA, 36 bp, Artificial Sequence
  Synthetic oligonucleotide
atgtagtacgcaaacaatgtaacacacacgggaaaa

SEQ ID NO: 62738 - DNA, 35 bp, Artificial Sequence
  Synthetic oligonucleotide
ttacacgctcctctcgccaagattccggggcccaa

SEQ ID NO: 62739 - DNA, 35 bp, Artificial Sequence
  Synthetic oligonucleotide
tctcccgtcggaggatctcctgccacacccgtgaa

SEQ ID NO: 62740 - DNA, 36 bp, Artificial Sequence
  Synthetic oligonucleotide
ggtccgcccacaattgtcaaacttctttatatcaca

SEQ ID NO: 62741 - DNA, 36 bp, Artificial Sequence
  Synthetic oligonucleotide
gttgaaccacgttcccaaattgccaatagaagacca

SEQ ID NO: 62742 - DNA, 36 bp, Artificial Sequence
  Synthetic oligonucleotide
tggtcatgccacacactcgaatagctcccgccgcca

SEQ ID NO: 62743 - DNA, 36 bp, Artificial Sequence
  Synthetic oligonucleotide
attccccacctatcctagcgcactgaacagtaggca

SEQ ID NO: 62744 - DNA, 36 bp, Artificial Sequence
  Synthetic oligonucleotide
acgaccctacagtctgaatctcctgcaccacttgca

SEQ ID NO: 62745 - DNA, 35 bp, Artificial Sequence
  Synthetic oligonucleotide
taccctacaaccgagccgctgtttccctccactca

SEQ ID NO: 62746 - DNA, 36 bp, Artificial Sequence
  Synthetic oligonucleotide
gccccgggccccgcattttttcggtaaacattctca

SEQ ID NO: 62747 - DNA, 35 bp, Artificial Sequence
  Synthetic oligonucleotide
tcaatgcgccattcatttacgaccatgggccttca

SEQ ID NO: 62748 - DNA, 35 bp, Artificial Sequence
  Synthetic oligonucleotide
gctcagcaccttccttgccaccgcccttgtcttca

SEQ ID NO: 62749 - DNA, 37 bp, Artificial Sequence
  Synthetic oligonucleotide
tccctgcgcacgcctgtccttgccgtaattctgaaga

SEQ ID NO: 62750 - DNA, 37 bp, Artificial Sequence
  Synthetic oligonucleotide
tgtagaggggtggggagtagcgggaggagccgtacga

SEQ ID NO: 62751 - DNA, 37 bp, Artificial Sequence
  Synthetic oligonucleotide
ttcgcgtagccccgcctactatacaagcctattacga

SEQ ID NO: 62752 - DNA, 36 bp, Artificial Sequence
  Synthetic oligonucleotide
gcccacgcctctctgctacgggttttcaattgccga

SEQ ID NO: 62753 - DNA, 36 bp, Artificial Sequence
  Synthetic oligonucleotide
ttcttccgcccatccgtgatgacttcccgttgccga

SEQ ID NO: 62754 - DNA, 37 bp, Artificial Sequence
  Synthetic oligonucleotide
acaacccatccgcgccagttcacgcggccccctccga

SEQ ID NO: 62755 - DNA, 36 bp, Artificial Sequence
  Synthetic oligonucleotide
atgtagtgcagttgtgacggctaataggcatttcga

SEQ ID NO: 62756 - DNA, 36 bp, Artificial Sequence
  Synthetic oligonucleotide
ttcacctgtgaacgtacgtaagcccgccactttcga

SEQ ID NO: 62757 - DNA, 37 bp, Artificial Sequence
  Synthetic oligonucleotide
atgccgtgggggctatggggtttaactgtggggcgga

SEQ ID NO: 62758 - DNA, 37 bp, Artificial Sequence
  Synthetic oligonucleotide
gccgtgcctccctcagttaggtacttatcccacggga

SEQ ID NO: 62759 - DNA, 37 bp, Artificial Sequence
  Synthetic oligonucleotide
gttcttgcccctcctatagtttgtacacacccatgga

SEQ ID NO: 62760 - DNA, 37 bp, Artificial Sequence
  Synthetic oligonucleotide
gcaatcgcgttaacgggttctccatccaccccctgga

SEQ ID NO: 62761 - DNA, 36 bp, Artificial Sequence
  Synthetic oligonucleotide
tgtgagggggtgcagtatcaaggaggagcatctgga

SEQ ID NO: 62762 - DNA, 38 bp, Artificial Sequence
  Synthetic oligonucleotide
tgtgcatgcctcggctccatttattctgacgcaactga

SEQ ID NO: 62763 - DNA, 38 bp, Artificial Sequence
  Synthetic oligonucleotide
gtgttccgcagcatcgacaccgtaccttcctgtcctga

SEQ ID NO: 62764 - DNA, 38 bp, Artificial Sequence
  Synthetic oligonucleotide
gacacgagctcatcaataggatgccatttttttcctga

SEQ ID NO: 62765 - DNA, 38 bp, Artificial Sequence
  Synthetic oligonucleotide
tacgctcgcagggccaacattctaactgcactagctga

SEQ ID NO: 62766 - DNA, 38 bp, Artificial Sequence
  Synthetic oligonucleotide
acatacatgagggcgaatgacacggtcacacattgtga

SEQ ID NO: 62767 - DNA, 36 bp, Artificial Sequence
  Synthetic oligonucleotide
gaggaagacctagggaatatagggaagaacttgtga

SEQ ID NO: 62768 - DNA, 38 bp, Artificial Sequence
  Synthetic oligonucleotide
aacggaacaggggaacgggtagtatccatgcaaattga

SEQ ID NO: 62769 - DNA, 37 bp, Artificial Sequence
  Synthetic oligonucleotide
gtaatacccacacgatcttgctgagacccctccttga

SEQ ID NO: 62770 - DNA, 38 bp, Artificial Sequence
  Synthetic oligonucleotide
gtcccgccatcgacctccaagcgccctgttcggcttga

SEQ ID NO: 62771 - DNA, 36 bp, Artificial Sequence
  Synthetic oligonucleotide
atctaccttcaccaaaccgcactctggcctctttga

SEQ ID NO: 62772 - DNA, 36 bp, Artificial Sequence
  Synthetic oligonucleotide
tccgagggtgacaggtggggaggttcaggtcagcta

SEQ ID NO: 62773 - DNA, 35 bp, Artificial Sequence
  Synthetic oligonucleotide
tatgagagcggtcaaagaaagtacggggcgggcta

SEQ ID NO: 62774 - DNA, 36 bp, Artificial Sequence
  Synthetic oligonucleotide
tcagcaaccaccatcgctgagagctttttcgtgcta

SEQ ID NO: 62775 - DNA, 36 bp, Artificial Sequence
  Synthetic oligonucleotide
tccctgcgcaaacgctattagccccccttcaccgta

SEQ ID NO: 62776 - DNA, 36 bp, Artificial Sequence
  Synthetic oligonucleotide
tgcaccacaccaaagggatcctacatccagccctta

SEQ ID NO: 62777 - DNA, 35 bp, Artificial Sequence
  Synthetic oligonucleotide
actgagccgtgcaaccgtttgttagtcctgcgaac

SEQ ID NO: 62778 - DNA, 35 bp, Artificial Sequence
  Synthetic oligonucleotide
aacagtgctctgcagaacctgcctacgttttgaac

SEQ ID NO: 62779 - DNA, 35 bp, Artificial Sequence
  Synthetic oligonucleotide
gtgtcctccgaccccaaacctgtttatccgactac

SEQ ID NO: 62780 - DNA, 35 bp, Artificial Sequence
  Synthetic oligonucleotide
gctactgcccgtagccataggagtttacacgctac

SEQ ID NO: 62781 - DNA, 35 bp, Artificial Sequence
  Synthetic oligonucleotide
acttccctacgtccttactgtccaccctcggaccc

SEQ ID NO: 62782 - DNA, 35 bp, Artificial Sequence
  Synthetic oligonucleotide
ccccccaatacgcccgtgattatttgatccacccc

SEQ ID NO: 62783 - DNA, 35 bp, Artificial Sequence
  Synthetic oligonucleotide
tccacagtgcccgctacccttcaccagtctcgccc

SEQ ID NO: 62784 - DNA, 35 bp, Artificial Sequence
  Synthetic oligonucleotide
tacgattcaagtacgctggtacgactagcactccc

SEQ ID NO: 62785 - DNA, 35 bp, Artificial Sequence
  Synthetic oligonucleotide
tccgtatgtactgccgacgttcgttccgtgtctcc

SEQ ID NO: 62786 - DNA, 35 bp, Artificial Sequence
  Synthetic oligonucleotide
acatagcgtattggtttcccctcccacttcgttcc

SEQ ID NO: 62787 - DNA, 35 bp, Artificial Sequence
  Synthetic oligonucleotide
acacagcccagttgattatttctcccttcctttcc

SEQ ID NO: 62788 - DNA, 35 bp, Artificial Sequence
  Synthetic oligonucleotide
aagactcaccctcgtgtaataacatcactatcagc

SEQ ID NO: 62789 - DNA, 35 bp, Artificial Sequence
  Synthetic oligonucleotide
atcttcatcgggacatcacccgccgcacctggagc

SEQ ID NO: 62790 - DNA, 35 bp, Artificial Sequence
  Synthetic oligonucleotide
gcccttcctcatgtccgagcaatagctttttatgc

SEQ ID NO: 62791 - DNA, 35 bp, Artificial Sequence
  Synthetic oligonucleotide
actccggcacactcggtcactttaaccacgatctc

SEQ ID NO: 62792 - DNA, 35 bp, Artificial Sequence
  Synthetic oligonucleotide
ttccctccccgtgctcgttgccgatagtaacagtc

SEQ ID NO: 62793 - DNA, 35 bp, Artificial Sequence
  Synthetic oligonucleotide
tccacaattatggacactttgcacgacccttagtc

SEQ ID NO: 62794 - DNA, 35 bp, Artificial Sequence
  Synthetic oligonucleotide
tcgtctccactcttgtctccgcctgcctcattgag

SEQ ID NO: 62795 - DNA, 35 bp, Artificial Sequence
  Synthetic oligonucleotide
gtccagagactggtgggtagggaggggtgaaatag

SEQ ID NO: 62796 - DNA, 35 bp, Artificial Sequence
  Synthetic oligonucleotide
acaatgccggttgcgcacttattcacacggctacg

SEQ ID NO: 62797 - DNA, 35 bp, Artificial Sequence
  Synthetic oligonucleotide
acaccccagagatagcttggcattattgacactgg

SEQ ID NO: 62798 - DNA, 35 bp, Artificial Sequence
  Synthetic oligonucleotide
gatccaaactccgtcacttctgcctgtctgcctgg

SEQ ID NO: 62799 - DNA, 35 bp, Artificial Sequence
  Synthetic oligonucleotide
tccgatccgccctctctcatttcctgtacagcttg

SEQ ID NO: 62800 - DNA, 35 bp, Artificial Sequence
  Synthetic oligonucleotide
gccgcctcgcagccggtctcagttgcccttgtttg

SEQ ID NO: 62801 - DNA, 35 bp, Artificial Sequence
  Synthetic oligonucleotide
gtgagggccctgacatgagctggaacttcataact

SEQ ID NO: 62802 - DNA, 35 bp, Artificial Sequence
  Synthetic oligonucleotide
gaggtgtccagctgccccggcctccaaccccgact

SEQ ID NO: 62803 - DNA, 35 bp, Artificial Sequence
  Synthetic oligonucleotide
acctcgaccgcctgaaggcatccagatttaaacct

SEQ ID NO: 62804 - DNA, 35 bp, Artificial Sequence
  Synthetic oligonucleotide
aatcgcgacggtccccgactttgaaccaaccgcct

SEQ ID NO: 62805 - DNA, 35 bp, Artificial Sequence
  Synthetic oligonucleotide
tccgtcgtcccatcgagttcgcttttcgtggtcct

SEQ ID NO: 62806 - DNA, 35 bp, Artificial Sequence
  Synthetic oligonucleotide
gttgcttagccaacccttacccattcgcgcctgct

SEQ ID NO: 62807 - DNA, 35 bp, Artificial Sequence
  Synthetic oligonucleotide
tccccgaaacacaggagactccctgtttaacctct

SEQ ID NO: 62808 - DNA, 35 bp, Artificial Sequence
  Synthetic oligonucleotide
aagcaccgtaccacccattccgagctacaaggtct

SEQ ID NO: 62809 - DNA, 35 bp, Artificial Sequence
  Synthetic oligonucleotide
gaaaggacggataaaacggacggcaaagcgggtct

SEQ ID NO: 62810 - DNA, 35 bp, Artificial Sequence
  Synthetic oligonucleotide
acgcgccctgtggctcagggcccgttgccccttct

SEQ ID NO: 62811 - DNA, 35 bp, Artificial Sequence
  Synthetic oligonucleotide
ccacgccacccacctcgagcaccaccggtcgttct

SEQ ID NO: 62812 - DNA, 35 bp, Artificial Sequence
  Synthetic oligonucleotide
taaaccgtccagtttcctcgcttaccatgctacgt

SEQ ID NO: 62813 - DNA, 35 bp, Artificial Sequence
  Synthetic oligonucleotide
tgccgaccttgcgcctgttcttattgattcatcgt

SEQ ID NO: 62814 - DNA, 35 bp, Artificial Sequence
  Synthetic oligonucleotide
tgatcacttttccacctcgaccagacgggtcctgt

SEQ ID NO: 62815 - DNA, 36 bp, Artificial Sequence
  Synthetic oligonucleotide
agcaccacaatatgttaccgcgcttgggcctcgcaa

SEQ ID NO: 62816 - DNA, 36 bp, Artificial Sequence
  Synthetic oligonucleotide
agtggccaggtccccgctcacggccgcaactttcaa

SEQ ID NO: 62817 - DNA, 36 bp, Artificial Sequence
  Synthetic oligonucleotide
acctggggaatggtggctgatagaacagtggtcgaa

SEQ ID NO: 62818 - DNA, 35 bp, Artificial Sequence
  Synthetic oligonucleotide
gataccccgcgtggggaggaggtacatctaacaca

SEQ ID NO: 62819 - DNA, 36 bp, Artificial Sequence
  Synthetic oligonucleotide
acatgcaaggcattagtacacgcacctctcagcaca

SEQ ID NO: 62820 - DNA, 36 bp, Artificial Sequence
  Synthetic oligonucleotide
tattgcccttgttggccctgcacccgttcttctaca

SEQ ID NO: 62821 - DNA, 36 bp, Artificial Sequence
  Synthetic oligonucleotide
tacgatcgggaatggctatgaaccgactgactacca

SEQ ID NO: 62822 - DNA, 36 bp, Artificial Sequence
  Synthetic oligonucleotide
ttgcctaccatgccgctgtagtccagcttagaccca

SEQ ID NO: 62823 - DNA, 35 bp, Artificial Sequence
  Synthetic oligonucleotide
ggtgcgtaagcatccacatgagtctttcataccca

SEQ ID NO: 62824 - DNA, 35 bp, Artificial Sequence
  Synthetic oligonucleotide
ggtggagtagtatggctattcctcgtgccccccca

SEQ ID NO: 62825 - DNA, 35 bp, Artificial Sequence
  Synthetic oligonucleotide
accatcgcctggctattgctctctcaggttggcca

SEQ ID NO: 62826 - DNA, 36 bp, Artificial Sequence
  Synthetic oligonucleotide
atgacggcctactcgggactccctctgtgaaacgca

SEQ ID NO: 62827 - DNA, 36 bp, Artificial Sequence
  Synthetic oligonucleotide
ggtgtcaacaggggaggataagggggttggcgatca

SEQ ID NO: 62828 - DNA, 36 bp, Artificial Sequence
  Synthetic oligonucleotide
acgccccgatcccactgtagcccatggcctcgttca

SEQ ID NO: 62829 - DNA, 37 bp, Artificial Sequence
  Synthetic oligonucleotide
ttgggaagtggggctgggtcggggcgcggcggggaga

SEQ ID NO: 62830 - DNA, 37 bp, Artificial Sequence
  Synthetic oligonucleotide
gcgtagggtggaggagcgggtggatactgctctgaga

SEQ ID NO: 62831 - DNA, 37 bp, Artificial Sequence
  Synthetic oligonucleotide
tagtggggggagccggagttgtaacgtctgataacga

SEQ ID NO: 62832 - DNA, 36 bp, Artificial Sequence
  Synthetic oligonucleotide
gacaaggcaaaacctgtccaggagatcaatggacga

SEQ ID NO: 62833 - DNA, 35 bp, Artificial Sequence
  Synthetic oligonucleotide
agtgcgcgggttatgaagggcaagggaggaagcga

SEQ ID NO: 62834 - DNA, 37 bp, Artificial Sequence
  Synthetic oligonucleotide
acgctacaccatcccatgttctgaaacagcccatcga

SEQ ID NO: 62835 - DNA, 37 bp, Artificial Sequence
  Synthetic oligonucleotide
tacatggctggtggaggttgaggcaagggaggaagga

SEQ ID NO: 62836 - DNA, 37 bp, Artificial Sequence
  Synthetic oligonucleotide
tcacacacacacccaggcgagacaaattgcaaacgga

SEQ ID NO: 62837 - DNA, 37 bp, Artificial Sequence
  Synthetic oligonucleotide
tccgacctccgctgccgattctcttttagcgtacgga

SEQ ID NO: 62838 - DNA, 37 bp, Artificial Sequence
  Synthetic oligonucleotide
tcactcgtcgaaccaccttgcctttcatcgtaccgga

SEQ ID NO: 62839 - DNA, 37 bp, Artificial Sequence
  Synthetic oligonucleotide
accttgcgcggaatatcgcaacctcccctgtcccgga

SEQ ID NO: 62840 - DNA, 37 bp, Artificial Sequence
  Synthetic oligonucleotide
tgccacgcctggcctcccacagtcacgctactcggga

SEQ ID NO: 62841 - DNA, 37 bp, Artificial Sequence
  Synthetic oligonucleotide
atgatatcacctctccgccccatcggtgtaatgggga

SEQ ID NO: 62842 - DNA, 37 bp, Artificial Sequence
  Synthetic oligonucleotide
ttaggagggaccgtgaaatacaggggtggtgggtgga

SEQ ID NO: 62843 - DNA, 37 bp, Artificial Sequence
  Synthetic oligonucleotide
gctcggagcacccccgttctacatcatgccctttgga

SEQ ID NO: 62844 - DNA, 38 bp, Artificial Sequence
  Synthetic oligonucleotide
atcccaaccgtaacttagtagaacacccaccgaaatga

SEQ ID NO: 62845 - DNA, 36 bp, Artificial Sequence
  Synthetic oligonucleotide
ttggacgcccactcagcctccgtaaccctgtgatga

SEQ ID NO: 62846 - DNA, 37 bp, Artificial Sequence
  Synthetic oligonucleotide
taccctccgctcccgtagtcttagagcttgcctatga

SEQ ID NO: 62847 - DNA, 36 bp, Artificial Sequence
  Synthetic oligonucleotide
tgtccatcacccgcccgctcataacgtctcgtatga

SEQ ID NO: 62848 - DNA, 37 bp, Artificial Sequence
  Synthetic oligonucleotide
acctagcgccagactattatgcttggtttgccactga

SEQ ID NO: 62849 - DNA, 38 bp, Artificial Sequence
  Synthetic oligonucleotide
tcccccgatcatttgttttcgctagccctatctactga

SEQ ID NO: 62850 - DNA, 38 bp, Artificial Sequence
  Synthetic oligonucleotide
gacacactgggaactgtgacgccatccactacacctga

SEQ ID NO: 62851 - DNA, 38 bp, Artificial Sequence
  Synthetic oligonucleotide
ggatccacccgtacaatcaatcgccggttctttcctga

SEQ ID NO: 62852 - DNA, 38 bp, Artificial Sequence
  Synthetic oligonucleotide
gctgtccattcgattcctgccacagcctaccttgctga

SEQ ID NO: 62853 - DNA, 37 bp, Artificial Sequence
  Synthetic oligonucleotide
tctcatccgtccctatcgatacctaccgtttctctga

SEQ ID NO: 62854 - DNA, 38 bp, Artificial Sequence
  Synthetic oligonucleotide
taattcgccactcggtcgttccacccacgttttcgtga

SEQ ID NO: 62855 - DNA, 36 bp, Artificial Sequence
  Synthetic oligonucleotide
tttgggttggaaaacgggggaggggaaaaggtgtga

SEQ ID NO: 62856 - DNA, 37 bp, Artificial Sequence
  Synthetic oligonucleotide
gtagccagaacatgaccgctagcttttctcaccttga

SEQ ID NO: 62857 - DNA, 37 bp, Artificial Sequence
  Synthetic oligonucleotide
tacgtacgcccgaacgtggcatactttactcgcttga

SEQ ID NO: 62858 - DNA, 35 bp, Artificial Sequence
  Synthetic oligonucleotide
aatggggggcaagtgagagaaaggacgtgggttga

SEQ ID NO: 62859 - DNA, 37 bp, Artificial Sequence
  Synthetic oligonucleotide
tgagtcacctcactgtttcggtgtacatccattttga

SEQ ID NO: 62860 - DNA, 36 bp, Artificial Sequence
  Synthetic oligonucleotide
attcgtgtaccgcagtgaaactgtgcccctttccta

SEQ ID NO: 62861 - DNA, 36 bp, Artificial Sequence
  Synthetic oligonucleotide
tgacagaagcggacagttatcctacaccctcccgta

SEQ ID NO: 62862 - DNA, 35 bp, Artificial Sequence
  Synthetic oligonucleotide
gcgacggtcgctcccccatcagcgttacagactta

SEQ ID NO: 62863 - DNA, 35 bp, Artificial Sequence
  Synthetic oligonucleotide
tgtgaggggcccgctaaaagggggggtggaattta

SEQ ID NO: 62864 - DNA, 35 bp, Artificial Sequence
  Synthetic oligonucleotide
acatccaggtagctatgcgaagatcgcccacttta

SEQ ID NO: 62865 - DNA, 35 bp, Artificial Sequence
  Synthetic oligonucleotide
gtggccccgcacctagcccttttacattcagcgac

SEQ ID NO: 62866 - DNA, 35 bp, Artificial Sequence
  Synthetic oligonucleotide
ttagcgtaggaacaatgcttcacagtactgcctcc

SEQ ID NO: 62867 - DNA, 35 bp, Artificial Sequence
  Synthetic oligonucleotide
acttcgacagggtatcgcccatcttgaacccaagc

SEQ ID NO: 62868 - DNA, 35 bp, Artificial Sequence
  Synthetic oligonucleotide
gtggcaccctgggctccggacaacccgtaatccgc

SEQ ID NO: 62869 - DNA, 34 bp, Artificial Sequence
  Synthetic oligonucleotide
gccggtgcacaccgccgtgaccccaccctcgctc

SEQ ID NO: 62870 - DNA, 35 bp, Artificial Sequence
  Synthetic oligonucleotide
gggactagagggtgtgggaacgaggtaagggggcg

SEQ ID NO: 62871 - DNA, 35 bp, Artificial Sequence
  Synthetic oligonucleotide
tgcaaatacagcgcggtctcgtaacaacattttcg

SEQ ID NO: 62872 - DNA, 35 bp, Artificial Sequence
  Synthetic oligonucleotide
gtcctcgcccctcactcatctcatccgagattagg

SEQ ID NO: 62873 - DNA, 35 bp, Artificial Sequence
  Synthetic oligonucleotide
tagtggctgcagatagggaggagggagcgtaatgg

SEQ ID NO: 62874 - DNA, 35 bp, Artificial Sequence
  Synthetic oligonucleotide
atctccttaagcacgcaccttgctactccgccctg

SEQ ID NO: 62875 - DNA, 35 bp, Artificial Sequence
  Synthetic oligonucleotide
gtctacgaaacttactgcgaaaccgcgacctcctg

SEQ ID NO: 62876 - DNA, 35 bp, Artificial Sequence
  Synthetic oligonucleotide
atgacctcggttcctgctcctaacacattgttctg

SEQ ID NO: 62877 - DNA, 35 bp, Artificial Sequence
  Synthetic oligonucleotide
ttgacataccttctgttcataccgccccccgagtg

SEQ ID NO: 62878 - DNA, 35 bp, Artificial Sequence
  Synthetic oligonucleotide
atgcggaggctgaatctgcactgcaaacacatgtg

SEQ ID NO: 62879 - DNA, 35 bp, Artificial Sequence
  Synthetic oligonucleotide
tgcgatcgactaattgtctctgtgcccccatgcat

SEQ ID NO: 62880 - DNA, 35 bp, Artificial Sequence
  Synthetic oligonucleotide
acgcgattccagagtctctacatgtcctggtttct

SEQ ID NO: 62881 - DNA, 35 bp, Artificial Sequence
  Synthetic oligonucleotide
acatacgcaccaacccgggctctccactcgtgtgt

SEQ ID NO: 62882 - DNA, 36 bp, Artificial Sequence
  Synthetic oligonucleotide
tcccccactgcccgtgtttcttgtcaatgacgtaaa

SEQ ID NO: 62883 - DNA, 35 bp, Artificial Sequence
  Synthetic oligonucleotide
gattaccgccaaccggatttaccaactgttgacaa

SEQ ID NO: 62884 - DNA, 35 bp, Artificial Sequence
  Synthetic oligonucleotide
gtgcaccctgcccgtgcttggatactctctgccaa

SEQ ID NO: 62885 - DNA, 36 bp, Artificial Sequence
  Synthetic oligonucleotide
gcaacacactggaactattttgacccgtactgctaa

SEQ ID NO: 62886 - DNA, 35 bp, Artificial Sequence
  Synthetic oligonucleotide
gtactcctgcccataccagctgcgcgtatagcaca

SEQ ID NO: 62887 - DNA, 36 bp, Artificial Sequence
  Synthetic oligonucleotide
tgcgtcgccctgagctgcttgattcattattgtaca

SEQ ID NO: 62888 - DNA, 36 bp, Artificial Sequence
  Synthetic oligonucleotide
attcccacgtacgtgatacccatgtgagttcttcca

SEQ ID NO: 62889 - DNA, 36 bp, Artificial Sequence
  Synthetic oligonucleotide
ttcctgcccagagcatctatccttaatgccatatca

SEQ ID NO: 62890 - DNA, 37 bp, Artificial Sequence
  Synthetic oligonucleotide
gaaccatcaacggttaagtgtattagggcatgtaaga

SEQ ID NO: 62891 - DNA, 36 bp, Artificial Sequence
  Synthetic oligonucleotide
ttgatgggggggggcattgtgatttgcggcaccaga

SEQ ID NO: 62892 - DNA, 37 bp, Artificial Sequence
  Synthetic oligonucleotide
gaaacgaatgggtggaggtgtactcgggataggcaga

SEQ ID NO: 62893 - DNA, 37 bp, Artificial Sequence
  Synthetic oligonucleotide
gagggtggtggaggattatgggaagtggtttgcgaga

SEQ ID NO: 62894 - DNA, 37 bp, Artificial Sequence
  Synthetic oligonucleotide
gggggacgggacgagaagcggattgacagttgtgaga

SEQ ID NO: 62895 - DNA, 36 bp, Artificial Sequence
  Synthetic oligonucleotide
gttgaggggaacggaaggtggtagtagaaattgaga

SEQ ID NO: 62896 - DNA, 37 bp, Artificial Sequence
  Synthetic oligonucleotide
aggaatcctccaccgcccctgctctgccgcccgtaga

SEQ ID NO: 62897 - DNA, 37 bp, Artificial Sequence
  Synthetic oligonucleotide
ccagataccgccagtaccacctcattcaagccgccga

SEQ ID NO: 62898 - DNA, 36 bp, Artificial Sequence
  Synthetic oligonucleotide
agtcagtcagctcccttgcctgccatcacctgccga

SEQ ID NO: 62899 - DNA, 37 bp, Artificial Sequence
  Synthetic oligonucleotide
tgactacacacatcatccgtcccgcccgggcatccga

SEQ ID NO: 62900 - DNA, 36 bp, Artificial Sequence
  Synthetic oligonucleotide
gcctgacctactcatcggtacttggagacctggcga

SEQ ID NO: 62901 - DNA, 37 bp, Artificial Sequence
  Synthetic oligonucleotide
gttccctcattggtatgacgatttctctcgtcctcga

SEQ ID NO: 62902 - DNA, 37 bp, Artificial Sequence
  Synthetic oligonucleotide
tactacttcctgcccggtgcgtgggttccacgctcga

SEQ ID NO: 62903 - DNA, 37 bp, Artificial Sequence
  Synthetic oligonucleotide
gaccctagctgcgccggcttaacccctgccttctcga

SEQ ID NO: 62904 - DNA, 37 bp, Artificial Sequence
  Synthetic oligonucleotide
gagtgaagagagggttcctgaagagagagggagtcga

SEQ ID NO: 62905 - DNA, 35 bp, Artificial Sequence
  Synthetic oligonucleotide
ttactggcaagcaagcacgtaggcgggagggagga

SEQ ID NO: 62906 - DNA, 37 bp, Artificial Sequence
  Synthetic oligonucleotide
atacacaaccgctgatcacagaatcctctccaacgga

SEQ ID NO: 62907 - DNA, 37 bp, Artificial Sequence
  Synthetic oligonucleotide
agtgaacctagcctaaagggagttgggggaaggggga

SEQ ID NO: 62908 - DNA, 37 bp, Artificial Sequence
  Synthetic oligonucleotide
atgacaccagggcaacactcccacaggcataggggga

SEQ ID NO: 62909 - DNA, 37 bp, Artificial Sequence
  Synthetic oligonucleotide
gaagggacgaaggggtgctaaagctaagcatttggga

SEQ ID NO: 62910 - DNA, 37 bp, Artificial Sequence
  Synthetic oligonucleotide
gagacgaagacacgtatggggaacagacggtggatga

SEQ ID NO: 62911 - DNA, 38 bp, Artificial Sequence
  Synthetic oligonucleotide
accactcacttctatgacaactcccgctcactcgctga

SEQ ID NO: 62912 - DNA, 38 bp, Artificial Sequence
  Synthetic oligonucleotide
gaaggtgagtaggggggaaaatctaggtaagtcagtga

SEQ ID NO: 62913 - DNA, 38 bp, Artificial Sequence
  Synthetic oligonucleotide
gattggcacgctcctcctgtttcgtcctcacttcgtga

SEQ ID NO: 62914 - DNA, 38 bp, Artificial Sequence
  Synthetic oligonucleotide
tgcacatgactcagctttcccctcgcaacaccgggtga

SEQ ID NO: 62915 - DNA, 38 bp, Artificial Sequence
  Synthetic oligonucleotide
gccgagtccggtgatagggaataccgggttgggggtga

SEQ ID NO: 62916 - DNA, 38 bp, Artificial Sequence
  Synthetic oligonucleotide
tccgtggaagagtgaggatggaagccaatgggtggtga

SEQ ID NO: 62917 - DNA, 37 bp, Artificial Sequence
  Synthetic oligonucleotide
gacgaccactccatcatctgcggtcatagtaatgtga

SEQ ID NO: 62918 - DNA, 37 bp, Artificial Sequence
  Synthetic oligonucleotide
accacgctttcttcgtgttagcctccttcctcattga

SEQ ID NO: 62919 - DNA, 38 bp, Artificial Sequence
  Synthetic oligonucleotide
atcatcctgggggtatgtggggcagggaacgggattga

SEQ ID NO: 62920 - DNA, 37 bp, Artificial Sequence
  Synthetic oligonucleotide
tccgaaggtggggggcaaatataaaggcaagggttga

SEQ ID NO: 62921 - DNA, 38 bp, Artificial Sequence
  Synthetic oligonucleotide
tgcgcgggcccaacgcgcgctctgtcaaaactttttga

SEQ ID NO: 62922 - DNA, 36 bp, Artificial Sequence
  Synthetic oligonucleotide
gtgcatactatcctatccggtgacccgactgctata

SEQ ID NO: 62923 - DNA, 36 bp, Artificial Sequence
  Synthetic oligonucleotide
gcccgcacgtcatccacacgccaccgcgttatgcta

SEQ ID NO: 62924 - DNA, 36 bp, Artificial Sequence
  Synthetic oligonucleotide
aagtgctgcctccaagtacagtaagtgtgcgaggta

SEQ ID NO: 62925 - DNA, 35 bp, Artificial Sequence
  Synthetic oligonucleotide
gtgactcgacgctttcatctgccctagtaatctta

SEQ ID NO: 62926 - DNA, 36 bp, Artificial Sequence
  Synthetic oligonucleotide
gatgcaatgagatggatggggatggcgaaggagtta

SEQ ID NO: 62927 - DNA, 35 bp, Artificial Sequence
  Synthetic oligonucleotide
gacctatcgggcagtattttgtcttctcctcgaac

SEQ ID NO: 62928 - DNA, 36 bp, Artificial Sequence
  Synthetic oligonucleotide
tcaaatgcgcaacgcgtcacacttcttccctttcac

SEQ ID NO: 62929 - DNA, 35 bp, Artificial Sequence
  Synthetic oligonucleotide
agtccataccacatctgtacgctgagcggaccgac

SEQ ID NO: 62930 - DNA, 35 bp, Artificial Sequence
  Synthetic oligonucleotide
tgttcggccgatcctgtttctttcgcccacgtgac

SEQ ID NO: 62931 - DNA, 35 bp, Artificial Sequence
  Synthetic oligonucleotide
atgacactccagacgtcagtagtacacttttcgcc

SEQ ID NO: 62932 - DNA, 35 bp, Artificial Sequence
  Synthetic oligonucleotide
tgatgaatacacacacagtcgccactccatcggcc

SEQ ID NO: 62933 - DNA, 35 bp, Artificial Sequence
  Synthetic oligonucleotide
gctcggtgccccattgtatctactctcgggtggcc

SEQ ID NO: 62934 - DNA, 35 bp, Artificial Sequence
  Synthetic oligonucleotide
gttgctaattccctggcactgttttcgatcattcc

SEQ ID NO: 62935 - DNA, 35 bp, Artificial Sequence
  Synthetic oligonucleotide
tcacgccgcattcatgctgtccgctatccacttcc

SEQ ID NO: 62936 - DNA, 35 bp, Artificial Sequence
  Synthetic oligonucleotide
tagacaggctctacacttcttcgtacctaccaggc

SEQ ID NO: 62937 - DNA, 35 bp, Artificial Sequence
  Synthetic oligonucleotide
tggatgacgccccccctccgctacattagacgggc

SEQ ID NO: 62938 - DNA, 35 bp, Artificial Sequence
  Synthetic oligonucleotide
gatatggcgcactgactctctacccaatacgcatc

SEQ ID NO: 62939 - DNA, 35 bp, Artificial Sequence
  Synthetic oligonucleotide
gtccctcgttcttcaccgtgatgcacgtgcctctc

SEQ ID NO: 62940 - DNA, 35 bp, Artificial Sequence
  Synthetic oligonucleotide
tagtacctctccgtattgctagaatatcacctgcg

SEQ ID NO: 62941 - DNA, 35 bp, Artificial Sequence
  Synthetic oligonucleotide
acctgttcgtgacgttccccacccgaccccacctg

SEQ ID NO: 62942 - DNA, 35 bp, Artificial Sequence
  Synthetic oligonucleotide
cccctgttccatttcgtctcgcataagacgatctg

SEQ ID NO: 62943 - DNA, 35 bp, Artificial Sequence
  Synthetic oligonucleotide
acggggtcacgcgcacctctgtttcccgtcctttg

SEQ ID NO: 62944 - DNA, 35 bp, Artificial Sequence
  Synthetic oligonucleotide
gtcgcctctccgaagcatagcagacttgccaccat

SEQ ID NO: 62945 - DNA, 35 bp, Artificial Sequence
  Synthetic oligonucleotide
tagactccaagcatgggcattacctggaaaccgat

SEQ ID NO: 62946 - DNA, 36 bp, Artificial Sequence
  Synthetic oligonucleotide
tccgcctagggcgtggtcgctacactctgctactat

SEQ ID NO: 62947 - DNA, 35 bp, Artificial Sequence
  Synthetic oligonucleotide
tactgcctcgggggcgctgcattctaacctaaact

SEQ ID NO: 62948 - DNA, 35 bp, Artificial Sequence
  Synthetic oligonucleotide
acgttagcctctccttccgcgccctgccatgatct

SEQ ID NO: 62949 - DNA, 35 bp, Artificial Sequence
  Synthetic oligonucleotide
acccagacctcttgccgttggataaacacttatct

SEQ ID NO: 62950 - DNA, 35 bp, Artificial Sequence
  Synthetic oligonucleotide
gtgtggtgaggggggcgacgaacatagaggccggt

SEQ ID NO: 62951 - DNA, 35 bp, Artificial Sequence
  Synthetic oligonucleotide
tgttagaagccgcttattctacactgtccccatgt

SEQ ID NO: 62952 - DNA, 35 bp, Artificial Sequence
  Synthetic oligonucleotide
atcgcccgcctaggctgcactcatagctgctcatt

SEQ ID NO: 62953 - DNA, 35 bp, Artificial Sequence
  Synthetic oligonucleotide
agtctcgacgcacatactttgcatattcccacctt

SEQ ID NO: 62954 - DNA, 35 bp, Artificial Sequence
  Synthetic oligonucleotide
ccacaccgccgtcacactcggacatccgctgcctt

SEQ ID NO: 62955 - DNA, 36 bp, Artificial Sequence
  Synthetic oligonucleotide
tacgaaccagctctaacgatgcctttactgtggctt

SEQ ID NO: 62956 - DNA, 36 bp, Artificial Sequence
  Synthetic oligonucleotide
tttgaccctcttatctgtactacttcacggtgaaaa

SEQ ID NO: 62957 - DNA, 35 bp, Artificial Sequence
  Synthetic oligonucleotide
ttgcccacgctgccgacgcgccccgataactgcaa

SEQ ID NO: 62958 - DNA, 36 bp, Artificial Sequence
  Synthetic oligonucleotide
acagattcgacgcctcctatgtccctgtttttgcaa

SEQ ID NO: 62959 - DNA, 35 bp, Artificial Sequence
  Synthetic oligonucleotide
acgaagcaaaagccggaagataaaacggggaagaa

SEQ ID NO: 62960 - DNA, 36 bp, Artificial Sequence
  Synthetic oligonucleotide
aaaaagaggggaaggaggttcaaggcacttggggaa

SEQ ID NO: 62961 - DNA, 35 bp, Artificial Sequence
  Synthetic oligonucleotide
gacacgcgaatcggcttaaattggccggcgaaaca

SEQ ID NO: 62962 - DNA, 36 bp, Artificial Sequence
  Synthetic oligonucleotide
tgcgagtaagccaagaacgagagaagacgggggaca

SEQ ID NO: 62963 - DNA, 36 bp, Artificial Sequence
  Synthetic oligonucleotide
actgagtgcggtctctttctccgccatttgattaca

SEQ ID NO: 62964 - DNA, 36 bp, Artificial Sequence
  Synthetic oligonucleotide
ggtggttccggcttagacctgccattcgttacacca

SEQ ID NO: 62965 - DNA, 35 bp, Artificial Sequence
  Synthetic oligonucleotide
agccccttgcatgaaatcgagtctatctgccacca

SEQ ID NO: 62966 - DNA, 35 bp, Artificial Sequence
  Synthetic oligonucleotide
gttgcaattgctttgctgagtttgtccatttgcca

SEQ ID NO: 62967 - DNA, 36 bp, Artificial Sequence
  Synthetic oligonucleotide
gtccgcctgtgccaacggcgcttttaccctgatcca

SEQ ID NO: 62968 - DNA, 35 bp, Artificial Sequence
  Synthetic oligonucleotide
tgggccgtcacttcgcgatcgactggcatccctca

SEQ ID NO: 62969 - DNA, 32 bp, Artificial Sequence
  Synthetic oligonucleotide
tgtgtccccgcccacccgagttccatgcctca

SEQ ID NO: 62970 - DNA, 37 bp, Artificial Sequence
  Synthetic oligonucleotide
tatgccccacgcctgtgtcgctctcccaacagacaga

SEQ ID NO: 62971 - DNA, 37 bp, Artificial Sequence
  Synthetic oligonucleotide
acaccaggcgagtaggaggggcgacccgggagtgaga

SEQ ID NO: 62972 - DNA, 36 bp, Artificial Sequence
  Synthetic oligonucleotide
attagaggtgcgaaaggtgcggtggtgggagtgaga

SEQ ID NO: 62973 - DNA, 37 bp, Artificial Sequence
  Synthetic oligonucleotide
gttgagcagaaggttggatgagcacaggggggtgaga

SEQ ID NO: 62974 - DNA, 37 bp, Artificial Sequence
  Synthetic oligonucleotide
gagtacgtcctcccggcaacctagtccgacccaacga

SEQ ID NO: 62975 - DNA, 37 bp, Artificial Sequence
  Synthetic oligonucleotide
actcaccacgctgaaacccgatgcccacatctaacga

SEQ ID NO: 62976 - DNA, 36 bp, Artificial Sequence
  Synthetic oligonucleotide
gcgaagcaacgttgtagggcttcgctttttccacga

SEQ ID NO: 62977 - DNA, 37 bp, Artificial Sequence
  Synthetic oligonucleotide
gatcaggcccatttgcaagaataacttgtcactccga

SEQ ID NO: 62978 - DNA, 37 bp, Artificial Sequence
  Synthetic oligonucleotide
tcgaacgcagatggacaagccattgcgtacctatcga

SEQ ID NO: 62979 - DNA, 36 bp, Artificial Sequence
  Synthetic oligonucleotide
accgatccgcttattcccttatcgctccgtattcga

SEQ ID NO: 62980 - DNA, 37 bp, Artificial Sequence
  Synthetic oligonucleotide
aacgcgcaaggacgggtcgtaagttaagggtgaggga

SEQ ID NO: 62981 - DNA, 37 bp, Artificial Sequence
  Synthetic oligonucleotide
gacaacgtgctgcacgtaaacggagatatggtcggga

SEQ ID NO: 62982 - DNA, 37 bp, Artificial Sequence
  Synthetic oligonucleotide
gaaccaggcaacggataatgggggcatcaaggtggga

SEQ ID NO: 62983 - DNA, 35 bp, Artificial Sequence
  Synthetic oligonucleotide
gctgtccacggggacgcaatgaaaagaagggtgga

SEQ ID NO: 62984 - DNA, 38 bp, Artificial Sequence
  Synthetic oligonucleotide
tcgggtgggggggcctgggtgaacgcactgaacaatga

SEQ ID NO: 62985 - DNA, 38 bp, Artificial Sequence
  Synthetic oligonucleotide
gggggtggggaggaagggcggtaaaacagactggatga

SEQ ID NO: 62986 - DNA, 38 bp, Artificial Sequence
  Synthetic oligonucleotide
ttagaggggtggtacatgggcagagggcgcagtgatga

SEQ ID NO: 62987 - DNA, 37 bp, Artificial Sequence
  Synthetic oligonucleotide
atgacacccgcgcaaactccgttccactttcgtatga

SEQ ID NO: 62988 - DNA, 37 bp, Artificial Sequence
  Synthetic oligonucleotide
tccatccctgtccaatctagactctgtccatttatga

SEQ ID NO: 62989 - DNA, 36 bp, Artificial Sequence
  Synthetic oligonucleotide
tacgcgtaccaatcggcttatttgcgaccccactga

SEQ ID NO: 62990 - DNA, 38 bp, Artificial Sequence
  Synthetic oligonucleotide
gcccgccgctgggcgatctacgttcattccccctctga

SEQ ID NO: 62991 - DNA, 38 bp, Artificial Sequence
  Synthetic oligonucleotide
ttctgggacagaagattaggggcggggaactggggtga

SEQ ID NO: 62992 - DNA, 37 bp, Artificial Sequence
  Synthetic oligonucleotide
tgttcacgcgcgatactctgtcgcaccactttattga

SEQ ID NO: 62993 - DNA, 38 bp, Artificial Sequence
  Synthetic oligonucleotide
gaacgcatcaggttgacacccgccaccactatacttga

SEQ ID NO: 62994 - DNA, 37 bp, Artificial Sequence
  Synthetic oligonucleotide
gacgagggctagggggggtaatggagggttgtgttga

SEQ ID NO: 62995 - DNA, 38 bp, Artificial Sequence
  Synthetic oligonucleotide
atcccaagcggtacgcgagtgtcatgccacacctttga

SEQ ID NO: 62996 - DNA, 37 bp, Artificial Sequence
  Synthetic oligonucleotide
atacggacgctggtcactcccccccccacccttttga

SEQ ID NO: 62997 - DNA, 36 bp, Artificial Sequence
  Synthetic oligonucleotide
gacgcattcggtaatcttgcctagacctcagccata

SEQ ID NO: 62998 - DNA, 36 bp, Artificial Sequence
  Synthetic oligonucleotide
tcccacccacatgtccttcatacctgactttctgta

SEQ ID NO: 62999 - DNA, 35 bp, Artificial Sequence
  Synthetic oligonucleotide
tccagcattcgccgattgatgccgccactctctta

SEQ ID NO: 63000 - DNA, 35 bp, Artificial Sequence
  Synthetic oligonucleotide
gttaacctccaggacgggtttttttgacgtttgcc

SEQ ID NO: 63001 - DNA, 35 bp, Artificial Sequence
  Synthetic oligonucleotide
aacaactacactctgggatgcggttctgccattcc

SEQ ID NO: 63002 - DNA, 35 bp, Artificial Sequence
  Synthetic oligonucleotide
aacccatcgattgacttattgcccgcattcattcc

SEQ ID NO: 63003 - DNA, 35 bp, Artificial Sequence
  Synthetic oligonucleotide
tctcactccgcaatgcatttatcaaccttcaacgc

SEQ ID NO: 63004 - DNA, 35 bp, Artificial Sequence
  Synthetic oligonucleotide
agtatccccttgcacagtggaattcctgcaacatc

SEQ ID NO: 63005 - DNA, 35 bp, Artificial Sequence
  Synthetic oligonucleotide
tcccatgacagtatcactagcgctcttactacatc

SEQ ID NO: 63006 - DNA, 35 bp, Artificial Sequence
  Synthetic oligonucleotide
gcacacgtccgtgaaaggcaatcgcaacggccatc

SEQ ID NO: 63007 - DNA, 35 bp, Artificial Sequence
  Synthetic oligonucleotide
gtgtgctggcttacggggctttaagcacccccctc

SEQ ID NO: 63008 - DNA, 35 bp, Artificial Sequence
  Synthetic oligonucleotide
aacccccacgtaatgctgataggctctctcatgtc

SEQ ID NO: 63009 - DNA, 35 bp, Artificial Sequence
  Synthetic oligonucleotide
ttgaacctccacctgttctgaaaggaactgctttc

SEQ ID NO: 63010 - DNA, 35 bp, Artificial Sequence
  Synthetic oligonucleotide
ttacatgcaacccccgccgtctaggtcctattttc

SEQ ID NO: 63011 - DNA, 35 bp, Artificial Sequence
  Synthetic oligonucleotide
actacccactcgatgcattaggtgaaacctttacg

SEQ ID NO: 63012 - DNA, 35 bp, Artificial Sequence
  Synthetic oligonucleotide
gactgccaaagccgcctcttcaccagttttaagcg

SEQ ID NO: 63013 - DNA, 35 bp, Artificial Sequence
  Synthetic oligonucleotide
tcaagtccggaggtgtttggtagtatgacttgagg

SEQ ID NO: 63014 - DNA, 35 bp, Artificial Sequence
  Synthetic oligonucleotide
tcccttctgcaaccaatatctttccgtgtatcttg

SEQ ID NO: 63015 - DNA, 35 bp, Artificial Sequence
  Synthetic oligonucleotide
tacacccccctcgtgacagcccccgacttgaccat

SEQ ID NO: 63016 - DNA, 35 bp, Artificial Sequence
  Synthetic oligonucleotide
gctgccacaacacctatatccaaccccagagcgat

SEQ ID NO: 63017 - DNA, 35 bp, Artificial Sequence
  Synthetic oligonucleotide
atgcatcgatcatcgcacgccgtcatctcccccct

SEQ ID NO: 63018 - DNA, 35 bp, Artificial Sequence
  Synthetic oligonucleotide
ggggaacgcgaccgtcgaggccacactgctcccct

SEQ ID NO: 63019 - DNA, 35 bp, Artificial Sequence
  Synthetic oligonucleotide
ttgcactcatggagtcttgtcatatcccgtttcct

SEQ ID NO: 63020 - DNA, 35 bp, Artificial Sequence
  Synthetic oligonucleotide
agcgacatcttacccgatttcgtcactgcttatct

SEQ ID NO: 63021 - DNA, 35 bp, Artificial Sequence
  Synthetic oligonucleotide
gccgtggtccccgcgtgcctgctcttttcgtccgt

SEQ ID NO: 63022 - DNA, 35 bp, Artificial Sequence
  Synthetic oligonucleotide
ggcgtgatcctgctcgtgttcgttccatcccctgt

SEQ ID NO: 63023 - DNA, 35 bp, Artificial Sequence
  Synthetic oligonucleotide
ttcctcaacgctttccgaccgggttgcacttttgt

SEQ ID NO: 63024 - DNA, 35 bp, Artificial Sequence
  Synthetic oligonucleotide
gaccctatcctgagtgcgcagtcacttgcgcgaaa

SEQ ID NO: 63025 - DNA, 36 bp, Artificial Sequence
  Synthetic oligonucleotide
aacgggcgggaagttgggggagtagtaggcgcaaca

SEQ ID NO: 63026 - DNA, 36 bp, Artificial Sequence
  Synthetic oligonucleotide
gattgcgtccagacaccctgctgcctgttctccaca

SEQ ID NO: 63027 - DNA, 35 bp, Artificial Sequence
  Synthetic oligonucleotide
tcccgtgaatcgggccaaaccctctccaccgcaca

SEQ ID NO: 63028 - DNA, 36 bp, Artificial Sequence
  Synthetic oligonucleotide
gccccttgacgagtcgttaccgcgtgtcaccgcaca

SEQ ID NO: 63029 - DNA, 36 bp, Artificial Sequence
  Synthetic oligonucleotide
accgcataccctcgctttcaatggcgacgttcccca

SEQ ID NO: 63030 - DNA, 35 bp, Artificial Sequence
  Synthetic oligonucleotide
gaagcgaccaagtagtacctcatgcctagctccca

SEQ ID NO: 63031 - DNA, 36 bp, Artificial Sequence
  Synthetic oligonucleotide
atgccacacccacccggcggcgatacctccatctca

SEQ ID NO: 63032 - DNA, 36 bp, Artificial Sequence
  Synthetic oligonucleotide
tccgcacgagcgcctaattcgctacaacacttgtca

SEQ ID NO: 63033 - DNA, 37 bp, Artificial Sequence
  Synthetic oligonucleotide
acctggcgggggaggggcatggtggtccaggataaga

SEQ ID NO: 63034 - DNA, 37 bp, Artificial Sequence
  Synthetic oligonucleotide
gacgatcaatactgctctgccacccaggctaccgaga

SEQ ID NO: 63035 - DNA, 37 bp, Artificial Sequence
  Synthetic oligonucleotide
tcgaacttcatccgcctggcccatccgccacattaga

SEQ ID NO: 63036 - DNA, 37 bp, Artificial Sequence
  Synthetic oligonucleotide
acttgccagagcagacgtctattttctttgtccacga

SEQ ID NO: 63037 - DNA, 36 bp, Artificial Sequence
  Synthetic oligonucleotide
tcatctcctgtgattagccctgtccattggccccga

SEQ ID NO: 63038 - DNA, 37 bp, Artificial Sequence
  Synthetic oligonucleotide
ccccacccatcgccccgtagaggaaactcatcatcga

SEQ ID NO: 63039 - DNA, 37 bp, Artificial Sequence
  Synthetic oligonucleotide
tcataccttggcctccatgaacacagtcaaccctcga

SEQ ID NO: 63040 - DNA, 36 bp, Artificial Sequence
  Synthetic oligonucleotide
ggtcacgtactacctgttatcaattctcgctgtcga

SEQ ID NO: 63041 - DNA, 36 bp, Artificial Sequence
  Synthetic oligonucleotide
atcgatgctccactctgagtttattctatctgtcga

SEQ ID NO: 63042 - DNA, 36 bp, Artificial Sequence
  Synthetic oligonucleotide
tcgaggggggaggtatgggcgctgtcggacaacgga

SEQ ID NO: 63043 - DNA, 37 bp, Artificial Sequence
  Synthetic oligonucleotide
gggaggtaacacgaggcgggaagtgcggtgtgaggga

SEQ ID NO: 63044 - DNA, 37 bp, Artificial Sequence
  Synthetic oligonucleotide
tgtaggagatcgacggggctagagcgggagggcggga

SEQ ID NO: 63045 - DNA, 37 bp, Artificial Sequence
  Synthetic oligonucleotide
acgaggaagggggatgaaggtcttgggagcccttgga

SEQ ID NO: 63046 - DNA, 37 bp, Artificial Sequence
  Synthetic oligonucleotide
gcactcccgccccctgcgcttagtcctagtgcaatga

SEQ ID NO: 63047 - DNA, 38 bp, Artificial Sequence
  Synthetic oligonucleotide
gccaccgcctcagtaacctgccaagggccgccctatga

SEQ ID NO: 63048 - DNA, 38 bp, Artificial Sequence
  Synthetic oligonucleotide
acacccccctggcatgagagcaattacgaccgcactga

SEQ ID NO: 63049 - DNA, 38 bp, Artificial Sequence
  Synthetic oligonucleotide
gttaaccaaatatcctaaacggtctgtcgtggcactga

SEQ ID NO: 63050 - DNA, 38 bp, Artificial Sequence
  Synthetic oligonucleotide
gatcaacaaccgcggggtgcaccatcattttcacctga

SEQ ID NO: 63051 - DNA, 36 bp, Artificial Sequence
  Synthetic oligonucleotide
acatgcatggcccccccggacacgtgaatatcctga

SEQ ID NO: 63052 - DNA, 38 bp, Artificial Sequence
  Synthetic oligonucleotide
accagagtggttcccttatgctccagctacatagctga

SEQ ID NO: 63053 - DNA, 37 bp, Artificial Sequence
  Synthetic oligonucleotide
tgtacttgccggcccatttgctttaacaaccctctga

SEQ ID NO: 63054 - DNA, 37 bp, Artificial Sequence
  Synthetic oligonucleotide
gccccgcggcattggtccccatcactcccagctctga

SEQ ID NO: 63055 - DNA, 38 bp, Artificial Sequence
  Synthetic oligonucleotide
gacatgcgcacccaggtcgccaaacaatcttattctga

SEQ ID NO: 63056 - DNA, 38 bp, Artificial Sequence
  Synthetic oligonucleotide
atttggcaagccactcctccaccctcagtgtcccgtga

SEQ ID NO: 63057 - DNA, 38 bp, Artificial Sequence
  Synthetic oligonucleotide
tccggagggggcaggaatgggtcgtgggattaaggtga

SEQ ID NO: 63058 - DNA, 38 bp, Artificial Sequence
  Synthetic oligonucleotide
taacgtggtgagggaagaggagggggaggtttttgtga

SEQ ID NO: 63059 - DNA, 37 bp, Artificial Sequence
  Synthetic oligonucleotide
gaccaggtagttattcaacgtttacccatttcattga

SEQ ID NO: 63060 - DNA, 38 bp, Artificial Sequence
  Synthetic oligonucleotide
gccgttccacgacttgtaaccctccactctctgattga

SEQ ID NO: 63061 - DNA, 36 bp, Artificial Sequence
  Synthetic oligonucleotide
gtgggtgcccgatgtggggtacgcgggcgggcttga

SEQ ID NO: 63062 - DNA, 38 bp, Artificial Sequence
  Synthetic oligonucleotide
ataagccaactgcacctgtcctctcctgtcaacgttga

SEQ ID NO: 63063 - DNA, 35 bp, Artificial Sequence
  Synthetic oligonucleotide
ataccgcctattacccctgctgtgttccttgttga

SEQ ID NO: 63064 - DNA, 38 bp, Artificial Sequence
  Synthetic oligonucleotide
gggaacacccaccgatttttacgactcatcctctttga

SEQ ID NO: 63065 - DNA, 36 bp, Artificial Sequence
  Synthetic oligonucleotide
gggacacccttggctcacttactcgccttttcacta

SEQ ID NO: 63066 - DNA, 36 bp, Artificial Sequence
  Synthetic oligonucleotide
gtgatctaacacccgcaccttcacaacatcatacta

SEQ ID NO: 63067 - DNA, 35 bp, Artificial Sequence
  Synthetic oligonucleotide
tttgcaccatccgcacctctacctaagttcagcta

SEQ ID NO: 63068 - DNA, 35 bp, Artificial Sequence
  Synthetic oligonucleotide
agtgttgtgggagggaacaagatgaatggggagta

SEQ ID NO: 63069 - DNA, 36 bp, Artificial Sequence
  Synthetic oligonucleotide
ttagtcgaggcgggagcatgtgggcggtgggtagta

SEQ ID NO: 63070 - DNA, 36 bp, Artificial Sequence
  Synthetic oligonucleotide
ttgaccatgctggacccgccactgtgctacgtatta

SEQ ID NO: 63071 - DNA, 36 bp, Artificial Sequence
  Synthetic oligonucleotide
tcgcgtagggcaaaaaattaaatgggatgacactta

SEQ ID NO: 63072 - DNA, 35 bp, Artificial Sequence
  Synthetic oligonucleotide
attgccctatcgctagctaccatggtccatcctta

SEQ ID NO: 63073 - DNA, 35 bp, Artificial Sequence
  Synthetic oligonucleotide
acccaacacgtgcgaatatcgaccccccccgctta

SEQ ID NO: 63074 - DNA, 35 bp, Artificial Sequence
  Synthetic oligonucleotide
actcgtgctgatgctaaatcgcgtcacctgaccac

SEQ ID NO: 63075 - DNA, 35 bp, Artificial Sequence
  Synthetic oligonucleotide
agtctacactgcccttttgcactgtcaggcttgac

SEQ ID NO: 63076 - DNA, 35 bp, Artificial Sequence
  Synthetic oligonucleotide
atcgcgaagcgtcaacttgacttccccattgctac

SEQ ID NO: 63077 - DNA, 35 bp, Artificial Sequence
  Synthetic oligonucleotide
ttcgcactcaatcgccgtccccgcccgaaaccacc

SEQ ID NO: 63078 - DNA, 35 bp, Artificial Sequence
  Synthetic oligonucleotide
gtcgtcgcgacgttctaacgcgttccctttcaccc

SEQ ID NO: 63079 - DNA, 35 bp, Artificial Sequence
  Synthetic oligonucleotide
ttggagtgactctccatcgtacattaccgtacccc

SEQ ID NO: 63080 - DNA, 35 bp, Artificial Sequence
  Synthetic oligonucleotide
tgcaaaccctgctccacacgcccataacttacgcc

SEQ ID NO: 63081 - DNA, 35 bp, Artificial Sequence
  Synthetic oligonucleotide
gacgcactgtgaggattttgggccattccgactcc

SEQ ID NO: 63082 - DNA, 35 bp, Artificial Sequence
  Synthetic oligonucleotide
atcgcttcggagtcgcagccacatctatctagtcc

SEQ ID NO: 63083 - DNA, 35 bp, Artificial Sequence
  Synthetic oligonucleotide
tctccaccctccagtttgttctactgtgcgccctc

SEQ ID NO: 63084 - DNA, 35 bp, Artificial Sequence
  Synthetic oligonucleotide
gtgcttacaactatgcgcaaacgcttccatgcctc

SEQ ID NO: 63085 - DNA, 35 bp, Artificial Sequence
  Synthetic oligonucleotide
gccgcctgttactatgctacctctgtgcccgggtc

SEQ ID NO: 63086 - DNA, 35 bp, Artificial Sequence
  Synthetic oligonucleotide
gcaaggggggtaggaagggaggttaccaaggggtc

SEQ ID NO: 63087 - DNA, 35 bp, Artificial Sequence
  Synthetic oligonucleotide
gcacggagggccccacccatagaccccggtctgtc

SEQ ID NO: 63088 - DNA, 35 bp, Artificial Sequence
  Synthetic oligonucleotide
gaaccctgcagaacaattccgtagcttgatccttc

SEQ ID NO: 63089 - DNA, 35 bp, Artificial Sequence
  Synthetic oligonucleotide
gatgagacgacgcacatccccacccaaccgactag

SEQ ID NO: 63090 - DNA, 35 bp, Artificial Sequence
  Synthetic oligonucleotide
gcctcgagccgactaattacgtcgctacattttag

SEQ ID NO: 63091 - DNA, 35 bp, Artificial Sequence
  Synthetic oligonucleotide
attgtcccgctgtgccttcatccttagacaagacg

SEQ ID NO: 63092 - DNA, 35 bp, Artificial Sequence
  Synthetic oligonucleotide
tattgataccctgctcctgtctgtccgctatagcg

SEQ ID NO: 63093 - DNA, 35 bp, Artificial Sequence
  Synthetic oligonucleotide
tccatggaggaggaaagtaatgtctgtgaagggcg

SEQ ID NO: 63094 - DNA, 35 bp, Artificial Sequence
  Synthetic oligonucleotide
gtggggggggtgagcgcgtggtcgatagcagaatg

SEQ ID NO: 63095 - DNA, 35 bp, Artificial Sequence
  Synthetic oligonucleotide
gacgacatgtcgtcgcgggtacctgaattatcatg

SEQ ID NO: 63096 - DNA, 35 bp, Artificial Sequence
  Synthetic oligonucleotide
ggtgggccgggagttgcgggtaaaaaatgggactg

SEQ ID NO: 63097 - DNA, 35 bp, Artificial Sequence
  Synthetic oligonucleotide
atccgcactcggcgacacattatagtacacccctg

SEQ ID NO: 63098 - DNA, 35 bp, Artificial Sequence
  Synthetic oligonucleotide
atctgctcgttggccacctctctctatttatcctg

SEQ ID NO: 63099 - DNA, 35 bp, Artificial Sequence
  Synthetic oligonucleotide
tgtttcctcccgccactcaacatcgtttcccggtg

SEQ ID NO: 63100 - DNA, 35 bp, Artificial Sequence
  Synthetic oligonucleotide
tcgtgtcaatatatggggttcatggggggtgggat

SEQ ID NO: 63101 - DNA, 35 bp, Artificial Sequence
  Synthetic oligonucleotide
gacaccgtggccattcctggtgaatgattctctat

SEQ ID NO: 63102 - DNA, 35 bp, Artificial Sequence
  Synthetic oligonucleotide
tacgacacccccccttcgccaatacacatagctct

SEQ ID NO: 63103 - DNA, 35 bp, Artificial Sequence
  Synthetic oligonucleotide
agacagccacctgtgggccaccccttgcatcttct

SEQ ID NO: 63104 - DNA, 35 bp, Artificial Sequence
  Synthetic oligonucleotide
gtgggagggcggttaaaagtgtaggtccagggagt

SEQ ID NO: 63105 - DNA, 35 bp, Artificial Sequence
  Synthetic oligonucleotide
gcacaccgtcctgcctagtgacttgtagattatgt

SEQ ID NO: 63106 - DNA, 35 bp, Artificial Sequence
  Synthetic oligonucleotide
gagatagcagtgccccgcgttccaaggcccccgtt

SEQ ID NO: 63107 - DNA, 35 bp, Artificial Sequence
  Synthetic oligonucleotide
gaaccatcctgtgttactcagggtccctctaggtt

SEQ ID NO: 63108 - DNA, 35 bp, Artificial Sequence
  Synthetic oligonucleotide
atgggaccggtggtgctcgtttaggtgcgggggtt

SEQ ID NO: 63109 - DNA, 35 bp, Artificial Sequence
  Synthetic oligonucleotide
gctgtccgcacgcaacgtttacacctggtattgtt

SEQ ID NO: 63110 - DNA, 35 bp, Artificial Sequence
  Synthetic oligonucleotide
tcgccataccctcccgatgctttgtacgcgcattt

SEQ ID NO: 63111 - DNA, 36 bp, Artificial Sequence
  Synthetic oligonucleotide
aatgccaacgtgagaccatccgcagcctctcttcaa

SEQ ID NO: 63112 - DNA, 32 bp, Artificial Sequence
  Synthetic oligonucleotide
taccgccccgtttcaactcaagctacctcgaa

SEQ ID NO: 63113 - DNA, 36 bp, Artificial Sequence
  Synthetic oligonucleotide
gaccatccactcgacgttatagcccaatatctcgaa

SEQ ID NO: 63114 - DNA, 36 bp, Artificial Sequence
  Synthetic oligonucleotide
gctgtgacgaaggaaaaatgtaagggtggccagcca

SEQ ID NO: 63115 - DNA, 36 bp, Artificial Sequence
  Synthetic oligonucleotide
gaaaccgaattgctggtccacgccctacaagctcca

SEQ ID NO: 63116 - DNA, 36 bp, Artificial Sequence
  Synthetic oligonucleotide
tgcctaactgtttcgtacggaccttgcacttttcca

SEQ ID NO: 63117 - DNA, 36 bp, Artificial Sequence
  Synthetic oligonucleotide
gatcaggagtcgtgttagcgggaatttggggtggca

SEQ ID NO: 63118 - DNA, 36 bp, Artificial Sequence
  Synthetic oligonucleotide
gttcacttgcggacgccgtactacacctttcatgca

SEQ ID NO: 63119 - DNA, 35 bp, Artificial Sequence
  Synthetic oligonucleotide
gacgccctaggtaagtctgacggaaaccaactgca

SEQ ID NO: 63120 - DNA, 36 bp, Artificial Sequence
  Synthetic oligonucleotide
tggtacgtccgtctcccgatcaacccaagttctgca

SEQ ID NO: 63121 - DNA, 35 bp, Artificial Sequence
  Synthetic oligonucleotide
atagtggggccgtgatagtaggagggaatggtgca

SEQ ID NO: 63122 - DNA, 36 bp, Artificial Sequence
  Synthetic oligonucleotide
gactcgtatctgggcgtcccgaagcattccaactca

SEQ ID NO: 63123 - DNA, 36 bp, Artificial Sequence
  Synthetic oligonucleotide
tctgcgccctcactgaatgtgcggccattccactca

SEQ ID NO: 63124 - DNA, 35 bp, Artificial Sequence
  Synthetic oligonucleotide
tccggacggacaaatccgctaatcctgagcactca

SEQ ID NO: 63125 - DNA, 35 bp, Artificial Sequence
  Synthetic oligonucleotide
acagcgcaaacgctctaaaagaacccacctgctca

SEQ ID NO: 63126 - DNA, 36 bp, Artificial Sequence
  Synthetic oligonucleotide
gttcacacagttcattatcgccgacttgggaggtca

SEQ ID NO: 63127 - DNA, 36 bp, Artificial Sequence
  Synthetic oligonucleotide
aacaccgatggtttggttggggtcccttatcattca

SEQ ID NO: 63128 - DNA, 35 bp, Artificial Sequence
  Synthetic oligonucleotide
gcactctcgttcgatctaggatctggcgcctttca

SEQ ID NO: 63129 - DNA, 37 bp, Artificial Sequence
  Synthetic oligonucleotide
taccacgtgccaatgattcgggcaccacttttctaga

SEQ ID NO: 63130 - DNA, 35 bp, Artificial Sequence
  Synthetic oligonucleotide
gaaccacgccatcatctatattacgacgacttaga

SEQ ID NO: 63131 - DNA, 37 bp, Artificial Sequence
  Synthetic oligonucleotide
atgcctgccaaaggtggggttaggaaagggtgaacga

SEQ ID NO: 63132 - DNA, 37 bp, Artificial Sequence
  Synthetic oligonucleotide
ttctcgcgctcagtacccgtgcacctctaccacacga

SEQ ID NO: 63133 - DNA, 36 bp, Artificial Sequence
  Synthetic oligonucleotide
gacaaactggtcacgctggtactgctgttcccccga

SEQ ID NO: 63134 - DNA, 37 bp, Artificial Sequence
  Synthetic oligonucleotide
gccgggtaaaggtaggatagggaattgcgaagcgcga

SEQ ID NO: 63135 - DNA, 37 bp, Artificial Sequence
  Synthetic oligonucleotide
tctccacgaaaacatcatcgacgctaccttctggcga

SEQ ID NO: 63136 - DNA, 35 bp, Artificial Sequence
  Synthetic oligonucleotide
gttgtcgccccctaccccgtgcttcggtgaatcga

SEQ ID NO: 63137 - DNA, 37 bp, Artificial Sequence
  Synthetic oligonucleotide
gtacttccacccgtactgttatcatttagatcctcga

SEQ ID NO: 63138 - DNA, 37 bp, Artificial Sequence
  Synthetic oligonucleotide
taggacggtacatcgccttaacacgcacctgaaagga

SEQ ID NO: 63139 - DNA, 36 bp, Artificial Sequence
  Synthetic oligonucleotide
taccggagccacttaccaccaccttacagacaagga

SEQ ID NO: 63140 - DNA, 37 bp, Artificial Sequence
  Synthetic oligonucleotide
gcaagcttgcacgagacctgggtcgggcgggacggga

SEQ ID NO: 63141 - DNA, 37 bp, Artificial Sequence
  Synthetic oligonucleotide
taaggaagagtgaacgggacattggttggggggggga

SEQ ID NO: 63142 - DNA, 37 bp, Artificial Sequence
  Synthetic oligonucleotide
tgttgcagactttgccccacgtccctttatgcttgga

SEQ ID NO: 63143 - DNA, 38 bp, Artificial Sequence
  Synthetic oligonucleotide
gatgctgcttcctctcgccctgtgcgcaatgccgctga

SEQ ID NO: 63144 - DNA, 38 bp, Artificial Sequence
  Synthetic oligonucleotide
ttccgcgctgtatgtctgcgctcaccgtatacctctga

SEQ ID NO: 63145 - DNA, 36 bp, Artificial Sequence
  Synthetic oligonucleotide
ttagccgcatgcccgccttcctgcatgcccctctga

SEQ ID NO: 63146 - DNA, 38 bp, Artificial Sequence
  Synthetic oligonucleotide
atctgcactagtgcccacgttcgtttgaacctctctga

SEQ ID NO: 63147 - DNA, 38 bp, Artificial Sequence
  Synthetic oligonucleotide
tcagccactggtgccgcttgtcgccttgttctttctga

SEQ ID NO: 63148 - DNA, 37 bp, Artificial Sequence
  Synthetic oligonucleotide
gagacgacaaggatagtcatgggagtatgcggagtga

SEQ ID NO: 63149 - DNA, 38 bp, Artificial Sequence
  Synthetic oligonucleotide
accccacctgatacgccctaggtctccgaccgaggtga

SEQ ID NO: 63150 - DNA, 38 bp, Artificial Sequence
  Synthetic oligonucleotide
gtgaccggtaacacatggtcaatgggtggtgggggtga

SEQ ID NO: 63151 - DNA, 38 bp, Artificial Sequence
  Synthetic oligonucleotide
atggtggggccggtgggttggtgggttttgtactgtga

SEQ ID NO: 63152 - DNA, 35 bp, Artificial Sequence
  Synthetic oligonucleotide
ttatgcagaaagggcggaaagtatagggggattga

SEQ ID NO: 63153 - DNA, 38 bp, Artificial Sequence
  Synthetic oligonucleotide
gttacaccgtcctgcttcctctaagttgtcgcacttga

SEQ ID NO: 63154 - DNA, 38 bp, Artificial Sequence
  Synthetic oligonucleotide
gcacgatgccaactggtttgcccaggcccataccttga

SEQ ID NO: 63155 - DNA, 38 bp, Artificial Sequence
  Synthetic oligonucleotide
gccgtctgaaggcaccagcacgccgcccgaccccttga

SEQ ID NO: 63156 - DNA, 38 bp, Artificial Sequence
  Synthetic oligonucleotide
gccgcacgatcgcgcccctatattcgtcgcaggcttga

SEQ ID NO: 63157 - DNA, 37 bp, Artificial Sequence
  Synthetic oligonucleotide
gatgatggggtaagtagaagaatggttcaggttttga

SEQ ID NO: 63158 - DNA, 36 bp, Artificial Sequence
  Synthetic oligonucleotide
actgacagggtaggctattgggctcttgggcacata

SEQ ID NO: 63159 - DNA, 35 bp, Artificial Sequence
  Synthetic oligonucleotide
tgttaaccccttcaccaccatctgacttgggcata

SEQ ID NO: 63160 - DNA, 35 bp, Artificial Sequence
  Synthetic oligonucleotide
acgttctgtacctgccttatccatttgcggaccta

SEQ ID NO: 63161 - DNA, 35 bp, Artificial Sequence
  Synthetic oligonucleotide
tgacgtagaagaaaatggggcaggcgatggaggta

SEQ ID NO: 63162 - DNA, 36 bp, Artificial Sequence
  Synthetic oligonucleotide
tgatccacccgtagtactacccggcaccggtatgta

SEQ ID NO: 63163 - DNA, 35 bp, Artificial Sequence
  Synthetic oligonucleotide
ttgatgtatcccctacgcgaccaggacgcccaaac

SEQ ID NO: 63164 - DNA, 35 bp, Artificial Sequence
  Synthetic oligonucleotide
gccacgtatgaagatccacggggcccatcctccac

SEQ ID NO: 63165 - DNA, 35 bp, Artificial Sequence
  Synthetic oligonucleotide
tttacctggcccctgtgtcacacgtaatgccatac

SEQ ID NO: 63166 - DNA, 35 bp, Artificial Sequence
  Synthetic oligonucleotide
atccccgatgccgacgtgaacacttggccctttac

SEQ ID NO: 63167 - DNA, 35 bp, Artificial Sequence
  Synthetic oligonucleotide
gagtacatgcgcagttattgcccaacgtcatcacc

SEQ ID NO: 63168 - DNA, 35 bp, Artificial Sequence
  Synthetic oligonucleotide
gacaccaccacctaccacggaccgacaccacgccc

SEQ ID NO: 63169 - DNA, 35 bp, Artificial Sequence
  Synthetic oligonucleotide
acaatgcgcttgttgcaacgcccgaaccacatccc

SEQ ID NO: 63170 - DNA, 35 bp, Artificial Sequence
  Synthetic oligonucleotide
tttgagcccatacgcattacccgtctttacgcgcc

SEQ ID NO: 63171 - DNA, 35 bp, Artificial Sequence
  Synthetic oligonucleotide
gttaggtccaccattaatgcgcaaccaacgttgcc

SEQ ID NO: 63172 - DNA, 35 bp, Artificial Sequence
  Synthetic oligonucleotide
attcgcttacgtcgcaacccagaaacctggcatcc

SEQ ID NO: 63173 - DNA, 35 bp, Artificial Sequence
  Synthetic oligonucleotide
attcgcccgcgtgtggctggcttttgatcttatcc

SEQ ID NO: 63174 - DNA, 35 bp, Artificial Sequence
  Synthetic oligonucleotide
tgcaatcaaccaaatgtccccctcggatcatccgc

SEQ ID NO: 63175 - DNA, 34 bp, Artificial Sequence
  Synthetic oligonucleotide
gcgctaccctaatgatctggcgtccgttctctgc

SEQ ID NO: 63176 - DNA, 35 bp, Artificial Sequence
  Synthetic oligonucleotide
accgctgggcttggtttctatgttctggtcccatc

SEQ ID NO: 63177 - DNA, 35 bp, Artificial Sequence
  Synthetic oligonucleotide
gtgtgactcttgctgtgaacgctctccaatatatc

SEQ ID NO: 63178 - DNA, 35 bp, Artificial Sequence
  Synthetic oligonucleotide
gctacaactgcgagacgctctgcggacattttatc

SEQ ID NO: 63179 - DNA, 35 bp, Artificial Sequence
  Synthetic oligonucleotide
tacatgctctgaggcacgccagccaaaaacctctc

SEQ ID NO: 63180 - DNA, 35 bp, Artificial Sequence
  Synthetic oligonucleotide
gaaacgtcatgagggccctggatctccctctcgtc

SEQ ID NO: 63181 - DNA, 35 bp, Artificial Sequence
  Synthetic oligonucleotide
gccatctagtaagcacactacgtctctgtttacag

SEQ ID NO: 63182 - DNA, 35 bp, Artificial Sequence
  Synthetic oligonucleotide
tcacatacgattagcgttcatccattaccaccgag

SEQ ID NO: 63183 - DNA, 35 bp, Artificial Sequence
  Synthetic oligonucleotide
tccctacatcccgcactaacatgctcgcccccgcg

SEQ ID NO: 63184 - DNA, 35 bp, Artificial Sequence
  Synthetic oligonucleotide
tatgcgcgacatacccactggtgaccttgtttgcg

SEQ ID NO: 63185 - DNA, 35 bp, Artificial Sequence
  Synthetic oligonucleotide
gcaatccccatctacgccgtctcttagcaaaccgg

SEQ ID NO: 63186 - DNA, 35 bp, Artificial Sequence
  Synthetic oligonucleotide
atttggttccgccgaccgactttcccttcccaggg

SEQ ID NO: 63187 - DNA, 35 bp, Artificial Sequence
  Synthetic oligonucleotide
gtagagcgggaaggaagttggtggagctaaggggg

SEQ ID NO: 63188 - DNA, 35 bp, Artificial Sequence
  Synthetic oligonucleotide
ttaccaccttcatctgatagattctctcccctgtg

SEQ ID NO: 63189 - DNA, 35 bp, Artificial Sequence
  Synthetic oligonucleotide
actgtcgctgtcctaccccagcctacaacatcaat

SEQ ID NO: 63190 - DNA, 35 bp, Artificial Sequence
  Synthetic oligonucleotide
gacgtatggtgtgactgggagggggatgtgtgtat

SEQ ID NO: 63191 - DNA, 35 bp, Artificial Sequence
  Synthetic oligonucleotide
gtgcgcagacaactcgttgcttttttcttcggcct

SEQ ID NO: 63192 - DNA, 35 bp, Artificial Sequence
  Synthetic oligonucleotide
ggcctcatatcccatgtgcccatatgctgtctcct

SEQ ID NO: 63193 - DNA, 35 bp, Artificial Sequence
  Synthetic oligonucleotide
gatatgggtgccgactgacgtatcaacccccctct

SEQ ID NO: 63194 - DNA, 35 bp, Artificial Sequence
  Synthetic oligonucleotide
gtgtcgtgggcgtctcccctggctccattcccagt

SEQ ID NO: 63195 - DNA, 35 bp, Artificial Sequence
  Synthetic oligonucleotide
agcgagaatcgcccactccatcgtttttcatgctt

SEQ ID NO: 63196 - DNA, 35 bp, Artificial Sequence
  Synthetic oligonucleotide
aatgaaactgtcgggtgaccggggagggggtagtt

SEQ ID NO: 63197 - DNA, 35 bp, Artificial Sequence
  Synthetic oligonucleotide
tgagttagcctggtagttcacgacctcctcctgtt

SEQ ID NO: 63198 - DNA, 34 bp, Artificial Sequence
  Synthetic oligonucleotide
taccccccctcgaagactgggtcacccatcccaa

SEQ ID NO: 63199 - DNA, 36 bp, Artificial Sequence
  Synthetic oligonucleotide
ggacagttcctgcctaaatgctgctgttcactccaa

SEQ ID NO: 63200 - DNA, 36 bp, Artificial Sequence
  Synthetic oligonucleotide
tgtaagagcggctaacgggtcatggaagggagggaa

SEQ ID NO: 63201 - DNA, 36 bp, Artificial Sequence
  Synthetic oligonucleotide
tccaccttatgtgctcagtctacatcaccctgtgaa

SEQ ID NO: 63202 - DNA, 35 bp, Artificial Sequence
  Synthetic oligonucleotide
gagaaccttatcctacattgctatacacagtgtaa

SEQ ID NO: 63203 - DNA, 36 bp, Artificial Sequence
  Synthetic oligonucleotide
gatacaacgccttgccccgcctgctatcgtaattaa

SEQ ID NO: 63204 - DNA, 36 bp, Artificial Sequence
  Synthetic oligonucleotide
tccattcccgtacgccgaaccttgcatattggttaa

SEQ ID NO: 63205 - DNA, 36 bp, Artificial Sequence
  Synthetic oligonucleotide
ggtgccccgcacatccgcattagaatccaagtaaca

SEQ ID NO: 63206 - DNA, 36 bp, Artificial Sequence
  Synthetic oligonucleotide
gacggactaggaccgtcattctatcactacacacca

SEQ ID NO: 63207 - DNA, 35 bp, Artificial Sequence
  Synthetic oligonucleotide
tagtcgccgccacagctctcctttcctgggtccca

SEQ ID NO: 63208 - DNA, 36 bp, Artificial Sequence
  Synthetic oligonucleotide
aatcgaccgccacatcgattctcgtgtgcattgcca

SEQ ID NO: 63209 - DNA, 36 bp, Artificial Sequence
  Synthetic oligonucleotide
gggccagggacccttgccgactaacgaccatcatca

SEQ ID NO: 63210 - DNA, 36 bp, Artificial Sequence
  Synthetic oligonucleotide
taccacgaatcgtgtgttaccatcccacttttctca

SEQ ID NO: 63211 - DNA, 36 bp, Artificial Sequence
  Synthetic oligonucleotide
gcctacaaacgtaaatcgcgtatccctctcgcttca

SEQ ID NO: 63212 - DNA, 36 bp, Artificial Sequence
  Synthetic oligonucleotide
gtacacccctcacatcagtcgcattcgagtggttca

SEQ ID NO: 63213 - DNA, 36 bp, Artificial Sequence
  Synthetic oligonucleotide
gatggagggggggatgaagacggacgaacttgaaga

SEQ ID NO: 63214 - DNA, 37 bp, Artificial Sequence
  Synthetic oligonucleotide
gttgctatgataggtattggtggtgggggggctaaga

SEQ ID NO: 63215 - DNA, 36 bp, Artificial Sequence
  Synthetic oligonucleotide
gacttgttagggggtggcgggataatgcttggcaga

SEQ ID NO: 63216 - DNA, 35 bp, Artificial Sequence
  Synthetic oligonucleotide
gatccgcctacacgtcttacttcaccctcaggaga

SEQ ID NO: 63217 - DNA, 37 bp, Artificial Sequence
  Synthetic oligonucleotide
agcatggaccagcgccatcactgcgacctactcacga

SEQ ID NO: 63218 - DNA, 37 bp, Artificial Sequence
  Synthetic oligonucleotide
agatccgccactccaactgcctaagagtcgttctcga

SEQ ID NO: 63219 - DNA, 36 bp, Artificial Sequence
  Synthetic oligonucleotide
cccagacctgcccgtgatttggtgctcccccttcga

SEQ ID NO: 63220 - DNA, 37 bp, Artificial Sequence
  Synthetic oligonucleotide
gatggtcggtgtcgagggaggggatccgaagaaagga

SEQ ID NO: 63221 - DNA, 37 bp, Artificial Sequence
  Synthetic oligonucleotide
acccgaactgttctaacccccgcccgatcccttagga

SEQ ID NO: 63222 - DNA, 37 bp, Artificial Sequence
  Synthetic oligonucleotide
gagcatcgacagtctccccgctacccatctccacgga

SEQ ID NO: 63223 - DNA, 34 bp, Artificial Sequence
  Synthetic oligonucleotide
ggatacccctgccgcctgcaaccttcctagcgga

SEQ ID NO: 63224 - DNA, 37 bp, Artificial Sequence
  Synthetic oligonucleotide
gctgacgaagatttgtttgtgtggtatgatgggggga

SEQ ID NO: 63225 - DNA, 37 bp, Artificial Sequence
  Synthetic oligonucleotide
gtatgaagggtgaatactaggtgagggtttgggtgga

SEQ ID NO: 63226 - DNA, 35 bp, Artificial Sequence
  Synthetic oligonucleotide
actggggggcgggggcatggtgccatggacttgga

SEQ ID NO: 63227 - DNA, 38 bp, Artificial Sequence
  Synthetic oligonucleotide
tgtggacgagggcgggtgggcattcggtaaaagaatga

SEQ ID NO: 63228 - DNA, 38 bp, Artificial Sequence
  Synthetic oligonucleotide
atccacgtagaagataggaaacggaagggggaggatga

SEQ ID NO: 63229 - DNA, 38 bp, Artificial Sequence
  Synthetic oligonucleotide
acgttcatcgtgacattgtttttctgcatctctcctga

SEQ ID NO: 63230 - DNA, 37 bp, Artificial Sequence
  Synthetic oligonucleotide
gccgagtccctgttttgtctcgtgtttagtttcctga

SEQ ID NO: 63231 - DNA, 38 bp, Artificial Sequence
  Synthetic oligonucleotide
gaaggtagtagcagttaggttatggggggaaggtctga

SEQ ID NO: 63232 - DNA, 38 bp, Artificial Sequence
  Synthetic oligonucleotide
gtaacacaccttccgctctcacccgtttatacgcgtga

SEQ ID NO: 63233 - DNA, 38 bp, Artificial Sequence
  Synthetic oligonucleotide
aagtagggggcaaacggaaaccggagacacgcaggtga

SEQ ID NO: 63234 - DNA, 38 bp, Artificial Sequence
  Synthetic oligonucleotide
ggaggagagcgggaggggtcagggtaacgcgtcggtga

SEQ ID NO: 63235 - DNA, 38 bp, Artificial Sequence
  Synthetic oligonucleotide
ggtacacgcgcctcactggttctggtccaatcgattga

SEQ ID NO: 63236 - DNA, 38 bp, Artificial Sequence
  Synthetic oligonucleotide
gacaccaatggtggtaaacatccccgccgataccttga

SEQ ID NO: 63237 - DNA, 37 bp, Artificial Sequence
  Synthetic oligonucleotide
gctgggccacgtatgatcctgcgttttccggccttga

SEQ ID NO: 63238 - DNA, 37 bp, Artificial Sequence
  Synthetic oligonucleotide
ttgcactgcttcaaactacccagcctgttgctcttga

SEQ ID NO: 63239 - DNA, 37 bp, Artificial Sequence
  Synthetic oligonucleotide
gaccaacgggtacgggcaataacgaacgcactgttga

SEQ ID NO: 63240 - DNA, 37 bp, Artificial Sequence
  Synthetic oligonucleotide
tccgctcggtcatatctctcatgtttgcgccatttga

SEQ ID NO: 63241 - DNA, 37 bp, Artificial Sequence
  Synthetic oligonucleotide
gttcaccgttggctatttagcaacttcttctatttga

SEQ ID NO: 63242 - DNA, 35 bp, Artificial Sequence
  Synthetic oligonucleotide
aatcactgcggcaacaggaaccgccacatggacta

SEQ ID NO: 63243 - DNA, 35 bp, Artificial Sequence
  Synthetic oligonucleotide
atagcaacccggagccttaccatgacattgaccta

SEQ ID NO: 63244 - DNA, 36 bp, Artificial Sequence
  Synthetic oligonucleotide
ggagtggcggaagggtctctcgcgcattcataccta

SEQ ID NO: 63245 - DNA, 36 bp, Artificial Sequence
  Synthetic oligonucleotide
tgtgtacattacctaccccgcagtcctccagcgcta

SEQ ID NO: 63246 - DNA, 36 bp, Artificial Sequence
  Synthetic oligonucleotide
gtcataccaagctgttttactccgacccgcactgta

SEQ ID NO: 63247 - DNA, 35 bp, Artificial Sequence
  Synthetic oligonucleotide
tactagcacggtatatgatccgccaacactcacac

SEQ ID NO: 63248 - DNA, 35 bp, Artificial Sequence
  Synthetic oligonucleotide
gaagacgcttatatcttctcgacccgaccgccacc

SEQ ID NO: 63249 - DNA, 35 bp, Artificial Sequence
  Synthetic oligonucleotide
tgtctgaagcggagccgtcatcgccgcaaaccccc

SEQ ID NO: 63250 - DNA, 35 bp, Artificial Sequence
  Synthetic oligonucleotide
tttgtcccttagcccatattcagtcatactgatcc

SEQ ID NO: 63251 - DNA, 35 bp, Artificial Sequence
  Synthetic oligonucleotide
ggggggccgcaagggaagggagggtagcgaatcgc

SEQ ID NO: 63252 - DNA, 35 bp, Artificial Sequence
  Synthetic oligonucleotide
gactgagcacacgtctagttccgccaccaacatgc

SEQ ID NO: 63253 - DNA, 35 bp, Artificial Sequence
  Synthetic oligonucleotide
tcaaggagccccatcccttgcagaaacagacatgc

SEQ ID NO: 63254 - DNA, 35 bp, Artificial Sequence
  Synthetic oligonucleotide
tcggacgcctcctattctgccgatctcgtttttgc

SEQ ID NO: 63255 - DNA, 35 bp, Artificial Sequence
  Synthetic oligonucleotide
gtcccttaacctgccactcggagggcgccttactc

SEQ ID NO: 63256 - DNA, 35 bp, Artificial Sequence
  Synthetic oligonucleotide
gtaacgtactacgatgtcccgtcgaacccatcctc

SEQ ID NO: 63257 - DNA, 35 bp, Artificial Sequence
  Synthetic oligonucleotide
gacgggggggattgtgtgggtgtaaattggggttc

SEQ ID NO: 63258 - DNA, 35 bp, Artificial Sequence
  Synthetic oligonucleotide
tcgaccctggtcttccggtcttagttcgctatttc

SEQ ID NO: 63259 - DNA, 35 bp, Artificial Sequence
  Synthetic oligonucleotide
gagctcaaccagacttcggacggcgtacctctttc

SEQ ID NO: 63260 - DNA, 35 bp, Artificial Sequence
  Synthetic oligonucleotide
tacctgtcgtatacccagcgtttaacgtttctttc

SEQ ID NO: 63261 - DNA, 35 bp, Artificial Sequence
  Synthetic oligonucleotide
gactacctcccgttcccaagccctcattcttcaag

SEQ ID NO: 63262 - DNA, 35 bp, Artificial Sequence
  Synthetic oligonucleotide
actggcgctccctgaattccccctcccttgtcgag

SEQ ID NO: 63263 - DNA, 35 bp, Artificial Sequence
  Synthetic oligonucleotide
tgctgtaccgtatcgttggttgcatttcacattag

SEQ ID NO: 63264 - DNA, 35 bp, Artificial Sequence
  Synthetic oligonucleotide
gacccgggaggcagtttagagggggggaggacacg

SEQ ID NO: 63265 - DNA, 35 bp, Artificial Sequence
  Synthetic oligonucleotide
aactgctccactcgttgattttaggtctctcgacg

SEQ ID NO: 63266 - DNA, 35 bp, Artificial Sequence
  Synthetic oligonucleotide
tgccaaagcccccctagcacgtaagtgactttacg

SEQ ID NO: 63267 - DNA, 35 bp, Artificial Sequence
  Synthetic oligonucleotide
tccgaatcccatttgcctgtggagctcgccttccg

SEQ ID NO: 63268 - DNA, 35 bp, Artificial Sequence
  Synthetic oligonucleotide
gagtgcctgccgacagcgactccttcctctttccg

SEQ ID NO: 63269 - DNA, 35 bp, Artificial Sequence
  Synthetic oligonucleotide
tacacgctctatccgcctgcacggctaccacctcg

SEQ ID NO: 63270 - DNA, 35 bp, Artificial Sequence
  Synthetic oligonucleotide
tggtggggggcacatggcgtaaattatactggtcg

SEQ ID NO: 63271 - DNA, 35 bp, Artificial Sequence
  Synthetic oligonucleotide
gaacagggagaagggtcgaggtttccgatgtgggg

SEQ ID NO: 63272 - DNA, 35 bp, Artificial Sequence
  Synthetic oligonucleotide
gaaacgcggacgttcgtcttgaggaggggggtatg

SEQ ID NO: 63273 - DNA, 35 bp, Artificial Sequence
  Synthetic oligonucleotide
acctcccgccacctgttcgctgcggcatcattatg

SEQ ID NO: 63274 - DNA, 35 bp, Artificial Sequence
  Synthetic oligonucleotide
gttgcacccagctaactgacactggctatcacgtg

SEQ ID NO: 63275 - DNA, 35 bp, Artificial Sequence
  Synthetic oligonucleotide
gactgccggggcacgtgctctcagtccctaccttg

SEQ ID NO: 63276 - DNA, 35 bp, Artificial Sequence
  Synthetic oligonucleotide
gacaccatcacctcccctccactagccgatgcttg

SEQ ID NO: 63277 - DNA, 35 bp, Artificial Sequence
  Synthetic oligonucleotide
ggtgaccagcccgcacacttggagaagttcttcat

SEQ ID NO: 63278 - DNA, 35 bp, Artificial Sequence
  Synthetic oligonucleotide
gtacatagcctcgcagacccccagcatcgccctat

SEQ ID NO: 63279 - DNA, 35 bp, Artificial Sequence
  Synthetic oligonucleotide
tcagggcctccgtgatgattcctccaatgtgcact

SEQ ID NO: 63280 - DNA, 35 bp, Artificial Sequence
  Synthetic oligonucleotide
acatcgccccgagatagttttcccccgcaatacct

SEQ ID NO: 63281 - DNA, 35 bp, Artificial Sequence
  Synthetic oligonucleotide
gcgatcgcacgctatctccgggtatttatgttcct

SEQ ID NO: 63282 - DNA, 35 bp, Artificial Sequence
  Synthetic oligonucleotide
acgatcaccggcctcaatcgctcaaaaggttccgt

SEQ ID NO: 63283 - DNA, 35 bp, Artificial Sequence
  Synthetic oligonucleotide
atagcatgcgggaaagcgaattaggaaatgggcgt

SEQ ID NO: 63284 - DNA, 35 bp, Artificial Sequence
  Synthetic oligonucleotide
ggtgcgggctctggcgccaccacccgatctctgtt

SEQ ID NO: 63285 - DNA, 35 bp, Artificial Sequence
  Synthetic oligonucleotide
tgccaagccggggggtggaggggatcaaggtattt

SEQ ID NO: 63286 - DNA, 36 bp, Artificial Sequence
  Synthetic oligonucleotide
gccccacaccctgccaacacaaagcggacataaaaa

SEQ ID NO: 63287 - DNA, 35 bp, Artificial Sequence
  Synthetic oligonucleotide
gtccccgaggtgccccctactcgccagtacacaaa

SEQ ID NO: 63288 - DNA, 35 bp, Artificial Sequence
  Synthetic oligonucleotide
accgcaacccttcttcctatctggcctatgaccaa

SEQ ID NO: 63289 - DNA, 36 bp, Artificial Sequence
  Synthetic oligonucleotide
tgcgctcacacaacgatagtcattgatatcctccaa

SEQ ID NO: 63290 - DNA, 36 bp, Artificial Sequence
  Synthetic oligonucleotide
ggaacctcatgacaccgttccctctcgcctctccaa

SEQ ID NO: 63291 - DNA, 35 bp, Artificial Sequence
  Synthetic oligonucleotide
atccacgcctcaggcccgcgctcatcatctttgaa

SEQ ID NO: 63292 - DNA, 35 bp, Artificial Sequence
  Synthetic oligonucleotide
tagcccacgacacgccaccgtattaggcgataaca

SEQ ID NO: 63293 - DNA, 36 bp, Artificial Sequence
  Synthetic oligonucleotide
gccaaggtcgagaagaaaggtgtcttgtgtgcgaca

SEQ ID NO: 63294 - DNA, 33 bp, Artificial Sequence
  Synthetic oligonucleotide
tgccacccgttccaatggcaatcagcttaccca

SEQ ID NO: 63295 - DNA, 36 bp, Artificial Sequence
  Synthetic oligonucleotide
tccacgcgttccaccgacaccgtcagttcgaatcca

SEQ ID NO: 63296 - DNA, 36 bp, Artificial Sequence
  Synthetic oligonucleotide
gatgggacaggtcacgcttaatagtttcaccgtcca

SEQ ID NO: 63297 - DNA, 36 bp, Artificial Sequence
  Synthetic oligonucleotide
aacgaaccactagcactactacccgcgcagttctca

SEQ ID NO: 63298 - DNA, 36 bp, Artificial Sequence
  Synthetic oligonucleotide
tcagtttaaccccagcccgctactctcgccgtttca

SEQ ID NO: 63299 - DNA, 36 bp, Artificial Sequence
  Synthetic oligonucleotide
ttgagcatgcagccgcactgcgctttatgacaacga

SEQ ID NO: 63300 - DNA, 36 bp, Artificial Sequence
  Synthetic oligonucleotide
acgccctgacgcgggcaaaaaaaatacatgttacga

SEQ ID NO: 63301 - DNA, 37 bp, Artificial Sequence
  Synthetic oligonucleotide
aggaaggccacccgggttattagccccgccacaccga

SEQ ID NO: 63302 - DNA, 37 bp, Artificial Sequence
  Synthetic oligonucleotide
tcctccccgccggacaggaaaactgagcacccaccga

SEQ ID NO: 63303 - DNA, 35 bp, Artificial Sequence
  Synthetic oligonucleotide
acgtgctccaccatacggccactgtcgacgaccga

SEQ ID NO: 63304 - DNA, 37 bp, Artificial Sequence
  Synthetic oligonucleotide
gccaacgtaaacgctcccacgcttccaatgaccccga

SEQ ID NO: 63305 - DNA, 36 bp, Artificial Sequence
  Synthetic oligonucleotide
gtgatgccgcccttaattcctggaagcctatcccga

SEQ ID NO: 63306 - DNA, 35 bp, Artificial Sequence
  Synthetic oligonucleotide
gaaagtcacatcacactccgctactaacttgccga

SEQ ID NO: 63307 - DNA, 37 bp, Artificial Sequence
  Synthetic oligonucleotide
gcacatcttcgccttggatccacattgaccattccga

SEQ ID NO: 63308 - DNA, 37 bp, Artificial Sequence
  Synthetic oligonucleotide
acagtgccttgtttgctatttgtctctcactgttcga

SEQ ID NO: 63309 - DNA, 37 bp, Artificial Sequence
  Synthetic oligonucleotide
gactcgtacagaggaaaaggcgttggagcaggaagga

SEQ ID NO: 63310 - DNA, 37 bp, Artificial Sequence
  Synthetic oligonucleotide
gaagacagagggcggttgatgactcatgttggtagga

SEQ ID NO: 63311 - DNA, 36 bp, Artificial Sequence
  Synthetic oligonucleotide
gatgatgccgggcagatcttcaactttctctaggga

SEQ ID NO: 63312 - DNA, 37 bp, Artificial Sequence
  Synthetic oligonucleotide
gccgtctcacgccgcctgtactgttccatctccggga

SEQ ID NO: 63313 - DNA, 35 bp, Artificial Sequence
  Synthetic oligonucleotide
gccgtgagcgagcgacggaaattggagcgggggga

SEQ ID NO: 63314 - DNA, 37 bp, Artificial Sequence
  Synthetic oligonucleotide
tgcacatccctgacctagcttccaggcccactgggga

SEQ ID NO: 63315 - DNA, 36 bp, Artificial Sequence
  Synthetic oligonucleotide
gagggaccatggggaaggaagggtagccaccttgga

SEQ ID NO: 63316 - DNA, 38 bp, Artificial Sequence
  Synthetic oligonucleotide
tacggaggctgagaactgggtggggggttgaagaatga

SEQ ID NO: 63317 - DNA, 38 bp, Artificial Sequence
  Synthetic oligonucleotide
actaggggggtgtaggtaggtaagggcgtgggttatga

SEQ ID NO: 63318 - DNA, 38 bp, Artificial Sequence
  Synthetic oligonucleotide
agaacggcaaacggggtcagagagggcgggcgggctga

SEQ ID NO: 63319 - DNA, 38 bp, Artificial Sequence
  Synthetic oligonucleotide
gtcgacccttaaccccatatctgtgccagtttctctga

SEQ ID NO: 63320 - DNA, 38 bp, Artificial Sequence
  Synthetic oligonucleotide
gtgatccccgtagattggccctgtttcgttggttctga

SEQ ID NO: 63321 - DNA, 38 bp, Artificial Sequence
  Synthetic oligonucleotide
acacaccctcattaacctgcgccgaacccgtgcagtga

SEQ ID NO: 63322 - DNA, 38 bp, Artificial Sequence
  Synthetic oligonucleotide
ggaccccgaaccgtctggattatccccttctcgcgtga

SEQ ID NO: 63323 - DNA, 34 bp, Artificial Sequence
  Synthetic oligonucleotide
tgaaactcaactaacccgtcctcgctcctcgtga

SEQ ID NO: 63324 - DNA, 36 bp, Artificial Sequence
  Synthetic oligonucleotide
gtcccggtagggtgaactaggggtgggttggggtga

SEQ ID NO: 63325 - DNA, 37 bp, Artificial Sequence
  Synthetic oligonucleotide
tattgcccgagggaggagcgagggtcgggacatgtga

SEQ ID NO: 63326 - DNA, 37 bp, Artificial Sequence
  Synthetic oligonucleotide
aacacggcactcacttttctgtacctccatcgtgtga

SEQ ID NO: 63327 - DNA, 37 bp, Artificial Sequence
  Synthetic oligonucleotide
agcgggcaagggcgaaggatgggtaggggtaaattga

SEQ ID NO: 63328 - DNA, 38 bp, Artificial Sequence
  Synthetic oligonucleotide
atggagggagaagaggggaggagactaactggtgttga

SEQ ID NO: 63329 - DNA, 35 bp, Artificial Sequence
  Synthetic oligonucleotide
atggccgttgctccgccgacctataccgctttata

SEQ ID NO: 63330 - DNA, 35 bp, Artificial Sequence
  Synthetic oligonucleotide
ttggggagatcgagacatgagatacaagagcggta

SEQ ID NO: 63331 - DNA, 36 bp, Artificial Sequence
  Synthetic oligonucleotide
gtgtgctgcacctccctccgcggccccagagcggta

SEQ ID NO: 63332 - DNA, 35 bp, Artificial Sequence
  Synthetic oligonucleotide
acctcggacccgagagtccttaatctgccgccgac

SEQ ID NO: 63333 - DNA, 35 bp, Artificial Sequence
  Synthetic oligonucleotide
gagatcgttaccgtcccgtactgccccggctctac

SEQ ID NO: 63334 - DNA, 35 bp, Artificial Sequence
  Synthetic oligonucleotide
atgccgggcatactacggtaaggcaaccattctac

SEQ ID NO: 63335 - DNA, 35 bp, Artificial Sequence
  Synthetic oligonucleotide
taaccccgagaggttgttacgccattatatgtacc

SEQ ID NO: 63336 - DNA, 35 bp, Artificial Sequence
  Synthetic oligonucleotide
tatgccattctcgttgaatctaggtgcctctaccc

SEQ ID NO: 63337 - DNA, 35 bp, Artificial Sequence
  Synthetic oligonucleotide
catcgtcacccacgacgcctgctttgcccattccc

SEQ ID NO: 63338 - DNA, 35 bp, Artificial Sequence
  Synthetic oligonucleotide
tcctagcaggcggtaaattaaggcttttgcgttcc

SEQ ID NO: 63339 - DNA, 35 bp, Artificial Sequence
  Synthetic oligonucleotide
gatctgcactccggttgctgcctagggtatgttcc

SEQ ID NO: 63340 - DNA, 35 bp, Artificial Sequence
  Synthetic oligonucleotide
gtgctgagcactacggctctccttaattcatccgc

SEQ ID NO: 63341 - DNA, 36 bp, Artificial Sequence
  Synthetic oligonucleotide
gggaggctcaaactgtacttctcctgactttctcgc

SEQ ID NO: 63342 - DNA, 35 bp, Artificial Sequence
  Synthetic oligonucleotide
accgacccaagtagctcatgcagttctattcttgc

SEQ ID NO: 63343 - DNA, 35 bp, Artificial Sequence
  Synthetic oligonucleotide
agccccgtacgcacacctagctccggctattgatc

SEQ ID NO: 63344 - DNA, 35 bp, Artificial Sequence
  Synthetic oligonucleotide
accgcctaccggacaccgggggttttttttctgtc

SEQ ID NO: 63345 - DNA, 35 bp, Artificial Sequence
  Synthetic oligonucleotide
atcgttcgtacatcgaatccctgtcgatcccgttc

SEQ ID NO: 63346 - DNA, 35 bp, Artificial Sequence
  Synthetic oligonucleotide
gagtggggatggagtgcagggttggcagttcgtag

SEQ ID NO: 63347 - DNA, 35 bp, Artificial Sequence
  Synthetic oligonucleotide
tgatcgactgttctacgcactactagctccccacg

SEQ ID NO: 63348 - DNA, 35 bp, Artificial Sequence
  Synthetic oligonucleotide
tatggtggtgaaggggttctataggcgatggcacg

SEQ ID NO: 63349 - DNA, 34 bp, Artificial Sequence
  Synthetic oligonucleotide
aagcggaaagggtgacccggggggggtggtgtcg

SEQ ID NO: 63350 - DNA, 35 bp, Artificial Sequence
  Synthetic oligonucleotide
attgaccgccccattctccgtacgtccaccgctgg

SEQ ID NO: 63351 - DNA, 35 bp, Artificial Sequence
  Synthetic oligonucleotide
tagggcacacgaattgcatgcgcctcttccccaat

SEQ ID NO: 63352 - DNA, 35 bp, Artificial Sequence
  Synthetic oligonucleotide
atcattgcccgttgcccgctttggtcgtgccccat

SEQ ID NO: 63353 - DNA, 35 bp, Artificial Sequence
  Synthetic oligonucleotide
ttcaccacatccgaatcaactggtattgattccct

SEQ ID NO: 63354 - DNA, 35 bp, Artificial Sequence
  Synthetic oligonucleotide
acagttcgtccgccgcaccagtatcgggatccgct

SEQ ID NO: 63355 - DNA, 35 bp, Artificial Sequence
  Synthetic oligonucleotide
ttcttcccacgccatttatagtatgcttccttgct

SEQ ID NO: 63356 - DNA, 35 bp, Artificial Sequence
  Synthetic oligonucleotide
gctccgccgtaggccgtattctataactcgcctct

SEQ ID NO: 63357 - DNA, 35 bp, Artificial Sequence
  Synthetic oligonucleotide
atcagggcaacgtggagggtcgggtgatgaggtct

SEQ ID NO: 63358 - DNA, 35 bp, Artificial Sequence
  Synthetic oligonucleotide
aacacgccagaccgccagtcaccgaaagtaccagt

SEQ ID NO: 63359 - DNA, 35 bp, Artificial Sequence
  Synthetic oligonucleotide
tatgtaccgccttacctatcttcaacatgcaaggt

SEQ ID NO: 63360 - DNA, 35 bp, Artificial Sequence
  Synthetic oligonucleotide
gcgacaggtaaaagggaacggaggcggagattggt

SEQ ID NO: 63361 - DNA, 35 bp, Artificial Sequence
  Synthetic oligonucleotide
atctagccctcggcatgggtgtgctgcccgccctt

SEQ ID NO: 63362 - DNA, 35 bp, Artificial Sequence
  Synthetic oligonucleotide
tacggggtcacaccatacgtaccccatgtgccctt

SEQ ID NO: 63363 - DNA, 35 bp, Artificial Sequence
  Synthetic oligonucleotide
aacccatctcccgcactctgattccatacggcctt

SEQ ID NO: 63364 - DNA, 35 bp, Artificial Sequence
  Synthetic oligonucleotide
attcatccttgcccgttacgaatcgcctccacgtt

SEQ ID NO: 63365 - DNA, 35 bp, Artificial Sequence
  Synthetic oligonucleotide
ttggagcacgggatagccgtcatggaaatttggtt

SEQ ID NO: 63366 - DNA, 36 bp, Artificial Sequence
  Synthetic oligonucleotide
aaatgggccgttcattgggaggggggggaacggaaa

SEQ ID NO: 63367 - DNA, 36 bp, Artificial Sequence
  Synthetic oligonucleotide
agcatggccggctttgtcatcttcgaccccacgcaa

SEQ ID NO: 63368 - DNA, 35 bp, Artificial Sequence
  Synthetic oligonucleotide
agctgggggagccgggaggttacgtagcctggcaa

SEQ ID NO: 63369 - DNA, 36 bp, Artificial Sequence
  Synthetic oligonucleotide
gattcgcaacattccttagtttcgttctgtgaagaa

SEQ ID NO: 63370 - DNA, 36 bp, Artificial Sequence
  Synthetic oligonucleotide
actaccacctctcggttagttatgccctatgcttaa

SEQ ID NO: 63371 - DNA, 36 bp, Artificial Sequence
  Synthetic oligonucleotide
tctgatcggctacggcggctatttacactctccaca

SEQ ID NO: 63372 - DNA, 35 bp, Artificial Sequence
  Synthetic oligonucleotide
gtcaacggtcgggtttctctcttctgcgggttaca

SEQ ID NO: 63373 - DNA, 36 bp, Artificial Sequence
  Synthetic oligonucleotide
gccgcaggaacagaaatgaggcaaaaatctacacca

SEQ ID NO: 63374 - DNA, 36 bp, Artificial Sequence
  Synthetic oligonucleotide
ccacctcctgcatcaacacgccacgtagctaaccca

SEQ ID NO: 63375 - DNA, 35 bp, Artificial Sequence
  Synthetic oligonucleotide
tcaccaccctatcgccggttctaagcgggtatcca

SEQ ID NO: 63376 - DNA, 36 bp, Artificial Sequence
  Synthetic oligonucleotide
ccctgtcctcaatcgcctcctaacactcctggtgca

SEQ ID NO: 63377 - DNA, 36 bp, Artificial Sequence
  Synthetic oligonucleotide
gcctcgccatgaccattattcacccacacgaagtca

SEQ ID NO: 63378 - DNA, 37 bp, Artificial Sequence
  Synthetic oligonucleotide
aaagggggaggccaggatggttggacctgaacaaaga

SEQ ID NO: 63379 - DNA, 37 bp, Artificial Sequence
  Synthetic oligonucleotide
gacatcccatctctggcctttcgtctgtccccacaga

SEQ ID NO: 63380 - DNA, 37 bp, Artificial Sequence
  Synthetic oligonucleotide
agcaaaggcttggcctggaggataacggaggaagaga

SEQ ID NO: 63381 - DNA, 37 bp, Artificial Sequence
  Synthetic oligonucleotide
gccccgcattgttctatccagttgcgacctcgcgaga

SEQ ID NO: 63382 - DNA, 36 bp, Artificial Sequence
  Synthetic oligonucleotide
tatcacacacaatgcagaatgccacacggctcgaga

SEQ ID NO: 63383 - DNA, 35 bp, Artificial Sequence
  Synthetic oligonucleotide
gagttacaaataagttgcaagagggggaggggaga

SEQ ID NO: 63384 - DNA, 37 bp, Artificial Sequence
  Synthetic oligonucleotide
atgatatgcaggaggcaagaagcctgggggggggaga

SEQ ID NO: 63385 - DNA, 37 bp, Artificial Sequence
  Synthetic oligonucleotide
atgttcctggtcactgctcgtccgcgcgaattgccga

SEQ ID NO: 63386 - DNA, 35 bp, Artificial Sequence
  Synthetic oligonucleotide
tattgccaatccgccccccccgactctcgatccga

SEQ ID NO: 63387 - DNA, 36 bp, Artificial Sequence
  Synthetic oligonucleotide
gaaatggtgaccgtgggagtggtggggggtaagcga

SEQ ID NO: 63388 - DNA, 37 bp, Artificial Sequence
  Synthetic oligonucleotide
gtacctcgcgcccggatcacaacacccttttagtcga

SEQ ID NO: 63389 - DNA, 36 bp, Artificial Sequence
  Synthetic oligonucleotide
gacgaccgtactggaccttattgcgtgctttgtcga

SEQ ID NO: 63390 - DNA, 37 bp, Artificial Sequence
  Synthetic oligonucleotide
aacactcgagaagggggcatgaacccgtttgatagga

SEQ ID NO: 63391 - DNA, 34 bp, Artificial Sequence
  Synthetic oligonucleotide
gacataggcacgtctcgctggctcacttttagga

SEQ ID NO: 63392 - DNA, 36 bp, Artificial Sequence
  Synthetic oligonucleotide
tcgacgagggagcggaggtcgggaatgaaaaacgga

SEQ ID NO: 63393 - DNA, 35 bp, Artificial Sequence
  Synthetic oligonucleotide
tgaaacagaggtagtgtactgatgggagtggggga

SEQ ID NO: 63394 - DNA, 37 bp, Artificial Sequence
  Synthetic oligonucleotide
aagtaggagcgccgaggggggtaatttggtggatgga

SEQ ID NO: 63395 - DNA, 38 bp, Artificial Sequence
  Synthetic oligonucleotide
gacgtgggtcagaggactaccctgccttcttcacatga

SEQ ID NO: 63396 - DNA, 38 bp, Artificial Sequence
  Synthetic oligonucleotide
gacggagaccgcacgggctcagagtctcccttacatga

SEQ ID NO: 63397 - DNA, 38 bp, Artificial Sequence
  Synthetic oligonucleotide
tgaatgaggactagtggtggaaacgggaagagtcatga

SEQ ID NO: 63398 - DNA, 38 bp, Artificial Sequence
  Synthetic oligonucleotide
aacagtcgcaatctgggcaagggtagtagtggggatga

SEQ ID NO: 63399 - DNA, 38 bp, Artificial Sequence
  Synthetic oligonucleotide
acctcatggccccctggtttgaatgtccatccgtatga

SEQ ID NO: 63400 - DNA, 38 bp, Artificial Sequence
  Synthetic oligonucleotide
gatggccgtcgggtgaccaaccatgaaaccgccactga

SEQ ID NO: 63401 - DNA, 38 bp, Artificial Sequence
  Synthetic oligonucleotide
aacggtgagcatatagtaggggatggggccggtactga

SEQ ID NO: 63402 - DNA, 35 bp, Artificial Sequence
  Synthetic oligonucleotide
tccgacattgactccatctagtacggtatccctga

SEQ ID NO: 63403 - DNA, 38 bp, Artificial Sequence
  Synthetic oligonucleotide
ttctgcccgtccgcgtccacctatgcgctcctagctga

SEQ ID NO: 63404 - DNA, 38 bp, Artificial Sequence
  Synthetic oligonucleotide
tgacgcctcgaattcgatccaacggtccagtgggctga

SEQ ID NO: 63405 - DNA, 37 bp, Artificial Sequence
  Synthetic oligonucleotide
tactgcgcaccccaaccggtttttgccgcatttctga

SEQ ID NO: 63406 - DNA, 38 bp, Artificial Sequence
  Synthetic oligonucleotide
tgcatcgggtgggggtgcattgatagggagggaagtga

SEQ ID NO: 63407 - DNA, 37 bp, Artificial Sequence
  Synthetic oligonucleotide
tgttcccaacgccgggccttaccacacattcccgtga

SEQ ID NO: 63408 - DNA, 38 bp, Artificial Sequence
  Synthetic oligonucleotide
gtgggtagggaggaaagatacagcagggacaggcgtga

SEQ ID NO: 63409 - DNA, 38 bp, Artificial Sequence
  Synthetic oligonucleotide
gggaggagggggggtcatagtcacggggaaggtggtga

SEQ ID NO: 63410 - DNA, 37 bp, Artificial Sequence
  Synthetic oligonucleotide
ggttcacccgcccaacttttgtaccgtagatctgtga

SEQ ID NO: 63411 - DNA, 37 bp, Artificial Sequence
  Synthetic oligonucleotide
acacgaccctggcatattctagttctagctcacttga

SEQ ID NO: 63412 - DNA, 37 bp, Artificial Sequence
  Synthetic oligonucleotide
atgggaacgcgagagggagaaaattttgggtccttga

SEQ ID NO: 63413 - DNA, 37 bp, Artificial Sequence
  Synthetic oligonucleotide
gtcacactgcccatctctcgccgagaccgaggcttga

SEQ ID NO: 63414 - DNA, 38 bp, Artificial Sequence
  Synthetic oligonucleotide
gcgctccgcacgttgagcatctctttcgaacttcttga

SEQ ID NO: 63415 - DNA, 37 bp, Artificial Sequence
  Synthetic oligonucleotide
acacgcaccataacacaagcaccggttaccttgttga

SEQ ID NO: 63416 - DNA, 38 bp, Artificial Sequence
  Synthetic oligonucleotide
gtgcactcgctagttccgttttcctcatatccatttga

SEQ ID NO: 63417 - DNA, 38 bp, Artificial Sequence
  Synthetic oligonucleotide
acacactgtgccaaacgggatttcgaccgcacttttga

SEQ ID NO: 63418 - DNA, 38 bp, Artificial Sequence
  Synthetic oligonucleotide
tttgagcaccctcctcagccatcgtagtcaccttttga

SEQ ID NO: 63419 - DNA, 36 bp, Artificial Sequence
  Synthetic oligonucleotide
tttgcgtccgggccccgtaatacgcctcacataata

SEQ ID NO: 63420 - DNA, 35 bp, Artificial Sequence
  Synthetic oligonucleotide
gatactgtgctcgctctgccctggaattccccata

SEQ ID NO: 63421 - DNA, 34 bp, Artificial Sequence
  Synthetic oligonucleotide
acacgactggaccaagggggtaggagtagggata

SEQ ID NO: 63422 - DNA, 35 bp, Artificial Sequence
  Synthetic oligonucleotide
ttgccgacctcctcttcatatcgtactagcctata

SEQ ID NO: 63423 - DNA, 35 bp, Artificial Sequence
  Synthetic oligonucleotide
tccgccaatcatttctggttcgcctactacgccta

SEQ ID NO: 63424 - DNA, 36 bp, Artificial Sequence
  Synthetic oligonucleotide
gccgacagaggtgcattttcctcgatctccatccta

SEQ ID NO: 63425 - DNA, 37 bp, Artificial Sequence
  Synthetic oligonucleotide
ttgccacccccagccctcgttagtaccctcttgcgta

SEQ ID NO: 63426 - DNA, 34 bp, Artificial Sequence
  Synthetic oligonucleotide
gatgcatcacaatctcccttttcgatggcctgta

SEQ ID NO: 63427 - DNA, 36 bp, Artificial Sequence
  Synthetic oligonucleotide
ttgccacacgacactcatccgcatctatgctactta

SEQ ID NO: 63428 - DNA, 35 bp, Artificial Sequence
  Synthetic oligonucleotide
gtctagagctccagctcccgcattccccatagtta

SEQ ID NO: 63429 - DNA, 35 bp, Artificial Sequence
  Synthetic oligonucleotide
gtgcatcctgacatctgcccaagttgcactcatac

SEQ ID NO: 63430 - DNA, 35 bp, Artificial Sequence
  Synthetic oligonucleotide
atcttgtaccctcaatctggccgacggtcctttac

SEQ ID NO: 63431 - DNA, 35 bp, Artificial Sequence
  Synthetic oligonucleotide
accgcggatcagggctagtcttctcctggtaaacc

SEQ ID NO: 63432 - DNA, 35 bp, Artificial Sequence
  Synthetic oligonucleotide
ggactcccggtctggcacccatgattgcgcccccc

SEQ ID NO: 63433 - DNA, 35 bp, Artificial Sequence
  Synthetic oligonucleotide
tctcgcattgttagcgagtagtcccacgccgcccc

SEQ ID NO: 63434 - DNA, 35 bp, Artificial Sequence
  Synthetic oligonucleotide
agtgtgcaccccctgaacgcagtgaccgcccctcc

SEQ ID NO: 63435 - DNA, 35 bp, Artificial Sequence
  Synthetic oligonucleotide
gcctgaatcctgcaccaagtgctactaataaccgc

SEQ ID NO: 63436 - DNA, 35 bp, Artificial Sequence
  Synthetic oligonucleotide
tggacacctttgcagtagtgactacacttccccgc

SEQ ID NO: 63437 - DNA, 35 bp, Artificial Sequence
  Synthetic oligonucleotide
aatgcccgcatcctaaatcgattgtaacgcctcgc

SEQ ID NO: 63438 - DNA, 35 bp, Artificial Sequence
  Synthetic oligonucleotide
gaaccagcagcgcactatttaccgtctcccttcgc

SEQ ID NO: 63439 - DNA, 35 bp, Artificial Sequence
  Synthetic oligonucleotide
tgaccgtactttaatgctgattttgccgtgcatgc

SEQ ID NO: 63440 - DNA, 35 bp, Artificial Sequence
  Synthetic oligonucleotide
agcattcacctctgctccgctagccgcactatatc

SEQ ID NO: 63441 - DNA, 35 bp, Artificial Sequence
  Synthetic oligonucleotide
acccaagtcacttgactgtctgaacccaactactc

SEQ ID NO: 63442 - DNA, 35 bp, Artificial Sequence
  Synthetic oligonucleotide
ggtatgacttgccgcatatattgcagatccgcctc

SEQ ID NO: 63443 - DNA, 35 bp, Artificial Sequence
  Synthetic oligonucleotide
gacacacgaaatccgctgtctccttatgaactgag

SEQ ID NO: 63444 - DNA, 35 bp, Artificial Sequence
  Synthetic oligonucleotide
atcggtacacctcggctcccgaccccaccataacg

SEQ ID NO: 63445 - DNA, 35 bp, Artificial Sequence
  Synthetic oligonucleotide
taagggtgcgggatgagggagggtgttgtatgacg

SEQ ID NO: 63446 - DNA, 35 bp, Artificial Sequence
  Synthetic oligonucleotide
tccaaagcccgcccgcgcagcacctattacctacg

SEQ ID NO: 63447 - DNA, 35 bp, Artificial Sequence
  Synthetic oligonucleotide
atcgggtgcttgtcactgcgccttctacttccccg

SEQ ID NO: 63448 - DNA, 35 bp, Artificial Sequence
  Synthetic oligonucleotide
ttgcaccatccatcccgcgctcgcctccaatcccg

SEQ ID NO: 63449 - DNA, 35 bp, Artificial Sequence
  Synthetic oligonucleotide
tcatcacgcagttccttaattgattaactgttgcg

SEQ ID NO: 63450 - DNA, 35 bp, Artificial Sequence
  Synthetic oligonucleotide
acgcgcgcactgctactccactttttatgtttgcg

SEQ ID NO: 63451 - DNA, 35 bp, Artificial Sequence
  Synthetic oligonucleotide
atgccgacgcagtaactctttttcgccgcagttcg

SEQ ID NO: 63452 - DNA, 35 bp, Artificial Sequence
  Synthetic oligonucleotide
tctatcacttgtatgcttccaccgggcctcccagg

SEQ ID NO: 63453 - DNA, 35 bp, Artificial Sequence
  Synthetic oligonucleotide
tgacacataatacgttttctacacccccctccagg

SEQ ID NO: 63454 - DNA, 35 bp, Artificial Sequence
  Synthetic oligonucleotide
gtttcgataggggaacgaaggaaggggtgttaggg

SEQ ID NO: 63455 - DNA, 35 bp, Artificial Sequence
  Synthetic oligonucleotide
gtccccgcctcactctgccgttacacttctttgtg

SEQ ID NO: 63456 - DNA, 35 bp, Artificial Sequence
  Synthetic oligonucleotide
tatccccagcacgccatggccgtctgatcgccttg

SEQ ID NO: 63457 - DNA, 35 bp, Artificial Sequence
  Synthetic oligonucleotide
gtggactgtctcattattcattttaccagtaccct

SEQ ID NO: 63458 - DNA, 35 bp, Artificial Sequence
  Synthetic oligonucleotide
tccgaccaatgataatggttcgtgattagtttcct

SEQ ID NO: 63459 - DNA, 35 bp, Artificial Sequence
  Synthetic oligonucleotide
tcaacggatgggaaaggaaggcgggagggtgcgct

SEQ ID NO: 63460 - DNA, 35 bp, Artificial Sequence
  Synthetic oligonucleotide
tcagtgtgtcacgttaggtattggctctcccgtct

SEQ ID NO: 63461 - DNA, 35 bp, Artificial Sequence
  Synthetic oligonucleotide
aatctcacacacgttgctgtactcctttctaatgt

SEQ ID NO: 63462 - DNA, 35 bp, Artificial Sequence
  Synthetic oligonucleotide
gaggtgcatgcgcggaatgggggagggtgttagtt

SEQ ID NO: 63463 - DNA, 35 bp, Artificial Sequence
  Synthetic oligonucleotide
atagcaccacatgcggtaccctcctttcctctgtt

SEQ ID NO: 63464 - DNA, 35 bp, Artificial Sequence
  Synthetic oligonucleotide
ggatgggagggaggcgcgtaggaggccctgttttt

SEQ ID NO: 63465 - DNA, 35 bp, Artificial Sequence
  Synthetic oligonucleotide
gcccatcccctccgaacagttgagtgattgtaaaa

SEQ ID NO: 63466 - DNA, 36 bp, Artificial Sequence
  Synthetic oligonucleotide
atgtacttggcgccgcggtgggtagggtgggggaaa

SEQ ID NO: 63467 - DNA, 36 bp, Artificial Sequence
  Synthetic oligonucleotide
gctgggacccgtcggagggggcgggaggggtaacaa

SEQ ID NO: 63468 - DNA, 36 bp, Artificial Sequence
  Synthetic oligonucleotide
aacaacacatcgccccgtaagcatcatgcactccaa

SEQ ID NO: 63469 - DNA, 36 bp, Artificial Sequence
  Synthetic oligonucleotide
atgctggctagcatcctacttcgtttcaccagcgaa

SEQ ID NO: 63470 - DNA, 36 bp, Artificial Sequence
  Synthetic oligonucleotide
tacgacaaggggcgggattgcgcagaatggtgggaa

SEQ ID NO: 63471 - DNA, 35 bp, Artificial Sequence
  Synthetic oligonucleotide
taccctacacgcacttggatttatcaacacttgaa

SEQ ID NO: 63472 - DNA, 35 bp, Artificial Sequence
  Synthetic oligonucleotide
gtgtggtccactaccgtgaaaagtttgatcttgaa

SEQ ID NO: 63473 - DNA, 36 bp, Artificial Sequence
  Synthetic oligonucleotide
ggtcctgtcccgtcctgaagcggtccctccccctaa

SEQ ID NO: 63474 - DNA, 36 bp, Artificial Sequence
  Synthetic oligonucleotide
attgcctcggccagcctggcttgcatttctatctaa

SEQ ID NO: 63475 - DNA, 36 bp, Artificial Sequence
  Synthetic oligonucleotide
gaccgataccgtgatcccctgtttgtccgctataca

SEQ ID NO: 63476 - DNA, 36 bp, Artificial Sequence
  Synthetic oligonucleotide
gattcacccgtacccgcactgtccttgggacgtaca

SEQ ID NO: 63477 - DNA, 36 bp, Artificial Sequence
  Synthetic oligonucleotide
ttcatgggaagggggctgggggggtgttagaaggca

SEQ ID NO: 63478 - DNA, 36 bp, Artificial Sequence
  Synthetic oligonucleotide
atgcacaccggaggtgtccgttaaaagcaaagctca

SEQ ID NO: 63479 - DNA, 36 bp, Artificial Sequence
  Synthetic oligonucleotide
agcgccactgcaaaatccgacctgtctagacgctca

SEQ ID NO: 63480 - DNA, 36 bp, Artificial Sequence
  Synthetic oligonucleotide
gcgcacgtatatggctcagacgccgcgcccttctca

SEQ ID NO: 63481 - DNA, 37 bp, Artificial Sequence
  Synthetic oligonucleotide
gatatgcggaggggaggacaaaattctagattccaga

SEQ ID NO: 63482 - DNA, 37 bp, Artificial Sequence
  Synthetic oligonucleotide
tcacttccgtcgatttgactctattctgtttgcccga

SEQ ID NO: 63483 - DNA, 37 bp, Artificial Sequence
  Synthetic oligonucleotide
aaactgcgctccacctgtttgtggccaaatcttccga

SEQ ID NO: 63484 - DNA, 36 bp, Artificial Sequence
  Synthetic oligonucleotide
aaccgaaaatcctgtccaatcgtatcgcgtacgcga

SEQ ID NO: 63485 - DNA, 37 bp, Artificial Sequence
  Synthetic oligonucleotide
acaccccgttcgccacgtaacttcccccttccggcga

SEQ ID NO: 63486 - DNA, 37 bp, Artificial Sequence
  Synthetic oligonucleotide
tacatcaacattgtgcatcacttgtcacgccattcga

SEQ ID NO: 63487 - DNA, 37 bp, Artificial Sequence
  Synthetic oligonucleotide
acctgcaccggtcgtcagtcaacttcaacattttcga

SEQ ID NO: 63488 - DNA, 37 bp, Artificial Sequence
  Synthetic oligonucleotide
cacggatcggacaggggtgagggggaggagtggagga

SEQ ID NO: 63489 - DNA, 37 bp, Artificial Sequence
  Synthetic oligonucleotide
gcggagctgaggggtgatgctgtggtggtacggggga

SEQ ID NO: 63490 - DNA, 36 bp, Artificial Sequence
  Synthetic oligonucleotide
tcaggagtgaggggtgttggttggggctgtaatgga

SEQ ID NO: 63491 - DNA, 36 bp, Artificial Sequence
  Synthetic oligonucleotide
tcatgcctcccactattggtccatatgcgcattgga

SEQ ID NO: 63492 - DNA, 38 bp, Artificial Sequence
  Synthetic oligonucleotide
gtcccgaccgaacgcaaggaatcgaccttccaccatga

SEQ ID NO: 63493 - DNA, 37 bp, Artificial Sequence
  Synthetic oligonucleotide
gatggtcgcctgggctggtccaccttttttattatga

SEQ ID NO: 63494 - DNA, 38 bp, Artificial Sequence
  Synthetic oligonucleotide
taggaccccgctccacccttagaagtctagcctactga

SEQ ID NO: 63495 - DNA, 38 bp, Artificial Sequence
  Synthetic oligonucleotide
acagagcgatcgcccagcgtccttctacatccacctga

SEQ ID NO: 63496 - DNA, 38 bp, Artificial Sequence
  Synthetic oligonucleotide
gcacgccagtcctcgcctcgactaccgatcgcccctga

SEQ ID NO: 63497 - DNA, 38 bp, Artificial Sequence
  Synthetic oligonucleotide
gtatctcacgcccaccaccattgatagagacactctga

SEQ ID NO: 63498 - DNA, 38 bp, Artificial Sequence
  Synthetic oligonucleotide
tcgcatcacccctgtacgccctgccagaccgcacgtga

SEQ ID NO: 63499 - DNA, 38 bp, Artificial Sequence
  Synthetic oligonucleotide
ttcatctccgatgatgctgcccactccctccgtcgtga

SEQ ID NO: 63500 - DNA, 38 bp, Artificial Sequence
  Synthetic oligonucleotide
gactccacgacctctcgcgcctcaactctgctctgtga

SEQ ID NO: 63501 - DNA, 38 bp, Artificial Sequence
  Synthetic oligonucleotide
tttgcgaaacgcggacggaggggccggaatttttgtga

SEQ ID NO: 63502 - DNA, 38 bp, Artificial Sequence
  Synthetic oligonucleotide
ttcgcacctgtactcggctctattacggatccacttga

SEQ ID NO: 63503 - DNA, 38 bp, Artificial Sequence
  Synthetic oligonucleotide
aaccctgtgaagccatgtcggtacttccgctcccttga

SEQ ID NO: 63504 - DNA, 37 bp, Artificial Sequence
  Synthetic oligonucleotide
actggacgctcccttcgataaccacgcctgactttga

SEQ ID NO: 63505 - DNA, 38 bp, Artificial Sequence
  Synthetic oligonucleotide
ttaggcgggccgacgtcatatattgcaccctcctttga

SEQ ID NO: 63506 - DNA, 38 bp, Artificial Sequence
  Synthetic oligonucleotide
tacccgctctgctatcgtaacccgctcgaaccttttga

SEQ ID NO: 63507 - DNA, 38 bp, Artificial Sequence
  Synthetic oligonucleotide
gacgcctgttggtactactaacacgctacatcttttga

SEQ ID NO: 63508 - DNA, 35 bp, Artificial Sequence
  Synthetic oligonucleotide
gggtgaacggttggggggcaaaaacggggttgata

SEQ ID NO: 63509 - DNA, 36 bp, Artificial Sequence
  Synthetic oligonucleotide
tcagaccgtactggtggcttacattcggattctcta

SEQ ID NO: 63510 - DNA, 36 bp, Artificial Sequence
  Synthetic oligonucleotide
gttgtggcatctgccttgtccacccatgttcttgta

SEQ ID NO: 63511 - DNA, 36 bp, Artificial Sequence
  Synthetic oligonucleotide
tctcgactacgctgacttttccgtgtcattccctta

SEQ ID NO: 63512 - DNA, 36 bp, Artificial Sequence
  Synthetic oligonucleotide
accgataggttctgcgccacacgctccgttacttta

SEQ ID NO: 63513 - DNA, 35 bp, Artificial Sequence
  Synthetic oligonucleotide
tcatcgcggtttgttccttacaccggcttaaacac

SEQ ID NO: 63514 - DNA, 35 bp, Artificial Sequence
  Synthetic oligonucleotide
acccgaatcgctgcttttgaactgcgggatcccac

SEQ ID NO: 63515 - DNA, 35 bp, Artificial Sequence
  Synthetic oligonucleotide
gccgtacattgctatctctacaacccggtggccac

SEQ ID NO: 63516 - DNA, 35 bp, Artificial Sequence
  Synthetic oligonucleotide
tcctcgcaacgtatgaccgcactgtaacaatccac

SEQ ID NO: 63517 - DNA, 35 bp, Artificial Sequence
  Synthetic oligonucleotide
tgacattacacccgtttcccgactgcggactgcac

SEQ ID NO: 63518 - DNA, 35 bp, Artificial Sequence
  Synthetic oligonucleotide
actcagatcagtcggccattccctccggtcactac

SEQ ID NO: 63519 - DNA, 35 bp, Artificial Sequence
  Synthetic oligonucleotide
ttgtcagcccatcaatttcataacgtcactcgacc

SEQ ID NO: 63520 - DNA, 35 bp, Artificial Sequence
  Synthetic oligonucleotide
gagtgcatccctgtccccttcccaggtacttcccc

SEQ ID NO: 63521 - DNA, 35 bp, Artificial Sequence
  Synthetic oligonucleotide
tccacatgacgcgggacgataaaccgttgcctgcc

SEQ ID NO: 63522 - DNA, 35 bp, Artificial Sequence
  Synthetic oligonucleotide
actgcggcactaacttcctgtctctgtgcggttcc

SEQ ID NO: 63523 - DNA, 37 bp, Artificial Sequence
  Synthetic oligonucleotide
tacgcatatgaaagggagggtgcaggggatgggtagc

SEQ ID NO: 63524 - DNA, 35 bp, Artificial Sequence
  Synthetic oligonucleotide
tgataggactaatgctagcccactcggttacccgc

SEQ ID NO: 63525 - DNA, 35 bp, Artificial Sequence
  Synthetic oligonucleotide
acaccccgcgccttcccgcacctcagttattttgc

SEQ ID NO: 63526 - DNA, 35 bp, Artificial Sequence
  Synthetic oligonucleotide
ccactgcctccctcggtcctttatgcgataatatc

SEQ ID NO: 63527 - DNA, 35 bp, Artificial Sequence
  Synthetic oligonucleotide
ggtgacgtagctttctgtccggccctgccctggtc

SEQ ID NO: 63528 - DNA, 35 bp, Artificial Sequence
  Synthetic oligonucleotide
ccacacccactcacggtagtacgtgatttttcttc

SEQ ID NO: 63529 - DNA, 35 bp, Artificial Sequence
  Synthetic oligonucleotide
gtcgtgggccaactggtaacacgaccacctttttc

SEQ ID NO: 63530 - DNA, 35 bp, Artificial Sequence
  Synthetic oligonucleotide
tccgcactaccattccagtcttgttaacccgcccg

SEQ ID NO: 63531 - DNA, 35 bp, Artificial Sequence
  Synthetic oligonucleotide
aaagggggggaatccgaacaaggatggttatgagg

SEQ ID NO: 63532 - DNA, 35 bp, Artificial Sequence
  Synthetic oligonucleotide
tgagttccacccccgtcgcgctatgaaacgatttg

SEQ ID NO: 63533 - DNA, 35 bp, Artificial Sequence
  Synthetic oligonucleotide
taccgtggtggccggcattcgtaaacgctctccat

SEQ ID NO: 63534 - DNA, 35 bp, Artificial Sequence
  Synthetic oligonucleotide
ggacctctcgagtttcctgcctgactaatatcact

SEQ ID NO: 63535 - DNA, 35 bp, Artificial Sequence
  Synthetic oligonucleotide
gtggcttacctatgcgctgggctctgcctcaccct

SEQ ID NO: 63536 - DNA, 35 bp, Artificial Sequence
  Synthetic oligonucleotide
gaacccaggctaagtagctcaactgacacatgcct

SEQ ID NO: 63537 - DNA, 35 bp, Artificial Sequence
  Synthetic oligonucleotide
ttacgagcgcctcaataactatttctctggttcct

SEQ ID NO: 63538 - DNA, 35 bp, Artificial Sequence
  Synthetic oligonucleotide
acgtacctggaaattgccgcccttcgcgtacctct

SEQ ID NO: 63539 - DNA, 35 bp, Artificial Sequence
  Synthetic oligonucleotide
acagccgggatgggcaaccaggaggtatgttgggt

SEQ ID NO: 63540 - DNA, 35 bp, Artificial Sequence
  Synthetic oligonucleotide
gtccagtgaggcgcctggtgctcagtttatcctgt

SEQ ID NO: 63541 - DNA, 35 bp, Artificial Sequence
  Synthetic oligonucleotide
gttgggggggcaactctggggaactcgaagggtgt

SEQ ID NO: 63542 - DNA, 35 bp, Artificial Sequence
  Synthetic oligonucleotide
cattaactgccgccgttgccgttccatctcgaatt

SEQ ID NO: 63543 - DNA, 36 bp, Artificial Sequence
  Synthetic oligonucleotide
gcacgaacttggtaattcagcatactcgcactggtt

SEQ ID NO: 63544 - DNA, 36 bp, Artificial Sequence
  Synthetic oligonucleotide
tcaccgaccgtctccttgacgctccctagctgtaaa

SEQ ID NO: 63545 - DNA, 36 bp, Artificial Sequence
  Synthetic oligonucleotide
gtcgcaaaccgctgccttgacttccattcggaccaa

SEQ ID NO: 63546 - DNA, 36 bp, Artificial Sequence
  Synthetic oligonucleotide
accccatcgtattcccgtgccgaacctgcgagccaa

SEQ ID NO: 63547 - DNA, 36 bp, Artificial Sequence
  Synthetic oligonucleotide
gccaacttatctgcgtttttctatcctgctggctaa

SEQ ID NO: 63548 - DNA, 35 bp, Artificial Sequence
  Synthetic oligonucleotide
gatgcgtacacctttcattgcgctcgacaaagtaa

SEQ ID NO: 63549 - DNA, 36 bp, Artificial Sequence
  Synthetic oligonucleotide
tgagatgccgtggcaaaggggatcgatggctagtaa

SEQ ID NO: 63550 - DNA, 36 bp, Artificial Sequence
  Synthetic oligonucleotide
gacatcggccataggggaaaacacggggaaacgtaa

SEQ ID NO: 63551 - DNA, 35 bp, Artificial Sequence
  Synthetic oligonucleotide
gtactacctccatagtgaattttacgcatgttaca

SEQ ID NO: 63552 - DNA, 36 bp, Artificial Sequence
  Synthetic oligonucleotide
tatctacgcgacgcatgttgccactccttctaccca

SEQ ID NO: 63553 - DNA, 35 bp, Artificial Sequence
  Synthetic oligonucleotide
gtgatgctcactttaacgccagactttttacccca

SEQ ID NO: 63554 - DNA, 36 bp, Artificial Sequence
  Synthetic oligonucleotide
gccactacacatcagatatttctgcccacttcagca

SEQ ID NO: 63555 - DNA, 36 bp, Artificial Sequence
  Synthetic oligonucleotide
ttccccctgtttgtcgcgctcgttttccttggcgca

SEQ ID NO: 63556 - DNA, 35 bp, Artificial Sequence
  Synthetic oligonucleotide
gaggaacgaacggaggtatagtgctacgaagggca

SEQ ID NO: 63557 - DNA, 35 bp, Artificial Sequence
  Synthetic oligonucleotide
gctggagccccgcgcaacacccccgtcctttggca

SEQ ID NO: 63558 - DNA, 36 bp, Artificial Sequence
  Synthetic oligonucleotide
tggaacgtgccgctgcacatcctcgacgtgacatca

SEQ ID NO: 63559 - DNA, 36 bp, Artificial Sequence
  Synthetic oligonucleotide
acagacacagttggttttgccatattattatcctca

SEQ ID NO: 63560 - DNA, 35 bp, Artificial Sequence
  Synthetic oligonucleotide
tagagcatagggaacgggggggctaggtgctttca

SEQ ID NO: 63561 - DNA, 37 bp, Artificial Sequence
  Synthetic oligonucleotide
tcacctgatgtagggggggatggaacctgggtgaaga

SEQ ID NO: 63562 - DNA, 37 bp, Artificial Sequence
  Synthetic oligonucleotide
tactcccggccgaagtcgtatttcttctctacgcaga

SEQ ID NO: 63563 - DNA, 37 bp, Artificial Sequence
  Synthetic oligonucleotide
gaaacagaagggcggttaggtgctataggcgctgaga

SEQ ID NO: 63564 - DNA, 36 bp, Artificial Sequence
  Synthetic oligonucleotide
ttgactcaggaacatgcatttcgatcactaccacga

SEQ ID NO: 63565 - DNA, 37 bp, Artificial Sequence
  Synthetic oligonucleotide
gtcaccaacctgatctttgctctcctcagtaagacga

SEQ ID NO: 63566 - DNA, 37 bp, Artificial Sequence
  Synthetic oligonucleotide
tgaagcccttctgctcacgcgtcactcccccttacga

SEQ ID NO: 63567 - DNA, 35 bp, Artificial Sequence
  Synthetic oligonucleotide
gacgcaggacgagaggggattgatattggcaccga

SEQ ID NO: 63568 - DNA, 37 bp, Artificial Sequence
  Synthetic oligonucleotide
gttcgcacagtccccatctcaaccaagtgaccgccga

SEQ ID NO: 63569 - DNA, 37 bp, Artificial Sequence
  Synthetic oligonucleotide
agcgacccctcgccacacagtaaacacacggatccga

SEQ ID NO: 63570 - DNA, 37 bp, Artificial Sequence
  Synthetic oligonucleotide
ggatgccccgagcgcgtgggtggaaagggatggtcga

SEQ ID NO: 63571 - DNA, 37 bp, Artificial Sequence
  Synthetic oligonucleotide
ttgccaccctgcttgttaaatagttttccttgttcga

SEQ ID NO: 63572 - DNA, 37 bp, Artificial Sequence
  Synthetic oligonucleotide
tcccattgggatgtctctctctccggtcctacacgga

SEQ ID NO: 63573 - DNA, 37 bp, Artificial Sequence
  Synthetic oligonucleotide
accaccccccacatcaggttcctgatgcgcctctgga

SEQ ID NO: 63574 - DNA, 36 bp, Artificial Sequence
  Synthetic oligonucleotide
agagtggagtgagacagtgaaagtgcgagatgtgga

SEQ ID NO: 63575 - DNA, 37 bp, Artificial Sequence
  Synthetic oligonucleotide
gctgccgacccaaccccggccactctgaatccttgga

SEQ ID NO: 63576 - DNA, 38 bp, Artificial Sequence
  Synthetic oligonucleotide
gacatgaccagacgattatatgtgctggtttggaatga

SEQ ID NO: 63577 - DNA, 38 bp, Artificial Sequence
  Synthetic oligonucleotide
acttacgcctggtgtaccacacgacaaaccacgcatga

SEQ ID NO: 63578 - DNA, 35 bp, Artificial Sequence
  Synthetic oligonucleotide
tcaatctcgcctccccgtatatcccgcactgatga

SEQ ID NO: 63579 - DNA, 38 bp, Artificial Sequence
  Synthetic oligonucleotide
ggacaccagacacacgctcgaacaccaaagtcatatga

SEQ ID NO: 63580 - DNA, 38 bp, Artificial Sequence
  Synthetic oligonucleotide
acaacccaaggtacgcgaatcgtcacccacttctatga

SEQ ID NO: 63581 - DNA, 38 bp, Artificial Sequence
  Synthetic oligonucleotide
gattagcccctcattgttcttcgaattgaccctactga

SEQ ID NO: 63582 - DNA, 38 bp, Artificial Sequence
  Synthetic oligonucleotide
atctagttgccgttccctttgttgcgatttcaccctga

SEQ ID NO: 63583 - DNA, 38 bp, Artificial Sequence
  Synthetic oligonucleotide
gttgacagtcttttgtattcaccgcctgggccccctga

SEQ ID NO: 63584 - DNA, 37 bp, Artificial Sequence
  Synthetic oligonucleotide
acgtgacactccttagattccggtctctccatcctga

SEQ ID NO: 63585 - DNA, 35 bp, Artificial Sequence
  Synthetic oligonucleotide
gacgctgtgcccctatttgaaatcttgccctctga

SEQ ID NO: 63586 - DNA, 36 bp, Artificial Sequence
  Synthetic oligonucleotide
tcttgcaccatgtacgtcacgccccacgttctctga

SEQ ID NO: 63587 - DNA, 37 bp, Artificial Sequence
  Synthetic oligonucleotide
tccctgcccggtttggcaccttcctatgtcctcgtga

SEQ ID NO: 63588 - DNA, 36 bp, Artificial Sequence
  Synthetic oligonucleotide
gcgaatgatccagtaggatggaggcgaatgaggtga

SEQ ID NO: 63589 - DNA, 38 bp, Artificial Sequence
  Synthetic oligonucleotide
tgttgggtgggggagtggaaaggaatgagagagggtga

SEQ ID NO: 63590 - DNA, 37 bp, Artificial Sequence
  Synthetic oligonucleotide
tcgattgggtggtggggctggaaacgtgattgggtga

SEQ ID NO: 63591 - DNA, 38 bp, Artificial Sequence
  Synthetic oligonucleotide
gatctgcgcacgcgctgttcctgcatcttattccttga

SEQ ID NO: 63592 - DNA, 37 bp, Artificial Sequence
  Synthetic oligonucleotide
gacaggaacgccaactcgttatccactcttttcttga

SEQ ID NO: 63593 - DNA, 38 bp, Artificial Sequence
  Synthetic oligonucleotide
gtggctgagacgcctccatacgcctgttctttctttga

SEQ ID NO: 63594 - DNA, 36 bp, Artificial Sequence
  Synthetic oligonucleotide
gactgacacctactttttgacgtacttgaccgaata

SEQ ID NO: 63595 - DNA, 36 bp, Artificial Sequence
  Synthetic oligonucleotide
acttggtaggtgggtagggggggacgttaatggata

SEQ ID NO: 63596 - DNA, 35 bp, Artificial Sequence
  Synthetic oligonucleotide
ggggccctcagacatcccccccagtgcaccaccta

SEQ ID NO: 63597 - DNA, 36 bp, Artificial Sequence
  Synthetic oligonucleotide
gttccccaccctgtgtaagggcgctattatggccta

SEQ ID NO: 63598 - DNA, 36 bp, Artificial Sequence
  Synthetic oligonucleotide
gtagtaggcgggtaaaaggtgcgtgggcgattagta

SEQ ID NO: 63599 - DNA, 37 bp, Artificial Sequence
  Synthetic oligonucleotide
accttggacacagccgttttggcgccattctttatta

SEQ ID NO: 63600 - DNA, 35 bp, Artificial Sequence
  Synthetic oligonucleotide
aactgattccgcccgtattggttctctgggattta

SEQ ID NO: 63601 - DNA, 35 bp, Artificial Sequence
  Synthetic oligonucleotide
gcccacaatgtccttcttccggagaatgtccaaac

SEQ ID NO: 63602 - DNA, 35 bp, Artificial Sequence
  Synthetic oligonucleotide
tgagctctgccttactcgaacgctaccttatcacc

SEQ ID NO: 63603 - DNA, 34 bp, Artificial Sequence
  Synthetic oligonucleotide
gccctcttagttctaagtacttgccccccgcccc

SEQ ID NO: 63604 - DNA, 35 bp, Artificial Sequence
  Synthetic oligonucleotide
tcgatcgtctgcggacgtgtcagtcccatctcccc

SEQ ID NO: 63605 - DNA, 35 bp, Artificial Sequence
  Synthetic oligonucleotide
gttggtaccgtgctggatggtaccgttctcatccc

SEQ ID NO: 63606 - DNA, 35 bp, Artificial Sequence
  Synthetic oligonucleotide
aaggacaaacataggtctcgaagcaactggtcgcc

SEQ ID NO: 63607 - DNA, 35 bp, Artificial Sequence
  Synthetic oligonucleotide
ataccgagcacatagctgcttagttccgtgcctcc

SEQ ID NO: 63608 - DNA, 35 bp, Artificial Sequence
  Synthetic oligonucleotide
ttcccgaccccgactcaccctgtcacttgctgtcc

SEQ ID NO: 63609 - DNA, 35 bp, Artificial Sequence
  Synthetic oligonucleotide
gagccaaattcccggtttacgtatcattgttttcc

SEQ ID NO: 63610 - DNA, 35 bp, Artificial Sequence
  Synthetic oligonucleotide
agaccaccatcagacgggtccatcagacccttcgc

SEQ ID NO: 63611 - DNA, 35 bp, Artificial Sequence
  Synthetic oligonucleotide
tgtcattgtgggccatcacaccgcctatgccatgc

SEQ ID NO: 63612 - DNA, 35 bp, Artificial Sequence
  Synthetic oligonucleotide
agagaccacctctatgacatttataggccacgtgc

SEQ ID NO: 63613 - DNA, 35 bp, Artificial Sequence
  Synthetic oligonucleotide
tctaacgaaacgaccccatgttcacacatgcactc

SEQ ID NO: 63614 - DNA, 32 bp, Artificial Sequence
  Synthetic oligonucleotide
tcgcatgttcttacgctggttccccatcactc

SEQ ID NO: 63615 - DNA, 35 bp, Artificial Sequence
  Synthetic oligonucleotide
acctgagccggaggttgtatcacattgcttcactc

SEQ ID NO: 63616 - DNA, 35 bp, Artificial Sequence
  Synthetic oligonucleotide
tcaccctcaaacacctctggatcatggctgacctc

SEQ ID NO: 63617 - DNA, 35 bp, Artificial Sequence
  Synthetic oligonucleotide
gtaagacccagccgacaccggaaatgaaacctctc

SEQ ID NO: 63618 - DNA, 35 bp, Artificial Sequence
  Synthetic oligonucleotide
tacttctcctaacgggctcctgcactcctgtggtc

SEQ ID NO: 63619 - DNA, 35 bp, Artificial Sequence
  Synthetic oligonucleotide
tcccacctcaccgcccatgccctccctgtctagag

SEQ ID NO: 63620 - DNA, 35 bp, Artificial Sequence
  Synthetic oligonucleotide
gtcaacgcgggaggcgaggacggaacatatactag

SEQ ID NO: 63621 - DNA, 35 bp, Artificial Sequence
  Synthetic oligonucleotide
aaccctcaaccggctcaatccatgctaccacaacg

SEQ ID NO: 63622 - DNA, 35 bp, Artificial Sequence
  Synthetic oligonucleotide
tactggatccactctccactgactagccccatccg

SEQ ID NO: 63623 - DNA, 35 bp, Artificial Sequence
  Synthetic oligonucleotide
actcctgtcccattccgacttagctcagcattgcg

SEQ ID NO: 63624 - DNA, 35 bp, Artificial Sequence
  Synthetic oligonucleotide
taggagaggccgagagggatttgggtgcgatcggg

SEQ ID NO: 63625 - DNA, 35 bp, Artificial Sequence
  Synthetic oligonucleotide
tgtcaagccgagcggtttgaaatttaaatggttgg

SEQ ID NO: 63626 - DNA, 35 bp, Artificial Sequence
  Synthetic oligonucleotide
aatgcatgtccccgcactattctcgcacagtcctg

SEQ ID NO: 63627 - DNA, 35 bp, Artificial Sequence
  Synthetic oligonucleotide
tgaagctgtgcctagcctgctgtcctgttcctttg

SEQ ID NO: 63628 - DNA, 35 bp, Artificial Sequence
  Synthetic oligonucleotide
atacacgcctttttctcgagctcgggccttttgct

SEQ ID NO: 63629 - DNA, 35 bp, Artificial Sequence
  Synthetic oligonucleotide
gcacccggggggtgaccggctacattgtacattct

SEQ ID NO: 63630 - DNA, 35 bp, Artificial Sequence
  Synthetic oligonucleotide
agtgatcctctgccccacaatgagaccgaaccagt

SEQ ID NO: 63631 - DNA, 35 bp, Artificial Sequence
  Synthetic oligonucleotide
taccctaatccacacccccatgagacctgcacggt

SEQ ID NO: 63632 - DNA, 35 bp, Artificial Sequence
  Synthetic oligonucleotide
agccaccgcaagcagggatcctggacctctactgt

SEQ ID NO: 63633 - DNA, 35 bp, Artificial Sequence
  Synthetic oligonucleotide
gcattaccgcgaggagtcgtaatttatccccttgt

SEQ ID NO: 63634 - DNA, 35 bp, Artificial Sequence
  Synthetic oligonucleotide
tatcctccacggtcattgaccctagttaaacaatt

SEQ ID NO: 63635 - DNA, 35 bp, Artificial Sequence
  Synthetic oligonucleotide
ttatcccccaacattcgcccagatcccgtcccatt

SEQ ID NO: 63636 - DNA, 35 bp, Artificial Sequence
  Synthetic oligonucleotide
ccacacatcaacactgccccgggtactgaatcatt

SEQ ID NO: 63637 - DNA, 35 bp, Artificial Sequence
  Synthetic oligonucleotide
actacatagctgtccgtactccacttccttagctt

SEQ ID NO: 63638 - DNA, 34 bp, Artificial Sequence
  Synthetic oligonucleotide
gagcatcagttcaaccctgctatctcgctcgctt

SEQ ID NO: 63639 - DNA, 35 bp, Artificial Sequence
  Synthetic oligonucleotide
gaggtgacggaaggaggagctgggcgaaaaaaaaa

SEQ ID NO: 63640 - DNA, 34 bp, Artificial Sequence
  Synthetic oligonucleotide
accaaaacacactggccccatacgcagacaacaa

SEQ ID NO: 63641 - DNA, 36 bp, Artificial Sequence
  Synthetic oligonucleotide
tccatccaccgggcctgacctacaaacacagaacaa

SEQ ID NO: 63642 - DNA, 36 bp, Artificial Sequence
  Synthetic oligonucleotide
tcacaatgcagcccccacatctcccaatgcgatcaa

SEQ ID NO: 63643 - DNA, 35 bp, Artificial Sequence
  Synthetic oligonucleotide
taaagccccgtcctctgtccgttgttagtctgtaa

SEQ ID NO: 63644 - DNA, 35 bp, Artificial Sequence
  Synthetic oligonucleotide
tacgtactcgctacaggacgtatcccaattcttaa

SEQ ID NO: 63645 - DNA, 36 bp, Artificial Sequence
  Synthetic oligonucleotide
tcaccctaggccggtttcgctgtttaacatatcaca

SEQ ID NO: 63646 - DNA, 36 bp, Artificial Sequence
  Synthetic oligonucleotide
gaccattgacagcagttgccatccctatcgggccca

SEQ ID NO: 63647 - DNA, 36 bp, Artificial Sequence
  Synthetic oligonucleotide
tcctgcggtcaacgggctaacgcgcttattattcca

SEQ ID NO: 63648 - DNA, 36 bp, Artificial Sequence
  Synthetic oligonucleotide
gatcatgccgaccgctccatctgctcgtcgtttcca

SEQ ID NO: 63649 - DNA, 36 bp, Artificial Sequence
  Synthetic oligonucleotide
atgccgtcctgcccttcgactagatgcacaatttca

SEQ ID NO: 63650 - DNA, 36 bp, Artificial Sequence
  Synthetic oligonucleotide
gacctctagccggtctccctgtccactttcccaaga

SEQ ID NO: 63651 - DNA, 35 bp, Artificial Sequence
  Synthetic oligonucleotide
gaccgggtgcgggggggtttgggactatcataaga

SEQ ID NO: 63652 - DNA, 37 bp, Artificial Sequence
  Synthetic oligonucleotide
gactccgctgagttggttctatcacgtccttaaacga

SEQ ID NO: 63653 - DNA, 37 bp, Artificial Sequence
  Synthetic oligonucleotide
gagccaccccgcgcctcacagactcctccccggacga

SEQ ID NO: 63654 - DNA, 37 bp, Artificial Sequence
  Synthetic oligonucleotide
gcgtacccacgtctccagaccttccaccgttgttcga

SEQ ID NO: 63655 - DNA, 36 bp, Artificial Sequence
  Synthetic oligonucleotide
gttggacctgaccagtttatacaccgtgtctttcga

SEQ ID NO: 63656 - DNA, 37 bp, Artificial Sequence
  Synthetic oligonucleotide
gcctcgcactcaaccgagtaccaacccctcaacagga

SEQ ID NO: 63657 - DNA, 36 bp, Artificial Sequence
  Synthetic oligonucleotide
gcttaccaaccccacttgaccagcccactgttagga

SEQ ID NO: 63658 - DNA, 37 bp, Artificial Sequence
  Synthetic oligonucleotide
gggacgaaggaattggggggtaggtaagggtcacgga

SEQ ID NO: 63659 - DNA, 37 bp, Artificial Sequence
  Synthetic oligonucleotide
atggggtggaaagaaggtaggtaactaacgagccgga

SEQ ID NO: 63660 - DNA, 37 bp, Artificial Sequence
  Synthetic oligonucleotide
aaggaggtcgggcgaaaacaatggggtttggggggga

SEQ ID NO: 63661 - DNA, 37 bp, Artificial Sequence
  Synthetic oligonucleotide
gtgcacctatccctccttagtactcccttgcctggga

SEQ ID NO: 63662 - DNA, 38 bp, Artificial Sequence
  Synthetic oligonucleotide
agtgcaccctagcattgtgcccttcttctacccgatga

SEQ ID NO: 63663 - DNA, 38 bp, Artificial Sequence
  Synthetic oligonucleotide
acccgggaggtaaggggtggcgtgaaaaagggggatga

SEQ ID NO: 63664 - DNA, 38 bp, Artificial Sequence
  Synthetic oligonucleotide
agccagacgctatggcagcaccgaccaatctccactga

SEQ ID NO: 63665 - DNA, 35 bp, Artificial Sequence
  Synthetic oligonucleotide
tgacctacaatccgcctggcaccgtacctgactga

SEQ ID NO: 63666 - DNA, 38 bp, Artificial Sequence
  Synthetic oligonucleotide
gagcactcatgttcctccccctgtacttctgcccctga

SEQ ID NO: 63667 - DNA, 37 bp, Artificial Sequence
  Synthetic oligonucleotide
accatcccaaccctcaagagtgctacttaatgcctga

SEQ ID NO: 63668 - DNA, 38 bp, Artificial Sequence
  Synthetic oligonucleotide
gcccaaacgctcgcatccacctctgatgtacctcctga

SEQ ID NO: 63669 - DNA, 38 bp, Artificial Sequence
  Synthetic oligonucleotide
aaccccgcgtatgctttctgccacattcccttgtctga

SEQ ID NO: 63670 - DNA, 37 bp, Artificial Sequence
  Synthetic oligonucleotide
ttgtcctatccaccttccccgtcccttccaggggtga

SEQ ID NO: 63671 - DNA, 38 bp, Artificial Sequence
  Synthetic oligonucleotide
atagtgctccgacacgctccacttcttcctacagttga

SEQ ID NO: 63672 - DNA, 38 bp, Artificial Sequence
  Synthetic oligonucleotide
accacggggacgtacgttatctacgagggactggttga

SEQ ID NO: 63673 - DNA, 37 bp, Artificial Sequence
  Synthetic oligonucleotide
tgtgcaatccctgctgctcaatgcaatgttctgttga

SEQ ID NO: 63674 - DNA, 38 bp, Artificial Sequence
  Synthetic oligonucleotide
tgaaacgccagtcgggatactcgtgccctctgatttga

SEQ ID NO: 63675 - DNA, 38 bp, Artificial Sequence
  Synthetic oligonucleotide
gccaagtcacccctgaggaaattgacccatccttttga

SEQ ID NO: 63676 - DNA, 35 bp, Artificial Sequence
  Synthetic oligonucleotide
atcaccaactctgtctaggtatcacgtagcttgta

SEQ ID NO: 63677 - DNA, 36 bp, Artificial Sequence
  Synthetic oligonucleotide
tggaactccccaatgtagaccattcgcctgtaatta

SEQ ID NO: 63678 - DNA, 30 bp, Artificial Sequence
  Synthetic oligonucleotide
acactcccgcttggtttggtcccctgttta

SEQ ID NO: 63679 - DNA, 35 bp, Artificial Sequence
  Synthetic oligonucleotide
tgacgggagcaagagttgcggcgtgggctttttta

SEQ ID NO: 63680 - DNA, 35 bp, Artificial Sequence
  Synthetic oligonucleotide
tatgttccccataccagcggctacccttttcacac

SEQ ID NO: 63681 - DNA, 35 bp, Artificial Sequence
  Synthetic oligonucleotide
ttcgcgagcattactatgcggcgttgcctcttcac

SEQ ID NO: 63682 - DNA, 35 bp, Artificial Sequence
  Synthetic oligonucleotide
agggcggccgcaggacgtccatcgcccctggttac

SEQ ID NO: 63683 - DNA, 35 bp, Artificial Sequence
  Synthetic oligonucleotide
tcacctgaagcaatttacttagtgtctgccctacc

SEQ ID NO: 63684 - DNA, 35 bp, Artificial Sequence
  Synthetic oligonucleotide
gccacacacaggcgtagctcgcttctggctctacc

SEQ ID NO: 63685 - DNA, 35 bp, Artificial Sequence
  Synthetic oligonucleotide
atccatgaaagggacaaatgccttccagcccaccc

SEQ ID NO: 63686 - DNA, 35 bp, Artificial Sequence
  Synthetic oligonucleotide
ggccttgcccttctgtctgcgttgaccctcatgcc

SEQ ID NO: 63687 - DNA, 35 bp, Artificial Sequence
  Synthetic oligonucleotide
tgtcaacgtacgctagttgctcgtcccgccttagc

SEQ ID NO: 63688 - DNA, 35 bp, Artificial Sequence
  Synthetic oligonucleotide
gtgccgcactgagtcacgcaatctgacccccgcgc

SEQ ID NO: 63689 - DNA, 35 bp, Artificial Sequence
  Synthetic oligonucleotide
taaccctgctgtatcgacaacaggctaatgttgtc

SEQ ID NO: 63690 - DNA, 35 bp, Artificial Sequence
  Synthetic oligonucleotide
aatacagggtgccaggtcgatccctttgttacttc

SEQ ID NO: 63691 - DNA, 35 bp, Artificial Sequence
  Synthetic oligonucleotide
gggtgtgcccagtggctccgcatacaccttcgttc

SEQ ID NO: 63692 - DNA, 35 bp, Artificial Sequence
  Synthetic oligonucleotide
tcccggttacacccctgctccctgttcgttcccag

SEQ ID NO: 63693 - DNA, 35 bp, Artificial Sequence
  Synthetic oligonucleotide
aagacccaccacaatgcttaagcccgcttatacgg

SEQ ID NO: 63694 - DNA, 35 bp, Artificial Sequence
  Synthetic oligonucleotide
tgcaagtccccaagcccttcatacgcaatcaactg

SEQ ID NO: 63695 - DNA, 35 bp, Artificial Sequence
  Synthetic oligonucleotide
tttcccgcgcccacctgctgtccaactccccgttg

SEQ ID NO: 63696 - DNA, 35 bp, Artificial Sequence
  Synthetic oligonucleotide
gcctgccaccggcgggacccttaatctcaatacat

SEQ ID NO: 63697 - DNA, 35 bp, Artificial Sequence
  Synthetic oligonucleotide
ttgacatgttacctctccgccatccatcgtgtgat

SEQ ID NO: 63698 - DNA, 35 bp, Artificial Sequence
  Synthetic oligonucleotide
gtgggaggggagtcatctctagggggggagcacgt

SEQ ID NO: 63699 - DNA, 35 bp, Artificial Sequence
  Synthetic oligonucleotide
gcgcctcctccccacacggtacttcgattgaccgt

SEQ ID NO: 63700 - DNA, 35 bp, Artificial Sequence
  Synthetic oligonucleotide
accccccctcgtgggcctccaaccttccagcccgt

SEQ ID NO: 63701 - DNA, 35 bp, Artificial Sequence
  Synthetic oligonucleotide
tgagccaaggtgtggaacaatgtagttggattggt

SEQ ID NO: 63702 - DNA, 35 bp, Artificial Sequence
  Synthetic oligonucleotide
ggtccctccgccgcctttaaaatgaacgcacaatt

SEQ ID NO: 63703 - DNA, 35 bp, Artificial Sequence
  Synthetic oligonucleotide
tcgcccgtgcgtcctcctggttcctgtcttacatt

SEQ ID NO: 63704 - DNA, 35 bp, Artificial Sequence
  Synthetic oligonucleotide
gcacccccccagttcggactgcggttcgcattatt

SEQ ID NO: 63705 - DNA, 35 bp, Artificial Sequence
  Synthetic oligonucleotide
ttatggcgccctcacactcgggaaatgttggcctt

SEQ ID NO: 63706 - DNA, 35 bp, Artificial Sequence
  Synthetic oligonucleotide
gcacggggagtggtggctgtgggtatatctacgtt

SEQ ID NO: 63707 - DNA, 35 bp, Artificial Sequence
  Synthetic oligonucleotide
tgtttagccgcactctggtcatctaaggcttattt

SEQ ID NO: 63708 - DNA, 36 bp, Artificial Sequence
  Synthetic oligonucleotide
ttgccactgcctccacttttcgctgaacccgcagaa

SEQ ID NO: 63709 - DNA, 36 bp, Artificial Sequence
  Synthetic oligonucleotide
atacgccgcagtacgcctcgactgcccatgaattaa

SEQ ID NO: 63710 - DNA, 36 bp, Artificial Sequence
  Synthetic oligonucleotide
gcaccacataagcacctgcatcgtgtctcacccaca

SEQ ID NO: 63711 - DNA, 36 bp, Artificial Sequence
  Synthetic oligonucleotide
cacgcccgcgcactgagatctctactgacaagcaca

SEQ ID NO: 63712 - DNA, 36 bp, Artificial Sequence
  Synthetic oligonucleotide
ggatctcgccccagtcctctgcacgatacctgcaca

SEQ ID NO: 63713 - DNA, 36 bp, Artificial Sequence
  Synthetic oligonucleotide
gaatctgctccgtacttgctgctgacctacgtacca

SEQ ID NO: 63714 - DNA, 36 bp, Artificial Sequence
  Synthetic oligonucleotide
acgaaccacatagaatgtttgagtcttacccatcca

SEQ ID NO: 63715 - DNA, 35 bp, Artificial Sequence
  Synthetic oligonucleotide
tagtccacgtctatcgacaccccctgtatctcgca

SEQ ID NO: 63716 - DNA, 35 bp, Artificial Sequence
  Synthetic oligonucleotide
gcgtggccacctcgtcgcgtatctctctacatgca

SEQ ID NO: 63717 - DNA, 36 bp, Artificial Sequence
  Synthetic oligonucleotide
accagtccattggtccggcggtcccgggttccatca

SEQ ID NO: 63718 - DNA, 36 bp, Artificial Sequence
  Synthetic oligonucleotide
atggggcatcagtccagcccgtccgtagcccactca

SEQ ID NO: 63719 - DNA, 36 bp, Artificial Sequence
  Synthetic oligonucleotide
gtagactccccagttcactgatacgtacgcctctca

SEQ ID NO: 63720 - DNA, 35 bp, Artificial Sequence
  Synthetic oligonucleotide
cctatggtccgtatcgcctctcttttctgttttca

SEQ ID NO: 63721 - DNA, 37 bp, Artificial Sequence
  Synthetic oligonucleotide
gaaggggagcaaggtgaggcgtgtggtatttcaaaga

SEQ ID NO: 63722 - DNA, 37 bp, Artificial Sequence
  Synthetic oligonucleotide
aaccagggcggcgggggggtctcaggtatgctaaaga

SEQ ID NO: 63723 - DNA, 37 bp, Artificial Sequence
  Synthetic oligonucleotide
gccatagccctgaccccgtctctcctacagattgaga

SEQ ID NO: 63724 - DNA, 36 bp, Artificial Sequence
  Synthetic oligonucleotide
tcccgctcctctatcccttacagtcgatttgctaga

SEQ ID NO: 63725 - DNA, 37 bp, Artificial Sequence
  Synthetic oligonucleotide
aacacgcctcctctccggcttatagactttttttaga

SEQ ID NO: 63726 - DNA, 36 bp, Artificial Sequence
  Synthetic oligonucleotide
tgccctccctgaatactctaaaacttcgtgtaacga

SEQ ID NO: 63727 - DNA, 37 bp, Artificial Sequence
  Synthetic oligonucleotide
gtgccccccttgtctttgtagacactactatctacga

SEQ ID NO: 63728 - DNA, 37 bp, Artificial Sequence
  Synthetic oligonucleotide
acatgtccatggctctgtttgcgtgacctcgccccga

SEQ ID NO: 63729 - DNA, 37 bp, Artificial Sequence
  Synthetic oligonucleotide
gcccacctcctgaactgcctcagatctctgccgccga

SEQ ID NO: 63730 - DNA, 37 bp, Artificial Sequence
  Synthetic oligonucleotide
gaggacgaggaatggaagcgggaggaagccgtgccga

SEQ ID NO: 63731 - DNA, 37 bp, Artificial Sequence
  Synthetic oligonucleotide
atgccagggccgactgctcaattgggtctctctccga

SEQ ID NO: 63732 - DNA, 37 bp, Artificial Sequence
  Synthetic oligonucleotide
actcacccgtagacctttacctcatacgtcgaatcga

SEQ ID NO: 63733 - DNA, 37 bp, Artificial Sequence
  Synthetic oligonucleotide
tcccagcctaacgctggaatagcctatactccctcga

SEQ ID NO: 63734 - DNA, 37 bp, Artificial Sequence
  Synthetic oligonucleotide
actcgccttcctgcatacgaacacatcaaaaattcga

SEQ ID NO: 63735 - DNA, 36 bp, Artificial Sequence
  Synthetic oligonucleotide
agcagagaacgcgtaatatccccctgccctcttcga

SEQ ID NO: 63736 - DNA, 37 bp, Artificial Sequence
  Synthetic oligonucleotide
actccgcacctcagctcatttacctaatttgcccgga

SEQ ID NO: 63737 - DNA, 37 bp, Artificial Sequence
  Synthetic oligonucleotide
gcgcggggaggagaaggtgaagcgctagatgcaggga

SEQ ID NO: 63738 - DNA, 37 bp, Artificial Sequence
  Synthetic oligonucleotide
tcctcaccccaatcgcgatggtgcacccgcccgggga

SEQ ID NO: 63739 - DNA, 37 bp, Artificial Sequence
  Synthetic oligonucleotide
tatgcgccggcatgaatgtctagctgcgaatggggga

SEQ ID NO: 63740 - DNA, 36 bp, Artificial Sequence
  Synthetic oligonucleotide
actcagccggccaggccgtagaggagggtgggtgga

SEQ ID NO: 63741 - DNA, 38 bp, Artificial Sequence
  Synthetic oligonucleotide
acacgagcatatgaacgggggacgaaaacagacaatga

SEQ ID NO: 63742 - DNA, 36 bp, Artificial Sequence
  Synthetic oligonucleotide
gacaccacccgctcatcaatggtttctggcacatga

SEQ ID NO: 63743 - DNA, 38 bp, Artificial Sequence
  Synthetic oligonucleotide
gctgcatccatttcttaggctccagtaccttatcatga

SEQ ID NO: 63744 - DNA, 38 bp, Artificial Sequence
  Synthetic oligonucleotide
tttgcctaccactgttcacctgcccgtatctaccctga

SEQ ID NO: 63745 - DNA, 38 bp, Artificial Sequence
  Synthetic oligonucleotide
aacacgaccagacgtgtctctcgcctcggtgtgcctga

SEQ ID NO: 63746 - DNA, 38 bp, Artificial Sequence
  Synthetic oligonucleotide
acaccccagcccttaattacgcctgatcagtttgctga

SEQ ID NO: 63747 - DNA, 37 bp, Artificial Sequence
  Synthetic oligonucleotide
accccaggtcccgtgttatctcctctggtctatctga

SEQ ID NO: 63748 - DNA, 38 bp, Artificial Sequence
  Synthetic oligonucleotide
gctcaccggttccgttccctttccgcagttccctctga

SEQ ID NO: 63749 - DNA, 38 bp, Artificial Sequence
  Synthetic oligonucleotide
tgtatccctccaccacgtcctcgttatttccccagtga

SEQ ID NO: 63750 - DNA, 38 bp, Artificial Sequence
  Synthetic oligonucleotide
tacgaaataggcggagggggggtcaaacaactcagtga

SEQ ID NO: 63751 - DNA, 38 bp, Artificial Sequence
  Synthetic oligonucleotide
gaggatggcaatcaatggtgaagcgggaatcggagtga

SEQ ID NO: 63752 - DNA, 37 bp, Artificial Sequence
  Synthetic oligonucleotide
gtccctctctgctagcctgcgctttaatccttcgtga

SEQ ID NO: 63753 - DNA, 37 bp, Artificial Sequence
  Synthetic oligonucleotide
tagatcgcagggcgggggacgaagtaggccttggtga

SEQ ID NO: 63754 - DNA, 38 bp, Artificial Sequence
  Synthetic oligonucleotide
tgtgaagggaagggtgggcaagcgggaagcaaccttga

SEQ ID NO: 63755 - DNA, 36 bp, Artificial Sequence
  Synthetic oligonucleotide
gttaccgttcgaccgtggcaaatatttagctcttga

SEQ ID NO: 63756 - DNA, 38 bp, Artificial Sequence
  Synthetic oligonucleotide
gctaaggttagcgcgtactttccccgttccgctgttga

SEQ ID NO: 63757 - DNA, 38 bp, Artificial Sequence
  Synthetic oligonucleotide
tatgactcgcactttgtctctgatagtacctcctttga

SEQ ID NO: 63758 - DNA, 38 bp, Artificial Sequence
  Synthetic oligonucleotide
gtgactcaccggaggcccataagcgttcttctttttga

SEQ ID NO: 63759 - DNA, 35 bp, Artificial Sequence
  Synthetic oligonucleotide
tctccagacggcctaatgtctatcacctccacgta

SEQ ID NO: 63760 - DNA, 36 bp, Artificial Sequence
  Synthetic oligonucleotide
tgtaggcccgataaccgtccgcatattacctccgta

SEQ ID NO: 63761 - DNA, 36 bp, Artificial Sequence
  Synthetic oligonucleotide
tagcagagaaacacagggcgggggggatgataggta

SEQ ID NO: 63762 - DNA, 35 bp, Artificial Sequence
  Synthetic oligonucleotide
agaccacatctcttccacattttacctagacggta

SEQ ID NO: 63763 - DNA, 36 bp, Artificial Sequence
  Synthetic oligonucleotide
attgaggtgggaattgggatagcgcctcggggggta

SEQ ID NO: 63764 - DNA, 35 bp, Artificial Sequence
  Synthetic oligonucleotide
gagcaccgccgactcggtgagcctcattaatctta

SEQ ID NO: 63765 - DNA, 35 bp, Artificial Sequence
  Synthetic oligonucleotide
gccataacccccatacccacaggtggtattatcac

SEQ ID NO: 63766 - DNA, 35 bp, Artificial Sequence
  Synthetic oligonucleotide
gttgccgaccttgtcttgctagtactgtgtccccc

SEQ ID NO: 63767 - DNA, 35 bp, Artificial Sequence
  Synthetic oligonucleotide
tttcgctcacatctgttttttattgtctcagcccc

SEQ ID NO: 63768 - DNA, 35 bp, Artificial Sequence
  Synthetic oligonucleotide
gtggaccacgttggcacggtcataacaaatgcccc

SEQ ID NO: 63769 - DNA, 35 bp, Artificial Sequence
  Synthetic oligonucleotide
gccccctgtccctgaccctgtctgagacacttgcc

SEQ ID NO: 63770 - DNA, 35 bp, Artificial Sequence
  Synthetic oligonucleotide
gctgacccctgcagttaggtttccgcagccttgcc

SEQ ID NO: 63771 - DNA, 35 bp, Artificial Sequence
  Synthetic oligonucleotide
gaccgatcagaacctcgtaaacaagccgtgttgcc

SEQ ID NO: 63772 - DNA, 35 bp, Artificial Sequence
  Synthetic oligonucleotide
gacccgacacgctggtggtcgtagggcactactcc

SEQ ID NO: 63773 - DNA, 35 bp, Artificial Sequence
  Synthetic oligonucleotide
gaggataactcctccgcttgactatcaggctgtcc

SEQ ID NO: 63774 - DNA, 35 bp, Artificial Sequence
  Synthetic oligonucleotide
tcatccccttcacacctacgacataactgcctcgc

SEQ ID NO: 63775 - DNA, 35 bp, Artificial Sequence
  Synthetic oligonucleotide
ttaccggacactccatcccgatcgctctgtctcgc

SEQ ID NO: 63776 - DNA, 34 bp, Artificial Sequence
  Synthetic oligonucleotide
tggatgccgacagtcacggtcctttatccatatc

SEQ ID NO: 63777 - DNA, 35 bp, Artificial Sequence
  Synthetic oligonucleotide
tgctcccaagcggcattaccatataggctcttatc

SEQ ID NO: 63778 - DNA, 35 bp, Artificial Sequence
  Synthetic oligonucleotide
tgatcagcgatgccgttcgacgatcaaccaccctc

SEQ ID NO: 63779 - DNA, 35 bp, Artificial Sequence
  Synthetic oligonucleotide
atgaacacctgtccctaatcgatctcttatagctc

SEQ ID NO: 63780 - DNA, 35 bp, Artificial Sequence
  Synthetic oligonucleotide
acacacctactctctacccgtagactgttcctgtc

SEQ ID NO: 63781 - DNA, 35 bp, Artificial Sequence
  Synthetic oligonucleotide
aaacggactgctgccctcatgattacggctctccg

SEQ ID NO: 63782 - DNA, 35 bp, Artificial Sequence
  Synthetic oligonucleotide
gccacggaatattgtgcgcctaccttcactactcg

SEQ ID NO: 63783 - DNA, 35 bp, Artificial Sequence
  Synthetic oligonucleotide
agtggaacggggagcgggaattgcacgggggttcg

SEQ ID NO: 63784 - DNA, 35 bp, Artificial Sequence
  Synthetic oligonucleotide
tcccagctccaccgattccaagtgcccccagtagg

SEQ ID NO: 63785 - DNA, 35 bp, Artificial Sequence
  Synthetic oligonucleotide
ggtaggagggggtaactgaacaaaacagcgctctg

SEQ ID NO: 63786 - DNA, 35 bp, Artificial Sequence
  Synthetic oligonucleotide
gtgaccctgctgttcattgaatctcattcgactat

SEQ ID NO: 63787 - DNA, 35 bp, Artificial Sequence
  Synthetic oligonucleotide
taatcacacccccgcgtctgtggaacccattctat

SEQ ID NO: 63788 - DNA, 35 bp, Artificial Sequence
  Synthetic oligonucleotide
atttctccgccctgtttgcttcatctataggcact

SEQ ID NO: 63789 - DNA, 35 bp, Artificial Sequence
  Synthetic oligonucleotide
tctcgcgcatggatgaacgtccgttatttttccct

SEQ ID NO: 63790 - DNA, 35 bp, Artificial Sequence
  Synthetic oligonucleotide
gagaccacggtggtgaagtaaattagttgccaagt

SEQ ID NO: 63791 - DNA, 34 bp, Artificial Sequence
  Synthetic oligonucleotide
atgcactgcccctgccctccttgtttaccctggt

SEQ ID NO: 63792 - DNA, 35 bp, Artificial Sequence
  Synthetic oligonucleotide
acagacttggcggaagggagcttacggggacttgt

SEQ ID NO: 63793 - DNA, 35 bp, Artificial Sequence
  Synthetic oligonucleotide
atcgaagtgcaaaggaacgagatcgccgacccttt

SEQ ID NO: 63794 - DNA, 35 bp, Artificial Sequence
  Synthetic oligonucleotide
gctgtaagcgtactccccagtggttcatgccgttt

SEQ ID NO: 63795 - DNA, 35 bp, Artificial Sequence
  Synthetic oligonucleotide
gaggtcgagggccggtaagttaaagggcgcggttt

SEQ ID NO: 63796 - DNA, 36 bp, Artificial Sequence
  Synthetic oligonucleotide
gtgaccgagcctgatacccttatcgccttctccaaa

SEQ ID NO: 63797 - DNA, 35 bp, Artificial Sequence
  Synthetic oligonucleotide
acctgatcccacgatcgcataattcaattcgcaaa

SEQ ID NO: 63798 - DNA, 35 bp, Artificial Sequence
  Synthetic oligonucleotide
gtaacacacaccacgtactacccaccctgagagaa

SEQ ID NO: 63799 - DNA, 36 bp, Artificial Sequence
  Synthetic oligonucleotide
actaaggcacggtggatgaagggttggggattggaa

SEQ ID NO: 63800 - DNA, 36 bp, Artificial Sequence
  Synthetic oligonucleotide
gcatgaaactgggtgggggactgggcacaaggtgaa

SEQ ID NO: 63801 - DNA, 36 bp, Artificial Sequence
  Synthetic oligonucleotide
atgcaaactgccttttctgttcttgtcgacgcctaa

SEQ ID NO: 63802 - DNA, 35 bp, Artificial Sequence
  Synthetic oligonucleotide
ggatatacccttcgcccccgccggctcctaccaca

SEQ ID NO: 63803 - DNA, 36 bp, Artificial Sequence
  Synthetic oligonucleotide
acctgtgcgagaaggtttgccgtctgtccagccaca

SEQ ID NO: 63804 - DNA, 36 bp, Artificial Sequence
  Synthetic oligonucleotide
gccaaacgcaacgcatacgtgagttgttccttcaca

SEQ ID NO: 63805 - DNA, 35 bp, Artificial Sequence
  Synthetic oligonucleotide
gtacataacgctgccctgctttggccccctggaca

SEQ ID NO: 63806 - DNA, 37 bp, Artificial Sequence
  Synthetic oligonucleotide
tgatgcagacccgagcattgcttatcatgtcgaacca

SEQ ID NO: 63807 - DNA, 36 bp, Artificial Sequence
  Synthetic oligonucleotide
tccgccatcatcgacgctttaccgtgcattggacca

SEQ ID NO: 63808 - DNA, 36 bp, Artificial Sequence
  Synthetic oligonucleotide
tttgccacatcattgtgcatatatcccacctggcca

SEQ ID NO: 63809 - DNA, 35 bp, Artificial Sequence
  Synthetic oligonucleotide
tcctcaccataatattgcctgatgggccccctcca

SEQ ID NO: 63810 - DNA, 35 bp, Artificial Sequence
  Synthetic oligonucleotide
acccgcaccccctcgcacccgcagccttgcactca

SEQ ID NO: 63811 - DNA, 36 bp, Artificial Sequence
  Synthetic oligonucleotide
gccccctcaagctgatcgtcccattaatagttgtca

SEQ ID NO: 63812 - DNA, 37 bp, Artificial Sequence
  Synthetic oligonucleotide
tcgttacatggcaaagttgggagggtgggggagtaga

SEQ ID NO: 63813 - DNA, 37 bp, Artificial Sequence
  Synthetic oligonucleotide
gatagccccatctcccgtaagcgagcacattcgacga

SEQ ID NO: 63814 - DNA, 37 bp, Artificial Sequence
  Synthetic oligonucleotide
atgctctgcaaggcccgtatcattgctttatcaccga

SEQ ID NO: 63815 - DNA, 36 bp, Artificial Sequence
  Synthetic oligonucleotide
acaaagccctacccgcccatggtccgcctgccccga

SEQ ID NO: 63816 - DNA, 37 bp, Artificial Sequence
  Synthetic oligonucleotide
atgctggcactggctcacgtttcatggatcactccga

SEQ ID NO: 63817 - DNA, 37 bp, Artificial Sequence
  Synthetic oligonucleotide
gcgctctcctggttcgtgttctctttcaatcgtggga

SEQ ID NO: 63818 - DNA, 36 bp, Artificial Sequence
  Synthetic oligonucleotide
atccacagccctacccaataacgcgggcaaactgga

SEQ ID NO: 63819 - DNA, 37 bp, Artificial Sequence
  Synthetic oligonucleotide
tctgtggacgccagcacctccataacgccatcttgga

SEQ ID NO: 63820 - DNA, 36 bp, Artificial Sequence
  Synthetic oligonucleotide
gacacgcgtacatacgctcaagttccgcctcttgga

SEQ ID NO: 63821 - DNA, 37 bp, Artificial Sequence
  Synthetic oligonucleotide
gtggtcgcacgcataccgcccatgcttctattttgga

SEQ ID NO: 63822 - DNA, 38 bp, Artificial Sequence
  Synthetic oligonucleotide
tatgcctccgccgcctgtatagcgtcgcctccaaatga

SEQ ID NO: 63823 - DNA, 37 bp, Artificial Sequence
  Synthetic oligonucleotide
gccggaggggtcgtacgaaaagctggtggggcaatga

SEQ ID NO: 63824 - DNA, 38 bp, Artificial Sequence
  Synthetic oligonucleotide
gccggacaagtggatgcacgggagtaacaggggaatga

SEQ ID NO: 63825 - DNA, 38 bp, Artificial Sequence
  Synthetic oligonucleotide
gtgaccaacgtcgacactgaagtgggggggcgggatga

SEQ ID NO: 63826 - DNA, 38 bp, Artificial Sequence
  Synthetic oligonucleotide
agggtcaacgcagactggttcatgggttttgaatatga

SEQ ID NO: 63827 - DNA, 38 bp, Artificial Sequence
  Synthetic oligonucleotide
ggaacggacggatgaatggttgaaaggttaagggctga

SEQ ID NO: 63828 - DNA, 35 bp, Artificial Sequence
  Synthetic oligonucleotide
actcctgcaatttgagccctcttctggcctgctga

SEQ ID NO: 63829 - DNA, 37 bp, Artificial Sequence
  Synthetic oligonucleotide
agctatgcgcacttcttggtttatgttcccgttctga

SEQ ID NO: 63830 - DNA, 38 bp, Artificial Sequence
  Synthetic oligonucleotide
tcgtgcccccgcattcgactatatctcccaccaagtga

SEQ ID NO: 63831 - DNA, 38 bp, Artificial Sequence
  Synthetic oligonucleotide
gcacgtccgcctcctgtctgcacggccaacatccgtga

SEQ ID NO: 63832 - DNA, 38 bp, Artificial Sequence
  Synthetic oligonucleotide
ttcggtgtgcctccttttgctcctatgaacgatcgtga

SEQ ID NO: 63833 - DNA, 37 bp, Artificial Sequence
  Synthetic oligonucleotide
gaggagaggggagattgaaattaggctagataggtga

SEQ ID NO: 63834 - DNA, 38 bp, Artificial Sequence
  Synthetic oligonucleotide
ttacatcctctgggcctctagtactggtacacctgtga

SEQ ID NO: 63835 - DNA, 37 bp, Artificial Sequence
  Synthetic oligonucleotide
tcaactgctgcctaggtccctttttctgcccgtgtga

SEQ ID NO: 63836 - DNA, 38 bp, Artificial Sequence
  Synthetic oligonucleotide
agacgagagggcgacgggacggaataggggcgcgttga

SEQ ID NO: 63837 - DNA, 36 bp, Artificial Sequence
  Synthetic oligonucleotide
tccactaccaatcccgccggccatctgtaatctata

SEQ ID NO: 63838 - DNA, 35 bp, Artificial Sequence
  Synthetic oligonucleotide
ttgcgcaggcgcggtctgaactggccctctttata

SEQ ID NO: 63839 - DNA, 36 bp, Artificial Sequence
  Synthetic oligonucleotide
gcctcgtatgctacgttccggaccctcactcaccta

SEQ ID NO: 63840 - DNA, 35 bp, Artificial Sequence
  Synthetic oligonucleotide
atgttagtcccaacggccgaatagcacccacccta

SEQ ID NO: 63841 - DNA, 35 bp, Artificial Sequence
  Synthetic oligonucleotide
tccaacgaatcaccttaaagtctgggctcatgcta

SEQ ID NO: 63842 - DNA, 36 bp, Artificial Sequence
  Synthetic oligonucleotide
gtgactcgcacggtccctctgttctacacctgtcta

SEQ ID NO: 63843 - DNA, 35 bp, Artificial Sequence
  Synthetic oligonucleotide
attctcagcgcaccgtctcgcgcaccctatacgta

SEQ ID NO: 63844 - DNA, 35 bp, Artificial Sequence
  Synthetic oligonucleotide
atgtgacgcaccattcggcttttgtggtctccgta

SEQ ID NO: 63845 - DNA, 35 bp, Artificial Sequence
  Synthetic oligonucleotide
tagaccgttgcattgggtacgctaatcacccctta

SEQ ID NO: 63846 - DNA, 35 bp, Artificial Sequence
  Synthetic oligonucleotide
aacctgctatcatccctttgtaatgtctgcagtac

SEQ ID NO: 63847 - DNA, 35 bp, Artificial Sequence
  Synthetic oligonucleotide
gcagtcgaaagccacccgcactgctctaccacacc

SEQ ID NO: 63848 - DNA, 35 bp, Artificial Sequence
  Synthetic oligonucleotide
atggttcctgctcccacaacggttcttttcgaccc

SEQ ID NO: 63849 - DNA, 35 bp, Artificial Sequence
  Synthetic oligonucleotide
gtacgattcaccagcccggaaagtggccacatccc

SEQ ID NO: 63850 - DNA, 35 bp, Artificial Sequence
  Synthetic oligonucleotide
gtggaatacgccgtgggtctgtggttccgttctcc

SEQ ID NO: 63851 - DNA, 35 bp, Artificial Sequence
  Synthetic oligonucleotide
aacgctactcaatctcgcagtgctaaaatacgctc

SEQ ID NO: 63852 - DNA, 35 bp, Artificial Sequence
  Synthetic oligonucleotide
tgtagaccgtcagtctgccaaataggccccccttc

SEQ ID NO: 63853 - DNA, 35 bp, Artificial Sequence
  Synthetic oligonucleotide
gttgacgactcgcacccgacctatgaaccccgttc

SEQ ID NO: 63854 - DNA, 35 bp, Artificial Sequence
  Synthetic oligonucleotide
tgttgccacaagctcctgacattcaaatgcgaacg

SEQ ID NO: 63855 - DNA, 35 bp, Artificial Sequence
  Synthetic oligonucleotide
taaccgccttccttctgattcaactatgtgctccg

SEQ ID NO: 63856 - DNA, 35 bp, Artificial Sequence
  Synthetic oligonucleotide
ttaaggagccaagaggagggtgactagtaggggcg

SEQ ID NO: 63857 - DNA, 35 bp, Artificial Sequence
  Synthetic oligonucleotide
gagtggagggcgttgaatgctgcggaaagggcagg

SEQ ID NO: 63858 - DNA, 35 bp, Artificial Sequence
  Synthetic oligonucleotide
acccgccgaactatgcttatccatccgtgactagg

SEQ ID NO: 63859 - DNA, 34 bp, Artificial Sequence
  Synthetic oligonucleotide
tacgcaccgctcatgttcgatcggttttctttgg

SEQ ID NO: 63860 - DNA, 35 bp, Artificial Sequence
  Synthetic oligonucleotide
gatgcccctatcttggaacaatactgaaagtttgg

SEQ ID NO: 63861 - DNA, 35 bp, Artificial Sequence
  Synthetic oligonucleotide
agtccccctcatgagtagccgcaatctctttacat

SEQ ID NO: 63862 - DNA, 36 bp, Artificial Sequence
  Synthetic oligonucleotide
gacgaagtgtgcgtggttggttgatttgcttttcat

SEQ ID NO: 63863 - DNA, 35 bp, Artificial Sequence
  Synthetic oligonucleotide
agcggaggtcgtaagaggtggggttaatggaagat

SEQ ID NO: 63864 - DNA, 35 bp, Artificial Sequence
  Synthetic oligonucleotide
gcatgagagtgaccgttccatctacgcttagctat

SEQ ID NO: 63865 - DNA, 35 bp, Artificial Sequence
  Synthetic oligonucleotide
atggacattgcagttcctacggataccatcccact

SEQ ID NO: 63866 - DNA, 35 bp, Artificial Sequence
  Synthetic oligonucleotide
tcgctccaagcctatgacatctacctttgcatcct

SEQ ID NO: 63867 - DNA, 35 bp, Artificial Sequence
  Synthetic oligonucleotide
tcccacgaacagtccacctgtggcgaaaccgctct

SEQ ID NO: 63868 - DNA, 35 bp, Artificial Sequence
  Synthetic oligonucleotide
aaccctcaaatgccagacgcacaaaagccggctct

SEQ ID NO: 63869 - DNA, 35 bp, Artificial Sequence
  Synthetic oligonucleotide
ttgatccgaatcatgttgaaacccagtactcccgt

SEQ ID NO: 63870 - DNA, 35 bp, Artificial Sequence
  Synthetic oligonucleotide
tgaaccggccggttctaaatacctgtcacactcgt

SEQ ID NO: 63871 - DNA, 35 bp, Artificial Sequence
  Synthetic oligonucleotide
agcacactgcacccacgtgtctgggacacggtatt

SEQ ID NO: 63872 - DNA, 34 bp, Artificial Sequence
  Synthetic oligonucleotide
gttactcatccgtttgacgccttgttcctgcctt

SEQ ID NO: 63873 - DNA, 35 bp, Artificial Sequence
  Synthetic oligonucleotide
attactcctcgcgtaccttgttgggatccttcctt

SEQ ID NO: 63874 - DNA, 35 bp, Artificial Sequence
  Synthetic oligonucleotide
acgaccatccccccgcagtctccatgtcctggttt

SEQ ID NO: 63875 - DNA, 35 bp, Artificial Sequence
  Synthetic oligonucleotide
gactctgccgccccgttaaaatttgtgcttggttt

SEQ ID NO: 63876 - DNA, 36 bp, Artificial Sequence
  Synthetic oligonucleotide
ggcccacatgccgcgttgcctcctaccttgctgaaa

SEQ ID NO: 63877 - DNA, 36 bp, Artificial Sequence
  Synthetic oligonucleotide
acccatctgtacgagctcacctgcatatttccacaa

SEQ ID NO: 63878 - DNA, 36 bp, Artificial Sequence
  Synthetic oligonucleotide
gattacgcccagacacctgtcgctatctctatacaa

SEQ ID NO: 63879 - DNA, 36 bp, Artificial Sequence
  Synthetic oligonucleotide
gacaccttcgtcataactgattcgtgatcgctccaa

SEQ ID NO: 63880 - DNA, 36 bp, Artificial Sequence
  Synthetic oligonucleotide
acgcctcccctccgctacggttgaagatggtctcaa

SEQ ID NO: 63881 - DNA, 36 bp, Artificial Sequence
  Synthetic oligonucleotide
tcatcccgccagctccatcatcacgatagcattcaa

SEQ ID NO: 63882 - DNA, 36 bp, Artificial Sequence
  Synthetic oligonucleotide
tgacggggccatacagctaacacaccctcctaggaa

SEQ ID NO: 63883 - DNA, 36 bp, Artificial Sequence
  Synthetic oligonucleotide
ttgcgagttttggtaccgttgtccgtccctcctgaa

SEQ ID NO: 63884 - DNA, 35 bp, Artificial Sequence
  Synthetic oligonucleotide
aaccagacgcctttcggttctcacacttcaagtaa

SEQ ID NO: 63885 - DNA, 36 bp, Artificial Sequence
  Synthetic oligonucleotide
accactcgttgcattcgggtgacgctcctttacaca

SEQ ID NO: 63886 - DNA, 36 bp, Artificial Sequence
  Synthetic oligonucleotide
gatgtctcgcaccctccagtaatcgacgttgtgaca

SEQ ID NO: 63887 - DNA, 35 bp, Artificial Sequence
  Synthetic oligonucleotide
gacccgtcggtcgcagaaccgtgggccaccttaca

SEQ ID NO: 63888 - DNA, 36 bp, Artificial Sequence
  Synthetic oligonucleotide
gtggtgtgtaggtcccattttgtcgccaggttgcca

SEQ ID NO: 63889 - DNA, 35 bp, Artificial Sequence
  Synthetic oligonucleotide
gtgaacggggggctgcattaaggagggggggtcca

SEQ ID NO: 63890 - DNA, 36 bp, Artificial Sequence
  Synthetic oligonucleotide
acacacactgagataatgtctaccttggcttgctca

SEQ ID NO: 63891 - DNA, 36 bp, Artificial Sequence
  Synthetic oligonucleotide
ttacaccacccctgcacctacgtcaactgggattca

SEQ ID NO: 63892 - DNA, 37 bp, Artificial Sequence
  Synthetic oligonucleotide
accatcctctgggccgatccgtttgcgcctcctaaga

SEQ ID NO: 63893 - DNA, 37 bp, Artificial Sequence
  Synthetic oligonucleotide
gtgttcgtccgtcccagaaccatccttctcccccaga

SEQ ID NO: 63894 - DNA, 36 bp, Artificial Sequence
  Synthetic oligonucleotide
gaagcgaggaacggtaaagagatgaatagaagcaga

SEQ ID NO: 63895 - DNA, 37 bp, Artificial Sequence
  Synthetic oligonucleotide
tgagtgtgggtgggtgggtctatggggaacattcaga

SEQ ID NO: 63896 - DNA, 37 bp, Artificial Sequence
  Synthetic oligonucleotide
accatcatccacttcctgcccctgttttacggctaga

SEQ ID NO: 63897 - DNA, 37 bp, Artificial Sequence
  Synthetic oligonucleotide
atctgggactcttgccacgtttacgctacacctccga

SEQ ID NO: 63898 - DNA, 37 bp, Artificial Sequence
  Synthetic oligonucleotide
actaaccccgctctgctttatcgcttccgctgcgcga

SEQ ID NO: 63899 - DNA, 37 bp, Artificial Sequence
  Synthetic oligonucleotide
tgcatcatccgttcgaccccaggacattttctatcga

SEQ ID NO: 63900 - DNA, 37 bp, Artificial Sequence
  Synthetic oligonucleotide
tgttgccacattcgtaactacggcttcctccattcga

SEQ ID NO: 63901 - DNA, 37 bp, Artificial Sequence
  Synthetic oligonucleotide
ggacgaacggggccggatatgcggcatggggtaagga

SEQ ID NO: 63902 - DNA, 37 bp, Artificial Sequence
  Synthetic oligonucleotide
atcgagtagagggggggaggatgggtaggtgccagga

SEQ ID NO: 63903 - DNA, 37 bp, Artificial Sequence
  Synthetic oligonucleotide
ggggccagttacgtgggcttggggtatttagagggga

SEQ ID NO: 63904 - DNA, 37 bp, Artificial Sequence
  Synthetic oligonucleotide
atgcatccagaagtatagtcatgtgggggggagggga

SEQ ID NO: 63905 - DNA, 37 bp, Artificial Sequence
  Synthetic oligonucleotide
actaccagcctatattatatgtacctcccttcctgga

SEQ ID NO: 63906 - DNA, 37 bp, Artificial Sequence
  Synthetic oligonucleotide
aggggtgccaggcaaggggcggagggtgagaattgga

SEQ ID NO: 63907 - DNA, 37 bp, Artificial Sequence
  Synthetic oligonucleotide
gaggagctaacggtccaattgcccacccactacatga

SEQ ID NO: 63908 - DNA, 38 bp, Artificial Sequence
  Synthetic oligonucleotide
actgctgagcgtggggggagttgaagggagagctatga

SEQ ID NO: 63909 - DNA, 38 bp, Artificial Sequence
  Synthetic oligonucleotide
gaaagctcacccgacccacctgcgcccgttatcactga

SEQ ID NO: 63910 - DNA, 38 bp, Artificial Sequence
  Synthetic oligonucleotide
aacgagggctgagtggggggggtggtggcttagcgtga

SEQ ID NO: 63911 - DNA, 37 bp, Artificial Sequence
  Synthetic oligonucleotide
acacggtcaaccgaaggtgcggggaaggggtgcgtga

SEQ ID NO: 63912 - DNA, 38 bp, Artificial Sequence
  Synthetic oligonucleotide
acgagggccctccggttaactgccatgtatttccttga

SEQ ID NO: 63913 - DNA, 38 bp, Artificial Sequence
  Synthetic oligonucleotide
gcgggggtggatcggaattggaagggtgagatcgttga

SEQ ID NO: 63914 - DNA, 38 bp, Artificial Sequence
  Synthetic oligonucleotide
gagaccgttagtagggcatggaggggggataagtttga

SEQ ID NO: 63915 - DNA, 36 bp, Artificial Sequence
  Synthetic oligonucleotide
gcgagagaacgcatcgtacttatacacaactccata

SEQ ID NO: 63916 - DNA, 35 bp, Artificial Sequence
  Synthetic oligonucleotide
ttcagatcggccgattcttattctgggcctcccta

SEQ ID NO: 63917 - DNA, 35 bp, Artificial Sequence
  Synthetic oligonucleotide
gggttgtcccgcactcgccctgccccgttattcta

SEQ ID NO: 63918 - DNA, 36 bp, Artificial Sequence
  Synthetic oligonucleotide
gtcccggacagaaaaatacaccatgcttaccttgta

SEQ ID NO: 63919 - DNA, 36 bp, Artificial Sequence
  Synthetic oligonucleotide
tgcacctgctatatttcaacccgacccgcgcttgta

SEQ ID NO: 63920 - DNA, 36 bp, Artificial Sequence
  Synthetic oligonucleotide
tcacgcctccgtcgcccatgcttccgttagtagtta

SEQ ID NO: 63921 - DNA, 36 bp, Artificial Sequence
  Synthetic oligonucleotide
gtcttgccaggtcgatcgaccgctctctcactgtta

SEQ ID NO: 63922 - DNA, 35 bp, Artificial Sequence
  Synthetic oligonucleotide
gacgatcaagcactcctctggtatccctcttttta

SEQ ID NO: 63923 - DNA, 35 bp, Artificial Sequence
  Synthetic oligonucleotide
gctgacacctactacatgtcctgcttgtcaagcac

SEQ ID NO: 63924 - DNA, 35 bp, Artificial Sequence
  Synthetic oligonucleotide
tcctgtcgacacacggctttcatagacaccctcac

SEQ ID NO: 63925 - DNA, 35 bp, Artificial Sequence
  Synthetic oligonucleotide
gtgtgtcctccgatcacctcttttacatgcaaacc

SEQ ID NO: 63926 - DNA, 35 bp, Artificial Sequence
  Synthetic oligonucleotide
acccgctctacctatatgttttcacgatcggcacc

SEQ ID NO: 63927 - DNA, 35 bp, Artificial Sequence
  Synthetic oligonucleotide
tagctcgccctatccttctgtttaggccactcacc

SEQ ID NO: 63928 - DNA, 35 bp, Artificial Sequence
  Synthetic oligonucleotide
taacaacggcatggcaagtactacttcatttttcc

SEQ ID NO: 63929 - DNA, 35 bp, Artificial Sequence
  Synthetic oligonucleotide
ggaccgtgggtcgccgcccctgcctgatcacaagc

SEQ ID NO: 63930 - DNA, 36 bp, Artificial Sequence
  Synthetic oligonucleotide
tcccttgcccggtgcatttgccgttcctacaatggc

SEQ ID NO: 63931 - DNA, 35 bp, Artificial Sequence
  Synthetic oligonucleotide
gagcgaaagcgggaaatattcgggctgggaggtgc

SEQ ID NO: 63932 - DNA, 35 bp, Artificial Sequence
  Synthetic oligonucleotide
atagcgcggtttcctactcgccgtatggttccatc

SEQ ID NO: 63933 - DNA, 35 bp, Artificial Sequence
  Synthetic oligonucleotide
tccccggacacctggtgccgtagtacggaaatctc

SEQ ID NO: 63934 - DNA, 35 bp, Artificial Sequence
  Synthetic oligonucleotide
accgtcttccgctaattgctttatctcgctcgttc

SEQ ID NO: 63935 - DNA, 35 bp, Artificial Sequence
  Synthetic oligonucleotide
ttgcccattcactatcgtccccttaggtctatttc

SEQ ID NO: 63936 - DNA, 35 bp, Artificial Sequence
  Synthetic oligonucleotide
agattgagtcgtcaatcctcgcaccacctttatag

SEQ ID NO: 63937 - DNA, 35 bp, Artificial Sequence
  Synthetic oligonucleotide
actccaccgcccgccagcgcactcttcaggactag

SEQ ID NO: 63938 - DNA, 35 bp, Artificial Sequence
  Synthetic oligonucleotide
tccgagttaaggacataggggataggaggaaaacg

SEQ ID NO: 63939 - DNA, 35 bp, Artificial Sequence
  Synthetic oligonucleotide
gtcccgttaaacgcgctacaaccattcctctgacg

SEQ ID NO: 63940 - DNA, 35 bp, Artificial Sequence
  Synthetic oligonucleotide
acgccataacctctgcccctatcgaagaacgaccg

SEQ ID NO: 63941 - DNA, 35 bp, Artificial Sequence
  Synthetic oligonucleotide
tcaagggccaacccaaactgcccaccgcccatccg

SEQ ID NO: 63942 - DNA, 36 bp, Artificial Sequence
  Synthetic oligonucleotide
gtgacggtggggtggtaggtctttttgcctcggtgg

SEQ ID NO: 63943 - DNA, 35 bp, Artificial Sequence
  Synthetic oligonucleotide
tagtcactccatttttatggctgccacatctcctg

SEQ ID NO: 63944 - DNA, 35 bp, Artificial Sequence
  Synthetic oligonucleotide
actcacccgttcgtataccgcttctctccttgctg

SEQ ID NO: 63945 - DNA, 35 bp, Artificial Sequence
  Synthetic oligonucleotide
attggtacacgcaagtttgcagaggggagggagtg

SEQ ID NO: 63946 - DNA, 35 bp, Artificial Sequence
  Synthetic oligonucleotide
tgttcaggcccccgggtcattgctcctatcttttg

SEQ ID NO: 63947 - DNA, 35 bp, Artificial Sequence
  Synthetic oligonucleotide
gacgcaacacgtaaatttcttctgttacatggaat

SEQ ID NO: 63948 - DNA, 35 bp, Artificial Sequence
  Synthetic oligonucleotide
actcccgcgggccctcccgtacccccctacaacat

SEQ ID NO: 63949 - DNA, 35 bp, Artificial Sequence
  Synthetic oligonucleotide
gatggacatcggttgcggcttctcatcacccacat

SEQ ID NO: 63950 - DNA, 35 bp, Artificial Sequence
  Synthetic oligonucleotide
tcgcctaaacctgtcgcctcatgcaacacgcccat

SEQ ID NO: 63951 - DNA, 35 bp, Artificial Sequence
  Synthetic oligonucleotide
gttcccctcccatgtttacagccactggactggat

SEQ ID NO: 63952 - DNA, 35 bp, Artificial Sequence
  Synthetic oligonucleotide
gatggtccaagcggcagacttacgcaccaccctat

SEQ ID NO: 63953 - DNA, 35 bp, Artificial Sequence
  Synthetic oligonucleotide
atcgccctgatgctgctgcgcccggcctcgaccct

SEQ ID NO: 63954 - DNA, 35 bp, Artificial Sequence
  Synthetic oligonucleotide
tcatgtcgcatgactcccctgcaacatacgttcct

SEQ ID NO: 63955 - DNA, 35 bp, Artificial Sequence
  Synthetic oligonucleotide
tagcccccccgttatgcctcttactcgtccccggt

SEQ ID NO: 63956 - DNA, 35 bp, Artificial Sequence
  Synthetic oligonucleotide
gtgtctcctgttcgttgattttggttctttcttgt

SEQ ID NO: 63957 - DNA, 36 bp, Artificial Sequence
  Synthetic oligonucleotide
tctgcgagggtgccacaagccacaagcctacccaaa

SEQ ID NO: 63958 - DNA, 36 bp, Artificial Sequence
  Synthetic oligonucleotide
gagccatcatcgcacccgcccttgcaaccgagccaa

SEQ ID NO: 63959 - DNA, 36 bp, Artificial Sequence
  Synthetic oligonucleotide
acaaagccgattgcccgtcgtatcccatgtccgcaa

SEQ ID NO: 63960 - DNA, 36 bp, Artificial Sequence
  Synthetic oligonucleotide
tttcccagcccgccatcaaagacgatctgactcgaa

SEQ ID NO: 63961 - DNA, 36 bp, Artificial Sequence
  Synthetic oligonucleotide
aagccacactcccctgactctatcgaagatctctaa

SEQ ID NO: 63962 - DNA, 36 bp, Artificial Sequence
  Synthetic oligonucleotide
gttcgcttgccgctcctttgttctgactcccgcaca

SEQ ID NO: 63963 - DNA, 36 bp, Artificial Sequence
  Synthetic oligonucleotide
gagatgatggttgaggtaggaacaaagacaggcaca

SEQ ID NO: 63964 - DNA, 36 bp, Artificial Sequence
  Synthetic oligonucleotide
gcccccgtggcacgttgcatgagagaatcgccacca

SEQ ID NO: 63965 - DNA, 36 bp, Artificial Sequence
  Synthetic oligonucleotide
aagtccagcacggaagtggggggatctgaatgacca

SEQ ID NO: 63966 - DNA, 36 bp, Artificial Sequence
  Synthetic oligonucleotide
ccatcctgtaggatggtgccacaatcgcttccccca

SEQ ID NO: 63967 - DNA, 36 bp, Artificial Sequence
  Synthetic oligonucleotide
acaccgggttcacaatgcgtgctcaggcttatccca

SEQ ID NO: 63968 - DNA, 36 bp, Artificial Sequence
  Synthetic oligonucleotide
gtcgacaaaccgtgcgccacacgtggtttcctccca

SEQ ID NO: 63969 - DNA, 35 bp, Artificial Sequence
  Synthetic oligonucleotide
gcccttagctgtgatactgctttccacctccgcca

SEQ ID NO: 63970 - DNA, 35 bp, Artificial Sequence
  Synthetic oligonucleotide
gccatgtacaggacccacactgagatgtacttcca

SEQ ID NO: 63971 - DNA, 36 bp, Artificial Sequence
  Synthetic oligonucleotide
gctgcgcaccttcagccgctttcccttgtacttgca

SEQ ID NO: 63972 - DNA, 36 bp, Artificial Sequence
  Synthetic oligonucleotide
acagtcggacgttctcgtgaagccgcgccccactca

SEQ ID NO: 63973 - DNA, 36 bp, Artificial Sequence
  Synthetic oligonucleotide
aacaccccgccaaatcggttccagcagagcttgtca

SEQ ID NO: 63974 - DNA, 36 bp, Artificial Sequence
  Synthetic oligonucleotide
tgtcatcttacttatcgtccttacgcgctggcttca

SEQ ID NO: 63975 - DNA, 36 bp, Artificial Sequence
  Synthetic oligonucleotide
catcgcccacccgtcgcaaggcccactacctcttca

SEQ ID NO: 63976 - DNA, 36 bp, Artificial Sequence
  Synthetic oligonucleotide
tctcaaccccgcaaattgactcatcgtgttttttca

SEQ ID NO: 63977 - DNA, 37 bp, Artificial Sequence
  Synthetic oligonucleotide
gccgtccatcgccgccgcctctaaacagttgccgaga

SEQ ID NO: 63978 - DNA, 37 bp, Artificial Sequence
  Synthetic oligonucleotide
gcacaccgtctcgtaaggaggagggggacagaggaga

SEQ ID NO: 63979 - DNA, 36 bp, Artificial Sequence
  Synthetic oligonucleotide
gtatgtgggggtgaaggagtagcaggcagaacacga

SEQ ID NO: 63980 - DNA, 37 bp, Artificial Sequence
  Synthetic oligonucleotide
acgcacaccccgtccgttgcttgcaatgttcatacga

SEQ ID NO: 63981 - DNA, 37 bp, Artificial Sequence
  Synthetic oligonucleotide
gacacctcccatcggtgtggccatagccaacctacga

SEQ ID NO: 63982 - DNA, 36 bp, Artificial Sequence
  Synthetic oligonucleotide
acctggggggagggggtactagggatcggtgaccga

SEQ ID NO: 63983 - DNA, 37 bp, Artificial Sequence
  Synthetic oligonucleotide
tacccccaaaggtgatcggaagcactcccacacgcga

SEQ ID NO: 63984 - DNA, 37 bp, Artificial Sequence
  Synthetic oligonucleotide
tgtagacatccgaatgcggtgcctcctcttcactcga

SEQ ID NO: 63985 - DNA, 35 bp, Artificial Sequence
  Synthetic oligonucleotide
tccgaacccacttatgttttcagtcttgtagtcga

SEQ ID NO: 63986 - DNA, 37 bp, Artificial Sequence
  Synthetic oligonucleotide
tcctagcaaagaggggtagagatgttggggtggtcga

SEQ ID NO: 63987 - DNA, 37 bp, Artificial Sequence
  Synthetic oligonucleotide
tccaccgtcccgcaatagcaactccgtatacgttcga

SEQ ID NO: 63988 - DNA, 37 bp, Artificial Sequence
  Synthetic oligonucleotide
gacacacggggacaataacagatctatcacgatagga

SEQ ID NO: 63989 - DNA, 36 bp, Artificial Sequence
  Synthetic oligonucleotide
tgaggggtgggaaagggacctggtgtgttaaacgga

SEQ ID NO: 63990 - DNA, 37 bp, Artificial Sequence
  Synthetic oligonucleotide
tccaacacgaggggacctcaccacattaacttacgga

SEQ ID NO: 63991 - DNA, 37 bp, Artificial Sequence
  Synthetic oligonucleotide
ttagggagggtaggtaggtgtgtccaaaagctgcgga

SEQ ID NO: 63992 - DNA, 37 bp, Artificial Sequence
  Synthetic oligonucleotide
tcaccgtgcccaaactcgcgccgacacctactaggga

SEQ ID NO: 63993 - DNA, 37 bp, Artificial Sequence
  Synthetic oligonucleotide
gtgtgttgccccagcgtcgttctttaccgctcatgga

SEQ ID NO: 63994 - DNA, 35 bp, Artificial Sequence
  Synthetic oligonucleotide
atccgacccatgtctcagcctaactgctctatgga

SEQ ID NO: 63995 - DNA, 37 bp, Artificial Sequence
  Synthetic oligonucleotide
gtggcccctcctaccttaacctgttgtcgttcctgga

SEQ ID NO: 63996 - DNA, 37 bp, Artificial Sequence
  Synthetic oligonucleotide
gcaggggtgggagttggggacttgggtatcaggtgga

SEQ ID NO: 63997 - DNA, 37 bp, Artificial Sequence
  Synthetic oligonucleotide
tgtcccaccacgacggcttgtttcaccttacaaatga

SEQ ID NO: 63998 - DNA, 38 bp, Artificial Sequence
  Synthetic oligonucleotide
tgcacatgcgtcacatcgtcgacctccccttcccatga

SEQ ID NO: 63999 - DNA, 37 bp, Artificial Sequence
  Synthetic oligonucleotide
gactcgcctcatgtgcattagttcccctctgatatga

SEQ ID NO: 64000 - DNA, 38 bp, Artificial Sequence
  Synthetic oligonucleotide
tgtcaagacacttgactccacacccgcctactcactga

SEQ ID NO: 64001 - DNA, 38 bp, Artificial Sequence
  Synthetic oligonucleotide
tacacggatgttccgttctaccaccgttttcaccctga

SEQ ID NO: 64002 - DNA, 38 bp, Artificial Sequence
  Synthetic oligonucleotide
tccaccgacactatttgatcaacataactctggcctga

SEQ ID NO: 64003 - DNA, 36 bp, Artificial Sequence
  Synthetic oligonucleotide
tcaaccgtgaatcgggggggcttactactgggctga

SEQ ID NO: 64004 - DNA, 38 bp, Artificial Sequence
  Synthetic oligonucleotide
tgcgacacctcgcatagttactcaccgtacacctctga

SEQ ID NO: 64005 - DNA, 36 bp, Artificial Sequence
  Synthetic oligonucleotide
ccctgccaagcattacacctagttccccccttctga

SEQ ID NO: 64006 - DNA, 37 bp, Artificial Sequence
  Synthetic oligonucleotide
gtcaccccaggtagtcgttgggtctcattctttctga

SEQ ID NO: 64007 - DNA, 38 bp, Artificial Sequence
  Synthetic oligonucleotide
accccgttctcgcctcactatctgcccgtccaaagtga

SEQ ID NO: 64008 - DNA, 38 bp, Artificial Sequence
  Synthetic oligonucleotide
agagccggaggaggtggaaggatggacttgtggagtga

SEQ ID NO: 64009 - DNA, 38 bp, Artificial Sequence
  Synthetic oligonucleotide
tctaccactacgctgttcattgaggcccaatcccgtga

SEQ ID NO: 64010 - DNA, 38 bp, Artificial Sequence
  Synthetic oligonucleotide
tgccccccttcgcatggcgaattcttcacacactgtga

SEQ ID NO: 64011 - DNA, 38 bp, Artificial Sequence
  Synthetic oligonucleotide
gcggataaggcggaaagggcggagggaaaaatgattga

SEQ ID NO: 64012 - DNA, 37 bp, Artificial Sequence
  Synthetic oligonucleotide
ggacgccgccgggaaggatgaagtgtggggctattga

SEQ ID NO: 64013 - DNA, 38 bp, Artificial Sequence
  Synthetic oligonucleotide
gtgagccgaggcgggcgatggcctctcttattacttga

SEQ ID NO: 64014 - DNA, 38 bp, Artificial Sequence
  Synthetic oligonucleotide
acttcagtcccctgacccacatgagtcgctatccttga

SEQ ID NO: 64015 - DNA, 38 bp, Artificial Sequence
  Synthetic oligonucleotide
tgaactgcacgccccgcgcttaccaacagcctgcttga

SEQ ID NO: 64016 - DNA, 38 bp, Artificial Sequence
  Synthetic oligonucleotide
cacgactcgttcttacccgcccatcacacagttgttga

SEQ ID NO: 64017 - DNA, 37 bp, Artificial Sequence
  Synthetic oligonucleotide
gccccaccagtaaccatcttcgagtctctcaatttga

SEQ ID NO: 64018 - DNA, 38 bp, Artificial Sequence
  Synthetic oligonucleotide
tcacccacagctcttaatcgtcaccacggtctatttga

SEQ ID NO: 64019 - DNA, 38 bp, Artificial Sequence
  Synthetic oligonucleotide
tgacaatcgttcgacttaatgctaccctcccgctttga

SEQ ID NO: 64020 - DNA, 36 bp, Artificial Sequence
  Synthetic oligonucleotide
gccgtaggagggggtatgggtgagggagtggctata

SEQ ID NO: 64021 - DNA, 35 bp, Artificial Sequence
  Synthetic oligonucleotide
ttcattgtcactgcatctcgatgattcctccgcta

SEQ ID NO: 64022 - DNA, 36 bp, Artificial Sequence
  Synthetic oligonucleotide
tccgtgagacgtcgtcgccctatcgtttcttgtcta

SEQ ID NO: 64023 - DNA, 35 bp, Artificial Sequence
  Synthetic oligonucleotide
tctacaccccgaatgagacgtatgacacgctgtta

SEQ ID NO: 64024 - DNA, 36 bp, Artificial Sequence
  Synthetic oligonucleotide
atctgtgacgccgtgcattattgcaccattaattta

SEQ ID NO: 64025 - DNA, 35 bp, Artificial Sequence
  Synthetic oligonucleotide
tagttaccccatgcgttttctccatcttggtccac

SEQ ID NO: 64026 - DNA, 35 bp, Artificial Sequence
  Synthetic oligonucleotide
atacccccgcagaagagatcataacgcctgggcac

SEQ ID NO: 64027 - DNA, 35 bp, Artificial Sequence
  Synthetic oligonucleotide
ttacgcgccacgcctgcaaattgccgccttcatac

SEQ ID NO: 64028 - DNA, 35 bp, Artificial Sequence
  Synthetic oligonucleotide
tgcaacggcaccctcctaccctgagttgttagacc

SEQ ID NO: 64029 - DNA, 35 bp, Artificial Sequence
  Synthetic oligonucleotide
taacgtattccccagttgcctgtgctccgcctacc

SEQ ID NO: 64030 - DNA, 34 bp, Artificial Sequence
  Synthetic oligonucleotide
gcctgatctatcagcgtatagcccatcgcaaccc

SEQ ID NO: 64031 - DNA, 35 bp, Artificial Sequence
  Synthetic oligonucleotide
atcaattgtatgacgtcactatcctgcctgctccc

SEQ ID NO: 64032 - DNA, 35 bp, Artificial Sequence
  Synthetic oligonucleotide
gcaaccctgtgttcggtgccggcgcggtaccatcc

SEQ ID NO: 64033 - DNA, 35 bp, Artificial Sequence
  Synthetic oligonucleotide
aattgccacctcccgttagacgggtccgcccatcc

SEQ ID NO: 64034 - DNA, 35 bp, Artificial Sequence
  Synthetic oligonucleotide
ggacttgcccgtgaatgggcttcctttgcttctcc

SEQ ID NO: 64035 - DNA, 35 bp, Artificial Sequence
  Synthetic oligonucleotide
catctccaccctgctacttgaaagtacacaatcgc

SEQ ID NO: 64036 - DNA, 35 bp, Artificial Sequence
  Synthetic oligonucleotide
gccattgttacagtttcccgtgtcggtcattatgc

SEQ ID NO: 64037 - DNA, 35 bp, Artificial Sequence
  Synthetic oligonucleotide
tatgcatggggctcagcaaaatgcatctcacctgc

SEQ ID NO: 64038 - DNA, 35 bp, Artificial Sequence
  Synthetic oligonucleotide
tctcccttaaggctgttcctatctggtcccatatc

SEQ ID NO: 64039 - DNA, 35 bp, Artificial Sequence
  Synthetic oligonucleotide
tacccgaacttagcgtgttgcgtgtttcgtctatc

SEQ ID NO: 64040 - DNA, 35 bp, Artificial Sequence
  Synthetic oligonucleotide
actcatggtcaaaactagcctctcccccgggactc

SEQ ID NO: 64041 - DNA, 35 bp, Artificial Sequence
  Synthetic oligonucleotide
ttccccgtccagcccagtcggccccatccctactc

SEQ ID NO: 64042 - DNA, 35 bp, Artificial Sequence
  Synthetic oligonucleotide
tactcgattggctccttgatgttcatctgcacctc

SEQ ID NO: 64043 - DNA, 35 bp, Artificial Sequence
  Synthetic oligonucleotide
tacgaccccgcgcgcctacacaatcgccggctctc

SEQ ID NO: 64044 - DNA, 35 bp, Artificial Sequence
  Synthetic oligonucleotide
gccccaggtacggccttcccacggtattctgtctc

SEQ ID NO: 64045 - DNA, 35 bp, Artificial Sequence
  Synthetic oligonucleotide
tattagacgtcacacccccctgcccgcgtagcgtc

SEQ ID NO: 64046 - DNA, 35 bp, Artificial Sequence
  Synthetic oligonucleotide
gctccatcggtcaacgagtctgcgatctatacttc

SEQ ID NO: 64047 - DNA, 35 bp, Artificial Sequence
  Synthetic oligonucleotide
accccccccatgatgcatagcccactgttcccttc

SEQ ID NO: 64048 - DNA, 35 bp, Artificial Sequence
  Synthetic oligonucleotide
gatgtgggggctcttcggtggaaagttgggaggag

SEQ ID NO: 64049 - DNA, 35 bp, Artificial Sequence
  Synthetic oligonucleotide
gcactactccggtcttgaacgcgaccagctttccg

SEQ ID NO: 64050 - DNA, 35 bp, Artificial Sequence
  Synthetic oligonucleotide
gctgcgctgaacccatgttttcccacgtccaagcg

SEQ ID NO: 64051 - DNA, 35 bp, Artificial Sequence
  Synthetic oligonucleotide
taccctcaccccataatgcctccacggaggccgcg

SEQ ID NO: 64052 - DNA, 35 bp, Artificial Sequence
  Synthetic oligonucleotide
tccctcgcccatcaccctgttatccgacgagcttg

SEQ ID NO: 64053 - DNA, 35 bp, Artificial Sequence
  Synthetic oligonucleotide
ggtgagggggctgaaagaaaaacggaagaaagaat

SEQ ID NO: 64054 - DNA, 35 bp, Artificial Sequence
  Synthetic oligonucleotide
acagacacccctgacacacctgatttagcacccct

SEQ ID NO: 64055 - DNA, 35 bp, Artificial Sequence
  Synthetic oligonucleotide
atgtaccgcgcgtactgtgcctctctacgttccct

SEQ ID NO: 64056 - DNA, 35 bp, Artificial Sequence
  Synthetic oligonucleotide
aacaggggctgggagcaatcacgaacattgagcct

SEQ ID NO: 64057 - DNA, 35 bp, Artificial Sequence
  Synthetic oligonucleotide
aagacagggcccaccccagcattaaccctgccgct

SEQ ID NO: 64058 - DNA, 35 bp, Artificial Sequence
  Synthetic oligonucleotide
acaaagggcggaaggtactagcgggaaattgggct

SEQ ID NO: 64059 - DNA, 35 bp, Artificial Sequence
  Synthetic oligonucleotide
acccaccttgccacatatggaaccgttgcacatct

SEQ ID NO: 64060 - DNA, 35 bp, Artificial Sequence
  Synthetic oligonucleotide
tgaaccaatccgccaacggtcttgtccatttatct

SEQ ID NO: 64061 - DNA, 35 bp, Artificial Sequence
  Synthetic oligonucleotide
actgccacgtataggaaaagataggatagcatggt

SEQ ID NO: 64062 - DNA, 35 bp, Artificial Sequence
  Synthetic oligonucleotide
gatcgaaggtggaagagctctgagggtggcatggt

SEQ ID NO: 64063 - DNA, 35 bp, Artificial Sequence
  Synthetic oligonucleotide
tcaaacgtctgtcccttccacttgatcacgcatgt

SEQ ID NO: 64064 - DNA, 35 bp, Artificial Sequence
  Synthetic oligonucleotide
attgttcccgctgtcagaatttcacctcatcatgt

SEQ ID NO: 64065 - DNA, 35 bp, Artificial Sequence
  Synthetic oligonucleotide
actgccaccgccacaacctcatagaccattggtgt

SEQ ID NO: 64066 - DNA, 35 bp, Artificial Sequence
  Synthetic oligonucleotide
ttatcacacttcctgatggtccgttcatccccgtt

SEQ ID NO: 64067 - DNA, 36 bp, Artificial Sequence
  Synthetic oligonucleotide
gtatgcccgaacgccatccatctaagaacaaaaaaa

SEQ ID NO: 64068 - DNA, 36 bp, Artificial Sequence
  Synthetic oligonucleotide
attcccacaggtacccacagtcttgacctccgaaaa

SEQ ID NO: 64069 - DNA, 36 bp, Artificial Sequence
  Synthetic oligonucleotide
gggactttgctgtccaccaccctctccacagtgaaa

SEQ ID NO: 64070 - DNA, 36 bp, Artificial Sequence
  Synthetic oligonucleotide
tacggactacccattctgacgtaccttaacactaaa

SEQ ID NO: 64071 - DNA, 36 bp, Artificial Sequence
  Synthetic oligonucleotide
gaaccacaccaactgcacttatcctccacgagggaa

SEQ ID NO: 64072 - DNA, 36 bp, Artificial Sequence
  Synthetic oligonucleotide
gacaccaatccatcgtctctattacatgtacgggaa

SEQ ID NO: 64073 - DNA, 35 bp, Artificial Sequence
  Synthetic oligonucleotide
gcgccctgcactgaagcctttccctggggatctaa

SEQ ID NO: 64074 - DNA, 36 bp, Artificial Sequence
  Synthetic oligonucleotide
tttgtacgtccgttgtttcttcggtcccgttacaca

SEQ ID NO: 64075 - DNA, 36 bp, Artificial Sequence
  Synthetic oligonucleotide
ggggacccgcgtactggcagtgcgcatttccaacca

SEQ ID NO: 64076 - DNA, 36 bp, Artificial Sequence
  Synthetic oligonucleotide
gatcgttgcccgctttttttcttgagacgtccccca

SEQ ID NO: 64077 - DNA, 36 bp, Artificial Sequence
  Synthetic oligonucleotide
tttgctaccttcggctatcgacgtgaccttccccca

SEQ ID NO: 64078 - DNA, 36 bp, Artificial Sequence
  Synthetic oligonucleotide
ttggtcgaagcgaactctcctggtttactagcccca

SEQ ID NO: 64079 - DNA, 36 bp, Artificial Sequence
  Synthetic oligonucleotide
agcctacctcattatcttccggcgcatgactcgcca

SEQ ID NO: 64080 - DNA, 36 bp, Artificial Sequence
  Synthetic oligonucleotide
tttgacgcacggtgggttacgtaccacctatctgca

SEQ ID NO: 64081 - DNA, 36 bp, Artificial Sequence
  Synthetic oligonucleotide
taatgccgctgttatccgccacacttgatcgttgca

SEQ ID NO: 64082 - DNA, 35 bp, Artificial Sequence
  Synthetic oligonucleotide
aaagcgtgcctaccccttttgcccacgtgtactca

SEQ ID NO: 64083 - DNA, 35 bp, Artificial Sequence
  Synthetic oligonucleotide
aatgcgccgtctaacccgtgtttcttcaaatctca

SEQ ID NO: 64084 - DNA, 35 bp, Artificial Sequence
  Synthetic oligonucleotide
atcccgagcgactgctttgggtaccccctccttca

SEQ ID NO: 64085 - DNA, 37 bp, Artificial Sequence
  Synthetic oligonucleotide
gaactggggcagagggagggtgcgtgctatgcgcaga

SEQ ID NO: 64086 - DNA, 37 bp, Artificial Sequence
  Synthetic oligonucleotide
acgacaacaacaggggagtagatggaatgattgtaga

SEQ ID NO: 64087 - DNA, 36 bp, Artificial Sequence
  Synthetic oligonucleotide
gccacgccgggcccccttactgctctaaccttccga

SEQ ID NO: 64088 - DNA, 37 bp, Artificial Sequence
  Synthetic oligonucleotide
gtcctcatggcccaccgctccgtcgctcagtctgcga

SEQ ID NO: 64089 - DNA, 37 bp, Artificial Sequence
  Synthetic oligonucleotide
tgtcagaaacaacggctcaagagggagggtaactgga

SEQ ID NO: 64090 - DNA, 37 bp, Artificial Sequence
  Synthetic oligonucleotide
acttgggaaaggcgcatggggatagggtactggtgga

SEQ ID NO: 64091 - DNA, 37 bp, Artificial Sequence
  Synthetic oligonucleotide
gacgatagcgcaaccggcccctctctttgacaaatga

SEQ ID NO: 64092 - DNA, 37 bp, Artificial Sequence
  Synthetic oligonucleotide
gcgaggggatgggggaggccataagggattgaaatga

SEQ ID NO: 64093 - DNA, 38 bp, Artificial Sequence
  Synthetic oligonucleotide
tcagctcggtcgtcctcctgccactccgcgcccaatga

SEQ ID NO: 64094 - DNA, 38 bp, Artificial Sequence
  Synthetic oligonucleotide
ttgtccccgttccatcctggagtcagctccgccaatga

SEQ ID NO: 64095 - DNA, 38 bp, Artificial Sequence
  Synthetic oligonucleotide
catgcagtcctccagcaactctgttccccgtgacatga

SEQ ID NO: 64096 - DNA, 38 bp, Artificial Sequence
  Synthetic oligonucleotide
aacgagccccactcctaaggacctagccaactacatga

SEQ ID NO: 64097 - DNA, 38 bp, Artificial Sequence
  Synthetic oligonucleotide
acacactagcagttgctttcgtcgccccggtgccatga

SEQ ID NO: 64098 - DNA, 38 bp, Artificial Sequence
  Synthetic oligonucleotide
gtactaccccgccccccgtcccaagagcattagcatga

SEQ ID NO: 64099 - DNA, 38 bp, Artificial Sequence
  Synthetic oligonucleotide
accgctcgcgcacagaatcgctccaccccgcccgatga

SEQ ID NO: 64100 - DNA, 38 bp, Artificial Sequence
  Synthetic oligonucleotide
acaggtagaggggtagggatggatgaaaaagggtatga

SEQ ID NO: 64101 - DNA, 38 bp, Artificial Sequence
  Synthetic oligonucleotide
gcatctactatgcctcctcaagaaccttgccattatga

SEQ ID NO: 64102 - DNA, 38 bp, Artificial Sequence
  Synthetic oligonucleotide
actccacgctgaagcggctgccatgttccccccactga

SEQ ID NO: 64103 - DNA, 38 bp, Artificial Sequence
  Synthetic oligonucleotide
tcgcgaccatcctggtgttaaccttaaatccaccctga

SEQ ID NO: 64104 - DNA, 38 bp, Artificial Sequence
  Synthetic oligonucleotide
gtcaccaccagagtctatcataacgtactttaccctga

SEQ ID NO: 64105 - DNA, 38 bp, Artificial Sequence
  Synthetic oligonucleotide
ataggacagctgaatacgccatttgctcctgcccctga

SEQ ID NO: 64106 - DNA, 37 bp, Artificial Sequence
  Synthetic oligonucleotide
atgcctggaagagtcgcatcgattaccgcctccctga

SEQ ID NO: 64107 - DNA, 36 bp, Artificial Sequence
  Synthetic oligonucleotide
tggtcgcacttagcacctgtctcccgctgatcctga

SEQ ID NO: 64108 - DNA, 38 bp, Artificial Sequence
  Synthetic oligonucleotide
ggataggacgtgaggccggtaaaaggggggagatctga

SEQ ID NO: 64109 - DNA, 37 bp, Artificial Sequence
  Synthetic oligonucleotide
atcacctcgtagctcttttgcctcccgtttcaagtga

SEQ ID NO: 64110 - DNA, 38 bp, Artificial Sequence
  Synthetic oligonucleotide
gcctcctgttcgctccccgccgtgccctgccgacgtga

SEQ ID NO: 64111 - DNA, 38 bp, Artificial Sequence
  Synthetic oligonucleotide
gctggtgccgcaggcattcttcacctgaccctccgtga

SEQ ID NO: 64112 - DNA, 38 bp, Artificial Sequence
  Synthetic oligonucleotide
ggaggggggggtagcacggcgagtagcagaccaggtga

SEQ ID NO: 64113 - DNA, 38 bp, Artificial Sequence
  Synthetic oligonucleotide
atggggggggcttacataaaaggggtagggaggggtga

SEQ ID NO: 64114 - DNA, 38 bp, Artificial Sequence
  Synthetic oligonucleotide
gtgggcgggtactagcccttaacaaggagggggggtga

SEQ ID NO: 64115 - DNA, 38 bp, Artificial Sequence
  Synthetic oligonucleotide
ggtataacgacaaggcggtgagttgacggtgggggtga

SEQ ID NO: 64116 - DNA, 37 bp, Artificial Sequence
  Synthetic oligonucleotide
tacgagtgcagagtgtggtgagggagcggagctgtga

SEQ ID NO: 64117 - DNA, 38 bp, Artificial Sequence
  Synthetic oligonucleotide
ggagggcacgaaactgagaggagaggaggcttaattga

SEQ ID NO: 64118 - DNA, 38 bp, Artificial Sequence
  Synthetic oligonucleotide
tcaccggacccgatttttcccgcactgcaggctattga

SEQ ID NO: 64119 - DNA, 36 bp, Artificial Sequence
  Synthetic oligonucleotide
gccacctgtcccttcgttgaccatatctggtattga

SEQ ID NO: 64120 - DNA, 37 bp, Artificial Sequence
  Synthetic oligonucleotide
gacgcctcctgatcttccttttccggtctattattga

SEQ ID NO: 64121 - DNA, 38 bp, Artificial Sequence
  Synthetic oligonucleotide
tgacccagcatactatctgtttcacgctgtgctcttga

SEQ ID NO: 64122 - DNA, 38 bp, Artificial Sequence
  Synthetic oligonucleotide
gtggggtcagtgggagaacgggggttcgttgaggttga

SEQ ID NO: 64123 - DNA, 37 bp, Artificial Sequence
  Synthetic oligonucleotide
gtaacagggtgggtgccaggaggaggtaggcgtttga

SEQ ID NO: 64124 - DNA, 36 bp, Artificial Sequence
  Synthetic oligonucleotide
agctgcgagcacatccgctcccgaataccgaacata

SEQ ID NO: 64125 - DNA, 36 bp, Artificial Sequence
  Synthetic oligonucleotide
tccacgtgtccgcggcaccaaagcctactagccata

SEQ ID NO: 64126 - DNA, 36 bp, Artificial Sequence
  Synthetic oligonucleotide
agtaccaccctatccgcatagcgactacctcctata

SEQ ID NO: 64127 - DNA, 35 bp, Artificial Sequence
  Synthetic oligonucleotide
tgtgcatgtacccgacgactctaaccattagccta

SEQ ID NO: 64128 - DNA, 36 bp, Artificial Sequence
  Synthetic oligonucleotide
acccgggtgtggagcggtaggaaataagaaagagta

SEQ ID NO: 64129 - DNA, 36 bp, Artificial Sequence
  Synthetic oligonucleotide
agaccatgccaggggggagttgacaaatgcgtggta

SEQ ID NO: 64130 - DNA, 35 bp, Artificial Sequence
  Synthetic oligonucleotide
aacgctgacgactcatcgaggcgcagacctaacac

SEQ ID NO: 64131 - DNA, 35 bp, Artificial Sequence
  Synthetic oligonucleotide
ccccactcgccggttgtttttccattcgcatacac

SEQ ID NO: 64132 - DNA, 36 bp, Artificial Sequence
  Synthetic oligonucleotide
tttgcctcagccctccgctcgcagctaggccttcac

SEQ ID NO: 64133 - DNA, 35 bp, Artificial Sequence
  Synthetic oligonucleotide
gtgcaaccactgaaccacctgacctagacagctac

SEQ ID NO: 64134 - DNA, 35 bp, Artificial Sequence
  Synthetic oligonucleotide
tcaacaacccacggtatcagggccttctggcaacc

SEQ ID NO: 64135 - DNA, 35 bp, Artificial Sequence
  Synthetic oligonucleotide
tcacattaatgtactggtacctgaccgttcccacc

SEQ ID NO: 64136 - DNA, 35 bp, Artificial Sequence
  Synthetic oligonucleotide
tcgaccccccgttcccgatttcatggcctgttacc

SEQ ID NO: 64137 - DNA, 35 bp, Artificial Sequence
  Synthetic oligonucleotide
ggaccgccactgccattcccatcgtgttttaatcc

SEQ ID NO: 64138 - DNA, 35 bp, Artificial Sequence
  Synthetic oligonucleotide
ggatggtagaggagtggtggacggaatgtaagagc

SEQ ID NO: 64139 - DNA, 35 bp, Artificial Sequence
  Synthetic oligonucleotide
gaaattcgccccacttggactttgactgaactagc

SEQ ID NO: 64140 - DNA, 35 bp, Artificial Sequence
  Synthetic oligonucleotide
tgctgctattcctgagcttcctccccaccggacgc

SEQ ID NO: 64141 - DNA, 35 bp, Artificial Sequence
  Synthetic oligonucleotide
atccaacacatactgggctgtaattccttttgcgc

SEQ ID NO: 64142 - DNA, 35 bp, Artificial Sequence
  Synthetic oligonucleotide
gacacgaaattctgggctccttgcgttgtactcgc

SEQ ID NO: 64143 - DNA, 35 bp, Artificial Sequence
  Synthetic oligonucleotide
tggaccaagcaatctacccgccaccgggtccctgc

SEQ ID NO: 64144 - DNA, 35 bp, Artificial Sequence
  Synthetic oligonucleotide
acatggggaggagtagtggaggtgcatccgtttgc

SEQ ID NO: 64145 - DNA, 35 bp, Artificial Sequence
  Synthetic oligonucleotide
ttagcacatttcgtgtgaggaatgctgcttttatc

SEQ ID NO: 64146 - DNA, 35 bp, Artificial Sequence
  Synthetic oligonucleotide
gttagccctcgcactttttatttggttgttggctc

SEQ ID NO: 64147 - DNA, 35 bp, Artificial Sequence
  Synthetic oligonucleotide
taaagtgcatcatctgtcgcacgtaacatccattc

SEQ ID NO: 64148 - DNA, 35 bp, Artificial Sequence
  Synthetic oligonucleotide
attagcgccccacatcacctatgcccactgagttc

SEQ ID NO: 64149 - DNA, 35 bp, Artificial Sequence
  Synthetic oligonucleotide
gatcgaccgggtgtcctggctcactgcacaaaaag

SEQ ID NO: 64150 - DNA, 35 bp, Artificial Sequence
  Synthetic oligonucleotide
gtacgcccgtatgatcaaggcccttatgcaacccg

SEQ ID NO: 64151 - DNA, 35 bp, Artificial Sequence
  Synthetic oligonucleotide
gagcctgggggtgggatggacattgcgggagggtg

SEQ ID NO: 64152 - DNA, 35 bp, Artificial Sequence
  Synthetic oligonucleotide
gccactgcagactgctaatcgttcccgaaccacat

SEQ ID NO: 64153 - DNA, 35 bp, Artificial Sequence
  Synthetic oligonucleotide
acatcaagccaaatacttatatgcaaattaccact

SEQ ID NO: 64154 - DNA, 35 bp, Artificial Sequence
  Synthetic oligonucleotide
ttaacaccgagtagcgcgctaatcaggccttccct

SEQ ID NO: 64155 - DNA, 35 bp, Artificial Sequence
  Synthetic oligonucleotide
acattgtgtccccccgtcacgcttggcacgtgcct

SEQ ID NO: 64156 - DNA, 35 bp, Artificial Sequence
  Synthetic oligonucleotide
tagtcccgaacgctctcacggttatccttggttct

SEQ ID NO: 64157 - DNA, 35 bp, Artificial Sequence
  Synthetic oligonucleotide
tacggacgtccagcatacactcgcttgtcttcagt

SEQ ID NO: 64158 - DNA, 36 bp, Artificial Sequence
  Synthetic oligonucleotide
aaccgctattgtcacattgctcacatgtttccccgt

SEQ ID NO: 64159 - DNA, 35 bp, Artificial Sequence
  Synthetic oligonucleotide
atctcgatccgactcctaccaatcctcccttaggt

SEQ ID NO: 64160 - DNA, 35 bp, Artificial Sequence
  Synthetic oligonucleotide
gtatcgccatggtacgcttcgtttcatcctgtggt

SEQ ID NO: 64161 - DNA, 35 bp, Artificial Sequence
  Synthetic oligonucleotide
gaagactcgccgctactctcctcccgactttactt

SEQ ID NO: 64162 - DNA, 35 bp, Artificial Sequence
  Synthetic oligonucleotide
gctgtgcaacacgatctttctgcgcattatccgtt

SEQ ID NO: 64163 - DNA, 35 bp, Artificial Sequence
  Synthetic oligonucleotide
gccaaccttacatcgcataaaccacttgagtaaaa

SEQ ID NO: 64164 - DNA, 36 bp, Artificial Sequence
  Synthetic oligonucleotide
tgattggacactcaatggcgtagtaccaccttccaa

SEQ ID NO: 64165 - DNA, 36 bp, Artificial Sequence
  Synthetic oligonucleotide
gatagtgcgctggatcagggaagggatggtggcgaa

SEQ ID NO: 64166 - DNA, 35 bp, Artificial Sequence
  Synthetic oligonucleotide
tgcttcccgctcatccctccgctttccctaaggaa

SEQ ID NO: 64167 - DNA, 36 bp, Artificial Sequence
  Synthetic oligonucleotide
gacttcgcacacgtagtctctaaacaacctttgaca

SEQ ID NO: 64168 - DNA, 35 bp, Artificial Sequence
  Synthetic oligonucleotide
gacatccgtagccgttatatacctctgccttacca

SEQ ID NO: 64169 - DNA, 35 bp, Artificial Sequence
  Synthetic oligonucleotide
tcaacagactcacacttagaccacctcggcaccca

SEQ ID NO: 64170 - DNA, 35 bp, Artificial Sequence
  Synthetic oligonucleotide
tgagaaaaggtagcccgaagccctcccgcacccca

SEQ ID NO: 64171 - DNA, 36 bp, Artificial Sequence
  Synthetic oligonucleotide
tgtcacccgttccgcccgccgtacctttagaggcca

SEQ ID NO: 64172 - DNA, 36 bp, Artificial Sequence
  Synthetic oligonucleotide
tattccatcctccaccatgtctccgccgatatgcca

SEQ ID NO: 64173 - DNA, 36 bp, Artificial Sequence
  Synthetic oligonucleotide
gtacggccgaagggtacacatgattcgctccatcca

SEQ ID NO: 64174 - DNA, 36 bp, Artificial Sequence
  Synthetic oligonucleotide
ttgggatgcagcacgtatcctagtaccttccctgca

SEQ ID NO: 64175 - DNA, 36 bp, Artificial Sequence
  Synthetic oligonucleotide
acatcacattgctagttcatagactttaaccgtgca

SEQ ID NO: 64176 - DNA, 35 bp, Artificial Sequence
  Synthetic oligonucleotide
tgctcctgctcacctttatcggaaggactcttgca

SEQ ID NO: 64177 - DNA, 36 bp, Artificial Sequence
  Synthetic oligonucleotide
gcgatcgcccggctcccaagcaaggtcaatctttca

SEQ ID NO: 64178 - DNA, 37 bp, Artificial Sequence
  Synthetic oligonucleotide
tgcggagaggcgggtggggggaaccgggaatgtaaga

SEQ ID NO: 64179 - DNA, 36 bp, Artificial Sequence
  Synthetic oligonucleotide
acactggcccgatcaataaaatccactgccctgaga

SEQ ID NO: 64180 - DNA, 37 bp, Artificial Sequence
  Synthetic oligonucleotide
atgccgccagtgtactgtcactcatctctactcacga

SEQ ID NO: 64181 - DNA, 37 bp, Artificial Sequence
  Synthetic oligonucleotide
tcccaccgccttgccttgtatcacatcctttggacga

SEQ ID NO: 64182 - DNA, 36 bp, Artificial Sequence
  Synthetic oligonucleotide
tctggctcactcccacaccaaatccccatgtctcga

SEQ ID NO: 64183 - DNA, 37 bp, Artificial Sequence
  Synthetic oligonucleotide
tcacctcatatctcgatgttgcgtacctcctcttcga

SEQ ID NO: 64184 - DNA, 37 bp, Artificial Sequence
  Synthetic oligonucleotide
aatgtgagtgggaaggaggtaagacggagcgaaagga

SEQ ID NO: 64185 - DNA, 37 bp, Artificial Sequence
  Synthetic oligonucleotide
tgatcatcactcattgtgattcctatacaatcccgga

SEQ ID NO: 64186 - DNA, 37 bp, Artificial Sequence
  Synthetic oligonucleotide
gccgacctcgatttcctttgacgttcctaccttcgga

SEQ ID NO: 64187 - DNA, 35 bp, Artificial Sequence
  Synthetic oligonucleotide
aacagggaacggtcggtaacgggagaaatgaggga

SEQ ID NO: 64188 - DNA, 36 bp, Artificial Sequence
  Synthetic oligonucleotide
gtaacgccccatcccgctgcgccactcgtcctggga

SEQ ID NO: 64189 - DNA, 35 bp, Artificial Sequence
  Synthetic oligonucleotide
tcatccccgtacgtggcccttcataaataactgga

SEQ ID NO: 64190 - DNA, 37 bp, Artificial Sequence
  Synthetic oligonucleotide
tgaaatggtgccgtgttggcttaggttggtttctgga

SEQ ID NO: 64191 - DNA, 37 bp, Artificial Sequence
  Synthetic oligonucleotide
ggacgagcccacaccagttttacgtagcctgaaatga

SEQ ID NO: 64192 - DNA, 38 bp, Artificial Sequence
  Synthetic oligonucleotide
gtccgatgcaggttgggggtcagggaagagcgtaatga

SEQ ID NO: 64193 - DNA, 38 bp, Artificial Sequence
  Synthetic oligonucleotide
accgtcgctccactctccccattggcccagtcgtatga

SEQ ID NO: 64194 - DNA, 36 bp, Artificial Sequence
  Synthetic oligonucleotide
actccaccctatgtggaagttgaattccttaactga

SEQ ID NO: 64195 - DNA, 38 bp, Artificial Sequence
  Synthetic oligonucleotide
gatgccgccatacctgacaacgaaaggacatttagtga

SEQ ID NO: 64196 - DNA, 38 bp, Artificial Sequence
  Synthetic oligonucleotide
ttagtcgacgccagtaattatccgcccactcttcgtga

SEQ ID NO: 64197 - DNA, 38 bp, Artificial Sequence
  Synthetic oligonucleotide
aagcgacatgtatgggagggttgactttgggcgggtga

SEQ ID NO: 64198 - DNA, 36 bp, Artificial Sequence
  Synthetic oligonucleotide
aagtcacacgcggatccgatgagttgggtggggtga

SEQ ID NO: 64199 - DNA, 38 bp, Artificial Sequence
  Synthetic oligonucleotide
gcgcaacccgaaagccgggtcccattctcatgctgtga

SEQ ID NO: 64200 - DNA, 38 bp, Artificial Sequence
  Synthetic oligonucleotide
gctgggccaagggctctgcacccaacctactaccttga

SEQ ID NO: 64201 - DNA, 38 bp, Artificial Sequence
  Synthetic oligonucleotide
gagagcccatgagaaggggcaaaaatgggggtagttga

SEQ ID NO: 64202 - DNA, 38 bp, Artificial Sequence
  Synthetic oligonucleotide
tactgtgccagagttcattttcgttctgtggtggttga

SEQ ID NO: 64203 - DNA, 36 bp, Artificial Sequence
  Synthetic oligonucleotide
atcgcccaaggcaccgcacaactccccgagcatata

SEQ ID NO: 64204 - DNA, 36 bp, Artificial Sequence
  Synthetic oligonucleotide
aacattgaggcggacctttttcgacactacttccta

SEQ ID NO: 64205 - DNA, 35 bp, Artificial Sequence
  Synthetic oligonucleotide
ggacccacagcgctatagcaaccaaccccctagta

SEQ ID NO: 64206 - DNA, 36 bp, Artificial Sequence
  Synthetic oligonucleotide
acactccttcctatagtaccgttaacctgcaaggta

SEQ ID NO: 64207 - DNA, 36 bp, Artificial Sequence
  Synthetic oligonucleotide
agcaccgctggcgattagctcctgtaggccacctta

SEQ ID NO: 64208 - DNA, 35 bp, Artificial Sequence
  Synthetic oligonucleotide
gtatcccactcaagcagcttgttttcgctactgac

SEQ ID NO: 64209 - DNA, 35 bp, Artificial Sequence
  Synthetic oligonucleotide
aacactgacgtacaccctcatttgaataggtatac

SEQ ID NO: 64210 - DNA, 35 bp, Artificial Sequence
  Synthetic oligonucleotide
accgactaggctgaaaggtctatcatttgctctcc

SEQ ID NO: 64211 - DNA, 35 bp, Artificial Sequence
  Synthetic oligonucleotide
tagccactcccatcaggaggatattaatctggtcc

SEQ ID NO: 64212 - DNA, 35 bp, Artificial Sequence
  Synthetic oligonucleotide
acctctatcccgttggccatctctcgcgtgaaagc

SEQ ID NO: 64213 - DNA, 35 bp, Artificial Sequence
  Synthetic oligonucleotide
tctagctcaccggcacacatttaaacttcttgctc

SEQ ID NO: 64214 - DNA, 35 bp, Artificial Sequence
  Synthetic oligonucleotide
tctggatgcccaacgcccgcccgatcataactctc

SEQ ID NO: 64215 - DNA, 35 bp, Artificial Sequence
  Synthetic oligonucleotide
tggaagagtgccccgagtccatctgaagcaggttc

SEQ ID NO: 64216 - DNA, 35 bp, Artificial Sequence
  Synthetic oligonucleotide
actcgtgtttgacctgctgcaattggttccggttc

SEQ ID NO: 64217 - DNA, 35 bp, Artificial Sequence
  Synthetic oligonucleotide
aatgcgcaataggctgggatttgctttttggtttc

SEQ ID NO: 64218 - DNA, 35 bp, Artificial Sequence
  Synthetic oligonucleotide
gagacggaggagaaggtaatagggcgccggataag

SEQ ID NO: 64219 - DNA, 35 bp, Artificial Sequence
  Synthetic oligonucleotide
gattagccctggccaacccgaccggcccccactcg

SEQ ID NO: 64220 - DNA, 34 bp, Artificial Sequence
  Synthetic oligonucleotide
gaaaatctggaagccgcccgaaccgtactcctcg

SEQ ID NO: 64221 - DNA, 35 bp, Artificial Sequence
  Synthetic oligonucleotide
tgcacacagagtttgcatttgcgttttcctccagg

SEQ ID NO: 64222 - DNA, 35 bp, Artificial Sequence
  Synthetic oligonucleotide
gtaaatcacggcggagggattgaaccggggtgggg

SEQ ID NO: 64223 - DNA, 35 bp, Artificial Sequence
  Synthetic oligonucleotide
aaaccaaggagtggacgtaacgatggcactgggtg

SEQ ID NO: 64224 - DNA, 35 bp, Artificial Sequence
  Synthetic oligonucleotide
gacacttccgcttacatgtccacaaccgagatttg

SEQ ID NO: 64225 - DNA, 35 bp, Artificial Sequence
  Synthetic oligonucleotide
gtgaatgatgaacgggtatcagttggaggggtttg

SEQ ID NO: 64226 - DNA, 34 bp, Artificial Sequence
  Synthetic oligonucleotide
attgccccgacccacgatctaccctgatgccaat

SEQ ID NO: 64227 - DNA, 35 bp, Artificial Sequence
  Synthetic oligonucleotide
gaaaatcagccgccagtccacttcttaatcctcat

SEQ ID NO: 64228 - DNA, 35 bp, Artificial Sequence
  Synthetic oligonucleotide
accacgcgcgcctttaacttgacccggtgattcat

SEQ ID NO: 64229 - DNA, 35 bp, Artificial Sequence
  Synthetic oligonucleotide
gctaggaggaggaagggggtgggtaaaggacggat

SEQ ID NO: 64230 - DNA, 35 bp, Artificial Sequence
  Synthetic oligonucleotide
gtgtgggtaccagggggagagatcaggggcgggat

SEQ ID NO: 64231 - DNA, 35 bp, Artificial Sequence
  Synthetic oligonucleotide
tgcgtgccccaaccccgtaatggaaatgtgacact

SEQ ID NO: 64232 - DNA, 35 bp, Artificial Sequence
  Synthetic oligonucleotide
gacgtcaaacgcgtcgcctgtcctctcacaccggt

SEQ ID NO: 64233 - DNA, 35 bp, Artificial Sequence
  Synthetic oligonucleotide
tgcctcactgccatgcgctaattaacaaccattgt

SEQ ID NO: 64234 - DNA, 35 bp, Artificial Sequence
  Synthetic oligonucleotide
agcccagccttggtcgacaccccgccaaagccatt

SEQ ID NO: 64235 - DNA, 35 bp, Artificial Sequence
  Synthetic oligonucleotide
gctttgaacttctgctggcctattacacccgcctt

SEQ ID NO: 64236 - DNA, 35 bp, Artificial Sequence
  Synthetic oligonucleotide
gcgccagtcctccgctgggacgcccaccatcgctt

SEQ ID NO: 64237 - DNA, 35 bp, Artificial Sequence
  Synthetic oligonucleotide
tttccgctcgcaaaatgttgtttgccccctcagtt

SEQ ID NO: 64238 - DNA, 35 bp, Artificial Sequence
  Synthetic oligonucleotide
gctccgcgagttctacgggctatccctccctggtt

SEQ ID NO: 64239 - DNA, 35 bp, Artificial Sequence
  Synthetic oligonucleotide
acctgtccatcgaatcccccaagtgtctcaggaaa

SEQ ID NO: 64240 - DNA, 36 bp, Artificial Sequence
  Synthetic oligonucleotide
tatgccgggtccgtaagggctcaggaaggatagcaa

SEQ ID NO: 64241 - DNA, 36 bp, Artificial Sequence
  Synthetic oligonucleotide
tcccccgggcctggtaataacattctgttggcctaa

SEQ ID NO: 64242 - DNA, 35 bp, Artificial Sequence
  Synthetic oligonucleotide
agccatcctatgccacagttccgaagtactccaca

SEQ ID NO: 64243 - DNA, 36 bp, Artificial Sequence
  Synthetic oligonucleotide
atgagacattcagtccaccttgccctctccgtccca

SEQ ID NO: 64244 - DNA, 36 bp, Artificial Sequence
  Synthetic oligonucleotide
aatgcgggtagacacgggggaaagactagaagagca

SEQ ID NO: 64245 - DNA, 36 bp, Artificial Sequence
  Synthetic oligonucleotide
ttgaccgtaaaacttgcgcctccaaagacgtaatca

SEQ ID NO: 64246 - DNA, 36 bp, Artificial Sequence
  Synthetic oligonucleotide
tctccacgccatcccatgaataccgcaggcgggtca

SEQ ID NO: 64247 - DNA, 37 bp, Artificial Sequence
  Synthetic oligonucleotide
acgcctggttcccgcgccacatcccgcattttcgaga

SEQ ID NO: 64248 - DNA, 37 bp, Artificial Sequence
  Synthetic oligonucleotide
acccgccccgtgcaatctactttgactcatttataga

SEQ ID NO: 64249 - DNA, 37 bp, Artificial Sequence
  Synthetic oligonucleotide
acgttgtacctgttgccgtgattgcccacaaccccga

SEQ ID NO: 64250 - DNA, 37 bp, Artificial Sequence
  Synthetic oligonucleotide
tatcctggcccagccatctttgccgtatgtaatccga

SEQ ID NO: 64251 - DNA, 37 bp, Artificial Sequence
  Synthetic oligonucleotide
gccccaccaacttgctgcgggtatcctgattcctcga

SEQ ID NO: 64252 - DNA, 37 bp, Artificial Sequence
  Synthetic oligonucleotide
atcactccactgcgtaatactatctctccccaccgga

SEQ ID NO: 64253 - DNA, 37 bp, Artificial Sequence
  Synthetic oligonucleotide
tcaacgagtggaagggcgtgggggactacctgaggga

SEQ ID NO: 64254 - DNA, 36 bp, Artificial Sequence
  Synthetic oligonucleotide
gaatacgattgcaagggaaggggaccgccataggga

SEQ ID NO: 64255 - DNA, 36 bp, Artificial Sequence
  Synthetic oligonucleotide
acccagggagagggagatggacgtgcgggagttgga

SEQ ID NO: 64256 - DNA, 37 bp, Artificial Sequence
  Synthetic oligonucleotide
ggacgggtacatggggctatggggagagggtggatga

SEQ ID NO: 64257 - DNA, 36 bp, Artificial Sequence
  Synthetic oligonucleotide
actgcaccgcgcattgttagtcctgcccccctatga

SEQ ID NO: 64258 - DNA, 35 bp, Artificial Sequence
  Synthetic oligonucleotide
gtctaccccatctgatagttgccttccaagtatga

SEQ ID NO: 64259 - DNA, 37 bp, Artificial Sequence
  Synthetic oligonucleotide
ttacgtacacctgtttgcctatacacaatagccctga

SEQ ID NO: 64260 - DNA, 37 bp, Artificial Sequence
  Synthetic oligonucleotide
gatatgcgtggccggggggacggggaaatttagctga

SEQ ID NO: 64261 - DNA, 38 bp, Artificial Sequence
  Synthetic oligonucleotide
aagttgacccgcttgatctgcataccgcacacctctga

SEQ ID NO: 64262 - DNA, 38 bp, Artificial Sequence
  Synthetic oligonucleotide
gacactgtcaaagtgggaggtggggagattttttctga

SEQ ID NO: 64263 - DNA, 38 bp, Artificial Sequence
  Synthetic oligonucleotide
gttgtgggggactagtggtagtggtagggagcgagtga

SEQ ID NO: 64264 - DNA, 38 bp, Artificial Sequence
  Synthetic oligonucleotide
gggatgcggagggaatggttagggtaattgcggggtga

SEQ ID NO: 64265 - DNA, 38 bp, Artificial Sequence
  Synthetic oligonucleotide
gataagggaggggtagaagcgtaaataacagcctgtga

SEQ ID NO: 64266 - DNA, 36 bp, Artificial Sequence
  Synthetic oligonucleotide
acccacacactatattttttgcttagacggacttga

SEQ ID NO: 64267 - DNA, 38 bp, Artificial Sequence
  Synthetic oligonucleotide
aagtcacgaacctagcatgggtggggggaggacgttga

SEQ ID NO: 64268 - DNA, 38 bp, Artificial Sequence
  Synthetic oligonucleotide
tcactacgatcgatgggtggtgggccgggtcgggttga

SEQ ID NO: 64269 - DNA, 38 bp, Artificial Sequence
  Synthetic oligonucleotide
tccccgacgctcacatttttgccagggccaacttttga

SEQ ID NO: 64270 - DNA, 36 bp, Artificial Sequence
  Synthetic oligonucleotide
tgctgaccccctgcgccagactacctctcatttgta

SEQ ID NO: 64271 - DNA, 36 bp, Artificial Sequence
  Synthetic oligonucleotide
accgctccgccgaatcccgttagccacacaatatta

SEQ ID NO: 64272 - DNA, 35 bp, Artificial Sequence
  Synthetic oligonucleotide
gagtcccctacgcgtagtccttgtttccgttatac

SEQ ID NO: 64273 - DNA, 35 bp, Artificial Sequence
  Synthetic oligonucleotide
acaccggttctgacttatttttggggcgctcctac

SEQ ID NO: 64274 - DNA, 35 bp, Artificial Sequence
  Synthetic oligonucleotide
gttgcactggcaccacctttgtagccaatccttac

SEQ ID NO: 64275 - DNA, 35 bp, Artificial Sequence
  Synthetic oligonucleotide
gatgcggatgtcagtcacgcatcttcatgtcttac

SEQ ID NO: 64276 - DNA, 35 bp, Artificial Sequence
  Synthetic oligonucleotide
ggtgcctcattcctgggctcaacgcactttcgacc

SEQ ID NO: 64277 - DNA, 35 bp, Artificial Sequence
  Synthetic oligonucleotide
gactggccgcaggttttcatgccttgtctataccc

SEQ ID NO: 64278 - DNA, 35 bp, Artificial Sequence
  Synthetic oligonucleotide
agttcgccgttcccgaccaatattgggtgcactcc

SEQ ID NO: 64279 - DNA, 35 bp, Artificial Sequence
  Synthetic oligonucleotide
gcccaatatggtccctagccgtaaaacgagcctcc

SEQ ID NO: 64280 - DNA, 35 bp, Artificial Sequence
  Synthetic oligonucleotide
agtgcccttctatctcgttcatgcaactgttccgc

SEQ ID NO: 64281 - DNA, 35 bp, Artificial Sequence
  Synthetic oligonucleotide
agcgcgctccactgcggtcccatttcatgctctgc

SEQ ID NO: 64282 - DNA, 35 bp, Artificial Sequence
  Synthetic oligonucleotide
aggagcccgaaacgttctgaataccccgcccgtgc

SEQ ID NO: 64283 - DNA, 35 bp, Artificial Sequence
  Synthetic oligonucleotide
tttcgcctcatacgtttcctagcacgcttctttgc

SEQ ID NO: 64284 - DNA, 35 bp, Artificial Sequence
  Synthetic oligonucleotide
tacacacaagtgcaagcttacgtactgacgtcctc

SEQ ID NO: 64285 - DNA, 35 bp, Artificial Sequence
  Synthetic oligonucleotide
ttggcccaaatgcgggtgcctcatctcgtttcctc

SEQ ID NO: 64286 - DNA, 35 bp, Artificial Sequence
  Synthetic oligonucleotide
gagaggcgagctgctcgcgtcatttcaacccattc

SEQ ID NO: 64287 - DNA, 35 bp, Artificial Sequence
  Synthetic oligonucleotide
gaatgaaaggtgaataaaacggacgactgggggag

SEQ ID NO: 64288 - DNA, 35 bp, Artificial Sequence
  Synthetic oligonucleotide
actacccccggacataagcacccttctcctatgag

SEQ ID NO: 64289 - DNA, 35 bp, Artificial Sequence
  Synthetic oligonucleotide
aaggatgagatgggattgaggtaagcgtataaggg

SEQ ID NO: 64290 - DNA, 35 bp, Artificial Sequence
  Synthetic oligonucleotide
gcacaggggttgcggtgggttgcggtcgggtgggg

SEQ ID NO: 64291 - DNA, 35 bp, Artificial Sequence
  Synthetic oligonucleotide
ggactaccagtactatggggatcgggaggtgtggg

SEQ ID NO: 64292 - DNA, 35 bp, Artificial Sequence
  Synthetic oligonucleotide
tacacccagcccacacccccgccgaggcatccgtg

SEQ ID NO: 64293 - DNA, 35 bp, Artificial Sequence
  Synthetic oligonucleotide
actcaaacgggggtaggggaaatgaaagtcgaaat

SEQ ID NO: 64294 - DNA, 35 bp, Artificial Sequence
  Synthetic oligonucleotide
gaaaaccatcctgtttccgttaagatctccttgat

SEQ ID NO: 64295 - DNA, 35 bp, Artificial Sequence
  Synthetic oligonucleotide
atccaccccaaccacggtagtggtgaaatcaaact

SEQ ID NO: 64296 - DNA, 36 bp, Artificial Sequence
  Synthetic oligonucleotide
gcaaactgtcgccggaatcgccaagtacttcgccct

SEQ ID NO: 64297 - DNA, 35 bp, Artificial Sequence
  Synthetic oligonucleotide
ttcgagtgatctcgcctgtatcctccgattgccct

SEQ ID NO: 64298 - DNA, 35 bp, Artificial Sequence
  Synthetic oligonucleotide
atgaaatagcctcaccgggtgctttcgtactccct

SEQ ID NO: 64299 - DNA, 35 bp, Artificial Sequence
  Synthetic oligonucleotide
gccatggatcaataaacagtctcgccaggtatcct

SEQ ID NO: 64300 - DNA, 35 bp, Artificial Sequence
  Synthetic oligonucleotide
gacacccgccttgttcctttatggtgatccctgct

SEQ ID NO: 64301 - DNA, 35 bp, Artificial Sequence
  Synthetic oligonucleotide
tctaccagccacaagcttaggccgtatttattgct

SEQ ID NO: 64302 - DNA, 35 bp, Artificial Sequence
  Synthetic oligonucleotide
ttatcgcgaggacctcggccgaacaccttgtctct

SEQ ID NO: 64303 - DNA, 35 bp, Artificial Sequence
  Synthetic oligonucleotide
ttcgactggctgcctgcttcttcaacctaaagggt

SEQ ID NO: 64304 - DNA, 35 bp, Artificial Sequence
  Synthetic oligonucleotide
agtggaggcccaagttaatgacgggttgggagggt

SEQ ID NO: 64305 - DNA, 35 bp, Artificial Sequence
  Synthetic oligonucleotide
gccacgcacgccattgcctacttactacggttatt

SEQ ID NO: 64306 - DNA, 35 bp, Artificial Sequence
  Synthetic oligonucleotide
tatgcacggaccacctcaacatgcacctggttatt

SEQ ID NO: 64307 - DNA, 35 bp, Artificial Sequence
  Synthetic oligonucleotide
ttggagtcctctgttcgcaacgaaacctgttcctt

SEQ ID NO: 64308 - DNA, 35 bp, Artificial Sequence
  Synthetic oligonucleotide
gctcctccgccaaatctctggacctatcagttctt

SEQ ID NO: 64309 - DNA, 35 bp, Artificial Sequence
  Synthetic oligonucleotide
actgcggttaccttcccactccctgaggatctgtt

SEQ ID NO: 64310 - DNA, 35 bp, Artificial Sequence
  Synthetic oligonucleotide
tatctgctggaccctaggggtggttttgctttttt

SEQ ID NO: 64311 - DNA, 36 bp, Artificial Sequence
  Synthetic oligonucleotide
gtgaccgtctcgccgcaataaaacgatgttgcccaa

SEQ ID NO: 64312 - DNA, 36 bp, Artificial Sequence
  Synthetic oligonucleotide
tagtcccccgtttctgcgtttctacatctcagtcaa

SEQ ID NO: 64313 - DNA, 35 bp, Artificial Sequence
  Synthetic oligonucleotide
gatgacgcccaccatctaatctggctccccactaa

SEQ ID NO: 64314 - DNA, 36 bp, Artificial Sequence
  Synthetic oligonucleotide
gagcacatccccgccctcagcacctgactgccctaa

SEQ ID NO: 64315 - DNA, 36 bp, Artificial Sequence
  Synthetic oligonucleotide
gtggccctccacggtttttgttcggtcaatccctaa

SEQ ID NO: 64316 - DNA, 35 bp, Artificial Sequence
  Synthetic oligonucleotide
gaacaggcgaggacgtcgccggctcttttcattaa

SEQ ID NO: 64317 - DNA, 36 bp, Artificial Sequence
  Synthetic oligonucleotide
tgtttgcacctgtctacaacccatgatatcactaca

SEQ ID NO: 64318 - DNA, 35 bp, Artificial Sequence
  Synthetic oligonucleotide
tccacacagggattaacttggacatcgtgccacca

SEQ ID NO: 64319 - DNA, 35 bp, Artificial Sequence
  Synthetic oligonucleotide
tgcctcaaccatccataggaacactgctgatgcca

SEQ ID NO: 64320 - DNA, 36 bp, Artificial Sequence
  Synthetic oligonucleotide
ggatgcccatacagtctgtacgatcattgccatcca

SEQ ID NO: 64321 - DNA, 36 bp, Artificial Sequence
  Synthetic oligonucleotide
aacacaccagccgcccatagaacagtcaacgtagca

SEQ ID NO: 64322 - DNA, 36 bp, Artificial Sequence
  Synthetic oligonucleotide
acatccaccccgacaactagcataaaggtccacgca

SEQ ID NO: 64323 - DNA, 36 bp, Artificial Sequence
  Synthetic oligonucleotide
gccagccgcccctaggctcccatgccagtattcgca

SEQ ID NO: 64324 - DNA, 36 bp, Artificial Sequence
  Synthetic oligonucleotide
atcgctatgccgcatgggagagcgactctcacctca

SEQ ID NO: 64325 - DNA, 36 bp, Artificial Sequence
  Synthetic oligonucleotide
taccatgagacatgtcgctatatgcgcatgttttca

SEQ ID NO: 64326 - DNA, 37 bp, Artificial Sequence
  Synthetic oligonucleotide
gaaaaggcgatcggaagttgggaggggcattgtaaga

SEQ ID NO: 64327 - DNA, 36 bp, Artificial Sequence
  Synthetic oligonucleotide
gctgcaggtgccctgctgccgcccttacctcacaga

SEQ ID NO: 64328 - DNA, 35 bp, Artificial Sequence
  Synthetic oligonucleotide
tctgaagaagggtgggtagtaggctgggtatcaga

SEQ ID NO: 64329 - DNA, 35 bp, Artificial Sequence
  Synthetic oligonucleotide
tctcgacacctcactcgtttaacccaatcgctaga

SEQ ID NO: 64330 - DNA, 37 bp, Artificial Sequence
  Synthetic oligonucleotide
aagccacccgcaggatcctccgctgcttgacatacga

SEQ ID NO: 64331 - DNA, 37 bp, Artificial Sequence
  Synthetic oligonucleotide
agtacacactgcgatacgctacccgagattacctcga

SEQ ID NO: 64332 - DNA, 37 bp, Artificial Sequence
  Synthetic oligonucleotide
gacatcagtgcagacattaactgggccaccctctcga

SEQ ID NO: 64333 - DNA, 37 bp, Artificial Sequence
  Synthetic oligonucleotide
agcaagatcacggaggagaaggggttagcagtttcga

SEQ ID NO: 64334 - DNA, 37 bp, Artificial Sequence
  Synthetic oligonucleotide
acctgcacacagggggggagagggtggaaggagcgga

SEQ ID NO: 64335 - DNA, 37 bp, Artificial Sequence
  Synthetic oligonucleotide
agcggagactgcctggggggcatgggggagtgaggga

SEQ ID NO: 64336 - DNA, 37 bp, Artificial Sequence
  Synthetic oligonucleotide
gcacgtaatccccctgcttatggttcgctccccggga

SEQ ID NO: 64337 - DNA, 36 bp, Artificial Sequence
  Synthetic oligonucleotide
tgccggacacgggataacactgcattggggagggga

SEQ ID NO: 64338 - DNA, 37 bp, Artificial Sequence
  Synthetic oligonucleotide
tcatgcgaactgaggtggggggcgcggcgggttggga

SEQ ID NO: 64339 - DNA, 38 bp, Artificial Sequence
  Synthetic oligonucleotide
tgtgtcgtgccaattggttcctgctaccgttctaatga

SEQ ID NO: 64340 - DNA, 38 bp, Artificial Sequence
  Synthetic oligonucleotide
gtcgggcgcgaagggtgggcgggtaaatgatgccatga

SEQ ID NO: 64341 - DNA, 35 bp, Artificial Sequence
  Synthetic oligonucleotide
tcttaccacctctaccataggacgtctattcatga

SEQ ID NO: 64342 - DNA, 38 bp, Artificial Sequence
  Synthetic oligonucleotide
agcacgggtggggagtaatgcaaacgcattaaaactga

SEQ ID NO: 64343 - DNA, 36 bp, Artificial Sequence
  Synthetic oligonucleotide
tgttcactgcctccttgggattcttcgtccaactga

SEQ ID NO: 64344 - DNA, 37 bp, Artificial Sequence
  Synthetic oligonucleotide
gtgccagagatgtccccacccgcacgatacacactga

SEQ ID NO: 64345 - DNA, 37 bp, Artificial Sequence
  Synthetic oligonucleotide
atgcctgcaaaggctgggcaaaaccacacttcactga

SEQ ID NO: 64346 - DNA, 38 bp, Artificial Sequence
  Synthetic oligonucleotide
tcgccccttgcctgagtctggccccgttgtttcactga

SEQ ID NO: 64347 - DNA, 38 bp, Artificial Sequence
  Synthetic oligonucleotide
atccgagagcaaaacagtaaggggtgggagaagactga

SEQ ID NO: 64348 - DNA, 38 bp, Artificial Sequence
  Synthetic oligonucleotide
tgaacgccggtgcgaagaacactatatgcccctactga

SEQ ID NO: 64349 - DNA, 36 bp, Artificial Sequence
  Synthetic oligonucleotide
atgtcaccatcgatccctgcctctatgttccgctga

SEQ ID NO: 64350 - DNA, 38 bp, Artificial Sequence
  Synthetic oligonucleotide
gtacataggggagggaagaggggttgatacaggtctga

SEQ ID NO: 64351 - DNA, 38 bp, Artificial Sequence
  Synthetic oligonucleotide
tgactgggggaagacgggtgtaaatcggggaggggtga

SEQ ID NO: 64352 - DNA, 38 bp, Artificial Sequence
  Synthetic oligonucleotide
agcgtactgcggtcgtcctctcgctggctttccattga

SEQ ID NO: 64353 - DNA, 37 bp, Artificial Sequence
  Synthetic oligonucleotide
gaccgaggggaggttgtgctttgtgtggcggtattga

SEQ ID NO: 64354 - DNA, 37 bp, Artificial Sequence
  Synthetic oligonucleotide
tcctcacgtaaccttcatagcgaacctgacttattga

SEQ ID NO: 64355 - DNA, 38 bp, Artificial Sequence
  Synthetic oligonucleotide
tgcaccgatcggtccaatcttcccgtcaccctagttga

SEQ ID NO: 64356 - DNA, 38 bp, Artificial Sequence
  Synthetic oligonucleotide
ggtgtgtccagatgttcttttctctcgccttccgttga

SEQ ID NO: 64357 - DNA, 36 bp, Artificial Sequence
  Synthetic oligonucleotide
tccgacgtttcccttgtgcggtattgccccttttga

SEQ ID NO: 64358 - DNA, 38 bp, Artificial Sequence
  Synthetic oligonucleotide
tcctacctgtcacccgtagttcttagtgggccttttga

SEQ ID NO: 64359 - DNA, 35 bp, Artificial Sequence
  Synthetic oligonucleotide
acgacgcaactaaggcgggggtaggtaggggtata

SEQ ID NO: 64360 - DNA, 36 bp, Artificial Sequence
  Synthetic oligonucleotide
gtcgttgcacctcgttgcccccttccaacagttata

SEQ ID NO: 64361 - DNA, 37 bp, Artificial Sequence
  Synthetic oligonucleotide
tccacatactgtcaagggatcctggccttcataacta

SEQ ID NO: 64362 - DNA, 36 bp, Artificial Sequence
  Synthetic oligonucleotide
ttagccggtagaggcgatcactccacttgtccccta

SEQ ID NO: 64363 - DNA, 36 bp, Artificial Sequence
  Synthetic oligonucleotide
gtgagcaacagttgggtgaacgggctgggaacggta

SEQ ID NO: 64364 - DNA, 36 bp, Artificial Sequence
  Synthetic oligonucleotide
gacaatcccagagatgcattgaatccaatcccgtta

SEQ ID NO: 64365 - DNA, 35 bp, Artificial Sequence
  Synthetic oligonucleotide
acacgtgccgccacacctccctctattgttacaac

SEQ ID NO: 64366 - DNA, 35 bp, Artificial Sequence
  Synthetic oligonucleotide
gtgtcctgtcaccgccttttctggattacgttaac

SEQ ID NO: 64367 - DNA, 35 bp, Artificial Sequence
  Synthetic oligonucleotide
gttgcctcctgttctccgtagttgcgccggtgcac

SEQ ID NO: 64368 - DNA, 35 bp, Artificial Sequence
  Synthetic oligonucleotide
gataactgcagcagcgtggcaactccgaacaaacc

SEQ ID NO: 64369 - DNA, 35 bp, Artificial Sequence
  Synthetic oligonucleotide
ttgagcaacagaccccctttggattcggtaatacc

SEQ ID NO: 64370 - DNA, 35 bp, Artificial Sequence
  Synthetic oligonucleotide
acccgccaaaaattgtcccttcgtcaaggaacccc

SEQ ID NO: 64371 - DNA, 35 bp, Artificial Sequence
  Synthetic oligonucleotide
atgagaggagtacggggagggatgcatgtgcgagc

SEQ ID NO: 64372 - DNA, 36 bp, Artificial Sequence
  Synthetic oligonucleotide
tcactccgccgtccacacgactccgccttcgcctgc

SEQ ID NO: 64373 - DNA, 35 bp, Artificial Sequence
  Synthetic oligonucleotide
agtcctgtcgtagctcacctatcacttgtaatatc

SEQ ID NO: 64374 - DNA, 35 bp, Artificial Sequence
  Synthetic oligonucleotide
gttacccccctgcaccgatgtggggctcgtccttc

SEQ ID NO: 64375 - DNA, 35 bp, Artificial Sequence
  Synthetic oligonucleotide
tcacttcgcacccacttaactctagctcggtcttc

SEQ ID NO: 64376 - DNA, 35 bp, Artificial Sequence
  Synthetic oligonucleotide
gctcagtgcaatgttacgttatcggtgctgggttc

SEQ ID NO: 64377 - DNA, 35 bp, Artificial Sequence
  Synthetic oligonucleotide
atcggtcagcccatgtagttctttcgtgccgtttc

SEQ ID NO: 64378 - DNA, 35 bp, Artificial Sequence
  Synthetic oligonucleotide
tgttaccccgccgctactcttcagctattctgcag

SEQ ID NO: 64379 - DNA, 35 bp, Artificial Sequence
  Synthetic oligonucleotide
acctgactgtcccctccccacattattgccgagag

SEQ ID NO: 64380 - DNA, 35 bp, Artificial Sequence
  Synthetic oligonucleotide
tttgcgctagcatcgtcattctcgggttctttggg

SEQ ID NO: 64381 - DNA, 35 bp, Artificial Sequence
  Synthetic oligonucleotide
tcagccgggcaaggattggattttgggttgttgtg

SEQ ID NO: 64382 - DNA, 35 bp, Artificial Sequence
  Synthetic oligonucleotide
aacactccccgcgaccccctccgggaacccttgat

SEQ ID NO: 64383 - DNA, 35 bp, Artificial Sequence
  Synthetic oligonucleotide
actccactgaagccctggctcctcaggctatttat

SEQ ID NO: 64384 - DNA, 35 bp, Artificial Sequence
  Synthetic oligonucleotide
tgcacgccacccctccccactacgaatgcctcact

SEQ ID NO: 64385 - DNA, 35 bp, Artificial Sequence
  Synthetic oligonucleotide
tcctattctgcgccggttcgctatcgcgcctccct

SEQ ID NO: 64386 - DNA, 35 bp, Artificial Sequence
  Synthetic oligonucleotide
ttactagcctgccactcgaagctagccttttgcct

SEQ ID NO: 64387 - DNA, 35 bp, Artificial Sequence
  Synthetic oligonucleotide
gatcacggtccttacgagccccacaatagcatgct

SEQ ID NO: 64388 - DNA, 35 bp, Artificial Sequence
  Synthetic oligonucleotide
ttcgacgtactccctcaaccacattgtatggatct

SEQ ID NO: 64389 - DNA, 35 bp, Artificial Sequence
  Synthetic oligonucleotide
gtgggaaccaccgttactggccctagcatacctgt

SEQ ID NO: 64390 - DNA, 35 bp, Artificial Sequence
  Synthetic oligonucleotide
gatccaccgcactgctgaaccctaaccagtcactt

SEQ ID NO: 64391 - DNA, 35 bp, Artificial Sequence
  Synthetic oligonucleotide
ggtgtagtgtgcagctccatatatctctttttgtt

SEQ ID NO: 64392 - DNA, 35 bp, Artificial Sequence
  Synthetic oligonucleotide
tcgtatcgatcctcgagtagtctttgccactcttt

SEQ ID NO: 64393 - DNA, 35 bp, Artificial Sequence
  Synthetic oligonucleotide
gcacccctgctggctagcaattttcggtccagttt

SEQ ID NO: 64394 - DNA, 35 bp, Artificial Sequence
  Synthetic oligonucleotide
aacgcaccctcgtggggcatctcccatctgttttt

SEQ ID NO: 64395 - DNA, 36 bp, Artificial Sequence
  Synthetic oligonucleotide
gcgtaagccgcgcgtagtatctcacttcatactaaa

SEQ ID NO: 64396 - DNA, 36 bp, Artificial Sequence
  Synthetic oligonucleotide
ttccagccacgtcgtcgacccgcacatagcgctaaa

SEQ ID NO: 64397 - DNA, 36 bp, Artificial Sequence
  Synthetic oligonucleotide
ttgggggggacgagtaaagcgagggggacaatccaa

SEQ ID NO: 64398 - DNA, 36 bp, Artificial Sequence
  Synthetic oligonucleotide
atcccacacattgactcgccaagacctggtatccaa

SEQ ID NO: 64399 - DNA, 36 bp, Artificial Sequence
  Synthetic oligonucleotide
gatcgctacacccctggtttacatgttcctgatcaa

SEQ ID NO: 64400 - DNA, 35 bp, Artificial Sequence
  Synthetic oligonucleotide
gacgaaaagcacagaaaggggggggcgccaacgaa

SEQ ID NO: 64401 - DNA, 35 bp, Artificial Sequence
  Synthetic oligonucleotide
gacacaggccgaagcggtcggaagtagggtaaaca

SEQ ID NO: 64402 - DNA, 36 bp, Artificial Sequence
  Synthetic oligonucleotide
tcgtaccctcgctgcaaacttatctcagcctagcca

SEQ ID NO: 64403 - DNA, 36 bp, Artificial Sequence
  Synthetic oligonucleotide
agttagcaccacgcccgatctctcacgcctgatcca

SEQ ID NO: 64404 - DNA, 36 bp, Artificial Sequence
  Synthetic oligonucleotide
gacctaacccctgtatgtagaatttcagcttgtcca

SEQ ID NO: 64405 - DNA, 35 bp, Artificial Sequence
  Synthetic oligonucleotide
atcactttgcgcccgacccgcgatttcacgacgca

SEQ ID NO: 64406 - DNA, 36 bp, Artificial Sequence
  Synthetic oligonucleotide
agatccctgtgaacgtcccccgccttgtaccccgca

SEQ ID NO: 64407 - DNA, 35 bp, Artificial Sequence
  Synthetic oligonucleotide
gaccacccatgaacgggtagaacagttgttctgca

SEQ ID NO: 64408 - DNA, 35 bp, Artificial Sequence
  Synthetic oligonucleotide
gacgccgcaactggagagttgcgtattccatatca

SEQ ID NO: 64409 - DNA, 36 bp, Artificial Sequence
  Synthetic oligonucleotide
gtgaacggccagttgttgatcccatgcgtccggtca

SEQ ID NO: 64410 - DNA, 36 bp, Artificial Sequence
  Synthetic oligonucleotide
acgatcgtcccgacccagcgcacacgcttcctgtca

SEQ ID NO: 64411 - DNA, 36 bp, Artificial Sequence
  Synthetic oligonucleotide
tcaaccgctccctgtctgcttcttactggcccttca

SEQ ID NO: 64412 - DNA, 37 bp, Artificial Sequence
  Synthetic oligonucleotide
agataaggggtgagggtaggggaggatggaggtaaga

SEQ ID NO: 64413 - DNA, 37 bp, Artificial Sequence
  Synthetic oligonucleotide
aacgtctaacgcctgcttcgttcactttctacccaga

SEQ ID NO: 64414 - DNA, 36 bp, Artificial Sequence
  Synthetic oligonucleotide
gcgggctccctctgacgcgctactataacatcgaga

SEQ ID NO: 64415 - DNA, 36 bp, Artificial Sequence
  Synthetic oligonucleotide
ttacaccatctctacacccggatcagtcgaatgaga

SEQ ID NO: 64416 - DNA, 37 bp, Artificial Sequence
  Synthetic oligonucleotide
ttggttccgtccacctagcccgatagcacctctgaga

SEQ ID NO: 64417 - DNA, 37 bp, Artificial Sequence
  Synthetic oligonucleotide
ggaccccctcatcggaattgaccacttgatgtaacga

SEQ ID NO: 64418 - DNA, 37 bp, Artificial Sequence
  Synthetic oligonucleotide
gacctgcattgatagcctcccctctgtccggacccga

SEQ ID NO: 64419 - DNA, 37 bp, Artificial Sequence
  Synthetic oligonucleotide
taccccactccagataagtacttgggtaaccccccga

SEQ ID NO: 64420 - DNA, 35 bp, Artificial Sequence
  Synthetic oligonucleotide
tcgatacgacgacagccctcagctgcatctcccga

SEQ ID NO: 64421 - DNA, 37 bp, Artificial Sequence
  Synthetic oligonucleotide
gccacatcacaccagtcagcttctctattcttgtcga

SEQ ID NO: 64422 - DNA, 37 bp, Artificial Sequence
  Synthetic oligonucleotide
aacgcgaccacagatgactctgattagacttcacgga

SEQ ID NO: 64423 - DNA, 37 bp, Artificial Sequence
  Synthetic oligonucleotide
tcacctaccatctcattgttattttgggattcccgga

SEQ ID NO: 64424 - DNA, 37 bp, Artificial Sequence
  Synthetic oligonucleotide
gtcaggcgcaaccctgccagccgcctttctacctgga

SEQ ID NO: 64425 - DNA, 37 bp, Artificial Sequence
  Synthetic oligonucleotide
tgccaacggccatccactgcttagggcttcgcttgga

SEQ ID NO: 64426 - DNA, 37 bp, Artificial Sequence
  Synthetic oligonucleotide
tgctccgtctgccgtcctctctttgggccatcttgga

SEQ ID NO: 64427 - DNA, 38 bp, Artificial Sequence
  Synthetic oligonucleotide
attgcaacgaacgcgagtggtttgcaggggggagatga

SEQ ID NO: 64428 - DNA, 38 bp, Artificial Sequence
  Synthetic oligonucleotide
tccacacgtcgtttgctctcgtgcccttgtgcctatga

SEQ ID NO: 64429 - DNA, 38 bp, Artificial Sequence
  Synthetic oligonucleotide
atcttggcccattaaactacggcccagtcctttcctga

SEQ ID NO: 64430 - DNA, 38 bp, Artificial Sequence
  Synthetic oligonucleotide
actgcactgccgcttcacaagcgcccctcttccgctga

SEQ ID NO: 64431 - DNA, 37 bp, Artificial Sequence
  Synthetic oligonucleotide
tgctcgtccgccaatcgccccccctgaacccggctga

SEQ ID NO: 64432 - DNA, 38 bp, Artificial Sequence
  Synthetic oligonucleotide
gatgcgcctcctcagtgtaccccagtttctcttgctga

SEQ ID NO: 64433 - DNA, 37 bp, Artificial Sequence
  Synthetic oligonucleotide
gcgacccccctgaagcaaactgtcttgtctctagtga

SEQ ID NO: 64434 - DNA, 38 bp, Artificial Sequence
  Synthetic oligonucleotide
agtcggggagccatttggtggggggctcagtggggtga

SEQ ID NO: 64435 - DNA, 38 bp, Artificial Sequence
  Synthetic oligonucleotide
tccagggacaagatgctactctctccagcctcacttga

SEQ ID NO: 64436 - DNA, 38 bp, Artificial Sequence
  Synthetic oligonucleotide
tgcagtgcaatatggtcacgctcctcacccgtacttga

SEQ ID NO: 64437 - DNA, 37 bp, Artificial Sequence
  Synthetic oligonucleotide
tgactacaagcgtatggcctgctccctcctgtcttga

SEQ ID NO: 64438 - DNA, 38 bp, Artificial Sequence
  Synthetic oligonucleotide
gtttccacagcttgcgtttacgttagccctccatttga

SEQ ID NO: 64439 - DNA, 38 bp, Artificial Sequence
  Synthetic oligonucleotide
aatcgccggcgcatgcatgatctcgaacgcgattttga

SEQ ID NO: 64440 - DNA, 36 bp, Artificial Sequence
  Synthetic oligonucleotide
aaaacccgcccagcacttcaatccccaggtttttga

SEQ ID NO: 64441 - DNA, 36 bp, Artificial Sequence
  Synthetic oligonucleotide
tctgacgcacagcaaggctgaagatcgactaccata

SEQ ID NO: 64442 - DNA, 36 bp, Artificial Sequence
  Synthetic oligonucleotide
gcgtaacgtcaggcttaatcgggcgcaatcatccta

SEQ ID NO: 64443 - DNA, 36 bp, Artificial Sequence
  Synthetic oligonucleotide
gactgtcaggccggggttgggaaggatctttggcta

SEQ ID NO: 64444 - DNA, 36 bp, Artificial Sequence
  Synthetic oligonucleotide
ccacacatcgggttcgatgtctatgtcttgcctcta

SEQ ID NO: 64445 - DNA, 36 bp, Artificial Sequence
  Synthetic oligonucleotide
gtgtggcgctacaattctctacctctaggcctggta

SEQ ID NO: 64446 - DNA, 35 bp, Artificial Sequence
  Synthetic oligonucleotide
acatcgcatagcatttatgcaccctttcgttgtta

SEQ ID NO: 64447 - DNA, 35 bp, Artificial Sequence
  Synthetic oligonucleotide
gcaccattgtccctacgctgttgacgcctttgtta

SEQ ID NO: 64448 - DNA, 35 bp, Artificial Sequence
  Synthetic oligonucleotide
ttgtcgcccctccagccaagtccgcagaacgatac

SEQ ID NO: 64449 - DNA, 35 bp, Artificial Sequence
  Synthetic oligonucleotide
gaaactgcagccggcgcccgcttgtcacctgctac

SEQ ID NO: 64450 - DNA, 35 bp, Artificial Sequence
  Synthetic oligonucleotide
gtgaaggcctcggcatctatttagcccgcctctac

SEQ ID NO: 64451 - DNA, 35 bp, Artificial Sequence
  Synthetic oligonucleotide
gatgcggtccgtgcgctacactagtaagcacttac

SEQ ID NO: 64452 - DNA, 34 bp, Artificial Sequence
  Synthetic oligonucleotide
aatctgctccacctatccctgataacggtcgacc

SEQ ID NO: 64453 - DNA, 35 bp, Artificial Sequence
  Synthetic oligonucleotide
gtcccgccaccctgaagtaaaggatcaagccaccc

SEQ ID NO: 64454 - DNA, 35 bp, Artificial Sequence
  Synthetic oligonucleotide
gactgcgcaatgtaagttcgaacgtcactcgcccc

SEQ ID NO: 64455 - DNA, 35 bp, Artificial Sequence
  Synthetic oligonucleotide
tgcccgcgctcctccccctcttcgtgcgtaggccc

SEQ ID NO: 64456 - DNA, 35 bp, Artificial Sequence
  Synthetic oligonucleotide
gtttaaggcactccattctcgttcgtcaccatccc

SEQ ID NO: 64457 - DNA, 34 bp, Artificial Sequence
  Synthetic oligonucleotide
acacccccccctgctatcttattactttgtagcc

SEQ ID NO: 64458 - DNA, 35 bp, Artificial Sequence
  Synthetic oligonucleotide
ccatatcaccgcagcagcgaaacaccgcgtactcc

SEQ ID NO: 64459 - DNA, 35 bp, Artificial Sequence
  Synthetic oligonucleotide
aagaccatgcgatcatgcgaagccatcattgctcc

SEQ ID NO: 64460 - DNA, 35 bp, Artificial Sequence
  Synthetic oligonucleotide
ttacccacagtgcaatgctttaatcggtctggtgc

SEQ ID NO: 64461 - DNA, 35 bp, Artificial Sequence
  Synthetic oligonucleotide
gttacgatgcggtgttcaactgcatatccatcatc

SEQ ID NO: 64462 - DNA, 35 bp, Artificial Sequence
  Synthetic oligonucleotide
ttcgacccattgtcatctccattgcattgatactc

SEQ ID NO: 64463 - DNA, 35 bp, Artificial Sequence
  Synthetic oligonucleotide
agcgctcacccctgtctaggatcgttggacccctc

SEQ ID NO: 64464 - DNA, 35 bp, Artificial Sequence
  Synthetic oligonucleotide
gcgtagtcgtaagactagcgccgaaacttgcattc

SEQ ID NO: 64465 - DNA, 35 bp, Artificial Sequence
  Synthetic oligonucleotide
ttgtagcccgcctaccccccgccaccgattcattc

SEQ ID NO: 64466 - DNA, 35 bp, Artificial Sequence
  Synthetic oligonucleotide
tccaccaccagttatctgccgttgtcactctcttc

SEQ ID NO: 64467 - DNA, 35 bp, Artificial Sequence
  Synthetic oligonucleotide
tgtactcctctatccatcttgcggtaccttggttc

SEQ ID NO: 64468 - DNA, 35 bp, Artificial Sequence
  Synthetic oligonucleotide
gtggggggtggcagggcaggattgtttacgctcag

SEQ ID NO: 64469 - DNA, 35 bp, Artificial Sequence
  Synthetic oligonucleotide
agtgcgcgttggcaccatattacccccgaccctag

SEQ ID NO: 64470 - DNA, 35 bp, Artificial Sequence
  Synthetic oligonucleotide
tctctcatgcccttctttttgttcccgccttgacg

SEQ ID NO: 64471 - DNA, 34 bp, Artificial Sequence
  Synthetic oligonucleotide
gccgaacccgcaagcacaaacagcgagtctaccg

SEQ ID NO: 64472 - DNA, 35 bp, Artificial Sequence
  Synthetic oligonucleotide
aaatgaagccgaccgggtcatgcagcctgccttcg

SEQ ID NO: 64473 - DNA, 35 bp, Artificial Sequence
  Synthetic oligonucleotide
ttgcccacacaccggtgaagttcgtaacctttagg

SEQ ID NO: 64474 - DNA, 35 bp, Artificial Sequence
  Synthetic oligonucleotide
gtgaaaaggggtggaatgcgctgcagctggtaggg

SEQ ID NO: 64475 - DNA, 35 bp, Artificial Sequence
  Synthetic oligonucleotide
atctggagggatggaatgcacttggaatgaacggg

SEQ ID NO: 64476 - DNA, 35 bp, Artificial Sequence
  Synthetic oligonucleotide
gtcgagaagagggaggcggggcggatctaacatgg

SEQ ID NO: 64477 - DNA, 35 bp, Artificial Sequence
  Synthetic oligonucleotide
tggaggattgggggtggggagggtatgcacggatg

SEQ ID NO: 64478 - DNA, 35 bp, Artificial Sequence
  Synthetic oligonucleotide
gatgtactgccatgagaacgtggcaatgggttttg

SEQ ID NO: 64479 - DNA, 35 bp, Artificial Sequence
  Synthetic oligonucleotide
gatccaccgcactactgaaccctaaccagtcacat

SEQ ID NO: 64480 - DNA, 35 bp, Artificial Sequence
  Synthetic oligonucleotide
gatcacgcactgctattgtcgccatagggttccct

SEQ ID NO: 64481 - DNA, 35 bp, Artificial Sequence
  Synthetic oligonucleotide
aaagccacagccgttggaacgctagaaaaccgcct

SEQ ID NO: 64482 - DNA, 35 bp, Artificial Sequence
  Synthetic oligonucleotide
atccacagcaagccccgccgtgacccacactgcct

SEQ ID NO: 64483 - DNA, 35 bp, Artificial Sequence
  Synthetic oligonucleotide
ttggcgcccggtatgtcggttgtcatgcatcttct

SEQ ID NO: 64484 - DNA, 35 bp, Artificial Sequence
  Synthetic oligonucleotide
gtcctcagctggcgtcatcgggctcactctcctgt

SEQ ID NO: 64485 - DNA, 35 bp, Artificial Sequence
  Synthetic oligonucleotide
agcacggcccgtcctccgcccagttaaatgtttgt

SEQ ID NO: 64486 - DNA, 36 bp, Artificial Sequence
  Synthetic oligonucleotide
tgccagccccgtgcgtggccgacgctactactcaaa

SEQ ID NO: 64487 - DNA, 36 bp, Artificial Sequence
  Synthetic oligonucleotide
gccgccggtagtcccttccacttgcggacttttaaa

SEQ ID NO: 64488 - DNA, 36 bp, Artificial Sequence
  Synthetic oligonucleotide
tacatcctcctctttcgcgcattgagaaggctacaa

SEQ ID NO: 64489 - DNA, 36 bp, Artificial Sequence
  Synthetic oligonucleotide
gaatacgaggtgtggagggggctggtggcttagcaa

SEQ ID NO: 64490 - DNA, 36 bp, Artificial Sequence
  Synthetic oligonucleotide
gttaacctcgcccgtgttcacgtagcccaacctcaa

SEQ ID NO: 64491 - DNA, 36 bp, Artificial Sequence
  Synthetic oligonucleotide
tcctgcctaccgccgccgccatttgaggcccactaa

SEQ ID NO: 64492 - DNA, 36 bp, Artificial Sequence
  Synthetic oligonucleotide
atcgatagccgtatcgatacagaggtgacatgttaa

SEQ ID NO: 64493 - DNA, 36 bp, Artificial Sequence
  Synthetic oligonucleotide
attatgcccccccattttgcatccagtacggtgaca

SEQ ID NO: 64494 - DNA, 36 bp, Artificial Sequence
  Synthetic oligonucleotide
tagcaacctgcgtactttgcctccctgtgcttccca

SEQ ID NO: 64495 - DNA, 36 bp, Artificial Sequence
  Synthetic oligonucleotide
cccaacctccccgtgaccctgcgatcgtttctgcca

SEQ ID NO: 64496 - DNA, 35 bp, Artificial Sequence
  Synthetic oligonucleotide
gccggaggcccggtagcaccttgcatggaatagca

SEQ ID NO: 64497 - DNA, 36 bp, Artificial Sequence
  Synthetic oligonucleotide
tagcacgcacccgcatccatacgcttcccaatctca

SEQ ID NO: 64498 - DNA, 36 bp, Artificial Sequence
  Synthetic oligonucleotide
gaaggtctgcacatccacagtcattgccgtttttca

SEQ ID NO: 64499 - DNA, 37 bp, Artificial Sequence
  Synthetic oligonucleotide
acaggggggtgagcttgcgggggtggatgaaggaaga

SEQ ID NO: 64500 - DNA, 37 bp, Artificial Sequence
  Synthetic oligonucleotide
gtgtaaccgggtgggcaataggatgggccggggaaga

SEQ ID NO: 64501 - DNA, 37 bp, Artificial Sequence
  Synthetic oligonucleotide
agtgccgtccacacccacgctgtacatcaatcttaga

SEQ ID NO: 64502 - DNA, 37 bp, Artificial Sequence
  Synthetic oligonucleotide
gactgtcacctgtccttttagcgattccaccgcccga

SEQ ID NO: 64503 - DNA, 37 bp, Artificial Sequence
  Synthetic oligonucleotide
tccattaacatcgccggcctgttgcccttcccgccga

SEQ ID NO: 64504 - DNA, 36 bp, Artificial Sequence
  Synthetic oligonucleotide
taacggagcagaaggctcccgaagagaagacatcga

SEQ ID NO: 64505 - DNA, 37 bp, Artificial Sequence
  Synthetic oligonucleotide
ttttgcccctctggtccgctttgacatttactctcga

SEQ ID NO: 64506 - DNA, 37 bp, Artificial Sequence
  Synthetic oligonucleotide
gatagcaactagagtgagggcggacgaggagagtcga

SEQ ID NO: 64507 - DNA, 37 bp, Artificial Sequence
  Synthetic oligonucleotide
agtgcaacaggaaggttaggtgcgggggtcgagagga

SEQ ID NO: 64508 - DNA, 37 bp, Artificial Sequence
  Synthetic oligonucleotide
ggagaggggcacaggaaggacgactggcacgcacgga

SEQ ID NO: 64509 - DNA, 37 bp, Artificial Sequence
  Synthetic oligonucleotide
gcacataggggtcggggggacgaaggtccctgaggga

SEQ ID NO: 64510 - DNA, 37 bp, Artificial Sequence
  Synthetic oligonucleotide
gctgggagtcaacgaggggtgtgggatcaagggggga

SEQ ID NO: 64511 - DNA, 37 bp, Artificial Sequence
  Synthetic oligonucleotide
ttcgcctccaacgcttgccactcaattgcccatggga

SEQ ID NO: 64512 - DNA, 36 bp, Artificial Sequence
  Synthetic oligonucleotide
aacgccagggtgcttgattccctccccataactgga

SEQ ID NO: 64513 - DNA, 37 bp, Artificial Sequence
  Synthetic oligonucleotide
gtcctcctccccacccacagcctccaatctcagtgga

SEQ ID NO: 64514 - DNA, 38 bp, Artificial Sequence
  Synthetic oligonucleotide
acagccaagggaaagctcgttgaagaggaacggaatga

SEQ ID NO: 64515 - DNA, 38 bp, Artificial Sequence
  Synthetic oligonucleotide
gcctgggtccgcccacattcgccttgctctgtccatga

SEQ ID NO: 64516 - DNA, 37 bp, Artificial Sequence
  Synthetic oligonucleotide
agttacgccaacctgaactcgctcctccgctgcatga

SEQ ID NO: 64517 - DNA, 37 bp, Artificial Sequence
  Synthetic oligonucleotide
aatcggggagcttaactgggatgggaggtagggatga

SEQ ID NO: 64518 - DNA, 38 bp, Artificial Sequence
  Synthetic oligonucleotide
gccacatcacatagcgggaagacgggggatcgttatga

SEQ ID NO: 64519 - DNA, 37 bp, Artificial Sequence
  Synthetic oligonucleotide
gagaccaccttcagaacctttttaacactcggactga

SEQ ID NO: 64520 - DNA, 38 bp, Artificial Sequence
  Synthetic oligonucleotide
tgcaagtgcaatgctgccttccctcgccatagacctga

SEQ ID NO: 64521 - DNA, 37 bp, Artificial Sequence
  Synthetic oligonucleotide
tcgcaacctgtctactctgccccttcggattcgctga

SEQ ID NO: 64522 - DNA, 38 bp, Artificial Sequence
  Synthetic oligonucleotide
acacaggagtgttgttgtcggagggtggggggggctga

SEQ ID NO: 64523 - DNA, 38 bp, Artificial Sequence
  Synthetic oligonucleotide
gatgtgcccagcctatccctaccacctcgttcgcgtga

SEQ ID NO: 64524 - DNA, 38 bp, Artificial Sequence
  Synthetic oligonucleotide
gcagggtgaaggtagccaataaggtgaatgtggcgtga

SEQ ID NO: 64525 - DNA, 38 bp, Artificial Sequence
  Synthetic oligonucleotide
acccgactctctgttttgatcctcgtttacctatgtga

SEQ ID NO: 64526 - DNA, 38 bp, Artificial Sequence
  Synthetic oligonucleotide
gtagcaagctctaaagttttagccccgaactcccttga

SEQ ID NO: 64527 - DNA, 38 bp, Artificial Sequence
  Synthetic oligonucleotide
gactggcctcataacctcgcatagggctctgttcttga

SEQ ID NO: 64528 - DNA, 38 bp, Artificial Sequence
  Synthetic oligonucleotide
tgtcaccacggttgacacacgattccacccagctttga

SEQ ID NO: 64529 - DNA, 38 bp, Artificial Sequence
  Synthetic oligonucleotide
tgagagagcccatccgttgtttgtcccccctgctttga

SEQ ID NO: 64530 - DNA, 36 bp, Artificial Sequence
  Synthetic oligonucleotide
accgacgacactttgcgatctccactatgtctttga

SEQ ID NO: 64531 - DNA, 35 bp, Artificial Sequence
  Synthetic oligonucleotide
gccaaccacaactgaccacactgctccgttgaata

SEQ ID NO: 64532 - DNA, 36 bp, Artificial Sequence
  Synthetic oligonucleotide
aaccatcttcccatcgcatgggcccgccgctgccta

SEQ ID NO: 64533 - DNA, 36 bp, Artificial Sequence
  Synthetic oligonucleotide
ttccatgccatgcactccaggtacgcacaatatcta

SEQ ID NO: 64534 - DNA, 36 bp, Artificial Sequence
  Synthetic oligonucleotide
tgtgagccggtgcatcacgcctttgccccacaggta

SEQ ID NO: 64535 - DNA, 36 bp, Artificial Sequence
  Synthetic oligonucleotide
ttggaaatggcaaacaggagggacaggaggcaatta

SEQ ID NO: 64536 - DNA, 36 bp, Artificial Sequence
  Synthetic oligonucleotide
gcagtgggaagtggcgggatggggggcgaggcgtta

SEQ ID NO: 64537 - DNA, 36 bp, Artificial Sequence
  Synthetic oligonucleotide
gtgggacagctaccgacgctgcaccgtatcccttta

SEQ ID NO: 64538 - DNA, 35 bp, Artificial Sequence
  Synthetic oligonucleotide
tgcctacccgtcctccagatatccaagtcctcccc

SEQ ID NO: 64539 - DNA, 35 bp, Artificial Sequence
  Synthetic oligonucleotide
actaccgacttcccgcctcgaacccgagacgagcc

SEQ ID NO: 64540 - DNA, 35 bp, Artificial Sequence
  Synthetic oligonucleotide
tacgccccagcccttccatatcttcaaccggcgcc

SEQ ID NO: 64541 - DNA, 35 bp, Artificial Sequence
  Synthetic oligonucleotide
gccccacaactgccggcctcaccttggtcagggcc

SEQ ID NO: 64542 - DNA, 35 bp, Artificial Sequence
  Synthetic oligonucleotide
tcgtccactcgggaccttaaaggatctccccctcc

SEQ ID NO: 64543 - DNA, 35 bp, Artificial Sequence
  Synthetic oligonucleotide
acgtctcgacgggctgtgcttgttatcgtaattcc

SEQ ID NO: 64544 - DNA, 35 bp, Artificial Sequence
  Synthetic oligonucleotide
tcctccaaagactacttcgaacactgacctctggc

SEQ ID NO: 64545 - DNA, 35 bp, Artificial Sequence
  Synthetic oligonucleotide
tatttcaacggttcctgccgtgttctttttcaatc

SEQ ID NO: 64546 - DNA, 35 bp, Artificial Sequence
  Synthetic oligonucleotide
gaaatccctccacggttataacagtctggcccatc

SEQ ID NO: 64547 - DNA, 35 bp, Artificial Sequence
  Synthetic oligonucleotide
taaccaggacatctggttcctcgaggtctcctctc

SEQ ID NO: 64548 - DNA, 34 bp, Artificial Sequence
  Synthetic oligonucleotide
agattagggagaacgggatgagtcgggtagggag

SEQ ID NO: 64549 - DNA, 35 bp, Artificial Sequence
  Synthetic oligonucleotide
gatcaggtgagggggttagattcggggttggtgag

SEQ ID NO: 64550 - DNA, 35 bp, Artificial Sequence
  Synthetic oligonucleotide
gaaggtcagggtgagtctggggagggggggacacg

SEQ ID NO: 64551 - DNA, 35 bp, Artificial Sequence
  Synthetic oligonucleotide
gatcactcatgcggaacgctgcacgacaagtgacg

SEQ ID NO: 64552 - DNA, 35 bp, Artificial Sequence
  Synthetic oligonucleotide
aaacgtaggtggcgcggggtgggaaaggctatccg

SEQ ID NO: 64553 - DNA, 35 bp, Artificial Sequence
  Synthetic oligonucleotide
gacaccgttcactgcttactaccaacatctgtccg

SEQ ID NO: 64554 - DNA, 35 bp, Artificial Sequence
  Synthetic oligonucleotide
acagtaagcccgccgcataacgcccttgtttcgcg

SEQ ID NO: 64555 - DNA, 35 bp, Artificial Sequence
  Synthetic oligonucleotide
gcacaacgtcctgtcgacctctaatagcgtggggg

SEQ ID NO: 64556 - DNA, 35 bp, Artificial Sequence
  Synthetic oligonucleotide
ggtggggggtagagctgtaggtcatggggggtatg

SEQ ID NO: 64557 - DNA, 35 bp, Artificial Sequence
  Synthetic oligonucleotide
gccaaataggcgggtgggtatggaaagtaaggaat

SEQ ID NO: 64558 - DNA, 35 bp, Artificial Sequence
  Synthetic oligonucleotide
gaccaccctggttcgtgtacccgcttgtgcctaat

SEQ ID NO: 64559 - DNA, 35 bp, Artificial Sequence
  Synthetic oligonucleotide
gtcgccggttgtctcatgatatctgccctatccat

SEQ ID NO: 64560 - DNA, 35 bp, Artificial Sequence
  Synthetic oligonucleotide
gctcatcctccattgagatcacgaccctctattat

SEQ ID NO: 64561 - DNA, 35 bp, Artificial Sequence
  Synthetic oligonucleotide
gaggccctcataagcctacctggtccgctcgtact

SEQ ID NO: 64562 - DNA, 35 bp, Artificial Sequence
  Synthetic oligonucleotide
acacggagcccctaaggtccattactagctgacct

SEQ ID NO: 64563 - DNA, 35 bp, Artificial Sequence
  Synthetic oligonucleotide
acgcacttggttgccggtggcagaaaaccattcct

SEQ ID NO: 64564 - DNA, 35 bp, Artificial Sequence
  Synthetic oligonucleotide
atgacgcacgttgtttcccggggtctccacactct

SEQ ID NO: 64565 - DNA, 35 bp, Artificial Sequence
  Synthetic oligonucleotide
ttaatgcatgcctgcactctagatcaaaaccctct

SEQ ID NO: 64566 - DNA, 35 bp, Artificial Sequence
  Synthetic oligonucleotide
gccatagccgtacgccttggatttcctaactaggt

SEQ ID NO: 64567 - DNA, 35 bp, Artificial Sequence
  Synthetic oligonucleotide
tcgaggccaacaacaggggggataggtgatgcggt

SEQ ID NO: 64568 - DNA, 35 bp, Artificial Sequence
  Synthetic oligonucleotide
attgctccgaccgcacccctatatatttcgtttgt

SEQ ID NO: 64569 - DNA, 35 bp, Artificial Sequence
  Synthetic oligonucleotide
actgccgatgcccccatgtacagtttgaggtactt

SEQ ID NO: 64570 - DNA, 35 bp, Artificial Sequence
  Synthetic oligonucleotide
tcccacacccgtatctcgtgaactcttggttattt

SEQ ID NO: 64571 - DNA, 36 bp, Artificial Sequence
  Synthetic oligonucleotide
atatccgccattagctgcgcatcccttccgcccaaa

SEQ ID NO: 64572 - DNA, 35 bp, Artificial Sequence
  Synthetic oligonucleotide
atctgccgcggttacagccaccggaaatatgcaca

SEQ ID NO: 64573 - DNA, 36 bp, Artificial Sequence
  Synthetic oligonucleotide
atcatccctggtggtggctaggaccccctgattaca

SEQ ID NO: 64574 - DNA, 36 bp, Artificial Sequence
  Synthetic oligonucleotide
aatcacccgtgagtaaattttttatgcttgccccca

SEQ ID NO: 64575 - DNA, 36 bp, Artificial Sequence
  Synthetic oligonucleotide
acctaacttggtccgctgtgctgttcacctttcgca

SEQ ID NO: 64576 - DNA, 35 bp, Artificial Sequence
  Synthetic oligonucleotide
atgcaaaggcgggttggaaggtacactaaccggca

SEQ ID NO: 64577 - DNA, 36 bp, Artificial Sequence
  Synthetic oligonucleotide
ttgcatgttgggattccatttattttgtgcattgca

SEQ ID NO: 64578 - DNA, 36 bp, Artificial Sequence
  Synthetic oligonucleotide
acccgcgggtgcctgatctgacgttgttccacctca

SEQ ID NO: 64579 - DNA, 36 bp, Artificial Sequence
  Synthetic oligonucleotide
tcgcgtcttacgaagtctataaccctcgctccctca

SEQ ID NO: 64580 - DNA, 34 bp, Artificial Sequence
  Synthetic oligonucleotide
gtccgtcgagcacggacgcgtttgaactatctca

SEQ ID NO: 64581 - DNA, 37 bp, Artificial Sequence
  Synthetic oligonucleotide
ggaggggatgggatggtgcggaagtgcggacggtaga

SEQ ID NO: 64582 - DNA, 35 bp, Artificial Sequence
  Synthetic oligonucleotide
caccaatccgctccgaactcgacaccaattgacga

SEQ ID NO: 64583 - DNA, 35 bp, Artificial Sequence
  Synthetic oligonucleotide
tccctggtctagtcccttcctgtgccactcgccga

SEQ ID NO: 64584 - DNA, 36 bp, Artificial Sequence
  Synthetic oligonucleotide
acctcgacctcgatccctttgttacaggcaaatcga

SEQ ID NO: 64585 - DNA, 37 bp, Artificial Sequence
  Synthetic oligonucleotide
tgatcgggggggatggagagatgggctgagagtagga

SEQ ID NO: 64586 - DNA, 37 bp, Artificial Sequence
  Synthetic oligonucleotide
gtgtcggaggggggtgagagcatgggatgtagcggga

SEQ ID NO: 64587 - DNA, 37 bp, Artificial Sequence
  Synthetic oligonucleotide
atcgagagcagggggttttggtgtgtgttcagtggga

SEQ ID NO: 64588 - DNA, 37 bp, Artificial Sequence
  Synthetic oligonucleotide
tcatgtgacgagagaagaggtaaggacggacatatga

SEQ ID NO: 64589 - DNA, 37 bp, Artificial Sequence
  Synthetic oligonucleotide
ttagccacccccgcgcgccagtccacagttagtatga

SEQ ID NO: 64590 - DNA, 38 bp, Artificial Sequence
  Synthetic oligonucleotide
ttaagcagcatgggttgggagggttgggacgacactga

SEQ ID NO: 64591 - DNA, 38 bp, Artificial Sequence
  Synthetic oligonucleotide
tctgacacgaccgcgcctctccgacgacttcaacctga

SEQ ID NO: 64592 - DNA, 36 bp, Artificial Sequence
  Synthetic oligonucleotide
gatggacggggtggggggctaattctgttgggctga

SEQ ID NO: 64593 - DNA, 38 bp, Artificial Sequence
  Synthetic oligonucleotide
gcgaacggcctctatgtcgaaacctacatctgatctga

SEQ ID NO: 64594 - DNA, 38 bp, Artificial Sequence
  Synthetic oligonucleotide
tgactcccgaatcacctccagccacagtctggctctga

SEQ ID NO: 64595 - DNA, 38 bp, Artificial Sequence
  Synthetic oligonucleotide
gaacccccccacatgcctgtttacacctggtgttctga

SEQ ID NO: 64596 - DNA, 38 bp, Artificial Sequence
  Synthetic oligonucleotide
gacacccccttgcgctcttaccttacccactacagtga

SEQ ID NO: 64597 - DNA, 38 bp, Artificial Sequence
  Synthetic oligonucleotide
aacgggaggaaggcaggaggctgttcgaagggcagtga

SEQ ID NO: 64598 - DNA, 38 bp, Artificial Sequence
  Synthetic oligonucleotide
gtcggtgtcgggggccaaggacgggagcaggaaggtga

SEQ ID NO: 64599 - DNA, 38 bp, Artificial Sequence
  Synthetic oligonucleotide
tactaggcgaggtcgaaaggagacgtgggaaacggtga

SEQ ID NO: 64600 - DNA, 38 bp, Artificial Sequence
  Synthetic oligonucleotide
cctgccgcacgcaacacctatggcctgtttcacattga

SEQ ID NO: 64601 - DNA, 38 bp, Artificial Sequence
  Synthetic oligonucleotide
aatccccatagcggccacaccccacctgaagacattga

SEQ ID NO: 64602 - DNA, 38 bp, Artificial Sequence
  Synthetic oligonucleotide
tccaccatcccctgctggcctatatagtcatagattga

SEQ ID NO: 64603 - DNA, 38 bp, Artificial Sequence
  Synthetic oligonucleotide
gtcgtcttgcatcccgtacctcattttggccaccttga

SEQ ID NO: 64604 - DNA, 38 bp, Artificial Sequence
  Synthetic oligonucleotide
gctcgtgccctgtgtctgcttttactgtttgtccttga

SEQ ID NO: 64605 - DNA, 38 bp, Artificial Sequence
  Synthetic oligonucleotide
tgtgtcagaggtacaattccctgctctttcaacgttga

SEQ ID NO: 64606 - DNA, 38 bp, Artificial Sequence
  Synthetic oligonucleotide
aaggggcgtaagtaagggggtaaggggtatggtgttga

SEQ ID NO: 64607 - DNA, 38 bp, Artificial Sequence
  Synthetic oligonucleotide
tgacgctcacattcctatacgtaactccagccctttga

SEQ ID NO: 64608 - DNA, 37 bp, Artificial Sequence
  Synthetic oligonucleotide
tcttcatgacgaccaccgggtaaccgcattgctttga

SEQ ID NO: 64609 - DNA, 37 bp, Artificial Sequence
  Synthetic oligonucleotide
gcgacacctaggcaatacgcgcatacatcatgtttga

SEQ ID NO: 64610 - DNA, 35 bp, Artificial Sequence
  Synthetic oligonucleotide
gatcctccgccaagcaccaacagccatctacgata

SEQ ID NO: 64611 - DNA, 36 bp, Artificial Sequence
  Synthetic oligonucleotide
gtcctctcacaccgtaaccgaccctcatatgaacta

SEQ ID NO: 64612 - DNA, 35 bp, Artificial Sequence
  Synthetic oligonucleotide
tgtcacatttcaagtcctgcaactggtctgcacta

SEQ ID NO: 64613 - DNA, 35 bp, Artificial Sequence
  Synthetic oligonucleotide
gtaggggaaaaaaagcatagggacattaagaagta

SEQ ID NO: 64614 - DNA, 36 bp, Artificial Sequence
  Synthetic oligonucleotide
aacacacattggggaaagggctctaccaaacacgta

SEQ ID NO: 64615 - DNA, 36 bp, Artificial Sequence
  Synthetic oligonucleotide
tccactcgctcaccgtactctgtctagcctcccgta

SEQ ID NO: 64616 - DNA, 36 bp, Artificial Sequence
  Synthetic oligonucleotide
aactccctccggatcatgtactacttctgacgctta

SEQ ID NO: 64617 - DNA, 36 bp, Artificial Sequence
  Synthetic oligonucleotide
acacacggagggggatgccggtcggttgggaattta

SEQ ID NO: 64618 - DNA, 35 bp, Artificial Sequence
  Synthetic oligonucleotide
acgtaacaccttgcgcaaccaacatcgtggcccac

SEQ ID NO: 64619 - DNA, 35 bp, Artificial Sequence
  Synthetic oligonucleotide
acccagactcgtaggtcgccaaagatcaacctcac

SEQ ID NO: 64620 - DNA, 35 bp, Artificial Sequence
  Synthetic oligonucleotide
aatttaccgcggcctgactgagtcctctccttcac

SEQ ID NO: 64621 - DNA, 35 bp, Artificial Sequence
  Synthetic oligonucleotide
tggacactggtagttacttttttttacgcctttac

SEQ ID NO: 64622 - DNA, 35 bp, Artificial Sequence
  Synthetic oligonucleotide
gcttactacctgctccgccttcacgctcaggaacc

SEQ ID NO: 64623 - DNA, 35 bp, Artificial Sequence
  Synthetic oligonucleotide
gagagggtccggcggtaaggcttttctcagtcacc

SEQ ID NO: 64624 - DNA, 35 bp, Artificial Sequence
  Synthetic oligonucleotide
tgaaccaccattcaagcttgccttcggcctctccc

SEQ ID NO: 64625 - DNA, 35 bp, Artificial Sequence
  Synthetic oligonucleotide
ttcaaactcccgccgttcactcatgaattgactcc

SEQ ID NO: 64626 - DNA, 35 bp, Artificial Sequence
  Synthetic oligonucleotide
gctcggggctatctttgctgatttatttcgcctcc

SEQ ID NO: 64627 - DNA, 35 bp, Artificial Sequence
  Synthetic oligonucleotide
tcccagttcaagagctcatttctcctggtttgtcc

SEQ ID NO: 64628 - DNA, 35 bp, Artificial Sequence
  Synthetic oligonucleotide
gcctctgcacgccttcactcattggatccacttcc

SEQ ID NO: 64629 - DNA, 35 bp, Artificial Sequence
  Synthetic oligonucleotide
tcattcatcatattccaccgttagcgtgttgttcc

SEQ ID NO: 64630 - DNA, 35 bp, Artificial Sequence
  Synthetic oligonucleotide
tacccccggttattctccgccccagccattcaagc

SEQ ID NO: 64631 - DNA, 35 bp, Artificial Sequence
  Synthetic oligonucleotide
tcagaccctagctcctggttgggatttgttcatgc

SEQ ID NO: 64632 - DNA, 35 bp, Artificial Sequence
  Synthetic oligonucleotide
attggcgtggagccagctactactaactgctttgc

SEQ ID NO: 64633 - DNA, 35 bp, Artificial Sequence
  Synthetic oligonucleotide
acacacgagagggcaaaagtttcaaccgacgcatc

SEQ ID NO: 64634 - DNA, 35 bp, Artificial Sequence
  Synthetic oligonucleotide
gatcattgccggttaggctgctttataaattcatc

SEQ ID NO: 64635 - DNA, 35 bp, Artificial Sequence
  Synthetic oligonucleotide
gcttcacgccctcctggtgggatcccttatatgtc

SEQ ID NO: 64636 - DNA, 35 bp, Artificial Sequence
  Synthetic oligonucleotide
atcgatagcgtttttgcccatccatagatctcttc

SEQ ID NO: 64637 - DNA, 35 bp, Artificial Sequence
  Synthetic oligonucleotide
ggacatgcttggtgtcttgtcaatttgttctgttc

SEQ ID NO: 64638 - DNA, 35 bp, Artificial Sequence
  Synthetic oligonucleotide
aaaccggagcgcacgagctacttccatcctgtttc

SEQ ID NO: 64639 - DNA, 35 bp, Artificial Sequence
  Synthetic oligonucleotide
acaaccccggccccagggatccgacctgactgtag

SEQ ID NO: 64640 - DNA, 35 bp, Artificial Sequence
  Synthetic oligonucleotide
gtcacgccctactgtcaccgtgatgctgtccaccg

SEQ ID NO: 64641 - DNA, 35 bp, Artificial Sequence
  Synthetic oligonucleotide
gtcgaggtagactcgcccggcgctgtattcccccg

SEQ ID NO: 64642 - DNA, 35 bp, Artificial Sequence
  Synthetic oligonucleotide
acaacctcgcttgccccagagctccacatctcgcg

SEQ ID NO: 64643 - DNA, 35 bp, Artificial Sequence
  Synthetic oligonucleotide
ttgggaccaggcgggtgggacgaaggtaacgggcg

SEQ ID NO: 64644 - DNA, 35 bp, Artificial Sequence
  Synthetic oligonucleotide
tcccgacgtcgcgcacaacagtcacccttcccggg

SEQ ID NO: 64645 - DNA, 35 bp, Artificial Sequence
  Synthetic oligonucleotide
gataccccaccattagccgtaagctgacgttatgg

SEQ ID NO: 64646 - DNA, 35 bp, Artificial Sequence
  Synthetic oligonucleotide
accacacggttgtcatcctccatcgcttccttaat

SEQ ID NO: 64647 - DNA, 35 bp, Artificial Sequence
  Synthetic oligonucleotide
gaattacccaccacccaagagcttgcgcggttcat

SEQ ID NO: 64648 - DNA, 35 bp, Artificial Sequence
  Synthetic oligonucleotide
gttgtccatagcgccacactggttaaacatcatct

SEQ ID NO: 64649 - DNA, 35 bp, Artificial Sequence
  Synthetic oligonucleotide
tagatcgacaccgttatatccggtacaacgcctct

SEQ ID NO: 64650 - DNA, 35 bp, Artificial Sequence
  Synthetic oligonucleotide
taacatcagcattatttgcatcttttcgtgtctct

SEQ ID NO: 64651 - DNA, 35 bp, Artificial Sequence
  Synthetic oligonucleotide
ttgagagagggtggtaaggtcgggccggtggttgt

SEQ ID NO: 64652 - DNA, 35 bp, Artificial Sequence
  Synthetic oligonucleotide
gaaacccagcacgccactcagccctcacccatgtt

SEQ ID NO: 64653 - DNA, 36 bp, Artificial Sequence
  Synthetic oligonucleotide
acccacgcgtgcttgtcaatcttctcatccatgaaa

SEQ ID NO: 64654 - DNA, 35 bp, Artificial Sequence
  Synthetic oligonucleotide
tatcacactgccgagcacgtaaagcacgttgccaa

SEQ ID NO: 64655 - DNA, 36 bp, Artificial Sequence
  Synthetic oligonucleotide
taggggacgccactggaggcctcatggaactgggaa

SEQ ID NO: 64656 - DNA, 36 bp, Artificial Sequence
  Synthetic oligonucleotide
gcaagggtaagcgtggggttgaggcttacggttgaa

SEQ ID NO: 64657 - DNA, 36 bp, Artificial Sequence
  Synthetic oligonucleotide
tgactggaagggatgggaacagatgagagcaattaa

SEQ ID NO: 64658 - DNA, 36 bp, Artificial Sequence
  Synthetic oligonucleotide
aacctgacctcattctcgactaggcctctgttttaa

SEQ ID NO: 64659 - DNA, 36 bp, Artificial Sequence
  Synthetic oligonucleotide
actcaccccactcctgcgcataggcatagatacaca

SEQ ID NO: 64660 - DNA, 35 bp, Artificial Sequence
  Synthetic oligonucleotide
ttcgccaggggacaaatagcgtacgcctctcacca

SEQ ID NO: 64661 - DNA, 36 bp, Artificial Sequence
  Synthetic oligonucleotide
acacatgtacgctcctccagatccaggcaaacccca

SEQ ID NO: 64662 - DNA, 36 bp, Artificial Sequence
  Synthetic oligonucleotide
acaaaacggtcacaccgcgcaaccatccttccagca

SEQ ID NO: 64663 - DNA, 36 bp, Artificial Sequence
  Synthetic oligonucleotide
gtgagcgggggttgcttctgcgtccgggggaaggca

SEQ ID NO: 64664 - DNA, 36 bp, Artificial Sequence
  Synthetic oligonucleotide
tcgctccgtactgtaaggtcaatcccagcaatttca

SEQ ID NO: 64665 - DNA, 37 bp, Artificial Sequence
  Synthetic oligonucleotide
tgcaccacgcgcgagctaacgatcaattccaccaaga

SEQ ID NO: 64666 - DNA, 37 bp, Artificial Sequence
  Synthetic oligonucleotide
gtccaaggggtgtgtgtgtgggtttcgtagggtaaga

SEQ ID NO: 64667 - DNA, 37 bp, Artificial Sequence
  Synthetic oligonucleotide
gctgggcataggaggaaggtatggagatggtgacaga

SEQ ID NO: 64668 - DNA, 36 bp, Artificial Sequence
  Synthetic oligonucleotide
tgagaacgggactgggggtttgacacaatacgtaga

SEQ ID NO: 64669 - DNA, 37 bp, Artificial Sequence
  Synthetic oligonucleotide
tccgaccccccgccgattcactggacatcgcaaacga

SEQ ID NO: 64670 - DNA, 37 bp, Artificial Sequence
  Synthetic oligonucleotide
agccaatggtcgctccctcgcactcaccgctccacga

SEQ ID NO: 64671 - DNA, 37 bp, Artificial Sequence
  Synthetic oligonucleotide
tccttgctctcacgttactgcctccggtaatcaccga

SEQ ID NO: 64672 - DNA, 37 bp, Artificial Sequence
  Synthetic oligonucleotide
ccacccgaccttgtgatctccgtaccatccggcccga

SEQ ID NO: 64673 - DNA, 36 bp, Artificial Sequence
  Synthetic oligonucleotide
tcccatgcctccccaagcgaacattcctgtaagcga

SEQ ID NO: 64674 - DNA, 37 bp, Artificial Sequence
  Synthetic oligonucleotide
agtgggcgggaggtggtgccagtaggggagagggcga

SEQ ID NO: 64675 - DNA, 37 bp, Artificial Sequence
  Synthetic oligonucleotide
ggagtacatcagacaaaggaaaagggaagggtggcga

SEQ ID NO: 64676 - DNA, 37 bp, Artificial Sequence
  Synthetic oligonucleotide
ggagtagcaagggcatctgggatcgggagggggtcga

SEQ ID NO: 64677 - DNA, 37 bp, Artificial Sequence
  Synthetic oligonucleotide
taacacctgccgcttgaccctagaatcgaactgtcga

SEQ ID NO: 64678 - DNA, 37 bp, Artificial Sequence
  Synthetic oligonucleotide
ttcatagcctacgttgcaccccacaagacctcaagga

SEQ ID NO: 64679 - DNA, 37 bp, Artificial Sequence
  Synthetic oligonucleotide
tttgaatgcaggtaaaagagtgggatggcggggagga

SEQ ID NO: 64680 - DNA, 37 bp, Artificial Sequence
  Synthetic oligonucleotide
acaccccccatcagcgcgccggccaagcaccatcgga

SEQ ID NO: 64681 - DNA, 37 bp, Artificial Sequence
  Synthetic oligonucleotide
tacgaacagaccggggagataggggttggcattggga

SEQ ID NO: 64682 - DNA, 36 bp, Artificial Sequence
  Synthetic oligonucleotide
aattgccgcgctccatcgtcccccagcatcactgga

SEQ ID NO: 64683 - DNA, 37 bp, Artificial Sequence
  Synthetic oligonucleotide
ttacatcccaccctggacaatgctggagtccattgga

SEQ ID NO: 64684 - DNA, 36 bp, Artificial Sequence
  Synthetic oligonucleotide
ggacaaatggggggactggtcggagggtcgtaatga

SEQ ID NO: 64685 - DNA, 35 bp, Artificial Sequence
  Synthetic oligonucleotide
gccactccgaactcccttaatctgttttaccatga

SEQ ID NO: 64686 - DNA, 37 bp, Artificial Sequence
  Synthetic oligonucleotide
ttgccttgccaggaactgcctcgcccccttaaactga

SEQ ID NO: 64687 - DNA, 38 bp, Artificial Sequence
  Synthetic oligonucleotide
aatcagccatgtcttacgcccacgccactctgaactga

SEQ ID NO: 64688 - DNA, 37 bp, Artificial Sequence
  Synthetic oligonucleotide
atcgcagtatgaggggatgaaacggtggaaaaagtga

SEQ ID NO: 64689 - DNA, 38 bp, Artificial Sequence
  Synthetic oligonucleotide
acagcaccgccttgcgtgcttagggttttcctacgtga

SEQ ID NO: 64690 - DNA, 38 bp, Artificial Sequence
  Synthetic oligonucleotide
tccatacaccctatgtgatcttgtgattccctcggtga

SEQ ID NO: 64691 - DNA, 38 bp, Artificial Sequence
  Synthetic oligonucleotide
tgtgcctttccatcaggccccctacccctttgttgtga

SEQ ID NO: 64692 - DNA, 38 bp, Artificial Sequence
  Synthetic oligonucleotide
gcatgggtgcgtaaggggcttgagtgaacggtgattga

SEQ ID NO: 64693 - DNA, 38 bp, Artificial Sequence
  Synthetic oligonucleotide
gttgtacgctcaccgttgccactcatctccgcccttga

SEQ ID NO: 64694 - DNA, 38 bp, Artificial Sequence
  Synthetic oligonucleotide
atacgcccacagccttggttatctacgtctcgccttga

SEQ ID NO: 64695 - DNA, 38 bp, Artificial Sequence
  Synthetic oligonucleotide
ggactccctccaatcgtaccggtcgttttcatggttga

SEQ ID NO: 64696 - DNA, 38 bp, Artificial Sequence
  Synthetic oligonucleotide
gacacaacgtggaaacacgtgagtgacaaacattttga

SEQ ID NO: 64697 - DNA, 35 bp, Artificial Sequence
  Synthetic oligonucleotide
tggaccagaggtccgtcacacaccttccttccata

SEQ ID NO: 64698 - DNA, 36 bp, Artificial Sequence
  Synthetic oligonucleotide
ttcaccacccttttgcccgaggcgtacgttatcata

SEQ ID NO: 64699 - DNA, 35 bp, Artificial Sequence
  Synthetic oligonucleotide
gagactgggcgaagagagtgccaaacggaacacta

SEQ ID NO: 64700 - DNA, 35 bp, Artificial Sequence
  Synthetic oligonucleotide
aatgtcgtccgccccctccccccctcaaccgacta

SEQ ID NO: 64701 - DNA, 35 bp, Artificial Sequence
  Synthetic oligonucleotide
gacggggccggtgcacgctctcttctttaagccta

SEQ ID NO: 64702 - DNA, 36 bp, Artificial Sequence
  Synthetic oligonucleotide
ttctggcggccgcacaataccgctgttaccctgcta

SEQ ID NO: 64703 - DNA, 36 bp, Artificial Sequence
  Synthetic oligonucleotide
tctgcgaagtatagctaagcctcgctccctcctcta

SEQ ID NO: 64704 - DNA, 36 bp, Artificial Sequence
  Synthetic oligonucleotide
gcacggcaactgccaatctcaaacgtctctctggta

SEQ ID NO: 64705 - DNA, 36 bp, Artificial Sequence
  Synthetic oligonucleotide
gaaccactctgcaagggttctagaccattcgcttta

SEQ ID NO: 64706 - DNA, 35 bp, Artificial Sequence
  Synthetic oligonucleotide
tgaaatactggcacaccccccattgttcacgtgac

SEQ ID NO: 64707 - DNA, 35 bp, Artificial Sequence
  Synthetic oligonucleotide
gatgctgtcaactgatccatctacgtgctggctac

SEQ ID NO: 64708 - DNA, 35 bp, Artificial Sequence
  Synthetic oligonucleotide
acagtgccgatcacacggtttacatttgttacccc

SEQ ID NO: 64709 - DNA, 35 bp, Artificial Sequence
  Synthetic oligonucleotide
actctggctaaccacctctcaatatgtcgattccc

SEQ ID NO: 64710 - DNA, 35 bp, Artificial Sequence
  Synthetic oligonucleotide
atcttagccgtatcgcgaaatctggcgcatcctcc

SEQ ID NO: 64711 - DNA, 35 bp, Artificial Sequence
  Synthetic oligonucleotide
tactgggaggcccgctccacgctttaatttcccgc

SEQ ID NO: 64712 - DNA, 35 bp, Artificial Sequence
  Synthetic oligonucleotide
gcctgagccgtacagggtcattagtttaatccctc

SEQ ID NO: 64713 - DNA, 35 bp, Artificial Sequence
  Synthetic oligonucleotide
tgggtggtcctctagagtgccggcctgctatcctc

SEQ ID NO: 64714 - DNA, 35 bp, Artificial Sequence
  Synthetic oligonucleotide
accgcgcctcccccgcctcgagtgtttggtcgctc

SEQ ID NO: 64715 - DNA, 35 bp, Artificial Sequence
  Synthetic oligonucleotide
acatcgctggatcctgtacttgctttgttggtctc

SEQ ID NO: 64716 - DNA, 35 bp, Artificial Sequence
  Synthetic oligonucleotide
gacaccgggatggaggaggactggggcgaaaggag

SEQ ID NO: 64717 - DNA, 37 bp, Artificial Sequence
  Synthetic oligonucleotide
tcgccgatacttgcgcgggcagacttcacctcactgg

SEQ ID NO: 64718 - DNA, 35 bp, Artificial Sequence
  Synthetic oligonucleotide
ttgccagtaacagggggttggtgattgagaggtgg

SEQ ID NO: 64719 - DNA, 34 bp, Artificial Sequence
  Synthetic oligonucleotide
acatacaccctcaactcgccgtacacacccactg

SEQ ID NO: 64720 - DNA, 35 bp, Artificial Sequence
  Synthetic oligonucleotide
acgcgctttaggccatcccatcactccttccactg

SEQ ID NO: 64721 - DNA, 35 bp, Artificial Sequence
  Synthetic oligonucleotide
tgtcgaggtctctccgtgtttgtttcctgtacctg

SEQ ID NO: 64722 - DNA, 35 bp, Artificial Sequence
  Synthetic oligonucleotide
gtccgccccccacggtagggtcctcatgattcaat

SEQ ID NO: 64723 - DNA, 35 bp, Artificial Sequence
  Synthetic oligonucleotide
gatgcaccacgtgccttacctcactggattaacat

SEQ ID NO: 64724 - DNA, 35 bp, Artificial Sequence
  Synthetic oligonucleotide
ggtgacatggggggctagggaagtgaagggcttat

SEQ ID NO: 64725 - DNA, 35 bp, Artificial Sequence
  Synthetic oligonucleotide
tgatatgaccgcataaaggtaccgacacacatact

SEQ ID NO: 64726 - DNA, 35 bp, Artificial Sequence
  Synthetic oligonucleotide
tagcagaactgcttcctgaactttcgattatacct

SEQ ID NO: 64727 - DNA, 35 bp, Artificial Sequence
  Synthetic oligonucleotide
gagtagcattcccagtgcttccagtgtgccctcct

SEQ ID NO: 64728 - DNA, 35 bp, Artificial Sequence
  Synthetic oligonucleotide
tgagctgggggccatgcattgctccctatcttcct

SEQ ID NO: 64729 - DNA, 35 bp, Artificial Sequence
  Synthetic oligonucleotide
acatggctctcctcccgttgttcctatcgattgct

SEQ ID NO: 64730 - DNA, 35 bp, Artificial Sequence
  Synthetic oligonucleotide
gttcactccatatggtaatttcccacctaaacatt

SEQ ID NO: 64731 - DNA, 35 bp, Artificial Sequence
  Synthetic oligonucleotide
gtcctgggccgcacatcctgtaacccgaccgcatt

SEQ ID NO: 64732 - DNA, 35 bp, Artificial Sequence
  Synthetic oligonucleotide
attgtcgccctcccgggtttatgttctggatcatt

SEQ ID NO: 64733 - DNA, 35 bp, Artificial Sequence
  Synthetic oligonucleotide
gtgccaatccacactccgctcgcccattctagatt

SEQ ID NO: 64734 - DNA, 35 bp, Artificial Sequence
  Synthetic oligonucleotide
accatcatcgctcgccaacctagggtcaaaaggtt

SEQ ID NO: 64735 - DNA, 35 bp, Artificial Sequence
  Synthetic oligonucleotide
tgcgacgtcgacccgtgcatatctccgtgctcttt

SEQ ID NO: 64736 - DNA, 36 bp, Artificial Sequence
  Synthetic oligonucleotide
gtgcaaacacgggagcaggctattcccgaccgacaa

SEQ ID NO: 64737 - DNA, 35 bp, Artificial Sequence
  Synthetic oligonucleotide
acagacctcctcgtaaacgctgtttctgtaaccaa

SEQ ID NO: 64738 - DNA, 36 bp, Artificial Sequence
  Synthetic oligonucleotide
gggacaggttcaatacatgcgctacctcttacccaa

SEQ ID NO: 64739 - DNA, 36 bp, Artificial Sequence
  Synthetic oligonucleotide
ttctgccacgggtgctgcctcagaccccttcatcaa

SEQ ID NO: 64740 - DNA, 36 bp, Artificial Sequence
  Synthetic oligonucleotide
ttcacgacatccacggctcgaccctgtacttttcaa

SEQ ID NO: 64741 - DNA, 35 bp, Artificial Sequence
  Synthetic oligonucleotide
gaccctcgatggcatatcggacctcctccataaca

SEQ ID NO: 64742 - DNA, 35 bp, Artificial Sequence
  Synthetic oligonucleotide
gcctagatgccgcctaagcaccataccacccgcca

SEQ ID NO: 64743 - DNA, 36 bp, Artificial Sequence
  Synthetic oligonucleotide
gagtgggagggggacaaaagaagggtgggttatgca

SEQ ID NO: 64744 - DNA, 36 bp, Artificial Sequence
  Synthetic oligonucleotide
atcgaacccccccgtgactcagagctccaggttgca

SEQ ID NO: 64745 - DNA, 35 bp, Artificial Sequence
  Synthetic oligonucleotide
actgcaaagcaagacacacctcacgccccctctca

SEQ ID NO: 64746 - DNA, 36 bp, Artificial Sequence
  Synthetic oligonucleotide
tggtaggtcgcccattatcgcgctgcaatcctctca

SEQ ID NO: 64747 - DNA, 35 bp, Artificial Sequence
  Synthetic oligonucleotide
gtttcatctgccactatcatgttcctgatctctca

SEQ ID NO: 64748 - DNA, 35 bp, Artificial Sequence
  Synthetic oligonucleotide
tactactgtcccatgagtcgggccaacaccattca

SEQ ID NO: 64749 - DNA, 36 bp, Artificial Sequence
  Synthetic oligonucleotide
gaatactcccaacttcacgtcctggacacaggttca

SEQ ID NO: 64750 - DNA, 37 bp, Artificial Sequence
  Synthetic oligonucleotide
aacatgcacactatggttgctcccgaagtcttccaga

SEQ ID NO: 64751 - DNA, 37 bp, Artificial Sequence
  Synthetic oligonucleotide
gaggatggagggagcgggtggtggggggggcaagaga

SEQ ID NO: 64752 - DNA, 38 bp, Artificial Sequence
  Synthetic oligonucleotide
gaggggtgcatggcggtagtagcagggctggagagaga

SEQ ID NO: 64753 - DNA, 37 bp, Artificial Sequence
  Synthetic oligonucleotide
tagagtcgaatacatgggaaagaaaaataggcgtaga

SEQ ID NO: 64754 - DNA, 35 bp, Artificial Sequence
  Synthetic oligonucleotide
gttgggtacgaaaggtgacggggggaattgttaga

SEQ ID NO: 64755 - DNA, 37 bp, Artificial Sequence
  Synthetic oligonucleotide
gaccacctatccgcactgttgcactttcttgacccga

SEQ ID NO: 64756 - DNA, 37 bp, Artificial Sequence
  Synthetic oligonucleotide
gacaacggtcctgaagattggacctcccaccctgcga

SEQ ID NO: 64757 - DNA, 35 bp, Artificial Sequence
  Synthetic oligonucleotide
gctctgtcggccttaactaccctgccccattgcga

SEQ ID NO: 64758 - DNA, 34 bp, Artificial Sequence
  Synthetic oligonucleotide
accacgccctgttatagcttgcaaaattactcga

SEQ ID NO: 64759 - DNA, 37 bp, Artificial Sequence
  Synthetic oligonucleotide
tgcggggagacgccgtttcattgtttctgtgcctcga

SEQ ID NO: 64760 - DNA, 37 bp, Artificial Sequence
  Synthetic oligonucleotide
gaatggaggggaataggtgagggagtcggggcttcga

SEQ ID NO: 64761 - DNA, 37 bp, Artificial Sequence
  Synthetic oligonucleotide
tcccaccatcgttgtcccctgagtctcacccttagga

SEQ ID NO: 64762 - DNA, 37 bp, Artificial Sequence
  Synthetic oligonucleotide
gaccgggatttatggatagaaggggagtggttacgga

SEQ ID NO: 64763 - DNA, 36 bp, Artificial Sequence
  Synthetic oligonucleotide
agccagcctgcccccccatgagttcccgcagccgga

SEQ ID NO: 64764 - DNA, 37 bp, Artificial Sequence
  Synthetic oligonucleotide
atcgaagggtggactgatataaagggggaggttcgga

SEQ ID NO: 64765 - DNA, 37 bp, Artificial Sequence
  Synthetic oligonucleotide
tcgacaaccggttgggagggagtaatgtaaaggggga

SEQ ID NO: 64766 - DNA, 37 bp, Artificial Sequence
  Synthetic oligonucleotide
aacagggacgtgaggtgccatgggggcgatagtggga

SEQ ID NO: 64767 - DNA, 37 bp, Artificial Sequence
  Synthetic oligonucleotide
gctcacgccccaacaccgttcctgctctcggtctgga

SEQ ID NO: 64768 - DNA, 38 bp, Artificial Sequence
  Synthetic oligonucleotide
tccgaaagacggctcatacgctcacggaaacaccatga

SEQ ID NO: 64769 - DNA, 38 bp, Artificial Sequence
  Synthetic oligonucleotide
gaatatgggatagggcctggcgggcgggagagccatga

SEQ ID NO: 64770 - DNA, 38 bp, Artificial Sequence
  Synthetic oligonucleotide
acacacagacctcccttgcgatcttcagggctccatga

SEQ ID NO: 64771 - DNA, 37 bp, Artificial Sequence
  Synthetic oligonucleotide
atcgaagcacctgatcgcgctctatcctgttgcatga

SEQ ID NO: 64772 - DNA, 38 bp, Artificial Sequence
  Synthetic oligonucleotide
gtgtacatgcaagtggggaagatggaagggcacgatga

SEQ ID NO: 64773 - DNA, 37 bp, Artificial Sequence
  Synthetic oligonucleotide
aaactgcggtaggaagaatcacataggagagggatga

SEQ ID NO: 64774 - DNA, 38 bp, Artificial Sequence
  Synthetic oligonucleotide
tcacgaccagccgccacgcctgaatttcgtatgtatga

SEQ ID NO: 64775 - DNA, 36 bp, Artificial Sequence
  Synthetic oligonucleotide
tgtacccctctctcttcccgtctggctcatcactga

SEQ ID NO: 64776 - DNA, 37 bp, Artificial Sequence
  Synthetic oligonucleotide
gactcgatttcgagcccatcctgttgttgccccctga

SEQ ID NO: 64777 - DNA, 38 bp, Artificial Sequence
  Synthetic oligonucleotide
accaccccgccgtgttttgctctacaagctttctctga

SEQ ID NO: 64778 - DNA, 37 bp, Artificial Sequence
  Synthetic oligonucleotide
agccacggaagcagtggtctacttatgcccgttctga

SEQ ID NO: 64779 - DNA, 38 bp, Artificial Sequence
  Synthetic oligonucleotide
gttgagagtgcaagaagaaggaggatgtacgcaggtga

SEQ ID NO: 64780 - DNA, 37 bp, Artificial Sequence
  Synthetic oligonucleotide
aacacaccaccttaacggaccacgaccaccgcggtga

SEQ ID NO: 64781 - DNA, 38 bp, Artificial Sequence
  Synthetic oligonucleotide
acctgccgtcccgcttcctgtcccggtccgcatggtga

SEQ ID NO: 64782 - DNA, 37 bp, Artificial Sequence
  Synthetic oligonucleotide
ttatggggttggtggaggtgtggtggtaggtatgtga

SEQ ID NO: 64783 - DNA, 38 bp, Artificial Sequence
  Synthetic oligonucleotide
attgccctttgttcctcaccgtcctgacgtcgcattga

SEQ ID NO: 64784 - DNA, 38 bp, Artificial Sequence
  Synthetic oligonucleotide
agcatggagggggggacacaaaagtcagtagttattga

SEQ ID NO: 64785 - DNA, 38 bp, Artificial Sequence
  Synthetic oligonucleotide
tgagaacatacgcccatggctcgggccctcctacttga

SEQ ID NO: 64786 - DNA, 38 bp, Artificial Sequence
  Synthetic oligonucleotide
tctaacccgctgacaacagccttccaccttccgcttga

SEQ ID NO: 64787 - DNA, 37 bp, Artificial Sequence
  Synthetic oligonucleotide
atcatcacgcagatggactgtgtccctcgcttcttga

SEQ ID NO: 64788 - DNA, 38 bp, Artificial Sequence
  Synthetic oligonucleotide
gaaaggtagccgggagcagggggtccagggcaagttga

SEQ ID NO: 64789 - DNA, 37 bp, Artificial Sequence
  Synthetic oligonucleotide
tgcctggccgaatgggcgtgggaaaagggagggttga

SEQ ID NO: 64790 - DNA, 38 bp, Artificial Sequence
  Synthetic oligonucleotide
gcgaaaccgttgctgacgtatctctgatcctttgttga

SEQ ID NO: 64791 - DNA, 35 bp, Artificial Sequence
  Synthetic oligonucleotide
atcctgggtccctgcgtaattttcctgcgtaccta

SEQ ID NO: 64792 - DNA, 36 bp, Artificial Sequence
  Synthetic oligonucleotide
gtctcactgatagatcgtagctaaccctcctccgta

SEQ ID NO: 64793 - DNA, 36 bp, Artificial Sequence
  Synthetic oligonucleotide
gcctggccaggtttctactcggattctcccacgtta

SEQ ID NO: 64794 - DNA, 35 bp, Artificial Sequence
  Synthetic oligonucleotide
atgccatcgcgggcatttcgcctggggccacctac

SEQ ID NO: 64795 - DNA, 35 bp, Artificial Sequence
  Synthetic oligonucleotide
tgctgatactgtgccttgaccaccgcctatacacc

SEQ ID NO: 64796 - DNA, 35 bp, Artificial Sequence
  Synthetic oligonucleotide
gcacacgcagaatacagcgacatctcgttcagacc

SEQ ID NO: 64797 - DNA, 35 bp, Artificial Sequence
  Synthetic oligonucleotide
aacgcacgaataagttggagtttgtgagggtgagc

SEQ ID NO: 64798 - DNA, 35 bp, Artificial Sequence
  Synthetic oligonucleotide
tgacacgacgtaaacggggtgagggagtaattagc

SEQ ID NO: 64799 - DNA, 35 bp, Artificial Sequence
  Synthetic oligonucleotide
ttgccgaagctgtacccaatgccgtcattgttcgc

SEQ ID NO: 64800 - DNA, 35 bp, Artificial Sequence
  Synthetic oligonucleotide
aagccatcgtgcttcgaaacatctcatcctggatc

SEQ ID NO: 64801 - DNA, 35 bp, Artificial Sequence
  Synthetic oligonucleotide
atagcctccaatcatttgcgtttgctgcctctatc

SEQ ID NO: 64802 - DNA, 35 bp, Artificial Sequence
  Synthetic oligonucleotide
gcccgtccacagcaaataaccttgcagaatgcctc

SEQ ID NO: 64803 - DNA, 35 bp, Artificial Sequence
  Synthetic oligonucleotide
gctatggtcacgggaagggctgcgtggggggggtc

SEQ ID NO: 64804 - DNA, 35 bp, Artificial Sequence
  Synthetic oligonucleotide
gacatccccactttccttgtattaggatacgattc

SEQ ID NO: 64805 - DNA, 35 bp, Artificial Sequence
  Synthetic oligonucleotide
gatgtcgccggtccaccctccatgcaattcgattc

SEQ ID NO: 64806 - DNA, 35 bp, Artificial Sequence
  Synthetic oligonucleotide
tcacacactcaaccattacgacacctggtcatttc

SEQ ID NO: 64807 - DNA, 36 bp, Artificial Sequence
  Synthetic oligonucleotide
aaacacaaccgtgcaaaaagggaccgaagatgccag

SEQ ID NO: 64808 - DNA, 35 bp, Artificial Sequence
  Synthetic oligonucleotide
tgaggccgaacgaagagagcggtttaggggaatag

SEQ ID NO: 64809 - DNA, 35 bp, Artificial Sequence
  Synthetic oligonucleotide
tcattatcgccgccgacgttcaacagcctgttccg

SEQ ID NO: 64810 - DNA, 35 bp, Artificial Sequence
  Synthetic oligonucleotide
ccctcccatcacatttttgaccacgaatcctcgcg

SEQ ID NO: 64811 - DNA, 34 bp, Artificial Sequence
  Synthetic oligonucleotide
gcgcagacactccaccctacgccatatgacggcg

SEQ ID NO: 64812 - DNA, 35 bp, Artificial Sequence
  Synthetic oligonucleotide
acccccaacgactgcgcctttgcatcataaactcg

SEQ ID NO: 64813 - DNA, 35 bp, Artificial Sequence
  Synthetic oligonucleotide
gtaccgactcgacgcaattactgtgggccctttcg

SEQ ID NO: 64814 - DNA, 35 bp, Artificial Sequence
  Synthetic oligonucleotide
tcttcggggtgggtactaggggttcgggtaaaagg

SEQ ID NO: 64815 - DNA, 35 bp, Artificial Sequence
  Synthetic oligonucleotide
tcgagaggactgaccgcgaatcccgcccccttctg

SEQ ID NO: 64816 - DNA, 35 bp, Artificial Sequence
  Synthetic oligonucleotide
tctcagaggggtcaagggggagtgggacgcgtttg

SEQ ID NO: 64817 - DNA, 35 bp, Artificial Sequence
  Synthetic oligonucleotide
ttcgccggttcctttatctgctatcgtgtgcacat

SEQ ID NO: 64818 - DNA, 35 bp, Artificial Sequence
  Synthetic oligonucleotide
aactgacgtggagggttatcgcatcttcttcacat

SEQ ID NO: 64819 - DNA, 35 bp, Artificial Sequence
  Synthetic oligonucleotide
ggtgggaacaatgccggggctgccgaatactacat

SEQ ID NO: 64820 - DNA, 35 bp, Artificial Sequence
  Synthetic oligonucleotide
ttcgatgccgtctttgtgtcctgcccagccaacct

SEQ ID NO: 64821 - DNA, 35 bp, Artificial Sequence
  Synthetic oligonucleotide
taggtgccttgcactacaccatcttgttgctacct

SEQ ID NO: 64822 - DNA, 35 bp, Artificial Sequence
  Synthetic oligonucleotide
gtcaacctacgacatttctctgtaaaaccaccgct

SEQ ID NO: 64823 - DNA, 35 bp, Artificial Sequence
  Synthetic oligonucleotide
atccatcgacttcgcgatccacaaactgttccgct

SEQ ID NO: 64824 - DNA, 35 bp, Artificial Sequence
  Synthetic oligonucleotide
ttcgccccatctgacgagtgtgacctctgacctct

SEQ ID NO: 64825 - DNA, 35 bp, Artificial Sequence
  Synthetic oligonucleotide
tcctgctcacgagcacgttctatcaccggttctct

SEQ ID NO: 64826 - DNA, 35 bp, Artificial Sequence
  Synthetic oligonucleotide
aacgaggggagtggtaggcgcagtgcacaggcggt

SEQ ID NO: 64827 - DNA, 35 bp, Artificial Sequence
  Synthetic oligonucleotide
tttcatgcctcgtgaactctcataacctgcccctt

SEQ ID NO: 64828 - DNA, 35 bp, Artificial Sequence
  Synthetic oligonucleotide
gcatgtcaacgttgcttttcatcgaccatggcctt

SEQ ID NO: 64829 - DNA, 35 bp, Artificial Sequence
  Synthetic oligonucleotide
taggaccacgcatctgccttagctgcccttttttt

SEQ ID NO: 64830 - DNA, 36 bp, Artificial Sequence
  Synthetic oligonucleotide
tgtcccgcccccgccaagtgtttacccatctgacaa

SEQ ID NO: 64831 - DNA, 36 bp, Artificial Sequence
  Synthetic oligonucleotide
tcacgccttcgactagccctatataccgtcatcgaa

SEQ ID NO: 64832 - DNA, 35 bp, Artificial Sequence
  Synthetic oligonucleotide
tccatgcctttcgatctcaccttatgttcgtggaa

SEQ ID NO: 64833 - DNA, 36 bp, Artificial Sequence
  Synthetic oligonucleotide
tgtcacacagccttcaaggtccttcactcttcgtaa

SEQ ID NO: 64834 - DNA, 36 bp, Artificial Sequence
  Synthetic oligonucleotide
gaagagagggacaagcgttgggggaggaaatattaa

SEQ ID NO: 64835 - DNA, 36 bp, Artificial Sequence
  Synthetic oligonucleotide
taccaaagaccacctgctcgccgtaaaaacgccaca

SEQ ID NO: 64836 - DNA, 36 bp, Artificial Sequence
  Synthetic oligonucleotide
ttcgagaagctgattgcattcgtcactcccttcaca

SEQ ID NO: 64837 - DNA, 36 bp, Artificial Sequence
  Synthetic oligonucleotide
tcacacgtaccctggtcccgatattccgtaaagaca

SEQ ID NO: 64838 - DNA, 35 bp, Artificial Sequence
  Synthetic oligonucleotide
aaaagccgcactgtgttctatcaccgctaccacca

SEQ ID NO: 64839 - DNA, 36 bp, Artificial Sequence
  Synthetic oligonucleotide
aacgccacacctccattgcatccccgcccggtacca

SEQ ID NO: 64840 - DNA, 35 bp, Artificial Sequence
  Synthetic oligonucleotide
gaccaccactccccctcgttcctcacctgtgccca

SEQ ID NO: 64841 - DNA, 36 bp, Artificial Sequence
  Synthetic oligonucleotide
ttgtctatcgtacgaagtacccggtgccctgttcca

SEQ ID NO: 64842 - DNA, 36 bp, Artificial Sequence
  Synthetic oligonucleotide
gacactccctgcaaaaatcgccaccttaggtaagca

SEQ ID NO: 64843 - DNA, 36 bp, Artificial Sequence
  Synthetic oligonucleotide
atcagtgggagtgtacctcctttcctttgttgcgca

SEQ ID NO: 64844 - DNA, 36 bp, Artificial Sequence
  Synthetic oligonucleotide
tacgtgccaagcactgaacccatccgacttactgca

SEQ ID NO: 64845 - DNA, 35 bp, Artificial Sequence
  Synthetic oligonucleotide
aatcctgccctggggaaacctgcttttgggactca

SEQ ID NO: 64846 - DNA, 36 bp, Artificial Sequence
  Synthetic oligonucleotide
tgcatcgtaccgcttaacgtcgttgtaataccctca

SEQ ID NO: 64847 - DNA, 36 bp, Artificial Sequence
  Synthetic oligonucleotide
gccttattgcatcgcaccgtcacgcttcccctttca

SEQ ID NO: 64848 - DNA, 37 bp, Artificial Sequence
  Synthetic oligonucleotide
gtaccaacgtggagcaaggggctgtcgcggtggaaga

SEQ ID NO: 64849 - DNA, 37 bp, Artificial Sequence
  Synthetic oligonucleotide
tgggatggggaggctgagtggagatcataggggcaga

SEQ ID NO: 64850 - DNA, 37 bp, Artificial Sequence
  Synthetic oligonucleotide
gtgaataggtggatgggttggggtaggttgggcgaga

SEQ ID NO: 64851 - DNA, 36 bp, Artificial Sequence
  Synthetic oligonucleotide
gactaccactgcacatcgacaatctaaaaatcccga

SEQ ID NO: 64852 - DNA, 37 bp, Artificial Sequence
  Synthetic oligonucleotide
agtgcgatggaggtcaaagccgggagtaggcaggcga

SEQ ID NO: 64853 - DNA, 37 bp, Artificial Sequence
  Synthetic oligonucleotide
agtgttgcaggagtggggtagttagaaaggtgggcga

SEQ ID NO: 64854 - DNA, 37 bp, Artificial Sequence
  Synthetic oligonucleotide
tgcccccattagcaattctgtctgacatatccgtcga

SEQ ID NO: 64855 - DNA, 37 bp, Artificial Sequence
  Synthetic oligonucleotide
accaaacgctgttcgacctccctcccaccttgttcga

SEQ ID NO: 64856 - DNA, 36 bp, Artificial Sequence
  Synthetic oligonucleotide
gccaccacgacggtgatttcgtcggttcagtttcga

SEQ ID NO: 64857 - DNA, 37 bp, Artificial Sequence
  Synthetic oligonucleotide
gaatcagagattaggtcacaggagtggggtgggagga

SEQ ID NO: 64858 - DNA, 37 bp, Artificial Sequence
  Synthetic oligonucleotide
agccacctccctgactcttgacttcagttttgccgga

SEQ ID NO: 64859 - DNA, 36 bp, Artificial Sequence
  Synthetic oligonucleotide
gcacggggatgggagggcgacgcggtctgccaggga

SEQ ID NO: 64860 - DNA, 37 bp, Artificial Sequence
  Synthetic oligonucleotide
acgacagggaatatgaatagtagcgggggggctggga

SEQ ID NO: 64861 - DNA, 37 bp, Artificial Sequence
  Synthetic oligonucleotide
atgagatgggaggtagggaatggatgtaacgaaatga

SEQ ID NO: 64862 - DNA, 37 bp, Artificial Sequence
  Synthetic oligonucleotide
gacgctccctgctgggttcacgcattcgactccatga

SEQ ID NO: 64863 - DNA, 38 bp, Artificial Sequence
  Synthetic oligonucleotide
tctggataggaaagataggggattgggccgagagatga

SEQ ID NO: 64864 - DNA, 38 bp, Artificial Sequence
  Synthetic oligonucleotide
gtccggtgtctgcttcttttgtccctcctgctcgatga

SEQ ID NO: 64865 - DNA, 38 bp, Artificial Sequence
  Synthetic oligonucleotide
tcttgcctccctgcacgccctatctgcccaccgcctga

SEQ ID NO: 64866 - DNA, 38 bp, Artificial Sequence
  Synthetic oligonucleotide
tgcaaatctccactgatccacccaccgtctgggcctga

SEQ ID NO: 64867 - DNA, 38 bp, Artificial Sequence
  Synthetic oligonucleotide
tgtcacctgtccttcccttgccctttgtgcgatcctga

SEQ ID NO: 64868 - DNA, 38 bp, Artificial Sequence
  Synthetic oligonucleotide
tccgacccggattactgatccaacacctgccccgctga

SEQ ID NO: 64869 - DNA, 38 bp, Artificial Sequence
  Synthetic oligonucleotide
gcctggaggggaggggtggcctgaaaggcgtgaagtga

SEQ ID NO: 64870 - DNA, 38 bp, Artificial Sequence
  Synthetic oligonucleotide
agttgtgcagggatcgttaaggggtgggatggtagtga

SEQ ID NO: 64871 - DNA, 38 bp, Artificial Sequence
  Synthetic oligonucleotide
tgcgggaggcggggggcacggcgtatgacacttggtga

SEQ ID NO: 64872 - DNA, 37 bp, Artificial Sequence
  Synthetic oligonucleotide
gaacgcgttggtgggtacagggggggaggaattgtga

SEQ ID NO: 64873 - DNA, 37 bp, Artificial Sequence
  Synthetic oligonucleotide
tcctcacttgcatcccgcatgcttatccatccattga

SEQ ID NO: 64874 - DNA, 38 bp, Artificial Sequence
  Synthetic oligonucleotide
atgcggggagggagcagtagttagttacatgaggttga

SEQ ID NO: 64875 - DNA, 38 bp, Artificial Sequence
  Synthetic oligonucleotide
gggagccctcctaattatgctgcacgtacctcctttga

SEQ ID NO: 64876 - DNA, 36 bp, Artificial Sequence
  Synthetic oligonucleotide
tgcccgcacctccattacactcgcagttatgcgata

SEQ ID NO: 64877 - DNA, 36 bp, Artificial Sequence
  Synthetic oligonucleotide
gtccagtccgttgtttgctgcgtcgctggccaccta

SEQ ID NO: 64878 - DNA, 36 bp, Artificial Sequence
  Synthetic oligonucleotide
actttccgtccgttttcgcaaagtctctacatccta

SEQ ID NO: 64879 - DNA, 36 bp, Artificial Sequence
  Synthetic oligonucleotide
gtcctcgccctcgcttcatgatccgttgcttttcta

SEQ ID NO: 64880 - DNA, 35 bp, Artificial Sequence
  Synthetic oligonucleotide
ggtatgcaaggaaaaggtggaaaagcctgcccgta

SEQ ID NO: 64881 - DNA, 36 bp, Artificial Sequence
  Synthetic oligonucleotide
gactagggagtgtcggtgggtaggattggtggggta

SEQ ID NO: 64882 - DNA, 36 bp, Artificial Sequence
  Synthetic oligonucleotide
ttgttgttcgcctgttgtttgccgcgcggctttgta

SEQ ID NO: 64883 - DNA, 35 bp, Artificial Sequence
  Synthetic oligonucleotide
gactgccgaataagcaacgtggccctgtcttctta

SEQ ID NO: 64884 - DNA, 36 bp, Artificial Sequence
  Synthetic oligonucleotide
tcccctgtgcaccttcaccgacctcctggatggtta

SEQ ID NO: 64885 - DNA, 36 bp, Artificial Sequence
  Synthetic oligonucleotide
atccttcaccctggcaacttgattacatcaacttta

SEQ ID NO: 64886 - DNA, 35 bp, Artificial Sequence
  Synthetic oligonucleotide
accaacccctgtccacgttattctatcttgtcaac

SEQ ID NO: 64887 - DNA, 35 bp, Artificial Sequence
  Synthetic oligonucleotide
attcgggggggcttagagggtgggcgttgtagaac

SEQ ID NO: 64888 - DNA, 35 bp, Artificial Sequence
  Synthetic oligonucleotide
gccgtaaacacgcccgcctttgatcatcaacacac

SEQ ID NO: 64889 - DNA, 35 bp, Artificial Sequence
  Synthetic oligonucleotide
gagccagtcaatacacaattcacgccctcatgcac

SEQ ID NO: 64890 - DNA, 35 bp, Artificial Sequence
  Synthetic oligonucleotide
acaccatgggcttttacatgcgtaccctgccgacc

SEQ ID NO: 64891 - DNA, 35 bp, Artificial Sequence
  Synthetic oligonucleotide
agcggagccgctattggcgttgggctgtcgccccc

SEQ ID NO: 64892 - DNA, 35 bp, Artificial Sequence
  Synthetic oligonucleotide
gtggcccgcttttaggatctcagtactgctgcccc

SEQ ID NO: 64893 - DNA, 35 bp, Artificial Sequence
  Synthetic oligonucleotide
gaaggggagagtggaggtcatgtacagagaccgcc

SEQ ID NO: 64894 - DNA, 35 bp, Artificial Sequence
  Synthetic oligonucleotide
agatgctgacacattttttgacaccatttcaatcc

SEQ ID NO: 64895 - DNA, 35 bp, Artificial Sequence
  Synthetic oligonucleotide
gatgacgactgggaactcgtgaccgcttctactcc

SEQ ID NO: 64896 - DNA, 35 bp, Artificial Sequence
  Synthetic oligonucleotide
gagatacacgagtccattagtctgcggtaccctcc

SEQ ID NO: 64897 - DNA, 35 bp, Artificial Sequence
  Synthetic oligonucleotide
gtcacgttcacttactaagtggtcctcttcgctgc

SEQ ID NO: 64898 - DNA, 35 bp, Artificial Sequence
  Synthetic oligonucleotide
ttcgaggccaaaaaacgatctgtacccgctggctc

SEQ ID NO: 64899 - DNA, 35 bp, Artificial Sequence
  Synthetic oligonucleotide
atcacccaactccccaagcacctagtcggggcttc

SEQ ID NO: 64900 - DNA, 35 bp, Artificial Sequence
  Synthetic oligonucleotide
aacaggctgccgccgaatttgccctcaacctcttc

SEQ ID NO: 64901 - DNA, 35 bp, Artificial Sequence
  Synthetic oligonucleotide
gagtgggttcggggggtaagaagttttgggcggag

SEQ ID NO: 64902 - DNA, 35 bp, Artificial Sequence
  Synthetic oligonucleotide
attcgccagtgctaggtttcccgttctccgctacg

SEQ ID NO: 64903 - DNA, 35 bp, Artificial Sequence
  Synthetic oligonucleotide
atggatgcccctgggcgttccagatgactccaccg

SEQ ID NO: 64904 - DNA, 35 bp, Artificial Sequence
  Synthetic oligonucleotide
tatataccatcacgccgcatagacccatgacatgg

SEQ ID NO: 64905 - DNA, 35 bp, Artificial Sequence
  Synthetic oligonucleotide
ctcaccccgttccatctgtccgccactgacattgg

SEQ ID NO: 64906 - DNA, 35 bp, Artificial Sequence
  Synthetic oligonucleotide
gcgatgtagcttagtatccactgttttccctttgg

SEQ ID NO: 64907 - DNA, 35 bp, Artificial Sequence
  Synthetic oligonucleotide
ttcccgcgtacgcctatcctgtttctatatacaat

SEQ ID NO: 64908 - DNA, 35 bp, Artificial Sequence
  Synthetic oligonucleotide
gcacgctggtgatcagccactgtttcaatcttcat

SEQ ID NO: 64909 - DNA, 35 bp, Artificial Sequence
  Synthetic oligonucleotide
tctgttcagacgttcctccttggcctcgtgtcact

SEQ ID NO: 64910 - DNA, 35 bp, Artificial Sequence
  Synthetic oligonucleotide
cccggaacctgtttcgtgatccgccctcgcttact

SEQ ID NO: 64911 - DNA, 35 bp, Artificial Sequence
  Synthetic oligonucleotide
tagtcacccacatacctacttacaagccaatctct

SEQ ID NO: 64912 - DNA, 35 bp, Artificial Sequence
  Synthetic oligonucleotide
actcctgcgctgacttagcctaccaacgacgttct

SEQ ID NO: 64913 - DNA, 35 bp, Artificial Sequence
  Synthetic oligonucleotide
tagtgggttggggggtaggctcgtaagaccgatgt

SEQ ID NO: 64914 - DNA, 35 bp, Artificial Sequence
  Synthetic oligonucleotide
gactcaactacactgacgacctttacaccccctgt

SEQ ID NO: 64915 - DNA, 35 bp, Artificial Sequence
  Synthetic oligonucleotide
acccctggatcggccctagcgtgtccctcgctctt

SEQ ID NO: 64916 - DNA, 35 bp, Artificial Sequence
  Synthetic oligonucleotide
cacggtcctcaccctgttaaggaactctccacttt

SEQ ID NO: 64917 - DNA, 36 bp, Artificial Sequence
  Synthetic oligonucleotide
gactgtgcatccggaaataccctctcacaaagacaa

SEQ ID NO: 64918 - DNA, 36 bp, Artificial Sequence
  Synthetic oligonucleotide
ttcgcaccttcctaatttcattgcgagtccgtacaa

SEQ ID NO: 64919 - DNA, 35 bp, Artificial Sequence
  Synthetic oligonucleotide
aacgtccgcacaaatccctacgagtatctcacgaa

SEQ ID NO: 64920 - DNA, 36 bp, Artificial Sequence
  Synthetic oligonucleotide
acacacccttacgcagctggagctaccttcccctaa

SEQ ID NO: 64921 - DNA, 35 bp, Artificial Sequence
  Synthetic oligonucleotide
ttttgatcgcactccccgccggtgtcttactaaca

SEQ ID NO: 64922 - DNA, 35 bp, Artificial Sequence
  Synthetic oligonucleotide
gagtccgccccccaccgtttcgatgccgcgcgaca

SEQ ID NO: 64923 - DNA, 36 bp, Artificial Sequence
  Synthetic oligonucleotide
gtcgagggcgggagcaaggatacgagcaaggtgaca

SEQ ID NO: 64924 - DNA, 36 bp, Artificial Sequence
  Synthetic oligonucleotide
gaaccccaccaccggcgtaatggtcgttcatttaca

SEQ ID NO: 64925 - DNA, 36 bp, Artificial Sequence
  Synthetic oligonucleotide
actgcacctgcacggcggttatcttgccctggacca

SEQ ID NO: 64926 - DNA, 36 bp, Artificial Sequence
  Synthetic oligonucleotide
attagcagtcacctggcaaatcatccaacctcccca

SEQ ID NO: 64927 - DNA, 36 bp, Artificial Sequence
  Synthetic oligonucleotide
gggcacagttagttctccgtcatcatccgtcctcca

SEQ ID NO: 64928 - DNA, 36 bp, Artificial Sequence
  Synthetic oligonucleotide
agtactctccacacacgcgatggcacctattgctca

SEQ ID NO: 64929 - DNA, 37 bp, Artificial Sequence
  Synthetic oligonucleotide
gggtgatggaacggatggaaaagcagcggttgtgaga

SEQ ID NO: 64930 - DNA, 36 bp, Artificial Sequence
  Synthetic oligonucleotide
aaggtaacccatgccgaaaaaaatagctccacacga

SEQ ID NO: 64931 - DNA, 37 bp, Artificial Sequence
  Synthetic oligonucleotide
accgcaacaacgagttgcctttttagaaacctgccga

SEQ ID NO: 64932 - DNA, 37 bp, Artificial Sequence
  Synthetic oligonucleotide
tacgagggatctgaggctttaggggggagagtggcga

SEQ ID NO: 64933 - DNA, 35 bp, Artificial Sequence
  Synthetic oligonucleotide
gtggtaggtaggcgaaggggccaaaaaaagtgcga

SEQ ID NO: 64934 - DNA, 37 bp, Artificial Sequence
  Synthetic oligonucleotide
accacgctgccccgaaggtaccggttcgcacactcga

SEQ ID NO: 64935 - DNA, 37 bp, Artificial Sequence
  Synthetic oligonucleotide
taccatcccctcaagggtccctcctgacatccctcga

SEQ ID NO: 64936 - DNA, 37 bp, Artificial Sequence
  Synthetic oligonucleotide
tggagagggcggggtgggtttagtagccgcaattcga

SEQ ID NO: 64937 - DNA, 36 bp, Artificial Sequence
  Synthetic oligonucleotide
tgggtgggagggtagtgaattttagggtgaccagga

SEQ ID NO: 64938 - DNA, 36 bp, Artificial Sequence
  Synthetic oligonucleotide
gggagggcacggggggcggagaacacacgtatagga

SEQ ID NO: 64939 - DNA, 36 bp, Artificial Sequence
  Synthetic oligonucleotide
gccggtgtgggaatgaacgggggtagtaagctagga

SEQ ID NO: 64940 - DNA, 37 bp, Artificial Sequence
  Synthetic oligonucleotide
gcaacatgggagtatgggtactttagtggctgaggga

SEQ ID NO: 64941 - DNA, 37 bp, Artificial Sequence
  Synthetic oligonucleotide
tatgtgagcacgcagccctgcacctttatgacctgga

SEQ ID NO: 64942 - DNA, 37 bp, Artificial Sequence
  Synthetic oligonucleotide
gcaactgtcgccccttcgctcccctacagtttttgga

SEQ ID NO: 64943 - DNA, 36 bp, Artificial Sequence
  Synthetic oligonucleotide
acgcctacgccgaaacaatgagcccacttgaaatga

SEQ ID NO: 64944 - DNA, 38 bp, Artificial Sequence
  Synthetic oligonucleotide
gacagggtggggcttggcggtaagagttttggtaatga

SEQ ID NO: 64945 - DNA, 38 bp, Artificial Sequence
  Synthetic oligonucleotide
tttgctgccgttgtatcacttacaccaccgatccatga

SEQ ID NO: 64946 - DNA, 38 bp, Artificial Sequence
  Synthetic oligonucleotide
tatgcgtatggtgatctggacgggcgggatggggatga

SEQ ID NO: 64947 - DNA, 38 bp, Artificial Sequence
  Synthetic oligonucleotide
acccccgccgaacgcactgcccttttgattcacactga

SEQ ID NO: 64948 - DNA, 38 bp, Artificial Sequence
  Synthetic oligonucleotide
tcgccatatcgctggttcccttctgccgtttgacctga

SEQ ID NO: 64949 - DNA, 38 bp, Artificial Sequence
  Synthetic oligonucleotide
tatgccccaaactttacgttcgccagtcctggccctga

SEQ ID NO: 64950 - DNA, 38 bp, Artificial Sequence
  Synthetic oligonucleotide
tggacaacccgacccccatgcgcgcccatccaagctga

SEQ ID NO: 64951 - DNA, 38 bp, Artificial Sequence
  Synthetic oligonucleotide
aaaacgtggagggggaactaggcgaagacatgcgctga

SEQ ID NO: 64952 - DNA, 38 bp, Artificial Sequence
  Synthetic oligonucleotide
gcgaacagggcgctgcattaacttttgactctggctga

SEQ ID NO: 64953 - DNA, 38 bp, Artificial Sequence
  Synthetic oligonucleotide
gtttaggagaaggtagggggaaaggtagccgggagtga

SEQ ID NO: 64954 - DNA, 38 bp, Artificial Sequence
  Synthetic oligonucleotide
tttgacgcctttgccacctctgaagtcactctccgtga

SEQ ID NO: 64955 - DNA, 38 bp, Artificial Sequence
  Synthetic oligonucleotide
agcgtgcaagttgcagccggatggtggtggggcggtga

SEQ ID NO: 64956 - DNA, 38 bp, Artificial Sequence
  Synthetic oligonucleotide
tgcacaatagaggcgggctgggagggcgactggggtga

SEQ ID NO: 64957 - DNA, 38 bp, Artificial Sequence
  Synthetic oligonucleotide
gggggccacgcccatttttagcccctctgacgaattga

SEQ ID NO: 64958 - DNA, 37 bp, Artificial Sequence
  Synthetic oligonucleotide
attcgcccccagcctgtacacttccttgtgagattga

SEQ ID NO: 64959 - DNA, 38 bp, Artificial Sequence
  Synthetic oligonucleotide
gtagccgtaggggggacggaggcgacgggtatgattga

SEQ ID NO: 64960 - DNA, 37 bp, Artificial Sequence
  Synthetic oligonucleotide
gccaacactagccatatcttgccgaccggattcttga

SEQ ID NO: 64961 - DNA, 38 bp, Artificial Sequence
  Synthetic oligonucleotide
atccccgccctagtatacagtcgaactcacggatttga

SEQ ID NO: 64962 - DNA, 38 bp, Artificial Sequence
  Synthetic oligonucleotide
acctaccaccatatctgtccgaaggcttgtaactttga

SEQ ID NO: 64963 - DNA, 37 bp, Artificial Sequence
  Synthetic oligonucleotide
atcgcccccaccctccttgccactccgggcgctttga

SEQ ID NO: 64964 - DNA, 38 bp, Artificial Sequence
  Synthetic oligonucleotide
acacccacacattatctcaagggagaccagtggtttga

SEQ ID NO: 64965 - DNA, 36 bp, Artificial Sequence
  Synthetic oligonucleotide
atcatggcgtgttcctctgcttcgtcctggccacta

SEQ ID NO: 64966 - DNA, 36 bp, Artificial Sequence
  Synthetic oligonucleotide
tcgaatcaccaacaccggatcgccttactgggccta

SEQ ID NO: 64967 - DNA, 35 bp, Artificial Sequence
  Synthetic oligonucleotide
acctccagcactcatgcatcttgtccgaggtctta

SEQ ID NO: 64968 - DNA, 35 bp, Artificial Sequence
  Synthetic oligonucleotide
tacgactcacgattcatctcgaaccctcggcacac

SEQ ID NO: 64969 - DNA, 35 bp, Artificial Sequence
  Synthetic oligonucleotide
ggtccgtcctaccaccactccgcggcatattacac

SEQ ID NO: 64970 - DNA, 35 bp, Artificial Sequence
  Synthetic oligonucleotide
ccatacgtctggccggctctaaattccacgctcac

SEQ ID NO: 64971 - DNA, 35 bp, Artificial Sequence
  Synthetic oligonucleotide
tatccgatatgcctgactttgcgtgttgtacctac

SEQ ID NO: 64972 - DNA, 35 bp, Artificial Sequence
  Synthetic oligonucleotide
ggagatatccccgccatcgtgccaccgttgcctac

SEQ ID NO: 64973 - DNA, 35 bp, Artificial Sequence
  Synthetic oligonucleotide
tacacacctccccttaatggcaattaacactcacc

SEQ ID NO: 64974 - DNA, 34 bp, Artificial Sequence
  Synthetic oligonucleotide
tcagacgttagtcgcttgaaactcctatgtaccc

SEQ ID NO: 64975 - DNA, 35 bp, Artificial Sequence
  Synthetic oligonucleotide
gcccctcgatgattaccacttcacctagcaccgcc

SEQ ID NO: 64976 - DNA, 35 bp, Artificial Sequence
  Synthetic oligonucleotide
gagtctggttacattcgtacattctctgccctgcc

SEQ ID NO: 64977 - DNA, 35 bp, Artificial Sequence
  Synthetic oligonucleotide
gtgactagcctctcaaagaccacgtaatgcctgcc

SEQ ID NO: 64978 - DNA, 35 bp, Artificial Sequence
  Synthetic oligonucleotide
tacgtagcgacggtccaaatcatggtcacccttcc

SEQ ID NO: 64979 - DNA, 35 bp, Artificial Sequence
  Synthetic oligonucleotide
tgacgcccctgttccatccagttccggcgtgttcc

SEQ ID NO: 64980 - DNA, 35 bp, Artificial Sequence
  Synthetic oligonucleotide
gagttacaccagtcgggtctcccgctcatccctgc

SEQ ID NO: 64981 - DNA, 35 bp, Artificial Sequence
  Synthetic oligonucleotide
tctacccgctaccaatcaaacttaccgcagagatc

SEQ ID NO: 64982 - DNA, 35 bp, Artificial Sequence
  Synthetic oligonucleotide
gacgtccctcaccatgctgttagcactctgtgatc

SEQ ID NO: 64983 - DNA, 35 bp, Artificial Sequence
  Synthetic oligonucleotide
gcatatgtgacctctcactcacgctacctccgctc

SEQ ID NO: 64984 - DNA, 35 bp, Artificial Sequence
  Synthetic oligonucleotide
atcgtccacaacccggcacgcatgttcactctgtc

SEQ ID NO: 64985 - DNA, 35 bp, Artificial Sequence
  Synthetic oligonucleotide
ttggagaccctctctgctccggtccatagccattc

SEQ ID NO: 64986 - DNA, 35 bp, Artificial Sequence
  Synthetic oligonucleotide
tacaggactgcccgcccccgtcgcgagaacacaag

SEQ ID NO: 64987 - DNA, 35 bp, Artificial Sequence
  Synthetic oligonucleotide
cattcattcgtgggggctctttaccttccttacag

SEQ ID NO: 64988 - DNA, 35 bp, Artificial Sequence
  Synthetic oligonucleotide
tgtctgagtcctccccccgactatagttgccccag

SEQ ID NO: 64989 - DNA, 35 bp, Artificial Sequence
  Synthetic oligonucleotide
acacctccccacctgacgcctgtcatagcttgcag

SEQ ID NO: 64990 - DNA, 35 bp, Artificial Sequence
  Synthetic oligonucleotide
agtcctccctgccacaaaccgatctatatagtacg

SEQ ID NO: 64991 - DNA, 35 bp, Artificial Sequence
  Synthetic oligonucleotide
gatgacgcacaacatcttgaaaagtcaggccatcg

SEQ ID NO: 64992 - DNA, 35 bp, Artificial Sequence
  Synthetic oligonucleotide
caaaaggtgacggcggtggatacaggaaagatagg

SEQ ID NO: 64993 - DNA, 35 bp, Artificial Sequence
  Synthetic oligonucleotide
tccaaagcctcacgttcagtttccccgctattatg

SEQ ID NO: 64994 - DNA, 35 bp, Artificial Sequence
  Synthetic oligonucleotide
gtatgcatccattgggagtttccgcttgttttcat

SEQ ID NO: 64995 - DNA, 35 bp, Artificial Sequence
  Synthetic oligonucleotide
actgccgccacctgtcagctccaactatctactat

SEQ ID NO: 64996 - DNA, 35 bp, Artificial Sequence
  Synthetic oligonucleotide
atgacagtagtttgctcagcagtcgtttccaccct

SEQ ID NO: 64997 - DNA, 35 bp, Artificial Sequence
  Synthetic oligonucleotide
tatgcagcacgtcgacgtcggcttcttcatcatct

SEQ ID NO: 64998 - DNA, 35 bp, Artificial Sequence
  Synthetic oligonucleotide
tagctcacctggtccaggtgatttttttccccatt

SEQ ID NO: 64999 - DNA, 35 bp, Artificial Sequence
  Synthetic oligonucleotide
ggtgccctggtccctctccccgctccgtgtagcaa

SEQ ID NO: 65000 - DNA, 36 bp, Artificial Sequence
  Synthetic oligonucleotide
aacgaaacccctgctcgtacacttgtcccgtaggaa

SEQ ID NO: 65001 - DNA, 36 bp, Artificial Sequence
  Synthetic oligonucleotide
tcaaggggagtctcgcgaaggggagggaggattgaa

SEQ ID NO: 65002 - DNA, 36 bp, Artificial Sequence
  Synthetic oligonucleotide
gacggggggccaaaacgaggaaaggtaaagagctaa

SEQ ID NO: 65003 - DNA, 36 bp, Artificial Sequence
  Synthetic oligonucleotide
aacacccaagatgcacacctccccccgcacgattaa

SEQ ID NO: 65004 - DNA, 35 bp, Artificial Sequence
  Synthetic oligonucleotide
acgctccgcctatatcttgcgcgcctatatccaca

SEQ ID NO: 65005 - DNA, 36 bp, Artificial Sequence
  Synthetic oligonucleotide
gcccggcgaaccgcacggaacttctttatcagccca

SEQ ID NO: 65006 - DNA, 35 bp, Artificial Sequence
  Synthetic oligonucleotide
tcaacccacgtggcagtgcactgcttgcggtccca

SEQ ID NO: 65007 - DNA, 36 bp, Artificial Sequence
  Synthetic oligonucleotide
acgattgcgcgcatagtatccctagcatccactcca

SEQ ID NO: 65008 - DNA, 36 bp, Artificial Sequence
  Synthetic oligonucleotide
tgacagtgctcgatgcagtcctcttttgtctgtcca

SEQ ID NO: 65009 - DNA, 36 bp, Artificial Sequence
  Synthetic oligonucleotide
aagctaggccccgtacaggctagccaatagtttcca

SEQ ID NO: 65010 - DNA, 36 bp, Artificial Sequence
  Synthetic oligonucleotide
gttgccacacagtctaattgggggggagtaggcgca

SEQ ID NO: 65011 - DNA, 36 bp, Artificial Sequence
  Synthetic oligonucleotide
tcattgcgtccgccccccgttcaattggattcgtca

SEQ ID NO: 65012 - DNA, 36 bp, Artificial Sequence
  Synthetic oligonucleotide
gtacctgtcaccactgcccaagagtcatagttgtca

SEQ ID NO: 65013 - DNA, 36 bp, Artificial Sequence
  Synthetic oligonucleotide
gtgctgacaaattacaccttatgttcccgctgttca

SEQ ID NO: 65014 - DNA, 37 bp, Artificial Sequence
  Synthetic oligonucleotide
accgactaattcgtcgcataacacctcctcctagaga

SEQ ID NO: 65015 - DNA, 37 bp, Artificial Sequence
  Synthetic oligonucleotide
ttgcgcctccggtccctctctcgcacccagaagacga

SEQ ID NO: 65016 - DNA, 35 bp, Artificial Sequence
  Synthetic oligonucleotide
gtccgtccctaacagtgcagcactgacccccccga

SEQ ID NO: 65017 - DNA, 37 bp, Artificial Sequence
  Synthetic oligonucleotide
tgagctgcctaccatcatctgaatgagcatctgccga

SEQ ID NO: 65018 - DNA, 37 bp, Artificial Sequence
  Synthetic oligonucleotide
taggacgcgaagtactaaccgatccatctacatccga

SEQ ID NO: 65019 - DNA, 37 bp, Artificial Sequence
  Synthetic oligonucleotide
taggcctcacccgtctcccactatccaatgctcgcga

SEQ ID NO: 65020 - DNA, 37 bp, Artificial Sequence
  Synthetic oligonucleotide
gtcccaccctatgtagcacccttatattcctttgcga

SEQ ID NO: 65021 - DNA, 36 bp, Artificial Sequence
  Synthetic oligonucleotide
gccaaccgcagtgacctctcccatgtattgcatcga

SEQ ID NO: 65022 - DNA, 37 bp, Artificial Sequence
  Synthetic oligonucleotide
tcgccttgtcaccccattggtttgttcactcgatcga

SEQ ID NO: 65023 - DNA, 36 bp, Artificial Sequence
  Synthetic oligonucleotide
gggttgggagggggggtctggacgcggtgttttcga

SEQ ID NO: 65024 - DNA, 36 bp, Artificial Sequence
  Synthetic oligonucleotide
tcacacgccgggggaggtattttaagctttaacgga

SEQ ID NO: 65025 - DNA, 37 bp, Artificial Sequence
  Synthetic oligonucleotide
tagttcacacctccctcacatgcataaaataggcgga

SEQ ID NO: 65026 - DNA, 37 bp, Artificial Sequence
  Synthetic oligonucleotide
taccgggggtaggggcgaagaaacggcacgtggggga

SEQ ID NO: 65027 - DNA, 35 bp, Artificial Sequence
  Synthetic oligonucleotide
aacgacccccccgctcaccctgtcatgaacatgga

SEQ ID NO: 65028 - DNA, 37 bp, Artificial Sequence
  Synthetic oligonucleotide
acacccacttactaggtgtacgtttcgctaccatgga

SEQ ID NO: 65029 - DNA, 37 bp, Artificial Sequence
  Synthetic oligonucleotide
atgagcatgagggaggatacgtgaagcccgaactgga

SEQ ID NO: 65030 - DNA, 37 bp, Artificial Sequence
  Synthetic oligonucleotide
gccgtacgagaccatgaggaaagggaatgttagtgga

SEQ ID NO: 65031 - DNA, 35 bp, Artificial Sequence
  Synthetic oligonucleotide
gtgaatccccaccccggttcatgactcaacttgga

SEQ ID NO: 65032 - DNA, 34 bp, Artificial Sequence
  Synthetic oligonucleotide
agtgcgtgtgaggctgcagggaggaaggagatga

SEQ ID NO: 65033 - DNA, 37 bp, Artificial Sequence
  Synthetic oligonucleotide
gcacgcccccccgctagcagacgtacatataatatga

SEQ ID NO: 65034 - DNA, 38 bp, Artificial Sequence
  Synthetic oligonucleotide
tcagccgtggcacactcaagttatcgcatcctcactga

SEQ ID NO: 65035 - DNA, 37 bp, Artificial Sequence
  Synthetic oligonucleotide
tcacaacacctgaggccacggagctatgcttcactga

SEQ ID NO: 65036 - DNA, 36 bp, Artificial Sequence
  Synthetic oligonucleotide
ttcgagcccgcctacattgtcagaaacgccacctga

SEQ ID NO: 65037 - DNA, 37 bp, Artificial Sequence
  Synthetic oligonucleotide
gtcttgctccaccggttccacttgtgtatccccctga

SEQ ID NO: 65038 - DNA, 38 bp, Artificial Sequence
  Synthetic oligonucleotide
tgttccccttcccggcgcctagtagcacacagccctga

SEQ ID NO: 65039 - DNA, 36 bp, Artificial Sequence
  Synthetic oligonucleotide
actatcccgcctcacttggcagttattcacgcctga

SEQ ID NO: 65040 - DNA, 37 bp, Artificial Sequence
  Synthetic oligonucleotide
gtcaacgcttctgaccgtgcctttatcgatcgcctga

SEQ ID NO: 65041 - DNA, 38 bp, Artificial Sequence
  Synthetic oligonucleotide
tcagcatagccgtacggtacatccgcctgcctgcctga

SEQ ID NO: 65042 - DNA, 38 bp, Artificial Sequence
  Synthetic oligonucleotide
ttagcaccctcatctttgctgtttacctctgcagctga

SEQ ID NO: 65043 - DNA, 36 bp, Artificial Sequence
  Synthetic oligonucleotide
tagcaggcctaacttgccgtccctcttacccgctga

SEQ ID NO: 65044 - DNA, 38 bp, Artificial Sequence
  Synthetic oligonucleotide
ccaatcacccgcccgttctggaaccctcgcccacgtga

SEQ ID NO: 65045 - DNA, 38 bp, Artificial Sequence
  Synthetic oligonucleotide
tgccaggaccctaccgctctcatgccatcatcccgtga

SEQ ID NO: 65046 - DNA, 38 bp, Artificial Sequence
  Synthetic oligonucleotide
gtgtaatgcggcaattagaaaggaataggttgaggtga

SEQ ID NO: 65047 - DNA, 38 bp, Artificial Sequence
  Synthetic oligonucleotide
gcgacatggtggtgggcttgaggaatggatagtggtga

SEQ ID NO: 65048 - DNA, 38 bp, Artificial Sequence
  Synthetic oligonucleotide
atgaggggggctggcggttcgggacgaggtgggtgtga

SEQ ID NO: 65049 - DNA, 37 bp, Artificial Sequence
  Synthetic oligonucleotide
gaccccgcacaaaccatttggactgcttacgaattga

SEQ ID NO: 65050 - DNA, 38 bp, Artificial Sequence
  Synthetic oligonucleotide
gcaccggtaacgtgaaaacgaaacgattccccacttga

SEQ ID NO: 65051 - DNA, 36 bp, Artificial Sequence
  Synthetic oligonucleotide
tgaccaacctctccgcacgacttaaaccttgcttga

SEQ ID NO: 65052 - DNA, 37 bp, Artificial Sequence
  Synthetic oligonucleotide
gtcacagccacgttgcgccttcagatggtccctttga

SEQ ID NO: 65053 - DNA, 36 bp, Artificial Sequence
  Synthetic oligonucleotide
tcagcacttccgttatctcaatcaccgtttacacta

SEQ ID NO: 65054 - DNA, 36 bp, Artificial Sequence
  Synthetic oligonucleotide
ttgaccaacacctgttcgtacggatttcactatcta

SEQ ID NO: 65055 - DNA, 35 bp, Artificial Sequence
  Synthetic oligonucleotide
atgcgacgatcgtactattccggttttcttgctta

SEQ ID NO: 65056 - DNA, 35 bp, Artificial Sequence
  Synthetic oligonucleotide
acctgaaatgctgtatgcgttagcaccccttacac

SEQ ID NO: 65057 - DNA, 35 bp, Artificial Sequence
  Synthetic oligonucleotide
gcacaccgatactatggtcgctttccggttaccac

SEQ ID NO: 65058 - DNA, 35 bp, Artificial Sequence
  Synthetic oligonucleotide
gcacacctccgttacacatattttgtgggccccac

SEQ ID NO: 65059 - DNA, 35 bp, Artificial Sequence
  Synthetic oligonucleotide
agtgccactccccacaacgcgtgaatttttagcac

SEQ ID NO: 65060 - DNA, 35 bp, Artificial Sequence
  Synthetic oligonucleotide
gccggagttgaatgcagctcgctctcttacctgac

SEQ ID NO: 65061 - DNA, 36 bp, Artificial Sequence
  Synthetic oligonucleotide
tacaccccccccccactctcggagtgccgcgcatac

SEQ ID NO: 65062 - DNA, 35 bp, Artificial Sequence
  Synthetic oligonucleotide
tacgcctgaacgctcactgcataggtcttgactac

SEQ ID NO: 65063 - DNA, 35 bp, Artificial Sequence
  Synthetic oligonucleotide
atatgtccggggccccgtcgcgcacgcatccttac

SEQ ID NO: 65064 - DNA, 35 bp, Artificial Sequence
  Synthetic oligonucleotide
gcctgtgcccaatgttcacataagccaaccgaacc

SEQ ID NO: 65065 - DNA, 35 bp, Artificial Sequence
  Synthetic oligonucleotide
ggtgcccttcagtcgcaacgattcccagccgtacc

SEQ ID NO: 65066 - DNA, 35 bp, Artificial Sequence
  Synthetic oligonucleotide
atgccctccttttcgcctgctactgcgggtgtacc

SEQ ID NO: 65067 - DNA, 35 bp, Artificial Sequence
  Synthetic oligonucleotide
gtggtccgcagttccaggcaataacccgtcgtccc

SEQ ID NO: 65068 - DNA, 35 bp, Artificial Sequence
  Synthetic oligonucleotide
atttgcaggtcatacgcacttcccgcttgctcgcc

SEQ ID NO: 65069 - DNA, 35 bp, Artificial Sequence
  Synthetic oligonucleotide
gatcgccgtaccggacgtcccgcgcatatctatcc

SEQ ID NO: 65070 - DNA, 35 bp, Artificial Sequence
  Synthetic oligonucleotide
tggcgtcgctttgcgcttatcccgtagttctatcc

SEQ ID NO: 65071 - DNA, 35 bp, Artificial Sequence
  Synthetic oligonucleotide
aacccacgcctcactattcgctaggaagtccctcc

SEQ ID NO: 65072 - DNA, 35 bp, Artificial Sequence
  Synthetic oligonucleotide
gccacgccgctccttcaccgagttacgccttacgc

SEQ ID NO: 65073 - DNA, 35 bp, Artificial Sequence
  Synthetic oligonucleotide
gtctctacctccgaatgctgcccgttggctatgtc

SEQ ID NO: 65074 - DNA, 35 bp, Artificial Sequence
  Synthetic oligonucleotide
gacaggtcgagtacggtaagggtcatgagctgacg

SEQ ID NO: 65075 - DNA, 35 bp, Artificial Sequence
  Synthetic oligonucleotide
gcgcatccattgctcagccctgctccgaacccgcg

SEQ ID NO: 65076 - DNA, 35 bp, Artificial Sequence
  Synthetic oligonucleotide
gtaaggagtgcgttgagaatcagggagttgggagg

SEQ ID NO: 65077 - DNA, 35 bp, Artificial Sequence
  Synthetic oligonucleotide
actgcattctacccggggttcggacgcacttacat

SEQ ID NO: 65078 - DNA, 35 bp, Artificial Sequence
  Synthetic oligonucleotide
tccatttcgagctatccttcggtgtcaaccgccat

SEQ ID NO: 65079 - DNA, 35 bp, Artificial Sequence
  Synthetic oligonucleotide
ttcccattccctcccactgtcggtaatagccgcat

SEQ ID NO: 65080 - DNA, 35 bp, Artificial Sequence
  Synthetic oligonucleotide
gatgcggatccctagctgctccgttgagtcctcat

SEQ ID NO: 65081 - DNA, 35 bp, Artificial Sequence
  Synthetic oligonucleotide
taacccgaaatgggaacgtacccgagaccttcact

SEQ ID NO: 65082 - DNA, 35 bp, Artificial Sequence
  Synthetic oligonucleotide
acgccggaaggatcattcatttccctcgctcacct

SEQ ID NO: 65083 - DNA, 35 bp, Artificial Sequence
  Synthetic oligonucleotide
tcaccgaaggtcggtaagttacgcaacctctgcct

SEQ ID NO: 65084 - DNA, 35 bp, Artificial Sequence
  Synthetic oligonucleotide
tcacccgcggcgcacaggctttacttctttcctct

SEQ ID NO: 65085 - DNA, 35 bp, Artificial Sequence
  Synthetic oligonucleotide
tgtgcggaggccagccaatatttaatgcatcgtct

SEQ ID NO: 65086 - DNA, 35 bp, Artificial Sequence
  Synthetic oligonucleotide
accgtgccctcactcctcgtatcccctgaacttgt

SEQ ID NO: 65087 - DNA, 35 bp, Artificial Sequence
  Synthetic oligonucleotide
tgtgaatccccccttcgtgctatgttcgggtcttt

SEQ ID NO: 65088 - DNA, 35 bp, Artificial Sequence
  Synthetic oligonucleotide
gcgaagtgtcaatcataatcttggtttccttcttt

SEQ ID NO: 65089 - DNA, 35 bp, Artificial Sequence
  Synthetic oligonucleotide
gaagtcggagtagggcgtaagcgcgcatggaaaaa

SEQ ID NO: 65090 - DNA, 36 bp, Artificial Sequence
  Synthetic oligonucleotide
tcctggccccgcagaacgcgccccacccgtctacaa

SEQ ID NO: 65091 - DNA, 36 bp, Artificial Sequence
  Synthetic oligonucleotide
atgaatgggagggccgggaggggcagcaacaatgaa

SEQ ID NO: 65092 - DNA, 36 bp, Artificial Sequence
  Synthetic oligonucleotide
tgtggctaccgtcagacatcccccccccctgaaaca

SEQ ID NO: 65093 - DNA, 36 bp, Artificial Sequence
  Synthetic oligonucleotide
tcccgaggttgatgcatggcagacgtcccccctaca

SEQ ID NO: 65094 - DNA, 36 bp, Artificial Sequence
  Synthetic oligonucleotide
ttgagcataagccgtgcttattccgttccgcctaca

SEQ ID NO: 65095 - DNA, 36 bp, Artificial Sequence
  Synthetic oligonucleotide
acaccgccaccatatccaatccggaatgtgttacca

SEQ ID NO: 65096 - DNA, 36 bp, Artificial Sequence
  Synthetic oligonucleotide
tgaagccgaccccgagcaaggccgattgcacaccca

SEQ ID NO: 65097 - DNA, 36 bp, Artificial Sequence
  Synthetic oligonucleotide
tatgactccagttgttcctgccctccagtttagcca

SEQ ID NO: 65098 - DNA, 36 bp, Artificial Sequence
  Synthetic oligonucleotide
ttagtacgacgccatctgtcaattaacatattctca

SEQ ID NO: 65099 - DNA, 36 bp, Artificial Sequence
  Synthetic oligonucleotide
tgcatccccctcccgtgtactgcgttgactggaaga

SEQ ID NO: 65100 - DNA, 37 bp, Artificial Sequence
  Synthetic oligonucleotide
atggacaagggcggagggcaagtgacggggtatgaga

SEQ ID NO: 65101 - DNA, 37 bp, Artificial Sequence
  Synthetic oligonucleotide
gcgtaatgcactgacgatcctactaccacctccacga

SEQ ID NO: 65102 - DNA, 37 bp, Artificial Sequence
  Synthetic oligonucleotide
tactccgccatgacaattactagccgaatacctacga

SEQ ID NO: 65103 - DNA, 37 bp, Artificial Sequence
  Synthetic oligonucleotide
atccccagggcccccgtgtccgtacaggttcctacga

SEQ ID NO: 65104 - DNA, 37 bp, Artificial Sequence
  Synthetic oligonucleotide
atgccatcctacggtattgacccacgttacaggccga

SEQ ID NO: 65105 - DNA, 35 bp, Artificial Sequence
  Synthetic oligonucleotide
tctgatgcatcccacctctttttgttatctgtcga

SEQ ID NO: 65106 - DNA, 36 bp, Artificial Sequence
  Synthetic oligonucleotide
gcacgccacacctctgtttctacagtcgacacagga

SEQ ID NO: 65107 - DNA, 37 bp, Artificial Sequence
  Synthetic oligonucleotide
gtgggcgaagaagattgattcaggaggggacggagga

SEQ ID NO: 65108 - DNA, 37 bp, Artificial Sequence
  Synthetic oligonucleotide
gatgtgcacgttgggtgataagcgtaacgcaaacgga

SEQ ID NO: 65109 - DNA, 37 bp, Artificial Sequence
  Synthetic oligonucleotide
gatagagaacgacggttagggggagcaggagttcgga

SEQ ID NO: 65110 - DNA, 37 bp, Artificial Sequence
  Synthetic oligonucleotide
gacgcagtgcggtccaaggggggggggctgttcggga

SEQ ID NO: 65111 - DNA, 37 bp, Artificial Sequence
  Synthetic oligonucleotide
aacagtagaggaagcagtcggaaagagttgaggggga

SEQ ID NO: 65112 - DNA, 38 bp, Artificial Sequence
  Synthetic oligonucleotide
accgtgagcgcggtctctcttttacttcggtgccatga

SEQ ID NO: 65113 - DNA, 38 bp, Artificial Sequence
  Synthetic oligonucleotide
gagcacacagtattagttaggaaggtggaaagggatga

SEQ ID NO: 65114 - DNA, 38 bp, Artificial Sequence
  Synthetic oligonucleotide
ttggacagtcagtaaagtgaaggttgctggatggatga

SEQ ID NO: 65115 - DNA, 38 bp, Artificial Sequence
  Synthetic oligonucleotide
gagaacacagtggggtgcaagtatgtgggaaggtatga

SEQ ID NO: 65116 - DNA, 38 bp, Artificial Sequence
  Synthetic oligonucleotide
gagtagcatgcaacaggagggggataggtcttgtatga

SEQ ID NO: 65117 - DNA, 38 bp, Artificial Sequence
  Synthetic oligonucleotide
cctgccggtcggttagaccattctcctgcgcaccctga

SEQ ID NO: 65118 - DNA, 37 bp, Artificial Sequence
  Synthetic oligonucleotide
atcgaggagcgtggccgcctattcctcctcttgctga

SEQ ID NO: 65119 - DNA, 38 bp, Artificial Sequence
  Synthetic oligonucleotide
gttcgcgccttcttcgcaagttgccttcatttctctga

SEQ ID NO: 65120 - DNA, 38 bp, Artificial Sequence
  Synthetic oligonucleotide
accaggccccggtgtccacatttgtccctaccttctga

SEQ ID NO: 65121 - DNA, 36 bp, Artificial Sequence
  Synthetic oligonucleotide
acacgtgggagttaatgggaggggtgcagggcgtga

SEQ ID NO: 65122 - DNA, 38 bp, Artificial Sequence
  Synthetic oligonucleotide
tggtgacggaaggaagggaccgcgtgaagtaggggtga

SEQ ID NO: 65123 - DNA, 38 bp, Artificial Sequence
  Synthetic oligonucleotide
gctatcgatagagtggggggagggcgggagcctggtga

SEQ ID NO: 65124 - DNA, 38 bp, Artificial Sequence
  Synthetic oligonucleotide
gccacggagacgttgcatcggaatcgatcactaattga

SEQ ID NO: 65125 - DNA, 38 bp, Artificial Sequence
  Synthetic oligonucleotide
gcctcgcacgccgcatgcctgcttatcgacgtcattga

SEQ ID NO: 65126 - DNA, 38 bp, Artificial Sequence
  Synthetic oligonucleotide
gcactccgtccacatttcagttaggccgccttcattga

SEQ ID NO: 65127 - DNA, 38 bp, Artificial Sequence
  Synthetic oligonucleotide
tctcgccgccgcgagagtcgtacgggaactcttattga

SEQ ID NO: 65128 - DNA, 38 bp, Artificial Sequence
  Synthetic oligonucleotide
tgacggtcgacttacgcgatcggaacactcttacttga

SEQ ID NO: 65129 - DNA, 38 bp, Artificial Sequence
  Synthetic oligonucleotide
gtgcgcagaccccccgtggtccattctatccatcttga

SEQ ID NO: 65130 - DNA, 38 bp, Artificial Sequence
  Synthetic oligonucleotide
gacgaggacgatgtcgtttcctttcttccaggagttga

SEQ ID NO: 65131 - DNA, 38 bp, Artificial Sequence
  Synthetic oligonucleotide
gaaccgatccatgctcaaaggcccctcgatttatttga

SEQ ID NO: 65132 - DNA, 38 bp, Artificial Sequence
  Synthetic oligonucleotide
gagcgggaaggggggggctagtgcttgagggagtttga

SEQ ID NO: 65133 - DNA, 35 bp, Artificial Sequence
  Synthetic oligonucleotide
gccgggcaggctgcagttttaccgatctttccata

SEQ ID NO: 65134 - DNA, 36 bp, Artificial Sequence
  Synthetic oligonucleotide
gggaaacgcaggtacgagggggaaagctggctgata

SEQ ID NO: 65135 - DNA, 36 bp, Artificial Sequence
  Synthetic oligonucleotide
tcatggcactccccgtatcccctccgaccgagacta

SEQ ID NO: 65136 - DNA, 35 bp, Artificial Sequence
  Synthetic oligonucleotide
ggtcaccctcatatgctcctcccggatcgcaccta

SEQ ID NO: 65137 - DNA, 35 bp, Artificial Sequence
  Synthetic oligonucleotide
acaccggcacggctccagcttaactccggatccta

SEQ ID NO: 65138 - DNA, 36 bp, Artificial Sequence
  Synthetic oligonucleotide
atgcaagacaagggggctatggcgcgtgggtacgta

SEQ ID NO: 65139 - DNA, 36 bp, Artificial Sequence
  Synthetic oligonucleotide
gacacgtagccacggtcgcaccatgtcccttgatta

SEQ ID NO: 65140 - DNA, 35 bp, Artificial Sequence
  Synthetic oligonucleotide
ggtcccgcacagggcgtaccccggcgaattcctta

SEQ ID NO: 65141 - DNA, 35 bp, Artificial Sequence
  Synthetic oligonucleotide
gtcagacacgcgagaattcgttatgtccctcttta

SEQ ID NO: 65142 - DNA, 35 bp, Artificial Sequence
  Synthetic oligonucleotide
gacgcgcgtgcttcgtgtccagtcccacatccaac

SEQ ID NO: 65143 - DNA, 35 bp, Artificial Sequence
  Synthetic oligonucleotide
agtgacacccagccactcgcattgctagcacacac

SEQ ID NO: 65144 - DNA, 35 bp, Artificial Sequence
  Synthetic oligonucleotide
atacttcccctacctctgtacagagtggtgatcac

SEQ ID NO: 65145 - DNA, 35 bp, Artificial Sequence
  Synthetic oligonucleotide
gcatcgaccatccttagatatactgcctgcttgac

SEQ ID NO: 65146 - DNA, 35 bp, Artificial Sequence
  Synthetic oligonucleotide
gcgtcaccacccctctcgcattttagaccgtatac

SEQ ID NO: 65147 - DNA, 36 bp, Artificial Sequence
  Synthetic oligonucleotide
acctggccggtaggatcgaagcacaactctggaacc

SEQ ID NO: 65148 - DNA, 35 bp, Artificial Sequence
  Synthetic oligonucleotide
tgattccgaagcaccggcgctcaggcttaaccacc

SEQ ID NO: 65149 - DNA, 35 bp, Artificial Sequence
  Synthetic oligonucleotide
tagccggctgacaagcacacacacgagagctcacc

SEQ ID NO: 65150 - DNA, 35 bp, Artificial Sequence
  Synthetic oligonucleotide
cccgctgtccggcctcttgtaaatatcaatcgccc

SEQ ID NO: 65151 - DNA, 35 bp, Artificial Sequence
  Synthetic oligonucleotide
acgattatcgtgcatatctctaattggtcactccc

SEQ ID NO: 65152 - DNA, 35 bp, Artificial Sequence
  Synthetic oligonucleotide
gaggaaacgtcggaacgcaccgtcaaccatgtccc

SEQ ID NO: 65153 - DNA, 35 bp, Artificial Sequence
  Synthetic oligonucleotide
atgacgaccgtccacatcggcggggggggcaatcc

SEQ ID NO: 65154 - DNA, 35 bp, Artificial Sequence
  Synthetic oligonucleotide
gaacgaggctaccttgtttcgttactttttattcc

SEQ ID NO: 65155 - DNA, 35 bp, Artificial Sequence
  Synthetic oligonucleotide
aagcactccaaactcgtggcaacgtaccccgtagc

SEQ ID NO: 65156 - DNA, 35 bp, Artificial Sequence
  Synthetic oligonucleotide
gtcgcacgcaacaatgccgttcctccatctggtgc

SEQ ID NO: 65157 - DNA, 35 bp, Artificial Sequence
  Synthetic oligonucleotide
gtcgcgaccgctttacgtttactcagccgcccatc

SEQ ID NO: 65158 - DNA, 35 bp, Artificial Sequence
  Synthetic oligonucleotide
accgggtgacacatctagggaggggggaggaagtc

SEQ ID NO: 65159 - DNA, 36 bp, Artificial Sequence
  Synthetic oligonucleotide
acgttcagtcccccgcgttcctgcggcacacatgtc

SEQ ID NO: 65160 - DNA, 35 bp, Artificial Sequence
  Synthetic oligonucleotide
tcgaccacaccctgctctgcgctttttacacattc

SEQ ID NO: 65161 - DNA, 35 bp, Artificial Sequence
  Synthetic oligonucleotide
acgccttgcccaagacacatgcagccctaccattc

SEQ ID NO: 65162 - DNA, 35 bp, Artificial Sequence
  Synthetic oligonucleotide
gcaagtgctgatagagcttctgtcggttccttttc

SEQ ID NO: 65163 - DNA, 35 bp, Artificial Sequence
  Synthetic oligonucleotide
gactgctactatttggagggggatagggaaaaaag

SEQ ID NO: 65164 - DNA, 35 bp, Artificial Sequence
  Synthetic oligonucleotide
atgggggaggcgaatactaagtatgggtaggcaag

SEQ ID NO: 65165 - DNA, 35 bp, Artificial Sequence
  Synthetic oligonucleotide
gtgccccatctcccatcgccacagctatcctgccg

SEQ ID NO: 65166 - DNA, 35 bp, Artificial Sequence
  Synthetic oligonucleotide
gcactagcccgaaggaacgccaccgaatgtaatcg

SEQ ID NO: 65167 - DNA, 35 bp, Artificial Sequence
  Synthetic oligonucleotide
gccacgtgtcgataaacgattccaatccccctcgg

SEQ ID NO: 65168 - DNA, 35 bp, Artificial Sequence
  Synthetic oligonucleotide
actccaaggcctaccggtattcttttccaaccctg

SEQ ID NO: 65169 - DNA, 35 bp, Artificial Sequence
  Synthetic oligonucleotide
ggttaaggagtgggcagggaatttgggggagggtg

SEQ ID NO: 65170 - DNA, 35 bp, Artificial Sequence
  Synthetic oligonucleotide
gtgctcgccccccacggttctggatttcttctttg

SEQ ID NO: 65171 - DNA, 35 bp, Artificial Sequence
  Synthetic oligonucleotide
tctacacagcccctgatccttgcactactcacaat

SEQ ID NO: 65172 - DNA, 35 bp, Artificial Sequence
  Synthetic oligonucleotide
atgcgcccctgtccggaacaaggtactacacgaat

SEQ ID NO: 65173 - DNA, 35 bp, Artificial Sequence
  Synthetic oligonucleotide
agccccgtggtgttcgctgcttggtctcgcctctt

SEQ ID NO: 65174 - DNA, 35 bp, Artificial Sequence
  Synthetic oligonucleotide
gcggacgcatgcccgcctgctatcgttcatctctt

SEQ ID NO: 65175 - DNA, 35 bp, Artificial Sequence
  Synthetic oligonucleotide
gacatccgggctccaggcacctcccctcatatgtt

SEQ ID NO: 65176 - DNA, 36 bp, Artificial Sequence
  Synthetic oligonucleotide
gttagacctgcctgataccccccccattgcctgaaa

SEQ ID NO: 65177 - DNA, 35 bp, Artificial Sequence
  Synthetic oligonucleotide
tgaatggctcagcgtgactcttcctcttcactcaa

SEQ ID NO: 65178 - DNA, 36 bp, Artificial Sequence
  Synthetic oligonucleotide
gacgcctcgctacacattggattgccaccattagaa

SEQ ID NO: 65179 - DNA, 35 bp, Artificial Sequence
  Synthetic oligonucleotide
acttcaccgctccccgaagtactgtcatcctcgaa

SEQ ID NO: 65180 - DNA, 36 bp, Artificial Sequence
  Synthetic oligonucleotide
aaccgcacaccagcacacggagtctcgtcttgggaa

SEQ ID NO: 65181 - DNA, 35 bp, Artificial Sequence
  Synthetic oligonucleotide
gctctgcctcctgactgcctataccatgcgaataa

SEQ ID NO: 65182 - DNA, 36 bp, Artificial Sequence
  Synthetic oligonucleotide
aagtggggcgtggggggacgggcgggctggcagtaa

SEQ ID NO: 65183 - DNA, 35 bp, Artificial Sequence
  Synthetic oligonucleotide
gctcagccccagaacccgcacaatctgtttagtaa

SEQ ID NO: 65184 - DNA, 35 bp, Artificial Sequence
  Synthetic oligonucleotide
tacacccgcccgaaaacgttccgttaggtagttaa

SEQ ID NO: 65185 - DNA, 35 bp, Artificial Sequence
  Synthetic oligonucleotide
actcccatgagtgcgtaaccctggctacatacaca

SEQ ID NO: 65186 - DNA, 36 bp, Artificial Sequence
  Synthetic oligonucleotide
gaagccttgagccttcccgtcccttcccgatccaca

SEQ ID NO: 65187 - DNA, 36 bp, Artificial Sequence
  Synthetic oligonucleotide
taggcccaacacggagtccctggccatggacctaca

SEQ ID NO: 65188 - DNA, 36 bp, Artificial Sequence
  Synthetic oligonucleotide
gtgcacccctggcctttccgacatgtcccccgtaca

SEQ ID NO: 65189 - DNA, 36 bp, Artificial Sequence
  Synthetic oligonucleotide
attcaaatgcgcacaattccaagctacacgctacca

SEQ ID NO: 65190 - DNA, 36 bp, Artificial Sequence
  Synthetic oligonucleotide
tgcagtccgccaggtctcaagtatcttcccctccca

SEQ ID NO: 65191 - DNA, 36 bp, Artificial Sequence
  Synthetic oligonucleotide
atctttctggcctgctgctgcacttatcacttccca

SEQ ID NO: 65192 - DNA, 36 bp, Artificial Sequence
  Synthetic oligonucleotide
acgacaaggtgcacatgttgcgccgcctttgctcca

SEQ ID NO: 65193 - DNA, 36 bp, Artificial Sequence
  Synthetic oligonucleotide
aacgcggtgcatttttacggacgtcccttgccatca

SEQ ID NO: 65194 - DNA, 36 bp, Artificial Sequence
  Synthetic oligonucleotide
tgcgaccacttgaccgtcaacacaggcccatcttca

SEQ ID NO: 65195 - DNA, 37 bp, Artificial Sequence
  Synthetic oligonucleotide
agtaagtgggggtaggcatatatgggaagggagaaga

SEQ ID NO: 65196 - DNA, 37 bp, Artificial Sequence
  Synthetic oligonucleotide
aagttggggagctacatctcgaagggagggtgggaga

SEQ ID NO: 65197 - DNA, 37 bp, Artificial Sequence
  Synthetic oligonucleotide
ttgcacggtgggtgaatgctgtggggtcttaagtaga

SEQ ID NO: 65198 - DNA, 35 bp, Artificial Sequence
  Synthetic oligonucleotide
gtaccctcacaattccacctgccgaacgcgcacga

SEQ ID NO: 65199 - DNA, 37 bp, Artificial Sequence
  Synthetic oligonucleotide
gggtcacaccatatcgttaaacgcggcctgcctacga

SEQ ID NO: 65200 - DNA, 37 bp, Artificial Sequence
  Synthetic oligonucleotide
gaacttgctcctgctcctgtactgggaaccagtacga

SEQ ID NO: 65201 - DNA, 37 bp, Artificial Sequence
  Synthetic oligonucleotide
tcatccttgccttggtgcccgtagaattatttaccga

SEQ ID NO: 65202 - DNA, 37 bp, Artificial Sequence
  Synthetic oligonucleotide
tgaccgaggtctccccagcgccgatccgcctgcccga

SEQ ID NO: 65203 - DNA, 37 bp, Artificial Sequence
  Synthetic oligonucleotide
gatccacgtacctattctcttctctcgccttatccga

SEQ ID NO: 65204 - DNA, 36 bp, Artificial Sequence
  Synthetic oligonucleotide
gatccacccatgggtccggattattttaccctccga

SEQ ID NO: 65205 - DNA, 36 bp, Artificial Sequence
  Synthetic oligonucleotide
gtaaacgcggtcattggtccccaaatacaccctcga

SEQ ID NO: 65206 - DNA, 35 bp, Artificial Sequence
  Synthetic oligonucleotide
tagcccagcttctcatattctggttatgctttcga

SEQ ID NO: 65207 - DNA, 37 bp, Artificial Sequence
  Synthetic oligonucleotide
tactgctccagtaacttacctcgacacactttacgga

SEQ ID NO: 65208 - DNA, 37 bp, Artificial Sequence
  Synthetic oligonucleotide
acgaggcgaccacctcgcttagcacataccatccgga

SEQ ID NO: 65209 - DNA, 37 bp, Artificial Sequence
  Synthetic oligonucleotide
taggctcactcgcttgtcctgctcacgttcctccgga

SEQ ID NO: 65210 - DNA, 37 bp, Artificial Sequence
  Synthetic oligonucleotide
gcccagatccccacgccatcacatcgcgtcagtcgga

SEQ ID NO: 65211 - DNA, 37 bp, Artificial Sequence
  Synthetic oligonucleotide
ggagacaataagcagcaggaattgtgtgtgcaatgga

SEQ ID NO: 65212 - DNA, 37 bp, Artificial Sequence
  Synthetic oligonucleotide
tgcgattcacccgctcaatctgattcctacaactgga

SEQ ID NO: 65213 - DNA, 37 bp, Artificial Sequence
  Synthetic oligonucleotide
ggtactagcagggttcggtaggggggagtgcggtgga

SEQ ID NO: 65214 - DNA, 37 bp, Artificial Sequence
  Synthetic oligonucleotide
ttagcccggggcgtctcccgatcccatactacttgga

SEQ ID NO: 65215 - DNA, 38 bp, Artificial Sequence
  Synthetic oligonucleotide
tagccggtcacgcaccggacattacacggtcttcatga

SEQ ID NO: 65216 - DNA, 37 bp, Artificial Sequence
  Synthetic oligonucleotide
tccgcgaggggcagggagaagtaccggatctggatga

SEQ ID NO: 65217 - DNA, 38 bp, Artificial Sequence
  Synthetic oligonucleotide
gacgtgcaatagggttggatgttcgtggagtagactga

SEQ ID NO: 65218 - DNA, 38 bp, Artificial Sequence
  Synthetic oligonucleotide
accgaccatgacaagactctgccccggaaggaccctga

SEQ ID NO: 65219 - DNA, 38 bp, Artificial Sequence
  Synthetic oligonucleotide
gctgcccagagacagttctctttatcctcagctcctga

SEQ ID NO: 65220 - DNA, 36 bp, Artificial Sequence
  Synthetic oligonucleotide
gaatgccaagtgggaattgtgcgcgtagggcgctga

SEQ ID NO: 65221 - DNA, 38 bp, Artificial Sequence
  Synthetic oligonucleotide
gagggcaaacgggtggtccaaagctgaacgggggctga

SEQ ID NO: 65222 - DNA, 38 bp, Artificial Sequence
  Synthetic oligonucleotide
agtgcgggagctgaacagggaaaaagggatgcacgtga

SEQ ID NO: 65223 - DNA, 37 bp, Artificial Sequence
  Synthetic oligonucleotide
gttgtaataggggggagaaggaagcagtcaagcgtga

SEQ ID NO: 65224 - DNA, 38 bp, Artificial Sequence
  Synthetic oligonucleotide
tgtatcctccaacactaactgaccgaccgcctaggtga

SEQ ID NO: 65225 - DNA, 38 bp, Artificial Sequence
  Synthetic oligonucleotide
atgcagcatgagtgggtggggggtgtagggcatggtga

SEQ ID NO: 65226 - DNA, 38 bp, Artificial Sequence
  Synthetic oligonucleotide
tctgggagaggacagcataacagtatgagtggtggtga

SEQ ID NO: 65227 - DNA, 38 bp, Artificial Sequence
  Synthetic oligonucleotide
taccacatactctcgatgagcacctatccctgctgtga

SEQ ID NO: 65228 - DNA, 36 bp, Artificial Sequence
  Synthetic oligonucleotide
tgacccccattgcgtggcttacatggttttcattga

SEQ ID NO: 65229 - DNA, 38 bp, Artificial Sequence
  Synthetic oligonucleotide
gtctccacccaatccatctgatattagaccgatattga

SEQ ID NO: 65230 - DNA, 38 bp, Artificial Sequence
  Synthetic oligonucleotide
agcaccccttgacgattagcaaagctagccaaacttga

SEQ ID NO: 65231 - DNA, 37 bp, Artificial Sequence
  Synthetic oligonucleotide
gaggtggatgccaaaagggggggaggcgccgagttga

SEQ ID NO: 65232 - DNA, 38 bp, Artificial Sequence
  Synthetic oligonucleotide
gctgaagcacgagcgctatccgtactcttccccgttga

SEQ ID NO: 65233 - DNA, 36 bp, Artificial Sequence
  Synthetic oligonucleotide
gggaggtctggtgccgccgctgccccttcctggata

SEQ ID NO: 65234 - DNA, 35 bp, Artificial Sequence
  Synthetic oligonucleotide
ttcgcccctgacctctgattcgtccattttggata

SEQ ID NO: 65235 - DNA, 36 bp, Artificial Sequence
  Synthetic oligonucleotide
tcaccgcagtcggtccccaagaaatttttgtcacta

SEQ ID NO: 65236 - DNA, 36 bp, Artificial Sequence
  Synthetic oligonucleotide
atgagaagggccaaagccgtataggtaaggaaggta

SEQ ID NO: 65237 - DNA, 35 bp, Artificial Sequence
  Synthetic oligonucleotide
tacgtgtggtgcgggggggtgatcttaggcgggta

SEQ ID NO: 65238 - DNA, 35 bp, Artificial Sequence
  Synthetic oligonucleotide
acgagcacaaagaagggcggtatagcgtgggggta

SEQ ID NO: 65239 - DNA, 36 bp, Artificial Sequence
  Synthetic oligonucleotide
atgatcccgcagttccgcactttcctgggctcctta

SEQ ID NO: 65240 - DNA, 36 bp, Artificial Sequence
  Synthetic oligonucleotide
gtaactgcccagcccttgaattggactccgatctta

SEQ ID NO: 65241 - DNA, 35 bp, Artificial Sequence
  Synthetic oligonucleotide
ggacgccgcgttaaagagaccacgccgccctctta

SEQ ID NO: 65242 - DNA, 35 bp, Artificial Sequence
  Synthetic oligonucleotide
tcatcccttggccgacgaacttttgctctcgttta

SEQ ID NO: 65243 - DNA, 35 bp, Artificial Sequence
  Synthetic oligonucleotide
atgcgtgcgccccctgttcacggccatcaacgaac

SEQ ID NO: 65244 - DNA, 35 bp, Artificial Sequence
  Synthetic oligonucleotide
tcgccacgcttggatcccaaactatggccacccac

SEQ ID NO: 65245 - DNA, 35 bp, Artificial Sequence
  Synthetic oligonucleotide
tccgaacgccacttgtgccgactataggctacgac

SEQ ID NO: 65246 - DNA, 34 bp, Artificial Sequence
  Synthetic oligonucleotide
gctttagcgcagccgttggcattgccactcttac

SEQ ID NO: 65247 - DNA, 35 bp, Artificial Sequence
  Synthetic oligonucleotide
gccgccgcgcctcccgcccctctatacttttttac

SEQ ID NO: 65248 - DNA, 35 bp, Artificial Sequence
  Synthetic oligonucleotide
gtggatcgccgtggtcttgcactgtctttgccacc

SEQ ID NO: 65249 - DNA, 35 bp, Artificial Sequence
  Synthetic oligonucleotide
gcacatctgcgcttggctagaagttcccttgcacc

SEQ ID NO: 65250 - DNA, 35 bp, Artificial Sequence
  Synthetic oligonucleotide
tggtgctgtatccgtcctcctcgccgattgaaccc

SEQ ID NO: 65251 - DNA, 35 bp, Artificial Sequence
  Synthetic oligonucleotide
tgcagatcgcgacaccccgttccgtgaagctaccc

SEQ ID NO: 65252 - DNA, 35 bp, Artificial Sequence
  Synthetic oligonucleotide
tgccaactgttctataccgtggggccttctccccc

SEQ ID NO: 65253 - DNA, 35 bp, Artificial Sequence
  Synthetic oligonucleotide
acacctccacagactttatgtcgcgatccgttgcc

SEQ ID NO: 65254 - DNA, 35 bp, Artificial Sequence
  Synthetic oligonucleotide
tcaaggctcagtctctgcccctttactgtcactcc

SEQ ID NO: 65255 - DNA, 35 bp, Artificial Sequence
  Synthetic oligonucleotide
actgcattagggaacccgagatcatcccgcggtcc

SEQ ID NO: 65256 - DNA, 35 bp, Artificial Sequence
  Synthetic oligonucleotide
acacgttggagcaatcgtcgacccccgccctttcc

SEQ ID NO: 65257 - DNA, 35 bp, Artificial Sequence
  Synthetic oligonucleotide
accccgtatactccgacactcgactggacgaaagc

SEQ ID NO: 65258 - DNA, 35 bp, Artificial Sequence
  Synthetic oligonucleotide
gatcgtccatccatgactattgctccggcccatgc

SEQ ID NO: 65259 - DNA, 35 bp, Artificial Sequence
  Synthetic oligonucleotide
tatgacatctcacaggccacttagataccgactgc

SEQ ID NO: 65260 - DNA, 35 bp, Artificial Sequence
  Synthetic oligonucleotide
agccccccagctcgatctcacggccttaggcttgc

SEQ ID NO: 65261 - DNA, 33 bp, Artificial Sequence
  Synthetic oligonucleotide
gaattgttcccatgcgctgcatgtccactcatc

SEQ ID NO: 65262 - DNA, 35 bp, Artificial Sequence
  Synthetic oligonucleotide
aacaacgatgctgtttccctattatgccgaagctc

SEQ ID NO: 65263 - DNA, 35 bp, Artificial Sequence
  Synthetic oligonucleotide
gtacaggacctgtgaggcgcctcctccccgttctc

SEQ ID NO: 65264 - DNA, 35 bp, Artificial Sequence
  Synthetic oligonucleotide
gaacaggccgtagcgcctcaactagaactttcttc

SEQ ID NO: 65265 - DNA, 33 bp, Artificial Sequence
  Synthetic oligonucleotide
tatctctgccaaacacgtggttaaacatctttc

SEQ ID NO: 65266 - DNA, 35 bp, Artificial Sequence
  Synthetic oligonucleotide
gccgctgaactgtctaccaactcctgcatacatag

SEQ ID NO: 65267 - DNA, 35 bp, Artificial Sequence
  Synthetic oligonucleotide
tgtgagactgcagtaggtcgatgggtggtgtatag

SEQ ID NO: 65268 - DNA, 35 bp, Artificial Sequence
  Synthetic oligonucleotide
aacagagtcgggccgctctcttccctatgccaacg

SEQ ID NO: 65269 - DNA, 35 bp, Artificial Sequence
  Synthetic oligonucleotide
taaacgatagggggaacggtagagggatggggccg

SEQ ID NO: 65270 - DNA, 32 bp, Artificial Sequence
  Synthetic oligonucleotide
tacattcgccaaacaggcgcccacctcttgcg

SEQ ID NO: 65271 - DNA, 35 bp, Artificial Sequence
  Synthetic oligonucleotide
accagcgacacacaaactgctccacaataacgtcg

SEQ ID NO: 65272 - DNA, 35 bp, Artificial Sequence
  Synthetic oligonucleotide
ggtctcccgaattcccctgccttaactaaatgtcg

SEQ ID NO: 65273 - DNA, 35 bp, Artificial Sequence
  Synthetic oligonucleotide
tcacccctctgaatcggttgcgctcgcccatttcg

SEQ ID NO: 65274 - DNA, 35 bp, Artificial Sequence
  Synthetic oligonucleotide
gagagcaggtcaattaaaggagcgttggggatggg

SEQ ID NO: 65275 - DNA, 35 bp, Artificial Sequence
  Synthetic oligonucleotide
gacgtccttcgcccaatttccgcatcagaccctgg

SEQ ID NO: 65276 - DNA, 35 bp, Artificial Sequence
  Synthetic oligonucleotide
gtgcgctacgtgttgctatcccatcatacatgctg

SEQ ID NO: 65277 - DNA, 35 bp, Artificial Sequence
  Synthetic oligonucleotide
ttgaacctgatcacgggagtgtaaacttgctccat

SEQ ID NO: 65278 - DNA, 35 bp, Artificial Sequence
  Synthetic oligonucleotide
tactgtcacatcgccatgtatttatggctatatat

SEQ ID NO: 65279 - DNA, 35 bp, Artificial Sequence
  Synthetic oligonucleotide
gttccctccgacgtacgtttccctgctaactgtat

SEQ ID NO: 65280 - DNA, 35 bp, Artificial Sequence
  Synthetic oligonucleotide
taatcccttcacttcgcgctcaagtcgcacgcact

SEQ ID NO: 65281 - DNA, 35 bp, Artificial Sequence
  Synthetic oligonucleotide
atgatgtgcggtggggtaatagcgtccgggtgcct

SEQ ID NO: 65282 - DNA, 35 bp, Artificial Sequence
  Synthetic oligonucleotide
accgtacggacgcacttgtgaactcgatgtttcct

SEQ ID NO: 65283 - DNA, 35 bp, Artificial Sequence
  Synthetic oligonucleotide
gacggggggcgcgcgggatcgcttgatgaggggct

SEQ ID NO: 65284 - DNA, 35 bp, Artificial Sequence
  Synthetic oligonucleotide
acatcggggcatgcctctacgccaaacatttctct

SEQ ID NO: 65285 - DNA, 35 bp, Artificial Sequence
  Synthetic oligonucleotide
tgccatgacgcagagcgctccaactcctgtttatt

SEQ ID NO: 65286 - DNA, 36 bp, Artificial Sequence
  Synthetic oligonucleotide
tgtgcgcctagcccacgagattcgctgtaacctcaa

SEQ ID NO: 65287 - DNA, 36 bp, Artificial Sequence
  Synthetic oligonucleotide
aacgcactacaaatctctcttcggtaccttgtcgaa

SEQ ID NO: 65288 - DNA, 36 bp, Artificial Sequence
  Synthetic oligonucleotide
ggacccgcccatcacatcagcaaaacgtacccgaca

SEQ ID NO: 65289 - DNA, 36 bp, Artificial Sequence
  Synthetic oligonucleotide
ccacgaccacagttcgaactcgggcctagaatgaca

SEQ ID NO: 65290 - DNA, 36 bp, Artificial Sequence
  Synthetic oligonucleotide
ttgacgattatccgttgggataccacctttttacca

SEQ ID NO: 65291 - DNA, 36 bp, Artificial Sequence
  Synthetic oligonucleotide
gtatcatcagccgcgtccccacgtttgtcatcccca

SEQ ID NO: 65292 - DNA, 35 bp, Artificial Sequence
  Synthetic oligonucleotide
gtacgtactcatgtagtggacttccgctacctcca

SEQ ID NO: 65293 - DNA, 36 bp, Artificial Sequence
  Synthetic oligonucleotide
actccgacaagtatgatcctgtcgctttactttcca

SEQ ID NO: 65294 - DNA, 36 bp, Artificial Sequence
  Synthetic oligonucleotide
gacatacgcggccaatcaacgccatcaacacaagca

SEQ ID NO: 65295 - DNA, 36 bp, Artificial Sequence
  Synthetic oligonucleotide
gcacaccgtacccctgagctcgcgagttacatagca

SEQ ID NO: 65296 - DNA, 35 bp, Artificial Sequence
  Synthetic oligonucleotide
atgtactgcaccggccagttagcgtttcagccgca

SEQ ID NO: 65297 - DNA, 36 bp, Artificial Sequence
  Synthetic oligonucleotide
gttgtggctagcccagtcatctgatacacccctgca

SEQ ID NO: 65298 - DNA, 35 bp, Artificial Sequence
  Synthetic oligonucleotide
tgcaagggtgggtctgggtggaggggtccgctgca

SEQ ID NO: 65299 - DNA, 35 bp, Artificial Sequence
  Synthetic oligonucleotide
gcatccggtaacacaccccgaccgagacgcgttca

SEQ ID NO: 65300 - DNA, 37 bp, Artificial Sequence
  Synthetic oligonucleotide
tatttacccccccccagccctctgacagtgccagaga

SEQ ID NO: 65301 - DNA, 37 bp, Artificial Sequence
  Synthetic oligonucleotide
tcatggcccactgttctgctcctacgggtgtacacga

SEQ ID NO: 65302 - DNA, 36 bp, Artificial Sequence
  Synthetic oligonucleotide
ttacactgccacgactgcgtgctgccaaactctcga

SEQ ID NO: 65303 - DNA, 37 bp, Artificial Sequence
  Synthetic oligonucleotide
tccgatgccctgccggtgcccgtatcctcccccagga

SEQ ID NO: 65304 - DNA, 36 bp, Artificial Sequence
  Synthetic oligonucleotide
acacgcgcaaagggcgaggatgggcgtgggtgagga

SEQ ID NO: 65305 - DNA, 37 bp, Artificial Sequence
  Synthetic oligonucleotide
ggacaggtctcacacaggataaagggctggggtagga

SEQ ID NO: 65306 - DNA, 37 bp, Artificial Sequence
  Synthetic oligonucleotide
gacaggggtggggtacagttctgagcggctcaccgga

SEQ ID NO: 65307 - DNA, 37 bp, Artificial Sequence
  Synthetic oligonucleotide
atctgccacgtacatcgtttccgccctgttaccggga

SEQ ID NO: 65308 - DNA, 37 bp, Artificial Sequence
  Synthetic oligonucleotide
gcaggggtatgggatggagtggggggtgggtcgggga

SEQ ID NO: 65309 - DNA, 37 bp, Artificial Sequence
  Synthetic oligonucleotide
gacataggtcacgtcgctggggggtggaacaggggga

SEQ ID NO: 65310 - DNA, 37 bp, Artificial Sequence
  Synthetic oligonucleotide
accacccgagtgccggtgagcctatttatcttttgga

SEQ ID NO: 65311 - DNA, 38 bp, Artificial Sequence
  Synthetic oligonucleotide
aaacgcgcgctacagacgttcacattgcccatacatga

SEQ ID NO: 65312 - DNA, 38 bp, Artificial Sequence
  Synthetic oligonucleotide
cccacccgccatcgctgccaattgaaatagatccatga

SEQ ID NO: 65313 - DNA, 37 bp, Artificial Sequence
  Synthetic oligonucleotide
gatcgacttgggggcgggtggggcaaagacgtgatga

SEQ ID NO: 65314 - DNA, 38 bp, Artificial Sequence
  Synthetic oligonucleotide
tagccccatacatcttgaacgccgccaatatgcactga

SEQ ID NO: 65315 - DNA, 38 bp, Artificial Sequence
  Synthetic oligonucleotide
acccacgacggtgacgaaagaaggaacgggcggactga

SEQ ID NO: 65316 - DNA, 38 bp, Artificial Sequence
  Synthetic oligonucleotide
atggcccgcactccccgagacacgccccagtaccctga

SEQ ID NO: 65317 - DNA, 36 bp, Artificial Sequence
  Synthetic oligonucleotide
ggaaccggacacgtgacaaaccctcctcgtgcctga

SEQ ID NO: 65318 - DNA, 38 bp, Artificial Sequence
  Synthetic oligonucleotide
ggaaactgcacagtggtggcggtgagagttaaacgtga

SEQ ID NO: 65319 - DNA, 38 bp, Artificial Sequence
  Synthetic oligonucleotide
gaccacttgtatgtcctgtcacccccgtcctcacgtga

SEQ ID NO: 65320 - DNA, 38 bp, Artificial Sequence
  Synthetic oligonucleotide
aatagaggaacgaggtggggcgtaggcacagggcgtga

SEQ ID NO: 65321 - DNA, 38 bp, Artificial Sequence
  Synthetic oligonucleotide
acaaaaaggcatgcaaaggggaggtagggaaatggtga

SEQ ID NO: 65322 - DNA, 38 bp, Artificial Sequence
  Synthetic oligonucleotide
atcccaccctcgctctagagaaggacctatccttgtga

SEQ ID NO: 65323 - DNA, 36 bp, Artificial Sequence
  Synthetic oligonucleotide
gtagagggaggggggagagggaaggttctgaattga

SEQ ID NO: 65324 - DNA, 37 bp, Artificial Sequence
  Synthetic oligonucleotide
ttggcgggactcctgcccttatgcatcaaacttttga

SEQ ID NO: 65325 - DNA, 38 bp, Artificial Sequence
  Synthetic oligonucleotide
tccctacgccctgccccatctgcacctctattttttga

SEQ ID NO: 65326 - DNA, 36 bp, Artificial Sequence
  Synthetic oligonucleotide
agtacaccctgacgtgcgcctacccagctagtacta

SEQ ID NO: 65327 - DNA, 36 bp, Artificial Sequence
  Synthetic oligonucleotide
acattcccccgtacgagaccccgaggagtcaaggta

SEQ ID NO: 65328 - DNA, 36 bp, Artificial Sequence
  Synthetic oligonucleotide
ggggacggacgggtataggctaataggggtgcggta

SEQ ID NO: 65329 - DNA, 35 bp, Artificial Sequence
  Synthetic oligonucleotide
gaacctcgggccaacgtctacttgccatccactta

SEQ ID NO: 65330 - DNA, 36 bp, Artificial Sequence
  Synthetic oligonucleotide
gacgaccattcatccgtgctggtactacccgtgtta

SEQ ID NO: 65331 - DNA, 35 bp, Artificial Sequence
  Synthetic oligonucleotide
aacacctggctatgcactgccacttaccagtagac

SEQ ID NO: 65332 - DNA, 35 bp, Artificial Sequence
  Synthetic oligonucleotide
tctaccgcaagaataatggaggtctcccgtactac

SEQ ID NO: 65333 - DNA, 35 bp, Artificial Sequence
  Synthetic oligonucleotide
acctctcccccgaatgaagcacgccaacatgctac

SEQ ID NO: 65334 - DNA, 35 bp, Artificial Sequence
  Synthetic oligonucleotide
ccccaccgccatcaatgctttcgcctacgtgctac

SEQ ID NO: 65335 - DNA, 35 bp, Artificial Sequence
  Synthetic oligonucleotide
acatgccccacagtgtgagatcttgttctagctcc

SEQ ID NO: 65336 - DNA, 33 bp, Artificial Sequence
  Synthetic oligonucleotide
tccccccgaaagcgtttagcccattcatccagc

SEQ ID NO: 65337 - DNA, 35 bp, Artificial Sequence
  Synthetic oligonucleotide
tgacccatccgtttggccagtggcgtcctttccgc

SEQ ID NO: 65338 - DNA, 35 bp, Artificial Sequence
  Synthetic oligonucleotide
aatgcgcgttgtacgcagccacattcacaattcgc

SEQ ID NO: 65339 - DNA, 35 bp, Artificial Sequence
  Synthetic oligonucleotide
gtccactcgctccgtcttctctatctcagcttcgc

SEQ ID NO: 65340 - DNA, 35 bp, Artificial Sequence
  Synthetic oligonucleotide
gccacgtgtctaatcgaacaaataggttgcccctc

SEQ ID NO: 65341 - DNA, 35 bp, Artificial Sequence
  Synthetic oligonucleotide
acgccccatgactcaggaaacgccgacattctctc

SEQ ID NO: 65342 - DNA, 35 bp, Artificial Sequence
  Synthetic oligonucleotide
gagtcccgtgccctgcccgcattacatcctaagtc

SEQ ID NO: 65343 - DNA, 35 bp, Artificial Sequence
  Synthetic oligonucleotide
tgccaagactccggctattggtacatcgaaccttc

SEQ ID NO: 65344 - DNA, 35 bp, Artificial Sequence
  Synthetic oligonucleotide
gcccattcacttaggttgactgactcgttacgttc

SEQ ID NO: 65345 - DNA, 35 bp, Artificial Sequence
  Synthetic oligonucleotide
ggggtcccatctcccggtccgttcctgcagttttc

SEQ ID NO: 65346 - DNA, 35 bp, Artificial Sequence
  Synthetic oligonucleotide
tcaagacattgacaaggatctaaccaccacccaag

SEQ ID NO: 65347 - DNA, 35 bp, Artificial Sequence
  Synthetic oligonucleotide
gtactgcctcacccggtactggcttcttggttccg

SEQ ID NO: 65348 - DNA, 34 bp, Artificial Sequence
  Synthetic oligonucleotide
gcacacgaggtttagacacactgcagaacctgcg

SEQ ID NO: 65349 - DNA, 35 bp, Artificial Sequence
  Synthetic oligonucleotide
gccggaacaagcgtactaacgaccccagtatctcg

SEQ ID NO: 65350 - DNA, 35 bp, Artificial Sequence
  Synthetic oligonucleotide
gcatatagggagggagacccgaaggacagacgagg

SEQ ID NO: 65351 - DNA, 35 bp, Artificial Sequence
  Synthetic oligonucleotide
gggacgctgtggacaacacagaggggtcaagaggg

SEQ ID NO: 65352 - DNA, 35 bp, Artificial Sequence
  Synthetic oligonucleotide
tcctgcacggtactgtgagggcggagtgaggaggg

SEQ ID NO: 65353 - DNA, 35 bp, Artificial Sequence
  Synthetic oligonucleotide
agcaaaccaccctacataaaactcgccacccgggg

SEQ ID NO: 65354 - DNA, 35 bp, Artificial Sequence
  Synthetic oligonucleotide
gtgacagggtgacacggaaaagaccgggggacatg

SEQ ID NO: 65355 - DNA, 35 bp, Artificial Sequence
  Synthetic oligonucleotide
tatctgaccatgccctgtccgcgcccgtcccatat

SEQ ID NO: 65356 - DNA, 35 bp, Artificial Sequence
  Synthetic oligonucleotide
tgctttagcgcaactgaatacttcctcagctcact

SEQ ID NO: 65357 - DNA, 35 bp, Artificial Sequence
  Synthetic oligonucleotide
tactttccccctgcacggccttggcccccgcccct

SEQ ID NO: 65358 - DNA, 35 bp, Artificial Sequence
  Synthetic oligonucleotide
aatgggatgacaaattggacggaaaaagacacgct

SEQ ID NO: 65359 - DNA, 35 bp, Artificial Sequence
  Synthetic oligonucleotide
ttcgtgtgcccatggttgctgtttgcgcatcctct

SEQ ID NO: 65360 - DNA, 35 bp, Artificial Sequence
  Synthetic oligonucleotide
tcgctcccccattgccttttctaaccccgtttagt

SEQ ID NO: 65361 - DNA, 35 bp, Artificial Sequence
  Synthetic oligonucleotide
agtagaccacgcgggtgggagagagggaagcgtgt

SEQ ID NO: 65362 - DNA, 35 bp, Artificial Sequence
  Synthetic oligonucleotide
gtggcccaaatggacctctttacacctccccttgt

SEQ ID NO: 65363 - DNA, 35 bp, Artificial Sequence
  Synthetic oligonucleotide
aaccgcgccactcatccgtcaaacgcgaaagtatt

SEQ ID NO: 65364 - DNA, 35 bp, Artificial Sequence
  Synthetic oligonucleotide
tcacatacttgtcgctgttggttccactgttactt

SEQ ID NO: 65365 - DNA, 35 bp, Artificial Sequence
  Synthetic oligonucleotide
ttcacgatgccggcgcgctctcggtactgcttgtt

SEQ ID NO: 65366 - DNA, 35 bp, Artificial Sequence
  Synthetic oligonucleotide
gtcaacgccaagttttagtgctacctcgtccattt

SEQ ID NO: 65367 - DNA, 35 bp, Artificial Sequence
  Synthetic oligonucleotide
tcagacacctgtttcattggttttttggtagtttt

SEQ ID NO: 65368 - DNA, 29 bp, Artificial Sequence
  Synthetic oligonucleotide
gttacctcctctatacgtatgtccgaaaa

SEQ ID NO: 65369 - DNA, 36 bp, Artificial Sequence
  Synthetic oligonucleotide
acaacagtaccaccacccgggtaatgcgcacccgaa

SEQ ID NO: 65370 - DNA, 36 bp, Artificial Sequence
  Synthetic oligonucleotide
atcccccttgcatgtagatcttccctacacactgaa

SEQ ID NO: 65371 - DNA, 35 bp, Artificial Sequence
  Synthetic oligonucleotide
agccattcggtcccccccgctgttcctgctcataa

SEQ ID NO: 65372 - DNA, 35 bp, Artificial Sequence
  Synthetic oligonucleotide
attagagcgcggatcgggtcggaaaggcgggaaca

SEQ ID NO: 65373 - DNA, 36 bp, Artificial Sequence
  Synthetic oligonucleotide
gactggcccggcctgtaccatgaccataccttaaca

SEQ ID NO: 65374 - DNA, 35 bp, Artificial Sequence
  Synthetic oligonucleotide
ggtcactcgcggtattccttccctacaaacccaca

SEQ ID NO: 65375 - DNA, 36 bp, Artificial Sequence
  Synthetic oligonucleotide
gaccatgtcgaaccacgtctaaggtacctgcttaca

SEQ ID NO: 65376 - DNA, 35 bp, Artificial Sequence
  Synthetic oligonucleotide
ttccggccacaaaccacgccaaggtacagccccca

SEQ ID NO: 65377 - DNA, 36 bp, Artificial Sequence
  Synthetic oligonucleotide
ttgatttgcagcaccctcaggttgcgatctttccca

SEQ ID NO: 65378 - DNA, 36 bp, Artificial Sequence
  Synthetic oligonucleotide
gacaccctgattggaatttcagatttcttgtctcca

SEQ ID NO: 65379 - DNA, 34 bp, Artificial Sequence
  Synthetic oligonucleotide
tcccacctatcacgctgtattaccaagagaagca

SEQ ID NO: 65380 - DNA, 35 bp, Artificial Sequence
  Synthetic oligonucleotide
ttactccgttccttcgtaagcctcccgccaccgca

SEQ ID NO: 65381 - DNA, 36 bp, Artificial Sequence
  Synthetic oligonucleotide
tggtcaccatcatttaagtcttacccatttgtttca

SEQ ID NO: 65382 - DNA, 37 bp, Artificial Sequence
  Synthetic oligonucleotide
gccaatggggtggaatattatgagtgtgaggcgaaga

SEQ ID NO: 65383 - DNA, 37 bp, Artificial Sequence
  Synthetic oligonucleotide
tcgagactaggatggagggtgggggtaatcggtaaga

SEQ ID NO: 65384 - DNA, 37 bp, Artificial Sequence
  Synthetic oligonucleotide
tgttgggactgggtacgggtgggcctaatggcggaga

SEQ ID NO: 65385 - DNA, 37 bp, Artificial Sequence
  Synthetic oligonucleotide
tacccccgtaaccgatccctagccactacccgataga

SEQ ID NO: 65386 - DNA, 37 bp, Artificial Sequence
  Synthetic oligonucleotide
acccattccaagcgccctcctgccgttgagcattcga

SEQ ID NO: 65387 - DNA, 38 bp, Artificial Sequence
  Synthetic oligonucleotide
gaggagggggagacggcttgcgataagacgagtacgga

SEQ ID NO: 65388 - DNA, 37 bp, Artificial Sequence
  Synthetic oligonucleotide
ggaagggtacgcggagggaggagctaggcaaagcgga

SEQ ID NO: 65389 - DNA, 35 bp, Artificial Sequence
  Synthetic oligonucleotide
ccgaagggcggggcggggtagtactagaacgggga

SEQ ID NO: 65390 - DNA, 35 bp, Artificial Sequence
  Synthetic oligonucleotide
ggtggtaactggagaggcggtgggcaggccgggga

SEQ ID NO: 65391 - DNA, 37 bp, Artificial Sequence
  Synthetic oligonucleotide
gagtggtgtggtggaagggtacaccaaaaggggggga

SEQ ID NO: 65392 - DNA, 37 bp, Artificial Sequence
  Synthetic oligonucleotide
tattgcaacaaggggtggaaacttaggagtgtgggga

SEQ ID NO: 65393 - DNA, 37 bp, Artificial Sequence
  Synthetic oligonucleotide
gagtaggggggaggtggagatctgcataaggtatgga

SEQ ID NO: 65394 - DNA, 38 bp, Artificial Sequence
  Synthetic oligonucleotide
gaggggggggcgagcaacaaagggtcatctgggtatga

SEQ ID NO: 65395 - DNA, 38 bp, Artificial Sequence
  Synthetic oligonucleotide
tacacagacggcggactggactaatgagggggttatga

SEQ ID NO: 65396 - DNA, 37 bp, Artificial Sequence
  Synthetic oligonucleotide
tgacacgcaattggacacgacaagcaacatcgactga

SEQ ID NO: 65397 - DNA, 38 bp, Artificial Sequence
  Synthetic oligonucleotide
gtccgcccagccgccatcccagtttctacctatactga

SEQ ID NO: 65398 - DNA, 38 bp, Artificial Sequence
  Synthetic oligonucleotide
atggccgccaccacctgtcaaactaccagtacgcctga

SEQ ID NO: 65399 - DNA, 38 bp, Artificial Sequence
  Synthetic oligonucleotide
atggtccaagccccgccccgcaccccctcttcgcctga

SEQ ID NO: 65400 - DNA, 38 bp, Artificial Sequence
  Synthetic oligonucleotide
agttcaccgatccctccagtcgtattatgcctgcctga

SEQ ID NO: 65401 - DNA, 37 bp, Artificial Sequence
  Synthetic oligonucleotide
gacgcaacgccatttctaccctccgcagagtgcctga

SEQ ID NO: 65402 - DNA, 38 bp, Artificial Sequence
  Synthetic oligonucleotide
accgaccgtgtcggttgggctagcccacatcctcctga

SEQ ID NO: 65403 - DNA, 37 bp, Artificial Sequence
  Synthetic oligonucleotide
accgagctgccggcatacctgtagctaactttcctga

SEQ ID NO: 65404 - DNA, 38 bp, Artificial Sequence
  Synthetic oligonucleotide
gcgatgtgtcgccgtgccccactccagaaccatgctga

SEQ ID NO: 65405 - DNA, 38 bp, Artificial Sequence
  Synthetic oligonucleotide
gtaggcaaagtagttgacaagggggtggagtttgctga

SEQ ID NO: 65406 - DNA, 38 bp, Artificial Sequence
  Synthetic oligonucleotide
tgccatacgcaatagtatcatccaactacaacctctga

SEQ ID NO: 65407 - DNA, 37 bp, Artificial Sequence
  Synthetic oligonucleotide
atgccaaccccctccatgcggcgtcacgttccagtga

SEQ ID NO: 65408 - DNA, 37 bp, Artificial Sequence
  Synthetic oligonucleotide
ttggaccgctcgcttcgaacctcagggcatcccgtga

SEQ ID NO: 65409 - DNA, 38 bp, Artificial Sequence
  Synthetic oligonucleotide
gccaactcagctgcatcatcccacttccgccttcgtga

SEQ ID NO: 65410 - DNA, 38 bp, Artificial Sequence
  Synthetic oligonucleotide
aaccgctgcgaccacatcttccaaactacctgcattga

SEQ ID NO: 65411 - DNA, 38 bp, Artificial Sequence
  Synthetic oligonucleotide
agacccggccggacgctctcttccctggtcctcattga

SEQ ID NO: 65412 - DNA, 38 bp, Artificial Sequence
  Synthetic oligonucleotide
gttgtacggagggggggtacactaaagggtaggattga

SEQ ID NO: 65413 - DNA, 36 bp, Artificial Sequence
  Synthetic oligonucleotide
actgtcatgttcgctccttcagccctaggctcttga

SEQ ID NO: 65414 - DNA, 38 bp, Artificial Sequence
  Synthetic oligonucleotide
tttgcctcccaagcaatgttgcaactacatgttcttga

SEQ ID NO: 65415 - DNA, 38 bp, Artificial Sequence
  Synthetic oligonucleotide
gaatgatggactgaggtagtaaaagggggaaaggttga

SEQ ID NO: 65416 - DNA, 38 bp, Artificial Sequence
  Synthetic oligonucleotide
acacccccatgtgtaccctatatgccagattcatttga

SEQ ID NO: 65417 - DNA, 38 bp, Artificial Sequence
  Synthetic oligonucleotide
tagcccctatgtcctcgtcacaacgatcccccctttga

SEQ ID NO: 65418 - DNA, 38 bp, Artificial Sequence
  Synthetic oligonucleotide
atgcgtggccacttatctggtttgcgaatatcctttga

SEQ ID NO: 65419 - DNA, 36 bp, Artificial Sequence
  Synthetic oligonucleotide
tccccccgcatacccgcgctacagtttcgtatcata

SEQ ID NO: 65420 - DNA, 36 bp, Artificial Sequence
  Synthetic oligonucleotide
tacctcacatgacaagggttacccgtccctgaacta

SEQ ID NO: 65421 - DNA, 36 bp, Artificial Sequence
  Synthetic oligonucleotide
tacccgccgcccccgcgtttgccgtcctcatggcta

SEQ ID NO: 65422 - DNA, 36 bp, Artificial Sequence
  Synthetic oligonucleotide
gaatggtgccgagcgattgggcagaggagtgaggta

SEQ ID NO: 65423 - DNA, 35 bp, Artificial Sequence
  Synthetic oligonucleotide
aagctgagtccgcccccatgtagtgcttcattgta

SEQ ID NO: 65424 - DNA, 36 bp, Artificial Sequence
  Synthetic oligonucleotide
aatccctcaccaatcagcagtgctcgactgcaatta

SEQ ID NO: 65425 - DNA, 35 bp, Artificial Sequence
  Synthetic oligonucleotide
gtctacgccctcacgtgctttgctgcccaatctta

SEQ ID NO: 65426 - DNA, 36 bp, Artificial Sequence
  Synthetic oligonucleotide
acgacgaccgacttgaccaccatacgaatgttctta

SEQ ID NO: 65427 - DNA, 35 bp, Artificial Sequence
  Synthetic oligonucleotide
tttaccaacgtaccgcccgcgcacttcccatcaac

SEQ ID NO: 65428 - DNA, 35 bp, Artificial Sequence
  Synthetic oligonucleotide
gccccacctgctacactttttgaggcaagctcaac

SEQ ID NO: 65429 - DNA, 35 bp, Artificial Sequence
  Synthetic oligonucleotide
atcacgcaacggtcgcccaccccttatatccacac

SEQ ID NO: 65430 - DNA, 35 bp, Artificial Sequence
  Synthetic oligonucleotide
gactgtggcggcggtatacgcaccaaaactcacac

SEQ ID NO: 65431 - DNA, 35 bp, Artificial Sequence
  Synthetic oligonucleotide
ataccgctgatctgcgcgcaaagttaacatcgcac

SEQ ID NO: 65432 - DNA, 35 bp, Artificial Sequence
  Synthetic oligonucleotide
acctatctgcccttcgagtaataaactcaggatac

SEQ ID NO: 65433 - DNA, 35 bp, Artificial Sequence
  Synthetic oligonucleotide
tacccgcctctggcgactcatagcctttcaattac

SEQ ID NO: 65434 - DNA, 35 bp, Artificial Sequence
  Synthetic oligonucleotide
aggtcaccctggcgctcacgcacgtacattacacc

SEQ ID NO: 65435 - DNA, 35 bp, Artificial Sequence
  Synthetic oligonucleotide
tgatcgggccgcaaatactaccaggttcgacatcc

SEQ ID NO: 65436 - DNA, 35 bp, Artificial Sequence
  Synthetic oligonucleotide
ttatcctgcacacccccggccttctccgcgcatcc

SEQ ID NO: 65437 - DNA, 35 bp, Artificial Sequence
  Synthetic oligonucleotide
ttccgcctcggcaccaacaacacatacccaacagc

SEQ ID NO: 65438 - DNA, 32 bp, Artificial Sequence
  Synthetic oligonucleotide
tggaccacctgacaccctaccccgccattagc

SEQ ID NO: 65439 - DNA, 35 bp, Artificial Sequence
  Synthetic oligonucleotide
gccacggaggcctcctttgcatgccacatgttcgc

SEQ ID NO: 65440 - DNA, 35 bp, Artificial Sequence
  Synthetic oligonucleotide
atccttgatccgccgggaagcactgacttttactc

SEQ ID NO: 65441 - DNA, 35 bp, Artificial Sequence
  Synthetic oligonucleotide
ttgaaaaccaagcccctgacctggcgttagtcctc

SEQ ID NO: 65442 - DNA, 35 bp, Artificial Sequence
  Synthetic oligonucleotide
tgccacccacctgtgtgaattctgtcgatgtcctc

SEQ ID NO: 65443 - DNA, 35 bp, Artificial Sequence
  Synthetic oligonucleotide
ttcgtgtagccctggtcttggtcggttttcccttc

SEQ ID NO: 65444 - DNA, 35 bp, Artificial Sequence
  Synthetic oligonucleotide
tgcccctgtggtcccacacttcccttggacagttc

SEQ ID NO: 65445 - DNA, 35 bp, Artificial Sequence
  Synthetic oligonucleotide
gagcacacgtacgtcccagaactcggtagaacaag

SEQ ID NO: 65446 - DNA, 35 bp, Artificial Sequence
  Synthetic oligonucleotide
gcaacgacgatagagtgggcggagaaagggcttag

SEQ ID NO: 65447 - DNA, 35 bp, Artificial Sequence
  Synthetic oligonucleotide
acccccgggtggaggagaattaggactagggttag

SEQ ID NO: 65448 - DNA, 35 bp, Artificial Sequence
  Synthetic oligonucleotide
atccgccagccacataactctcggatgacctaacg

SEQ ID NO: 65449 - DNA, 35 bp, Artificial Sequence
  Synthetic oligonucleotide
gttccacgcgcagggcagttctatcttctcttccg

SEQ ID NO: 65450 - DNA, 35 bp, Artificial Sequence
  Synthetic oligonucleotide
gccagcaaaacttgctcctttcgaacccacctagg

SEQ ID NO: 65451 - DNA, 35 bp, Artificial Sequence
  Synthetic oligonucleotide
agggaggacatggtggcgggcggtcggtggtaggg

SEQ ID NO: 65452 - DNA, 35 bp, Artificial Sequence
  Synthetic oligonucleotide
gatacgtgacgagaacaaggttgggggtggacggg

SEQ ID NO: 65453 - DNA, 35 bp, Artificial Sequence
  Synthetic oligonucleotide
agacgcacacacagctccactgcacagcctcttgg

SEQ ID NO: 65454 - DNA, 35 bp, Artificial Sequence
  Synthetic oligonucleotide
gaccacacgtacttagtctttttgcctgtcttctg

SEQ ID NO: 65455 - DNA, 35 bp, Artificial Sequence
  Synthetic oligonucleotide
ggaccattatgccgatcgggcctgacctactcttg

SEQ ID NO: 65456 - DNA, 35 bp, Artificial Sequence
  Synthetic oligonucleotide
ggacgatcgatctggtactccgtcactttcttttg

SEQ ID NO: 65457 - DNA, 35 bp, Artificial Sequence
  Synthetic oligonucleotide
tccgcccatggccaacagttactgcatgctgacat

SEQ ID NO: 65458 - DNA, 35 bp, Artificial Sequence
  Synthetic oligonucleotide
attcacctgccatcctcctgttctcaactagccat

SEQ ID NO: 65459 - DNA, 35 bp, Artificial Sequence
  Synthetic oligonucleotide
gatcacgaaggagtcggcgcacgcatttaccctat

SEQ ID NO: 65460 - DNA, 35 bp, Artificial Sequence
  Synthetic oligonucleotide
gtcatcacagcatcgactctcttttgttattcact

SEQ ID NO: 65461 - DNA, 35 bp, Artificial Sequence
  Synthetic oligonucleotide
gccatgacagcatttagcgtactcagttcccgggt

SEQ ID NO: 65462 - DNA, 35 bp, Artificial Sequence
  Synthetic oligonucleotide
gcccaaccttaggcactagaaagtaacaggccctt

SEQ ID NO: 65463 - DNA, 35 bp, Artificial Sequence
  Synthetic oligonucleotide
caatgtaggagggggaggtatacgggcggggtgtt

SEQ ID NO: 65464 - DNA, 35 bp, Artificial Sequence
  Synthetic oligonucleotide
tgccacactgtagcttgttcgccgaaacttgaaaa

SEQ ID NO: 65465 - DNA, 35 bp, Artificial Sequence
  Synthetic oligonucleotide
gacgccgttttcggtgtcgctgaacgcttaccaaa

SEQ ID NO: 65466 - DNA, 36 bp, Artificial Sequence
  Synthetic oligonucleotide
tccatctgtcactggcacttgtcttcttgccccaaa

SEQ ID NO: 65467 - DNA, 35 bp, Artificial Sequence
  Synthetic oligonucleotide
tgccccctcctcgtccctatcgcgacacatcccaa

SEQ ID NO: 65468 - DNA, 36 bp, Artificial Sequence
  Synthetic oligonucleotide
accatgcccgggtaactttctagtccagccctccaa

SEQ ID NO: 65469 - DNA, 36 bp, Artificial Sequence
  Synthetic oligonucleotide
tatccgcgtaggttccggatgccctgcctgctccaa

SEQ ID NO: 65470 - DNA, 36 bp, Artificial Sequence
  Synthetic oligonucleotide
ttccacctagagttgtcactattctggccctctcaa

SEQ ID NO: 65471 - DNA, 36 bp, Artificial Sequence
  Synthetic oligonucleotide
attgggcgcattggactaggcgaggggagctgggaa

SEQ ID NO: 65472 - DNA, 36 bp, Artificial Sequence
  Synthetic oligonucleotide
gcacgccgcaccgtttagggcctctacccacccaca

SEQ ID NO: 65473 - DNA, 36 bp, Artificial Sequence
  Synthetic oligonucleotide
gagaggcgcctctcaatgtttaccaatacgcccaca

SEQ ID NO: 65474 - DNA, 36 bp, Artificial Sequence
  Synthetic oligonucleotide
tgtgaccccgcgaaacatgccccattattgcaacca

SEQ ID NO: 65475 - DNA, 36 bp, Artificial Sequence
  Synthetic oligonucleotide
tgctgacgcctcgtattctctcttttgtgcaatcca

SEQ ID NO: 65476 - DNA, 36 bp, Artificial Sequence
  Synthetic oligonucleotide
atactgtctccggtccatggtcaactactcgctcca

SEQ ID NO: 65477 - DNA, 36 bp, Artificial Sequence
  Synthetic oligonucleotide
tgtcgatgtagctgatggttttgcggctccccctca

SEQ ID NO: 65478 - DNA, 36 bp, Artificial Sequence
  Synthetic oligonucleotide
aatccccgcaaacattaaccccacgttaatgtttca

SEQ ID NO: 65479 - DNA, 37 bp, Artificial Sequence
  Synthetic oligonucleotide
gtgcgggggcgagtaagggttgggtccttcggcaaga

SEQ ID NO: 65480 - DNA, 37 bp, Artificial Sequence
  Synthetic oligonucleotide
gttcgaacacgggtaaaggagagacacaacgcacaga

SEQ ID NO: 65481 - DNA, 37 bp, Artificial Sequence
  Synthetic oligonucleotide
tgtggtgcacgaggtgaaggtaggcacgttgaagaga

SEQ ID NO: 65482 - DNA, 37 bp, Artificial Sequence
  Synthetic oligonucleotide
aaagcaaagccagcaaattatttgtttcatccaccga

SEQ ID NO: 65483 - DNA, 37 bp, Artificial Sequence
  Synthetic oligonucleotide
acttgccgtctctcgtattccccgtccccgtgagcga

SEQ ID NO: 65484 - DNA, 37 bp, Artificial Sequence
  Synthetic oligonucleotide
tgactccgtcgagcttattcacgtgctcaaccatcga

SEQ ID NO: 65485 - DNA, 37 bp, Artificial Sequence
  Synthetic oligonucleotide
gtccccccgtgttcttatgatccatttgtgccttcga

SEQ ID NO: 65486 - DNA, 37 bp, Artificial Sequence
  Synthetic oligonucleotide
aagacgggccagtggagttgcacggagtgagatagga

SEQ ID NO: 65487 - DNA, 37 bp, Artificial Sequence
  Synthetic oligonucleotide
atagcgcaccatctcgctcctcctttgtattgtcgga

SEQ ID NO: 65488 - DNA, 37 bp, Artificial Sequence
  Synthetic oligonucleotide
agtccgcctactgcgcccgacttcttcacctttcgga

SEQ ID NO: 65489 - DNA, 37 bp, Artificial Sequence
  Synthetic oligonucleotide
agtcgccgggaaagcaggagcaaggggaagggcggga

SEQ ID NO: 65490 - DNA, 37 bp, Artificial Sequence
  Synthetic oligonucleotide
aaagtggacctccgtgtggtggtagggggtaggggga

SEQ ID NO: 65491 - DNA, 37 bp, Artificial Sequence
  Synthetic oligonucleotide
atgaccgggactgtggggagcatcagatacttgggga

SEQ ID NO: 65492 - DNA, 37 bp, Artificial Sequence
  Synthetic oligonucleotide
gatcaagtgggcgagaagttcgggggttcgtgtggga

SEQ ID NO: 65493 - DNA, 38 bp, Artificial Sequence
  Synthetic oligonucleotide
tgccacaccttccgcctgttcctcgtgtttgcacatga

SEQ ID NO: 65494 - DNA, 38 bp, Artificial Sequence
  Synthetic oligonucleotide
gatgcatgtcctccagtgtagctcgcccctgttcatga

SEQ ID NO: 65495 - DNA, 38 bp, Artificial Sequence
  Synthetic oligonucleotide
gcaaggggccggggggaggaagcagtacccctggatga

SEQ ID NO: 65496 - DNA, 38 bp, Artificial Sequence
  Synthetic oligonucleotide
gtcacttacgctctcgttatccagcccgtccgccctga

SEQ ID NO: 65497 - DNA, 38 bp, Artificial Sequence
  Synthetic oligonucleotide
ttagtgcactggcggggtgggaaggataggggctctga

SEQ ID NO: 65498 - DNA, 38 bp, Artificial Sequence
  Synthetic oligonucleotide
tgtgagtgggcgggtatgaagcgttccacgattggtga

SEQ ID NO: 65499 - DNA, 37 bp, Artificial Sequence
  Synthetic oligonucleotide
acattatgtggagagggataaagtgtgagcaatgtga

SEQ ID NO: 65500 - DNA, 38 bp, Artificial Sequence
  Synthetic oligonucleotide
acaaccgaagggatagggcctggcatggggtggattga

SEQ ID NO: 65501 - DNA, 38 bp, Artificial Sequence
  Synthetic oligonucleotide
gtccctgtcacatctcgcaactgaagcctcgtccttga

SEQ ID NO: 65502 - DNA, 38 bp, Artificial Sequence
  Synthetic oligonucleotide
actgtgtcccaatcgccacttgagtcctgttcgcttga

SEQ ID NO: 65503 - DNA, 38 bp, Artificial Sequence
  Synthetic oligonucleotide
tacgcgggtatctaaaggcgggaatgaagggggcttga

SEQ ID NO: 65504 - DNA, 38 bp, Artificial Sequence
  Synthetic oligonucleotide
gaaccgcaccatccagtttcgacccttcggcttcttga

SEQ ID NO: 65505 - DNA, 36 bp, Artificial Sequence
  Synthetic oligonucleotide
tgatccaccgacctcctgtactttgtctcgtcaata

SEQ ID NO: 65506 - DNA, 36 bp, Artificial Sequence
  Synthetic oligonucleotide
tccacctcgcattctctattaagagctcctgtgcta

SEQ ID NO: 65507 - DNA, 35 bp, Artificial Sequence
  Synthetic oligonucleotide
gcgagtgcaaggagggcttagggaggttaattgta

SEQ ID NO: 65508 - DNA, 34 bp, Artificial Sequence
  Synthetic oligonucleotide
gtgcacaggcttgtcacatatgcccaacacatta

SEQ ID NO: 65509 - DNA, 36 bp, Artificial Sequence
  Synthetic oligonucleotide
tagtcaacgaacttcgcgaaccctgtgcattcatta

SEQ ID NO: 65510 - DNA, 36 bp, Artificial Sequence
  Synthetic oligonucleotide
gtcaaacgcgcggggatggaagaggccatgaggtta

SEQ ID NO: 65511 - DNA, 35 bp, Artificial Sequence
  Synthetic oligonucleotide
gtctccagttacgaattgcctatccagctgaacac

SEQ ID NO: 65512 - DNA, 35 bp, Artificial Sequence
  Synthetic oligonucleotide
tccatcgttgtagcaacatgtactctccctcacac

SEQ ID NO: 65513 - DNA, 35 bp, Artificial Sequence
  Synthetic oligonucleotide
tactagccacgccaccggttatcgggtagtttcac

SEQ ID NO: 65514 - DNA, 35 bp, Artificial Sequence
  Synthetic oligonucleotide
tacacggctgtatcctccttgaggcaccatttgac

SEQ ID NO: 65515 - DNA, 34 bp, Artificial Sequence
  Synthetic oligonucleotide
agagccctccctgtgcttaaattccctcggttac

SEQ ID NO: 65516 - DNA, 35 bp, Artificial Sequence
  Synthetic oligonucleotide
gtgcacgatcaaacccgatcctcgcagttatcacc

SEQ ID NO: 65517 - DNA, 35 bp, Artificial Sequence
  Synthetic oligonucleotide
actaatccaaccaacacattactgaagaggagccc

SEQ ID NO: 65518 - DNA, 35 bp, Artificial Sequence
  Synthetic oligonucleotide
gattgccggtcctttcacctacgtaacactcgccc

SEQ ID NO: 65519 - DNA, 35 bp, Artificial Sequence
  Synthetic oligonucleotide
tcaccaccagtactaccaacgccgcgctaaacgcc

SEQ ID NO: 65520 - DNA, 35 bp, Artificial Sequence
  Synthetic oligonucleotide
tgacactccccgtcccttcctctttgtttgctgcc

SEQ ID NO: 65521 - DNA, 35 bp, Artificial Sequence
  Synthetic oligonucleotide
gactgccgttcccttagtgtcagtcgccgttctcc

SEQ ID NO: 65522 - DNA, 35 bp, Artificial Sequence
  Synthetic oligonucleotide
gagaccgcacttctgtcccgtgattctcatgttcc

SEQ ID NO: 65523 - DNA, 35 bp, Artificial Sequence
  Synthetic oligonucleotide
tacgcccacttttactatcacgccgccgttacggc

SEQ ID NO: 65524 - DNA, 35 bp, Artificial Sequence
  Synthetic oligonucleotide
gaacacaacacccctgacttacgtcccacccgggc

SEQ ID NO: 65525 - DNA, 35 bp, Artificial Sequence
  Synthetic oligonucleotide
tgcctcaaatcccgatatcaccctcacatgctggc

SEQ ID NO: 65526 - DNA, 35 bp, Artificial Sequence
  Synthetic oligonucleotide
acacctgctacagtcatagtttcttattcgtcatc

SEQ ID NO: 65527 - DNA, 35 bp, Artificial Sequence
  Synthetic oligonucleotide
gcgacgcttcggtccctcttgccccagatcatatc

SEQ ID NO: 65528 - DNA, 35 bp, Artificial Sequence
  Synthetic oligonucleotide
tcttacgcccccccgtgcttcatactcattgattc

SEQ ID NO: 65529 - DNA, 35 bp, Artificial Sequence
  Synthetic oligonucleotide
actcccccaggcctccacgcatgccgagaactttc

SEQ ID NO: 65530 - DNA, 35 bp, Artificial Sequence
  Synthetic oligonucleotide
tacggtcatcatgtttacccacaccatgtcttttc

SEQ ID NO: 65531 - DNA, 35 bp, Artificial Sequence
  Synthetic oligonucleotide
tgtggaagaaagtttgggacggataatgaaaacag

SEQ ID NO: 65532 - DNA, 35 bp, Artificial Sequence
  Synthetic oligonucleotide
gtgatccggatccgcctttactctaccccgccgag

SEQ ID NO: 65533 - DNA, 35 bp, Artificial Sequence
  Synthetic oligonucleotide
gtgggatgtaagagtaacgtggtgggtgggttgag

SEQ ID NO: 65534 - DNA, 35 bp, Artificial Sequence
  Synthetic oligonucleotide
ttgtcaatcgcttgcgactacccttcatcctctag

SEQ ID NO: 65535 - DNA, 35 bp, Artificial Sequence
  Synthetic oligonucleotide
gaagcacccacatgcagtaccgtcatagctaatcg

SEQ ID NO: 65536 - DNA, 35 bp, Artificial Sequence
  Synthetic oligonucleotide
accgcggtcatcaaatcatgaattattctgtcctg

SEQ ID NO: 65537 - DNA, 35 bp, Artificial Sequence
  Synthetic oligonucleotide
accgcacagcagatctcccggcctccgatcttctg

SEQ ID NO: 65538 - DNA, 35 bp, Artificial Sequence
  Synthetic oligonucleotide
atgcacctgccagacttttttcttgtgtttcattg

SEQ ID NO: 65539 - DNA, 35 bp, Artificial Sequence
  Synthetic oligonucleotide
gtcatgtgcggtgaacaaagcaaaaaataggaaat

SEQ ID NO: 65540 - DNA, 35 bp, Artificial Sequence
  Synthetic oligonucleotide
acacttccacacatcgtggctttgagaacatcact

SEQ ID NO: 65541 - DNA, 35 bp, Artificial Sequence
  Synthetic oligonucleotide
tctgtccggtcagatccggcccgtacacacatact

SEQ ID NO: 65542 - DNA, 35 bp, Artificial Sequence
  Synthetic oligonucleotide
attgcaggctggtgtcacgccttttcgctcttact

SEQ ID NO: 65543 - DNA, 35 bp, Artificial Sequence
  Synthetic oligonucleotide
taaccgagatggttcgattgcccggtattacccct

SEQ ID NO: 65544 - DNA, 35 bp, Artificial Sequence
  Synthetic oligonucleotide
accacgtatcggggtcggagcttggacttcatcct

SEQ ID NO: 65545 - DNA, 35 bp, Artificial Sequence
  Synthetic oligonucleotide
gacaccctccgtgttcctttatggtgatccctgct

SEQ ID NO: 65546 - DNA, 35 bp, Artificial Sequence
  Synthetic oligonucleotide
ttcccccgccaatatgagtttgcgccgccctgagt

SEQ ID NO: 65547 - DNA, 35 bp, Artificial Sequence
  Synthetic oligonucleotide
tgaacgcattgtgccctcaagttagccctacatgt

SEQ ID NO: 65548 - DNA, 35 bp, Artificial Sequence
  Synthetic oligonucleotide
gacctatctcagcacataatcactgccatcttatt

SEQ ID NO: 65549 - DNA, 36 bp, Artificial Sequence
  Synthetic oligonucleotide
aagtcacccacgaatctccgtagccacctgctaaaa

SEQ ID NO: 65550 - DNA, 36 bp, Artificial Sequence
  Synthetic oligonucleotide
ttcgcaaacgggtaggcattcaagggaggaacgaaa

SEQ ID NO: 65551 - DNA, 36 bp, Artificial Sequence
  Synthetic oligonucleotide
tacgaaagacgtggtaggtaaggtggtgtgcataaa

SEQ ID NO: 65552 - DNA, 35 bp, Artificial Sequence
  Synthetic oligonucleotide
atcccacgtccctatagcacaacatcgccggtaaa

SEQ ID NO: 65553 - DNA, 36 bp, Artificial Sequence
  Synthetic oligonucleotide
gaacacaacttagtgccctcgcctccaccggtacaa

SEQ ID NO: 65554 - DNA, 36 bp, Artificial Sequence
  Synthetic oligonucleotide
atcgccattcccacctcacaatatatgcatgtacaa

SEQ ID NO: 65555 - DNA, 36 bp, Artificial Sequence
  Synthetic oligonucleotide
tgacacggcataataatttcgcgtgggggtttgcaa

SEQ ID NO: 65556 - DNA, 35 bp, Artificial Sequence
  Synthetic oligonucleotide
gactgcactacgctctggaacctatggccgatcaa

SEQ ID NO: 65557 - DNA, 36 bp, Artificial Sequence
  Synthetic oligonucleotide
tacagccaacgtatcggtacccccacaatctctcaa

SEQ ID NO: 65558 - DNA, 35 bp, Artificial Sequence
  Synthetic oligonucleotide
gccacgatcaaagaatccctctgaccatctggtaa

SEQ ID NO: 65559 - DNA, 35 bp, Artificial Sequence
  Synthetic oligonucleotide
tccgcactggtccgtcgaccttctctccttataca

SEQ ID NO: 65560 - DNA, 36 bp, Artificial Sequence
  Synthetic oligonucleotide
gcacgagagtcctggctgcccaagtctatcccacca

SEQ ID NO: 65561 - DNA, 34 bp, Artificial Sequence
  Synthetic oligonucleotide
gagacacacaactgttgctagttctcgcctccca

SEQ ID NO: 65562 - DNA, 36 bp, Artificial Sequence
  Synthetic oligonucleotide
atcacgtaggaccgtgcgtggtgggaggttaatgca

SEQ ID NO: 65563 - DNA, 35 bp, Artificial Sequence
  Synthetic oligonucleotide
acccgtcgtggcagcttcaagcgcatcttttctca

SEQ ID NO: 65564 - DNA, 37 bp, Artificial Sequence
  Synthetic oligonucleotide
gccccgccaccataaactcggcttcattgtcccgaga

SEQ ID NO: 65565 - DNA, 37 bp, Artificial Sequence
  Synthetic oligonucleotide
gaaggagggatcgggcggggtgacagcagctggtaga

SEQ ID NO: 65566 - DNA, 37 bp, Artificial Sequence
  Synthetic oligonucleotide
acacaacgcgattttgtcccatctttgtttagttaga

SEQ ID NO: 65567 - DNA, 37 bp, Artificial Sequence
  Synthetic oligonucleotide
gacaagacacgaagtacggggaagtgtggggtttaga

SEQ ID NO: 65568 - DNA, 37 bp, Artificial Sequence
  Synthetic oligonucleotide
gtgacgggggaattgtcgggaagagtgggctgtccga

SEQ ID NO: 65569 - DNA, 37 bp, Artificial Sequence
  Synthetic oligonucleotide
tagcccctagctgctgaccagtccccatacattccga

SEQ ID NO: 65570 - DNA, 37 bp, Artificial Sequence
  Synthetic oligonucleotide
tgaacgtaggatcaagagtagagggggaaagtgtcga

SEQ ID NO: 65571 - DNA, 37 bp, Artificial Sequence
  Synthetic oligonucleotide
aaccctaccactgacaaaatttgcaggcccccacgga

SEQ ID NO: 65572 - DNA, 37 bp, Artificial Sequence
  Synthetic oligonucleotide
atgtgggggtagggtgggcactgtgtcgggttacgga

SEQ ID NO: 65573 - DNA, 37 bp, Artificial Sequence
  Synthetic oligonucleotide
tcatcccccgacattacgaggtggcttccccgaggga

SEQ ID NO: 65574 - DNA, 37 bp, Artificial Sequence
  Synthetic oligonucleotide
gagggatagacggttagcaatgggggtttgggaggga

SEQ ID NO: 65575 - DNA, 37 bp, Artificial Sequence
  Synthetic oligonucleotide
actgctacacatcgcggttccagcacctaccattgga

SEQ ID NO: 65576 - DNA, 38 bp, Artificial Sequence
  Synthetic oligonucleotide
actcatccatgcacgcctaaaacatgcagtcgcaatga

SEQ ID NO: 65577 - DNA, 38 bp, Artificial Sequence
  Synthetic oligonucleotide
ggatgaggtgatggggaaaaatggttgggcagagatga

SEQ ID NO: 65578 - DNA, 37 bp, Artificial Sequence
  Synthetic oligonucleotide
tcagagtgctccaactgaagctgcccgcacactatga

SEQ ID NO: 65579 - DNA, 38 bp, Artificial Sequence
  Synthetic oligonucleotide
gcactcggcacaatgtccacgctacattcccaaactga

SEQ ID NO: 65580 - DNA, 37 bp, Artificial Sequence
  Synthetic oligonucleotide
ttcactcccaacttcttacctatgagccttcccctga

SEQ ID NO: 65581 - DNA, 37 bp, Artificial Sequence
  Synthetic oligonucleotide
gcatcaccgcctttattcgtatactattgttccctga

SEQ ID NO: 65582 - DNA, 38 bp, Artificial Sequence
  Synthetic oligonucleotide
agcccgccgggctatacacattcgatgacgcatcctga

SEQ ID NO: 65583 - DNA, 37 bp, Artificial Sequence
  Synthetic oligonucleotide
atgccctactcatgatgactccgccctatggtcctga

SEQ ID NO: 65584 - DNA, 38 bp, Artificial Sequence
  Synthetic oligonucleotide
tttcaataccacccgtgtcgcataacgaatcttcctga

SEQ ID NO: 65585 - DNA, 38 bp, Artificial Sequence
  Synthetic oligonucleotide
tcgatgcctcgaccccacatttgagttcccctggctga

SEQ ID NO: 65586 - DNA, 38 bp, Artificial Sequence
  Synthetic oligonucleotide
actacgtccggaacttagcttaatttgcaccactctga

SEQ ID NO: 65587 - DNA, 38 bp, Artificial Sequence
  Synthetic oligonucleotide
gcaactgaatccgagccaccacgacgtctcctctctga

SEQ ID NO: 65588 - DNA, 37 bp, Artificial Sequence
  Synthetic oligonucleotide
gcacagtctaatgtccacctctccacctttatagtga

SEQ ID NO: 65589 - DNA, 37 bp, Artificial Sequence
  Synthetic oligonucleotide
attgaccgatcctgtcatctcacacctttttgcgtga

SEQ ID NO: 65590 - DNA, 38 bp, Artificial Sequence
  Synthetic oligonucleotide
atgtgggggcgggggtcgcaaagacgcactgttggtga

SEQ ID NO: 65591 - DNA, 38 bp, Artificial Sequence
  Synthetic oligonucleotide
gtccaggtagccaatgtggtaggggttgggggatgtga

SEQ ID NO: 65592 - DNA, 38 bp, Artificial Sequence
  Synthetic oligonucleotide
gtgaggggataagggttatgggttcggacggggattga

SEQ ID NO: 65593 - DNA, 38 bp, Artificial Sequence
  Synthetic oligonucleotide
acatctcctgctgctgaccttatctcatccaacgttga

SEQ ID NO: 65594 - DNA, 36 bp, Artificial Sequence
  Synthetic oligonucleotide
aacgcgccggtttcccaggcgtgatctgttccccta

SEQ ID NO: 65595 - DNA, 35 bp, Artificial Sequence
  Synthetic oligonucleotide
taagttcgccccttgtccgcccgatctggatccta

SEQ ID NO: 65596 - DNA, 36 bp, Artificial Sequence
  Synthetic oligonucleotide
accgttcgtatgaacccgtaacactgtcttgctcta

SEQ ID NO: 65597 - DNA, 35 bp, Artificial Sequence
  Synthetic oligonucleotide
gtccgaggacacgatacaggacacaagggacagta

SEQ ID NO: 65598 - DNA, 34 bp, Artificial Sequence
  Synthetic oligonucleotide
tacacctggattgccgccaaaccgccttttatta

SEQ ID NO: 65599 - DNA, 36 bp, Artificial Sequence
  Synthetic oligonucleotide
gcctgacgttgtagccgccctttagccccacactta

SEQ ID NO: 65600 - DNA, 36 bp, Artificial Sequence
  Synthetic oligonucleotide
tagtccccctgatctaattgtaaccctggcccttta

SEQ ID NO: 65601 - DNA, 35 bp, Artificial Sequence
  Synthetic oligonucleotide
aaggagaggggtggcatggagggtgggaattcaac

SEQ ID NO: 65602 - DNA, 35 bp, Artificial Sequence
  Synthetic oligonucleotide
tgcttcctcgatgccccagccatacccccgctaac

SEQ ID NO: 65603 - DNA, 35 bp, Artificial Sequence
  Synthetic oligonucleotide
acctcatcctggtgcctctgacaccgtctccttac

SEQ ID NO: 65604 - DNA, 35 bp, Artificial Sequence
  Synthetic oligonucleotide
atagccaccgccgagccttcatatactggccgccc

SEQ ID NO: 65605 - DNA, 35 bp, Artificial Sequence
  Synthetic oligonucleotide
agccaagcaatccccttccagcccccggtgcagcc

SEQ ID NO: 65606 - DNA, 35 bp, Artificial Sequence
  Synthetic oligonucleotide
tccacggtcagtcgttccctaactccctttgtgcc

SEQ ID NO: 65607 - DNA, 35 bp, Artificial Sequence
  Synthetic oligonucleotide
gagtacgttccgctcctcatggtgcatgatcatcc

SEQ ID NO: 65608 - DNA, 35 bp, Artificial Sequence
  Synthetic oligonucleotide
gctcctatcctccatcctgggcagggcctcagtcc

SEQ ID NO: 65609 - DNA, 35 bp, Artificial Sequence
  Synthetic oligonucleotide
gagcatccacctgccaatatgacaagcctgggtcc

SEQ ID NO: 65610 - DNA, 35 bp, Artificial Sequence
  Synthetic oligonucleotide
aactacccatggaactggccccgcccgacagacgc

SEQ ID NO: 65611 - DNA, 35 bp, Artificial Sequence
  Synthetic oligonucleotide
acagcacctcgcatacctatcaccgtcccggtcgc

SEQ ID NO: 65612 - DNA, 35 bp, Artificial Sequence
  Synthetic oligonucleotide
gtgagtaagggaaagatggggggtaaatcagtggc

SEQ ID NO: 65613 - DNA, 35 bp, Artificial Sequence
  Synthetic oligonucleotide
tgccccgccactggaaaattggtttccgcatatgc

SEQ ID NO: 65614 - DNA, 35 bp, Artificial Sequence
  Synthetic oligonucleotide
ttaacccgatctggttggtacaaccttccttatgc

SEQ ID NO: 65615 - DNA, 35 bp, Artificial Sequence
  Synthetic oligonucleotide
tgcctagcctcttgtcaccctctgcattccattgc

SEQ ID NO: 65616 - DNA, 35 bp, Artificial Sequence
  Synthetic oligonucleotide
tatggcccgtgccccatacgacggaacttaacctc

SEQ ID NO: 65617 - DNA, 35 bp, Artificial Sequence
  Synthetic oligonucleotide
tctacccatctggtagactatgtggtacctctctc

SEQ ID NO: 65618 - DNA, 35 bp, Artificial Sequence
  Synthetic oligonucleotide
gccgaggtaggtggctgggggcttggaaggtggag

SEQ ID NO: 65619 - DNA, 35 bp, Artificial Sequence
  Synthetic oligonucleotide
aagattgccaccccttctgtattcactacgtgacg

SEQ ID NO: 65620 - DNA, 35 bp, Artificial Sequence
  Synthetic oligonucleotide
agatgccacttgactatttagccttattgcctacg

SEQ ID NO: 65621 - DNA, 35 bp, Artificial Sequence
  Synthetic oligonucleotide
gatgttccgttctccagtgatgttttgtggtctcg

SEQ ID NO: 65622 - DNA, 35 bp, Artificial Sequence
  Synthetic oligonucleotide
gtcgtgcctcaggtcgtaaaatccccgtcgtgtcg

SEQ ID NO: 65623 - DNA, 36 bp, Artificial Sequence
  Synthetic oligonucleotide
ggagggtgaggagcaaatagaaaaagtcgtgttagg

SEQ ID NO: 65624 - DNA, 35 bp, Artificial Sequence
  Synthetic oligonucleotide
tcgaccccgcctgacatctttcggtcatactccgg

SEQ ID NO: 65625 - DNA, 35 bp, Artificial Sequence
  Synthetic oligonucleotide
gatgacaaagcagggtgttgggagttgtgaagggg

SEQ ID NO: 65626 - DNA, 35 bp, Artificial Sequence
  Synthetic oligonucleotide
ttacctcctgaaatcgtatatccacatgtcctctg

SEQ ID NO: 65627 - DNA, 35 bp, Artificial Sequence
  Synthetic oligonucleotide
ggtgagagcaaagtggggtagggcgatgagaattg

SEQ ID NO: 65628 - DNA, 35 bp, Artificial Sequence
  Synthetic oligonucleotide
gtggccaactgaaagtcctattcataaatcgcttg

SEQ ID NO: 65629 - DNA, 35 bp, Artificial Sequence
  Synthetic oligonucleotide
tcacgaatggggtaccgcagcctaggggaatcaat

SEQ ID NO: 65630 - DNA, 35 bp, Artificial Sequence
  Synthetic oligonucleotide
accaaatctgccgctgccgttgacctaccatttat

SEQ ID NO: 65631 - DNA, 35 bp, Artificial Sequence
  Synthetic oligonucleotide
gagcggccttgatcctatgaccatctccatgctct

SEQ ID NO: 65632 - DNA, 35 bp, Artificial Sequence
  Synthetic oligonucleotide
gtttagcgcgggacggggggaaaaaaagagaaggt

SEQ ID NO: 65633 - DNA, 35 bp, Artificial Sequence
  Synthetic oligonucleotide
tacagtgggggggcggtgaccgataagttatgggt

SEQ ID NO: 65634 - DNA, 35 bp, Artificial Sequence
  Synthetic oligonucleotide
gaaacgtccaccccagtttacattatacattatgt

SEQ ID NO: 65635 - DNA, 35 bp, Artificial Sequence
  Synthetic oligonucleotide
gatgactctcgcctctcactctagcaagtagactt

SEQ ID NO: 65636 - DNA, 35 bp, Artificial Sequence
  Synthetic oligonucleotide
gagggaccgtagccggccgtatcttttgttggttt

SEQ ID NO: 65637 - DNA, 36 bp, Artificial Sequence
  Synthetic oligonucleotide
ttcctgccccgtatctcgttggaatccgccccgaaa

SEQ ID NO: 65638 - DNA, 36 bp, Artificial Sequence
  Synthetic oligonucleotide
ggaccagcccaatttttgcttcaccggcggacccaa

SEQ ID NO: 65639 - DNA, 36 bp, Artificial Sequence
  Synthetic oligonucleotide
taccaccctcacgtgctgtgccaaaattattagcaa

SEQ ID NO: 65640 - DNA, 36 bp, Artificial Sequence
  Synthetic oligonucleotide
gagcatggcctttgtcctatttaatcttcgcctgaa

SEQ ID NO: 65641 - DNA, 36 bp, Artificial Sequence
  Synthetic oligonucleotide
ttcgcacttagggcaacacgcgctgttctttacaca

SEQ ID NO: 65642 - DNA, 35 bp, Artificial Sequence
  Synthetic oligonucleotide
tcttcaagcccctcccatggcggcctttacccaca

SEQ ID NO: 65643 - DNA, 36 bp, Artificial Sequence
  Synthetic oligonucleotide
tcccacaaggccgacttattctacgacacctggaca

SEQ ID NO: 65644 - DNA, 36 bp, Artificial Sequence
  Synthetic oligonucleotide
gactacgggtccttgaagcgaaatgcaccgtaacca

SEQ ID NO: 65645 - DNA, 36 bp, Artificial Sequence
  Synthetic oligonucleotide
gagatgccgcctatacatctccaccccagttcccca

SEQ ID NO: 65646 - DNA, 36 bp, Artificial Sequence
  Synthetic oligonucleotide
atgctgtgctaccaactcttttgggctggcctccca

SEQ ID NO: 65647 - DNA, 36 bp, Artificial Sequence
  Synthetic oligonucleotide
ggaccacgcaccaggaggtctctaggtgtcttccca

SEQ ID NO: 65648 - DNA, 36 bp, Artificial Sequence
  Synthetic oligonucleotide
tgagcgctttaccggtgtgccgcccacgtttgtcca

SEQ ID NO: 65649 - DNA, 35 bp, Artificial Sequence
  Synthetic oligonucleotide
gccgcctttaaacgtttcaaccagtcccgccctca

SEQ ID NO: 65650 - DNA, 36 bp, Artificial Sequence
  Synthetic oligonucleotide
tgtccaagcgcaattgcatcatctcaacccaattca

SEQ ID NO: 65651 - DNA, 37 bp, Artificial Sequence
  Synthetic oligonucleotide
tacaaatcgacgacggcagagaaaggaggagcagaga

SEQ ID NO: 65652 - DNA, 36 bp, Artificial Sequence
  Synthetic oligonucleotide
gacatgagttcgggggggagccgggtaggagagaga

SEQ ID NO: 65653 - DNA, 37 bp, Artificial Sequence
  Synthetic oligonucleotide
ttggagccactgttcctccgtcactaacggaccccga

SEQ ID NO: 65654 - DNA, 37 bp, Artificial Sequence
  Synthetic oligonucleotide
tgtatgccccgacctctatcaccttggcctgtcccga

SEQ ID NO: 65655 - DNA, 37 bp, Artificial Sequence
  Synthetic oligonucleotide
tcccacgtagtgcgttttcccgggtggttcttcccga

SEQ ID NO: 65656 - DNA, 37 bp, Artificial Sequence
  Synthetic oligonucleotide
tagcaccggagagggcagtagggtgctgtgaagccga

SEQ ID NO: 65657 - DNA, 37 bp, Artificial Sequence
  Synthetic oligonucleotide
actcgaactcttacgtgcatcatgtttctgtttccga

SEQ ID NO: 65658 - DNA, 36 bp, Artificial Sequence
  Synthetic oligonucleotide
acaccgccatatactcgttgtcatgatcatctgcga

SEQ ID NO: 65659 - DNA, 37 bp, Artificial Sequence
  Synthetic oligonucleotide
ttgctacccctctgtgcgcatcgttaccttacgagga

SEQ ID NO: 65660 - DNA, 37 bp, Artificial Sequence
  Synthetic oligonucleotide
gatcgcgttgaggggggaaatgaggaacacgatagga

SEQ ID NO: 65661 - DNA, 37 bp, Artificial Sequence
  Synthetic oligonucleotide
ttgcgccttcccgctggagccgtatctttctctcgga

SEQ ID NO: 65662 - DNA, 37 bp, Artificial Sequence
  Synthetic oligonucleotide
gaagggggtggaaggcaagaggtgtgcttctggggga

SEQ ID NO: 65663 - DNA, 35 bp, Artificial Sequence
  Synthetic oligonucleotide
gagagcctcgcacttaacctgtactttattcatga

SEQ ID NO: 65664 - DNA, 38 bp, Artificial Sequence
  Synthetic oligonucleotide
tgatccacgccccacgcttctcatgaacgaccatatga

SEQ ID NO: 65665 - DNA, 36 bp, Artificial Sequence
  Synthetic oligonucleotide
ttcacagcacaaatagagtggatgggtgggcactga

SEQ ID NO: 65666 - DNA, 38 bp, Artificial Sequence
  Synthetic oligonucleotide
tcattcactcccgaactcagaacagtctacgcctctga

SEQ ID NO: 65667 - DNA, 38 bp, Artificial Sequence
  Synthetic oligonucleotide
gtccaggtcagcaaactttcaccgtatgtccaaagtga

SEQ ID NO: 65668 - DNA, 38 bp, Artificial Sequence
  Synthetic oligonucleotide
aatagagggtgatgacgttaggaaggattgggtagtga

SEQ ID NO: 65669 - DNA, 37 bp, Artificial Sequence
  Synthetic oligonucleotide
aacccgcactcaatagtcttggtccgctcctttgtga

SEQ ID NO: 65670 - DNA, 38 bp, Artificial Sequence
  Synthetic oligonucleotide
tgatgcgaagcgtggattcggatgggcgggtgggttga

SEQ ID NO: 65671 - DNA, 38 bp, Artificial Sequence
  Synthetic oligonucleotide
gttggagccctgcttttaaatccttccactttggttga

SEQ ID NO: 65672 - DNA, 36 bp, Artificial Sequence
  Synthetic oligonucleotide
ttcgccttccaccgcacccccgtctacagagtttga

SEQ ID NO: 65673 - DNA, 38 bp, Artificial Sequence
  Synthetic oligonucleotide
tcccagtccaccgcttggtcatcttgaacgggttttga

SEQ ID NO: 65674 - DNA, 35 bp, Artificial Sequence
  Synthetic oligonucleotide
tcgtgcccgtccccatcatattatccctccgcata

SEQ ID NO: 65675 - DNA, 36 bp, Artificial Sequence
  Synthetic oligonucleotide
actcattctgcaagattgcttatgccctgaccacta

SEQ ID NO: 65676 - DNA, 36 bp, Artificial Sequence
  Synthetic oligonucleotide
agtacaacccatgccacttcgatattagtcgcgcta

SEQ ID NO: 65677 - DNA, 36 bp, Artificial Sequence
  Synthetic oligonucleotide
acgaatgacccccccacgcgctactatgaactcgta

SEQ ID NO: 65678 - DNA, 36 bp, Artificial Sequence
  Synthetic oligonucleotide
aatagagccgggctgatggagttgggatgaacggta

SEQ ID NO: 65679 - DNA, 36 bp, Artificial Sequence
  Synthetic oligonucleotide
tattcctcacagtggacactacccctggcattggta

SEQ ID NO: 65680 - DNA, 35 bp, Artificial Sequence
  Synthetic oligonucleotide
ggaccccgcccagtaagcctcgccgaaatccctta

SEQ ID NO: 65681 - DNA, 35 bp, Artificial Sequence
  Synthetic oligonucleotide
agcgcatttcacacgtgcccacatatattttcaac

SEQ ID NO: 65682 - DNA, 35 bp, Artificial Sequence
  Synthetic oligonucleotide
tccgcaaagatgagggggtcgtggggttgcggaac

SEQ ID NO: 65683 - DNA, 35 bp, Artificial Sequence
  Synthetic oligonucleotide
actcacgtcgatccactccgcccataggcaaacac

SEQ ID NO: 65684 - DNA, 35 bp, Artificial Sequence
  Synthetic oligonucleotide
tgcgattcccccctgctccctctatcgagcaagac

SEQ ID NO: 65685 - DNA, 35 bp, Artificial Sequence
  Synthetic oligonucleotide
tgacactgttcctatgacgcgacctgcctcgatac

SEQ ID NO: 65686 - DNA, 35 bp, Artificial Sequence
  Synthetic oligonucleotide
tcacgactcactcttgcctatgggcacccgtatac

SEQ ID NO: 65687 - DNA, 35 bp, Artificial Sequence
  Synthetic oligonucleotide
gcccatgacggtccttgctttaatacactccgccc

SEQ ID NO: 65688 - DNA, 35 bp, Artificial Sequence
  Synthetic oligonucleotide
gttagcctcaagttcccgggaaccctacccgctcc

SEQ ID NO: 65689 - DNA, 35 bp, Artificial Sequence
  Synthetic oligonucleotide
ttacacaactaaaacgctgtatcgcagataagtcc

SEQ ID NO: 65690 - DNA, 35 bp, Artificial Sequence
  Synthetic oligonucleotide
tcagcacatgacccctattattgttccaggattcc

SEQ ID NO: 65691 - DNA, 35 bp, Artificial Sequence
  Synthetic oligonucleotide
agcactgactagtgcttggatcagtttcctcccgc

SEQ ID NO: 65692 - DNA, 35 bp, Artificial Sequence
  Synthetic oligonucleotide
gacacgtcatcacacggtcccagtccaaagtatgc

SEQ ID NO: 65693 - DNA, 35 bp, Artificial Sequence
  Synthetic oligonucleotide
atccgttgggtcggttcagtccttccttcacttgc

SEQ ID NO: 65694 - DNA, 34 bp, Artificial Sequence
  Synthetic oligonucleotide
gcatgagtcccaacatgtgggatgctccactctc

SEQ ID NO: 65695 - DNA, 35 bp, Artificial Sequence
  Synthetic oligonucleotide
tgtgccattcacggctaacatccccggtatccttc

SEQ ID NO: 65696 - DNA, 35 bp, Artificial Sequence
  Synthetic oligonucleotide
tatgtccttccccttccccattgggcggttcgttc

SEQ ID NO: 65697 - DNA, 35 bp, Artificial Sequence
  Synthetic oligonucleotide
tctggtgggacaattgggttggtctcgttttgttc

SEQ ID NO: 65698 - DNA, 35 bp, Artificial Sequence
  Synthetic oligonucleotide
tcaacgtaacgccctgtcccaatctccgaaattag

SEQ ID NO: 65699 - DNA, 35 bp, Artificial Sequence
  Synthetic oligonucleotide
ggccaactcaacctcgccggccctactgaatctcg

SEQ ID NO: 65700 - DNA, 35 bp, Artificial Sequence
  Synthetic oligonucleotide
tagctaatccagctgtccatctattgtcctgccgg

SEQ ID NO: 65701 - DNA, 35 bp, Artificial Sequence
  Synthetic oligonucleotide
gagtgaggagccacgagggcggtgaatagttaggg

SEQ ID NO: 65702 - DNA, 35 bp, Artificial Sequence
  Synthetic oligonucleotide
taccaaccgacggactcagatggcacgtggggtgg

SEQ ID NO: 65703 - DNA, 35 bp, Artificial Sequence
  Synthetic oligonucleotide
gtcacacgcgcaccgcttatcaccaccctcccctg

SEQ ID NO: 65704 - DNA, 35 bp, Artificial Sequence
  Synthetic oligonucleotide
ttggcggaaggtatggtggtgggaggtcggaagtg

SEQ ID NO: 65705 - DNA, 35 bp, Artificial Sequence
  Synthetic oligonucleotide
gtacgtcggagaggtctgattctccttccttcttg

SEQ ID NO: 65706 - DNA, 35 bp, Artificial Sequence
  Synthetic oligonucleotide
gtactggcccggtatctctttgttaggccctcaat

SEQ ID NO: 65707 - DNA, 35 bp, Artificial Sequence
  Synthetic oligonucleotide
tctacacccgtacgattcttgcattgaagttcgat

SEQ ID NO: 65708 - DNA, 35 bp, Artificial Sequence
  Synthetic oligonucleotide
acccagctctgtaacctcagtggcatcaaccccct

SEQ ID NO: 65709 - DNA, 35 bp, Artificial Sequence
  Synthetic oligonucleotide
agtatgcgaacgaagtcccttgtagcacctgccct

SEQ ID NO: 65710 - DNA, 35 bp, Artificial Sequence
  Synthetic oligonucleotide
acagtcactgccttcagactccggcctgactccct

SEQ ID NO: 65711 - DNA, 35 bp, Artificial Sequence
  Synthetic oligonucleotide
tcgcactcagcagtttgcccgaacccaaatccgct

SEQ ID NO: 65712 - DNA, 35 bp, Artificial Sequence
  Synthetic oligonucleotide
tattacccctgctccgcacaggttttaaaaactct

SEQ ID NO: 65713 - DNA, 35 bp, Artificial Sequence
  Synthetic oligonucleotide
gtacaccacgccaatgtccctcgtagggcccgagt

SEQ ID NO: 65714 - DNA, 35 bp, Artificial Sequence
  Synthetic oligonucleotide
acagtaggcaccacttttacacgctcttctattgt

SEQ ID NO: 65715 - DNA, 35 bp, Artificial Sequence
  Synthetic oligonucleotide
tagtgcgcgctgtttttaatgcgctttcctccatt

SEQ ID NO: 65716 - DNA, 35 bp, Artificial Sequence
  Synthetic oligonucleotide
acgtgaagcttagccccgtgcctcctgcggtcctt

SEQ ID NO: 65717 - DNA, 35 bp, Artificial Sequence
  Synthetic oligonucleotide
gtatccgccccagataaactcatgctgtggtcctt

SEQ ID NO: 65718 - DNA, 35 bp, Artificial Sequence
  Synthetic oligonucleotide
tacccctcacgccaggagtcgtcttaatattgctt

SEQ ID NO: 65719 - DNA, 35 bp, Artificial Sequence
  Synthetic oligonucleotide
ctaaatcctgtcagcggtttcctcgtttcctggtt

SEQ ID NO: 65720 - DNA, 35 bp, Artificial Sequence
  Synthetic oligonucleotide
acccgttggtacctgatgcctctgctaaaacattt

SEQ ID NO: 65721 - DNA, 36 bp, Artificial Sequence
  Synthetic oligonucleotide
gaaagaaaggtggtggtaagaagtaggaaaacgaaa

SEQ ID NO: 65722 - DNA, 35 bp, Artificial Sequence
  Synthetic oligonucleotide
atgaccgctaatgtcatcaccttcctgtgccataa

SEQ ID NO: 65723 - DNA, 36 bp, Artificial Sequence
  Synthetic oligonucleotide
gacacgacggcgggggggattcagctggggctataa

SEQ ID NO: 65724 - DNA, 35 bp, Artificial Sequence
  Synthetic oligonucleotide
accctttcaccgtgcacccatgaatactgaagtaa

SEQ ID NO: 65725 - DNA, 36 bp, Artificial Sequence
  Synthetic oligonucleotide
ttgcctccacccggaccctaaagagggacatcttaa

SEQ ID NO: 65726 - DNA, 36 bp, Artificial Sequence
  Synthetic oligonucleotide
gcaaacccggccccatcagtctgggaccatcacaca

SEQ ID NO: 65727 - DNA, 35 bp, Artificial Sequence
  Synthetic oligonucleotide
tctctcccctatgcattgtacaattcccctggaca

SEQ ID NO: 65728 - DNA, 36 bp, Artificial Sequence
  Synthetic oligonucleotide
ctcgggctggagcctcgagcctaacgattataccca

SEQ ID NO: 65729 - DNA, 37 bp, Artificial Sequence
  Synthetic oligonucleotide
gaccaccgatccgcactgttgcactttcttgacccca

SEQ ID NO: 65730 - DNA, 36 bp, Artificial Sequence
  Synthetic oligonucleotide
tagtacgcccgttcggtctcctcgaataatgtgcca

SEQ ID NO: 65731 - DNA, 36 bp, Artificial Sequence
  Synthetic oligonucleotide
gtgccgacatacatgaaagcatccgaaaacatcgca

SEQ ID NO: 65732 - DNA, 36 bp, Artificial Sequence
  Synthetic oligonucleotide
tccgaactacggtgagtactccccgcccacggttca

SEQ ID NO: 65733 - DNA, 36 bp, Artificial Sequence
  Synthetic oligonucleotide
gacgccatcttgcgacctgaacccgtcaccggttca

SEQ ID NO: 65734 - DNA, 36 bp, Artificial Sequence
  Synthetic oligonucleotide
gccaccggcccacgaacgtatcccaaacttcaaaga

SEQ ID NO: 65735 - DNA, 36 bp, Artificial Sequence
  Synthetic oligonucleotide
acactccgcactttccagagaaagctttctccacga

SEQ ID NO: 65736 - DNA, 37 bp, Artificial Sequence
  Synthetic oligonucleotide
tacacggtgcctgaactgtctaactacccttttccga

SEQ ID NO: 65737 - DNA, 35 bp, Artificial Sequence
  Synthetic oligonucleotide
gtggggctgggggggttgtcatgagtggagcgcga

SEQ ID NO: 65738 - DNA, 35 bp, Artificial Sequence
  Synthetic oligonucleotide
gccccgcccagcgactattcaccctgatgtcgcga

SEQ ID NO: 65739 - DNA, 37 bp, Artificial Sequence
  Synthetic oligonucleotide
gaccagtaagggagtggtggggtaataaaagagtcga

SEQ ID NO: 65740 - DNA, 37 bp, Artificial Sequence
  Synthetic oligonucleotide
aacccctgcgtgccccaacctgtcgcccgagtgagga

SEQ ID NO: 65741 - DNA, 37 bp, Artificial Sequence
  Synthetic oligonucleotide
accacaggtcagggaaacataccagagaaggctagga

SEQ ID NO: 65742 - DNA, 37 bp, Artificial Sequence
  Synthetic oligonucleotide
gaactcacccccccccgcttcgtgcacttacgtagga

SEQ ID NO: 65743 - DNA, 35 bp, Artificial Sequence
  Synthetic oligonucleotide
gccagtgaagaataaagcgggtggaagaagaggga

SEQ ID NO: 65744 - DNA, 37 bp, Artificial Sequence
  Synthetic oligonucleotide
aaccagccgggcgcaataggaaagggagagcagggga

SEQ ID NO: 65745 - DNA, 36 bp, Artificial Sequence
  Synthetic oligonucleotide
tctacggagggggcgggaatatggggggaaggggga

SEQ ID NO: 65746 - DNA, 36 bp, Artificial Sequence
  Synthetic oligonucleotide
gccgggcacgtagttggggggggaggaccaatggga

SEQ ID NO: 65747 - DNA, 37 bp, Artificial Sequence
  Synthetic oligonucleotide
ggggagtggggagtgagggttgcgcagtggctgtgga

SEQ ID NO: 65748 - DNA, 38 bp, Artificial Sequence
  Synthetic oligonucleotide
gaggacaggtgaggtggcgcggagttaataggtaatga

SEQ ID NO: 65749 - DNA, 38 bp, Artificial Sequence
  Synthetic oligonucleotide
ggatgacgggaggagcaacaaggacgggtttattatga

SEQ ID NO: 65750 - DNA, 38 bp, Artificial Sequence
  Synthetic oligonucleotide
taagaggggggtagtggaggagccggtgggtgttatga

SEQ ID NO: 65751 - DNA, 37 bp, Artificial Sequence
  Synthetic oligonucleotide
atcgccgactaccccctgttagtactggaacaactga

SEQ ID NO: 65752 - DNA, 38 bp, Artificial Sequence
  Synthetic oligonucleotide
agtaccgcagacccatcccctgtcccgagcctaactga

SEQ ID NO: 65753 - DNA, 37 bp, Artificial Sequence
  Synthetic oligonucleotide
ggacctacggacccctttatctgccataccacactga

SEQ ID NO: 65754 - DNA, 37 bp, Artificial Sequence
  Synthetic oligonucleotide
accagcccagtctcccttgccgctatttaccccctga

SEQ ID NO: 65755 - DNA, 38 bp, Artificial Sequence
  Synthetic oligonucleotide
tgccaccggcctctttcgagcatactcacaccagctga

SEQ ID NO: 65756 - DNA, 38 bp, Artificial Sequence
  Synthetic oligonucleotide
tcaggcacccgtgatcaccctacgctcatcctggctga

SEQ ID NO: 65757 - DNA, 37 bp, Artificial Sequence
  Synthetic oligonucleotide
tgggacggaaaaggaggggttgggtaggggttgctga

SEQ ID NO: 65758 - DNA, 38 bp, Artificial Sequence
  Synthetic oligonucleotide
acacactcggagtcattaatgacaccctcataccgtga

SEQ ID NO: 65759 - DNA, 38 bp, Artificial Sequence
  Synthetic oligonucleotide
gaggatgcggagggggcggggggcgctacttatcgtga

SEQ ID NO: 65760 - DNA, 38 bp, Artificial Sequence
  Synthetic oligonucleotide
atgaggcccactgtttctctcgaattgcacgttcgtga

SEQ ID NO: 65761 - DNA, 38 bp, Artificial Sequence
  Synthetic oligonucleotide
acccaccgcccatgataatgtgtgcaagctggcggtga

SEQ ID NO: 65762 - DNA, 38 bp, Artificial Sequence
  Synthetic oligonucleotide
tacagcccacctgcattaagcaattgacccttcggtga

SEQ ID NO: 65763 - DNA, 38 bp, Artificial Sequence
  Synthetic oligonucleotide
tgtaggacctggtggcgggggagaacggggatgattga

SEQ ID NO: 65764 - DNA, 38 bp, Artificial Sequence
  Synthetic oligonucleotide
tcgctgcctacaccgtctacttgcttcgtccaacttga

SEQ ID NO: 65765 - DNA, 38 bp, Artificial Sequence
  Synthetic oligonucleotide
atggtgggccgtccttctttagcatcgaatagccttga

SEQ ID NO: 65766 - DNA, 38 bp, Artificial Sequence
  Synthetic oligonucleotide
tctgccctcagcattatagcgtcaatgccctatcttga

SEQ ID NO: 65767 - DNA, 38 bp, Artificial Sequence
  Synthetic oligonucleotide
gccgaaaggcacattggtgcagaagttaggcacgttga

SEQ ID NO: 65768 - DNA, 38 bp, Artificial Sequence
  Synthetic oligonucleotide
aacacgcggtgtgattggccttatttcgttccctttga

SEQ ID NO: 65769 - DNA, 36 bp, Artificial Sequence
  Synthetic oligonucleotide
aacacacctctctctctaggggcccgtgaaactata

SEQ ID NO: 65770 - DNA, 36 bp, Artificial Sequence
  Synthetic oligonucleotide
tgccaacaccttgtcgctccatcattaatggcccta

SEQ ID NO: 65771 - DNA, 36 bp, Artificial Sequence
  Synthetic oligonucleotide
gtcacaggctcgtatctccttcgattctgttcccta

SEQ ID NO: 65772 - DNA, 36 bp, Artificial Sequence
  Synthetic oligonucleotide
ggaacctgcccacaccatatgtcttagatatgtcta

SEQ ID NO: 65773 - DNA, 36 bp, Artificial Sequence
  Synthetic oligonucleotide
ggagccgcctcacgccccctgctttctggagtagta

SEQ ID NO: 65774 - DNA, 36 bp, Artificial Sequence
  Synthetic oligonucleotide
acgacgccggctctaccctcgtaagcctgtaactac

SEQ ID NO: 65775 - DNA, 35 bp, Artificial Sequence
  Synthetic oligonucleotide
acacagaaaccccgcccatcttgcgagtgtccccc

SEQ ID NO: 65776 - DNA, 35 bp, Artificial Sequence
  Synthetic oligonucleotide
tgaccctatcctgcgatgcacgaaatcacattccc

SEQ ID NO: 65777 - DNA, 35 bp, Artificial Sequence
  Synthetic oligonucleotide
tgcagtcagttaacatactccatgccctactttcc

SEQ ID NO: 65778 - DNA, 35 bp, Artificial Sequence
  Synthetic oligonucleotide
ggaccgtgtcaccatccggtccgccactttcatgc

SEQ ID NO: 65779 - DNA, 35 bp, Artificial Sequence
  Synthetic oligonucleotide
tcccgcctccttgtttttttggtccgtcgtcactc

SEQ ID NO: 65780 - DNA, 35 bp, Artificial Sequence
  Synthetic oligonucleotide
gtgtgcccccttattagaatgcctgccctgtactc

SEQ ID NO: 65781 - DNA, 35 bp, Artificial Sequence
  Synthetic oligonucleotide
actcatgcgtgtgggggtgccttactgtctacttc

SEQ ID NO: 65782 - DNA, 35 bp, Artificial Sequence
  Synthetic oligonucleotide
tttgccttgttcggccgcccgttcccggcactttc

SEQ ID NO: 65783 - DNA, 35 bp, Artificial Sequence
  Synthetic oligonucleotide
ttggtgggaaggtagaggggggccaaagccgaacg

SEQ ID NO: 65784 - DNA, 35 bp, Artificial Sequence
  Synthetic oligonucleotide
gtgctagtcactttttggaacccgttttgtcgccg

SEQ ID NO: 65785 - DNA, 35 bp, Artificial Sequence
  Synthetic oligonucleotide
atttacgcaatcattgtcccccccagtcaaccggg

SEQ ID NO: 65786 - DNA, 35 bp, Artificial Sequence
  Synthetic oligonucleotide
tcccgagcatcccatctacctggtacaaccttctg

SEQ ID NO: 65787 - DNA, 35 bp, Artificial Sequence
  Synthetic oligonucleotide
atcacccttaacatcgcttcgaccgtcgccttctg

SEQ ID NO: 65788 - DNA, 35 bp, Artificial Sequence
  Synthetic oligonucleotide
gacaagggtcgggctagcgatacaatagaggagtg

SEQ ID NO: 65789 - DNA, 35 bp, Artificial Sequence
  Synthetic oligonucleotide
tgtgttggatgccgtcatctattccctcctccgtg

SEQ ID NO: 65790 - DNA, 35 bp, Artificial Sequence
  Synthetic oligonucleotide
tgacccgatcaggagttggtgggtgtaaaccggtg

SEQ ID NO: 65791 - DNA, 35 bp, Artificial Sequence
  Synthetic oligonucleotide
tccgacctgccctccgctgactaattatatgctat

SEQ ID NO: 65792 - DNA, 35 bp, Artificial Sequence
  Synthetic oligonucleotide
tgcgagcctcctcaaccgagtttctctttggcgct

SEQ ID NO: 65793 - DNA, 35 bp, Artificial Sequence
  Synthetic oligonucleotide
gtgtgtgtaaactgcttctcttctgtcgcgtatct

SEQ ID NO: 65794 - DNA, 35 bp, Artificial Sequence
  Synthetic oligonucleotide
accataggaccaggtttcacgggtttgatccttct

SEQ ID NO: 65795 - DNA, 35 bp, Artificial Sequence
  Synthetic oligonucleotide
tgcccctggcctccctcgctcgtacacacgaacgt

SEQ ID NO: 65796 - DNA, 35 bp, Artificial Sequence
  Synthetic oligonucleotide
tacgtagacatccacatctgcacaaattacgcatt

SEQ ID NO: 65797 - DNA, 35 bp, Artificial Sequence
  Synthetic oligonucleotide
tgagtacatcgatggccgcccaaaaagcgctcctt

SEQ ID NO: 65798 - DNA, 35 bp, Artificial Sequence
  Synthetic oligonucleotide
acatcgcgggatcccttgctgagatctggtttctt

SEQ ID NO: 65799 - DNA, 35 bp, Artificial Sequence
  Synthetic oligonucleotide
gtcccaatgccagtgcgcccaccgaagtatcattt

SEQ ID NO: 65800 - DNA, 35 bp, Artificial Sequence
  Synthetic oligonucleotide
gagctccctagtcggcatccttccctgttgccttt

SEQ ID NO: 65801 - DNA, 35 bp, Artificial Sequence
  Synthetic oligonucleotide
gtcctatgcgcccatccgcgatcacctgaaagttt

SEQ ID NO: 65802 - DNA, 36 bp, Artificial Sequence
  Synthetic oligonucleotide
atcactcggtgtcgttcgctctaccccagattacaa

SEQ ID NO: 65803 - DNA, 35 bp, Artificial Sequence
  Synthetic oligonucleotide
gtagccaccacctggcctcagtaaccactccccaa

SEQ ID NO: 65804 - DNA, 36 bp, Artificial Sequence
  Synthetic oligonucleotide
actgtgatgcgctccagtctaccccctactgctcaa

SEQ ID NO: 65805 - DNA, 35 bp, Artificial Sequence
  Synthetic oligonucleotide
accgcgcccacggcgtgtttccatcctggtctcaa

SEQ ID NO: 65806 - DNA, 36 bp, Artificial Sequence
  Synthetic oligonucleotide
gaaacggatggaaatggtggaggatgtagatgggaa

SEQ ID NO: 65807 - DNA, 35 bp, Artificial Sequence
  Synthetic oligonucleotide
tacaataacgcccgccgtacaatccccacactgaa

SEQ ID NO: 65808 - DNA, 36 bp, Artificial Sequence
  Synthetic oligonucleotide
acccgccgtcactgtctactccgttcggtaccataa

SEQ ID NO: 65809 - DNA, 35 bp, Artificial Sequence
  Synthetic oligonucleotide
gacgcccttcccagatcctcgcgactccaaactaa

SEQ ID NO: 65810 - DNA, 36 bp, Artificial Sequence
  Synthetic oligonucleotide
tgaaatctgcacactgcctgagaatggcccccttaa

SEQ ID NO: 65811 - DNA, 36 bp, Artificial Sequence
  Synthetic oligonucleotide
gggagggcatggtggagtagggagggagggggtaca

SEQ ID NO: 65812 - DNA, 36 bp, Artificial Sequence
  Synthetic oligonucleotide
gacccgtgctcgtgcactcccaggggattaccacca

SEQ ID NO: 65813 - DNA, 36 bp, Artificial Sequence
  Synthetic oligonucleotide
agccccgggctcgtaccggccttccgacccctacca

SEQ ID NO: 65814 - DNA, 36 bp, Artificial Sequence
  Synthetic oligonucleotide
gtctgcgctctatagggctgcccaaattacctccca

SEQ ID NO: 65815 - DNA, 36 bp, Artificial Sequence
  Synthetic oligonucleotide
gtccctcgcgtgcctcacatatctgccttttcgcca

SEQ ID NO: 65816 - DNA, 36 bp, Artificial Sequence
  Synthetic oligonucleotide
ttccagcacgcctacactctatttcgcacacctcca

SEQ ID NO: 65817 - DNA, 35 bp, Artificial Sequence
  Synthetic oligonucleotide
gaacatggtggacgagggcaaagcgtggcaaagca

SEQ ID NO: 65818 - DNA, 36 bp, Artificial Sequence
  Synthetic oligonucleotide
gaatgtcgcactctgcctctagtccagagaacctca

SEQ ID NO: 65819 - DNA, 36 bp, Artificial Sequence
  Synthetic oligonucleotide
gtcagtgccgccttaagtcacccacgcatactctca

SEQ ID NO: 65820 - DNA, 36 bp, Artificial Sequence
  Synthetic oligonucleotide
tgtcgtacccgctcaaccgtcgttttccttttctca

SEQ ID NO: 65821 - DNA, 36 bp, Artificial Sequence
  Synthetic oligonucleotide
gccggtcgtcgtacggtttttttcgtctagtcttca

SEQ ID NO: 65822 - DNA, 35 bp, Artificial Sequence
  Synthetic oligonucleotide
atgactggggctggcggagaattggcggagtaaga

SEQ ID NO: 65823 - DNA, 37 bp, Artificial Sequence
  Synthetic oligonucleotide
gatgggacaatgtgggaagatggatggcaacgccaga

SEQ ID NO: 65824 - DNA, 36 bp, Artificial Sequence
  Synthetic oligonucleotide
ggagagttgtagggcaagttacgaaggacgggcaga

SEQ ID NO: 65825 - DNA, 36 bp, Artificial Sequence
  Synthetic oligonucleotide
gagccacatctgaacacccgccattaaggtctgaga

SEQ ID NO: 65826 - DNA, 37 bp, Artificial Sequence
  Synthetic oligonucleotide
gcatgtccagacctgcaaaattagcctgaccacacga

SEQ ID NO: 65827 - DNA, 37 bp, Artificial Sequence
  Synthetic oligonucleotide
tcgagaccagctgaacacgcactatgaccccatccga

SEQ ID NO: 65828 - DNA, 37 bp, Artificial Sequence
  Synthetic oligonucleotide
ttgcgggagggaatggggttgggcctcaacaaatcga

SEQ ID NO: 65829 - DNA, 36 bp, Artificial Sequence
  Synthetic oligonucleotide
tggggaggtgggaggggatgcacgggtgttcaggga

SEQ ID NO: 65830 - DNA, 37 bp, Artificial Sequence
  Synthetic oligonucleotide
tgagcgggaggctcgagggcgcaaaacggtggaggga

SEQ ID NO: 65831 - DNA, 38 bp, Artificial Sequence
  Synthetic oligonucleotide
aacggagggagggagggttgggtggggaacttacatga

SEQ ID NO: 65832 - DNA, 38 bp, Artificial Sequence
  Synthetic oligonucleotide
ttgcatgcgactcgccgcctgttctagccaattcatga

SEQ ID NO: 65833 - DNA, 37 bp, Artificial Sequence
  Synthetic oligonucleotide
gtcccgctccacccgccccagtctagtactgagatga

SEQ ID NO: 65834 - DNA, 38 bp, Artificial Sequence
  Synthetic oligonucleotide
ggtgcccctcacgccccccatatccagcagttgtatga

SEQ ID NO: 65835 - DNA, 36 bp, Artificial Sequence
  Synthetic oligonucleotide
acagtcctcacactgatctggacactacttttatga

SEQ ID NO: 65836 - DNA, 38 bp, Artificial Sequence
  Synthetic oligonucleotide
acaaagccaccccctgccttgaagtgccggccacctga

SEQ ID NO: 65837 - DNA, 38 bp, Artificial Sequence
  Synthetic oligonucleotide
ggttcagcccctgagcctctttttcgcctctcatctga

SEQ ID NO: 65838 - DNA, 37 bp, Artificial Sequence
  Synthetic oligonucleotide
acagcctagggccgtgcacaacccatgtttactctga

SEQ ID NO: 65839 - DNA, 37 bp, Artificial Sequence
  Synthetic oligonucleotide
acaccgcaaattagactgaaggtcccgctttttctga

SEQ ID NO: 65840 - DNA, 37 bp, Artificial Sequence
  Synthetic oligonucleotide
tttcgatcgaaccacctccgccccagtccaccagtga

SEQ ID NO: 65841 - DNA, 38 bp, Artificial Sequence
  Synthetic oligonucleotide
gtccacgctagttggatcgcgccccacatctccagtga

SEQ ID NO: 65842 - DNA, 38 bp, Artificial Sequence
  Synthetic oligonucleotide
aacaagggggtgagggtagtgaaggttgagcgtagtga

SEQ ID NO: 65843 - DNA, 38 bp, Artificial Sequence
  Synthetic oligonucleotide
tcgccgccctgctacgggctgcccttccttaaacgtga

SEQ ID NO: 65844 - DNA, 37 bp, Artificial Sequence
  Synthetic oligonucleotide
tcacagccgttgcccgtaggatagcctattcccgtga

SEQ ID NO: 65845 - DNA, 38 bp, Artificial Sequence
  Synthetic oligonucleotide
atagctcccatcttgtgcgcaaaatccttccttcgtga

SEQ ID NO: 65846 - DNA, 38 bp, Artificial Sequence
  Synthetic oligonucleotide
ttgggacgattgatacggggaggacgaaagcagggtga

SEQ ID NO: 65847 - DNA, 38 bp, Artificial Sequence
  Synthetic oligonucleotide
acaagtgggatggagctagaggccgcgggggggggtga

SEQ ID NO: 65848 - DNA, 37 bp, Artificial Sequence
  Synthetic oligonucleotide
tacggaggtggagctgaatggatgggtgatgatgtga

SEQ ID NO: 65849 - DNA, 38 bp, Artificial Sequence
  Synthetic oligonucleotide
taggaaccgtatcattaattgttgccctcaccgtgtga

SEQ ID NO: 65850 - DNA, 38 bp, Artificial Sequence
  Synthetic oligonucleotide
tcacgagcctcgaattccatcgccgcactcttgtttga

SEQ ID NO: 65851 - DNA, 38 bp, Artificial Sequence
  Synthetic oligonucleotide
agacaaagcgtggtagaaaggcggtgggggaattttga

SEQ ID NO: 65852 - DNA, 36 bp, Artificial Sequence
  Synthetic oligonucleotide
atcccgtacgccggagctaccttcaatttacgcata

SEQ ID NO: 65853 - DNA, 36 bp, Artificial Sequence
  Synthetic oligonucleotide
tagcttgcccaaccgtgtctttctggcactacacta

SEQ ID NO: 65854 - DNA, 36 bp, Artificial Sequence
  Synthetic oligonucleotide
gaagggcgcctcctgagttttcttcgttatctccta

SEQ ID NO: 65855 - DNA, 36 bp, Artificial Sequence
  Synthetic oligonucleotide
gaatgggtgggtttagggtggaggtatggattagta

SEQ ID NO: 65856 - DNA, 36 bp, Artificial Sequence
  Synthetic oligonucleotide
tgacatacccccctggactgtttcttcccgaacgta

SEQ ID NO: 65857 - DNA, 36 bp, Artificial Sequence
  Synthetic oligonucleotide
tgacccccatgcacctccgctttactattgctggta

SEQ ID NO: 65858 - DNA, 36 bp, Artificial Sequence
  Synthetic oligonucleotide
gctagggaaggatggagggctatggttgggtaatta

SEQ ID NO: 65859 - DNA, 36 bp, Artificial Sequence
  Synthetic oligonucleotide
ataccacgtcacaggcttcctccttcattggactta

SEQ ID NO: 65860 - DNA, 35 bp, Artificial Sequence
  Synthetic oligonucleotide
actgacgcagtggaggagtcaaactatggggtaac

SEQ ID NO: 65861 - DNA, 35 bp, Artificial Sequence
  Synthetic oligonucleotide
gtccatccccaaagctctaagcttagttcttccac

SEQ ID NO: 65862 - DNA, 35 bp, Artificial Sequence
  Synthetic oligonucleotide
tttggccctgcaagttaacctctctagtttttgac

SEQ ID NO: 65863 - DNA, 35 bp, Artificial Sequence
  Synthetic oligonucleotide
tgtggtcgcctaatttttttgccgtgtcccttgcc

SEQ ID NO: 65864 - DNA, 35 bp, Artificial Sequence
  Synthetic oligonucleotide
gtgtacgccaatacccgtcgtattagctttcttcc

SEQ ID NO: 65865 - DNA, 35 bp, Artificial Sequence
  Synthetic oligonucleotide
taacccatcctaccaagggccaccataacggacgc

SEQ ID NO: 65866 - DNA, 35 bp, Artificial Sequence
  Synthetic oligonucleotide
gccgccgtttctcctgaactacaatcagacctcgc

SEQ ID NO: 65867 - DNA, 35 bp, Artificial Sequence
  Synthetic oligonucleotide
ttccgggctcaccggtgctgaccgctacttactgc

SEQ ID NO: 65868 - DNA, 35 bp, Artificial Sequence
  Synthetic oligonucleotide
gaccacacaaggctcggactccttcggtcccttgc

SEQ ID NO: 65869 - DNA, 35 bp, Artificial Sequence
  Synthetic oligonucleotide
taccaccttcagcctctgtgttgaaaacccccatc

SEQ ID NO: 65870 - DNA, 35 bp, Artificial Sequence
  Synthetic oligonucleotide
tgagcccagcttttccggtctcctggtaccacctc

SEQ ID NO: 65871 - DNA, 35 bp, Artificial Sequence
  Synthetic oligonucleotide
gcatgccatctgcccgttcacgactcattcacctc

SEQ ID NO: 65872 - DNA, 35 bp, Artificial Sequence
  Synthetic oligonucleotide
gctgtcctacacacacattacgtattgtactcctc

SEQ ID NO: 65873 - DNA, 35 bp, Artificial Sequence
  Synthetic oligonucleotide
atgttcctcctacaggtcgcggtttgtagctcctc

SEQ ID NO: 65874 - DNA, 35 bp, Artificial Sequence
  Synthetic oligonucleotide
gggttcaccgctgtaatgctaacggtcgtttcctc

SEQ ID NO: 65875 - DNA, 35 bp, Artificial Sequence
  Synthetic oligonucleotide
ggagtgagctgggagacggaacgtaggctgtagag

SEQ ID NO: 65876 - DNA, 35 bp, Artificial Sequence
  Synthetic oligonucleotide
gatgcgaacgtgcgggacggtgggaaaggtgctag

SEQ ID NO: 65877 - DNA, 35 bp, Artificial Sequence
  Synthetic oligonucleotide
ttgatgaagaagtggaacgaccgcaggctaagtag

SEQ ID NO: 65878 - DNA, 35 bp, Artificial Sequence
  Synthetic oligonucleotide
ttctgaccctcaatccgtgaactgttgtgtgaacg

SEQ ID NO: 65879 - DNA, 35 bp, Artificial Sequence
  Synthetic oligonucleotide
aaacgtggaatgagaatagtggggttgggaatacg

SEQ ID NO: 65880 - DNA, 35 bp, Artificial Sequence
  Synthetic oligonucleotide
tcatcctgggcattatccgtgacgtaattccaccg

SEQ ID NO: 65881 - DNA, 35 bp, Artificial Sequence
  Synthetic oligonucleotide
tatgcaacatcactcctcacgtgcattacgtcccg

SEQ ID NO: 65882 - DNA, 35 bp, Artificial Sequence
  Synthetic oligonucleotide
gtgcactgtgctccgtatgacccttaattgcttcg

SEQ ID NO: 65883 - DNA, 36 bp, Artificial Sequence
  Synthetic oligonucleotide
tgatagggtagaagagcctggaaagttgcagggggg

SEQ ID NO: 65884 - DNA, 35 bp, Artificial Sequence
  Synthetic oligonucleotide
tccctctctccaattaaccgacgctctcccgttgg

SEQ ID NO: 65885 - DNA, 35 bp, Artificial Sequence
  Synthetic oligonucleotide
ttgagacgtgcctacctaacctttgcatactgctg

SEQ ID NO: 65886 - DNA, 35 bp, Artificial Sequence
  Synthetic oligonucleotide
ccgtagcggacggcataaggataaatgtgactctg

SEQ ID NO: 65887 - DNA, 35 bp, Artificial Sequence
  Synthetic oligonucleotide
gcccggacatggttgtgcgctccatcctctgcaat

SEQ ID NO: 65888 - DNA, 35 bp, Artificial Sequence
  Synthetic oligonucleotide
gagctcgccggtgtcccgatcccaggttgctacat

SEQ ID NO: 65889 - DNA, 35 bp, Artificial Sequence
  Synthetic oligonucleotide
tcgaagcgtggctatcagtctagctgccatcccct

SEQ ID NO: 65890 - DNA, 35 bp, Artificial Sequence
  Synthetic oligonucleotide
agtgtcccagcgctatcgacgctctaacactgtct

SEQ ID NO: 65891 - DNA, 35 bp, Artificial Sequence
  Synthetic oligonucleotide
gtatgtctgggggcgagggtcgagggagggttagt

SEQ ID NO: 65892 - DNA, 35 bp, Artificial Sequence
  Synthetic oligonucleotide
gcacagcacgcggatccgctccctcacccctacgt

SEQ ID NO: 65893 - DNA, 36 bp, Artificial Sequence
  Synthetic oligonucleotide
tcgcgaacttcccccctgccctgatatgagaccggt

SEQ ID NO: 65894 - DNA, 35 bp, Artificial Sequence
  Synthetic oligonucleotide
gatgctgttaacgctggatgtcgcccaaccctttt

SEQ ID NO: 65895 - DNA, 36 bp, Artificial Sequence
  Synthetic oligonucleotide
taactccgcccagtatgtcccatcattcacagtcaa

SEQ ID NO: 65896 - DNA, 36 bp, Artificial Sequence
  Synthetic oligonucleotide
agcgaagaggctggaatgtagggcacgggaatggaa

SEQ ID NO: 65897 - DNA, 34 bp, Artificial Sequence
  Synthetic oligonucleotide
ggatgggataaacggtatgaggggaaaacgtgaa

SEQ ID NO: 65898 - DNA, 36 bp, Artificial Sequence
  Synthetic oligonucleotide
accacatcccacaggaaggtattcaatttacgtgaa

SEQ ID NO: 65899 - DNA, 36 bp, Artificial Sequence
  Synthetic oligonucleotide
aaagaggtggaaagtaaggggtaagtaatgtgataa

SEQ ID NO: 65900 - DNA, 35 bp, Artificial Sequence
  Synthetic oligonucleotide
acaccgagtacgtatcagctaactccctaccaaca

SEQ ID NO: 65901 - DNA, 35 bp, Artificial Sequence
  Synthetic oligonucleotide
tctccgtgatccgtggtgtccctattctcgtcaca

SEQ ID NO: 65902 - DNA, 36 bp, Artificial Sequence
  Synthetic oligonucleotide
atctcccactcactgcacactgctaatggccagaca

SEQ ID NO: 65903 - DNA, 36 bp, Artificial Sequence
  Synthetic oligonucleotide
actggggaatgatccgaggggagaagggcattgaca

SEQ ID NO: 65904 - DNA, 36 bp, Artificial Sequence
  Synthetic oligonucleotide
gacaccgaggaaaaggggtagaaggttgcttttaca

SEQ ID NO: 65905 - DNA, 35 bp, Artificial Sequence
  Synthetic oligonucleotide
acagctgaggccccttttacgtcccatggcaccca

SEQ ID NO: 65906 - DNA, 36 bp, Artificial Sequence
  Synthetic oligonucleotide
gacacgaagccttaattctacagtgccgatcgccca

SEQ ID NO: 65907 - DNA, 35 bp, Artificial Sequence
  Synthetic oligonucleotide
tggtaccggcacctaatcctcatcctggctggcca

SEQ ID NO: 65908 - DNA, 36 bp, Artificial Sequence
  Synthetic oligonucleotide
ggttgctgccatccgagctttacttgcctcgctcca

SEQ ID NO: 65909 - DNA, 36 bp, Artificial Sequence
  Synthetic oligonucleotide
ggttaccgcgcaagatagcatcgtaaccctcttcca

SEQ ID NO: 65910 - DNA, 35 bp, Artificial Sequence
  Synthetic oligonucleotide
gtaaccctgagcaaacagtacagtgcgaaaaagca

SEQ ID NO: 65911 - DNA, 36 bp, Artificial Sequence
  Synthetic oligonucleotide
agatgccagaccccggttcgactccacccccccgca

SEQ ID NO: 65912 - DNA, 36 bp, Artificial Sequence
  Synthetic oligonucleotide
gatagaccacctccttgtttggaacctcgttaatca

SEQ ID NO: 65913 - DNA, 36 bp, Artificial Sequence
  Synthetic oligonucleotide
cgaccctggaccgcccacctctcgttgtgtaattca

SEQ ID NO: 65914 - DNA, 36 bp, Artificial Sequence
  Synthetic oligonucleotide
tgcaagccgatattccctcctatccgagcaccttca

SEQ ID NO: 65915 - DNA, 36 bp, Artificial Sequence
  Synthetic oligonucleotide
tccattcccgtccctagttctatcgtacgacgaaga

SEQ ID NO: 65916 - DNA, 37 bp, Artificial Sequence
  Synthetic oligonucleotide
tgaccagccttttattgaatctgtacttccacccaga

SEQ ID NO: 65917 - DNA, 37 bp, Artificial Sequence
  Synthetic oligonucleotide
tgcgcctactgccatgaagcctgtgccccctcaccga

SEQ ID NO: 65918 - DNA, 36 bp, Artificial Sequence
  Synthetic oligonucleotide
gcgtggtaccatcaggttatttgttctatccatcga

SEQ ID NO: 65919 - DNA, 37 bp, Artificial Sequence
  Synthetic oligonucleotide
gcacttcaccgacccgtctgtcgttcattcccttcga

SEQ ID NO: 65920 - DNA, 36 bp, Artificial Sequence
  Synthetic oligonucleotide
tacagcacttcctggtctttcagcctgtcctttcga

SEQ ID NO: 65921 - DNA, 37 bp, Artificial Sequence
  Synthetic oligonucleotide
gagtacacagaggagcaaagaagggcgtaagcgagga

SEQ ID NO: 65922 - DNA, 37 bp, Artificial Sequence
  Synthetic oligonucleotide
tagaggggtacacagggaaatcgatggagctggagga

SEQ ID NO: 65923 - DNA, 37 bp, Artificial Sequence
  Synthetic oligonucleotide
aagagatcgtggtgggcaaaggagtttagaacgggga

SEQ ID NO: 65924 - DNA, 36 bp, Artificial Sequence
  Synthetic oligonucleotide
ggacccacccgcctcctcatacccacaacgtgggga

SEQ ID NO: 65925 - DNA, 37 bp, Artificial Sequence
  Synthetic oligonucleotide
ttggtcgccaactgccactgtttcacatagactggga

SEQ ID NO: 65926 - DNA, 37 bp, Artificial Sequence
  Synthetic oligonucleotide
tacgtagtcctctgatatcaactctcgcgccctggga

SEQ ID NO: 65927 - DNA, 35 bp, Artificial Sequence
  Synthetic oligonucleotide
acacaccatctctcatgtgcgaatgtgtaggtgga

SEQ ID NO: 65928 - DNA, 37 bp, Artificial Sequence
  Synthetic oligonucleotide
tgagatcggatcgagcgggacaaatagggcgggtgga

SEQ ID NO: 65929 - DNA, 37 bp, Artificial Sequence
  Synthetic oligonucleotide
atgtgctctgacgtcctgccgtatccctccctttgga

SEQ ID NO: 65930 - DNA, 38 bp, Artificial Sequence
  Synthetic oligonucleotide
ttggaccaccgaattgctgctaacttaaacatacatga

SEQ ID NO: 65931 - DNA, 38 bp, Artificial Sequence
  Synthetic oligonucleotide
gacattgcattggcgcattagttagcttattttcctga

SEQ ID NO: 65932 - DNA, 38 bp, Artificial Sequence
  Synthetic oligonucleotide
agcgtatacaggacggggaggaaggacggatcaggtga

SEQ ID NO: 65933 - DNA, 38 bp, Artificial Sequence
  Synthetic oligonucleotide
ataagcaggggaggatgagactgggggaaatgaggtga

SEQ ID NO: 65934 - DNA, 38 bp, Artificial Sequence
  Synthetic oligonucleotide
atggtcagtaagaggggttcggcaagggatgatggtga

SEQ ID NO: 65935 - DNA, 38 bp, Artificial Sequence
  Synthetic oligonucleotide
gacatgggaagggtacggtttgtggtccgggtttgtga

SEQ ID NO: 65936 - DNA, 38 bp, Artificial Sequence
  Synthetic oligonucleotide
ggagactccggtgcgcttctcacacaacatctaattga

SEQ ID NO: 65937 - DNA, 38 bp, Artificial Sequence
  Synthetic oligonucleotide
gccgttcctcccgcactccaccgggctcaccccattga

SEQ ID NO: 65938 - DNA, 37 bp, Artificial Sequence
  Synthetic oligonucleotide
ggaacagccgccacgctgctcccatactacatattga

SEQ ID NO: 65939 - DNA, 38 bp, Artificial Sequence
  Synthetic oligonucleotide
gacgccgacacgagctttattgcaagtccccaccttga

SEQ ID NO: 65940 - DNA, 38 bp, Artificial Sequence
  Synthetic oligonucleotide
tcccatccgcggacggtaatcgtcgacccggcccttga

SEQ ID NO: 65941 - DNA, 38 bp, Artificial Sequence
  Synthetic oligonucleotide
ggaccctgtgcacggactgcatccgagacacggtttga

SEQ ID NO: 65942 - DNA, 36 bp, Artificial Sequence
  Synthetic oligonucleotide
tgcggactgcctgggacccttttgaatgcattttga

SEQ ID NO: 65943 - DNA, 38 bp, Artificial Sequence
  Synthetic oligonucleotide
acacccggacgttacgtacgcctcacactcccttttga

SEQ ID NO: 65944 - DNA, 36 bp, Artificial Sequence
  Synthetic oligonucleotide
cccactcccccgctgaaatggcgcaggttttgcata

SEQ ID NO: 65945 - DNA, 36 bp, Artificial Sequence
  Synthetic oligonucleotide
tttcaccgccctcctttaggggtcctttctttcata

SEQ ID NO: 65946 - DNA, 35 bp, Artificial Sequence
  Synthetic oligonucleotide
gactcccccgcgtaaaaccccgtccgtgccagcta

SEQ ID NO: 65947 - DNA, 36 bp, Artificial Sequence
  Synthetic oligonucleotide
tgagctggtcgttgtccccgtccattgccgatgcta

SEQ ID NO: 65948 - DNA, 36 bp, Artificial Sequence
  Synthetic oligonucleotide
taacagacacagtcttcgcctccgacccagttttta

SEQ ID NO: 65949 - DNA, 35 bp, Artificial Sequence
  Synthetic oligonucleotide
gagaccagcagcccgtgccgtgtaacacctttcac

SEQ ID NO: 65950 - DNA, 35 bp, Artificial Sequence
  Synthetic oligonucleotide
gacagtactgcggtaggaacggtggggctatctac

SEQ ID NO: 65951 - DNA, 35 bp, Artificial Sequence
  Synthetic oligonucleotide
gcccacactagaggacatatgcgttctgtcatacc

SEQ ID NO: 65952 - DNA, 34 bp, Artificial Sequence
  Synthetic oligonucleotide
atggtccttcctgttcactcggccctccgttacc

SEQ ID NO: 65953 - DNA, 35 bp, Artificial Sequence
  Synthetic oligonucleotide
gaccgtgctgcctaaagcacctttatgttcgcccc

SEQ ID NO: 65954 - DNA, 35 bp, Artificial Sequence
  Synthetic oligonucleotide
gcccgcactgcaaattcccatcccctgtacaatcc

SEQ ID NO: 65955 - DNA, 35 bp, Artificial Sequence
  Synthetic oligonucleotide
ttgctccccgtcaccacaaacgtcctgtcatatcc

SEQ ID NO: 65956 - DNA, 35 bp, Artificial Sequence
  Synthetic oligonucleotide
gactcacattcctggcacactcccaggtgcgctgc

SEQ ID NO: 65957 - DNA, 36 bp, Artificial Sequence
  Synthetic oligonucleotide
ttgcccacctcggctccgtagtaatgacaaacgtgc

SEQ ID NO: 65958 - DNA, 35 bp, Artificial Sequence
  Synthetic oligonucleotide
gagtacgtaacggtcgtacgtgcaattaccatctc

SEQ ID NO: 65959 - DNA, 35 bp, Artificial Sequence
  Synthetic oligonucleotide
gtcgtatcacgggcctatggacactacttactctc

SEQ ID NO: 65960 - DNA, 35 bp, Artificial Sequence
  Synthetic oligonucleotide
gaatagcaccatatcctccactgaaccacccggtc

SEQ ID NO: 65961 - DNA, 35 bp, Artificial Sequence
  Synthetic oligonucleotide
gacccgggcgtttaggcccgagcatccattacttc

SEQ ID NO: 65962 - DNA, 35 bp, Artificial Sequence
  Synthetic oligonucleotide
tgactcattggtgacgatttaactgcgcccccttc

SEQ ID NO: 65963 - DNA, 35 bp, Artificial Sequence
  Synthetic oligonucleotide
gacactttcacaacttgggcctgctcgtccgccag

SEQ ID NO: 65964 - DNA, 35 bp, Artificial Sequence
  Synthetic oligonucleotide
agacaggggggggggaggtgccaggagggggttag

SEQ ID NO: 65965 - DNA, 35 bp, Artificial Sequence
  Synthetic oligonucleotide
tagggatcgccgacgcaccttacaacaactattcg

SEQ ID NO: 65966 - DNA, 35 bp, Artificial Sequence
  Synthetic oligonucleotide
gttactgcccatatgtccatttctcccggccctgg

SEQ ID NO: 65967 - DNA, 35 bp, Artificial Sequence
  Synthetic oligonucleotide
agcataacggggggcaggcgcacaagaaggattgg

SEQ ID NO: 65968 - DNA, 35 bp, Artificial Sequence
  Synthetic oligonucleotide
gatccgcgtgctcgattcgaaccttcacatcttgg

SEQ ID NO: 65969 - DNA, 35 bp, Artificial Sequence
  Synthetic oligonucleotide
acccgccacttccgaagctacgctcaatgaccctg

SEQ ID NO: 65970 - DNA, 36 bp, Artificial Sequence
  Synthetic oligonucleotide
gtcgagtgggaaggggggatgttaggagagggcaat

SEQ ID NO: 65971 - DNA, 35 bp, Artificial Sequence
  Synthetic oligonucleotide
agccactcgcgcggacctctatgcactcccgctat

SEQ ID NO: 65972 - DNA, 35 bp, Artificial Sequence
  Synthetic oligonucleotide
gcgagcatacggccacgcgttacggcgcccccact

SEQ ID NO: 65973 - DNA, 35 bp, Artificial Sequence
  Synthetic oligonucleotide
tcactcaccctcccgtatgcacctaacttcagact

SEQ ID NO: 65974 - DNA, 35 bp, Artificial Sequence
  Synthetic oligonucleotide
atgccggttgggttagggtggaaggggttggtact

SEQ ID NO: 65975 - DNA, 35 bp, Artificial Sequence
  Synthetic oligonucleotide
tcctaaacacctggcccccaaattgtcattggcct

SEQ ID NO: 65976 - DNA, 35 bp, Artificial Sequence
  Synthetic oligonucleotide
gccgccctgcccggcccggtacttgctgagctcct

SEQ ID NO: 65977 - DNA, 35 bp, Artificial Sequence
  Synthetic oligonucleotide
ggggaaccgggctgacctgtcgcttaatctcatct

SEQ ID NO: 65978 - DNA, 35 bp, Artificial Sequence
  Synthetic oligonucleotide
gccagacggttgctgcgatccttacggccatatct

SEQ ID NO: 65979 - DNA, 35 bp, Artificial Sequence
  Synthetic oligonucleotide
tagctccacaggagcgggctgtcttctcatcctct

SEQ ID NO: 65980 - DNA, 35 bp, Artificial Sequence
  Synthetic oligonucleotide
tcctagaccttcaccatctgacttgcctgtgcatt

SEQ ID NO: 65981 - DNA, 35 bp, Artificial Sequence
  Synthetic oligonucleotide
aaccccagcccgtcgccaccggacaccaagtgatt

SEQ ID NO: 65982 - DNA, 34 bp, Artificial Sequence
  Synthetic oligonucleotide
tccgttttcacgccatcacgatcaccacaccgtt

SEQ ID NO: 65983 - DNA, 35 bp, Artificial Sequence
  Synthetic oligonucleotide
tataccacacatcggagattctatttcgaccattt

SEQ ID NO: 65984 - DNA, 35 bp, Artificial Sequence
  Synthetic oligonucleotide
tttgcccgaagctactgagtctgtccttaaccttt

SEQ ID NO: 65985 - DNA, 35 bp, Artificial Sequence
  Synthetic oligonucleotide
tccccgaacctagctatatacgcctcagcctcttt

SEQ ID NO: 65986 - DNA, 36 bp, Artificial Sequence
  Synthetic oligonucleotide
gtgcctacgcctgttctcctattgcgccccgctgaa

SEQ ID NO: 65987 - DNA, 36 bp, Artificial Sequence
  Synthetic oligonucleotide
aacgccacggagggtcactccacacgtcgtttaaca

SEQ ID NO: 65988 - DNA, 36 bp, Artificial Sequence
  Synthetic oligonucleotide
gcccagacatcacgcgacgcacttaaacattcacca

SEQ ID NO: 65989 - DNA, 36 bp, Artificial Sequence
  Synthetic oligonucleotide
acagccagggtggagggttcgggtgtctgggtacca

SEQ ID NO: 65990 - DNA, 36 bp, Artificial Sequence
  Synthetic oligonucleotide
cgcaggtatctcaccgctaccgtacttttattgcca

SEQ ID NO: 65991 - DNA, 36 bp, Artificial Sequence
  Synthetic oligonucleotide
tgctgtccttgccttggtctcgttccccttcatcca

SEQ ID NO: 65992 - DNA, 35 bp, Artificial Sequence
  Synthetic oligonucleotide
ggtcgtctcccgtgcctctgatcccaccgtatcca

SEQ ID NO: 65993 - DNA, 36 bp, Artificial Sequence
  Synthetic oligonucleotide
gcatccaccacccgttaggaactagcaccacgtcca

SEQ ID NO: 65994 - DNA, 36 bp, Artificial Sequence
  Synthetic oligonucleotide
accacaaccaccgtctgcctgtccccctgggaagca

SEQ ID NO: 65995 - DNA, 36 bp, Artificial Sequence
  Synthetic oligonucleotide
agagcctccgcaactcaatatcttgtcaacacagca

SEQ ID NO: 65996 - DNA, 36 bp, Artificial Sequence
  Synthetic oligonucleotide
atcacgtcactcatcttcatgccggcattaacctca

SEQ ID NO: 65997 - DNA, 36 bp, Artificial Sequence
  Synthetic oligonucleotide
tcatcctcgggtgtccgcccctgtgaatccgcctca

SEQ ID NO: 65998 - DNA, 36 bp, Artificial Sequence
  Synthetic oligonucleotide
gtacaacatcgggccgctcgcaatactccgtgctca

SEQ ID NO: 65999 - DNA, 35 bp, Artificial Sequence
  Synthetic oligonucleotide
ccctcacccgatgatctgcctgtctcgcagtctca

SEQ ID NO: 66000 - DNA, 36 bp, Artificial Sequence
  Synthetic oligonucleotide
ccgagttcgctgcccgttcatcccgttctgttctca

SEQ ID NO: 66001 - DNA, 35 bp, Artificial Sequence
  Synthetic oligonucleotide
gttgtaggggggagtatggggcatataacggttca

SEQ ID NO: 66002 - DNA, 35 bp, Artificial Sequence
  Synthetic oligonucleotide
tgccggttcctgactcaccacaatgacctcccaga

SEQ ID NO: 66003 - DNA, 37 bp, Artificial Sequence
  Synthetic oligonucleotide
atggaggggccaaggcaagtcgggtgcgaagtcgaga

SEQ ID NO: 66004 - DNA, 37 bp, Artificial Sequence
  Synthetic oligonucleotide
gtcgaagggcggggtgaaggctagcaaggcccgtaga

SEQ ID NO: 66005 - DNA, 37 bp, Artificial Sequence
  Synthetic oligonucleotide
tcgaccacactgggcccacttgagactaaatcttaga

SEQ ID NO: 66006 - DNA, 36 bp, Artificial Sequence
  Synthetic oligonucleotide
tgaacccctccccccaggatttgttgtggctaacga

SEQ ID NO: 66007 - DNA, 37 bp, Artificial Sequence
  Synthetic oligonucleotide
ttacggcccatcgatttcccacgcctgctaccgccga

SEQ ID NO: 66008 - DNA, 37 bp, Artificial Sequence
  Synthetic oligonucleotide
acacctgcgtcgttttctatcctggtttccttctcga

SEQ ID NO: 66009 - DNA, 37 bp, Artificial Sequence
  Synthetic oligonucleotide
gtcatccaacacgcaggtgttgccctgtctcacggga

SEQ ID NO: 66010 - DNA, 37 bp, Artificial Sequence
  Synthetic oligonucleotide
aacgcattcggtcgggatggctgcaaactggggggga

SEQ ID NO: 66011 - DNA, 37 bp, Artificial Sequence
  Synthetic oligonucleotide
atggaacatggtgaggggtggcaaaaagctcatggga

SEQ ID NO: 66012 - DNA, 37 bp, Artificial Sequence
  Synthetic oligonucleotide
agatacgggaatacatggtgaggaggggttagtggga

SEQ ID NO: 66013 - DNA, 37 bp, Artificial Sequence
  Synthetic oligonucleotide
atcaaccacatggagtgtccaccataacaaggtggga

SEQ ID NO: 66014 - DNA, 37 bp, Artificial Sequence
  Synthetic oligonucleotide
agcgggaggaagcacgggggaggttactattgtggga

SEQ ID NO: 66015 - DNA, 36 bp, Artificial Sequence
  Synthetic oligonucleotide
ggggatttgggtggtggaaatggatggaggcgtgga

SEQ ID NO: 66016 - DNA, 38 bp, Artificial Sequence
  Synthetic oligonucleotide
ggacatcccgccaccctgttctacgagtccaataatga

SEQ ID NO: 66017 - DNA, 38 bp, Artificial Sequence
  Synthetic oligonucleotide
aaactgcgaagggggggtgaggctggaatacgacatga

SEQ ID NO: 66018 - DNA, 38 bp, Artificial Sequence
  Synthetic oligonucleotide
gctatcaacccgtacgagcgcactttacacagttatga

SEQ ID NO: 66019 - DNA, 38 bp, Artificial Sequence
  Synthetic oligonucleotide
gccaccacgtgacaatctcgacttccatccccccctga

SEQ ID NO: 66020 - DNA, 38 bp, Artificial Sequence
  Synthetic oligonucleotide
gaactacgcctgaaccgtcctattatcgtagtccctga

SEQ ID NO: 66021 - DNA, 38 bp, Artificial Sequence
  Synthetic oligonucleotide
accaaacgccgatttctttcctagtccaccgagcctga

SEQ ID NO: 66022 - DNA, 38 bp, Artificial Sequence
  Synthetic oligonucleotide
gtggccggacgggaggtgggttcatgggaataggctga

SEQ ID NO: 66023 - DNA, 38 bp, Artificial Sequence
  Synthetic oligonucleotide
gacgccgttcatctgtgttaccccttgttgctttctga

SEQ ID NO: 66024 - DNA, 38 bp, Artificial Sequence
  Synthetic oligonucleotide
gttaacgagtagtatgggagaagggatggaacgagtga

SEQ ID NO: 66025 - DNA, 37 bp, Artificial Sequence
  Synthetic oligonucleotide
acccgacgcccccatcactgccctttctcgcgcgtga

SEQ ID NO: 66026 - DNA, 38 bp, Artificial Sequence
  Synthetic oligonucleotide
gaagagaggtggcgcgcaggggggtgggacgttcgtga

SEQ ID NO: 66027 - DNA, 38 bp, Artificial Sequence
  Synthetic oligonucleotide
aagtgagggacaggtgatttgccgagagagacgggtga

SEQ ID NO: 66028 - DNA, 37 bp, Artificial Sequence
  Synthetic oligonucleotide
acacaggggtggttgatcgcggagggcaggagattga

SEQ ID NO: 66029 - DNA, 38 bp, Artificial Sequence
  Synthetic oligonucleotide
gaacgcatccacgggccaaggacaccacctccacttga

SEQ ID NO: 66030 - DNA, 38 bp, Artificial Sequence
  Synthetic oligonucleotide
ttcgcggttgggggggggttcacaagggtggagcttga

SEQ ID NO: 66031 - DNA, 38 bp, Artificial Sequence
  Synthetic oligonucleotide
accacgcataggccgaccacttatttgtgccctcttga

SEQ ID NO: 66032 - DNA, 38 bp, Artificial Sequence
  Synthetic oligonucleotide
tgtgaagggtacgggtgggggcccaagatgccagttga

SEQ ID NO: 66033 - DNA, 38 bp, Artificial Sequence
  Synthetic oligonucleotide
gcaatgcggtagggttggttaggggtgctgagtgttga

SEQ ID NO: 66034 - DNA, 38 bp, Artificial Sequence
  Synthetic oligonucleotide
gtcggtcacctgtggtgcttgttttgttcttcctttga

SEQ ID NO: 66035 - DNA, 37 bp, Artificial Sequence
  Synthetic oligonucleotide
gttgcacagttctgcccctcggtctccgctcttttga

SEQ ID NO: 66036 - DNA, 35 bp, Artificial Sequence
  Synthetic oligonucleotide
atctgccatggtatccgttcctctactggcgctta

SEQ ID NO: 66037 - DNA, 35 bp, Artificial Sequence
  Synthetic oligonucleotide
tcgcgcacccctgttcgtggtcatcaaattcgtta

SEQ ID NO: 66038 - DNA, 36 bp, Artificial Sequence
  Synthetic oligonucleotide
atttgcgcaccaccgtttttccgacccgggctgtta

SEQ ID NO: 66039 - DNA, 36 bp, Artificial Sequence
  Synthetic oligonucleotide
accccaggcggtttaatcgttatgcaccgtcgttta

SEQ ID NO: 66040 - DNA, 36 bp, Artificial Sequence
  Synthetic oligonucleotide
gaccccattcgtttcattgagtcgatacctggttta

SEQ ID NO: 66041 - DNA, 35 bp, Artificial Sequence
  Synthetic oligonucleotide
tcacttccctgtctgtattgtctttctactgtaac

SEQ ID NO: 66042 - DNA, 35 bp, Artificial Sequence
  Synthetic oligonucleotide
gtgcctcggccctgcgatgccacgtcgaccatcac

SEQ ID NO: 66043 - DNA, 35 bp, Artificial Sequence
  Synthetic oligonucleotide
gggatggcgcacctttatctccgcgtgaccctgac

SEQ ID NO: 66044 - DNA, 35 bp, Artificial Sequence
  Synthetic oligonucleotide
gccagaagcgacggccgcgatttcattttagttac

SEQ ID NO: 66045 - DNA, 35 bp, Artificial Sequence
  Synthetic oligonucleotide
gacgccgggattcggtaacccaggcatagaacacc

SEQ ID NO: 66046 - DNA, 35 bp, Artificial Sequence
  Synthetic oligonucleotide
ttacgccttgtagttgggatcacggcccttccacc

SEQ ID NO: 66047 - DNA, 35 bp, Artificial Sequence
  Synthetic oligonucleotide
gcccgcaccaccacatcacctgtcgctggacaccc

SEQ ID NO: 66048 - DNA, 35 bp, Artificial Sequence
  Synthetic oligonucleotide
atggacgctgtaggcacgccgacgctatcccaccc

SEQ ID NO: 66049 - DNA, 35 bp, Artificial Sequence
  Synthetic oligonucleotide
tccggttccctcacgttctggtctacgcctgtagc

SEQ ID NO: 66050 - DNA, 35 bp, Artificial Sequence
  Synthetic oligonucleotide
tgttgctggcctgtgctcgctgttctctgttgtgc

SEQ ID NO: 66051 - DNA, 35 bp, Artificial Sequence
  Synthetic oligonucleotide
aatgggcatggtagcggtgcgggttgggtgattgc

SEQ ID NO: 66052 - DNA, 35 bp, Artificial Sequence
  Synthetic oligonucleotide
tgctcatcatcctggtgcagttggacccagctatc

SEQ ID NO: 66053 - DNA, 35 bp, Artificial Sequence
  Synthetic oligonucleotide
ggacggtgacccttgttagtactatccttcccctc

SEQ ID NO: 66054 - DNA, 35 bp, Artificial Sequence
  Synthetic oligonucleotide
aacttcactgccccgatttctcgaattgagatttc

SEQ ID NO: 66055 - DNA, 35 bp, Artificial Sequence
  Synthetic oligonucleotide
gcccttggcaatcttccagcccttccgtactccag

SEQ ID NO: 66056 - DNA, 35 bp, Artificial Sequence
  Synthetic oligonucleotide
tgtccctgtggcacgggatgctcatcttctttacg

SEQ ID NO: 66057 - DNA, 35 bp, Artificial Sequence
  Synthetic oligonucleotide
tcagtgccccgtgaacgtagtagctccctctttcg

SEQ ID NO: 66058 - DNA, 35 bp, Artificial Sequence
  Synthetic oligonucleotide
gcgtagggcaggaaagagatgggaacaggaaaagg

SEQ ID NO: 66059 - DNA, 35 bp, Artificial Sequence
  Synthetic oligonucleotide
actcaaacggtcgcacggtgggaatatggggctgg

SEQ ID NO: 66060 - DNA, 35 bp, Artificial Sequence
  Synthetic oligonucleotide
tactaacaacagcccttcactgcacctagcggtgg

SEQ ID NO: 66061 - DNA, 35 bp, Artificial Sequence
  Synthetic oligonucleotide
aacacacatggacggctctctctcgttcgctattg

SEQ ID NO: 66062 - DNA, 35 bp, Artificial Sequence
  Synthetic oligonucleotide
tcacacccatgtcaccgaaagccgcacaacggttg

SEQ ID NO: 66063 - DNA, 35 bp, Artificial Sequence
  Synthetic oligonucleotide
tccgaagcaagctgcagtcaaaaccaggtagtaat

SEQ ID NO: 66064 - DNA, 35 bp, Artificial Sequence
  Synthetic oligonucleotide
accgcgcatcactagcgtcttacatgactcactat

SEQ ID NO: 66065 - DNA, 35 bp, Artificial Sequence
  Synthetic oligonucleotide
ttcctcgggccccctaactcaatctgtacagctat

SEQ ID NO: 66066 - DNA, 35 bp, Artificial Sequence
  Synthetic oligonucleotide
actttccgcccccgccctggccgagcgttctcact

SEQ ID NO: 66067 - DNA, 35 bp, Artificial Sequence
  Synthetic oligonucleotide
ggactgttaccagaatattgctccccacacgtact

SEQ ID NO: 66068 - DNA, 35 bp, Artificial Sequence
  Synthetic oligonucleotide
atagggagaggggtagccgggggagatccagatct

SEQ ID NO: 66069 - DNA, 35 bp, Artificial Sequence
  Synthetic oligonucleotide
gtatgcccacgttgttctcttcgtttcgcgattct

SEQ ID NO: 66070 - DNA, 35 bp, Artificial Sequence
  Synthetic oligonucleotide
gtcagaaaacgcgcctgcatgccttaggtccttct

SEQ ID NO: 66071 - DNA, 35 bp, Artificial Sequence
  Synthetic oligonucleotide
ttcgccctcctttcgcccccacgtatctgcgccgt

SEQ ID NO: 66072 - DNA, 35 bp, Artificial Sequence
  Synthetic oligonucleotide
gaaaggggggctgggcacatagggtctgggagtgt

SEQ ID NO: 66073 - DNA, 35 bp, Artificial Sequence
  Synthetic oligonucleotide
tcccgagcgtcacttttttgcgtacccctccactt

SEQ ID NO: 66074 - DNA, 35 bp, Artificial Sequence
  Synthetic oligonucleotide
attgtgagaagccattgcgtaactggctctacctt

SEQ ID NO: 66075 - DNA, 35 bp, Artificial Sequence
  Synthetic oligonucleotide
gagaagcaccctgctttaccaacggttctgacgtt

SEQ ID NO: 66076 - DNA, 35 bp, Artificial Sequence
  Synthetic oligonucleotide
gtagcacaccatttcttcaggctggcactccgttt

SEQ ID NO: 66077 - DNA, 35 bp, Artificial Sequence
  Synthetic oligonucleotide
tcgttgttgcctgttccactgtaatgtctattttt

SEQ ID NO: 66078 - DNA, 35 bp, Artificial Sequence
  Synthetic oligonucleotide
acagccgcccaccgccatgactgtgaggcctacaa

SEQ ID NO: 66079 - DNA, 36 bp, Artificial Sequence
  Synthetic oligonucleotide
gccactgctcttgagggttcttcatccgcctcccaa

SEQ ID NO: 66080 - DNA, 36 bp, Artificial Sequence
  Synthetic oligonucleotide
tgtgccgtcgcccctgtagaactcattctccgtcaa

SEQ ID NO: 66081 - DNA, 36 bp, Artificial Sequence
  Synthetic oligonucleotide
gacgacatccaggaaccctgcaaatcatttcacgaa

SEQ ID NO: 66082 - DNA, 36 bp, Artificial Sequence
  Synthetic oligonucleotide
gtccaccccgcgaggcaaatgagctcgtcttgcgaa

SEQ ID NO: 66083 - DNA, 36 bp, Artificial Sequence
  Synthetic oligonucleotide
atccccgtccgtatgcttttgctattgtggtcctaa

SEQ ID NO: 66084 - DNA, 36 bp, Artificial Sequence
  Synthetic oligonucleotide
ttcacgatgagccgccagcatatagcgtctttcaca

SEQ ID NO: 66085 - DNA, 36 bp, Artificial Sequence
  Synthetic oligonucleotide
atacaaaccgtcgctcgccttgaccttcttgttaca

SEQ ID NO: 66086 - DNA, 36 bp, Artificial Sequence
  Synthetic oligonucleotide
gaacacctctaccgcatggcgaagagccttacccca

SEQ ID NO: 66087 - DNA, 35 bp, Artificial Sequence
  Synthetic oligonucleotide
aagtcacccttgcttgtgcatttcgcctgggccca

SEQ ID NO: 66088 - DNA, 35 bp, Artificial Sequence
  Synthetic oligonucleotide
gactgagcctgttgcttaggtcattcacctgccca

SEQ ID NO: 66089 - DNA, 35 bp, Artificial Sequence
  Synthetic oligonucleotide
aaccacattatccgaatgtcgctaaccgctctcca

SEQ ID NO: 66090 - DNA, 36 bp, Artificial Sequence
  Synthetic oligonucleotide
gtcaccagctccccggcaccgtttcaaatcactgca

SEQ ID NO: 66091 - DNA, 35 bp, Artificial Sequence
  Synthetic oligonucleotide
acagtaatggcccgtcgagtacacttccacctgca

SEQ ID NO: 66092 - DNA, 36 bp, Artificial Sequence
  Synthetic oligonucleotide
agtcaatggtagggggaagcagggagttaggttgca

SEQ ID NO: 66093 - DNA, 36 bp, Artificial Sequence
  Synthetic oligonucleotide
acattcaggcagtcacccggctgcatcatttactca

SEQ ID NO: 66094 - DNA, 36 bp, Artificial Sequence
  Synthetic oligonucleotide
gacgatcctctgtccttgaagctattccggttctca

SEQ ID NO: 66095 - DNA, 38 bp, Artificial Sequence
  Synthetic oligonucleotide
tgcgggggggggcgaagatgatgcaggggcgatcgtca

SEQ ID NO: 66096 - DNA, 36 bp, Artificial Sequence
  Synthetic oligonucleotide
cccaggtcgtgccacccatcccgcggtccagtttca

SEQ ID NO: 66097 - DNA, 36 bp, Artificial Sequence
  Synthetic oligonucleotide
tcatctgtctgagcatgcgttgcgctccgtttttca

SEQ ID NO: 66098 - DNA, 37 bp, Artificial Sequence
  Synthetic oligonucleotide
atcgccaatgccagactagctagcacctacccccaga

SEQ ID NO: 66099 - DNA, 37 bp, Artificial Sequence
  Synthetic oligonucleotide
acagcgcaccgcctgaggaaccgccctgctacataga

SEQ ID NO: 66100 - DNA, 37 bp, Artificial Sequence
  Synthetic oligonucleotide
acctccgcaccccgcataccgccaacgtcagtctaga

SEQ ID NO: 66101 - DNA, 37 bp, Artificial Sequence
  Synthetic oligonucleotide
gcctggcctccacatcttcgctgaccttgcgctacga

SEQ ID NO: 66102 - DNA, 37 bp, Artificial Sequence
  Synthetic oligonucleotide
ttgcgctgtaaaatcaggccagctgcatcccccccga

SEQ ID NO: 66103 - DNA, 37 bp, Artificial Sequence
  Synthetic oligonucleotide
atctatcacgtcccagtacttcttatgcgctccccga

SEQ ID NO: 66104 - DNA, 37 bp, Artificial Sequence
  Synthetic oligonucleotide
atccatcccaggccgacctagcttcgcctccacgcga

SEQ ID NO: 66105 - DNA, 37 bp, Artificial Sequence
  Synthetic oligonucleotide
gtgcagtacgggaggaagtagggaaattatgaggcga

SEQ ID NO: 66106 - DNA, 37 bp, Artificial Sequence
  Synthetic oligonucleotide
tgcaacttagccttttttttcccgtgctcccttgcga

SEQ ID NO: 66107 - DNA, 37 bp, Artificial Sequence
  Synthetic oligonucleotide
accataccgatccctgctgaacgtcgctggacttcga

SEQ ID NO: 66108 - DNA, 37 bp, Artificial Sequence
  Synthetic oligonucleotide
tactgcacactagcactgtaatttctctgctcttcga

SEQ ID NO: 66109 - DNA, 37 bp, Artificial Sequence
  Synthetic oligonucleotide
gaacatagggaggaatacgccgcggtgggcatgagga

SEQ ID NO: 66110 - DNA, 37 bp, Artificial Sequence
  Synthetic oligonucleotide
gtgagtgctggctcaaggagggcggaggaacatagga

SEQ ID NO: 66111 - DNA, 35 bp, Artificial Sequence
  Synthetic oligonucleotide
tgggaaggagaggaagggctgaggatcctgccgga

SEQ ID NO: 66112 - DNA, 37 bp, Artificial Sequence
  Synthetic oligonucleotide
gagagtggggacgcgggtggcgagattggaatgcgga

SEQ ID NO: 66113 - DNA, 36 bp, Artificial Sequence
  Synthetic oligonucleotide
atggttggggcagggcgggcaacagaacccgaggga

SEQ ID NO: 66114 - DNA, 36 bp, Artificial Sequence
  Synthetic oligonucleotide
accgcggccgacttagccatcatttcttccccggga

SEQ ID NO: 66115 - DNA, 37 bp, Artificial Sequence
  Synthetic oligonucleotide
acagggggtgcggggaagcacttgattcataggggga

SEQ ID NO: 66116 - DNA, 37 bp, Artificial Sequence
  Synthetic oligonucleotide
tagtccgcgcacatttcaccttgacgatttctgggga

SEQ ID NO: 66117 - DNA, 35 bp, Artificial Sequence
  Synthetic oligonucleotide
gaacgctgtgcgtaactcccaactatcacactgga

SEQ ID NO: 66118 - DNA, 37 bp, Artificial Sequence
  Synthetic oligonucleotide
gaagccggtggggggggttattgagggtgtaaaatga

SEQ ID NO: 66119 - DNA, 38 bp, Artificial Sequence
  Synthetic oligonucleotide
taccgcacctcactcttacaggattcacagcagaatga

SEQ ID NO: 66120 - DNA, 38 bp, Artificial Sequence
  Synthetic oligonucleotide
gactccatcgccgacctccaaccggattcattttatga

SEQ ID NO: 66121 - DNA, 37 bp, Artificial Sequence
  Synthetic oligonucleotide
ttgcgcggggggcggggtggaagccgggtgtcactga

SEQ ID NO: 66122 - DNA, 38 bp, Artificial Sequence
  Synthetic oligonucleotide
atgaccgagcctgcgtgaattctcggtgtccttactga

SEQ ID NO: 66123 - DNA, 38 bp, Artificial Sequence
  Synthetic oligonucleotide
ttggggtgggtccgtagatgggacgggggatgagctga

SEQ ID NO: 66124 - DNA, 38 bp, Artificial Sequence
  Synthetic oligonucleotide
acagctaagctcgtccttgctactacacacacttctga

SEQ ID NO: 66125 - DNA, 38 bp, Artificial Sequence
  Synthetic oligonucleotide
gtacagacagtcgaggaggttagcgataggcgaggtga

SEQ ID NO: 66126 - DNA, 37 bp, Artificial Sequence
  Synthetic oligonucleotide
gtccagggagcaagtgctggcacataggaaagggtga

SEQ ID NO: 66127 - DNA, 38 bp, Artificial Sequence
  Synthetic oligonucleotide
gatgggagggggggtgccggatcgatagtatcgggtga

SEQ ID NO: 66128 - DNA, 37 bp, Artificial Sequence
  Synthetic oligonucleotide
atcagtaggcctcaattcctagctgcctgttttgtga

SEQ ID NO: 66129 - DNA, 37 bp, Artificial Sequence
  Synthetic oligonucleotide
tcacacctactcctctgtctatagagactgaaattga

SEQ ID NO: 66130 - DNA, 38 bp, Artificial Sequence
  Synthetic oligonucleotide
tctgatcctgcgtgcgggctgcggttacctatcattga

SEQ ID NO: 66131 - DNA, 37 bp, Artificial Sequence
  Synthetic oligonucleotide
gtcgatgcaaggcggggtcatcaatgaccttcattga

SEQ ID NO: 66132 - DNA, 34 bp, Artificial Sequence
  Synthetic oligonucleotide
tagtgtgcgcaaatcacgaactaggaaggcttga

SEQ ID NO: 66133 - DNA, 36 bp, Artificial Sequence
  Synthetic oligonucleotide
acccggagcggtaactttactggggtctgaatttga

SEQ ID NO: 66134 - DNA, 38 bp, Artificial Sequence
  Synthetic oligonucleotide
gccacccagtgatgttactgggctgcccttgaatttga

SEQ ID NO: 66135 - DNA, 38 bp, Artificial Sequence
  Synthetic oligonucleotide
aagtcgcccatgcttagatgtcctccccctcactttga

SEQ ID NO: 66136 - DNA, 38 bp, Artificial Sequence
  Synthetic oligonucleotide
actaaccacagggcggcataacatgctatcctctttga

SEQ ID NO: 66137 - DNA, 37 bp, Artificial Sequence
  Synthetic oligonucleotide
tggagcaggcacacctgtaataccattttctctttga

SEQ ID NO: 66138 - DNA, 38 bp, Artificial Sequence
  Synthetic oligonucleotide
gcacgggccggactaaagaggggggggtacgggtttga

SEQ ID NO: 66139 - DNA, 36 bp, Artificial Sequence
  Synthetic oligonucleotide
tcgcgggaggggccggtgggggacgtgggtgagata

SEQ ID NO: 66140 - DNA, 36 bp, Artificial Sequence
  Synthetic oligonucleotide
tcgctaaagcccacctgtcccctccggtagtgacta

SEQ ID NO: 66141 - DNA, 36 bp, Artificial Sequence
  Synthetic oligonucleotide
gtcaacataagcatttgattagcctactagccccta

SEQ ID NO: 66142 - DNA, 35 bp, Artificial Sequence
  Synthetic oligonucleotide
acccactggacagaacccattcactatcactgcta

SEQ ID NO: 66143 - DNA, 36 bp, Artificial Sequence
  Synthetic oligonucleotide
tcacaccccctctgtcctgtcggaaatcctgttcta

SEQ ID NO: 66144 - DNA, 36 bp, Artificial Sequence
  Synthetic oligonucleotide
gtcccttccaaatgcgtactcacctctactcgggta

SEQ ID NO: 66145 - DNA, 36 bp, Artificial Sequence
  Synthetic oligonucleotide
gcgtgttcacccctcacgattcctatcttgctttta

SEQ ID NO: 66146 - DNA, 35 bp, Artificial Sequence
  Synthetic oligonucleotide
gaccaacaggagatcctgccactcttctatgcaac

SEQ ID NO: 66147 - DNA, 35 bp, Artificial Sequence
  Synthetic oligonucleotide
taacgccttgccccggggatcttactgcctataac

SEQ ID NO: 66148 - DNA, 35 bp, Artificial Sequence
  Synthetic oligonucleotide
tcatatacaaccagcaccccacttgcccggaggac

SEQ ID NO: 66149 - DNA, 32 bp, Artificial Sequence
  Synthetic oligonucleotide
gccagggcaatcttacccaacacagcccatac

SEQ ID NO: 66150 - DNA, 35 bp, Artificial Sequence
  Synthetic oligonucleotide
acacgacgtcttaccttagtctattgccaacctac

SEQ ID NO: 66151 - DNA, 35 bp, Artificial Sequence
  Synthetic oligonucleotide
taacagtgctagttgaatctcgctgtcccccttac

SEQ ID NO: 66152 - DNA, 35 bp, Artificial Sequence
  Synthetic oligonucleotide
gtcccaccgtaaactttcgtgaccaactcccacgc

SEQ ID NO: 66153 - DNA, 35 bp, Artificial Sequence
  Synthetic oligonucleotide
gggacactaagcgcaaactatgccgtcaattcatc

SEQ ID NO: 66154 - DNA, 35 bp, Artificial Sequence
  Synthetic oligonucleotide
gtctcgcgccgcaaatatgcgattttctctcgttc

SEQ ID NO: 66155 - DNA, 35 bp, Artificial Sequence
  Synthetic oligonucleotide
accgccccttcagccccgctcacacgctcccatag

SEQ ID NO: 66156 - DNA, 35 bp, Artificial Sequence
  Synthetic oligonucleotide
gcccctcccggaacattttacattacatcgttccg

SEQ ID NO: 66157 - DNA, 35 bp, Artificial Sequence
  Synthetic oligonucleotide
gtggcctttcctgtctgcacgctttctttccagcg

SEQ ID NO: 66158 - DNA, 35 bp, Artificial Sequence
  Synthetic oligonucleotide
gaatcccaatgttgagctcccgtcccgcgccctcg

SEQ ID NO: 66159 - DNA, 35 bp, Artificial Sequence
  Synthetic oligonucleotide
gacacgtatcgcgtcttttgtgctggcttccttcg

SEQ ID NO: 66160 - DNA, 35 bp, Artificial Sequence
  Synthetic oligonucleotide
gtgaatcgaccgcctgcctgccccacaatagttcg

SEQ ID NO: 66161 - DNA, 35 bp, Artificial Sequence
  Synthetic oligonucleotide
tgttaaacacagaggagttggactggggtaaaggg

SEQ ID NO: 66162 - DNA, 35 bp, Artificial Sequence
  Synthetic oligonucleotide
tgctagcagggtaggtgggaaagtaaaggaatggg

SEQ ID NO: 66163 - DNA, 35 bp, Artificial Sequence
  Synthetic oligonucleotide
tcaatgcatcaacctcgccgtgcccaaacgaccat

SEQ ID NO: 66164 - DNA, 35 bp, Artificial Sequence
  Synthetic oligonucleotide
gcctacctacatcaacgcggatcgccctcgatcat

SEQ ID NO: 66165 - DNA, 35 bp, Artificial Sequence
  Synthetic oligonucleotide
gagaggcacacatctcattctccctcagatttact

SEQ ID NO: 66166 - DNA, 35 bp, Artificial Sequence
  Synthetic oligonucleotide
tttcggtaccccacgttaacacacaagccgctcct

SEQ ID NO: 66167 - DNA, 35 bp, Artificial Sequence
  Synthetic oligonucleotide
acctggtccatcccttttgatgtacagcaaaatct

SEQ ID NO: 66168 - DNA, 35 bp, Artificial Sequence
  Synthetic oligonucleotide
ttcgtgccatcatccgtaccagatcagatacccgt

SEQ ID NO: 66169 - DNA, 35 bp, Artificial Sequence
  Synthetic oligonucleotide
tcctaacacccctgcgttgcgcaacaccctcaggt

SEQ ID NO: 66170 - DNA, 35 bp, Artificial Sequence
  Synthetic oligonucleotide
aacacacaggatggtagggggatttcatggagtgt

SEQ ID NO: 66171 - DNA, 35 bp, Artificial Sequence
  Synthetic oligonucleotide
ggatgcgccgtcgctacttttcggacctctggctt

SEQ ID NO: 66172 - DNA, 35 bp, Artificial Sequence
  Synthetic oligonucleotide
ccatccgctgcacgcttgattccgctgtccttttt

SEQ ID NO: 66173 - DNA, 36 bp, Artificial Sequence
  Synthetic oligonucleotide
acacacgtcccacatagccgatgactaccgtccaaa

SEQ ID NO: 66174 - DNA, 36 bp, Artificial Sequence
  Synthetic oligonucleotide
gcctgacttcaatcgctcgtactcattcccctgaaa

SEQ ID NO: 66175 - DNA, 35 bp, Artificial Sequence
  Synthetic oligonucleotide
tcctcacatcatactagactccaggacacgctaaa

SEQ ID NO: 66176 - DNA, 36 bp, Artificial Sequence
  Synthetic oligonucleotide
gatgccaccgtgattagtggctaggtggaaaattaa

SEQ ID NO: 66177 - DNA, 36 bp, Artificial Sequence
  Synthetic oligonucleotide
gactaccctcgtcccactggggcaattccaacttaa

SEQ ID NO: 66178 - DNA, 36 bp, Artificial Sequence
  Synthetic oligonucleotide
gatgttacgtcctgccttcactcccccttgcgaaca

SEQ ID NO: 66179 - DNA, 36 bp, Artificial Sequence
  Synthetic oligonucleotide
tgctccaccccatgcggactttgtccaagaataaca

SEQ ID NO: 66180 - DNA, 36 bp, Artificial Sequence
  Synthetic oligonucleotide
gcatgccgtaatggatccccgacgcccggactcaca

SEQ ID NO: 66181 - DNA, 36 bp, Artificial Sequence
  Synthetic oligonucleotide
actcttcgcattcctgactctcaccgtgggttcaca

SEQ ID NO: 66182 - DNA, 36 bp, Artificial Sequence
  Synthetic oligonucleotide
acatgccccccccgtgttcggtatgacaccgcgaca

SEQ ID NO: 66183 - DNA, 36 bp, Artificial Sequence
  Synthetic oligonucleotide
acttaatccggcagttccgtatcaccaagctcacca

SEQ ID NO: 66184 - DNA, 36 bp, Artificial Sequence
  Synthetic oligonucleotide
atacgtcacgagaaccggccgtgcacactcttacca

SEQ ID NO: 66185 - DNA, 35 bp, Artificial Sequence
  Synthetic oligonucleotide
aatcgccaccagtcctaaatctatcagtgcatgca

SEQ ID NO: 66186 - DNA, 36 bp, Artificial Sequence
  Synthetic oligonucleotide
ggcctgccgcacggtattaggcaactaagccctgca

SEQ ID NO: 66187 - DNA, 35 bp, Artificial Sequence
  Synthetic oligonucleotide
acacaccctacttctccggagccatagtatttgca

SEQ ID NO: 66188 - DNA, 36 bp, Artificial Sequence
  Synthetic oligonucleotide
tacctaccgatgatcccttgcatagcaatgcgatca

SEQ ID NO: 66189 - DNA, 36 bp, Artificial Sequence
  Synthetic oligonucleotide
gacgtaagcatctgcgttcgcgactgctcttcttca

SEQ ID NO: 66190 - DNA, 36 bp, Artificial Sequence
  Synthetic oligonucleotide
tgcttgcaagcaaagctctcattgccgttcttttca

SEQ ID NO: 66191 - DNA, 37 bp, Artificial Sequence
  Synthetic oligonucleotide
gatagccgcagtgtgtcgcagggatagggtggaaaga

SEQ ID NO: 66192 - DNA, 37 bp, Artificial Sequence
  Synthetic oligonucleotide
gcccacctgcctttatgtttttctaagctcgacgaga

SEQ ID NO: 66193 - DNA, 37 bp, Artificial Sequence
  Synthetic oligonucleotide
gatagggcctgggttggggtacaattgctgggcgaga

SEQ ID NO: 66194 - DNA, 37 bp, Artificial Sequence
  Synthetic oligonucleotide
agatatgggaggggacggagagggtacgcgtaaacga

SEQ ID NO: 66195 - DNA, 37 bp, Artificial Sequence
  Synthetic oligonucleotide
ggaccccccccgccatttggtttcatagctctcacga

SEQ ID NO: 66196 - DNA, 36 bp, Artificial Sequence
  Synthetic oligonucleotide
accacttccccgccttgattgccgtcttggatccga

SEQ ID NO: 66197 - DNA, 36 bp, Artificial Sequence
  Synthetic oligonucleotide
ttgaccaaactgaaggacgcgtcgcatcctctccga

SEQ ID NO: 66198 - DNA, 37 bp, Artificial Sequence
  Synthetic oligonucleotide
tcacggagctctgccatgccccaactgacatacgcga

SEQ ID NO: 66199 - DNA, 37 bp, Artificial Sequence
  Synthetic oligonucleotide
accgacaccctgattattgtggttacacccttcgcga

SEQ ID NO: 66200 - DNA, 37 bp, Artificial Sequence
  Synthetic oligonucleotide
tcaccctcacaatttgattcgactgtcaatcactcga

SEQ ID NO: 66201 - DNA, 37 bp, Artificial Sequence
  Synthetic oligonucleotide
atgcaattggggagggttagggcgggacgtacgagga

SEQ ID NO: 66202 - DNA, 37 bp, Artificial Sequence
  Synthetic oligonucleotide
aaaggaaagtagagggcagttcaggcaggcgggagga

SEQ ID NO: 66203 - DNA, 37 bp, Artificial Sequence
  Synthetic oligonucleotide
gtgcaccactcctgcctcccccccgtccgtaaccgga

SEQ ID NO: 66204 - DNA, 36 bp, Artificial Sequence
  Synthetic oligonucleotide
actcaatcacttctgtcccgccaatcacccctcgga

SEQ ID NO: 66205 - DNA, 37 bp, Artificial Sequence
  Synthetic oligonucleotide
tagggtgggggtgacgcaagtgaccgggtacaaggga

SEQ ID NO: 66206 - DNA, 36 bp, Artificial Sequence
  Synthetic oligonucleotide
tccctcgccctaataccgtgatcgattcctacggga

SEQ ID NO: 66207 - DNA, 37 bp, Artificial Sequence
  Synthetic oligonucleotide
tgcaccacgtccgtttttgaccgatttctctggggga

SEQ ID NO: 66208 - DNA, 37 bp, Artificial Sequence
  Synthetic oligonucleotide
gaccaaggtgacaaatgtcgtatgctgggattgggga

SEQ ID NO: 66209 - DNA, 37 bp, Artificial Sequence
  Synthetic oligonucleotide
ttcagcacaaggcaatgtgggatgtttttgtttggga

SEQ ID NO: 66210 - DNA, 37 bp, Artificial Sequence
  Synthetic oligonucleotide
acatgacagccgatcactccactgttaacatcttgga

SEQ ID NO: 66211 - DNA, 38 bp, Artificial Sequence
  Synthetic oligonucleotide
accgccccgcggtacgagcgagatagtgattcgcatga

SEQ ID NO: 66212 - DNA, 38 bp, Artificial Sequence
  Synthetic oligonucleotide
tagaacgtggccgagaggggttggggaaggtgagatga

SEQ ID NO: 66213 - DNA, 37 bp, Artificial Sequence
  Synthetic oligonucleotide
ggtcgtagtgggggaaaggactataggagaacgatga

SEQ ID NO: 66214 - DNA, 37 bp, Artificial Sequence
  Synthetic oligonucleotide
gatgcggtgacgatggggggagttgggtgggggatga

SEQ ID NO: 66215 - DNA, 38 bp, Artificial Sequence
  Synthetic oligonucleotide
acgccggtctcggtgtcggccgtacacaggaacactga

SEQ ID NO: 66216 - DNA, 37 bp, Artificial Sequence
  Synthetic oligonucleotide
tcctgccacacatgcgccacagactttacggtactga

SEQ ID NO: 66217 - DNA, 38 bp, Artificial Sequence
  Synthetic oligonucleotide
tatgccttcctgcacgtctcactaacgcgttgccctga

SEQ ID NO: 66218 - DNA, 38 bp, Artificial Sequence
  Synthetic oligonucleotide
tggagactacagcaatgtcgaaatatccatgttcctga

SEQ ID NO: 66219 - DNA, 37 bp, Artificial Sequence
  Synthetic oligonucleotide
gacctgaacgaactgagtaacgccattttcaatctga

SEQ ID NO: 66220 - DNA, 37 bp, Artificial Sequence
  Synthetic oligonucleotide
ggtggaaagactggggaaaggggggaggaagatctga

SEQ ID NO: 66221 - DNA, 37 bp, Artificial Sequence
  Synthetic oligonucleotide
atatgcgctgcactctgtcttcctcttttttgtctga

SEQ ID NO: 66222 - DNA, 36 bp, Artificial Sequence
  Synthetic oligonucleotide
tttccacctacatcttgtgcttcatctctcaagtga

SEQ ID NO: 66223 - DNA, 38 bp, Artificial Sequence
  Synthetic oligonucleotide
gaacgccctcccttcgccctcggccgcacgtgccgtga

SEQ ID NO: 66224 - DNA, 38 bp, Artificial Sequence
  Synthetic oligonucleotide
gcttgagacgggtggcgtaatctaagtgggcggggtga

SEQ ID NO: 66225 - DNA, 37 bp, Artificial Sequence
  Synthetic oligonucleotide
gacccgcccgttcctgccccatgtcgtattacattga

SEQ ID NO: 66226 - DNA, 37 bp, Artificial Sequence
  Synthetic oligonucleotide
agtcacacgcgcaccgaactctattgtttatcattga

SEQ ID NO: 66227 - DNA, 38 bp, Artificial Sequence
  Synthetic oligonucleotide
agatcacacacgtgcaccattttagcttaagcccttga

SEQ ID NO: 66228 - DNA, 37 bp, Artificial Sequence
  Synthetic oligonucleotide
tcacccgttcccgtgtgtgaaattgtacctcccttga

SEQ ID NO: 66229 - DNA, 38 bp, Artificial Sequence
  Synthetic oligonucleotide
tcctgcggagcaatttgcctgttctctttgttggttga

SEQ ID NO: 66230 - DNA, 38 bp, Artificial Sequence
  Synthetic oligonucleotide
gaccccctccccgagtactcgcaaagttcttcgtttga

SEQ ID NO: 66231 - DNA, 36 bp, Artificial Sequence
  Synthetic oligonucleotide
acacgcgattcgcccgtttgttgcatactcacgcta

SEQ ID NO: 66232 - DNA, 36 bp, Artificial Sequence
  Synthetic oligonucleotide
tagcggagagagaatcataaaggaggaacggggcta

SEQ ID NO: 66233 - DNA, 35 bp, Artificial Sequence
  Synthetic oligonucleotide
accttgactcaacagcgtattcctacggtcctcta

SEQ ID NO: 66234 - DNA, 35 bp, Artificial Sequence
  Synthetic oligonucleotide
gaaacctcaccacacgccacggagtccgtgaatta

SEQ ID NO: 66235 - DNA, 36 bp, Artificial Sequence
  Synthetic oligonucleotide
aagcagagcactgttacagtgtttctttccccctta

SEQ ID NO: 66236 - DNA, 36 bp, Artificial Sequence
  Synthetic oligonucleotide
aagtacggacgtaggatggagtgggtcagatagtta

SEQ ID NO: 66237 - DNA, 35 bp, Artificial Sequence
  Synthetic oligonucleotide
gctcccgcttggtcccatagcctgcctctgcttta

SEQ ID NO: 66238 - DNA, 35 bp, Artificial Sequence
  Synthetic oligonucleotide
agccttcaccgcccttgtgtcctttcgttcgccac

SEQ ID NO: 66239 - DNA, 35 bp, Artificial Sequence
  Synthetic oligonucleotide
tatgtgtggctgtctggtttcaccgtccttacacc

SEQ ID NO: 66240 - DNA, 35 bp, Artificial Sequence
  Synthetic oligonucleotide
agtacgtgccccgtattgacatgttctacgtcccc

SEQ ID NO: 66241 - DNA, 35 bp, Artificial Sequence
  Synthetic oligonucleotide
gtcgctcgtggttcgccgatcctgccgtaactgcc

SEQ ID NO: 66242 - DNA, 35 bp, Artificial Sequence
  Synthetic oligonucleotide
atgcacttcgcgctatctcacatgcaaccttatcc

SEQ ID NO: 66243 - DNA, 35 bp, Artificial Sequence
  Synthetic oligonucleotide
acccgggcctcagtggctaaccgtcattgccccgc

SEQ ID NO: 66244 - DNA, 35 bp, Artificial Sequence
  Synthetic oligonucleotide
gattcatgtaacgcgtatgacattcctgtacctgc

SEQ ID NO: 66245 - DNA, 35 bp, Artificial Sequence
  Synthetic oligonucleotide
taccaacgcccgagcgagctttgcacttggcttgc

SEQ ID NO: 66246 - DNA, 35 bp, Artificial Sequence
  Synthetic oligonucleotide
gaaagcccacgcggagacatttttaccatgctatc

SEQ ID NO: 66247 - DNA, 35 bp, Artificial Sequence
  Synthetic oligonucleotide
taatgcggtccctgaacatactcgccacataagtc

SEQ ID NO: 66248 - DNA, 35 bp, Artificial Sequence
  Synthetic oligonucleotide
tgccacactgtttggagcttcaattcattctagtc

SEQ ID NO: 66249 - DNA, 35 bp, Artificial Sequence
  Synthetic oligonucleotide
tgtaccacgcccataacgatcggcccaggcccgtc

SEQ ID NO: 66250 - DNA, 35 bp, Artificial Sequence
  Synthetic oligonucleotide
ttccccacaaggccatgaatattcacccgcaaccg

SEQ ID NO: 66251 - DNA, 35 bp, Artificial Sequence
  Synthetic oligonucleotide
acctgactgtcacctccccacattattgccgagcg

SEQ ID NO: 66252 - DNA, 35 bp, Artificial Sequence
  Synthetic oligonucleotide
tcgtacgcccccaaacactcatgccaaagagcagg

SEQ ID NO: 66253 - DNA, 35 bp, Artificial Sequence
  Synthetic oligonucleotide
gcaaaacccgtgggtaggagggtcaagtaacgggg

SEQ ID NO: 66254 - DNA, 35 bp, Artificial Sequence
  Synthetic oligonucleotide
gagacgactaggtagcccatcttacaccatgaatg

SEQ ID NO: 66255 - DNA, 35 bp, Artificial Sequence
  Synthetic oligonucleotide
gatagggaggtggccttgtgacaggaaggagggtg

SEQ ID NO: 66256 - DNA, 35 bp, Artificial Sequence
  Synthetic oligonucleotide
gcctgttcggacgccttactacacaaaatcttgat

SEQ ID NO: 66257 - DNA, 35 bp, Artificial Sequence
  Synthetic oligonucleotide
aactcccatcgtgtacgccaaatcctgaattctat

SEQ ID NO: 66258 - DNA, 35 bp, Artificial Sequence
  Synthetic oligonucleotide
gtcatgatgatcgtcctctcccgcaaagttggcct

SEQ ID NO: 66259 - DNA, 35 bp, Artificial Sequence
  Synthetic oligonucleotide
tatggcggacggaatgggatttcacggggggaagt

SEQ ID NO: 66260 - DNA, 35 bp, Artificial Sequence
  Synthetic oligonucleotide
gatgtggtccagtcagtgtccatcacaagtctagt

SEQ ID NO: 66261 - DNA, 35 bp, Artificial Sequence
  Synthetic oligonucleotide
gtcccgctgctgtctgactcgcttgctctcgtcgt

SEQ ID NO: 66262 - DNA, 35 bp, Artificial Sequence
  Synthetic oligonucleotide
gtaccccatcatacgtgatcccttaatttcgaggt

SEQ ID NO: 66263 - DNA, 35 bp, Artificial Sequence
  Synthetic oligonucleotide
tcctcgcacccgcccacgcgcagacactcaggggt

SEQ ID NO: 66264 - DNA, 35 bp, Artificial Sequence
  Synthetic oligonucleotide
aagtacgccggaagcaactggtattccctccttgt

SEQ ID NO: 66265 - DNA, 35 bp, Artificial Sequence
  Synthetic oligonucleotide
gcaaacgggtaaacggaattgatagtggcggagtt

SEQ ID NO: 66266 - DNA, 35 bp, Artificial Sequence
  Synthetic oligonucleotide
acagccaccgacttgcccctactcgttagagcttt

SEQ ID NO: 66267 - DNA, 35 bp, Artificial Sequence
  Synthetic oligonucleotide
tggaccaccaatccgcccaaggttttaacctcttt

SEQ ID NO: 66268 - DNA, 35 bp, Artificial Sequence
  Synthetic oligonucleotide
gtcgcgtgctcgcaacacccagtcctatcgcaaaa

SEQ ID NO: 66269 - DNA, 35 bp, Artificial Sequence
  Synthetic oligonucleotide
tatccaaccacctggcaccggaaccgttggtaaaa

SEQ ID NO: 66270 - DNA, 35 bp, Artificial Sequence
  Synthetic oligonucleotide
attacatcacctgccgccctgatcccgaacccaaa

SEQ ID NO: 66271 - DNA, 36 bp, Artificial Sequence
  Synthetic oligonucleotide
gattgcggccagacaccctgctgcctgttctccaaa

SEQ ID NO: 66272 - DNA, 35 bp, Artificial Sequence
  Synthetic oligonucleotide
tcagtaagctggactccctctcgcccaatcccgaa

SEQ ID NO: 66273 - DNA, 35 bp, Artificial Sequence
  Synthetic oligonucleotide
tcttggcttacctgccctcagtccccttttttgaa

SEQ ID NO: 66274 - DNA, 36 bp, Artificial Sequence
  Synthetic oligonucleotide
tgcacgctcccgaccccctatggcgttgatccgtaa

SEQ ID NO: 66275 - DNA, 36 bp, Artificial Sequence
  Synthetic oligonucleotide
tccaccgttaggcgaacaaagcttgccccaatgaca

SEQ ID NO: 66276 - DNA, 36 bp, Artificial Sequence
  Synthetic oligonucleotide
gactacgggcacgctccttgccgcttgttgttacca

SEQ ID NO: 66277 - DNA, 36 bp, Artificial Sequence
  Synthetic oligonucleotide
gacacgctgtcgtggtcaaggggatataattctgca

SEQ ID NO: 66278 - DNA, 36 bp, Artificial Sequence
  Synthetic oligonucleotide
tagtatcctgctggtggcatcctacgtactttctca

SEQ ID NO: 66279 - DNA, 36 bp, Artificial Sequence
  Synthetic oligonucleotide
tcatctcccacacgctatttgagggatcctcattca

SEQ ID NO: 66280 - DNA, 37 bp, Artificial Sequence
  Synthetic oligonucleotide
tccattccacctcagtgcacacgttatgcaatctaga

SEQ ID NO: 66281 - DNA, 37 bp, Artificial Sequence
  Synthetic oligonucleotide
tatccgcccgatcccaacgtgaactggaccatttaga

SEQ ID NO: 66282 - DNA, 37 bp, Artificial Sequence
  Synthetic oligonucleotide
gccctccactaccaattgttttcgaccggaactccga

SEQ ID NO: 66283 - DNA, 37 bp, Artificial Sequence
  Synthetic oligonucleotide
gcacgcccatcatctcacctgcgacatgccaattcga

SEQ ID NO: 66284 - DNA, 37 bp, Artificial Sequence
  Synthetic oligonucleotide
atggaagacgtaccgttactcagccactcccattcga

SEQ ID NO: 66285 - DNA, 37 bp, Artificial Sequence
  Synthetic oligonucleotide
atcgcatggccacgacgcccccttgaagatcctagga

SEQ ID NO: 66286 - DNA, 37 bp, Artificial Sequence
  Synthetic oligonucleotide
aacacatgagggggagtagtagaggtgcgcgctagga

SEQ ID NO: 66287 - DNA, 37 bp, Artificial Sequence
  Synthetic oligonucleotide
accgtggccgagcaatcgcatttcaacatcccccgga

SEQ ID NO: 66288 - DNA, 37 bp, Artificial Sequence
  Synthetic oligonucleotide
gccgacggttacgtcggtaagtgagatgggcggggga

SEQ ID NO: 66289 - DNA, 37 bp, Artificial Sequence
  Synthetic oligonucleotide
ggtacaatctcggggaaggggcgggaatacgggggga

SEQ ID NO: 66290 - DNA, 36 bp, Artificial Sequence
  Synthetic oligonucleotide
aggagagggcgaggcggtgagtgggtcggtggggga

SEQ ID NO: 66291 - DNA, 35 bp, Artificial Sequence
  Synthetic oligonucleotide
acgtatccgcaaggcaacccacgctactttcatga

SEQ ID NO: 66292 - DNA, 38 bp, Artificial Sequence
  Synthetic oligonucleotide
gatagggggtgggagtagagaggcgataacagcgatga

SEQ ID NO: 66293 - DNA, 38 bp, Artificial Sequence
  Synthetic oligonucleotide
aagacatgccgtgtagtagtgtagtgtgctgaggatga

SEQ ID NO: 66294 - DNA, 38 bp, Artificial Sequence
  Synthetic oligonucleotide
aagacgaacggaagagtgtgggagtaggctggtgatga

SEQ ID NO: 66295 - DNA, 38 bp, Artificial Sequence
  Synthetic oligonucleotide
gggagtgggaggaaataaaaccatggtgagtgaactga

SEQ ID NO: 66296 - DNA, 37 bp, Artificial Sequence
  Synthetic oligonucleotide
tccttgcggtacggatgaccacgcctctcgccactga

SEQ ID NO: 66297 - DNA, 36 bp, Artificial Sequence
  Synthetic oligonucleotide
tccacgccctttgcgttttagattcgttcaccctga

SEQ ID NO: 66298 - DNA, 38 bp, Artificial Sequence
  Synthetic oligonucleotide
tacttcaccaccccaggcccacgtcaacggcctgctga

SEQ ID NO: 66299 - DNA, 38 bp, Artificial Sequence
  Synthetic oligonucleotide
tcatcccggccccggcgtcggagctttggcccctctga

SEQ ID NO: 66300 - DNA, 38 bp, Artificial Sequence
  Synthetic oligonucleotide
tgacacttgactgcttatagtaagtacaccctctctga

SEQ ID NO: 66301 - DNA, 38 bp, Artificial Sequence
  Synthetic oligonucleotide
gcccacagggcaatgggagggaaattcgagggaagtga

SEQ ID NO: 66302 - DNA, 37 bp, Artificial Sequence
  Synthetic oligonucleotide
attgggcaaccagcgcacaccatctcgtacccagtga

SEQ ID NO: 66303 - DNA, 38 bp, Artificial Sequence
  Synthetic oligonucleotide
tcaatgcgcccgatgttgagggggggaagggggagtga

SEQ ID NO: 66304 - DNA, 38 bp, Artificial Sequence
  Synthetic oligonucleotide
acctcactccctgtagttcccaagttacttgaccgtga

SEQ ID NO: 66305 - DNA, 38 bp, Artificial Sequence
  Synthetic oligonucleotide
agatccatcgcgctgggctacgaccccattcatcgtga

SEQ ID NO: 66306 - DNA, 38 bp, Artificial Sequence
  Synthetic oligonucleotide
gacgcgaggggggttacagaacggagtcagatcggtga

SEQ ID NO: 66307 - DNA, 38 bp, Artificial Sequence
  Synthetic oligonucleotide
acaaacatcccccgcacgccctattatggcaagtgtga

SEQ ID NO: 66308 - DNA, 37 bp, Artificial Sequence
  Synthetic oligonucleotide
gcgctacgcccgactgccgaccatattgccgttgtga

SEQ ID NO: 66309 - DNA, 38 bp, Artificial Sequence
  Synthetic oligonucleotide
ggtcgacccaacatctgacctctttgtgaccgcattga

SEQ ID NO: 66310 - DNA, 38 bp, Artificial Sequence
  Synthetic oligonucleotide
cctgccgcacgcaacacctatgtcctgtttcaccttga

SEQ ID NO: 66311 - DNA, 38 bp, Artificial Sequence
  Synthetic oligonucleotide
gtcagcccgacattttgccttcttggtgcgccccttga

SEQ ID NO: 66312 - DNA, 38 bp, Artificial Sequence
  Synthetic oligonucleotide
gcactcggtccaatttgtgtatgtgtgtgtttgcttga

SEQ ID NO: 66313 - DNA, 38 bp, Artificial Sequence
  Synthetic oligonucleotide
ggtccaaccggcacttacctaacgatctgaactcttga

SEQ ID NO: 66314 - DNA, 38 bp, Artificial Sequence
  Synthetic oligonucleotide
actatcaccacaacggataaatccgcccaccttgttga

SEQ ID NO: 66315 - DNA, 36 bp, Artificial Sequence
  Synthetic oligonucleotide
tagagggaggaaggtgagggtactgagcgtcatcta

SEQ ID NO: 66316 - DNA, 36 bp, Artificial Sequence
  Synthetic oligonucleotide
tgctgttacccgagtgacatctgccccgattctcta

SEQ ID NO: 66317 - DNA, 36 bp, Artificial Sequence
  Synthetic oligonucleotide
gacatagcaagtcccgtccttccacctcaccaagta

SEQ ID NO: 66318 - DNA, 36 bp, Artificial Sequence
  Synthetic oligonucleotide
gtaaccgcaagttggcgttgctcccccgagttcgta

SEQ ID NO: 66319 - DNA, 36 bp, Artificial Sequence
  Synthetic oligonucleotide
ttgtgcgctgctgagttatctgctcttttcgtggta

SEQ ID NO: 66320 - DNA, 36 bp, Artificial Sequence
  Synthetic oligonucleotide
tagtcaaccacattttccctctgccagagcctatta

SEQ ID NO: 66321 - DNA, 35 bp, Artificial Sequence
  Synthetic oligonucleotide
gtcatagccgctctgcctaacctccttaacgaaac

SEQ ID NO: 66322 - DNA, 35 bp, Artificial Sequence
  Synthetic oligonucleotide
atccccctgcttgcgtatcacattatcatcgccac

SEQ ID NO: 66323 - DNA, 35 bp, Artificial Sequence
  Synthetic oligonucleotide
tccaagctcattgtacttacccacctattgttcac

SEQ ID NO: 66324 - DNA, 35 bp, Artificial Sequence
  Synthetic oligonucleotide
ttgtccacgctccagagcatatgacctcgaccgac

SEQ ID NO: 66325 - DNA, 35 bp, Artificial Sequence
  Synthetic oligonucleotide
gtagcccacccctcaggctgcaccccattctatac

SEQ ID NO: 66326 - DNA, 35 bp, Artificial Sequence
  Synthetic oligonucleotide
gtcacgagaatcctccacaatgcttatacgtaccc

SEQ ID NO: 66327 - DNA, 35 bp, Artificial Sequence
  Synthetic oligonucleotide
cccactcccgatttaattcatgccgtgacctcccc

SEQ ID NO: 66328 - DNA, 35 bp, Artificial Sequence
  Synthetic oligonucleotide
gttccacctaaggctgacgttccaggaacatcgcc

SEQ ID NO: 66329 - DNA, 35 bp, Artificial Sequence
  Synthetic oligonucleotide
tcgaccacacaattagtctaacaatctgcgatagc

SEQ ID NO: 66330 - DNA, 35 bp, Artificial Sequence
  Synthetic oligonucleotide
actcaaaagcatactgctcgttctatctttcatgc

SEQ ID NO: 66331 - DNA, 35 bp, Artificial Sequence
  Synthetic oligonucleotide
gcgagaggcttgaccatggtttttttcgcgtgtgc

SEQ ID NO: 66332 - DNA, 35 bp, Artificial Sequence
  Synthetic oligonucleotide
acgctcagcccatgcaagttacgtttcccataatc

SEQ ID NO: 66333 - DNA, 35 bp, Artificial Sequence
  Synthetic oligonucleotide
attgctacctacccatagatccgttttgtgcggtc

SEQ ID NO: 66334 - DNA, 35 bp, Artificial Sequence
  Synthetic oligonucleotide
ggaggccgcccgtattttaactgctcgcccatgtc

SEQ ID NO: 66335 - DNA, 35 bp, Artificial Sequence
  Synthetic oligonucleotide
tacatcccgtatctacatcgggcacataacttgtc

SEQ ID NO: 66336 - DNA, 35 bp, Artificial Sequence
  Synthetic oligonucleotide
tagacgacccgtatgggttctccactgtatgtttc

SEQ ID NO: 66337 - DNA, 35 bp, Artificial Sequence
  Synthetic oligonucleotide
tgatgcccattcagttatctccgtctatagaaagg

SEQ ID NO: 66338 - DNA, 35 bp, Artificial Sequence
  Synthetic oligonucleotide
gccccccacctaaggcccaatgcgattcccctggg

SEQ ID NO: 66339 - DNA, 35 bp, Artificial Sequence
  Synthetic oligonucleotide
gcgccgcacctttgcacgctaccacagactgctgg

SEQ ID NO: 66340 - DNA, 35 bp, Artificial Sequence
  Synthetic oligonucleotide
gacccagcaccctcgactggcatgttctcaccctg

SEQ ID NO: 66341 - DNA, 35 bp, Artificial Sequence
  Synthetic oligonucleotide
gagtggtgggatcagtcagggggatatcgcgcaat

SEQ ID NO: 66342 - DNA, 35 bp, Artificial Sequence
  Synthetic oligonucleotide
tcaggtgtgcctgcgcattaactcgtactcactat

SEQ ID NO: 66343 - DNA, 35 bp, Artificial Sequence
  Synthetic oligonucleotide
tcgaccaatgccgccgggtttcctattatctctat

SEQ ID NO: 66344 - DNA, 35 bp, Artificial Sequence
  Synthetic oligonucleotide
ttactccccatgcttacctactttcctgggagact

SEQ ID NO: 66345 - DNA, 35 bp, Artificial Sequence
  Synthetic oligonucleotide
tgactgtctatgggagaatccccctgtccacccct

SEQ ID NO: 66346 - DNA, 35 bp, Artificial Sequence
  Synthetic oligonucleotide
tgagcaagccacacgggcccttgagcctagccgct

SEQ ID NO: 66347 - DNA, 35 bp, Artificial Sequence
  Synthetic oligonucleotide
gcatattaaagatcgcctgctcccccgctgcctct

SEQ ID NO: 66348 - DNA, 35 bp, Artificial Sequence
  Synthetic oligonucleotide
acacccttagtgctcttaaaatagtgaaccattct

SEQ ID NO: 66349 - DNA, 35 bp, Artificial Sequence
  Synthetic oligonucleotide
tcaccttacctgcctatgtcgcaaatcgcgatatt

SEQ ID NO: 66350 - DNA, 35 bp, Artificial Sequence
  Synthetic oligonucleotide
gcaccgcatcctaacacgccgacgacgttgatttt

SEQ ID NO: 66351 - DNA, 36 bp, Artificial Sequence
  Synthetic oligonucleotide
taactacgtggacaggaaaaaaccggagagcgaaaa

SEQ ID NO: 66352 - DNA, 36 bp, Artificial Sequence
  Synthetic oligonucleotide
tttgggagggaacgtagcctggcggatagaaggaaa

SEQ ID NO: 66353 - DNA, 35 bp, Artificial Sequence
  Synthetic oligonucleotide
aacatcgggagcaagagggtaagtgttggatgaaa

SEQ ID NO: 66354 - DNA, 36 bp, Artificial Sequence
  Synthetic oligonucleotide
agccactccctcgttcttccccgcagtatcacacaa

SEQ ID NO: 66355 - DNA, 35 bp, Artificial Sequence
  Synthetic oligonucleotide
tccgtgcccccaactcatatgttatttatctgcaa

SEQ ID NO: 66356 - DNA, 38 bp, Artificial Sequence
  Synthetic oligonucleotide
agatcccgcgatgcctattcacgaagccgtggccctaa

SEQ ID NO: 66357 - DNA, 35 bp, Artificial Sequence
  Synthetic oligonucleotide
accaccccaactctggagttcgataatccctgtaa

SEQ ID NO: 66358 - DNA, 36 bp, Artificial Sequence
  Synthetic oligonucleotide
tttgtcacctggtccttcatcagccatccatgttaa

SEQ ID NO: 66359 - DNA, 37 bp, Artificial Sequence
  Synthetic oligonucleotide
gtacattccatcaccactgcgcattgcatagcgaaca

SEQ ID NO: 66360 - DNA, 36 bp, Artificial Sequence
  Synthetic oligonucleotide
gccacccgcgagccgtattatcctaggttgttaaca

SEQ ID NO: 66361 - DNA, 35 bp, Artificial Sequence
  Synthetic oligonucleotide
tcaacatcaccttgcccgcgataaaccggacgaca

SEQ ID NO: 66362 - DNA, 36 bp, Artificial Sequence
  Synthetic oligonucleotide
tagtggtcgccctctacggtatttctggattttaca

SEQ ID NO: 66363 - DNA, 36 bp, Artificial Sequence
  Synthetic oligonucleotide
gcacccgcaagctgtccgccacccatgcctgcgcca

SEQ ID NO: 66364 - DNA, 36 bp, Artificial Sequence
  Synthetic oligonucleotide
acatgtacgacgcatggcacccgcccggaaactcca

SEQ ID NO: 66365 - DNA, 35 bp, Artificial Sequence
  Synthetic oligonucleotide
gttgggtcactatagccgccgccttaccatttcca

SEQ ID NO: 66366 - DNA, 35 bp, Artificial Sequence
  Synthetic oligonucleotide
ggaggtccggcttgtactcgcgctcttactttcca

SEQ ID NO: 66367 - DNA, 36 bp, Artificial Sequence
  Synthetic oligonucleotide
acagatcgttgtacgggtaccactccttgcccctca

SEQ ID NO: 66368 - DNA, 35 bp, Artificial Sequence
  Synthetic oligonucleotide
accacaccccctcgccaagtactcttacggcctca

SEQ ID NO: 66369 - DNA, 36 bp, Artificial Sequence
  Synthetic oligonucleotide
agatccaccctcttgtaaccatagagagctttctca

SEQ ID NO: 66370 - DNA, 35 bp, Artificial Sequence
  Synthetic oligonucleotide
aacatgcatgcattcattggtcgaccccaacttca

SEQ ID NO: 66371 - DNA, 36 bp, Artificial Sequence
  Synthetic oligonucleotide
gtccaccttatcagctattaactcacaaggttttca

SEQ ID NO: 66372 - DNA, 37 bp, Artificial Sequence
  Synthetic oligonucleotide
ttagcgaagggaggagatgggattccagggcaccaga

SEQ ID NO: 66373 - DNA, 37 bp, Artificial Sequence
  Synthetic oligonucleotide
gatggtcggatggaatcgaagcacggggggagggaga

SEQ ID NO: 66374 - DNA, 37 bp, Artificial Sequence
  Synthetic oligonucleotide
gaagggtggcgaaggcgggccggttttctgagggaga

SEQ ID NO: 66375 - DNA, 36 bp, Artificial Sequence
  Synthetic oligonucleotide
ggtcaggtcctgggggggggagcagggcacggtaga

SEQ ID NO: 66376 - DNA, 37 bp, Artificial Sequence
  Synthetic oligonucleotide
gcccacctctgtctgtcgacgtgtaccgtactgtaga

SEQ ID NO: 66377 - DNA, 37 bp, Artificial Sequence
  Synthetic oligonucleotide
atctccaccacgcatttcgtgttcactgatcttacga

SEQ ID NO: 66378 - DNA, 35 bp, Artificial Sequence
  Synthetic oligonucleotide
aacacgcgacgctttcggtggcccgcactttacga

SEQ ID NO: 66379 - DNA, 37 bp, Artificial Sequence
  Synthetic oligonucleotide
gtaccatcctgttgtgcgtttagtaccacccgtgcga

SEQ ID NO: 66380 - DNA, 37 bp, Artificial Sequence
  Synthetic oligonucleotide
gtatggcaataccctcctctgtctgttacccgctcga

SEQ ID NO: 66381 - DNA, 34 bp, Artificial Sequence
  Synthetic oligonucleotide
gataagcgcctattccattttccctccagttcga

SEQ ID NO: 66382 - DNA, 36 bp, Artificial Sequence
  Synthetic oligonucleotide
aatggagtcagacgtagcgggaactgactttgagga

SEQ ID NO: 66383 - DNA, 36 bp, Artificial Sequence
  Synthetic oligonucleotide
tcgaacgagaggatgtgtggttctcacaaagtagga

SEQ ID NO: 66384 - DNA, 37 bp, Artificial Sequence
  Synthetic oligonucleotide
aacccatcctcatgatcatttgattcgtgtcaacgga

SEQ ID NO: 66385 - DNA, 37 bp, Artificial Sequence
  Synthetic oligonucleotide
ttcgtggggcgggcgtagagaacaatgggattcggga

SEQ ID NO: 66386 - DNA, 35 bp, Artificial Sequence
  Synthetic oligonucleotide
tactcagggcgagggaaggggaatgcattgctgga

SEQ ID NO: 66387 - DNA, 38 bp, Artificial Sequence
  Synthetic oligonucleotide
gatgccgcgagacttgattcgctccttctccacaatga

SEQ ID NO: 66388 - DNA, 38 bp, Artificial Sequence
  Synthetic oligonucleotide
gacgcgggggggatggactgcgggggcgtgtgacatga

SEQ ID NO: 66389 - DNA, 37 bp, Artificial Sequence
  Synthetic oligonucleotide
accgcgcattaccaccttgtgacccatttttgcatga

SEQ ID NO: 66390 - DNA, 38 bp, Artificial Sequence
  Synthetic oligonucleotide
accgcaccatcattcacctgggccgttgtctatcatga

SEQ ID NO: 66391 - DNA, 37 bp, Artificial Sequence
  Synthetic oligonucleotide
tgcaatacgtgaggaggaaaagggatagaatgtatga

SEQ ID NO: 66392 - DNA, 38 bp, Artificial Sequence
  Synthetic oligonucleotide
gttaccgatcatcatgccacctcggaacacctacctga

SEQ ID NO: 66393 - DNA, 37 bp, Artificial Sequence
  Synthetic oligonucleotide
accaccgccctcggctatcaccctcgtctttccctga

SEQ ID NO: 66394 - DNA, 38 bp, Artificial Sequence
  Synthetic oligonucleotide
taccccattccgcccgcaccatcctgagtacgcagtga

SEQ ID NO: 66395 - DNA, 38 bp, Artificial Sequence
  Synthetic oligonucleotide
tacgctaacacacgcaccttagatctagaacggagtga

SEQ ID NO: 66396 - DNA, 37 bp, Artificial Sequence
  Synthetic oligonucleotide
gagcccatcttccgagtattactcactttgaccgtga

SEQ ID NO: 66397 - DNA, 38 bp, Artificial Sequence
  Synthetic oligonucleotide
accccgaacctccacccgcagcgcctgtttttgcgtga

SEQ ID NO: 66398 - DNA, 38 bp, Artificial Sequence
  Synthetic oligonucleotide
tgccaagcccgaccttatgccacattgagctgacttga

SEQ ID NO: 66399 - DNA, 37 bp, Artificial Sequence
  Synthetic oligonucleotide
gacacgggaggtggaacattaaaaacgtgaagcttga

SEQ ID NO: 66400 - DNA, 36 bp, Artificial Sequence
  Synthetic oligonucleotide
gtgctcccgacttcgcctttgccacatattaacata

SEQ ID NO: 66401 - DNA, 36 bp, Artificial Sequence
  Synthetic oligonucleotide
acccccttcaggagctgaccgtccccgctgatccta

SEQ ID NO: 66402 - DNA, 36 bp, Artificial Sequence
  Synthetic oligonucleotide
gttaacacgtggtgcctgccggttcatttctcgcta

SEQ ID NO: 66403 - DNA, 36 bp, Artificial Sequence
  Synthetic oligonucleotide
tgaccggtacgattgaggagaaacggggggtaagta

SEQ ID NO: 66404 - DNA, 36 bp, Artificial Sequence
  Synthetic oligonucleotide
gtcaagttggagggaaggtcctgtaggggtctggta

SEQ ID NO: 66405 - DNA, 36 bp, Artificial Sequence
  Synthetic oligonucleotide
tgccacctttgttagccctgtgcagcctggtaatta

SEQ ID NO: 66406 - DNA, 36 bp, Artificial Sequence
  Synthetic oligonucleotide
tgtttcagccgaatgtcatgaggccctatctcctta

SEQ ID NO: 66407 - DNA, 35 bp, Artificial Sequence
  Synthetic oligonucleotide
aggccacgtgcgccctgcgtgtatccaatctgtta

SEQ ID NO: 66408 - DNA, 35 bp, Artificial Sequence
  Synthetic oligonucleotide
actgaccgctaatatcgacaccccacgccacccac

SEQ ID NO: 66409 - DNA, 35 bp, Artificial Sequence
  Synthetic oligonucleotide
aaacaccgggacccggtctgttatactaccttgac

SEQ ID NO: 66410 - DNA, 35 bp, Artificial Sequence
  Synthetic oligonucleotide
tcacctccctggatgacattaccgtagccgaatac

SEQ ID NO: 66411 - DNA, 35 bp, Artificial Sequence
  Synthetic oligonucleotide
accctgacgaccgtttaaacccggggggcccatac

SEQ ID NO: 66412 - DNA, 35 bp, Artificial Sequence
  Synthetic oligonucleotide
aaccccacaattaatgcagaacgccccgccgatac

SEQ ID NO: 66413 - DNA, 35 bp, Artificial Sequence
  Synthetic oligonucleotide
actcatggactgttcctcatcaggtttactggtac

SEQ ID NO: 66414 - DNA, 35 bp, Artificial Sequence
  Synthetic oligonucleotide
agccgaaaacacacgaaaacttgcctcagtgcacc

SEQ ID NO: 66415 - DNA, 35 bp, Artificial Sequence
  Synthetic oligonucleotide
gtccaaaccgtacactccatattatggatcatacc

SEQ ID NO: 66416 - DNA, 35 bp, Artificial Sequence
  Synthetic oligonucleotide
tcatgactttgcgtaagtgtctttccaccttgccc

SEQ ID NO: 66417 - DNA, 35 bp, Artificial Sequence
  Synthetic oligonucleotide
gaatgaggctaccgaacagcgcaactagcccctcc

SEQ ID NO: 66418 - DNA, 35 bp, Artificial Sequence
  Synthetic oligonucleotide
gcctgccgacccgtaccgtgcgatagacactctcc

SEQ ID NO: 66419 - DNA, 35 bp, Artificial Sequence
  Synthetic oligonucleotide
taagctcactaaaacaccacggctcaccatcacgc

SEQ ID NO: 66420 - DNA, 35 bp, Artificial Sequence
  Synthetic oligonucleotide
accgacggttcagcttaccctttcgatgactccgc

SEQ ID NO: 66421 - DNA, 35 bp, Artificial Sequence
  Synthetic oligonucleotide
gagctcgccttagcttcaccattacgcggactcgc

SEQ ID NO: 66422 - DNA, 35 bp, Artificial Sequence
  Synthetic oligonucleotide
gcgaatcaggcacttgaccccccctattgccatgc

SEQ ID NO: 66423 - DNA, 35 bp, Artificial Sequence
  Synthetic oligonucleotide
gttgttcgaagggtgctgattccccgtgtcccatc

SEQ ID NO: 66424 - DNA, 35 bp, Artificial Sequence
  Synthetic oligonucleotide
ttctggccgcaacctctcttagttccgtgatagtc

SEQ ID NO: 66425 - DNA, 35 bp, Artificial Sequence
  Synthetic oligonucleotide
attcgcacgacgagcaaacgagtgatttttttttc

SEQ ID NO: 66426 - DNA, 35 bp, Artificial Sequence
  Synthetic oligonucleotide
atagacctgcccagcccctctttctcgtttctaag

SEQ ID NO: 66427 - DNA, 35 bp, Artificial Sequence
  Synthetic oligonucleotide
gcccacctcacctcccatgccctccctgtctagag

SEQ ID NO: 66428 - DNA, 35 bp, Artificial Sequence
  Synthetic oligonucleotide
tcctgggagggacgcatcgagcgtgggaggggtag

SEQ ID NO: 66429 - DNA, 35 bp, Artificial Sequence
  Synthetic oligonucleotide
tttaaccacatggcctccgagactacgccataacg

SEQ ID NO: 66430 - DNA, 35 bp, Artificial Sequence
  Synthetic oligonucleotide
atcctcctcacaaggccacaagttattcccaatgg

SEQ ID NO: 66431 - DNA, 35 bp, Artificial Sequence
  Synthetic oligonucleotide
ttacgccacctagaagcgatcgtgtttctcctcat

SEQ ID NO: 66432 - DNA, 35 bp, Artificial Sequence
  Synthetic oligonucleotide
ctttcccgccgccctgtaattggttaccgccacct

SEQ ID NO: 66433 - DNA, 35 bp, Artificial Sequence
  Synthetic oligonucleotide
tccccacccctcacgttcgctatcatagctggcct

SEQ ID NO: 66434 - DNA, 35 bp, Artificial Sequence
  Synthetic oligonucleotide
tcgaggcatcactcacatcgctcctgattctatct

SEQ ID NO: 66435 - DNA, 35 bp, Artificial Sequence
  Synthetic oligonucleotide
agcatacttgcatgtctccccgggcccctcgtagt

SEQ ID NO: 66436 - DNA, 35 bp, Artificial Sequence
  Synthetic oligonucleotide
gactgtcaatctggcctgctgtcccttgcttttgt

SEQ ID NO: 66437 - DNA, 35 bp, Artificial Sequence
  Synthetic oligonucleotide
atgactgccgtaatcggtacacaatttcatttatt

SEQ ID NO: 66438 - DNA, 35 bp, Artificial Sequence
  Synthetic oligonucleotide
gaacaggtgttgtgccctctagttaacatcccctt

SEQ ID NO: 66439 - DNA, 35 bp, Artificial Sequence
  Synthetic oligonucleotide
gagggggcctcgaatcgcgcgattaaaccttcctt

SEQ ID NO: 66440 - DNA, 35 bp, Artificial Sequence
  Synthetic oligonucleotide
ggatcgaagccaatgggcgaacaatcctacacttt

SEQ ID NO: 66441 - DNA, 35 bp, Artificial Sequence
  Synthetic oligonucleotide
tctagctctcacacctggtttccgaaattgatttt

SEQ ID NO: 66442 - DNA, 35 bp, Artificial Sequence
  Synthetic oligonucleotide
gcccgcctccctcatgcgctttttatgaaactaaa

SEQ ID NO: 66443 - DNA, 36 bp, Artificial Sequence
  Synthetic oligonucleotide
gagatcggagggaagccatggacgaatggaaaacaa

SEQ ID NO: 66444 - DNA, 36 bp, Artificial Sequence
  Synthetic oligonucleotide
gagtgcggggtggagaaaaatattaggcagttacaa

SEQ ID NO: 66445 - DNA, 36 bp, Artificial Sequence
  Synthetic oligonucleotide
gcctcccctgcaccatacacccaatgggcttgccaa

SEQ ID NO: 66446 - DNA, 36 bp, Artificial Sequence
  Synthetic oligonucleotide
acgctcctccgcaatgacatccatgggaactatcaa

SEQ ID NO: 66447 - DNA, 35 bp, Artificial Sequence
  Synthetic oligonucleotide
acagccacaaccgaccccacaactgccccagagaa

SEQ ID NO: 66448 - DNA, 36 bp, Artificial Sequence
  Synthetic oligonucleotide
gaacgcttaggcattttgtaggatgggggggctgaa

SEQ ID NO: 66449 - DNA, 36 bp, Artificial Sequence
  Synthetic oligonucleotide
gacgacgagtggggcaaggaagtgagtacacgataa

SEQ ID NO: 66450 - DNA, 36 bp, Artificial Sequence
  Synthetic oligonucleotide
gccatgccgtcgatccgccgagccatcgcaccaaca

SEQ ID NO: 66451 - DNA, 35 bp, Artificial Sequence
  Synthetic oligonucleotide
tagcgtctgccgccattagcgtctttattccacca

SEQ ID NO: 66452 - DNA, 36 bp, Artificial Sequence
  Synthetic oligonucleotide
tgaacacgcgcttcttcccttcatgaggttgcacca

SEQ ID NO: 66453 - DNA, 35 bp, Artificial Sequence
  Synthetic oligonucleotide
accatacggcgaatgcccacaaaccggtttgtcca

SEQ ID NO: 66454 - DNA, 36 bp, Artificial Sequence
  Synthetic oligonucleotide
gcccccaactgtagctacacgccccttatttgcgca

SEQ ID NO: 66455 - DNA, 35 bp, Artificial Sequence
  Synthetic oligonucleotide
gatgcatgcaaacactggtggggtgctcaggatca

SEQ ID NO: 66456 - DNA, 35 bp, Artificial Sequence
  Synthetic oligonucleotide
gcaaatcgtacgaagtccggcccaataccccctca

SEQ ID NO: 66457 - DNA, 35 bp, Artificial Sequence
  Synthetic oligonucleotide
gagcacacggttacaccaccgctttacctatctca

SEQ ID NO: 66458 - DNA, 37 bp, Artificial Sequence
  Synthetic oligonucleotide
atcggatgggacaagggctaaaagggtggacgagaga

SEQ ID NO: 66459 - DNA, 37 bp, Artificial Sequence
  Synthetic oligonucleotide
tcactgcggattggggtggagatgggggaggagtaga

SEQ ID NO: 66460 - DNA, 37 bp, Artificial Sequence
  Synthetic oligonucleotide
tctagtcgcgccaccgccttgccgttcctacgaacga

SEQ ID NO: 66461 - DNA, 37 bp, Artificial Sequence
  Synthetic oligonucleotide
tgcgaccccgctcgagtgcgatccctccccctgccga

SEQ ID NO: 66462 - DNA, 35 bp, Artificial Sequence
  Synthetic oligonucleotide
aacgacggcccaacggggtgtcatcctctttccga

SEQ ID NO: 66463 - DNA, 37 bp, Artificial Sequence
  Synthetic oligonucleotide
acaactggggaagagggtccggaaaagaagacggcga

SEQ ID NO: 66464 - DNA, 36 bp, Artificial Sequence
  Synthetic oligonucleotide
gctgcacggacatcctattcggccaacgttcatcga

SEQ ID NO: 66465 - DNA, 37 bp, Artificial Sequence
  Synthetic oligonucleotide
ggagaacgaggtgaagccggatctggagacaatagga

SEQ ID NO: 66466 - DNA, 37 bp, Artificial Sequence
  Synthetic oligonucleotide
gcaactgaccactccccgtgcaacaccactctgcgga

SEQ ID NO: 66467 - DNA, 36 bp, Artificial Sequence
  Synthetic oligonucleotide
atcagagtggggctgggttcggggggaagaacggga

SEQ ID NO: 66468 - DNA, 35 bp, Artificial Sequence
  Synthetic oligonucleotide
actccccctgcgcaccatcccgttatgatatggga

SEQ ID NO: 66469 - DNA, 37 bp, Artificial Sequence
  Synthetic oligonucleotide
agtacgtcactgcacccgatatgtgctccctcatgga

SEQ ID NO: 66470 - DNA, 37 bp, Artificial Sequence
  Synthetic oligonucleotide
aaccaccgcctaagtttcacgggatctgcctagtgga

SEQ ID NO: 66471 - DNA, 37 bp, Artificial Sequence
  Synthetic oligonucleotide
tccacaatcgccgcgatcccttcatatctcttttgga

SEQ ID NO: 66472 - DNA, 38 bp, Artificial Sequence
  Synthetic oligonucleotide
gccacaacaattttaggactgcacactgcatggaatga

SEQ ID NO: 66473 - DNA, 37 bp, Artificial Sequence
  Synthetic oligonucleotide
tatgacaggccacacaactttgtcattgcactaatga

SEQ ID NO: 66474 - DNA, 37 bp, Artificial Sequence
  Synthetic oligonucleotide
tagtagaacggggattgggagcaatggtaagtaatga

SEQ ID NO: 66475 - DNA, 38 bp, Artificial Sequence
  Synthetic oligonucleotide
ggtacaggtggaggcgggaggacgggtcggcttgatga

SEQ ID NO: 66476 - DNA, 38 bp, Artificial Sequence
  Synthetic oligonucleotide
tgctagccagagacttgcctcattttgtttcatcctga

SEQ ID NO: 66477 - DNA, 38 bp, Artificial Sequence
  Synthetic oligonucleotide
tgcataggtgaagagggagggggggtaaatcgttctga

SEQ ID NO: 66478 - DNA, 37 bp, Artificial Sequence
  Synthetic oligonucleotide
gcatatccgagatgacactcgtatcacccctttctga

SEQ ID NO: 66479 - DNA, 38 bp, Artificial Sequence
  Synthetic oligonucleotide
cccgcaccgaccgacactttgtagctttatctttctga

SEQ ID NO: 66480 - DNA, 38 bp, Artificial Sequence
  Synthetic oligonucleotide
ggttaccggccgggaggaatataggcgagggggagtga

SEQ ID NO: 66481 - DNA, 36 bp, Artificial Sequence
  Synthetic oligonucleotide
acgcgatccatggcgcccctcctctacacatagtga

SEQ ID NO: 66482 - DNA, 37 bp, Artificial Sequence
  Synthetic oligonucleotide
atcacgacggtacctcctcatttctcacctttagtga

SEQ ID NO: 66483 - DNA, 37 bp, Artificial Sequence
  Synthetic oligonucleotide
gtaccgattcgcccaatgattcttcagttccccgtga

SEQ ID NO: 66484 - DNA, 38 bp, Artificial Sequence
  Synthetic oligonucleotide
attggggggggcgaggtggcggaaggatatacaggtga

SEQ ID NO: 66485 - DNA, 38 bp, Artificial Sequence
  Synthetic oligonucleotide
acagatgacacgtgcatcaaggttgggtgtgggggtga

SEQ ID NO: 66486 - DNA, 38 bp, Artificial Sequence
  Synthetic oligonucleotide
actagccaccacagctgccactggtccgaatcacttga

SEQ ID NO: 66487 - DNA, 38 bp, Artificial Sequence
  Synthetic oligonucleotide
tccgccgccggacccctgtttacataattgcgacttga

SEQ ID NO: 66488 - DNA, 38 bp, Artificial Sequence
  Synthetic oligonucleotide
acccccccatccacccaggaaatcacgacgcaggttga

SEQ ID NO: 66489 - DNA, 33 bp, Artificial Sequence
  Synthetic oligonucleotide
tatatccagcgcccccaattgctcttttatcta

SEQ ID NO: 66490 - DNA, 36 bp, Artificial Sequence
  Synthetic oligonucleotide
tttgatctgctaccatcacgtcgtgcccgccctgta

SEQ ID NO: 66491 - DNA, 35 bp, Artificial Sequence
  Synthetic oligonucleotide
ttgtcccagcccatgtgcgattcacaactgctgta

SEQ ID NO: 66492 - DNA, 35 bp, Artificial Sequence
  Synthetic oligonucleotide
gccgattcacatccccgtcttgcctcctgttgcac

SEQ ID NO: 66493 - DNA, 35 bp, Artificial Sequence
  Synthetic oligonucleotide
tgccatgagcctctcatgttgaaccgcactttcac

SEQ ID NO: 66494 - DNA, 35 bp, Artificial Sequence
  Synthetic oligonucleotide
gcaaagggtctcccggcaatgactctatcctcccc

SEQ ID NO: 66495 - DNA, 35 bp, Artificial Sequence
  Synthetic oligonucleotide
ttcacctaacatgtccccgcagatctttgaggtcc

SEQ ID NO: 66496 - DNA, 35 bp, Artificial Sequence
  Synthetic oligonucleotide
ttggacgtgcccggccgttttgtctctctgtttcc

SEQ ID NO: 66497 - DNA, 35 bp, Artificial Sequence
  Synthetic oligonucleotide
gttgcaggagaggatgtacgggcatggggcttagc

SEQ ID NO: 66498 - DNA, 35 bp, Artificial Sequence
  Synthetic oligonucleotide
gaccgtcgcactatttgcttagcctctcttaccgc

SEQ ID NO: 66499 - DNA, 35 bp, Artificial Sequence
  Synthetic oligonucleotide
gactcaatcgcgcgaatgctggagcgtcgcctcgc

SEQ ID NO: 66500 - DNA, 35 bp, Artificial Sequence
  Synthetic oligonucleotide
ttaagaagttagactgcgggggaaggggacggatc

SEQ ID NO: 66501 - DNA, 35 bp, Artificial Sequence
  Synthetic oligonucleotide
ttccttgctcgccgattatccaaccttggcatctc

SEQ ID NO: 66502 - DNA, 35 bp, Artificial Sequence
  Synthetic oligonucleotide
tctcgcccttgctcactattttattgatcctagtc

SEQ ID NO: 66503 - DNA, 35 bp, Artificial Sequence
  Synthetic oligonucleotide
tcctcgcctgggaattgtcatcgtttcacatcttc

SEQ ID NO: 66504 - DNA, 35 bp, Artificial Sequence
  Synthetic oligonucleotide
gaacaagggcggggcgaacatagcaacataaagag

SEQ ID NO: 66505 - DNA, 35 bp, Artificial Sequence
  Synthetic oligonucleotide
tcctacctgaccgctccccctctgcttcccaggag

SEQ ID NO: 66506 - DNA, 35 bp, Artificial Sequence
  Synthetic oligonucleotide
gtgcccacctatcacataaccaccgaacgacctag

SEQ ID NO: 66507 - DNA, 35 bp, Artificial Sequence
  Synthetic oligonucleotide
aacaacgcgtaccgtggagggggtcaatggggagg

SEQ ID NO: 66508 - DNA, 35 bp, Artificial Sequence
  Synthetic oligonucleotide
gatagaatggggctactcgcagaggggggtggggg

SEQ ID NO: 66509 - DNA, 35 bp, Artificial Sequence
  Synthetic oligonucleotide
gccgggaatgctgacgattagggatgggatttggg

SEQ ID NO: 66510 - DNA, 35 bp, Artificial Sequence
  Synthetic oligonucleotide
ggaatgcctcccacacgtttaactctggcctgaat

SEQ ID NO: 66511 - DNA, 35 bp, Artificial Sequence
  Synthetic oligonucleotide
ccaccaccttgtttgtctagactgttctccaccat

SEQ ID NO: 66512 - DNA, 35 bp, Artificial Sequence
  Synthetic oligonucleotide
gggggacgggtcggtagtccgaaaaaattgaggat

SEQ ID NO: 66513 - DNA, 35 bp, Artificial Sequence
  Synthetic oligonucleotide
accgcccccccctcttaaagaccatgctggcacct

SEQ ID NO: 66514 - DNA, 35 bp, Artificial Sequence
  Synthetic oligonucleotide
gccctgccggagtgtcagtctgcgatgctctccct

SEQ ID NO: 66515 - DNA, 35 bp, Artificial Sequence
  Synthetic oligonucleotide
atcgcacacggtcggatatactcacttgtcactct

SEQ ID NO: 66516 - DNA, 34 bp, Artificial Sequence
  Synthetic oligonucleotide
aactgctgctcccttccctgcttctagcgttatt

SEQ ID NO: 66517 - DNA, 35 bp, Artificial Sequence
  Synthetic oligonucleotide
acgcacatcgcccattgcctcatcgtgtttagctt

SEQ ID NO: 66518 - DNA, 35 bp, Artificial Sequence
  Synthetic oligonucleotide
gaatcgccctaatgggaatgtgcctctttatgctt

SEQ ID NO: 66519 - DNA, 35 bp, Artificial Sequence
  Synthetic oligonucleotide
gttccgcccatgacagccttgtcgtaaggcttctt

SEQ ID NO: 66520 - DNA, 35 bp, Artificial Sequence
  Synthetic oligonucleotide
gttagggccggtgcagtctaaagctcaatttggtt

SEQ ID NO: 66521 - DNA, 35 bp, Artificial Sequence
  Synthetic oligonucleotide
gacgacgggggggcatgatttcgggcttataacaa

SEQ ID NO: 66522 - DNA, 36 bp, Artificial Sequence
  Synthetic oligonucleotide
gaaccgatccagctgtcacttctttaactctcggaa

SEQ ID NO: 66523 - DNA, 35 bp, Artificial Sequence
  Synthetic oligonucleotide
atcaggctgggcgggataggggggggggtaactaa

SEQ ID NO: 66524 - DNA, 35 bp, Artificial Sequence
  Synthetic oligonucleotide
tatccttacacccccatgcctatctagacagctaa

SEQ ID NO: 66525 - DNA, 36 bp, Artificial Sequence
  Synthetic oligonucleotide
acctatagctgccaactcgcgaccatccgttccaca

SEQ ID NO: 66526 - DNA, 36 bp, Artificial Sequence
  Synthetic oligonucleotide
gcgtcgacaatccgcacctggacctctgaccgccca

SEQ ID NO: 66527 - DNA, 35 bp, Artificial Sequence
  Synthetic oligonucleotide
tgataccgacctcacgcttcataacacctgatcca

SEQ ID NO: 66528 - DNA, 35 bp, Artificial Sequence
  Synthetic oligonucleotide
tcgactcacgtactgtgtacccttcaattctctca

SEQ ID NO: 66529 - DNA, 36 bp, Artificial Sequence
  Synthetic oligonucleotide
ccctgtccgcaatcgcctcctaacactcctggttca

SEQ ID NO: 66530 - DNA, 36 bp, Artificial Sequence
  Synthetic oligonucleotide
acacgacttcactaggtgggtctgttccttctttca

SEQ ID NO: 66531 - DNA, 36 bp, Artificial Sequence
  Synthetic oligonucleotide
ttattcccgccattgctgctaagccatgaattttca

SEQ ID NO: 66532 - DNA, 37 bp, Artificial Sequence
  Synthetic oligonucleotide
atggggccatggtggagaaaataaaggtcaaaacaga

SEQ ID NO: 66533 - DNA, 36 bp, Artificial Sequence
  Synthetic oligonucleotide
tgccacgatgggcagtggtaggagggaatcagcaga

SEQ ID NO: 66534 - DNA, 37 bp, Artificial Sequence
  Synthetic oligonucleotide
tagtgcggaccgtggatgaagggtgtgtagcaggaga

SEQ ID NO: 66535 - DNA, 36 bp, Artificial Sequence
  Synthetic oligonucleotide
tagtcctacccacgctcgaaccacgatttccaacga

SEQ ID NO: 66536 - DNA, 37 bp, Artificial Sequence
  Synthetic oligonucleotide
tgccattcgattagaatatatcggttcctgcccccga

SEQ ID NO: 66537 - DNA, 37 bp, Artificial Sequence
  Synthetic oligonucleotide
actaataacaccgcagccgtttccgcacgcatgccga

SEQ ID NO: 66538 - DNA, 36 bp, Artificial Sequence
  Synthetic oligonucleotide
acaacgcaccgcttacacatacgaacgactcatcga

SEQ ID NO: 66539 - DNA, 37 bp, Artificial Sequence
  Synthetic oligonucleotide
agcgaaagtaccggtggatggactggggggatatcga

SEQ ID NO: 66540 - DNA, 37 bp, Artificial Sequence
  Synthetic oligonucleotide
tgcacacggatccagcctggtctgcacctcctatcga

SEQ ID NO: 66541 - DNA, 37 bp, Artificial Sequence
  Synthetic oligonucleotide
tgacacatagcaaggaaggagaggcgaacattatcga

SEQ ID NO: 66542 - DNA, 37 bp, Artificial Sequence
  Synthetic oligonucleotide
gtatcccgcctccttagtagccactcctggaattcga

SEQ ID NO: 66543 - DNA, 37 bp, Artificial Sequence
  Synthetic oligonucleotide
gcgcgatcaatgtggcgcgcacgcccgtgttgttcga

SEQ ID NO: 66544 - DNA, 37 bp, Artificial Sequence
  Synthetic oligonucleotide
aaaccgccttaagttcgcctcgcccctgccttttcga

SEQ ID NO: 66545 - DNA, 36 bp, Artificial Sequence
  Synthetic oligonucleotide
atcacatcccacgccccgctcgtacgaaatatcgga

SEQ ID NO: 66546 - DNA, 37 bp, Artificial Sequence
  Synthetic oligonucleotide
tttgaccggtgggtgggacaagcaagaaggcacggga

SEQ ID NO: 66547 - DNA, 37 bp, Artificial Sequence
  Synthetic oligonucleotide
gttgaccgcctgctgctgcctccttgcgtactatgga

SEQ ID NO: 66548 - DNA, 37 bp, Artificial Sequence
  Synthetic oligonucleotide
taccaccctgcggcggtttagttatcttccctcatga

SEQ ID NO: 66549 - DNA, 38 bp, Artificial Sequence
  Synthetic oligonucleotide
agtcggagtgagggaggaaaagaattggacgacgatga

SEQ ID NO: 66550 - DNA, 38 bp, Artificial Sequence
  Synthetic oligonucleotide
gtgtgtagcccttcttgccttaactgacgtgcctatga

SEQ ID NO: 66551 - DNA, 38 bp, Artificial Sequence
  Synthetic oligonucleotide
aagacgtacaggggcgggggagcgatttgccatactga

SEQ ID NO: 66552 - DNA, 38 bp, Artificial Sequence
  Synthetic oligonucleotide
ttggccttctcacacaggtgtacccactcctctactga

SEQ ID NO: 66553 - DNA, 35 bp, Artificial Sequence
  Synthetic oligonucleotide
agccagtgacgcttttgtcccgtacactttcctga

SEQ ID NO: 66554 - DNA, 37 bp, Artificial Sequence
  Synthetic oligonucleotide
tcatggacagactcatccgttttcaccgcacctctga

SEQ ID NO: 66555 - DNA, 37 bp, Artificial Sequence
  Synthetic oligonucleotide
aaaggacgaggggtggaggttcgaaaggcaacagtga

SEQ ID NO: 66556 - DNA, 38 bp, Artificial Sequence
  Synthetic oligonucleotide
tggttaaccaccatctaagcacctctcacaccccgtga

SEQ ID NO: 66557 - DNA, 38 bp, Artificial Sequence
  Synthetic oligonucleotide
gaagtggagatacgcaaaaaaggggggcattccggtga

SEQ ID NO: 66558 - DNA, 38 bp, Artificial Sequence
  Synthetic oligonucleotide
acatcgcgaggagggccgggtgatactcactaaattga

SEQ ID NO: 66559 - DNA, 36 bp, Artificial Sequence
  Synthetic oligonucleotide
atgcgggaagggggccgggatacgcatacggattga

SEQ ID NO: 66560 - DNA, 37 bp, Artificial Sequence
  Synthetic oligonucleotide
tacgccggtccgcttcccgttttttggctacacttga

SEQ ID NO: 66561 - DNA, 38 bp, Artificial Sequence
  Synthetic oligonucleotide
gggaagtctgtccgcttctgcccatccacttcgcttga

SEQ ID NO: 66562 - DNA, 38 bp, Artificial Sequence
  Synthetic oligonucleotide
gcaacgatcgtatctcgattgggtgtagttacttttga

SEQ ID NO: 66563 - DNA, 36 bp, Artificial Sequence
  Synthetic oligonucleotide
acacctccctacgaacgggtaatttgtacacgaata

SEQ ID NO: 66564 - DNA, 35 bp, Artificial Sequence
  Synthetic oligonucleotide
gtcatcctccttacacgcaaggccgttttgtccta

SEQ ID NO: 66565 - DNA, 36 bp, Artificial Sequence
  Synthetic oligonucleotide
aatcagccccacccctctcaatgttagaaacacgta

SEQ ID NO: 66566 - DNA, 36 bp, Artificial Sequence
  Synthetic oligonucleotide
aactaaccgacctgccatcgtatgtatcttgctgta

SEQ ID NO: 66567 - DNA, 35 bp, Artificial Sequence
  Synthetic oligonucleotide
accgccggacctctcacttgttgattcgtgttgta

SEQ ID NO: 66568 - DNA, 35 bp, Artificial Sequence
  Synthetic oligonucleotide
tacatcccattggaatgacctgtgaacatacatta

SEQ ID NO: 66569 - DNA, 35 bp, Artificial Sequence
  Synthetic oligonucleotide
tgacgcgcctcacactcctgtagcacttggtaaac

SEQ ID NO: 66570 - DNA, 35 bp, Artificial Sequence
  Synthetic oligonucleotide
gactcattcccttacgagggcgactcgccacatac

SEQ ID NO: 66571 - DNA, 35 bp, Artificial Sequence
  Synthetic oligonucleotide
tagcggtcataccatgctccccgttgtcccaaacc

SEQ ID NO: 66572 - DNA, 35 bp, Artificial Sequence
  Synthetic oligonucleotide
gtgttgccggaactcgtcttcgcctatagtccccc

SEQ ID NO: 66573 - DNA, 35 bp, Artificial Sequence
  Synthetic oligonucleotide
accgcctcagtccctcctgtaccctgagcctatcc

SEQ ID NO: 66574 - DNA, 35 bp, Artificial Sequence
  Synthetic oligonucleotide
tccacgccgctcctgcaccgagttacgccttacgc

SEQ ID NO: 66575 - DNA, 35 bp, Artificial Sequence
  Synthetic oligonucleotide
gcgtgcacttacctgacatatatccctgttgcatc

SEQ ID NO: 66576 - DNA, 35 bp, Artificial Sequence
  Synthetic oligonucleotide
gcgaacgtcgctttatcctgaccacatgtatgatc

SEQ ID NO: 66577 - DNA, 35 bp, Artificial Sequence
  Synthetic oligonucleotide
tgctactcctaccatcggaagggtgtttccccctc

SEQ ID NO: 66578 - DNA, 35 bp, Artificial Sequence
  Synthetic oligonucleotide
gaactaggcgccgaagtcctctggctgaactcctc

SEQ ID NO: 66579 - DNA, 35 bp, Artificial Sequence
  Synthetic oligonucleotide
gagtgctgccttttcttcgtcgctctcttccggtc

SEQ ID NO: 66580 - DNA, 35 bp, Artificial Sequence
  Synthetic oligonucleotide
ttacccgcacacatcactcaagctgcaatatattc

SEQ ID NO: 66581 - DNA, 35 bp, Artificial Sequence
  Synthetic oligonucleotide
accacgaagggcgttacactcgattatcaccgttc

SEQ ID NO: 66582 - DNA, 35 bp, Artificial Sequence
  Synthetic oligonucleotide
acacctgaccccgggctatctcacctcaaatgacg

SEQ ID NO: 66583 - DNA, 35 bp, Artificial Sequence
  Synthetic oligonucleotide
tgttcctcctgcatataaaaggcctcatatctacg

SEQ ID NO: 66584 - DNA, 35 bp, Artificial Sequence
  Synthetic oligonucleotide
gaacgggacgctggtggtagttagtggatgttacg

SEQ ID NO: 66585 - DNA, 36 bp, Artificial Sequence
  Synthetic oligonucleotide
tccccctccggcccactgctaaaaaatacaaccccg

SEQ ID NO: 66586 - DNA, 35 bp, Artificial Sequence
  Synthetic oligonucleotide
gtgtgaccgccaccgatcaacgtgcgcattcgccg

SEQ ID NO: 66587 - DNA, 35 bp, Artificial Sequence
  Synthetic oligonucleotide
ttccctgggcgctatgtccactccgcttggttccg

SEQ ID NO: 66588 - DNA, 35 bp, Artificial Sequence
  Synthetic oligonucleotide
aaagtgctaatgggatggaggcggagtggggaagg

SEQ ID NO: 66589 - DNA, 35 bp, Artificial Sequence
  Synthetic oligonucleotide
acatatcgtggccccgctcttgtagtccccccatg

SEQ ID NO: 66590 - DNA, 35 bp, Artificial Sequence
  Synthetic oligonucleotide
agcccaacagggtaccatgcccgctcttcccagtg

SEQ ID NO: 66591 - DNA, 35 bp, Artificial Sequence
  Synthetic oligonucleotide
aacaccagcgcgcttctcttgttcacgaaatagtg

SEQ ID NO: 66592 - DNA, 35 bp, Artificial Sequence
  Synthetic oligonucleotide
tacctgctccggtcatctgacttgcttttctcgtg

SEQ ID NO: 66593 - DNA, 35 bp, Artificial Sequence
  Synthetic oligonucleotide
gacgaaggatggagaaaagcgtgagaggcgcggtg

SEQ ID NO: 66594 - DNA, 35 bp, Artificial Sequence
  Synthetic oligonucleotide
gcctagggcgatctatggcacctattctatctttg

SEQ ID NO: 66595 - DNA, 32 bp, Artificial Sequence
  Synthetic oligonucleotide
gacgacgctcctttccctgcacgcgctctaat

SEQ ID NO: 66596 - DNA, 35 bp, Artificial Sequence
  Synthetic oligonucleotide
tgtacggtcccgccctttgttgagcaacccaaact

SEQ ID NO: 66597 - DNA, 35 bp, Artificial Sequence
  Synthetic oligonucleotide
acactgtccccgaggctgggcactatccactgact

SEQ ID NO: 66598 - DNA, 35 bp, Artificial Sequence
  Synthetic oligonucleotide
gacgtgtatcatgtccatatccgctgtactctact

SEQ ID NO: 66599 - DNA, 35 bp, Artificial Sequence
  Synthetic oligonucleotide
gcacttatgccaggtccccctcaaccccgtttact

SEQ ID NO: 66600 - DNA, 35 bp, Artificial Sequence
  Synthetic oligonucleotide
atttgtgcgcgcgaccgtcatgtactgccacacct

SEQ ID NO: 66601 - DNA, 35 bp, Artificial Sequence
  Synthetic oligonucleotide
gatgctccctctatattcatacgcggcctatacct

SEQ ID NO: 66602 - DNA, 35 bp, Artificial Sequence
  Synthetic oligonucleotide
atctagaggcacaggccccttcaccaccgcccgct

SEQ ID NO: 66603 - DNA, 35 bp, Artificial Sequence
  Synthetic oligonucleotide
actggccgatgctattggctttatcagttccctct

SEQ ID NO: 66604 - DNA, 35 bp, Artificial Sequence
  Synthetic oligonucleotide
gagttggtcagacaacctttacttctgtatgctct

SEQ ID NO: 66605 - DNA, 35 bp, Artificial Sequence
  Synthetic oligonucleotide
gtccagggaggggtgattactcgggaatggagtct

SEQ ID NO: 66606 - DNA, 35 bp, Artificial Sequence
  Synthetic oligonucleotide
agctgcaccggccgcgccttcacacttgtctgtct

SEQ ID NO: 66607 - DNA, 35 bp, Artificial Sequence
  Synthetic oligonucleotide
gattcggggcaagagaggagtatgaaatggagcgt

SEQ ID NO: 66608 - DNA, 35 bp, Artificial Sequence
  Synthetic oligonucleotide
ttttgccccctcgacgacatgccacgcgacggcgt

SEQ ID NO: 66609 - DNA, 36 bp, Artificial Sequence
  Synthetic oligonucleotide
gacatcacgcacaattatgacgaccaagaagcctgt

SEQ ID NO: 66610 - DNA, 35 bp, Artificial Sequence
  Synthetic oligonucleotide
tctcggctggccacgctcactccccatagtcctgt

SEQ ID NO: 66611 - DNA, 35 bp, Artificial Sequence
  Synthetic oligonucleotide
tgcgccatacctccatcgcgggtaccttctttatt

SEQ ID NO: 66612 - DNA, 35 bp, Artificial Sequence
  Synthetic oligonucleotide
gatccaccgcactactgaacactaaccagtcactt

SEQ ID NO: 66613 - DNA, 35 bp, Artificial Sequence
  Synthetic oligonucleotide
taccccgcgcgtggccagcaagtccgttaaatttt

SEQ ID NO: 66614 - DNA, 35 bp, Artificial Sequence
  Synthetic oligonucleotide
gtccctcagtcctatgaactcattctcactgcaaa

SEQ ID NO: 66615 - DNA, 34 bp, Artificial Sequence
  Synthetic oligonucleotide
actgggcgaggagggaaaggtggagggggtcaaa

SEQ ID NO: 66616 - DNA, 36 bp, Artificial Sequence
  Synthetic oligonucleotide
tgagaacgggggggtgaccaacataggtaatataaa

SEQ ID NO: 66617 - DNA, 36 bp, Artificial Sequence
  Synthetic oligonucleotide
tcccagccaatttagctaccctcgcatctgggccaa

SEQ ID NO: 66618 - DNA, 36 bp, Artificial Sequence
  Synthetic oligonucleotide
tacgctccccatgctgcgtgccctcgaatcaagcaa

SEQ ID NO: 66619 - DNA, 35 bp, Artificial Sequence
  Synthetic oligonucleotide
atggaatgaagctggaataggtaaggtggggagaa

SEQ ID NO: 66620 - DNA, 36 bp, Artificial Sequence
  Synthetic oligonucleotide
tcattatgcccccccgattgtaccttgtccatagaa

SEQ ID NO: 66621 - DNA, 35 bp, Artificial Sequence
  Synthetic oligonucleotide
catcactgaagactaccgtatagcacgagctataa

SEQ ID NO: 66622 - DNA, 35 bp, Artificial Sequence
  Synthetic oligonucleotide
tgtcccccatcagcccgtccgtattggccttataa

SEQ ID NO: 66623 - DNA, 35 bp, Artificial Sequence
  Synthetic oligonucleotide
gccctgcccccgccagtccgaatcacaccaactaa

SEQ ID NO: 66624 - DNA, 35 bp, Artificial Sequence
  Synthetic oligonucleotide
gcctacctctctgaagttcacgacctctaccttaa

SEQ ID NO: 66625 - DNA, 36 bp, Artificial Sequence
  Synthetic oligonucleotide
tgacaacgcaatccagcatccccgcatcaatccaca

SEQ ID NO: 66626 - DNA, 35 bp, Artificial Sequence
  Synthetic oligonucleotide
gactcccttctaggctccataaaagctgagcacca

SEQ ID NO: 66627 - DNA, 36 bp, Artificial Sequence
  Synthetic oligonucleotide
acagtctcctctccagtgcccactggccgaagccca

SEQ ID NO: 66628 - DNA, 36 bp, Artificial Sequence
  Synthetic oligonucleotide
tgattcatcccatgttccttttttccgatgacgcca

SEQ ID NO: 66629 - DNA, 35 bp, Artificial Sequence
  Synthetic oligonucleotide
tgacattgcgttgtccgtccttatcacatacgcca

SEQ ID NO: 66630 - DNA, 36 bp, Artificial Sequence
  Synthetic oligonucleotide
acacccatcctatggattttgtagccttccgctcca

SEQ ID NO: 66631 - DNA, 36 bp, Artificial Sequence
  Synthetic oligonucleotide
gtcgttgcctaacccctattgaatttggcctctcca

SEQ ID NO: 66632 - DNA, 35 bp, Artificial Sequence
  Synthetic oligonucleotide
gttccaacccaattgctcagggccttgaaattcca

SEQ ID NO: 66633 - DNA, 36 bp, Artificial Sequence
  Synthetic oligonucleotide
gtcccccatacactgcctcttgagtgtgttcccgca

SEQ ID NO: 66634 - DNA, 36 bp, Artificial Sequence
  Synthetic oligonucleotide
acatacctcaataggccgaaaggacacggacttgca

SEQ ID NO: 66635 - DNA, 36 bp, Artificial Sequence
  Synthetic oligonucleotide
gttgcccaacacttgacggaccggtgtactcgctca

SEQ ID NO: 66636 - DNA, 35 bp, Artificial Sequence
  Synthetic oligonucleotide
acgctcattgccggagcctactgtttcacacttca

SEQ ID NO: 66637 - DNA, 35 bp, Artificial Sequence
  Synthetic oligonucleotide
atgctacctcctatgcgaccactatgactttttca

SEQ ID NO: 66638 - DNA, 37 bp, Artificial Sequence
  Synthetic oligonucleotide
agggggtggggcggtaaggttgcggcgcgtgaaaaga

SEQ ID NO: 66639 - DNA, 37 bp, Artificial Sequence
  Synthetic oligonucleotide
agcatgaagttgagaaggcggacggggcacggaaaga

SEQ ID NO: 66640 - DNA, 37 bp, Artificial Sequence
  Synthetic oligonucleotide
tagtggcaatggtgcggagggaacaggtaaaggcaga

SEQ ID NO: 66641 - DNA, 37 bp, Artificial Sequence
  Synthetic oligonucleotide
accactcgcgaacaggaaaggagggattactctgaga

SEQ ID NO: 66642 - DNA, 37 bp, Artificial Sequence
  Synthetic oligonucleotide
tctaccggccatccgcctgcataccatcggttataga

SEQ ID NO: 66643 - DNA, 35 bp, Artificial Sequence
  Synthetic oligonucleotide
tagcgccctcagtgccttttcccgtttgagttaga

SEQ ID NO: 66644 - DNA, 36 bp, Artificial Sequence
  Synthetic oligonucleotide
gcacgtggttcaatccactccgactctttgacacga

SEQ ID NO: 66645 - DNA, 37 bp, Artificial Sequence
  Synthetic oligonucleotide
aaccgccaccgcgcaatcctcctttgagttcctacga

SEQ ID NO: 66646 - DNA, 37 bp, Artificial Sequence
  Synthetic oligonucleotide
atgtccgcctcgcgatactgtgacggccccctaccga

SEQ ID NO: 66647 - DNA, 36 bp, Artificial Sequence
  Synthetic oligonucleotide
atacatgggcccctccccacccaactcggatcccga

SEQ ID NO: 66648 - DNA, 37 bp, Artificial Sequence
  Synthetic oligonucleotide
gcgtatccgcctatgtagcacttgctgccactcccga

SEQ ID NO: 66649 - DNA, 37 bp, Artificial Sequence
  Synthetic oligonucleotide
tgcctacaaagatcagtgcctccccctgtgccgccga

SEQ ID NO: 66650 - DNA, 35 bp, Artificial Sequence
  Synthetic oligonucleotide
gcctatgcctccaagtcaactatagcatcgatcga

SEQ ID NO: 66651 - DNA, 37 bp, Artificial Sequence
  Synthetic oligonucleotide
gtggtcgctccctctgctaaattgccgttgactagga

SEQ ID NO: 66652 - DNA, 36 bp, Artificial Sequence
  Synthetic oligonucleotide
taaagggtggagaaagcactacatgtgggaggggga

SEQ ID NO: 66653 - DNA, 37 bp, Artificial Sequence
  Synthetic oligonucleotide
tcactagtagggtggatacgtgattgtgggggtggga

SEQ ID NO: 66654 - DNA, 37 bp, Artificial Sequence
  Synthetic oligonucleotide
gaacgcgaactgcactttatcaaccctctctactgga

SEQ ID NO: 66655 - DNA, 35 bp, Artificial Sequence
  Synthetic oligonucleotide
gaaagctacccccccttacgcgtatcgcgcctgga

SEQ ID NO: 66656 - DNA, 38 bp, Artificial Sequence
  Synthetic oligonucleotide
gacatgacagctggagtctttacagggagtccatatga

SEQ ID NO: 66657 - DNA, 37 bp, Artificial Sequence
  Synthetic oligonucleotide
gtgcacaggcacctacacccatccgctgtcggtatga

SEQ ID NO: 66658 - DNA, 36 bp, Artificial Sequence
  Synthetic oligonucleotide
ttacgtttaccccatccgcccatcgtatcacactga

SEQ ID NO: 66659 - DNA, 37 bp, Artificial Sequence
  Synthetic oligonucleotide
ggtcgggcgggcgggaaaacggggcatcaagtactga

SEQ ID NO: 66660 - DNA, 36 bp, Artificial Sequence
  Synthetic oligonucleotide
aacacctgcaatgccggtcacattagtactccctga

SEQ ID NO: 66661 - DNA, 38 bp, Artificial Sequence
  Synthetic oligonucleotide
ttccctgtcaggggctacctccgcgcccagttccctga

SEQ ID NO: 66662 - DNA, 37 bp, Artificial Sequence
  Synthetic oligonucleotide
gatctcaccgtgtcaatgatcctgccgtttcgcctga

SEQ ID NO: 66663 - DNA, 37 bp, Artificial Sequence
  Synthetic oligonucleotide
gcatcccctccattggcgcataattagtgacccgtga

SEQ ID NO: 66664 - DNA, 38 bp, Artificial Sequence
  Synthetic oligonucleotide
tgcgtgggggggcgaagatgatgcaggggcgatcgtga

SEQ ID NO: 66665 - DNA, 38 bp, Artificial Sequence
  Synthetic oligonucleotide
tggacatgcctactataccctttcccccagacaggtga

SEQ ID NO: 66666 - DNA, 38 bp, Artificial Sequence
  Synthetic oligonucleotide
tgaagggagcgggccacgtcgtttagcagggagggtga

SEQ ID NO: 66667 - DNA, 38 bp, Artificial Sequence
  Synthetic oligonucleotide
tccacgctgccccaatttgcttattcacaagtttgtga

SEQ ID NO: 66668 - DNA, 35 bp, Artificial Sequence
  Synthetic oligonucleotide
acctgagacatccccccgtgcacttccgacattga

SEQ ID NO: 66669 - DNA, 36 bp, Artificial Sequence
  Synthetic oligonucleotide
ttgatggtgcacgcgagtaaaccgtatttccttata

SEQ ID NO: 66670 - DNA, 36 bp, Artificial Sequence
  Synthetic oligonucleotide
gtaggccattaggtaaagtccacgtctcttctccta

SEQ ID NO: 66671 - DNA, 35 bp, Artificial Sequence
  Synthetic oligonucleotide
accatgtgctccgtctgctcacgactcttatgcta

SEQ ID NO: 66672 - DNA, 35 bp, Artificial Sequence
  Synthetic oligonucleotide
gccaccccgcaaatgtccatttgttcgaacatcta

SEQ ID NO: 66673 - DNA, 36 bp, Artificial Sequence
  Synthetic oligonucleotide
acaatcacgccggctaagggtgcatgtccatccgta

SEQ ID NO: 66674 - DNA, 36 bp, Artificial Sequence
  Synthetic oligonucleotide
tttgcccagaagctagtgtgcactatccattccgta

SEQ ID NO: 66675 - DNA, 36 bp, Artificial Sequence
  Synthetic oligonucleotide
gctgagcgaaccctgcgctgaccgtgtcgctcctta

SEQ ID NO: 66676 - DNA, 36 bp, Artificial Sequence
  Synthetic oligonucleotide
tgacaacgcgtaaccctcgcgcacgaaatgctttta

SEQ ID NO: 66677 - DNA, 36 bp, Artificial Sequence
  Synthetic oligonucleotide
gatcacccgacctttgaaagtcgccccaagttttta

SEQ ID NO: 66678 - DNA, 35 bp, Artificial Sequence
  Synthetic oligonucleotide
tgatcggccatctgtagggcgatcgaactctcaac

SEQ ID NO: 66679 - DNA, 35 bp, Artificial Sequence
  Synthetic oligonucleotide
tcgtggggaccccacatcttcccttcacccgacac

SEQ ID NO: 66680 - DNA, 35 bp, Artificial Sequence
  Synthetic oligonucleotide
tcctgcacgcacgaccggcgtcgtttactctctac

SEQ ID NO: 66681 - DNA, 35 bp, Artificial Sequence
  Synthetic oligonucleotide
gaatgccggacataccccctgggtcgactctgtac

SEQ ID NO: 66682 - DNA, 35 bp, Artificial Sequence
  Synthetic oligonucleotide
tttgaccgcggaaacgtgcgttgatttttctcccc

SEQ ID NO: 66683 - DNA, 35 bp, Artificial Sequence
  Synthetic oligonucleotide
tcatttgtcacacgcaccacttagtcgtcctagcc

SEQ ID NO: 66684 - DNA, 35 bp, Artificial Sequence
  Synthetic oligonucleotide
gtgctgagtagctttctccctctcgaggcactgcc

SEQ ID NO: 66685 - DNA, 35 bp, Artificial Sequence
  Synthetic oligonucleotide
tagacaagtgcggtcatcgtaagcgtggatgctcc

SEQ ID NO: 66686 - DNA, 35 bp, Artificial Sequence
  Synthetic oligonucleotide
tatgtgctaaccacctgccctgatccggaccgagc

SEQ ID NO: 66687 - DNA, 35 bp, Artificial Sequence
  Synthetic oligonucleotide
tcaagggcggtgtgatccagcaacattcacttcgc

SEQ ID NO: 66688 - DNA, 35 bp, Artificial Sequence
  Synthetic oligonucleotide
gtggctagtgcccgtttcctctacgttcgcttcgc

SEQ ID NO: 66689 - DNA, 35 bp, Artificial Sequence
  Synthetic oligonucleotide
tacacactcgagataccttgccactgctcgtttgc

SEQ ID NO: 66690 - DNA, 35 bp, Artificial Sequence
  Synthetic oligonucleotide
ttgtccccgtgtcattgcattaacccctcactgtc

SEQ ID NO: 66691 - DNA, 35 bp, Artificial Sequence
  Synthetic oligonucleotide
tgccactttactgttacgctggctcgtcctgcccg

SEQ ID NO: 66692 - DNA, 35 bp, Artificial Sequence
  Synthetic oligonucleotide
ttacgccgcctacaaacgtcgattattaccccgcg

SEQ ID NO: 66693 - DNA, 35 bp, Artificial Sequence
  Synthetic oligonucleotide
gtcgctgctaatcgactattcctcccgttctcagg

SEQ ID NO: 66694 - DNA, 35 bp, Artificial Sequence
  Synthetic oligonucleotide
aatgtggggacgacgataaaaatggagctgtatgg

SEQ ID NO: 66695 - DNA, 35 bp, Artificial Sequence
  Synthetic oligonucleotide
ttcacactatccccacgcagcacttttgacgtatg

SEQ ID NO: 66696 - DNA, 35 bp, Artificial Sequence
  Synthetic oligonucleotide
gaacatccttggccctggtttcgtttctgctgctg

SEQ ID NO: 66697 - DNA, 35 bp, Artificial Sequence
  Synthetic oligonucleotide
gtctcagatgcgcttctacttctctatctaccgtg

SEQ ID NO: 66698 - DNA, 35 bp, Artificial Sequence
  Synthetic oligonucleotide
tgagcattcgtttgtcccacctaccggcccctgtg

SEQ ID NO: 66699 - DNA, 35 bp, Artificial Sequence
  Synthetic oligonucleotide
gaaaggaaagagagccaagggagaggtgatgtttg

SEQ ID NO: 66700 - DNA, 35 bp, Artificial Sequence
  Synthetic oligonucleotide
gacgaccacaaccccaccgggagtacgcgaaccat

SEQ ID NO: 66701 - DNA, 35 bp, Artificial Sequence
  Synthetic oligonucleotide
taaggagtgaggatatgggggaaagtggtaagcat

SEQ ID NO: 66702 - DNA, 35 bp, Artificial Sequence
  Synthetic oligonucleotide
tactcgcagtcctttaacaccctgatcccctcact

SEQ ID NO: 66703 - DNA, 35 bp, Artificial Sequence
  Synthetic oligonucleotide
accccatacccagctgttgggtatgtttccaacct

SEQ ID NO: 66704 - DNA, 35 bp, Artificial Sequence
  Synthetic oligonucleotide
atagctccgctgacgccttcgttccgcctccacct

SEQ ID NO: 66705 - DNA, 35 bp, Artificial Sequence
  Synthetic oligonucleotide
gtctggcttacccctggttcttggacatctatcct

SEQ ID NO: 66706 - DNA, 35 bp, Artificial Sequence
  Synthetic oligonucleotide
gtcattcccccagagggcactgccaccccatcgct

SEQ ID NO: 66707 - DNA, 35 bp, Artificial Sequence
  Synthetic oligonucleotide
tgttgggccggtctgattttctcgtgcctttccgt

SEQ ID NO: 66708 - DNA, 35 bp, Artificial Sequence
  Synthetic oligonucleotide
gcacgttcgcccaccgagtcatctattcccccatt

SEQ ID NO: 66709 - DNA, 35 bp, Artificial Sequence
  Synthetic oligonucleotide
gcatcacgcccttttttgtcgtcgtggtacgcatt

SEQ ID NO: 66710 - DNA, 35 bp, Artificial Sequence
  Synthetic oligonucleotide
tccagacagtcggactcgaggtcatggcatctctt

SEQ ID NO: 66711 - DNA, 35 bp, Artificial Sequence
  Synthetic oligonucleotide
atcaaaggctgctcagccacttttttcttgccttt

SEQ ID NO: 66712 - DNA, 35 bp, Artificial Sequence
  Synthetic oligonucleotide
tgtacatcaccagccttgggccctcgatcgagttt

SEQ ID NO: 66713 - DNA, 36 bp, Artificial Sequence
  Synthetic oligonucleotide
aaccgtagccgcttagcttttttgcacgacaccaaa

SEQ ID NO: 66714 - DNA, 36 bp, Artificial Sequence
  Synthetic oligonucleotide
attggcacccccgccgatgatccctgtttgcaccaa

SEQ ID NO: 66715 - DNA, 35 bp, Artificial Sequence
  Synthetic oligonucleotide
ggacacgacacggccactcggtgctgatacctcaa

SEQ ID NO: 66716 - DNA, 35 bp, Artificial Sequence
  Synthetic oligonucleotide
gggggatgggaaagatgttgggtgcgggaggtcaa

SEQ ID NO: 66717 - DNA, 36 bp, Artificial Sequence
  Synthetic oligonucleotide
tgccacgaccgaaacttatatccgctgctgcacaca

SEQ ID NO: 66718 - DNA, 36 bp, Artificial Sequence
  Synthetic oligonucleotide
aatccctggcctccttcaacgcacgttccagacaca

SEQ ID NO: 66719 - DNA, 36 bp, Artificial Sequence
  Synthetic oligonucleotide
gctgatgctactaacgccggtccgagccccaaacca

SEQ ID NO: 66720 - DNA, 36 bp, Artificial Sequence
  Synthetic oligonucleotide
atccgcggccccatagctctacattgccccgtccca

SEQ ID NO: 66721 - DNA, 36 bp, Artificial Sequence
  Synthetic oligonucleotide
tcctccgcacttttgacagctccccgcattttccca

SEQ ID NO: 66722 - DNA, 32 bp, Artificial Sequence
  Synthetic oligonucleotide
gtacctgggtccccgtccgtccctcatggcca

SEQ ID NO: 66723 - DNA, 35 bp, Artificial Sequence
  Synthetic oligonucleotide
agttcccacgcgcgaagtccgttctcgctgatcca

SEQ ID NO: 66724 - DNA, 36 bp, Artificial Sequence
  Synthetic oligonucleotide
gcatgatgcctgaggtctcaactgcctgactttcca

SEQ ID NO: 66725 - DNA, 35 bp, Artificial Sequence
  Synthetic oligonucleotide
actctaactcaccgttattaatgtctgctatctca

SEQ ID NO: 66726 - DNA, 36 bp, Artificial Sequence
  Synthetic oligonucleotide
agcacccaagctgattcgtgctgttttatgatgtca

SEQ ID NO: 66727 - DNA, 36 bp, Artificial Sequence
  Synthetic oligonucleotide
gccccccgtacttcccctgtcctcttggtttcaaga

SEQ ID NO: 66728 - DNA, 37 bp, Artificial Sequence
  Synthetic oligonucleotide
gtagcgggctctgagaggaggaatgagggggctaaga

SEQ ID NO: 66729 - DNA, 37 bp, Artificial Sequence
  Synthetic oligonucleotide
gctgagaggtggaagttaggagggggagcgaccgaga

SEQ ID NO: 66730 - DNA, 37 bp, Artificial Sequence
  Synthetic oligonucleotide
actgcacacaccgcctccgaggacccctgacgctaga

SEQ ID NO: 66731 - DNA, 37 bp, Artificial Sequence
  Synthetic oligonucleotide
aactgcaacaactggtaaggcgacgtgtgattaacga

SEQ ID NO: 66732 - DNA, 37 bp, Artificial Sequence
  Synthetic oligonucleotide
acaatgcttccatcctatttagccactgaccccccga

SEQ ID NO: 66733 - DNA, 37 bp, Artificial Sequence
  Synthetic oligonucleotide
gcatgacatctcaagacccaaccctgtcgacatccga

SEQ ID NO: 66734 - DNA, 36 bp, Artificial Sequence
  Synthetic oligonucleotide
atggccacacagactacctattgcgcgcttatccga

SEQ ID NO: 66735 - DNA, 37 bp, Artificial Sequence
  Synthetic oligonucleotide
tgacaaggcgctgggttcatacataggcggaaaagga

SEQ ID NO: 66736 - DNA, 36 bp, Artificial Sequence
  Synthetic oligonucleotide
tactcacggccccaacggtcaccattcgctatagga

SEQ ID NO: 66737 - DNA, 37 bp, Artificial Sequence
  Synthetic oligonucleotide
tttgactcgcccctcgcaataacagtacttgttagga

SEQ ID NO: 66738 - DNA, 37 bp, Artificial Sequence
  Synthetic oligonucleotide
tgtagagggaggaacgttggaaataaagaggggcgga

SEQ ID NO: 66739 - DNA, 37 bp, Artificial Sequence
  Synthetic oligonucleotide
ggggagaagggaggatggagctggggaattataggga

SEQ ID NO: 66740 - DNA, 37 bp, Artificial Sequence
  Synthetic oligonucleotide
gcgaacgatagccagggggggtagcaacggtgcggga

SEQ ID NO: 66741 - DNA, 37 bp, Artificial Sequence
  Synthetic oligonucleotide
aaaacgggtatggtggggcaaaagcaactagtgggga

SEQ ID NO: 66742 - DNA, 37 bp, Artificial Sequence
  Synthetic oligonucleotide
ggaccaaagtgaagaggaggggcttggggagtatgga

SEQ ID NO: 66743 - DNA, 37 bp, Artificial Sequence
  Synthetic oligonucleotide
tcaacgggtatgggtgtagctggctggcgggggtgga

SEQ ID NO: 66744 - DNA, 38 bp, Artificial Sequence
  Synthetic oligonucleotide
gccgatcgggtggaggtcgaataggaagctggaaatga

SEQ ID NO: 66745 - DNA, 37 bp, Artificial Sequence
  Synthetic oligonucleotide
ttacacgcgcccaggcatcatacacacgctcccatga

SEQ ID NO: 66746 - DNA, 38 bp, Artificial Sequence
  Synthetic oligonucleotide
tacgatcgctgatggtgaaaaaggagtgtgtgggatga

SEQ ID NO: 66747 - DNA, 37 bp, Artificial Sequence
  Synthetic oligonucleotide
ttgacggcacgacatcacaccatgcctcccatactga

SEQ ID NO: 66748 - DNA, 35 bp, Artificial Sequence
  Synthetic oligonucleotide
tactgacctccgtggacataacctatacctactga

SEQ ID NO: 66749 - DNA, 38 bp, Artificial Sequence
  Synthetic oligonucleotide
tctgcgcccgcaatcactcccctctgtcgaactgctga

SEQ ID NO: 66750 - DNA, 37 bp, Artificial Sequence
  Synthetic oligonucleotide
actctggcagggatctccccactccttcgctctctga

SEQ ID NO: 66751 - DNA, 37 bp, Artificial Sequence
  Synthetic oligonucleotide
gtatgccaaagcgcgtccttcatcaccgtgtctctga

SEQ ID NO: 66752 - DNA, 37 bp, Artificial Sequence
  Synthetic oligonucleotide
aagggaggtacagggctagtggggagtgatatcgtga

SEQ ID NO: 66753 - DNA, 38 bp, Artificial Sequence
  Synthetic oligonucleotide
gcgacaggtcgaagatctggctgcacgggatgcattga

SEQ ID NO: 66754 - DNA, 36 bp, Artificial Sequence
  Synthetic oligonucleotide
gatggcgccgtacctgaaaaatacactacctcttga

SEQ ID NO: 66755 - DNA, 38 bp, Artificial Sequence
  Synthetic oligonucleotide
tacgctggcacccttgtacatcgggccgaccttcttga

SEQ ID NO: 66756 - DNA, 38 bp, Artificial Sequence
  Synthetic oligonucleotide
gtcacaccgccccgtttcatgggactcaaatttcttga

SEQ ID NO: 66757 - DNA, 37 bp, Artificial Sequence
  Synthetic oligonucleotide
acattctcagacgatgatccgcccggcccctatttga

SEQ ID NO: 66758 - DNA, 36 bp, Artificial Sequence
  Synthetic oligonucleotide
ttgcgacacacgctgactgcttggtcgaactctata

SEQ ID NO: 66759 - DNA, 36 bp, Artificial Sequence
  Synthetic oligonucleotide
acacgtcgcgacccgacaattaccggccccctgcta

SEQ ID NO: 66760 - DNA, 36 bp, Artificial Sequence
  Synthetic oligonucleotide
gcgagggacctgacatcgttttgccttacctgagta

SEQ ID NO: 66761 - DNA, 36 bp, Artificial Sequence
  Synthetic oligonucleotide
gttccctgccccagagccgttacgttgctttaggta

SEQ ID NO: 66762 - DNA, 35 bp, Artificial Sequence
  Synthetic oligonucleotide
ttgacacccttggttcctctgtgctattaaaatta

SEQ ID NO: 66763 - DNA, 35 bp, Artificial Sequence
  Synthetic oligonucleotide
atcacgcaaccggggcggtttggagaaaaggttta

SEQ ID NO: 66764 - DNA, 35 bp, Artificial Sequence
  Synthetic oligonucleotide
aacatgcccagtagttgtccctccacgtgttcaac

SEQ ID NO: 66765 - DNA, 35 bp, Artificial Sequence
  Synthetic oligonucleotide
ttggcccacctctattggagcatacgcatccacac

SEQ ID NO: 66766 - DNA, 35 bp, Artificial Sequence
  Synthetic oligonucleotide
tccagacccttggccgcccggttagtactggccac

SEQ ID NO: 66767 - DNA, 35 bp, Artificial Sequence
  Synthetic oligonucleotide
acgacatcgcggcggtccgttactttttccatcac

SEQ ID NO: 66768 - DNA, 35 bp, Artificial Sequence
  Synthetic oligonucleotide
atgtccacatgttcctccctggtatcagtaactac

SEQ ID NO: 66769 - DNA, 35 bp, Artificial Sequence
  Synthetic oligonucleotide
gccgtccaacgtgagtctgtccaaccttcacctac

SEQ ID NO: 66770 - DNA, 35 bp, Artificial Sequence
  Synthetic oligonucleotide
ttgtgcgagctcttgagttacatctccagccctac

SEQ ID NO: 66771 - DNA, 35 bp, Artificial Sequence
  Synthetic oligonucleotide
aactggcaccgacaagaatcgtcatctgtctctac

SEQ ID NO: 66772 - DNA, 35 bp, Artificial Sequence
  Synthetic oligonucleotide
atgctgtcaggtagcgtttagttttccccctgtac

SEQ ID NO: 66773 - DNA, 35 bp, Artificial Sequence
  Synthetic oligonucleotide
accttgggcggtcctacatcaccgtttagctttac

SEQ ID NO: 66774 - DNA, 35 bp, Artificial Sequence
  Synthetic oligonucleotide
agtctcatccggcattattacttcgaaaggtcacc

SEQ ID NO: 66775 - DNA, 36 bp, Artificial Sequence
  Synthetic oligonucleotide
gtgtctggctgagcgcgtaataccactcacttgccc

SEQ ID NO: 66776 - DNA, 34 bp, Artificial Sequence
  Synthetic oligonucleotide
gcccacctcgaggtccgtcgctacacaccaatcc

SEQ ID NO: 66777 - DNA, 35 bp, Artificial Sequence
  Synthetic oligonucleotide
tcccagtcgttttccgcaaccctgttttggattcc

SEQ ID NO: 66778 - DNA, 35 bp, Artificial Sequence
  Synthetic oligonucleotide
gacgccgatcccaccaagcctgtgtttatttcagc

SEQ ID NO: 66779 - DNA, 35 bp, Artificial Sequence
  Synthetic oligonucleotide
ccgcgaaccgtgcgatacttttttgagcgtttcgc

SEQ ID NO: 66780 - DNA, 35 bp, Artificial Sequence
  Synthetic oligonucleotide
cctgcccctacccccgttctcaccatcgtgtgatc

SEQ ID NO: 66781 - DNA, 35 bp, Artificial Sequence
  Synthetic oligonucleotide
ggtgcgttacgctctccccgtatccgccttaattc

SEQ ID NO: 66782 - DNA, 35 bp, Artificial Sequence
  Synthetic oligonucleotide
ccacaggtcgtcctccctgttcatactgttgtttc

SEQ ID NO: 66783 - DNA, 35 bp, Artificial Sequence
  Synthetic oligonucleotide
atgcgacaggccccacatacacgtccaccctgaag

SEQ ID NO: 66784 - DNA, 35 bp, Artificial Sequence
  Synthetic oligonucleotide
gacgtgctgtcacttgtcttggagtaattatgcag

SEQ ID NO: 66785 - DNA, 35 bp, Artificial Sequence
  Synthetic oligonucleotide
gaggggggaatcttacggggagaaataggaatacg

SEQ ID NO: 66786 - DNA, 35 bp, Artificial Sequence
  Synthetic oligonucleotide
gacgcccctgctgtaatatgcctcttctaacgccg

SEQ ID NO: 66787 - DNA, 35 bp, Artificial Sequence
  Synthetic oligonucleotide
gcccccactccgaacggtccgtctgaaagccctcg

SEQ ID NO: 66788 - DNA, 35 bp, Artificial Sequence
  Synthetic oligonucleotide
tatgcggatcagctgcaaaatgctggatggtgggg

SEQ ID NO: 66789 - DNA, 35 bp, Artificial Sequence
  Synthetic oligonucleotide
tcacaagtgcgagggggatatacggtgggaagtgg

SEQ ID NO: 66790 - DNA, 35 bp, Artificial Sequence
  Synthetic oligonucleotide
caatatggaggtggggggaagggcggacggtttgg

SEQ ID NO: 66791 - DNA, 35 bp, Artificial Sequence
  Synthetic oligonucleotide
tcgagaactccctcccgtgccccctatttgcattg

SEQ ID NO: 66792 - DNA, 35 bp, Artificial Sequence
  Synthetic oligonucleotide
ggaggaggtcggagggtgtggagaaggatgtgttg

SEQ ID NO: 66793 - DNA, 34 bp, Artificial Sequence
  Synthetic oligonucleotide
tcacacctgtctgggctcaatttaattgatgaat

SEQ ID NO: 66794 - DNA, 35 bp, Artificial Sequence
  Synthetic oligonucleotide
accagtctgcctctcttcatgtcgggtccacacat

SEQ ID NO: 66795 - DNA, 35 bp, Artificial Sequence
  Synthetic oligonucleotide
gagcctgctgcttgcccttcctaacttaggaccat

SEQ ID NO: 66796 - DNA, 35 bp, Artificial Sequence
  Synthetic oligonucleotide
gttgaagtaaggttaagtgaggacgggggaattat

SEQ ID NO: 66797 - DNA, 35 bp, Artificial Sequence
  Synthetic oligonucleotide
tcactccgagaacaacattgagatttggaacgcct

SEQ ID NO: 66798 - DNA, 32 bp, Artificial Sequence
  Synthetic oligonucleotide
gtctatgtcgcctatccgtccttcttttctct

SEQ ID NO: 66799 - DNA, 35 bp, Artificial Sequence
  Synthetic oligonucleotide
gcgcacgtccgccataaaactgcttctttgcttct

SEQ ID NO: 66800 - DNA, 35 bp, Artificial Sequence
  Synthetic oligonucleotide
taccatccggccctcttgctttaatctcttaacgt

SEQ ID NO: 66801 - DNA, 33 bp, Artificial Sequence
  Synthetic oligonucleotide
tctagatcataaccccgccccgcccgttaacgt

SEQ ID NO: 66802 - DNA, 35 bp, Artificial Sequence
  Synthetic oligonucleotide
gatgcactgtcattcatttttgcccgcgcgaactt

SEQ ID NO: 66803 - DNA, 35 bp, Artificial Sequence
  Synthetic oligonucleotide
gtgccgtggaactgtctagtcgtttgcctttcttt

SEQ ID NO: 66804 - DNA, 35 bp, Artificial Sequence
  Synthetic oligonucleotide
acacacaccggtacgtttagcggtacttagggttt

SEQ ID NO: 66805 - DNA, 36 bp, Artificial Sequence
  Synthetic oligonucleotide
gcaccggcctctaatttgccacagctaactgaacaa

SEQ ID NO: 66806 - DNA, 36 bp, Artificial Sequence
  Synthetic oligonucleotide
acacatccctgttgtgccaacattatgggcacccaa

SEQ ID NO: 66807 - DNA, 36 bp, Artificial Sequence
  Synthetic oligonucleotide
tcttgacccccctcacgcaacaaggtacaggttgaa

SEQ ID NO: 66808 - DNA, 36 bp, Artificial Sequence
  Synthetic oligonucleotide
gggataggcgcagagtgccgttctcccccaccataa

SEQ ID NO: 66809 - DNA, 35 bp, Artificial Sequence
  Synthetic oligonucleotide
tgtccctccggcccctcttattagcctgtggttaa

SEQ ID NO: 66810 - DNA, 36 bp, Artificial Sequence
  Synthetic oligonucleotide
gcccgggttgtctggcccggtatctccctttccaca

SEQ ID NO: 66811 - DNA, 36 bp, Artificial Sequence
  Synthetic oligonucleotide
gcatcccggacagtcttaaaaaccgggctactcaca

SEQ ID NO: 66812 - DNA, 36 bp, Artificial Sequence
  Synthetic oligonucleotide
gttgccctagcttcctttctcacgcgtgccaggaca

SEQ ID NO: 66813 - DNA, 35 bp, Artificial Sequence
  Synthetic oligonucleotide
atgcgctctaaacagcctaacggtatggcacacca

SEQ ID NO: 66814 - DNA, 35 bp, Artificial Sequence
  Synthetic oligonucleotide
tgagctccccgttctcgccctagcgtctcactcca

SEQ ID NO: 66815 - DNA, 35 bp, Artificial Sequence
  Synthetic oligonucleotide
tgtcactctcccacgatctcgcacccagtgcagca

SEQ ID NO: 66816 - DNA, 36 bp, Artificial Sequence
  Synthetic oligonucleotide
ttgagcggtggtggtaaatgagaagcgtaaagagca

SEQ ID NO: 66817 - DNA, 35 bp, Artificial Sequence
  Synthetic oligonucleotide
atacccctggactctgatactgctccctttccgca

SEQ ID NO: 66818 - DNA, 36 bp, Artificial Sequence
  Synthetic oligonucleotide
tgataaccctcccccgatactgactccagtccggca

SEQ ID NO: 66819 - DNA, 36 bp, Artificial Sequence
  Synthetic oligonucleotide
aaaggcggatatcaggggggagggaggaaccgggca

SEQ ID NO: 66820 - DNA, 37 bp, Artificial Sequence
  Synthetic oligonucleotide
gaagaaatggtgggtgagggaggggggatagagaaga

SEQ ID NO: 66821 - DNA, 35 bp, Artificial Sequence
  Synthetic oligonucleotide
aggaccgcccctgcgtaacgcccaaacactcacga

SEQ ID NO: 66822 - DNA, 37 bp, Artificial Sequence
  Synthetic oligonucleotide
ttgctcctgctcatttaagtaaaacttgcctgcccga

SEQ ID NO: 66823 - DNA, 37 bp, Artificial Sequence
  Synthetic oligonucleotide
gtcccccaacccacagacccagaagatgcctgtccga

SEQ ID NO: 66824 - DNA, 37 bp, Artificial Sequence
  Synthetic oligonucleotide
tccgattcccaccgatgacgcttgtccgattcatcga

SEQ ID NO: 66825 - DNA, 37 bp, Artificial Sequence
  Synthetic oligonucleotide
gatataggggcggagtggggggtcgggcatctgtcga

SEQ ID NO: 66826 - DNA, 37 bp, Artificial Sequence
  Synthetic oligonucleotide
accacctgcatccacggtcaagtatctacacgcagga

SEQ ID NO: 66827 - DNA, 37 bp, Artificial Sequence
  Synthetic oligonucleotide
tcggggtggagggaaatgcagggtataggggtgcgga

SEQ ID NO: 66828 - DNA, 37 bp, Artificial Sequence
  Synthetic oligonucleotide
gatagggaacggaggtaggtcggtcgcaaatgaggga

SEQ ID NO: 66829 - DNA, 37 bp, Artificial Sequence
  Synthetic oligonucleotide
atgggcacgggcggggagacctattagtacgtaggga

SEQ ID NO: 66830 - DNA, 37 bp, Artificial Sequence
  Synthetic oligonucleotide
gcgactggtcatggtaagggatagaagtgggagggga

SEQ ID NO: 66831 - DNA, 36 bp, Artificial Sequence
  Synthetic oligonucleotide
ttcgcccgtctccgccaccgtgcagacaaacatgga

SEQ ID NO: 66832 - DNA, 37 bp, Artificial Sequence
  Synthetic oligonucleotide
gcgcacccacgctatgcgccgtttactgtatcttgga

SEQ ID NO: 66833 - DNA, 38 bp, Artificial Sequence
  Synthetic oligonucleotide
aaggtggagctgaagagggtgtggcaaggatacactga

SEQ ID NO: 66834 - DNA, 38 bp, Artificial Sequence
  Synthetic oligonucleotide
agcgcccccccgatgcatcgtttactcgcttgtactga

SEQ ID NO: 66835 - DNA, 38 bp, Artificial Sequence
  Synthetic oligonucleotide
gccacctgcaggtcgaatttacagtagttgctccctga

SEQ ID NO: 66836 - DNA, 37 bp, Artificial Sequence
  Synthetic oligonucleotide
taccgtgcatcaaactaataatgttctatctccctga

SEQ ID NO: 66837 - DNA, 38 bp, Artificial Sequence
  Synthetic oligonucleotide
gtgagagcagagggaatgacattcaaagcacacgctga

SEQ ID NO: 66838 - DNA, 38 bp, Artificial Sequence
  Synthetic oligonucleotide
aattgccccgtcggtaagctttccatcacgttctctga

SEQ ID NO: 66839 - DNA, 37 bp, Artificial Sequence
  Synthetic oligonucleotide
atcacacatcttcttggcgccgccctgtcttttctga

SEQ ID NO: 66840 - DNA, 38 bp, Artificial Sequence
  Synthetic oligonucleotide
acaccctcattttctcactgagaaccccttcttagtga

SEQ ID NO: 66841 - DNA, 38 bp, Artificial Sequence
  Synthetic oligonucleotide
tctcgcgcaacgttttaggggccggaaaatgaaggtga

SEQ ID NO: 66842 - DNA, 37 bp, Artificial Sequence
  Synthetic oligonucleotide
gttgggggtaggacataatagggtaagcggtgggtga

SEQ ID NO: 66843 - DNA, 37 bp, Artificial Sequence
  Synthetic oligonucleotide
agttactgctgccaacactgaattttgctatacttga

SEQ ID NO: 66844 - DNA, 38 bp, Artificial Sequence
  Synthetic oligonucleotide
gatcctgctcgtgatctgccatgcctctttaaccttga

SEQ ID NO: 66845 - DNA, 38 bp, Artificial Sequence
  Synthetic oligonucleotide
tagtgcaaactccaggatctcctttgcactgcccttga

SEQ ID NO: 66846 - DNA, 37 bp, Artificial Sequence
  Synthetic oligonucleotide
gtcactgttgcggtgactaaccgcattcatttcttga

SEQ ID NO: 66847 - DNA, 38 bp, Artificial Sequence
  Synthetic oligonucleotide
aacaatgcacgctccctgaccctgtcccattaagttga

SEQ ID NO: 66848 - DNA, 37 bp, Artificial Sequence
  Synthetic oligonucleotide
gcctgcggaccatgttctctttgcgtactttttttga

SEQ ID NO: 66849 - DNA, 36 bp, Artificial Sequence
  Synthetic oligonucleotide
acgaatggggggaactgtgaccattagagggagata

SEQ ID NO: 66850 - DNA, 36 bp, Artificial Sequence
  Synthetic oligonucleotide
gatctcgatgttaatcaggcccaccgctctcatcta

SEQ ID NO: 66851 - DNA, 35 bp, Artificial Sequence
  Synthetic oligonucleotide
tgcctgctaccagctcccccgttttcacttgtgta

SEQ ID NO: 66852 - DNA, 35 bp, Artificial Sequence
  Synthetic oligonucleotide
gatcgccggctccgtactagtagcgcaactgcaac

SEQ ID NO: 66853 - DNA, 35 bp, Artificial Sequence
  Synthetic oligonucleotide
aaccacgtttcggatgccataccacattagcgaac

SEQ ID NO: 66854 - DNA, 35 bp, Artificial Sequence
  Synthetic oligonucleotide
tccggactgggctttggggggggtttgtggtacac

SEQ ID NO: 66855 - DNA, 35 bp, Artificial Sequence
  Synthetic oligonucleotide
gtccgtagcctggtttattttccgtccgttctgac

SEQ ID NO: 66856 - DNA, 35 bp, Artificial Sequence
  Synthetic oligonucleotide
gtgcgactcgtgtatgttccaccttcttaacgtac

SEQ ID NO: 66857 - DNA, 36 bp, Artificial Sequence
  Synthetic oligonucleotide
gcaattacagtttcgccccaactgcgccgtgccacc

SEQ ID NO: 66858 - DNA, 35 bp, Artificial Sequence
  Synthetic oligonucleotide
acctcgcacagccatagaaaatacgctacttcgcc

SEQ ID NO: 66859 - DNA, 35 bp, Artificial Sequence
  Synthetic oligonucleotide
ggtgggatgaagggtggggggggctcacttaggcc

SEQ ID NO: 66860 - DNA, 35 bp, Artificial Sequence
  Synthetic oligonucleotide
gccggtaccgcctatgcttgtcccctccccattcc

SEQ ID NO: 66861 - DNA, 35 bp, Artificial Sequence
  Synthetic oligonucleotide
tgctccacctcacctgatagttccttttccccagc

SEQ ID NO: 66862 - DNA, 35 bp, Artificial Sequence
  Synthetic oligonucleotide
gtcgcgctcccttccctatgtgcgcgtaacatctc

SEQ ID NO: 66863 - DNA, 35 bp, Artificial Sequence
  Synthetic oligonucleotide
aaatgaccggccggtacgcatgccccaatcctgtc

SEQ ID NO: 66864 - DNA, 35 bp, Artificial Sequence
  Synthetic oligonucleotide
tccgaacccgacatccgctggcgccttcttgtgtc

SEQ ID NO: 66865 - DNA, 35 bp, Artificial Sequence
  Synthetic oligonucleotide
agcgccatgcgccaccccacatcgtcatgccattc

SEQ ID NO: 66866 - DNA, 35 bp, Artificial Sequence
  Synthetic oligonucleotide
ttaggggggtgggtactggggttgagggtgcgttc

SEQ ID NO: 66867 - DNA, 35 bp, Artificial Sequence
  Synthetic oligonucleotide
accccttctcaggtgtgtctcctgttctgtcctag

SEQ ID NO: 66868 - DNA, 35 bp, Artificial Sequence
  Synthetic oligonucleotide
aagtccacatcatgccttgcaattgacccatttag

SEQ ID NO: 66869 - DNA, 35 bp, Artificial Sequence
  Synthetic oligonucleotide
acttgcccagccgtgaatccgcgcttctagccacg

SEQ ID NO: 66870 - DNA, 35 bp, Artificial Sequence
  Synthetic oligonucleotide
tctgacgcccgtttgtcactccttaggatatcacg

SEQ ID NO: 66871 - DNA, 35 bp, Artificial Sequence
  Synthetic oligonucleotide
aagaggcgtgtggtgggttgcatgggaaggaaggg

SEQ ID NO: 66872 - DNA, 35 bp, Artificial Sequence
  Synthetic oligonucleotide
atcaacgcagcaatgactgcggcgggttaagaggg

SEQ ID NO: 66873 - DNA, 35 bp, Artificial Sequence
  Synthetic oligonucleotide
acccgccacattgttcccaggctctccacggatgg

SEQ ID NO: 66874 - DNA, 35 bp, Artificial Sequence
  Synthetic oligonucleotide
accccccaccctttacgagccagtaggtttgactg

SEQ ID NO: 66875 - DNA, 35 bp, Artificial Sequence
  Synthetic oligonucleotide
gatgatgagccccacgttctctatgacgacctttg

SEQ ID NO: 66876 - DNA, 35 bp, Artificial Sequence
  Synthetic oligonucleotide
gtgcctaccccaacggactggacctgaccgaaaat

SEQ ID NO: 66877 - DNA, 35 bp, Artificial Sequence
  Synthetic oligonucleotide
gtccccctctcagtgggatcctactaacacacaat

SEQ ID NO: 66878 - DNA, 35 bp, Artificial Sequence
  Synthetic oligonucleotide
aaacccgcagggcaacagttatcacagctttccat

SEQ ID NO: 66879 - DNA, 35 bp, Artificial Sequence
  Synthetic oligonucleotide
ggagagggcggtaggcgtaggtaataactgggcat

SEQ ID NO: 66880 - DNA, 35 bp, Artificial Sequence
  Synthetic oligonucleotide
tcactccactgcctgaccttcaagcgccgcatact

SEQ ID NO: 66881 - DNA, 35 bp, Artificial Sequence
  Synthetic oligonucleotide
tgacgcggtatcctcccctgatccatatcatgcct

SEQ ID NO: 66882 - DNA, 35 bp, Artificial Sequence
  Synthetic oligonucleotide
tgcatcctccaaaacgcacgaaggaccgtgccgct

SEQ ID NO: 66883 - DNA, 35 bp, Artificial Sequence
  Synthetic oligonucleotide
tcaatccacccgccgaatgttcgcttaaacttttt

SEQ ID NO: 66884 - DNA, 36 bp, Artificial Sequence
  Synthetic oligonucleotide
gtagggggggagagaggaaggggtgagcggtataaa

SEQ ID NO: 66885 - DNA, 36 bp, Artificial Sequence
  Synthetic oligonucleotide
tatcctctaccccccgctcgcgttacctggttacca

SEQ ID NO: 66886 - DNA, 35 bp, Artificial Sequence
  Synthetic oligonucleotide
gaacaaagcctcccgcctctttcacttcgcaccca

SEQ ID NO: 66887 - DNA, 35 bp, Artificial Sequence
  Synthetic oligonucleotide
acctacatcaaagggtccccggcctcgctgcccca

SEQ ID NO: 66888 - DNA, 36 bp, Artificial Sequence
  Synthetic oligonucleotide
ttctccccgcactatgtgaggttgctgccatgccca

SEQ ID NO: 66889 - DNA, 36 bp, Artificial Sequence
  Synthetic oligonucleotide
tacgaggcgaacgatcgccctctttgttccctgcca

SEQ ID NO: 66890 - DNA, 35 bp, Artificial Sequence
  Synthetic oligonucleotide
atcaaccatgcgaaacggttcctatgcccggtcca

SEQ ID NO: 66891 - DNA, 36 bp, Artificial Sequence
  Synthetic oligonucleotide
ttacacacgtggccctctatctggtcatgcattcca

SEQ ID NO: 66892 - DNA, 36 bp, Artificial Sequence
  Synthetic oligonucleotide
tgccacacgcgacactgttctcgcccctccactgca

SEQ ID NO: 66893 - DNA, 35 bp, Artificial Sequence
  Synthetic oligonucleotide
gtgggcgtccatcagtggccctcctttgctctgca

SEQ ID NO: 66894 - DNA, 36 bp, Artificial Sequence
  Synthetic oligonucleotide
gtggtggagaattctagcacgagaggggggtttgca

SEQ ID NO: 66895 - DNA, 35 bp, Artificial Sequence
  Synthetic oligonucleotide
tcctctgccgtccggtcacttctcggcgcctatca

SEQ ID NO: 66896 - DNA, 36 bp, Artificial Sequence
  Synthetic oligonucleotide
acatgtctgcgcatacgtttcttagctgcgcactca

SEQ ID NO: 66897 - DNA, 36 bp, Artificial Sequence
  Synthetic oligonucleotide
gcatccaaactgtgcttctccccgtctgtctcttca

SEQ ID NO: 66898 - DNA, 36 bp, Artificial Sequence
  Synthetic oligonucleotide
taacgtcgcccgccccctgatgcaggctgaatttca

SEQ ID NO: 66899 - DNA, 37 bp, Artificial Sequence
  Synthetic oligonucleotide
gtccaccatcaaagtaaaatcgtccacggaccccaga

SEQ ID NO: 66900 - DNA, 37 bp, Artificial Sequence
  Synthetic oligonucleotide
tccgacctttacctgacctgtagatcagactttcaga

SEQ ID NO: 66901 - DNA, 37 bp, Artificial Sequence
  Synthetic oligonucleotide
ttgggcggtcgagtgggaagggttaggtatccggaga

SEQ ID NO: 66902 - DNA, 37 bp, Artificial Sequence
  Synthetic oligonucleotide
aaggaggggtgcaaaagaattatgaggtatggctaga

SEQ ID NO: 66903 - DNA, 37 bp, Artificial Sequence
  Synthetic oligonucleotide
atgcccagtactcacggtccaccccgcaccctaacga

SEQ ID NO: 66904 - DNA, 37 bp, Artificial Sequence
  Synthetic oligonucleotide
atccccccatgagcgccaacgttacctttgcccccga

SEQ ID NO: 66905 - DNA, 36 bp, Artificial Sequence
  Synthetic oligonucleotide
gacatggtagtcgaaccaccactctctgctatccga

SEQ ID NO: 66906 - DNA, 37 bp, Artificial Sequence
  Synthetic oligonucleotide
gaatgagccgggcacgggatagagggtaggccaggga

SEQ ID NO: 66907 - DNA, 37 bp, Artificial Sequence
  Synthetic oligonucleotide
agggcgatacaccactgagcccctcccccgtatggga

SEQ ID NO: 66908 - DNA, 37 bp, Artificial Sequence
  Synthetic oligonucleotide
tcatgtcgggtgtgaacgggtgatctttgaggtggga

SEQ ID NO: 66909 - DNA, 37 bp, Artificial Sequence
  Synthetic oligonucleotide
ggagtcatcggggaggggtcgggtgggacacactgga

SEQ ID NO: 66910 - DNA, 37 bp, Artificial Sequence
  Synthetic oligonucleotide
tcgctgtgtacaatactctctttaccctgactctgga

SEQ ID NO: 66911 - DNA, 36 bp, Artificial Sequence
  Synthetic oligonucleotide
gctaggtgagggtacgtggtctgggtggtggttgga

SEQ ID NO: 66912 - DNA, 35 bp, Artificial Sequence
  Synthetic oligonucleotide
gattcaacccagcgagccacccacctgattttgga

SEQ ID NO: 66913 - DNA, 38 bp, Artificial Sequence
  Synthetic oligonucleotide
gcaaatgggtaaggtctagggggggatacgggcaatga

SEQ ID NO: 66914 - DNA, 37 bp, Artificial Sequence
  Synthetic oligonucleotide
ggtgccatctcggggcccgtatatacctcctacatga

SEQ ID NO: 66915 - DNA, 38 bp, Artificial Sequence
  Synthetic oligonucleotide
agacaccgaagggtggcaggtccacttatatcccatga

SEQ ID NO: 66916 - DNA, 38 bp, Artificial Sequence
  Synthetic oligonucleotide
gctatggggctgctggctaccgtgcacctcttccatga

SEQ ID NO: 66917 - DNA, 38 bp, Artificial Sequence
  Synthetic oligonucleotide
gccaatgtcagccatcgctccccgtatcaccattatga

SEQ ID NO: 66918 - DNA, 37 bp, Artificial Sequence
  Synthetic oligonucleotide
agttgggtggtagagggaggggcgacatagtttatga

SEQ ID NO: 66919 - DNA, 37 bp, Artificial Sequence
  Synthetic oligonucleotide
tgacgcatccctccattcaatgcacgcacagtcctga

SEQ ID NO: 66920 - DNA, 38 bp, Artificial Sequence
  Synthetic oligonucleotide
tatcaaccccgtgtcttcgtctcctgttccccacgtga

SEQ ID NO: 66921 - DNA, 38 bp, Artificial Sequence
  Synthetic oligonucleotide
atcacatggccatccccgtccacccgtccctaccgtga

SEQ ID NO: 66922 - DNA, 38 bp, Artificial Sequence
  Synthetic oligonucleotide
gtgggcttcctcgtagtcgcatttcaccacctccgtga

SEQ ID NO: 66923 - DNA, 37 bp, Artificial Sequence
  Synthetic oligonucleotide
gaaattgcagccggtgggtgagattggtggggggtga

SEQ ID NO: 66924 - DNA, 38 bp, Artificial Sequence
  Synthetic oligonucleotide
tatgaagcgggcgggatctgtgctggagctgtgggtga

SEQ ID NO: 66925 - DNA, 37 bp, Artificial Sequence
  Synthetic oligonucleotide
gagggacaggggaccagaagtacttgtaatagtgtga

SEQ ID NO: 66926 - DNA, 38 bp, Artificial Sequence
  Synthetic oligonucleotide
ttcgctgactgctcggtctgagcctccctcccttgtga

SEQ ID NO: 66927 - DNA, 37 bp, Artificial Sequence
  Synthetic oligonucleotide
atgggttgggtgacgaatggtcgggaggggacattga

SEQ ID NO: 66928 - DNA, 38 bp, Artificial Sequence
  Synthetic oligonucleotide
gcctacaggcgcgctgtaactccctatcgcctgattga

SEQ ID NO: 66929 - DNA, 38 bp, Artificial Sequence
  Synthetic oligonucleotide
gtgtccctccatatctggtccctgactacctggcttga

SEQ ID NO: 66930 - DNA, 37 bp, Artificial Sequence
  Synthetic oligonucleotide
tacatacccgtggctgaccttgcgacttccctcttga

SEQ ID NO: 66931 - DNA, 37 bp, Artificial Sequence
  Synthetic oligonucleotide
tcttatccaccacacgcagccgtgcattgcctcttga

SEQ ID NO: 66932 - DNA, 38 bp, Artificial Sequence
  Synthetic oligonucleotide
atcgaatcccaccccgagcaacaccgtcctttagttga

SEQ ID NO: 66933 - DNA, 37 bp, Artificial Sequence
  Synthetic oligonucleotide
gagaagctggcggcgggggtagagcgtcaatggttga

SEQ ID NO: 66934 - DNA, 37 bp, Artificial Sequence
  Synthetic oligonucleotide
tgagcaacgaaaactggcttgttcgattcacctttga

SEQ ID NO: 66935 - DNA, 36 bp, Artificial Sequence
  Synthetic oligonucleotide
tgtcaatatccgcttggttttcgttgccatgtttga

SEQ ID NO: 66936 - DNA, 38 bp, Artificial Sequence
  Synthetic oligonucleotide
tgacaacaggccctgattcttccttgttaccattttga

SEQ ID NO: 66937 - DNA, 36 bp, Artificial Sequence
  Synthetic oligonucleotide
acgattccacctcaccagcctcggaatacacgacta

SEQ ID NO: 66938 - DNA, 35 bp, Artificial Sequence
  Synthetic oligonucleotide
acccggactctacatcctctgtgaaccacttacta

SEQ ID NO: 66939 - DNA, 36 bp, Artificial Sequence
  Synthetic oligonucleotide
ttaatccaccaccgcttcggttcacatgggacccta

SEQ ID NO: 66940 - DNA, 36 bp, Artificial Sequence
  Synthetic oligonucleotide
gtgattcgaaaggggggctaatggaggacctacgta

SEQ ID NO: 66941 - DNA, 36 bp, Artificial Sequence
  Synthetic oligonucleotide
agcatcccagtcccgccaccagatcttttttccgta

SEQ ID NO: 66942 - DNA, 35 bp, Artificial Sequence
  Synthetic oligonucleotide
gtgaggcatacagcctttatcacatccaacataac

SEQ ID NO: 66943 - DNA, 35 bp, Artificial Sequence
  Synthetic oligonucleotide
atgcgacaactcctcacgctaagtcacccgcacac

SEQ ID NO: 66944 - DNA, 35 bp, Artificial Sequence
  Synthetic oligonucleotide
accgggcgaataccatttgatgatggccctcccac

SEQ ID NO: 66945 - DNA, 35 bp, Artificial Sequence
  Synthetic oligonucleotide
tctgagtgcaccgaccccggccttccttgctaacc

SEQ ID NO: 66946 - DNA, 35 bp, Artificial Sequence
  Synthetic oligonucleotide
aagttatgcccgacctgtattcatttccggtaccc

SEQ ID NO: 66947 - DNA, 35 bp, Artificial Sequence
  Synthetic oligonucleotide
accccgtcaacgcacccatgccgtccactccgccc

SEQ ID NO: 66948 - DNA, 35 bp, Artificial Sequence
  Synthetic oligonucleotide
tcgaccccaattgtcctagactacatcctgctccc

SEQ ID NO: 66949 - DNA, 35 bp, Artificial Sequence
  Synthetic oligonucleotide
tgagctgggtgtctgaccactcgctttgaattccc

SEQ ID NO: 66950 - DNA, 35 bp, Artificial Sequence
  Synthetic oligonucleotide
tcagttccccctgtgagtttaacctaaatgttgcc

SEQ ID NO: 66951 - DNA, 36 bp, Artificial Sequence
  Synthetic oligonucleotide
tacccgcccaacattgaactggatgctatggaacgc

SEQ ID NO: 66952 - DNA, 35 bp, Artificial Sequence
  Synthetic oligonucleotide
agcaccatcccaagcgcctacaccacccatctggc

SEQ ID NO: 66953 - DNA, 35 bp, Artificial Sequence
  Synthetic oligonucleotide
atggggctcagggcccgtccattccttcgctactc

SEQ ID NO: 66954 - DNA, 35 bp, Artificial Sequence
  Synthetic oligonucleotide
attgtcgcacggttgcaccagtcctacagtccctc

SEQ ID NO: 66955 - DNA, 35 bp, Artificial Sequence
  Synthetic oligonucleotide
acatcacaccttcatagggcttataggattgcctc

SEQ ID NO: 66956 - DNA, 35 bp, Artificial Sequence
  Synthetic oligonucleotide
tctgacacatccgccgccttgtccgaaaacatgtc

SEQ ID NO: 66957 - DNA, 35 bp, Artificial Sequence
  Synthetic oligonucleotide
tgaacggagcggtcttacggtttggcctgtacttc

SEQ ID NO: 66958 - DNA, 35 bp, Artificial Sequence
  Synthetic oligonucleotide
acaaaccgctacagcatgtaaattttctggccttc

SEQ ID NO: 66959 - DNA, 35 bp, Artificial Sequence
  Synthetic oligonucleotide
tatgtccgtcgttttggcttatgctagtaggtttc

SEQ ID NO: 66960 - DNA, 35 bp, Artificial Sequence
  Synthetic oligonucleotide
tctggggggcgggtacggggggcagggcagttttc

SEQ ID NO: 66961 - DNA, 35 bp, Artificial Sequence
  Synthetic oligonucleotide
ttgggagggcgattcgggtgaggggctgactcaag

SEQ ID NO: 66962 - DNA, 36 bp, Artificial Sequence
  Synthetic oligonucleotide
agcgagaaagaaggggagtgtagaacttggatgaag

SEQ ID NO: 66963 - DNA, 35 bp, Artificial Sequence
  Synthetic oligonucleotide
tcatgtagatgtgcttcctttgtgttgtcccaccg

SEQ ID NO: 66964 - DNA, 35 bp, Artificial Sequence
  Synthetic oligonucleotide
actctgactcacgacttcctcttatcactcatgcg

SEQ ID NO: 66965 - DNA, 35 bp, Artificial Sequence
  Synthetic oligonucleotide
gaattgggtggtagaaggtggggtgatattacagg

SEQ ID NO: 66966 - DNA, 35 bp, Artificial Sequence
  Synthetic oligonucleotide
tcactccaccgttattatagggaagccgaggtagg

SEQ ID NO: 66967 - DNA, 35 bp, Artificial Sequence
  Synthetic oligonucleotide
gtgtcggaatcagtccccgtccctatactacccgg

SEQ ID NO: 66968 - DNA, 35 bp, Artificial Sequence
  Synthetic oligonucleotide
aaagcgaagggagtggtaggggggctattcgaggg

SEQ ID NO: 66969 - DNA, 35 bp, Artificial Sequence
  Synthetic oligonucleotide
tgacgttggtcaatcaccctctcactttactatgg

SEQ ID NO: 66970 - DNA, 35 bp, Artificial Sequence
  Synthetic oligonucleotide
gtacatggggagtgggtcttctaagtgtggggctg

SEQ ID NO: 66971 - DNA, 35 bp, Artificial Sequence
  Synthetic oligonucleotide
acatgtcactgctgatatcccgcccctagtatctg

SEQ ID NO: 66972 - DNA, 35 bp, Artificial Sequence
  Synthetic oligonucleotide
accgggcgaagtaagagggctatcgtgtgtttgtg

SEQ ID NO: 66973 - DNA, 35 bp, Artificial Sequence
  Synthetic oligonucleotide
gcaccgaggtttcatgcttcgggctcgacccccat

SEQ ID NO: 66974 - DNA, 35 bp, Artificial Sequence
  Synthetic oligonucleotide
ttcgccccatagtagtgacctagcactgctcccat

SEQ ID NO: 66975 - DNA, 35 bp, Artificial Sequence
  Synthetic oligonucleotide
gattcccgctacatgcgctattgtgactggctcat

SEQ ID NO: 66976 - DNA, 35 bp, Artificial Sequence
  Synthetic oligonucleotide
tcccgaccattgtacatcacggtgtatgcaattat

SEQ ID NO: 66977 - DNA, 35 bp, Artificial Sequence
  Synthetic oligonucleotide
acgatggatctatcctcacacctcagagccgccct

SEQ ID NO: 66978 - DNA, 35 bp, Artificial Sequence
  Synthetic oligonucleotide
gacccgttttggtcaaaaatgccatggtactcgct

SEQ ID NO: 66979 - DNA, 35 bp, Artificial Sequence
  Synthetic oligonucleotide
tccgcgctacttgacccgggtcattgactactgct

SEQ ID NO: 66980 - DNA, 35 bp, Artificial Sequence
  Synthetic oligonucleotide
tacggggcgacgagcacatcaattcatgtccctct

SEQ ID NO: 66981 - DNA, 35 bp, Artificial Sequence
  Synthetic oligonucleotide
ggtccccatgactgctgacgtttcggtcgaattct

SEQ ID NO: 66982 - DNA, 35 bp, Artificial Sequence
  Synthetic oligonucleotide
ttagctcaatgctactccacatcttccactcaagt

SEQ ID NO: 66983 - DNA, 35 bp, Artificial Sequence
  Synthetic oligonucleotide
gcacgtcattatggatcttccctgccctcgcacgt

SEQ ID NO: 66984 - DNA, 35 bp, Artificial Sequence
  Synthetic oligonucleotide
actgtgccacggccttagctacccagatctccggt

SEQ ID NO: 66985 - DNA, 35 bp, Artificial Sequence
  Synthetic oligonucleotide
gaagagaggttgatgcaaaatatggggcagtatgt

SEQ ID NO: 66986 - DNA, 35 bp, Artificial Sequence
  Synthetic oligonucleotide
caaccacccttgtcattccgttattatcacggttt

SEQ ID NO: 66987 - DNA, 35 bp, Artificial Sequence
  Synthetic oligonucleotide
accacatgtaagaacctcactggtacgtatttttt

SEQ ID NO: 66988 - DNA, 36 bp, Artificial Sequence
  Synthetic oligonucleotide
gcacgtggccgccaccccctgaatcaagtgctaaaa

SEQ ID NO: 66989 - DNA, 36 bp, Artificial Sequence
  Synthetic oligonucleotide
tgaaccgacactttcttcgaactagcttgtaacaaa

SEQ ID NO: 66990 - DNA, 36 bp, Artificial Sequence
  Synthetic oligonucleotide
tatccccgcacactcgccgaactttggtctcataaa

SEQ ID NO: 66991 - DNA, 36 bp, Artificial Sequence
  Synthetic oligonucleotide
tcaattgccccacacgcttgttgtagatcacaacaa

SEQ ID NO: 66992 - DNA, 36 bp, Artificial Sequence
  Synthetic oligonucleotide
gatgcttcctggcccttcaatatcgtatctgttcaa

SEQ ID NO: 66993 - DNA, 36 bp, Artificial Sequence
  Synthetic oligonucleotide
gttgtgcggtgcaccccgtaattatgcccttgtgaa

SEQ ID NO: 66994 - DNA, 36 bp, Artificial Sequence
  Synthetic oligonucleotide
ttggtgtgggtgggccgtcggaataagggaggataa

SEQ ID NO: 66995 - DNA, 36 bp, Artificial Sequence
  Synthetic oligonucleotide
ggccacgccccatcccttgcttcccgcatgtctaca

SEQ ID NO: 66996 - DNA, 35 bp, Artificial Sequence
  Synthetic oligonucleotide
gtcacacaccaaggcttattttattgcttgcacca

SEQ ID NO: 66997 - DNA, 35 bp, Artificial Sequence
  Synthetic oligonucleotide
tgctattggcccccccccgtgatggtagcacatca

SEQ ID NO: 66998 - DNA, 36 bp, Artificial Sequence
  Synthetic oligonucleotide
atgcgtctaatctgcaccaccatctacgtaagctca

SEQ ID NO: 66999 - DNA, 36 bp, Artificial Sequence
  Synthetic oligonucleotide
ggcaccactgctgcctctgtccattatccaccttca

SEQ ID NO: 67000 - DNA, 36 bp, Artificial Sequence
  Synthetic oligonucleotide
tctccatactgagctgctgtacttctgcactgttca

SEQ ID NO: 67001 - DNA, 36 bp, Artificial Sequence
  Synthetic oligonucleotide
gaaacgtacctaacaggcgactttgcccccttttca

SEQ ID NO: 67002 - DNA, 36 bp, Artificial Sequence
  Synthetic oligonucleotide
tgtccatggcctgtctcaccataggagcctttttca

SEQ ID NO: 67003 - DNA, 37 bp, Artificial Sequence
  Synthetic oligonucleotide
tagactactccactcctccgatgctgcttgaacaaga

SEQ ID NO: 67004 - DNA, 37 bp, Artificial Sequence
  Synthetic oligonucleotide
agaggtgggtgggacaaaggggcgggctgccttgaga

SEQ ID NO: 67005 - DNA, 37 bp, Artificial Sequence
  Synthetic oligonucleotide
tccctcctcggcccttttcacacgtcacgcatgtaga

SEQ ID NO: 67006 - DNA, 37 bp, Artificial Sequence
  Synthetic oligonucleotide
atgactccccccccgcatgctttcaatcgggtaacga

SEQ ID NO: 67007 - DNA, 37 bp, Artificial Sequence
  Synthetic oligonucleotide
gactacatcaagtaccaccctagtcgttactacccga

SEQ ID NO: 67008 - DNA, 37 bp, Artificial Sequence
  Synthetic oligonucleotide
aacacggggcacttggtgctatggttccccttcccga

SEQ ID NO: 67009 - DNA, 35 bp, Artificial Sequence
  Synthetic oligonucleotide
atgccaagcagtttctgctcccgttacacctgcga

SEQ ID NO: 67010 - DNA, 37 bp, Artificial Sequence
  Synthetic oligonucleotide
tcacacgccgccccataaatagccattgcctcatcga

SEQ ID NO: 67011 - DNA, 37 bp, Artificial Sequence
  Synthetic oligonucleotide
tgccatgtgcctgtatcttttggcaacgtaatatcga

SEQ ID NO: 67012 - DNA, 37 bp, Artificial Sequence
  Synthetic oligonucleotide
ctcaccccgcaactagcttctaccgacgtcatttcga

SEQ ID NO: 67013 - DNA, 37 bp, Artificial Sequence
  Synthetic oligonucleotide
tttgtcgtcactcccgcgcactccactccattgagga

SEQ ID NO: 67014 - DNA, 37 bp, Artificial Sequence
  Synthetic oligonucleotide
acgaggccataaagcagcgtgggggaacattggcgga

SEQ ID NO: 67015 - DNA, 36 bp, Artificial Sequence
  Synthetic oligonucleotide
aagggaagccaaatagggaaggagataaggaaggga

SEQ ID NO: 67016 - DNA, 37 bp, Artificial Sequence
  Synthetic oligonucleotide
attgcacggagagggattgggttcatattgctcggga

SEQ ID NO: 67017 - DNA, 37 bp, Artificial Sequence
  Synthetic oligonucleotide
tccttgcaccaccgcgctctgtccctgccaagatgga

SEQ ID NO: 67018 - DNA, 36 bp, Artificial Sequence
  Synthetic oligonucleotide
tgccatccaggtactacgcatgtgctccattttgga

SEQ ID NO: 67019 - DNA, 37 bp, Artificial Sequence
  Synthetic oligonucleotide
gaaagcgggggaatggggtttaaggtgtataggatga

SEQ ID NO: 67020 - DNA, 38 bp, Artificial Sequence
  Synthetic oligonucleotide
ttgagtcagctgcagtgtgtgcgtattatagcggatga

SEQ ID NO: 67021 - DNA, 37 bp, Artificial Sequence
  Synthetic oligonucleotide
aacccatgcgcgaaactatatcaagatggccatctga

SEQ ID NO: 67022 - DNA, 38 bp, Artificial Sequence
  Synthetic oligonucleotide
tgcaccgacatcatcccgttctcttgtttacagtctga

SEQ ID NO: 67023 - DNA, 38 bp, Artificial Sequence
  Synthetic oligonucleotide
ggggacagcgaagtgggtgggagggatgcaaatagtga

SEQ ID NO: 67024 - DNA, 38 bp, Artificial Sequence
  Synthetic oligonucleotide
tcatgcagggggggaattggatgcgtcagttaaggtga

SEQ ID NO: 67025 - DNA, 38 bp, Artificial Sequence
  Synthetic oligonucleotide
gataatgtggggaaaggcgatcaagagtccgtctgtga

SEQ ID NO: 67026 - DNA, 38 bp, Artificial Sequence
  Synthetic oligonucleotide
gcctacccgccgtagctccagaaaactgtaccttgtga

SEQ ID NO: 67027 - DNA, 38 bp, Artificial Sequence
  Synthetic oligonucleotide
tatgcctctccgatccgcagagttaccccatcccttga

SEQ ID NO: 67028 - DNA, 38 bp, Artificial Sequence
  Synthetic oligonucleotide
tgcacttgttcccccggcctattcgcaaactgccttga

SEQ ID NO: 67029 - DNA, 37 bp, Artificial Sequence
  Synthetic oligonucleotide
tgcatctctgccaatccgcttaaccgactccgcttga

SEQ ID NO: 67030 - DNA, 38 bp, Artificial Sequence
  Synthetic oligonucleotide
tgtgaatgggccaatgggtgcggcaagtgggtggttga

SEQ ID NO: 67031 - DNA, 37 bp, Artificial Sequence
  Synthetic oligonucleotide
gccgcactacaccgtacccacgatctttattgtttga

SEQ ID NO: 67032 - DNA, 36 bp, Artificial Sequence
  Synthetic oligonucleotide
gagacgacatcccgcgtgcactcgctctactcacta

SEQ ID NO: 67033 - DNA, 36 bp, Artificial Sequence
  Synthetic oligonucleotide
gtgttggtcgcgcagtcactttctactctatgccta

SEQ ID NO: 67034 - DNA, 36 bp, Artificial Sequence
  Synthetic oligonucleotide
gaccctgggccctgcagcaacttgacaattgcgcta

SEQ ID NO: 67035 - DNA, 35 bp, Artificial Sequence
  Synthetic oligonucleotide
ggacatgttgccctgtccttcgtacgagccttcta

SEQ ID NO: 67036 - DNA, 36 bp, Artificial Sequence
  Synthetic oligonucleotide
tctacatgaccgactttgtctaatgcttaatcttta

SEQ ID NO: 67037 - DNA, 35 bp, Artificial Sequence
  Synthetic oligonucleotide
tcccccatacagccccctggtgcatgtactgtaac

SEQ ID NO: 67038 - DNA, 35 bp, Artificial Sequence
  Synthetic oligonucleotide
ttctatggaccgcccccgtaccacctctcggtacc

SEQ ID NO: 67039 - DNA, 35 bp, Artificial Sequence
  Synthetic oligonucleotide
tgtcggtgccccgcgtgctaacctgcccaactgcc

SEQ ID NO: 67040 - DNA, 35 bp, Artificial Sequence
  Synthetic oligonucleotide
tccctgtttcgtcaggcccaccgccctgcctgatc

SEQ ID NO: 67041 - DNA, 35 bp, Artificial Sequence
  Synthetic oligonucleotide
aggaccacccacgccgcaatatcaggcgagaactc

SEQ ID NO: 67042 - DNA, 35 bp, Artificial Sequence
  Synthetic oligonucleotide
taacccatgaccgagccatatggtccaatacactc

SEQ ID NO: 67043 - DNA, 35 bp, Artificial Sequence
  Synthetic oligonucleotide
gtcctcaaggcacttacccgctctggtactcgctc

SEQ ID NO: 67044 - DNA, 35 bp, Artificial Sequence
  Synthetic oligonucleotide
ccttcaaccccgccgttgttgacttttatacattc

SEQ ID NO: 67045 - DNA, 35 bp, Artificial Sequence
  Synthetic oligonucleotide
gactacacccgtggtcgcatggaacgcttacaacg

SEQ ID NO: 67046 - DNA, 35 bp, Artificial Sequence
  Synthetic oligonucleotide
aactcatttcgcccagaacttcccagtatgtaacg

SEQ ID NO: 67047 - DNA, 35 bp, Artificial Sequence
  Synthetic oligonucleotide
gcccccacggctcgattagcaccccacccttaccg

SEQ ID NO: 67048 - DNA, 35 bp, Artificial Sequence
  Synthetic oligonucleotide
acaaccagctgctagcttgcccataggcccctccg

SEQ ID NO: 67049 - DNA, 35 bp, Artificial Sequence
  Synthetic oligonucleotide
atccctccccgctcgccgccaccctgatgctatcg

SEQ ID NO: 67050 - DNA, 35 bp, Artificial Sequence
  Synthetic oligonucleotide
ttacttcagcgcccatcgtgactcacctatcttcg

SEQ ID NO: 67051 - DNA, 35 bp, Artificial Sequence
  Synthetic oligonucleotide
gattaccgtacccaacactgccgtagagaagttcg

SEQ ID NO: 67052 - DNA, 34 bp, Artificial Sequence
  Synthetic oligonucleotide
atgcctccccatctcctgttggagcctcaacagg

SEQ ID NO: 67053 - DNA, 35 bp, Artificial Sequence
  Synthetic oligonucleotide
ttgtgccatggccgggaatggtgagggtttgtgtg

SEQ ID NO: 67054 - DNA, 35 bp, Artificial Sequence
  Synthetic oligonucleotide
acccgagcagtcctgttccctacgttgggactttg

SEQ ID NO: 67055 - DNA, 35 bp, Artificial Sequence
  Synthetic oligonucleotide
agtccaccccgcatgtttggcataatacattgaat

SEQ ID NO: 67056 - DNA, 35 bp, Artificial Sequence
  Synthetic oligonucleotide
gactggtgcatggacgcgctcccacccgagtgact

SEQ ID NO: 67057 - DNA, 35 bp, Artificial Sequence
  Synthetic oligonucleotide
tcccagtagctccattttgagtccacccgttgcct

SEQ ID NO: 67058 - DNA, 35 bp, Artificial Sequence
  Synthetic oligonucleotide
atccaccccagccaatctgcccctgccaccattct

SEQ ID NO: 67059 - DNA, 35 bp, Artificial Sequence
  Synthetic oligonucleotide
gtaaccgccaggctgacatgggaggttcttgttct

SEQ ID NO: 67060 - DNA, 35 bp, Artificial Sequence
  Synthetic oligonucleotide
tccaccgtccatcaccgtcgacgctttctactggt

SEQ ID NO: 67061 - DNA, 35 bp, Artificial Sequence
  Synthetic oligonucleotide
acccgattagctcggtcttttcatggtacctcttt

SEQ ID NO: 67062 - DNA, 35 bp, Artificial Sequence
  Synthetic oligonucleotide
aactgacgctcccggcaagcctatttactccgttt

SEQ ID NO: 67063 - DNA, 35 bp, Artificial Sequence
  Synthetic oligonucleotide
accctttacgtgaaccatcctgcatgtggcctttt

SEQ ID NO: 67064 - DNA, 36 bp, Artificial Sequence
  Synthetic oligonucleotide
gccactttccagtccttgcacacgagcaactcacaa

SEQ ID NO: 67065 - DNA, 35 bp, Artificial Sequence
  Synthetic oligonucleotide
gccaccctcaaaatcccacctacctgtcacatcaa

SEQ ID NO: 67066 - DNA, 36 bp, Artificial Sequence
  Synthetic oligonucleotide
aacgaggaggaagacattaatcagcggggggtagaa

SEQ ID NO: 67067 - DNA, 35 bp, Artificial Sequence
  Synthetic oligonucleotide
gccaaggggagtggaggttgggcgccttagggtaa

SEQ ID NO: 67068 - DNA, 36 bp, Artificial Sequence
  Synthetic oligonucleotide
gaccggaaagcctctcatatgccactgatctcgaca

SEQ ID NO: 67069 - DNA, 35 bp, Artificial Sequence
  Synthetic oligonucleotide
gcgccctcgacatgaaacgcctcagccctaggaca

SEQ ID NO: 67070 - DNA, 35 bp, Artificial Sequence
  Synthetic oligonucleotide
acacctttcgaacatgtactgtggtcgacacacca

SEQ ID NO: 67071 - DNA, 36 bp, Artificial Sequence
  Synthetic oligonucleotide
tctccaccgctgcctgttagccaactagacagccca

SEQ ID NO: 67072 - DNA, 36 bp, Artificial Sequence
  Synthetic oligonucleotide
agatgcatcgtcccctgtgcgctatccaccgtgcca

SEQ ID NO: 67073 - DNA, 36 bp, Artificial Sequence
  Synthetic oligonucleotide
atacacgctcctcgaaaaacccctgcacattgagca

SEQ ID NO: 67074 - DNA, 36 bp, Artificial Sequence
  Synthetic oligonucleotide
aatgggagggtggagttgcagttggagtggtccgca

SEQ ID NO: 67075 - DNA, 35 bp, Artificial Sequence
  Synthetic oligonucleotide
gtgagtgagagggaggtgagggtgtttttacggca

SEQ ID NO: 67076 - DNA, 36 bp, Artificial Sequence
  Synthetic oligonucleotide
gaaagcaaaggccgaagagataagggcgggcattca

SEQ ID NO: 67077 - DNA, 37 bp, Artificial Sequence
  Synthetic oligonucleotide
gataagagactggaggggagtggtaagggcatataga

SEQ ID NO: 67078 - DNA, 36 bp, Artificial Sequence
  Synthetic oligonucleotide
taggggaggactattggggtggtggccaggcaacga

SEQ ID NO: 67079 - DNA, 36 bp, Artificial Sequence
  Synthetic oligonucleotide
tccatgacggccatagtttcggtcttccacccacga

SEQ ID NO: 67080 - DNA, 37 bp, Artificial Sequence
  Synthetic oligonucleotide
gttgacaccccgcttgatgaatttctgttgtcaccga

SEQ ID NO: 67081 - DNA, 37 bp, Artificial Sequence
  Synthetic oligonucleotide
ttccgcccactgttggcccctattgttagctctgcga

SEQ ID NO: 67082 - DNA, 37 bp, Artificial Sequence
  Synthetic oligonucleotide
aatggcaagggtgaggatgcgaactcaggtaggagga

SEQ ID NO: 67083 - DNA, 37 bp, Artificial Sequence
  Synthetic oligonucleotide
atgagccgggacaagatgcagggtgggaaagcgggga

SEQ ID NO: 67084 - DNA, 37 bp, Artificial Sequence
  Synthetic oligonucleotide
tagggtagcacgtagggaggggagagcgaatcgggga

SEQ ID NO: 67085 - DNA, 36 bp, Artificial Sequence
  Synthetic oligonucleotide
gatcgggatgagagcgaacggaaaagctgctgggga

SEQ ID NO: 67086 - DNA, 36 bp, Artificial Sequence
  Synthetic oligonucleotide
tgaatccaacgccgtcacacacaattggacctggga

SEQ ID NO: 67087 - DNA, 37 bp, Artificial Sequence
  Synthetic oligonucleotide
taccgcaacacagcgattcactacgcgccatctggga

SEQ ID NO: 67088 - DNA, 38 bp, Artificial Sequence
  Synthetic oligonucleotide
tagtgcagatgggggtgaaggtggttgggtgacaatga

SEQ ID NO: 67089 - DNA, 38 bp, Artificial Sequence
  Synthetic oligonucleotide
gcaagaaccgggggaagaaggggcaagactatacatga

SEQ ID NO: 67090 - DNA, 37 bp, Artificial Sequence
  Synthetic oligonucleotide
tcccgcattacatccctcccgaccgttcttgcgatga

SEQ ID NO: 67091 - DNA, 37 bp, Artificial Sequence
  Synthetic oligonucleotide
tcccctcacccctcgatattatccgtgatccggatga

SEQ ID NO: 67092 - DNA, 37 bp, Artificial Sequence
  Synthetic oligonucleotide
gttcaccccacctctgcgctgttcccaaaaacactga

SEQ ID NO: 67093 - DNA, 36 bp, Artificial Sequence
  Synthetic oligonucleotide
ttcggtgcctcttgaagcacggattatcccccctga

SEQ ID NO: 67094 - DNA, 38 bp, Artificial Sequence
  Synthetic oligonucleotide
atacactccgaccgactcctcgttatgtacattcctga

SEQ ID NO: 67095 - DNA, 38 bp, Artificial Sequence
  Synthetic oligonucleotide
aagtgggggatggagaggtgtatgggaggagcagctga

SEQ ID NO: 67096 - DNA, 38 bp, Artificial Sequence
  Synthetic oligonucleotide
gatttcagcgctacatcccttcccattgtgcaacgtga

SEQ ID NO: 67097 - DNA, 38 bp, Artificial Sequence
  Synthetic oligonucleotide
tgccgcccatgccacccacgttcgttttttattcgtga

SEQ ID NO: 67098 - DNA, 37 bp, Artificial Sequence
  Synthetic oligonucleotide
tctgtggaggaatggtggtaggatcgggttgaggtga

SEQ ID NO: 67099 - DNA, 35 bp, Artificial Sequence
  Synthetic oligonucleotide
ggggaggatgggggaacaaacgaggcgacctgtga

SEQ ID NO: 67100 - DNA, 38 bp, Artificial Sequence
  Synthetic oligonucleotide
tgtgtgagctctcaaccacgcttagtaacatctcttga

SEQ ID NO: 67101 - DNA, 38 bp, Artificial Sequence
  Synthetic oligonucleotide
atggtgcaggtggccgaaaagctgagttggtgggttga

SEQ ID NO: 67102 - DNA, 38 bp, Artificial Sequence
  Synthetic oligonucleotide
gatccgcggactgggccatcctacattcctcttgttga

SEQ ID NO: 67103 - DNA, 37 bp, Artificial Sequence
  Synthetic oligonucleotide
tgctcagcccatggttaacctgtcaccccttttttga

SEQ ID NO: 67104 - DNA, 36 bp, Artificial Sequence
  Synthetic oligonucleotide
acgattccacggtgctgccttccgtttccaatcata

SEQ ID NO: 67105 - DNA, 36 bp, Artificial Sequence
  Synthetic oligonucleotide
tccgcatgcacccccaaacggagtgaattgccacta

SEQ ID NO: 67106 - DNA, 36 bp, Artificial Sequence
  Synthetic oligonucleotide
gaacaagcaccaatactaattcactactgtgctcta

SEQ ID NO: 67107 - DNA, 35 bp, Artificial Sequence
  Synthetic oligonucleotide
atcaacccctatggctttcggtcttctccccagta

SEQ ID NO: 67108 - DNA, 36 bp, Artificial Sequence
  Synthetic oligonucleotide
ctgcctgcatggttgtctgacacttttctcctggta

SEQ ID NO: 67109 - DNA, 35 bp, Artificial Sequence
  Synthetic oligonucleotide
tgcctccagggtagctggacacccaccacctcgac

SEQ ID NO: 67110 - DNA, 35 bp, Artificial Sequence
  Synthetic oligonucleotide
agatccaccacccatgtcaacgaccctgttgatac

SEQ ID NO: 67111 - DNA, 34 bp, Artificial Sequence
  Synthetic oligonucleotide
agtcggccacccgttttcccgaagccgcttgtac

SEQ ID NO: 67112 - DNA, 35 bp, Artificial Sequence
  Synthetic oligonucleotide
gaccagcagtcacttaaccgtctacaggctctccc

SEQ ID NO: 67113 - DNA, 35 bp, Artificial Sequence
  Synthetic oligonucleotide
gtgggccgcccctttgaactcttatccagttatgc

SEQ ID NO: 67114 - DNA, 35 bp, Artificial Sequence
  Synthetic oligonucleotide
atacggaacgggccgtgctcccctaattatgctgc

SEQ ID NO: 67115 - DNA, 35 bp, Artificial Sequence
  Synthetic oligonucleotide
tacacgctctgaactccacgtcccgaatcttgtgc

SEQ ID NO: 67116 - DNA, 35 bp, Artificial Sequence
  Synthetic oligonucleotide
tgatgagacgcctgaatgccattgttactatttgc

SEQ ID NO: 67117 - DNA, 35 bp, Artificial Sequence
  Synthetic oligonucleotide
gtcctctccgcactcgcgcttgcgacgttgcaatc

SEQ ID NO: 67118 - DNA, 35 bp, Artificial Sequence
  Synthetic oligonucleotide
ttccaccgccgtagctgccaacaaacgtctgcatc

SEQ ID NO: 67119 - DNA, 35 bp, Artificial Sequence
  Synthetic oligonucleotide
gagcaccaggtccggcttcgaggatctagcacctc

SEQ ID NO: 67120 - DNA, 35 bp, Artificial Sequence
  Synthetic oligonucleotide
gtacgcgccaacatccctaattttgtgacgtgctc

SEQ ID NO: 67121 - DNA, 35 bp, Artificial Sequence
  Synthetic oligonucleotide
tcgtggggggctacattgttatgattcccgttctc

SEQ ID NO: 67122 - DNA, 35 bp, Artificial Sequence
  Synthetic oligonucleotide
atttcactcaccccttgttattatcacctacagag

SEQ ID NO: 67123 - DNA, 35 bp, Artificial Sequence
  Synthetic oligonucleotide
taagcaaaccgacttgtaaccctccgccccgatag

SEQ ID NO: 67124 - DNA, 35 bp, Artificial Sequence
  Synthetic oligonucleotide
tctaacgtgcgcgcctgccctgctccatctcttag

SEQ ID NO: 67125 - DNA, 35 bp, Artificial Sequence
  Synthetic oligonucleotide
tacgacaactggccttaaaaactgtcagctcgacg

SEQ ID NO: 67126 - DNA, 35 bp, Artificial Sequence
  Synthetic oligonucleotide
aatccccactgctcatcatctacagccttagctgg

SEQ ID NO: 67127 - DNA, 35 bp, Artificial Sequence
  Synthetic oligonucleotide
accctaatcctcgccccccctcgttaatgtgtgtg

SEQ ID NO: 67128 - DNA, 35 bp, Artificial Sequence
  Synthetic oligonucleotide
aggtgtgacggggggcagaaggaaagtggagggat

SEQ ID NO: 67129 - DNA, 35 bp, Artificial Sequence
  Synthetic oligonucleotide
aaacataccccaggccgttactagtctttcgccct

SEQ ID NO: 67130 - DNA, 35 bp, Artificial Sequence
  Synthetic oligonucleotide
ttgtccacggcctactctggcgaattaagcatcct

SEQ ID NO: 67131 - DNA, 35 bp, Artificial Sequence
  Synthetic oligonucleotide
acaacaaaggctctgaccacgaccgtccctgtcct

SEQ ID NO: 67132 - DNA, 35 bp, Artificial Sequence
  Synthetic oligonucleotide
tagatgatatcggccacgtcgctttggtttcctct

SEQ ID NO: 67133 - DNA, 35 bp, Artificial Sequence
  Synthetic oligonucleotide
ttacccgtagcgtgcacccttagtcggtttcgtct

SEQ ID NO: 67134 - DNA, 35 bp, Artificial Sequence
  Synthetic oligonucleotide
ggatcatcatcgggcgtggggctcttctatctcgt

SEQ ID NO: 67135 - DNA, 35 bp, Artificial Sequence
  Synthetic oligonucleotide
ggaccccctcgcaactaatagcgccttatatactt

SEQ ID NO: 67136 - DNA, 35 bp, Artificial Sequence
  Synthetic oligonucleotide
gacgaccattccctcccctagttgccctaaggctt

SEQ ID NO: 67137 - DNA, 35 bp, Artificial Sequence
  Synthetic oligonucleotide
aacgcttccctagccacggtaccactatccctgtt

SEQ ID NO: 67138 - DNA, 35 bp, Artificial Sequence
  Synthetic oligonucleotide
tctcacccagcctccatccgttcgttaatgggttt

SEQ ID NO: 67139 - DNA, 35 bp, Artificial Sequence
  Synthetic oligonucleotide
gtatccctcagataccttgttccaccaactttttt

SEQ ID NO: 67140 - DNA, 36 bp, Artificial Sequence
  Synthetic oligonucleotide
aatgcaggcctctgttacaccgtgtaaactctcgaa

SEQ ID NO: 67141 - DNA, 35 bp, Artificial Sequence
  Synthetic oligonucleotide
tccaaataaagtgggggtggtggtaggcacagtaa

SEQ ID NO: 67142 - DNA, 36 bp, Artificial Sequence
  Synthetic oligonucleotide
acaggtctgtcccatctgccaaatatgcaatcccca

SEQ ID NO: 67143 - DNA, 36 bp, Artificial Sequence
  Synthetic oligonucleotide
atccccgctacacagcaagtgacttcgacttagcca

SEQ ID NO: 67144 - DNA, 36 bp, Artificial Sequence
  Synthetic oligonucleotide
tcgcatcggcgatcttcagcctccgactgccttcca

SEQ ID NO: 67145 - DNA, 36 bp, Artificial Sequence
  Synthetic oligonucleotide
acccgaacgctactctataccagcacacagaccgca

SEQ ID NO: 67146 - DNA, 36 bp, Artificial Sequence
  Synthetic oligonucleotide
gtctcacacgcaggttccgcccagaagctccccgca

SEQ ID NO: 67147 - DNA, 35 bp, Artificial Sequence
  Synthetic oligonucleotide
aacagcaactgtcccccctatcattcgattttgca

SEQ ID NO: 67148 - DNA, 35 bp, Artificial Sequence
  Synthetic oligonucleotide
actcatccgccacccgctcaggccccgcactctca

SEQ ID NO: 67149 - DNA, 36 bp, Artificial Sequence
  Synthetic oligonucleotide
acacgttcgtacccgttcttgaatcctccgcattca

SEQ ID NO: 67150 - DNA, 36 bp, Artificial Sequence
  Synthetic oligonucleotide
acacgactaacagtctcttcaggatccccgccttca

SEQ ID NO: 67151 - DNA, 36 bp, Artificial Sequence
  Synthetic oligonucleotide
ggggtggttggtgtgggcttggggtgttgaggttca

SEQ ID NO: 67152 - DNA, 37 bp, Artificial Sequence
  Synthetic oligonucleotide
ttgccggggggaggggcacagggcggagatcataaga

SEQ ID NO: 67153 - DNA, 37 bp, Artificial Sequence
  Synthetic oligonucleotide
tcatcccagccccccctagcacctcctaaccgtgaga

SEQ ID NO: 67154 - DNA, 37 bp, Artificial Sequence
  Synthetic oligonucleotide
gtgaccgggtgggaataatggcattggtagatataga

SEQ ID NO: 67155 - DNA, 37 bp, Artificial Sequence
  Synthetic oligonucleotide
gagcatcacattcgttccagaccatgccatatcacga

SEQ ID NO: 67156 - DNA, 37 bp, Artificial Sequence
  Synthetic oligonucleotide
gattgcccatgttagacagcgctttttgtggccccga

SEQ ID NO: 67157 - DNA, 36 bp, Artificial Sequence
  Synthetic oligonucleotide
tcactcgttccatcctgcattatgtctgttgcccga

SEQ ID NO: 67158 - DNA, 36 bp, Artificial Sequence
  Synthetic oligonucleotide
accacagctcgcccccggattgagccgcacctccga

SEQ ID NO: 67159 - DNA, 37 bp, Artificial Sequence
  Synthetic oligonucleotide
accgtgcacctgctcagttccatcccaattttttcga

SEQ ID NO: 67160 - DNA, 37 bp, Artificial Sequence
  Synthetic oligonucleotide
atgcgttaggtgatgaggaagatggtgttggggtgga

SEQ ID NO: 67161 - DNA, 37 bp, Artificial Sequence
  Synthetic oligonucleotide
ggaagggagattagctcgtggagagggggggtgtgga

SEQ ID NO: 67162 - DNA, 38 bp, Artificial Sequence
  Synthetic oligonucleotide
gcattccacccgccagacggctaggcgaaaacccatga

SEQ ID NO: 67163 - DNA, 38 bp, Artificial Sequence
  Synthetic oligonucleotide
tatgcccgtaatgtactcaatggtcctcgatctcatga

SEQ ID NO: 67164 - DNA, 38 bp, Artificial Sequence
  Synthetic oligonucleotide
ggagtggaggaagggaactgttgacgatgaatggatga

SEQ ID NO: 67165 - DNA, 38 bp, Artificial Sequence
  Synthetic oligonucleotide
tttgcagtcgtagtgacgtgccgaaccttcccttatga

SEQ ID NO: 67166 - DNA, 37 bp, Artificial Sequence
  Synthetic oligonucleotide
ttggtgccctcgttctccggactagttccatcactga

SEQ ID NO: 67167 - DNA, 38 bp, Artificial Sequence
  Synthetic oligonucleotide
accgacgtgcccgaaagcacccacttgttccttactga

SEQ ID NO: 67168 - DNA, 38 bp, Artificial Sequence
  Synthetic oligonucleotide
gaccaccgcttacctactgcatttattgagctacctga

SEQ ID NO: 67169 - DNA, 38 bp, Artificial Sequence
  Synthetic oligonucleotide
gcccacaccctcaatcgcttctttgacactagccctga

SEQ ID NO: 67170 - DNA, 38 bp, Artificial Sequence
  Synthetic oligonucleotide
taagccggccggctgtccgtacctatgttcgtccctga

SEQ ID NO: 67171 - DNA, 38 bp, Artificial Sequence
  Synthetic oligonucleotide
agtactggaccatggcataacaccattcagtctcctga

SEQ ID NO: 67172 - DNA, 38 bp, Artificial Sequence
  Synthetic oligonucleotide
gttgcctcagtaattgtctccctcgtccccgaatctga

SEQ ID NO: 67173 - DNA, 38 bp, Artificial Sequence
  Synthetic oligonucleotide
gtagggccactcccgactccatgttacgcacacagtga

SEQ ID NO: 67174 - DNA, 37 bp, Artificial Sequence
  Synthetic oligonucleotide
gtagcgggaggccatgggttagggggttatgcagtga

SEQ ID NO: 67175 - DNA, 38 bp, Artificial Sequence
  Synthetic oligonucleotide
aagagcaacgcatggagggtggagtcattcgatagtga

SEQ ID NO: 67176 - DNA, 37 bp, Artificial Sequence
  Synthetic oligonucleotide
ttgccaaccaccatgggcaccgtcgcctgactagtga

SEQ ID NO: 67177 - DNA, 38 bp, Artificial Sequence
  Synthetic oligonucleotide
aaacaaacgtcaggttcacaacgctctcccacccgtga

SEQ ID NO: 67178 - DNA, 38 bp, Artificial Sequence
  Synthetic oligonucleotide
atcaagggccgactttaagggtgggtaggtgtgggtga

SEQ ID NO: 67179 - DNA, 38 bp, Artificial Sequence
  Synthetic oligonucleotide
acacgcactcgctggattggcttctccagcatccttga

SEQ ID NO: 67180 - DNA, 38 bp, Artificial Sequence
  Synthetic oligonucleotide
gcccccgtgtcattccgtcctccgagcctgaagcttga

SEQ ID NO: 67181 - DNA, 37 bp, Artificial Sequence
  Synthetic oligonucleotide
catttgccccgcgcaggggacgaccttttaacgttga

SEQ ID NO: 67182 - DNA, 38 bp, Artificial Sequence
  Synthetic oligonucleotide
tgtgtctgagcgtatctccttttacttcccgtggttga

SEQ ID NO: 67183 - DNA, 35 bp, Artificial Sequence
  Synthetic oligonucleotide
actgaaggacggtgggtcgtgacatgatgaacata

SEQ ID NO: 67184 - DNA, 36 bp, Artificial Sequence
  Synthetic oligonucleotide
gtctctacacaggaggctcatcacgttaccttccta

SEQ ID NO: 67185 - DNA, 36 bp, Artificial Sequence
  Synthetic oligonucleotide
gtgtcaatcctccgctcgtcatcccgatttccgcta

SEQ ID NO: 67186 - DNA, 36 bp, Artificial Sequence
  Synthetic oligonucleotide
gacacatgggaaacagagggagtggagagggttgta

SEQ ID NO: 67187 - DNA, 35 bp, Artificial Sequence
  Synthetic oligonucleotide
aacccgcctctcattactttttgggaccagagtta

SEQ ID NO: 67188 - DNA, 35 bp, Artificial Sequence
  Synthetic oligonucleotide
gactcggcgaagggaacttccattaccggttcaac

SEQ ID NO: 67189 - DNA, 35 bp, Artificial Sequence
  Synthetic oligonucleotide
accccgtcaacgcacccatgccttccactccgcac

SEQ ID NO: 67190 - DNA, 35 bp, Artificial Sequence
  Synthetic oligonucleotide
aaccggtgcacgccgaaaacacagtagatcttgac

SEQ ID NO: 67191 - DNA, 35 bp, Artificial Sequence
  Synthetic oligonucleotide
gcgcacaagaacacgtcgtgcgtcacttcctttac

SEQ ID NO: 67192 - DNA, 35 bp, Artificial Sequence
  Synthetic oligonucleotide
tgatattggccgacctgtttttctttcttctttac

SEQ ID NO: 67193 - DNA, 35 bp, Artificial Sequence
  Synthetic oligonucleotide
gctgccggggattaatatgcttgtcccgcaccacc

SEQ ID NO: 67194 - DNA, 35 bp, Artificial Sequence
  Synthetic oligonucleotide
aacatgccacacgtggagtcgtttatcgggtaccc

SEQ ID NO: 67195 - DNA, 35 bp, Artificial Sequence
  Synthetic oligonucleotide
atacgctacatcgagggtccatcgatttctccccc

SEQ ID NO: 67196 - DNA, 35 bp, Artificial Sequence
  Synthetic oligonucleotide
gtgatctcatcggtctacgccttttaaccgtatcc

SEQ ID NO: 67197 - DNA, 35 bp, Artificial Sequence
  Synthetic oligonucleotide
aaccacgtcgaccctagcccgcttaaacggtttcc

SEQ ID NO: 67198 - DNA, 35 bp, Artificial Sequence
  Synthetic oligonucleotide
gtacccgctggctctctcgggacgctccttccagc

SEQ ID NO: 67199 - DNA, 35 bp, Artificial Sequence
  Synthetic oligonucleotide
attctaccccccaagtcgccgcgcatcttcacggc

SEQ ID NO: 67200 - DNA, 35 bp, Artificial Sequence
  Synthetic oligonucleotide
tgtgagcccacctatcccttttgcacgacatgtgc

SEQ ID NO: 67201 - DNA, 35 bp, Artificial Sequence
  Synthetic oligonucleotide
gcaaccgtaacattacagaacatggtccacccctc

SEQ ID NO: 67202 - DNA, 35 bp, Artificial Sequence
  Synthetic oligonucleotide
accacacaatccagggccctccattcggtttcctc

SEQ ID NO: 67203 - DNA, 35 bp, Artificial Sequence
  Synthetic oligonucleotide
aatccggtaggggggagttgccgaatggatcagtc

SEQ ID NO: 67204 - DNA, 35 bp, Artificial Sequence
  Synthetic oligonucleotide
ttgcgcagaagccatcctcgtagattttaccattc

SEQ ID NO: 67205 - DNA, 35 bp, Artificial Sequence
  Synthetic oligonucleotide
gacaatgggggggtagtaatatagcgggggtgttc

SEQ ID NO: 67206 - DNA, 35 bp, Artificial Sequence
  Synthetic oligonucleotide
taggagaacgggagaaataggtacagacatagaag

SEQ ID NO: 67207 - DNA, 35 bp, Artificial Sequence
  Synthetic oligonucleotide
tacacctctgttcttctttacacacatttttggag

SEQ ID NO: 67208 - DNA, 35 bp, Artificial Sequence
  Synthetic oligonucleotide
gcttcgtcacctggccctctatcttaatcgttgag

SEQ ID NO: 67209 - DNA, 35 bp, Artificial Sequence
  Synthetic oligonucleotide
ggaccatacacagaagtataccctacttaccctag

SEQ ID NO: 67210 - DNA, 36 bp, Artificial Sequence
  Synthetic oligonucleotide
tgccattaggtgtcggcctccatcttcgctccaacg

SEQ ID NO: 67211 - DNA, 35 bp, Artificial Sequence
  Synthetic oligonucleotide
acatgccatctctttgcggttttacgttccagtcg

SEQ ID NO: 67212 - DNA, 35 bp, Artificial Sequence
  Synthetic oligonucleotide
gactgctggcggagaccataggagataagtaaagg

SEQ ID NO: 67213 - DNA, 35 bp, Artificial Sequence
  Synthetic oligonucleotide
gggatggtaggaggtaactatagcgtatggtgggg

SEQ ID NO: 67214 - DNA, 35 bp, Artificial Sequence
  Synthetic oligonucleotide
gcgagctgcagggggtgagggggaatggtaatatg

SEQ ID NO: 67215 - DNA, 35 bp, Artificial Sequence
  Synthetic oligonucleotide
tgccccccactcgcgcttgatgaaagtccgaactg

SEQ ID NO: 67216 - DNA, 35 bp, Artificial Sequence
  Synthetic oligonucleotide
gcatcgcacaatgaacaacgaaaactagtgaactg

SEQ ID NO: 67217 - DNA, 35 bp, Artificial Sequence
  Synthetic oligonucleotide
tcaactgacatcttgccttttttgcgacttctttg

SEQ ID NO: 67218 - DNA, 35 bp, Artificial Sequence
  Synthetic oligonucleotide
gtcaacctctgcccctagacttgccccccgaagat

SEQ ID NO: 67219 - DNA, 35 bp, Artificial Sequence
  Synthetic oligonucleotide
gcacctctactggatggcccatgaccccacactat

SEQ ID NO: 67220 - DNA, 35 bp, Artificial Sequence
  Synthetic oligonucleotide
gtacactcctgtcgtcaattcttaccccgttttat

SEQ ID NO: 67221 - DNA, 35 bp, Artificial Sequence
  Synthetic oligonucleotide
acgagccgtttccctccaggtgcgccatcctgact

SEQ ID NO: 67222 - DNA, 35 bp, Artificial Sequence
  Synthetic oligonucleotide
tcccgttggcaattttgggcctccgatttcttact

SEQ ID NO: 67223 - DNA, 35 bp, Artificial Sequence
  Synthetic oligonucleotide
agacagctacaccctctgttccggccttttcgcct

SEQ ID NO: 67224 - DNA, 35 bp, Artificial Sequence
  Synthetic oligonucleotide
gccgccgtgccaacgtaccttgacaacttttagct

SEQ ID NO: 67225 - DNA, 35 bp, Artificial Sequence
  Synthetic oligonucleotide
gatgtaccgtccacagtcttgctcctgactagggt

SEQ ID NO: 67226 - DNA, 35 bp, Artificial Sequence
  Synthetic oligonucleotide
aactgactggcaaggaagttccccccctcttttgt

SEQ ID NO: 67227 - DNA, 35 bp, Artificial Sequence
  Synthetic oligonucleotide
gccataactgcagggcttgggactacgttggaatt

SEQ ID NO: 67228 - DNA, 35 bp, Artificial Sequence
  Synthetic oligonucleotide
tgaaccggtacacacctgcactcattatagcgatt

SEQ ID NO: 67229 - DNA, 35 bp, Artificial Sequence
  Synthetic oligonucleotide
tttcaaccgcgcttaccgccgggtactatctcctt

SEQ ID NO: 67230 - DNA, 35 bp, Artificial Sequence
  Synthetic oligonucleotide
tcatcgcgcccttttaatgcccacacacagacaaa

SEQ ID NO: 67231 - DNA, 35 bp, Artificial Sequence
  Synthetic oligonucleotide
accgggaggggacggttagagttgagcgcggcaaa

SEQ ID NO: 67232 - DNA, 36 bp, Artificial Sequence
  Synthetic oligonucleotide
gcgcacaccttcatcgggaccctggcaagcctccaa

SEQ ID NO: 67233 - DNA, 35 bp, Artificial Sequence
  Synthetic oligonucleotide
gactgcattacacttcgggtcttcttcagtttcaa

SEQ ID NO: 67234 - DNA, 35 bp, Artificial Sequence
  Synthetic oligonucleotide
acctccacctgtacggtcttgcgtagttagacgaa

SEQ ID NO: 67235 - DNA, 36 bp, Artificial Sequence
  Synthetic oligonucleotide
tgacacgtactcattgactatacgtccgtctgctaa

SEQ ID NO: 67236 - DNA, 36 bp, Artificial Sequence
  Synthetic oligonucleotide
attggccaccactctccccggaacatcacgcagtaa

SEQ ID NO: 67237 - DNA, 36 bp, Artificial Sequence
  Synthetic oligonucleotide
tcctatctgtcaccgcgccaccttcgcgttcgccca

SEQ ID NO: 67238 - DNA, 36 bp, Artificial Sequence
  Synthetic oligonucleotide
gccggggagggtggcatttgagggttttgatttgca

SEQ ID NO: 67239 - DNA, 36 bp, Artificial Sequence
  Synthetic oligonucleotide
ttctcggtcgccgagccacatcctactctaatgtca

SEQ ID NO: 67240 - DNA, 37 bp, Artificial Sequence
  Synthetic oligonucleotide
gccccaccgcacattttttttgttacctgcctcaaga

SEQ ID NO: 67241 - DNA, 37 bp, Artificial Sequence
  Synthetic oligonucleotide
gttcatcccgatttattctgtgctacatccaacgaga

SEQ ID NO: 67242 - DNA, 37 bp, Artificial Sequence
  Synthetic oligonucleotide
gcatggggaagggccgagacagggggcgcatgtgaga

SEQ ID NO: 67243 - DNA, 36 bp, Artificial Sequence
  Synthetic oligonucleotide
gtggatgtgatggactatagggagagagagaaacga

SEQ ID NO: 67244 - DNA, 37 bp, Artificial Sequence
  Synthetic oligonucleotide
acctactcccaccaagtgacctctgccgtatggccga

SEQ ID NO: 67245 - DNA, 37 bp, Artificial Sequence
  Synthetic oligonucleotide
agacatgttcggcccgccccacaccgctgcactccga

SEQ ID NO: 67246 - DNA, 35 bp, Artificial Sequence
  Synthetic oligonucleotide
agttaacacgccaaccgtccaccgcacctccgcga

SEQ ID NO: 67247 - DNA, 36 bp, Artificial Sequence
  Synthetic oligonucleotide
tgaccaggtagagagcgatgcataaggatgcccgga

SEQ ID NO: 67248 - DNA, 35 bp, Artificial Sequence
  Synthetic oligonucleotide
ttgacgcgatccactcacaccctgctaatgccgga

SEQ ID NO: 67249 - DNA, 37 bp, Artificial Sequence
  Synthetic oligonucleotide
tccacggacgcttccacaagcctctcttcctctcgga

SEQ ID NO: 67250 - DNA, 37 bp, Artificial Sequence
  Synthetic oligonucleotide
aatgaagggggggtagaggggcttgactcccgaggga

SEQ ID NO: 67251 - DNA, 37 bp, Artificial Sequence
  Synthetic oligonucleotide
ttaccgagccgcatgtgtgcccctgtttttgtctgga

SEQ ID NO: 67252 - DNA, 36 bp, Artificial Sequence
  Synthetic oligonucleotide
tccctccgcaccatcctgggtccgcctgtttttgga

SEQ ID NO: 67253 - DNA, 38 bp, Artificial Sequence
  Synthetic oligonucleotide
tttgcaccccattgctataccttacattttcataatga

SEQ ID NO: 67254 - DNA, 38 bp, Artificial Sequence
  Synthetic oligonucleotide
tacgaactatgcttgcttgctctacagtcacttcatga

SEQ ID NO: 67255 - DNA, 38 bp, Artificial Sequence
  Synthetic oligonucleotide
ttcgagcatcgttttgccaccatcacgctcctccctga

SEQ ID NO: 67256 - DNA, 36 bp, Artificial Sequence
  Synthetic oligonucleotide
acctcacgaacacaccgttttatcacccgcgcctga

SEQ ID NO: 67257 - DNA, 38 bp, Artificial Sequence
  Synthetic oligonucleotide
tccggtcacctaccctgattagccgcctcggttcctga

SEQ ID NO: 67258 - DNA, 38 bp, Artificial Sequence
  Synthetic oligonucleotide
aaccacgttacgactcatagcaaccgacgcatctctga

SEQ ID NO: 67259 - DNA, 38 bp, Artificial Sequence
  Synthetic oligonucleotide
gtcacatcactgctctctcacaacgttcgcctctctga

SEQ ID NO: 67260 - DNA, 38 bp, Artificial Sequence
  Synthetic oligonucleotide
gcccctcttcaatcgctaccgaccttcgctctgcgtga

SEQ ID NO: 67261 - DNA, 38 bp, Artificial Sequence
  Synthetic oligonucleotide
gtgccagagccgtaggaaaatgcgggagggcacggtga

SEQ ID NO: 67262 - DNA, 37 bp, Artificial Sequence
  Synthetic oligonucleotide
gcatgcaacgttaaccatgtctatcctgcccctgtga

SEQ ID NO: 67263 - DNA, 38 bp, Artificial Sequence
  Synthetic oligonucleotide
gacacgcctcatagtccctgactcagctatatctgtga

SEQ ID NO: 67264 - DNA, 37 bp, Artificial Sequence
  Synthetic oligonucleotide
taacaccctctctcgctgatgcacctcatctctgtga

SEQ ID NO: 67265 - DNA, 37 bp, Artificial Sequence
  Synthetic oligonucleotide
ttactggccagcgcgtacgtcctgtttcatcccttga

SEQ ID NO: 67266 - DNA, 38 bp, Artificial Sequence
  Synthetic oligonucleotide
aaacgttccgagcgtatccagcccgttgccatccttga

SEQ ID NO: 67267 - DNA, 38 bp, Artificial Sequence
  Synthetic oligonucleotide
attcgtcccgcccattatgtcctaccacatcgtcttga

SEQ ID NO: 67268 - DNA, 38 bp, Artificial Sequence
  Synthetic oligonucleotide
gggtggagggaggaggggtcagcaaggtgtcaatttga

SEQ ID NO: 67269 - DNA, 38 bp, Artificial Sequence
  Synthetic oligonucleotide
tcacgctgcagactctttcgcaccccgttgacttttga

SEQ ID NO: 67270 - DNA, 38 bp, Artificial Sequence
  Synthetic oligonucleotide
ggtgccagccgttccctgcctgtgtacgcaccttttga

SEQ ID NO: 67271 - DNA, 36 bp, Artificial Sequence
  Synthetic oligonucleotide
actccgaacagttgctcttttgagtgaacccccata

SEQ ID NO: 67272 - DNA, 35 bp, Artificial Sequence
  Synthetic oligonucleotide
ggagccagataccgcctttgatgtacctttccata

SEQ ID NO: 67273 - DNA, 36 bp, Artificial Sequence
  Synthetic oligonucleotide
tacatcggccaataatactgtcctcttttagcgata

SEQ ID NO: 67274 - DNA, 36 bp, Artificial Sequence
  Synthetic oligonucleotide
ttatcacgcgtgtctcaaccatggccctccctagta

SEQ ID NO: 67275 - DNA, 36 bp, Artificial Sequence
  Synthetic oligonucleotide
gtgggatcacttgcgctctaacattctgtcgcctta

SEQ ID NO: 67276 - DNA, 35 bp, Artificial Sequence
  Synthetic oligonucleotide
attgagccccgaggacgggaccggccccttacaac

SEQ ID NO: 67277 - DNA, 35 bp, Artificial Sequence
  Synthetic oligonucleotide
tcccggcccagccgcattatcatcggagtcccaac

SEQ ID NO: 67278 - DNA, 35 bp, Artificial Sequence
  Synthetic oligonucleotide
tctgcaccaagtggtgcttcgccgatctctcatac

SEQ ID NO: 67279 - DNA, 35 bp, Artificial Sequence
  Synthetic oligonucleotide
ttccttccgtcgtgtggttgatgctcaccactacc

SEQ ID NO: 67280 - DNA, 35 bp, Artificial Sequence
  Synthetic oligonucleotide
gctaaccagcctcacgcccttgctactaatacccc

SEQ ID NO: 67281 - DNA, 35 bp, Artificial Sequence
  Synthetic oligonucleotide
gcacgcccctggattctactaccccgtgtaaggcc

SEQ ID NO: 67282 - DNA, 35 bp, Artificial Sequence
  Synthetic oligonucleotide
acagttgtgccgtccggtcgcacttacaccctagc

SEQ ID NO: 67283 - DNA, 35 bp, Artificial Sequence
  Synthetic oligonucleotide
tttaagcgcatgtccgttttttcgcacgccgtagc

SEQ ID NO: 67284 - DNA, 35 bp, Artificial Sequence
  Synthetic oligonucleotide
atcgcctgtaggcaacttgcacattacgctttagc

SEQ ID NO: 67285 - DNA, 35 bp, Artificial Sequence
  Synthetic oligonucleotide
ttcgatcgtaccatctgattagctcacccaaccgc

SEQ ID NO: 67286 - DNA, 35 bp, Artificial Sequence
  Synthetic oligonucleotide
agatccaaccggcctcggtgtcgaagctacaccgc

SEQ ID NO: 67287 - DNA, 35 bp, Artificial Sequence
  Synthetic oligonucleotide
agctcagctgtaccctcctatctcgcttatgtcgc

SEQ ID NO: 67288 - DNA, 35 bp, Artificial Sequence
  Synthetic oligonucleotide
atggagggacaaggatacagaggggcagagggggc

SEQ ID NO: 67289 - DNA, 35 bp, Artificial Sequence
  Synthetic oligonucleotide
agcggtcccctcatgccgccatgtccatgctcatc

SEQ ID NO: 67290 - DNA, 35 bp, Artificial Sequence
  Synthetic oligonucleotide
tcacccctcagacgatccacagcattagagccctc

SEQ ID NO: 67291 - DNA, 35 bp, Artificial Sequence
  Synthetic oligonucleotide
gcctacacgctcgctgacttaccgaaaagtacttc

SEQ ID NO: 67292 - DNA, 35 bp, Artificial Sequence
  Synthetic oligonucleotide
acagccacgcgtaacagctgcacttccttctcttc

SEQ ID NO: 67293 - DNA, 35 bp, Artificial Sequence
  Synthetic oligonucleotide
gtcaccgggtgcaaatttattcgacgctccttttc

SEQ ID NO: 67294 - DNA, 35 bp, Artificial Sequence
  Synthetic oligonucleotide
tctaacccccggtgtcttcccgctcgtatacatag

SEQ ID NO: 67295 - DNA, 35 bp, Artificial Sequence
  Synthetic oligonucleotide
gcacggtacaccttgataattcagccctcatgccg

SEQ ID NO: 67296 - DNA, 35 bp, Artificial Sequence
  Synthetic oligonucleotide
acaactgcagttggggaattacggtaagttgtgcg

SEQ ID NO: 67297 - DNA, 35 bp, Artificial Sequence
  Synthetic oligonucleotide
tatgtcgcaccaactcactaccgctcgttatatcg

SEQ ID NO: 67298 - DNA, 35 bp, Artificial Sequence
  Synthetic oligonucleotide
gtcgacgatgtgataatggggtggtggggagcagg

SEQ ID NO: 67299 - DNA, 35 bp, Artificial Sequence
  Synthetic oligonucleotide
ttgtgaagtagtgggataacaaggggctgcaaggg

SEQ ID NO: 67300 - DNA, 35 bp, Artificial Sequence
  Synthetic oligonucleotide
gaagcgcgggaagttatggaccgatgtggaaaatg

SEQ ID NO: 67301 - DNA, 35 bp, Artificial Sequence
  Synthetic oligonucleotide
gccgaatggcacgttcaatcttacagtatgtattg

SEQ ID NO: 67302 - DNA, 36 bp, Artificial Sequence
  Synthetic oligonucleotide
ttccgcccccgcaccttctcttaggcatcaaccttg

SEQ ID NO: 67303 - DNA, 35 bp, Artificial Sequence
  Synthetic oligonucleotide
acactgccctcttcctcacctatagtatgtagttg

SEQ ID NO: 67304 - DNA, 35 bp, Artificial Sequence
  Synthetic oligonucleotide
gatgaggtagggtttggtgaagatgcctaatgttg

SEQ ID NO: 67305 - DNA, 35 bp, Artificial Sequence
  Synthetic oligonucleotide
gcccacctcgttgttctacgctagcctcccatttg

SEQ ID NO: 67306 - DNA, 35 bp, Artificial Sequence
  Synthetic oligonucleotide
gtcaattgaggactacctcttccctggttacccat

SEQ ID NO: 67307 - DNA, 35 bp, Artificial Sequence
  Synthetic oligonucleotide
accgaccgacattcgctttccatgttacctcggct

SEQ ID NO: 67308 - DNA, 35 bp, Artificial Sequence
  Synthetic oligonucleotide
tcacgcgtaacgcccactgtaaccaacactgccgt

SEQ ID NO: 67309 - DNA, 35 bp, Artificial Sequence
  Synthetic oligonucleotide
tgaccacattatgcgccttagttcaccacagcaaa

SEQ ID NO: 67310 - DNA, 35 bp, Artificial Sequence
  Synthetic oligonucleotide
gtcgcaagccgtgctgcttctaatggtgccgcaaa

SEQ ID NO: 67311 - DNA, 36 bp, Artificial Sequence
  Synthetic oligonucleotide
atgcctgccacacctaaggcacagggctaagggcaa

SEQ ID NO: 67312 - DNA, 36 bp, Artificial Sequence
  Synthetic oligonucleotide
tcctccgccccaacggccttctcgcccatacacgaa

SEQ ID NO: 67313 - DNA, 34 bp, Artificial Sequence
  Synthetic oligonucleotide
gcctcgcacgacggacctccagaattaatgcgaa

SEQ ID NO: 67314 - DNA, 36 bp, Artificial Sequence
  Synthetic oligonucleotide
gtcaccctccgcccacctacggcagtcccactctaa

SEQ ID NO: 67315 - DNA, 36 bp, Artificial Sequence
  Synthetic oligonucleotide
accacagtccgcgagttaatgtcgggcctttcaaca

SEQ ID NO: 67316 - DNA, 36 bp, Artificial Sequence
  Synthetic oligonucleotide
ttactctccccgatgcataagctcacgaggcacaca

SEQ ID NO: 67317 - DNA, 35 bp, Artificial Sequence
  Synthetic oligonucleotide
taaagcgggcatggcgaaaggggtcggggttgaca

SEQ ID NO: 67318 - DNA, 36 bp, Artificial Sequence
  Synthetic oligonucleotide
tatcgtccgtgccccctgtggtttaccttcgataca

SEQ ID NO: 67319 - DNA, 36 bp, Artificial Sequence
  Synthetic oligonucleotide
tgacccgccgctgtacgtgctcgtaatccagctcca

SEQ ID NO: 67320 - DNA, 36 bp, Artificial Sequence
  Synthetic oligonucleotide
ggtcgacgtgcccgagttctatctagctatactgca

SEQ ID NO: 67321 - DNA, 35 bp, Artificial Sequence
  Synthetic oligonucleotide
gtcaatcggccgtccccctgtaacctagccttgca

SEQ ID NO: 67322 - DNA, 34 bp, Artificial Sequence
  Synthetic oligonucleotide
tccctatgcgtctactctggctgcatatccctca

SEQ ID NO: 67323 - DNA, 35 bp, Artificial Sequence
  Synthetic oligonucleotide
tacctgccaatgcccgaagccgccctgctttaaga

SEQ ID NO: 67324 - DNA, 36 bp, Artificial Sequence
  Synthetic oligonucleotide
aatgggaaaggtgctggcgtggacggagcggtgaga

SEQ ID NO: 67325 - DNA, 37 bp, Artificial Sequence
  Synthetic oligonucleotide
acatggtcggcatcacacccttagcactttctctaga

SEQ ID NO: 67326 - DNA, 37 bp, Artificial Sequence
  Synthetic oligonucleotide
agtgttcagcactcgggagggcggggagtagggtaga

SEQ ID NO: 67327 - DNA, 37 bp, Artificial Sequence
  Synthetic oligonucleotide
aagagcaccgcgacaccccagccttccgttctaacga

SEQ ID NO: 67328 - DNA, 37 bp, Artificial Sequence
  Synthetic oligonucleotide
tgatggtggaaaggcggaagggtcactcagacgacga

SEQ ID NO: 67329 - DNA, 37 bp, Artificial Sequence
  Synthetic oligonucleotide
tagccacgctcgctatatctggaaaatcataccccga

SEQ ID NO: 67330 - DNA, 35 bp, Artificial Sequence
  Synthetic oligonucleotide
accacgtaggactgcaatatattctacactcccga

SEQ ID NO: 67331 - DNA, 37 bp, Artificial Sequence
  Synthetic oligonucleotide
ttgggacaagtgaggggaattgatagtgactggcgga

SEQ ID NO: 67332 - DNA, 36 bp, Artificial Sequence
  Synthetic oligonucleotide
agtagcaagggagggattggagttatgttgggggga

SEQ ID NO: 67333 - DNA, 38 bp, Artificial Sequence
  Synthetic oligonucleotide
acgctccgctggcctatgcacacattatatccacatga

SEQ ID NO: 67334 - DNA, 35 bp, Artificial Sequence
  Synthetic oligonucleotide
gcgcaagagcagatattctgtttccccggccatga

SEQ ID NO: 67335 - DNA, 38 bp, Artificial Sequence
  Synthetic oligonucleotide
gcgtaagacataggaggctaaatggggaagggtgatga

SEQ ID NO: 67336 - DNA, 38 bp, Artificial Sequence
  Synthetic oligonucleotide
gtcaacgcatggtctttgacacttttttattcctatga

SEQ ID NO: 67337 - DNA, 38 bp, Artificial Sequence
  Synthetic oligonucleotide
tgaccgagcgtatctcggtttttgttttccatttatga

SEQ ID NO: 67338 - DNA, 38 bp, Artificial Sequence
  Synthetic oligonucleotide
tgtgctgttccacaacgaagccagctccaccacactga

SEQ ID NO: 67339 - DNA, 37 bp, Artificial Sequence
  Synthetic oligonucleotide
acattacatcattttggctgacaccagacctcactga

SEQ ID NO: 67340 - DNA, 37 bp, Artificial Sequence
  Synthetic oligonucleotide
gcaccgtgtgctgagccccccttctcctgaggactga

SEQ ID NO: 67341 - DNA, 35 bp, Artificial Sequence
  Synthetic oligonucleotide
ttcccacgccgccggacctgctgtctatgacctga

SEQ ID NO: 67342 - DNA, 37 bp, Artificial Sequence
  Synthetic oligonucleotide
agttcgcctcacccccggtcgtttagacaactgctga

SEQ ID NO: 67343 - DNA, 37 bp, Artificial Sequence
  Synthetic oligonucleotide
tcatgcatgcccaggcggctttacgtggctgtgctga

SEQ ID NO: 67344 - DNA, 37 bp, Artificial Sequence
  Synthetic oligonucleotide
gactaccacaccactccacccacgttcccgggtctga

SEQ ID NO: 67345 - DNA, 37 bp, Artificial Sequence
  Synthetic oligonucleotide
gtagcaaagggctagaggaggggttccgttggagtga

SEQ ID NO: 67346 - DNA, 38 bp, Artificial Sequence
  Synthetic oligonucleotide
gtcacaggctggtacgtgggggaatgctgggtgggtga

SEQ ID NO: 67347 - DNA, 38 bp, Artificial Sequence
  Synthetic oligonucleotide
tagcgaaggggcccaaggtagactgacaggtatggtga

SEQ ID NO: 67348 - DNA, 36 bp, Artificial Sequence
  Synthetic oligonucleotide
tccgcctcgcactcggttaacgttcgcgccaattga

SEQ ID NO: 67349 - DNA, 38 bp, Artificial Sequence
  Synthetic oligonucleotide
gagcgcgatcatcgcgactacctacatactgccattga

SEQ ID NO: 67350 - DNA, 38 bp, Artificial Sequence
  Synthetic oligonucleotide
aacaccgtcctgtgcatctctctccgtcaccatcttga

SEQ ID NO: 67351 - DNA, 37 bp, Artificial Sequence
  Synthetic oligonucleotide
tagagggataggggaaggggtaataatcactgtttga

SEQ ID NO: 67352 - DNA, 37 bp, Artificial Sequence
  Synthetic oligonucleotide
gccaggcacgcgccctccgccccccaccgaattttga

SEQ ID NO: 67353 - DNA, 37 bp, Artificial Sequence
  Synthetic oligonucleotide
actgcccaactatttggtaaccaccgttcttttttga

SEQ ID NO: 67354 - DNA, 36 bp, Artificial Sequence
  Synthetic oligonucleotide
aacaagcgcagctcctaagctgtacttttcctgcta

SEQ ID NO: 67355 - DNA, 36 bp, Artificial Sequence
  Synthetic oligonucleotide
tcccgttcaccggtcttatctttcgataccttgcta

SEQ ID NO: 67356 - DNA, 36 bp, Artificial Sequence
  Synthetic oligonucleotide
gcagacggaagtgaagcccgtccttgttcatttcta

SEQ ID NO: 67357 - DNA, 36 bp, Artificial Sequence
  Synthetic oligonucleotide
acgacgtaggaccctacggagtatcgcttaccatta

SEQ ID NO: 67358 - DNA, 36 bp, Artificial Sequence
  Synthetic oligonucleotide
gcacgcccagaaacctagtggatctcgtctgcctta

SEQ ID NO: 67359 - DNA, 35 bp, Artificial Sequence
  Synthetic oligonucleotide
tagccacgtttaacgcaatggcactcctctcctta

SEQ ID NO: 67360 - DNA, 36 bp, Artificial Sequence
  Synthetic oligonucleotide
tcctgccatcctacgtccctatcattctggtcgtta

SEQ ID NO: 67361 - DNA, 35 bp, Artificial Sequence
  Synthetic oligonucleotide
acgctgactacgctgcggggcgcctgcttccccac

SEQ ID NO: 67362 - DNA, 35 bp, Artificial Sequence
  Synthetic oligonucleotide
gtggtgggccgctactatgaccattcaagtctcac

SEQ ID NO: 67363 - DNA, 35 bp, Artificial Sequence
  Synthetic oligonucleotide
gaggacaggtcacctatgcgttgaatatcccctac

SEQ ID NO: 67364 - DNA, 35 bp, Artificial Sequence
  Synthetic oligonucleotide
gttcagattcggcccactcgcggttctattccacc

SEQ ID NO: 67365 - DNA, 35 bp, Artificial Sequence
  Synthetic oligonucleotide
tagccaaaccatgaagcatattactagacgtcacc

SEQ ID NO: 67366 - DNA, 35 bp, Artificial Sequence
  Synthetic oligonucleotide
gtggccggaccagtccaccctacccctgacgtacc

SEQ ID NO: 67367 - DNA, 35 bp, Artificial Sequence
  Synthetic oligonucleotide
accctgtcgccggtcgtgcgaccgctgatcacccc

SEQ ID NO: 67368 - DNA, 35 bp, Artificial Sequence
  Synthetic oligonucleotide
atgccctgtacttagggatgtcatcacgttctccc

SEQ ID NO: 67369 - DNA, 35 bp, Artificial Sequence
  Synthetic oligonucleotide
gtcccctagctcgactgaggccctttctcaactcc

SEQ ID NO: 67370 - DNA, 35 bp, Artificial Sequence
  Synthetic oligonucleotide
acgaatcatcccaaactgcgaacggaaactggtcc

SEQ ID NO: 67371 - DNA, 35 bp, Artificial Sequence
  Synthetic oligonucleotide
acaaacaaccccgccgtcaattcgcgtgaaattcc

SEQ ID NO: 67372 - DNA, 35 bp, Artificial Sequence
  Synthetic oligonucleotide
gctcccgtgagttgttcctttgcaagttctgttcc

SEQ ID NO: 67373 - DNA, 35 bp, Artificial Sequence
  Synthetic oligonucleotide
acactaggacaccctcttccgcacgacgaacaagc

SEQ ID NO: 67374 - DNA, 35 bp, Artificial Sequence
  Synthetic oligonucleotide
gtcaaccctaccttgggacaataatgaaccaccgc

SEQ ID NO: 67375 - DNA, 35 bp, Artificial Sequence
  Synthetic oligonucleotide
acccgaaattgtgctctgtcccttggatcacgctc

SEQ ID NO: 67376 - DNA, 35 bp, Artificial Sequence
  Synthetic oligonucleotide
aaggaagagaagaggaaagggctggaccagggtag

SEQ ID NO: 67377 - DNA, 35 bp, Artificial Sequence
  Synthetic oligonucleotide
tcctgaccacacatgccggttgtctgatcaaaccg

SEQ ID NO: 67378 - DNA, 36 bp, Artificial Sequence
  Synthetic oligonucleotide
tgagctgtgaccgggtctacccttccttcctgcccg

SEQ ID NO: 67379 - DNA, 35 bp, Artificial Sequence
  Synthetic oligonucleotide
gtgtcgcagattagtacaccctgaacccatcgccg

SEQ ID NO: 67380 - DNA, 35 bp, Artificial Sequence
  Synthetic oligonucleotide
tgccacgtcccctgtggccctcttttcgagtctcg

SEQ ID NO: 67381 - DNA, 35 bp, Artificial Sequence
  Synthetic oligonucleotide
gattcatgccaccaagtctcccgcatttgcaaggg

SEQ ID NO: 67382 - DNA, 35 bp, Artificial Sequence
  Synthetic oligonucleotide
gagcggagtgggagtcgtaaaggcagacggattgg

SEQ ID NO: 67383 - DNA, 35 bp, Artificial Sequence
  Synthetic oligonucleotide
tgatcagtactggatcgcatcacaccaccatactg

SEQ ID NO: 67384 - DNA, 35 bp, Artificial Sequence
  Synthetic oligonucleotide
gccagtacctccctcgtcacgcggaatcccacctg

SEQ ID NO: 67385 - DNA, 35 bp, Artificial Sequence
  Synthetic oligonucleotide
agacccccgccgccttcgaactcatatgttcgttg

SEQ ID NO: 67386 - DNA, 35 bp, Artificial Sequence
  Synthetic oligonucleotide
acgacgatgcccgtctattaacatactcgccaaat

SEQ ID NO: 67387 - DNA, 35 bp, Artificial Sequence
  Synthetic oligonucleotide
aactacgaaccacgattggcatgcgattgttccat

SEQ ID NO: 67388 - DNA, 35 bp, Artificial Sequence
  Synthetic oligonucleotide
ccaacgctacccgtgccgtaaccctctcgctctat

SEQ ID NO: 67389 - DNA, 35 bp, Artificial Sequence
  Synthetic oligonucleotide
ttacgaactgggagggatgtgggttaggggtgtat

SEQ ID NO: 67390 - DNA, 35 bp, Artificial Sequence
  Synthetic oligonucleotide
tgtgcgttggtgttcaaccgacgcttatcatacct

SEQ ID NO: 67391 - DNA, 35 bp, Artificial Sequence
  Synthetic oligonucleotide
tcaaaaggcgtcgctggcaaagttgccctccgtct

SEQ ID NO: 67392 - DNA, 35 bp, Artificial Sequence
  Synthetic oligonucleotide
acgacctgagaggcctctaagcaggttttctttct

SEQ ID NO: 67393 - DNA, 35 bp, Artificial Sequence
  Synthetic oligonucleotide
ggaacggttgggaacggggacagttgaaggcaagt

SEQ ID NO: 67394 - DNA, 35 bp, Artificial Sequence
  Synthetic oligonucleotide
gtcccaaccttcagtttagccccccctctcgcggt

SEQ ID NO: 67395 - DNA, 35 bp, Artificial Sequence
  Synthetic oligonucleotide
gccgaaatccactcgaacgtctttgcgaggctctt

SEQ ID NO: 67396 - DNA, 35 bp, Artificial Sequence
  Synthetic oligonucleotide
tgctatcatcctcgcagcccccccgtaagtccttt

SEQ ID NO: 67397 - DNA, 35 bp, Artificial Sequence
  Synthetic oligonucleotide
tgagtgccgccgccatctacgccacacacgtgttt

SEQ ID NO: 67398 - DNA, 36 bp, Artificial Sequence
  Synthetic oligonucleotide
attgatcgcccaatgctatttctacctggtaccaaa

SEQ ID NO: 67399 - DNA, 36 bp, Artificial Sequence
  Synthetic oligonucleotide
tccgccgatcttacatgctgtctgcacccgtcgcaa

SEQ ID NO: 67400 - DNA, 36 bp, Artificial Sequence
  Synthetic oligonucleotide
ataagccatggcccaacgttctaagcgcacctgcaa

SEQ ID NO: 67401 - DNA, 35 bp, Artificial Sequence
  Synthetic oligonucleotide
tagagcggcgggtgaagaattagaaggggaacgaa

SEQ ID NO: 67402 - DNA, 36 bp, Artificial Sequence
  Synthetic oligonucleotide
tcctccaaccctgaatttgctacatccggttccgaa

SEQ ID NO: 67403 - DNA, 36 bp, Artificial Sequence
  Synthetic oligonucleotide
gcgccgccgctcgtcattcaccacctctatatcgaa

SEQ ID NO: 67404 - DNA, 36 bp, Artificial Sequence
  Synthetic oligonucleotide
gccaactttcgcgccgttcgccataaacattttaca

SEQ ID NO: 67405 - DNA, 35 bp, Artificial Sequence
  Synthetic oligonucleotide
ttccgtacgcagatcgatccacacctcgaaaccca

SEQ ID NO: 67406 - DNA, 36 bp, Artificial Sequence
  Synthetic oligonucleotide
ttgctccaacatcttgttgtgatgtctttaccccca

SEQ ID NO: 67407 - DNA, 36 bp, Artificial Sequence
  Synthetic oligonucleotide
tctgtcatcccataccttcacgcgtaggacccgcca

SEQ ID NO: 67408 - DNA, 33 bp, Artificial Sequence
  Synthetic oligonucleotide
gtgagaatagaacgggggggagctggcaaagca

SEQ ID NO: 67409 - DNA, 36 bp, Artificial Sequence
  Synthetic oligonucleotide
atctcccaccaccgaatcaccctctttgacagagca

SEQ ID NO: 67410 - DNA, 35 bp, Artificial Sequence
  Synthetic oligonucleotide
catgcacttaaatcgttgacagtgtccgtgccgca

SEQ ID NO: 67411 - DNA, 36 bp, Artificial Sequence
  Synthetic oligonucleotide
accgcacgtgcaaacaatggaggatagactctgtca

SEQ ID NO: 67412 - DNA, 36 bp, Artificial Sequence
  Synthetic oligonucleotide
agcacagctaggatgctcgtcccaccacgcttttca

SEQ ID NO: 67413 - DNA, 37 bp, Artificial Sequence
  Synthetic oligonucleotide
tggaatgcagggggaattgctaccgggtgaggaaaga

SEQ ID NO: 67414 - DNA, 37 bp, Artificial Sequence
  Synthetic oligonucleotide
tgaagagagcgggaaacgagggagtactgggacgaga

SEQ ID NO: 67415 - DNA, 37 bp, Artificial Sequence
  Synthetic oligonucleotide
tgtatcgcctgccgtgctttgttccgccgtagaacga

SEQ ID NO: 67416 - DNA, 37 bp, Artificial Sequence
  Synthetic oligonucleotide
gccgaggaaaagcggggggcaatgaatggtggtacga

SEQ ID NO: 67417 - DNA, 37 bp, Artificial Sequence
  Synthetic oligonucleotide
tcactggacagcggtgcccgttctgttcttcacccga

SEQ ID NO: 67418 - DNA, 37 bp, Artificial Sequence
  Synthetic oligonucleotide
gagaggggtagatagaggaactgacggatgccggcga

SEQ ID NO: 67419 - DNA, 37 bp, Artificial Sequence
  Synthetic oligonucleotide
ggagtggccgcgaggggaagtagggcggaaataagga

SEQ ID NO: 67420 - DNA, 36 bp, Artificial Sequence
  Synthetic oligonucleotide
tcagacgcacaacatatggcgctaaattatccagga

SEQ ID NO: 67421 - DNA, 37 bp, Artificial Sequence
  Synthetic oligonucleotide
taaagtgctgcagatcaaaggaggagtaggggtagga

SEQ ID NO: 67422 - DNA, 37 bp, Artificial Sequence
  Synthetic oligonucleotide
agaggtgggatggatggttgtgcggaagcaatgcgga

SEQ ID NO: 67423 - DNA, 37 bp, Artificial Sequence
  Synthetic oligonucleotide
gggggaggaagatctttaaaagtaaagggtgagggga

SEQ ID NO: 67424 - DNA, 38 bp, Artificial Sequence
  Synthetic oligonucleotide
gctcaaccacccgactttgctctgtcttctgccaatga

SEQ ID NO: 67425 - DNA, 38 bp, Artificial Sequence
  Synthetic oligonucleotide
acaccccgaccgttttctatcgaccccgtaagcgatga

SEQ ID NO: 67426 - DNA, 37 bp, Artificial Sequence
  Synthetic oligonucleotide
gtgtgcgagagagaaaaggtaaacagtgtgcggatga

SEQ ID NO: 67427 - DNA, 37 bp, Artificial Sequence
  Synthetic oligonucleotide
gatggcgaaaaatcgggagggatggagtcaagtatga

SEQ ID NO: 67428 - DNA, 37 bp, Artificial Sequence
  Synthetic oligonucleotide
agccatacatgcatgatttaacaagcccctccactga

SEQ ID NO: 67429 - DNA, 37 bp, Artificial Sequence
  Synthetic oligonucleotide
gtgtcacccttggtttgctctgctccactcgcactga

SEQ ID NO: 67430 - DNA, 37 bp, Artificial Sequence
  Synthetic oligonucleotide
tgaaacccttacatggtgcttgaggcccaaaccctga

SEQ ID NO: 67431 - DNA, 37 bp, Artificial Sequence
  Synthetic oligonucleotide
ggatccatcccgttcgctcatttctccaggcccctga

SEQ ID NO: 67432 - DNA, 38 bp, Artificial Sequence
  Synthetic oligonucleotide
gcgtccacccgggctgactttgcgccacctctatctga

SEQ ID NO: 67433 - DNA, 38 bp, Artificial Sequence
  Synthetic oligonucleotide
gcgatctcccgcctttcttcttgcctggccttttctga

SEQ ID NO: 67434 - DNA, 37 bp, Artificial Sequence
  Synthetic oligonucleotide
tcctgcaactgcggctgtcctccgcctctctaagtga

SEQ ID NO: 67435 - DNA, 38 bp, Artificial Sequence
  Synthetic oligonucleotide
aggggggagggagggtgggttcacagcacgtgaggtga

SEQ ID NO: 67436 - DNA, 37 bp, Artificial Sequence
  Synthetic oligonucleotide
tcccactactccacacactctagcccccttcgtgtga

SEQ ID NO: 67437 - DNA, 38 bp, Artificial Sequence
  Synthetic oligonucleotide
gccatcccctctcggtcaaccactgcacataggtgtga

SEQ ID NO: 67438 - DNA, 38 bp, Artificial Sequence
  Synthetic oligonucleotide
gatgccctgggcgcgagaccacatggacctgtttgtga

SEQ ID NO: 67439 - DNA, 38 bp, Artificial Sequence
  Synthetic oligonucleotide
acgtatctccaggcagacggttccatgatccaccttga

SEQ ID NO: 67440 - DNA, 38 bp, Artificial Sequence
  Synthetic oligonucleotide
aaacacccatcaacctttttacgagtccatgaccttga

SEQ ID NO: 67441 - DNA, 38 bp, Artificial Sequence
  Synthetic oligonucleotide
gttcagcgaaccgttgcacttattctgttccgccttga

SEQ ID NO: 67442 - DNA, 35 bp, Artificial Sequence
  Synthetic oligonucleotide
aacaccaaccatcctacgcgggagcgcttccttga

SEQ ID NO: 67443 - DNA, 38 bp, Artificial Sequence
  Synthetic oligonucleotide
aacccacccttgctgatcgtctcgactttgactcttga

SEQ ID NO: 67444 - DNA, 38 bp, Artificial Sequence
  Synthetic oligonucleotide
tcaccacttgtgatcgcccacagcctacaaaactttga

SEQ ID NO: 67445 - DNA, 38 bp, Artificial Sequence
  Synthetic oligonucleotide
aatcaccagtagccccgccctactcactccgcctttga

SEQ ID NO: 67446 - DNA, 36 bp, Artificial Sequence
  Synthetic oligonucleotide
gcccatccctcacactgtggcctggacgttaaaata

SEQ ID NO: 67447 - DNA, 35 bp, Artificial Sequence
  Synthetic oligonucleotide
ttcgcgtacctgccgggctcactccaatacatata

SEQ ID NO: 67448 - DNA, 36 bp, Artificial Sequence
  Synthetic oligonucleotide
tctgacccatttcgtgccattgacgttgctatacta

SEQ ID NO: 67449 - DNA, 36 bp, Artificial Sequence
  Synthetic oligonucleotide
accaacaccgtggtctttatagttcgcatactgcta

SEQ ID NO: 67450 - DNA, 36 bp, Artificial Sequence
  Synthetic oligonucleotide
aatctcaccgcaacggatgccttagttcattatcta

SEQ ID NO: 67451 - DNA, 36 bp, Artificial Sequence
  Synthetic oligonucleotide
gtacgaggggagggggaggccaagaggtccggtcta

SEQ ID NO: 67452 - DNA, 36 bp, Artificial Sequence
  Synthetic oligonucleotide
gcccccgactcactgtcactcgacaactgtatagta

SEQ ID NO: 67453 - DNA, 36 bp, Artificial Sequence
  Synthetic oligonucleotide
tgcaccgccggtcccttcacgaccctccgacatgta

SEQ ID NO: 67454 - DNA, 36 bp, Artificial Sequence
  Synthetic oligonucleotide
actccccagcgtggaacgacacaaccatgcgcctta

SEQ ID NO: 67455 - DNA, 35 bp, Artificial Sequence
  Synthetic oligonucleotide
accccactcgctgcagaatactttcgaatatcaac

SEQ ID NO: 67456 - DNA, 35 bp, Artificial Sequence
  Synthetic oligonucleotide
atcacacgccattgctgcctagctgcgcctgacac

SEQ ID NO: 67457 - DNA, 34 bp, Artificial Sequence
  Synthetic oligonucleotide
tgattggaaccgtgtttcgctactgacctgccac

SEQ ID NO: 67458 - DNA, 35 bp, Artificial Sequence
  Synthetic oligonucleotide
gtctagcgtgtcgcgcaacaccccggacctcaacc

SEQ ID NO: 67459 - DNA, 35 bp, Artificial Sequence
  Synthetic oligonucleotide
gaacccatacgtggtgaattccctcttcccacccc

SEQ ID NO: 67460 - DNA, 36 bp, Artificial Sequence
  Synthetic oligonucleotide
gccactgatgaatcgttgtggcatgactttacgccc

SEQ ID NO: 67461 - DNA, 35 bp, Artificial Sequence
  Synthetic oligonucleotide
gcaccgagaaacccgtatcatcgcggctaaaatcc

SEQ ID NO: 67462 - DNA, 35 bp, Artificial Sequence
  Synthetic oligonucleotide
taacacggtaaacggccaaagatcaccaccattgc

SEQ ID NO: 67463 - DNA, 35 bp, Artificial Sequence
  Synthetic oligonucleotide
actcatcctctgttcggtcaaaccgtcctcgcctc

SEQ ID NO: 67464 - DNA, 35 bp, Artificial Sequence
  Synthetic oligonucleotide
gcaacgacttgtctcttatgcaccgttaatctttc

SEQ ID NO: 67465 - DNA, 35 bp, Artificial Sequence
  Synthetic oligonucleotide
gttgcgggaaaaggtgaactgtaggtggcagaaag

SEQ ID NO: 67466 - DNA, 35 bp, Artificial Sequence
  Synthetic oligonucleotide
atgtacgtcaagtctaccctcccgccacctctccg

SEQ ID NO: 67467 - DNA, 35 bp, Artificial Sequence
  Synthetic oligonucleotide
gatggggacactgaaggagcggggagtttgcatgg

SEQ ID NO: 67468 - DNA, 35 bp, Artificial Sequence
  Synthetic oligonucleotide
tatccccgcaggtgcacgttatgtagggtccctgg

SEQ ID NO: 67469 - DNA, 35 bp, Artificial Sequence
  Synthetic oligonucleotide
atgggagggaaatacaaacggggaatggctgtatg

SEQ ID NO: 67470 - DNA, 35 bp, Artificial Sequence
  Synthetic oligonucleotide
gcaggacaggtatgctgttgttgtggggttgagtg

SEQ ID NO: 67471 - DNA, 35 bp, Artificial Sequence
  Synthetic oligonucleotide
tatgtcgccgcccaccttgcgttcctaacaacttg

SEQ ID NO: 67472 - DNA, 35 bp, Artificial Sequence
  Synthetic oligonucleotide
gacgcatcacacataacaaagtgttactcttcttg

SEQ ID NO: 67473 - DNA, 35 bp, Artificial Sequence
  Synthetic oligonucleotide
tggggacccgaccaatgccagtcgccttctactat

SEQ ID NO: 67474 - DNA, 35 bp, Artificial Sequence
  Synthetic oligonucleotide
tgatacttgcccacctgactatacataatggctat

SEQ ID NO: 67475 - DNA, 35 bp, Artificial Sequence
  Synthetic oligonucleotide
tttgtctcccgcagcagttgcacgcaatgttccct

SEQ ID NO: 67476 - DNA, 35 bp, Artificial Sequence
  Synthetic oligonucleotide
tgacagcccttgaactggtccaccaccggcctcct

SEQ ID NO: 67477 - DNA, 35 bp, Artificial Sequence
  Synthetic oligonucleotide
tctgtcatatccgcgattacaccgcccgcccatgt

SEQ ID NO: 67478 - DNA, 35 bp, Artificial Sequence
  Synthetic oligonucleotide
atcgctgctcacatcgccaacccacctacacttgt

SEQ ID NO: 67479 - DNA, 35 bp, Artificial Sequence
  Synthetic oligonucleotide
gtagttcgctgctacgacgattccgctttctcatt

SEQ ID NO: 67480 - DNA, 35 bp, Artificial Sequence
  Synthetic oligonucleotide
gctccgtgcacgatccggtctcacggataattatt

SEQ ID NO: 67481 - DNA, 35 bp, Artificial Sequence
  Synthetic oligonucleotide
actgggtcggattcgcctcggatgtcattgccctt

SEQ ID NO: 67482 - DNA, 35 bp, Artificial Sequence
  Synthetic oligonucleotide
gccagtcctccgcgaacacaccgcgacagtaattt

SEQ ID NO: 67483 - DNA, 36 bp, Artificial Sequence
  Synthetic oligonucleotide
ttccagctgtccatctgccttcctgtcgtggtccaa

SEQ ID NO: 67484 - DNA, 36 bp, Artificial Sequence
  Synthetic oligonucleotide
agcaccacacacgctaccccttgccataaactagaa

SEQ ID NO: 67485 - DNA, 36 bp, Artificial Sequence
  Synthetic oligonucleotide
ataccacctccagcggttttactatgaccaccggaa

SEQ ID NO: 67486 - DNA, 36 bp, Artificial Sequence
  Synthetic oligonucleotide
agcggggcaacctcgaggtttctacccatacccaca

SEQ ID NO: 67487 - DNA, 36 bp, Artificial Sequence
  Synthetic oligonucleotide
ttcactcatgaccttctgcgtaagcccgcttttaca

SEQ ID NO: 67488 - DNA, 35 bp, Artificial Sequence
  Synthetic oligonucleotide
ggaatgcatataaggcaattgccacgacctcacca

SEQ ID NO: 67489 - DNA, 36 bp, Artificial Sequence
  Synthetic oligonucleotide
tgccccgtaactccattttcttacccagtgctacca

SEQ ID NO: 67490 - DNA, 35 bp, Artificial Sequence
  Synthetic oligonucleotide
tcccatcatcggatcgcaggaacacgaacaaatca

SEQ ID NO: 67491 - DNA, 35 bp, Artificial Sequence
  Synthetic oligonucleotide
taagtgcctcccagttcttcgcatacaggaactca

SEQ ID NO: 67492 - DNA, 36 bp, Artificial Sequence
  Synthetic oligonucleotide
ttccttcgacgctgacttactaggctcttgcattca

SEQ ID NO: 67493 - DNA, 37 bp, Artificial Sequence
  Synthetic oligonucleotide
gtgttatccgcccgcatgcgtttcatgacccgaccga

SEQ ID NO: 67494 - DNA, 37 bp, Artificial Sequence
  Synthetic oligonucleotide
gtcctcgctatctgaatcgaccccatcctgctaccga

SEQ ID NO: 67495 - DNA, 35 bp, Artificial Sequence
  Synthetic oligonucleotide
tgaaatcgtcagcaaccatccttcccttgtcccga

SEQ ID NO: 67496 - DNA, 36 bp, Artificial Sequence
  Synthetic oligonucleotide
atatccgccacagccccagtctaactctgacgccga

SEQ ID NO: 67497 - DNA, 35 bp, Artificial Sequence
  Synthetic oligonucleotide
gggttggtcaccagctcccggcacccctccgccga

SEQ ID NO: 67498 - DNA, 37 bp, Artificial Sequence
  Synthetic oligonucleotide
gggaggtgggcctgggatcaagaggggatgtgagcga

SEQ ID NO: 67499 - DNA, 37 bp, Artificial Sequence
  Synthetic oligonucleotide
agtcggggcagggctaaaggggtgggataggattcga

SEQ ID NO: 67500 - DNA, 37 bp, Artificial Sequence
  Synthetic oligonucleotide
gtgagtgccagcgcatgcgtgaggatgggggaaagga

SEQ ID NO: 67501 - DNA, 37 bp, Artificial Sequence
  Synthetic oligonucleotide
tgtcatggatcggctcggaaataaagtagtgggagga

SEQ ID NO: 67502 - DNA, 36 bp, Artificial Sequence
  Synthetic oligonucleotide
aaccactccttacctatgcgcgagcgcccctacgga

SEQ ID NO: 67503 - DNA, 36 bp, Artificial Sequence
  Synthetic oligonucleotide
gattgtgcagcaacattctcactctcacacatcgga

SEQ ID NO: 67504 - DNA, 37 bp, Artificial Sequence
  Synthetic oligonucleotide
ttacgcgcatggacggacgacggaaggggagcaggga

SEQ ID NO: 67505 - DNA, 37 bp, Artificial Sequence
  Synthetic oligonucleotide
tttccagtcgcgatgtctttactcctctcactcggga

SEQ ID NO: 67506 - DNA, 36 bp, Artificial Sequence
  Synthetic oligonucleotide
ttacgacaggcttcacattattacttcacgctggga

SEQ ID NO: 67507 - DNA, 37 bp, Artificial Sequence
  Synthetic oligonucleotide
ggatcgtcgaaggcggtagggttgctgggaggtggga

SEQ ID NO: 67508 - DNA, 36 bp, Artificial Sequence
  Synthetic oligonucleotide
gtttcacgccacccaatacagtattttatctctgga

SEQ ID NO: 67509 - DNA, 37 bp, Artificial Sequence
  Synthetic oligonucleotide
tcaacgtggacgcggaccactaccatccgtaccatga

SEQ ID NO: 67510 - DNA, 38 bp, Artificial Sequence
  Synthetic oligonucleotide
tttgccactgttggtatcctggcctccctctgcgatga

SEQ ID NO: 67511 - DNA, 38 bp, Artificial Sequence
  Synthetic oligonucleotide
gatccggggggaaagtagcataaagagagacatgatga

SEQ ID NO: 67512 - DNA, 37 bp, Artificial Sequence
  Synthetic oligonucleotide
tcagataatgtgggaggggtggattaaccgggtatga

SEQ ID NO: 67513 - DNA, 38 bp, Artificial Sequence
  Synthetic oligonucleotide
tcactcatttggtcgctttctccctgccaagacactga

SEQ ID NO: 67514 - DNA, 38 bp, Artificial Sequence
  Synthetic oligonucleotide
atgacgggcccagtgcttgtcaacatcccaacacctga

SEQ ID NO: 67515 - DNA, 38 bp, Artificial Sequence
  Synthetic oligonucleotide
tcgtcgcatgccacgctggtcttgccttgtacccctga

SEQ ID NO: 67516 - DNA, 38 bp, Artificial Sequence
  Synthetic oligonucleotide
acccaatgtcgggcgcgcgtccccactatcactcctga

SEQ ID NO: 67517 - DNA, 38 bp, Artificial Sequence
  Synthetic oligonucleotide
gcatccccattgtatcctgattaccgcaatccagctga

SEQ ID NO: 67518 - DNA, 36 bp, Artificial Sequence
  Synthetic oligonucleotide
gatcacactacctacgtttcaatagtcagtttctga

SEQ ID NO: 67519 - DNA, 37 bp, Artificial Sequence
  Synthetic oligonucleotide
ggaggggtggaacagtgggtcgaaggtttggaagtga

SEQ ID NO: 67520 - DNA, 38 bp, Artificial Sequence
  Synthetic oligonucleotide
actccgcccactgcaccgtgacctgaaaagacgagtga

SEQ ID NO: 67521 - DNA, 38 bp, Artificial Sequence
  Synthetic oligonucleotide
acacggagggagttcaaaacgtcatggggagcaggtga

SEQ ID NO: 67522 - DNA, 37 bp, Artificial Sequence
  Synthetic oligonucleotide
ttggacgcactctctatcttcttatttggcccggtga

SEQ ID NO: 67523 - DNA, 38 bp, Artificial Sequence
  Synthetic oligonucleotide
tgcctgacgccacggtcctcctcgagtttgcacattga

SEQ ID NO: 67524 - DNA, 37 bp, Artificial Sequence
  Synthetic oligonucleotide
gactctgtccacgctcacgttctcgcccccttattga

SEQ ID NO: 67525 - DNA, 36 bp, Artificial Sequence
  Synthetic oligonucleotide
ggatgggaccctggggcacgggaacaaactatttga

SEQ ID NO: 67526 - DNA, 38 bp, Artificial Sequence
  Synthetic oligonucleotide
acttcccatcgcccgttacgctaatattgatcctttga

SEQ ID NO: 67527 - DNA, 35 bp, Artificial Sequence
  Synthetic oligonucleotide
tccgcctcctccgctgcacttgccgcatcctgata

SEQ ID NO: 67528 - DNA, 35 bp, Artificial Sequence
  Synthetic oligonucleotide
gattcagccttcattccttacaacaatggatccta

SEQ ID NO: 67529 - DNA, 36 bp, Artificial Sequence
  Synthetic oligonucleotide
tcacaccgcgcagtgcacctaagcctcgcctagcta

SEQ ID NO: 67530 - DNA, 36 bp, Artificial Sequence
  Synthetic oligonucleotide
accacgtctgccactcgcatcatgcaacgagccgta

SEQ ID NO: 67531 - DNA, 35 bp, Artificial Sequence
  Synthetic oligonucleotide
gtccggaaattaagcagggagaggcggatcgggta

SEQ ID NO: 67532 - DNA, 36 bp, Artificial Sequence
  Synthetic oligonucleotide
gacttcacgctccattgactgcccccgtaactggta

SEQ ID NO: 67533 - DNA, 36 bp, Artificial Sequence
  Synthetic oligonucleotide
ttcccgctcgtcaccacagcctctttccacctatta

SEQ ID NO: 67534 - DNA, 35 bp, Artificial Sequence
  Synthetic oligonucleotide
attgcccgagcccccgcaccggtcactccacatac

SEQ ID NO: 67535 - DNA, 35 bp, Artificial Sequence
  Synthetic oligonucleotide
tctccgttccaacatagccgccgagaaggccttac

SEQ ID NO: 67536 - DNA, 35 bp, Artificial Sequence
  Synthetic oligonucleotide
gcaccacataacggaattgtcccgtctcttcaacc

SEQ ID NO: 67537 - DNA, 35 bp, Artificial Sequence
  Synthetic oligonucleotide
tactgccttggccgttggtcattacatcggtaacc

SEQ ID NO: 67538 - DNA, 35 bp, Artificial Sequence
  Synthetic oligonucleotide
tcaaccaggccgtggaaccgccgcatgcaaaaccc

SEQ ID NO: 67539 - DNA, 35 bp, Artificial Sequence
  Synthetic oligonucleotide
ttggaccagtttttgcgtgtgcttctacccggccc

SEQ ID NO: 67540 - DNA, 35 bp, Artificial Sequence
  Synthetic oligonucleotide
gtgcagccgccgtttgtcgatcctcagccactccc

SEQ ID NO: 67541 - DNA, 35 bp, Artificial Sequence
  Synthetic oligonucleotide
gacactctctctggctatcccggttcacaattccc

SEQ ID NO: 67542 - DNA, 35 bp, Artificial Sequence
  Synthetic oligonucleotide
tgccgcagatctcccgcttaaccccgtgccactcc

SEQ ID NO: 67543 - DNA, 35 bp, Artificial Sequence
  Synthetic oligonucleotide
atcgccccggtacgggtccggtcgtaattgtccgc

SEQ ID NO: 67544 - DNA, 35 bp, Artificial Sequence
  Synthetic oligonucleotide
gcttactccgtcactttggttaccgtccgtccctc

SEQ ID NO: 67545 - DNA, 35 bp, Artificial Sequence
  Synthetic oligonucleotide
agtgctcccgtctcgcttggttttccccgatgctc

SEQ ID NO: 67546 - DNA, 35 bp, Artificial Sequence
  Synthetic oligonucleotide
tcttaccccgaatcgtgtgtccgagttcgggattc

SEQ ID NO: 67547 - DNA, 35 bp, Artificial Sequence
  Synthetic oligonucleotide
attcatgccaatactcacacacggggacgggtgag

SEQ ID NO: 67548 - DNA, 35 bp, Artificial Sequence
  Synthetic oligonucleotide
gtccccagcctactacccggatctgcttcacatag

SEQ ID NO: 67549 - DNA, 35 bp, Artificial Sequence
  Synthetic oligonucleotide
tccacctacgctctagggccatcggcgtttccgcg

SEQ ID NO: 67550 - DNA, 35 bp, Artificial Sequence
  Synthetic oligonucleotide
aaaacaccatcttcgttagccgccggaccactgcg

SEQ ID NO: 67551 - DNA, 35 bp, Artificial Sequence
  Synthetic oligonucleotide
accggaaaagggtgctgtattaatgatgaggggtg

SEQ ID NO: 67552 - DNA, 35 bp, Artificial Sequence
  Synthetic oligonucleotide
gattgacggagggggtaccatacagagcggttgtg

SEQ ID NO: 67553 - DNA, 35 bp, Artificial Sequence
  Synthetic oligonucleotide
aatggaagtggagcagtgcagggacgggtcggttg

SEQ ID NO: 67554 - DNA, 35 bp, Artificial Sequence
  Synthetic oligonucleotide
actgagccggccccgagcccaatatctgcattaat

SEQ ID NO: 67555 - DNA, 35 bp, Artificial Sequence
  Synthetic oligonucleotide
tgttgggaagaggaggattgaggggctgacgacat

SEQ ID NO: 67556 - DNA, 35 bp, Artificial Sequence
  Synthetic oligonucleotide
attacacgcccgacttcaatcctaccgacgcccat

SEQ ID NO: 67557 - DNA, 35 bp, Artificial Sequence
  Synthetic oligonucleotide
tgatcgatgcatcgtcttcccttacgccatctgat

SEQ ID NO: 67558 - DNA, 35 bp, Artificial Sequence
  Synthetic oligonucleotide
aaacccagtggcaagcacaccacaccgactcgtat

SEQ ID NO: 67559 - DNA, 35 bp, Artificial Sequence
  Synthetic oligonucleotide
tgtgacacggaaatgcctacgcgttgtccttaact

SEQ ID NO: 67560 - DNA, 35 bp, Artificial Sequence
  Synthetic oligonucleotide
gagcaccaccaacgccaaggggctaaacccgccct

SEQ ID NO: 67561 - DNA, 35 bp, Artificial Sequence
  Synthetic oligonucleotide
tgaaacctaccaccagtcttcgtctaatgctgcct

SEQ ID NO: 67562 - DNA, 35 bp, Artificial Sequence
  Synthetic oligonucleotide
gtgtgcaccgccctgaccagcttgttgccaccgct

SEQ ID NO: 67563 - DNA, 35 bp, Artificial Sequence
  Synthetic oligonucleotide
attgcctcacgcacaccaaaaattaagaacccgct

SEQ ID NO: 67564 - DNA, 35 bp, Artificial Sequence
  Synthetic oligonucleotide
tgttttcgccggtctcgctcttttgtcaccaggct

SEQ ID NO: 67565 - DNA, 35 bp, Artificial Sequence
  Synthetic oligonucleotide
agcatggggaacagaaaagtccgtgaggggaaggt

SEQ ID NO: 67566 - DNA, 35 bp, Artificial Sequence
  Synthetic oligonucleotide
atggacgcccccataccttcgttcgtctctccggt

SEQ ID NO: 67567 - DNA, 35 bp, Artificial Sequence
  Synthetic oligonucleotide
actccatcaggaggcaccctaacccatgtctttgt

SEQ ID NO: 67568 - DNA, 35 bp, Artificial Sequence
  Synthetic oligonucleotide
acgcacaagacgccctcctcctagtgagccaaatt

SEQ ID NO: 67569 - DNA, 35 bp, Artificial Sequence
  Synthetic oligonucleotide
ggcctccgtaccaccctcgcttaagcctgacactt

SEQ ID NO: 67570 - DNA, 35 bp, Artificial Sequence
  Synthetic oligonucleotide
aacccgctataacatgcaagcccaccaacgcggtt

SEQ ID NO: 67571 - DNA, 34 bp, Artificial Sequence
  Synthetic oligonucleotide
aacctggtctcacaacatgattaaagtcactgtt

SEQ ID NO: 67572 - DNA, 35 bp, Artificial Sequence
  Synthetic oligonucleotide
atgcgtcgccatccaaatgcttcgggttcatattt

SEQ ID NO: 67573 - DNA, 35 bp, Artificial Sequence
  Synthetic oligonucleotide
tgctgagttccccaggtctgccccgaacgcacttt

SEQ ID NO: 67574 - DNA, 35 bp, Artificial Sequence
  Synthetic oligonucleotide
aacctgctgcccggttcatgagttcgcacgctttt

SEQ ID NO: 67575 - DNA, 36 bp, Artificial Sequence
  Synthetic oligonucleotide
agtacgttcaaagtgccctttgctccccttacgaaa

SEQ ID NO: 67576 - DNA, 36 bp, Artificial Sequence
  Synthetic oligonucleotide
gctgatcatcccttccccattgaggtcgccccgcaa

SEQ ID NO: 67577 - DNA, 36 bp, Artificial Sequence
  Synthetic oligonucleotide
gaacaccctgacaccgtgcgtttcattggaattcaa

SEQ ID NO: 67578 - DNA, 36 bp, Artificial Sequence
  Synthetic oligonucleotide
gccatccccccgtcgcaactgtctgcatcatcagaa

SEQ ID NO: 67579 - DNA, 36 bp, Artificial Sequence
  Synthetic oligonucleotide
ggatgcagggaacaaggacgggcgtgcagtcagtaa

SEQ ID NO: 67580 - DNA, 36 bp, Artificial Sequence
  Synthetic oligonucleotide
aaatgcccgcaatcatctgccatcgcgacttgttaa

SEQ ID NO: 67581 - DNA, 36 bp, Artificial Sequence
  Synthetic oligonucleotide
gtgccaggtccttggagttgtactgcttgcttcaca

SEQ ID NO: 67582 - DNA, 35 bp, Artificial Sequence
  Synthetic oligonucleotide
tcacatgaacacgttgaaatacaaacaacttgaca

SEQ ID NO: 67583 - DNA, 36 bp, Artificial Sequence
  Synthetic oligonucleotide
gcctgatcagtgtgctctctctccgactcggctaca

SEQ ID NO: 67584 - DNA, 36 bp, Artificial Sequence
  Synthetic oligonucleotide
tgccacaccgcttcgcaagcgccctcagccattcca

SEQ ID NO: 67585 - DNA, 36 bp, Artificial Sequence
  Synthetic oligonucleotide
gaacctgcctctcgaacgcctacatcaacagcagca

SEQ ID NO: 67586 - DNA, 35 bp, Artificial Sequence
  Synthetic oligonucleotide
atccacgccgagttgctagatcagaccctaccgca

SEQ ID NO: 67587 - DNA, 36 bp, Artificial Sequence
  Synthetic oligonucleotide
tccccaaccttagtacctagggcacacccttgtgca

SEQ ID NO: 67588 - DNA, 36 bp, Artificial Sequence
  Synthetic oligonucleotide
tgtcaagcatcctttcttcacggcgtttttccatca

SEQ ID NO: 67589 - DNA, 35 bp, Artificial Sequence
  Synthetic oligonucleotide
tgccataccgactcgcacgtaacagttatcgctca

SEQ ID NO: 67590 - DNA, 35 bp, Artificial Sequence
  Synthetic oligonucleotide
gtcgagaccggtcaaccttaatcagccctttgtca

SEQ ID NO: 67591 - DNA, 35 bp, Artificial Sequence
  Synthetic oligonucleotide
gcagagcactcgccaacacgaccggacttacaaga

SEQ ID NO: 67592 - DNA, 37 bp, Artificial Sequence
  Synthetic oligonucleotide
agagggacgtggtagggaagggcaagcggagcagaga

SEQ ID NO: 67593 - DNA, 37 bp, Artificial Sequence
  Synthetic oligonucleotide
tgaaagggggagtaagaatgataggtatggccggaga

SEQ ID NO: 67594 - DNA, 37 bp, Artificial Sequence
  Synthetic oligonucleotide
tatgaccaagcacggtggaaaggacgggtgtggtaga

SEQ ID NO: 67595 - DNA, 37 bp, Artificial Sequence
  Synthetic oligonucleotide
aagcacagggtggcagtaaggggggccggaatgtaga

SEQ ID NO: 67596 - DNA, 37 bp, Artificial Sequence
  Synthetic oligonucleotide
acgccacttgtgccacactggaatcgatccttttaga

SEQ ID NO: 67597 - DNA, 37 bp, Artificial Sequence
  Synthetic oligonucleotide
gtggcgagatgtggggcggggtgcgaaggaggaacga

SEQ ID NO: 67598 - DNA, 35 bp, Artificial Sequence
  Synthetic oligonucleotide
tcaacatgccttccggaaatactgcctgaacacga

SEQ ID NO: 67599 - DNA, 37 bp, Artificial Sequence
  Synthetic oligonucleotide
ggggctgactatggactccaacacactgattcaccga

SEQ ID NO: 67600 - DNA, 37 bp, Artificial Sequence
  Synthetic oligonucleotide
tcagtcaagtgcgaggggacgggggatagcagaccga

SEQ ID NO: 67601 - DNA, 37 bp, Artificial Sequence
  Synthetic oligonucleotide
tgatggctccacctatatcttcctttctcgtgtccga

SEQ ID NO: 67602 - DNA, 37 bp, Artificial Sequence
  Synthetic oligonucleotide
gacgccgaccagcgcgtctatatactccagtgatcga

SEQ ID NO: 67603 - DNA, 37 bp, Artificial Sequence
  Synthetic oligonucleotide
tccgaatttcgacctgcctcgcgataccgcctatcga

SEQ ID NO: 67604 - DNA, 35 bp, Artificial Sequence
  Synthetic oligonucleotide
agaaaagggtggaacggcgggtcgtacaagtagga

SEQ ID NO: 67605 - DNA, 36 bp, Artificial Sequence
  Synthetic oligonucleotide
tgattggggcctagagtctaaaaatggggtgtagga

SEQ ID NO: 67606 - DNA, 37 bp, Artificial Sequence
  Synthetic oligonucleotide
gagacaccacacggtgagttccacccgtattcccgga

SEQ ID NO: 67607 - DNA, 37 bp, Artificial Sequence
  Synthetic oligonucleotide
gaacccccatgcccctagtagacctttccgtggcgga

SEQ ID NO: 67608 - DNA, 37 bp, Artificial Sequence
  Synthetic oligonucleotide
gtcctaggaggttaagggggtggaaataggatgcgga

SEQ ID NO: 67609 - DNA, 37 bp, Artificial Sequence
  Synthetic oligonucleotide
acgccaagggtctgaatgggagggggatcaaaaggga

SEQ ID NO: 67610 - DNA, 37 bp, Artificial Sequence
  Synthetic oligonucleotide
gtgcacggaaagggaagctcaacgggtaaggtctgga

SEQ ID NO: 67611 - DNA, 36 bp, Artificial Sequence
  Synthetic oligonucleotide
tcccaacggccaaacccgccgcctctaggttcatga

SEQ ID NO: 67612 - DNA, 38 bp, Artificial Sequence
  Synthetic oligonucleotide
tacatcacctactcgaggaatcgacccacatgatatga

SEQ ID NO: 67613 - DNA, 38 bp, Artificial Sequence
  Synthetic oligonucleotide
ggtaaccgtggcagcatctcactcacatcccagcctga

SEQ ID NO: 67614 - DNA, 38 bp, Artificial Sequence
  Synthetic oligonucleotide
tgtgagtgatcccgagcccgtagtccccctttgcctga

SEQ ID NO: 67615 - DNA, 38 bp, Artificial Sequence
  Synthetic oligonucleotide
tgccaacagccagcaagctcaccttccttctccagtga

SEQ ID NO: 67616 - DNA, 38 bp, Artificial Sequence
  Synthetic oligonucleotide
gacggggtgggtgaaacatagggctgattcgtgagtga

SEQ ID NO: 67617 - DNA, 38 bp, Artificial Sequence
  Synthetic oligonucleotide
gaagctcagagcgtagaagggtatggggtggtgagtga

SEQ ID NO: 67618 - DNA, 38 bp, Artificial Sequence
  Synthetic oligonucleotide
gaagcggaaaggttggccgataggaggccgggtagtga

SEQ ID NO: 67619 - DNA, 38 bp, Artificial Sequence
  Synthetic oligonucleotide
atgtactgcataggtcctgaacgcgatagtcttagtga

SEQ ID NO: 67620 - DNA, 37 bp, Artificial Sequence
  Synthetic oligonucleotide
gtacgtgccaatctaatactcctggtccccatcgtga

SEQ ID NO: 67621 - DNA, 38 bp, Artificial Sequence
  Synthetic oligonucleotide
tcacgatcccccgtccatggcgataccttctagtgtga

SEQ ID NO: 67622 - DNA, 38 bp, Artificial Sequence
  Synthetic oligonucleotide
tagtacggggggccggggagggcgatgcaggcttgtga

SEQ ID NO: 67623 - DNA, 38 bp, Artificial Sequence
  Synthetic oligonucleotide
gctgaccaggagtatggttgagggatgggtgcttgtga

SEQ ID NO: 67624 - DNA, 37 bp, Artificial Sequence
  Synthetic oligonucleotide
acgtgaagaacaatggacgggaagggaaggagattga

SEQ ID NO: 67625 - DNA, 38 bp, Artificial Sequence
  Synthetic oligonucleotide
tatgccaggcgggccaccaggtaggagggagggattga

SEQ ID NO: 67626 - DNA, 38 bp, Artificial Sequence
  Synthetic oligonucleotide
ttacgtcgacatccggccaatcacgcactccctattga

SEQ ID NO: 67627 - DNA, 38 bp, Artificial Sequence
  Synthetic oligonucleotide
tatcaccctcacatttaatacgcggttccaggacttga

SEQ ID NO: 67628 - DNA, 37 bp, Artificial Sequence
  Synthetic oligonucleotide
acgactccctcgccttgacgatttcaacacgccttga

SEQ ID NO: 67629 - DNA, 38 bp, Artificial Sequence
  Synthetic oligonucleotide
tctgtcccagtagtcgtaacgtcctttcacctccttga

SEQ ID NO: 67630 - DNA, 37 bp, Artificial Sequence
  Synthetic oligonucleotide
ttgcacggtacataggggacgaagggcttgagcttga

SEQ ID NO: 67631 - DNA, 37 bp, Artificial Sequence
  Synthetic oligonucleotide
gaccgaatggtaaccaacagacaggaacgtacgttga

SEQ ID NO: 67632 - DNA, 38 bp, Artificial Sequence
  Synthetic oligonucleotide
tgagggctaggagtggagggtgggcatgactcggttga

SEQ ID NO: 67633 - DNA, 37 bp, Artificial Sequence
  Synthetic oligonucleotide
acgcaccatcacgggcatccgacttgtactttgttga

SEQ ID NO: 67634 - DNA, 38 bp, Artificial Sequence
  Synthetic oligonucleotide
tccccgacatgtgctttggcgtaaggccaaccatttga

SEQ ID NO: 67635 - DNA, 38 bp, Artificial Sequence
  Synthetic oligonucleotide
atggtcgtgtcgtcacaccgttgtaatatccgctttga

SEQ ID NO: 67636 - DNA, 35 bp, Artificial Sequence
  Synthetic oligonucleotide
gtgccacttcccacgtgaccgcccccacggaaata

SEQ ID NO: 67637 - DNA, 36 bp, Artificial Sequence
  Synthetic oligonucleotide
tgataccacaacaagagtactatgcgttggggcata

SEQ ID NO: 67638 - DNA, 36 bp, Artificial Sequence
  Synthetic oligonucleotide
ggggtgctgtctaaccgccccagccaacaccatgta

SEQ ID NO: 67639 - DNA, 36 bp, Artificial Sequence
  Synthetic oligonucleotide
gaactccccggtggtttacctttcgacttggtttta

SEQ ID NO: 67640 - DNA, 35 bp, Artificial Sequence
  Synthetic oligonucleotide
gacccgggggacccctcaatacaggcgatatccac

SEQ ID NO: 67641 - DNA, 35 bp, Artificial Sequence
  Synthetic oligonucleotide
gatcccgtaaattccttcccgaagctgccacgcac

SEQ ID NO: 67642 - DNA, 35 bp, Artificial Sequence
  Synthetic oligonucleotide
cgtagggccacctctgcctccttgggaccgccacc

SEQ ID NO: 67643 - DNA, 35 bp, Artificial Sequence
  Synthetic oligonucleotide
tatctacctcggtccataggtgatcacataacgcc

SEQ ID NO: 67644 - DNA, 35 bp, Artificial Sequence
  Synthetic oligonucleotide
tcccgaacaatgctcactttcccgagcgcgcccgc

SEQ ID NO: 67645 - DNA, 35 bp, Artificial Sequence
  Synthetic oligonucleotide
tcatgggtgcccatcttccagatccttaccgctgc

SEQ ID NO: 67646 - DNA, 35 bp, Artificial Sequence
  Synthetic oligonucleotide
aaccgggatcgactagagccacgacctatgccatc

SEQ ID NO: 67647 - DNA, 35 bp, Artificial Sequence
  Synthetic oligonucleotide
ttggagcttgccatctacggcctatcacaggtatc

SEQ ID NO: 67648 - DNA, 36 bp, Artificial Sequence
  Synthetic oligonucleotide
acaaggaggcctgccctaaaggacctttcttccctc

SEQ ID NO: 67649 - DNA, 35 bp, Artificial Sequence
  Synthetic oligonucleotide
gccccccaccccatgctgcacaactggagaaacag

SEQ ID NO: 67650 - DNA, 35 bp, Artificial Sequence
  Synthetic oligonucleotide
gaattctgcagtcggggaggatgggggggggtgag

SEQ ID NO: 67651 - DNA, 35 bp, Artificial Sequence
  Synthetic oligonucleotide
gtatggtacgcgggggggacattgcacagggtagg

SEQ ID NO: 67652 - DNA, 35 bp, Artificial Sequence
  Synthetic oligonucleotide
ttggtgtccacggcttaccaacccctttatcatgg

SEQ ID NO: 67653 - DNA, 35 bp, Artificial Sequence
  Synthetic oligonucleotide
tacagaaggcgcaagatggaactgttgggtcatgg

SEQ ID NO: 67654 - DNA, 35 bp, Artificial Sequence
  Synthetic oligonucleotide
gacacttgtctgtcccatctaatcagttatcgact

SEQ ID NO: 67655 - DNA, 34 bp, Artificial Sequence
  Synthetic oligonucleotide
attaccgacgccgcccatcgttgctgctgcccct

SEQ ID NO: 67656 - DNA, 35 bp, Artificial Sequence
  Synthetic oligonucleotide
gccagactataaatgcgtccccccccggctcgcct

SEQ ID NO: 67657 - DNA, 35 bp, Artificial Sequence
  Synthetic oligonucleotide
gctgcctctgcggtttccatgccactgaagttgct

SEQ ID NO: 67658 - DNA, 35 bp, Artificial Sequence
  Synthetic oligonucleotide
tgttcacccgccctccgtccgtcctgatactcagt

SEQ ID NO: 67659 - DNA, 35 bp, Artificial Sequence
  Synthetic oligonucleotide
gctccacttaggcaatttgttctggcgcccacatt

SEQ ID NO: 67660 - DNA, 35 bp, Artificial Sequence
  Synthetic oligonucleotide
tcactgtcgacacgctttttacttgttcgattatt

SEQ ID NO: 67661 - DNA, 35 bp, Artificial Sequence
  Synthetic oligonucleotide
gttggtcgaccgagctgccagccacaaaaactttt

SEQ ID NO: 67662 - DNA, 35 bp, Artificial Sequence
  Synthetic oligonucleotide
gtgaacctacgtcttgtcctaccctggtctgtaaa

SEQ ID NO: 67663 - DNA, 36 bp, Artificial Sequence
  Synthetic oligonucleotide
attggtcccgcaacacatgccatccccggacttaaa

SEQ ID NO: 67664 - DNA, 36 bp, Artificial Sequence
  Synthetic oligonucleotide
acgatgacactcagcccacttttaatcagtctgcaa

SEQ ID NO: 67665 - DNA, 36 bp, Artificial Sequence
  Synthetic oligonucleotide
tcatcgcctcgcaccccggttgcactatattcgtaa

SEQ ID NO: 67666 - DNA, 36 bp, Artificial Sequence
  Synthetic oligonucleotide
gtgcaagctgagtggagttgggtgggtggttggtaa

SEQ ID NO: 67667 - DNA, 36 bp, Artificial Sequence
  Synthetic oligonucleotide
atgtgggccctacactcgttatacacagcttattaa

SEQ ID NO: 67668 - DNA, 36 bp, Artificial Sequence
  Synthetic oligonucleotide
tgctactccccgggtgaactccgagttgtaccttaa

SEQ ID NO: 67669 - DNA, 35 bp, Artificial Sequence
  Synthetic oligonucleotide
gagccgaccaatcttttacaagcgtcgttttacca

SEQ ID NO: 67670 - DNA, 36 bp, Artificial Sequence
  Synthetic oligonucleotide
ttgaagtgacgcatgcctatcgcccatatctcccca

SEQ ID NO: 67671 - DNA, 35 bp, Artificial Sequence
  Synthetic oligonucleotide
gtaccgcgctggcctgacgtccgcttattccgcca

SEQ ID NO: 67672 - DNA, 36 bp, Artificial Sequence
  Synthetic oligonucleotide
gtcaccctccatcctttcgtacgctcgtcaaggcca

SEQ ID NO: 67673 - DNA, 35 bp, Artificial Sequence
  Synthetic oligonucleotide
accgtcaatcacacatgacggctgttacacctcca

SEQ ID NO: 67674 - DNA, 36 bp, Artificial Sequence
  Synthetic oligonucleotide
tatctggtgggtggcaggcgtggaattcggggagca

SEQ ID NO: 67675 - DNA, 35 bp, Artificial Sequence
  Synthetic oligonucleotide
atgagtggcgtactgcagttttttttagtttcgca

SEQ ID NO: 67676 - DNA, 36 bp, Artificial Sequence
  Synthetic oligonucleotide
gtgcacgagcgtgaacgtggttctctgtatctctca

SEQ ID NO: 67677 - DNA, 36 bp, Artificial Sequence
  Synthetic oligonucleotide
aacccactgtcgttacaatgacgtagctatcattca

SEQ ID NO: 67678 - DNA, 36 bp, Artificial Sequence
  Synthetic oligonucleotide
tagccagcgttacccaagcttctcatcttcgtttca

SEQ ID NO: 67679 - DNA, 35 bp, Artificial Sequence
  Synthetic oligonucleotide
tcagtgagaggggaggagattttagtaggtgaaga

SEQ ID NO: 67680 - DNA, 35 bp, Artificial Sequence
  Synthetic oligonucleotide
gttaaccgctgaaagtcctgctccactcatcgaga

SEQ ID NO: 67681 - DNA, 37 bp, Artificial Sequence
  Synthetic oligonucleotide
cacaggttgcttgtcccattgtctttggctttcacga

SEQ ID NO: 67682 - DNA, 36 bp, Artificial Sequence
  Synthetic oligonucleotide
gtcaactcccatttaaacacgcgtattgcgtcccga

SEQ ID NO: 67683 - DNA, 37 bp, Artificial Sequence
  Synthetic oligonucleotide
tcacttctagtgcatccctcaccgcggccggatccga

SEQ ID NO: 67684 - DNA, 37 bp, Artificial Sequence
  Synthetic oligonucleotide
atcgcgagtcaccgcctgccttggttagtctttccga

SEQ ID NO: 67685 - DNA, 37 bp, Artificial Sequence
  Synthetic oligonucleotide
ttggagtgctgagacgggggagggaaggtgttagcga

SEQ ID NO: 67686 - DNA, 36 bp, Artificial Sequence
  Synthetic oligonucleotide
attctctgccctgcttcgcccaactcccgtgtgcga

SEQ ID NO: 67687 - DNA, 37 bp, Artificial Sequence
  Synthetic oligonucleotide
atcccacgcagccccttggtctcccgacgattgtcga

SEQ ID NO: 67688 - DNA, 37 bp, Artificial Sequence
  Synthetic oligonucleotide
atcgcccaactacgctttcacataagtccgtccagga

SEQ ID NO: 67689 - DNA, 37 bp, Artificial Sequence
  Synthetic oligonucleotide
acagagtgcgggttctagagggacgctaaggggagga

SEQ ID NO: 67690 - DNA, 37 bp, Artificial Sequence
  Synthetic oligonucleotide
ggggggtactgggaacggggtggtgtggaagatagga

SEQ ID NO: 67691 - DNA, 37 bp, Artificial Sequence
  Synthetic oligonucleotide
gagagggtaatgggggggtcaaggagtgggactagga

SEQ ID NO: 67692 - DNA, 37 bp, Artificial Sequence
  Synthetic oligonucleotide
gcaactagacgtcgtcttcatttcccacccttacgga

SEQ ID NO: 67693 - DNA, 37 bp, Artificial Sequence
  Synthetic oligonucleotide
gtgctcgagagagggactagcaacttgacgggaggga

SEQ ID NO: 67694 - DNA, 37 bp, Artificial Sequence
  Synthetic oligonucleotide
tacgactctgctgaggaatcgggtggtgcgggaggga

SEQ ID NO: 67695 - DNA, 37 bp, Artificial Sequence
  Synthetic oligonucleotide
gtgcgttctggtgaggatgggcggggtgctttaggga

SEQ ID NO: 67696 - DNA, 37 bp, Artificial Sequence
  Synthetic oligonucleotide
gtgatgacatcaactgctgcgtatctcccgtccctga

SEQ ID NO: 67697 - DNA, 35 bp, Artificial Sequence
  Synthetic oligonucleotide
tgattgcgtacttcacccgtctaatacgatcctga

SEQ ID NO: 67698 - DNA, 36 bp, Artificial Sequence
  Synthetic oligonucleotide
tgacgccgtgatactaaccatgcggatctttcctga

SEQ ID NO: 67699 - DNA, 38 bp, Artificial Sequence
  Synthetic oligonucleotide
tttgtcgggccatatctggtttacttccactcctctga

SEQ ID NO: 67700 - DNA, 38 bp, Artificial Sequence
  Synthetic oligonucleotide
acccccgatacctttggggcatatgatcctttccgtga

SEQ ID NO: 67701 - DNA, 37 bp, Artificial Sequence
  Synthetic oligonucleotide
accctctttgccccgaccagtacaccgaagctcgtga

SEQ ID NO: 67702 - DNA, 38 bp, Artificial Sequence
  Synthetic oligonucleotide
acgtgtcatccaattcggcgcggtggcccccttcgtga

SEQ ID NO: 67703 - DNA, 37 bp, Artificial Sequence
  Synthetic oligonucleotide
ggggggagaagaatagggtgatcaatgcggaaggtga

SEQ ID NO: 67704 - DNA, 38 bp, Artificial Sequence
  Synthetic oligonucleotide
gttacgcgggacgtaagggggtggtgaaagcggggtga

SEQ ID NO: 67705 - DNA, 37 bp, Artificial Sequence
  Synthetic oligonucleotide
tcctctacccatgtgctaattgttgcaccacaattga

SEQ ID NO: 67706 - DNA, 38 bp, Artificial Sequence
  Synthetic oligonucleotide
tacgcgaggctgcagtatgtctgacgtgggatcattga

SEQ ID NO: 67707 - DNA, 37 bp, Artificial Sequence
  Synthetic oligonucleotide
tcaatctccgcctgaagcttttcgtccgtagccttga

SEQ ID NO: 67708 - DNA, 38 bp, Artificial Sequence
  Synthetic oligonucleotide
taccacataccgggtgatagggactatccccctcttga

SEQ ID NO: 67709 - DNA, 37 bp, Artificial Sequence
  Synthetic oligonucleotide
aactcgcaatgtccttcgtggcctagccttcctttga

SEQ ID NO: 67710 - DNA, 38 bp, Artificial Sequence
  Synthetic oligonucleotide
atccgccgccctagaagcagtggtgtgccttcctttga

SEQ ID NO: 67711 - DNA, 38 bp, Artificial Sequence
  Synthetic oligonucleotide
tccgaaggtaatacgggggaggggcgggcgacgtttga

SEQ ID NO: 67712 - DNA, 36 bp, Artificial Sequence
  Synthetic oligonucleotide
gtcactcagccgttgctcaccgcccttgttagaata

SEQ ID NO: 67713 - DNA, 35 bp, Artificial Sequence
  Synthetic oligonucleotide
atgacacaaaaggggggaacggcatcagagggata

SEQ ID NO: 67714 - DNA, 36 bp, Artificial Sequence
  Synthetic oligonucleotide
gtgatagcatcccccctggcccggcttcatgaacta

SEQ ID NO: 67715 - DNA, 36 bp, Artificial Sequence
  Synthetic oligonucleotide
tgtgacccgcttcttactacgctcgttcgcccacta

SEQ ID NO: 67716 - DNA, 36 bp, Artificial Sequence
  Synthetic oligonucleotide
tccttgcaacggtcgcatatctcatacccagtacta

SEQ ID NO: 67717 - DNA, 36 bp, Artificial Sequence
  Synthetic oligonucleotide
gagctgaaggtggtgaggtggttgggggggtaggta

SEQ ID NO: 67718 - DNA, 36 bp, Artificial Sequence
  Synthetic oligonucleotide
tccacatgggctttttggttttttgtatgacctgta

SEQ ID NO: 67719 - DNA, 36 bp, Artificial Sequence
  Synthetic oligonucleotide
tcgaccgaaccccccgcgaattacttgacacgtgta

SEQ ID NO: 67720 - DNA, 36 bp, Artificial Sequence
  Synthetic oligonucleotide
tcataacgccacattctccccctacacgtaccatta

SEQ ID NO: 67721 - DNA, 36 bp, Artificial Sequence
  Synthetic oligonucleotide
gatgcaacaaggcaactttgtactatcaaccgatta

SEQ ID NO: 67722 - DNA, 35 bp, Artificial Sequence
  Synthetic oligonucleotide
gcctgcacgggggcctccgcttttgtcacaactta

SEQ ID NO: 67723 - DNA, 36 bp, Artificial Sequence
  Synthetic oligonucleotide
acaagtcgcacgattcaatgtcgtgacctaccctta

SEQ ID NO: 67724 - DNA, 35 bp, Artificial Sequence
  Synthetic oligonucleotide
gcaccgcgagctgctcaccatcgagaatcgcttta

SEQ ID NO: 67725 - DNA, 35 bp, Artificial Sequence
  Synthetic oligonucleotide
tcccgccgccttgtttttttggtccgtcgtcaccc

SEQ ID NO: 67726 - DNA, 35 bp, Artificial Sequence
  Synthetic oligonucleotide
gcgagggtaaggcaactgaacctggagggagaccc

SEQ ID NO: 67727 - DNA, 35 bp, Artificial Sequence
  Synthetic oligonucleotide
gcgcgtatgacaccgtaatgcgtgtcacgttcccc

SEQ ID NO: 67728 - DNA, 35 bp, Artificial Sequence
  Synthetic oligonucleotide
gagttacacgcagcactacgaatcccaaacttgcc

SEQ ID NO: 67729 - DNA, 35 bp, Artificial Sequence
  Synthetic oligonucleotide
acaagcccacgtccatgtcattcggatctagatcc

SEQ ID NO: 67730 - DNA, 35 bp, Artificial Sequence
  Synthetic oligonucleotide
tttccgacttgccgcctcgctttttgttggtctcc

SEQ ID NO: 67731 - DNA, 35 bp, Artificial Sequence
  Synthetic oligonucleotide
gacgacaggggatggagtaggtagcaattgaactc

SEQ ID NO: 67732 - DNA, 35 bp, Artificial Sequence
  Synthetic oligonucleotide
tagtaccacggcttccgagacaagtatttaacctc

SEQ ID NO: 67733 - DNA, 35 bp, Artificial Sequence
  Synthetic oligonucleotide
acaccgccggagtgcctttatccgaatttggagtc

SEQ ID NO: 67734 - DNA, 35 bp, Artificial Sequence
  Synthetic oligonucleotide
tcatccgcttgcaaccaaggcactagcacctcttc

SEQ ID NO: 67735 - DNA, 35 bp, Artificial Sequence
  Synthetic oligonucleotide
gatgccaggaggttataggcacacggcttaaggag

SEQ ID NO: 67736 - DNA, 35 bp, Artificial Sequence
  Synthetic oligonucleotide
tcacccctaaagtgtgggttttcctttctactgcg

SEQ ID NO: 67737 - DNA, 35 bp, Artificial Sequence
  Synthetic oligonucleotide
ggacaccagcgggaacaagaagttgggtgataggg

SEQ ID NO: 67738 - DNA, 35 bp, Artificial Sequence
  Synthetic oligonucleotide
actagagtggaggcctagaggggatgtaggtaggg

SEQ ID NO: 67739 - DNA, 35 bp, Artificial Sequence
  Synthetic oligonucleotide
gttaacgagggtaaggaaggacgaaggggatttgg

SEQ ID NO: 67740 - DNA, 35 bp, Artificial Sequence
  Synthetic oligonucleotide
tgacgctctctgtgtcttctcgcttattcgctctg

SEQ ID NO: 67741 - DNA, 35 bp, Artificial Sequence
  Synthetic oligonucleotide
ggtgacctccgtttttaatgcccacttgaactttg

SEQ ID NO: 67742 - DNA, 35 bp, Artificial Sequence
  Synthetic oligonucleotide
acaacacctgcgcattgagcaccgttattccccat

SEQ ID NO: 67743 - DNA, 35 bp, Artificial Sequence
  Synthetic oligonucleotide
tatgggatgggtgggtggtgacaacgaagtaggat

SEQ ID NO: 67744 - DNA, 35 bp, Artificial Sequence
  Synthetic oligonucleotide
gagaaaacgaaatcggggtggatgagcgaggctat

SEQ ID NO: 67745 - DNA, 35 bp, Artificial Sequence
  Synthetic oligonucleotide
tctcatgctcatgaatcaagatcacctctcgcact

SEQ ID NO: 67746 - DNA, 35 bp, Artificial Sequence
  Synthetic oligonucleotide
cacctcacgcctatcctgtatcacgcctgaaacct

SEQ ID NO: 67747 - DNA, 35 bp, Artificial Sequence
  Synthetic oligonucleotide
ttcgacggtctgaaacggtacttttttatccccct

SEQ ID NO: 67748 - DNA, 34 bp, Artificial Sequence
  Synthetic oligonucleotide
acagggcgagtgtcgtgaaaagtgtggaatatgt

SEQ ID NO: 67749 - DNA, 35 bp, Artificial Sequence
  Synthetic oligonucleotide
atctttccgtccattgatgcttatcgccctcttgt

SEQ ID NO: 67750 - DNA, 35 bp, Artificial Sequence
  Synthetic oligonucleotide
gtcggtcttcctctctcgcgcacagccaccgttgt

SEQ ID NO: 67751 - DNA, 35 bp, Artificial Sequence
  Synthetic oligonucleotide
tcgaacagtcagtggtcatcccgtgtcgcctggtt

SEQ ID NO: 67752 - DNA, 35 bp, Artificial Sequence
  Synthetic oligonucleotide
tcctccacccaccccctccgtgtcacatcttggtt

SEQ ID NO: 67753 - DNA, 35 bp, Artificial Sequence
  Synthetic oligonucleotide
tttgccctcgacccacgctggctgacagccacttt

SEQ ID NO: 67754 - DNA, 35 bp, Artificial Sequence
  Synthetic oligonucleotide
ggagccaggggcgcaaccttgttacttcctgtttt

SEQ ID NO: 67755 - DNA, 36 bp, Artificial Sequence
  Synthetic oligonucleotide
agacgccccaccaatcgtgctatgaatccggccaaa

SEQ ID NO: 67756 - DNA, 35 bp, Artificial Sequence
  Synthetic oligonucleotide
acagccggctcactctctgaacctttttcgttaaa

SEQ ID NO: 67757 - DNA, 36 bp, Artificial Sequence
  Synthetic oligonucleotide
gacgcatctatactcgctggttatctttctgcacaa

SEQ ID NO: 67758 - DNA, 36 bp, Artificial Sequence
  Synthetic oligonucleotide
tgggttggagggttggggtattagtgggtggcataa

SEQ ID NO: 67759 - DNA, 36 bp, Artificial Sequence
  Synthetic oligonucleotide
aatagcctgccactccgtttcacgttccgttcttaa

SEQ ID NO: 67760 - DNA, 36 bp, Artificial Sequence
  Synthetic oligonucleotide
tagttgtgcgcattcccggcctggataccattttaa

SEQ ID NO: 67761 - DNA, 35 bp, Artificial Sequence
  Synthetic oligonucleotide
gctgtacgtgacagcactgatcgagcctggcaaca

SEQ ID NO: 67762 - DNA, 35 bp, Artificial Sequence
  Synthetic oligonucleotide
gccactgagatcgctgtctgttccctcacgtaaca

SEQ ID NO: 67763 - DNA, 35 bp, Artificial Sequence
  Synthetic oligonucleotide
ggcccacctcatctaccatcacagcttctcgcaca

SEQ ID NO: 67764 - DNA, 36 bp, Artificial Sequence
  Synthetic oligonucleotide
gccctccactcgcatccaggttgcgttacctgtcca

SEQ ID NO: 67765 - DNA, 36 bp, Artificial Sequence
  Synthetic oligonucleotide
aacataccgccgccaggtgttcgtccgggatccgca

SEQ ID NO: 67766 - DNA, 36 bp, Artificial Sequence
  Synthetic oligonucleotide
gactcgccttcacaaggtgaatacccctgactcgca

SEQ ID NO: 67767 - DNA, 34 bp, Artificial Sequence
  Synthetic oligonucleotide
tcacgctgtccgctctatgccatacgtacatgca

SEQ ID NO: 67768 - DNA, 36 bp, Artificial Sequence
  Synthetic oligonucleotide
tacactcccgattggaatggaacaactcaaattgca

SEQ ID NO: 67769 - DNA, 36 bp, Artificial Sequence
  Synthetic oligonucleotide
gcaaccgctccacaagccgcaaggagcttgacatca

SEQ ID NO: 67770 - DNA, 36 bp, Artificial Sequence
  Synthetic oligonucleotide
gtatgaacacgaagcagagggggaaaagcgaggtca

SEQ ID NO: 67771 - DNA, 36 bp, Artificial Sequence
  Synthetic oligonucleotide
acaggacactcgtcattattcctcactctcgtttca

SEQ ID NO: 67772 - DNA, 35 bp, Artificial Sequence
  Synthetic oligonucleotide
gacacttgccccttgaaccgtgatcaacaacgaga

SEQ ID NO: 67773 - DNA, 37 bp, Artificial Sequence
  Synthetic oligonucleotide
tccaacagtgatcagctgtgaggggtgggaatggaga

SEQ ID NO: 67774 - DNA, 37 bp, Artificial Sequence
  Synthetic oligonucleotide
ggccggccaactgctaaactgcctccaccttatacga

SEQ ID NO: 67775 - DNA, 35 bp, Artificial Sequence
  Synthetic oligonucleotide
acccttcgcactgctttccatcggaattcttacga

SEQ ID NO: 67776 - DNA, 37 bp, Artificial Sequence
  Synthetic oligonucleotide
gcctgtttcccgattatgtttaccgcaccttccccga

SEQ ID NO: 67777 - DNA, 36 bp, Artificial Sequence
  Synthetic oligonucleotide
gtcatcgcggctctggtctatctatttccttcccga

SEQ ID NO: 67778 - DNA, 37 bp, Artificial Sequence
  Synthetic oligonucleotide
acgcaaccgtcccatttacaccttgtccgccgtgcga

SEQ ID NO: 67779 - DNA, 37 bp, Artificial Sequence
  Synthetic oligonucleotide
tcacattgaaactgcatccatcacgcatgtctatcga

SEQ ID NO: 67780 - DNA, 37 bp, Artificial Sequence
  Synthetic oligonucleotide
agcgtgcctggtccctccttccgtgttctcctgtcga

SEQ ID NO: 67781 - DNA, 37 bp, Artificial Sequence
  Synthetic oligonucleotide
tgagacccacacctccctcctaatatagttcgaagga

SEQ ID NO: 67782 - DNA, 36 bp, Artificial Sequence
  Synthetic oligonucleotide
taggtggtcaagccataagtagaggggaagggagga

SEQ ID NO: 67783 - DNA, 37 bp, Artificial Sequence
  Synthetic oligonucleotide
actctacggtccccgatgtcacccccttcttcccgga

SEQ ID NO: 67784 - DNA, 37 bp, Artificial Sequence
  Synthetic oligonucleotide
gacccgccccctatattttgaagactcttcattcgga

SEQ ID NO: 67785 - DNA, 36 bp, Artificial Sequence
  Synthetic oligonucleotide
atccactccctctcgcacggtgtccataagccggga

SEQ ID NO: 67786 - DNA, 37 bp, Artificial Sequence
  Synthetic oligonucleotide
gcacacagaactcaggggaggactggggaacttggga

SEQ ID NO: 67787 - DNA, 37 bp, Artificial Sequence
  Synthetic oligonucleotide
aacgtggcggaccgggttgcgtagtgggtagggtgga

SEQ ID NO: 67788 - DNA, 37 bp, Artificial Sequence
  Synthetic oligonucleotide
ttcaccaacctcgatgttccttctactacaataatga

SEQ ID NO: 67789 - DNA, 38 bp, Artificial Sequence
  Synthetic oligonucleotide
gttgggggcgaggaaaagggcagtcgcacataagatga

SEQ ID NO: 67790 - DNA, 37 bp, Artificial Sequence
  Synthetic oligonucleotide
gtccacatgctcgagtggccactggacccacctatga

SEQ ID NO: 67791 - DNA, 38 bp, Artificial Sequence
  Synthetic oligonucleotide
ttctatgaggggtgggagggtacatggggaatgtatga

SEQ ID NO: 67792 - DNA, 38 bp, Artificial Sequence
  Synthetic oligonucleotide
tccatccgtatatggtgcctgctctcccccgtttatga

SEQ ID NO: 67793 - DNA, 38 bp, Artificial Sequence
  Synthetic oligonucleotide
aacgtcgtcttccaccaccgcctcgccgtcttttatga

SEQ ID NO: 67794 - DNA, 37 bp, Artificial Sequence
  Synthetic oligonucleotide
gtagagctcgacactgccctgtgcccgttcatactga

SEQ ID NO: 67795 - DNA, 38 bp, Artificial Sequence
  Synthetic oligonucleotide
gtaaccctggccccgcacttttcgtacgtccttactga

SEQ ID NO: 67796 - DNA, 38 bp, Artificial Sequence
  Synthetic oligonucleotide
atagtcagcccaatgtccttttccccgcgaacgcctga

SEQ ID NO: 67797 - DNA, 38 bp, Artificial Sequence
  Synthetic oligonucleotide
ttgcccactacggggtttaccgccatctctcttcctga

SEQ ID NO: 67798 - DNA, 38 bp, Artificial Sequence
  Synthetic oligonucleotide
tgacgagggggtagggagtatcttgaggtttggtctga

SEQ ID NO: 67799 - DNA, 38 bp, Artificial Sequence
  Synthetic oligonucleotide
tacacgctgccggcggtgttctctcgcgtcctgtctga

SEQ ID NO: 67800 - DNA, 38 bp, Artificial Sequence
  Synthetic oligonucleotide
gtgatgctccgcgtgctgccttcttacctattttctga

SEQ ID NO: 67801 - DNA, 38 bp, Artificial Sequence
  Synthetic oligonucleotide
tccatccccactttcatattgttaggtactcacagtga

SEQ ID NO: 67802 - DNA, 37 bp, Artificial Sequence
  Synthetic oligonucleotide
gcagggaaagtagcgggcgcagacgggaggggagtga

SEQ ID NO: 67803 - DNA, 37 bp, Artificial Sequence
  Synthetic oligonucleotide
gaccccgcctcagcgatctagttacaccattacgtga

SEQ ID NO: 67804 - DNA, 38 bp, Artificial Sequence
  Synthetic oligonucleotide
gcccgctccgtcccttggcgcgactccggaccccgtga

SEQ ID NO: 67805 - DNA, 38 bp, Artificial Sequence
  Synthetic oligonucleotide
gtcccgccctctatatgttcgcataccatcttaattga

SEQ ID NO: 67806 - DNA, 38 bp, Artificial Sequence
  Synthetic oligonucleotide
atgattggtggggagggtctagggggaccgcggattga

SEQ ID NO: 67807 - DNA, 38 bp, Artificial Sequence
  Synthetic oligonucleotide
gtccgtaccaactgtatccgtcatcacccccttcttga

SEQ ID NO: 67808 - DNA, 37 bp, Artificial Sequence
  Synthetic oligonucleotide
tgctcagccagcccgccgctattccaaaagaatttga

SEQ ID NO: 67809 - DNA, 38 bp, Artificial Sequence
  Synthetic oligonucleotide
gagtgcgcccccgactggttaatagtaaccgaatttga

SEQ ID NO: 67810 - DNA, 37 bp, Artificial Sequence
  Synthetic oligonucleotide
tcacctgttgaactgccctaaaagccagatcttttga

SEQ ID NO: 67811 - DNA, 36 bp, Artificial Sequence
  Synthetic oligonucleotide
ttatggtcgaatcccccgctgcgctttgcataccta

SEQ ID NO: 67812 - DNA, 36 bp, Artificial Sequence
  Synthetic oligonucleotide
aagccaccaccatggcttcaggacgaacatctgcta

SEQ ID NO: 67813 - DNA, 36 bp, Artificial Sequence
  Synthetic oligonucleotide
gttggggaacatcgtgtcaccaacaccgattctcta

SEQ ID NO: 67814 - DNA, 33 bp, Artificial Sequence
  Synthetic oligonucleotide
atgacctgggacacttccgcatgttgcatctta

SEQ ID NO: 67815 - DNA, 37 bp, Artificial Sequence
  Synthetic oligonucleotide
tcttgagcaggcctattcatgcaattctgtgatctta

SEQ ID NO: 67816 - DNA, 35 bp, Artificial Sequence
  Synthetic oligonucleotide
ttctgacgtcgttcctcgcctacacactttcgcac

SEQ ID NO: 67817 - DNA, 35 bp, Artificial Sequence
  Synthetic oligonucleotide
tttagccatccttgccgtcgactcgctacgttcac

SEQ ID NO: 67818 - DNA, 35 bp, Artificial Sequence
  Synthetic oligonucleotide
tgtccgttcccacgttcgtctactatacaccagac

SEQ ID NO: 67819 - DNA, 35 bp, Artificial Sequence
  Synthetic oligonucleotide
ttgttagcaccaagtccggcccgaccaccgcgtac

SEQ ID NO: 67820 - DNA, 35 bp, Artificial Sequence
  Synthetic oligonucleotide
tagccccggatagctgcagccagtcgacatccacc

SEQ ID NO: 67821 - DNA, 35 bp, Artificial Sequence
  Synthetic oligonucleotide
tgatcatgccctccgtccactgcgtgctcctgccc

SEQ ID NO: 67822 - DNA, 35 bp, Artificial Sequence
  Synthetic oligonucleotide
gatcgacggaccccttgaggcggccttttttttcc

SEQ ID NO: 67823 - DNA, 35 bp, Artificial Sequence
  Synthetic oligonucleotide
atcgtgctgatcgcttggtgcccattactccccgc

SEQ ID NO: 67824 - DNA, 35 bp, Artificial Sequence
  Synthetic oligonucleotide
tcccgtccactatcatacggcacccctataaaggc

SEQ ID NO: 67825 - DNA, 35 bp, Artificial Sequence
  Synthetic oligonucleotide
aagcctaacccgttaccccctttgtaccagtgtgc

SEQ ID NO: 67826 - DNA, 35 bp, Artificial Sequence
  Synthetic oligonucleotide
caccctgagcctcctagttgcgactaagcccactc

SEQ ID NO: 67827 - DNA, 35 bp, Artificial Sequence
  Synthetic oligonucleotide
gtagccccatgtggcctcgaccttgcactcccttc

SEQ ID NO: 67828 - DNA, 35 bp, Artificial Sequence
  Synthetic oligonucleotide
atggatcgtccacatccggcttcctgttgttcttc

SEQ ID NO: 67829 - DNA, 35 bp, Artificial Sequence
  Synthetic oligonucleotide
agctcgagtatggtggggtggtcttgaaaagcggg

SEQ ID NO: 67830 - DNA, 35 bp, Artificial Sequence
  Synthetic oligonucleotide
aggggggaacggagggagtctctaatacggtcggg

SEQ ID NO: 67831 - DNA, 35 bp, Artificial Sequence
  Synthetic oligonucleotide
tccatcctaagatgtcgtacctgcgcctcttacat

SEQ ID NO: 67832 - DNA, 35 bp, Artificial Sequence
  Synthetic oligonucleotide
gattgcccgagtgcttgcaaaatttcctggatcat

SEQ ID NO: 67833 - DNA, 36 bp, Artificial Sequence
  Synthetic oligonucleotide
gttcgggtaggatggtgcagtcggggtggggtatat

SEQ ID NO: 67834 - DNA, 35 bp, Artificial Sequence
  Synthetic oligonucleotide
acgtcgccatccatttccgcaagttccatacacct

SEQ ID NO: 67835 - DNA, 35 bp, Artificial Sequence
  Synthetic oligonucleotide
gataccgctagtgttacattgtgtcgcgttaccct

SEQ ID NO: 67836 - DNA, 35 bp, Artificial Sequence
  Synthetic oligonucleotide
gcccggtccgacccaccctaaacgtcgatctctct

SEQ ID NO: 67837 - DNA, 35 bp, Artificial Sequence
  Synthetic oligonucleotide
gatgccaccgtttataccagtggtgccttatttct

SEQ ID NO: 67838 - DNA, 35 bp, Artificial Sequence
  Synthetic oligonucleotide
tgaccaccgtgctgccagtctgtcttcctgtaggt

SEQ ID NO: 67839 - DNA, 35 bp, Artificial Sequence
  Synthetic oligonucleotide
gacgttacgttcttcccgcttactttcttgtctgt

SEQ ID NO: 67840 - DNA, 35 bp, Artificial Sequence
  Synthetic oligonucleotide
attctgcggctctcacttggttgctcgttctttgt

SEQ ID NO: 67841 - DNA, 35 bp, Artificial Sequence
  Synthetic oligonucleotide
gtcggacgactgagcttggtcgccctctcttttgt

SEQ ID NO: 67842 - DNA, 35 bp, Artificial Sequence
  Synthetic oligonucleotide
gcatatgccctggcacgaaccacacgccttatctt

SEQ ID NO: 67843 - DNA, 35 bp, Artificial Sequence
  Synthetic oligonucleotide
gtatcacacatgggtcgtactgcaactgctcattt

SEQ ID NO: 67844 - DNA, 35 bp, Artificial Sequence
  Synthetic oligonucleotide
acctatcccggaagtctcccctaaggtgccacttt

SEQ ID NO: 67845 - DNA, 35 bp, Artificial Sequence
  Synthetic oligonucleotide
tccatgcgcgcgcattgcttaccatttaatctgaa

SEQ ID NO: 67846 - DNA, 35 bp, Artificial Sequence
  Synthetic oligonucleotide
acaccaaccgcccttgcaccttaaacgtgggcaca

SEQ ID NO: 67847 - DNA, 36 bp, Artificial Sequence
  Synthetic oligonucleotide
acgacccgccatccgttgctacacactgtccaccca

SEQ ID NO: 67848 - DNA, 36 bp, Artificial Sequence
  Synthetic oligonucleotide
acatgcaaagctcaatccggacgcacactacgccca

SEQ ID NO: 67849 - DNA, 36 bp, Artificial Sequence
  Synthetic oligonucleotide
gaacccgccaacccctgttttacaatgtgagtgcca

SEQ ID NO: 67850 - DNA, 36 bp, Artificial Sequence
  Synthetic oligonucleotide
accccgagtcctctcccacgctgtaccattcctgca

SEQ ID NO: 67851 - DNA, 36 bp, Artificial Sequence
  Synthetic oligonucleotide
gcttaatcccgcctcccaccaccctcaaagtgtgca

SEQ ID NO: 67852 - DNA, 36 bp, Artificial Sequence
  Synthetic oligonucleotide
tcctgctgcctttcatgacctttttgctaggattca

SEQ ID NO: 67853 - DNA, 35 bp, Artificial Sequence
  Synthetic oligonucleotide
tccacatcccgttcctctttgatcgtagcacttca

SEQ ID NO: 67854 - DNA, 36 bp, Artificial Sequence
  Synthetic oligonucleotide
aacgcctgggaacatctctcagagccttacatttca

SEQ ID NO: 67855 - DNA, 37 bp, Artificial Sequence
  Synthetic oligonucleotide
tcccgaccacgcatattgtacacctcaaccggtaaga

SEQ ID NO: 67856 - DNA, 37 bp, Artificial Sequence
  Synthetic oligonucleotide
aatcacctcacaactccagaccaccacctgtagcaga

SEQ ID NO: 67857 - DNA, 37 bp, Artificial Sequence
  Synthetic oligonucleotide
gaacggacgagtgaaagattaggggcgcatgtagaga

SEQ ID NO: 67858 - DNA, 37 bp, Artificial Sequence
  Synthetic oligonucleotide
tgtgagaggcgagaggcgaggcggggggatggtgaga

SEQ ID NO: 67859 - DNA, 37 bp, Artificial Sequence
  Synthetic oligonucleotide
gccagccataccgctgaggtaaatcatgcacctacga

SEQ ID NO: 67860 - DNA, 36 bp, Artificial Sequence
  Synthetic oligonucleotide
gttaccacattggcacccccagccgccctgaaccga

SEQ ID NO: 67861 - DNA, 37 bp, Artificial Sequence
  Synthetic oligonucleotide
tcaccaaaccatgagtgctttatgtctccacgcccga

SEQ ID NO: 67862 - DNA, 35 bp, Artificial Sequence
  Synthetic oligonucleotide
tcccatccccagcctccacgtttcattctaatcga

SEQ ID NO: 67863 - DNA, 37 bp, Artificial Sequence
  Synthetic oligonucleotide
acaaccaccaggccaacataagggtgcacttcctcga

SEQ ID NO: 67864 - DNA, 37 bp, Artificial Sequence
  Synthetic oligonucleotide
ggaccagtcctcaaacgccccgtacctcgcccacgga

SEQ ID NO: 67865 - DNA, 37 bp, Artificial Sequence
  Synthetic oligonucleotide
gtacgcctagtaattgctgcccctcgttcctgacgga

SEQ ID NO: 67866 - DNA, 37 bp, Artificial Sequence
  Synthetic oligonucleotide
aagattaggggacgggtcggaggggtctaggtaggga

SEQ ID NO: 67867 - DNA, 37 bp, Artificial Sequence
  Synthetic oligonucleotide
gaatgcgctggtagactgcatttgttactggtgggga

SEQ ID NO: 67868 - DNA, 37 bp, Artificial Sequence
  Synthetic oligonucleotide
gtgtgaatgacgggggggggaagtgcagcacgtggga

SEQ ID NO: 67869 - DNA, 37 bp, Artificial Sequence
  Synthetic oligonucleotide
tgcaagtggggaactgaaaagcggcggaatgaatgga

SEQ ID NO: 67870 - DNA, 36 bp, Artificial Sequence
  Synthetic oligonucleotide
taagcctacgttcgagcccttacctcccctcgtgga

SEQ ID NO: 67871 - DNA, 35 bp, Artificial Sequence
  Synthetic oligonucleotide
ggagggccatgggaggtaagacggtagagggtgga

SEQ ID NO: 67872 - DNA, 37 bp, Artificial Sequence
  Synthetic oligonucleotide
gcgatgggtcacggtttacttgtttctcctccttgga

SEQ ID NO: 67873 - DNA, 38 bp, Artificial Sequence
  Synthetic oligonucleotide
atccgccatacgccgtacctcacattgacctctaatga

SEQ ID NO: 67874 - DNA, 38 bp, Artificial Sequence
  Synthetic oligonucleotide
ccaccggtcattcccatcttgcagccaccataccatga

SEQ ID NO: 67875 - DNA, 38 bp, Artificial Sequence
  Synthetic oligonucleotide
agaggggggtggagcactgggctgaatagaggggatga

SEQ ID NO: 67876 - DNA, 38 bp, Artificial Sequence
  Synthetic oligonucleotide
gcgaatgtgcgtacagcgaactaactctctctctctga

SEQ ID NO: 67877 - DNA, 36 bp, Artificial Sequence
  Synthetic oligonucleotide
tcctgctgtgcctcccgctcttcttactcggtctga

SEQ ID NO: 67878 - DNA, 38 bp, Artificial Sequence
  Synthetic oligonucleotide
tcccaggaaaaaatgcccaatgagaggggacgaagtga

SEQ ID NO: 67879 - DNA, 38 bp, Artificial Sequence
  Synthetic oligonucleotide
gagatgaaagggaacgagagggacgaagatgtaggtga

SEQ ID NO: 67880 - DNA, 38 bp, Artificial Sequence
  Synthetic oligonucleotide
gaatcaggctcatacggttttttatggcttcttggtga

SEQ ID NO: 67881 - DNA, 38 bp, Artificial Sequence
  Synthetic oligonucleotide
catctgcccctgctcgctatcatacgttcttttggtga

SEQ ID NO: 67882 - DNA, 38 bp, Artificial Sequence
  Synthetic oligonucleotide
tacctctcgcccctcacgcctgttgtgcgaaccattga

SEQ ID NO: 67883 - DNA, 38 bp, Artificial Sequence
  Synthetic oligonucleotide
gtctgctccactgttaccctgcgccgcttatcacttga

SEQ ID NO: 67884 - DNA, 37 bp, Artificial Sequence
  Synthetic oligonucleotide
tcagtccagacccgccctccacgccctcatcggttga

SEQ ID NO: 67885 - DNA, 37 bp, Artificial Sequence
  Synthetic oligonucleotide
aacacgcgctcaacactctccgcacgtgaccatttga

SEQ ID NO: 67886 - DNA, 38 bp, Artificial Sequence
  Synthetic oligonucleotide
gatgagcctggagtgggtggagtggctcgtccctttga

SEQ ID NO: 67887 - DNA, 36 bp, Artificial Sequence
  Synthetic oligonucleotide
ttgtgcagagcttcccactattgttcgcggcaacta

SEQ ID NO: 67888 - DNA, 36 bp, Artificial Sequence
  Synthetic oligonucleotide
agggggaggggaaggaaggaaggtcgcgcagagcta

SEQ ID NO: 67889 - DNA, 36 bp, Artificial Sequence
  Synthetic oligonucleotide
gatagggacatagaaaagtaagagcgagacaggcta

SEQ ID NO: 67890 - DNA, 35 bp, Artificial Sequence
  Synthetic oligonucleotide
tcacccgccagatcacgcttctttggatcaatcta

SEQ ID NO: 67891 - DNA, 36 bp, Artificial Sequence
  Synthetic oligonucleotide
tcaaaggtgcgtgccgatccaaccactacctgagta

SEQ ID NO: 67892 - DNA, 35 bp, Artificial Sequence
  Synthetic oligonucleotide
ggtagagccccaatctgccgtaacttcaccatgta

SEQ ID NO: 67893 - DNA, 36 bp, Artificial Sequence
  Synthetic oligonucleotide
ttgccctgtctcgatatgacctcgctttcctatgta

SEQ ID NO: 67894 - DNA, 36 bp, Artificial Sequence
  Synthetic oligonucleotide
tatctcgccacctcctaacacagcagttcctactta

SEQ ID NO: 67895 - DNA, 35 bp, Artificial Sequence
  Synthetic oligonucleotide
gtgcctgcatctattccactgaggccttaccctta

SEQ ID NO: 67896 - DNA, 35 bp, Artificial Sequence
  Synthetic oligonucleotide
gacatgaccgggtgccttgttggggagcctaccac

SEQ ID NO: 67897 - DNA, 35 bp, Artificial Sequence
  Synthetic oligonucleotide
tacaccgggggtcataacagtagcgtcgcaactac

SEQ ID NO: 67898 - DNA, 35 bp, Artificial Sequence
  Synthetic oligonucleotide
aacgaggggacctgtacgggcgttaccttctctac

SEQ ID NO: 67899 - DNA, 35 bp, Artificial Sequence
  Synthetic oligonucleotide
attcgaacctctgccactagccttcacatgtaacc

SEQ ID NO: 67900 - DNA, 35 bp, Artificial Sequence
  Synthetic oligonucleotide
tgccaccgctctgtctcagcaggtgacccctaccc

SEQ ID NO: 67901 - DNA, 35 bp, Artificial Sequence
  Synthetic oligonucleotide
tccgtagcgtacctcgtcacggttaaccggtcccc

SEQ ID NO: 67902 - DNA, 35 bp, Artificial Sequence
  Synthetic oligonucleotide
tgcccgcgctcctccccctcgtcttgcgtaggccc

SEQ ID NO: 67903 - DNA, 35 bp, Artificial Sequence
  Synthetic oligonucleotide
tctctcacgctctaccctgtcattcgctcggtccc

SEQ ID NO: 67904 - DNA, 35 bp, Artificial Sequence
  Synthetic oligonucleotide
ggatgcctcgtgagcgcttaactctgatcctatcc

SEQ ID NO: 67905 - DNA, 35 bp, Artificial Sequence
  Synthetic oligonucleotide
tcaacacttggtcggcgtgcccagtctagacctcc

SEQ ID NO: 67906 - DNA, 35 bp, Artificial Sequence
  Synthetic oligonucleotide
gctgaccgaataggagggagggggagggccggtcc

SEQ ID NO: 67907 - DNA, 35 bp, Artificial Sequence
  Synthetic oligonucleotide
gccaacgggtttttatcgatcgcccttttatgtcc

SEQ ID NO: 67908 - DNA, 35 bp, Artificial Sequence
  Synthetic oligonucleotide
acattgcgagagcagagtcacaccgacctgctagc

SEQ ID NO: 67909 - DNA, 35 bp, Artificial Sequence
  Synthetic oligonucleotide
gcctacgccctgtacacgacccttcccactcacgc

SEQ ID NO: 67910 - DNA, 35 bp, Artificial Sequence
  Synthetic oligonucleotide
atgtccccagtggttagcgcgcccttcactgacgc

SEQ ID NO: 67911 - DNA, 35 bp, Artificial Sequence
  Synthetic oligonucleotide
gtcccactatgcccccgaaagacgggcattttctc

SEQ ID NO: 67912 - DNA, 35 bp, Artificial Sequence
  Synthetic oligonucleotide
ccgcgggttccagttcctcaatcaatccggtattc

SEQ ID NO: 67913 - DNA, 35 bp, Artificial Sequence
  Synthetic oligonucleotide
gtgatgccatgttaaagccgtaccagttccatttc

SEQ ID NO: 67914 - DNA, 35 bp, Artificial Sequence
  Synthetic oligonucleotide
ttctccctccaccgacagtcatccagtaacttgag

SEQ ID NO: 67915 - DNA, 35 bp, Artificial Sequence
  Synthetic oligonucleotide
tccgccacactcagcacttttcggatgaacttacg

SEQ ID NO: 67916 - DNA, 35 bp, Artificial Sequence
  Synthetic oligonucleotide
caccctcgccactttttgaccttgctgtttattcg

SEQ ID NO: 67917 - DNA, 35 bp, Artificial Sequence
  Synthetic oligonucleotide
tccactcgctttcatatctgggatactactgcctg

SEQ ID NO: 67918 - DNA, 35 bp, Artificial Sequence
  Synthetic oligonucleotide
gtcaaaagaacagtacgtgcaatgggtaggtattg

SEQ ID NO: 67919 - DNA, 35 bp, Artificial Sequence
  Synthetic oligonucleotide
gctgagctctcaatctctgaggccacatacaacat

SEQ ID NO: 67920 - DNA, 35 bp, Artificial Sequence
  Synthetic oligonucleotide
gctgctgccatccactttcgtacctagcgccatat

SEQ ID NO: 67921 - DNA, 35 bp, Artificial Sequence
  Synthetic oligonucleotide
tcatcgcctaacatccctccataaccatgggctat

SEQ ID NO: 67922 - DNA, 35 bp, Artificial Sequence
  Synthetic oligonucleotide
acgagtggtaacaaatagggtgtaggtggaagtat

SEQ ID NO: 67923 - DNA, 35 bp, Artificial Sequence
  Synthetic oligonucleotide
gccccagccatctgtccaaaccaatgcacgcgcct

SEQ ID NO: 67924 - DNA, 35 bp, Artificial Sequence
  Synthetic oligonucleotide
acgccccgcacggttgaaactgccttgtctcggct

SEQ ID NO: 67925 - DNA, 35 bp, Artificial Sequence
  Synthetic oligonucleotide
gccgatcacctggccagtacataccgcgcttggct

SEQ ID NO: 67926 - DNA, 35 bp, Artificial Sequence
  Synthetic oligonucleotide
acatcctcctgccggtgattctaatgaagattcgt

SEQ ID NO: 67927 - DNA, 34 bp, Artificial Sequence
  Synthetic oligonucleotide
aagatgctcctgcccctgtcaccgcttgcaaatt

SEQ ID NO: 67928 - DNA, 35 bp, Artificial Sequence
  Synthetic oligonucleotide
acctcaacaaccgcaactatggcgcatcctctctt

SEQ ID NO: 67929 - DNA, 35 bp, Artificial Sequence
  Synthetic oligonucleotide
tgctaccgccaccatttcggtctcttgctttattt

SEQ ID NO: 67930 - DNA, 36 bp, Artificial Sequence
  Synthetic oligonucleotide
taatcacccccttgctgacacgcctgtgcagcaaaa

SEQ ID NO: 67931 - DNA, 35 bp, Artificial Sequence
  Synthetic oligonucleotide
gaggtgactagggggatgcccggaatggtgggaaa

SEQ ID NO: 67932 - DNA, 36 bp, Artificial Sequence
  Synthetic oligonucleotide
acttcacccgcgttttctgacaagccacccccgcaa

SEQ ID NO: 67933 - DNA, 36 bp, Artificial Sequence
  Synthetic oligonucleotide
gttacacgcctcacgagtgcacaccaagaacctcaa

SEQ ID NO: 67934 - DNA, 35 bp, Artificial Sequence
  Synthetic oligonucleotide
tccaccaattcgacgaccggatcgatcaccttcaa

SEQ ID NO: 67935 - DNA, 35 bp, Artificial Sequence
  Synthetic oligonucleotide
gtgggaatcgcagcagcccagcctcacacctcgaa

SEQ ID NO: 67936 - DNA, 35 bp, Artificial Sequence
  Synthetic oligonucleotide
ggaacatgccggagaaaagtggagtatgcacggaa

SEQ ID NO: 67937 - DNA, 35 bp, Artificial Sequence
  Synthetic oligonucleotide
gcacccacacgatatccacctacgaatcttctgaa

SEQ ID NO: 67938 - DNA, 35 bp, Artificial Sequence
  Synthetic oligonucleotide
tttggaggacccgacctctgtatcacgtaccttaa

SEQ ID NO: 67939 - DNA, 35 bp, Artificial Sequence
  Synthetic oligonucleotide
accccccgcactgcctatgaacgccaatgtcttaa

SEQ ID NO: 67940 - DNA, 36 bp, Artificial Sequence
  Synthetic oligonucleotide
gagggcgagacgggggaaataatgtggcagcaaaca

SEQ ID NO: 67941 - DNA, 36 bp, Artificial Sequence
  Synthetic oligonucleotide
ttatgacgctggtaccttatggccgtactttaaaca

SEQ ID NO: 67942 - DNA, 35 bp, Artificial Sequence
  Synthetic oligonucleotide
gcgaacaaagccatctctcgccacatagtgccaca

SEQ ID NO: 67943 - DNA, 36 bp, Artificial Sequence
  Synthetic oligonucleotide
tatccctgcgtcttgacgcgactttttgatcctaca

SEQ ID NO: 67944 - DNA, 35 bp, Artificial Sequence
  Synthetic oligonucleotide
tagagcgcaaagaacaagaaggaaagtcggacgca

SEQ ID NO: 67945 - DNA, 36 bp, Artificial Sequence
  Synthetic oligonucleotide
gctgagctcgtcccatgccaaccgtactgtgatgca

SEQ ID NO: 67946 - DNA, 35 bp, Artificial Sequence
  Synthetic oligonucleotide
gggaggcacgggaagtgttggatgggggaggtgca

SEQ ID NO: 67947 - DNA, 36 bp, Artificial Sequence
  Synthetic oligonucleotide
tccgaccccccgtgtaagctctgcctgagaattgca

SEQ ID NO: 67948 - DNA, 36 bp, Artificial Sequence
  Synthetic oligonucleotide
gatttacgcctgcctgcttattgggtcgctattgca

SEQ ID NO: 67949 - DNA, 36 bp, Artificial Sequence
  Synthetic oligonucleotide
tatcattacacccgtcctgcttacgtagtattatca

SEQ ID NO: 67950 - DNA, 36 bp, Artificial Sequence
  Synthetic oligonucleotide
ttcatccccactgaccaactaggacgttaagtttca

SEQ ID NO: 67951 - DNA, 37 bp, Artificial Sequence
  Synthetic oligonucleotide
gccacatacagcacgcctcctgacatcattcacaaga

SEQ ID NO: 67952 - DNA, 37 bp, Artificial Sequence
  Synthetic oligonucleotide
gagagccggaagggaagtaagttgggctgggacaaga

SEQ ID NO: 67953 - DNA, 37 bp, Artificial Sequence
  Synthetic oligonucleotide
tagacctgtcaacgcataccagcactgccccataaga

SEQ ID NO: 67954 - DNA, 37 bp, Artificial Sequence
  Synthetic oligonucleotide
tcctgacccctgtactgtgccaaaggaattccctaga

SEQ ID NO: 67955 - DNA, 37 bp, Artificial Sequence
  Synthetic oligonucleotide
tgctcgggaccatgccccttgctccccccccctccga

SEQ ID NO: 67956 - DNA, 37 bp, Artificial Sequence
  Synthetic oligonucleotide
gcgcgatcaaacccgccccttccgtgcacgattccga

SEQ ID NO: 67957 - DNA, 37 bp, Artificial Sequence
  Synthetic oligonucleotide
tcaccggctcatctcttccgcctcgcgttccaatcga

SEQ ID NO: 67958 - DNA, 37 bp, Artificial Sequence
  Synthetic oligonucleotide
tgcatagaacgtctgccctcctgaaaccctgtctcga

SEQ ID NO: 67959 - DNA, 37 bp, Artificial Sequence
  Synthetic oligonucleotide
gttagacagtggaaaaataggggttggtggcgccgga

SEQ ID NO: 67960 - DNA, 37 bp, Artificial Sequence
  Synthetic oligonucleotide
gtggggctggaaaggccaagggattaggatgggcgga

SEQ ID NO: 67961 - DNA, 37 bp, Artificial Sequence
  Synthetic oligonucleotide
gacacgaggggttttactgagggcgggtattgaggga

SEQ ID NO: 67962 - DNA, 37 bp, Artificial Sequence
  Synthetic oligonucleotide
agacagaagggcggagagggctactgcgcaatcggga

SEQ ID NO: 67963 - DNA, 37 bp, Artificial Sequence
  Synthetic oligonucleotide
actcagcaccgattgcccaatttccctccagcctgga

SEQ ID NO: 67964 - DNA, 37 bp, Artificial Sequence
  Synthetic oligonucleotide
agccacgcttcaccaccgccgaaagcttgaacttgga

SEQ ID NO: 67965 - DNA, 38 bp, Artificial Sequence
  Synthetic oligonucleotide
ttgaccgtggagagtgtcactccgcctcacctaaatga

SEQ ID NO: 67966 - DNA, 38 bp, Artificial Sequence
  Synthetic oligonucleotide
tgccatccgaccaatgatctcacctcagcgtgccatga

SEQ ID NO: 67967 - DNA, 38 bp, Artificial Sequence
  Synthetic oligonucleotide
gattaccgtagactgagcatagggttcattgtctatga

SEQ ID NO: 67968 - DNA, 38 bp, Artificial Sequence
  Synthetic oligonucleotide
ggacatccatcatgtccgcgccacctttctaacactga

SEQ ID NO: 67969 - DNA, 38 bp, Artificial Sequence
  Synthetic oligonucleotide
tcctgtcagggaacgcactaccatctccaccccactga

SEQ ID NO: 67970 - DNA, 35 bp, Artificial Sequence
  Synthetic oligonucleotide
gatacgctattctccccaaggcccgccgccactga

SEQ ID NO: 67971 - DNA, 38 bp, Artificial Sequence
  Synthetic oligonucleotide
gtagttaccgccaccgctcccagccgccgaccacctga

SEQ ID NO: 67972 - DNA, 38 bp, Artificial Sequence
  Synthetic oligonucleotide
acctaccgaactggcctccacaaggtcactggacctga

SEQ ID NO: 67973 - DNA, 37 bp, Artificial Sequence
  Synthetic oligonucleotide
acgaactacacctggctgtgcctcccccagcccctga

SEQ ID NO: 67974 - DNA, 38 bp, Artificial Sequence
  Synthetic oligonucleotide
taggtactgcttggggaagggtgagtgggggggcctga

SEQ ID NO: 67975 - DNA, 38 bp, Artificial Sequence
  Synthetic oligonucleotide
gacccctccccatgcttggaacagtttggaaaagctga

SEQ ID NO: 67976 - DNA, 38 bp, Artificial Sequence
  Synthetic oligonucleotide
tcatgcacacgccaacttgactccacgcggaaagctga

SEQ ID NO: 67977 - DNA, 37 bp, Artificial Sequence
  Synthetic oligonucleotide
gcattagccctccaccccagttatgctcagtcgctga

SEQ ID NO: 67978 - DNA, 38 bp, Artificial Sequence
  Synthetic oligonucleotide
gacggggagtgtgctgaatggcattaagggtgtgctga

SEQ ID NO: 67979 - DNA, 38 bp, Artificial Sequence
  Synthetic oligonucleotide
tccatgccaggggaaagataatagggacggaggggtga

SEQ ID NO: 67980 - DNA, 37 bp, Artificial Sequence
  Synthetic oligonucleotide
tcacacacactattttgaattttggctggacaattga

SEQ ID NO: 67981 - DNA, 38 bp, Artificial Sequence
  Synthetic oligonucleotide
ttttgccacaggcctaactgccatacaattctacttga

SEQ ID NO: 67982 - DNA, 38 bp, Artificial Sequence
  Synthetic oligonucleotide
tgggaggggcaggatagaatagggggtggtaggcttga

SEQ ID NO: 67983 - DNA, 37 bp, Artificial Sequence
  Synthetic oligonucleotide
aactgccctccaaccgatacttgttcagatctcttga

SEQ ID NO: 67984 - DNA, 38 bp, Artificial Sequence
  Synthetic oligonucleotide
tgctcacctgcccgaactcagcacagtctgattcttga

SEQ ID NO: 67985 - DNA, 38 bp, Artificial Sequence
  Synthetic oligonucleotide
atcacgtaccaccttgccgccttaccaagctatgttga

SEQ ID NO: 67986 - DNA, 38 bp, Artificial Sequence
  Synthetic oligonucleotide
gaccatccattgtctactgaaccatgaacatactttga

SEQ ID NO: 67987 - DNA, 36 bp, Artificial Sequence
  Synthetic oligonucleotide
gagaccgcctttcactcccatgcgttggggccaata

SEQ ID NO: 67988 - DNA, 36 bp, Artificial Sequence
  Synthetic oligonucleotide
gtaccccccgtagagtctcaacacaatgttgacata

SEQ ID NO: 67989 - DNA, 36 bp, Artificial Sequence
  Synthetic oligonucleotide
tggtttggagtgctaatgttatgcgcgccatctcta

SEQ ID NO: 67990 - DNA, 35 bp, Artificial Sequence
  Synthetic oligonucleotide
gtggaccatcgcccctcaaggaaagaacttgagta

SEQ ID NO: 67991 - DNA, 35 bp, Artificial Sequence
  Synthetic oligonucleotide
gcaagcatatctgccaccatacacgttttctagta

SEQ ID NO: 67992 - DNA, 37 bp, Artificial Sequence
  Synthetic oligonucleotide
gacaccacccgctgcccaactgcaggcattgccggta

SEQ ID NO: 67993 - DNA, 36 bp, Artificial Sequence
  Synthetic oligonucleotide
taagtggtcccgcctgcgtgtctccatcccctatta

SEQ ID NO: 67994 - DNA, 36 bp, Artificial Sequence
  Synthetic oligonucleotide
ttacctggccggtttctatcctagaccatatcctta

SEQ ID NO: 67995 - DNA, 37 bp, Artificial Sequence
  Synthetic oligonucleotide
aatgcctggcatcacagtgtgcgcgcatctatcctta

SEQ ID NO: 67996 - DNA, 35 bp, Artificial Sequence
  Synthetic oligonucleotide
tcagaacacgcctacgcgagagtaatcacactaac

SEQ ID NO: 67997 - DNA, 35 bp, Artificial Sequence
  Synthetic oligonucleotide
cccgcaccaggccccatagcagcatgcacgcacac

SEQ ID NO: 67998 - DNA, 35 bp, Artificial Sequence
  Synthetic oligonucleotide
atcaccccctgatcttgaggtcttgagtactgcac

SEQ ID NO: 67999 - DNA, 35 bp, Artificial Sequence
  Synthetic oligonucleotide
tggacgcctactacttccaatctgccactgtgcac

SEQ ID NO: 68000 - DNA, 35 bp, Artificial Sequence
  Synthetic oligonucleotide
gcatacggggtatgccaacccactggtctactcac

SEQ ID NO: 68001 - DNA, 35 bp, Artificial Sequence
  Synthetic oligonucleotide
tccagggctagccgcaccaagcattttcacctcac

SEQ ID NO: 68002 - DNA, 35 bp, Artificial Sequence
  Synthetic oligonucleotide
agtggcgggcccctaactgcatgaccgtacttgac

SEQ ID NO: 68003 - DNA, 35 bp, Artificial Sequence
  Synthetic oligonucleotide
acgatcaacaggcctgcaaacatcctagaacgtac

SEQ ID NO: 68004 - DNA, 35 bp, Artificial Sequence
  Synthetic oligonucleotide
gcactgcacctagactgcctcagcccctcccgtac

SEQ ID NO: 68005 - DNA, 35 bp, Artificial Sequence
  Synthetic oligonucleotide
tccgacgtcgcccttcctgattattccagccgtac

SEQ ID NO: 68006 - DNA, 35 bp, Artificial Sequence
  Synthetic oligonucleotide
ttcacggacgtggaaactgctaccatcacccaccc

SEQ ID NO: 68007 - DNA, 34 bp, Artificial Sequence
  Synthetic oligonucleotide
tcccccgccgccggcccatcaaagtcacctaccc

SEQ ID NO: 68008 - DNA, 35 bp, Artificial Sequence
  Synthetic oligonucleotide
gtgcgggcactctattgaatcacgtgagtcatccc

SEQ ID NO: 68009 - DNA, 35 bp, Artificial Sequence
  Synthetic oligonucleotide
atgacgaggcgtgacgattcaagtccactattccc

SEQ ID NO: 68010 - DNA, 35 bp, Artificial Sequence
  Synthetic oligonucleotide
gcgaacctgactgcgaacctggccacgctcttccc

SEQ ID NO: 68011 - DNA, 35 bp, Artificial Sequence
  Synthetic oligonucleotide
atgcacctctttggtcttttcttcttcgttactcc

SEQ ID NO: 68012 - DNA, 35 bp, Artificial Sequence
  Synthetic oligonucleotide
gtgcgtaggtggtcgtcgatttcgccatacactgc

SEQ ID NO: 68013 - DNA, 35 bp, Artificial Sequence
  Synthetic oligonucleotide
tgacgagcgcgatgccagcacttagtttgtttatc

SEQ ID NO: 68014 - DNA, 35 bp, Artificial Sequence
  Synthetic oligonucleotide
tctaacaccgcccacagcaaaacagtgcacagctc

SEQ ID NO: 68015 - DNA, 35 bp, Artificial Sequence
  Synthetic oligonucleotide
aatgagccgggcaaaggcgacaggggcgaagggtc

SEQ ID NO: 68016 - DNA, 35 bp, Artificial Sequence
  Synthetic oligonucleotide
agtttgcacgcctcccaccgtattatccacaattc

SEQ ID NO: 68017 - DNA, 35 bp, Artificial Sequence
  Synthetic oligonucleotide
tacatccagcgttcgtcttcatgggcgcctagttc

SEQ ID NO: 68018 - DNA, 35 bp, Artificial Sequence
  Synthetic oligonucleotide
attgtatgccccgcctcgctgtatctcgtcctcag

SEQ ID NO: 68019 - DNA, 35 bp, Artificial Sequence
  Synthetic oligonucleotide
gatgcctagtgtaagaaaattggtgtggggtgtag

SEQ ID NO: 68020 - DNA, 35 bp, Artificial Sequence
  Synthetic oligonucleotide
gtatgcgaggggtctgtcttcccgatactccaccg

SEQ ID NO: 68021 - DNA, 35 bp, Artificial Sequence
  Synthetic oligonucleotide
attagccatccgtcgaacccatattcccgtgcccg

SEQ ID NO: 68022 - DNA, 35 bp, Artificial Sequence
  Synthetic oligonucleotide
gcccacccgcactacccgccgagtagcaccttgcg

SEQ ID NO: 68023 - DNA, 35 bp, Artificial Sequence
  Synthetic oligonucleotide
taccttcgctggctggcccccgtgttatctctgtg

SEQ ID NO: 68024 - DNA, 35 bp, Artificial Sequence
  Synthetic oligonucleotide
agatgactaaccacgcccccggccttcccgcattg

SEQ ID NO: 68025 - DNA, 35 bp, Artificial Sequence
  Synthetic oligonucleotide
aaatagacatacaggaggaaaggtcggacagattg

SEQ ID NO: 68026 - DNA, 35 bp, Artificial Sequence
  Synthetic oligonucleotide
gaatccgcctctgggcctggccttacgtgtacaat

SEQ ID NO: 68027 - DNA, 35 bp, Artificial Sequence
  Synthetic oligonucleotide
gttccccgctgatgcgcgctctagatcaattccat

SEQ ID NO: 68028 - DNA, 35 bp, Artificial Sequence
  Synthetic oligonucleotide
gtgcctagcactggtcggttcattgccaatcctat

SEQ ID NO: 68029 - DNA, 35 bp, Artificial Sequence
  Synthetic oligonucleotide
accgcgaacgggggcaaaaggaagaagtcgcgtat

SEQ ID NO: 68030 - DNA, 35 bp, Artificial Sequence
  Synthetic oligonucleotide
tacattatgtgccccacccccagacagtgctcact

SEQ ID NO: 68031 - DNA, 35 bp, Artificial Sequence
  Synthetic oligonucleotide
acctcactgtgtgcctggactcccttttcttcact

SEQ ID NO: 68032 - DNA, 35 bp, Artificial Sequence
  Synthetic oligonucleotide
tactgctcattcgactgcgcctagtcatcttccct

SEQ ID NO: 68033 - DNA, 34 bp, Artificial Sequence
  Synthetic oligonucleotide
acctaccctcgccccatgctatgagccccacgct

SEQ ID NO: 68034 - DNA, 35 bp, Artificial Sequence
  Synthetic oligonucleotide
atgccgctgttcgtcgaccttgcgatacgctttct

SEQ ID NO: 68035 - DNA, 35 bp, Artificial Sequence
  Synthetic oligonucleotide
attggaggggggggatgaacgagtgttataccagt

SEQ ID NO: 68036 - DNA, 35 bp, Artificial Sequence
  Synthetic oligonucleotide
tccaactggcgcccatcatcttaagaccgcgcggt

SEQ ID NO: 68037 - DNA, 35 bp, Artificial Sequence
  Synthetic oligonucleotide
accactgctttcgcagtatttctgattcctttggt

SEQ ID NO: 68038 - DNA, 35 bp, Artificial Sequence
  Synthetic oligonucleotide
gaggacgttcaagcactcaaccgccctcactcctt

SEQ ID NO: 68039 - DNA, 35 bp, Artificial Sequence
  Synthetic oligonucleotide
gtgtcaccctttatctgtcatgtgtcttcgcgttt

SEQ ID NO: 68040 - DNA, 36 bp, Artificial Sequence
  Synthetic oligonucleotide
tagtgagcgcggatcggggggatcattgcggaaaaa

SEQ ID NO: 68041 - DNA, 36 bp, Artificial Sequence
  Synthetic oligonucleotide
atgcccgcctaaccctcctagcgcagacggtaacaa

SEQ ID NO: 68042 - DNA, 36 bp, Artificial Sequence
  Synthetic oligonucleotide
tagataggtccggcacatcttactacagtctaccaa

SEQ ID NO: 68043 - DNA, 36 bp, Artificial Sequence
  Synthetic oligonucleotide
gcatggtacgttcccccagtgcccacattaagccaa

SEQ ID NO: 68044 - DNA, 35 bp, Artificial Sequence
  Synthetic oligonucleotide
ttcaaccccagtaacgaaaggtcttacatacggaa

SEQ ID NO: 68045 - DNA, 35 bp, Artificial Sequence
  Synthetic oligonucleotide
gatgactcgcctgggacgaccggataccacactaa

SEQ ID NO: 68046 - DNA, 36 bp, Artificial Sequence
  Synthetic oligonucleotide
agatccacactctctgtttacagttccccctcctaa

SEQ ID NO: 68047 - DNA, 36 bp, Artificial Sequence
  Synthetic oligonucleotide
agctcgcacggcaacctcccgccatgtgatctttaa

SEQ ID NO: 68048 - DNA, 36 bp, Artificial Sequence
  Synthetic oligonucleotide
acaccgcaccgctctgcttctagacgtaggcacaca

SEQ ID NO: 68049 - DNA, 35 bp, Artificial Sequence
  Synthetic oligonucleotide
tgtgaccagaatgttacccccgctccacacccaca

SEQ ID NO: 68050 - DNA, 36 bp, Artificial Sequence
  Synthetic oligonucleotide
atgccgtcgtaacccctgacgttttccacacagaca

SEQ ID NO: 68051 - DNA, 35 bp, Artificial Sequence
  Synthetic oligonucleotide
acctacatcaactggtccccggcctcgctgcccca

SEQ ID NO: 68052 - DNA, 36 bp, Artificial Sequence
  Synthetic oligonucleotide
agcggtcaatcgcacgtcccatcattgctagtccca

SEQ ID NO: 68053 - DNA, 36 bp, Artificial Sequence
  Synthetic oligonucleotide
gcaagccttctatgcactatcgaactttcgggtcca

SEQ ID NO: 68054 - DNA, 36 bp, Artificial Sequence
  Synthetic oligonucleotide
atctcatcctgtttggccagcccttccagccgatca

SEQ ID NO: 68055 - DNA, 36 bp, Artificial Sequence
  Synthetic oligonucleotide
gacgatcgcctagccgctattttcaccgctgtatca

SEQ ID NO: 68056 - DNA, 36 bp, Artificial Sequence
  Synthetic oligonucleotide
gtgaagggtcgagagggaggagaagatcagttgtca

SEQ ID NO: 68057 - DNA, 35 bp, Artificial Sequence
  Synthetic oligonucleotide
aaacccgaccacaccctggaaacagcgcatcttca

SEQ ID NO: 68058 - DNA, 35 bp, Artificial Sequence
  Synthetic oligonucleotide
atgacgcacaactgaggctccacactattcgttca

SEQ ID NO: 68059 - DNA, 35 bp, Artificial Sequence
  Synthetic oligonucleotide
attttgctggccacaggagttccgccttttgttca

SEQ ID NO: 68060 - DNA, 37 bp, Artificial Sequence
  Synthetic oligonucleotide
attgagcggtaggggtaaaacgcatggcgtaagaaga

SEQ ID NO: 68061 - DNA, 37 bp, Artificial Sequence
  Synthetic oligonucleotide
gcaccacgcgaccagcacatacccatcccgaaccaga

SEQ ID NO: 68062 - DNA, 37 bp, Artificial Sequence
  Synthetic oligonucleotide
gtacatcaccgctcgcacccggaatcgacccatacga

SEQ ID NO: 68063 - DNA, 37 bp, Artificial Sequence
  Synthetic oligonucleotide
tgatcggtcagattttggcacgctgctttttttacga

SEQ ID NO: 68064 - DNA, 37 bp, Artificial Sequence
  Synthetic oligonucleotide
tcagtgtacacgcgggagtgagggcggaaattagcga

SEQ ID NO: 68065 - DNA, 37 bp, Artificial Sequence
  Synthetic oligonucleotide
tgcactacttgtgtggtctccctatccgtgctatcga

SEQ ID NO: 68066 - DNA, 37 bp, Artificial Sequence
  Synthetic oligonucleotide
tcaacccagctctgtcgagtgtgtcccgttatttcga

SEQ ID NO: 68067 - DNA, 37 bp, Artificial Sequence
  Synthetic oligonucleotide
accttgtccgttgcgtcataccacctacttccgcgga

SEQ ID NO: 68068 - DNA, 37 bp, Artificial Sequence
  Synthetic oligonucleotide
gccagggaaaatacacggggataaggattgtacggga

SEQ ID NO: 68069 - DNA, 37 bp, Artificial Sequence
  Synthetic oligonucleotide
ggtagggtagggtaagataactttgaggagaggggga

SEQ ID NO: 68070 - DNA, 35 bp, Artificial Sequence
  Synthetic oligonucleotide
gtactccacactggtcatagtgcgaccaactggga

SEQ ID NO: 68071 - DNA, 36 bp, Artificial Sequence
  Synthetic oligonucleotide
gacatcaacggagaatgggagttttgggatttggga

SEQ ID NO: 68072 - DNA, 37 bp, Artificial Sequence
  Synthetic oligonucleotide
atgaccgacgacttaagtcggaaccctttccacatga

SEQ ID NO: 68073 - DNA, 38 bp, Artificial Sequence
  Synthetic oligonucleotide
tcatcataacctcacgtaggccaccagaacaggcatga

SEQ ID NO: 68074 - DNA, 38 bp, Artificial Sequence
  Synthetic oligonucleotide
atgcatgccgctgccttcctccgtcaccagctagatga

SEQ ID NO: 68075 - DNA, 38 bp, Artificial Sequence
  Synthetic oligonucleotide
tgcgaacacgtggataggggcaaggagtgtatcgatga

SEQ ID NO: 68076 - DNA, 38 bp, Artificial Sequence
  Synthetic oligonucleotide
taacccgccaacccttgctatttacatcggtcttatga

SEQ ID NO: 68077 - DNA, 38 bp, Artificial Sequence
  Synthetic oligonucleotide
gttcatacctccatacctggtcgtgacagtactactga

SEQ ID NO: 68078 - DNA, 37 bp, Artificial Sequence
  Synthetic oligonucleotide
gcatgcactacgctcctacacatgttatgtaacctga

SEQ ID NO: 68079 - DNA, 37 bp, Artificial Sequence
  Synthetic oligonucleotide
gtaatgctgcgatacttgccactcccctgtaccctga

SEQ ID NO: 68080 - DNA, 37 bp, Artificial Sequence
  Synthetic oligonucleotide
ttcgcctgagctacccccccgtcacgcgatctcctga

SEQ ID NO: 68081 - DNA, 38 bp, Artificial Sequence
  Synthetic oligonucleotide
ttccgtacgcctttatacttgagccctcgttttcctga

SEQ ID NO: 68082 - DNA, 38 bp, Artificial Sequence
  Synthetic oligonucleotide
atggtccggggcctggccgtactaacacaactctctga

SEQ ID NO: 68083 - DNA, 35 bp, Artificial Sequence
  Synthetic oligonucleotide
tcctccgccatgcaagcagcctgcctaattagtga

SEQ ID NO: 68084 - DNA, 37 bp, Artificial Sequence
  Synthetic oligonucleotide
tcacacatagggtggggatgggggttggctaaggtga

SEQ ID NO: 68085 - DNA, 38 bp, Artificial Sequence
  Synthetic oligonucleotide
gagtcgaagacagggagggtggatggacaatatggtga

SEQ ID NO: 68086 - DNA, 38 bp, Artificial Sequence
  Synthetic oligonucleotide
gcacggcgaaaacaagggggagggcatgaagaaattga

SEQ ID NO: 68087 - DNA, 38 bp, Artificial Sequence
  Synthetic oligonucleotide
ggtacaggggcggggtgggggtgtgagaagcgcattga

SEQ ID NO: 68088 - DNA, 38 bp, Artificial Sequence
  Synthetic oligonucleotide
acgctagtcggtatagaccctgccccttccttgtttga

SEQ ID NO: 68089 - DNA, 37 bp, Artificial Sequence
  Synthetic oligonucleotide
aagatcggccaatctgctgcctccgaccaatttttga

SEQ ID NO: 68090 - DNA, 36 bp, Artificial Sequence
  Synthetic oligonucleotide
atccccgtagaacactacggatggcctacatagata

SEQ ID NO: 68091 - DNA, 35 bp, Artificial Sequence
  Synthetic oligonucleotide
gacacgaccacaggcgtcctagtaacatcaatata

SEQ ID NO: 68092 - DNA, 35 bp, Artificial Sequence
  Synthetic oligonucleotide
agccccgttattcgtctacacccggaacttttcta

SEQ ID NO: 68093 - DNA, 36 bp, Artificial Sequence
  Synthetic oligonucleotide
tacgcgatcgcttccctttgactcacctacgtcgta

SEQ ID NO: 68094 - DNA, 35 bp, Artificial Sequence
  Synthetic oligonucleotide
gcacgcatgtagtgcattttgacctcccgcttgta

SEQ ID NO: 68095 - DNA, 36 bp, Artificial Sequence
  Synthetic oligonucleotide
atatccacccatgctttactgcgttcgggcctttta

SEQ ID NO: 68096 - DNA, 35 bp, Artificial Sequence
  Synthetic oligonucleotide
tacagttccccacaagcgactccctggcaccgaac

SEQ ID NO: 68097 - DNA, 35 bp, Artificial Sequence
  Synthetic oligonucleotide
gaaccgcatgaagcgctgttagtgccacgttccac

SEQ ID NO: 68098 - DNA, 35 bp, Artificial Sequence
  Synthetic oligonucleotide
tagctaacctcccgccgggcctgacgaatggcacc

SEQ ID NO: 68099 - DNA, 35 bp, Artificial Sequence
  Synthetic oligonucleotide
ttcagtgccctatgcacaatcgtattacattcccc

SEQ ID NO: 68100 - DNA, 35 bp, Artificial Sequence
  Synthetic oligonucleotide
tgttgagttctgtccgcatcccgtcttcccgagcc

SEQ ID NO: 68101 - DNA, 35 bp, Artificial Sequence
  Synthetic oligonucleotide
atcgagtcagcccccatccgcagttgacaattgcc

SEQ ID NO: 68102 - DNA, 35 bp, Artificial Sequence
  Synthetic oligonucleotide
accacctatatgccagcgttcactcgtctatctcc

SEQ ID NO: 68103 - DNA, 35 bp, Artificial Sequence
  Synthetic oligonucleotide
gaacctgctgccagcccattgaaatcgatttctgc

SEQ ID NO: 68104 - DNA, 35 bp, Artificial Sequence
  Synthetic oligonucleotide
tgaaacgtcctggcatccatgacttgaacatcctc

SEQ ID NO: 68105 - DNA, 35 bp, Artificial Sequence
  Synthetic oligonucleotide
actgtaccattagcctccactctggctccctgctc

SEQ ID NO: 68106 - DNA, 35 bp, Artificial Sequence
  Synthetic oligonucleotide
gtccacccttcgttcataagcccggctcactgttc

SEQ ID NO: 68107 - DNA, 35 bp, Artificial Sequence
  Synthetic oligonucleotide
gattagactcctgatgcgcccctcttgaacttttc

SEQ ID NO: 68108 - DNA, 35 bp, Artificial Sequence
  Synthetic oligonucleotide
gcaggcgaatactagtagggtagggcagaggagag

SEQ ID NO: 68109 - DNA, 35 bp, Artificial Sequence
  Synthetic oligonucleotide
accacccctgtcctaccagaacgccgcccactgcg

SEQ ID NO: 68110 - DNA, 35 bp, Artificial Sequence
  Synthetic oligonucleotide
actgggcccgtgcgcactatgacgttcctttatcg

SEQ ID NO: 68111 - DNA, 35 bp, Artificial Sequence
  Synthetic oligonucleotide
agtggggggtaggaggtagtagttgctgcttgatg

SEQ ID NO: 68112 - DNA, 35 bp, Artificial Sequence
  Synthetic oligonucleotide
attgcactgtcctggttctttttagtcttggcttg

SEQ ID NO: 68113 - DNA, 35 bp, Artificial Sequence
  Synthetic oligonucleotide
gcccacattcccgggtatacctttcaactctgttg

SEQ ID NO: 68114 - DNA, 35 bp, Artificial Sequence
  Synthetic oligonucleotide
acgacccagtcgtacggcaagaagtatgggtgttg

SEQ ID NO: 68115 - DNA, 35 bp, Artificial Sequence
  Synthetic oligonucleotide
tccacctgtgccatggttagttcctgtggtcccat

SEQ ID NO: 68116 - DNA, 35 bp, Artificial Sequence
  Synthetic oligonucleotide
aaagacagtggtccgtttccattcctccctctcat

SEQ ID NO: 68117 - DNA, 35 bp, Artificial Sequence
  Synthetic oligonucleotide
aacatccacaaaacggagcctcccctctgctcgat

SEQ ID NO: 68118 - DNA, 35 bp, Artificial Sequence
  Synthetic oligonucleotide
ttaacccattccacagtgccaaggagcacgacgct

SEQ ID NO: 68119 - DNA, 35 bp, Artificial Sequence
  Synthetic oligonucleotide
gacgggagggaagaccagggtagttaaacggggct

SEQ ID NO: 68120 - DNA, 35 bp, Artificial Sequence
  Synthetic oligonucleotide
tacatcctgacggtggtaccctaacggcttttgct

SEQ ID NO: 68121 - DNA, 35 bp, Artificial Sequence
  Synthetic oligonucleotide
gacgagttagggatgggcaaatgaatggaaggtct

SEQ ID NO: 68122 - DNA, 35 bp, Artificial Sequence
  Synthetic oligonucleotide
gtgaggccactcatagttgttatcttgcatatggt

SEQ ID NO: 68123 - DNA, 35 bp, Artificial Sequence
  Synthetic oligonucleotide
acgacgccccccaaataaaacgcggtcgccgactt

SEQ ID NO: 68124 - DNA, 35 bp, Artificial Sequence
  Synthetic oligonucleotide
acgacccaagcaactctaggctgggtttaaatgtt

SEQ ID NO: 68125 - DNA, 35 bp, Artificial Sequence
  Synthetic oligonucleotide
tgcggaccccggcatgagggagggggagggtattt

SEQ ID NO: 68126 - DNA, 36 bp, Artificial Sequence
  Synthetic oligonucleotide
gacgctgacctttaccggactacagttaccacccaa

SEQ ID NO: 68127 - DNA, 35 bp, Artificial Sequence
  Synthetic oligonucleotide
atcctaggcctctagcatgatgctttttcttagaa

SEQ ID NO: 68128 - DNA, 35 bp, Artificial Sequence
  Synthetic oligonucleotide
gcctgccgcccaccggactttacccagttagcgaa

SEQ ID NO: 68129 - DNA, 36 bp, Artificial Sequence
  Synthetic oligonucleotide
gtcatagccggctcaccttgaccccctctttaggaa

SEQ ID NO: 68130 - DNA, 36 bp, Artificial Sequence
  Synthetic oligonucleotide
tcatcccgacgcaaaaggcggccctacccatcctaa

SEQ ID NO: 68131 - DNA, 36 bp, Artificial Sequence
  Synthetic oligonucleotide
gggtcgggtacgggggggcttaaactagcacggtaa

SEQ ID NO: 68132 - DNA, 36 bp, Artificial Sequence
  Synthetic oligonucleotide
tccaggtacgagctaaccacggtatttccaccaaca

SEQ ID NO: 68133 - DNA, 36 bp, Artificial Sequence
  Synthetic oligonucleotide
gtgcgacggcggacaggacaaaggaagtagaacaca

SEQ ID NO: 68134 - DNA, 35 bp, Artificial Sequence
  Synthetic oligonucleotide
tgatctcatccttaagcttactggtcctgcataca

SEQ ID NO: 68135 - DNA, 36 bp, Artificial Sequence
  Synthetic oligonucleotide
tgatgtacagacgtacgcctccgccttcattttaca

SEQ ID NO: 68136 - DNA, 35 bp, Artificial Sequence
  Synthetic oligonucleotide
gtatcgtgcgagcgactccattcctctcgccccca

SEQ ID NO: 68137 - DNA, 36 bp, Artificial Sequence
  Synthetic oligonucleotide
tcatgcaagcagtttacggtgcctgatcttttccca

SEQ ID NO: 68138 - DNA, 35 bp, Artificial Sequence
  Synthetic oligonucleotide
ttactccgccgcatcgagggctttgaaatgcgcca

SEQ ID NO: 68139 - DNA, 37 bp, Artificial Sequence
  Synthetic oligonucleotide
gccccggggtggaggtgggtttcacagggagctggca

SEQ ID NO: 68140 - DNA, 36 bp, Artificial Sequence
  Synthetic oligonucleotide
tcacaagtcggcatccctctcagctggctccgtgca

SEQ ID NO: 68141 - DNA, 35 bp, Artificial Sequence
  Synthetic oligonucleotide
gtggaaaggcgctctgtttcaatgctccaatctca

SEQ ID NO: 68142 - DNA, 37 bp, Artificial Sequence
  Synthetic oligonucleotide
tagtagctgcaccatagtatacgtcacgcaatcaaga

SEQ ID NO: 68143 - DNA, 37 bp, Artificial Sequence
  Synthetic oligonucleotide
gtaaagaggggaacgagagtaagggtatggctcaaga

SEQ ID NO: 68144 - DNA, 37 bp, Artificial Sequence
  Synthetic oligonucleotide
ttggaagacaagtgagggggacaaagataatggaaga

SEQ ID NO: 68145 - DNA, 35 bp, Artificial Sequence
  Synthetic oligonucleotide
tcagttattccggccacattgttcgttcccctaga

SEQ ID NO: 68146 - DNA, 37 bp, Artificial Sequence
  Synthetic oligonucleotide
agcgcaccgctccccttggtcccttttcactgttaga

SEQ ID NO: 68147 - DNA, 37 bp, Artificial Sequence
  Synthetic oligonucleotide
ttcccaccaaggttgcgtattccgcgttactgcacga

SEQ ID NO: 68148 - DNA, 37 bp, Artificial Sequence
  Synthetic oligonucleotide
acacgtcactacttaccggaccaactttgctcgccga

SEQ ID NO: 68149 - DNA, 37 bp, Artificial Sequence
  Synthetic oligonucleotide
aactgcgccggcaattttaaccagggaaccatatcga

SEQ ID NO: 68150 - DNA, 36 bp, Artificial Sequence
  Synthetic oligonucleotide
gccatccaacgctctggccgctattacaattatcga

SEQ ID NO: 68151 - DNA, 37 bp, Artificial Sequence
  Synthetic oligonucleotide
gagctctgatcgaactatccacccttcactttcagga

SEQ ID NO: 68152 - DNA, 35 bp, Artificial Sequence
  Synthetic oligonucleotide
gtaaaggggggagatgatgtgggtgaatcatagga

SEQ ID NO: 68153 - DNA, 37 bp, Artificial Sequence
  Synthetic oligonucleotide
gcgtggaacggagaacgaggaggattggaaataggga

SEQ ID NO: 68154 - DNA, 37 bp, Artificial Sequence
  Synthetic oligonucleotide
gcgcatgatggccgggtatgggtgggacctcgcggga

SEQ ID NO: 68155 - DNA, 37 bp, Artificial Sequence
  Synthetic oligonucleotide
ggtctggaaatgcaggggaacgaaatcaagcagggga

SEQ ID NO: 68156 - DNA, 36 bp, Artificial Sequence
  Synthetic oligonucleotide
aacatgtggcgacgtggtgtagggcgggcgagggga

SEQ ID NO: 68157 - DNA, 37 bp, Artificial Sequence
  Synthetic oligonucleotide
actcacagacgcaagctcctgccccagttccatggga

SEQ ID NO: 68158 - DNA, 35 bp, Artificial Sequence
  Synthetic oligonucleotide
gatgctggccccacggctcaatacaccacttggga

SEQ ID NO: 68159 - DNA, 36 bp, Artificial Sequence
  Synthetic oligonucleotide
acgacgtgatacgccaacgcccccagccccaatgga

SEQ ID NO: 68160 - DNA, 38 bp, Artificial Sequence
  Synthetic oligonucleotide
gccacagtgcgatttactggccacctatttatccatga

SEQ ID NO: 68161 - DNA, 38 bp, Artificial Sequence
  Synthetic oligonucleotide
gcgaatttcggggagggcgggataatgaggcatgatga

SEQ ID NO: 68162 - DNA, 38 bp, Artificial Sequence
  Synthetic oligonucleotide
acccgacagaacaacgtgcgcctaacctgcctctatga

SEQ ID NO: 68163 - DNA, 38 bp, Artificial Sequence
  Synthetic oligonucleotide
gaaacccctctctatgttgtccattggaccctgtatga

SEQ ID NO: 68164 - DNA, 38 bp, Artificial Sequence
  Synthetic oligonucleotide
tacgcggctgtgcctactcgcccactatgctcgactga

SEQ ID NO: 68165 - DNA, 37 bp, Artificial Sequence
  Synthetic oligonucleotide
ttaacctgcggcgacccatctctatcacgcatgctga

SEQ ID NO: 68166 - DNA, 37 bp, Artificial Sequence
  Synthetic oligonucleotide
tgcgcagggggtgggagggggcgagtctaaggggtga

SEQ ID NO: 68167 - DNA, 38 bp, Artificial Sequence
  Synthetic oligonucleotide
gtgtacctcactcgcattaatgcactcacccatggtga

SEQ ID NO: 68168 - DNA, 38 bp, Artificial Sequence
  Synthetic oligonucleotide
aactccccaccgaagcatactgccttcacataatgtga

SEQ ID NO: 68169 - DNA, 36 bp, Artificial Sequence
  Synthetic oligonucleotide
gcctggtaaatttggctacctgtactcccactgtga

SEQ ID NO: 68170 - DNA, 36 bp, Artificial Sequence
  Synthetic oligonucleotide
actcatacccgctcaccccgcgcaacaatcgattga

SEQ ID NO: 68171 - DNA, 37 bp, Artificial Sequence
  Synthetic oligonucleotide
aaggtcgcaagggggggtggatacgtggaaaagttga

SEQ ID NO: 68172 - DNA, 38 bp, Artificial Sequence
  Synthetic oligonucleotide
tacgcccgtttgttatctccactcttcgccatcgttga

SEQ ID NO: 68173 - DNA, 38 bp, Artificial Sequence
  Synthetic oligonucleotide
acaccactgccatacgagggcattatattttgatttga

SEQ ID NO: 68174 - DNA, 37 bp, Artificial Sequence
  Synthetic oligonucleotide
tccatcacccgacctttgcgtagttatgcctgtttga

SEQ ID NO: 68175 - DNA, 37 bp, Artificial Sequence
  Synthetic oligonucleotide
tatcgctcacctcgtgcatctggatttttggttttga

SEQ ID NO: 68176 - DNA, 36 bp, Artificial Sequence
  Synthetic oligonucleotide
gacccactgggccctgtcacgtgactcaccataata

SEQ ID NO: 68177 - DNA, 36 bp, Artificial Sequence
  Synthetic oligonucleotide
gtgcatctgctggcttcaagcaaccgcaactccgta

SEQ ID NO: 68178 - DNA, 36 bp, Artificial Sequence
  Synthetic oligonucleotide
tgtgcaaccctttatgattcccatgcacaacactta

SEQ ID NO: 68179 - DNA, 36 bp, Artificial Sequence
  Synthetic oligonucleotide
ggacatgtgtacgtgggtgaagctgggggcaagtta

SEQ ID NO: 68180 - DNA, 36 bp, Artificial Sequence
  Synthetic oligonucleotide
gtagcgcattattcgcactagatccgcacttggtta

SEQ ID NO: 68181 - DNA, 36 bp, Artificial Sequence
  Synthetic oligonucleotide
tgcgcacgtactgatccgcccgctttctatacttta

SEQ ID NO: 68182 - DNA, 36 bp, Artificial Sequence
  Synthetic oligonucleotide
tttggtgcagccgtagcaactctacccccggcttta

SEQ ID NO: 68183 - DNA, 35 bp, Artificial Sequence
  Synthetic oligonucleotide
gtaccgaagcccccgccctatattaatagccgaac

SEQ ID NO: 68184 - DNA, 35 bp, Artificial Sequence
  Synthetic oligonucleotide
gcacacagctcccgcgtccataccattagctgcac

SEQ ID NO: 68185 - DNA, 35 bp, Artificial Sequence
  Synthetic oligonucleotide
tcaccagtcgcttcatctacattggtctcgctcac

SEQ ID NO: 68186 - DNA, 35 bp, Artificial Sequence
  Synthetic oligonucleotide
gcgagtgctgatccatcactatcctacattttcac

SEQ ID NO: 68187 - DNA, 35 bp, Artificial Sequence
  Synthetic oligonucleotide
acccgcctactcccgtgcctgatctaaccatggac

SEQ ID NO: 68188 - DNA, 35 bp, Artificial Sequence
  Synthetic oligonucleotide
tagttagtccgcagcccgcgtttcgcctttgatac

SEQ ID NO: 68189 - DNA, 35 bp, Artificial Sequence
  Synthetic oligonucleotide
actgacacccctcctccgcacgcttaggctgttac

SEQ ID NO: 68190 - DNA, 35 bp, Artificial Sequence
  Synthetic oligonucleotide
agcccacctctgcattgatcttgcgcgtgaccccc

SEQ ID NO: 68191 - DNA, 35 bp, Artificial Sequence
  Synthetic oligonucleotide
tagaattgcagcccttccttcttaaccggggcccc

SEQ ID NO: 68192 - DNA, 35 bp, Artificial Sequence
  Synthetic oligonucleotide
gacacggcgtcttcatcctacaggcactttctccc

SEQ ID NO: 68193 - DNA, 35 bp, Artificial Sequence
  Synthetic oligonucleotide
cagatagctccatcgttgcccctcccgttcacgcc

SEQ ID NO: 68194 - DNA, 35 bp, Artificial Sequence
  Synthetic oligonucleotide
tagtgccacacgacgtctatcaccgcttctcctgc

SEQ ID NO: 68195 - DNA, 35 bp, Artificial Sequence
  Synthetic oligonucleotide
gcatatacgatctgagtctcgaccgcccccacatc

SEQ ID NO: 68196 - DNA, 35 bp, Artificial Sequence
  Synthetic oligonucleotide
tgtgccctccagctgactccccccgtcatctactc

SEQ ID NO: 68197 - DNA, 35 bp, Artificial Sequence
  Synthetic oligonucleotide
tcttcgcgagggccacctactctttatttgacctc

SEQ ID NO: 68198 - DNA, 35 bp, Artificial Sequence
  Synthetic oligonucleotide
gcataacccgactgctgctccatacgcgttccctc

SEQ ID NO: 68199 - DNA, 35 bp, Artificial Sequence
  Synthetic oligonucleotide
tgagacgccgcacgctagcctggcccttccctgtc

SEQ ID NO: 68200 - DNA, 35 bp, Artificial Sequence
  Synthetic oligonucleotide
tcacgcatgtgttcttctttgaatggggctatttc

SEQ ID NO: 68201 - DNA, 35 bp, Artificial Sequence
  Synthetic oligonucleotide
attccactccgaccagcccttctttgggtccctag

SEQ ID NO: 68202 - DNA, 35 bp, Artificial Sequence
  Synthetic oligonucleotide
gacacctcaaccgtccctaagcctttcactcctag

SEQ ID NO: 68203 - DNA, 35 bp, Artificial Sequence
  Synthetic oligonucleotide
gaatccccgcccaaacccaccggaacaggcttacg

SEQ ID NO: 68204 - DNA, 35 bp, Artificial Sequence
  Synthetic oligonucleotide
atacgccttcgtctactcgcatcctcgtgccaccg

SEQ ID NO: 68205 - DNA, 35 bp, Artificial Sequence
  Synthetic oligonucleotide
tacatgaacctagaaaccagttcccgccaccctcg

SEQ ID NO: 68206 - DNA, 35 bp, Artificial Sequence
  Synthetic oligonucleotide
tgctaccgtccccctacttggtaatttgaacatgg

SEQ ID NO: 68207 - DNA, 35 bp, Artificial Sequence
  Synthetic oligonucleotide
acgaccacgccccttatcccattaatttaatgctg

SEQ ID NO: 68208 - DNA, 35 bp, Artificial Sequence
  Synthetic oligonucleotide
ttcaaccgagccactccaaccacttcagtcttgtg

SEQ ID NO: 68209 - DNA, 35 bp, Artificial Sequence
  Synthetic oligonucleotide
gacttcccgggcgcgtttttggcgtctctattcat

SEQ ID NO: 68210 - DNA, 35 bp, Artificial Sequence
  Synthetic oligonucleotide
gaaggccaccccttcagttgaacttgtttgcacct

SEQ ID NO: 68211 - DNA, 35 bp, Artificial Sequence
  Synthetic oligonucleotide
gtacagccccggacgttgggttccaccatttgtct

SEQ ID NO: 68212 - DNA, 35 bp, Artificial Sequence
  Synthetic oligonucleotide
tccaatcgctgacctatcaatcattcgttctacgt

SEQ ID NO: 68213 - DNA, 35 bp, Artificial Sequence
  Synthetic oligonucleotide
gatctcataggttggcatggagggaaatagagggt

SEQ ID NO: 68214 - DNA, 35 bp, Artificial Sequence
  Synthetic oligonucleotide
tagcgccccgcctcttctattcctgtctgaccctt

SEQ ID NO: 68215 - DNA, 35 bp, Artificial Sequence
  Synthetic oligonucleotide
tcatgatgcactcctccactgccgtgatatgcctt

SEQ ID NO: 68216 - DNA, 35 bp, Artificial Sequence
  Synthetic oligonucleotide
taggaccacacctatcgactcctgcccccgatttt

SEQ ID NO: 68217 - DNA, 36 bp, Artificial Sequence
  Synthetic oligonucleotide
ccacctccggactccttagtcgcatgcttgctgcaa

SEQ ID NO: 68218 - DNA, 35 bp, Artificial Sequence
  Synthetic oligonucleotide
ctagtgggggggaaccgggggatctatgatgggaa

SEQ ID NO: 68219 - DNA, 36 bp, Artificial Sequence
  Synthetic oligonucleotide
ttgcacaggaaaagcgggcccaggactggaaagtaa

SEQ ID NO: 68220 - DNA, 36 bp, Artificial Sequence
  Synthetic oligonucleotide
ggacgactgcctgctgcttcgagctttacgatttaa

SEQ ID NO: 68221 - DNA, 35 bp, Artificial Sequence
  Synthetic oligonucleotide
gtccccacaggtttgacctaacgtaactagtttaa

SEQ ID NO: 68222 - DNA, 36 bp, Artificial Sequence
  Synthetic oligonucleotide
agtcagactacccgttcccgtgcacgcttcctcaca

SEQ ID NO: 68223 - DNA, 36 bp, Artificial Sequence
  Synthetic oligonucleotide
acccccacgctagggttatcttgtcgtactattaca

SEQ ID NO: 68224 - DNA, 36 bp, Artificial Sequence
  Synthetic oligonucleotide
tgcgggggcactttccgccagaccgcctttttacca

SEQ ID NO: 68225 - DNA, 36 bp, Artificial Sequence
  Synthetic oligonucleotide
attgctcctccacccgggggttcatgtgttccccca

SEQ ID NO: 68226 - DNA, 36 bp, Artificial Sequence
  Synthetic oligonucleotide
aatcagctggggggagaacaggcggacgtagggcca

SEQ ID NO: 68227 - DNA, 36 bp, Artificial Sequence
  Synthetic oligonucleotide
gagcgccgaaggacacacgtatttttgcctagtcca

SEQ ID NO: 68228 - DNA, 36 bp, Artificial Sequence
  Synthetic oligonucleotide
gccacctgtgtgcatcaatcccctttgcaaatagca

SEQ ID NO: 68229 - DNA, 37 bp, Artificial Sequence
  Synthetic oligonucleotide
actgccatcggcccccgccctgatcccttggccatca

SEQ ID NO: 68230 - DNA, 36 bp, Artificial Sequence
  Synthetic oligonucleotide
acaaaacacacgagcacacccatccgtcctctcaga

SEQ ID NO: 68231 - DNA, 37 bp, Artificial Sequence
  Synthetic oligonucleotide
gtaccaccttccgggaagacctcatttccatgagaga

SEQ ID NO: 68232 - DNA, 37 bp, Artificial Sequence
  Synthetic oligonucleotide
aagctggaggaggagtatagggaagggagttgggaga

SEQ ID NO: 68233 - DNA, 37 bp, Artificial Sequence
  Synthetic oligonucleotide
gatggaaatgccctccgcccccgccggtcgcatacga

SEQ ID NO: 68234 - DNA, 36 bp, Artificial Sequence
  Synthetic oligonucleotide
agtgaccccacgagagccgcctatccaccactacga

SEQ ID NO: 68235 - DNA, 37 bp, Artificial Sequence
  Synthetic oligonucleotide
gaccgacggcctctcacggctgttttcgaatttacga

SEQ ID NO: 68236 - DNA, 37 bp, Artificial Sequence
  Synthetic oligonucleotide
acttaccacgtctaacctgcatactctcatggaccga

SEQ ID NO: 68237 - DNA, 37 bp, Artificial Sequence
  Synthetic oligonucleotide
tcaccccactcggtataaaacgtctctcttaagccga

SEQ ID NO: 68238 - DNA, 36 bp, Artificial Sequence
  Synthetic oligonucleotide
gcgcacccaccacggactttatattgactccgccga

SEQ ID NO: 68239 - DNA, 37 bp, Artificial Sequence
  Synthetic oligonucleotide
gtgcaaacccctctcttgtgatcacctattgttgcga

SEQ ID NO: 68240 - DNA, 37 bp, Artificial Sequence
  Synthetic oligonucleotide
taccgcgccgtgacatcccatccacctgtctcgtcga

SEQ ID NO: 68241 - DNA, 37 bp, Artificial Sequence
  Synthetic oligonucleotide
ttctgtgcacaacggagtggaagctaccccccttcga

SEQ ID NO: 68242 - DNA, 37 bp, Artificial Sequence
  Synthetic oligonucleotide
gtactcatcgcccatcttacactggacccgcggggga

SEQ ID NO: 68243 - DNA, 37 bp, Artificial Sequence
  Synthetic oligonucleotide
accgactgactgcatcggtactagaaactcgcctgga

SEQ ID NO: 68244 - DNA, 37 bp, Artificial Sequence
  Synthetic oligonucleotide
ttcgcagggggaggcttgaaaacaggtattgtgtgga

SEQ ID NO: 68245 - DNA, 37 bp, Artificial Sequence
  Synthetic oligonucleotide
tcatgtcctcatggcggactctgttactacccttgga

SEQ ID NO: 68246 - DNA, 38 bp, Artificial Sequence
  Synthetic oligonucleotide
agtcaacggcaatcgccccgcacctcgttgattcatga

SEQ ID NO: 68247 - DNA, 38 bp, Artificial Sequence
  Synthetic oligonucleotide
gcagttagtggtggggggtcgggctccggaggtgatga

SEQ ID NO: 68248 - DNA, 38 bp, Artificial Sequence
  Synthetic oligonucleotide
tcagtcgctcgcgctgctttgaaaacccgttacactga

SEQ ID NO: 68249 - DNA, 38 bp, Artificial Sequence
  Synthetic oligonucleotide
gccatgcttacgctgctaccccacaccccggtccctga

SEQ ID NO: 68250 - DNA, 38 bp, Artificial Sequence
  Synthetic oligonucleotide
ttccgccctcggactcttgcacggtcccaatctcctga

SEQ ID NO: 68251 - DNA, 38 bp, Artificial Sequence
  Synthetic oligonucleotide
aatgcgcgaacaggtagctgagaatgagacgaagctga

SEQ ID NO: 68252 - DNA, 37 bp, Artificial Sequence
  Synthetic oligonucleotide
acccggaccgtattggttaggtttcttctccctctga

SEQ ID NO: 68253 - DNA, 38 bp, Artificial Sequence
  Synthetic oligonucleotide
tgagagggaagggtaatgcgcggcaaaattgaaagtga

SEQ ID NO: 68254 - DNA, 38 bp, Artificial Sequence
  Synthetic oligonucleotide
gctacgctgagggacgggagttaaggggtgaggagtga

SEQ ID NO: 68255 - DNA, 38 bp, Artificial Sequence
  Synthetic oligonucleotide
atccctccgccctcgcccgtgttataaccctgtagtga

SEQ ID NO: 68256 - DNA, 37 bp, Artificial Sequence
  Synthetic oligonucleotide
aatggagggcggaccgggggcgcactataggacgtga

SEQ ID NO: 68257 - DNA, 38 bp, Artificial Sequence
  Synthetic oligonucleotide
gatacgtatatgagggctttggaaggaatgtggcgtga

SEQ ID NO: 68258 - DNA, 37 bp, Artificial Sequence
  Synthetic oligonucleotide
tacatcgtttcccatggcttttctctgcccctcgtga

SEQ ID NO: 68259 - DNA, 38 bp, Artificial Sequence
  Synthetic oligonucleotide
gtgcgaccagggcgcaggggacacattccacggggtga

SEQ ID NO: 68260 - DNA, 38 bp, Artificial Sequence
  Synthetic oligonucleotide
agcgggtcgggagggtgcctgggacgcatatcaattga

SEQ ID NO: 68261 - DNA, 38 bp, Artificial Sequence
  Synthetic oligonucleotide
tgcctcaggcggctgaatccagctttttttcccgttga

SEQ ID NO: 68262 - DNA, 36 bp, Artificial Sequence
  Synthetic oligonucleotide
tccaacgccggccttaatggcttcaggcattgttga

SEQ ID NO: 68263 - DNA, 38 bp, Artificial Sequence
  Synthetic oligonucleotide
ggtacctccgctggttactctcttccccgtccttttga

SEQ ID NO: 68264 - DNA, 36 bp, Artificial Sequence
  Synthetic oligonucleotide
tgacgagaggggacttgatgggggaggaggaagata

SEQ ID NO: 68265 - DNA, 36 bp, Artificial Sequence
  Synthetic oligonucleotide
atccaaagccggggatcatatggcgcaggatatata

SEQ ID NO: 68266 - DNA, 36 bp, Artificial Sequence
  Synthetic oligonucleotide
cagcaaaagtctgtgcactttatgctactctaccta

SEQ ID NO: 68267 - DNA, 36 bp, Artificial Sequence
  Synthetic oligonucleotide
tttgccctacacatggtattgtacgccccaaagcta

SEQ ID NO: 68268 - DNA, 36 bp, Artificial Sequence
  Synthetic oligonucleotide
ttacacccgcacaactttttggtagtcttcgcgcta

SEQ ID NO: 68269 - DNA, 35 bp, Artificial Sequence
  Synthetic oligonucleotide
acgattgctacccaccttccgcgacttttgacgta

SEQ ID NO: 68270 - DNA, 36 bp, Artificial Sequence
  Synthetic oligonucleotide
ataccacccaacttagcccatgctgggccgtacgta

SEQ ID NO: 68271 - DNA, 35 bp, Artificial Sequence
  Synthetic oligonucleotide
ggggccgagttgggaaggggtcagtatatggggac

SEQ ID NO: 68272 - DNA, 35 bp, Artificial Sequence
  Synthetic oligonucleotide
gtaccggaccggccgcgaccacccgcaccgactac

SEQ ID NO: 68273 - DNA, 35 bp, Artificial Sequence
  Synthetic oligonucleotide
accctccctcggtacatgtattatccccgaagtac

SEQ ID NO: 68274 - DNA, 35 bp, Artificial Sequence
  Synthetic oligonucleotide
gatgctcggagttaccgttgtcctttcgcatgtac

SEQ ID NO: 68275 - DNA, 35 bp, Artificial Sequence
  Synthetic oligonucleotide
acaccttgtgttcagcactgccttatcctagcacc

SEQ ID NO: 68276 - DNA, 35 bp, Artificial Sequence
  Synthetic oligonucleotide
actcgttggccgcctgcgtagtacttgaacccccc

SEQ ID NO: 68277 - DNA, 35 bp, Artificial Sequence
  Synthetic oligonucleotide
cccacgtgtggtcgtactgcttgacgcgtcttccc

SEQ ID NO: 68278 - DNA, 35 bp, Artificial Sequence
  Synthetic oligonucleotide
tccctgaccctgtggactattagttcgagcgagcc

SEQ ID NO: 68279 - DNA, 35 bp, Artificial Sequence
  Synthetic oligonucleotide
tcacactccatcactgagccaccctagtttatagc

SEQ ID NO: 68280 - DNA, 35 bp, Artificial Sequence
  Synthetic oligonucleotide
tatgctcggcacgaatctcagatcaacttttcatc

SEQ ID NO: 68281 - DNA, 35 bp, Artificial Sequence
  Synthetic oligonucleotide
ggagcgcaaccaaattgccacatttcccccctatc

SEQ ID NO: 68282 - DNA, 35 bp, Artificial Sequence
  Synthetic oligonucleotide
agaccctccgccctatgaccgtacgtcgcacactc

SEQ ID NO: 68283 - DNA, 35 bp, Artificial Sequence
  Synthetic oligonucleotide
tcctacggtggatccttatggctacgggtttggtc

SEQ ID NO: 68284 - DNA, 35 bp, Artificial Sequence
  Synthetic oligonucleotide
gcaccctcgtacatgtatgtcactgagttttattc

SEQ ID NO: 68285 - DNA, 35 bp, Artificial Sequence
  Synthetic oligonucleotide
gaacggggtgttgcggtaatctttagggggcgaag

SEQ ID NO: 68286 - DNA, 35 bp, Artificial Sequence
  Synthetic oligonucleotide
gtccatcaaggccggcccctacgtatccctctcag

SEQ ID NO: 68287 - DNA, 35 bp, Artificial Sequence
  Synthetic oligonucleotide
aacaagggcgggaaatggggggcaaatacacggag

SEQ ID NO: 68288 - DNA, 35 bp, Artificial Sequence
  Synthetic oligonucleotide
ttatgccgtccgagattggcacgtacccattttag

SEQ ID NO: 68289 - DNA, 35 bp, Artificial Sequence
  Synthetic oligonucleotide
gtctggagggccgggggatctagctgggtgacgcg

SEQ ID NO: 68290 - DNA, 35 bp, Artificial Sequence
  Synthetic oligonucleotide
ttccacaaaggcccgatacctcgctctcatgatcg

SEQ ID NO: 68291 - DNA, 35 bp, Artificial Sequence
  Synthetic oligonucleotide
gcaatggtgcgggcgggggggtcaccctagaaagg

SEQ ID NO: 68292 - DNA, 35 bp, Artificial Sequence
  Synthetic oligonucleotide
gatcacggggactgggtctggaattaaggttgagg

SEQ ID NO: 68293 - DNA, 35 bp, Artificial Sequence
  Synthetic oligonucleotide
acaacgggggacgggcagggagttattatcggggg

SEQ ID NO: 68294 - DNA, 35 bp, Artificial Sequence
  Synthetic oligonucleotide
gccgagcgcacgttatcctatgtgtcttttcctgg

SEQ ID NO: 68295 - DNA, 35 bp, Artificial Sequence
  Synthetic oligonucleotide
gacaaaggggactataaggtggtagatagatgtgg

SEQ ID NO: 68296 - DNA, 35 bp, Artificial Sequence
  Synthetic oligonucleotide
taataaccgcccgcgctaagctgcatccaccattg

SEQ ID NO: 68297 - DNA, 35 bp, Artificial Sequence
  Synthetic oligonucleotide
gaccagctgctacggctaagtccaatcgcaaaact

SEQ ID NO: 68298 - DNA, 35 bp, Artificial Sequence
  Synthetic oligonucleotide
acacctcaccccgggacaagtaaagcccatgaact

SEQ ID NO: 68299 - DNA, 35 bp, Artificial Sequence
  Synthetic oligonucleotide
gacgaccatcacgccctgaccgggtcaatgcgact

SEQ ID NO: 68300 - DNA, 35 bp, Artificial Sequence
  Synthetic oligonucleotide
aacaccctcatccccgcgcatggttatacgtatct

SEQ ID NO: 68301 - DNA, 35 bp, Artificial Sequence
  Synthetic oligonucleotide
tcagtaaagctcagtcacttacggccctgatctct

SEQ ID NO: 68302 - DNA, 35 bp, Artificial Sequence
  Synthetic oligonucleotide
tcaagcgctgacccccctgtagcacattttgctgt

SEQ ID NO: 68303 - DNA, 35 bp, Artificial Sequence
  Synthetic oligonucleotide
ggaacgccctacctctctgtcatatatcgttttgt

SEQ ID NO: 68304 - DNA, 35 bp, Artificial Sequence
  Synthetic oligonucleotide
gcctaccctttgtgggtacgatcgcctcctacctt

SEQ ID NO: 68305 - DNA, 35 bp, Artificial Sequence
  Synthetic oligonucleotide
tacgcctatcccatcatttattggtattagtggtt

SEQ ID NO: 68306 - DNA, 35 bp, Artificial Sequence
  Synthetic oligonucleotide
tgatggccacgatcaattgtcgcacctcgaacttt

SEQ ID NO: 68307 - DNA, 35 bp, Artificial Sequence
  Synthetic oligonucleotide
acaaaccagccatagatggtccatacccatcgttt

SEQ ID NO: 68308 - DNA, 36 bp, Artificial Sequence
  Synthetic oligonucleotide
ttacccgtacacaccagcgtttccaattgctctcaa

SEQ ID NO: 68309 - DNA, 36 bp, Artificial Sequence
  Synthetic oligonucleotide
atacgcatcacaaccccgcacctctattgccaggaa

SEQ ID NO: 68310 - DNA, 36 bp, Artificial Sequence
  Synthetic oligonucleotide
ttgaggggaaggcaaggcggagctgatgggcgggaa

SEQ ID NO: 68311 - DNA, 35 bp, Artificial Sequence
  Synthetic oligonucleotide
tacgtatgtcggtcactggaatttctgggctggaa

SEQ ID NO: 68312 - DNA, 36 bp, Artificial Sequence
  Synthetic oligonucleotide
tgccacacgcgacactgttctcgccccgccactgaa

SEQ ID NO: 68313 - DNA, 36 bp, Artificial Sequence
  Synthetic oligonucleotide
agcgccctgttctgcaccccctttccttctgggtaa

SEQ ID NO: 68314 - DNA, 36 bp, Artificial Sequence
  Synthetic oligonucleotide
aactggcccccccaaatatgtttaacacacgtttaa

SEQ ID NO: 68315 - DNA, 36 bp, Artificial Sequence
  Synthetic oligonucleotide
ttcgaacacccggactggctgagccttctggcaaca

SEQ ID NO: 68316 - DNA, 35 bp, Artificial Sequence
  Synthetic oligonucleotide
tgtcatacccgcacaccgattaccgtcgaaccaca

SEQ ID NO: 68317 - DNA, 36 bp, Artificial Sequence
  Synthetic oligonucleotide
ttcgctgaccagaggccacataacattctgcccaca

SEQ ID NO: 68318 - DNA, 36 bp, Artificial Sequence
  Synthetic oligonucleotide
aacccatcgcgcccagtctgtctacaaaggcggaca

SEQ ID NO: 68319 - DNA, 36 bp, Artificial Sequence
  Synthetic oligonucleotide
gatccgaacgacctcccactaccgtgcatgtttaca

SEQ ID NO: 68320 - DNA, 36 bp, Artificial Sequence
  Synthetic oligonucleotide
gcccaggccattttttgaatccgcaacgccgcacca

SEQ ID NO: 68321 - DNA, 35 bp, Artificial Sequence
  Synthetic oligonucleotide
aacgcgctccaactggctagctctgagaattacca

SEQ ID NO: 68322 - DNA, 36 bp, Artificial Sequence
  Synthetic oligonucleotide
actccaaaactgcctcagcccctccgtggcatcgca

SEQ ID NO: 68323 - DNA, 36 bp, Artificial Sequence
  Synthetic oligonucleotide
gtttcaccggccgtggtttcatttcttcacggtgca

SEQ ID NO: 68324 - DNA, 36 bp, Artificial Sequence
  Synthetic oligonucleotide
ggtgcatcggctgtcccctttgtcggctagtttgca

SEQ ID NO: 68325 - DNA, 35 bp, Artificial Sequence
  Synthetic oligonucleotide
gatcatggggtaaccacagggtgggagggatatca

SEQ ID NO: 68326 - DNA, 35 bp, Artificial Sequence
  Synthetic oligonucleotide
ttcactggcacctggtcgcgcgacccccgttatca

SEQ ID NO: 68327 - DNA, 37 bp, Artificial Sequence
  Synthetic oligonucleotide
tccgagcatcgcccttctgtacactgcgcctccctca

SEQ ID NO: 68328 - DNA, 36 bp, Artificial Sequence
  Synthetic oligonucleotide
gtaccgtctgaccgcaattcacgccttcttcagtca

SEQ ID NO: 68329 - DNA, 37 bp, Artificial Sequence
  Synthetic oligonucleotide
gcaagggggggacgcacaaataaagtagagggtaaga

SEQ ID NO: 68330 - DNA, 37 bp, Artificial Sequence
  Synthetic oligonucleotide
atcctactcccgtcaaccgttgaacatccagaacaga

SEQ ID NO: 68331 - DNA, 37 bp, Artificial Sequence
  Synthetic oligonucleotide
acgcggaatcaggggggacgaatctaagcgagacaga

SEQ ID NO: 68332 - DNA, 37 bp, Artificial Sequence
  Synthetic oligonucleotide
gcacgaggagtcggtggtagaaattttcggggataga

SEQ ID NO: 68333 - DNA, 37 bp, Artificial Sequence
  Synthetic oligonucleotide
gatgcctctcatcatacgacctgaagaatttttacga

SEQ ID NO: 68334 - DNA, 37 bp, Artificial Sequence
  Synthetic oligonucleotide
gtctgaccgtcacttcctgcagctgcatctttaccga

SEQ ID NO: 68335 - DNA, 37 bp, Artificial Sequence
  Synthetic oligonucleotide
gctcccccctgcatccgcgccgctccagtccgcgcga

SEQ ID NO: 68336 - DNA, 37 bp, Artificial Sequence
  Synthetic oligonucleotide
atgagggtggagggtgatccgcagggctgcatggcga

SEQ ID NO: 68337 - DNA, 36 bp, Artificial Sequence
  Synthetic oligonucleotide
accgaccatcgactctatgctttgtttttctctcga

SEQ ID NO: 68338 - DNA, 36 bp, Artificial Sequence
  Synthetic oligonucleotide
tacaccatgaggtcgtgatcccgtttccacttagga

SEQ ID NO: 68339 - DNA, 37 bp, Artificial Sequence
  Synthetic oligonucleotide
tgttgtcccatttgcccgtagtagcgcgttcgccgga

SEQ ID NO: 68340 - DNA, 36 bp, Artificial Sequence
  Synthetic oligonucleotide
tctgggacttgtggggggtgagtggaaaacgaggga

SEQ ID NO: 68341 - DNA, 37 bp, Artificial Sequence
  Synthetic oligonucleotide
ataataggcggaaggggtcggggaggtaggataggga

SEQ ID NO: 68342 - DNA, 37 bp, Artificial Sequence
  Synthetic oligonucleotide
acgtgccagtcgaggagggattgggatagagggggga

SEQ ID NO: 68343 - DNA, 37 bp, Artificial Sequence
  Synthetic oligonucleotide
gtggatggcgctatcctgaccactcaccatcactgga

SEQ ID NO: 68344 - DNA, 36 bp, Artificial Sequence
  Synthetic oligonucleotide
aaccgccatgcatacgttcaaccccgaccagctgga

SEQ ID NO: 68345 - DNA, 36 bp, Artificial Sequence
  Synthetic oligonucleotide
agctgtgccctgaacttctgtctgcatccccaatga

SEQ ID NO: 68346 - DNA, 38 bp, Artificial Sequence
  Synthetic oligonucleotide
tcttcacgccctatcactctacctcagactggcaatga

SEQ ID NO: 68347 - DNA, 37 bp, Artificial Sequence
  Synthetic oligonucleotide
tttacacctccgttttcatgggcgaattatcccatga

SEQ ID NO: 68348 - DNA, 36 bp, Artificial Sequence
  Synthetic oligonucleotide
gcaagccgggggggggtgcatgtggggagcagatga

SEQ ID NO: 68349 - DNA, 37 bp, Artificial Sequence
  Synthetic oligonucleotide
aagttgcgccgcgttggccttctgtactgttacctga

SEQ ID NO: 68350 - DNA, 37 bp, Artificial Sequence
  Synthetic oligonucleotide
tagtccactcctgactcggatattgtggccaccctga

SEQ ID NO: 68351 - DNA, 38 bp, Artificial Sequence
  Synthetic oligonucleotide
gccataagcggtaacgcctgcaggtacgctttccctga

SEQ ID NO: 68352 - DNA, 38 bp, Artificial Sequence
  Synthetic oligonucleotide
ttgtgcgccaggtaaacgcgttggtgcaaactgcctga

SEQ ID NO: 68353 - DNA, 38 bp, Artificial Sequence
  Synthetic oligonucleotide
accgcacgtaggtacatctccaccagctagttcgctga

SEQ ID NO: 68354 - DNA, 37 bp, Artificial Sequence
  Synthetic oligonucleotide
gatcgggtagaggaggggcaagtaatgagggtgctga

SEQ ID NO: 68355 - DNA, 38 bp, Artificial Sequence
  Synthetic oligonucleotide
gttgccccagataaggcaattttgcacccattttctga

SEQ ID NO: 68356 - DNA, 38 bp, Artificial Sequence
  Synthetic oligonucleotide
gacaaggggggtgggcttcgagaatgtggacggagtga

SEQ ID NO: 68357 - DNA, 38 bp, Artificial Sequence
  Synthetic oligonucleotide
aaccaggggaagaagggacaaagattcgatggtagtga

SEQ ID NO: 68358 - DNA, 38 bp, Artificial Sequence
  Synthetic oligonucleotide
ggaacgctccatttctgacgccgatcctccacccgtga

SEQ ID NO: 68359 - DNA, 38 bp, Artificial Sequence
  Synthetic oligonucleotide
gaccaccctgacgaagacctattgatccaccctcgtga

SEQ ID NO: 68360 - DNA, 38 bp, Artificial Sequence
  Synthetic oligonucleotide
taagagaggaacggtggaagttagacaagatgaggtga

SEQ ID NO: 68361 - DNA, 37 bp, Artificial Sequence
  Synthetic oligonucleotide
actgacaatcctcgcctcccttaccggtaaacggtga

SEQ ID NO: 68362 - DNA, 38 bp, Artificial Sequence
  Synthetic oligonucleotide
atgcactggaggagggggagacgcccgagtcacggtga

SEQ ID NO: 68363 - DNA, 38 bp, Artificial Sequence
  Synthetic oligonucleotide
ttcagggagggaacgagggtacgtgtattagagggtga

SEQ ID NO: 68364 - DNA, 38 bp, Artificial Sequence
  Synthetic oligonucleotide
gaccagctccaataacggtgagcaggtcacgaatgtga

SEQ ID NO: 68365 - DNA, 38 bp, Artificial Sequence
  Synthetic oligonucleotide
acgtgtcgccgggtcgacaccctcacatcactatgtga

SEQ ID NO: 68366 - DNA, 37 bp, Artificial Sequence
  Synthetic oligonucleotide
gccactccaccgtagacgcgcacataccgcatattga

SEQ ID NO: 68367 - DNA, 37 bp, Artificial Sequence
  Synthetic oligonucleotide
gcacacgtcgcttctcgtgcgcaacatttattattga

SEQ ID NO: 68368 - DNA, 38 bp, Artificial Sequence
  Synthetic oligonucleotide
acgctgagtggtagtcttttcccgtctcctgcccttga

SEQ ID NO: 68369 - DNA, 37 bp, Artificial Sequence
  Synthetic oligonucleotide
gtggcaccggtcccctttcgcacgagctcctccttga

SEQ ID NO: 68370 - DNA, 37 bp, Artificial Sequence
  Synthetic oligonucleotide
gtcactctgcttatgcccgttctagcaatcttcttga

SEQ ID NO: 68371 - DNA, 38 bp, Artificial Sequence
  Synthetic oligonucleotide
tgtgcctcagcgcctcgattcccccacctgtgatttga

SEQ ID NO: 68372 - DNA, 35 bp, Artificial Sequence
  Synthetic oligonucleotide
ggaaccaacaccttcgcacatgagagcgggaaata

SEQ ID NO: 68373 - DNA, 36 bp, Artificial Sequence
  Synthetic oligonucleotide
tcattccgcagctcgttttgctagccgcgatcccta

SEQ ID NO: 68374 - DNA, 36 bp, Artificial Sequence
  Synthetic oligonucleotide
tctgcaaaggtctagctgacccaaacaatgccgcta

SEQ ID NO: 68375 - DNA, 36 bp, Artificial Sequence
  Synthetic oligonucleotide
tccatttgccgtgtatgtagccgcacgccacttcta

SEQ ID NO: 68376 - DNA, 35 bp, Artificial Sequence
  Synthetic oligonucleotide
tgaagttggggaggaagacgagcagaaacgagaac

SEQ ID NO: 68377 - DNA, 35 bp, Artificial Sequence
  Synthetic oligonucleotide
gacacgtgggtcgtgtcatatccgagtatactcac

SEQ ID NO: 68378 - DNA, 35 bp, Artificial Sequence
  Synthetic oligonucleotide
gttgacgctagcctcccaatcataaaaggcctcac

SEQ ID NO: 68379 - DNA, 35 bp, Artificial Sequence
  Synthetic oligonucleotide
acaccgcttagcgagcgaatcccgcccgactgacc

SEQ ID NO: 68380 - DNA, 35 bp, Artificial Sequence
  Synthetic oligonucleotide
tacaggttagcccgtaggccgcaacatctccgccc

SEQ ID NO: 68381 - DNA, 35 bp, Artificial Sequence
  Synthetic oligonucleotide
tcaggcgatacctcgttggtgctacactcgctccc

SEQ ID NO: 68382 - DNA, 35 bp, Artificial Sequence
  Synthetic oligonucleotide
tcaccacccgtactaccaacgcctcgctaaacgcc

SEQ ID NO: 68383 - DNA, 35 bp, Artificial Sequence
  Synthetic oligonucleotide
gtaaggagcgttatgctactgccacatcacccgcc

SEQ ID NO: 68384 - DNA, 35 bp, Artificial Sequence
  Synthetic oligonucleotide
gcgtccgtatgatgcgcacctctatgcctcgatcc

SEQ ID NO: 68385 - DNA, 35 bp, Artificial Sequence
  Synthetic oligonucleotide
gcgcgaacaggcggattctacgtttccagccctcc

SEQ ID NO: 68386 - DNA, 35 bp, Artificial Sequence
  Synthetic oligonucleotide
atgcccgcacggttgccctagtatgctatgtttcc

SEQ ID NO: 68387 - DNA, 35 bp, Artificial Sequence
  Synthetic oligonucleotide
aaaccacttctgctttgctatctctctgactaggc

SEQ ID NO: 68388 - DNA, 35 bp, Artificial Sequence
  Synthetic oligonucleotide
gtccactcctcaagttatttggatcttggtttggc

SEQ ID NO: 68389 - DNA, 35 bp, Artificial Sequence
  Synthetic oligonucleotide
gagctggactgcaagaccgcgtcaaacactcctgc

SEQ ID NO: 68390 - DNA, 35 bp, Artificial Sequence
  Synthetic oligonucleotide
aattggcctcctataaccgctatttagtaccgtgc

SEQ ID NO: 68391 - DNA, 35 bp, Artificial Sequence
  Synthetic oligonucleotide
aacgcggggaccttctctttttcatgcgtttcatc

SEQ ID NO: 68392 - DNA, 35 bp, Artificial Sequence
  Synthetic oligonucleotide
gccacaaccgacttgtagcagtgtctctcatactc

SEQ ID NO: 68393 - DNA, 35 bp, Artificial Sequence
  Synthetic oligonucleotide
ttatcccaaacccactgtgttcggccgacaccttc

SEQ ID NO: 68394 - DNA, 35 bp, Artificial Sequence
  Synthetic oligonucleotide
agagcaaggccacggaaccttgaggataaaaaggg

SEQ ID NO: 68395 - DNA, 35 bp, Artificial Sequence
  Synthetic oligonucleotide
gtcagggtacgaggggggggttggtgcgactcggg

SEQ ID NO: 68396 - DNA, 35 bp, Artificial Sequence
  Synthetic oligonucleotide
tctgggatgcagaatgctggtaggtaagttggggg

SEQ ID NO: 68397 - DNA, 35 bp, Artificial Sequence
  Synthetic oligonucleotide
tcatcgcctagctggttcaccctgtgctttagctg

SEQ ID NO: 68398 - DNA, 35 bp, Artificial Sequence
  Synthetic oligonucleotide
tcagacttcactatcgcgtcgccttggcaacccct

SEQ ID NO: 68399 - DNA, 35 bp, Artificial Sequence
  Synthetic oligonucleotide
gacccctcgcagcaggggtagtgaagtggggaagt

SEQ ID NO: 68400 - DNA, 35 bp, Artificial Sequence
  Synthetic oligonucleotide
tgacgctcctgtgtcatactgcacaccgaccccgt

SEQ ID NO: 68401 - DNA, 35 bp, Artificial Sequence
  Synthetic oligonucleotide
aaaacgaagaggggggggtagaagtgatacgtcgt

SEQ ID NO: 68402 - DNA, 35 bp, Artificial Sequence
  Synthetic oligonucleotide
tctcgcaggccccttgcattcctccaccgtcctgt

SEQ ID NO: 68403 - DNA, 36 bp, Artificial Sequence
  Synthetic oligonucleotide
ggaccaccgccaatgcccatccgataaacgccttaa

SEQ ID NO: 68404 - DNA, 35 bp, Artificial Sequence
  Synthetic oligonucleotide
tttgacgccctatccgggtaggactctggttgaca

SEQ ID NO: 68405 - DNA, 36 bp, Artificial Sequence
  Synthetic oligonucleotide
gggggctgtgccacatctcgtatcctcttcgaacca

SEQ ID NO: 68406 - DNA, 36 bp, Artificial Sequence
  Synthetic oligonucleotide
gtcagtcaccatgccactactccggatcccaggcca

SEQ ID NO: 68407 - DNA, 36 bp, Artificial Sequence
  Synthetic oligonucleotide
gagccacgggcctcgcgccaccgatcccctaccgca

SEQ ID NO: 68408 - DNA, 35 bp, Artificial Sequence
  Synthetic oligonucleotide
tcacgcgaacgcccctatggttaccctgctcatca

SEQ ID NO: 68409 - DNA, 35 bp, Artificial Sequence
  Synthetic oligonucleotide
aagtcgaacggcttactctgccactctcaacctca

SEQ ID NO: 68410 - DNA, 35 bp, Artificial Sequence
  Synthetic oligonucleotide
tgacgcaaacaagggggagaaggagaaccgcgtca

SEQ ID NO: 68411 - DNA, 35 bp, Artificial Sequence
  Synthetic oligonucleotide
tctacgatctcaccttgaacagacatacagtttca

SEQ ID NO: 68412 - DNA, 36 bp, Artificial Sequence
  Synthetic oligonucleotide
aatgagagggggaggcgcctctaagaggagttttca

SEQ ID NO: 68413 - DNA, 37 bp, Artificial Sequence
  Synthetic oligonucleotide
ctgagacaccacgacatttgtaacaataccttcccga

SEQ ID NO: 68414 - DNA, 37 bp, Artificial Sequence
  Synthetic oligonucleotide
tattgggggggagtaggaaaggaagggagttagccga

SEQ ID NO: 68415 - DNA, 37 bp, Artificial Sequence
  Synthetic oligonucleotide
tgacctgtaccatagttagtcccattgcccctgccga

SEQ ID NO: 68416 - DNA, 35 bp, Artificial Sequence
  Synthetic oligonucleotide
gaagctatgccccatacctgatttcctttttgcga

SEQ ID NO: 68417 - DNA, 37 bp, Artificial Sequence
  Synthetic oligonucleotide
tcaatcacccgtctcacgcctttctccgttatctcga

SEQ ID NO: 68418 - DNA, 37 bp, Artificial Sequence
  Synthetic oligonucleotide
atcccatcacctatcaatcccgggagactcccgagga

SEQ ID NO: 68419 - DNA, 37 bp, Artificial Sequence
  Synthetic oligonucleotide
gtgtggggaggtgcgggattaaagtggtagctgagga

SEQ ID NO: 68420 - DNA, 37 bp, Artificial Sequence
  Synthetic oligonucleotide
ttcaccgccagctcaccttttttcacgtcgcctagga

SEQ ID NO: 68421 - DNA, 37 bp, Artificial Sequence
  Synthetic oligonucleotide
gcgacgacgggggtgaccataatgctgggagtgcgga

SEQ ID NO: 68422 - DNA, 37 bp, Artificial Sequence
  Synthetic oligonucleotide
acctccccgtgggcatatacgtgcgtcccctcctgga

SEQ ID NO: 68423 - DNA, 38 bp, Artificial Sequence
  Synthetic oligonucleotide
tgataggaagggtaggagggggggagccaggccaatga

SEQ ID NO: 68424 - DNA, 38 bp, Artificial Sequence
  Synthetic oligonucleotide
gcgaggtgaaggttaagagcggggggggagggcaatga

SEQ ID NO: 68425 - DNA, 37 bp, Artificial Sequence
  Synthetic oligonucleotide
gtgaaccctaccaaactgataactacgcatcccatga

SEQ ID NO: 68426 - DNA, 37 bp, Artificial Sequence
  Synthetic oligonucleotide
tctgacatcaacagcattcccgcagccatactcatga

SEQ ID NO: 68427 - DNA, 38 bp, Artificial Sequence
  Synthetic oligonucleotide
gcagtcgggtggagcagggaacgtcaagcgatcgatga

SEQ ID NO: 68428 - DNA, 35 bp, Artificial Sequence
  Synthetic oligonucleotide
ttgcacccgttattctaccgacaccaactcgatga

SEQ ID NO: 68429 - DNA, 38 bp, Artificial Sequence
  Synthetic oligonucleotide
tcgagacgtgccaacctgcttgtaagccactgaactga

SEQ ID NO: 68430 - DNA, 38 bp, Artificial Sequence
  Synthetic oligonucleotide
agtacgcgtgacgcgctccacctatactccgcccctga

SEQ ID NO: 68431 - DNA, 37 bp, Artificial Sequence
  Synthetic oligonucleotide
gagtcatacgacaagcccgacccccgttattgcctga

SEQ ID NO: 68432 - DNA, 37 bp, Artificial Sequence
  Synthetic oligonucleotide
gacacccactacgtgccgcctgttatcaaattcctga

SEQ ID NO: 68433 - DNA, 38 bp, Artificial Sequence
  Synthetic oligonucleotide
aacgcgccgtgcgccctgtgctccaactcaaccgctga

SEQ ID NO: 68434 - DNA, 38 bp, Artificial Sequence
  Synthetic oligonucleotide
ttagccgctgacttcttatttctactcgcgtttgctga

SEQ ID NO: 68435 - DNA, 38 bp, Artificial Sequence
  Synthetic oligonucleotide
tcaactgcaaagcgtcaagcatatcgtgccctctctga

SEQ ID NO: 68436 - DNA, 38 bp, Artificial Sequence
  Synthetic oligonucleotide
agcgggaacggacagcatggggtcagcggggaaagtga

SEQ ID NO: 68437 - DNA, 37 bp, Artificial Sequence
  Synthetic oligonucleotide
gggttgtgggaaggggggggcgggagtagtcacgtga

SEQ ID NO: 68438 - DNA, 38 bp, Artificial Sequence
  Synthetic oligonucleotide
agggaaggcgggcactacgtaatggggggatagggtga

SEQ ID NO: 68439 - DNA, 38 bp, Artificial Sequence
  Synthetic oligonucleotide
atcccgtggaaggagttgtgggacaacgcaaggggtga

SEQ ID NO: 68440 - DNA, 36 bp, Artificial Sequence
  Synthetic oligonucleotide
gaacaggggggcggtggggttaattaatgctggtga

SEQ ID NO: 68441 - DNA, 38 bp, Artificial Sequence
  Synthetic oligonucleotide
tatccatcataccacccctacagtgcagtcaacattga

SEQ ID NO: 68442 - DNA, 38 bp, Artificial Sequence
  Synthetic oligonucleotide
ggatggagaggggtgtaataacgcgagtacgacattga

SEQ ID NO: 68443 - DNA, 38 bp, Artificial Sequence
  Synthetic oligonucleotide
cctgccgcacgcaacacctatggcctgtttcaacttga

SEQ ID NO: 68444 - DNA, 38 bp, Artificial Sequence
  Synthetic oligonucleotide
ttcgctgaccgcacagtctcttgactagcctgacttga

SEQ ID NO: 68445 - DNA, 37 bp, Artificial Sequence
  Synthetic oligonucleotide
atcactctcatgaaattaaaagcaccctcgcccttga

SEQ ID NO: 68446 - DNA, 38 bp, Artificial Sequence
  Synthetic oligonucleotide
tccccaacccggccgaaaaaccggtctgactcccttga

SEQ ID NO: 68447 - DNA, 38 bp, Artificial Sequence
  Synthetic oligonucleotide
gcacacatcaggggccacattgtcactactcgatttga

SEQ ID NO: 68448 - DNA, 38 bp, Artificial Sequence
  Synthetic oligonucleotide
ggccacacgcactgtttctttctccctctgtagtttga

SEQ ID NO: 68449 - DNA, 36 bp, Artificial Sequence
  Synthetic oligonucleotide
tgtgtcaccatctgaaagcgaatgaaacgcctacta

SEQ ID NO: 68450 - DNA, 36 bp, Artificial Sequence
  Synthetic oligonucleotide
gtccttccacaggctccacttccagatctgcgccta

SEQ ID NO: 68451 - DNA, 35 bp, Artificial Sequence
  Synthetic oligonucleotide
tactgttggcgtctcgtacgtctattctccttcta

SEQ ID NO: 68452 - DNA, 35 bp, Artificial Sequence
  Synthetic oligonucleotide
gaccacgaaggtggtaagtcagagaggcgatggta

SEQ ID NO: 68453 - DNA, 36 bp, Artificial Sequence
  Synthetic oligonucleotide
tccctcaccgcgtacgtgacatccatgaagcctgta

SEQ ID NO: 68454 - DNA, 36 bp, Artificial Sequence
  Synthetic oligonucleotide
ggaatccgccacacccttcaagtcaacagcattgta

SEQ ID NO: 68455 - DNA, 36 bp, Artificial Sequence
  Synthetic oligonucleotide
gcacatccgaatcggtattcctaacactcaacttta

SEQ ID NO: 68456 - DNA, 35 bp, Artificial Sequence
  Synthetic oligonucleotide
acgcaatcctaagacgccgccttatgcacgccccc

SEQ ID NO: 68457 - DNA, 35 bp, Artificial Sequence
  Synthetic oligonucleotide
gatccaactggtatggattgcgatgtcactgcccc

SEQ ID NO: 68458 - DNA, 35 bp, Artificial Sequence
  Synthetic oligonucleotide
tctgaggccaacaatacgtgagtatttacatcccc

SEQ ID NO: 68459 - DNA, 35 bp, Artificial Sequence
  Synthetic oligonucleotide
ttgagatacgatgcccgctccccgcacacacagcc

SEQ ID NO: 68460 - DNA, 35 bp, Artificial Sequence
  Synthetic oligonucleotide
aacccgttgacaccccggttgggccgaccacagcc

SEQ ID NO: 68461 - DNA, 35 bp, Artificial Sequence
  Synthetic oligonucleotide
gttgacaattcgctcgatactgcctcgtaacatcc

SEQ ID NO: 68462 - DNA, 35 bp, Artificial Sequence
  Synthetic oligonucleotide
agtgttcaccccctgaccgcagtgaccgcccctcc

SEQ ID NO: 68463 - DNA, 35 bp, Artificial Sequence
  Synthetic oligonucleotide
tctccctccgcccccaactgttgacgtaatattcc

SEQ ID NO: 68464 - DNA, 35 bp, Artificial Sequence
  Synthetic oligonucleotide
accttccgacatcctctggcccgctgggcgcaatc

SEQ ID NO: 68465 - DNA, 35 bp, Artificial Sequence
  Synthetic oligonucleotide
gtcccacactgtgagcaagtgaaacggggctcatc

SEQ ID NO: 68466 - DNA, 35 bp, Artificial Sequence
  Synthetic oligonucleotide
tgctgcaccagaatgttagccctcctcacgtggtc

SEQ ID NO: 68467 - DNA, 35 bp, Artificial Sequence
  Synthetic oligonucleotide
gagcccaaaccccgcccgaggctagccgcttattc

SEQ ID NO: 68468 - DNA, 35 bp, Artificial Sequence
  Synthetic oligonucleotide
tgcatgccatacggtattgctaatctgttgacttc

SEQ ID NO: 68469 - DNA, 35 bp, Artificial Sequence
  Synthetic oligonucleotide
agccgggaggaaaaacaatcgggcggggtattcag

SEQ ID NO: 68470 - DNA, 35 bp, Artificial Sequence
  Synthetic oligonucleotide
gacggagggacaccttaaggtgactaaggggagag

SEQ ID NO: 68471 - DNA, 35 bp, Artificial Sequence
  Synthetic oligonucleotide
gacaggtccagcattattttccctctcctcgaacg

SEQ ID NO: 68472 - DNA, 35 bp, Artificial Sequence
  Synthetic oligonucleotide
gcacggagtctctgccgcccccactgcaacccacg

SEQ ID NO: 68473 - DNA, 35 bp, Artificial Sequence
  Synthetic oligonucleotide
actcacctatgatctgagatgacctaatccgaccg

SEQ ID NO: 68474 - DNA, 35 bp, Artificial Sequence
  Synthetic oligonucleotide
atgaaagtggtgaggcaagcaggcggtgcagggcg

SEQ ID NO: 68475 - DNA, 35 bp, Artificial Sequence
  Synthetic oligonucleotide
tattctctccgacaaccgttacgcaccttcgtgcg

SEQ ID NO: 68476 - DNA, 35 bp, Artificial Sequence
  Synthetic oligonucleotide
gctgactctgccactacttcaatcgcacgaaatcg

SEQ ID NO: 68477 - DNA, 35 bp, Artificial Sequence
  Synthetic oligonucleotide
agactacctcccgagttttgaactctatcctttcg

SEQ ID NO: 68478 - DNA, 35 bp, Artificial Sequence
  Synthetic oligonucleotide
tacccaccgcctaggcaggatcacccgcgtgcctg

SEQ ID NO: 68479 - DNA, 35 bp, Artificial Sequence
  Synthetic oligonucleotide
acactctcaacccgccctagcatcctgggaccgtg

SEQ ID NO: 68480 - DNA, 35 bp, Artificial Sequence
  Synthetic oligonucleotide
tctacaaacagcccaccctctggagaccatgggtg

SEQ ID NO: 68481 - DNA, 35 bp, Artificial Sequence
  Synthetic oligonucleotide
ttaatccccctcatcccgttttagtagacctattg

SEQ ID NO: 68482 - DNA, 35 bp, Artificial Sequence
  Synthetic oligonucleotide
gggaagtcactttcgttttactcgcccatgtccat

SEQ ID NO: 68483 - DNA, 35 bp, Artificial Sequence
  Synthetic oligonucleotide
actcagagcaggtgtttcttaccgctcgacctcat

SEQ ID NO: 68484 - DNA, 35 bp, Artificial Sequence
  Synthetic oligonucleotide
gatcccgctccagcaccgtgtcccaacctgctcat

SEQ ID NO: 68485 - DNA, 35 bp, Artificial Sequence
  Synthetic oligonucleotide
gaactccccggcgtgttgtcgccaccaaactggat

SEQ ID NO: 68486 - DNA, 35 bp, Artificial Sequence
  Synthetic oligonucleotide
gacatgtgggtagtacagggatgtgcaggaggtat

SEQ ID NO: 68487 - DNA, 35 bp, Artificial Sequence
  Synthetic oligonucleotide
tgtactcactcacgtctcccggcgtttccatacct

SEQ ID NO: 68488 - DNA, 35 bp, Artificial Sequence
  Synthetic oligonucleotide
tccgaatgcatggtctgcaatagtcaacatgccct

SEQ ID NO: 68489 - DNA, 35 bp, Artificial Sequence
  Synthetic oligonucleotide
ttaggcgggtcacgttaccatgcctttcgttatct

SEQ ID NO: 68490 - DNA, 35 bp, Artificial Sequence
  Synthetic oligonucleotide
atagtgccacttcccacatccatcctgtacccagt

SEQ ID NO: 68491 - DNA, 35 bp, Artificial Sequence
  Synthetic oligonucleotide
tcacctcgggcaggctttgaatccccgtccacggt

SEQ ID NO: 68492 - DNA, 35 bp, Artificial Sequence
  Synthetic oligonucleotide
atgggcgcctcaccgtaccttttcctgctacgatt

SEQ ID NO: 68493 - DNA, 35 bp, Artificial Sequence
  Synthetic oligonucleotide
gaattgccactttgttcactgagtttcatacactt

SEQ ID NO: 68494 - DNA, 35 bp, Artificial Sequence
  Synthetic oligonucleotide
ttcggagctcgaatcgctgttgctggccgaacctt

SEQ ID NO: 68495 - DNA, 35 bp, Artificial Sequence
  Synthetic oligonucleotide
agagactcaaacacctgcctagagctagtctcctt

SEQ ID NO: 68496 - DNA, 35 bp, Artificial Sequence
  Synthetic oligonucleotide
tccggacatccccctcctatacctcaccgtcgctt

SEQ ID NO: 68497 - DNA, 35 bp, Artificial Sequence
  Synthetic oligonucleotide
atgcacgttgagtcagacaagaggggggtcgtgtt

SEQ ID NO: 68498 - DNA, 35 bp, Artificial Sequence
  Synthetic oligonucleotide
gtacgcacccggccatggatagtcagatcgcattt

SEQ ID NO: 68499 - DNA, 35 bp, Artificial Sequence
  Synthetic oligonucleotide
aggaccacacgccgcaagcctagaatgccttattt

SEQ ID NO: 68500 - DNA, 35 bp, Artificial Sequence
  Synthetic oligonucleotide
tagagaggcgctgctcctattcacgtccccccttt

SEQ ID NO: 68501 - DNA, 36 bp, Artificial Sequence
  Synthetic oligonucleotide
gcagaacgcatacactgctatacaattgcacccaaa

SEQ ID NO: 68502 - DNA, 35 bp, Artificial Sequence
  Synthetic oligonucleotide
tcgaggaagcatcgcgaccaccgtaccatctagaa

SEQ ID NO: 68503 - DNA, 36 bp, Artificial Sequence
  Synthetic oligonucleotide
gaaggatgggtggttgattggctaaggctaagcgaa

SEQ ID NO: 68504 - DNA, 38 bp, Artificial Sequence
  Synthetic oligonucleotide
gtatccatccgcctctcagccgtcaaccatcatgggaa

SEQ ID NO: 68505 - DNA, 36 bp, Artificial Sequence
  Synthetic oligonucleotide
gctgccctctcataaatgactgtcctctgccctgaa

SEQ ID NO: 68506 - DNA, 35 bp, Artificial Sequence
  Synthetic oligonucleotide
aacgtgtcgtacctgaatcgcccctaccacagtaa

SEQ ID NO: 68507 - DNA, 36 bp, Artificial Sequence
  Synthetic oligonucleotide
accgcctccatgccttcctagtttcaggcagcttaa

SEQ ID NO: 68508 - DNA, 36 bp, Artificial Sequence
  Synthetic oligonucleotide
ttacaccctcaactgcactagatacaacgtcgttaa

SEQ ID NO: 68509 - DNA, 35 bp, Artificial Sequence
  Synthetic oligonucleotide
tataccgtccgtctcggcttatgctatcctgttaa

SEQ ID NO: 68510 - DNA, 36 bp, Artificial Sequence
  Synthetic oligonucleotide
gtaaaccgcaccaaaaggcatactcgtagttctaca

SEQ ID NO: 68511 - DNA, 35 bp, Artificial Sequence
  Synthetic oligonucleotide
atgcactggctcgaatagcaccaactctgggtaca

SEQ ID NO: 68512 - DNA, 36 bp, Artificial Sequence
  Synthetic oligonucleotide
gtccatatccttggcccacatgtctatccctgacca

SEQ ID NO: 68513 - DNA, 35 bp, Artificial Sequence
  Synthetic oligonucleotide
ccacattccctgcaccgtaaaagttcttggcccca

SEQ ID NO: 68514 - DNA, 36 bp, Artificial Sequence
  Synthetic oligonucleotide
gagctgcgccttccgttacatccgtcgtactctcca

SEQ ID NO: 68515 - DNA, 36 bp, Artificial Sequence
  Synthetic oligonucleotide
aagtccccccaactcatgtcctgcccctggatagca

SEQ ID NO: 68516 - DNA, 36 bp, Artificial Sequence
  Synthetic oligonucleotide
tgacaaggcattcctcgcatatattggcctctcgca

SEQ ID NO: 68517 - DNA, 36 bp, Artificial Sequence
  Synthetic oligonucleotide
taacccggtcacctttttattgccataagttctgca

SEQ ID NO: 68518 - DNA, 36 bp, Artificial Sequence
  Synthetic oligonucleotide
ttctgccctgccgcccccgtttgtctcgatgttgca

SEQ ID NO: 68519 - DNA, 35 bp, Artificial Sequence
  Synthetic oligonucleotide
tacccggcgcacgacggccgccagttctatactca

SEQ ID NO: 68520 - DNA, 37 bp, Artificial Sequence
  Synthetic oligonucleotide
gaacatcgcagctgggccttttcttttcatcatgaga

SEQ ID NO: 68521 - DNA, 35 bp, Artificial Sequence
  Synthetic oligonucleotide
aacgcgaacctcatgtcaaccactatccacataga

SEQ ID NO: 68522 - DNA, 35 bp, Artificial Sequence
  Synthetic oligonucleotide
tatgtcacccggcgttctgctctaaccgtgttaga

SEQ ID NO: 68523 - DNA, 37 bp, Artificial Sequence
  Synthetic oligonucleotide
agcatgccccttccttgcctatgctacaagctaccga

SEQ ID NO: 68524 - DNA, 36 bp, Artificial Sequence
  Synthetic oligonucleotide
tccagctctgtctcattgcctatctactacgttcga

SEQ ID NO: 68525 - DNA, 35 bp, Artificial Sequence
  Synthetic oligonucleotide
gaagcgcaggggggggtaagctggctatatacgga

SEQ ID NO: 68526 - DNA, 37 bp, Artificial Sequence
  Synthetic oligonucleotide
gagacgacggatcgcaggaaggaaaggacagcccgga

SEQ ID NO: 68527 - DNA, 37 bp, Artificial Sequence
  Synthetic oligonucleotide
ttgagggggtggaattaggtgagacggttgttgcgga

SEQ ID NO: 68528 - DNA, 37 bp, Artificial Sequence
  Synthetic oligonucleotide
ggtggttgagtgtgaagtgggcaggaagggatgggga

SEQ ID NO: 68529 - DNA, 37 bp, Artificial Sequence
  Synthetic oligonucleotide
atgccccactccaatcctcacgggactgtaacttgga

SEQ ID NO: 68530 - DNA, 38 bp, Artificial Sequence
  Synthetic oligonucleotide
gacacgtgacccatgggagcttaactctactgacatga

SEQ ID NO: 68531 - DNA, 38 bp, Artificial Sequence
  Synthetic oligonucleotide
tgaccctccaacaattgggacctgtgattatgccatga

SEQ ID NO: 68532 - DNA, 38 bp, Artificial Sequence
  Synthetic oligonucleotide
gcccgcactccgctgaacaagcaacgctcccgttatga

SEQ ID NO: 68533 - DNA, 38 bp, Artificial Sequence
  Synthetic oligonucleotide
tccttaccaccgccgccctctcgctcgttcgcaactga

SEQ ID NO: 68534 - DNA, 38 bp, Artificial Sequence
  Synthetic oligonucleotide
tcacgtgcggtggactccgaacatccctttcccactga

SEQ ID NO: 68535 - DNA, 35 bp, Artificial Sequence
  Synthetic oligonucleotide
acttcatccctgtccgtcgacgcatcgagcactga

SEQ ID NO: 68536 - DNA, 36 bp, Artificial Sequence
  Synthetic oligonucleotide
aacccacatctgtacctcgcgtccacactctactga

SEQ ID NO: 68537 - DNA, 38 bp, Artificial Sequence
  Synthetic oligonucleotide
tcaggccctcacccttttgcgttatactcctgccctga

SEQ ID NO: 68538 - DNA, 38 bp, Artificial Sequence
  Synthetic oligonucleotide
ttcactgaatgcccgacgcgatatgcaatgttccctga

SEQ ID NO: 68539 - DNA, 37 bp, Artificial Sequence
  Synthetic oligonucleotide
ttagatccgctaccgttggctattacctacatcctga

SEQ ID NO: 68540 - DNA, 38 bp, Artificial Sequence
  Synthetic oligonucleotide
gcgccttctttgcgtcacctttcatattctgcctctga

SEQ ID NO: 68541 - DNA, 37 bp, Artificial Sequence
  Synthetic oligonucleotide
tcatggacagacgttacgtaaaaaaggcgcagagtga

SEQ ID NO: 68542 - DNA, 38 bp, Artificial Sequence
  Synthetic oligonucleotide
gagcgggtcgccgcgagtagttcttggggagagagtga

SEQ ID NO: 68543 - DNA, 38 bp, Artificial Sequence
  Synthetic oligonucleotide
ttgtgaggggagttggaactgagggctcgaaggagtga

SEQ ID NO: 68544 - DNA, 38 bp, Artificial Sequence
  Synthetic oligonucleotide
tggtcagggaatagggagggtagggcagcaataggtga

SEQ ID NO: 68545 - DNA, 37 bp, Artificial Sequence
  Synthetic oligonucleotide
tagcgaacaacagtatgatagcgggcggaaggggtga

SEQ ID NO: 68546 - DNA, 38 bp, Artificial Sequence
  Synthetic oligonucleotide
gacatggagtcacattggggcaaggggggggtgggtga

SEQ ID NO: 68547 - DNA, 38 bp, Artificial Sequence
  Synthetic oligonucleotide
atcaccgcaaccgggcgttgcttactcattcctggtga

SEQ ID NO: 68548 - DNA, 37 bp, Artificial Sequence
  Synthetic oligonucleotide
tgtggctcctcgacctcgttattgctcgctcctgtga

SEQ ID NO: 68549 - DNA, 38 bp, Artificial Sequence
  Synthetic oligonucleotide
taccacggcggactttgtttgcttcgtgttctcattga

SEQ ID NO: 68550 - DNA, 37 bp, Artificial Sequence
  Synthetic oligonucleotide
gcagactcggagggcgggggtagggatcgctacttga

SEQ ID NO: 68551 - DNA, 36 bp, Artificial Sequence
  Synthetic oligonucleotide
aacatcggtcgtagggggaggaggtcggtcgctata

SEQ ID NO: 68552 - DNA, 36 bp, Artificial Sequence
  Synthetic oligonucleotide
aacatgccaagcaggtccagccgcccaccgattata

SEQ ID NO: 68553 - DNA, 36 bp, Artificial Sequence
  Synthetic oligonucleotide
tcaacactcccttcgcaccccatatgatggaaacta

SEQ ID NO: 68554 - DNA, 35 bp, Artificial Sequence
  Synthetic oligonucleotide
gacgccggaaatctgggaccacctgaccctcgcta

SEQ ID NO: 68555 - DNA, 36 bp, Artificial Sequence
  Synthetic oligonucleotide
tgatagtggggtggggaaaaagtgcgcagttgtgta

SEQ ID NO: 68556 - DNA, 36 bp, Artificial Sequence
  Synthetic oligonucleotide
tgtaggtcatgacgctgctggcaccttctttttgta

SEQ ID NO: 68557 - DNA, 36 bp, Artificial Sequence
  Synthetic oligonucleotide
gtgccatcaccatataccatgtttctgcgagcttta

SEQ ID NO: 68558 - DNA, 36 bp, Artificial Sequence
  Synthetic oligonucleotide
gctcccatccgaagcttgaattgtcactacatttta

SEQ ID NO: 68559 - DNA, 35 bp, Artificial Sequence
  Synthetic oligonucleotide
gcaacccctttatgcgtagccccgactctatcaac

SEQ ID NO: 68560 - DNA, 35 bp, Artificial Sequence
  Synthetic oligonucleotide
tagccacacttcctgttctatacgatgtcacgaac

SEQ ID NO: 68561 - DNA, 35 bp, Artificial Sequence
  Synthetic oligonucleotide
gcgacgcctcggtcgaccccacctatatcacgcac

SEQ ID NO: 68562 - DNA, 35 bp, Artificial Sequence
  Synthetic oligonucleotide
gacgaacgaggtgcggataacacagaaggatgtac

SEQ ID NO: 68563 - DNA, 35 bp, Artificial Sequence
  Synthetic oligonucleotide
tcacgagcgtgtctctctgataagctgaaatcacc

SEQ ID NO: 68564 - DNA, 35 bp, Artificial Sequence
  Synthetic oligonucleotide
tcagtacgatccatctcacctcccgttcgagtacc

SEQ ID NO: 68565 - DNA, 35 bp, Artificial Sequence
  Synthetic oligonucleotide
tcgctccttgcgagtgttactcgttcttgctcccc

SEQ ID NO: 68566 - DNA, 35 bp, Artificial Sequence
  Synthetic oligonucleotide
tgtccctactccgcaacaattagttttcagccgcc

SEQ ID NO: 68567 - DNA, 35 bp, Artificial Sequence
  Synthetic oligonucleotide
tccaaccgggtttccttctatgccaactccgatcc

SEQ ID NO: 68568 - DNA, 35 bp, Artificial Sequence
  Synthetic oligonucleotide
gtgaaggcgctgtgttgcgtggtttagccccctcc

SEQ ID NO: 68569 - DNA, 35 bp, Artificial Sequence
  Synthetic oligonucleotide
gggatcctgcacacgcgtacgagtacccgtcttcc

SEQ ID NO: 68570 - DNA, 35 bp, Artificial Sequence
  Synthetic oligonucleotide
ttacatctccagccgcgttgacgctacgagtttcc

SEQ ID NO: 68571 - DNA, 35 bp, Artificial Sequence
  Synthetic oligonucleotide
atgacctctcttagtatctgacccgtgtccccggc

SEQ ID NO: 68572 - DNA, 35 bp, Artificial Sequence
  Synthetic oligonucleotide
atgcggaatcgcttcggagtcttgcccacgatatc

SEQ ID NO: 68573 - DNA, 35 bp, Artificial Sequence
  Synthetic oligonucleotide
tccaactatgtggccccttgtatgtctgtgctctc

SEQ ID NO: 68574 - DNA, 35 bp, Artificial Sequence
  Synthetic oligonucleotide
atgttgccagcgacggatccccttatggaagctgg

SEQ ID NO: 68575 - DNA, 35 bp, Artificial Sequence
  Synthetic oligonucleotide
acgaccgacccgccgctatttccgcaccttgtctg

SEQ ID NO: 68576 - DNA, 34 bp, Artificial Sequence
  Synthetic oligonucleotide
tgtttggacgttcatgcctctgtacccccttctg

SEQ ID NO: 68577 - DNA, 35 bp, Artificial Sequence
  Synthetic oligonucleotide
tcaaccggtatcatgcctacttatcacttgtcgtg

SEQ ID NO: 68578 - DNA, 35 bp, Artificial Sequence
  Synthetic oligonucleotide
tgtcgtgtcagtttcttcgaccacacatgttccat

SEQ ID NO: 68579 - DNA, 35 bp, Artificial Sequence
  Synthetic oligonucleotide
gacgccgatgtactaccgttactccaatgtaccct

SEQ ID NO: 68580 - DNA, 35 bp, Artificial Sequence
  Synthetic oligonucleotide
tatcgtaaggcgtggcaccaccatgatccctccct

SEQ ID NO: 68581 - DNA, 35 bp, Artificial Sequence
  Synthetic oligonucleotide
tcagtcgaacgggggcggagtttttgttagcggct

SEQ ID NO: 68582 - DNA, 35 bp, Artificial Sequence
  Synthetic oligonucleotide
actcactcgatataggtccggtaccacttcttgct

SEQ ID NO: 68583 - DNA, 35 bp, Artificial Sequence
  Synthetic oligonucleotide
aagtgcgtgggggtggtaagcggggagttgtccgt

SEQ ID NO: 68584 - DNA, 35 bp, Artificial Sequence
  Synthetic oligonucleotide
tataccgccctgtccgtacataacaccactcaatt

SEQ ID NO: 68585 - DNA, 35 bp, Artificial Sequence
  Synthetic oligonucleotide
gccgctagtacgcaactcgtaaatgccatcaactt

SEQ ID NO: 68586 - DNA, 35 bp, Artificial Sequence
  Synthetic oligonucleotide
acacactgtccgaaaatgtccacaggaccgaactt

SEQ ID NO: 68587 - DNA, 36 bp, Artificial Sequence
  Synthetic oligonucleotide
tgacgtccggaaatgcgcagtgataaacacctcctt

SEQ ID NO: 68588 - DNA, 35 bp, Artificial Sequence
  Synthetic oligonucleotide
gcccagacgcgagatacattccaatttgccccgtt

SEQ ID NO: 68589 - DNA, 35 bp, Artificial Sequence
  Synthetic oligonucleotide
cccacctgtcatgtgtacaccgcctctcgtttgtt

SEQ ID NO: 68590 - DNA, 35 bp, Artificial Sequence
  Synthetic oligonucleotide
gccacctctcgttccgattcttacgccggggattt

SEQ ID NO: 68591 - DNA, 35 bp, Artificial Sequence
  Synthetic oligonucleotide
tcacgcaccttgcgcaaagtcgcctcatcacgttt

SEQ ID NO: 68592 - DNA, 35 bp, Artificial Sequence
  Synthetic oligonucleotide
tctcaaccacgtttgttgcgacacaaacggtaaaa

SEQ ID NO: 68593 - DNA, 36 bp, Artificial Sequence
  Synthetic oligonucleotide
aagtgcgaaaggagggttcggcaactgtgggaccaa

SEQ ID NO: 68594 - DNA, 36 bp, Artificial Sequence
  Synthetic oligonucleotide
gtggtccctcgttgtttttttccgtgttgtctccaa

SEQ ID NO: 68595 - DNA, 36 bp, Artificial Sequence
  Synthetic oligonucleotide
gcagtgcacctcccgataaactgtggccttcatcaa

SEQ ID NO: 68596 - DNA, 36 bp, Artificial Sequence
  Synthetic oligonucleotide
gaagccggtgaccacacgtgtcaaactacacccgaa

SEQ ID NO: 68597 - DNA, 36 bp, Artificial Sequence
  Synthetic oligonucleotide
gtctcctgctcgagcacatacccacccagacaggaa

SEQ ID NO: 68598 - DNA, 36 bp, Artificial Sequence
  Synthetic oligonucleotide
ttgatagcggagggaagacatagggaggctcaggaa

SEQ ID NO: 68599 - DNA, 36 bp, Artificial Sequence
  Synthetic oligonucleotide
ggagggtggggcggatcagtgaaggagttattggaa

SEQ ID NO: 68600 - DNA, 36 bp, Artificial Sequence
  Synthetic oligonucleotide
gtccatatgacacgtcgtgccagatcgtcccagtaa

SEQ ID NO: 68601 - DNA, 36 bp, Artificial Sequence
  Synthetic oligonucleotide
accgccagacgctaaaactgtaaaatttgctcgtaa

SEQ ID NO: 68602 - DNA, 35 bp, Artificial Sequence
  Synthetic oligonucleotide
ttaggggaggggggggaataagggacattcataca

SEQ ID NO: 68603 - DNA, 35 bp, Artificial Sequence
  Synthetic oligonucleotide
tagcgggccctctagttcgcgaggtcttccctaca

SEQ ID NO: 68604 - DNA, 36 bp, Artificial Sequence
  Synthetic oligonucleotide
tcattgtgcccatgggtaccgtttagcctcgtgcca

SEQ ID NO: 68605 - DNA, 36 bp, Artificial Sequence
  Synthetic oligonucleotide
tcctgcgaactcaggacctatcctatctgcattcca

SEQ ID NO: 68606 - DNA, 35 bp, Artificial Sequence
  Synthetic oligonucleotide
tgcatgatcacctattacaccacattgtcctagca

SEQ ID NO: 68607 - DNA, 36 bp, Artificial Sequence
  Synthetic oligonucleotide
gttgtccccatgcgtccccagcgctctatcaacgca

SEQ ID NO: 68608 - DNA, 36 bp, Artificial Sequence
  Synthetic oligonucleotide
tctaccaccccttatgcattccatgtagttcacgca

SEQ ID NO: 68609 - DNA, 36 bp, Artificial Sequence
  Synthetic oligonucleotide
gaacatgaacgagggaggggcgtgagtgcgactgca

SEQ ID NO: 68610 - DNA, 36 bp, Artificial Sequence
  Synthetic oligonucleotide
gaactcgatgcaagtagccgcgtttgcactattgca

SEQ ID NO: 68611 - DNA, 36 bp, Artificial Sequence
  Synthetic oligonucleotide
gctgactcgctcgtcagattaccgaaaaccttgtca

SEQ ID NO: 68612 - DNA, 35 bp, Artificial Sequence
  Synthetic oligonucleotide
accaacctccgtctttcctttactgagtcttttca

SEQ ID NO: 68613 - DNA, 37 bp, Artificial Sequence
  Synthetic oligonucleotide
taccagctaaggaaggaattttaaaagggtgacaaga

SEQ ID NO: 68614 - DNA, 37 bp, Artificial Sequence
  Synthetic oligonucleotide
tagtcccgggtgggttgggggatgataccgagggaga

SEQ ID NO: 68615 - DNA, 37 bp, Artificial Sequence
  Synthetic oligonucleotide
gtctcaccgatcgacttcctgcctaccatctcctaga

SEQ ID NO: 68616 - DNA, 37 bp, Artificial Sequence
  Synthetic oligonucleotide
ttgaccacacatgggctctgacactgatagaaaacga

SEQ ID NO: 68617 - DNA, 37 bp, Artificial Sequence
  Synthetic oligonucleotide
tctgcatcccggctgcttccctcatgcgctttgacga

SEQ ID NO: 68618 - DNA, 37 bp, Artificial Sequence
  Synthetic oligonucleotide
tgtctccacgctgtaagtaactccctctcatcaccga

SEQ ID NO: 68619 - DNA, 35 bp, Artificial Sequence
  Synthetic oligonucleotide
tgcattgggtgggtaggagggtttgtgtgggccga

SEQ ID NO: 68620 - DNA, 37 bp, Artificial Sequence
  Synthetic oligonucleotide
taggtcccagtgctgctccgtacgcttactttgccga

SEQ ID NO: 68621 - DNA, 37 bp, Artificial Sequence
  Synthetic oligonucleotide
acactgtgcttctacgtgtcttcgccccatgatccga

SEQ ID NO: 68622 - DNA, 37 bp, Artificial Sequence
  Synthetic oligonucleotide
tccacatccaaaccagcctgtcaacactagcatgcga

SEQ ID NO: 68623 - DNA, 35 bp, Artificial Sequence
  Synthetic oligonucleotide
tcactccgcgagggatatatccggttctcaatcga

SEQ ID NO: 68624 - DNA, 37 bp, Artificial Sequence
  Synthetic oligonucleotide
aacgctccagttcatccccgcttagtatgccattcga

SEQ ID NO: 68625 - DNA, 36 bp, Artificial Sequence
  Synthetic oligonucleotide
tcgctcaccacatccttctattaagccagcattcga

SEQ ID NO: 68626 - DNA, 37 bp, Artificial Sequence
  Synthetic oligonucleotide
tagacgccgcattaaaaccgcctgtccccattaagga

SEQ ID NO: 68627 - DNA, 37 bp, Artificial Sequence
  Synthetic oligonucleotide
cgcgcacgtacggataagggggaggggtaggtgagga

SEQ ID NO: 68628 - DNA, 37 bp, Artificial Sequence
  Synthetic oligonucleotide
agtgtcgggtaacagggtgggtattccggggcacgga

SEQ ID NO: 68629 - DNA, 37 bp, Artificial Sequence
  Synthetic oligonucleotide
gaaggtagggaggacgggtggctcgagggttgacgga

SEQ ID NO: 68630 - DNA, 37 bp, Artificial Sequence
  Synthetic oligonucleotide
aatggtgcaaggggcagtcagggaggaggttcaggga

SEQ ID NO: 68631 - DNA, 37 bp, Artificial Sequence
  Synthetic oligonucleotide
gtatgcgcgatgggggtgccgcggggaataggaggga

SEQ ID NO: 68632 - DNA, 37 bp, Artificial Sequence
  Synthetic oligonucleotide
acagacagtcatcggatcgatggatgagggataggga

SEQ ID NO: 68633 - DNA, 37 bp, Artificial Sequence
  Synthetic oligonucleotide
actgatcgcgagggcgagatactgttgtaggggggga

SEQ ID NO: 68634 - DNA, 37 bp, Artificial Sequence
  Synthetic oligonucleotide
tcccgctaccaactattgtcactccactctctgggga

SEQ ID NO: 68635 - DNA, 33 bp, Artificial Sequence
  Synthetic oligonucleotide
tagtgctgcagctgcgttcgtgcgatgaatgga

SEQ ID NO: 68636 - DNA, 35 bp, Artificial Sequence
  Synthetic oligonucleotide
gaggggggatggcaactgggcaacggtagagtgga

SEQ ID NO: 68637 - DNA, 38 bp, Artificial Sequence
  Synthetic oligonucleotide
actggacgctcctgacccctgtattgcttcgatcatga

SEQ ID NO: 68638 - DNA, 38 bp, Artificial Sequence
  Synthetic oligonucleotide
tccatcgcagattgcccgccacggccgcccatttatga

SEQ ID NO: 68639 - DNA, 38 bp, Artificial Sequence
  Synthetic oligonucleotide
gacggtcgcccctccaacccgatcctggccttcactga

SEQ ID NO: 68640 - DNA, 37 bp, Artificial Sequence
  Synthetic oligonucleotide
acagggacgagggtgaggaaggtcagggtgcgactga

SEQ ID NO: 68641 - DNA, 38 bp, Artificial Sequence
  Synthetic oligonucleotide
tgcacttccggcccgcgcctaggcactatccaccctga

SEQ ID NO: 68642 - DNA, 36 bp, Artificial Sequence
  Synthetic oligonucleotide
gatcatacccgaaactgtgttacccatcgttcctga

SEQ ID NO: 68643 - DNA, 37 bp, Artificial Sequence
  Synthetic oligonucleotide
gactccatcatgtcaacccacgcttccgtcgagctga

SEQ ID NO: 68644 - DNA, 38 bp, Artificial Sequence
  Synthetic oligonucleotide
aacatcacggggtaaggagggaagaaagaatgtggtga

SEQ ID NO: 68645 - DNA, 38 bp, Artificial Sequence
  Synthetic oligonucleotide
gaaccgcatactctttcgcagccagcataacgttgtga

SEQ ID NO: 68646 - DNA, 37 bp, Artificial Sequence
  Synthetic oligonucleotide
tcacgccacgactacacccttcgaggcccatgattga

SEQ ID NO: 68647 - DNA, 37 bp, Artificial Sequence
  Synthetic oligonucleotide
gagaccagtcacatcggccacaaccactacttcttga

SEQ ID NO: 68648 - DNA, 36 bp, Artificial Sequence
  Synthetic oligonucleotide
tcctagctcttgagtgcttttcgctatactatttga

SEQ ID NO: 68649 - DNA, 35 bp, Artificial Sequence
  Synthetic oligonucleotide
gtcgaagcctgagctccccttcctgatctttaata

SEQ ID NO: 68650 - DNA, 36 bp, Artificial Sequence
  Synthetic oligonucleotide
ttgcatggccaggcgaattctagcacactaaacata

SEQ ID NO: 68651 - DNA, 35 bp, Artificial Sequence
  Synthetic oligonucleotide
tcaacaccaccctttgcactcatattgtcggacta

SEQ ID NO: 68652 - DNA, 35 bp, Artificial Sequence
  Synthetic oligonucleotide
agttcgcgtgccctcgcttgtcccagaccacccta

SEQ ID NO: 68653 - DNA, 36 bp, Artificial Sequence
  Synthetic oligonucleotide
ggtgtccaccgtcagcccagccccttgcagccccta

SEQ ID NO: 68654 - DNA, 36 bp, Artificial Sequence
  Synthetic oligonucleotide
tatacacctgggccaacccatccctgctatgtgcta

SEQ ID NO: 68655 - DNA, 36 bp, Artificial Sequence
  Synthetic oligonucleotide
tacatgctcgaacgtcccttatgcgcgcgtactcta

SEQ ID NO: 68656 - DNA, 36 bp, Artificial Sequence
  Synthetic oligonucleotide
gcccggttgtcaagatcgccctactcttctgccgta

SEQ ID NO: 68657 - DNA, 36 bp, Artificial Sequence
  Synthetic oligonucleotide
gtgtggggaacacggtggaaatagtgcacggcggta

SEQ ID NO: 68658 - DNA, 36 bp, Artificial Sequence
  Synthetic oligonucleotide
tcaacgacgcaaccttgcttaaacccctgttatgta

SEQ ID NO: 68659 - DNA, 36 bp, Artificial Sequence
  Synthetic oligonucleotide
ggcccccacgcctgtaattggtcctccacaccctta

SEQ ID NO: 68660 - DNA, 35 bp, Artificial Sequence
  Synthetic oligonucleotide
gaccccacttgcggccccaaactgccgatgcaaac

SEQ ID NO: 68661 - DNA, 35 bp, Artificial Sequence
  Synthetic oligonucleotide
acttgtccaatccctagcaccatcacgcgacacac

SEQ ID NO: 68662 - DNA, 35 bp, Artificial Sequence
  Synthetic oligonucleotide
gaaactcctacaatgctaatgctgggaccgcccac

SEQ ID NO: 68663 - DNA, 35 bp, Artificial Sequence
  Synthetic oligonucleotide
ttacgcctttccatggtcccgcccctccgacgcac

SEQ ID NO: 68664 - DNA, 35 bp, Artificial Sequence
  Synthetic oligonucleotide
attctgtgcaccgtgtcatctagatttcgtccacc

SEQ ID NO: 68665 - DNA, 35 bp, Artificial Sequence
  Synthetic oligonucleotide
tcctcgctccacttatgttcggccagtaatgaccc

SEQ ID NO: 68666 - DNA, 35 bp, Artificial Sequence
  Synthetic oligonucleotide
actcgccagccatcgtttgcaccgacccccacgcc

SEQ ID NO: 68667 - DNA, 35 bp, Artificial Sequence
  Synthetic oligonucleotide
tggagccagaataccccgcggccatccttcacgcc

SEQ ID NO: 68668 - DNA, 35 bp, Artificial Sequence
  Synthetic oligonucleotide
cacgctcctgtcacccctcgtacctattttgcgcc

SEQ ID NO: 68669 - DNA, 35 bp, Artificial Sequence
  Synthetic oligonucleotide
gacaatagaggaggggtacgaggcaacatggttcc

SEQ ID NO: 68670 - DNA, 35 bp, Artificial Sequence
  Synthetic oligonucleotide
tgtacattccgcttttcttataacccacgcgtggc

SEQ ID NO: 68671 - DNA, 35 bp, Artificial Sequence
  Synthetic oligonucleotide
tgccaccgtattatgagcttcctgtacataccatc

SEQ ID NO: 68672 - DNA, 35 bp, Artificial Sequence
  Synthetic oligonucleotide
gttcaacactatcttatattcgcggaattgccatc

SEQ ID NO: 68673 - DNA, 35 bp, Artificial Sequence
  Synthetic oligonucleotide
actgcgtggcgctcgctacctccccgtgattgatc

SEQ ID NO: 68674 - DNA, 35 bp, Artificial Sequence
  Synthetic oligonucleotide
atctctgcacctctactcctgactgggttagtgtc

SEQ ID NO: 68675 - DNA, 35 bp, Artificial Sequence
  Synthetic oligonucleotide
tttgatgccactgcaattacacccaagagattgtc

SEQ ID NO: 68676 - DNA, 35 bp, Artificial Sequence
  Synthetic oligonucleotide
atttgcgactcttgctggcctttcccttatcgttc

SEQ ID NO: 68677 - DNA, 35 bp, Artificial Sequence
  Synthetic oligonucleotide
agaccgcaatcattccgtttctatctgctgtagcg

SEQ ID NO: 68678 - DNA, 35 bp, Artificial Sequence
  Synthetic oligonucleotide
agaccctcggttcccgctaagtactccgtctctcg

SEQ ID NO: 68679 - DNA, 35 bp, Artificial Sequence
  Synthetic oligonucleotide
gctcaccagggggataaagaaaagtgagttaaatg

SEQ ID NO: 68680 - DNA, 35 bp, Artificial Sequence
  Synthetic oligonucleotide
tccccccactgcatcacagtgtagatctcatactg

SEQ ID NO: 68681 - DNA, 35 bp, Artificial Sequence
  Synthetic oligonucleotide
gacgcatgcgaggtggggttacagggggggtacat

SEQ ID NO: 68682 - DNA, 35 bp, Artificial Sequence
  Synthetic oligonucleotide
tccatcatgcctaccaggaagcctggttaacttat

SEQ ID NO: 68683 - DNA, 35 bp, Artificial Sequence
  Synthetic oligonucleotide
agagatgcaccctccatctcttagcctttgtacct

SEQ ID NO: 68684 - DNA, 35 bp, Artificial Sequence
  Synthetic oligonucleotide
acgactaccaaagctgaatattttacttgccccct

SEQ ID NO: 68685 - DNA, 35 bp, Artificial Sequence
  Synthetic oligonucleotide
tggtggcctcgtacctgaacacccagctccctcct

SEQ ID NO: 68686 - DNA, 30 bp, Artificial Sequence
  Synthetic oligonucleotide
tttcgcaatgcgagcccttctagtttttct

SEQ ID NO: 68687 - DNA, 35 bp, Artificial Sequence
  Synthetic oligonucleotide
tccaagtaccgccgcatttatgaaccatcctgagt

SEQ ID NO: 68688 - DNA, 35 bp, Artificial Sequence
  Synthetic oligonucleotide
actgtaggacacacttatatcacttcattcactgt

SEQ ID NO: 68689 - DNA, 35 bp, Artificial Sequence
  Synthetic oligonucleotide
gatagacggctggattgacgcaaggaacggtgatt

SEQ ID NO: 68690 - DNA, 35 bp, Artificial Sequence
  Synthetic oligonucleotide
acgacgcccgccgcatggtggctgggttctcactt

SEQ ID NO: 68691 - DNA, 35 bp, Artificial Sequence
  Synthetic oligonucleotide
tctgtcttggccgactcgttagttttaccctcctt

SEQ ID NO: 68692 - DNA, 35 bp, Artificial Sequence
  Synthetic oligonucleotide
actcctacgcgctgcagggcccaaaatatcctgtt

SEQ ID NO: 68693 - DNA, 35 bp, Artificial Sequence
  Synthetic oligonucleotide
atgcatgcactccgtatctacgtgacatttctgtt

SEQ ID NO: 68694 - DNA, 36 bp, Artificial Sequence
  Synthetic oligonucleotide
gagacgacggggagaatgagcgtgttagcaaaaaaa

SEQ ID NO: 68695 - DNA, 35 bp, Artificial Sequence
  Synthetic oligonucleotide
gcccagggtaggtagggccaaaaggttatgaaaaa

SEQ ID NO: 68696 - DNA, 36 bp, Artificial Sequence
  Synthetic oligonucleotide
gcctgggaccctgctgatacgatacctctgatacaa

SEQ ID NO: 68697 - DNA, 36 bp, Artificial Sequence
  Synthetic oligonucleotide
gatgcctcagggcatgtaaggcggggggtagtacaa

SEQ ID NO: 68698 - DNA, 36 bp, Artificial Sequence
  Synthetic oligonucleotide
acctgactgagccctgcacaccaccacaaactggaa

SEQ ID NO: 68699 - DNA, 36 bp, Artificial Sequence
  Synthetic oligonucleotide
agctgaaacaacacgaacgggaaaggggtggatgaa

SEQ ID NO: 68700 - DNA, 36 bp, Artificial Sequence
  Synthetic oligonucleotide
accccatttacgccgtccctatctgtcgccaagtaa

SEQ ID NO: 68701 - DNA, 35 bp, Artificial Sequence
  Synthetic oligonucleotide
tagaacccacacccgctctaataggatattgaaca

SEQ ID NO: 68702 - DNA, 36 bp, Artificial Sequence
  Synthetic oligonucleotide
tatgacagattgccactactgtatttttccatcaca

SEQ ID NO: 68703 - DNA, 36 bp, Artificial Sequence
  Synthetic oligonucleotide
tcctactccacccgttgatgttactctacaacacca

SEQ ID NO: 68704 - DNA, 35 bp, Artificial Sequence
  Synthetic oligonucleotide
ccctcgacgacgtaggagtaacactttcttgccca

SEQ ID NO: 68705 - DNA, 35 bp, Artificial Sequence
  Synthetic oligonucleotide
gaccccagtccggttgttcttgcctgcccctccca

SEQ ID NO: 68706 - DNA, 36 bp, Artificial Sequence
  Synthetic oligonucleotide
tagactgcagtggtggggaggtattaaagctgagca

SEQ ID NO: 68707 - DNA, 36 bp, Artificial Sequence
  Synthetic oligonucleotide
tggacaacgggtcggggcatggggaagagctgagca

SEQ ID NO: 68708 - DNA, 36 bp, Artificial Sequence
  Synthetic oligonucleotide
gtctcagcatccgcttacgctcccgacccgcatgca

SEQ ID NO: 68709 - DNA, 36 bp, Artificial Sequence
  Synthetic oligonucleotide
gtatcgttcagccaccacctgtttttattaccatca

SEQ ID NO: 68710 - DNA, 36 bp, Artificial Sequence
  Synthetic oligonucleotide
gttgggcccctgcctgcaaccgttctcacatcatca

SEQ ID NO: 68711 - DNA, 36 bp, Artificial Sequence
  Synthetic oligonucleotide
acttacctcccaggtctgaccctgtgccggttatca

SEQ ID NO: 68712 - DNA, 35 bp, Artificial Sequence
  Synthetic oligonucleotide
tacgtaatccagagttatagcacctcacttcctca

SEQ ID NO: 68713 - DNA, 36 bp, Artificial Sequence
  Synthetic oligonucleotide
tacatcctcgatcgtgaccatgcagttttggtgtca

SEQ ID NO: 68714 - DNA, 36 bp, Artificial Sequence
  Synthetic oligonucleotide
atgccttcttagacgcaccacccgaccagtcattca

SEQ ID NO: 68715 - DNA, 36 bp, Artificial Sequence
  Synthetic oligonucleotide
gccgcgatcacactattgaccaaagcactaacttca

SEQ ID NO: 68716 - DNA, 35 bp, Artificial Sequence
  Synthetic oligonucleotide
gctacctcactcgcaggcacatgaagcatctttca

SEQ ID NO: 68717 - DNA, 37 bp, Artificial Sequence
  Synthetic oligonucleotide
gcctctcccgatatataccatgcatcctgtttgcaga

SEQ ID NO: 68718 - DNA, 36 bp, Artificial Sequence
  Synthetic oligonucleotide
ggaaggcctccttctctacactcagtccacctgaga

SEQ ID NO: 68719 - DNA, 37 bp, Artificial Sequence
  Synthetic oligonucleotide
gccatccccctatgagattttggttcgtaccagtaga

SEQ ID NO: 68720 - DNA, 37 bp, Artificial Sequence
  Synthetic oligonucleotide
tcgcaaccccagatatttttgccccccttttaaacga

SEQ ID NO: 68721 - DNA, 37 bp, Artificial Sequence
  Synthetic oligonucleotide
ttgaactgccctccttattgattgggtaccctcacga

SEQ ID NO: 68722 - DNA, 37 bp, Artificial Sequence
  Synthetic oligonucleotide
tcgattggccacgctgcacacttccacctttctacga

SEQ ID NO: 68723 - DNA, 37 bp, Artificial Sequence
  Synthetic oligonucleotide
tgggcaaccaccgaattcgtccgacttccacaaccga

SEQ ID NO: 68724 - DNA, 36 bp, Artificial Sequence
  Synthetic oligonucleotide
aatgtaccgccaactcgacgactcccaggccaccga

SEQ ID NO: 68725 - DNA, 37 bp, Artificial Sequence
  Synthetic oligonucleotide
ttaggcccgcatcttcacgcttacttcgcctcaccga

SEQ ID NO: 68726 - DNA, 35 bp, Artificial Sequence
  Synthetic oligonucleotide
acatctaccccccaacatacgccctccacaggcga

SEQ ID NO: 68727 - DNA, 36 bp, Artificial Sequence
  Synthetic oligonucleotide
acgtagcatgatcggtagggaagggggaataggcga

SEQ ID NO: 68728 - DNA, 36 bp, Artificial Sequence
  Synthetic oligonucleotide
tggtcgtaggggggaataaaggaggtgaatcaagga

SEQ ID NO: 68729 - DNA, 35 bp, Artificial Sequence
  Synthetic oligonucleotide
atgccgatgtgggggtgtcgcggaagcaaggagga

SEQ ID NO: 68730 - DNA, 37 bp, Artificial Sequence
  Synthetic oligonucleotide
actccgctgatccgcatacgtgtcacgtacagccgga

SEQ ID NO: 68731 - DNA, 37 bp, Artificial Sequence
  Synthetic oligonucleotide
gactcaacgagttcgtgggcaggactagcgaggggga

SEQ ID NO: 68732 - DNA, 37 bp, Artificial Sequence
  Synthetic oligonucleotide
agtgggaacggcgtatatatcagggaaggatgatgga

SEQ ID NO: 68733 - DNA, 36 bp, Artificial Sequence
  Synthetic oligonucleotide
tacagaggaggaggggaaaatcttgatcctgatgga

SEQ ID NO: 68734 - DNA, 37 bp, Artificial Sequence
  Synthetic oligonucleotide
tgacctcctaccagtgagtcttgactctgttcttgga

SEQ ID NO: 68735 - DNA, 38 bp, Artificial Sequence
  Synthetic oligonucleotide
accattgtcgcgtaagccgacgccatcttgaccaatga

SEQ ID NO: 68736 - DNA, 38 bp, Artificial Sequence
  Synthetic oligonucleotide
catgggtagggtagggggggtgcgacactggaacatga

SEQ ID NO: 68737 - DNA, 38 bp, Artificial Sequence
  Synthetic oligonucleotide
attccctgctgtgcacctggtccaatctggctacatga

SEQ ID NO: 68738 - DNA, 37 bp, Artificial Sequence
  Synthetic oligonucleotide
gaagcaagtggagacaaggacgttaggcaagcgatga

SEQ ID NO: 68739 - DNA, 38 bp, Artificial Sequence
  Synthetic oligonucleotide
gcagtgagagaggcatcgaggctgggaaattgtgatga

SEQ ID NO: 68740 - DNA, 38 bp, Artificial Sequence
  Synthetic oligonucleotide
agaagcacggcctgagtgatgggggggcaacttgatga

SEQ ID NO: 68741 - DNA, 38 bp, Artificial Sequence
  Synthetic oligonucleotide
agcctccactaacgcaatccagccactgactactatga

SEQ ID NO: 68742 - DNA, 38 bp, Artificial Sequence
  Synthetic oligonucleotide
atcacaccgtcacggccaaaggaccgccctacgactga

SEQ ID NO: 68743 - DNA, 38 bp, Artificial Sequence
  Synthetic oligonucleotide
gattacctaccagcgtatgatcttttttctccacctga

SEQ ID NO: 68744 - DNA, 38 bp, Artificial Sequence
  Synthetic oligonucleotide
gcgatgacgcaagcggagccgccctttctccaccctga

SEQ ID NO: 68745 - DNA, 36 bp, Artificial Sequence
  Synthetic oligonucleotide
tagataccccgcctttcgtagtgctttatggcctga

SEQ ID NO: 68746 - DNA, 38 bp, Artificial Sequence
  Synthetic oligonucleotide
actgcacccgctttgccgcccggatcaaatcatcctga

SEQ ID NO: 68747 - DNA, 38 bp, Artificial Sequence
  Synthetic oligonucleotide
gtgaacgggcctcagtgggtgaagcgatgggtggctga

SEQ ID NO: 68748 - DNA, 36 bp, Artificial Sequence
  Synthetic oligonucleotide
accacccacgtcacaggtgggaaaaaataatgctga

SEQ ID NO: 68749 - DNA, 38 bp, Artificial Sequence
  Synthetic oligonucleotide
gcgactgagggaagaagtcataacacggggagaagtga

SEQ ID NO: 68750 - DNA, 38 bp, Artificial Sequence
  Synthetic oligonucleotide
gacctccatcacatcctttggaccactctggttagtga

SEQ ID NO: 68751 - DNA, 38 bp, Artificial Sequence
  Synthetic oligonucleotide
gccgaggcaccgtatttattatgcccatgctcacgtga

SEQ ID NO: 68752 - DNA, 38 bp, Artificial Sequence
  Synthetic oligonucleotide
gcacgcaccgagtgtaagtagtggagttggaagggtga

SEQ ID NO: 68753 - DNA, 38 bp, Artificial Sequence
  Synthetic oligonucleotide
gaccgatccattatatcatgcgccaatcctgctattga

SEQ ID NO: 68754 - DNA, 38 bp, Artificial Sequence
  Synthetic oligonucleotide
gtacgtgcgcatagtggactcgggggtagggaacttga

SEQ ID NO: 68755 - DNA, 38 bp, Artificial Sequence
  Synthetic oligonucleotide
gccaatcagcgaaccaaccgacttgaaccccgccttga

SEQ ID NO: 68756 - DNA, 38 bp, Artificial Sequence
  Synthetic oligonucleotide
gttcctcggcgcctgtagcacatttgccacctccttga

SEQ ID NO: 68757 - DNA, 37 bp, Artificial Sequence
  Synthetic oligonucleotide
tgcggggggagatagcgggttgggcttgagatcttga

SEQ ID NO: 68758 - DNA, 38 bp, Artificial Sequence
  Synthetic oligonucleotide
gtgaagacccccccatgctgtctttgccatattcttga

SEQ ID NO: 68759 - DNA, 36 bp, Artificial Sequence
  Synthetic oligonucleotide
attgcgggggaaggaatgcgtaaagggggctgttga

SEQ ID NO: 68760 - DNA, 36 bp, Artificial Sequence
  Synthetic oligonucleotide
ttccgaccgacaacgctttactcgtgcctcacaata

SEQ ID NO: 68761 - DNA, 35 bp, Artificial Sequence
  Synthetic oligonucleotide
tcctcagtgaacacgtctctgcttactcgccaata

SEQ ID NO: 68762 - DNA, 36 bp, Artificial Sequence
  Synthetic oligonucleotide
gaagacgggtggctcggggtggggcatgtggcaata

SEQ ID NO: 68763 - DNA, 36 bp, Artificial Sequence
  Synthetic oligonucleotide
tccgtcgtctcaggcttcggctccatccacttaata

SEQ ID NO: 68764 - DNA, 35 bp, Artificial Sequence
  Synthetic oligonucleotide
gccccgggctggtgacgggtgggtgggtattcata

SEQ ID NO: 68765 - DNA, 36 bp, Artificial Sequence
  Synthetic oligonucleotide
attcgtgtacccttgacctgcccccgagacacgata

SEQ ID NO: 68766 - DNA, 36 bp, Artificial Sequence
  Synthetic oligonucleotide
gagtggtggagtggatttaagtgctaatgagggata

SEQ ID NO: 68767 - DNA, 36 bp, Artificial Sequence
  Synthetic oligonucleotide
tcgaactaccttcatcatcgcgagctttagcgacta

SEQ ID NO: 68768 - DNA, 36 bp, Artificial Sequence
  Synthetic oligonucleotide
tataggcactgcacctgcggacttagcacccatcta

SEQ ID NO: 68769 - DNA, 36 bp, Artificial Sequence
  Synthetic oligonucleotide
tcgcatcactgcaaccccgcgccatgccgacttcta

SEQ ID NO: 68770 - DNA, 36 bp, Artificial Sequence
  Synthetic oligonucleotide
gcatacctaaggccaaggaaggagcacatccacgta

SEQ ID NO: 68771 - DNA, 36 bp, Artificial Sequence
  Synthetic oligonucleotide
gagtcacaaggaaggcgatcttggggcattagggta

SEQ ID NO: 68772 - DNA, 36 bp, Artificial Sequence
  Synthetic oligonucleotide
acaccgcgcctatattatcgatgcgtgttacgctta

SEQ ID NO: 68773 - DNA, 36 bp, Artificial Sequence
  Synthetic oligonucleotide
acacctcctccgctctcgtggcctcgacccctctta

SEQ ID NO: 68774 - DNA, 35 bp, Artificial Sequence
  Synthetic oligonucleotide
tgtgaaccaccatgcccgtaccggtattcgcgaac

SEQ ID NO: 68775 - DNA, 36 bp, Artificial Sequence
  Synthetic oligonucleotide
tcgcatgcttaagctccatgtgaccgtcgctcccac

SEQ ID NO: 68776 - DNA, 35 bp, Artificial Sequence
  Synthetic oligonucleotide
ttgacaccccgccgtcaaggccaatccatcaatcc

SEQ ID NO: 68777 - DNA, 35 bp, Artificial Sequence
  Synthetic oligonucleotide
aacagcctttcaagcggtcgtcctctctctcatcc

SEQ ID NO: 68778 - DNA, 35 bp, Artificial Sequence
  Synthetic oligonucleotide
aaggagtgctccctctgcgtaatgcgtacgtctcc

SEQ ID NO: 68779 - DNA, 35 bp, Artificial Sequence
  Synthetic oligonucleotide
tcccactcactgctctctgtttcccctgttagtcc

SEQ ID NO: 68780 - DNA, 35 bp, Artificial Sequence
  Synthetic oligonucleotide
gtaccggccccaggtaccatctgcattgcccgagc

SEQ ID NO: 68781 - DNA, 35 bp, Artificial Sequence
  Synthetic oligonucleotide
tgcatggtccacttaacgaaatcaactcttgtagc

SEQ ID NO: 68782 - DNA, 35 bp, Artificial Sequence
  Synthetic oligonucleotide
gtactacacccttgtgccgggttcgacctcctggc

SEQ ID NO: 68783 - DNA, 35 bp, Artificial Sequence
  Synthetic oligonucleotide
atcattggcgcttcaatctatctgcccaactgtgc

SEQ ID NO: 68784 - DNA, 35 bp, Artificial Sequence
  Synthetic oligonucleotide
gtgccctgcacgcatgccgtatacccgttcccatc

SEQ ID NO: 68785 - DNA, 35 bp, Artificial Sequence
  Synthetic oligonucleotide
tgcgcatcccgacgctggctcattaaccctccatc

SEQ ID NO: 68786 - DNA, 35 bp, Artificial Sequence
  Synthetic oligonucleotide
accactccgccttatgtttactgagcgctcgcttc

SEQ ID NO: 68787 - DNA, 35 bp, Artificial Sequence
  Synthetic oligonucleotide
atgtccgtgcacatggtgactcataggtggtcttc

SEQ ID NO: 68788 - DNA, 35 bp, Artificial Sequence
  Synthetic oligonucleotide
ttggctcaacccgctcgctattatctacagctcag

SEQ ID NO: 68789 - DNA, 35 bp, Artificial Sequence
  Synthetic oligonucleotide
gtgcgacgtaccactgaatttttacttaccatccg

SEQ ID NO: 68790 - DNA, 35 bp, Artificial Sequence
  Synthetic oligonucleotide
tcgaccccgcccacacccgttacatcaactgttcg

SEQ ID NO: 68791 - DNA, 35 bp, Artificial Sequence
  Synthetic oligonucleotide
aatggggaccgaggagcataggtacatggaggagg

SEQ ID NO: 68792 - DNA, 35 bp, Artificial Sequence
  Synthetic oligonucleotide
gcacacgtactaccgtgatgaagggctagtagcgg

SEQ ID NO: 68793 - DNA, 35 bp, Artificial Sequence
  Synthetic oligonucleotide
ggttggccccgtactatactctgttactcaggatg

SEQ ID NO: 68794 - DNA, 35 bp, Artificial Sequence
  Synthetic oligonucleotide
atgtagaggagggggagtgaacgacgctttgtatg

SEQ ID NO: 68795 - DNA, 35 bp, Artificial Sequence
  Synthetic oligonucleotide
gcgattaccaacggttcatttaagactaccctctg

SEQ ID NO: 68796 - DNA, 35 bp, Artificial Sequence
  Synthetic oligonucleotide
tgtgagaccggcgtctatactggcacatactccat

SEQ ID NO: 68797 - DNA, 35 bp, Artificial Sequence
  Synthetic oligonucleotide
ttcgccgtgtcccaacttcttgccccgagcatcat

SEQ ID NO: 68798 - DNA, 35 bp, Artificial Sequence
  Synthetic oligonucleotide
tgcagacctctctcctccgtcataggaacatgtct

SEQ ID NO: 68799 - DNA, 35 bp, Artificial Sequence
  Synthetic oligonucleotide
taaaagaccaagtctggcacccccgttcccacagt

SEQ ID NO: 68800 - DNA, 35 bp, Artificial Sequence
  Synthetic oligonucleotide
tagcacgaacgggcgctttctcaacactggtatgt

SEQ ID NO: 68801 - DNA, 35 bp, Artificial Sequence
  Synthetic oligonucleotide
tctgacccaccatccaaggcccgagttgatcttgt

SEQ ID NO: 68802 - DNA, 35 bp, Artificial Sequence
  Synthetic oligonucleotide
acctgcggtgaagcgttcgtgcaggttatcttctt

SEQ ID NO: 68803 - DNA, 35 bp, Artificial Sequence
  Synthetic oligonucleotide
gctcctcccagctgtacacccatttctaacaagtt

SEQ ID NO: 68804 - DNA, 35 bp, Artificial Sequence
  Synthetic oligonucleotide
aatggctggtggccgagatatttgcgtctcccttt

SEQ ID NO: 68805 - DNA, 35 bp, Artificial Sequence
  Synthetic oligonucleotide
tcacggcttccgcttcatcgtctgtttttcggttt

SEQ ID NO: 68806 - DNA, 36 bp, Artificial Sequence
  Synthetic oligonucleotide
tgtacgcacgagcatacatcaatcacggtatgaaaa

SEQ ID NO: 68807 - DNA, 36 bp, Artificial Sequence
  Synthetic oligonucleotide
gtgcggaattatggcgtggtgggtggcatgatcaaa

SEQ ID NO: 68808 - DNA, 36 bp, Artificial Sequence
  Synthetic oligonucleotide
gcctgtccatctggtcctcgccatgtcccctgtaaa

SEQ ID NO: 68809 - DNA, 35 bp, Artificial Sequence
  Synthetic oligonucleotide
tgccttttggcctgtcacaacttccccaccgccaa

SEQ ID NO: 68810 - DNA, 36 bp, Artificial Sequence
  Synthetic oligonucleotide
gacgacgactcccgccagttatcattagtttcgcaa

SEQ ID NO: 68811 - DNA, 36 bp, Artificial Sequence
  Synthetic oligonucleotide
ggacaggaaaaaagggggaatgtgacattggggcaa

SEQ ID NO: 68812 - DNA, 36 bp, Artificial Sequence
  Synthetic oligonucleotide
acatccccttaaatcgcattcatttagacctgtaca

SEQ ID NO: 68813 - DNA, 36 bp, Artificial Sequence
  Synthetic oligonucleotide
atcactaccgcttagacgggacaccctgtggttaca

SEQ ID NO: 68814 - DNA, 36 bp, Artificial Sequence
  Synthetic oligonucleotide
tgtggttcgcttcttgttgcccgtacgtccagtcca

SEQ ID NO: 68815 - DNA, 36 bp, Artificial Sequence
  Synthetic oligonucleotide
accgtaacatacagcccttgtaattgttcatttcca

SEQ ID NO: 68816 - DNA, 36 bp, Artificial Sequence
  Synthetic oligonucleotide
ttagccccccaggcctcgttgttctatccgggagca

SEQ ID NO: 68817 - DNA, 36 bp, Artificial Sequence
  Synthetic oligonucleotide
atcacactcgacaccgggtgtctatcctcaaaatca

SEQ ID NO: 68818 - DNA, 36 bp, Artificial Sequence
  Synthetic oligonucleotide
aacagtctgcgattcgagtcaccttccgctccatca

SEQ ID NO: 68819 - DNA, 36 bp, Artificial Sequence
  Synthetic oligonucleotide
taagggcacgggcccccgcagttctaaaccacttca

SEQ ID NO: 68820 - DNA, 37 bp, Artificial Sequence
  Synthetic oligonucleotide
gccacgctaccgtggccttctgttcgcctttgcgaga

SEQ ID NO: 68821 - DNA, 37 bp, Artificial Sequence
  Synthetic oligonucleotide
atggtacagggtgggggtataacagcacgattaacga

SEQ ID NO: 68822 - DNA, 37 bp, Artificial Sequence
  Synthetic oligonucleotide
atatctctgcacacctgcttatacgaccttcacacga

SEQ ID NO: 68823 - DNA, 37 bp, Artificial Sequence
  Synthetic oligonucleotide
gatggcccttggccagcaaccttttactctccgacga

SEQ ID NO: 68824 - DNA, 36 bp, Artificial Sequence
  Synthetic oligonucleotide
tgcactatcaggcactgttagatctgctttccccga

SEQ ID NO: 68825 - DNA, 38 bp, Artificial Sequence
  Synthetic oligonucleotide
gtccacccatctggccaacaagtaagggcttttcccga

SEQ ID NO: 68826 - DNA, 37 bp, Artificial Sequence
  Synthetic oligonucleotide
agtctagccccatcgtcgtacccgcgagcctttccga

SEQ ID NO: 68827 - DNA, 37 bp, Artificial Sequence
  Synthetic oligonucleotide
gcttgtccgatagctgcacacccacctggcctctcga

SEQ ID NO: 68828 - DNA, 36 bp, Artificial Sequence
  Synthetic oligonucleotide
tagctccacagacgcacacaccgatatcctagtcga

SEQ ID NO: 68829 - DNA, 36 bp, Artificial Sequence
  Synthetic oligonucleotide
actgcctacagcagtagggggggagtgccatgagga

SEQ ID NO: 68830 - DNA, 37 bp, Artificial Sequence
  Synthetic oligonucleotide
aacgcaagtagggggatgaagaagtttcgcagtagga

SEQ ID NO: 68831 - DNA, 37 bp, Artificial Sequence
  Synthetic oligonucleotide
acactcacccctgatcggtgttacggccccccccgga

SEQ ID NO: 68832 - DNA, 37 bp, Artificial Sequence
  Synthetic oligonucleotide
tctgaaaggaacacggaggagcatagacgagagggga

SEQ ID NO: 68833 - DNA, 37 bp, Artificial Sequence
  Synthetic oligonucleotide
atttcgtgcccctgttgccatccgtcccttttgggga

SEQ ID NO: 68834 - DNA, 37 bp, Artificial Sequence
  Synthetic oligonucleotide
tcaggtcaagcaattttaggggtgcgcatggttggga

SEQ ID NO: 68835 - DNA, 37 bp, Artificial Sequence
  Synthetic oligonucleotide
aacaagttggggaggtaggatgagacgggtgcgtgga

SEQ ID NO: 68836 - DNA, 37 bp, Artificial Sequence
  Synthetic oligonucleotide
gatggggcgatagtatgcaaatggggggacagactga

SEQ ID NO: 68837 - DNA, 38 bp, Artificial Sequence
  Synthetic oligonucleotide
gaacacgctcccagcaccctcatcgccgcgccccctga

SEQ ID NO: 68838 - DNA, 38 bp, Artificial Sequence
  Synthetic oligonucleotide
tctgcaagccagtgcgttcccgtccgcctctcccctga

SEQ ID NO: 68839 - DNA, 38 bp, Artificial Sequence
  Synthetic oligonucleotide
tactgggccgtcataacctgctctctccggaatcctga

SEQ ID NO: 68840 - DNA, 38 bp, Artificial Sequence
  Synthetic oligonucleotide
aacgcaaccatctcttaacttgcccgcccacccagtga

SEQ ID NO: 68841 - DNA, 38 bp, Artificial Sequence
  Synthetic oligonucleotide
atgtcctacgcgcacatgtctgacctggttccgagtga

SEQ ID NO: 68842 - DNA, 38 bp, Artificial Sequence
  Synthetic oligonucleotide
ggtgggaggaaacgagataaagaagggtagcaccgtga

SEQ ID NO: 68843 - DNA, 37 bp, Artificial Sequence
  Synthetic oligonucleotide
atgtcactgcggacctgtcaacctgataccctcgtga

SEQ ID NO: 68844 - DNA, 38 bp, Artificial Sequence
  Synthetic oligonucleotide
gtgggggtagggtccggcgagggtgggaattgtggtga

SEQ ID NO: 68845 - DNA, 37 bp, Artificial Sequence
  Synthetic oligonucleotide
tactcgccgtggtgcacgcccttttctgtacatgtga

SEQ ID NO: 68846 - DNA, 38 bp, Artificial Sequence
  Synthetic oligonucleotide
tcaaaccacgagctgagcaaccgagtcactctctgtga

SEQ ID NO: 68847 - DNA, 37 bp, Artificial Sequence
  Synthetic oligonucleotide
gcgtaccactgactcgtaccgatctatcatacattga

SEQ ID NO: 68848 - DNA, 36 bp, Artificial Sequence
  Synthetic oligonucleotide
tataacccccggtggaaactcactgaccagtattga

SEQ ID NO: 68849 - DNA, 38 bp, Artificial Sequence
  Synthetic oligonucleotide
gcccacacttcttttccgtctttgaacgttgaccttga

SEQ ID NO: 68850 - DNA, 38 bp, Artificial Sequence
  Synthetic oligonucleotide
atcaccccgattgagattattcgccctgcacttcttga

SEQ ID NO: 68851 - DNA, 37 bp, Artificial Sequence
  Synthetic oligonucleotide
gacgcggagactgggggatgggaaggcagttatttga

SEQ ID NO: 68852 - DNA, 37 bp, Artificial Sequence
  Synthetic oligonucleotide
tctgtgactcaattcctgccaggtactgtttctttga

SEQ ID NO: 68853 - DNA, 38 bp, Artificial Sequence
  Synthetic oligonucleotide
ttagcgtgcatgctccccgtggctgttttctggtttga

SEQ ID NO: 68854 - DNA, 35 bp, Artificial Sequence
  Synthetic oligonucleotide
gccccacgacgctttgcattgctaaactggctata

SEQ ID NO: 68855 - DNA, 36 bp, Artificial Sequence
  Synthetic oligonucleotide
gcgaagccctatgtcgtggtcggaattttctcacta

SEQ ID NO: 68856 - DNA, 36 bp, Artificial Sequence
  Synthetic oligonucleotide
attcactcgaacgtttagtcgtcattcctttgccta

SEQ ID NO: 68857 - DNA, 36 bp, Artificial Sequence
  Synthetic oligonucleotide
gtgaaggcaaggggggagttgtagtcagtggatgta

SEQ ID NO: 68858 - DNA, 36 bp, Artificial Sequence
  Synthetic oligonucleotide
gtgatagaatcggggagggaacggggcaggagatta

SEQ ID NO: 68859 - DNA, 35 bp, Artificial Sequence
  Synthetic oligonucleotide
acgctcaggtctacacattgtccgtagtttgccac

SEQ ID NO: 68860 - DNA, 35 bp, Artificial Sequence
  Synthetic oligonucleotide
gtgccatccacgccaattccaagacagcaccgcac

SEQ ID NO: 68861 - DNA, 35 bp, Artificial Sequence
  Synthetic oligonucleotide
gacttgtcggccctatcctggagtccacgctcgac

SEQ ID NO: 68862 - DNA, 35 bp, Artificial Sequence
  Synthetic oligonucleotide
gtttcgccgagtacccgtggcccgttcgaatctac

SEQ ID NO: 68863 - DNA, 35 bp, Artificial Sequence
  Synthetic oligonucleotide
tagacgctggcgccattccctgtcatgactagtac

SEQ ID NO: 68864 - DNA, 35 bp, Artificial Sequence
  Synthetic oligonucleotide
agatgccatccccgttggggcgaccgccgctcccc

SEQ ID NO: 68865 - DNA, 35 bp, Artificial Sequence
  Synthetic oligonucleotide
aaaccgcgtagccacgcctattatatccccgggcc

SEQ ID NO: 68866 - DNA, 35 bp, Artificial Sequence
  Synthetic oligonucleotide
gcgcaaggctacggcatacatttttggttttctcc

SEQ ID NO: 68867 - DNA, 35 bp, Artificial Sequence
  Synthetic oligonucleotide
tgccccactgcgctttaacaagagcctatagacgc

SEQ ID NO: 68868 - DNA, 35 bp, Artificial Sequence
  Synthetic oligonucleotide
gtgccgttgatttcctccgcatcttatttgcccgc

SEQ ID NO: 68869 - DNA, 35 bp, Artificial Sequence
  Synthetic oligonucleotide
agccaagcatcgtttctatgctgctctgaactcgc

SEQ ID NO: 68870 - DNA, 33 bp, Artificial Sequence
  Synthetic oligonucleotide
tacacgtgcagtccctaacggatagtcctaggc

SEQ ID NO: 68871 - DNA, 35 bp, Artificial Sequence
  Synthetic oligonucleotide
tcaatcgcgacgaggtatgcaatgtaagcccatgc

SEQ ID NO: 68872 - DNA, 35 bp, Artificial Sequence
  Synthetic oligonucleotide
gttgtacccaatcgcattccacgtcgaacgactgc

SEQ ID NO: 68873 - DNA, 35 bp, Artificial Sequence
  Synthetic oligonucleotide
gctgtagccccacctgaaagcggtcaaaggccatc

SEQ ID NO: 68874 - DNA, 35 bp, Artificial Sequence
  Synthetic oligonucleotide
gtcatcgatacacatcccacgtgttgtcgttcctc

SEQ ID NO: 68875 - DNA, 35 bp, Artificial Sequence
  Synthetic oligonucleotide
tccttgagagcctactgcatcgttccttccccttc

SEQ ID NO: 68876 - DNA, 35 bp, Artificial Sequence
  Synthetic oligonucleotide
gctacggtcggggaagaataaagtaagatcggaag

SEQ ID NO: 68877 - DNA, 35 bp, Artificial Sequence
  Synthetic oligonucleotide
gcctgtatcggttagccctttcgttcgctctctag

SEQ ID NO: 68878 - DNA, 35 bp, Artificial Sequence
  Synthetic oligonucleotide
ggtcatagggaggagagagggacagttggaacacg

SEQ ID NO: 68879 - DNA, 35 bp, Artificial Sequence
  Synthetic oligonucleotide
tccgaacaagcaaaactttgggaaacagggggacg

SEQ ID NO: 68880 - DNA, 35 bp, Artificial Sequence
  Synthetic oligonucleotide
tccatgccacataccctccccctggtcgtttctcg

SEQ ID NO: 68881 - DNA, 35 bp, Artificial Sequence
  Synthetic oligonucleotide
gacctggagtcgggtgggaagggggggaggcgagg

SEQ ID NO: 68882 - DNA, 35 bp, Artificial Sequence
  Synthetic oligonucleotide
agtgggagaatgcagtgatgttacgagggatcggg

SEQ ID NO: 68883 - DNA, 35 bp, Artificial Sequence
  Synthetic oligonucleotide
gcgtcgtacatgctatacttccactcctatcctgg

SEQ ID NO: 68884 - DNA, 35 bp, Artificial Sequence
  Synthetic oligonucleotide
accccgatacctcagctaccaaaccgccataggtg

SEQ ID NO: 68885 - DNA, 35 bp, Artificial Sequence
  Synthetic oligonucleotide
actcagcaccgaaccatatcaattctaccccgttg

SEQ ID NO: 68886 - DNA, 35 bp, Artificial Sequence
  Synthetic oligonucleotide
gtgcttaccactcattgaagtcgcgaaactcccat

SEQ ID NO: 68887 - DNA, 35 bp, Artificial Sequence
  Synthetic oligonucleotide
aacaggtacaagtcggttaaatgtaggaacggcat

SEQ ID NO: 68888 - DNA, 35 bp, Artificial Sequence
  Synthetic oligonucleotide
gaagggggacggagaggccggtaaatgcccaagat

SEQ ID NO: 68889 - DNA, 35 bp, Artificial Sequence
  Synthetic oligonucleotide
tccacgggtggtgtacgtgtttgtgagtgttggat

SEQ ID NO: 68890 - DNA, 35 bp, Artificial Sequence
  Synthetic oligonucleotide
tcgtctataggcactctgtcacccccgtccgcact

SEQ ID NO: 68891 - DNA, 35 bp, Artificial Sequence
  Synthetic oligonucleotide
cacgcctctacctgtctcaactgcgccgccgccct

SEQ ID NO: 68892 - DNA, 35 bp, Artificial Sequence
  Synthetic oligonucleotide
ttgctgaaggggcctcgactgttttccgttattct

SEQ ID NO: 68893 - DNA, 35 bp, Artificial Sequence
  Synthetic oligonucleotide
aacactgccttgtgtcgttttgacgccctacttct

SEQ ID NO: 68894 - DNA, 35 bp, Artificial Sequence
  Synthetic oligonucleotide
acaatcaacgcaccgaagtaccctgcggtaccggt

SEQ ID NO: 68895 - DNA, 35 bp, Artificial Sequence
  Synthetic oligonucleotide
acacgctccgttaacatcaccgctctgctcggggt

SEQ ID NO: 68896 - DNA, 35 bp, Artificial Sequence
  Synthetic oligonucleotide
tacaactcccgcctcccctggctctagccacatgt

SEQ ID NO: 68897 - DNA, 35 bp, Artificial Sequence
  Synthetic oligonucleotide
ttggactaccgctgacccgttctacagtaagtctt

SEQ ID NO: 68898 - DNA, 35 bp, Artificial Sequence
  Synthetic oligonucleotide
tgcccggtgagccgtagcttgcctgtatctttctt

SEQ ID NO: 68899 - DNA, 35 bp, Artificial Sequence
  Synthetic oligonucleotide
aaggggcctccgcgaaagtaagcaggggaagggtt

SEQ ID NO: 68900 - DNA, 36 bp, Artificial Sequence
  Synthetic oligonucleotide
gcctgggggggctgacatctgggagggccagtgaaa

SEQ ID NO: 68901 - DNA, 36 bp, Artificial Sequence
  Synthetic oligonucleotide
ggaccgtcacgcgaccaaagccacgtctcccctaaa

SEQ ID NO: 68902 - DNA, 36 bp, Artificial Sequence
  Synthetic oligonucleotide
tgcgcaccaaccgggctattgaatatccttacgtaa

SEQ ID NO: 68903 - DNA, 36 bp, Artificial Sequence
  Synthetic oligonucleotide
atcccacgcaaggctgccctctctcgacgaatttaa

SEQ ID NO: 68904 - DNA, 35 bp, Artificial Sequence
  Synthetic oligonucleotide
gccaacatttaacctctcgccgcacctgaagcaca

SEQ ID NO: 68905 - DNA, 35 bp, Artificial Sequence
  Synthetic oligonucleotide
gccacaatccaacaccgactggagaaatacgcaca

SEQ ID NO: 68906 - DNA, 36 bp, Artificial Sequence
  Synthetic oligonucleotide
tcgttcgtgccaccttccatccgctacagtaagaca

SEQ ID NO: 68907 - DNA, 36 bp, Artificial Sequence
  Synthetic oligonucleotide
agcgccgcccacttctcagcccagcaaccggtgaca

SEQ ID NO: 68908 - DNA, 36 bp, Artificial Sequence
  Synthetic oligonucleotide
tcacatcctcttacaatgtttcacctcatgagtaca

SEQ ID NO: 68909 - DNA, 35 bp, Artificial Sequence
  Synthetic oligonucleotide
gcatcgaagcctgcctcatgccgcaccggtgtaca

SEQ ID NO: 68910 - DNA, 36 bp, Artificial Sequence
  Synthetic oligonucleotide
gtccccaatctcacgatcgtttaccaaggcgcacca

SEQ ID NO: 68911 - DNA, 36 bp, Artificial Sequence
  Synthetic oligonucleotide
tgcaccttttcgcagtcccacattgctcgattccca

SEQ ID NO: 68912 - DNA, 36 bp, Artificial Sequence
  Synthetic oligonucleotide
acacacaggtggcgtgcataagtggcgtgttaggca

SEQ ID NO: 68913 - DNA, 36 bp, Artificial Sequence
  Synthetic oligonucleotide
ttgcgccgtgctgccaacctctcttcgcggagctca

SEQ ID NO: 68914 - DNA, 36 bp, Artificial Sequence
  Synthetic oligonucleotide
gtacccccagcttagttttacccgccacctcattca

SEQ ID NO: 68915 - DNA, 37 bp, Artificial Sequence
  Synthetic oligonucleotide
ttatgtgacgggcatggtgaaaggagcagaaataaga

SEQ ID NO: 68916 - DNA, 37 bp, Artificial Sequence
  Synthetic oligonucleotide
aggatgtgagcagggggggtgcaggtggagagagaga

SEQ ID NO: 68917 - DNA, 37 bp, Artificial Sequence
  Synthetic oligonucleotide
aggaacgggagggggattgagtagagtggcacgtaga

SEQ ID NO: 68918 - DNA, 37 bp, Artificial Sequence
  Synthetic oligonucleotide
gtcgcaacaacattctgtgcctatctgcatttcacga

SEQ ID NO: 68919 - DNA, 37 bp, Artificial Sequence
  Synthetic oligonucleotide
tgcaacgaagcgagcaccctcttctatcccacgacga

SEQ ID NO: 68920 - DNA, 37 bp, Artificial Sequence
  Synthetic oligonucleotide
gatcaacgagcttgtagcggggccctttcatgtacga

SEQ ID NO: 68921 - DNA, 37 bp, Artificial Sequence
  Synthetic oligonucleotide
gccatcgcacgccctcaacccagtatgacccttacga

SEQ ID NO: 68922 - DNA, 37 bp, Artificial Sequence
  Synthetic oligonucleotide
tgcggacggcaaaatcctatctgatcctgctaaccga

SEQ ID NO: 68923 - DNA, 37 bp, Artificial Sequence
  Synthetic oligonucleotide
tcttcctgccagccttcgtccacctcgcatgtcccga

SEQ ID NO: 68924 - DNA, 37 bp, Artificial Sequence
  Synthetic oligonucleotide
tccttgcactgtattgttccttccgtctgtcagccga

SEQ ID NO: 68925 - DNA, 37 bp, Artificial Sequence
  Synthetic oligonucleotide
aacgcaaatcagcgagtcttggcccactgcactccga

SEQ ID NO: 68926 - DNA, 37 bp, Artificial Sequence
  Synthetic oligonucleotide
gtcccacaatacatcgcactccggacatggtttccga

SEQ ID NO: 68927 - DNA, 37 bp, Artificial Sequence
  Synthetic oligonucleotide
ggactacttgtccgctgctaaattcgtcccatctcga

SEQ ID NO: 68928 - DNA, 37 bp, Artificial Sequence
  Synthetic oligonucleotide
ttgggggggtggaagcgatgtagctggagcgagagga

SEQ ID NO: 68929 - DNA, 37 bp, Artificial Sequence
  Synthetic oligonucleotide
gacgcccctgttctcgtgaatgtccgcaatgcccgga

SEQ ID NO: 68930 - DNA, 37 bp, Artificial Sequence
  Synthetic oligonucleotide
atgcgagagaaatgggggtgttgcataaagtgaggga

SEQ ID NO: 68931 - DNA, 37 bp, Artificial Sequence
  Synthetic oligonucleotide
attcgcaggggccacggcgagtacgttcgggaatgga

SEQ ID NO: 68932 - DNA, 37 bp, Artificial Sequence
  Synthetic oligonucleotide
gcatggagagcataggtggttcagatagaggggtgga

SEQ ID NO: 68933 - DNA, 38 bp, Artificial Sequence
  Synthetic oligonucleotide
ttcaagcacttcggcgtggctcacacatacaccaatga

SEQ ID NO: 68934 - DNA, 38 bp, Artificial Sequence
  Synthetic oligonucleotide
gacacgccaagaatgtcgttttgtactcccatgcatga

SEQ ID NO: 68935 - DNA, 38 bp, Artificial Sequence
  Synthetic oligonucleotide
tcgagactctgaaccctgccctgtacatcctatcatga

SEQ ID NO: 68936 - DNA, 38 bp, Artificial Sequence
  Synthetic oligonucleotide
acccttaccctcgccctgattgcctgattgcgagatga

SEQ ID NO: 68937 - DNA, 38 bp, Artificial Sequence
  Synthetic oligonucleotide
gttaccccactatgtctctgcccacaacaatgttatga

SEQ ID NO: 68938 - DNA, 38 bp, Artificial Sequence
  Synthetic oligonucleotide
ttcctccccagatcctgcatattccggtcctctactga

SEQ ID NO: 68939 - DNA, 37 bp, Artificial Sequence
  Synthetic oligonucleotide
ttgaccacgccccatctggcacccccgccactcctga

SEQ ID NO: 68940 - DNA, 38 bp, Artificial Sequence
  Synthetic oligonucleotide
cacgtcaccagttttgcgatcagatactcctactctga

SEQ ID NO: 68941 - DNA, 38 bp, Artificial Sequence
  Synthetic oligonucleotide
gaccaaggcggtctggaccggggtgggagatgaggtga

SEQ ID NO: 68942 - DNA, 38 bp, Artificial Sequence
  Synthetic oligonucleotide
gttgggtgcgtactggggcgggtacctgtgccgggtga

SEQ ID NO: 68943 - DNA, 38 bp, Artificial Sequence
  Synthetic oligonucleotide
gggtgctgcgggggaggagggtttcttgggcggggtga

SEQ ID NO: 68944 - DNA, 37 bp, Artificial Sequence
  Synthetic oligonucleotide
gcgggatgaaacatggaaaggggggagagatgggtga

SEQ ID NO: 68945 - DNA, 38 bp, Artificial Sequence
  Synthetic oligonucleotide
atggtggtgcagtgattagcatacgggggtcgtggtga

SEQ ID NO: 68946 - DNA, 38 bp, Artificial Sequence
  Synthetic oligonucleotide
tgttcctgccatggcacgacccctcctacctttggtga

SEQ ID NO: 68947 - DNA, 35 bp, Artificial Sequence
  Synthetic oligonucleotide
gaccgccctggcatctcttttaaatcctgctgtga

SEQ ID NO: 68948 - DNA, 37 bp, Artificial Sequence
  Synthetic oligonucleotide
ggtcgccgccgaacgatatatcccctttaccgtgtga

SEQ ID NO: 68949 - DNA, 38 bp, Artificial Sequence
  Synthetic oligonucleotide
ttgggtggcggggtggggcagggcttaacggattgtga

SEQ ID NO: 68950 - DNA, 38 bp, Artificial Sequence
  Synthetic oligonucleotide
tacgcccgacgccatcgctgggcatgtgactgcattga

SEQ ID NO: 68951 - DNA, 38 bp, Artificial Sequence
  Synthetic oligonucleotide
gccgcaacacagcgtactctatgtcttccgccgcttga

SEQ ID NO: 68952 - DNA, 38 bp, Artificial Sequence
  Synthetic oligonucleotide
gtgagcatagcttaggttctagtcccatcctctcttga

SEQ ID NO: 68953 - DNA, 38 bp, Artificial Sequence
  Synthetic oligonucleotide
gtgagacgcactagtcgtacaagagttggaagagttga

SEQ ID NO: 68954 - DNA, 37 bp, Artificial Sequence
  Synthetic oligonucleotide
ttcacacagccgttctcgagggtgctcctcttgttga

SEQ ID NO: 68955 - DNA, 38 bp, Artificial Sequence
  Synthetic oligonucleotide
attcacgccaggaccccctcgtaccccgtcgcctttga

SEQ ID NO: 68956 - DNA, 36 bp, Artificial Sequence
  Synthetic oligonucleotide
aagggacacgggcgggcagtccgggagatcgcaata

SEQ ID NO: 68957 - DNA, 35 bp, Artificial Sequence
  Synthetic oligonucleotide
atgtaacaccacgacctacgcagacactacgaata

SEQ ID NO: 68958 - DNA, 36 bp, Artificial Sequence
  Synthetic oligonucleotide
gtagaggtcaactatgttactccgcccacactcata

SEQ ID NO: 68959 - DNA, 35 bp, Artificial Sequence
  Synthetic oligonucleotide
acaacgagcgccatcctgaggagggggggcaacta

SEQ ID NO: 68960 - DNA, 35 bp, Artificial Sequence
  Synthetic oligonucleotide
ttcaccccccagtgccttgtcatcgcacctgcgta

SEQ ID NO: 68961 - DNA, 36 bp, Artificial Sequence
  Synthetic oligonucleotide
tgcaccgcctggcccttcacgaccctccgacatgta

SEQ ID NO: 68962 - DNA, 36 bp, Artificial Sequence
  Synthetic oligonucleotide
gcccttccgctcagcgttcgcacgcccttacctgta

SEQ ID NO: 68963 - DNA, 36 bp, Artificial Sequence
  Synthetic oligonucleotide
tgttgcccggcaggacccgttacatcttgcatctta

SEQ ID NO: 68964 - DNA, 35 bp, Artificial Sequence
  Synthetic oligonucleotide
ttcacgtagcgttcactctggaagcccatcgtaac

SEQ ID NO: 68965 - DNA, 35 bp, Artificial Sequence
  Synthetic oligonucleotide
caccattcggcacgccgcggccctgacaccgccac

SEQ ID NO: 68966 - DNA, 35 bp, Artificial Sequence
  Synthetic oligonucleotide
gtctgccccaagatcctgctctactccccaaagac

SEQ ID NO: 68967 - DNA, 35 bp, Artificial Sequence
  Synthetic oligonucleotide
ttgtcccacacctatttgttatccaggtttcagac

SEQ ID NO: 68968 - DNA, 35 bp, Artificial Sequence
  Synthetic oligonucleotide
tccatcagtacacaccaccttcggatctagacacc

SEQ ID NO: 68969 - DNA, 35 bp, Artificial Sequence
  Synthetic oligonucleotide
atcaagccttgagccgtcctagccattcatatccc

SEQ ID NO: 68970 - DNA, 35 bp, Artificial Sequence
  Synthetic oligonucleotide
agacccatagcgactcgtccccctgaacagttccc

SEQ ID NO: 68971 - DNA, 36 bp, Artificial Sequence
  Synthetic oligonucleotide
agtgaccttaatgccccggtaacaattatctccgcc

SEQ ID NO: 68972 - DNA, 35 bp, Artificial Sequence
  Synthetic oligonucleotide
tggtgtacctcctcggtgatcgccgtactctcgcc

SEQ ID NO: 68973 - DNA, 35 bp, Artificial Sequence
  Synthetic oligonucleotide
gacactaaagagggtagggcgatgggatgtgggcc

SEQ ID NO: 68974 - DNA, 35 bp, Artificial Sequence
  Synthetic oligonucleotide
gtcgcagaacctttctatcttgccacgggcatgcc

SEQ ID NO: 68975 - DNA, 35 bp, Artificial Sequence
  Synthetic oligonucleotide
tcaccctcgtggacttggtgaccctcgccccctcc

SEQ ID NO: 68976 - DNA, 35 bp, Artificial Sequence
  Synthetic oligonucleotide
agcctcgcagaaccctctgtcacctaccgaagtcc

SEQ ID NO: 68977 - DNA, 35 bp, Artificial Sequence
  Synthetic oligonucleotide
gcctgcttagggcattctacgacatacttccgcgc

SEQ ID NO: 68978 - DNA, 35 bp, Artificial Sequence
  Synthetic oligonucleotide
gccgaaatccattgtccgggcctgtacgatccgtc

SEQ ID NO: 68979 - DNA, 35 bp, Artificial Sequence
  Synthetic oligonucleotide
tccttcagcgctggcccgcttagactcctgttgtc

SEQ ID NO: 68980 - DNA, 35 bp, Artificial Sequence
  Synthetic oligonucleotide
tgggcgcatcccggtcttcttgcttcgttacgttc

SEQ ID NO: 68981 - DNA, 35 bp, Artificial Sequence
  Synthetic oligonucleotide
gcctcgcccatcgcattgaccctagtggtgccccg

SEQ ID NO: 68982 - DNA, 35 bp, Artificial Sequence
  Synthetic oligonucleotide
gtcgcacagcctttctattagtctcactgcaggcg

SEQ ID NO: 68983 - DNA, 35 bp, Artificial Sequence
  Synthetic oligonucleotide
atggacaccgggaggtgaacatacatgaggtatcg

SEQ ID NO: 68984 - DNA, 35 bp, Artificial Sequence
  Synthetic oligonucleotide
tagagccatagccttatccccgcagagcgaactcg

SEQ ID NO: 68985 - DNA, 35 bp, Artificial Sequence
  Synthetic oligonucleotide
tcatatacactcttgtcagacatcgcccccattcg

SEQ ID NO: 68986 - DNA, 35 bp, Artificial Sequence
  Synthetic oligonucleotide
acgcagtacgctctctctgtacaccacaaaaccgg

SEQ ID NO: 68987 - DNA, 35 bp, Artificial Sequence
  Synthetic oligonucleotide
ttgctcctcagtggcggatctccaatttacacctg

SEQ ID NO: 68988 - DNA, 35 bp, Artificial Sequence
  Synthetic oligonucleotide
gaagtgagtacatgaacgggaggaatggataattg

SEQ ID NO: 68989 - DNA, 35 bp, Artificial Sequence
  Synthetic oligonucleotide
aacccgcgcttgaaatgaccacatccctaagtttg

SEQ ID NO: 68990 - DNA, 35 bp, Artificial Sequence
  Synthetic oligonucleotide
gcattaagcacgctctttctgctatgccactacat

SEQ ID NO: 68991 - DNA, 35 bp, Artificial Sequence
  Synthetic oligonucleotide
ggggctgggtgaagcatctggtgggcggtggggat

SEQ ID NO: 68992 - DNA, 35 bp, Artificial Sequence
  Synthetic oligonucleotide
attcacccctgggaagaatccctgcctcctgttat

SEQ ID NO: 68993 - DNA, 35 bp, Artificial Sequence
  Synthetic oligonucleotide
ttgtctcgaaggtccgccctttgttatgtttcgct

SEQ ID NO: 68994 - DNA, 35 bp, Artificial Sequence
  Synthetic oligonucleotide
tcgtcctcccctgcacgtaccctagaacttcatct

SEQ ID NO: 68995 - DNA, 35 bp, Artificial Sequence
  Synthetic oligonucleotide
tcaacacctggcctgagcaacgctcctcactgtct

SEQ ID NO: 68996 - DNA, 35 bp, Artificial Sequence
  Synthetic oligonucleotide
agagcatcgcggagccatcttacgccactaattct

SEQ ID NO: 68997 - DNA, 35 bp, Artificial Sequence
  Synthetic oligonucleotide
gacgcgatcgtttgtcatgcgctcgggcctattct

SEQ ID NO: 68998 - DNA, 35 bp, Artificial Sequence
  Synthetic oligonucleotide
acacagacagtggcccaatccgctactttcgttct

SEQ ID NO: 68999 - DNA, 35 bp, Artificial Sequence
  Synthetic oligonucleotide
ggtggagtaaagcattggaagggtagaggggtcgt

SEQ ID NO: 69000 - DNA, 35 bp, Artificial Sequence
  Synthetic oligonucleotide
tcctcgataaggtgccatcatcgattctgtccatt

SEQ ID NO: 69001 - DNA, 35 bp, Artificial Sequence
  Synthetic oligonucleotide
atcacgctaatcaatgacctcctatgcgccgactt

SEQ ID NO: 69002 - DNA, 35 bp, Artificial Sequence
  Synthetic oligonucleotide
gctgcacgccgccgccgtgattgtccgcccccctt

SEQ ID NO: 69003 - DNA, 35 bp, Artificial Sequence
  Synthetic oligonucleotide
ggatggtcgcaccgcaattcgacggcatctccctt

SEQ ID NO: 69004 - DNA, 35 bp, Artificial Sequence
  Synthetic oligonucleotide
ttccgcagtgcttgattttttgcttcgaccgcctt

SEQ ID NO: 69005 - DNA, 35 bp, Artificial Sequence
  Synthetic oligonucleotide
tgcatcagcaacgcggggcccgaatcgaatgcctt

SEQ ID NO: 69006 - DNA, 35 bp, Artificial Sequence
  Synthetic oligonucleotide
ttagagcctggggtctgcggctcttttttgttctt

SEQ ID NO: 69007 - DNA, 35 bp, Artificial Sequence
  Synthetic oligonucleotide
gtcgcctagaccggtttttggtgtcaatccccgtt

SEQ ID NO: 69008 - DNA, 36 bp, Artificial Sequence
  Synthetic oligonucleotide
gatcgtaccaccgcctagggatccttcagtaccaaa

SEQ ID NO: 69009 - DNA, 36 bp, Artificial Sequence
  Synthetic oligonucleotide
atcttggaaggggacggtagggcaaaaggggagaaa

SEQ ID NO: 69010 - DNA, 36 bp, Artificial Sequence
  Synthetic oligonucleotide
taatgcaggtggggggatctggacgcataggggaaa

SEQ ID NO: 69011 - DNA, 35 bp, Artificial Sequence
  Synthetic oligonucleotide
aacagacgactacgctcacgacctttaactcccaa

SEQ ID NO: 69012 - DNA, 33 bp, Artificial Sequence
  Synthetic oligonucleotide
atttacgggctccacctggtcatcctgtctcaa

SEQ ID NO: 69013 - DNA, 36 bp, Artificial Sequence
  Synthetic oligonucleotide
tgttccatcaacttgaggtgctctcgaataccgtaa

SEQ ID NO: 69014 - DNA, 36 bp, Artificial Sequence
  Synthetic oligonucleotide
gcatgcctcatgttagtgtggttaaatccgcgaaca

SEQ ID NO: 69015 - DNA, 36 bp, Artificial Sequence
  Synthetic oligonucleotide
aaagggcataccgccagcctcaccttataccttaca

SEQ ID NO: 69016 - DNA, 36 bp, Artificial Sequence
  Synthetic oligonucleotide
accgcctcacttataccgtgtaacgacccgatgcca

SEQ ID NO: 69017 - DNA, 35 bp, Artificial Sequence
  Synthetic oligonucleotide
acagtcgcaccatctaaacaggcgccctccatcca

SEQ ID NO: 69018 - DNA, 35 bp, Artificial Sequence
  Synthetic oligonucleotide
gcgcattattgaccgccgcgctgcccccgattcca

SEQ ID NO: 69019 - DNA, 36 bp, Artificial Sequence
  Synthetic oligonucleotide
gcgaccatgtcctggatccctgtaacgaaagccgca

SEQ ID NO: 69020 - DNA, 36 bp, Artificial Sequence
  Synthetic oligonucleotide
atacgtgccacactgtacatggtgtctgtctgctca

SEQ ID NO: 69021 - DNA, 36 bp, Artificial Sequence
  Synthetic oligonucleotide
ttggacccgcccatggccgcactctagtgtttgtca

SEQ ID NO: 69022 - DNA, 36 bp, Artificial Sequence
  Synthetic oligonucleotide
gaccggccacctctgggagtccacctctgccattca

SEQ ID NO: 69023 - DNA, 35 bp, Artificial Sequence
  Synthetic oligonucleotide
aatcgactccgcactatctaacgccctcgacttca

SEQ ID NO: 69024 - DNA, 36 bp, Artificial Sequence
  Synthetic oligonucleotide
ttagccgacatccccactggttcgcgaattttttca

SEQ ID NO: 69025 - DNA, 37 bp, Artificial Sequence
  Synthetic oligonucleotide
gccgccctagcgcattctgtctcaggtcgaccacaga

SEQ ID NO: 69026 - DNA, 38 bp, Artificial Sequence
  Synthetic oligonucleotide
tgaccactcagtacgctcccctccatccattcgtcaga

SEQ ID NO: 69027 - DNA, 36 bp, Artificial Sequence
  Synthetic oligonucleotide
gaggagtggagccggaggtggacacatgtggggaga

SEQ ID NO: 69028 - DNA, 36 bp, Artificial Sequence
  Synthetic oligonucleotide
gcaaccgaaccgcatcgcataaattacatcttgaga

SEQ ID NO: 69029 - DNA, 35 bp, Artificial Sequence
  Synthetic oligonucleotide
gttgccccaggacaccctgttcatgtctcgctaga

SEQ ID NO: 69030 - DNA, 37 bp, Artificial Sequence
  Synthetic oligonucleotide
tttgtcgtacgctggaacgtatcccctcctttctaga

SEQ ID NO: 69031 - DNA, 36 bp, Artificial Sequence
  Synthetic oligonucleotide
gacatactaggcacgacgggaggggactcgggtaga

SEQ ID NO: 69032 - DNA, 37 bp, Artificial Sequence
  Synthetic oligonucleotide
ttgtacgcgccgtgtaccgtagtttttccgcccccga

SEQ ID NO: 69033 - DNA, 37 bp, Artificial Sequence
  Synthetic oligonucleotide
tgccaccgctccaatggaatttgaaatccctagccga

SEQ ID NO: 69034 - DNA, 36 bp, Artificial Sequence
  Synthetic oligonucleotide
aatgcgatactgccacttcttcaccttgtgcatcga

SEQ ID NO: 69035 - DNA, 37 bp, Artificial Sequence
  Synthetic oligonucleotide
gcccccgacacaaaaggctttctcgattcttgctcga

SEQ ID NO: 69036 - DNA, 35 bp, Artificial Sequence
  Synthetic oligonucleotide
gacggggtcaggtaactctgccttttccctctcga

SEQ ID NO: 69037 - DNA, 37 bp, Artificial Sequence
  Synthetic oligonucleotide
actggggccgggtgggtagggccttatctatatagga

SEQ ID NO: 69038 - DNA, 35 bp, Artificial Sequence
  Synthetic oligonucleotide
actgcccgggccaggtttccgctacacaattcgga

SEQ ID NO: 69039 - DNA, 37 bp, Artificial Sequence
  Synthetic oligonucleotide
gacatcggggaggagccatacgaccaatgatagggga

SEQ ID NO: 69040 - DNA, 37 bp, Artificial Sequence
  Synthetic oligonucleotide
gaaactcgtcgccggttacacttccttcactagggga

SEQ ID NO: 69041 - DNA, 37 bp, Artificial Sequence
  Synthetic oligonucleotide
gtgaaccggcctcatcaaacaacacaccacgcgggga

SEQ ID NO: 69042 - DNA, 38 bp, Artificial Sequence
  Synthetic oligonucleotide
tgaacgggaccgatgcggagtgaagcaatggtgaatga

SEQ ID NO: 69043 - DNA, 38 bp, Artificial Sequence
  Synthetic oligonucleotide
atgtggtgggggtgggtttcgttcgtcgtcagtaatga

SEQ ID NO: 69044 - DNA, 38 bp, Artificial Sequence
  Synthetic oligonucleotide
ataacagcaccgaattcctgcattagcgacccccatga

SEQ ID NO: 69045 - DNA, 37 bp, Artificial Sequence
  Synthetic oligonucleotide
gtgattgcagcatacacttcaacttctgcttccatga

SEQ ID NO: 69046 - DNA, 38 bp, Artificial Sequence
  Synthetic oligonucleotide
gccttgccgtgcacatcctgtcctactcccgtttatga

SEQ ID NO: 69047 - DNA, 38 bp, Artificial Sequence
  Synthetic oligonucleotide
tagctgaacctggtccctaatctgacacccttgactga

SEQ ID NO: 69048 - DNA, 38 bp, Artificial Sequence
  Synthetic oligonucleotide
gtaccgttgccttgatcgccattccgctattatcctga

SEQ ID NO: 69049 - DNA, 37 bp, Artificial Sequence
  Synthetic oligonucleotide
tccatgcagttgacccataaacctatctagctcctga

SEQ ID NO: 69050 - DNA, 38 bp, Artificial Sequence
  Synthetic oligonucleotide
tcctagccgggatcctgtttgctatactcttctcctga

SEQ ID NO: 69051 - DNA, 37 bp, Artificial Sequence
  Synthetic oligonucleotide
gtcccgcacactccacgctgcctaacgtctcagctga

SEQ ID NO: 69052 - DNA, 38 bp, Artificial Sequence
  Synthetic oligonucleotide
gctggaggtatggggatggtggtagatgtttggcgtga

SEQ ID NO: 69053 - DNA, 37 bp, Artificial Sequence
  Synthetic oligonucleotide
taccgctcctgcttctgtccatccaccagattcgtga

SEQ ID NO: 69054 - DNA, 35 bp, Artificial Sequence
  Synthetic oligonucleotide
aaacagaagcgggaaggttccaggaggggaggtga

SEQ ID NO: 69055 - DNA, 37 bp, Artificial Sequence
  Synthetic oligonucleotide
atgcaggtgggaagagggaagatcattagcgtggtga

SEQ ID NO: 69056 - DNA, 36 bp, Artificial Sequence
  Synthetic oligonucleotide
acgcacttagaacacatagacctccaccgaaattga

SEQ ID NO: 69057 - DNA, 38 bp, Artificial Sequence
  Synthetic oligonucleotide
gtgctagcctcgtacgcacacgtaatttaactcattga

SEQ ID NO: 69058 - DNA, 38 bp, Artificial Sequence
  Synthetic oligonucleotide
tgtgggttgccaagactgagtgggggggccgggattga

SEQ ID NO: 69059 - DNA, 36 bp, Artificial Sequence
  Synthetic oligonucleotide
agttcacgctggcaacacttacaatcgcccccttga

SEQ ID NO: 69060 - DNA, 38 bp, Artificial Sequence
  Synthetic oligonucleotide
gaggtgtatcgccaccctcacctgttctcttccgttga

SEQ ID NO: 69061 - DNA, 37 bp, Artificial Sequence
  Synthetic oligonucleotide
attgaccacctgtacaccctctgtaagtccttgttga

SEQ ID NO: 69062 - DNA, 38 bp, Artificial Sequence
  Synthetic oligonucleotide
actacgtccactatctcaagtgtccgctaatttgttga

SEQ ID NO: 69063 - DNA, 35 bp, Artificial Sequence
  Synthetic oligonucleotide
actgcccctctcacgagaccaccaaacttgccata

SEQ ID NO: 69064 - DNA, 33 bp, Artificial Sequence
  Synthetic oligonucleotide
gatgacactgcgagctccagttttacgcttata

SEQ ID NO: 69065 - DNA, 35 bp, Artificial Sequence
  Synthetic oligonucleotide
gtgcgcgcatgcctcccattttgaggcaccaacta

SEQ ID NO: 69066 - DNA, 36 bp, Artificial Sequence
  Synthetic oligonucleotide
ggtaaccgcctctgtctactctcaagcaaacacgta

SEQ ID NO: 69067 - DNA, 36 bp, Artificial Sequence
  Synthetic oligonucleotide
aacgacccggagagggtccaatccacttgtctctta

SEQ ID NO: 69068 - DNA, 35 bp, Artificial Sequence
  Synthetic oligonucleotide
ttggaccgcgtacatccctaagccactacgattta

SEQ ID NO: 69069 - DNA, 35 bp, Artificial Sequence
  Synthetic oligonucleotide
tgttccagcgcatgatcatctacgcccggctttta

SEQ ID NO: 69070 - DNA, 35 bp, Artificial Sequence
  Synthetic oligonucleotide
gctcaactaggtttccgttctgtcttttactccac

SEQ ID NO: 69071 - DNA, 35 bp, Artificial Sequence
  Synthetic oligonucleotide
gagccgaatgcgacccattgcctttcgttcccgac

SEQ ID NO: 69072 - DNA, 35 bp, Artificial Sequence
  Synthetic oligonucleotide
tttggcctacttggagctgaacccgccgcccttac

SEQ ID NO: 69073 - DNA, 35 bp, Artificial Sequence
  Synthetic oligonucleotide
gttctggcaccctttcccgatctatcgtagcttac

SEQ ID NO: 69074 - DNA, 35 bp, Artificial Sequence
  Synthetic oligonucleotide
gccagttaatctaacgcgataacaacctgctaacc

SEQ ID NO: 69075 - DNA, 35 bp, Artificial Sequence
  Synthetic oligonucleotide
tacgccccggatgtcttttgccacggtcacgcacc

SEQ ID NO: 69076 - DNA, 35 bp, Artificial Sequence
  Synthetic oligonucleotide
gacaccgacgccccttcgaactgccaccctagccc

SEQ ID NO: 69077 - DNA, 35 bp, Artificial Sequence
  Synthetic oligonucleotide
attatcgccggcgaatcatatatgtcacattcgcc

SEQ ID NO: 69078 - DNA, 35 bp, Artificial Sequence
  Synthetic oligonucleotide
gcgcccggtccggtcctagcgaaaactttccatcc

SEQ ID NO: 69079 - DNA, 35 bp, Artificial Sequence
  Synthetic oligonucleotide
caaaccagcattgctcattgcctttatccccccgc

SEQ ID NO: 69080 - DNA, 35 bp, Artificial Sequence
  Synthetic oligonucleotide
tcatttcccgggatcactctgttcagactccccgc

SEQ ID NO: 69081 - DNA, 35 bp, Artificial Sequence
  Synthetic oligonucleotide
ttgcaccatgcattcgattcccccaggagggccgc

SEQ ID NO: 69082 - DNA, 35 bp, Artificial Sequence
  Synthetic oligonucleotide
acacctactcacgacaaggcatctatgacctcggc

SEQ ID NO: 69083 - DNA, 35 bp, Artificial Sequence
  Synthetic oligonucleotide
acctctcctccaatcgcgggacacggcacaattgc

SEQ ID NO: 69084 - DNA, 35 bp, Artificial Sequence
  Synthetic oligonucleotide
tgatactctcgaattgcctgtagaaatggcctatc

SEQ ID NO: 69085 - DNA, 35 bp, Artificial Sequence
  Synthetic oligonucleotide
gagctgtggcggccccatgttgttacactgccctc

SEQ ID NO: 69086 - DNA, 35 bp, Artificial Sequence
  Synthetic oligonucleotide
acagtgccctctgtctctttctttcgcaacctctc

SEQ ID NO: 69087 - DNA, 35 bp, Artificial Sequence
  Synthetic oligonucleotide
aacccctctgctcccgccattacaacctggtatcg

SEQ ID NO: 69088 - DNA, 35 bp, Artificial Sequence
  Synthetic oligonucleotide
gcacaagggaaagggatcgaagggtacaacagagg

SEQ ID NO: 69089 - DNA, 35 bp, Artificial Sequence
  Synthetic oligonucleotide
ttcaccaactgcctgtcccttgagctactagccgg

SEQ ID NO: 69090 - DNA, 35 bp, Artificial Sequence
  Synthetic oligonucleotide
ggtgatgcagggggagggtgatggcgggacgtggg

SEQ ID NO: 69091 - DNA, 35 bp, Artificial Sequence
  Synthetic oligonucleotide
gattggggtggtgaatctaagtttggggcacgatg

SEQ ID NO: 69092 - DNA, 35 bp, Artificial Sequence
  Synthetic oligonucleotide
gcaagggcaagcaaagtacacgcatgcagggattg

SEQ ID NO: 69093 - DNA, 35 bp, Artificial Sequence
  Synthetic oligonucleotide
tatcgtgccatagccacacgggttctttcatcttg

SEQ ID NO: 69094 - DNA, 35 bp, Artificial Sequence
  Synthetic oligonucleotide
ggggatggccagcacattgagcctactttacccat

SEQ ID NO: 69095 - DNA, 35 bp, Artificial Sequence
  Synthetic oligonucleotide
tcgacccggtagaaccccagctgcacccgtctcat

SEQ ID NO: 69096 - DNA, 35 bp, Artificial Sequence
  Synthetic oligonucleotide
gacattgtatccggccctgctcccttcaccttcat

SEQ ID NO: 69097 - DNA, 35 bp, Artificial Sequence
  Synthetic oligonucleotide
aaggagggtgcatcgagcggtaggacaagaggtat

SEQ ID NO: 69098 - DNA, 35 bp, Artificial Sequence
  Synthetic oligonucleotide
gactgccacaacatctgtccgtttcactcgcgcct

SEQ ID NO: 69099 - DNA, 35 bp, Artificial Sequence
  Synthetic oligonucleotide
ttcaggccaagagctccctgatctggccatcttct

SEQ ID NO: 69100 - DNA, 35 bp, Artificial Sequence
  Synthetic oligonucleotide
tatgcgcgactctcccctgcgcacgaatctccggt

SEQ ID NO: 69101 - DNA, 35 bp, Artificial Sequence
  Synthetic oligonucleotide
tccgggaaaattcagcaaatagggacgggtggggt

SEQ ID NO: 69102 - DNA, 35 bp, Artificial Sequence
  Synthetic oligonucleotide
gcaaaggaagggcagggaagcatccacagaattgt

SEQ ID NO: 69103 - DNA, 35 bp, Artificial Sequence
  Synthetic oligonucleotide
tcgacccgcttcgagccttttaatgtctctcttgt

SEQ ID NO: 69104 - DNA, 35 bp, Artificial Sequence
  Synthetic oligonucleotide
gcccagcatcttctgcgccttgtcctttttgttgt

SEQ ID NO: 69105 - DNA, 35 bp, Artificial Sequence
  Synthetic oligonucleotide
gctcacgtgccttttctgttccggtcagtagcatt

SEQ ID NO: 69106 - DNA, 35 bp, Artificial Sequence
  Synthetic oligonucleotide
gtagttggggggaaaaacgtggtaaggggctcatt

SEQ ID NO: 69107 - DNA, 35 bp, Artificial Sequence
  Synthetic oligonucleotide
tgaagggcagacgatctgcattcagccttaccctt

SEQ ID NO: 69108 - DNA, 35 bp, Artificial Sequence
  Synthetic oligonucleotide
gtagcgaagcaatcattaggggtagcattatggtt

SEQ ID NO: 69109 - DNA, 35 bp, Artificial Sequence
  Synthetic oligonucleotide
aattcacatcaggccgccccaaactaggccacttt

SEQ ID NO: 69110 - DNA, 35 bp, Artificial Sequence
  Synthetic oligonucleotide
tgtcgcccccgcacctccataatcaacggcagaaa

SEQ ID NO: 69111 - DNA, 35 bp, Artificial Sequence
  Synthetic oligonucleotide
tccggagcatggggggggtcgcttacgaactagaa

SEQ ID NO: 69112 - DNA, 35 bp, Artificial Sequence
  Synthetic oligonucleotide
ttcatgcctcggcctttccattccctgcttccgaa

SEQ ID NO: 69113 - DNA, 35 bp, Artificial Sequence
  Synthetic oligonucleotide
gcctgggctcgtactgcttatggtgcaatcgggaa

SEQ ID NO: 69114 - DNA, 36 bp, Artificial Sequence
  Synthetic oligonucleotide
ggactacggtcaatctcatgctctggtctcggtgaa

SEQ ID NO: 69115 - DNA, 35 bp, Artificial Sequence
  Synthetic oligonucleotide
tacgcaacagcacaggcaacaccagctcctcgtaa

SEQ ID NO: 69116 - DNA, 35 bp, Artificial Sequence
  Synthetic oligonucleotide
tgctacgaacaaggcttaaacacccgctgcaaaca

SEQ ID NO: 69117 - DNA, 36 bp, Artificial Sequence
  Synthetic oligonucleotide
gacacccactccgtcatggcgtggtacgctggccca

SEQ ID NO: 69118 - DNA, 34 bp, Artificial Sequence
  Synthetic oligonucleotide
acgaagaagggaggaggatgggcatcggtacgca

SEQ ID NO: 69119 - DNA, 35 bp, Artificial Sequence
  Synthetic oligonucleotide
tagtgggccgtgcatcctggcaactcctttttgca

SEQ ID NO: 69120 - DNA, 36 bp, Artificial Sequence
  Synthetic oligonucleotide
tcatggtcggcctgcattgagccacttgactcctca

SEQ ID NO: 69121 - DNA, 35 bp, Artificial Sequence
  Synthetic oligonucleotide
gcgtaatgacatcccctccaccgcctgcctcgtca

SEQ ID NO: 69122 - DNA, 35 bp, Artificial Sequence
  Synthetic oligonucleotide
gacaccaccaagtctacctaaattcaattcggtca

SEQ ID NO: 69123 - DNA, 37 bp, Artificial Sequence
  Synthetic oligonucleotide
ttccccgccccactctgatcgaggtacttttgtaaga

SEQ ID NO: 69124 - DNA, 37 bp, Artificial Sequence
  Synthetic oligonucleotide
cccatgtcaagccctattgtcacctctctcctgcaga

SEQ ID NO: 69125 - DNA, 37 bp, Artificial Sequence
  Synthetic oligonucleotide
gcgcacggctgctcaccgcttccctccgtgctcgaga

SEQ ID NO: 69126 - DNA, 37 bp, Artificial Sequence
  Synthetic oligonucleotide
tagcccagtcccgtcgtaacacccccacagcctacga

SEQ ID NO: 69127 - DNA, 37 bp, Artificial Sequence
  Synthetic oligonucleotide
gatcaagggatccggccatactccacctgcgtaccga

SEQ ID NO: 69128 - DNA, 37 bp, Artificial Sequence
  Synthetic oligonucleotide
gatcgccaggacgctcgcaaactcttcttcacgccga

SEQ ID NO: 69129 - DNA, 37 bp, Artificial Sequence
  Synthetic oligonucleotide
ttactacccacatacatgtgcaccgactattccagga

SEQ ID NO: 69130 - DNA, 36 bp, Artificial Sequence
  Synthetic oligonucleotide
acagaacggaggatagggaatactgttgaatgagga

SEQ ID NO: 69131 - DNA, 37 bp, Artificial Sequence
  Synthetic oligonucleotide
tactgcctggtgcatgcgttcccttcaccctttcgga

SEQ ID NO: 69132 - DNA, 37 bp, Artificial Sequence
  Synthetic oligonucleotide
tcaacctcctgccccgtaaacgcgtgacagacctgga

SEQ ID NO: 69133 - DNA, 37 bp, Artificial Sequence
  Synthetic oligonucleotide
gaccccgtcgttggaccttaaaccgttgacaccatga

SEQ ID NO: 69134 - DNA, 38 bp, Artificial Sequence
  Synthetic oligonucleotide
atacctgccgccaacctcagaccagacatctcagatga

SEQ ID NO: 69135 - DNA, 38 bp, Artificial Sequence
  Synthetic oligonucleotide
tccacgtccatagacccgggcctccacatttgatatga

SEQ ID NO: 69136 - DNA, 37 bp, Artificial Sequence
  Synthetic oligonucleotide
gtgccgaccagcatttctcattcttggccttctatga

SEQ ID NO: 69137 - DNA, 38 bp, Artificial Sequence
  Synthetic oligonucleotide
gcgggttgggaggggaagtggagggccatgggaactga

SEQ ID NO: 69138 - DNA, 38 bp, Artificial Sequence
  Synthetic oligonucleotide
gctggaggcatccatatgatctacgcgagtacccctga

SEQ ID NO: 69139 - DNA, 36 bp, Artificial Sequence
  Synthetic oligonucleotide
agacgtaggcggtcatcctcccgttaactcccctga

SEQ ID NO: 69140 - DNA, 38 bp, Artificial Sequence
  Synthetic oligonucleotide
tcagtcaccccttgtcgtactcccgtccatcctcctga

SEQ ID NO: 69141 - DNA, 38 bp, Artificial Sequence
  Synthetic oligonucleotide
tgcctgctgccagatgatgccaattcctctcctcctga

SEQ ID NO: 69142 - DNA, 37 bp, Artificial Sequence
  Synthetic oligonucleotide
gccgccccagcttgtgccggatttgctttacctctga

SEQ ID NO: 69143 - DNA, 38 bp, Artificial Sequence
  Synthetic oligonucleotide
tcacccgccccgccccaatcaaaccactgtcctagtga

SEQ ID NO: 69144 - DNA, 38 bp, Artificial Sequence
  Synthetic oligonucleotide
gctgcccgagtttctgtccaagttctgcactccggtga

SEQ ID NO: 69145 - DNA, 38 bp, Artificial Sequence
  Synthetic oligonucleotide
gaccccgtctgcctcgcccattacagcgccgttggtga

SEQ ID NO: 69146 - DNA, 36 bp, Artificial Sequence
  Synthetic oligonucleotide
ttcacgtacgaatgggggaaggggttatagttgtga

SEQ ID NO: 69147 - DNA, 38 bp, Artificial Sequence
  Synthetic oligonucleotide
ttagcccgtcagggcattcgtaccacacgttttattga

SEQ ID NO: 69148 - DNA, 38 bp, Artificial Sequence
  Synthetic oligonucleotide
tcctcgatcgcttattagttattttcttctgcacttga

SEQ ID NO: 69149 - DNA, 35 bp, Artificial Sequence
  Synthetic oligonucleotide
tacatacctcacgcttgtggccccggacccgtata

SEQ ID NO: 69150 - DNA, 35 bp, Artificial Sequence
  Synthetic oligonucleotide
tacgtgccggaattaggaaggcaggaagggtacta

SEQ ID NO: 69151 - DNA, 36 bp, Artificial Sequence
  Synthetic oligonucleotide
taccgacatagtaagtgcctagaagagtgggccgta

SEQ ID NO: 69152 - DNA, 35 bp, Artificial Sequence
  Synthetic oligonucleotide
tactgtggtggtccccgcttttgaatacaacatta

SEQ ID NO: 69153 - DNA, 35 bp, Artificial Sequence
  Synthetic oligonucleotide
gtgaccgctacacgaaacagctcctcaccccatta

SEQ ID NO: 69154 - DNA, 36 bp, Artificial Sequence
  Synthetic oligonucleotide
gatcgctacactggttccatgacttggcgtacctta

SEQ ID NO: 69155 - DNA, 35 bp, Artificial Sequence
  Synthetic oligonucleotide
tgtcgtatgccatctggtcctaggattgcccctta

SEQ ID NO: 69156 - DNA, 36 bp, Artificial Sequence
  Synthetic oligonucleotide
attcgcacgagcgatcgccccccttatagacgctta

SEQ ID NO: 69157 - DNA, 35 bp, Artificial Sequence
  Synthetic oligonucleotide
tgctcccgacttgcctgccaccgttttaccaggac

SEQ ID NO: 69158 - DNA, 35 bp, Artificial Sequence
  Synthetic oligonucleotide
tacccgcctgtgccaaaataattccgtgattctac

SEQ ID NO: 69159 - DNA, 35 bp, Artificial Sequence
  Synthetic oligonucleotide
tgggccctatccatgactacctgtcgcacacgtac

SEQ ID NO: 69160 - DNA, 35 bp, Artificial Sequence
  Synthetic oligonucleotide
gcaccattgcctcagaaccgtcccggtcgttttac

SEQ ID NO: 69161 - DNA, 35 bp, Artificial Sequence
  Synthetic oligonucleotide
gccccgaagggcatgtgtggcaacactaaacaacc

SEQ ID NO: 69162 - DNA, 35 bp, Artificial Sequence
  Synthetic oligonucleotide
tcatgacccgtaaaggagttggactacactacacc

SEQ ID NO: 69163 - DNA, 35 bp, Artificial Sequence
  Synthetic oligonucleotide
caacggcgcaactctgcacactagcccatgccacc

SEQ ID NO: 69164 - DNA, 35 bp, Artificial Sequence
  Synthetic oligonucleotide
actccctacgaggcttacttgagctacgcatcccc

SEQ ID NO: 69165 - DNA, 35 bp, Artificial Sequence
  Synthetic oligonucleotide
accgccatgcccgcctaatcgagtacgctatatcc

SEQ ID NO: 69166 - DNA, 34 bp, Artificial Sequence
  Synthetic oligonucleotide
aacgtcccacccctttctagtcggttatctgtcc

SEQ ID NO: 69167 - DNA, 36 bp, Artificial Sequence
  Synthetic oligonucleotide
gcgcacggacgtgtgactttatcacctgccgcttcc

SEQ ID NO: 69168 - DNA, 35 bp, Artificial Sequence
  Synthetic oligonucleotide
acgttcatcaaccaccattgcgatggccccctagc

SEQ ID NO: 69169 - DNA, 35 bp, Artificial Sequence
  Synthetic oligonucleotide
ttcccgcccctcggaaatttgtttcaacctttagc

SEQ ID NO: 69170 - DNA, 35 bp, Artificial Sequence
  Synthetic oligonucleotide
caaccaccccacgtagaggactccacctttggcgc

SEQ ID NO: 69171 - DNA, 35 bp, Artificial Sequence
  Synthetic oligonucleotide
gctgcgtgacctgcttatctctccgttatctcggc

SEQ ID NO: 69172 - DNA, 35 bp, Artificial Sequence
  Synthetic oligonucleotide
gtctcgggcagaattcgcttcccatctaccatatc

SEQ ID NO: 69173 - DNA, 35 bp, Artificial Sequence
  Synthetic oligonucleotide
acctggacagccacctcgatcattactttgatctc

SEQ ID NO: 69174 - DNA, 35 bp, Artificial Sequence
  Synthetic oligonucleotide
tatggcaatagggggaagggaacgaaaatggggtc

SEQ ID NO: 69175 - DNA, 35 bp, Artificial Sequence
  Synthetic oligonucleotide
gcccggaggttacatatcctcgttccatctagttc

SEQ ID NO: 69176 - DNA, 35 bp, Artificial Sequence
  Synthetic oligonucleotide
gtggtgaagtacggatctgattgtgcgtccgtttc

SEQ ID NO: 69177 - DNA, 35 bp, Artificial Sequence
  Synthetic oligonucleotide
agagcatgcagtcaccccctccctctgcacggccg

SEQ ID NO: 69178 - DNA, 31 bp, Artificial Sequence
  Synthetic oligonucleotide
gatagccccgttcgttccaggcgccctatcg

SEQ ID NO: 69179 - DNA, 35 bp, Artificial Sequence
  Synthetic oligonucleotide
gccaccgtaaccgttcccgttgcgacttgttatcg

SEQ ID NO: 69180 - DNA, 35 bp, Artificial Sequence
  Synthetic oligonucleotide
gctcgggacagtaagggtggcgcgaaaagtggggg

SEQ ID NO: 69181 - DNA, 35 bp, Artificial Sequence
  Synthetic oligonucleotide
gaaacgccgcttcccgccacatatcgccttgtctg

SEQ ID NO: 69182 - DNA, 35 bp, Artificial Sequence
  Synthetic oligonucleotide
gcttcctaacctggaacaccgacctaccgaccaat

SEQ ID NO: 69183 - DNA, 35 bp, Artificial Sequence
  Synthetic oligonucleotide
gactccgactttcgacgtgcccacctgatgaccat

SEQ ID NO: 69184 - DNA, 36 bp, Artificial Sequence
  Synthetic oligonucleotide
ggtaaggaagggtgcggctggaggacctcggggtat

SEQ ID NO: 69185 - DNA, 35 bp, Artificial Sequence
  Synthetic oligonucleotide
agccggacctccctatggtaaacgattctttaact

SEQ ID NO: 69186 - DNA, 35 bp, Artificial Sequence
  Synthetic oligonucleotide
tcatgccccggcgtgttcccatgacttttgtcact

SEQ ID NO: 69187 - DNA, 35 bp, Artificial Sequence
  Synthetic oligonucleotide
aatgctgaacgcccgcactatgcgtttgctctact

SEQ ID NO: 69188 - DNA, 35 bp, Artificial Sequence
  Synthetic oligonucleotide
ttgatcgtaggccccgattcgctactgagtttact

SEQ ID NO: 69189 - DNA, 35 bp, Artificial Sequence
  Synthetic oligonucleotide
gtgtgagcggactagcggcctcaccataacatcct

SEQ ID NO: 69190 - DNA, 35 bp, Artificial Sequence
  Synthetic oligonucleotide
tcaccaccacatagtgggcggtttccgtatatcct

SEQ ID NO: 69191 - DNA, 35 bp, Artificial Sequence
  Synthetic oligonucleotide
taccaaaacgcgtgcacagtttcccctgcatctct

SEQ ID NO: 69192 - DNA, 35 bp, Artificial Sequence
  Synthetic oligonucleotide
ttgcctacggaatgttattgttccctcgttgttct

SEQ ID NO: 69193 - DNA, 35 bp, Artificial Sequence
  Synthetic oligonucleotide
tcccaagtgacttttctgtagctttacgcctttct

SEQ ID NO: 69194 - DNA, 35 bp, Artificial Sequence
  Synthetic oligonucleotide
gtctattcccgccgccccaccattatctagccagt

SEQ ID NO: 69195 - DNA, 35 bp, Artificial Sequence
  Synthetic oligonucleotide
gagcggtcactgccgaggtcgcctcccactatagt

SEQ ID NO: 69196 - DNA, 35 bp, Artificial Sequence
  Synthetic oligonucleotide
acccgaacagtagacaagtgaagtcactcccccgt

SEQ ID NO: 69197 - DNA, 35 bp, Artificial Sequence
  Synthetic oligonucleotide
gttgcgtgagccccttgagtgtgcgccttctggtt

SEQ ID NO: 69198 - DNA, 35 bp, Artificial Sequence
  Synthetic oligonucleotide
ggaccgtcctcgaagcgcgcaacctcaataaattt

SEQ ID NO: 69199 - DNA, 36 bp, Artificial Sequence
  Synthetic oligonucleotide
tgcaccgtactcggcttagaccatacgcatcccaaa

SEQ ID NO: 69200 - DNA, 36 bp, Artificial Sequence
  Synthetic oligonucleotide
tcacgacaacccggattgatcatgatctccccgaaa

SEQ ID NO: 69201 - DNA, 35 bp, Artificial Sequence
  Synthetic oligonucleotide
ttatccggagcctccgttctatcttcttggttaaa

SEQ ID NO: 69202 - DNA, 35 bp, Artificial Sequence
  Synthetic oligonucleotide
actgggccctttcggaataaactgtctctctgcaa

SEQ ID NO: 69203 - DNA, 35 bp, Artificial Sequence
  Synthetic oligonucleotide
gccacctgccccagaatacggttttcggtcatcaa

SEQ ID NO: 69204 - DNA, 36 bp, Artificial Sequence
  Synthetic oligonucleotide
tccaatattgcacccgtcctgcccatacgcttctaa

SEQ ID NO: 69205 - DNA, 36 bp, Artificial Sequence
  Synthetic oligonucleotide
gaatccgaagagtgcggaggggcgtaaaggtggtaa

SEQ ID NO: 69206 - DNA, 36 bp, Artificial Sequence
  Synthetic oligonucleotide
gccaagggtgaagctctgttcctcctgtctacttaa

SEQ ID NO: 69207 - DNA, 35 bp, Artificial Sequence
  Synthetic oligonucleotide
gccaccgcccatcggtgtccgatttaatttgaaca

SEQ ID NO: 69208 - DNA, 36 bp, Artificial Sequence
  Synthetic oligonucleotide
gtaacgatcccgacaaaccttgttttggaggacaca

SEQ ID NO: 69209 - DNA, 36 bp, Artificial Sequence
  Synthetic oligonucleotide
tatgacgtccatattggcacaacaacgctggaacca

SEQ ID NO: 69210 - DNA, 36 bp, Artificial Sequence
  Synthetic oligonucleotide
gtgttgcatctcccgtgttaggtcttctttatccca

SEQ ID NO: 69211 - DNA, 36 bp, Artificial Sequence
  Synthetic oligonucleotide
tcatgtcgccctggaggtccctctcattttcatcca

SEQ ID NO: 69212 - DNA, 36 bp, Artificial Sequence
  Synthetic oligonucleotide
tgttccgccggacgcccgcatagaagcccttatcca

SEQ ID NO: 69213 - DNA, 35 bp, Artificial Sequence
  Synthetic oligonucleotide
gacaagcaaaaatcggacgtaatgcgggcggggca

SEQ ID NO: 69214 - DNA, 35 bp, Artificial Sequence
  Synthetic oligonucleotide
ttgcacttagcattgccgccctcctactatctgca

SEQ ID NO: 69215 - DNA, 36 bp, Artificial Sequence
  Synthetic oligonucleotide
tcccctcatggcctccacgaatttctaaagacgtca

SEQ ID NO: 69216 - DNA, 37 bp, Artificial Sequence
  Synthetic oligonucleotide
taccgagtggggagaatgcgataacgggagaggaaga

SEQ ID NO: 69217 - DNA, 37 bp, Artificial Sequence
  Synthetic oligonucleotide
ttcccccgcatgctgtttcgcccgccttacaataaga

SEQ ID NO: 69218 - DNA, 37 bp, Artificial Sequence
  Synthetic oligonucleotide
agaggggggacagttcgggaagacgccggggaacaga

SEQ ID NO: 69219 - DNA, 37 bp, Artificial Sequence
  Synthetic oligonucleotide
gaaaaggggtgaggggggatggcagttagggcccaga

SEQ ID NO: 69220 - DNA, 37 bp, Artificial Sequence
  Synthetic oligonucleotide
atccctcccccgcactaagaccaggtccgtgtcacga

SEQ ID NO: 69221 - DNA, 37 bp, Artificial Sequence
  Synthetic oligonucleotide
agcgggcacactgaacattgctcaacatactctacga

SEQ ID NO: 69222 - DNA, 36 bp, Artificial Sequence
  Synthetic oligonucleotide
tatcggtcccccacaggcctgagttaactatcccga

SEQ ID NO: 69223 - DNA, 37 bp, Artificial Sequence
  Synthetic oligonucleotide
gtgagctacggggaagggcacgcggagggccgtagga

SEQ ID NO: 69224 - DNA, 37 bp, Artificial Sequence
  Synthetic oligonucleotide
tccgacacaggcccagcgcatacaaacctaaaacgga

SEQ ID NO: 69225 - DNA, 37 bp, Artificial Sequence
  Synthetic oligonucleotide
gttacatcacctatggctttatagcgaacctcacgga

SEQ ID NO: 69226 - DNA, 37 bp, Artificial Sequence
  Synthetic oligonucleotide
aacacccgccagcctggacagctagccgcagaaggga

SEQ ID NO: 69227 - DNA, 37 bp, Artificial Sequence
  Synthetic oligonucleotide
tcacggagaggggggagcctggttagacattcaggga

SEQ ID NO: 69228 - DNA, 37 bp, Artificial Sequence
  Synthetic oligonucleotide
tcagagccctgatagtacaggttggggtggtggggga

SEQ ID NO: 69229 - DNA, 37 bp, Artificial Sequence
  Synthetic oligonucleotide
ttccaacgcgaattgcctcacctcatgaccttgggga

SEQ ID NO: 69230 - DNA, 37 bp, Artificial Sequence
  Synthetic oligonucleotide
acccaaccttgactgtaacctccacactaccgtggga

SEQ ID NO: 69231 - DNA, 37 bp, Artificial Sequence
  Synthetic oligonucleotide
tcattgcccctcctaaatgcttacagccgttgctgga

SEQ ID NO: 69232 - DNA, 37 bp, Artificial Sequence
  Synthetic oligonucleotide
gcaatcccgtttctgcttttccgtcatcccttctgga

SEQ ID NO: 69233 - DNA, 37 bp, Artificial Sequence
  Synthetic oligonucleotide
gttacaccgcccggtgcactatatgtttaaacaatga

SEQ ID NO: 69234 - DNA, 37 bp, Artificial Sequence
  Synthetic oligonucleotide
tctagccgtacaatagagtcaacctgcacctccatga

SEQ ID NO: 69235 - DNA, 38 bp, Artificial Sequence
  Synthetic oligonucleotide
tcgctattgccgccccactccgccatccttcagcatga

SEQ ID NO: 69236 - DNA, 38 bp, Artificial Sequence
  Synthetic oligonucleotide
gaggaggctgcaaggggggaccggggacgcaatgatga

SEQ ID NO: 69237 - DNA, 38 bp, Artificial Sequence
  Synthetic oligonucleotide
gaacctcgcgcaacatcgttcttgagctctcgttatga

SEQ ID NO: 69238 - DNA, 37 bp, Artificial Sequence
  Synthetic oligonucleotide
tatgtgccgcctagcctcctgccatcaccttaactga

SEQ ID NO: 69239 - DNA, 38 bp, Artificial Sequence
  Synthetic oligonucleotide
tagtgcgtgagatagaggggttacagggatgggactga

SEQ ID NO: 69240 - DNA, 38 bp, Artificial Sequence
  Synthetic oligonucleotide
gagtgcgggtacgacgcgttctttaccacaaaacctga

SEQ ID NO: 69241 - DNA, 38 bp, Artificial Sequence
  Synthetic oligonucleotide
tctgctgaccactacgtctcttcatacacccggcctga

SEQ ID NO: 69242 - DNA, 38 bp, Artificial Sequence
  Synthetic oligonucleotide
tatcggagccacgtcgatgccattctgctctatcctga

SEQ ID NO: 69243 - DNA, 38 bp, Artificial Sequence
  Synthetic oligonucleotide
acgacaccccgcggtccttacgacgtacaacatgctga

SEQ ID NO: 69244 - DNA, 38 bp, Artificial Sequence
  Synthetic oligonucleotide
tccacgtcaaaccgccctgccacctacattcctgctga

SEQ ID NO: 69245 - DNA, 38 bp, Artificial Sequence
  Synthetic oligonucleotide
gtaacggggggtagggtatcactgcagcagctgagtga

SEQ ID NO: 69246 - DNA, 37 bp, Artificial Sequence
  Synthetic oligonucleotide
gtcgaatgacggagtttgcaaaggaaggcgcacgtga

SEQ ID NO: 69247 - DNA, 38 bp, Artificial Sequence
  Synthetic oligonucleotide
gggggacacgggtaaaaagcgagaggcaaaaatggtga

SEQ ID NO: 69248 - DNA, 37 bp, Artificial Sequence
  Synthetic oligonucleotide
gcgcatcaccgagtcgttagcccctcgtccatcttga

SEQ ID NO: 69249 - DNA, 38 bp, Artificial Sequence
  Synthetic oligonucleotide
acgcctggctccaaagtgttactgccaccaccatttga

SEQ ID NO: 69250 - DNA, 38 bp, Artificial Sequence
  Synthetic oligonucleotide
atcaacagaggaggagggagggaaaaaggtctatttga

SEQ ID NO: 69251 - DNA, 38 bp, Artificial Sequence
  Synthetic oligonucleotide
gcttgcagccggctcacgtccgcctttagtacctttga

SEQ ID NO: 69252 - DNA, 36 bp, Artificial Sequence
  Synthetic oligonucleotide
gatccccacctcattgactaggttgaccggttcata

SEQ ID NO: 69253 - DNA, 36 bp, Artificial Sequence
  Synthetic oligonucleotide
gtgggagggagggttgggctcagttgggaagttata

SEQ ID NO: 69254 - DNA, 35 bp, Artificial Sequence
  Synthetic oligonucleotide
gtgctaaatgctgcaccgcaatgaaactcatccta

SEQ ID NO: 69255 - DNA, 35 bp, Artificial Sequence
  Synthetic oligonucleotide
aatgccatttgcaccaccctataattcacaggcta

SEQ ID NO: 69256 - DNA, 36 bp, Artificial Sequence
  Synthetic oligonucleotide
gtcacaaggggggggtgtgaggacgggatgtatcta

SEQ ID NO: 69257 - DNA, 35 bp, Artificial Sequence
  Synthetic oligonucleotide
attagcaccgattccgtttcgcaccatcctatgta

SEQ ID NO: 69258 - DNA, 35 bp, Artificial Sequence
  Synthetic oligonucleotide
tacaacccgacgatatttcacacgtgttatgctta

SEQ ID NO: 69259 - DNA, 35 bp, Artificial Sequence
  Synthetic oligonucleotide
agttggccaacactgatctctcgttacttcacaac

SEQ ID NO: 69260 - DNA, 35 bp, Artificial Sequence
  Synthetic oligonucleotide
gcatcatctccactggtctctcgacatttccgaac

SEQ ID NO: 69261 - DNA, 35 bp, Artificial Sequence
  Synthetic oligonucleotide
gtatgcctcgcttttctcgctcatcagcaccacac

SEQ ID NO: 69262 - DNA, 35 bp, Artificial Sequence
  Synthetic oligonucleotide
gatggcccttcgcccttgggtctttagcataccac

SEQ ID NO: 69263 - DNA, 35 bp, Artificial Sequence
  Synthetic oligonucleotide
gctaccgctcatcctagcgccgactccactttcac

SEQ ID NO: 69264 - DNA, 36 bp, Artificial Sequence
  Synthetic oligonucleotide
tttgtcggccccccgctatgggctattatcccttac

SEQ ID NO: 69265 - DNA, 35 bp, Artificial Sequence
  Synthetic oligonucleotide
gagcgaaatgcactgcttggcataatatttgtacc

SEQ ID NO: 69266 - DNA, 35 bp, Artificial Sequence
  Synthetic oligonucleotide
atgagtacggcattgtttccacctctatctcgccc

SEQ ID NO: 69267 - DNA, 35 bp, Artificial Sequence
  Synthetic oligonucleotide
gtctgtccgttaccgcgttgtgacccgctaatccc

SEQ ID NO: 69268 - DNA, 35 bp, Artificial Sequence
  Synthetic oligonucleotide
atcgcctgggccggcccctactgctttttcgtgcc

SEQ ID NO: 69269 - DNA, 35 bp, Artificial Sequence
  Synthetic oligonucleotide
gtcgtgctcgctttcttactagccccaggccatcc

SEQ ID NO: 69270 - DNA, 35 bp, Artificial Sequence
  Synthetic oligonucleotide
aagactactcaccgctttgttgtcgttttctttcc

SEQ ID NO: 69271 - DNA, 35 bp, Artificial Sequence
  Synthetic oligonucleotide
tcacaccctcgcccaaaacaattctgcatgaacgc

SEQ ID NO: 69272 - DNA, 35 bp, Artificial Sequence
  Synthetic oligonucleotide
tcgtgagccatacgcgcaccttacacacccatggc

SEQ ID NO: 69273 - DNA, 35 bp, Artificial Sequence
  Synthetic oligonucleotide
gacgcacgtcctcaatacctccgatctcgatatgc

SEQ ID NO: 69274 - DNA, 34 bp, Artificial Sequence
  Synthetic oligonucleotide
tgcacgactgcttcccgcaactcgatacttctgc

SEQ ID NO: 69275 - DNA, 35 bp, Artificial Sequence
  Synthetic oligonucleotide
gtcggtgctcgcgatagccctcccctacttggctc

SEQ ID NO: 69276 - DNA, 35 bp, Artificial Sequence
  Synthetic oligonucleotide
agcgccattcgtattgttccgcctatccaacagtc

SEQ ID NO: 69277 - DNA, 35 bp, Artificial Sequence
  Synthetic oligonucleotide
tcatttcctcccttccttctgagactgttgatgtc

SEQ ID NO: 69278 - DNA, 35 bp, Artificial Sequence
  Synthetic oligonucleotide
tcgtacacctgcgaagttcaatttctccacctgtc

SEQ ID NO: 69279 - DNA, 34 bp, Artificial Sequence
  Synthetic oligonucleotide
gtcaacaccttgcactctacacctacccaccttc

SEQ ID NO: 69280 - DNA, 35 bp, Artificial Sequence
  Synthetic oligonucleotide
aaggtcgaccatgcccgcaccagattcctcccttc

SEQ ID NO: 69281 - DNA, 35 bp, Artificial Sequence
  Synthetic oligonucleotide
acccgatggtgctgcgattctagtgtccgtcctag

SEQ ID NO: 69282 - DNA, 34 bp, Artificial Sequence
  Synthetic oligonucleotide
tgaccgtcccccggcacgcctcctaagtttaacg

SEQ ID NO: 69283 - DNA, 35 bp, Artificial Sequence
  Synthetic oligonucleotide
acgttgaccagaagggtcttgtttcatccatgccg

SEQ ID NO: 69284 - DNA, 35 bp, Artificial Sequence
  Synthetic oligonucleotide
atatcgggcccacccagatctacccatagcctccg

SEQ ID NO: 69285 - DNA, 35 bp, Artificial Sequence
  Synthetic oligonucleotide
tgacgcagtctagttattctcagtaatcttttccg

SEQ ID NO: 69286 - DNA, 35 bp, Artificial Sequence
  Synthetic oligonucleotide
gggaggcgtgtgagggggggtgggacattgacgcg

SEQ ID NO: 69287 - DNA, 35 bp, Artificial Sequence
  Synthetic oligonucleotide
accttcccagtccgtagatacctcccgaagtttcg

SEQ ID NO: 69288 - DNA, 35 bp, Artificial Sequence
  Synthetic oligonucleotide
acctccaccgccgggtctggacaatggtcacactg

SEQ ID NO: 69289 - DNA, 35 bp, Artificial Sequence
  Synthetic oligonucleotide
gtagctgtgtccacaccgggtaccgccccctcttg

SEQ ID NO: 69290 - DNA, 35 bp, Artificial Sequence
  Synthetic oligonucleotide
acagtcggggtctgattgcctttctatcacttcat

SEQ ID NO: 69291 - DNA, 35 bp, Artificial Sequence
  Synthetic oligonucleotide
tcagagacaccatccttttgaaccatctcgtctat

SEQ ID NO: 69292 - DNA, 35 bp, Artificial Sequence
  Synthetic oligonucleotide
ttcactgggtccgagaatgttttgccccccaacct

SEQ ID NO: 69293 - DNA, 36 bp, Artificial Sequence
  Synthetic oligonucleotide
accgccccccccctcgtaaagaccatgctggcacct

SEQ ID NO: 69294 - DNA, 35 bp, Artificial Sequence
  Synthetic oligonucleotide
gacgtatccgcctacgtagtcattgaagctcctct

SEQ ID NO: 69295 - DNA, 35 bp, Artificial Sequence
  Synthetic oligonucleotide
ggggaggtcgtgtaagaggtgggatgggaggacgt

SEQ ID NO: 69296 - DNA, 35 bp, Artificial Sequence
  Synthetic oligonucleotide
gtgccacgctgccttctccgatccacaccccgggt

SEQ ID NO: 69297 - DNA, 35 bp, Artificial Sequence
  Synthetic oligonucleotide
gcgaatgtgcactgttcgtgtgatgccctctttgt

SEQ ID NO: 69298 - DNA, 35 bp, Artificial Sequence
  Synthetic oligonucleotide
gcaagcagaacaatttcggccgcctaatacacctt

SEQ ID NO: 69299 - DNA, 35 bp, Artificial Sequence
  Synthetic oligonucleotide
tgagacgcaggaggtacgcgtgtgcgggtaatttt

SEQ ID NO: 69300 - DNA, 36 bp, Artificial Sequence
  Synthetic oligonucleotide
tgcataggcctcccatcccagattcagttcggcaaa

SEQ ID NO: 69301 - DNA, 36 bp, Artificial Sequence
  Synthetic oligonucleotide
gtagacttcctccccgataggtatatcctgcccgaa

SEQ ID NO: 69302 - DNA, 38 bp, Artificial Sequence
  Synthetic oligonucleotide
tacagaagggacggttgcggagggcatgaacaggggaa

SEQ ID NO: 69303 - DNA, 36 bp, Artificial Sequence
  Synthetic oligonucleotide
tcacacaggtccctgcaccgccgttttctgcactaa

SEQ ID NO: 69304 - DNA, 36 bp, Artificial Sequence
  Synthetic oligonucleotide
gccattggcccccatccccgctatttcatcaagaca

SEQ ID NO: 69305 - DNA, 36 bp, Artificial Sequence
  Synthetic oligonucleotide
atactcccccttcgagagtgcattctgccttttaca

SEQ ID NO: 69306 - DNA, 35 bp, Artificial Sequence
  Synthetic oligonucleotide
tcccgtgagggcatactcgacctgaactcatacca

SEQ ID NO: 69307 - DNA, 35 bp, Artificial Sequence
  Synthetic oligonucleotide
acacgcagttggactcacggcaaactgctaaccca

SEQ ID NO: 69308 - DNA, 36 bp, Artificial Sequence
  Synthetic oligonucleotide
gtctccgcataactactgcactccactcgctagcca

SEQ ID NO: 69309 - DNA, 36 bp, Artificial Sequence
  Synthetic oligonucleotide
tcccccacaaagaccgtaatagtttcgaccggtcca

SEQ ID NO: 69310 - DNA, 35 bp, Artificial Sequence
  Synthetic oligonucleotide
aaagcgtgagttagtgggaggctgggggaagggca

SEQ ID NO: 69311 - DNA, 35 bp, Artificial Sequence
  Synthetic oligonucleotide
ggacacacggcctgaagcttctcaaaatgttctca

SEQ ID NO: 69312 - DNA, 36 bp, Artificial Sequence
  Synthetic oligonucleotide
gactcatgtctggtcagaacccccttctcttagtca

SEQ ID NO: 69313 - DNA, 37 bp, Artificial Sequence
  Synthetic oligonucleotide
ggacaagggggaggaaccgtgtcggggtacaattaga

SEQ ID NO: 69314 - DNA, 37 bp, Artificial Sequence
  Synthetic oligonucleotide
gcaaactcgcccaccccgcatccctctcgctggccga

SEQ ID NO: 69315 - DNA, 35 bp, Artificial Sequence
  Synthetic oligonucleotide
taacgacgcggccagctccccgtacccggttccga

SEQ ID NO: 69316 - DNA, 37 bp, Artificial Sequence
  Synthetic oligonucleotide
gactcgcccaacctacgtccatcccgtaatgttccga

SEQ ID NO: 69317 - DNA, 37 bp, Artificial Sequence
  Synthetic oligonucleotide
aaccccgcaccacacactcagcagccgaccttcgcga

SEQ ID NO: 69318 - DNA, 36 bp, Artificial Sequence
  Synthetic oligonucleotide
gtcttgagcgcgggacctgccttccatcatctgcga

SEQ ID NO: 69319 - DNA, 36 bp, Artificial Sequence
  Synthetic oligonucleotide
taatgcgcaatcttcccctggtctgcggtccttcga

SEQ ID NO: 69320 - DNA, 37 bp, Artificial Sequence
  Synthetic oligonucleotide
ccgcgactggacggcacgttggcctcccccgcttcga

SEQ ID NO: 69321 - DNA, 37 bp, Artificial Sequence
  Synthetic oligonucleotide
aatacccgcgctaccggtttcgcagtctccgtttcga

SEQ ID NO: 69322 - DNA, 37 bp, Artificial Sequence
  Synthetic oligonucleotide
gtgggggtataagggaggggttccccgaggggaagga

SEQ ID NO: 69323 - DNA, 37 bp, Artificial Sequence
  Synthetic oligonucleotide
gcgagagcgcggaagaaacacctaactcacatgagga

SEQ ID NO: 69324 - DNA, 37 bp, Artificial Sequence
  Synthetic oligonucleotide
gcaccccacaccgcctattagtgcgtcacgcaaggga

SEQ ID NO: 69325 - DNA, 36 bp, Artificial Sequence
  Synthetic oligonucleotide
aagtcaaactgggatagggaaggtagtaggcgtgga

SEQ ID NO: 69326 - DNA, 36 bp, Artificial Sequence
  Synthetic oligonucleotide
gacaggggtggatgatgaggtagtggatggtaatga

SEQ ID NO: 69327 - DNA, 38 bp, Artificial Sequence
  Synthetic oligonucleotide
gagggaaggaggggagtaagtaattcattcgttaatga

SEQ ID NO: 69328 - DNA, 38 bp, Artificial Sequence
  Synthetic oligonucleotide
aacgatgcccgtagggtaggaggaggagtggtgcatga

SEQ ID NO: 69329 - DNA, 38 bp, Artificial Sequence
  Synthetic oligonucleotide
tatcacccatcccggctagagcgttacagtctggatga

SEQ ID NO: 69330 - DNA, 37 bp, Artificial Sequence
  Synthetic oligonucleotide
tagcccagtccgacctaaccagcttttatacctatga

SEQ ID NO: 69331 - DNA, 38 bp, Artificial Sequence
  Synthetic oligonucleotide
gacacccgcacagactctttatatatgtcaatgtatga

SEQ ID NO: 69332 - DNA, 37 bp, Artificial Sequence
  Synthetic oligonucleotide
gcggagcacccgtttcctcgctcctctgggattatga

SEQ ID NO: 69333 - DNA, 38 bp, Artificial Sequence
  Synthetic oligonucleotide
atctggcgggtggtagcaagagggagggtcgggactga

SEQ ID NO: 69334 - DNA, 38 bp, Artificial Sequence
  Synthetic oligonucleotide
tcccatactatccggcggccataccaagctgaccctga

SEQ ID NO: 69335 - DNA, 38 bp, Artificial Sequence
  Synthetic oligonucleotide
ggtaccagcccgtcccccccggtagtcccacctcctga

SEQ ID NO: 69336 - DNA, 38 bp, Artificial Sequence
  Synthetic oligonucleotide
tcagatgcctccactttttatatatattgtccccgtga

SEQ ID NO: 69337 - DNA, 38 bp, Artificial Sequence
  Synthetic oligonucleotide
gccgacaaagaaaaaacacgagagagtagagggggtga

SEQ ID NO: 69338 - DNA, 38 bp, Artificial Sequence
  Synthetic oligonucleotide
cctggggcgggtggggtggagagcctactttggggtga

SEQ ID NO: 69339 - DNA, 37 bp, Artificial Sequence
  Synthetic oligonucleotide
tgccgtgccggcttgctttccgtttttcacttggtga

SEQ ID NO: 69340 - DNA, 38 bp, Artificial Sequence
  Synthetic oligonucleotide
acgcataggcaactggaactaatgtacgatcttggtga

SEQ ID NO: 69341 - DNA, 38 bp, Artificial Sequence
  Synthetic oligonucleotide
ggacacgttcggcctagatccctgacgctgctctgtga

SEQ ID NO: 69342 - DNA, 37 bp, Artificial Sequence
  Synthetic oligonucleotide
tcccacatacatcaaattagctcactgactcgtgtga

SEQ ID NO: 69343 - DNA, 37 bp, Artificial Sequence
  Synthetic oligonucleotide
aaccgccctctcgctgccctctattcagagcgattga

SEQ ID NO: 69344 - DNA, 37 bp, Artificial Sequence
  Synthetic oligonucleotide
atgacgggaggtggtgtggtcgcgcgtgttgtattga

SEQ ID NO: 69345 - DNA, 38 bp, Artificial Sequence
  Synthetic oligonucleotide
accgtgaccccgaccgtttatgcccgatacttagttga

SEQ ID NO: 69346 - DNA, 38 bp, Artificial Sequence
  Synthetic oligonucleotide
tgctacattcccgaggtcctgtctgtggccacttttga

SEQ ID NO: 69347 - DNA, 35 bp, Artificial Sequence
  Synthetic oligonucleotide
tcctaccccggtgctgtaattcgaggcaacggata

SEQ ID NO: 69348 - DNA, 36 bp, Artificial Sequence
  Synthetic oligonucleotide
gccccccagctctgcaatctttatccgggtcgacta

SEQ ID NO: 69349 - DNA, 36 bp, Artificial Sequence
  Synthetic oligonucleotide
tccaaccgccaactttcgataagtcatttagtacta

SEQ ID NO: 69350 - DNA, 35 bp, Artificial Sequence
  Synthetic oligonucleotide
gaacccccagaaggggtcaagccccctcacctcta

SEQ ID NO: 69351 - DNA, 36 bp, Artificial Sequence
  Synthetic oligonucleotide
tatcgcccccgttcgactctttgggttatcgctcta

SEQ ID NO: 69352 - DNA, 36 bp, Artificial Sequence
  Synthetic oligonucleotide
agtgaagggcacgctgctgattttgggtcttttgta

SEQ ID NO: 69353 - DNA, 35 bp, Artificial Sequence
  Synthetic oligonucleotide
acctgcaagcaggtcgcccagcacgaaccatttta

SEQ ID NO: 69354 - DNA, 35 bp, Artificial Sequence
  Synthetic oligonucleotide
ggtggaagtcgtacggaagggtggtgcaggtcgac

SEQ ID NO: 69355 - DNA, 35 bp, Artificial Sequence
  Synthetic oligonucleotide
ttcgtacaacttcacccgccgttccattcaatgac

SEQ ID NO: 69356 - DNA, 35 bp, Artificial Sequence
  Synthetic oligonucleotide
ccgtttcatcagcgactgcccttactgtcaacacc

SEQ ID NO: 69357 - DNA, 35 bp, Artificial Sequence
  Synthetic oligonucleotide
gtaccgcaatccatatctcgttaattcttctcacc

SEQ ID NO: 69358 - DNA, 35 bp, Artificial Sequence
  Synthetic oligonucleotide
tcacagcatacataactgttcaaactctctacccc

SEQ ID NO: 69359 - DNA, 35 bp, Artificial Sequence
  Synthetic oligonucleotide
accaatgtaggcctgacatgccctgaaattccccc

SEQ ID NO: 69360 - DNA, 35 bp, Artificial Sequence
  Synthetic oligonucleotide
tacgacctccattcacgtatgccttctagaccgcc

SEQ ID NO: 69361 - DNA, 35 bp, Artificial Sequence
  Synthetic oligonucleotide
acccgccctcacagtcttccacgcgtgccgcctcc

SEQ ID NO: 69362 - DNA, 35 bp, Artificial Sequence
  Synthetic oligonucleotide
aactgccgtgaacgcctcatataacgagttcctcc

SEQ ID NO: 69363 - DNA, 35 bp, Artificial Sequence
  Synthetic oligonucleotide
aaccatggtcacatgcagcgaatcccctagtccgc

SEQ ID NO: 69364 - DNA, 35 bp, Artificial Sequence
  Synthetic oligonucleotide
gccgagagcaccctcctcttataacccctcaaggc

SEQ ID NO: 69365 - DNA, 35 bp, Artificial Sequence
  Synthetic oligonucleotide
tccccgatcggttatatgcaaattggcctgtttgc

SEQ ID NO: 69366 - DNA, 35 bp, Artificial Sequence
  Synthetic oligonucleotide
tcccgccgccttgtttttttgttccgtcgtcactc

SEQ ID NO: 69367 - DNA, 35 bp, Artificial Sequence
  Synthetic oligonucleotide
tacaccgtcctcgctatacatccgaacagtcagag

SEQ ID NO: 69368 - DNA, 35 bp, Artificial Sequence
  Synthetic oligonucleotide
tgaggaatgagagcaggacataggggaggccggag

SEQ ID NO: 69369 - DNA, 35 bp, Artificial Sequence
  Synthetic oligonucleotide
accctatcaccagagagcctcaaaactacattccg

SEQ ID NO: 69370 - DNA, 35 bp, Artificial Sequence
  Synthetic oligonucleotide
tcagtctgctggctcgcgaaccttcatatttctgg

SEQ ID NO: 69371 - DNA, 35 bp, Artificial Sequence
  Synthetic oligonucleotide
gcagggcgaagagaagggggggtttgcgaagcgtg

SEQ ID NO: 69372 - DNA, 35 bp, Artificial Sequence
  Synthetic oligonucleotide
gccccgcttgaaaccgatacgacgcctaacaattg

SEQ ID NO: 69373 - DNA, 35 bp, Artificial Sequence
  Synthetic oligonucleotide
tgcgacaccacacgggtcttaatgcaacacaccat

SEQ ID NO: 69374 - DNA, 35 bp, Artificial Sequence
  Synthetic oligonucleotide
actagacggcggagaggggggggtgggaatccgat

SEQ ID NO: 69375 - DNA, 35 bp, Artificial Sequence
  Synthetic oligonucleotide
ttgggattggggtggttaggaaaaggaggccggat

SEQ ID NO: 69376 - DNA, 35 bp, Artificial Sequence
  Synthetic oligonucleotide
gtatgtaccgccgtttttgaactccccgaccttat

SEQ ID NO: 69377 - DNA, 35 bp, Artificial Sequence
  Synthetic oligonucleotide
gccatacagcatttcccatcggcgttattagccct

SEQ ID NO: 69378 - DNA, 35 bp, Artificial Sequence
  Synthetic oligonucleotide
gattgcccccctgactacgtgaacgcccgttgcct

SEQ ID NO: 69379 - DNA, 35 bp, Artificial Sequence
  Synthetic oligonucleotide
gtaggcccattatcgtcgctgccgccacaaccgct

SEQ ID NO: 69380 - DNA, 35 bp, Artificial Sequence
  Synthetic oligonucleotide
aattcacgttctacgtccttctgctcgatccatct

SEQ ID NO: 69381 - DNA, 35 bp, Artificial Sequence
  Synthetic oligonucleotide
aacaggcgggccccgagcgcccctagaccctctct

SEQ ID NO: 69382 - DNA, 35 bp, Artificial Sequence
  Synthetic oligonucleotide
gttgcgccctcgcctttagggctcctgttatcatt

SEQ ID NO: 69383 - DNA, 35 bp, Artificial Sequence
  Synthetic oligonucleotide
tgaaccgccctgggttgttgctttcgttttgactt

SEQ ID NO: 69384 - DNA, 35 bp, Artificial Sequence
  Synthetic oligonucleotide
gttcattcaccgatctacaggcttgtacaaccctt

SEQ ID NO: 69385 - DNA, 35 bp, Artificial Sequence
  Synthetic oligonucleotide
atctggcgggttctcgtaccagccttccgttcctt

SEQ ID NO: 69386 - DNA, 35 bp, Artificial Sequence
  Synthetic oligonucleotide
gttgactccgcaggccgtcgttaaccgttccgctt

SEQ ID NO: 69387 - DNA, 35 bp, Artificial Sequence
  Synthetic oligonucleotide
tgttgagcatcaggggggcaagggtgggcttggtt

SEQ ID NO: 69388 - DNA, 35 bp, Artificial Sequence
  Synthetic oligonucleotide
ggttgggtgcggagcggggtttacgggctgagttt

SEQ ID NO: 69389 - DNA, 36 bp, Artificial Sequence
  Synthetic oligonucleotide
actgatgcccttctgcctcctctaattgtacgccaa

SEQ ID NO: 69390 - DNA, 36 bp, Artificial Sequence
  Synthetic oligonucleotide
gtcacactgacatcgggcacgtcgtctattcctcaa

SEQ ID NO: 69391 - DNA, 36 bp, Artificial Sequence
  Synthetic oligonucleotide
gaacgtgggggcatggcgactggtacgtaaccgtaa

SEQ ID NO: 69392 - DNA, 35 bp, Artificial Sequence
  Synthetic oligonucleotide
gttagccatatgccacaatggccactttcctgtaa

SEQ ID NO: 69393 - DNA, 36 bp, Artificial Sequence
  Synthetic oligonucleotide
gactacgtgcgcaatgctcagaaccgcactagtaca

SEQ ID NO: 69394 - DNA, 36 bp, Artificial Sequence
  Synthetic oligonucleotide
tatcgcctctcttttcccgtttggtaccaatgtaca

SEQ ID NO: 69395 - DNA, 33 bp, Artificial Sequence
  Synthetic oligonucleotide
tgcaatagccccataacgcgtattccggttaca

SEQ ID NO: 69396 - DNA, 36 bp, Artificial Sequence
  Synthetic oligonucleotide
gctggctccatggtgatagcaactcacactcgccca

SEQ ID NO: 69397 - DNA, 36 bp, Artificial Sequence
  Synthetic oligonucleotide
gtgagtttgtcccacccgacccagcgaccctcgcca

SEQ ID NO: 69398 - DNA, 36 bp, Artificial Sequence
  Synthetic oligonucleotide
ttgtatcgccacgtcgtccttttggttggtggtcca

SEQ ID NO: 69399 - DNA, 36 bp, Artificial Sequence
  Synthetic oligonucleotide
gtacaccccgtaaccggctcattggtacctacatca

SEQ ID NO: 69400 - DNA, 36 bp, Artificial Sequence
  Synthetic oligonucleotide
atccatctgcgcactggtgcctatactggctcatca

SEQ ID NO: 69401 - DNA, 35 bp, Artificial Sequence
  Synthetic oligonucleotide
gtacccacaccactcctcgctgtttacagtcaaga

SEQ ID NO: 69402 - DNA, 37 bp, Artificial Sequence
  Synthetic oligonucleotide
accgatcgggaaagagtagaaggtgggggggggcaga

SEQ ID NO: 69403 - DNA, 37 bp, Artificial Sequence
  Synthetic oligonucleotide
gaccaccccacatcagcccgcatggtaccaggcacga

SEQ ID NO: 69404 - DNA, 35 bp, Artificial Sequence
  Synthetic oligonucleotide
acacgactccatgtcacggtatttcactccaccga

SEQ ID NO: 69405 - DNA, 37 bp, Artificial Sequence
  Synthetic oligonucleotide
gtagccaccagctttaacagacgtatcacacccccga

SEQ ID NO: 69406 - DNA, 35 bp, Artificial Sequence
  Synthetic oligonucleotide
gtcacctgcatgccatttttgtggcacccctccga

SEQ ID NO: 69407 - DNA, 37 bp, Artificial Sequence
  Synthetic oligonucleotide
ataacaccatgtcgcgacgtatattgccctcctccga

SEQ ID NO: 69408 - DNA, 37 bp, Artificial Sequence
  Synthetic oligonucleotide
tgaccccctctcggtatgttctcgcttgaatttgcga

SEQ ID NO: 69409 - DNA, 37 bp, Artificial Sequence
  Synthetic oligonucleotide
ttaccgccactcgaactcttaatccgcgaccgctcga

SEQ ID NO: 69410 - DNA, 37 bp, Artificial Sequence
  Synthetic oligonucleotide
tgtcggatatggagggtaagggtcgagtaggaaagga

SEQ ID NO: 69411 - DNA, 35 bp, Artificial Sequence
  Synthetic oligonucleotide
gtgcccaactacacgtgcctaacatcttttaagga

SEQ ID NO: 69412 - DNA, 35 bp, Artificial Sequence
  Synthetic oligonucleotide
tgactcgccctactctccgcactctcagccgagga

SEQ ID NO: 69413 - DNA, 35 bp, Artificial Sequence
  Synthetic oligonucleotide
tgagaggggcatgggcgaaaaagggaaaccgggga

SEQ ID NO: 69414 - DNA, 37 bp, Artificial Sequence
  Synthetic oligonucleotide
agagggggagggttactgatcggattcgggggctgga

SEQ ID NO: 69415 - DNA, 37 bp, Artificial Sequence
  Synthetic oligonucleotide
tctcaacctccgggccatcccgcagtctgactctgga

SEQ ID NO: 69416 - DNA, 37 bp, Artificial Sequence
  Synthetic oligonucleotide
gcacaggtaccccgaccttacgaccgttttccttgga

SEQ ID NO: 69417 - DNA, 37 bp, Artificial Sequence
  Synthetic oligonucleotide
gacatcgggctcaatcctcgtcgtcctgtctgttgga

SEQ ID NO: 69418 - DNA, 37 bp, Artificial Sequence
  Synthetic oligonucleotide
accagcgcaaggccaccggtctcgcttacctacatga

SEQ ID NO: 69419 - DNA, 37 bp, Artificial Sequence
  Synthetic oligonucleotide
tctcgctacccacctcgtgattgcaccgctcccatga

SEQ ID NO: 69420 - DNA, 38 bp, Artificial Sequence
  Synthetic oligonucleotide
tgcacctccgacccttgtgcctaaacccgtttagatga

SEQ ID NO: 69421 - DNA, 37 bp, Artificial Sequence
  Synthetic oligonucleotide
ggtagtgagttcggggggaggaagaacgaggtgatga

SEQ ID NO: 69422 - DNA, 37 bp, Artificial Sequence
  Synthetic oligonucleotide
gatggatgggaagggggtcgtcggtgattgtgtatga

SEQ ID NO: 69423 - DNA, 38 bp, Artificial Sequence
  Synthetic oligonucleotide
gagtaacgccatgtccctaactatcttcacacttatga

SEQ ID NO: 69424 - DNA, 38 bp, Artificial Sequence
  Synthetic oligonucleotide
tgtaaaccgccgatagcagaaaacacgcacactactga

SEQ ID NO: 69425 - DNA, 38 bp, Artificial Sequence
  Synthetic oligonucleotide
tgtatagctggcccttctatctaacgacctcctactga

SEQ ID NO: 69426 - DNA, 36 bp, Artificial Sequence
  Synthetic oligonucleotide
gggaccgctccaaaatcgctacacgtctctccctga

SEQ ID NO: 69427 - DNA, 38 bp, Artificial Sequence
  Synthetic oligonucleotide
ggttgccctcaatcgcgcattcatctatggttccctga

SEQ ID NO: 69428 - DNA, 38 bp, Artificial Sequence
  Synthetic oligonucleotide
gggggcgggtgtggtgggggttctcgctaaacgcctga

SEQ ID NO: 69429 - DNA, 36 bp, Artificial Sequence
  Synthetic oligonucleotide
tactgccacgtggacccaccgacgtcttctgcctga

SEQ ID NO: 69430 - DNA, 38 bp, Artificial Sequence
  Synthetic oligonucleotide
aaccacggaaagggggggaaaagaaataggagatctga

SEQ ID NO: 69431 - DNA, 37 bp, Artificial Sequence
  Synthetic oligonucleotide
gtcaagtgagggggattgagatatgggagggaagtga

SEQ ID NO: 69432 - DNA, 38 bp, Artificial Sequence
  Synthetic oligonucleotide
tgagggggggcatcgggtgcggtcggaatcaggggtga

SEQ ID NO: 69433 - DNA, 37 bp, Artificial Sequence
  Synthetic oligonucleotide
agtgaaggaggggaaggggaatcgactgaggcgttga

SEQ ID NO: 69434 - DNA, 38 bp, Artificial Sequence
  Synthetic oligonucleotide
tacacaacccggctgtatcgaactacgcttttatttga

SEQ ID NO: 69435 - DNA, 38 bp, Artificial Sequence
  Synthetic oligonucleotide
tgttccacgctctcgagctatgctcacctgccttttga

SEQ ID NO: 69436 - DNA, 36 bp, Artificial Sequence
  Synthetic oligonucleotide
ggtgaagtcggaatagggtttggaaaaggggaacta

SEQ ID NO: 69437 - DNA, 36 bp, Artificial Sequence
  Synthetic oligonucleotide
tgacacgcaaacgctactcttctcgaatcgtaccta

SEQ ID NO: 69438 - DNA, 36 bp, Artificial Sequence
  Synthetic oligonucleotide
gccaaacaggccggctccccaacccagttagtatta

SEQ ID NO: 69439 - DNA, 36 bp, Artificial Sequence
  Synthetic oligonucleotide
acctccctgcctccctccttattcgggacagagtta

SEQ ID NO: 69440 - DNA, 36 bp, Artificial Sequence
  Synthetic oligonucleotide
cagttagcgtaggagggggaataggtcggatattta

SEQ ID NO: 69441 - DNA, 35 bp, Artificial Sequence
  Synthetic oligonucleotide
tgcccccaccttgtgtctgcaacgcccagtccaac

SEQ ID NO: 69442 - DNA, 34 bp, Artificial Sequence
  Synthetic oligonucleotide
gccgtcactcgcacacgcctgtgtttcctctcac

SEQ ID NO: 69443 - DNA, 35 bp, Artificial Sequence
  Synthetic oligonucleotide
tcccagacgagccccgatgccgcctgcctaccgac

SEQ ID NO: 69444 - DNA, 35 bp, Artificial Sequence
  Synthetic oligonucleotide
gtaccagccgctaaatctggcaataatcgtggccc

SEQ ID NO: 69445 - DNA, 35 bp, Artificial Sequence
  Synthetic oligonucleotide
tctcgatggcggtcgtcctcgctagtttttttccc

SEQ ID NO: 69446 - DNA, 35 bp, Artificial Sequence
  Synthetic oligonucleotide
accgacggccgggggaagggtgttggtgactagcc

SEQ ID NO: 69447 - DNA, 35 bp, Artificial Sequence
  Synthetic oligonucleotide
gcaccccgtcattcagcgtaactcagatcatggcc

SEQ ID NO: 69448 - DNA, 35 bp, Artificial Sequence
  Synthetic oligonucleotide
acacatcattggtagttcattgacatcaccggtcc

SEQ ID NO: 69449 - DNA, 35 bp, Artificial Sequence
  Synthetic oligonucleotide
agctcgccagaactgtggtaacgttcttttcttcc

SEQ ID NO: 69450 - DNA, 35 bp, Artificial Sequence
  Synthetic oligonucleotide
tacggtccccaacaacttaacgatacgcctactgc

SEQ ID NO: 69451 - DNA, 35 bp, Artificial Sequence
  Synthetic oligonucleotide
attggaatccgttgctgccctgtgtcttttgctgc

SEQ ID NO: 69452 - DNA, 35 bp, Artificial Sequence
  Synthetic oligonucleotide
tctccaattggtctctttgctgtcatcctgtcatc

SEQ ID NO: 69453 - DNA, 35 bp, Artificial Sequence
  Synthetic oligonucleotide
taccgcgcaagctccaacgaatagcccgttgcctc

SEQ ID NO: 69454 - DNA, 35 bp, Artificial Sequence
  Synthetic oligonucleotide
aggacggggacacagcctggggtcacttacttctc

SEQ ID NO: 69455 - DNA, 35 bp, Artificial Sequence
  Synthetic oligonucleotide
gttcacgcgctcatttcattgcttgtacgttcttc

SEQ ID NO: 69456 - DNA, 35 bp, Artificial Sequence
  Synthetic oligonucleotide
gtccagccaacccgctcacacctttatgctcatag

SEQ ID NO: 69457 - DNA, 35 bp, Artificial Sequence
  Synthetic oligonucleotide
aaccgagatactcacctgcccaaccgctctgcttg

SEQ ID NO: 69458 - DNA, 35 bp, Artificial Sequence
  Synthetic oligonucleotide
tgccatctccgttctctcggttttccttggttcat

SEQ ID NO: 69459 - DNA, 35 bp, Artificial Sequence
  Synthetic oligonucleotide
gcgaaggtgcggatgggaattaccggggttgggat

SEQ ID NO: 69460 - DNA, 35 bp, Artificial Sequence
  Synthetic oligonucleotide
acgtcgccacgtacggaggactacccccctgctat

SEQ ID NO: 69461 - DNA, 35 bp, Artificial Sequence
  Synthetic oligonucleotide
actcgatccggtgtcattcgcccctctgaatacct

SEQ ID NO: 69462 - DNA, 35 bp, Artificial Sequence
  Synthetic oligonucleotide
tacagaccgtgcggagcgttctttcgctcctacct

SEQ ID NO: 69463 - DNA, 35 bp, Artificial Sequence
  Synthetic oligonucleotide
attcacacaaccgcctgagactgacctcaaatggt

SEQ ID NO: 69464 - DNA, 35 bp, Artificial Sequence
  Synthetic oligonucleotide
tatcgcacacccactcaagtgctccatcacttggt

SEQ ID NO: 69465 - DNA, 35 bp, Artificial Sequence
  Synthetic oligonucleotide
tctgacggatcactactggtaattggctctattgt

SEQ ID NO: 69466 - DNA, 35 bp, Artificial Sequence
  Synthetic oligonucleotide
actgttgcactccgttgacgcacctaccccctgtt

SEQ ID NO: 69467 - DNA, 35 bp, Artificial Sequence
  Synthetic oligonucleotide
atgggtggcaaaatgtagtacggcaagtggttgtt

SEQ ID NO: 69468 - DNA, 35 bp, Artificial Sequence
  Synthetic oligonucleotide
gccacggacacccccgccgaatacacgatgcacaa

SEQ ID NO: 69469 - DNA, 36 bp, Artificial Sequence
  Synthetic oligonucleotide
gtcaactggctgtgattcacccatcctacgctccaa

SEQ ID NO: 69470 - DNA, 36 bp, Artificial Sequence
  Synthetic oligonucleotide
tcctgggatcgcgccctcatcgtcgtcttatactaa

SEQ ID NO: 69471 - DNA, 36 bp, Artificial Sequence
  Synthetic oligonucleotide
gtatcgcccggtgcattcatagtccataattcctaa

SEQ ID NO: 69472 - DNA, 35 bp, Artificial Sequence
  Synthetic oligonucleotide
aagtgcacgccccacgctctgacgctgttaacaca

SEQ ID NO: 69473 - DNA, 36 bp, Artificial Sequence
  Synthetic oligonucleotide
gcccgcactaaccgaacagcgcaacttaccgcgaca

SEQ ID NO: 69474 - DNA, 36 bp, Artificial Sequence
  Synthetic oligonucleotide
tcacactgaggcttatactcgatcataactgctcca

SEQ ID NO: 69475 - DNA, 36 bp, Artificial Sequence
  Synthetic oligonucleotide
gatcatgcggctgctcctccgttaaaagccttggca

SEQ ID NO: 69476 - DNA, 35 bp, Artificial Sequence
  Synthetic oligonucleotide
tgacgttacacagatacctgcgctctctcactgca

SEQ ID NO: 69477 - DNA, 36 bp, Artificial Sequence
  Synthetic oligonucleotide
ggacccatgactatggtacgattccgaactctatca

SEQ ID NO: 69478 - DNA, 35 bp, Artificial Sequence
  Synthetic oligonucleotide
tagaggcacctgggctctcgttccctaccgtatca

SEQ ID NO: 69479 - DNA, 36 bp, Artificial Sequence
  Synthetic oligonucleotide
tgtgccttgtggttcattttgctgcaccttaattca

SEQ ID NO: 69480 - DNA, 35 bp, Artificial Sequence
  Synthetic oligonucleotide
gtggaccttcagccgtaggtccaccccctacttca

SEQ ID NO: 69481 - DNA, 36 bp, Artificial Sequence
  Synthetic oligonucleotide
gatgccccatatagtacgataccaggtggtacttca

SEQ ID NO: 69482 - DNA, 35 bp, Artificial Sequence
  Synthetic oligonucleotide
tgacccatctgtcgcagtatagtgaatccgtttca

SEQ ID NO: 69483 - DNA, 37 bp, Artificial Sequence
  Synthetic oligonucleotide
ggggagccacgaggttagggggatggaaactggcaga

SEQ ID NO: 69484 - DNA, 35 bp, Artificial Sequence
  Synthetic oligonucleotide
gcagtcgggcgagacgggaacgagggtggatcaga

SEQ ID NO: 69485 - DNA, 37 bp, Artificial Sequence
  Synthetic oligonucleotide
gactgggaagggattacattaagagcataggagacga

SEQ ID NO: 69486 - DNA, 37 bp, Artificial Sequence
  Synthetic oligonucleotide
ccacaccgcctgcatattcgatccctctttgcgacga

SEQ ID NO: 69487 - DNA, 36 bp, Artificial Sequence
  Synthetic oligonucleotide
agtacggggcgggtgtgaaggtaaacacgcgtacga

SEQ ID NO: 69488 - DNA, 37 bp, Artificial Sequence
  Synthetic oligonucleotide
atccgcgaccggacacggcgctaaaacacattcccga

SEQ ID NO: 69489 - DNA, 35 bp, Artificial Sequence
  Synthetic oligonucleotide
aagcgggtgctgccggaagcatggggggaagccga

SEQ ID NO: 69490 - DNA, 37 bp, Artificial Sequence
  Synthetic oligonucleotide
tccatgctcccggactcgaattgcacacctatagcga

SEQ ID NO: 69491 - DNA, 37 bp, Artificial Sequence
  Synthetic oligonucleotide
gcgaagaacgctcacatgcccttatgtacatctgcga

SEQ ID NO: 69492 - DNA, 36 bp, Artificial Sequence
  Synthetic oligonucleotide
atgaccccttcctcgcaaccagaactgcccgtgcga

SEQ ID NO: 69493 - DNA, 37 bp, Artificial Sequence
  Synthetic oligonucleotide
tctaaccggcgctttaggccagcacccgactactcga

SEQ ID NO: 69494 - DNA, 37 bp, Artificial Sequence
  Synthetic oligonucleotide
tgacacacaaacgggttcgatccatctttgccctcga

SEQ ID NO: 69495 - DNA, 37 bp, Artificial Sequence
  Synthetic oligonucleotide
gaaatcgggttgaaaggagaaatggggggacacagga

SEQ ID NO: 69496 - DNA, 37 bp, Artificial Sequence
  Synthetic oligonucleotide
ttgaaccagagtgataagggtaaggggaggtcacgga

SEQ ID NO: 69497 - DNA, 37 bp, Artificial Sequence
  Synthetic oligonucleotide
gatgaccgcgaagagtcgacaggaggtcggagaggga

SEQ ID NO: 69498 - DNA, 37 bp, Artificial Sequence
  Synthetic oligonucleotide
aatcagagatgggggacaatgggaggtaagcgaggga

SEQ ID NO: 69499 - DNA, 37 bp, Artificial Sequence
  Synthetic oligonucleotide
gtccgcaacccgttctttgaattatgctgcctaggga

SEQ ID NO: 69500 - DNA, 35 bp, Artificial Sequence
  Synthetic oligonucleotide
gtacgtgccatccatctattttgcgttatcctgga

SEQ ID NO: 69501 - DNA, 36 bp, Artificial Sequence
  Synthetic oligonucleotide
tccctcggcagaacctctctgcttaccatggttgga

SEQ ID NO: 69502 - DNA, 38 bp, Artificial Sequence
  Synthetic oligonucleotide
tctgggtgggttagaatacgtacgtcgtcagccaatga

SEQ ID NO: 69503 - DNA, 38 bp, Artificial Sequence
  Synthetic oligonucleotide
tgtgacgcacgggaaggcaggtaggcactttaggatga

SEQ ID NO: 69504 - DNA, 35 bp, Artificial Sequence
  Synthetic oligonucleotide
acccgcgccttctgcatcatataccaccgctatga

SEQ ID NO: 69505 - DNA, 38 bp, Artificial Sequence
  Synthetic oligonucleotide
gggtgcgcatacgccgatacttacctgcccccaactga

SEQ ID NO: 69506 - DNA, 38 bp, Artificial Sequence
  Synthetic oligonucleotide
gcaatgcagggggataagggcgcggctacggtgactga

SEQ ID NO: 69507 - DNA, 38 bp, Artificial Sequence
  Synthetic oligonucleotide
gttgagctacgtagctgcgatggccttgggttccctga

SEQ ID NO: 69508 - DNA, 38 bp, Artificial Sequence
  Synthetic oligonucleotide
tgatacgcgaacccttgagctcttcatctgtctcctga

SEQ ID NO: 69509 - DNA, 37 bp, Artificial Sequence
  Synthetic oligonucleotide
acgatcgtccttggcgcgtaccaactatatctgctga

SEQ ID NO: 69510 - DNA, 38 bp, Artificial Sequence
  Synthetic oligonucleotide
ttcgcccatactcacgctctttcatagtgtacttctga

SEQ ID NO: 69511 - DNA, 38 bp, Artificial Sequence
  Synthetic oligonucleotide
acgcacgtacccccaggctgccagcctcttacgcgtga

SEQ ID NO: 69512 - DNA, 38 bp, Artificial Sequence
  Synthetic oligonucleotide
gagacaatacgagatggaatatgcggggaggcgggtga

SEQ ID NO: 69513 - DNA, 38 bp, Artificial Sequence
  Synthetic oligonucleotide
tgaaggggagctgaggaaaatgactctgcaagtggtga

SEQ ID NO: 69514 - DNA, 38 bp, Artificial Sequence
  Synthetic oligonucleotide
aaatgggaggagtaggatgggcccaataagggtggtga

SEQ ID NO: 69515 - DNA, 37 bp, Artificial Sequence
  Synthetic oligonucleotide
attgcccgggtaaggtacggaggggaaacacgtgtga

SEQ ID NO: 69516 - DNA, 38 bp, Artificial Sequence
  Synthetic oligonucleotide
gacactccacctgatgccttgaccaacacgacaattga

SEQ ID NO: 69517 - DNA, 38 bp, Artificial Sequence
  Synthetic oligonucleotide
agacaccatccgacccaccagctgtttttagtaattga

SEQ ID NO: 69518 - DNA, 38 bp, Artificial Sequence
  Synthetic oligonucleotide
attctcccgccactccactctatatgggatccacttga

SEQ ID NO: 69519 - DNA, 37 bp, Artificial Sequence
  Synthetic oligonucleotide
atgtgctaggtccgctgcgtctcttacctgatcttga

SEQ ID NO: 69520 - DNA, 38 bp, Artificial Sequence
  Synthetic oligonucleotide
gcctccatgtccagacgtgcatcttgtccctgcgttga

SEQ ID NO: 69521 - DNA, 38 bp, Artificial Sequence
  Synthetic oligonucleotide
attggcgatgcaagggggaaggaataggtgctcgttga

SEQ ID NO: 69522 - DNA, 38 bp, Artificial Sequence
  Synthetic oligonucleotide
tgacacgacggacgtgacccggtgcgctctcatgttga

SEQ ID NO: 69523 - DNA, 37 bp, Artificial Sequence
  Synthetic oligonucleotide
tgtgaacccgctttccctggcgccatgaaccttttga

SEQ ID NO: 69524 - DNA, 36 bp, Artificial Sequence
  Synthetic oligonucleotide
tacgcatccggtcgctgctgacatgcacgtttcata

SEQ ID NO: 69525 - DNA, 35 bp, Artificial Sequence
  Synthetic oligonucleotide
gagcggaccttgcctttctctgtggtctgggccta

SEQ ID NO: 69526 - DNA, 35 bp, Artificial Sequence
  Synthetic oligonucleotide
gacccatcagacagtaaagcgttctcgctctgcta

SEQ ID NO: 69527 - DNA, 36 bp, Artificial Sequence
  Synthetic oligonucleotide
gacacctttctgtatgcgccatctctgttcgtagta

SEQ ID NO: 69528 - DNA, 36 bp, Artificial Sequence
  Synthetic oligonucleotide
aaacccacgacttccgctgaaatgttcttttgctta

SEQ ID NO: 69529 - DNA, 36 bp, Artificial Sequence
  Synthetic oligonucleotide
atactccctcgtgcgtatgaccactcctcaacgtta

SEQ ID NO: 69530 - DNA, 35 bp, Artificial Sequence
  Synthetic oligonucleotide
tagctccatccatcatgtctgggctcgttaattta

SEQ ID NO: 69531 - DNA, 35 bp, Artificial Sequence
  Synthetic oligonucleotide
ggacgcctacacgaatccgcgagggacttgccaac

SEQ ID NO: 69532 - DNA, 35 bp, Artificial Sequence
  Synthetic oligonucleotide
gcccctctcccggtgtccgccaaactagaatcaac

SEQ ID NO: 69533 - DNA, 35 bp, Artificial Sequence
  Synthetic oligonucleotide
tccgtccaactcccgcgagctaggccacctttcac

SEQ ID NO: 69534 - DNA, 35 bp, Artificial Sequence
  Synthetic oligonucleotide
accgtccctcgataagcctgctcgcattactagcc

SEQ ID NO: 69535 - DNA, 35 bp, Artificial Sequence
  Synthetic oligonucleotide
gacagagcggaagctcacttatccctgtttacgcc

SEQ ID NO: 69536 - DNA, 35 bp, Artificial Sequence
  Synthetic oligonucleotide
tccaagtgcaagtgtaattcctcatcctctatgcc

SEQ ID NO: 69537 - DNA, 35 bp, Artificial Sequence
  Synthetic oligonucleotide
tgtcactgcagagcacacttctgttattagcctcc

SEQ ID NO: 69538 - DNA, 35 bp, Artificial Sequence
  Synthetic oligonucleotide
tgtagcgccggaaagctttcgctcgtccattctcc

SEQ ID NO: 69539 - DNA, 35 bp, Artificial Sequence
  Synthetic oligonucleotide
tcctcagtcgctggccttgcttgaactcactgtcc

SEQ ID NO: 69540 - DNA, 35 bp, Artificial Sequence
  Synthetic oligonucleotide
taccctcaaacgtcggcctctaagcacgcacccgc

SEQ ID NO: 69541 - DNA, 35 bp, Artificial Sequence
  Synthetic oligonucleotide
gtgtgatccaattcgggaggagtaaggaggacggc

SEQ ID NO: 69542 - DNA, 35 bp, Artificial Sequence
  Synthetic oligonucleotide
agtactctccggtcaactgccgctccaactagggc

SEQ ID NO: 69543 - DNA, 35 bp, Artificial Sequence
  Synthetic oligonucleotide
gatgcaactaaattaaccgttctgcctgctttggc

SEQ ID NO: 69544 - DNA, 35 bp, Artificial Sequence
  Synthetic oligonucleotide
gtttgatccgttgcttttccgtacgatatgtcctc

SEQ ID NO: 69545 - DNA, 35 bp, Artificial Sequence
  Synthetic oligonucleotide
acagcgcacacgttatcaccccttgagtttacttc

SEQ ID NO: 69546 - DNA, 35 bp, Artificial Sequence
  Synthetic oligonucleotide
cccacgttcccgtcccacttagatgcgccctgttc

SEQ ID NO: 69547 - DNA, 35 bp, Artificial Sequence
  Synthetic oligonucleotide
gacaggtccagcattatttgccctctcctcgaaag

SEQ ID NO: 69548 - DNA, 35 bp, Artificial Sequence
  Synthetic oligonucleotide
gcatcagggcgggcagggaactggagggttatgag

SEQ ID NO: 69549 - DNA, 35 bp, Artificial Sequence
  Synthetic oligonucleotide
gtcaactccaccctagttttgccagcccgggcacg

SEQ ID NO: 69550 - DNA, 35 bp, Artificial Sequence
  Synthetic oligonucleotide
ttcgtatttcaccccacgccccgattgtttccccg

SEQ ID NO: 69551 - DNA, 35 bp, Artificial Sequence
  Synthetic oligonucleotide
gcaacccttccgaactcagctcatttgctgggccg

SEQ ID NO: 69552 - DNA, 35 bp, Artificial Sequence
  Synthetic oligonucleotide
tcaccctcatgtgccgtagcgtacccaactgtccg

SEQ ID NO: 69553 - DNA, 35 bp, Artificial Sequence
  Synthetic oligonucleotide
tgttctgctccaagttaccgaccacacacatcgcg

SEQ ID NO: 69554 - DNA, 35 bp, Artificial Sequence
  Synthetic oligonucleotide
aaggtgcatgccgtactatacctctcctcatgggg

SEQ ID NO: 69555 - DNA, 35 bp, Artificial Sequence
  Synthetic oligonucleotide
gacccttccgcacggtgttcaatcctcttggcatg

SEQ ID NO: 69556 - DNA, 35 bp, Artificial Sequence
  Synthetic oligonucleotide
ggatcatcactccacggggcacaaggggccatcat

SEQ ID NO: 69557 - DNA, 35 bp, Artificial Sequence
  Synthetic oligonucleotide
tctggaacctcggtgtcgccctcttcgaatttact

SEQ ID NO: 69558 - DNA, 35 bp, Artificial Sequence
  Synthetic oligonucleotide
tggtctcccgcacataacctctggccgccatacct

SEQ ID NO: 69559 - DNA, 35 bp, Artificial Sequence
  Synthetic oligonucleotide
ggaagggggggggtggatgcaggaactatgcggct

SEQ ID NO: 69560 - DNA, 35 bp, Artificial Sequence
  Synthetic oligonucleotide
tttgtagcggaaatggttacaatctgccttcatct

SEQ ID NO: 69561 - DNA, 35 bp, Artificial Sequence
  Synthetic oligonucleotide
taacactagctcccgctggacgttctgtacgctct

SEQ ID NO: 69562 - DNA, 35 bp, Artificial Sequence
  Synthetic oligonucleotide
aaacacgtctggccttatcctagctgcaatcgagt

SEQ ID NO: 69563 - DNA, 35 bp, Artificial Sequence
  Synthetic oligonucleotide
tccacaacttactgctcgtgaatgatgttctccgt

SEQ ID NO: 69564 - DNA, 35 bp, Artificial Sequence
  Synthetic oligonucleotide
acttcacagaccccgccgttccaccttaccagtgt

SEQ ID NO: 69565 - DNA, 35 bp, Artificial Sequence
  Synthetic oligonucleotide
ctgcaggacactgacggcaccccatcgcagcttgt

SEQ ID NO: 69566 - DNA, 35 bp, Artificial Sequence
  Synthetic oligonucleotide
gggtggtgccgaaatctggtttgcgcattcttgtt

SEQ ID NO: 69567 - DNA, 35 bp, Artificial Sequence
  Synthetic oligonucleotide
gaccgcaaaaagggttaacaggtgggatcatgttt

SEQ ID NO: 69568 - DNA, 33 bp, Artificial Sequence
  Synthetic oligonucleotide
tgtacgttgccgcgatcctgggactttcctttt

SEQ ID NO: 69569 - DNA, 36 bp, Artificial Sequence
  Synthetic oligonucleotide
tctccgccaccagcaacgtaaatgccccacagaaaa

SEQ ID NO: 69570 - DNA, 36 bp, Artificial Sequence
  Synthetic oligonucleotide
atggacgcccgcgaggatctcaaccgtacgtacaaa

SEQ ID NO: 69571 - DNA, 36 bp, Artificial Sequence
  Synthetic oligonucleotide
agaagcactgcagcatcaaagcaacctattgtacaa

SEQ ID NO: 69572 - DNA, 36 bp, Artificial Sequence
  Synthetic oligonucleotide
actgtcgaagggggggctggggaatgaactactcaa

SEQ ID NO: 69573 - DNA, 35 bp, Artificial Sequence
  Synthetic oligonucleotide
ggaaccaccttattgacctaaagcactatctagaa

SEQ ID NO: 69574 - DNA, 35 bp, Artificial Sequence
  Synthetic oligonucleotide
tttggccggttgatctgccgatgcctttatcctaa

SEQ ID NO: 69575 - DNA, 35 bp, Artificial Sequence
  Synthetic oligonucleotide
atccggcccttgggtctccagttctcgttcacaca

SEQ ID NO: 69576 - DNA, 36 bp, Artificial Sequence
  Synthetic oligonucleotide
gaaaaccggcgggccagcccgttgcactacccccca

SEQ ID NO: 69577 - DNA, 35 bp, Artificial Sequence
  Synthetic oligonucleotide
agtgagcgcctcgctctaccataacttatccagca

SEQ ID NO: 69578 - DNA, 36 bp, Artificial Sequence
  Synthetic oligonucleotide
tcctacagcaggtccctgaagcccctcgaacgtgca

SEQ ID NO: 69579 - DNA, 35 bp, Artificial Sequence
  Synthetic oligonucleotide
gggtgcattagtcgctctactctcacgggccctca

SEQ ID NO: 69580 - DNA, 37 bp, Artificial Sequence
  Synthetic oligonucleotide
gaaccagctgcatctatggtcgtgggcgggtgggaga

SEQ ID NO: 69581 - DNA, 37 bp, Artificial Sequence
  Synthetic oligonucleotide
taaacactgcccttccacattgctaaacagttggaga

SEQ ID NO: 69582 - DNA, 36 bp, Artificial Sequence
  Synthetic oligonucleotide
ggatcgggagggggaaaccttaggcggaccgataga

SEQ ID NO: 69583 - DNA, 37 bp, Artificial Sequence
  Synthetic oligonucleotide
gtctgatctcggcattctgttttttcccatcgataga

SEQ ID NO: 69584 - DNA, 37 bp, Artificial Sequence
  Synthetic oligonucleotide
aaccgaggtaggttgggatacgggataaaatggacga

SEQ ID NO: 69585 - DNA, 36 bp, Artificial Sequence
  Synthetic oligonucleotide
tcgacataatcaccgcaaggtctcgtgccataccga

SEQ ID NO: 69586 - DNA, 37 bp, Artificial Sequence
  Synthetic oligonucleotide
gatcacgtaacatatgccgccggagcgttcttaccga

SEQ ID NO: 69587 - DNA, 37 bp, Artificial Sequence
  Synthetic oligonucleotide
gcgaagccgtacgagaattccacgaaaactgccccga

SEQ ID NO: 69588 - DNA, 37 bp, Artificial Sequence
  Synthetic oligonucleotide
taccaccaataaacgccttgaacgcgctgtccctcga

SEQ ID NO: 69589 - DNA, 37 bp, Artificial Sequence
  Synthetic oligonucleotide
gtcaaccacatactaagtgttattgtcctcttctcga

SEQ ID NO: 69590 - DNA, 37 bp, Artificial Sequence
  Synthetic oligonucleotide
aaccgcatgatcagttcagaagaatggggagtttcga

SEQ ID NO: 69591 - DNA, 37 bp, Artificial Sequence
  Synthetic oligonucleotide
tagagagacggatgggtggtccacggaaggtgcagga

SEQ ID NO: 69592 - DNA, 35 bp, Artificial Sequence
  Synthetic oligonucleotide
tgaacacccctctgtttactgccactgacttagga

SEQ ID NO: 69593 - DNA, 37 bp, Artificial Sequence
  Synthetic oligonucleotide
gatcggggtgtgacaaccgggctcgcaggggagggga

SEQ ID NO: 69594 - DNA, 37 bp, Artificial Sequence
  Synthetic oligonucleotide
accgcccctcctatctgtcgcctcgtatacctatgga

SEQ ID NO: 69595 - DNA, 38 bp, Artificial Sequence
  Synthetic oligonucleotide
tgcggtgtccggttccatcatgctcgtgcattccatga

SEQ ID NO: 69596 - DNA, 37 bp, Artificial Sequence
  Synthetic oligonucleotide
aaccggggggtcacgggtcttctctcactctctatga

SEQ ID NO: 69597 - DNA, 37 bp, Artificial Sequence
  Synthetic oligonucleotide
agccgcagtggggggggaccgcgaggcaagggtatga

SEQ ID NO: 69598 - DNA, 37 bp, Artificial Sequence
  Synthetic oligonucleotide
gacagacacctcccattgaatttgccatctgttatga

SEQ ID NO: 69599 - DNA, 38 bp, Artificial Sequence
  Synthetic oligonucleotide
gaagcacctcattgtgtgctatactccttctgcactga

SEQ ID NO: 69600 - DNA, 38 bp, Artificial Sequence
  Synthetic oligonucleotide
aaccgaacttccatagagcctcgcaccatcttgcctga

SEQ ID NO: 69601 - DNA, 38 bp, Artificial Sequence
  Synthetic oligonucleotide
gaccctctcagccgagacatgccctgtccggatcctga

SEQ ID NO: 69602 - DNA, 37 bp, Artificial Sequence
  Synthetic oligonucleotide
gtgcgcccccatttagctgtcggaccgcctatcctga

SEQ ID NO: 69603 - DNA, 37 bp, Artificial Sequence
  Synthetic oligonucleotide
tcaccgttccttatccccttcccgtccagcctgctga

SEQ ID NO: 69604 - DNA, 37 bp, Artificial Sequence
  Synthetic oligonucleotide
tacgattgcctctctgccatgggactttaccctctga

SEQ ID NO: 69605 - DNA, 38 bp, Artificial Sequence
  Synthetic oligonucleotide
gatcccagcagtcgaagggccattgctttcatctctga

SEQ ID NO: 69606 - DNA, 38 bp, Artificial Sequence
  Synthetic oligonucleotide
ccacgccccatcgcctcagcaccctacatctcaagtga

SEQ ID NO: 69607 - DNA, 37 bp, Artificial Sequence
  Synthetic oligonucleotide
tcgctcccctacctacgctgaatagtaatgcccgtga

SEQ ID NO: 69608 - DNA, 38 bp, Artificial Sequence
  Synthetic oligonucleotide
gtacggacatacgtgcatcttttagttcctttcattga

SEQ ID NO: 69609 - DNA, 38 bp, Artificial Sequence
  Synthetic oligonucleotide
gaacgaggcggggtgactggagggagttaaatgattga

SEQ ID NO: 69610 - DNA, 38 bp, Artificial Sequence
  Synthetic oligonucleotide
gctacaaacccgcccgtctgcctttgccctatacttga

SEQ ID NO: 69611 - DNA, 38 bp, Artificial Sequence
  Synthetic oligonucleotide
tgcgggcagtacggtactatctcgctcttgacccttga

SEQ ID NO: 69612 - DNA, 38 bp, Artificial Sequence
  Synthetic oligonucleotide
ttagagcctcacacgtcgtacattatccatttccttga

SEQ ID NO: 69613 - DNA, 38 bp, Artificial Sequence
  Synthetic oligonucleotide
tgaccgatcagtgtctctggttacctttctgttcttga

SEQ ID NO: 69614 - DNA, 37 bp, Artificial Sequence
  Synthetic oligonucleotide
ttcaccactggcttctattaatgactattacttttga

SEQ ID NO: 69615 - DNA, 36 bp, Artificial Sequence
  Synthetic oligonucleotide
accaccggcaatttacccgttccgcattgaaccata

SEQ ID NO: 69616 - DNA, 36 bp, Artificial Sequence
  Synthetic oligonucleotide
gtcttccatcgcaatgattattctatgcccttgata

SEQ ID NO: 69617 - DNA, 36 bp, Artificial Sequence
  Synthetic oligonucleotide
ttccgaaccctacgtacaaggattatcttgtcacta

SEQ ID NO: 69618 - DNA, 36 bp, Artificial Sequence
  Synthetic oligonucleotide
taccaatcagtgtaatgcgccatttccaccgtgcta

SEQ ID NO: 69619 - DNA, 36 bp, Artificial Sequence
  Synthetic oligonucleotide
gttcaacaccggcccgtccgttcccctaacatcgta

SEQ ID NO: 69620 - DNA, 36 bp, Artificial Sequence
  Synthetic oligonucleotide
gcgaaactggtcagggggttcgggggggtgaaggta

SEQ ID NO: 69621 - DNA, 36 bp, Artificial Sequence
  Synthetic oligonucleotide
ttgtcggtaaaaggcgggcacgggagaggacgggta

SEQ ID NO: 69622 - DNA, 36 bp, Artificial Sequence
  Synthetic oligonucleotide
ttgggagggggggaaccgctggaaaatgtgacatta

SEQ ID NO: 69623 - DNA, 36 bp, Artificial Sequence
  Synthetic oligonucleotide
gagaaccatgcgttacacgttcccgcttatacttta

SEQ ID NO: 69624 - DNA, 35 bp, Artificial Sequence
  Synthetic oligonucleotide
accctataccgctgctcgacggtccaccgaaaaac

SEQ ID NO: 69625 - DNA, 35 bp, Artificial Sequence
  Synthetic oligonucleotide
gatcagtcgcaaggagccggaggggtggccaaaac

SEQ ID NO: 69626 - DNA, 35 bp, Artificial Sequence
  Synthetic oligonucleotide
gtggcctccaacgaggatagcttgctaggcctaac

SEQ ID NO: 69627 - DNA, 35 bp, Artificial Sequence
  Synthetic oligonucleotide
atgaaacgccgcccccgcttttacgtctctgctac

SEQ ID NO: 69628 - DNA, 35 bp, Artificial Sequence
  Synthetic oligonucleotide
gtacacctcgagctcagcacagtggcacatattac

SEQ ID NO: 69629 - DNA, 35 bp, Artificial Sequence
  Synthetic oligonucleotide
gtacactcgtcatttgcgcctgtccccctgctacc

SEQ ID NO: 69630 - DNA, 35 bp, Artificial Sequence
  Synthetic oligonucleotide
gacgcacccgccttaatgctcgctgcatttcaccc

SEQ ID NO: 69631 - DNA, 35 bp, Artificial Sequence
  Synthetic oligonucleotide
ccactgccatccccgagcgattacgctgctagccc

SEQ ID NO: 69632 - DNA, 35 bp, Artificial Sequence
  Synthetic oligonucleotide
acacatccaccatcctgatctagcagccactgccc

SEQ ID NO: 69633 - DNA, 35 bp, Artificial Sequence
  Synthetic oligonucleotide
aatactgccgttcactctacttaagctatcctgcc

SEQ ID NO: 69634 - DNA, 35 bp, Artificial Sequence
  Synthetic oligonucleotide
ttcccccctcccatcctggtgtctgcaaacgctcc

SEQ ID NO: 69635 - DNA, 35 bp, Artificial Sequence
  Synthetic oligonucleotide
gcaatccggggcgttatatacgaccatgccgctcc

SEQ ID NO: 69636 - DNA, 35 bp, Artificial Sequence
  Synthetic oligonucleotide
gcacgataaccaggacgggtgagtggagggaaagc

SEQ ID NO: 69637 - DNA, 35 bp, Artificial Sequence
  Synthetic oligonucleotide
tccaccatccgcgctgacgccgcttattgcccagc

SEQ ID NO: 69638 - DNA, 35 bp, Artificial Sequence
  Synthetic oligonucleotide
gcctcatttacacacacgaagaagagacattgcgc

SEQ ID NO: 69639 - DNA, 35 bp, Artificial Sequence
  Synthetic oligonucleotide
atctcatggtctgttccttcactcgctcccctcgc

SEQ ID NO: 69640 - DNA, 35 bp, Artificial Sequence
  Synthetic oligonucleotide
taaccccgcccccccactgttctacttctgtgtgc

SEQ ID NO: 69641 - DNA, 35 bp, Artificial Sequence
  Synthetic oligonucleotide
agacccatgctacccgcggttaataggtccccatc

SEQ ID NO: 69642 - DNA, 35 bp, Artificial Sequence
  Synthetic oligonucleotide
tcccgcctacgccagttaagtcccgctgtccactc

SEQ ID NO: 69643 - DNA, 35 bp, Artificial Sequence
  Synthetic oligonucleotide
ggacgacagctccggtccccatgctctaacccctc

SEQ ID NO: 69644 - DNA, 35 bp, Artificial Sequence
  Synthetic oligonucleotide
gtaacacaggccagacacaacccgccatgcaacag

SEQ ID NO: 69645 - DNA, 35 bp, Artificial Sequence
  Synthetic oligonucleotide
tgcaatacccgctctgtctgtcgtccaacttccag

SEQ ID NO: 69646 - DNA, 35 bp, Artificial Sequence
  Synthetic oligonucleotide
tgtgccccagttaccatacacccggacccttcgag

SEQ ID NO: 69647 - DNA, 35 bp, Artificial Sequence
  Synthetic oligonucleotide
tgttactacatgtacggactccgcagccatccccg

SEQ ID NO: 69648 - DNA, 35 bp, Artificial Sequence
  Synthetic oligonucleotide
accgaccctttcctacctgcacaatacgtgatccg

SEQ ID NO: 69649 - DNA, 35 bp, Artificial Sequence
  Synthetic oligonucleotide
tgtgatgttcgacagaacttatattggtcccctcg

SEQ ID NO: 69650 - DNA, 35 bp, Artificial Sequence
  Synthetic oligonucleotide
aacacctttgggtgctcttctcgtacatctcctcg

SEQ ID NO: 69651 - DNA, 35 bp, Artificial Sequence
  Synthetic oligonucleotide
gcactcgcaccactcgaatcgaagccacctgtagg

SEQ ID NO: 69652 - DNA, 36 bp, Artificial Sequence
  Synthetic oligonucleotide
ttatcacgcccacttatcttgagtacaagcctgggg

SEQ ID NO: 69653 - DNA, 35 bp, Artificial Sequence
  Synthetic oligonucleotide
gacatcaggggctctatatgctttcccacttcatg

SEQ ID NO: 69654 - DNA, 35 bp, Artificial Sequence
  Synthetic oligonucleotide
gtggacggtggccggtgagtttaactgggtaattg

SEQ ID NO: 69655 - DNA, 35 bp, Artificial Sequence
  Synthetic oligonucleotide
ggatgagcctaatgccccctccgcggtcccaccat

SEQ ID NO: 69656 - DNA, 35 bp, Artificial Sequence
  Synthetic oligonucleotide
taagcccagtccacctgcatccccaacttcggcat

SEQ ID NO: 69657 - DNA, 35 bp, Artificial Sequence
  Synthetic oligonucleotide
gtgccactcgactctcaccgcccctaggctttgat

SEQ ID NO: 69658 - DNA, 35 bp, Artificial Sequence
  Synthetic oligonucleotide
atgaaaccatcgccgctgcaggccctgcttcctat

SEQ ID NO: 69659 - DNA, 35 bp, Artificial Sequence
  Synthetic oligonucleotide
gatttcaacccccgcgacctacactcacaggttat

SEQ ID NO: 69660 - DNA, 35 bp, Artificial Sequence
  Synthetic oligonucleotide
gatctaccagtcctttctggggtgccttccgccct

SEQ ID NO: 69661 - DNA, 35 bp, Artificial Sequence
  Synthetic oligonucleotide
gtcacgtcatcaaccgccgctcccagtccaacgct

SEQ ID NO: 69662 - DNA, 34 bp, Artificial Sequence
  Synthetic oligonucleotide
gtccataggtctgctttatcccggtgacccctct

SEQ ID NO: 69663 - DNA, 35 bp, Artificial Sequence
  Synthetic oligonucleotide
gagcacaccacccaggccgttgctgcttagcctct

SEQ ID NO: 69664 - DNA, 35 bp, Artificial Sequence
  Synthetic oligonucleotide
tccggagtcgtaagaaccagcctctccggacttct

SEQ ID NO: 69665 - DNA, 35 bp, Artificial Sequence
  Synthetic oligonucleotide
gccaggcgtatcttcgtggcccggtcttaccttct

SEQ ID NO: 69666 - DNA, 35 bp, Artificial Sequence
  Synthetic oligonucleotide
tcgccatatccgcgcccttaaggtccgccctttct

SEQ ID NO: 69667 - DNA, 35 bp, Artificial Sequence
  Synthetic oligonucleotide
ttccacagcgcactcggttcggtttcaagctttct

SEQ ID NO: 69668 - DNA, 35 bp, Artificial Sequence
  Synthetic oligonucleotide
agcgccgtcagttatcgccgtgctactcctttcgt

SEQ ID NO: 69669 - DNA, 35 bp, Artificial Sequence
  Synthetic oligonucleotide
gatcaccctcctgcctgtcgattagtccgcctctt

SEQ ID NO: 69670 - DNA, 35 bp, Artificial Sequence
  Synthetic oligonucleotide
taacggaaccctcgccctgactcttccgagcagtt

SEQ ID NO: 69671 - DNA, 35 bp, Artificial Sequence
  Synthetic oligonucleotide
gtgcaagtgagactgattaggatggaggaagggaa

SEQ ID NO: 69672 - DNA, 36 bp, Artificial Sequence
  Synthetic oligonucleotide
gatacctcctcgagtcgctccagagcaccaacataa

SEQ ID NO: 69673 - DNA, 36 bp, Artificial Sequence
  Synthetic oligonucleotide
tcacgtccctctcgtgactatccaacgtttgtacca

SEQ ID NO: 69674 - DNA, 36 bp, Artificial Sequence
  Synthetic oligonucleotide
acctgccatcctggtttaccttcaatcttgtcccca

SEQ ID NO: 69675 - DNA, 36 bp, Artificial Sequence
  Synthetic oligonucleotide
tagttacgccgctccgtgcgttcttactcccgccca

SEQ ID NO: 69676 - DNA, 36 bp, Artificial Sequence
  Synthetic oligonucleotide
tccctacacacacttcggttttaagccttcggccca

SEQ ID NO: 69677 - DNA, 35 bp, Artificial Sequence
  Synthetic oligonucleotide
gacaccccaccttcgcgcccgttctccactgccca

SEQ ID NO: 69678 - DNA, 36 bp, Artificial Sequence
  Synthetic oligonucleotide
ttatcatgcaagcgtacacccaccttccaggctcca

SEQ ID NO: 69679 - DNA, 36 bp, Artificial Sequence
  Synthetic oligonucleotide
gttgaggtaggacgtgacacccgccggccctttcca

SEQ ID NO: 69680 - DNA, 36 bp, Artificial Sequence
  Synthetic oligonucleotide
gtgtctcatagggcaaggagggagggaagcaacgca

SEQ ID NO: 69681 - DNA, 36 bp, Artificial Sequence
  Synthetic oligonucleotide
gcatgacaaaggcacaactcgaaatgtactaccgca

SEQ ID NO: 69682 - DNA, 36 bp, Artificial Sequence
  Synthetic oligonucleotide
tggatgacccccgtgcccgtcgctcattccctcgca

SEQ ID NO: 69683 - DNA, 36 bp, Artificial Sequence
  Synthetic oligonucleotide
tgcacacgccccctgtagccatccattcactgtgca

SEQ ID NO: 69684 - DNA, 36 bp, Artificial Sequence
  Synthetic oligonucleotide
atgagcaaaggggggggttcgtgacaattcaaatca

SEQ ID NO: 69685 - DNA, 36 bp, Artificial Sequence
  Synthetic oligonucleotide
tcccacccttgttgtcatccacgcactgcccactca

SEQ ID NO: 69686 - DNA, 35 bp, Artificial Sequence
  Synthetic oligonucleotide
aggacaccggaccctgctacgccgctctgatctca

SEQ ID NO: 69687 - DNA, 36 bp, Artificial Sequence
  Synthetic oligonucleotide
gaaatggcggtgttcgctcgttctccttaactgtca

SEQ ID NO: 69688 - DNA, 37 bp, Artificial Sequence
  Synthetic oligonucleotide
tccgccgagctatacacatctacccgcatacatgaga

SEQ ID NO: 69689 - DNA, 36 bp, Artificial Sequence
  Synthetic oligonucleotide
accttaacgccccgtgcaagagctatgcctcttaga

SEQ ID NO: 69690 - DNA, 37 bp, Artificial Sequence
  Synthetic oligonucleotide
gtccgaatccgctcgctccattccatttaagtaacga

SEQ ID NO: 69691 - DNA, 36 bp, Artificial Sequence
  Synthetic oligonucleotide
gagagggatagggggatagcgaatgagtggggacga

SEQ ID NO: 69692 - DNA, 37 bp, Artificial Sequence
  Synthetic oligonucleotide
accatgagccatcctctctctttcctttcaggtacga

SEQ ID NO: 69693 - DNA, 37 bp, Artificial Sequence
  Synthetic oligonucleotide
gaggtacgcatagctctgtccatatacacttgtacga

SEQ ID NO: 69694 - DNA, 37 bp, Artificial Sequence
  Synthetic oligonucleotide
gtgcacttgcacacgtcacggacactgatttcaccga

SEQ ID NO: 69695 - DNA, 37 bp, Artificial Sequence
  Synthetic oligonucleotide
gtaccaggcgcacacacaaactgttaattaggtccga

SEQ ID NO: 69696 - DNA, 37 bp, Artificial Sequence
  Synthetic oligonucleotide
gtaggaggtgggcaaaggaagcgttgtaggccggcga

SEQ ID NO: 69697 - DNA, 37 bp, Artificial Sequence
  Synthetic oligonucleotide
tgaacgggcacgatatgaatggatgggagggactcga

SEQ ID NO: 69698 - DNA, 37 bp, Artificial Sequence
  Synthetic oligonucleotide
gggaggtaataggctcggggggtatggacggggagga

SEQ ID NO: 69699 - DNA, 37 bp, Artificial Sequence
  Synthetic oligonucleotide
tgaaacacaaaatcaaagaggggcgaacttgggagga

SEQ ID NO: 69700 - DNA, 37 bp, Artificial Sequence
  Synthetic oligonucleotide
tgaaccgtgccccctcccttgaatttatcgcgacgga

SEQ ID NO: 69701 - DNA, 37 bp, Artificial Sequence
  Synthetic oligonucleotide
gacgataggcacgtacagcaatctggaagcaaaggga

SEQ ID NO: 69702 - DNA, 37 bp, Artificial Sequence
  Synthetic oligonucleotide
accgacgacacttgtaccacctcaaatgcatcctgga

SEQ ID NO: 69703 - DNA, 37 bp, Artificial Sequence
  Synthetic oligonucleotide
acccccgcctatatgcggaatatagtacactgctgga

SEQ ID NO: 69704 - DNA, 37 bp, Artificial Sequence
  Synthetic oligonucleotide
tgcaaagcctccattattcgctccctcataccaatga

SEQ ID NO: 69705 - DNA, 38 bp, Artificial Sequence
  Synthetic oligonucleotide
agcctgcaatcggagggcgggcaaaattggggagatga

SEQ ID NO: 69706 - DNA, 38 bp, Artificial Sequence
  Synthetic oligonucleotide
tccacgggggatgtgtaatttgtgtagcatgacgatga

SEQ ID NO: 69707 - DNA, 38 bp, Artificial Sequence
  Synthetic oligonucleotide
aatgggagggttagagagggtagaaatatgcatgatga

SEQ ID NO: 69708 - DNA, 37 bp, Artificial Sequence
  Synthetic oligonucleotide
actggggtgggcgatggcgggccgatccatcctatga

SEQ ID NO: 69709 - DNA, 38 bp, Artificial Sequence
  Synthetic oligonucleotide
gccgagaggtccggttgggaaatgggggccgggactga

SEQ ID NO: 69710 - DNA, 38 bp, Artificial Sequence
  Synthetic oligonucleotide
tagccacactggtgctaggaagatcgcgcgccttctga

SEQ ID NO: 69711 - DNA, 38 bp, Artificial Sequence
  Synthetic oligonucleotide
gtcaacccgccgcctttcgcctctgtggtcgtgagtga

SEQ ID NO: 69712 - DNA, 38 bp, Artificial Sequence
  Synthetic oligonucleotide
ggatgtggagttgggatgaaagatgaggaagatagtga

SEQ ID NO: 69713 - DNA, 38 bp, Artificial Sequence
  Synthetic oligonucleotide
gagccgaacctcagccctaatcacatagctccccgtga

SEQ ID NO: 69714 - DNA, 37 bp, Artificial Sequence
  Synthetic oligonucleotide
gtccgagttccggtccgtttgcctctctcttgggtga

SEQ ID NO: 69715 - DNA, 37 bp, Artificial Sequence
  Synthetic oligonucleotide
taggaatggctgtaaaaggtagaggagtggatggtga

SEQ ID NO: 69716 - DNA, 37 bp, Artificial Sequence
  Synthetic oligonucleotide
taggtgtagggagttggggttgaagtagtggcattga

SEQ ID NO: 69717 - DNA, 38 bp, Artificial Sequence
  Synthetic oligonucleotide
ttgccccccatgctacttaacagtcaataatggattga

SEQ ID NO: 69718 - DNA, 36 bp, Artificial Sequence
  Synthetic oligonucleotide
agccactgtgcgcatcgcactgccccacccccttga

SEQ ID NO: 69719 - DNA, 38 bp, Artificial Sequence
  Synthetic oligonucleotide
gagaaccgctggacctttgaatgcactcctcatcttga

SEQ ID NO: 69720 - DNA, 38 bp, Artificial Sequence
  Synthetic oligonucleotide
gacatgcccccgccccccaagagcattatgtatcttga

SEQ ID NO: 69721 - DNA, 38 bp, Artificial Sequence
  Synthetic oligonucleotide
atgcacccgcggctaccctccgccgtaattcctcttga

SEQ ID NO: 69722 - DNA, 38 bp, Artificial Sequence
  Synthetic oligonucleotide
gctaagaagcacgtacggcgggggagaagacaagttga

SEQ ID NO: 69723 - DNA, 37 bp, Artificial Sequence
  Synthetic oligonucleotide
aaccgcgaggggagagaaagggagttagcggcgttga

SEQ ID NO: 69724 - DNA, 38 bp, Artificial Sequence
  Synthetic oligonucleotide
gtttacgaccgcaggtgtggtttcgcccctcgtgttga

SEQ ID NO: 69725 - DNA, 38 bp, Artificial Sequence
  Synthetic oligonucleotide
gtctgttcagcgttcatatattagccctccccatttga

SEQ ID NO: 69726 - DNA, 36 bp, Artificial Sequence
  Synthetic oligonucleotide
tcctccttcatccccagctgccgtgatcctctttga

SEQ ID NO: 69727 - DNA, 38 bp, Artificial Sequence
  Synthetic oligonucleotide
agttccacactgaagtttaattgcgcccctccgtttga

SEQ ID NO: 69728 - DNA, 36 bp, Artificial Sequence
  Synthetic oligonucleotide
gactcggtcctgtccctcttcgagcgtaattccata

SEQ ID NO: 69729 - DNA, 36 bp, Artificial Sequence
  Synthetic oligonucleotide
tgtgtactgtccacgcccaaggtcccttcagcccta

SEQ ID NO: 69730 - DNA, 36 bp, Artificial Sequence
  Synthetic oligonucleotide
gcaccgttcccttgatgtttccgtcttgtcgcccta

SEQ ID NO: 69731 - DNA, 35 bp, Artificial Sequence
  Synthetic oligonucleotide
gttggtgtaaggcttggggaacggtggagcagtta

SEQ ID NO: 69732 - DNA, 35 bp, Artificial Sequence
  Synthetic oligonucleotide
tccatcgcccaatggaacatccgtgttcgccgtta

SEQ ID NO: 69733 - DNA, 35 bp, Artificial Sequence
  Synthetic oligonucleotide
gaactgcgtgaccacgttaattaacgaccccacac

SEQ ID NO: 69734 - DNA, 34 bp, Artificial Sequence
  Synthetic oligonucleotide
gtttcgacactggccgccttcaaattcacgccac

SEQ ID NO: 69735 - DNA, 35 bp, Artificial Sequence
  Synthetic oligonucleotide
acccgactgatctcagtcgccaccgattcccagac

SEQ ID NO: 69736 - DNA, 35 bp, Artificial Sequence
  Synthetic oligonucleotide
gcacgacaatctctcccgtagctatgtcctttccc

SEQ ID NO: 69737 - DNA, 35 bp, Artificial Sequence
  Synthetic oligonucleotide
gccccaacccgaaacaggagagaggttcctaccgc

SEQ ID NO: 69738 - DNA, 35 bp, Artificial Sequence
  Synthetic oligonucleotide
aatccaaccccctgtgaaacgacgccgtagggtgc

SEQ ID NO: 69739 - DNA, 35 bp, Artificial Sequence
  Synthetic oligonucleotide
gacccttcaaccgcccgatgcttggccaacgcatc

SEQ ID NO: 69740 - DNA, 35 bp, Artificial Sequence
  Synthetic oligonucleotide
acaccaccttgcccacgatcaccttcgtgcttatc

SEQ ID NO: 69741 - DNA, 35 bp, Artificial Sequence
  Synthetic oligonucleotide
gatactccggaaggtattttgacaataccgcactc

SEQ ID NO: 69742 - DNA, 35 bp, Artificial Sequence
  Synthetic oligonucleotide
agtaccccttcctcgtcaccgccgtgagcccagtc

SEQ ID NO: 69743 - DNA, 35 bp, Artificial Sequence
  Synthetic oligonucleotide
tgcacgtgcgatgatctgatcttagtttatccgtc

SEQ ID NO: 69744 - DNA, 35 bp, Artificial Sequence
  Synthetic oligonucleotide
gagagatggggagtggtctaacaaatgctcaagag

SEQ ID NO: 69745 - DNA, 34 bp, Artificial Sequence
  Synthetic oligonucleotide
aattccgtcactggccatacaattgttctcctag

SEQ ID NO: 69746 - DNA, 35 bp, Artificial Sequence
  Synthetic oligonucleotide
tccccagggggcaagccagtctcccgttaatcccg

SEQ ID NO: 69747 - DNA, 35 bp, Artificial Sequence
  Synthetic oligonucleotide
tcccatctaccttactcatttgctaatagctcccg

SEQ ID NO: 69748 - DNA, 35 bp, Artificial Sequence
  Synthetic oligonucleotide
accccgccccctccctagtatcagactttctgccg

SEQ ID NO: 69749 - DNA, 35 bp, Artificial Sequence
  Synthetic oligonucleotide
gtcatagaggattggtcgtggggtgggagaatgcg

SEQ ID NO: 69750 - DNA, 35 bp, Artificial Sequence
  Synthetic oligonucleotide
tcgctgtgaacacaccgctccataccatccatggg

SEQ ID NO: 69751 - DNA, 35 bp, Artificial Sequence
  Synthetic oligonucleotide
tacagtgcgccgccacgacccaataaatcacatgg

SEQ ID NO: 69752 - DNA, 35 bp, Artificial Sequence
  Synthetic oligonucleotide
gggaaaccttacctgttcgtaagaacactctcctg

SEQ ID NO: 69753 - DNA, 35 bp, Artificial Sequence
  Synthetic oligonucleotide
gaaggaagaacggggcgctaagcgagcaattggtg

SEQ ID NO: 69754 - DNA, 35 bp, Artificial Sequence
  Synthetic oligonucleotide
atctgtgaacgttgcgggtaggggaggggttcaat

SEQ ID NO: 69755 - DNA, 35 bp, Artificial Sequence
  Synthetic oligonucleotide
tgtgaccggatggtcaaaagggggaatgtacacat

SEQ ID NO: 69756 - DNA, 35 bp, Artificial Sequence
  Synthetic oligonucleotide
tccattgagcttgtcacggctccatactataccat

SEQ ID NO: 69757 - DNA, 35 bp, Artificial Sequence
  Synthetic oligonucleotide
gtcatacattccgaacgtcccgaacctaccgctat

SEQ ID NO: 69758 - DNA, 35 bp, Artificial Sequence
  Synthetic oligonucleotide
tttgtccactcccacactcgtaacagggcggaact

SEQ ID NO: 69759 - DNA, 35 bp, Artificial Sequence
  Synthetic oligonucleotide
acttacgcattgacctggcattctgtcccccatct

SEQ ID NO: 69760 - DNA, 35 bp, Artificial Sequence
  Synthetic oligonucleotide
tacacgggggttatcctactttgtttttcgtgtct

SEQ ID NO: 69761 - DNA, 35 bp, Artificial Sequence
  Synthetic oligonucleotide
agtactgccacagcataccccaccgcgagttttct

SEQ ID NO: 69762 - DNA, 35 bp, Artificial Sequence
  Synthetic oligonucleotide
gacttcggcatatccaacacacaagtcctacccgt

SEQ ID NO: 69763 - DNA, 35 bp, Artificial Sequence
  Synthetic oligonucleotide
gtactgctggagccgtccctcatgcacccatccgt

SEQ ID NO: 69764 - DNA, 35 bp, Artificial Sequence
  Synthetic oligonucleotide
tgggatgccccttggcgtgcgcaacattcccttgt

SEQ ID NO: 69765 - DNA, 35 bp, Artificial Sequence
  Synthetic oligonucleotide
gtctcactgcaggcctagccatccctcgattactt

SEQ ID NO: 69766 - DNA, 35 bp, Artificial Sequence
  Synthetic oligonucleotide
acccgctgttacctcgtgatcccaatttgtacgtt

SEQ ID NO: 69767 - DNA, 35 bp, Artificial Sequence
  Synthetic oligonucleotide
ttcgatcactcctacctcatgacacctacacggtt

SEQ ID NO: 69768 - DNA, 35 bp, Artificial Sequence
  Synthetic oligonucleotide
taccctgcaacgcctaatccgaccaatacagggtt

SEQ ID NO: 69769 - DNA, 35 bp, Artificial Sequence
  Synthetic oligonucleotide
gtagcttggaacatagggaaagtgctgagtgggtt

SEQ ID NO: 69770 - DNA, 35 bp, Artificial Sequence
  Synthetic oligonucleotide
gacacctcgcccgtagtcgtaacactaatgttgtt

SEQ ID NO: 69771 - DNA, 36 bp, Artificial Sequence
  Synthetic oligonucleotide
tccgtaggtcattgcccctgtaaccttcgacccaaa

SEQ ID NO: 69772 - DNA, 36 bp, Artificial Sequence
  Synthetic oligonucleotide
atgtagtgagggaagaataacgggtaggcgggccaa

SEQ ID NO: 69773 - DNA, 35 bp, Artificial Sequence
  Synthetic oligonucleotide
acaactagcacatcaccccgcttgctaagaggcaa

SEQ ID NO: 69774 - DNA, 36 bp, Artificial Sequence
  Synthetic oligonucleotide
ttcagatctgtaccgcaccccaccgtagccatcgaa

SEQ ID NO: 69775 - DNA, 36 bp, Artificial Sequence
  Synthetic oligonucleotide
atgcaaaaggcgggcggggacaagactggactggaa

SEQ ID NO: 69776 - DNA, 35 bp, Artificial Sequence
  Synthetic oligonucleotide
ggtcgccgtcctacgtctcgattccgtctacctaa

SEQ ID NO: 69777 - DNA, 36 bp, Artificial Sequence
  Synthetic oligonucleotide
tgccgatgcaatgccaacctattagatttagctaca

SEQ ID NO: 69778 - DNA, 36 bp, Artificial Sequence
  Synthetic oligonucleotide
tgctccttgaacaccgccttgtgcaattatgctaca

SEQ ID NO: 69779 - DNA, 36 bp, Artificial Sequence
  Synthetic oligonucleotide
ttgcacccacggtgcagcccaaacactactggacca

SEQ ID NO: 69780 - DNA, 35 bp, Artificial Sequence
  Synthetic oligonucleotide
atccactctcagtttgtcgacccggcctccaatca

SEQ ID NO: 69781 - DNA, 36 bp, Artificial Sequence
  Synthetic oligonucleotide
gcccaccgtggcgatgaggtggctattgtaccatca

SEQ ID NO: 69782 - DNA, 35 bp, Artificial Sequence
  Synthetic oligonucleotide
gtctcaagccctcggttggtacacgtattacctca

SEQ ID NO: 69783 - DNA, 35 bp, Artificial Sequence
  Synthetic oligonucleotide
acctccaccagttgtgtgttcaacagcacccgtca

SEQ ID NO: 69784 - DNA, 35 bp, Artificial Sequence
  Synthetic oligonucleotide
ttcgaccgctgcgagctacgccccgagccaattca

SEQ ID NO: 69785 - DNA, 37 bp, Artificial Sequence
  Synthetic oligonucleotide
tttctgcagtgtagcacaggggggagggttggacaga

SEQ ID NO: 69786 - DNA, 37 bp, Artificial Sequence
  Synthetic oligonucleotide
agtgggggcggatactgacagggataaaagatgcaga

SEQ ID NO: 69787 - DNA, 37 bp, Artificial Sequence
  Synthetic oligonucleotide
gtgacgggacccgggagggagggccgaatcctcgaga

SEQ ID NO: 69788 - DNA, 37 bp, Artificial Sequence
  Synthetic oligonucleotide
tgtatcgtgagaggtgggggacggagggcacgggaga

SEQ ID NO: 69789 - DNA, 37 bp, Artificial Sequence
  Synthetic oligonucleotide
tacgttcccaggccaagtaacgttccatcttgttcga

SEQ ID NO: 69790 - DNA, 37 bp, Artificial Sequence
  Synthetic oligonucleotide
ttgtcgactccatctgatagtacgctttgcttttcga

SEQ ID NO: 69791 - DNA, 37 bp, Artificial Sequence
  Synthetic oligonucleotide
actgaacctcccccgtagtttgtgacctgccgcagga

SEQ ID NO: 69792 - DNA, 37 bp, Artificial Sequence
  Synthetic oligonucleotide
gtggggcatgtagagactaaaagagggaggtagagga

SEQ ID NO: 69793 - DNA, 36 bp, Artificial Sequence
  Synthetic oligonucleotide
gttggaaacagggttgaggacggggcgggaaacgga

SEQ ID NO: 69794 - DNA, 37 bp, Artificial Sequence
  Synthetic oligonucleotide
gatgaacagaatgcgggtgatgggctgacagcgggga

SEQ ID NO: 69795 - DNA, 38 bp, Artificial Sequence
  Synthetic oligonucleotide
gctatcaacggatagcagtggtaggatagaggggggga

SEQ ID NO: 69796 - DNA, 38 bp, Artificial Sequence
  Synthetic oligonucleotide
acgatggctcgcacggtggggaaaggtggatttaatga

SEQ ID NO: 69797 - DNA, 38 bp, Artificial Sequence
  Synthetic oligonucleotide
tctacaacttcgcgcagccacctcgctcccacccatga

SEQ ID NO: 69798 - DNA, 38 bp, Artificial Sequence
  Synthetic oligonucleotide
tcgacgcaccattcctgtgaggcccagactctaactga

SEQ ID NO: 69799 - DNA, 38 bp, Artificial Sequence
  Synthetic oligonucleotide
atccccccgtcagcccgccccccgttttcatgtactga

SEQ ID NO: 69800 - DNA, 38 bp, Artificial Sequence
  Synthetic oligonucleotide
actacgcagacctcctccttccatgagactgcgcctga

SEQ ID NO: 69801 - DNA, 36 bp, Artificial Sequence
  Synthetic oligonucleotide
tcagccaccctgttctgcctcgatattgctacgtga

SEQ ID NO: 69802 - DNA, 38 bp, Artificial Sequence
  Synthetic oligonucleotide
tgctggggggggcgaagatgatgcaggggcgatcgtga

SEQ ID NO: 69803 - DNA, 37 bp, Artificial Sequence
  Synthetic oligonucleotide
tgcgtgcagaatcacacaaataattaggggaaggtga

SEQ ID NO: 69804 - DNA, 37 bp, Artificial Sequence
  Synthetic oligonucleotide
gtgacgggtaccgggtgtgggagagggttattggtga

SEQ ID NO: 69805 - DNA, 38 bp, Artificial Sequence
  Synthetic oligonucleotide
gttgacctgtgcctagttcttctagtccaccttggtga

SEQ ID NO: 69806 - DNA, 38 bp, Artificial Sequence
  Synthetic oligonucleotide
tagcacgacagcatcttattgggggtggggcttggtga

SEQ ID NO: 69807 - DNA, 35 bp, Artificial Sequence
  Synthetic oligonucleotide
tgttacccacctcagcgcctgtagatcccttgtga

SEQ ID NO: 69808 - DNA, 37 bp, Artificial Sequence
  Synthetic oligonucleotide
ataccaacgcgaacgcattatacctcacatcttgtga

SEQ ID NO: 69809 - DNA, 37 bp, Artificial Sequence
  Synthetic oligonucleotide
atctgccacctaagctcatcacatttccagttattga

SEQ ID NO: 69810 - DNA, 38 bp, Artificial Sequence
  Synthetic oligonucleotide
gatgttccctgatgcaccccgcgtatgcactagcttga

SEQ ID NO: 69811 - DNA, 37 bp, Artificial Sequence
  Synthetic oligonucleotide
tgacacccgcttaatagttgaatcatctcgtcgttga

SEQ ID NO: 69812 - DNA, 38 bp, Artificial Sequence
  Synthetic oligonucleotide
gacatgcacctgtccgctcgacctttgcctggatttga

SEQ ID NO: 69813 - DNA, 38 bp, Artificial Sequence
  Synthetic oligonucleotide
gtggaggggacggaaaggtcgccgggatcatggtttga

SEQ ID NO: 69814 - DNA, 37 bp, Artificial Sequence
  Synthetic oligonucleotide
gatgccacattgggtagagtcgtgaccgacattttga

SEQ ID NO: 69815 - DNA, 36 bp, Artificial Sequence
  Synthetic oligonucleotide
acgcggcgctgccccctcgagcctagctacattcta

SEQ ID NO: 69816 - DNA, 35 bp, Artificial Sequence
  Synthetic oligonucleotide
acattcaccattccgctggatgcagaaacgcttta

SEQ ID NO: 69817 - DNA, 35 bp, Artificial Sequence
  Synthetic oligonucleotide
agcacgactctcagttcgtgctctcttagaaccac

SEQ ID NO: 69818 - DNA, 35 bp, Artificial Sequence
  Synthetic oligonucleotide
taacgcctctactttactaagtatctgttgcccac

SEQ ID NO: 69819 - DNA, 35 bp, Artificial Sequence
  Synthetic oligonucleotide
gccacgactggccccgattatatctcccatcgcac

SEQ ID NO: 69820 - DNA, 35 bp, Artificial Sequence
  Synthetic oligonucleotide
gtgcccagcctcatgagggcgctactgattactac

SEQ ID NO: 69821 - DNA, 35 bp, Artificial Sequence
  Synthetic oligonucleotide
acgatgtgctgtgctgcaacacgatactgatctac

SEQ ID NO: 69822 - DNA, 35 bp, Artificial Sequence
  Synthetic oligonucleotide
aagtgccgctacacttccatcgtatcactctgtac

SEQ ID NO: 69823 - DNA, 35 bp, Artificial Sequence
  Synthetic oligonucleotide
gcgagatacaccgtgctcctagttgaccaactacc

SEQ ID NO: 69824 - DNA, 35 bp, Artificial Sequence
  Synthetic oligonucleotide
cgtcaggtccgaaccgcgccatgtccttacttacc

SEQ ID NO: 69825 - DNA, 35 bp, Artificial Sequence
  Synthetic oligonucleotide
gtagtgccaacgaagtcgctacatggagagggccc

SEQ ID NO: 69826 - DNA, 35 bp, Artificial Sequence
  Synthetic oligonucleotide
gatcccaccattggctcatgagactgggacatgcc

SEQ ID NO: 69827 - DNA, 35 bp, Artificial Sequence
  Synthetic oligonucleotide
gaagaggtgccgccggtagtttttagcaccttgcc

SEQ ID NO: 69828 - DNA, 35 bp, Artificial Sequence
  Synthetic oligonucleotide
ttacgcgccactcctgcaaattgccgccttcatcc

SEQ ID NO: 69829 - DNA, 35 bp, Artificial Sequence
  Synthetic oligonucleotide
atctgcccccaactttccgacacaagagttgtcgc

SEQ ID NO: 69830 - DNA, 35 bp, Artificial Sequence
  Synthetic oligonucleotide
gcggtctctccacatcgctgccttttatgtttcgc

SEQ ID NO: 69831 - DNA, 35 bp, Artificial Sequence
  Synthetic oligonucleotide
tagccgagtacggcgtgtcctgttgctcacttggc

SEQ ID NO: 69832 - DNA, 35 bp, Artificial Sequence
  Synthetic oligonucleotide
ggttcgattcgtactcattatgtttgccctcatgc

SEQ ID NO: 69833 - DNA, 35 bp, Artificial Sequence
  Synthetic oligonucleotide
gtaaccacacactcatacaaacgccatggggttgc

SEQ ID NO: 69834 - DNA, 35 bp, Artificial Sequence
  Synthetic oligonucleotide
atggaccacactgtaccggtaataatggccgaatc

SEQ ID NO: 69835 - DNA, 35 bp, Artificial Sequence
  Synthetic oligonucleotide
gtgccactgcactgaggagaacgggcgagagcatc

SEQ ID NO: 69836 - DNA, 35 bp, Artificial Sequence
  Synthetic oligonucleotide
tctgagcgtggttttccccgggcaacaagttcttc

SEQ ID NO: 69837 - DNA, 35 bp, Artificial Sequence
  Synthetic oligonucleotide
ttcatgccggaggcccagctggaggataattacag

SEQ ID NO: 69838 - DNA, 35 bp, Artificial Sequence
  Synthetic oligonucleotide
tttgggttgaggtagaggggggcatgggtaatgag

SEQ ID NO: 69839 - DNA, 35 bp, Artificial Sequence
  Synthetic oligonucleotide
gcccgcaccccactttgaactacagtacccgcccg

SEQ ID NO: 69840 - DNA, 35 bp, Artificial Sequence
  Synthetic oligonucleotide
gacaagcacttattgtggggttttcgatctgtccg

SEQ ID NO: 69841 - DNA, 35 bp, Artificial Sequence
  Synthetic oligonucleotide
gtctccgcacctatggcgacccaactacactttcg

SEQ ID NO: 69842 - DNA, 35 bp, Artificial Sequence
  Synthetic oligonucleotide
aaagacaagtgcacagatggttcgatgcaggccgg

SEQ ID NO: 69843 - DNA, 35 bp, Artificial Sequence
  Synthetic oligonucleotide
accgcattataccttttatgtaccccttccccggg

SEQ ID NO: 69844 - DNA, 35 bp, Artificial Sequence
  Synthetic oligonucleotide
aacggggtaacgggggcattaggggagcgcgtggg

SEQ ID NO: 69845 - DNA, 35 bp, Artificial Sequence
  Synthetic oligonucleotide
gtcaggggtgcggattctgtcgttttgtgggtggg

SEQ ID NO: 69846 - DNA, 35 bp, Artificial Sequence
  Synthetic oligonucleotide
gagaggggtaggtaggggcgataagcgaacgcatg

SEQ ID NO: 69847 - DNA, 35 bp, Artificial Sequence
  Synthetic oligonucleotide
agcccctttagctgtctctgctcctctgccctatg

SEQ ID NO: 69848 - DNA, 35 bp, Artificial Sequence
  Synthetic oligonucleotide
caccactcctgcccgtgaggctctaccctatcttg

SEQ ID NO: 69849 - DNA, 35 bp, Artificial Sequence
  Synthetic oligonucleotide
agtactacctggacaatatcctgcctcatgccact

SEQ ID NO: 69850 - DNA, 35 bp, Artificial Sequence
  Synthetic oligonucleotide
gctgacacgcaaatgttggcaccggattccaccct

SEQ ID NO: 69851 - DNA, 35 bp, Artificial Sequence
  Synthetic oligonucleotide
tccttcctcactcgccggagaggggctttggccct

SEQ ID NO: 69852 - DNA, 35 bp, Artificial Sequence
  Synthetic oligonucleotide
tttgagtgccgctcacctcgccctcgaagtgttct

SEQ ID NO: 69853 - DNA, 35 bp, Artificial Sequence
  Synthetic oligonucleotide
atcgtcctaacttccagttactgagctctcacctt

SEQ ID NO: 69854 - DNA, 35 bp, Artificial Sequence
  Synthetic oligonucleotide
tctggatgggacatccccactgttggtctcacctt

SEQ ID NO: 69855 - DNA, 35 bp, Artificial Sequence
  Synthetic oligonucleotide
gtgggtgcagacccattccgtatttaaccaagctt

SEQ ID NO: 69856 - DNA, 35 bp, Artificial Sequence
  Synthetic oligonucleotide
gtccacccctcacattctactccgaggtagatctt

SEQ ID NO: 69857 - DNA, 35 bp, Artificial Sequence
  Synthetic oligonucleotide
gcgatgtgcactcattgctgcccctcccagctctt

SEQ ID NO: 69858 - DNA, 33 bp, Artificial Sequence
  Synthetic oligonucleotide
tcgtatcgctgaccttggcctcccggtacggtt

SEQ ID NO: 69859 - DNA, 35 bp, Artificial Sequence
  Synthetic oligonucleotide
tccacaccacaaaccttgaaacgtggccttgcaaa

SEQ ID NO: 69860 - DNA, 36 bp, Artificial Sequence
  Synthetic oligonucleotide
aatgtcccagccctatacggccttcacgccaaacaa

SEQ ID NO: 69861 - DNA, 36 bp, Artificial Sequence
  Synthetic oligonucleotide
ggaatccgtcgcatgtcttgcctgcccttcccccaa

SEQ ID NO: 69862 - DNA, 36 bp, Artificial Sequence
  Synthetic oligonucleotide
taggtccatcgcctattctatcgtcctaatgcccaa

SEQ ID NO: 69863 - DNA, 36 bp, Artificial Sequence
  Synthetic oligonucleotide
gtgtcgccatgtcgcattgcgcctaagttttgccaa

SEQ ID NO: 69864 - DNA, 36 bp, Artificial Sequence
  Synthetic oligonucleotide
gactccaccctggtattgtatatcttcttgtactaa

SEQ ID NO: 69865 - DNA, 36 bp, Artificial Sequence
  Synthetic oligonucleotide
gtactccacccacatatggtaacccgtaggatctaa

SEQ ID NO: 69866 - DNA, 35 bp, Artificial Sequence
  Synthetic oligonucleotide
tcacgagtccgctaacacagccccccgccttgtaa

SEQ ID NO: 69867 - DNA, 36 bp, Artificial Sequence
  Synthetic oligonucleotide
tcactacgacccggagagagacgtgtcaggaattaa

SEQ ID NO: 69868 - DNA, 36 bp, Artificial Sequence
  Synthetic oligonucleotide
tctcatcccgttctcgtgaccgatttcggcccttaa

SEQ ID NO: 69869 - DNA, 36 bp, Artificial Sequence
  Synthetic oligonucleotide
ggggtgggaaaggggttagtactggtgacaagaaca

SEQ ID NO: 69870 - DNA, 34 bp, Artificial Sequence
  Synthetic oligonucleotide
gtgtcagccttctttgcactttcggaacttaaca

SEQ ID NO: 69871 - DNA, 36 bp, Artificial Sequence
  Synthetic oligonucleotide
gcccctgaggctgagcccgttacgcggctgtacaca

SEQ ID NO: 69872 - DNA, 35 bp, Artificial Sequence
  Synthetic oligonucleotide
tcccatgtcggatacgcgccgtggcgtcacaacca

SEQ ID NO: 69873 - DNA, 36 bp, Artificial Sequence
  Synthetic oligonucleotide
tccccccagcatgagaaccgctgtgaccatgcacca

SEQ ID NO: 69874 - DNA, 35 bp, Artificial Sequence
  Synthetic oligonucleotide
gtctcctcccatcgggattttattgaccactacca

SEQ ID NO: 69875 - DNA, 36 bp, Artificial Sequence
  Synthetic oligonucleotide
gctcaacgaggtgacgtacaacagaacgagccccca

SEQ ID NO: 69876 - DNA, 35 bp, Artificial Sequence
  Synthetic oligonucleotide
gtgggagctcagcaatcgtcgcgtccctagtccca

SEQ ID NO: 69877 - DNA, 35 bp, Artificial Sequence
  Synthetic oligonucleotide
gtgcccgccctaaagctgacccccattagacgcca

SEQ ID NO: 69878 - DNA, 36 bp, Artificial Sequence
  Synthetic oligonucleotide
attcgtcgctccatctctaatgcttctaccgttcca

SEQ ID NO: 69879 - DNA, 36 bp, Artificial Sequence
  Synthetic oligonucleotide
tcatgtgggtgggttcatacggttcgggggggagca

SEQ ID NO: 69880 - DNA, 35 bp, Artificial Sequence
  Synthetic oligonucleotide
gttgccgttacgcaccaccacgggcttagctagca

SEQ ID NO: 69881 - DNA, 36 bp, Artificial Sequence
  Synthetic oligonucleotide
gaatggaccgagtaccgaggtggtggaggggcggca

SEQ ID NO: 69882 - DNA, 36 bp, Artificial Sequence
  Synthetic oligonucleotide
gacacggtatccgctttatgaatggtcctaactgca

SEQ ID NO: 69883 - DNA, 35 bp, Artificial Sequence
  Synthetic oligonucleotide
aactgcccaacacaatagcaattggagtacctgca

SEQ ID NO: 69884 - DNA, 36 bp, Artificial Sequence
  Synthetic oligonucleotide
gttcgactaacgcgtgtgccctctttccgcggttca

SEQ ID NO: 69885 - DNA, 37 bp, Artificial Sequence
  Synthetic oligonucleotide
gccgatactttgcccccttaccgtacatgtctaaaga

SEQ ID NO: 69886 - DNA, 36 bp, Artificial Sequence
  Synthetic oligonucleotide
agaagggccggagtattagtgggaaggggattaaga

SEQ ID NO: 69887 - DNA, 37 bp, Artificial Sequence
  Synthetic oligonucleotide
gggaccggggagaccggaatttaggggcatggagaga

SEQ ID NO: 69888 - DNA, 37 bp, Artificial Sequence
  Synthetic oligonucleotide
tcaggcggagaaatgggccagggtggcaagtgggaga

SEQ ID NO: 69889 - DNA, 36 bp, Artificial Sequence
  Synthetic oligonucleotide
gacgatccaccttctacacagttttttctcagacga

SEQ ID NO: 69890 - DNA, 37 bp, Artificial Sequence
  Synthetic oligonucleotide
acctcacaacatctagaagcattactcgcccgcgcga

SEQ ID NO: 69891 - DNA, 37 bp, Artificial Sequence
  Synthetic oligonucleotide
tcgaacgcccaaccctcatgactctaaaacagtgcga

SEQ ID NO: 69892 - DNA, 36 bp, Artificial Sequence
  Synthetic oligonucleotide
gattaccgcccgctcgttatccagtgaatctttcga

SEQ ID NO: 69893 - DNA, 37 bp, Artificial Sequence
  Synthetic oligonucleotide
gctgcgcaataccgcattccacacattgtactccgga

SEQ ID NO: 69894 - DNA, 36 bp, Artificial Sequence
  Synthetic oligonucleotide
tgattcagccttgcccggaccctccaccttgtcgga

SEQ ID NO: 69895 - DNA, 37 bp, Artificial Sequence
  Synthetic oligonucleotide
taacggaaggaaggggataacttaaaggcaacgggga

SEQ ID NO: 69896 - DNA, 37 bp, Artificial Sequence
  Synthetic oligonucleotide
acatccgcgacgaaaggggatgattaaaaggggggga

SEQ ID NO: 69897 - DNA, 37 bp, Artificial Sequence
  Synthetic oligonucleotide
taggccagcagagtgggggggtagggtgggtggtgga

SEQ ID NO: 69898 - DNA, 37 bp, Artificial Sequence
  Synthetic oligonucleotide
gaggggtgggggcgcgaagttattgtaggattgtgga

SEQ ID NO: 69899 - DNA, 37 bp, Artificial Sequence
  Synthetic oligonucleotide
acacctagcagcttgtgtccactcttcgctgcaatga

SEQ ID NO: 69900 - DNA, 37 bp, Artificial Sequence
  Synthetic oligonucleotide
tgctggccccgtgctgaatcatctcccatcagaatga

SEQ ID NO: 69901 - DNA, 38 bp, Artificial Sequence
  Synthetic oligonucleotide
actgctcttcccacccgcgcaatccgggcctcccatga

SEQ ID NO: 69902 - DNA, 38 bp, Artificial Sequence
  Synthetic oligonucleotide
atgtgttagccgcaacactgtgtctcatcaaatcatga

SEQ ID NO: 69903 - DNA, 37 bp, Artificial Sequence
  Synthetic oligonucleotide
taatcggagggatcggcggggaaggggcttgggatga

SEQ ID NO: 69904 - DNA, 38 bp, Artificial Sequence
  Synthetic oligonucleotide
accgccgtacgcttagtcctactcatgataccttatga

SEQ ID NO: 69905 - DNA, 38 bp, Artificial Sequence
  Synthetic oligonucleotide
ataccacggaggttgtccatccgcctcactacaactga

SEQ ID NO: 69906 - DNA, 38 bp, Artificial Sequence
  Synthetic oligonucleotide
tcattcacctctcgcctccaccatgtgcctggcactga

SEQ ID NO: 69907 - DNA, 38 bp, Artificial Sequence
  Synthetic oligonucleotide
gtagggagggggcaacaaagagcaggtgaaccgcctga

SEQ ID NO: 69908 - DNA, 38 bp, Artificial Sequence
  Synthetic oligonucleotide
accctggccccatccttcgcccgctctgtggccggtga

SEQ ID NO: 69909 - DNA, 36 bp, Artificial Sequence
  Synthetic oligonucleotide
tacacgccacacgggtattatcctccaagggggtga

SEQ ID NO: 69910 - DNA, 35 bp, Artificial Sequence
  Synthetic oligonucleotide
gactgggggcgttatgagggtggggcatggggtga

SEQ ID NO: 69911 - DNA, 38 bp, Artificial Sequence
  Synthetic oligonucleotide
tgtggaggggatcaaacggagaaggcaaatctgggtga

SEQ ID NO: 69912 - DNA, 38 bp, Artificial Sequence
  Synthetic oligonucleotide
atgaggtgaggatggcatgaaagggctgtggcaattga

SEQ ID NO: 69913 - DNA, 38 bp, Artificial Sequence
  Synthetic oligonucleotide
gagcgagacgcccacccattgatcccgtccccgattga

SEQ ID NO: 69914 - DNA, 37 bp, Artificial Sequence
  Synthetic oligonucleotide
tggtggtcatcccccccgattgatttgcccaacttga

SEQ ID NO: 69915 - DNA, 38 bp, Artificial Sequence
  Synthetic oligonucleotide
aacgacgaacgctcacaccgccgtatatttggccttga

SEQ ID NO: 69916 - DNA, 37 bp, Artificial Sequence
  Synthetic oligonucleotide
gagagccaggaggtacatgttgtgtgaagggtgttga

SEQ ID NO: 69917 - DNA, 37 bp, Artificial Sequence
  Synthetic oligonucleotide
acgcggcttcgtagcgtacgctcatatcatttgttga

SEQ ID NO: 69918 - DNA, 38 bp, Artificial Sequence
  Synthetic oligonucleotide
gatcctcaagtgcattccagataactgccttcctttga

SEQ ID NO: 69919 - DNA, 37 bp, Artificial Sequence
  Synthetic oligonucleotide
gtgacaagaggaggaggttagtgatgcagcagtttga

SEQ ID NO: 69920 - DNA, 36 bp, Artificial Sequence
  Synthetic oligonucleotide
gcgaaggtaggggcgaacggggggacactgttaata

SEQ ID NO: 69921 - DNA, 36 bp, Artificial Sequence
  Synthetic oligonucleotide
cccaatcccatatgctcgacggactacctgtaccta

SEQ ID NO: 69922 - DNA, 36 bp, Artificial Sequence
  Synthetic oligonucleotide
agccctgtgcaccatcttaaagtgcgttaatcccta

SEQ ID NO: 69923 - DNA, 36 bp, Artificial Sequence
  Synthetic oligonucleotide
acttacatacgcgtctttacccttgttcttcgtcta

SEQ ID NO: 69924 - DNA, 36 bp, Artificial Sequence
  Synthetic oligonucleotide
tacctagccctgctgaattcctccatacaaaccgta

SEQ ID NO: 69925 - DNA, 35 bp, Artificial Sequence
  Synthetic oligonucleotide
gatccaggggagcgggcaaaaggggttccaaggta

SEQ ID NO: 69926 - DNA, 35 bp, Artificial Sequence
  Synthetic oligonucleotide
tagtactacgcagatgtcgatccgccccatcttta

SEQ ID NO: 69927 - DNA, 36 bp, Artificial Sequence
  Synthetic oligonucleotide
aatttgccccgacatcgaacacggtgccattcttta

SEQ ID NO: 69928 - DNA, 35 bp, Artificial Sequence
  Synthetic oligonucleotide
acaaaagccagttcatccggtttccctcgtgccac

SEQ ID NO: 69929 - DNA, 34 bp, Artificial Sequence
  Synthetic oligonucleotide
gatatgctaagctcatcaagccagctttcctcac

SEQ ID NO: 69930 - DNA, 35 bp, Artificial Sequence
  Synthetic oligonucleotide
gttgcattcgtacctggtacacaccacgcaccgac

SEQ ID NO: 69931 - DNA, 35 bp, Artificial Sequence
  Synthetic oligonucleotide
gccagtgcaggggtcggcccgcctaacactattac

SEQ ID NO: 69932 - DNA, 35 bp, Artificial Sequence
  Synthetic oligonucleotide
agcctcacatgcccatgctgacatgtatgtacacc

SEQ ID NO: 69933 - DNA, 35 bp, Artificial Sequence
  Synthetic oligonucleotide
aaccaaatgggcaccagcgcttatgcccccctacc

SEQ ID NO: 69934 - DNA, 35 bp, Artificial Sequence
  Synthetic oligonucleotide
gccatccgttcgggatgcagcgagatagccctccc

SEQ ID NO: 69935 - DNA, 35 bp, Artificial Sequence
  Synthetic oligonucleotide
ttgtccctcggtcgacgcagttagcacctggtccc

SEQ ID NO: 69936 - DNA, 34 bp, Artificial Sequence
  Synthetic oligonucleotide
tacccggactgaatcctgtgatgtctatcacgcc

SEQ ID NO: 69937 - DNA, 35 bp, Artificial Sequence
  Synthetic oligonucleotide
ggatagaccctatgcgtaacccgtcattttccgcc

SEQ ID NO: 69938 - DNA, 35 bp, Artificial Sequence
  Synthetic oligonucleotide
agtgtcgcactcacttcttatgttcctgcctggcc

SEQ ID NO: 69939 - DNA, 35 bp, Artificial Sequence
  Synthetic oligonucleotide
attgccgtttaacctaccgctcgcattccatgcgc

SEQ ID NO: 69940 - DNA, 35 bp, Artificial Sequence
  Synthetic oligonucleotide
atcacccttgcagcttgtacacgccgaactaatgc

SEQ ID NO: 69941 - DNA, 35 bp, Artificial Sequence
  Synthetic oligonucleotide
aagccaaatgcataccttcgtggtcgccgtactgc

SEQ ID NO: 69942 - DNA, 35 bp, Artificial Sequence
  Synthetic oligonucleotide
tgatgtagtcccgtcgttgccgtcttttgctgatc

SEQ ID NO: 69943 - DNA, 35 bp, Artificial Sequence
  Synthetic oligonucleotide
gtccacacaacggtctccgacggacagttcttatc

SEQ ID NO: 69944 - DNA, 35 bp, Artificial Sequence
  Synthetic oligonucleotide
tcgaggcactgcacttgcacgccgtcgaacccctc

SEQ ID NO: 69945 - DNA, 35 bp, Artificial Sequence
  Synthetic oligonucleotide
taacaccgctggacggtttctattctggccccctc

SEQ ID NO: 69946 - DNA, 35 bp, Artificial Sequence
  Synthetic oligonucleotide
ttgcaatcctctgacgtcatcctggaccatccctc

SEQ ID NO: 69947 - DNA, 35 bp, Artificial Sequence
  Synthetic oligonucleotide
tatgctctgccttgatcactgctcctcaaagtctc

SEQ ID NO: 69948 - DNA, 35 bp, Artificial Sequence
  Synthetic oligonucleotide
ggatcgcatatagtaacccctgcatactccccgtc

SEQ ID NO: 69949 - DNA, 35 bp, Artificial Sequence
  Synthetic oligonucleotide
ttcgtggcccgacctggttgctatcagtccatgtc

SEQ ID NO: 69950 - DNA, 35 bp, Artificial Sequence
  Synthetic oligonucleotide
tcctttaccacccacctgttgatgtattatcgttc

SEQ ID NO: 69951 - DNA, 35 bp, Artificial Sequence
  Synthetic oligonucleotide
tcactcgacgaggctttacatcaaaggtcgctttc

SEQ ID NO: 69952 - DNA, 35 bp, Artificial Sequence
  Synthetic oligonucleotide
gacctgagccttctccggtgccatcgatgccaccg

SEQ ID NO: 69953 - DNA, 35 bp, Artificial Sequence
  Synthetic oligonucleotide
gtcactacccttcaagcatatccgaatcctgcccg

SEQ ID NO: 69954 - DNA, 35 bp, Artificial Sequence
  Synthetic oligonucleotide
gtgctcccgggtaagtagggtgggggtggaggagg

SEQ ID NO: 69955 - DNA, 35 bp, Artificial Sequence
  Synthetic oligonucleotide
tcccacacctggttcttgcggagcaacctcttagg

SEQ ID NO: 69956 - DNA, 35 bp, Artificial Sequence
  Synthetic oligonucleotide
agcgaagggacaggtagggagcgtgggtagttagg

SEQ ID NO: 69957 - DNA, 36 bp, Artificial Sequence
  Synthetic oligonucleotide
atcacactccttatctagcctttaggtacagctggg

SEQ ID NO: 69958 - DNA, 35 bp, Artificial Sequence
  Synthetic oligonucleotide
gaagcgccctgtcaccctaccctccaactgactgg

SEQ ID NO: 69959 - DNA, 35 bp, Artificial Sequence
  Synthetic oligonucleotide
tcagccccatgaaggctacggtctacctcccctgg

SEQ ID NO: 69960 - DNA, 35 bp, Artificial Sequence
  Synthetic oligonucleotide
gccgcctcaggtcaaccgttctcgatttttgctgg

SEQ ID NO: 69961 - DNA, 35 bp, Artificial Sequence
  Synthetic oligonucleotide
agccggggcgccaggctattacccaactcaccctg

SEQ ID NO: 69962 - DNA, 35 bp, Artificial Sequence
  Synthetic oligonucleotide
tcagtgtggggctcggattatggggaggaagcttg

SEQ ID NO: 69963 - DNA, 35 bp, Artificial Sequence
  Synthetic oligonucleotide
tccctccgcacgaggcgttgcggtttgctaccact

SEQ ID NO: 69964 - DNA, 35 bp, Artificial Sequence
  Synthetic oligonucleotide
cccacatgcccgaacatgtccaggtcttcctcact

SEQ ID NO: 69965 - DNA, 35 bp, Artificial Sequence
  Synthetic oligonucleotide
actgcctcaccataactggcttagtgaaataacct

SEQ ID NO: 69966 - DNA, 35 bp, Artificial Sequence
  Synthetic oligonucleotide
tccatcccccactgtttaagtctgcagctatacct

SEQ ID NO: 69967 - DNA, 35 bp, Artificial Sequence
  Synthetic oligonucleotide
acgcctttgctcagtcctctacgtgaaccgtacct

SEQ ID NO: 69968 - DNA, 35 bp, Artificial Sequence
  Synthetic oligonucleotide
ttggtcacggggacgcccgaccgaccgcttaccct

SEQ ID NO: 69969 - DNA, 35 bp, Artificial Sequence
  Synthetic oligonucleotide
tatctgacgtctgcggcacaacactgtccttatct

SEQ ID NO: 69970 - DNA, 35 bp, Artificial Sequence
  Synthetic oligonucleotide
atcgctccctccaccatcccaacccagcaccgagt

SEQ ID NO: 69971 - DNA, 35 bp, Artificial Sequence
  Synthetic oligonucleotide
ttaccctcccaaatgcacacgcacgttgcgcttgt

SEQ ID NO: 69972 - DNA, 35 bp, Artificial Sequence
  Synthetic oligonucleotide
tcacatttgcagtactggccctcggtaccatcatt

SEQ ID NO: 69973 - DNA, 35 bp, Artificial Sequence
  Synthetic oligonucleotide
tcgatgtgatcattggcccgaaactcccccctatt

SEQ ID NO: 69974 - DNA, 33 bp, Artificial Sequence
  Synthetic oligonucleotide
ttacgagggggttggggtgcttacacttggctt

SEQ ID NO: 69975 - DNA, 35 bp, Artificial Sequence
  Synthetic oligonucleotide
tttgtgagcgcacaatttgtctgccctctgcattt

SEQ ID NO: 69976 - DNA, 35 bp, Artificial Sequence
  Synthetic oligonucleotide
aacacagcacgatcttcgttgcattaaaaccgttt

SEQ ID NO: 69977 - DNA, 35 bp, Artificial Sequence
  Synthetic oligonucleotide
gtgcggtctcgcgacgagagtcgagttatccgttt

SEQ ID NO: 69978 - DNA, 35 bp, Artificial Sequence
  Synthetic oligonucleotide
tcccgaacccctccgaaagactcgtttccaacaaa

SEQ ID NO: 69979 - DNA, 35 bp, Artificial Sequence
  Synthetic oligonucleotide
gccagcccgacttcacacacccgttgggacgcaaa

SEQ ID NO: 69980 - DNA, 35 bp, Artificial Sequence
  Synthetic oligonucleotide
gatgcctagcatcgatattcccggtgacaaaccaa

SEQ ID NO: 69981 - DNA, 36 bp, Artificial Sequence
  Synthetic oligonucleotide
acgtacaggcgccagcgtcttcccatattacctcaa

SEQ ID NO: 69982 - DNA, 33 bp, Artificial Sequence
  Synthetic oligonucleotide
gacaaaaaagggtggatcagggcgtcagcagaa

SEQ ID NO: 69983 - DNA, 36 bp, Artificial Sequence
  Synthetic oligonucleotide
gacatagctacttacaacggggatctgccgaacgaa

SEQ ID NO: 69984 - DNA, 36 bp, Artificial Sequence
  Synthetic oligonucleotide
ttccccccatgatgtcgcaccggtataccgcccgaa

SEQ ID NO: 69985 - DNA, 36 bp, Artificial Sequence
  Synthetic oligonucleotide
acaccgctcggcgccgctgtttgcccaacaactaca

SEQ ID NO: 69986 - DNA, 36 bp, Artificial Sequence
  Synthetic oligonucleotide
agccaccaacacgccttgctccgtgcagtccttaca

SEQ ID NO: 69987 - DNA, 36 bp, Artificial Sequence
  Synthetic oligonucleotide
gagtatcagtcgcaccacccccttgacgtctagcca

SEQ ID NO: 69988 - DNA, 35 bp, Artificial Sequence
  Synthetic oligonucleotide
ttcccccctcctgctttttacagtctgtgccctca

SEQ ID NO: 69989 - DNA, 35 bp, Artificial Sequence
  Synthetic oligonucleotide
acgcataaacgccgcccgttttacttcaattctca

SEQ ID NO: 69990 - DNA, 35 bp, Artificial Sequence
  Synthetic oligonucleotide
ttagggagggagggacgtaaaagagggttatgtca

SEQ ID NO: 69991 - DNA, 36 bp, Artificial Sequence
  Synthetic oligonucleotide
gcaacggcatgtcttctttggctgtctatcctgtca

SEQ ID NO: 69992 - DNA, 35 bp, Artificial Sequence
  Synthetic oligonucleotide
tccacggcgaaactcactgcaagtacccactttca

SEQ ID NO: 69993 - DNA, 36 bp, Artificial Sequence
  Synthetic oligonucleotide
tcagtcggacaagaagtacaagctgcatgtgtaaga

SEQ ID NO: 69994 - DNA, 37 bp, Artificial Sequence
  Synthetic oligonucleotide
agtaaggttgggagggggagagtcgatatctggcaga

SEQ ID NO: 69995 - DNA, 37 bp, Artificial Sequence
  Synthetic oligonucleotide
gtaaccggaggaagggacgaggaaggctgtaggtaga

SEQ ID NO: 69996 - DNA, 37 bp, Artificial Sequence
  Synthetic oligonucleotide
agccaccaccaaggatcgtcacaagtttttgccccga

SEQ ID NO: 69997 - DNA, 37 bp, Artificial Sequence
  Synthetic oligonucleotide
gacgtgcccccttcccgagcctagctgacgtgcgcga

SEQ ID NO: 69998 - DNA, 37 bp, Artificial Sequence
  Synthetic oligonucleotide
tatcgccccactcacttttgctagctattgtctgcga

SEQ ID NO: 69999 - DNA, 37 bp, Artificial Sequence
  Synthetic oligonucleotide
tatacgcactcgcaccttcccgctatttattgtgcga

SEQ ID NO: 70000 - DNA, 37 bp, Artificial Sequence
  Synthetic oligonucleotide
agatgacgctgtctatatacccccgtcctgccctcga

SEQ ID NO: 70001 - DNA, 37 bp, Artificial Sequence
  Synthetic oligonucleotide
atggcggggcaggcagagcaagagggcggaggacgga

SEQ ID NO: 70002 - DNA, 36 bp, Artificial Sequence
  Synthetic oligonucleotide
aacgttgggacgggggagtagggacggaatacggga

SEQ ID NO: 70003 - DNA, 37 bp, Artificial Sequence
  Synthetic oligonucleotide
tagtactgcgggggggatccgcttttgttgtagggga

SEQ ID NO: 70004 - DNA, 37 bp, Artificial Sequence
  Synthetic oligonucleotide
gatgggcgttcttgccggtttagggtgctggtgggga

SEQ ID NO: 70005 - DNA, 37 bp, Artificial Sequence
  Synthetic oligonucleotide
gattgaagggaggaatagataagtgcgaatgatggga

SEQ ID NO: 70006 - DNA, 37 bp, Artificial Sequence
  Synthetic oligonucleotide
ggtcagggtaggtaagaagagaagcatgaaggtggga

SEQ ID NO: 70007 - DNA, 36 bp, Artificial Sequence
  Synthetic oligonucleotide
gacctatgcccatccataatccatccaccatctgga

SEQ ID NO: 70008 - DNA, 36 bp, Artificial Sequence
  Synthetic oligonucleotide
ccgacaggtagatcttttaccgaccccatctctgga

SEQ ID NO: 70009 - DNA, 37 bp, Artificial Sequence
  Synthetic oligonucleotide
gtgacgggcggtgaaggctaggcaagaaaggggtgga

SEQ ID NO: 70010 - DNA, 37 bp, Artificial Sequence
  Synthetic oligonucleotide
tgcccacggactattcgcgtagagttcacacccatga

SEQ ID NO: 70011 - DNA, 37 bp, Artificial Sequence
  Synthetic oligonucleotide
gcacacgggaagatgacttcgtctcaatagtacctga

SEQ ID NO: 70012 - DNA, 38 bp, Artificial Sequence
  Synthetic oligonucleotide
ggagcgatcatgctctcccaaactccgacgcaccctga

SEQ ID NO: 70013 - DNA, 38 bp, Artificial Sequence
  Synthetic oligonucleotide
actgcacattcaaatcagctcgagtacccgcaccctga

SEQ ID NO: 70014 - DNA, 38 bp, Artificial Sequence
  Synthetic oligonucleotide
tacatgcggacacggggatactggtgcttgtgcagtga

SEQ ID NO: 70015 - DNA, 38 bp, Artificial Sequence
  Synthetic oligonucleotide
gcatcgggagggtggaggtggtgggattactcgcgtga

SEQ ID NO: 70016 - DNA, 38 bp, Artificial Sequence
  Synthetic oligonucleotide
tagggcgcaggaaagcaaaggatcgatcggaaaggtga

SEQ ID NO: 70017 - DNA, 37 bp, Artificial Sequence
  Synthetic oligonucleotide
atgggcgggggacaattaaaggaatgcgacgctgtga

SEQ ID NO: 70018 - DNA, 38 bp, Artificial Sequence
  Synthetic oligonucleotide
aacagggatggcgcaatgaagggggggagtggttgtga

SEQ ID NO: 70019 - DNA, 38 bp, Artificial Sequence
  Synthetic oligonucleotide
tgagaccggcacactccacagctccagttcccacttga

SEQ ID NO: 70020 - DNA, 37 bp, Artificial Sequence
  Synthetic oligonucleotide
tgcctgacgtttgcacccctacacgccacaaccttga

SEQ ID NO: 70021 - DNA, 37 bp, Artificial Sequence
  Synthetic oligonucleotide
aatccgcctggcccttgagcaaagctgtccaccttga

SEQ ID NO: 70022 - DNA, 38 bp, Artificial Sequence
  Synthetic oligonucleotide
tcgaagcgcccagtaccttcatgtttgccctcccttga

SEQ ID NO: 70023 - DNA, 38 bp, Artificial Sequence
  Synthetic oligonucleotide
tgaacaacgacggaatggcagagggtgaactggcttga

SEQ ID NO: 70024 - DNA, 38 bp, Artificial Sequence
  Synthetic oligonucleotide
gacacaccatcctatcccacgccccgcccctgtcttga

SEQ ID NO: 70025 - DNA, 38 bp, Artificial Sequence
  Synthetic oligonucleotide
tcaggccacccaccagatcgtaactcagcggccgttga

SEQ ID NO: 70026 - DNA, 38 bp, Artificial Sequence
  Synthetic oligonucleotide
atccaccccctcgcatccgcatcatttaagtagtttga

SEQ ID NO: 70027 - DNA, 36 bp, Artificial Sequence
  Synthetic oligonucleotide
atggagagggggcatgtgatagggtgtagcgccata

SEQ ID NO: 70028 - DNA, 36 bp, Artificial Sequence
  Synthetic oligonucleotide
gccacagcagtagatgtctgtgatccttctcgcata

SEQ ID NO: 70029 - DNA, 36 bp, Artificial Sequence
  Synthetic oligonucleotide
accgctgcacctgcaatgctttgcagactaacacta

SEQ ID NO: 70030 - DNA, 35 bp, Artificial Sequence
  Synthetic oligonucleotide
ggaccatcacatgcggacgggaacgccctctacta

SEQ ID NO: 70031 - DNA, 36 bp, Artificial Sequence
  Synthetic oligonucleotide
gactggtcctgcacgtacgccaacgaataactccta

SEQ ID NO: 70032 - DNA, 36 bp, Artificial Sequence
  Synthetic oligonucleotide
gtgttaccagggccgtcataccacagcacgcatcta

SEQ ID NO: 70033 - DNA, 36 bp, Artificial Sequence
  Synthetic oligonucleotide
tcgtagcctcgcacgtaacctcccacagttccggta

SEQ ID NO: 70034 - DNA, 36 bp, Artificial Sequence
  Synthetic oligonucleotide
tgagcccggcgcctacgttgtctctttgtcccttta

SEQ ID NO: 70035 - DNA, 35 bp, Artificial Sequence
  Synthetic oligonucleotide
aattacatctgccgtgcgaggaccgagcatctaac

SEQ ID NO: 70036 - DNA, 35 bp, Artificial Sequence
  Synthetic oligonucleotide
ttcgccccggtacttgtcgcaggctccacgaccac

SEQ ID NO: 70037 - DNA, 35 bp, Artificial Sequence
  Synthetic oligonucleotide
gctgcgaacggaccccaacctctcgtgacttccac

SEQ ID NO: 70038 - DNA, 35 bp, Artificial Sequence
  Synthetic oligonucleotide
ggaccatcacctacaagtcacagtcatagttcgac

SEQ ID NO: 70039 - DNA, 35 bp, Artificial Sequence
  Synthetic oligonucleotide
accgtggaaaggaggggggccggagaggtgaggac

SEQ ID NO: 70040 - DNA, 35 bp, Artificial Sequence
  Synthetic oligonucleotide
tctgtgccaatgtttcaactacccctccagcaacc

SEQ ID NO: 70041 - DNA, 35 bp, Artificial Sequence
  Synthetic oligonucleotide
tgttgggccggaatttccagtgcatcgctttcacc

SEQ ID NO: 70042 - DNA, 35 bp, Artificial Sequence
  Synthetic oligonucleotide
atgttccaactagactgtttttccgctcggttacc

SEQ ID NO: 70043 - DNA, 35 bp, Artificial Sequence
  Synthetic oligonucleotide
atactcgacctaccctgacgctctctttgccggcc

SEQ ID NO: 70044 - DNA, 35 bp, Artificial Sequence
  Synthetic oligonucleotide
ataccccgccccaaggacttaactagctgtcgagc

SEQ ID NO: 70045 - DNA, 35 bp, Artificial Sequence
  Synthetic oligonucleotide
gaatcgcacgtagctacacaacacctgccgtgagc

SEQ ID NO: 70046 - DNA, 35 bp, Artificial Sequence
  Synthetic oligonucleotide
gacgaggtccgccggccccctgctgtcatactggc

SEQ ID NO: 70047 - DNA, 35 bp, Artificial Sequence
  Synthetic oligonucleotide
gcaaccagcccgtcacccggggaagcatacttggc

SEQ ID NO: 70048 - DNA, 35 bp, Artificial Sequence
  Synthetic oligonucleotide
tgtgggtgcatctgccgtgccttctaccgctatgc

SEQ ID NO: 70049 - DNA, 35 bp, Artificial Sequence
  Synthetic oligonucleotide
tgttgctcatctctcacgggattgcgattccttgc

SEQ ID NO: 70050 - DNA, 35 bp, Artificial Sequence
  Synthetic oligonucleotide
tctacgcactcaatcagtgcccagtcatttaactc

SEQ ID NO: 70051 - DNA, 35 bp, Artificial Sequence
  Synthetic oligonucleotide
tagaccgagccggggtccacccgcacttacgactc

SEQ ID NO: 70052 - DNA, 35 bp, Artificial Sequence
  Synthetic oligonucleotide
aaatgcccttgcgcccaaccatagccgtactagtc

SEQ ID NO: 70053 - DNA, 35 bp, Artificial Sequence
  Synthetic oligonucleotide
acctggtagtggtacctacagccgatttagctttc

SEQ ID NO: 70054 - DNA, 35 bp, Artificial Sequence
  Synthetic oligonucleotide
accccccaatcagtctattagcgttcaatgaacag

SEQ ID NO: 70055 - DNA, 35 bp, Artificial Sequence
  Synthetic oligonucleotide
atgggaaatgatgggcgataggaggggatttggag

SEQ ID NO: 70056 - DNA, 35 bp, Artificial Sequence
  Synthetic oligonucleotide
gaccacgcgtgcccctcctccgcttacgtcactag

SEQ ID NO: 70057 - DNA, 35 bp, Artificial Sequence
  Synthetic oligonucleotide
ttgtacctcagcttggtctgctacttctttttacg

SEQ ID NO: 70058 - DNA, 35 bp, Artificial Sequence
  Synthetic oligonucleotide
attgctcgactccgggttcatctggtactttatcg

SEQ ID NO: 70059 - DNA, 35 bp, Artificial Sequence
  Synthetic oligonucleotide
acgtccaatttcagccattgcattctgttttctcg

SEQ ID NO: 70060 - DNA, 35 bp, Artificial Sequence
  Synthetic oligonucleotide
gaatgcaatgggcgtacgggtagaggaagagtagg

SEQ ID NO: 70061 - DNA, 35 bp, Artificial Sequence
  Synthetic oligonucleotide
attgcgcgagtaggtgatgccggacgtggtggtgg

SEQ ID NO: 70062 - DNA, 35 bp, Artificial Sequence
  Synthetic oligonucleotide
atgaccgctcttccgctggttgattatgcacactg

SEQ ID NO: 70063 - DNA, 35 bp, Artificial Sequence
  Synthetic oligonucleotide
ggtgaaggggggggttgggcatgcaaacatgcctg

SEQ ID NO: 70064 - DNA, 35 bp, Artificial Sequence
  Synthetic oligonucleotide
tccgcaccccgaacccacccgtgccaatccaccct

SEQ ID NO: 70065 - DNA, 35 bp, Artificial Sequence
  Synthetic oligonucleotide
tgtgctctgtgacgcatccttcttgccgaaagcct

SEQ ID NO: 70066 - DNA, 35 bp, Artificial Sequence
  Synthetic oligonucleotide
acccgctgttgtcattaacggtcacccacattcct

SEQ ID NO: 70067 - DNA, 35 bp, Artificial Sequence
  Synthetic oligonucleotide
agggtggggcgaataactggggattaaggcgcggt

SEQ ID NO: 70068 - DNA, 35 bp, Artificial Sequence
  Synthetic oligonucleotide
atgtcccagttgccgcgataacaggctcgaccatt

SEQ ID NO: 70069 - DNA, 35 bp, Artificial Sequence
  Synthetic oligonucleotide
ttgcaactcatgtgttgtcccgctcgtctgccatt

SEQ ID NO: 70070 - DNA, 35 bp, Artificial Sequence
  Synthetic oligonucleotide
gaccccttcctgatcattgttcgtgacacttgatt

SEQ ID NO: 70071 - DNA, 35 bp, Artificial Sequence
  Synthetic oligonucleotide
tccccaggtggcacgccccccctaccgtgagagtt

SEQ ID NO: 70072 - DNA, 35 bp, Artificial Sequence
  Synthetic oligonucleotide
atgtgtcctgaccaaatcgcctcttatgcttagtt

SEQ ID NO: 70073 - DNA, 36 bp, Artificial Sequence
  Synthetic oligonucleotide
ggggactggacgggggtggacatagcgtgcaaagaa

SEQ ID NO: 70074 - DNA, 35 bp, Artificial Sequence
  Synthetic oligonucleotide
atgcctgcgagagtatggtgcaaggtgggagagaa

SEQ ID NO: 70075 - DNA, 35 bp, Artificial Sequence
  Synthetic oligonucleotide
gccctggccctccgtgtcttgaactattgcatgaa

SEQ ID NO: 70076 - DNA, 35 bp, Artificial Sequence
  Synthetic oligonucleotide
atactccatccgccacgctcttactggggtcataa

SEQ ID NO: 70077 - DNA, 36 bp, Artificial Sequence
  Synthetic oligonucleotide
aggagccaggcggacgagctaggggagggaggataa

SEQ ID NO: 70078 - DNA, 36 bp, Artificial Sequence
  Synthetic oligonucleotide
gtccctagccccgccgttaaaagcacacacttgtaa

SEQ ID NO: 70079 - DNA, 36 bp, Artificial Sequence
  Synthetic oligonucleotide
aacggaggtccgccacggctcagagcattcaccaca

SEQ ID NO: 70080 - DNA, 36 bp, Artificial Sequence
  Synthetic oligonucleotide
gtcatcgggaccggtacgttaggccaactactcaca

SEQ ID NO: 70081 - DNA, 36 bp, Artificial Sequence
  Synthetic oligonucleotide
gaacctgggcctccccgccttgcctccactggacca

SEQ ID NO: 70082 - DNA, 36 bp, Artificial Sequence
  Synthetic oligonucleotide
ttccgtcccggtgccgtcgcctttcgtctgccgcca

SEQ ID NO: 70083 - DNA, 35 bp, Artificial Sequence
  Synthetic oligonucleotide
gatggaccagccccttacttacctgaccgagagca

SEQ ID NO: 70084 - DNA, 36 bp, Artificial Sequence
  Synthetic oligonucleotide
taggtagccaatgacccagccgctcaagtctccgca

SEQ ID NO: 70085 - DNA, 36 bp, Artificial Sequence
  Synthetic oligonucleotide
ggggtgccccccttaactgttctatccgtcctggca

SEQ ID NO: 70086 - DNA, 36 bp, Artificial Sequence
  Synthetic oligonucleotide
tttatcgtgccactttgttccgttccagccactgca

SEQ ID NO: 70087 - DNA, 35 bp, Artificial Sequence
  Synthetic oligonucleotide
aactcactaccacagcttgctgtttgctaccatca

SEQ ID NO: 70088 - DNA, 35 bp, Artificial Sequence
  Synthetic oligonucleotide
tctacctcccatacgttcagatggtcgtcctatca

SEQ ID NO: 70089 - DNA, 35 bp, Artificial Sequence
  Synthetic oligonucleotide
gatggatggggttcgttgggcggtagaagtcgtca

SEQ ID NO: 70090 - DNA, 35 bp, Artificial Sequence
  Synthetic oligonucleotide
agcacgaccacggtccatgggccaacaccgcttca

SEQ ID NO: 70091 - DNA, 37 bp, Artificial Sequence
  Synthetic oligonucleotide
atcagccgcccttgaaccctattgacattttgtaaga

SEQ ID NO: 70092 - DNA, 35 bp, Artificial Sequence
  Synthetic oligonucleotide
atcgcaccttgcacacttgggcacctgaaccacga

SEQ ID NO: 70093 - DNA, 36 bp, Artificial Sequence
  Synthetic oligonucleotide
gaattcagcactcccactgccttacaatgccaccga

SEQ ID NO: 70094 - DNA, 37 bp, Artificial Sequence
  Synthetic oligonucleotide
agcccgactccccccggtgacttgccactaaacccga

SEQ ID NO: 70095 - DNA, 37 bp, Artificial Sequence
  Synthetic oligonucleotide
acacatactctgggtcctcgagccaacaaacccccga

SEQ ID NO: 70096 - DNA, 37 bp, Artificial Sequence
  Synthetic oligonucleotide
tgctcactggtgctccattcatgactactcatcccga

SEQ ID NO: 70097 - DNA, 36 bp, Artificial Sequence
  Synthetic oligonucleotide
tgccaagccaaagggggcactggacagaattaagga

SEQ ID NO: 70098 - DNA, 37 bp, Artificial Sequence
  Synthetic oligonucleotide
gaactgtccgtccgtttagttactctcgtttccagga

SEQ ID NO: 70099 - DNA, 37 bp, Artificial Sequence
  Synthetic oligonucleotide
tgagggtggaaaggtgggcctcgggtgggtttacgga

SEQ ID NO: 70100 - DNA, 35 bp, Artificial Sequence
  Synthetic oligonucleotide
ttcgcactaccttgcgctatgcccctagatccgga

SEQ ID NO: 70101 - DNA, 37 bp, Artificial Sequence
  Synthetic oligonucleotide
acacgagtggacatagggcttttcgtagtgcaaggga

SEQ ID NO: 70102 - DNA, 37 bp, Artificial Sequence
  Synthetic oligonucleotide
tgaggaagaagagggggatgagatatgggtttctgga

SEQ ID NO: 70103 - DNA, 37 bp, Artificial Sequence
  Synthetic oligonucleotide
tacaaccacattgctcacgatcctttcctgtagtgga

SEQ ID NO: 70104 - DNA, 38 bp, Artificial Sequence
  Synthetic oligonucleotide
gacaatgcaatgacatgaaaaggaagcgaaggaaatga

SEQ ID NO: 70105 - DNA, 38 bp, Artificial Sequence
  Synthetic oligonucleotide
tctcagcacctccgctcatctgtcgcttcatccaatga

SEQ ID NO: 70106 - DNA, 37 bp, Artificial Sequence
  Synthetic oligonucleotide
ggacagggcgggaaatactaaaaagggggccacatga

SEQ ID NO: 70107 - DNA, 38 bp, Artificial Sequence
  Synthetic oligonucleotide
agccaagcctgtgccatcctttaggccattcaccatga

SEQ ID NO: 70108 - DNA, 37 bp, Artificial Sequence
  Synthetic oligonucleotide
taccgccaggtaacatcattagcaatccgccatatga

SEQ ID NO: 70109 - DNA, 38 bp, Artificial Sequence
  Synthetic oligonucleotide
tacctccagcccacactttgcttggactacacaactga

SEQ ID NO: 70110 - DNA, 38 bp, Artificial Sequence
  Synthetic oligonucleotide
tcacccttagcctggaccgctaaactgagtcttcctga

SEQ ID NO: 70111 - DNA, 36 bp, Artificial Sequence
  Synthetic oligonucleotide
acagcccaaccacactgcactttactggatagctga

SEQ ID NO: 70112 - DNA, 38 bp, Artificial Sequence
  Synthetic oligonucleotide
gcaagcgacggatctattctaaacgctactcccgctga

SEQ ID NO: 70113 - DNA, 35 bp, Artificial Sequence
  Synthetic oligonucleotide
attcccctgtcgtacgtggttcccttttgctctga

SEQ ID NO: 70114 - DNA, 38 bp, Artificial Sequence
  Synthetic oligonucleotide
gatcccgccactaccttaaatagccatcgaaatcgtga

SEQ ID NO: 70115 - DNA, 38 bp, Artificial Sequence
  Synthetic oligonucleotide
gcgaggtggtgaggtaaggtgaaagggggcagaggtga

SEQ ID NO: 70116 - DNA, 38 bp, Artificial Sequence
  Synthetic oligonucleotide
gcaggggggtggggctatttgacttaagcatgcggtga

SEQ ID NO: 70117 - DNA, 38 bp, Artificial Sequence
  Synthetic oligonucleotide
gaggagggtggaggtagagtgcccggccctttgtgtga

SEQ ID NO: 70118 - DNA, 38 bp, Artificial Sequence
  Synthetic oligonucleotide
acgaccacccgtgacaaacattcgaccgtccgacttga

SEQ ID NO: 70119 - DNA, 37 bp, Artificial Sequence
  Synthetic oligonucleotide
ggatgggcagggcgacggggaacgggggccgggttga

SEQ ID NO: 70120 - DNA, 37 bp, Artificial Sequence
  Synthetic oligonucleotide
aattgacacctacacttgtgcatttattttcatttga

SEQ ID NO: 70121 - DNA, 38 bp, Artificial Sequence
  Synthetic oligonucleotide
taacgtaacgcccgaccatgcacatatacctgctttga

SEQ ID NO: 70122 - DNA, 36 bp, Artificial Sequence
  Synthetic oligonucleotide
gactcctatcagccccgagcacgtcattccccgata

SEQ ID NO: 70123 - DNA, 36 bp, Artificial Sequence
  Synthetic oligonucleotide
tgctgcacctggtgacttatcgcatcttacacacta

SEQ ID NO: 70124 - DNA, 36 bp, Artificial Sequence
  Synthetic oligonucleotide
acccctgtaacgccgagcctctccgttcgctctcta

SEQ ID NO: 70125 - DNA, 35 bp, Artificial Sequence
  Synthetic oligonucleotide
acccagttccctcatcctagtatgtccctgtagta

SEQ ID NO: 70126 - DNA, 36 bp, Artificial Sequence
  Synthetic oligonucleotide
accctccttacatgctttatagcccacaggcattta

SEQ ID NO: 70127 - DNA, 36 bp, Artificial Sequence
  Synthetic oligonucleotide
ggtgtaccccgctcatcattgcttttgtccgattta

SEQ ID NO: 70128 - DNA, 35 bp, Artificial Sequence
  Synthetic oligonucleotide
ttagcgccccgcaagaccggccctgttctgccgac

SEQ ID NO: 70129 - DNA, 35 bp, Artificial Sequence
  Synthetic oligonucleotide
taggggtggaagagaaggatgtagggaaaaggacc

SEQ ID NO: 70130 - DNA, 35 bp, Artificial Sequence
  Synthetic oligonucleotide
accagatccgtgcgtgttatatcgtacgcactacc

SEQ ID NO: 70131 - DNA, 35 bp, Artificial Sequence
  Synthetic oligonucleotide
tacgtgacgcctaaacctgacaccagaagggtacc

SEQ ID NO: 70132 - DNA, 35 bp, Artificial Sequence
  Synthetic oligonucleotide
tacgcactacgacctaccgacactgcagtgctgcc

SEQ ID NO: 70133 - DNA, 35 bp, Artificial Sequence
  Synthetic oligonucleotide
ttccaaccggatctagagttgccccctcttctgcc

SEQ ID NO: 70134 - DNA, 35 bp, Artificial Sequence
  Synthetic oligonucleotide
gctcgccctcgctgtacaaccgatccgtgaattcc

SEQ ID NO: 70135 - DNA, 35 bp, Artificial Sequence
  Synthetic oligonucleotide
ggaaaacccgcaaacaactcaaatgtcagaccagc

SEQ ID NO: 70136 - DNA, 35 bp, Artificial Sequence
  Synthetic oligonucleotide
catgtgccgcaactccgccgtccgtatcctcgcgc

SEQ ID NO: 70137 - DNA, 35 bp, Artificial Sequence
  Synthetic oligonucleotide
tacaccactatagggctagtgccatggttcaactc

SEQ ID NO: 70138 - DNA, 35 bp, Artificial Sequence
  Synthetic oligonucleotide
gatcaacgctctacacaactcagcccgtaacactc

SEQ ID NO: 70139 - DNA, 35 bp, Artificial Sequence
  Synthetic oligonucleotide
gcgccctccactacttatagcgacgtccacggttc

SEQ ID NO: 70140 - DNA, 35 bp, Artificial Sequence
  Synthetic oligonucleotide
aacacccgttctggtgcacgacgtgttcctgcccg

SEQ ID NO: 70141 - DNA, 35 bp, Artificial Sequence
  Synthetic oligonucleotide
aacgcacagcattacgttacgtctggcctcaatcg

SEQ ID NO: 70142 - DNA, 35 bp, Artificial Sequence
  Synthetic oligonucleotide
aagtagacaccgggaattggggtaggggatggagg

SEQ ID NO: 70143 - DNA, 35 bp, Artificial Sequence
  Synthetic oligonucleotide
gcatgagctgaaagacgattgggtgtggtggttgg

SEQ ID NO: 70144 - DNA, 35 bp, Artificial Sequence
  Synthetic oligonucleotide
gctcccccaccacaatctatatgacagatatgatg

SEQ ID NO: 70145 - DNA, 35 bp, Artificial Sequence
  Synthetic oligonucleotide
accgactgccccgtgtccaccgcacctttcctctg

SEQ ID NO: 70146 - DNA, 35 bp, Artificial Sequence
  Synthetic oligonucleotide
tgttaccttctctctgactcccgattgggcctttg

SEQ ID NO: 70147 - DNA, 35 bp, Artificial Sequence
  Synthetic oligonucleotide
aatgccctatctgttatgcgtaattgtcaccccat

SEQ ID NO: 70148 - DNA, 35 bp, Artificial Sequence
  Synthetic oligonucleotide
gtgagcaccgcccgatatcgatcggacccaactat

SEQ ID NO: 70149 - DNA, 35 bp, Artificial Sequence
  Synthetic oligonucleotide
ggacccccattcaacgtcacaagctagtacatcct

SEQ ID NO: 70150 - DNA, 35 bp, Artificial Sequence
  Synthetic oligonucleotide
aacaccacactatccagcttacgattaccagacgt

SEQ ID NO: 70151 - DNA, 35 bp, Artificial Sequence
  Synthetic oligonucleotide
gcccttgccactatgctcaccctaaatgtgccggt

SEQ ID NO: 70152 - DNA, 35 bp, Artificial Sequence
  Synthetic oligonucleotide
aactcgatgctctgcccacctcgctcacgctatgt

SEQ ID NO: 70153 - DNA, 35 bp, Artificial Sequence
  Synthetic oligonucleotide
gacctccacaccgcgcgtgttccaacctaaggctt

SEQ ID NO: 70154 - DNA, 35 bp, Artificial Sequence
  Synthetic oligonucleotide
aacttggtccgcctatccccaattagcctgtgctt

SEQ ID NO: 70155 - DNA, 35 bp, Artificial Sequence
  Synthetic oligonucleotide
ggaaggcacggtaatgcgccccacctccgccagtt

SEQ ID NO: 70156 - DNA, 34 bp, Artificial Sequence
  Synthetic oligonucleotide
ttaactacgcccacctcgtacatagttcctagtt

SEQ ID NO: 70157 - DNA, 35 bp, Artificial Sequence
  Synthetic oligonucleotide
tgcaacgggatgggtgttggtgaaatggaactgtt

SEQ ID NO: 70158 - DNA, 35 bp, Artificial Sequence
  Synthetic oligonucleotide
gcctggctgtgcgcccttcttcaccagtttaattt

SEQ ID NO: 70159 - DNA, 35 bp, Artificial Sequence
  Synthetic oligonucleotide
tccaccagacctgatctgaagcaacctaatcgaaa

SEQ ID NO: 70160 - DNA, 36 bp, Artificial Sequence
  Synthetic oligonucleotide
atctcgcgatccctgctttcttcgccattctaggaa

SEQ ID NO: 70161 - DNA, 36 bp, Artificial Sequence
  Synthetic oligonucleotide
gatacagtgccacatttacatctccgacttgctgaa

SEQ ID NO: 70162 - DNA, 35 bp, Artificial Sequence
  Synthetic oligonucleotide
gaatggcggaatggacccacacagggctcaagaca

SEQ ID NO: 70163 - DNA, 36 bp, Artificial Sequence
  Synthetic oligonucleotide
gacctcatcaaggttgtttttcattgggatactaca

SEQ ID NO: 70164 - DNA, 36 bp, Artificial Sequence
  Synthetic oligonucleotide
tgtatccccagccaccattcgaaagcacagtaccca

SEQ ID NO: 70165 - DNA, 35 bp, Artificial Sequence
  Synthetic oligonucleotide
gcgaccactcgcaacaccgttaatgacaaccccca

SEQ ID NO: 70166 - DNA, 36 bp, Artificial Sequence
  Synthetic oligonucleotide
atctaccgccatgtccctgtcttcagaagggtgcca

SEQ ID NO: 70167 - DNA, 36 bp, Artificial Sequence
  Synthetic oligonucleotide
aacgagggtggacaggttgggagtcggcttcgtcca

SEQ ID NO: 70168 - DNA, 36 bp, Artificial Sequence
  Synthetic oligonucleotide
aacccttctcgtatcactatagcttgcctgtaatca

SEQ ID NO: 70169 - DNA, 36 bp, Artificial Sequence
  Synthetic oligonucleotide
tacgatccatctctacccatatgtgcaaactcctca

SEQ ID NO: 70170 - DNA, 36 bp, Artificial Sequence
  Synthetic oligonucleotide
actgagccagcctctacttgatttataccatattca

SEQ ID NO: 70171 - DNA, 37 bp, Artificial Sequence
  Synthetic oligonucleotide
agctcgctgccaccgtatctaactaaagccatccaga

SEQ ID NO: 70172 - DNA, 37 bp, Artificial Sequence
  Synthetic oligonucleotide
gtgtggttgggacggggtgcgggggcggaaactcaga

SEQ ID NO: 70173 - DNA, 37 bp, Artificial Sequence
  Synthetic oligonucleotide
acatagcgccgaagggagtgggaaggctggcgagaga

SEQ ID NO: 70174 - DNA, 37 bp, Artificial Sequence
  Synthetic oligonucleotide
gtgtcagacacagggcgagaggacgaggcggtttaga

SEQ ID NO: 70175 - DNA, 37 bp, Artificial Sequence
  Synthetic oligonucleotide
acacgacaccttgcagcacattccgctgagaagccga

SEQ ID NO: 70176 - DNA, 37 bp, Artificial Sequence
  Synthetic oligonucleotide
tgtctcacagtgtacgtcctggtcctttcttcgccga

SEQ ID NO: 70177 - DNA, 37 bp, Artificial Sequence
  Synthetic oligonucleotide
aagtggccgactgaccactattatgtttccctgccga

SEQ ID NO: 70178 - DNA, 37 bp, Artificial Sequence
  Synthetic oligonucleotide
gtcacgcatccgagctgcacagcacagctacatccga

SEQ ID NO: 70179 - DNA, 37 bp, Artificial Sequence
  Synthetic oligonucleotide
gagacgagcaattgtcgaagcccccctctttcatcga

SEQ ID NO: 70180 - DNA, 37 bp, Artificial Sequence
  Synthetic oligonucleotide
gaagcgatcgtgtgattgataggaaaatggaggagga

SEQ ID NO: 70181 - DNA, 37 bp, Artificial Sequence
  Synthetic oligonucleotide
acgggactggtggggcggaacgggtgagtttttagga

SEQ ID NO: 70182 - DNA, 37 bp, Artificial Sequence
  Synthetic oligonucleotide
atgatacgccctcaccaatgcccgccgattttccgga

SEQ ID NO: 70183 - DNA, 37 bp, Artificial Sequence
  Synthetic oligonucleotide
tgggtacatggggttgtaaagggtaagggagttcgga

SEQ ID NO: 70184 - DNA, 37 bp, Artificial Sequence
  Synthetic oligonucleotide
tagcccagtcggatcttgtgcgatgcgttgacaggga

SEQ ID NO: 70185 - DNA, 37 bp, Artificial Sequence
  Synthetic oligonucleotide
tgtgatggccgacgatagggtagaggcgagcgaggga

SEQ ID NO: 70186 - DNA, 37 bp, Artificial Sequence
  Synthetic oligonucleotide
atcaccccccttatcgatatccaacagtcatgaggga

SEQ ID NO: 70187 - DNA, 37 bp, Artificial Sequence
  Synthetic oligonucleotide
tcgcagtgaggttctatacatggggtggtgctgggga

SEQ ID NO: 70188 - DNA, 37 bp, Artificial Sequence
  Synthetic oligonucleotide
tgacgaggaggagggtgggtggggcggccgcatggga

SEQ ID NO: 70189 - DNA, 37 bp, Artificial Sequence
  Synthetic oligonucleotide
ggacatactccccactctctcatccgcctcgggtgga

SEQ ID NO: 70190 - DNA, 37 bp, Artificial Sequence
  Synthetic oligonucleotide
gcctccaaccagatgggcaggtactgcagaaaaatga

SEQ ID NO: 70191 - DNA, 38 bp, Artificial Sequence
  Synthetic oligonucleotide
tcaatggcatgtgagggtaggaggagagatgggaatga

SEQ ID NO: 70192 - DNA, 38 bp, Artificial Sequence
  Synthetic oligonucleotide
tgccatcctttgcattatcttagcctgtcccctaatga

SEQ ID NO: 70193 - DNA, 37 bp, Artificial Sequence
  Synthetic oligonucleotide
tccatcgggaactactgcactgagatacggtcgatga

SEQ ID NO: 70194 - DNA, 38 bp, Artificial Sequence
  Synthetic oligonucleotide
ggagactacgcacagcgggcacaaagggggagggatga

SEQ ID NO: 70195 - DNA, 38 bp, Artificial Sequence
  Synthetic oligonucleotide
tcacggccctccctgtcacgtcgtccccgagcatatga

SEQ ID NO: 70196 - DNA, 38 bp, Artificial Sequence
  Synthetic oligonucleotide
gaaagctaccctggccgtccgcacctcgtttacactga

SEQ ID NO: 70197 - DNA, 37 bp, Artificial Sequence
  Synthetic oligonucleotide
gtcatccaccaggctgaatctgcccctattcgactga

SEQ ID NO: 70198 - DNA, 38 bp, Artificial Sequence
  Synthetic oligonucleotide
tcgaaccaccatctgtagctgcagtatttggcacctga

SEQ ID NO: 70199 - DNA, 37 bp, Artificial Sequence
  Synthetic oligonucleotide
acactgccgtaggacgtgccgctgttctcgaccctga

SEQ ID NO: 70200 - DNA, 37 bp, Artificial Sequence
  Synthetic oligonucleotide
tcctagcatcgcccttctgtacactgcgcctccctga

SEQ ID NO: 70201 - DNA, 38 bp, Artificial Sequence
  Synthetic oligonucleotide
tccccctgcgctctacccctgagtttccctgccgctga

SEQ ID NO: 70202 - DNA, 37 bp, Artificial Sequence
  Synthetic oligonucleotide
tacgacccatccaaggacaaggttcacttcctgctga

SEQ ID NO: 70203 - DNA, 37 bp, Artificial Sequence
  Synthetic oligonucleotide
gtttcgccgcagacgtcactaattgatccccttctga

SEQ ID NO: 70204 - DNA, 38 bp, Artificial Sequence
  Synthetic oligonucleotide
tagaccacccgcctccatctcgtgtcagctcaacgtga

SEQ ID NO: 70205 - DNA, 35 bp, Artificial Sequence
  Synthetic oligonucleotide
acacacccatagttgttcaaatttcacgctcgtga

SEQ ID NO: 70206 - DNA, 38 bp, Artificial Sequence
  Synthetic oligonucleotide
gcgaagcacaggagtgggataagccggccagggggtga

SEQ ID NO: 70207 - DNA, 38 bp, Artificial Sequence
  Synthetic oligonucleotide
gaacccgggtagaaacgtgaagtggtggggtggggtga

SEQ ID NO: 70208 - DNA, 36 bp, Artificial Sequence
  Synthetic oligonucleotide
gaaagtagggatggaaagggcgacggggttatgtga

SEQ ID NO: 70209 - DNA, 38 bp, Artificial Sequence
  Synthetic oligonucleotide
atctggcaacccctgcctgctccacatagtttctgtga

SEQ ID NO: 70210 - DNA, 38 bp, Artificial Sequence
  Synthetic oligonucleotide
aagtgcggtccttgtagctcccctcctcttacgtgtga

SEQ ID NO: 70211 - DNA, 38 bp, Artificial Sequence
  Synthetic oligonucleotide
aaccctccccggtgtgagaaacctttggccttcattga

SEQ ID NO: 70212 - DNA, 35 bp, Artificial Sequence
  Synthetic oligonucleotide
agtaggacgcactgcctgctgaaatgtacccttga

SEQ ID NO: 70213 - DNA, 38 bp, Artificial Sequence
  Synthetic oligonucleotide
tagacgctccgtttttgctattaccttgttttccttga

SEQ ID NO: 70214 - DNA, 36 bp, Artificial Sequence
  Synthetic oligonucleotide
gcccacccgggtctccgacaccttaattggtcttga

SEQ ID NO: 70215 - DNA, 37 bp, Artificial Sequence
  Synthetic oligonucleotide
agcggaggggatggagtgggaagggcaagcacgttga

SEQ ID NO: 70216 - DNA, 38 bp, Artificial Sequence
  Synthetic oligonucleotide
gcgccaaaccacgggtttctcctgccattccctgttga

SEQ ID NO: 70217 - DNA, 38 bp, Artificial Sequence
  Synthetic oligonucleotide
tctggtccaggaccggaactcactaccctctttgttga

SEQ ID NO: 70218 - DNA, 38 bp, Artificial Sequence
  Synthetic oligonucleotide
tgcatccgcatactgccttagccgcaactctactttga

SEQ ID NO: 70219 - DNA, 36 bp, Artificial Sequence
  Synthetic oligonucleotide
gtgtagcacagcatgctccgtggccccctattacta

SEQ ID NO: 70220 - DNA, 36 bp, Artificial Sequence
  Synthetic oligonucleotide
gatgacgcttgacctacccgtgggtcctccccgcta

SEQ ID NO: 70221 - DNA, 35 bp, Artificial Sequence
  Synthetic oligonucleotide
gggacgcctccggacacaatctgcgcctatttcta

SEQ ID NO: 70222 - DNA, 36 bp, Artificial Sequence
  Synthetic oligonucleotide
tacgccaaccttggcgacgtgtgaaccttgtttcta

SEQ ID NO: 70223 - DNA, 35 bp, Artificial Sequence
  Synthetic oligonucleotide
ttatcgagcagggggaggcattgggattagatgta

SEQ ID NO: 70224 - DNA, 36 bp, Artificial Sequence
  Synthetic oligonucleotide
agcgcccgcaacagtcgcctcagagccgctgactta

SEQ ID NO: 70225 - DNA, 36 bp, Artificial Sequence
  Synthetic oligonucleotide
ttgcggtgcaactggagcatctcctctcgcccgtta

SEQ ID NO: 70226 - DNA, 35 bp, Artificial Sequence
  Synthetic oligonucleotide
tacgcgcctccaaaattatctcactccgcgggtta

SEQ ID NO: 70227 - DNA, 35 bp, Artificial Sequence
  Synthetic oligonucleotide
tcagcccactcaacgatcttctgtcatcttacaac

SEQ ID NO: 70228 - DNA, 35 bp, Artificial Sequence
  Synthetic oligonucleotide
agcacgttcgttttggcttgtcttgctttcttcac

SEQ ID NO: 70229 - DNA, 35 bp, Artificial Sequence
  Synthetic oligonucleotide
gtccatccagtcaagatcaatgcttacgcaccacc

SEQ ID NO: 70230 - DNA, 35 bp, Artificial Sequence
  Synthetic oligonucleotide
acacatacccagtgaggcttaacgtaaatacaccc

SEQ ID NO: 70231 - DNA, 35 bp, Artificial Sequence
  Synthetic oligonucleotide
tacgggctcctcctcataccatgttactatcaccc

SEQ ID NO: 70232 - DNA, 35 bp, Artificial Sequence
  Synthetic oligonucleotide
accgggctcctctgtttcatacaccatgaccttcc

SEQ ID NO: 70233 - DNA, 35 bp, Artificial Sequence
  Synthetic oligonucleotide
tctccgctcgcctccgtaccccacactaattccgc

SEQ ID NO: 70234 - DNA, 35 bp, Artificial Sequence
  Synthetic oligonucleotide
tatggtggggcgcttaagggtgggttgttcggcgc

SEQ ID NO: 70235 - DNA, 35 bp, Artificial Sequence
  Synthetic oligonucleotide
gaatacagcaacgctacgcacacctcctcgaaggc

SEQ ID NO: 70236 - DNA, 35 bp, Artificial Sequence
  Synthetic oligonucleotide
ggggaacatgccgaattcccccgcacaacaactgc

SEQ ID NO: 70237 - DNA, 35 bp, Artificial Sequence
  Synthetic oligonucleotide
gaagcctgttacacacgatgcccacagtttagctc

SEQ ID NO: 70238 - DNA, 35 bp, Artificial Sequence
  Synthetic oligonucleotide
gactgctgcgaaggcatccgtctacgttagtgctc

SEQ ID NO: 70239 - DNA, 35 bp, Artificial Sequence
  Synthetic oligonucleotide
tgcacaagacccatgccagctataggcaacccttc

SEQ ID NO: 70240 - DNA, 35 bp, Artificial Sequence
  Synthetic oligonucleotide
tgatcggagagcgttgcgtgctgccctccgttttc

SEQ ID NO: 70241 - DNA, 35 bp, Artificial Sequence
  Synthetic oligonucleotide
gtcaaggtgctgtgagttgagttgggagagagaag

SEQ ID NO: 70242 - DNA, 35 bp, Artificial Sequence
  Synthetic oligonucleotide
ggacgggagtatatctgattgagtgcggggaagag

SEQ ID NO: 70243 - DNA, 35 bp, Artificial Sequence
  Synthetic oligonucleotide
aaccgcaagtagggaagggcaccgaatagcacgag

SEQ ID NO: 70244 - DNA, 35 bp, Artificial Sequence
  Synthetic oligonucleotide
tgtgttcaaggtgggatcatgcgaagtaggaggag

SEQ ID NO: 70245 - DNA, 34 bp, Artificial Sequence
  Synthetic oligonucleotide
acaccgaggtggagatttttcctatggattatag

SEQ ID NO: 70246 - DNA, 35 bp, Artificial Sequence
  Synthetic oligonucleotide
gtgcatgtgcacaagtttttcggctcttaactacg

SEQ ID NO: 70247 - DNA, 35 bp, Artificial Sequence
  Synthetic oligonucleotide
gggtccacatctggaattacctgccactagcaccg

SEQ ID NO: 70248 - DNA, 35 bp, Artificial Sequence
  Synthetic oligonucleotide
gacatctgccaaatctagctacggagcttatcccg

SEQ ID NO: 70249 - DNA, 35 bp, Artificial Sequence
  Synthetic oligonucleotide
taatcctccaaacgcaggcgttcgtcccgccttcg

SEQ ID NO: 70250 - DNA, 35 bp, Artificial Sequence
  Synthetic oligonucleotide
ggtggaggggataggaaactgagtagaaaccgggg

SEQ ID NO: 70251 - DNA, 35 bp, Artificial Sequence
  Synthetic oligonucleotide
ccattacccggcctccacgtgtgtcgccccccctg

SEQ ID NO: 70252 - DNA, 35 bp, Artificial Sequence
  Synthetic oligonucleotide
taactacgcaattatcgctataacccccctacgtg

SEQ ID NO: 70253 - DNA, 35 bp, Artificial Sequence
  Synthetic oligonucleotide
tagaggacacatccgccactcccccgtaggccaat

SEQ ID NO: 70254 - DNA, 35 bp, Artificial Sequence
  Synthetic oligonucleotide
aagccagctgcattttcatacggcctcagtaacat

SEQ ID NO: 70255 - DNA, 34 bp, Artificial Sequence
  Synthetic oligonucleotide
ggaccgaacacgcgcttcttagaccctttgtcat

SEQ ID NO: 70256 - DNA, 35 bp, Artificial Sequence
  Synthetic oligonucleotide
gtcgagggtgcagggggtaggttccttctgtgtct

SEQ ID NO: 70257 - DNA, 35 bp, Artificial Sequence
  Synthetic oligonucleotide
agaaacaaggaagaaagggagaagggctggagcgt

SEQ ID NO: 70258 - DNA, 35 bp, Artificial Sequence
  Synthetic oligonucleotide
gaacagttgggcgcataatacgaggggtaggtggt

SEQ ID NO: 70259 - DNA, 35 bp, Artificial Sequence
  Synthetic oligonucleotide
gactcgtgccgatctggacctttgcccatccctgt

SEQ ID NO: 70260 - DNA, 35 bp, Artificial Sequence
  Synthetic oligonucleotide
aagcccctccgctgtaggagtcttcggttatactt

SEQ ID NO: 70261 - DNA, 35 bp, Artificial Sequence
  Synthetic oligonucleotide
gttccctgaccgagtgatttggcctatcctgattt

SEQ ID NO: 70262 - DNA, 35 bp, Artificial Sequence
  Synthetic oligonucleotide
gaccccctcccagtattgggactgataaccagttt

SEQ ID NO: 70263 - DNA, 34 bp, Artificial Sequence
  Synthetic oligonucleotide
acacgggcgactctcttaaactgtcctggggttt

SEQ ID NO: 70264 - DNA, 35 bp, Artificial Sequence
  Synthetic oligonucleotide
gtgcgccgggtaccgccatcaatccgaacaccaaa

SEQ ID NO: 70265 - DNA, 36 bp, Artificial Sequence
  Synthetic oligonucleotide
gtgtgcatcactgggcattcaactccgatccgacaa

SEQ ID NO: 70266 - DNA, 36 bp, Artificial Sequence
  Synthetic oligonucleotide
tcgtacaacactcccacgttcttcaacacaggacaa

SEQ ID NO: 70267 - DNA, 36 bp, Artificial Sequence
  Synthetic oligonucleotide
taatgcgacggaatattggaacgggagggcaacgaa

SEQ ID NO: 70268 - DNA, 36 bp, Artificial Sequence
  Synthetic oligonucleotide
gccctcaccgatgaacccccacatcagtccaaggaa

SEQ ID NO: 70269 - DNA, 36 bp, Artificial Sequence
  Synthetic oligonucleotide
gtcatggcggatgtcgcagtagggttgggttgggaa

SEQ ID NO: 70270 - DNA, 36 bp, Artificial Sequence
  Synthetic oligonucleotide
tgtaaccatcccttacacgttttagtacgccctgaa

SEQ ID NO: 70271 - DNA, 35 bp, Artificial Sequence
  Synthetic oligonucleotide
gaaccccggtcatgttccgcaacctctacgttgaa

SEQ ID NO: 70272 - DNA, 36 bp, Artificial Sequence
  Synthetic oligonucleotide
gtagtccgacgaggataagtggggagaatggtgtaa

SEQ ID NO: 70273 - DNA, 36 bp, Artificial Sequence
  Synthetic oligonucleotide
gcacctccccaaccctctctggagagcaggctttaa

SEQ ID NO: 70274 - DNA, 35 bp, Artificial Sequence
  Synthetic oligonucleotide
gcccccccccacgaggtgtgccttgctggagtaca

SEQ ID NO: 70275 - DNA, 35 bp, Artificial Sequence
  Synthetic oligonucleotide
tccaccctaagcactctgccgcgcccccccgtaca

SEQ ID NO: 70276 - DNA, 35 bp, Artificial Sequence
  Synthetic oligonucleotide
atacgcaccccgcagggcttacttaatttcgtaca

SEQ ID NO: 70277 - DNA, 36 bp, Artificial Sequence
  Synthetic oligonucleotide
acgaccccggacactacatggattctgggcccacca

SEQ ID NO: 70278 - DNA, 36 bp, Artificial Sequence
  Synthetic oligonucleotide
gcatgccaccatctgttttcgccagctcaacctcca

SEQ ID NO: 70279 - DNA, 36 bp, Artificial Sequence
  Synthetic oligonucleotide
ttccccctgagtaggtattacatcatgtttcctcca

SEQ ID NO: 70280 - DNA, 36 bp, Artificial Sequence
  Synthetic oligonucleotide
gcacgcgcgaggctaagctcccacgtacgatctcca

SEQ ID NO: 70281 - DNA, 35 bp, Artificial Sequence
  Synthetic oligonucleotide
tctgaccgcacaactttctgcaccccagaggtcca

SEQ ID NO: 70282 - DNA, 36 bp, Artificial Sequence
  Synthetic oligonucleotide
actactccgcgcccgccccctatggtactgacagca

SEQ ID NO: 70283 - DNA, 37 bp, Artificial Sequence
  Synthetic oligonucleotide
gcaatcgctcgtcatgtaccgtcgtcttccgtatgca

SEQ ID NO: 70284 - DNA, 36 bp, Artificial Sequence
  Synthetic oligonucleotide
atcgtggacacgcaccaaccttcttgtataccatca

SEQ ID NO: 70285 - DNA, 37 bp, Artificial Sequence
  Synthetic oligonucleotide
tgttctggtcacgcgcccaaacgtggctcccacctca

SEQ ID NO: 70286 - DNA, 36 bp, Artificial Sequence
  Synthetic oligonucleotide
ttatgcccccacttcccatgatccctaacgagctca

SEQ ID NO: 70287 - DNA, 37 bp, Artificial Sequence
  Synthetic oligonucleotide
tgaagaggtgggggtgtagtagggcgacagcataaga

SEQ ID NO: 70288 - DNA, 37 bp, Artificial Sequence
  Synthetic oligonucleotide
ggggggggcgtacggtagggatcgggatacgtacaga

SEQ ID NO: 70289 - DNA, 37 bp, Artificial Sequence
  Synthetic oligonucleotide
gcagggaggcgggggtaggtatgtctggggagcgaga

SEQ ID NO: 70290 - DNA, 37 bp, Artificial Sequence
  Synthetic oligonucleotide
gatgcatatcgcatgatacctactccacttcccacga

SEQ ID NO: 70291 - DNA, 35 bp, Artificial Sequence
  Synthetic oligonucleotide
ggacactgtacaatgtgcacgcctgctatccacga

SEQ ID NO: 70292 - DNA, 37 bp, Artificial Sequence
  Synthetic oligonucleotide
gaacaacgctacgtcgattaacacaactttctcacga

SEQ ID NO: 70293 - DNA, 37 bp, Artificial Sequence
  Synthetic oligonucleotide
tccacgctttcatcggttccacccacctcgcagacga

SEQ ID NO: 70294 - DNA, 37 bp, Artificial Sequence
  Synthetic oligonucleotide
taaccaggctcaaggaaggggggatgtcgtcgtacga

SEQ ID NO: 70295 - DNA, 37 bp, Artificial Sequence
  Synthetic oligonucleotide
gattgtcacctcggttcgtacataccgttttccccga

SEQ ID NO: 70296 - DNA, 37 bp, Artificial Sequence
  Synthetic oligonucleotide
tacgatcactggacctgagttggatttctttcttcga

SEQ ID NO: 70297 - DNA, 35 bp, Artificial Sequence
  Synthetic oligonucleotide
tccacacccttagcgcttctccgagacttgcagga

SEQ ID NO: 70298 - DNA, 36 bp, Artificial Sequence
  Synthetic oligonucleotide
tatggcgtccgtcattctcctacctgcaccccggga

SEQ ID NO: 70299 - DNA, 37 bp, Artificial Sequence
  Synthetic oligonucleotide
tgaggtcaaatcaggggtgggtgcatcatttcgggga

SEQ ID NO: 70300 - DNA, 37 bp, Artificial Sequence
  Synthetic oligonucleotide
tcagcggggtcggtgggcactgggtgatgatggggga

SEQ ID NO: 70301 - DNA, 37 bp, Artificial Sequence
  Synthetic oligonucleotide
tgaaagtgcgaggggctaaacgaagagggtcatggga

SEQ ID NO: 70302 - DNA, 37 bp, Artificial Sequence
  Synthetic oligonucleotide
gacccagcgatgtcgctgcttctttcatttcactgga

SEQ ID NO: 70303 - DNA, 37 bp, Artificial Sequence
  Synthetic oligonucleotide
tcacgcacccgaccagttgatttccctccgcgctgga

SEQ ID NO: 70304 - DNA, 37 bp, Artificial Sequence
  Synthetic oligonucleotide
tgtcaacgcatacaccacgtcgttgtcaccatctgga

SEQ ID NO: 70305 - DNA, 38 bp, Artificial Sequence
  Synthetic oligonucleotide
gccgcaggcaggccccccgtcttccactcgcgacatga

SEQ ID NO: 70306 - DNA, 37 bp, Artificial Sequence
  Synthetic oligonucleotide
ggaaagtggaggggtagcgatagtcgactgaggatga

SEQ ID NO: 70307 - DNA, 37 bp, Artificial Sequence
  Synthetic oligonucleotide
gtgtgaggggggacgcaggcgattagaaaagggatga

SEQ ID NO: 70308 - DNA, 38 bp, Artificial Sequence
  Synthetic oligonucleotide
ttctgcgaggaggtgagggtgggtgggaacatggatga

SEQ ID NO: 70309 - DNA, 38 bp, Artificial Sequence
  Synthetic oligonucleotide
gagcaaccccagcctacacaaccggaccacctggatga

SEQ ID NO: 70310 - DNA, 38 bp, Artificial Sequence
  Synthetic oligonucleotide
attggtgggtgggtatgagaagaaggggtaagatatga

SEQ ID NO: 70311 - DNA, 37 bp, Artificial Sequence
  Synthetic oligonucleotide
tgtcccccacattccgagttgacttcgaggtcactga

SEQ ID NO: 70312 - DNA, 38 bp, Artificial Sequence
  Synthetic oligonucleotide
tcattactagccccagtatcactacccagacgccctga

SEQ ID NO: 70313 - DNA, 38 bp, Artificial Sequence
  Synthetic oligonucleotide
aacacggggtgagtaggacggaagaataaataagctga

SEQ ID NO: 70314 - DNA, 38 bp, Artificial Sequence
  Synthetic oligonucleotide
ccctcctccgcccaatgtcatgtagcaatacccgctga

SEQ ID NO: 70315 - DNA, 36 bp, Artificial Sequence
  Synthetic oligonucleotide
gtgagccgctcagtcctacttggccttccccgctga

SEQ ID NO: 70316 - DNA, 38 bp, Artificial Sequence
  Synthetic oligonucleotide
tgcgggggggggcgaagattatgcaggggcgatcgtga

SEQ ID NO: 70317 - DNA, 38 bp, Artificial Sequence
  Synthetic oligonucleotide
gcatgggagtaatgaaagggaatattgacaggaggtga

SEQ ID NO: 70318 - DNA, 38 bp, Artificial Sequence
  Synthetic oligonucleotide
atcccgtccttctctcgcgtgtcctttctggttggtga

SEQ ID NO: 70319 - DNA, 38 bp, Artificial Sequence
  Synthetic oligonucleotide
gtggtcgcgacgcctgctctcgaagccaactcctgtga

SEQ ID NO: 70320 - DNA, 36 bp, Artificial Sequence
  Synthetic oligonucleotide
taactacggccactaacgactcgtcttctccattga

SEQ ID NO: 70321 - DNA, 38 bp, Artificial Sequence
  Synthetic oligonucleotide
tcgcttcctcgtttgctagttgaacccaccatccttga

SEQ ID NO: 70322 - DNA, 36 bp, Artificial Sequence
  Synthetic oligonucleotide
gacttctccccatctggaagggcctgccaattttga

SEQ ID NO: 70323 - DNA, 38 bp, Artificial Sequence
  Synthetic oligonucleotide
gccacccctactctgcccggcgacattttggcttttga

SEQ ID NO: 70324 - DNA, 35 bp, Artificial Sequence
  Synthetic oligonucleotide
gctgcaacgatccgacggacgcccctcctaccata

SEQ ID NO: 70325 - DNA, 36 bp, Artificial Sequence
  Synthetic oligonucleotide
agagggaggaaggcgagggcggatcgatccaatata

SEQ ID NO: 70326 - DNA, 36 bp, Artificial Sequence
  Synthetic oligonucleotide
gtcccatgtctgacctttcaactcccttcgctacta

SEQ ID NO: 70327 - DNA, 36 bp, Artificial Sequence
  Synthetic oligonucleotide
tctagtcgcaaccgtttccctacagcacatacccta

SEQ ID NO: 70328 - DNA, 35 bp, Artificial Sequence
  Synthetic oligonucleotide
atgccctcatcaacctgcgtgctttctttcttcta

SEQ ID NO: 70329 - DNA, 35 bp, Artificial Sequence
  Synthetic oligonucleotide
ggaacatacgcctcacacgtgccaagttaacggta

SEQ ID NO: 70330 - DNA, 36 bp, Artificial Sequence
  Synthetic oligonucleotide
ggcgacatcaccgttttaacgccgcttccctttgta

SEQ ID NO: 70331 - DNA, 35 bp, Artificial Sequence
  Synthetic oligonucleotide
gccgattcacatccccgtctggcctcctgtttcac

SEQ ID NO: 70332 - DNA, 35 bp, Artificial Sequence
  Synthetic oligonucleotide
gcatgttcgcaccattacgcaactactgggaatac

SEQ ID NO: 70333 - DNA, 35 bp, Artificial Sequence
  Synthetic oligonucleotide
tcaaggccgcgacgacctagtcctatccctattac

SEQ ID NO: 70334 - DNA, 35 bp, Artificial Sequence
  Synthetic oligonucleotide
accccggtggctgcatcgcgtacagttcacaatcc

SEQ ID NO: 70335 - DNA, 35 bp, Artificial Sequence
  Synthetic oligonucleotide
acacagttagcgtcttacgtcccacctggcaatcc

SEQ ID NO: 70336 - DNA, 35 bp, Artificial Sequence
  Synthetic oligonucleotide
gacgctccacgctttcgataggactacccggatcc

SEQ ID NO: 70337 - DNA, 35 bp, Artificial Sequence
  Synthetic oligonucleotide
acgacggaaagtccggcgttttatgctacccctcc

SEQ ID NO: 70338 - DNA, 35 bp, Artificial Sequence
  Synthetic oligonucleotide
gcgttaacgctgccatttctctgtgtctggcctcc

SEQ ID NO: 70339 - DNA, 35 bp, Artificial Sequence
  Synthetic oligonucleotide
gccagtcatcaaatcctcattccaccggattcagc

SEQ ID NO: 70340 - DNA, 35 bp, Artificial Sequence
  Synthetic oligonucleotide
gaactaacggtcgtgcggataggtgtgggggtggc

SEQ ID NO: 70341 - DNA, 35 bp, Artificial Sequence
  Synthetic oligonucleotide
gtacaaggattggagagggatagacgcgtaggtgc

SEQ ID NO: 70342 - DNA, 35 bp, Artificial Sequence
  Synthetic oligonucleotide
tctggcatgtgactccggcgcttacttacctttgc

SEQ ID NO: 70343 - DNA, 35 bp, Artificial Sequence
  Synthetic oligonucleotide
tgcttcgcggggacccaccattttttaagccactc

SEQ ID NO: 70344 - DNA, 35 bp, Artificial Sequence
  Synthetic oligonucleotide
gcatcctcacatggtgctccattgggggcttactc

SEQ ID NO: 70345 - DNA, 35 bp, Artificial Sequence
  Synthetic oligonucleotide
ttacctctgtcccattggcgaaatacacaacgctc

SEQ ID NO: 70346 - DNA, 32 bp, Artificial Sequence
  Synthetic oligonucleotide
aagtataccatcactcgtccgaacccctattc

SEQ ID NO: 70347 - DNA, 35 bp, Artificial Sequence
  Synthetic oligonucleotide
tcgaacgccttggtgcgtcacgtaacctccctacg

SEQ ID NO: 70348 - DNA, 35 bp, Artificial Sequence
  Synthetic oligonucleotide
acccgtgtagttgagttttttccccgttgttaccg

SEQ ID NO: 70349 - DNA, 35 bp, Artificial Sequence
  Synthetic oligonucleotide
taggcacgaccttcatacggctccctccatacccg

SEQ ID NO: 70350 - DNA, 35 bp, Artificial Sequence
  Synthetic oligonucleotide
gactgcaacaatattgggaggctaaaatgagcagg

SEQ ID NO: 70351 - DNA, 35 bp, Artificial Sequence
  Synthetic oligonucleotide
gaacagccgccgaacgcacagccaggtcgaaaggg

SEQ ID NO: 70352 - DNA, 35 bp, Artificial Sequence
  Synthetic oligonucleotide
acatccggaggggtgtaagggtgggggggtaagat

SEQ ID NO: 70353 - DNA, 35 bp, Artificial Sequence
  Synthetic oligonucleotide
tatctgcgacatctcggcacgtgcttatccttgat

SEQ ID NO: 70354 - DNA, 34 bp, Artificial Sequence
  Synthetic oligonucleotide
tagacagcacaattttggccatcgatttcacact

SEQ ID NO: 70355 - DNA, 35 bp, Artificial Sequence
  Synthetic oligonucleotide
tactacgtctgtcacctgcgagccatccttgcact

SEQ ID NO: 70356 - DNA, 34 bp, Artificial Sequence
  Synthetic oligonucleotide
gtatcccgttcacctttagtacctctgctttact

SEQ ID NO: 70357 - DNA, 34 bp, Artificial Sequence
  Synthetic oligonucleotide
gcaatgcgcctgtattccctgctaaacctgccct

SEQ ID NO: 70358 - DNA, 35 bp, Artificial Sequence
  Synthetic oligonucleotide
ttccgaaagaacacggcactgtccaacctgctcct

SEQ ID NO: 70359 - DNA, 35 bp, Artificial Sequence
  Synthetic oligonucleotide
taaactgccccacatgcgcattgcattttgctcct

SEQ ID NO: 70360 - DNA, 35 bp, Artificial Sequence
  Synthetic oligonucleotide
actggcccccactgtgtgcgcctttcacttttcct

SEQ ID NO: 70361 - DNA, 35 bp, Artificial Sequence
  Synthetic oligonucleotide
tgcaccaaccgggtttttgacctctagctatcgct

SEQ ID NO: 70362 - DNA, 34 bp, Artificial Sequence
  Synthetic oligonucleotide
acgtgtgctccccccttccattcattctcggagt

SEQ ID NO: 70363 - DNA, 35 bp, Artificial Sequence
  Synthetic oligonucleotide
gtgtgttgggggaaggggacgggggctaaaaaggt

SEQ ID NO: 70364 - DNA, 35 bp, Artificial Sequence
  Synthetic oligonucleotide
atgcaaagccgcgcaatcggtttcttttgtcctgt

SEQ ID NO: 70365 - DNA, 35 bp, Artificial Sequence
  Synthetic oligonucleotide
gaaagacaaggtgtgtgataggcgcgagggtgttt

SEQ ID NO: 70366 - DNA, 35 bp, Artificial Sequence
  Synthetic oligonucleotide
gtttactgaaaccccgcccatccttttgtattttt

SEQ ID NO: 70367 - DNA, 36 bp, Artificial Sequence
  Synthetic oligonucleotide
gagcacaggttcattgcttccacatctctgttaaaa

SEQ ID NO: 70368 - DNA, 35 bp, Artificial Sequence
  Synthetic oligonucleotide
gtcacatcaactcctaccaccgtagccctctcaaa

SEQ ID NO: 70369 - DNA, 36 bp, Artificial Sequence
  Synthetic oligonucleotide
atcgaccatacgatgtgcaaatggctgtcatacgaa

SEQ ID NO: 70370 - DNA, 35 bp, Artificial Sequence
  Synthetic oligonucleotide
acgagcccgcagggacgtacggagcggggcactaa

SEQ ID NO: 70371 - DNA, 36 bp, Artificial Sequence
  Synthetic oligonucleotide
gacgagccgatcgacgggctggggggagtcgggtaa

SEQ ID NO: 70372 - DNA, 36 bp, Artificial Sequence
  Synthetic oligonucleotide
aagcctaccctccctgagtttccacgcgagtataca

SEQ ID NO: 70373 - DNA, 36 bp, Artificial Sequence
  Synthetic oligonucleotide
gcaccccatcggctcagaacaagtccagggtcccca

SEQ ID NO: 70374 - DNA, 35 bp, Artificial Sequence
  Synthetic oligonucleotide
tcctcacctagttgaatgcgtagcctgcctagcca

SEQ ID NO: 70375 - DNA, 36 bp, Artificial Sequence
  Synthetic oligonucleotide
tgctcaccgtaacaccttcgggcggactatcgctca

SEQ ID NO: 70376 - DNA, 36 bp, Artificial Sequence
  Synthetic oligonucleotide
tacacgacctgacctagcccggactctcgagcttca

SEQ ID NO: 70377 - DNA, 33 bp, Artificial Sequence
  Synthetic oligonucleotide
atcaccgcgcacctacatacggttgctatttca

SEQ ID NO: 70378 - DNA, 35 bp, Artificial Sequence
  Synthetic oligonucleotide
acacatgccttccgtttacgtaaggagttttttca

SEQ ID NO: 70379 - DNA, 35 bp, Artificial Sequence
  Synthetic oligonucleotide
tacacttccctgacccgcgtttacaggttcaaaga

SEQ ID NO: 70380 - DNA, 35 bp, Artificial Sequence
  Synthetic oligonucleotide
ccccgacggccctttccctgtcctcccaacggaga

SEQ ID NO: 70381 - DNA, 37 bp, Artificial Sequence
  Synthetic oligonucleotide
gcacgagtagtgggaggttggaacggaggtctggaga

SEQ ID NO: 70382 - DNA, 37 bp, Artificial Sequence
  Synthetic oligonucleotide
gtggtcccccccatcaatatggctctgtctacaacga

SEQ ID NO: 70383 - DNA, 37 bp, Artificial Sequence
  Synthetic oligonucleotide
tgatggctatagcgtagtccattatttgcccaaccga

SEQ ID NO: 70384 - DNA, 37 bp, Artificial Sequence
  Synthetic oligonucleotide
atcgacgccggcaaactaccttaattacagcccccga

SEQ ID NO: 70385 - DNA, 37 bp, Artificial Sequence
  Synthetic oligonucleotide
tccgaatattgccgatcgtttcttgcttcgcctccga

SEQ ID NO: 70386 - DNA, 37 bp, Artificial Sequence
  Synthetic oligonucleotide
tcacttcccgaagctctatcacatcaccgaccttcga

SEQ ID NO: 70387 - DNA, 36 bp, Artificial Sequence
  Synthetic oligonucleotide
gccgtaccaatcggtgtcacacgccgccctcccgga

SEQ ID NO: 70388 - DNA, 35 bp, Artificial Sequence
  Synthetic oligonucleotide
gcacttgtccctacgcccttatgttgtctcctgga

SEQ ID NO: 70389 - DNA, 36 bp, Artificial Sequence
  Synthetic oligonucleotide
tccctccgccccatcctgtgtccgcctgtttttgga

SEQ ID NO: 70390 - DNA, 35 bp, Artificial Sequence
  Synthetic oligonucleotide
gatgcatgacccctggcactccgaccaataaatga

SEQ ID NO: 70391 - DNA, 38 bp, Artificial Sequence
  Synthetic oligonucleotide
acagagccgtacgatcgatccaccccttgcttacatga

SEQ ID NO: 70392 - DNA, 37 bp, Artificial Sequence
  Synthetic oligonucleotide
gacccaaggaagacagcgaaagggcaaagtgagatga

SEQ ID NO: 70393 - DNA, 38 bp, Artificial Sequence
  Synthetic oligonucleotide
ttgcgggacagttgcgtcaatggaccttgggtagatga

SEQ ID NO: 70394 - DNA, 38 bp, Artificial Sequence
  Synthetic oligonucleotide
ggggacgagggggggaatgggctactgttttacgatga

SEQ ID NO: 70395 - DNA, 38 bp, Artificial Sequence
  Synthetic oligonucleotide
atgacagggtggaggttaggctactgtaatgctgatga

SEQ ID NO: 70396 - DNA, 38 bp, Artificial Sequence
  Synthetic oligonucleotide
aaggagccagggggcggatggggtagatggtagtatga

SEQ ID NO: 70397 - DNA, 38 bp, Artificial Sequence
  Synthetic oligonucleotide
tcaccgtaccggtgaccgctgcctttttatgcccctga

SEQ ID NO: 70398 - DNA, 38 bp, Artificial Sequence
  Synthetic oligonucleotide
accccagcacccaaccaagaagccagtacatcccctga

SEQ ID NO: 70399 - DNA, 38 bp, Artificial Sequence
  Synthetic oligonucleotide
gtcgacggacgttctcagatcactcgcctctgccctga

SEQ ID NO: 70400 - DNA, 38 bp, Artificial Sequence
  Synthetic oligonucleotide
gacccctcgttgtcctaacatgactgtacattgcctga

SEQ ID NO: 70401 - DNA, 38 bp, Artificial Sequence
  Synthetic oligonucleotide
agattgggggggagccgatacgggtgagtgggtgctga

SEQ ID NO: 70402 - DNA, 38 bp, Artificial Sequence
  Synthetic oligonucleotide
tgcagaatctatgttgccttagcctccgccccctctga

SEQ ID NO: 70403 - DNA, 38 bp, Artificial Sequence
  Synthetic oligonucleotide
gggaccaaaggggggggatagcacagggacaagtctga

SEQ ID NO: 70404 - DNA, 38 bp, Artificial Sequence
  Synthetic oligonucleotide
tgcacccagtcggccctatctgcgatttttctgagtga

SEQ ID NO: 70405 - DNA, 38 bp, Artificial Sequence
  Synthetic oligonucleotide
ttacgcctcaaccgagaggacactacctgccaacgtga

SEQ ID NO: 70406 - DNA, 38 bp, Artificial Sequence
  Synthetic oligonucleotide
aaccgaagacaggaagggcatcacggggaggaacgtga

SEQ ID NO: 70407 - DNA, 38 bp, Artificial Sequence
  Synthetic oligonucleotide
tacccgagatctcattgagttgtttccctcctacgtga

SEQ ID NO: 70408 - DNA, 38 bp, Artificial Sequence
  Synthetic oligonucleotide
tactagccggcactcagctctcctcactgtttccgtga

SEQ ID NO: 70409 - DNA, 38 bp, Artificial Sequence
  Synthetic oligonucleotide
acatcggtagtgggtgaggagggcttatgaattcgtga

SEQ ID NO: 70410 - DNA, 37 bp, Artificial Sequence
  Synthetic oligonucleotide
tccctccgccaatcggtcactggtacccaaatggtga

SEQ ID NO: 70411 - DNA, 37 bp, Artificial Sequence
  Synthetic oligonucleotide
atcgatggcccccgatgcgccttcctttttgtggtga

SEQ ID NO: 70412 - DNA, 36 bp, Artificial Sequence
  Synthetic oligonucleotide
tcattgatgcccaccgaacgctactacacgccttga

SEQ ID NO: 70413 - DNA, 38 bp, Artificial Sequence
  Synthetic oligonucleotide
atctcgctgacattgcactttccttcaccagtcgttga

SEQ ID NO: 70414 - DNA, 38 bp, Artificial Sequence
  Synthetic oligonucleotide
taactagcgcccgttctgtcgattgccacctcgtttga

SEQ ID NO: 70415 - DNA, 36 bp, Artificial Sequence
  Synthetic oligonucleotide
gtgacacccgggcgactagtcgcgacaaaacgaata

SEQ ID NO: 70416 - DNA, 36 bp, Artificial Sequence
  Synthetic oligonucleotide
actccaccgacttgtacccacactgacccgatgata

SEQ ID NO: 70417 - DNA, 36 bp, Artificial Sequence
  Synthetic oligonucleotide
tgtacggggtgggtggggcgcagagaggcggttata

SEQ ID NO: 70418 - DNA, 36 bp, Artificial Sequence
  Synthetic oligonucleotide
acacgaacatcgggctccacttctggcttttgacta

SEQ ID NO: 70419 - DNA, 36 bp, Artificial Sequence
  Synthetic oligonucleotide
acccccgctcttctccacgactgattggagtgccta

SEQ ID NO: 70420 - DNA, 36 bp, Artificial Sequence
  Synthetic oligonucleotide
gcacccgcaagctttccgccacccatgcctgcgcta

SEQ ID NO: 70421 - DNA, 35 bp, Artificial Sequence
  Synthetic oligonucleotide
gacaatcatgccggttagttacagctctccatcta

SEQ ID NO: 70422 - DNA, 36 bp, Artificial Sequence
  Synthetic oligonucleotide
agcccgtgcgagctctccggtttacgctctcctcta

SEQ ID NO: 70423 - DNA, 35 bp, Artificial Sequence
  Synthetic oligonucleotide
gttgcgaaatcggacaaagagagaggagaccggta

SEQ ID NO: 70424 - DNA, 36 bp, Artificial Sequence
  Synthetic oligonucleotide
aagaaatggagggtaggagggtaaacggctagggta

SEQ ID NO: 70425 - DNA, 36 bp, Artificial Sequence
  Synthetic oligonucleotide
tccgttcgtcaagaactcgaccacgcttaccctgta

SEQ ID NO: 70426 - DNA, 36 bp, Artificial Sequence
  Synthetic oligonucleotide
ttcgccatacacagactcacactaccggacagatta

SEQ ID NO: 70427 - DNA, 35 bp, Artificial Sequence
  Synthetic oligonucleotide
tgtcgccctacctgagtggaggcccgttgccacac

SEQ ID NO: 70428 - DNA, 35 bp, Artificial Sequence
  Synthetic oligonucleotide
tgtgctggctctgcatgccaaccttttgccttcac

SEQ ID NO: 70429 - DNA, 35 bp, Artificial Sequence
  Synthetic oligonucleotide
ttcacgtcggcccttccatagggacgttctcctac

SEQ ID NO: 70430 - DNA, 35 bp, Artificial Sequence
  Synthetic oligonucleotide
gcagatagcccgtcgctaacatccgtttttgctac

SEQ ID NO: 70431 - DNA, 35 bp, Artificial Sequence
  Synthetic oligonucleotide
aggtcgccgcccgccgtttcttaggcacgacgtac

SEQ ID NO: 70432 - DNA, 35 bp, Artificial Sequence
  Synthetic oligonucleotide
gagtacgcgtgctgttccagcatcctaacaattac

SEQ ID NO: 70433 - DNA, 35 bp, Artificial Sequence
  Synthetic oligonucleotide
gaggtctggcacctggtccgccgctcttcatttac

SEQ ID NO: 70434 - DNA, 35 bp, Artificial Sequence
  Synthetic oligonucleotide
ttcgcacgcaatcgccgtccccgccctaaaccacc

SEQ ID NO: 70435 - DNA, 35 bp, Artificial Sequence
  Synthetic oligonucleotide
tcaacggggttctgatagcccgttcttcctatgcc

SEQ ID NO: 70436 - DNA, 35 bp, Artificial Sequence
  Synthetic oligonucleotide
atgaccggtagcatgggggaccctcgttgcctgcc

SEQ ID NO: 70437 - DNA, 35 bp, Artificial Sequence
  Synthetic oligonucleotide
ggactcaattagcccggcctgctccatccgatcgc

SEQ ID NO: 70438 - DNA, 35 bp, Artificial Sequence
  Synthetic oligonucleotide
gaccgagattgtcgtttcctgttgaagccattcgc

SEQ ID NO: 70439 - DNA, 34 bp, Artificial Sequence
  Synthetic oligonucleotide
tgaccccccggggattctacacacactttcatgc

SEQ ID NO: 70440 - DNA, 35 bp, Artificial Sequence
  Synthetic oligonucleotide
acacttgaacatccacgtcgctccgctttctatgc

SEQ ID NO: 70441 - DNA, 35 bp, Artificial Sequence
  Synthetic oligonucleotide
gttgttgtcgcactacgcctctcatgtcgattatc

SEQ ID NO: 70442 - DNA, 35 bp, Artificial Sequence
  Synthetic oligonucleotide
gttcccacatcgcgcgcataccagcaatgctggtc

SEQ ID NO: 70443 - DNA, 34 bp, Artificial Sequence
  Synthetic oligonucleotide
tgcaccctcagaaactcttagcctagtccatgtc

SEQ ID NO: 70444 - DNA, 35 bp, Artificial Sequence
  Synthetic oligonucleotide
ttcggtccaattgataccttttcaggccccctgtc

SEQ ID NO: 70445 - DNA, 35 bp, Artificial Sequence
  Synthetic oligonucleotide
gacaacatcgctgcacagccacgtcgggcgcattc

SEQ ID NO: 70446 - DNA, 35 bp, Artificial Sequence
  Synthetic oligonucleotide
tcgacctatgcctccctccgcacgctctaatgaag

SEQ ID NO: 70447 - DNA, 35 bp, Artificial Sequence
  Synthetic oligonucleotide
gtggccactcctcgacttgtcttccctggttctag

SEQ ID NO: 70448 - DNA, 35 bp, Artificial Sequence
  Synthetic oligonucleotide
tagacctgcaccgtcgtgactttttatcaaccacg

SEQ ID NO: 70449 - DNA, 35 bp, Artificial Sequence
  Synthetic oligonucleotide
tcagcactgcccccctatccgtgacatccggcacg

SEQ ID NO: 70450 - DNA, 35 bp, Artificial Sequence
  Synthetic oligonucleotide
gcccgagtgcctcgcttaatctatggtcccccccg

SEQ ID NO: 70451 - DNA, 35 bp, Artificial Sequence
  Synthetic oligonucleotide
acagaccatgaatgatttgccgggaaggggaaggg

SEQ ID NO: 70452 - DNA, 35 bp, Artificial Sequence
  Synthetic oligonucleotide
gcctgtcggacgggaactagatatattggaatggg

SEQ ID NO: 70453 - DNA, 35 bp, Artificial Sequence
  Synthetic oligonucleotide
ccatgcacccaccctacgtttcgcccactgacatg

SEQ ID NO: 70454 - DNA, 35 bp, Artificial Sequence
  Synthetic oligonucleotide
ataccatgcctcgtccttgctccactattcttcat

SEQ ID NO: 70455 - DNA, 35 bp, Artificial Sequence
  Synthetic oligonucleotide
gacagtgttgccgtgccttttaactgtttgctgat

SEQ ID NO: 70456 - DNA, 34 bp, Artificial Sequence
  Synthetic oligonucleotide
ttacattagcacgacactggtacctgttttctat

SEQ ID NO: 70457 - DNA, 34 bp, Artificial Sequence
  Synthetic oligonucleotide
taatacgggtgggaacgggtgaaagggtttttat

SEQ ID NO: 70458 - DNA, 35 bp, Artificial Sequence
  Synthetic oligonucleotide
tactccctgtccgctgtttttctacccggtggact

SEQ ID NO: 70459 - DNA, 35 bp, Artificial Sequence
  Synthetic oligonucleotide
gaatcccgtacccctatagataagtaacacaccct

SEQ ID NO: 70460 - DNA, 35 bp, Artificial Sequence
  Synthetic oligonucleotide
agacttgccacagttctccgtatcctaacgcatct

SEQ ID NO: 70461 - DNA, 34 bp, Artificial Sequence
  Synthetic oligonucleotide
gcctagagcctgcgatccaggctaaatttcttct

SEQ ID NO: 70462 - DNA, 35 bp, Artificial Sequence
  Synthetic oligonucleotide
tctaccactgtagacacgaccccacccgatttagt

SEQ ID NO: 70463 - DNA, 35 bp, Artificial Sequence
  Synthetic oligonucleotide
acaatcctcaaactgaatagcgtcacccaccacgt

SEQ ID NO: 70464 - DNA, 35 bp, Artificial Sequence
  Synthetic oligonucleotide
tctaccttcctccttgcttgagcaccgcttatggt

SEQ ID NO: 70465 - DNA, 35 bp, Artificial Sequence
  Synthetic oligonucleotide
agcggggatcatctcctctgaatttgcaaccatgt

SEQ ID NO: 70466 - DNA, 35 bp, Artificial Sequence
  Synthetic oligonucleotide
ggtgccgggctcattgccgccagtgccccccactt

SEQ ID NO: 70467 - DNA, 35 bp, Artificial Sequence
  Synthetic oligonucleotide
gaagatccgcgtgttccataccccgttgccacgtt

SEQ ID NO: 70468 - DNA, 35 bp, Artificial Sequence
  Synthetic oligonucleotide
attggggcggttccacgcggggccagcttattttt

SEQ ID NO: 70469 - DNA, 36 bp, Artificial Sequence
  Synthetic oligonucleotide
tcccacaaacgcccctcactgcgtggtgcctttaaa

SEQ ID NO: 70470 - DNA, 33 bp, Artificial Sequence
  Synthetic oligonucleotide
acctgcgcatgccgatctcatcccgtgtctcaa

SEQ ID NO: 70471 - DNA, 36 bp, Artificial Sequence
  Synthetic oligonucleotide
attccgcccgcaaggcctccacctcatcatggcgaa

SEQ ID NO: 70472 - DNA, 36 bp, Artificial Sequence
  Synthetic oligonucleotide
tgcccatcttcattgctctgttgttggcacattgaa

SEQ ID NO: 70473 - DNA, 36 bp, Artificial Sequence
  Synthetic oligonucleotide
gcaccccctcagcccacccgtatggttgtgcattaa

SEQ ID NO: 70474 - DNA, 36 bp, Artificial Sequence
  Synthetic oligonucleotide
gttcacgcccccggccctgacgaggaacacccttaa

SEQ ID NO: 70475 - DNA, 36 bp, Artificial Sequence
  Synthetic oligonucleotide
gtatgcacgcatttccttcactgtctggcccgcaca

SEQ ID NO: 70476 - DNA, 36 bp, Artificial Sequence
  Synthetic oligonucleotide
agctactgcaccatttcttcaacccactgtgcgaca

SEQ ID NO: 70477 - DNA, 36 bp, Artificial Sequence
  Synthetic oligonucleotide
ggactacatccggatataccatacgctgctgttaca

SEQ ID NO: 70478 - DNA, 36 bp, Artificial Sequence
  Synthetic oligonucleotide
gtggtccccggtaccagttatcgatattagccccca

SEQ ID NO: 70479 - DNA, 36 bp, Artificial Sequence
  Synthetic oligonucleotide
aacccaagtcctgcgaaggtccccctatttactcca

SEQ ID NO: 70480 - DNA, 36 bp, Artificial Sequence
  Synthetic oligonucleotide
aatggtcagggcgaggaggtagggctgcttggtcca

SEQ ID NO: 70481 - DNA, 36 bp, Artificial Sequence
  Synthetic oligonucleotide
gtccataacctgcggcaccacacccgtagcattcca

SEQ ID NO: 70482 - DNA, 36 bp, Artificial Sequence
  Synthetic oligonucleotide
actctgtagcgcagaaaatcccattcctatctgtca

SEQ ID NO: 70483 - DNA, 37 bp, Artificial Sequence
  Synthetic oligonucleotide
tctgcctgatggggaggaagggggaacacttgacaga

SEQ ID NO: 70484 - DNA, 37 bp, Artificial Sequence
  Synthetic oligonucleotide
gaacaaggggggagactctgaaacaggctggcggaga

SEQ ID NO: 70485 - DNA, 37 bp, Artificial Sequence
  Synthetic oligonucleotide
agctacatgcttcccccctctgaccatcttcgggaga

SEQ ID NO: 70486 - DNA, 37 bp, Artificial Sequence
  Synthetic oligonucleotide
aactcggagagtggggagaggtaggtaatggtggaga

SEQ ID NO: 70487 - DNA, 37 bp, Artificial Sequence
  Synthetic oligonucleotide
gagcggggaaagaggatagggcgaagattcgatgaga

SEQ ID NO: 70488 - DNA, 36 bp, Artificial Sequence
  Synthetic oligonucleotide
acccctccacagcacgcagccacccatctctgtaga

SEQ ID NO: 70489 - DNA, 37 bp, Artificial Sequence
  Synthetic oligonucleotide
gcacacgcatggtaacgccacgaaatccagccaccga

SEQ ID NO: 70490 - DNA, 37 bp, Artificial Sequence
  Synthetic oligonucleotide
agtgccagcacaccgatatctaatccaccctgcccga

SEQ ID NO: 70491 - DNA, 37 bp, Artificial Sequence
  Synthetic oligonucleotide
tcagcaacgcaccccgctaccaggactgttttgccga

SEQ ID NO: 70492 - DNA, 37 bp, Artificial Sequence
  Synthetic oligonucleotide
actgggcggagtaggggtgctgcggagggccttagga

SEQ ID NO: 70493 - DNA, 36 bp, Artificial Sequence
  Synthetic oligonucleotide
gagcacccgacctcaactttgctcataacctaggga

SEQ ID NO: 70494 - DNA, 37 bp, Artificial Sequence
  Synthetic oligonucleotide
taagaaggtagtggtggtaggggattggttaacggga

SEQ ID NO: 70495 - DNA, 36 bp, Artificial Sequence
  Synthetic oligonucleotide
accgggccggggtgtcaaaacgggttggtgggggga

SEQ ID NO: 70496 - DNA, 37 bp, Artificial Sequence
  Synthetic oligonucleotide
gctaagagcaggggcatgggagctggaggatggggga

SEQ ID NO: 70497 - DNA, 37 bp, Artificial Sequence
  Synthetic oligonucleotide
gacctgatacgatctccgcactagcctttaacatgga

SEQ ID NO: 70498 - DNA, 38 bp, Artificial Sequence
  Synthetic oligonucleotide
ccacacgtctgaccactgtaatcgcgccccacccatga

SEQ ID NO: 70499 - DNA, 38 bp, Artificial Sequence
  Synthetic oligonucleotide
aggacaccgtcccacctttgtccgtacgaactgcatga

SEQ ID NO: 70500 - DNA, 38 bp, Artificial Sequence
  Synthetic oligonucleotide
gcgccccactcggaactgtccgaatctgcttcttatga

SEQ ID NO: 70501 - DNA, 37 bp, Artificial Sequence
  Synthetic oligonucleotide
gtacgtgtaccgtgggggggcgtgcggggaaaactga

SEQ ID NO: 70502 - DNA, 38 bp, Artificial Sequence
  Synthetic oligonucleotide
agcgacgtaccgctttacagcacacctcgattaactga

SEQ ID NO: 70503 - DNA, 35 bp, Artificial Sequence
  Synthetic oligonucleotide
gcctcacattggagtttcatgcccttttacactga

SEQ ID NO: 70504 - DNA, 38 bp, Artificial Sequence
  Synthetic oligonucleotide
aagagcggacaatcgtcctatccgcgaaaatcacctga

SEQ ID NO: 70505 - DNA, 38 bp, Artificial Sequence
  Synthetic oligonucleotide
tgcaccacgtctgcgttaacccacttcggttcccctga

SEQ ID NO: 70506 - DNA, 37 bp, Artificial Sequence
  Synthetic oligonucleotide
gtcctcatcacctttgtatctttgctacacgccctga

SEQ ID NO: 70507 - DNA, 38 bp, Artificial Sequence
  Synthetic oligonucleotide
agtgggctgtacgttcctgccttttttgcccatcctga

SEQ ID NO: 70508 - DNA, 37 bp, Artificial Sequence
  Synthetic oligonucleotide
agagcctcactgcatttgttgccaccgcaattcctga

SEQ ID NO: 70509 - DNA, 38 bp, Artificial Sequence
  Synthetic oligonucleotide
gtagccagcgcttaagggacggggcggggggaagctga

SEQ ID NO: 70510 - DNA, 38 bp, Artificial Sequence
  Synthetic oligonucleotide
gaccaccttccagtctccgccggacttcaaactgctga

SEQ ID NO: 70511 - DNA, 37 bp, Artificial Sequence
  Synthetic oligonucleotide
accccatcctctcgccttctgagcgagactcctctga

SEQ ID NO: 70512 - DNA, 37 bp, Artificial Sequence
  Synthetic oligonucleotide
ggaataacggcgcgcgcatatgaccacccttctctga

SEQ ID NO: 70513 - DNA, 38 bp, Artificial Sequence
  Synthetic oligonucleotide
tacgcctggcgtaacgtgaagtggagtataaggtctga

SEQ ID NO: 70514 - DNA, 38 bp, Artificial Sequence
  Synthetic oligonucleotide
gtcctggacacagtaaagagggaggcgggcaggagtga

SEQ ID NO: 70515 - DNA, 38 bp, Artificial Sequence
  Synthetic oligonucleotide
taacgcacgccagcgttattttctacttcgtttcgtga

SEQ ID NO: 70516 - DNA, 37 bp, Artificial Sequence
  Synthetic oligonucleotide
gtgatcggtaggggtacagcgggtccggaatgggtga

SEQ ID NO: 70517 - DNA, 37 bp, Artificial Sequence
  Synthetic oligonucleotide
gtgatctccctcctgtattgattttgttgcactgtga

SEQ ID NO: 70518 - DNA, 36 bp, Artificial Sequence
  Synthetic oligonucleotide
acatcggcacgatcgcctaccagcctgctactgtga

SEQ ID NO: 70519 - DNA, 37 bp, Artificial Sequence
  Synthetic oligonucleotide
ccggtggggtgccggaggtgatactggtggggtgtga

SEQ ID NO: 70520 - DNA, 37 bp, Artificial Sequence
  Synthetic oligonucleotide
tatgggcatctccgcctttgatcttactctcttgtga

SEQ ID NO: 70521 - DNA, 38 bp, Artificial Sequence
  Synthetic oligonucleotide
atgcacgttgcccaccgccgatagtagcacaccattga

SEQ ID NO: 70522 - DNA, 38 bp, Artificial Sequence
  Synthetic oligonucleotide
attcatgcagacccccgttacgacgcacatcttattga

SEQ ID NO: 70523 - DNA, 38 bp, Artificial Sequence
  Synthetic oligonucleotide
acgttctccctcggcatatattgattccgtacccttga

SEQ ID NO: 70524 - DNA, 38 bp, Artificial Sequence
  Synthetic oligonucleotide
aacctcgcaaaatgttctagttagcctcactcccttga

SEQ ID NO: 70525 - DNA, 37 bp, Artificial Sequence
  Synthetic oligonucleotide
tcgacactatgggggcgggtggggtatggtaagttga

SEQ ID NO: 70526 - DNA, 38 bp, Artificial Sequence
  Synthetic oligonucleotide
tactgcgacgcggtatgcattgtaccatctcgagttga

SEQ ID NO: 70527 - DNA, 38 bp, Artificial Sequence
  Synthetic oligonucleotide
gtagtgcgtgcagttgcgatatgctgggtgtgggttga

SEQ ID NO: 70528 - DNA, 37 bp, Artificial Sequence
  Synthetic oligonucleotide
tagtaccgcctgctacccaagggtctcaatcttttga

SEQ ID NO: 70529 - DNA, 37 bp, Artificial Sequence
  Synthetic oligonucleotide
acccctaccgtcagccatagaaatgctccttttttga

SEQ ID NO: 70530 - DNA, 36 bp, Artificial Sequence
  Synthetic oligonucleotide
ggagcccatccccggttatatgccgccccgtgaata

SEQ ID NO: 70531 - DNA, 35 bp, Artificial Sequence
  Synthetic oligonucleotide
gccttacccccgacagtttggccaaacggttcata

SEQ ID NO: 70532 - DNA, 35 bp, Artificial Sequence
  Synthetic oligonucleotide
acactccagtcaccaacagcgtatccacgacttta

SEQ ID NO: 70533 - DNA, 35 bp, Artificial Sequence
  Synthetic oligonucleotide
accgaccctctagtgtctttagttagaactaacac

SEQ ID NO: 70534 - DNA, 35 bp, Artificial Sequence
  Synthetic oligonucleotide
gcctctcgcgactgcccgcgcagcccctaactcac

SEQ ID NO: 70535 - DNA, 34 bp, Artificial Sequence
  Synthetic oligonucleotide
tgttagcgcagctctccttgcacctgcctctcac

SEQ ID NO: 70536 - DNA, 35 bp, Artificial Sequence
  Synthetic oligonucleotide
tgcactctcccgttttccacatgcaatcctgctac

SEQ ID NO: 70537 - DNA, 35 bp, Artificial Sequence
  Synthetic oligonucleotide
tcacccacccccgtagcgcatcgtgacggcattac

SEQ ID NO: 70538 - DNA, 35 bp, Artificial Sequence
  Synthetic oligonucleotide
gctcacttgcccatgtttccaatagtttgcgttac

SEQ ID NO: 70539 - DNA, 35 bp, Artificial Sequence
  Synthetic oligonucleotide
agaccgcggattgcactacctaagcgttactaacc

SEQ ID NO: 70540 - DNA, 35 bp, Artificial Sequence
  Synthetic oligonucleotide
gctggggccggccgtgacaacccattcacttgccc

SEQ ID NO: 70541 - DNA, 35 bp, Artificial Sequence
  Synthetic oligonucleotide
ggagggcttcacaaacctgctccgcctcactatcc

SEQ ID NO: 70542 - DNA, 35 bp, Artificial Sequence
  Synthetic oligonucleotide
gtgaaaccacctttgcccctggcatcgcgacttcc

SEQ ID NO: 70543 - DNA, 35 bp, Artificial Sequence
  Synthetic oligonucleotide
gcacgtgacgaacccatgcatccctccaggtccgc

SEQ ID NO: 70544 - DNA, 35 bp, Artificial Sequence
  Synthetic oligonucleotide
aatggcccccgtcttcgtttggcaccgacaccctc

SEQ ID NO: 70545 - DNA, 35 bp, Artificial Sequence
  Synthetic oligonucleotide
gcccccgcacagtgacgctctaagttattgtgctc

SEQ ID NO: 70546 - DNA, 35 bp, Artificial Sequence
  Synthetic oligonucleotide
agacggaaccgtaccgctttcgtattatgtccttc

SEQ ID NO: 70547 - DNA, 35 bp, Artificial Sequence
  Synthetic oligonucleotide
gcagaggtggtgccgattctaatgcctcgaatttc

SEQ ID NO: 70548 - DNA, 35 bp, Artificial Sequence
  Synthetic oligonucleotide
tgctcagcatgctacacacacatcaccagagacag

SEQ ID NO: 70549 - DNA, 35 bp, Artificial Sequence
  Synthetic oligonucleotide
gtcccgctgacccgaacgtccccctactgtgacag

SEQ ID NO: 70550 - DNA, 35 bp, Artificial Sequence
  Synthetic oligonucleotide
gagcagaggtgggaaagtcaaaggaatgaaaaacg

SEQ ID NO: 70551 - DNA, 35 bp, Artificial Sequence
  Synthetic oligonucleotide
tgagcgggggggtgggtagggagcaatatcgtacg

SEQ ID NO: 70552 - DNA, 35 bp, Artificial Sequence
  Synthetic oligonucleotide
tacaagaaggggggcggtcgagaacaggaaatgcg

SEQ ID NO: 70553 - DNA, 36 bp, Artificial Sequence
  Synthetic oligonucleotide
actcaaccgtcgcatgatagtcgcccccagagctcg

SEQ ID NO: 70554 - DNA, 35 bp, Artificial Sequence
  Synthetic oligonucleotide
gtcgcgtgctcgatctgtgttttgccctccattcg

SEQ ID NO: 70555 - DNA, 35 bp, Artificial Sequence
  Synthetic oligonucleotide
acccagtcgggggccgtattatgttctggtggtgg

SEQ ID NO: 70556 - DNA, 35 bp, Artificial Sequence
  Synthetic oligonucleotide
aaagacctggcagaaatggtggaggttggggttgg

SEQ ID NO: 70557 - DNA, 35 bp, Artificial Sequence
  Synthetic oligonucleotide
gcactccaaacattttatacgctcctgactgttgg

SEQ ID NO: 70558 - DNA, 35 bp, Artificial Sequence
  Synthetic oligonucleotide
tgcaatacccgctcgcacagcctgcccttataatg

SEQ ID NO: 70559 - DNA, 35 bp, Artificial Sequence
  Synthetic oligonucleotide
gaccatcgctggagccgctcccatctgaaagcttg

SEQ ID NO: 70560 - DNA, 35 bp, Artificial Sequence
  Synthetic oligonucleotide
aagcacacccctgcatgattcaacgttatacgttg

SEQ ID NO: 70561 - DNA, 35 bp, Artificial Sequence
  Synthetic oligonucleotide
tctgtcctgtcgacgactcatttctccaaatcact

SEQ ID NO: 70562 - DNA, 35 bp, Artificial Sequence
  Synthetic oligonucleotide
gaacgcctggtattttccgatcccccctacaacct

SEQ ID NO: 70563 - DNA, 35 bp, Artificial Sequence
  Synthetic oligonucleotide
actgcgcacctaggtcttcgattgctaacttacct

SEQ ID NO: 70564 - DNA, 35 bp, Artificial Sequence
  Synthetic oligonucleotide
tccccggacttttcgtggtcattgtttcgcttcct

SEQ ID NO: 70565 - DNA, 35 bp, Artificial Sequence
  Synthetic oligonucleotide
tacagaccggttgacctttgctcatattacatgct

SEQ ID NO: 70566 - DNA, 35 bp, Artificial Sequence
  Synthetic oligonucleotide
gtacactgcggtacatccactgcagcctcaactct

SEQ ID NO: 70567 - DNA, 35 bp, Artificial Sequence
  Synthetic oligonucleotide
gggaccggagggaatgggacgggcttggaaatagt

SEQ ID NO: 70568 - DNA, 35 bp, Artificial Sequence
  Synthetic oligonucleotide
tgacatgtgggattaatggaagtagtgtggaaggt

SEQ ID NO: 70569 - DNA, 35 bp, Artificial Sequence
  Synthetic oligonucleotide
tagcgatgtgagagtggggcggaggaaggggatgt

SEQ ID NO: 70570 - DNA, 35 bp, Artificial Sequence
  Synthetic oligonucleotide
tcatttcgcacaagcacacgcctccaatcagcctt

SEQ ID NO: 70571 - DNA, 36 bp, Artificial Sequence
  Synthetic oligonucleotide
gacctccaccagccgctttacgcactgacaagaaaa

SEQ ID NO: 70572 - DNA, 36 bp, Artificial Sequence
  Synthetic oligonucleotide
agacccgagcactattgtctgcccttggttccccaa

SEQ ID NO: 70573 - DNA, 35 bp, Artificial Sequence
  Synthetic oligonucleotide
tcaacggaacagtgggcaaatagtcgaggctccaa

SEQ ID NO: 70574 - DNA, 35 bp, Artificial Sequence
  Synthetic oligonucleotide
tcccatgtccgcgcagccatattattcaactggaa

SEQ ID NO: 70575 - DNA, 36 bp, Artificial Sequence
  Synthetic oligonucleotide
gtgcgagtccccgccgaacttgtctccgacccataa

SEQ ID NO: 70576 - DNA, 36 bp, Artificial Sequence
  Synthetic oligonucleotide
aacctccccaactggaccataaaagagcagagctaa

SEQ ID NO: 70577 - DNA, 35 bp, Artificial Sequence
  Synthetic oligonucleotide
gatgtggcaatgtgggagtaggtaggaaggcaaca

SEQ ID NO: 70578 - DNA, 35 bp, Artificial Sequence
  Synthetic oligonucleotide
gccacgccggcgagatgcttctccctggcaccaca

SEQ ID NO: 70579 - DNA, 36 bp, Artificial Sequence
  Synthetic oligonucleotide
accctcgtgcgtcgattttccgcactcatccccaca

SEQ ID NO: 70580 - DNA, 36 bp, Artificial Sequence
  Synthetic oligonucleotide
agtgcctcccgaccgtatttggcctctcttttcaca

SEQ ID NO: 70581 - DNA, 35 bp, Artificial Sequence
  Synthetic oligonucleotide
aagagtcagtcggcccgttcttccgtcacaaccca

SEQ ID NO: 70582 - DNA, 36 bp, Artificial Sequence
  Synthetic oligonucleotide
gatagcatcatgtgtcctgtaccctgatttggccca

SEQ ID NO: 70583 - DNA, 35 bp, Artificial Sequence
  Synthetic oligonucleotide
gcatgcatccgcgggtcttcgtccaggttctgcca

SEQ ID NO: 70584 - DNA, 35 bp, Artificial Sequence
  Synthetic oligonucleotide
acatgggccggggggaaaaaagccaatcttctcca

SEQ ID NO: 70585 - DNA, 36 bp, Artificial Sequence
  Synthetic oligonucleotide
actggcgcccatccgcatgttgattagctctttcca

SEQ ID NO: 70586 - DNA, 36 bp, Artificial Sequence
  Synthetic oligonucleotide
tgatgatcccggcgatgacaccacacccccactgca

SEQ ID NO: 70587 - DNA, 36 bp, Artificial Sequence
  Synthetic oligonucleotide
taatcaccgcgctcccggttcgaaaccttgttgtca

SEQ ID NO: 70588 - DNA, 36 bp, Artificial Sequence
  Synthetic oligonucleotide
gagccgtcgccctttctcacaggtgtgaacacttca

SEQ ID NO: 70589 - DNA, 37 bp, Artificial Sequence
  Synthetic oligonucleotide
taccacatcaggacggaaaaggccctgcctgcacaga

SEQ ID NO: 70590 - DNA, 37 bp, Artificial Sequence
  Synthetic oligonucleotide
tggggagatagggggaggaagagaagagcactagaga

SEQ ID NO: 70591 - DNA, 37 bp, Artificial Sequence
  Synthetic oligonucleotide
attggtaggagatgtgaccggctggagtgcgtggaga

SEQ ID NO: 70592 - DNA, 37 bp, Artificial Sequence
  Synthetic oligonucleotide
tctgaccatgcctaaccactgacaaagggacctgaga

SEQ ID NO: 70593 - DNA, 37 bp, Artificial Sequence
  Synthetic oligonucleotide
accctgcgtccatatgccctgacccgctgcgttgaga

SEQ ID NO: 70594 - DNA, 36 bp, Artificial Sequence
  Synthetic oligonucleotide
tgcacgggaaagaggaggaacgatagcacgccacga

SEQ ID NO: 70595 - DNA, 37 bp, Artificial Sequence
  Synthetic oligonucleotide
gaccaagcagtcttatctgcttcttactgaatcccga

SEQ ID NO: 70596 - DNA, 37 bp, Artificial Sequence
  Synthetic oligonucleotide
tcatcactatacatggtgaacagttttttccttccga

SEQ ID NO: 70597 - DNA, 37 bp, Artificial Sequence
  Synthetic oligonucleotide
acctgacctttgtccctccagacgccgtgtagtgcga

SEQ ID NO: 70598 - DNA, 36 bp, Artificial Sequence
  Synthetic oligonucleotide
gtgacaaccaccatgtccaccctattctcgtgtcga

SEQ ID NO: 70599 - DNA, 37 bp, Artificial Sequence
  Synthetic oligonucleotide
gcaccctcaaactctatgccatgcgtaactgcttcga

SEQ ID NO: 70600 - DNA, 37 bp, Artificial Sequence
  Synthetic oligonucleotide
tatgcgcgccgcagaaagttttgaggctgaatgcgga

SEQ ID NO: 70601 - DNA, 37 bp, Artificial Sequence
  Synthetic oligonucleotide
accctgaccgccccttatgaatgtgtaatttctcgga

SEQ ID NO: 70602 - DNA, 37 bp, Artificial Sequence
  Synthetic oligonucleotide
atgatcaggggatgggaaggcagggtgcatggcggga

SEQ ID NO: 70603 - DNA, 36 bp, Artificial Sequence
  Synthetic oligonucleotide
gatcacagccgttctacacatacagtgttctgggga

SEQ ID NO: 70604 - DNA, 37 bp, Artificial Sequence
  Synthetic oligonucleotide
gagtgagagacagggaaagaccgggggggagtgggga

SEQ ID NO: 70605 - DNA, 37 bp, Artificial Sequence
  Synthetic oligonucleotide
gatcgcgaggggagaggtctagcgggggatgtgggga

SEQ ID NO: 70606 - DNA, 37 bp, Artificial Sequence
  Synthetic oligonucleotide
ttgccgcccagcttcccgctctttgctctgccgatga

SEQ ID NO: 70607 - DNA, 36 bp, Artificial Sequence
  Synthetic oligonucleotide
agagtaagggtgggagaaaggtggagttgcggatga

SEQ ID NO: 70608 - DNA, 38 bp, Artificial Sequence
  Synthetic oligonucleotide
gtgatgaccggcctgatccctcgctttaacaactatga

SEQ ID NO: 70609 - DNA, 38 bp, Artificial Sequence
  Synthetic oligonucleotide
gtccacgccaccaagccacatagcggacttaaaactga

SEQ ID NO: 70610 - DNA, 38 bp, Artificial Sequence
  Synthetic oligonucleotide
tatcaccggcggaagcgtggcgcgtctccctcaactga

SEQ ID NO: 70611 - DNA, 38 bp, Artificial Sequence
  Synthetic oligonucleotide
actaactcacgccccggacgtactaaacggataactga

SEQ ID NO: 70612 - DNA, 38 bp, Artificial Sequence
  Synthetic oligonucleotide
gcaaccacgtctacatttctcccatgatgcacacctga

SEQ ID NO: 70613 - DNA, 38 bp, Artificial Sequence
  Synthetic oligonucleotide
acactggccgtatgctgcccaaatttgaacctacctga

SEQ ID NO: 70614 - DNA, 38 bp, Artificial Sequence
  Synthetic oligonucleotide
gaccccgtggtggtattggcatccctcaatttacctga

SEQ ID NO: 70615 - DNA, 38 bp, Artificial Sequence
  Synthetic oligonucleotide
tagtggccagcaggtcaatgaccacctgaacaccctga

SEQ ID NO: 70616 - DNA, 38 bp, Artificial Sequence
  Synthetic oligonucleotide
acacaagcatattgtagtgccacatgttcctgccctga

SEQ ID NO: 70617 - DNA, 38 bp, Artificial Sequence
  Synthetic oligonucleotide
gtgactttgcccgattttttaacgtttgttccatctga

SEQ ID NO: 70618 - DNA, 38 bp, Artificial Sequence
  Synthetic oligonucleotide
tatgcgcatccgtttacggctatttcacgcttttctga

SEQ ID NO: 70619 - DNA, 38 bp, Artificial Sequence
  Synthetic oligonucleotide
gactggctaccggatcgtattcttctgcctctgcgtga

SEQ ID NO: 70620 - DNA, 37 bp, Artificial Sequence
  Synthetic oligonucleotide
tcgcgcactgatagacccaccccccacgccatggtga

SEQ ID NO: 70621 - DNA, 38 bp, Artificial Sequence
  Synthetic oligonucleotide
tccggaaccggaacagaaaggcaaggggtgtagtgtga

SEQ ID NO: 70622 - DNA, 37 bp, Artificial Sequence
  Synthetic oligonucleotide
gacccctcagcccaatcggctctcaatgatacattga

SEQ ID NO: 70623 - DNA, 38 bp, Artificial Sequence
  Synthetic oligonucleotide
aacacccggtcaaatagtgaactactgagaggtattga

SEQ ID NO: 70624 - DNA, 37 bp, Artificial Sequence
  Synthetic oligonucleotide
acgtgccacttgttttcggtatacctctcatccttga

SEQ ID NO: 70625 - DNA, 38 bp, Artificial Sequence
  Synthetic oligonucleotide
tgtccctcccgcgtccccgtgccgcttcttcacgttga

SEQ ID NO: 70626 - DNA, 38 bp, Artificial Sequence
  Synthetic oligonucleotide
gccaggtccatgcccagcttattactcccgagtgttga

SEQ ID NO: 70627 - DNA, 38 bp, Artificial Sequence
  Synthetic oligonucleotide
gcccatatcgcctcactgccccatgctccggcatttga

SEQ ID NO: 70628 - DNA, 37 bp, Artificial Sequence
  Synthetic oligonucleotide
gtcgccctcctgcatttttctcaccacatcgatttga

SEQ ID NO: 70629 - DNA, 35 bp, Artificial Sequence
  Synthetic oligonucleotide
gccccgaccgctcgtgggtcgtagttgccctttga

SEQ ID NO: 70630 - DNA, 37 bp, Artificial Sequence
  Synthetic oligonucleotide
gttccgctaacgtgctccccaaacaccagttctttga

SEQ ID NO: 70631 - DNA, 38 bp, Artificial Sequence
  Synthetic oligonucleotide
acagagcctgtaccggcgcatactggacgaacttttga

SEQ ID NO: 70632 - DNA, 34 bp, Artificial Sequence
  Synthetic oligonucleotide
gaatgcccggtaccccctgcgactacgttccata

SEQ ID NO: 70633 - DNA, 35 bp, Artificial Sequence
  Synthetic oligonucleotide
acacgccatgatctgcctcaccagagcatgcccta

SEQ ID NO: 70634 - DNA, 36 bp, Artificial Sequence
  Synthetic oligonucleotide
gcaccgtgcaatcactctcacaacactttaaccgta

SEQ ID NO: 70635 - DNA, 36 bp, Artificial Sequence
  Synthetic oligonucleotide
tgcacccggaccatcaaccgtccttacacgagcgta

SEQ ID NO: 70636 - DNA, 36 bp, Artificial Sequence
  Synthetic oligonucleotide
gcccccaccgcaataaatgccacgaggacagtcgta

SEQ ID NO: 70637 - DNA, 35 bp, Artificial Sequence
  Synthetic oligonucleotide
atgttgcaggcccccccgcgtctgaccgccaggta

SEQ ID NO: 70638 - DNA, 35 bp, Artificial Sequence
  Synthetic oligonucleotide
aaccacctcggtgccaggaacaggaggccctccac

SEQ ID NO: 70639 - DNA, 35 bp, Artificial Sequence
  Synthetic oligonucleotide
tgatttctccgccatattttgtgcattttcatcac

SEQ ID NO: 70640 - DNA, 35 bp, Artificial Sequence
  Synthetic oligonucleotide
gcatctgtggtccgctcaccagctgtcattatcac

SEQ ID NO: 70641 - DNA, 36 bp, Artificial Sequence
  Synthetic oligonucleotide
taggtcgtcccgtgcaatctggcccacgccatctac

SEQ ID NO: 70642 - DNA, 35 bp, Artificial Sequence
  Synthetic oligonucleotide
atcatactacctctagtcttgccccttgggacacc

SEQ ID NO: 70643 - DNA, 35 bp, Artificial Sequence
  Synthetic oligonucleotide
tccaatgaaatggagtgcccctaatagcatgcccc

SEQ ID NO: 70644 - DNA, 35 bp, Artificial Sequence
  Synthetic oligonucleotide
gcctcgtgaactctgctgttacatccttgagtgcc

SEQ ID NO: 70645 - DNA, 35 bp, Artificial Sequence
  Synthetic oligonucleotide
gctacgcttaggccactcagactgaccaccgtgcc

SEQ ID NO: 70646 - DNA, 35 bp, Artificial Sequence
  Synthetic oligonucleotide
gtgtcaacacaaccggaagagagcataggattgcc

SEQ ID NO: 70647 - DNA, 35 bp, Artificial Sequence
  Synthetic oligonucleotide
tgttaccattcgtgcgcatgctaagcctgtcttcc

SEQ ID NO: 70648 - DNA, 35 bp, Artificial Sequence
  Synthetic oligonucleotide
atgacacttccgtggcccctagtctccatcgttgc

SEQ ID NO: 70649 - DNA, 35 bp, Artificial Sequence
  Synthetic oligonucleotide
tgcggaggaaatcgtccgtcacacgcacctcgctc

SEQ ID NO: 70650 - DNA, 33 bp, Artificial Sequence
  Synthetic oligonucleotide
agtgatccgctggtacacacatcgactgttttc

SEQ ID NO: 70651 - DNA, 35 bp, Artificial Sequence
  Synthetic oligonucleotide
gagacccgcagttcctgtgttccatcctccagcag

SEQ ID NO: 70652 - DNA, 35 bp, Artificial Sequence
  Synthetic oligonucleotide
accaattcggtcctcatgcataaaacatacccgag

SEQ ID NO: 70653 - DNA, 35 bp, Artificial Sequence
  Synthetic oligonucleotide
tactccgattgccctcctccggttcgtggttaacg

SEQ ID NO: 70654 - DNA, 35 bp, Artificial Sequence
  Synthetic oligonucleotide
gtgccataccaactccacgtcccgacatgcgtacg

SEQ ID NO: 70655 - DNA, 35 bp, Artificial Sequence
  Synthetic oligonucleotide
cccacccgtccgtcttagtccttaataccgccccg

SEQ ID NO: 70656 - DNA, 35 bp, Artificial Sequence
  Synthetic oligonucleotide
gttccccatcgcccatcgccacagctatcctgccg

SEQ ID NO: 70657 - DNA, 35 bp, Artificial Sequence
  Synthetic oligonucleotide
accctcgtgcccagtttagccccctgatcaatccg

SEQ ID NO: 70658 - DNA, 35 bp, Artificial Sequence
  Synthetic oligonucleotide
acgcgaacttgtccatttctgcccgctaaaactcg

SEQ ID NO: 70659 - DNA, 35 bp, Artificial Sequence
  Synthetic oligonucleotide
gtaatgctagtccggatcaatgggcgggtgggggg

SEQ ID NO: 70660 - DNA, 35 bp, Artificial Sequence
  Synthetic oligonucleotide
atgagagatgtaccaggattaagatgagaggtggg

SEQ ID NO: 70661 - DNA, 35 bp, Artificial Sequence
  Synthetic oligonucleotide
tgaacaccctttcccgttggttttgcactcctgtg

SEQ ID NO: 70662 - DNA, 35 bp, Artificial Sequence
  Synthetic oligonucleotide
ggtggggccatggaggataggtctttctggttttg

SEQ ID NO: 70663 - DNA, 35 bp, Artificial Sequence
  Synthetic oligonucleotide
gccaccccgcataccctgcatcaactagccataat

SEQ ID NO: 70664 - DNA, 35 bp, Artificial Sequence
  Synthetic oligonucleotide
acgtatggcgcccccccgatcggctatctcgttat

SEQ ID NO: 70665 - DNA, 35 bp, Artificial Sequence
  Synthetic oligonucleotide
aactcaacgcacaacaccgtaaggatacattcact

SEQ ID NO: 70666 - DNA, 36 bp, Artificial Sequence
  Synthetic oligonucleotide
tgtcaatcctgccccttctgtccccgaaagaggact

SEQ ID NO: 70667 - DNA, 35 bp, Artificial Sequence
  Synthetic oligonucleotide
ggtccactccagtcgcgaaaccaaccaaaggtact

SEQ ID NO: 70668 - DNA, 35 bp, Artificial Sequence
  Synthetic oligonucleotide
accctgggggttctcactaaggtgccactatacct

SEQ ID NO: 70669 - DNA, 35 bp, Artificial Sequence
  Synthetic oligonucleotide
tatccccggtcagccatgccacagaactggctcct

SEQ ID NO: 70670 - DNA, 35 bp, Artificial Sequence
  Synthetic oligonucleotide
tgcacgggagatgttagcggtgagggatgtgggct

SEQ ID NO: 70671 - DNA, 35 bp, Artificial Sequence
  Synthetic oligonucleotide
tgtctgccaatgtcgcttagcgaaaccgcacctct

SEQ ID NO: 70672 - DNA, 35 bp, Artificial Sequence
  Synthetic oligonucleotide
actcctcgacctgtacacccgtcttttgtacttct

SEQ ID NO: 70673 - DNA, 35 bp, Artificial Sequence
  Synthetic oligonucleotide
agcaacactcgcacgttcggaattttaactattgt

SEQ ID NO: 70674 - DNA, 35 bp, Artificial Sequence
  Synthetic oligonucleotide
gactgggccacatgcttcccgaccgcaccataatt

SEQ ID NO: 70675 - DNA, 35 bp, Artificial Sequence
  Synthetic oligonucleotide
tcacaaaacctccacttcctgtcataatagtcatt

SEQ ID NO: 70676 - DNA, 35 bp, Artificial Sequence
  Synthetic oligonucleotide
tgttagctagtccccatgcgcacttcaatgtcctt

SEQ ID NO: 70677 - DNA, 35 bp, Artificial Sequence
  Synthetic oligonucleotide
accctcgagccattatgcatccgtgtctccgtctt

SEQ ID NO: 70678 - DNA, 35 bp, Artificial Sequence
  Synthetic oligonucleotide
gccgaggccctgtacggcgttccttaagttcgttt

SEQ ID NO: 70679 - DNA, 35 bp, Artificial Sequence
  Synthetic oligonucleotide
aatgtccgcaaggtctgcctatatcgccccgtttt

SEQ ID NO: 70680 - DNA, 35 bp, Artificial Sequence
  Synthetic oligonucleotide
ttataaccagccccatccgtctgcatctgggtttt

SEQ ID NO: 70681 - DNA, 36 bp, Artificial Sequence
  Synthetic oligonucleotide
gaccccgtatcgattttattttgtctcgccgggaaa

SEQ ID NO: 70682 - DNA, 36 bp, Artificial Sequence
  Synthetic oligonucleotide
tcgaggccccgcgctgccgtatcttaaccacaacaa

SEQ ID NO: 70683 - DNA, 36 bp, Artificial Sequence
  Synthetic oligonucleotide
gtagaccgactccgctgataatactctcaggcccaa

SEQ ID NO: 70684 - DNA, 36 bp, Artificial Sequence
  Synthetic oligonucleotide
tgtccgactaagccttcagccggtctctactctcaa

SEQ ID NO: 70685 - DNA, 35 bp, Artificial Sequence
  Synthetic oligonucleotide
tctacatgctctgcgggtccttttctctgttcgaa

SEQ ID NO: 70686 - DNA, 36 bp, Artificial Sequence
  Synthetic oligonucleotide
gaacgtggcaggggtagagggagggtattgggttaa

SEQ ID NO: 70687 - DNA, 36 bp, Artificial Sequence
  Synthetic oligonucleotide
tccgccgctcacgccactagtttgatacccaaaaca

SEQ ID NO: 70688 - DNA, 35 bp, Artificial Sequence
  Synthetic oligonucleotide
accagcaccgcccctgccacggtgatttagacaca

SEQ ID NO: 70689 - DNA, 36 bp, Artificial Sequence
  Synthetic oligonucleotide
gtgaacgagcgcgcatcgtcttttccggcctacaca

SEQ ID NO: 70690 - DNA, 36 bp, Artificial Sequence
  Synthetic oligonucleotide
gtgaccctatagcgtgggtctctaaaccgcctccca

SEQ ID NO: 70691 - DNA, 36 bp, Artificial Sequence
  Synthetic oligonucleotide
agtgaaccccggcccgtcgttcctgctggtctccca

SEQ ID NO: 70692 - DNA, 36 bp, Artificial Sequence
  Synthetic oligonucleotide
gcagacctagcgtgcctatctttcgcaaccgggcca

SEQ ID NO: 70693 - DNA, 36 bp, Artificial Sequence
  Synthetic oligonucleotide
gccgcacagtcttgaagttctccggttgttcgtcca

SEQ ID NO: 70694 - DNA, 36 bp, Artificial Sequence
  Synthetic oligonucleotide
tatgcgtctgggcgtaccctattccctatttgtcca

SEQ ID NO: 70695 - DNA, 36 bp, Artificial Sequence
  Synthetic oligonucleotide
tccctttgctgcgttgccgtcattcccgcctttcca

SEQ ID NO: 70696 - DNA, 36 bp, Artificial Sequence
  Synthetic oligonucleotide
actcccacacagtgccgtattagcgtgtaaccgtca

SEQ ID NO: 70697 - DNA, 35 bp, Artificial Sequence
  Synthetic oligonucleotide
acaccgtacgaggggcatcacccagcacaatgtca

SEQ ID NO: 70698 - DNA, 36 bp, Artificial Sequence
  Synthetic oligonucleotide
acgatagacccagtgcgtcctattgcttccctgtca

SEQ ID NO: 70699 - DNA, 36 bp, Artificial Sequence
  Synthetic oligonucleotide
gtggggtgcaacgtactggttagacctccatcttca

SEQ ID NO: 70700 - DNA, 37 bp, Artificial Sequence
  Synthetic oligonucleotide
gctgacagagggtggtgttctatcgttcccctcaaga

SEQ ID NO: 70701 - DNA, 37 bp, Artificial Sequence
  Synthetic oligonucleotide
tcgatccacacctcttatcgtaagactgacgccgaga

SEQ ID NO: 70702 - DNA, 36 bp, Artificial Sequence
  Synthetic oligonucleotide
tgagagataagggtagacggaattggaggagcgaga

SEQ ID NO: 70703 - DNA, 37 bp, Artificial Sequence
  Synthetic oligonucleotide
atgctcacgggccctcatactgctgcttatctttaga

SEQ ID NO: 70704 - DNA, 37 bp, Artificial Sequence
  Synthetic oligonucleotide
actcccgttcacaggcctggcttcggtacacacacga

SEQ ID NO: 70705 - DNA, 37 bp, Artificial Sequence
  Synthetic oligonucleotide
gcaaccggagcagaagggtagtgggaagggccgacga

SEQ ID NO: 70706 - DNA, 37 bp, Artificial Sequence
  Synthetic oligonucleotide
aaacgacatcgtgttctcttcctatgcggatggacga

SEQ ID NO: 70707 - DNA, 37 bp, Artificial Sequence
  Synthetic oligonucleotide
tgaacgcccgggccgctcactcactttcttgtaccga

SEQ ID NO: 70708 - DNA, 37 bp, Artificial Sequence
  Synthetic oligonucleotide
ggttaacccgcgcctgccccgacacctcattccgcga

SEQ ID NO: 70709 - DNA, 36 bp, Artificial Sequence
  Synthetic oligonucleotide
gagccgcaactacggacagtacaataaggatggcga

SEQ ID NO: 70710 - DNA, 37 bp, Artificial Sequence
  Synthetic oligonucleotide
atgcacaccacgtcttatcccgcgccttggctggcga

SEQ ID NO: 70711 - DNA, 37 bp, Artificial Sequence
  Synthetic oligonucleotide
gcaacccctgaccgacctccctagccacactgctcga

SEQ ID NO: 70712 - DNA, 33 bp, Artificial Sequence
  Synthetic oligonucleotide
tgaatccaccactcgtaaccgacgtcaggagga

SEQ ID NO: 70713 - DNA, 38 bp, Artificial Sequence
  Synthetic oligonucleotide
attgctgatgcgtagtgggggggatagggcaatgagga

SEQ ID NO: 70714 - DNA, 37 bp, Artificial Sequence
  Synthetic oligonucleotide
gacgggcatgagatcattaaggaggggaaaggaggga

SEQ ID NO: 70715 - DNA, 37 bp, Artificial Sequence
  Synthetic oligonucleotide
aagtggaaggagaggcgagcaacacaagaggccggga

SEQ ID NO: 70716 - DNA, 35 bp, Artificial Sequence
  Synthetic oligonucleotide
gtatggagagaacagggagggagtgcgcaggggga

SEQ ID NO: 70717 - DNA, 37 bp, Artificial Sequence
  Synthetic oligonucleotide
gatgcatagcaaagtggacttggtagagcaggtggga

SEQ ID NO: 70718 - DNA, 37 bp, Artificial Sequence
  Synthetic oligonucleotide
gtgggggcgttaaacctggaacgggaaataggtggga

SEQ ID NO: 70719 - DNA, 37 bp, Artificial Sequence
  Synthetic oligonucleotide
atccgcaaccacaatcgtgataccgtaccgccgtgga

SEQ ID NO: 70720 - DNA, 37 bp, Artificial Sequence
  Synthetic oligonucleotide
gacgagtagcagagggaacggaggtggcaatggtgga

SEQ ID NO: 70721 - DNA, 37 bp, Artificial Sequence
  Synthetic oligonucleotide
gatgctagacgtccgtcgtcttgcagtacaaaaatga

SEQ ID NO: 70722 - DNA, 38 bp, Artificial Sequence
  Synthetic oligonucleotide
acctgaggaaggtgggaacttggggacgagtcgtatga

SEQ ID NO: 70723 - DNA, 38 bp, Artificial Sequence
  Synthetic oligonucleotide
gcgcactgcccgcctactttacacctggcttgttatga

SEQ ID NO: 70724 - DNA, 37 bp, Artificial Sequence
  Synthetic oligonucleotide
gagacatagccaggagatgccacacccgcccaactga

SEQ ID NO: 70725 - DNA, 37 bp, Artificial Sequence
  Synthetic oligonucleotide
gagacccaacagtaaccaagttacgtcaccaccctga

SEQ ID NO: 70726 - DNA, 36 bp, Artificial Sequence
  Synthetic oligonucleotide
gaagtgggcggtattggtaggtggatttctggctga

SEQ ID NO: 70727 - DNA, 38 bp, Artificial Sequence
  Synthetic oligonucleotide
gtggaaccggcgctcttacacagtccggttatatctga

SEQ ID NO: 70728 - DNA, 38 bp, Artificial Sequence
  Synthetic oligonucleotide
tagtacacgggacgactgggataaggaagggacagtga

SEQ ID NO: 70729 - DNA, 38 bp, Artificial Sequence
  Synthetic oligonucleotide
actcgcaagaggaacgggctgtggaaggagaggattga

SEQ ID NO: 70730 - DNA, 38 bp, Artificial Sequence
  Synthetic oligonucleotide
tgaatccgcatgatcaccgccaaagcacccccgcttga

SEQ ID NO: 70731 - DNA, 37 bp, Artificial Sequence
  Synthetic oligonucleotide
ggtgtcgccccgagttggctctctatccctgtcttga

SEQ ID NO: 70732 - DNA, 37 bp, Artificial Sequence
  Synthetic oligonucleotide
gatgtagacgggggggacgactatttagacacgttga

SEQ ID NO: 70733 - DNA, 38 bp, Artificial Sequence
  Synthetic oligonucleotide
ttccgggtggctcgtgggagggttcgacatctcgttga

SEQ ID NO: 70734 - DNA, 38 bp, Artificial Sequence
  Synthetic oligonucleotide
taccacggaagaacactgttctacacacattaatttga

SEQ ID NO: 70735 - DNA, 38 bp, Artificial Sequence
  Synthetic oligonucleotide
tgcaccgatccgacactaccacgcgaccttgtatttga

SEQ ID NO: 70736 - DNA, 37 bp, Artificial Sequence
  Synthetic oligonucleotide
gtccgagctgtctcaccaacttagccgccttatttga

SEQ ID NO: 70737 - DNA, 38 bp, Artificial Sequence
  Synthetic oligonucleotide
attggcaccgtaacgtcccgcatgatcaccaactttga

SEQ ID NO: 70738 - DNA, 37 bp, Artificial Sequence
  Synthetic oligonucleotide
ggagccggcctactttctatgcacttcctgcctttga

SEQ ID NO: 70739 - DNA, 38 bp, Artificial Sequence
  Synthetic oligonucleotide
tccgaacctccttaagcaacaagggcgcctgtctttga

SEQ ID NO: 70740 - DNA, 36 bp, Artificial Sequence
  Synthetic oligonucleotide
tgatcgttctgctcctttattgccgttgtcttttga

SEQ ID NO: 70741 - DNA, 36 bp, Artificial Sequence
  Synthetic oligonucleotide
gtgagccgaggccctttgcgtcttgcgagttctata

SEQ ID NO: 70742 - DNA, 36 bp, Artificial Sequence
  Synthetic oligonucleotide
aacacgaggatgaggcaaaggaaaggtgagcaagta

SEQ ID NO: 70743 - DNA, 35 bp, Artificial Sequence
  Synthetic oligonucleotide
acctggccacgctttactccacaccatatgacgta

SEQ ID NO: 70744 - DNA, 35 bp, Artificial Sequence
  Synthetic oligonucleotide
tacacccccttcggactagcttatctgtttccgta

SEQ ID NO: 70745 - DNA, 37 bp, Artificial Sequence
  Synthetic oligonucleotide
atctgctccacccgggtgtccgtccttcgctccggta

SEQ ID NO: 70746 - DNA, 36 bp, Artificial Sequence
  Synthetic oligonucleotide
gttgatcaacgccgccatagctctatacaggtctta

SEQ ID NO: 70747 - DNA, 34 bp, Artificial Sequence
  Synthetic oligonucleotide
ttccctcggaggattcagttacgtcgctccttac

SEQ ID NO: 70748 - DNA, 35 bp, Artificial Sequence
  Synthetic oligonucleotide
actcgtccgaccgtgcaacaacaaatcgttaaccc

SEQ ID NO: 70749 - DNA, 36 bp, Artificial Sequence
  Synthetic oligonucleotide
gtccacttatagtttcgaaccgcatgccacttagcc

SEQ ID NO: 70750 - DNA, 35 bp, Artificial Sequence
  Synthetic oligonucleotide
tccccacgcccctcttccaccttaggctctccgcc

SEQ ID NO: 70751 - DNA, 35 bp, Artificial Sequence
  Synthetic oligonucleotide
ttgcgcccttcattctctactcgggttcctgaagc

SEQ ID NO: 70752 - DNA, 35 bp, Artificial Sequence
  Synthetic oligonucleotide
atcgtccggctaaccaactccagcacatttagggc

SEQ ID NO: 70753 - DNA, 35 bp, Artificial Sequence
  Synthetic oligonucleotide
gtcaccccctgctgttcgtccatacatgcactttc

SEQ ID NO: 70754 - DNA, 35 bp, Artificial Sequence
  Synthetic oligonucleotide
atgtcccccttccagtccccctcatgcttttgtag

SEQ ID NO: 70755 - DNA, 35 bp, Artificial Sequence
  Synthetic oligonucleotide
aactgtagggtgggaaagtacaatgtggttgttag

SEQ ID NO: 70756 - DNA, 35 bp, Artificial Sequence
  Synthetic oligonucleotide
tgcacgtgccactgccattattggggtgccttacg

SEQ ID NO: 70757 - DNA, 35 bp, Artificial Sequence
  Synthetic oligonucleotide
gaagtccagcctgctcccgccaccagtcacccatg

SEQ ID NO: 70758 - DNA, 35 bp, Artificial Sequence
  Synthetic oligonucleotide
tgacgtcgcagggctctcggcctcactctaccctg

SEQ ID NO: 70759 - DNA, 35 bp, Artificial Sequence
  Synthetic oligonucleotide
acacccttatcagccgggtttcagttagcaccgtg

SEQ ID NO: 70760 - DNA, 35 bp, Artificial Sequence
  Synthetic oligonucleotide
actccacttcggaatctcatagcgcatttattgtg

SEQ ID NO: 70761 - DNA, 35 bp, Artificial Sequence
  Synthetic oligonucleotide
gcatcactctttactggcctatctgtgccagcttg

SEQ ID NO: 70762 - DNA, 35 bp, Artificial Sequence
  Synthetic oligonucleotide
gcagacgctattttcctagttccccccgtatcttg

SEQ ID NO: 70763 - DNA, 35 bp, Artificial Sequence
  Synthetic oligonucleotide
accgaacccgctaacttgcatgcgcttctccgttg

SEQ ID NO: 70764 - DNA, 35 bp, Artificial Sequence
  Synthetic oligonucleotide
taactggtggggtatgagggtgggacaaggcgttg

SEQ ID NO: 70765 - DNA, 35 bp, Artificial Sequence
  Synthetic oligonucleotide
gatcccccctccagtctcattgttttcacgcggat

SEQ ID NO: 70766 - DNA, 35 bp, Artificial Sequence
  Synthetic oligonucleotide
tcgcccgaacatacgacccaacggacaatccccct

SEQ ID NO: 70767 - DNA, 35 bp, Artificial Sequence
  Synthetic oligonucleotide
gtggacccgcactatattctttcaaggcctcccct

SEQ ID NO: 70768 - DNA, 35 bp, Artificial Sequence
  Synthetic oligonucleotide
tggttgtctctccctccgtgcgtcattgcctttct

SEQ ID NO: 70769 - DNA, 35 bp, Artificial Sequence
  Synthetic oligonucleotide
tgttcaccctccctccgtccgtcctgctactcagt

SEQ ID NO: 70770 - DNA, 35 bp, Artificial Sequence
  Synthetic oligonucleotide
tcattccgatagcccccgcccagatatctttatgt

SEQ ID NO: 70771 - DNA, 35 bp, Artificial Sequence
  Synthetic oligonucleotide
aaccaccatgccaggcaccgagcctctacctcatt

SEQ ID NO: 70772 - DNA, 35 bp, Artificial Sequence
  Synthetic oligonucleotide
tagccgaatagctccgctgataaacttagctcctt

SEQ ID NO: 70773 - DNA, 36 bp, Artificial Sequence
  Synthetic oligonucleotide
tccgaactattggtatccctggcctgaccttttaaa

SEQ ID NO: 70774 - DNA, 36 bp, Artificial Sequence
  Synthetic oligonucleotide
gacagtgggatggtgagggggggcgtaaacagcgaa

SEQ ID NO: 70775 - DNA, 35 bp, Artificial Sequence
  Synthetic oligonucleotide
ataccggtcgagcaaggaacggtcggggaatggaa

SEQ ID NO: 70776 - DNA, 35 bp, Artificial Sequence
  Synthetic oligonucleotide
gcacgtccatcgtttcccggccccttccaacgtaa

SEQ ID NO: 70777 - DNA, 36 bp, Artificial Sequence
  Synthetic oligonucleotide
ttccaccttcctcacatgcccagctcgcggttgtaa

SEQ ID NO: 70778 - DNA, 36 bp, Artificial Sequence
  Synthetic oligonucleotide
acttactccatctgaggctcctcagtctccatcaca

SEQ ID NO: 70779 - DNA, 35 bp, Artificial Sequence
  Synthetic oligonucleotide
tgctcctcccacgcccccaggttgtttccctcaca

SEQ ID NO: 70780 - DNA, 36 bp, Artificial Sequence
  Synthetic oligonucleotide
tcgcgcaccttaaatctgtcatccggccgcttcaca

SEQ ID NO: 70781 - DNA, 36 bp, Artificial Sequence
  Synthetic oligonucleotide
acacgcatagtccttttcgttttgcgcttactgaca

SEQ ID NO: 70782 - DNA, 36 bp, Artificial Sequence
  Synthetic oligonucleotide
acccagtccatcacgcactgcacctgttggtataca

SEQ ID NO: 70783 - DNA, 36 bp, Artificial Sequence
  Synthetic oligonucleotide
tactggccccagtttgtctggcttgtcttttctaca

SEQ ID NO: 70784 - DNA, 35 bp, Artificial Sequence
  Synthetic oligonucleotide
tcatcaggctgagacgtttttcctagatcttccca

SEQ ID NO: 70785 - DNA, 35 bp, Artificial Sequence
  Synthetic oligonucleotide
tcagggagttggccccctttgtttttgttcccgca

SEQ ID NO: 70786 - DNA, 36 bp, Artificial Sequence
  Synthetic oligonucleotide
aacgctgtcgtcgcgttttgcaaattcaacctggca

SEQ ID NO: 70787 - DNA, 36 bp, Artificial Sequence
  Synthetic oligonucleotide
ttacgaccatccccacaccagacaattcaggctgca

SEQ ID NO: 70788 - DNA, 35 bp, Artificial Sequence
  Synthetic oligonucleotide
gccttgcccagtcatcatccatgaaggtctttgca

SEQ ID NO: 70789 - DNA, 36 bp, Artificial Sequence
  Synthetic oligonucleotide
actgtgtagcatgccatcgagtcctcaatcatatca

SEQ ID NO: 70790 - DNA, 36 bp, Artificial Sequence
  Synthetic oligonucleotide
acctgccatccatccttgttataaacatctgcctca

SEQ ID NO: 70791 - DNA, 35 bp, Artificial Sequence
  Synthetic oligonucleotide
gctacgaaacgcatgttgtcttaaactcactctca

SEQ ID NO: 70792 - DNA, 36 bp, Artificial Sequence
  Synthetic oligonucleotide
gtgatccagatcctccaccgaaccgttgtcccgtca

SEQ ID NO: 70793 - DNA, 36 bp, Artificial Sequence
  Synthetic oligonucleotide
gcggagttaccagatgcattcgctcctctccggtca

SEQ ID NO: 70794 - DNA, 37 bp, Artificial Sequence
  Synthetic oligonucleotide
gtgacaccaagcagaatgacatcggtcatgccagaga

SEQ ID NO: 70795 - DNA, 37 bp, Artificial Sequence
  Synthetic oligonucleotide
gacaccgacgacttggaaattgtacgagctagcgaga

SEQ ID NO: 70796 - DNA, 37 bp, Artificial Sequence
  Synthetic oligonucleotide
acacgcatggcctatgatgaaatgtcatgccttacga

SEQ ID NO: 70797 - DNA, 37 bp, Artificial Sequence
  Synthetic oligonucleotide
tatcctgcaagctgtgcccgccccgttgttataccga

SEQ ID NO: 70798 - DNA, 35 bp, Artificial Sequence
  Synthetic oligonucleotide
atacaccactccgaggtctaggcgccgttcgccga

SEQ ID NO: 70799 - DNA, 36 bp, Artificial Sequence
  Synthetic oligonucleotide
gaccacaactcaagctgtcgtccgctattattccga

SEQ ID NO: 70800 - DNA, 37 bp, Artificial Sequence
  Synthetic oligonucleotide
gggtgggacggagcagttgctaaagtgggttgggcga

SEQ ID NO: 70801 - DNA, 37 bp, Artificial Sequence
  Synthetic oligonucleotide
gatagtacgaggtggaaaacatgtagataaatggcga

SEQ ID NO: 70802 - DNA, 37 bp, Artificial Sequence
  Synthetic oligonucleotide
acactcgcacattacacatcattaattcaggacagga

SEQ ID NO: 70803 - DNA, 35 bp, Artificial Sequence
  Synthetic oligonucleotide
agacgggtgggtggggtttgtattgggattcagga

SEQ ID NO: 70804 - DNA, 37 bp, Artificial Sequence
  Synthetic oligonucleotide
aacgggatgaacggggaggtttggaacaaaaggagga

SEQ ID NO: 70805 - DNA, 37 bp, Artificial Sequence
  Synthetic oligonucleotide
gccaacctcactcccttgtcaaaattgccatatagga

SEQ ID NO: 70806 - DNA, 37 bp, Artificial Sequence
  Synthetic oligonucleotide
ggtcggacgcaaacataacaatcatacccacaccgga

SEQ ID NO: 70807 - DNA, 37 bp, Artificial Sequence
  Synthetic oligonucleotide
tcatgccccgagcagctgaccataaaatcctcgcgga

SEQ ID NO: 70808 - DNA, 37 bp, Artificial Sequence
  Synthetic oligonucleotide
tttgatcaacccccatggtcctcggtccacacatgga

SEQ ID NO: 70809 - DNA, 37 bp, Artificial Sequence
  Synthetic oligonucleotide
tcatgtgccattgcccccgaacatacttttacctgga

SEQ ID NO: 70810 - DNA, 37 bp, Artificial Sequence
  Synthetic oligonucleotide
gaaagttggtggaagaggaaagaagcaggtgattgga

SEQ ID NO: 70811 - DNA, 38 bp, Artificial Sequence
  Synthetic oligonucleotide
ttgtacggtcctccgcattggagaccccctgaaaatga

SEQ ID NO: 70812 - DNA, 38 bp, Artificial Sequence
  Synthetic oligonucleotide
tcacctccgcaaccccagtgccccgactgataccatga

SEQ ID NO: 70813 - DNA, 38 bp, Artificial Sequence
  Synthetic oligonucleotide
aagccggggccgaccctgttactggaacagtgatatga

SEQ ID NO: 70814 - DNA, 38 bp, Artificial Sequence
  Synthetic oligonucleotide
atgggtggagagggatggttggctcagcatcgttatga

SEQ ID NO: 70815 - DNA, 38 bp, Artificial Sequence
  Synthetic oligonucleotide
tagtgctgcagttctctctgaaaggataggtagactga

SEQ ID NO: 70816 - DNA, 38 bp, Artificial Sequence
  Synthetic oligonucleotide
agcattgcgccgcttccgccattacgcgatcctcctga

SEQ ID NO: 70817 - DNA, 36 bp, Artificial Sequence
  Synthetic oligonucleotide
accaaaccggcgactgcgatgaccttcctaacgtga

SEQ ID NO: 70818 - DNA, 38 bp, Artificial Sequence
  Synthetic oligonucleotide
atcaccgaaccatggtcaacacccccccaaacgcgtga

SEQ ID NO: 70819 - DNA, 38 bp, Artificial Sequence
  Synthetic oligonucleotide
accacttgcgcagggacggggggaacaaaggtgcgtga

SEQ ID NO: 70820 - DNA, 38 bp, Artificial Sequence
  Synthetic oligonucleotide
gtcgacgcatagtcatcatctcttcatccaactcgtga

SEQ ID NO: 70821 - DNA, 38 bp, Artificial Sequence
  Synthetic oligonucleotide
tctccacccgtctcccccccccgctggtaattaggtga

SEQ ID NO: 70822 - DNA, 37 bp, Artificial Sequence
  Synthetic oligonucleotide
tgacagggagggactgatgatttgttggccggggtga

SEQ ID NO: 70823 - DNA, 38 bp, Artificial Sequence
  Synthetic oligonucleotide
tgatgcgcagaattacggtgtcctctcgggtggggtga

SEQ ID NO: 70824 - DNA, 37 bp, Artificial Sequence
  Synthetic oligonucleotide
gtcgaacaggaatatcggtgatgggtgcatgttgtga

SEQ ID NO: 70825 - DNA, 37 bp, Artificial Sequence
  Synthetic oligonucleotide
aaggtacggacgggagaaggatttgggaacatattga

SEQ ID NO: 70826 - DNA, 38 bp, Artificial Sequence
  Synthetic oligonucleotide
tcacatccactcacactggaaaactgccttattattga

SEQ ID NO: 70827 - DNA, 37 bp, Artificial Sequence
  Synthetic oligonucleotide
acccaccccccaactgaccgtgttgtcgctcccttga

SEQ ID NO: 70828 - DNA, 36 bp, Artificial Sequence
  Synthetic oligonucleotide
tatccgcgcgattatcccggtggtctgctcccttga

SEQ ID NO: 70829 - DNA, 37 bp, Artificial Sequence
  Synthetic oligonucleotide
acaaaccacggcacgatcatcgcttaatctgccttga

SEQ ID NO: 70830 - DNA, 37 bp, Artificial Sequence
  Synthetic oligonucleotide
acacacaccggttatgccaaggatagcccgatcttga

SEQ ID NO: 70831 - DNA, 38 bp, Artificial Sequence
  Synthetic oligonucleotide
acactggtcgccggccgtgcaagccatccatatcttga

SEQ ID NO: 70832 - DNA, 38 bp, Artificial Sequence
  Synthetic oligonucleotide
gtgacacctgccctaacccccgttgcaacatatgttga

SEQ ID NO: 70833 - DNA, 37 bp, Artificial Sequence
  Synthetic oligonucleotide
tcccccgcattctgcaccttgacgagatttcatttga

SEQ ID NO: 70834 - DNA, 38 bp, Artificial Sequence
  Synthetic oligonucleotide
agacacaccactctctggccattcgcgacgggctttga

SEQ ID NO: 70835 - DNA, 36 bp, Artificial Sequence
  Synthetic oligonucleotide
ttcgggtacccccgttgtccacccgattcatcgata

SEQ ID NO: 70836 - DNA, 36 bp, Artificial Sequence
  Synthetic oligonucleotide
tacaccaccagttgcgtacagtttaaccgtcctata

SEQ ID NO: 70837 - DNA, 36 bp, Artificial Sequence
  Synthetic oligonucleotide
agctgacacagaggacgcaccactcctttaacacta

SEQ ID NO: 70838 - DNA, 36 bp, Artificial Sequence
  Synthetic oligonucleotide
gataccgggcgagggagaaagaagggaatcgagcta

SEQ ID NO: 70839 - DNA, 36 bp, Artificial Sequence
  Synthetic oligonucleotide
tgaactcacctttagaacaaagacacacggacgcta

SEQ ID NO: 70840 - DNA, 35 bp, Artificial Sequence
  Synthetic oligonucleotide
ggggcacgcctcgctaaaacggtctgacccacgta

SEQ ID NO: 70841 - DNA, 36 bp, Artificial Sequence
  Synthetic oligonucleotide
tgcggtggagggggaactcgtatactgacgtacgta

SEQ ID NO: 70842 - DNA, 35 bp, Artificial Sequence
  Synthetic oligonucleotide
tgacgacacgcagagacatcgggataggaagtgta

SEQ ID NO: 70843 - DNA, 36 bp, Artificial Sequence
  Synthetic oligonucleotide
accgacatctccctcgtccagaagaacgcttttgta

SEQ ID NO: 70844 - DNA, 35 bp, Artificial Sequence
  Synthetic oligonucleotide
tatcgccacgacttgaatgctgacggccagcatta

SEQ ID NO: 70845 - DNA, 35 bp, Artificial Sequence
  Synthetic oligonucleotide
acacacgtgccatcttttgagagccatcacagcac

SEQ ID NO: 70846 - DNA, 35 bp, Artificial Sequence
  Synthetic oligonucleotide
acttcaccaccattccctaaccacgggccaccgac

SEQ ID NO: 70847 - DNA, 35 bp, Artificial Sequence
  Synthetic oligonucleotide
ttcccacccgctcccgttagccttttgtgcccgac

SEQ ID NO: 70848 - DNA, 35 bp, Artificial Sequence
  Synthetic oligonucleotide
gctcacacatctccgtcacgaattaggctacaccc

SEQ ID NO: 70849 - DNA, 35 bp, Artificial Sequence
  Synthetic oligonucleotide
gacccctcgcgctccgctcaaacggttattcaccc

SEQ ID NO: 70850 - DNA, 35 bp, Artificial Sequence
  Synthetic oligonucleotide
cccgattcatctgttcccatgtaccgccgttaccc

SEQ ID NO: 70851 - DNA, 35 bp, Artificial Sequence
  Synthetic oligonucleotide
gatgcgccccgaaacgccttcggatgagttccccc

SEQ ID NO: 70852 - DNA, 35 bp, Artificial Sequence
  Synthetic oligonucleotide
tgactgccacttaatctgttacagccctagccgcc

SEQ ID NO: 70853 - DNA, 35 bp, Artificial Sequence
  Synthetic oligonucleotide
ttccccccgcccatcctgttgtctgcaaacgctcc

SEQ ID NO: 70854 - DNA, 35 bp, Artificial Sequence
  Synthetic oligonucleotide
attgcccactcgacccggacgctgattttcccggc

SEQ ID NO: 70855 - DNA, 35 bp, Artificial Sequence
  Synthetic oligonucleotide
cacactgaatgctgaagtgtgctcgtattatcggc

SEQ ID NO: 70856 - DNA, 35 bp, Artificial Sequence
  Synthetic oligonucleotide
ggtggaaggagggcgaagagacgagtgtgaatggc

SEQ ID NO: 70857 - DNA, 35 bp, Artificial Sequence
  Synthetic oligonucleotide
atccgaccggcgcccgctggtcctccgattacatc

SEQ ID NO: 70858 - DNA, 35 bp, Artificial Sequence
  Synthetic oligonucleotide
gcaggcccaggatatcatttggcgaccccactctc

SEQ ID NO: 70859 - DNA, 35 bp, Artificial Sequence
  Synthetic oligonucleotide
acgccacgttaatcacggtctggtctcactcattc

SEQ ID NO: 70860 - DNA, 35 bp, Artificial Sequence
  Synthetic oligonucleotide
ttcggagtgcggctctgcaagcgcttctttccttc

SEQ ID NO: 70861 - DNA, 35 bp, Artificial Sequence
  Synthetic oligonucleotide
gtcaggtccgacactttcggcaccggactaatttc

SEQ ID NO: 70862 - DNA, 35 bp, Artificial Sequence
  Synthetic oligonucleotide
gcgttcattccgcatcacagccgacacaacctttc

SEQ ID NO: 70863 - DNA, 35 bp, Artificial Sequence
  Synthetic oligonucleotide
gagtgcaagttacctcgtctctcccactcctccag

SEQ ID NO: 70864 - DNA, 35 bp, Artificial Sequence
  Synthetic oligonucleotide
agttgaggagtggtgctgataggggctttggctag

SEQ ID NO: 70865 - DNA, 35 bp, Artificial Sequence
  Synthetic oligonucleotide
tgcaactcgactgtttacctccgcagtcaactacg

SEQ ID NO: 70866 - DNA, 35 bp, Artificial Sequence
  Synthetic oligonucleotide
tcctgtccttgcggaaatccatctacctcccgccg

SEQ ID NO: 70867 - DNA, 35 bp, Artificial Sequence
  Synthetic oligonucleotide
gagccgagaaaatcttgccttccgttacacttccg

SEQ ID NO: 70868 - DNA, 35 bp, Artificial Sequence
  Synthetic oligonucleotide
actgacgtcctgtccctccgccctctgcaaatgcg

SEQ ID NO: 70869 - DNA, 35 bp, Artificial Sequence
  Synthetic oligonucleotide
gctcacctctgcacgtattccatttccaaaaaagg

SEQ ID NO: 70870 - DNA, 35 bp, Artificial Sequence
  Synthetic oligonucleotide
acctggcaggagacaattgggaggaaatttggggg

SEQ ID NO: 70871 - DNA, 35 bp, Artificial Sequence
  Synthetic oligonucleotide
atcgcggcccggaaacattggcaccaactgaatgg

SEQ ID NO: 70872 - DNA, 35 bp, Artificial Sequence
  Synthetic oligonucleotide
atcactagtggaggtggggggtgaagttgagatgg

SEQ ID NO: 70873 - DNA, 35 bp, Artificial Sequence
  Synthetic oligonucleotide
tacgacggtacggcaaagtttgaggggaaaagtgg

SEQ ID NO: 70874 - DNA, 35 bp, Artificial Sequence
  Synthetic oligonucleotide
gagtcacctcggatgggctaatttttggatggtgg

SEQ ID NO: 70875 - DNA, 35 bp, Artificial Sequence
  Synthetic oligonucleotide
attgactcagctgtctttaccgttaccaaagttgg

SEQ ID NO: 70876 - DNA, 35 bp, Artificial Sequence
  Synthetic oligonucleotide
tttagcactgtagaaacttgcccccctgatccctg

SEQ ID NO: 70877 - DNA, 35 bp, Artificial Sequence
  Synthetic oligonucleotide
tcatgaaggggggatgaaagatttaaactgcagtg

SEQ ID NO: 70878 - DNA, 35 bp, Artificial Sequence
  Synthetic oligonucleotide
tacgacgttaggtatctggcacctccatcaccttg

SEQ ID NO: 70879 - DNA, 35 bp, Artificial Sequence
  Synthetic oligonucleotide
gtcactccaattctgcgccgatcactgtaccgttg

SEQ ID NO: 70880 - DNA, 35 bp, Artificial Sequence
  Synthetic oligonucleotide
ttcaaagctcaccggtcacccgacactcttttcat

SEQ ID NO: 70881 - DNA, 35 bp, Artificial Sequence
  Synthetic oligonucleotide
tgaaggggataagtggctgtggattagggggcgat

SEQ ID NO: 70882 - DNA, 35 bp, Artificial Sequence
  Synthetic oligonucleotide
atgacctgctactggggctatctttggacatggat

SEQ ID NO: 70883 - DNA, 35 bp, Artificial Sequence
  Synthetic oligonucleotide
tccctcacagtacgcgtccccgcaataccttcact

SEQ ID NO: 70884 - DNA, 35 bp, Artificial Sequence
  Synthetic oligonucleotide
taacccttcaacacgccttgaacgttgtagcacct

SEQ ID NO: 70885 - DNA, 35 bp, Artificial Sequence
  Synthetic oligonucleotide
acccaggtaacgcccgatccaccactacgtaccct

SEQ ID NO: 70886 - DNA, 35 bp, Artificial Sequence
  Synthetic oligonucleotide
aaactgccatcacgggttgcgcatcacaaccccct

SEQ ID NO: 70887 - DNA, 36 bp, Artificial Sequence
  Synthetic oligonucleotide
tgcgatgcagtagcctgccttccatgggtgccccct

SEQ ID NO: 70888 - DNA, 35 bp, Artificial Sequence
  Synthetic oligonucleotide
ggttgcgcaggggctcaacacacccccacccgcct

SEQ ID NO: 70889 - DNA, 35 bp, Artificial Sequence
  Synthetic oligonucleotide
gtcatgttctctcagcgccatcctcaccccctcct

SEQ ID NO: 70890 - DNA, 35 bp, Artificial Sequence
  Synthetic oligonucleotide
gcccgaacgccggaccctttaatttcccgatcgct

SEQ ID NO: 70891 - DNA, 35 bp, Artificial Sequence
  Synthetic oligonucleotide
gacatcgcacgtttactttctccaaaggcctggct

SEQ ID NO: 70892 - DNA, 35 bp, Artificial Sequence
  Synthetic oligonucleotide
gaaagagggcagagaaggagcagtgtcgggacggt

SEQ ID NO: 70893 - DNA, 35 bp, Artificial Sequence
  Synthetic oligonucleotide
actacaccgctgcttctacctcccttgcccctggt

SEQ ID NO: 70894 - DNA, 35 bp, Artificial Sequence
  Synthetic oligonucleotide
atcgaagcacccgcgatatgaatctttggtccatt

SEQ ID NO: 70895 - DNA, 35 bp, Artificial Sequence
  Synthetic oligonucleotide
gactccctgccatttgataggctcaccgaccactt

SEQ ID NO: 70896 - DNA, 35 bp, Artificial Sequence
  Synthetic oligonucleotide
tccgcactctccgcattctcacgcacgaccggaaa

SEQ ID NO: 70897 - DNA, 36 bp, Artificial Sequence
  Synthetic oligonucleotide
gagtgcactcgtttccccgtatcttccttgcataaa

SEQ ID NO: 70898 - DNA, 35 bp, Artificial Sequence
  Synthetic oligonucleotide
ttccatcaacggcttcacggtacaagccctttaaa

SEQ ID NO: 70899 - DNA, 36 bp, Artificial Sequence
  Synthetic oligonucleotide
gatccagtcgcatcctgacaccaaagccctagacaa

SEQ ID NO: 70900 - DNA, 36 bp, Artificial Sequence
  Synthetic oligonucleotide
gtacccgtacccacttcactgcgcaaccttgctcaa

SEQ ID NO: 70901 - DNA, 35 bp, Artificial Sequence
  Synthetic oligonucleotide
agatggaaacctgaaggcatagggggcgaaaggaa

SEQ ID NO: 70902 - DNA, 36 bp, Artificial Sequence
  Synthetic oligonucleotide
aaagaggtcgagggggcgcatacaactaggaaataa

SEQ ID NO: 70903 - DNA, 36 bp, Artificial Sequence
  Synthetic oligonucleotide
acacgtctgcctctaatgtcttcttatcgcccataa

SEQ ID NO: 70904 - DNA, 35 bp, Artificial Sequence
  Synthetic oligonucleotide
gatttgacaccttcgttacgacgttgctttgcaca

SEQ ID NO: 70905 - DNA, 36 bp, Artificial Sequence
  Synthetic oligonucleotide
tctcgccagtgttatcgctcacgggctccactacca

SEQ ID NO: 70906 - DNA, 36 bp, Artificial Sequence
  Synthetic oligonucleotide
gtaggggagccgggaagccaggtaaaggcagtagca

SEQ ID NO: 70907 - DNA, 36 bp, Artificial Sequence
  Synthetic oligonucleotide
atcctcgccgccgatgaatatcctagccttgacgca

SEQ ID NO: 70908 - DNA, 36 bp, Artificial Sequence
  Synthetic oligonucleotide
ataacaccacgacagccgtccagtcccatactcgca

SEQ ID NO: 70909 - DNA, 36 bp, Artificial Sequence
  Synthetic oligonucleotide
gacccagggaagggaacgtcgaggctgctttgtgca

SEQ ID NO: 70910 - DNA, 36 bp, Artificial Sequence
  Synthetic oligonucleotide
gtgaagtgcgcaccatctgttagcgtagcatgatca

SEQ ID NO: 70911 - DNA, 37 bp, Artificial Sequence
  Synthetic oligonucleotide
acaggggacgaaaaaatggggaccccaagaaaggaga

SEQ ID NO: 70912 - DNA, 37 bp, Artificial Sequence
  Synthetic oligonucleotide
acaagggtgacaatgacgagggtaatggcgggggaga

SEQ ID NO: 70913 - DNA, 34 bp, Artificial Sequence
  Synthetic oligonucleotide
agtgccatccgtatgcccaaattgcttatcacga

SEQ ID NO: 70914 - DNA, 37 bp, Artificial Sequence
  Synthetic oligonucleotide
taaactcctgaccgaacatatacaccgacgtcgacga

SEQ ID NO: 70915 - DNA, 36 bp, Artificial Sequence
  Synthetic oligonucleotide
acatgcaggtagcagagtccagccccaacgccccga

SEQ ID NO: 70916 - DNA, 37 bp, Artificial Sequence
  Synthetic oligonucleotide
tcttcctccgtgcacgcattcgtactgcttttcccga

SEQ ID NO: 70917 - DNA, 37 bp, Artificial Sequence
  Synthetic oligonucleotide
gtagatggagaacggggatatgaacagggtgaatcga

SEQ ID NO: 70918 - DNA, 35 bp, Artificial Sequence
  Synthetic oligonucleotide
tgtctcgcctactccccgacctgctagccactcga

SEQ ID NO: 70919 - DNA, 36 bp, Artificial Sequence
  Synthetic oligonucleotide
aacgcttcccctcattttcgaacatacgcacctcga

SEQ ID NO: 70920 - DNA, 37 bp, Artificial Sequence
  Synthetic oligonucleotide
agccccaccgggtcaccattccttataacatgctcga

SEQ ID NO: 70921 - DNA, 37 bp, Artificial Sequence
  Synthetic oligonucleotide
acaacggccgtcgtgactccgctttctcaacattcga

SEQ ID NO: 70922 - DNA, 36 bp, Artificial Sequence
  Synthetic oligonucleotide
gcaatgctcccgacaagcccaccagtcaatcttcga

SEQ ID NO: 70923 - DNA, 37 bp, Artificial Sequence
  Synthetic oligonucleotide
tgactgacgtatacttcccaatcctgttccgtaagga

SEQ ID NO: 70924 - DNA, 37 bp, Artificial Sequence
  Synthetic oligonucleotide
gacaccgcccgaactcttccgatatcttctggtagga

SEQ ID NO: 70925 - DNA, 36 bp, Artificial Sequence
  Synthetic oligonucleotide
atgttatagtgggggggagtagaatctgtggtagga

SEQ ID NO: 70926 - DNA, 37 bp, Artificial Sequence
  Synthetic oligonucleotide
ggggccttccccatgccgacacactttcttcaacgga

SEQ ID NO: 70927 - DNA, 37 bp, Artificial Sequence
  Synthetic oligonucleotide
gatgccgtagtgcatcccggtgaattggtcgaacgga

SEQ ID NO: 70928 - DNA, 37 bp, Artificial Sequence
  Synthetic oligonucleotide
gtaaggttggtgggagggggtagctacaagactggga

SEQ ID NO: 70929 - DNA, 37 bp, Artificial Sequence
  Synthetic oligonucleotide
aggtcggggggggtatagtcagggatagggtttggga

SEQ ID NO: 70930 - DNA, 37 bp, Artificial Sequence
  Synthetic oligonucleotide
gagtgggcgggtatggaagggagcggacatcagtgga

SEQ ID NO: 70931 - DNA, 37 bp, Artificial Sequence
  Synthetic oligonucleotide
gtgtgacagtgggaaaagggccgcggtaggcaaatga

SEQ ID NO: 70932 - DNA, 38 bp, Artificial Sequence
  Synthetic oligonucleotide
tccccgcacactttgaccttcagcatacccgccaatga

SEQ ID NO: 70933 - DNA, 37 bp, Artificial Sequence
  Synthetic oligonucleotide
gccaagcaacacgagcggggagggcgggaaggaatga

SEQ ID NO: 70934 - DNA, 38 bp, Artificial Sequence
  Synthetic oligonucleotide
tgcgcaaggcggaaagtggaaggggggatggttaatga

SEQ ID NO: 70935 - DNA, 37 bp, Artificial Sequence
  Synthetic oligonucleotide
gaaacacggtccaattcaccatacgacactatcatga

SEQ ID NO: 70936 - DNA, 38 bp, Artificial Sequence
  Synthetic oligonucleotide
gaccagacagaggttcatgttggagacggagcggatga

SEQ ID NO: 70937 - DNA, 34 bp, Artificial Sequence
  Synthetic oligonucleotide
gcccgaaaccatcttgctccactcgcatatatga

SEQ ID NO: 70938 - DNA, 38 bp, Artificial Sequence
  Synthetic oligonucleotide
gcaccgtccacctctggtccgcacttcacctactatga

SEQ ID NO: 70939 - DNA, 38 bp, Artificial Sequence
  Synthetic oligonucleotide
tgatcaaccgcaatctgtcccttatccatatcacctga

SEQ ID NO: 70940 - DNA, 38 bp, Artificial Sequence
  Synthetic oligonucleotide
gacgcctgagtgctactggtttcattatgttctcctga

SEQ ID NO: 70941 - DNA, 38 bp, Artificial Sequence
  Synthetic oligonucleotide
aacacgttcatgcacactttccccagtcccgactctga

SEQ ID NO: 70942 - DNA, 37 bp, Artificial Sequence
  Synthetic oligonucleotide
gactgtgccgagcctatatcgcatccgaacattctga

SEQ ID NO: 70943 - DNA, 37 bp, Artificial Sequence
  Synthetic oligonucleotide
taggatcgcgcaccaaagtctcctgtgacccttctga

SEQ ID NO: 70944 - DNA, 37 bp, Artificial Sequence
  Synthetic oligonucleotide
acagggagtgctgtagggcgcggaaaaggcagagtga

SEQ ID NO: 70945 - DNA, 37 bp, Artificial Sequence
  Synthetic oligonucleotide
gtgacgtagtgggatggatggatgggggcaacggtga

SEQ ID NO: 70946 - DNA, 38 bp, Artificial Sequence
  Synthetic oligonucleotide
tcaggactgcgcgataggttgattgtacgggtgggtga

SEQ ID NO: 70947 - DNA, 38 bp, Artificial Sequence
  Synthetic oligonucleotide
acactcgttcctgtgatggccttctctcttccgtgtga

SEQ ID NO: 70948 - DNA, 38 bp, Artificial Sequence
  Synthetic oligonucleotide
gctaccggcaaaccgtttttcgtcacacactcacttga

SEQ ID NO: 70949 - DNA, 38 bp, Artificial Sequence
  Synthetic oligonucleotide
acaatgcgggaaaggtaggtccgttagggaagggttga

SEQ ID NO: 70950 - DNA, 36 bp, Artificial Sequence
  Synthetic oligonucleotide
atcacatgcaccctacctcgatggcgcccatctata

SEQ ID NO: 70951 - DNA, 35 bp, Artificial Sequence
  Synthetic oligonucleotide
gacctcagcctcccacgcccagccctgccgtacta

SEQ ID NO: 70952 - DNA, 36 bp, Artificial Sequence
  Synthetic oligonucleotide
tagcgccattcctctgccactagcacgcacacccta

SEQ ID NO: 70953 - DNA, 36 bp, Artificial Sequence
  Synthetic oligonucleotide
gaaagcgccgtccccactgttcgaccacttcggcta

SEQ ID NO: 70954 - DNA, 36 bp, Artificial Sequence
  Synthetic oligonucleotide
atccatccccaccgaagtgcggtcttgtaactagta

SEQ ID NO: 70955 - DNA, 35 bp, Artificial Sequence
  Synthetic oligonucleotide
accgtattataacctgctgccttcaacggtacgta

SEQ ID NO: 70956 - DNA, 36 bp, Artificial Sequence
  Synthetic oligonucleotide
gatgatagggttagctcctggaggagtgacatggta

SEQ ID NO: 70957 - DNA, 35 bp, Artificial Sequence
  Synthetic oligonucleotide
gtacgccccagttaatcaaacctcacgagctggta

SEQ ID NO: 70958 - DNA, 36 bp, Artificial Sequence
  Synthetic oligonucleotide
ggatgccaatcatgtccccattaatcgcctgtctta

SEQ ID NO: 70959 - DNA, 36 bp, Artificial Sequence
  Synthetic oligonucleotide
gtgggtgcccatgcatcgctatttgatcctttctta

SEQ ID NO: 70960 - DNA, 35 bp, Artificial Sequence
  Synthetic oligonucleotide
ttgcatggaccctcactcaaccgcacccattacac

SEQ ID NO: 70961 - DNA, 35 bp, Artificial Sequence
  Synthetic oligonucleotide
tacttcccgccgcccttcctccatggtgatggcac

SEQ ID NO: 70962 - DNA, 35 bp, Artificial Sequence
  Synthetic oligonucleotide
gctcaagcgcagtctcccgattagttccgccaccc

SEQ ID NO: 70963 - DNA, 35 bp, Artificial Sequence
  Synthetic oligonucleotide
atggccgataatttgaaccgttcatgccagctccc

SEQ ID NO: 70964 - DNA, 35 bp, Artificial Sequence
  Synthetic oligonucleotide
tgccatccagattaagttcacaagcccttcgtccc

SEQ ID NO: 70965 - DNA, 35 bp, Artificial Sequence
  Synthetic oligonucleotide
agccgagggcgttattctcggacttacctttctcc

SEQ ID NO: 70966 - DNA, 35 bp, Artificial Sequence
  Synthetic oligonucleotide
tcgttagctgccgtattttggtcctctttgtttcc

SEQ ID NO: 70967 - DNA, 35 bp, Artificial Sequence
  Synthetic oligonucleotide
gccattgagtagcaccagcacccgccacttcgcgc

SEQ ID NO: 70968 - DNA, 35 bp, Artificial Sequence
  Synthetic oligonucleotide
tgactgcattgcccccggtgacccagctgactcgc

SEQ ID NO: 70969 - DNA, 35 bp, Artificial Sequence
  Synthetic oligonucleotide
gaaatggtgaagcggataaaggtgtgccgaagtgc

SEQ ID NO: 70970 - DNA, 35 bp, Artificial Sequence
  Synthetic oligonucleotide
acctcgccacactcgttggcatataaaactaaatc

SEQ ID NO: 70971 - DNA, 35 bp, Artificial Sequence
  Synthetic oligonucleotide
atcttggcggtcgctggtccatatcctatccactc

SEQ ID NO: 70972 - DNA, 35 bp, Artificial Sequence
  Synthetic oligonucleotide
tagtccttcccaatcaccgcagctcatgtccactc

SEQ ID NO: 70973 - DNA, 35 bp, Artificial Sequence
  Synthetic oligonucleotide
gcggtcacactctcgggcattagcagtctttcctc

SEQ ID NO: 70974 - DNA, 35 bp, Artificial Sequence
  Synthetic oligonucleotide
tcccaaagcgactttcaccgtgctcgaccgtgctc

SEQ ID NO: 70975 - DNA, 35 bp, Artificial Sequence
  Synthetic oligonucleotide
cccatatcatgcccatccgacatccgcacgttctc

SEQ ID NO: 70976 - DNA, 36 bp, Artificial Sequence
  Synthetic oligonucleotide
gcgctcgccgcaacgcgctccaatcctacggttctc

SEQ ID NO: 70977 - DNA, 35 bp, Artificial Sequence
  Synthetic oligonucleotide
aaccagggtaccgtttcctgtcctgtgttcacttc

SEQ ID NO: 70978 - DNA, 35 bp, Artificial Sequence
  Synthetic oligonucleotide
gtgcgcactatttctccagcaatgactatcgcttc

SEQ ID NO: 70979 - DNA, 35 bp, Artificial Sequence
  Synthetic oligonucleotide
gcaactgctcatccgtgggagcacttgccgctttc

SEQ ID NO: 70980 - DNA, 35 bp, Artificial Sequence
  Synthetic oligonucleotide
accactttccgctaggcctgcaccatccttcccag

SEQ ID NO: 70981 - DNA, 35 bp, Artificial Sequence
  Synthetic oligonucleotide
aaagcaacggcccctcactcacctgtttaccctag

SEQ ID NO: 70982 - DNA, 35 bp, Artificial Sequence
  Synthetic oligonucleotide
tctcccaaccgcggtatcggccgtaactctggacg

SEQ ID NO: 70983 - DNA, 35 bp, Artificial Sequence
  Synthetic oligonucleotide
ggtgaccacctccttgctcgccctgtgctatgccg

SEQ ID NO: 70984 - DNA, 35 bp, Artificial Sequence
  Synthetic oligonucleotide
tcaccgttacctgacgcccttctatggtccctgcg

SEQ ID NO: 70985 - DNA, 35 bp, Artificial Sequence
  Synthetic oligonucleotide
gaacgagcatggaccctgatctttttgaactcttg

SEQ ID NO: 70986 - DNA, 35 bp, Artificial Sequence
  Synthetic oligonucleotide
tacctgctaccttttcccctccggttggagcctat

SEQ ID NO: 70987 - DNA, 35 bp, Artificial Sequence
  Synthetic oligonucleotide
tagatagccgccttaatgttctcatgccctgcact

SEQ ID NO: 70988 - DNA, 35 bp, Artificial Sequence
  Synthetic oligonucleotide
atcatccatgacacctgtttagactcttacgatct

SEQ ID NO: 70989 - DNA, 35 bp, Artificial Sequence
  Synthetic oligonucleotide
agcaactcgctctgctacaaccattcccgacccgt

SEQ ID NO: 70990 - DNA, 35 bp, Artificial Sequence
  Synthetic oligonucleotide
gacctccagtgcccgccctaagtaattcaatccgt

SEQ ID NO: 70991 - DNA, 35 bp, Artificial Sequence
  Synthetic oligonucleotide
atcgtagcctctccttcctacattgtctttttggt

SEQ ID NO: 70992 - DNA, 35 bp, Artificial Sequence
  Synthetic oligonucleotide
tccctgcagcctccagacattcctgttaacacatt

SEQ ID NO: 70993 - DNA, 35 bp, Artificial Sequence
  Synthetic oligonucleotide
actcaaaccgtatcgccggtgccgttacccttttt

SEQ ID NO: 70994 - DNA, 35 bp, Artificial Sequence
  Synthetic oligonucleotide
gctccctccacttggcgtgatacatgcatactaaa

SEQ ID NO: 70995 - DNA, 36 bp, Artificial Sequence
  Synthetic oligonucleotide
tacggagagcacgccgccattaccagacgaatacaa

SEQ ID NO: 70996 - DNA, 35 bp, Artificial Sequence
  Synthetic oligonucleotide
gtcagggggggcagtaaaaaatgattgcgcaagaa

SEQ ID NO: 70997 - DNA, 35 bp, Artificial Sequence
  Synthetic oligonucleotide
tatgcgccctcgatccaagcgttacttccccagaa

SEQ ID NO: 70998 - DNA, 36 bp, Artificial Sequence
  Synthetic oligonucleotide
ggagggtggtggtgcttggggattgggtacagtgaa

SEQ ID NO: 70999 - DNA, 36 bp, Artificial Sequence
  Synthetic oligonucleotide
ccatacgtcgcattgttggcccctcccaccccctaa

SEQ ID NO: 71000 - DNA, 35 bp, Artificial Sequence
  Synthetic oligonucleotide
gacgatcatctccccccagctattgtctggaaaca

SEQ ID NO: 71001 - DNA, 36 bp, Artificial Sequence
  Synthetic oligonucleotide
gtcctcatctacgtccactgtcacattctgctaaca

SEQ ID NO: 71002 - DNA, 35 bp, Artificial Sequence
  Synthetic oligonucleotide
tcagtgagtgggggggatggacgtcagatgtcaca

SEQ ID NO: 71003 - DNA, 36 bp, Artificial Sequence
  Synthetic oligonucleotide
agtacatactccaccgaggcctaatttatagcccca

SEQ ID NO: 71004 - DNA, 36 bp, Artificial Sequence
  Synthetic oligonucleotide
tatcagcggtctcatcaccgtacttatccgcatcca

SEQ ID NO: 71005 - DNA, 36 bp, Artificial Sequence
  Synthetic oligonucleotide
gtcctcagttcccgtttttttacagaccccacatca

SEQ ID NO: 71006 - DNA, 37 bp, Artificial Sequence
  Synthetic oligonucleotide
tttgagggccgggaggggagtatgagcgcagcgaaga

SEQ ID NO: 71007 - DNA, 37 bp, Artificial Sequence
  Synthetic oligonucleotide
gtggaacaaccgggggaggggtaaaacaccatagaga

SEQ ID NO: 71008 - DNA, 36 bp, Artificial Sequence
  Synthetic oligonucleotide
atccacgtagccctggtcagcacccgttcctcccga

SEQ ID NO: 71009 - DNA, 37 bp, Artificial Sequence
  Synthetic oligonucleotide
agccataccgccctataaaaccgcccgaaagtgccga

SEQ ID NO: 71010 - DNA, 37 bp, Artificial Sequence
  Synthetic oligonucleotide
ggtctcgtctgacccactcacgacctcacccatccga

SEQ ID NO: 71011 - DNA, 37 bp, Artificial Sequence
  Synthetic oligonucleotide
gaaccgcatccccgttgacgtaactaacactgtccga

SEQ ID NO: 71012 - DNA, 37 bp, Artificial Sequence
  Synthetic oligonucleotide
tgtagccgccgttggtcaaccgccgacctctccgcga

SEQ ID NO: 71013 - DNA, 37 bp, Artificial Sequence
  Synthetic oligonucleotide
atagggagccggggggagtgtaggggatcgaaatcga

SEQ ID NO: 71014 - DNA, 37 bp, Artificial Sequence
  Synthetic oligonucleotide
agcgcacgcccattaagccctgtcctccgcgtgtcga

SEQ ID NO: 71015 - DNA, 37 bp, Artificial Sequence
  Synthetic oligonucleotide
gcacctccgacttgttcgcccatattattcccttcga

SEQ ID NO: 71016 - DNA, 36 bp, Artificial Sequence
  Synthetic oligonucleotide
gccgtggcgaatgggggagggtacagtgcggaagga

SEQ ID NO: 71017 - DNA, 37 bp, Artificial Sequence
  Synthetic oligonucleotide
gtagagtaggagtagggggggatacaagatgtaagga

SEQ ID NO: 71018 - DNA, 37 bp, Artificial Sequence
  Synthetic oligonucleotide
gtcacagggagggggccaaacatggcatggaacagga

SEQ ID NO: 71019 - DNA, 36 bp, Artificial Sequence
  Synthetic oligonucleotide
tgcacgggtcgaggagttaactttaaaggggtagga

SEQ ID NO: 71020 - DNA, 36 bp, Artificial Sequence
  Synthetic oligonucleotide
accatgacgaattatccgagcctcctcgcctacgga

SEQ ID NO: 71021 - DNA, 37 bp, Artificial Sequence
  Synthetic oligonucleotide
atcaccactcggggctttctagcagtcacttgcggga

SEQ ID NO: 71022 - DNA, 37 bp, Artificial Sequence
  Synthetic oligonucleotide
gggtaggtgggaaggtttggtgctatcacacagggga

SEQ ID NO: 71023 - DNA, 37 bp, Artificial Sequence
  Synthetic oligonucleotide
acgaaagggtggtgggcgcgagggtcactgcagggga

SEQ ID NO: 71024 - DNA, 37 bp, Artificial Sequence
  Synthetic oligonucleotide
ggactggtgaaaaggggctgggacaagggcaggggga

SEQ ID NO: 71025 - DNA, 37 bp, Artificial Sequence
  Synthetic oligonucleotide
ggtggagaggaggagaatttttagttagtgctgggga

SEQ ID NO: 71026 - DNA, 36 bp, Artificial Sequence
  Synthetic oligonucleotide
gtacagccgacgccggaactgcttcataccttggga

SEQ ID NO: 71027 - DNA, 36 bp, Artificial Sequence
  Synthetic oligonucleotide
gtcacgtgcaggaattggagggcaataggtttggga

SEQ ID NO: 71028 - DNA, 36 bp, Artificial Sequence
  Synthetic oligonucleotide
agcgggagcagaggggaaggctggggtcgtgatgga

SEQ ID NO: 71029 - DNA, 38 bp, Artificial Sequence
  Synthetic oligonucleotide
atcaacgtgggtggtgggcatgctttcgaagggaatga

SEQ ID NO: 71030 - DNA, 37 bp, Artificial Sequence
  Synthetic oligonucleotide
gtgatagagggtcggtaaagggacgggtgtggaatga

SEQ ID NO: 71031 - DNA, 37 bp, Artificial Sequence
  Synthetic oligonucleotide
aaccacacctaatcaggggatcatcttcgcaacatga

SEQ ID NO: 71032 - DNA, 38 bp, Artificial Sequence
  Synthetic oligonucleotide
acacgaatcaccatcgattacagtctattgccgcatga

SEQ ID NO: 71033 - DNA, 38 bp, Artificial Sequence
  Synthetic oligonucleotide
acctcagggacaaagggaggggaaaacatagcggatga

SEQ ID NO: 71034 - DNA, 38 bp, Artificial Sequence
  Synthetic oligonucleotide
ggatccgggctccgacctccctattagtccacatatga

SEQ ID NO: 71035 - DNA, 38 bp, Artificial Sequence
  Synthetic oligonucleotide
tcaccatcccgcggtgccgttccctctacgctatatga

SEQ ID NO: 71036 - DNA, 38 bp, Artificial Sequence
  Synthetic oligonucleotide
tgcccctgcttcttcctctgaaaccgcagtctacctga

SEQ ID NO: 71037 - DNA, 37 bp, Artificial Sequence
  Synthetic oligonucleotide
gaggacgggttcagttccatgtccaacgccaccctga

SEQ ID NO: 71038 - DNA, 37 bp, Artificial Sequence
  Synthetic oligonucleotide
tagtgccctgtgagtagaattcccccaacctccctga

SEQ ID NO: 71039 - DNA, 38 bp, Artificial Sequence
  Synthetic oligonucleotide
ggtccacccctctaagaccgataacatgcctggcctga

SEQ ID NO: 71040 - DNA, 38 bp, Artificial Sequence
  Synthetic oligonucleotide
tacaatagcgccgaccatatagttccaacctctgctga

SEQ ID NO: 71041 - DNA, 38 bp, Artificial Sequence
  Synthetic oligonucleotide
ggaagactgaaatgggcggaaggggaagtgggaagtga

SEQ ID NO: 71042 - DNA, 38 bp, Artificial Sequence
  Synthetic oligonucleotide
acaccgccaccccgtacccgaaacccgcaaatgagtga

SEQ ID NO: 71043 - DNA, 36 bp, Artificial Sequence
  Synthetic oligonucleotide
tcgacatcaaccggtggtctttcgtcttgcccgtga

SEQ ID NO: 71044 - DNA, 38 bp, Artificial Sequence
  Synthetic oligonucleotide
acagggcgacaccacaatattgaacacccaggccgtga

SEQ ID NO: 71045 - DNA, 38 bp, Artificial Sequence
  Synthetic oligonucleotide
aacgaggggatggttggctattgcggtggaggcggtga

SEQ ID NO: 71046 - DNA, 38 bp, Artificial Sequence
  Synthetic oligonucleotide
ggtgggcaaagcaaggagtgggaattcaagcggggtga

SEQ ID NO: 71047 - DNA, 37 bp, Artificial Sequence
  Synthetic oligonucleotide
ttgactcccccctcctggatctttagatcgaatgtga

SEQ ID NO: 71048 - DNA, 38 bp, Artificial Sequence
  Synthetic oligonucleotide
gattcacgtacctacccgttaaacatgtgacaacttga

SEQ ID NO: 71049 - DNA, 38 bp, Artificial Sequence
  Synthetic oligonucleotide
tgcacagacctcaagtactcgcctcccttcaatgttga

SEQ ID NO: 71050 - DNA, 38 bp, Artificial Sequence
  Synthetic oligonucleotide
gaccccctaacagtagcctgaggctctatattctttga

SEQ ID NO: 71051 - DNA, 38 bp, Artificial Sequence
  Synthetic oligonucleotide
tcgcctccatcgcacccgtaattaggttctttgtttga

SEQ ID NO: 71052 - DNA, 38 bp, Artificial Sequence
  Synthetic oligonucleotide
acagcactggaagaagctaaaccgtacgctccttttga

SEQ ID NO: 71053 - DNA, 36 bp, Artificial Sequence
  Synthetic oligonucleotide
gacacgttattgactcatttttgcgggccagaccta

SEQ ID NO: 71054 - DNA, 36 bp, Artificial Sequence
  Synthetic oligonucleotide
tcctaccgccacacactaagccgggtagcttaccta

SEQ ID NO: 71055 - DNA, 35 bp, Artificial Sequence
  Synthetic oligonucleotide
tcgcattcatcacagagcccgcagcctcgtactta

SEQ ID NO: 71056 - DNA, 36 bp, Artificial Sequence
  Synthetic oligonucleotide
agggcctccgccttccaaccgccgcctgtaccttta

SEQ ID NO: 71057 - DNA, 36 bp, Artificial Sequence
  Synthetic oligonucleotide
aatcgacctcaacatacgttggcactgctatcttta

SEQ ID NO: 71058 - DNA, 35 bp, Artificial Sequence
  Synthetic oligonucleotide
atccatgacctgccctgttctcgcgcaatagaaac

SEQ ID NO: 71059 - DNA, 35 bp, Artificial Sequence
  Synthetic oligonucleotide
tcgtggtgctgcccgtaacgtttattccatcatac

SEQ ID NO: 71060 - DNA, 35 bp, Artificial Sequence
  Synthetic oligonucleotide
atccatattgcgagccttgtatgttgcccgccccc

SEQ ID NO: 71061 - DNA, 35 bp, Artificial Sequence
  Synthetic oligonucleotide
aaccccggacagcatcgcgaccaactaacacgccc

SEQ ID NO: 71062 - DNA, 35 bp, Artificial Sequence
  Synthetic oligonucleotide
tcacccctttccggccttagctagtctcattcgcc

SEQ ID NO: 71063 - DNA, 35 bp, Artificial Sequence
  Synthetic oligonucleotide
ggtcccctggacactccccttgcgacgttttcgcc

SEQ ID NO: 71064 - DNA, 35 bp, Artificial Sequence
  Synthetic oligonucleotide
gtgctgcctccgtactttatagcttggattctgcc

SEQ ID NO: 71065 - DNA, 35 bp, Artificial Sequence
  Synthetic oligonucleotide
aggaccaagctgccaatcaacatcgagccttgtcc

SEQ ID NO: 71066 - DNA, 35 bp, Artificial Sequence
  Synthetic oligonucleotide
tacacgccgcgaacctgtacttcatctggctgagc

SEQ ID NO: 71067 - DNA, 35 bp, Artificial Sequence
  Synthetic oligonucleotide
ttacgatagccaaccgtcctaacttactcctgcgc

SEQ ID NO: 71068 - DNA, 34 bp, Artificial Sequence
  Synthetic oligonucleotide
atccatcggtttgacccttaccatccctggaggc

SEQ ID NO: 71069 - DNA, 35 bp, Artificial Sequence
  Synthetic oligonucleotide
actcgaggccctgtagcccgcgtttttgaccgtgc

SEQ ID NO: 71070 - DNA, 35 bp, Artificial Sequence
  Synthetic oligonucleotide
gcccagtcaaggcccaccaccgattacgaaatatc

SEQ ID NO: 71071 - DNA, 35 bp, Artificial Sequence
  Synthetic oligonucleotide
aacgccaaaacacagctggtctacttagcacgctc

SEQ ID NO: 71072 - DNA, 35 bp, Artificial Sequence
  Synthetic oligonucleotide
attccagcatgtccggacctgtccactttgatctc

SEQ ID NO: 71073 - DNA, 35 bp, Artificial Sequence
  Synthetic oligonucleotide
gccggctacgtcatcctgcactttattggcccttc

SEQ ID NO: 71074 - DNA, 35 bp, Artificial Sequence
  Synthetic oligonucleotide
gaccgcagtttatagttacttgactgctcattttc

SEQ ID NO: 71075 - DNA, 35 bp, Artificial Sequence
  Synthetic oligonucleotide
gtcatgtcgcggccatacacctaccaattgaatag

SEQ ID NO: 71076 - DNA, 35 bp, Artificial Sequence
  Synthetic oligonucleotide
gtgccatcgggcatacatattgtaatatcattacg

SEQ ID NO: 71077 - DNA, 35 bp, Artificial Sequence
  Synthetic oligonucleotide
gcgtagttgccaccctcgttaccgctttgccaccg

SEQ ID NO: 71078 - DNA, 36 bp, Artificial Sequence
  Synthetic oligonucleotide
tacacacctattctgacagcccgacgcgacttctcg

SEQ ID NO: 71079 - DNA, 35 bp, Artificial Sequence
  Synthetic oligonucleotide
actcacgctgatctaggcctgcccaatactattcg

SEQ ID NO: 71080 - DNA, 35 bp, Artificial Sequence
  Synthetic oligonucleotide
tcgaaggaatagggtggggagtcacataggagatg

SEQ ID NO: 71081 - DNA, 35 bp, Artificial Sequence
  Synthetic oligonucleotide
gagcggacgtttgtgggtgaagggaacgggggatg

SEQ ID NO: 71082 - DNA, 35 bp, Artificial Sequence
  Synthetic oligonucleotide
gatgtaaaggagactggtgggctgggaagggactg

SEQ ID NO: 71083 - DNA, 35 bp, Artificial Sequence
  Synthetic oligonucleotide
tggaagggctgtgtaaaggttgggtgggtgtgctg

SEQ ID NO: 71084 - DNA, 35 bp, Artificial Sequence
  Synthetic oligonucleotide
attcaagtcgccacacactggccttccctacattg

SEQ ID NO: 71085 - DNA, 35 bp, Artificial Sequence
  Synthetic oligonucleotide
ggtcgccagttatttccaccccgctgtttcgtttg

SEQ ID NO: 71086 - DNA, 35 bp, Artificial Sequence
  Synthetic oligonucleotide
ggaaccccagtatcccattgcgtgcccactttttg

SEQ ID NO: 71087 - DNA, 35 bp, Artificial Sequence
  Synthetic oligonucleotide
ttaacgcacacggccccaattccatatgtctccat

SEQ ID NO: 71088 - DNA, 35 bp, Artificial Sequence
  Synthetic oligonucleotide
accgtcactgccaccttgccatagttgcccaatct

SEQ ID NO: 71089 - DNA, 35 bp, Artificial Sequence
  Synthetic oligonucleotide
ttatgagcacctgctgcacctcttattcaacatct

SEQ ID NO: 71090 - DNA, 35 bp, Artificial Sequence
  Synthetic oligonucleotide
ttaagccgccgttccccgttctgcgtttgccctct

SEQ ID NO: 71091 - DNA, 35 bp, Artificial Sequence
  Synthetic oligonucleotide
gccgggacggagtgggacgaagggtaggatcttct

SEQ ID NO: 71092 - DNA, 35 bp, Artificial Sequence
  Synthetic oligonucleotide
gaggatgggggtagaaagattgatcgggggatggt

SEQ ID NO: 71093 - DNA, 35 bp, Artificial Sequence
  Synthetic oligonucleotide
tgtgccaccccgtttgccctagattaaggtactgt

SEQ ID NO: 71094 - DNA, 35 bp, Artificial Sequence
  Synthetic oligonucleotide
atcgcgttcgtgatatacgcacaccttctccctgt

SEQ ID NO: 71095 - DNA, 35 bp, Artificial Sequence
  Synthetic oligonucleotide
tccgcccctgcctatggttctgtcatcgccccatt

SEQ ID NO: 71096 - DNA, 35 bp, Artificial Sequence
  Synthetic oligonucleotide
ggaacagaaataaggaggtggaaatgggagggatt

SEQ ID NO: 71097 - DNA, 35 bp, Artificial Sequence
  Synthetic oligonucleotide
gcaacggtatctcgcttcccgccgcccttttggtt

SEQ ID NO: 71098 - DNA, 35 bp, Artificial Sequence
  Synthetic oligonucleotide
ggttcacgcctccatcctgcattggctagacattt

SEQ ID NO: 71099 - DNA, 35 bp, Artificial Sequence
  Synthetic oligonucleotide
gcacctccgccctgatctacgttttttagtcccaa

SEQ ID NO: 71100 - DNA, 36 bp, Artificial Sequence
  Synthetic oligonucleotide
gcaccaggggagaccactcatattgcaacactccaa

SEQ ID NO: 71101 - DNA, 35 bp, Artificial Sequence
  Synthetic oligonucleotide
tgcacgtgcgacacctttccattcggcttcctcaa

SEQ ID NO: 71102 - DNA, 36 bp, Artificial Sequence
  Synthetic oligonucleotide
gtatactcgcagatgggagtggggactgggagggaa

SEQ ID NO: 71103 - DNA, 36 bp, Artificial Sequence
  Synthetic oligonucleotide
aacgctgccgcaatggggtgcctaggaggggtggaa

SEQ ID NO: 71104 - DNA, 35 bp, Artificial Sequence
  Synthetic oligonucleotide
gccccccttgcgccttccacttatttgtcattgaa

SEQ ID NO: 71105 - DNA, 36 bp, Artificial Sequence
  Synthetic oligonucleotide
gccactcttccgtccctacgaccaccctgccccaca

SEQ ID NO: 71106 - DNA, 36 bp, Artificial Sequence
  Synthetic oligonucleotide
tcatgtccacggagtcgcgccttaccacatcaacca

SEQ ID NO: 71107 - DNA, 36 bp, Artificial Sequence
  Synthetic oligonucleotide
gtcccgctggatagggaatgccccactgttcaacca

SEQ ID NO: 71108 - DNA, 36 bp, Artificial Sequence
  Synthetic oligonucleotide
tccttagcccggctggtccaaccccctgggccccca

SEQ ID NO: 71109 - DNA, 36 bp, Artificial Sequence
  Synthetic oligonucleotide
attcgccctcgtcccattttgaagtcaaaccgccca

SEQ ID NO: 71110 - DNA, 36 bp, Artificial Sequence
  Synthetic oligonucleotide
tagttgacaccgcactcctctctgaacgtagtccca

SEQ ID NO: 71111 - DNA, 36 bp, Artificial Sequence
  Synthetic oligonucleotide
agccaacgtaggcttaaattattgaccagctatcca

SEQ ID NO: 71112 - DNA, 36 bp, Artificial Sequence
  Synthetic oligonucleotide
gtcccgatcgcatggcattctctttgccctactcca

SEQ ID NO: 71113 - DNA, 36 bp, Artificial Sequence
  Synthetic oligonucleotide
taagcctcctgttgtaaatgtcctgcttattcctca

SEQ ID NO: 71114 - DNA, 37 bp, Artificial Sequence
  Synthetic oligonucleotide
gttaggccctgattttcgaatacacaccactcccaga

SEQ ID NO: 71115 - DNA, 37 bp, Artificial Sequence
  Synthetic oligonucleotide
gtgaactggggggcgggtcgcgatgacggggggcaga

SEQ ID NO: 71116 - DNA, 36 bp, Artificial Sequence
  Synthetic oligonucleotide
tgcgatggcgagagttcgtggtgaagtggggtcaga

SEQ ID NO: 71117 - DNA, 37 bp, Artificial Sequence
  Synthetic oligonucleotide
gtggtactggtaggggaagtagggacatgttcaacga

SEQ ID NO: 71118 - DNA, 37 bp, Artificial Sequence
  Synthetic oligonucleotide
tacatcacttctcacaccagcaaaggacaccgtgcga

SEQ ID NO: 71119 - DNA, 37 bp, Artificial Sequence
  Synthetic oligonucleotide
tacactcgacctgaacgtgccagaaaccccgttgcga

SEQ ID NO: 71120 - DNA, 36 bp, Artificial Sequence
  Synthetic oligonucleotide
aacacgcacggagagcaatggggggttggcgaagga

SEQ ID NO: 71121 - DNA, 35 bp, Artificial Sequence
  Synthetic oligonucleotide
accaacccatccctacccagcacagaagtaacgga

SEQ ID NO: 71122 - DNA, 37 bp, Artificial Sequence
  Synthetic oligonucleotide
tgtggagcatcatctttcctacaccctgccacacgga

SEQ ID NO: 71123 - DNA, 35 bp, Artificial Sequence
  Synthetic oligonucleotide
gaagaccgcaacacgagagggtgggggaaaccgga

SEQ ID NO: 71124 - DNA, 37 bp, Artificial Sequence
  Synthetic oligonucleotide
gagggggtgatggttcgtgcgggtattgggagtggga

SEQ ID NO: 71125 - DNA, 37 bp, Artificial Sequence
  Synthetic oligonucleotide
tgtcacgctttcctgttggctcgtccccccgcaatga

SEQ ID NO: 71126 - DNA, 37 bp, Artificial Sequence
  Synthetic oligonucleotide
gtgaagggaaggaatattgggcaagtttgcaggatga

SEQ ID NO: 71127 - DNA, 38 bp, Artificial Sequence
  Synthetic oligonucleotide
tccgatgcatgcttaaggtgactgggggaaggatatga

SEQ ID NO: 71128 - DNA, 38 bp, Artificial Sequence
  Synthetic oligonucleotide
tcgaccggtagtggctactcttgatccattttcactga

SEQ ID NO: 71129 - DNA, 38 bp, Artificial Sequence
  Synthetic oligonucleotide
agcgcaaaggaaggtcgggcatgggacttgggtactga

SEQ ID NO: 71130 - DNA, 38 bp, Artificial Sequence
  Synthetic oligonucleotide
gtcaaagccgtcttcacccgtactatgtagaaccctga

SEQ ID NO: 71131 - DNA, 38 bp, Artificial Sequence
  Synthetic oligonucleotide
gctcagccggttaaaatgtctccctcgtgctaccctga

SEQ ID NO: 71132 - DNA, 38 bp, Artificial Sequence
  Synthetic oligonucleotide
gccggaggactggtttcaaaacactcctgattccctga

SEQ ID NO: 71133 - DNA, 37 bp, Artificial Sequence
  Synthetic oligonucleotide
agtgaggggcatgacaaagttgaaggatgggctctga

SEQ ID NO: 71134 - DNA, 38 bp, Artificial Sequence
  Synthetic oligonucleotide
aaccctgcccctaccccaccgtaacggaactgttctga

SEQ ID NO: 71135 - DNA, 38 bp, Artificial Sequence
  Synthetic oligonucleotide
gccacctagcctcaacgttgcctccgcttctccagtga

SEQ ID NO: 71136 - DNA, 38 bp, Artificial Sequence
  Synthetic oligonucleotide
atcacacacgaacggatggctcctctggggacgagtga

SEQ ID NO: 71137 - DNA, 37 bp, Artificial Sequence
  Synthetic oligonucleotide
gggaaaacgtgggaagacctgaaaggggaggaggtga

SEQ ID NO: 71138 - DNA, 38 bp, Artificial Sequence
  Synthetic oligonucleotide
aagatgcaacagaggacgtgggaagcgagtgtgtgtga

SEQ ID NO: 71139 - DNA, 37 bp, Artificial Sequence
  Synthetic oligonucleotide
acacccacaacgcacaccgcgagattctagtttgtga

SEQ ID NO: 71140 - DNA, 38 bp, Artificial Sequence
  Synthetic oligonucleotide
tgactaggcaattcggaataggaggtgggattttgtga

SEQ ID NO: 71141 - DNA, 37 bp, Artificial Sequence
  Synthetic oligonucleotide
gtgaaaatcgggggtggagcacgatgaggcaaattga

SEQ ID NO: 71142 - DNA, 38 bp, Artificial Sequence
  Synthetic oligonucleotide
tacccacccgattcatctagtgtagcggtaccccttga

SEQ ID NO: 71143 - DNA, 38 bp, Artificial Sequence
  Synthetic oligonucleotide
accccaacagtcctctctgtttaccacaggttatttga

SEQ ID NO: 71144 - DNA, 38 bp, Artificial Sequence
  Synthetic oligonucleotide
acacctctgcatacataacgacagtaatgatgctttga

SEQ ID NO: 71145 - DNA, 35 bp, Artificial Sequence
  Synthetic oligonucleotide
tttatcggaccgcaccgcgcgagcatttacaccta

SEQ ID NO: 71146 - DNA, 36 bp, Artificial Sequence
  Synthetic oligonucleotide
tcacggtccaccgtctcttagatacacgctccccta

SEQ ID NO: 71147 - DNA, 36 bp, Artificial Sequence
  Synthetic oligonucleotide
tattgatgcggtggggggttacggagctggagccta

SEQ ID NO: 71148 - DNA, 35 bp, Artificial Sequence
  Synthetic oligonucleotide
gcccacggcatccataccatgccacgctatctgta

SEQ ID NO: 71149 - DNA, 35 bp, Artificial Sequence
  Synthetic oligonucleotide
acaactccccttccatcatgattagatgtcggtta

SEQ ID NO: 71150 - DNA, 35 bp, Artificial Sequence
  Synthetic oligonucleotide
ttacgtaacctcgcttgccctaatcctggttgtta

SEQ ID NO: 71151 - DNA, 36 bp, Artificial Sequence
  Synthetic oligonucleotide
ttcaccggtagcgatcctgctccaccgtgcgattta

SEQ ID NO: 71152 - DNA, 35 bp, Artificial Sequence
  Synthetic oligonucleotide
ttggccggttttgcctccgaaccagcacctcttta

SEQ ID NO: 71153 - DNA, 36 bp, Artificial Sequence
  Synthetic oligonucleotide
ccgaccgcctggatgccatccacccatacctcttta

SEQ ID NO: 71154 - DNA, 35 bp, Artificial Sequence
  Synthetic oligonucleotide
atgaccaacgagggggagcactcgttcttctacac

SEQ ID NO: 71155 - DNA, 35 bp, Artificial Sequence
  Synthetic oligonucleotide
ttgacctaggcgacgccgaccatgagaagccccac

SEQ ID NO: 71156 - DNA, 35 bp, Artificial Sequence
  Synthetic oligonucleotide
gcatcacctccgagacgaccctatggagtcatgac

SEQ ID NO: 71157 - DNA, 35 bp, Artificial Sequence
  Synthetic oligonucleotide
tgacgcccagaccctgtcggttaataaattcctac

SEQ ID NO: 71158 - DNA, 35 bp, Artificial Sequence
  Synthetic oligonucleotide
aaccgggcatgagcacgcatgaacctgctttcacc

SEQ ID NO: 71159 - DNA, 35 bp, Artificial Sequence
  Synthetic oligonucleotide
tcatactcggtcagtttcttgcacccttcacgacc

SEQ ID NO: 71160 - DNA, 35 bp, Artificial Sequence
  Synthetic oligonucleotide
acctagcagggtgttactcttcgcgcgcccaaccc

SEQ ID NO: 71161 - DNA, 35 bp, Artificial Sequence
  Synthetic oligonucleotide
cacccagacgcatggtactactcttttgacccccc

SEQ ID NO: 71162 - DNA, 35 bp, Artificial Sequence
  Synthetic oligonucleotide
gtcgcaaatcgctatgagaccccctgctcgccccc

SEQ ID NO: 71163 - DNA, 35 bp, Artificial Sequence
  Synthetic oligonucleotide
tcgcgaggcacatcgagatccgtcctaactgcccc

SEQ ID NO: 71164 - DNA, 35 bp, Artificial Sequence
  Synthetic oligonucleotide
tgctactcgctcgaactactcttgaaccgggtccc

SEQ ID NO: 71165 - DNA, 35 bp, Artificial Sequence
  Synthetic oligonucleotide
acacccaaacaagacggaggatggaacgcggggcc

SEQ ID NO: 71166 - DNA, 35 bp, Artificial Sequence
  Synthetic oligonucleotide
aacacatgcccggatcctcctattacaacgtttcc

SEQ ID NO: 71167 - DNA, 35 bp, Artificial Sequence
  Synthetic oligonucleotide
tgagagggcggggatagtaaagggcggggaaaagc

SEQ ID NO: 71168 - DNA, 35 bp, Artificial Sequence
  Synthetic oligonucleotide
ttacctcccccgcggggcacaccttgttgacacgc

SEQ ID NO: 71169 - DNA, 35 bp, Artificial Sequence
  Synthetic oligonucleotide
aacgcatagaggaagttggggaattgctgggtggc

SEQ ID NO: 71170 - DNA, 35 bp, Artificial Sequence
  Synthetic oligonucleotide
tcgacccgggctccccttatcttttctcttgctgc

SEQ ID NO: 71171 - DNA, 35 bp, Artificial Sequence
  Synthetic oligonucleotide
tcagccgccccaaagctgcatcaaccacctgtatc

SEQ ID NO: 71172 - DNA, 35 bp, Artificial Sequence
  Synthetic oligonucleotide
tgatcagaccgcagcatattttcctactgaagctc

SEQ ID NO: 71173 - DNA, 35 bp, Artificial Sequence
  Synthetic oligonucleotide
ggggaggggcacaggaggggtaggaactgtcggtc

SEQ ID NO: 71174 - DNA, 35 bp, Artificial Sequence
  Synthetic oligonucleotide
gcaacgtcgcccaatccccggactcgtgctcattc

SEQ ID NO: 71175 - DNA, 35 bp, Artificial Sequence
  Synthetic oligonucleotide
ccacaatccgcgctgcccatctctccctgtcgaag

SEQ ID NO: 71176 - DNA, 34 bp, Artificial Sequence
  Synthetic oligonucleotide
accagcctggtccttgccccctacttcgtgtgag

SEQ ID NO: 71177 - DNA, 35 bp, Artificial Sequence
  Synthetic oligonucleotide
ggatacctcaccatgacggatttacgcccttctag

SEQ ID NO: 71178 - DNA, 35 bp, Artificial Sequence
  Synthetic oligonucleotide
accaaagcgagggaatctaggggaggccggaaccg

SEQ ID NO: 71179 - DNA, 35 bp, Artificial Sequence
  Synthetic oligonucleotide
ggtgggagggggttgggtagtttcaatgttcaccg

SEQ ID NO: 71180 - DNA, 35 bp, Artificial Sequence
  Synthetic oligonucleotide
tgtggaggccgaaggaagggagcgtaaaagcatcg

SEQ ID NO: 71181 - DNA, 35 bp, Artificial Sequence
  Synthetic oligonucleotide
gtgccgaccatattctaacccaaactcacgattcg

SEQ ID NO: 71182 - DNA, 35 bp, Artificial Sequence
  Synthetic oligonucleotide
gggatggtcgatatggaaaacacggtaaatggagg

SEQ ID NO: 71183 - DNA, 35 bp, Artificial Sequence
  Synthetic oligonucleotide
gtacgggggaaaggggaccggttaggctctgaggg

SEQ ID NO: 71184 - DNA, 35 bp, Artificial Sequence
  Synthetic oligonucleotide
ggttgccactaggctggggatttgccggagggggg

SEQ ID NO: 71185 - DNA, 35 bp, Artificial Sequence
  Synthetic oligonucleotide
acccgccacgtattgccatcacatattcagcgatg

SEQ ID NO: 71186 - DNA, 35 bp, Artificial Sequence
  Synthetic oligonucleotide
gtccccgattgcctcgattagtctcatttcttctg

SEQ ID NO: 71187 - DNA, 35 bp, Artificial Sequence
  Synthetic oligonucleotide
attgcccctccatagtagctcaatcacgagttgtg

SEQ ID NO: 71188 - DNA, 35 bp, Artificial Sequence
  Synthetic oligonucleotide
gaacgtcaaaatcaatcagaccccacttcaccttg

SEQ ID NO: 71189 - DNA, 35 bp, Artificial Sequence
  Synthetic oligonucleotide
tacgagtcctagtcactttttgtttttgtcctttg

SEQ ID NO: 71190 - DNA, 35 bp, Artificial Sequence
  Synthetic oligonucleotide
taagccccccgctccgtatttttctgtcccatgat

SEQ ID NO: 71191 - DNA, 35 bp, Artificial Sequence
  Synthetic oligonucleotide
tcccaatgcgctctttattgagtgtgcctcatcct

SEQ ID NO: 71192 - DNA, 35 bp, Artificial Sequence
  Synthetic oligonucleotide
gttgccgaccatcatggcatagtccacactgtcct

SEQ ID NO: 71193 - DNA, 35 bp, Artificial Sequence
  Synthetic oligonucleotide
gcgcgacggcacccatcttctgcagccctttaagt

SEQ ID NO: 71194 - DNA, 35 bp, Artificial Sequence
  Synthetic oligonucleotide
gtgtccacaggaggagtgcagggctgaaagcaatt

SEQ ID NO: 71195 - DNA, 35 bp, Artificial Sequence
  Synthetic oligonucleotide
tctatcgcaggctgccaatctttcttaacagcatt

SEQ ID NO: 71196 - DNA, 35 bp, Artificial Sequence
  Synthetic oligonucleotide
tcacgcaccgttcctatcacacgtaaccaaacctt

SEQ ID NO: 71197 - DNA, 35 bp, Artificial Sequence
  Synthetic oligonucleotide
tccttcccaagtccgacagacctattgttgtcctt

SEQ ID NO: 71198 - DNA, 35 bp, Artificial Sequence
  Synthetic oligonucleotide
atccggttccgttcactctcctaggttcatctgtt

SEQ ID NO: 71199 - DNA, 35 bp, Artificial Sequence
  Synthetic oligonucleotide
gagtgcactgtcccccaagcctaccttacagtgtt

SEQ ID NO: 71200 - DNA, 35 bp, Artificial Sequence
  Synthetic oligonucleotide
aagtgcaacccacaccaccgactgggaagaaattt

SEQ ID NO: 71201 - DNA, 35 bp, Artificial Sequence
  Synthetic oligonucleotide
gcacaccagaatgacttgtgttcggcctaatattt

SEQ ID NO: 71202 - DNA, 36 bp, Artificial Sequence
  Synthetic oligonucleotide
acagttcactccgccgttcgtgcgcacgcttttcaa

SEQ ID NO: 71203 - DNA, 35 bp, Artificial Sequence
  Synthetic oligonucleotide
acgcgcccggctccccacctctaccagttatagaa

SEQ ID NO: 71204 - DNA, 36 bp, Artificial Sequence
  Synthetic oligonucleotide
aactggggggaaggctgaggaactgggttttgtgaa

SEQ ID NO: 71205 - DNA, 35 bp, Artificial Sequence
  Synthetic oligonucleotide
tccgccagagtcgcccatgcacctctgtactctaa

SEQ ID NO: 71206 - DNA, 36 bp, Artificial Sequence
  Synthetic oligonucleotide
gatactgaggccgcacatcgtaccgacccactaaca

SEQ ID NO: 71207 - DNA, 35 bp, Artificial Sequence
  Synthetic oligonucleotide
tatcgccggtatcgtgatactgcctaactgccaca

SEQ ID NO: 71208 - DNA, 36 bp, Artificial Sequence
  Synthetic oligonucleotide
acgctctaagccgccaatctttgtacttgcccacca

SEQ ID NO: 71209 - DNA, 36 bp, Artificial Sequence
  Synthetic oligonucleotide
ttgaaccgcgcttttttaggatggctttttccacca

SEQ ID NO: 71210 - DNA, 36 bp, Artificial Sequence
  Synthetic oligonucleotide
tatgtgtgtggcgccgctcacgttcctgaatcacca

SEQ ID NO: 71211 - DNA, 36 bp, Artificial Sequence
  Synthetic oligonucleotide
taaccctcagtcgccgcagtatagatcctccgccca

SEQ ID NO: 71212 - DNA, 35 bp, Artificial Sequence
  Synthetic oligonucleotide
gctaacgacaccccatcttgcagtagcgaaatcca

SEQ ID NO: 71213 - DNA, 36 bp, Artificial Sequence
  Synthetic oligonucleotide
tcacgcgcctccgccactattgaacgcatggaagca

SEQ ID NO: 71214 - DNA, 36 bp, Artificial Sequence
  Synthetic oligonucleotide
gtgagcaaggcaggagagtggagtggggacacagca

SEQ ID NO: 71215 - DNA, 35 bp, Artificial Sequence
  Synthetic oligonucleotide
gtcccccctccaatgaagctcatcgcatatgagca

SEQ ID NO: 71216 - DNA, 36 bp, Artificial Sequence
  Synthetic oligonucleotide
acgtcactcccacgctaaatgccgccgcgttacgca

SEQ ID NO: 71217 - DNA, 35 bp, Artificial Sequence
  Synthetic oligonucleotide
aaaacccgaccagaacgaccccatatagggaggca

SEQ ID NO: 71218 - DNA, 35 bp, Artificial Sequence
  Synthetic oligonucleotide
acccagccggctatccaacgaaggcaaatgattca

SEQ ID NO: 71219 - DNA, 38 bp, Artificial Sequence
  Synthetic oligonucleotide
atacaccacaccttctgccctacgtgctcaggccttca

SEQ ID NO: 71220 - DNA, 35 bp, Artificial Sequence
  Synthetic oligonucleotide
acaccagtcgaaactctttccttgtgacgtgttca

SEQ ID NO: 71221 - DNA, 37 bp, Artificial Sequence
  Synthetic oligonucleotide
gtgcttacgtcactccctgccttccccttagtccaga

SEQ ID NO: 71222 - DNA, 37 bp, Artificial Sequence
  Synthetic oligonucleotide
tcagccgtgctcccccgctggcccaaacaaatataga

SEQ ID NO: 71223 - DNA, 37 bp, Artificial Sequence
  Synthetic oligonucleotide
atgtgtccgccacacacacagccgtgctttcaaacga

SEQ ID NO: 71224 - DNA, 37 bp, Artificial Sequence
  Synthetic oligonucleotide
gcacagatcctcgcatgctccactaaccccagcccga

SEQ ID NO: 71225 - DNA, 37 bp, Artificial Sequence
  Synthetic oligonucleotide
tacggggaggaagaggaggatgcaaggccaatggcga

SEQ ID NO: 71226 - DNA, 35 bp, Artificial Sequence
  Synthetic oligonucleotide
agtgacccgcaagttccgtgatactcccacctcga

SEQ ID NO: 71227 - DNA, 36 bp, Artificial Sequence
  Synthetic oligonucleotide
accccgcaggtaacatactgaccccacttatctcga

SEQ ID NO: 71228 - DNA, 37 bp, Artificial Sequence
  Synthetic oligonucleotide
ttcacccggcctcaatcgtacatcgctgacgagcgga

SEQ ID NO: 71229 - DNA, 38 bp, Artificial Sequence
  Synthetic oligonucleotide
atgagagggatcggtgagggatatggggccatggcgga

SEQ ID NO: 71230 - DNA, 37 bp, Artificial Sequence
  Synthetic oligonucleotide
tctgtgtccccggggaagagggatatagggcggggga

SEQ ID NO: 71231 - DNA, 37 bp, Artificial Sequence
  Synthetic oligonucleotide
atagccagggtcaggacaactcaggggctggggggga

SEQ ID NO: 71232 - DNA, 36 bp, Artificial Sequence
  Synthetic oligonucleotide
tcacaagggaacagggtggttatcgggatttgggga

SEQ ID NO: 71233 - DNA, 37 bp, Artificial Sequence
  Synthetic oligonucleotide
acagccagttacatcgaatgggggggtaggggtggga

SEQ ID NO: 71234 - DNA, 36 bp, Artificial Sequence
  Synthetic oligonucleotide
acagtagtgtgggggtgagcggtggggtgtttggga

SEQ ID NO: 71235 - DNA, 37 bp, Artificial Sequence
  Synthetic oligonucleotide
taccaggcggaagcaagcgggttcttgaaggggtgga

SEQ ID NO: 71236 - DNA, 37 bp, Artificial Sequence
  Synthetic oligonucleotide
accattccgccactgaaccacactaagtgatcttgga

SEQ ID NO: 71237 - DNA, 38 bp, Artificial Sequence
  Synthetic oligonucleotide
gcgctggcaccatccttcatagctccgagttcgcatga

SEQ ID NO: 71238 - DNA, 38 bp, Artificial Sequence
  Synthetic oligonucleotide
tggttgctgggcagggtagggagggcaattcatgatga

SEQ ID NO: 71239 - DNA, 36 bp, Artificial Sequence
  Synthetic oligonucleotide
agcctactccgcggtggtgctctcgtccctttatga

SEQ ID NO: 71240 - DNA, 38 bp, Artificial Sequence
  Synthetic oligonucleotide
agccccattgtcctgtcttcctggcgccctcttactga

SEQ ID NO: 71241 - DNA, 37 bp, Artificial Sequence
  Synthetic oligonucleotide
ataccgaccggctaatgtccaatgcatacaaccctga

SEQ ID NO: 71242 - DNA, 38 bp, Artificial Sequence
  Synthetic oligonucleotide
tcgtttgcaactgacccgccacccgtccgcttccctga

SEQ ID NO: 71243 - DNA, 38 bp, Artificial Sequence
  Synthetic oligonucleotide
tgcggggggtggcgaagatgatgcaggggcgatcgtga

SEQ ID NO: 71244 - DNA, 38 bp, Artificial Sequence
  Synthetic oligonucleotide
tcataccccttcgcgaacgccactgtacccacgggtga

SEQ ID NO: 71245 - DNA, 38 bp, Artificial Sequence
  Synthetic oligonucleotide
accaggcatcccccctcccgaacgtcgccacgtggtga

SEQ ID NO: 71246 - DNA, 38 bp, Artificial Sequence
  Synthetic oligonucleotide
atggagacggaggtgggcgggtaacacgaagttggtga

SEQ ID NO: 71247 - DNA, 37 bp, Artificial Sequence
  Synthetic oligonucleotide
tcgccgctcccgcctctccacgtctacagtcgattga

SEQ ID NO: 71248 - DNA, 38 bp, Artificial Sequence
  Synthetic oligonucleotide
aggagtgcacagaggcttgtcgggggcgtgggggttga

SEQ ID NO: 71249 - DNA, 37 bp, Artificial Sequence
  Synthetic oligonucleotide
catgcacgacgtgcacttgtatttcaacggtggttga

SEQ ID NO: 71250 - DNA, 35 bp, Artificial Sequence
  Synthetic oligonucleotide
gctggtcgatgcgggctatggcttgggggatttga

SEQ ID NO: 71251 - DNA, 38 bp, Artificial Sequence
  Synthetic oligonucleotide
aactagacgtcgacttctttttctgtgctgttatttga

SEQ ID NO: 71252 - DNA, 38 bp, Artificial Sequence
  Synthetic oligonucleotide
ttggaccgctaatcggctattggattttttttgtttga

SEQ ID NO: 71253 - DNA, 35 bp, Artificial Sequence
  Synthetic oligonucleotide
gacccccctatggatatctttgagataaccgacta

SEQ ID NO: 71254 - DNA, 36 bp, Artificial Sequence
  Synthetic oligonucleotide
gacaaatctacacccgatctgcttgagccgaaccta

SEQ ID NO: 71255 - DNA, 36 bp, Artificial Sequence
  Synthetic oligonucleotide
tatcccaccccgcctcgcccctgcaaaagaagccta

SEQ ID NO: 71256 - DNA, 36 bp, Artificial Sequence
  Synthetic oligonucleotide
ttcaccgcgcaatcaccgactcttgcgacttgtcta

SEQ ID NO: 71257 - DNA, 36 bp, Artificial Sequence
  Synthetic oligonucleotide
acattccgcgtgctctctatgcggtttactgttcta

SEQ ID NO: 71258 - DNA, 36 bp, Artificial Sequence
  Synthetic oligonucleotide
acctctacacccgaccccgcacttccgctggccgta

SEQ ID NO: 71259 - DNA, 36 bp, Artificial Sequence
  Synthetic oligonucleotide
tatcaccccccccagaaggcttgcatggagctggta

SEQ ID NO: 71260 - DNA, 35 bp, Artificial Sequence
  Synthetic oligonucleotide
aatgccccgcgagtacccgtgcagttttaccctta

SEQ ID NO: 71261 - DNA, 35 bp, Artificial Sequence
  Synthetic oligonucleotide
agtacgaccgggtcggtctactcaccatcctgtta

SEQ ID NO: 71262 - DNA, 36 bp, Artificial Sequence
  Synthetic oligonucleotide
atcccactataccgacgttaatccactgcacgttta

SEQ ID NO: 71263 - DNA, 35 bp, Artificial Sequence
  Synthetic oligonucleotide
agccgtgggcgcacatcccttggtccaatccgaac

SEQ ID NO: 71264 - DNA, 35 bp, Artificial Sequence
  Synthetic oligonucleotide
gtattccacagtaccctctttacgcgctggtccac

SEQ ID NO: 71265 - DNA, 35 bp, Artificial Sequence
  Synthetic oligonucleotide
atcccagcatgggagtatcaaccgacactggtcac

SEQ ID NO: 71266 - DNA, 35 bp, Artificial Sequence
  Synthetic oligonucleotide
tacgccactgactcgcatattcgacatcttgtgac

SEQ ID NO: 71267 - DNA, 35 bp, Artificial Sequence
  Synthetic oligonucleotide
gatggatgcatctcgaagccggacctatccccacc

SEQ ID NO: 71268 - DNA, 35 bp, Artificial Sequence
  Synthetic oligonucleotide
ttaccctgtccagtggtatctcttctcggttcacc

SEQ ID NO: 71269 - DNA, 35 bp, Artificial Sequence
  Synthetic oligonucleotide
aacacgagaactggctctaccagcctggacatacc

SEQ ID NO: 71270 - DNA, 35 bp, Artificial Sequence
  Synthetic oligonucleotide
tcccgaagggtcaccggtagttattcgcctatacc

SEQ ID NO: 71271 - DNA, 35 bp, Artificial Sequence
  Synthetic oligonucleotide
gcgaatccagtagtctgtttctattgccggccccc

SEQ ID NO: 71272 - DNA, 35 bp, Artificial Sequence
  Synthetic oligonucleotide
tagtaggactacgtgaggcaataccgacttttccc

SEQ ID NO: 71273 - DNA, 35 bp, Artificial Sequence
  Synthetic oligonucleotide
gtcctgctgccgatcttcatcccctccacaaggcc

SEQ ID NO: 71274 - DNA, 35 bp, Artificial Sequence
  Synthetic oligonucleotide
tgataccgtgcggtgaccccgttgctatcccccgc

SEQ ID NO: 71275 - DNA, 35 bp, Artificial Sequence
  Synthetic oligonucleotide
ttacacatcgcatcttagaaatcgggattactcgc

SEQ ID NO: 71276 - DNA, 35 bp, Artificial Sequence
  Synthetic oligonucleotide
gacactgcgtactattccacagccagtgtatcctc

SEQ ID NO: 71277 - DNA, 35 bp, Artificial Sequence
  Synthetic oligonucleotide
gcaccccccacttctgggctcactagactttagtc

SEQ ID NO: 71278 - DNA, 35 bp, Artificial Sequence
  Synthetic oligonucleotide
gtctggtacctcctgttgattgctgagcttatgtc

SEQ ID NO: 71279 - DNA, 35 bp, Artificial Sequence
  Synthetic oligonucleotide
tgctagcgccggacaatcgtctccttcaccgtgtc

SEQ ID NO: 71280 - DNA, 35 bp, Artificial Sequence
  Synthetic oligonucleotide
attgatccccctataactatccgccggacggcttc

SEQ ID NO: 71281 - DNA, 35 bp, Artificial Sequence
  Synthetic oligonucleotide
tgcccgaaggaggaagtacaaaggggagtgatcag

SEQ ID NO: 71282 - DNA, 35 bp, Artificial Sequence
  Synthetic oligonucleotide
tgtacaccctccaaccataaagcctctcgttctag

SEQ ID NO: 71283 - DNA, 35 bp, Artificial Sequence
  Synthetic oligonucleotide
gacaggcgatggtccttacgtactgttcccccacg

SEQ ID NO: 71284 - DNA, 35 bp, Artificial Sequence
  Synthetic oligonucleotide
ttgccggttaactgcactcgcgcctccctataccg

SEQ ID NO: 71285 - DNA, 35 bp, Artificial Sequence
  Synthetic oligonucleotide
gtcctggagcgcccccgcctgattatccatactcg

SEQ ID NO: 71286 - DNA, 35 bp, Artificial Sequence
  Synthetic oligonucleotide
tcagaaccaccactgagattaaatttttagcctcg

SEQ ID NO: 71287 - DNA, 34 bp, Artificial Sequence
  Synthetic oligonucleotide
tccccggtctctacatcaagcccctccaccttcg

SEQ ID NO: 71288 - DNA, 35 bp, Artificial Sequence
  Synthetic oligonucleotide
tagtcggttctgttgggtgggagggtgcatccggg

SEQ ID NO: 71289 - DNA, 35 bp, Artificial Sequence
  Synthetic oligonucleotide
gataatgagtggatgggtgctgggcaacaagcggg

SEQ ID NO: 71290 - DNA, 35 bp, Artificial Sequence
  Synthetic oligonucleotide
tacagatgtagtgcccgcactctttccccttatgg

SEQ ID NO: 71291 - DNA, 35 bp, Artificial Sequence
  Synthetic oligonucleotide
tctgacggaaaacatggtggtggtatgacagaatg

SEQ ID NO: 71292 - DNA, 35 bp, Artificial Sequence
  Synthetic oligonucleotide
tcccaccatgccggcctatgcctcacccgatactg

SEQ ID NO: 71293 - DNA, 35 bp, Artificial Sequence
  Synthetic oligonucleotide
tacccaatgtggcgtgttctacgtatagtttcctg

SEQ ID NO: 71294 - DNA, 35 bp, Artificial Sequence
  Synthetic oligonucleotide
aaggagagagttggggtactgacaggggggaaaat

SEQ ID NO: 71295 - DNA, 35 bp, Artificial Sequence
  Synthetic oligonucleotide
aagtgctcaccgcacacccacgagactcttggaat

SEQ ID NO: 71296 - DNA, 35 bp, Artificial Sequence
  Synthetic oligonucleotide
gcataacgcccccgtccctcaatccggaattacat

SEQ ID NO: 71297 - DNA, 35 bp, Artificial Sequence
  Synthetic oligonucleotide
tccacctccacataaccgtcgtttcgaccgggcat

SEQ ID NO: 71298 - DNA, 35 bp, Artificial Sequence
  Synthetic oligonucleotide
acgaccggtagttcggggaggggcacgaaaggact

SEQ ID NO: 71299 - DNA, 35 bp, Artificial Sequence
  Synthetic oligonucleotide
gacaacaccgccgcacatgccgtccagtacgccct

SEQ ID NO: 71300 - DNA, 35 bp, Artificial Sequence
  Synthetic oligonucleotide
gccttccacttctggttgctcacttccatgtttct

SEQ ID NO: 71301 - DNA, 35 bp, Artificial Sequence
  Synthetic oligonucleotide
taccccctgatccactgtcgttctcctagtcgagt

SEQ ID NO: 71302 - DNA, 35 bp, Artificial Sequence
  Synthetic oligonucleotide
atatgccaacacacaccgggtactccatcgtatgt

SEQ ID NO: 71303 - DNA, 35 bp, Artificial Sequence
  Synthetic oligonucleotide
gcaacctgcaactagagcacagctgcatatgctgt

SEQ ID NO: 71304 - DNA, 35 bp, Artificial Sequence
  Synthetic oligonucleotide
gccggtccgcgatcccttccccttacgccgtctgt

SEQ ID NO: 71305 - DNA, 35 bp, Artificial Sequence
  Synthetic oligonucleotide
gctccacccagtcctctgatcgattcgggacttgt

SEQ ID NO: 71306 - DNA, 35 bp, Artificial Sequence
  Synthetic oligonucleotide
aactagcacgatccctgctatcatcgtgcctaatt

SEQ ID NO: 71307 - DNA, 35 bp, Artificial Sequence
  Synthetic oligonucleotide
gacacacatcgtcctttcccgctgtctaccatatt

SEQ ID NO: 71308 - DNA, 35 bp, Artificial Sequence
  Synthetic oligonucleotide
gtcaacccagtgttactactccggggggaaaattt

SEQ ID NO: 71309 - DNA, 35 bp, Artificial Sequence
  Synthetic oligonucleotide
accgtcgaccatcattgggctccaacaggttattt

SEQ ID NO: 71310 - DNA, 35 bp, Artificial Sequence
  Synthetic oligonucleotide
tcaccttactccgcctgactcgcatgggactacaa

SEQ ID NO: 71311 - DNA, 35 bp, Artificial Sequence
  Synthetic oligonucleotide
aatggggacatgcgggagacaaagggcaattagaa

SEQ ID NO: 71312 - DNA, 36 bp, Artificial Sequence
  Synthetic oligonucleotide
tgcacgcagtgagatccgaccaccacatcacacgaa

SEQ ID NO: 71313 - DNA, 35 bp, Artificial Sequence
  Synthetic oligonucleotide
tgcttgagccctgtcccatggtcgctccctccgaa

SEQ ID NO: 71314 - DNA, 36 bp, Artificial Sequence
  Synthetic oligonucleotide
acacccgaccaaggatacacgagcgatacctttgaa

SEQ ID NO: 71315 - DNA, 35 bp, Artificial Sequence
  Synthetic oligonucleotide
ttcacccgggtgtttggtatacactcgccttgtaa

SEQ ID NO: 71316 - DNA, 36 bp, Artificial Sequence
  Synthetic oligonucleotide
agtaatcgcaccagtgacatccaggcccctacttaa

SEQ ID NO: 71317 - DNA, 35 bp, Artificial Sequence
  Synthetic oligonucleotide
actgactatgccccatccaacttgcaggggagaca

SEQ ID NO: 71318 - DNA, 36 bp, Artificial Sequence
  Synthetic oligonucleotide
tcgtgcgcctcgaacccacaacttcgctgttttaca

SEQ ID NO: 71319 - DNA, 36 bp, Artificial Sequence
  Synthetic oligonucleotide
accctcacctactctgggtactgtctaagtaaacca

SEQ ID NO: 71320 - DNA, 37 bp, Artificial Sequence
  Synthetic oligonucleotide
cacgccgggcccacacgacaatttcatcactgcacca

SEQ ID NO: 71321 - DNA, 36 bp, Artificial Sequence
  Synthetic oligonucleotide
atcgtgcactacgagtgccctatccccaatcaccca

SEQ ID NO: 71322 - DNA, 35 bp, Artificial Sequence
  Synthetic oligonucleotide
atagccctgctgcaaaccgcttcaggccaccccca

SEQ ID NO: 71323 - DNA, 35 bp, Artificial Sequence
  Synthetic oligonucleotide
tgatgcacaccgttacgttttttcggttcatgcca

SEQ ID NO: 71324 - DNA, 36 bp, Artificial Sequence
  Synthetic oligonucleotide
gactgacccatgggaaacagaagaggtgaggatcca

SEQ ID NO: 71325 - DNA, 36 bp, Artificial Sequence
  Synthetic oligonucleotide
agtgcccaccgcccacccccgtcttgggttagtcca

SEQ ID NO: 71326 - DNA, 36 bp, Artificial Sequence
  Synthetic oligonucleotide
aaacaacggcctccagaagaatcttgctccattcca

SEQ ID NO: 71327 - DNA, 35 bp, Artificial Sequence
  Synthetic oligonucleotide
gtatgcgctccactctcgactgcggcttaatagca

SEQ ID NO: 71328 - DNA, 35 bp, Artificial Sequence
  Synthetic oligonucleotide
aatccgcacccgaagcagtcatacccccataggca

SEQ ID NO: 71329 - DNA, 36 bp, Artificial Sequence
  Synthetic oligonucleotide
tcctggacctcctaaacctatgtgctagccattgca

SEQ ID NO: 71330 - DNA, 36 bp, Artificial Sequence
  Synthetic oligonucleotide
tagtacactctctcatgctcttcagatcgcacatca

SEQ ID NO: 71331 - DNA, 36 bp, Artificial Sequence
  Synthetic oligonucleotide
tccccgcaactgtaacttcctaacgccggatactca

SEQ ID NO: 71332 - DNA, 35 bp, Artificial Sequence
  Synthetic oligonucleotide
ttgagcactggccaaacatttttacgcctcattca

SEQ ID NO: 71333 - DNA, 37 bp, Artificial Sequence
  Synthetic oligonucleotide
gagcccgttcctcagggccgtcaccccgttttgccga

SEQ ID NO: 71334 - DNA, 37 bp, Artificial Sequence
  Synthetic oligonucleotide
gattgaacgtgctgcagcgattttggttccgtcgcga

SEQ ID NO: 71335 - DNA, 37 bp, Artificial Sequence
  Synthetic oligonucleotide
tacgtatggagggaggagggtggacagatagatgcga

SEQ ID NO: 71336 - DNA, 36 bp, Artificial Sequence
  Synthetic oligonucleotide
actgtctcagtttcgctgctacccatcacattgcga

SEQ ID NO: 71337 - DNA, 37 bp, Artificial Sequence
  Synthetic oligonucleotide
aggaggtcgctgagctgcacttaccaccacttccgga

SEQ ID NO: 71338 - DNA, 36 bp, Artificial Sequence
  Synthetic oligonucleotide
gtgctctgcagggttcggagggcaataggggaggga

SEQ ID NO: 71339 - DNA, 36 bp, Artificial Sequence
  Synthetic oligonucleotide
agtgggcatgtagtcgtaatttgggtaagggtggga

SEQ ID NO: 71340 - DNA, 36 bp, Artificial Sequence
  Synthetic oligonucleotide
tctaaacgagggggcgggtggacgaagcgtgtggga

SEQ ID NO: 71341 - DNA, 37 bp, Artificial Sequence
  Synthetic oligonucleotide
tatctcacctcgacccatgtcgtaacatgttcatgga

SEQ ID NO: 71342 - DNA, 36 bp, Artificial Sequence
  Synthetic oligonucleotide
tctatgcacacacctcttcattttacagtccctgga

SEQ ID NO: 71343 - DNA, 37 bp, Artificial Sequence
  Synthetic oligonucleotide
tgagtcacgaaaccgcgtaagtaaaagggggggtgga

SEQ ID NO: 71344 - DNA, 38 bp, Artificial Sequence
  Synthetic oligonucleotide
gtcacccgcctgttttcacatatcatacattcaaatga

SEQ ID NO: 71345 - DNA, 36 bp, Artificial Sequence
  Synthetic oligonucleotide
tccgccgcaggggggaaaatcacgactgaagaatga

SEQ ID NO: 71346 - DNA, 37 bp, Artificial Sequence
  Synthetic oligonucleotide
gtaaggagtgggtgatgcggccgggagagggaactga

SEQ ID NO: 71347 - DNA, 38 bp, Artificial Sequence
  Synthetic oligonucleotide
gcgcataggggtgggtgggtctggcggagtgacactga

SEQ ID NO: 71348 - DNA, 38 bp, Artificial Sequence
  Synthetic oligonucleotide
acctccgatccggtccctttacatgttcctgttactga

SEQ ID NO: 71349 - DNA, 37 bp, Artificial Sequence
  Synthetic oligonucleotide
atcgaactcccggccctgacgtgttgctcacccctga

SEQ ID NO: 71350 - DNA, 37 bp, Artificial Sequence
  Synthetic oligonucleotide
gcatacccttgtgcactcttatcacgcccccatctga

SEQ ID NO: 71351 - DNA, 38 bp, Artificial Sequence
  Synthetic oligonucleotide
gctacgtaccctgtgccatcaagttttggttcctctga

SEQ ID NO: 71352 - DNA, 38 bp, Artificial Sequence
  Synthetic oligonucleotide
aatgcagccaatggaacacgccctgcccgaatctctga

SEQ ID NO: 71353 - DNA, 38 bp, Artificial Sequence
  Synthetic oligonucleotide
acgacaatcagcacatatgctcaccaccgcaccagtga

SEQ ID NO: 71354 - DNA, 38 bp, Artificial Sequence
  Synthetic oligonucleotide
tccgctagcctacaagctccatcttacacccccagtga

SEQ ID NO: 71355 - DNA, 38 bp, Artificial Sequence
  Synthetic oligonucleotide
tcccccgcaaggtgctgattgcgttttcatttacgtga

SEQ ID NO: 71356 - DNA, 38 bp, Artificial Sequence
  Synthetic oligonucleotide
tctggttgggtggggctgagtaagggcaaggggcgtga

SEQ ID NO: 71357 - DNA, 38 bp, Artificial Sequence
  Synthetic oligonucleotide
gcataagggggtggagttggaatgagcagtgaaggtga

SEQ ID NO: 71358 - DNA, 38 bp, Artificial Sequence
  Synthetic oligonucleotide
tctcggggtgggggctccaggaggggatgggagggtga

SEQ ID NO: 71359 - DNA, 38 bp, Artificial Sequence
  Synthetic oligonucleotide
gacaagggtgagcgatgcagtcggggaaggctgggtga

SEQ ID NO: 71360 - DNA, 38 bp, Artificial Sequence
  Synthetic oligonucleotide
tcaaacaccacgtgcgctcttaatctgtacacctgtga

SEQ ID NO: 71361 - DNA, 38 bp, Artificial Sequence
  Synthetic oligonucleotide
ttgacccttacgcccagccccctcattgggttgtgtga

SEQ ID NO: 71362 - DNA, 38 bp, Artificial Sequence
  Synthetic oligonucleotide
tgccatcggtccccccttttcccggtcattgcccttga

SEQ ID NO: 71363 - DNA, 38 bp, Artificial Sequence
  Synthetic oligonucleotide
gaaccgccgactagttatacttctgtctgcatccttga

SEQ ID NO: 71364 - DNA, 38 bp, Artificial Sequence
  Synthetic oligonucleotide
atgtggggtggaggactggaaaaacaggagtaggttga

SEQ ID NO: 71365 - DNA, 38 bp, Artificial Sequence
  Synthetic oligonucleotide
actatcccgtacactgggcccatcactttcttggttga

SEQ ID NO: 71366 - DNA, 37 bp, Artificial Sequence
  Synthetic oligonucleotide
tagacttacactcctgccggtttgggaacctgtttga

SEQ ID NO: 71367 - DNA, 36 bp, Artificial Sequence
  Synthetic oligonucleotide
gaaacgaactacggcccaccgtcctaagcctatcta

SEQ ID NO: 71368 - DNA, 36 bp, Artificial Sequence
  Synthetic oligonucleotide
gaacccgtgtgccacgctccacagaatggctttcta

SEQ ID NO: 71369 - DNA, 35 bp, Artificial Sequence
  Synthetic oligonucleotide
aacagccgagttcctactattgccacccatgcgta

SEQ ID NO: 71370 - DNA, 38 bp, Artificial Sequence
  Synthetic oligonucleotide
tgtgcggtactggatgtctcgtactccccctgctttta

SEQ ID NO: 71371 - DNA, 35 bp, Artificial Sequence
  Synthetic oligonucleotide
tcaaccgatgatgcgttccgcacccggtcgtaaac

SEQ ID NO: 71372 - DNA, 35 bp, Artificial Sequence
  Synthetic oligonucleotide
tacggaccaacagcactgctatactgggggagaac

SEQ ID NO: 71373 - DNA, 35 bp, Artificial Sequence
  Synthetic oligonucleotide
atgccccgccaccactttcttgcctacggttccac

SEQ ID NO: 71374 - DNA, 35 bp, Artificial Sequence
  Synthetic oligonucleotide
accgcatgtaggtggcatcgcattgctcttaatac

SEQ ID NO: 71375 - DNA, 35 bp, Artificial Sequence
  Synthetic oligonucleotide
tcctcaagcctctgtagaaccacgaacccgtctac

SEQ ID NO: 71376 - DNA, 35 bp, Artificial Sequence
  Synthetic oligonucleotide
tcctcaactggcgttaggcatcctctgtttccacc

SEQ ID NO: 71377 - DNA, 35 bp, Artificial Sequence
  Synthetic oligonucleotide
tggggcgatgccacccatggtccttgtggtttacc

SEQ ID NO: 71378 - DNA, 35 bp, Artificial Sequence
  Synthetic oligonucleotide
atgagtgaaaagcgcacaatccctgcaacccaccc

SEQ ID NO: 71379 - DNA, 35 bp, Artificial Sequence
  Synthetic oligonucleotide
tgcccgcgctcctccccctcgtcgttcgtaggccc

SEQ ID NO: 71380 - DNA, 35 bp, Artificial Sequence
  Synthetic oligonucleotide
gtgaccccatctgggatattatttagcatgaagcc

SEQ ID NO: 71381 - DNA, 35 bp, Artificial Sequence
  Synthetic oligonucleotide
tgctcccgcccgttgcactgatgaccctgttcgcc

SEQ ID NO: 71382 - DNA, 35 bp, Artificial Sequence
  Synthetic oligonucleotide
gtgtctaaacgccgccctaacattcgtaggactcc

SEQ ID NO: 71383 - DNA, 35 bp, Artificial Sequence
  Synthetic oligonucleotide
ttgctacaggccatcgcgtactcgagatattctcc

SEQ ID NO: 71384 - DNA, 35 bp, Artificial Sequence
  Synthetic oligonucleotide
gacaccgagatagaacacccgacacataatgcagc

SEQ ID NO: 71385 - DNA, 35 bp, Artificial Sequence
  Synthetic oligonucleotide
tgcatatgcaatcggggtacttacatctctcacgc

SEQ ID NO: 71386 - DNA, 36 bp, Artificial Sequence
  Synthetic oligonucleotide
acgacacccaactctgatctccgttatgtaaaccgc

SEQ ID NO: 71387 - DNA, 34 bp, Artificial Sequence
  Synthetic oligonucleotide
ggtacccatccggccctcatagacacacggtcgc

SEQ ID NO: 71388 - DNA, 35 bp, Artificial Sequence
  Synthetic oligonucleotide
attgtcgacgccccccacccgtgggcattcaatgc

SEQ ID NO: 71389 - DNA, 35 bp, Artificial Sequence
  Synthetic oligonucleotide
aatcactgcagatattcatcgccctcccgtacatc

SEQ ID NO: 71390 - DNA, 35 bp, Artificial Sequence
  Synthetic oligonucleotide
ttagccgcaggttacagtttagtaatttaaccatc

SEQ ID NO: 71391 - DNA, 35 bp, Artificial Sequence
  Synthetic oligonucleotide
actcatctgggatcgccgctttcctatgacttatc

SEQ ID NO: 71392 - DNA, 35 bp, Artificial Sequence
  Synthetic oligonucleotide
atcactctcgacgtgcttgccttacatggaaactc

SEQ ID NO: 71393 - DNA, 35 bp, Artificial Sequence
  Synthetic oligonucleotide
gaccccgcactccccgcgtttagtggcgtttcctc

SEQ ID NO: 71394 - DNA, 35 bp, Artificial Sequence
  Synthetic oligonucleotide
tccccgccaagttcccctccgagcaacattggttc

SEQ ID NO: 71395 - DNA, 35 bp, Artificial Sequence
  Synthetic oligonucleotide
gtcccgccaccgtgctaccctcgcgcctgactttc

SEQ ID NO: 71396 - DNA, 35 bp, Artificial Sequence
  Synthetic oligonucleotide
ttcgcgcaccacccccattgtctctaatactaccg

SEQ ID NO: 71397 - DNA, 35 bp, Artificial Sequence
  Synthetic oligonucleotide
tactcccactgcggacacctatgatccgtttgtcg

SEQ ID NO: 71398 - DNA, 35 bp, Artificial Sequence
  Synthetic oligonucleotide
taggacgtcatccacgcaaatcccttatgtctggg

SEQ ID NO: 71399 - DNA, 35 bp, Artificial Sequence
  Synthetic oligonucleotide
tccaaagcctagcccgaccgccccttcgattagtg

SEQ ID NO: 71400 - DNA, 35 bp, Artificial Sequence
  Synthetic oligonucleotide
tcacaagcaatgcgcgcgtgagggtgtggtgggtg

SEQ ID NO: 71401 - DNA, 35 bp, Artificial Sequence
  Synthetic oligonucleotide
ttcgggaggttatctagggcaatgaagggctggtg

SEQ ID NO: 71402 - DNA, 35 bp, Artificial Sequence
  Synthetic oligonucleotide
atgccgattcacctgtatcctatacgctacgttat

SEQ ID NO: 71403 - DNA, 35 bp, Artificial Sequence
  Synthetic oligonucleotide
gatgagcgccaagttttatctaccgctttaccact

SEQ ID NO: 71404 - DNA, 35 bp, Artificial Sequence
  Synthetic oligonucleotide
acacggctccacagggggattctcgctctttcact

SEQ ID NO: 71405 - DNA, 35 bp, Artificial Sequence
  Synthetic oligonucleotide
acgaatggccacttcatgccattcggtgttaacct

SEQ ID NO: 71406 - DNA, 35 bp, Artificial Sequence
  Synthetic oligonucleotide
gcgagccgtatgcaacatgatcatgcctggaccct

SEQ ID NO: 71407 - DNA, 35 bp, Artificial Sequence
  Synthetic oligonucleotide
gcctcaccaactctataaaggcgctgttaatccct

SEQ ID NO: 71408 - DNA, 35 bp, Artificial Sequence
  Synthetic oligonucleotide
gcaagcccagccacatcgtaaaccacggggtccct

SEQ ID NO: 71409 - DNA, 35 bp, Artificial Sequence
  Synthetic oligonucleotide
gccaatggtcacgttggctcgtggtttcttttgct

SEQ ID NO: 71410 - DNA, 35 bp, Artificial Sequence
  Synthetic oligonucleotide
tccccatctgtgcacgtaagccttcgaattactct

SEQ ID NO: 71411 - DNA, 35 bp, Artificial Sequence
  Synthetic oligonucleotide
gcgaggtcccgatccccagcctatctgccacgtgt

SEQ ID NO: 71412 - DNA, 35 bp, Artificial Sequence
  Synthetic oligonucleotide
tccgcctattgcccagtttaaaacaatcaccttgt

SEQ ID NO: 71413 - DNA, 35 bp, Artificial Sequence
  Synthetic oligonucleotide
accaaagggaagtggtgcatttaaactgtaggatt

SEQ ID NO: 71414 - DNA, 36 bp, Artificial Sequence
  Synthetic oligonucleotide
gtcagtaggcacgctctacacgcacaccgagatctt

SEQ ID NO: 71415 - DNA, 35 bp, Artificial Sequence
  Synthetic oligonucleotide
tgagctctggctgaccactcaagtgccttctattt

SEQ ID NO: 71416 - DNA, 36 bp, Artificial Sequence
  Synthetic oligonucleotide
gtaggtcactgaggaagataggaaggagagtacaaa

SEQ ID NO: 71417 - DNA, 36 bp, Artificial Sequence
  Synthetic oligonucleotide
agaccagacccgggaacacgaagctcacagttcaaa

SEQ ID NO: 71418 - DNA, 36 bp, Artificial Sequence
  Synthetic oligonucleotide
aatactgcgcatatctaaccatgctcccccgggcaa

SEQ ID NO: 71419 - DNA, 35 bp, Artificial Sequence
  Synthetic oligonucleotide
taccttgcgcgctccacctagttatcaccgctcaa

SEQ ID NO: 71420 - DNA, 35 bp, Artificial Sequence
  Synthetic oligonucleotide
tcctcactcgcacacatcagggatgctccgctcaa

SEQ ID NO: 71421 - DNA, 36 bp, Artificial Sequence
  Synthetic oligonucleotide
agtgcgttccaccattattgtctcctccagtattaa

SEQ ID NO: 71422 - DNA, 36 bp, Artificial Sequence
  Synthetic oligonucleotide
gcagggcaatactgagggggggtgaggatgtaaaca

SEQ ID NO: 71423 - DNA, 36 bp, Artificial Sequence
  Synthetic oligonucleotide
gagttcaggtctatgaaaccctggcccacccgcaca

SEQ ID NO: 71424 - DNA, 36 bp, Artificial Sequence
  Synthetic oligonucleotide
tccccaccccgtgacgcttggacaatatcgaaacca

SEQ ID NO: 71425 - DNA, 36 bp, Artificial Sequence
  Synthetic oligonucleotide
ttcgatgcacgcccaattcgcaatacagtttcacca

SEQ ID NO: 71426 - DNA, 35 bp, Artificial Sequence
  Synthetic oligonucleotide
gccgacaccttgttttcagaatatccctactgcca

SEQ ID NO: 71427 - DNA, 35 bp, Artificial Sequence
  Synthetic oligonucleotide
gtgattctaccccgagcgccccgcggccatttgca

SEQ ID NO: 71428 - DNA, 35 bp, Artificial Sequence
  Synthetic oligonucleotide
aacaagcgtgcacaggtactccagctccgttttca

SEQ ID NO: 71429 - DNA, 37 bp, Artificial Sequence
  Synthetic oligonucleotide
acttccccagcctgctcccacattctgtcgacaaaga

SEQ ID NO: 71430 - DNA, 35 bp, Artificial Sequence
  Synthetic oligonucleotide
gccagagccttacccacgcgcttttgccctacaga

SEQ ID NO: 71431 - DNA, 36 bp, Artificial Sequence
  Synthetic oligonucleotide
atcgcggcataggaaggttaagggtttgcggggaga

SEQ ID NO: 71432 - DNA, 35 bp, Artificial Sequence
  Synthetic oligonucleotide
gaacgcggggggcgttggagggggggccgaataga

SEQ ID NO: 71433 - DNA, 37 bp, Artificial Sequence
  Synthetic oligonucleotide
acagggtggggatgagtctgatgggtggggatgtaga

SEQ ID NO: 71434 - DNA, 37 bp, Artificial Sequence
  Synthetic oligonucleotide
aaagaaccgcctctcataataacacactgttctacga

SEQ ID NO: 71435 - DNA, 35 bp, Artificial Sequence
  Synthetic oligonucleotide
gcgcgcgtacgccctctgctttcttgggtcatcga

SEQ ID NO: 71436 - DNA, 37 bp, Artificial Sequence
  Synthetic oligonucleotide
acagtcacacttctaggctccgttgaccgcccttcga

SEQ ID NO: 71437 - DNA, 36 bp, Artificial Sequence
  Synthetic oligonucleotide
taacacaggcgacggggaggttgcggttggcaagga

SEQ ID NO: 71438 - DNA, 37 bp, Artificial Sequence
  Synthetic oligonucleotide
gacaactgaaagggattgcgggacgggtggggaggga

SEQ ID NO: 71439 - DNA, 37 bp, Artificial Sequence
  Synthetic oligonucleotide
accccccggcattacggttttttctgttcttgtggga

SEQ ID NO: 71440 - DNA, 37 bp, Artificial Sequence
  Synthetic oligonucleotide
gacctatgtaggggggggagggaaagaccggggtgga

SEQ ID NO: 71441 - DNA, 38 bp, Artificial Sequence
  Synthetic oligonucleotide
acctcgcctaacacatgaatcgtagccatccgaaatga

SEQ ID NO: 71442 - DNA, 37 bp, Artificial Sequence
  Synthetic oligonucleotide
agccagatcgttcaccttgcttcccttcaccgaatga

SEQ ID NO: 71443 - DNA, 38 bp, Artificial Sequence
  Synthetic oligonucleotide
gccatacgcctatattattctctttcggcagtccatga

SEQ ID NO: 71444 - DNA, 37 bp, Artificial Sequence
  Synthetic oligonucleotide
tcatgcactgtgaggaatagtggagtgctcagcatga

SEQ ID NO: 71445 - DNA, 37 bp, Artificial Sequence
  Synthetic oligonucleotide
ttatcaacacctggttacaagatccatccaccgatga

SEQ ID NO: 71446 - DNA, 38 bp, Artificial Sequence
  Synthetic oligonucleotide
tgggaaagggatgaagcggtaactgcgggtggggatga

SEQ ID NO: 71447 - DNA, 37 bp, Artificial Sequence
  Synthetic oligonucleotide
actggctcgccactctcctgccacattcgcccactga

SEQ ID NO: 71448 - DNA, 38 bp, Artificial Sequence
  Synthetic oligonucleotide
aagacacaccccggccgtgaagtacactttgcacctga

SEQ ID NO: 71449 - DNA, 38 bp, Artificial Sequence
  Synthetic oligonucleotide
tgtcaattatgcgtctgcctgtttgctcctccccctga

SEQ ID NO: 71450 - DNA, 38 bp, Artificial Sequence
  Synthetic oligonucleotide
gtaccaacgccccggaccatccagtctactcggtctga

SEQ ID NO: 71451 - DNA, 38 bp, Artificial Sequence
  Synthetic oligonucleotide
tcaccgccgcgcttgctggtgaactatccttattctga

SEQ ID NO: 71452 - DNA, 38 bp, Artificial Sequence
  Synthetic oligonucleotide
acccggaccctcacggctgtgtacattctccgttctga

SEQ ID NO: 71453 - DNA, 37 bp, Artificial Sequence
  Synthetic oligonucleotide
taggtcgcaccaccaccccgtaaaatgaaacgagtga

SEQ ID NO: 71454 - DNA, 38 bp, Artificial Sequence
  Synthetic oligonucleotide
tgtgggaaggagggggtgacgccaggtgaggctagtga

SEQ ID NO: 71455 - DNA, 37 bp, Artificial Sequence
  Synthetic oligonucleotide
accgtagtccgcaactgccttctcgttacatgcgtga

SEQ ID NO: 71456 - DNA, 38 bp, Artificial Sequence
  Synthetic oligonucleotide
gatgtgtccccctcttttcacccccggtcagtatgtga

SEQ ID NO: 71457 - DNA, 35 bp, Artificial Sequence
  Synthetic oligonucleotide
ggaacgatggagggtgggggtgccggcatgtgtga

SEQ ID NO: 71458 - DNA, 38 bp, Artificial Sequence
  Synthetic oligonucleotide
atgagcgaggggagagaacgacagggatttggaattga

SEQ ID NO: 71459 - DNA, 38 bp, Artificial Sequence
  Synthetic oligonucleotide
tctgcgacccacccataccagtcagccgccgccattga

SEQ ID NO: 71460 - DNA, 36 bp, Artificial Sequence
  Synthetic oligonucleotide
gctctggcccagctcacttaatccggaccaccttga

SEQ ID NO: 71461 - DNA, 37 bp, Artificial Sequence
  Synthetic oligonucleotide
aagtgccctcccgtcccgctgtgaaggccccccttga

SEQ ID NO: 71462 - DNA, 38 bp, Artificial Sequence
  Synthetic oligonucleotide
ttgatggtgcagtcagttcgatcgggctgggctgttga

SEQ ID NO: 71463 - DNA, 38 bp, Artificial Sequence
  Synthetic oligonucleotide
tgtctggccgtctgaccgctcacccccattccctttga

SEQ ID NO: 71464 - DNA, 36 bp, Artificial Sequence
  Synthetic oligonucleotide
acctgggcacgtaagtaggagggtgggggatgcata

SEQ ID NO: 71465 - DNA, 35 bp, Artificial Sequence
  Synthetic oligonucleotide
gtgatcctggccgggagcctactcatgctttacta

SEQ ID NO: 71466 - DNA, 36 bp, Artificial Sequence
  Synthetic oligonucleotide
acatttcgctgtcagtgttccatttcgatctcccta

SEQ ID NO: 71467 - DNA, 36 bp, Artificial Sequence
  Synthetic oligonucleotide
ttcaatgcaggtggcggagaagccggggggggagta

SEQ ID NO: 71468 - DNA, 36 bp, Artificial Sequence
  Synthetic oligonucleotide
gaagatgagggggcgaaaggggcgaataaataggta

SEQ ID NO: 71469 - DNA, 38 bp, Artificial Sequence
  Synthetic oligonucleotide
ttaaccactcctcctacgtgtaacggtgggccccgtta

SEQ ID NO: 71470 - DNA, 35 bp, Artificial Sequence
  Synthetic oligonucleotide
agaacatcaactcaatcgtgcctattggcctgtta

SEQ ID NO: 71471 - DNA, 35 bp, Artificial Sequence
  Synthetic oligonucleotide
ttcgccctctacagacatgaagtctctctggttta

SEQ ID NO: 71472 - DNA, 35 bp, Artificial Sequence
  Synthetic oligonucleotide
gaagacgtacaccccagtatctatcccgtcgtgac

SEQ ID NO: 71473 - DNA, 35 bp, Artificial Sequence
  Synthetic oligonucleotide
gtgccatgtaagcacatgtcatacgaccctcgtac

SEQ ID NO: 71474 - DNA, 35 bp, Artificial Sequence
  Synthetic oligonucleotide
accacggttgtcgacgcttagccgcccgcgtaacc

SEQ ID NO: 71475 - DNA, 36 bp, Artificial Sequence
  Synthetic oligonucleotide
tgacacgggcctcgagatcacgtacctactcctacc

SEQ ID NO: 71476 - DNA, 35 bp, Artificial Sequence
  Synthetic oligonucleotide
gatgaccagtctgtgatacacccctgcttttcccc

SEQ ID NO: 71477 - DNA, 35 bp, Artificial Sequence
  Synthetic oligonucleotide
tcacctctcccgtatagcccgcattaagcttgccc

SEQ ID NO: 71478 - DNA, 35 bp, Artificial Sequence
  Synthetic oligonucleotide
aaacacctctacacctggccgcacatggcgcatcc

SEQ ID NO: 71479 - DNA, 35 bp, Artificial Sequence
  Synthetic oligonucleotide
taacgtccacatctggttccgtcctcctgcagagc

SEQ ID NO: 71480 - DNA, 35 bp, Artificial Sequence
  Synthetic oligonucleotide
acacattcctccgcacatggccgcactaatggagc

SEQ ID NO: 71481 - DNA, 35 bp, Artificial Sequence
  Synthetic oligonucleotide
tcaccacccgtactaccaacgccgcgctaaacggc

SEQ ID NO: 71482 - DNA, 35 bp, Artificial Sequence
  Synthetic oligonucleotide
taccctgttcacacgttccccagttcgtcttctgc

SEQ ID NO: 71483 - DNA, 35 bp, Artificial Sequence
  Synthetic oligonucleotide
ttgccaatccttggcaatggggctcttatcctgtc

SEQ ID NO: 71484 - DNA, 35 bp, Artificial Sequence
  Synthetic oligonucleotide
tcccaccgcggggcccgtccgacgctcccgggttc

SEQ ID NO: 71485 - DNA, 35 bp, Artificial Sequence
  Synthetic oligonucleotide
acccgttggaccgttaaagcgcttcgctcttgttc

SEQ ID NO: 71486 - DNA, 35 bp, Artificial Sequence
  Synthetic oligonucleotide
tcgctcaccgggatcagcccctaccaacaactttc

SEQ ID NO: 71487 - DNA, 35 bp, Artificial Sequence
  Synthetic oligonucleotide
gataacaagctagagcgcttaatagccactttttc

SEQ ID NO: 71488 - DNA, 35 bp, Artificial Sequence
  Synthetic oligonucleotide
acagctcaggtccacacctcgatatatttttcaag

SEQ ID NO: 71489 - DNA, 35 bp, Artificial Sequence
  Synthetic oligonucleotide
ccagatgcccattctcgcgacgctaaaacattcag

SEQ ID NO: 71490 - DNA, 35 bp, Artificial Sequence
  Synthetic oligonucleotide
gcctccagggtagagcgagggggagaggggaggag

SEQ ID NO: 71491 - DNA, 35 bp, Artificial Sequence
  Synthetic oligonucleotide
ggatgcgggcgaagtgtgcgatggggggataatag

SEQ ID NO: 71492 - DNA, 35 bp, Artificial Sequence
  Synthetic oligonucleotide
aaccttgccatcacgggaactgctttaagcaaccg

SEQ ID NO: 71493 - DNA, 35 bp, Artificial Sequence
  Synthetic oligonucleotide
tagcaacccacataccatcctttcacatagcttcg

SEQ ID NO: 71494 - DNA, 35 bp, Artificial Sequence
  Synthetic oligonucleotide
acctcgcgttggcaatttaacccccgtgcctttcg

SEQ ID NO: 71495 - DNA, 35 bp, Artificial Sequence
  Synthetic oligonucleotide
gtatcgctcccgcctcctgtttagtagttgtccgg

SEQ ID NO: 71496 - DNA, 35 bp, Artificial Sequence
  Synthetic oligonucleotide
ttgtcgcgtagcaaagaatcaactgtctcgcctgg

SEQ ID NO: 71497 - DNA, 35 bp, Artificial Sequence
  Synthetic oligonucleotide
aggacgagaagaaggggatgttacacgggggaatg

SEQ ID NO: 71498 - DNA, 35 bp, Artificial Sequence
  Synthetic oligonucleotide
tgtgcgaagcctgtatgtaggagggggtgaatatg

SEQ ID NO: 71499 - DNA, 35 bp, Artificial Sequence
  Synthetic oligonucleotide
ggggtgacgggtagcgggccccactgtaattccat

SEQ ID NO: 71500 - DNA, 35 bp, Artificial Sequence
  Synthetic oligonucleotide
tcactcgacgtacatgccccttactcatggctcat

SEQ ID NO: 71501 - DNA, 35 bp, Artificial Sequence
  Synthetic oligonucleotide
aattctggggagggggtggaagggcagtactagat

SEQ ID NO: 71502 - DNA, 35 bp, Artificial Sequence
  Synthetic oligonucleotide
atgcccggccacctactttgatccagccacacgat

SEQ ID NO: 71503 - DNA, 35 bp, Artificial Sequence
  Synthetic oligonucleotide
acacaacacgatctccttgcgccgtcttcgacgat

SEQ ID NO: 71504 - DNA, 35 bp, Artificial Sequence
  Synthetic oligonucleotide
tcaccaccgcaacccccggaactgtaatttaccct

SEQ ID NO: 71505 - DNA, 35 bp, Artificial Sequence
  Synthetic oligonucleotide
tcattgtgcctgttgtgcaccggttattattctct

SEQ ID NO: 71506 - DNA, 35 bp, Artificial Sequence
  Synthetic oligonucleotide
tcaggccccctcacccagcttcctagtgacggtct

SEQ ID NO: 71507 - DNA, 35 bp, Artificial Sequence
  Synthetic oligonucleotide
acgatgctgcgtatggcctctttagtcttctccgt

SEQ ID NO: 71508 - DNA, 35 bp, Artificial Sequence
  Synthetic oligonucleotide
gtaaaggtcatataccctgcccccaccgtacctgt

SEQ ID NO: 71509 - DNA, 36 bp, Artificial Sequence
  Synthetic oligonucleotide
agttacatcattgagctctttgtgccctctactctt

SEQ ID NO: 71510 - DNA, 35 bp, Artificial Sequence
  Synthetic oligonucleotide
atatgctgtacccgttcgacgtccccaagcaagtt

SEQ ID NO: 71511 - DNA, 35 bp, Artificial Sequence
  Synthetic oligonucleotide
tcctgcatctgctctatcgattacgaagttgccaa

SEQ ID NO: 71512 - DNA, 36 bp, Artificial Sequence
  Synthetic oligonucleotide
actgcccctcacaatttgagcctcttctcccaagaa

SEQ ID NO: 71513 - DNA, 36 bp, Artificial Sequence
  Synthetic oligonucleotide
ggatgtacgacggggggaaaacacgtttggcaggaa

SEQ ID NO: 71514 - DNA, 35 bp, Artificial Sequence
  Synthetic oligonucleotide
tcattccccgccaccgatatgatcagccatgttaa

SEQ ID NO: 71515 - DNA, 36 bp, Artificial Sequence
  Synthetic oligonucleotide
tccacgggcctaccagggcattagaaatagcacaca

SEQ ID NO: 71516 - DNA, 35 bp, Artificial Sequence
  Synthetic oligonucleotide
gatcatgcctacttgtttggcgtggctctaaccca

SEQ ID NO: 71517 - DNA, 36 bp, Artificial Sequence
  Synthetic oligonucleotide
acacgtgcgagcacgacccaaatataccttcgccca

SEQ ID NO: 71518 - DNA, 37 bp, Artificial Sequence
  Synthetic oligonucleotide
gtcaacgtacgcaatgtcatcggcttcgcagggccca

SEQ ID NO: 71519 - DNA, 36 bp, Artificial Sequence
  Synthetic oligonucleotide
tatgcgagcaatgtgtcccgctgatttacaccgcca

SEQ ID NO: 71520 - DNA, 35 bp, Artificial Sequence
  Synthetic oligonucleotide
gtccgttcccgtctgctcttgattaaacccattca

SEQ ID NO: 71521 - DNA, 35 bp, Artificial Sequence
  Synthetic oligonucleotide
ggtcgactcccaattttttgttctgtggctgttca

SEQ ID NO: 71522 - DNA, 35 bp, Artificial Sequence
  Synthetic oligonucleotide
tagccagatagtgctgccttaggggggggatttca

SEQ ID NO: 71523 - DNA, 36 bp, Artificial Sequence
  Synthetic oligonucleotide
acccatggcgtttcagtctttaggttttgcttttca

SEQ ID NO: 71524 - DNA, 36 bp, Artificial Sequence
  Synthetic oligonucleotide
atccaacgcacgcccccatgcattctatcgcagaga

SEQ ID NO: 71525 - DNA, 37 bp, Artificial Sequence
  Synthetic oligonucleotide
actctcaccgcatagaccagccacatactccaggaga

SEQ ID NO: 71526 - DNA, 35 bp, Artificial Sequence
  Synthetic oligonucleotide
tagggtgggcggaaaggaggagaaccgggccacga

SEQ ID NO: 71527 - DNA, 37 bp, Artificial Sequence
  Synthetic oligonucleotide
acttcactcacatgacagccaacgcctgacctcacga

SEQ ID NO: 71528 - DNA, 37 bp, Artificial Sequence
  Synthetic oligonucleotide
gcatgggagggaggagagacactctggtggacatcga

SEQ ID NO: 71529 - DNA, 37 bp, Artificial Sequence
  Synthetic oligonucleotide
gcgacctctagtgatcatatcgcactctccccctcga

SEQ ID NO: 71530 - DNA, 37 bp, Artificial Sequence
  Synthetic oligonucleotide
tgcgaaggtctgaatatttttaatgcctctttctcga

SEQ ID NO: 71531 - DNA, 37 bp, Artificial Sequence
  Synthetic oligonucleotide
tatccagcgcacggaattattgattatcctgcttcga

SEQ ID NO: 71532 - DNA, 37 bp, Artificial Sequence
  Synthetic oligonucleotide
atccctcgcacgaacgcctcataattccctgcccgga

SEQ ID NO: 71533 - DNA, 37 bp, Artificial Sequence
  Synthetic oligonucleotide
acacgtagggaagtggaggtgaaacgtggcatccgga

SEQ ID NO: 71534 - DNA, 37 bp, Artificial Sequence
  Synthetic oligonucleotide
gaacgcagacatcgtacgctccgctcctgttatcgga

SEQ ID NO: 71535 - DNA, 37 bp, Artificial Sequence
  Synthetic oligonucleotide
tgaggacccgaatctgtggggcttgtgagggagggga

SEQ ID NO: 71536 - DNA, 37 bp, Artificial Sequence
  Synthetic oligonucleotide
tgagacagccagcgggaggggtgactggcgaatggga

SEQ ID NO: 71537 - DNA, 36 bp, Artificial Sequence
  Synthetic oligonucleotide
gggggatagcctgaggggaggatgagggggtctgga

SEQ ID NO: 71538 - DNA, 37 bp, Artificial Sequence
  Synthetic oligonucleotide
ggatcagcctcatcagattacaccctaccttgcatga

SEQ ID NO: 71539 - DNA, 38 bp, Artificial Sequence
  Synthetic oligonucleotide
gaaagggggcacacgacgcatagggggtaaaaggatga

SEQ ID NO: 71540 - DNA, 38 bp, Artificial Sequence
  Synthetic oligonucleotide
ttgcgcccacgttcattctgatgaagccacatcactga

SEQ ID NO: 71541 - DNA, 38 bp, Artificial Sequence
  Synthetic oligonucleotide
gacgtgtaagcacccctctgtcaactattcctgcctga

SEQ ID NO: 71542 - DNA, 37 bp, Artificial Sequence
  Synthetic oligonucleotide
tcccgatcaggtccttggcgtcctcacattctcctga

SEQ ID NO: 71543 - DNA, 37 bp, Artificial Sequence
  Synthetic oligonucleotide
gcccccctctgtccgcagtttcgtttccttgtcctga

SEQ ID NO: 71544 - DNA, 38 bp, Artificial Sequence
  Synthetic oligonucleotide
gtcccagcctgcggatactcctctgcttcctttcctga

SEQ ID NO: 71545 - DNA, 38 bp, Artificial Sequence
  Synthetic oligonucleotide
gtgagggcgaggacggaagaaaggaaacgtagcgctga

SEQ ID NO: 71546 - DNA, 36 bp, Artificial Sequence
  Synthetic oligonucleotide
gtcagaaatcggggggagagaaggtttgcgggctga

SEQ ID NO: 71547 - DNA, 38 bp, Artificial Sequence
  Synthetic oligonucleotide
tccgggtgggaaagggggtggactaaggtgtatgctga

SEQ ID NO: 71548 - DNA, 38 bp, Artificial Sequence
  Synthetic oligonucleotide
acaagtggggcggaacgaggggtggtacttggaagtga

SEQ ID NO: 71549 - DNA, 38 bp, Artificial Sequence
  Synthetic oligonucleotide
gatcgatcaccatgttccatacctgacactgtcagtga

SEQ ID NO: 71550 - DNA, 38 bp, Artificial Sequence
  Synthetic oligonucleotide
gtgggaatagaccaggagtatgggggaggctagagtga

SEQ ID NO: 71551 - DNA, 35 bp, Artificial Sequence
  Synthetic oligonucleotide
gctgccgaatctctggcgtacctaccatcacgtga

SEQ ID NO: 71552 - DNA, 38 bp, Artificial Sequence
  Synthetic oligonucleotide
ggaccaggcggagagagaaagtggtacaaaagtggtga

SEQ ID NO: 71553 - DNA, 37 bp, Artificial Sequence
  Synthetic oligonucleotide
tcacaccgcaagtgttgcgattatttccccgcattga

SEQ ID NO: 71554 - DNA, 36 bp, Artificial Sequence
  Synthetic oligonucleotide
tgaaccggacagccataaaacaagcccggtcattga

SEQ ID NO: 71555 - DNA, 38 bp, Artificial Sequence
  Synthetic oligonucleotide
gccaagcgcggaaatcactaagcacccaccgaccttga

SEQ ID NO: 71556 - DNA, 37 bp, Artificial Sequence
  Synthetic oligonucleotide
tcacaccgccgcccctttgacactacattagccttga

SEQ ID NO: 71557 - DNA, 38 bp, Artificial Sequence
  Synthetic oligonucleotide
ttggttgccacgcgctgctacaatcattttcatcttga

SEQ ID NO: 71558 - DNA, 38 bp, Artificial Sequence
  Synthetic oligonucleotide
ttctccacctctgaattgaccatgaacctgctcgttga

SEQ ID NO: 71559 - DNA, 38 bp, Artificial Sequence
  Synthetic oligonucleotide
ttgctccggcaaacgctataggtggttgttggtgttga

SEQ ID NO: 71560 - DNA, 38 bp, Artificial Sequence
  Synthetic oligonucleotide
ttgttgagcccggtgcagctatgacacttgccctttga

SEQ ID NO: 71561 - DNA, 36 bp, Artificial Sequence
  Synthetic oligonucleotide
gccaccgcacgcaaacgtcaaacacctcaacgcata

SEQ ID NO: 71562 - DNA, 36 bp, Artificial Sequence
  Synthetic oligonucleotide
agaaggttgtggacggtggttcgaagggaggtcata

SEQ ID NO: 71563 - DNA, 36 bp, Artificial Sequence
  Synthetic oligonucleotide
gctgacgcgcactgtgctccttcgcgtgtgaaacta

SEQ ID NO: 71564 - DNA, 36 bp, Artificial Sequence
  Synthetic oligonucleotide
ttacgccccttccctagtatctgtcgagcccaccta

SEQ ID NO: 71565 - DNA, 36 bp, Artificial Sequence
  Synthetic oligonucleotide
ttacccgggaaatggacggtcggaacaggggagcta

SEQ ID NO: 71566 - DNA, 36 bp, Artificial Sequence
  Synthetic oligonucleotide
gcccccgatgaccgactcctattgttctatatgcta

SEQ ID NO: 71567 - DNA, 36 bp, Artificial Sequence
  Synthetic oligonucleotide
gaacacgtcccaggcctctcacattaagcagtcgta

SEQ ID NO: 71568 - DNA, 36 bp, Artificial Sequence
  Synthetic oligonucleotide
ggagtccactggtcatggcgccctccactttcttta

SEQ ID NO: 71569 - DNA, 35 bp, Artificial Sequence
  Synthetic oligonucleotide
gtacaattgcagccgagtttctggccctgtgaaac

SEQ ID NO: 71570 - DNA, 36 bp, Artificial Sequence
  Synthetic oligonucleotide
gcacgcggtccctgggcttactgattgccgctccac

SEQ ID NO: 71571 - DNA, 35 bp, Artificial Sequence
  Synthetic oligonucleotide
ttggagccgctcgcatgctggactttgcgcttcac

SEQ ID NO: 71572 - DNA, 35 bp, Artificial Sequence
  Synthetic oligonucleotide
gacagacagtcgtccctgcccaccaagccccgtac

SEQ ID NO: 71573 - DNA, 34 bp, Artificial Sequence
  Synthetic oligonucleotide
aacacccgtagggtcttacttgcggagcaagacc

SEQ ID NO: 71574 - DNA, 35 bp, Artificial Sequence
  Synthetic oligonucleotide
gacgagcaagcatcctatcctgcgtacctgtgacc

SEQ ID NO: 71575 - DNA, 35 bp, Artificial Sequence
  Synthetic oligonucleotide
ttgattgtcccaacgctcccatctaagggcgggcc

SEQ ID NO: 71576 - DNA, 35 bp, Artificial Sequence
  Synthetic oligonucleotide
acgccccccttacgtgctccccccgagctcctgcc

SEQ ID NO: 71577 - DNA, 35 bp, Artificial Sequence
  Synthetic oligonucleotide
taacccgcccaacctgaggtttaaacaaggagtcc

SEQ ID NO: 71578 - DNA, 35 bp, Artificial Sequence
  Synthetic oligonucleotide
acctcgctaaacatctgccggtttcaggaccgagc

SEQ ID NO: 71579 - DNA, 35 bp, Artificial Sequence
  Synthetic oligonucleotide
tcacgaacgaatgcacaagtgtccgcacatttggc

SEQ ID NO: 71580 - DNA, 35 bp, Artificial Sequence
  Synthetic oligonucleotide
agacactacccttccattagttagtgcacccctgc

SEQ ID NO: 71581 - DNA, 35 bp, Artificial Sequence
  Synthetic oligonucleotide
tcaaagagagcctgctcgacttgtttctccccatc

SEQ ID NO: 71582 - DNA, 35 bp, Artificial Sequence
  Synthetic oligonucleotide
atgtgtcaccactgctctatctcagacaaactatc

SEQ ID NO: 71583 - DNA, 35 bp, Artificial Sequence
  Synthetic oligonucleotide
attgcaccttagccacaaagtatgggatgtccttc

SEQ ID NO: 71584 - DNA, 35 bp, Artificial Sequence
  Synthetic oligonucleotide
atccaggcaggccgcaccgtacacactactaccag

SEQ ID NO: 71585 - DNA, 35 bp, Artificial Sequence
  Synthetic oligonucleotide
tctggcaaggctacaccacactacctgttactccg

SEQ ID NO: 71586 - DNA, 35 bp, Artificial Sequence
  Synthetic oligonucleotide
aatgcatctggcaccctctgccgtgttcaacttcg

SEQ ID NO: 71587 - DNA, 35 bp, Artificial Sequence
  Synthetic oligonucleotide
tactgtccatactcctcatgtccgcagtgatgcgg

SEQ ID NO: 71588 - DNA, 35 bp, Artificial Sequence
  Synthetic oligonucleotide
tggaggggtgggcgggtcgcatgggcataataggg

SEQ ID NO: 71589 - DNA, 35 bp, Artificial Sequence
  Synthetic oligonucleotide
gccccactacgcgcgataacgtttagcactagctg

SEQ ID NO: 71590 - DNA, 35 bp, Artificial Sequence
  Synthetic oligonucleotide
acacgactcggttgtaatgtgtctttgggcactat

SEQ ID NO: 71591 - DNA, 35 bp, Artificial Sequence
  Synthetic oligonucleotide
tgtggcgaacatccggtttgcatgctttttactat

SEQ ID NO: 71592 - DNA, 35 bp, Artificial Sequence
  Synthetic oligonucleotide
aacgttgcccacgggttgataccagttgttgccct

SEQ ID NO: 71593 - DNA, 35 bp, Artificial Sequence
  Synthetic oligonucleotide
tgcagcaattgttctgcactaaacacactccgcct

SEQ ID NO: 71594 - DNA, 35 bp, Artificial Sequence
  Synthetic oligonucleotide
attgagtcgcagacttttccatctcctgtggttct

SEQ ID NO: 71595 - DNA, 35 bp, Artificial Sequence
  Synthetic oligonucleotide
aatgcgttgggcctctttcatgtgcgtaccctatt

SEQ ID NO: 71596 - DNA, 35 bp, Artificial Sequence
  Synthetic oligonucleotide
tgcaaagttccgtccccgttcagccacacacactt

SEQ ID NO: 71597 - DNA, 35 bp, Artificial Sequence
  Synthetic oligonucleotide
tttgcggtagacaaacttgattttagctgtctctt

SEQ ID NO: 71598 - DNA, 35 bp, Artificial Sequence
  Synthetic oligonucleotide
acgaccacgttgtcggttcggacaacattctcgtt

SEQ ID NO: 71599 - DNA, 35 bp, Artificial Sequence
  Synthetic oligonucleotide
tagccgagagaggagatgtggcggggcgtggggtt

SEQ ID NO: 71600 - DNA, 35 bp, Artificial Sequence
  Synthetic oligonucleotide
taccaagggtgggcggtgatgggatcgtaacattt

SEQ ID NO: 71601 - DNA, 36 bp, Artificial Sequence
  Synthetic oligonucleotide
gccgtctgcacgcccacgtcccttccaatggagaaa

SEQ ID NO: 71602 - DNA, 36 bp, Artificial Sequence
  Synthetic oligonucleotide
gtgcgatgccgccctctctgtatgcgtgttcgtaaa

SEQ ID NO: 71603 - DNA, 35 bp, Artificial Sequence
  Synthetic oligonucleotide
tagcacctcacatgtatcgtcaactgccccgccaa

SEQ ID NO: 71604 - DNA, 36 bp, Artificial Sequence
  Synthetic oligonucleotide
attgaagtggccgatggatggggaacgcggaacgaa

SEQ ID NO: 71605 - DNA, 35 bp, Artificial Sequence
  Synthetic oligonucleotide
agtgcgcggacaccgcctggatctccacctccgaa

SEQ ID NO: 71606 - DNA, 36 bp, Artificial Sequence
  Synthetic oligonucleotide
gtgccggggaaaaaacaaagtagggaagcatttgaa

SEQ ID NO: 71607 - DNA, 36 bp, Artificial Sequence
  Synthetic oligonucleotide
agtacggggggggtgaagagtgggggccaggggtaa

SEQ ID NO: 71608 - DNA, 35 bp, Artificial Sequence
  Synthetic oligonucleotide
gtcgaatcatctctaaagctcgcactggtgaaaca

SEQ ID NO: 71609 - DNA, 36 bp, Artificial Sequence
  Synthetic oligonucleotide
tgccacctgtgtgcacttcgctcgtctcattaaaca

SEQ ID NO: 71610 - DNA, 36 bp, Artificial Sequence
  Synthetic oligonucleotide
ttggcacatcggtttgtcttgatctcccttctaaca

SEQ ID NO: 71611 - DNA, 36 bp, Artificial Sequence
  Synthetic oligonucleotide
agacgacatagggagaggaagggcacagggttaaca

SEQ ID NO: 71612 - DNA, 35 bp, Artificial Sequence
  Synthetic oligonucleotide
aggagttggaagcaagaaaaaaaaagtacgataca

SEQ ID NO: 71613 - DNA, 36 bp, Artificial Sequence
  Synthetic oligonucleotide
aacaggtgactcctcgtctgctagatcttactacca

SEQ ID NO: 71614 - DNA, 36 bp, Artificial Sequence
  Synthetic oligonucleotide
gtacgaccgcacagcaaactctgacctggcttccca

SEQ ID NO: 71615 - DNA, 36 bp, Artificial Sequence
  Synthetic oligonucleotide
tagtaagcgcggttacgccctcctaggcccaggcca

SEQ ID NO: 71616 - DNA, 36 bp, Artificial Sequence
  Synthetic oligonucleotide
acgacccgcccgaactctctcaaggatgtgcacgca

SEQ ID NO: 71617 - DNA, 34 bp, Artificial Sequence
  Synthetic oligonucleotide
gatggtgaaacgcaagggtatggcatggagggca

SEQ ID NO: 71618 - DNA, 35 bp, Artificial Sequence
  Synthetic oligonucleotide
gtgtaaaggcgcatctggccagcccctttccctca

SEQ ID NO: 71619 - DNA, 36 bp, Artificial Sequence
  Synthetic oligonucleotide
gacacatcggtgaaaccagagtgtaacttttcctca

SEQ ID NO: 71620 - DNA, 36 bp, Artificial Sequence
  Synthetic oligonucleotide
gccaatgctaagggagtcaggcaggaggcaaattca

SEQ ID NO: 71621 - DNA, 36 bp, Artificial Sequence
  Synthetic oligonucleotide
gtgtcactgcgttaattcatcggacccttgctttca

SEQ ID NO: 71622 - DNA, 37 bp, Artificial Sequence
  Synthetic oligonucleotide
gacactgcgggcggtagggggagcagggtggtataga

SEQ ID NO: 71623 - DNA, 37 bp, Artificial Sequence
  Synthetic oligonucleotide
tgacccggcacccgcgttttcccaggcactgactaga

SEQ ID NO: 71624 - DNA, 37 bp, Artificial Sequence
  Synthetic oligonucleotide
gctgcctcccatcattgcgtcgaactgtcggcgtaga

SEQ ID NO: 71625 - DNA, 37 bp, Artificial Sequence
  Synthetic oligonucleotide
actgcggagcctaactgcatcttcaccagtcgttaga

SEQ ID NO: 71626 - DNA, 37 bp, Artificial Sequence
  Synthetic oligonucleotide
tacgcccggctcctgcgtttgttgtccctgattccga

SEQ ID NO: 71627 - DNA, 37 bp, Artificial Sequence
  Synthetic oligonucleotide
gctctgccccgcctcatattagttgctattacagcga

SEQ ID NO: 71628 - DNA, 35 bp, Artificial Sequence
  Synthetic oligonucleotide
gactacatcaggctccggactcgtacctccctcga

SEQ ID NO: 71629 - DNA, 37 bp, Artificial Sequence
  Synthetic oligonucleotide
gacgcccccttcctacatcgagtgactatggtacgga

SEQ ID NO: 71630 - DNA, 37 bp, Artificial Sequence
  Synthetic oligonucleotide
ggggtacggtcaataccaatggagggggggaacggga

SEQ ID NO: 71631 - DNA, 37 bp, Artificial Sequence
  Synthetic oligonucleotide
tcaagccgagggttcaaatgggagtgtagcattggga

SEQ ID NO: 71632 - DNA, 37 bp, Artificial Sequence
  Synthetic oligonucleotide
ggttaaggggccgcagggaacgggtgacatggatgga

SEQ ID NO: 71633 - DNA, 37 bp, Artificial Sequence
  Synthetic oligonucleotide
gacacgggcactgacacacagcttctcccaccgtgga

SEQ ID NO: 71634 - DNA, 37 bp, Artificial Sequence
  Synthetic oligonucleotide
ttttgcgcggatttcgcttacacctgctcccttatga

SEQ ID NO: 71635 - DNA, 38 bp, Artificial Sequence
  Synthetic oligonucleotide
tactccaaccaccgctgttccgtccatttaggtactga

SEQ ID NO: 71636 - DNA, 38 bp, Artificial Sequence
  Synthetic oligonucleotide
acgacactcccaactctcgacactctccgttcacctga

SEQ ID NO: 71637 - DNA, 38 bp, Artificial Sequence
  Synthetic oligonucleotide
atgtccacccgctccccactaatacggtgttcccctga

SEQ ID NO: 71638 - DNA, 36 bp, Artificial Sequence
  Synthetic oligonucleotide
tgcattgctgcctactatctttgattgacctcctga

SEQ ID NO: 71639 - DNA, 36 bp, Artificial Sequence
  Synthetic oligonucleotide
tcagcaagtgctcaagtaagggggagaagctgctga

SEQ ID NO: 71640 - DNA, 38 bp, Artificial Sequence
  Synthetic oligonucleotide
gtactggaggaggtaagtgggtggggtcgaattgctga

SEQ ID NO: 71641 - DNA, 38 bp, Artificial Sequence
  Synthetic oligonucleotide
tctgtgctctcgtcctcgcgccgcccccctgttgctga

SEQ ID NO: 71642 - DNA, 38 bp, Artificial Sequence
  Synthetic oligonucleotide
acgcgtaccgctctttcttgtcgagcctgtgactctga

SEQ ID NO: 71643 - DNA, 38 bp, Artificial Sequence
  Synthetic oligonucleotide
tgaatcgcaggtgcaatccgaacctccctaccttctga

SEQ ID NO: 71644 - DNA, 38 bp, Artificial Sequence
  Synthetic oligonucleotide
ggaagagacaggaaggaacaggtgagagacgtaagtga

SEQ ID NO: 71645 - DNA, 36 bp, Artificial Sequence
  Synthetic oligonucleotide
tgacgaccttctgttaccactctgctccagccgtga

SEQ ID NO: 71646 - DNA, 38 bp, Artificial Sequence
  Synthetic oligonucleotide
agcacggacatgaggccataatttaaacgtaacggtga

SEQ ID NO: 71647 - DNA, 38 bp, Artificial Sequence
  Synthetic oligonucleotide
actatcactgcgcatgcctcgtctatactcacttgtga

SEQ ID NO: 71648 - DNA, 35 bp, Artificial Sequence
  Synthetic oligonucleotide
tcacagcagaagctctccatgattccgattcttga

SEQ ID NO: 71649 - DNA, 38 bp, Artificial Sequence
  Synthetic oligonucleotide
acatgcaggccggggctaggaagggtagaatgagttga

SEQ ID NO: 71650 - DNA, 38 bp, Artificial Sequence
  Synthetic oligonucleotide
tgaccgaaacatcacagacacaccacgggcaaggttga

SEQ ID NO: 71651 - DNA, 38 bp, Artificial Sequence
  Synthetic oligonucleotide
acacagggaggattgggagtgacgcaggcgggggttga

SEQ ID NO: 71652 - DNA, 37 bp, Artificial Sequence
  Synthetic oligonucleotide
gctaagcgggaggatggaatggggaaatcggttttga

SEQ ID NO: 71653 - DNA, 36 bp, Artificial Sequence
  Synthetic oligonucleotide
gatggagtagcgtgtaccacctaggtcattttgata

SEQ ID NO: 71654 - DNA, 36 bp, Artificial Sequence
  Synthetic oligonucleotide
ttgggacgtacgctgcctggaaacacatcacgccta

SEQ ID NO: 71655 - DNA, 36 bp, Artificial Sequence
  Synthetic oligonucleotide
acacacctaccaaacacgtggcgctctcctcccgta

SEQ ID NO: 71656 - DNA, 35 bp, Artificial Sequence
  Synthetic oligonucleotide
acacctcctggaattgtgtcccgccgaactctgta

SEQ ID NO: 71657 - DNA, 35 bp, Artificial Sequence
  Synthetic oligonucleotide
tttcagccctcatgttctctcgcttagatccatta

SEQ ID NO: 71658 - DNA, 35 bp, Artificial Sequence
  Synthetic oligonucleotide
taacaccacagcttgccgaagctgactttgcatta

SEQ ID NO: 71659 - DNA, 35 bp, Artificial Sequence
  Synthetic oligonucleotide
gtgccttccgcagaccttcccgcgtccactattta

SEQ ID NO: 71660 - DNA, 35 bp, Artificial Sequence
  Synthetic oligonucleotide
gacacacatagcagcttgcacagggcggtgagaac

SEQ ID NO: 71661 - DNA, 35 bp, Artificial Sequence
  Synthetic oligonucleotide
gcccgcaccaccacatcacctgtcgctggaaacac

SEQ ID NO: 71662 - DNA, 35 bp, Artificial Sequence
  Synthetic oligonucleotide
tgaggacagcgttttccgcctcatgtcttttctac

SEQ ID NO: 71663 - DNA, 35 bp, Artificial Sequence
  Synthetic oligonucleotide
gccctttacggccattgtacgtactcgcttctacc

SEQ ID NO: 71664 - DNA, 35 bp, Artificial Sequence
  Synthetic oligonucleotide
acctccgcgaaccatgtgtagtagttattcttacc

SEQ ID NO: 71665 - DNA, 35 bp, Artificial Sequence
  Synthetic oligonucleotide
tgagctctacccgtctaacagaccccctccaaccc

SEQ ID NO: 71666 - DNA, 35 bp, Artificial Sequence
  Synthetic oligonucleotide
gaagccaccatgctgacgtactctccgtatctgcc

SEQ ID NO: 71667 - DNA, 35 bp, Artificial Sequence
  Synthetic oligonucleotide
actcccaccctgttctagttctagttgctctgtcc

SEQ ID NO: 71668 - DNA, 35 bp, Artificial Sequence
  Synthetic oligonucleotide
acgctccaccacatccgaacccatatggaaacagc

SEQ ID NO: 71669 - DNA, 35 bp, Artificial Sequence
  Synthetic oligonucleotide
gtcgcaatcactcgcagtttaacctttcacctcgc

SEQ ID NO: 71670 - DNA, 35 bp, Artificial Sequence
  Synthetic oligonucleotide
taaccggcggaccctacattatacccccgctaggc

SEQ ID NO: 71671 - DNA, 35 bp, Artificial Sequence
  Synthetic oligonucleotide
gacccaccgggccaggccctgattccccatttggc

SEQ ID NO: 71672 - DNA, 35 bp, Artificial Sequence
  Synthetic oligonucleotide
acatgcaggtcatatatcctcagctccccttatgc

SEQ ID NO: 71673 - DNA, 35 bp, Artificial Sequence
  Synthetic oligonucleotide
tccacatatcgatccttccgtgaaacccaccttgc

SEQ ID NO: 71674 - DNA, 35 bp, Artificial Sequence
  Synthetic oligonucleotide
tcgatcaaatcagcccgatcaatccagcctttatc

SEQ ID NO: 71675 - DNA, 35 bp, Artificial Sequence
  Synthetic oligonucleotide
gttgccgggaccattaaatggattcgtttaccctc

SEQ ID NO: 71676 - DNA, 35 bp, Artificial Sequence
  Synthetic oligonucleotide
actctacccgactctgggtctttgtactgttcctc

SEQ ID NO: 71677 - DNA, 35 bp, Artificial Sequence
  Synthetic oligonucleotide
tgcaaaccctgctccccacgcccataacttacgtc

SEQ ID NO: 71678 - DNA, 35 bp, Artificial Sequence
  Synthetic oligonucleotide
actgagagttcatccacctgatagtctgtgatttc

SEQ ID NO: 71679 - DNA, 35 bp, Artificial Sequence
  Synthetic oligonucleotide
gacgccctgatgtacccgccatgtctcaccctttc

SEQ ID NO: 71680 - DNA, 35 bp, Artificial Sequence
  Synthetic oligonucleotide
atcgtgcactccagctcctaacccgggttattttc

SEQ ID NO: 71681 - DNA, 35 bp, Artificial Sequence
  Synthetic oligonucleotide
aagtcttacaggagagagagggggatgacggatag

SEQ ID NO: 71682 - DNA, 35 bp, Artificial Sequence
  Synthetic oligonucleotide
actccccgtactgacttatagtcctcattctcacg

SEQ ID NO: 71683 - DNA, 35 bp, Artificial Sequence
  Synthetic oligonucleotide
ttcacctggatctgttgcaccgtcgtatttctccg

SEQ ID NO: 71684 - DNA, 35 bp, Artificial Sequence
  Synthetic oligonucleotide
ttttgcgcccacactgctcctcagcgttctttgcg

SEQ ID NO: 71685 - DNA, 35 bp, Artificial Sequence
  Synthetic oligonucleotide
ggtcaatcaaggggaatataggtggctgagaaagg

SEQ ID NO: 71686 - DNA, 34 bp, Artificial Sequence
  Synthetic oligonucleotide
tcgtgggtggttgagaaatgtgggatgggtgagg

SEQ ID NO: 71687 - DNA, 35 bp, Artificial Sequence
  Synthetic oligonucleotide
gtggtgacaggaaacgggaaaggacgagtggtagg

SEQ ID NO: 71688 - DNA, 35 bp, Artificial Sequence
  Synthetic oligonucleotide
tcagacgacgtacggacccttcacccctatattgg

SEQ ID NO: 71689 - DNA, 35 bp, Artificial Sequence
  Synthetic oligonucleotide
ttcgcaaacactcccttcgaccacgtcgttctgtg

SEQ ID NO: 71690 - DNA, 35 bp, Artificial Sequence
  Synthetic oligonucleotide
cactccccactgcctttagtattgtctgttttcat

SEQ ID NO: 71691 - DNA, 35 bp, Artificial Sequence
  Synthetic oligonucleotide
tgtcacctgtacgcccctgttcttcccctcgcact

SEQ ID NO: 71692 - DNA, 35 bp, Artificial Sequence
  Synthetic oligonucleotide
gtccccacgtgaaatggttcagcgtgcatttacct

SEQ ID NO: 71693 - DNA, 35 bp, Artificial Sequence
  Synthetic oligonucleotide
gaacacagacgctacctatctattgcgtttctcct

SEQ ID NO: 71694 - DNA, 35 bp, Artificial Sequence
  Synthetic oligonucleotide
ttatgccatcccgcgcaagtaacagaacgtttcct

SEQ ID NO: 71695 - DNA, 35 bp, Artificial Sequence
  Synthetic oligonucleotide
tcatgccagacgcccactccatcgagcgcccctct

SEQ ID NO: 71696 - DNA, 35 bp, Artificial Sequence
  Synthetic oligonucleotide
aactgtccctcctcaacgcgagctgtttccagtct

SEQ ID NO: 71697 - DNA, 35 bp, Artificial Sequence
  Synthetic oligonucleotide
gtgccccccgcctcttttgcgttaaccattcccgt

SEQ ID NO: 71698 - DNA, 35 bp, Artificial Sequence
  Synthetic oligonucleotide
gcacatttcacctcggcccactaatcaacatcggt

SEQ ID NO: 71699 - DNA, 35 bp, Artificial Sequence
  Synthetic oligonucleotide
tatatcgcaccgtctttatgcatttttaactcctt

SEQ ID NO: 71700 - DNA, 35 bp, Artificial Sequence
  Synthetic oligonucleotide
gcgaggtaagcagtatcccccgcccgacttggttt

SEQ ID NO: 71701 - DNA, 34 bp, Artificial Sequence
  Synthetic oligonucleotide
actgaacgcgtaccattccgtgtctccgctgttt

SEQ ID NO: 71702 - DNA, 35 bp, Artificial Sequence
  Synthetic oligonucleotide
gtgggcgtttccgggctgcacgggttacacatttt

SEQ ID NO: 71703 - DNA, 36 bp, Artificial Sequence
  Synthetic oligonucleotide
gacgcctctaccctaaaacggttcattggctcccaa

SEQ ID NO: 71704 - DNA, 36 bp, Artificial Sequence
  Synthetic oligonucleotide
gctgccacctctaatcatggattacgatctttccaa

SEQ ID NO: 71705 - DNA, 36 bp, Artificial Sequence
  Synthetic oligonucleotide
acaggaccgactgcccatactaactgacctccgcaa

SEQ ID NO: 71706 - DNA, 36 bp, Artificial Sequence
  Synthetic oligonucleotide
gacgccacccctatcctttaaaatgatccagtcgaa

SEQ ID NO: 71707 - DNA, 36 bp, Artificial Sequence
  Synthetic oligonucleotide
atgagcgggagaagggcgttatcaggtaggcgggaa

SEQ ID NO: 71708 - DNA, 36 bp, Artificial Sequence
  Synthetic oligonucleotide
tagggaaccgacgtaacatttggtccttcttcttaa

SEQ ID NO: 71709 - DNA, 35 bp, Artificial Sequence
  Synthetic oligonucleotide
gaacatataggcagccccacgccgctccgagcaca

SEQ ID NO: 71710 - DNA, 35 bp, Artificial Sequence
  Synthetic oligonucleotide
tccctcggtacacatcgggccttccttctaagaca

SEQ ID NO: 71711 - DNA, 35 bp, Artificial Sequence
  Synthetic oligonucleotide
aacgtggcccactcccacggtcattattcctgaca

SEQ ID NO: 71712 - DNA, 36 bp, Artificial Sequence
  Synthetic oligonucleotide
ggccgaacggacgtactaatcccagctacccaccca

SEQ ID NO: 71713 - DNA, 36 bp, Artificial Sequence
  Synthetic oligonucleotide
gctcattcgtccttttgggatcaccccgcctcccca

SEQ ID NO: 71714 - DNA, 35 bp, Artificial Sequence
  Synthetic oligonucleotide
gtacctcgccgcaatgaactataactctactgcca

SEQ ID NO: 71715 - DNA, 36 bp, Artificial Sequence
  Synthetic oligonucleotide
cacccccgcacacagtacgactcgtcgaatcatcca

SEQ ID NO: 71716 - DNA, 36 bp, Artificial Sequence
  Synthetic oligonucleotide
gtgacagcccgcttatgccctcaacaccctggcgca

SEQ ID NO: 71717 - DNA, 35 bp, Artificial Sequence
  Synthetic oligonucleotide
ttcatccgtcaataaccccgccgccttttttggca

SEQ ID NO: 71718 - DNA, 36 bp, Artificial Sequence
  Synthetic oligonucleotide
ttggcgccacctctcaacgcgtcccatcataatgca

SEQ ID NO: 71719 - DNA, 35 bp, Artificial Sequence
  Synthetic oligonucleotide
tccctgaccaccaccgcaatacttaatcagatgca

SEQ ID NO: 71720 - DNA, 36 bp, Artificial Sequence
  Synthetic oligonucleotide
gggacccgcaccaattgattatgctctctaggctca

SEQ ID NO: 71721 - DNA, 37 bp, Artificial Sequence
  Synthetic oligonucleotide
gtgtgcgcccattgtcagtttcgccctccattaaaga

SEQ ID NO: 71722 - DNA, 37 bp, Artificial Sequence
  Synthetic oligonucleotide
tgagagggtgaaataatgggggtaaaggtttggaaga

SEQ ID NO: 71723 - DNA, 36 bp, Artificial Sequence
  Synthetic oligonucleotide
tatgggcggggaggtaccaggtagataacatcgaga

SEQ ID NO: 71724 - DNA, 37 bp, Artificial Sequence
  Synthetic oligonucleotide
ttcaacgccagacagggtagaacgatgggatgataga

SEQ ID NO: 71725 - DNA, 37 bp, Artificial Sequence
  Synthetic oligonucleotide
tggatgaaaaggtagggggagtatggctggaggtaga

SEQ ID NO: 71726 - DNA, 37 bp, Artificial Sequence
  Synthetic oligonucleotide
gcacagcattatgcatgcgcaccctatttattgtaga

SEQ ID NO: 71727 - DNA, 34 bp, Artificial Sequence
  Synthetic oligonucleotide
tcactacatcacagggcctcctgactcgggacga

SEQ ID NO: 71728 - DNA, 37 bp, Artificial Sequence
  Synthetic oligonucleotide
tacgccacacatggtacacttagtactaaacatacga

SEQ ID NO: 71729 - DNA, 37 bp, Artificial Sequence
  Synthetic oligonucleotide
tccaacccctttacaccgagacgggaggagacaccga

SEQ ID NO: 71730 - DNA, 36 bp, Artificial Sequence
  Synthetic oligonucleotide
actacactcaaggcgcccgcgagaacttccccccga

SEQ ID NO: 71731 - DNA, 37 bp, Artificial Sequence
  Synthetic oligonucleotide
tgtaggacacccttggacgcagacaccccgctcccga

SEQ ID NO: 71732 - DNA, 37 bp, Artificial Sequence
  Synthetic oligonucleotide
tgacgctgacctcgccaggcctgttctgttttcccga

SEQ ID NO: 71733 - DNA, 36 bp, Artificial Sequence
  Synthetic oligonucleotide
gcaccgccgcatacttcacacatagaccctattcga

SEQ ID NO: 71734 - DNA, 36 bp, Artificial Sequence
  Synthetic oligonucleotide
tatttcaccggcctgactaactgccgctcttttcga

SEQ ID NO: 71735 - DNA, 36 bp, Artificial Sequence
  Synthetic oligonucleotide
ttcgagaaagtggggtatagacggggttgggcagga

SEQ ID NO: 71736 - DNA, 36 bp, Artificial Sequence
  Synthetic oligonucleotide
atcgatctcaatggtctcgcaatccaccctctcgga

SEQ ID NO: 71737 - DNA, 37 bp, Artificial Sequence
  Synthetic oligonucleotide
agacgtaaaacgggagggtggcaaagttgggccggga

SEQ ID NO: 71738 - DNA, 37 bp, Artificial Sequence
  Synthetic oligonucleotide
gagtcgatgcgggatagacttgggctacaggggggga

SEQ ID NO: 71739 - DNA, 37 bp, Artificial Sequence
  Synthetic oligonucleotide
acgaatctggcctacactacaacccccccgcttggga

SEQ ID NO: 71740 - DNA, 37 bp, Artificial Sequence
  Synthetic oligonucleotide
ttgtgcaggactcgcccccctccctcttagtcgtgga

SEQ ID NO: 71741 - DNA, 38 bp, Artificial Sequence
  Synthetic oligonucleotide
atgtccctgtctgcgtattccgccgccccatgcaatga

SEQ ID NO: 71742 - DNA, 38 bp, Artificial Sequence
  Synthetic oligonucleotide
ttccccccacgctagccacaccttggcccgtgccatga

SEQ ID NO: 71743 - DNA, 38 bp, Artificial Sequence
  Synthetic oligonucleotide
gcacaggaagtccagcgaaaaggggaggtagattatga

SEQ ID NO: 71744 - DNA, 36 bp, Artificial Sequence
  Synthetic oligonucleotide
gacatccctgtttacacgccgttttcttcctactga

SEQ ID NO: 71745 - DNA, 38 bp, Artificial Sequence
  Synthetic oligonucleotide
gcggtacatcttccatccggcgtccgtcaaccacctga

SEQ ID NO: 71746 - DNA, 36 bp, Artificial Sequence
  Synthetic oligonucleotide
agatccccgccccggtgtaggttttaaattacctga

SEQ ID NO: 71747 - DNA, 38 bp, Artificial Sequence
  Synthetic oligonucleotide
gatgcactctgtcggctcaatcatgccccttcccctga

SEQ ID NO: 71748 - DNA, 38 bp, Artificial Sequence
  Synthetic oligonucleotide
tttgcctcacccttatgaacttaacgtacaatccctga

SEQ ID NO: 71749 - DNA, 38 bp, Artificial Sequence
  Synthetic oligonucleotide
agtacgagcagtccaaccttaagcaacagtaacgctga

SEQ ID NO: 71750 - DNA, 38 bp, Artificial Sequence
  Synthetic oligonucleotide
actgcacgcctaccacatcaaatgccgctacctgctga

SEQ ID NO: 71751 - DNA, 36 bp, Artificial Sequence
  Synthetic oligonucleotide
ttggaatccccctttgctttgtgctgacgtgagtga

SEQ ID NO: 71752 - DNA, 38 bp, Artificial Sequence
  Synthetic oligonucleotide
accgccctcatcgcgctatctcactccacctttagtga

SEQ ID NO: 71753 - DNA, 37 bp, Artificial Sequence
  Synthetic oligonucleotide
acagatagggcggaaacgggaaagtgcagtgaggtga

SEQ ID NO: 71754 - DNA, 36 bp, Artificial Sequence
  Synthetic oligonucleotide
attcgccccacgcttccagtgtctgaccatcattga

SEQ ID NO: 71755 - DNA, 37 bp, Artificial Sequence
  Synthetic oligonucleotide
tacgacgtaggtcgtaatctacgctcccatgacttga

SEQ ID NO: 71756 - DNA, 36 bp, Artificial Sequence
  Synthetic oligonucleotide
tccacgtactacgccaaaactcacgtgtttctttga

SEQ ID NO: 71757 - DNA, 38 bp, Artificial Sequence
  Synthetic oligonucleotide
tagtcggtccgatgcgcaccctgtatagccctttttga

SEQ ID NO: 71758 - DNA, 36 bp, Artificial Sequence
  Synthetic oligonucleotide
gcacaacctcatacctcctgaaatcgtggcacgata

SEQ ID NO: 71759 - DNA, 36 bp, Artificial Sequence
  Synthetic oligonucleotide
gagttggtaaacagttggtgctagctggggaggata

SEQ ID NO: 71760 - DNA, 36 bp, Artificial Sequence
  Synthetic oligonucleotide
gactgttgccctggttccaagcccacccttaatata

SEQ ID NO: 71761 - DNA, 36 bp, Artificial Sequence
  Synthetic oligonucleotide
tctcgtgtcacgttccatgtcgacctcgttccacta

SEQ ID NO: 71762 - DNA, 36 bp, Artificial Sequence
  Synthetic oligonucleotide
acacgcacagtcaggctggcaacggggggggagcta

SEQ ID NO: 71763 - DNA, 36 bp, Artificial Sequence
  Synthetic oligonucleotide
agttgccacgggctctcatgtcttcatcacttgcta

SEQ ID NO: 71764 - DNA, 36 bp, Artificial Sequence
  Synthetic oligonucleotide
gtggtcatcacatagctgacgaaggtcacgtttcta

SEQ ID NO: 71765 - DNA, 36 bp, Artificial Sequence
  Synthetic oligonucleotide
tatgatcctctgcccgttctcttgtccttggacgta

SEQ ID NO: 71766 - DNA, 36 bp, Artificial Sequence
  Synthetic oligonucleotide
ttcaacgcagtagtcggtgaggattgggtagccgta

SEQ ID NO: 71767 - DNA, 35 bp, Artificial Sequence
  Synthetic oligonucleotide
tctcccaatccggggtgcccacttctaggacctta

SEQ ID NO: 71768 - DNA, 36 bp, Artificial Sequence
  Synthetic oligonucleotide
tcacctggagctgcgcccccgtcttaccatggctta

SEQ ID NO: 71769 - DNA, 36 bp, Artificial Sequence
  Synthetic oligonucleotide
gttgtgctaccccccccgttaatagcaggacattta

SEQ ID NO: 71770 - DNA, 36 bp, Artificial Sequence
  Synthetic oligonucleotide
aatcaaccccgcagagcgtccgtactagctttttta

SEQ ID NO: 71771 - DNA, 33 bp, Artificial Sequence
  Synthetic oligonucleotide
tccatcctgtacgtccccctttggtccagaaac

SEQ ID NO: 71772 - DNA, 35 bp, Artificial Sequence
  Synthetic oligonucleotide
gggacatgcagatacgcactttcatcgctcacaac

SEQ ID NO: 71773 - DNA, 35 bp, Artificial Sequence
  Synthetic oligonucleotide
gattttcagcgattgtcctcagttccgtcctctac

SEQ ID NO: 71774 - DNA, 35 bp, Artificial Sequence
  Synthetic oligonucleotide
agccaatgcaacctagtaaccgaacaaggctcacc

SEQ ID NO: 71775 - DNA, 35 bp, Artificial Sequence
  Synthetic oligonucleotide
tgcgtcactaagcccggtgttttgcccacttgacc

SEQ ID NO: 71776 - DNA, 35 bp, Artificial Sequence
  Synthetic oligonucleotide
acacgggcgcgctacaactgttgcgtacggttccc

SEQ ID NO: 71777 - DNA, 35 bp, Artificial Sequence
  Synthetic oligonucleotide
gtttggtccgcacgagtcatcacgcgctggaatcc

SEQ ID NO: 71778 - DNA, 33 bp, Artificial Sequence
  Synthetic oligonucleotide
gtccggatgtcgactacgtcactgcacctctcc

SEQ ID NO: 71779 - DNA, 35 bp, Artificial Sequence
  Synthetic oligonucleotide
accgagcgacctcagccattaatgaaacgttctcc

SEQ ID NO: 71780 - DNA, 35 bp, Artificial Sequence
  Synthetic oligonucleotide
gcatactcacatccgttcacccaattaccgaatgc

SEQ ID NO: 71781 - DNA, 35 bp, Artificial Sequence
  Synthetic oligonucleotide
tctcacgcacgttcccggctcacatcgccccctgc

SEQ ID NO: 71782 - DNA, 35 bp, Artificial Sequence
  Synthetic oligonucleotide
gagccactattcctggaaccgccctgaggactatc

SEQ ID NO: 71783 - DNA, 35 bp, Artificial Sequence
  Synthetic oligonucleotide
atacctgcgactgccttacgctaccgcgtgacctc

SEQ ID NO: 71784 - DNA, 35 bp, Artificial Sequence
  Synthetic oligonucleotide
tgatgcactccactcactgttagcgtcactcgctc

SEQ ID NO: 71785 - DNA, 36 bp, Artificial Sequence
  Synthetic oligonucleotide
accctgagaggacgtcctcgcttgcactcttgtctc

SEQ ID NO: 71786 - DNA, 35 bp, Artificial Sequence
  Synthetic oligonucleotide
ttgggggggcgcaccttcacacaggactacttgtc

SEQ ID NO: 71787 - DNA, 35 bp, Artificial Sequence
  Synthetic oligonucleotide
gcgatgccccatgcggcccgggcctcaacgcattc

SEQ ID NO: 71788 - DNA, 35 bp, Artificial Sequence
  Synthetic oligonucleotide
atgctgaacaacgtgtccatgccgcagtatagttc

SEQ ID NO: 71789 - DNA, 34 bp, Artificial Sequence
  Synthetic oligonucleotide
gaccgcgctcggtcaactgtccatattctttttc

SEQ ID NO: 71790 - DNA, 35 bp, Artificial Sequence
  Synthetic oligonucleotide
ggtgtggggaagggtgatgacggcaaaacactcag

SEQ ID NO: 71791 - DNA, 35 bp, Artificial Sequence
  Synthetic oligonucleotide
gccgggggtcgggggcaacggcggacatctagtag

SEQ ID NO: 71792 - DNA, 35 bp, Artificial Sequence
  Synthetic oligonucleotide
tagccaatcccggtccctgtttacttacaacttag

SEQ ID NO: 71793 - DNA, 34 bp, Artificial Sequence
  Synthetic oligonucleotide
tatgcaaccggagagacagatcagaggaagtacg

SEQ ID NO: 71794 - DNA, 35 bp, Artificial Sequence
  Synthetic oligonucleotide
gtgacgcctccaagatgcgacgcagggactgaccg

SEQ ID NO: 71795 - DNA, 35 bp, Artificial Sequence
  Synthetic oligonucleotide
gaccccccgcttggtcaccccagccgttatgcccg

SEQ ID NO: 71796 - DNA, 35 bp, Artificial Sequence
  Synthetic oligonucleotide
gctgacctacgcactatcctcaaaaccaccggtcg

SEQ ID NO: 71797 - DNA, 35 bp, Artificial Sequence
  Synthetic oligonucleotide
ttagacagcagcccactactgcatctttttattcg

SEQ ID NO: 71798 - DNA, 35 bp, Artificial Sequence
  Synthetic oligonucleotide
cactgcccccgactcccggtcttatcctcagctgg

SEQ ID NO: 71799 - DNA, 35 bp, Artificial Sequence
  Synthetic oligonucleotide
tagtccagaaagggaagacggcgaaaagaagtatg

SEQ ID NO: 71800 - DNA, 35 bp, Artificial Sequence
  Synthetic oligonucleotide
gtctccgcctctggttatgttcagcctgtatcttg

SEQ ID NO: 71801 - DNA, 35 bp, Artificial Sequence
  Synthetic oligonucleotide
agccgccacaacgaccttaacgtaattatagccat

SEQ ID NO: 71802 - DNA, 35 bp, Artificial Sequence
  Synthetic oligonucleotide
tactcatctgcggtccggcccgcactaccccgtat

SEQ ID NO: 71803 - DNA, 35 bp, Artificial Sequence
  Synthetic oligonucleotide
atctgcccctgtactacgcttcatgatcttcttat

SEQ ID NO: 71804 - DNA, 35 bp, Artificial Sequence
  Synthetic oligonucleotide
tcataaagcccacacatcgtggtatcggttcaact

SEQ ID NO: 71805 - DNA, 35 bp, Artificial Sequence
  Synthetic oligonucleotide
ccaccacctgcatattcgtagtgcagtttgcccct

SEQ ID NO: 71806 - DNA, 35 bp, Artificial Sequence
  Synthetic oligonucleotide
tgcagccgcatagctactcctcttgctctatccct

SEQ ID NO: 71807 - DNA, 35 bp, Artificial Sequence
  Synthetic oligonucleotide
gtccatgcgattggctaacatcccccttcgtatct

SEQ ID NO: 71808 - DNA, 35 bp, Artificial Sequence
  Synthetic oligonucleotide
gtgcggtgcacgaatggtcgggaaactctcacagt

SEQ ID NO: 71809 - DNA, 35 bp, Artificial Sequence
  Synthetic oligonucleotide
atgccatccttcatctattagtcactgcctaccgt

SEQ ID NO: 71810 - DNA, 35 bp, Artificial Sequence
  Synthetic oligonucleotide
tatgtgggggaccgggatgagggagtgctataggt

SEQ ID NO: 71811 - DNA, 35 bp, Artificial Sequence
  Synthetic oligonucleotide
agccctgggtctcaccctcctccacgtccgtaggt

SEQ ID NO: 71812 - DNA, 35 bp, Artificial Sequence
  Synthetic oligonucleotide
atgcgggccaacctgccacccccagatatttgatt

SEQ ID NO: 71813 - DNA, 35 bp, Artificial Sequence
  Synthetic oligonucleotide
tgacgatacagatgcagctccgctctgctccactt

SEQ ID NO: 71814 - DNA, 35 bp, Artificial Sequence
  Synthetic oligonucleotide
atgacatcaaaaggcgcttctcgccggcctccctt

SEQ ID NO: 71815 - DNA, 35 bp, Artificial Sequence
  Synthetic oligonucleotide
attcaaacccaccgactcacctgcaaggtcgtttt

SEQ ID NO: 71816 - DNA, 35 bp, Artificial Sequence
  Synthetic oligonucleotide
tccacccgggtggtccaatacctgaaaagggaaaa

SEQ ID NO: 71817 - DNA, 35 bp, Artificial Sequence
  Synthetic oligonucleotide
acacatgcaacccgggagtgactccttccttacaa

SEQ ID NO: 71818 - DNA, 36 bp, Artificial Sequence
  Synthetic oligonucleotide
aaccgtggtggtgccagcaggagggggacgggccaa

SEQ ID NO: 71819 - DNA, 36 bp, Artificial Sequence
  Synthetic oligonucleotide
tgtgctcgcctgctaactatcgtggaattgccctaa

SEQ ID NO: 71820 - DNA, 36 bp, Artificial Sequence
  Synthetic oligonucleotide
aaccccccggcttattgacattttgtctgttcgtaa

SEQ ID NO: 71821 - DNA, 36 bp, Artificial Sequence
  Synthetic oligonucleotide
gacactggctcagtgtcatcatcttgtctttgttaa

SEQ ID NO: 71822 - DNA, 36 bp, Artificial Sequence
  Synthetic oligonucleotide
tccatccatcacgggacgatacaagacatcaaaaca

SEQ ID NO: 71823 - DNA, 36 bp, Artificial Sequence
  Synthetic oligonucleotide
gattaagcgcaggctcacccctttacccccggtaca

SEQ ID NO: 71824 - DNA, 35 bp, Artificial Sequence
  Synthetic oligonucleotide
gtgtacactctccattcatgtaagtaaccattaca

SEQ ID NO: 71825 - DNA, 35 bp, Artificial Sequence
  Synthetic oligonucleotide
acaccagtgcgtcgccgaccctgcatacacaacca

SEQ ID NO: 71826 - DNA, 36 bp, Artificial Sequence
  Synthetic oligonucleotide
tgtggaacctacctgccaactatgagacaggtacca

SEQ ID NO: 71827 - DNA, 36 bp, Artificial Sequence
  Synthetic oligonucleotide
gctgagaccggctcctgtaggtgcgcttgccaccca

SEQ ID NO: 71828 - DNA, 35 bp, Artificial Sequence
  Synthetic oligonucleotide
tcgatacatctgtcagctccatagttttctcccca

SEQ ID NO: 71829 - DNA, 36 bp, Artificial Sequence
  Synthetic oligonucleotide
tttccacgcggctccacccatctatattatcgccca

SEQ ID NO: 71830 - DNA, 36 bp, Artificial Sequence
  Synthetic oligonucleotide
atgtccctcgtaatgcagtctcttcatcaattggca

SEQ ID NO: 71831 - DNA, 36 bp, Artificial Sequence
  Synthetic oligonucleotide
tccacatgtagccggttcctttttttcgtgagtgca

SEQ ID NO: 71832 - DNA, 36 bp, Artificial Sequence
  Synthetic oligonucleotide
ttgacacaactcacctgctaaggtttgcttaactca

SEQ ID NO: 71833 - DNA, 35 bp, Artificial Sequence
  Synthetic oligonucleotide
ggagaacaacgtccctgacattctatatcgcttca

SEQ ID NO: 71834 - DNA, 36 bp, Artificial Sequence
  Synthetic oligonucleotide
atgccatccccggctattctagcccgaaccgtttca

SEQ ID NO: 71835 - DNA, 35 bp, Artificial Sequence
  Synthetic oligonucleotide
tgcacacctccggcatactctgtccattacgacga

SEQ ID NO: 71836 - DNA, 37 bp, Artificial Sequence
  Synthetic oligonucleotide
actccatcagtcgttccaattgtatcgttacatacga

SEQ ID NO: 71837 - DNA, 37 bp, Artificial Sequence
  Synthetic oligonucleotide
tgttcacatcattcgtcgctttaatcgttctacccga

SEQ ID NO: 71838 - DNA, 37 bp, Artificial Sequence
  Synthetic oligonucleotide
tgcgagcctactcttccgtttgcattgtatgccccga

SEQ ID NO: 71839 - DNA, 37 bp, Artificial Sequence
  Synthetic oligonucleotide
taccgcattcatccgtaccgttatcaccccttcccga

SEQ ID NO: 71840 - DNA, 35 bp, Artificial Sequence
  Synthetic oligonucleotide
atgccatttcaccacaacatttgctacaccgccga

SEQ ID NO: 71841 - DNA, 37 bp, Artificial Sequence
  Synthetic oligonucleotide
tatgcgaccatacatgaagcaccacacctgtttccga

SEQ ID NO: 71842 - DNA, 37 bp, Artificial Sequence
  Synthetic oligonucleotide
ttgagatctcgctccccgtgtaaacggtacctctcga

SEQ ID NO: 71843 - DNA, 37 bp, Artificial Sequence
  Synthetic oligonucleotide
gggtgggggatgggctggggtaggaaactccattcga

SEQ ID NO: 71844 - DNA, 36 bp, Artificial Sequence
  Synthetic oligonucleotide
tgtcgatgcttgatcgtcagcaccccccgatttcga

SEQ ID NO: 71845 - DNA, 37 bp, Artificial Sequence
  Synthetic oligonucleotide
gtgggcacaagtacaacaccgctcgctgctctttcga

SEQ ID NO: 71846 - DNA, 37 bp, Artificial Sequence
  Synthetic oligonucleotide
gaccatcctactgcgtgactcacccctttgttaagga

SEQ ID NO: 71847 - DNA, 37 bp, Artificial Sequence
  Synthetic oligonucleotide
ggtgtatggggagggggtgagtgaagggctgaacgga

SEQ ID NO: 71848 - DNA, 37 bp, Artificial Sequence
  Synthetic oligonucleotide
taggtgtggcaaaggaaggggcaaataagtcatggga

SEQ ID NO: 71849 - DNA, 37 bp, Artificial Sequence
  Synthetic oligonucleotide
gaggtgtaggtgctaggggtgactcggagcggtggga

SEQ ID NO: 71850 - DNA, 36 bp, Artificial Sequence
  Synthetic oligonucleotide
acatacgccgcgactaccacctctcgcgaacatgga

SEQ ID NO: 71851 - DNA, 37 bp, Artificial Sequence
  Synthetic oligonucleotide
aatgagggggctaagagggagtaatgggtggagtgga

SEQ ID NO: 71852 - DNA, 38 bp, Artificial Sequence
  Synthetic oligonucleotide
gcgcaagcaccaactattcgagtgtcactgccacatga

SEQ ID NO: 71853 - DNA, 37 bp, Artificial Sequence
  Synthetic oligonucleotide
tccacccgttctctatccgcctgcgacagaccactga

SEQ ID NO: 71854 - DNA, 38 bp, Artificial Sequence
  Synthetic oligonucleotide
tctcgggatcggccagcttttacgtcctccacacctga

SEQ ID NO: 71855 - DNA, 38 bp, Artificial Sequence
  Synthetic oligonucleotide
ttgtacgccggcactttgtcacgatgacattgccctga

SEQ ID NO: 71856 - DNA, 36 bp, Artificial Sequence
  Synthetic oligonucleotide
gactctgcccgtcgcgccctatgttagcctccctga

SEQ ID NO: 71857 - DNA, 38 bp, Artificial Sequence
  Synthetic oligonucleotide
acgcgccgtccatatccctatagctttccttggcctga

SEQ ID NO: 71858 - DNA, 36 bp, Artificial Sequence
  Synthetic oligonucleotide
gctagccacgcctgctaagaaccaatatcccgctga

SEQ ID NO: 71859 - DNA, 37 bp, Artificial Sequence
  Synthetic oligonucleotide
tacgcgctattaccttgttttgtacactttttgctga

SEQ ID NO: 71860 - DNA, 36 bp, Artificial Sequence
  Synthetic oligonucleotide
aacctccaccgtcccgctggcaaaaacggaatctga

SEQ ID NO: 71861 - DNA, 38 bp, Artificial Sequence
  Synthetic oligonucleotide
gacccgccttcgaccccaccacagactgttcgaggtga

SEQ ID NO: 71862 - DNA, 38 bp, Artificial Sequence
  Synthetic oligonucleotide
aatacggggtggaagcaataaagcagggggttaggtga

SEQ ID NO: 71863 - DNA, 38 bp, Artificial Sequence
  Synthetic oligonucleotide
gaagggtgggcgcttgtcgggggggctactgacggtga

SEQ ID NO: 71864 - DNA, 38 bp, Artificial Sequence
  Synthetic oligonucleotide
accaacgcttgttggggggactcggggaaggagggtga

SEQ ID NO: 71865 - DNA, 38 bp, Artificial Sequence
  Synthetic oligonucleotide
ggggggtggtagggtgtcgtggaaatccgactgggtga

SEQ ID NO: 71866 - DNA, 38 bp, Artificial Sequence
  Synthetic oligonucleotide
tcagacgcccgccgctagtttactgaacccaaaattga

SEQ ID NO: 71867 - DNA, 38 bp, Artificial Sequence
  Synthetic oligonucleotide
gagcccttacacagccagtactagcccgttctccttga

SEQ ID NO: 71868 - DNA, 38 bp, Artificial Sequence
  Synthetic oligonucleotide
atgaggggggtggtggacaggattgtgggcgcagttga

SEQ ID NO: 71869 - DNA, 38 bp, Artificial Sequence
  Synthetic oligonucleotide
ttcccgcacgtcaaattctcttccgccatactcgttga

SEQ ID NO: 71870 - DNA, 38 bp, Artificial Sequence
  Synthetic oligonucleotide
gcaacccgattcttagaccacacgtgcgccttctttga

SEQ ID NO: 71871 - DNA, 38 bp, Artificial Sequence
  Synthetic oligonucleotide
tcccaccctcatgtattgtcttaggtccctgtgtttga

SEQ ID NO: 71872 - DNA, 28 bp, Artificial Sequence
  Synthetic oligonucleotide
tctgtcctaaatgggccctaccaacata

SEQ ID NO: 71873 - DNA, 36 bp, Artificial Sequence
  Synthetic oligonucleotide
gttaccgtgcaccataggtccttagccaccccgcta

SEQ ID NO: 71874 - DNA, 36 bp, Artificial Sequence
  Synthetic oligonucleotide
aaccccctccatgatggatgcctgaatcgcattgta

SEQ ID NO: 71875 - DNA, 36 bp, Artificial Sequence
  Synthetic oligonucleotide
atgactgagtatgcgcacgttgatctctcggttgta

SEQ ID NO: 71876 - DNA, 35 bp, Artificial Sequence
  Synthetic oligonucleotide
ggagtcccgtgcccactcagcattccaccccatta

SEQ ID NO: 71877 - DNA, 36 bp, Artificial Sequence
  Synthetic oligonucleotide
actggccacacacatgtctgtaagttttggggatta

SEQ ID NO: 71878 - DNA, 36 bp, Artificial Sequence
  Synthetic oligonucleotide
tgtgggtgggtgctctcttgtatttgttcctcctta

SEQ ID NO: 71879 - DNA, 35 bp, Artificial Sequence
  Synthetic oligonucleotide
attgttgtggtgctaccctcgtgtgattattccac

SEQ ID NO: 71880 - DNA, 35 bp, Artificial Sequence
  Synthetic oligonucleotide
cccacaactcgccgtttctatagtttatgcactac

SEQ ID NO: 71881 - DNA, 35 bp, Artificial Sequence
  Synthetic oligonucleotide
gccacaactcactgtccaagggttgtttctgttac

SEQ ID NO: 71882 - DNA, 34 bp, Artificial Sequence
  Synthetic oligonucleotide
tcatacacgtcgtgatcccaagttgttgtccacc

SEQ ID NO: 71883 - DNA, 35 bp, Artificial Sequence
  Synthetic oligonucleotide
agcacctcccccagaccgtgacacccatctactcc

SEQ ID NO: 71884 - DNA, 35 bp, Artificial Sequence
  Synthetic oligonucleotide
tcatgttatgcacccatcctaccacgtggtactcc

SEQ ID NO: 71885 - DNA, 35 bp, Artificial Sequence
  Synthetic oligonucleotide
ggacactttccgttctagttggtccagctacccgc

SEQ ID NO: 71886 - DNA, 36 bp, Artificial Sequence
  Synthetic oligonucleotide
ttacacaaccggcttgtggctgccgcgcatccccgc

SEQ ID NO: 71887 - DNA, 35 bp, Artificial Sequence
  Synthetic oligonucleotide
ttgttccattgacctactgccgagccgtgagccgc

SEQ ID NO: 71888 - DNA, 35 bp, Artificial Sequence
  Synthetic oligonucleotide
tgcatactttgcccccgctacaacactggttgcgc

SEQ ID NO: 71889 - DNA, 35 bp, Artificial Sequence
  Synthetic oligonucleotide
gactgccagcaaaaccttccaccaagtaatttcgc

SEQ ID NO: 71890 - DNA, 35 bp, Artificial Sequence
  Synthetic oligonucleotide
gtgaccttctaaactgcccgttgctcgtgcacctc

SEQ ID NO: 71891 - DNA, 35 bp, Artificial Sequence
  Synthetic oligonucleotide
gtgcgacgtgtttgaatacctcctgatcccctctc

SEQ ID NO: 71892 - DNA, 35 bp, Artificial Sequence
  Synthetic oligonucleotide
attagtgtaagcgctccacgggctccttgtctctc

SEQ ID NO: 71893 - DNA, 35 bp, Artificial Sequence
  Synthetic oligonucleotide
ttacacgcgtggccgatgcgcctttatcccgtctc

SEQ ID NO: 71894 - DNA, 35 bp, Artificial Sequence
  Synthetic oligonucleotide
tcccgagcagccccttacctttattcctttgcgtc

SEQ ID NO: 71895 - DNA, 35 bp, Artificial Sequence
  Synthetic oligonucleotide
gctgctctgtgctcctacacccccgcgcccgcttc

SEQ ID NO: 71896 - DNA, 35 bp, Artificial Sequence
  Synthetic oligonucleotide
tacccgagcgagcttaatcgccaggtccacctttc

SEQ ID NO: 71897 - DNA, 35 bp, Artificial Sequence
  Synthetic oligonucleotide
tactctagctccctgactgatacgccgtttttttc

SEQ ID NO: 71898 - DNA, 35 bp, Artificial Sequence
  Synthetic oligonucleotide
gcttcaccattcacgacacacattgcgagccctag

SEQ ID NO: 71899 - DNA, 35 bp, Artificial Sequence
  Synthetic oligonucleotide
aactccctcatcctctgtcgcctcaggctgagccg

SEQ ID NO: 71900 - DNA, 35 bp, Artificial Sequence
  Synthetic oligonucleotide
atgacaccaaaacatttatacaccttccgaacgcg

SEQ ID NO: 71901 - DNA, 35 bp, Artificial Sequence
  Synthetic oligonucleotide
actacccccctgcgattaacatgttccaactctcg

SEQ ID NO: 71902 - DNA, 35 bp, Artificial Sequence
  Synthetic oligonucleotide
tttggcgcgctacccggcttttcgtcacctgttcg

SEQ ID NO: 71903 - DNA, 35 bp, Artificial Sequence
  Synthetic oligonucleotide
tcttagcccgacatccaccacgatacatcaccagg

SEQ ID NO: 71904 - DNA, 35 bp, Artificial Sequence
  Synthetic oligonucleotide
atatgggacgggtaaggtgggcgtagcgggtgcgg

SEQ ID NO: 71905 - DNA, 34 bp, Artificial Sequence
  Synthetic oligonucleotide
gtgggggatctgggagggttgtagaaacccaggg

SEQ ID NO: 71906 - DNA, 35 bp, Artificial Sequence
  Synthetic oligonucleotide
tagtagaggaaagaacgtagggggaggactcgatg

SEQ ID NO: 71907 - DNA, 35 bp, Artificial Sequence
  Synthetic oligonucleotide
tgagggtctggtggtcggtgaagggggagcttctg

SEQ ID NO: 71908 - DNA, 35 bp, Artificial Sequence
  Synthetic oligonucleotide
attgcaccaacaccccctgaaaatactgcactgtg

SEQ ID NO: 71909 - DNA, 35 bp, Artificial Sequence
  Synthetic oligonucleotide
gtgcgcctatttccgtgcgagccccgtccgcccct

SEQ ID NO: 71910 - DNA, 35 bp, Artificial Sequence
  Synthetic oligonucleotide
tcacgcctccgtgatctttcgttgtttgcttgcct

SEQ ID NO: 71911 - DNA, 35 bp, Artificial Sequence
  Synthetic oligonucleotide
gcatccgtttcatcgttcgtcctatttccaatcct

SEQ ID NO: 71912 - DNA, 35 bp, Artificial Sequence
  Synthetic oligonucleotide
ttagcagtcagcagtacctatgttcatcctttcct

SEQ ID NO: 71913 - DNA, 35 bp, Artificial Sequence
  Synthetic oligonucleotide
ttatcatgcccctccgtatacacagttgacactct

SEQ ID NO: 71914 - DNA, 35 bp, Artificial Sequence
  Synthetic oligonucleotide
aatgctacgtaacacttgtccaggcttaaccacgt

SEQ ID NO: 71915 - DNA, 35 bp, Artificial Sequence
  Synthetic oligonucleotide
aactgcactggaggctcatctttcatttagggatt

SEQ ID NO: 71916 - DNA, 35 bp, Artificial Sequence
  Synthetic oligonucleotide
actccaatcgcctaaggctcctttttaccacactt

SEQ ID NO: 71917 - DNA, 35 bp, Artificial Sequence
  Synthetic oligonucleotide
gacccgagcccggtattgttgtttcgtcatacgtt

SEQ ID NO: 71918 - DNA, 35 bp, Artificial Sequence
  Synthetic oligonucleotide
gagaccgcaatctacactgtctttttactggcttt

SEQ ID NO: 71919 - DNA, 35 bp, Artificial Sequence
  Synthetic oligonucleotide
ttcgtcccgcctcactgcgctccatcgttgctttt

SEQ ID NO: 71920 - DNA, 35 bp, Artificial Sequence
  Synthetic oligonucleotide
aggacccctcattcgttgatcatttagcgcttttt

SEQ ID NO: 71921 - DNA, 36 bp, Artificial Sequence
  Synthetic oligonucleotide
tgtgtacgagggcgggaatcaggagccggggtataa

SEQ ID NO: 71922 - DNA, 36 bp, Artificial Sequence
  Synthetic oligonucleotide
gtcgagctccaattcttccgcccatctaccacgtaa

SEQ ID NO: 71923 - DNA, 36 bp, Artificial Sequence
  Synthetic oligonucleotide
aaagtggccgtcactactgtacgatcgcctggttaa

SEQ ID NO: 71924 - DNA, 35 bp, Artificial Sequence
  Synthetic oligonucleotide
taagcgtgcgcgcccacaactctatgaccagaaca

SEQ ID NO: 71925 - DNA, 36 bp, Artificial Sequence
  Synthetic oligonucleotide
ttccatcccatcatgccttcgttgatctgactcaca

SEQ ID NO: 71926 - DNA, 35 bp, Artificial Sequence
  Synthetic oligonucleotide
tctaacgcccgcaccaccgagaggtacaattgaca

SEQ ID NO: 71927 - DNA, 36 bp, Artificial Sequence
  Synthetic oligonucleotide
aacacgccctgaacacgctctcactgtccgtttaca

SEQ ID NO: 71928 - DNA, 35 bp, Artificial Sequence
  Synthetic oligonucleotide
ttccatccatccgcggggatggctatgtgccccca

SEQ ID NO: 71929 - DNA, 36 bp, Artificial Sequence
  Synthetic oligonucleotide
gtccacacctcatgctatgggacctctcttactcca

SEQ ID NO: 71930 - DNA, 36 bp, Artificial Sequence
  Synthetic oligonucleotide
aatgcaagggggggggacgggagacgagggggagca

SEQ ID NO: 71931 - DNA, 36 bp, Artificial Sequence
  Synthetic oligonucleotide
ttgactaggcaactatcgccaccatggtgtctcgca

SEQ ID NO: 71932 - DNA, 36 bp, Artificial Sequence
  Synthetic oligonucleotide
atcaggccttacacggtccactaccctgggatatca

SEQ ID NO: 71933 - DNA, 36 bp, Artificial Sequence
  Synthetic oligonucleotide
tgtcccccatcccccggagcgttgatcaagtcctca

SEQ ID NO: 71934 - DNA, 36 bp, Artificial Sequence
  Synthetic oligonucleotide
gccccgcgaccgtcgttgctttttaggccaaattca

SEQ ID NO: 71935 - DNA, 35 bp, Artificial Sequence
  Synthetic oligonucleotide
aactacccccaggcataaagacattcagcacttca

SEQ ID NO: 71936 - DNA, 37 bp, Artificial Sequence
  Synthetic oligonucleotide
acttggtggtgtggtggggcaaggagcaaggccgaga

SEQ ID NO: 71937 - DNA, 37 bp, Artificial Sequence
  Synthetic oligonucleotide
gagagctcacgggaagattgggttcgggagggcgaga

SEQ ID NO: 71938 - DNA, 36 bp, Artificial Sequence
  Synthetic oligonucleotide
aaatgcagccgggggacaggttataggcggaggaga

SEQ ID NO: 71939 - DNA, 37 bp, Artificial Sequence
  Synthetic oligonucleotide
accccgttctatccgtgccctcgtatcatctctgaga

SEQ ID NO: 71940 - DNA, 36 bp, Artificial Sequence
  Synthetic oligonucleotide
gctgcagaagacggggagctagcgagggccgtgaga

SEQ ID NO: 71941 - DNA, 37 bp, Artificial Sequence
  Synthetic oligonucleotide
aacaccgcccacctaggtacctctattcaacttacga

SEQ ID NO: 71942 - DNA, 37 bp, Artificial Sequence
  Synthetic oligonucleotide
aatgttcagcgctatgcgatgctggcctcattcccga

SEQ ID NO: 71943 - DNA, 37 bp, Artificial Sequence
  Synthetic oligonucleotide
tgccccgcccgttctgtcgttctccccagctgggcga

SEQ ID NO: 71944 - DNA, 37 bp, Artificial Sequence
  Synthetic oligonucleotide
agaacccatctgttcgcacatttagcagtccttgcga

SEQ ID NO: 71945 - DNA, 37 bp, Artificial Sequence
  Synthetic oligonucleotide
tgcgaggtgcctcccattctgtttcttactaccagga

SEQ ID NO: 71946 - DNA, 35 bp, Artificial Sequence
  Synthetic oligonucleotide
accagtcccgagatccgtacctgtgtgccctagga

SEQ ID NO: 71947 - DNA, 37 bp, Artificial Sequence
  Synthetic oligonucleotide
taggctccccgtcgccccacaagctgcccactacgga

SEQ ID NO: 71948 - DNA, 36 bp, Artificial Sequence
  Synthetic oligonucleotide
taagcatgggttgtggcgggaggggcggcatccgga

SEQ ID NO: 71949 - DNA, 37 bp, Artificial Sequence
  Synthetic oligonucleotide
gacactgcgatgaactagggtgggtttacggagggga

SEQ ID NO: 71950 - DNA, 37 bp, Artificial Sequence
  Synthetic oligonucleotide
ttagtcaagagggggcagaaacttacatgcagtggga

SEQ ID NO: 71951 - DNA, 37 bp, Artificial Sequence
  Synthetic oligonucleotide
actagcccaccaatcccgagccacgtggccttatgga

SEQ ID NO: 71952 - DNA, 37 bp, Artificial Sequence
  Synthetic oligonucleotide
aacatggggtggtctgtgcggggcaaagtggtctgga

SEQ ID NO: 71953 - DNA, 37 bp, Artificial Sequence
  Synthetic oligonucleotide
aacccacggcattcaatacttgcgacactaccttgga

SEQ ID NO: 71954 - DNA, 38 bp, Artificial Sequence
  Synthetic oligonucleotide
aatacccccgatctcgtgcttcatagcccaccccatga

SEQ ID NO: 71955 - DNA, 38 bp, Artificial Sequence
  Synthetic oligonucleotide
tgacgtccagcccccctaccactccgtaggttccatga

SEQ ID NO: 71956 - DNA, 38 bp, Artificial Sequence
  Synthetic oligonucleotide
gcaccagcatcacacttggtcgtccgtagttctcatga

SEQ ID NO: 71957 - DNA, 38 bp, Artificial Sequence
  Synthetic oligonucleotide
tgctcctctcacatctgcattaccctctcgctagatga

SEQ ID NO: 71958 - DNA, 38 bp, Artificial Sequence
  Synthetic oligonucleotide
tccctccctcagtggggctattccatacctttacctga

SEQ ID NO: 71959 - DNA, 37 bp, Artificial Sequence
  Synthetic oligonucleotide
acgcaatggtccaccccatactcgttaacgtccctga

SEQ ID NO: 71960 - DNA, 38 bp, Artificial Sequence
  Synthetic oligonucleotide
aagaggaggaggggataacttatacagggaaatgctga

SEQ ID NO: 71961 - DNA, 38 bp, Artificial Sequence
  Synthetic oligonucleotide
gctcccgacacactatacgacctgttcccacgttctga

SEQ ID NO: 71962 - DNA, 38 bp, Artificial Sequence
  Synthetic oligonucleotide
aacacggggagggttggttacaagcaggtaggtagtga

SEQ ID NO: 71963 - DNA, 37 bp, Artificial Sequence
  Synthetic oligonucleotide
tcctttgcgcggatccctcacaacctttatctcgtga

SEQ ID NO: 71964 - DNA, 37 bp, Artificial Sequence
  Synthetic oligonucleotide
gatgtagagtagtgaggaaagtgtggcaactgggtga

SEQ ID NO: 71965 - DNA, 37 bp, Artificial Sequence
  Synthetic oligonucleotide
tcagcactcgccatgcccactcttgctccgaatgtga

SEQ ID NO: 71966 - DNA, 37 bp, Artificial Sequence
  Synthetic oligonucleotide
tgtgcaccgccgcaccctgcgtatggcatctctgtga

SEQ ID NO: 71967 - DNA, 38 bp, Artificial Sequence
  Synthetic oligonucleotide
aagtctacgtcaccacgcgctttacttcctttctgtga

SEQ ID NO: 71968 - DNA, 38 bp, Artificial Sequence
  Synthetic oligonucleotide
gctgcactcgcatctaaggattccatcccccgaattga

SEQ ID NO: 71969 - DNA, 38 bp, Artificial Sequence
  Synthetic oligonucleotide
ggcgctccacgcatgcctactgcacctgtatcccttga

SEQ ID NO: 71970 - DNA, 37 bp, Artificial Sequence
  Synthetic oligonucleotide
gatcaagtcgctccgatatcgcataccttctgcttga

SEQ ID NO: 71971 - DNA, 37 bp, Artificial Sequence
  Synthetic oligonucleotide
tcgcgaagcagttcctccggtcccatcagactcttga

SEQ ID NO: 71972 - DNA, 36 bp, Artificial Sequence
  Synthetic oligonucleotide
aacagtcgatcgtgcccctgtatttgtcgccgttga

SEQ ID NO: 71973 - DNA, 37 bp, Artificial Sequence
  Synthetic oligonucleotide
tgaggaccggcactgacacggagggcactggggttga

SEQ ID NO: 71974 - DNA, 38 bp, Artificial Sequence
  Synthetic oligonucleotide
tagccctcctcatgggcggttcctttgtcacctgttga

SEQ ID NO: 71975 - DNA, 37 bp, Artificial Sequence
  Synthetic oligonucleotide
gactagccccagggtcaagcggcgcacctcctgttga

SEQ ID NO: 71976 - DNA, 37 bp, Artificial Sequence
  Synthetic oligonucleotide
gtgcgggacgccccccatccagtaaccacccgtttga

SEQ ID NO: 71977 - DNA, 35 bp, Artificial Sequence
  Synthetic oligonucleotide
gccactaatacagcgcgctacgatcctgcctccta

SEQ ID NO: 71978 - DNA, 35 bp, Artificial Sequence
  Synthetic oligonucleotide
gatgagaaaaaagggtggtgatacggggggcgcta

SEQ ID NO: 71979 - DNA, 36 bp, Artificial Sequence
  Synthetic oligonucleotide
aaagggaaatgaggagtaaggggactgagggaagta

SEQ ID NO: 71980 - DNA, 36 bp, Artificial Sequence
  Synthetic oligonucleotide
cacacacgcccctttcatgccccgccaactgtagta

SEQ ID NO: 71981 - DNA, 36 bp, Artificial Sequence
  Synthetic oligonucleotide
tctactacgtgctccagccaccccgtccatcgcgta

SEQ ID NO: 71982 - DNA, 36 bp, Artificial Sequence
  Synthetic oligonucleotide
atctcccatcctgcgagttgtctaactgcccgtgta

SEQ ID NO: 71983 - DNA, 35 bp, Artificial Sequence
  Synthetic oligonucleotide
gtacgggaaaacgtcccgggaagggcgggcgatta

SEQ ID NO: 71984 - DNA, 35 bp, Artificial Sequence
  Synthetic oligonucleotide
agaccatcccggtcaacatctaggggctatcacac

SEQ ID NO: 71985 - DNA, 35 bp, Artificial Sequence
  Synthetic oligonucleotide
ttttccccgcccccagatctaatggttgctcccac

SEQ ID NO: 71986 - DNA, 35 bp, Artificial Sequence
  Synthetic oligonucleotide
aagtcagtgcaacagggattttatgagtagtggac

SEQ ID NO: 71987 - DNA, 35 bp, Artificial Sequence
  Synthetic oligonucleotide
gaccgaaatcttgtacgtcttagaagccctgcacc

SEQ ID NO: 71988 - DNA, 35 bp, Artificial Sequence
  Synthetic oligonucleotide
tttactgccacgcactaccacaatttcgttttacc

SEQ ID NO: 71989 - DNA, 35 bp, Artificial Sequence
  Synthetic oligonucleotide
taaccgcgaatttcggtcgtcgtttattatccccc

SEQ ID NO: 71990 - DNA, 35 bp, Artificial Sequence
  Synthetic oligonucleotide
gtaagcgacccccgccttatatctccccgcagccc

SEQ ID NO: 71991 - DNA, 35 bp, Artificial Sequence
  Synthetic oligonucleotide
tcaacaacattcaatagcgtcggctactcgcgccc

SEQ ID NO: 71992 - DNA, 35 bp, Artificial Sequence
  Synthetic oligonucleotide
tcaccgcaggacgtatgcctggtccgctgactgcc

SEQ ID NO: 71993 - DNA, 35 bp, Artificial Sequence
  Synthetic oligonucleotide
acacgctcctatggacgaaactgttactaatatcc

SEQ ID NO: 71994 - DNA, 35 bp, Artificial Sequence
  Synthetic oligonucleotide
gaaccggtgactgttttccatcacataatatttcc

SEQ ID NO: 71995 - DNA, 35 bp, Artificial Sequence
  Synthetic oligonucleotide
gatggtcgtggtgaggagtgagtagtgtctcgcgc

SEQ ID NO: 71996 - DNA, 35 bp, Artificial Sequence
  Synthetic oligonucleotide
gaatcacattcgggtactcgatctcagatgtctgc

SEQ ID NO: 71997 - DNA, 35 bp, Artificial Sequence
  Synthetic oligonucleotide
gctagcgtaccttgctactaccaggcgccattatc

SEQ ID NO: 71998 - DNA, 35 bp, Artificial Sequence
  Synthetic oligonucleotide
aaggtccatcactgcggtctgcctttccccgagtc

SEQ ID NO: 71999 - DNA, 35 bp, Artificial Sequence
  Synthetic oligonucleotide
gaacgctgtgcctataggctccattgagtctcttc

SEQ ID NO: 72000 - DNA, 35 bp, Artificial Sequence
  Synthetic oligonucleotide
acacgcacaacatcgggtctcaccacgggtatttc

SEQ ID NO: 72001 - DNA, 35 bp, Artificial Sequence
  Synthetic oligonucleotide
ttgagccaacttgcgagactccgatcccctaccag

SEQ ID NO: 72002 - DNA, 35 bp, Artificial Sequence
  Synthetic oligonucleotide
atccaccatccgatacccgcgcctcttaccaaccg

SEQ ID NO: 72003 - DNA, 35 bp, Artificial Sequence
  Synthetic oligonucleotide
tgatctgcccccgtgcgtctaactttgggccatcg

SEQ ID NO: 72004 - DNA, 35 bp, Artificial Sequence
  Synthetic oligonucleotide
gtctcaccctgcctgcccatggaccgtgtataggg

SEQ ID NO: 72005 - DNA, 35 bp, Artificial Sequence
  Synthetic oligonucleotide
acaaggcacgtgagagaaaatgggatgtcatgtgg

SEQ ID NO: 72006 - DNA, 35 bp, Artificial Sequence
  Synthetic oligonucleotide
tgttctcgaccttcttacacgtgccgccccttgtg

SEQ ID NO: 72007 - DNA, 35 bp, Artificial Sequence
  Synthetic oligonucleotide
gagaggactgggtggaaggggtacgcagatgtttg

SEQ ID NO: 72008 - DNA, 35 bp, Artificial Sequence
  Synthetic oligonucleotide
gtgcgctagttgccttccgatgctttccactcaat

SEQ ID NO: 72009 - DNA, 35 bp, Artificial Sequence
  Synthetic oligonucleotide
tcaacacccaaatgcagctatcttggtgtatccat

SEQ ID NO: 72010 - DNA, 35 bp, Artificial Sequence
  Synthetic oligonucleotide
acccgacgactgcaacttttcctaggccttcctat

SEQ ID NO: 72011 - DNA, 35 bp, Artificial Sequence
  Synthetic oligonucleotide
acacatcctgctcctatggtacgtttccattctat

SEQ ID NO: 72012 - DNA, 35 bp, Artificial Sequence
  Synthetic oligonucleotide
agaacacgggatgagttgcgggaggaggggtttat

SEQ ID NO: 72013 - DNA, 35 bp, Artificial Sequence
  Synthetic oligonucleotide
tgagccccttgtcctatccgaaagactctgccgct

SEQ ID NO: 72014 - DNA, 35 bp, Artificial Sequence
  Synthetic oligonucleotide
tcgacgtattctgctatgttctggtgaacacctct

SEQ ID NO: 72015 - DNA, 35 bp, Artificial Sequence
  Synthetic oligonucleotide
tctagggtgggactatgggtggaatcggggagagt

SEQ ID NO: 72016 - DNA, 35 bp, Artificial Sequence
  Synthetic oligonucleotide
tagtgcctggcgccatcagacctggatcattacgt

SEQ ID NO: 72017 - DNA, 35 bp, Artificial Sequence
  Synthetic oligonucleotide
gcacgacgtcgtaatcatggctcgttcaactgttt

SEQ ID NO: 72018 - DNA, 36 bp, Artificial Sequence
  Synthetic oligonucleotide
gtggatgccccccttcgttgcttctgtcgcttgaaa

SEQ ID NO: 72019 - DNA, 35 bp, Artificial Sequence
  Synthetic oligonucleotide
tcacattaccgctttcgttcctagttggtttacaa

SEQ ID NO: 72020 - DNA, 36 bp, Artificial Sequence
  Synthetic oligonucleotide
tacccgcaccaacgacgccccttattcgagctccaa

SEQ ID NO: 72021 - DNA, 36 bp, Artificial Sequence
  Synthetic oligonucleotide
actatacgccacccctaatcttcagagactgatcaa

SEQ ID NO: 72022 - DNA, 36 bp, Artificial Sequence
  Synthetic oligonucleotide
gactgctgacacgatcgcctactcccccaaacagaa

SEQ ID NO: 72023 - DNA, 36 bp, Artificial Sequence
  Synthetic oligonucleotide
atatgagaagggtgggaggatagggaggatgcagaa

SEQ ID NO: 72024 - DNA, 36 bp, Artificial Sequence
  Synthetic oligonucleotide
gaccagtccaatactaacacacgagctacccgggaa

SEQ ID NO: 72025 - DNA, 35 bp, Artificial Sequence
  Synthetic oligonucleotide
gaactgcctcagccgcccctcccgcccgcgttgaa

SEQ ID NO: 72026 - DNA, 36 bp, Artificial Sequence
  Synthetic oligonucleotide
gatgggactaaggtgagggggaggagggtgcgataa

SEQ ID NO: 72027 - DNA, 35 bp, Artificial Sequence
  Synthetic oligonucleotide
atagaccacactcctgtcattggcctgttatataa

SEQ ID NO: 72028 - DNA, 35 bp, Artificial Sequence
  Synthetic oligonucleotide
agatagcacctctagagttcatacaccacaccaca

SEQ ID NO: 72029 - DNA, 36 bp, Artificial Sequence
  Synthetic oligonucleotide
gcacgcctcaccgtttagggcctcgacccacccaca

SEQ ID NO: 72030 - DNA, 36 bp, Artificial Sequence
  Synthetic oligonucleotide
gacaaggcgggcagttccagcctagccacaacccca

SEQ ID NO: 72031 - DNA, 36 bp, Artificial Sequence
  Synthetic oligonucleotide
ttgcgacctgccgaagtaagtctttcccacttccca

SEQ ID NO: 72032 - DNA, 36 bp, Artificial Sequence
  Synthetic oligonucleotide
gtcactacccctgtatacgcaatgcttgtccctcca

SEQ ID NO: 72033 - DNA, 36 bp, Artificial Sequence
  Synthetic oligonucleotide
gcctgggacagctctatctcttcggtagccactgca

SEQ ID NO: 72034 - DNA, 35 bp, Artificial Sequence
  Synthetic oligonucleotide
tccaacgcccttcccctcatcttctgccatctgca

SEQ ID NO: 72035 - DNA, 36 bp, Artificial Sequence
  Synthetic oligonucleotide
gtcaccccctatcaccgtatccagaacctccaatca

SEQ ID NO: 72036 - DNA, 36 bp, Artificial Sequence
  Synthetic oligonucleotide
tgtggagagaagtctgtagggtaggccggcggatca

SEQ ID NO: 72037 - DNA, 36 bp, Artificial Sequence
  Synthetic oligonucleotide
accaacttgcaaccgacttgacttttccagtgatca

SEQ ID NO: 72038 - DNA, 33 bp, Artificial Sequence
  Synthetic oligonucleotide
tgagactctggaggaccttctccatttccctca

SEQ ID NO: 72039 - DNA, 36 bp, Artificial Sequence
  Synthetic oligonucleotide
tcaccgcacgcttcaacagtaaccgcctcacagtca

SEQ ID NO: 72040 - DNA, 37 bp, Artificial Sequence
  Synthetic oligonucleotide
atgcggagagagggcccgggagggtgtgtatgacaga

SEQ ID NO: 72041 - DNA, 37 bp, Artificial Sequence
  Synthetic oligonucleotide
ttggggcttcggggaccacataatgggaggacggaga

SEQ ID NO: 72042 - DNA, 37 bp, Artificial Sequence
  Synthetic oligonucleotide
tacgcgtgtaccactgggcattacttcttcattgaga

SEQ ID NO: 72043 - DNA, 37 bp, Artificial Sequence
  Synthetic oligonucleotide
tatcagcccacgaaatggcttcaacaaatacgcacga

SEQ ID NO: 72044 - DNA, 35 bp, Artificial Sequence
  Synthetic oligonucleotide
tcgcaatgcccttgcaaccctctaagccctcacga

SEQ ID NO: 72045 - DNA, 35 bp, Artificial Sequence
  Synthetic oligonucleotide
tcaccagcggaccgcctgtttcggctacacaccga

SEQ ID NO: 72046 - DNA, 37 bp, Artificial Sequence
  Synthetic oligonucleotide
gtccagcgtttccctcctgccgccttcagcctaccga

SEQ ID NO: 72047 - DNA, 36 bp, Artificial Sequence
  Synthetic oligonucleotide
tgaggcccagccgcgacaccacatcccgctatccga

SEQ ID NO: 72048 - DNA, 37 bp, Artificial Sequence
  Synthetic oligonucleotide
acccgcttcgagaccccgcgttccatcaactgtccga

SEQ ID NO: 72049 - DNA, 35 bp, Artificial Sequence
  Synthetic oligonucleotide
tacgtccaccactttcgatgcggctttatttccga

SEQ ID NO: 72050 - DNA, 36 bp, Artificial Sequence
  Synthetic oligonucleotide
gccataggcggggtggtgaggtctgtgactggagga

SEQ ID NO: 72051 - DNA, 37 bp, Artificial Sequence
  Synthetic oligonucleotide
acacctgcaccctcccacggcctaatggaccatagga

SEQ ID NO: 72052 - DNA, 37 bp, Artificial Sequence
  Synthetic oligonucleotide
gggaggtagagtgcagtagatagagggggattacgga

SEQ ID NO: 72053 - DNA, 37 bp, Artificial Sequence
  Synthetic oligonucleotide
gcaaccccatgtttttggccttcctagtctgtgcgga

SEQ ID NO: 72054 - DNA, 37 bp, Artificial Sequence
  Synthetic oligonucleotide
gacacactgcaggacacgggaacagcgggtgaaggga

SEQ ID NO: 72055 - DNA, 37 bp, Artificial Sequence
  Synthetic oligonucleotide
tagaagggcgatgggcaaaagctgggaatgcgaggga

SEQ ID NO: 72056 - DNA, 35 bp, Artificial Sequence
  Synthetic oligonucleotide
ggaaatgggaacggattcggtggaaggcttgggga

SEQ ID NO: 72057 - DNA, 36 bp, Artificial Sequence
  Synthetic oligonucleotide
taccaaaccaggaccggattaggaaacaaggtggga

SEQ ID NO: 72058 - DNA, 36 bp, Artificial Sequence
  Synthetic oligonucleotide
gacggacatgtaggtgggctacctgacgaggtggga

SEQ ID NO: 72059 - DNA, 37 bp, Artificial Sequence
  Synthetic oligonucleotide
gcatgtatcatccatcccgtcgacagcactacgtgga

SEQ ID NO: 72060 - DNA, 36 bp, Artificial Sequence
  Synthetic oligonucleotide
gtgagaccgggggggggtggaacaggtcatgttgga

SEQ ID NO: 72061 - DNA, 37 bp, Artificial Sequence
  Synthetic oligonucleotide
cccacccatctgttggcactgaaccctgacttaatga

SEQ ID NO: 72062 - DNA, 38 bp, Artificial Sequence
  Synthetic oligonucleotide
gtacgcacctctggccggaaaaatgttgacggacatga

SEQ ID NO: 72063 - DNA, 38 bp, Artificial Sequence
  Synthetic oligonucleotide
acacgccacatgtctccccgtggacccatacaccatga

SEQ ID NO: 72064 - DNA, 35 bp, Artificial Sequence
  Synthetic oligonucleotide
gtggagtcctccaaaagggatgagggtaggtatga

SEQ ID NO: 72065 - DNA, 38 bp, Artificial Sequence
  Synthetic oligonucleotide
gaccccccgtctttcgtgatcttcaatgccaaaactga

SEQ ID NO: 72066 - DNA, 37 bp, Artificial Sequence
  Synthetic oligonucleotide
tcacacaacggcctacacaatttggcgacacacctga

SEQ ID NO: 72067 - DNA, 38 bp, Artificial Sequence
  Synthetic oligonucleotide
aacgccctgcacgccgaggcaacgaggcattttcctga

SEQ ID NO: 72068 - DNA, 38 bp, Artificial Sequence
  Synthetic oligonucleotide
tgactaacatcgtggttttgatttacctctcattctga

SEQ ID NO: 72069 - DNA, 37 bp, Artificial Sequence
  Synthetic oligonucleotide
tgatcccacgtgcgttataacatgacccagccagtga

SEQ ID NO: 72070 - DNA, 36 bp, Artificial Sequence
  Synthetic oligonucleotide
gacacacgggcgcaataaggcaagggggacatgtga

SEQ ID NO: 72071 - DNA, 38 bp, Artificial Sequence
  Synthetic oligonucleotide
gccaccaagccataaggtccagcggactctgcccttga

SEQ ID NO: 72072 - DNA, 38 bp, Artificial Sequence
  Synthetic oligonucleotide
attgccgggaaggtgtagcatccaagtgttggggttga

SEQ ID NO: 72073 - DNA, 37 bp, Artificial Sequence
  Synthetic oligonucleotide
agcaaggaagggagcgaaaaccaggtgggcttgttga

SEQ ID NO: 72074 - DNA, 38 bp, Artificial Sequence
  Synthetic oligonucleotide
gatcgcaaggtcgctccatctaccgacgtcaagtttga

SEQ ID NO: 72075 - DNA, 36 bp, Artificial Sequence
  Synthetic oligonucleotide
actgccactctggtgctccaatcccgtgacacacta

SEQ ID NO: 72076 - DNA, 36 bp, Artificial Sequence
  Synthetic oligonucleotide
tcacccaccaattagttcgcaggttacctacaccta

SEQ ID NO: 72077 - DNA, 35 bp, Artificial Sequence
  Synthetic oligonucleotide
gaccgccgcatgacaattaccacaccgtacagcta

SEQ ID NO: 72078 - DNA, 35 bp, Artificial Sequence
  Synthetic oligonucleotide
gctcatttctgccttcttccacgttgtacgtgcta

SEQ ID NO: 72079 - DNA, 36 bp, Artificial Sequence
  Synthetic oligonucleotide
acatgccgttacaagctcgaatatggtcactctcta

SEQ ID NO: 72080 - DNA, 35 bp, Artificial Sequence
  Synthetic oligonucleotide
acaaaggaggcgatctcggaacgggggggcaatta

SEQ ID NO: 72081 - DNA, 36 bp, Artificial Sequence
  Synthetic oligonucleotide
gattggcggtacataaaaatgatagttaccgcatta

SEQ ID NO: 72082 - DNA, 35 bp, Artificial Sequence
  Synthetic oligonucleotide
gtgacccttgccgtgaaggtgctaattcccggaac

SEQ ID NO: 72083 - DNA, 35 bp, Artificial Sequence
  Synthetic oligonucleotide
tacgttgcttcggcgtaatctacacccatgcccac

SEQ ID NO: 72084 - DNA, 35 bp, Artificial Sequence
  Synthetic oligonucleotide
aagtccaggaccagggtgggttgggtaggtatgac

SEQ ID NO: 72085 - DNA, 35 bp, Artificial Sequence
  Synthetic oligonucleotide
ggactcgttacctgctctttcatgttccgttgtac

SEQ ID NO: 72086 - DNA, 35 bp, Artificial Sequence
  Synthetic oligonucleotide
tctctccaccaccggtatcgatctgaactatcccc

SEQ ID NO: 72087 - DNA, 35 bp, Artificial Sequence
  Synthetic oligonucleotide
ttcacgtgctataattcccgttggtcccagttgcc

SEQ ID NO: 72088 - DNA, 35 bp, Artificial Sequence
  Synthetic oligonucleotide
gaggtgcaacctcagcccttagagcgcgacgctcc

SEQ ID NO: 72089 - DNA, 35 bp, Artificial Sequence
  Synthetic oligonucleotide
gcctgtggcacccgtaccatgcctcttcgttgtcc

SEQ ID NO: 72090 - DNA, 35 bp, Artificial Sequence
  Synthetic oligonucleotide
atcacacgacgccccgcagcaggtccagcaatggc

SEQ ID NO: 72091 - DNA, 35 bp, Artificial Sequence
  Synthetic oligonucleotide
gataacacacatctaactgcggagactcttcctgc

SEQ ID NO: 72092 - DNA, 35 bp, Artificial Sequence
  Synthetic oligonucleotide
gccccatccttgcccctcgtatgtagccgcattgc

SEQ ID NO: 72093 - DNA, 35 bp, Artificial Sequence
  Synthetic oligonucleotide
tgatcccctgacgtgtcccaagcttgcgcgtgctc

SEQ ID NO: 72094 - DNA, 35 bp, Artificial Sequence
  Synthetic oligonucleotide
gtaatccctccgtccggcacttagcaccacatgtc

SEQ ID NO: 72095 - DNA, 35 bp, Artificial Sequence
  Synthetic oligonucleotide
gccctacacgcccgcacgcgatccccgttatcgag

SEQ ID NO: 72096 - DNA, 35 bp, Artificial Sequence
  Synthetic oligonucleotide
aatggacgaacgggaaggcaggggttagcgtgtag

SEQ ID NO: 72097 - DNA, 35 bp, Artificial Sequence
  Synthetic oligonucleotide
atccatggcctgtacgttctacgaggcattttacg

SEQ ID NO: 72098 - DNA, 35 bp, Artificial Sequence
  Synthetic oligonucleotide
gagagctgccaaccggtttgtaatttttgttcgcg

SEQ ID NO: 72099 - DNA, 35 bp, Artificial Sequence
  Synthetic oligonucleotide
tctactgcccctgtgcgcgggaacatctacgatcg

SEQ ID NO: 72100 - DNA, 35 bp, Artificial Sequence
  Synthetic oligonucleotide
atcaatcgatgcgcgccgaccctccgttttgttcg

SEQ ID NO: 72101 - DNA, 35 bp, Artificial Sequence
  Synthetic oligonucleotide
agtcaggcaagaaggggcacacggtcggggcaggg

SEQ ID NO: 72102 - DNA, 35 bp, Artificial Sequence
  Synthetic oligonucleotide
agaaagccaccacatctttcttttccccgcttggg

SEQ ID NO: 72103 - DNA, 34 bp, Artificial Sequence
  Synthetic oligonucleotide
ttgtgcgacaagggctacgggttggtctgttggg

SEQ ID NO: 72104 - DNA, 35 bp, Artificial Sequence
  Synthetic oligonucleotide
ttgtcacgcggcgcttacactagaacatgatcctg

SEQ ID NO: 72105 - DNA, 35 bp, Artificial Sequence
  Synthetic oligonucleotide
acgcggcttatcctcgttatggtctccccaccttg

SEQ ID NO: 72106 - DNA, 35 bp, Artificial Sequence
  Synthetic oligonucleotide
gtcgccactgtgctatttcatgcgcttccactttg

SEQ ID NO: 72107 - DNA, 35 bp, Artificial Sequence
  Synthetic oligonucleotide
ggatgacgacggcactcagtggccctactatcact

SEQ ID NO: 72108 - DNA, 35 bp, Artificial Sequence
  Synthetic oligonucleotide
ttcaagcacgtagcttccacctgcttagcaacgct

SEQ ID NO: 72109 - DNA, 35 bp, Artificial Sequence
  Synthetic oligonucleotide
agccgttccacgctcaccacccagacttcaacgct

SEQ ID NO: 72110 - DNA, 35 bp, Artificial Sequence
  Synthetic oligonucleotide
gcaaaaataggggtgggtggaagagatggcgcgct

SEQ ID NO: 72111 - DNA, 35 bp, Artificial Sequence
  Synthetic oligonucleotide
gaagggggaatgcggtgggttcagttcgactcgct

SEQ ID NO: 72112 - DNA, 35 bp, Artificial Sequence
  Synthetic oligonucleotide
gtgccccgtgatcgcgacccgaactaagcctgtct

SEQ ID NO: 72113 - DNA, 35 bp, Artificial Sequence
  Synthetic oligonucleotide
ggacgcgcgggtttatgcgcacttcctaccgttct

SEQ ID NO: 72114 - DNA, 35 bp, Artificial Sequence
  Synthetic oligonucleotide
gcgtgaatcccgcccctgaaatatgtctgtcactt

SEQ ID NO: 72115 - DNA, 35 bp, Artificial Sequence
  Synthetic oligonucleotide
tcagactatccatcaatccgtatcctgttaacctt

SEQ ID NO: 72116 - DNA, 35 bp, Artificial Sequence
  Synthetic oligonucleotide
agaccgccccggttatgatttttacagcctacgtt

SEQ ID NO: 72117 - DNA, 35 bp, Artificial Sequence
  Synthetic oligonucleotide
gaacactaactctggtgtcacatcgcccacgcttt

SEQ ID NO: 72118 - DNA, 36 bp, Artificial Sequence
  Synthetic oligonucleotide
tctcaaccatgcctggggtcttatttctccaccaaa

SEQ ID NO: 72119 - DNA, 36 bp, Artificial Sequence
  Synthetic oligonucleotide
agacagggtagtaatgggggtggattgggcacgaaa

SEQ ID NO: 72120 - DNA, 35 bp, Artificial Sequence
  Synthetic oligonucleotide
ttgtcatcacagggacgtgccttaaaccatctcaa

SEQ ID NO: 72121 - DNA, 35 bp, Artificial Sequence
  Synthetic oligonucleotide
tctaggggaggggaagcatgagaagaatggttcaa

SEQ ID NO: 72122 - DNA, 35 bp, Artificial Sequence
  Synthetic oligonucleotide
ttgcccatttggagtgcccccgaccttgcccataa

SEQ ID NO: 72123 - DNA, 36 bp, Artificial Sequence
  Synthetic oligonucleotide
gacctcagcccggaccacaatcgtctgccttattaa

SEQ ID NO: 72124 - DNA, 36 bp, Artificial Sequence
  Synthetic oligonucleotide
tcatccacctacctgcccggtcgcatcgtcacttaa

SEQ ID NO: 72125 - DNA, 36 bp, Artificial Sequence
  Synthetic oligonucleotide
ttaccagtgtcaaagctaatcacggcctcccaaaca

SEQ ID NO: 72126 - DNA, 36 bp, Artificial Sequence
  Synthetic oligonucleotide
gcgaccacacgtgcacgatgaagctcctctcgaaca

SEQ ID NO: 72127 - DNA, 36 bp, Artificial Sequence
  Synthetic oligonucleotide
aacaaaccagtccgcggcatctctgcatccctcaca

SEQ ID NO: 72128 - DNA, 35 bp, Artificial Sequence
  Synthetic oligonucleotide
gcgattgccgacccaactatagcaaccgttcacca

SEQ ID NO: 72129 - DNA, 36 bp, Artificial Sequence
  Synthetic oligonucleotide
gcactggtcatctgctcagatccgccatttgtccca

SEQ ID NO: 72130 - DNA, 35 bp, Artificial Sequence
  Synthetic oligonucleotide
aacacccgttgcttaccgtgaggggtcatttccca

SEQ ID NO: 72131 - DNA, 36 bp, Artificial Sequence
  Synthetic oligonucleotide
tagttccacgagcgcctgctgccctaacctgatcca

SEQ ID NO: 72132 - DNA, 36 bp, Artificial Sequence
  Synthetic oligonucleotide
gagcaccctgacgttttcctgcgaaggcttcccgca

SEQ ID NO: 72133 - DNA, 36 bp, Artificial Sequence
  Synthetic oligonucleotide
tgtccaatctgccacgtactctatatccggttcgca

SEQ ID NO: 72134 - DNA, 35 bp, Artificial Sequence
  Synthetic oligonucleotide
tgctttaccccacagagtggtcttcttccctttca

SEQ ID NO: 72135 - DNA, 37 bp, Artificial Sequence
  Synthetic oligonucleotide
gtgaagggatagggggtttatgtatagtagtggcaga

SEQ ID NO: 72136 - DNA, 37 bp, Artificial Sequence
  Synthetic oligonucleotide
gcaagggtaggtgggatgggccgaaacgagggcgaga

SEQ ID NO: 72137 - DNA, 37 bp, Artificial Sequence
  Synthetic oligonucleotide
gacagacaggaggagtcgcaggggcatggcgaataga

SEQ ID NO: 72138 - DNA, 38 bp, Artificial Sequence
  Synthetic oligonucleotide
acaccacgcctccgctatgatcttgttcgccagataga

SEQ ID NO: 72139 - DNA, 35 bp, Artificial Sequence
  Synthetic oligonucleotide
tgggaggacgttttgtcctactagttacacctaga

SEQ ID NO: 72140 - DNA, 37 bp, Artificial Sequence
  Synthetic oligonucleotide
ttgatcctcaagccgctacccctccaccttcagtaga

SEQ ID NO: 72141 - DNA, 37 bp, Artificial Sequence
  Synthetic oligonucleotide
taacccgctacctggtaccatgccatatttgctacga

SEQ ID NO: 72142 - DNA, 36 bp, Artificial Sequence
  Synthetic oligonucleotide
ttcttgcctgctttcactttttcgcacctgtcccga

SEQ ID NO: 72143 - DNA, 37 bp, Artificial Sequence
  Synthetic oligonucleotide
acccgccccttcgggatctgcatgacagttattccga

SEQ ID NO: 72144 - DNA, 37 bp, Artificial Sequence
  Synthetic oligonucleotide
tcaccccgcaacgcccattatggctcgtcctccgcga

SEQ ID NO: 72145 - DNA, 37 bp, Artificial Sequence
  Synthetic oligonucleotide
tcgctccacctttcgcctgccaatcgctacaattcga

SEQ ID NO: 72146 - DNA, 37 bp, Artificial Sequence
  Synthetic oligonucleotide
gccgacgtggggggaaaactttgacaaaaggacagga

SEQ ID NO: 72147 - DNA, 37 bp, Artificial Sequence
  Synthetic oligonucleotide
accgtgggggaggtgggttagggtggttacgtcagga

SEQ ID NO: 72148 - DNA, 37 bp, Artificial Sequence
  Synthetic oligonucleotide
gatgcacctcctttgccatgtgaatccaatttcagga

SEQ ID NO: 72149 - DNA, 37 bp, Artificial Sequence
  Synthetic oligonucleotide
gggtgaacgggaaggggaattaggttgtgccagagga

SEQ ID NO: 72150 - DNA, 36 bp, Artificial Sequence
  Synthetic oligonucleotide
atcgtgggtgggctgggagggacagccatcaccgga

SEQ ID NO: 72151 - DNA, 36 bp, Artificial Sequence
  Synthetic oligonucleotide
gcatatgagggaggggattgggacaacctgtgcgga

SEQ ID NO: 72152 - DNA, 37 bp, Artificial Sequence
  Synthetic oligonucleotide
atgtaggccggaccagggggatgacacggaatgggga

SEQ ID NO: 72153 - DNA, 37 bp, Artificial Sequence
  Synthetic oligonucleotide
tcccatcgggatgggtggtctctgttgtagggtggga

SEQ ID NO: 72154 - DNA, 35 bp, Artificial Sequence
  Synthetic oligonucleotide
taacaattgggtatagcaaagccgggtgggtggga

SEQ ID NO: 72155 - DNA, 37 bp, Artificial Sequence
  Synthetic oligonucleotide
aggagtggaggggaacagtgggtttgtggagtatgga

SEQ ID NO: 72156 - DNA, 37 bp, Artificial Sequence
  Synthetic oligonucleotide
tcgcaggaggcccctcccgtttatcgcttcctctgga

SEQ ID NO: 72157 - DNA, 37 bp, Artificial Sequence
  Synthetic oligonucleotide
tcaatgcagatggaggactttggggactaggcgtgga

SEQ ID NO: 72158 - DNA, 37 bp, Artificial Sequence
  Synthetic oligonucleotide
gagtcgcctggcccacctggacccttcgtatccatga

SEQ ID NO: 72159 - DNA, 38 bp, Artificial Sequence
  Synthetic oligonucleotide
gagaaggtggaaagatgcggaggattaaggttggatga

SEQ ID NO: 72160 - DNA, 37 bp, Artificial Sequence
  Synthetic oligonucleotide
tgtgggaacacggagacagagggagggagggttatga

SEQ ID NO: 72161 - DNA, 37 bp, Artificial Sequence
  Synthetic oligonucleotide
tagccttaacgcctgccttgatatctactacaactga

SEQ ID NO: 72162 - DNA, 37 bp, Artificial Sequence
  Synthetic oligonucleotide
gcctccgagaggcatgtttctatgcaacgtgaactga

SEQ ID NO: 72163 - DNA, 37 bp, Artificial Sequence
  Synthetic oligonucleotide
gtgcttagcctacactgcgctcacaccctatcactga

SEQ ID NO: 72164 - DNA, 38 bp, Artificial Sequence
  Synthetic oligonucleotide
ggtgcggggagacacattgagccacacattccacctga

SEQ ID NO: 72165 - DNA, 38 bp, Artificial Sequence
  Synthetic oligonucleotide
gcgcgtcgtcacgttgtaatatcctgtaattgccctga

SEQ ID NO: 72166 - DNA, 38 bp, Artificial Sequence
  Synthetic oligonucleotide
gtctgctcgtcctcatgtctcattgtaacttcgtctga

SEQ ID NO: 72167 - DNA, 38 bp, Artificial Sequence
  Synthetic oligonucleotide
gagggggatggaagatatgtgtgatgagagctgtctga

SEQ ID NO: 72168 - DNA, 38 bp, Artificial Sequence
  Synthetic oligonucleotide
ggaaacaatatgggtaaggagggaggcgggacaagtga

SEQ ID NO: 72169 - DNA, 37 bp, Artificial Sequence
  Synthetic oligonucleotide
tgaatctgtcgcccatctattccgtgtccttaggtga

SEQ ID NO: 72170 - DNA, 38 bp, Artificial Sequence
  Synthetic oligonucleotide
aaccgtgcgggtaagggtgaaaagtggcgatcgtgtga

SEQ ID NO: 72171 - DNA, 38 bp, Artificial Sequence
  Synthetic oligonucleotide
tgggctggctagggtggaggtggaggtgttggggttga

SEQ ID NO: 72172 - DNA, 38 bp, Artificial Sequence
  Synthetic oligonucleotide
tacgcgcccaatctggctttaataacacaccgctttga

SEQ ID NO: 72173 - DNA, 35 bp, Artificial Sequence
  Synthetic oligonucleotide
gagtgcgccaaggcatcgcgtaccgaacctctata

SEQ ID NO: 72174 - DNA, 36 bp, Artificial Sequence
  Synthetic oligonucleotide
tcagaccttcctcaactctggtccgtgattcaacta

SEQ ID NO: 72175 - DNA, 35 bp, Artificial Sequence
  Synthetic oligonucleotide
acacttcgcccctggcattcattttcaggccacta

SEQ ID NO: 72176 - DNA, 36 bp, Artificial Sequence
  Synthetic oligonucleotide
aacccctccccgcagggggtgtttggattttcccta

SEQ ID NO: 72177 - DNA, 36 bp, Artificial Sequence
  Synthetic oligonucleotide
tgcgtcctaagccgatttcctggtccatcatgccta

SEQ ID NO: 72178 - DNA, 35 bp, Artificial Sequence
  Synthetic oligonucleotide
gcacacgtcactgttccgaaacatctctcatccta

SEQ ID NO: 72179 - DNA, 36 bp, Artificial Sequence
  Synthetic oligonucleotide
gaactcaccccccggtgtcatttcagtaaattgcta

SEQ ID NO: 72180 - DNA, 37 bp, Artificial Sequence
  Synthetic oligonucleotide
ggacatccgccccgtgccgacctcaatacccgacgta

SEQ ID NO: 72181 - DNA, 36 bp, Artificial Sequence
  Synthetic oligonucleotide
accggtccacccttgtctggctgtctctctagctta

SEQ ID NO: 72182 - DNA, 35 bp, Artificial Sequence
  Synthetic oligonucleotide
ttacacaccgcaattatatacgcccctttctctta

SEQ ID NO: 72183 - DNA, 36 bp, Artificial Sequence
  Synthetic oligonucleotide
tattccacttgcccccgcgtactagctacagtctta

SEQ ID NO: 72184 - DNA, 36 bp, Artificial Sequence
  Synthetic oligonucleotide
gatgcataaccagcttgttcgaaatcatcctcgtta

SEQ ID NO: 72185 - DNA, 35 bp, Artificial Sequence
  Synthetic oligonucleotide
ttgaccacccgcgcttgcaaggacagaaccgccac

SEQ ID NO: 72186 - DNA, 35 bp, Artificial Sequence
  Synthetic oligonucleotide
ttgacccgtcccaccaggcctattaagccgtagac

SEQ ID NO: 72187 - DNA, 35 bp, Artificial Sequence
  Synthetic oligonucleotide
atcaacatgcgtcgtatcatcgttcgaaatcctac

SEQ ID NO: 72188 - DNA, 35 bp, Artificial Sequence
  Synthetic oligonucleotide
ttgcctactcaactcgcgtctcgatccctcgctac

SEQ ID NO: 72189 - DNA, 35 bp, Artificial Sequence
  Synthetic oligonucleotide
ttcgcacgcaatcgccgtccccgcccgaaaacacc

SEQ ID NO: 72190 - DNA, 35 bp, Artificial Sequence
  Synthetic oligonucleotide
gcgtgctgtcggacatccgccactgcgttgctccc

SEQ ID NO: 72191 - DNA, 35 bp, Artificial Sequence
  Synthetic oligonucleotide
tcaggcccccgtagcgcgttaatctatctcgctcc

SEQ ID NO: 72192 - DNA, 35 bp, Artificial Sequence
  Synthetic oligonucleotide
tgtgttcaccactctggtgctcgttcttctcttcc

SEQ ID NO: 72193 - DNA, 35 bp, Artificial Sequence
  Synthetic oligonucleotide
tcatgagtgcgcatcaaattgcgttgttgttttcc

SEQ ID NO: 72194 - DNA, 35 bp, Artificial Sequence
  Synthetic oligonucleotide
aaccagcctataacggctcactatgaaactctggc

SEQ ID NO: 72195 - DNA, 35 bp, Artificial Sequence
  Synthetic oligonucleotide
attgggcccgaactcgaccccacataggactactc

SEQ ID NO: 72196 - DNA, 35 bp, Artificial Sequence
  Synthetic oligonucleotide
gtcacgaactggaacgaatgattatgataaacctc

SEQ ID NO: 72197 - DNA, 35 bp, Artificial Sequence
  Synthetic oligonucleotide
gcacccccttccatcttttgcgcatcatgaacgtc

SEQ ID NO: 72198 - DNA, 35 bp, Artificial Sequence
  Synthetic oligonucleotide
atacctcccgcatgaatgctaggcctggtactgtc

SEQ ID NO: 72199 - DNA, 35 bp, Artificial Sequence
  Synthetic oligonucleotide
gcacaactagcgccgccgtttcccattaccgcttc

SEQ ID NO: 72200 - DNA, 35 bp, Artificial Sequence
  Synthetic oligonucleotide
tgtgaccacggccttggtgtcttccgtttacgttc

SEQ ID NO: 72201 - DNA, 35 bp, Artificial Sequence
  Synthetic oligonucleotide
tccgaagctgggtatttgctttcttccgctggttc

SEQ ID NO: 72202 - DNA, 35 bp, Artificial Sequence
  Synthetic oligonucleotide
gtccgagcattcagcagcacgccccgccccccaag

SEQ ID NO: 72203 - DNA, 35 bp, Artificial Sequence
  Synthetic oligonucleotide
tgcacgtgcccactcgcccatggtagtcactagag

SEQ ID NO: 72204 - DNA, 35 bp, Artificial Sequence
  Synthetic oligonucleotide
ggatgtgggggggcgtgatgaggcacaatactgag

SEQ ID NO: 72205 - DNA, 35 bp, Artificial Sequence
  Synthetic oligonucleotide
gtccatgccatcgggatcccttcctcgctttatag

SEQ ID NO: 72206 - DNA, 36 bp, Artificial Sequence
  Synthetic oligonucleotide
gacgcccacgcaatacgcgagctaggactcttgacg

SEQ ID NO: 72207 - DNA, 35 bp, Artificial Sequence
  Synthetic oligonucleotide
gcgcccctggctgagtttttctggcttcctaaccg

SEQ ID NO: 72208 - DNA, 35 bp, Artificial Sequence
  Synthetic oligonucleotide
gatccccgaggatcacgggtcacctttcgagcccg

SEQ ID NO: 72209 - DNA, 35 bp, Artificial Sequence
  Synthetic oligonucleotide
gatgggacggtagaacggcataggattcatgaagg

SEQ ID NO: 72210 - DNA, 35 bp, Artificial Sequence
  Synthetic oligonucleotide
gatccacccctttctgttacatgcggtgagccatg

SEQ ID NO: 72211 - DNA, 35 bp, Artificial Sequence
  Synthetic oligonucleotide
ccacccgcccttggcgtacaaacctggtcctactg

SEQ ID NO: 72212 - DNA, 35 bp, Artificial Sequence
  Synthetic oligonucleotide
gtgtggccccttctcccctgatccgttcaaagttg

SEQ ID NO: 72213 - DNA, 35 bp, Artificial Sequence
  Synthetic oligonucleotide
gtgcgccatggaactgttctacggaggttttgttg

SEQ ID NO: 72214 - DNA, 35 bp, Artificial Sequence
  Synthetic oligonucleotide
gccggagtccatacggatttttgactaacccccat

SEQ ID NO: 72215 - DNA, 35 bp, Artificial Sequence
  Synthetic oligonucleotide
ttagccccactcacactcagattgtctgaagtcat

SEQ ID NO: 72216 - DNA, 35 bp, Artificial Sequence
  Synthetic oligonucleotide
actagagccaagctgcgattacacaacctttcact

SEQ ID NO: 72217 - DNA, 35 bp, Artificial Sequence
  Synthetic oligonucleotide
gcagtcgtagacgctattccctgtaccgaagccct

SEQ ID NO: 72218 - DNA, 35 bp, Artificial Sequence
  Synthetic oligonucleotide
gctcgttgcgcgatctatgaaacttctccaggcct

SEQ ID NO: 72219 - DNA, 35 bp, Artificial Sequence
  Synthetic oligonucleotide
gcaaacatcgtggggattgacggatgagggggagt

SEQ ID NO: 72220 - DNA, 35 bp, Artificial Sequence
  Synthetic oligonucleotide
actcccctaccctcagcgacatagtccgggccatt

SEQ ID NO: 72221 - DNA, 35 bp, Artificial Sequence
  Synthetic oligonucleotide
agcccagccccgatgttcccctgccgactcgtatt

SEQ ID NO: 72222 - DNA, 35 bp, Artificial Sequence
  Synthetic oligonucleotide
acctgacgcagtatggttcgattggccgtaacctt

SEQ ID NO: 72223 - DNA, 35 bp, Artificial Sequence
  Synthetic oligonucleotide
ggaacacgtcattttcatacctcgatcttctagtt

SEQ ID NO: 72224 - DNA, 35 bp, Artificial Sequence
  Synthetic oligonucleotide
ttagcatgccccgagtccattggcaattacttttt

SEQ ID NO: 72225 - DNA, 36 bp, Artificial Sequence
  Synthetic oligonucleotide
gaccaggtggatcctggcttttccagacaagttcaa

SEQ ID NO: 72226 - DNA, 35 bp, Artificial Sequence
  Synthetic oligonucleotide
acctgtctccctcaacctcgagaagttctactgaa

SEQ ID NO: 72227 - DNA, 36 bp, Artificial Sequence
  Synthetic oligonucleotide
gccgccaccaggtaccatggcttctatacaacctaa

SEQ ID NO: 72228 - DNA, 35 bp, Artificial Sequence
  Synthetic oligonucleotide
tataaccgtcagcgagcttaacttcaccactctaa

SEQ ID NO: 72229 - DNA, 36 bp, Artificial Sequence
  Synthetic oligonucleotide
aactaccagcctaatcgcggcacccgctcccgttaa

SEQ ID NO: 72230 - DNA, 35 bp, Artificial Sequence
  Synthetic oligonucleotide
gaggtcaggggccgcaaggggcgcagggagaaaca

SEQ ID NO: 72231 - DNA, 36 bp, Artificial Sequence
  Synthetic oligonucleotide
taacagggggcgggaaaccgggtagggcggaccaca

SEQ ID NO: 72232 - DNA, 36 bp, Artificial Sequence
  Synthetic oligonucleotide
tcaccccttggtggtctgctatttcatcttcccaca

SEQ ID NO: 72233 - DNA, 35 bp, Artificial Sequence
  Synthetic oligonucleotide
gcccacgagtaccggtggcccttctgtaacataca

SEQ ID NO: 72234 - DNA, 36 bp, Artificial Sequence
  Synthetic oligonucleotide
gagccgtaccatgagttcctagggctccagactaca

SEQ ID NO: 72235 - DNA, 35 bp, Artificial Sequence
  Synthetic oligonucleotide
gaccccagtacggttggtcttgcctgcccctccca

SEQ ID NO: 72236 - DNA, 36 bp, Artificial Sequence
  Synthetic oligonucleotide
gactacgtttgtcctcgctgccattcataatcgcca

SEQ ID NO: 72237 - DNA, 33 bp, Artificial Sequence
  Synthetic oligonucleotide
ttgagttgccattttatcagcgcctcgtctcca

SEQ ID NO: 72238 - DNA, 35 bp, Artificial Sequence
  Synthetic oligonucleotide
gtgacccaccgccaggttttgctcctggtatcgca

SEQ ID NO: 72239 - DNA, 36 bp, Artificial Sequence
  Synthetic oligonucleotide
gtgccaccctccaacaagggacctgagactggggca

SEQ ID NO: 72240 - DNA, 35 bp, Artificial Sequence
  Synthetic oligonucleotide
gcacactaaccgctgaagggtacgcacataatgca

SEQ ID NO: 72241 - DNA, 36 bp, Artificial Sequence
  Synthetic oligonucleotide
ccggatgccactagactgtccccgaatagctactca

SEQ ID NO: 72242 - DNA, 36 bp, Artificial Sequence
  Synthetic oligonucleotide
tctcataacccaccggcccactgacctggatcctca

SEQ ID NO: 72243 - DNA, 36 bp, Artificial Sequence
  Synthetic oligonucleotide
gcaggacgggtggggtaaacttctttcttgctgtca

SEQ ID NO: 72244 - DNA, 34 bp, Artificial Sequence
  Synthetic oligonucleotide
tccacaggccattattacaataacgtttagttca

SEQ ID NO: 72245 - DNA, 37 bp, Artificial Sequence
  Synthetic oligonucleotide
gtgggggggccgtggattatatgtcggcggaacgaga

SEQ ID NO: 72246 - DNA, 37 bp, Artificial Sequence
  Synthetic oligonucleotide
tctcgcgaaaagggggccttggagtatgacggggaga

SEQ ID NO: 72247 - DNA, 36 bp, Artificial Sequence
  Synthetic oligonucleotide
ttacggccctcctcccgctattttcaccgtttgaga

SEQ ID NO: 72248 - DNA, 37 bp, Artificial Sequence
  Synthetic oligonucleotide
gacgtgggcggtggatctggtgggaggacgcacacga

SEQ ID NO: 72249 - DNA, 37 bp, Artificial Sequence
  Synthetic oligonucleotide
atccgccatcaccttatcctgtatcaatgaccgacga

SEQ ID NO: 72250 - DNA, 36 bp, Artificial Sequence
  Synthetic oligonucleotide
tttacgccgcaacttctagaggggagctcaatgcga

SEQ ID NO: 72251 - DNA, 37 bp, Artificial Sequence
  Synthetic oligonucleotide
tcgaaacggactgaaaaaacggtggacgcttgaagga

SEQ ID NO: 72252 - DNA, 36 bp, Artificial Sequence
  Synthetic oligonucleotide
ttgaaccaccaactcttattattctgtccctaagga

SEQ ID NO: 72253 - DNA, 36 bp, Artificial Sequence
  Synthetic oligonucleotide
gatggccgtggcaaagcgaaggacagagggtacgga

SEQ ID NO: 72254 - DNA, 37 bp, Artificial Sequence
  Synthetic oligonucleotide
gtacgtaacgtgcgggaggggtaaggttaggggcgga

SEQ ID NO: 72255 - DNA, 35 bp, Artificial Sequence
  Synthetic oligonucleotide
atgacagactcgcaaccatcctacccgtaagggga

SEQ ID NO: 72256 - DNA, 37 bp, Artificial Sequence
  Synthetic oligonucleotide
acacctctgacgctctcatctctacatcaccggggga

SEQ ID NO: 72257 - DNA, 37 bp, Artificial Sequence
  Synthetic oligonucleotide
ggggtgggcgagggcaaaatgggtgaagattggggga

SEQ ID NO: 72258 - DNA, 35 bp, Artificial Sequence
  Synthetic oligonucleotide
gttggatggaggtagggctgagcttagaaaatgga

SEQ ID NO: 72259 - DNA, 36 bp, Artificial Sequence
  Synthetic oligonucleotide
gcacccccgatccatcaagaccatctatgcagtgga

SEQ ID NO: 72260 - DNA, 36 bp, Artificial Sequence
  Synthetic oligonucleotide
gagtaggaaccgggaagggaagggatgtacgttgga

SEQ ID NO: 72261 - DNA, 37 bp, Artificial Sequence
  Synthetic oligonucleotide
gagttagaagagggggtggttggggatggaggttgga

SEQ ID NO: 72262 - DNA, 36 bp, Artificial Sequence
  Synthetic oligonucleotide
tagtgcgcaagacactccgccgacatcctgacatga

SEQ ID NO: 72263 - DNA, 37 bp, Artificial Sequence
  Synthetic oligonucleotide
gtcggaacgctcgtacttcttcgctgaaaatgcatga

SEQ ID NO: 72264 - DNA, 38 bp, Artificial Sequence
  Synthetic oligonucleotide
tgtaggttgcagcaggggggtgaaatggttgtggatga

SEQ ID NO: 72265 - DNA, 38 bp, Artificial Sequence
  Synthetic oligonucleotide
gagacgtccggaaatgctgggctggaggaagggactga

SEQ ID NO: 72266 - DNA, 38 bp, Artificial Sequence
  Synthetic oligonucleotide
accgttgtcgcctcttgacatttgattcgtacacctga

SEQ ID NO: 72267 - DNA, 37 bp, Artificial Sequence
  Synthetic oligonucleotide
gacaacccttgtggagttatttcattgccaaccctga

SEQ ID NO: 72268 - DNA, 38 bp, Artificial Sequence
  Synthetic oligonucleotide
tgcgtgcccgtatcctatctgaatttgcttaaccctga

SEQ ID NO: 72269 - DNA, 38 bp, Artificial Sequence
  Synthetic oligonucleotide
tagaccagatattccatgccgtattgttgccaccctga

SEQ ID NO: 72270 - DNA, 38 bp, Artificial Sequence
  Synthetic oligonucleotide
tgatgcctatgctacatccacctcacgaaggggcctga

SEQ ID NO: 72271 - DNA, 38 bp, Artificial Sequence
  Synthetic oligonucleotide
gtctgaacagcggtttactacggtacttcccctcctga

SEQ ID NO: 72272 - DNA, 38 bp, Artificial Sequence
  Synthetic oligonucleotide
tgtcgccgccgcacctgcaaatgtctcgtacgagctga

SEQ ID NO: 72273 - DNA, 36 bp, Artificial Sequence
  Synthetic oligonucleotide
tgtccggggcaattgctactttcccatttctgctga

SEQ ID NO: 72274 - DNA, 38 bp, Artificial Sequence
  Synthetic oligonucleotide
tccaccaactgggacgccattaccgatcttcttgctga

SEQ ID NO: 72275 - DNA, 37 bp, Artificial Sequence
  Synthetic oligonucleotide
gattggtagggtggagggcggggatggtccaaagtga

SEQ ID NO: 72276 - DNA, 38 bp, Artificial Sequence
  Synthetic oligonucleotide
accgctcgtgcggggtaatactggagggggaaaggtga

SEQ ID NO: 72277 - DNA, 38 bp, Artificial Sequence
  Synthetic oligonucleotide
tgacttgccgcctcctataccattatttcgcccggtga

SEQ ID NO: 72278 - DNA, 38 bp, Artificial Sequence
  Synthetic oligonucleotide
tgagcgtgtcgttgcccaaaactcttgcacttcattga

SEQ ID NO: 72279 - DNA, 37 bp, Artificial Sequence
  Synthetic oligonucleotide
ttccgaaccatcttgctatccttgtcatcgcgattga

SEQ ID NO: 72280 - DNA, 38 bp, Artificial Sequence
  Synthetic oligonucleotide
tgcactcgctgcaccgtgagccactaggttgaacttga

SEQ ID NO: 72281 - DNA, 36 bp, Artificial Sequence
  Synthetic oligonucleotide
agcctgtggcgccccgaccttctgcgtatcccttga

SEQ ID NO: 72282 - DNA, 38 bp, Artificial Sequence
  Synthetic oligonucleotide
acgcaaccaagttggtgtcgaccctgcgttttccttga

SEQ ID NO: 72283 - DNA, 36 bp, Artificial Sequence
  Synthetic oligonucleotide
tcacgacaaggatcacaacggttgggccacatttga

SEQ ID NO: 72284 - DNA, 38 bp, Artificial Sequence
  Synthetic oligonucleotide
gcctgagccctccgctaactggttctcgtcatctttga

SEQ ID NO: 72285 - DNA, 37 bp, Artificial Sequence
  Synthetic oligonucleotide
tcttcaccctcccgttcacggaagttcacagttttga

SEQ ID NO: 72286 - DNA, 36 bp, Artificial Sequence
  Synthetic oligonucleotide
tctccctcgcccctgccaccagctccgtacaccata

SEQ ID NO: 72287 - DNA, 36 bp, Artificial Sequence
  Synthetic oligonucleotide
gtgtagtggagagggagcgaagtgacaacagggata

SEQ ID NO: 72288 - DNA, 35 bp, Artificial Sequence
  Synthetic oligonucleotide
ttagcatgggactaacggtgggggtaggcagtata

SEQ ID NO: 72289 - DNA, 36 bp, Artificial Sequence
  Synthetic oligonucleotide
gaaccgctacggtatttcttgtgcgtttcttaccta

SEQ ID NO: 72290 - DNA, 36 bp, Artificial Sequence
  Synthetic oligonucleotide
ccagccacgcctgggtctggccatctttccttccta

SEQ ID NO: 72291 - DNA, 35 bp, Artificial Sequence
  Synthetic oligonucleotide
tccacctgcctcacacggacacatactcgcccgta

SEQ ID NO: 72292 - DNA, 36 bp, Artificial Sequence
  Synthetic oligonucleotide
ttagcggagcccgatgcttgctctcaacattctgta

SEQ ID NO: 72293 - DNA, 35 bp, Artificial Sequence
  Synthetic oligonucleotide
gctgcccctcattcgactttcaggtcacgtactta

SEQ ID NO: 72294 - DNA, 32 bp, Artificial Sequence
  Synthetic oligonucleotide
acccgatcgccctacaacgcccccccttgtta

SEQ ID NO: 72295 - DNA, 36 bp, Artificial Sequence
  Synthetic oligonucleotide
ttagtccgccttctatttagaccttcaccgcgttta

SEQ ID NO: 72296 - DNA, 36 bp, Artificial Sequence
  Synthetic oligonucleotide
gcccagagcacgaactcgcgatagatcaccatttta

SEQ ID NO: 72297 - DNA, 35 bp, Artificial Sequence
  Synthetic oligonucleotide
acaagccccagctgctacctcaactctaattgaac

SEQ ID NO: 72298 - DNA, 35 bp, Artificial Sequence
  Synthetic oligonucleotide
tttgtcctcgaccgtctcgcttcttctctcagcac

SEQ ID NO: 72299 - DNA, 35 bp, Artificial Sequence
  Synthetic oligonucleotide
actggtgatgggggcttctaaggtgtgtgcggcac

SEQ ID NO: 72300 - DNA, 35 bp, Artificial Sequence
  Synthetic oligonucleotide
aaatcgctagctgccagcattcctcgactcctcac

SEQ ID NO: 72301 - DNA, 35 bp, Artificial Sequence
  Synthetic oligonucleotide
tatatcccccgggcaatgccaagctaccttgctac

SEQ ID NO: 72302 - DNA, 35 bp, Artificial Sequence
  Synthetic oligonucleotide
attagccccatcactggatccacgcagaccagtac

SEQ ID NO: 72303 - DNA, 35 bp, Artificial Sequence
  Synthetic oligonucleotide
taccagccgccacttgactacacttgattcctacc

SEQ ID NO: 72304 - DNA, 35 bp, Artificial Sequence
  Synthetic oligonucleotide
tgagcctcgaaagcttaacgtctcccctgacgccc

SEQ ID NO: 72305 - DNA, 35 bp, Artificial Sequence
  Synthetic oligonucleotide
gacctggataatcacaatctatgagccacccgccc

SEQ ID NO: 72306 - DNA, 35 bp, Artificial Sequence
  Synthetic oligonucleotide
tgacgtacactgtaccccatagaatagcgattccc

SEQ ID NO: 72307 - DNA, 35 bp, Artificial Sequence
  Synthetic oligonucleotide
tgtcaaaaccccgccttacgtctttcaggtctgcc

SEQ ID NO: 72308 - DNA, 35 bp, Artificial Sequence
  Synthetic oligonucleotide
agtacatccggaaagccgttaagcgccgatactcc

SEQ ID NO: 72309 - DNA, 35 bp, Artificial Sequence
  Synthetic oligonucleotide
tctaccctggctgccattcgtttcggcaactgtcc

SEQ ID NO: 72310 - DNA, 35 bp, Artificial Sequence
  Synthetic oligonucleotide
gcccactccccagtacgtttgtcttacggatttcc

SEQ ID NO: 72311 - DNA, 35 bp, Artificial Sequence
  Synthetic oligonucleotide
gctcgcctaggtcggccgttacaaattatttccgc

SEQ ID NO: 72312 - DNA, 35 bp, Artificial Sequence
  Synthetic oligonucleotide
atgccatgaggggtgtttactgcagtgaggggcgc

SEQ ID NO: 72313 - DNA, 35 bp, Artificial Sequence
  Synthetic oligonucleotide
atcacgcgccccatacaaacggatcgcctttatgc

SEQ ID NO: 72314 - DNA, 35 bp, Artificial Sequence
  Synthetic oligonucleotide
gacacgcaccgcaacccgacacatcccgtgacctc

SEQ ID NO: 72315 - DNA, 35 bp, Artificial Sequence
  Synthetic oligonucleotide
gcaatccggcgttctgcgccttaacttaccatgtc

SEQ ID NO: 72316 - DNA, 35 bp, Artificial Sequence
  Synthetic oligonucleotide
tccgtcaggcacagccagtgatctttcatgtcttc

SEQ ID NO: 72317 - DNA, 35 bp, Artificial Sequence
  Synthetic oligonucleotide
gaccgcgggcgttcctttcatcacccttgtgtttc

SEQ ID NO: 72318 - DNA, 35 bp, Artificial Sequence
  Synthetic oligonucleotide
gttggggaaatggcggtatgacttagggaacaaag

SEQ ID NO: 72319 - DNA, 35 bp, Artificial Sequence
  Synthetic oligonucleotide
acccaccacagcgcttttgagagcaacaaaggtag

SEQ ID NO: 72320 - DNA, 35 bp, Artificial Sequence
  Synthetic oligonucleotide
gcgctattcgcatatgtgactgtcccccgattccg

SEQ ID NO: 72321 - DNA, 35 bp, Artificial Sequence
  Synthetic oligonucleotide
tccgttccacgcaccctggttatcgatatcttccg

SEQ ID NO: 72322 - DNA, 35 bp, Artificial Sequence
  Synthetic oligonucleotide
accgaacctcatcagacatcacccggtttctcgcg

SEQ ID NO: 72323 - DNA, 35 bp, Artificial Sequence
  Synthetic oligonucleotide
accaaggtcgcgaggaggagggtttcggtggtgcg

SEQ ID NO: 72324 - DNA, 35 bp, Artificial Sequence
  Synthetic oligonucleotide
ttttccgcctggtttccacccctatgtcttttgcg

SEQ ID NO: 72325 - DNA, 35 bp, Artificial Sequence
  Synthetic oligonucleotide
acctcagccgcgctaacccagtgcacctactttcg

SEQ ID NO: 72326 - DNA, 35 bp, Artificial Sequence
  Synthetic oligonucleotide
atggatgtcgtataagtgtgattatgggggggagg

SEQ ID NO: 72327 - DNA, 35 bp, Artificial Sequence
  Synthetic oligonucleotide
gcaacgcccggcactcaccctctctattaaagggg

SEQ ID NO: 72328 - DNA, 35 bp, Artificial Sequence
  Synthetic oligonucleotide
actggtggtgggtgtgggtacggtcggagacgggg

SEQ ID NO: 72329 - DNA, 35 bp, Artificial Sequence
  Synthetic oligonucleotide
acattatgccgattcttcctacctcgcactccatg

SEQ ID NO: 72330 - DNA, 37 bp, Artificial Sequence
  Synthetic oligonucleotide
atggcccgccatacctcaggaccgacaataccccctg

SEQ ID NO: 72331 - DNA, 35 bp, Artificial Sequence
  Synthetic oligonucleotide
accatcacgcccgttagtccgtcttaccagctctg

SEQ ID NO: 72332 - DNA, 35 bp, Artificial Sequence
  Synthetic oligonucleotide
tgattcaacgcacttccctattccctccgtgagtg

SEQ ID NO: 72333 - DNA, 35 bp, Artificial Sequence
  Synthetic oligonucleotide
atcaaaccgagcctcctccgtacacaggccacttg

SEQ ID NO: 72334 - DNA, 35 bp, Artificial Sequence
  Synthetic oligonucleotide
atggtgtgggtggggcagaacggtctggcatcaat

SEQ ID NO: 72335 - DNA, 34 bp, Artificial Sequence
  Synthetic oligonucleotide
taatgacgtaccacaccggttcacccttcaccat

SEQ ID NO: 72336 - DNA, 35 bp, Artificial Sequence
  Synthetic oligonucleotide
gacgagccccgtgcccggtgactcacctaacccat

SEQ ID NO: 72337 - DNA, 35 bp, Artificial Sequence
  Synthetic oligonucleotide
gccccgccacacccggagtaagggaatggtcccat

SEQ ID NO: 72338 - DNA, 35 bp, Artificial Sequence
  Synthetic oligonucleotide
tcgcgcaccctctcgtctgttctggctccgctcat

SEQ ID NO: 72339 - DNA, 35 bp, Artificial Sequence
  Synthetic oligonucleotide
atgtcacttctagccgcgacgcctcccgaattcat

SEQ ID NO: 72340 - DNA, 35 bp, Artificial Sequence
  Synthetic oligonucleotide
taccacgggagccccatgtcgctcttacgatcgct

SEQ ID NO: 72341 - DNA, 35 bp, Artificial Sequence
  Synthetic oligonucleotide
atgcatgtccgcatggatactgattctacctcgct

SEQ ID NO: 72342 - DNA, 35 bp, Artificial Sequence
  Synthetic oligonucleotide
tccaagggtgcgatcgtctcaagttttattgctct

SEQ ID NO: 72343 - DNA, 35 bp, Artificial Sequence
  Synthetic oligonucleotide
gcatgctgcaccaaacatgccgcgacgttcttagt

SEQ ID NO: 72344 - DNA, 35 bp, Artificial Sequence
  Synthetic oligonucleotide
accatcccgctcggcttaccgcagcctttccacgt

SEQ ID NO: 72345 - DNA, 35 bp, Artificial Sequence
  Synthetic oligonucleotide
tgatgtgtacctagtcccctttaagtgtttctggt

SEQ ID NO: 72346 - DNA, 35 bp, Artificial Sequence
  Synthetic oligonucleotide
tcactcgccctaagggcccttcccaaactatgatt

SEQ ID NO: 72347 - DNA, 35 bp, Artificial Sequence
  Synthetic oligonucleotide
gtgagcactatggtcgcacattacggatataattt

SEQ ID NO: 72348 - DNA, 35 bp, Artificial Sequence
  Synthetic oligonucleotide
gtgcgaggtcgcataccactcgattgagccgattt

SEQ ID NO: 72349 - DNA, 35 bp, Artificial Sequence
  Synthetic oligonucleotide
gcttcatcctggccgtccagcgtacccgcacgttt

SEQ ID NO: 72350 - DNA, 35 bp, Artificial Sequence
  Synthetic oligonucleotide
tggggcgcccactgagcttgttttgccacggtttt

SEQ ID NO: 72351 - DNA, 36 bp, Artificial Sequence
  Synthetic oligonucleotide
gctgggaaagaggtaagggacggggcgcgctacaaa

SEQ ID NO: 72352 - DNA, 35 bp, Artificial Sequence
  Synthetic oligonucleotide
tctacacccggcttatgccatctagtacgctgaaa

SEQ ID NO: 72353 - DNA, 36 bp, Artificial Sequence
  Synthetic oligonucleotide
actgggcgacgaagaacacacgggcaaatgttgaaa

SEQ ID NO: 72354 - DNA, 36 bp, Artificial Sequence
  Synthetic oligonucleotide
tcatccgttccccatcgttctatgaccttccctaaa

SEQ ID NO: 72355 - DNA, 36 bp, Artificial Sequence
  Synthetic oligonucleotide
tttggaccgacccacctccctcctctcgcgacgcaa

SEQ ID NO: 72356 - DNA, 36 bp, Artificial Sequence
  Synthetic oligonucleotide
atcacccactgtctatcgcccctacccccgcgtcaa

SEQ ID NO: 72357 - DNA, 36 bp, Artificial Sequence
  Synthetic oligonucleotide
gtctgggaacgggggggtatttataggtggcaagaa

SEQ ID NO: 72358 - DNA, 36 bp, Artificial Sequence
  Synthetic oligonucleotide
tccatcactgcttggcccgcccgtagccgatacgaa

SEQ ID NO: 72359 - DNA, 35 bp, Artificial Sequence
  Synthetic oligonucleotide
actcatcccgaatcgtcgtaagcccgcttcactaa

SEQ ID NO: 72360 - DNA, 36 bp, Artificial Sequence
  Synthetic oligonucleotide
tcatcgctgccggatctggcctcggataaactgtaa

SEQ ID NO: 72361 - DNA, 36 bp, Artificial Sequence
  Synthetic oligonucleotide
gacacacgtcacgtatacataaggaagtcctcttaa

SEQ ID NO: 72362 - DNA, 35 bp, Artificial Sequence
  Synthetic oligonucleotide
gtcgaggtgctcgaaagtggaggtggggtgtaaca

SEQ ID NO: 72363 - DNA, 36 bp, Artificial Sequence
  Synthetic oligonucleotide
gcccgcatggccggtctcattaggctttgtagcaca

SEQ ID NO: 72364 - DNA, 35 bp, Artificial Sequence
  Synthetic oligonucleotide
accactcctgagcttggaggttatgtccaatcaca

SEQ ID NO: 72365 - DNA, 36 bp, Artificial Sequence
  Synthetic oligonucleotide
ttgtgggacatggagggaaggataagtcaccggaca

SEQ ID NO: 72366 - DNA, 36 bp, Artificial Sequence
  Synthetic oligonucleotide
gcccaacgagtgattcggttctcaagccacttgcca

SEQ ID NO: 72367 - DNA, 36 bp, Artificial Sequence
  Synthetic oligonucleotide
acgttcctccggctaagggctctattaatccatcca

SEQ ID NO: 72368 - DNA, 36 bp, Artificial Sequence
  Synthetic oligonucleotide
agacgccgcctaagtattcaggcacatacttctcca

SEQ ID NO: 72369 - DNA, 35 bp, Artificial Sequence
  Synthetic oligonucleotide
gcaccgttgcgctctcttgcgtctgccttgtagca

SEQ ID NO: 72370 - DNA, 36 bp, Artificial Sequence
  Synthetic oligonucleotide
gcatcttgaaccagcaccgtgtcgctctcacctgca

SEQ ID NO: 72371 - DNA, 36 bp, Artificial Sequence
  Synthetic oligonucleotide
ataccccacctagccatgttctcattgcactttgca

SEQ ID NO: 72372 - DNA, 36 bp, Artificial Sequence
  Synthetic oligonucleotide
aacaccggcggtacacgggaaggccccaccacatca

SEQ ID NO: 72373 - DNA, 37 bp, Artificial Sequence
  Synthetic oligonucleotide
agacctaccatccaagaggatctttgagccaccatca

SEQ ID NO: 72374 - DNA, 37 bp, Artificial Sequence
  Synthetic oligonucleotide
gtcagagcatggggaggttagtgctgagggcgcgaga

SEQ ID NO: 72375 - DNA, 36 bp, Artificial Sequence
  Synthetic oligonucleotide
atgcacaacacaactgtttcacttcatggacctaga

SEQ ID NO: 72376 - DNA, 36 bp, Artificial Sequence
  Synthetic oligonucleotide
ggagcaaagtgagcgggttaggggacgtttggtaga

SEQ ID NO: 72377 - DNA, 37 bp, Artificial Sequence
  Synthetic oligonucleotide
tcccagcgcttattccgtctcaccgtagctacaacga

SEQ ID NO: 72378 - DNA, 36 bp, Artificial Sequence
  Synthetic oligonucleotide
aaatcgacgccccaccttcacctgtcatctcaccga

SEQ ID NO: 72379 - DNA, 37 bp, Artificial Sequence
  Synthetic oligonucleotide
gctcgacaccgcaagcatcccatgagtacgctaccga

SEQ ID NO: 72380 - DNA, 37 bp, Artificial Sequence
  Synthetic oligonucleotide
ttactaccgtacgcatataccgacctactcagcccga

SEQ ID NO: 72381 - DNA, 37 bp, Artificial Sequence
  Synthetic oligonucleotide
gagggcacaattccgttgccggaccacccactcccga

SEQ ID NO: 72382 - DNA, 37 bp, Artificial Sequence
  Synthetic oligonucleotide
tcgaccggggcatcccaccagccccttccgtactcga

SEQ ID NO: 72383 - DNA, 37 bp, Artificial Sequence
  Synthetic oligonucleotide
gaacaacctgagctcttttcgaaccaggcgcattcga

SEQ ID NO: 72384 - DNA, 37 bp, Artificial Sequence
  Synthetic oligonucleotide
gcacacaacctcgcaattacgccctagctccaccgga

SEQ ID NO: 72385 - DNA, 37 bp, Artificial Sequence
  Synthetic oligonucleotide
tgaaggttggaacatggggaacacgtgggacgaggga

SEQ ID NO: 72386 - DNA, 37 bp, Artificial Sequence
  Synthetic oligonucleotide
gtggcgtgagggagggggtggagtgttattgccggga

SEQ ID NO: 72387 - DNA, 36 bp, Artificial Sequence
  Synthetic oligonucleotide
ggggagtgatcgcgaatggatcgggctaggagggga

SEQ ID NO: 72388 - DNA, 38 bp, Artificial Sequence
  Synthetic oligonucleotide
atgacaaactccaacgggaggagggaagaccgtaatga

SEQ ID NO: 72389 - DNA, 38 bp, Artificial Sequence
  Synthetic oligonucleotide
tttgccccacaacgccttttacagtcggttaatcatga

SEQ ID NO: 72390 - DNA, 37 bp, Artificial Sequence
  Synthetic oligonucleotide
tccctcacatccagcctgagatacctcgtccctatga

SEQ ID NO: 72391 - DNA, 38 bp, Artificial Sequence
  Synthetic oligonucleotide
ttccccgccctcccttgcagacgttgagttctacctga

SEQ ID NO: 72392 - DNA, 37 bp, Artificial Sequence
  Synthetic oligonucleotide
gtctaggacacgtaccagagcatttcgcatcccctga

SEQ ID NO: 72393 - DNA, 37 bp, Artificial Sequence
  Synthetic oligonucleotide
tcatcgcacgaacttctttctactgacgaacctctga

SEQ ID NO: 72394 - DNA, 38 bp, Artificial Sequence
  Synthetic oligonucleotide
ggtgacacctccattgctccttagagctggttctctga

SEQ ID NO: 72395 - DNA, 38 bp, Artificial Sequence
  Synthetic oligonucleotide
gacgctacagtattccacccgctcctcgtgctccgtga

SEQ ID NO: 72396 - DNA, 38 bp, Artificial Sequence
  Synthetic oligonucleotide
tcacttgctcagaggagaaaggtaggaggaatgcgtga

SEQ ID NO: 72397 - DNA, 37 bp, Artificial Sequence
  Synthetic oligonucleotide
gtgatagggtggcgggggcggaatagcgcgaaggtga

SEQ ID NO: 72398 - DNA, 35 bp, Artificial Sequence
  Synthetic oligonucleotide
gaaagacggggcaggaggttcgaattaatcggtga

SEQ ID NO: 72399 - DNA, 38 bp, Artificial Sequence
  Synthetic oligonucleotide
attgggatgttgaagcgggaggggggacgactcggtga

SEQ ID NO: 72400 - DNA, 38 bp, Artificial Sequence
  Synthetic oligonucleotide
attcgcgacgcggagggggcggatgacgggtggggtga

SEQ ID NO: 72401 - DNA, 36 bp, Artificial Sequence
  Synthetic oligonucleotide
atgaagagagatcgtgcgtcaggaggaggatggtga

SEQ ID NO: 72402 - DNA, 38 bp, Artificial Sequence
  Synthetic oligonucleotide
gacctgcctcccggtggctcctcttcaacgactattga

SEQ ID NO: 72403 - DNA, 37 bp, Artificial Sequence
  Synthetic oligonucleotide
atgaccgcggatccgccacccccccatggaaccttga

SEQ ID NO: 72404 - DNA, 38 bp, Artificial Sequence
  Synthetic oligonucleotide
aacccgtccgccttcgagatcatgcgcatttcccttga

SEQ ID NO: 72405 - DNA, 38 bp, Artificial Sequence
  Synthetic oligonucleotide
gagccggccaagggtgccctcctcctttctatgcttga

SEQ ID NO: 72406 - DNA, 38 bp, Artificial Sequence
  Synthetic oligonucleotide
tcagggaagggggcaataacgggtgacctctgggttga

SEQ ID NO: 72407 - DNA, 38 bp, Artificial Sequence
  Synthetic oligonucleotide
ttctgcgccgttcacccgtattcatattgctcgtttga

SEQ ID NO: 72408 - DNA, 36 bp, Artificial Sequence
  Synthetic oligonucleotide
tcacagggggggcgggaaatctttgtggttggtata

SEQ ID NO: 72409 - DNA, 35 bp, Artificial Sequence
  Synthetic oligonucleotide
acccttaccccattgcgcactaaacaggccttata

SEQ ID NO: 72410 - DNA, 36 bp, Artificial Sequence
  Synthetic oligonucleotide
atctcccagacgtatctttgcccaggtactgttata

SEQ ID NO: 72411 - DNA, 36 bp, Artificial Sequence
  Synthetic oligonucleotide
gtcgaatgcatccgtttcatctggtgtactaccgta

SEQ ID NO: 72412 - DNA, 36 bp, Artificial Sequence
  Synthetic oligonucleotide
taagcccgccctacacggttttgtccaacactatta

SEQ ID NO: 72413 - DNA, 36 bp, Artificial Sequence
  Synthetic oligonucleotide
ttaaagccacatgttcatcccgccgttacggtgtta

SEQ ID NO: 72414 - DNA, 36 bp, Artificial Sequence
  Synthetic oligonucleotide
atatccacctcacgaatgattttgtttgcgtgaaac

SEQ ID NO: 72415 - DNA, 35 bp, Artificial Sequence
  Synthetic oligonucleotide
ttgtctaactcacatcgtaccacggccttccggac

SEQ ID NO: 72416 - DNA, 35 bp, Artificial Sequence
  Synthetic oligonucleotide
gatcttcgaccccacacgctccttttctaatggac

SEQ ID NO: 72417 - DNA, 35 bp, Artificial Sequence
  Synthetic oligonucleotide
catgtggctcactgccactatgcccccatcctgac

SEQ ID NO: 72418 - DNA, 35 bp, Artificial Sequence
  Synthetic oligonucleotide
actgtagttgccacatttacctgactatgcgatac

SEQ ID NO: 72419 - DNA, 35 bp, Artificial Sequence
  Synthetic oligonucleotide
agccagacggactttcggttattattacctccacc

SEQ ID NO: 72420 - DNA, 35 bp, Artificial Sequence
  Synthetic oligonucleotide
acagggcaggaactccgtcacccatcgccccgccc

SEQ ID NO: 72421 - DNA, 35 bp, Artificial Sequence
  Synthetic oligonucleotide
caacacgatcaagcatagcgccgtaacaccatccc

SEQ ID NO: 72422 - DNA, 35 bp, Artificial Sequence
  Synthetic oligonucleotide
gccgatcgcgatccatggtccggcattcaattccc

SEQ ID NO: 72423 - DNA, 35 bp, Artificial Sequence
  Synthetic oligonucleotide
tgaatacgtactctcccctctgaatagtgattgcc

SEQ ID NO: 72424 - DNA, 35 bp, Artificial Sequence
  Synthetic oligonucleotide
tgatgcgtgggccatcgttgttttcgttttcttcc

SEQ ID NO: 72425 - DNA, 35 bp, Artificial Sequence
  Synthetic oligonucleotide
aacccaggcgtggcatttatcggtaattggtttcc

SEQ ID NO: 72426 - DNA, 35 bp, Artificial Sequence
  Synthetic oligonucleotide
tccaccgatccggggaaacctatctattgtaacgc

SEQ ID NO: 72427 - DNA, 35 bp, Artificial Sequence
  Synthetic oligonucleotide
tccgctatacatgtcgttttttatctcatggccgc

SEQ ID NO: 72428 - DNA, 35 bp, Artificial Sequence
  Synthetic oligonucleotide
tatgcctattcgatggatctcgtctgctttttcgc

SEQ ID NO: 72429 - DNA, 35 bp, Artificial Sequence
  Synthetic oligonucleotide
gatgcccgccacagttctaataacaataacggtgc

SEQ ID NO: 72430 - DNA, 35 bp, Artificial Sequence
  Synthetic oligonucleotide
tttcaatccacttgtggattaagaccactctttgc

SEQ ID NO: 72431 - DNA, 35 bp, Artificial Sequence
  Synthetic oligonucleotide
gcttggcctcgcacatacgttttccgcagtcaatc

SEQ ID NO: 72432 - DNA, 35 bp, Artificial Sequence
  Synthetic oligonucleotide
gccgccggcttggtaggacttataccaccctcatc

SEQ ID NO: 72433 - DNA, 35 bp, Artificial Sequence
  Synthetic oligonucleotide
ggggccacacgagatcatccctgcctcgcctactc

SEQ ID NO: 72434 - DNA, 35 bp, Artificial Sequence
  Synthetic oligonucleotide
ttgccgcccgttactgccccgccgatacagagctc

SEQ ID NO: 72435 - DNA, 35 bp, Artificial Sequence
  Synthetic oligonucleotide
gtatcctggcctatccgacctgaaccaacttggtc

SEQ ID NO: 72436 - DNA, 35 bp, Artificial Sequence
  Synthetic oligonucleotide
gcatggtacatggccgcacgttcactacacatgtc

SEQ ID NO: 72437 - DNA, 35 bp, Artificial Sequence
  Synthetic oligonucleotide
gcaaatctctccccccatatgtcaactaggtgacg

SEQ ID NO: 72438 - DNA, 35 bp, Artificial Sequence
  Synthetic oligonucleotide
tagcacatcaagccgatttcgcctagccagactcg

SEQ ID NO: 72439 - DNA, 35 bp, Artificial Sequence
  Synthetic oligonucleotide
tcctgcacccccgcctttttgagcccctcctctcg

SEQ ID NO: 72440 - DNA, 35 bp, Artificial Sequence
  Synthetic oligonucleotide
tattgcgcacatttggtttttttggtgatcccggg

SEQ ID NO: 72441 - DNA, 35 bp, Artificial Sequence
  Synthetic oligonucleotide
gacgcgggcacacagcatgacatgatcaaagaatg

SEQ ID NO: 72442 - DNA, 35 bp, Artificial Sequence
  Synthetic oligonucleotide
gatagccgcgaaaacctttacactaacttggcctg

SEQ ID NO: 72443 - DNA, 35 bp, Artificial Sequence
  Synthetic oligonucleotide
atgcacggccacatctttatgtagttctccttgtg

SEQ ID NO: 72444 - DNA, 35 bp, Artificial Sequence
  Synthetic oligonucleotide
agatcgaaccagggccgcatattatcccttgcttg

SEQ ID NO: 72445 - DNA, 35 bp, Artificial Sequence
  Synthetic oligonucleotide
gcactctttctgatataacctcgccttccacgcat

SEQ ID NO: 72446 - DNA, 35 bp, Artificial Sequence
  Synthetic oligonucleotide
accccgtcctcaccacgcgtggccgttccgcccct

SEQ ID NO: 72447 - DNA, 35 bp, Artificial Sequence
  Synthetic oligonucleotide
gcggggaccgacatccgatttccaacacacactct

SEQ ID NO: 72448 - DNA, 35 bp, Artificial Sequence
  Synthetic oligonucleotide
ggtggacgctcaccaatcatacactgaatccgtct

SEQ ID NO: 72449 - DNA, 35 bp, Artificial Sequence
  Synthetic oligonucleotide
gccgatttgaccacttatgttagcgatcactttct

SEQ ID NO: 72450 - DNA, 35 bp, Artificial Sequence
  Synthetic oligonucleotide
gtgatagcgggatacgattgggtggggaggtcagt

SEQ ID NO: 72451 - DNA, 35 bp, Artificial Sequence
  Synthetic oligonucleotide
ttccaaatcgccgagtggcgcctcaccctatgggt

SEQ ID NO: 72452 - DNA, 35 bp, Artificial Sequence
  Synthetic oligonucleotide
acacaccccgccccgtacggcaacatcccaagatt

SEQ ID NO: 72453 - DNA, 35 bp, Artificial Sequence
  Synthetic oligonucleotide
tcccccaaactgtgcccctgggttgtggtcacctt

SEQ ID NO: 72454 - DNA, 35 bp, Artificial Sequence
  Synthetic oligonucleotide
gcggacacaggccgcgcatcgacgcaacattcctt

SEQ ID NO: 72455 - DNA, 35 bp, Artificial Sequence
  Synthetic oligonucleotide
gaggaagtctctcctgcgttttctctatgcttctt

SEQ ID NO: 72456 - DNA, 35 bp, Artificial Sequence
  Synthetic oligonucleotide
cctcaccccaatgctatctcccttttgagcccgtt

SEQ ID NO: 72457 - DNA, 35 bp, Artificial Sequence
  Synthetic oligonucleotide
gtgctgccttccccccttgagttctcttgtatgtt

SEQ ID NO: 72458 - DNA, 35 bp, Artificial Sequence
  Synthetic oligonucleotide
atgactacgcccccaggaactagcgttacctcttt

SEQ ID NO: 72459 - DNA, 36 bp, Artificial Sequence
  Synthetic oligonucleotide
gtggtgggggcaaggttgcatagtagtgcagaaaaa

SEQ ID NO: 72460 - DNA, 35 bp, Artificial Sequence
  Synthetic oligonucleotide
gctccatccacgataggtcttaatgctattaccaa

SEQ ID NO: 72461 - DNA, 35 bp, Artificial Sequence
  Synthetic oligonucleotide
tacgtgcacatcacggcacttccgctccccccgaa

SEQ ID NO: 72462 - DNA, 36 bp, Artificial Sequence
  Synthetic oligonucleotide
gagggatggaatagagtgaacatggtgggtggcgaa

SEQ ID NO: 72463 - DNA, 36 bp, Artificial Sequence
  Synthetic oligonucleotide
tgcgaactgtcttctcgttgcccacacacttattaa

SEQ ID NO: 72464 - DNA, 36 bp, Artificial Sequence
  Synthetic oligonucleotide
acaacttgctccacattatttctgttacaacgcaca

SEQ ID NO: 72465 - DNA, 36 bp, Artificial Sequence
  Synthetic oligonucleotide
acaaccggatggtaggggtggcgggattgactgaca

SEQ ID NO: 72466 - DNA, 35 bp, Artificial Sequence
  Synthetic oligonucleotide
tcaccacgcccgtattcaaattggttgagcgtaca

SEQ ID NO: 72467 - DNA, 36 bp, Artificial Sequence
  Synthetic oligonucleotide
aagggtgcatggatggaagggggagatcggcaacca

SEQ ID NO: 72468 - DNA, 36 bp, Artificial Sequence
  Synthetic oligonucleotide
accatgccatggctgaaggaggctcggttcgtacca

SEQ ID NO: 72469 - DNA, 36 bp, Artificial Sequence
  Synthetic oligonucleotide
ccaccgccgccacacacggccggtcttacacaccca

SEQ ID NO: 72470 - DNA, 36 bp, Artificial Sequence
  Synthetic oligonucleotide
actgccattactaccatctgcaagaactccttgcca

SEQ ID NO: 72471 - DNA, 36 bp, Artificial Sequence
  Synthetic oligonucleotide
aaaaccgaactaatgccgcgccttcatctggccgca

SEQ ID NO: 72472 - DNA, 36 bp, Artificial Sequence
  Synthetic oligonucleotide
gcaaccgccgcaagcgttactccatcccccatcgca

SEQ ID NO: 72473 - DNA, 36 bp, Artificial Sequence
  Synthetic oligonucleotide
tcccaaactcagacctctctgatattctttgactca

SEQ ID NO: 72474 - DNA, 35 bp, Artificial Sequence
  Synthetic oligonucleotide
gtcatggccgatcttcagctgactaaatgccctca

SEQ ID NO: 72475 - DNA, 36 bp, Artificial Sequence
  Synthetic oligonucleotide
ttcccgaaccacattatgctgcgtggccaccgctca

SEQ ID NO: 72476 - DNA, 36 bp, Artificial Sequence
  Synthetic oligonucleotide
tgtggtgcattagccgcaaaggttccagttatctca

SEQ ID NO: 72477 - DNA, 36 bp, Artificial Sequence
  Synthetic oligonucleotide
gcatccgaaggttgaaccagaggtgccacaatttca

SEQ ID NO: 72478 - DNA, 37 bp, Artificial Sequence
  Synthetic oligonucleotide
tgcgcgatgccgagtgcacgtttaacttccttccaga

SEQ ID NO: 72479 - DNA, 37 bp, Artificial Sequence
  Synthetic oligonucleotide
gatccaccgtacgataagattgggacacaggaagaga

SEQ ID NO: 72480 - DNA, 37 bp, Artificial Sequence
  Synthetic oligonucleotide
aagaggggatcatcgagagggggggtcaatgtagaga

SEQ ID NO: 72481 - DNA, 37 bp, Artificial Sequence
  Synthetic oligonucleotide
tatgaatggggggcacaggtggggggtttaaagtaga

SEQ ID NO: 72482 - DNA, 36 bp, Artificial Sequence
  Synthetic oligonucleotide
gaccacaagtcacgcctccacataacgctcgtacga

SEQ ID NO: 72483 - DNA, 37 bp, Artificial Sequence
  Synthetic oligonucleotide
tcatcccccttcaaagagcactacgtgagccctccga

SEQ ID NO: 72484 - DNA, 37 bp, Artificial Sequence
  Synthetic oligonucleotide
tgacacgttccgccggtacattcatcagcaagagcga

SEQ ID NO: 72485 - DNA, 37 bp, Artificial Sequence
  Synthetic oligonucleotide
gttaccacccttcccgtcaatcggctcttaagagcga

SEQ ID NO: 72486 - DNA, 35 bp, Artificial Sequence
  Synthetic oligonucleotide
acgccattgtaggctgggggtggggggttgtgcga

SEQ ID NO: 72487 - DNA, 36 bp, Artificial Sequence
  Synthetic oligonucleotide
gcacccgcactcgagcataagcggcctttctttcga

SEQ ID NO: 72488 - DNA, 36 bp, Artificial Sequence
  Synthetic oligonucleotide
aagggatgtggggggcgatagataatggtggcagga

SEQ ID NO: 72489 - DNA, 37 bp, Artificial Sequence
  Synthetic oligonucleotide
tgttatgaacgcccctgctcccagtctccccgtagga

SEQ ID NO: 72490 - DNA, 36 bp, Artificial Sequence
  Synthetic oligonucleotide
gaggttgggatagggaggacgggtgctggggacgga

SEQ ID NO: 72491 - DNA, 37 bp, Artificial Sequence
  Synthetic oligonucleotide
taaggtggagcctagtagggggaatgaggagctcgga

SEQ ID NO: 72492 - DNA, 36 bp, Artificial Sequence
  Synthetic oligonucleotide
atagtggtggagggggtaaagtccggaacaggggga

SEQ ID NO: 72493 - DNA, 37 bp, Artificial Sequence
  Synthetic oligonucleotide
gcacacctgccgctacgtcaagcttttgttggtggga

SEQ ID NO: 72494 - DNA, 37 bp, Artificial Sequence
  Synthetic oligonucleotide
gatgtagcggaaatctgatgaagtgagtgtggctgga

SEQ ID NO: 72495 - DNA, 36 bp, Artificial Sequence
  Synthetic oligonucleotide
agcatgcctaggctatcgacctcttattattttgga

SEQ ID NO: 72496 - DNA, 38 bp, Artificial Sequence
  Synthetic oligonucleotide
gcgaacgcacgcacctgattcacgaccttccgacatga

SEQ ID NO: 72497 - DNA, 38 bp, Artificial Sequence
  Synthetic oligonucleotide
ttcggtggccgtatgccctccttgccagccctccatga

SEQ ID NO: 72498 - DNA, 37 bp, Artificial Sequence
  Synthetic oligonucleotide
gagtgaagaccgcaagtgggggatttgggcaggatga

SEQ ID NO: 72499 - DNA, 37 bp, Artificial Sequence
  Synthetic oligonucleotide
agctctgcaaccatcctgttttagctcatcctactga

SEQ ID NO: 72500 - DNA, 36 bp, Artificial Sequence
  Synthetic oligonucleotide
agatacacccaccaatgtgatccttttgaaacctga

SEQ ID NO: 72501 - DNA, 38 bp, Artificial Sequence
  Synthetic oligonucleotide
gatcaccgccgaactctaccataagcggagacctctga

SEQ ID NO: 72502 - DNA, 38 bp, Artificial Sequence
  Synthetic oligonucleotide
gcgcccggtcttgcatgtgccttcctcaccatttctga

SEQ ID NO: 72503 - DNA, 38 bp, Artificial Sequence
  Synthetic oligonucleotide
tcaccatctggaccaccgccttatgacgccataagtga

SEQ ID NO: 72504 - DNA, 37 bp, Artificial Sequence
  Synthetic oligonucleotide
tccaccgacccgagattgaggtaactacgccccgtga

SEQ ID NO: 72505 - DNA, 38 bp, Artificial Sequence
  Synthetic oligonucleotide
tctccccaccgattttcaccgtctcgtgcgtgccgtga

SEQ ID NO: 72506 - DNA, 37 bp, Artificial Sequence
  Synthetic oligonucleotide
tgcggggggggcgaagatgattcaggggcgatcgtga

SEQ ID NO: 72507 - DNA, 38 bp, Artificial Sequence
  Synthetic oligonucleotide
gatgacggtaaagtggggtggatcaaagtgtggggtga

SEQ ID NO: 72508 - DNA, 37 bp, Artificial Sequence
  Synthetic oligonucleotide
atgcgtggtggaggtggattggggtctaagatggtga

SEQ ID NO: 72509 - DNA, 38 bp, Artificial Sequence
  Synthetic oligonucleotide
gtttacgcctcatgggcatcacgaccccaccactgtga

SEQ ID NO: 72510 - DNA, 38 bp, Artificial Sequence
  Synthetic oligonucleotide
tatcaccacaatccgtaacgaacggttgaatacattga

SEQ ID NO: 72511 - DNA, 38 bp, Artificial Sequence
  Synthetic oligonucleotide
ggaccgctgacaacgcttcccttcgtccttttgattga

SEQ ID NO: 72512 - DNA, 37 bp, Artificial Sequence
  Synthetic oligonucleotide
tctcgttcaagccgtgatcgaacctctcctcacttga

SEQ ID NO: 72513 - DNA, 38 bp, Artificial Sequence
  Synthetic oligonucleotide
gacatccacccggtgtaaattggtgcatcttcacttga

SEQ ID NO: 72514 - DNA, 38 bp, Artificial Sequence
  Synthetic oligonucleotide
gatcagcatatccctgctttctgccttgtccgccttga

SEQ ID NO: 72515 - DNA, 38 bp, Artificial Sequence
  Synthetic oligonucleotide
gtcccctcgcagcaccaacacacaccatcttccgttga

SEQ ID NO: 72516 - DNA, 37 bp, Artificial Sequence
  Synthetic oligonucleotide
tcgagtcgttacttatttgcgccatcctgatctttga

SEQ ID NO: 72517 - DNA, 38 bp, Artificial Sequence
  Synthetic oligonucleotide
gatcacccgggtctctagctactaacgacgccttttga

SEQ ID NO: 72518 - DNA, 36 bp, Artificial Sequence
  Synthetic oligonucleotide
tgatgcgtggtcactctatatgccgcatcaattata

SEQ ID NO: 72519 - DNA, 36 bp, Artificial Sequence
  Synthetic oligonucleotide
gtacggccccgctgacgccctattctttctttacta

SEQ ID NO: 72520 - DNA, 36 bp, Artificial Sequence
  Synthetic oligonucleotide
ttggactcctcgcccacttcccacttttggtccgta

SEQ ID NO: 72521 - DNA, 36 bp, Artificial Sequence
  Synthetic oligonucleotide
tagaacccacgccatcatacatttccgctttccgta

SEQ ID NO: 72522 - DNA, 36 bp, Artificial Sequence
  Synthetic oligonucleotide
atacccggtcggtcacctagcccagcctttactgta

SEQ ID NO: 72523 - DNA, 35 bp, Artificial Sequence
  Synthetic oligonucleotide
ataccactgatagtagcccggacgcccgtattgta

SEQ ID NO: 72524 - DNA, 36 bp, Artificial Sequence
  Synthetic oligonucleotide
atcctcgtcctcccctttatttaggcctcgcattta

SEQ ID NO: 72525 - DNA, 35 bp, Artificial Sequence
  Synthetic oligonucleotide
atgcacctgctggaccaccatgcacgatagtccac

SEQ ID NO: 72526 - DNA, 35 bp, Artificial Sequence
  Synthetic oligonucleotide
tactgctggccacacgcatattacgtcctcctgac

SEQ ID NO: 72527 - DNA, 35 bp, Artificial Sequence
  Synthetic oligonucleotide
atccgagaattggcaattggagcacaacgcccacc

SEQ ID NO: 72528 - DNA, 35 bp, Artificial Sequence
  Synthetic oligonucleotide
tccaatattcctgccgctagttttacaggtctacc

SEQ ID NO: 72529 - DNA, 35 bp, Artificial Sequence
  Synthetic oligonucleotide
gcgccgtcctgccacgcacattaccttaggttacc

SEQ ID NO: 72530 - DNA, 35 bp, Artificial Sequence
  Synthetic oligonucleotide
tgacacctttgctacgggaaactatgcctgaaccc

SEQ ID NO: 72531 - DNA, 35 bp, Artificial Sequence
  Synthetic oligonucleotide
ttgtgacgcgcagagtttccatttagttcccatcc

SEQ ID NO: 72532 - DNA, 35 bp, Artificial Sequence
  Synthetic oligonucleotide
taccgcacacaactcggcatcagcaccaggcgagc

SEQ ID NO: 72533 - DNA, 35 bp, Artificial Sequence
  Synthetic oligonucleotide
aaacgccatctacgcctttaccgaccactccaatc

SEQ ID NO: 72534 - DNA, 35 bp, Artificial Sequence
  Synthetic oligonucleotide
tagttgcacccctttacgtaagtcatttgcccctc

SEQ ID NO: 72535 - DNA, 35 bp, Artificial Sequence
  Synthetic oligonucleotide
ggatgtggggtagagggtaatgtggtggtcagctc

SEQ ID NO: 72536 - DNA, 35 bp, Artificial Sequence
  Synthetic oligonucleotide
tccgagtcgtccacattaatcattagggttgggtc

SEQ ID NO: 72537 - DNA, 35 bp, Artificial Sequence
  Synthetic oligonucleotide
agaacgggatagtggtgccgggtgacaacggacag

SEQ ID NO: 72538 - DNA, 35 bp, Artificial Sequence
  Synthetic oligonucleotide
gcccacctgcgcatgtgacgttgagttctatccag

SEQ ID NO: 72539 - DNA, 35 bp, Artificial Sequence
  Synthetic oligonucleotide
tcacgttgatcccaccttaaaaatgcccgctccag

SEQ ID NO: 72540 - DNA, 35 bp, Artificial Sequence
  Synthetic oligonucleotide
gtgacgccacgacggtcaatattaggaagatgcag

SEQ ID NO: 72541 - DNA, 35 bp, Artificial Sequence
  Synthetic oligonucleotide
gtggaggtgggctatggagatggtgctagctttag

SEQ ID NO: 72542 - DNA, 35 bp, Artificial Sequence
  Synthetic oligonucleotide
tgacctccccgccccatgtccttacaatgcacccg

SEQ ID NO: 72543 - DNA, 35 bp, Artificial Sequence
  Synthetic oligonucleotide
atggaagtcaagtctaccctcccgccacctctccg

SEQ ID NO: 72544 - DNA, 35 bp, Artificial Sequence
  Synthetic oligonucleotide
gtgccccatcgcccatcgccacagctatccttccg

SEQ ID NO: 72545 - DNA, 35 bp, Artificial Sequence
  Synthetic oligonucleotide
gccgtgcgcaatcctttcccgtttaacgacgttcg

SEQ ID NO: 72546 - DNA, 35 bp, Artificial Sequence
  Synthetic oligonucleotide
ttaggtcgcaggacggtggatgctcatggaatggg

SEQ ID NO: 72547 - DNA, 35 bp, Artificial Sequence
  Synthetic oligonucleotide
agcccccccctattcgccctgtgaccgaacactgg

SEQ ID NO: 72548 - DNA, 35 bp, Artificial Sequence
  Synthetic oligonucleotide
gaaaacggagagaaggtgtttgttctggttgttgg

SEQ ID NO: 72549 - DNA, 35 bp, Artificial Sequence
  Synthetic oligonucleotide
tgacgcatgcgcctcgccctggaactacgatcctg

SEQ ID NO: 72550 - DNA, 35 bp, Artificial Sequence
  Synthetic oligonucleotide
tccgatcactacctttatgaatgcgagcctatcat

SEQ ID NO: 72551 - DNA, 35 bp, Artificial Sequence
  Synthetic oligonucleotide
ttgcaacctcggtcggtgtaacgccctctataact

SEQ ID NO: 72552 - DNA, 35 bp, Artificial Sequence
  Synthetic oligonucleotide
gccgcaataaggtcactgcttgtgcttcaccccct

SEQ ID NO: 72553 - DNA, 35 bp, Artificial Sequence
  Synthetic oligonucleotide
aaacccgcatggtgacgttgcctctgtccagtcct

SEQ ID NO: 72554 - DNA, 35 bp, Artificial Sequence
  Synthetic oligonucleotide
agtggtgctccagccgtttgttcatgatccaccgt

SEQ ID NO: 72555 - DNA, 35 bp, Artificial Sequence
  Synthetic oligonucleotide
gctgagtgggggctgaagaactagcaggtaagggt

SEQ ID NO: 72556 - DNA, 35 bp, Artificial Sequence
  Synthetic oligonucleotide
tgtcacgccgagctacgccccccgctccgcatggt

SEQ ID NO: 72557 - DNA, 35 bp, Artificial Sequence
  Synthetic oligonucleotide
tacaaactgtgtcagggggtggagagggctgtggt

SEQ ID NO: 72558 - DNA, 35 bp, Artificial Sequence
  Synthetic oligonucleotide
tatcgccatgcccatgttccgaccgtgcacactgt

SEQ ID NO: 72559 - DNA, 35 bp, Artificial Sequence
  Synthetic oligonucleotide
tcatagtgtggtcgcctcctcttttcacatactgt

SEQ ID NO: 72560 - DNA, 35 bp, Artificial Sequence
  Synthetic oligonucleotide
ttggtagggtggataactgtaggggggctcgtgtt

SEQ ID NO: 72561 - DNA, 35 bp, Artificial Sequence
  Synthetic oligonucleotide
agtgaggggtgggtgtggttatcggtgaggtacaa

SEQ ID NO: 72562 - DNA, 36 bp, Artificial Sequence
  Synthetic oligonucleotide
tgtagggcggagggaggacgagatagacatgtgcaa

SEQ ID NO: 72563 - DNA, 36 bp, Artificial Sequence
  Synthetic oligonucleotide
aacacgcttcccctgttgtctctcctgcgtgtgcaa

SEQ ID NO: 72564 - DNA, 35 bp, Artificial Sequence
  Synthetic oligonucleotide
agactcggggggaaagggatgatcttgaacaggaa

SEQ ID NO: 72565 - DNA, 36 bp, Artificial Sequence
  Synthetic oligonucleotide
ttgcatgagcccgaggtgcgggtggggctgggggaa

SEQ ID NO: 72566 - DNA, 35 bp, Artificial Sequence
  Synthetic oligonucleotide
accgagcactccttagtcgcggattaatcttggaa

SEQ ID NO: 72567 - DNA, 36 bp, Artificial Sequence
  Synthetic oligonucleotide
gaggccaccctcggttcctctcaagtttcgttttaa

SEQ ID NO: 72568 - DNA, 36 bp, Artificial Sequence
  Synthetic oligonucleotide
gaaccacttgcggggaggaaggataggtggttaaca

SEQ ID NO: 72569 - DNA, 36 bp, Artificial Sequence
  Synthetic oligonucleotide
gagtccccgtacattccaagcgttttcccggccaca

SEQ ID NO: 72570 - DNA, 35 bp, Artificial Sequence
  Synthetic oligonucleotide
gctcccgcccttttgcttgcaccttgccctcacca

SEQ ID NO: 72571 - DNA, 36 bp, Artificial Sequence
  Synthetic oligonucleotide
gctgtcgcaatcagccggacttatatacttatccca

SEQ ID NO: 72572 - DNA, 36 bp, Artificial Sequence
  Synthetic oligonucleotide
tgctcccccggcccgttacgagtggtgaccaatcca

SEQ ID NO: 72573 - DNA, 36 bp, Artificial Sequence
  Synthetic oligonucleotide
agtgccggcctgtcttgatcacaagcccaccctcca

SEQ ID NO: 72574 - DNA, 36 bp, Artificial Sequence
  Synthetic oligonucleotide
gtgcgctagctatttttttccgacattctcgttcca

SEQ ID NO: 72575 - DNA, 36 bp, Artificial Sequence
  Synthetic oligonucleotide
actgaccgaggaaagactgtgggggggaaggtagca

SEQ ID NO: 72576 - DNA, 35 bp, Artificial Sequence
  Synthetic oligonucleotide
gtcacccctgcgccatccggagacgattctgggca

SEQ ID NO: 72577 - DNA, 36 bp, Artificial Sequence
  Synthetic oligonucleotide
gattcatccccccatcggtttaccgtgcctggtgca

SEQ ID NO: 72578 - DNA, 36 bp, Artificial Sequence
  Synthetic oligonucleotide
gctgtacagacgcccttctccccaggtcagtaatca

SEQ ID NO: 72579 - DNA, 37 bp, Artificial Sequence
  Synthetic oligonucleotide
gacacgaacgtcgtgagttcgtgataggtctaataga

SEQ ID NO: 72580 - DNA, 36 bp, Artificial Sequence
  Synthetic oligonucleotide
actacatcgctgtgcactaccctgctctaataacga

SEQ ID NO: 72581 - DNA, 36 bp, Artificial Sequence
  Synthetic oligonucleotide
ttgcatccgcggaccttgcctcagccgccgacccga

SEQ ID NO: 72582 - DNA, 37 bp, Artificial Sequence
  Synthetic oligonucleotide
tgtccatcgacaaagccatttcatccacgtgccccga

SEQ ID NO: 72583 - DNA, 35 bp, Artificial Sequence
  Synthetic oligonucleotide
tcaccccaatgctttcatcccatcgttgaagccga

SEQ ID NO: 72584 - DNA, 37 bp, Artificial Sequence
  Synthetic oligonucleotide
gagaagtcgaggggggtgaaacacaagggaagcgcga

SEQ ID NO: 72585 - DNA, 37 bp, Artificial Sequence
  Synthetic oligonucleotide
tgataaggggggaatgtaaagggggagacatgggcga

SEQ ID NO: 72586 - DNA, 35 bp, Artificial Sequence
  Synthetic oligonucleotide
tcctgtctccgtactctatcttcacacaatctcga

SEQ ID NO: 72587 - DNA, 36 bp, Artificial Sequence
  Synthetic oligonucleotide
gcactccattaaccgccaccatctttagctgttcga

SEQ ID NO: 72588 - DNA, 36 bp, Artificial Sequence
  Synthetic oligonucleotide
tgcgtgctgtttcccgctggtactatctcttgagga

SEQ ID NO: 72589 - DNA, 35 bp, Artificial Sequence
  Synthetic oligonucleotide
tagttctccctccaactcgcgctccgcacgcggga

SEQ ID NO: 72590 - DNA, 36 bp, Artificial Sequence
  Synthetic oligonucleotide
atcagggagagactttggcggaatacgtagggggga

SEQ ID NO: 72591 - DNA, 38 bp, Artificial Sequence
  Synthetic oligonucleotide
tagtctacgcccacggtctagcccttttgccaacatga

SEQ ID NO: 72592 - DNA, 38 bp, Artificial Sequence
  Synthetic oligonucleotide
tactgcatacgccgcccgcacacgagtcaccgccatga

SEQ ID NO: 72593 - DNA, 36 bp, Artificial Sequence
  Synthetic oligonucleotide
gaacactggtagagggagggttaacgggttagatga

SEQ ID NO: 72594 - DNA, 38 bp, Artificial Sequence
  Synthetic oligonucleotide
agcggatgaagagggaagaggataaaattgatggatga

SEQ ID NO: 72595 - DNA, 37 bp, Artificial Sequence
  Synthetic oligonucleotide
atccccacaggcggtggagagtaagcccgcctactga

SEQ ID NO: 72596 - DNA, 38 bp, Artificial Sequence
  Synthetic oligonucleotide
gcatggcccggtgactacttacatccaactgatcctga

SEQ ID NO: 72597 - DNA, 38 bp, Artificial Sequence
  Synthetic oligonucleotide
actgacgagaaatctggggggagaaggtcggtagctga

SEQ ID NO: 72598 - DNA, 37 bp, Artificial Sequence
  Synthetic oligonucleotide
gacctccctgtgttcagtcttatccacccactgctga

SEQ ID NO: 72599 - DNA, 38 bp, Artificial Sequence
  Synthetic oligonucleotide
gcaccaaccgcatgccctgactagaccggaccctctga

SEQ ID NO: 72600 - DNA, 38 bp, Artificial Sequence
  Synthetic oligonucleotide
gtaacctcatgtcgcaatatctcgtcaccagggagtga

SEQ ID NO: 72601 - DNA, 38 bp, Artificial Sequence
  Synthetic oligonucleotide
tccaagcaggaaacgaaggaacgagtcagtaagcgtga

SEQ ID NO: 72602 - DNA, 38 bp, Artificial Sequence
  Synthetic oligonucleotide
gaatgcccgagcgaaaaaataaggtatgatgggggtga

SEQ ID NO: 72603 - DNA, 38 bp, Artificial Sequence
  Synthetic oligonucleotide
gctacctacacgtttgctatgagttcgtttcacattga

SEQ ID NO: 72604 - DNA, 38 bp, Artificial Sequence
  Synthetic oligonucleotide
ggtcgcccctcttctacttatttggccactgacattga

SEQ ID NO: 72605 - DNA, 37 bp, Artificial Sequence
  Synthetic oligonucleotide
gtgcctgcccctcttctgctcctctatctgcacttga

SEQ ID NO: 72606 - DNA, 38 bp, Artificial Sequence
  Synthetic oligonucleotide
gacgccacggatggtctaatcatgatctcacctcttga

SEQ ID NO: 72607 - DNA, 37 bp, Artificial Sequence
  Synthetic oligonucleotide
aagagggaggttatggggcagaggtagggtaggttga

SEQ ID NO: 72608 - DNA, 38 bp, Artificial Sequence
  Synthetic oligonucleotide
atcgggggggagagatacgaaaggagaccgaaatttga

SEQ ID NO: 72609 - DNA, 37 bp, Artificial Sequence
  Synthetic oligonucleotide
aaccgacgtagcaccgtcgataacaatctgaatttga

SEQ ID NO: 72610 - DNA, 38 bp, Artificial Sequence
  Synthetic oligonucleotide
gctgtaagcacgttgaacagtattgtccggtactttga

SEQ ID NO: 72611 - DNA, 38 bp, Artificial Sequence
  Synthetic oligonucleotide
tccgcgctctgactctatctctgcgccgaacagtttga

SEQ ID NO: 72612 - DNA, 38 bp, Artificial Sequence
  Synthetic oligonucleotide
ttgtagggccagggaaaggggagccggggcatgtttga

SEQ ID NO: 72613 - DNA, 38 bp, Artificial Sequence
  Synthetic oligonucleotide
tacgcaggaccccgtaatgggcattcctcactttttga

SEQ ID NO: 72614 - DNA, 36 bp, Artificial Sequence
  Synthetic oligonucleotide
gctcgacctcctacctgtgcgcgaagttcgccaata

SEQ ID NO: 72615 - DNA, 35 bp, Artificial Sequence
  Synthetic oligonucleotide
attgatcctgtccattccctcagtacccccggata

SEQ ID NO: 72616 - DNA, 35 bp, Artificial Sequence
  Synthetic oligonucleotide
taggggggggtggcggggaccgggaatgtatccta

SEQ ID NO: 72617 - DNA, 36 bp, Artificial Sequence
  Synthetic oligonucleotide
ttgttccgcacacgtttgcacggtccgcattatcta

SEQ ID NO: 72618 - DNA, 35 bp, Artificial Sequence
  Synthetic oligonucleotide
tctacacgcccactcaccactccacattgaaggta

SEQ ID NO: 72619 - DNA, 35 bp, Artificial Sequence
  Synthetic oligonucleotide
ttggggtacgctgagtgcaatgaagtgggggtgta

SEQ ID NO: 72620 - DNA, 35 bp, Artificial Sequence
  Synthetic oligonucleotide
gtgtttgccgcatgtctcccagggcccacgcatta

SEQ ID NO: 72621 - DNA, 36 bp, Artificial Sequence
  Synthetic oligonucleotide
atgacccccaaagaccgtttgccgagttcactatta

SEQ ID NO: 72622 - DNA, 35 bp, Artificial Sequence
  Synthetic oligonucleotide
tccacgcgcgcactgagcgtaatctctactagaac

SEQ ID NO: 72623 - DNA, 35 bp, Artificial Sequence
  Synthetic oligonucleotide
gcaccctacattcctggtaatcggaaggtccacac

SEQ ID NO: 72624 - DNA, 35 bp, Artificial Sequence
  Synthetic oligonucleotide
aatcaggcctaatgtaacgttggtaggcccgaacc

SEQ ID NO: 72625 - DNA, 33 bp, Artificial Sequence
  Synthetic oligonucleotide
ttatactccgtcctcctcccgttccaggtcacc

SEQ ID NO: 72626 - DNA, 35 bp, Artificial Sequence
  Synthetic oligonucleotide
gagtcgcggtaaccgctgcggaatgctcgccaccc

SEQ ID NO: 72627 - DNA, 35 bp, Artificial Sequence
  Synthetic oligonucleotide
gacacaccgcgacgcccggtgttaccatgacgccc

SEQ ID NO: 72628 - DNA, 35 bp, Artificial Sequence
  Synthetic oligonucleotide
gagtgcttacatgatcttcctatgcgataccatcc

SEQ ID NO: 72629 - DNA, 35 bp, Artificial Sequence
  Synthetic oligonucleotide
gacaacctctttgtcgaaacttaacgtccctatcc

SEQ ID NO: 72630 - DNA, 35 bp, Artificial Sequence
  Synthetic oligonucleotide
acccgaggtgattctggttgttgccaccgtactcc

SEQ ID NO: 72631 - DNA, 35 bp, Artificial Sequence
  Synthetic oligonucleotide
gtcgcattatctcacgtcgtttaactcctgtctcc

SEQ ID NO: 72632 - DNA, 35 bp, Artificial Sequence
  Synthetic oligonucleotide
gtccgcatcgtccgtctgtccctgttcctttgtcc

SEQ ID NO: 72633 - DNA, 35 bp, Artificial Sequence
  Synthetic oligonucleotide
gaacctcacgaacttgtccgctaaacctggctggc

SEQ ID NO: 72634 - DNA, 35 bp, Artificial Sequence
  Synthetic oligonucleotide
gatgacgcatttgactctgtacgaccctaagcctc

SEQ ID NO: 72635 - DNA, 35 bp, Artificial Sequence
  Synthetic oligonucleotide
accctcgaacgccacgaagtgcatgcgctctcctc

SEQ ID NO: 72636 - DNA, 35 bp, Artificial Sequence
  Synthetic oligonucleotide
ttacctcactagtcgatcatgtccatgtgcccgtc

SEQ ID NO: 72637 - DNA, 35 bp, Artificial Sequence
  Synthetic oligonucleotide
catagtggggctcgggggggaaagaaataagggtc

SEQ ID NO: 72638 - DNA, 35 bp, Artificial Sequence
  Synthetic oligonucleotide
tagcctattccctccgtgtccgtgcactttagttc

SEQ ID NO: 72639 - DNA, 35 bp, Artificial Sequence
  Synthetic oligonucleotide
gactgtcgttgtcatcggccccactatattgtttc

SEQ ID NO: 72640 - DNA, 35 bp, Artificial Sequence
  Synthetic oligonucleotide
tacgcggagaggggggagcaaagtggaagtatgag

SEQ ID NO: 72641 - DNA, 35 bp, Artificial Sequence
  Synthetic oligonucleotide
aggggagcaaaaatgataaagaggagggggagacg

SEQ ID NO: 72642 - DNA, 35 bp, Artificial Sequence
  Synthetic oligonucleotide
atcatctcgttggctactcacgcattttgcttacg

SEQ ID NO: 72643 - DNA, 35 bp, Artificial Sequence
  Synthetic oligonucleotide
ggttcacgccttccccattatcctctatgttgccg

SEQ ID NO: 72644 - DNA, 35 bp, Artificial Sequence
  Synthetic oligonucleotide
ggacaggtgggattgggagtgggcgtaaggttagg

SEQ ID NO: 72645 - DNA, 35 bp, Artificial Sequence
  Synthetic oligonucleotide
tacgatgtgtacctcgtcccctggtgtgtgtctgg

SEQ ID NO: 72646 - DNA, 35 bp, Artificial Sequence
  Synthetic oligonucleotide
gatatgaaccagttgggttgggctaggggagggtg

SEQ ID NO: 72647 - DNA, 34 bp, Artificial Sequence
  Synthetic oligonucleotide
gcctcccgaactgacgtctcacgcatgtattttg

SEQ ID NO: 72648 - DNA, 35 bp, Artificial Sequence
  Synthetic oligonucleotide
aagccgagcccagcctatattctctccgaggcaat

SEQ ID NO: 72649 - DNA, 35 bp, Artificial Sequence
  Synthetic oligonucleotide
gaatccgcccaacggggatactggttttctcccat

SEQ ID NO: 72650 - DNA, 35 bp, Artificial Sequence
  Synthetic oligonucleotide
tcatggaaccctctattcttacggtgtattagcat

SEQ ID NO: 72651 - DNA, 35 bp, Artificial Sequence
  Synthetic oligonucleotide
acacccgatctccttcccggtgctgttggaatact

SEQ ID NO: 72652 - DNA, 35 bp, Artificial Sequence
  Synthetic oligonucleotide
tatctacctgcgcactccaagccaatgagtctcct

SEQ ID NO: 72653 - DNA, 35 bp, Artificial Sequence
  Synthetic oligonucleotide
acgaggggaagcgcatgccgaactcacactctgct

SEQ ID NO: 72654 - DNA, 35 bp, Artificial Sequence
  Synthetic oligonucleotide
atggcgagatcgtgtaatcctgtccttactcctct

SEQ ID NO: 72655 - DNA, 35 bp, Artificial Sequence
  Synthetic oligonucleotide
ttaacgtgcccgccccataccaattatttgccagt

SEQ ID NO: 72656 - DNA, 35 bp, Artificial Sequence
  Synthetic oligonucleotide
accatttccaccgaaacattctgtcatcagaatgt

SEQ ID NO: 72657 - DNA, 35 bp, Artificial Sequence
  Synthetic oligonucleotide
actaatcactggacgtgggggctcaattcatcatt

SEQ ID NO: 72658 - DNA, 35 bp, Artificial Sequence
  Synthetic oligonucleotide
gccccgttcatttatatctcgtagtgctacttgtt

SEQ ID NO: 72659 - DNA, 35 bp, Artificial Sequence
  Synthetic oligonucleotide
ggtggggtgttgggagtatggatattcaggggttt

SEQ ID NO: 72660 - DNA, 35 bp, Artificial Sequence
  Synthetic oligonucleotide
gatggggggccggtacatgggttggcgttcctttt

SEQ ID NO: 72661 - DNA, 35 bp, Artificial Sequence
  Synthetic oligonucleotide
gcgccttactcgcctcgttctacaatgcactgaaa

SEQ ID NO: 72662 - DNA, 36 bp, Artificial Sequence
  Synthetic oligonucleotide
agggtgaaggccgagtgtgagatggcgtactataaa

SEQ ID NO: 72663 - DNA, 35 bp, Artificial Sequence
  Synthetic oligonucleotide
gatagagcggtggaagaccgggtaggaagtgggaa

SEQ ID NO: 72664 - DNA, 36 bp, Artificial Sequence
  Synthetic oligonucleotide
actcgtcgcgctttcattaatagggtccgtcgccca

SEQ ID NO: 72665 - DNA, 35 bp, Artificial Sequence
  Synthetic oligonucleotide
agcgattgcaccggctactttttcactgttgtcca

SEQ ID NO: 72666 - DNA, 36 bp, Artificial Sequence
  Synthetic oligonucleotide
gctcacgttcgcccgttcggtattcccgttgtagca

SEQ ID NO: 72667 - DNA, 36 bp, Artificial Sequence
  Synthetic oligonucleotide
atgcccagcctgggttaccggcccattcgtatcgca

SEQ ID NO: 72668 - DNA, 36 bp, Artificial Sequence
  Synthetic oligonucleotide
gcccagactcccgcctgaatcgacgttaagcctgca

SEQ ID NO: 72669 - DNA, 36 bp, Artificial Sequence
  Synthetic oligonucleotide
gtccggtggcaattgtacacccgtacacccattgca

SEQ ID NO: 72670 - DNA, 36 bp, Artificial Sequence
  Synthetic oligonucleotide
tccctgtcacagagtctctagccgcgcctgctatca

SEQ ID NO: 72671 - DNA, 37 bp, Artificial Sequence
  Synthetic oligonucleotide
acgcacgatcccctggcctctcttttcgttcggtaga

SEQ ID NO: 72672 - DNA, 37 bp, Artificial Sequence
  Synthetic oligonucleotide
gacaacgggctccgctgtccttactgcccaccaacga

SEQ ID NO: 72673 - DNA, 37 bp, Artificial Sequence
  Synthetic oligonucleotide
aacccctgtagcagcacgctcaccttatttctgacga

SEQ ID NO: 72674 - DNA, 37 bp, Artificial Sequence
  Synthetic oligonucleotide
tggaccccgcctcaatcgctatgccccgtatatccga

SEQ ID NO: 72675 - DNA, 36 bp, Artificial Sequence
  Synthetic oligonucleotide
gacatcacacttaagcctattagccattctactcga

SEQ ID NO: 72676 - DNA, 37 bp, Artificial Sequence
  Synthetic oligonucleotide
aacgcagtcttccgcttctgcctctaagttccctcga

SEQ ID NO: 72677 - DNA, 37 bp, Artificial Sequence
  Synthetic oligonucleotide
tgcccaaccaatgactttttatttcttccccggggga

SEQ ID NO: 72678 - DNA, 35 bp, Artificial Sequence
  Synthetic oligonucleotide
ttgggacaaggggtgcgaagccgtggtgtggggga

SEQ ID NO: 72679 - DNA, 35 bp, Artificial Sequence
  Synthetic oligonucleotide
gggaacacggggataaataggacgagtggctggga

SEQ ID NO: 72680 - DNA, 35 bp, Artificial Sequence
  Synthetic oligonucleotide
tatgtcggcgagggctaaacattaggaaggtggga

SEQ ID NO: 72681 - DNA, 37 bp, Artificial Sequence
  Synthetic oligonucleotide
gagaactggagaagggggtgagcaggcgttattggga

SEQ ID NO: 72682 - DNA, 37 bp, Artificial Sequence
  Synthetic oligonucleotide
gatcgcacccccacaagaccgtccatgcccaggtgga

SEQ ID NO: 72683 - DNA, 37 bp, Artificial Sequence
  Synthetic oligonucleotide
gattggccctccgcctctaccatggtcctggattgga

SEQ ID NO: 72684 - DNA, 37 bp, Artificial Sequence
  Synthetic oligonucleotide
tcactcccacgccactacctcgagtgaattaccatga

SEQ ID NO: 72685 - DNA, 37 bp, Artificial Sequence
  Synthetic oligonucleotide
tacgcctaactcctatctgcgcctacgtcactcatga

SEQ ID NO: 72686 - DNA, 38 bp, Artificial Sequence
  Synthetic oligonucleotide
tatgtgttgggcgggggggcctgtagatgggacgatga

SEQ ID NO: 72687 - DNA, 37 bp, Artificial Sequence
  Synthetic oligonucleotide
accgcagactaaccagggagaagcaggaggggtatga

SEQ ID NO: 72688 - DNA, 38 bp, Artificial Sequence
  Synthetic oligonucleotide
gccaagctcgcattcttccgctagttgtctgtcactga

SEQ ID NO: 72689 - DNA, 38 bp, Artificial Sequence
  Synthetic oligonucleotide
ttgtctgcccgaaggtagcctggcctcaaatctcctga

SEQ ID NO: 72690 - DNA, 38 bp, Artificial Sequence
  Synthetic oligonucleotide
aatacactcgccgcctcgcatgtctttcacctttctga

SEQ ID NO: 72691 - DNA, 35 bp, Artificial Sequence
  Synthetic oligonucleotide
gtgggtgaatgctctagcatgggggagtgaagtga

SEQ ID NO: 72692 - DNA, 38 bp, Artificial Sequence
  Synthetic oligonucleotide
gagagtggttgcggctgaagggggcgcgggaggagtga

SEQ ID NO: 72693 - DNA, 38 bp, Artificial Sequence
  Synthetic oligonucleotide
atacagacatgccccaatggatatgactgacttagtga

SEQ ID NO: 72694 - DNA, 38 bp, Artificial Sequence
  Synthetic oligonucleotide
acgtacgaagacaatggtggctgggtaaagggtggtga

SEQ ID NO: 72695 - DNA, 37 bp, Artificial Sequence
  Synthetic oligonucleotide
tgcacgccctcaccacgccgttcattgaagcatgtga

SEQ ID NO: 72696 - DNA, 37 bp, Artificial Sequence
  Synthetic oligonucleotide
accgacaatcagcccatacatttgtctgtgaacttga

SEQ ID NO: 72697 - DNA, 35 bp, Artificial Sequence
  Synthetic oligonucleotide
tactggggggggtgggcgttagttagggaggttga

SEQ ID NO: 72698 - DNA, 38 bp, Artificial Sequence
  Synthetic oligonucleotide
acgcggacatcagacacaaatacatgattacactttga

SEQ ID NO: 72699 - DNA, 38 bp, Artificial Sequence
  Synthetic oligonucleotide
acgacaattcgcctcgttggacctgatttggcctttga

SEQ ID NO: 72700 - DNA, 38 bp, Artificial Sequence
  Synthetic oligonucleotide
gcacccccccactggctgacgcgcgcaagttcctttga

SEQ ID NO: 72701 - DNA, 35 bp, Artificial Sequence
  Synthetic oligonucleotide
gaacatcaactgccggcccgcatgtcctcaacata

SEQ ID NO: 72702 - DNA, 36 bp, Artificial Sequence
  Synthetic oligonucleotide
gttaccggttccgtgcgaatacaagcctgccacata

SEQ ID NO: 72703 - DNA, 36 bp, Artificial Sequence
  Synthetic oligonucleotide
tagagaggcaaggttcgggtgggaattgctgtcata

SEQ ID NO: 72704 - DNA, 35 bp, Artificial Sequence
  Synthetic oligonucleotide
ggatcaggccagctccgtcttaaaccttgcaacta

SEQ ID NO: 72705 - DNA, 36 bp, Artificial Sequence
  Synthetic oligonucleotide
gccaagcagtaacgtggctgtaggtccagcgtacta

SEQ ID NO: 72706 - DNA, 36 bp, Artificial Sequence
  Synthetic oligonucleotide
gggagcccaccccacctgtcctggacgtgttcccta

SEQ ID NO: 72707 - DNA, 36 bp, Artificial Sequence
  Synthetic oligonucleotide
gccacagcaaatttctacgggcatgactttccgcta

SEQ ID NO: 72708 - DNA, 36 bp, Artificial Sequence
  Synthetic oligonucleotide
gttcacagctcgctctgcatactcgccgttttgcta

SEQ ID NO: 72709 - DNA, 36 bp, Artificial Sequence
  Synthetic oligonucleotide
gaaacggggaggcgagggagggaccgccatatagta

SEQ ID NO: 72710 - DNA, 35 bp, Artificial Sequence
  Synthetic oligonucleotide
tccacctgcctcaaccggacacatactcgcccgta

SEQ ID NO: 72711 - DNA, 36 bp, Artificial Sequence
  Synthetic oligonucleotide
accatacgcttgcagcacgccgttccatcaccggta

SEQ ID NO: 72712 - DNA, 36 bp, Artificial Sequence
  Synthetic oligonucleotide
tagatagacggggttggctggaggcgctgaggggta

SEQ ID NO: 72713 - DNA, 35 bp, Artificial Sequence
  Synthetic oligonucleotide
agcgtgagggagaaaagggaaggcgagtttgtgta

SEQ ID NO: 72714 - DNA, 36 bp, Artificial Sequence
  Synthetic oligonucleotide
tactacgcgcaagaagcgatctacacccaggcttta

SEQ ID NO: 72715 - DNA, 34 bp, Artificial Sequence
  Synthetic oligonucleotide
gacaccgccccgcggcatggaggctgtaccacac

SEQ ID NO: 72716 - DNA, 35 bp, Artificial Sequence
  Synthetic oligonucleotide
ttaccgatcggttatgagggtccatctgttaccac

SEQ ID NO: 72717 - DNA, 35 bp, Artificial Sequence
  Synthetic oligonucleotide
gacgctcaaaagcctgggtctccgccccatcccac

SEQ ID NO: 72718 - DNA, 35 bp, Artificial Sequence
  Synthetic oligonucleotide
acaaaatggcgccgcagttactcctcctgtatcac

SEQ ID NO: 72719 - DNA, 35 bp, Artificial Sequence
  Synthetic oligonucleotide
tccatacagtgttacgaagccttcttgcctttcac

SEQ ID NO: 72720 - DNA, 35 bp, Artificial Sequence
  Synthetic oligonucleotide
gctatccagcgggttagctcccctcgccctgctac

SEQ ID NO: 72721 - DNA, 35 bp, Artificial Sequence
  Synthetic oligonucleotide
tgcgccttcgtactcattcgtcatcccgcagcacc

SEQ ID NO: 72722 - DNA, 35 bp, Artificial Sequence
  Synthetic oligonucleotide
tggcccaccaatgtgcttactccacttgctctacc

SEQ ID NO: 72723 - DNA, 35 bp, Artificial Sequence
  Synthetic oligonucleotide
gacgggaccgtcactacccattggtttgcaacccc

SEQ ID NO: 72724 - DNA, 35 bp, Artificial Sequence
  Synthetic oligonucleotide
gttcacgagatcacattctataaatattgccgccc

SEQ ID NO: 72725 - DNA, 35 bp, Artificial Sequence
  Synthetic oligonucleotide
tagcatgcagggttatctttactctggtgcatccc

SEQ ID NO: 72726 - DNA, 34 bp, Artificial Sequence
  Synthetic oligonucleotide
atccatctccgtgggacggaaccctttagccgcc

SEQ ID NO: 72727 - DNA, 35 bp, Artificial Sequence
  Synthetic oligonucleotide
ggagtgctcatctgtacacgctccaagttctggcc

SEQ ID NO: 72728 - DNA, 35 bp, Artificial Sequence
  Synthetic oligonucleotide
gaagacaacaaactatggccgaattggccccccgc

SEQ ID NO: 72729 - DNA, 35 bp, Artificial Sequence
  Synthetic oligonucleotide
tgtgcacgttcgcttgtcccttctcatttgtccgc

SEQ ID NO: 72730 - DNA, 35 bp, Artificial Sequence
  Synthetic oligonucleotide
accatcgtatgggttaacgccatgccctttcactc

SEQ ID NO: 72731 - DNA, 35 bp, Artificial Sequence
  Synthetic oligonucleotide
gtcccgcaaccgcaccttcctgtttccatgtactc

SEQ ID NO: 72732 - DNA, 35 bp, Artificial Sequence
  Synthetic oligonucleotide
tctcgcgccgcagaatttaccggaaatttgccctc

SEQ ID NO: 72733 - DNA, 35 bp, Artificial Sequence
  Synthetic oligonucleotide
tacatccccgtaggccgatcaatagtcctacgctc

SEQ ID NO: 72734 - DNA, 35 bp, Artificial Sequence
  Synthetic oligonucleotide
tgtatccgtcgggtttcactgggttgtcctttctc

SEQ ID NO: 72735 - DNA, 35 bp, Artificial Sequence
  Synthetic oligonucleotide
tacatcgacgggatggtgttggttaattcaaggtc

SEQ ID NO: 72736 - DNA, 35 bp, Artificial Sequence
  Synthetic oligonucleotide
agtcggggggagagcaacagtaagcgtaggtaaag

SEQ ID NO: 72737 - DNA, 35 bp, Artificial Sequence
  Synthetic oligonucleotide
gatattccatccctctgttaagcactcttttaaag

SEQ ID NO: 72738 - DNA, 35 bp, Artificial Sequence
  Synthetic oligonucleotide
aatgtagcacgtagccgccctccttatccatctag

SEQ ID NO: 72739 - DNA, 35 bp, Artificial Sequence
  Synthetic oligonucleotide
gatgccgtcttattttggtctctccatcgttgacg

SEQ ID NO: 72740 - DNA, 35 bp, Artificial Sequence
  Synthetic oligonucleotide
gagccgacgaagccggcggatctgcctattctacg

SEQ ID NO: 72741 - DNA, 35 bp, Artificial Sequence
  Synthetic oligonucleotide
gatgtgaggaaagggtgggtcgcagggccaggccg

SEQ ID NO: 72742 - DNA, 35 bp, Artificial Sequence
  Synthetic oligonucleotide
acactgatccgccgcgaggtgttcccaaccttccg

SEQ ID NO: 72743 - DNA, 36 bp, Artificial Sequence
  Synthetic oligonucleotide
gcacatcactgctctccccctcctggggcgacttcg

SEQ ID NO: 72744 - DNA, 34 bp, Artificial Sequence
  Synthetic oligonucleotide
tcgcgttccgaccaccttatgcgttcccctcagg

SEQ ID NO: 72745 - DNA, 35 bp, Artificial Sequence
  Synthetic oligonucleotide
gcgaaaggtggggggtcccggggttcagatagggg

SEQ ID NO: 72746 - DNA, 36 bp, Artificial Sequence
  Synthetic oligonucleotide
atggttgacggagggagaaatttggttacagagtgg

SEQ ID NO: 72747 - DNA, 35 bp, Artificial Sequence
  Synthetic oligonucleotide
accgaaggcacctgtaacacctgcgagtactcctg

SEQ ID NO: 72748 - DNA, 35 bp, Artificial Sequence
  Synthetic oligonucleotide
cccgacttcagccttcaacgtaccatccatcattg

SEQ ID NO: 72749 - DNA, 35 bp, Artificial Sequence
  Synthetic oligonucleotide
aagtacgggcaaaagaaattatagcaaagtagtat

SEQ ID NO: 72750 - DNA, 35 bp, Artificial Sequence
  Synthetic oligonucleotide
gccccgcatggcccccagggaattgacacatttct

SEQ ID NO: 72751 - DNA, 35 bp, Artificial Sequence
  Synthetic oligonucleotide
gtttccatctgcattataaccacatttttttgagt

SEQ ID NO: 72752 - DNA, 35 bp, Artificial Sequence
  Synthetic oligonucleotide
taagcccacttcagtcgctctgctaactctttagt

SEQ ID NO: 72753 - DNA, 35 bp, Artificial Sequence
  Synthetic oligonucleotide
gtatgaataggaggttgcaaaggcgatgggcgggt

SEQ ID NO: 72754 - DNA, 35 bp, Artificial Sequence
  Synthetic oligonucleotide
tccaggtcgcttgctcgtttctcacaagtgaactt

SEQ ID NO: 72755 - DNA, 35 bp, Artificial Sequence
  Synthetic oligonucleotide
atgggtggtggcatagtctcgggcaaatctacctt

SEQ ID NO: 72756 - DNA, 35 bp, Artificial Sequence
  Synthetic oligonucleotide
acgatgggccaaatgtattgtcaacgtactttctt

SEQ ID NO: 72757 - DNA, 35 bp, Artificial Sequence
  Synthetic oligonucleotide
tgcgacgtacacaatgacctttcatcacgacggtt

SEQ ID NO: 72758 - DNA, 35 bp, Artificial Sequence
  Synthetic oligonucleotide
accttgcaacaccccctctttcagagtaaactgtt

SEQ ID NO: 72759 - DNA, 35 bp, Artificial Sequence
  Synthetic oligonucleotide
catggacgtggggacagaagatgtgtctagccttt

SEQ ID NO: 72760 - DNA, 35 bp, Artificial Sequence
  Synthetic oligonucleotide
ttgctcctcagcccgaccacactgtgctgttcttt

SEQ ID NO: 72761 - DNA, 35 bp, Artificial Sequence
  Synthetic oligonucleotide
atctccttcaactggcctccaggcaactgactttt

SEQ ID NO: 72762 - DNA, 36 bp, Artificial Sequence
  Synthetic oligonucleotide
gaggagcgcccctgccggagtatcgtcacatacaaa

SEQ ID NO: 72763 - DNA, 35 bp, Artificial Sequence
  Synthetic oligonucleotide
acttgggcgctttggcctaacttcacttttctaaa

SEQ ID NO: 72764 - DNA, 35 bp, Artificial Sequence
  Synthetic oligonucleotide
gtgatctcagttgcgctccagctaacttgtcccaa

SEQ ID NO: 72765 - DNA, 36 bp, Artificial Sequence
  Synthetic oligonucleotide
tccaggcgtgccatccatcggtactccatcccgcaa

SEQ ID NO: 72766 - DNA, 35 bp, Artificial Sequence
  Synthetic oligonucleotide
agccaagctcatacctcttagcactggatcctcaa

SEQ ID NO: 72767 - DNA, 35 bp, Artificial Sequence
  Synthetic oligonucleotide
gtcactcctgacaatgtcttttcctcttacgagaa

SEQ ID NO: 72768 - DNA, 35 bp, Artificial Sequence
  Synthetic oligonucleotide
aaacaagaactgttggagggatgaagtgagtggaa

SEQ ID NO: 72769 - DNA, 36 bp, Artificial Sequence
  Synthetic oligonucleotide
tcgcatcatactttcacatcacggcctgagcaccca

SEQ ID NO: 72770 - DNA, 36 bp, Artificial Sequence
  Synthetic oligonucleotide
ccctgccacacccagtcgccatacgttcaggcccca

SEQ ID NO: 72771 - DNA, 36 bp, Artificial Sequence
  Synthetic oligonucleotide
tgcaatgtgctcagttcaccggcttctgttgcccca

SEQ ID NO: 72772 - DNA, 35 bp, Artificial Sequence
  Synthetic oligonucleotide
agctcgccgctaacccctgccaatttggtaccgca

SEQ ID NO: 72773 - DNA, 36 bp, Artificial Sequence
  Synthetic oligonucleotide
acatcccagatattctctacaagcccgccttcggca

SEQ ID NO: 72774 - DNA, 35 bp, Artificial Sequence
  Synthetic oligonucleotide
acatttgtgcccgttgcgcattcaccacacatgca

SEQ ID NO: 72775 - DNA, 35 bp, Artificial Sequence
  Synthetic oligonucleotide
agcagtgcccaccgtccacctgccctacctaatca

SEQ ID NO: 72776 - DNA, 36 bp, Artificial Sequence
  Synthetic oligonucleotide
tgccctggtccaaggtactgtcattggccattatca

SEQ ID NO: 72777 - DNA, 36 bp, Artificial Sequence
  Synthetic oligonucleotide
gttagccgacagaggggaaagggaggaagtcattca

SEQ ID NO: 72778 - DNA, 36 bp, Artificial Sequence
  Synthetic oligonucleotide
atccctcacacttctgcctggagatcgtttacttca

SEQ ID NO: 72779 - DNA, 35 bp, Artificial Sequence
  Synthetic oligonucleotide
tcaggaactcaccactgcgcacatcatctgcttca

SEQ ID NO: 72780 - DNA, 35 bp, Artificial Sequence
  Synthetic oligonucleotide
acgggagagggagatttgggtgggtcttatgaaga

SEQ ID NO: 72781 - DNA, 37 bp, Artificial Sequence
  Synthetic oligonucleotide
tgatgtcatcagcgccccgtttccgcacacccgcaga

SEQ ID NO: 72782 - DNA, 37 bp, Artificial Sequence
  Synthetic oligonucleotide
acaacgagggtgtgcgttattaagggggctgggcaga

SEQ ID NO: 72783 - DNA, 37 bp, Artificial Sequence
  Synthetic oligonucleotide
tcacaagcacacaccatattactcagtctctgtcaga

SEQ ID NO: 72784 - DNA, 35 bp, Artificial Sequence
  Synthetic oligonucleotide
atggaaaagcagaaggagggtgtcggggagagaga

SEQ ID NO: 72785 - DNA, 37 bp, Artificial Sequence
  Synthetic oligonucleotide
gcaatgggagggtaggggacggaaccgttaatggaga

SEQ ID NO: 72786 - DNA, 37 bp, Artificial Sequence
  Synthetic oligonucleotide
gcaaagggtaggggtgataggggacttgggcattaga

SEQ ID NO: 72787 - DNA, 37 bp, Artificial Sequence
  Synthetic oligonucleotide
tgtccgccctcatctatcagtgcctctaacatttaga

SEQ ID NO: 72788 - DNA, 37 bp, Artificial Sequence
  Synthetic oligonucleotide
tcatccgcacattgacacgggactgattgcctaacga

SEQ ID NO: 72789 - DNA, 37 bp, Artificial Sequence
  Synthetic oligonucleotide
ggacgatgtagtaggattataaggctggggcggacga

SEQ ID NO: 72790 - DNA, 35 bp, Artificial Sequence
  Synthetic oligonucleotide
gaatcaccgtccacctcttcttgctgcgttgccga

SEQ ID NO: 72791 - DNA, 37 bp, Artificial Sequence
  Synthetic oligonucleotide
gactgagccacatggatcggaacgtatagggatgcga

SEQ ID NO: 72792 - DNA, 38 bp, Artificial Sequence
  Synthetic oligonucleotide
gtttgcaccttcatgttctcgtcacattgcgattgcga

SEQ ID NO: 72793 - DNA, 37 bp, Artificial Sequence
  Synthetic oligonucleotide
tgctggcccccgctctcggccttctccatgtgatcga

SEQ ID NO: 72794 - DNA, 37 bp, Artificial Sequence
  Synthetic oligonucleotide
tcacccacgttgaagcttatctgtcctgcggtctcga

SEQ ID NO: 72795 - DNA, 37 bp, Artificial Sequence
  Synthetic oligonucleotide
gactacacccgcccgctgactgtttcccaagccagga

SEQ ID NO: 72796 - DNA, 37 bp, Artificial Sequence
  Synthetic oligonucleotide
gtaaggtcgatggggaatgggaggtgttggtggcgga

SEQ ID NO: 72797 - DNA, 37 bp, Artificial Sequence
  Synthetic oligonucleotide
acattactggggtggttgaggaaggaaaagggaggga

SEQ ID NO: 72798 - DNA, 37 bp, Artificial Sequence
  Synthetic oligonucleotide
tgaacatcgggggggcaggttggggatattgtaggga

SEQ ID NO: 72799 - DNA, 37 bp, Artificial Sequence
  Synthetic oligonucleotide
tcgctgttccccatcgctgtttttcgtttgcccggga

SEQ ID NO: 72800 - DNA, 37 bp, Artificial Sequence
  Synthetic oligonucleotide
tctaacaagtgggggtgggctcaaagtaaagaatgga

SEQ ID NO: 72801 - DNA, 38 bp, Artificial Sequence
  Synthetic oligonucleotide
agggagggcggttaagaagggcgggatattcacaatga

SEQ ID NO: 72802 - DNA, 38 bp, Artificial Sequence
  Synthetic oligonucleotide
taccactgtcgcattgcgcgcgatttcattcataatga

SEQ ID NO: 72803 - DNA, 38 bp, Artificial Sequence
  Synthetic oligonucleotide
tataccagcccaccgccaacatgtcaggcacaccatga

SEQ ID NO: 72804 - DNA, 38 bp, Artificial Sequence
  Synthetic oligonucleotide
ttcgtcctagccattccttgttcattattcagacctga

SEQ ID NO: 72805 - DNA, 38 bp, Artificial Sequence
  Synthetic oligonucleotide
tgactaggtggtgggttatcgggggggtgcggctctga

SEQ ID NO: 72806 - DNA, 38 bp, Artificial Sequence
  Synthetic oligonucleotide
gactccaccaccattgtcgcgaaagaacactcttctga

SEQ ID NO: 72807 - DNA, 38 bp, Artificial Sequence
  Synthetic oligonucleotide
gacaccaccctgctgacgcctcctcacctatgacgtga

SEQ ID NO: 72808 - DNA, 37 bp, Artificial Sequence
  Synthetic oligonucleotide
gcacccgtcggcttctcgttcgctggccatcccgtga

SEQ ID NO: 72809 - DNA, 38 bp, Artificial Sequence
  Synthetic oligonucleotide
accagccagcacccgattattgtagggtcctctattga

SEQ ID NO: 72810 - DNA, 38 bp, Artificial Sequence
  Synthetic oligonucleotide
tatcttccccgaacgtttgctggacattcaaacgttga

SEQ ID NO: 72811 - DNA, 36 bp, Artificial Sequence
  Synthetic oligonucleotide
gaaataacgacggtggagggagcaagatttggttga

SEQ ID NO: 72812 - DNA, 38 bp, Artificial Sequence
  Synthetic oligonucleotide
acccacactgaccggacttagggtactcattaatttga

SEQ ID NO: 72813 - DNA, 36 bp, Artificial Sequence
  Synthetic oligonucleotide
tatccctcggcgtctctctttctgcctacagccata

SEQ ID NO: 72814 - DNA, 35 bp, Artificial Sequence
  Synthetic oligonucleotide
atgcaccagggggagaaaaatagcaagagagcata

SEQ ID NO: 72815 - DNA, 36 bp, Artificial Sequence
  Synthetic oligonucleotide
gccagggggaaggaaaagtggaagctggactatcta

SEQ ID NO: 72816 - DNA, 35 bp, Artificial Sequence
  Synthetic oligonucleotide
gtgttccgcatctccttctattgttcgaccttgta

SEQ ID NO: 72817 - DNA, 35 bp, Artificial Sequence
  Synthetic oligonucleotide
gctcctacgcgagctggaacctaaacatctgcaac

SEQ ID NO: 72818 - DNA, 35 bp, Artificial Sequence
  Synthetic oligonucleotide
taacgtgctcccgcagcttcctccttcggttcaac

SEQ ID NO: 72819 - DNA, 35 bp, Artificial Sequence
  Synthetic oligonucleotide
tcgtccttaactgttcctgcactgccactggtcac

SEQ ID NO: 72820 - DNA, 35 bp, Artificial Sequence
  Synthetic oligonucleotide
ggagtactcgcacttgcacttctggtcctcactac

SEQ ID NO: 72821 - DNA, 35 bp, Artificial Sequence
  Synthetic oligonucleotide
gacactcgactcttggtttcaacaacctatgctac

SEQ ID NO: 72822 - DNA, 35 bp, Artificial Sequence
  Synthetic oligonucleotide
tcaccctacgcctctattccgtcctcgggccttac

SEQ ID NO: 72823 - DNA, 35 bp, Artificial Sequence
  Synthetic oligonucleotide
gtgctagctaaggggaccccgcccaaaaatacacc

SEQ ID NO: 72824 - DNA, 35 bp, Artificial Sequence
  Synthetic oligonucleotide
tgcactccctcgcccggcaccacccgcaagctacc

SEQ ID NO: 72825 - DNA, 35 bp, Artificial Sequence
  Synthetic oligonucleotide
ttgtgccgactgtgactgaccttttctgcgccccc

SEQ ID NO: 72826 - DNA, 35 bp, Artificial Sequence
  Synthetic oligonucleotide
gcctacgaaggggtcacaagctgtggcccacgccc

SEQ ID NO: 72827 - DNA, 35 bp, Artificial Sequence
  Synthetic oligonucleotide
ttggacaggtcccgccaaagcattttactacgccc

SEQ ID NO: 72828 - DNA, 35 bp, Artificial Sequence
  Synthetic oligonucleotide
acgcttcacctggttccgatcttcccgggctagcc

SEQ ID NO: 72829 - DNA, 35 bp, Artificial Sequence
  Synthetic oligonucleotide
gcctgcatagcagtcgactttggagctggtactcc

SEQ ID NO: 72830 - DNA, 35 bp, Artificial Sequence
  Synthetic oligonucleotide
ggagctgtaccccgggtgactggcacaaaccctcc

SEQ ID NO: 72831 - DNA, 35 bp, Artificial Sequence
  Synthetic oligonucleotide
tgtgagatcctccatcccccccattgggtgccagc

SEQ ID NO: 72832 - DNA, 35 bp, Artificial Sequence
  Synthetic oligonucleotide
actgcgccaaccctcatggtcattgcgattacgtc

SEQ ID NO: 72833 - DNA, 35 bp, Artificial Sequence
  Synthetic oligonucleotide
gagcggacacaaaccttttcgaccgtaccatggtc

SEQ ID NO: 72834 - DNA, 35 bp, Artificial Sequence
  Synthetic oligonucleotide
gtcccaaccatttcctgtgccggccataacttgtc

SEQ ID NO: 72835 - DNA, 35 bp, Artificial Sequence
  Synthetic oligonucleotide
gtgccactacgcccgccgctctggctgtatggttc

SEQ ID NO: 72836 - DNA, 35 bp, Artificial Sequence
  Synthetic oligonucleotide
gactacctctcacacatgctattattcctactttc

SEQ ID NO: 72837 - DNA, 35 bp, Artificial Sequence
  Synthetic oligonucleotide
gagccacacccccgctgcagttctctcgcctacag

SEQ ID NO: 72838 - DNA, 35 bp, Artificial Sequence
  Synthetic oligonucleotide
acatctctccgccgcctcaatcctattggcaccag

SEQ ID NO: 72839 - DNA, 35 bp, Artificial Sequence
  Synthetic oligonucleotide
atcccttgtccatcttgtgttctttcctcgctgag

SEQ ID NO: 72840 - DNA, 35 bp, Artificial Sequence
  Synthetic oligonucleotide
tagacgatgtgccattcccgtccctcaatcgatag

SEQ ID NO: 72841 - DNA, 35 bp, Artificial Sequence
  Synthetic oligonucleotide
acttgcacgccttccacgcccaatggtatcgtacg

SEQ ID NO: 72842 - DNA, 35 bp, Artificial Sequence
  Synthetic oligonucleotide
gttgagcgccacgcactttttatgcacttcttagg

SEQ ID NO: 72843 - DNA, 35 bp, Artificial Sequence
  Synthetic oligonucleotide
gcgagggaataggtgggtatggggtggtggtgggg

SEQ ID NO: 72844 - DNA, 35 bp, Artificial Sequence
  Synthetic oligonucleotide
tgcgtagggcatcgggagtagataggaaggggatg

SEQ ID NO: 72845 - DNA, 35 bp, Artificial Sequence
  Synthetic oligonucleotide
gggtgcagaatagtggtgctcggggggaggtactg

SEQ ID NO: 72846 - DNA, 35 bp, Artificial Sequence
  Synthetic oligonucleotide
tatggggaggtgtgttaaatatgatgtgggcgctg

SEQ ID NO: 72847 - DNA, 33 bp, Artificial Sequence
  Synthetic oligonucleotide
tacatgtcacgagtgtgcttaatccgttcgctg

SEQ ID NO: 72848 - DNA, 35 bp, Artificial Sequence
  Synthetic oligonucleotide
tctacaccgactcactatgggcaacagccatgttg

SEQ ID NO: 72849 - DNA, 35 bp, Artificial Sequence
  Synthetic oligonucleotide
aaccaccgtctcagtggtttccggaacaccttttg

SEQ ID NO: 72850 - DNA, 35 bp, Artificial Sequence
  Synthetic oligonucleotide
tgccgaccccttttcgatccagtcttggagttcat

SEQ ID NO: 72851 - DNA, 35 bp, Artificial Sequence
  Synthetic oligonucleotide
tgatcgggacatggttagtaaaaggtgggagggat

SEQ ID NO: 72852 - DNA, 34 bp, Artificial Sequence
  Synthetic oligonucleotide
taatccagggctgccatgcgactaccacatttat

SEQ ID NO: 72853 - DNA, 35 bp, Artificial Sequence
  Synthetic oligonucleotide
actacactcgcttcgactagccgcaagccaccact

SEQ ID NO: 72854 - DNA, 35 bp, Artificial Sequence
  Synthetic oligonucleotide
tcgacgattcagcgtctgccttgcatcccccccct

SEQ ID NO: 72855 - DNA, 35 bp, Artificial Sequence
  Synthetic oligonucleotide
gtgaaggtacctgcacatgatggcgcctccctcct

SEQ ID NO: 72856 - DNA, 35 bp, Artificial Sequence
  Synthetic oligonucleotide
gacttccacctactcgtgcacgttgcctcaattct

SEQ ID NO: 72857 - DNA, 35 bp, Artificial Sequence
  Synthetic oligonucleotide
gttgcccactcgccttcagttcccggacatgccgt

SEQ ID NO: 72858 - DNA, 35 bp, Artificial Sequence
  Synthetic oligonucleotide
tcccacgaccccgaaccgggtgggcatgggagggt

SEQ ID NO: 72859 - DNA, 35 bp, Artificial Sequence
  Synthetic oligonucleotide
actgcacggcataacttctgcgcttccttgcgggt

SEQ ID NO: 72860 - DNA, 35 bp, Artificial Sequence
  Synthetic oligonucleotide
gcaccaccgttacgactccggattttgcccccctt

SEQ ID NO: 72861 - DNA, 35 bp, Artificial Sequence
  Synthetic oligonucleotide
gcccagccttacgtgcagatcctttcaattacttt

SEQ ID NO: 72862 - DNA, 36 bp, Artificial Sequence
  Synthetic oligonucleotide
gccagggaccaggacaaaagggggttcgttcgaaaa

SEQ ID NO: 72863 - DNA, 35 bp, Artificial Sequence
  Synthetic oligonucleotide
ttgtcacgaggcgtgacactacactaaacttaaaa

SEQ ID NO: 72864 - DNA, 35 bp, Artificial Sequence
  Synthetic oligonucleotide
gaacgtgttccacccttctcgcccccgtcgaacaa

SEQ ID NO: 72865 - DNA, 36 bp, Artificial Sequence
  Synthetic oligonucleotide
tagcccccccgcccacgattatcatcactgacacaa

SEQ ID NO: 72866 - DNA, 35 bp, Artificial Sequence
  Synthetic oligonucleotide
tacgcagacgtaccacaacgcttatctttccacaa

SEQ ID NO: 72867 - DNA, 36 bp, Artificial Sequence
  Synthetic oligonucleotide
gtgcggacatacagaacgatccacagcacctcacaa

SEQ ID NO: 72868 - DNA, 35 bp, Artificial Sequence
  Synthetic oligonucleotide
agaacgcccgactccccatagcaagaatgccccaa

SEQ ID NO: 72869 - DNA, 35 bp, Artificial Sequence
  Synthetic oligonucleotide
aagtaccatgcaccgcgagttccacactctttcaa

SEQ ID NO: 72870 - DNA, 35 bp, Artificial Sequence
  Synthetic oligonucleotide
tccatccgacttgaagttcacgtatagttcaagaa

SEQ ID NO: 72871 - DNA, 36 bp, Artificial Sequence
  Synthetic oligonucleotide
aagcgcaaccaacagccctatcatgcccgccactaa

SEQ ID NO: 72872 - DNA, 36 bp, Artificial Sequence
  Synthetic oligonucleotide
gcaaccaccggtgtttgtcaatgtactctacgctaa

SEQ ID NO: 72873 - DNA, 36 bp, Artificial Sequence
  Synthetic oligonucleotide
gccagaccctccgcctgacttatgacctagggctaa

SEQ ID NO: 72874 - DNA, 35 bp, Artificial Sequence
  Synthetic oligonucleotide
tcgtcgcacctccggcccatatagctccccagtaa

SEQ ID NO: 72875 - DNA, 36 bp, Artificial Sequence
  Synthetic oligonucleotide
ttcctctccgccctgtcgtgttgcgatgcacgttaa

SEQ ID NO: 72876 - DNA, 36 bp, Artificial Sequence
  Synthetic oligonucleotide
gctggcccaactctatgtcatttctgtgaacacaca

SEQ ID NO: 72877 - DNA, 36 bp, Artificial Sequence
  Synthetic oligonucleotide
gactcgctcccttatcggcacaaagttcacgccaca

SEQ ID NO: 72878 - DNA, 36 bp, Artificial Sequence
  Synthetic oligonucleotide
ggtcacgggtgagggggtgtggggatgagcgagaca

SEQ ID NO: 72879 - DNA, 36 bp, Artificial Sequence
  Synthetic oligonucleotide
gtgacgagccatcattcagtgtggtacattattaca

SEQ ID NO: 72880 - DNA, 36 bp, Artificial Sequence
  Synthetic oligonucleotide
acttgacacaacgaatcccgagtgagcagtgagcca

SEQ ID NO: 72881 - DNA, 35 bp, Artificial Sequence
  Synthetic oligonucleotide
tatgtccatccatccgcaatctcatacagttagca

SEQ ID NO: 72882 - DNA, 36 bp, Artificial Sequence
  Synthetic oligonucleotide
gtgacaaaccgttgccgtgcttaattagccttcgca

SEQ ID NO: 72883 - DNA, 35 bp, Artificial Sequence
  Synthetic oligonucleotide
gatcacccgccctttgataagagcgcgcccggtca

SEQ ID NO: 72884 - DNA, 36 bp, Artificial Sequence
  Synthetic oligonucleotide
gttcaggcctctttccctcgacactttgttggttca

SEQ ID NO: 72885 - DNA, 36 bp, Artificial Sequence
  Synthetic oligonucleotide
gtggggaggacgacgtggcaattggaacgcagaaga

SEQ ID NO: 72886 - DNA, 38 bp, Artificial Sequence
  Synthetic oligonucleotide
tacgctgttaagggcaatattggctgagggtctgaaga

SEQ ID NO: 72887 - DNA, 37 bp, Artificial Sequence
  Synthetic oligonucleotide
tgaaccctcctccgccttctgatcgcctggtgctaga

SEQ ID NO: 72888 - DNA, 37 bp, Artificial Sequence
  Synthetic oligonucleotide
tgacgtgggagaaataggggatgcttaggcgggtaga

SEQ ID NO: 72889 - DNA, 37 bp, Artificial Sequence
  Synthetic oligonucleotide
acatcccccggcccttggatagttgtcgaccccacga

SEQ ID NO: 72890 - DNA, 38 bp, Artificial Sequence
  Synthetic oligonucleotide
taggccccccatcattgtttgcactatcggaattacga

SEQ ID NO: 72891 - DNA, 37 bp, Artificial Sequence
  Synthetic oligonucleotide
tgtaccgtgcccccttttgttcagtgagctatgccga

SEQ ID NO: 72892 - DNA, 37 bp, Artificial Sequence
  Synthetic oligonucleotide
gcgatgggggtctgtggggggggaaccgggaaagcga

SEQ ID NO: 72893 - DNA, 37 bp, Artificial Sequence
  Synthetic oligonucleotide
tcgacccccgctcggttcgccataccctgtagcgcga

SEQ ID NO: 72894 - DNA, 37 bp, Artificial Sequence
  Synthetic oligonucleotide
gcacaacctatacctcttgcagccacatccactgcga

SEQ ID NO: 72895 - DNA, 37 bp, Artificial Sequence
  Synthetic oligonucleotide
taaccaccagtcgccgtgcggacgctaccccttgcga

SEQ ID NO: 72896 - DNA, 36 bp, Artificial Sequence
  Synthetic oligonucleotide
gagccacgcaaccaaagatcctgattatcccatcga

SEQ ID NO: 72897 - DNA, 37 bp, Artificial Sequence
  Synthetic oligonucleotide
gtatcctcgctgaagggaacgggagaggtgggatcga

SEQ ID NO: 72898 - DNA, 35 bp, Artificial Sequence
  Synthetic oligonucleotide
agatcccccacatattctcacgataacatcctcga

SEQ ID NO: 72899 - DNA, 37 bp, Artificial Sequence
  Synthetic oligonucleotide
tactagggagagggcgtgataggtgccggttggagga

SEQ ID NO: 72900 - DNA, 37 bp, Artificial Sequence
  Synthetic oligonucleotide
gaagaaggttatgggtggtgagagagcggtgatagga

SEQ ID NO: 72901 - DNA, 37 bp, Artificial Sequence
  Synthetic oligonucleotide
tagcaaggctagggggcttgttggaaagggtgatgga

SEQ ID NO: 72902 - DNA, 38 bp, Artificial Sequence
  Synthetic oligonucleotide
ttcaccggggtgaaactgaccccttcctcaatgaatga

SEQ ID NO: 72903 - DNA, 37 bp, Artificial Sequence
  Synthetic oligonucleotide
accaccaccacgtgcaaccacagtcactcgttcatga

SEQ ID NO: 72904 - DNA, 36 bp, Artificial Sequence
  Synthetic oligonucleotide
gtgggtcgcgggagggagggaacgtggacccgatga

SEQ ID NO: 72905 - DNA, 37 bp, Artificial Sequence
  Synthetic oligonucleotide
tgtgtaggtctgggagggatcgggtgggagagactga

SEQ ID NO: 72906 - DNA, 38 bp, Artificial Sequence
  Synthetic oligonucleotide
gagacagggacataatgtggaaacgaggggggtactga

SEQ ID NO: 72907 - DNA, 38 bp, Artificial Sequence
  Synthetic oligonucleotide
accctcgtgcccacctgtagtgcaacccaacaacctga

SEQ ID NO: 72908 - DNA, 38 bp, Artificial Sequence
  Synthetic oligonucleotide
aatgcgagccggacttccacttacagacaaacccctga

SEQ ID NO: 72909 - DNA, 38 bp, Artificial Sequence
  Synthetic oligonucleotide
gtgaactcatcgcattggcgtatagaccacctccctga

SEQ ID NO: 72910 - DNA, 38 bp, Artificial Sequence
  Synthetic oligonucleotide
catccccatcatgacttcagggtcgtcaatgagcctga

SEQ ID NO: 72911 - DNA, 38 bp, Artificial Sequence
  Synthetic oligonucleotide
tgcgtttggcgccccacgtgcttcaccccttgtcctga

SEQ ID NO: 72912 - DNA, 38 bp, Artificial Sequence
  Synthetic oligonucleotide
gcacatcacggtgataactgcattgggggaactgctga

SEQ ID NO: 72913 - DNA, 37 bp, Artificial Sequence
  Synthetic oligonucleotide
tcttaccctcttgcgataagcataaccaacaccgtga

SEQ ID NO: 72914 - DNA, 38 bp, Artificial Sequence
  Synthetic oligonucleotide
atgtcgagtgaaaacgagggtggggtgagacatcgtga

SEQ ID NO: 72915 - DNA, 37 bp, Artificial Sequence
  Synthetic oligonucleotide
atgtcacgggcacatcgataagggcggtggtaggtga

SEQ ID NO: 72916 - DNA, 38 bp, Artificial Sequence
  Synthetic oligonucleotide
ggacactgaagcggggtgaaataactgggagatggtga

SEQ ID NO: 72917 - DNA, 38 bp, Artificial Sequence
  Synthetic oligonucleotide
actccccgccgccgccccgcctgtttgtgaacgtgtga

SEQ ID NO: 72918 - DNA, 38 bp, Artificial Sequence
  Synthetic oligonucleotide
atggggagtgggggggaactggaatatgacttgtgtga

SEQ ID NO: 72919 - DNA, 38 bp, Artificial Sequence
  Synthetic oligonucleotide
gcgtaccatcagccctgttccagcctcgacctcattga

SEQ ID NO: 72920 - DNA, 38 bp, Artificial Sequence
  Synthetic oligonucleotide
aagacggggggcaggtacgacatggggtagtggattga

SEQ ID NO: 72921 - DNA, 38 bp, Artificial Sequence
  Synthetic oligonucleotide
actgccccgccagtagacacttcacagtagccccttga

SEQ ID NO: 72922 - DNA, 36 bp, Artificial Sequence
  Synthetic oligonucleotide
tgcatcccagaccgttataaattacttacctcttga

SEQ ID NO: 72923 - DNA, 38 bp, Artificial Sequence
  Synthetic oligonucleotide
gtccactcacatgatcatccctgcattttcgcagttga

SEQ ID NO: 72924 - DNA, 37 bp, Artificial Sequence
  Synthetic oligonucleotide
tgatccctccagaaccgtaaaagccgcaattcgttga

SEQ ID NO: 72925 - DNA, 38 bp, Artificial Sequence
  Synthetic oligonucleotide
tcgacccgtacgtctggggaaaggggaatgaggtttga

SEQ ID NO: 72926 - DNA, 34 bp, Artificial Sequence
  Synthetic oligonucleotide
tacagagccactgcgaccacctatacgaattata

SEQ ID NO: 72927 - DNA, 36 bp, Artificial Sequence
  Synthetic oligonucleotide
ttacgcaaactgcgtaaacccattagtcgtagacta

SEQ ID NO: 72928 - DNA, 36 bp, Artificial Sequence
  Synthetic oligonucleotide
tgaccctgaacaccagggattcgattcttctatcta

SEQ ID NO: 72929 - DNA, 35 bp, Artificial Sequence
  Synthetic oligonucleotide
aactgacggacagagtgcgaggtaaaacaagcgta

SEQ ID NO: 72930 - DNA, 36 bp, Artificial Sequence
  Synthetic oligonucleotide
gaatcacagtccggaacaagggtagtaggggaggta

SEQ ID NO: 72931 - DNA, 35 bp, Artificial Sequence
  Synthetic oligonucleotide
tcgttgattccgcctgctcgaaagatctgaaccac

SEQ ID NO: 72932 - DNA, 35 bp, Artificial Sequence
  Synthetic oligonucleotide
gtacgcctcgggcttcccctttggtttttcaaacc

SEQ ID NO: 72933 - DNA, 35 bp, Artificial Sequence
  Synthetic oligonucleotide
aatgccagccaactttttcactggctcatgagacc

SEQ ID NO: 72934 - DNA, 35 bp, Artificial Sequence
  Synthetic oligonucleotide
taacatcccactgtgccccgctccacgctccgacc

SEQ ID NO: 72935 - DNA, 35 bp, Artificial Sequence
  Synthetic oligonucleotide
atgcaacacccgtatgtctgcacactcattctacc

SEQ ID NO: 72936 - DNA, 35 bp, Artificial Sequence
  Synthetic oligonucleotide
gcgaagctacaggcgtgccattctgtgcatctccc

SEQ ID NO: 72937 - DNA, 35 bp, Artificial Sequence
  Synthetic oligonucleotide
aactagcactcaccgccggagaagccccctgagcc

SEQ ID NO: 72938 - DNA, 35 bp, Artificial Sequence
  Synthetic oligonucleotide
acccttgcaggggtcggattgctttcctgcctgcc

SEQ ID NO: 72939 - DNA, 35 bp, Artificial Sequence
  Synthetic oligonucleotide
gttcgaagcacacaatatccacctttgttacaagc

SEQ ID NO: 72940 - DNA, 35 bp, Artificial Sequence
  Synthetic oligonucleotide
accgtaccttgtagttgggctttccctcctgccgc

SEQ ID NO: 72941 - DNA, 35 bp, Artificial Sequence
  Synthetic oligonucleotide
ttggtacccagggctgacatctctttactttgggc

SEQ ID NO: 72942 - DNA, 35 bp, Artificial Sequence
  Synthetic oligonucleotide
ttcaccccgtataccccgcatccagcagattatgc

SEQ ID NO: 72943 - DNA, 35 bp, Artificial Sequence
  Synthetic oligonucleotide
acgatcacaaacgtcctggactcaataaacgctgc

SEQ ID NO: 72944 - DNA, 35 bp, Artificial Sequence
  Synthetic oligonucleotide
gggataccgcacctggctgaccgcgcattttaatc

SEQ ID NO: 72945 - DNA, 35 bp, Artificial Sequence
  Synthetic oligonucleotide
ttgaagccgcatgaacctttacgccattcatcatc

SEQ ID NO: 72946 - DNA, 35 bp, Artificial Sequence
  Synthetic oligonucleotide
tgtgcaacatgtacagacttcctgtctgattgctc

SEQ ID NO: 72947 - DNA, 35 bp, Artificial Sequence
  Synthetic oligonucleotide
gacaaccgcgcgcctctccgatcagtcacttcgtc

SEQ ID NO: 72948 - DNA, 34 bp, Artificial Sequence
  Synthetic oligonucleotide
tccgtaatcgtactccgtccttctatccactgtc

SEQ ID NO: 72949 - DNA, 35 bp, Artificial Sequence
  Synthetic oligonucleotide
gactccttacaagaccctgagatccacctgaattc

SEQ ID NO: 72950 - DNA, 35 bp, Artificial Sequence
  Synthetic oligonucleotide
tctaacgacctgcttcgaccctcacaggcaacttc

SEQ ID NO: 72951 - DNA, 35 bp, Artificial Sequence
  Synthetic oligonucleotide
taccgaccattgacaccaccccgcgctgtaacaag

SEQ ID NO: 72952 - DNA, 35 bp, Artificial Sequence
  Synthetic oligonucleotide
aaacacatccacagtatgccaccgctttctatatg

SEQ ID NO: 72953 - DNA, 35 bp, Artificial Sequence
  Synthetic oligonucleotide
gtgtggtggtcggaagagatctcttgggaagtgtg

SEQ ID NO: 72954 - DNA, 35 bp, Artificial Sequence
  Synthetic oligonucleotide
gcaataccctacgcgatccccaaggccaccacttg

SEQ ID NO: 72955 - DNA, 35 bp, Artificial Sequence
  Synthetic oligonucleotide
acccgtcccgccaacgcgccgccttagacacaaat

SEQ ID NO: 72956 - DNA, 35 bp, Artificial Sequence
  Synthetic oligonucleotide
agcccgactccccgaatatgtacttacggccgaat

SEQ ID NO: 72957 - DNA, 35 bp, Artificial Sequence
  Synthetic oligonucleotide
gtatccgccaccacgcaggccacccgttgcaccat

SEQ ID NO: 72958 - DNA, 35 bp, Artificial Sequence
  Synthetic oligonucleotide
gctgccctcaccctaggccactcatagtacctgat

SEQ ID NO: 72959 - DNA, 35 bp, Artificial Sequence
  Synthetic oligonucleotide
aaactgcctcccgtcttttaccgtttttgcaaact

SEQ ID NO: 72960 - DNA, 35 bp, Artificial Sequence
  Synthetic oligonucleotide
gttgccatgttctgctaaattcaatgtcccaccct

SEQ ID NO: 72961 - DNA, 35 bp, Artificial Sequence
  Synthetic oligonucleotide
gttgcactatgctgtaaattttacccactgcccct

SEQ ID NO: 72962 - DNA, 35 bp, Artificial Sequence
  Synthetic oligonucleotide
tttagtgaccgttctgttcgttagcgcatctccct

SEQ ID NO: 72963 - DNA, 35 bp, Artificial Sequence
  Synthetic oligonucleotide
tgaccatatatcggttgagagctctatccttccct

SEQ ID NO: 72964 - DNA, 35 bp, Artificial Sequence
  Synthetic oligonucleotide
gcctgttccacctagataactaataactgttgcct

SEQ ID NO: 72965 - DNA, 35 bp, Artificial Sequence
  Synthetic oligonucleotide
acaaccaagtctctgaccacgaccgtccctgtcct

SEQ ID NO: 72966 - DNA, 35 bp, Artificial Sequence
  Synthetic oligonucleotide
ttgctgctttccgcactgtccctcctggaattcct

SEQ ID NO: 72967 - DNA, 35 bp, Artificial Sequence
  Synthetic oligonucleotide
taggggcgcttctaaggcctgccaaccgtttcgct

SEQ ID NO: 72968 - DNA, 35 bp, Artificial Sequence
  Synthetic oligonucleotide
tgaagagtgagggggcggtggcttcgaggacgtct

SEQ ID NO: 72969 - DNA, 35 bp, Artificial Sequence
  Synthetic oligonucleotide
gcctgtacactcccctatttgcctggtctcttagt

SEQ ID NO: 72970 - DNA, 35 bp, Artificial Sequence
  Synthetic oligonucleotide
aactccgtgtcccgccggctgttgctccgtctcgt

SEQ ID NO: 72971 - DNA, 35 bp, Artificial Sequence
  Synthetic oligonucleotide
gtggactgacgtggaagtcatggatcgagtggggt

SEQ ID NO: 72972 - DNA, 35 bp, Artificial Sequence
  Synthetic oligonucleotide
ggggctgaaactcgatccgtcctgtcatcactatt

SEQ ID NO: 72973 - DNA, 35 bp, Artificial Sequence
  Synthetic oligonucleotide
tgcaaagttccgtcccctgtcagccacacacactt

SEQ ID NO: 72974 - DNA, 34 bp, Artificial Sequence
  Synthetic oligonucleotide
tccatccgtaagtgaggaagcggaaactcacctt

SEQ ID NO: 72975 - DNA, 35 bp, Artificial Sequence
  Synthetic oligonucleotide
tgtgtaccgaatttagcctattgttattgttcctt

SEQ ID NO: 72976 - DNA, 35 bp, Artificial Sequence
  Synthetic oligonucleotide
gcccacgtatgtcgtaatgatcccgccttctgctt

SEQ ID NO: 72977 - DNA, 36 bp, Artificial Sequence
  Synthetic oligonucleotide
gagtggactagcggaggggggtaaagggcactaaaa

SEQ ID NO: 72978 - DNA, 36 bp, Artificial Sequence
  Synthetic oligonucleotide
gctcagccgccccccagcttttaccatgtcttgcaa

SEQ ID NO: 72979 - DNA, 36 bp, Artificial Sequence
  Synthetic oligonucleotide
tgtgactggcacacagcaaagaagatacggggtcaa

SEQ ID NO: 72980 - DNA, 35 bp, Artificial Sequence
  Synthetic oligonucleotide
gcgagagcgcacgtaggagggggatcgtacaagaa

SEQ ID NO: 72981 - DNA, 36 bp, Artificial Sequence
  Synthetic oligonucleotide
tatgcggcttaaatgggcgggagggatttaggggaa

SEQ ID NO: 72982 - DNA, 36 bp, Artificial Sequence
  Synthetic oligonucleotide
acacatgggtggctgtgtggaggggtctgttttgaa

SEQ ID NO: 72983 - DNA, 36 bp, Artificial Sequence
  Synthetic oligonucleotide
ttgtgccaccgggaggctcactgcctgcatttttaa

SEQ ID NO: 72984 - DNA, 35 bp, Artificial Sequence
  Synthetic oligonucleotide
agtcccctccaccgcatctaatctatcgagtaaca

SEQ ID NO: 72985 - DNA, 36 bp, Artificial Sequence
  Synthetic oligonucleotide
gcatctgcactcgatggcctcccttatactgtacca

SEQ ID NO: 72986 - DNA, 36 bp, Artificial Sequence
  Synthetic oligonucleotide
gctccccctactgatcgcgccctgtggatcatccca

SEQ ID NO: 72987 - DNA, 35 bp, Artificial Sequence
  Synthetic oligonucleotide
tgaactggtttaagtccagcgttccatttctgcca

SEQ ID NO: 72988 - DNA, 36 bp, Artificial Sequence
  Synthetic oligonucleotide
ttgcatgcaggcgcacaaccgttcgttcctaatcca

SEQ ID NO: 72989 - DNA, 36 bp, Artificial Sequence
  Synthetic oligonucleotide
acgttgaaatgggagggggtgggagataggggagca

SEQ ID NO: 72990 - DNA, 36 bp, Artificial Sequence
  Synthetic oligonucleotide
gaagacagcacatgaaaaatgggacacggaggggca

SEQ ID NO: 72991 - DNA, 35 bp, Artificial Sequence
  Synthetic oligonucleotide
aatcattaccgtgcacaccccggtctggtccctca

SEQ ID NO: 72992 - DNA, 36 bp, Artificial Sequence
  Synthetic oligonucleotide
atggggagggggccgtatgatgttcttggggcgtca

SEQ ID NO: 72993 - DNA, 36 bp, Artificial Sequence
  Synthetic oligonucleotide
tcacatgcatttcctgcactatgggagaactattca

SEQ ID NO: 72994 - DNA, 36 bp, Artificial Sequence
  Synthetic oligonucleotide
gcttgttcgcccgcgccgttcccctccgtttattca

SEQ ID NO: 72995 - DNA, 36 bp, Artificial Sequence
  Synthetic oligonucleotide
gggtggccttacctcgtgaattacgtaccatcttca

SEQ ID NO: 72996 - DNA, 35 bp, Artificial Sequence
  Synthetic oligonucleotide
atcatcctcccacctgtatagccaggaccacaaga

SEQ ID NO: 72997 - DNA, 37 bp, Artificial Sequence
  Synthetic oligonucleotide
tcgtttcaccctgccactcatttacagtcatagaaga

SEQ ID NO: 72998 - DNA, 36 bp, Artificial Sequence
  Synthetic oligonucleotide
acgaacggtagagtgggcacaaaatcaatcatcaga

SEQ ID NO: 72999 - DNA, 37 bp, Artificial Sequence
  Synthetic oligonucleotide
gagtgagggtaatggtaggcatatatggagagagaga

SEQ ID NO: 73000 - DNA, 37 bp, Artificial Sequence
  Synthetic oligonucleotide
aacgtggatggcgcgataggctggaagggggaggaga

SEQ ID NO: 73001 - DNA, 37 bp, Artificial Sequence
  Synthetic oligonucleotide
tgcggaaaggaggcaagaaattggctgaaacggacga

SEQ ID NO: 73002 - DNA, 37 bp, Artificial Sequence
  Synthetic oligonucleotide
gacccgactcgactataatccatgctgacaccatcga

SEQ ID NO: 73003 - DNA, 37 bp, Artificial Sequence
  Synthetic oligonucleotide
aacgatgtacggctgaggatggaccaaatattgagga

SEQ ID NO: 73004 - DNA, 36 bp, Artificial Sequence
  Synthetic oligonucleotide
acttcgtgccctcccttcaccgtcccaaattacgga

SEQ ID NO: 73005 - DNA, 37 bp, Artificial Sequence
  Synthetic oligonucleotide
tcttgcgcccctagccatcctcttgtaattgtccgga

SEQ ID NO: 73006 - DNA, 36 bp, Artificial Sequence
  Synthetic oligonucleotide
gcccaacggtgggaggaaggtgagcggcttacggga

SEQ ID NO: 73007 - DNA, 37 bp, Artificial Sequence
  Synthetic oligonucleotide
tagtggaaggtgcaactacttatggggaggcggggga

SEQ ID NO: 73008 - DNA, 36 bp, Artificial Sequence
  Synthetic oligonucleotide
tacccggagtgataacgcacctcatttatcttggga

SEQ ID NO: 73009 - DNA, 37 bp, Artificial Sequence
  Synthetic oligonucleotide
gcatgaccaccttccacccacggccacttaggctgga

SEQ ID NO: 73010 - DNA, 37 bp, Artificial Sequence
  Synthetic oligonucleotide
aagagaacggacagcgggggcaaaggtacggtgtgga

SEQ ID NO: 73011 - DNA, 38 bp, Artificial Sequence
  Synthetic oligonucleotide
gacacgctccgtgcacatccatccattcgataaaatga

SEQ ID NO: 73012 - DNA, 38 bp, Artificial Sequence
  Synthetic oligonucleotide
atgccccgcccggggtgtaaatctcgcgccacccatga

SEQ ID NO: 73013 - DNA, 38 bp, Artificial Sequence
  Synthetic oligonucleotide
gatcccctccagacgcgataccacaaatggtggtatga

SEQ ID NO: 73014 - DNA, 37 bp, Artificial Sequence
  Synthetic oligonucleotide
ggggaaggaagggcaggaagtgggtcgtttcttatga

SEQ ID NO: 73015 - DNA, 38 bp, Artificial Sequence
  Synthetic oligonucleotide
tgtctcctcaccgcacgcccggtgctttacgcccctga

SEQ ID NO: 73016 - DNA, 37 bp, Artificial Sequence
  Synthetic oligonucleotide
actaacacccacaacctggctcctgctccctgcctga

SEQ ID NO: 73017 - DNA, 38 bp, Artificial Sequence
  Synthetic oligonucleotide
gtctcacgtccgactgctcaatactctctctaggctga

SEQ ID NO: 73018 - DNA, 36 bp, Artificial Sequence
  Synthetic oligonucleotide
tagcggagaggaaacggaggtgtttgaacttgctga

SEQ ID NO: 73019 - DNA, 38 bp, Artificial Sequence
  Synthetic oligonucleotide
acttgctggggggagtggggtggaataggcaagtctga

SEQ ID NO: 73020 - DNA, 38 bp, Artificial Sequence
  Synthetic oligonucleotide
atcgacaaagtcgaacggtgagggggagaaggttctga

SEQ ID NO: 73021 - DNA, 37 bp, Artificial Sequence
  Synthetic oligonucleotide
ttgggcccgcatgctcacctggctccccctacagtga

SEQ ID NO: 73022 - DNA, 37 bp, Artificial Sequence
  Synthetic oligonucleotide
ggtggtgggtctagggagggaattgatcatggagtga

SEQ ID NO: 73023 - DNA, 38 bp, Artificial Sequence
  Synthetic oligonucleotide
gcaaggtaggggggcgagcgctaaggtactgggggtga

SEQ ID NO: 73024 - DNA, 38 bp, Artificial Sequence
  Synthetic oligonucleotide
tgacacccgtcctaggaagaaaattatgccggtggtga

SEQ ID NO: 73025 - DNA, 38 bp, Artificial Sequence
  Synthetic oligonucleotide
gcgaagccactaggtaggctatattagggttgtggtga

SEQ ID NO: 73026 - DNA, 37 bp, Artificial Sequence
  Synthetic oligonucleotide
acacacttcatcagcacgtagttccgccaattattga

SEQ ID NO: 73027 - DNA, 35 bp, Artificial Sequence
  Synthetic oligonucleotide
gagatacacacgatggacctacgcactcttattga

SEQ ID NO: 73028 - DNA, 38 bp, Artificial Sequence
  Synthetic oligonucleotide
aacgccattacctcagccgtatgccctcatatacttga

SEQ ID NO: 73029 - DNA, 37 bp, Artificial Sequence
  Synthetic oligonucleotide
tcgataggccacctgacacaatcgagtccgtccttga

SEQ ID NO: 73030 - DNA, 38 bp, Artificial Sequence
  Synthetic oligonucleotide
acacgttatcacacccgctcccgagcagttcatcttga

SEQ ID NO: 73031 - DNA, 38 bp, Artificial Sequence
  Synthetic oligonucleotide
acatgcaagcagagcgtaaatcctggcgatgatcttga

SEQ ID NO: 73032 - DNA, 38 bp, Artificial Sequence
  Synthetic oligonucleotide
tgatcctcactcagctcgcgaacagagctaacatttga

SEQ ID NO: 73033 - DNA, 38 bp, Artificial Sequence
  Synthetic oligonucleotide
ggatccatccccctcatagcgtagttctacatctttga

SEQ ID NO: 73034 - DNA, 38 bp, Artificial Sequence
  Synthetic oligonucleotide
atgcgcgttaactcgtcccgtcgccacacctcttttga

SEQ ID NO: 73035 - DNA, 36 bp, Artificial Sequence
  Synthetic oligonucleotide
gaccgctgcatgccgaccaacatacgaccctgcata

SEQ ID NO: 73036 - DNA, 36 bp, Artificial Sequence
  Synthetic oligonucleotide
gactaaacgccctggaacgagcgcaatctcaatata

SEQ ID NO: 73037 - DNA, 35 bp, Artificial Sequence
  Synthetic oligonucleotide
tgaccccgctttatcgccgcgcattctgccatata

SEQ ID NO: 73038 - DNA, 35 bp, Artificial Sequence
  Synthetic oligonucleotide
gcccgctgggtacttcaatcttgcgtttgctccta

SEQ ID NO: 73039 - DNA, 36 bp, Artificial Sequence
  Synthetic oligonucleotide
accacgtgcagcattgacacccttcggaaccttcta

SEQ ID NO: 73040 - DNA, 36 bp, Artificial Sequence
  Synthetic oligonucleotide
tctaacctgtccgcttccgaagcatgtccccccgta

SEQ ID NO: 73041 - DNA, 36 bp, Artificial Sequence
  Synthetic oligonucleotide
tccgccacgcactgctggagtactcgtactgattta

SEQ ID NO: 73042 - DNA, 35 bp, Artificial Sequence
  Synthetic oligonucleotide
aacccgtactccgaacttggactcaccaggcaaac

SEQ ID NO: 73043 - DNA, 35 bp, Artificial Sequence
  Synthetic oligonucleotide
tctcgacccactgctatctcaactcggcgaacaac

SEQ ID NO: 73044 - DNA, 34 bp, Artificial Sequence
  Synthetic oligonucleotide
gactccgtcattaccatctgctccttcccgcgac

SEQ ID NO: 73045 - DNA, 35 bp, Artificial Sequence
  Synthetic oligonucleotide
tctagccgcgggccacccagcctcatccctgtgac

SEQ ID NO: 73046 - DNA, 35 bp, Artificial Sequence
  Synthetic oligonucleotide
ccgctccccgtagctatacgcaatttccggtatac

SEQ ID NO: 73047 - DNA, 35 bp, Artificial Sequence
  Synthetic oligonucleotide
gttgccacacttacttattctactatgtgtacacc

SEQ ID NO: 73048 - DNA, 35 bp, Artificial Sequence
  Synthetic oligonucleotide
cattacccccccaatgcttgtttattgcggatccc

SEQ ID NO: 73049 - DNA, 35 bp, Artificial Sequence
  Synthetic oligonucleotide
tttaccgttccccttaccactcgttgacgagtccc

SEQ ID NO: 73050 - DNA, 35 bp, Artificial Sequence
  Synthetic oligonucleotide
agtgacctcattccaggcctccccgtaacgcatcc

SEQ ID NO: 73051 - DNA, 35 bp, Artificial Sequence
  Synthetic oligonucleotide
tacggttgctccaccgtgcaactctctatgactcc

SEQ ID NO: 73052 - DNA, 35 bp, Artificial Sequence
  Synthetic oligonucleotide
ttttccgccacgcatcaaaccaccgtgttttgtcc

SEQ ID NO: 73053 - DNA, 35 bp, Artificial Sequence
  Synthetic oligonucleotide
gagcgcgctgtcaattaagttcattcccattttcc

SEQ ID NO: 73054 - DNA, 35 bp, Artificial Sequence
  Synthetic oligonucleotide
tacttcgcatctcatgactcacccgggaccacagc

SEQ ID NO: 73055 - DNA, 35 bp, Artificial Sequence
  Synthetic oligonucleotide
acagccacatttacgttgacttattatacacgcgc

SEQ ID NO: 73056 - DNA, 34 bp, Artificial Sequence
  Synthetic oligonucleotide
cctaccactgccccccaacatgctcctggctggc

SEQ ID NO: 73057 - DNA, 35 bp, Artificial Sequence
  Synthetic oligonucleotide
gtacgaccgagtacgtgccggatacacctcactgc

SEQ ID NO: 73058 - DNA, 35 bp, Artificial Sequence
  Synthetic oligonucleotide
ggacgccttcccaagttgtcacgcggaccaaaatc

SEQ ID NO: 73059 - DNA, 35 bp, Artificial Sequence
  Synthetic oligonucleotide
gtcgtaccacagaacttacctatcctctcctcatc

SEQ ID NO: 73060 - DNA, 35 bp, Artificial Sequence
  Synthetic oligonucleotide
acaccctcacatgtattgtcgatcttatctgcctc

SEQ ID NO: 73061 - DNA, 35 bp, Artificial Sequence
  Synthetic oligonucleotide
gtactgtcctatcacaggatgcacaaccactcctc

SEQ ID NO: 73062 - DNA, 35 bp, Artificial Sequence
  Synthetic oligonucleotide
ggttgccaccggctgaggcatgtcacatcttcctc

SEQ ID NO: 73063 - DNA, 35 bp, Artificial Sequence
  Synthetic oligonucleotide
tccagctaagggctaatttcctgtgtccccggctc

SEQ ID NO: 73064 - DNA, 35 bp, Artificial Sequence
  Synthetic oligonucleotide
agcactctcactgctccccgtgctggctccacgtc

SEQ ID NO: 73065 - DNA, 35 bp, Artificial Sequence
  Synthetic oligonucleotide
acgtccctgcacttcatctcacatttcacagtgtc

SEQ ID NO: 73066 - DNA, 35 bp, Artificial Sequence
  Synthetic oligonucleotide
tatgcggtcacaattttctcctacttgcgtacttc

SEQ ID NO: 73067 - DNA, 35 bp, Artificial Sequence
  Synthetic oligonucleotide
gtcacttatgcgcaggtaatacctgacctcttttc

SEQ ID NO: 73068 - DNA, 35 bp, Artificial Sequence
  Synthetic oligonucleotide
gaaggggtgggaggtgtgggtcctatcctgataag

SEQ ID NO: 73069 - DNA, 35 bp, Artificial Sequence
  Synthetic oligonucleotide
acctcaatgccactgattacatctatcccggtccg

SEQ ID NO: 73070 - DNA, 35 bp, Artificial Sequence
  Synthetic oligonucleotide
aagcccaacggctcgcttcccatcaacctgtctgg

SEQ ID NO: 73071 - DNA, 35 bp, Artificial Sequence
  Synthetic oligonucleotide
gatcgcctgggccgtgccacctttttaagtccctg

SEQ ID NO: 73072 - DNA, 35 bp, Artificial Sequence
  Synthetic oligonucleotide
aaaacagtgggggaggggccgggggtggacttgtg

SEQ ID NO: 73073 - DNA, 34 bp, Artificial Sequence
  Synthetic oligonucleotide
tgaggccttgccccatctttgccacaatttcttg

SEQ ID NO: 73074 - DNA, 35 bp, Artificial Sequence
  Synthetic oligonucleotide
taacaccacagcaaattggatcaagccaacctttg

SEQ ID NO: 73075 - DNA, 35 bp, Artificial Sequence
  Synthetic oligonucleotide
ggtaccaccacacatgctcctcacatgcctacaat

SEQ ID NO: 73076 - DNA, 35 bp, Artificial Sequence
  Synthetic oligonucleotide
tgtctctggccactacatctcgttcattgtaccat

SEQ ID NO: 73077 - DNA, 35 bp, Artificial Sequence
  Synthetic oligonucleotide
aacgagcctcacggcgattgagatctttactccat

SEQ ID NO: 73078 - DNA, 35 bp, Artificial Sequence
  Synthetic oligonucleotide
ggagccggggtgatggaacgaacgcggggaacgat

SEQ ID NO: 73079 - DNA, 35 bp, Artificial Sequence
  Synthetic oligonucleotide
tccattcccaatttgccagcacacaccccagctat

SEQ ID NO: 73080 - DNA, 36 bp, Artificial Sequence
  Synthetic oligonucleotide
agaccgaagggcaatgaccgatacccgtgctcacct

SEQ ID NO: 73081 - DNA, 35 bp, Artificial Sequence
  Synthetic oligonucleotide
tcacgccatccgcgaacgtctggtgcttatcccct

SEQ ID NO: 73082 - DNA, 35 bp, Artificial Sequence
  Synthetic oligonucleotide
ggtgacacaatcctacgaaaaagtacgactcgcct

SEQ ID NO: 73083 - DNA, 35 bp, Artificial Sequence
  Synthetic oligonucleotide
gtctgcccacaatgacacgtcgggcgttacaagct

SEQ ID NO: 73084 - DNA, 35 bp, Artificial Sequence
  Synthetic oligonucleotide
tgagtccgcctgctggctaccacgccccatctgct

SEQ ID NO: 73085 - DNA, 35 bp, Artificial Sequence
  Synthetic oligonucleotide
tccctacttcgttcctgtttggcatccgcacctct

SEQ ID NO: 73086 - DNA, 36 bp, Artificial Sequence
  Synthetic oligonucleotide
gcgcacctcccctgtgctcttctctcatgaagtcgt

SEQ ID NO: 73087 - DNA, 35 bp, Artificial Sequence
  Synthetic oligonucleotide
attggccgtcatactcagctgcatgcttttttcgt

SEQ ID NO: 73088 - DNA, 35 bp, Artificial Sequence
  Synthetic oligonucleotide
tcgcaccgcactcgcgggatcttagccattcctgt

SEQ ID NO: 73089 - DNA, 35 bp, Artificial Sequence
  Synthetic oligonucleotide
gactccacagtgcgttcatccccgtattctaaaaa

SEQ ID NO: 73090 - DNA, 36 bp, Artificial Sequence
  Synthetic oligonucleotide
gtcacgggagtaggaatatggggcggaagacgacaa

SEQ ID NO: 73091 - DNA, 34 bp, Artificial Sequence
  Synthetic oligonucleotide
gttcatggccgcccgttatgtctcattcgctgaa

SEQ ID NO: 73092 - DNA, 36 bp, Artificial Sequence
  Synthetic oligonucleotide
gcactgacgcgtaacaacacggattccttttagtaa

SEQ ID NO: 73093 - DNA, 35 bp, Artificial Sequence
  Synthetic oligonucleotide
gtctatttgcaccacgcgtacccagcccgcacaca

SEQ ID NO: 73094 - DNA, 36 bp, Artificial Sequence
  Synthetic oligonucleotide
atcacaggcacagacattacagcaggccagttgaca

SEQ ID NO: 73095 - DNA, 36 bp, Artificial Sequence
  Synthetic oligonucleotide
tccccgtacacgctttttttcatgcagagccaacca

SEQ ID NO: 73096 - DNA, 36 bp, Artificial Sequence
  Synthetic oligonucleotide
ggtgcattctccacacgatcactttgcgagctacca

SEQ ID NO: 73097 - DNA, 36 bp, Artificial Sequence
  Synthetic oligonucleotide
taactcctccctgggcctggattatgtaccgtacca

SEQ ID NO: 73098 - DNA, 36 bp, Artificial Sequence
  Synthetic oligonucleotide
gcacactgtcccatgttaattgttcctgtgcgtgca

SEQ ID NO: 73099 - DNA, 36 bp, Artificial Sequence
  Synthetic oligonucleotide
tcactccctaaacatgtatcccgcctactatgtgca

SEQ ID NO: 73100 - DNA, 36 bp, Artificial Sequence
  Synthetic oligonucleotide
ttaagtgtccctccgtatttgttccccacctgtgca

SEQ ID NO: 73101 - DNA, 36 bp, Artificial Sequence
  Synthetic oligonucleotide
gcctagccacgtctttactgattttcgtcagttgca

SEQ ID NO: 73102 - DNA, 36 bp, Artificial Sequence
  Synthetic oligonucleotide
tgccgcatattgtcgcaactgggcctcgtgaactca

SEQ ID NO: 73103 - DNA, 37 bp, Artificial Sequence
  Synthetic oligonucleotide
atcagaagtgcagggtggtgtaaaaagattgcagaga

SEQ ID NO: 73104 - DNA, 36 bp, Artificial Sequence
  Synthetic oligonucleotide
gactgccacttcattctgttccaatgccacaggaga

SEQ ID NO: 73105 - DNA, 37 bp, Artificial Sequence
  Synthetic oligonucleotide
agagaggaggccgggattgggaacgggggatcgacga

SEQ ID NO: 73106 - DNA, 37 bp, Artificial Sequence
  Synthetic oligonucleotide
tcgcggtcctgttttatgctattatgcctcgtaccga

SEQ ID NO: 73107 - DNA, 37 bp, Artificial Sequence
  Synthetic oligonucleotide
actccaagtcaccccggcattatcgaactgtgcccga

SEQ ID NO: 73108 - DNA, 37 bp, Artificial Sequence
  Synthetic oligonucleotide
tccatcattacgacgcctaggtcgagagtcgtcccga

SEQ ID NO: 73109 - DNA, 37 bp, Artificial Sequence
  Synthetic oligonucleotide
gaggcacaccccactttggtaacggcctcttatccga

SEQ ID NO: 73110 - DNA, 36 bp, Artificial Sequence
  Synthetic oligonucleotide
tagtccatccgtacagtgccaccccatcgtaagcga

SEQ ID NO: 73111 - DNA, 36 bp, Artificial Sequence
  Synthetic oligonucleotide
taggacgctgagtcgcttttggcctggttttatcga

SEQ ID NO: 73112 - DNA, 36 bp, Artificial Sequence
  Synthetic oligonucleotide
taatctgcccacgcgcgaggtaacctctctcttcga

SEQ ID NO: 73113 - DNA, 36 bp, Artificial Sequence
  Synthetic oligonucleotide
atgagtggtgctgaatgggaagggaggcaggacgga

SEQ ID NO: 73114 - DNA, 36 bp, Artificial Sequence
  Synthetic oligonucleotide
tcataggaggagaggaagagtggacaacgcgaggga

SEQ ID NO: 73115 - DNA, 37 bp, Artificial Sequence
  Synthetic oligonucleotide
acaacgtgcatgagggaggggattaaaagcaagggga

SEQ ID NO: 73116 - DNA, 37 bp, Artificial Sequence
  Synthetic oligonucleotide
agctagtcgaggtaggtggattgctacggattgggga

SEQ ID NO: 73117 - DNA, 37 bp, Artificial Sequence
  Synthetic oligonucleotide
tccaacaccctataatcgcactgccggaaggcctgga

SEQ ID NO: 73118 - DNA, 36 bp, Artificial Sequence
  Synthetic oligonucleotide
aatgtgtccggcgcgcatttttatatttcctctgga

SEQ ID NO: 73119 - DNA, 37 bp, Artificial Sequence
  Synthetic oligonucleotide
aacaagttggagctgcagtattggggattggggtgga

SEQ ID NO: 73120 - DNA, 37 bp, Artificial Sequence
  Synthetic oligonucleotide
tcgagggcgcacacggggaatgaatggctgctgtgga

SEQ ID NO: 73121 - DNA, 36 bp, Artificial Sequence
  Synthetic oligonucleotide
ttgcatgagcaagaacggggggttttacggtttgga

SEQ ID NO: 73122 - DNA, 38 bp, Artificial Sequence
  Synthetic oligonucleotide
tgtcacatcaggcggatagcctgcgcccacttacatga

SEQ ID NO: 73123 - DNA, 38 bp, Artificial Sequence
  Synthetic oligonucleotide
gggactcgaccgccgaccttgttaagttcctcccatga

SEQ ID NO: 73124 - DNA, 37 bp, Artificial Sequence
  Synthetic oligonucleotide
ttatgccgctctcgaatctaaacgtgctctgccctga

SEQ ID NO: 73125 - DNA, 37 bp, Artificial Sequence
  Synthetic oligonucleotide
atgccggtaccgattctgcaccctttgcgcgagctga

SEQ ID NO: 73126 - DNA, 38 bp, Artificial Sequence
  Synthetic oligonucleotide
gcgagtcggagaagatattgcaggggcagggattctga

SEQ ID NO: 73127 - DNA, 38 bp, Artificial Sequence
  Synthetic oligonucleotide
gctgggggaaggtaaggaggcggcgggtgggggagtga

SEQ ID NO: 73128 - DNA, 38 bp, Artificial Sequence
  Synthetic oligonucleotide
ggttaagggtaaaaggaatgggaagaaagggcgggtga

SEQ ID NO: 73129 - DNA, 38 bp, Artificial Sequence
  Synthetic oligonucleotide
tgcgataggagggggcgggaacaatggacccggggtga

SEQ ID NO: 73130 - DNA, 37 bp, Artificial Sequence
  Synthetic oligonucleotide
taacacgccaggtgtaatcgggggggtccaaacttga

SEQ ID NO: 73131 - DNA, 38 bp, Artificial Sequence
  Synthetic oligonucleotide
tgttcccacacctgacccttcgcatccgcttcgcttga

SEQ ID NO: 73132 - DNA, 37 bp, Artificial Sequence
  Synthetic oligonucleotide
gccgcaacggctcacatccatttgcacctctgcttga

SEQ ID NO: 73133 - DNA, 38 bp, Artificial Sequence
  Synthetic oligonucleotide
gtgcgagaggcgggcggattcggatatgggcgtcttga

SEQ ID NO: 73134 - DNA, 38 bp, Artificial Sequence
  Synthetic oligonucleotide
tgccacatcctctggtagcacctgttacttatagttga

SEQ ID NO: 73135 - DNA, 38 bp, Artificial Sequence
  Synthetic oligonucleotide
gtacccctatgctacgacgaccaattctgcacatttga

SEQ ID NO: 73136 - DNA, 38 bp, Artificial Sequence
  Synthetic oligonucleotide
gtagcctggccctatttcctcagctcccgtccctttga

SEQ ID NO: 73137 - DNA, 36 bp, Artificial Sequence
  Synthetic oligonucleotide
gtaccgtgccttttctgttctgatttccgccttata

SEQ ID NO: 73138 - DNA, 36 bp, Artificial Sequence
  Synthetic oligonucleotide
gttcgaatcgctcctcctattgatctcgttggacta

SEQ ID NO: 73139 - DNA, 35 bp, Artificial Sequence
  Synthetic oligonucleotide
tcgtagtgaacgactttgcactctggctctcccta

SEQ ID NO: 73140 - DNA, 36 bp, Artificial Sequence
  Synthetic oligonucleotide
tgcttgacgacaatgattacgtccctcctctgccta

SEQ ID NO: 73141 - DNA, 35 bp, Artificial Sequence
  Synthetic oligonucleotide
atgggacaggaaaagggtaggctaggatggatcta

SEQ ID NO: 73142 - DNA, 35 bp, Artificial Sequence
  Synthetic oligonucleotide
gtctggagcggttcctgcctttctcgagttctcta

SEQ ID NO: 73143 - DNA, 36 bp, Artificial Sequence
  Synthetic oligonucleotide
acgcaaccggcggagctaatgtaacccacagcagta

SEQ ID NO: 73144 - DNA, 36 bp, Artificial Sequence
  Synthetic oligonucleotide
aaatgaggagaagtggggcgcaaagttacgtaggta

SEQ ID NO: 73145 - DNA, 36 bp, Artificial Sequence
  Synthetic oligonucleotide
gaaccagctgagcaagggtgtggtagatgaattgta

SEQ ID NO: 73146 - DNA, 36 bp, Artificial Sequence
  Synthetic oligonucleotide
gacgccgccctagtttctcacccagccggttttgta

SEQ ID NO: 73147 - DNA, 36 bp, Artificial Sequence
  Synthetic oligonucleotide
acctgccatgactctgatagatctcaatccctctta

SEQ ID NO: 73148 - DNA, 35 bp, Artificial Sequence
  Synthetic oligonucleotide
atacaacgccgctccttaccgaacccttctacaac

SEQ ID NO: 73149 - DNA, 35 bp, Artificial Sequence
  Synthetic oligonucleotide
accgcccccgcagaacacgtcatgtctagtggaac

SEQ ID NO: 73150 - DNA, 35 bp, Artificial Sequence
  Synthetic oligonucleotide
accgcaacatggcactcgcgaagccttagttacac

SEQ ID NO: 73151 - DNA, 35 bp, Artificial Sequence
  Synthetic oligonucleotide
gatccgcgcgttatttccgaatctagttttgcacc

SEQ ID NO: 73152 - DNA, 35 bp, Artificial Sequence
  Synthetic oligonucleotide
taccaacctaaggcatttatacgtacacccggccc

SEQ ID NO: 73153 - DNA, 35 bp, Artificial Sequence
  Synthetic oligonucleotide
gacgtatgcagcaacctctgatcctttgattagcc

SEQ ID NO: 73154 - DNA, 35 bp, Artificial Sequence
  Synthetic oligonucleotide
tgttgccgtcccacagctcattaccttgccttgcc

SEQ ID NO: 73155 - DNA, 35 bp, Artificial Sequence
  Synthetic oligonucleotide
acgcgcatactgtagtttcgcgacatagctcatcc

SEQ ID NO: 73156 - DNA, 35 bp, Artificial Sequence
  Synthetic oligonucleotide
tacgacgtaacacgcctgctagtgactcgatctcc

SEQ ID NO: 73157 - DNA, 35 bp, Artificial Sequence
  Synthetic oligonucleotide
gccacggcagatcccttcatagaactttcctgtcc

SEQ ID NO: 73158 - DNA, 35 bp, Artificial Sequence
  Synthetic oligonucleotide
ttggtaaaacgacaccagctcacgccctgtttcgc

SEQ ID NO: 73159 - DNA, 35 bp, Artificial Sequence
  Synthetic oligonucleotide
agtaatcgcatccgagctatcataccagaccatgc

SEQ ID NO: 73160 - DNA, 35 bp, Artificial Sequence
  Synthetic oligonucleotide
tccgccaccgaacattgtactcacgccttggaatc

SEQ ID NO: 73161 - DNA, 35 bp, Artificial Sequence
  Synthetic oligonucleotide
tcagacgtgcagggcttgttgtcgtcgatttcctc

SEQ ID NO: 73162 - DNA, 36 bp, Artificial Sequence
  Synthetic oligonucleotide
gtcttgactgcacatgcggtacacatcggttttctc

SEQ ID NO: 73163 - DNA, 35 bp, Artificial Sequence
  Synthetic oligonucleotide
acccccgttcgaaatgccgggcattacccacggtc

SEQ ID NO: 73164 - DNA, 35 bp, Artificial Sequence
  Synthetic oligonucleotide
tagtccacatcgccgtgttgccccttttgtcattc

SEQ ID NO: 73165 - DNA, 35 bp, Artificial Sequence
  Synthetic oligonucleotide
gacctccacgatctggtcgacctataccatccttc

SEQ ID NO: 73166 - DNA, 35 bp, Artificial Sequence
  Synthetic oligonucleotide
caagtgcaattgtagtcgtaaaggattgcaataag

SEQ ID NO: 73167 - DNA, 35 bp, Artificial Sequence
  Synthetic oligonucleotide
cccgctcccgacaccaccagaaccgcaaggaatag

SEQ ID NO: 73168 - DNA, 35 bp, Artificial Sequence
  Synthetic oligonucleotide
gtcaagggtgcgcacgtgcggggaggaggggttag

SEQ ID NO: 73169 - DNA, 35 bp, Artificial Sequence
  Synthetic oligonucleotide
acccaatcgccttacgtgctatctaccattaaacg

SEQ ID NO: 73170 - DNA, 35 bp, Artificial Sequence
  Synthetic oligonucleotide
tccgatcgtttacgtactttgtctgtcaccatccg

SEQ ID NO: 73171 - DNA, 35 bp, Artificial Sequence
  Synthetic oligonucleotide
tccaggacgcatccatttcattattcacccttgcg

SEQ ID NO: 73172 - DNA, 35 bp, Artificial Sequence
  Synthetic oligonucleotide
tattagccactcgtactcgcgccaatcagccttcg

SEQ ID NO: 73173 - DNA, 35 bp, Artificial Sequence
  Synthetic oligonucleotide
aatctgggcacacagaggatatgtgggggtggagg

SEQ ID NO: 73174 - DNA, 35 bp, Artificial Sequence
  Synthetic oligonucleotide
gttgccaccttaggttccccccttattccctgagg

SEQ ID NO: 73175 - DNA, 35 bp, Artificial Sequence
  Synthetic oligonucleotide
gctagagggaagggggaaagtgatagaggaggcgg

SEQ ID NO: 73176 - DNA, 35 bp, Artificial Sequence
  Synthetic oligonucleotide
aaggagtgaaagactagggggtgtgggtgtagtgg

SEQ ID NO: 73177 - DNA, 35 bp, Artificial Sequence
  Synthetic oligonucleotide
agtgcgagagaccgagtggtaactgtgtgtggtgg

SEQ ID NO: 73178 - DNA, 35 bp, Artificial Sequence
  Synthetic oligonucleotide
atagcacatgcccccacagcttaattcggttaatg

SEQ ID NO: 73179 - DNA, 35 bp, Artificial Sequence
  Synthetic oligonucleotide
accaaacccctcgttaatgcgaatcaccctctatg

SEQ ID NO: 73180 - DNA, 35 bp, Artificial Sequence
  Synthetic oligonucleotide
tgagcactgccactcccatctctatgtgccacctg

SEQ ID NO: 73181 - DNA, 35 bp, Artificial Sequence
  Synthetic oligonucleotide
gcatggactgtagtgtcgggaacgggaagggtgtg

SEQ ID NO: 73182 - DNA, 35 bp, Artificial Sequence
  Synthetic oligonucleotide
gcgtgccatcggtccttctacccagtcccctattg

SEQ ID NO: 73183 - DNA, 28 bp, Artificial Sequence
  Synthetic oligonucleotide
tgtcgcatgccttcgaacatagcccaat

SEQ ID NO: 73184 - DNA, 35 bp, Artificial Sequence
  Synthetic oligonucleotide
aaccaacagcccatccttggggtgtgagagccaat

SEQ ID NO: 73185 - DNA, 35 bp, Artificial Sequence
  Synthetic oligonucleotide
ggacgctagggggtacatggatggggggtgatgat

SEQ ID NO: 73186 - DNA, 36 bp, Artificial Sequence
  Synthetic oligonucleotide
gaacagtcagggtgatgcgggccgacccatcctact

SEQ ID NO: 73187 - DNA, 35 bp, Artificial Sequence
  Synthetic oligonucleotide
agacgtacgctacctgccgtcccccaaacaagcct

SEQ ID NO: 73188 - DNA, 35 bp, Artificial Sequence
  Synthetic oligonucleotide
ttcccgattagcccttcacctgttgtaacggatct

SEQ ID NO: 73189 - DNA, 35 bp, Artificial Sequence
  Synthetic oligonucleotide
atgcgtccagactcggcattgccaaccctccttct

SEQ ID NO: 73190 - DNA, 35 bp, Artificial Sequence
  Synthetic oligonucleotide
gatcccgtagggtgaaccgtttcatccaatgttct

SEQ ID NO: 73191 - DNA, 35 bp, Artificial Sequence
  Synthetic oligonucleotide
aagtgacgagggcggggttagggcaacaattgggt

SEQ ID NO: 73192 - DNA, 35 bp, Artificial Sequence
  Synthetic oligonucleotide
gacgcacgcaacgccgtatttaaattgcgataatt

SEQ ID NO: 73193 - DNA, 35 bp, Artificial Sequence
  Synthetic oligonucleotide
gcaaccagacgaccgctgctatccgtgtttacctt

SEQ ID NO: 73194 - DNA, 35 bp, Artificial Sequence
  Synthetic oligonucleotide
tgccctgtcctaagccacgtatctgcgttactctt

SEQ ID NO: 73195 - DNA, 35 bp, Artificial Sequence
  Synthetic oligonucleotide
gatcaccctcctgcctgtctattcgtccgcctctt

SEQ ID NO: 73196 - DNA, 35 bp, Artificial Sequence
  Synthetic oligonucleotide
ttgcatgcgaataccctcttctacgccgtcccgtt

SEQ ID NO: 73197 - DNA, 35 bp, Artificial Sequence
  Synthetic oligonucleotide
acgttactgccacctccccatgctgtggtttggtt

SEQ ID NO: 73198 - DNA, 35 bp, Artificial Sequence
  Synthetic oligonucleotide
ttggacggaccaggcttgtacccggaaacccattt

SEQ ID NO: 73199 - DNA, 35 bp, Artificial Sequence
  Synthetic oligonucleotide
gataccgccaaaccatagcaagggacccgcgcaaa

SEQ ID NO: 73200 - DNA, 35 bp, Artificial Sequence
  Synthetic oligonucleotide
agttcgcctagacacgcattccacggacctgtaaa

SEQ ID NO: 73201 - DNA, 36 bp, Artificial Sequence
  Synthetic oligonucleotide
tctagccccaccactgctcacttgacacacccccaa

SEQ ID NO: 73202 - DNA, 36 bp, Artificial Sequence
  Synthetic oligonucleotide
gtggtgacagaaggggacgacggataaggggaagaa

SEQ ID NO: 73203 - DNA, 36 bp, Artificial Sequence
  Synthetic oligonucleotide
gatgcggtagaacaagcgatggcacaggcaggagaa

SEQ ID NO: 73204 - DNA, 35 bp, Artificial Sequence
  Synthetic oligonucleotide
atcgcacacccacttgtccagaccgaacgtacgaa

SEQ ID NO: 73205 - DNA, 35 bp, Artificial Sequence
  Synthetic oligonucleotide
gaactagacagggcgggtgtaacgtgagtggggaa

SEQ ID NO: 73206 - DNA, 36 bp, Artificial Sequence
  Synthetic oligonucleotide
acatgcaccgacctgccggataacttagggcattaa

SEQ ID NO: 73207 - DNA, 36 bp, Artificial Sequence
  Synthetic oligonucleotide
gtatggtccagcaagggggtaggggtcggttgaaca

SEQ ID NO: 73208 - DNA, 35 bp, Artificial Sequence
  Synthetic oligonucleotide
agcacacacacataacgccaggacgtccagtaaca

SEQ ID NO: 73209 - DNA, 36 bp, Artificial Sequence
  Synthetic oligonucleotide
acaaccgacgtgatggcctattttcaaccgcgcaca

SEQ ID NO: 73210 - DNA, 36 bp, Artificial Sequence
  Synthetic oligonucleotide
aacgtttcaccctccattccgtgttctatcgtgaca

SEQ ID NO: 73211 - DNA, 36 bp, Artificial Sequence
  Synthetic oligonucleotide
atgggaggaggaaactggaaattgaaggctaataca

SEQ ID NO: 73212 - DNA, 36 bp, Artificial Sequence
  Synthetic oligonucleotide
acctgactactggaccttcccccgtgtcgttataca

SEQ ID NO: 73213 - DNA, 36 bp, Artificial Sequence
  Synthetic oligonucleotide
taacacctcgcggtcgacgtaatctctctcaggcca

SEQ ID NO: 73214 - DNA, 36 bp, Artificial Sequence
  Synthetic oligonucleotide
gtgtcgccgattctatcccaccgtagattatgtcca

SEQ ID NO: 73215 - DNA, 36 bp, Artificial Sequence
  Synthetic oligonucleotide
tccgaccacccccccgtctttgtttttgggtgcgca

SEQ ID NO: 73216 - DNA, 36 bp, Artificial Sequence
  Synthetic oligonucleotide
gtccaggtcgccggaatcaggttagcgcccccatca

SEQ ID NO: 73217 - DNA, 36 bp, Artificial Sequence
  Synthetic oligonucleotide
acacagctagcccctgtgtcaactctcgctggttca

SEQ ID NO: 73218 - DNA, 35 bp, Artificial Sequence
  Synthetic oligonucleotide
aatgccacaaggcatgctgggaaaggtaagacaga

SEQ ID NO: 73219 - DNA, 35 bp, Artificial Sequence
  Synthetic oligonucleotide
gccttctacgccgctactctccatgtcatagcaga

SEQ ID NO: 73220 - DNA, 37 bp, Artificial Sequence
  Synthetic oligonucleotide
acaccaaacgcagctgaatccataaccccttcgcaga

SEQ ID NO: 73221 - DNA, 37 bp, Artificial Sequence
  Synthetic oligonucleotide
gcaaaacgaactgcaacatcctcggccaggtccgaga

SEQ ID NO: 73222 - DNA, 37 bp, Artificial Sequence
  Synthetic oligonucleotide
tcagagagaggaggatcgggagaacggaggagtgaga

SEQ ID NO: 73223 - DNA, 36 bp, Artificial Sequence
  Synthetic oligonucleotide
aacgtgccccacctaccgccgaccgttcaatataga

SEQ ID NO: 73224 - DNA, 37 bp, Artificial Sequence
  Synthetic oligonucleotide
tctcccactgcgcaccagcatatatggctacccacga

SEQ ID NO: 73225 - DNA, 37 bp, Artificial Sequence
  Synthetic oligonucleotide
gctccgccaaagtcgtccccctcctgcgtcagcacga

SEQ ID NO: 73226 - DNA, 36 bp, Artificial Sequence
  Synthetic oligonucleotide
tgcatcacaaccccaacctgttgtccacagaaccga

SEQ ID NO: 73227 - DNA, 35 bp, Artificial Sequence
  Synthetic oligonucleotide
gctccggattgtacaccccccacacactcccccga

SEQ ID NO: 73228 - DNA, 36 bp, Artificial Sequence
  Synthetic oligonucleotide
aataacggctgaactccctcacgtgcgattctccga

SEQ ID NO: 73229 - DNA, 37 bp, Artificial Sequence
  Synthetic oligonucleotide
ggggatgggctgggtaatgcctaggaggaaagggcga

SEQ ID NO: 73230 - DNA, 37 bp, Artificial Sequence
  Synthetic oligonucleotide
gacgcccccccttctaccggcagagccaatggctcga

SEQ ID NO: 73231 - DNA, 37 bp, Artificial Sequence
  Synthetic oligonucleotide
gacctcgccgttcactagccgctacttttatcttcga

SEQ ID NO: 73232 - DNA, 37 bp, Artificial Sequence
  Synthetic oligonucleotide
aaccccatctgcccactcttgttcgcgttctcttcga

SEQ ID NO: 73233 - DNA, 36 bp, Artificial Sequence
  Synthetic oligonucleotide
gaggtgtgagtagactggggacgagagggagaagga

SEQ ID NO: 73234 - DNA, 37 bp, Artificial Sequence
  Synthetic oligonucleotide
acaacaaggtgtgtggggatagaggatgaggtgagga

SEQ ID NO: 73235 - DNA, 36 bp, Artificial Sequence
  Synthetic oligonucleotide
gcaaggtgagtgggccttgtttgagttggtgtagga

SEQ ID NO: 73236 - DNA, 37 bp, Artificial Sequence
  Synthetic oligonucleotide
gtcctctgtaccacgcccgctgaactatcccttcgga

SEQ ID NO: 73237 - DNA, 37 bp, Artificial Sequence
  Synthetic oligonucleotide
gccgtgcacctacgatcgccgccacccacaaagggga

SEQ ID NO: 73238 - DNA, 36 bp, Artificial Sequence
  Synthetic oligonucleotide
atcagacatgccgctgctccattcaccacatctgga

SEQ ID NO: 73239 - DNA, 37 bp, Artificial Sequence
  Synthetic oligonucleotide
gacgcaccgccgtttatgcgatccgtgaggttctgga

SEQ ID NO: 73240 - DNA, 37 bp, Artificial Sequence
  Synthetic oligonucleotide
tccacaggaacggctaagcggagcgaggaatggtgga

SEQ ID NO: 73241 - DNA, 37 bp, Artificial Sequence
  Synthetic oligonucleotide
tctggaccatgagggaagcacgaagggtcaggaatga

SEQ ID NO: 73242 - DNA, 36 bp, Artificial Sequence
  Synthetic oligonucleotide
gacaaccctcatagcttacttgtttcgattgaatga

SEQ ID NO: 73243 - DNA, 38 bp, Artificial Sequence
  Synthetic oligonucleotide
tgccgactccagtattgccaacccctccatgccgatga

SEQ ID NO: 73244 - DNA, 38 bp, Artificial Sequence
  Synthetic oligonucleotide
acagatggcctcacgatgtccgttgacccgccccctga

SEQ ID NO: 73245 - DNA, 38 bp, Artificial Sequence
  Synthetic oligonucleotide
tcttggtcaggtctgttccctgtctatatacgccctga

SEQ ID NO: 73246 - DNA, 36 bp, Artificial Sequence
  Synthetic oligonucleotide
tgatccgtgtatgtcccatgttgctgccattcctga

SEQ ID NO: 73247 - DNA, 38 bp, Artificial Sequence
  Synthetic oligonucleotide
atctgccaagtctatagacaccctcatctcctcgctga

SEQ ID NO: 73248 - DNA, 38 bp, Artificial Sequence
  Synthetic oligonucleotide
tgagggtcgcggatcgtcatgtgccgttttccatctga

SEQ ID NO: 73249 - DNA, 38 bp, Artificial Sequence
  Synthetic oligonucleotide
gcaccaaggcagacatccacctcctccaccagttctga

SEQ ID NO: 73250 - DNA, 38 bp, Artificial Sequence
  Synthetic oligonucleotide
gcgccgggttatgggagggaagggcactgcgaccgtga

SEQ ID NO: 73251 - DNA, 38 bp, Artificial Sequence
  Synthetic oligonucleotide
tgggggggggggcgaagatgattcaggggcgatcgtga

SEQ ID NO: 73252 - DNA, 38 bp, Artificial Sequence
  Synthetic oligonucleotide
acctccctcctcgtgccatctattagacgggttcgtga

SEQ ID NO: 73253 - DNA, 37 bp, Artificial Sequence
  Synthetic oligonucleotide
tgacactcttctcgccagcccccattctacccggtga

SEQ ID NO: 73254 - DNA, 38 bp, Artificial Sequence
  Synthetic oligonucleotide
gcaggtcgaagtgtcgcgctctctctctcgtcttgtga

SEQ ID NO: 73255 - DNA, 38 bp, Artificial Sequence
  Synthetic oligonucleotide
acaacggagtgtctggcttggatgagggaattgcttga

SEQ ID NO: 73256 - DNA, 37 bp, Artificial Sequence
  Synthetic oligonucleotide
ggggatgaggagcggtgaaggtcgggggggtggttga

SEQ ID NO: 73257 - DNA, 38 bp, Artificial Sequence
  Synthetic oligonucleotide
gagcgggaccgaagctgatcgccatttgccacctttga

SEQ ID NO: 73258 - DNA, 38 bp, Artificial Sequence
  Synthetic oligonucleotide
atactccttccatgcaattaatgtaccagtcggtttga

SEQ ID NO: 73259 - DNA, 37 bp, Artificial Sequence
  Synthetic oligonucleotide
aagacagtctcggcgctccattgactccactgtttga

SEQ ID NO: 73260 - DNA, 38 bp, Artificial Sequence
  Synthetic oligonucleotide
gcttcagcacgccgcagagcgtctttaccttcttttga

SEQ ID NO: 73261 - DNA, 38 bp, Artificial Sequence
  Synthetic oligonucleotide
acatgcaccaccccctagctgaagcctgttggttttga

SEQ ID NO: 73262 - DNA, 38 bp, Artificial Sequence
  Synthetic oligonucleotide
ggtacgccgacctgaaatcgttctcgcctttgttttga

SEQ ID NO: 73263 - DNA, 36 bp, Artificial Sequence
  Synthetic oligonucleotide
agccatactcctgataattaccggatcccgccaata

SEQ ID NO: 73264 - DNA, 36 bp, Artificial Sequence
  Synthetic oligonucleotide
gccgaagcctgaagccgctcacatccacttccaata

SEQ ID NO: 73265 - DNA, 36 bp, Artificial Sequence
  Synthetic oligonucleotide
ccgccaattatgcagatgtgctgtcgtgaactaata

SEQ ID NO: 73266 - DNA, 36 bp, Artificial Sequence
  Synthetic oligonucleotide
gcaaccgacgtcccgtctagggccatcccgaaacta

SEQ ID NO: 73267 - DNA, 36 bp, Artificial Sequence
  Synthetic oligonucleotide
gtgtcaaactatccacatccgttgacgaccccccta

SEQ ID NO: 73268 - DNA, 36 bp, Artificial Sequence
  Synthetic oligonucleotide
attcaaccactatagccctatccctgtacccgagta

SEQ ID NO: 73269 - DNA, 33 bp, Artificial Sequence
  Synthetic oligonucleotide
acccccgccgagttatccttagcacctcgcgta

SEQ ID NO: 73270 - DNA, 36 bp, Artificial Sequence
  Synthetic oligonucleotide
gttgacagggtgctcctgtcgtccgcctctccttta

SEQ ID NO: 73271 - DNA, 36 bp, Artificial Sequence
  Synthetic oligonucleotide
gcagtcgacgctgactgagtgtgcgtcctctcttta

SEQ ID NO: 73272 - DNA, 35 bp, Artificial Sequence
  Synthetic oligonucleotide
gtaaagtacgcgcagctgcatcctcccttcaccac

SEQ ID NO: 73273 - DNA, 35 bp, Artificial Sequence
  Synthetic oligonucleotide
tcgtagttactcatgtctcacccttctggtttcac

SEQ ID NO: 73274 - DNA, 35 bp, Artificial Sequence
  Synthetic oligonucleotide
tcccatctgaccatttgcgacctaatcagaacacc

SEQ ID NO: 73275 - DNA, 35 bp, Artificial Sequence
  Synthetic oligonucleotide
ttctgacaccgctactgacgatccgaccttccacc

SEQ ID NO: 73276 - DNA, 35 bp, Artificial Sequence
  Synthetic oligonucleotide
tgcactcaggcaagtactacggcccggatcccccc

SEQ ID NO: 73277 - DNA, 35 bp, Artificial Sequence
  Synthetic oligonucleotide
cagatagctccagagttgcccctcccgttcacgcc

SEQ ID NO: 73278 - DNA, 35 bp, Artificial Sequence
  Synthetic oligonucleotide
agcttgggtacaccttcagtcctgcttcgcctgcc

SEQ ID NO: 73279 - DNA, 35 bp, Artificial Sequence
  Synthetic oligonucleotide
gccacccgttgttgtccctgcctgtctacgtaggc

SEQ ID NO: 73280 - DNA, 35 bp, Artificial Sequence
  Synthetic oligonucleotide
ttctactgcccgacgcgggtactgccgagttttgc

SEQ ID NO: 73281 - DNA, 35 bp, Artificial Sequence
  Synthetic oligonucleotide
ggatcgagcccaccatcggtcatgttacattggtc

SEQ ID NO: 73282 - DNA, 35 bp, Artificial Sequence
  Synthetic oligonucleotide
gcccgtaatctctcctcctgtgtaacccatgtgtc

SEQ ID NO: 73283 - DNA, 35 bp, Artificial Sequence
  Synthetic oligonucleotide
attcgtacgacacactcaactttgcattatacttc

SEQ ID NO: 73284 - DNA, 35 bp, Artificial Sequence
  Synthetic oligonucleotide
atgatcgtcaacacgctgctgccgggccacgtttc

SEQ ID NO: 73285 - DNA, 35 bp, Artificial Sequence
  Synthetic oligonucleotide
agaggggagggcattttgggggctgaggaaccaag

SEQ ID NO: 73286 - DNA, 35 bp, Artificial Sequence
  Synthetic oligonucleotide
tacagtgcaggggaggagtataatggcaactcgag

SEQ ID NO: 73287 - DNA, 35 bp, Artificial Sequence
  Synthetic oligonucleotide
ggatggacgtagtggggcgggttgaagggggggag

SEQ ID NO: 73288 - DNA, 35 bp, Artificial Sequence
  Synthetic oligonucleotide
tcagcccttcccccctatccgtgacatccggcacg

SEQ ID NO: 73289 - DNA, 35 bp, Artificial Sequence
  Synthetic oligonucleotide
ggaacagggtgggtgttcggaacaaggagtctacg

SEQ ID NO: 73290 - DNA, 35 bp, Artificial Sequence
  Synthetic oligonucleotide
aaggggtcggggaacggcaagaatacacggccgcg

SEQ ID NO: 73291 - DNA, 35 bp, Artificial Sequence
  Synthetic oligonucleotide
acagcttggaagggatgggggcacgggtttcaagg

SEQ ID NO: 73292 - DNA, 35 bp, Artificial Sequence
  Synthetic oligonucleotide
gatgagatcggcaagaggagacagaacaaggaggg

SEQ ID NO: 73293 - DNA, 35 bp, Artificial Sequence
  Synthetic oligonucleotide
ttacaaggcggtggagcgggaactagtagtcgggg

SEQ ID NO: 73294 - DNA, 35 bp, Artificial Sequence
  Synthetic oligonucleotide
gtgagaccgagagggtgggaataaaatcaattggg

SEQ ID NO: 73295 - DNA, 35 bp, Artificial Sequence
  Synthetic oligonucleotide
actcaatgtaggtaagatgtgctggtcaagggatg

SEQ ID NO: 73296 - DNA, 35 bp, Artificial Sequence
  Synthetic oligonucleotide
ggtgggccacacactcgaaaacaactacccatatg

SEQ ID NO: 73297 - DNA, 35 bp, Artificial Sequence
  Synthetic oligonucleotide
tagctgagtcaacattgatcgggcttcatcacctg

SEQ ID NO: 73298 - DNA, 35 bp, Artificial Sequence
  Synthetic oligonucleotide
acaccggaagtgcatacatgcgtaagctgacggtg

SEQ ID NO: 73299 - DNA, 35 bp, Artificial Sequence
  Synthetic oligonucleotide
tagccagtgaaatggggaaggggaattggggattg

SEQ ID NO: 73300 - DNA, 35 bp, Artificial Sequence
  Synthetic oligonucleotide
acccggacatccgagctgttacgtttacctcttat

SEQ ID NO: 73301 - DNA, 35 bp, Artificial Sequence
  Synthetic oligonucleotide
ttaccctaccgctgctctcgatcgatcgagaaact

SEQ ID NO: 73302 - DNA, 35 bp, Artificial Sequence
  Synthetic oligonucleotide
atgtgcctcctcgttaccggcgcctactgggcact

SEQ ID NO: 73303 - DNA, 35 bp, Artificial Sequence
  Synthetic oligonucleotide
agaccgccgggtcccgcctacttacttccttccct

SEQ ID NO: 73304 - DNA, 35 bp, Artificial Sequence
  Synthetic oligonucleotide
agttacctgccatcgtgcactcccggtggttccct

SEQ ID NO: 73305 - DNA, 35 bp, Artificial Sequence
  Synthetic oligonucleotide
acagctgcccacatccgtccgagtctccctttcct

SEQ ID NO: 73306 - DNA, 35 bp, Artificial Sequence
  Synthetic oligonucleotide
tttatcgctcgcctacatatcatctggaatctgct

SEQ ID NO: 73307 - DNA, 35 bp, Artificial Sequence
  Synthetic oligonucleotide
acccacccgttggttcacagtagggtggaacatct

SEQ ID NO: 73308 - DNA, 35 bp, Artificial Sequence
  Synthetic oligonucleotide
ttgtgtggaaggaagagtaacgtagggaaagaggt

SEQ ID NO: 73309 - DNA, 35 bp, Artificial Sequence
  Synthetic oligonucleotide
aatccaccaccgcattattttagatccgcgtactt

SEQ ID NO: 73310 - DNA, 35 bp, Artificial Sequence
  Synthetic oligonucleotide
gccatgccattctgtaagcctctggtcccttcaaa

SEQ ID NO: 73311 - DNA, 36 bp, Artificial Sequence
  Synthetic oligonucleotide
gagaggaatagaaggctcatgaagcggggaaataaa

SEQ ID NO: 73312 - DNA, 36 bp, Artificial Sequence
  Synthetic oligonucleotide
ttcgcactgctgactgaacacacgtcaccggaccaa

SEQ ID NO: 73313 - DNA, 36 bp, Artificial Sequence
  Synthetic oligonucleotide
acctccgttctgtgccctagcgctatgttctaccaa

SEQ ID NO: 73314 - DNA, 36 bp, Artificial Sequence
  Synthetic oligonucleotide
gaggaagccactgcttaatctagcctgtccacgcaa

SEQ ID NO: 73315 - DNA, 36 bp, Artificial Sequence
  Synthetic oligonucleotide
tcacctgtgccatcgatttaccactgagtcacataa

SEQ ID NO: 73316 - DNA, 36 bp, Artificial Sequence
  Synthetic oligonucleotide
caatgcgatgggtggggcgggctaggggtacgctaa

SEQ ID NO: 73317 - DNA, 35 bp, Artificial Sequence
  Synthetic oligonucleotide
agcctgttccgggcgttccttctacagtgttcaca

SEQ ID NO: 73318 - DNA, 36 bp, Artificial Sequence
  Synthetic oligonucleotide
accaccaactgcagctaatcccccgcctttttcaca

SEQ ID NO: 73319 - DNA, 36 bp, Artificial Sequence
  Synthetic oligonucleotide
cccactgcctactctattagatcttcctgtgcacca

SEQ ID NO: 73320 - DNA, 35 bp, Artificial Sequence
  Synthetic oligonucleotide
ggatcgccacatgacatcgtttatacactttgcca

SEQ ID NO: 73321 - DNA, 33 bp, Artificial Sequence
  Synthetic oligonucleotide
gacctgcctgagcgtacctcgagccgcaatcca

SEQ ID NO: 73322 - DNA, 36 bp, Artificial Sequence
  Synthetic oligonucleotide
ttgggccaccagagccgaattttgtcttctgttcca

SEQ ID NO: 73323 - DNA, 36 bp, Artificial Sequence
  Synthetic oligonucleotide
tcaccacctccatatcggcacactggcataggagca

SEQ ID NO: 73324 - DNA, 36 bp, Artificial Sequence
  Synthetic oligonucleotide
tcaacgaggtcattttgagtggggggttaaggtgca

SEQ ID NO: 73325 - DNA, 36 bp, Artificial Sequence
  Synthetic oligonucleotide
gaccagcgatgctggtggggaaatggggggattgca

SEQ ID NO: 73326 - DNA, 36 bp, Artificial Sequence
  Synthetic oligonucleotide
cgctatgtccatccgtacacgacgcgatacctctca

SEQ ID NO: 73327 - DNA, 36 bp, Artificial Sequence
  Synthetic oligonucleotide
tcgacgggatcagttttcttacgatctttgctctca

SEQ ID NO: 73328 - DNA, 35 bp, Artificial Sequence
  Synthetic oligonucleotide
atgggtggggggtgttatatgtgaatgtatgaaga

SEQ ID NO: 73329 - DNA, 37 bp, Artificial Sequence
  Synthetic oligonucleotide
gactccacccatagtgctttattgatattcctgaaga

SEQ ID NO: 73330 - DNA, 37 bp, Artificial Sequence
  Synthetic oligonucleotide
gcgggccaggcgcagaacccgcacgaacgcacccaga

SEQ ID NO: 73331 - DNA, 37 bp, Artificial Sequence
  Synthetic oligonucleotide
gacgaggcgagctgactagtaggaccggggtggtaga

SEQ ID NO: 73332 - DNA, 37 bp, Artificial Sequence
  Synthetic oligonucleotide
attcacaccgtttggcgtttcgtgcccgctccttaga

SEQ ID NO: 73333 - DNA, 37 bp, Artificial Sequence
  Synthetic oligonucleotide
tccatccacaccgcttcgttaacatccatcagaacga

SEQ ID NO: 73334 - DNA, 37 bp, Artificial Sequence
  Synthetic oligonucleotide
gcacaggaaaatgaggacggggatatgtgcggaacga

SEQ ID NO: 73335 - DNA, 37 bp, Artificial Sequence
  Synthetic oligonucleotide
ttcccagccgaaccaggccgctacgcgcactcaccga

SEQ ID NO: 73336 - DNA, 36 bp, Artificial Sequence
  Synthetic oligonucleotide
gccctagcgcagggatatcatacttacaccccccga

SEQ ID NO: 73337 - DNA, 37 bp, Artificial Sequence
  Synthetic oligonucleotide
tagcccgactggttcatcagttatcacgcctctccga

SEQ ID NO: 73338 - DNA, 37 bp, Artificial Sequence
  Synthetic oligonucleotide
ggggaacggggagagggcgcggggggaaaagttccga

SEQ ID NO: 73339 - DNA, 37 bp, Artificial Sequence
  Synthetic oligonucleotide
atgtcaaggggagacatggtgagggacaccgacgcga

SEQ ID NO: 73340 - DNA, 37 bp, Artificial Sequence
  Synthetic oligonucleotide
gttgccagtgtctcggtcatccaccatcaccaatcga

SEQ ID NO: 73341 - DNA, 36 bp, Artificial Sequence
  Synthetic oligonucleotide
agcacccccgcccccgctcttgtctctgcggatcga

SEQ ID NO: 73342 - DNA, 37 bp, Artificial Sequence
  Synthetic oligonucleotide
gacttgccctcctaagctatcacaagccgattttcga

SEQ ID NO: 73343 - DNA, 37 bp, Artificial Sequence
  Synthetic oligonucleotide
atcatgtgcgccgaccactaaacgacctttttacgga

SEQ ID NO: 73344 - DNA, 37 bp, Artificial Sequence
  Synthetic oligonucleotide
ggggacgtatgaccggcaggaggggtacggggcggga

SEQ ID NO: 73345 - DNA, 37 bp, Artificial Sequence
  Synthetic oligonucleotide
gaggtaggatcggaggggggattcgggccgcagggga

SEQ ID NO: 73346 - DNA, 36 bp, Artificial Sequence
  Synthetic oligonucleotide
gtacaggatggcagggaataatcagagcggggggga

SEQ ID NO: 73347 - DNA, 37 bp, Artificial Sequence
  Synthetic oligonucleotide
gctaacgtggaatacgtacgagggtggtgggtgggga

SEQ ID NO: 73348 - DNA, 37 bp, Artificial Sequence
  Synthetic oligonucleotide
gcagagctagcacagtgtcgatagggggatggtggga

SEQ ID NO: 73349 - DNA, 37 bp, Artificial Sequence
  Synthetic oligonucleotide
gtgccgacacacgtgcggatcaaagttatatcatgga

SEQ ID NO: 73350 - DNA, 37 bp, Artificial Sequence
  Synthetic oligonucleotide
atcaggacaggaaagggagggaggcgagccggatgga

SEQ ID NO: 73351 - DNA, 37 bp, Artificial Sequence
  Synthetic oligonucleotide
ttactgaacctgagctgaaacgggtaccttccttgga

SEQ ID NO: 73352 - DNA, 38 bp, Artificial Sequence
  Synthetic oligonucleotide
tagtacgcgaaggggaggacaagcctgaccgtaaatga

SEQ ID NO: 73353 - DNA, 38 bp, Artificial Sequence
  Synthetic oligonucleotide
gtttggcgtaaggggagggctagtgggtttgctaatga

SEQ ID NO: 73354 - DNA, 38 bp, Artificial Sequence
  Synthetic oligonucleotide
acctcacccagacgggtaagcaaatcacccccacatga

SEQ ID NO: 73355 - DNA, 38 bp, Artificial Sequence
  Synthetic oligonucleotide
agacactccctcgtgtcgaattccattatgttccatga

SEQ ID NO: 73356 - DNA, 38 bp, Artificial Sequence
  Synthetic oligonucleotide
gagcaggaaacaagaacgggggcaaagaaaaagcatga

SEQ ID NO: 73357 - DNA, 38 bp, Artificial Sequence
  Synthetic oligonucleotide
tcaaccccccatgtctgtcccgggccactaggtcatga

SEQ ID NO: 73358 - DNA, 38 bp, Artificial Sequence
  Synthetic oligonucleotide
gacaaaggtaggtggagaagcgtgaggcaggttgatga

SEQ ID NO: 73359 - DNA, 37 bp, Artificial Sequence
  Synthetic oligonucleotide
tagtgtcggtcgccgcctcaagaacatacacgtatga

SEQ ID NO: 73360 - DNA, 36 bp, Artificial Sequence
  Synthetic oligonucleotide
tcaagactactgcctgccgcccgtatgcacttatga

SEQ ID NO: 73361 - DNA, 38 bp, Artificial Sequence
  Synthetic oligonucleotide
gagagccgataggggtggtgaactgatgtatcttatga

SEQ ID NO: 73362 - DNA, 37 bp, Artificial Sequence
  Synthetic oligonucleotide
ttcgcatcgcctgtcgcggcccgacactgcccactga

SEQ ID NO: 73363 - DNA, 37 bp, Artificial Sequence
  Synthetic oligonucleotide
gccttgcctcatggactctcccgtatccggctactga

SEQ ID NO: 73364 - DNA, 38 bp, Artificial Sequence
  Synthetic oligonucleotide
atgcgattcatcatccgagttatctttccgtgccctga

SEQ ID NO: 73365 - DNA, 38 bp, Artificial Sequence
  Synthetic oligonucleotide
tgagagccgacacccgtatgtaagcgctctctccctga

SEQ ID NO: 73366 - DNA, 38 bp, Artificial Sequence
  Synthetic oligonucleotide
gacgcagatcccatctgcctcaagagagaccatcctga

SEQ ID NO: 73367 - DNA, 38 bp, Artificial Sequence
  Synthetic oligonucleotide
gaacaggggaggtacaaaggagcgggcgaattggctga

SEQ ID NO: 73368 - DNA, 38 bp, Artificial Sequence
  Synthetic oligonucleotide
gcgcaccatatcgaccacggtgcttctttccttgctga

SEQ ID NO: 73369 - DNA, 37 bp, Artificial Sequence
  Synthetic oligonucleotide
tccctaccaggcccggtagtacacctcctctctctga

SEQ ID NO: 73370 - DNA, 38 bp, Artificial Sequence
  Synthetic oligonucleotide
gcggaccgtgccgaccccatcccatccgtctgttctga

SEQ ID NO: 73371 - DNA, 38 bp, Artificial Sequence
  Synthetic oligonucleotide
gattcacgagggtgtgggaagggaacatgaggtcgtga

SEQ ID NO: 73372 - DNA, 37 bp, Artificial Sequence
  Synthetic oligonucleotide
gccaacacgatctgaaggcacacgctacattcattga

SEQ ID NO: 73373 - DNA, 38 bp, Artificial Sequence
  Synthetic oligonucleotide
tacaggggggatgggttagggagaatgggaaagcttga

SEQ ID NO: 73374 - DNA, 38 bp, Artificial Sequence
  Synthetic oligonucleotide
atgagagagtgaaatgggtgcaggggggatgagcttga

SEQ ID NO: 73375 - DNA, 38 bp, Artificial Sequence
  Synthetic oligonucleotide
gctgctatcgcaaacatacatcagctgcccaatcttga

SEQ ID NO: 73376 - DNA, 38 bp, Artificial Sequence
  Synthetic oligonucleotide
gcccagctaacttaaatctgtcgccctacgtctcttga

SEQ ID NO: 73377 - DNA, 38 bp, Artificial Sequence
  Synthetic oligonucleotide
tgtgggtgcaaatgatagaacagaggaagggcagttga

SEQ ID NO: 73378 - DNA, 38 bp, Artificial Sequence
  Synthetic oligonucleotide
ctgcgcgtagtgagcggcgcctgtacttttccatttga

SEQ ID NO: 73379 - DNA, 38 bp, Artificial Sequence
  Synthetic oligonucleotide
acccgcgtaacggccatactgacgtcagtgccctttga

SEQ ID NO: 73380 - DNA, 37 bp, Artificial Sequence
  Synthetic oligonucleotide
agcgcatctgaacatctacccagccattacgctttga

SEQ ID NO: 73381 - DNA, 38 bp, Artificial Sequence
  Synthetic oligonucleotide
aatgcaccgtgagacctgtacaccgcatggccttttga

SEQ ID NO: 73382 - DNA, 36 bp, Artificial Sequence
  Synthetic oligonucleotide
gtgcgagttaaggggtgggtaacagggtggagcata

SEQ ID NO: 73383 - DNA, 35 bp, Artificial Sequence
  Synthetic oligonucleotide
gccacaagagagggcgatagaaatacggaggcata

SEQ ID NO: 73384 - DNA, 35 bp, Artificial Sequence
  Synthetic oligonucleotide
atgtccggcccacatatcgttcattcgggtgcata

SEQ ID NO: 73385 - DNA, 36 bp, Artificial Sequence
  Synthetic oligonucleotide
agatagatggtacggatgacagcaggatagcatata

SEQ ID NO: 73386 - DNA, 36 bp, Artificial Sequence
  Synthetic oligonucleotide
ggagggcgaagaataggctgaggggatgtaggtata

SEQ ID NO: 73387 - DNA, 36 bp, Artificial Sequence
  Synthetic oligonucleotide
gcatcacgccgttcccaacgccgaggacttgaccta

SEQ ID NO: 73388 - DNA, 36 bp, Artificial Sequence
  Synthetic oligonucleotide
acatcgtcgcccttgacagttccccgttactccgta

SEQ ID NO: 73389 - DNA, 35 bp, Artificial Sequence
  Synthetic oligonucleotide
tagaggccggtctttgctcgtacccgcttccatta

SEQ ID NO: 73390 - DNA, 35 bp, Artificial Sequence
  Synthetic oligonucleotide
tacccaccttctgctggaactaggttcgcacttta

SEQ ID NO: 73391 - DNA, 35 bp, Artificial Sequence
  Synthetic oligonucleotide
tttggtaacccgacgcagggtatcctttttcacac

SEQ ID NO: 73392 - DNA, 35 bp, Artificial Sequence
  Synthetic oligonucleotide
accaccgacagccattccccgaaagtcgagctgac

SEQ ID NO: 73393 - DNA, 35 bp, Artificial Sequence
  Synthetic oligonucleotide
acaaggaagagccctttctgatgctcacactcacc

SEQ ID NO: 73394 - DNA, 35 bp, Artificial Sequence
  Synthetic oligonucleotide
gatgcgcactgcgcttcccccagaggttgcaaccc

SEQ ID NO: 73395 - DNA, 35 bp, Artificial Sequence
  Synthetic oligonucleotide
gggtctggctccctgtcttcggagaacccttcccc

SEQ ID NO: 73396 - DNA, 35 bp, Artificial Sequence
  Synthetic oligonucleotide
tcgtacgacggttgttcctagctgctctccctgcc

SEQ ID NO: 73397 - DNA, 35 bp, Artificial Sequence
  Synthetic oligonucleotide
ttaaacccgtcctctcttgtttttatccacgttcc

SEQ ID NO: 73398 - DNA, 35 bp, Artificial Sequence
  Synthetic oligonucleotide
gtcctaacccgtccaacgtttttttactggtgagc

SEQ ID NO: 73399 - DNA, 35 bp, Artificial Sequence
  Synthetic oligonucleotide
ttgtaaggccaccaaactcacttctaatgcactgc

SEQ ID NO: 73400 - DNA, 35 bp, Artificial Sequence
  Synthetic oligonucleotide
tcgatctgggcacactccagtacaaccatccaatc

SEQ ID NO: 73401 - DNA, 35 bp, Artificial Sequence
  Synthetic oligonucleotide
tgcccactatagtcatgggcacctacctacacatc

SEQ ID NO: 73402 - DNA, 35 bp, Artificial Sequence
  Synthetic oligonucleotide
accccttgggtgactgctatgcccactggtccatc

SEQ ID NO: 73403 - DNA, 35 bp, Artificial Sequence
  Synthetic oligonucleotide
tattaccacgttcggcattgtgagtaccgcttctc

SEQ ID NO: 73404 - DNA, 35 bp, Artificial Sequence
  Synthetic oligonucleotide
aatgaatcctccgcgtgtaagttcttaaacctgtc

SEQ ID NO: 73405 - DNA, 35 bp, Artificial Sequence
  Synthetic oligonucleotide
gcacagtgccaagagtcgtagccgccctacatttc

SEQ ID NO: 73406 - DNA, 35 bp, Artificial Sequence
  Synthetic oligonucleotide
tacgcctacgcactagccttgacatctctgcaacg

SEQ ID NO: 73407 - DNA, 35 bp, Artificial Sequence
  Synthetic oligonucleotide
ttcgcatcccgaggtcgttccccacatcctccccg

SEQ ID NO: 73408 - DNA, 35 bp, Artificial Sequence
  Synthetic oligonucleotide
gtccaatgcggtaggagggaaaaacgcagacagcg

SEQ ID NO: 73409 - DNA, 35 bp, Artificial Sequence
  Synthetic oligonucleotide
tacccccgctttggttggattctgctattgtttcg

SEQ ID NO: 73410 - DNA, 35 bp, Artificial Sequence
  Synthetic oligonucleotide
acccagtcacctcctagtgttagtcctaccttcgg

SEQ ID NO: 73411 - DNA, 36 bp, Artificial Sequence
  Synthetic oligonucleotide
gataaggaaaatggagggccggctacatggaggggg

SEQ ID NO: 73412 - DNA, 35 bp, Artificial Sequence
  Synthetic oligonucleotide
gcgtgaaacctcccatcaacatactcttgccactg

SEQ ID NO: 73413 - DNA, 35 bp, Artificial Sequence
  Synthetic oligonucleotide
gaccccggtctgtctcctctctctttgtgggattg

SEQ ID NO: 73414 - DNA, 35 bp, Artificial Sequence
  Synthetic oligonucleotide
gctccctctcagtcctgcctatctcacgttatttg

SEQ ID NO: 73415 - DNA, 35 bp, Artificial Sequence
  Synthetic oligonucleotide
gacctgctgcagattaacccttccgcacccacaat

SEQ ID NO: 73416 - DNA, 35 bp, Artificial Sequence
  Synthetic oligonucleotide
gcactgttccggtctacttaacatgctttttgaat

SEQ ID NO: 73417 - DNA, 35 bp, Artificial Sequence
  Synthetic oligonucleotide
atgccgctcccacttgctcttgtggttctgcacat

SEQ ID NO: 73418 - DNA, 35 bp, Artificial Sequence
  Synthetic oligonucleotide
ggtgtaaggaccccgctttacggatttgttgccat

SEQ ID NO: 73419 - DNA, 35 bp, Artificial Sequence
  Synthetic oligonucleotide
ggtgcactgaccatctcgcagtaacaacaatccat

SEQ ID NO: 73420 - DNA, 35 bp, Artificial Sequence
  Synthetic oligonucleotide
atcgccggcgataccacctccgatctgatctcgat

SEQ ID NO: 73421 - DNA, 35 bp, Artificial Sequence
  Synthetic oligonucleotide
tccacaccttgcatcctggccgccttttggcttat

SEQ ID NO: 73422 - DNA, 35 bp, Artificial Sequence
  Synthetic oligonucleotide
gatacctctgttagtacacgcgatcactctccact

SEQ ID NO: 73423 - DNA, 35 bp, Artificial Sequence
  Synthetic oligonucleotide
tctgttccccgtgggcctatagttctcgtatcact

SEQ ID NO: 73424 - DNA, 35 bp, Artificial Sequence
  Synthetic oligonucleotide
gcacccgttggctgtggtcacaccccttgtcgcct

SEQ ID NO: 73425 - DNA, 35 bp, Artificial Sequence
  Synthetic oligonucleotide
aagggtagtagggggtgcactagggtccggatcct

SEQ ID NO: 73426 - DNA, 35 bp, Artificial Sequence
  Synthetic oligonucleotide
tttatccgtcccgcttgtaacgtcttgaatatcct

SEQ ID NO: 73427 - DNA, 35 bp, Artificial Sequence
  Synthetic oligonucleotide
gcactggtcagttcttcacattcctgctccctgct

SEQ ID NO: 73428 - DNA, 35 bp, Artificial Sequence
  Synthetic oligonucleotide
ttacatgccgcattacttctctgtctgtggcatct

SEQ ID NO: 73429 - DNA, 35 bp, Artificial Sequence
  Synthetic oligonucleotide
tgaacccgcgtactatatcgaactcgtgaacctct

SEQ ID NO: 73430 - DNA, 35 bp, Artificial Sequence
  Synthetic oligonucleotide
ttatcagctgccactggtatgctttaccgccctct

SEQ ID NO: 73431 - DNA, 35 bp, Artificial Sequence
  Synthetic oligonucleotide
attggatcacgcgatgtaggcgtacctctttttct

SEQ ID NO: 73432 - DNA, 35 bp, Artificial Sequence
  Synthetic oligonucleotide
aaagagtaggggacacgagggaagttgcaagtagt

SEQ ID NO: 73433 - DNA, 35 bp, Artificial Sequence
  Synthetic oligonucleotide
acaacaatgagcctggccttctccctgacccacgt

SEQ ID NO: 73434 - DNA, 35 bp, Artificial Sequence
  Synthetic oligonucleotide
tgacctctttctacacctgctatatactccacggt

SEQ ID NO: 73435 - DNA, 35 bp, Artificial Sequence
  Synthetic oligonucleotide
gcacgcgtaggtcttcctggcgtctatttcccggt

SEQ ID NO: 73436 - DNA, 35 bp, Artificial Sequence
  Synthetic oligonucleotide
ttgacgccccacgctctatcacacccatggtctgt

SEQ ID NO: 73437 - DNA, 35 bp, Artificial Sequence
  Synthetic oligonucleotide
gcacccgaccgagacctacctaggacatatccctt

SEQ ID NO: 73438 - DNA, 35 bp, Artificial Sequence
  Synthetic oligonucleotide
tcagcctgcctcagcacactccacatctcgcagtt

SEQ ID NO: 73439 - DNA, 35 bp, Artificial Sequence
  Synthetic oligonucleotide
ttgacggtgcatacgttgaaccattgtgcctagtt

SEQ ID NO: 73440 - DNA, 35 bp, Artificial Sequence
  Synthetic oligonucleotide
atccgcacactttaacgcagttattacccctggtt

SEQ ID NO: 73441 - DNA, 35 bp, Artificial Sequence
  Synthetic oligonucleotide
ggggggtggtgggaggagcattattggaaagtgtt

SEQ ID NO: 73442 - DNA, 35 bp, Artificial Sequence
  Synthetic oligonucleotide
tagacgggagtcgttatagccccactctctttgtt

SEQ ID NO: 73443 - DNA, 35 bp, Artificial Sequence
  Synthetic oligonucleotide
atttgcaaccccttcctaatcggagcccacttttt

SEQ ID NO: 73444 - DNA, 35 bp, Artificial Sequence
  Synthetic oligonucleotide
ggagtacgtcgcctagggtcgcaggtggccttttt

SEQ ID NO: 73445 - DNA, 36 bp, Artificial Sequence
  Synthetic oligonucleotide
ggtcacacgccgggaaaactttcgcaagacctccaa

SEQ ID NO: 73446 - DNA, 35 bp, Artificial Sequence
  Synthetic oligonucleotide
tgactcattcacaccttacaccagagtcgcagaca

SEQ ID NO: 73447 - DNA, 36 bp, Artificial Sequence
  Synthetic oligonucleotide
acccacccgttcttgccagtggtcacagacttgaca

SEQ ID NO: 73448 - DNA, 36 bp, Artificial Sequence
  Synthetic oligonucleotide
gtcaacacccccatatggagcgggcgcccaacccca

SEQ ID NO: 73449 - DNA, 36 bp, Artificial Sequence
  Synthetic oligonucleotide
aagacatgacgcaggcttatatcacccgccccccca

SEQ ID NO: 73450 - DNA, 36 bp, Artificial Sequence
  Synthetic oligonucleotide
acatccaccttcactccgcatggccatccgagccca

SEQ ID NO: 73451 - DNA, 35 bp, Artificial Sequence
  Synthetic oligonucleotide
tgtacgcccgcacttactacacgtttgtgtcgcca

SEQ ID NO: 73452 - DNA, 36 bp, Artificial Sequence
  Synthetic oligonucleotide
gaccaccgttacgataattcaatcaagtccatgcca

SEQ ID NO: 73453 - DNA, 36 bp, Artificial Sequence
  Synthetic oligonucleotide
gatttccggtcgtgattacacctgtccctgtttcca

SEQ ID NO: 73454 - DNA, 36 bp, Artificial Sequence
  Synthetic oligonucleotide
accgctgcacgataccacgtccttaacattttggca

SEQ ID NO: 73455 - DNA, 36 bp, Artificial Sequence
  Synthetic oligonucleotide
tgaacctctctctgtgtcttcaaatacaccattgca

SEQ ID NO: 73456 - DNA, 36 bp, Artificial Sequence
  Synthetic oligonucleotide
ggtacagctgcccagctgcccccagaccatacctca

SEQ ID NO: 73457 - DNA, 37 bp, Artificial Sequence
  Synthetic oligonucleotide
tgactgacagaaggggttcgggtgtgcgggggaaaga

SEQ ID NO: 73458 - DNA, 37 bp, Artificial Sequence
  Synthetic oligonucleotide
tttagatccgacacgcgctccgccttctccaccaaga

SEQ ID NO: 73459 - DNA, 37 bp, Artificial Sequence
  Synthetic oligonucleotide
tacgtgggcgggatagatgtatgttggagggtcaaga

SEQ ID NO: 73460 - DNA, 37 bp, Artificial Sequence
  Synthetic oligonucleotide
aaggaggtaaacggagaggaaacctgattggggaaga

SEQ ID NO: 73461 - DNA, 37 bp, Artificial Sequence
  Synthetic oligonucleotide
accagcagggcgtatggcaattggacttgaggagaga

SEQ ID NO: 73462 - DNA, 35 bp, Artificial Sequence
  Synthetic oligonucleotide
tcagttcacccatcactcctttatgcttgccgaga

SEQ ID NO: 73463 - DNA, 37 bp, Artificial Sequence
  Synthetic oligonucleotide
ttggcctcaccatgggcgttcacctcgcacgcaacga

SEQ ID NO: 73464 - DNA, 37 bp, Artificial Sequence
  Synthetic oligonucleotide
tgactcgatcagaaaagtggggcagggcttccgacga

SEQ ID NO: 73465 - DNA, 36 bp, Artificial Sequence
  Synthetic oligonucleotide
gagaggagagaaggtgcaataggtaggcacttacga

SEQ ID NO: 73466 - DNA, 37 bp, Artificial Sequence
  Synthetic oligonucleotide
gctacggcgccatgtatcgaatccgttcactacccga

SEQ ID NO: 73467 - DNA, 35 bp, Artificial Sequence
  Synthetic oligonucleotide
atcgcactgggtcaatttttttatcaccggtccga

SEQ ID NO: 73468 - DNA, 37 bp, Artificial Sequence
  Synthetic oligonucleotide
tcccatcgaacgaacgaacagccaactgcattagcga

SEQ ID NO: 73469 - DNA, 37 bp, Artificial Sequence
  Synthetic oligonucleotide
gcacgaggtggagggagactggggaacagatgcgcga

SEQ ID NO: 73470 - DNA, 38 bp, Artificial Sequence
  Synthetic oligonucleotide
gaagggcccaaggggtctcatggaagtagtgcaggcga

SEQ ID NO: 73471 - DNA, 37 bp, Artificial Sequence
  Synthetic oligonucleotide
ttaaaccaccatcgtgaccatcttcagcgccatgcga

SEQ ID NO: 73472 - DNA, 37 bp, Artificial Sequence
  Synthetic oligonucleotide
tggagagtgaaccgtaaaggaggaggaagggatgcga

SEQ ID NO: 73473 - DNA, 35 bp, Artificial Sequence
  Synthetic oligonucleotide
gactgttccccctcttgacagcgcatctcctgcga

SEQ ID NO: 73474 - DNA, 37 bp, Artificial Sequence
  Synthetic oligonucleotide
tggggtaaacagaggggatacataggggaggtaagga

SEQ ID NO: 73475 - DNA, 37 bp, Artificial Sequence
  Synthetic oligonucleotide
atcccggggtcaggggcgtggttgggggatgagcgga

SEQ ID NO: 73476 - DNA, 35 bp, Artificial Sequence
  Synthetic oligonucleotide
gatgtgagcagctgaacgagttagacgggggcgga

SEQ ID NO: 73477 - DNA, 35 bp, Artificial Sequence
  Synthetic oligonucleotide
cacccgaacacctgacttttacggttaacctcgga

SEQ ID NO: 73478 - DNA, 37 bp, Artificial Sequence
  Synthetic oligonucleotide
gcaacctacagacgggtggtttcggtttgtacatgga

SEQ ID NO: 73479 - DNA, 37 bp, Artificial Sequence
  Synthetic oligonucleotide
aaggaggtgttggaaggggtagcacgaagcggatgga

SEQ ID NO: 73480 - DNA, 37 bp, Artificial Sequence
  Synthetic oligonucleotide
ttacctacccgagagcatgaatggctccctttttgga

SEQ ID NO: 73481 - DNA, 38 bp, Artificial Sequence
  Synthetic oligonucleotide
ttgagaggtagagagggttacgagataggcgtcaatga

SEQ ID NO: 73482 - DNA, 38 bp, Artificial Sequence
  Synthetic oligonucleotide
gcacatccgccacggggcacctgcttgattcttcatga

SEQ ID NO: 73483 - DNA, 38 bp, Artificial Sequence
  Synthetic oligonucleotide
gtgaccagtgaatgaaaggggcgtagggcacgggatga

SEQ ID NO: 73484 - DNA, 37 bp, Artificial Sequence
  Synthetic oligonucleotide
tgaaagtagtctcgctgcacttaacctccacctatga

SEQ ID NO: 73485 - DNA, 35 bp, Artificial Sequence
  Synthetic oligonucleotide
gacaaacacaaaacgtacggaactatcattactga

SEQ ID NO: 73486 - DNA, 37 bp, Artificial Sequence
  Synthetic oligonucleotide
gtcttgcacctggtcgcactctccactctgtacctga

SEQ ID NO: 73487 - DNA, 38 bp, Artificial Sequence
  Synthetic oligonucleotide
gcctacctccataatgggctcctaatgcactgccctga

SEQ ID NO: 73488 - DNA, 38 bp, Artificial Sequence
  Synthetic oligonucleotide
gcaaacatgcgtctgggcgtgcttcctccttcttctga

SEQ ID NO: 73489 - DNA, 38 bp, Artificial Sequence
  Synthetic oligonucleotide
gtgggggttggggggatcctgttgcaagccgcgagtga

SEQ ID NO: 73490 - DNA, 37 bp, Artificial Sequence
  Synthetic oligonucleotide
gacctagccgcagccccatgcatccaattcaaggtga

SEQ ID NO: 73491 - DNA, 36 bp, Artificial Sequence
  Synthetic oligonucleotide
tgaagggtcgcgaggaggacggagatggtagggtga

SEQ ID NO: 73492 - DNA, 37 bp, Artificial Sequence
  Synthetic oligonucleotide
aacccatccgcacatgggacctcctttgtgtctgtga

SEQ ID NO: 73493 - DNA, 38 bp, Artificial Sequence
  Synthetic oligonucleotide
ttccccgactttgtgcttctgcaccccgccctttgtga

SEQ ID NO: 73494 - DNA, 36 bp, Artificial Sequence
  Synthetic oligonucleotide
ttcgcgtacccgtccacgtctgtctctatcgattga

SEQ ID NO: 73495 - DNA, 38 bp, Artificial Sequence
  Synthetic oligonucleotide
gtggacgcttggatcctggcgataattgccctccttga

SEQ ID NO: 73496 - DNA, 37 bp, Artificial Sequence
  Synthetic oligonucleotide
gctgtggagcatcacaggaatggatgtgctggtttga

SEQ ID NO: 73497 - DNA, 36 bp, Artificial Sequence
  Synthetic oligonucleotide
tcatccctgttcgcctgtaggtttcatatacggata

SEQ ID NO: 73498 - DNA, 36 bp, Artificial Sequence
  Synthetic oligonucleotide
tcactcggccaggacctccttcacgcccatatgata

SEQ ID NO: 73499 - DNA, 36 bp, Artificial Sequence
  Synthetic oligonucleotide
gcgacacgactctcacctgtctttaacgtgctacta

SEQ ID NO: 73500 - DNA, 36 bp, Artificial Sequence
  Synthetic oligonucleotide
acccacggggcgcccggggtcgtttccctctaccta

SEQ ID NO: 73501 - DNA, 34 bp, Artificial Sequence
  Synthetic oligonucleotide
agtggtcgggggcatgggggtgagcgttgagcta

SEQ ID NO: 73502 - DNA, 36 bp, Artificial Sequence
  Synthetic oligonucleotide
gcactcttgacgatcgagccctccttcgcaccgcta

SEQ ID NO: 73503 - DNA, 36 bp, Artificial Sequence
  Synthetic oligonucleotide
atttccatctgcgtcccccgaccctcagcccggcta

SEQ ID NO: 73504 - DNA, 36 bp, Artificial Sequence
  Synthetic oligonucleotide
gtcgtaaccctcctgatgtccgctcgccgatactta

SEQ ID NO: 73505 - DNA, 35 bp, Artificial Sequence
  Synthetic oligonucleotide
tgcaccgcctttagcgcccatggccactactgtta

SEQ ID NO: 73506 - DNA, 35 bp, Artificial Sequence
  Synthetic oligonucleotide
tatggcccttcgcccttgggtctttcgcataccac

SEQ ID NO: 73507 - DNA, 35 bp, Artificial Sequence
  Synthetic oligonucleotide
tagaagccgcacttagccgtcggccaatacctcac

SEQ ID NO: 73508 - DNA, 35 bp, Artificial Sequence
  Synthetic oligonucleotide
gacaccaccgcatcactgtctaacccatctcatac

SEQ ID NO: 73509 - DNA, 35 bp, Artificial Sequence
  Synthetic oligonucleotide
tcgaacaccacttccgccgtaagtaggtaccaccc

SEQ ID NO: 73510 - DNA, 35 bp, Artificial Sequence
  Synthetic oligonucleotide
tacaatatccacccgtgtgagccatttggtgaccc

SEQ ID NO: 73511 - DNA, 35 bp, Artificial Sequence
  Synthetic oligonucleotide
accccgacatttatcgtttggcgcaaccggacccc

SEQ ID NO: 73512 - DNA, 35 bp, Artificial Sequence
  Synthetic oligonucleotide
agtactggaccggttcacattattgagtacttccc

SEQ ID NO: 73513 - DNA, 35 bp, Artificial Sequence
  Synthetic oligonucleotide
gcatacaccgcaaatggttttccctttctttggcc

SEQ ID NO: 73514 - DNA, 35 bp, Artificial Sequence
  Synthetic oligonucleotide
acttcaactgggctcttgcgcgtgtccatcttgcc

SEQ ID NO: 73515 - DNA, 35 bp, Artificial Sequence
  Synthetic oligonucleotide
gtgagatctctgggcccacgcatccgctcgcttcc

SEQ ID NO: 73516 - DNA, 35 bp, Artificial Sequence
  Synthetic oligonucleotide
tcagttcccggtagctcggccggctgcttttttcc

SEQ ID NO: 73517 - DNA, 35 bp, Artificial Sequence
  Synthetic oligonucleotide
aacatggggctggggcttttgggaggagagggagc

SEQ ID NO: 73518 - DNA, 35 bp, Artificial Sequence
  Synthetic oligonucleotide
gaccggacactttttatccaaggctttccaccggc

SEQ ID NO: 73519 - DNA, 35 bp, Artificial Sequence
  Synthetic oligonucleotide
atacaagtgcggagtcgttcctgttcgctccctgc

SEQ ID NO: 73520 - DNA, 35 bp, Artificial Sequence
  Synthetic oligonucleotide
tctgccacatacatgttagtgcacttgcattactc

SEQ ID NO: 73521 - DNA, 35 bp, Artificial Sequence
  Synthetic oligonucleotide
atgcagatcgcgctcgggtcaactccttctcgctc

SEQ ID NO: 73522 - DNA, 36 bp, Artificial Sequence
  Synthetic oligonucleotide
gatgacgcgagcaagagggcattgatgaagacggtc

SEQ ID NO: 73523 - DNA, 36 bp, Artificial Sequence
  Synthetic oligonucleotide
tccaatcgacgtcacgcgcactggtgataccctgtc

SEQ ID NO: 73524 - DNA, 35 bp, Artificial Sequence
  Synthetic oligonucleotide
aaccgccctaacttgcatcatcacgacggaccttc

SEQ ID NO: 73525 - DNA, 35 bp, Artificial Sequence
  Synthetic oligonucleotide
ggacgaacctcacgttctcttatagcctatggttc

SEQ ID NO: 73526 - DNA, 35 bp, Artificial Sequence
  Synthetic oligonucleotide
atcatacactctccatagcttcgttgagctggttc

SEQ ID NO: 73527 - DNA, 35 bp, Artificial Sequence
  Synthetic oligonucleotide
acgcggagtaaagaaaatggtggggttggacgaag

SEQ ID NO: 73528 - DNA, 35 bp, Artificial Sequence
  Synthetic oligonucleotide
attcccatcccgcgaggctaccgaggctgtaccag

SEQ ID NO: 73529 - DNA, 35 bp, Artificial Sequence
  Synthetic oligonucleotide
tctacccggcgcctatatctgcatgacacacagag

SEQ ID NO: 73530 - DNA, 35 bp, Artificial Sequence
  Synthetic oligonucleotide
aacttgaccgcgcgccccaatgcgaacacctcacg

SEQ ID NO: 73531 - DNA, 35 bp, Artificial Sequence
  Synthetic oligonucleotide
gtgggaacaacggggagaacaggtaagtaggtacg

SEQ ID NO: 73532 - DNA, 35 bp, Artificial Sequence
  Synthetic oligonucleotide
ataccaactgactcaaattccaacgcgctttcccg

SEQ ID NO: 73533 - DNA, 35 bp, Artificial Sequence
  Synthetic oligonucleotide
tcacaaggcgacgtgctcactagaattttcctccg

SEQ ID NO: 73534 - DNA, 35 bp, Artificial Sequence
  Synthetic oligonucleotide
actcaccccagacgtgtcgttggcactgagcctcg

SEQ ID NO: 73535 - DNA, 35 bp, Artificial Sequence
  Synthetic oligonucleotide
tacatcccaatctccgccgcgccctacccaatagg

SEQ ID NO: 73536 - DNA, 35 bp, Artificial Sequence
  Synthetic oligonucleotide
atggcccatacttaatgaccccagcttacatcctg

SEQ ID NO: 73537 - DNA, 35 bp, Artificial Sequence
  Synthetic oligonucleotide
gcaccttccgcctcgttagcctgctccgaccggtg

SEQ ID NO: 73538 - DNA, 35 bp, Artificial Sequence
  Synthetic oligonucleotide
tgccgccatcgaccatatttccacgtcatccattg

SEQ ID NO: 73539 - DNA, 35 bp, Artificial Sequence
  Synthetic oligonucleotide
gaacctcctgcatcttactgaccttgttggtcttg

SEQ ID NO: 73540 - DNA, 35 bp, Artificial Sequence
  Synthetic oligonucleotide
tattgccaacgccccgtacccctcaccgcgtacat

SEQ ID NO: 73541 - DNA, 35 bp, Artificial Sequence
  Synthetic oligonucleotide
ttcaaggtgacccacgctgcgattccctcttgcat

SEQ ID NO: 73542 - DNA, 35 bp, Artificial Sequence
  Synthetic oligonucleotide
gcgtcgcggccgctggacctcccactttcgctcat

SEQ ID NO: 73543 - DNA, 35 bp, Artificial Sequence
  Synthetic oligonucleotide
gacaagggtaatgaggcaagatataaacagcggat

SEQ ID NO: 73544 - DNA, 35 bp, Artificial Sequence
  Synthetic oligonucleotide
ttgacatctttcacatcttttgccacccacccgct

SEQ ID NO: 73545 - DNA, 35 bp, Artificial Sequence
  Synthetic oligonucleotide
gctacacattctggaccggacactaccctgctgct

SEQ ID NO: 73546 - DNA, 35 bp, Artificial Sequence
  Synthetic oligonucleotide
gccagcccatagccgcgtgcgtacccccgctatct

SEQ ID NO: 73547 - DNA, 35 bp, Artificial Sequence
  Synthetic oligonucleotide
tatctgtaccccggcctcaggctaccacaagttct

SEQ ID NO: 73548 - DNA, 35 bp, Artificial Sequence
  Synthetic oligonucleotide
taccacgcaaaataccacgttaaggatgaaccagt

SEQ ID NO: 73549 - DNA, 35 bp, Artificial Sequence
  Synthetic oligonucleotide
cacaaccggcgatctcatgcccatcttttactagt

SEQ ID NO: 73550 - DNA, 35 bp, Artificial Sequence
  Synthetic oligonucleotide
taagtggggggttggctcaaatgaggaaagtgcgt

SEQ ID NO: 73551 - DNA, 34 bp, Artificial Sequence
  Synthetic oligonucleotide
ttgcaaagacggggggaagtggggatttaatggt

SEQ ID NO: 73552 - DNA, 35 bp, Artificial Sequence
  Synthetic oligonucleotide
gtgaccctgtaatgcctcgctaggagattccaatt

SEQ ID NO: 73553 - DNA, 35 bp, Artificial Sequence
  Synthetic oligonucleotide
tccggtacctgtcgagcggtatccacgtctctctt

SEQ ID NO: 73554 - DNA, 35 bp, Artificial Sequence
  Synthetic oligonucleotide
tccaacactcacaacaggtgctttgctacagtctt

SEQ ID NO: 73555 - DNA, 36 bp, Artificial Sequence
  Synthetic oligonucleotide
tccacctgcactatccgcgctccttcgtaggtaaaa

SEQ ID NO: 73556 - DNA, 36 bp, Artificial Sequence
  Synthetic oligonucleotide
ggagaagagaggaacgtcaaagagcagggtgggaaa

SEQ ID NO: 73557 - DNA, 36 bp, Artificial Sequence
  Synthetic oligonucleotide
gcgaggtcagtcttcgctcgagtagtcttccaccaa

SEQ ID NO: 73558 - DNA, 36 bp, Artificial Sequence
  Synthetic oligonucleotide
acgctctgccaacccccagctagctgaatgtaccaa

SEQ ID NO: 73559 - DNA, 36 bp, Artificial Sequence
  Synthetic oligonucleotide
atgtgcctccgcaaaccgtcaatccatgtcctccaa

SEQ ID NO: 73560 - DNA, 35 bp, Artificial Sequence
  Synthetic oligonucleotide
accgagccgttgtatgccaatttcctcagggcgaa

SEQ ID NO: 73561 - DNA, 35 bp, Artificial Sequence
  Synthetic oligonucleotide
gggaccccaccttctgcaccccctcttgggaggaa

SEQ ID NO: 73562 - DNA, 36 bp, Artificial Sequence
  Synthetic oligonucleotide
tcacatgcactgagctttattggttccttcttgtaa

SEQ ID NO: 73563 - DNA, 35 bp, Artificial Sequence
  Synthetic oligonucleotide
gggaccatcgtggttatcaaaacttgccccgtaca

SEQ ID NO: 73564 - DNA, 35 bp, Artificial Sequence
  Synthetic oligonucleotide
catcacaccgctgatccctccacctgggctcacca

SEQ ID NO: 73565 - DNA, 36 bp, Artificial Sequence
  Synthetic oligonucleotide
attggaacgctggtgactcccccagaatcgtggcca

SEQ ID NO: 73566 - DNA, 36 bp, Artificial Sequence
  Synthetic oligonucleotide
gattcgtactccttcatcccgccactctagatggca

SEQ ID NO: 73567 - DNA, 36 bp, Artificial Sequence
  Synthetic oligonucleotide
aaggtcgaagcctctaccgcaaccttctcccgctca

SEQ ID NO: 73568 - DNA, 36 bp, Artificial Sequence
  Synthetic oligonucleotide
gagacgaaagacggactgcagtcgtatagacggtca

SEQ ID NO: 73569 - DNA, 36 bp, Artificial Sequence
  Synthetic oligonucleotide
tgagccagtttgcatatactgtaacaccgtccttca

SEQ ID NO: 73570 - DNA, 37 bp, Artificial Sequence
  Synthetic oligonucleotide
ttgggctcagagagggagcgaaaactacacaacaaga

SEQ ID NO: 73571 - DNA, 37 bp, Artificial Sequence
  Synthetic oligonucleotide
gccacgtgtggcacccctttgcgatcgatccgcaaga

SEQ ID NO: 73572 - DNA, 36 bp, Artificial Sequence
  Synthetic oligonucleotide
gctggaggcagaagacattagagagaatgcgtgaga

SEQ ID NO: 73573 - DNA, 37 bp, Artificial Sequence
  Synthetic oligonucleotide
gtgagcgcacccgttacccgtgacacttgctgataga

SEQ ID NO: 73574 - DNA, 37 bp, Artificial Sequence
  Synthetic oligonucleotide
gcgcctcactctcacctccttccgccatgacggtaga

SEQ ID NO: 73575 - DNA, 37 bp, Artificial Sequence
  Synthetic oligonucleotide
acacctcaacacatgtgtttcacccgggcccagacga

SEQ ID NO: 73576 - DNA, 37 bp, Artificial Sequence
  Synthetic oligonucleotide
aattccgaccggtaatcgatgaggccctgtacaccga

SEQ ID NO: 73577 - DNA, 37 bp, Artificial Sequence
  Synthetic oligonucleotide
ttacctgccccgccaacccacgcagatacattcccga

SEQ ID NO: 73578 - DNA, 35 bp, Artificial Sequence
  Synthetic oligonucleotide
tcccgtgactctccgtacatagccgttcattccga

SEQ ID NO: 73579 - DNA, 36 bp, Artificial Sequence
  Synthetic oligonucleotide
aaccaccgctaaatttttcaaagtgctctctcgcga

SEQ ID NO: 73580 - DNA, 37 bp, Artificial Sequence
  Synthetic oligonucleotide
aaaaacaggagggtgggaattacgcgaatgggtgcga

SEQ ID NO: 73581 - DNA, 36 bp, Artificial Sequence
  Synthetic oligonucleotide
gtgagatggaggcgaatggaagaagaaggtaatcga

SEQ ID NO: 73582 - DNA, 37 bp, Artificial Sequence
  Synthetic oligonucleotide
acaggtggggatctagttgggtggtgttcaaaaggga

SEQ ID NO: 73583 - DNA, 36 bp, Artificial Sequence
  Synthetic oligonucleotide
tgtgacctaggggaacgaacacgagtgggagtggga

SEQ ID NO: 73584 - DNA, 36 bp, Artificial Sequence
  Synthetic oligonucleotide
tgatcccaaaccgttctcacaatctcctccggtgga

SEQ ID NO: 73585 - DNA, 37 bp, Artificial Sequence
  Synthetic oligonucleotide
tatggtggagacagaggaatatgctgctcggtgtgga

SEQ ID NO: 73586 - DNA, 37 bp, Artificial Sequence
  Synthetic oligonucleotide
gcccgatctggcaatgaccccagttccctcccttgga

SEQ ID NO: 73587 - DNA, 37 bp, Artificial Sequence
  Synthetic oligonucleotide
atgcaacagccgcatgccttcctactattctgttgga

SEQ ID NO: 73588 - DNA, 38 bp, Artificial Sequence
  Synthetic oligonucleotide
ggaagagacagggtgagttagcgcgggtggtaagatga

SEQ ID NO: 73589 - DNA, 38 bp, Artificial Sequence
  Synthetic oligonucleotide
attgttgtgtggggctgggggagggaatggacagatga

SEQ ID NO: 73590 - DNA, 38 bp, Artificial Sequence
  Synthetic oligonucleotide
gcatagcacgatgtagggaatgtagagtggctcgatga

SEQ ID NO: 73591 - DNA, 38 bp, Artificial Sequence
  Synthetic oligonucleotide
gagacagtccgtaaactaatgtgtggagtcggggatga

SEQ ID NO: 73592 - DNA, 37 bp, Artificial Sequence
  Synthetic oligonucleotide
gtcgatgcacgacgcgcccgcttttcgtccttactga

SEQ ID NO: 73593 - DNA, 38 bp, Artificial Sequence
  Synthetic oligonucleotide
gtctgtccgaaccaggctcacatctagactacacctga

SEQ ID NO: 73594 - DNA, 38 bp, Artificial Sequence
  Synthetic oligonucleotide
tccgcctcaacttgtcccgagcaccactctagccctga

SEQ ID NO: 73595 - DNA, 38 bp, Artificial Sequence
  Synthetic oligonucleotide
gccctagcccccagtcactgccttcaataacagcctga

SEQ ID NO: 73596 - DNA, 37 bp, Artificial Sequence
  Synthetic oligonucleotide
accgctatcaccacctaaagtacatccacagtgctga

SEQ ID NO: 73597 - DNA, 38 bp, Artificial Sequence
  Synthetic oligonucleotide
actcagtgggaggtaggatacgagtagtgggttgctga

SEQ ID NO: 73598 - DNA, 38 bp, Artificial Sequence
  Synthetic oligonucleotide
aactgcactgcgcaacttcgtatgttctttacttctga

SEQ ID NO: 73599 - DNA, 38 bp, Artificial Sequence
  Synthetic oligonucleotide
tagacgctagggagggatcatgggagtacgggttctga

SEQ ID NO: 73600 - DNA, 37 bp, Artificial Sequence
  Synthetic oligonucleotide
gatcactctccacggacgttattgcgctgtaccgtga

SEQ ID NO: 73601 - DNA, 37 bp, Artificial Sequence
  Synthetic oligonucleotide
tccccaacttcgatctcgccgcactcacgggtcgtga

SEQ ID NO: 73602 - DNA, 38 bp, Artificial Sequence
  Synthetic oligonucleotide
tagccgggagaagggatgcggtaatagggtgcgggtga

SEQ ID NO: 73603 - DNA, 37 bp, Artificial Sequence
  Synthetic oligonucleotide
gatgaaggggaaaataatgagtggccagtcggtgtga

SEQ ID NO: 73604 - DNA, 37 bp, Artificial Sequence
  Synthetic oligonucleotide
tatcacactctgacatacaagtcccgccctattgtga

SEQ ID NO: 73605 - DNA, 38 bp, Artificial Sequence
  Synthetic oligonucleotide
gcgcaagctcactttcgtcacgtctacaaccatcttga

SEQ ID NO: 73606 - DNA, 35 bp, Artificial Sequence
  Synthetic oligonucleotide
atccaaacattagctgcgcgtctaccctctcttga

SEQ ID NO: 73607 - DNA, 37 bp, Artificial Sequence
  Synthetic oligonucleotide
aacccagggcgagggacacaacggtgtgaggggttga

SEQ ID NO: 73608 - DNA, 36 bp, Artificial Sequence
  Synthetic oligonucleotide
tccgctgcagtccgtaatctcctaaagcactgccta

SEQ ID NO: 73609 - DNA, 36 bp, Artificial Sequence
  Synthetic oligonucleotide
gccacatgccatagggcctctttatgcacatttcta

SEQ ID NO: 73610 - DNA, 36 bp, Artificial Sequence
  Synthetic oligonucleotide
acccaggggggaaaggagaatgggaccgtaacagta

SEQ ID NO: 73611 - DNA, 36 bp, Artificial Sequence
  Synthetic oligonucleotide
ataccaggggcaagggagtcaaagatggcgaatgta

SEQ ID NO: 73612 - DNA, 35 bp, Artificial Sequence
  Synthetic oligonucleotide
tgacatttcgcccaccacgatcgatgaaccggtta

SEQ ID NO: 73613 - DNA, 36 bp, Artificial Sequence
  Synthetic oligonucleotide
tacttggcccatattgatcgacttcacttactgtta

SEQ ID NO: 73614 - DNA, 35 bp, Artificial Sequence
  Synthetic oligonucleotide
atcgtcacctgaaaattgtcgccaacgcctgcaac

SEQ ID NO: 73615 - DNA, 35 bp, Artificial Sequence
  Synthetic oligonucleotide
tcaaggctcagtctcggcccctttactgtcactac

SEQ ID NO: 73616 - DNA, 35 bp, Artificial Sequence
  Synthetic oligonucleotide
gtgttccgacgtccattgtgcttacacttccctac

SEQ ID NO: 73617 - DNA, 35 bp, Artificial Sequence
  Synthetic oligonucleotide
tgtcagcaacacgttcccacctatgagcccgcccc

SEQ ID NO: 73618 - DNA, 35 bp, Artificial Sequence
  Synthetic oligonucleotide
gacccccctaggatcgttgtgtcacttgcctgccc

SEQ ID NO: 73619 - DNA, 35 bp, Artificial Sequence
  Synthetic oligonucleotide
aagactccgcttcattgccagccatcgcctttagc

SEQ ID NO: 73620 - DNA, 35 bp, Artificial Sequence
  Synthetic oligonucleotide
gtgtcctgatccatctctttgttaggtacacgctc

SEQ ID NO: 73621 - DNA, 35 bp, Artificial Sequence
  Synthetic oligonucleotide
ttcgggaaagcatgagttcgccctattagtctctc

SEQ ID NO: 73622 - DNA, 35 bp, Artificial Sequence
  Synthetic oligonucleotide
ttaccccaacgaccctcaggttgagcgccccattc

SEQ ID NO: 73623 - DNA, 35 bp, Artificial Sequence
  Synthetic oligonucleotide
gcctactcaatgatgatccacgttgcttgttgttc

SEQ ID NO: 73624 - DNA, 35 bp, Artificial Sequence
  Synthetic oligonucleotide
tagaccgcccttcacttccttaccctcctccagag

SEQ ID NO: 73625 - DNA, 35 bp, Artificial Sequence
  Synthetic oligonucleotide
gcgaccacgatcgctgagcatatcaacaccgctag

SEQ ID NO: 73626 - DNA, 35 bp, Artificial Sequence
  Synthetic oligonucleotide
gcgaagcatgtagtgcagaccatgggggattcccg

SEQ ID NO: 73627 - DNA, 35 bp, Artificial Sequence
  Synthetic oligonucleotide
gacggctcgcacatgaccacgcccctgcttattcg

SEQ ID NO: 73628 - DNA, 35 bp, Artificial Sequence
  Synthetic oligonucleotide
accccaggccatgtggtcatcaagttatttccggg

SEQ ID NO: 73629 - DNA, 35 bp, Artificial Sequence
  Synthetic oligonucleotide
tcctggtgcttttgtcggcccccctttcttcctgg

SEQ ID NO: 73630 - DNA, 35 bp, Artificial Sequence
  Synthetic oligonucleotide
aacaggctactgtggggccaagggataaacgaatg

SEQ ID NO: 73631 - DNA, 35 bp, Artificial Sequence
  Synthetic oligonucleotide
tgaggagggtgagacggagtagtgtggacagcatg

SEQ ID NO: 73632 - DNA, 35 bp, Artificial Sequence
  Synthetic oligonucleotide
gtctattggcgccttgaaattattctgtccacctg

SEQ ID NO: 73633 - DNA, 35 bp, Artificial Sequence
  Synthetic oligonucleotide
tcatgccatcacacttgggattatctgaatccctg

SEQ ID NO: 73634 - DNA, 35 bp, Artificial Sequence
  Synthetic oligonucleotide
actgctgcgcgggcctcctctcgctaccttatttg

SEQ ID NO: 73635 - DNA, 35 bp, Artificial Sequence
  Synthetic oligonucleotide
tgcaccatcttgtaggccttattagaatctgtttg

SEQ ID NO: 73636 - DNA, 35 bp, Artificial Sequence
  Synthetic oligonucleotide
gctgagcacagcctcctccaacatcagcagacaat

SEQ ID NO: 73637 - DNA, 35 bp, Artificial Sequence
  Synthetic oligonucleotide
aatcgtgccatccccggttgcttaatagtctacat

SEQ ID NO: 73638 - DNA, 35 bp, Artificial Sequence
  Synthetic oligonucleotide
agtgcctacccccaagtgcggaaagtttctcccat

SEQ ID NO: 73639 - DNA, 35 bp, Artificial Sequence
  Synthetic oligonucleotide
gaagacgcaaagggcgggagatcaaggaattatat

SEQ ID NO: 73640 - DNA, 35 bp, Artificial Sequence
  Synthetic oligonucleotide
actcccattcccggtacctctcacatgtttgctat

SEQ ID NO: 73641 - DNA, 35 bp, Artificial Sequence
  Synthetic oligonucleotide
tgttacagcgatgtcccctcggcctactactcgct

SEQ ID NO: 73642 - DNA, 35 bp, Artificial Sequence
  Synthetic oligonucleotide
tgcctcacaccattcatgattggcgcacccatgct

SEQ ID NO: 73643 - DNA, 35 bp, Artificial Sequence
  Synthetic oligonucleotide
gtaccctcaccgccgcttccgggttgtgatcttct

SEQ ID NO: 73644 - DNA, 35 bp, Artificial Sequence
  Synthetic oligonucleotide
tatgaaatgcctcgcgtcgtcttgcctgaaaccgt

SEQ ID NO: 73645 - DNA, 35 bp, Artificial Sequence
  Synthetic oligonucleotide
ataatcatgcagccctgtacgcctaacctcaccgt

SEQ ID NO: 73646 - DNA, 35 bp, Artificial Sequence
  Synthetic oligonucleotide
tgtcacggcttgctagtggtcctgggtgctggggt

SEQ ID NO: 73647 - DNA, 35 bp, Artificial Sequence
  Synthetic oligonucleotide
tttcgccccagactctccaaaaaccagaacagatt

SEQ ID NO: 73648 - DNA, 35 bp, Artificial Sequence
  Synthetic oligonucleotide
atacacttgcacctggctcatgctggacccatttt

SEQ ID NO: 73649 - DNA, 36 bp, Artificial Sequence
  Synthetic oligonucleotide
gctggcccctgcctgttagttccaactgtcgataaa

SEQ ID NO: 73650 - DNA, 36 bp, Artificial Sequence
  Synthetic oligonucleotide
tagcccctgcttaggacctcacgctccgacccccaa

SEQ ID NO: 73651 - DNA, 35 bp, Artificial Sequence
  Synthetic oligonucleotide
atctccgatccaacactcaccttgacttgggtcaa

SEQ ID NO: 73652 - DNA, 36 bp, Artificial Sequence
  Synthetic oligonucleotide
gcgatgctccacgacacacactggcctcctcaagaa

SEQ ID NO: 73653 - DNA, 35 bp, Artificial Sequence
  Synthetic oligonucleotide
tgcccatacaacatcggcgcaacaccaccacggaa

SEQ ID NO: 73654 - DNA, 35 bp, Artificial Sequence
  Synthetic oligonucleotide
atcgccgtaattgcccttgacctgatatctctgaa

SEQ ID NO: 73655 - DNA, 36 bp, Artificial Sequence
  Synthetic oligonucleotide
acgttatcccgcccatctcgccgtggtcctcactaa

SEQ ID NO: 73656 - DNA, 36 bp, Artificial Sequence
  Synthetic oligonucleotide
tccaccgattgtcgcaatggcactatttcatctaca

SEQ ID NO: 73657 - DNA, 36 bp, Artificial Sequence
  Synthetic oligonucleotide
tccctgcacagaagtaaccaagtctccttgcgtaca

SEQ ID NO: 73658 - DNA, 35 bp, Artificial Sequence
  Synthetic oligonucleotide
gtttacatccaatctgaatctgtcttggacttaca

SEQ ID NO: 73659 - DNA, 36 bp, Artificial Sequence
  Synthetic oligonucleotide
tttaggccggtccgtgctccgctgcttgtttcacca

SEQ ID NO: 73660 - DNA, 35 bp, Artificial Sequence
  Synthetic oligonucleotide
tcctgcaacctacgatggagtaaaccgcccaccca

SEQ ID NO: 73661 - DNA, 36 bp, Artificial Sequence
  Synthetic oligonucleotide
agagggcaaaagggaggcctggtagccgtaagagca

SEQ ID NO: 73662 - DNA, 36 bp, Artificial Sequence
  Synthetic oligonucleotide
ttaagagccgactctcatgtgatccctggtccctca

SEQ ID NO: 73663 - DNA, 36 bp, Artificial Sequence
  Synthetic oligonucleotide
tggatcccaccgttctgcatctatatgctgttctca

SEQ ID NO: 73664 - DNA, 37 bp, Artificial Sequence
  Synthetic oligonucleotide
gatgtaaggggggaggaagggtacgtgggtgagaaga

SEQ ID NO: 73665 - DNA, 38 bp, Artificial Sequence
  Synthetic oligonucleotide
ggatgcaaaaacgggatgaaaagggtggcggtctaaga

SEQ ID NO: 73666 - DNA, 37 bp, Artificial Sequence
  Synthetic oligonucleotide
taggtgtgggtgggaacgtgaagggtcgtagcaacga

SEQ ID NO: 73667 - DNA, 37 bp, Artificial Sequence
  Synthetic oligonucleotide
aacccgacgtcaatgtacactcaattaccggatccga

SEQ ID NO: 73668 - DNA, 35 bp, Artificial Sequence
  Synthetic oligonucleotide
attcccgcccgaatgcactgcatacgtcccctcga

SEQ ID NO: 73669 - DNA, 37 bp, Artificial Sequence
  Synthetic oligonucleotide
tccccccccttcccccatatgacctataaagggtcga

SEQ ID NO: 73670 - DNA, 37 bp, Artificial Sequence
  Synthetic oligonucleotide
gaccccgctcctttcgtagaagtttgtatcttttcga

SEQ ID NO: 73671 - DNA, 37 bp, Artificial Sequence
  Synthetic oligonucleotide
gactccttctgcttgccacctggttccgtctgacgga

SEQ ID NO: 73672 - DNA, 34 bp, Artificial Sequence
  Synthetic oligonucleotide
tcatgtgtctgctccttccttatttgggcccgga

SEQ ID NO: 73673 - DNA, 37 bp, Artificial Sequence
  Synthetic oligonucleotide
tccccctcgacttcagagtcgcgccaatccctccgga

SEQ ID NO: 73674 - DNA, 35 bp, Artificial Sequence
  Synthetic oligonucleotide
gccatctcgacctcggaaaaatctgttacctcgga

SEQ ID NO: 73675 - DNA, 37 bp, Artificial Sequence
  Synthetic oligonucleotide
agagtaggactacggtaatgagggaggtcggggggga

SEQ ID NO: 73676 - DNA, 37 bp, Artificial Sequence
  Synthetic oligonucleotide
ttagaaagaggggatgggggctcgaggagcgtgggga

SEQ ID NO: 73677 - DNA, 37 bp, Artificial Sequence
  Synthetic oligonucleotide
gagaaccaccactagcccctaacagcgacccttggga

SEQ ID NO: 73678 - DNA, 37 bp, Artificial Sequence
  Synthetic oligonucleotide
ttgatgagcggacagggaagggaatttggtcgtatga

SEQ ID NO: 73679 - DNA, 38 bp, Artificial Sequence
  Synthetic oligonucleotide
gggaggggtaaattgcggagggggagtaacaggtatga

SEQ ID NO: 73680 - DNA, 38 bp, Artificial Sequence
  Synthetic oligonucleotide
atggtcgtacgttcacgggcccaatccaccattcctga

SEQ ID NO: 73681 - DNA, 38 bp, Artificial Sequence
  Synthetic oligonucleotide
ttcgcgcatcacatccgacttccgatattttattctga

SEQ ID NO: 73682 - DNA, 37 bp, Artificial Sequence
  Synthetic oligonucleotide
tgcattacaccatccgcggtgcctgtcaagtttctga

SEQ ID NO: 73683 - DNA, 38 bp, Artificial Sequence
  Synthetic oligonucleotide
gcatgggccaagggtaggggaggcggacaaaggagtga

SEQ ID NO: 73684 - DNA, 38 bp, Artificial Sequence
  Synthetic oligonucleotide
gctaatgggagggagtaagggggggctatctatagtga

SEQ ID NO: 73685 - DNA, 38 bp, Artificial Sequence
  Synthetic oligonucleotide
atcgcgaactcctgtacttctgaacgtccttttagtga

SEQ ID NO: 73686 - DNA, 38 bp, Artificial Sequence
  Synthetic oligonucleotide
ataccgcacgtgctccttcttcctgccactcacggtga

SEQ ID NO: 73687 - DNA, 37 bp, Artificial Sequence
  Synthetic oligonucleotide
tctcacccctgccgcattacaagacctttcatggtga

SEQ ID NO: 73688 - DNA, 38 bp, Artificial Sequence
  Synthetic oligonucleotide
atccaggcgccacattgggcccatctctactctggtga

SEQ ID NO: 73689 - DNA, 35 bp, Artificial Sequence
  Synthetic oligonucleotide
atctgcctcgacttctccgcaacaacactatgtga

SEQ ID NO: 73690 - DNA, 38 bp, Artificial Sequence
  Synthetic oligonucleotide
ttcggagccctcgaatccgggtaccagtttgaccttga

SEQ ID NO: 73691 - DNA, 38 bp, Artificial Sequence
  Synthetic oligonucleotide
tgccgagcaattttctctgctgactatgacctccttga

SEQ ID NO: 73692 - DNA, 37 bp, Artificial Sequence
  Synthetic oligonucleotide
gccgggtggaggctgagggcacggaacattaagttga

SEQ ID NO: 73693 - DNA, 38 bp, Artificial Sequence
  Synthetic oligonucleotide
tacggtggggaggtgggggaatgtcggacacaggttga

SEQ ID NO: 73694 - DNA, 38 bp, Artificial Sequence
  Synthetic oligonucleotide
gagatgcggggaggtaaggggctaactaatgtggttga

SEQ ID NO: 73695 - DNA, 35 bp, Artificial Sequence
  Synthetic oligonucleotide
tgctgcctgcccctcgggttaaaacacccatcata

SEQ ID NO: 73696 - DNA, 35 bp, Artificial Sequence
  Synthetic oligonucleotide
tcccgcacatactccggctacttcgacccacgata

SEQ ID NO: 73697 - DNA, 36 bp, Artificial Sequence
  Synthetic oligonucleotide
tttcagtgcaccattatactgttcgatccgctccta

SEQ ID NO: 73698 - DNA, 36 bp, Artificial Sequence
  Synthetic oligonucleotide
attgtctcgaaggctcgttcgttttgcccatctcta

SEQ ID NO: 73699 - DNA, 36 bp, Artificial Sequence
  Synthetic oligonucleotide
gctgtctccggcggcatgaccattactatctttcta

SEQ ID NO: 73700 - DNA, 35 bp, Artificial Sequence
  Synthetic oligonucleotide
gtcgccggcctcccccacatgctgacgcctgcgta

SEQ ID NO: 73701 - DNA, 35 bp, Artificial Sequence
  Synthetic oligonucleotide
gaatcaaaaacgcaaagaggaaaggtgtggaggta

SEQ ID NO: 73702 - DNA, 36 bp, Artificial Sequence
  Synthetic oligonucleotide
actgccacttcgggatacatagccgttgcaccttta

SEQ ID NO: 73703 - DNA, 36 bp, Artificial Sequence
  Synthetic oligonucleotide
acagccactctttgccgaactaacctggaattttta

SEQ ID NO: 73704 - DNA, 36 bp, Artificial Sequence
  Synthetic oligonucleotide
actattgctgcacggctctctgttttcgccttttta

SEQ ID NO: 73705 - DNA, 35 bp, Artificial Sequence
  Synthetic oligonucleotide
tctgtcgcgaaggtactcctcagcgccccactaac

SEQ ID NO: 73706 - DNA, 35 bp, Artificial Sequence
  Synthetic oligonucleotide
taaggacgctgcccaagtctgagccttttgcacac

SEQ ID NO: 73707 - DNA, 35 bp, Artificial Sequence
  Synthetic oligonucleotide
ttgttcgcacaaccccacaaccccaaggattccac

SEQ ID NO: 73708 - DNA, 35 bp, Artificial Sequence
  Synthetic oligonucleotide
gtgcactactgcttttccaccatcctgtgactcac

SEQ ID NO: 73709 - DNA, 35 bp, Artificial Sequence
  Synthetic oligonucleotide
gatgctccgttcgggggctcctttctgctcttcac

SEQ ID NO: 73710 - DNA, 35 bp, Artificial Sequence
  Synthetic oligonucleotide
ttgacgctcaagcgtaggaaacaagccacaattac

SEQ ID NO: 73711 - DNA, 35 bp, Artificial Sequence
  Synthetic oligonucleotide
actgcccctgggcacaagtatcctgattccgaacc

SEQ ID NO: 73712 - DNA, 35 bp, Artificial Sequence
  Synthetic oligonucleotide
gagtcgcaccaggatccgtctgtgtctttctcacc

SEQ ID NO: 73713 - DNA, 35 bp, Artificial Sequence
  Synthetic oligonucleotide
tgaacacgagcatgtacaactgattactacttacc

SEQ ID NO: 73714 - DNA, 35 bp, Artificial Sequence
  Synthetic oligonucleotide
tagcgactcatacttcaccgtgccaagcattaccc

SEQ ID NO: 73715 - DNA, 35 bp, Artificial Sequence
  Synthetic oligonucleotide
tcaccacccgtactaccaacgccgctctaaacgcc

SEQ ID NO: 73716 - DNA, 35 bp, Artificial Sequence
  Synthetic oligonucleotide
attggtcgtgtgcgattcttcgccgttttccctcc

SEQ ID NO: 73717 - DNA, 35 bp, Artificial Sequence
  Synthetic oligonucleotide
actagccaccgcatggacattcacttcgagcaagc

SEQ ID NO: 73718 - DNA, 35 bp, Artificial Sequence
  Synthetic oligonucleotide
gcccggcgcacgagctgtccttctatctaccacgc

SEQ ID NO: 73719 - DNA, 35 bp, Artificial Sequence
  Synthetic oligonucleotide
accatcgcacaacttatgaatccatccttccaggc

SEQ ID NO: 73720 - DNA, 35 bp, Artificial Sequence
  Synthetic oligonucleotide
tgaatcccctccgctctaacgctattgctataggc

SEQ ID NO: 73721 - DNA, 35 bp, Artificial Sequence
  Synthetic oligonucleotide
gtggaaccctcaaatagccaacaacagggttgggc

SEQ ID NO: 73722 - DNA, 35 bp, Artificial Sequence
  Synthetic oligonucleotide
gaccaatatgcgcaaccccctggactaaagccatc

SEQ ID NO: 73723 - DNA, 35 bp, Artificial Sequence
  Synthetic oligonucleotide
tgcatccactcctttaggttaatctcggtcttttc

SEQ ID NO: 73724 - DNA, 35 bp, Artificial Sequence
  Synthetic oligonucleotide
tcgcggtcctctgcgttctggctgccctctcgtag

SEQ ID NO: 73725 - DNA, 35 bp, Artificial Sequence
  Synthetic oligonucleotide
gccgacacggggggcgcaaaaatactgagactacg

SEQ ID NO: 73726 - DNA, 35 bp, Artificial Sequence
  Synthetic oligonucleotide
atcggactgccatttatctatccgccttggtcccg

SEQ ID NO: 73727 - DNA, 35 bp, Artificial Sequence
  Synthetic oligonucleotide
tcatccgcctagagtctatacacgcgctcgtgccg

SEQ ID NO: 73728 - DNA, 35 bp, Artificial Sequence
  Synthetic oligonucleotide
ggtctcgtgcgcctgcctaaacttccatctgtccg

SEQ ID NO: 73729 - DNA, 35 bp, Artificial Sequence
  Synthetic oligonucleotide
aacgtgcagagggaaaagtactcacacaacccagg

SEQ ID NO: 73730 - DNA, 35 bp, Artificial Sequence
  Synthetic oligonucleotide
tgtatggtgtagggggacaagaaaggcgacggggg

SEQ ID NO: 73731 - DNA, 35 bp, Artificial Sequence
  Synthetic oligonucleotide
atccgaccagaaggttcctggtgacttggggggtg

SEQ ID NO: 73732 - DNA, 35 bp, Artificial Sequence
  Synthetic oligonucleotide
accaacccataccaagagccttactgttcatgttg

SEQ ID NO: 73733 - DNA, 35 bp, Artificial Sequence
  Synthetic oligonucleotide
actccgccagcctgtgcgtgccttgcttttcaaat

SEQ ID NO: 73734 - DNA, 35 bp, Artificial Sequence
  Synthetic oligonucleotide
atgccgagtcgtcatggctatgctggcattttcat

SEQ ID NO: 73735 - DNA, 35 bp, Artificial Sequence
  Synthetic oligonucleotide
taacgacccccggcaccaactccctagacaaggat

SEQ ID NO: 73736 - DNA, 35 bp, Artificial Sequence
  Synthetic oligonucleotide
gccgatgattggggaaggtgccggcgggaatttat

SEQ ID NO: 73737 - DNA, 35 bp, Artificial Sequence
  Synthetic oligonucleotide
ttacactcacaacaactagggcaagtgctttacct

SEQ ID NO: 73738 - DNA, 35 bp, Artificial Sequence
  Synthetic oligonucleotide
agggccatacgtcctccccgaattgatcctgccct

SEQ ID NO: 73739 - DNA, 35 bp, Artificial Sequence
  Synthetic oligonucleotide
ttattcatccgccgcctcaaagcacgattgatcct

SEQ ID NO: 73740 - DNA, 34 bp, Artificial Sequence
  Synthetic oligonucleotide
tgtccacacggggcttgtagtaggcgccctatct

SEQ ID NO: 73741 - DNA, 35 bp, Artificial Sequence
  Synthetic oligonucleotide
ccacccgcccggccgaaacgcatcaacattcacgt

SEQ ID NO: 73742 - DNA, 35 bp, Artificial Sequence
  Synthetic oligonucleotide
gcacgcgtgagtcattgaacaagtgggtggctggt

SEQ ID NO: 73743 - DNA, 35 bp, Artificial Sequence
  Synthetic oligonucleotide
ttgtgcacagactgcatccaagcccctgccgttgt

SEQ ID NO: 73744 - DNA, 35 bp, Artificial Sequence
  Synthetic oligonucleotide
tctgctcactttgatccgtggctttcgatcatctt

SEQ ID NO: 73745 - DNA, 35 bp, Artificial Sequence
  Synthetic oligonucleotide
tccaaacgcgctcatctcgtcgcacccatggattt

SEQ ID NO: 73746 - DNA, 34 bp, Artificial Sequence
  Synthetic oligonucleotide
gaaacgggccatccccttccagtctctcgtattt

SEQ ID NO: 73747 - DNA, 35 bp, Artificial Sequence
  Synthetic oligonucleotide
gtgaacgtggtacttaatgccgggccttgtccttt

SEQ ID NO: 73748 - DNA, 35 bp, Artificial Sequence
  Synthetic oligonucleotide
gagccaagcgggctagacaagggggactggggaaa

SEQ ID NO: 73749 - DNA, 36 bp, Artificial Sequence
  Synthetic oligonucleotide
tcgcccgccccaaccgatctagcgagagcccaacaa

SEQ ID NO: 73750 - DNA, 36 bp, Artificial Sequence
  Synthetic oligonucleotide
tccacctttcgccaccattagtgtctccaactcgaa

SEQ ID NO: 73751 - DNA, 36 bp, Artificial Sequence
  Synthetic oligonucleotide
tcacgcgcacatatatcactcgcttacacgtagtaa

SEQ ID NO: 73752 - DNA, 35 bp, Artificial Sequence
  Synthetic oligonucleotide
attcaccatcactcgggttccagctatgcaggaca

SEQ ID NO: 73753 - DNA, 36 bp, Artificial Sequence
  Synthetic oligonucleotide
gcaaatagaaaagattgggagggagtgagcagtaca

SEQ ID NO: 73754 - DNA, 36 bp, Artificial Sequence
  Synthetic oligonucleotide
tcctggcccctcagaacgcgccccacccgtctacca

SEQ ID NO: 73755 - DNA, 36 bp, Artificial Sequence
  Synthetic oligonucleotide
gacccctacctcagcatcctcgaaacacctattgca

SEQ ID NO: 73756 - DNA, 36 bp, Artificial Sequence
  Synthetic oligonucleotide
tcatgcccaacatgttacttttcgtcccgaccttca

SEQ ID NO: 73757 - DNA, 36 bp, Artificial Sequence
  Synthetic oligonucleotide
acgactgcccacgtggtccattctgttgaactttca

SEQ ID NO: 73758 - DNA, 36 bp, Artificial Sequence
  Synthetic oligonucleotide
tgcgaacgtccggttcaggcgttggtccttctttca

SEQ ID NO: 73759 - DNA, 36 bp, Artificial Sequence
  Synthetic oligonucleotide
gcacagagtagcacgagatactgcacatcgataaga

SEQ ID NO: 73760 - DNA, 35 bp, Artificial Sequence
  Synthetic oligonucleotide
gaacacgcccccgtacgcgctatctttacctaaga

SEQ ID NO: 73761 - DNA, 37 bp, Artificial Sequence
  Synthetic oligonucleotide
gtcgtcctgcactctaaggcctctacttgacaggaga

SEQ ID NO: 73762 - DNA, 35 bp, Artificial Sequence
  Synthetic oligonucleotide
gaggggcgggaccaactgattgtcgggttgggaga

SEQ ID NO: 73763 - DNA, 37 bp, Artificial Sequence
  Synthetic oligonucleotide
acaactgccgtaccaccgtgttttgcccgaatataga

SEQ ID NO: 73764 - DNA, 38 bp, Artificial Sequence
  Synthetic oligonucleotide
tgctaacgcaggacgtccaggcaagggaaggcggtaga

SEQ ID NO: 73765 - DNA, 37 bp, Artificial Sequence
  Synthetic oligonucleotide
tatgccctgagttgttttttgcttacttgtttcacga

SEQ ID NO: 73766 - DNA, 37 bp, Artificial Sequence
  Synthetic oligonucleotide
gagccaatccaaaatgtcaaatatctatcgctcccga

SEQ ID NO: 73767 - DNA, 37 bp, Artificial Sequence
  Synthetic oligonucleotide
gagatcaatagcaatgcggagggaaggacgtggccga

SEQ ID NO: 73768 - DNA, 37 bp, Artificial Sequence
  Synthetic oligonucleotide
tacctgcctcccttccatcgctttggttcgtctccga

SEQ ID NO: 73769 - DNA, 37 bp, Artificial Sequence
  Synthetic oligonucleotide
gcaaaggccggggaaggaggatcgtcgtcgaacgcga

SEQ ID NO: 73770 - DNA, 37 bp, Artificial Sequence
  Synthetic oligonucleotide
gcgctcccccacttgactacatgttatcgacctgcga

SEQ ID NO: 73771 - DNA, 37 bp, Artificial Sequence
  Synthetic oligonucleotide
gcccgaccagggaaatcgcagtgacccgacccctcga

SEQ ID NO: 73772 - DNA, 36 bp, Artificial Sequence
  Synthetic oligonucleotide
gtcccaaccgcactaatggtctctgcattctctcga

SEQ ID NO: 73773 - DNA, 37 bp, Artificial Sequence
  Synthetic oligonucleotide
gagaatcccacctgtaataacggtctcgccccttcga

SEQ ID NO: 73774 - DNA, 37 bp, Artificial Sequence
  Synthetic oligonucleotide
gttgcgccctggttttggttttgctccgcgtggagga

SEQ ID NO: 73775 - DNA, 37 bp, Artificial Sequence
  Synthetic oligonucleotide
aaggagtgcaggggaagaagaggagcgtttatgagga

SEQ ID NO: 73776 - DNA, 37 bp, Artificial Sequence
  Synthetic oligonucleotide
gaagagacaagggataggaactgaatgtatggacgga

SEQ ID NO: 73777 - DNA, 37 bp, Artificial Sequence
  Synthetic oligonucleotide
aaggtaggggaaggcgggcggagagtaaattgtggga

SEQ ID NO: 73778 - DNA, 36 bp, Artificial Sequence
  Synthetic oligonucleotide
taatcaagggggggagaggaaggggcgccgagtgga

SEQ ID NO: 73779 - DNA, 37 bp, Artificial Sequence
  Synthetic oligonucleotide
atccaccccacaagactcagtatcaatactgagtgga

SEQ ID NO: 73780 - DNA, 37 bp, Artificial Sequence
  Synthetic oligonucleotide
atagtagggtggtgcgggtgtataggcggaacgtgga

SEQ ID NO: 73781 - DNA, 37 bp, Artificial Sequence
  Synthetic oligonucleotide
gtccacccgggagatcctttacactaaccacgcatga

SEQ ID NO: 73782 - DNA, 37 bp, Artificial Sequence
  Synthetic oligonucleotide
acgccactatacccttctcctaggtccagcacgctga

SEQ ID NO: 73783 - DNA, 38 bp, Artificial Sequence
  Synthetic oligonucleotide
gcgaatcgcccatcccctaacgtattgttcatctctga

SEQ ID NO: 73784 - DNA, 37 bp, Artificial Sequence
  Synthetic oligonucleotide
tacgggctgaacccacttaacacaatcactaccgtga

SEQ ID NO: 73785 - DNA, 38 bp, Artificial Sequence
  Synthetic oligonucleotide
acgttcgggtgcggtgggggggctaattcttctcgtga

SEQ ID NO: 73786 - DNA, 37 bp, Artificial Sequence
  Synthetic oligonucleotide
gtcgccacaacttgtaccaccatctgcgcagacttga

SEQ ID NO: 73787 - DNA, 38 bp, Artificial Sequence
  Synthetic oligonucleotide
gtagaccatccacttgtaatgcctgttgttttacttga

SEQ ID NO: 73788 - DNA, 38 bp, Artificial Sequence
  Synthetic oligonucleotide
ttggcccccttctcgatatacgttatgctaaactttga

SEQ ID NO: 73789 - DNA, 37 bp, Artificial Sequence
  Synthetic oligonucleotide
actgagccccggcgcttacttttgaccaaacctttga

SEQ ID NO: 73790 - DNA, 37 bp, Artificial Sequence
  Synthetic oligonucleotide
tgttccctacgctggtccactattgccctacctttga

SEQ ID NO: 73791 - DNA, 38 bp, Artificial Sequence
  Synthetic oligonucleotide
gcgtatctgcacatattcatctatctacactgctttga

SEQ ID NO: 73792 - DNA, 37 bp, Artificial Sequence
  Synthetic oligonucleotide
agcttgcccctcgcatatcgacgaccatgatttttga

SEQ ID NO: 73793 - DNA, 36 bp, Artificial Sequence
  Synthetic oligonucleotide
tctatcgctaatggagggcactgctttttcccacta

SEQ ID NO: 73794 - DNA, 35 bp, Artificial Sequence
  Synthetic oligonucleotide
gcaacgctacccctccgagggccgaatctacgcta

SEQ ID NO: 73795 - DNA, 35 bp, Artificial Sequence
  Synthetic oligonucleotide
tccctgcctatcacggtccgcaccctatcattcta

SEQ ID NO: 73796 - DNA, 35 bp, Artificial Sequence
  Synthetic oligonucleotide
tcaggtaggtcactcgggctttcaaaacatgcgta

SEQ ID NO: 73797 - DNA, 36 bp, Artificial Sequence
  Synthetic oligonucleotide
aacaactccagctctcgacagttcactgctatcgta

SEQ ID NO: 73798 - DNA, 35 bp, Artificial Sequence
  Synthetic oligonucleotide
atgcgtgcacacaagttttacctagctacttcgta

SEQ ID NO: 73799 - DNA, 35 bp, Artificial Sequence
  Synthetic oligonucleotide
tgccaatcagcctggtttcgatatctctaattgta

SEQ ID NO: 73800 - DNA, 35 bp, Artificial Sequence
  Synthetic oligonucleotide
cttacgctcaatctgttcctgtgggatgttttgta

SEQ ID NO: 73801 - DNA, 36 bp, Artificial Sequence
  Synthetic oligonucleotide
ttatactgacggcggttacttgccaagccaccttta

SEQ ID NO: 73802 - DNA, 35 bp, Artificial Sequence
  Synthetic oligonucleotide
gctacccgtactcgaatccgtgggggtcttacaac

SEQ ID NO: 73803 - DNA, 35 bp, Artificial Sequence
  Synthetic oligonucleotide
tgtagctggagcccgcgcgccttcgcattcccaac

SEQ ID NO: 73804 - DNA, 35 bp, Artificial Sequence
  Synthetic oligonucleotide
ggacactacccctggttacgtacgctgaaacgcac

SEQ ID NO: 73805 - DNA, 35 bp, Artificial Sequence
  Synthetic oligonucleotide
acgcagacctacttacgtacctaagggctctctac

SEQ ID NO: 73806 - DNA, 35 bp, Artificial Sequence
  Synthetic oligonucleotide
ttgccacgactcggcgcctattttccatcctaacc

SEQ ID NO: 73807 - DNA, 35 bp, Artificial Sequence
  Synthetic oligonucleotide
tgactcctgtcacgtcctatagctcaccctgtacc

SEQ ID NO: 73808 - DNA, 35 bp, Artificial Sequence
  Synthetic oligonucleotide
aacctgttcctcgagcgctgtaaagtcttccagcc

SEQ ID NO: 73809 - DNA, 35 bp, Artificial Sequence
  Synthetic oligonucleotide
tacgtcgagagctgactgactttctagcccttgcc

SEQ ID NO: 73810 - DNA, 35 bp, Artificial Sequence
  Synthetic oligonucleotide
tgcatatgtcccacggcctcgattctaatccgtcc

SEQ ID NO: 73811 - DNA, 35 bp, Artificial Sequence
  Synthetic oligonucleotide
tcagacggtactgatcgtttattcattctcgccgc

SEQ ID NO: 73812 - DNA, 35 bp, Artificial Sequence
  Synthetic oligonucleotide
atcctctccataagcgcttttgtctcgccgtccgc

SEQ ID NO: 73813 - DNA, 35 bp, Artificial Sequence
  Synthetic oligonucleotide
ggtcatcccgggtagcttattcgattatcctgatc

SEQ ID NO: 73814 - DNA, 35 bp, Artificial Sequence
  Synthetic oligonucleotide
tgacaaggcgcccacggccgctcggccctactctc

SEQ ID NO: 73815 - DNA, 35 bp, Artificial Sequence
  Synthetic oligonucleotide
gccgtcccctagccgaggtgctgataatttctctc

SEQ ID NO: 73816 - DNA, 35 bp, Artificial Sequence
  Synthetic oligonucleotide
gtgtaccaattgcccatgccgagaatctccttgtc

SEQ ID NO: 73817 - DNA, 34 bp, Artificial Sequence
  Synthetic oligonucleotide
actagcggccccccgttaaccaccgccaccgacg

SEQ ID NO: 73818 - DNA, 35 bp, Artificial Sequence
  Synthetic oligonucleotide
tataaccgcccccatcatctgtagtgccccatacg

SEQ ID NO: 73819 - DNA, 35 bp, Artificial Sequence
  Synthetic oligonucleotide
tgtcacgcccgcgcatagtgcccagaattcttacg

SEQ ID NO: 73820 - DNA, 35 bp, Artificial Sequence
  Synthetic oligonucleotide
tctaacacccctcttttgcacgtcgccctttcccg

SEQ ID NO: 73821 - DNA, 35 bp, Artificial Sequence
  Synthetic oligonucleotide
agtgtgccgcccacgcttattgaccaggttgaagg

SEQ ID NO: 73822 - DNA, 35 bp, Artificial Sequence
  Synthetic oligonucleotide
taatgtgggcggtaggtagaggagggtgcagccgg

SEQ ID NO: 73823 - DNA, 35 bp, Artificial Sequence
  Synthetic oligonucleotide
aactgagtagtagggggggaagcactcggttatgg

SEQ ID NO: 73824 - DNA, 35 bp, Artificial Sequence
  Synthetic oligonucleotide
acgggcatcccttcctaacctgcatagggcacatg

SEQ ID NO: 73825 - DNA, 35 bp, Artificial Sequence
  Synthetic oligonucleotide
gggatgccacccggattctgaacccgaacaacctg

SEQ ID NO: 73826 - DNA, 35 bp, Artificial Sequence
  Synthetic oligonucleotide
atatgcacaccgatctacatgcactcccgaatctg

SEQ ID NO: 73827 - DNA, 35 bp, Artificial Sequence
  Synthetic oligonucleotide
gagatccgagggcattgggtacatggggaagacat

SEQ ID NO: 73828 - DNA, 35 bp, Artificial Sequence
  Synthetic oligonucleotide
gcaccacccactagggaacggtcatcacacttcat

SEQ ID NO: 73829 - DNA, 35 bp, Artificial Sequence
  Synthetic oligonucleotide
aaccgaccccggcccgcatgaatttcgtttccgat

SEQ ID NO: 73830 - DNA, 35 bp, Artificial Sequence
  Synthetic oligonucleotide
acttaccaccaggcacacgttgtccatgaatggat

SEQ ID NO: 73831 - DNA, 35 bp, Artificial Sequence
  Synthetic oligonucleotide
aaacgcatctgccggacgcctgctgagcttactat

SEQ ID NO: 73832 - DNA, 35 bp, Artificial Sequence
  Synthetic oligonucleotide
atcacacccattgtctgtacaccaaggttcagact

SEQ ID NO: 73833 - DNA, 35 bp, Artificial Sequence
  Synthetic oligonucleotide
tgccaagaactgatattcacccgctgtctcctact

SEQ ID NO: 73834 - DNA, 35 bp, Artificial Sequence
  Synthetic oligonucleotide
tccgcgccggcacccactcatcgctccatctgcct

SEQ ID NO: 73835 - DNA, 35 bp, Artificial Sequence
  Synthetic oligonucleotide
aacgaaggggatggaaatggcaagaggaaccggct

SEQ ID NO: 73836 - DNA, 35 bp, Artificial Sequence
  Synthetic oligonucleotide
tcacacatggatcgcaaggggaaacaggccgggct

SEQ ID NO: 73837 - DNA, 35 bp, Artificial Sequence
  Synthetic oligonucleotide
tgtgcatcgggtattctcagcgccaccaatgttct

SEQ ID NO: 73838 - DNA, 35 bp, Artificial Sequence
  Synthetic oligonucleotide
gatgcaatagcgggcggaggaattacggttggcgt

SEQ ID NO: 73839 - DNA, 35 bp, Artificial Sequence
  Synthetic oligonucleotide
atacccggtcgatttcaccatacgctccgccttgt

SEQ ID NO: 73840 - DNA, 34 bp, Artificial Sequence
  Synthetic oligonucleotide
attcacctagactcacgccgatggcgagcacctt

SEQ ID NO: 73841 - DNA, 35 bp, Artificial Sequence
  Synthetic oligonucleotide
tcatgacacgtctccagatcgtctttcctagcctt

SEQ ID NO: 73842 - DNA, 35 bp, Artificial Sequence
  Synthetic oligonucleotide
ttccgcgcaagccccgcccccgctcaggcggcctt

SEQ ID NO: 73843 - DNA, 35 bp, Artificial Sequence
  Synthetic oligonucleotide
agatcaagtgtcagccttagggtccgtgcctcctt

SEQ ID NO: 73844 - DNA, 35 bp, Artificial Sequence
  Synthetic oligonucleotide
acgagctatcaccccacagcccgaacatcaacgtt

SEQ ID NO: 73845 - DNA, 35 bp, Artificial Sequence
  Synthetic oligonucleotide
ttcgtccatctacagcccctcccccccatatggtt

SEQ ID NO: 73846 - DNA, 35 bp, Artificial Sequence
  Synthetic oligonucleotide
ttgccctatcaccctccttggtcatgtgtagtttt

SEQ ID NO: 73847 - DNA, 36 bp, Artificial Sequence
  Synthetic oligonucleotide
tgtgaacgatcgaaggccgccacttttcctatcaaa

SEQ ID NO: 73848 - DNA, 35 bp, Artificial Sequence
  Synthetic oligonucleotide
gttccgttgccctccaatgcaaccattccttccaa

SEQ ID NO: 73849 - DNA, 35 bp, Artificial Sequence
  Synthetic oligonucleotide
gtgccggaggcgctacaactaacaccctttctgaa

SEQ ID NO: 73850 - DNA, 34 bp, Artificial Sequence
  Synthetic oligonucleotide
tatccgcctccaatgcaagtacctccccgagtaa

SEQ ID NO: 73851 - DNA, 36 bp, Artificial Sequence
  Synthetic oligonucleotide
gagcaccacagaaggttaggggaatatttgcgttaa

SEQ ID NO: 73852 - DNA, 35 bp, Artificial Sequence
  Synthetic oligonucleotide
caaggtgcgaaggttaggtcgcatcctccttttaa

SEQ ID NO: 73853 - DNA, 36 bp, Artificial Sequence
  Synthetic oligonucleotide
gaggaggacccggtggaaaggcaagtacagttttaa

SEQ ID NO: 73854 - DNA, 35 bp, Artificial Sequence
  Synthetic oligonucleotide
gcgcacaccggctcctcccgcaacgtctcaacaca

SEQ ID NO: 73855 - DNA, 36 bp, Artificial Sequence
  Synthetic oligonucleotide
tcgaagccacgcgatggttcgcttaaactcctcaca

SEQ ID NO: 73856 - DNA, 36 bp, Artificial Sequence
  Synthetic oligonucleotide
acgttgggccgcctgctgattccgaacctcctgaca

SEQ ID NO: 73857 - DNA, 36 bp, Artificial Sequence
  Synthetic oligonucleotide
aaacccgcgtactccgccgtcaacatcttctctaca

SEQ ID NO: 73858 - DNA, 36 bp, Artificial Sequence
  Synthetic oligonucleotide
tgctggctgcaccccattttgcacggcccattacca

SEQ ID NO: 73859 - DNA, 35 bp, Artificial Sequence
  Synthetic oligonucleotide
tcgatatgccccgaactcgtcggtcggtacaccca

SEQ ID NO: 73860 - DNA, 35 bp, Artificial Sequence
  Synthetic oligonucleotide
tccattaccccatcaagttgttaggaatagttgca

SEQ ID NO: 73861 - DNA, 35 bp, Artificial Sequence
  Synthetic oligonucleotide
gatgcctgatcggtctcttatccttcctcgcatca

SEQ ID NO: 73862 - DNA, 35 bp, Artificial Sequence
  Synthetic oligonucleotide
gctccagcgtggtggcacatcactaccatccctca

SEQ ID NO: 73863 - DNA, 35 bp, Artificial Sequence
  Synthetic oligonucleotide
ttgccagaaggcatacgtcgtcccacctccggtca

SEQ ID NO: 73864 - DNA, 37 bp, Artificial Sequence
  Synthetic oligonucleotide
ttgacacggtctcaatataatgccgatcacaccaaga

SEQ ID NO: 73865 - DNA, 37 bp, Artificial Sequence
  Synthetic oligonucleotide
tcagtcatggtgggtgagtggggcgggtctcggaaga

SEQ ID NO: 73866 - DNA, 37 bp, Artificial Sequence
  Synthetic oligonucleotide
gtcatccacatttcccctgccgtttagctccaaacga

SEQ ID NO: 73867 - DNA, 37 bp, Artificial Sequence
  Synthetic oligonucleotide
agtccgagagagcatgggagtgggagaactaagacga

SEQ ID NO: 73868 - DNA, 36 bp, Artificial Sequence
  Synthetic oligonucleotide
cccactgaccccctttccacctgcctaagagtacga

SEQ ID NO: 73869 - DNA, 36 bp, Artificial Sequence
  Synthetic oligonucleotide
atccgccctcctgttcagcaatccgaaacctgccga

SEQ ID NO: 73870 - DNA, 36 bp, Artificial Sequence
  Synthetic oligonucleotide
agctggaagcccagatgcaccctaccccccccgcga

SEQ ID NO: 73871 - DNA, 37 bp, Artificial Sequence
  Synthetic oligonucleotide
acccctaccctgcagaatagtagtcaatcctgctcga

SEQ ID NO: 73872 - DNA, 37 bp, Artificial Sequence
  Synthetic oligonucleotide
gcctaggaccgccccgacgtgatcgtctccccttcga

SEQ ID NO: 73873 - DNA, 37 bp, Artificial Sequence
  Synthetic oligonucleotide
gtccgcaccactccctttaggtgattcttttcttcga

SEQ ID NO: 73874 - DNA, 37 bp, Artificial Sequence
  Synthetic oligonucleotide
aaccacacctgctatcgactttaatttcacggttcga

SEQ ID NO: 73875 - DNA, 37 bp, Artificial Sequence
  Synthetic oligonucleotide
tcatcaccggcggggagggacctagagtaggtgagga

SEQ ID NO: 73876 - DNA, 37 bp, Artificial Sequence
  Synthetic oligonucleotide
gtctaccgacgtctccataccaccccgcgcctacgga

SEQ ID NO: 73877 - DNA, 37 bp, Artificial Sequence
  Synthetic oligonucleotide
attccaccacgaaaatgctgcagttcgttcacccgga

SEQ ID NO: 73878 - DNA, 37 bp, Artificial Sequence
  Synthetic oligonucleotide
acatcgagggtcgagctgtacctttgctattcccgga

SEQ ID NO: 73879 - DNA, 36 bp, Artificial Sequence
  Synthetic oligonucleotide
tccttcgctcaaaagttcacctcatcatatgccgga

SEQ ID NO: 73880 - DNA, 37 bp, Artificial Sequence
  Synthetic oligonucleotide
gttacaccggtaatagaagtaggagggaggtgccgga

SEQ ID NO: 73881 - DNA, 37 bp, Artificial Sequence
  Synthetic oligonucleotide
gaacatggtaggaagccgagcatgtcaggaaaaggga

SEQ ID NO: 73882 - DNA, 37 bp, Artificial Sequence
  Synthetic oligonucleotide
atcgcagcccgcctgccgattgcccaaccttcaggga

SEQ ID NO: 73883 - DNA, 36 bp, Artificial Sequence
  Synthetic oligonucleotide
taggacggacgcagaagggatctaggtttacgggga

SEQ ID NO: 73884 - DNA, 37 bp, Artificial Sequence
  Synthetic oligonucleotide
gacggaaaaaggtaaggagatgaaaacacaaggggga

SEQ ID NO: 73885 - DNA, 37 bp, Artificial Sequence
  Synthetic oligonucleotide
ggtagggggtggggctaagggcgacacgacgctggga

SEQ ID NO: 73886 - DNA, 37 bp, Artificial Sequence
  Synthetic oligonucleotide
atcgagcgcagtgcactgacagcagtgaagggtggga

SEQ ID NO: 73887 - DNA, 36 bp, Artificial Sequence
  Synthetic oligonucleotide
gacaacgcaatcgacggtgattcatagtgggtggga

SEQ ID NO: 73888 - DNA, 36 bp, Artificial Sequence
  Synthetic oligonucleotide
accacgccaggaagccgctccccttttcatattgga

SEQ ID NO: 73889 - DNA, 37 bp, Artificial Sequence
  Synthetic oligonucleotide
aacccacccgacgatgccgtatgcatgttcctttgga

SEQ ID NO: 73890 - DNA, 37 bp, Artificial Sequence
  Synthetic oligonucleotide
atgggtaaccgccctgtgccccacccaattttttgga

SEQ ID NO: 73891 - DNA, 38 bp, Artificial Sequence
  Synthetic oligonucleotide
gggggagcgtagcggggcacttaagattgggggaatga

SEQ ID NO: 73892 - DNA, 38 bp, Artificial Sequence
  Synthetic oligonucleotide
ttgcgagcaaaattgatgggatgggatgaacgtaatga

SEQ ID NO: 73893 - DNA, 38 bp, Artificial Sequence
  Synthetic oligonucleotide
tagccgccgcccaagtctcatactggatctacgcatga

SEQ ID NO: 73894 - DNA, 38 bp, Artificial Sequence
  Synthetic oligonucleotide
aacaggaggtcggctaaatggagtccgggggacgatga

SEQ ID NO: 73895 - DNA, 37 bp, Artificial Sequence
  Synthetic oligonucleotide
ttgaagtcagcctctgtagtgcggtgaggtgggatga

SEQ ID NO: 73896 - DNA, 37 bp, Artificial Sequence
  Synthetic oligonucleotide
gatcgcgtggccgttcaactcccttcgctctatatga

SEQ ID NO: 73897 - DNA, 38 bp, Artificial Sequence
  Synthetic oligonucleotide
agggccacccctggcaccatcccacccgtttcaactga

SEQ ID NO: 73898 - DNA, 38 bp, Artificial Sequence
  Synthetic oligonucleotide
gtccaactcaattgctcgatcggttactttcccactga

SEQ ID NO: 73899 - DNA, 38 bp, Artificial Sequence
  Synthetic oligonucleotide
tagtacctgcctccacctcgcgaatgcactcggactga

SEQ ID NO: 73900 - DNA, 37 bp, Artificial Sequence
  Synthetic oligonucleotide
gtataccggctcccctccttgccgatcctatccctga

SEQ ID NO: 73901 - DNA, 36 bp, Artificial Sequence
  Synthetic oligonucleotide
gtgagcccactcaactagatagcctccgtttcctga

SEQ ID NO: 73902 - DNA, 38 bp, Artificial Sequence
  Synthetic oligonucleotide
gctaagccgccttccacagcatactcccacgctgctga

SEQ ID NO: 73903 - DNA, 38 bp, Artificial Sequence
  Synthetic oligonucleotide
tcgcgcccccaacctaggcccaatgagctacactctga

SEQ ID NO: 73904 - DNA, 38 bp, Artificial Sequence
  Synthetic oligonucleotide
tgcaaggggcgtggtgctccctttgtccatcattctga

SEQ ID NO: 73905 - DNA, 38 bp, Artificial Sequence
  Synthetic oligonucleotide
gacccgccctgtgatctgcctcggattcgactttctga

SEQ ID NO: 73906 - DNA, 38 bp, Artificial Sequence
  Synthetic oligonucleotide
tagcgggtgtaaggtacgggtgtaggggaaataagtga

SEQ ID NO: 73907 - DNA, 38 bp, Artificial Sequence
  Synthetic oligonucleotide
gagggaatggagtgcaagatgggtgggtaattaggtga

SEQ ID NO: 73908 - DNA, 38 bp, Artificial Sequence
  Synthetic oligonucleotide
aagactaaaaggtgagggtggtagatggagtggggtga

SEQ ID NO: 73909 - DNA, 38 bp, Artificial Sequence
  Synthetic oligonucleotide
tagaaggaaacagggggaagaggtaagagccttgttga

SEQ ID NO: 73910 - DNA, 36 bp, Artificial Sequence
  Synthetic oligonucleotide
gtatctcgcacgttggactaacgtgtccacctttga

SEQ ID NO: 73911 - DNA, 36 bp, Artificial Sequence
  Synthetic oligonucleotide
agacccatctgatcgagcttccgagcccctgcacta

SEQ ID NO: 73912 - DNA, 36 bp, Artificial Sequence
  Synthetic oligonucleotide
gtcccgaccgcgtgccactctaacgcactcagccta

SEQ ID NO: 73913 - DNA, 35 bp, Artificial Sequence
  Synthetic oligonucleotide
ggtcgagtaccgcaattctcttcagcccttcgcta

SEQ ID NO: 73914 - DNA, 36 bp, Artificial Sequence
  Synthetic oligonucleotide
accgagtggctatccgttcacgcactcaccttgcta

SEQ ID NO: 73915 - DNA, 36 bp, Artificial Sequence
  Synthetic oligonucleotide
atgcgacaggcctctctcccctgattatcacatcta

SEQ ID NO: 73916 - DNA, 35 bp, Artificial Sequence
  Synthetic oligonucleotide
gcctgttgtgtgtcgccgcctcgttgtcacttcta

SEQ ID NO: 73917 - DNA, 36 bp, Artificial Sequence
  Synthetic oligonucleotide
tgcccatcgaccattgcccactcgtcgtccgctgta

SEQ ID NO: 73918 - DNA, 36 bp, Artificial Sequence
  Synthetic oligonucleotide
agtgcccatgtggagagggtggattgtcaatggtta

SEQ ID NO: 73919 - DNA, 35 bp, Artificial Sequence
  Synthetic oligonucleotide
actcagggccgcctgtctcactcatagtccgtcac

SEQ ID NO: 73920 - DNA, 35 bp, Artificial Sequence
  Synthetic oligonucleotide
gtcgatgtgtccccgatctctctgtctttgaatac

SEQ ID NO: 73921 - DNA, 35 bp, Artificial Sequence
  Synthetic oligonucleotide
gtcgctctaccgaagcgcacttagtcatcaacacc

SEQ ID NO: 73922 - DNA, 35 bp, Artificial Sequence
  Synthetic oligonucleotide
gactactggaactcatgactcgcaccgtgcgaccc

SEQ ID NO: 73923 - DNA, 35 bp, Artificial Sequence
  Synthetic oligonucleotide
gagccggcgaccagccttcctttccgcaaagcccc

SEQ ID NO: 73924 - DNA, 35 bp, Artificial Sequence
  Synthetic oligonucleotide
ttaaccaggtcacaccatctcttatgcgggcgccc

SEQ ID NO: 73925 - DNA, 35 bp, Artificial Sequence
  Synthetic oligonucleotide
tatgaccccgaccgaaagtaattgcgtagacggcc

SEQ ID NO: 73926 - DNA, 35 bp, Artificial Sequence
  Synthetic oligonucleotide
gctggggtacactgcgatttctccattacaatgcc

SEQ ID NO: 73927 - DNA, 35 bp, Artificial Sequence
  Synthetic oligonucleotide
tgtgtgggccaccgacctacgttctttgttctgcc

SEQ ID NO: 73928 - DNA, 35 bp, Artificial Sequence
  Synthetic oligonucleotide
tgtacctcaggatcttctatatggtgcgcatctcc

SEQ ID NO: 73929 - DNA, 35 bp, Artificial Sequence
  Synthetic oligonucleotide
gtaaggtggggaaaagtcggggagacgcgagaagc

SEQ ID NO: 73930 - DNA, 35 bp, Artificial Sequence
  Synthetic oligonucleotide
tcacctcctatgtgccatcaacgaaaggaaaacgc

SEQ ID NO: 73931 - DNA, 35 bp, Artificial Sequence
  Synthetic oligonucleotide
gaacggactgcttagctcagcgccgcaactgacgc

SEQ ID NO: 73932 - DNA, 35 bp, Artificial Sequence
  Synthetic oligonucleotide
gacccgcgccttccctttactaggtaacaacatgc

SEQ ID NO: 73933 - DNA, 35 bp, Artificial Sequence
  Synthetic oligonucleotide
gattcctcctcaaccacaggcacatgcccgtatgc

SEQ ID NO: 73934 - DNA, 35 bp, Artificial Sequence
  Synthetic oligonucleotide
actcccattgcaaaatggctttaaaacacttcatc

SEQ ID NO: 73935 - DNA, 35 bp, Artificial Sequence
  Synthetic oligonucleotide
ggtacacacgtaatctccaggcccgttctttactc

SEQ ID NO: 73936 - DNA, 35 bp, Artificial Sequence
  Synthetic oligonucleotide
tcccaccacctatcgcacaagtagattattggctc

SEQ ID NO: 73937 - DNA, 35 bp, Artificial Sequence
  Synthetic oligonucleotide
attgtccaggctggcgtccgcacatactcctcgtc

SEQ ID NO: 73938 - DNA, 35 bp, Artificial Sequence
  Synthetic oligonucleotide
tcccgccgctcacagagcctcccgacctccctgtc

SEQ ID NO: 73939 - DNA, 35 bp, Artificial Sequence
  Synthetic oligonucleotide
tccacatcgcgcagtaaactgggggggtccacttc

SEQ ID NO: 73940 - DNA, 35 bp, Artificial Sequence
  Synthetic oligonucleotide
attacccctccctctgcttatgaatgaacaccttc

SEQ ID NO: 73941 - DNA, 35 bp, Artificial Sequence
  Synthetic oligonucleotide
gttgccaggctcccacgtccgtgatccttccgaag

SEQ ID NO: 73942 - DNA, 35 bp, Artificial Sequence
  Synthetic oligonucleotide
gctgtcacccactatccgaattgcgcaactcgaag

SEQ ID NO: 73943 - DNA, 35 bp, Artificial Sequence
  Synthetic oligonucleotide
gttgtcccgtccacgcttccacaatcgtttccgag

SEQ ID NO: 73944 - DNA, 35 bp, Artificial Sequence
  Synthetic oligonucleotide
ggttccaactccgcacttatctaccatcagcaacg

SEQ ID NO: 73945 - DNA, 35 bp, Artificial Sequence
  Synthetic oligonucleotide
tgtactcgcagcaatgagccggctctcacacctcg

SEQ ID NO: 73946 - DNA, 35 bp, Artificial Sequence
  Synthetic oligonucleotide
gagtacgtctggttctctgcattattcaactctcg

SEQ ID NO: 73947 - DNA, 35 bp, Artificial Sequence
  Synthetic oligonucleotide
gaaccatgccgtttgttccgtaattggccgccggg

SEQ ID NO: 73948 - DNA, 35 bp, Artificial Sequence
  Synthetic oligonucleotide
gcacgtgaccttttctgtttttttcgtcctcgatg

SEQ ID NO: 73949 - DNA, 35 bp, Artificial Sequence
  Synthetic oligonucleotide
tgagtccaataccctgcccgtaacatcatttagtg

SEQ ID NO: 73950 - DNA, 35 bp, Artificial Sequence
  Synthetic oligonucleotide
gggagggccgctctcttgtttttttgtgtctcgtg

SEQ ID NO: 73951 - DNA, 35 bp, Artificial Sequence
  Synthetic oligonucleotide
tgtgtcgtggtgtgacctcacgcgaattacctcat

SEQ ID NO: 73952 - DNA, 35 bp, Artificial Sequence
  Synthetic oligonucleotide
ggggaggaacgggcaaggggtcttgaggcaaagat

SEQ ID NO: 73953 - DNA, 35 bp, Artificial Sequence
  Synthetic oligonucleotide
ttaatccgccctttgaagttcatgccctccggtat

SEQ ID NO: 73954 - DNA, 35 bp, Artificial Sequence
  Synthetic oligonucleotide
tgcaatcacgagtactatcaacatgcatccgggct

SEQ ID NO: 73955 - DNA, 35 bp, Artificial Sequence
  Synthetic oligonucleotide
tacatatccggtgccatccttcgcgggctgctgct

SEQ ID NO: 73956 - DNA, 35 bp, Artificial Sequence
  Synthetic oligonucleotide
tgatttgcctcggctttggtacatcacccacatct

SEQ ID NO: 73957 - DNA, 35 bp, Artificial Sequence
  Synthetic oligonucleotide
gatcacacccgtctcaatagctaacgacccgctct

SEQ ID NO: 73958 - DNA, 35 bp, Artificial Sequence
  Synthetic oligonucleotide
gctgcaccctttctgttcgtgtggccatctgtatt

SEQ ID NO: 73959 - DNA, 35 bp, Artificial Sequence
  Synthetic oligonucleotide
acgtacaccctctcgccttgtgccacgaagtcctt

SEQ ID NO: 73960 - DNA, 35 bp, Artificial Sequence
  Synthetic oligonucleotide
actggaacaccatacggatttggcttaacactctt

SEQ ID NO: 73961 - DNA, 35 bp, Artificial Sequence
  Synthetic oligonucleotide
agcgtgtagaaggaggtagggggcgggttgtagtt

SEQ ID NO: 73962 - DNA, 35 bp, Artificial Sequence
  Synthetic oligonucleotide
gctatatcctgcgccacctatttagtcgaccgttt

SEQ ID NO: 73963 - DNA, 35 bp, Artificial Sequence
  Synthetic oligonucleotide
tatcgagctgcattggtcttcccaacctgttgttt

SEQ ID NO: 73964 - DNA, 36 bp, Artificial Sequence
  Synthetic oligonucleotide
gcacgccgctttaaacgcgctttaccgtcccccaca

SEQ ID NO: 73965 - DNA, 36 bp, Artificial Sequence
  Synthetic oligonucleotide
agcgaatggtcccgcttcctatattatcatggcaca

SEQ ID NO: 73966 - DNA, 36 bp, Artificial Sequence
  Synthetic oligonucleotide
gacccttgctcatcttcctctgttacctgtaataca

SEQ ID NO: 73967 - DNA, 36 bp, Artificial Sequence
  Synthetic oligonucleotide
gccgggggagagtggggatggatgtagctggaacca

SEQ ID NO: 73968 - DNA, 36 bp, Artificial Sequence
  Synthetic oligonucleotide
gctcggttcatggatatttctcgtcggctaccacca

SEQ ID NO: 73969 - DNA, 35 bp, Artificial Sequence
  Synthetic oligonucleotide
acacacgtatgtgtcacggaagctggcgcccacca

SEQ ID NO: 73970 - DNA, 36 bp, Artificial Sequence
  Synthetic oligonucleotide
gtgccactctacccgattctattcgaagcgccccca

SEQ ID NO: 73971 - DNA, 36 bp, Artificial Sequence
  Synthetic oligonucleotide
gtcgccacctccctgttcaattgtacaccgctccca

SEQ ID NO: 73972 - DNA, 36 bp, Artificial Sequence
  Synthetic oligonucleotide
tttgcaatcaccctgactctctctggccttctgcca

SEQ ID NO: 73973 - DNA, 36 bp, Artificial Sequence
  Synthetic oligonucleotide
tgagacgtcgagttctttgttatccgtccccttcca

SEQ ID NO: 73974 - DNA, 36 bp, Artificial Sequence
  Synthetic oligonucleotide
cccaagtgcccatccgagtaccttacaggacacgca

SEQ ID NO: 73975 - DNA, 36 bp, Artificial Sequence
  Synthetic oligonucleotide
tcgggataggtaggggggagggggcagaaaaaggca

SEQ ID NO: 73976 - DNA, 36 bp, Artificial Sequence
  Synthetic oligonucleotide
tctcaaccccagctctctgaacttctttgcagggca

SEQ ID NO: 73977 - DNA, 36 bp, Artificial Sequence
  Synthetic oligonucleotide
aatatgcgggaagggagaaggagcggtagataatca

SEQ ID NO: 73978 - DNA, 33 bp, Artificial Sequence
  Synthetic oligonucleotide
gtggagcaggggtggagttagagcaaaatctca

SEQ ID NO: 73979 - DNA, 36 bp, Artificial Sequence
  Synthetic oligonucleotide
gccgcatagccttcccgagaggtttggtcgctttca

SEQ ID NO: 73980 - DNA, 38 bp, Artificial Sequence
  Synthetic oligonucleotide
gggtacccgatcgcggggaaaggagggggaaataaaga

SEQ ID NO: 73981 - DNA, 37 bp, Artificial Sequence
  Synthetic oligonucleotide
gacccgattagaaaataagtagggaagggggggtaga

SEQ ID NO: 73982 - DNA, 37 bp, Artificial Sequence
  Synthetic oligonucleotide
tccccactcccctgtgtcagtcaacgggccagttaga

SEQ ID NO: 73983 - DNA, 36 bp, Artificial Sequence
  Synthetic oligonucleotide
gggagggtggggaagccatgtggatcaatggttaga

SEQ ID NO: 73984 - DNA, 37 bp, Artificial Sequence
  Synthetic oligonucleotide
ttcgacatccacaatctctaatcgttttaccaaacga

SEQ ID NO: 73985 - DNA, 35 bp, Artificial Sequence
  Synthetic oligonucleotide
gtccgcccgccgactaagcctattgctgtgcacga

SEQ ID NO: 73986 - DNA, 37 bp, Artificial Sequence
  Synthetic oligonucleotide
atgcaatcgggagcaagtaaaatgtctcagtgtacga

SEQ ID NO: 73987 - DNA, 35 bp, Artificial Sequence
  Synthetic oligonucleotide
tcacgcatacccgctcgccgaatttagctacccga

SEQ ID NO: 73988 - DNA, 37 bp, Artificial Sequence
  Synthetic oligonucleotide
gatcgcacttcaccagtgaataccctacgtaccccga

SEQ ID NO: 73989 - DNA, 37 bp, Artificial Sequence
  Synthetic oligonucleotide
taacgcccactcggaatgggcgctaactgacccccga

SEQ ID NO: 73990 - DNA, 36 bp, Artificial Sequence
  Synthetic oligonucleotide
atctccacccgggggacagcaggatacccatcccga

SEQ ID NO: 73991 - DNA, 38 bp, Artificial Sequence
  Synthetic oligonucleotide
acgagcacactcataccatctttggccaggccacgcga

SEQ ID NO: 73992 - DNA, 37 bp, Artificial Sequence
  Synthetic oligonucleotide
aaccccccacagttcgtcctctacattcttcacgcga

SEQ ID NO: 73993 - DNA, 37 bp, Artificial Sequence
  Synthetic oligonucleotide
gagaacagaacagggggagcggtgggtagatgatcga

SEQ ID NO: 73994 - DNA, 37 bp, Artificial Sequence
  Synthetic oligonucleotide
gcactcccatcatctcacctgcgacctgccaattcga

SEQ ID NO: 73995 - DNA, 36 bp, Artificial Sequence
  Synthetic oligonucleotide
gcaggcgggggcgggctgcaaaataatggggtcgga

SEQ ID NO: 73996 - DNA, 37 bp, Artificial Sequence
  Synthetic oligonucleotide
agagggccctagtcggaatggagggcgaaggtaggga

SEQ ID NO: 73997 - DNA, 37 bp, Artificial Sequence
  Synthetic oligonucleotide
tcgcgaaggggagttaaggagggctagggtactggga

SEQ ID NO: 73998 - DNA, 37 bp, Artificial Sequence
  Synthetic oligonucleotide
atcgtcctcactgctgagccgctgaactaaattggga

SEQ ID NO: 73999 - DNA, 35 bp, Artificial Sequence
  Synthetic oligonucleotide
gagtgcagtatgcgtagggaaaggtggttgatgga

SEQ ID NO: 74000 - DNA, 37 bp, Artificial Sequence
  Synthetic oligonucleotide
agacgtccgctctggctgaaacactgcataacctgga

SEQ ID NO: 74001 - DNA, 37 bp, Artificial Sequence
  Synthetic oligonucleotide
gagaccgccgggctcatgtgacatcattgtttttgga

SEQ ID NO: 74002 - DNA, 38 bp, Artificial Sequence
  Synthetic oligonucleotide
tacccaacgctcttgcactgcacaccgattttccatga

SEQ ID NO: 74003 - DNA, 38 bp, Artificial Sequence
  Synthetic oligonucleotide
gtgcatcagcaccggcacacgttcttgacctcgcatga

SEQ ID NO: 74004 - DNA, 37 bp, Artificial Sequence
  Synthetic oligonucleotide
acaggcacctgcggatgtatgccgccccccttcatga

SEQ ID NO: 74005 - DNA, 35 bp, Artificial Sequence
  Synthetic oligonucleotide
gatcgcctacatgcctatgtttaacccatctatga

SEQ ID NO: 74006 - DNA, 38 bp, Artificial Sequence
  Synthetic oligonucleotide
tacattccagccctgttcggagaactatgtacttatga

SEQ ID NO: 74007 - DNA, 37 bp, Artificial Sequence
  Synthetic oligonucleotide
tcccgcgagtccccacgtcgttcccttccgttgctga

SEQ ID NO: 74008 - DNA, 38 bp, Artificial Sequence
  Synthetic oligonucleotide
gaggaacgaagagaggtagaatcgtggtgatacagtga

SEQ ID NO: 74009 - DNA, 38 bp, Artificial Sequence
  Synthetic oligonucleotide
acagcaaggtggtcagggagcgcgggacggaatagtga

SEQ ID NO: 74010 - DNA, 37 bp, Artificial Sequence
  Synthetic oligonucleotide
tgactcatagggggaacgacggagggaacgttggtga

SEQ ID NO: 74011 - DNA, 36 bp, Artificial Sequence
  Synthetic oligonucleotide
tgagggaggatgcgtaaagaatggaagcgttggtga

SEQ ID NO: 74012 - DNA, 38 bp, Artificial Sequence
  Synthetic oligonucleotide
gttgtcacagaagatggggggagggattaagaatgtga

SEQ ID NO: 74013 - DNA, 37 bp, Artificial Sequence
  Synthetic oligonucleotide
accagtcgccagctataccgaatagcctcctacttga

SEQ ID NO: 74014 - DNA, 38 bp, Artificial Sequence
  Synthetic oligonucleotide
gttgcatccctacgacctttggaaaccgcggtccttga

SEQ ID NO: 74015 - DNA, 37 bp, Artificial Sequence
  Synthetic oligonucleotide
acctagcaatcctgcacattgaactcccgaaggttga

SEQ ID NO: 74016 - DNA, 37 bp, Artificial Sequence
  Synthetic oligonucleotide
agttaccgctatacacccggcccagtcaccatgttga

SEQ ID NO: 74017 - DNA, 36 bp, Artificial Sequence
  Synthetic oligonucleotide
tgtggttgttgcccgccctggtattactcttgttga

SEQ ID NO: 74018 - DNA, 38 bp, Artificial Sequence
  Synthetic oligonucleotide
acattagcctgccctcacctggtattattttggtttga

SEQ ID NO: 74019 - DNA, 36 bp, Artificial Sequence
  Synthetic oligonucleotide
gttgtacgcccctccagctagcttagcatgcacata

SEQ ID NO: 74020 - DNA, 36 bp, Artificial Sequence
  Synthetic oligonucleotide
acatgcgccctcactttcactggagccgccattata

SEQ ID NO: 74021 - DNA, 33 bp, Artificial Sequence
  Synthetic oligonucleotide
tcttaggctcagatccctatcctgtcgccacta

SEQ ID NO: 74022 - DNA, 36 bp, Artificial Sequence
  Synthetic oligonucleotide
atgctcgcaacatccagcatcctttttatagtacta

SEQ ID NO: 74023 - DNA, 36 bp, Artificial Sequence
  Synthetic oligonucleotide
ttcgccttccgacaggctaatttttcgttcaaccta

SEQ ID NO: 74024 - DNA, 35 bp, Artificial Sequence
  Synthetic oligonucleotide
gccgcggatcttccctatgaacctgtacccgccta

SEQ ID NO: 74025 - DNA, 35 bp, Artificial Sequence
  Synthetic oligonucleotide
tgatgttccctccggtgtgcgcacctgcccatcta

SEQ ID NO: 74026 - DNA, 36 bp, Artificial Sequence
  Synthetic oligonucleotide
tacttcacttcgtgtgccattaccccttccggtcta

SEQ ID NO: 74027 - DNA, 35 bp, Artificial Sequence
  Synthetic oligonucleotide
ggaggtccctaatgctactatccccgccgtttcta

SEQ ID NO: 74028 - DNA, 35 bp, Artificial Sequence
  Synthetic oligonucleotide
tcagcccactaccgaccacccgcgctccacctgta

SEQ ID NO: 74029 - DNA, 36 bp, Artificial Sequence
  Synthetic oligonucleotide
tgtgaccgcctattactccatctgtttcggtttgta

SEQ ID NO: 74030 - DNA, 36 bp, Artificial Sequence
  Synthetic oligonucleotide
atccatcgcaaccatcttagaacacagagcccatta

SEQ ID NO: 74031 - DNA, 35 bp, Artificial Sequence
  Synthetic oligonucleotide
gtagacaccaacatcaatgactttaccgcaactta

SEQ ID NO: 74032 - DNA, 36 bp, Artificial Sequence
  Synthetic oligonucleotide
gagccccttgacgttacctttccatcgtgacactta

SEQ ID NO: 74033 - DNA, 35 bp, Artificial Sequence
  Synthetic oligonucleotide
gacgccaccacactataccttccctggtaaggcac

SEQ ID NO: 74034 - DNA, 34 bp, Artificial Sequence
  Synthetic oligonucleotide
tgacctactcgcggatatgtccctccttttgcac

SEQ ID NO: 74035 - DNA, 35 bp, Artificial Sequence
  Synthetic oligonucleotide
ggaacgctctagcgcgaaaatctagccatcacacc

SEQ ID NO: 74036 - DNA, 35 bp, Artificial Sequence
  Synthetic oligonucleotide
tactgtcccacctccggccattgcgcccacagacc

SEQ ID NO: 74037 - DNA, 35 bp, Artificial Sequence
  Synthetic oligonucleotide
atggggcaaaccatccatctattcttgcagaaccc

SEQ ID NO: 74038 - DNA, 35 bp, Artificial Sequence
  Synthetic oligonucleotide
acctacctcatgttttaaagccccggctaggcccc

SEQ ID NO: 74039 - DNA, 35 bp, Artificial Sequence
  Synthetic oligonucleotide
tttgacacgcaactattcctcgattaaaccagccc

SEQ ID NO: 74040 - DNA, 35 bp, Artificial Sequence
  Synthetic oligonucleotide
tcctgagcatgatcacatacgcctaataaacgccc

SEQ ID NO: 74041 - DNA, 35 bp, Artificial Sequence
  Synthetic oligonucleotide
attcggacggtaccattcttgcgtacttatatccc

SEQ ID NO: 74042 - DNA, 35 bp, Artificial Sequence
  Synthetic oligonucleotide
gccaaagacagggggccatttcaccatcatttccc

SEQ ID NO: 74043 - DNA, 35 bp, Artificial Sequence
  Synthetic oligonucleotide
tgagtgggcgtcccccaacgtacggtccctctgcc

SEQ ID NO: 74044 - DNA, 35 bp, Artificial Sequence
  Synthetic oligonucleotide
accccaatccccctcctctgtgcaggtcctgtgcc

SEQ ID NO: 74045 - DNA, 36 bp, Artificial Sequence
  Synthetic oligonucleotide
atcacagcgccaaacatgcctacttccgtgccatcc

SEQ ID NO: 74046 - DNA, 35 bp, Artificial Sequence
  Synthetic oligonucleotide
gtgacccagggggagggggatcggccggtatttcc

SEQ ID NO: 74047 - DNA, 35 bp, Artificial Sequence
  Synthetic oligonucleotide
tgtcgggagtctcggtccggctccctccctcacgc

SEQ ID NO: 74048 - DNA, 35 bp, Artificial Sequence
  Synthetic oligonucleotide
acttacaggcgtctactacttccgccaattgttgc

SEQ ID NO: 74049 - DNA, 35 bp, Artificial Sequence
  Synthetic oligonucleotide
gttcacatcaaactccagaatgctaccaacccatc

SEQ ID NO: 74050 - DNA, 35 bp, Artificial Sequence
  Synthetic oligonucleotide
atggtcacttgccacaccagctatccgttgctatc

SEQ ID NO: 74051 - DNA, 35 bp, Artificial Sequence
  Synthetic oligonucleotide
tgtgcaccgtcgtcgcttccgctggtgtcaccctc

SEQ ID NO: 74052 - DNA, 35 bp, Artificial Sequence
  Synthetic oligonucleotide
tttacgatcacccgtataaaactgtatctgccctc

SEQ ID NO: 74053 - DNA, 35 bp, Artificial Sequence
  Synthetic oligonucleotide
agacaccctgcccgatttcctgctcccagccgctg

SEQ ID NO: 74054 - DNA, 35 bp, Artificial Sequence
  Synthetic oligonucleotide
tgacggaggataactgttggggtaccgaaggagtg

SEQ ID NO: 74055 - DNA, 35 bp, Artificial Sequence
  Synthetic oligonucleotide
ttgtggtgtgggggatagagtggagtttgcaggtg

SEQ ID NO: 74056 - DNA, 35 bp, Artificial Sequence
  Synthetic oligonucleotide
gacacgaaccgtgcgactcaattgaccgcactttg

SEQ ID NO: 74057 - DNA, 35 bp, Artificial Sequence
  Synthetic oligonucleotide
gaaggcacctccctttttcaacacatcagtgtttg

SEQ ID NO: 74058 - DNA, 35 bp, Artificial Sequence
  Synthetic oligonucleotide
gctcacagcgccctggtctttctttttgcattttg

SEQ ID NO: 74059 - DNA, 35 bp, Artificial Sequence
  Synthetic oligonucleotide
actcacactacccgtccgtttggttctgttttaat

SEQ ID NO: 74060 - DNA, 35 bp, Artificial Sequence
  Synthetic oligonucleotide
gaatcacgccgtacatctctattcatcgactgcat

SEQ ID NO: 74061 - DNA, 35 bp, Artificial Sequence
  Synthetic oligonucleotide
aacggatgggatggacataggttggtgggatggat

SEQ ID NO: 74062 - DNA, 35 bp, Artificial Sequence
  Synthetic oligonucleotide
tgtctacctcgcccaatactatcagacttgcttat

SEQ ID NO: 74063 - DNA, 35 bp, Artificial Sequence
  Synthetic oligonucleotide
gcacaccattttgttgtttccattaccagatgcct

SEQ ID NO: 74064 - DNA, 35 bp, Artificial Sequence
  Synthetic oligonucleotide
tcttcactctcgagatccggctcctcgcactgcct

SEQ ID NO: 74065 - DNA, 35 bp, Artificial Sequence
  Synthetic oligonucleotide
gatgtgctccctctttgatgaacaggctaacatct

SEQ ID NO: 74066 - DNA, 35 bp, Artificial Sequence
  Synthetic oligonucleotide
ttgcgaatcggacccctcgcgctatgttctcatct

SEQ ID NO: 74067 - DNA, 35 bp, Artificial Sequence
  Synthetic oligonucleotide
aacagcccgctccatcgacagttgccccatctcgt

SEQ ID NO: 74068 - DNA, 35 bp, Artificial Sequence
  Synthetic oligonucleotide
gcacgtgcaacttggggcatatttccaggccactt

SEQ ID NO: 74069 - DNA, 35 bp, Artificial Sequence
  Synthetic oligonucleotide
taccggggcgggtgggggctttcatgttttgcctt

SEQ ID NO: 74070 - DNA, 35 bp, Artificial Sequence
  Synthetic oligonucleotide
gtgagtaatgcggggggaagacgggaggcccaaaa

SEQ ID NO: 74071 - DNA, 36 bp, Artificial Sequence
  Synthetic oligonucleotide
gctaaggctgccccgcttccttcagtaccacacaaa

SEQ ID NO: 74072 - DNA, 36 bp, Artificial Sequence
  Synthetic oligonucleotide
atcgctgggcacaggagatcgagggatatgaggaaa

SEQ ID NO: 74073 - DNA, 35 bp, Artificial Sequence
  Synthetic oligonucleotide
gtcgtacgtcactcggtactagcccgtctctccaa

SEQ ID NO: 74074 - DNA, 35 bp, Artificial Sequence
  Synthetic oligonucleotide
aatacgcctgttggtcccttagcataccctccgaa

SEQ ID NO: 74075 - DNA, 35 bp, Artificial Sequence
  Synthetic oligonucleotide
aatgaaccggcttggtgtcatctcattttggcgaa

SEQ ID NO: 74076 - DNA, 36 bp, Artificial Sequence
  Synthetic oligonucleotide
gacgacgtgtagtaaggatctgcaggagggcgggaa

SEQ ID NO: 74077 - DNA, 36 bp, Artificial Sequence
  Synthetic oligonucleotide
tatcgggaaggaaggaaaacataggtcaactttgaa

SEQ ID NO: 74078 - DNA, 36 bp, Artificial Sequence
  Synthetic oligonucleotide
tgcaaaaacctgggctggacaacctacacgaactaa

SEQ ID NO: 74079 - DNA, 35 bp, Artificial Sequence
  Synthetic oligonucleotide
acccaggctccatgcaacgtcccctcaatccttaa

SEQ ID NO: 74080 - DNA, 36 bp, Artificial Sequence
  Synthetic oligonucleotide
gtaccgcagagagtacccctgtcatgtctgaaaaca

SEQ ID NO: 74081 - DNA, 35 bp, Artificial Sequence
  Synthetic oligonucleotide
tacaccaaggacggtcgggaggggggatacaaaca

SEQ ID NO: 74082 - DNA, 36 bp, Artificial Sequence
  Synthetic oligonucleotide
gaggtgccttcccttctgctcataaacgcgctgaca

SEQ ID NO: 74083 - DNA, 36 bp, Artificial Sequence
  Synthetic oligonucleotide
gtgactcctgctggaacgccttagaagcactaacca

SEQ ID NO: 74084 - DNA, 35 bp, Artificial Sequence
  Synthetic oligonucleotide
tcctgaacacgtatctgtcgtggactccttgccca

SEQ ID NO: 74085 - DNA, 36 bp, Artificial Sequence
  Synthetic oligonucleotide
attccggaatgccatgtccttcgctcgcctcatcca

SEQ ID NO: 74086 - DNA, 35 bp, Artificial Sequence
  Synthetic oligonucleotide
gagccactgcaaaacaaaaactatctcgacgcgca

SEQ ID NO: 74087 - DNA, 35 bp, Artificial Sequence
  Synthetic oligonucleotide
tagtggtggtggagtctagggtgatgttactggca

SEQ ID NO: 74088 - DNA, 35 bp, Artificial Sequence
  Synthetic oligonucleotide
ttgcgctggacgcccaaagcgcacttttaacctca

SEQ ID NO: 74089 - DNA, 37 bp, Artificial Sequence
  Synthetic oligonucleotide
ggacagaggagcgacagtacaagcggtaggtgaaaga

SEQ ID NO: 74090 - DNA, 37 bp, Artificial Sequence
  Synthetic oligonucleotide
ttccatgcgcccatccctgacgttgacccgtcacaga

SEQ ID NO: 74091 - DNA, 37 bp, Artificial Sequence
  Synthetic oligonucleotide
tacctggtccagaagagcgatagcatcagggaggaga

SEQ ID NO: 74092 - DNA, 37 bp, Artificial Sequence
  Synthetic oligonucleotide
acgcacatacctgcgctcttcctgcgcctctcgacga

SEQ ID NO: 74093 - DNA, 37 bp, Artificial Sequence
  Synthetic oligonucleotide
gagtgcgaggtaaagaagagtaccgagtgtggtacga

SEQ ID NO: 74094 - DNA, 36 bp, Artificial Sequence
  Synthetic oligonucleotide
aaccgacagtccgataacctatgcctctggagccga

SEQ ID NO: 74095 - DNA, 37 bp, Artificial Sequence
  Synthetic oligonucleotide
tcttgcccctggggtccactgccatcgtctccgccga

SEQ ID NO: 74096 - DNA, 37 bp, Artificial Sequence
  Synthetic oligonucleotide
tccattacgctggtcgtatgaacaccacccattccga

SEQ ID NO: 74097 - DNA, 35 bp, Artificial Sequence
  Synthetic oligonucleotide
attaggggagggggcacgagcacgagcaagatcga

SEQ ID NO: 74098 - DNA, 37 bp, Artificial Sequence
  Synthetic oligonucleotide
gtgtcatcagccttttctcagccaccgctttactcga

SEQ ID NO: 74099 - DNA, 37 bp, Artificial Sequence
  Synthetic oligonucleotide
agcggtggcgctcaccgacgcctttttacgccttcga

SEQ ID NO: 74100 - DNA, 37 bp, Artificial Sequence
  Synthetic oligonucleotide
ttgccgacacacacgagcttccctgaatggccttcga

SEQ ID NO: 74101 - DNA, 37 bp, Artificial Sequence
  Synthetic oligonucleotide
ggacgagttgcatctcattgttttctggatccttcga

SEQ ID NO: 74102 - DNA, 36 bp, Artificial Sequence
  Synthetic oligonucleotide
gcccctcccgagccctgcatcctgtttagagcagga

SEQ ID NO: 74103 - DNA, 37 bp, Artificial Sequence
  Synthetic oligonucleotide
gaaggggacggcggacggaaatacgtagcgttgagga

SEQ ID NO: 74104 - DNA, 37 bp, Artificial Sequence
  Synthetic oligonucleotide
gatccgaggggccggagggggattcaaggatgtagga

SEQ ID NO: 74105 - DNA, 37 bp, Artificial Sequence
  Synthetic oligonucleotide
aggtgcacgccacctagccttgttccatcctttagga

SEQ ID NO: 74106 - DNA, 37 bp, Artificial Sequence
  Synthetic oligonucleotide
tacttagtgggggagcggagggcctggcggggacgga

SEQ ID NO: 74107 - DNA, 37 bp, Artificial Sequence
  Synthetic oligonucleotide
gatccgcctagctcctgttccctcgattgcacgcgga

SEQ ID NO: 74108 - DNA, 37 bp, Artificial Sequence
  Synthetic oligonucleotide
atgcccactgccgttaacacctactcctcctcgcgga

SEQ ID NO: 74109 - DNA, 37 bp, Artificial Sequence
  Synthetic oligonucleotide
aacggggggttcgcacggactgagaatagggatcgga

SEQ ID NO: 74110 - DNA, 37 bp, Artificial Sequence
  Synthetic oligonucleotide
aaagacagacagactgacggggtgtggggggatcgga

SEQ ID NO: 74111 - DNA, 37 bp, Artificial Sequence
  Synthetic oligonucleotide
tgtttactcagccgcccatcttacccccagtatcgga

SEQ ID NO: 74112 - DNA, 35 bp, Artificial Sequence
  Synthetic oligonucleotide
tacagcatacacacgccaccattaaggttctcgga

SEQ ID NO: 74113 - DNA, 37 bp, Artificial Sequence
  Synthetic oligonucleotide
tcacggtaagtggacggtggagataacggctaaggga

SEQ ID NO: 74114 - DNA, 36 bp, Artificial Sequence
  Synthetic oligonucleotide
ttccagcctccacgcccgatccctagttaataggga

SEQ ID NO: 74115 - DNA, 37 bp, Artificial Sequence
  Synthetic oligonucleotide
gagtgagtgaagtggagtaggaccgataccacgggga

SEQ ID NO: 74116 - DNA, 37 bp, Artificial Sequence
  Synthetic oligonucleotide
ccggaatccggtcacgctgcccacatctgttctggga

SEQ ID NO: 74117 - DNA, 37 bp, Artificial Sequence
  Synthetic oligonucleotide
gaggggtaggacgactcaaacgatacttagggtggga

SEQ ID NO: 74118 - DNA, 37 bp, Artificial Sequence
  Synthetic oligonucleotide
gggggggtcggggtgatcatacactgaaggggttgga

SEQ ID NO: 74119 - DNA, 38 bp, Artificial Sequence
  Synthetic oligonucleotide
gtgggcctccatggcgttacctatccgtcttcccatga

SEQ ID NO: 74120 - DNA, 37 bp, Artificial Sequence
  Synthetic oligonucleotide
actgccatcggcccccgccctgatccctttgccatga

SEQ ID NO: 74121 - DNA, 38 bp, Artificial Sequence
  Synthetic oligonucleotide
actcagtacctatgccgcttgaacccgtttcttcatga

SEQ ID NO: 74122 - DNA, 38 bp, Artificial Sequence
  Synthetic oligonucleotide
tgcaacatccgctcagcgctcgccatccacctggatga

SEQ ID NO: 74123 - DNA, 38 bp, Artificial Sequence
  Synthetic oligonucleotide
aacaaatgcgttcccgttgccgtcgccgaatacactga

SEQ ID NO: 74124 - DNA, 35 bp, Artificial Sequence
  Synthetic oligonucleotide
gacccttctgatggtcccacattatcccgacctga

SEQ ID NO: 74125 - DNA, 38 bp, Artificial Sequence
  Synthetic oligonucleotide
gacttgaccgaggttcataccgataaacgcccccctga

SEQ ID NO: 74126 - DNA, 38 bp, Artificial Sequence
  Synthetic oligonucleotide
gaacgagtgggatgggtgggtggctgaatcagtcctga

SEQ ID NO: 74127 - DNA, 38 bp, Artificial Sequence
  Synthetic oligonucleotide
gaacaggcgcacaggtcgggaagctaggtagtatctga

SEQ ID NO: 74128 - DNA, 37 bp, Artificial Sequence
  Synthetic oligonucleotide
actaccgcgctatttctattccacgtaagtcctctga

SEQ ID NO: 74129 - DNA, 38 bp, Artificial Sequence
  Synthetic oligonucleotide
atgtcactcatctctgttttgctaccattcgcttctga

SEQ ID NO: 74130 - DNA, 37 bp, Artificial Sequence
  Synthetic oligonucleotide
atacgggagggggggtcatcgggtaatggagttctga

SEQ ID NO: 74131 - DNA, 38 bp, Artificial Sequence
  Synthetic oligonucleotide
gagggaaacgcggggtgcaaagaagaaaaggtgagtga

SEQ ID NO: 74132 - DNA, 37 bp, Artificial Sequence
  Synthetic oligonucleotide
gacgcacgaagagaatggaagttcgggagtaaggtga

SEQ ID NO: 74133 - DNA, 38 bp, Artificial Sequence
  Synthetic oligonucleotide
gtacgctcagaagctacacatacattttcctccggtga

SEQ ID NO: 74134 - DNA, 38 bp, Artificial Sequence
  Synthetic oligonucleotide
atgccgtctagaggaaaggaacaagtggcgggtggtga

SEQ ID NO: 74135 - DNA, 37 bp, Artificial Sequence
  Synthetic oligonucleotide
agtgatgacgcggcctgcccccctcctgtccctgtga

SEQ ID NO: 74136 - DNA, 38 bp, Artificial Sequence
  Synthetic oligonucleotide
gaatagggcggtagtagaagggggggaaactagattga

SEQ ID NO: 74137 - DNA, 38 bp, Artificial Sequence
  Synthetic oligonucleotide
attgtagcattgcaccgatcgtacccgactccccttga

SEQ ID NO: 74138 - DNA, 37 bp, Artificial Sequence
  Synthetic oligonucleotide
aagttgggtggaagggaatttaagtgaggacggttga

SEQ ID NO: 74139 - DNA, 37 bp, Artificial Sequence
  Synthetic oligonucleotide
acatcgggcgccactcaccacttagcgcaactgttga

SEQ ID NO: 74140 - DNA, 36 bp, Artificial Sequence
  Synthetic oligonucleotide
gtgaggatggagaagggctgaatggaactgacaata

SEQ ID NO: 74141 - DNA, 36 bp, Artificial Sequence
  Synthetic oligonucleotide
gtgtcatccccggagcccgtgctgtaccctccgata

SEQ ID NO: 74142 - DNA, 36 bp, Artificial Sequence
  Synthetic oligonucleotide
aacccgaactactgactcaccaaagctgacgctata

SEQ ID NO: 74143 - DNA, 35 bp, Artificial Sequence
  Synthetic oligonucleotide
gtccacattcatgctgaccttgggtctctacacta

SEQ ID NO: 74144 - DNA, 35 bp, Artificial Sequence
  Synthetic oligonucleotide
tggacacccacaccctggaatcgtatgcactgcta

SEQ ID NO: 74145 - DNA, 36 bp, Artificial Sequence
  Synthetic oligonucleotide
ggagttccaccatggctccggatcatttcgcttgta

SEQ ID NO: 74146 - DNA, 36 bp, Artificial Sequence
  Synthetic oligonucleotide
aacagggcggggggaagttgcagtcaagtacggtta

SEQ ID NO: 74147 - DNA, 35 bp, Artificial Sequence
  Synthetic oligonucleotide
acagcctccgaacttgccacatgcaccgttctaac

SEQ ID NO: 74148 - DNA, 35 bp, Artificial Sequence
  Synthetic oligonucleotide
tgcaaactgaccgttgatttaattgggttcttcac

SEQ ID NO: 74149 - DNA, 35 bp, Artificial Sequence
  Synthetic oligonucleotide
ttaacctcagtcacatctttcgcaacactgtcgac

SEQ ID NO: 74150 - DNA, 35 bp, Artificial Sequence
  Synthetic oligonucleotide
acattctcaagtgtccttgtaccgttgggccctac

SEQ ID NO: 74151 - DNA, 35 bp, Artificial Sequence
  Synthetic oligonucleotide
ttgtaagatcctgaggtccttatctagccccttac

SEQ ID NO: 74152 - DNA, 35 bp, Artificial Sequence
  Synthetic oligonucleotide
tttgtcaggcaaatcccgcccccgtcacttggacc

SEQ ID NO: 74153 - DNA, 35 bp, Artificial Sequence
  Synthetic oligonucleotide
ttgaccgcttcatgctgtccccacccagtttaccc

SEQ ID NO: 74154 - DNA, 35 bp, Artificial Sequence
  Synthetic oligonucleotide
gcgacctgaccctgattccgtgatgttgtctgccc

SEQ ID NO: 74155 - DNA, 35 bp, Artificial Sequence
  Synthetic oligonucleotide
tgtgtgccctcgtctatgaccaccaattgcaggcc

SEQ ID NO: 74156 - DNA, 35 bp, Artificial Sequence
  Synthetic oligonucleotide
tcgtaatgcagtgacagcatggaacttcaacggcc

SEQ ID NO: 74157 - DNA, 35 bp, Artificial Sequence
  Synthetic oligonucleotide
ttccccgaacatgtctactaacgacatggactgcc

SEQ ID NO: 74158 - DNA, 35 bp, Artificial Sequence
  Synthetic oligonucleotide
agcgaccggaggtactcgccgccactgactattcc

SEQ ID NO: 74159 - DNA, 35 bp, Artificial Sequence
  Synthetic oligonucleotide
acatcaaccacatcattgcggatccgagaaaacgc

SEQ ID NO: 74160 - DNA, 35 bp, Artificial Sequence
  Synthetic oligonucleotide
gcaaatcccttcattctggatccacgcatgtatgc

SEQ ID NO: 74161 - DNA, 35 bp, Artificial Sequence
  Synthetic oligonucleotide
ttcacaacgtgaacgtgcccttcttaatttattgc

SEQ ID NO: 74162 - DNA, 35 bp, Artificial Sequence
  Synthetic oligonucleotide
ttcgtgtcgcattgctacggaagtctcttttttgc

SEQ ID NO: 74163 - DNA, 35 bp, Artificial Sequence
  Synthetic oligonucleotide
atcctgcgtggacatttttaagtctctctgcactc

SEQ ID NO: 74164 - DNA, 35 bp, Artificial Sequence
  Synthetic oligonucleotide
tgaacatgcggctgggctacgtcgccccattcctc

SEQ ID NO: 74165 - DNA, 34 bp, Artificial Sequence
  Synthetic oligonucleotide
taaatgccctgtccccagttggcggtcttcgctc

SEQ ID NO: 74166 - DNA, 35 bp, Artificial Sequence
  Synthetic oligonucleotide
tcatgctcaacattgcgcgtaacattgtactgctc

SEQ ID NO: 74167 - DNA, 35 bp, Artificial Sequence
  Synthetic oligonucleotide
gacgtaaacatagctctcttagaatctggcatctc

SEQ ID NO: 74168 - DNA, 35 bp, Artificial Sequence
  Synthetic oligonucleotide
aagtccacctctgtcgggaaccattcaaatcagtc

SEQ ID NO: 74169 - DNA, 35 bp, Artificial Sequence
  Synthetic oligonucleotide
gatgcaagagggggatagagatgtcactaggagtc

SEQ ID NO: 74170 - DNA, 35 bp, Artificial Sequence
  Synthetic oligonucleotide
tatgtcgcctacattgattttgctacctaacggtc

SEQ ID NO: 74171 - DNA, 35 bp, Artificial Sequence
  Synthetic oligonucleotide
tacagtgcttctgtgcagcgcgacgtcgtttcttc

SEQ ID NO: 74172 - DNA, 35 bp, Artificial Sequence
  Synthetic oligonucleotide
gatgctgactcccgcgccgtcgatacaccgcccag

SEQ ID NO: 74173 - DNA, 35 bp, Artificial Sequence
  Synthetic oligonucleotide
atgtaccccctcaccagtgtatagtcttactgcag

SEQ ID NO: 74174 - DNA, 35 bp, Artificial Sequence
  Synthetic oligonucleotide
gaacgccggctccagtgcctttgaatccccatacg

SEQ ID NO: 74175 - DNA, 35 bp, Artificial Sequence
  Synthetic oligonucleotide
tgcactctcccgctcacgcgcgtacctgctctacg

SEQ ID NO: 74176 - DNA, 35 bp, Artificial Sequence
  Synthetic oligonucleotide
atgaaacatccccgcaccgggtccttgccctgccg

SEQ ID NO: 74177 - DNA, 35 bp, Artificial Sequence
  Synthetic oligonucleotide
ttgccgaacaaattgtacttactttgcctacctcg

SEQ ID NO: 74178 - DNA, 35 bp, Artificial Sequence
  Synthetic oligonucleotide
aggtatggagtgggaagaagggcgggtgtctaagg

SEQ ID NO: 74179 - DNA, 35 bp, Artificial Sequence
  Synthetic oligonucleotide
ttggtcggtgtactgggtctaggggttaactgtgg

SEQ ID NO: 74180 - DNA, 35 bp, Artificial Sequence
  Synthetic oligonucleotide
gcactaaacgccactaactcacacccaagtgtatg

SEQ ID NO: 74181 - DNA, 35 bp, Artificial Sequence
  Synthetic oligonucleotide
ccaatcgccctcgcacttcactacgcctgatcctg

SEQ ID NO: 74182 - DNA, 35 bp, Artificial Sequence
  Synthetic oligonucleotide
gactatgtagacgggatggaaatgagtgggtggtg

SEQ ID NO: 74183 - DNA, 35 bp, Artificial Sequence
  Synthetic oligonucleotide
gctagggtcggatcgtcccctgtctcgcctttttg

SEQ ID NO: 74184 - DNA, 35 bp, Artificial Sequence
  Synthetic oligonucleotide
tgagcccctcaacccaagccgcctttggcctcaat

SEQ ID NO: 74185 - DNA, 35 bp, Artificial Sequence
  Synthetic oligonucleotide
tgctaatacgctcatcgcaccacccgccgtatcat

SEQ ID NO: 74186 - DNA, 35 bp, Artificial Sequence
  Synthetic oligonucleotide
gctgctcctgccatgactagcccaagtgcaccgat

SEQ ID NO: 74187 - DNA, 35 bp, Artificial Sequence
  Synthetic oligonucleotide
atcctacactcgcaaacagttatctagccggatat

SEQ ID NO: 74188 - DNA, 35 bp, Artificial Sequence
  Synthetic oligonucleotide
gtgtgggtttgcccgcgctgttagccttcacctat

SEQ ID NO: 74189 - DNA, 36 bp, Artificial Sequence
  Synthetic oligonucleotide
gacgcccaggccttctacttctcccgtcgcggctat

SEQ ID NO: 74190 - DNA, 35 bp, Artificial Sequence
  Synthetic oligonucleotide
atctcgaaggtgccggtgtctctttgcgctgccct

SEQ ID NO: 74191 - DNA, 35 bp, Artificial Sequence
  Synthetic oligonucleotide
tcaccgaccacgggattctctgcggcccacacgct

SEQ ID NO: 74192 - DNA, 35 bp, Artificial Sequence
  Synthetic oligonucleotide
tcgaacgagtgttcggccgcccattcaatcccgct

SEQ ID NO: 74193 - DNA, 35 bp, Artificial Sequence
  Synthetic oligonucleotide
atcgtgcgcaaacacagccgttctctttccatgct

SEQ ID NO: 74194 - DNA, 35 bp, Artificial Sequence
  Synthetic oligonucleotide
gggtccgaaagggggtgcggagaggggctttgggt

SEQ ID NO: 74195 - DNA, 35 bp, Artificial Sequence
  Synthetic oligonucleotide
atttccggcccttacaccgcggtcacactttgctt

SEQ ID NO: 74196 - DNA, 36 bp, Artificial Sequence
  Synthetic oligonucleotide
gtaccggccctaagcgccctgcaccttctctgtaaa

SEQ ID NO: 74197 - DNA, 35 bp, Artificial Sequence
  Synthetic oligonucleotide
gacctgcactcacctactagttttccgcgcatcaa

SEQ ID NO: 74198 - DNA, 36 bp, Artificial Sequence
  Synthetic oligonucleotide
ttgtagcgctactgctttcgggggtcctcctatcaa

SEQ ID NO: 74199 - DNA, 35 bp, Artificial Sequence
  Synthetic oligonucleotide
tgctccacgtccggctctcatatattgcatctcaa

SEQ ID NO: 74200 - DNA, 36 bp, Artificial Sequence
  Synthetic oligonucleotide
gaggggggatgtaacatgggattatgaggtttcgaa

SEQ ID NO: 74201 - DNA, 36 bp, Artificial Sequence
  Synthetic oligonucleotide
actcaatcgagctactggtctatacactgcactgaa

SEQ ID NO: 74202 - DNA, 35 bp, Artificial Sequence
  Synthetic oligonucleotide
gattggaacacctcatcttgggtctccctgaccca

SEQ ID NO: 74203 - DNA, 36 bp, Artificial Sequence
  Synthetic oligonucleotide
acacaacctgtctacttcaatagcgtggacgcccca

SEQ ID NO: 74204 - DNA, 35 bp, Artificial Sequence
  Synthetic oligonucleotide
gccacccgaccgttattatcccatacatggtgcca

SEQ ID NO: 74205 - DNA, 36 bp, Artificial Sequence
  Synthetic oligonucleotide
gcgcacctcctccatatgctttgatagcgtgtgcca

SEQ ID NO: 74206 - DNA, 36 bp, Artificial Sequence
  Synthetic oligonucleotide
tcatcacctcgaaatcttcttactacgtgtattcca

SEQ ID NO: 74207 - DNA, 36 bp, Artificial Sequence
  Synthetic oligonucleotide
tacccgcccccgagcggacgcttgctcctattcgca

SEQ ID NO: 74208 - DNA, 37 bp, Artificial Sequence
  Synthetic oligonucleotide
agtgatagagagcggaaataaggccgagggtgagaga

SEQ ID NO: 74209 - DNA, 36 bp, Artificial Sequence
  Synthetic oligonucleotide
tcacaggggtgtagcaagtgcaaaaaggggccgaga

SEQ ID NO: 74210 - DNA, 37 bp, Artificial Sequence
  Synthetic oligonucleotide
gcaataagcacggggattgaaaggcggaggattgaga

SEQ ID NO: 74211 - DNA, 37 bp, Artificial Sequence
  Synthetic oligonucleotide
tccccgcaccttttggtctgaaagattaccgacccga

SEQ ID NO: 74212 - DNA, 37 bp, Artificial Sequence
  Synthetic oligonucleotide
ggtcacgtttggtccatcctccctgttcctcgcccga

SEQ ID NO: 74213 - DNA, 37 bp, Artificial Sequence
  Synthetic oligonucleotide
gagcgcaacaatcacagcaatatttgaggacctccga

SEQ ID NO: 74214 - DNA, 37 bp, Artificial Sequence
  Synthetic oligonucleotide
gacatccagcgcttgccgcaaccaccctgaattccga

SEQ ID NO: 74215 - DNA, 37 bp, Artificial Sequence
  Synthetic oligonucleotide
tcctgtgcgcgctgtggtttgtgtttctctccttcga

SEQ ID NO: 74216 - DNA, 36 bp, Artificial Sequence
  Synthetic oligonucleotide
tgtataacagcccactccaccttttcttgcgttcga

SEQ ID NO: 74217 - DNA, 37 bp, Artificial Sequence
  Synthetic oligonucleotide
tcaccccggcccttggttaatcacccacatgtgagga

SEQ ID NO: 74218 - DNA, 37 bp, Artificial Sequence
  Synthetic oligonucleotide
atgcgcaagcttactatcatgcagtagtcctcacgga

SEQ ID NO: 74219 - DNA, 37 bp, Artificial Sequence
  Synthetic oligonucleotide
gagggaaagggacccgcggtgtgggggaggtgtcgga

SEQ ID NO: 74220 - DNA, 37 bp, Artificial Sequence
  Synthetic oligonucleotide
gtcactgccttttccgacgctttctacccctcaggga

SEQ ID NO: 74221 - DNA, 37 bp, Artificial Sequence
  Synthetic oligonucleotide
tatcaccgagggacaggacgggagttagatagaggga

SEQ ID NO: 74222 - DNA, 38 bp, Artificial Sequence
  Synthetic oligonucleotide
tagggacagggccagttgcgatgcattttgggtgggga

SEQ ID NO: 74223 - DNA, 37 bp, Artificial Sequence
  Synthetic oligonucleotide
gcgaacgccataacgtatgcaaggatgtgccatggga

SEQ ID NO: 74224 - DNA, 37 bp, Artificial Sequence
  Synthetic oligonucleotide
gaccacatcagaccgctccccaagtagctccaatgga

SEQ ID NO: 74225 - DNA, 37 bp, Artificial Sequence
  Synthetic oligonucleotide
tccgctccaccctggagcgttgacctttttcactgga

SEQ ID NO: 74226 - DNA, 37 bp, Artificial Sequence
  Synthetic oligonucleotide
ttaccactgatctgctttagcgctgtaccgagctgga

SEQ ID NO: 74227 - DNA, 37 bp, Artificial Sequence
  Synthetic oligonucleotide
tgcgatggggaggaaggggtctcagggcccatgtgga

SEQ ID NO: 74228 - DNA, 38 bp, Artificial Sequence
  Synthetic oligonucleotide
accaccctgccaccgacgggaacactcttaacaaatga

SEQ ID NO: 74229 - DNA, 38 bp, Artificial Sequence
  Synthetic oligonucleotide
aagacgacaaaggggggagaagtgcagagataacatga

SEQ ID NO: 74230 - DNA, 38 bp, Artificial Sequence
  Synthetic oligonucleotide
aacgcggccctctaacggcgccaagtaccctcccatga

SEQ ID NO: 74231 - DNA, 38 bp, Artificial Sequence
  Synthetic oligonucleotide
tgcacgctcgtcagatcctttccgccggaccatcatga

SEQ ID NO: 74232 - DNA, 38 bp, Artificial Sequence
  Synthetic oligonucleotide
accaaccgagcaagggggaatcgggctgtaggggatga

SEQ ID NO: 74233 - DNA, 38 bp, Artificial Sequence
  Synthetic oligonucleotide
gctcgctccaggagcacgtgaattgagtcccatgatga

SEQ ID NO: 74234 - DNA, 38 bp, Artificial Sequence
  Synthetic oligonucleotide
acttgaaggtggtggtaaagggggaggtaggttgatga

SEQ ID NO: 74235 - DNA, 38 bp, Artificial Sequence
  Synthetic oligonucleotide
gcacaccctactgattgctttgtcgtttccggcactga

SEQ ID NO: 74236 - DNA, 38 bp, Artificial Sequence
  Synthetic oligonucleotide
tgctgacgctcgaccttcgttaaattgcatcttcctga

SEQ ID NO: 74237 - DNA, 38 bp, Artificial Sequence
  Synthetic oligonucleotide
acatcgccctcgccactgattcgacgcaatttcgctga

SEQ ID NO: 74238 - DNA, 37 bp, Artificial Sequence
  Synthetic oligonucleotide
tacttgctgcccctccgctttgtgtatacacggctga

SEQ ID NO: 74239 - DNA, 38 bp, Artificial Sequence
  Synthetic oligonucleotide
gcacgcctgtgaaagtgcaatacctcccacactgctga

SEQ ID NO: 74240 - DNA, 38 bp, Artificial Sequence
  Synthetic oligonucleotide
aatcgaaagggctgcagggttgtagcacgggagggtga

SEQ ID NO: 74241 - DNA, 37 bp, Artificial Sequence
  Synthetic oligonucleotide
ggaggtgctcaaaacggatgggggtggctcatggtga

SEQ ID NO: 74242 - DNA, 38 bp, Artificial Sequence
  Synthetic oligonucleotide
ttggcccagtatcctccagcagcctatccactctgtga

SEQ ID NO: 74243 - DNA, 38 bp, Artificial Sequence
  Synthetic oligonucleotide
tcagtacaaccgaggaggtaaggtcacaggcattgtga

SEQ ID NO: 74244 - DNA, 36 bp, Artificial Sequence
  Synthetic oligonucleotide
accccctagccctgaatgagcccagcttgaccttga

SEQ ID NO: 74245 - DNA, 38 bp, Artificial Sequence
  Synthetic oligonucleotide
ggtgccacggtgatctaactacgctgcctatctcttga

SEQ ID NO: 74246 - DNA, 36 bp, Artificial Sequence
  Synthetic oligonucleotide
gactatgcacggggcggtgataaatgctggggttga

SEQ ID NO: 74247 - DNA, 36 bp, Artificial Sequence
  Synthetic oligonucleotide
agataggtacgaggaaggaaattaaggttgggttga

SEQ ID NO: 74248 - DNA, 37 bp, Artificial Sequence
  Synthetic oligonucleotide
aacggatcgccgcccgtatgccctatggcctggttga

SEQ ID NO: 74249 - DNA, 36 bp, Artificial Sequence
  Synthetic oligonucleotide
gtcgaccccccgcctcgcccgacacgttcgcgtata

SEQ ID NO: 74250 - DNA, 36 bp, Artificial Sequence
  Synthetic oligonucleotide
atggggaatagatcaggaagggcggggtggtaggta

SEQ ID NO: 74251 - DNA, 36 bp, Artificial Sequence
  Synthetic oligonucleotide
gctacgtcggccggggaaccccctttcctttctgta

SEQ ID NO: 74252 - DNA, 36 bp, Artificial Sequence
  Synthetic oligonucleotide
gccatctgcctaatcctatattgcccgttacgtgta

SEQ ID NO: 74253 - DNA, 35 bp, Artificial Sequence
  Synthetic oligonucleotide
tccaaaccgcactaacgcacaatactgaaggatta

SEQ ID NO: 74254 - DNA, 36 bp, Artificial Sequence
  Synthetic oligonucleotide
taacactagcctcccatcagccttcgtgttgcctta

SEQ ID NO: 74255 - DNA, 35 bp, Artificial Sequence
  Synthetic oligonucleotide
tcacgacatctcgccggattcccttctcgataaac

SEQ ID NO: 74256 - DNA, 35 bp, Artificial Sequence
  Synthetic oligonucleotide
ggtaccacggggcatagaccacacatacgattaac

SEQ ID NO: 74257 - DNA, 35 bp, Artificial Sequence
  Synthetic oligonucleotide
tgcaggccgtcacttacaatcgtgcccatatccac

SEQ ID NO: 74258 - DNA, 35 bp, Artificial Sequence
  Synthetic oligonucleotide
tcagccgcttgatccttgcgatccgggcttgctac

SEQ ID NO: 74259 - DNA, 35 bp, Artificial Sequence
  Synthetic oligonucleotide
tagacaacgaactccgcccgcactatgatacgacc

SEQ ID NO: 74260 - DNA, 35 bp, Artificial Sequence
  Synthetic oligonucleotide
ttccccgtcccgcgtagaatccatttggcgacccc

SEQ ID NO: 74261 - DNA, 35 bp, Artificial Sequence
  Synthetic oligonucleotide
agcattagccgaatctaacttttcaggtgcctccc

SEQ ID NO: 74262 - DNA, 35 bp, Artificial Sequence
  Synthetic oligonucleotide
aacacctggatggttggatcgtttcgtctatatcc

SEQ ID NO: 74263 - DNA, 35 bp, Artificial Sequence
  Synthetic oligonucleotide
ctgcaatgcctatcttcagcgtccataacacttcc

SEQ ID NO: 74264 - DNA, 35 bp, Artificial Sequence
  Synthetic oligonucleotide
tgacgccactcatttaccttcttggcctgtacagc

SEQ ID NO: 74265 - DNA, 35 bp, Artificial Sequence
  Synthetic oligonucleotide
gtgccaaccctcgctaaatgaatcgtggctcacgc

SEQ ID NO: 74266 - DNA, 35 bp, Artificial Sequence
  Synthetic oligonucleotide
tgggatcagatgtccaaccgtactcctcttctcgc

SEQ ID NO: 74267 - DNA, 35 bp, Artificial Sequence
  Synthetic oligonucleotide
ggggggtggtaggagggcaagagtggtaaggaggc

SEQ ID NO: 74268 - DNA, 35 bp, Artificial Sequence
  Synthetic oligonucleotide
tagtaacacacgccccttcgccaatcacgcacggc

SEQ ID NO: 74269 - DNA, 35 bp, Artificial Sequence
  Synthetic oligonucleotide
aatgggcgcagtaggaccattaatcattgctctgc

SEQ ID NO: 74270 - DNA, 35 bp, Artificial Sequence
  Synthetic oligonucleotide
ggagactccgcggtgctacttgctccttttgcctc

SEQ ID NO: 74271 - DNA, 35 bp, Artificial Sequence
  Synthetic oligonucleotide
tctccgccaccattgtaggaatacaccccactctc

SEQ ID NO: 74272 - DNA, 34 bp, Artificial Sequence
  Synthetic oligonucleotide
gctctcccgccacagataccaagccaacgctctc

SEQ ID NO: 74273 - DNA, 35 bp, Artificial Sequence
  Synthetic oligonucleotide
tgagacgccgcacgctcgccttgcccttccctgtc

SEQ ID NO: 74274 - DNA, 35 bp, Artificial Sequence
  Synthetic oligonucleotide
accataggtccgccctgttggttacaattaacttc

SEQ ID NO: 74275 - DNA, 35 bp, Artificial Sequence
  Synthetic oligonucleotide
tagtcaagcctcgcctgaatccgactcccttgttc

SEQ ID NO: 74276 - DNA, 35 bp, Artificial Sequence
  Synthetic oligonucleotide
atgcgtggtgcctcgcccagttcctgtttgcctag

SEQ ID NO: 74277 - DNA, 35 bp, Artificial Sequence
  Synthetic oligonucleotide
atatgcacatcaccctggtaccttgacaaatgacg

SEQ ID NO: 74278 - DNA, 32 bp, Artificial Sequence
  Synthetic oligonucleotide
tgattcagtccttttcttcgtgccccaccgcg

SEQ ID NO: 74279 - DNA, 35 bp, Artificial Sequence
  Synthetic oligonucleotide
ggagagaggagattattggacagaaaggagtgtcg

SEQ ID NO: 74280 - DNA, 35 bp, Artificial Sequence
  Synthetic oligonucleotide
acaggacatgagggcaaggtgcttaaatcaaaagg

SEQ ID NO: 74281 - DNA, 35 bp, Artificial Sequence
  Synthetic oligonucleotide
accccggaggtagagggccctgtgacgcaccccgg

SEQ ID NO: 74282 - DNA, 35 bp, Artificial Sequence
  Synthetic oligonucleotide
taccgcacaccgctccgagctgattaatctcccgg

SEQ ID NO: 74283 - DNA, 35 bp, Artificial Sequence
  Synthetic oligonucleotide
gcatagggagccaagggagggttaagcgtttcggg

SEQ ID NO: 74284 - DNA, 35 bp, Artificial Sequence
  Synthetic oligonucleotide
tgccactcgaactgccatgcccacgccctgtactg

SEQ ID NO: 74285 - DNA, 35 bp, Artificial Sequence
  Synthetic oligonucleotide
gttcgcccaagttcgcaagttgtactacctctgtg

SEQ ID NO: 74286 - DNA, 35 bp, Artificial Sequence
  Synthetic oligonucleotide
ggcggaacgctaatcctgtactcctgctgtccttg

SEQ ID NO: 74287 - DNA, 35 bp, Artificial Sequence
  Synthetic oligonucleotide
gaacagccaaccctgtatacctattgttcggtact

SEQ ID NO: 74288 - DNA, 35 bp, Artificial Sequence
  Synthetic oligonucleotide
tccatgaccctgccatcacagcgcatcggtatcct

SEQ ID NO: 74289 - DNA, 35 bp, Artificial Sequence
  Synthetic oligonucleotide
ttacctgtcccagccgatgctggcttgccgctcct

SEQ ID NO: 74290 - DNA, 36 bp, Artificial Sequence
  Synthetic oligonucleotide
tttcacacagttgttacttcgcttgtgtcccgtcct

SEQ ID NO: 74291 - DNA, 35 bp, Artificial Sequence
  Synthetic oligonucleotide
ttccatgccattctatattggtccgcacccttgct

SEQ ID NO: 74292 - DNA, 35 bp, Artificial Sequence
  Synthetic oligonucleotide
gcgctcacctctcttaatgttccagagtccttgct

SEQ ID NO: 74293 - DNA, 35 bp, Artificial Sequence
  Synthetic oligonucleotide
gtgcgctgttccatcctgtctttcacactcttcgt

SEQ ID NO: 74294 - DNA, 35 bp, Artificial Sequence
  Synthetic oligonucleotide
ttcggtgactgtcgctcctggtcgttctcattggt

SEQ ID NO: 74295 - DNA, 35 bp, Artificial Sequence
  Synthetic oligonucleotide
atccgctcccaagacgctcctacgtcattgcaatt

SEQ ID NO: 74296 - DNA, 35 bp, Artificial Sequence
  Synthetic oligonucleotide
gacgtacgaaccaggtaccaatactccgccgaatt

SEQ ID NO: 74297 - DNA, 35 bp, Artificial Sequence
  Synthetic oligonucleotide
acacgcataacttggtagggccaaacacatatctt

SEQ ID NO: 74298 - DNA, 35 bp, Artificial Sequence
  Synthetic oligonucleotide
acttccgaccgcgaggaggtagagggtgggcggtt

SEQ ID NO: 74299 - DNA, 35 bp, Artificial Sequence
  Synthetic oligonucleotide
gccccagtactggttccccggttcttagacctgtt

SEQ ID NO: 74300 - DNA, 35 bp, Artificial Sequence
  Synthetic oligonucleotide
tggtggaacgccgttttctacctcatggcctattt

SEQ ID NO: 74301 - DNA, 36 bp, Artificial Sequence
  Synthetic oligonucleotide
agcatccacctatttggtacggccccctattgcaaa

SEQ ID NO: 74302 - DNA, 36 bp, Artificial Sequence
  Synthetic oligonucleotide
tcgcggtggccgcacgcttacacgcaacacatgaaa

SEQ ID NO: 74303 - DNA, 35 bp, Artificial Sequence
  Synthetic oligonucleotide
gaccgcaccctctacccccggcgcaggttgcacaa

SEQ ID NO: 74304 - DNA, 35 bp, Artificial Sequence
  Synthetic oligonucleotide
tcaacgcagtgcaaataacgtggtgaattgctcaa

SEQ ID NO: 74305 - DNA, 36 bp, Artificial Sequence
  Synthetic oligonucleotide
aagaaggggattaggcgtggaaaggcttgtagggaa

SEQ ID NO: 74306 - DNA, 36 bp, Artificial Sequence
  Synthetic oligonucleotide
gagattcgggtgaagtaggataaaggtgaaggggaa

SEQ ID NO: 74307 - DNA, 36 bp, Artificial Sequence
  Synthetic oligonucleotide
gactcaccacgccaccgatcgtcctctatatgggaa

SEQ ID NO: 74308 - DNA, 36 bp, Artificial Sequence
  Synthetic oligonucleotide
gcccgcctctgatccgttcttgcgcagatgattgaa

SEQ ID NO: 74309 - DNA, 36 bp, Artificial Sequence
  Synthetic oligonucleotide
aaccgacgggggagggtggctcgggagtacgtaaca

SEQ ID NO: 74310 - DNA, 36 bp, Artificial Sequence
  Synthetic oligonucleotide
acttctcaccgcccgctagtactccttttagcgaca

SEQ ID NO: 74311 - DNA, 36 bp, Artificial Sequence
  Synthetic oligonucleotide
tcaccatcctagttctgggcgcctacatttgttgca

SEQ ID NO: 74312 - DNA, 36 bp, Artificial Sequence
  Synthetic oligonucleotide
gatacactccaccagctcggctccaccagtgcatca

SEQ ID NO: 74313 - DNA, 35 bp, Artificial Sequence
  Synthetic oligonucleotide
gttcgagcgacgggtacgcttattcttccacctca

SEQ ID NO: 74314 - DNA, 34 bp, Artificial Sequence
  Synthetic oligonucleotide
tgcgacgatccgtttccgtggcctcctttcctca

SEQ ID NO: 74315 - DNA, 36 bp, Artificial Sequence
  Synthetic oligonucleotide
tcacaatcactgtcgcgttaacctttcctttcgtca

SEQ ID NO: 74316 - DNA, 36 bp, Artificial Sequence
  Synthetic oligonucleotide
ttcccgctctgcagtcgtcgttcatttcggtcttca

SEQ ID NO: 74317 - DNA, 36 bp, Artificial Sequence
  Synthetic oligonucleotide
gtcgacgttcattggtcctcttttttgaagctttca

SEQ ID NO: 74318 - DNA, 37 bp, Artificial Sequence
  Synthetic oligonucleotide
ttgacagggtcagtccagagtaggaggagagtgaaga

SEQ ID NO: 74319 - DNA, 37 bp, Artificial Sequence
  Synthetic oligonucleotide
gtccgtgtccagggcatcaagccgctcctccccgaga

SEQ ID NO: 74320 - DNA, 37 bp, Artificial Sequence
  Synthetic oligonucleotide
acacgcacaacgaacggtcggaggactgtgcgggaga

SEQ ID NO: 74321 - DNA, 37 bp, Artificial Sequence
  Synthetic oligonucleotide
tagcgggggagtagggggaggccacttcaagtggaga

SEQ ID NO: 74322 - DNA, 37 bp, Artificial Sequence
  Synthetic oligonucleotide
tcaaaaggtgggggcggtatccggatcaacgatgaga

SEQ ID NO: 74323 - DNA, 37 bp, Artificial Sequence
  Synthetic oligonucleotide
tgtggggccctctactcctatatgttcctgatctaga

SEQ ID NO: 74324 - DNA, 37 bp, Artificial Sequence
  Synthetic oligonucleotide
tagtgcgtagcgggaggagatagttgaagcatgtaga

SEQ ID NO: 74325 - DNA, 37 bp, Artificial Sequence
  Synthetic oligonucleotide
ggagagtgggaaacaggtactatggaggcagggacga

SEQ ID NO: 74326 - DNA, 37 bp, Artificial Sequence
  Synthetic oligonucleotide
caacacgtgcacgcaaatccactgaaacaccgtacga

SEQ ID NO: 74327 - DNA, 36 bp, Artificial Sequence
  Synthetic oligonucleotide
gagtgatgcccgtttcctattgtgtcgttccaccga

SEQ ID NO: 74328 - DNA, 37 bp, Artificial Sequence
  Synthetic oligonucleotide
ttcacggcggactctgtaccgtcaacagcccccccga

SEQ ID NO: 74329 - DNA, 37 bp, Artificial Sequence
  Synthetic oligonucleotide
taagaccactccaatccgtgtattcgctaccctccga

SEQ ID NO: 74330 - DNA, 37 bp, Artificial Sequence
  Synthetic oligonucleotide
gtaacgcccaaagtgaattaggggggaagggaagcga

SEQ ID NO: 74331 - DNA, 37 bp, Artificial Sequence
  Synthetic oligonucleotide
gccgtcggtggagataagtgatggagggggggggcga

SEQ ID NO: 74332 - DNA, 36 bp, Artificial Sequence
  Synthetic oligonucleotide
gacagtctggatctcctgccctccgtccacgtgcga

SEQ ID NO: 74333 - DNA, 36 bp, Artificial Sequence
  Synthetic oligonucleotide
aatagagaggaggagaggcggactcggatgacagga

SEQ ID NO: 74334 - DNA, 37 bp, Artificial Sequence
  Synthetic oligonucleotide
gcgtaggcctcactactcttcccggccctttatagga

SEQ ID NO: 74335 - DNA, 37 bp, Artificial Sequence
  Synthetic oligonucleotide
gcgaatagagaggaaggtggatgaggggcataacgga

SEQ ID NO: 74336 - DNA, 37 bp, Artificial Sequence
  Synthetic oligonucleotide
ggaagatggacgaacgggggacggtgcagtagacgga

SEQ ID NO: 74337 - DNA, 37 bp, Artificial Sequence
  Synthetic oligonucleotide
gaagggtgcattcgggaatggacggggacggagcgga

SEQ ID NO: 74338 - DNA, 37 bp, Artificial Sequence
  Synthetic oligonucleotide
gatcgggtctcacctcacccgtatgctttttaaatga

SEQ ID NO: 74339 - DNA, 38 bp, Artificial Sequence
  Synthetic oligonucleotide
tagtcaacacaaggctatccagggatcacgggtaatga

SEQ ID NO: 74340 - DNA, 38 bp, Artificial Sequence
  Synthetic oligonucleotide
gaacacccttaatgtgttcttctacttgtacaacatga

SEQ ID NO: 74341 - DNA, 38 bp, Artificial Sequence
  Synthetic oligonucleotide
gagacccccactggtagtacctgctacaagccctatga

SEQ ID NO: 74342 - DNA, 37 bp, Artificial Sequence
  Synthetic oligonucleotide
atgtgcgtaatggggcggaataactgggggtcactga

SEQ ID NO: 74343 - DNA, 38 bp, Artificial Sequence
  Synthetic oligonucleotide
gaagccaccacgacacgtcaagtgaagcacgttactga

SEQ ID NO: 74344 - DNA, 37 bp, Artificial Sequence
  Synthetic oligonucleotide
taatcctgtgcacgccgatcaatgcatctccacctga

SEQ ID NO: 74345 - DNA, 38 bp, Artificial Sequence
  Synthetic oligonucleotide
gagtcagtcgccgtttctatgccgttgtacgtccctga

SEQ ID NO: 74346 - DNA, 38 bp, Artificial Sequence
  Synthetic oligonucleotide
tgacacagacaactttgttggtaactctccctcgctga

SEQ ID NO: 74347 - DNA, 36 bp, Artificial Sequence
  Synthetic oligonucleotide
tacccggtccctcgcactatcccctatgaccagtga

SEQ ID NO: 74348 - DNA, 38 bp, Artificial Sequence
  Synthetic oligonucleotide
ggtgccgaggggggagagacgggagaagtttagcgtga

SEQ ID NO: 74349 - DNA, 37 bp, Artificial Sequence
  Synthetic oligonucleotide
aactctgccctgtccctgtatcgtgcatttcaggtga

SEQ ID NO: 74350 - DNA, 38 bp, Artificial Sequence
  Synthetic oligonucleotide
taaggtcatgcgaagtgggaggggaaataggggtgtga

SEQ ID NO: 74351 - DNA, 37 bp, Artificial Sequence
  Synthetic oligonucleotide
tcacaccgatgtcttaccgattcatccattcacttga

SEQ ID NO: 74352 - DNA, 38 bp, Artificial Sequence
  Synthetic oligonucleotide
tgccatgccacacgcacgttatggactctgttacttga

SEQ ID NO: 74353 - DNA, 37 bp, Artificial Sequence
  Synthetic oligonucleotide
tccatcaccctacctttgcgtagttctgcctgtttga

SEQ ID NO: 74354 - DNA, 38 bp, Artificial Sequence
  Synthetic oligonucleotide
gttcacgcgaggaagactatacaacacttcgattttga

SEQ ID NO: 74355 - DNA, 36 bp, Artificial Sequence
  Synthetic oligonucleotide
atgtcacccccggatcacagctcttagaacttttga

SEQ ID NO: 74356 - DNA, 38 bp, Artificial Sequence
  Synthetic oligonucleotide
gcgatgcgcactgtctacccgcatcggttttgttttga

SEQ ID NO: 74357 - DNA, 37 bp, Artificial Sequence
  Synthetic oligonucleotide
gaccgatccttcatccgtatttagaatccctttttga

SEQ ID NO: 74358 - DNA, 35 bp, Artificial Sequence
  Synthetic oligonucleotide
aaagacctcccccgatgcatggaacgccctgaata

SEQ ID NO: 74359 - DNA, 35 bp, Artificial Sequence
  Synthetic oligonucleotide
gcaccctcgacgttcccgttacttttgcaccacta

SEQ ID NO: 74360 - DNA, 35 bp, Artificial Sequence
  Synthetic oligonucleotide
gacctggttggggggggaacggttcaggaaagcta

SEQ ID NO: 74361 - DNA, 36 bp, Artificial Sequence
  Synthetic oligonucleotide
atccgcccttcccgatttgattactacgattttcta

SEQ ID NO: 74362 - DNA, 35 bp, Artificial Sequence
  Synthetic oligonucleotide
tcgacacatgttttcgttccctctccaacgccgta

SEQ ID NO: 74363 - DNA, 36 bp, Artificial Sequence
  Synthetic oligonucleotide
gtagggtagggatggggttatggaggggtttcggta

SEQ ID NO: 74364 - DNA, 36 bp, Artificial Sequence
  Synthetic oligonucleotide
cccaccgcacggggggcctttgaccgactctgctta

SEQ ID NO: 74365 - DNA, 36 bp, Artificial Sequence
  Synthetic oligonucleotide
gtatcatctggccttctgtcgggaaacactctctta

SEQ ID NO: 74366 - DNA, 35 bp, Artificial Sequence
  Synthetic oligonucleotide
aacagacatcacgagaatacccgaaccatttttta

SEQ ID NO: 74367 - DNA, 35 bp, Artificial Sequence
  Synthetic oligonucleotide
accccgtcaacgcacccatgccgtccactcctcac

SEQ ID NO: 74368 - DNA, 35 bp, Artificial Sequence
  Synthetic oligonucleotide
agatccactgttctttttactctctggtccactac

SEQ ID NO: 74369 - DNA, 35 bp, Artificial Sequence
  Synthetic oligonucleotide
gtccccttgcatgccctacctggcttctgacttac

SEQ ID NO: 74370 - DNA, 35 bp, Artificial Sequence
  Synthetic oligonucleotide
actccctgatgcagattgtgacctacgctaccacc

SEQ ID NO: 74371 - DNA, 35 bp, Artificial Sequence
  Synthetic oligonucleotide
ttgaccccctaatcttacgaggctcaagcatgacc

SEQ ID NO: 74372 - DNA, 35 bp, Artificial Sequence
  Synthetic oligonucleotide
taccagccgcgacgcttcagcgcttcaagtctacc

SEQ ID NO: 74373 - DNA, 35 bp, Artificial Sequence
  Synthetic oligonucleotide
gcgccctcgtgtaatgctgtctggctactcctccc

SEQ ID NO: 74374 - DNA, 35 bp, Artificial Sequence
  Synthetic oligonucleotide
atactccccgcctacgccaagttaggcgacatgcc

SEQ ID NO: 74375 - DNA, 35 bp, Artificial Sequence
  Synthetic oligonucleotide
gttgccacagcggttatcctacgacttcccctcgc

SEQ ID NO: 74376 - DNA, 35 bp, Artificial Sequence
  Synthetic oligonucleotide
tccgatcaaaggtgttgttgtttccgccacccctc

SEQ ID NO: 74377 - DNA, 35 bp, Artificial Sequence
  Synthetic oligonucleotide
gaacacttccccgatggagatatcttatgctcctc

SEQ ID NO: 74378 - DNA, 35 bp, Artificial Sequence
  Synthetic oligonucleotide
tacgacaagcgcgccttatctcctctagtacagtc

SEQ ID NO: 74379 - DNA, 35 bp, Artificial Sequence
  Synthetic oligonucleotide
gtgtggtgggtagggtgggtatctccagcaatttc

SEQ ID NO: 74380 - DNA, 35 bp, Artificial Sequence
  Synthetic oligonucleotide
gcgatcacagagcgaaaaaggggggctgagtgaag

SEQ ID NO: 74381 - DNA, 35 bp, Artificial Sequence
  Synthetic oligonucleotide
ggttggggaaagggcgtaaaaagcggatgggtaag

SEQ ID NO: 74382 - DNA, 35 bp, Artificial Sequence
  Synthetic oligonucleotide
attgcctgcctttccgttctgcctcttgctcctag

SEQ ID NO: 74383 - DNA, 35 bp, Artificial Sequence
  Synthetic oligonucleotide
tcagcctaagccaccctacaccgatctaggaaccg

SEQ ID NO: 74384 - DNA, 35 bp, Artificial Sequence
  Synthetic oligonucleotide
tttcagtccagcgcatctttaactgtcaatccccg

SEQ ID NO: 74385 - DNA, 35 bp, Artificial Sequence
  Synthetic oligonucleotide
tactaccacattaatcgcaagccatctcgtatccg

SEQ ID NO: 74386 - DNA, 35 bp, Artificial Sequence
  Synthetic oligonucleotide
tacatcgccagagtgccatacctacctcgccgctg

SEQ ID NO: 74387 - DNA, 35 bp, Artificial Sequence
  Synthetic oligonucleotide
gtgatggcgacagtcaaaatcccaccttatacgtg

SEQ ID NO: 74388 - DNA, 35 bp, Artificial Sequence
  Synthetic oligonucleotide
tacctaccgcattaccgtctttttcattacaggtg

SEQ ID NO: 74389 - DNA, 35 bp, Artificial Sequence
  Synthetic oligonucleotide
gtgtgaaagtgtggatgggcaggtgagtggtggtg

SEQ ID NO: 74390 - DNA, 34 bp, Artificial Sequence
  Synthetic oligonucleotide
aacgccaaccatcgcatctacaccttaccttttg

SEQ ID NO: 74391 - DNA, 35 bp, Artificial Sequence
  Synthetic oligonucleotide
gccaactcgccccgggtgctgcctgacacgagaat

SEQ ID NO: 74392 - DNA, 35 bp, Artificial Sequence
  Synthetic oligonucleotide
ggtttgccccacatccctttgggttattttcacat

SEQ ID NO: 74393 - DNA, 35 bp, Artificial Sequence
  Synthetic oligonucleotide
aatgatgttgctggcatcttctcactctcatgact

SEQ ID NO: 74394 - DNA, 35 bp, Artificial Sequence
  Synthetic oligonucleotide
accccaaccggcgtgagtgcgtaatttccccacct

SEQ ID NO: 74395 - DNA, 35 bp, Artificial Sequence
  Synthetic oligonucleotide
tcccaatgaggagggcgaccgagtcattagtccct

SEQ ID NO: 74396 - DNA, 35 bp, Artificial Sequence
  Synthetic oligonucleotide
tctgccccctctcctcatagccgattcagattcct

SEQ ID NO: 74397 - DNA, 35 bp, Artificial Sequence
  Synthetic oligonucleotide
gatccccactgtaccggggaatagagtacacatct

SEQ ID NO: 74398 - DNA, 35 bp, Artificial Sequence
  Synthetic oligonucleotide
tagctagcacctgcactcaccctactaactgttct

SEQ ID NO: 74399 - DNA, 35 bp, Artificial Sequence
  Synthetic oligonucleotide
tactcgctgaccctctagaacaattctgacaatgt

SEQ ID NO: 74400 - DNA, 35 bp, Artificial Sequence
  Synthetic oligonucleotide
gtaatggcatcctgcctcgttctcacatgtccatt

SEQ ID NO: 74401 - DNA, 35 bp, Artificial Sequence
  Synthetic oligonucleotide
gccctgcgctcggtctttaaccctgcggtgccctt

SEQ ID NO: 74402 - DNA, 35 bp, Artificial Sequence
  Synthetic oligonucleotide
tgaggacgaagacctactcgtcctggaacaaggtt

SEQ ID NO: 74403 - DNA, 35 bp, Artificial Sequence
  Synthetic oligonucleotide
tgagagcagaccggtaaccacgaccaacaagggtt

SEQ ID NO: 74404 - DNA, 35 bp, Artificial Sequence
  Synthetic oligonucleotide
ggggttgggcccgaggaagatagggacggttggtt

SEQ ID NO: 74405 - DNA, 35 bp, Artificial Sequence
  Synthetic oligonucleotide
attggtgccagcgttctttgcccaacccgaatgtt

SEQ ID NO: 74406 - DNA, 35 bp, Artificial Sequence
  Synthetic oligonucleotide
acccgttcacaggccaggagccttaaaccactttt

SEQ ID NO: 74407 - DNA, 35 bp, Artificial Sequence
  Synthetic oligonucleotide
gccggaacgaccgctgttctaccttcaactcgcaa

SEQ ID NO: 74408 - DNA, 36 bp, Artificial Sequence
  Synthetic oligonucleotide
gacccacgccgtaacagttcgaggatcagtcaagaa

SEQ ID NO: 74409 - DNA, 35 bp, Artificial Sequence
  Synthetic oligonucleotide
acatccacctctgattttaccctagtgatacagaa

SEQ ID NO: 74410 - DNA, 36 bp, Artificial Sequence
  Synthetic oligonucleotide
aattggccaccatctcatattaacgtgccccctgaa

SEQ ID NO: 74411 - DNA, 36 bp, Artificial Sequence
  Synthetic oligonucleotide
ttcgacccgcagcctggtattaaccctcacgtctaa

SEQ ID NO: 74412 - DNA, 36 bp, Artificial Sequence
  Synthetic oligonucleotide
gttccgcatatttcccgcctgtctctcatccggaca

SEQ ID NO: 74413 - DNA, 36 bp, Artificial Sequence
  Synthetic oligonucleotide
tgacgtcacttaatcattaccaccgtagcccacgca

SEQ ID NO: 74414 - DNA, 36 bp, Artificial Sequence
  Synthetic oligonucleotide
gtgtggatataatggggggaaaagagaagtacggca

SEQ ID NO: 74415 - DNA, 35 bp, Artificial Sequence
  Synthetic oligonucleotide
gtccgacacatttttcccgttagtttggactatca

SEQ ID NO: 74416 - DNA, 36 bp, Artificial Sequence
  Synthetic oligonucleotide
gagcacatcaccgccctcagcacctgactgccctca

SEQ ID NO: 74417 - DNA, 36 bp, Artificial Sequence
  Synthetic oligonucleotide
tctggcttcgacgccccctcccagccaagtgagtca

SEQ ID NO: 74418 - DNA, 35 bp, Artificial Sequence
  Synthetic oligonucleotide
ttatgaccacccgcgcgaactccgcacccggttca

SEQ ID NO: 74419 - DNA, 37 bp, Artificial Sequence
  Synthetic oligonucleotide
gatgatcacaaagggcagggagaccatatcatctaga

SEQ ID NO: 74420 - DNA, 37 bp, Artificial Sequence
  Synthetic oligonucleotide
tacacacacggagcgcgtagaaaggccgttgattaga

SEQ ID NO: 74421 - DNA, 37 bp, Artificial Sequence
  Synthetic oligonucleotide
tatagcccaacgcacggtccctacaacctctttacga

SEQ ID NO: 74422 - DNA, 37 bp, Artificial Sequence
  Synthetic oligonucleotide
gctggctagcacgtggtgaggggatgggcgggtccga

SEQ ID NO: 74423 - DNA, 37 bp, Artificial Sequence
  Synthetic oligonucleotide
ttcagacgtgcaatacttaacgatataccccttgcga

SEQ ID NO: 74424 - DNA, 37 bp, Artificial Sequence
  Synthetic oligonucleotide
tacgccatcctgctttcggagttcccgaacacatcga

SEQ ID NO: 74425 - DNA, 37 bp, Artificial Sequence
  Synthetic oligonucleotide
tagcccccgatcttacggccaggacatttatcctcga

SEQ ID NO: 74426 - DNA, 37 bp, Artificial Sequence
  Synthetic oligonucleotide
agggggataggaatggcataggagggggtgttgtcga

SEQ ID NO: 74427 - DNA, 37 bp, Artificial Sequence
  Synthetic oligonucleotide
aaccgctctacccgtcatggctctcgtgcctgttcga

SEQ ID NO: 74428 - DNA, 37 bp, Artificial Sequence
  Synthetic oligonucleotide
tatggtgcttgtgaggagcggggactggggttttcga

SEQ ID NO: 74429 - DNA, 37 bp, Artificial Sequence
  Synthetic oligonucleotide
tcataccaccgcccctcccatggccgtcatcgaagga

SEQ ID NO: 74430 - DNA, 37 bp, Artificial Sequence
  Synthetic oligonucleotide
atagaacgagggtgcaggtgggggtgtgctcgtagga

SEQ ID NO: 74431 - DNA, 37 bp, Artificial Sequence
  Synthetic oligonucleotide
gatgccgagaaaaaagagtggttgggaatagtacgga

SEQ ID NO: 74432 - DNA, 37 bp, Artificial Sequence
  Synthetic oligonucleotide
agacagagcgcggattatggaagaaaggaaggtcgga

SEQ ID NO: 74433 - DNA, 37 bp, Artificial Sequence
  Synthetic oligonucleotide
gagagcgtggctcaataactttaacgggcgggaggga

SEQ ID NO: 74434 - DNA, 37 bp, Artificial Sequence
  Synthetic oligonucleotide
tctgccacttatcgcacatcatttctcccctccggga

SEQ ID NO: 74435 - DNA, 36 bp, Artificial Sequence
  Synthetic oligonucleotide
gggaacagttgaccttaattagatggtgagtgggga

SEQ ID NO: 74436 - DNA, 37 bp, Artificial Sequence
  Synthetic oligonucleotide
attcaacgacactcctcgtttcccccagcccatggga

SEQ ID NO: 74437 - DNA, 37 bp, Artificial Sequence
  Synthetic oligonucleotide
ccacctgcacacaccctgtcgcctacctcgctatgga

SEQ ID NO: 74438 - DNA, 37 bp, Artificial Sequence
  Synthetic oligonucleotide
acactcagacatcttggcattgggatccgcttttgga

SEQ ID NO: 74439 - DNA, 38 bp, Artificial Sequence
  Synthetic oligonucleotide
gtaagacgccctgtattcgcctccccccttggtaatga

SEQ ID NO: 74440 - DNA, 37 bp, Artificial Sequence
  Synthetic oligonucleotide
ggaggccgtcttgcaccctgttttcgtcctatcatga

SEQ ID NO: 74441 - DNA, 38 bp, Artificial Sequence
  Synthetic oligonucleotide
aggaaaagtacggggagggaaggggggcaggacgatga

SEQ ID NO: 74442 - DNA, 38 bp, Artificial Sequence
  Synthetic oligonucleotide
gggacgctgcaggcatgatgggggtgtgattaggatga

SEQ ID NO: 74443 - DNA, 38 bp, Artificial Sequence
  Synthetic oligonucleotide
aatctccacccgcctacatacagccttactccggatga

SEQ ID NO: 74444 - DNA, 38 bp, Artificial Sequence
  Synthetic oligonucleotide
tacgacccccacgcacagctcacacctttcgccactga

SEQ ID NO: 74445 - DNA, 37 bp, Artificial Sequence
  Synthetic oligonucleotide
gccaaacttccatcgatattttgcatgaccatactga

SEQ ID NO: 74446 - DNA, 37 bp, Artificial Sequence
  Synthetic oligonucleotide
accacatgggcgaactttggtgaatctcccaacctga

SEQ ID NO: 74447 - DNA, 38 bp, Artificial Sequence
  Synthetic oligonucleotide
taagcccgtctagcccgcacgctctcatacatgcctga

SEQ ID NO: 74448 - DNA, 37 bp, Artificial Sequence
  Synthetic oligonucleotide
gcgatggcacgttggaagggctatagtttgagcgtga

SEQ ID NO: 74449 - DNA, 38 bp, Artificial Sequence
  Synthetic oligonucleotide
tgtcagagggcgggtgagagggaagtgtaatggggtga

SEQ ID NO: 74450 - DNA, 37 bp, Artificial Sequence
  Synthetic oligonucleotide
gtgcggagaggcggccggttgctgggctatggggtga

SEQ ID NO: 74451 - DNA, 38 bp, Artificial Sequence
  Synthetic oligonucleotide
actgagggctcaaatgtgatggtggtccggggtggtga

SEQ ID NO: 74452 - DNA, 38 bp, Artificial Sequence
  Synthetic oligonucleotide
gtggccttagcatcagaacctccattgctcccgtgtga

SEQ ID NO: 74453 - DNA, 38 bp, Artificial Sequence
  Synthetic oligonucleotide
ttcagaacaggggactagggtgacggtgggtcgtgtga

SEQ ID NO: 74454 - DNA, 38 bp, Artificial Sequence
  Synthetic oligonucleotide
acctccaaccattcgaatgattgacactgtaccattga

SEQ ID NO: 74455 - DNA, 38 bp, Artificial Sequence
  Synthetic oligonucleotide
gtgaaacgggaaaggagtggagtgcggtggcagattga

SEQ ID NO: 74456 - DNA, 38 bp, Artificial Sequence
  Synthetic oligonucleotide
tgtgaagtgcaggctggagtaaagatggaacggattga

SEQ ID NO: 74457 - DNA, 36 bp, Artificial Sequence
  Synthetic oligonucleotide
tatgctcctggcctgctgtgcaatctgggggattga

SEQ ID NO: 74458 - DNA, 38 bp, Artificial Sequence
  Synthetic oligonucleotide
taagtgctcaggtaggccgatagtaggagcgcacttga

SEQ ID NO: 74459 - DNA, 36 bp, Artificial Sequence
  Synthetic oligonucleotide
accctcacatcagggcgcctcaaacatagctcttga

SEQ ID NO: 74460 - DNA, 37 bp, Artificial Sequence
  Synthetic oligonucleotide
atccctgaccactgtgcccacgcagtatcatcgttga

SEQ ID NO: 74461 - DNA, 38 bp, Artificial Sequence
  Synthetic oligonucleotide
gcttaggcgcattctgccaggttgtttcttttcgttga

SEQ ID NO: 74462 - DNA, 37 bp, Artificial Sequence
  Synthetic oligonucleotide
tacctgtgcctgcctgcaactatggttcttctgttga

SEQ ID NO: 74463 - DNA, 35 bp, Artificial Sequence
  Synthetic oligonucleotide
gagctcgcccccgcgcaacgctttttgcttgcata

SEQ ID NO: 74464 - DNA, 36 bp, Artificial Sequence
  Synthetic oligonucleotide
tggacagtcacatgcctggcgtaaatttccatcata

SEQ ID NO: 74465 - DNA, 36 bp, Artificial Sequence
  Synthetic oligonucleotide
atgactggaccgcaaggttattagcagtagtagcta

SEQ ID NO: 74466 - DNA, 36 bp, Artificial Sequence
  Synthetic oligonucleotide
ttggcgtatcactggtttttctttcggagtccgcta

SEQ ID NO: 74467 - DNA, 36 bp, Artificial Sequence
  Synthetic oligonucleotide
gaccgtgcaccgatcacgttacacctgctctgagta

SEQ ID NO: 74468 - DNA, 36 bp, Artificial Sequence
  Synthetic oligonucleotide
tacctgagcggggggggaaagaagaatattcacgta

SEQ ID NO: 74469 - DNA, 35 bp, Artificial Sequence
  Synthetic oligonucleotide
atgtcgacacctaatcgctggtcccattgactgta

SEQ ID NO: 74470 - DNA, 36 bp, Artificial Sequence
  Synthetic oligonucleotide
aatgcactcgacaaccctaagccagtccttccatta

SEQ ID NO: 74471 - DNA, 36 bp, Artificial Sequence
  Synthetic oligonucleotide
gataccacccacactgtgagcggcgatgtcccctta

SEQ ID NO: 74472 - DNA, 36 bp, Artificial Sequence
  Synthetic oligonucleotide
ttcatctcgctaataccctgtggcctgtccccgtta

SEQ ID NO: 74473 - DNA, 35 bp, Artificial Sequence
  Synthetic oligonucleotide
gatcgctgcccattaatttatccaagcccttcaac

SEQ ID NO: 74474 - DNA, 35 bp, Artificial Sequence
  Synthetic oligonucleotide
gattatccccagccctgggtgcgtcgcggtaccac

SEQ ID NO: 74475 - DNA, 35 bp, Artificial Sequence
  Synthetic oligonucleotide
gtcccctatcctgctgggtgaacgccaaaccgcac

SEQ ID NO: 74476 - DNA, 35 bp, Artificial Sequence
  Synthetic oligonucleotide
gccggtccacatttcactgcctctaatagtccgac

SEQ ID NO: 74477 - DNA, 35 bp, Artificial Sequence
  Synthetic oligonucleotide
accactcgaatcccacaatgcgaagcacatcgtac

SEQ ID NO: 74478 - DNA, 35 bp, Artificial Sequence
  Synthetic oligonucleotide
tagaccccaatgcgccatcaactcgcaggatttac

SEQ ID NO: 74479 - DNA, 35 bp, Artificial Sequence
  Synthetic oligonucleotide
accgctaccatcgcgctcctgcctcttcgaggacc

SEQ ID NO: 74480 - DNA, 35 bp, Artificial Sequence
  Synthetic oligonucleotide
gataatacgcacggaccgcccgctctaacatgacc

SEQ ID NO: 74481 - DNA, 35 bp, Artificial Sequence
  Synthetic oligonucleotide
gaccccaattcaggttatacgtccttgtggcaccc

SEQ ID NO: 74482 - DNA, 35 bp, Artificial Sequence
  Synthetic oligonucleotide
gcatacgtctcaagcatttaggtttacaccacccc

SEQ ID NO: 74483 - DNA, 35 bp, Artificial Sequence
  Synthetic oligonucleotide
gatgcgtcttcgccctcctttcttcacagtacgcc

SEQ ID NO: 74484 - DNA, 35 bp, Artificial Sequence
  Synthetic oligonucleotide
gcgatgctctcaaatagccgtcttgaccaatcgcc

SEQ ID NO: 74485 - DNA, 35 bp, Artificial Sequence
  Synthetic oligonucleotide
gctaaccgctactctaccatctacagttcccggcc

SEQ ID NO: 74486 - DNA, 35 bp, Artificial Sequence
  Synthetic oligonucleotide
gtaccaccttttcgacttttgttgccggactctcc

SEQ ID NO: 74487 - DNA, 35 bp, Artificial Sequence
  Synthetic oligonucleotide
tacaccgcatttttaaatcctgtgcttccctttcc

SEQ ID NO: 74488 - DNA, 35 bp, Artificial Sequence
  Synthetic oligonucleotide
agctcacacactacttcgttaattgctggttttcc

SEQ ID NO: 74489 - DNA, 35 bp, Artificial Sequence
  Synthetic oligonucleotide
acccggtgtgaatgcgtagccagtccgtcccccgc

SEQ ID NO: 74490 - DNA, 35 bp, Artificial Sequence
  Synthetic oligonucleotide
acttccgtccgcccccctgtcctagccatgtatgc

SEQ ID NO: 74491 - DNA, 35 bp, Artificial Sequence
  Synthetic oligonucleotide
tcaatgtctctgccgtgttggtcccatctcgttgc

SEQ ID NO: 74492 - DNA, 35 bp, Artificial Sequence
  Synthetic oligonucleotide
acccgattgcgcccctaagtccatagttcactatc

SEQ ID NO: 74493 - DNA, 35 bp, Artificial Sequence
  Synthetic oligonucleotide
tctcgactgccttgccagtgacatctgacctactc

SEQ ID NO: 74494 - DNA, 35 bp, Artificial Sequence
  Synthetic oligonucleotide
tagaacggagcgacggtttttctcggttcgccctc

SEQ ID NO: 74495 - DNA, 35 bp, Artificial Sequence
  Synthetic oligonucleotide
agtaagcctgtggtcatcgttctggccccgcgctc

SEQ ID NO: 74496 - DNA, 35 bp, Artificial Sequence
  Synthetic oligonucleotide
tgttgttcccttccatgtcttgctttgcacctctc

SEQ ID NO: 74497 - DNA, 35 bp, Artificial Sequence
  Synthetic oligonucleotide
gacgggtcaagtacgcctcccaccactagcgggtc

SEQ ID NO: 74498 - DNA, 35 bp, Artificial Sequence
  Synthetic oligonucleotide
gccgcagagcagtgtacatacctaaatgtgccttc

SEQ ID NO: 74499 - DNA, 35 bp, Artificial Sequence
  Synthetic oligonucleotide
tcccgtctcgtatgcctggtccttcaattactgag

SEQ ID NO: 74500 - DNA, 35 bp, Artificial Sequence
  Synthetic oligonucleotide
acacatacatttcttccgtatacaccgttctcacg

SEQ ID NO: 74501 - DNA, 35 bp, Artificial Sequence
  Synthetic oligonucleotide
gcccaccctcacgacccgccgagtagcaccttgcg

SEQ ID NO: 74502 - DNA, 36 bp, Artificial Sequence
  Synthetic oligonucleotide
acgttcgtgcaaggagaattaaaggatggggcgtgg

SEQ ID NO: 74503 - DNA, 35 bp, Artificial Sequence
  Synthetic oligonucleotide
atcaacctcggttgtgtcattctcacctacggatg

SEQ ID NO: 74504 - DNA, 35 bp, Artificial Sequence
  Synthetic oligonucleotide
cgtcattaccgttcgtatgctatttttctatcctg

SEQ ID NO: 74505 - DNA, 35 bp, Artificial Sequence
  Synthetic oligonucleotide
acaggagatcctcgtaccgcctttcatcaccattg

SEQ ID NO: 74506 - DNA, 35 bp, Artificial Sequence
  Synthetic oligonucleotide
gctccatacccatgcccctgaaaaacgtgattaat

SEQ ID NO: 74507 - DNA, 35 bp, Artificial Sequence
  Synthetic oligonucleotide
atgagccccctcccgttctgttttcatatggatat

SEQ ID NO: 74508 - DNA, 35 bp, Artificial Sequence
  Synthetic oligonucleotide
gagcttgcacgaacatgccaccgtatgccatatat

SEQ ID NO: 74509 - DNA, 35 bp, Artificial Sequence
  Synthetic oligonucleotide
gtgattgtggtgtacacgctgtacccaagccttat

SEQ ID NO: 74510 - DNA, 35 bp, Artificial Sequence
  Synthetic oligonucleotide
ggtcgcacatcgtacgtcagtcataccgttccact

SEQ ID NO: 74511 - DNA, 35 bp, Artificial Sequence
  Synthetic oligonucleotide
tttaacctcgagatccctgtacgtgctcgaagcct

SEQ ID NO: 74512 - DNA, 35 bp, Artificial Sequence
  Synthetic oligonucleotide
gtccacgccccctatcggtccagggctgtcaagct

SEQ ID NO: 74513 - DNA, 35 bp, Artificial Sequence
  Synthetic oligonucleotide
atcgcatccgtcacacctgatcttatatccaggct

SEQ ID NO: 74514 - DNA, 36 bp, Artificial Sequence
  Synthetic oligonucleotide
tatggcgccatgtgtcaataccacccccatttggct

SEQ ID NO: 74515 - DNA, 35 bp, Artificial Sequence
  Synthetic oligonucleotide
tcgatggtccattacgctcgagttttacgttctct

SEQ ID NO: 74516 - DNA, 35 bp, Artificial Sequence
  Synthetic oligonucleotide
gaaaacctgtcgatccgacgaaccccccgcattct

SEQ ID NO: 74517 - DNA, 35 bp, Artificial Sequence
  Synthetic oligonucleotide
ttccgacagttcctaccgtccgcccctcattcggt

SEQ ID NO: 74518 - DNA, 35 bp, Artificial Sequence
  Synthetic oligonucleotide
gatctccctctcggacgacaggctggtaagcttgt

SEQ ID NO: 74519 - DNA, 35 bp, Artificial Sequence
  Synthetic oligonucleotide
gctgtacacgttttcgacacgttgccacacccctt

SEQ ID NO: 74520 - DNA, 35 bp, Artificial Sequence
  Synthetic oligonucleotide
ggttgacagagggatcaaagggggagtggaaggtt

SEQ ID NO: 74521 - DNA, 35 bp, Artificial Sequence
  Synthetic oligonucleotide
gacgctctccggcaactctaggtatcatctcggtt

SEQ ID NO: 74522 - DNA, 35 bp, Artificial Sequence
  Synthetic oligonucleotide
gtcctccccactgatagcattaacaaactagaaaa

SEQ ID NO: 74523 - DNA, 36 bp, Artificial Sequence
  Synthetic oligonucleotide
agctctcaccccggttaacaccgcacattcttgaaa

SEQ ID NO: 74524 - DNA, 35 bp, Artificial Sequence
  Synthetic oligonucleotide
acttcccaccctcgttgtccttactctgtgacgaa

SEQ ID NO: 74525 - DNA, 36 bp, Artificial Sequence
  Synthetic oligonucleotide
ttatcgccctcttggaagagcccgcttaccaccgaa

SEQ ID NO: 74526 - DNA, 35 bp, Artificial Sequence
  Synthetic oligonucleotide
aaagaccagtgtcaggttatcccagcccgtttgaa

SEQ ID NO: 74527 - DNA, 35 bp, Artificial Sequence
  Synthetic oligonucleotide
tatgacgacggtcccgattggtcatcctgtagtaa

SEQ ID NO: 74528 - DNA, 35 bp, Artificial Sequence
  Synthetic oligonucleotide
gaatcatccgcagagtgtgctacagtttagaaaca

SEQ ID NO: 74529 - DNA, 35 bp, Artificial Sequence
  Synthetic oligonucleotide
tcctgacccctcccgatccgtacgagtgcccccca

SEQ ID NO: 74530 - DNA, 36 bp, Artificial Sequence
  Synthetic oligonucleotide
gtgctatcgtaactgccaaactttctaagctgccca

SEQ ID NO: 74531 - DNA, 36 bp, Artificial Sequence
  Synthetic oligonucleotide
aaagctcgcggccggtacgccttcgctcctattcca

SEQ ID NO: 74532 - DNA, 36 bp, Artificial Sequence
  Synthetic oligonucleotide
ttcgaggaggaaaagggacagggtgagaacagtgca

SEQ ID NO: 74533 - DNA, 35 bp, Artificial Sequence
  Synthetic oligonucleotide
atgatgcaacctgtttacgtactttgccgtgatca

SEQ ID NO: 74534 - DNA, 35 bp, Artificial Sequence
  Synthetic oligonucleotide
gtgcagaatcgccaaatcgcctagtttgcccttca

SEQ ID NO: 74535 - DNA, 36 bp, Artificial Sequence
  Synthetic oligonucleotide
agcactctgagctggtcgggcctttcctatatttca

SEQ ID NO: 74536 - DNA, 35 bp, Artificial Sequence
  Synthetic oligonucleotide
tcacattccaccccggttgcagtcaacgaagtaga

SEQ ID NO: 74537 - DNA, 37 bp, Artificial Sequence
  Synthetic oligonucleotide
ttgctgcgaacacacccctgggagcccacgttaacga

SEQ ID NO: 74538 - DNA, 36 bp, Artificial Sequence
  Synthetic oligonucleotide
acccacttcaaattgctctagcgctgcccggtacga

SEQ ID NO: 74539 - DNA, 36 bp, Artificial Sequence
  Synthetic oligonucleotide
gtccgactgcagggctctcctctctttcaacaccga

SEQ ID NO: 74540 - DNA, 37 bp, Artificial Sequence
  Synthetic oligonucleotide
caagctggcctccacacgcgcaagacccctcacccga

SEQ ID NO: 74541 - DNA, 37 bp, Artificial Sequence
  Synthetic oligonucleotide
gagcaacgccccaccttgctcatgtatcgtcacccga

SEQ ID NO: 74542 - DNA, 36 bp, Artificial Sequence
  Synthetic oligonucleotide
tgaatgcatggcccccacaatctgtccgtcctccga

SEQ ID NO: 74543 - DNA, 36 bp, Artificial Sequence
  Synthetic oligonucleotide
agctacctggtgacgatcttgcgcctttatttccga

SEQ ID NO: 74544 - DNA, 37 bp, Artificial Sequence
  Synthetic oligonucleotide
aaccacaactggcgcatgcgtcctacaccccacgcga

SEQ ID NO: 74545 - DNA, 38 bp, Artificial Sequence
  Synthetic oligonucleotide
actgccacgctcgacctgcttggagcaattgtttgcga

SEQ ID NO: 74546 - DNA, 35 bp, Artificial Sequence
  Synthetic oligonucleotide
aatgagggcatgataagtatcgggggatggatcga

SEQ ID NO: 74547 - DNA, 35 bp, Artificial Sequence
  Synthetic oligonucleotide
acgccagaagagggggggcttaaaagcggaaagga

SEQ ID NO: 74548 - DNA, 36 bp, Artificial Sequence
  Synthetic oligonucleotide
gggtgaggcgagagcagtagaaggtggaatagagga

SEQ ID NO: 74549 - DNA, 37 bp, Artificial Sequence
  Synthetic oligonucleotide
acctttgccccgatgatccccacgtttgctttgagga

SEQ ID NO: 74550 - DNA, 37 bp, Artificial Sequence
  Synthetic oligonucleotide
ttaggagggtcaaaaaaaacggagagggtaaaaggga

SEQ ID NO: 74551 - DNA, 37 bp, Artificial Sequence
  Synthetic oligonucleotide
tccgccttcctcacgctcacccgaacttccgcgggga

SEQ ID NO: 74552 - DNA, 36 bp, Artificial Sequence
  Synthetic oligonucleotide
tatggaccagaggagtttgcgtgggcgaacggggga

SEQ ID NO: 74553 - DNA, 36 bp, Artificial Sequence
  Synthetic oligonucleotide
gtgagggacgggctgggttctcctgggtgcttggga

SEQ ID NO: 74554 - DNA, 37 bp, Artificial Sequence
  Synthetic oligonucleotide
gatgcgtgctggctctctaaatcaaccatgatctgga

SEQ ID NO: 74555 - DNA, 37 bp, Artificial Sequence
  Synthetic oligonucleotide
ggccagaccctgctacccaccaactgctcaccttgga

SEQ ID NO: 74556 - DNA, 38 bp, Artificial Sequence
  Synthetic oligonucleotide
ttccggagccccaaagttaaccaccactctccgaatga

SEQ ID NO: 74557 - DNA, 38 bp, Artificial Sequence
  Synthetic oligonucleotide
accccaaccgccgagagtttgctaaccgagccccatga

SEQ ID NO: 74558 - DNA, 38 bp, Artificial Sequence
  Synthetic oligonucleotide
gtggacagggatgtatagtgcaatggttggatcgatga

SEQ ID NO: 74559 - DNA, 37 bp, Artificial Sequence
  Synthetic oligonucleotide
gagtacgctggggggatgaaaccggcttttgtgatga

SEQ ID NO: 74560 - DNA, 38 bp, Artificial Sequence
  Synthetic oligonucleotide
tgctacacagcagaggttcagccccctcattcacctga

SEQ ID NO: 74561 - DNA, 36 bp, Artificial Sequence
  Synthetic oligonucleotide
aagacagcgggccctggacttctctcctccccctga

SEQ ID NO: 74562 - DNA, 37 bp, Artificial Sequence
  Synthetic oligonucleotide
actggtcagatcctccccgcgcgcccttagagcctga

SEQ ID NO: 74563 - DNA, 38 bp, Artificial Sequence
  Synthetic oligonucleotide
tgaccctcttcacccataggactctcctgcttgcctga

SEQ ID NO: 74564 - DNA, 37 bp, Artificial Sequence
  Synthetic oligonucleotide
tatttacgcactgtggtgttccgcaccctcctcctga

SEQ ID NO: 74565 - DNA, 38 bp, Artificial Sequence
  Synthetic oligonucleotide
gaaccgccgtggaggtaggcgtgacgtaacctaagtga

SEQ ID NO: 74566 - DNA, 38 bp, Artificial Sequence
  Synthetic oligonucleotide
gtaattgtggacaggggggtggggatagcacagggtga

SEQ ID NO: 74567 - DNA, 38 bp, Artificial Sequence
  Synthetic oligonucleotide
tagtcctccggttggtcctgcactatcccctctggtga

SEQ ID NO: 74568 - DNA, 38 bp, Artificial Sequence
  Synthetic oligonucleotide
gagacgtagaggaggtatcggtcgcagtaagttggtga

SEQ ID NO: 74569 - DNA, 38 bp, Artificial Sequence
  Synthetic oligonucleotide
tgagctcacccgcgtgctccagtacgacccccaattga

SEQ ID NO: 74570 - DNA, 38 bp, Artificial Sequence
  Synthetic oligonucleotide
ttctgtccagacctacctggttcatagcctcaccttga

SEQ ID NO: 74571 - DNA, 37 bp, Artificial Sequence
  Synthetic oligonucleotide
atttgccacaaacctcttgcgagacaaccttccttga

SEQ ID NO: 74572 - DNA, 38 bp, Artificial Sequence
  Synthetic oligonucleotide
agccacacattggctcctccatcaatcttctagcttga

SEQ ID NO: 74573 - DNA, 38 bp, Artificial Sequence
  Synthetic oligonucleotide
aagaaaaggtgggggtatgaagtggggatggcagttga

SEQ ID NO: 74574 - DNA, 38 bp, Artificial Sequence
  Synthetic oligonucleotide
tccacacagcctgttctacgggactgcactgctgttga

SEQ ID NO: 74575 - DNA, 37 bp, Artificial Sequence
  Synthetic oligonucleotide
tgtacatccacacccggtcgattcccttctcatttga

SEQ ID NO: 74576 - DNA, 35 bp, Artificial Sequence
  Synthetic oligonucleotide
gtgatcggagatagggagggtggaggatattacta

SEQ ID NO: 74577 - DNA, 36 bp, Artificial Sequence
  Synthetic oligonucleotide
ttgaagtgcccagcacaatgctcctattccagccta

SEQ ID NO: 74578 - DNA, 36 bp, Artificial Sequence
  Synthetic oligonucleotide
taccctccctcaaatctcatgtaaggcccgacgcta

SEQ ID NO: 74579 - DNA, 36 bp, Artificial Sequence
  Synthetic oligonucleotide
tcagggatgaatcgcgtggccatgaggtcggaagta

SEQ ID NO: 74580 - DNA, 36 bp, Artificial Sequence
  Synthetic oligonucleotide
aagtgatggtaagtgggaggtaatagagctgtggta

SEQ ID NO: 74581 - DNA, 35 bp, Artificial Sequence
  Synthetic oligonucleotide
tcaacactagttggccaatataccgactgccaaac

SEQ ID NO: 74582 - DNA, 35 bp, Artificial Sequence
  Synthetic oligonucleotide
gatgtaggagacgaagcaaggaccaggttaacaac

SEQ ID NO: 74583 - DNA, 34 bp, Artificial Sequence
  Synthetic oligonucleotide
ggttagctcagctctccttgcacctgcctctcac

SEQ ID NO: 74584 - DNA, 35 bp, Artificial Sequence
  Synthetic oligonucleotide
accacacacgtgacctcagaatcgggccaccgtac

SEQ ID NO: 74585 - DNA, 35 bp, Artificial Sequence
  Synthetic oligonucleotide
atcaccctcggtacggacgctacattgcactaacc

SEQ ID NO: 74586 - DNA, 35 bp, Artificial Sequence
  Synthetic oligonucleotide
gagccacgccttaccgccaaaggcatcctactacc

SEQ ID NO: 74587 - DNA, 35 bp, Artificial Sequence
  Synthetic oligonucleotide
tgttgaacccgaccttatagatacgcatgtctacc

SEQ ID NO: 74588 - DNA, 35 bp, Artificial Sequence
  Synthetic oligonucleotide
agcataccggtcgctgatacctgcccctcctagcc

SEQ ID NO: 74589 - DNA, 35 bp, Artificial Sequence
  Synthetic oligonucleotide
ataccaccgccttgtcacgctatattcccctgtcc

SEQ ID NO: 74590 - DNA, 35 bp, Artificial Sequence
  Synthetic oligonucleotide
ggagagaccgtcagaacaccgagtctacctcttcc

SEQ ID NO: 74591 - DNA, 35 bp, Artificial Sequence
  Synthetic oligonucleotide
ttgacagcaaagccttgccatttcacgtaggttcc

SEQ ID NO: 74592 - DNA, 35 bp, Artificial Sequence
  Synthetic oligonucleotide
agcaactggccaccctacgacttacatatccacgc

SEQ ID NO: 74593 - DNA, 35 bp, Artificial Sequence
  Synthetic oligonucleotide
tccatccctggagaagctgtgactgcttcctaatc

SEQ ID NO: 74594 - DNA, 35 bp, Artificial Sequence
  Synthetic oligonucleotide
ttggagcaggcgtttactctgtggccactcctatc

SEQ ID NO: 74595 - DNA, 35 bp, Artificial Sequence
  Synthetic oligonucleotide
gtgcctagacgttcaattcgacaccactaccgctc

SEQ ID NO: 74596 - DNA, 35 bp, Artificial Sequence
  Synthetic oligonucleotide
tcagcgggtacatactcctgtagttcgttgctctc

SEQ ID NO: 74597 - DNA, 35 bp, Artificial Sequence
  Synthetic oligonucleotide
acctcacctgtccatttgtccacttcgttgcattc

SEQ ID NO: 74598 - DNA, 35 bp, Artificial Sequence
  Synthetic oligonucleotide
atgcgtccctgcatcacccgtcttattataaaacg

SEQ ID NO: 74599 - DNA, 35 bp, Artificial Sequence
  Synthetic oligonucleotide
actcctcatccaggacccgccacttacacatcccg

SEQ ID NO: 74600 - DNA, 35 bp, Artificial Sequence
  Synthetic oligonucleotide
tacaccccaatcacggcgattcgcaccgacacgcg

SEQ ID NO: 74601 - DNA, 35 bp, Artificial Sequence
  Synthetic oligonucleotide
aacggggaagaggaggaaaggagcatattaaaagg

SEQ ID NO: 74602 - DNA, 35 bp, Artificial Sequence
  Synthetic oligonucleotide
gtccgtcgactacgttgcccatcgtttcccccagg

SEQ ID NO: 74603 - DNA, 35 bp, Artificial Sequence
  Synthetic oligonucleotide
gcgtacgtttggagaggggaattcaagggaggggg

SEQ ID NO: 74604 - DNA, 35 bp, Artificial Sequence
  Synthetic oligonucleotide
tcataaggacggatggtaaatatgggggctgtatg

SEQ ID NO: 74605 - DNA, 35 bp, Artificial Sequence
  Synthetic oligonucleotide
gaagggttcgtgggaattggtcatgaaagggattg

SEQ ID NO: 74606 - DNA, 35 bp, Artificial Sequence
  Synthetic oligonucleotide
ttatccacccgctgatacaccttgggttactaaat

SEQ ID NO: 74607 - DNA, 35 bp, Artificial Sequence
  Synthetic oligonucleotide
tcgtctcacgcctcatgtgccgctcactatgccat

SEQ ID NO: 74608 - DNA, 35 bp, Artificial Sequence
  Synthetic oligonucleotide
ccgatgaggggtgaaggggagggactaaggagcat

SEQ ID NO: 74609 - DNA, 35 bp, Artificial Sequence
  Synthetic oligonucleotide
gcttcccgtccacgccccccatatcaaagtagact

SEQ ID NO: 74610 - DNA, 35 bp, Artificial Sequence
  Synthetic oligonucleotide
gtggtcacgttggcactttgtgtcctgcccgtcct

SEQ ID NO: 74611 - DNA, 35 bp, Artificial Sequence
  Synthetic oligonucleotide
gagtaggaacgtggagaggaagtacagtaatggct

SEQ ID NO: 74612 - DNA, 35 bp, Artificial Sequence
  Synthetic oligonucleotide
gtaccatccctaaagtacgtatatcacttagtgct

SEQ ID NO: 74613 - DNA, 35 bp, Artificial Sequence
  Synthetic oligonucleotide
gacgccggcggaagccagcccccttactatgtgct

SEQ ID NO: 74614 - DNA, 34 bp, Artificial Sequence
  Synthetic oligonucleotide
gacgcggtcctggatcaccctgaccccacaatct

SEQ ID NO: 74615 - DNA, 35 bp, Artificial Sequence
  Synthetic oligonucleotide
gtggttgcaggaactcggccgtacttacaccatct

SEQ ID NO: 74616 - DNA, 35 bp, Artificial Sequence
  Synthetic oligonucleotide
atcccccactgtggttaagcattctaccgtggtct

SEQ ID NO: 74617 - DNA, 35 bp, Artificial Sequence
  Synthetic oligonucleotide
tacgaacgaggggtcgagttttcctttattgtagt

SEQ ID NO: 74618 - DNA, 35 bp, Artificial Sequence
  Synthetic oligonucleotide
gtacgaacgccatggacatccactcagaccttagt

SEQ ID NO: 74619 - DNA, 35 bp, Artificial Sequence
  Synthetic oligonucleotide
tccgcccctgcctatgtttcggtcatcgccccatt

SEQ ID NO: 74620 - DNA, 35 bp, Artificial Sequence
  Synthetic oligonucleotide
ggggctcgcggaactatcgtctgtcttttcttctt

SEQ ID NO: 74621 - DNA, 35 bp, Artificial Sequence
  Synthetic oligonucleotide
acacaacctaggcacgttcagaacaggctaaagtt

SEQ ID NO: 74622 - DNA, 35 bp, Artificial Sequence
  Synthetic oligonucleotide
gcaacgaccaggtctgtccaattcgtgtggttttt

SEQ ID NO: 74623 - DNA, 35 bp, Artificial Sequence
  Synthetic oligonucleotide
gaccggagctgactagcacaactttcaattcgaaa

SEQ ID NO: 74624 - DNA, 36 bp, Artificial Sequence
  Synthetic oligonucleotide
tcagtgagatgtcccaataacgccctcctttaacaa

SEQ ID NO: 74625 - DNA, 36 bp, Artificial Sequence
  Synthetic oligonucleotide
gagcgtaggctccgggcaattcgcgttccaccccaa

SEQ ID NO: 74626 - DNA, 36 bp, Artificial Sequence
  Synthetic oligonucleotide
atgcgaccgttctatgttaaccgatcacctactcaa

SEQ ID NO: 74627 - DNA, 35 bp, Artificial Sequence
  Synthetic oligonucleotide
tgttccgcctgaaatcgctaactagtcctgcagaa

SEQ ID NO: 74628 - DNA, 35 bp, Artificial Sequence
  Synthetic oligonucleotide
tactaacaccattgccctggcctcgcattagagaa

SEQ ID NO: 74629 - DNA, 35 bp, Artificial Sequence
  Synthetic oligonucleotide
actcatcttgcatcctacctctctcgtgtggggaa

SEQ ID NO: 74630 - DNA, 36 bp, Artificial Sequence
  Synthetic oligonucleotide
acacgacaggctatcggtctccacctctgtcactaa

SEQ ID NO: 74631 - DNA, 35 bp, Artificial Sequence
  Synthetic oligonucleotide
gtccctctcacgacatgcctctccatttgttctaa

SEQ ID NO: 74632 - DNA, 36 bp, Artificial Sequence
  Synthetic oligonucleotide
tcatggaggccttagctttgaccacttcctacgcca

SEQ ID NO: 74633 - DNA, 33 bp, Artificial Sequence
  Synthetic oligonucleotide
gtcacgttgtagcgcttcctctctcttgtggca

SEQ ID NO: 74634 - DNA, 35 bp, Artificial Sequence
  Synthetic oligonucleotide
tgcggggagggtaccataggttggcggaagaatca

SEQ ID NO: 74635 - DNA, 35 bp, Artificial Sequence
  Synthetic oligonucleotide
gagccctctaaatacgttacgcgaatgtcccatca

SEQ ID NO: 74636 - DNA, 35 bp, Artificial Sequence
  Synthetic oligonucleotide
gaacaacgtactgtcagcgtccggaaccgacctca

SEQ ID NO: 74637 - DNA, 36 bp, Artificial Sequence
  Synthetic oligonucleotide
gacacggcctgattggacatcgtcttccttctctca

SEQ ID NO: 74638 - DNA, 36 bp, Artificial Sequence
  Synthetic oligonucleotide
gcgcccaccgaccacggggccttccgacgtttctca

SEQ ID NO: 74639 - DNA, 36 bp, Artificial Sequence
  Synthetic oligonucleotide
tagcgagcgacgggttggatggaaaggggggcgaga

SEQ ID NO: 74640 - DNA, 37 bp, Artificial Sequence
  Synthetic oligonucleotide
acgaacgtccatgacgtgagttaccaattctctgaga

SEQ ID NO: 74641 - DNA, 36 bp, Artificial Sequence
  Synthetic oligonucleotide
ggtcaaacttacctgccgcattgggacaaaactaga

SEQ ID NO: 74642 - DNA, 37 bp, Artificial Sequence
  Synthetic oligonucleotide
taccggaaagacggggtggggcaggaaggagagtaga

SEQ ID NO: 74643 - DNA, 37 bp, Artificial Sequence
  Synthetic oligonucleotide
atgggaagagtggaaaaaacaaaaagggtcgacacga

SEQ ID NO: 74644 - DNA, 37 bp, Artificial Sequence
  Synthetic oligonucleotide
cacactctcgttgacttttttttggatccgctcccga

SEQ ID NO: 74645 - DNA, 37 bp, Artificial Sequence
  Synthetic oligonucleotide
aaccgcagggttacacatcttccaccaccttggccga

SEQ ID NO: 74646 - DNA, 37 bp, Artificial Sequence
  Synthetic oligonucleotide
atccaggccacatccgtaactctaacggctctgccga

SEQ ID NO: 74647 - DNA, 37 bp, Artificial Sequence
  Synthetic oligonucleotide
cacgactcagcccagcccgtaccatcgttgactccga

SEQ ID NO: 74648 - DNA, 37 bp, Artificial Sequence
  Synthetic oligonucleotide
gatcaacccgatgctgggactgcttaattcccctcga

SEQ ID NO: 74649 - DNA, 37 bp, Artificial Sequence
  Synthetic oligonucleotide
gaaacgcagatcggtaaggtggcatgggcgtaaagga

SEQ ID NO: 74650 - DNA, 37 bp, Artificial Sequence
  Synthetic oligonucleotide
atgtactgaggtaggaagtaatggggtaacgggagga

SEQ ID NO: 74651 - DNA, 37 bp, Artificial Sequence
  Synthetic oligonucleotide
tcaccactcatccctgtttagacccacaccgggagga

SEQ ID NO: 74652 - DNA, 37 bp, Artificial Sequence
  Synthetic oligonucleotide
gcgagaggtggtacaatgtaggatggggctcagggga

SEQ ID NO: 74653 - DNA, 37 bp, Artificial Sequence
  Synthetic oligonucleotide
tccatgagagggaaagggatggtcgtgggtacctgga

SEQ ID NO: 74654 - DNA, 37 bp, Artificial Sequence
  Synthetic oligonucleotide
aatagggtgttggcatagggggactgcggggggtgga

SEQ ID NO: 74655 - DNA, 38 bp, Artificial Sequence
  Synthetic oligonucleotide
aatgcacccacacctgaagtattcggacaggggaatga

SEQ ID NO: 74656 - DNA, 37 bp, Artificial Sequence
  Synthetic oligonucleotide
tacatcggtgccctaatgtttgctaccccatccatga

SEQ ID NO: 74657 - DNA, 37 bp, Artificial Sequence
  Synthetic oligonucleotide
accaccaccacgggaaaccacagtcactcgttcatga

SEQ ID NO: 74658 - DNA, 38 bp, Artificial Sequence
  Synthetic oligonucleotide
ttaggaggctcacacgctgccgatcgaaccccctatga

SEQ ID NO: 74659 - DNA, 38 bp, Artificial Sequence
  Synthetic oligonucleotide
tacgcggagggctaagggcatagggggaagtcgtatga

SEQ ID NO: 74660 - DNA, 38 bp, Artificial Sequence
  Synthetic oligonucleotide
tagggcgaccaaggagattgtgtgtgaaaggggtatga

SEQ ID NO: 74661 - DNA, 37 bp, Artificial Sequence
  Synthetic oligonucleotide
tgcacttgtactcgctatccgacgcatttggaactga

SEQ ID NO: 74662 - DNA, 38 bp, Artificial Sequence
  Synthetic oligonucleotide
accattccctcactccttgattctaggagacagactga

SEQ ID NO: 74663 - DNA, 37 bp, Artificial Sequence
  Synthetic oligonucleotide
gggtggccaactgcagattttgtcctatttgtactga

SEQ ID NO: 74664 - DNA, 38 bp, Artificial Sequence
  Synthetic oligonucleotide
tcacaagcggaaaaagggctcaacccaacactacctga

SEQ ID NO: 74665 - DNA, 36 bp, Artificial Sequence
  Synthetic oligonucleotide
gtcatgagagcgtccctgtttgcaattgttccctga

SEQ ID NO: 74666 - DNA, 38 bp, Artificial Sequence
  Synthetic oligonucleotide
atcaacccgcccgattatagccgtacctttgatcctga

SEQ ID NO: 74667 - DNA, 38 bp, Artificial Sequence
  Synthetic oligonucleotide
gacatgtcaggggtgagggcaaggggaaagacggctga

SEQ ID NO: 74668 - DNA, 37 bp, Artificial Sequence
  Synthetic oligonucleotide
tctagcacagcttcgtatcacgccattacttatctga

SEQ ID NO: 74669 - DNA, 38 bp, Artificial Sequence
  Synthetic oligonucleotide
tttgtcctccagccgcactcgttccttcaacactctga

SEQ ID NO: 74670 - DNA, 38 bp, Artificial Sequence
  Synthetic oligonucleotide
ggactaggtagtgaggttaaggtgtgggggctacgtga

SEQ ID NO: 74671 - DNA, 38 bp, Artificial Sequence
  Synthetic oligonucleotide
ggatacgccatatcattactcctgtacactcgccgtga

SEQ ID NO: 74672 - DNA, 38 bp, Artificial Sequence
  Synthetic oligonucleotide
acaatcgcgaaggggaacagggaaggttttgcgattga

SEQ ID NO: 74673 - DNA, 38 bp, Artificial Sequence
  Synthetic oligonucleotide
ttatggtggatggtaggatggagtggagcgtgtattga

SEQ ID NO: 74674 - DNA, 37 bp, Artificial Sequence
  Synthetic oligonucleotide
tccctaccgcattgcccatcggaccgtgcctccttga

SEQ ID NO: 74675 - DNA, 38 bp, Artificial Sequence
  Synthetic oligonucleotide
gccactccacctccaagctgctgacctcgttacgttga

SEQ ID NO: 74676 - DNA, 38 bp, Artificial Sequence
  Synthetic oligonucleotide
tcatatggggcgaggaggggggagtaggtacaatttga

SEQ ID NO: 74677 - DNA, 37 bp, Artificial Sequence
  Synthetic oligonucleotide
gcatgcctcgcgtatggccatctgtcccatcatttga

SEQ ID NO: 74678 - DNA, 36 bp, Artificial Sequence
  Synthetic oligonucleotide
tgcttagcgtgcctttccccctcggtcactatgcta

SEQ ID NO: 74679 - DNA, 35 bp, Artificial Sequence
  Synthetic oligonucleotide
gcgtactgatcactctctatctcgggcccctgcta

SEQ ID NO: 74680 - DNA, 35 bp, Artificial Sequence
  Synthetic oligonucleotide
ggtgcaccactctcggtagcccaccccatgttcta

SEQ ID NO: 74681 - DNA, 36 bp, Artificial Sequence
  Synthetic oligonucleotide
gatacccattccccgtcacggttttaacactccgta

SEQ ID NO: 74682 - DNA, 36 bp, Artificial Sequence
  Synthetic oligonucleotide
gccgaacgaacaatgcttgtgtcaccgccatttgta

SEQ ID NO: 74683 - DNA, 36 bp, Artificial Sequence
  Synthetic oligonucleotide
attcgggagggaggggttcgctatggggaaccatta

SEQ ID NO: 74684 - DNA, 36 bp, Artificial Sequence
  Synthetic oligonucleotide
acttgtccactgtgcatcctgtttcggcttctatta

SEQ ID NO: 74685 - DNA, 35 bp, Artificial Sequence
  Synthetic oligonucleotide
gcacgcatttgtcgccccatccctctcaacgtgac

SEQ ID NO: 74686 - DNA, 35 bp, Artificial Sequence
  Synthetic oligonucleotide
gttggcgcagcaactaagctcaatcacttctcccc

SEQ ID NO: 74687 - DNA, 35 bp, Artificial Sequence
  Synthetic oligonucleotide
gctggcttatagtgtatgcttacccgtctttcccc

SEQ ID NO: 74688 - DNA, 35 bp, Artificial Sequence
  Synthetic oligonucleotide
accactgtgcacctatacggttggcttcacttgcc

SEQ ID NO: 74689 - DNA, 35 bp, Artificial Sequence
  Synthetic oligonucleotide
gcacctgcctctgcttccgtccccggtcaatgtcc

SEQ ID NO: 74690 - DNA, 35 bp, Artificial Sequence
  Synthetic oligonucleotide
atccgcgctttaccgatcctgtggtttcatcttcc

SEQ ID NO: 74691 - DNA, 35 bp, Artificial Sequence
  Synthetic oligonucleotide
gcaacaaccactagcgtacctaacagcgcacccgc

SEQ ID NO: 74692 - DNA, 35 bp, Artificial Sequence
  Synthetic oligonucleotide
aatgggtgccaccgccgtaccgagacctttttcgc

SEQ ID NO: 74693 - DNA, 35 bp, Artificial Sequence
  Synthetic oligonucleotide
gcaatgtggctctgactttccaaccgccttttggc

SEQ ID NO: 74694 - DNA, 35 bp, Artificial Sequence
  Synthetic oligonucleotide
gcggtatccaacaacgccatgcaccaccttcatgc

SEQ ID NO: 74695 - DNA, 35 bp, Artificial Sequence
  Synthetic oligonucleotide
tcttcgggccggccctctcgctgttgcccccgtgc

SEQ ID NO: 74696 - DNA, 35 bp, Artificial Sequence
  Synthetic oligonucleotide
tatctaccagcgcgatcacttgcttactgcgcatc

SEQ ID NO: 74697 - DNA, 35 bp, Artificial Sequence
  Synthetic oligonucleotide
tgtctcccacgacggcttagtgccattacaacctc
